United States Patent 7,655,785 (BIOINFORMATICALLY DETECTABLE GROUP OF NOVEL REGULATORY OLIGONUCLEOTIDES AND USES THEREOF) - sequence listing, part 8

SEQ ID NO: 282050 - RNA, 22 nt, Homo sapiens
aagauaguaaacauuuucugcu

SEQ ID NO: 282051 - RNA, 22 nt, Homo sapiens
aagaugcagucauacuggagga

SEQ ID NO: 282052 - RNA, 22 nt, Homo sapiens
aagcaaacaucagcuugguuaa

SEQ ID NO: 282053 - RNA, 22 nt, Homo sapiens
aagcaacacaucugccccgguu

SEQ ID NO: 282054 - RNA, 22 nt, Homo sapiens
aagcacccuuugucuggacaug

SEQ ID NO: 282055 - RNA, 20 nt, Homo sapiens
aagcagacauuuggaugaaa

SEQ ID NO: 282056 - RNA, 22 nt, Homo sapiens
aagcaggugucugugucuguaa

SEQ ID NO: 282057 - RNA, 22 nt, Homo sapiens
aagcuacuuuggugguuccuua

SEQ ID NO: 282058 - RNA, 20 nt, Homo sapiens
aagcugaguguuuuuuuaau

SEQ ID NO: 282059 - RNA, 22 nt, Homo sapiens
aagcuggagugcaguggugcga

SEQ ID NO: 282060 - RNA, 22 nt, Homo sapiens
aagcugguguguauuauucacu

SEQ ID NO: 282061 - RNA, 22 nt, Homo sapiens
aagcugugucuugucagcuacc

SEQ ID NO: 282062 - RNA, 22 nt, Homo sapiens
aagcuguguguaagcucucaca

SEQ ID NO: 282063 - RNA, 22 nt, Homo sapiens
aagcuguugguggaucuaccau

SEQ ID NO: 282064 - RNA, 22 nt, Homo sapiens
aagcuguugguggauguaccau

SEQ ID NO: 282065 - RNA, 22 nt, Homo sapiens
aaggaguguggugaucuugggc

SEQ ID NO: 282066 - RNA, 22 nt, Homo sapiens
aaggcaugcaguacguuucuau

SEQ ID NO: 282067 - RNA, 20 nt, Homo sapiens
aaggcuuucgaguuccaggg

SEQ ID NO: 282068 - RNA, 22 nt, Homo sapiens
aagggaaugcgcugccuguguu

SEQ ID NO: 282069 - RNA, 22 nt, Homo sapiens
aagggaauguuguggcugguug

SEQ ID NO: 282070 - RNA, 22 nt, Homo sapiens
aagguauuuuugucuauaucuu

SEQ ID NO: 282071 - RNA, 18 nt, Homo sapiens
aaggugcuucuguucuga

SEQ ID NO: 282072 - RNA, 22 nt, Homo sapiens
aagguucuugcuugcaugacug

SEQ ID NO: 282073 - RNA, 22 nt, Homo sapiens
aaguaaacauuuuguacaauaa

SEQ ID NO: 282074 - RNA, 22 nt, Homo sapiens
aaguagcagaggcaagacuuga

SEQ ID NO: 282075 - RNA, 22 nt, Homo sapiens
aaguauagcuaugauaaacauu

SEQ ID NO: 282076 - RNA, 22 nt, Homo sapiens
aagucaguuugggagaagcuau

SEQ ID NO: 282077 - RNA, 23 nt, Homo sapiens
aagugagcuccaauugggugaga

SEQ ID NO: 282078 - RNA, 20 nt, Homo sapiens
aagugaguguuaaacugaac

SEQ ID NO: 282079 - RNA, 22 nt, Homo sapiens
aagugcacuguaagugcaggau

SEQ ID NO: 282080 - RNA, 22 nt, Homo sapiens
aagugcuuuguacagggguuga

SEQ ID NO: 282081 - RNA, 17 nt, Homo sapiens
aaguggcuuguucacca

SEQ ID NO: 282082 - RNA, 22 nt, Homo sapiens
aagugguguuuguauuuaugca

SEQ ID NO: 282083 - RNA, 22 nt, Homo sapiens
aaguugcuuuagguaagucaau

SEQ ID NO: 282084 - RNA, 22 nt, Homo sapiens
aaguuguuggaguuccauuguu

SEQ ID NO: 282085 - RNA, 22 nt, Homo sapiens
aauaaagcaggguccuugcacu

SEQ ID NO: 282086 - RNA, 22 nt, Homo sapiens
aauaaagcugaauccuuccuga

SEQ ID NO: 282087 - RNA, 22 nt, Homo sapiens
aauaagcugagagaauucuaca

SEQ ID NO: 282088 - RNA, 22 nt, Homo sapiens
aauacucaguccuggugaggcu

SEQ ID NO: 282089 - RNA, 22 nt, Homo sapiens
aauacugagaugugagguacua

SEQ ID NO: 282090 - RNA, 22 nt, Homo sapiens
aauagcuguccuuagaagugug

SEQ ID NO: 282091 - RNA, 22 nt, Homo sapiens
aauaguggcuuggacuaaauau

SEQ ID NO: 282092 - RNA, 22 nt, Homo sapiens
aauaucacaguuggguguacac

SEQ ID NO: 282093 - RNA, 22 nt, Homo sapiens
aauauguccuugaaauggugcu

SEQ ID NO: 282094 - RNA, 22 nt, Homo sapiens
aauauugucaaaauggauucca

SEQ ID NO: 282095 - RNA, 22 nt, Homo sapiens
aaucacaggucuuggcugcaug

SEQ ID NO: 282096 - RNA, 21 nt, Homo sapiens
aaucacaguuguucugccuuc

SEQ ID NO: 282097 - RNA, 22 nt, Homo sapiens
aaucacauuaaugcucccucag

SEQ ID NO: 282098 - RNA, 17 nt, Homo sapiens
aaucagauuucugagga

SEQ ID NO: 282099 - RNA, 22 nt, Homo sapiens
aaucauauugucugccaagagg

SEQ ID NO: 282100 - RNA, 22 nt, Homo sapiens
aaucccuuuguccagucucuuu

SEQ ID NO: 282101 - RNA, 22 nt, Homo sapiens
aaucgcuuuugguaggcaagga

SEQ ID NO: 282102 - RNA, 22 nt, Homo sapiens
aaucucagagauaucugugucc

SEQ ID NO: 282103 - RNA, 22 nt, Homo sapiens
aaucugucaguuuuguguuaau

SEQ ID NO: 282104 - RNA, 22 nt, Homo sapiens
aaugacugugauauuuuucuuc

SEQ ID NO: 282105 - RNA, 22 nt, Homo sapiens
aaugaucaauguuugaggugau

SEQ ID NO: 282106 - RNA, 22 nt, Homo sapiens
aaugcacuccagccugggcgac

SEQ ID NO: 282107 - RNA, 22 nt, Homo sapiens
aauggagcugaguggccuuggg

SEQ ID NO: 282108 - RNA, 22 nt, Homo sapiens
aauggcacacaccuggucuaac

SEQ ID NO: 282109 - RNA, 22 nt, Homo sapiens
aauggccuuuuucauuauacug

SEQ ID NO: 282110 - RNA, 22 nt, Homo sapiens
aauggcuauuucaugugguagg

SEQ ID NO: 282111 - RNA, 18 nt, Homo sapiens
aauggcucuggguucuaa

SEQ ID NO: 282112 - RNA, 22 nt, Homo sapiens
aauggcuuucagcuuuucccca

SEQ ID NO: 282113 - RNA, 22 nt, Homo sapiens
aauguguuuugaaaucaggaag

SEQ ID NO: 282114 - RNA, 22 nt, Homo sapiens
aauuacucgugucuuuacugcu

SEQ ID NO: 282115 - RNA, 22 nt, Homo sapiens
aauuaguuggcugccuaugauu

SEQ ID NO: 282116 - RNA, 22 nt, Homo sapiens
aauugcaauggacaaugcagca

SEQ ID NO: 282117 - RNA, 22 nt, Homo sapiens
aggcacggugucucaugccugu

SEQ ID NO: 282118 - RNA, 22 nt, Homo sapiens
aggcaugaguucagaggguaug

SEQ ID NO: 282119 - RNA, 23 nt, Homo sapiens
aggcauuguacaguaauggaaaa

SEQ ID NO: 282120 - RNA, 19 nt, Homo sapiens
aggcauugugcucaucugu

SEQ ID NO: 282121 - RNA, 22 nt, Homo sapiens
aggccaguuuuuggagggaaac

SEQ ID NO: 282122 - RNA, 22 nt, Homo sapiens
aggcuagaaucuuccaucuugg

SEQ ID NO: 282123 - RNA, 21 nt, Homo sapiens
aggcuguuguuuugggaugga

SEQ ID NO: 282124 - RNA, 22 nt, Homo sapiens
aggcuuuuggagaacacugcac

SEQ ID NO: 282125 - RNA, 22 nt, Homo sapiens
agggaauguaaguuuuaugaga

SEQ ID NO: 282126 - RNA, 22 nt, Homo sapiens
agggcauuguacaaaucaucau

SEQ ID NO: 282127 - RNA, 22 nt, Homo sapiens
agggcuuguuuaacuaucauua

SEQ ID NO: 282128 - RNA, 22 nt, Homo sapiens
agguaagaugugacuugguguu

SEQ ID NO: 282129 - RNA, 22 nt, Homo sapiens
agguaauuuucccagagggaaa

SEQ ID NO: 282130 - RNA, 22 nt, Homo sapiens
agguacuuucccaaccauacug

SEQ ID NO: 282131 - RNA, 22 nt, Homo sapiens
agguagucuuuuccuauuguca

SEQ ID NO: 282132 - RNA, 22 nt, Homo sapiens
agguauuuuuuauccuccagca

SEQ ID NO: 282133 - RNA, 21 nt, Homo sapiens
aggucaguaagaaugcagcac

SEQ ID NO: 282134 - RNA, 22 nt, Homo sapiens
agguccacuuacuacuccuguu

SEQ ID NO: 282135 - RNA, 22 nt, Homo sapiens
aggugacugguuuaucuggcag

SEQ ID NO: 282136 - RNA, 22 nt, Homo sapiens
aggugcuaucugguuuuauagu

SEQ ID NO: 282137 - RNA, 22 nt, Homo sapiens
aggugcugacaggauagguuuc

SEQ ID NO: 282138 - RNA, 22 nt, Homo sapiens
aggugcugagcagagaauccug

SEQ ID NO: 282139 - RNA, 22 nt, Homo sapiens
aggugguuuugaugagcaggua

SEQ ID NO: 282140 - RNA, 22 nt, Homo sapiens
aguaaacuucagaguucuuccu

SEQ ID NO: 282141 - RNA, 22 nt, Homo sapiens
aguaaauuucugugcuuucaua

SEQ ID NO: 282142 - RNA, 22 nt, Homo sapiens
aguaagauggcaacucuccaca

SEQ ID NO: 282143 - RNA, 22 nt, Homo sapiens
aguaaucaucugagggcagaaa

SEQ ID NO: 282144 - RNA, 23 nt, Homo sapiens
aguacuguaguaauugaggggaa

SEQ ID NO: 282145 - RNA, 22 nt, Homo sapiens
aguaucaagccacacaugguca

SEQ ID NO: 282146 - RNA, 22 nt, Homo sapiens
aguaucacaagguguacaccca

SEQ ID NO: 282147 - RNA, 22 nt, Homo sapiens
aguaucacaggcaaaacagaau

SEQ ID NO: 282148 - RNA, 20 nt, Homo sapiens
aguauucacuuuuuucaugg

SEQ ID NO: 282149 - RNA, 22 nt, Homo sapiens
aguauuuguuggaauaccuguu

SEQ ID NO: 282150 - RNA, 22 nt, Homo sapiens
agucacagguucuugggauuag

SEQ ID NO: 282151 - RNA, 22 nt, Homo sapiens
agugaaaucugaagaaggucau

SEQ ID NO: 282152 - RNA, 22 nt, Homo sapiens
agugaacaaagaagugcagaua

SEQ ID NO: 282153 - RNA, 22 nt, Homo sapiens
agugaucauuugaauugaugau

SEQ ID NO: 282154 - RNA, 22 nt, Homo sapiens
agugauggagccaggauuuaau

SEQ ID NO: 282155 - RNA, 22 nt, Homo sapiens
agugcaauggugccaucauagc

SEQ ID NO: 282156 - RNA, 22 nt, Homo sapiens
agugcagugguuaggagccagg

SEQ ID NO: 282157 - RNA, 22 nt, Homo sapiens
aguggcaaugugauguccugaa

SEQ ID NO: 282158 - RNA, 22 nt, Homo sapiens
aguggcacuauucucagaguca

SEQ ID NO: 282159 - RNA, 22 nt, Homo sapiens
aguguuuuuacaagcacucugg

SEQ ID NO: 282160 - RNA, 22 nt, Homo sapiens
aguuggccccuacugggaggug

SEQ ID NO: 282161 - RNA, 22 nt, Homo sapiens
auaaaagcaggucuaggucagg

SEQ ID NO: 282162 - RNA, 22 nt, Homo sapiens
auaaagcaagucucuggccuca

SEQ ID NO: 282163 - RNA, 22 nt, Homo sapiens
auaaagccaggagacguaauug

SEQ ID NO: 282164 - RNA, 22 nt, Homo sapiens
auaaagcuauuccucucuuuuu

SEQ ID NO: 282165 - RNA, 22 nt, Homo sapiens
auaaagguaauaauaguugcau

SEQ ID NO: 282166 - RNA, 22 nt, Homo sapiens
auaaauaguaguugugguggcc

SEQ ID NO: 282167 - RNA, 22 nt, Homo sapiens
auaaaugcaaugguauuuuuga

SEQ ID NO: 282168 - RNA, 22 nt, Homo sapiens
auaaaugcuuagaucuguauau

SEQ ID NO: 282169 - RNA, 22 nt, Homo sapiens
auaagaagugaaccagacgucu

SEQ ID NO: 282170 - RNA, 22 nt, Homo sapiens
auaagaugaaggaagccauauc

SEQ ID NO: 282171 - RNA, 22 nt, Homo sapiens
auaaggaguaucauauuaaaac

SEQ ID NO: 282172 - RNA, 22 nt, Homo sapiens
auaaggcuaaggacuugaguua

SEQ ID NO: 282173 - RNA, 22 nt, Homo sapiens
auaauaccugccacauuugaau

SEQ ID NO: 282174 - RNA, 22 nt, Homo sapiens
auaauacugggaagaugagcau

SEQ ID NO: 282175 - RNA, 22 nt, Homo sapiens
auaauagguaguaauggauuga

SEQ ID NO: 282176 - RNA, 22 nt, Homo sapiens
auaaucaugucugaaaccuuug

SEQ ID NO: 282177 - RNA, 19 nt, Homo sapiens
auaauuagcagugaggaca

SEQ ID NO: 282178 - RNA, 22 nt, Homo sapiens
auacaagcaguccaacuccaua

SEQ ID NO: 282179 - RNA, 22 nt, Homo sapiens
auacaagugccauguuggugug

SEQ ID NO: 282180 - RNA, 22 nt, Homo sapiens
auacaguaucuucuggcaagca

SEQ ID NO: 282181 - RNA, 22 nt, Homo sapiens
auacaguauggagggcccagcu

SEQ ID NO: 282182 - RNA, 22 nt, Homo sapiens
auacaugugccaugcuggugug

SEQ ID NO: 282183 - RNA, 22 nt, Homo sapiens
auacauguucaagggcauauau

SEQ ID NO: 282184 - RNA, 22 nt, Homo sapiens
auacauguuucauguuggugug

SEQ ID NO: 282185 - RNA, 22 nt, Homo sapiens
auaccuuguagugcuauuugau

SEQ ID NO: 282186 - RNA, 22 nt, Homo sapiens
auacuguauaggauuguagccu

SEQ ID NO: 282187 - RNA, 21 nt, Homo sapiens
auacuugagacuggguaauuu

SEQ ID NO: 282188 - RNA, 22 nt, Homo sapiens
auagaagcugccaacguuucag

SEQ ID NO: 282189 - RNA, 22 nt, Homo sapiens
aucuuugauugaagggacccug

SEQ ID NO: 282190 - RNA, 22 nt, Homo sapiens
augaaacuggcuaauuuuugua

SEQ ID NO: 282191 - RNA, 22 nt, Homo sapiens
augaaagguugucuuaagccau

SEQ ID NO: 282192 - RNA, 22 nt, Homo sapiens
augaacuaugugggauguuuua

SEQ ID NO: 282193 - RNA, 18 nt, Homo sapiens
augaacucaucauuuuuu

SEQ ID NO: 282194 - RNA, 22 nt, Homo sapiens
augaagauguugccuuuuuaau

SEQ ID NO: 282195 - RNA, 20 nt, Homo sapiens
augaaggcaggugugaguuu

SEQ ID NO: 282196 - RNA, 17 nt, Homo sapiens
augaagucaucauuuuu

SEQ ID NO: 282197 - RNA, 22 nt, Homo sapiens
augaaguguguguucaagucuu

SEQ ID NO: 282198 - RNA, 21 nt, Homo sapiens
augaauguaaagaauguggga

SEQ ID NO: 282199 - RNA, 20 nt, Homo sapiens
augaauguccuugauggcau

SEQ ID NO: 282200 - RNA, 22 nt, Homo sapiens
augacaagagccuucuuuccuu

SEQ ID NO: 282201 - RNA, 22 nt, Homo sapiens
augacaagaguguucagggaga

SEQ ID NO: 282202 - RNA, 23 nt, Homo sapiens
augacacuccugugcgcacccug

SEQ ID NO: 282203 - RNA, 22 nt, Homo sapiens
augacaguguggauuauuguaa

SEQ ID NO: 282204 - RNA, 22 nt, Homo sapiens
augacauguauuuccaggauuu

SEQ ID NO: 282205 - RNA, 22 nt, Homo sapiens
augacauugaugcucuggcugg

SEQ ID NO: 282206 - RNA, 22 nt, Homo sapiens
augacuauugcacuuuccuggu

SEQ ID NO: 282207 - RNA, 22 nt, Homo sapiens
augacuuuucugaaaaccacca

SEQ ID NO: 282208 - RNA, 22 nt, Homo sapiens
augagaacugucaaugagagcu

SEQ ID NO: 282209 - RNA, 22 nt, Homo sapiens
augagacuagaagagaauaaua

SEQ ID NO: 282210 - RNA, 22 nt, Homo sapiens
augagagcugacuuuaaggcaa

SEQ ID NO: 282211 - RNA, 22 nt, Homo sapiens
augagaugauaggcguucuaac

SEQ ID NO: 282212 - RNA, 21 nt, Homo sapiens
augagauguuagacuuuagac

SEQ ID NO: 282213 - RNA, 22 nt, Homo sapiens
augagcacuuguuuugggcaca

SEQ ID NO: 282214 - RNA, 22 nt, Homo sapiens
augagcagaugcuccugccucu

SEQ ID NO: 282215 - RNA, 22 nt, Homo sapiens
augagcaucaccagaaucaaua

SEQ ID NO: 282216 - RNA, 22 nt, Homo sapiens
augagcugauuuccuuaccaua

SEQ ID NO: 282217 - RNA, 22 nt, Homo sapiens
augagggcggacgcccuggaga

SEQ ID NO: 282218 - RNA, 22 nt, Homo sapiens
augaggugauuucuguucgggu

SEQ ID NO: 282219 - RNA, 22 nt, Homo sapiens
augaggugcagaggaaaugagu

SEQ ID NO: 282220 - RNA, 22 nt, Homo sapiens
augaggugggcggcuuggaaga

SEQ ID NO: 282221 - RNA, 22 nt, Homo sapiens
augagguguuuauuguauccug

SEQ ID NO: 282222 - RNA, 22 nt, Homo sapiens
augagucacuuauuauuggggu

SEQ ID NO: 282223 - RNA, 22 nt, Homo sapiens
augauauguuuguagcuaucuc

SEQ ID NO: 282224 - RNA, 22 nt, Homo sapiens
augaucacugugccuccuguga

SEQ ID NO: 282225 - RNA, 22 nt, Homo sapiens
augaucaucugaaagcuuuuac

SEQ ID NO: 282226 - RNA, 22 nt, Homo sapiens
augaugaaguaagugcuuagga

SEQ ID NO: 282227 - RNA, 22 nt, Homo sapiens
augauggaggccgugauggacg

SEQ ID NO: 282228 - RNA, 22 nt, Homo sapiens
augauuagaacucauuuccagg

SEQ ID NO: 282229 - RNA, 22 nt, Homo sapiens
augauugaccaucugcugggcu

SEQ ID NO: 282230 - RNA, 22 nt, Homo sapiens
augcaagcacacaagaggaaau

SEQ ID NO: 282231 - RNA, 22 nt, Homo sapiens
augcaauucuagauugauagua

SEQ ID NO: 282232 - RNA, 22 nt, Homo sapiens
augcacaguccagcccaugugg

SEQ ID NO: 282233 - RNA, 22 nt, Homo sapiens
augcacauggcuaacuuuuuuc

SEQ ID NO: 282234 - RNA, 22 nt, Homo sapiens
augcacuuggcaggaugauucc

SEQ ID NO: 282235 - RNA, 22 nt, Homo sapiens
augcagagaaaucuaaaauaug

SEQ ID NO: 282236 - RNA, 22 nt, Homo sapiens
augcauauuccugggccucacu

SEQ ID NO: 282237 - RNA, 19 nt, Homo sapiens
augccacagugaggucaga

SEQ ID NO: 282238 - RNA, 22 nt, Homo sapiens
augccacugcacuucagccugc

SEQ ID NO: 282239 - RNA, 22 nt, Homo sapiens
augccacuguacucuagccuag

SEQ ID NO: 282240 - RNA, 22 nt, Homo sapiens
augccauugcacuccagccuag

SEQ ID NO: 282241 - RNA, 22 nt, Homo sapiens
augcccauuuguuuucugaaag

SEQ ID NO: 282242 - RNA, 22 nt, Homo sapiens
augccucugacaauuggauucu

SEQ ID NO: 282243 - RNA, 22 nt, Homo sapiens
augcuacuggacaauggugacu

SEQ ID NO: 282244 - RNA, 22 nt, Homo sapiens
augcuacuggauuuguauaaau

SEQ ID NO: 282245 - RNA, 22 nt, Homo sapiens
augcuauguagaugagggccca

SEQ ID NO: 282246 - RNA, 22 nt, Homo sapiens
augcuuguguuggggcagugga

SEQ ID NO: 282247 - RNA, 22 nt, Homo sapiens
auggaaacauaagaguauagau

SEQ ID NO: 282248 - RNA, 22 nt, Homo sapiens
auggaagaaaguuggguucuug

SEQ ID NO: 282249 - RNA, 22 nt, Homo sapiens
auggaagacuccucuuugggua

SEQ ID NO: 282250 - RNA, 22 nt, Homo sapiens
auggaagcauaguauucuauug

SEQ ID NO: 282251 - RNA, 22 nt, Homo sapiens
auggaaggagaauggucuuuga

SEQ ID NO: 282252 - RNA, 22 nt, Homo sapiens
auggagguguggggagugaguu

SEQ ID NO: 282253 - RNA, 22 nt, Homo sapiens
auggaguguaauauugagagcu

SEQ ID NO: 282254 - RNA, 22 nt, Homo sapiens
auggaguguggaacugggaauc

SEQ ID NO: 282255 - RNA, 22 nt, Homo sapiens
auggaguguucugaauccuuug

SEQ ID NO: 282256 - RNA, 22 nt, Homo sapiens
auggcacuuuggacugcuagau

SEQ ID NO: 282257 - RNA, 22 nt, Homo sapiens
auggcagcugacacuuccgucu

SEQ ID NO: 282258 - RNA, 22 nt, Homo sapiens
auggcauggugaagucuuugga

SEQ ID NO: 282259 - RNA, 22 nt, Homo sapiens
auggcccugcuaccacuuuucu

SEQ ID NO: 282260 - RNA, 22 nt, Homo sapiens
auggccuuguauaccuggcaaa

SEQ ID NO: 282261 - RNA, 22 nt, Homo sapiens
auggccuuuacaauuugguaug

SEQ ID NO: 282262 - RNA, 20 nt, Homo sapiens
gugugcauuucagauuuugg

SEQ ID NO: 282263 - RNA, 22 nt, Homo sapiens
gugugcucaucacaugcaauag

SEQ ID NO: 282264 - RNA, 21 nt, Homo sapiens
gugugcuugagugaugggauu

SEQ ID NO: 282265 - RNA, 22 nt, Homo sapiens
guguggcaggugggggcucaga

SEQ ID NO: 282266 - RNA, 22 nt, Homo sapiens
gugugucuugaccaggaucgga

SEQ ID NO: 282267 - RNA, 20 nt, Homo sapiens
guuaaggcagcauuacucuu

SEQ ID NO: 282268 - RNA, 22 nt, Homo sapiens
guuacagucuuguguaagguua

SEQ ID NO: 282269 - RNA, 22 nt, Homo sapiens
guuaugcagcaauugauaaucu

SEQ ID NO: 282270 - RNA, 22 nt, Homo sapiens
guuauguuaguuacaaggcuag

SEQ ID NO: 282271 - RNA, 22 nt, Homo sapiens
guuauuguccauuuauuuagca

SEQ ID NO: 282272 - RNA, 22 nt, Homo sapiens
guucaagugauagcugggauua

SEQ ID NO: 282273 - RNA, 21 nt, Homo sapiens
guucaagugauccuccugucu

SEQ ID NO: 282274 - RNA, 22 nt, Homo sapiens
guucacagugguugccuuccag

SEQ ID NO: 282275 - RNA, 22 nt, Homo sapiens
guucacaguuaggacaacugcu

SEQ ID NO: 282276 - RNA, 22 nt, Homo sapiens
guucagcaggggcuucaauggu

SEQ ID NO: 282277 - RNA, 22 nt, Homo sapiens
guucagguauucuggaacagag

SEQ ID NO: 282278 - RNA, 22 nt, Homo sapiens
guucaucagggauacuggccuu

SEQ ID NO: 282279 - RNA, 20 nt, Homo sapiens
guucauguaauuaguucagg

SEQ ID NO: 282280 - RNA, 22 nt, Homo sapiens
guucccaguugaaaugauuagu

SEQ ID NO: 282281 - RNA, 22 nt, Homo sapiens
guucucacuggugcugguaagu

SEQ ID NO: 282282 - RNA, 20 nt, Homo sapiens
guucuugcucguguaucuuc

SEQ ID NO: 282283 - RNA, 22 nt, Homo sapiens
guugagcaagcuuuggagccua

SEQ ID NO: 282284 - RNA, 18 nt, Homo sapiens
guugagcuuuuccuuuag

SEQ ID NO: 282285 - RNA, 22 nt, Homo sapiens
guugaggcaggagaauuacuug

SEQ ID NO: 282286 - RNA, 22 nt, Homo sapiens
guugcucaggcugaagugcagu

SEQ ID NO: 282287 - RNA, 22 nt, Homo sapiens
guuggaauguauugcuacuucu

SEQ ID NO: 282288 - RNA, 22 nt, Homo sapiens
guugguuuccuguaacuggaca

SEQ ID NO: 282289 - RNA, 22 nt, Homo sapiens
guuugcagaucaugaagaaccc

SEQ ID NO: 282290 - RNA, 22 nt, Homo sapiens
guuugcauagugcugggagggg

SEQ ID NO: 282291 - RNA, 22 nt, Homo sapiens
guuugccuuuuagauaggaaug

SEQ ID NO: 282292 - RNA, 22 nt, Homo sapiens
guuuggcuuucucucuauccug

SEQ ID NO: 282293 - RNA, 22 nt, Homo sapiens
guuugugguuaaagccuuucau

SEQ ID NO: 282294 - RNA, 15 nt, Homo sapiens
guuuuuggauacaau

SEQ ID NO: 282295 - RNA, 22 nt, Homo sapiens
uaaagaugcugggaaggcuagg

SEQ ID NO: 282296 - RNA, 22 nt, Homo sapiens
uaaagcacaaguaaagaauacu

SEQ ID NO: 282297 - RNA, 22 nt, Homo sapiens
uaaagcauguaauuagguuaga

SEQ ID NO: 282298 - RNA, 22 nt, Homo sapiens
uaaagccuagaacuuucagccc

SEQ ID NO: 282299 - RNA, 22 nt, Homo sapiens
uaaagcuacaguauaugguauu

SEQ ID NO: 282300 - RNA, 22 nt, Homo sapiens
uaaagcuagagcuggaguggca

SEQ ID NO: 282301 - RNA, 22 nt, Homo sapiens
uaaagcuaugagaacaccguag

SEQ ID NO: 282302 - RNA, 22 nt, Homo sapiens
uaaagcugaaaugauuaugaca

SEQ ID NO: 282303 - RNA, 21 nt, Homo sapiens
uaaagcuuagcuauaguggcu

SEQ ID NO: 282304 - RNA, 18 nt, Homo sapiens
uaaaggcacuguguuguu

SEQ ID NO: 282305 - RNA, 22 nt, Homo sapiens
uaaagugaggauggcaguaggu

SEQ ID NO: 282306 - RNA, 22 nt, Homo sapiens
uaaagugcugagaugaggcugg

SEQ ID NO: 282307 - RNA, 22 nt, Homo sapiens
uaaaguuauugccccucaguua

SEQ ID NO: 282308 - RNA, 22 nt, Homo sapiens
uaacauagucauauacuugcuu

SEQ ID NO: 282309 - RNA, 23 nt, Homo sapiens
uaacauugcaugauuaccugcau

SEQ ID NO: 282310 - RNA, 22 nt, Homo sapiens
uaacuaguggaauuugauuuca

SEQ ID NO: 282311 - RNA, 22 nt, Homo sapiens
uaacugcaaccucugccugcug

SEQ ID NO: 282312 - RNA, 18 nt, Homo sapiens
uaacuggugugagauggu

SEQ ID NO: 282313 - RNA, 18 nt, Homo sapiens
uaacugugggaacuaacu

SEQ ID NO: 282314 - RNA, 23 nt, Homo sapiens
uaagacacuaacuuuaugcuuug

SEQ ID NO: 282315 - RNA, 21 nt, Homo sapiens
uaagacugccaguagggcugu

SEQ ID NO: 282316 - RNA, 22 nt, Homo sapiens
uaagacugccccagacagcaag

SEQ ID NO: 282317 - RNA, 22 nt, Homo sapiens
uaagagagcuccaucuuuuccu

SEQ ID NO: 282318 - RNA, 22 nt, Homo sapiens
uaagagcuaggauuuuaaauca

SEQ ID NO: 282319 - RNA, 19 nt, Homo sapiens
uaagaugaagcugucuggg

SEQ ID NO: 282320 - RNA, 22 nt, Homo sapiens
uaaggaaggcugugugcuuuua

SEQ ID NO: 282321 - RNA, 22 nt, Homo sapiens
uaaggcacuacuuuaggcuuuc

SEQ ID NO: 282322 - RNA, 22 nt, Homo sapiens
uaaggcacucuucugugugccu

SEQ ID NO: 282323 - RNA, 22 nt, Homo sapiens
uaaggcuaggaauucucugaag

SEQ ID NO: 282324 - RNA, 22 nt, Homo sapiens
uaaggcuucuuggaauacugca

SEQ ID NO: 282325 - RNA, 22 nt, Homo sapiens
uaaggcuugcuucagucuugaa

SEQ ID NO: 282326 - RNA, 22 nt, Homo sapiens
uaagggcaugcugcaugagagu

SEQ ID NO: 282327 - RNA, 22 nt, Homo sapiens
uaagguccuuaaauguguaacc

SEQ ID NO: 282328 - RNA, 22 nt, Homo sapiens
uaaguauuaugugcugcauuuu

SEQ ID NO: 282329 - RNA, 20 nt, Homo sapiens
uaagugcuugagacuucuga

SEQ ID NO: 282330 - RNA, 20 nt, Homo sapiens
uaagugcuugaugaaugaac

SEQ ID NO: 282331 - RNA, 22 nt, Homo sapiens
uaagugguguucauucuuuuga

SEQ ID NO: 282332 - RNA, 22 nt, Homo sapiens
uaaguucauucaugaaacuuag

SEQ ID NO: 282333 - RNA, 22 nt, Homo sapiens
uaaguugcagguugugauucca

SEQ ID NO: 282334 - RNA, 22 nt, Homo sapiens
uaauacuugucauaaaggcauu

SEQ ID NO: 282335 - RNA, 22 nt, Homo sapiens
uagcagccaggaagggcuggcu

SEQ ID NO: 282336 - RNA, 20 nt, Homo sapiens
uagcaggugucaggugauau

SEQ ID NO: 282337 - RNA, 22 nt, Homo sapiens
uagcagucaagauagucauuau

SEQ ID NO: 282338 - RNA, 22 nt, Homo sapiens
uagccucacaaagugcuuaaga

SEQ ID NO: 282339 - RNA, 21 nt, Homo sapiens
uagcuacacugugauucaugg

SEQ ID NO: 282340 - RNA, 21 nt, Homo sapiens
uagcucagugguguugccaua

SEQ ID NO: 282341 - RNA, 22 nt, Homo sapiens
uagcugcccagcacgaaguugg

SEQ ID NO: 282342 - RNA, 22 nt, Homo sapiens
uagcuggaauuacuugcaccug

SEQ ID NO: 282343 - RNA, 18 nt, Homo sapiens
uaggaacauugauuggag

SEQ ID NO: 282344 - RNA, 22 nt, Homo sapiens
uaggaaguuuucuugcugggcc

SEQ ID NO: 282345 - RNA, 22 nt, Homo sapiens
uaggaaugaacgauuuauuggu

SEQ ID NO: 282346 - RNA, 22 nt, Homo sapiens
uaggacacaggacauauguaga

SEQ ID NO: 282347 - RNA, 22 nt, Homo sapiens
uaggagugugaacccuguuuug

SEQ ID NO: 282348 - RNA, 22 nt, Homo sapiens
uaggcagccagcuguggauuga

SEQ ID NO: 282349 - RNA, 22 nt, Homo sapiens
uaggcauuuuucugauaaacua

SEQ ID NO: 282350 - RNA, 21 nt, Homo sapiens
uaggccgggugcaggaugcuu

SEQ ID NO: 282351 - RNA, 22 nt, Homo sapiens
uagggcuuuuccaagcugccac

SEQ ID NO: 282352 - RNA, 22 nt, Homo sapiens
uaggggcacacuucgguuagca

SEQ ID NO: 282353 - RNA, 19 nt, Homo sapiens
uagguacauucaagucucc

SEQ ID NO: 282354 - RNA, 22 nt, Homo sapiens
uagguuaucucaaguguaauuu

SEQ ID NO: 282355 - RNA, 22 nt, Homo sapiens
uaguagcaccucucaugagcuu

SEQ ID NO: 282356 - RNA, 22 nt, Homo sapiens
uaguaucacaagguguacaccc

SEQ ID NO: 282357 - RNA, 22 nt, Homo sapiens
uagucccauaugauuuagugaa

SEQ ID NO: 282358 - RNA, 22 nt, Homo sapiens
uaguguuuuucauuggcagagg

SEQ ID NO: 282359 - RNA, 22 nt, Homo sapiens
uaguugcauucaggauaugacg

SEQ ID NO: 282360 - RNA, 20 nt, Homo sapiens
uauagcaauuuuuuucuccu

SEQ ID NO: 282361 - RNA, 22 nt, Homo sapiens
uauagcagccugaacaaaguaa

SEQ ID NO: 282362 - RNA, 22 nt, Homo sapiens
uauagcagugaguauugacuaa

SEQ ID NO: 282363 - RNA, 22 nt, Homo sapiens
uauauagcuaugucuguccauu

SEQ ID NO: 282364 - RNA, 22 nt, Homo sapiens
uauaugucugagacugggggau

SEQ ID NO: 282365 - RNA, 22 nt, Homo sapiens
uaucaaggccacucauuuuaug

SEQ ID NO: 282366 - RNA, 23 nt, Homo sapiens
uaucacacuuucucugugccaca

SEQ ID NO: 282367 - RNA, 22 nt, Homo sapiens
uaucacagcgggguguacaccc

SEQ ID NO: 282368 - RNA, 20 nt, Homo sapiens
uaucacaggucagaaacccu

SEQ ID NO: 282369 - RNA, 20 nt, Homo sapiens
uaucacauggggagaaaccu

SEQ ID NO: 282370 - RNA, 21 nt, Homo sapiens
uaucacauuggugauuaaguu

SEQ ID NO: 282371 - RNA, 22 nt, Homo sapiens
uaucagaguuacacugaagacu

SEQ ID NO: 282372 - RNA, 22 nt, Homo sapiens
uaucaucauuggcaggugagaa

SEQ ID NO: 282373 - RNA, 22 nt, Homo sapiens
uaucaugucuguguguaccuag

SEQ ID NO: 282374 - RNA, 22 nt, Homo sapiens
uaucauugccucaaucuguauu

SEQ ID NO: 282375 - RNA, 22 nt, Homo sapiens
uaucccuguggacuucccaaca

SEQ ID NO: 282376 - RNA, 22 nt, Homo sapiens
uauccugaagcuuuauuuaagu

SEQ ID NO: 282377 - RNA, 22 nt, Homo sapiens
uaucucacauauucaguagguu

SEQ ID NO: 282378 - RNA, 20 nt, Homo sapiens
uaucucaguuuguccuaaac

SEQ ID NO: 282379 - RNA, 22 nt, Homo sapiens
uaucucuguggguagugcugaa

SEQ ID NO: 282380 - RNA, 22 nt, Homo sapiens
uaucucuuuucauguguaaaug

SEQ ID NO: 282381 - RNA, 22 nt, Homo sapiens
uaugaaucugagagaucuggaa

SEQ ID NO: 282382 - RNA, 20 nt, Homo sapiens
uaugacaaagccuagugagu

SEQ ID NO: 282383 - RNA, 22 nt, Homo sapiens
uaugccuuugaccauuuuguga

SEQ ID NO: 282384 - RNA, 22 nt, Homo sapiens
uaugccuuuugguucaagcaac

SEQ ID NO: 282385 - RNA, 22 nt, Homo sapiens
uauggaaaucuuaccuuauggu

SEQ ID NO: 282386 - RNA, 22 nt, Homo sapiens
uauggauuugccuauucuguau

SEQ ID NO: 282387 - RNA, 22 nt, Homo sapiens
uauggcaaugcauaggaaggaa

SEQ ID NO: 282388 - RNA, 22 nt, Homo sapiens
uauggcacuaguacuggaaagc

SEQ ID NO: 282389 - RNA, 22 nt, Homo sapiens
uauggcauuguuggugaugaua

SEQ ID NO: 282390 - RNA, 22 nt, Homo sapiens
uauggcuacuacgaauaaugcu

SEQ ID NO: 282391 - RNA, 22 nt, Homo sapiens
uauggcuauggcuguggcuaug

SEQ ID NO: 282392 - RNA, 22 nt, Homo sapiens
uauggcuucuauaaggaagcuu

SEQ ID NO: 282393 - RNA, 22 nt, Homo sapiens
uauggcuucuuauucuuucccg

SEQ ID NO: 282394 - RNA, 22 nt, Homo sapiens
uaugguuuucucuuacguguug

SEQ ID NO: 282395 - RNA, 17 nt, Homo sapiens
uauguaguacuuauaaa

SEQ ID NO: 282396 - RNA, 22 nt, Homo sapiens
uaugugcacaugcccuggugac

SEQ ID NO: 282397 - RNA, 20 nt, Homo sapiens
uauuacagaguaauggugga

SEQ ID NO: 282398 - RNA, 22 nt, Homo sapiens
uauuagguuggugcaacaguaa

SEQ ID NO: 282399 - RNA, 22 nt, Homo sapiens
uauuagguugguggaaaaguaa

SEQ ID NO: 282400 - RNA, 22 nt, Homo sapiens
uauuaugcacuuuauaaaaauu

SEQ ID NO: 282401 - RNA, 22 nt, Homo sapiens
uauucacuguaucauugauggg

SEQ ID NO: 282402 - RNA, 22 nt, Homo sapiens
uauuccacaauaugauuuuuaa

SEQ ID NO: 282403 - RNA, 22 nt, Homo sapiens
uauuccauuugggucaggauga

SEQ ID NO: 282404 - RNA, 22 nt, Homo sapiens
uauuccuuuugcauuuccacau

SEQ ID NO: 282405 - RNA, 22 nt, Homo sapiens
uauugacauuacagugggucuu

SEQ ID NO: 282406 - RNA, 22 nt, Homo sapiens
uauugcaauuggcagagugcua

SEQ ID NO: 282407 - RNA, 22 nt, Homo sapiens
uauugcaauuggggaaacuggg

SEQ ID NO: 282408 - RNA, 20 nt, Homo sapiens
ucauacuguggaguaccagg

SEQ ID NO: 282409 - RNA, 22 nt, Homo sapiens
ucauagaucaaguaauaagaca

SEQ ID NO: 282410 - RNA, 16 nt, Homo sapiens
ucauaguaucucuucu

SEQ ID NO: 282411 - RNA, 22 nt, Homo sapiens
ucauaugucauaguaugaucuu

SEQ ID NO: 282412 - RNA, 22 nt, Homo sapiens
ucauauugcgguucauugacuu

SEQ ID NO: 282413 - RNA, 22 nt, Homo sapiens
ucaucaggcucauucaagcuga

SEQ ID NO: 282414 - RNA, 22 nt, Homo sapiens
ucaucaguggggaugugguuga

SEQ ID NO: 282415 - RNA, 23 nt, Homo sapiens
ucaugaggccauucaaauccauu

SEQ ID NO: 282416 - RNA, 22 nt, Homo sapiens
ucauggcacugaugagaguuuc

SEQ ID NO: 282417 - RNA, 19 nt, Homo sapiens
ucauggcuuuuucagcugu

SEQ ID NO: 282418 - RNA, 22 nt, Homo sapiens
ucauggggugagcuacaggcac

SEQ ID NO: 282419 - RNA, 22 nt, Homo sapiens
ucauuagagacagggugucacu

SEQ ID NO: 282420 - RNA, 22 nt, Homo sapiens
ucauucauuugcucacuccaca

SEQ ID NO: 282421 - RNA, 22 nt, Homo sapiens
ucauugguugcguaauuugauu

SEQ ID NO: 282422 - RNA, 21 nt, Homo sapiens
ucauugguuggcugcccugua

SEQ ID NO: 282423 - RNA, 22 nt, Homo sapiens
uccacaauggcugaacuagauu

SEQ ID NO: 282424 - RNA, 22 nt, Homo sapiens
uccacaguggugaggugcagca

SEQ ID NO: 282425 - RNA, 19 nt, Homo sapiens
uccaccgcgugcaccucua

SEQ ID NO: 282426 - RNA, 22 nt, Homo sapiens
uccagugcauucagacacuugg

SEQ ID NO: 282427 - RNA, 22 nt, Homo sapiens
uccaguguuauaauaugcgucu

SEQ ID NO: 282428 - RNA, 22 nt, Homo sapiens
uccaguuuggaggcuugaugug

SEQ ID NO: 282429 - RNA, 22 nt, Homo sapiens
uccauaguacuagaaacugacc

SEQ ID NO: 282430 - RNA, 22 nt, Homo sapiens
uccauaguugcacucuggagcc

SEQ ID NO: 282431 - RNA, 22 nt, Homo sapiens
uccaugagaauaguuaggcucu

SEQ ID NO: 282432 - RNA, 22 nt, Homo sapiens
uccauguagaagacaggggaga

SEQ ID NO: 282433 - RNA, 18 nt, Homo sapiens
uccauuuguaugggaugg

SEQ ID NO: 282434 - RNA, 22 nt, Homo sapiens
ucccagugaaaccccaccuuca

SEQ ID NO: 282435 - RNA, 22 nt, Homo sapiens
ucccaguggucuugaaacaggg

SEQ ID NO: 282436 - RNA, 17 nt, Homo sapiens
ucccauguuucuucuac

SEQ ID NO: 282437 - RNA, 22 nt, Homo sapiens
uccccugagaacuugcuagaaa

SEQ ID NO: 282438 - RNA, 22 nt, Homo sapiens
ucccugaaaauuagcauuuuaa

SEQ ID NO: 282439 - RNA, 19 nt, Homo sapiens
ucccuguagaccacagugc

SEQ ID NO: 282440 - RNA, 17 nt, Homo sapiens
ucccuguuuuuucaguc

SEQ ID NO: 282441 - RNA, 22 nt, Homo sapiens
ucccuuagccaaauccccagcc

SEQ ID NO: 282442 - RNA, 22 nt, Homo sapiens
ucccuuucuggaguuucccaag

SEQ ID NO: 282443 - RNA, 19 nt, Homo sapiens
ucccuuuguauggacauac

SEQ ID NO: 282444 - RNA, 22 nt, Homo sapiens
uccuacugucuucggggcacug

SEQ ID NO: 282445 - RNA, 22 nt, Homo sapiens
uccugagacugaggagcuuugg

SEQ ID NO: 282446 - RNA, 22 nt, Homo sapiens
uccugauacgguugcaguucuc

SEQ ID NO: 282447 - RNA, 21 nt, Homo sapiens
uccuuggugaugcccugcagu

SEQ ID NO: 282448 - RNA, 22 nt, Homo sapiens
uccuugguugauccugugcaga

SEQ ID NO: 282449 - RNA, 22 nt, Homo sapiens
uccuuuaguuaauaaagacaag

SEQ ID NO: 282450 - RNA, 22 nt, Homo sapiens
uccuuugguucuugucacccca

SEQ ID NO: 282451 - RNA, 22 nt, Homo sapiens
uccuuuguuacaguuggcucug

SEQ ID NO: 282452 - RNA, 22 nt, Homo sapiens
ucggcucagugcaagcucugcc

SEQ ID NO: 282453 - RNA, 22 nt, Homo sapiens
ucuaaaacuagauugugaugau

SEQ ID NO: 282454 - RNA, 22 nt, Homo sapiens
ucuaaugcucugagaacagugc

SEQ ID NO: 282455 - RNA, 22 nt, Homo sapiens
ucucaaguaacugggacaauaa

SEQ ID NO: 282456 - RNA, 22 nt, Homo sapiens
ucucaauggguuguagacaaag

SEQ ID NO: 282457 - RNA, 22 nt, Homo sapiens
ucucaauuugauuacauucaua

SEQ ID NO: 282458 - RNA, 18 nt, Homo sapiens
ucucacagcaaucuguca

SEQ ID NO: 282459 - RNA, 22 nt, Homo sapiens
ucucacauuucacagggauggg

SEQ ID NO: 282460 - RNA, 22 nt, Homo sapiens
ucucagagccuaggguuuuuca

SEQ ID NO: 282461 - RNA, 22 nt, Homo sapiens
ucucagugaaauaaauuauuuu

SEQ ID NO: 282462 - RNA, 22 nt, Homo sapiens
ucucagugacugcugggucccc

SEQ ID NO: 282463 - RNA, 22 nt, Homo sapiens
ucucauagaggcagagaguaaa

SEQ ID NO: 282464 - RNA, 22 nt, Homo sapiens
ucucauggagucaggagcagaa

SEQ ID NO: 282465 - RNA, 20 nt, Homo sapiens
ucucccaaacagcaggcccu

SEQ ID NO: 282466 - RNA, 22 nt, Homo sapiens
ucucccuaccugagccgagcca

SEQ ID NO: 282467 - RNA, 22 nt, Homo sapiens
ucucuugguugaacaguuugga

SEQ ID NO: 282468 - RNA, 22 nt, Homo sapiens
ucugacuagacaagcaguguac

SEQ ID NO: 282469 - RNA, 22 nt, Homo sapiens
ucugagaugagacuuugaauuu

SEQ ID NO: 282470 - RNA, 22 nt, Homo sapiens
ucugauggaguugccagggaga

SEQ ID NO: 282471 - RNA, 22 nt, Homo sapiens
ucugccacugucauugugugau

SEQ ID NO: 282472 - RNA, 22 nt, Homo sapiens
ucuggccccucucaaaucucau

SEQ ID NO: 282473 - RNA, 22 nt, Homo sapiens
ucuggccuacaaguaauuuuau

SEQ ID NO: 282474 - RNA, 22 nt, Homo sapiens
ucuggccuagaacaauuaauua

SEQ ID NO: 282475 - RNA, 22 nt, Homo sapiens
ucuggccuccuaugagaaucga

SEQ ID NO: 282476 - RNA, 17 nt, Homo sapiens
ucuggcuuucacaccug

SEQ ID NO: 282477 - RNA, 22 nt, Homo sapiens
ucuggcuuugugaguugccaga

SEQ ID NO: 282478 - RNA, 22 nt, Homo sapiens
ucuggcuuuuaacaucuauaaa

SEQ ID NO: 282479 - RNA, 22 nt, Homo sapiens
ucugggguuagucaaagguaug

SEQ ID NO: 282480 - RNA, 20 nt, Homo sapiens
ucuggguuuuggccacgccc

SEQ ID NO: 282481 - RNA, 22 nt, Homo sapiens
ugacagugugagauccugucuc

SEQ ID NO: 282482 - RNA, 22 nt, Homo sapiens
ugacaucaccaccuccgucauc

SEQ ID NO: 282483 - RNA, 20 nt, Homo sapiens
ugacaucagcaauguaauaa

SEQ ID NO: 282484 - RNA, 22 nt, Homo sapiens
ugacaugaugagcaauaauggc

SEQ ID NO: 282485 - RNA, 22 nt, Homo sapiens
ugacauggagagagaagccuuu

SEQ ID NO: 282486 - RNA, 22 nt, Homo sapiens
ugacauggugcucuuucaggca

SEQ ID NO: 282487 - RNA, 22 nt, Homo sapiens
ugacauguauuagcucagugcu

SEQ ID NO: 282488 - RNA, 21 nt, Homo sapiens
ugacauguuggugugcugcac

SEQ ID NO: 282489 - RNA, 22 nt, Homo sapiens
ugaccacagaaagugagggagc

SEQ ID NO: 282490 - RNA, 17 nt, Homo sapiens
ugaccacugauucuacu

SEQ ID NO: 282491 - RNA, 22 nt, Homo sapiens
ugacuacaccacacgguuaagg

SEQ ID NO: 282492 - RNA, 22 nt, Homo sapiens
ugacuagagacagaaacuaaaa

SEQ ID NO: 282493 - RNA, 22 nt, Homo sapiens
ugacuauugauuuagacgugcu

SEQ ID NO: 282494 - RNA, 22 nt, Homo sapiens
ugacucaagagccugacucauc

SEQ ID NO: 282495 - RNA, 22 nt, Homo sapiens
ugacucgaggcgccuccagucc

SEQ ID NO: 282496 - RNA, 22 nt, Homo sapiens
ugacucuagagcugccuguggc

SEQ ID NO: 282497 - RNA, 18 nt, Homo sapiens
ugacuguccagguggacc

SEQ ID NO: 282498 - RNA, 22 nt, Homo sapiens
ugacugucuagauagagcuugg

SEQ ID NO: 282499 - RNA, 22 nt, Homo sapiens
ugacugugcagcuccaucaggg

SEQ ID NO: 282500 - RNA, 22 nt, Homo sapiens
ugacuucagacugaaaugauuc

SEQ ID NO: 282501 - RNA, 22 nt, Homo sapiens
ugacuugaguaacuggcucagg

SEQ ID NO: 282502 - RNA, 21 nt, Homo sapiens
ugagaacaacaggucaagcag

SEQ ID NO: 282503 - RNA, 22 nt, Homo sapiens
ugagaacaugugauauuuggug

SEQ ID NO: 282504 - RNA, 19 nt, Homo sapiens
ugagaacaugugguauuug

SEQ ID NO: 282505 - RNA, 18 nt, Homo sapiens
ugagaacauguguacaca

SEQ ID NO: 282506 - RNA, 22 nt, Homo sapiens
ugagaaccucugugugcccacu

SEQ ID NO: 282507 - RNA, 22 nt, Homo sapiens
ugagaagacaucuuugcuuugu

SEQ ID NO: 282508 - RNA, 22 nt, Homo sapiens
ugagaagaugaacuccuugguc

SEQ ID NO: 282509 - RNA, 22 nt, Homo sapiens
ugagacaaaguuguuggauguu

SEQ ID NO: 282510 - RNA, 23 nt, Homo sapiens
ugagacauuggaaaguuaggcag

SEQ ID NO: 282511 - RNA, 22 nt, Homo sapiens
ugagacgaagucuugcucuguu

SEQ ID NO: 282512 - RNA, 22 nt, Homo sapiens
ugagacggagucucgcucucua

SEQ ID NO: 282513 - RNA, 22 nt, Homo sapiens
ugagacggagucuggcacuguc

SEQ ID NO: 282514 - RNA, 22 nt, Homo sapiens
ugagacggagucuugcccuguc

SEQ ID NO: 282515 - RNA, 22 nt, Homo sapiens
ugagacugagucucgcucuugu

SEQ ID NO: 282516 - RNA, 22 nt, Homo sapiens
ugagacugagucuugcucuauu

SEQ ID NO: 282517 - RNA, 22 nt, Homo sapiens
ugagacugaguuuugcucuugu

SEQ ID NO: 282518 - RNA, 22 nt, Homo sapiens
ugagacugguuaauugauaaag

SEQ ID NO: 282519 - RNA, 22 nt, Homo sapiens
ugagagacauuuguuguagagu

SEQ ID NO: 282520 - RNA, 22 nt, Homo sapiens
ugagaggugauaaagcaagggu

SEQ ID NO: 282521 - RNA, 22 nt, Homo sapiens
ugagaguauaaauugaugcagc

SEQ ID NO: 282522 - RNA, 22 nt, Homo sapiens
ugagagucacugaccugguaua

SEQ ID NO: 282523 - RNA, 22 nt, Homo sapiens
ugagauauauauauuugagaca

SEQ ID NO: 282524 - RNA, 22 nt, Homo sapiens
ugagaucaaggugggcccuggg

SEQ ID NO: 282525 - RNA, 22 nt, Homo sapiens
ugagaucacgccacugcacucc

SEQ ID NO: 282526 - RNA, 22 nt, Homo sapiens
ugagaucagaaggauuucucug

SEQ ID NO: 282527 - RNA, 22 nt, Homo sapiens
ugagaugaagucucacucuguc

SEQ ID NO: 282528 - RNA, 22 nt, Homo sapiens
ugagaugaggucucacucuguu

SEQ ID NO: 282529 - RNA, 22 nt, Homo sapiens
ugagaugaggucucgcucuguc

SEQ ID NO: 282530 - RNA, 22 nt, Homo sapiens
ugagaugauaucuuauuguaau

SEQ ID NO: 282531 - RNA, 22 nt, Homo sapiens
ugagaugcuuguaaauucauuu

SEQ ID NO: 282532 - RNA, 22 nt, Homo sapiens
ugagauggcuuuauugcugaau

SEQ ID NO: 282533 - RNA, 22 nt, Homo sapiens
ugagauguagauauggauuaga

SEQ ID NO: 282534 - RNA, 22 nt, Homo sapiens
ugagaugugaagaucacaugaa

SEQ ID NO: 282535 - RNA, 22 nt, Homo sapiens
ugagauguguccagaucuaguu

SEQ ID NO: 282536 - RNA, 22 nt, Homo sapiens
ugagauguuccaaugacuauua

SEQ ID NO: 282537 - RNA, 22 nt, Homo sapiens
ugagauguugcucugaaacaag

SEQ ID NO: 282538 - RNA, 23 nt, Homo sapiens
ugagcaauauucuacuauugagu

SEQ ID NO: 282539 - RNA, 22 nt, Homo sapiens
ugagcacagagccugggguggc

SEQ ID NO: 282540 - RNA, 22 nt, Homo sapiens
ugagcagagaucacggcauugu

SEQ ID NO: 282541 - RNA, 22 nt, Homo sapiens
ugagcagagggagaaguaaauu

SEQ ID NO: 282542 - RNA, 20 nt, Homo sapiens
ugagccccuggacucaagcg

SEQ ID NO: 282543 - RNA, 22 nt, Homo sapiens
ugagcuaggucuugcucuguca

SEQ ID NO: 282544 - RNA, 22 nt, Homo sapiens
ugagcucaugcauucuugagga

SEQ ID NO: 282545 - RNA, 22 nt, Homo sapiens
ugagcugagaaaugcagcagcu

SEQ ID NO: 282546 - RNA, 22 nt, Homo sapiens
ugagcugguacuaauauuauca

SEQ ID NO: 282547 - RNA, 20 nt, Homo sapiens
ugagcuuguaaacacuguuu

SEQ ID NO: 282548 - RNA, 22 nt, Homo sapiens
ugaggaaugaccccgugugguc

SEQ ID NO: 282549 - RNA, 22 nt, Homo sapiens
ugaggacugagaggcacugugg

SEQ ID NO: 282550 - RNA, 22 nt, Homo sapiens
ugaggaguauguucuguagacc

SEQ ID NO: 282551 - RNA, 20 nt, Homo sapiens
ugaggucaggaguuacagac

SEQ ID NO: 282552 - RNA, 21 nt, Homo sapiens
ugaggucaugaugcugcuucc

SEQ ID NO: 282553 - RNA, 22 nt, Homo sapiens
ugagguuauuuguucaagaagu

SEQ ID NO: 282554 - RNA, 22 nt, Homo sapiens
ugcugcacuuauggcucugagg

SEQ ID NO: 282555 - RNA, 22 nt, Homo sapiens
ugcugguggucccauaugauua

SEQ ID NO: 282556 - RNA, 22 nt, Homo sapiens
ugcugguguggucuagccgcuu

SEQ ID NO: 282557 - RNA, 22 nt, Homo sapiens
ugcuguuguuugaugaaguaau

SEQ ID NO: 282558 - RNA, 21 nt, Homo sapiens
ugcuuuggucauacuucuucc

SEQ ID NO: 282559 - RNA, 22 nt, Homo sapiens
uggaaaacaugcacauuggauu

SEQ ID NO: 282560 - RNA, 22 nt, Homo sapiens
uggaaaauuaggggagguuaua

SEQ ID NO: 282561 - RNA, 22 nt, Homo sapiens
uggaaauaaaauagaguuugcc

SEQ ID NO: 282562 - RNA, 22 nt, Homo sapiens
uggaaauuaagucuuuccugag

SEQ ID NO: 282563 - RNA, 22 nt, Homo sapiens
uggaagauggaguuuuaucauu

SEQ ID NO: 282564 - RNA, 22 nt, Homo sapiens
uggaagaugggaccucaguuuu

SEQ ID NO: 282565 - RNA, 22 nt, Homo sapiens
uggaagccuagauucuuuucuu

SEQ ID NO: 282566 - RNA, 20 nt, Homo sapiens
uggaagccuggugcuaucuu

SEQ ID NO: 282567 - RNA, 22 nt, Homo sapiens
uggaaggucauuguucauuuga

SEQ ID NO: 282568 - RNA, 22 nt, Homo sapiens
uggaagucuauggcauuugagu

SEQ ID NO: 282569 - RNA, 22 nt, Homo sapiens
uggaagugucugugcccagcuc

SEQ ID NO: 282570 - RNA, 22 nt, Homo sapiens
uggaaguuaaauuaguugauga

SEQ ID NO: 282571 - RNA, 21 nt, Homo sapiens
uggaaugaauggccaacaugg

SEQ ID NO: 282572 - RNA, 22 nt, Homo sapiens
uggaaugcuaagcaugugggag

SEQ ID NO: 282573 - RNA, 19 nt, Homo sapiens
uggaauggauuuaaaugug

SEQ ID NO: 282574 - RNA, 22 nt, Homo sapiens
uggaaugguuggugugauuuua

SEQ ID NO: 282575 - RNA, 22 nt, Homo sapiens
uggaaugucagcuacaagaggg

SEQ ID NO: 282576 - RNA, 18 nt, Homo sapiens
uggaauguuuggguuaau

SEQ ID NO: 282577 - RNA, 21 nt, Homo sapiens
uggaauuaauggagagguguu

SEQ ID NO: 282578 - RNA, 22 nt, Homo sapiens
uggacauguacauauguguaug

SEQ ID NO: 282579 - RNA, 20 nt, Homo sapiens
uggaccagagagguggggac

SEQ ID NO: 282580 - RNA, 21 nt, Homo sapiens
uggaccccuacuucucaccau

SEQ ID NO: 282581 - RNA, 22 nt, Homo sapiens
uggacuagagggugggcgaggu

SEQ ID NO: 282582 - RNA, 22 nt, Homo sapiens
uggacuuuaauaaaagggaaau

SEQ ID NO: 282583 - RNA, 22 nt, Homo sapiens
uggagagcaaaaucaauccaaa

SEQ ID NO: 282584 - RNA, 22 nt, Homo sapiens
uggagagcaaagaauuuguuag

SEQ ID NO: 282585 - RNA, 22 nt, Homo sapiens
uggagauguuuaaaauccacug

SEQ ID NO: 282586 - RNA, 22 nt, Homo sapiens
uggaguauuauguaauuucaau

SEQ ID NO: 282587 - RNA, 22 nt, Homo sapiens
uggagucuugcucuguugccca

SEQ ID NO: 282588 - RNA, 21 nt, Homo sapiens
uggagugaagaguuuauugac

SEQ ID NO: 282589 - RNA, 22 nt, Homo sapiens
uggauaguaauaaacauauagg

SEQ ID NO: 282590 - RNA, 18 nt, Homo sapiens
uggauaguuguuggcaga

SEQ ID NO: 282591 - RNA, 22 nt, Homo sapiens
uggauccaucacgccucuuccc

SEQ ID NO: 282592 - RNA, 22 nt, Homo sapiens
uggcaaaaaucacaaguaccuu

SEQ ID NO: 282593 - RNA, 22 nt, Homo sapiens
uggcaaaucagaggcauggaca

SEQ ID NO: 282594 - RNA, 22 nt, Homo sapiens
uggcaagaaccacaauuacuuu

SEQ ID NO: 282595 - RNA, 22 nt, Homo sapiens
uggcaagaagagcaugagacca

SEQ ID NO: 282596 - RNA, 22 nt, Homo sapiens
uggcaagagcaaaauguacagu

SEQ ID NO: 282597 - RNA, 22 nt, Homo sapiens
uggcaagagggaugcaagguuu

SEQ ID NO: 282598 - RNA, 20 nt, Homo sapiens
uggcaagauggcagaauaga

SEQ ID NO: 282599 - RNA, 22 nt, Homo sapiens
uggcaagauuguuccgguuugg

SEQ ID NO: 282600 - RNA, 22 nt, Homo sapiens
uggcaccugacuccgagaugca

SEQ ID NO: 282601 - RNA, 19 nt, Homo sapiens
uggcacuugacguccggau

SEQ ID NO: 282602 - RNA, 22 nt, Homo sapiens
uggcaggugcacuggcuuugaa

SEQ ID NO: 282603 - RNA, 22 nt, Homo sapiens
uggcaguuucacauggcucaac

SEQ ID NO: 282604 - RNA, 22 nt, Homo sapiens
uggcauggucugcccaaguuuc

SEQ ID NO: 282605 - RNA, 22 nt, Homo sapiens
uggcauguauuuuguguauuaa

SEQ ID NO: 282606 - RNA, 23 nt, Homo sapiens
uggcauuuuuggcaaugccuucu

SEQ ID NO: 282607 - RNA, 18 nt, Homo sapiens
uggccaauggcaaacaga

SEQ ID NO: 282608 - RNA, 22 nt, Homo sapiens
uggccagugucggaggccagga

SEQ ID NO: 282609 - RNA, 22 nt, Homo sapiens
uggccagugucuauugguuucc

SEQ ID NO: 282610 - RNA, 22 nt, Homo sapiens
uggccaguguuuuuccugggcu

SEQ ID NO: 282611 - RNA, 22 nt, Homo sapiens
uggcuaaguuaaucaaggagau

SEQ ID NO: 282612 - RNA, 23 nt, Homo sapiens
uggcuagacguccuuuccugaug

SEQ ID NO: 282613 - RNA, 22 nt, Homo sapiens
uggcuagauauccagaguucug

SEQ ID NO: 282614 - RNA, 22 nt, Homo sapiens
uggcuguguccucucccaaauc

SEQ ID NO: 282615 - RNA, 22 nt, Homo sapiens
uggcuguuguuacuaacaguuc

SEQ ID NO: 282616 - RNA, 22 nt, Homo sapiens
uggcuguuuauuucaccugggu

SEQ ID NO: 282617 - RNA, 21 nt, Homo sapiens
uggcuuauuugaaucuggcuu

SEQ ID NO: 282618 - RNA, 20 nt, Homo sapiens
uggcuucuuaauugcaggca

SEQ ID NO: 282619 - RNA, 22 nt, Homo sapiens
uggcuuuguaagguuucauuuu

SEQ ID NO: 282620 - RNA, 22 nt, Homo sapiens
ugggaaacauccagcacauacu

SEQ ID NO: 282621 - RNA, 20 nt, Homo sapiens
ugggaacaugugguauaugg

SEQ ID NO: 282622 - RNA, 22 nt, Homo sapiens
ugggaagagggagcgauuuugg

SEQ ID NO: 282623 - RNA, 22 nt, Homo sapiens
ugggaagcugcugaacuacagu

SEQ ID NO: 282624 - RNA, 19 nt, Homo sapiens
ugggaauguaaauuaguuc

SEQ ID NO: 282625 - RNA, 22 nt, Homo sapiens
ugggaccccuacucuuuccaca

SEQ ID NO: 282626 - RNA, 22 nt, Homo sapiens
ugggcaaauugugagggaggua

SEQ ID NO: 282627 - RNA, 22 nt, Homo sapiens
ugugguuuuauaaacgugaccu

SEQ ID NO: 282628 - RNA, 22 nt, Homo sapiens
ugugguuuuucacauuuagaga

SEQ ID NO: 282629 - RNA, 22 nt, Homo sapiens
uguguaaauaugauagaggaau

SEQ ID NO: 282630 - RNA, 22 nt, Homo sapiens
uguguaauaccuuugacuauau

SEQ ID NO: 282631 - RNA, 22 nt, Homo sapiens
uguguacaucucuacacacaug

SEQ ID NO: 282632 - RNA, 22 nt, Homo sapiens
ugugucuccugaaaauucacau

SEQ ID NO: 282633 - RNA, 22 nt, Homo sapiens
ugugucuugaauuuuguaugua

SEQ ID NO: 282634 - RNA, 22 nt, Homo sapiens
ugugucuuguuuuuucccaggc

SEQ ID NO: 282635 - RNA, 22 nt, Homo sapiens
uguguuugauaaguccauaguu

SEQ ID NO: 282636 - RNA, 21 nt, Homo sapiens
uguuaacaugcagauuacugg

SEQ ID NO: 282637 - RNA, 22 nt, Homo sapiens
uguuauguucuacuuuuaggug

SEQ ID NO: 282638 - RNA, 22 nt, Homo sapiens
uguucuugaguugggaguacaa

SEQ ID NO: 282639 - RNA, 22 nt, Homo sapiens
uguugcacuccagccuagguga

SEQ ID NO: 282640 - RNA, 22 nt, Homo sapiens
uguugcacuccagccugggcaa

SEQ ID NO: 282641 - RNA, 22 nt, Homo sapiens
uguuggacuuacuuggcagauu

SEQ ID NO: 282642 - RNA, 18 nt, Homo sapiens
uguugguguucacucacu

SEQ ID NO: 282643 - RNA, 19 nt, Homo sapiens
uguuuggcuauaggucuaa

SEQ ID NO: 282644 - RNA, 22 nt, Homo sapiens
uguuuguuugagauggagucuc

SEQ ID NO: 282645 - RNA, 22 nt, Homo sapiens
uuaaaaguauaggccuggcaua

SEQ ID NO: 282646 - RNA, 22 nt, Homo sapiens
uuaaagcuggcguuacaguuug

SEQ ID NO: 282647 - RNA, 22 nt, Homo sapiens
uuaaaugcauagaauguguagu

SEQ ID NO: 282648 - RNA, 22 nt, Homo sapiens
uuaaaugcuagaauuuucuuug

SEQ ID NO: 282649 - RNA, 22 nt, Homo sapiens
uuaaaugucuguagaugugcug

SEQ ID NO: 282650 - RNA, 21 nt, Homo sapiens
uuaacagacaagugucuuccc

SEQ ID NO: 282651 - RNA, 22 nt, Homo sapiens
uuaacaguugcaugagacugag

SEQ ID NO: 282652 - RNA, 22 nt, Homo sapiens
uuaagaagugauuuuccucauu

SEQ ID NO: 282653 - RNA, 22 nt, Homo sapiens
uuaagaucagugcaaacuggag

SEQ ID NO: 282654 - RNA, 22 nt, Homo sapiens
uuaaggaaggagucuuaaaugg

SEQ ID NO: 282655 - RNA, 22 nt, Homo sapiens
uuaaggcagugcaucuggaguu

SEQ ID NO: 282656 - RNA, 22 nt, Homo sapiens
uuaaggcagugucuaugccagu

SEQ ID NO: 282657 - RNA, 23 nt, Homo sapiens
uuaaggugaugucuuugugccuc

SEQ ID NO: 282658 - RNA, 22 nt, Homo sapiens
uuaaguagcugggcaugguggu

SEQ ID NO: 282659 - RNA, 22 nt, Homo sapiens
uuaagugcucaguuacucaguu

SEQ ID NO: 282660 - RNA, 22 nt, Homo sapiens
uuaauagcaaagaguuuagacu

SEQ ID NO: 282661 - RNA, 22 nt, Homo sapiens
uuaaucaggccguuuccuaaga

SEQ ID NO: 282662 - RNA, 22 nt, Homo sapiens
uuaauccugccuuauuucagua

SEQ ID NO: 282663 - RNA, 22 nt, Homo sapiens
uuaauguaauugauugauugac

SEQ ID NO: 282664 - RNA, 22 nt, Homo sapiens
uuaaugugaaucaggaugcauu

SEQ ID NO: 282665 - RNA, 22 nt, Homo sapiens
uuaauuguaucuauagauguca

SEQ ID NO: 282666 - RNA, 22 nt, Homo sapiens
uuaauuguccauuauucuguuc

SEQ ID NO: 282667 - RNA, 22 nt, Homo sapiens
uuacaagaugucuguccaacac

SEQ ID NO: 282668 - RNA, 21 nt, Homo sapiens
uuacaauggcuccuugaaggu

SEQ ID NO: 282669 - RNA, 22 nt, Homo sapiens
uuacagucaaguuacauuucuc

SEQ ID NO: 282670 - RNA, 22 nt, Homo sapiens
uuacagugguugcuauugugaa

SEQ ID NO: 282671 - RNA, 21 nt, Homo sapiens
uuacaguugguugugaggugg

SEQ ID NO: 282672 - RNA, 22 nt, Homo sapiens
uuacaguugugagccaccaugc

SEQ ID NO: 282673 - RNA, 22 nt, Homo sapiens
uuacauaguguguggguucggg

SEQ ID NO: 282674 - RNA, 20 nt, Homo sapiens
uuacuccuuaaugagguuuu

SEQ ID NO: 282675 - RNA, 22 nt, Homo sapiens
uuacuguagugucauaucguau

SEQ ID NO: 282676 - RNA, 22 nt, Homo sapiens
uuacuguauagaaucaucuuga

SEQ ID NO: 282677 - RNA, 22 nt, Homo sapiens
uuagagguaggauuucaccaug

SEQ ID NO: 282678 - RNA, 22 nt, Homo sapiens
uuagaguguagcaggaagaggc

SEQ ID NO: 282679 - RNA, 22 nt, Homo sapiens
uuagauuauugguguuuugcaa

SEQ ID NO: 282680 - RNA, 22 nt, Homo sapiens
uuagcacaguucauucauguua

SEQ ID NO: 282681 - RNA, 22 nt, Homo sapiens
uuagcacaucuuucuauguaag

SEQ ID NO: 282682 - RNA, 22 nt, Homo sapiens
uuagcacauuuccagcacaugg

SEQ ID NO: 282683 - RNA, 22 nt, Homo sapiens
uuagcagcaugagaauggacua

SEQ ID NO: 282684 - RNA, 20 nt, Homo sapiens
uuagcagcaugauuuauaau

SEQ ID NO: 282685 - RNA, 22 nt, Homo sapiens
uuagcaugucuacuaauuugcu

SEQ ID NO: 282686 - RNA, 22 nt, Homo sapiens
uuaggcaggauaguuacauauu

SEQ ID NO: 282687 - RNA, 22 nt, Homo sapiens
uuagggaggcucaggacaagag

SEQ ID NO: 282688 - RNA, 22 nt, Homo sapiens
uuagguaauauauugcugcuuu

SEQ ID NO: 282689 - RNA, 23 nt, Homo sapiens
uuaguaaacucaaugacaccaca

SEQ ID NO: 282690 - RNA, 22 nt, Homo sapiens
uuaguagcacagaguaucagca

SEQ ID NO: 282691 - RNA, 22 nt, Homo sapiens
uuagugaaugcaccacuucuga

SEQ ID NO: 282692 - RNA, 22 nt, Homo sapiens
uuagugcaaacucuucaaugcu

SEQ ID NO: 282693 - RNA, 21 nt, Homo sapiens
uuagugcucaguuugacaaaa

SEQ ID NO: 282694 - RNA, 22 nt, Homo sapiens
uuauacucgucugaaugauucu

SEQ ID NO: 282695 - RNA, 20 nt, Homo sapiens
uuauagcuacaucuugacug

SEQ ID NO: 282696 - RNA, 22 nt, Homo sapiens
uuauggauuuauauucuguagu

SEQ ID NO: 282697 - RNA, 22 nt, Homo sapiens
uuauggcuauugaugacaauug

SEQ ID NO: 282698 - RNA, 22 nt, Homo sapiens
uuauuagguuagugcaaaaguu

SEQ ID NO: 282699 - RNA, 22 nt, Homo sapiens
uuauugcucauuugggcauucu

SEQ ID NO: 282700 - RNA, 22 nt, Homo sapiens
uucuugcacuuaacugacauuc

SEQ ID NO: 282701 - RNA, 21 nt, Homo sapiens
uucuuugcucaguguuagagu

SEQ ID NO: 282702 - RNA, 22 nt, Homo sapiens
uucuuuggaaacaguacuaauu

SEQ ID NO: 282703 - RNA, 22 nt, Homo sapiens
uucuuugguacaagggccgacc

SEQ ID NO: 282704 - RNA, 22 nt, Homo sapiens
uugaaggaacgcuguucccuug

SEQ ID NO: 282705 - RNA, 22 nt, Homo sapiens
uugaaggaggugcucacucucg

SEQ ID NO: 282706 - RNA, 22 nt, Homo sapiens
uugaauagcauguuuagugcau

SEQ ID NO: 282707 - RNA, 22 nt, Homo sapiens
uugaauagugacuuugauucug

SEQ ID NO: 282708 - RNA, 22 nt, Homo sapiens
uugaaugaaaugaugucauuug

SEQ ID NO: 282709 - RNA, 22 nt, Homo sapiens
uugacacuaauuauuauaggug

SEQ ID NO: 282710 - RNA, 20 nt, Homo sapiens
uugacagagggaaaguugcu

SEQ ID NO: 282711 - RNA, 22 nt, Homo sapiens
uugacaguggcuuaaauugguu

SEQ ID NO: 282712 - RNA, 20 nt, Homo sapiens
uugacaguggguuguuaaag

SEQ ID NO: 282713 - RNA, 22 nt, Homo sapiens
uugacauugcuguaguguccag

SEQ ID NO: 282714 - RNA, 22 nt, Homo sapiens
uugacuuuuauucacucugcua

SEQ ID NO: 282715 - RNA, 22 nt, Homo sapiens
uugagacgaagucucacucuug

SEQ ID NO: 282716 - RNA, 22 nt, Homo sapiens
uugagacggaguuuugcucuug

SEQ ID NO: 282717 - RNA, 22 nt, Homo sapiens
uugagacugaacauuuguguac

SEQ ID NO: 282718 - RNA, 22 nt, Homo sapiens
uugagagaaaaaauuuauuggu

SEQ ID NO: 282719 - RNA, 22 nt, Homo sapiens
uugagaguggaggcuauaucuu

SEQ ID NO: 282720 - RNA, 22 nt, Homo sapiens
uugagauacauaauuaugaaug

SEQ ID NO: 282721 - RNA, 20 nt, Homo sapiens
uugagaucuguaucugguuu

SEQ ID NO: 282722 - RNA, 22 nt, Homo sapiens
uugagauggagucucacuccuu

SEQ ID NO: 282723 - RNA, 22 nt, Homo sapiens
uugagauggagucucacucugc

SEQ ID NO: 282724 - RNA, 22 nt, Homo sapiens
uugagauggagucucacucuug

SEQ ID NO: 282725 - RNA, 22 nt, Homo sapiens
uugagauggagucuugcacugu

SEQ ID NO: 282726 - RNA, 22 nt, Homo sapiens
uugagauggagucuugcgcugu

SEQ ID NO: 282727 - RNA, 22 nt, Homo sapiens
uugagauggagucuugcucucu

SEQ ID NO: 282728 - RNA, 22 nt, Homo sapiens
uugagauggagucuuguucucu

SEQ ID NO: 282729 - RNA, 22 nt, Homo sapiens
uugagauggagucuuguucuuu

SEQ ID NO: 282730 - RNA, 22 nt, Homo sapiens
uugagauggaguguugcucugu

SEQ ID NO: 282731 - RNA, 22 nt, Homo sapiens
uugagauggaguuucaauauug

SEQ ID NO: 282732 - RNA, 22 nt, Homo sapiens
uugagauggaguuucacucucg

SEQ ID NO: 282733 - RNA, 22 nt, Homo sapiens
uugagauggaguuucacucuug

SEQ ID NO: 282734 - RNA, 22 nt, Homo sapiens
uugagauggaguuucgcucuug

SEQ ID NO: 282735 - RNA, 22 nt, Homo sapiens
uugagauggauagacauagcau

SEQ ID NO: 282736 - RNA, 22 nt, Homo sapiens
uugagauguauguauauaaugu

SEQ ID NO: 282737 - RNA, 22 nt, Homo sapiens
uugagauguggcaguuuaugag

SEQ ID NO: 282738 - RNA, 22 nt, Homo sapiens
uugagauuauuguguuccuuua

SEQ ID NO: 282739 - RNA, 22 nt, Homo sapiens
uugagauuuuccucaaauauuu

SEQ ID NO: 282740 - RNA, 22 nt, Homo sapiens
uugagcaaugucacugaggcuu

SEQ ID NO: 282741 - RNA, 22 nt, Homo sapiens
uugaggaaugucauuuguguuu

SEQ ID NO: 282742 - RNA, 22 nt, Homo sapiens
uugaggacuggaacacaggucu

SEQ ID NO: 282743 - RNA, 23 nt, Homo sapiens
uugaggcauguaccaucaauauc

SEQ ID NO: 282744 - RNA, 22 nt, Homo sapiens
uugaggccugauaacacacuga

SEQ ID NO: 282745 - RNA, 22 nt, Homo sapiens
uugagggagcacagauucuuau

SEQ ID NO: 282746 - RNA, 22 nt, Homo sapiens
uugagggagcauuuguuuugag

SEQ ID NO: 282747 - RNA, 22 nt, Homo sapiens
uugagguagcuuugauggaggu

SEQ ID NO: 282748 - RNA, 22 nt, Homo sapiens
uugaggugaauuugcaggaugc

SEQ ID NO: 282749 - RNA, 22 nt, Homo sapiens
uugaggugggaggaucacuuga

SEQ ID NO: 282750 - RNA, 22 nt, Homo sapiens
uugaguuugaguauucuaaagc

SEQ ID NO: 282751 - RNA, 22 nt, Homo sapiens
uugauaguuuaauuaaugcuag

SEQ ID NO: 282752 - RNA, 22 nt, Homo sapiens
uugauauguaguuggacuugau

SEQ ID NO: 282753 - RNA, 22 nt, Homo sapiens
uugauauuacucaguaacagau

SEQ ID NO: 282754 - RNA, 22 nt, Homo sapiens
uugauguguuuccaggauuugu

SEQ ID NO: 282755 - RNA, 22 nt, Homo sapiens
uugcaaacaucuuguuucacau

SEQ ID NO: 282756 - RNA, 22 nt, Homo sapiens
uugcaagaaaugcagauucuca

SEQ ID NO: 282757 - RNA, 22 nt, Homo sapiens
uugcacagugguuuagagccug

SEQ ID NO: 282758 - RNA, 22 nt, Homo sapiens
uugcacaguguguacagcacca

SEQ ID NO: 282759 - RNA, 22 nt, Homo sapiens
uugcacauggcuggggaggccu

SEQ ID NO: 282760 - RNA, 22 nt, Homo sapiens
uugcacauguugaaccagcaaa

SEQ ID NO: 282761 - RNA, 22 nt, Homo sapiens
uugcacauugauuuuguaucuu

SEQ ID NO: 282762 - RNA, 22 nt, Homo sapiens
uugcacauuuuuucuggcagaa

SEQ ID NO: 282763 - RNA, 22 nt, Homo sapiens
uugcacuauaggaaaauguguc

SEQ ID NO: 282764 - RNA, 22 nt, Homo sapiens
uugcacugagauuuugcuuaca

SEQ ID NO: 282765 - RNA, 22 nt, Homo sapiens
uugcacuguaauuuauuuaugu

SEQ ID NO: 282766 - RNA, 20 nt, Homo sapiens
uugcagagcccaacccugga

SEQ ID NO: 282767 - RNA, 22 nt, Homo sapiens
uugcagagccccacacugggcu

SEQ ID NO: 282768 - RNA, 22 nt, Homo sapiens
uugcaguagucugaaagcaaua

SEQ ID NO: 282769 - RNA, 22 nt, Homo sapiens
uugcauagacaauauuaaucuu

SEQ ID NO: 282770 - RNA, 19 nt, Homo sapiens
uugcauagguugaaccagc

SEQ ID NO: 282771 - RNA, 19 nt, Homo sapiens
uugcauauguugaaccagg

SEQ ID NO: 282772 - RNA, 22 nt, Homo sapiens
uugcauuagugugguacauuug

SEQ ID NO: 282773 - RNA, 19 nt, Homo sapiens
uuguguccccacaaaauuc

SEQ ID NO: 282774 - RNA, 22 nt, Homo sapiens
uuguucaggagguuggggaugc

SEQ ID NO: 282775 - RNA, 22 nt, Homo sapiens
uuuaaagcaugacgagaagaag

SEQ ID NO: 282776 - RNA, 22 nt, Homo sapiens
uuuaaaguuagaaggaaagggc

SEQ ID NO: 282777 - RNA, 23 nt, Homo sapiens
uuuaagcuucauguccuaacauc

SEQ ID NO: 282778 - RNA, 22 nt, Homo sapiens
uuuacagucucauagguggaag

SEQ ID NO: 282779 - RNA, 22 nt, Homo sapiens
uuuacaguuuucuaggcuacca

SEQ ID NO: 282780 - RNA, 22 nt, Homo sapiens
uuuagcaaagcaauuuacacca

SEQ ID NO: 282781 - RNA, 22 nt, Homo sapiens
uuuagcaauucauuuugugucu

SEQ ID NO: 282782 - RNA, 22 nt, Homo sapiens
uuuagcacugugauugacaaaa

SEQ ID NO: 282783 - RNA, 22 nt, Homo sapiens
uuuagcucauucaauuucaguc

SEQ ID NO: 282784 - RNA, 22 nt, Homo sapiens
uuucaacuaauuuuuuggugag

SEQ ID NO: 282785 - RNA, 19 nt, Homo sapiens
uuucaauguaaggauggag

SEQ ID NO: 282786 - RNA, 22 nt, Homo sapiens
uuucacagagggcuucuuucua

SEQ ID NO: 282787 - RNA, 22 nt, Homo sapiens
uuucacagcaauugccuauugu

SEQ ID NO: 282788 - RNA, 22 nt, Homo sapiens
uuucaccguguuggccaggcug

SEQ ID NO: 282789 - RNA, 21 nt, Homo sapiens
uuucacugugaguuuuucugu

SEQ ID NO: 282790 - RNA, 22 nt, Homo sapiens
uuucagagucaucugcccaagu

SEQ ID NO: 282791 - RNA, 18 nt, Homo sapiens
uuucaggguggacaugag

SEQ ID NO: 282792 - RNA, 23 nt, Homo sapiens
uuucaguaguuguauccuguugc

SEQ ID NO: 282793 - RNA, 16 nt, Homo sapiens
uuucaucaguuuuaau

SEQ ID NO: 282794 - RNA, 18 nt, Homo sapiens
uuucauugagugugauau

SEQ ID NO: 282795 - RNA, 19 nt, Homo sapiens
uuuccaguaaucuuaugug

SEQ ID NO: 282796 - RNA, 22 nt, Homo sapiens
uuuccaguuggaaagccuguuu

SEQ ID NO: 282797 - RNA, 22 nt, Homo sapiens
uuucccauuguucugcucugug

SEQ ID NO: 282798 - RNA, 22 nt, Homo sapiens
uuucccuuacuuaaacuuacuc

SEQ ID NO: 282799 - RNA, 22 nt, Homo sapiens
uuucccuuuagcuuagugauuu

SEQ ID NO: 282800 - RNA, 22 nt, Homo sapiens
uuuccuggagaaucuuaacaaa

SEQ ID NO: 282801 - RNA, 22 nt, Homo sapiens
uuuccuguagggggcaaggccu

SEQ ID NO: 282802 - RNA, 21 nt, Homo sapiens
uuucugggggagcauggcagg

SEQ ID NO: 282803 - RNA, 22 nt, Homo sapiens
uuucuuggagcucuuagggucg

SEQ ID NO: 282804 - RNA, 22 nt, Homo sapiens
uuugaaaguaauuugguuggug

SEQ ID NO: 282805 - RNA, 22 nt, Homo sapiens
uuugaauggaaguuuugugaaa

SEQ ID NO: 282806 - RNA, 20 nt, Homo sapiens
uuugaauguaaagcauguca

SEQ ID NO: 282807 - RNA, 22 nt, Homo sapiens
uuugaauguaaugagcaggaag

SEQ ID NO: 282808 - RNA, 22 nt, Homo sapiens
uuugacuaccaggaauguucuu

SEQ ID NO: 282809 - RNA, 22 nt, Homo sapiens
uuugacuagaguguuuuacaac

SEQ ID NO: 282810 - RNA, 22 nt, Homo sapiens
uuugagcaagaggugacauuau

SEQ ID NO: 282811 - RNA, 22 nt, Homo sapiens
uuugaguuugaggugcugauga

SEQ ID NO: 282812 - RNA, 22 nt, Homo sapiens
uuugauguugagacuauaaagc

SEQ ID NO: 282813 - RNA, 22 nt, Homo sapiens
uuugcacuggagauucaauggg

SEQ ID NO: 282814 - RNA, 23 nt, Homo sapiens
uuugcacuugcuccuucuauggc

SEQ ID NO: 282815 - RNA, 21 nt, Homo sapiens
uuugcacuuugcaaaucccua

SEQ ID NO: 282816 - RNA, 22 nt, Homo sapiens
uuugcagugucagcuucugugu

SEQ ID NO: 282817 - RNA, 22 nt, Homo sapiens
uuugccaaugggaauuuuccua

SEQ ID NO: 282818 - RNA, 22 nt, Homo sapiens
uuugcuugaggucuagcuaccc

SEQ ID NO: 282819 - RNA, 22 nt, Homo sapiens
uuuggaaugugcacucagauug

SEQ ID NO: 282820 - RNA, 22 nt, Homo sapiens
uuuggcaaagaucaacauguua

SEQ ID NO: 282821 - RNA, 22 nt, Homo sapiens
uuuggcauuagagagacuugca

SEQ ID NO: 282822 - RNA, 22 nt, Homo sapiens
uuuggcauuuaaauaugcaugg

SEQ ID NO: 282823 - RNA, 21 nt, Homo sapiens
uuuggcuucucugcugcagcc

SEQ ID NO: 282824 - RNA, 22 nt, Homo sapiens
uuugggaaugguuugucuccca

SEQ ID NO: 282825 - RNA, 22 nt, Homo sapiens
uuuggucacugccgccgccagc

SEQ ID NO: 282826 - RNA, 22 nt, Homo sapiens
uuuggucagcugcgggucagcu

SEQ ID NO: 282827 - RNA, 22 nt, Homo sapiens
uuugguuauuugaaacuagcau

SEQ ID NO: 282828 - RNA, 22 nt, Homo sapiens
uuugguugucacaacuggggga

SEQ ID NO: 282829 - RNA, 22 nt, Homo sapiens
uuuguacucccuuuagauaaaa

SEQ ID NO: 282830 - RNA, 21 nt, Homo sapiens
uuuguaguagcaugauuuaua

SEQ ID NO: 282831 - RNA, 22 nt, Homo sapiens
uuuguggaaugcccuuauuuau

SEQ ID NO: 282832 - RNA, 22 nt, Homo sapiens
uuuguggaaugcucauguguag

SEQ ID NO: 282833 - RNA, 21 nt, Homo sapiens
uuugugguuacugugugagcu

SEQ ID NO: 282834 - RNA, 22 nt, Homo sapiens
uuuguucaccucaaggauggga

SEQ ID NO: 282835 - RNA, 22 nt, Homo sapiens
uuuuaacagccaggggacggcc

SEQ ID NO: 282836 - RNA, 22 nt, Homo sapiens
uuuuacacaucaccgcucgugu

SEQ ID NO: 282837 - RNA, 22 nt, Homo sapiens
uuuuagcaaagagacugguggc

SEQ ID NO: 282838 - RNA, 22 nt, Homo sapiens
uuuuagcagccaugacaaagau

SEQ ID NO: 282839 - RNA, 20 nt, Homo sapiens
uuuuagcuuuuauugaaagc

SEQ ID NO: 282840 - RNA, 21 nt, Homo sapiens
uuuugcacacuaugcagcuuu

SEQ ID NO: 282841 - RNA, 22 nt, Homo sapiens
uuuugcaccauccuaauaguau

SEQ ID NO: 282842 - RNA, 22 nt, Homo sapiens
uuuugcaggcauuggaaguuua

SEQ ID NO: 282843 - RNA, 22 nt, Homo sapiens
uuuugcaguuacagagagugag

SEQ ID NO: 282844 - RNA, 18 nt, Homo sapiens
uuuugcuuaacugcgcca

SEQ ID NO: 282845 - RNA, 19 nt, Homo sapiens
uuuuggaaaugugaacagc

SEQ ID NO: 282846 - RNA, 22 nt, Homo sapiens
cuacagguaugaaagggaguau

SEQ ID NO: 282847 - RNA, 22 nt, Homo sapiens
cuacaguagagaggauguagaa

SEQ ID NO: 282848 - RNA, 22 nt, Homo sapiens
cuacaguaugaaaccuuuacuc

SEQ ID NO: 282849 - RNA, 22 nt, Homo sapiens
cuacauuguagguauucaaacu

SEQ ID NO: 282850 - RNA, 22 nt, Homo sapiens
cuagaacuagaacugcuggggu

SEQ ID NO: 282851 - RNA, 22 nt, Homo sapiens
cuagaagcauauucagaacaga

SEQ ID NO: 282852 - RNA, 22 nt, Homo sapiens
cuagcagacaggcugggagcag

SEQ ID NO: 282853 - RNA, 22 nt, Homo sapiens
cuagcaggcaagauaagauuca

SEQ ID NO: 282854 - RNA, 22 nt, Homo sapiens
cuagguuauacucugaaauggu

SEQ ID NO: 282855 - RNA, 22 nt, Homo sapiens
cuagguucucaaaccagcguca

SEQ ID NO: 282856 - RNA, 18 nt, Homo sapiens
cuaugccacuuuauauca

SEQ ID NO: 282857 - RNA, 22 nt, Homo sapiens
cuauggcuguagucccugugua

SEQ ID NO: 282858 - RNA, 20 nt, Homo sapiens
cucacagacagcuucuuucu

SEQ ID NO: 282859 - RNA, 20 nt, Homo sapiens
cucaccagguguaggcugag

SEQ ID NO: 282860 - RNA, 22 nt, Homo sapiens
cucaccuugugauccacccgcc

SEQ ID NO: 282861 - RNA, 22 nt, Homo sapiens
cucaccuugugauccuccugcc

SEQ ID NO: 282862 - RNA, 22 nt, Homo sapiens
cucacuggguguaaaacaugua

SEQ ID NO: 282863 - RNA, 22 nt, Homo sapiens
cucacugucaacauguauuugg

SEQ ID NO: 282864 - RNA, 22 nt, Homo sapiens
cucagcuacuugagaggcuuag

SEQ ID NO: 282865 - RNA, 22 nt, Homo sapiens
cucagcuacuugggaagcugag

SEQ ID NO: 282866 - RNA, 22 nt, Homo sapiens
cucagguaguuccuuauagcaa

SEQ ID NO: 282867 - RNA, 22 nt, Homo sapiens
cucagugaagggcaagaggcaa

SEQ ID NO: 282868 - RNA, 22 nt, Homo sapiens
cucagugucuggcacacagaaa

SEQ ID NO: 282869 - RNA, 22 nt, Homo sapiens
cucaguguuucagcugcucaga

SEQ ID NO: 282870 - RNA, 22 nt, Homo sapiens
cucaugcugucuucugggguaa

SEQ ID NO: 282871 - RNA, 19 nt, Homo sapiens
cucauggagaaggagaaua

SEQ ID NO: 282872 - RNA, 22 nt, Homo sapiens
cuccauuuaucugaaauuuuau

SEQ ID NO: 282873 - RNA, 22 nt, Homo sapiens
cucccacccucauuuuuaggca

SEQ ID NO: 282874 - RNA, 22 nt, Homo sapiens
cucccagagccaguuauaggcu

SEQ ID NO: 282875 - RNA, 22 nt, Homo sapiens
cucccugagccagggcuuugac

SEQ ID NO: 282876 - RNA, 22 nt, Homo sapiens
cuccgggugcgucggcgcccug

SEQ ID NO: 282877 - RNA, 20 nt, Homo sapiens
cuccuucauuccuuuggacc

SEQ ID NO: 282878 - RNA, 22 nt, Homo sapiens
cuccuugauuagaguauagagu

SEQ ID NO: 282879 - RNA, 20 nt, Homo sapiens
cucuaguaauaaaguuuccc

SEQ ID NO: 282880 - RNA, 22 nt, Homo sapiens
cucugacagugguuagcacugu

SEQ ID NO: 282881 - RNA, 22 nt, Homo sapiens
cucugagguuauucguaauauu

SEQ ID NO: 282882 - RNA, 20 nt, Homo sapiens
cucugguugugaauugucuu

SEQ ID NO: 282883 - RNA, 22 nt, Homo sapiens
cucuuagauuagccauccuaau

SEQ ID NO: 282884 - RNA, 22 nt, Homo sapiens
cucuuugaguuccuccuggugu

SEQ ID NO: 282885 - RNA, 19 nt, Homo sapiens
cucuuuggugucucuucuu

SEQ ID NO: 282886 - RNA, 22 nt, Homo sapiens
cugaaaguuauucaggggcaag

SEQ ID NO: 282887 - RNA, 22 nt, Homo sapiens
cugaaaugaauuauuuucuuuc

SEQ ID NO: 282888 - RNA, 22 nt, Homo sapiens
cugaaggcagguagaauagaga

SEQ ID NO: 282889 - RNA, 22 nt, Homo sapiens
cugaagugcuugccacauaaaa

SEQ ID NO: 282890 - RNA, 22 nt, Homo sapiens
cugaaucauugcauuaucaagg

SEQ ID NO: 282891 - RNA, 22 nt, Homo sapiens
cugaaucauugguuaugaguac

SEQ ID NO: 282892 - RNA, 20 nt, Homo sapiens
cugaaugucaaggcagaggu

SEQ ID NO: 282893 - RNA, 22 nt, Homo sapiens
cugacauuguugaucacagcca

SEQ ID NO: 282894 - RNA, 22 nt, Homo sapiens
cugagaagaaacagguaaggac

SEQ ID NO: 282895 - RNA, 22 nt, Homo sapiens
cugagagaugagaccucucacu

SEQ ID NO: 282896 - RNA, 22 nt, Homo sapiens
cugagagugguauguuuaagug

SEQ ID NO: 282897 - RNA, 22 nt, Homo sapiens
cugagcacugagauccucuagc

SEQ ID NO: 282898 - RNA, 22 nt, Homo sapiens
cugaggaaguucuuuaacaguu

SEQ ID NO: 282899 - RNA, 22 nt, Homo sapiens
cugaggauauucagccucugug

SEQ ID NO: 282900 - RNA, 22 nt, Homo sapiens
cugagguacugggggccaggau

SEQ ID NO: 282901 - RNA, 22 nt, Homo sapiens
gaaugguaaacuuccaugacug

SEQ ID NO: 282902 - RNA, 22 nt, Homo sapiens
gaaugucuuauugcucguugua

SEQ ID NO: 282903 - RNA, 22 nt, Homo sapiens
gacaaguuugauuuauuccaag

SEQ ID NO: 282904 - RNA, 22 nt, Homo sapiens
gacacagugaagucucuacuug

SEQ ID NO: 282905 - RNA, 22 nt, Homo sapiens
gacacuggguguuuguuggcgu

SEQ ID NO: 282906 - RNA, 22 nt, Homo sapiens
gacagguuuucuguuucugaaa

SEQ ID NO: 282907 - RNA, 22 nt, Homo sapiens
gacagugugauacuuagucuca

SEQ ID NO: 282908 - RNA, 22 nt, Homo sapiens
gacaguguggcgauuccucaag

SEQ ID NO: 282909 - RNA, 20 nt, Homo sapiens
gacauguugguuugcugcac

SEQ ID NO: 282910 - RNA, 21 nt, Homo sapiens
gaccccuagaucuuuuuccag

SEQ ID NO: 282911 - RNA, 22 nt, Homo sapiens
gaccuggugguccacccgccuu

SEQ ID NO: 282912 - RNA, 22 nt, Homo sapiens
gacguagagaaaugugaaaugg

SEQ ID NO: 282913 - RNA, 22 nt, Homo sapiens
uauaggacuugguguaguuucu

SEQ ID NO: 282914 - RNA, 22 nt, Homo sapiens
uauauguucuugcacuggaaag

SEQ ID NO: 282915 - RNA, 22 nt, Homo sapiens
uaucaacaggguggccagugua

SEQ ID NO: 282916 - RNA, 22 nt, Homo sapiens
uaucaagauggauaaggauaga

SEQ ID NO: 282917 - RNA, 22 nt, Homo sapiens
uaucacaggucaggaaucuugc

SEQ ID NO: 282918 - RNA, 22 nt, Homo sapiens
uaucacaguaaaucugggugca

SEQ ID NO: 282919 - RNA, 22 nt, Homo sapiens
uaucacggaguacauguucugu

SEQ ID NO: 282920 - RNA, 22 nt, Homo sapiens
uaucacuguuguuuguuuaagg

SEQ ID NO: 282921 - RNA, 22 nt, Homo sapiens
uaucacuuugauaguuuaaaug

SEQ ID NO: 282922 - RNA, 22 nt, Homo sapiens
uaucagcagcaggggcugcaga

SEQ ID NO: 282923 - RNA, 22 nt, Homo sapiens
uaucaucauguuuuugcugugu

SEQ ID NO: 282924 - RNA, 21 nt, Homo sapiens
uaucauggugaaacccugucu

SEQ ID NO: 282925 - RNA, 22 nt, Homo sapiens
uaucauuguguuauuucuucca

SEQ ID NO: 282926 - RNA, 22 nt, Homo sapiens
uaucucagaguguacaagauua

SEQ ID NO: 282927 - RNA, 22 nt, Homo sapiens
uaugaaagcuacuucucacaau

SEQ ID NO: 282928 - RNA, 22 nt, Homo sapiens
uaugaagccaggauuuauuauu

SEQ ID NO: 282929 - RNA, 22 nt, Homo sapiens
uaugagacugguuaauuuuugu

SEQ ID NO: 282930 - RNA, 22 nt, Homo sapiens
uaugaugcuguuuagaaucucu

SEQ ID NO: 282931 - RNA, 23 nt, Homo sapiens
uaugccuguuucaaacaaacuuu

SEQ ID NO: 282932 - RNA, 19 nt, Homo sapiens
uaugcuauuuauuagaagu

SEQ ID NO: 282933 - RNA, 22 nt, Homo sapiens
uaugcuuauuaaaacagugugu

SEQ ID NO: 282934 - RNA, 22 nt, Homo sapiens
uauggauguuaagguucacagc

SEQ ID NO: 282935 - RNA, 22 nt, Homo sapiens
uauggcauuauuuugauagaca

SEQ ID NO: 282936 - RNA, 21 nt, Homo sapiens
uauggcuuagucaguguuucc

SEQ ID NO: 282937 - RNA, 21 nt, Homo sapiens
uaugguuucuaauucugcagg

SEQ ID NO: 282938 - RNA, 22 nt, Homo sapiens
uaugucuuuugcuugcaaauag

SEQ ID NO: 282939 - RNA, 18 nt, Homo sapiens
uauuaagcuagauauuau

SEQ ID NO: 282940 - RNA, 22 nt, Homo sapiens
uauuagguuggugcaaaaguaa

SEQ ID NO: 282941 - RNA, 22 nt, Homo sapiens
uauuagugucuuuugguuagaa

SEQ ID NO: 282942 - RNA, 20 nt, Homo sapiens
uauucacucuccagucuugc

SEQ ID NO: 282943 - RNA, 22 nt, Homo sapiens
uauuccacuauuaguccagaug

SEQ ID NO: 282944 - RNA, 22 nt, Homo sapiens
uauuccacuuacaugagguauc

SEQ ID NO: 282945 - RNA, 22 nt, Homo sapiens
uauugaauuuuuaagcccuuug

SEQ ID NO: 282946 - RNA, 22 nt, Homo sapiens
uauugacuuuuuuguuaggagg

SEQ ID NO: 282947 - RNA, 22 nt, Homo sapiens
uauugcacuccucaugcauuug

SEQ ID NO: 282948 - RNA, 22 nt, Homo sapiens
uauugcauauuauucuaguggc

SEQ ID NO: 282949 - RNA, 22 nt, Homo sapiens
uauugcauuugagguugguuga

SEQ ID NO: 282950 - RNA, 22 nt, Homo sapiens
uauugccugucuccaaaaauca

SEQ ID NO: 282951 - RNA, 22 nt, Homo sapiens
uauugcuggcacauaguagguc

SEQ ID NO: 282952 - RNA, 22 nt, Homo sapiens
uauugcuuuugauucaaggcag

SEQ ID NO: 282953 - RNA, 22 nt, Homo sapiens
uauuguacauguuauagauuuu

SEQ ID NO: 282954 - RNA, 22 nt, Homo sapiens
uauuguuaaagauguuaaugau

SEQ ID NO: 282955 - RNA, 22 nt, Homo sapiens
uauuguuuuucccaggagucua

SEQ ID NO: 282956 - RNA, 22 nt, Homo sapiens
uauuucaguugcguuucccgag

SEQ ID NO: 282957 - RNA, 22 nt, Homo sapiens
uauuucccuuaacuuuccugca

SEQ ID NO: 282958 - RNA, 22 nt, Homo sapiens
uauuuggauagucuggaaaaaa

SEQ ID NO: 282959 - RNA, 22 nt, Homo sapiens
uauuugguagcuauuuugcagu

SEQ ID NO: 282960 - RNA, 22 nt, Homo sapiens
ucaaagacacacaaggagaagg

SEQ ID NO: 282961 - RNA, 22 nt, Homo sapiens
ucaaagugacaaaguugcagca

SEQ ID NO: 282962 - RNA, 22 nt, Homo sapiens
ucaaagugcuauggcucagguu

SEQ ID NO: 282963 - RNA, 21 nt, Homo sapiens
ucaaaguguucuuuuguugaa

SEQ ID NO: 282964 - RNA, 18 nt, Homo sapiens
ucaaauacuuugggcagu

SEQ ID NO: 282965 - RNA, 22 nt, Homo sapiens
ucaaaugauucacccaccuuug

SEQ ID NO: 282966 - RNA, 22 nt, Homo sapiens
ucaaauguuuguuuaaggcuua

SEQ ID NO: 282967 - RNA, 20 nt, Homo sapiens
ucaaauucuuggccuccagc

SEQ ID NO: 282968 - RNA, 22 nt, Homo sapiens
ucaacacaguuaaauggggaaa

SEQ ID NO: 282969 - RNA, 22 nt, Homo sapiens
ucaagaccucacauagaggaga

SEQ ID NO: 282970 - RNA, 22 nt, Homo sapiens
ucaagcaauucuccugccucag

SEQ ID NO: 282971 - RNA, 22 nt, Homo sapiens
ucaaggcacuagcugagcugca

SEQ ID NO: 282972 - RNA, 22 nt, Homo sapiens
ucaaguaauacucccaucuugg

SEQ ID NO: 282973 - RNA, 22 nt, Homo sapiens
ucaagugauucuugugccuuag

SEQ ID NO: 282974 - RNA, 22 nt, Homo sapiens
gaucugagaaagugucauaaca

SEQ ID NO: 282975 - RNA, 19 nt, Homo sapiens
gaugcaaugcacugagguc

SEQ ID NO: 282976 - RNA, 22 nt, Homo sapiens
gauggaguaauguaaucuugag

SEQ ID NO: 282977 - RNA, 22 nt, Homo sapiens
gauggauuuuaagugaaugaaa

SEQ ID NO: 282978 - RNA, 22 nt, Homo sapiens
gauggcagugcagccccuggcu

SEQ ID NO: 282979 - RNA, 22 nt, Homo sapiens
gauggcaucugagaguguuaga

SEQ ID NO: 282980 - RNA, 21 nt, Homo sapiens
aacagugcuuaguagauguuc

SEQ ID NO: 282981 - RNA, 22 nt, Homo sapiens
aacugcacuaggacagguuuuu

SEQ ID NO: 282982 - RNA, 22 nt, Homo sapiens
aacuggcauauucugguugcgg

SEQ ID NO: 282983 - RNA, 22 nt, Homo sapiens
aacuggcauguuuuaaggcuua

SEQ ID NO: 282984 - RNA, 22 nt, Homo sapiens
aacuggccuggcgugcagaggg

SEQ ID NO: 282985 - RNA, 22 nt, Homo sapiens
aacugggcaagcauuacauggu

SEQ ID NO: 282986 - RNA, 22 nt, Homo sapiens
aacuggucuuaugcaagcacua

SEQ ID NO: 282987 - RNA, 20 nt, Homo sapiens
aagacacuguccccacugga

SEQ ID NO: 282988 - RNA, 22 nt, Homo sapiens
aagaccuaugcaggaagaaaug

SEQ ID NO: 282989 - RNA, 18 nt, Homo sapiens
aagagcucagcacagguu

SEQ ID NO: 282990 - RNA, 22 nt, Homo sapiens
aagagguaauaacaaagcuucu

SEQ ID NO: 282991 - RNA, 22 nt, Homo sapiens
aagagguuguaccuaaaguguu

SEQ ID NO: 282992 - RNA, 22 nt, Homo sapiens
aagagguuuaacugacucacag

SEQ ID NO: 282993 - RNA, 22 nt, Homo sapiens
aagaguaguaguggcacucucu

SEQ ID NO: 282994 - RNA, 22 nt, Homo sapiens
aagauauguuaguuauaaacuc

SEQ ID NO: 282995 - RNA, 22 nt, Homo sapiens
aagaucaucauagagggcauga

SEQ ID NO: 282996 - RNA, 22 nt, Homo sapiens
aagaucauucagggaaggcuga

SEQ ID NO: 282997 - RNA, 22 nt, Homo sapiens
aagaugcagaagcccagauguu

SEQ ID NO: 282998 - RNA, 22 nt, Homo sapiens
aagcaccaauaggagauuuguc

SEQ ID NO: 282999 - RNA, 22 nt, Homo sapiens
aagcaucauuuggaauuugaga

SEQ ID NO: 283000 - RNA, 22 nt, Homo sapiens
aagccacuguaccugucucuua

SEQ ID NO: 283001 - RNA, 22 nt, Homo sapiens
aagcuccauuucugccaugaga

SEQ ID NO: 283002 - RNA, 22 nt, Homo sapiens
aagcugccuugugaaggcauuc

SEQ ID NO: 283003 - RNA, 22 nt, Homo sapiens
aagcuggagugcaguggugcaa

SEQ ID NO: 283004 - RNA, 22 nt, Homo sapiens
aagcuguuguucauccugaauu

SEQ ID NO: 283005 - RNA, 22 nt, Homo sapiens
aaggaagcuagcaggaauuggu

SEQ ID NO: 283006 - RNA, 22 nt, Homo sapiens
aaggaaguaauuugguuuauag

SEQ ID NO: 283007 - RNA, 22 nt, Homo sapiens
aaggaguagaauagaugcaccu

SEQ ID NO: 283008 - RNA, 22 nt, Homo sapiens
aaggaguagacaacauggcgcc

SEQ ID NO: 283009 - RNA, 22 nt, Homo sapiens
aaggauuguaaaguugacaaau

SEQ ID NO: 283010 - RNA, 22 nt, Homo sapiens
aaggauuguaacaccaagguua

SEQ ID NO: 283011 - RNA, 22 nt, Homo sapiens
aaggcaacgugaguuguugauu

SEQ ID NO: 283012 - RNA, 22 nt, Homo sapiens
aaggcaagaaaauggauucucc

SEQ ID NO: 283013 - RNA, 22 nt, Homo sapiens
aaggcagucacuaaauagugag

SEQ ID NO: 283014 - RNA, 22 nt, Homo sapiens
aaggcagugugcacauaacacu

SEQ ID NO: 283015 - RNA, 22 nt, Homo sapiens
aaggcaugcugaguccuaaaag

SEQ ID NO: 283016 - RNA, 22 nt, Homo sapiens
aaggcauggugacuauuuaggc

SEQ ID NO: 283017 - RNA, 22 nt, Homo sapiens
aagggaauguuguagcugguuu

SEQ ID NO: 283018 - RNA, 22 nt, Homo sapiens
aagggaauguugugguugguuu

SEQ ID NO: 283019 - RNA, 22 nt, Homo sapiens
aagggagcugcauaaucuugug

SEQ ID NO: 283020 - RNA, 22 nt, Homo sapiens
aaggucauugugguuuuugcca

SEQ ID NO: 283021 - RNA, 22 nt, Homo sapiens
aaggugcuguaagcauccaugu

SEQ ID NO: 283022 - RNA, 22 nt, Homo sapiens
aagguggugucagagagcuuau

SEQ ID NO: 283023 - RNA, 22 nt, Homo sapiens
aaggugguuuucucuuggaguc

SEQ ID NO: 283024 - RNA, 22 nt, Homo sapiens
aaguaagcauccaauaaauguu

SEQ ID NO: 283025 - RNA, 22 nt, Homo sapiens
aaguaauugagguuuuugcugu

SEQ ID NO: 283026 - RNA, 22 nt, Homo sapiens
aaguagugcuugugcucaucuc

SEQ ID NO: 283027 - RNA, 22 nt, Homo sapiens
aaguaguuaggaacauucucuc

SEQ ID NO: 283028 - RNA, 22 nt, Homo sapiens
aaguauguaucaagucauacuu

SEQ ID NO: 283029 - RNA, 22 nt, Homo sapiens
aaguauuagcuaauugugcuua

SEQ ID NO: 283030 - RNA, 22 nt, Homo sapiens
aaguauuaugaguccuuguuuu

SEQ ID NO: 283031 - RNA, 22 nt, Homo sapiens
aagucaugaagaggaaaggaca

SEQ ID NO: 283032 - RNA, 22 nt, Homo sapiens
aaguccaugaagucuugugggu

SEQ ID NO: 283033 - RNA, 22 nt, Homo sapiens
aagugaauucauuguguuauau

SEQ ID NO: 283034 - RNA, 22 nt, Homo sapiens
aagugcaaaucuguggcugaaa

SEQ ID NO: 283035 - RNA, 22 nt, Homo sapiens
aagugcucuugaaacugccuua

SEQ ID NO: 283036 - RNA, 22 nt, Homo sapiens
aagugcucuugaaacugucuua

SEQ ID NO: 283037 - RNA, 22 nt, Homo sapiens
aagugcuuuacacaugcaugau

SEQ ID NO: 283038 - RNA, 22 nt, Homo sapiens
aagugguagggucaggauugga

SEQ ID NO: 283039 - RNA, 23 nt, Homo sapiens
aagugguuuugaacccggacccu

SEQ ID NO: 283040 - RNA, 22 nt, Homo sapiens
aaguguaugaaacaguccaugg

SEQ ID NO: 283041 - RNA, 23 nt, Homo sapiens
aaguucaugcucaucuguuacac

SEQ ID NO: 283042 - RNA, 21 nt, Homo sapiens
aauaaagcaaccuuaugccau

SEQ ID NO: 283043 - RNA, 22 nt, Homo sapiens
aauaaagcagcuuuuugggacu

SEQ ID NO: 283044 - RNA, 22 nt, Homo sapiens
aauaaagcauggcuacuccaua

SEQ ID NO: 283045 - RNA, 22 nt, Homo sapiens
aauaaagccugucucuuuagag

SEQ ID NO: 283046 - RNA, 22 nt, Homo sapiens
aauacuuccaaaucuagucauu

SEQ ID NO: 283047 - RNA, 22 nt, Homo sapiens
aauagugcugcaaaaacauacg

SEQ ID NO: 283048 - RNA, 22 nt, Homo sapiens
aauaugguuuuaugaagcaauu

SEQ ID NO: 283049 - RNA, 22 nt, Homo sapiens
aaucacaguuaguaagggagaa

SEQ ID NO: 283050 - RNA, 21 nt, Homo sapiens
aaucacugucuguuuccccuu

SEQ ID NO: 283051 - RNA, 23 nt, Homo sapiens
aaucugucuuuguuauagggguc

SEQ ID NO: 283052 - RNA, 22 nt, Homo sapiens
aaucugucuuuuguuauugagg

SEQ ID NO: 283053 - RNA, 22 nt, Homo sapiens
aaugaaguuagauguugagaag

SEQ ID NO: 283054 - RNA, 22 nt, Homo sapiens
aaugauacuguguacaagggca

SEQ ID NO: 283055 - RNA, 22 nt, Homo sapiens
aaugcacauaaaauccuccagg

SEQ ID NO: 283056 - RNA, 22 nt, Homo sapiens
aaugcauaauuuguaugaggua

SEQ ID NO: 283057 - RNA, 22 nt, Homo sapiens
aaugccaucagagaaaacucuu

SEQ ID NO: 283058 - RNA, 22 nt, Homo sapiens
aaugccuagugugugacaggug

SEQ ID NO: 283059 - RNA, 22 nt, Homo sapiens
aaugcuaucuggaacauuguug

SEQ ID NO: 283060 - RNA, 22 nt, Homo sapiens
aauggcaucuacguuaaauguc

SEQ ID NO: 283061 - RNA, 19 nt, Homo sapiens
aauggcuuuuccuguuccc

SEQ ID NO: 283062 - RNA, 22 nt, Homo sapiens
aaugugcacuauuagggugaua

SEQ ID NO: 283063 - RNA, 22 nt, Homo sapiens
aaugugcuguucagaggagucc

SEQ ID NO: 283064 - RNA, 22 nt, Homo sapiens
aauugguuaagauaagaucaua

SEQ ID NO: 283065 - RNA, 22 nt, Homo sapiens
acaaaguguuuucugaaggccu

SEQ ID NO: 283066 - RNA, 20 nt, Homo sapiens
acaaaugcauucugugacau

SEQ ID NO: 283067 - RNA, 22 nt, Homo sapiens
acaagugaauacaggauucucu

SEQ ID NO: 283068 - RNA, 22 nt, Homo sapiens
acacaguaaauauguauugaau

SEQ ID NO: 283069 - RNA, 22 nt, Homo sapiens
acacaguauaugacaaugcuuu

SEQ ID NO: 283070 - RNA, 22 nt, Homo sapiens
acacaugcuccacuguggccuc

SEQ ID NO: 283071 - RNA, 22 nt, Homo sapiens
acacaugugaaaaaaauguuac

SEQ ID NO: 283072 - RNA, 22 nt, Homo sapiens
acacaugugcguagacucuuua

SEQ ID NO: 283073 - RNA, 22 nt, Homo sapiens
acacauuagcaagugcuguuau

SEQ ID NO: 283074 - RNA, 22 nt, Homo sapiens
acaccaugucuguuucugguuu

SEQ ID NO: 283075 - RNA, 22 nt, Homo sapiens
acacuggaggagagcuguugcu

SEQ ID NO: 283076 - RNA, 22 nt, Homo sapiens
acacuggguaacauaucuguua

SEQ ID NO: 283077 - RNA, 22 nt, Homo sapiens
acacuguaacucuuugagggca

SEQ ID NO: 283078 - RNA, 22 nt, Homo sapiens
acacuguccaguuaggcuacau

SEQ ID NO: 283079 - RNA, 22 nt, Homo sapiens
acacuuucuggagcugcacaua

SEQ ID NO: 283080 - RNA, 22 nt, Homo sapiens
acagaacugggcuugcuuuugg

SEQ ID NO: 283081 - RNA, 22 nt, Homo sapiens
acagaucagagauauuuagguu

SEQ ID NO: 283082 - RNA, 22 nt, Homo sapiens
acagcacugccaagugacccau

SEQ ID NO: 283083 - RNA, 22 nt, Homo sapiens
acaggugaaguauuacacuaag

SEQ ID NO: 283084 - RNA, 22 nt, Homo sapiens
acaguacaugauaaauaaggua

SEQ ID NO: 283085 - RNA, 22 nt, Homo sapiens
acaguacuuuuggauuugugaa

SEQ ID NO: 283086 - RNA, 22 nt, Homo sapiens
acaguagugggcuacagaauca

SEQ ID NO: 283087 - RNA, 22 nt, Homo sapiens
acagugcuguuguguuuucacg

SEQ ID NO: 283088 - RNA, 19 nt, Homo sapiens
acagugcuuugucagaagc

SEQ ID NO: 283089 - RNA, 22 nt, Homo sapiens
acaguggaauguaggguuugag

SEQ ID NO: 283090 - RNA, 22 nt, Homo sapiens
acaguguagugacugccaacuu

SEQ ID NO: 283091 - RNA, 22 nt, Homo sapiens
acaguguguguguucaccuaga

SEQ ID NO: 283092 - RNA, 22 nt, Homo sapiens
acauaugaguacaugugccaug

SEQ ID NO: 283093 - RNA, 22 nt, Homo sapiens
acauccauuugcuuuauuugcu

SEQ ID NO: 283094 - RNA, 18 nt, Homo sapiens
acaucccaugcuggggug

SEQ ID NO: 283095 - RNA, 22 nt, Homo sapiens
acaucuguacaguggguguggu

SEQ ID NO: 283096 - RNA, 22 nt, Homo sapiens
acaugccucccugguccgcugu

SEQ ID NO: 283097 - RNA, 23 nt, Homo sapiens
acauguauagacuuuuuuuccuu

SEQ ID NO: 283098 - RNA, 22 nt, Homo sapiens
acauguauauaaugcauagcga

SEQ ID NO: 283099 - RNA, 22 nt, Homo sapiens
accacaggguaaaguuagauau

SEQ ID NO: 283100 - RNA, 17 nt, Homo sapiens
accagugcaugugcuuu

SEQ ID NO: 283101 - RNA, 22 nt, Homo sapiens
accaguguuuaccaaguagcau

SEQ ID NO: 283102 - RNA, 22 nt, Homo sapiens
acccacuagaugccaguggcac

SEQ ID NO: 283103 - RNA, 22 nt, Homo sapiens
acccaguaacauaugggaggga

SEQ ID NO: 283104 - RNA, 17 nt, Homo sapiens
acccagucuuuuugcac

SEQ ID NO: 283105 - RNA, 22 nt, Homo sapiens
acccugcuaaacagcccccugc

SEQ ID NO: 283106 - RNA, 22 nt, Homo sapiens
acccugguagcuaugaagucuu

SEQ ID NO: 283107 - RNA, 22 nt, Homo sapiens
acccuguaggacuauucuaauc

SEQ ID NO: 283108 - RNA, 22 nt, Homo sapiens
acccuguaguuagaaacuuuca

SEQ ID NO: 283109 - RNA, 22 nt, Homo sapiens
acccugucaaaacggaccaauc

SEQ ID NO: 283110 - RNA, 19 nt, Homo sapiens
acccuguccccaccuuuac

SEQ ID NO: 283111 - RNA, 22 nt, Homo sapiens
acccuuagguuaaaguugaguc

SEQ ID NO: 283112 - RNA, 22 nt, Homo sapiens
accugagauuacaggugcuggc

SEQ ID NO: 283113 - RNA, 22 nt, Homo sapiens
accuggacacuuugggcuccuc

SEQ ID NO: 283114 - RNA, 22 nt, Homo sapiens
accugggugcugaugggcuuua

SEQ ID NO: 283115 - RNA, 22 nt, Homo sapiens
accugugguuacagucugucuc

SEQ ID NO: 283116 - RNA, 22 nt, Homo sapiens
uccaguguuucuuccacuauuu

SEQ ID NO: 283117 - RNA, 19 nt, Homo sapiens
uccaugagcccacagugau

SEQ ID NO: 283118 - RNA, 22 nt, Homo sapiens
uccauggagacacauuuuauau

SEQ ID NO: 283119 - RNA, 22 nt, Homo sapiens
uccaugugaaaucuaugaggac

SEQ ID NO: 283120 - RNA, 22 nt, Homo sapiens
uccauuuguagguagugagaca

SEQ ID NO: 283121 - RNA, 22 nt, Homo sapiens
uccauuuguucagcuucaggaa

SEQ ID NO: 283122 - RNA, 22 nt, Homo sapiens
ucccagaaacgcauauguucau

SEQ ID NO: 283123 - RNA, 22 nt, Homo sapiens
ucccagucuagagccggauugg

SEQ ID NO: 283124 - RNA, 22 nt, Homo sapiens
uccccgaggcuggagugcagug

SEQ ID NO: 283125 - RNA, 22 nt, Homo sapiens
uccccgucacacgcaggcuuac

SEQ ID NO: 283126 - RNA, 22 nt, Homo sapiens
ucccgaggacaucugggggcaa

SEQ ID NO: 283127 - RNA, 20 nt, Homo sapiens
ucccucaaacuuuuccacug

SEQ ID NO: 283128 - RNA, 22 nt, Homo sapiens
ucccugaaaaauuggcuuaaca

SEQ ID NO: 283129 - RNA, 22 nt, Homo sapiens
ucccugaacacauguugagaag

SEQ ID NO: 283130 - RNA, 22 nt, Homo sapiens
ucccugaagcugcagcaacaca

SEQ ID NO: 283131 - RNA, 22 nt, Homo sapiens
ucccuguguccugggggcaccu

SEQ ID NO: 283132 - RNA, 22 nt, Homo sapiens
uccucaguggauuggauggugc

SEQ ID NO: 283133 - RNA, 22 nt, Homo sapiens
uccucauggagaaccucugcua

SEQ ID NO: 283134 - RNA, 22 nt, Homo sapiens
uccugagagcagacccucuaua

SEQ ID NO: 283135 - RNA, 20 nt, Homo sapiens
uccugagauucccaguucuc

SEQ ID NO: 283136 - RNA, 22 nt, Homo sapiens
uccugagucagcauccguuugu

SEQ ID NO: 283137 - RNA, 22 nt, Homo sapiens
uccugcauucugacuugcuuuc

SEQ ID NO: 283138 - RNA, 22 nt, Homo sapiens
uccuucaugcaucaauguaucc

SEQ ID NO: 283139 - RNA, 22 nt, Homo sapiens
uccuucauuugucaacucuagu

SEQ ID NO: 283140 - RNA, 22 nt, Homo sapiens
uccuugagccucccagacucag

SEQ ID NO: 283141 - RNA, 22 nt, Homo sapiens
uccuugagccugggaguuauag

SEQ ID NO: 283142 - RNA, 22 nt, Homo sapiens
uccuugagccuuaaauuauaaa

SEQ ID NO: 283143 - RNA, 22 nt, Homo sapiens
uccuugagucugaacuuuggau

SEQ ID NO: 283144 - RNA, 22 nt, Homo sapiens
uccuuggugacauuucuugucu

SEQ ID NO: 283145 - RNA, 22 nt, Homo sapiens
uccuuuggucaguauucuuuug

SEQ ID NO: 283146 - RNA, 22 nt, Homo sapiens
ucgcauuucccucuguagcuuc

SEQ ID NO: 283147 - RNA, 22 nt, Homo sapiens
ucguucuugucaguuuauaaag

SEQ ID NO: 283148 - RNA, 22 nt, Homo sapiens
ucuacccugugagggacacagu

SEQ ID NO: 283149 - RNA, 22 nt, Homo sapiens
ucuagcacuuacuggcugugug

SEQ ID NO: 283150 - RNA, 22 nt, Homo sapiens
ucucacagccauuucucccucu

SEQ ID NO: 283151 - RNA, 19 nt, Homo sapiens
ucucacagcucuacuaugu

SEQ ID NO: 283152 - RNA, 22 nt, Homo sapiens
ucucacaggguuauugaggggg

SEQ ID NO: 283153 - RNA, 22 nt, Homo sapiens
ucucagcacaaacaaaauugcu

SEQ ID NO: 283154 - RNA, 20 nt, Homo sapiens
ucucauggagguagagaaua

SEQ ID NO: 283155 - RNA, 22 nt, Homo sapiens
ucucauggcucacccugcauag

SEQ ID NO: 283156 - RNA, 21 nt, Homo sapiens
ucucauuacugaugagccaga

SEQ ID NO: 283157 - RNA, 23 nt, Homo sapiens
ucucauuccuugaaaauaaugac

SEQ ID NO: 283158 - RNA, 22 nt, Homo sapiens
ucucuagagagccugguguuca

SEQ ID NO: 283159 - RNA, 22 nt, Homo sapiens
ucucugacacugaccccaaaaa

SEQ ID NO: 283160 - RNA, 22 nt, Homo sapiens
ucucugguuuguggaaucuuag

SEQ ID NO: 283161 - RNA, 22 nt, Homo sapiens
ucucuguuuauuuuugguguau

SEQ ID NO: 283162 - RNA, 22 nt, Homo sapiens
ucucuguuugucuguuacuggu

SEQ ID NO: 283163 - RNA, 22 nt, Homo sapiens
ucucuuggugacuuaaaauguu

SEQ ID NO: 283164 - RNA, 22 nt, Homo sapiens
ucugacaaugaacaaucuauag

SEQ ID NO: 283165 - RNA, 19 nt, Homo sapiens
ucugacagccccagucaac

SEQ ID NO: 283166 - RNA, 22 nt, Homo sapiens
ucugacucugugaugggcccaa

SEQ ID NO: 283167 - RNA, 22 nt, Homo sapiens
ucugagacuguuucuaacaagc

SEQ ID NO: 283168 - RNA, 22 nt, Homo sapiens
ucugagaucaugucugugcugu

SEQ ID NO: 283169 - RNA, 22 nt, Homo sapiens
ucugagcaugcaucuugccugg

SEQ ID NO: 283170 - RNA, 22 nt, Homo sapiens
ucugagguuaaauuuuauaguu

SEQ ID NO: 283171 - RNA, 22 nt, Homo sapiens
ucugagguuacugcuuuguaga

SEQ ID NO: 283172 - RNA, 23 nt, Homo sapiens
ucugauguuauaaaauucuuugg

SEQ ID NO: 283173 - RNA, 22 nt, Homo sapiens
ucugccuuuucaugugggaugg

SEQ ID NO: 283174 - RNA, 21 nt, Homo sapiens
ucuggcccccucaaaucucau

SEQ ID NO: 283175 - RNA, 21 nt, Homo sapiens
ucuggccccuccaaaucucau

SEQ ID NO: 283176 - RNA, 22 nt, Homo sapiens
ucuggcuccaaagucuauuuuu

SEQ ID NO: 283177 - RNA, 16 nt, Homo sapiens
ucuggcucuacaguuc

SEQ ID NO: 283178 - RNA, 18 nt, Homo sapiens
ucuggcuucuuuguucca

SEQ ID NO: 283179 - RNA, 22 nt, Homo sapiens
ucuggcuuuagcaugugggaag

SEQ ID NO: 283180 - RNA, 22 nt, Homo sapiens
ucuggcuuucuuuacuuaaugu

SEQ ID NO: 283181 - RNA, 23 nt, Homo sapiens
ucuggcuuugggaugcucaaggg

SEQ ID NO: 283182 - RNA, 22 nt, Homo sapiens
ucugguuccugcauucauucaa

SEQ ID NO: 283183 - RNA, 22 nt, Homo sapiens
ucuguggucagcauccgccacu

SEQ ID NO: 283184 - RNA, 22 nt, Homo sapiens
ucugugguucaggcuggagugc

SEQ ID NO: 283185 - RNA, 22 nt, Homo sapiens
ucuguguuuagacccaggguag

SEQ ID NO: 283186 - RNA, 22 nt, Homo sapiens
ucuguuguuaucauaauauuga

SEQ ID NO: 283187 - RNA, 22 nt, Homo sapiens
ggacaucauuaccauggaccca

SEQ ID NO: 283188 - RNA, 22 nt, Homo sapiens
ggacuagaggugaaaagaagac

SEQ ID NO: 283189 - RNA, 22 nt, Homo sapiens
ggacugagaggacuacagugua

SEQ ID NO: 283190 - RNA, 22 nt, Homo sapiens
ggagcugugauuugaguccaga

SEQ ID NO: 283191 - RNA, 22 nt, Homo sapiens
ggagguagguuugugauuugua

SEQ ID NO: 283192 - RNA, 22 nt, Homo sapiens
uggcacaaugacccuugugggc

SEQ ID NO: 283193 - RNA, 22 nt, Homo sapiens
uggcacuaugugacaagguuuu

SEQ ID NO: 283194 - RNA, 22 nt, Homo sapiens
uggcagugggagauauuuuauu

SEQ ID NO: 283195 - RNA, 22 nt, Homo sapiens
uggcaguuuugauguggagaga

SEQ ID NO: 283196 - RNA, 19 nt, Homo sapiens
uggcaugaaugugaacuaa

SEQ ID NO: 283197 - RNA, 22 nt, Homo sapiens
uggcauguagucugggaccugg

SEQ ID NO: 283198 - RNA, 22 nt, Homo sapiens
uggcauguuggguguugacucc

SEQ ID NO: 283199 - RNA, 22 nt, Homo sapiens
uggccuuuuccaagaacuacua

SEQ ID NO: 283200 - RNA, 22 nt, Homo sapiens
uggcuagaccugcauaacagcu

SEQ ID NO: 283201 - RNA, 19 nt, Homo sapiens
uggcuagaggccaggcguu

SEQ ID NO: 283202 - RNA, 22 nt, Homo sapiens
uggcuccguuguacaggcugga

SEQ ID NO: 283203 - RNA, 22 nt, Homo sapiens
uggcuguuuauuucaccugggc

SEQ ID NO: 283204 - RNA, 21 nt, Homo sapiens
uggcuguuuucaugcuagaac

SEQ ID NO: 283205 - RNA, 22 nt, Homo sapiens
uggcuuuuguuauuuggaagcu

SEQ ID NO: 283206 - RNA, 20 nt, Homo sapiens
ugggaaauguccaggacaua

SEQ ID NO: 283207 - RNA, 22 nt, Homo sapiens
ugggaagauucuguguuuuucc

SEQ ID NO: 283208 - RNA, 22 nt, Homo sapiens
ugggaauaugauacaggucuuu

SEQ ID NO: 283209 - RNA, 22 nt, Homo sapiens
ugggagcauugcauuagaagcc

SEQ ID NO: 283210 - RNA, 22 nt, Homo sapiens
ugggaucuuuccuauuagcgag

SEQ ID NO: 283211 - RNA, 22 nt, Homo sapiens
ugggaugaaaauagcuucuucc

SEQ ID NO: 283212 - RNA, 22 nt, Homo sapiens
ugggaugaugcuugagaauauc

SEQ ID NO: 283213 - RNA, 22 nt, Homo sapiens
ugggcaagagagcaugacccug

SEQ ID NO: 283214 - RNA, 21 nt, Homo sapiens
ugggccccuuccuuacaucau

SEQ ID NO: 283215 - RNA, 22 nt, Homo sapiens
ugggguaggcuguauacucugu

SEQ ID NO: 283216 - RNA, 22 nt, Homo sapiens
uggggucguaggugcccgccag

SEQ ID NO: 283217 - RNA, 22 nt, Homo sapiens
uggguagagaaucaggaucuua

SEQ ID NO: 283218 - RNA, 22 nt, Homo sapiens
uggguaggaccagaaaugcacu

SEQ ID NO: 283219 - RNA, 22 nt, Homo sapiens
ugggucaguagcauguaugucu

SEQ ID NO: 283220 - RNA, 23 nt, Homo sapiens
ugggucaguuuuucugacaucau

SEQ ID NO: 283221 - RNA, 22 nt, Homo sapiens
uggguucccugucuguccuuga

SEQ ID NO: 283222 - RNA, 22 nt, Homo sapiens
ugguacuucaugcucacagaua

SEQ ID NO: 283223 - RNA, 17 nt, Homo sapiens
ugguagguuuuucuggc

SEQ ID NO: 283224 - RNA, 22 nt, Homo sapiens
ugguaugucuagauggggaagu

SEQ ID NO: 283225 - RNA, 22 nt, Homo sapiens
ugguauguuuauaaguauagga

SEQ ID NO: 283226 - RNA, 22 nt, Homo sapiens
uggucaaaucugaugugagaaa

SEQ ID NO: 283227 - RNA, 22 nt, Homo sapiens
uggucagaaaauuacuugauau

SEQ ID NO: 283228 - RNA, 22 nt, Homo sapiens
uggucagaugcugaguggaucu

SEQ ID NO: 283229 - RNA, 22 nt, Homo sapiens
augauacugaguugaguucuca

SEQ ID NO: 283230 - RNA, 22 nt, Homo sapiens
augauaucuuguuuuucaugca

SEQ ID NO: 283231 - RNA, 22 nt, Homo sapiens
augauauggguugucaguugua

SEQ ID NO: 283232 - RNA, 22 nt, Homo sapiens
augaucacuguggaaauucagc

SEQ ID NO: 283233 - RNA, 22 nt, Homo sapiens
augauggagguagauuguccau

SEQ ID NO: 283234 - RNA, 22 nt, Homo sapiens
augauuguucucacucaagaga

SEQ ID NO: 283235 - RNA, 22 nt, Homo sapiens
augauuuuuguaucgccugaug

SEQ ID NO: 283236 - RNA, 22 nt, Homo sapiens
augcaaacaucauagaguguac

SEQ ID NO: 283237 - RNA, 22 nt, Homo sapiens
augcaaacaucugaagagacau

SEQ ID NO: 283238 - RNA, 22 nt, Homo sapiens
augcacauauguacugcccuau

SEQ ID NO: 283239 - RNA, 22 nt, Homo sapiens
augcacaugcgaaaacuugugu

SEQ ID NO: 283240 - RNA, 22 nt, Homo sapiens
augcacuguuguuauuggauaa

SEQ ID NO: 283241 - RNA, 22 nt, Homo sapiens
augcacuguuuucuugaugaga

SEQ ID NO: 283242 - RNA, 22 nt, Homo sapiens
augcagugugcaacagauuaag

SEQ ID NO: 283243 - RNA, 22 nt, Homo sapiens
augcauagcaucugcaaauguu

SEQ ID NO: 283244 - RNA, 22 nt, Homo sapiens
augcauauuuuaccuagaagag

SEQ ID NO: 283245 - RNA, 22 nt, Homo sapiens
augcauggcagagucaggguac

SEQ ID NO: 283246 - RNA, 22 nt, Homo sapiens
augccacugcacuucagcuugg

SEQ ID NO: 283247 - RNA, 22 nt, Homo sapiens
augccacuucucuaagucaugu

SEQ ID NO: 283248 - RNA, 22 nt, Homo sapiens
augcuacugaccccuacuuaca

SEQ ID NO: 283249 - RNA, 21 nt, Homo sapiens
auggaaagacugccucuucaa

SEQ ID NO: 283250 - RNA, 22 nt, Homo sapiens
auggaacugaagugcugcccuu

SEQ ID NO: 283251 - RNA, 22 nt, Homo sapiens
auggaacuggagaucauuaugu

SEQ ID NO: 283252 - RNA, 22 nt, Homo sapiens
auggaacuggagaugguuauau

SEQ ID NO: 283253 - RNA, 22 nt, Homo sapiens
auggaagcugauuagauaguac

SEQ ID NO: 283254 - RNA, 22 nt, Homo sapiens
auggaaggagaggaaugaauga

SEQ ID NO: 283255 - RNA, 22 nt, Homo sapiens
auggaaugccauuuauaaugga

SEQ ID NO: 283256 - RNA, 22 nt, Homo sapiens
auggaaugguugggucauaagg

SEQ ID NO: 283257 - RNA, 22 nt, Homo sapiens
auggaauguauagucauguagg

SEQ ID NO: 283258 - RNA, 22 nt, Homo sapiens
auggaauguggaaugguaagua

SEQ ID NO: 283259 - RNA, 22 nt, Homo sapiens
auggacagaaaaaaauagaugu

SEQ ID NO: 283260 - RNA, 22 nt, Homo sapiens
auggacagacacuggccuucug

SEQ ID NO: 283261 - RNA, 22 nt, Homo sapiens
auggagaugugcgaacugagua

SEQ ID NO: 283262 - RNA, 22 nt, Homo sapiens
auggagcuugacaguuguagag

SEQ ID NO: 283263 - RNA, 22 nt, Homo sapiens
auggaggacaaugucaccuuca

SEQ ID NO: 283264 - RNA, 22 nt, Homo sapiens
auggaggaggaagcugaaacaa

SEQ ID NO: 283265 - RNA, 21 nt, Homo sapiens
uuauccagcacuguuucggac

SEQ ID NO: 283266 - RNA, 22 nt, Homo sapiens
uuaucucagugaacugagugga

SEQ ID NO: 283267 - RNA, 22 nt, Homo sapiens
uuaugguuuauuagcaggguua

SEQ ID NO: 283268 - RNA, 22 nt, Homo sapiens
uuaugguuuuucugugagaugg

SEQ ID NO: 283269 - RNA, 22 nt, Homo sapiens
uuaugugccuuuuugccauuca

SEQ ID NO: 283270 - RNA, 22 nt, Homo sapiens
uuauucauuaauugcuaagguu

SEQ ID NO: 283271 - RNA, 22 nt, Homo sapiens
uucaaaguaaaaauguguucac

SEQ ID NO: 283272 - RNA, 22 nt, Homo sapiens
uucaaaguguugguuuugggcu

SEQ ID NO: 283273 - RNA, 23 nt, Homo sapiens
uucaacagguagacccucccugc

SEQ ID NO: 283274 - RNA, 22 nt, Homo sapiens
uucaagaauuaaaguggcuuuu

SEQ ID NO: 283275 - RNA, 22 nt, Homo sapiens
uucaaggacuaaggauuuuugg

SEQ ID NO: 283276 - RNA, 22 nt, Homo sapiens
uucaaguaagaaagacaucagg

SEQ ID NO: 283277 - RNA, 22 nt, Homo sapiens
uucaaguaguucucaugccuca

SEQ ID NO: 283278 - RNA, 20 nt, Homo sapiens
uucaagugauucucaugccu

SEQ ID NO: 283279 - RNA, 22 nt, Homo sapiens
uucaaguguucaggagcuacag

SEQ ID NO: 283280 - RNA, 22 nt, Homo sapiens
uucacacugggccuacucugug

SEQ ID NO: 283281 - RNA, 22 nt, Homo sapiens
uucacgguguucacgggggucc

SEQ ID NO: 283282 - RNA, 21 nt, Homo sapiens
uucacuggucuauuucccuuu

SEQ ID NO: 283283 - RNA, 22 nt, Homo sapiens
uucagagagggagggauaccua

SEQ ID NO: 283284 - RNA, 22 nt, Homo sapiens
uucagauugcauaccgaaagua

SEQ ID NO: 283285 - RNA, 22 nt, Homo sapiens
uucagcacugaaaauaugucau

SEQ ID NO: 283286 - RNA, 22 nt, Homo sapiens
uucagcaguggccaguggaaau

SEQ ID NO: 283287 - RNA, 22 nt, Homo sapiens
auuuuugguugucagcacuagg

SEQ ID NO: 283288 - RNA, 22 nt, Homo sapiens
caaaagugauugcgguuuuugc

SEQ ID NO: 283289 - RNA, 22 nt, Homo sapiens
caaaggugcuuuccagguccaa

SEQ ID NO: 283290 - RNA, 22 nt, Homo sapiens
caaaguaauugcuguuuugcca

SEQ ID NO: 283291 - RNA, 22 nt, Homo sapiens
caaagucuucucauuaugucuu

SEQ ID NO: 283292 - RNA, 22 nt, Homo sapiens
caaagugcuggaauuggccggg

SEQ ID NO: 283293 - RNA, 22 nt, Homo sapiens
caaagugcugggacuggccggg

SEQ ID NO: 283294 - RNA, 22 nt, Homo sapiens
caaauacuuucauguugucuug

SEQ ID NO: 283295 - RNA, 22 nt, Homo sapiens
caaauccucaccucaucaugaa

SEQ ID NO: 283296 - RNA, 22 nt, Homo sapiens
caagaucauuuaugcuaaaauu

SEQ ID NO: 283297 - RNA, 22 nt, Homo sapiens
caaggcacagccccuacuuccu

SEQ ID NO: 283298 - RNA, 22 nt, Homo sapiens
caagguacuuuuacaauuuccc

SEQ ID NO: 283299 - RNA, 22 nt, Homo sapiens
caagugcuugaugaaugaucaa

SEQ ID NO: 283300 - RNA, 22 nt, Homo sapiens
caauacuguuaccugaaauagg

SEQ ID NO: 283301 - RNA, 21 nt, Homo sapiens
caauggcacaaucucugcuca

SEQ ID NO: 283302 - RNA, 22 nt, Homo sapiens
cacaaaguagauuagucuucca

SEQ ID NO: 283303 - RNA, 22 nt, Homo sapiens
cacaccuaccucauuauggaca

SEQ ID NO: 283304 - RNA, 22 nt, Homo sapiens
cacaccuacuagggccgugggc

SEQ ID NO: 283305 - RNA, 22 nt, Homo sapiens
cacacuguuuuccauggggguu

SEQ ID NO: 283306 - RNA, 22 nt, Homo sapiens
cacagcacaggcaugaguguca

SEQ ID NO: 283307 - RNA, 22 nt, Homo sapiens
cacaggaagaggcacggucccu

SEQ ID NO: 283308 - RNA, 22 nt, Homo sapiens
cacaguguuacugguaugaagu

SEQ ID NO: 283309 - RNA, 22 nt, Homo sapiens
cacaguguuccagcuauuugaa

SEQ ID NO: 283310 - RNA, 22 nt, Homo sapiens
cacauagucccugcuaaucuuc

SEQ ID NO: 283311 - RNA, 23 nt, Homo sapiens
caccaguagaaugugugggaggg

SEQ ID NO: 283312 - RNA, 22 nt, Homo sapiens
caccugagcgggaugcucgccu

SEQ ID NO: 283313 - RNA, 22 nt, Homo sapiens
caccuguagucccagcugaggc

SEQ ID NO: 283314 - RNA, 22 nt, Homo sapiens
cacuaggcuggagugcaguggc

SEQ ID NO: 283315 - RNA, 22 nt, Homo sapiens
cacucaguuugugguacuuugu

SEQ ID NO: 283316 - RNA, 22 nt, Homo sapiens
cacugcacuccagcuuugguga

SEQ ID NO: 283317 - RNA, 22 nt, Homo sapiens
cacugcauccuccaccuccugg

SEQ ID NO: 283318 - RNA, 22 nt, Homo sapiens
cacugcauggucuagcuggguu

SEQ ID NO: 283319 - RNA, 22 nt, Homo sapiens
cacugcgaccuccaccucccgg

SEQ ID NO: 283320 - RNA, 22 nt, Homo sapiens
cacuggacauguugaagcuuuu

SEQ ID NO: 283321 - RNA, 22 nt, Homo sapiens
cacuggcacuguguuuagaugg

SEQ ID NO: 283322 - RNA, 22 nt, Homo sapiens
cacugggugccauauguuugcu

SEQ ID NO: 283323 - RNA, 21 nt, Homo sapiens
cacuggguucaggcuugugga

SEQ ID NO: 283324 - RNA, 22 nt, Homo sapiens
cacuggucucauggcaugagag

SEQ ID NO: 283325 - RNA, 22 nt, Homo sapiens
cagagaucaugcaacugcucgc

SEQ ID NO: 283326 - RNA, 20 nt, Homo sapiens
cagagcaaagcaguccuggc

SEQ ID NO: 283327 - RNA, 22 nt, Homo sapiens
cagagcaaugcuuuugcuuuga

SEQ ID NO: 283328 - RNA, 22 nt, Homo sapiens
cagagcacugauacuggguucu

SEQ ID NO: 283329 - RNA, 22 nt, Homo sapiens
cagagucaagcucuuguuccau

SEQ ID NO: 283330 - RNA, 22 nt, Homo sapiens
cagauacucauggaacuggguu

SEQ ID NO: 283331 - RNA, 22 nt, Homo sapiens
cagauaguuguagauaugcagc

SEQ ID NO: 283332 - RNA, 22 nt, Homo sapiens
cagaugcaugaccugggcuugg

SEQ ID NO: 283333 - RNA, 22 nt, Homo sapiens
cagauguaguauuuuagugaaa

SEQ ID NO: 283334 - RNA, 20 nt, Homo sapiens
cagcaaccugcucucuuccu

SEQ ID NO: 283335 - RNA, 23 nt, Homo sapiens
cagcuggugauuuuaaguugaag

SEQ ID NO: 283336 - RNA, 22 nt, Homo sapiens
caggcacgcuugggagacacac

SEQ ID NO: 283337 - RNA, 22 nt, Homo sapiens
augcaaggaugguuagauauau

SEQ ID NO: 283338 - RNA, 22 nt, Homo sapiens
augcaauggaaaggacaauuac

SEQ ID NO: 283339 - RNA, 22 nt, Homo sapiens
augcacaucagcuccagggacc

SEQ ID NO: 283340 - RNA, 22 nt, Homo sapiens
augcagagucccagccccuagc

SEQ ID NO: 283341 - RNA, 22 nt, Homo sapiens
augcagaucacauuuuucuguc

SEQ ID NO: 283342 - RNA, 22 nt, Homo sapiens
augcagcugaggguaguggagc

SEQ ID NO: 283343 - RNA, 18 nt, Homo sapiens
augcauauuuuaaguugu

SEQ ID NO: 283344 - RNA, 22 nt, Homo sapiens
augcauggagucuuucacaagu

SEQ ID NO: 283345 - RNA, 22 nt, Homo sapiens
augcaugucaaauuuguagguu

SEQ ID NO: 283346 - RNA, 22 nt, Homo sapiens
augccaagagacaaagggaauc

SEQ ID NO: 283347 - RNA, 22 nt, Homo sapiens
augccaagaugagcacgcgucu

SEQ ID NO: 283348 - RNA, 20 nt, Homo sapiens
augccacugagcagugguga

SEQ ID NO: 283349 - RNA, 22 nt, Homo sapiens
augccacugcacuccaaccugg

SEQ ID NO: 283350 - RNA, 22 nt, Homo sapiens
augccacugcgcucuagccugg

SEQ ID NO: 283351 - RNA, 22 nt, Homo sapiens
augccacuguccuccugccuag

SEQ ID NO: 283352 - RNA, 19 nt, Homo sapiens
augccucaguuuuguacuu

SEQ ID NO: 283353 - RNA, 19 nt, Homo sapiens
augccuggagaugguuaua

SEQ ID NO: 283354 - RNA, 22 nt, Homo sapiens
augcuacauucuacaauuaggc

SEQ ID NO: 283355 - RNA, 22 nt, Homo sapiens
augcuuguugcagccugagccu

SEQ ID NO: 283356 - RNA, 19 nt, Homo sapiens
auggaacugcuggagccac

SEQ ID NO: 283357 - RNA, 22 nt, Homo sapiens
auggaagaaacgauuuucugga

SEQ ID NO: 283358 - RNA, 22 nt, Homo sapiens
auggaagucucuguuaaguuuc

SEQ ID NO: 283359 - RNA, 21 nt, Homo sapiens
auggacugugugacccugcac

SEQ ID NO: 283360 - RNA, 22 nt, Homo sapiens
auggagaugaauaucaucuguu

SEQ ID NO: 283361 - RNA, 22 nt, Homo sapiens
auggaggccuacagaauuuugg

SEQ ID NO: 283362 - RNA, 22 nt, Homo sapiens
auggaucuuucugcuuuugaau

SEQ ID NO: 283363 - RNA, 22 nt, Homo sapiens
auggcaaaauguuccuaguggu

SEQ ID NO: 283364 - RNA, 22 nt, Homo sapiens
auggcacagacucuuggucaag

SEQ ID NO: 283365 - RNA, 22 nt, Homo sapiens
auggcacagaguagaugcucaa

SEQ ID NO: 283366 - RNA, 22 nt, Homo sapiens
auggcacuacugggaaugucuu

SEQ ID NO: 283367 - RNA, 22 nt, Homo sapiens
auggcacuccagccugggcaac

SEQ ID NO: 283368 - RNA, 22 nt, Homo sapiens
ucuuuugggccucuugucagac

SEQ ID NO: 283369 - RNA, 22 nt, Homo sapiens
ucuuuuguucuauucaggccuu

SEQ ID NO: 283370 - RNA, 22 nt, Homo sapiens
ugaaacauacacucugaugggg

SEQ ID NO: 283371 - RNA, 22 nt, Homo sapiens
ugaaacugcagugggcuuggca

SEQ ID NO: 283372 - RNA, 22 nt, Homo sapiens
ugaaagcuacagucuccuagga

SEQ ID NO: 283373 - RNA, 22 nt, Homo sapiens
ugaaagguuuaauucugugaga

SEQ ID NO: 283374 - RNA, 22 nt, Homo sapiens
ugaaauacuuuggcucuuuguu

SEQ ID NO: 283375 - RNA, 22 nt, Homo sapiens
ugaaauggaagaagucccuuuu

SEQ ID NO: 283376 - RNA, 22 nt, Homo sapiens
ugaagacucauacuugaaucag

SEQ ID NO: 283377 - RNA, 22 nt, Homo sapiens
ugaaggccgggcaugguggcuc

SEQ ID NO: 283378 - RNA, 21 nt, Homo sapiens
ugaauacugcugcucccuuug

SEQ ID NO: 283379 - RNA, 22 nt, Homo sapiens
ugaaucaugcugcuauaaagac

SEQ ID NO: 283380 - RNA, 22 nt, Homo sapiens
ugaaugcuucaugucugggcug

SEQ ID NO: 283381 - RNA, 21 nt, Homo sapiens
ugaaugcuuuaaauauuagaa

SEQ ID NO: 283382 - RNA, 22 nt, Homo sapiens
ugaauguaagaugucugcuggu

SEQ ID NO: 283383 - RNA, 22 nt, Homo sapiens
ugaauguacuuaacacuggauu

SEQ ID NO: 283384 - RNA, 23 nt, Homo sapiens
ugacaagagcgagacuuggucuc

SEQ ID NO: 283385 - RNA, 22 nt, Homo sapiens
ugacaagcucccucugcaccuu

SEQ ID NO: 283386 - RNA, 22 nt, Homo sapiens
ugacaaguaaacagucagcacc

SEQ ID NO: 283387 - RNA, 18 nt, Homo sapiens
ugacaaugcuaguccugg

SEQ ID NO: 283388 - RNA, 21 nt, Homo sapiens
ugacagaaaauugaguuugcu

SEQ ID NO: 283389 - RNA, 22 nt, Homo sapiens
ugacagguugauaggugcagca

SEQ ID NO: 283390 - RNA, 22 nt, Homo sapiens
ugacaguaaacagucuugauua

SEQ ID NO: 283391 - RNA, 22 nt, Homo sapiens
ugacagucaccaggacccacag

SEQ ID NO: 283392 - RNA, 22 nt, Homo sapiens
ugacagugaauaagucucuuaa

SEQ ID NO: 283393 - RNA, 23 nt, Homo sapiens
ugacagugcuugaaauugcucuu

SEQ ID NO: 283394 - RNA, 18 nt, Homo sapiens
ugacaucauuuagaaagg

SEQ ID NO: 283395 - RNA, 22 nt, Homo sapiens
ugacauguauaucuuacgcuau

SEQ ID NO: 283396 - RNA, 22 nt, Homo sapiens
ugacccuguggcagcgucuaag

SEQ ID NO: 283397 - RNA, 22 nt, Homo sapiens
ugacggaggcauuggaagcuug

SEQ ID NO: 283398 - RNA, 22 nt, Homo sapiens
ugacuagugcccuuugcugccu

SEQ ID NO: 283399 - RNA, 22 nt, Homo sapiens
ugacuaguuugaggacauuaua

SEQ ID NO: 283400 - RNA, 22 nt, Homo sapiens
ugacuaguuuugcuguuguuau

SEQ ID NO: 283401 - RNA, 22 nt, Homo sapiens
ugacuauaaauaagcaagggcu

SEQ ID NO: 283402 - RNA, 22 nt, Homo sapiens
ugacucaguuucucagguagua

SEQ ID NO: 283403 - RNA, 22 nt, Homo sapiens
ugacuccagagacugugcuguc

SEQ ID NO: 283404 - RNA, 22 nt, Homo sapiens
ugacuggagucuugcucugucg

SEQ ID NO: 283405 - RNA, 22 nt, Homo sapiens
ugacuugaaguuaccauaugca

SEQ ID NO: 283406 - RNA, 22 nt, Homo sapiens
ugacuugaucacccccuaaggg

SEQ ID NO: 283407 - RNA, 22 nt, Homo sapiens
ugacuugaucauuacacauucu

SEQ ID NO: 283408 - RNA, 22 nt, Homo sapiens
ugagaacagauggcuuuauuau

SEQ ID NO: 283409 - RNA, 17 nt, Homo sapiens
ugagaacaugugguauu

SEQ ID NO: 283410 - RNA, 19 nt, Homo sapiens
ugagaaccucuacagaguc

SEQ ID NO: 283411 - RNA, 22 nt, Homo sapiens
ugagaaugaugauugguaaacc

SEQ ID NO: 283412 - RNA, 22 nt, Homo sapiens
ugagaaugcagaaucucgugca

SEQ ID NO: 283413 - RNA, 22 nt, Homo sapiens
ugagacacugaauccggccuga

SEQ ID NO: 283414 - RNA, 22 nt, Homo sapiens
ugagacauauuauacugcuuuu

SEQ ID NO: 283415 - RNA, 22 nt, Homo sapiens
ugagacugagucucccucuguc

SEQ ID NO: 283416 - RNA, 22 nt, Homo sapiens
ugagacugaguuuugcucguug

SEQ ID NO: 283417 - RNA, 22 nt, Homo sapiens
ugagacugauaggacauuuucu

SEQ ID NO: 283418 - RNA, 22 nt, Homo sapiens
ugagaggugaauggcaggcuca

SEQ ID NO: 283419 - RNA, 22 nt, Homo sapiens
ugagauaaggaaauugaggcuc

SEQ ID NO: 283420 - RNA, 22 nt, Homo sapiens
ugagauaguacuuuuuuaaagg

SEQ ID NO: 283421 - RNA, 22 nt, Homo sapiens
ugagauaguuguagauguacau

SEQ ID NO: 283422 - RNA, 22 nt, Homo sapiens
ugagauauugggaguaauguca

SEQ ID NO: 283423 - RNA, 22 nt, Homo sapiens
ugagaucaagauguuagggacu

SEQ ID NO: 283424 - RNA, 22 nt, Homo sapiens
ugagaucacuaagagguaaugg

SEQ ID NO: 283425 - RNA, 22 nt, Homo sapiens
ugagaucagugaagaaguguuu

SEQ ID NO: 283426 - RNA, 22 nt, Homo sapiens
ugagaucgagucucgcucuguc

SEQ ID NO: 283427 - RNA, 22 nt, Homo sapiens
ugagaucuuaccuuccugccuu

SEQ ID NO: 283428 - RNA, 22 nt, Homo sapiens
ugagaucuucgcucuucacaga

SEQ ID NO: 283429 - RNA, 19 nt, Homo sapiens
ugagaugaagacagggguu

SEQ ID NO: 283430 - RNA, 22 nt, Homo sapiens
ugagaugaguucucgcucuguc

SEQ ID NO: 283431 - RNA, 22 nt, Homo sapiens
ugagaugaucaaaguauaggcu

SEQ ID NO: 283432 - RNA, 22 nt, Homo sapiens
ugagaugcucgccggccagcau

SEQ ID NO: 283433 - RNA, 22 nt, Homo sapiens
ugagauggagucuugucgccua

SEQ ID NO: 283434 - RNA, 22 nt, Homo sapiens
ugagaugguaaauuuuuguugu

SEQ ID NO: 283435 - RNA, 22 nt, Homo sapiens
ugagauguuuagauuguugucu

SEQ ID NO: 283436 - RNA, 22 nt, Homo sapiens
ugagauguuuguuucagugccu

SEQ ID NO: 283437 - RNA, 23 nt, Homo sapiens
ugagauuacccagaaagaguaua

SEQ ID NO: 283438 - RNA, 23 nt, Homo sapiens
ugagauuauaaucuuuuacuucu

SEQ ID NO: 283439 - RNA, 22 nt, Homo sapiens
uugagauggagucucacgcauu

SEQ ID NO: 283440 - RNA, 22 nt, Homo sapiens
uugagauggagucucacucuuc

SEQ ID NO: 283441 - RNA, 22 nt, Homo sapiens
uugagauggagucucacucuuu

SEQ ID NO: 283442 - RNA, 22 nt, Homo sapiens
uugagauggagucucacugugu

SEQ ID NO: 283443 - RNA, 22 nt, Homo sapiens
uugagauggagucucgcucuuu

SEQ ID NO: 283444 - RNA, 22 nt, Homo sapiens
uugagauggagucucgcugugu

SEQ ID NO: 283445 - RNA, 22 nt, Homo sapiens
uugagauggaguuucgcucuuu

SEQ ID NO: 283446 - RNA, 22 nt, Homo sapiens
uugagauguaagauguuaauau

SEQ ID NO: 283447 - RNA, 19 nt, Homo sapiens
uugagaugugaacucacac

SEQ ID NO: 283448 - RNA, 22 nt, Homo sapiens
uugagcaaugaacgauucaggg

SEQ ID NO: 283449 - RNA, 22 nt, Homo sapiens
uugagcacaguagguuguggcu

SEQ ID NO: 283450 - RNA, 22 nt, Homo sapiens
uugagcuuuuuacuuguccaau

SEQ ID NO: 283451 - RNA, 22 nt, Homo sapiens
uugaggaaugugauuucaaaua

SEQ ID NO: 283452 - RNA, 22 nt, Homo sapiens
uugaggaggcagucucuccauu

SEQ ID NO: 283453 - RNA, 16 nt, Homo sapiens
uugaggcaugucucag

SEQ ID NO: 283454 - RNA, 22 nt, Homo sapiens
uugagggaaacauucacaucau

SEQ ID NO: 283455 - RNA, 22 nt, Homo sapiens
uugagggaagccagaggucugc

SEQ ID NO: 283456 - RNA, 22 nt, Homo sapiens
uugagggcugaauaccaaucag

SEQ ID NO: 283457 - RNA, 22 nt, Homo sapiens
uugaggucuucaggaucaggcu

SEQ ID NO: 283458 - RNA, 22 nt, Homo sapiens
uugaggugaagggcagagcagc

SEQ ID NO: 283459 - RNA, 22 nt, Homo sapiens
uugagguggugucuugcucugu

SEQ ID NO: 283460 - RNA, 22 nt, Homo sapiens
uugagguguauuguacagcaca

SEQ ID NO: 283461 - RNA, 20 nt, Homo sapiens
uugaggugugaggggcagag

SEQ ID NO: 283462 - RNA, 19 nt, Homo sapiens
uugauaugauuaggagcac

SEQ ID NO: 283463 - RNA, 22 nt, Homo sapiens
uugauaugcuugucaguccauu

SEQ ID NO: 283464 - RNA, 22 nt, Homo sapiens
uugauauguuguuagauucagu

SEQ ID NO: 283465 - RNA, 22 nt, Homo sapiens
uugauauuaaguacugaagugg

SEQ ID NO: 283466 - RNA, 22 nt, Homo sapiens
uugaucaaaucugagugagaau

SEQ ID NO: 283467 - RNA, 22 nt, Homo sapiens
uugaucaauagaauacaacaga

SEQ ID NO: 283468 - RNA, 22 nt, Homo sapiens
uugaucuaugugucuguuuuua

SEQ ID NO: 283469 - RNA, 22 nt, Homo sapiens
uugaucugugucccugcccaau

SEQ ID NO: 283470 - RNA, 22 nt, Homo sapiens
uugcaacauguauucuggugau

SEQ ID NO: 283471 - RNA, 22 nt, Homo sapiens
uugcaacuuagaaaaaucauuu

SEQ ID NO: 283472 - RNA, 22 nt, Homo sapiens
uugcaagugccguaacuaccaa

SEQ ID NO: 283473 - RNA, 22 nt, Homo sapiens
uugcaaugugaugugauuugga

SEQ ID NO: 283474 - RNA, 22 nt, Homo sapiens
uugcacaauccugugagugagu

SEQ ID NO: 283475 - RNA, 22 nt, Homo sapiens
uugcacagucuagcuccaccuu

SEQ ID NO: 283476 - RNA, 22 nt, Homo sapiens
uugcacauggcaggugcucaau

SEQ ID NO: 283477 - RNA, 22 nt, Homo sapiens
uugcacauugauuuuguauccu

SEQ ID NO: 283478 - RNA, 22 nt, Homo sapiens
uugcacuucauguaggccaaag

SEQ ID NO: 283479 - RNA, 22 nt, Homo sapiens
uugcacuuccgccugggugaca

SEQ ID NO: 283480 - RNA, 22 nt, Homo sapiens
uugcagaucccacacucacccu

SEQ ID NO: 283481 - RNA, 22 nt, Homo sapiens
uugcagcaacauggaugaaacu

SEQ ID NO: 283482 - RNA, 22 nt, Homo sapiens
uugcaguaguaacuccuuaccu

SEQ ID NO: 283483 - RNA, 22 nt, Homo sapiens
uugcauagaggugaguauagua

SEQ ID NO: 283484 - RNA, 18 nt, Homo sapiens
uugcauaguguauccaaa

SEQ ID NO: 283485 - RNA, 22 nt, Homo sapiens
uugcauauguugaaccagccuu

SEQ ID NO: 283486 - RNA, 22 nt, Homo sapiens
uugcauauucucugaggcagga

SEQ ID NO: 283487 - RNA, 18 nt, Homo sapiens
uugcaucauuuuguuguu

SEQ ID NO: 283488 - RNA, 22 nt, Homo sapiens
uugcauguacguacagagagag

SEQ ID NO: 283489 - RNA, 22 nt, Homo sapiens
uugcaugucauaacugauggaa

SEQ ID NO: 283490 - RNA, 22 nt, Homo sapiens
uugccaucaucucuuacucagu

SEQ ID NO: 283491 - RNA, 20 nt, Homo sapiens
uugccgagagaaagguguua

SEQ ID NO: 283492 - RNA, 22 nt, Homo sapiens
uugccuaggcuggagugcagua

SEQ ID NO: 283493 - RNA, 22 nt, Homo sapiens
uugcuacauugauugccucuuu

SEQ ID NO: 283494 - RNA, 22 nt, Homo sapiens
uugcugagucuuucuagguugc

SEQ ID NO: 283495 - RNA, 22 nt, Homo sapiens
uugcuuagagccaaucuugauu

SEQ ID NO: 283496 - RNA, 22 nt, Homo sapiens
uugcuuuguuacugcaguuucc

SEQ ID NO: 283497 - RNA, 22 nt, Homo sapiens
uuggaaacgucaccuuuuccuu

SEQ ID NO: 283498 - RNA, 22 nt, Homo sapiens
uuggaaagagguguuuaugacu

SEQ ID NO: 283499 - RNA, 22 nt, Homo sapiens
uuggaagagaagggagauaaac

SEQ ID NO: 283500 - RNA, 23 nt, Homo sapiens
uuggaaugagaccuaagaguuuu

SEQ ID NO: 283501 - RNA, 22 nt, Homo sapiens
uuggaaugcaacagaaggauaa

SEQ ID NO: 283502 - RNA, 22 nt, Homo sapiens
uuggaauuaagagauauuuucu

SEQ ID NO: 283503 - RNA, 22 nt, Homo sapiens
uuggacuucucaaggcaauaaa

SEQ ID NO: 283504 - RNA, 22 nt, Homo sapiens
uuggagugugucuuauuccauu

SEQ ID NO: 283505 - RNA, 22 nt, Homo sapiens
uuggcaaauagguuuuauugca

SEQ ID NO: 283506 - RNA, 22 nt, Homo sapiens
uuggcaacauagugagaccccc

SEQ ID NO: 283507 - RNA, 22 nt, Homo sapiens
uuggcaaguuucugucagcaaa

SEQ ID NO: 283508 - RNA, 22 nt, Homo sapiens
uuggcaaucaauucugacgucu

SEQ ID NO: 283509 - RNA, 21 nt, Homo sapiens
uuggcacucuucucuccuuau

SEQ ID NO: 283510 - RNA, 22 nt, Homo sapiens
cuagagagaagcugugugaccu

SEQ ID NO: 283511 - RNA, 22 nt, Homo sapiens
cuagcagacacuuccagagagu

SEQ ID NO: 283512 - RNA, 22 nt, Homo sapiens
cuagcagacaugggcugaacca

SEQ ID NO: 283513 - RNA, 22 nt, Homo sapiens
cuagcccugagauaaaugucau

SEQ ID NO: 283514 - RNA, 22 nt, Homo sapiens
cuagccuggagugcaguggugc

SEQ ID NO: 283515 - RNA, 21 nt, Homo sapiens
cuaggaccaguucuguaauuc

SEQ ID NO: 283516 - RNA, 22 nt, Homo sapiens
cuaggcuuuucuuggauccagg

SEQ ID NO: 283517 - RNA, 22 nt, Homo sapiens
cuagugcaguuccccugucuua

SEQ ID NO: 283518 - RNA, 22 nt, Homo sapiens
cuaucacuguuuugaugcccgg

SEQ ID NO: 283519 - RNA, 22 nt, Homo sapiens
cuauggccugcuuagaacauac

SEQ ID NO: 283520 - RNA, 22 nt, Homo sapiens
cuaugguuucucaaacuccuga

SEQ ID NO: 283521 - RNA, 22 nt, Homo sapiens
cuauucacaggcaauauguaca

SEQ ID NO: 283522 - RNA, 22 nt, Homo sapiens
cuauuugguuggugaaaaaagu

SEQ ID NO: 283523 - RNA, 22 nt, Homo sapiens
cucaaaugguccagcuaguggu

SEQ ID NO: 283524 - RNA, 22 nt, Homo sapiens
cucaaguacaugggauuacagg

SEQ ID NO: 283525 - RNA, 18 nt, Homo sapiens
cucacaguaacuuuuaag

SEQ ID NO: 283526 - RNA, 22 nt, Homo sapiens
cucacagucucucccuaauuuu

SEQ ID NO: 283527 - RNA, 22 nt, Homo sapiens
cucacagugacacgaaccccca

SEQ ID NO: 283528 - RNA, 22 nt, Homo sapiens
cucacaguucuaaaggcaagaa

SEQ ID NO: 283529 - RNA, 22 nt, Homo sapiens
cucaccuugugauccacccacc

SEQ ID NO: 283530 - RNA, 22 nt, Homo sapiens
cucacggugcaggcuucuggga

SEQ ID NO: 283531 - RNA, 22 nt, Homo sapiens
cucacugggaccacucugaagu

SEQ ID NO: 283532 - RNA, 22 nt, Homo sapiens
cucagagcacaguuuaugacag

SEQ ID NO: 283533 - RNA, 22 nt, Homo sapiens
cucagucuaugauacuuugcua

SEQ ID NO: 283534 - RNA, 22 nt, Homo sapiens
cucaguuuugccuuguuuaagg

SEQ ID NO: 283535 - RNA, 21 nt, Homo sapiens
cucauauugcuuuuccauggu

SEQ ID NO: 283536 - RNA, 22 nt, Homo sapiens
cucauggaauacuucacagcca

SEQ ID NO: 283537 - RNA, 22 nt, Homo sapiens
cuccaggugagguuaagggacu

SEQ ID NO: 283538 - RNA, 22 nt, Homo sapiens
cuccaggugucauccaccuccu

SEQ ID NO: 283539 - RNA, 22 nt, Homo sapiens
cuccuaaccagggcuguuaguc

SEQ ID NO: 283540 - RNA, 22 nt, Homo sapiens
cuccuguagccccaucaucuuu

SEQ ID NO: 283541 - RNA, 22 nt, Homo sapiens
cucucugagccauggcugcccu

SEQ ID NO: 283542 - RNA, 21 nt, Homo sapiens
cucucugcuuaugaauaguga

SEQ ID NO: 283543 - RNA, 22 nt, Homo sapiens
cucugagccugagguuccuacu

SEQ ID NO: 283544 - RNA, 22 nt, Homo sapiens
cucugcuuaaugucccacuuga

SEQ ID NO: 283545 - RNA, 21 nt, Homo sapiens
cucugguuugcauuggauuau

SEQ ID NO: 283546 - RNA, 15 nt, Homo sapiens
cucugguuuuucuuc

SEQ ID NO: 283547 - RNA, 22 nt, Homo sapiens
cucuuugaugugaaccgugguu

SEQ ID NO: 283548 - RNA, 22 nt, Homo sapiens
cucuuugcuucuggcaucauug

SEQ ID NO: 283549 - RNA, 22 nt, Homo sapiens
cucuuuggaugccuuaggguua

SEQ ID NO: 283550 - RNA, 22 nt, Homo sapiens
cucuuuuguuuagcugagaggg

SEQ ID NO: 283551 - RNA, 19 nt, Homo sapiens
cugaaacacagagagggcu

SEQ ID NO: 283552 - RNA, 22 nt, Homo sapiens
cugaaauggaaugugugcacag

SEQ ID NO: 283553 - RNA, 22 nt, Homo sapiens
cugaauagucaacgauggacug

SEQ ID NO: 283554 - RNA, 22 nt, Homo sapiens
cugaauguucuauagaagccgc

SEQ ID NO: 283555 - RNA, 22 nt, Homo sapiens
cugacaagauucaucacucagu

SEQ ID NO: 283556 - RNA, 22 nt, Homo sapiens
cugacaagugaucacagcagca

SEQ ID NO: 283557 - RNA, 22 nt, Homo sapiens
cugacuaguuuuaaugcagauu

SEQ ID NO: 283558 - RNA, 22 nt, Homo sapiens
cugagagaggagcuaaaacugc

SEQ ID NO: 283559 - RNA, 22 nt, Homo sapiens
cugagauaggacucugcuggcu

SEQ ID NO: 283560 - RNA, 22 nt, Homo sapiens
cugagaucaugggucagguggu

SEQ ID NO: 283561 - RNA, 22 nt, Homo sapiens
cugagauuaagauauugggagu

SEQ ID NO: 283562 - RNA, 22 nt, Homo sapiens
cugagcaaaguucuauuuaugg

SEQ ID NO: 283563 - RNA, 22 nt, Homo sapiens
cugagcaugacaucaugugacu

SEQ ID NO: 283564 - RNA, 22 nt, Homo sapiens
cugagcucauuucuuuugcuac

SEQ ID NO: 283565 - RNA, 22 nt, Homo sapiens
cugaggugauauauacauauuu

SEQ ID NO: 283566 - RNA, 22 nt, Homo sapiens
cugaggugggaguuuuucucau

SEQ ID NO: 283567 - RNA, 22 nt, Homo sapiens
cugagugcaagugauccuccca

SEQ ID NO: 283568 - RNA, 22 nt, Homo sapiens
cugauguagguggucugugauc

SEQ ID NO: 283569 - RNA, 19 nt, Homo sapiens
cugcaagguaauaggucag

SEQ ID NO: 283570 - RNA, 19 nt, Homo sapiens
cugcacugagaaaaggagg

SEQ ID NO: 283571 - RNA, 22 nt, Homo sapiens
cugcagguaggggcagcuuugg

SEQ ID NO: 283572 - RNA, 22 nt, Homo sapiens
cugccugagaaaauggagggca

SEQ ID NO: 283573 - RNA, 22 nt, Homo sapiens
cuggaaagaaacccuuaauucu

SEQ ID NO: 283574 - RNA, 22 nt, Homo sapiens
uguccuggugaugcccaaauuc

SEQ ID NO: 283575 - RNA, 22 nt, Homo sapiens
ugucuaaagaauggcagacuca

SEQ ID NO: 283576 - RNA, 22 nt, Homo sapiens
ugucuuggagaauccuggguuu

SEQ ID NO: 283577 - RNA, 21 nt, Homo sapiens
ugucuuggagccagacgccag

SEQ ID NO: 283578 - RNA, 22 nt, Homo sapiens
ugucuuugguucaggcaaggag

SEQ ID NO: 283579 - RNA, 22 nt, Homo sapiens
ugugaaacacgaaagucuaaaa

SEQ ID NO: 283580 - RNA, 22 nt, Homo sapiens
ugugaaauguuaucccgucgug

SEQ ID NO: 283581 - RNA, 19 nt, Homo sapiens
ugugaacaucacagagugu

SEQ ID NO: 283582 - RNA, 21 nt, Homo sapiens
ugugaacauguuggguggcau

SEQ ID NO: 283583 - RNA, 20 nt, Homo sapiens
ugugaacuguagauagucuu

SEQ ID NO: 283584 - RNA, 22 nt, Homo sapiens
ugugaagaugagaugacgcccu

SEQ ID NO: 283585 - RNA, 22 nt, Homo sapiens
ugugacagguauccuguguucu

SEQ ID NO: 283586 - RNA, 22 nt, Homo sapiens
ugugagacugguucugaaccca

SEQ ID NO: 283587 - RNA, 22 nt, Homo sapiens
ugugagcuauggaguuguagag

SEQ ID NO: 283588 - RNA, 22 nt, Homo sapiens
ugugauaguuggcuaaagcagu

SEQ ID NO: 283589 - RNA, 22 nt, Homo sapiens
ugugaucaugcuccaggcgaga

SEQ ID NO: 283590 - RNA, 22 nt, Homo sapiens
ugugcaaucuuccauuuuuagg

SEQ ID NO: 283591 - RNA, 22 nt, Homo sapiens
ugugcauaugucuuuauaguag

SEQ ID NO: 283592 - RNA, 22 nt, Homo sapiens
ugugccacugcacuccugccug

SEQ ID NO: 283593 - RNA, 22 nt, Homo sapiens
uguggaaauuguuguauuuaau

SEQ ID NO: 283594 - RNA, 22 nt, Homo sapiens
uguggccuuuguuucaguuggg

SEQ ID NO: 283595 - RNA, 22 nt, Homo sapiens
uguggcuuuacagcaugguuca

SEQ ID NO: 283596 - RNA, 22 nt, Homo sapiens
uguggcuuuuucuuggcugagg

SEQ ID NO: 283597 - RNA, 22 nt, Homo sapiens
ugugggugguaaaauacaauga

SEQ ID NO: 283598 - RNA, 22 nt, Homo sapiens
uguguaaauauauacacacgug

SEQ ID NO: 283599 - RNA, 22 nt, Homo sapiens
ugugucacugcacuccagccug

SEQ ID NO: 283600 - RNA, 22 nt, Homo sapiens
ugugucuugagagucucgagaa

SEQ ID NO: 283601 - RNA, 22 nt, Homo sapiens
ugugucuuuuaucacacaaugu

SEQ ID NO: 283602 - RNA, 22 nt, Homo sapiens
uguguuuuuauguaaaauggaa

SEQ ID NO: 283603 - RNA, 22 nt, Homo sapiens
uguuaacauuuuagagugggaa

SEQ ID NO: 283604 - RNA, 22 nt, Homo sapiens
uguuaagaugucaauuuuccac

SEQ ID NO: 283605 - RNA, 22 nt, Homo sapiens
uguuacagcagaauugaaagag

SEQ ID NO: 283606 - RNA, 22 nt, Homo sapiens
uguuaugaagaugccugguaca

SEQ ID NO: 283607 - RNA, 22 nt, Homo sapiens
uguuauguuuuagagguuucaa

SEQ ID NO: 283608 - RNA, 22 nt, Homo sapiens
uguucuggagaguuuagucugg

SEQ ID NO: 283609 - RNA, 22 nt, Homo sapiens
uguugcacuccauccugggcga

SEQ ID NO: 283610 - RNA, 22 nt, Homo sapiens
uguugcacucuagccugggcaa

SEQ ID NO: 283611 - RNA, 22 nt, Homo sapiens
uguugcacugguaauguacuga

SEQ ID NO: 283612 - RNA, 22 nt, Homo sapiens
uguuuaguuaagacauagaauu

SEQ ID NO: 283613 - RNA, 22 nt, Homo sapiens
uguuucuacugucucuguagua

SEQ ID NO: 283614 - RNA, 22 nt, Homo sapiens
uuaaauacagcaugguguuucu

SEQ ID NO: 283615 - RNA, 23 nt, Homo sapiens
uuaagcaacggcugcuuuucaga

SEQ ID NO: 283616 - RNA, 22 nt, Homo sapiens
uuaaggcauucuuugucuucau

SEQ ID NO: 283617 - RNA, 22 nt, Homo sapiens
uuaagucacacuagacaacuga

SEQ ID NO: 283618 - RNA, 22 nt, Homo sapiens
uuaauacucuucuaaguagucc

SEQ ID NO: 283619 - RNA, 22 nt, Homo sapiens
uuaauagugacucauuuuccac

SEQ ID NO: 283620 - RNA, 22 nt, Homo sapiens
uuaaugcuuggggaguaguucu

SEQ ID NO: 283621 - RNA, 22 nt, Homo sapiens
uuacagauggauggcagcuggc

SEQ ID NO: 283622 - RNA, 22 nt, Homo sapiens
uuacagauggcacacucaaggg

SEQ ID NO: 283623 - RNA, 22 nt, Homo sapiens
uuacagguggagaaguaaggcu

SEQ ID NO: 283624 - RNA, 22 nt, Homo sapiens
uuacaguagaugaggguauaau

SEQ ID NO: 283625 - RNA, 22 nt, Homo sapiens
uuacaguggugaccuuguauug

SEQ ID NO: 283626 - RNA, 22 nt, Homo sapiens
uuacaugagacugucgcuaguu

SEQ ID NO: 283627 - RNA, 22 nt, Homo sapiens
uuacauugcuucaaauucagug

SEQ ID NO: 283628 - RNA, 22 nt, Homo sapiens
uuaccagucugauaaacagaaa

SEQ ID NO: 283629 - RNA, 22 nt, Homo sapiens
uuacccauuagagaauuuaaga

SEQ ID NO: 283630 - RNA, 22 nt, Homo sapiens
uuacccuuuaacccuuuaaagu

SEQ ID NO: 283631 - RNA, 22 nt, Homo sapiens
uuacugcucuuuugucaugagu

SEQ ID NO: 283632 - RNA, 22 nt, Homo sapiens
uuacugcuuaagugauucaaca

SEQ ID NO: 283633 - RNA, 22 nt, Homo sapiens
ggagauaauccagggagggacu

SEQ ID NO: 283634 - RNA, 22 nt, Homo sapiens
ggagcucaucuagcauagaggu

SEQ ID NO: 283635 - RNA, 22 nt, Homo sapiens
ggagggugagaucaauuuggga

SEQ ID NO: 283636 - RNA, 22 nt, Homo sapiens
ggaguaaaagaguaggaggaau

SEQ ID NO: 283637 - RNA, 22 nt, Homo sapiens
ggagucuugcuauguugccaag

SEQ ID NO: 283638 - RNA, 22 nt, Homo sapiens
ggagugugauucaguauaauau

SEQ ID NO: 283639 - RNA, 21 nt, Homo sapiens
ggauagaaaacuuggcuguau

SEQ ID NO: 283640 - RNA, 22 nt, Homo sapiens
ggaucacuugagaccaggaguu

SEQ ID NO: 283641 - RNA, 22 nt, Homo sapiens
ggcaaaucugcaauuacuuuug

SEQ ID NO: 283642 - RNA, 22 nt, Homo sapiens
ggcaagaaagaaaucaucuguc

SEQ ID NO: 283643 - RNA, 22 nt, Homo sapiens
ggcaagaaccucaauuaccuuu

SEQ ID NO: 283644 - RNA, 22 nt, Homo sapiens
ggcaaggaggggcacuuucacu

SEQ ID NO: 283645 - RNA, 22 nt, Homo sapiens
ggcaaugucagcuaaugaugga

SEQ ID NO: 283646 - RNA, 22 nt, Homo sapiens
ucugugguuguugcauggaaug

SEQ ID NO: 283647 - RNA, 22 nt, Homo sapiens
ucuguguugaucacacugggag

SEQ ID NO: 283648 - RNA, 22 nt, Homo sapiens
ucuuaguuugggguggggauag

SEQ ID NO: 283649 - RNA, 22 nt, Homo sapiens
ucuugcuuuugcagagcuucuc

SEQ ID NO: 283650 - RNA, 22 nt, Homo sapiens
ucuuggccaugaauggcaaggc

SEQ ID NO: 283651 - RNA, 22 nt, Homo sapiens
ucuuggguuguuggcuucuccu

SEQ ID NO: 283652 - RNA, 22 nt, Homo sapiens
ucuugguuuauugauggagagg

SEQ ID NO: 283653 - RNA, 17 nt, Homo sapiens
ucuugugguucuugaau

SEQ ID NO: 283654 - RNA, 22 nt, Homo sapiens
ucuuuaguuaagggacauuuua

SEQ ID NO: 283655 - RNA, 22 nt, Homo sapiens
ucuuugaguguauacuuagauu

SEQ ID NO: 283656 - RNA, 22 nt, Homo sapiens
ucuuugauguucugaaagaugg

SEQ ID NO: 283657 - RNA, 22 nt, Homo sapiens
ucuuugccuaacccaaggucau

SEQ ID NO: 283658 - RNA, 19 nt, Homo sapiens
ucuuugcuuuucuaagagg

SEQ ID NO: 283659 - RNA, 22 nt, Homo sapiens
ucuuugggauauucugaaaggg

SEQ ID NO: 283660 - RNA, 22 nt, Homo sapiens
ucuuuggguagauauguagcug

SEQ ID NO: 283661 - RNA, 22 nt, Homo sapiens
ucuuuggucaucaugggaagca

SEQ ID NO: 283662 - RNA, 22 nt, Homo sapiens
ucuuuggugaauggucauccag

SEQ ID NO: 283663 - RNA, 22 nt, Homo sapiens
ucuuugucuacauccuguuaaa

SEQ ID NO: 283664 - RNA, 22 nt, Homo sapiens
caugccauugcucuccugggug

SEQ ID NO: 283665 - RNA, 22 nt, Homo sapiens
cauggcucuuguuuacucccag

SEQ ID NO: 283666 - RNA, 22 nt, Homo sapiens
cauggcuuguauaagauucuca

SEQ ID NO: 283667 - RNA, 22 nt, Homo sapiens
cauggcuuuaagcaacaccaag

SEQ ID NO: 283668 - RNA, 22 nt, Homo sapiens
caugggacugucuuggcuauac

SEQ ID NO: 283669 - RNA, 22 nt, Homo sapiens
cauguaguagaaggagccagac

SEQ ID NO: 283670 - RNA, 22 nt, Homo sapiens
caugucuuuuaaacauucaacu

SEQ ID NO: 283671 - RNA, 22 nt, Homo sapiens
cauuccacauguaggacaauuu

SEQ ID NO: 283672 - RNA, 22 nt, Homo sapiens
cauugcacuccaccuuggguaa

SEQ ID NO: 283673 - RNA, 22 nt, Homo sapiens
cauugcacuccagcccuggcaa

SEQ ID NO: 283674 - RNA, 22 nt, Homo sapiens
cauugcacuccagccucggcaa

SEQ ID NO: 283675 - RNA, 22 nt, Homo sapiens
cauugcacuccagccugccugg

SEQ ID NO: 283676 - RNA, 22 nt, Homo sapiens
cauugcacuccagccuggcaac

SEQ ID NO: 283677 - RNA, 22 nt, Homo sapiens
cauugcacugcuucuugggugu

SEQ ID NO: 283678 - RNA, 22 nt, Homo sapiens
cauugcacuuagacaacuuuug

SEQ ID NO: 283679 - RNA, 22 nt, Homo sapiens
cauugcaugccagccugggcaa

SEQ ID NO: 283680 - RNA, 22 nt, Homo sapiens
cauuugguggcuacagaguaac

SEQ ID NO: 283681 - RNA, 22 nt, Homo sapiens
ccaaggaauacccucccuuuuu

SEQ ID NO: 283682 - RNA, 22 nt, Homo sapiens
ccacaaccucaacagcaucuau

SEQ ID NO: 283683 - RNA, 23 nt, Homo sapiens
ccacaaugguugaacuagauuac

SEQ ID NO: 283684 - RNA, 23 nt, Homo sapiens
ccacacuguuuagaauggcauca

SEQ ID NO: 283685 - RNA, 22 nt, Homo sapiens
ccacaguagucuugggaugggc

SEQ ID NO: 283686 - RNA, 22 nt, Homo sapiens
ccacaguugaaauuuugacugu

SEQ ID NO: 283687 - RNA, 22 nt, Homo sapiens
ccacccuggagaauuugagguc

SEQ ID NO: 283688 - RNA, 22 nt, Homo sapiens
ccacccuuccauucuuccucuu

SEQ ID NO: 283689 - RNA, 22 nt, Homo sapiens
ccagaguuucugauucagcagg

SEQ ID NO: 283690 - RNA, 22 nt, Homo sapiens
ccagauguuuucauucagcaag

SEQ ID NO: 283691 - RNA, 20 nt, Homo sapiens
ccagcaucauuagauucugg

SEQ ID NO: 283692 - RNA, 22 nt, Homo sapiens
ccaggguugcuuuagauucuga

SEQ ID NO: 283693 - RNA, 21 nt, Homo sapiens
ccaguguaaugauagcaggca

SEQ ID NO: 283694 - RNA, 22 nt, Homo sapiens
ccaguguuuuugaauuccagga

SEQ ID NO: 283695 - RNA, 22 nt, Homo sapiens
ccaguucaaugauauggaaacu

SEQ ID NO: 283696 - RNA, 22 nt, Homo sapiens
ccauacugucaaauagauuucc

SEQ ID NO: 283697 - RNA, 18 nt, Homo sapiens
ccauucaacagauuuguc

SEQ ID NO: 283698 - RNA, 23 nt, Homo sapiens
ccauugcacuccagccucaguga

SEQ ID NO: 283699 - RNA, 22 nt, Homo sapiens
ccauugcacucuggccuaggug

SEQ ID NO: 283700 - RNA, 22 nt, Homo sapiens
cccagaguucuuaaauacugag

SEQ ID NO: 283701 - RNA, 22 nt, Homo sapiens
cccagugugcugggugacagcu

SEQ ID NO: 283702 - RNA, 22 nt, Homo sapiens
cccaguuuugccacuuacuagc

SEQ ID NO: 283703 - RNA, 20 nt, Homo sapiens
ccccuggaguggggcugcuu

SEQ ID NO: 283704 - RNA, 19 nt, Homo sapiens
ccccuguggauaccgaggg

SEQ ID NO: 283705 - RNA, 18 nt, Homo sapiens
cccgggugggcuguuccc

SEQ ID NO: 283706 - RNA, 23 nt, Homo sapiens
cccucagaagugcagggagagaa

SEQ ID NO: 283707 - RNA, 22 nt, Homo sapiens
cccuguagcagcauucuuaaau

SEQ ID NO: 283708 - RNA, 22 nt, Homo sapiens
cccuguguuguucaaggaucug

SEQ ID NO: 283709 - RNA, 22 nt, Homo sapiens
ccucaguguuuaucauuauuuu

SEQ ID NO: 283710 - RNA, 22 nt, Homo sapiens
ccucauggagaacaucugcuag

SEQ ID NO: 283711 - RNA, 22 nt, Homo sapiens
ccucuguaguccugcaagagga

SEQ ID NO: 283712 - RNA, 22 nt, Homo sapiens
ccugagaucauacuguuaguaa

SEQ ID NO: 283713 - RNA, 21 nt, Homo sapiens
ccugaugaccucugagaguua

SEQ ID NO: 283714 - RNA, 22 nt, Homo sapiens
ccugcauaguucaccgcugaua

SEQ ID NO: 283715 - RNA, 22 nt, Homo sapiens
ccuggaagaaaggugcuaaaua

SEQ ID NO: 283716 - RNA, 22 nt, Homo sapiens
ccuggcaagagacugaagauag

SEQ ID NO: 283717 - RNA, 22 nt, Homo sapiens
ccuucuuuuguaaggcugaaua

SEQ ID NO: 283718 - RNA, 22 nt, Homo sapiens
ccuugguggccacaagacauug

SEQ ID NO: 283719 - RNA, 22 nt, Homo sapiens
uugaaguagcauuucaugucua

SEQ ID NO: 283720 - RNA, 18 nt, Homo sapiens
uugaauaguguccaaucu

SEQ ID NO: 283721 - RNA, 22 nt, Homo sapiens
uugaaugaaauuggugugggga

SEQ ID NO: 283722 - RNA, 22 nt, Homo sapiens
uugaaugaauggaaagaagggu

SEQ ID NO: 283723 - RNA, 17 nt, Homo sapiens
uugaaugcauuacuugg

SEQ ID NO: 283724 - RNA, 22 nt, Homo sapiens
uugacaaugcacugugcuaagu

SEQ ID NO: 283725 - RNA, 21 nt, Homo sapiens
uugacagugacagguaaaguu

SEQ ID NO: 283726 - RNA, 22 nt, Homo sapiens
uugagacggagucucacucugu

SEQ ID NO: 283727 - RNA, 22 nt, Homo sapiens
uugagacggagucuugcucuuu

SEQ ID NO: 283728 - RNA, 22 nt, Homo sapiens
uugagaucaugcuacugcacuc

SEQ ID NO: 283729 - RNA, 22 nt, Homo sapiens
uugagaugaagucuugcucucu

SEQ ID NO: 283730 - RNA, 22 nt, Homo sapiens
uugagaugaaguuuugcucuuu

SEQ ID NO: 283731 - RNA, 22 nt, Homo sapiens
uugagaugauggauaugcuaau

SEQ ID NO: 283732 - RNA, 22 nt, Homo sapiens
aucaugcacaugcauagguaug

SEQ ID NO: 283733 - RNA, 22 nt, Homo sapiens
aucauguuuauguguaggauau

SEQ ID NO: 283734 - RNA, 22 nt, Homo sapiens
auccacagugucaauguuguga

SEQ ID NO: 283735 - RNA, 22 nt, Homo sapiens
auccaguguuuucuuuugucac

SEQ ID NO: 283736 - RNA, 22 nt, Homo sapiens
aucccagaaacucggguuucuc

SEQ ID NO: 283737 - RNA, 22 nt, Homo sapiens
aucccugaggaauuucugcacu

SEQ ID NO: 283738 - RNA, 22 nt, Homo sapiens
aucccuuccuagcacuuggugu

SEQ ID NO: 283739 - RNA, 22 nt, Homo sapiens
auccugaagcuuuacugaauuc

SEQ ID NO: 283740 - RNA, 22 nt, Homo sapiens
auccugagacuuuucugaaguu

SEQ ID NO: 283741 - RNA, 22 nt, Homo sapiens
auccugaugacacagugcugca

SEQ ID NO: 283742 - RNA, 22 nt, Homo sapiens
auccuugagaaaauaaaugacc

SEQ ID NO: 283743 - RNA, 22 nt, Homo sapiens
auccuuuagacuguccaguuga

SEQ ID NO: 283744 - RNA, 22 nt, Homo sapiens
aucgcauaaucucuaaaaagca

SEQ ID NO: 283745 - RNA, 22 nt, Homo sapiens
aucuaaaucucauaugggcaca

SEQ ID NO: 283746 - RNA, 22 nt, Homo sapiens
aucuaaucaucgcaaccuucaa

SEQ ID NO: 283747 - RNA, 22 nt, Homo sapiens
aucucagagaaaauuacuaaga

SEQ ID NO: 283748 - RNA, 22 nt, Homo sapiens
aucucauggagguagagaguaa

SEQ ID NO: 283749 - RNA, 19 nt, Homo sapiens
aucuggaguuccuggggcu

SEQ ID NO: 283750 - RNA, 22 nt, Homo sapiens
aucuggcuccuuuugacaaugc

SEQ ID NO: 283751 - RNA, 22 nt, Homo sapiens
aucugguguccucgugggaguc

SEQ ID NO: 283752 - RNA, 22 nt, Homo sapiens
aucugguguggcugugauccuc

SEQ ID NO: 283753 - RNA, 22 nt, Homo sapiens
aucugguguuuccuucacauug

SEQ ID NO: 283754 - RNA, 22 nt, Homo sapiens
aucuugcauuugcuaaaaugca

SEQ ID NO: 283755 - RNA, 22 nt, Homo sapiens
aucuuguccugagguuuuauug

SEQ ID NO: 283756 - RNA, 22 nt, Homo sapiens
aucuuugauuagacugauggau

SEQ ID NO: 283757 - RNA, 22 nt, Homo sapiens
aucuuugcugagaugcauggca

SEQ ID NO: 283758 - RNA, 22 nt, Homo sapiens
aucuuuggauacuugauauagu

SEQ ID NO: 283759 - RNA, 22 nt, Homo sapiens
augaaaagcauaaacgcugaag

SEQ ID NO: 283760 - RNA, 23 nt, Homo sapiens
augaaagcccuugcaaaugcugg

SEQ ID NO: 283761 - RNA, 22 nt, Homo sapiens
augaaagugauaaaugucucua

SEQ ID NO: 283762 - RNA, 22 nt, Homo sapiens
augaaaguguguggaaacuuga

SEQ ID NO: 283763 - RNA, 22 nt, Homo sapiens
augaaaucuuuccugugaggau

SEQ ID NO: 283764 - RNA, 18 nt, Homo sapiens
augaacucaucauuuuua

SEQ ID NO: 283765 - RNA, 22 nt, Homo sapiens
augaagcuagcugauugcugau

SEQ ID NO: 283766 - RNA, 22 nt, Homo sapiens
augaaugucuuauuuugagaaa

SEQ ID NO: 283767 - RNA, 22 nt, Homo sapiens
augacagagauaugugaauuuu

SEQ ID NO: 283768 - RNA, 22 nt, Homo sapiens
augacaguaugacuccaaaagu

SEQ ID NO: 283769 - RNA, 22 nt, Homo sapiens
augacauuccacagccguagag

SEQ ID NO: 283770 - RNA, 22 nt, Homo sapiens
augacauugaaaagcaagugga

SEQ ID NO: 283771 - RNA, 22 nt, Homo sapiens
augaccagagagugcgcagggu

SEQ ID NO: 283772 - RNA, 18 nt, Homo sapiens
augaccugcggguuauau

SEQ ID NO: 283773 - RNA, 22 nt, Homo sapiens
augacuggaacagcaauuuaca

SEQ ID NO: 283774 - RNA, 22 nt, Homo sapiens
augagacauuaaaguguguuug

SEQ ID NO: 283775 - RNA, 22 nt, Homo sapiens
augagcucauaaagagugauuu

SEQ ID NO: 283776 - RNA, 22 nt, Homo sapiens
augaggagguaugauuuucuga

SEQ ID NO: 283777 - RNA, 22 nt, Homo sapiens
augaggcacugcgcccuacuga

SEQ ID NO: 283778 - RNA, 22 nt, Homo sapiens
augaggcaggaaaggcguaucu

SEQ ID NO: 283779 - RNA, 22 nt, Homo sapiens
augaggugauaucuggaaauua

SEQ ID NO: 283780 - RNA, 21 nt, Homo sapiens
augagguguacuguggugaaa

SEQ ID NO: 283781 - RNA, 18 nt, Homo sapiens
augagucauuguggaaau

SEQ ID NO: 283782 - RNA, 19 nt, Homo sapiens
augagucugcaagaaccag

SEQ ID NO: 283783 - RNA, 22 nt, Homo sapiens
augauacuggcuucauagaaug

SEQ ID NO: 283784 - RNA, 22 nt, Homo sapiens
augaugcaguacuuugggaaca

SEQ ID NO: 283785 - RNA, 22 nt, Homo sapiens
augauguguguuuaagaugucu

SEQ ID NO: 283786 - RNA, 22 nt, Homo sapiens
augauucugaucuagagcuugg

SEQ ID NO: 283787 - RNA, 19 nt, Homo sapiens
augcaaugucacaggcugc

SEQ ID NO: 283788 - RNA, 22 nt, Homo sapiens
augcacuguauaggaucuugcg

SEQ ID NO: 283789 - RNA, 22 nt, Homo sapiens
augcauaugucuuuauaguggc

SEQ ID NO: 283790 - RNA, 22 nt, Homo sapiens
augcauggucugaagucaaccu

SEQ ID NO: 283791 - RNA, 22 nt, Homo sapiens
augccacagaaauaaccaaaau

SEQ ID NO: 283792 - RNA, 22 nt, Homo sapiens
augccacugcacucuagccugg

SEQ ID NO: 283793 - RNA, 22 nt, Homo sapiens
augccacugcacuucagccugg

SEQ ID NO: 283794 - RNA, 22 nt, Homo sapiens
augccacuguuuaugucacuua

SEQ ID NO: 283795 - RNA, 22 nt, Homo sapiens
augccagggagaauuguucaag

SEQ ID NO: 283796 - RNA, 22 nt, Homo sapiens
augccaguguccagaguggguu

SEQ ID NO: 283797 - RNA, 22 nt, Homo sapiens
augccauugcacuccagccugg

SEQ ID NO: 283798 - RNA, 19 nt, Homo sapiens
augcugguguugcucaaac

SEQ ID NO: 283799 - RNA, 22 nt, Homo sapiens
auggaaagcuguuccuacacaa

SEQ ID NO: 283800 - RNA, 22 nt, Homo sapiens
aguccaguguuaugaucaguag

SEQ ID NO: 283801 - RNA, 22 nt, Homo sapiens
aguccauuugaugaugauucca

SEQ ID NO: 283802 - RNA, 22 nt, Homo sapiens
agugaaaugucaccuuuuagga

SEQ ID NO: 283803 - RNA, 17 nt, Homo sapiens
agugagaucauggcuua

SEQ ID NO: 283804 - RNA, 19 nt, Homo sapiens
agugagccaagauccuacc

SEQ ID NO: 283805 - RNA, 22 nt, Homo sapiens
agugagcuguuuuuacuuucug

SEQ ID NO: 283806 - RNA, 21 nt, Homo sapiens
agugagucauuuggaaagcaa

SEQ ID NO: 283807 - RNA, 22 nt, Homo sapiens
agugauuuuaacuuccagcaau

SEQ ID NO: 283808 - RNA, 22 nt, Homo sapiens
agugcacuccagccugggcaac

SEQ ID NO: 283809 - RNA, 22 nt, Homo sapiens
agugcaguggugccaucauaac

SEQ ID NO: 283810 - RNA, 22 nt, Homo sapiens
agugcauaugucuuuuuggaag

SEQ ID NO: 283811 - RNA, 22 nt, Homo sapiens
agugccauggcugcuagauggc

SEQ ID NO: 283812 - RNA, 22 nt, Homo sapiens
agugccuacuauguagaugcug

SEQ ID NO: 283813 - RNA, 22 nt, Homo sapiens
agugccuacuugaauuguagug

SEQ ID NO: 283814 - RNA, 22 nt, Homo sapiens
aguggaauuaagaaacugaauu

SEQ ID NO: 283815 - RNA, 22 nt, Homo sapiens
aguggcacaauuuugacucccc

SEQ ID NO: 283816 - RNA, 22 nt, Homo sapiens
aguggcuuuuuaguggcagaug

SEQ ID NO: 283817 - RNA, 23 nt, Homo sapiens
aguggucuccugggcccagcugu

SEQ ID NO: 283818 - RNA, 22 nt, Homo sapiens
agugguguugccuguugaccua

SEQ ID NO: 283819 - RNA, 22 nt, Homo sapiens
aguguuuuuaucaugaaagggu

SEQ ID NO: 283820 - RNA, 22 nt, Homo sapiens
aguucaaugcucuuucuacuau

SEQ ID NO: 283821 - RNA, 22 nt, Homo sapiens
aguuuugguugaguuacuagca

SEQ ID NO: 283822 - RNA, 17 nt, Homo sapiens
auaaacucaucauuuuu

SEQ ID NO: 283823 - RNA, 23 nt, Homo sapiens
auaaacugucaaaagccagcccu

SEQ ID NO: 283824 - RNA, 22 nt, Homo sapiens
auaaaugcauugagaacugcug

SEQ ID NO: 283825 - RNA, 19 nt, Homo sapiens
auaaaugccuacaagggug

SEQ ID NO: 283826 - RNA, 22 nt, Homo sapiens
auaacagcauuauugcauacgu

SEQ ID NO: 283827 - RNA, 22 nt, Homo sapiens
auaacagcugcaaggcaaaagc

SEQ ID NO: 283828 - RNA, 22 nt, Homo sapiens
auaacauggaguuugucauuua

SEQ ID NO: 283829 - RNA, 22 nt, Homo sapiens
auaaggcagcugcuaaaaggca

SEQ ID NO: 283830 - RNA, 22 nt, Homo sapiens
auaauaguguuuagauuuggga

SEQ ID NO: 283831 - RNA, 22 nt, Homo sapiens
auacaguaaugucuuaggcugu

SEQ ID NO: 283832 - RNA, 22 nt, Homo sapiens
auacaugugccauguucgugug

SEQ ID NO: 283833 - RNA, 22 nt, Homo sapiens
auacaugugugagcgaagaugu

SEQ ID NO: 283834 - RNA, 22 nt, Homo sapiens
auacuguacugaaguacccauu

SEQ ID NO: 283835 - RNA, 21 nt, Homo sapiens
auacuugcauccuuggagaga

SEQ ID NO: 283836 - RNA, 22 nt, Homo sapiens
auagagugcuucaucaguagua

SEQ ID NO: 283837 - RNA, 21 nt, Homo sapiens
auagcacaucagauuuuauua

SEQ ID NO: 283838 - RNA, 22 nt, Homo sapiens
auagcacauggcauccucucuu

SEQ ID NO: 283839 - RNA, 22 nt, Homo sapiens
auagcagaauuuggucaagucu

SEQ ID NO: 283840 - RNA, 20 nt, Homo sapiens
auagcagcaugauuuauaau

SEQ ID NO: 283841 - RNA, 20 nt, Homo sapiens
auagcagcaugauuuauagu

SEQ ID NO: 283842 - RNA, 22 nt, Homo sapiens
auagcagcucacuuauuuaugg

SEQ ID NO: 283843 - RNA, 22 nt, Homo sapiens
auagcaucauuucuugaaaaga

SEQ ID NO: 283844 - RNA, 22 nt, Homo sapiens
auagcccauuuguugguccugg

SEQ ID NO: 283845 - RNA, 22 nt, Homo sapiens
auaggacuauugugaggauuaa

SEQ ID NO: 283846 - RNA, 21 nt, Homo sapiens
auagggcuuguugauaguuaa

SEQ ID NO: 283847 - RNA, 22 nt, Homo sapiens
auagucaguagucucauaauga

SEQ ID NO: 283848 - RNA, 22 nt, Homo sapiens
auagugcugcaaucaacauaca

SEQ ID NO: 283849 - RNA, 19 nt, Homo sapiens
auaguguaggaaaacagcu

SEQ ID NO: 283850 - RNA, 22 nt, Homo sapiens
auauagcucuggcuggaugacu

SEQ ID NO: 283851 - RNA, 22 nt, Homo sapiens
auaucaacaucgugucauuagu

SEQ ID NO: 283852 - RNA, 22 nt, Homo sapiens
auaucacaggaaaggaagauac

SEQ ID NO: 283853 - RNA, 22 nt, Homo sapiens
auaucccuguauaagugaaugu

SEQ ID NO: 283854 - RNA, 17 nt, Homo sapiens
auaugaauuuuggagau

SEQ ID NO: 283855 - RNA, 22 nt, Homo sapiens
auaugcacaguggaguacuauu

SEQ ID NO: 283856 - RNA, 22 nt, Homo sapiens
auaugcauacauguaugcagga

SEQ ID NO: 283857 - RNA, 21 nt, Homo sapiens
auauggaacuggugacguguu

SEQ ID NO: 283858 - RNA, 22 nt, Homo sapiens
auaugguuuuuggaagcauauc

SEQ ID NO: 283859 - RNA, 22 nt, Homo sapiens
auauguaguauggaaacauugu

SEQ ID NO: 283860 - RNA, 22 nt, Homo sapiens
auaugugacuucaugcaaggcu

SEQ ID NO: 283861 - RNA, 22 nt, Homo sapiens
auauguucucauucauaugugg

SEQ ID NO: 283862 - RNA, 19 nt, Homo sapiens
aucaaacugcucuuugagg

SEQ ID NO: 283863 - RNA, 22 nt, Homo sapiens
aucaaguacuguacugaaagug

SEQ ID NO: 283864 - RNA, 22 nt, Homo sapiens
aucacugggauggaacugcuga

SEQ ID NO: 283865 - RNA, 22 nt, Homo sapiens
agcaucacaugggcugcuuggg

SEQ ID NO: 283866 - RNA, 22 nt, Homo sapiens
agcaucaugcaguugcuauuca

SEQ ID NO: 283867 - RNA, 22 nt, Homo sapiens
agcaucauguuuucgagguuca

SEQ ID NO: 283868 - RNA, 22 nt, Homo sapiens
agcaugacauauuguagagaaa

SEQ ID NO: 283869 - RNA, 22 nt, Homo sapiens
agccaagacucuguuccccuug

SEQ ID NO: 283870 - RNA, 22 nt, Homo sapiens
agcccauguggcugaggcuucu

SEQ ID NO: 283871 - RNA, 17 nt, Homo sapiens
agccccauuagcuaguu

SEQ ID NO: 283872 - RNA, 22 nt, Homo sapiens
agccuucauucugacaguagga

SEQ ID NO: 283873 - RNA, 20 nt, Homo sapiens
agcuccauuccugaaggcug

SEQ ID NO: 283874 - RNA, 22 nt, Homo sapiens
agcuccuacuguuacaucauug

SEQ ID NO: 283875 - RNA, 22 nt, Homo sapiens
agcuccuuucugcaggcagguc

SEQ ID NO: 283876 - RNA, 22 nt, Homo sapiens
agcucuuguuaguauuagcagu

SEQ ID NO: 283877 - RNA, 22 nt, Homo sapiens
agcugauuuuaaguccuugucc

SEQ ID NO: 283878 - RNA, 22 nt, Homo sapiens
agcugcacaaauggaugugagg

SEQ ID NO: 283879 - RNA, 22 nt, Homo sapiens
agcugcacgugguaaauguaaa

SEQ ID NO: 283880 - RNA, 22 nt, Homo sapiens
agcugccagucuuguaaggccu

SEQ ID NO: 283881 - RNA, 22 nt, Homo sapiens
agcuggacuugauaaaugaaua

SEQ ID NO: 283882 - RNA, 22 nt, Homo sapiens
agcuggauguauguuaagugaa

SEQ ID NO: 283883 - RNA, 22 nt, Homo sapiens
agcugguauuuguuagggaguu

SEQ ID NO: 283884 - RNA, 22 nt, Homo sapiens
agcuggucuuggggaagaguag

SEQ ID NO: 283885 - RNA, 22 nt, Homo sapiens
agcuguaguuuauucauguuaa

SEQ ID NO: 283886 - RNA, 20 nt, Homo sapiens
agcuguuguuaaaaaggagg

SEQ ID NO: 283887 - RNA, 22 nt, Homo sapiens
agcuguuguuuuaagauacuaa

SEQ ID NO: 283888 - RNA, 22 nt, Homo sapiens
agcuuguguuuuucuaaguauc

SEQ ID NO: 283889 - RNA, 22 nt, Homo sapiens
agcuuuuugggaggccuuagga

SEQ ID NO: 283890 - RNA, 22 nt, Homo sapiens
aggaagguaaacuaacuugccu

SEQ ID NO: 283891 - RNA, 22 nt, Homo sapiens
aggaaugucaaugguaguuuaa

SEQ ID NO: 283892 - RNA, 22 nt, Homo sapiens
aggaauguuaguacuucuuagu

SEQ ID NO: 283893 - RNA, 21 nt, Homo sapiens
aggagauguuuguccuuuuag

SEQ ID NO: 283894 - RNA, 22 nt, Homo sapiens
aggagcacuggccuuggaguca

SEQ ID NO: 283895 - RNA, 23 nt, Homo sapiens
aggagcuuagaaguugccauugc

SEQ ID NO: 283896 - RNA, 22 nt, Homo sapiens
aggagguagggugugaaacagc

SEQ ID NO: 283897 - RNA, 21 nt, Homo sapiens
aggcaaaugaagcagccgcuc

SEQ ID NO: 283898 - RNA, 22 nt, Homo sapiens
aggcaacaugguaaaacccugu

SEQ ID NO: 283899 - RNA, 22 nt, Homo sapiens
aggcaagagugacuacgugaaa

SEQ ID NO: 283900 - RNA, 22 nt, Homo sapiens
aggcaagcaucuugcucccuuc

SEQ ID NO: 283901 - RNA, 22 nt, Homo sapiens
aggcacacaacccuggaccuga

SEQ ID NO: 283902 - RNA, 22 nt, Homo sapiens
aggcaugauuguauuuugcucu

SEQ ID NO: 283903 - RNA, 22 nt, Homo sapiens
aggcuuuauuacagggucucag

SEQ ID NO: 283904 - RNA, 22 nt, Homo sapiens
agggagcaaaguggucuuucuc

SEQ ID NO: 283905 - RNA, 22 nt, Homo sapiens
agggccuuuguagauguacuca

SEQ ID NO: 283906 - RNA, 22 nt, Homo sapiens
agggguauuauguaaaucugac

SEQ ID NO: 283907 - RNA, 22 nt, Homo sapiens
agguaaacauggggacugcuac

SEQ ID NO: 283908 - RNA, 22 nt, Homo sapiens
agguaauuuuaucauuauguga

SEQ ID NO: 283909 - RNA, 22 nt, Homo sapiens
agguauguaugucuguacagcg

SEQ ID NO: 283910 - RNA, 22 nt, Homo sapiens
agguauuuucaacuuagaaugg

SEQ ID NO: 283911 - RNA, 21 nt, Homo sapiens
aggucaugaagauguucuaau

SEQ ID NO: 283912 - RNA, 22 nt, Homo sapiens
agguccauugguauuauagcau

SEQ ID NO: 283913 - RNA, 22 nt, Homo sapiens
aggucccauguccucccugacc

SEQ ID NO: 283914 - RNA, 22 nt, Homo sapiens
aggugcacucagaaaacagaua

SEQ ID NO: 283915 - RNA, 22 nt, Homo sapiens
aggugguauuuaaaauuauuug

SEQ ID NO: 283916 - RNA, 20 nt, Homo sapiens
agguuauuauaauuagaaga

SEQ ID NO: 283917 - RNA, 22 nt, Homo sapiens
aguaagucucaagguaggguag

SEQ ID NO: 283918 - RNA, 22 nt, Homo sapiens
aguacaauguugaguagaagug

SEQ ID NO: 283919 - RNA, 22 nt, Homo sapiens
aguacacuguugaacagaagug

SEQ ID NO: 283920 - RNA, 22 nt, Homo sapiens
aguagcaauggcucugagcuau

SEQ ID NO: 283921 - RNA, 22 nt, Homo sapiens
aguauuaggugaguguauuuca

SEQ ID NO: 283922 - RNA, 22 nt, Homo sapiens
agucaaaugcuuauguauaaag

SEQ ID NO: 283923 - RNA, 22 nt, Homo sapiens
agucaagaaucucagcaucuuu

SEQ ID NO: 283924 - RNA, 22 nt, Homo sapiens
agucaaggaggccuuucagaug

SEQ ID NO: 283925 - RNA, 22 nt, Homo sapiens
agucacagugaccuugucugac

SEQ ID NO: 283926 - RNA, 20 nt, Homo sapiens
acuggcacugguaggugugg

SEQ ID NO: 283927 - RNA, 22 nt, Homo sapiens
acuggcuuaaggaugggccacu

SEQ ID NO: 283928 - RNA, 22 nt, Homo sapiens
acugguguaugggaggucccaa

SEQ ID NO: 283929 - RNA, 19 nt, Homo sapiens
acuguacuccagucugggc

SEQ ID NO: 283930 - RNA, 19 nt, Homo sapiens
acuuuggugauuagaggga

SEQ ID NO: 283931 - RNA, 22 nt, Homo sapiens
acuuuuugaugaggucguuugu

SEQ ID NO: 283932 - RNA, 22 nt, Homo sapiens
acuuuuugauggggagaacauu

SEQ ID NO: 283933 - RNA, 23 nt, Homo sapiens
agaaaugucuauucagggucccu

SEQ ID NO: 283934 - RNA, 22 nt, Homo sapiens
agaaauguuuacucacccccuu

SEQ ID NO: 283935 - RNA, 22 nt, Homo sapiens
agaaccauuagagggagauauu

SEQ ID NO: 283936 - RNA, 22 nt, Homo sapiens
agaagugcuggguucaggcugg

SEQ ID NO: 283937 - RNA, 22 nt, Homo sapiens
agaauguauauucuguaguugu

SEQ ID NO: 283938 - RNA, 22 nt, Homo sapiens
agaauucugucauguuuauauu

SEQ ID NO: 283939 - RNA, 22 nt, Homo sapiens
agacuagacagaugaacagcac

SEQ ID NO: 283940 - RNA, 22 nt, Homo sapiens
agagaacugauuggaguugggc

SEQ ID NO: 283941 - RNA, 22 nt, Homo sapiens
agagaacugauuggaugugggc

SEQ ID NO: 283942 - RNA, 22 nt, Homo sapiens
agagaucaacugaauuacugga

SEQ ID NO: 283943 - RNA, 22 nt, Homo sapiens
agagaucaauaugaaggaaaug

SEQ ID NO: 283944 - RNA, 22 nt, Homo sapiens
agagcacugcugcaggguucug

SEQ ID NO: 283945 - RNA, 22 nt, Homo sapiens
agagcauugaguuaaugguuca

SEQ ID NO: 283946 - RNA, 22 nt, Homo sapiens
agagccacauuaaauaugggaa

SEQ ID NO: 283947 - RNA, 22 nt, Homo sapiens
agaggaguacuacuccaagucu

SEQ ID NO: 283948 - RNA, 22 nt, Homo sapiens
agaguauacaugugagugagau

SEQ ID NO: 283949 - RNA, 22 nt, Homo sapiens
agaguauagcaacuuaguaaaa

SEQ ID NO: 283950 - RNA, 22 nt, Homo sapiens
aaugguuuuaucagcguccaaa

SEQ ID NO: 283951 - RNA, 22 nt, Homo sapiens
aaugugcuucuggcugugguca

SEQ ID NO: 283952 - RNA, 22 nt, Homo sapiens
aauuacauggcaauugggaaau

SEQ ID NO: 283953 - RNA, 22 nt, Homo sapiens
aauuaguugaaagucugcuuuu

SEQ ID NO: 283954 - RNA, 22 nt, Homo sapiens
aauugcacuaagcauaguccag

SEQ ID NO: 283955 - RNA, 22 nt, Homo sapiens
aauugccucaagugaucauggc

SEQ ID NO: 283956 - RNA, 22 nt, Homo sapiens
aauugcuuuuauuuagggccag

SEQ ID NO: 283957 - RNA, 22 nt, Homo sapiens
acaagugcuuuuccuggagaca

SEQ ID NO: 283958 - RNA, 22 nt, Homo sapiens
acaauguauauuuuacuguagg

SEQ ID NO: 283959 - RNA, 22 nt, Homo sapiens
acaccauugcauuccagccugg

SEQ ID NO: 283960 - RNA, 22 nt, Homo sapiens
acacucucucauuacuuguuug

SEQ ID NO: 283961 - RNA, 22 nt, Homo sapiens
acacugcugaguaaauaauuuu

SEQ ID NO: 283962 - RNA, 22 nt, Homo sapiens
acacuguagcugagggcaugcg

SEQ ID NO: 283963 - RNA, 22 nt, Homo sapiens
acacugucugaugaaaguaguu

SEQ ID NO: 283964 - RNA, 22 nt, Homo sapiens
acacuguuuuaguuauuauagc

SEQ ID NO: 283965 - RNA, 22 nt, Homo sapiens
acacuuucuagacaagggaaua

SEQ ID NO: 283966 - RNA, 22 nt, Homo sapiens
acagauagacauauauagcuca

SEQ ID NO: 283967 - RNA, 22 nt, Homo sapiens
acaggguuauuguaauaaugua

SEQ ID NO: 283968 - RNA, 22 nt, Homo sapiens
acaguacuguuguuugcugcca

SEQ ID NO: 283969 - RNA, 21 nt, Homo sapiens
acaguacuugagaucuuuuga

SEQ ID NO: 283970 - RNA, 20 nt, Homo sapiens
cuuuguccuccugcugugcu

SEQ ID NO: 283971 - RNA, 22 nt, Homo sapiens
cuuuguccuucaagguguguca

SEQ ID NO: 283972 - RNA, 22 nt, Homo sapiens
cuuuguguggacauuucaggca

SEQ ID NO: 283973 - RNA, 22 nt, Homo sapiens
cuuuuacacuguuagugggaau

SEQ ID NO: 283974 - RNA, 23 nt, Homo sapiens
cuuuugcaaugugaucuugccac

SEQ ID NO: 283975 - RNA, 22 nt, Homo sapiens
cuuuuggugugaagaagcucuu

SEQ ID NO: 283976 - RNA, 22 nt, Homo sapiens
gaaaacugcuucucuggguuuc

SEQ ID NO: 283977 - RNA, 22 nt, Homo sapiens
gaaagauuuccugagcuagaaa

SEQ ID NO: 283978 - RNA, 22 nt, Homo sapiens
gaaagcugguauagauacauua

SEQ ID NO: 283979 - RNA, 22 nt, Homo sapiens
gaaaguaauuaacgauuguugc

SEQ ID NO: 283980 - RNA, 22 nt, Homo sapiens
gaaaugcucauuuuggauccuu

SEQ ID NO: 283981 - RNA, 22 nt, Homo sapiens
gaaauguuuuucaugugggcaa

SEQ ID NO: 283982 - RNA, 22 nt, Homo sapiens
gaacugggguuggguugcgaua

SEQ ID NO: 283983 - RNA, 22 nt, Homo sapiens
gaagauucaaccaaaccagaac

SEQ ID NO: 283984 - RNA, 22 nt, Homo sapiens
gaagguaguuuauagauguggu

SEQ ID NO: 283985 - RNA, 22 nt, Homo sapiens
gaagguauauucuguuaaugcu

SEQ ID NO: 283986 - RNA, 23 nt, Homo sapiens
gaaguaauaaauggauucuuaac

SEQ ID NO: 283987 - RNA, 23 nt, Homo sapiens
gaaguauagcaugcacauggaaa

SEQ ID NO: 283988 - RNA, 17 nt, Homo sapiens
gaaguguuucagcagcu

SEQ ID NO: 283989 - RNA, 22 nt, Homo sapiens
gaaucacagauuaugaguaucu

SEQ ID NO: 283990 - RNA, 22 nt, Homo sapiens
gaaucauuggguugauucaaga

SEQ ID NO: 283991 - RNA, 22 nt, Homo sapiens
gaaugcaugaggggaucagaug

SEQ ID NO: 283992 - RNA, 22 nt, Homo sapiens
gaaugcuaccagcaucuagugg

SEQ ID NO: 283993 - RNA, 22 nt, Homo sapiens
gaaugugcuguuggcugggcgu

SEQ ID NO: 283994 - RNA, 22 nt, Homo sapiens
gaauguuuacuuuguuuaauac

SEQ ID NO: 283995 - RNA, 22 nt, Homo sapiens
gaauugcacaaaaacugcuugu

SEQ ID NO: 283996 - RNA, 22 nt, Homo sapiens
gacaccauuucaguacuagguu

SEQ ID NO: 283997 - RNA, 22 nt, Homo sapiens
gacaguuucucaggcuuccuua

SEQ ID NO: 283998 - RNA, 22 nt, Homo sapiens
gacauagagccuugacuucauu

SEQ ID NO: 283999 - RNA, 22 nt, Homo sapiens
gacauguuuuuuaagguuuaug

SEQ ID NO: 284000 - RNA, 22 nt, Homo sapiens
gacauuaucagguuuguuuucu

SEQ ID NO: 284001 - RNA, 21 nt, Homo sapiens
gaccacagcagggaaugucag

SEQ ID NO: 284002 - RNA, 22 nt, Homo sapiens
gacccucuagagggaagcgcuu

SEQ ID NO: 284003 - RNA, 21 nt, Homo sapiens
gacuacaccaggaugcuaguu

SEQ ID NO: 284004 - RNA, 22 nt, Homo sapiens
gacuagggaaaauuauuuuguu

SEQ ID NO: 284005 - RNA, 22 nt, Homo sapiens
gacuauguuaccuuacacauca

SEQ ID NO: 284006 - RNA, 22 nt, Homo sapiens
gacuggccuauaauggcgaauu

SEQ ID NO: 284007 - RNA, 22 nt, Homo sapiens
gagaacaguguuguauuuuuuc

SEQ ID NO: 284008 - RNA, 22 nt, Homo sapiens
gagaacauuuaagccacucagg

SEQ ID NO: 284009 - RNA, 22 nt, Homo sapiens
gagaacugagauaagugauauu

SEQ ID NO: 284010 - RNA, 21 nt, Homo sapiens
gagaaucaucauggcugcaua

SEQ ID NO: 284011 - RNA, 22 nt, Homo sapiens
gagaaugagaggggaaggccac

SEQ ID NO: 284012 - RNA, 23 nt, Homo sapiens
gagaccagcuucagaaagcacga

SEQ ID NO: 284013 - RNA, 20 nt, Homo sapiens
gagaccugagauucacucaa

SEQ ID NO: 284014 - RNA, 22 nt, Homo sapiens
gagacggagucucgcucugucg

SEQ ID NO: 284015 - RNA, 22 nt, Homo sapiens
gagacggagucuugcucuguug

SEQ ID NO: 284016 - RNA, 22 nt, Homo sapiens
gagacucuuagauuggaaaucu

SEQ ID NO: 284017 - RNA, 22 nt, Homo sapiens
gagacugagucucacucuguca

SEQ ID NO: 284018 - RNA, 22 nt, Homo sapiens
gagacugagucuugcucugucg

SEQ ID NO: 284019 - RNA, 22 nt, Homo sapiens
gagagugcuuuggguguaggcc

SEQ ID NO: 284020 - RNA, 22 nt, Homo sapiens
gagauaggauucacuuucaugu

SEQ ID NO: 284021 - RNA, 22 nt, Homo sapiens
gagauauuauuucccuuucaca

SEQ ID NO: 284022 - RNA, 22 nt, Homo sapiens
gagauauuuagaaauguguucu

SEQ ID NO: 284023 - RNA, 22 nt, Homo sapiens
gagaucauuaugucagggguca

SEQ ID NO: 284024 - RNA, 22 nt, Homo sapiens
gagaugaaaucuugcucuguca

SEQ ID NO: 284025 - RNA, 22 nt, Homo sapiens
gagaugaagugucaauaaggau

SEQ ID NO: 284026 - RNA, 22 nt, Homo sapiens
gagaugaaguuaaggaucuuua

SEQ ID NO: 284027 - RNA, 22 nt, Homo sapiens
gagaugguguuccacugccagu

SEQ ID NO: 284028 - RNA, 22 nt, Homo sapiens
gagauuauuagauguucugcuu

SEQ ID NO: 284029 - RNA, 22 nt, Homo sapiens
gagauucaucuagguccagaga

SEQ ID NO: 284030 - RNA, 22 nt, Homo sapiens
gagcacauguggagagucuggg

SEQ ID NO: 284031 - RNA, 22 nt, Homo sapiens
gagccauggagaaaacagcuau

SEQ ID NO: 284032 - RNA, 22 nt, Homo sapiens
gagcucaccuuaccucuggagc

SEQ ID NO: 284033 - RNA, 22 nt, Homo sapiens
gagcugaucuuuucugauucca

SEQ ID NO: 284034 - RNA, 22 nt, Homo sapiens
gaggagucagacugugcaaggu

SEQ ID NO: 284035 - RNA, 22 nt, Homo sapiens
gaggcacucuguacaaaucugc

SEQ ID NO: 284036 - RNA, 22 nt, Homo sapiens
gaggcagucugacccuuagcag

SEQ ID NO: 284037 - RNA, 22 nt, Homo sapiens
gaggcagucuguccauucucag

SEQ ID NO: 284038 - RNA, 22 nt, Homo sapiens
gaggcggugugaugucacaugc

SEQ ID NO: 284039 - RNA, 22 nt, Homo sapiens
gagguaagagaauaaacaguuu

SEQ ID NO: 284040 - RNA, 20 nt, Homo sapiens
agcuguuguuaugagguuua

SEQ ID NO: 284041 - RNA, 22 nt, Homo sapiens
agcuucauuguuaugaauguca

SEQ ID NO: 284042 - RNA, 22 nt, Homo sapiens
agcuugucuuauacuacuucau

SEQ ID NO: 284043 - RNA, 22 nt, Homo sapiens
agcuuguguuugucugccuggg

SEQ ID NO: 284044 - RNA, 22 nt, Homo sapiens
agcuuuuugggcagcuauugac

SEQ ID NO: 284045 - RNA, 22 nt, Homo sapiens
aggaaauguuggucccauuucu

SEQ ID NO: 284046 - RNA, 21 nt, Homo sapiens
aggaagacuaugaucaauugg

SEQ ID NO: 284047 - RNA, 23 nt, Homo sapiens
aggaaguaacuaucuuuucuguc

SEQ ID NO: 284048 - RNA, 22 nt, Homo sapiens
aggaaugcuaaguuuuccuccu

SEQ ID NO: 284049 - RNA, 22 nt, Homo sapiens
aggaauggaaacuuuugauggu

SEQ ID NO: 284050 - RNA, 22 nt, Homo sapiens
aggagaauugguucuucuugau

SEQ ID NO: 284051 - RNA, 22 nt, Homo sapiens
aggagcacaggacuuugauuau

SEQ ID NO: 284052 - RNA, 22 nt, Homo sapiens
aggagguugguaccaucuguuu

SEQ ID NO: 284053 - RNA, 22 nt, Homo sapiens
aggcaaaugccagcaaucacac

SEQ ID NO: 284054 - RNA, 21 nt, Homo sapiens
aggcaagauuacuuacgagca

SEQ ID NO: 284055 - RNA, 21 nt, Homo sapiens
aggcaagguguuauuauugaa

SEQ ID NO: 284056 - RNA, 22 nt, Homo sapiens
aggcacgguggcucacaccugu

SEQ ID NO: 284057 - RNA, 22 nt, Homo sapiens
aggcagcuguuauauacugagu

SEQ ID NO: 284058 - RNA, 22 nt, Homo sapiens
aggcaggugaaagauaguuuua

SEQ ID NO: 284059 - RNA, 22 nt, Homo sapiens
aggcagucucugccggcugagg

SEQ ID NO: 284060 - RNA, 22 nt, Homo sapiens
aggcaguuucagugagagguga

SEQ ID NO: 284061 - RNA, 22 nt, Homo sapiens
aggcaugaaauacaugcauuga

SEQ ID NO: 284062 - RNA, 22 nt, Homo sapiens
aggcaugauggcuccagaucau

SEQ ID NO: 284063 - RNA, 22 nt, Homo sapiens
aggcauguggcucuguucugac

SEQ ID NO: 284064 - RNA, 22 nt, Homo sapiens
aggcauugugcaucgaugauuu

SEQ ID NO: 284065 - RNA, 22 nt, Homo sapiens
aggcugguauuuacaaaagcuc

SEQ ID NO: 284066 - RNA, 22 nt, Homo sapiens
aggcuuauuaagauucccuuau

SEQ ID NO: 284067 - RNA, 22 nt, Homo sapiens
agggcaguguuaggacugucug

SEQ ID NO: 284068 - RNA, 22 nt, Homo sapiens
agggcuuuugagcugagauggu

SEQ ID NO: 284069 - RNA, 20 nt, Homo sapiens
agguacacugacaugccuuc

SEQ ID NO: 284070 - RNA, 22 nt, Homo sapiens
guagcagucacauagcagauug

SEQ ID NO: 284071 - RNA, 22 nt, Homo sapiens
guaggcacuggcucagcuuauc

SEQ ID NO: 284072 - RNA, 22 nt, Homo sapiens
guauacacccugugauauuauu

SEQ ID NO: 284073 - RNA, 22 nt, Homo sapiens
guauagaucguagaccaauaaa

SEQ ID NO: 284074 - RNA, 22 nt, Homo sapiens
guaucaucauguuggccaggcu

SEQ ID NO: 284075 - RNA, 22 nt, Homo sapiens
guaugaaaaucggagauugggu

SEQ ID NO: 284076 - RNA, 22 nt, Homo sapiens
guauggcacuauccucucugau

SEQ ID NO: 284077 - RNA, 22 nt, Homo sapiens
guaugguugaagugacaagcca

SEQ ID NO: 284078 - RNA, 22 nt, Homo sapiens
guaugguuuauagggaaauugu

SEQ ID NO: 284079 - RNA, 22 nt, Homo sapiens
guauugacuaucaaucaugugc

SEQ ID NO: 284080 - RNA, 22 nt, Homo sapiens
guauuugauuauagcaugcuua

SEQ ID NO: 284081 - RNA, 19 nt, Homo sapiens
guauuugguaaacucucca

SEQ ID NO: 284082 - RNA, 22 nt, Homo sapiens
guauuuggugaugccuccaaac

SEQ ID NO: 284083 - RNA, 22 nt, Homo sapiens
guauuugguuauugcagccuga

SEQ ID NO: 284084 - RNA, 22 nt, Homo sapiens
guauuuuguuagggugugguau

SEQ ID NO: 284085 - RNA, 22 nt, Homo sapiens
gucaaagucuauuggcuaauuc

SEQ ID NO: 284086 - RNA, 22 nt, Homo sapiens
agguacuugagauucugaacug

SEQ ID NO: 284087 - RNA, 22 nt, Homo sapiens
agguagguugagaugggcauca

SEQ ID NO: 284088 - RNA, 22 nt, Homo sapiens
agguagugugaugcuccuguuu

SEQ ID NO: 284089 - RNA, 22 nt, Homo sapiens
agguauauuggacagauguaaa

SEQ ID NO: 284090 - RNA, 22 nt, Homo sapiens
agguccauuauuuucauucaug

SEQ ID NO: 284091 - RNA, 22 nt, Homo sapiens
aggugaaugcucacauucuaau

SEQ ID NO: 284092 - RNA, 22 nt, Homo sapiens
aggugcuugaaucuaugagcuc

SEQ ID NO: 284093 - RNA, 22 nt, Homo sapiens
aggugguguuggguuccagccc

SEQ ID NO: 284094 - RNA, 21 nt, Homo sapiens
aggugucuuggguucccuggc

SEQ ID NO: 284095 - RNA, 22 nt, Homo sapiens
agguuguguuugugauuagaua

SEQ ID NO: 284096 - RNA, 22 nt, Homo sapiens
aguaacauuucuaguagagagu

SEQ ID NO: 284097 - RNA, 22 nt, Homo sapiens
aguacacuguuaaaaagaagug

SEQ ID NO: 284098 - RNA, 22 nt, Homo sapiens
aguaccauuccguuggagcugg

SEQ ID NO: 284099 - RNA, 22 nt, Homo sapiens
aguagguguugguagagguuuc

SEQ ID NO: 284100 - RNA, 22 nt, Homo sapiens
aguaucaucuuguuggccaggc

SEQ ID NO: 284101 - RNA, 22 nt, Homo sapiens
agucaagauggcaagguaaggc

SEQ ID NO: 284102 - RNA, 22 nt, Homo sapiens
agucaaguuuuuucagagaaua

SEQ ID NO: 284103 - RNA, 22 nt, Homo sapiens
agucacaugcauuuucuucaau

SEQ ID NO: 284104 - RNA, 22 nt, Homo sapiens
aguccagguuuuguaauggcaa

SEQ ID NO: 284105 - RNA, 23 nt, Homo sapiens
agucuguguuuacaggcucucug

SEQ ID NO: 284106 - RNA, 22 nt, Homo sapiens
agugaauguuggaaaguuauuu

SEQ ID NO: 284107 - RNA, 22 nt, Homo sapiens
agugacuagaauaugaauuuua

SEQ ID NO: 284108 - RNA, 22 nt, Homo sapiens
agugauguggaguuuggaugga

SEQ ID NO: 284109 - RNA, 22 nt, Homo sapiens
agugcaauggcgugaucuuggc

SEQ ID NO: 284110 - RNA, 22 nt, Homo sapiens
agugcaguggcacaaucuuggc

SEQ ID NO: 284111 - RNA, 22 nt, Homo sapiens
agugcaguggcucaaaaugccu

SEQ ID NO: 284112 - RNA, 22 nt, Homo sapiens
agugcauugcaucucugcuuca

SEQ ID NO: 284113 - RNA, 22 nt, Homo sapiens
agugcauuuguucugugucagg

SEQ ID NO: 284114 - RNA, 22 nt, Homo sapiens
aguggaaucuguuauacuaacu

SEQ ID NO: 284115 - RNA, 19 nt, Homo sapiens
aguggguguuuucuguuug

SEQ ID NO: 284116 - RNA, 22 nt, Homo sapiens
aguggugucugaguggccaggg

SEQ ID NO: 284117 - RNA, 22 nt, Homo sapiens
agugguuugaucacagcucacu

SEQ ID NO: 284118 - RNA, 19 nt, Homo sapiens
agugucauggucauuauuu

SEQ ID NO: 284119 - RNA, 22 nt, Homo sapiens
aguguuuuuaacaagaaagggu

SEQ ID NO: 284120 - RNA, 22 nt, Homo sapiens
aguguuuuucaugggauacuuu

SEQ ID NO: 284121 - RNA, 22 nt, Homo sapiens
aguuagcaaaacucccaaaggu

SEQ ID NO: 284122 - RNA, 21 nt, Homo sapiens
aguucacauggcuccuguguu

SEQ ID NO: 284123 - RNA, 22 nt, Homo sapiens
aguugcaagucuugaguaaaga

SEQ ID NO: 284124 - RNA, 22 nt, Homo sapiens
auaaacagcuuauccucuauuc

SEQ ID NO: 284125 - RNA, 22 nt, Homo sapiens
auaaagguaagcacuauccuga

SEQ ID NO: 284126 - RNA, 22 nt, Homo sapiens
cuagcugcacuuccugcuacug

SEQ ID NO: 284127 - RNA, 22 nt, Homo sapiens
cuauaugucuguuuugguacca

SEQ ID NO: 284128 - RNA, 22 nt, Homo sapiens
cuauggcagccacggccuggag

SEQ ID NO: 284129 - RNA, 22 nt, Homo sapiens
cuauguaccuggaacuguauua

SEQ ID NO: 284130 - RNA, 22 nt, Homo sapiens
cuauuacuuuuauugaacucag

SEQ ID NO: 284131 - RNA, 21 nt, Homo sapiens
cucaaaguacugauauuacag

SEQ ID NO: 284132 - RNA, 22 nt, Homo sapiens
cucaaagucaagggaaagcagg

SEQ ID NO: 284133 - RNA, 22 nt, Homo sapiens
cucaaagugcuaagauuaggcu

SEQ ID NO: 284134 - RNA, 22 nt, Homo sapiens
cucaaagugcugggacuggcug

SEQ ID NO: 284135 - RNA, 19 nt, Homo sapiens
cucaaagugguauuuggag

SEQ ID NO: 284136 - RNA, 18 nt, Homo sapiens
cucaaccucaugcagggc

SEQ ID NO: 284137 - RNA, 22 nt, Homo sapiens
cucacagucagaagggacuugc

SEQ ID NO: 284138 - RNA, 22 nt, Homo sapiens
cucaccuugugauccaccggcc

SEQ ID NO: 284139 - RNA, 22 nt, Homo sapiens
cucacuaguaaggcuguuuagu

SEQ ID NO: 284140 - RNA, 22 nt, Homo sapiens
cucacugcauuucaguuuuguu

SEQ ID NO: 284141 - RNA, 20 nt, Homo sapiens
cucagauuauucugaagcaa

SEQ ID NO: 284142 - RNA, 22 nt, Homo sapiens
cuccacugagcaggugggaggc

SEQ ID NO: 284143 - RNA, 22 nt, Homo sapiens
cuccaguacagagagguuccuc

SEQ ID NO: 284144 - RNA, 22 nt, Homo sapiens
cuccaguuucagaaucccaugu

SEQ ID NO: 284145 - RNA, 22 nt, Homo sapiens
cuccaugagauuguugaaguag

SEQ ID NO: 284146 - RNA, 23 nt, Homo sapiens
cuccaugagccguccagggccug

SEQ ID NO: 284147 - RNA, 20 nt, Homo sapiens
cucccugacaaauguggaaa

SEQ ID NO: 284148 - RNA, 22 nt, Homo sapiens
cuccuggugauuggagugugaa

SEQ ID NO: 284149 - RNA, 22 nt, Homo sapiens
cucucaagaugcugggauuaca

SEQ ID NO: 284150 - RNA, 22 nt, Homo sapiens
cucucaguguggaggccagaaa

SEQ ID NO: 284151 - RNA, 22 nt, Homo sapiens
cucucugagccccagacaccuu

SEQ ID NO: 284152 - RNA, 22 nt, Homo sapiens
cucuggauauuccugucuaaaa

SEQ ID NO: 284153 - RNA, 22 nt, Homo sapiens
cucugguuaaggcugaacuaua

SEQ ID NO: 284154 - RNA, 22 nt, Homo sapiens
cucuuacaguguguggugaaag

SEQ ID NO: 284155 - RNA, 22 nt, Homo sapiens
cucuuggguagauuuugcagag

SEQ ID NO: 284156 - RNA, 22 nt, Homo sapiens
cugaaaagcaucugcauagcug

SEQ ID NO: 284157 - RNA, 22 nt, Homo sapiens
cugaaagagcauguaacacagu

SEQ ID NO: 284158 - RNA, 22 nt, Homo sapiens
cugaaaucagccaguuaguuuc

SEQ ID NO: 284159 - RNA, 22 nt, Homo sapiens
cugaauguucuggauggaagag

SEQ ID NO: 284160 - RNA, 22 nt, Homo sapiens
cugacagucucauugauuugcu

SEQ ID NO: 284161 - RNA, 22 nt, Homo sapiens
cugacaucuucaagugaggaga

SEQ ID NO: 284162 - RNA, 22 nt, Homo sapiens
cugacugugcaugcccagcccc

SEQ ID NO: 284163 - RNA, 22 nt, Homo sapiens
cugagaaugaugauuuccaguu

SEQ ID NO: 284164 - RNA, 22 nt, Homo sapiens
cugagacacucuuaucugcaua

SEQ ID NO: 284165 - RNA, 22 nt, Homo sapiens
cugagcaaaaugaagacacgau

SEQ ID NO: 284166 - RNA, 22 nt, Homo sapiens
cugagcaauauagugagaucuu

SEQ ID NO: 284167 - RNA, 22 nt, Homo sapiens
cugagcaucauggcagaaucuu

SEQ ID NO: 284168 - RNA, 22 nt, Homo sapiens
cugagcccauucuggggagaag

SEQ ID NO: 284169 - RNA, 22 nt, Homo sapiens
cugagcuaugccuggaaaggca

SEQ ID NO: 284170 - RNA, 22 nt, Homo sapiens
cugaggacaucagggaagcauc

SEQ ID NO: 284171 - RNA, 22 nt, Homo sapiens
cugaggguagaaggaucacuug

SEQ ID NO: 284172 - RNA, 22 nt, Homo sapiens
cugagguaggcccugagaauau

SEQ ID NO: 284173 - RNA, 22 nt, Homo sapiens
cugaggucugaauccagguauc

SEQ ID NO: 284174 - RNA, 20 nt, Homo sapiens
cugaggugggagaaucgcuu

SEQ ID NO: 284175 - RNA, 22 nt, Homo sapiens
cugaggugggaggauuggcuug

SEQ ID NO: 284176 - RNA, 20 nt, Homo sapiens
cugagguugggguccuuccc

SEQ ID NO: 284177 - RNA, 22 nt, Homo sapiens
cugauaaguuuuucuuuauaag

SEQ ID NO: 284178 - RNA, 20 nt, Homo sapiens
cugauacagccugagcucuc

SEQ ID NO: 284179 - RNA, 22 nt, Homo sapiens
cugauaguucucuuuagaguuu

SEQ ID NO: 284180 - RNA, 22 nt, Homo sapiens
cugaugaaguauuuguucugga

SEQ ID NO: 284181 - RNA, 22 nt, Homo sapiens
cugcaagaugcauaggaauuuu

SEQ ID NO: 284182 - RNA, 22 nt, Homo sapiens
cugcagaucuuggggcuugcca

SEQ ID NO: 284183 - RNA, 22 nt, Homo sapiens
cugcaguaaccacuguaggugu

SEQ ID NO: 284184 - RNA, 22 nt, Homo sapiens
cugcagucaucugaagauuuug

SEQ ID NO: 284185 - RNA, 22 nt, Homo sapiens
cugcuggucuuuaaggucuagg

SEQ ID NO: 284186 - RNA, 22 nt, Homo sapiens
cugcuguuguuaacuuuuggag

SEQ ID NO: 284187 - RNA, 18 nt, Homo sapiens
cuggaaggcuacuacagu

SEQ ID NO: 284188 - RNA, 22 nt, Homo sapiens
cuggaaucuauggauaacaucg

SEQ ID NO: 284189 - RNA, 22 nt, Homo sapiens
cuggaauguuccuaaagauuca

SEQ ID NO: 284190 - RNA, 22 nt, Homo sapiens
cuggaauuacaggguugagcua

SEQ ID NO: 284191 - RNA, 22 nt, Homo sapiens
cuggagauauuggaagaaagaa

SEQ ID NO: 284192 - RNA, 22 nt, Homo sapiens
cuggaguaugaaccauguauca

SEQ ID NO: 284193 - RNA, 22 nt, Homo sapiens
cuggauauuaacauugaugaaa

SEQ ID NO: 284194 - RNA, 22 nt, Homo sapiens
cuggcaaauaguagagccagga

SEQ ID NO: 284195 - RNA, 19 nt, Homo sapiens
cuggcaaaugcuuuggcca

SEQ ID NO: 284196 - RNA, 22 nt, Homo sapiens
cuggcuaagugcuugagugugc

SEQ ID NO: 284197 - RNA, 22 nt, Homo sapiens
cuggcucauuucauuuagcaua

SEQ ID NO: 284198 - RNA, 22 nt, Homo sapiens
cuggcucugggcuaaagaaaua

SEQ ID NO: 284199 - RNA, 22 nt, Homo sapiens
ggcaagcucaggccucaggugu

SEQ ID NO: 284200 - RNA, 22 nt, Homo sapiens
ggcaaggauguuuuucuggcaa

SEQ ID NO: 284201 - RNA, 21 nt, Homo sapiens
ggcaagugugagguuuggggu

SEQ ID NO: 284202 - RNA, 22 nt, Homo sapiens
ggcacaaugucagcucacugca

SEQ ID NO: 284203 - RNA, 22 nt, Homo sapiens
ggcacaauugcagcaauaaaca

SEQ ID NO: 284204 - RNA, 22 nt, Homo sapiens
ggcacuguggcucaagccugua

SEQ ID NO: 284205 - RNA, 22 nt, Homo sapiens
ggcagaauugcugaggaugcua

SEQ ID NO: 284206 - RNA, 22 nt, Homo sapiens
ggcagcacaauuuucugaugga

SEQ ID NO: 284207 - RNA, 22 nt, Homo sapiens
ggcaguguauuacuuaggguuc

SEQ ID NO: 284208 - RNA, 22 nt, Homo sapiens
ggcaguguggcugcauauagca

SEQ ID NO: 284209 - RNA, 22 nt, Homo sapiens
ggcaugguggugugugccuaua

SEQ ID NO: 284210 - RNA, 21 nt, Homo sapiens
ggcauugugcccuugcucuag

SEQ ID NO: 284211 - RNA, 22 nt, Homo sapiens
ggcuagagagcucagggauaug

SEQ ID NO: 284212 - RNA, 22 nt, Homo sapiens
ggcuagauauucacauauggcu

SEQ ID NO: 284213 - RNA, 22 nt, Homo sapiens
ggcucuguugcuaccaauuaag

SEQ ID NO: 284214 - RNA, 22 nt, Homo sapiens
gggaaaaugucuauugaaugaa

SEQ ID NO: 284215 - RNA, 22 nt, Homo sapiens
gggaacaugagaaugugaauga

SEQ ID NO: 284216 - RNA, 22 nt, Homo sapiens
gggaagguaaucauuacuugau

SEQ ID NO: 284217 - RNA, 22 nt, Homo sapiens
gggaauggaagacauuaugaug

SEQ ID NO: 284218 - RNA, 22 nt, Homo sapiens
gggaauguagcaaaucugcaau

SEQ ID NO: 284219 - RNA, 22 nt, Homo sapiens
gggagguaggaguuauuauuuu

SEQ ID NO: 284220 - RNA, 22 nt, Homo sapiens
gggaugaagcccuaggguuggu

SEQ ID NO: 284221 - RNA, 20 nt, Homo sapiens
gggaugugagguacacucuu

SEQ ID NO: 284222 - RNA, 23 nt, Homo sapiens
gggauuguaaaauaugagggcag

SEQ ID NO: 284223 - RNA, 21 nt, Homo sapiens
gggcaaaucuuuauccuaagc

SEQ ID NO: 284224 - RNA, 22 nt, Homo sapiens
gggcaaauuauguaucucucag

SEQ ID NO: 284225 - RNA, 22 nt, Homo sapiens
gggcaugauggugcacacaugu

SEQ ID NO: 284226 - RNA, 22 nt, Homo sapiens
gggcauugugggcagagggcag

SEQ ID NO: 284227 - RNA, 22 nt, Homo sapiens
ggggaauguuaaagaauuugca

SEQ ID NO: 284228 - RNA, 22 nt, Homo sapiens
ggguaggcaagcggaugucaga

SEQ ID NO: 284229 - RNA, 22 nt, Homo sapiens
ggguucccuucuggcucagggu

SEQ ID NO: 284230 - RNA, 22 nt, Homo sapiens
gguaaguuuggggcuaauuugu

SEQ ID NO: 284231 - RNA, 22 nt, Homo sapiens
gguaauguaacugguauucugu

SEQ ID NO: 284232 - RNA, 22 nt, Homo sapiens
gguccgccugccuuggccuccc

SEQ ID NO: 284233 - RNA, 22 nt, Homo sapiens
gguguguaaauuacuuaucucu

SEQ ID NO: 284234 - RNA, 22 nt, Homo sapiens
guaaauaccaguuucuggaaca

SEQ ID NO: 284235 - RNA, 22 nt, Homo sapiens
guaacuggccuucaauuucuuc

SEQ ID NO: 284236 - RNA, 22 nt, Homo sapiens
guaagguuguauuucaagaaac

SEQ ID NO: 284237 - RNA, 22 nt, Homo sapiens
guaauaccuuccccugcuggag

SEQ ID NO: 284238 - RNA, 23 nt, Homo sapiens
guaauacuagucauaguagcagg

SEQ ID NO: 284239 - RNA, 22 nt, Homo sapiens
guaaucucagcuacuugggagu

SEQ ID NO: 284240 - RNA, 19 nt, Homo sapiens
guaaugugcuucaguagca

SEQ ID NO: 284241 - RNA, 22 nt, Homo sapiens
guacaagugcaguuucguuaca

SEQ ID NO: 284242 - RNA, 22 nt, Homo sapiens
guacaguacugaaugaauguau

SEQ ID NO: 284243 - RNA, 22 nt, Homo sapiens
guacaguauaguaauaggauuu

SEQ ID NO: 284244 - RNA, 22 nt, Homo sapiens
guacaugcauaguuuauuucug

SEQ ID NO: 284245 - RNA, 22 nt, Homo sapiens
guacauguaugcaugcaugcau

SEQ ID NO: 284246 - RNA, 22 nt, Homo sapiens
guagaaaguuugcugucacaug

SEQ ID NO: 284247 - RNA, 22 nt, Homo sapiens
guagaagcacaggugaguuggu

SEQ ID NO: 284248 - RNA, 22 nt, Homo sapiens
guagagagaaauacaaagcugu

SEQ ID NO: 284249 - RNA, 22 nt, Homo sapiens
guagaugcauggauuuacuucu

SEQ ID NO: 284250 - RNA, 22 nt, Homo sapiens
guauacaugucaaaacucacau

SEQ ID NO: 284251 - RNA, 22 nt, Homo sapiens
guauacuucugaaaauagcuau

SEQ ID NO: 284252 - RNA, 22 nt, Homo sapiens
guauagcacauaauacuugaug

SEQ ID NO: 284253 - RNA, 22 nt, Homo sapiens
guauaggcuuucaccacgccau

SEQ ID NO: 284254 - RNA, 22 nt, Homo sapiens
guauuuguugcagcagcacuau

SEQ ID NO: 284255 - RNA, 22 nt, Homo sapiens
gucaaaugcacagaaccauuaa

SEQ ID NO: 284256 - RNA, 22 nt, Homo sapiens
gucaagagaacuuucuaucacu

SEQ ID NO: 284257 - RNA, 22 nt, Homo sapiens
gucaaggaauuuauccauuucu

SEQ ID NO: 284258 - RNA, 22 nt, Homo sapiens
gucacuguuuccuauuauauuu

SEQ ID NO: 284259 - RNA, 22 nt, Homo sapiens
gucagcuuguccagagacucug

SEQ ID NO: 284260 - RNA, 22 nt, Homo sapiens
gucaggugcuuacgcggagauc

SEQ ID NO: 284261 - RNA, 22 nt, Homo sapiens
gucagugcuuuaguucaggaug

SEQ ID NO: 284262 - RNA, 22 nt, Homo sapiens
gucaguggauacugucucuguc

SEQ ID NO: 284263 - RNA, 22 nt, Homo sapiens
gucagugugauaucugcagggg

SEQ ID NO: 284264 - RNA, 22 nt, Homo sapiens
gucaugucugcacauaguaaaa

SEQ ID NO: 284265 - RNA, 22 nt, Homo sapiens
gucauugagucagggaguaucu

SEQ ID NO: 284266 - RNA, 21 nt, Homo sapiens
guccaaaacaguguccaaugc

SEQ ID NO: 284267 - RNA, 22 nt, Homo sapiens
guccagagaagucauuacuuca

SEQ ID NO: 284268 - RNA, 22 nt, Homo sapiens
guccaugagaugaauccacaca

SEQ ID NO: 284269 - RNA, 22 nt, Homo sapiens
gucccaguggaaccuccaagcu

SEQ ID NO: 284270 - RNA, 22 nt, Homo sapiens
guccugaagaccuuccucugga

SEQ ID NO: 284271 - RNA, 22 nt, Homo sapiens
ccccauguucucucugcagcuc

SEQ ID NO: 284272 - RNA, 22 nt, Homo sapiens
ccccggguggauguacauguga

SEQ ID NO: 284273 - RNA, 22 nt, Homo sapiens
ccccuguaucucagcgucuuca

SEQ ID NO: 284274 - RNA, 17 nt, Homo sapiens
cccuaguagcugggacu

SEQ ID NO: 284275 - RNA, 22 nt, Homo sapiens
ccggcugugugacugugggcag

SEQ ID NO: 284276 - RNA, 19 nt, Homo sapiens
ccucaaguacuaauauguu

SEQ ID NO: 284277 - RNA, 22 nt, Homo sapiens
ccucacaaccuuuauugaagag

SEQ ID NO: 284278 - RNA, 22 nt, Homo sapiens
ccucuuuguugagacuucacca

SEQ ID NO: 284279 - RNA, 22 nt, Homo sapiens
ccugagacuugagggggcuucu

SEQ ID NO: 284280 - RNA, 19 nt, Homo sapiens
ccugcuguucuuuugcacc

SEQ ID NO: 284281 - RNA, 22 nt, Homo sapiens
ccuggcacugagcaguguucua

SEQ ID NO: 284282 - RNA, 22 nt, Homo sapiens
ccugucuugauuaaauuacuua

SEQ ID NO: 284283 - RNA, 22 nt, Homo sapiens
ccuucauucauuaauuuagccc

SEQ ID NO: 284284 - RNA, 21 nt, Homo sapiens
ccuugagaacaucaauuugcu

SEQ ID NO: 284285 - RNA, 22 nt, Homo sapiens
ccuuggcacuacugacauugua

SEQ ID NO: 284286 - RNA, 22 nt, Homo sapiens
ccuuggcacuuugccacagugc

SEQ ID NO: 284287 - RNA, 22 nt, Homo sapiens
cggcaguggguaagccaagcuu

SEQ ID NO: 284288 - RNA, 22 nt, Homo sapiens
cuaaaugucucuacuaaguuua

SEQ ID NO: 284289 - RNA, 22 nt, Homo sapiens
cuaacacagagguuuauuucuc

SEQ ID NO: 284290 - RNA, 22 nt, Homo sapiens
cuacacaugcaggcucccugcc

SEQ ID NO: 284291 - RNA, 22 nt, Homo sapiens
guggcuuuaaguacgauugagg

SEQ ID NO: 284292 - RNA, 22 nt, Homo sapiens
gugggaagcuggaacucccucc

SEQ ID NO: 284293 - RNA, 22 nt, Homo sapiens
gugggguagcaggcuccuaucu

SEQ ID NO: 284294 - RNA, 22 nt, Homo sapiens
gugggguaggaggaguacuucc

SEQ ID NO: 284295 - RNA, 22 nt, Homo sapiens
guggggucaucucauuugugga

SEQ ID NO: 284296 - RNA, 22 nt, Homo sapiens
gugguacuaucuuugguuucag

SEQ ID NO: 284297 - RNA, 22 nt, Homo sapiens
gugguaggaaagugcaaaugua

SEQ ID NO: 284298 - RNA, 22 nt, Homo sapiens
gugguucuagaauugaguaucc

SEQ ID NO: 284299 - RNA, 22 nt, Homo sapiens
gugguuuuuaaaguaccugugg

SEQ ID NO: 284300 - RNA, 22 nt, Homo sapiens
gugguuuuuuucugccuuauag

SEQ ID NO: 284301 - RNA, 22 nt, Homo sapiens
guguaaaucugcugugaacauu

SEQ ID NO: 284302 - RNA, 18 nt, Homo sapiens
guguauggauggaggcca

SEQ ID NO: 284303 - RNA, 22 nt, Homo sapiens
gugugacagcuauagacaugau

SEQ ID NO: 284304 - RNA, 22 nt, Homo sapiens
gugugcaaauguguaccuacau

SEQ ID NO: 284305 - RNA, 22 nt, Homo sapiens
gugugguaggauugguuacuca

SEQ ID NO: 284306 - RNA, 22 nt, Homo sapiens
guguugcacauucuguggaugu

SEQ ID NO: 284307 - RNA, 22 nt, Homo sapiens
guuauguaucuugauugggugg

SEQ ID NO: 284308 - RNA, 22 nt, Homo sapiens
guuauuaguugauauuaaguuc

SEQ ID NO: 284309 - RNA, 22 nt, Homo sapiens
guucaagcaauucugcugccuc

SEQ ID NO: 284310 - RNA, 22 nt, Homo sapiens
guucacacuugcaaccccagca

SEQ ID NO: 284311 - RNA, 20 nt, Homo sapiens
guucacaggcuuccuuucag

SEQ ID NO: 284312 - RNA, 22 nt, Homo sapiens
guucacaguucagccuguaaca

SEQ ID NO: 284313 - RNA, 22 nt, Homo sapiens
guucaucagggauacuggcuua

SEQ ID NO: 284314 - RNA, 20 nt, Homo sapiens
guucccuguaggugugcgga

SEQ ID NO: 284315 - RNA, 22 nt, Homo sapiens
guucuggagauaaagccaaggu

SEQ ID NO: 284316 - RNA, 22 nt, Homo sapiens
guugagcaaacagcuuaacagu

SEQ ID NO: 284317 - RNA, 22 nt, Homo sapiens
guugcucaggccggagugcagu

SEQ ID NO: 284318 - RNA, 22 nt, Homo sapiens
guugcugagucccaucaccaga

SEQ ID NO: 284319 - RNA, 22 nt, Homo sapiens
guugcuuauuccuguaauccca

SEQ ID NO: 284320 - RNA, 22 nt, Homo sapiens
guuggucucguauaaaucaagg

SEQ ID NO: 284321 - RNA, 22 nt, Homo sapiens
guuguggagucuucuguucugg

SEQ ID NO: 284322 - RNA, 22 nt, Homo sapiens
guuuggcucuuguuucugucaa

SEQ ID NO: 284323 - RNA, 17 nt, Homo sapiens
guuuggguacuggguaa

SEQ ID NO: 284324 - RNA, 22 nt, Homo sapiens
guuugguugcauggaaaauuua

SEQ ID NO: 284325 - RNA, 22 nt, Homo sapiens
guuuugguuauauggaucaguu

SEQ ID NO: 284326 - RNA, 21 nt, Homo sapiens
uaaaacuguaacuuuguccug

SEQ ID NO: 284327 - RNA, 22 nt, Homo sapiens
uaaaccacguuuacauuugaga

SEQ ID NO: 284328 - RNA, 22 nt, Homo sapiens
uaaagccauugucaaguuugua

SEQ ID NO: 284329 - RNA, 22 nt, Homo sapiens
uaaagcuacagagcggaaaauu

SEQ ID NO: 284330 - RNA, 20 nt, Homo sapiens
uaaagcugcucagggggcuc

SEQ ID NO: 284331 - RNA, 22 nt, Homo sapiens
uaaagcuuagauccaugguggc

SEQ ID NO: 284332 - RNA, 22 nt, Homo sapiens
uaaauggauaaaugaauaccua

SEQ ID NO: 284333 - RNA, 19 nt, Homo sapiens
uaacacaguuguguuugag

SEQ ID NO: 284334 - RNA, 22 nt, Homo sapiens
uaacuauagagaauguugagua

SEQ ID NO: 284335 - RNA, 22 nt, Homo sapiens
uaagacacuuaaaauguuacau

SEQ ID NO: 284336 - RNA, 22 nt, Homo sapiens
uaagacuuuuugggaauauaga

SEQ ID NO: 284337 - RNA, 20 nt, Homo sapiens
uaagcauaguugucaggguc

SEQ ID NO: 284338 - RNA, 22 nt, Homo sapiens
uaaggcaaguuuuuaguggaca

SEQ ID NO: 284339 - RNA, 22 nt, Homo sapiens
uaaggcccgugaguuucauauc

SEQ ID NO: 284340 - RNA, 22 nt, Homo sapiens
uaaggcuagcaagaugagaaua

SEQ ID NO: 284341 - RNA, 22 nt, Homo sapiens
uaaguaaaugaaagguugauuu

SEQ ID NO: 284342 - RNA, 22 nt, Homo sapiens
uaaguaauuguuaauagggaag

SEQ ID NO: 284343 - RNA, 22 nt, Homo sapiens
uaaguauuuuaauuccuggcau

SEQ ID NO: 284344 - RNA, 22 nt, Homo sapiens
uuauucugucuuuggucucaau

SEQ ID NO: 284345 - RNA, 17 nt, Homo sapiens
uuauugcuauaagcuga

SEQ ID NO: 284346 - RNA, 22 nt, Homo sapiens
uuauuguccaaguuucccuuug

SEQ ID NO: 284347 - RNA, 22 nt, Homo sapiens
uuauuugguuauuguaauuggg

SEQ ID NO: 284348 - RNA, 22 nt, Homo sapiens
uucaaaggauagauuaagauca

SEQ ID NO: 284349 - RNA, 23 nt, Homo sapiens
uucaaauguucucugguugucag

SEQ ID NO: 284350 - RNA, 22 nt, Homo sapiens
uucaacagugauggccuuugua

SEQ ID NO: 284351 - RNA, 22 nt, Homo sapiens
acaucccuuucccacccuucac

SEQ ID NO: 284352 - RNA, 22 nt, Homo sapiens
acaugcaucauuaggugguuua

SEQ ID NO: 284353 - RNA, 22 nt, Homo sapiens
acauggcacugcgggcuucuug

SEQ ID NO: 284354 - RNA, 22 nt, Homo sapiens
accagucucagguaugucuuua

SEQ ID NO: 284355 - RNA, 22 nt, Homo sapiens
accaguuuuuuauacaucuucu

SEQ ID NO: 284356 - RNA, 22 nt, Homo sapiens
accaugcaguccaauaugcaca

SEQ ID NO: 284357 - RNA, 22 nt, Homo sapiens
acccaguagucauucaggagca

SEQ ID NO: 284358 - RNA, 22 nt, Homo sapiens
acccaguguucagacuaccugu

SEQ ID NO: 284359 - RNA, 22 nt, Homo sapiens
acccaguguugggcagaacugu

SEQ ID NO: 284360 - RNA, 22 nt, Homo sapiens
acccgcccagguguggccggga

SEQ ID NO: 284361 - RNA, 22 nt, Homo sapiens
acccuguaacauacaagugguu

SEQ ID NO: 284362 - RNA, 22 nt, Homo sapiens
acccugucaaaauagaccaauc

SEQ ID NO: 284363 - RNA, 22 nt, Homo sapiens
acuacauaugacaucuucuuua

SEQ ID NO: 284364 - RNA, 22 nt, Homo sapiens
acuauacugaagcaaauuaaca

SEQ ID NO: 284365 - RNA, 22 nt, Homo sapiens
acucagagauuagcacauguuu

SEQ ID NO: 284366 - RNA, 22 nt, Homo sapiens
auugcccaggcuggagugcagu

SEQ ID NO: 284367 - RNA, 22 nt, Homo sapiens
auugccuagccuggucucaaaa

SEQ ID NO: 284368 - RNA, 22 nt, Homo sapiens
auugcucacacaaagccuguuu

SEQ ID NO: 284369 - RNA, 22 nt, Homo sapiens
auugcuuaagucccuguauuag

SEQ ID NO: 284370 - RNA, 22 nt, Homo sapiens
auugcuuacccuguauuagauc

SEQ ID NO: 284371 - RNA, 22 nt, Homo sapiens
auugcuuacuaaucaucuucag

SEQ ID NO: 284372 - RNA, 22 nt, Homo sapiens
auuggcagaaaucuuuauagua

SEQ ID NO: 284373 - RNA, 22 nt, Homo sapiens
auuguacuccagccugggcaaa

SEQ ID NO: 284374 - RNA, 22 nt, Homo sapiens
auuguacugccccccuguugcu

SEQ ID NO: 284375 - RNA, 22 nt, Homo sapiens
auugucccucuuaaucccagca

SEQ ID NO: 284376 - RNA, 22 nt, Homo sapiens
auugugauggucaaaggaaaua

SEQ ID NO: 284377 - RNA, 22 nt, Homo sapiens
auugugauugcugcuaggccua

SEQ ID NO: 284378 - RNA, 22 nt, Homo sapiens
auuguguagucuuacugcuugc

SEQ ID NO: 284379 - RNA, 22 nt, Homo sapiens
auugugucuuguagagagauau

SEQ ID NO: 284380 - RNA, 19 nt, Homo sapiens
auuugaucaucaggcacag

SEQ ID NO: 284381 - RNA, 22 nt, Homo sapiens
auuuggcaacguagggaggcau

SEQ ID NO: 284382 - RNA, 22 nt, Homo sapiens
auuuggcaguauaaugcuuugg

SEQ ID NO: 284383 - RNA, 22 nt, Homo sapiens
auuugggaaugugcauuauacu

SEQ ID NO: 284384 - RNA, 22 nt, Homo sapiens
auuuggguaaugagugcaaggg

SEQ ID NO: 284385 - RNA, 22 nt, Homo sapiens
auuuuugguuucaccugcacgc

SEQ ID NO: 284386 - RNA, 22 nt, Homo sapiens
caaaagugguucuuauccuuuu

SEQ ID NO: 284387 - RNA, 22 nt, Homo sapiens
caaaggauucauuuccaggagu

SEQ ID NO: 284388 - RNA, 22 nt, Homo sapiens
caaaguaauuacgguuuuggcc

SEQ ID NO: 284389 - RNA, 22 nt, Homo sapiens
caaagugcuggccgggcgcagu

SEQ ID NO: 284390 - RNA, 22 nt, Homo sapiens
caacagucagcccauccacaga

SEQ ID NO: 284391 - RNA, 22 nt, Homo sapiens
caacauccaccuccuggguuca

SEQ ID NO: 284392 - RNA, 22 nt, Homo sapiens
caagacuguccaacauauuggg

SEQ ID NO: 284393 - RNA, 22 nt, Homo sapiens
caagagaccugagugucauucu

SEQ ID NO: 284394 - RNA, 22 nt, Homo sapiens
caaggugcugagacaggagccc

SEQ ID NO: 284395 - RNA, 19 nt, Homo sapiens
caauacuucuuggcauaca

SEQ ID NO: 284396 - RNA, 22 nt, Homo sapiens
caaucugucuuuuagggggcca

SEQ ID NO: 284397 - RNA, 22 nt, Homo sapiens
caauggcacgaucucgucucac

SEQ ID NO: 284398 - RNA, 22 nt, Homo sapiens
caauggcacuauuggaaaaggu

SEQ ID NO: 284399 - RNA, 22 nt, Homo sapiens
caaugguacuagauaucuucag

SEQ ID NO: 284400 - RNA, 22 nt, Homo sapiens
cacacugucuucaauggguggu

SEQ ID NO: 284401 - RNA, 22 nt, Homo sapiens
cacacugucuuucagaaugguu

SEQ ID NO: 284402 - RNA, 22 nt, Homo sapiens
cacagcgacuuccgccuaccgg

SEQ ID NO: 284403 - RNA, 22 nt, Homo sapiens
cacagcuagucaaugguagaca

SEQ ID NO: 284404 - RNA, 23 nt, Homo sapiens
cacagggugaacaccccuaaucc

SEQ ID NO: 284405 - RNA, 22 nt, Homo sapiens
cacagucugggcuuguuuguac

SEQ ID NO: 284406 - RNA, 22 nt, Homo sapiens
cacaguugccuaucuccugaag

SEQ ID NO: 284407 - RNA, 22 nt, Homo sapiens
cacauagcuagucaguagugaa

SEQ ID NO: 284408 - RNA, 21 nt, Homo sapiens
cacauggaggcagagagugua

SEQ ID NO: 284409 - RNA, 22 nt, Homo sapiens
caccacagccauuauugucccc

SEQ ID NO: 284410 - RNA, 22 nt, Homo sapiens
caccacuacaccccaggcuggg

SEQ ID NO: 284411 - RNA, 19 nt, Homo sapiens
caccagugcaugcuacuau

SEQ ID NO: 284412 - RNA, 22 nt, Homo sapiens
gugcaguuuuaagugaguuucu

SEQ ID NO: 284413 - RNA, 22 nt, Homo sapiens
gugcauauaaguuguuucuagu

SEQ ID NO: 284414 - RNA, 22 nt, Homo sapiens
gugcauaucugugguuggcuga

SEQ ID NO: 284415 - RNA, 22 nt, Homo sapiens
gugcauguccacuaguccauau

SEQ ID NO: 284416 - RNA, 22 nt, Homo sapiens
gugcuaggugcuaggaagauag

SEQ ID NO: 284417 - RNA, 21 nt, Homo sapiens
gugcuuguagccucacuucug

SEQ ID NO: 284418 - RNA, 22 nt, Homo sapiens
gugcuuguauuuaaaucaugug

SEQ ID NO: 284419 - RNA, 22 nt, Homo sapiens
guggaaaacauaugcuuguuga

SEQ ID NO: 284420 - RNA, 22 nt, Homo sapiens
guggaagaaaucagguuauuug

SEQ ID NO: 284421 - RNA, 22 nt, Homo sapiens
guggaaugaaaacucucucaca

SEQ ID NO: 284422 - RNA, 22 nt, Homo sapiens
guggaauggaaugauuguguau

SEQ ID NO: 284423 - RNA, 22 nt, Homo sapiens
guggagacaaaggcugagugag

SEQ ID NO: 284424 - RNA, 22 nt, Homo sapiens
guggaggacuggauaaagaaaa

SEQ ID NO: 284425 - RNA, 22 nt, Homo sapiens
guggcaaguguuccaagaggcg

SEQ ID NO: 284426 - RNA, 22 nt, Homo sapiens
guggcacaauuaaguagcuauu

SEQ ID NO: 284427 - RNA, 22 nt, Homo sapiens
guggcagugugaggauccugcu

SEQ ID NO: 284428 - RNA, 22 nt, Homo sapiens
guggcaugaaagcaucugugau

SEQ ID NO: 284429 - RNA, 22 nt, Homo sapiens
guggcauuucccaaaguauucu

SEQ ID NO: 284430 - RNA, 23 nt, Homo sapiens
guggccuuuggccaguccgaguc

SEQ ID NO: 284431 - RNA, 22 nt, Homo sapiens
guggcuauuguucccugguugc

SEQ ID NO: 284432 - RNA, 22 nt, Homo sapiens
guggcuuguaggggucaaggga

SEQ ID NO: 284433 - RNA, 22 nt, Homo sapiens
aaggcaguggcagaagauguca

SEQ ID NO: 284434 - RNA, 22 nt, Homo sapiens
aaggcaugcaaagaacauuuua

SEQ ID NO: 284435 - RNA, 22 nt, Homo sapiens
aaggcauucucaaacuaguucu

SEQ ID NO: 284436 - RNA, 22 nt, Homo sapiens
aaggcgguguggauccuacagc

SEQ ID NO: 284437 - RNA, 22 nt, Homo sapiens
aaggcuguucauuuagcacagu

SEQ ID NO: 284438 - RNA, 22 nt, Homo sapiens
aagggaaugugguagcugguuu

SEQ ID NO: 284439 - RNA, 23 nt, Homo sapiens
aagguaagcuagaaagauguaga

SEQ ID NO: 284440 - RNA, 22 nt, Homo sapiens
aagguaguuuucuuuaaugcug

SEQ ID NO: 284441 - RNA, 22 nt, Homo sapiens
aagguggaguugacaauuuuca

SEQ ID NO: 284442 - RNA, 22 nt, Homo sapiens
aaguacuguuuaaauugcagaa

SEQ ID NO: 284443 - RNA, 22 nt, Homo sapiens
aaguagcuggaugcaguggcac

SEQ ID NO: 284444 - RNA, 22 nt, Homo sapiens
aagucacugagacuuguggcug

SEQ ID NO: 284445 - RNA, 22 nt, Homo sapiens
aagugaaugaugugaaguguaa

SEQ ID NO: 284446 - RNA, 22 nt, Homo sapiens
aagugaaugugcuggaauagcu

SEQ ID NO: 284447 - RNA, 22 nt, Homo sapiens
aagugaauguuugguagcagug

SEQ ID NO: 284448 - RNA, 22 nt, Homo sapiens
aagugaccuaacaaugaaggcc

SEQ ID NO: 284449 - RNA, 22 nt, Homo sapiens
aagugagaugcaguggaguucc

SEQ ID NO: 284450 - RNA, 22 nt, Homo sapiens
aagugaguaauacgucaguugu

SEQ ID NO: 284451 - RNA, 22 nt, Homo sapiens
aagugauguuauugggugacuc

SEQ ID NO: 284452 - RNA, 22 nt, Homo sapiens
aagugcauguauuaguguaguc

SEQ ID NO: 284453 - RNA, 22 nt, Homo sapiens
aagugcugggauuggccgggca

SEQ ID NO: 284454 - RNA, 22 nt, Homo sapiens
aagugcuuacagggaacaugau

SEQ ID NO: 284455 - RNA, 22 nt, Homo sapiens
aagugcuuaggauagugugugg

SEQ ID NO: 284456 - RNA, 22 nt, Homo sapiens
aaguggaauguuuguggcacaa

SEQ ID NO: 284457 - RNA, 22 nt, Homo sapiens
aagugguguuugggagcuggac

SEQ ID NO: 284458 - RNA, 22 nt, Homo sapiens
aaguguaaguuaauguuuaggu

SEQ ID NO: 284459 - RNA, 22 nt, Homo sapiens
aagugucuuaccgggagggagu

SEQ ID NO: 284460 - RNA, 22 nt, Homo sapiens
aaguuaauguuuaagacuccua

SEQ ID NO: 284461 - RNA, 22 nt, Homo sapiens
aauacuggcacugaagaccaug

SEQ ID NO: 284462 - RNA, 22 nt, Homo sapiens
aauagcuguuuuuaauuccugc

SEQ ID NO: 284463 - RNA, 22 nt, Homo sapiens
aauaucacaggguguacacuca

SEQ ID NO: 284464 - RNA, 22 nt, Homo sapiens
aauaugucugcuaauuguuucu

SEQ ID NO: 284465 - RNA, 22 nt, Homo sapiens
aaucacacuugauguugagcaa

SEQ ID NO: 284466 - RNA, 22 nt, Homo sapiens
aaucagcacacugugcuuucca

SEQ ID NO: 284467 - RNA, 22 nt, Homo sapiens
aauccaugugcuuuaccauuuu

SEQ ID NO: 284468 - RNA, 22 nt, Homo sapiens
aaucucaacacuuugggaggcu

SEQ ID NO: 284469 - RNA, 22 nt, Homo sapiens
aaucucagcauuuugggcugag

SEQ ID NO: 284470 - RNA, 22 nt, Homo sapiens
aaucugggguuguuuggggagu

SEQ ID NO: 284471 - RNA, 22 nt, Homo sapiens
aaucuguagaaggugcacauuc

SEQ ID NO: 284472 - RNA, 22 nt, Homo sapiens
aaucugucuagacaaggagucu

SEQ ID NO: 284473 - RNA, 22 nt, Homo sapiens
aaugacacugagcaucuuucau

SEQ ID NO: 284474 - RNA, 22 nt, Homo sapiens
aaugacagccagauucuucucu

SEQ ID NO: 284475 - RNA, 17 nt, Homo sapiens
aaugagacauuucugcu

SEQ ID NO: 284476 - RNA, 22 nt, Homo sapiens
aaugauauguuauguuuagguu

SEQ ID NO: 284477 - RNA, 22 nt, Homo sapiens
aaugcacauauauuuccuuauu

SEQ ID NO: 284478 - RNA, 22 nt, Homo sapiens
aaugcaucuagaaaggugaauu

SEQ ID NO: 284479 - RNA, 22 nt, Homo sapiens
aauggagcuguuuggaugacuu

SEQ ID NO: 284480 - RNA, 22 nt, Homo sapiens
aauggcaagagccacagaggcg

SEQ ID NO: 284481 - RNA, 22 nt, Homo sapiens
aauggcacaagacaugaagaag

SEQ ID NO: 284482 - RNA, 22 nt, Homo sapiens
aauggcauugguccuuuuggau

SEQ ID NO: 284483 - RNA, 22 nt, Homo sapiens
aauggguaguacugugguaaca

SEQ ID NO: 284484 - RNA, 21 nt, Homo sapiens
aaugguguugccaacaaggug

SEQ ID NO: 284485 - RNA, 22 nt, Homo sapiens
aaugguguuuccguuaagcuga

SEQ ID NO: 284486 - RNA, 22 nt, Homo sapiens
aaaagcauucagagugcugggc

SEQ ID NO: 284487 - RNA, 22 nt, Homo sapiens
aaaaggcuagcuaguaacagaa

SEQ ID NO: 284488 - RNA, 22 nt, Homo sapiens
aaaagugguguuguuucuaaau

SEQ ID NO: 284489 - RNA, 22 nt, Homo sapiens
aaagcagcaggugguuuucaau

SEQ ID NO: 284490 - RNA, 22 nt, Homo sapiens
aaaggcacugaucuuauccagu

SEQ ID NO: 284491 - RNA, 22 nt, Homo sapiens
aaagggcuguuucuugacuugg

SEQ ID NO: 284492 - RNA, 22 nt, Homo sapiens
aaagggcuugaauacucuuuuu

SEQ ID NO: 284493 - RNA, 22 nt, Homo sapiens
aaagguaguacuucuagaaggg

SEQ ID NO: 284494 - RNA, 22 nt, Homo sapiens
aaagucacuggagaaggaauau

SEQ ID NO: 284495 - RNA, 22 nt, Homo sapiens
aaagucuguuacagcuauuucu

SEQ ID NO: 284496 - RNA, 22 nt, Homo sapiens
aaagugacuuagugccccauuu

SEQ ID NO: 284497 - RNA, 22 nt, Homo sapiens
aaagugcugagauuguaggcau

SEQ ID NO: 284498 - RNA, 22 nt, Homo sapiens
aaagugcugggauuaggccagg

SEQ ID NO: 284499 - RNA, 22 nt, Homo sapiens
aaagugcugggauuggcugggc

SEQ ID NO: 284500 - RNA, 22 nt, Homo sapiens
aaagugcuguagacugggcgca

SEQ ID NO: 284501 - RNA, 22 nt, Homo sapiens
aaaguggugugaguauguaucu

SEQ ID NO: 284502 - RNA, 22 nt, Homo sapiens
aaaguucuguugauagugcuga

SEQ ID NO: 284503 - RNA, 22 nt, Homo sapiens
aaauaacugucagguucuggaa

SEQ ID NO: 284504 - RNA, 22 nt, Homo sapiens
aaaugcacaaagauuuugcacu

SEQ ID NO: 284505 - RNA, 21 nt, Homo sapiens
aaaugcacauuacugcuggug

SEQ ID NO: 284506 - RNA, 22 nt, Homo sapiens
aaaugcauaucaagauugcccu

SEQ ID NO: 284507 - RNA, 22 nt, Homo sapiens
aaaugcaugaauaagcucgugu

SEQ ID NO: 284508 - RNA, 22 nt, Homo sapiens
aaaugcauggacagcuggucuu

SEQ ID NO: 284509 - RNA, 22 nt, Homo sapiens
aaauggauuaaguucacuugcu

SEQ ID NO: 284510 - RNA, 22 nt, Homo sapiens
aaaugggacugggguccuuuga

SEQ ID NO: 284511 - RNA, 22 nt, Homo sapiens
aaaugguguuaguagaucuuua

SEQ ID NO: 284512 - RNA, 19 nt, Homo sapiens
aaaugugcacuguuuucca

SEQ ID NO: 284513 - RNA, 21 nt, Homo sapiens
aaaugugcuuuaguacccuca

SEQ ID NO: 284514 - RNA, 22 nt, Homo sapiens
aaauugcuuuugaagacuuagu

SEQ ID NO: 284515 - RNA, 22 nt, Homo sapiens
aacaccuugcagggauuaugac

SEQ ID NO: 284516 - RNA, 22 nt, Homo sapiens
aacagaauccucuuuuccuggg

SEQ ID NO: 284517 - RNA, 22 nt, Homo sapiens
aacaggguguuugcaguuucuu

SEQ ID NO: 284518 - RNA, 22 nt, Homo sapiens
aacagucuccaguuguauccau

SEQ ID NO: 284519 - RNA, 21 nt, Homo sapiens
aacagugcugaacagacaccu

SEQ ID NO: 284520 - RNA, 22 nt, Homo sapiens
aacaucaaccaugaggguugga

SEQ ID NO: 284521 - RNA, 22 nt, Homo sapiens
aacauguuuagcagauaccugu

SEQ ID NO: 284522 - RNA, 22 nt, Homo sapiens
aaccuuuagucagcucuuagga

SEQ ID NO: 284523 - RNA, 22 nt, Homo sapiens
aacuaugucaaauaaaaugagg

SEQ ID NO: 284524 - RNA, 22 nt, Homo sapiens
aacucugucuccuucaaguuca

SEQ ID NO: 284525 - RNA, 22 nt, Homo sapiens
aacugcuguuuggguacuggug

SEQ ID NO: 284526 - RNA, 22 nt, Homo sapiens
aacuggccugagaugaaaagug

SEQ ID NO: 284527 - RNA, 21 nt, Homo sapiens
aacuggugugagaugguaugu

SEQ ID NO: 284528 - RNA, 22 nt, Homo sapiens
aacuugcacuugauugagagcu

SEQ ID NO: 284529 - RNA, 21 nt, Homo sapiens
aagaaagcuggacuugccgcu

SEQ ID NO: 284530 - RNA, 18 nt, Homo sapiens
aaaaagugcucaggccua

SEQ ID NO: 284531 - RNA, 22 nt, Homo sapiens
aaaagagcugagagguauucuu

SEQ ID NO: 284532 - RNA, 22 nt, Homo sapiens
aaaagcuuagaugggcuuguau

SEQ ID NO: 284533 - RNA, 22 nt, Homo sapiens
aaaaugcugauauugggcccca

SEQ ID NO: 284534 - RNA, 22 nt, Homo sapiens
aaacauugaccucauccuggca

SEQ ID NO: 284535 - RNA, 20 nt, Homo sapiens
aaacucugucuucuuuauca

SEQ ID NO: 284536 - RNA, 21 nt, Homo sapiens
aaacuggcccaauuguuccau

SEQ ID NO: 284537 - RNA, 22 nt, Homo sapiens
aaagagaucuaugggcacuaug

SEQ ID NO: 284538 - RNA, 22 nt, Homo sapiens
aaagcacugaauaaauuugcuu

SEQ ID NO: 284539 - RNA, 22 nt, Homo sapiens
aaagcacuggagucaucaucua

SEQ ID NO: 284540 - RNA, 22 nt, Homo sapiens
aaaggcacuagaaguuaccuuu

SEQ ID NO: 284541 - RNA, 22 nt, Homo sapiens
aaaguacucaguucaguuccgu

SEQ ID NO: 284542 - RNA, 22 nt, Homo sapiens
aaagucuguuuugucagagacu

SEQ ID NO: 284543 - RNA, 22 nt, Homo sapiens
aaagugcacuuggaagagggcc

SEQ ID NO: 284544 - RNA, 22 nt, Homo sapiens
aaagugcaguauuugggcagga

SEQ ID NO: 284545 - RNA, 22 nt, Homo sapiens
aaagugcugagaguucuaacuu

SEQ ID NO: 284546 - RNA, 22 nt, Homo sapiens
aaagugcugggauuuuaggcau

SEQ ID NO: 284547 - RNA, 22 nt, Homo sapiens
uacagugcuuuuugguggagaa

SEQ ID NO: 284548 - RNA, 22 nt, Homo sapiens
uacaguguuuugguauuccaca

SEQ ID NO: 284549 - RNA, 22 nt, Homo sapiens
uacaucagccugaaagagcucg

SEQ ID NO: 284550 - RNA, 22 nt, Homo sapiens
uacauuggcuagguuuggaggc

SEQ ID NO: 284551 - RNA, 23 nt, Homo sapiens
uaccacauuccuucuuuccuguu

SEQ ID NO: 284552 - RNA, 22 nt, Homo sapiens
uaccugagaaagaaagcccucg

SEQ ID NO: 284553 - RNA, 22 nt, Homo sapiens
uaccuuugucaguuacucaccu

SEQ ID NO: 284554 - RNA, 16 nt, Homo sapiens
uacuacugccuauuau

SEQ ID NO: 284555 - RNA, 22 nt, Homo sapiens
uacuauugcaucggugauuagg

SEQ ID NO: 284556 - RNA, 22 nt, Homo sapiens
uacuccccuuguucugugagcu

SEQ ID NO: 284557 - RNA, 22 nt, Homo sapiens
uacucugcaguaauuccagccc

SEQ ID NO: 284558 - RNA, 20 nt, Homo sapiens
uacugcacuccauccugggu

SEQ ID NO: 284559 - RNA, 18 nt, Homo sapiens
uacugcacucuccagccu

SEQ ID NO: 284560 - RNA, 22 nt, Homo sapiens
uacugcaguugcagcuugagga

SEQ ID NO: 284561 - RNA, 22 nt, Homo sapiens
uacuuuguuauagcagcaggaa

SEQ ID NO: 284562 - RNA, 20 nt, Homo sapiens
uagaaaguagaguggugguu

SEQ ID NO: 284563 - RNA, 22 nt, Homo sapiens
uagaaaguagggaagguaggau

SEQ ID NO: 284564 - RNA, 22 nt, Homo sapiens
uagaacaauugcuggauccgaa

SEQ ID NO: 284565 - RNA, 22 nt, Homo sapiens
uagaagcacuaucccuccuagu

SEQ ID NO: 284566 - RNA, 22 nt, Homo sapiens
uagaauggaagguugagaagaa

SEQ ID NO: 284567 - RNA, 22 nt, Homo sapiens
uagacacuagauaugugacuga

SEQ ID NO: 284568 - RNA, 22 nt, Homo sapiens
uagagcuaguuuuuaaucuaac

SEQ ID NO: 284569 - RNA, 22 nt, Homo sapiens
uagaguguaaaccacauaguga

SEQ ID NO: 284570 - RNA, 21 nt, Homo sapiens
uagauaguugguucugaaucu

SEQ ID NO: 284571 - RNA, 22 nt, Homo sapiens
uagaucaauuaauuguuacuug

SEQ ID NO: 284572 - RNA, 21 nt, Homo sapiens
uagaugguguucuagagagaa

SEQ ID NO: 284573 - RNA, 22 nt, Homo sapiens
uagauuaucauucauacaggga

SEQ ID NO: 284574 - RNA, 22 nt, Homo sapiens
uagauuaucccugauuugucca

SEQ ID NO: 284575 - RNA, 22 nt, Homo sapiens
uagauuaucucaccacucgagu

SEQ ID NO: 284576 - RNA, 22 nt, Homo sapiens
uagauucaucuguuccuuuuga

SEQ ID NO: 284577 - RNA, 22 nt, Homo sapiens
uagauucauuuuagcaaaaguu

SEQ ID NO: 284578 - RNA, 22 nt, Homo sapiens
uagcaccucuuuggccuuucgu

SEQ ID NO: 284579 - RNA, 22 nt, Homo sapiens
uagcacuauuuauugaaaagga

SEQ ID NO: 284580 - RNA, 19 nt, Homo sapiens
uagcagcaugauuuauaau

SEQ ID NO: 284581 - RNA, 22 nt, Homo sapiens
uagcaggaaaggggucagaucu

SEQ ID NO: 284582 - RNA, 17 nt, Homo sapiens
uagcucuauuucuagcc

SEQ ID NO: 284583 - RNA, 22 nt, Homo sapiens
uagcugagacuacaguaggugc

SEQ ID NO: 284584 - RNA, 22 nt, Homo sapiens
uaggacauugcccuuguggaga

SEQ ID NO: 284585 - RNA, 22 nt, Homo sapiens
uaggagugugaacccuaugaac

SEQ ID NO: 284586 - RNA, 22 nt, Homo sapiens
uaggcaauggagauagaggaug

SEQ ID NO: 284587 - RNA, 22 nt, Homo sapiens
uaggcaguggagaaauaaacag

SEQ ID NO: 284588 - RNA, 22 nt, Homo sapiens
uaggcaguguucucacuuguaa

SEQ ID NO: 284589 - RNA, 22 nt, Homo sapiens
uaggcaguuuuccuuucacagu

SEQ ID NO: 284590 - RNA, 22 nt, Homo sapiens
uaggccuuuuucagauggguag

SEQ ID NO: 284591 - RNA, 22 nt, Homo sapiens
uaggcgagauguguguuucaug

SEQ ID NO: 284592 - RNA, 22 nt, Homo sapiens
uagggaguuuuggggugcagaa

SEQ ID NO: 284593 - RNA, 19 nt, Homo sapiens
uagggcacgaggcagaguc

SEQ ID NO: 284594 - RNA, 22 nt, Homo sapiens
uagggcaugugggaaguuauaa

SEQ ID NO: 284595 - RNA, 22 nt, Homo sapiens
uagggcauuuagaggcuauuaa

SEQ ID NO: 284596 - RNA, 22 nt, Homo sapiens
uagguauguauauacacacaca

SEQ ID NO: 284597 - RNA, 22 nt, Homo sapiens
uaggucuccuuuuugccuaaau

SEQ ID NO: 284598 - RNA, 22 nt, Homo sapiens
uaggugaaugcuggaagaaaug

SEQ ID NO: 284599 - RNA, 22 nt, Homo sapiens
uaggugguuugaaauacucaag

SEQ ID NO: 284600 - RNA, 22 nt, Homo sapiens
uagguucucaggaaugagcuuc

SEQ ID NO: 284601 - RNA, 22 nt, Homo sapiens
uagguugucuucccagaguuuu

SEQ ID NO: 284602 - RNA, 22 nt, Homo sapiens
uaguaaacauaguucuuuugcu

SEQ ID NO: 284603 - RNA, 22 nt, Homo sapiens
uaguaaacauuuuucuaucauu

SEQ ID NO: 284604 - RNA, 22 nt, Homo sapiens
acugagccuuuaaaugacuuca

SEQ ID NO: 284605 - RNA, 19 nt, Homo sapiens
acugagcuaccugggggca

SEQ ID NO: 284606 - RNA, 20 nt, Homo sapiens
acugauauguuccuguucuc

SEQ ID NO: 284607 - RNA, 22 nt, Homo sapiens
acugcacuccaaccuuggugac

SEQ ID NO: 284608 - RNA, 22 nt, Homo sapiens
acugcacuccacccuuggcagc

SEQ ID NO: 284609 - RNA, 22 nt, Homo sapiens
acugcacuccagcccgggugac

SEQ ID NO: 284610 - RNA, 22 nt, Homo sapiens
acugcacuccagccugcccaac

SEQ ID NO: 284611 - RNA, 22 nt, Homo sapiens
acugcacuccagccuuggcggc

SEQ ID NO: 284612 - RNA, 20 nt, Homo sapiens
acugcacuccaggcugccca

SEQ ID NO: 284613 - RNA, 22 nt, Homo sapiens
acugcacuccaguuugggcagc

SEQ ID NO: 284614 - RNA, 18 nt, Homo sapiens
acugcacuccauccuagg

SEQ ID NO: 284615 - RNA, 22 nt, Homo sapiens
acugcacuccggccucgugaca

SEQ ID NO: 284616 - RNA, 22 nt, Homo sapiens
acugcacuccuccuugggugac

SEQ ID NO: 284617 - RNA, 22 nt, Homo sapiens
acugcacugcagccuggccaac

SEQ ID NO: 284618 - RNA, 22 nt, Homo sapiens
acugcacuucagccuguugaca

SEQ ID NO: 284619 - RNA, 18 nt, Homo sapiens
acuggauguaaagggucc

SEQ ID NO: 284620 - RNA, 22 nt, Homo sapiens
acuggcucugcuuuacaaacag

SEQ ID NO: 284621 - RNA, 22 nt, Homo sapiens
acuguguguuugucuagcacag

SEQ ID NO: 284622 - RNA, 22 nt, Homo sapiens
acuugacacuuauauuacucac

SEQ ID NO: 284623 - RNA, 22 nt, Homo sapiens
acuuggcaaaguuuuaaacagc

SEQ ID NO: 284624 - RNA, 17 nt, Homo sapiens
acuuuuugaggaggcau

SEQ ID NO: 284625 - RNA, 22 nt, Homo sapiens
agaaacauucucuugccuccuu

SEQ ID NO: 284626 - RNA, 22 nt, Homo sapiens
agaaagugcuucccuuugguga

SEQ ID NO: 284627 - RNA, 22 nt, Homo sapiens
agaaauguuuauucaaacccgu

SEQ ID NO: 284628 - RNA, 22 nt, Homo sapiens
agaacccuuugaaauguguuug

SEQ ID NO: 284629 - RNA, 19 nt, Homo sapiens
agaagugcauggucuagag

SEQ ID NO: 284630 - RNA, 22 nt, Homo sapiens
agaauguaaacagaauagagga

SEQ ID NO: 284631 - RNA, 22 nt, Homo sapiens
agaaugucagcuggauucagcu

SEQ ID NO: 284632 - RNA, 22 nt, Homo sapiens
agaauguuuuagaccaauacaa

SEQ ID NO: 284633 - RNA, 22 nt, Homo sapiens
agacaagauggcuugagguuca

SEQ ID NO: 284634 - RNA, 22 nt, Homo sapiens
agacacugaaauguauugaaga

SEQ ID NO: 284635 - RNA, 20 nt, Homo sapiens
agacagcugcagcccacauc

SEQ ID NO: 284636 - RNA, 20 nt, Homo sapiens
agacuagggagcagaaagcc

SEQ ID NO: 284637 - RNA, 22 nt, Homo sapiens
agagaacugauucagggaaaau

SEQ ID NO: 284638 - RNA, 22 nt, Homo sapiens
agagauaauuagguuaaaugag

SEQ ID NO: 284639 - RNA, 22 nt, Homo sapiens
agagaucacugaaucacggggg

SEQ ID NO: 284640 - RNA, 22 nt, Homo sapiens
agagcaauguuaucagucucug

SEQ ID NO: 284641 - RNA, 21 nt, Homo sapiens
agaggacugaccacagcccua

SEQ ID NO: 284642 - RNA, 22 nt, Homo sapiens
agagguaagcaguggcaagugc

SEQ ID NO: 284643 - RNA, 22 nt, Homo sapiens
agagguagaagauaggcuacag

SEQ ID NO: 284644 - RNA, 22 nt, Homo sapiens
agagguuuaacuggcuuauggu

SEQ ID NO: 284645 - RNA, 22 nt, Homo sapiens
agagguuuaauugauucacagu

SEQ ID NO: 284646 - RNA, 22 nt, Homo sapiens
agaguacaggcaaguuagucau

SEQ ID NO: 284647 - RNA, 22 nt, Homo sapiens
agagucacaugaggcccuucau

SEQ ID NO: 284648 - RNA, 22 nt, Homo sapiens
agaugauguuuacugagcauca

SEQ ID NO: 284649 - RNA, 20 nt, Homo sapiens
agaugcaugcacauaaacac

SEQ ID NO: 284650 - RNA, 18 nt, Homo sapiens
agaugcaugcucacuaca

SEQ ID NO: 284651 - RNA, 23 nt, Homo sapiens
agaugcauucuuguaggauauau

SEQ ID NO: 284652 - RNA, 22 nt, Homo sapiens
agaugcauugguggcauauuca

SEQ ID NO: 284653 - RNA, 22 nt, Homo sapiens
agaugcuguuaucaacuguagc

SEQ ID NO: 284654 - RNA, 23 nt, Homo sapiens
agauggcauuucaguucuuuagg

SEQ ID NO: 284655 - RNA, 22 nt, Homo sapiens
agauucauccaaguuguugcau

SEQ ID NO: 284656 - RNA, 22 nt, Homo sapiens
agcaacauugagacugcaguug

SEQ ID NO: 284657 - RNA, 22 nt, Homo sapiens
agcaagacauggcuuccaaaug

SEQ ID NO: 284658 - RNA, 22 nt, Homo sapiens
agcaauaugacauugcuacauc

SEQ ID NO: 284659 - RNA, 22 nt, Homo sapiens
agcaccaauaacaguuucuagc

SEQ ID NO: 284660 - RNA, 23 nt, Homo sapiens
agcaccuuuccuccacuaucugc

SEQ ID NO: 284661 - RNA, 22 nt, Homo sapiens
agcagcaugcaaauggacuaau

SEQ ID NO: 284662 - RNA, 22 nt, Homo sapiens
agccaguauuuuauugaggauu

SEQ ID NO: 284663 - RNA, 21 nt, Homo sapiens
agccaguguuccuuguggcuc

SEQ ID NO: 284664 - RNA, 22 nt, Homo sapiens
agcccagagacuguguaaauuu

SEQ ID NO: 284665 - RNA, 20 nt, Homo sapiens
agccccauguaaaccacaug

SEQ ID NO: 284666 - RNA, 22 nt, Homo sapiens
agccccauuuguugaaaagacg

SEQ ID NO: 284667 - RNA, 22 nt, Homo sapiens
agcccuuagauggcuccuucca

SEQ ID NO: 284668 - RNA, 22 nt, Homo sapiens
guacaaguaagaaaauugccca

SEQ ID NO: 284669 - RNA, 22 nt, Homo sapiens
guacaggcagcaaacaccauaa

SEQ ID NO: 284670 - RNA, 22 nt, Homo sapiens
guacaugugcacagugugcagg

SEQ ID NO: 284671 - RNA, 22 nt, Homo sapiens
guaccucaguuggaaaugcaga

SEQ ID NO: 284672 - RNA, 22 nt, Homo sapiens
guagagguagacuuccuugucu

SEQ ID NO: 284673 - RNA, 22 nt, Homo sapiens
guagagugcugggcacuggcuc

SEQ ID NO: 284674 - RNA, 22 nt, Homo sapiens
guagcagcaauuuacuccauac

SEQ ID NO: 284675 - RNA, 22 nt, Homo sapiens
guagugcaguuugagaaucagu

SEQ ID NO: 284676 - RNA, 22 nt, Homo sapiens
guaguggcaugaucuuggcuca

SEQ ID NO: 284677 - RNA, 22 nt, Homo sapiens
ucacaugaauugucuuguucca

SEQ ID NO: 284678 - RNA, 22 nt, Homo sapiens
ucacauggaggugauaguugaa

SEQ ID NO: 284679 - RNA, 22 nt, Homo sapiens
ucacaugugcguuuuggcaugu

SEQ ID NO: 284680 - RNA, 22 nt, Homo sapiens
ucacauguguaaauugguguaa

SEQ ID NO: 284681 - RNA, 22 nt, Homo sapiens
ucaccaccugcugauuguagag

SEQ ID NO: 284682 - RNA, 22 nt, Homo sapiens
ucaccagugucagggaacugcu

SEQ ID NO: 284683 - RNA, 22 nt, Homo sapiens
ucaccuggagccuucacauucu

SEQ ID NO: 284684 - RNA, 22 nt, Homo sapiens
ucacgugguucauaaggcagaa

SEQ ID NO: 284685 - RNA, 22 nt, Homo sapiens
ucacuaggcuggagugcagugg

SEQ ID NO: 284686 - RNA, 22 nt, Homo sapiens
ucacuauagaaaacagugugga

SEQ ID NO: 284687 - RNA, 22 nt, Homo sapiens
ucacugaaaccgccuccaccuc

SEQ ID NO: 284688 - RNA, 22 nt, Homo sapiens
ucacugaaaccuccaccucucg

SEQ ID NO: 284689 - RNA, 22 nt, Homo sapiens
ucacugcacucuccgccuugcg

SEQ ID NO: 284690 - RNA, 22 nt, Homo sapiens
ucacugcgaccuccaccucccg

SEQ ID NO: 284691 - RNA, 22 nt, Homo sapiens
ucacugcgaccuccaccuccug

SEQ ID NO: 284692 - RNA, 19 nt, Homo sapiens
ucacuggacagcacacuca

SEQ ID NO: 284693 - RNA, 22 nt, Homo sapiens
ucacugggagaccaaagccauc

SEQ ID NO: 284694 - RNA, 20 nt, Homo sapiens
ucacuggguucuugaagucu

SEQ ID NO: 284695 - RNA, 22 nt, Homo sapiens
ucacuggucuaaguggaggggg

SEQ ID NO: 284696 - RNA, 22 nt, Homo sapiens
ucacugugagaguuuauccugu

SEQ ID NO: 284697 - RNA, 22 nt, Homo sapiens
ucacugugugucucuguaucug

SEQ ID NO: 284698 - RNA, 18 nt, Homo sapiens
ucacugugugucuugggu

SEQ ID NO: 284699 - RNA, 22 nt, Homo sapiens
ucagaguagcugucugaggugc

SEQ ID NO: 284700 - RNA, 22 nt, Homo sapiens
ucagaucacuggcgcuggcgga

SEQ ID NO: 284701 - RNA, 22 nt, Homo sapiens
ucagcaaugaccuaagcaaaua

SEQ ID NO: 284702 - RNA, 22 nt, Homo sapiens
ucagcagugugaaaacaaacua

SEQ ID NO: 284703 - RNA, 22 nt, Homo sapiens
ucagcaucacaggcagugagug

SEQ ID NO: 284704 - RNA, 22 nt, Homo sapiens
ucagcgggaguggaaagucaga

SEQ ID NO: 284705 - RNA, 22 nt, Homo sapiens
ucaggcuuuucccagagugaug

SEQ ID NO: 284706 - RNA, 21 nt, Homo sapiens
ucaggcuuuuugagugccaau

SEQ ID NO: 284707 - RNA, 20 nt, Homo sapiens
ucagguagaucuuugagguc

SEQ ID NO: 284708 - RNA, 22 nt, Homo sapiens
uggucauggggcagcugacacu

SEQ ID NO: 284709 - RNA, 20 nt, Homo sapiens
ugguccccaccaaaucucau

SEQ ID NO: 284710 - RNA, 20 nt, Homo sapiens
ugguccccugagucuggcuu

SEQ ID NO: 284711 - RNA, 22 nt, Homo sapiens
ugguccuuuccauuggagacac

SEQ ID NO: 284712 - RNA, 22 nt, Homo sapiens
uggucuccuuuguacccugggc

SEQ ID NO: 284713 - RNA, 22 nt, Homo sapiens
uggucucuuugcuuuagucauc

SEQ ID NO: 284714 - RNA, 19 nt, Homo sapiens
uggugccuuguucuuggau

SEQ ID NO: 284715 - RNA, 15 nt, Homo sapiens
uggugguguugagac

SEQ ID NO: 284716 - RNA, 22 nt, Homo sapiens
ugguuagucuguguguauauau

SEQ ID NO: 284717 - RNA, 20 nt, Homo sapiens
uguaacacauggagaacucu

SEQ ID NO: 284718 - RNA, 21 nt, Homo sapiens
uguaacugcaaaccucagauu

SEQ ID NO: 284719 - RNA, 19 nt, Homo sapiens
uguaccagcaagucuuuuc

SEQ ID NO: 284720 - RNA, 22 nt, Homo sapiens
uguagauaucuaucaggucaau

SEQ ID NO: 284721 - RNA, 22 nt, Homo sapiens
uguagcacauuugaagagaagc

SEQ ID NO: 284722 - RNA, 21 nt, Homo sapiens
uguauacauauguuaggugca

SEQ ID NO: 284723 - RNA, 22 nt, Homo sapiens
uguaugcuuuugagagauauuu

SEQ ID NO: 284724 - RNA, 22 nt, Homo sapiens
uguauguaaagacaggauaaca

SEQ ID NO: 284725 - RNA, 22 nt, Homo sapiens
uguauguugauguuauauucug

SEQ ID NO: 284726 - RNA, 22 nt, Homo sapiens
ugucaaauucuggguuaaaaca

SEQ ID NO: 284727 - RNA, 20 nt, Homo sapiens
ugucaagaaacauuacuuau

SEQ ID NO: 284728 - RNA, 22 nt, Homo sapiens
ugucaaggaaugucauugguuu

SEQ ID NO: 284729 - RNA, 20 nt, Homo sapiens
ugucaaggaauucccaaauc

SEQ ID NO: 284730 - RNA, 21 nt, Homo sapiens
ugucaagugggaaaacaugua

SEQ ID NO: 284731 - RNA, 18 nt, Homo sapiens
ugucacuggauaaugguc

SEQ ID NO: 284732 - RNA, 22 nt, Homo sapiens
ugucacugugcagucaugcauu

SEQ ID NO: 284733 - RNA, 18 nt, Homo sapiens
ugucagaguggauuguaa

SEQ ID NO: 284734 - RNA, 22 nt, Homo sapiens
ugucaggaggguccagagaaaa

SEQ ID NO: 284735 - RNA, 22 nt, Homo sapiens
ugucaguuucccuccucuuccu

SEQ ID NO: 284736 - RNA, 22 nt, Homo sapiens
ugucaucauuggaaucugccuc

SEQ ID NO: 284737 - RNA, 22 nt, Homo sapiens
ugucaugguguuaauuuuccug

SEQ ID NO: 284738 - RNA, 22 nt, Homo sapiens
ugucaugugagggaacuuguuc

SEQ ID NO: 284739 - RNA, 20 nt, Homo sapiens
ugucauuaagcacugugcca

SEQ ID NO: 284740 - RNA, 22 nt, Homo sapiens
uguccaaauugaaucaucuggu

SEQ ID NO: 284741 - RNA, 22 nt, Homo sapiens
uguccaguguuccucagaagaa

SEQ ID NO: 284742 - RNA, 22 nt, Homo sapiens
ugucccugagccuggauuccug

SEQ ID NO: 284743 - RNA, 22 nt, Homo sapiens
uguccuagagggaugucacccc

SEQ ID NO: 284744 - RNA, 20 nt, Homo sapiens
ugucuauggggguucucugc

SEQ ID NO: 284745 - RNA, 22 nt, Homo sapiens
ugucuggaaggguggccuccug

SEQ ID NO: 284746 - RNA, 22 nt, Homo sapiens
ugugaacauuuuguauauauua

SEQ ID NO: 284747 - RNA, 19 nt, Homo sapiens
ugugaagaaaugcugcaag

SEQ ID NO: 284748 - RNA, 22 nt, Homo sapiens
ugugaauggugcuuccuagaug

SEQ ID NO: 284749 - RNA, 22 nt, Homo sapiens
ugugacacugaauggcagaacu

SEQ ID NO: 284750 - RNA, 22 nt, Homo sapiens
uccagguuuggcuuuauaacuu

SEQ ID NO: 284751 - RNA, 22 nt, Homo sapiens
uccagguuuugugaguuuaaau

SEQ ID NO: 284752 - RNA, 22 nt, Homo sapiens
uccaguacaggucucucauuuc

SEQ ID NO: 284753 - RNA, 22 nt, Homo sapiens
uccaguuguucucgaagcuccu

SEQ ID NO: 284754 - RNA, 22 nt, Homo sapiens
uccauagugagcagucaaugua

SEQ ID NO: 284755 - RNA, 22 nt, Homo sapiens
uccaugaguccauuagaaaaaa

SEQ ID NO: 284756 - RNA, 22 nt, Homo sapiens
uccauugucuagauguaacaca

SEQ ID NO: 284757 - RNA, 22 nt, Homo sapiens
ucccaagaugagaugggggcug

SEQ ID NO: 284758 - RNA, 19 nt, Homo sapiens
ucccaagaugcucauacau

SEQ ID NO: 284759 - RNA, 19 nt, Homo sapiens
ucccaauguuuccaggcag

SEQ ID NO: 284760 - RNA, 22 nt, Homo sapiens
ucccacugucuucucgugcucg

SEQ ID NO: 284761 - RNA, 20 nt, Homo sapiens
ucccaguaggagaaggaagg

SEQ ID NO: 284762 - RNA, 22 nt, Homo sapiens
ucccaguauucauuuacagaag

SEQ ID NO: 284763 - RNA, 22 nt, Homo sapiens
ucccagugcuaugcaaaagccu

SEQ ID NO: 284764 - RNA, 22 nt, Homo sapiens
uccccugagaccccucagcacu

SEQ ID NO: 284765 - RNA, 22 nt, Homo sapiens
ucccugacagggucugagcuuu

SEQ ID NO: 284766 - RNA, 22 nt, Homo sapiens
ucccuggacagccuugccuggg

SEQ ID NO: 284767 - RNA, 22 nt, Homo sapiens
ucccuguagugccuagaucaga

SEQ ID NO: 284768 - RNA, 22 nt, Homo sapiens
ucccuuaaugaugaacaaugag

SEQ ID NO: 284769 - RNA, 22 nt, Homo sapiens
ucccuugguaauucuguuccuu

SEQ ID NO: 284770 - RNA, 22 nt, Homo sapiens
uccugagacucacaggcucccc

SEQ ID NO: 284771 - RNA, 21 nt, Homo sapiens
uccugagagaggaguaacucu

SEQ ID NO: 284772 - RNA, 22 nt, Homo sapiens
uccugcauucauccugguguug

SEQ ID NO: 284773 - RNA, 22 nt, Homo sapiens
uccuggcuccacuguuuauucc

SEQ ID NO: 284774 - RNA, 22 nt, Homo sapiens
ugugucuacugagaugaucaug

SEQ ID NO: 284775 - RNA, 22 nt, Homo sapiens
ugugucuuguuuauagcuuucu

SEQ ID NO: 284776 - RNA, 22 nt, Homo sapiens
uguuaacauggucucagucugu

SEQ ID NO: 284777 - RNA, 22 nt, Homo sapiens
uguuaaggcagagauaauacau

SEQ ID NO: 284778 - RNA, 22 nt, Homo sapiens
uguuacacugugcacuaaauuu

SEQ ID NO: 284779 - RNA, 22 nt, Homo sapiens
uguuagguuggugcaaaaguga

SEQ ID NO: 284780 - RNA, 22 nt, Homo sapiens
uguucacaguguuucuuugaga

SEQ ID NO: 284781 - RNA, 19 nt, Homo sapiens
uguugcacauaucaauaug

SEQ ID NO: 284782 - RNA, 22 nt, Homo sapiens
uguugcacuccagccuggguga

SEQ ID NO: 284783 - RNA, 19 nt, Homo sapiens
uguugcacuccagcuuggg

SEQ ID NO: 284784 - RNA, 22 nt, Homo sapiens
uguuugcuguguggaguagcag

SEQ ID NO: 284785 - RNA, 22 nt, Homo sapiens
uguuuuguuagcacucugggaa

SEQ ID NO: 284786 - RNA, 21 nt, Homo sapiens
uguuuuugcuguguaucucuc

SEQ ID NO: 284787 - RNA, 22 nt, Homo sapiens
uuaaaugcucacauaaagguag

SEQ ID NO: 284788 - RNA, 22 nt, Homo sapiens
uuaacacugccauugauacugu

SEQ ID NO: 284789 - RNA, 22 nt, Homo sapiens
uuaacagucacuuagcucauuu

SEQ ID NO: 284790 - RNA, 22 nt, Homo sapiens
uuaacagugaccccugguggcc

SEQ ID NO: 284791 - RNA, 22 nt, Homo sapiens
uuaagaugcauuuugaaguuaa

SEQ ID NO: 284792 - RNA, 22 nt, Homo sapiens
uuaagcaaagguaacaugagaa

SEQ ID NO: 284793 - RNA, 22 nt, Homo sapiens
uuaagccaggugugguggcaca

SEQ ID NO: 284794 - RNA, 18 nt, Homo sapiens
uuaaggcaggacuuuaag

SEQ ID NO: 284795 - RNA, 22 nt, Homo sapiens
uuaaggugaaguucucagaugc

SEQ ID NO: 284796 - RNA, 22 nt, Homo sapiens
uuaagugaauuaucuaacaugu

SEQ ID NO: 284797 - RNA, 21 nt, Homo sapiens
uuaaugcuaugcagaaaaucu

SEQ ID NO: 284798 - RNA, 22 nt, Homo sapiens
uuaauucugucugcccucaucc

SEQ ID NO: 284799 - RNA, 22 nt, Homo sapiens
uuacaaguggcaucucucugga

SEQ ID NO: 284800 - RNA, 22 nt, Homo sapiens
uuacaccuguaauccagcacuu

SEQ ID NO: 284801 - RNA, 22 nt, Homo sapiens
uuacagcugggugugucuggua

SEQ ID NO: 284802 - RNA, 20 nt, Homo sapiens
uuacagugggaccuuccuga

SEQ ID NO: 284803 - RNA, 22 nt, Homo sapiens
uuacaugucuugguaagguuag

SEQ ID NO: 284804 - RNA, 22 nt, Homo sapiens
uuacauguggugugaagaagag

SEQ ID NO: 284805 - RNA, 22 nt, Homo sapiens
uuaccagucuagggcucaguuu

SEQ ID NO: 284806 - RNA, 22 nt, Homo sapiens
uuacugcuagcugugugcucuu

SEQ ID NO: 284807 - RNA, 22 nt, Homo sapiens
uuacuugagaugaguuggacaa

SEQ ID NO: 284808 - RNA, 22 nt, Homo sapiens
uuagaauggaaaugcgagguua

SEQ ID NO: 284809 - RNA, 17 nt, Homo sapiens
uuagagguagacucauu

SEQ ID NO: 284810 - RNA, 22 nt, Homo sapiens
uuagaugaaugucucuuaaaca

SEQ ID NO: 284811 - RNA, 22 nt, Homo sapiens
uuagauguuuagaagugggcca

SEQ ID NO: 284812 - RNA, 22 nt, Homo sapiens
uuagccccuuugagccucaacu

SEQ ID NO: 284813 - RNA, 21 nt, Homo sapiens
uuaggcagugucagaggugag

SEQ ID NO: 284814 - RNA, 22 nt, Homo sapiens
uuaggcuaguugauauaguuug

SEQ ID NO: 284815 - RNA, 22 nt, Homo sapiens
uuauaacagagacuccugugcu

SEQ ID NO: 284816 - RNA, 20 nt, Homo sapiens
uuauaacuuuuguucugggg

SEQ ID NO: 284817 - RNA, 22 nt, Homo sapiens
uuauacacugugggaguguaaa

SEQ ID NO: 284818 - RNA, 22 nt, Homo sapiens
uuauagcagugcaggaacagac

SEQ ID NO: 284819 - RNA, 22 nt, Homo sapiens
uuauagcuaacaucugugaaaa

SEQ ID NO: 284820 - RNA, 22 nt, Homo sapiens
uuauauguuagacauggugggu

SEQ ID NO: 284821 - RNA, 22 nt, Homo sapiens
uuauauguuuguacuuaggccu

SEQ ID NO: 284822 - RNA, 22 nt, Homo sapiens
uuaucauagugcaguuuucuga

SEQ ID NO: 284823 - RNA, 22 nt, Homo sapiens
ggcaugcauuguacuaguaugc

SEQ ID NO: 284824 - RNA, 22 nt, Homo sapiens
ggcauguugauagguagaugua

SEQ ID NO: 284825 - RNA, 22 nt, Homo sapiens
ggcauguuuaguagaauguggu

SEQ ID NO: 284826 - RNA, 23 nt, Homo sapiens
ggcauuguggcucacaucuguaa

SEQ ID NO: 284827 - RNA, 22 nt, Homo sapiens
ggccagaugcaguggcucacac

SEQ ID NO: 284828 - RNA, 22 nt, Homo sapiens
ggccagaugcgguggcucacac

SEQ ID NO: 284829 - RNA, 22 nt, Homo sapiens
ggccggguggccauggcugccc

SEQ ID NO: 284830 - RNA, 18 nt, Homo sapiens
ggcggguguuuuauucac

SEQ ID NO: 284831 - RNA, 22 nt, Homo sapiens
ggcuagagacaaguugcugaga

SEQ ID NO: 284832 - RNA, 22 nt, Homo sapiens
ggcucagugggguccugguucu

SEQ ID NO: 284833 - RNA, 21 nt, Homo sapiens
ggcucuguggucucagguuuc

SEQ ID NO: 284834 - RNA, 22 nt, Homo sapiens
gggaaauguaaagucauaagau

SEQ ID NO: 284835 - RNA, 22 nt, Homo sapiens
gggaagaaggagugguuuacuc

SEQ ID NO: 284836 - RNA, 18 nt, Homo sapiens
gggaauauggggaguuga

SEQ ID NO: 284837 - RNA, 22 nt, Homo sapiens
gggaguagagaguuucucugac

SEQ ID NO: 284838 - RNA, 22 nt, Homo sapiens
gggagugugcacacaugguaua

SEQ ID NO: 284839 - RNA, 23 nt, Homo sapiens
gggcuagaugagagcuuccuggg

SEQ ID NO: 284840 - RNA, 22 nt, Homo sapiens
ggggaguguggacaucacccug

SEQ ID NO: 284841 - RNA, 17 nt, Homo sapiens
gggucaccuugcaggua

SEQ ID NO: 284842 - RNA, 15 nt, Homo sapiens
ggguccucucccaaa

SEQ ID NO: 284843 - RNA, 22 nt, Homo sapiens
gggugguuuuaucucuucccuu

SEQ ID NO: 284844 - RNA, 22 nt, Homo sapiens
gggugguuuuauuaucagugac

SEQ ID NO: 284845 - RNA, 22 nt, Homo sapiens
ggguucaaaucuuggcucuuac

SEQ ID NO: 284846 - RNA, 22 nt, Homo sapiens
gguaaacauacugcugucuucu

SEQ ID NO: 284847 - RNA, 22 nt, Homo sapiens
gguaggcacuggugggaagaga

SEQ ID NO: 284848 - RNA, 22 nt, Homo sapiens
ggucacauugcuagcauggguu

SEQ ID NO: 284849 - RNA, 22 nt, Homo sapiens
ggucagauggcagcugggccug

SEQ ID NO: 284850 - RNA, 22 nt, Homo sapiens
ggucaggagaaugguaacugag

SEQ ID NO: 284851 - RNA, 22 nt, Homo sapiens
ggucagugcauucuaaaggcaa

SEQ ID NO: 284852 - RNA, 22 nt, Homo sapiens
ggucaguuuucuccaggaucca

SEQ ID NO: 284853 - RNA, 22 nt, Homo sapiens
ggucauggagcuuuacuuuaug

SEQ ID NO: 284854 - RNA, 21 nt, Homo sapiens
ggugagaaaggagacauagac

SEQ ID NO: 284855 - RNA, 19 nt, Homo sapiens
ggugagaaauuaugggucu

SEQ ID NO: 284856 - RNA, 22 nt, Homo sapiens
ggugcagcacaccaacauggca

SEQ ID NO: 284857 - RNA, 22 nt, Homo sapiens
gguggcuuuuugugauggcuga

SEQ ID NO: 284858 - RNA, 22 nt, Homo sapiens
gguguuccccuuaccucuuggc

SEQ ID NO: 284859 - RNA, 22 nt, Homo sapiens
guaaacuuccccucaugaauga

SEQ ID NO: 284860 - RNA, 22 nt, Homo sapiens
guaaaucucuguuuucauggac

SEQ ID NO: 284861 - RNA, 22 nt, Homo sapiens
guaaauguccccugugauauug

SEQ ID NO: 284862 - RNA, 22 nt, Homo sapiens
guaagacuuauuuucuuuauca

SEQ ID NO: 284863 - RNA, 22 nt, Homo sapiens
guaagagcauguaguggcucua

SEQ ID NO: 284864 - RNA, 22 nt, Homo sapiens
guaagauaguauguuuaaccca

SEQ ID NO: 284865 - RNA, 22 nt, Homo sapiens
gaugugaaaucauaguuucuag

SEQ ID NO: 284866 - RNA, 22 nt, Homo sapiens
gauguguugggaagauuucaag

SEQ ID NO: 284867 - RNA, 22 nt, Homo sapiens
gauguguuuccaggauuuguuu

SEQ ID NO: 284868 - RNA, 22 nt, Homo sapiens
gauguuguuuagccuuugaugu

SEQ ID NO: 284869 - RNA, 22 nt, Homo sapiens
gauuccauuuguggcuauuuac

SEQ ID NO: 284870 - RNA, 22 nt, Homo sapiens
gauugguugaaaguagaauacu

SEQ ID NO: 284871 - RNA, 22 nt, Homo sapiens
gauuuguauuaaaagugugacg

SEQ ID NO: 284872 - RNA, 22 nt, Homo sapiens
gcaaagaaugcagauuugccuc

SEQ ID NO: 284873 - RNA, 21 nt, Homo sapiens
gcaaaguggcuaccuugcucc

SEQ ID NO: 284874 - RNA, 22 nt, Homo sapiens
gcaaaguguuuuuaggaagucu

SEQ ID NO: 284875 - RNA, 23 nt, Homo sapiens
gcaaauaucguagagugucccug

SEQ ID NO: 284876 - RNA, 22 nt, Homo sapiens
gcaagagguaucuuauuuuccc

SEQ ID NO: 284877 - RNA, 22 nt, Homo sapiens
gcaagaguauuucaaggaagau

SEQ ID NO: 284878 - RNA, 22 nt, Homo sapiens
gcaagauguuaccauuagggaa

SEQ ID NO: 284879 - RNA, 22 nt, Homo sapiens
gcaagauuguguggcugaagua

SEQ ID NO: 284880 - RNA, 22 nt, Homo sapiens
gcacagaugaggagaggucuca

SEQ ID NO: 284881 - RNA, 22 nt, Homo sapiens
gcacgcauuguccuucuaguca

SEQ ID NO: 284882 - RNA, 22 nt, Homo sapiens
gcacgugcacccacaugcacgu

SEQ ID NO: 284883 - RNA, 22 nt, Homo sapiens
gcacgugcucauuugaggucuu

SEQ ID NO: 284884 - RNA, 22 nt, Homo sapiens
gcacugggccacauuuauuuuc

SEQ ID NO: 284885 - RNA, 22 nt, Homo sapiens
gcagagaaacaggucuaaggag

SEQ ID NO: 284886 - RNA, 22 nt, Homo sapiens
gcagguaguuucugacuuuuac

SEQ ID NO: 284887 - RNA, 22 nt, Homo sapiens
gcagguguuaugcaaacaacug

SEQ ID NO: 284888 - RNA, 22 nt, Homo sapiens
gcagugcaguggcgcgaucucg

SEQ ID NO: 284889 - RNA, 22 nt, Homo sapiens
gcagugugauguuuuaaucuau

SEQ ID NO: 284890 - RNA, 22 nt, Homo sapiens
gcaguguucaaaucaugcccau

SEQ ID NO: 284891 - RNA, 22 nt, Homo sapiens
gcaguguucugggcaggaagaa

SEQ ID NO: 284892 - RNA, 22 nt, Homo sapiens
gcauaaagcuaauaagacgaag

SEQ ID NO: 284893 - RNA, 20 nt, Homo sapiens
gcauaugucuuuauagcaga

SEQ ID NO: 284894 - RNA, 19 nt, Homo sapiens
gcaucauuaguugcuuuuc

SEQ ID NO: 284895 - RNA, 22 nt, Homo sapiens
gcaugcacaugugaaaaaauga

SEQ ID NO: 284896 - RNA, 22 nt, Homo sapiens
gcaugcauuuuccuaacuagaa

SEQ ID NO: 284897 - RNA, 22 nt, Homo sapiens
gcauggaguggaaauucuuggg

SEQ ID NO: 284898 - RNA, 22 nt, Homo sapiens
gcauugcacuuggcauagacug

SEQ ID NO: 284899 - RNA, 22 nt, Homo sapiens
gccaagaugcugcccacagaca

SEQ ID NO: 284900 - RNA, 22 nt, Homo sapiens
gccaagauugguuuaauauucc

SEQ ID NO: 284901 - RNA, 22 nt, Homo sapiens
gccaagauuuaauucaucaguu

SEQ ID NO: 284902 - RNA, 22 nt, Homo sapiens
auaaaguucugcuggcauauau

SEQ ID NO: 284903 - RNA, 20 nt, Homo sapiens
auaaauguauagguguacau

SEQ ID NO: 284904 - RNA, 22 nt, Homo sapiens
auaacaggaaauacagggcuuu

SEQ ID NO: 284905 - RNA, 22 nt, Homo sapiens
auaaggcugguauagacauuca

SEQ ID NO: 284906 - RNA, 22 nt, Homo sapiens
auaagguuagcucugagaaagu

SEQ ID NO: 284907 - RNA, 22 nt, Homo sapiens
auaauagcugaucauuuagaag

SEQ ID NO: 284908 - RNA, 22 nt, Homo sapiens
auaauagguugauugacauugc

SEQ ID NO: 284909 - RNA, 22 nt, Homo sapiens
auaauaucagguugugaugaug

SEQ ID NO: 284910 - RNA, 22 nt, Homo sapiens
auaauguuugauugagcagaua

SEQ ID NO: 284911 - RNA, 22 nt, Homo sapiens
auacaaggaaugaagagauuug

SEQ ID NO: 284912 - RNA, 22 nt, Homo sapiens
auacaaguuauuugaacugcgg

SEQ ID NO: 284913 - RNA, 22 nt, Homo sapiens
auacacauuccugggccucacc

SEQ ID NO: 284914 - RNA, 22 nt, Homo sapiens
auacagacacagucagaggggu

SEQ ID NO: 284915 - RNA, 22 nt, Homo sapiens
auacagguauacaaugcauaau

SEQ ID NO: 284916 - RNA, 22 nt, Homo sapiens
auacaugugcaggucagguuac

SEQ ID NO: 284917 - RNA, 22 nt, Homo sapiens
auacaugugccauggugguuug

SEQ ID NO: 284918 - RNA, 22 nt, Homo sapiens
auacaugugccauguugguaug

SEQ ID NO: 284919 - RNA, 22 nt, Homo sapiens
auacaugugccauguugguuug

SEQ ID NO: 284920 - RNA, 22 nt, Homo sapiens
auacaugugucauguugguuug

SEQ ID NO: 284921 - RNA, 22 nt, Homo sapiens
auacccaguaguggaauugcua

SEQ ID NO: 284922 - RNA, 22 nt, Homo sapiens
auacccucugggugguuaguug

SEQ ID NO: 284923 - RNA, 22 nt, Homo sapiens
auaccugguagucuugcuacac

SEQ ID NO: 284924 - RNA, 22 nt, Homo sapiens
auacuaugagauaauaaagacu

SEQ ID NO: 284925 - RNA, 22 nt, Homo sapiens
auacugccuuuagcaaaacagu

SEQ ID NO: 284926 - RNA, 22 nt, Homo sapiens
auacuguuuuacaucauugccu

SEQ ID NO: 284927 - RNA, 20 nt, Homo sapiens
auagaagacuagugcagcag

SEQ ID NO: 284928 - RNA, 22 nt, Homo sapiens
auagcaaugccccaauccuugg

SEQ ID NO: 284929 - RNA, 22 nt, Homo sapiens
auagcaauuugggaaucagacu

SEQ ID NO: 284930 - RNA, 22 nt, Homo sapiens
auagcacaguguguguacacca

SEQ ID NO: 284931 - RNA, 22 nt, Homo sapiens
auagcacaugugcaaauggcug

SEQ ID NO: 284932 - RNA, 22 nt, Homo sapiens
auagcagaagaagggacaauuc

SEQ ID NO: 284933 - RNA, 22 nt, Homo sapiens
auagcaggagaauggucauggg

SEQ ID NO: 284934 - RNA, 22 nt, Homo sapiens
auagcagugucccacuccuugg

SEQ ID NO: 284935 - RNA, 22 nt, Homo sapiens
auagcucuugcuuacccacugu

SEQ ID NO: 284936 - RNA, 22 nt, Homo sapiens
auagguuauuagagcaaagcuu

SEQ ID NO: 284937 - RNA, 22 nt, Homo sapiens
ggaauguuaaggcgcuguuggu

SEQ ID NO: 284938 - RNA, 22 nt, Homo sapiens
ggacagaaaggguucaccaaac

SEQ ID NO: 284939 - RNA, 22 nt, Homo sapiens
ggacauuaacugcaagauagau

SEQ ID NO: 284940 - RNA, 22 nt, Homo sapiens
ggacuagagaugagauuuuuca

SEQ ID NO: 284941 - RNA, 19 nt, Homo sapiens
ggacugucauggaguaguu

SEQ ID NO: 284942 - RNA, 22 nt, Homo sapiens
ggagaauguaauugguauuuug

SEQ ID NO: 284943 - RNA, 20 nt, Homo sapiens
ggagagugacauaauucugg

SEQ ID NO: 284944 - RNA, 22 nt, Homo sapiens
ggagguaauaaguuccagugua

SEQ ID NO: 284945 - RNA, 22 nt, Homo sapiens
ggaguaggcuguccggcaccca

SEQ ID NO: 284946 - RNA, 22 nt, Homo sapiens
ggagucugaacuggacaaugac

SEQ ID NO: 284947 - RNA, 22 nt, Homo sapiens
ggagucugauguucuaaggcag

SEQ ID NO: 284948 - RNA, 22 nt, Homo sapiens
ggagugugauuguucucuguua

SEQ ID NO: 284949 - RNA, 22 nt, Homo sapiens
ggaguguguuuuccaacuuggu

SEQ ID NO: 284950 - RNA, 22 nt, Homo sapiens
ggauaucauuauuucuagggcu

SEQ ID NO: 284951 - RNA, 22 nt, Homo sapiens
ggauauguagggcauaucuaca

SEQ ID NO: 284952 - RNA, 22 nt, Homo sapiens
ggcaaaauauugucugguauag

SEQ ID NO: 284953 - RNA, 22 nt, Homo sapiens
ggcaaagagacaugcaucgggg

SEQ ID NO: 284954 - RNA, 17 nt, Homo sapiens
ggcaagaaguggaacuc

SEQ ID NO: 284955 - RNA, 20 nt, Homo sapiens
ggcaagacccaaagugugug

SEQ ID NO: 284956 - RNA, 19 nt, Homo sapiens
ggcaagaguuguucugugu

SEQ ID NO: 284957 - RNA, 22 nt, Homo sapiens
ggcaaggauuagauucuccccu

SEQ ID NO: 284958 - RNA, 22 nt, Homo sapiens
ggcaaggugaugaaugucuaca

SEQ ID NO: 284959 - RNA, 22 nt, Homo sapiens
ggcaagugggagggaguguuuc

SEQ ID NO: 284960 - RNA, 22 nt, Homo sapiens
ggcaaguugcuauucuuuaaug

SEQ ID NO: 284961 - RNA, 19 nt, Homo sapiens
ggcaccuuuuccaaaaaug

SEQ ID NO: 284962 - RNA, 23 nt, Homo sapiens
ggcacggaauucaaagaggcauu

SEQ ID NO: 284963 - RNA, 22 nt, Homo sapiens
ggcagaguggacauuuaaaugu

SEQ ID NO: 284964 - RNA, 22 nt, Homo sapiens
ggcagcucaggccccgcgcuga

SEQ ID NO: 284965 - RNA, 22 nt, Homo sapiens
ggcagcuguguccuucguaagg

SEQ ID NO: 284966 - RNA, 22 nt, Homo sapiens
ggcaguggaagugccaguuucu

SEQ ID NO: 284967 - RNA, 22 nt, Homo sapiens
ggcaguuucucaggcaggggua

SEQ ID NO: 284968 - RNA, 22 nt, Homo sapiens
ggcaguuuguuugugaggucca

SEQ ID NO: 284969 - RNA, 21 nt, Homo sapiens
ggcaugaauggaaaagugaga

SEQ ID NO: 284970 - RNA, 22 nt, Homo sapiens
aucaugucuucccagugauucu

SEQ ID NO: 284971 - RNA, 22 nt, Homo sapiens
aucauugcacaucacagccuca

SEQ ID NO: 284972 - RNA, 22 nt, Homo sapiens
auccacaugcaguuggaaacag

SEQ ID NO: 284973 - RNA, 22 nt, Homo sapiens
auccagaugggcuuaauguaau

SEQ ID NO: 284974 - RNA, 22 nt, Homo sapiens
aucccaguaaaaauggcuucua

SEQ ID NO: 284975 - RNA, 20 nt, Homo sapiens
aucccauuccugaagauacu

SEQ ID NO: 284976 - RNA, 22 nt, Homo sapiens
auccccugcacggggugucauu

SEQ ID NO: 284977 - RNA, 22 nt, Homo sapiens
aucccugugacgagcaucccua

SEQ ID NO: 284978 - RNA, 22 nt, Homo sapiens
aucccuuucugauacuuucccu

SEQ ID NO: 284979 - RNA, 22 nt, Homo sapiens
auccucaguggcuuaaguauag

SEQ ID NO: 284980 - RNA, 22 nt, Homo sapiens
auccuguacuaagguuuuccca

SEQ ID NO: 284981 - RNA, 22 nt, Homo sapiens
aucucaguucaggcuggccaca

SEQ ID NO: 284982 - RNA, 22 nt, Homo sapiens
aucuuggauuaccugggugggu

SEQ ID NO: 284983 - RNA, 22 nt, Homo sapiens
aucuuuggugaguucuuugguc

SEQ ID NO: 284984 - RNA, 22 nt, Homo sapiens
aucuuuggugcaugauacuuug

SEQ ID NO: 284985 - RNA, 22 nt, Homo sapiens
augaaaucacugugaugcccua

SEQ ID NO: 284986 - RNA, 22 nt, Homo sapiens
augaacagagccuugagaaccu

SEQ ID NO: 284987 - RNA, 22 nt, Homo sapiens
augaacucaucauuuuuuaugg

SEQ ID NO: 284988 - RNA, 22 nt, Homo sapiens
augaaguauuaggacacauuua

SEQ ID NO: 284989 - RNA, 18 nt, Homo sapiens
augaagucaucacuuuua

SEQ ID NO: 284990 - RNA, 22 nt, Homo sapiens
augaagucguuacuaccaauug

SEQ ID NO: 284991 - RNA, 22 nt, Homo sapiens
augaaguuagcucauuucuuuu

SEQ ID NO: 284992 - RNA, 22 nt, Homo sapiens
augaauacagcuaugcgugcau

SEQ ID NO: 284993 - RNA, 19 nt, Homo sapiens
augacauuuggggguggac

SEQ ID NO: 284994 - RNA, 18 nt, Homo sapiens
augacucuggguguuccu

SEQ ID NO: 284995 - RNA, 22 nt, Homo sapiens
augacugaguagcauuccauua

SEQ ID NO: 284996 - RNA, 17 nt, Homo sapiens
augacuucuucagugug

SEQ ID NO: 284997 - RNA, 22 nt, Homo sapiens
augagaaucauuucagcuugua

SEQ ID NO: 284998 - RNA, 22 nt, Homo sapiens
augagaugaauaccgacgaugu

SEQ ID NO: 284999 - RNA, 22 nt, Homo sapiens
augagaugcaagauuagauggg

SEQ ID NO: 285000 - RNA, 22 nt, Homo sapiens
augagauuguuuguacuccaca

SEQ ID NO: 285001 - RNA, 22 nt, Homo sapiens
augaggaagucaggcccagggg

SEQ ID NO: 285002 - RNA, 22 nt, Homo sapiens
augaggugaggucaguaaggua

SEQ ID NO: 285003 - RNA, 20 nt, Homo sapiens
augagguguaugacacugaa

SEQ ID NO: 285004 - RNA, 22 nt, Homo sapiens
augauaugagaaaggaucaaca

SEQ ID NO: 285005 - RNA, 22 nt, Homo sapiens
augauauuauucuagcccagag

SEQ ID NO: 285006 - RNA, 22 nt, Homo sapiens
augaucacaccacugcacucca

SEQ ID NO: 285007 - RNA, 22 nt, Homo sapiens
augaucuguagaacuaguccuu

SEQ ID NO: 285008 - RNA, 22 nt, Homo sapiens
augaucuguuuggugaucuugu

SEQ ID NO: 285009 - RNA, 22 nt, Homo sapiens
augcaaaucuuaaguaugugug

SEQ ID NO: 285010 - RNA, 22 nt, Homo sapiens
ugugcuugaauuuaguagcuua

SEQ ID NO: 285011 - RNA, 22 nt, Homo sapiens
uguggaguguaugugacagaga

SEQ ID NO: 285012 - RNA, 22 nt, Homo sapiens
uguggcacuguguccagagaaa

SEQ ID NO: 285013 - RNA, 22 nt, Homo sapiens
uggaagugaacaaccaaggcag

SEQ ID NO: 285014 - RNA, 22 nt, Homo sapiens
uggaauacaugucgcugagcug

SEQ ID NO: 285015 - RNA, 20 nt, Homo sapiens
uggaaucuaggcggagguuu

SEQ ID NO: 285016 - RNA, 22 nt, Homo sapiens
uggaaugcucuccccacggacu

SEQ ID NO: 285017 - RNA, 22 nt, Homo sapiens
uggaauggagagagggugcacg

SEQ ID NO: 285018 - RNA, 17 nt, Homo sapiens
uggaaugucuaagccug

SEQ ID NO: 285019 - RNA, 22 nt, Homo sapiens
uggaaugucuauguuuuugauu

SEQ ID NO: 285020 - RNA, 22 nt, Homo sapiens
uggaaugucuuuuccccaaagc

SEQ ID NO: 285021 - RNA, 22 nt, Homo sapiens
uggacaugaagggcacaggagg

SEQ ID NO: 285022 - RNA, 22 nt, Homo sapiens
uggacuguaauagagaacagaa

SEQ ID NO: 285023 - RNA, 22 nt, Homo sapiens
uggagagucauuuauaguauuu

SEQ ID NO: 285024 - RNA, 22 nt, Homo sapiens
uggagagugagggccuccuuaa

SEQ ID NO: 285025 - RNA, 22 nt, Homo sapiens
uggagagugauaaguaaaugga

SEQ ID NO: 285026 - RNA, 22 nt, Homo sapiens
uggagguaggacgaagaacucu

SEQ ID NO: 285027 - RNA, 22 nt, Homo sapiens
uggagguagggccuaggaaucu

SEQ ID NO: 285028 - RNA, 22 nt, Homo sapiens
uggagugaaaacacacuaaucu

SEQ ID NO: 285029 - RNA, 20 nt, Homo sapiens
uggagugaagguucuggacc

SEQ ID NO: 285030 - RNA, 22 nt, Homo sapiens
uggagugagaacuucaaugaug

SEQ ID NO: 285031 - RNA, 22 nt, Homo sapiens
uggagugcaauggcaccaucuu

SEQ ID NO: 285032 - RNA, 22 nt, Homo sapiens
uggagugcaauggugagaucuu

SEQ ID NO: 285033 - RNA, 22 nt, Homo sapiens
uggagugcgagggugaaacuuu

SEQ ID NO: 285034 - RNA, 22 nt, Homo sapiens
uggaguguaaauuaguucagcc

SEQ ID NO: 285035 - RNA, 20 nt, Homo sapiens
uggaguuguggcaguuugga

SEQ ID NO: 285036 - RNA, 20 nt, Homo sapiens
uggaguuugaguucuuggag

SEQ ID NO: 285037 - RNA, 22 nt, Homo sapiens
uggauauguucuuuguguaagg

SEQ ID NO: 285038 - RNA, 19 nt, Homo sapiens
uggaugacugucugggucu

SEQ ID NO: 285039 - RNA, 21 nt, Homo sapiens
uggaugccuaggcagaaguuu

SEQ ID NO: 285040 - RNA, 22 nt, Homo sapiens
uggcaaaaaaccgcaguugccu

SEQ ID NO: 285041 - RNA, 22 nt, Homo sapiens
uggcaaaauauuuugguuucug

SEQ ID NO: 285042 - RNA, 21 nt, Homo sapiens
uggcaaaaugggcaguggguu

SEQ ID NO: 285043 - RNA, 22 nt, Homo sapiens
uggcaaagugugacgugggggu

SEQ ID NO: 285044 - RNA, 22 nt, Homo sapiens
uggcaaauagcaauaggagggu

SEQ ID NO: 285045 - RNA, 22 nt, Homo sapiens
uggcaaauauuuuguuuuguaa

SEQ ID NO: 285046 - RNA, 22 nt, Homo sapiens
uggcaaaugaagucagcuguac

SEQ ID NO: 285047 - RNA, 22 nt, Homo sapiens
uggcaaauuccaaaguuaauuc

SEQ ID NO: 285048 - RNA, 22 nt, Homo sapiens
uggcaacaucuggggacauguu

SEQ ID NO: 285049 - RNA, 22 nt, Homo sapiens
uggcaagaacgaaauguagggu

SEQ ID NO: 285050 - RNA, 22 nt, Homo sapiens
uggcaagaaggauuuauuccuu

SEQ ID NO: 285051 - RNA, 22 nt, Homo sapiens
uggcaagaucacaauuacuuuu

SEQ ID NO: 285052 - RNA, 23 nt, Homo sapiens
uggcaagauuuguauugccugga

SEQ ID NO: 285053 - RNA, 19 nt, Homo sapiens
uggcaaugucagcagagau

SEQ ID NO: 285054 - RNA, 19 nt, Homo sapiens
uggcacauguauacauaug

SEQ ID NO: 285055 - RNA, 22 nt, Homo sapiens
uggcagauaggauacaggacua

SEQ ID NO: 285056 - RNA, 22 nt, Homo sapiens
uggcagaugggugagcuggaga

SEQ ID NO: 285057 - RNA, 22 nt, Homo sapiens
uggcagcgugaaagacuuuuuc

SEQ ID NO: 285058 - RNA, 22 nt, Homo sapiens
uggcagcgugaauguggcugaa

SEQ ID NO: 285059 - RNA, 22 nt, Homo sapiens
uggcagcugcuucaugggaugc

SEQ ID NO: 285060 - RNA, 22 nt, Homo sapiens
uggcaugauccuagauucaaca

SEQ ID NO: 285061 - RNA, 22 nt, Homo sapiens
uggcauggaacuacuuugaaac

SEQ ID NO: 285062 - RNA, 22 nt, Homo sapiens
uggcaugggguaguagcgcugg

SEQ ID NO: 285063 - RNA, 22 nt, Homo sapiens
uggcauguguuugaaugaguau

SEQ ID NO: 285064 - RNA, 20 nt, Homo sapiens
uggcauguugguaugcaccc

SEQ ID NO: 285065 - RNA, 22 nt, Homo sapiens
uggcauuuucucuguucuuaga

SEQ ID NO: 285066 - RNA, 23 nt, Homo sapiens
uggccaagauaaucucaguuuuc

SEQ ID NO: 285067 - RNA, 22 nt, Homo sapiens
uggccagagggcaauuagcugu

SEQ ID NO: 285068 - RNA, 22 nt, Homo sapiens
uggccaguugaagacaaugcuc

SEQ ID NO: 285069 - RNA, 22 nt, Homo sapiens
uggcgggaaaguugggagaaga

SEQ ID NO: 285070 - RNA, 22 nt, Homo sapiens
uggcuacagaaaguacuaguga

SEQ ID NO: 285071 - RNA, 22 nt, Homo sapiens
uggcuguuuauuucacaugggu

SEQ ID NO: 285072 - RNA, 22 nt, Homo sapiens
uggcuuucuggggcuucuguuc

SEQ ID NO: 285073 - RNA, 18 nt, Homo sapiens
ugggaagaaauucuucuc

SEQ ID NO: 285074 - RNA, 22 nt, Homo sapiens
ugggaaugaaauuacauagcuu

SEQ ID NO: 285075 - RNA, 22 nt, Homo sapiens
ugggagugugcacaauuucagc

SEQ ID NO: 285076 - RNA, 22 nt, Homo sapiens
ugggaucauucaaugacgaaau

SEQ ID NO: 285077 - RNA, 22 nt, Homo sapiens
ugggaucgucaagugaggcucg

SEQ ID NO: 285078 - RNA, 22 nt, Homo sapiens
ugggcaaaacuaagagcugugg

SEQ ID NO: 285079 - RNA, 22 nt, Homo sapiens
ugggcggagacgugcagccgcc

SEQ ID NO: 285080 - RNA, 22 nt, Homo sapiens
ugggguagaauagaauugauau

SEQ ID NO: 285081 - RNA, 22 nt, Homo sapiens
ugguauuuaauauaugagaguu

SEQ ID NO: 285082 - RNA, 21 nt, Homo sapiens
uggucaguuuucucacuagga

SEQ ID NO: 285083 - RNA, 19 nt, Homo sapiens
uggucccccgcaaucucau

SEQ ID NO: 285084 - RNA, 22 nt, Homo sapiens
uggugcccuguccuucuguggc

SEQ ID NO: 285085 - RNA, 22 nt, Homo sapiens
ugguguccugucucugcgcuug

SEQ ID NO: 285086 - RNA, 23 nt, Homo sapiens
uguaaaagcauuugucagccugg

SEQ ID NO: 285087 - RNA, 22 nt, Homo sapiens
uguaaacucaguauguuuuacu

SEQ ID NO: 285088 - RNA, 22 nt, Homo sapiens
uguaaagaaagcuguuguugua

SEQ ID NO: 285089 - RNA, 22 nt, Homo sapiens
uguaaaucuauuuuuaguguuu

SEQ ID NO: 285090 - RNA, 22 nt, Homo sapiens
uguaacaggaggaaaaugugaa

SEQ ID NO: 285091 - RNA, 22 nt, Homo sapiens
uguaauaguaggcucacauuug

SEQ ID NO: 285092 - RNA, 22 nt, Homo sapiens
uguaaugaucaaaucagaguaa

SEQ ID NO: 285093 - RNA, 20 nt, Homo sapiens
uguacacaguguacccacau

SEQ ID NO: 285094 - RNA, 22 nt, Homo sapiens
uguacacauaugugggguacau

SEQ ID NO: 285095 - RNA, 22 nt, Homo sapiens
uguagacaccaaagacagcaua

SEQ ID NO: 285096 - RNA, 22 nt, Homo sapiens
uguagcaaaucgauacuauugg

SEQ ID NO: 285097 - RNA, 20 nt, Homo sapiens
uguagguguacaguaaggag

SEQ ID NO: 285098 - RNA, 22 nt, Homo sapiens
uguagucauuccuuuuugcuuu

SEQ ID NO: 285099 - RNA, 22 nt, Homo sapiens
uguauaggcaaauuuccucaug

SEQ ID NO: 285100 - RNA, 22 nt, Homo sapiens
uguaugagagacauggcugcuu

SEQ ID NO: 285101 - RNA, 22 nt, Homo sapiens
uguauguugggucaaaguacau

SEQ ID NO: 285102 - RNA, 22 nt, Homo sapiens
uguauuuguuguuaaauggaga

SEQ ID NO: 285103 - RNA, 22 nt, Homo sapiens
ugucaaacauuaugaugcucua

SEQ ID NO: 285104 - RNA, 22 nt, Homo sapiens
ugucacauccaagaaggugcag

SEQ ID NO: 285105 - RNA, 22 nt, Homo sapiens
ugucagaaucuagaggcugcua

SEQ ID NO: 285106 - RNA, 22 nt, Homo sapiens
ugucaguguaugagccccggau

SEQ ID NO: 285107 - RNA, 22 nt, Homo sapiens
ugucauacaguaacaugguugg

SEQ ID NO: 285108 - RNA, 22 nt, Homo sapiens
ugucauggauucugagucuggg

SEQ ID NO: 285109 - RNA, 22 nt, Homo sapiens
ugucaugucaacuauggaauuu

SEQ ID NO: 285110 - RNA, 22 nt, Homo sapiens
ugucauguggcuaacgauucau

SEQ ID NO: 285111 - RNA, 21 nt, Homo sapiens
uguccagcuuuuggaauauaa

SEQ ID NO: 285112 - RNA, 22 nt, Homo sapiens
uguccugaagcuuuguuaugua

SEQ ID NO: 285113 - RNA, 21 nt, Homo sapiens
ugucgugcaggaucuguggga

SEQ ID NO: 285114 - RNA, 22 nt, Homo sapiens
ugucuaguuuugaaguauagca

SEQ ID NO: 285115 - RNA, 22 nt, Homo sapiens
ugucucaguucccuucucugga

SEQ ID NO: 285116 - RNA, 22 nt, Homo sapiens
ugucucaguuucuguggguuag

SEQ ID NO: 285117 - RNA, 22 nt, Homo sapiens
ugucuugagagaggacaugacu

SEQ ID NO: 285118 - RNA, 22 nt, Homo sapiens
ugucuuguagacaauguauagu

SEQ ID NO: 285119 - RNA, 22 nt, Homo sapiens
ugucuuuguuaguuguccuagu

SEQ ID NO: 285120 - RNA, 22 nt, Homo sapiens
ugugaaacauggauagaacugg

SEQ ID NO: 285121 - RNA, 21 nt, Homo sapiens
ugugaaaucuaggcagagguu

SEQ ID NO: 285122 - RNA, 22 nt, Homo sapiens
ugugaacagaauuagucaccua

SEQ ID NO: 285123 - RNA, 22 nt, Homo sapiens
ugugaacagcuccaaaugugga

SEQ ID NO: 285124 - RNA, 22 nt, Homo sapiens
ugugaagauggacuaauauagu

SEQ ID NO: 285125 - RNA, 22 nt, Homo sapiens
ugugaaugauggagugucgaau

SEQ ID NO: 285126 - RNA, 22 nt, Homo sapiens
ugugaauggugcugcaaugaac

SEQ ID NO: 285127 - RNA, 23 nt, Homo sapiens
ugugacacuuccgucaguucauu

SEQ ID NO: 285128 - RNA, 22 nt, Homo sapiens
ugugacagcacgguucaacugc

SEQ ID NO: 285129 - RNA, 22 nt, Homo sapiens
ugugacaguguuacauuucaug

SEQ ID NO: 285130 - RNA, 22 nt, Homo sapiens
ugugacaguuaguuugguguua

SEQ ID NO: 285131 - RNA, 19 nt, Homo sapiens
ugugagcauuagcauuuag

SEQ ID NO: 285132 - RNA, 22 nt, Homo sapiens
ugugauagagaaugguggagaa

SEQ ID NO: 285133 - RNA, 22 nt, Homo sapiens
ugugaucaaccugcagggcugg

SEQ ID NO: 285134 - RNA, 22 nt, Homo sapiens
ugugaucaugugugccuuaguc

SEQ ID NO: 285135 - RNA, 22 nt, Homo sapiens
ugugaucauugcuguuaaagug

SEQ ID NO: 285136 - RNA, 22 nt, Homo sapiens
ugugaucauuucaggaauuuug

SEQ ID NO: 285137 - RNA, 22 nt, Homo sapiens
ugugauggaguuucauggacug

SEQ ID NO: 285138 - RNA, 17 nt, Homo sapiens
ugugauugaagucaucc

SEQ ID NO: 285139 - RNA, 22 nt, Homo sapiens
ugugcaaaaacaauugcgguuu

SEQ ID NO: 285140 - RNA, 22 nt, Homo sapiens
ugugcacaugauauaucacaua

SEQ ID NO: 285141 - RNA, 22 nt, Homo sapiens
ugugcaccucuucacacaggga

SEQ ID NO: 285142 - RNA, 22 nt, Homo sapiens
ugugcauauaaguguguauaua

SEQ ID NO: 285143 - RNA, 22 nt, Homo sapiens
ugugccaaucauagggcuuggu

SEQ ID NO: 285144 - RNA, 22 nt, Homo sapiens
ugugccacuccagcucuagcuu

SEQ ID NO: 285145 - RNA, 22 nt, Homo sapiens
ugugccacuccaggaggcuguu

SEQ ID NO: 285146 - RNA, 22 nt, Homo sapiens
ugugccacugcacuucagccug

SEQ ID NO: 285147 - RNA, 22 nt, Homo sapiens
ugugcuaaaaugggacuucuaa

SEQ ID NO: 285148 - RNA, 22 nt, Homo sapiens
ugugcuaauacauacagugcua

SEQ ID NO: 285149 - RNA, 22 nt, Homo sapiens
ugugcuauguuauucacauggg

SEQ ID NO: 285150 - RNA, 22 nt, Homo sapiens
ugugcuugaaauucaguuuuga

SEQ ID NO: 285151 - RNA, 22 nt, Homo sapiens
uggaacaccaggcuggcguggc

SEQ ID NO: 285152 - RNA, 22 nt, Homo sapiens
uggaagacaaguguuagcaugg

SEQ ID NO: 285153 - RNA, 22 nt, Homo sapiens
uggaagacaggcuguauuuuaa

SEQ ID NO: 285154 - RNA, 22 nt, Homo sapiens
uggaagacucaagguggugaau

SEQ ID NO: 285155 - RNA, 22 nt, Homo sapiens
uggaagauuacuuuuuguugaa

SEQ ID NO: 285156 - RNA, 22 nt, Homo sapiens
uggaagcauagcagcgugugug

SEQ ID NO: 285157 - RNA, 22 nt, Homo sapiens
uggaagucaugcugcaagaaca

SEQ ID NO: 285158 - RNA, 22 nt, Homo sapiens
uuucccagugguacaguuuaua

SEQ ID NO: 285159 - RNA, 16 nt, Homo sapiens
uuucccuuugguguuu

SEQ ID NO: 285160 - RNA, 21 nt, Homo sapiens
uuuccuggagcguauggcuuc

SEQ ID NO: 285161 - RNA, 22 nt, Homo sapiens
uuucgugucuggucugugaugg

SEQ ID NO: 285162 - RNA, 17 nt, Homo sapiens
uuucucagcccucuucu

SEQ ID NO: 285163 - RNA, 22 nt, Homo sapiens
uuucugagaccaaaacuuguaa

SEQ ID NO: 285164 - RNA, 22 nt, Homo sapiens
uuucugcuugagagaauugcug

SEQ ID NO: 285165 - RNA, 22 nt, Homo sapiens
uuucugggggugcugauggaaa

SEQ ID NO: 285166 - RNA, 22 nt, Homo sapiens
uuucugguuaauuucuaagagc

SEQ ID NO: 285167 - RNA, 22 nt, Homo sapiens
uuucugugguccucuugaaggu

SEQ ID NO: 285168 - RNA, 23 nt, Homo sapiens
uuucuugggcaugcuaugucagu

SEQ ID NO: 285169 - RNA, 22 nt, Homo sapiens
uuucuugguuguauuuagacuu

SEQ ID NO: 285170 - RNA, 22 nt, Homo sapiens
uuugaagacuacugggagugaa

SEQ ID NO: 285171 - RNA, 22 nt, Homo sapiens
uuugacacugggagugugggug

SEQ ID NO: 285172 - RNA, 22 nt, Homo sapiens
uuugagcaggcuaaucaauaua

SEQ ID NO: 285173 - RNA, 22 nt, Homo sapiens
uuugagcaugcagauugccagg

SEQ ID NO: 285174 - RNA, 22 nt, Homo sapiens
uuugagcauggaaauggcauga

SEQ ID NO: 285175 - RNA, 22 nt, Homo sapiens
uuugagcuagagucucacucug

SEQ ID NO: 285176 - RNA, 22 nt, Homo sapiens
uuugaggaaaggcauaaguagg

SEQ ID NO: 285177 - RNA, 23 nt, Homo sapiens
uuugagugugauaaacacuguca

SEQ ID NO: 285178 - RNA, 22 nt, Homo sapiens
uuugagugugauaucgauugga

SEQ ID NO: 285179 - RNA, 21 nt, Homo sapiens
uuugaucauuaaaagugaauc

SEQ ID NO: 285180 - RNA, 22 nt, Homo sapiens
uuugauguugauacuaccuuca

SEQ ID NO: 285181 - RNA, 22 nt, Homo sapiens
uuugcaagaugaaaaaguucua

SEQ ID NO: 285182 - RNA, 22 nt, Homo sapiens
uuugcaauguugugauggugaa

SEQ ID NO: 285183 - RNA, 22 nt, Homo sapiens
uuugcacauauuugggcaaaag

SEQ ID NO: 285184 - RNA, 22 nt, Homo sapiens
uuugcuuaaaucuuaaucagau

SEQ ID NO: 285185 - RNA, 22 nt, Homo sapiens
uuugcuucacuguuuggcaaaa

SEQ ID NO: 285186 - RNA, 22 nt, Homo sapiens
uuuggcaauuugacuguauagg

SEQ ID NO: 285187 - RNA, 22 nt, Homo sapiens
uuuggcauuaagaugcuguauc

SEQ ID NO: 285188 - RNA, 22 nt, Homo sapiens
uuugggacuguauuaaaugccu

SEQ ID NO: 285189 - RNA, 22 nt, Homo sapiens
uuugguccaguguucagguccu

SEQ ID NO: 285190 - RNA, 22 nt, Homo sapiens
uuugguccuccuacagggcagg

SEQ ID NO: 285191 - RNA, 22 nt, Homo sapiens
uuuggucuuuuauuuaaagcag

SEQ ID NO: 285192 - RNA, 22 nt, Homo sapiens
uuugguguauaaaaaugcuagu

SEQ ID NO: 285193 - RNA, 22 nt, Homo sapiens
uuugguuauauauauacacucu

SEQ ID NO: 285194 - RNA, 22 nt, Homo sapiens
uuugguugccucuaugagccug

SEQ ID NO: 285195 - RNA, 22 nt, Homo sapiens
uuuguaauccuauuccaaagga

SEQ ID NO: 285196 - RNA, 22 nt, Homo sapiens
uuuguacuugaagaaucuuuau

SEQ ID NO: 285197 - RNA, 22 nt, Homo sapiens
uuuguagcucacucugagcuga

SEQ ID NO: 285198 - RNA, 19 nt, Homo sapiens
uuuguauguuuccaguaau

SEQ ID NO: 285199 - RNA, 22 nt, Homo sapiens
uuuguccugccaugguuuauuu

SEQ ID NO: 285200 - RNA, 22 nt, Homo sapiens
uuugugacacaaacacauauau

SEQ ID NO: 285201 - RNA, 22 nt, Homo sapiens
uuugugcaugaagagggggugc

SEQ ID NO: 285202 - RNA, 22 nt, Homo sapiens
uuuguguggccuuggccuggca

SEQ ID NO: 285203 - RNA, 22 nt, Homo sapiens
uuuuaagcuacaagagacauau

SEQ ID NO: 285204 - RNA, 22 nt, Homo sapiens
uuuuaguggacaaagguauuua

SEQ ID NO: 285205 - RNA, 22 nt, Homo sapiens
uuuucacggugucccagagagu

SEQ ID NO: 285206 - RNA, 22 nt, Homo sapiens
uuuucaguggccauaguggaga

SEQ ID NO: 285207 - RNA, 22 nt, Homo sapiens
uuuuccagugggacucccauua

SEQ ID NO: 285208 - RNA, 23 nt, Homo sapiens
uuuugcaauaagucacuggaaua

SEQ ID NO: 285209 - RNA, 22 nt, Homo sapiens
uuuugcacauugauuugguauc

SEQ ID NO: 285210 - RNA, 19 nt, Homo sapiens
uuuugcucuuuauaccuau

SEQ ID NO: 285211 - RNA, 22 nt, Homo sapiens
uuuugcuugugaauagccacau

SEQ ID NO: 285212 - RNA, 22 nt, Homo sapiens
uuuugugacuauuguaaauggg

SEQ ID NO: 285213 - RNA, 22 nt, Homo sapiens
uuuuuauggccaauccucagaa

SEQ ID NO: 285214 - RNA, 22 nt, Homo sapiens
uuuuuggauaaugguacaugua

SEQ ID NO: 285215 - RNA, 21 nt, Homo sapiens
uuuuugggcuuucauaguguu

SEQ ID NO: 285216 - RNA, 22 nt, Homo sapiens
uuuuugguugguaggcuauuaa

SEQ ID NO: 285217 - RNA, 22 nt, Homo sapiens
uuuuuugcuguaugcaaacauc

SEQ ID NO: 285218 - RNA, 22 nt, Homo sapiens
ugaguucuuuguagauucugug

SEQ ID NO: 285219 - RNA, 22 nt, Homo sapiens
ugaguuguagcuauaguuucuu

SEQ ID NO: 285220 - RNA, 23 nt, Homo sapiens
ugauaacagcauaugaagauucu

SEQ ID NO: 285221 - RNA, 22 nt, Homo sapiens
ugauaacauugggggaagcuga

SEQ ID NO: 285222 - RNA, 22 nt, Homo sapiens
ugauaauuuugucagguuuugg

SEQ ID NO: 285223 - RNA, 22 nt, Homo sapiens
ugauacugugcauuagaggcua

SEQ ID NO: 285224 - RNA, 22 nt, Homo sapiens
ugauaggucagaugauauugaa

SEQ ID NO: 285225 - RNA, 22 nt, Homo sapiens
ugauagugccuuuuauaucucu

SEQ ID NO: 285226 - RNA, 22 nt, Homo sapiens
ugauauauugaaugaugaaaca

SEQ ID NO: 285227 - RNA, 22 nt, Homo sapiens
ugauaugaaagggaaauaagug

SEQ ID NO: 285228 - RNA, 22 nt, Homo sapiens
ugauauguggcuauugagauug

SEQ ID NO: 285229 - RNA, 22 nt, Homo sapiens
uugagauggagucucacucugu

SEQ ID NO: 285230 - RNA, 22 nt, Homo sapiens
uugagauggagucucgcacugu

SEQ ID NO: 285231 - RNA, 22 nt, Homo sapiens
uugagauggagucucgcucugu

SEQ ID NO: 285232 - RNA, 22 nt, Homo sapiens
uugagauggagucucguucugu

SEQ ID NO: 285233 - RNA, 22 nt, Homo sapiens
uugagauggagucuugcucuug

SEQ ID NO: 285234 - RNA, 22 nt, Homo sapiens
uugagauggaguuucacucugu

SEQ ID NO: 285235 - RNA, 22 nt, Homo sapiens
uugagauggaguuuugcucuug

SEQ ID NO: 285236 - RNA, 22 nt, Homo sapiens
uugagauggugccacuguacuc

SEQ ID NO: 285237 - RNA, 22 nt, Homo sapiens
uugagcaaaacauuaauauuag

SEQ ID NO: 285238 - RNA, 22 nt, Homo sapiens
uugagcaacauagugagacugu

SEQ ID NO: 285239 - RNA, 21 nt, Homo sapiens
uugagcaacuaggguuauagg

SEQ ID NO: 285240 - RNA, 22 nt, Homo sapiens
uugagcaauccuccugccaugu

SEQ ID NO: 285241 - RNA, 22 nt, Homo sapiens
uugagcacaggaguuuugagac

SEQ ID NO: 285242 - RNA, 22 nt, Homo sapiens
uugagccaaggauugucuuucc

SEQ ID NO: 285243 - RNA, 22 nt, Homo sapiens
uugagcuaugaguuaauaggac

SEQ ID NO: 285244 - RNA, 22 nt, Homo sapiens
uugagcucaucaagauagagaa

SEQ ID NO: 285245 - RNA, 21 nt, Homo sapiens
uugagcuuuuaguacagacag

SEQ ID NO: 285246 - RNA, 22 nt, Homo sapiens
uugaggacugcuaagcauuuga

SEQ ID NO: 285247 - RNA, 22 nt, Homo sapiens
uugaggucuuugagcaaacgca

SEQ ID NO: 285248 - RNA, 22 nt, Homo sapiens
uugaguagauaccuaggaauag

SEQ ID NO: 285249 - RNA, 22 nt, Homo sapiens
uugaguaguaagaagaugauag

SEQ ID NO: 285250 - RNA, 22 nt, Homo sapiens
uugaguaguaagugguucaccg

SEQ ID NO: 285251 - RNA, 22 nt, Homo sapiens
uugaguauuggacugguaucuu

SEQ ID NO: 285252 - RNA, 22 nt, Homo sapiens
uugauaguccuguaucuauuuu

SEQ ID NO: 285253 - RNA, 22 nt, Homo sapiens
uugaucacuguacuaugacuau

SEQ ID NO: 285254 - RNA, 22 nt, Homo sapiens
uugauccucugagaaucuaucg

SEQ ID NO: 285255 - RNA, 22 nt, Homo sapiens
uugcaaagaccucuucacuucc

SEQ ID NO: 285256 - RNA, 22 nt, Homo sapiens
ccuugguugugcuucaacuucu

SEQ ID NO: 285257 - RNA, 22 nt, Homo sapiens
cgcccuguagcuagcuagaggu

SEQ ID NO: 285258 - RNA, 22 nt, Homo sapiens
cgccgggggaugggcaccagcg

SEQ ID NO: 285259 - RNA, 22 nt, Homo sapiens
cgcuggugucuaagcgacagcu

SEQ ID NO: 285260 - RNA, 22 nt, Homo sapiens
cggaaugaaaauguccuucagu

SEQ ID NO: 285261 - RNA, 23 nt, Homo sapiens
cuaaagucugucacugaggacuu

SEQ ID NO: 285262 - RNA, 22 nt, Homo sapiens
cuaaaguucuucugagagaaca

SEQ ID NO: 285263 - RNA, 22 nt, Homo sapiens
cuaacuaugucucaggaugucc

SEQ ID NO: 285264 - RNA, 18 nt, Homo sapiens
cuaauacuauucaacaag

SEQ ID NO: 285265 - RNA, 22 nt, Homo sapiens
cuaauucuggccaaagggauaa

SEQ ID NO: 285266 - RNA, 23 nt, Homo sapiens
cuacagugccugucucuuuggcc

SEQ ID NO: 285267 - RNA, 22 nt, Homo sapiens
cuacaguguauuuauggagggu

SEQ ID NO: 285268 - RNA, 21 nt, Homo sapiens
cuacccuguauuagagaaaga

SEQ ID NO: 285269 - RNA, 22 nt, Homo sapiens
cuacugcacaucaucugaguua

SEQ ID NO: 285270 - RNA, 22 nt, Homo sapiens
cuagaagguaagagcuggaugc

SEQ ID NO: 285271 - RNA, 19 nt, Homo sapiens
uucagcagugucugcucuu

SEQ ID NO: 285272 - RNA, 22 nt, Homo sapiens
uucagcuacuuggaaacagcaa

SEQ ID NO: 285273 - RNA, 22 nt, Homo sapiens
uucaggcuuuuauuuacugaua

SEQ ID NO: 285274 - RNA, 22 nt, Homo sapiens
uucagugagacgaaaacaacaa

SEQ ID NO: 285275 - RNA, 22 nt, Homo sapiens
uucauagaggacauuacuggag

SEQ ID NO: 285276 - RNA, 22 nt, Homo sapiens
uucauagucacauucgaugucu

SEQ ID NO: 285277 - RNA, 22 nt, Homo sapiens
uucauaguuuauacugauauuu

SEQ ID NO: 285278 - RNA, 21 nt, Homo sapiens
uucaucagccagaaaucaagc

SEQ ID NO: 285279 - RNA, 22 nt, Homo sapiens
uucaucagggagaaauaauuuc

SEQ ID NO: 285280 - RNA, 18 nt, Homo sapiens
uucaucaguccucagcug

SEQ ID NO: 285281 - RNA, 22 nt, Homo sapiens
uucauccccuccaaaucucaug

SEQ ID NO: 285282 - RNA, 22 nt, Homo sapiens
uucaucuggcaauucagagauu

SEQ ID NO: 285283 - RNA, 22 nt, Homo sapiens
uucauggaugcauuugaggggu

SEQ ID NO: 285284 - RNA, 22 nt, Homo sapiens
uucauguaauuccauaagguaa

SEQ ID NO: 285285 - RNA, 22 nt, Homo sapiens
uucauguagucaucauccugcu

SEQ ID NO: 285286 - RNA, 22 nt, Homo sapiens
uucaugucuuggcuguuagagu

SEQ ID NO: 285287 - RNA, 22 nt, Homo sapiens
uucaugugagucuguauuaacu

SEQ ID NO: 285288 - RNA, 22 nt, Homo sapiens
uuccacuuuuuccuugugcucc

SEQ ID NO: 285289 - RNA, 22 nt, Homo sapiens
uuccagagucaccuuucugucg

SEQ ID NO: 285290 - RNA, 22 nt, Homo sapiens
uuccaggugggcgugggccugg

SEQ ID NO: 285291 - RNA, 22 nt, Homo sapiens
uuccaguggaguaaauggacaa

SEQ ID NO: 285292 - RNA, 22 nt, Homo sapiens
uuccaguugugagcuauccggg

SEQ ID NO: 285293 - RNA, 22 nt, Homo sapiens
uuccauguaguugaacgguuuu

SEQ ID NO: 285294 - RNA, 22 nt, Homo sapiens
uucccaguaaacucuaucccuc

SEQ ID NO: 285295 - RNA, 22 nt, Homo sapiens
uucccugagcaucuguugagcc

SEQ ID NO: 285296 - RNA, 22 nt, Homo sapiens
uucccuguaucuucugccaugu

SEQ ID NO: 285297 - RNA, 22 nt, Homo sapiens
uucccuugcaggaugaucugga

SEQ ID NO: 285298 - RNA, 22 nt, Homo sapiens
uuccguguaguugagcaguuuu

SEQ ID NO: 285299 - RNA, 22 nt, Homo sapiens
uuccuagagauuagcaagcugc

SEQ ID NO: 285300 - RNA, 22 nt, Homo sapiens
uuccuugaaacagucaagagaa

SEQ ID NO: 285301 - RNA, 22 nt, Homo sapiens
uuccuuguagcaaaugcgauga

SEQ ID NO: 285302 - RNA, 22 nt, Homo sapiens
uuccuuguuuauuuacaggagg

SEQ ID NO: 285303 - RNA, 22 nt, Homo sapiens
uucuacaggcuguucaagaagc

SEQ ID NO: 285304 - RNA, 22 nt, Homo sapiens
uucuauguuguuagacccacca

SEQ ID NO: 285305 - RNA, 22 nt, Homo sapiens
uucucaauggaugugggaccag

SEQ ID NO: 285306 - RNA, 22 nt, Homo sapiens
uucucaauggcaacuuguugcu

SEQ ID NO: 285307 - RNA, 21 nt, Homo sapiens
uucucagaggcaggggauaaa

SEQ ID NO: 285308 - RNA, 22 nt, Homo sapiens
uucucagugaacuccagcuugu

SEQ ID NO: 285309 - RNA, 22 nt, Homo sapiens
uucucagugaaguuuagaacau

SEQ ID NO: 285310 - RNA, 22 nt, Homo sapiens
uucucauggugauggcaaaauc

SEQ ID NO: 285311 - RNA, 22 nt, Homo sapiens
uucugacuggugugagauggua

SEQ ID NO: 285312 - RNA, 22 nt, Homo sapiens
uucugcuugaucuaguguguug

SEQ ID NO: 285313 - RNA, 22 nt, Homo sapiens
uucuggcuaugggauacuaaau

SEQ ID NO: 285314 - RNA, 22 nt, Homo sapiens
uucuuagucaaguuguauuuca

SEQ ID NO: 285315 - RNA, 22 nt, Homo sapiens
uucuucaggcauucccagaagc

SEQ ID NO: 285316 - RNA, 22 nt, Homo sapiens
uucuucugguuaugaaauuuga

SEQ ID NO: 285317 - RNA, 22 nt, Homo sapiens
uucuugcugaauugugcccuuc

SEQ ID NO: 285318 - RNA, 22 nt, Homo sapiens
uucuugguuggcaaccaacagu

SEQ ID NO: 285319 - RNA, 22 nt, Homo sapiens
uucuuugcuuggaagcggggga

SEQ ID NO: 285320 - RNA, 22 nt, Homo sapiens
uucuuuggauaaaguuuuaugc

SEQ ID NO: 285321 - RNA, 22 nt, Homo sapiens
uugaaagaaaggagacugaguu

SEQ ID NO: 285322 - RNA, 22 nt, Homo sapiens
uugaaaguguucacaaugguau

SEQ ID NO: 285323 - RNA, 22 nt, Homo sapiens
uugaaauguguaagcuccgaaa

SEQ ID NO: 285324 - RNA, 22 nt, Homo sapiens
uugaaauguuuagaaguuugga

SEQ ID NO: 285325 - RNA, 22 nt, Homo sapiens
uugaacuguaagggucugugug

SEQ ID NO: 285326 - RNA, 22 nt, Homo sapiens
uugaagacuauaugauucuuca

SEQ ID NO: 285327 - RNA, 22 nt, Homo sapiens
uugaagagaaccgcggcuuauu

SEQ ID NO: 285328 - RNA, 22 nt, Homo sapiens
uugaaguagaaagacgaaauuu

SEQ ID NO: 285329 - RNA, 22 nt, Homo sapiens
uaagcuauagugaauaaauugc

SEQ ID NO: 285330 - RNA, 22 nt, Homo sapiens
uaaggauuuuggugauuacacu

SEQ ID NO: 285331 - RNA, 22 nt, Homo sapiens
uaaggcaaaccuuggcugcagu

SEQ ID NO: 285332 - RNA, 22 nt, Homo sapiens
uaaggcacccuucugaguagag

SEQ ID NO: 285333 - RNA, 18 nt, Homo sapiens
uaaggcacuauaggcauu

SEQ ID NO: 285334 - RNA, 22 nt, Homo sapiens
uaaggcuugaucuuggugagau

SEQ ID NO: 285335 - RNA, 22 nt, Homo sapiens
uaagguuacaaaggacuucaua

SEQ ID NO: 285336 - RNA, 22 nt, Homo sapiens
uaaguaauuuguauuuuaccca

SEQ ID NO: 285337 - RNA, 23 nt, Homo sapiens
uaagucacacagauuaauuuauu

SEQ ID NO: 285338 - RNA, 22 nt, Homo sapiens
uaagugcaugauuacaugcaua

SEQ ID NO: 285339 - RNA, 22 nt, Homo sapiens
uaagugcuguguuguuaccuaa

SEQ ID NO: 285340 - RNA, 20 nt, Homo sapiens
uaagugcuuuauauugauua

SEQ ID NO: 285341 - RNA, 22 nt, Homo sapiens
uaaguggugcauuguuaaaugg

SEQ ID NO: 285342 - RNA, 22 nt, Homo sapiens
uaauaauguuaggcuuacucaa

SEQ ID NO: 285343 - RNA, 22 nt, Homo sapiens
uaauaguguuaaugcuagagcu

SEQ ID NO: 285344 - RNA, 22 nt, Homo sapiens
uaaugcaucaugguuggcaaac

SEQ ID NO: 285345 - RNA, 22 nt, Homo sapiens
uaauucacauaaagcacuuaga

SEQ ID NO: 285346 - RNA, 22 nt, Homo sapiens
uaauugcaguucuguguuauau

SEQ ID NO: 285347 - RNA, 22 nt, Homo sapiens
uacaagcacaggcagcaggcug

SEQ ID NO: 285348 - RNA, 22 nt, Homo sapiens
uacaaguaauaagggaagaauu

SEQ ID NO: 285349 - RNA, 22 nt, Homo sapiens
uacaaguauuuuuauuagugcc

SEQ ID NO: 285350 - RNA, 21 nt, Homo sapiens
uacaaugcacaggagagccuc

SEQ ID NO: 285351 - RNA, 22 nt, Homo sapiens
uacagaauugcagguguggcag

SEQ ID NO: 285352 - RNA, 22 nt, Homo sapiens
uacagcacaggugcagguguug

SEQ ID NO: 285353 - RNA, 22 nt, Homo sapiens
uacagccacauaauguaugauu

SEQ ID NO: 285354 - RNA, 22 nt, Homo sapiens
uacagcuaugugcaugcaugcu

SEQ ID NO: 285355 - RNA, 22 nt, Homo sapiens
uacaggcaccuggcuaauuuuu

SEQ ID NO: 285356 - RNA, 22 nt, Homo sapiens
uacaguaauguuaaucuuugug

SEQ ID NO: 285357 - RNA, 22 nt, Homo sapiens
uacagucacauuccugaccaua

SEQ ID NO: 285358 - RNA, 22 nt, Homo sapiens
uacagucuagaggagaaucagg

SEQ ID NO: 285359 - RNA, 22 nt, Homo sapiens
uacaguggaaguuaaccccauu

SEQ ID NO: 285360 - RNA, 22 nt, Homo sapiens
uuguccuugagauaguuugcug

SEQ ID NO: 285361 - RNA, 22 nt, Homo sapiens
uugucuccuagacgaccaggcg

SEQ ID NO: 285362 - RNA, 22 nt, Homo sapiens
uugugaagaugugaagcaagca

SEQ ID NO: 285363 - RNA, 22 nt, Homo sapiens
uugugaucauugucaaauagug

SEQ ID NO: 285364 - RNA, 22 nt, Homo sapiens
uugugcaaaguugugguuucug

SEQ ID NO: 285365 - RNA, 22 nt, Homo sapiens
uugugcaugaugcauacauggu

SEQ ID NO: 285366 - RNA, 22 nt, Homo sapiens
uugugccugguacauggagaaa

SEQ ID NO: 285367 - RNA, 22 nt, Homo sapiens
uugugcuugcuguguucuaugc

SEQ ID NO: 285368 - RNA, 22 nt, Homo sapiens
uugugcuuguaacuacauucag

SEQ ID NO: 285369 - RNA, 22 nt, Homo sapiens
uugugggaggugauuagaucau

SEQ ID NO: 285370 - RNA, 22 nt, Homo sapiens
uugugguaaucugugacagcag

SEQ ID NO: 285371 - RNA, 22 nt, Homo sapiens
uugugguaggaugaagagauga

SEQ ID NO: 285372 - RNA, 22 nt, Homo sapiens
uugugguugauacacguaggaa

SEQ ID NO: 285373 - RNA, 22 nt, Homo sapiens
uugugguuuuaucuaccuuugg

SEQ ID NO: 285374 - RNA, 22 nt, Homo sapiens
uuguguuuuuaguagggaaggg

SEQ ID NO: 285375 - RNA, 22 nt, Homo sapiens
uuuaaguguuuguuccugaaaa

SEQ ID NO: 285376 - RNA, 22 nt, Homo sapiens
uuuaauagcagggacuuccggg

SEQ ID NO: 285377 - RNA, 22 nt, Homo sapiens
uuuaaugcugcccagucauggg

SEQ ID NO: 285378 - RNA, 22 nt, Homo sapiens
uuuacccugaggaaucuauuuu

SEQ ID NO: 285379 - RNA, 21 nt, Homo sapiens
uuuacuguggacccauugcuu

SEQ ID NO: 285380 - RNA, 19 nt, Homo sapiens
uuuagaucuuuuaugcagc

SEQ ID NO: 285381 - RNA, 23 nt, Homo sapiens
uuuaguccccuaugagcuggugu

SEQ ID NO: 285382 - RNA, 22 nt, Homo sapiens
uuuauguggagcacuugacaca

SEQ ID NO: 285383 - RNA, 22 nt, Homo sapiens
uuuauucggcuaggagcuucgg

SEQ ID NO: 285384 - RNA, 22 nt, Homo sapiens
uuuauugcucuaaaguugccau

SEQ ID NO: 285385 - RNA, 22 nt, Homo sapiens
uuucacagcugucuuccgucuc

SEQ ID NO: 285386 - RNA, 22 nt, Homo sapiens
uuucacaguguucucccccaga

SEQ ID NO: 285387 - RNA, 17 nt, Homo sapiens
uuucagaguggaagugu

SEQ ID NO: 285388 - RNA, 22 nt, Homo sapiens
uuucagguauuuaagggccguu

SEQ ID NO: 285389 - RNA, 22 nt, Homo sapiens
uuucaguguggcaggcauagcu

SEQ ID NO: 285390 - RNA, 22 nt, Homo sapiens
uuucaucaagcacagaguagau

SEQ ID NO: 285391 - RNA, 22 nt, Homo sapiens
uuucauggaggauuugcuucuu

SEQ ID NO: 285392 - RNA, 22 nt, Homo sapiens
uuucauguuuuucugugaggca

SEQ ID NO: 285393 - RNA, 19 nt, Homo sapiens
uuucauguuuuuggugaga

SEQ ID NO: 285394 - RNA, 22 nt, Homo sapiens
uuuccagguggccaacauuuua

SEQ ID NO: 285395 - RNA, 22 nt, Homo sapiens
uuuccaguuguucuagaaagcu

SEQ ID NO: 285396 - RNA, 22 nt, Homo sapiens
uuuccaguuuggaggaugcauu

SEQ ID NO: 285397 - RNA, 22 nt, Homo sapiens
uagcaacauucagcucagguac

SEQ ID NO: 285398 - RNA, 22 nt, Homo sapiens
uagcacagggaauugguucucu

SEQ ID NO: 285399 - RNA, 19 nt, Homo sapiens
uagcacagggucccagacu

SEQ ID NO: 285400 - RNA, 22 nt, Homo sapiens
uagcacagugucauucuaggua

SEQ ID NO: 285401 - RNA, 22 nt, Homo sapiens
uagcacaguucacccucgauuu

SEQ ID NO: 285402 - RNA, 22 nt, Homo sapiens
uagcaccaaacauauacucagu

SEQ ID NO: 285403 - RNA, 22 nt, Homo sapiens
uagcagaauauaccucuuacuu

SEQ ID NO: 285404 - RNA, 22 nt, Homo sapiens
uagcagcaaagcaggaucugcu

SEQ ID NO: 285405 - RNA, 22 nt, Homo sapiens
uagcagcaucucuggcuucuac

SEQ ID NO: 285406 - RNA, 22 nt, Homo sapiens
uagcagcuuuauugagguaaau

SEQ ID NO: 285407 - RNA, 22 nt, Homo sapiens
uagcaggaaaccuguguugagg

SEQ ID NO: 285408 - RNA, 22 nt, Homo sapiens
uagcagguguuccacaaauauu

SEQ ID NO: 285409 - RNA, 22 nt, Homo sapiens
uagcaguauacguacugggucc

SEQ ID NO: 285410 - RNA, 22 nt, Homo sapiens
uagcaguauugaaagaugaggg

SEQ ID NO: 285411 - RNA, 22 nt, Homo sapiens
uagcagugugaaaacggacuaa

SEQ ID NO: 285412 - RNA, 21 nt, Homo sapiens
uagcauacauuuugcaucuua

SEQ ID NO: 285413 - RNA, 22 nt, Homo sapiens
uagcugguucuccaggagcuag

SEQ ID NO: 285414 - RNA, 22 nt, Homo sapiens
uagcuucuccauagcuccaugu

SEQ ID NO: 285415 - RNA, 22 nt, Homo sapiens
uaggagcacaaacccuacugug

SEQ ID NO: 285416 - RNA, 22 nt, Homo sapiens
uaggagcacagcagcauguggg

SEQ ID NO: 285417 - RNA, 22 nt, Homo sapiens
uaggcaaaugcaagaguagaac

SEQ ID NO: 285418 - RNA, 22 nt, Homo sapiens
uaggcacuguguuuguaggagu

SEQ ID NO: 285419 - RNA, 22 nt, Homo sapiens
uaggcuguguggccguggggcu

SEQ ID NO: 285420 - RNA, 22 nt, Homo sapiens
uagggaguguccuuucgggaaa

SEQ ID NO: 285421 - RNA, 22 nt, Homo sapiens
uagggagugucuucauuuugua

SEQ ID NO: 285422 - RNA, 22 nt, Homo sapiens
uagggcauguguggaguguaug

SEQ ID NO: 285423 - RNA, 22 nt, Homo sapiens
uagggcuuuccggccugucaga

SEQ ID NO: 285424 - RNA, 22 nt, Homo sapiens
uagguacuuaagaucucagcua

SEQ ID NO: 285425 - RNA, 22 nt, Homo sapiens
uaggugaauguaguaagguguu

SEQ ID NO: 285426 - RNA, 19 nt, Homo sapiens
uaggugguuuuccccucac

SEQ ID NO: 285427 - RNA, 22 nt, Homo sapiens
uaguagugucccugacuaucac

SEQ ID NO: 285428 - RNA, 22 nt, Homo sapiens
uagucaaaucugaaggaaauuu

SEQ ID NO: 285429 - RNA, 21 nt, Homo sapiens
uagugcagugggguaugacuu

SEQ ID NO: 285430 - RNA, 22 nt, Homo sapiens
uaguuaguagacucugauuauu

SEQ ID NO: 285431 - RNA, 22 nt, Homo sapiens
uaguucauuauguguugcucag

SEQ ID NO: 285432 - RNA, 22 nt, Homo sapiens
uaguucauuuuucuugcuuaga

SEQ ID NO: 285433 - RNA, 22 nt, Homo sapiens
uaguugcaucuuaggucuguga

SEQ ID NO: 285434 - RNA, 22 nt, Homo sapiens
uaguugcauuggcugcuaugcu

SEQ ID NO: 285435 - RNA, 22 nt, Homo sapiens
uauacaugugccauguuggugu

SEQ ID NO: 285436 - RNA, 22 nt, Homo sapiens
uauacuguuuucuauaguggcu

SEQ ID NO: 285437 - RNA, 22 nt, Homo sapiens
uauagcaaugugccacucucug

SEQ ID NO: 285438 - RNA, 22 nt, Homo sapiens
uauagcuaugggauguauuugc

SEQ ID NO: 285439 - RNA, 22 nt, Homo sapiens
uauaguguuuucaaaaguaugu

SEQ ID NO: 285440 - RNA, 22 nt, Homo sapiens
uauaucacaugcacucauuuuc

SEQ ID NO: 285441 - RNA, 22 nt, Homo sapiens
uauaugcaacauaguguaugug

SEQ ID NO: 285442 - RNA, 22 nt, Homo sapiens
uaucacacgccuugcuucauuu

SEQ ID NO: 285443 - RNA, 22 nt, Homo sapiens
uaucacaggucaggaaccuugu

SEQ ID NO: 285444 - RNA, 22 nt, Homo sapiens
uaucacagguggacugcacacc

SEQ ID NO: 285445 - RNA, 22 nt, Homo sapiens
uaucacaguaucuagcacagug

SEQ ID NO: 285446 - RNA, 22 nt, Homo sapiens
uaucacagugcuggaguauucc

SEQ ID NO: 285447 - RNA, 22 nt, Homo sapiens
uaucagaucccaauuucuggcc

SEQ ID NO: 285448 - RNA, 22 nt, Homo sapiens
uaucagauugcugccaucugcu

SEQ ID NO: 285449 - RNA, 22 nt, Homo sapiens
uaucagcacaguggguucaugg

SEQ ID NO: 285450 - RNA, 22 nt, Homo sapiens
uaucaguauggauucauggauu

SEQ ID NO: 285451 - RNA, 22 nt, Homo sapiens
uaucauagacaaucaguuauug

SEQ ID NO: 285452 - RNA, 21 nt, Homo sapiens
uauccacuugcaacagagaag

SEQ ID NO: 285453 - RNA, 22 nt, Homo sapiens
uaucccaguggauguaccccau

SEQ ID NO: 285454 - RNA, 22 nt, Homo sapiens
uaucccuuagagcggggugguu

SEQ ID NO: 285455 - RNA, 23 nt, Homo sapiens
uaucucaaugcacagagaggaaa

SEQ ID NO: 285456 - RNA, 22 nt, Homo sapiens
uaugaauuuuauccaggauaua

SEQ ID NO: 285457 - RNA, 23 nt, Homo sapiens
uaugacagaggaagggggagcug

SEQ ID NO: 285458 - RNA, 22 nt, Homo sapiens
uaugacuuuggaaaaauuacuu

SEQ ID NO: 285459 - RNA, 21 nt, Homo sapiens
uaugagucugcaagaaccaca

SEQ ID NO: 285460 - RNA, 22 nt, Homo sapiens
uaugaucauuauguuauugcag

SEQ ID NO: 285461 - RNA, 22 nt, Homo sapiens
uaugauuuuugggagaggucaa

SEQ ID NO: 285462 - RNA, 22 nt, Homo sapiens
uaugcacacacguguuuaugug

SEQ ID NO: 285463 - RNA, 22 nt, Homo sapiens
uaugcacaugcaugcuugaaua

SEQ ID NO: 285464 - RNA, 19 nt, Homo sapiens
uaugcuagagagggaagcu

SEQ ID NO: 285465 - RNA, 22 nt, Homo sapiens
uaugcuguuucugauuuaggga

SEQ ID NO: 285466 - RNA, 22 nt, Homo sapiens
uauggcuucuuuaaauugaggu

SEQ ID NO: 285467 - RNA, 22 nt, Homo sapiens
uauggcuuuuaacugucguaug

SEQ ID NO: 285468 - RNA, 22 nt, Homo sapiens
uauggcuuuuauuauguuguag

SEQ ID NO: 285469 - RNA, 22 nt, Homo sapiens
uaugggcuuuguuuuguacuag

SEQ ID NO: 285470 - RNA, 22 nt, Homo sapiens
uauggguuuuucauaaauaggu

SEQ ID NO: 285471 - RNA, 22 nt, Homo sapiens
uauuacacuuuagugucuucca

SEQ ID NO: 285472 - RNA, 22 nt, Homo sapiens
uauuacauccauaggcucugcu

SEQ ID NO: 285473 - RNA, 22 nt, Homo sapiens
uauuacuugucugugucucaau

SEQ ID NO: 285474 - RNA, 22 nt, Homo sapiens
uauuagguuggggcaaaaguaa

SEQ ID NO: 285475 - RNA, 22 nt, Homo sapiens
uauuauuguccuucuauaccca

SEQ ID NO: 285476 - RNA, 22 nt, Homo sapiens
uauucaagccaaauucaagcca

SEQ ID NO: 285477 - RNA, 22 nt, Homo sapiens
uauucacaggugugggacaaag

SEQ ID NO: 285478 - RNA, 22 nt, Homo sapiens
uauuccacucuguuggagguaa

SEQ ID NO: 285479 - RNA, 22 nt, Homo sapiens
uauugaacgugggauauugaag

SEQ ID NO: 285480 - RNA, 22 nt, Homo sapiens
uauugaauuugagcugucucuu

SEQ ID NO: 285481 - RNA, 22 nt, Homo sapiens
uauugccuugccuacuuuucca

SEQ ID NO: 285482 - RNA, 22 nt, Homo sapiens
uauugcuggauguauuacaugu

SEQ ID NO: 285483 - RNA, 22 nt, Homo sapiens
uauugcuugaggaaaugguaau

SEQ ID NO: 285484 - RNA, 18 nt, Homo sapiens
uauugcuugguuuggaga

SEQ ID NO: 285485 - RNA, 22 nt, Homo sapiens
uauuugguuacuugaauagcua

SEQ ID NO: 285486 - RNA, 22 nt, Homo sapiens
uauuugguuauaugaguaaguu

SEQ ID NO: 285487 - RNA, 20 nt, Homo sapiens
uauuugguuauuuccauggu

SEQ ID NO: 285488 - RNA, 22 nt, Homo sapiens
ucaaacauccccaccagggacu

SEQ ID NO: 285489 - RNA, 20 nt, Homo sapiens
ucaaagacauggcugucaga

SEQ ID NO: 285490 - RNA, 20 nt, Homo sapiens
ucaaaguaugcucugcacua

SEQ ID NO: 285491 - RNA, 22 nt, Homo sapiens
ucaaagucuucucaaguaacau

SEQ ID NO: 285492 - RNA, 22 nt, Homo sapiens
ucaaaugauucuccugccucag

SEQ ID NO: 285493 - RNA, 22 nt, Homo sapiens
ucaaaugcacguagagaaaaua

SEQ ID NO: 285494 - RNA, 22 nt, Homo sapiens
ucaaaugcuguauuguaguaau

SEQ ID NO: 285495 - RNA, 22 nt, Homo sapiens
ucaacaggucaauugcauagaa

SEQ ID NO: 285496 - RNA, 22 nt, Homo sapiens
ucaacagugggcacuguaaaug

SEQ ID NO: 285497 - RNA, 22 nt, Homo sapiens
ucaacugcuugagaucacaaau

SEQ ID NO: 285498 - RNA, 22 nt, Homo sapiens
ucaagcaauucgccugucucag

SEQ ID NO: 285499 - RNA, 22 nt, Homo sapiens
ucaagcaauucuccucucagcc

SEQ ID NO: 285500 - RNA, 19 nt, Homo sapiens
ucaagcuauucuccugccu

SEQ ID NO: 285501 - RNA, 20 nt, Homo sapiens
ucaaggcacgaauaaaaguu

SEQ ID NO: 285502 - RNA, 22 nt, Homo sapiens
ucaaggcaguggccuuccuucu

SEQ ID NO: 285503 - RNA, 22 nt, Homo sapiens
ucaaugcaugugacaaagagua

SEQ ID NO: 285504 - RNA, 22 nt, Homo sapiens
ucacaaguguauagacaugucc

SEQ ID NO: 285505 - RNA, 22 nt, Homo sapiens
ucacaauggcugaacuaauuua

SEQ ID NO: 285506 - RNA, 22 nt, Homo sapiens
ucacaauguaaaugaggguugg

SEQ ID NO: 285507 - RNA, 19 nt, Homo sapiens
ucacacuguggcuucuuua

SEQ ID NO: 285508 - RNA, 22 nt, Homo sapiens
ucacagcuaaaaugaaaguagu

SEQ ID NO: 285509 - RNA, 22 nt, Homo sapiens
ugagacacuucccagaucccuu

SEQ ID NO: 285510 - RNA, 22 nt, Homo sapiens
ugagacauacuuacaggggaug

SEQ ID NO: 285511 - RNA, 22 nt, Homo sapiens
ugagacggagucucacucuguu

SEQ ID NO: 285512 - RNA, 22 nt, Homo sapiens
ugagacggagucucgcucuguc

SEQ ID NO: 285513 - RNA, 22 nt, Homo sapiens
ugagacggagucucgcucuguu

SEQ ID NO: 285514 - RNA, 22 nt, Homo sapiens
ugagacggagucuugcucuguc

SEQ ID NO: 285515 - RNA, 22 nt, Homo sapiens
ugagacggaguuucacucuugu

SEQ ID NO: 285516 - RNA, 22 nt, Homo sapiens
ugagacggaguuucgcucuugu

SEQ ID NO: 285517 - RNA, 22 nt, Homo sapiens
ugagacugaaauuaggaaacug

SEQ ID NO: 285518 - RNA, 22 nt, Homo sapiens
ugagacugaguuuccaucuugu

SEQ ID NO: 285519 - RNA, 22 nt, Homo sapiens
ugagacugaguuucucucuugu

SEQ ID NO: 285520 - RNA, 22 nt, Homo sapiens
ugagacugaguuuugccuuugu

SEQ ID NO: 285521 - RNA, 22 nt, Homo sapiens
ugagacuguuuuggggaacuuc

SEQ ID NO: 285522 - RNA, 22 nt, Homo sapiens
ugagagacagacauuaucuuau

SEQ ID NO: 285523 - RNA, 22 nt, Homo sapiens
ugagagacaguuuguuaaaauu

SEQ ID NO: 285524 - RNA, 22 nt, Homo sapiens
ugagauaaucaugugauuucau

SEQ ID NO: 285525 - RNA, 18 nt, Homo sapiens
ugagauacuagaauaggu

SEQ ID NO: 285526 - RNA, 22 nt, Homo sapiens
uuuugguguauuguauaaggua

SEQ ID NO: 285527 - RNA, 22 nt, Homo sapiens
uuuugguuaggauggguggcau

SEQ ID NO: 285528 - RNA, 22 nt, Homo sapiens
uuuugguucaauuaauuugcua

SEQ ID NO: 285529 - RNA, 22 nt, Homo sapiens
uuuugguuuuauccagggucuc

SEQ ID NO: 285530 - RNA, 18 nt, Homo sapiens
uuuuugaggcacagggga

SEQ ID NO: 285531 - RNA, 22 nt, Homo sapiens
uuuuugaguagcuggagagcag

SEQ ID NO: 285532 - RNA, 22 nt, Homo sapiens
uuuuuugguaauugaacaauga

SEQ ID NO: 285533 - RNA, 22 nt, Homo sapiens
auggccuuucuggcacauuucc

SEQ ID NO: 285534 - RNA, 22 nt, Homo sapiens
auggcuagaaccuguauauuca

SEQ ID NO: 285535 - RNA, 22 nt, Homo sapiens
auggcucuguuccaugugucuu

SEQ ID NO: 285536 - RNA, 22 nt, Homo sapiens
auggcuguuuuuuauguuacag

SEQ ID NO: 285537 - RNA, 22 nt, Homo sapiens
auggcuuguuaugcauuaguac

SEQ ID NO: 285538 - RNA, 22 nt, Homo sapiens
augggguaggcuuugcugcagu

SEQ ID NO: 285539 - RNA, 22 nt, Homo sapiens
augguacuagaguaagaauugu

SEQ ID NO: 285540 - RNA, 22 nt, Homo sapiens
augguacucucuugucugcaaa

SEQ ID NO: 285541 - RNA, 22 nt, Homo sapiens
augguacuggggucccggaguu

SEQ ID NO: 285542 - RNA, 22 nt, Homo sapiens
auggucccuguuccaugcuccu

SEQ ID NO: 285543 - RNA, 22 nt, Homo sapiens
augguguccuguuuccccagga

SEQ ID NO: 285544 - RNA, 22 nt, Homo sapiens
augguugguuaaaucuguguau

SEQ ID NO: 285545 - RNA, 22 nt, Homo sapiens
augguuuuacugcaaaauggga

SEQ ID NO: 285546 - RNA, 21 nt, Homo sapiens
auguaaugaagaagccacugg

SEQ ID NO: 285547 - RNA, 22 nt, Homo sapiens
auguaauguuaaauugcuaauu

SEQ ID NO: 285548 - RNA, 22 nt, Homo sapiens
auguaguagcagaaaauauuuu

SEQ ID NO: 285549 - RNA, 22 nt, Homo sapiens
auguauacauagauacgugugu

SEQ ID NO: 285550 - RNA, 22 nt, Homo sapiens
augucaaagaggaaaacuggau

SEQ ID NO: 285551 - RNA, 22 nt, Homo sapiens
augucauagaagccugugaacc

SEQ ID NO: 285552 - RNA, 22 nt, Homo sapiens
augucuuucauagagacccaga

SEQ ID NO: 285553 - RNA, 22 nt, Homo sapiens
augugacugauggagaauaugu

SEQ ID NO: 285554 - RNA, 22 nt, Homo sapiens
augugcaaagcacuguucagca

SEQ ID NO: 285555 - RNA, 22 nt, Homo sapiens
augugcacaacgugcagguuug

SEQ ID NO: 285556 - RNA, 22 nt, Homo sapiens
augugcacaugcuuacauguga

SEQ ID NO: 285557 - RNA, 22 nt, Homo sapiens
auguggugguagccaggacagg

SEQ ID NO: 285558 - RNA, 20 nt, Homo sapiens
auguucuggaggacagaagc

SEQ ID NO: 285559 - RNA, 22 nt, Homo sapiens
auguuguaguaugagucaaaau

SEQ ID NO: 285560 - RNA, 22 nt, Homo sapiens
auuaauguaauuaguaaaguug

SEQ ID NO: 285561 - RNA, 22 nt, Homo sapiens
auuacacuuucuauucaaugag

SEQ ID NO: 285562 - RNA, 22 nt, Homo sapiens
auuacccuuagacuccagagug

SEQ ID NO: 285563 - RNA, 22 nt, Homo sapiens
auuagguauuuucuggacaggg

SEQ ID NO: 285564 - RNA, 22 nt, Homo sapiens
auuagguuaggcaaacuucugu

SEQ ID NO: 285565 - RNA, 22 nt, Homo sapiens
auuauaugucaucacagacacc

SEQ ID NO: 285566 - RNA, 22 nt, Homo sapiens
auuauauguguaugugcauacc

SEQ ID NO: 285567 - RNA, 22 nt, Homo sapiens
auuauuagucggccagcuguua

SEQ ID NO: 285568 - RNA, 22 nt, Homo sapiens
auuauuaguuguugaaugaagu

SEQ ID NO: 285569 - RNA, 22 nt, Homo sapiens
auucaagggauuucaggaggcu

SEQ ID NO: 285570 - RNA, 20 nt, Homo sapiens
auucaaguaugccuugagaa

SEQ ID NO: 285571 - RNA, 22 nt, Homo sapiens
auucacagcuuuaaaaggcgug

SEQ ID NO: 285572 - RNA, 22 nt, Homo sapiens
auucacuguggguccuuuggau

SEQ ID NO: 285573 - RNA, 22 nt, Homo sapiens
auucaucagggauacuggccug

SEQ ID NO: 285574 - RNA, 22 nt, Homo sapiens
auucaucagggauauugguuga

SEQ ID NO: 285575 - RNA, 21 nt, Homo sapiens
auuccacuuuuccuucaggga

SEQ ID NO: 285576 - RNA, 22 nt, Homo sapiens
auuccagguggcgccauucaca

SEQ ID NO: 285577 - RNA, 22 nt, Homo sapiens
auuccauuuguguggaauggcu

SEQ ID NO: 285578 - RNA, 22 nt, Homo sapiens
auucuugcuugaacuuggugca

SEQ ID NO: 285579 - RNA, 23 nt, Homo sapiens
auugaacacuuucauaugugagg

SEQ ID NO: 285580 - RNA, 22 nt, Homo sapiens
auugacacugauuuuucuuuaa

SEQ ID NO: 285581 - RNA, 22 nt, Homo sapiens
auugagcaauuccuaugugcuu

SEQ ID NO: 285582 - RNA, 18 nt, Homo sapiens
auugagcaugacagaccu

SEQ ID NO: 285583 - RNA, 22 nt, Homo sapiens
auugagucauuucaaauccaag

SEQ ID NO: 285584 - RNA, 22 nt, Homo sapiens
auugcaacaguguugagaggug

SEQ ID NO: 285585 - RNA, 22 nt, Homo sapiens
auugcaaugggaaacuaugaaa

SEQ ID NO: 285586 - RNA, 22 nt, Homo sapiens
auugcacuccacccugggcaac

SEQ ID NO: 285587 - RNA, 22 nt, Homo sapiens
auugcacuccagccuagguaac

SEQ ID NO: 285588 - RNA, 22 nt, Homo sapiens
auugcacuccagccugagcaaa

SEQ ID NO: 285589 - RNA, 22 nt, Homo sapiens
auugcacuccagccugggcuag

SEQ ID NO: 285590 - RNA, 22 nt, Homo sapiens
auugcacuccagucugggcaac

SEQ ID NO: 285591 - RNA, 22 nt, Homo sapiens
auugcacugcagccugggcaac

SEQ ID NO: 285592 - RNA, 22 nt, Homo sapiens
auugcuaacugaaauaagacca

SEQ ID NO: 285593 - RNA, 22 nt, Homo sapiens
auugcuuuuacugggagcuuug

SEQ ID NO: 285594 - RNA, 22 nt, Homo sapiens
auuggcuuuugaaagucugcga

SEQ ID NO: 285595 - RNA, 22 nt, Homo sapiens
auuggggaaugguggcuuuagu

SEQ ID NO: 285596 - RNA, 22 nt, Homo sapiens
auuguaauuuuagagaaagugg

SEQ ID NO: 285597 - RNA, 22 nt, Homo sapiens
auugucauuuauaacuguguag

SEQ ID NO: 285598 - RNA, 20 nt, Homo sapiens
auuguccuugauuacacaga

SEQ ID NO: 285599 - RNA, 22 nt, Homo sapiens
auugugcuaaaguaauaaguca

SEQ ID NO: 285600 - RNA, 22 nt, Homo sapiens
auuuagcaauggagguagugua

SEQ ID NO: 285601 - RNA, 20 nt, Homo sapiens
auuugcauuauggagcaccc

SEQ ID NO: 285602 - RNA, 22 nt, Homo sapiens
auuuggcaauuuugaagaugcc

SEQ ID NO: 285603 - RNA, 22 nt, Homo sapiens
auuugguaauauuuaaggacuu

SEQ ID NO: 285604 - RNA, 21 nt, Homo sapiens
auuugguguuagaaauaaauu

SEQ ID NO: 285605 - RNA, 22 nt, Homo sapiens
auuugguuauggucauggacac

SEQ ID NO: 285606 - RNA, 22 nt, Homo sapiens
gacccuuagaaugugaucuuau

SEQ ID NO: 285607 - RNA, 22 nt, Homo sapiens
gacuauaucaggaauggggauu

SEQ ID NO: 285608 - RNA, 22 nt, Homo sapiens
gacucagaacuaaggguguuuc

SEQ ID NO: 285609 - RNA, 19 nt, Homo sapiens
gacuccagaguugugugcu

SEQ ID NO: 285610 - RNA, 22 nt, Homo sapiens
gacuggcuguuuucuuuauuau

SEQ ID NO: 285611 - RNA, 22 nt, Homo sapiens
gacuugaagaaucuaagggagg

SEQ ID NO: 285612 - RNA, 18 nt, Homo sapiens
gacuuggaguuuacagug

SEQ ID NO: 285613 - RNA, 22 nt, Homo sapiens
gagaacagagauaauuuuacuu

SEQ ID NO: 285614 - RNA, 22 nt, Homo sapiens
gagaaccauuuggagaaaaagu

SEQ ID NO: 285615 - RNA, 22 nt, Homo sapiens
gagacggagucacgcccuguca

SEQ ID NO: 285616 - RNA, 22 nt, Homo sapiens
gagacugagucuugcuuuguca

SEQ ID NO: 285617 - RNA, 22 nt, Homo sapiens
gagagaguacuugauauaauuu

SEQ ID NO: 285618 - RNA, 22 nt, Homo sapiens
gagagcaugugcuggcaucagu

SEQ ID NO: 285619 - RNA, 22 nt, Homo sapiens
gagagucacagugaauguggca

SEQ ID NO: 285620 - RNA, 22 nt, Homo sapiens
gagauacacccagugcagaggc

SEQ ID NO: 285621 - RNA, 22 nt, Homo sapiens
gagauauguuggcagcugguau

SEQ ID NO: 285622 - RNA, 22 nt, Homo sapiens
gagauauucugguuuacuaaau

SEQ ID NO: 285623 - RNA, 22 nt, Homo sapiens
gagaucauucugauccagaguc

SEQ ID NO: 285624 - RNA, 22 nt, Homo sapiens
gagaugcaccuugucacguuuc

SEQ ID NO: 285625 - RNA, 22 nt, Homo sapiens
gagaugucuauuucagagaugu

SEQ ID NO: 285626 - RNA, 22 nt, Homo sapiens
gagaugugguucaaggguguuu

SEQ ID NO: 285627 - RNA, 22 nt, Homo sapiens
gagauuauugucucccucacca

SEQ ID NO: 285628 - RNA, 22 nt, Homo sapiens
gagauucuucaauauuuauucu

SEQ ID NO: 285629 - RNA, 22 nt, Homo sapiens
gagcaaaaguauguauugguua

SEQ ID NO: 285630 - RNA, 22 nt, Homo sapiens
gagcaaugagcugccugcugag

SEQ ID NO: 285631 - RNA, 22 nt, Homo sapiens
gagcagacaugaggaccgcugg

SEQ ID NO: 285632 - RNA, 22 nt, Homo sapiens
gagcccauuucacuuguccagc

SEQ ID NO: 285633 - RNA, 22 nt, Homo sapiens
gagcuagugcuuaugcaccacu

SEQ ID NO: 285634 - RNA, 22 nt, Homo sapiens
gagcuaguguaauauuuugggg

SEQ ID NO: 285635 - RNA, 22 nt, Homo sapiens
gagcucguuuuugcugacucuu

SEQ ID NO: 285636 - RNA, 22 nt, Homo sapiens
gagcugaauugcugccauuugc

SEQ ID NO: 285637 - RNA, 22 nt, Homo sapiens
gagcugaucuuuauguaaauuc

SEQ ID NO: 285638 - RNA, 20 nt, Homo sapiens
gagcugguguacugccgggc

SEQ ID NO: 285639 - RNA, 22 nt, Homo sapiens
gaggacauuaugcuaaguggaa

SEQ ID NO: 285640 - RNA, 22 nt, Homo sapiens
gaggaguauuuugucgaauguc

SEQ ID NO: 285641 - RNA, 22 nt, Homo sapiens
gaggcauugaaauauugcuuau

SEQ ID NO: 285642 - RNA, 22 nt, Homo sapiens
gagguaaguaagaauggcaagc

SEQ ID NO: 285643 - RNA, 22 nt, Homo sapiens
gagguagagacuauguauuaga

SEQ ID NO: 285644 - RNA, 22 nt, Homo sapiens
gagguaggaggauugcuuaagg

SEQ ID NO: 285645 - RNA, 22 nt, Homo sapiens
gagguagguacaauugccacca

SEQ ID NO: 285646 - RNA, 22 nt, Homo sapiens
gagguagguuugguuacaaaag

SEQ ID NO: 285647 - RNA, 22 nt, Homo sapiens
gagguaguuaaugcauucacua

SEQ ID NO: 285648 - RNA, 22 nt, Homo sapiens
gaggucauguggcaggcagcca

SEQ ID NO: 285649 - RNA, 22 nt, Homo sapiens
gagguggugguggaggcauagc

SEQ ID NO: 285650 - RNA, 22 nt, Homo sapiens
gagguguagagauauaccugaa

SEQ ID NO: 285651 - RNA, 22 nt, Homo sapiens
gagguugggaugagggauacag

SEQ ID NO: 285652 - RNA, 22 nt, Homo sapiens
gagucagugucuugcucuguca

SEQ ID NO: 285653 - RNA, 22 nt, Homo sapiens
gagugcaaagguccugaggugg

SEQ ID NO: 285654 - RNA, 21 nt, Homo sapiens
gagugcaaauaaagagagggc

SEQ ID NO: 285655 - RNA, 22 nt, Homo sapiens
gagugcaauggcaugaucuggg

SEQ ID NO: 285656 - RNA, 22 nt, Homo sapiens
gagugcaauggugcuaucucgg

SEQ ID NO: 285657 - RNA, 22 nt, Homo sapiens
gagugcugagcccacuuccuug

SEQ ID NO: 285658 - RNA, 22 nt, Homo sapiens
gaguucaaaucucagcucuguu

SEQ ID NO: 285659 - RNA, 22 nt, Homo sapiens
gaguuccuuugagccugagagg

SEQ ID NO: 285660 - RNA, 22 nt, Homo sapiens
gauaacagauaaugucaguuau

SEQ ID NO: 285661 - RNA, 22 nt, Homo sapiens
gauauguucugagaaaugcauu

SEQ ID NO: 285662 - RNA, 22 nt, Homo sapiens
gaucacaguuccucacgggcau

SEQ ID NO: 285663 - RNA, 22 nt, Homo sapiens
gaucagagugaaccuuguuaug

SEQ ID NO: 285664 - RNA, 22 nt, Homo sapiens
gaucaguuucuggagauacgua

SEQ ID NO: 285665 - RNA, 22 nt, Homo sapiens
gaucugucuuuccuuauagucu

SEQ ID NO: 285666 - RNA, 22 nt, Homo sapiens
gaucugugugauuggaugcauu

SEQ ID NO: 285667 - RNA, 22 nt, Homo sapiens
gaucuguuuuccuauuguuugu

SEQ ID NO: 285668 - RNA, 22 nt, Homo sapiens
gaugaaacaucuuuggaaacug

SEQ ID NO: 285669 - RNA, 22 nt, Homo sapiens
gaugcaguaagaaugcauagcg

SEQ ID NO: 285670 - RNA, 22 nt, Homo sapiens
gauggcacuguagcaacacaaa

SEQ ID NO: 285671 - RNA, 22 nt, Homo sapiens
gauggcacuuaagagcaagagc

SEQ ID NO: 285672 - RNA, 22 nt, Homo sapiens
gauggcauuucuggaucugaca

SEQ ID NO: 285673 - RNA, 22 nt, Homo sapiens
gauuagcacuucaguuacagua

SEQ ID NO: 285674 - RNA, 22 nt, Homo sapiens
gauuagucccauuuuacaggug

SEQ ID NO: 285675 - RNA, 22 nt, Homo sapiens
gauuccauugcgaauuuucaga

SEQ ID NO: 285676 - RNA, 22 nt, Homo sapiens
gauuugguguucuggcucaaga

SEQ ID NO: 285677 - RNA, 22 nt, Homo sapiens
gauuuuccaguggcccugauca

SEQ ID NO: 285678 - RNA, 22 nt, Homo sapiens
aauaaaguaggaggugaggaaa

SEQ ID NO: 285679 - RNA, 21 nt, Homo sapiens
aauacucuagguuaagagagc

SEQ ID NO: 285680 - RNA, 22 nt, Homo sapiens
aauagcauugaaucuaccaauu

SEQ ID NO: 285681 - RNA, 22 nt, Homo sapiens
aauauagcuauguacaugucca

SEQ ID NO: 285682 - RNA, 22 nt, Homo sapiens
aauaucacaguggguguacacc

SEQ ID NO: 285683 - RNA, 23 nt, Homo sapiens
aauaucacaguggguguacaccc

SEQ ID NO: 285684 - RNA, 19 nt, Homo sapiens
aauauugacaguggugucu

SEQ ID NO: 285685 - RNA, 22 nt, Homo sapiens
aaucaacauuguuuuaagucaa

SEQ ID NO: 285686 - RNA, 22 nt, Homo sapiens
aaucacaguguucuugugaggg

SEQ ID NO: 285687 - RNA, 22 nt, Homo sapiens
aaucacauugaaucugcuaccu

SEQ ID NO: 285688 - RNA, 22 nt, Homo sapiens
aaucaccaugcacuacagccuu

SEQ ID NO: 285689 - RNA, 22 nt, Homo sapiens
aaugacuaagaugguacauuuu

SEQ ID NO: 285690 - RNA, 22 nt, Homo sapiens
aaugcaagauguuaauuauagg

SEQ ID NO: 285691 - RNA, 22 nt, Homo sapiens
aauggcaguagauggaugggua

SEQ ID NO: 285692 - RNA, 22 nt, Homo sapiens
aauggcucuuccuggaguugug

SEQ ID NO: 285693 - RNA, 22 nt, Homo sapiens
aauggcuuuuaauauccauaau

SEQ ID NO: 285694 - RNA, 22 nt, Homo sapiens
aaugucaucuucaguuguacag

SEQ ID NO: 285695 - RNA, 22 nt, Homo sapiens
aaugugcuuugaaaagagcuga

SEQ ID NO: 285696 - RNA, 22 nt, Homo sapiens
aauugcauugaauuuguagcuu

SEQ ID NO: 285697 - RNA, 22 nt, Homo sapiens
aauugcuucuguauuuuggaca

SEQ ID NO: 285698 - RNA, 22 nt, Homo sapiens
aauuggcagugcucuugccaca

SEQ ID NO: 285699 - RNA, 22 nt, Homo sapiens
aauuguacucccauaauucccu

SEQ ID NO: 285700 - RNA, 22 nt, Homo sapiens
acaaagcuagggaauccaucuu

SEQ ID NO: 285701 - RNA, 22 nt, Homo sapiens
acaaagugccuccuuuuagagu

SEQ ID NO: 285702 - RNA, 22 nt, Homo sapiens
acaacaguuuuaucaccccaga

SEQ ID NO: 285703 - RNA, 22 nt, Homo sapiens
acaagacuucuuguauucuagu

SEQ ID NO: 285704 - RNA, 23 nt, Homo sapiens
acacaguaaacuaaaagcuagcu

SEQ ID NO: 285705 - RNA, 22 nt, Homo sapiens
acacagucaaauccacuuggcu

SEQ ID NO: 285706 - RNA, 22 nt, Homo sapiens
acacagugucuguguauuuaaa

SEQ ID NO: 285707 - RNA, 22 nt, Homo sapiens
acacaguguuuauugugguuag

SEQ ID NO: 285708 - RNA, 22 nt, Homo sapiens
acaccaucuccuuauuucucuu

SEQ ID NO: 285709 - RNA, 22 nt, Homo sapiens
acacuggaguuaaaggugauuu

SEQ ID NO: 285710 - RNA, 22 nt, Homo sapiens
acacuguauccuucuguccuuu

SEQ ID NO: 285711 - RNA, 22 nt, Homo sapiens
acacugucaugucucacaggca

SEQ ID NO: 285712 - RNA, 20 nt, Homo sapiens
acacugugcuaaggauuuuc

SEQ ID NO: 285713 - RNA, 22 nt, Homo sapiens
acagagcaaugagcuacggucu

SEQ ID NO: 285714 - RNA, 19 nt, Homo sapiens
acagauagaauguucuaca

SEQ ID NO: 285715 - RNA, 20 nt, Homo sapiens
acagcacugguuucaagcaa

SEQ ID NO: 285716 - RNA, 20 nt, Homo sapiens
acagcauagccuuuuaaagc

SEQ ID NO: 285717 - RNA, 19 nt, Homo sapiens
acagcugguuuugguuucu

SEQ ID NO: 285718 - RNA, 22 nt, Homo sapiens
acaggagugggauuugaguccu

SEQ ID NO: 285719 - RNA, 22 nt, Homo sapiens
acaguaaugggccccuuuuccu

SEQ ID NO: 285720 - RNA, 22 nt, Homo sapiens
acaguacucugcucuuuugauu

SEQ ID NO: 285721 - RNA, 23 nt, Homo sapiens
acaguauguggauguggcuaagu

SEQ ID NO: 285722 - RNA, 20 nt, Homo sapiens
acaguauguuuggaugcaua

SEQ ID NO: 285723 - RNA, 22 nt, Homo sapiens
acagugacagaaagcugauuau

SEQ ID NO: 285724 - RNA, 18 nt, Homo sapiens
acagugcuggcaugagau

SEQ ID NO: 285725 - RNA, 18 nt, Homo sapiens
acagugcugucacugcuu

SEQ ID NO: 285726 - RNA, 22 nt, Homo sapiens
acagugcugucugcuuuggcua

SEQ ID NO: 285727 - RNA, 22 nt, Homo sapiens
acagugcuuucaauguucagua

SEQ ID NO: 285728 - RNA, 22 nt, Homo sapiens
acagugcuuuuguuccucuccu

SEQ ID NO: 285729 - RNA, 22 nt, Homo sapiens
acaguguacaauagccuuuuaa

SEQ ID NO: 285730 - RNA, 22 nt, Homo sapiens
acauagaguagcuaccuguaga

SEQ ID NO: 285731 - RNA, 22 nt, Homo sapiens
acauauaaggagacuagggcau

SEQ ID NO: 285732 - RNA, 22 nt, Homo sapiens
acaucaggcuugugaugauuac

SEQ ID NO: 285733 - RNA, 22 nt, Homo sapiens
acaucccaugccuggguacucc

SEQ ID NO: 285734 - RNA, 17 nt, Homo sapiens
aaggugcuucgaccucc

SEQ ID NO: 285735 - RNA, 21 nt, Homo sapiens
aaggugguggugauugagaug

SEQ ID NO: 285736 - RNA, 21 nt, Homo sapiens
aagguuuuuagugcuugacuu

SEQ ID NO: 285737 - RNA, 22 nt, Homo sapiens
aaguaaacauugagagacaaga

SEQ ID NO: 285738 - RNA, 22 nt, Homo sapiens
aaguaauggaguuauuuuauga

SEQ ID NO: 285739 - RNA, 22 nt, Homo sapiens
aagucaaggagagaagcuucag

SEQ ID NO: 285740 - RNA, 23 nt, Homo sapiens
aagucauggaaucaaaugaggug

SEQ ID NO: 285741 - RNA, 22 nt, Homo sapiens
aagugacauugugcccauuuga

SEQ ID NO: 285742 - RNA, 22 nt, Homo sapiens
aagugcaaauucccaggcucug

SEQ ID NO: 285743 - RNA, 22 nt, Homo sapiens
aagugccauguggaugggcccu

SEQ ID NO: 285744 - RNA, 22 nt, Homo sapiens
aagugcuggccuacucaaucga

SEQ ID NO: 285745 - RNA, 22 nt, Homo sapiens
aagugcuguaugggagccuagg

SEQ ID NO: 285746 - RNA, 22 nt, Homo sapiens
aagugcuguccuaccuuuggga

SEQ ID NO: 285747 - RNA, 22 nt, Homo sapiens
aagugcuucagaagacaauauu

SEQ ID NO: 285748 - RNA, 22 nt, Homo sapiens
aaguggcauugaggaaaaaaau

SEQ ID NO: 285749 - RNA, 22 nt, Homo sapiens
aagugguucuaugaguuugcaa

SEQ ID NO: 285750 - RNA, 19 nt, Homo sapiens
aagugguuuaaacuuguau

SEQ ID NO: 285751 - RNA, 22 nt, Homo sapiens
aagugguuuuaaucuggugagu

SEQ ID NO: 285752 - RNA, 22 nt, Homo sapiens
aaaacgcauccucacaggucug

SEQ ID NO: 285753 - RNA, 22 nt, Homo sapiens
aaaagucuguagugaaagguga

SEQ ID NO: 285754 - RNA, 22 nt, Homo sapiens
aaacagucuucuccugagggac

SEQ ID NO: 285755 - RNA, 22 nt, Homo sapiens
aaacugcuuuccaugguggcug

SEQ ID NO: 285756 - RNA, 22 nt, Homo sapiens
aaagaagucagccuguccuuug

SEQ ID NO: 285757 - RNA, 23 nt, Homo sapiens
aaagacuagucaggugcaguggu

SEQ ID NO: 285758 - RNA, 22 nt, Homo sapiens
aaaggcacacacuccuuguuau

SEQ ID NO: 285759 - RNA, 22 nt, Homo sapiens
aaaggcuucggaucagaaggua

SEQ ID NO: 285760 - RNA, 22 nt, Homo sapiens
aaaguaguagcaguuucugcca

SEQ ID NO: 285761 - RNA, 22 nt, Homo sapiens
aaagugauugcgguuuuugcca

SEQ ID NO: 285762 - RNA, 22 nt, Homo sapiens
aaagugcaguauuugggcagaa

SEQ ID NO: 285763 - RNA, 22 nt, Homo sapiens
aaagugcuaggauuaccugggg

SEQ ID NO: 285764 - RNA, 22 nt, Homo sapiens
aaagugcugagacagacuggga

SEQ ID NO: 285765 - RNA, 22 nt, Homo sapiens
aaagugcugggaucacacugaa

SEQ ID NO: 285766 - RNA, 22 nt, Homo sapiens
aaagugcugggauuggccgggc

SEQ ID NO: 285767 - RNA, 22 nt, Homo sapiens
aaaguggacuaagugaauauga

SEQ ID NO: 285768 - RNA, 22 nt, Homo sapiens
aaaugacuuuuuaugcagagua

SEQ ID NO: 285769 - RNA, 22 nt, Homo sapiens
aaaugcaccacucuggugcagg

SEQ ID NO: 285770 - RNA, 22 nt, Homo sapiens
aaaugcacgcuacccagcuaga

SEQ ID NO: 285771 - RNA, 22 nt, Homo sapiens
aaaugcucuuuaugaaguugga

SEQ ID NO: 285772 - RNA, 22 nt, Homo sapiens
aaaugcugucugugagccucau

SEQ ID NO: 285773 - RNA, 22 nt, Homo sapiens
aaaugcuuucuuggaccauuug

SEQ ID NO: 285774 - RNA, 22 nt, Homo sapiens
aaauggcacaguaagggcauuu

SEQ ID NO: 285775 - RNA, 22 nt, Homo sapiens
aaauggcaccggcucuucccuc

SEQ ID NO: 285776 - RNA, 22 nt, Homo sapiens
aaauucaucaaaugguuuguau

SEQ ID NO: 285777 - RNA, 22 nt, Homo sapiens
aaauucauuucagcucugggua

SEQ ID NO: 285778 - RNA, 22 nt, Homo sapiens
aaauugcaaugcgaggcagagg

SEQ ID NO: 285779 - RNA, 22 nt, Homo sapiens
aacagucaauugcugaugaccu

SEQ ID NO: 285780 - RNA, 22 nt, Homo sapiens
aacagugccugucauuuaguag

SEQ ID NO: 285781 - RNA, 22 nt, Homo sapiens
aacagugcuucauucacacauu

SEQ ID NO: 285782 - RNA, 22 nt, Homo sapiens
aacaguguuuuggguuuucugg

SEQ ID NO: 285783 - RNA, 22 nt, Homo sapiens
aaccuacauucuuaacuguugc

SEQ ID NO: 285784 - RNA, 22 nt, Homo sapiens
aaccuauaguauugaaaucaag

SEQ ID NO: 285785 - RNA, 22 nt, Homo sapiens
aaccugaagaaaauauuugcug

SEQ ID NO: 285786 - RNA, 22 nt, Homo sapiens
aacuacaucucuuugaggcagg

SEQ ID NO: 285787 - RNA, 22 nt, Homo sapiens
aacuggcacuacaucaagagcu

SEQ ID NO: 285788 - RNA, 22 nt, Homo sapiens
aacuggcauaugaacuuguucu

SEQ ID NO: 285789 - RNA, 22 nt, Homo sapiens
aacuggccuccuugggaaauua

SEQ ID NO: 285790 - RNA, 22 nt, Homo sapiens
aacugguauugaauuuaggaag

SEQ ID NO: 285791 - RNA, 22 nt, Homo sapiens
aagagagccagcugguauauuu

SEQ ID NO: 285792 - RNA, 22 nt, Homo sapiens
aagagcauuggauggggagauu

SEQ ID NO: 285793 - RNA, 22 nt, Homo sapiens
aagagcgcugauaacauguuug

SEQ ID NO: 285794 - RNA, 20 nt, Homo sapiens
aagagcucaccagaauaucu

SEQ ID NO: 285795 - RNA, 22 nt, Homo sapiens
aagagcucauccauaguuguca

SEQ ID NO: 285796 - RNA, 22 nt, Homo sapiens
acuccauuuggacucugggagg

SEQ ID NO: 285797 - RNA, 22 nt, Homo sapiens
acucugucuaguuguaaaauuu

SEQ ID NO: 285798 - RNA, 22 nt, Homo sapiens
acugaauguaaacacggagugu

SEQ ID NO: 285799 - RNA, 22 nt, Homo sapiens
acugagacugagaauguuucuu

SEQ ID NO: 285800 - RNA, 22 nt, Homo sapiens
acugagaucuuuaaauaaauaa

SEQ ID NO: 285801 - RNA, 18 nt, Homo sapiens
acugcacuccaccuuggg

SEQ ID NO: 285802 - RNA, 22 nt, Homo sapiens
acugcacuccaccuugggcaac

SEQ ID NO: 285803 - RNA, 22 nt, Homo sapiens
acugcacuccagccucaugaca

SEQ ID NO: 285804 - RNA, 22 nt, Homo sapiens
acugcacuccagccucggcaau

SEQ ID NO: 285805 - RNA, 22 nt, Homo sapiens
acugcacuccagccucggugac

SEQ ID NO: 285806 - RNA, 22 nt, Homo sapiens
acugcacuccagccuucggaca

SEQ ID NO: 285807 - RNA, 22 nt, Homo sapiens
acugcacuccagccuugcgaca

SEQ ID NO: 285808 - RNA, 22 nt, Homo sapiens
acugcacuccagccuugugaca

SEQ ID NO: 285809 - RNA, 22 nt, Homo sapiens
acugcacuccagcuugggugac

SEQ ID NO: 285810 - RNA, 22 nt, Homo sapiens
acugcacucccgcccgggugac

SEQ ID NO: 285811 - RNA, 22 nt, Homo sapiens
acugcacugucaaccuccuggg

SEQ ID NO: 285812 - RNA, 22 nt, Homo sapiens
acugcacuuauccuccaauguu

SEQ ID NO: 285813 - RNA, 22 nt, Homo sapiens
acugcacuucagccuuggggac

SEQ ID NO: 285814 - RNA, 22 nt, Homo sapiens
acuggcuguuaggaauuaccuc

SEQ ID NO: 285815 - RNA, 22 nt, Homo sapiens
acuggcuuauuucacuuagcau

SEQ ID NO: 285816 - RNA, 22 nt, Homo sapiens
acuggcuuuugagaaaaacacu

SEQ ID NO: 285817 - RNA, 22 nt, Homo sapiens
acugggauauuauugguaauau

SEQ ID NO: 285818 - RNA, 20 nt, Homo sapiens
acugggcuaccgaaguaagg

SEQ ID NO: 285819 - RNA, 22 nt, Homo sapiens
acuggguuaauuugaagguuga

SEQ ID NO: 285820 - RNA, 22 nt, Homo sapiens
acuguacucuacccugggcaac

SEQ ID NO: 285821 - RNA, 22 nt, Homo sapiens
acuguacugucuggggcagucu

SEQ ID NO: 285822 - RNA, 22 nt, Homo sapiens
acuguauagauggaguugauuu

SEQ ID NO: 285823 - RNA, 22 nt, Homo sapiens
acuuugguuaucauacuuucag

SEQ ID NO: 285824 - RNA, 22 nt, Homo sapiens
acuuuguguuacccagcaagga

SEQ ID NO: 285825 - RNA, 22 nt, Homo sapiens
agaaacacagguggaauugcuu

SEQ ID NO: 285826 - RNA, 22 nt, Homo sapiens
agaacacugaguucagggucag

SEQ ID NO: 285827 - RNA, 22 nt, Homo sapiens
agaauguaacucuaugaaggca

SEQ ID NO: 285828 - RNA, 22 nt, Homo sapiens
agaaugugaacaucuugaaagu

SEQ ID NO: 285829 - RNA, 22 nt, Homo sapiens
agaaugugaccuuauuuggaga

SEQ ID NO: 285830 - RNA, 20 nt, Homo sapiens
agacaguguggagauuccuu

SEQ ID NO: 285831 - RNA, 22 nt, Homo sapiens
agacccuguauguguuuaguuu

SEQ ID NO: 285832 - RNA, 22 nt, Homo sapiens
agagagcuuuaacuacccauuu

SEQ ID NO: 285833 - RNA, 22 nt, Homo sapiens
agagauaaagauuuuaauuuug

SEQ ID NO: 285834 - RNA, 20 nt, Homo sapiens
agagaucaguaauucaucaa

SEQ ID NO: 285835 - RNA, 22 nt, Homo sapiens
agagauuauccuggcuucucug

SEQ ID NO: 285836 - RNA, 20 nt, Homo sapiens
agagcaaagccgcaccccua

SEQ ID NO: 285837 - RNA, 18 nt, Homo sapiens
agagcacugaguuuuaga

SEQ ID NO: 285838 - RNA, 22 nt, Homo sapiens
agagccacacucuccuaacuca

SEQ ID NO: 285839 - RNA, 22 nt, Homo sapiens
agagcuaguauuuacggagcau

SEQ ID NO: 285840 - RNA, 22 nt, Homo sapiens
agagguaugccugggcuggagc

SEQ ID NO: 285841 - RNA, 22 nt, Homo sapiens
agaggucuuaucaaacaugcuu

SEQ ID NO: 285842 - RNA, 22 nt, Homo sapiens
agaguaguuucuauauucuuca

SEQ ID NO: 285843 - RNA, 22 nt, Homo sapiens
agagugaagcuuuuuauauucu

SEQ ID NO: 285844 - RNA, 22 nt, Homo sapiens
agagugcaaagguuggggcugg

SEQ ID NO: 285845 - RNA, 23 nt, Homo sapiens
agagugcaauggugccaucucgg

SEQ ID NO: 285846 - RNA, 22 nt, Homo sapiens
agauacauuggauaaugguggg

SEQ ID NO: 285847 - RNA, 22 nt, Homo sapiens
agaugccuaugaagagaaauua

SEQ ID NO: 285848 - RNA, 22 nt, Homo sapiens
agauggauuuuguagccccagc

SEQ ID NO: 285849 - RNA, 22 nt, Homo sapiens
agauggucuucauaaguuuuaa

SEQ ID NO: 285850 - RNA, 22 nt, Homo sapiens
agaugguguuggcugaguguau

SEQ ID NO: 285851 - RNA, 22 nt, Homo sapiens
agcaaaucuaugaauguauauu

SEQ ID NO: 285852 - RNA, 23 nt, Homo sapiens
agcaaaugcucuagcacuccaac

SEQ ID NO: 285853 - RNA, 22 nt, Homo sapiens
agcaaccagaggagaugaggcu

SEQ ID NO: 285854 - RNA, 22 nt, Homo sapiens
agcaagaugaaguugagcuagg

SEQ ID NO: 285855 - RNA, 22 nt, Homo sapiens
ccugugguuaaccagcuagaug

SEQ ID NO: 285856 - RNA, 22 nt, Homo sapiens
ccuguguuaugguuucuaaugu

SEQ ID NO: 285857 - RNA, 22 nt, Homo sapiens
ccuucauccuccagcaggcuag

SEQ ID NO: 285858 - RNA, 22 nt, Homo sapiens
ccuucauugcaucuuuaagaga

SEQ ID NO: 285859 - RNA, 22 nt, Homo sapiens
ccuugguaauguguuuuauucu

SEQ ID NO: 285860 - RNA, 22 nt, Homo sapiens
ccuugucacugaguggaaugaa

SEQ ID NO: 285861 - RNA, 22 nt, Homo sapiens
cgacuggccuagacuaguguuu

SEQ ID NO: 285862 - RNA, 22 nt, Homo sapiens
cggucacagugauucaaggguc

SEQ ID NO: 285863 - RNA, 16 nt, Homo sapiens
cuaaaaugucuacuug

SEQ ID NO: 285864 - RNA, 22 nt, Homo sapiens
cuaaaugcacugucaaaggaag

SEQ ID NO: 285865 - RNA, 22 nt, Homo sapiens
cuaagauugucuuaguguguug

SEQ ID NO: 285866 - RNA, 22 nt, Homo sapiens
cuaagugaguauaauuuuaaga

SEQ ID NO: 285867 - RNA, 22 nt, Homo sapiens
cuaaucuagccuuauaaguauu

SEQ ID NO: 285868 - RNA, 22 nt, Homo sapiens
cuagauuauccaacuuauuagc

SEQ ID NO: 285869 - RNA, 22 nt, Homo sapiens
cuagcuuuugauguaaagugag

SEQ ID NO: 285870 - RNA, 22 nt, Homo sapiens
cuaggcacgccugggucuccag

SEQ ID NO: 285871 - RNA, 22 nt, Homo sapiens
cuaggcacugauaguuguauuu

SEQ ID NO: 285872 - RNA, 18 nt, Homo sapiens
cuaguguuucuugaauca

SEQ ID NO: 285873 - RNA, 22 nt, Homo sapiens
cuauauacugccugcugauuag

SEQ ID NO: 285874 - RNA, 22 nt, Homo sapiens
cuaugcuucuuaaauuaguuau

SEQ ID NO: 285875 - RNA, 22 nt, Homo sapiens
cucaaagugcugggauuggcca

SEQ ID NO: 285876 - RNA, 22 nt, Homo sapiens
cucaaaguguggucuguggguu

SEQ ID NO: 285877 - RNA, 22 nt, Homo sapiens
cucaauuuggaauugucaguaa

SEQ ID NO: 285878 - RNA, 22 nt, Homo sapiens
cucacaugcucaccugguguuc

SEQ ID NO: 285879 - RNA, 22 nt, Homo sapiens
cucacggcccugcgcacuggca

SEQ ID NO: 285880 - RNA, 22 nt, Homo sapiens
cucacugugguguccuuaggua

SEQ ID NO: 285881 - RNA, 22 nt, Homo sapiens
cucagaguacuuuucccacuuc

SEQ ID NO: 285882 - RNA, 22 nt, Homo sapiens
cucagcaguggauuuaccacca

SEQ ID NO: 285883 - RNA, 22 nt, Homo sapiens
cucaggcacucugauuccagug

SEQ ID NO: 285884 - RNA, 22 nt, Homo sapiens
cucagggugguggacucuaaua

SEQ ID NO: 285885 - RNA, 22 nt, Homo sapiens
cucaguacuugcacagaagaac

SEQ ID NO: 285886 - RNA, 22 nt, Homo sapiens
cucaguagaaaauacauggacu

SEQ ID NO: 285887 - RNA, 20 nt, Homo sapiens
cucagugcacccccauaaaa

SEQ ID NO: 285888 - RNA, 22 nt, Homo sapiens
cucauugcaaucuccaccuccc

SEQ ID NO: 285889 - RNA, 22 nt, Homo sapiens
cucauugcaaucucugccuccc

SEQ ID NO: 285890 - RNA, 22 nt, Homo sapiens
cuccagugcaaagucaugauca

SEQ ID NO: 285891 - RNA, 22 nt, Homo sapiens
cuccauguggcuaacuuuuaaa

SEQ ID NO: 285892 - RNA, 22 nt, Homo sapiens
cuccauuuggaacagauguccu

SEQ ID NO: 285893 - RNA, 22 nt, Homo sapiens
cucccagugacccaggaacagg

SEQ ID NO: 285894 - RNA, 22 nt, Homo sapiens
cucccauugcaaacaacagaag

SEQ ID NO: 285895 - RNA, 22 nt, Homo sapiens
cuccccuuuaguuucuuaauaa

SEQ ID NO: 285896 - RNA, 23 nt, Homo sapiens
cucccugaacaugacacaccaga

SEQ ID NO: 285897 - RNA, 22 nt, Homo sapiens
cucccuuugcugaauguuuuuc

SEQ ID NO: 285898 - RNA, 17 nt, Homo sapiens
cucucugguuuaaagca

SEQ ID NO: 285899 - RNA, 22 nt, Homo sapiens
cucucuguuugucuguuauugg

SEQ ID NO: 285900 - RNA, 22 nt, Homo sapiens
cucugauggagauauacaagga

SEQ ID NO: 285901 - RNA, 22 nt, Homo sapiens
cucugguggaagcagggggcaa

SEQ ID NO: 285902 - RNA, 22 nt, Homo sapiens
cucugguucugcagugcacccu

SEQ ID NO: 285903 - RNA, 22 nt, Homo sapiens
cucugguuucgcaggaaauaga

SEQ ID NO: 285904 - RNA, 22 nt, Homo sapiens
cucugguuuuucuuccauuaag

SEQ ID NO: 285905 - RNA, 22 nt, Homo sapiens
cucuuugaggugagcugcccau

SEQ ID NO: 285906 - RNA, 22 nt, Homo sapiens
cugaaagagcauuugaaugggu

SEQ ID NO: 285907 - RNA, 22 nt, Homo sapiens
cugacagaugacugccacugua

SEQ ID NO: 285908 - RNA, 22 nt, Homo sapiens
cugaccucugucaaagacaccc

SEQ ID NO: 285909 - RNA, 22 nt, Homo sapiens
cugagaguugaugaaauauggu

SEQ ID NO: 285910 - RNA, 22 nt, Homo sapiens
cugagaucguggggcugcuguc

SEQ ID NO: 285911 - RNA, 22 nt, Homo sapiens
aagagcucucuguagcauguga

SEQ ID NO: 285912 - RNA, 22 nt, Homo sapiens
aagaugauguucuuuuucuuag

SEQ ID NO: 285913 - RNA, 20 nt, Homo sapiens
aagcaagcauuugcaaucau

SEQ ID NO: 285914 - RNA, 22 nt, Homo sapiens
aagcaucacauaauggaucaug

SEQ ID NO: 285915 - RNA, 22 nt, Homo sapiens
aagcuacauuuuauuuauguca

SEQ ID NO: 285916 - RNA, 22 nt, Homo sapiens
aagcucuuguugaaucuuguca

SEQ ID NO: 285917 - RNA, 22 nt, Homo sapiens
aagcugccaggcaugguggcug

SEQ ID NO: 285918 - RNA, 22 nt, Homo sapiens
aagcuggcauucauucguucuu

SEQ ID NO: 285919 - RNA, 22 nt, Homo sapiens
aagcuggcuuucauugagugcu

SEQ ID NO: 285920 - RNA, 22 nt, Homo sapiens
aagcugguuuuauaucugugag

SEQ ID NO: 285921 - RNA, 22 nt, Homo sapiens
aaggaacuggaauauuuugaac

SEQ ID NO: 285922 - RNA, 22 nt, Homo sapiens
aaggagcuaagagaucauacau

SEQ ID NO: 285923 - RNA, 22 nt, Homo sapiens
aaggaguagaggaauagcaaug

SEQ ID NO: 285924 - RNA, 22 nt, Homo sapiens
aaggaguaucuguuuucucacc

SEQ ID NO: 285925 - RNA, 22 nt, Homo sapiens
aaggagugugauucuucaguuu

SEQ ID NO: 285926 - RNA, 22 nt, Homo sapiens
aaggcaagagaaaauuucgagu

SEQ ID NO: 285927 - RNA, 22 nt, Homo sapiens
aaggcacugaacuuaaauucug

SEQ ID NO: 285928 - RNA, 22 nt, Homo sapiens
ucuaugguuuauuuccaagugu

SEQ ID NO: 285929 - RNA, 22 nt, Homo sapiens
ucuauuugggguaccuguggua

SEQ ID NO: 285930 - RNA, 22 nt, Homo sapiens
ucucacagaguugaauguuucu

SEQ ID NO: 285931 - RNA, 22 nt, Homo sapiens
ucucagugaauguggaaaaagc

SEQ ID NO: 285932 - RNA, 22 nt, Homo sapiens
ucucaguggcacccccaacacc

SEQ ID NO: 285933 - RNA, 22 nt, Homo sapiens
ucucagugugguaaaaguuuuu

SEQ ID NO: 285934 - RNA, 22 nt, Homo sapiens
ucucaugaagauagagaauaga

SEQ ID NO: 285935 - RNA, 22 nt, Homo sapiens
ucucauggagguagagaguaaa

SEQ ID NO: 285936 - RNA, 22 nt, Homo sapiens
ucucauuggucugagucaccug

SEQ ID NO: 285937 - RNA, 22 nt, Homo sapiens
ucuccaguuuccuucgucuauc

SEQ ID NO: 285938 - RNA, 22 nt, Homo sapiens
ucuccauuuguaaggguuucuc

SEQ ID NO: 285939 - RNA, 17 nt, Homo sapiens
ucucccaucccuuucuc

SEQ ID NO: 285940 - RNA, 22 nt, Homo sapiens
ucuccggguggcggcgaaggga

SEQ ID NO: 285941 - RNA, 22 nt, Homo sapiens
ucucugauuaaacaagauagug

SEQ ID NO: 285942 - RNA, 22 nt, Homo sapiens
ucucuggauaucuacuuauguu

SEQ ID NO: 285943 - RNA, 22 nt, Homo sapiens
ucucuuggcggaaguugcagug

SEQ ID NO: 285944 - RNA, 22 nt, Homo sapiens
ucugacagugagagaaaucuga

SEQ ID NO: 285945 - RNA, 22 nt, Homo sapiens
ucugagcaauagauguggauau

SEQ ID NO: 285946 - RNA, 22 nt, Homo sapiens
ucugccuacugguuggaggaac

SEQ ID NO: 285947 - RNA, 22 nt, Homo sapiens
ucuggcaagagccgagggcagu

SEQ ID NO: 285948 - RNA, 22 nt, Homo sapiens
ucuggcaagauauccauugcuu

SEQ ID NO: 285949 - RNA, 22 nt, Homo sapiens
ucuggcacugaugugggaugcu

SEQ ID NO: 285950 - RNA, 20 nt, Homo sapiens
ucuggccccuccaaaucuca

SEQ ID NO: 285951 - RNA, 22 nt, Homo sapiens
ucuggccccucccaaaucucau

SEQ ID NO: 285952 - RNA, 20 nt, Homo sapiens
ucuggccccucuaaaucuca

SEQ ID NO: 285953 - RNA, 22 nt, Homo sapiens
ucugguguuauucauguaguuu

SEQ ID NO: 285954 - RNA, 22 nt, Homo sapiens
ucuguacuuccguaccuaaagu

SEQ ID NO: 285955 - RNA, 22 nt, Homo sapiens
ucuguaguuaacagcuucagcu

SEQ ID NO: 285956 - RNA, 22 nt, Homo sapiens
ucugucaaaucuuauguuguag

SEQ ID NO: 285957 - RNA, 19 nt, Homo sapiens
ucugucacuggggguauuc

SEQ ID NO: 285958 - RNA, 22 nt, Homo sapiens
ucugucuuguccucacccuaga

SEQ ID NO: 285959 - RNA, 22 nt, Homo sapiens
ucugucuuugucaggaccagag

SEQ ID NO: 285960 - RNA, 22 nt, Homo sapiens
ucugugcauuacacuuuucuca

SEQ ID NO: 285961 - RNA, 22 nt, Homo sapiens
ucugugcauuguaacaacuaaa

SEQ ID NO: 285962 - RNA, 22 nt, Homo sapiens
ucugugcggucuguguuaugaa

SEQ ID NO: 285963 - RNA, 22 nt, Homo sapiens
ucugugcugagaguugaaaguu

SEQ ID NO: 285964 - RNA, 22 nt, Homo sapiens
ucuguguuugguuggcaauuuc

SEQ ID NO: 285965 - RNA, 22 nt, Homo sapiens
ucuguuguuguuuuaagagaca

SEQ ID NO: 285966 - RNA, 22 nt, Homo sapiens
ucuuagugcggcugcugcagcc

SEQ ID NO: 285967 - RNA, 22 nt, Homo sapiens
ucuuaguuuagauuagcaauuc

SEQ ID NO: 285968 - RNA, 22 nt, Homo sapiens
ucuucaugcuugaaauaauagc

SEQ ID NO: 285969 - RNA, 17 nt, Homo sapiens
ucuucuguuacuguggc

SEQ ID NO: 285970 - RNA, 22 nt, Homo sapiens
ucuugcaguucccaaauucaca

SEQ ID NO: 285971 - RNA, 22 nt, Homo sapiens
ucuugccacuucauccccuuuc

SEQ ID NO: 285972 - RNA, 20 nt, Homo sapiens
ucuugggaauguagccuagg

SEQ ID NO: 285973 - RNA, 22 nt, Homo sapiens
ucuugggugaguuugugaauaa

SEQ ID NO: 285974 - RNA, 21 nt, Homo sapiens
ucuuggguugaauucucccag

SEQ ID NO: 285975 - RNA, 22 nt, Homo sapiens
ucuuggguuuguccuucuccua

SEQ ID NO: 285976 - RNA, 22 nt, Homo sapiens
ucuugucacugcauccccagcu

SEQ ID NO: 285977 - RNA, 21 nt, Homo sapiens
uugagacggagucucacucug

SEQ ID NO: 285978 - RNA, 22 nt, Homo sapiens
uugagagaaaaggccaugccuu

SEQ ID NO: 285979 - RNA, 22 nt, Homo sapiens
uugagauaggaacucacuaugc

SEQ ID NO: 285980 - RNA, 22 nt, Homo sapiens
uugagaucuacuacuguaggag

SEQ ID NO: 285981 - RNA, 22 nt, Homo sapiens
uugagauggaaucucgcuuugu

SEQ ID NO: 285982 - RNA, 22 nt, Homo sapiens
uugagauggagucuugcucugu

SEQ ID NO: 285983 - RNA, 22 nt, Homo sapiens
uugagauggaguucauuuuugu

SEQ ID NO: 285984 - RNA, 22 nt, Homo sapiens
uugagauguaguuucacuccug

SEQ ID NO: 285985 - RNA, 22 nt, Homo sapiens
uugagauguggguuggugacuu

SEQ ID NO: 285986 - RNA, 22 nt, Homo sapiens
uugagcauugguauagguuuua

SEQ ID NO: 285987 - RNA, 22 nt, Homo sapiens
uugaggaagugguuccccagag

SEQ ID NO: 285988 - RNA, 22 nt, Homo sapiens
uugaggaggcagucuucccauu

SEQ ID NO: 285989 - RNA, 22 nt, Homo sapiens
uugaggcaaugaggagaagcug

SEQ ID NO: 285990 - RNA, 22 nt, Homo sapiens
uugagggagccuguuagucccg

SEQ ID NO: 285991 - RNA, 22 nt, Homo sapiens
uugagggaggcagggcuugucu

SEQ ID NO: 285992 - RNA, 22 nt, Homo sapiens
uugagggaggccucaguuuaca

SEQ ID NO: 285993 - RNA, 22 nt, Homo sapiens
uugaggucagagguucgagacc

SEQ ID NO: 285994 - RNA, 22 nt, Homo sapiens
uugagugaaggcuguguucuug

SEQ ID NO: 285995 - RNA, 22 nt, Homo sapiens
uugagugaaugaaugauuaaau

SEQ ID NO: 285996 - RNA, 22 nt, Homo sapiens
uugaguuuaucuaaagaccugg

SEQ ID NO: 285997 - RNA, 22 nt, Homo sapiens
uugauaguuuuaaaauuaaucu

SEQ ID NO: 285998 - RNA, 22 nt, Homo sapiens
uugauauauugcaugggcuacu

SEQ ID NO: 285999 - RNA, 22 nt, Homo sapiens
uugaucaucagcuuugucaucu

SEQ ID NO: 286000 - RNA, 22 nt, Homo sapiens
uugauguugaggacauaaaccu

SEQ ID NO: 286001 - RNA, 22 nt, Homo sapiens
uugcaagaaaucagagccuucc

SEQ ID NO: 286002 - RNA, 22 nt, Homo sapiens
uugcaagauguuaacauuggag

SEQ ID NO: 286003 - RNA, 20 nt, Homo sapiens
uugcacagagaaggaggcag

SEQ ID NO: 286004 - RNA, 22 nt, Homo sapiens
uugcacuccagcucgggugaca

SEQ ID NO: 286005 - RNA, 22 nt, Homo sapiens
uugcagcauucugguuccuggu

SEQ ID NO: 286006 - RNA, 22 nt, Homo sapiens
uugcauagugcugagguucggg

SEQ ID NO: 286007 - RNA, 19 nt, Homo sapiens
uugcauauguugaaccagc

SEQ ID NO: 286008 - RNA, 22 nt, Homo sapiens
uugcaugcuccuuaugagaauc

SEQ ID NO: 286009 - RNA, 22 nt, Homo sapiens
uugcaugguggaacuuggagcu

SEQ ID NO: 286010 - RNA, 22 nt, Homo sapiens
uugccauagugcugccagauau

SEQ ID NO: 286011 - RNA, 22 nt, Homo sapiens
uugcccuuuagguaacuauaua

SEQ ID NO: 286012 - RNA, 22 nt, Homo sapiens
uugccuaggcuggagugcagug

SEQ ID NO: 286013 - RNA, 22 nt, Homo sapiens
uugccuauucacucugaugaua

SEQ ID NO: 286014 - RNA, 22 nt, Homo sapiens
uugccugagaagccaagaauaa

SEQ ID NO: 286015 - RNA, 22 nt, Homo sapiens
uugcucaggcuggaguacaaug

SEQ ID NO: 286016 - RNA, 22 nt, Homo sapiens
uugcuccccaggaaaggaagca

SEQ ID NO: 286017 - RNA, 22 nt, Homo sapiens
uugcugguuuucauaugagcag

SEQ ID NO: 286018 - RNA, 22 nt, Homo sapiens
uuggaaaaauccaccuugaucu

SEQ ID NO: 286019 - RNA, 22 nt, Homo sapiens
uuggaauguacucuagccuaug

SEQ ID NO: 286020 - RNA, 22 nt, Homo sapiens
uuggacaagauugcagagaauu

SEQ ID NO: 286021 - RNA, 22 nt, Homo sapiens
uuggacagaugguuacauuuuu

SEQ ID NO: 286022 - RNA, 22 nt, Homo sapiens
uuggacucccuccccagcuuca

SEQ ID NO: 286023 - RNA, 22 nt, Homo sapiens
uuggacugagaguuccaccauu

SEQ ID NO: 286024 - RNA, 22 nt, Homo sapiens
uuggacugugagguuucguggg

SEQ ID NO: 286025 - RNA, 22 nt, Homo sapiens
uuggagagucacuaguuagugc

SEQ ID NO: 286026 - RNA, 22 nt, Homo sapiens
uuggagagugauauucagaugc

SEQ ID NO: 286027 - RNA, 22 nt, Homo sapiens
uuggagcacuggggcacugaca

SEQ ID NO: 286028 - RNA, 22 nt, Homo sapiens
uuggauggucuuuauauaguau

SEQ ID NO: 286029 - RNA, 22 nt, Homo sapiens
uuggauuauaaacugagauuug

SEQ ID NO: 286030 - RNA, 22 nt, Homo sapiens
uuggcaagcuguuaauuauaaa

SEQ ID NO: 286031 - RNA, 19 nt, Homo sapiens
uuggcagaguugcccccua

SEQ ID NO: 286032 - RNA, 22 nt, Homo sapiens
uuggcaguaucuacuacagcua

SEQ ID NO: 286033 - RNA, 22 nt, Homo sapiens
uuggcagucugaggcacagacu

SEQ ID NO: 286034 - RNA, 22 nt, Homo sapiens
uuggcauuuuuagucaugggaa

SEQ ID NO: 286035 - RNA, 22 nt, Homo sapiens
aauugcauaugcaguagaucua

SEQ ID NO: 286036 - RNA, 23 nt, Homo sapiens
aauugcuuuugaggacuuaguug

SEQ ID NO: 286037 - RNA, 22 nt, Homo sapiens
aauugugcuuguaggccaggca

SEQ ID NO: 286038 - RNA, 22 nt, Homo sapiens
acaagcacaaaugcauagaugg

SEQ ID NO: 286039 - RNA, 22 nt, Homo sapiens
acacauacacauaugguguaua

SEQ ID NO: 286040 - RNA, 22 nt, Homo sapiens
acacauuggcaauucuggagca

SEQ ID NO: 286041 - RNA, 22 nt, Homo sapiens
acacuauugagguuuguuugca

SEQ ID NO: 286042 - RNA, 20 nt, Homo sapiens
acacuggaguaucaaggccc

SEQ ID NO: 286043 - RNA, 20 nt, Homo sapiens
acacuggcuuugagauuuag

SEQ ID NO: 286044 - RNA, 22 nt, Homo sapiens
acagguacaagggauuaggaug

SEQ ID NO: 286045 - RNA, 22 nt, Homo sapiens
acagguauagaaagcuaaaggg

SEQ ID NO: 286046 - RNA, 20 nt, Homo sapiens
acaguagaagggauuucaaa

SEQ ID NO: 286047 - RNA, 21 nt, Homo sapiens
acaguaguaauaguguagcca

SEQ ID NO: 286048 - RNA, 22 nt, Homo sapiens
acaguauaaugcuguagggaga

SEQ ID NO: 286049 - RNA, 22 nt, Homo sapiens
acagucuggagaaugggugcuc

SEQ ID NO: 286050 - RNA, 22 nt, Homo sapiens
acagugcuuggcacacaguaau

SEQ ID NO: 286051 - RNA, 17 nt, Homo sapiens
acagugcuuugcuuucc

SEQ ID NO: 286052 - RNA, 22 nt, Homo sapiens
acagugucugacacguaggaag

SEQ ID NO: 286053 - RNA, 18 nt, Homo sapiens
acaguguguaaggguucu

SEQ ID NO: 286054 - RNA, 22 nt, Homo sapiens
acauaaagaagcaggacauugu

SEQ ID NO: 286055 - RNA, 22 nt, Homo sapiens
acauagaguaguggugaggaug

SEQ ID NO: 286056 - RNA, 22 nt, Homo sapiens
acauaguagacacugaaaauau

SEQ ID NO: 286057 - RNA, 21 nt, Homo sapiens
acaucagaguugugaagguag

SEQ ID NO: 286058 - RNA, 22 nt, Homo sapiens
acaucauugggggcuacaggug

SEQ ID NO: 286059 - RNA, 17 nt, Homo sapiens
acaugagacuggauucu

SEQ ID NO: 286060 - RNA, 22 nt, Homo sapiens
acaugagacuggguuuguaggg

SEQ ID NO: 286061 - RNA, 22 nt, Homo sapiens
acauucagcuguuguuucaaug

SEQ ID NO: 286062 - RNA, 22 nt, Homo sapiens
accaccacucccgcauucuaaa

SEQ ID NO: 286063 - RNA, 22 nt, Homo sapiens
accauugcacuccagccuuggc

SEQ ID NO: 286064 - RNA, 22 nt, Homo sapiens
accauugcacuucagccuaggc

SEQ ID NO: 286065 - RNA, 22 nt, Homo sapiens
acccagaauucagucuuaggcc

SEQ ID NO: 286066 - RNA, 22 nt, Homo sapiens
acccagaguuccuugucuuuca

SEQ ID NO: 286067 - RNA, 22 nt, Homo sapiens
acccaguagccagauguagcug

SEQ ID NO: 286068 - RNA, 22 nt, Homo sapiens
acccaguguucaacauucacau

SEQ ID NO: 286069 - RNA, 21 nt, Homo sapiens
acccccacaccuccuuaguuc

SEQ ID NO: 286070 - RNA, 23 nt, Homo sapiens
accccuacaggcuuguguccugc

SEQ ID NO: 286071 - RNA, 22 nt, Homo sapiens
acccucagaccaguuucccugg

SEQ ID NO: 286072 - RNA, 21 nt, Homo sapiens
acccucuaguuuucaacaggc

SEQ ID NO: 286073 - RNA, 22 nt, Homo sapiens
acccugucauccacauggugcu

SEQ ID NO: 286074 - RNA, 22 nt, Homo sapiens
accgggcugagcgcaggccccg

SEQ ID NO: 286075 - RNA, 22 nt, Homo sapiens
accucagcccggggaaguugag

SEQ ID NO: 286076 - RNA, 21 nt, Homo sapiens
accugauguuucaguuggagu

SEQ ID NO: 286077 - RNA, 23 nt, Homo sapiens
accugauguuucuguggggagcc

SEQ ID NO: 286078 - RNA, 22 nt, Homo sapiens
accuggguguauguucaguuug

SEQ ID NO: 286079 - RNA, 18 nt, Homo sapiens
accuucauuccuuugccu

SEQ ID NO: 286080 - RNA, 22 nt, Homo sapiens
accuucauuguugccaugucca

SEQ ID NO: 286081 - RNA, 22 nt, Homo sapiens
accuuguaucuguuaggauugc

SEQ ID NO: 286082 - RNA, 22 nt, Homo sapiens
acucacagcaaccuccgccucc

SEQ ID NO: 286083 - RNA, 22 nt, Homo sapiens
acucagagagaacugucauuug

SEQ ID NO: 286084 - RNA, 22 nt, Homo sapiens
acugcacuccagccuccugaca

SEQ ID NO: 286085 - RNA, 22 nt, Homo sapiens
acugcacuccagccuccugggu

SEQ ID NO: 286086 - RNA, 22 nt, Homo sapiens
acugcacuccagccucguggac

SEQ ID NO: 286087 - RNA, 22 nt, Homo sapiens
acugcacuccagccugaugaaa

SEQ ID NO: 286088 - RNA, 22 nt, Homo sapiens
acugcacuccagccugccgaca

SEQ ID NO: 286089 - RNA, 22 nt, Homo sapiens
acugcacuccagccuguugaca

SEQ ID NO: 286090 - RNA, 22 nt, Homo sapiens
acugcacuccagccuuggagac

SEQ ID NO: 286091 - RNA, 22 nt, Homo sapiens
acugcacuccagccuuugcgau

SEQ ID NO: 286092 - RNA, 22 nt, Homo sapiens
acugcacuccaucuuagguggc

SEQ ID NO: 286093 - RNA, 22 nt, Homo sapiens
acugcacucuagcuugggugac

SEQ ID NO: 286094 - RNA, 22 nt, Homo sapiens
acugcacuucaaccucauugac

SEQ ID NO: 286095 - RNA, 22 nt, Homo sapiens
acugcauuugucugucucaauu

SEQ ID NO: 286096 - RNA, 22 nt, Homo sapiens
acuguacuccagccugggcaac

SEQ ID NO: 286097 - RNA, 22 nt, Homo sapiens
acuuauuguggcugacccaaac

SEQ ID NO: 286098 - RNA, 22 nt, Homo sapiens
acuucauucucuggaucagaau

SEQ ID NO: 286099 - RNA, 21 nt, Homo sapiens
acuuucuguggcaguccauuc

SEQ ID NO: 286100 - RNA, 22 nt, Homo sapiens
acuuuuugcaaccauuuggacc

SEQ ID NO: 286101 - RNA, 20 nt, Homo sapiens
agaaccuguaguguagaggg

SEQ ID NO: 286102 - RNA, 22 nt, Homo sapiens
agaauaauguccccccaaggga

SEQ ID NO: 286103 - RNA, 22 nt, Homo sapiens
agaauacugucuauucauggua

SEQ ID NO: 286104 - RNA, 19 nt, Homo sapiens
agaaucuaaauuauuucug

SEQ ID NO: 286105 - RNA, 22 nt, Homo sapiens
agaaugucaguauuggcuaaaa

SEQ ID NO: 286106 - RNA, 22 nt, Homo sapiens
agacacuguugaaaaggcccca

SEQ ID NO: 286107 - RNA, 22 nt, Homo sapiens
agacagcugguagcacuuccug

SEQ ID NO: 286108 - RNA, 22 nt, Homo sapiens
gagugcaauggcaugaucuggg

SEQ ID NO: 286109 - RNA, 22 nt, Homo sapiens
gagugcaauggugcuaucucgg

SEQ ID NO: 286110 - RNA, 22 nt, Homo sapiens
gagugcugagcccacuuccuug

SEQ ID NO: 286111 - RNA, 21 nt, Homo sapiens
gaguggcuuuuguuucaccag

SEQ ID NO: 286112 - RNA, 22 nt, Homo sapiens
gaguggugguucugaaacuuuu

SEQ ID NO: 286113 - RNA, 22 nt, Homo sapiens
gagugguucuauauguaauugg

SEQ ID NO: 286114 - RNA, 22 nt, Homo sapiens
gaguuagguugucaaugucuua

SEQ ID NO: 286115 - RNA, 22 nt, Homo sapiens
gaguucaauuuccagcuguucu

SEQ ID NO: 286116 - RNA, 22 nt, Homo sapiens
gauaacagauaaugucaguuau

SEQ ID NO: 286117 - RNA, 21 nt, Homo sapiens
gauaugacauggguaaaacca

SEQ ID NO: 286118 - RNA, 22 nt, Homo sapiens
gauauguucugagaaaugcauu

SEQ ID NO: 286119 - RNA, 22 nt, Homo sapiens
gaucacaugggagaaugagagu

SEQ ID NO: 286120 - RNA, 22 nt, Homo sapiens
gaucccauuggcugccaugugg

SEQ ID NO: 286121 - RNA, 22 nt, Homo sapiens
gaucuggagguuuuccucauga

SEQ ID NO: 286122 - RNA, 22 nt, Homo sapiens
gaucuggucuuugauuagacac

SEQ ID NO: 286123 - RNA, 22 nt, Homo sapiens
gaucuguguuuguaugcauaag

SEQ ID NO: 286124 - RNA, 22 nt, Homo sapiens
gaucuguuguuuggaaguauca

SEQ ID NO: 286125 - RNA, 22 nt, Homo sapiens
gaugaacugucuuacuacucac

SEQ ID NO: 286126 - RNA, 22 nt, Homo sapiens
gaugacagugaguaaccccaac

SEQ ID NO: 286127 - RNA, 22 nt, Homo sapiens
gaugaggcuagagacaugugua

SEQ ID NO: 286128 - RNA, 22 nt, Homo sapiens
gaugagguagaagacucagcaa

SEQ ID NO: 286129 - RNA, 22 nt, Homo sapiens
gaugccuuuuuguccucaguua

SEQ ID NO: 286130 - RNA, 22 nt, Homo sapiens
gauggcaucugagaguguuaga

SEQ ID NO: 286131 - RNA, 22 nt, Homo sapiens
gaugguggucuacccuuucccu

SEQ ID NO: 286132 - RNA, 22 nt, Homo sapiens
gauguaggugcauuugcacgug

SEQ ID NO: 286133 - RNA, 22 nt, Homo sapiens
gauguguuuuaggaucucagca

SEQ ID NO: 286134 - RNA, 22 nt, Homo sapiens
gauuagucccauuuuacaggug

SEQ ID NO: 286135 - RNA, 22 nt, Homo sapiens
gauugguugaaaguagaauacu

SEQ ID NO: 286136 - RNA, 22 nt, Homo sapiens
gauuugagagaggguguuuaua

SEQ ID NO: 286137 - RNA, 22 nt, Homo sapiens
gauuuuccaguggcccugauca

SEQ ID NO: 286138 - RNA, 22 nt, Homo sapiens
gauuuugguuagggaaggauac

SEQ ID NO: 286139 - RNA, 22 nt, Homo sapiens
gauuuuuggggaagccucuuau

SEQ ID NO: 286140 - RNA, 22 nt, Homo sapiens
gcaaaaaguagugcugguuagg

SEQ ID NO: 286141 - RNA, 22 nt, Homo sapiens
gcaaaguguuuuccaacuuggu

SEQ ID NO: 286142 - RNA, 22 nt, Homo sapiens
gcaaaguguuuuuaggaagucu

SEQ ID NO: 286143 - RNA, 22 nt, Homo sapiens
gcaaaugcuaugccauuuuaua

SEQ ID NO: 286144 - RNA, 22 nt, Homo sapiens
gcaacugguuucaguuuuucag

SEQ ID NO: 286145 - RNA, 22 nt, Homo sapiens
gcacaaugccugacgaguccug

SEQ ID NO: 286146 - RNA, 22 nt, Homo sapiens
gcacacuuacacgaaccuagau

SEQ ID NO: 286147 - RNA, 22 nt, Homo sapiens
gcacaguaggugguaggacuuu

SEQ ID NO: 286148 - RNA, 22 nt, Homo sapiens
gcacauuacaaguauuagcuca

SEQ ID NO: 286149 - RNA, 22 nt, Homo sapiens
gcaccguggaguauggggagga

SEQ ID NO: 286150 - RNA, 22 nt, Homo sapiens
gcagaauugacucuguuuuuuc

SEQ ID NO: 286151 - RNA, 22 nt, Homo sapiens
gcagagaaacaggucuaaggag

SEQ ID NO: 286152 - RNA, 22 nt, Homo sapiens
gcagaguauagagggcugggcc

SEQ ID NO: 286153 - RNA, 22 nt, Homo sapiens
gcagaucucuucauuucucuua

SEQ ID NO: 286154 - RNA, 22 nt, Homo sapiens
gcagcacaugacuguauguaua

SEQ ID NO: 286155 - RNA, 22 nt, Homo sapiens
gcagcagugcccuggauggaaa

SEQ ID NO: 286156 - RNA, 22 nt, Homo sapiens
gcagcagugugggcugaaccua

SEQ ID NO: 286157 - RNA, 22 nt, Homo sapiens
gcaguagugugaucuuggcuca

SEQ ID NO: 286158 - RNA, 22 nt, Homo sapiens
gcagucaucugaaggcuuaacu

SEQ ID NO: 286159 - RNA, 22 nt, Homo sapiens
gcagugugauguuuuaaucuau

SEQ ID NO: 286160 - RNA, 22 nt, Homo sapiens
gcaguguggguagagggcaaga

SEQ ID NO: 286161 - RNA, 16 nt, Homo sapiens
gcaguguguuuaauag

SEQ ID NO: 286162 - RNA, 22 nt, Homo sapiens
gcaguguugugauccaggucuu

SEQ ID NO: 286163 - RNA, 22 nt, Homo sapiens
gcauaaagcuaauaagacgaag

SEQ ID NO: 286164 - RNA, 20 nt, Homo sapiens
gcauaugucuuuauggcagc

SEQ ID NO: 286165 - RNA, 22 nt, Homo sapiens
gcauauguuuggguguguauau

SEQ ID NO: 286166 - RNA, 22 nt, Homo sapiens
gcaugacaaugauugcucuuca

SEQ ID NO: 286167 - RNA, 22 nt, Homo sapiens
gcaugaugaauaauaucacaag

SEQ ID NO: 286168 - RNA, 22 nt, Homo sapiens
gcaugauuuuauaucuauguaa

SEQ ID NO: 286169 - RNA, 22 nt, Homo sapiens
gcaugcacuguauuuaaguauc

SEQ ID NO: 286170 - RNA, 22 nt, Homo sapiens
gcauguaguagauguugaauaa

SEQ ID NO: 286171 - RNA, 22 nt, Homo sapiens
gcauugcacuuggcauagacug

SEQ ID NO: 286172 - RNA, 22 nt, Homo sapiens
gccaacauggcgcuccauucuu

SEQ ID NO: 286173 - RNA, 22 nt, Homo sapiens
gccaagaugcugcccacagaca

SEQ ID NO: 286174 - RNA, 22 nt, Homo sapiens
gccaguauuuuguugagaauuu

SEQ ID NO: 286175 - RNA, 22 nt, Homo sapiens
gccaguguuuuauugagaauuu

SEQ ID NO: 286176 - RNA, 22 nt, Homo sapiens
gcccagcguucagggaggggcu

SEQ ID NO: 286177 - RNA, 22 nt, Homo sapiens
gccccaguacaggcuccuuaga

SEQ ID NO: 286178 - RNA, 22 nt, Homo sapiens
gccccgggugaugcagccguca

SEQ ID NO: 286179 - RNA, 22 nt, Homo sapiens
gcccugagauucuuggauucug

SEQ ID NO: 286180 - RNA, 22 nt, Homo sapiens
gcccuguguuuggguaugguca

SEQ ID NO: 286181 - RNA, 17 nt, Homo sapiens
gcccuuugugccucuuc

SEQ ID NO: 286182 - RNA, 22 nt, Homo sapiens
gccuagggacaaaccguccgac

SEQ ID NO: 286183 - RNA, 22 nt, Homo sapiens
gccugagaggauaugauccccu

SEQ ID NO: 286184 - RNA, 22 nt, Homo sapiens
gcuaaaugcaugaggcgaugug

SEQ ID NO: 286185 - RNA, 22 nt, Homo sapiens
gcucaaguaauggcaguuuugc

SEQ ID NO: 286186 - RNA, 22 nt, Homo sapiens
gcugaaauguuuaauuugggag

SEQ ID NO: 286187 - RNA, 22 nt, Homo sapiens
gcugagaucucuugccugaacu

SEQ ID NO: 286188 - RNA, 22 nt, Homo sapiens
gcugagguucaagaagguuaaa

SEQ ID NO: 286189 - RNA, 22 nt, Homo sapiens
gcugaguaguauuucauuguau

SEQ ID NO: 286190 - RNA, 21 nt, Homo sapiens
auugagcacaugaaacauggc

SEQ ID NO: 286191 - RNA, 22 nt, Homo sapiens
auugagcuuuuuaaaauauagu

SEQ ID NO: 286192 - RNA, 19 nt, Homo sapiens
auugauuaaguuugcuguc

SEQ ID NO: 286193 - RNA, 22 nt, Homo sapiens
auugcaaugggaaacuaugaaa

SEQ ID NO: 286194 - RNA, 18 nt, Homo sapiens
auugcacaccagccuggg

SEQ ID NO: 286195 - RNA, 22 nt, Homo sapiens
auugcacuccacccugggcaac

SEQ ID NO: 286196 - RNA, 22 nt, Homo sapiens
auugcacuccagccuggccaac

SEQ ID NO: 286197 - RNA, 22 nt, Homo sapiens
auugcacuccagccuugugaca

SEQ ID NO: 286198 - RNA, 22 nt, Homo sapiens
auugcacucuaaccuaggugac

SEQ ID NO: 286199 - RNA, 22 nt, Homo sapiens
auugcacugcagccugggcaac

SEQ ID NO: 286200 - RNA, 23 nt, Homo sapiens
auugcagaaucacagagguagug

SEQ ID NO: 286201 - RNA, 23 nt, Homo sapiens
auugcagucuugaacuccugggc

SEQ ID NO: 286202 - RNA, 22 nt, Homo sapiens
auugcaguuucaacuccagggc

SEQ ID NO: 286203 - RNA, 22 nt, Homo sapiens
auugcauugugaucuucccaga

SEQ ID NO: 286204 - RNA, 22 nt, Homo sapiens
auugccacaucucagaggcaga

SEQ ID NO: 286205 - RNA, 21 nt, Homo sapiens
auugcccaaaguggaggggaa

SEQ ID NO: 286206 - RNA, 22 nt, Homo sapiens
auugccuaugauugagguacua

SEQ ID NO: 286207 - RNA, 22 nt, Homo sapiens
auugccucaauuccaagacugc

SEQ ID NO: 286208 - RNA, 22 nt, Homo sapiens
uugggaaugcuaaaccucuauu

SEQ ID NO: 286209 - RNA, 22 nt, Homo sapiens
uugggacccuguccuguaacaa

SEQ ID NO: 286210 - RNA, 23 nt, Homo sapiens
uugggcaaaucacuaacgucucc

SEQ ID NO: 286211 - RNA, 23 nt, Homo sapiens
uugggcaaaucacugagggcaga

SEQ ID NO: 286212 - RNA, 22 nt, Homo sapiens
uugggguagaauugcaacauau

SEQ ID NO: 286213 - RNA, 22 nt, Homo sapiens
uugguaaaaugaccacagacau

SEQ ID NO: 286214 - RNA, 22 nt, Homo sapiens
uugguaaucccuagugucuaga

SEQ ID NO: 286215 - RNA, 22 nt, Homo sapiens
uuggucacugacauguuugaaa

SEQ ID NO: 286216 - RNA, 22 nt, Homo sapiens
uuggucagcucaauggagaggg

SEQ ID NO: 286217 - RNA, 22 nt, Homo sapiens
uuggucaggagccucccucuuu

SEQ ID NO: 286218 - RNA, 22 nt, Homo sapiens
uuggucaggcuagaguguggug

SEQ ID NO: 286219 - RNA, 22 nt, Homo sapiens
uugguccacugugaaauuggga

SEQ ID NO: 286220 - RNA, 22 nt, Homo sapiens
uugguccguugugaaaaggccu

SEQ ID NO: 286221 - RNA, 22 nt, Homo sapiens
uuggucucaucaagagcagcuu

SEQ ID NO: 286222 - RNA, 22 nt, Homo sapiens
uuggucucuuaaucacacuuuu

SEQ ID NO: 286223 - RNA, 22 nt, Homo sapiens
uugguuaccuucagaaaugagu

SEQ ID NO: 286224 - RNA, 22 nt, Homo sapiens
uugguuccauuuuaccagcucu

SEQ ID NO: 286225 - RNA, 21 nt, Homo sapiens
uugguucccucugacaggucu

SEQ ID NO: 286226 - RNA, 22 nt, Homo sapiens
uugguucucuuagccaucuuaa

SEQ ID NO: 286227 - RNA, 22 nt, Homo sapiens
uuguaaagucugucucagucag

SEQ ID NO: 286228 - RNA, 22 nt, Homo sapiens
uuguaacaguucugcgagcagc

SEQ ID NO: 286229 - RNA, 22 nt, Homo sapiens
uuguaauguuaggguguccaug

SEQ ID NO: 286230 - RNA, 23 nt, Homo sapiens
uuguacacuaagaaucgcagaug

SEQ ID NO: 286231 - RNA, 22 nt, Homo sapiens
uuguacuagucauauuuugaaa

SEQ ID NO: 286232 - RNA, 22 nt, Homo sapiens
uuguacuuuuaguagagacggg

SEQ ID NO: 286233 - RNA, 22 nt, Homo sapiens
uuguagcaaauguguaaacaaa

SEQ ID NO: 286234 - RNA, 22 nt, Homo sapiens
uuguaguguuuauucugucaac

SEQ ID NO: 286235 - RNA, 22 nt, Homo sapiens
uugucacugcacuccagucugg

SEQ ID NO: 286236 - RNA, 21 nt, Homo sapiens
uuguccccacccaaaucucau

SEQ ID NO: 286237 - RNA, 22 nt, Homo sapiens
uuguccccaucugcugccagaa

SEQ ID NO: 286238 - RNA, 19 nt, Homo sapiens
uuguccccucuaaaucuca

SEQ ID NO: 286239 - RNA, 22 nt, Homo sapiens
uuguccuccacauuugaucagu

SEQ ID NO: 286240 - RNA, 22 nt, Homo sapiens
uuguccuugagauaguuugcag

SEQ ID NO: 286241 - RNA, 21 nt, Homo sapiens
uugucuagagaaauauaucuc

SEQ ID NO: 286242 - RNA, 22 nt, Homo sapiens
uugucucacuggaguuuaguaa

SEQ ID NO: 286243 - RNA, 19 nt, Homo sapiens
uugucuuagaguugucauu

SEQ ID NO: 286244 - RNA, 22 nt, Homo sapiens
uugugaagaaaccagaaaaguu

SEQ ID NO: 286245 - RNA, 22 nt, Homo sapiens
uugugaaugaugucgcaguaaa

SEQ ID NO: 286246 - RNA, 22 nt, Homo sapiens
uugugaauggugccacaauaaa

SEQ ID NO: 286247 - RNA, 22 nt, Homo sapiens
uugugaauggugccucaguaaa

SEQ ID NO: 286248 - RNA, 22 nt, Homo sapiens
uugugagggagcuaagaugagu

SEQ ID NO: 286249 - RNA, 22 nt, Homo sapiens
uugugaguggugccgcaauaaa

SEQ ID NO: 286250 - RNA, 22 nt, Homo sapiens
uugugauggugcauacugagcu

SEQ ID NO: 286251 - RNA, 22 nt, Homo sapiens
uacaggauagacaauuuauuaa

SEQ ID NO: 286252 - RNA, 22 nt, Homo sapiens
uacaggcagguguucccugguu

SEQ ID NO: 286253 - RNA, 22 nt, Homo sapiens
uacagguauagauguguguucu

SEQ ID NO: 286254 - RNA, 22 nt, Homo sapiens
uacaguacagugacaccauuau

SEQ ID NO: 286255 - RNA, 22 nt, Homo sapiens
uacagucuagaggagaaucagg

SEQ ID NO: 286256 - RNA, 22 nt, Homo sapiens
uacagugcuugguaucuaguaa

SEQ ID NO: 286257 - RNA, 22 nt, Homo sapiens
uacagugcuuuuugguggagaa

SEQ ID NO: 286258 - RNA, 22 nt, Homo sapiens
uacaguggcaugucaggugcuu

SEQ ID NO: 286259 - RNA, 19 nt, Homo sapiens
uacauaguauuuaguggca

SEQ ID NO: 286260 - RNA, 22 nt, Homo sapiens
uacaugugcaggucuguggggg

SEQ ID NO: 286261 - RNA, 22 nt, Homo sapiens
uaccacagucauuacacuugua

SEQ ID NO: 286262 - RNA, 22 nt, Homo sapiens
uaccagcauuucucuuuaagua

SEQ ID NO: 286263 - RNA, 22 nt, Homo sapiens
uacccguugaggguuugccagc

SEQ ID NO: 286264 - RNA, 22 nt, Homo sapiens
uaccuaguaggugguuuuucag

SEQ ID NO: 286265 - RNA, 22 nt, Homo sapiens
uaccugagcccucugcugaguu

SEQ ID NO: 286266 - RNA, 22 nt, Homo sapiens
uacuacuuucugacaucuuuaa

SEQ ID NO: 286267 - RNA, 22 nt, Homo sapiens
uacucacauucuguuucuugcu

SEQ ID NO: 286268 - RNA, 22 nt, Homo sapiens
uacucuuuagcuccuuaaggaa

SEQ ID NO: 286269 - RNA, 22 nt, Homo sapiens
uacugcacuccagccugggaga

SEQ ID NO: 286270 - RNA, 19 nt, Homo sapiens
uacugcacuccagucuggg

SEQ ID NO: 286271 - RNA, 22 nt, Homo sapiens
uacugcacucuagccuggguga

SEQ ID NO: 286272 - RNA, 22 nt, Homo sapiens
uacugcacuggaggccucagau

SEQ ID NO: 286273 - RNA, 22 nt, Homo sapiens
uacugcaucgaaaugcuuuuau

SEQ ID NO: 286274 - RNA, 22 nt, Homo sapiens
uacugcauucuccgccuccggg

SEQ ID NO: 286275 - RNA, 22 nt, Homo sapiens
uacuggccccaaaguagguagu

SEQ ID NO: 286276 - RNA, 19 nt, Homo sapiens
uacuggcucgggaauuuuc

SEQ ID NO: 286277 - RNA, 22 nt, Homo sapiens
uacuggguguucugagaaaaua

SEQ ID NO: 286278 - RNA, 22 nt, Homo sapiens
uacuucauucuugaccuugcau

SEQ ID NO: 286279 - RNA, 22 nt, Homo sapiens
uagaaaguagggaagguaggau

SEQ ID NO: 286280 - RNA, 22 nt, Homo sapiens
uagaacauuccaggugauguug

SEQ ID NO: 286281 - RNA, 22 nt, Homo sapiens
uagaagcugagaauguccucag

SEQ ID NO: 286282 - RNA, 18 nt, Homo sapiens
uagaauauaggucauucu

SEQ ID NO: 286283 - RNA, 22 nt, Homo sapiens
uagaaucuaacucgcaugaaaa

SEQ ID NO: 286284 - RNA, 22 nt, Homo sapiens
uagaauggaaggcauguuugcc

SEQ ID NO: 286285 - RNA, 22 nt, Homo sapiens
uagaauguaacuuccaugucau

SEQ ID NO: 286286 - RNA, 22 nt, Homo sapiens
uagacuguaagauccaggagag

SEQ ID NO: 286287 - RNA, 22 nt, Homo sapiens
uagagcuugacacuuuccaugg

SEQ ID NO: 286288 - RNA, 22 nt, Homo sapiens
uagagguagccuacuacacacc

SEQ ID NO: 286289 - RNA, 22 nt, Homo sapiens
uagagguauuaacaguagaaga

SEQ ID NO: 286290 - RNA, 19 nt, Homo sapiens
uagagguuuaagaaaagaa

SEQ ID NO: 286291 - RNA, 19 nt, Homo sapiens
uacaggacugagcugaggu

SEQ ID NO: 286292 - RNA, 22 nt, Homo sapiens
uacagguaugugucuauauaca

SEQ ID NO: 286293 - RNA, 22 nt, Homo sapiens
uacaggugcucuacagacagga

SEQ ID NO: 286294 - RNA, 22 nt, Homo sapiens
uacaguauuaugagugauugaa

SEQ ID NO: 286295 - RNA, 22 nt, Homo sapiens
uacaguccaugcauuauccucc

SEQ ID NO: 286296 - RNA, 22 nt, Homo sapiens
uacagugggcacuggcgcccug

SEQ ID NO: 286297 - RNA, 22 nt, Homo sapiens
uacaguggugugaucucagcuc

SEQ ID NO: 286298 - RNA, 22 nt, Homo sapiens
uacauacuguaugguucuguuu

SEQ ID NO: 286299 - RNA, 22 nt, Homo sapiens
uacauaguuacuuccauuucca

SEQ ID NO: 286300 - RNA, 22 nt, Homo sapiens
uacaucagccugaaagagcucg

SEQ ID NO: 286301 - RNA, 19 nt, Homo sapiens
uacaugcagcaggcacgca

SEQ ID NO: 286302 - RNA, 22 nt, Homo sapiens
uacauguauacaggguuuacuu

SEQ ID NO: 286303 - RNA, 22 nt, Homo sapiens
uacauguauccauuguuuuugg

SEQ ID NO: 286304 - RNA, 22 nt, Homo sapiens
uacauguauguguuuauggcug

SEQ ID NO: 286305 - RNA, 22 nt, Homo sapiens
uaccaaguauuuucacaugaac

SEQ ID NO: 286306 - RNA, 22 nt, Homo sapiens
uaccacccuuuuuccagaagcc

SEQ ID NO: 286307 - RNA, 22 nt, Homo sapiens
uaccacugccgagaaaacagau

SEQ ID NO: 286308 - RNA, 22 nt, Homo sapiens
uacccuuuaguauaaaaucaga

SEQ ID NO: 286309 - RNA, 22 nt, Homo sapiens
uaccucagccaaugcccagaag

SEQ ID NO: 286310 - RNA, 22 nt, Homo sapiens
uaccugagaaagaaagcccucg

SEQ ID NO: 286311 - RNA, 22 nt, Homo sapiens
uaccugagacaacuuugaggaa

SEQ ID NO: 286312 - RNA, 22 nt, Homo sapiens
uaccugagucuagagucuagaa

SEQ ID NO: 286313 - RNA, 22 nt, Homo sapiens
uaccuguagacuacagcuucag

SEQ ID NO: 286314 - RNA, 22 nt, Homo sapiens
uaccuguagcucuucuaggcug

SEQ ID NO: 286315 - RNA, 22 nt, Homo sapiens
uacugaccugucauucagaguu

SEQ ID NO: 286316 - RNA, 19 nt, Homo sapiens
uacugcaccucaaccuggg

SEQ ID NO: 286317 - RNA, 22 nt, Homo sapiens
uacugcacuccaaccugagaga

SEQ ID NO: 286318 - RNA, 22 nt, Homo sapiens
uacugcacuccacccuggguga

SEQ ID NO: 286319 - RNA, 22 nt, Homo sapiens
uacugcacuccagccugccaac

SEQ ID NO: 286320 - RNA, 22 nt, Homo sapiens
uacugcacuccagccuggguga

SEQ ID NO: 286321 - RNA, 20 nt, Homo sapiens
uacugcacuuuccucauggu

SEQ ID NO: 286322 - RNA, 23 nt, Homo sapiens
uacugcauccuccgccucuaggg

SEQ ID NO: 286323 - RNA, 22 nt, Homo sapiens
uacuuuguuauagcagcaggaa

SEQ ID NO: 286324 - RNA, 20 nt, Homo sapiens
uagaaaguagaguggugguu

SEQ ID NO: 286325 - RNA, 22 nt, Homo sapiens
uagaagcacuaucccuccuagu

SEQ ID NO: 286326 - RNA, 22 nt, Homo sapiens
uagaagcuacucuucuuguggc

SEQ ID NO: 286327 - RNA, 22 nt, Homo sapiens
uagaauguauaauauuuuacuu

SEQ ID NO: 286328 - RNA, 23 nt, Homo sapiens
uagaauguuuuuccauguuucuu

SEQ ID NO: 286329 - RNA, 22 nt, Homo sapiens
uagacacugcauauuuuuuuaa

SEQ ID NO: 286330 - RNA, 22 nt, Homo sapiens
uagacccauuguucagagagug

SEQ ID NO: 286331 - RNA, 20 nt, Homo sapiens
uagagagauauggggguucc

SEQ ID NO: 286332 - RNA, 22 nt, Homo sapiens
uagagagcuguuugaaagcagg

SEQ ID NO: 286333 - RNA, 22 nt, Homo sapiens
uagagcaaugacucuggaaacc

SEQ ID NO: 286334 - RNA, 22 nt, Homo sapiens
uagagcacauuaucauuuccaa

SEQ ID NO: 286335 - RNA, 22 nt, Homo sapiens
uagagcucaucuucuuuaaacu

SEQ ID NO: 286336 - RNA, 20 nt, Homo sapiens
uaugagacugggagaaguuc

SEQ ID NO: 286337 - RNA, 19 nt, Homo sapiens
uaugagcuaugacaugcau

SEQ ID NO: 286338 - RNA, 22 nt, Homo sapiens
uaugcacuauagcauauguggu

SEQ ID NO: 286339 - RNA, 19 nt, Homo sapiens
uaugcuagagagggaagcu

SEQ ID NO: 286340 - RNA, 22 nt, Homo sapiens
uaugcuguuucugauuuaggga

SEQ ID NO: 286341 - RNA, 22 nt, Homo sapiens
uaugcuuauugucucauccacu

SEQ ID NO: 286342 - RNA, 22 nt, Homo sapiens
uauggauguuaagguucacagc

SEQ ID NO: 286343 - RNA, 22 nt, Homo sapiens
uauggauuugccuauucuguau

SEQ ID NO: 286344 - RNA, 22 nt, Homo sapiens
uauggccugcguccagugguau

SEQ ID NO: 286345 - RNA, 21 nt, Homo sapiens
uauggcuuagucaguguuucc

SEQ ID NO: 286346 - RNA, 19 nt, Homo sapiens
uaugggauuuuuagggugu

SEQ ID NO: 286347 - RNA, 22 nt, Homo sapiens
uauggguuuauuucuggucuca

SEQ ID NO: 286348 - RNA, 20 nt, Homo sapiens
uaugguuuuagguauagcau

SEQ ID NO: 286349 - RNA, 22 nt, Homo sapiens
uaugucuuuugcuugcaaauag

SEQ ID NO: 286350 - RNA, 22 nt, Homo sapiens
uaugugcaaauuaauugcuaga

SEQ ID NO: 286351 - RNA, 22 nt, Homo sapiens
uaugugcacaugcccuggugac

SEQ ID NO: 286352 - RNA, 22 nt, Homo sapiens
uaugugguuaauaggaauuugu

SEQ ID NO: 286353 - RNA, 22 nt, Homo sapiens
uauuacacuuuagugucuucca

SEQ ID NO: 286354 - RNA, 20 nt, Homo sapiens
uauuacagaguaauggugga

SEQ ID NO: 286355 - RNA, 22 nt, Homo sapiens
uauuagguuggugcaaaaguua

SEQ ID NO: 286356 - RNA, 22 nt, Homo sapiens
uauuagugccuaagucuuaggg

SEQ ID NO: 286357 - RNA, 22 nt, Homo sapiens
uauuccacacuguuggugggau

SEQ ID NO: 286358 - RNA, 22 nt, Homo sapiens
uauuccagcccuggugagccag

SEQ ID NO: 286359 - RNA, 22 nt, Homo sapiens
uauuccauuugugaaaggaagu

SEQ ID NO: 286360 - RNA, 18 nt, Homo sapiens
uauuccucuuccucuauc

SEQ ID NO: 286361 - RNA, 22 nt, Homo sapiens
uauuccuuuugcauuuccacau

SEQ ID NO: 286362 - RNA, 17 nt, Homo sapiens
uauugaccuuuguaugu

SEQ ID NO: 286363 - RNA, 22 nt, Homo sapiens
uauugacuuuuuuguuaggagg

SEQ ID NO: 286364 - RNA, 22 nt, Homo sapiens
uauugcacaugaggagacauug

SEQ ID NO: 286365 - RNA, 20 nt, Homo sapiens
uauugccuaaauaccagaau

SEQ ID NO: 286366 - RNA, 22 nt, Homo sapiens
uauugccugucuccaaaaauca

SEQ ID NO: 286367 - RNA, 22 nt, Homo sapiens
uauugcuccccauaucgcagug

SEQ ID NO: 286368 - RNA, 22 nt, Homo sapiens
uauugcugaugcugaagggaag

SEQ ID NO: 286369 - RNA, 22 nt, Homo sapiens
ggcagaauugcugaggaugcua

SEQ ID NO: 286370 - RNA, 22 nt, Homo sapiens
ggcagaucauuggccucaguuu

SEQ ID NO: 286371 - RNA, 22 nt, Homo sapiens
ggcagcgugguggauugaaaau

SEQ ID NO: 286372 - RNA, 23 nt, Homo sapiens
ggcagguuggucuaggucuauuc

SEQ ID NO: 286373 - RNA, 22 nt, Homo sapiens
ggcaguguggcugcauauagca

SEQ ID NO: 286374 - RNA, 22 nt, Homo sapiens
ggcaguguuauuauauuuuugg

SEQ ID NO: 286375 - RNA, 22 nt, Homo sapiens
ggcaugaaguagcccacaggca

SEQ ID NO: 286376 - RNA, 22 nt, Homo sapiens
ggcaugaggccauaaaaguaag

SEQ ID NO: 286377 - RNA, 21 nt, Homo sapiens
ggcauugugcccuugcucuag

SEQ ID NO: 286378 - RNA, 22 nt, Homo sapiens
ggcccaguugcgggugguaccg

SEQ ID NO: 286379 - RNA, 22 nt, Homo sapiens
ggcuagagagcucagggauaug

SEQ ID NO: 286380 - RNA, 22 nt, Homo sapiens
ggcuagaugcuagagauaucau

SEQ ID NO: 286381 - RNA, 21 nt, Homo sapiens
ggcucuguggucucagguuuc

SEQ ID NO: 286382 - RNA, 22 nt, Homo sapiens
gggaagguaaucauuacuugau

SEQ ID NO: 286383 - RNA, 22 nt, Homo sapiens
gggaagugugguuucuuuacag

SEQ ID NO: 286384 - RNA, 22 nt, Homo sapiens
gggaaugaagagaaccuuccca

SEQ ID NO: 286385 - RNA, 22 nt, Homo sapiens
gggaauggaagacauuaugaug

SEQ ID NO: 286386 - RNA, 22 nt, Homo sapiens
gggaguagagaguuucucugac

SEQ ID NO: 286387 - RNA, 22 nt, Homo sapiens
gggaucaacuuauacuaaaauu

SEQ ID NO: 286388 - RNA, 22 nt, Homo sapiens
gggaugaauuagguauguuuau

SEQ ID NO: 286389 - RNA, 22 nt, Homo sapiens
gggaugauuaugguucacuaca

SEQ ID NO: 286390 - RNA, 20 nt, Homo sapiens
gggaugugagguacacucuu

SEQ ID NO: 286391 - RNA, 22 nt, Homo sapiens
gggauguuuuauacugagccug

SEQ ID NO: 286392 - RNA, 22 nt, Homo sapiens
ggggcaaaaugccacgagucuc

SEQ ID NO: 286393 - RNA, 22 nt, Homo sapiens
ggguaggcaagcggaugucaga

SEQ ID NO: 286394 - RNA, 22 nt, Homo sapiens
gggucauggaugugaagcuaga

SEQ ID NO: 286395 - RNA, 22 nt, Homo sapiens
gguaucuuggagagagaaguga

SEQ ID NO: 286396 - RNA, 22 nt, Homo sapiens
gguauguagcaaaagaggugcu

SEQ ID NO: 286397 - RNA, 22 nt, Homo sapiens
gguauguuuagaccauuuacau

SEQ ID NO: 286398 - RNA, 19 nt, Homo sapiens
ggucagcaaagucuagcug

SEQ ID NO: 286399 - RNA, 22 nt, Homo sapiens
ggucagugcauucuaaaggcaa

SEQ ID NO: 286400 - RNA, 22 nt, Homo sapiens
ggucauggagcuuuacuuuaug

SEQ ID NO: 286401 - RNA, 22 nt, Homo sapiens
ggucuuggagaauuguccuggg

SEQ ID NO: 286402 - RNA, 21 nt, Homo sapiens
ggugagaaaggagacauagac

SEQ ID NO: 286403 - RNA, 22 nt, Homo sapiens
ggugagguaguaagguacaaua

SEQ ID NO: 286404 - RNA, 22 nt, Homo sapiens
ggugauguuugaguugagacag

SEQ ID NO: 286405 - RNA, 22 nt, Homo sapiens
gguuagaaacagguccucagga

SEQ ID NO: 286406 - RNA, 22 nt, Homo sapiens
guaaacuuccccucaugaauga

SEQ ID NO: 286407 - RNA, 22 nt, Homo sapiens
guaaaguaaagcacaucaaggu

SEQ ID NO: 286408 - RNA, 22 nt, Homo sapiens
guaacucugucacuuacuaguu

SEQ ID NO: 286409 - RNA, 22 nt, Homo sapiens
guaagauaguauguuuaaccca

SEQ ID NO: 286410 - RNA, 22 nt, Homo sapiens
guaauacuggacaggguaucag

SEQ ID NO: 286411 - RNA, 22 nt, Homo sapiens
guaaucucaccuacuugggagg

SEQ ID NO: 286412 - RNA, 22 nt, Homo sapiens
guaaucucagcuacucgggaga

SEQ ID NO: 286413 - RNA, 22 nt, Homo sapiens
guacaggcagcaaacaccauaa

SEQ ID NO: 286414 - RNA, 22 nt, Homo sapiens
guacaguggguguagggaccag

SEQ ID NO: 286415 - RNA, 22 nt, Homo sapiens
guaccuguauguucauuucaca

SEQ ID NO: 286416 - RNA, 22 nt, Homo sapiens
guacuuagagauagggucuuua

SEQ ID NO: 286417 - RNA, 22 nt, Homo sapiens
guagaaaguuugcugucacaug

SEQ ID NO: 286418 - RNA, 22 nt, Homo sapiens
guagaagcacaggugaguuggu

SEQ ID NO: 286419 - RNA, 22 nt, Homo sapiens
guagagagaaauacaaagcugu

SEQ ID NO: 286420 - RNA, 22 nt, Homo sapiens
auagcagugugaaaauugacug

SEQ ID NO: 286421 - RNA, 22 nt, Homo sapiens
auagcagugugaggacagacua

SEQ ID NO: 286422 - RNA, 22 nt, Homo sapiens
auagcaucauuucuugaaaaga

SEQ ID NO: 286423 - RNA, 22 nt, Homo sapiens
auagcuguugaauggaauauuc

SEQ ID NO: 286424 - RNA, 22 nt, Homo sapiens
auaggagcacaaacuauuguga

SEQ ID NO: 286425 - RNA, 22 nt, Homo sapiens
auaggcacauuaggaacuuuug

SEQ ID NO: 286426 - RNA, 22 nt, Homo sapiens
auagugcugcaaaaaacauacg

SEQ ID NO: 286427 - RNA, 22 nt, Homo sapiens
auagugcugcaauaaacauaca

SEQ ID NO: 286428 - RNA, 22 nt, Homo sapiens
auagugcugcauuaaacauacg

SEQ ID NO: 286429 - RNA, 22 nt, Homo sapiens
auagugcuggaauaaauauacg

SEQ ID NO: 286430 - RNA, 22 nt, Homo sapiens
auagugcuguauuaaacauacg

SEQ ID NO: 286431 - RNA, 22 nt, Homo sapiens
auauauguuuucugggaagaaa

SEQ ID NO: 286432 - RNA, 22 nt, Homo sapiens
auaucacaaacaagucuguacu

SEQ ID NO: 286433 - RNA, 22 nt, Homo sapiens
auaucacaggaaaggaagauac

SEQ ID NO: 286434 - RNA, 22 nt, Homo sapiens
auaucacagguguuuaccugau

SEQ ID NO: 286435 - RNA, 22 nt, Homo sapiens
auaucccagugaugauugauag

SEQ ID NO: 286436 - RNA, 22 nt, Homo sapiens
auaucccaguguguaaacacug

SEQ ID NO: 286437 - RNA, 22 nt, Homo sapiens
auaucugcauugccauuuaugu

SEQ ID NO: 286438 - RNA, 16 nt, Homo sapiens
auaugacuuuaggagg

SEQ ID NO: 286439 - RNA, 22 nt, Homo sapiens
auaugcacuauacacacguaua

SEQ ID NO: 286440 - RNA, 20 nt, Homo sapiens
auaugcauguguuuucacuu

SEQ ID NO: 286441 - RNA, 22 nt, Homo sapiens
auaugccacugaacuguaccca

SEQ ID NO: 286442 - RNA, 22 nt, Homo sapiens
auauggcuuuuauuauguugag

SEQ ID NO: 286443 - RNA, 22 nt, Homo sapiens
auauggguuuuauauuaggcuc

SEQ ID NO: 286444 - RNA, 22 nt, Homo sapiens
auaugguuuuuggaagcauauc

SEQ ID NO: 286445 - RNA, 22 nt, Homo sapiens
auauguucucauucauaugugg

SEQ ID NO: 286446 - RNA, 21 nt, Homo sapiens
auauuacuguuagaggacugc

SEQ ID NO: 286447 - RNA, 22 nt, Homo sapiens
auauucacuauaugcagaacca

SEQ ID NO: 286448 - RNA, 22 nt, Homo sapiens
auauugcuuagugaugaagucu

SEQ ID NO: 286449 - RNA, 22 nt, Homo sapiens
auauuggccuaaaauucucuuu

SEQ ID NO: 286450 - RNA, 22 nt, Homo sapiens
uauugucaccaucccuguuuua

SEQ ID NO: 286451 - RNA, 22 nt, Homo sapiens
uauuuggauagucuggaaaaaa

SEQ ID NO: 286452 - RNA, 22 nt, Homo sapiens
uauuuggugaaugaaugcaugu

SEQ ID NO: 286453 - RNA, 20 nt, Homo sapiens
uauuugguuauuuccauggu

SEQ ID NO: 286454 - RNA, 22 nt, Homo sapiens
uauuugguuggugcaaaaguaa

SEQ ID NO: 286455 - RNA, 22 nt, Homo sapiens
ucaaagacacacaaggagaagg

SEQ ID NO: 286456 - RNA, 22 nt, Homo sapiens
ucaaaguaaagccucaggaugg

SEQ ID NO: 286457 - RNA, 22 nt, Homo sapiens
ucaaaucaucuuuuccaaagcu

SEQ ID NO: 286458 - RNA, 22 nt, Homo sapiens
ucaaaugauucacccaccuuug

SEQ ID NO: 286459 - RNA, 22 nt, Homo sapiens
ucaaaugguccacgugaacauu

SEQ ID NO: 286460 - RNA, 22 nt, Homo sapiens
ucaaauguuuguuuaaggcuua

SEQ ID NO: 286461 - RNA, 22 nt, Homo sapiens
ucaacacaguuaaauggggaaa

SEQ ID NO: 286462 - RNA, 22 nt, Homo sapiens
ucaagcaauucuccucucagcc

SEQ ID NO: 286463 - RNA, 22 nt, Homo sapiens
ucaagcaauucugcugccucag

SEQ ID NO: 286464 - RNA, 18 nt, Homo sapiens
ucaagcuauugucaugcc

SEQ ID NO: 286465 - RNA, 22 nt, Homo sapiens
ucaagguacguugccucagauu

SEQ ID NO: 286466 - RNA, 22 nt, Homo sapiens
ucaaguacuuauuugauaauua

SEQ ID NO: 286467 - RNA, 22 nt, Homo sapiens
ucaagugcauugauucaguauu

SEQ ID NO: 286468 - RNA, 22 nt, Homo sapiens
ucaaugaaugaugguugguaug

SEQ ID NO: 286469 - RNA, 19 nt, Homo sapiens
ucaauucugucaauggcuu

SEQ ID NO: 286470 - RNA, 21 nt, Homo sapiens
ucacaaugaacagcagcagaa

SEQ ID NO: 286471 - RNA, 22 nt, Homo sapiens
ucacaauguaaaugaggguugg

SEQ ID NO: 286472 - RNA, 22 nt, Homo sapiens
ucacaauucucaauuugugaaa

SEQ ID NO: 286473 - RNA, 22 nt, Homo sapiens
ucacacgugaacucaucacaga

SEQ ID NO: 286474 - RNA, 23 nt, Homo sapiens
ucacacuuaagagaaaugcagcu

SEQ ID NO: 286475 - RNA, 22 nt, Homo sapiens
ucacagacugagccaaauagag

SEQ ID NO: 286476 - RNA, 22 nt, Homo sapiens
ucacagauaaauaaagaugauu

SEQ ID NO: 286477 - RNA, 22 nt, Homo sapiens
ucacagaugaggcgagaggcag

SEQ ID NO: 286478 - RNA, 22 nt, Homo sapiens
ucacagaugcuugacccauuuc

SEQ ID NO: 286479 - RNA, 22 nt, Homo sapiens
ucacagccuaguuuuauacauu

SEQ ID NO: 286480 - RNA, 22 nt, Homo sapiens
ucacaguaacuuuguugcuuuu

SEQ ID NO: 286481 - RNA, 22 nt, Homo sapiens
ucacaguagagcuucuuucaga

SEQ ID NO: 286482 - RNA, 22 nt, Homo sapiens
ucacaguagggaacugacaaag

SEQ ID NO: 286483 - RNA, 22 nt, Homo sapiens
ucacagucaaaguaaucauaga

SEQ ID NO: 286484 - RNA, 22 nt, Homo sapiens
ucacaguccuguuuaggagagg

SEQ ID NO: 286485 - RNA, 22 nt, Homo sapiens
ucacagugaguggaguggggug

SEQ ID NO: 286486 - RNA, 22 nt, Homo sapiens
ucacaguguuaaaccuuucuuu

SEQ ID NO: 286487 - RNA, 22 nt, Homo sapiens
ucacaguucagcauggcugagg

SEQ ID NO: 286488 - RNA, 22 nt, Homo sapiens
ucacauagcauaaugucugcaa

SEQ ID NO: 286489 - RNA, 22 nt, Homo sapiens
ucacauggaaaaguccaguaaa

SEQ ID NO: 286490 - RNA, 22 nt, Homo sapiens
ucacaugggugcaauauaauca

SEQ ID NO: 286491 - RNA, 22 nt, Homo sapiens
ucacaugugacauauauauuug

SEQ ID NO: 286492 - RNA, 22 nt, Homo sapiens
ucacccacacaggagacaggga

SEQ ID NO: 286493 - RNA, 20 nt, Homo sapiens
ucacccugacaucugcccag

SEQ ID NO: 286494 - RNA, 22 nt, Homo sapiens
ucaccuggagaagauggaucau

SEQ ID NO: 286495 - RNA, 22 nt, Homo sapiens
ucaccuggggcacagcugaaga

SEQ ID NO: 286496 - RNA, 18 nt, Homo sapiens
ucaccuugugagagagag

SEQ ID NO: 286497 - RNA, 22 nt, Homo sapiens
ucacuagaucaagggagagaaa

SEQ ID NO: 286498 - RNA, 22 nt, Homo sapiens
ucacugaaaccacugccuccug

SEQ ID NO: 286499 - RNA, 21 nt, Homo sapiens
ucacugagcaucaugguuuca

SEQ ID NO: 286500 - RNA, 22 nt, Homo sapiens
ucacugagcuagaucacuugac

SEQ ID NO: 286501 - RNA, 20 nt, Homo sapiens
ucacugaguaucuacgauua

SEQ ID NO: 286502 - RNA, 22 nt, Homo sapiens
ucacugcgaccuccgccucccg

SEQ ID NO: 286503 - RNA, 19 nt, Homo sapiens
ucacuggacagcacacuca

SEQ ID NO: 286504 - RNA, 22 nt, Homo sapiens
ucuggccuagaacaauuaauua

SEQ ID NO: 286505 - RNA, 22 nt, Homo sapiens
ucuggcuugugaacugucuucu

SEQ ID NO: 286506 - RNA, 22 nt, Homo sapiens
ugcaccauuacacuccaggcug

SEQ ID NO: 286507 - RNA, 22 nt, Homo sapiens
ugcaccauugcacuccagccug

SEQ ID NO: 286508 - RNA, 22 nt, Homo sapiens
ugcaccauugcauuccagccug

SEQ ID NO: 286509 - RNA, 22 nt, Homo sapiens
ugcacugucuugucgcauagca

SEQ ID NO: 286510 - RNA, 22 nt, Homo sapiens
ugcacuguggucugagagacag

SEQ ID NO: 286511 - RNA, 22 nt, Homo sapiens
ugcagagaaacauuuuguauuu

SEQ ID NO: 286512 - RNA, 22 nt, Homo sapiens
ugcagagucuguccugccugcc

SEQ ID NO: 286513 - RNA, 22 nt, Homo sapiens
ugcagcacugaacuucugggcu

SEQ ID NO: 286514 - RNA, 22 nt, Homo sapiens
ugcagcacuguucacaauagcc

SEQ ID NO: 286515 - RNA, 22 nt, Homo sapiens
ugcagcucagcugcggaguuuu

SEQ ID NO: 286516 - RNA, 23 nt, Homo sapiens
ugcaguagugagaucuaggcuca

SEQ ID NO: 286517 - RNA, 22 nt, Homo sapiens
ugcagugucaauaauaauuagu

SEQ ID NO: 286518 - RNA, 22 nt, Homo sapiens
ugcagugugcuggggucuccau

SEQ ID NO: 286519 - RNA, 22 nt, Homo sapiens
ugcauaauuccuugcaccagaa

SEQ ID NO: 286520 - RNA, 19 nt, Homo sapiens
ugcauaggguuacauacuc

SEQ ID NO: 286521 - RNA, 22 nt, Homo sapiens
ugcauaugcagcauuuaugauu

SEQ ID NO: 286522 - RNA, 22 nt, Homo sapiens
ugcauauucaaggcaggccauu

SEQ ID NO: 286523 - RNA, 22 nt, Homo sapiens
ugcauuaguaaguaauuuuaau

SEQ ID NO: 286524 - RNA, 22 nt, Homo sapiens
ugcauuaucagauguuugcuuu

SEQ ID NO: 286525 - RNA, 22 nt, Homo sapiens
ugcauuguaggauguuuagcag

SEQ ID NO: 286526 - RNA, 22 nt, Homo sapiens
ugcauuguauuguugacucgcc

SEQ ID NO: 286527 - RNA, 22 nt, Homo sapiens
ugccaaaaugggcuuuauaccg

SEQ ID NO: 286528 - RNA, 22 nt, Homo sapiens
ugccaacugguuucuuuuaguu

SEQ ID NO: 286529 - RNA, 22 nt, Homo sapiens
ugccaagauuucaggaauuaag

SEQ ID NO: 286530 - RNA, 22 nt, Homo sapiens
ugccagaugcuggugugagggg

SEQ ID NO: 286531 - RNA, 22 nt, Homo sapiens
ugccaguuuuuacauuuccugu

SEQ ID NO: 286532 - RNA, 22 nt, Homo sapiens
ugccauagagauuuguggaacu

SEQ ID NO: 286533 - RNA, 22 nt, Homo sapiens
ugccauagcaaugguaagcuga

SEQ ID NO: 286534 - RNA, 22 nt, Homo sapiens
ugccaugaagagaggaagcagu

SEQ ID NO: 286535 - RNA, 23 nt, Homo sapiens
ugccuagaugcugcccugggaca

SEQ ID NO: 286536 - RNA, 22 nt, Homo sapiens
ugccuaggcccaguccucagaa

SEQ ID NO: 286537 - RNA, 22 nt, Homo sapiens
ugccuagucuauugagagucuu

SEQ ID NO: 286538 - RNA, 22 nt, Homo sapiens
ugccuaguggaaggagagcaaa

SEQ ID NO: 286539 - RNA, 22 nt, Homo sapiens
ugccugagccagguuuuaggag

SEQ ID NO: 286540 - RNA, 21 nt, Homo sapiens
ugccuuuguaguaggugucuu

SEQ ID NO: 286541 - RNA, 22 nt, Homo sapiens
ugcgccauugcacucuagccug

SEQ ID NO: 286542 - RNA, 18 nt, Homo sapiens
ugcuaugagauuauuuua

SEQ ID NO: 286543 - RNA, 22 nt, Homo sapiens
ugcuaugucuucucucacagag

SEQ ID NO: 286544 - RNA, 22 nt, Homo sapiens
ugcucaccugcugcucaccucc

SEQ ID NO: 286545 - RNA, 22 nt, Homo sapiens
ugcugcaaacaugagaggaagu

SEQ ID NO: 286546 - RNA, 20 nt, Homo sapiens
ugcugcacuuaagcaugggc

SEQ ID NO: 286547 - RNA, 22 nt, Homo sapiens
ugcugcacuuauggcucugagg

SEQ ID NO: 286548 - RNA, 22 nt, Homo sapiens
ugcuggcguuacucuccaucag

SEQ ID NO: 286549 - RNA, 22 nt, Homo sapiens
ugcuggugauucagauucaaau

SEQ ID NO: 286550 - RNA, 22 nt, Homo sapiens
ugcuuguguucagguaaccuuu

SEQ ID NO: 286551 - RNA, 22 nt, Homo sapiens
uggaaaguacuugaguuuguau

SEQ ID NO: 286552 - RNA, 19 nt, Homo sapiens
uggaacauaaaaguugguu

SEQ ID NO: 286553 - RNA, 23 nt, Homo sapiens
uggaacugaauuucuuagcauuu

SEQ ID NO: 286554 - RNA, 22 nt, Homo sapiens
uggaacugauauugauggaaaa

SEQ ID NO: 286555 - RNA, 22 nt, Homo sapiens
uggaagacauuuuggaccuugg

SEQ ID NO: 286556 - RNA, 23 nt, Homo sapiens
uggaagacuccucucuuggcugc

SEQ ID NO: 286557 - RNA, 22 nt, Homo sapiens
uggaagauuacuuuuuguugaa

SEQ ID NO: 286558 - RNA, 22 nt, Homo sapiens
uggaagccuagauucuuuucuu

SEQ ID NO: 286559 - RNA, 20 nt, Homo sapiens
uggaaggcaucugcauuauu

SEQ ID NO: 286560 - RNA, 22 nt, Homo sapiens
uggaagucaugcugcaagaaca

SEQ ID NO: 286561 - RNA, 22 nt, Homo sapiens
uggaagucauugagguguguua

SEQ ID NO: 286562 - RNA, 22 nt, Homo sapiens
uggaagucuucauuauguauag

SEQ ID NO: 286563 - RNA, 22 nt, Homo sapiens
uggaauacaugucgcugagcug

SEQ ID NO: 286564 - RNA, 22 nt, Homo sapiens
uggaauaucaugagaguuuguu

SEQ ID NO: 286565 - RNA, 21 nt, Homo sapiens
uggaaucuauuauuccaguuu

SEQ ID NO: 286566 - RNA, 22 nt, Homo sapiens
uggaaugguaucuuguuggggu

SEQ ID NO: 286567 - RNA, 22 nt, Homo sapiens
uggaauguagcguugacacgag

SEQ ID NO: 286568 - RNA, 22 nt, Homo sapiens
uggaauguuuaucaaaacagua

SEQ ID NO: 286569 - RNA, 22 nt, Homo sapiens
uggaauuaauuaaaauauacug

SEQ ID NO: 286570 - RNA, 22 nt, Homo sapiens
uggacacuggagauucgucagu

SEQ ID NO: 286571 - RNA, 22 nt, Homo sapiens
uggacacugguggauauggaau

SEQ ID NO: 286572 - RNA, 21 nt, Homo sapiens
uggaccccuuccuuacaucau

SEQ ID NO: 286573 - RNA, 22 nt, Homo sapiens
uggacuguaagugccuugagua

SEQ ID NO: 286574 - RNA, 22 nt, Homo sapiens
uggacuuuaauaaaagggaaau

SEQ ID NO: 286575 - RNA, 22 nt, Homo sapiens
uggagacaaagauagaaaagca

SEQ ID NO: 286576 - RNA, 22 nt, Homo sapiens
uggagagcaaagaauuuguuag

SEQ ID NO: 286577 - RNA, 22 nt, Homo sapiens
uggagagucauuuauaguauuu

SEQ ID NO: 286578 - RNA, 22 nt, Homo sapiens
uggagagugauaaguaaaugga

SEQ ID NO: 286579 - RNA, 22 nt, Homo sapiens
uggaguaggccuaagaaugaca

SEQ ID NO: 286580 - RNA, 20 nt, Homo sapiens
uggagugaagguucuggacc

SEQ ID NO: 286581 - RNA, 22 nt, Homo sapiens
uggagugcgugucugaguuuuu

SEQ ID NO: 286582 - RNA, 22 nt, Homo sapiens
uggauagaacuaagugcuuaga

SEQ ID NO: 286583 - RNA, 22 nt, Homo sapiens
uggaucaugcgaggccuccccu

SEQ ID NO: 286584 - RNA, 22 nt, Homo sapiens
uggauccaucacgccucuuccc

SEQ ID NO: 286585 - RNA, 22 nt, Homo sapiens
uggaugaagagaugguaguugc

SEQ ID NO: 286586 - RNA, 21 nt, Homo sapiens
uggaugccuaggcagaaguuu

SEQ ID NO: 286587 - RNA, 21 nt, Homo sapiens
uggauugagaaccccaggagg

SEQ ID NO: 286588 - RNA, 22 nt, Homo sapiens
uggcaaagugugacgugggggu

SEQ ID NO: 286589 - RNA, 22 nt, Homo sapiens
uggcaaauagcaauaggagggu

SEQ ID NO: 286590 - RNA, 22 nt, Homo sapiens
uggcaaaucagaggcauggaca

SEQ ID NO: 286591 - RNA, 22 nt, Homo sapiens
uggcaagaacugcaauugcuuu

SEQ ID NO: 286592 - RNA, 22 nt, Homo sapiens
uggcaagaagagcaugagacca

SEQ ID NO: 286593 - RNA, 22 nt, Homo sapiens
uggcaagaaggauuuauuccuu

SEQ ID NO: 286594 - RNA, 22 nt, Homo sapiens
uggcaagagaacaacaucucuc

SEQ ID NO: 286595 - RNA, 23 nt, Homo sapiens
uggcaagauuuguauugccugga

SEQ ID NO: 286596 - RNA, 22 nt, Homo sapiens
uggcaauaaggacuccuuaggu

SEQ ID NO: 286597 - RNA, 19 nt, Homo sapiens
uggcaaugucagcagagau

SEQ ID NO: 286598 - RNA, 22 nt, Homo sapiens
uggcacaaugacccuugugggc

SEQ ID NO: 286599 - RNA, 22 nt, Homo sapiens
uggcaccauccaggugucucua

SEQ ID NO: 286600 - RNA, 22 nt, Homo sapiens
uggcagaugggugagcuggaga

SEQ ID NO: 286601 - RNA, 22 nt, Homo sapiens
uggcagcugcuucaugggaugc

SEQ ID NO: 286602 - RNA, 22 nt, Homo sapiens
uggcaguuuacaaaugccauga

SEQ ID NO: 286603 - RNA, 22 nt, Homo sapiens
uggcaguuucauaugguucaac

SEQ ID NO: 286604 - RNA, 20 nt, Homo sapiens
uggcaugaaauuuuccaagc

SEQ ID NO: 286605 - RNA, 22 nt, Homo sapiens
uggcaugaagaccccauccuuu

SEQ ID NO: 286606 - RNA, 22 nt, Homo sapiens
uggcaugauguguucauugaaa

SEQ ID NO: 286607 - RNA, 22 nt, Homo sapiens
uggcaugggguaguagcgcugg

SEQ ID NO: 286608 - RNA, 22 nt, Homo sapiens
uggcaugugugaagugcccagc

SEQ ID NO: 286609 - RNA, 20 nt, Homo sapiens
uggcauguugguaugcaccc

SEQ ID NO: 286610 - RNA, 22 nt, Homo sapiens
uggccaguguuuuuccugggcu

SEQ ID NO: 286611 - RNA, 22 nt, Homo sapiens
uggcuagaccugcauaacagcu

SEQ ID NO: 286612 - RNA, 22 nt, Homo sapiens
uggcucauuucuaaacccagcu

SEQ ID NO: 286613 - RNA, 22 nt, Homo sapiens
uggcuguuuauuucaccuggau

SEQ ID NO: 286614 - RNA, 22 nt, Homo sapiens
uggcuguuuauuucacgugggu

SEQ ID NO: 286615 - RNA, 22 nt, Homo sapiens
uggcuuuuaucuacucucaacu

SEQ ID NO: 286616 - RNA, 22 nt, Homo sapiens
uggcuuuuguuauuuggaagcu

SEQ ID NO: 286617 - RNA, 22 nt, Homo sapiens
ugggaagaagguuuacuugcca

SEQ ID NO: 286618 - RNA, 22 nt, Homo sapiens
ugggaagagggagcgauuuugg

SEQ ID NO: 286619 - RNA, 22 nt, Homo sapiens
ugggaagauucuguguuuuucc

SEQ ID NO: 286620 - RNA, 22 nt, Homo sapiens
ugggaagcugcauuuuaacaag

SEQ ID NO: 286621 - RNA, 22 nt, Homo sapiens
ugggaauaugauacaggucuuu

SEQ ID NO: 286622 - RNA, 22 nt, Homo sapiens
ugggaaugaaauuacauagcuu

SEQ ID NO: 286623 - RNA, 22 nt, Homo sapiens
ugggagugugcacaauuucagc

SEQ ID NO: 286624 - RNA, 22 nt, Homo sapiens
ugggaucauuaugcauagugua

SEQ ID NO: 286625 - RNA, 22 nt, Homo sapiens
ugggaucauucaaugacgaaau

SEQ ID NO: 286626 - RNA, 22 nt, Homo sapiens
ugggaugaaaauagcuucuucc

SEQ ID NO: 286627 - RNA, 22 nt, Homo sapiens
ugggauguagccuucuauuuuc

SEQ ID NO: 286628 - RNA, 22 nt, Homo sapiens
ugggcaaauugugagggaggua

SEQ ID NO: 286629 - RNA, 21 nt, Homo sapiens
ugggccccuuccuuacaucau

SEQ ID NO: 286630 - RNA, 22 nt, Homo sapiens
ugggccgcugcaggaugguccc

SEQ ID NO: 286631 - RNA, 22 nt, Homo sapiens
ugggguagaauagaauugauau

SEQ ID NO: 286632 - RNA, 22 nt, Homo sapiens
uggguaggaccagaaaugcacu

SEQ ID NO: 286633 - RNA, 19 nt, Homo sapiens
uggguagugaugagacaua

SEQ ID NO: 286634 - RNA, 21 nt, Homo sapiens
uggguaguuuucaaggccccg

SEQ ID NO: 286635 - RNA, 22 nt, Homo sapiens
uggguaguuuuucagcucuugc

SEQ ID NO: 286636 - RNA, 22 nt, Homo sapiens
ugguaaaaugucauuuaccaga

SEQ ID NO: 286637 - RNA, 22 nt, Homo sapiens
ugguaguuucuguaucucacag

SEQ ID NO: 286638 - RNA, 22 nt, Homo sapiens
ugguauguauacuagcgacacu

SEQ ID NO: 286639 - RNA, 22 nt, Homo sapiens
ugguaugucuagauggggaagu

SEQ ID NO: 286640 - RNA, 22 nt, Homo sapiens
uggucagaugcugaguggaucu

SEQ ID NO: 286641 - RNA, 22 nt, Homo sapiens
uggucaugaggugaggcuucuc

SEQ ID NO: 286642 - RNA, 22 nt, Homo sapiens
uggucauggggcagcugacacu

SEQ ID NO: 286643 - RNA, 22 nt, Homo sapiens
ugguccaguucugugauauugc

SEQ ID NO: 286644 - RNA, 22 nt, Homo sapiens
ugguccccaauacuucuauaga

SEQ ID NO: 286645 - RNA, 20 nt, Homo sapiens
ugguccccaccaaaucucau

SEQ ID NO: 286646 - RNA, 22 nt, Homo sapiens
uggugagaaaagaugucuuugu

SEQ ID NO: 286647 - RNA, 22 nt, Homo sapiens
uggugcuugaugaggguggagc

SEQ ID NO: 286648 - RNA, 22 nt, Homo sapiens
ugguggcuuuucguagguucac

SEQ ID NO: 286649 - RNA, 22 nt, Homo sapiens
ugguugaucccaucacccaggu

SEQ ID NO: 286650 - RNA, 23 nt, Homo sapiens
ugguuuguaagagauggacugga

SEQ ID NO: 286651 - RNA, 22 nt, Homo sapiens
uguaaaaagcccagccgcugag

SEQ ID NO: 286652 - RNA, 22 nt, Homo sapiens
uguaaacauguauguguuuaug

SEQ ID NO: 286653 - RNA, 18 nt, Homo sapiens
uguaaacuaccucaaccu

SEQ ID NO: 286654 - RNA, 22 nt, Homo sapiens
uguaaaucuuucacaguugaug

SEQ ID NO: 286655 - RNA, 22 nt, Homo sapiens
uguaauguuucaucauuauuaa

SEQ ID NO: 286656 - RNA, 20 nt, Homo sapiens
uguacacaguguacccacau

SEQ ID NO: 286657 - RNA, 22 nt, Homo sapiens
uguacacauaugugggguacau

SEQ ID NO: 286658 - RNA, 22 nt, Homo sapiens
uguacaugggacaggaggagag

SEQ ID NO: 286659 - RNA, 22 nt, Homo sapiens
uguagauaucuaucaggucaau

SEQ ID NO: 286660 - RNA, 22 nt, Homo sapiens
uguagcaaaucgauacuauugg

SEQ ID NO: 286661 - RNA, 22 nt, Homo sapiens
uguagcagccauaaacacagug

SEQ ID NO: 286662 - RNA, 22 nt, Homo sapiens
uguagucauuugaaggaugucc

SEQ ID NO: 286663 - RNA, 22 nt, Homo sapiens
uguagucauuuggaguccagcu

SEQ ID NO: 286664 - RNA, 22 nt, Homo sapiens
uguauacauauguauguuuugu

SEQ ID NO: 286665 - RNA, 22 nt, Homo sapiens
uguauauguuuguacauauguc

SEQ ID NO: 286666 - RNA, 22 nt, Homo sapiens
uguaugaguuguuuauaaauuu

SEQ ID NO: 286667 - RNA, 22 nt, Homo sapiens
uguauguugauguuauauucug

SEQ ID NO: 286668 - RNA, 22 nt, Homo sapiens
ugucaaagagacaucugcacuc

SEQ ID NO: 286669 - RNA, 22 nt, Homo sapiens
ugucaagaugguuugauguugu

SEQ ID NO: 286670 - RNA, 22 nt, Homo sapiens
uucaggcaccauggucauugau

SEQ ID NO: 286671 - RNA, 22 nt, Homo sapiens
uucagggagaaggcaaacguug

SEQ ID NO: 286672 - RNA, 22 nt, Homo sapiens
uucaguagucaaaagauaaggg

SEQ ID NO: 286673 - RNA, 20 nt, Homo sapiens
uucagugcagguaacaaucc

SEQ ID NO: 286674 - RNA, 22 nt, Homo sapiens
uucagugccuggaagucgugcu

SEQ ID NO: 286675 - RNA, 22 nt, Homo sapiens
uucaguucugcacugaucuuag

SEQ ID NO: 286676 - RNA, 19 nt, Homo sapiens
uucauacagugagagcagc

SEQ ID NO: 286677 - RNA, 22 nt, Homo sapiens
uucauagaggacauuacuggag

SEQ ID NO: 286678 - RNA, 22 nt, Homo sapiens
uucauagucuaauuuuuuccac

SEQ ID NO: 286679 - RNA, 22 nt, Homo sapiens
uucauagucuaugcaaguaaga

SEQ ID NO: 286680 - RNA, 22 nt, Homo sapiens
uucauagugaaaaauucaaagu

SEQ ID NO: 286681 - RNA, 22 nt, Homo sapiens
uucauaguuuauacugauauuu

SEQ ID NO: 286682 - RNA, 22 nt, Homo sapiens
uucaucacagucuccgaugccc

SEQ ID NO: 286683 - RNA, 22 nt, Homo sapiens
uucaucagggguauuggccaau

SEQ ID NO: 286684 - RNA, 22 nt, Homo sapiens
uucauggaacaaguggguucaa

SEQ ID NO: 286685 - RNA, 22 nt, Homo sapiens
uucauggaauauugaccauuuu

SEQ ID NO: 286686 - RNA, 22 nt, Homo sapiens
uucauggaguuuaaauuguagu

SEQ ID NO: 286687 - RNA, 20 nt, Homo sapiens
uucaugggagcaaagaggcc

SEQ ID NO: 286688 - RNA, 22 nt, Homo sapiens
uucauguaauauauuucaggcc

SEQ ID NO: 286689 - RNA, 22 nt, Homo sapiens
uucauguaauauuucacagcuu

SEQ ID NO: 286690 - RNA, 22 nt, Homo sapiens
uucauguaaucaaggcagcuaa

SEQ ID NO: 286691 - RNA, 22 nt, Homo sapiens
uucaugucuuggcuguuagagu

SEQ ID NO: 286692 - RNA, 22 nt, Homo sapiens
uucauuggacuuguguucuuga

SEQ ID NO: 286693 - RNA, 22 nt, Homo sapiens
uuccacaggguugaacuaguuu

SEQ ID NO: 286694 - RNA, 22 nt, Homo sapiens
uuccagaugggaguucuauucu

SEQ ID NO: 286695 - RNA, 22 nt, Homo sapiens
uuccaguaauagcacagcauug

SEQ ID NO: 286696 - RNA, 22 nt, Homo sapiens
uuccaguguguucauccucaga

SEQ ID NO: 286697 - RNA, 22 nt, Homo sapiens
uuccauguaguugaacgguuuu

SEQ ID NO: 286698 - RNA, 22 nt, Homo sapiens
uucccaguaaacucuaucccuc

SEQ ID NO: 286699 - RNA, 22 nt, Homo sapiens
uucccauuguuggccagcaugu

SEQ ID NO: 286700 - RNA, 22 nt, Homo sapiens
uucccgggguggaaugcaguga

SEQ ID NO: 286701 - RNA, 22 nt, Homo sapiens
uucccugagcaucuguugagcc

SEQ ID NO: 286702 - RNA, 22 nt, Homo sapiens
uucccugugguauagaagccgu

SEQ ID NO: 286703 - RNA, 22 nt, Homo sapiens
uucccuuucugaaaaucucauu

SEQ ID NO: 286704 - RNA, 19 nt, Homo sapiens
uuccuagugguugggaagu

SEQ ID NO: 286705 - RNA, 22 nt, Homo sapiens
uuccugagagggcugggugcag

SEQ ID NO: 286706 - RNA, 22 nt, Homo sapiens
uuccugucuuccaagagagauu

SEQ ID NO: 286707 - RNA, 20 nt, Homo sapiens
uuccuuaggcauuggaagaa

SEQ ID NO: 286708 - RNA, 22 nt, Homo sapiens
uuccuugaaacagucaagagaa

SEQ ID NO: 286709 - RNA, 22 nt, Homo sapiens
uuccuugguucagggaaggucc

SEQ ID NO: 286710 - RNA, 22 nt, Homo sapiens
uuccuuguagcaaaugcgauga

SEQ ID NO: 286711 - RNA, 22 nt, Homo sapiens
uuccuugugacuaguagugacc

SEQ ID NO: 286712 - RNA, 22 nt, Homo sapiens
uucuaaguaauuuugcaugccu

SEQ ID NO: 286713 - RNA, 22 nt, Homo sapiens
uucuagagagaagacuuaagcu

SEQ ID NO: 286714 - RNA, 22 nt, Homo sapiens
uucuagcaauggcagagugucu

SEQ ID NO: 286715 - RNA, 22 nt, Homo sapiens
uucuaguacucccuggagcugg

SEQ ID NO: 286716 - RNA, 22 nt, Homo sapiens
uucucaaggagccuucguaacu

SEQ ID NO: 286717 - RNA, 22 nt, Homo sapiens
uucucaauggcaacuuguugcu

SEQ ID NO: 286718 - RNA, 22 nt, Homo sapiens
uucucagugaacuccagcuugu

SEQ ID NO: 286719 - RNA, 17 nt, Homo sapiens
uucucaguucugaucuc

SEQ ID NO: 286720 - RNA, 22 nt, Homo sapiens
uucuccugguggacccuaaacg

SEQ ID NO: 286721 - RNA, 22 nt, Homo sapiens
guagcaugcaauauuauagaga

SEQ ID NO: 286722 - RNA, 22 nt, Homo sapiens
guagggcaggcugagaaauaua

SEQ ID NO: 286723 - RNA, 22 nt, Homo sapiens
guagugcaguuugagaaucagu

SEQ ID NO: 286724 - RNA, 22 nt, Homo sapiens
guaguggcaugaucuuggcuca

SEQ ID NO: 286725 - RNA, 22 nt, Homo sapiens
guauacacccugugauauuauu

SEQ ID NO: 286726 - RNA, 22 nt, Homo sapiens
guauacaguugacccuugaacc

SEQ ID NO: 286727 - RNA, 22 nt, Homo sapiens
guauagaucguagaccaauaaa

SEQ ID NO: 286728 - RNA, 22 nt, Homo sapiens
guauagcacauaauacuugaug

SEQ ID NO: 286729 - RNA, 22 nt, Homo sapiens
guaucaucauguuggccaggcu

SEQ ID NO: 286730 - RNA, 22 nt, Homo sapiens
guaucccuugcuaucugaaucu

SEQ ID NO: 286731 - RNA, 22 nt, Homo sapiens
guaugcacauauguguauguau

SEQ ID NO: 286732 - RNA, 22 nt, Homo sapiens
guaugugacuggaacaguagga

SEQ ID NO: 286733 - RNA, 22 nt, Homo sapiens
guauugacauuuuuaaggaacu

SEQ ID NO: 286734 - RNA, 22 nt, Homo sapiens
guauugcuugagcccaggaguu

SEQ ID NO: 286735 - RNA, 22 nt, Homo sapiens
guauuguacuacaagcucuuua

SEQ ID NO: 286736 - RNA, 22 nt, Homo sapiens
gucaagugaagaccugacucuu

SEQ ID NO: 286737 - RNA, 22 nt, Homo sapiens
gucaaguguuuucaaggcuucc

SEQ ID NO: 286738 - RNA, 22 nt, Homo sapiens
gucacagcuggcauugucugca

SEQ ID NO: 286739 - RNA, 22 nt, Homo sapiens
gucacaggaaacuaauaugcgc

SEQ ID NO: 286740 - RNA, 22 nt, Homo sapiens
gucacaguguuuguucauccca

SEQ ID NO: 286741 - RNA, 22 nt, Homo sapiens
gucacauugaugcccauggugg

SEQ ID NO: 286742 - RNA, 22 nt, Homo sapiens
gucagauaauuugcauccaucu

SEQ ID NO: 286743 - RNA, 22 nt, Homo sapiens
gucagugauugauuuaaagacg

SEQ ID NO: 286744 - RNA, 22 nt, Homo sapiens
gucagugcauguaaacauaaaa

SEQ ID NO: 286745 - RNA, 22 nt, Homo sapiens
gucagugucuuaacagagauua

SEQ ID NO: 286746 - RNA, 22 nt, Homo sapiens
gucagugugauaucugcagggg

SEQ ID NO: 286747 - RNA, 22 nt, Homo sapiens
gucaguuucacucagcuggaac

SEQ ID NO: 286748 - RNA, 22 nt, Homo sapiens
gucaguuugguuaaucauucca

SEQ ID NO: 286749 - RNA, 21 nt, Homo sapiens
gucauaugucucugauuagug

SEQ ID NO: 286750 - RNA, 22 nt, Homo sapiens
gucauggaaaucuacauuguua

SEQ ID NO: 286751 - RNA, 22 nt, Homo sapiens
gucauggaacaacuuaaaguca

SEQ ID NO: 286752 - RNA, 22 nt, Homo sapiens
gucauggacaguuugcuaauug

SEQ ID NO: 286753 - RNA, 21 nt, Homo sapiens
uugagaagaauuagcucuucc

SEQ ID NO: 286754 - RNA, 22 nt, Homo sapiens
uugagaaucuuucgaauguucu

SEQ ID NO: 286755 - RNA, 22 nt, Homo sapiens
uugagacgaagucucacucuug

SEQ ID NO: 286756 - RNA, 22 nt, Homo sapiens
uugagauacauaauuaugaaug

SEQ ID NO: 286757 - RNA, 22 nt, Homo sapiens
uugagaugaagucuugcucucu

SEQ ID NO: 286758 - RNA, 22 nt, Homo sapiens
uugagaugaaguuuugcucuuu

SEQ ID NO: 286759 - RNA, 22 nt, Homo sapiens
uugagaugauggauaugcuaau

SEQ ID NO: 286760 - RNA, 22 nt, Homo sapiens
uugagauggagucucacucuug

SEQ ID NO: 286761 - RNA, 22 nt, Homo sapiens
uugagauggagucuugcucucu

SEQ ID NO: 286762 - RNA, 22 nt, Homo sapiens
uugagauggaguguugcucugu

SEQ ID NO: 286763 - RNA, 22 nt, Homo sapiens
uugagauggaguuucaauauug

SEQ ID NO: 286764 - RNA, 22 nt, Homo sapiens
uugagauggaguuucacucucg

SEQ ID NO: 286765 - RNA, 22 nt, Homo sapiens
uugagauggaguuuugcucuug

SEQ ID NO: 286766 - RNA, 22 nt, Homo sapiens
uugagauggauagacauagcau

SEQ ID NO: 286767 - RNA, 19 nt, Homo sapiens
uugagaugugaacucacac

SEQ ID NO: 286768 - RNA, 22 nt, Homo sapiens
uugagcacauguguuaaggggu

SEQ ID NO: 286769 - RNA, 22 nt, Homo sapiens
uugagcccuggaggcagaggcu

SEQ ID NO: 286770 - RNA, 22 nt, Homo sapiens
uugagcuauguacagaugcugu

SEQ ID NO: 286771 - RNA, 22 nt, Homo sapiens
uugagcucaucuucagggguga

SEQ ID NO: 286772 - RNA, 22 nt, Homo sapiens
uugaggaagugguuccccagag

SEQ ID NO: 286773 - RNA, 22 nt, Homo sapiens
uugaggaaugugauuucaaaua

SEQ ID NO: 286774 - RNA, 22 nt, Homo sapiens
uugaggacugguugaaagcuuu

SEQ ID NO: 286775 - RNA, 22 nt, Homo sapiens
uugaggaggcagucuguccguu

SEQ ID NO: 286776 - RNA, 22 nt, Homo sapiens
uugagggaagccagaggucugc

SEQ ID NO: 286777 - RNA, 22 nt, Homo sapiens
uugagggaggccucaguuuaca

SEQ ID NO: 286778 - RNA, 22 nt, Homo sapiens
uugagguaggaggagcuuggau

SEQ ID NO: 286779 - RNA, 22 nt, Homo sapiens
uugaggucagagguucgagacc

SEQ ID NO: 286780 - RNA, 22 nt, Homo sapiens
uugaggugaauuugcaggaugc

SEQ ID NO: 286781 - RNA, 22 nt, Homo sapiens
uugagguggugucuugcucugu

SEQ ID NO: 286782 - RNA, 22 nt, Homo sapiens
uugaguagaaguaugucaguau

SEQ ID NO: 286783 - RNA, 22 nt, Homo sapiens
uugaguagugugaugcaugucu

SEQ ID NO: 286784 - RNA, 22 nt, Homo sapiens
uugagugaaugaaugauuaaau

SEQ ID NO: 286785 - RNA, 22 nt, Homo sapiens
uugaguuugaguauucuaaagc

SEQ ID NO: 286786 - RNA, 22 nt, Homo sapiens
uugauagacacauauccaugug

SEQ ID NO: 286787 - RNA, 23 nt, Homo sapiens
uugcaaagccugaaacucuucag

SEQ ID NO: 286788 - RNA, 22 nt, Homo sapiens
uugcaaaguugccaaggaagga

SEQ ID NO: 286789 - RNA, 18 nt, Homo sapiens
uugcaaauucuucccugu

SEQ ID NO: 286790 - RNA, 22 nt, Homo sapiens
uugcaacuuagaaaaaucauuu

SEQ ID NO: 286791 - RNA, 22 nt, Homo sapiens
uugcaagauguucaugggcugu

SEQ ID NO: 286792 - RNA, 22 nt, Homo sapiens
uugcaaguggagcuuccagggc

SEQ ID NO: 286793 - RNA, 22 nt, Homo sapiens
uugcacagugcuuucuuugccc

SEQ ID NO: 286794 - RNA, 22 nt, Homo sapiens
uugcacagugguuuagagccug

SEQ ID NO: 286795 - RNA, 22 nt, Homo sapiens
uugcacauggcuggggaggccu

SEQ ID NO: 286796 - RNA, 22 nt, Homo sapiens
uugcacauguugaaccagcaaa

SEQ ID NO: 286797 - RNA, 22 nt, Homo sapiens
uugcacauugcaccuuuuguau

SEQ ID NO: 286798 - RNA, 22 nt, Homo sapiens
uugcacuccagccugggugaca

SEQ ID NO: 286799 - RNA, 22 nt, Homo sapiens
uugcacugagauuuugcuuaca

SEQ ID NO: 286800 - RNA, 22 nt, Homo sapiens
uugcacuugcugaggagugauu

SEQ ID NO: 286801 - RNA, 22 nt, Homo sapiens
gugcaaacuccaggucucuuca

SEQ ID NO: 286802 - RNA, 22 nt, Homo sapiens
gugcaaaucucugaguaucuuu

SEQ ID NO: 286803 - RNA, 22 nt, Homo sapiens
gugcaagagugacugcaguuuu

SEQ ID NO: 286804 - RNA, 22 nt, Homo sapiens
gugcaaguguaauacagcuagg

SEQ ID NO: 286805 - RNA, 18 nt, Homo sapiens
gugcaaugaauagcagag

SEQ ID NO: 286806 - RNA, 22 nt, Homo sapiens
gugcaaugucaggagaugcagc

SEQ ID NO: 286807 - RNA, 22 nt, Homo sapiens
gugcacaacgugcaaguuuguu

SEQ ID NO: 286808 - RNA, 22 nt, Homo sapiens
gugcacaacgugcaggcuuguu

SEQ ID NO: 286809 - RNA, 22 nt, Homo sapiens
gugcacaacgugcagguuuguu

SEQ ID NO: 286810 - RNA, 22 nt, Homo sapiens
gugcacaaugugcagguuuguu

SEQ ID NO: 286811 - RNA, 22 nt, Homo sapiens
gugcacaugguagguauugagu

SEQ ID NO: 286812 - RNA, 22 nt, Homo sapiens
gugcacgucuuaggaggucacg

SEQ ID NO: 286813 - RNA, 21 nt, Homo sapiens
gugcagaugccacagucacuc

SEQ ID NO: 286814 - RNA, 23 nt, Homo sapiens
gugcaguggcgagauuucggcuc

SEQ ID NO: 286815 - RNA, 22 nt, Homo sapiens
gugcaguguuugcauggaauca

SEQ ID NO: 286816 - RNA, 22 nt, Homo sapiens
gugcaguuugaaaguagaaaca

SEQ ID NO: 286817 - RNA, 22 nt, Homo sapiens
gugcaguuuuaagugaguuucu

SEQ ID NO: 286818 - RNA, 22 nt, Homo sapiens
gugcaugcaucuuuauaguagc

SEQ ID NO: 286819 - RNA, 22 nt, Homo sapiens
gugcaugucuaugcgagucuaa

SEQ ID NO: 286820 - RNA, 22 nt, Homo sapiens
gugcucauuuagagagaagcac

SEQ ID NO: 286821 - RNA, 22 nt, Homo sapiens
guggaaagaacacaaaauuagg

SEQ ID NO: 286822 - RNA, 22 nt, Homo sapiens
guggaagaccagacuuuccaac

SEQ ID NO: 286823 - RNA, 22 nt, Homo sapiens
guggaagcacaggccuccugga

SEQ ID NO: 286824 - RNA, 22 nt, Homo sapiens
guggaagugucuggggccaggg

SEQ ID NO: 286825 - RNA, 22 nt, Homo sapiens
guggaaugaaaacucucucaca

SEQ ID NO: 286826 - RNA, 22 nt, Homo sapiens
guggaggacuggauaaagaaaa

SEQ ID NO: 286827 - RNA, 22 nt, Homo sapiens
guggaucacuugaggucaagag

SEQ ID NO: 286828 - RNA, 22 nt, Homo sapiens
guggaucacuugagguuagaag

SEQ ID NO: 286829 - RNA, 22 nt, Homo sapiens
guggcaaacucagcaugcccca

SEQ ID NO: 286830 - RNA, 22 nt, Homo sapiens
guggcaaggaaaugcugcucac

SEQ ID NO: 286831 - RNA, 22 nt, Homo sapiens
guggcagugugaggauccugcu

SEQ ID NO: 286832 - RNA, 22 nt, Homo sapiens
guggcaugaaagcagauaccac

SEQ ID NO: 286833 - RNA, 22 nt, Homo sapiens
guggcaugaaagcaucugugau

SEQ ID NO: 286834 - RNA, 22 nt, Homo sapiens
guggcuagaaugaagguagcug

SEQ ID NO: 286835 - RNA, 22 nt, Homo sapiens
gugggaagcuggaacucccucc

SEQ ID NO: 286836 - RNA, 18 nt, Homo sapiens
uaacugugggaacuaacu

SEQ ID NO: 286837 - RNA, 22 nt, Homo sapiens
uaagaauucuguccgguauacu

SEQ ID NO: 286838 - RNA, 22 nt, Homo sapiens
uaagacacauguguucccaggc

SEQ ID NO: 286839 - RNA, 23 nt, Homo sapiens
uaagacacuaacuuuaugcuuug

SEQ ID NO: 286840 - RNA, 20 nt, Homo sapiens
uaagacaugguccacaugcc

SEQ ID NO: 286841 - RNA, 21 nt, Homo sapiens
uaagacugccaguagggcugu

SEQ ID NO: 286842 - RNA, 22 nt, Homo sapiens
uaagacugccccagacagcaag

SEQ ID NO: 286843 - RNA, 22 nt, Homo sapiens
uaagacuguguaauuuaugaag

SEQ ID NO: 286844 - RNA, 22 nt, Homo sapiens
uaagagagcuccaucuuuuccu

SEQ ID NO: 286845 - RNA, 22 nt, Homo sapiens
uaagcuagcauagggguaaauu

SEQ ID NO: 286846 - RNA, 22 nt, Homo sapiens
uaagcuguguggacuaugccuc

SEQ ID NO: 286847 - RNA, 22 nt, Homo sapiens
uaaggaguagaauaguaaggca

SEQ ID NO: 286848 - RNA, 22 nt, Homo sapiens
uaaggcacauaggccuggaaac

SEQ ID NO: 286849 - RNA, 22 nt, Homo sapiens
uaaggcacucuucugugugccu

SEQ ID NO: 286850 - RNA, 22 nt, Homo sapiens
uaaggcccauucuaugaagcag

SEQ ID NO: 286851 - RNA, 22 nt, Homo sapiens
uaaggcuagcaagaugagaaua

SEQ ID NO: 286852 - RNA, 22 nt, Homo sapiens
uaaggcuaggaauucucugaag

SEQ ID NO: 286853 - RNA, 22 nt, Homo sapiens
uaaggcucuuguuauuuugagg

SEQ ID NO: 286854 - RNA, 22 nt, Homo sapiens
uaagguauuuacauuucuguuu

SEQ ID NO: 286855 - RNA, 22 nt, Homo sapiens
uaaguaauugcagcaauuugcc

SEQ ID NO: 286856 - RNA, 22 nt, Homo sapiens
uaaguacaugcuagauggaaug

SEQ ID NO: 286857 - RNA, 22 nt, Homo sapiens
uaaguaguccugauuuaaccuu

SEQ ID NO: 286858 - RNA, 22 nt, Homo sapiens
uaaguaguuucuggauauucuc

SEQ ID NO: 286859 - RNA, 22 nt, Homo sapiens
uaagucacuccagguuaaagug

SEQ ID NO: 286860 - RNA, 22 nt, Homo sapiens
uaagugaaggaaguguguuuac

SEQ ID NO: 286861 - RNA, 22 nt, Homo sapiens
uaagugcuguguuguuaccuaa

SEQ ID NO: 286862 - RNA, 22 nt, Homo sapiens
uaaguggaagaugucaaucaua

SEQ ID NO: 286863 - RNA, 23 nt, Homo sapiens
uaaguucaucucuaauaggugga

SEQ ID NO: 286864 - RNA, 22 nt, Homo sapiens
uaaguugcagguugugauucca

SEQ ID NO: 286865 - RNA, 22 nt, Homo sapiens
uaaguuguugacauuaggggaa

SEQ ID NO: 286866 - RNA, 22 nt, Homo sapiens
uaauaauguuaggcuuacucaa

SEQ ID NO: 286867 - RNA, 22 nt, Homo sapiens
uaauacuagugaauagcaggau

SEQ ID NO: 286868 - RNA, 22 nt, Homo sapiens
uaauacugcugugcuugaguug

SEQ ID NO: 286869 - RNA, 22 nt, Homo sapiens
uaauacuguaauggugguuccg

SEQ ID NO: 286870 - RNA, 22 nt, Homo sapiens
uaauaguuggcacuggagaaag

SEQ ID NO: 286871 - RNA, 22 nt, Homo sapiens
uaauaguuucagaaguuguuuu

SEQ ID NO: 286872 - RNA, 22 nt, Homo sapiens
uaaugcacauuuauuuuaccuu

SEQ ID NO: 286873 - RNA, 22 nt, Homo sapiens
uaaugcauacagaagguguuuu

SEQ ID NO: 286874 - RNA, 22 nt, Homo sapiens
uaaugcucauuagcaggccaau

SEQ ID NO: 286875 - RNA, 22 nt, Homo sapiens
uaaugcuccauggguuauuaaa

SEQ ID NO: 286876 - RNA, 22 nt, Homo sapiens
uaauucuguauguaucagaguu

SEQ ID NO: 286877 - RNA, 22 nt, Homo sapiens
uacaagcaggaaaugguauaug

SEQ ID NO: 286878 - RNA, 16 nt, Homo sapiens
uacaauguagaaaaca

SEQ ID NO: 286879 - RNA, 22 nt, Homo sapiens
uacagaguagaagauuugcaga

SEQ ID NO: 286880 - RNA, 22 nt, Homo sapiens
uacagaucaguuauuuuguaga

SEQ ID NO: 286881 - RNA, 22 nt, Homo sapiens
aagcagacauguucauuuugaa

SEQ ID NO: 286882 - RNA, 20 nt, Homo sapiens
aagcagacauuuggaugaaa

SEQ ID NO: 286883 - RNA, 22 nt, Homo sapiens
aagcagauguguugaaaguacu

SEQ ID NO: 286884 - RNA, 22 nt, Homo sapiens
aagcaucacauaauggaucaug

SEQ ID NO: 286885 - RNA, 22 nt, Homo sapiens
aagcucuuguugaaucuuguca

SEQ ID NO: 286886 - RNA, 22 nt, Homo sapiens
aagcugccaggcaugguggcug

SEQ ID NO: 286887 - RNA, 22 nt, Homo sapiens
aagcuggauuuaguguggagca

SEQ ID NO: 286888 - RNA, 22 nt, Homo sapiens
aagcuggcauucaugagauuac

SEQ ID NO: 286889 - RNA, 22 nt, Homo sapiens
aagcuggcuuucauugagugcu

SEQ ID NO: 286890 - RNA, 22 nt, Homo sapiens
aagcuguguguaagcucucaca

SEQ ID NO: 286891 - RNA, 22 nt, Homo sapiens
aaggaagcuagcaggaauuggu

SEQ ID NO: 286892 - RNA, 22 nt, Homo sapiens
aaggaaguaauuugguuuauag

SEQ ID NO: 286893 - RNA, 22 nt, Homo sapiens
aaggaauacuggugguugcuau

SEQ ID NO: 286894 - RNA, 22 nt, Homo sapiens
aaggaauucaaauuuucucugg

SEQ ID NO: 286895 - RNA, 23 nt, Homo sapiens
aaggacacugaacacuucccagc

SEQ ID NO: 286896 - RNA, 22 nt, Homo sapiens
aaggagugugauucuucaguuu

SEQ ID NO: 286897 - RNA, 22 nt, Homo sapiens
aaggcaagaagagaaccaucgg

SEQ ID NO: 286898 - RNA, 22 nt, Homo sapiens
aaggcaagaaugcgugcuuuca

SEQ ID NO: 286899 - RNA, 22 nt, Homo sapiens
aaggcaagguggauaaugaagc

SEQ ID NO: 286900 - RNA, 22 nt, Homo sapiens
aaggcaguggcagaagauguca

SEQ ID NO: 286901 - RNA, 22 nt, Homo sapiens
aaggcaugcaguacguuucuau

SEQ ID NO: 286902 - RNA, 22 nt, Homo sapiens
aaggcaugcugaguccuaaaag

SEQ ID NO: 286903 - RNA, 22 nt, Homo sapiens
aaggcgguguggauccuacagc

SEQ ID NO: 286904 - RNA, 22 nt, Homo sapiens
aaggcuagagaagaagggcauc

SEQ ID NO: 286905 - RNA, 22 nt, Homo sapiens
aaggcucuuucaacguaaauua

SEQ ID NO: 286906 - RNA, 22 nt, Homo sapiens
aaggcuguucauuuagcacagu

SEQ ID NO: 286907 - RNA, 22 nt, Homo sapiens
aagggaauguuguagcugguuu

SEQ ID NO: 286908 - RNA, 22 nt, Homo sapiens
aagguacuggaaagaggaaugg

SEQ ID NO: 286909 - RNA, 22 nt, Homo sapiens
aucgcacuccauccugggcaac

SEQ ID NO: 286910 - RNA, 22 nt, Homo sapiens
aucgcgccauuguacuccagcc

SEQ ID NO: 286911 - RNA, 22 nt, Homo sapiens
aucucagagaaaauuacuaaga

SEQ ID NO: 286912 - RNA, 22 nt, Homo sapiens
aucucagcaacuaaagauccuu

SEQ ID NO: 286913 - RNA, 22 nt, Homo sapiens
aucucauggagguagagaguaa

SEQ ID NO: 286914 - RNA, 22 nt, Homo sapiens
aucucuugccagucagaauggu

SEQ ID NO: 286915 - RNA, 22 nt, Homo sapiens
aucugcauuagggugaagaccu

SEQ ID NO: 286916 - RNA, 19 nt, Homo sapiens
aucuggaguuccuggggcu

SEQ ID NO: 286917 - RNA, 22 nt, Homo sapiens
aucuguguuuaaggucccagaa

SEQ ID NO: 286918 - RNA, 22 nt, Homo sapiens
aucuuguccugagguuuuauug

SEQ ID NO: 286919 - RNA, 22 nt, Homo sapiens
aucuuugauuguagguacaaug

SEQ ID NO: 286920 - RNA, 22 nt, Homo sapiens
augaaacuggagcgccuggagg

SEQ ID NO: 286921 - RNA, 22 nt, Homo sapiens
augaaagugauaaaugucucua

SEQ ID NO: 286922 - RNA, 22 nt, Homo sapiens
augaaaucuuuccugugaggau

SEQ ID NO: 286923 - RNA, 22 nt, Homo sapiens
augaaaucuuuggcagaucuua

SEQ ID NO: 286924 - RNA, 22 nt, Homo sapiens
augaaaugcauguuaaguccgu

SEQ ID NO: 286925 - RNA, 22 nt, Homo sapiens
augaaauugcuaucgcaguacu

SEQ ID NO: 286926 - RNA, 22 nt, Homo sapiens
augaacucaucauuuuuuaugg

SEQ ID NO: 286927 - RNA, 19 nt, Homo sapiens
augaacucauucuuuuuau

SEQ ID NO: 286928 - RNA, 17 nt, Homo sapiens
augaagucaucauuuuu

SEQ ID NO: 286929 - RNA, 20 nt, Homo sapiens
augaagugaaguuagggaac

SEQ ID NO: 286930 - RNA, 22 nt, Homo sapiens
augaaguguguguucaagucuu

SEQ ID NO: 286931 - RNA, 22 nt, Homo sapiens
augaaguuagcucauuucuuuu

SEQ ID NO: 286932 - RNA, 22 nt, Homo sapiens
augaaugcuuuuggauguaucu

SEQ ID NO: 286933 - RNA, 23 nt, Homo sapiens
augaauguaaggaguguaagaaa

SEQ ID NO: 286934 - RNA, 20 nt, Homo sapiens
augaauguccuugauggcau

SEQ ID NO: 286935 - RNA, 22 nt, Homo sapiens
augacaagagccuucuuuccuu

SEQ ID NO: 286936 - RNA, 22 nt, Homo sapiens
augacagagauaugugaauuuu

SEQ ID NO: 286937 - RNA, 22 nt, Homo sapiens
augaccuuggggaaccaugucu

SEQ ID NO: 286938 - RNA, 22 nt, Homo sapiens
augaccuuguccucagugucau

SEQ ID NO: 286939 - RNA, 22 nt, Homo sapiens
augacugagacuaacuuacuuu

SEQ ID NO: 286940 - RNA, 22 nt, Homo sapiens
augacuggaacagcaauuuaca

SEQ ID NO: 286941 - RNA, 22 nt, Homo sapiens
augagaacugucaaugagagcu

SEQ ID NO: 286942 - RNA, 18 nt, Homo sapiens
augagagccgauuccugg

SEQ ID NO: 286943 - RNA, 22 nt, Homo sapiens
augagauauguuaaaaguuaaa

SEQ ID NO: 286944 - RNA, 22 nt, Homo sapiens
augagaucaaauuuaagcuguu

SEQ ID NO: 286945 - RNA, 22 nt, Homo sapiens
augagaugaauaccgacgaugu

SEQ ID NO: 286946 - RNA, 22 nt, Homo sapiens
augagaugauaggcguucuaac

SEQ ID NO: 286947 - RNA, 22 nt, Homo sapiens
augagauucuuagagaagucug

SEQ ID NO: 286948 - RNA, 22 nt, Homo sapiens
augagauuguuugugugaaaua

SEQ ID NO: 286949 - RNA, 22 nt, Homo sapiens
augagcaucaccagaaucaaua

SEQ ID NO: 286950 - RNA, 22 nt, Homo sapiens
augagcuaggacagaaugucag

SEQ ID NO: 286951 - RNA, 22 nt, Homo sapiens
augagcucauugggugacuggg

SEQ ID NO: 286952 - RNA, 22 nt, Homo sapiens
augagcuccucaaggucagaga

SEQ ID NO: 286953 - RNA, 22 nt, Homo sapiens
augaggacaucuuccuuaugga

SEQ ID NO: 286954 - RNA, 22 nt, Homo sapiens
augaggcaggaaaggcguaucu

SEQ ID NO: 286955 - RNA, 22 nt, Homo sapiens
augaggugcagaggaaaugagu

SEQ ID NO: 286956 - RNA, 19 nt, Homo sapiens
augagucugcaagaaccag

SEQ ID NO: 286957 - RNA, 22 nt, Homo sapiens
augagugugaccugccaagaga

SEQ ID NO: 286958 - RNA, 19 nt, Homo sapiens
augaguuaggggaaauuuc

SEQ ID NO: 286959 - RNA, 22 nt, Homo sapiens
augauaaguuauuagaagaaga

SEQ ID NO: 286960 - RNA, 22 nt, Homo sapiens
augauaugagaaaggaucaaca

SEQ ID NO: 286961 - RNA, 22 nt, Homo sapiens
augauauguuuguagcuaucuc

SEQ ID NO: 286962 - RNA, 22 nt, Homo sapiens
augauccagugaguuucaguuc

SEQ ID NO: 286963 - RNA, 22 nt, Homo sapiens
augaucuagaguaggaaacaga

SEQ ID NO: 286964 - RNA, 22 nt, Homo sapiens
augaugcaguacuuugggaaca

SEQ ID NO: 286965 - RNA, 22 nt, Homo sapiens
augauggaggccgugauggacg

SEQ ID NO: 286966 - RNA, 22 nt, Homo sapiens
augauguaggccauggguuucu

SEQ ID NO: 286967 - RNA, 22 nt, Homo sapiens
augauuagaacucauuuccagg

SEQ ID NO: 286968 - RNA, 22 nt, Homo sapiens
augauuuuuguaucgccugaug

SEQ ID NO: 286969 - RNA, 22 nt, Homo sapiens
augcaaacaucauagaguguac

SEQ ID NO: 286970 - RNA, 20 nt, Homo sapiens
augcaaacccugcuuugugg

SEQ ID NO: 286971 - RNA, 22 nt, Homo sapiens
augcaagcacacaagaggaaau

SEQ ID NO: 286972 - RNA, 22 nt, Homo sapiens
augcacaguccagcccaugugg

SEQ ID NO: 286973 - RNA, 22 nt, Homo sapiens
augcacuuggcaggaugauucc

SEQ ID NO: 286974 - RNA, 22 nt, Homo sapiens
augcagagaaaucuaaaauaug

SEQ ID NO: 286975 - RNA, 22 nt, Homo sapiens
augcagaucacauuuuucuguc

SEQ ID NO: 286976 - RNA, 22 nt, Homo sapiens
augccacugcauaagguuuuca

SEQ ID NO: 286977 - RNA, 22 nt, Homo sapiens
augccagggagaauuguucaag

SEQ ID NO: 286978 - RNA, 22 nt, Homo sapiens
augcuacuggacaauggugacu

SEQ ID NO: 286979 - RNA, 22 nt, Homo sapiens
augcuguuuugaauucucuaga

SEQ ID NO: 286980 - RNA, 22 nt, Homo sapiens
auggaaagcuguuccuacacaa

SEQ ID NO: 286981 - RNA, 22 nt, Homo sapiens
auggaacauaacuauuugggga

SEQ ID NO: 286982 - RNA, 19 nt, Homo sapiens
auggaacugcuggagccac

SEQ ID NO: 286983 - RNA, 22 nt, Homo sapiens
auggaagaaacgauuuucugga

SEQ ID NO: 286984 - RNA, 22 nt, Homo sapiens
auggaagaaaguuggguucuug

SEQ ID NO: 286985 - RNA, 22 nt, Homo sapiens
auggaagacuccucuuugggua

SEQ ID NO: 286986 - RNA, 22 nt, Homo sapiens
auggaagcugauuagauaguac

SEQ ID NO: 286987 - RNA, 22 nt, Homo sapiens
auggaaugccauuuauaaugga

SEQ ID NO: 286988 - RNA, 22 nt, Homo sapiens
auggaauguaaguuauguuugc

SEQ ID NO: 286989 - RNA, 22 nt, Homo sapiens
auggaauguauagucauguagg

SEQ ID NO: 286990 - RNA, 22 nt, Homo sapiens
auggaauguggaaugguaagua

SEQ ID NO: 286991 - RNA, 22 nt, Homo sapiens
aaggugcuguaagcauccaugu

SEQ ID NO: 286992 - RNA, 22 nt, Homo sapiens
aaggugguuuucucuuggaguc

SEQ ID NO: 286993 - RNA, 22 nt, Homo sapiens
aagguuguauuuaauauacugu

SEQ ID NO: 286994 - RNA, 22 nt, Homo sapiens
aaguacuguuuaaauugcagaa

SEQ ID NO: 286995 - RNA, 19 nt, Homo sapiens
aaguacuugucuuuugaag

SEQ ID NO: 286996 - RNA, 22 nt, Homo sapiens
aaguagcagaggcaagacuuga

SEQ ID NO: 286997 - RNA, 22 nt, Homo sapiens
aaguaguuaggaacauucucuc

SEQ ID NO: 286998 - RNA, 22 nt, Homo sapiens
aaguauuagugaggauauggaa

SEQ ID NO: 286999 - RNA, 22 nt, Homo sapiens
aagucaaggagagaagcuucag

SEQ ID NO: 287000 - RNA, 22 nt, Homo sapiens
aagucauggaggaguaugugag

SEQ ID NO: 287001 - RNA, 23 nt, Homo sapiens
aagugagcuccaauugggugaga

SEQ ID NO: 287002 - RNA, 22 nt, Homo sapiens
aagugaguaauacgucaguugu

SEQ ID NO: 287003 - RNA, 20 nt, Homo sapiens
aagugaguguuaaacugaac

SEQ ID NO: 287004 - RNA, 20 nt, Homo sapiens
aagugcaucguugugucugc

SEQ ID NO: 287005 - RNA, 22 nt, Homo sapiens
aagugccauguggaugggcccu

SEQ ID NO: 287006 - RNA, 22 nt, Homo sapiens
aagugcucuugaaacugccuua

SEQ ID NO: 287007 - RNA, 22 nt, Homo sapiens
aagugguucuaugaguuugcaa

SEQ ID NO: 287008 - RNA, 22 nt, Homo sapiens
aagugguuuuuacaaagacaga

SEQ ID NO: 287009 - RNA, 22 nt, Homo sapiens
aaguguaaguuaauguuuaggu

SEQ ID NO: 287010 - RNA, 22 nt, Homo sapiens
aagugucagaguugcuaaugac

SEQ ID NO: 287011 - RNA, 22 nt, Homo sapiens
aagugucuuaccgggagggagu

SEQ ID NO: 287012 - RNA, 23 nt, Homo sapiens
aaguucaugcucaucuguuacac

SEQ ID NO: 287013 - RNA, 22 nt, Homo sapiens
aauaaagcaggguccuugcacu

SEQ ID NO: 287014 - RNA, 22 nt, Homo sapiens
aauaaagcauggcuacuccaua

SEQ ID NO: 287015 - RNA, 22 nt, Homo sapiens
aauaaagcuuugagcuuugcug

SEQ ID NO: 287016 - RNA, 22 nt, Homo sapiens
aauaaaguaggaggugaggaaa

SEQ ID NO: 287017 - RNA, 20 nt, Homo sapiens
aauaacagccccagggaggu

SEQ ID NO: 287018 - RNA, 22 nt, Homo sapiens
aauaagaaguggaagggaccgg

SEQ ID NO: 287019 - RNA, 22 nt, Homo sapiens
aauaagcugagagaauucuaca

SEQ ID NO: 287020 - RNA, 19 nt, Homo sapiens
aauaaugccagaugucugu

SEQ ID NO: 287021 - RNA, 22 nt, Homo sapiens
aauacugaaaguauuuucaaau

SEQ ID NO: 287022 - RNA, 22 nt, Homo sapiens
aauacugcuuugauguaagcua

SEQ ID NO: 287023 - RNA, 22 nt, Homo sapiens
aauagcacuguagauggaggaa

SEQ ID NO: 287024 - RNA, 22 nt, Homo sapiens
aauagcuguccuuagaagugug

SEQ ID NO: 287025 - RNA, 22 nt, Homo sapiens
aauaguggcuuggacuaaauau

SEQ ID NO: 287026 - RNA, 22 nt, Homo sapiens
aaucccauuucucuguguuuuu

SEQ ID NO: 287027 - RNA, 22 nt, Homo sapiens
aaucccuggacuuucggaggcu

SEQ ID NO: 287028 - RNA, 22 nt, Homo sapiens
aaucgcuuuugguaggcaagga

SEQ ID NO: 287029 - RNA, 22 nt, Homo sapiens
aaucucagagauaucugugucc

SEQ ID NO: 287030 - RNA, 22 nt, Homo sapiens
aaucugggguuguuuggggagu

SEQ ID NO: 287031 - RNA, 22 nt, Homo sapiens
aaugacagugcuaaagaacccu

SEQ ID NO: 287032 - RNA, 17 nt, Homo sapiens
aaugagacauuucugcu

SEQ ID NO: 287033 - RNA, 22 nt, Homo sapiens
aauggcacaagaguaaacuguu

SEQ ID NO: 287034 - RNA, 22 nt, Homo sapiens
aauggcaguagauggaugggua

SEQ ID NO: 287035 - RNA, 18 nt, Homo sapiens
aauggcucuggguucuaa

SEQ ID NO: 287036 - RNA, 22 nt, Homo sapiens
aauggcucuuccuggaguugug

SEQ ID NO: 287037 - RNA, 22 nt, Homo sapiens
aauggcuucuuauugugguuca

SEQ ID NO: 287038 - RNA, 22 nt, Homo sapiens
aaugucaugaguccaaccagaa

SEQ ID NO: 287039 - RNA, 22 nt, Homo sapiens
aaugugcacuauuagggugaua

SEQ ID NO: 287040 - RNA, 22 nt, Homo sapiens
aauuaguugucgugagaguggu

SEQ ID NO: 287041 - RNA, 22 nt, Homo sapiens
aauucuguauuguuuagggacu

SEQ ID NO: 287042 - RNA, 22 nt, Homo sapiens
aauucugugagauggugcagau

SEQ ID NO: 287043 - RNA, 22 nt, Homo sapiens
aauugaaucaugugggcagacu

SEQ ID NO: 287044 - RNA, 22 nt, Homo sapiens
aauugaaugauaugggacauuu

SEQ ID NO: 287045 - RNA, 22 nt, Homo sapiens
aauugaccuaaucugauuacug

SEQ ID NO: 287046 - RNA, 22 nt, Homo sapiens
aauugcuucuguauuuuggaca

SEQ ID NO: 287047 - RNA, 22 nt, Homo sapiens
aauuugucaccucucucccuuu

SEQ ID NO: 287048 - RNA, 22 nt, Homo sapiens
acaaaguaggcagugggcugga

SEQ ID NO: 287049 - RNA, 22 nt, Homo sapiens
acaaagugccuccuuuuagagu

SEQ ID NO: 287050 - RNA, 22 nt, Homo sapiens
uugcagagaaauuucugguuua

SEQ ID NO: 287051 - RNA, 20 nt, Homo sapiens
uugcagagcccaacccugga

SEQ ID NO: 287052 - RNA, 22 nt, Homo sapiens
uugcagcaaagagggaggggca

SEQ ID NO: 287053 - RNA, 22 nt, Homo sapiens
uugcaguaguaacuccuuaccu

SEQ ID NO: 287054 - RNA, 22 nt, Homo sapiens
uugcauaagugcauucugugau

SEQ ID NO: 287055 - RNA, 22 nt, Homo sapiens
uugcauaauaagagggauacgu

SEQ ID NO: 287056 - RNA, 22 nt, Homo sapiens
uugcauaauaagauuggggggg

SEQ ID NO: 287057 - RNA, 22 nt, Homo sapiens
uugcauagacaauauuaaucuu

SEQ ID NO: 287058 - RNA, 19 nt, Homo sapiens
uugcauauguugaaccagc

SEQ ID NO: 287059 - RNA, 22 nt, Homo sapiens
uugcaugcacaguucucaauag

SEQ ID NO: 287060 - RNA, 22 nt, Homo sapiens
uugcauguacguacagagagag

SEQ ID NO: 287061 - RNA, 22 nt, Homo sapiens
uugcaugucauaacugauggaa

SEQ ID NO: 287062 - RNA, 22 nt, Homo sapiens
uugccacuucucuugccccauu

SEQ ID NO: 287063 - RNA, 22 nt, Homo sapiens
uugccuaggcuggagugcagug

SEQ ID NO: 287064 - RNA, 22 nt, Homo sapiens
uugccuauucacucugaugaua

SEQ ID NO: 287065 - RNA, 21 nt, Homo sapiens
uugccugacacuggaagaaau

SEQ ID NO: 287066 - RNA, 22 nt, Homo sapiens
uugcuacauugauugccucuuu

SEQ ID NO: 287067 - RNA, 22 nt, Homo sapiens
uugcuccccaggaaaggaagca

SEQ ID NO: 287068 - RNA, 22 nt, Homo sapiens
uugcuucauucaacauugaggg

SEQ ID NO: 287069 - RNA, 22 nt, Homo sapiens
uuggaaacgucaccuuuuccuu

SEQ ID NO: 287070 - RNA, 22 nt, Homo sapiens
uuggaaauauguuaagugucau

SEQ ID NO: 287071 - RNA, 20 nt, Homo sapiens
uuggaaaugugaauugggag

SEQ ID NO: 287072 - RNA, 22 nt, Homo sapiens
uuggaacacauguuuuucuacc

SEQ ID NO: 287073 - RNA, 22 nt, Homo sapiens
uuggaagagaagggagauaaac

SEQ ID NO: 287074 - RNA, 22 nt, Homo sapiens
uuggaagauuacuuaguuuucu

SEQ ID NO: 287075 - RNA, 22 nt, Homo sapiens
uuggaaggcuccuaaugaaugg

SEQ ID NO: 287076 - RNA, 22 nt, Homo sapiens
uuggaaggcugaauggccucuc

SEQ ID NO: 287077 - RNA, 22 nt, Homo sapiens
uuggaagguaaucaaaaguucu

SEQ ID NO: 287078 - RNA, 22 nt, Homo sapiens
uuggaaguguguauguauagcu

SEQ ID NO: 287079 - RNA, 23 nt, Homo sapiens
uuggaaugagaccuaagaguuuu

SEQ ID NO: 287080 - RNA, 22 nt, Homo sapiens
uuggaaugugacugauaauauu

SEQ ID NO: 287081 - RNA, 22 nt, Homo sapiens
uuggacaagauugcagagaauu

SEQ ID NO: 287082 - RNA, 22 nt, Homo sapiens
uuggacugagaguuccaccauu

SEQ ID NO: 287083 - RNA, 22 nt, Homo sapiens
uuggagagaaaggcaguuccug

SEQ ID NO: 287084 - RNA, 22 nt, Homo sapiens
uuggagagugauauucagaugc

SEQ ID NO: 287085 - RNA, 22 nt, Homo sapiens
uuggagugugagagcagccugg

SEQ ID NO: 287086 - RNA, 22 nt, Homo sapiens
uuggaguguucugguccgggcu

SEQ ID NO: 287087 - RNA, 22 nt, Homo sapiens
uuggauuuugguggcaacucau

SEQ ID NO: 287088 - RNA, 22 nt, Homo sapiens
uuggcaaaugucacaaaucagg

SEQ ID NO: 287089 - RNA, 22 nt, Homo sapiens
uuggcaagaaccuucuuccaag

SEQ ID NO: 287090 - RNA, 22 nt, Homo sapiens
uuggcaaucaauucugacgucu

SEQ ID NO: 287091 - RNA, 22 nt, Homo sapiens
uuggcaauucagauucuuuuau

SEQ ID NO: 287092 - RNA, 22 nt, Homo sapiens
uuggcacgugguggggcucgga

SEQ ID NO: 287093 - RNA, 22 nt, Homo sapiens
uuggcacuugauaauauucugg

SEQ ID NO: 287094 - RNA, 22 nt, Homo sapiens
uuggcagcacgcaguccagagg

SEQ ID NO: 287095 - RNA, 22 nt, Homo sapiens
uuggcagcuguggaaucugggc

SEQ ID NO: 287096 - RNA, 22 nt, Homo sapiens
uuggcagugguucugacggacc

SEQ ID NO: 287097 - RNA, 22 nt, Homo sapiens
uuggccauggagcacuuuucua

SEQ ID NO: 287098 - RNA, 19 nt, Homo sapiens
uuggcccugguucucuucu

SEQ ID NO: 287099 - RNA, 22 nt, Homo sapiens
uuggccuuuucaaugccucuuu

SEQ ID NO: 287100 - RNA, 22 nt, Homo sapiens
uuggcuaugaguccuaugugca

SEQ ID NO: 287101 - RNA, 22 nt, Homo sapiens
uuggcuguguuccucaaggagu

SEQ ID NO: 287102 - RNA, 22 nt, Homo sapiens
uuggcuguguuuauaugcugga

SEQ ID NO: 287103 - RNA, 22 nt, Homo sapiens
uuggcuucuggacuauugugca

SEQ ID NO: 287104 - RNA, 22 nt, Homo sapiens
uuggcuuggagaguugaaaugu

SEQ ID NO: 287105 - RNA, 22 nt, Homo sapiens
uuggcuuguaaaaugaaaagcu

SEQ ID NO: 287106 - RNA, 17 nt, Homo sapiens
uugggcaagguagguga

SEQ ID NO: 287107 - RNA, 22 nt, Homo sapiens
uugggguaggaauauggaauga

SEQ ID NO: 287108 - RNA, 21 nt, Homo sapiens
uugguccacaugucauaguua

SEQ ID NO: 287109 - RNA, 22 nt, Homo sapiens
uugguccauuacauugaugaca

SEQ ID NO: 287110 - RNA, 22 nt, Homo sapiens
uugguccccuucaaccagcugu

SEQ ID NO: 287111 - RNA, 22 nt, Homo sapiens
uugguuccuuagccuaggacua

SEQ ID NO: 287112 - RNA, 22 nt, Homo sapiens
uugguuuccuuccugcuuaacu

SEQ ID NO: 287113 - RNA, 22 nt, Homo sapiens
uuguaaacaucuguacauugcu

SEQ ID NO: 287114 - RNA, 22 nt, Homo sapiens
uuguaaagaucauaugcuguuc

SEQ ID NO: 287115 - RNA, 22 nt, Homo sapiens
uuguacaggaguguaagcuuca

SEQ ID NO: 287116 - RNA, 22 nt, Homo sapiens
uuguacuucagacaugccaaag

SEQ ID NO: 287117 - RNA, 22 nt, Homo sapiens
uuguagaucuucaguugcuaca

SEQ ID NO: 287118 - RNA, 22 nt, Homo sapiens
uuguauacucuauuuuagcagu

SEQ ID NO: 287119 - RNA, 22 nt, Homo sapiens
uuguauaggcucaguaagaauc

SEQ ID NO: 287120 - RNA, 22 nt, Homo sapiens
uuguauaguucuauguguuuug

SEQ ID NO: 287121 - RNA, 21 nt, Homo sapiens
uuguaugguugaacuugauac

SEQ ID NO: 287122 - RNA, 22 nt, Homo sapiens
uuguaugucuucauuugaaaaa

SEQ ID NO: 287123 - RNA, 22 nt, Homo sapiens
uugucaacaugaaacuguguuu

SEQ ID NO: 287124 - RNA, 22 nt, Homo sapiens
uugucaaugggugagugcagag

SEQ ID NO: 287125 - RNA, 22 nt, Homo sapiens
uugucacccuacauaacaggga

SEQ ID NO: 287126 - RNA, 22 nt, Homo sapiens
uugucacucuuccuaggguagg

SEQ ID NO: 287127 - RNA, 22 nt, Homo sapiens
uugucuugcagcuuaggcauca

SEQ ID NO: 287128 - RNA, 22 nt, Homo sapiens
uugugaaugaugucgcaauaaa

SEQ ID NO: 287129 - RNA, 22 nt, Homo sapiens
uugugaauggugccgcaauaaa

SEQ ID NO: 287130 - RNA, 22 nt, Homo sapiens
uugugaauggugccgcgauaaa

SEQ ID NO: 287131 - RNA, 22 nt, Homo sapiens
uugugacacagcugggccuaua

SEQ ID NO: 287132 - RNA, 22 nt, Homo sapiens
uugugaucauugucaaauagug

SEQ ID NO: 287133 - RNA, 22 nt, Homo sapiens
uugugcauguauauuaguucac

SEQ ID NO: 287134 - RNA, 22 nt, Homo sapiens
uugugccccuucucagucgggc

SEQ ID NO: 287135 - RNA, 22 nt, Homo sapiens
uugugcuucaucaccuagcaga

SEQ ID NO: 287136 - RNA, 22 nt, Homo sapiens
uugugggaggugauuagaucau

SEQ ID NO: 287137 - RNA, 22 nt, Homo sapiens
uugugguaggaugaagagauga

SEQ ID NO: 287138 - RNA, 22 nt, Homo sapiens
uugugguuuuuaaaacuaggug

SEQ ID NO: 287139 - RNA, 22 nt, Homo sapiens
uuguguacuacaguaugccaca

SEQ ID NO: 287140 - RNA, 22 nt, Homo sapiens
uuguguccccacccaaaucuca

SEQ ID NO: 287141 - RNA, 22 nt, Homo sapiens
uuguguuuuuaguagggaaggg

SEQ ID NO: 287142 - RNA, 22 nt, Homo sapiens
uuguucaggagguuggggaugc

SEQ ID NO: 287143 - RNA, 22 nt, Homo sapiens
uuuaaagcacggaguuuguggc

SEQ ID NO: 287144 - RNA, 22 nt, Homo sapiens
uuuaagccaggugcaguggcuc

SEQ ID NO: 287145 - RNA, 23 nt, Homo sapiens
uuuaagcuucauguccuaacauc

SEQ ID NO: 287146 - RNA, 22 nt, Homo sapiens
uuuaaguguuuguuccugaaaa

SEQ ID NO: 287147 - RNA, 22 nt, Homo sapiens
uuuacaguuuucuaggcuacca

SEQ ID NO: 287148 - RNA, 22 nt, Homo sapiens
uuuagcaauucauuuugugucu

SEQ ID NO: 287149 - RNA, 22 nt, Homo sapiens
uuuaguucauuaaggaaucucc

SEQ ID NO: 287150 - RNA, 22 nt, Homo sapiens
uuuauagucaggaacuugagga

SEQ ID NO: 287151 - RNA, 22 nt, Homo sapiens
uuuauggcaugcucccucucaa

SEQ ID NO: 287152 - RNA, 22 nt, Homo sapiens
uuuaugucuguacaucgggcgg

SEQ ID NO: 287153 - RNA, 22 nt, Homo sapiens
uuucaagugcugucuuagcugu

SEQ ID NO: 287154 - RNA, 19 nt, Homo sapiens
uuucaauguaaggauggag

SEQ ID NO: 287155 - RNA, 19 nt, Homo sapiens
uuucacacucgccuacuuc

SEQ ID NO: 287156 - RNA, 23 nt, Homo sapiens
uuucacagaaggauuguagggcc

SEQ ID NO: 287157 - RNA, 22 nt, Homo sapiens
uuucacuagccagcccuuuauu

SEQ ID NO: 287158 - RNA, 22 nt, Homo sapiens
uuucagagucaucugcccaagu

SEQ ID NO: 287159 - RNA, 22 nt, Homo sapiens
uuucaggcaagggugacccuga

SEQ ID NO: 287160 - RNA, 22 nt, Homo sapiens
uuucauagaucaugcuuuugga

SEQ ID NO: 287161 - RNA, 16 nt, Homo sapiens
uuucaucaguuuuaau

SEQ ID NO: 287162 - RNA, 22 nt, Homo sapiens
uuucauggaggauuugcuucuu

SEQ ID NO: 287163 - RNA, 19 nt, Homo sapiens
uuucccugcagaccuacua

SEQ ID NO: 287164 - RNA, 22 nt, Homo sapiens
uuucgguuaucuagcuuuauga

SEQ ID NO: 287165 - RNA, 22 nt, Homo sapiens
uuucuauguugaccagucuaga

SEQ ID NO: 287166 - RNA, 17 nt, Homo sapiens
uuucucagcccucuucu

SEQ ID NO: 287167 - RNA, 20 nt, Homo sapiens
uuucuccccuauaaaucuca

SEQ ID NO: 287168 - RNA, 22 nt, Homo sapiens
uuucugagaccaaaacuuguaa

SEQ ID NO: 287169 - RNA, 22 nt, Homo sapiens
uuucugaggccucaccagaagc

SEQ ID NO: 287170 - RNA, 22 nt, Homo sapiens
uuucugcuugagagaauugcug

SEQ ID NO: 287171 - RNA, 21 nt, Homo sapiens
uuucugggggagcauggcagg

SEQ ID NO: 287172 - RNA, 22 nt, Homo sapiens
uuucuuggagcucuuagggucg

SEQ ID NO: 287173 - RNA, 22 nt, Homo sapiens
uuugaagcuaaggugcuugguu

SEQ ID NO: 287174 - RNA, 22 nt, Homo sapiens
uuugaagugugaugccuugaug

SEQ ID NO: 287175 - RNA, 22 nt, Homo sapiens
uuugaauguaaugagcaggaag

SEQ ID NO: 287176 - RNA, 22 nt, Homo sapiens
uuugacuaccaggaauguucuu

SEQ ID NO: 287177 - RNA, 22 nt, Homo sapiens
uuugacucacagccuggcugcc

SEQ ID NO: 287178 - RNA, 22 nt, Homo sapiens
uuugacuuuuagaauaugaguu

SEQ ID NO: 287179 - RNA, 22 nt, Homo sapiens
uuugagaucuuuagaaucaggc

SEQ ID NO: 287180 - RNA, 22 nt, Homo sapiens
uuugagcaggcuaaucaauaua

SEQ ID NO: 287181 - RNA, 22 nt, Homo sapiens
uuugagcauguaguuuaacccu

SEQ ID NO: 287182 - RNA, 22 nt, Homo sapiens
uuugaggaaaggcauaaguagg

SEQ ID NO: 287183 - RNA, 22 nt, Homo sapiens
uuugaguaggcuuauauuuugg

SEQ ID NO: 287184 - RNA, 22 nt, Homo sapiens
uuugagugugauaucgauugga

SEQ ID NO: 287185 - RNA, 22 nt, Homo sapiens
uuugaguuugaggugcugauga

SEQ ID NO: 287186 - RNA, 22 nt, Homo sapiens
uuugauuguacuaaaauuguac

SEQ ID NO: 287187 - RNA, 22 nt, Homo sapiens
uuugcacauauuugggcaaaag

SEQ ID NO: 287188 - RNA, 22 nt, Homo sapiens
uuugcaccuuccuaguggcuga

SEQ ID NO: 287189 - RNA, 22 nt, Homo sapiens
uuugcacuugaaaacacucuca

SEQ ID NO: 287190 - RNA, 22 nt, Homo sapiens
uuugcagagacuuguuaggaau

SEQ ID NO: 287191 - RNA, 22 nt, Homo sapiens
uuugcagagucuuucgcugggc

SEQ ID NO: 287192 - RNA, 22 nt, Homo sapiens
uuugcauauguugaaccagccu

SEQ ID NO: 287193 - RNA, 22 nt, Homo sapiens
uuugcaucuuuugcuuccugga

SEQ ID NO: 287194 - RNA, 22 nt, Homo sapiens
uuugccaauauuuuacugagga

SEQ ID NO: 287195 - RNA, 22 nt, Homo sapiens
uuugccuguagacacuuacccu

SEQ ID NO: 287196 - RNA, 22 nt, Homo sapiens
uuugcuauagugaauagugcug

SEQ ID NO: 287197 - RNA, 22 nt, Homo sapiens
uuugcugagucauuccaugcug

SEQ ID NO: 287198 - RNA, 22 nt, Homo sapiens
uuugcuuguguaaaaaucugga

SEQ ID NO: 287199 - RNA, 22 nt, Homo sapiens
uuuggaaugaaacagcagagcc

SEQ ID NO: 287200 - RNA, 22 nt, Homo sapiens
uuuggaaugugcacucagauug

SEQ ID NO: 287201 - RNA, 22 nt, Homo sapiens
uuuggacuucuagccuccagag

SEQ ID NO: 287202 - RNA, 22 nt, Homo sapiens
uuuggcaacguuggaucccuca

SEQ ID NO: 287203 - RNA, 22 nt, Homo sapiens
uuuggcagaaaacuaaaaggua

SEQ ID NO: 287204 - RNA, 22 nt, Homo sapiens
uuuggcaugggcuauuugcuuu

SEQ ID NO: 287205 - RNA, 23 nt, Homo sapiens
uuuggcauuccagaaauuuucau

SEQ ID NO: 287206 - RNA, 22 nt, Homo sapiens
uuuggcauuuuacuacucaaau

SEQ ID NO: 287207 - RNA, 21 nt, Homo sapiens
ugagcauuaguacaguaggga

SEQ ID NO: 287208 - RNA, 23 nt, Homo sapiens
ugagccaugggacuccaagggag

SEQ ID NO: 287209 - RNA, 17 nt, Homo sapiens
ugagcuaagauuacccc

SEQ ID NO: 287210 - RNA, 22 nt, Homo sapiens
ugagcucagcuaguugaggugu

SEQ ID NO: 287211 - RNA, 22 nt, Homo sapiens
ugagcugagaucacacuacugu

SEQ ID NO: 287212 - RNA, 18 nt, Homo sapiens
ugaggaaaggguuugcua

SEQ ID NO: 287213 - RNA, 22 nt, Homo sapiens
ugaggaaugaccccgugugguc

SEQ ID NO: 287214 - RNA, 22 nt, Homo sapiens
ugaggcacucccuagcggggug

SEQ ID NO: 287215 - RNA, 22 nt, Homo sapiens
ugaggcuaggauaggcugauuc

SEQ ID NO: 287216 - RNA, 22 nt, Homo sapiens
ugagggcguauccuucauuaag

SEQ ID NO: 287217 - RNA, 22 nt, Homo sapiens
ugaggguauagccagcccuuag

SEQ ID NO: 287218 - RNA, 22 nt, Homo sapiens
ugagguaaugcuguagcuguga

SEQ ID NO: 287219 - RNA, 22 nt, Homo sapiens
ugagguagaaugauucuaauau

SEQ ID NO: 287220 - RNA, 22 nt, Homo sapiens
ugagguagaggugaacuugacc

SEQ ID NO: 287221 - RNA, 22 nt, Homo sapiens
ugagguagguaccauuaucacu

SEQ ID NO: 287222 - RNA, 22 nt, Homo sapiens
ugaggucauucaugugggcgca

SEQ ID NO: 287223 - RNA, 22 nt, Homo sapiens
ugaggugaggguaucaaaugcu

SEQ ID NO: 287224 - RNA, 22 nt, Homo sapiens
ugagguuauuuguucaagaagu

SEQ ID NO: 287225 - RNA, 22 nt, Homo sapiens
ugagguugaaggacauuuuuau

SEQ ID NO: 287226 - RNA, 22 nt, Homo sapiens
ugagguugucagugucauucuu

SEQ ID NO: 287227 - RNA, 22 nt, Homo sapiens
ugaguacugauuuaagauacac

SEQ ID NO: 287228 - RNA, 22 nt, Homo sapiens
ugaguauagaucaguucaagug

SEQ ID NO: 287229 - RNA, 22 nt, Homo sapiens
ugaguaugaguucaggaaaggc

SEQ ID NO: 287230 - RNA, 22 nt, Homo sapiens
ugagucaauucuaacaauggca

SEQ ID NO: 287231 - RNA, 22 nt, Homo sapiens
ugagucagucucacucugcugc

SEQ ID NO: 287232 - RNA, 22 nt, Homo sapiens
ugagucaugcuggagucauggc

SEQ ID NO: 287233 - RNA, 22 nt, Homo sapiens
ugagucgagauugcgccacugu

SEQ ID NO: 287234 - RNA, 22 nt, Homo sapiens
ugagugugacuuagcagaagga

SEQ ID NO: 287235 - RNA, 22 nt, Homo sapiens
ugaguuaauuuuuguaucaugu

SEQ ID NO: 287236 - RNA, 22 nt, Homo sapiens
ugaguuauuaguagaggcuaug

SEQ ID NO: 287237 - RNA, 22 nt, Homo sapiens
ugaguucaauguuaaugaagca

SEQ ID NO: 287238 - RNA, 22 nt, Homo sapiens
ugaguucaugcuuguaguucua

SEQ ID NO: 287239 - RNA, 22 nt, Homo sapiens
ugaguuccuuucccaguccagu

SEQ ID NO: 287240 - RNA, 22 nt, Homo sapiens
ugaguucuuuuacauuuugaau

SEQ ID NO: 287241 - RNA, 22 nt, Homo sapiens
ugaguuguugcauucuuggugu

SEQ ID NO: 287242 - RNA, 22 nt, Homo sapiens
ugaguuuaucuaaagaccuggg

SEQ ID NO: 287243 - RNA, 22 nt, Homo sapiens
ugauaagaaauuguucauguag

SEQ ID NO: 287244 - RNA, 22 nt, Homo sapiens
ugauagaucugggcaaaguaaa

SEQ ID NO: 287245 - RNA, 21 nt, Homo sapiens
ugauaugguuuggauaugugu

SEQ ID NO: 287246 - RNA, 22 nt, Homo sapiens
ugauaugugaguauaugguuau

SEQ ID NO: 287247 - RNA, 22 nt, Homo sapiens
ugauccccucacauuauuauau

SEQ ID NO: 287248 - RNA, 22 nt, Homo sapiens
ugaucuguccaccucagcuucc

SEQ ID NO: 287249 - RNA, 22 nt, Homo sapiens
ugaugcugaguggcuauuugaa

SEQ ID NO: 287250 - RNA, 22 nt, Homo sapiens
ugauggcauuucauguuuguaa

SEQ ID NO: 287251 - RNA, 22 nt, Homo sapiens
ugaugguccauaguucauggua

SEQ ID NO: 287252 - RNA, 22 nt, Homo sapiens
ugauguguuuuguaguucaacu

SEQ ID NO: 287253 - RNA, 22 nt, Homo sapiens
ugauguugaauuguucagcguc

SEQ ID NO: 287254 - RNA, 21 nt, Homo sapiens
ugauguugaccuaaguaguga

SEQ ID NO: 287255 - RNA, 22 nt, Homo sapiens
ugauguugacuguaggcagaga

SEQ ID NO: 287256 - RNA, 22 nt, Homo sapiens
ugauuagagcccaagcuuugaa

SEQ ID NO: 287257 - RNA, 22 nt, Homo sapiens
ugauuuccaugagaacaugccu

SEQ ID NO: 287258 - RNA, 19 nt, Homo sapiens
ugcaaagucuuuuccuauu

SEQ ID NO: 287259 - RNA, 22 nt, Homo sapiens
ugcaaaugucaaggguuagugu

SEQ ID NO: 287260 - RNA, 19 nt, Homo sapiens
ugcaaauucuaaaaacuga

SEQ ID NO: 287261 - RNA, 22 nt, Homo sapiens
ugcaagaaucuuucaggcuagc

SEQ ID NO: 287262 - RNA, 22 nt, Homo sapiens
ugcaagaugauuucaauugaua

SEQ ID NO: 287263 - RNA, 22 nt, Homo sapiens
aagagugucuuugugcuggccc

SEQ ID NO: 287264 - RNA, 22 nt, Homo sapiens
aagaguuaguaaaauuuccucu

SEQ ID NO: 287265 - RNA, 22 nt, Homo sapiens
aagauaguaaacauuuucugcu

SEQ ID NO: 287266 - RNA, 22 nt, Homo sapiens
aagaucaucauagagggcauga

SEQ ID NO: 287267 - RNA, 22 nt, Homo sapiens
aagaugauguucuuuuucuuag

SEQ ID NO: 287268 - RNA, 20 nt, Homo sapiens
aagcaagcauuugcaaucau

SEQ ID NO: 287269 - RNA, 22 nt, Homo sapiens
aagcaggugugggaggaaaugg

SEQ ID NO: 287270 - RNA, 20 nt, Homo sapiens
aagcauggguuuuaggguca

SEQ ID NO: 287271 - RNA, 22 nt, Homo sapiens
aagcuacauuuuauuuauguca

SEQ ID NO: 287272 - RNA, 22 nt, Homo sapiens
aagcuccauuucugccaugaga

SEQ ID NO: 287273 - RNA, 22 nt, Homo sapiens
aagcuggagugcaguggugcaa

SEQ ID NO: 287274 - RNA, 22 nt, Homo sapiens
aagcugguguguauuauucacu

SEQ ID NO: 287275 - RNA, 22 nt, Homo sapiens
aaggaguaucuguuuucucacc

SEQ ID NO: 287276 - RNA, 22 nt, Homo sapiens
aaggaguauugaaugaccaagu

SEQ ID NO: 287277 - RNA, 22 nt, Homo sapiens
aaggcaacgugaguuguugauu

SEQ ID NO: 287278 - RNA, 22 nt, Homo sapiens
aaggcaagagaaaauuucgagu

SEQ ID NO: 287279 - RNA, 22 nt, Homo sapiens
aaggcacugaacuuaaauucug

SEQ ID NO: 287280 - RNA, 22 nt, Homo sapiens
aaggcagugugcacauaacacu

SEQ ID NO: 287281 - RNA, 22 nt, Homo sapiens
aaggcauggugacuauuuaggc

SEQ ID NO: 287282 - RNA, 22 nt, Homo sapiens
aagggaauguuguggcugguug

SEQ ID NO: 287283 - RNA, 22 nt, Homo sapiens
aagggaauguugugguugguuu

SEQ ID NO: 287284 - RNA, 23 nt, Homo sapiens
aagguaagcuagaaagauguaga

SEQ ID NO: 287285 - RNA, 22 nt, Homo sapiens
aaggucauugugguuuuugcca

SEQ ID NO: 287286 - RNA, 18 nt, Homo sapiens
aaggugcuucuguucuga

SEQ ID NO: 287287 - RNA, 22 nt, Homo sapiens
aaguaaacauuuuguacaauaa

SEQ ID NO: 287288 - RNA, 19 nt, Homo sapiens
aaguaguugugacagaugc

SEQ ID NO: 287289 - RNA, 18 nt, Homo sapiens
aaguauagagagcccuua

SEQ ID NO: 287290 - RNA, 22 nt, Homo sapiens
aaguaucaggaauaguuauugg

SEQ ID NO: 287291 - RNA, 22 nt, Homo sapiens
aaguauuaagacuaagaggcuu

SEQ ID NO: 287292 - RNA, 22 nt, Homo sapiens
aaguauuagcuaauugugcuua

SEQ ID NO: 287293 - RNA, 22 nt, Homo sapiens
aagucaguuugggagaagcuau

SEQ ID NO: 287294 - RNA, 22 nt, Homo sapiens
aagucaugaagaggaaaggaca

SEQ ID NO: 287295 - RNA, 23 nt, Homo sapiens
aagucauggaaucaaaugaggug

SEQ ID NO: 287296 - RNA, 22 nt, Homo sapiens
aagucauggagaagguggaggu

SEQ ID NO: 287297 - RNA, 22 nt, Homo sapiens
aagugaccuaacaaugaaggcc

SEQ ID NO: 287298 - RNA, 22 nt, Homo sapiens
aagugagaugcaguggaguucc

SEQ ID NO: 287299 - RNA, 22 nt, Homo sapiens
aagugcacuguaagugcaggau

SEQ ID NO: 287300 - RNA, 21 nt, Homo sapiens
aagugcucugggacucuaaau

SEQ ID NO: 287301 - RNA, 22 nt, Homo sapiens
aagugcucuugaaacugucuua

SEQ ID NO: 287302 - RNA, 22 nt, Homo sapiens
aagugcuguccuaccuuuggga

SEQ ID NO: 287303 - RNA, 22 nt, Homo sapiens
aagugcuuacagggaacaugau

SEQ ID NO: 287304 - RNA, 22 nt, Homo sapiens
aagugcuucuuuccucgagaag

SEQ ID NO: 287305 - RNA, 22 nt, Homo sapiens
aagugcuuuacacaugcaugau

SEQ ID NO: 287306 - RNA, 22 nt, Homo sapiens
aagugcuuuguacagggguuga

SEQ ID NO: 287307 - RNA, 22 nt, Homo sapiens
aagugguagggucaggauugga

SEQ ID NO: 287308 - RNA, 22 nt, Homo sapiens
aagugguguuugggagcuggac

SEQ ID NO: 287309 - RNA, 22 nt, Homo sapiens
aagugguuuuaaucuggugagu

SEQ ID NO: 287310 - RNA, 22 nt, Homo sapiens
aaguuaauguuuaagacuccua

SEQ ID NO: 287311 - RNA, 22 nt, Homo sapiens
aaguuguuggaguuccauuguu

SEQ ID NO: 287312 - RNA, 22 nt, Homo sapiens
aauaaagccugucucuuuagag

SEQ ID NO: 287313 - RNA, 22 nt, Homo sapiens
aauaaagucugaagugugcuua

SEQ ID NO: 287314 - RNA, 22 nt, Homo sapiens
aauaagcauaguaccugauagg

SEQ ID NO: 287315 - RNA, 22 nt, Homo sapiens
aauaauggcaccaaagcacaag

SEQ ID NO: 287316 - RNA, 22 nt, Homo sapiens
aauacugagaugugagguacua

SEQ ID NO: 287317 - RNA, 22 nt, Homo sapiens
aauagagucaggguuucaccau

SEQ ID NO: 287318 - RNA, 22 nt, Homo sapiens
aauagcuguuuuuaauuccugc

SEQ ID NO: 287319 - RNA, 22 nt, Homo sapiens
aauagugcugcaaaaacauacg

SEQ ID NO: 287320 - RNA, 22 nt, Homo sapiens
aauauagcuauguacaugucca

SEQ ID NO: 287321 - RNA, 22 nt, Homo sapiens
aauaucacaggguguacacuca

SEQ ID NO: 287322 - RNA, 22 nt, Homo sapiens
aauaucacaguuggguguacac

SEQ ID NO: 287323 - RNA, 22 nt, Homo sapiens
aauaugguuuuaugaagcaauu

SEQ ID NO: 287324 - RNA, 19 nt, Homo sapiens
aauauugacaguggugucu

SEQ ID NO: 287325 - RNA, 22 nt, Homo sapiens
aaucacacuugauguugagcaa

SEQ ID NO: 287326 - RNA, 22 nt, Homo sapiens
aaucacagccagcuuccgcuau

SEQ ID NO: 287327 - RNA, 22 nt, Homo sapiens
aaucacaguuaguaagggagaa

SEQ ID NO: 287328 - RNA, 22 nt, Homo sapiens
aaucacguagcaguagggagaa

SEQ ID NO: 287329 - RNA, 21 nt, Homo sapiens
aaucacugucuguuuccccuu

SEQ ID NO: 287330 - RNA, 22 nt, Homo sapiens
aaucacuuuggcaccaaccuaa

SEQ ID NO: 287331 - RNA, 22 nt, Homo sapiens
aaucccugagcuagacacaaag

SEQ ID NO: 287332 - RNA, 22 nt, Homo sapiens
aauccuguagauucuaauuccu

SEQ ID NO: 287333 - RNA, 22 nt, Homo sapiens
aauccugucuugccauccaaua

SEQ ID NO: 287334 - RNA, 22 nt, Homo sapiens
aaucuguagaaggugcacauuc

SEQ ID NO: 287335 - RNA, 22 nt, Homo sapiens
aaucugucaguuuuguguuaau

SEQ ID NO: 287336 - RNA, 22 nt, Homo sapiens
aaugacacugagcaucuuucau

SEQ ID NO: 287337 - RNA, 22 nt, Homo sapiens
aaugcacauauauuuccuuauu

SEQ ID NO: 287338 - RNA, 22 nt, Homo sapiens
aaugcacuccagccugggcgac

SEQ ID NO: 287339 - RNA, 22 nt, Homo sapiens
aaugcuaucuggaacauuguug

SEQ ID NO: 287340 - RNA, 22 nt, Homo sapiens
aauggcaaauguuuucuguuga

SEQ ID NO: 287341 - RNA, 22 nt, Homo sapiens
aauggcacaccuagcccuaacc

SEQ ID NO: 287342 - RNA, 22 nt, Homo sapiens
aauggcacuuuauaaauguuaa

SEQ ID NO: 287343 - RNA, 22 nt, Homo sapiens
aauggcagaugaaauugucauu

SEQ ID NO: 287344 - RNA, 22 nt, Homo sapiens
aauggcuuuuaauauccauaau

SEQ ID NO: 287345 - RNA, 18 nt, Homo sapiens
aaugggacuacaaagcca

SEQ ID NO: 287346 - RNA, 22 nt, Homo sapiens
auauguaguuucagaaguggaa

SEQ ID NO: 287347 - RNA, 22 nt, Homo sapiens
auauguauuuuaacguguaagg

SEQ ID NO: 287348 - RNA, 22 nt, Homo sapiens
auaugucuauuauuagggcagg

SEQ ID NO: 287349 - RNA, 22 nt, Homo sapiens
auaugugacuucaugcaaggcu

SEQ ID NO: 287350 - RNA, 22 nt, Homo sapiens
auauuacagagaggaccuggga

SEQ ID NO: 287351 - RNA, 22 nt, Homo sapiens
auauuagguuggugcaaaagua

SEQ ID NO: 287352 - RNA, 22 nt, Homo sapiens
auauucacagguaucagagauu

SEQ ID NO: 287353 - RNA, 18 nt, Homo sapiens
auauugcauuggauggau

SEQ ID NO: 287354 - RNA, 22 nt, Homo sapiens
auauugcuccuaauaccacggu

SEQ ID NO: 287355 - RNA, 22 nt, Homo sapiens
auauuggacugugcuaguuaga

SEQ ID NO: 287356 - RNA, 22 nt, Homo sapiens
auauuguacugcuacugguucu

SEQ ID NO: 287357 - RNA, 22 nt, Homo sapiens
aucaaaguaucucaauauggua

SEQ ID NO: 287358 - RNA, 22 nt, Homo sapiens
aucaaauugucauuuuaaggau

SEQ ID NO: 287359 - RNA, 22 nt, Homo sapiens
aucaaguaaucugaguaagagu

SEQ ID NO: 287360 - RNA, 22 nt, Homo sapiens
aucaaguacuguacugaaagug

SEQ ID NO: 287361 - RNA, 22 nt, Homo sapiens
aucacaauuguacguaggagcc

SEQ ID NO: 287362 - RNA, 22 nt, Homo sapiens
aucacacucaccuucuguccuu

SEQ ID NO: 287363 - RNA, 22 nt, Homo sapiens
aucacagaguuaaaacuuucuu

SEQ ID NO: 287364 - RNA, 22 nt, Homo sapiens
aucacagauauggguuuaaauc

SEQ ID NO: 287365 - RNA, 22 nt, Homo sapiens
aucacaguuaagaggugaugaa

SEQ ID NO: 287366 - RNA, 22 nt, Homo sapiens
aucacaguuuuaccauuuggua

SEQ ID NO: 287367 - RNA, 22 nt, Homo sapiens
aucacauggccagguaguaauc

SEQ ID NO: 287368 - RNA, 22 nt, Homo sapiens
aucaccuggaguagcccguccc

SEQ ID NO: 287369 - RNA, 22 nt, Homo sapiens
aucaccuuucccuuucugaauc

SEQ ID NO: 287370 - RNA, 22 nt, Homo sapiens
aucacuggccuuuuuaaaugcu

SEQ ID NO: 287371 - RNA, 22 nt, Homo sapiens
aucacugggagcagccauuaau

SEQ ID NO: 287372 - RNA, 22 nt, Homo sapiens
aucacugggauggaacugcuga

SEQ ID NO: 287373 - RNA, 22 nt, Homo sapiens
aucacuguaaguuuacacuuug

SEQ ID NO: 287374 - RNA, 22 nt, Homo sapiens
aucacuguuuugaugcucggac

SEQ ID NO: 287375 - RNA, 22 nt, Homo sapiens
aucagaaucucuugagaguguu

SEQ ID NO: 287376 - RNA, 22 nt, Homo sapiens
aucagauaccuguugggaaaug

SEQ ID NO: 287377 - RNA, 22 nt, Homo sapiens
aucagauggcuaaaacagaaga

SEQ ID NO: 287378 - RNA, 22 nt, Homo sapiens
aucagauuccacauuuuaucag

SEQ ID NO: 287379 - RNA, 22 nt, Homo sapiens
aucagcagcaugaaaacaggcu

SEQ ID NO: 287380 - RNA, 22 nt, Homo sapiens
aucagcagcaugaaaagcaacu

SEQ ID NO: 287381 - RNA, 22 nt, Homo sapiens
aucagugcagugggaacuagaa

SEQ ID NO: 287382 - RNA, 22 nt, Homo sapiens
aucagugcauaguauuuaauga

SEQ ID NO: 287383 - RNA, 22 nt, Homo sapiens
aucagugcauguuuguugagcu

SEQ ID NO: 287384 - RNA, 21 nt, Homo sapiens
aucauaugcucacuccuagaa

SEQ ID NO: 287385 - RNA, 22 nt, Homo sapiens
aucaucaugcacuacagccugg

SEQ ID NO: 287386 - RNA, 22 nt, Homo sapiens
aucauccugucaggagcuguga

SEQ ID NO: 287387 - RNA, 22 nt, Homo sapiens
aucauugugcaucuucauucca

SEQ ID NO: 287388 - RNA, 22 nt, Homo sapiens
auccacagugucaauguuguga

SEQ ID NO: 287389 - RNA, 22 nt, Homo sapiens
auccagaugggcuuaauguaau

SEQ ID NO: 287390 - RNA, 22 nt, Homo sapiens
auccauguggauaaauguguau

SEQ ID NO: 287391 - RNA, 22 nt, Homo sapiens
aucccaguaaaaauggcuucua

SEQ ID NO: 287392 - RNA, 22 nt, Homo sapiens
auccccugcacggggugucauu

SEQ ID NO: 287393 - RNA, 22 nt, Homo sapiens
aucccgagacuuugcugaaguu

SEQ ID NO: 287394 - RNA, 22 nt, Homo sapiens
aucccugagaacuuuuaauguu

SEQ ID NO: 287395 - RNA, 22 nt, Homo sapiens
aucccugagccugacucucaga

SEQ ID NO: 287396 - RNA, 22 nt, Homo sapiens
auccugagacuuuucugaaguu

SEQ ID NO: 287397 - RNA, 22 nt, Homo sapiens
auccuguagucucacagcccca

SEQ ID NO: 287398 - RNA, 22 nt, Homo sapiens
aucgcaccauugcacuccagca

SEQ ID NO: 287399 - RNA, 22 nt, Homo sapiens
aucuacagccagucugguuugu

SEQ ID NO: 287400 - RNA, 22 nt, Homo sapiens
aucucaguucaggcuggccaca

SEQ ID NO: 287401 - RNA, 22 nt, Homo sapiens
aucucauuccuucugggcugau

SEQ ID NO: 287402 - RNA, 22 nt, Homo sapiens
aucugcauucccauguuuauug

SEQ ID NO: 287403 - RNA, 22 nt, Homo sapiens
aucuggcguuuacuuccuuccu

SEQ ID NO: 287404 - RNA, 22 nt, Homo sapiens
aucuggcuccuuuugacaaugc

SEQ ID NO: 287405 - RNA, 22 nt, Homo sapiens
aucuggcuucuuuuaguccaca

SEQ ID NO: 287406 - RNA, 22 nt, Homo sapiens
aucugguguauuggugcugggu

SEQ ID NO: 287407 - RNA, 22 nt, Homo sapiens
aucugguguccucgugggaguc

SEQ ID NO: 287408 - RNA, 22 nt, Homo sapiens
aucugguguggcugugauccuc

SEQ ID NO: 287409 - RNA, 22 nt, Homo sapiens
aucuucucuugaagggugggga

SEQ ID NO: 287410 - RNA, 22 nt, Homo sapiens
aucuugcauuugcuaaaaugca

SEQ ID NO: 287411 - RNA, 22 nt, Homo sapiens
aucuuugauugaagggacccug

SEQ ID NO: 287412 - RNA, 22 nt, Homo sapiens
aucuuuggcgggaauaucacag

SEQ ID NO: 287413 - RNA, 22 nt, Homo sapiens
aucuuuggugcaugauacuuug

SEQ ID NO: 287414 - RNA, 22 nt, Homo sapiens
augaaaacaugauuugccuguu

SEQ ID NO: 287415 - RNA, 22 nt, Homo sapiens
augaaagucaauccccaagugu

SEQ ID NO: 287416 - RNA, 22 nt, Homo sapiens
augaaaucacugugaugcccua

SEQ ID NO: 287417 - RNA, 22 nt, Homo sapiens
augaaauguaugagucuggguu

SEQ ID NO: 287418 - RNA, 22 nt, Homo sapiens
augaacagagccuugagaaccu

SEQ ID NO: 287419 - RNA, 19 nt, Homo sapiens
augaacucaucauuucuca

SEQ ID NO: 287420 - RNA, 18 nt, Homo sapiens
augaacucaucauuuuua

SEQ ID NO: 287421 - RNA, 20 nt, Homo sapiens
augaaggcaggugugaguuu

SEQ ID NO: 287422 - RNA, 22 nt, Homo sapiens
augaagucguuacuaccaauug

SEQ ID NO: 287423 - RNA, 22 nt, Homo sapiens
augaagugcaugauaguugguu

SEQ ID NO: 287424 - RNA, 22 nt, Homo sapiens
augaauacagcuaugcgugcau

SEQ ID NO: 287425 - RNA, 22 nt, Homo sapiens
augaauacugcugcaaugaaca

SEQ ID NO: 287426 - RNA, 22 nt, Homo sapiens
augaaugcagcacuguuuuucu

SEQ ID NO: 287427 - RNA, 22 nt, Homo sapiens
augacaaugaaucccuguuuca

SEQ ID NO: 287428 - RNA, 22 nt, Homo sapiens
augacauguauuuccaggauuu

SEQ ID NO: 287429 - RNA, 22 nt, Homo sapiens
aaaagugguguuguuucuaaau

SEQ ID NO: 287430 - RNA, 22 nt, Homo sapiens
aaacauugaccucauccuggca

SEQ ID NO: 287431 - RNA, 15 nt, Homo sapiens
aaacccugucucaag

SEQ ID NO: 287432 - RNA, 22 nt, Homo sapiens
aaacugucuucugacaguuucc

SEQ ID NO: 287433 - RNA, 22 nt, Homo sapiens
aaagaguucagguagauuucaa

SEQ ID NO: 287434 - RNA, 22 nt, Homo sapiens
aaagcacugaauaaauuugcuu

SEQ ID NO: 287435 - RNA, 22 nt, Homo sapiens
aaaggcaucauuaguaccaagu

SEQ ID NO: 287436 - RNA, 22 nt, Homo sapiens
aaagggcuguuucuugacuugg

SEQ ID NO: 287437 - RNA, 22 nt, Homo sapiens
aaagggcuuuguaaacuucaag

SEQ ID NO: 287438 - RNA, 22 nt, Homo sapiens
aaaguacugggauuggccgggu

SEQ ID NO: 287439 - RNA, 22 nt, Homo sapiens
aaaguaguagcaguuucugcca

SEQ ID NO: 287440 - RNA, 22 nt, Homo sapiens
aaagucuguuuugucagagacu

SEQ ID NO: 287441 - RNA, 22 nt, Homo sapiens
aaagugauguccaggcuuucag

SEQ ID NO: 287442 - RNA, 22 nt, Homo sapiens
aaagugcacuuggaagagggcc

SEQ ID NO: 287443 - RNA, 22 nt, Homo sapiens
aaagugcaguauuugggcagaa

SEQ ID NO: 287444 - RNA, 22 nt, Homo sapiens
aaagugccuucuauuuuaguga

SEQ ID NO: 287445 - RNA, 22 nt, Homo sapiens
aaagugcugagacagacuggga

SEQ ID NO: 287446 - RNA, 22 nt, Homo sapiens
aaagugcugggauuggccgggc

SEQ ID NO: 287447 - RNA, 22 nt, Homo sapiens
aaagugcuguagacugggcgca

SEQ ID NO: 287448 - RNA, 22 nt, Homo sapiens
aaaguguguuuccaaccugugg

SEQ ID NO: 287449 - RNA, 22 nt, Homo sapiens
aaaguucuguugauagugcuga

SEQ ID NO: 287450 - RNA, 22 nt, Homo sapiens
aaauaguagcugaaugagggaa

SEQ ID NO: 287451 - RNA, 22 nt, Homo sapiens
aaaugacuuuuuaugcagagua

SEQ ID NO: 287452 - RNA, 22 nt, Homo sapiens
aaaugcacaaagauuuugcacu

SEQ ID NO: 287453 - RNA, 22 nt, Homo sapiens
aaaugcagucuuuguucugggc

SEQ ID NO: 287454 - RNA, 22 nt, Homo sapiens
aaaugcaguugguggggauaug

SEQ ID NO: 287455 - RNA, 22 nt, Homo sapiens
aaaugcaucauuaggugauuuu

SEQ ID NO: 287456 - RNA, 22 nt, Homo sapiens
aaaugcccuaaaauggagcauc

SEQ ID NO: 287457 - RNA, 23 nt, Homo sapiens
aaaugcucucaggugccaguaga

SEQ ID NO: 287458 - RNA, 22 nt, Homo sapiens
aaaugcucuguggguaguaaug

SEQ ID NO: 287459 - RNA, 18 nt, Homo sapiens
aaaugcucuucuggaaua

SEQ ID NO: 287460 - RNA, 20 nt, Homo sapiens
aaaugcuguaauguuuggga

SEQ ID NO: 287461 - RNA, 22 nt, Homo sapiens
aaaugggacugggguccuuuga

SEQ ID NO: 287462 - RNA, 22 nt, Homo sapiens
aaauugcacaaguggugauuug

SEQ ID NO: 287463 - RNA, 23 nt, Homo sapiens
aaauuugccuauuauuccuaugg

SEQ ID NO: 287464 - RNA, 22 nt, Homo sapiens
aacaccuugcagggauuaugac

SEQ ID NO: 287465 - RNA, 22 nt, Homo sapiens
aacagauugcugagccccaccc

SEQ ID NO: 287466 - RNA, 22 nt, Homo sapiens
aacagcuaguaccaauccacua

SEQ ID NO: 287467 - RNA, 22 nt, Homo sapiens
aacauagucaugggguaauguu

SEQ ID NO: 287468 - RNA, 22 nt, Homo sapiens
aacauugaacuuggcacaccca

SEQ ID NO: 287469 - RNA, 22 nt, Homo sapiens
aacccugagucaugagucuaga

SEQ ID NO: 287470 - RNA, 22 nt, Homo sapiens
aaccuauaguauugaaaucaag

SEQ ID NO: 287471 - RNA, 22 nt, Homo sapiens
aaccugaagaaaauauuugcug

SEQ ID NO: 287472 - RNA, 22 nt, Homo sapiens
aaccuguaaccauaugaucagu

SEQ ID NO: 287473 - RNA, 22 nt, Homo sapiens
aacuccauuuuagacccuagau

SEQ ID NO: 287474 - RNA, 22 nt, Homo sapiens
aacugcacuaggacagguuuuu

SEQ ID NO: 287475 - RNA, 22 nt, Homo sapiens
aacugccucugacauaggcagg

SEQ ID NO: 287476 - RNA, 22 nt, Homo sapiens
aacuggccugagaugaaaagug

SEQ ID NO: 287477 - RNA, 22 nt, Homo sapiens
aacuugcacuugauugagagcu

SEQ ID NO: 287478 - RNA, 22 nt, Homo sapiens
aagagcauuauuuaguaauuuc

SEQ ID NO: 287479 - RNA, 22 nt, Homo sapiens
ggguucccuucuggcucagggu

SEQ ID NO: 287480 - RNA, 22 nt, Homo sapiens
gguaaguuuggggcuaauuugu

SEQ ID NO: 287481 - RNA, 22 nt, Homo sapiens
ggucaaguaauccuggguguca

SEQ ID NO: 287482 - RNA, 22 nt, Homo sapiens
ggucaggagaaugguaacugag

SEQ ID NO: 287483 - RNA, 22 nt, Homo sapiens
gguccgccugccuuggccuccc

SEQ ID NO: 287484 - RNA, 22 nt, Homo sapiens
ggugacagugguuaaaauuugu

SEQ ID NO: 287485 - RNA, 22 nt, Homo sapiens
ggugagcacagaaugcccugag

SEQ ID NO: 287486 - RNA, 22 nt, Homo sapiens
ggugaggaaaguugaguuucua

SEQ ID NO: 287487 - RNA, 23 nt, Homo sapiens
ggugaggaguacagagucuucau

SEQ ID NO: 287488 - RNA, 22 nt, Homo sapiens
ggugagguaggaaaaguuagga

SEQ ID NO: 287489 - RNA, 22 nt, Homo sapiens
gguggcaaaucugaguggcgcu

SEQ ID NO: 287490 - RNA, 22 nt, Homo sapiens
ggugucuuguuuaauacucauu

SEQ ID NO: 287491 - RNA, 18 nt, Homo sapiens
guaaauguaucuauugcc

SEQ ID NO: 287492 - RNA, 22 nt, Homo sapiens
guaacacaugcugcucucuggu

SEQ ID NO: 287493 - RNA, 20 nt, Homo sapiens
guaacagcacuuucccaaag

SEQ ID NO: 287494 - RNA, 22 nt, Homo sapiens
guaacagucucaacaguggucu

SEQ ID NO: 287495 - RNA, 22 nt, Homo sapiens
guaagagcauguaguggcucua

SEQ ID NO: 287496 - RNA, 22 nt, Homo sapiens
guaauaccuuccccugcuggag

SEQ ID NO: 287497 - RNA, 23 nt, Homo sapiens
guaauacuagucauaguagcagg

SEQ ID NO: 287498 - RNA, 22 nt, Homo sapiens
guaaucucagcuacucaggagg

SEQ ID NO: 287499 - RNA, 22 nt, Homo sapiens
guaaucucagcuacucgggagg

SEQ ID NO: 287500 - RNA, 22 nt, Homo sapiens
guaaucucagcuacuugggagc

SEQ ID NO: 287501 - RNA, 22 nt, Homo sapiens
guaaucucagcuacuugggagu

SEQ ID NO: 287502 - RNA, 22 nt, Homo sapiens
guaaugaacuugaaagccuguu

SEQ ID NO: 287503 - RNA, 22 nt, Homo sapiens
guaaugcacucccaaagaucca

SEQ ID NO: 287504 - RNA, 22 nt, Homo sapiens
ucacuggaggagaggaagugga

SEQ ID NO: 287505 - RNA, 20 nt, Homo sapiens
ucacugugaacuucuugagg

SEQ ID NO: 287506 - RNA, 22 nt, Homo sapiens
ucacuguggaacucaaaaagcu

SEQ ID NO: 287507 - RNA, 22 nt, Homo sapiens
ucacuguguauguauaugcagg

SEQ ID NO: 287508 - RNA, 22 nt, Homo sapiens
ucagacacugcccuccaccugu

SEQ ID NO: 287509 - RNA, 22 nt, Homo sapiens
ucagaguguuuuccaacuuggu

SEQ ID NO: 287510 - RNA, 22 nt, Homo sapiens
ucagaucaugcuuaugauggga

SEQ ID NO: 287511 - RNA, 22 nt, Homo sapiens
ucagaugaugucccuguucuaa

SEQ ID NO: 287512 - RNA, 22 nt, Homo sapiens
ucagaugcauccauaccccacu

SEQ ID NO: 287513 - RNA, 22 nt, Homo sapiens
ucagauguuucuuuaacgcaug

SEQ ID NO: 287514 - RNA, 16 nt, Homo sapiens
ucagcgagggagccag

SEQ ID NO: 287515 - RNA, 22 nt, Homo sapiens
ucagcgcauggucgugcggcau

SEQ ID NO: 287516 - RNA, 21 nt, Homo sapiens
ucagcucaucacugccuggag

SEQ ID NO: 287517 - RNA, 21 nt, Homo sapiens
ucaggaccucuaguuagccag

SEQ ID NO: 287518 - RNA, 20 nt, Homo sapiens
ucaggcuccgcauuaacuua

SEQ ID NO: 287519 - RNA, 23 nt, Homo sapiens
ucagguaggccuagaguauucuu

SEQ ID NO: 287520 - RNA, 22 nt, Homo sapiens
ucaggucauuccaggagggcca

SEQ ID NO: 287521 - RNA, 22 nt, Homo sapiens
ucaggugccuuggcuaauuguu

SEQ ID NO: 287522 - RNA, 22 nt, Homo sapiens
ucaguagcauugcuuauacagu

SEQ ID NO: 287523 - RNA, 22 nt, Homo sapiens
ucaguaguaaauggauuuggaa

SEQ ID NO: 287524 - RNA, 22 nt, Homo sapiens
ucaguauaugaaucuggggcag

SEQ ID NO: 287525 - RNA, 20 nt, Homo sapiens
ucaguauauuguuuccacag

SEQ ID NO: 287526 - RNA, 22 nt, Homo sapiens
ucagucauucacucacucggac

SEQ ID NO: 287527 - RNA, 22 nt, Homo sapiens
ucagugaacgaggaggagggug

SEQ ID NO: 287528 - RNA, 23 nt, Homo sapiens
ucagugaaggaacaacuaaauag

SEQ ID NO: 287529 - RNA, 22 nt, Homo sapiens
ucagugaauauauaacagcgau

SEQ ID NO: 287530 - RNA, 22 nt, Homo sapiens
ucagugcaggaaucucuagcca

SEQ ID NO: 287531 - RNA, 22 nt, Homo sapiens
ucagugcaggaauuuccuuaga

SEQ ID NO: 287532 - RNA, 22 nt, Homo sapiens
ucagugccucaguuuuuaaaga

SEQ ID NO: 287533 - RNA, 19 nt, Homo sapiens
ucagugcuauguaauguag

SEQ ID NO: 287534 - RNA, 21 nt, Homo sapiens
ucagugcugugggcaaggugc

SEQ ID NO: 287535 - RNA, 22 nt, Homo sapiens
ucagugcuguuugcccucguuu

SEQ ID NO: 287536 - RNA, 22 nt, Homo sapiens
ucagugcuuuuuguugucauca

SEQ ID NO: 287537 - RNA, 22 nt, Homo sapiens
ucaguggagagcuuccaggauu

SEQ ID NO: 287538 - RNA, 22 nt, Homo sapiens
ucaguggagccucacucugugg

SEQ ID NO: 287539 - RNA, 22 nt, Homo sapiens
ucaguggagcuacaauucuggg

SEQ ID NO: 287540 - RNA, 22 nt, Homo sapiens
ucccuggagcaagagaagaagg

SEQ ID NO: 287541 - RNA, 16 nt, Homo sapiens
ucccugugacaugugc

SEQ ID NO: 287542 - RNA, 22 nt, Homo sapiens
ucccuguuaggcacagauuuau

SEQ ID NO: 287543 - RNA, 22 nt, Homo sapiens
ucccuuucuggaguuucccaag

SEQ ID NO: 287544 - RNA, 22 nt, Homo sapiens
uccucaguggauuggauggugc

SEQ ID NO: 287545 - RNA, 22 nt, Homo sapiens
uccucauggagaaccucugcua

SEQ ID NO: 287546 - RNA, 22 nt, Homo sapiens
uccuucaugcaucaauguaucc

SEQ ID NO: 287547 - RNA, 22 nt, Homo sapiens
uccuucauuugucaacucuagu

SEQ ID NO: 287548 - RNA, 22 nt, Homo sapiens
uccuugagaggacagagccaua

SEQ ID NO: 287549 - RNA, 22 nt, Homo sapiens
uccuugagucugaacuuuggau

SEQ ID NO: 287550 - RNA, 22 nt, Homo sapiens
uccuugagucuuugcucagaug

SEQ ID NO: 287551 - RNA, 22 nt, Homo sapiens
uccuuggucaaaaagaaagugu

SEQ ID NO: 287552 - RNA, 22 nt, Homo sapiens
uccuuggucauggaagagacag

SEQ ID NO: 287553 - RNA, 22 nt, Homo sapiens
uccuugguugauccugugcaga

SEQ ID NO: 287554 - RNA, 22 nt, Homo sapiens
ucgcagcacgagcaugcaaggu

SEQ ID NO: 287555 - RNA, 23 nt, Homo sapiens
ucgcagcauucaauaccaggcag

SEQ ID NO: 287556 - RNA, 19 nt, Homo sapiens
ucgcgccauucuccugccu

SEQ ID NO: 287557 - RNA, 22 nt, Homo sapiens
ucgcugggaaccagagguaaag

SEQ ID NO: 287558 - RNA, 22 nt, Homo sapiens
ucgcugggaagacugaaguguc

SEQ ID NO: 287559 - RNA, 22 nt, Homo sapiens
ucggcucagugcaagcucugcc

SEQ ID NO: 287560 - RNA, 22 nt, Homo sapiens
ucguggccugugaguccucccc

SEQ ID NO: 287561 - RNA, 20 nt, Homo sapiens
ucguugguagagagcagggc

SEQ ID NO: 287562 - RNA, 22 nt, Homo sapiens
ucuaaaguacuacuacuguugg

SEQ ID NO: 287563 - RNA, 22 nt, Homo sapiens
ucuaagaauucauuuauaagcc

SEQ ID NO: 287564 - RNA, 22 nt, Homo sapiens
ucuaaggcaccuagagucauca

SEQ ID NO: 287565 - RNA, 17 nt, Homo sapiens
ucuaauaauaugcauuu

SEQ ID NO: 287566 - RNA, 22 nt, Homo sapiens
ucuaauguaaccugcaaauauu

SEQ ID NO: 287567 - RNA, 21 nt, Homo sapiens
ucuaccuacugcucacaggcu

SEQ ID NO: 287568 - RNA, 22 nt, Homo sapiens
ucuaucacagccccacacucuc

SEQ ID NO: 287569 - RNA, 22 nt, Homo sapiens
ucucaagaugguagaugggaau

SEQ ID NO: 287570 - RNA, 22 nt, Homo sapiens
ucucaaguggucgcaguuagau

SEQ ID NO: 287571 - RNA, 22 nt, Homo sapiens
ucucagcacagucagggcgccu

SEQ ID NO: 287572 - RNA, 22 nt, Homo sapiens
ucucagcggacaggccggccag

SEQ ID NO: 287573 - RNA, 22 nt, Homo sapiens
ucucagugaauguggaaaaagc

SEQ ID NO: 287574 - RNA, 22 nt, Homo sapiens
uggaacacaucuaaggaagcag

SEQ ID NO: 287575 - RNA, 21 nt, Homo sapiens
uggaacgcaaaugagaugaau

SEQ ID NO: 287576 - RNA, 22 nt, Homo sapiens
uggaagacacauaccugauaac

SEQ ID NO: 287577 - RNA, 22 nt, Homo sapiens
uggaagacucaagguggugaau

SEQ ID NO: 287578 - RNA, 22 nt, Homo sapiens
uggaagacucuagucucuugag

SEQ ID NO: 287579 - RNA, 22 nt, Homo sapiens
uggaagacuuuagaggcuuaua

SEQ ID NO: 287580 - RNA, 22 nt, Homo sapiens
uggaagaugggaccucaguuuu

SEQ ID NO: 287581 - RNA, 22 nt, Homo sapiens
uggaaggcuucauauguaaaga

SEQ ID NO: 287582 - RNA, 22 nt, Homo sapiens
uggaaguaaucaugagguagca

SEQ ID NO: 287583 - RNA, 23 nt, Homo sapiens
uggaaguauggaggaggcagaau

SEQ ID NO: 287584 - RNA, 22 nt, Homo sapiens
uggaauggagagagggugcacg

SEQ ID NO: 287585 - RNA, 22 nt, Homo sapiens
uggaaugugaauaacuuccuuc

SEQ ID NO: 287586 - RNA, 22 nt, Homo sapiens
uggaauguuauggcuuuaaucu

SEQ ID NO: 287587 - RNA, 21 nt, Homo sapiens
uggaauguucugacuucaggg

SEQ ID NO: 287588 - RNA, 22 nt, Homo sapiens
uggacaagugcccuccaccuca

SEQ ID NO: 287589 - RNA, 20 nt, Homo sapiens
uggaccagagagguggggac

SEQ ID NO: 287590 - RNA, 19 nt, Homo sapiens
uggaccccuuccuuacacc

SEQ ID NO: 287591 - RNA, 22 nt, Homo sapiens
uggagaacugaugucuccaaga

SEQ ID NO: 287592 - RNA, 22 nt, Homo sapiens
uggagacugaucccucuuuccu

SEQ ID NO: 287593 - RNA, 22 nt, Homo sapiens
uggagagugagggccuccuuaa

SEQ ID NO: 287594 - RNA, 22 nt, Homo sapiens
uggagauguuuaaaauccacug

SEQ ID NO: 287595 - RNA, 22 nt, Homo sapiens
uggagcccuaaacuucuaauau

SEQ ID NO: 287596 - RNA, 22 nt, Homo sapiens
uggaggacugcagaacugaggc

SEQ ID NO: 287597 - RNA, 22 nt, Homo sapiens
ugguauguaugauuaacaugga

SEQ ID NO: 287598 - RNA, 22 nt, Homo sapiens
ugguauuuaauauaugagaguu

SEQ ID NO: 287599 - RNA, 22 nt, Homo sapiens
uggucaaaucugaugugagaaa

SEQ ID NO: 287600 - RNA, 21 nt, Homo sapiens
uggucaguuuucucacuagga

SEQ ID NO: 287601 - RNA, 20 nt, Homo sapiens
ugguccccugagucuggcuu

SEQ ID NO: 287602 - RNA, 22 nt, Homo sapiens
ugguccuuuccauuggagacac

SEQ ID NO: 287603 - RNA, 22 nt, Homo sapiens
uggugagaaaugagaugcuuuu

SEQ ID NO: 287604 - RNA, 20 nt, Homo sapiens
uggugguuuuaugugguuua

SEQ ID NO: 287605 - RNA, 20 nt, Homo sapiens
uggugucuuggaaagagcuc

SEQ ID NO: 287606 - RNA, 20 nt, Homo sapiens
ugguguuugaacagugaaug

SEQ ID NO: 287607 - RNA, 22 nt, Homo sapiens
ugguuagucuguguguauauau

SEQ ID NO: 287608 - RNA, 21 nt, Homo sapiens
ugguugauccuccuagugccu

SEQ ID NO: 287609 - RNA, 22 nt, Homo sapiens
uguaaacuuuugagauugacuu

SEQ ID NO: 287610 - RNA, 22 nt, Homo sapiens
uguaaaucugguuaauuggaua

SEQ ID NO: 287611 - RNA, 16 nt, Homo sapiens
uguaaauguuuugcau

SEQ ID NO: 287612 - RNA, 22 nt, Homo sapiens
uguaacugcuuagaagguuuua

SEQ ID NO: 287613 - RNA, 22 nt, Homo sapiens
uguaagcagcagagacuauccu

SEQ ID NO: 287614 - RNA, 22 nt, Homo sapiens
uguaagcauuauauaauuguug

SEQ ID NO: 287615 - RNA, 22 nt, Homo sapiens
uguaauuuaaaugauccuugga

SEQ ID NO: 287616 - RNA, 19 nt, Homo sapiens
uguacacuguaaaccugug

SEQ ID NO: 287617 - RNA, 22 nt, Homo sapiens
auggacguagauucucaaggau

SEQ ID NO: 287618 - RNA, 22 nt, Homo sapiens
auggacuuuuuguucagugucu

SEQ ID NO: 287619 - RNA, 22 nt, Homo sapiens
auggagagaauuauucucucag

SEQ ID NO: 287620 - RNA, 22 nt, Homo sapiens
auggaggaggaagcugaaacaa

SEQ ID NO: 287621 - RNA, 22 nt, Homo sapiens
auggaguguggaacugggaauc

SEQ ID NO: 287622 - RNA, 22 nt, Homo sapiens
auggauauuuuuugaacauaga

SEQ ID NO: 287623 - RNA, 22 nt, Homo sapiens
auggaucuuucugcuuuugaau

SEQ ID NO: 287624 - RNA, 22 nt, Homo sapiens
auggauuuuaggauacaguuga

SEQ ID NO: 287625 - RNA, 22 nt, Homo sapiens
auggcacuaaguucaacacuua

SEQ ID NO: 287626 - RNA, 22 nt, Homo sapiens
auggcacuuuggacugcuagau

SEQ ID NO: 287627 - RNA, 22 nt, Homo sapiens
auggcagcccucuuuauccaug

SEQ ID NO: 287628 - RNA, 22 nt, Homo sapiens
auggcagcugguuuuacccuag

SEQ ID NO: 287629 - RNA, 22 nt, Homo sapiens
auggcauggugaagucuuugga

SEQ ID NO: 287630 - RNA, 22 nt, Homo sapiens
auggcauggugcaggguuuaag

SEQ ID NO: 287631 - RNA, 22 nt, Homo sapiens
auggcauugaagaguugucccu

SEQ ID NO: 287632 - RNA, 22 nt, Homo sapiens
auggcccaguuugcuaucccua

SEQ ID NO: 287633 - RNA, 22 nt, Homo sapiens
auggcccugaguucaauauauu

SEQ ID NO: 287634 - RNA, 22 nt, Homo sapiens
auggcccuguguggagcugcug

SEQ ID NO: 287635 - RNA, 22 nt, Homo sapiens
auggccgggugcgguggcucac

SEQ ID NO: 287636 - RNA, 22 nt, Homo sapiens
auggccuuuuuaucucaccaag

SEQ ID NO: 287637 - RNA, 22 nt, Homo sapiens
auggcggugugaucuuggcuca

SEQ ID NO: 287638 - RNA, 22 nt, Homo sapiens
auggcucaauucuuucccugaa

SEQ ID NO: 287639 - RNA, 22 nt, Homo sapiens
auggcucaguguguaucuauca

SEQ ID NO: 287640 - RNA, 22 nt, Homo sapiens
auggcucuggauagaaugcagg

SEQ ID NO: 287641 - RNA, 22 nt, Homo sapiens
auggcucuguuuuuuaugcucu

SEQ ID NO: 287642 - RNA, 22 nt, Homo sapiens
auggcuguuuuuuauguuacag

SEQ ID NO: 287643 - RNA, 22 nt, Homo sapiens
auggcuucuuacucuucugcau

SEQ ID NO: 287644 - RNA, 22 nt, Homo sapiens
auggcuugugacccaugcuuca

SEQ ID NO: 287645 - RNA, 22 nt, Homo sapiens
auggcuugugggaacuuuuaaa

SEQ ID NO: 287646 - RNA, 22 nt, Homo sapiens
auggcuuuaagagugucugaau

SEQ ID NO: 287647 - RNA, 22 nt, Homo sapiens
auggcuuuuccugucuugcaug

SEQ ID NO: 287648 - RNA, 22 nt, Homo sapiens
auggcuuuugaccugguaggau

SEQ ID NO: 287649 - RNA, 22 nt, Homo sapiens
augggugaguaugaguugacuu

SEQ ID NO: 287650 - RNA, 18 nt, Homo sapiens
auggguguuggaaaauga

SEQ ID NO: 287651 - RNA, 22 nt, Homo sapiens
augguaguagaugugugguuuu

SEQ ID NO: 287652 - RNA, 22 nt, Homo sapiens
auggucccuguuccaugcuccu

SEQ ID NO: 287653 - RNA, 22 nt, Homo sapiens
augguguccuguuuccccagga

SEQ ID NO: 287654 - RNA, 22 nt, Homo sapiens
auggugugugaauuaaauguua

SEQ ID NO: 287655 - RNA, 22 nt, Homo sapiens
augguuugugcuccuauaagaa

SEQ ID NO: 287656 - RNA, 22 nt, Homo sapiens
auguaaacauuuggucuaaauu

SEQ ID NO: 287657 - RNA, 22 nt, Homo sapiens
auguaaacuacagauuuugggu

SEQ ID NO: 287658 - RNA, 22 nt, Homo sapiens
auguagauaucaagaggcauau

SEQ ID NO: 287659 - RNA, 22 nt, Homo sapiens
auguaugagaguuccagcugau

SEQ ID NO: 287660 - RNA, 22 nt, Homo sapiens
auguauggcagguuugggguuu

SEQ ID NO: 287661 - RNA, 22 nt, Homo sapiens
augucaaggugaagaaagauca

SEQ ID NO: 287662 - RNA, 22 nt, Homo sapiens
augucauagaagccugugaacc

SEQ ID NO: 287663 - RNA, 21 nt, Homo sapiens
augucauggaugacuaauuca

SEQ ID NO: 287664 - RNA, 22 nt, Homo sapiens
auguccuaaucuccuguucuua

SEQ ID NO: 287665 - RNA, 22 nt, Homo sapiens
augugaacaucauagaaugcac

SEQ ID NO: 287666 - RNA, 22 nt, Homo sapiens
augugaaugugaucggauaguc

SEQ ID NO: 287667 - RNA, 22 nt, Homo sapiens
augugacagugguuuuaagcgu

SEQ ID NO: 287668 - RNA, 22 nt, Homo sapiens
augugcaaauuuccaaacucuu

SEQ ID NO: 287669 - RNA, 22 nt, Homo sapiens
augugcaagaucauuaaagcuc

SEQ ID NO: 287670 - RNA, 22 nt, Homo sapiens
augugcacaacgugcagguuug

SEQ ID NO: 287671 - RNA, 22 nt, Homo sapiens
augugcauaugaagcacagaca

SEQ ID NO: 287672 - RNA, 22 nt, Homo sapiens
augugcaugcuguucugccaga

SEQ ID NO: 287673 - RNA, 22 nt, Homo sapiens
augugcuuauagguguauguuu

SEQ ID NO: 287674 - RNA, 22 nt, Homo sapiens
auguggauaucuauaucuggau

SEQ ID NO: 287675 - RNA, 22 nt, Homo sapiens
auguggcuuuccuagaucuuag

SEQ ID NO: 287676 - RNA, 18 nt, Homo sapiens
auguggcuuuugaaggcu

SEQ ID NO: 287677 - RNA, 22 nt, Homo sapiens
augugggaggacuuggcuguug

SEQ ID NO: 287678 - RNA, 22 nt, Homo sapiens
augugguaguuauagugauaag

SEQ ID NO: 287679 - RNA, 22 nt, Homo sapiens
auguggugguagccaggacagg

SEQ ID NO: 287680 - RNA, 23 nt, Homo sapiens
augugguuuuagguguugaacug

SEQ ID NO: 287681 - RNA, 22 nt, Homo sapiens
auguguauuaccucgauuguga

SEQ ID NO: 287682 - RNA, 22 nt, Homo sapiens
augugugaaucccagaaccugu

SEQ ID NO: 287683 - RNA, 22 nt, Homo sapiens
auguguucaucacagcacaauu

SEQ ID NO: 287684 - RNA, 22 nt, Homo sapiens
auguuaacaucuuaguuuucau

SEQ ID NO: 287685 - RNA, 22 nt, Homo sapiens
auguuaagauggaacaugggaa

SEQ ID NO: 287686 - RNA, 22 nt, Homo sapiens
auguuacggaguuuuuauccag

SEQ ID NO: 287687 - RNA, 22 nt, Homo sapiens
auguuagcaucuggcacuaugg

SEQ ID NO: 287688 - RNA, 22 nt, Homo sapiens
auguuauguucuucucuguaua

SEQ ID NO: 287689 - RNA, 22 nt, Homo sapiens
auguuugguagugaauauggua

SEQ ID NO: 287690 - RNA, 22 nt, Homo sapiens
auuaaguaaugguuccaauaau

SEQ ID NO: 287691 - RNA, 22 nt, Homo sapiens
auuaaguugugccugaaaacuu

SEQ ID NO: 287692 - RNA, 22 nt, Homo sapiens
auuaauguaauuaguaaaguug

SEQ ID NO: 287693 - RNA, 22 nt, Homo sapiens
auuacacuuucuauucaaugag

SEQ ID NO: 287694 - RNA, 22 nt, Homo sapiens
auuacuuugcaccaaccuaaua

SEQ ID NO: 287695 - RNA, 22 nt, Homo sapiens
auuagaugguuauaggugugag

SEQ ID NO: 287696 - RNA, 22 nt, Homo sapiens
auuauaguguauacuugaaauu

SEQ ID NO: 287697 - RNA, 22 nt, Homo sapiens
auuauguuguauuuccuugcag

SEQ ID NO: 287698 - RNA, 22 nt, Homo sapiens
auucaaagugcauguucccacu

SEQ ID NO: 287699 - RNA, 22 nt, Homo sapiens
agcuguuuuugugggcauguga

SEQ ID NO: 287700 - RNA, 22 nt, Homo sapiens
agcuucacaaugcagagggcag

SEQ ID NO: 287701 - RNA, 22 nt, Homo sapiens
agcuugugcuguaugaagggcc

SEQ ID NO: 287702 - RNA, 22 nt, Homo sapiens
agcuuguguuuuucuaaguauc

SEQ ID NO: 287703 - RNA, 22 nt, Homo sapiens
agcuuguuuucccauaacuaga

SEQ ID NO: 287704 - RNA, 19 nt, Homo sapiens
agcuuuggcuaacuuucuc

SEQ ID NO: 287705 - RNA, 22 nt, Homo sapiens
agcuuuuugggaggccuuagga

SEQ ID NO: 287706 - RNA, 22 nt, Homo sapiens
aggaaaucuuagcugaggggau

SEQ ID NO: 287707 - RNA, 22 nt, Homo sapiens
aggaaauguuggucccauuucu

SEQ ID NO: 287708 - RNA, 21 nt, Homo sapiens
aggaagacuaugaucaauugg

SEQ ID NO: 287709 - RNA, 22 nt, Homo sapiens
aggaaucuaagguaucagguua

SEQ ID NO: 287710 - RNA, 23 nt, Homo sapiens
aggaauggaaaaccaaguaucau

SEQ ID NO: 287711 - RNA, 22 nt, Homo sapiens
aggacacugauguaugcugugg

SEQ ID NO: 287712 - RNA, 19 nt, Homo sapiens
aggacuaaagacuagaagu

SEQ ID NO: 287713 - RNA, 22 nt, Homo sapiens
aggagaucagccucccugcaac

SEQ ID NO: 287714 - RNA, 21 nt, Homo sapiens
aggagcauucaugacgagguu

SEQ ID NO: 287715 - RNA, 22 nt, Homo sapiens
aggagguaggaauugugcuagg

SEQ ID NO: 287716 - RNA, 22 nt, Homo sapiens
aggagguagggugugaaacagc

SEQ ID NO: 287717 - RNA, 22 nt, Homo sapiens
aggagguugguaccaucuguuu

SEQ ID NO: 287718 - RNA, 22 nt, Homo sapiens
aggcaaaugccagcaaucacac

SEQ ID NO: 287719 - RNA, 21 nt, Homo sapiens
aggcaagacuuuuagguuugu

SEQ ID NO: 287720 - RNA, 21 nt, Homo sapiens
aggcaagauuacuuacgagca

SEQ ID NO: 287721 - RNA, 22 nt, Homo sapiens
aggcaaguugcucaaaugcaaa

SEQ ID NO: 287722 - RNA, 22 nt, Homo sapiens
aggcacacaacccuggaccuga

SEQ ID NO: 287723 - RNA, 22 nt, Homo sapiens
aggcaugauggcuccagaucau

SEQ ID NO: 287724 - RNA, 22 nt, Homo sapiens
aggcaugauuguauuuugcucu

SEQ ID NO: 287725 - RNA, 23 nt, Homo sapiens
aggcauuguacaguaauggaaaa

SEQ ID NO: 287726 - RNA, 22 nt, Homo sapiens
aggccaguuuuuggagggaaac

SEQ ID NO: 287727 - RNA, 22 nt, Homo sapiens
aggcuagaaucuuccaucuugg

SEQ ID NO: 287728 - RNA, 22 nt, Homo sapiens
agggaagugugcuaugcauuua

SEQ ID NO: 287729 - RNA, 22 nt, Homo sapiens
agggcacuguagguccugccuc

SEQ ID NO: 287730 - RNA, 22 nt, Homo sapiens
agguagguugagaugggcauca

SEQ ID NO: 287731 - RNA, 20 nt, Homo sapiens
agguaguuauacaaaugugu

SEQ ID NO: 287732 - RNA, 22 nt, Homo sapiens
agguauauuggacagauguaaa

SEQ ID NO: 287733 - RNA, 22 nt, Homo sapiens
agguauguaugucuguacagcg

SEQ ID NO: 287734 - RNA, 22 nt, Homo sapiens
agguccacuuacuacuccuguu

SEQ ID NO: 287735 - RNA, 22 nt, Homo sapiens
aggugcucuuccuguaggucac

SEQ ID NO: 287736 - RNA, 22 nt, Homo sapiens
aggugcugacaggauagguuuc

SEQ ID NO: 287737 - RNA, 22 nt, Homo sapiens
aggugcugagcagagaauccug

SEQ ID NO: 287738 - RNA, 22 nt, Homo sapiens
aggugguguuggguuccagccc

SEQ ID NO: 287739 - RNA, 22 nt, Homo sapiens
agguuaucccgcauuauuuggu

SEQ ID NO: 287740 - RNA, 20 nt, Homo sapiens
agguucaaaucccaaucaug

SEQ ID NO: 287741 - RNA, 22 nt, Homo sapiens
agguucccuuuuggccugggau

SEQ ID NO: 287742 - RNA, 22 nt, Homo sapiens
agguuguugcaugcuccuuagg

SEQ ID NO: 287743 - RNA, 22 nt, Homo sapiens
aguaacacaccugcauggugug

SEQ ID NO: 287744 - RNA, 22 nt, Homo sapiens
aguaaucaucugagggcagaaa

SEQ ID NO: 287745 - RNA, 22 nt, Homo sapiens
aguacugucugguuaccugaca

SEQ ID NO: 287746 - RNA, 22 nt, Homo sapiens
aguauuuguuggaauaccuguu

SEQ ID NO: 287747 - RNA, 22 nt, Homo sapiens
agucaagaaucucagcaucuuu

SEQ ID NO: 287748 - RNA, 22 nt, Homo sapiens
agucaaggaggccuuucagaug

SEQ ID NO: 287749 - RNA, 22 nt, Homo sapiens
agucaagugggguuagauaguu

SEQ ID NO: 287750 - RNA, 22 nt, Homo sapiens
agucacagccuuuuacuuuaga

SEQ ID NO: 287751 - RNA, 22 nt, Homo sapiens
agucacaugcauuuucuucaau

SEQ ID NO: 287752 - RNA, 22 nt, Homo sapiens
agucagauuggcauuuguuggg

SEQ ID NO: 287753 - RNA, 22 nt, Homo sapiens
agucaugguaguaaauuuggac

SEQ ID NO: 287754 - RNA, 22 nt, Homo sapiens
aguccaguguuaugaucaguag

SEQ ID NO: 287755 - RNA, 22 nt, Homo sapiens
agugaauguuggaaaguuauuu

SEQ ID NO: 287756 - RNA, 17 nt, Homo sapiens
agugagaucauggcuua

SEQ ID NO: 287757 - RNA, 22 nt, Homo sapiens
agugaucauuugaauugaugau

SEQ ID NO: 287758 - RNA, 22 nt, Homo sapiens
agugauguggaguuuggaugga

SEQ ID NO: 287759 - RNA, 22 nt, Homo sapiens
agugcaaugauccggugcuggg

SEQ ID NO: 287760 - RNA, 22 nt, Homo sapiens
agugcaauggugccaucauagc

SEQ ID NO: 287761 - RNA, 19 nt, Homo sapiens
agugcaauugccuuugugc

SEQ ID NO: 287762 - RNA, 22 nt, Homo sapiens
agugcacugcccgcuuccuguc

SEQ ID NO: 287763 - RNA, 22 nt, Homo sapiens
agugcauugcaucucugcuuca

SEQ ID NO: 287764 - RNA, 22 nt, Homo sapiens
agugccuacuauguagaugcug

SEQ ID NO: 287765 - RNA, 23 nt, Homo sapiens
agugccuaguauauaggaggcgc

SEQ ID NO: 287766 - RNA, 22 nt, Homo sapiens
aguggauguuguggccugggag

SEQ ID NO: 287767 - RNA, 22 nt, Homo sapiens
aguggcacaauuuugacucccc

SEQ ID NO: 287768 - RNA, 22 nt, Homo sapiens
aguggcuuuuuaguggcagaug

SEQ ID NO: 287769 - RNA, 19 nt, Homo sapiens
aguggguguuuucuguuug

SEQ ID NO: 287770 - RNA, 22 nt, Homo sapiens
aguggugucugaguggccaggg

SEQ ID NO: 287771 - RNA, 22 nt, Homo sapiens
aguguuuuuaacaagaaagggu

SEQ ID NO: 287772 - RNA, 22 nt, Homo sapiens
aguguuuuucaugggauacuuu

SEQ ID NO: 287773 - RNA, 22 nt, Homo sapiens
aguucaaugcucuuucuacuau

SEQ ID NO: 287774 - RNA, 22 nt, Homo sapiens
aguuuuugcugauagcaugcuu

SEQ ID NO: 287775 - RNA, 18 nt, Homo sapiens
auaaacucaucauuuuua

SEQ ID NO: 287776 - RNA, 22 nt, Homo sapiens
auaaagcaagucucuggccuca

SEQ ID NO: 287777 - RNA, 22 nt, Homo sapiens
auaacaggaaauacagggcuuu

SEQ ID NO: 287778 - RNA, 22 nt, Homo sapiens
auaacauggaguuugucauuua

SEQ ID NO: 287779 - RNA, 22 nt, Homo sapiens
auaagauaguggaagugggauu

SEQ ID NO: 287780 - RNA, 22 nt, Homo sapiens
auaagcuaagaguuucugggcu

SEQ ID NO: 287781 - RNA, 22 nt, Homo sapiens
agcagcaucgggaaguuggcca

SEQ ID NO: 287782 - RNA, 22 nt, Homo sapiens
agcagcaugaggggacuucugc

SEQ ID NO: 287783 - RNA, 22 nt, Homo sapiens
agcagcaugcaaauggacuaau

SEQ ID NO: 287784 - RNA, 22 nt, Homo sapiens
agcagcauuaguggaaucuugu

SEQ ID NO: 287785 - RNA, 20 nt, Homo sapiens
agcagccacagauuccucag

SEQ ID NO: 287786 - RNA, 17 nt, Homo sapiens
agcagcccauaucccca

SEQ ID NO: 287787 - RNA, 22 nt, Homo sapiens
agcagcgacacccuguggugag

SEQ ID NO: 287788 - RNA, 22 nt, Homo sapiens
agcaggauuguuacaauaguaa

SEQ ID NO: 287789 - RNA, 22 nt, Homo sapiens
agcaggucuuaacuugugaggu

SEQ ID NO: 287790 - RNA, 16 nt, Homo sapiens
agcagguuuuucugca

SEQ ID NO: 287791 - RNA, 22 nt, Homo sapiens
agcauagugccuugaaaacaau

SEQ ID NO: 287792 - RNA, 20 nt, Homo sapiens
agcaucacagagccgggugu

SEQ ID NO: 287793 - RNA, 18 nt, Homo sapiens
agcaucacugaucauccu

SEQ ID NO: 287794 - RNA, 19 nt, Homo sapiens
agcaucauuauuguuuugg

SEQ ID NO: 287795 - RNA, 22 nt, Homo sapiens
agcaugacauauuguagagaaa

SEQ ID NO: 287796 - RNA, 22 nt, Homo sapiens
agccaguauuuccacagagugg

SEQ ID NO: 287797 - RNA, 20 nt, Homo sapiens
agccccauguaaaccacaug

SEQ ID NO: 287798 - RNA, 22 nt, Homo sapiens
agcccugugauuacuuuuauaa

SEQ ID NO: 287799 - RNA, 22 nt, Homo sapiens
agccucauucuacauguuaaug

SEQ ID NO: 287800 - RNA, 21 nt, Homo sapiens
agccugugggucauaguugcc

SEQ ID NO: 287801 - RNA, 22 nt, Homo sapiens
agccuucauucugacaguagga

SEQ ID NO: 287802 - RNA, 22 nt, Homo sapiens
agcgccauugcacuccagccuu

SEQ ID NO: 287803 - RNA, 21 nt, Homo sapiens
agcuaaauuggaaauuucugu

SEQ ID NO: 287804 - RNA, 22 nt, Homo sapiens
agcuagugugauucuuuggggu

SEQ ID NO: 287805 - RNA, 22 nt, Homo sapiens
agcuaguguucaccagagguca

SEQ ID NO: 287806 - RNA, 22 nt, Homo sapiens
agcuaugucugaugccugauua

SEQ ID NO: 287807 - RNA, 21 nt, Homo sapiens
agcuccacucguucccaaagc

SEQ ID NO: 287808 - RNA, 22 nt, Homo sapiens
agcuccuuucugcagguagguu

SEQ ID NO: 287809 - RNA, 22 nt, Homo sapiens
agcuccuuugcuuuuuccagga

SEQ ID NO: 287810 - RNA, 22 nt, Homo sapiens
agcugaguguuccaagagcgag

SEQ ID NO: 287811 - RNA, 22 nt, Homo sapiens
agcugcaaagggagagaugauu

SEQ ID NO: 287812 - RNA, 22 nt, Homo sapiens
agcugcacugguauaggagaaa

SEQ ID NO: 287813 - RNA, 20 nt, Homo sapiens
agcugcagauauaaauccgc

SEQ ID NO: 287814 - RNA, 22 nt, Homo sapiens
agcugcauucguaucauauugu

SEQ ID NO: 287815 - RNA, 22 nt, Homo sapiens
agcugccagucuuguaaggccu

SEQ ID NO: 287816 - RNA, 22 nt, Homo sapiens
agcuggaauuuaagguagauag

SEQ ID NO: 287817 - RNA, 22 nt, Homo sapiens
agcuggacuugauaaaugaaua

SEQ ID NO: 287818 - RNA, 22 nt, Homo sapiens
agcuggcuguggagaaaccccu

SEQ ID NO: 287819 - RNA, 22 nt, Homo sapiens
agcugguauuuugucaaggaua

SEQ ID NO: 287820 - RNA, 22 nt, Homo sapiens
agcugguccugugacuugcuuc

SEQ ID NO: 287821 - RNA, 22 nt, Homo sapiens
agcuggucugauacuuaccucc

SEQ ID NO: 287822 - RNA, 22 nt, Homo sapiens
agcuggucuuggggaagaguag

SEQ ID NO: 287823 - RNA, 21 nt, Homo sapiens
agcugguuuccacagugugcu

SEQ ID NO: 287824 - RNA, 22 nt, Homo sapiens
agcuguaguuuauucauguuaa

SEQ ID NO: 287825 - RNA, 22 nt, Homo sapiens
agcugugucuucuuaaagauuu

SEQ ID NO: 287826 - RNA, 19 nt, Homo sapiens
agcuguguugccugugaga

SEQ ID NO: 287827 - RNA, 22 nt, Homo sapiens
agcuguuguucucagaggcuuu

SEQ ID NO: 287828 - RNA, 22 nt, Homo sapiens
agcuguuguuuuaagauacuaa

SEQ ID NO: 287829 - RNA, 22 nt, Homo sapiens
acuuugcuuagagggcauuaaa

SEQ ID NO: 287830 - RNA, 22 nt, Homo sapiens
acuuugguuaucauacuuucag

SEQ ID NO: 287831 - RNA, 22 nt, Homo sapiens
acuuuuugauggggagaacauu

SEQ ID NO: 287832 - RNA, 22 nt, Homo sapiens
acuuuuugcaaccauuuggacc

SEQ ID NO: 287833 - RNA, 22 nt, Homo sapiens
agaaacauucucuugccuccuu

SEQ ID NO: 287834 - RNA, 22 nt, Homo sapiens
agaaagugcuucccuuugguga

SEQ ID NO: 287835 - RNA, 22 nt, Homo sapiens
agaacccuuugaaauguguuug

SEQ ID NO: 287836 - RNA, 20 nt, Homo sapiens
agaaccuguaguguagaggg

SEQ ID NO: 287837 - RNA, 19 nt, Homo sapiens
agaaucuaaauuauuucug

SEQ ID NO: 287838 - RNA, 22 nt, Homo sapiens
agaaugauccuucucagaggca

SEQ ID NO: 287839 - RNA, 22 nt, Homo sapiens
agaaugugaacaucuugaaagu

SEQ ID NO: 287840 - RNA, 22 nt, Homo sapiens
agaauguuuuagaccaauacaa

SEQ ID NO: 287841 - RNA, 22 nt, Homo sapiens
agaauucugucauguuuauauu

SEQ ID NO: 287842 - RNA, 20 nt, Homo sapiens
agacuagggagcagaaagcc

SEQ ID NO: 287843 - RNA, 21 nt, Homo sapiens
agagaacugaaacaugugacu

SEQ ID NO: 287844 - RNA, 22 nt, Homo sapiens
agagaucacugaaucacggggg

SEQ ID NO: 287845 - RNA, 20 nt, Homo sapiens
agagaucaguaauucaucaa

SEQ ID NO: 287846 - RNA, 22 nt, Homo sapiens
agagaucauuuuguuucaaauc

SEQ ID NO: 287847 - RNA, 22 nt, Homo sapiens
agagaugaagauggggcucccg

SEQ ID NO: 287848 - RNA, 22 nt, Homo sapiens
agagcaaugggugaauauuaaa

SEQ ID NO: 287849 - RNA, 22 nt, Homo sapiens
agagcaauguuaucagucucug

SEQ ID NO: 287850 - RNA, 22 nt, Homo sapiens
agagcacugcugcaggguucug

SEQ ID NO: 287851 - RNA, 22 nt, Homo sapiens
agagcauugaguuaaugguuca

SEQ ID NO: 287852 - RNA, 22 nt, Homo sapiens
agagguagaagauaggcuacag

SEQ ID NO: 287853 - RNA, 22 nt, Homo sapiens
agagguauacauuugagagcca

SEQ ID NO: 287854 - RNA, 22 nt, Homo sapiens
agagguaugccugggcuggagc

SEQ ID NO: 287855 - RNA, 23 nt, Homo sapiens
agagguuuaaucaggcaguugcu

SEQ ID NO: 287856 - RNA, 22 nt, Homo sapiens
agauacaucuaugugucugugu

SEQ ID NO: 287857 - RNA, 22 nt, Homo sapiens
agauacauuggauaaugguggg

SEQ ID NO: 287858 - RNA, 22 nt, Homo sapiens
agauauguuauugauguuaaug

SEQ ID NO: 287859 - RNA, 22 nt, Homo sapiens
agaugauguuucuggcacauga

SEQ ID NO: 287860 - RNA, 22 nt, Homo sapiens
agaugcauuuuuauuggaauac

SEQ ID NO: 287861 - RNA, 22 nt, Homo sapiens
agaugguauuauagguuucugu

SEQ ID NO: 287862 - RNA, 23 nt, Homo sapiens
agcaaaugcucuagcacuccaac

SEQ ID NO: 287863 - RNA, 22 nt, Homo sapiens
agcaacauagaaauuugggugg

SEQ ID NO: 287864 - RNA, 22 nt, Homo sapiens
agcaacauuuuugaccuuucuu

SEQ ID NO: 287865 - RNA, 22 nt, Homo sapiens
agcaagaugaaguugagcuagg

SEQ ID NO: 287866 - RNA, 22 nt, Homo sapiens
agcaagauuguucccauuuucu

SEQ ID NO: 287867 - RNA, 22 nt, Homo sapiens
agcacagccuuguguuuucuug

SEQ ID NO: 287868 - RNA, 22 nt, Homo sapiens
agcacauuaguaucuaagaaca

SEQ ID NO: 287869 - RNA, 22 nt, Homo sapiens
agcaccacaauuuccugccuaa

SEQ ID NO: 287870 - RNA, 23 nt, Homo sapiens
agcaccaccccaggucacaagug

SEQ ID NO: 287871 - RNA, 23 nt, Homo sapiens
agcaccuuuccuccacuaucugc

SEQ ID NO: 287872 - RNA, 22 nt, Homo sapiens
agcacgauggggucacgaugag

SEQ ID NO: 287873 - RNA, 19 nt, Homo sapiens
agcagaacaaauguguggg

SEQ ID NO: 287874 - RNA, 22 nt, Homo sapiens
agcagcauauuuuuauaaugua

SEQ ID NO: 287875 - RNA, 22 nt, Homo sapiens
agcagcuuugcauggccugugg

SEQ ID NO: 287876 - RNA, 21 nt, Homo sapiens
agcagcuuugguugaagcaga

SEQ ID NO: 287877 - RNA, 22 nt, Homo sapiens
agcagguguggcuuauccugaa

SEQ ID NO: 287878 - RNA, 16 nt, Homo sapiens
agcagguguuagguga

SEQ ID NO: 287879 - RNA, 22 nt, Homo sapiens
agcaguagugaaaguagacuua

SEQ ID NO: 287880 - RNA, 22 nt, Homo sapiens
agcagugucauuuucuggugag

SEQ ID NO: 287881 - RNA, 22 nt, Homo sapiens
agcaucacguagacuuuaccau

SEQ ID NO: 287882 - RNA, 22 nt, Homo sapiens
agcauggucacuuugggcccca

SEQ ID NO: 287883 - RNA, 20 nt, Homo sapiens
agcauugguuagaacaguag

SEQ ID NO: 287884 - RNA, 16 nt, Homo sapiens
agccaccauuuacuug

SEQ ID NO: 287885 - RNA, 22 nt, Homo sapiens
agcccagagacuguguaaauuu

SEQ ID NO: 287886 - RNA, 22 nt, Homo sapiens
agccgguguccacgaagaagag

SEQ ID NO: 287887 - RNA, 22 nt, Homo sapiens
agccuagagagccacuuugaga

SEQ ID NO: 287888 - RNA, 22 nt, Homo sapiens
agcuccaugauaguaugucugu

SEQ ID NO: 287889 - RNA, 22 nt, Homo sapiens
agcucuuguuaguauuagcagu

SEQ ID NO: 287890 - RNA, 22 nt, Homo sapiens
agcugcacgugguaaauguaaa

SEQ ID NO: 287891 - RNA, 21 nt, Homo sapiens
agcugcguuuaggcauuuucc

SEQ ID NO: 287892 - RNA, 16 nt, Homo sapiens
agcuggaauuacaggc

SEQ ID NO: 287893 - RNA, 22 nt, Homo sapiens
agcuggauguggaugacccugu

SEQ ID NO: 287894 - RNA, 22 nt, Homo sapiens
agcugguaguuuucuaguguuu

SEQ ID NO: 287895 - RNA, 22 nt, Homo sapiens
agcugguauuuguuagggaguu

SEQ ID NO: 287896 - RNA, 22 nt, Homo sapiens
agcuggucuacguguguaugag

SEQ ID NO: 287897 - RNA, 22 nt, Homo sapiens
agcuggucucaggugcccugcu

SEQ ID NO: 287898 - RNA, 22 nt, Homo sapiens
agcugguuuaauaugcugucug

SEQ ID NO: 287899 - RNA, 22 nt, Homo sapiens
agcugguuuauuucuauauccu

SEQ ID NO: 287900 - RNA, 20 nt, Homo sapiens
agcugguuuuaugaaucuuu

SEQ ID NO: 287901 - RNA, 20 nt, Homo sapiens
agcuguuguuaaaaaggagg

SEQ ID NO: 287902 - RNA, 22 nt, Homo sapiens
agcuguuguuaauuaacucauu

SEQ ID NO: 287903 - RNA, 22 nt, Homo sapiens
agcuucauuccaacuuccuucu

SEQ ID NO: 287904 - RNA, 22 nt, Homo sapiens
agcuucauucugaauagguuga

SEQ ID NO: 287905 - RNA, 22 nt, Homo sapiens
agcuucauuguuaugaauguca

SEQ ID NO: 287906 - RNA, 22 nt, Homo sapiens
aggaagacugaaauugcuguuc

SEQ ID NO: 287907 - RNA, 22 nt, Homo sapiens
aggaagcuagcauuuguucagu

SEQ ID NO: 287908 - RNA, 22 nt, Homo sapiens
aggaagugucuucuuuuaggca

SEQ ID NO: 287909 - RNA, 22 nt, Homo sapiens
aggaauggaaacuuuugauggu

SEQ ID NO: 287910 - RNA, 22 nt, Homo sapiens
aggaauguuaguacuucuuagu

SEQ ID NO: 287911 - RNA, 21 nt, Homo sapiens
cacauggaggcagagagugua

SEQ ID NO: 287912 - RNA, 22 nt, Homo sapiens
cacauugaauuucugaugacaa

SEQ ID NO: 287913 - RNA, 22 nt, Homo sapiens
caccaaccucaguagcaucugu

SEQ ID NO: 287914 - RNA, 22 nt, Homo sapiens
caccacagccauuauugucccc

SEQ ID NO: 287915 - RNA, 22 nt, Homo sapiens
caccaguuuuucagugauucaa

SEQ ID NO: 287916 - RNA, 22 nt, Homo sapiens
caccauguguucagaaggauug

SEQ ID NO: 287917 - RNA, 22 nt, Homo sapiens
caccggauucauggggaagaag

SEQ ID NO: 287918 - RNA, 22 nt, Homo sapiens
caccuguagucccagcugaggc

SEQ ID NO: 287919 - RNA, 22 nt, Homo sapiens
cacugaaugugagguuggggag

SEQ ID NO: 287920 - RNA, 22 nt, Homo sapiens
cacugcacuccagcuugugggc

SEQ ID NO: 287921 - RNA, 22 nt, Homo sapiens
cacugcacucuucuucugggca

SEQ ID NO: 287922 - RNA, 22 nt, Homo sapiens
cacugcaguaaauugcgucggu

SEQ ID NO: 287923 - RNA, 22 nt, Homo sapiens
cacugcauccuccaccugccag

SEQ ID NO: 287924 - RNA, 22 nt, Homo sapiens
cacugcauuacucaugagcaug

SEQ ID NO: 287925 - RNA, 22 nt, Homo sapiens
cacugggccaucacuuaauauu

SEQ ID NO: 287926 - RNA, 17 nt, Homo sapiens
cacugggugcaagagga

SEQ ID NO: 287927 - RNA, 22 nt, Homo sapiens
cacugggugccauauguuugcu

SEQ ID NO: 287928 - RNA, 21 nt, Homo sapiens
cacuggguucaggcuugugga

SEQ ID NO: 287929 - RNA, 21 nt, Homo sapiens
cagagaucaucucuguuuuaa

SEQ ID NO: 287930 - RNA, 22 nt, Homo sapiens
cagagaucaugcaacugcucgc

SEQ ID NO: 287931 - RNA, 22 nt, Homo sapiens
cagagcacuaaagguaaaaggc

SEQ ID NO: 287932 - RNA, 22 nt, Homo sapiens
cagagguaagcaagucagcauu

SEQ ID NO: 287933 - RNA, 22 nt, Homo sapiens
cagaguuaguagccuuugacaa

SEQ ID NO: 287934 - RNA, 22 nt, Homo sapiens
cagauacuggaguccugaaguu

SEQ ID NO: 287935 - RNA, 20 nt, Homo sapiens
cagcaaccugcucucuuccu

SEQ ID NO: 287936 - RNA, 22 nt, Homo sapiens
cagcaagucucuaagaguucau

SEQ ID NO: 287937 - RNA, 22 nt, Homo sapiens
cagcacauagcaguugcucagu

SEQ ID NO: 287938 - RNA, 20 nt, Homo sapiens
cagcacgcacaugagacugu

SEQ ID NO: 287939 - RNA, 22 nt, Homo sapiens
cagcccguaaucccagcacuuu

SEQ ID NO: 287940 - RNA, 20 nt, Homo sapiens
cagcuagugguaggagucgg

SEQ ID NO: 287941 - RNA, 22 nt, Homo sapiens
cagcucuuguuaaaacuaacua

SEQ ID NO: 287942 - RNA, 22 nt, Homo sapiens
cagcugaugucgaaugcacucu

SEQ ID NO: 287943 - RNA, 23 nt, Homo sapiens
cagcuggugauuuuaaguugaag

SEQ ID NO: 287944 - RNA, 22 nt, Homo sapiens
cagcuggugggagcuggguucc

SEQ ID NO: 287945 - RNA, 22 nt, Homo sapiens
cagcuguuguuaugucugcagg

SEQ ID NO: 287946 - RNA, 23 nt, Homo sapiens
cagcuucauugaacauaacuccu

SEQ ID NO: 287947 - RNA, 22 nt, Homo sapiens
caggaccucuugccuggaagcc

SEQ ID NO: 287948 - RNA, 22 nt, Homo sapiens
caggcaacauggcgaaacucug

SEQ ID NO: 287949 - RNA, 22 nt, Homo sapiens
caggcauagucuugaguuuuau

SEQ ID NO: 287950 - RNA, 22 nt, Homo sapiens
caggcuuuuccacacauggguu

SEQ ID NO: 287951 - RNA, 22 nt, Homo sapiens
cagggaauguuauuuaauagca

SEQ ID NO: 287952 - RNA, 22 nt, Homo sapiens
cagguacaugcaugugugugca

SEQ ID NO: 287953 - RNA, 22 nt, Homo sapiens
cagguaggccaauguuuuccaa

SEQ ID NO: 287954 - RNA, 22 nt, Homo sapiens
cagguagucaacgggucuugga

SEQ ID NO: 287955 - RNA, 19 nt, Homo sapiens
cagguagugugcugacaug

SEQ ID NO: 287956 - RNA, 23 nt, Homo sapiens
cagguaguucuuuauaguagugu

SEQ ID NO: 287957 - RNA, 22 nt, Homo sapiens
caguaguagccccuuagaugga

SEQ ID NO: 287958 - RNA, 19 nt, Homo sapiens
caguaucauugcacauagu

SEQ ID NO: 287959 - RNA, 22 nt, Homo sapiens
cagucacagugacaggaugugg

SEQ ID NO: 287960 - RNA, 22 nt, Homo sapiens
caguccuaugauaaccauuuac

SEQ ID NO: 287961 - RNA, 22 nt, Homo sapiens
cagugaauuucaggucaagagu

SEQ ID NO: 287962 - RNA, 22 nt, Homo sapiens
cagugacacugaaaaguucggg

SEQ ID NO: 287963 - RNA, 22 nt, Homo sapiens
cagugcacugggauuauaagug

SEQ ID NO: 287964 - RNA, 20 nt, Homo sapiens
cagugcacuuucccacuggu

SEQ ID NO: 287965 - RNA, 22 nt, Homo sapiens
cagugcauaggaucuaaaauuu

SEQ ID NO: 287966 - RNA, 23 nt, Homo sapiens
cagugcaugacuguauaugcaaa

SEQ ID NO: 287967 - RNA, 22 nt, Homo sapiens
cagugcaugacuguauauuauc

SEQ ID NO: 287968 - RNA, 23 nt, Homo sapiens
cagugguguuagagaaaucuuuu

SEQ ID NO: 287969 - RNA, 22 nt, Homo sapiens
cagugguuuucucaguucagca

SEQ ID NO: 287970 - RNA, 22 nt, Homo sapiens
caguugcacuagccccguuuca

SEQ ID NO: 287971 - RNA, 22 nt, Homo sapiens
caguuguuuuaugacauaagau

SEQ ID NO: 287972 - RNA, 22 nt, Homo sapiens
cauagcacacauuuaccuaugu

SEQ ID NO: 287973 - RNA, 22 nt, Homo sapiens
cauagcacacguauaccuaugu

SEQ ID NO: 287974 - RNA, 22 nt, Homo sapiens
cauagcacugagcucuacccuc

SEQ ID NO: 287975 - RNA, 18 nt, Homo sapiens
cauagcacuucagcacau

SEQ ID NO: 287976 - RNA, 22 nt, Homo sapiens
cauagguugggcguuugauuuu

SEQ ID NO: 287977 - RNA, 22 nt, Homo sapiens
cauauaguaguacuguuagguu

SEQ ID NO: 287978 - RNA, 22 nt, Homo sapiens
caucaaaguggagggaaggacc

SEQ ID NO: 287979 - RNA, 22 nt, Homo sapiens
caucacacuuggauguaagaca

SEQ ID NO: 287980 - RNA, 23 nt, Homo sapiens
caucacagagccuuccuugacuc

SEQ ID NO: 287981 - RNA, 22 nt, Homo sapiens
caucacaguacuaaucgucaua

SEQ ID NO: 287982 - RNA, 22 nt, Homo sapiens
caucacuuuuccuuuuacagau

SEQ ID NO: 287983 - RNA, 18 nt, Homo sapiens
aaaaagugcucaggccua

SEQ ID NO: 287984 - RNA, 22 nt, Homo sapiens
aaaagagcugagagguauucuu

SEQ ID NO: 287985 - RNA, 22 nt, Homo sapiens
aaaagcauucagagugcugggc

SEQ ID NO: 287986 - RNA, 22 nt, Homo sapiens
aaaaggcuagcuaguaacagaa

SEQ ID NO: 287987 - RNA, 22 nt, Homo sapiens
aaaagucuguagugaaagguga

SEQ ID NO: 287988 - RNA, 22 nt, Homo sapiens
aaaaguucuuugagccuugaca

SEQ ID NO: 287989 - RNA, 22 nt, Homo sapiens
aaaaugcugauauugggcccca

SEQ ID NO: 287990 - RNA, 22 nt, Homo sapiens
aaacaccacgcggucccucgga

SEQ ID NO: 287991 - RNA, 22 nt, Homo sapiens
aaacagucuucuccugagggac

SEQ ID NO: 287992 - RNA, 22 nt, Homo sapiens
aaacgugcagagaucaauagca

SEQ ID NO: 287993 - RNA, 22 nt, Homo sapiens
aaacucuguagcagagacagau

SEQ ID NO: 287994 - RNA, 22 nt, Homo sapiens
aaacugaucugaaggccaggcu

SEQ ID NO: 287995 - RNA, 22 nt, Homo sapiens
aggaauuuaauguaugauaaua

SEQ ID NO: 287996 - RNA, 22 nt, Homo sapiens
aggacacugauagucuuuggca

SEQ ID NO: 287997 - RNA, 22 nt, Homo sapiens
aggaccccucaucagcaccagu

SEQ ID NO: 287998 - RNA, 20 nt, Homo sapiens
aggacuacagaggguaggau

SEQ ID NO: 287999 - RNA, 21 nt, Homo sapiens
aggagauguuuguccuuuuag

SEQ ID NO: 288000 - RNA, 22 nt, Homo sapiens
aggagcacuggccuuggaguca

SEQ ID NO: 288001 - RNA, 23 nt, Homo sapiens
aggagcuuagaaguugccauugc

SEQ ID NO: 288002 - RNA, 22 nt, Homo sapiens
aggagguagucugucccuuagc

SEQ ID NO: 288003 - RNA, 21 nt, Homo sapiens
aggcaagguguuauuauugaa

SEQ ID NO: 288004 - RNA, 22 nt, Homo sapiens
aggcagcuguuauauacugagu

SEQ ID NO: 288005 - RNA, 22 nt, Homo sapiens
aggcagucucugccggcugagg

SEQ ID NO: 288006 - RNA, 22 nt, Homo sapiens
aggcaugaaauacaugcauuga

SEQ ID NO: 288007 - RNA, 22 nt, Homo sapiens
aggcaugguggcacauacaugu

SEQ ID NO: 288008 - RNA, 22 nt, Homo sapiens
aggcuaagaugacuccaccccc

SEQ ID NO: 288009 - RNA, 22 nt, Homo sapiens
aggcugguauuuacaaaagcuc

SEQ ID NO: 288010 - RNA, 22 nt, Homo sapiens
aggcuguguggauaauauuggg

SEQ ID NO: 288011 - RNA, 21 nt, Homo sapiens
aggcuguuguuuugggaugga

SEQ ID NO: 288012 - RNA, 22 nt, Homo sapiens
aggcuuauuaagauucccuuau

SEQ ID NO: 288013 - RNA, 22 nt, Homo sapiens
aggcuuuauuacagggucucag

SEQ ID NO: 288014 - RNA, 22 nt, Homo sapiens
agggagcaaaguggucuuucuc

SEQ ID NO: 288015 - RNA, 22 nt, Homo sapiens
agggcaagacuuguuaagaaca

SEQ ID NO: 288016 - RNA, 22 nt, Homo sapiens
agggguauuauguaaaucugac

SEQ ID NO: 288017 - RNA, 22 nt, Homo sapiens
agguaaacauggggacugcuac

SEQ ID NO: 288018 - RNA, 20 nt, Homo sapiens
agguacacugacaugccuuc

SEQ ID NO: 288019 - RNA, 22 nt, Homo sapiens
agguagugugaugcuccuguuu

SEQ ID NO: 288020 - RNA, 21 nt, Homo sapiens
agguaguuuuccuuuuggagu

SEQ ID NO: 288021 - RNA, 22 nt, Homo sapiens
aggucaccucaggaaauacuga

SEQ ID NO: 288022 - RNA, 21 nt, Homo sapiens
aggucaugaagauguucuaau

SEQ ID NO: 288023 - RNA, 22 nt, Homo sapiens
agguccauugguauuauagcau

SEQ ID NO: 288024 - RNA, 22 nt, Homo sapiens
aggugcuugaaucuaugagcuc

SEQ ID NO: 288025 - RNA, 22 nt, Homo sapiens
agguuaacaucuauuuuggaug

SEQ ID NO: 288026 - RNA, 21 nt, Homo sapiens
agguuguguuuccucuuacuu

SEQ ID NO: 288027 - RNA, 22 nt, Homo sapiens
aguaaauuucugugcuuucaua

SEQ ID NO: 288028 - RNA, 17 nt, Homo sapiens
aguacugucccauccuu

SEQ ID NO: 288029 - RNA, 22 nt, Homo sapiens
agucacagugaccuugucugac

SEQ ID NO: 288030 - RNA, 22 nt, Homo sapiens
agucacaugccagcacacccag

SEQ ID NO: 288031 - RNA, 22 nt, Homo sapiens
agucagugucuguaaggagaac

SEQ ID NO: 288032 - RNA, 20 nt, Homo sapiens
agucaguuuauuuucucucu

SEQ ID NO: 288033 - RNA, 22 nt, Homo sapiens
agucauaggagagauaucacug

SEQ ID NO: 288034 - RNA, 19 nt, Homo sapiens
agucaugugaggacccuug

SEQ ID NO: 288035 - RNA, 22 nt, Homo sapiens
aguccauuugaugaugauucca

SEQ ID NO: 288036 - RNA, 22 nt, Homo sapiens
agucgguguuacugacagaaug

SEQ ID NO: 288037 - RNA, 22 nt, Homo sapiens
agugaaaugucaccuuuuagga

SEQ ID NO: 288038 - RNA, 22 nt, Homo sapiens
agugaacacagcuucuuugguu

SEQ ID NO: 288039 - RNA, 22 nt, Homo sapiens
agugaauuguucaacaggagga

SEQ ID NO: 288040 - RNA, 19 nt, Homo sapiens
agugagccaagauccuacc

SEQ ID NO: 288041 - RNA, 22 nt, Homo sapiens
agugauggagccaggauuuaau

SEQ ID NO: 288042 - RNA, 22 nt, Homo sapiens
agugauuuuaacuuccagcaau

SEQ ID NO: 288043 - RNA, 22 nt, Homo sapiens
agugcaaggacauuuagguugu

SEQ ID NO: 288044 - RNA, 22 nt, Homo sapiens
agugcagugguuaggagccagg

SEQ ID NO: 288045 - RNA, 22 nt, Homo sapiens
agugcauaugucuuuuuggaag

SEQ ID NO: 288046 - RNA, 22 nt, Homo sapiens
agugcauuuguucugugucagg

SEQ ID NO: 288047 - RNA, 22 nt, Homo sapiens
agugccauggcugcuagauggc

SEQ ID NO: 288048 - RNA, 22 nt, Homo sapiens
agugcuuaauagauguccagca

SEQ ID NO: 288049 - RNA, 22 nt, Homo sapiens
aguggaauuaagaaacugaauu

SEQ ID NO: 288050 - RNA, 19 nt, Homo sapiens
agugggcuagaaaucaggg

SEQ ID NO: 288051 - RNA, 22 nt, Homo sapiens
aguggguguuccauuggauaaa

SEQ ID NO: 288052 - RNA, 22 nt, Homo sapiens
agugguaguacaggagauaccg

SEQ ID NO: 288053 - RNA, 23 nt, Homo sapiens
aguggucuccugggcccagcugu

SEQ ID NO: 288054 - RNA, 20 nt, Homo sapiens
agugguuuucaaauaugucu

SEQ ID NO: 288055 - RNA, 22 nt, Homo sapiens
agugguuuuggaauggaauuca

SEQ ID NO: 288056 - RNA, 22 nt, Homo sapiens
aguguaaugauauuuggagagg

SEQ ID NO: 288057 - RNA, 19 nt, Homo sapiens
agugucauggucauuauuu

SEQ ID NO: 288058 - RNA, 22 nt, Homo sapiens
aguguuuuuaucaugaaagggu

SEQ ID NO: 288059 - RNA, 22 nt, Homo sapiens
aguuccuacuggcuguaaagaa

SEQ ID NO: 288060 - RNA, 22 nt, Homo sapiens
aguuuugguugaguuacuagca

SEQ ID NO: 288061 - RNA, 22 nt, Homo sapiens
auaaaguagaggugaggugcau

SEQ ID NO: 288062 - RNA, 22 nt, Homo sapiens
auaaaguguuuaguauaggcaa

SEQ ID NO: 288063 - RNA, 22 nt, Homo sapiens
auaaaugccuguuguuuuaagc

SEQ ID NO: 288064 - RNA, 22 nt, Homo sapiens
auaaaugcuuagaucuguauau

SEQ ID NO: 288065 - RNA, 22 nt, Homo sapiens
auaaauucauuuaagcuccuua

SEQ ID NO: 288066 - RNA, 22 nt, Homo sapiens
auaacagcauuauugcauacgu

SEQ ID NO: 288067 - RNA, 22 nt, Homo sapiens
auaacauccuuucuuaucguug

SEQ ID NO: 288068 - RNA, 22 nt, Homo sapiens
auaagaagugaaccagacgucu

SEQ ID NO: 288069 - RNA, 22 nt, Homo sapiens
auaagucaauggaacagauuaa

SEQ ID NO: 288070 - RNA, 22 nt, Homo sapiens
cuacaguuauguuuuaaaugug

SEQ ID NO: 288071 - RNA, 22 nt, Homo sapiens
cuagaauguauaaaaccaagcu

SEQ ID NO: 288072 - RNA, 22 nt, Homo sapiens
cuagacacugacguuccuccga

SEQ ID NO: 288073 - RNA, 22 nt, Homo sapiens
cuagcacauaguuauucacuca

SEQ ID NO: 288074 - RNA, 22 nt, Homo sapiens
cuagcagaacaauacaauucgg

SEQ ID NO: 288075 - RNA, 22 nt, Homo sapiens
cuagcagacaugggcugaacca

SEQ ID NO: 288076 - RNA, 22 nt, Homo sapiens
aucuaaucaucgcaaccuucaa

SEQ ID NO: 288077 - RNA, 22 nt, Homo sapiens
aucuacuugcugggucucugga

SEQ ID NO: 288078 - RNA, 22 nt, Homo sapiens
ggacugagaggacuacagugua

SEQ ID NO: 288079 - RNA, 22 nt, Homo sapiens
ggagagcuaggcagagguuugu

SEQ ID NO: 288080 - RNA, 22 nt, Homo sapiens
ggagauuauugaaucaugaggg

SEQ ID NO: 288081 - RNA, 22 nt, Homo sapiens
ggagguagguuugugauuugua

SEQ ID NO: 288082 - RNA, 22 nt, Homo sapiens
ggagucuugcuauguugccaag

SEQ ID NO: 288083 - RNA, 22 nt, Homo sapiens
ggauacaucuggacagccgaau

SEQ ID NO: 288084 - RNA, 21 nt, Homo sapiens
ggauagaaaacuuggcuguau

SEQ ID NO: 288085 - RNA, 22 nt, Homo sapiens
ggaucacugugaaccgugucag

SEQ ID NO: 288086 - RNA, 22 nt, Homo sapiens
ggaugcauuuuugguugucaca

SEQ ID NO: 288087 - RNA, 23 nt, Homo sapiens
ggauggaaaguuuugagggccac

SEQ ID NO: 288088 - RNA, 23 nt, Homo sapiens
ggauucaucuguuuguucgcugu

SEQ ID NO: 288089 - RNA, 22 nt, Homo sapiens
ggauugugauaauuguugcaaa

SEQ ID NO: 288090 - RNA, 22 nt, Homo sapiens
ggcaaaauauugucugguauag

SEQ ID NO: 288091 - RNA, 22 nt, Homo sapiens
ggcaaaauggccagugggucac

SEQ ID NO: 288092 - RNA, 22 nt, Homo sapiens
ggcaaagaugaccauuacuuuu

SEQ ID NO: 288093 - RNA, 22 nt, Homo sapiens
ggcaacaaagacauuucaacau

SEQ ID NO: 288094 - RNA, 22 nt, Homo sapiens
ggcaacaugaugaaaugccauc

SEQ ID NO: 288095 - RNA, 22 nt, Homo sapiens
ggcaagaaaaugcaauuacugu

SEQ ID NO: 288096 - RNA, 22 nt, Homo sapiens
ggcaagaaagaaaucaucuguc

SEQ ID NO: 288097 - RNA, 22 nt, Homo sapiens
ggcaagaaccucaauuaccuuu

SEQ ID NO: 288098 - RNA, 19 nt, Homo sapiens
ggcaagaguuguucugugu

SEQ ID NO: 288099 - RNA, 22 nt, Homo sapiens
ggcaaggauuagauucuccccu

SEQ ID NO: 288100 - RNA, 22 nt, Homo sapiens
ggcaaggugcuacagacaguga

SEQ ID NO: 288101 - RNA, 22 nt, Homo sapiens
ggcaaugucagcuaaugaugga

SEQ ID NO: 288102 - RNA, 22 nt, Homo sapiens
ggcaccauggaaggacgggagc

SEQ ID NO: 288103 - RNA, 22 nt, Homo sapiens
ggcaccauuuuacuccuucccu

SEQ ID NO: 288104 - RNA, 22 nt, Homo sapiens
ggcagagucuugcaucuuuaga

SEQ ID NO: 288105 - RNA, 22 nt, Homo sapiens
ggcagaguggacauuuaaaugu

SEQ ID NO: 288106 - RNA, 22 nt, Homo sapiens
ggcagcacaauuuucugaugga

SEQ ID NO: 288107 - RNA, 22 nt, Homo sapiens
ggcagcauugccuuugcaguga

SEQ ID NO: 288108 - RNA, 17 nt, Homo sapiens
ggcaggauccaggaucc

SEQ ID NO: 288109 - RNA, 22 nt, Homo sapiens
ggcagguaaggagugggagccu

SEQ ID NO: 288110 - RNA, 22 nt, Homo sapiens
ggcaguguaauaauuuauuaau

SEQ ID NO: 288111 - RNA, 22 nt, Homo sapiens
ggcaguuuguucuugcuccuuu

SEQ ID NO: 288112 - RNA, 22 nt, Homo sapiens
ggcaguuuguuugugaggucca

SEQ ID NO: 288113 - RNA, 22 nt, Homo sapiens
ggcaugguggugugugccuaua

SEQ ID NO: 288114 - RNA, 23 nt, Homo sapiens
ggcauuguggcucacaucuguaa

SEQ ID NO: 288115 - RNA, 22 nt, Homo sapiens
ggccagaugcaguggcucacac

SEQ ID NO: 288116 - RNA, 22 nt, Homo sapiens
ggcucagugaucuguuucugua

SEQ ID NO: 288117 - RNA, 22 nt, Homo sapiens
ggcucaguuuccuccgucugcu

SEQ ID NO: 288118 - RNA, 22 nt, Homo sapiens
ggcucguguuuucuguccaguu

SEQ ID NO: 288119 - RNA, 22 nt, Homo sapiens
ggcucuguugcuaccaauuaag

SEQ ID NO: 288120 - RNA, 22 nt, Homo sapiens
ggcuuuggucacacaggggcaa

SEQ ID NO: 288121 - RNA, 22 nt, Homo sapiens
gggaagaaggagugguuuacuc

SEQ ID NO: 288122 - RNA, 22 nt, Homo sapiens
gggagcacaagaaauguuucau

SEQ ID NO: 288123 - RNA, 19 nt, Homo sapiens
gggaggaugcgucuucagg

SEQ ID NO: 288124 - RNA, 22 nt, Homo sapiens
gggaggucauuguucaaugcug

SEQ ID NO: 288125 - RNA, 22 nt, Homo sapiens
gggaugaagaagaauaguucgu

SEQ ID NO: 288126 - RNA, 22 nt, Homo sapiens
gggauguaaaagugggcacauu

SEQ ID NO: 288127 - RNA, 22 nt, Homo sapiens
gggauuguaauacugaguuggu

SEQ ID NO: 288128 - RNA, 19 nt, Homo sapiens
gggcaaaucuggaaauuua

SEQ ID NO: 288129 - RNA, 21 nt, Homo sapiens
gggcaaaucuuuauccuaagc

SEQ ID NO: 288130 - RNA, 22 nt, Homo sapiens
gggcaaauuauguaucucucag

SEQ ID NO: 288131 - RNA, 18 nt, Homo sapiens
gggcaaguugccuggcuu

SEQ ID NO: 288132 - RNA, 22 nt, Homo sapiens
gggcagaugucuggacaccuca

SEQ ID NO: 288133 - RNA, 22 nt, Homo sapiens
gggcaugaugucuuaugccuau

SEQ ID NO: 288134 - RNA, 22 nt, Homo sapiens
ggggaguguggacaucacccug

SEQ ID NO: 288135 - RNA, 22 nt, Homo sapiens
gggguaggcuacacugaguucc

SEQ ID NO: 288136 - RNA, 22 nt, Homo sapiens
gggguauguaagugagugagug

SEQ ID NO: 288137 - RNA, 22 nt, Homo sapiens
ggggucaucagagaaucuaccc

SEQ ID NO: 288138 - RNA, 22 nt, Homo sapiens
gggugguuuuauuaucagugac

SEQ ID NO: 288139 - RNA, 22 nt, Homo sapiens
cacugugcaaccuccaccuccc

SEQ ID NO: 288140 - RNA, 22 nt, Homo sapiens
cagaaguauugguaugcucugu

SEQ ID NO: 288141 - RNA, 22 nt, Homo sapiens
cagacagugucccgagucccug

SEQ ID NO: 288142 - RNA, 22 nt, Homo sapiens
cagagagcuugcccuuguauau

SEQ ID NO: 288143 - RNA, 22 nt, Homo sapiens
cagauacuccuggucucaggag

SEQ ID NO: 288144 - RNA, 22 nt, Homo sapiens
cagauaguuguagguguguggc

SEQ ID NO: 288145 - RNA, 22 nt, Homo sapiens
cagaugguggucccacagccca

SEQ ID NO: 288146 - RNA, 22 nt, Homo sapiens
cagcaaaucauccuauuugagc

SEQ ID NO: 288147 - RNA, 22 nt, Homo sapiens
cagccggguggcuccuagggua

SEQ ID NO: 288148 - RNA, 22 nt, Homo sapiens
cagcuaaauuguuaaauccaag

SEQ ID NO: 288149 - RNA, 22 nt, Homo sapiens
cagcuaguaauuuauugaagau

SEQ ID NO: 288150 - RNA, 22 nt, Homo sapiens
cagcucauugcagucucgaccu

SEQ ID NO: 288151 - RNA, 22 nt, Homo sapiens
cagcugcuuuggaaaauauuuu

SEQ ID NO: 288152 - RNA, 22 nt, Homo sapiens
cagcuguuguuccagucuuuua

SEQ ID NO: 288153 - RNA, 22 nt, Homo sapiens
cagcuugugguauugcugguug

SEQ ID NO: 288154 - RNA, 22 nt, Homo sapiens
caggaaugugaggguucccugc

SEQ ID NO: 288155 - RNA, 22 nt, Homo sapiens
caggcaaggugaaguguacugg

SEQ ID NO: 288156 - RNA, 22 nt, Homo sapiens
caggcacgcuugggagacacac

SEQ ID NO: 288157 - RNA, 22 nt, Homo sapiens
caggcagucuggcucccaagug

SEQ ID NO: 288158 - RNA, 22 nt, Homo sapiens
cagggcaugugggucuauuggc

SEQ ID NO: 288159 - RNA, 22 nt, Homo sapiens
cagguacauuuuaaagggcuca

SEQ ID NO: 288160 - RNA, 22 nt, Homo sapiens
cagguacuucugggcugagcag

SEQ ID NO: 288161 - RNA, 22 nt, Homo sapiens
auggcacuguguccugggguca

SEQ ID NO: 288162 - RNA, 22 nt, Homo sapiens
auggcagaaucaagccgacagc

SEQ ID NO: 288163 - RNA, 22 nt, Homo sapiens
auggcagcugacacuuccgucu

SEQ ID NO: 288164 - RNA, 22 nt, Homo sapiens
auggcaguuucagcuauaguuu

SEQ ID NO: 288165 - RNA, 22 nt, Homo sapiens
auggccauuacuaagaauguuu

SEQ ID NO: 288166 - RNA, 22 nt, Homo sapiens
auggcccccuguuugugaacau

SEQ ID NO: 288167 - RNA, 22 nt, Homo sapiens
auggcccugcuaccacuuuucu

SEQ ID NO: 288168 - RNA, 22 nt, Homo sapiens
auggccuuguauaccuggcaaa

SEQ ID NO: 288169 - RNA, 22 nt, Homo sapiens
auggccuuuacaauuugguaug

SEQ ID NO: 288170 - RNA, 22 nt, Homo sapiens
auggcugagugauuucaaacag

SEQ ID NO: 288171 - RNA, 22 nt, Homo sapiens
auggcuguuccugggaguucua

SEQ ID NO: 288172 - RNA, 22 nt, Homo sapiens
auggcuguuuaagaguuucauu

SEQ ID NO: 288173 - RNA, 22 nt, Homo sapiens
auggcuucuucuaaaagugggg

SEQ ID NO: 288174 - RNA, 22 nt, Homo sapiens
auggcuuucaggacguggcgag

SEQ ID NO: 288175 - RNA, 22 nt, Homo sapiens
augggacugggugccguggagc

SEQ ID NO: 288176 - RNA, 22 nt, Homo sapiens
augggguaggcuugcuguagua

SEQ ID NO: 288177 - RNA, 22 nt, Homo sapiens
augggguaggcuuugcugcagu

SEQ ID NO: 288178 - RNA, 22 nt, Homo sapiens
augguacuccagagaagcagaa

SEQ ID NO: 288179 - RNA, 22 nt, Homo sapiens
augguauuuugugauaccuugu

SEQ ID NO: 288180 - RNA, 22 nt, Homo sapiens
auggucccauucauucacguau

SEQ ID NO: 288181 - RNA, 22 nt, Homo sapiens
augguuuuacugcaaaauggga

SEQ ID NO: 288182 - RNA, 17 nt, Homo sapiens
auguaauccucaucucu

SEQ ID NO: 288183 - RNA, 22 nt, Homo sapiens
auguaauugagguuuuugccau

SEQ ID NO: 288184 - RNA, 22 nt, Homo sapiens
auguaguauuaaugagagauaa

SEQ ID NO: 288185 - RNA, 22 nt, Homo sapiens
augucacugcacuccugccugg

SEQ ID NO: 288186 - RNA, 22 nt, Homo sapiens
augucauagauaaggaagugga

SEQ ID NO: 288187 - RNA, 22 nt, Homo sapiens
auguccaugagcacauguauca

SEQ ID NO: 288188 - RNA, 22 nt, Homo sapiens
auguccuagagagauggugguc

SEQ ID NO: 288189 - RNA, 22 nt, Homo sapiens
augucuuucauagagacccaga

SEQ ID NO: 288190 - RNA, 17 nt, Homo sapiens
augugaauguucaaaua

SEQ ID NO: 288191 - RNA, 22 nt, Homo sapiens
augugacagcaacccccagccc

SEQ ID NO: 288192 - RNA, 22 nt, Homo sapiens
augugcaaaguuaagaucccag

SEQ ID NO: 288193 - RNA, 22 nt, Homo sapiens
augugcaacugcuggaacaguc

SEQ ID NO: 288194 - RNA, 22 nt, Homo sapiens
augugcaauguguacguagccc

SEQ ID NO: 288195 - RNA, 18 nt, Homo sapiens
augugcaauuuuguauuu

SEQ ID NO: 288196 - RNA, 22 nt, Homo sapiens
augugcacaugcuuacauguga

SEQ ID NO: 288197 - RNA, 22 nt, Homo sapiens
augugcacauucugguaaauau

SEQ ID NO: 288198 - RNA, 22 nt, Homo sapiens
augugcagauguuacaaauugu

SEQ ID NO: 288199 - RNA, 22 nt, Homo sapiens
augugcuugagggaaaucaguu

SEQ ID NO: 288200 - RNA, 22 nt, Homo sapiens
auguggaaagcagcaugauaug

SEQ ID NO: 288201 - RNA, 22 nt, Homo sapiens
auguggcuuuucaacuguguga

SEQ ID NO: 288202 - RNA, 22 nt, Homo sapiens
auguguaaagcuuuucuuuguu

SEQ ID NO: 288203 - RNA, 22 nt, Homo sapiens
augugugcuugugacacagccu

SEQ ID NO: 288204 - RNA, 22 nt, Homo sapiens
auuaacaucuagaguuuuggug

SEQ ID NO: 288205 - RNA, 22 nt, Homo sapiens
auuaagagcacauguucugggu

SEQ ID NO: 288206 - RNA, 22 nt, Homo sapiens
auuaagugcuugccagugcugg

SEQ ID NO: 288207 - RNA, 22 nt, Homo sapiens
auuaaucaggcaaugcuugcua

SEQ ID NO: 288208 - RNA, 22 nt, Homo sapiens
auuacauagucaaggugucuca

SEQ ID NO: 288209 - RNA, 20 nt, Homo sapiens
auuagacuugccuuauccuu

SEQ ID NO: 288210 - RNA, 22 nt, Homo sapiens
auuauaugucaucacagacacc

SEQ ID NO: 288211 - RNA, 22 nt, Homo sapiens
auucaacuaauuauugaagaug

SEQ ID NO: 288212 - RNA, 22 nt, Homo sapiens
auucaaggacuggauugcggga

SEQ ID NO: 288213 - RNA, 22 nt, Homo sapiens
auucaaggagucuucgucccaa

SEQ ID NO: 288214 - RNA, 22 nt, Homo sapiens
auucaagugaugugauucuucu

SEQ ID NO: 288215 - RNA, 22 nt, Homo sapiens
auucaccauggcuaccaagggu

SEQ ID NO: 288216 - RNA, 22 nt, Homo sapiens
auucacugugcuuggccaaauu

SEQ ID NO: 288217 - RNA, 22 nt, Homo sapiens
auucacuguggcuuucucugau

SEQ ID NO: 288218 - RNA, 22 nt, Homo sapiens
auucacuuuuauagacaggucu

SEQ ID NO: 288219 - RNA, 22 nt, Homo sapiens
auucaucagggauacuggccug

SEQ ID NO: 288220 - RNA, 22 nt, Homo sapiens
auucaucagggauauugguuga

SEQ ID NO: 288221 - RNA, 22 nt, Homo sapiens
auuccacagccgauaccaugac

SEQ ID NO: 288222 - RNA, 22 nt, Homo sapiens
auuccacuuacaugaaguaccu

SEQ ID NO: 288223 - RNA, 20 nt, Homo sapiens
auuccacuuguuugagguac

SEQ ID NO: 288224 - RNA, 21 nt, Homo sapiens
auuccacuuuuccuucaggga

SEQ ID NO: 288225 - RNA, 23 nt, Homo sapiens
auuccaguggcaauuggagaaac

SEQ ID NO: 288226 - RNA, 22 nt, Homo sapiens
auuccauagugucuguggcaga

SEQ ID NO: 288227 - RNA, 22 nt, Homo sapiens
auuccauuuguguggaauggcu

SEQ ID NO: 288228 - RNA, 22 nt, Homo sapiens
auucuauaguccuaggauuggg

SEQ ID NO: 288229 - RNA, 22 nt, Homo sapiens
auugaacacagaguagcuuucc

SEQ ID NO: 288230 - RNA, 22 nt, Homo sapiens
auugaacacuucugugugccag

SEQ ID NO: 288231 - RNA, 22 nt, Homo sapiens
auugacaguuggccaguaagug

SEQ ID NO: 288232 - RNA, 22 nt, Homo sapiens
gaauacuguccaagagugaugg

SEQ ID NO: 288233 - RNA, 22 nt, Homo sapiens
gaauagugcugcaagaaacaua

SEQ ID NO: 288234 - RNA, 22 nt, Homo sapiens
gaauagugcugcaguaaacaua

SEQ ID NO: 288235 - RNA, 22 nt, Homo sapiens
gaaugauacuguuaacgaaaga

SEQ ID NO: 288236 - RNA, 22 nt, Homo sapiens
gaaugguaaacuuccaugacug

SEQ ID NO: 288237 - RNA, 22 nt, Homo sapiens
gaaugugcuguuggcugggcgu

SEQ ID NO: 288238 - RNA, 22 nt, Homo sapiens
gaauguuuacuuuguuuaauac

SEQ ID NO: 288239 - RNA, 22 nt, Homo sapiens
gacaagagaacacugcuauauu

SEQ ID NO: 288240 - RNA, 22 nt, Homo sapiens
gacacagugaagucucuacuug

SEQ ID NO: 288241 - RNA, 22 nt, Homo sapiens
gacacugucuucugcucuuaaa

SEQ ID NO: 288242 - RNA, 18 nt, Homo sapiens
gacaguguggugauuccu

SEQ ID NO: 288243 - RNA, 22 nt, Homo sapiens
gacaguuuggugaggaagacga

SEQ ID NO: 288244 - RNA, 22 nt, Homo sapiens
ggaagccuggaaaaaauuguga

SEQ ID NO: 288245 - RNA, 23 nt, Homo sapiens
ggaaugaaaccugguuaugauau

SEQ ID NO: 288246 - RNA, 22 nt, Homo sapiens
ggaaugugugucaugcuuuugc

SEQ ID NO: 288247 - RNA, 22 nt, Homo sapiens
ggacaucauuaccauggaccca

SEQ ID NO: 288248 - RNA, 22 nt, Homo sapiens
ggacauguauauauaugugugu

SEQ ID NO: 288249 - RNA, 22 nt, Homo sapiens
ggacauuaacugcaagauagau

SEQ ID NO: 288250 - RNA, 22 nt, Homo sapiens
ggacuagggacauggggagcug

SEQ ID NO: 288251 - RNA, 22 nt, Homo sapiens
ggagagugacauauuucuaggc

SEQ ID NO: 288252 - RNA, 22 nt, Homo sapiens
ggagauaauccagggagggacu

SEQ ID NO: 288253 - RNA, 22 nt, Homo sapiens
ggagaugaaaugagcuacuuaa

SEQ ID NO: 288254 - RNA, 22 nt, Homo sapiens
ggagaugugccugcucugcucu

SEQ ID NO: 288255 - RNA, 22 nt, Homo sapiens
ggagucugaacuggacaaugac

SEQ ID NO: 288256 - RNA, 22 nt, Homo sapiens
ggagugcuguuguuacacaagg

SEQ ID NO: 288257 - RNA, 23 nt, Homo sapiens
ggaguguaaugacucgaucucgg

SEQ ID NO: 288258 - RNA, 23 nt, Homo sapiens
ggaguguauuggcacgaucucag

SEQ ID NO: 288259 - RNA, 22 nt, Homo sapiens
ggagugucagaaacaguguccu

SEQ ID NO: 288260 - RNA, 22 nt, Homo sapiens
ggagugugauuguucucuguua

SEQ ID NO: 288261 - RNA, 22 nt, Homo sapiens
ggaguguuccauuugucacauu

SEQ ID NO: 288262 - RNA, 22 nt, Homo sapiens
ggauaucauuauuucuagggcu

SEQ ID NO: 288263 - RNA, 22 nt, Homo sapiens
ggaucauaugauagcucaauuu

SEQ ID NO: 288264 - RNA, 22 nt, Homo sapiens
ggaugugugcacgcgcacaugc

SEQ ID NO: 288265 - RNA, 22 nt, Homo sapiens
ggauugcuuaagaaguuucauu

SEQ ID NO: 288266 - RNA, 22 nt, Homo sapiens
ggcaaaaucgcaauuacuuuug

SEQ ID NO: 288267 - RNA, 22 nt, Homo sapiens
ggcaaagagacaugcaucgggg

SEQ ID NO: 288268 - RNA, 22 nt, Homo sapiens
ggcaaaugaagauggagaggcu

SEQ ID NO: 288269 - RNA, 22 nt, Homo sapiens
ggcaagaacuucacucacuuuu

SEQ ID NO: 288270 - RNA, 22 nt, Homo sapiens
ggcaagaagagaguuuaaacau

SEQ ID NO: 288271 - RNA, 17 nt, Homo sapiens
ggcaagaaguggaacuc

SEQ ID NO: 288272 - RNA, 22 nt, Homo sapiens
ggcaagauagauaucaguguca

SEQ ID NO: 288273 - RNA, 22 nt, Homo sapiens
ggcaaggaggggcacuuucacu

SEQ ID NO: 288274 - RNA, 20 nt, Homo sapiens
ggcaagguagcauuucuucu

SEQ ID NO: 288275 - RNA, 22 nt, Homo sapiens
ggcaaggugaugaaugucuaca

SEQ ID NO: 288276 - RNA, 22 nt, Homo sapiens
ggcacaaugucagcucacugca

SEQ ID NO: 288277 - RNA, 22 nt, Homo sapiens
ggcaccacagacgccaggcgug

SEQ ID NO: 288278 - RNA, 22 nt, Homo sapiens
ggcacugugaugugagggggua

SEQ ID NO: 288279 - RNA, 19 nt, Homo sapiens
ggcacugugugagugagga

SEQ ID NO: 288280 - RNA, 22 nt, Homo sapiens
agcagauguuuagugagcgccu

SEQ ID NO: 288281 - RNA, 22 nt, Homo sapiens
agcagcauggguauaaaucucc

SEQ ID NO: 288282 - RNA, 22 nt, Homo sapiens
agcagcucaagacuuaaauuug

SEQ ID NO: 288283 - RNA, 22 nt, Homo sapiens
agcagcuuugaucugaaugauu

SEQ ID NO: 288284 - RNA, 22 nt, Homo sapiens
agcaggacaauaugggaucagg

SEQ ID NO: 288285 - RNA, 22 nt, Homo sapiens
agcaucacacacuacagggaaa

SEQ ID NO: 288286 - RNA, 22 nt, Homo sapiens
agcaucacaugggcugcuuggg

SEQ ID NO: 288287 - RNA, 22 nt, Homo sapiens
agcaucauaccaaucugguccu

SEQ ID NO: 288288 - RNA, 22 nt, Homo sapiens
agcaucaugcaguugcuauuca

SEQ ID NO: 288289 - RNA, 22 nt, Homo sapiens
agcaucauguuuucgagguuca

SEQ ID NO: 288290 - RNA, 17 nt, Homo sapiens
agcauguguuugagauu

SEQ ID NO: 288291 - RNA, 22 nt, Homo sapiens
agccauacaacguaugcaugua

SEQ ID NO: 288292 - RNA, 22 nt, Homo sapiens
agcccauguggcugaggcuucu

SEQ ID NO: 288293 - RNA, 23 nt, Homo sapiens
agccugguuucccugcuucuccc

SEQ ID NO: 288294 - RNA, 22 nt, Homo sapiens
agcuaaaucucauguugaauug

SEQ ID NO: 288295 - RNA, 22 nt, Homo sapiens
agcuagcauucauaguuugagg

SEQ ID NO: 288296 - RNA, 19 nt, Homo sapiens
agcuagugcucagcuguca

SEQ ID NO: 288297 - RNA, 22 nt, Homo sapiens
agcuaguggucauucaauccuu

SEQ ID NO: 288298 - RNA, 22 nt, Homo sapiens
agcucauugcaaccuccgccuc

SEQ ID NO: 288299 - RNA, 20 nt, Homo sapiens
agcuccauuccugaaggcug

SEQ ID NO: 288300 - RNA, 22 nt, Homo sapiens
agcuccauuguaaucaccuggu

SEQ ID NO: 288301 - RNA, 22 nt, Homo sapiens
agcuccuuucugcaggcagguc

SEQ ID NO: 288302 - RNA, 22 nt, Homo sapiens
agcugauggucuuguaugaugu

SEQ ID NO: 288303 - RNA, 17 nt, Homo sapiens
agcuggaauuacgggag

SEQ ID NO: 288304 - RNA, 20 nt, Homo sapiens
agcuggguguguuggugcau

SEQ ID NO: 288305 - RNA, 22 nt, Homo sapiens
agcugguaugaaaaucucccca

SEQ ID NO: 288306 - RNA, 22 nt, Homo sapiens
agcuguguugucugaagucaga

SEQ ID NO: 288307 - RNA, 22 nt, Homo sapiens
agcuuaugcuuggaagagauga

SEQ ID NO: 288308 - RNA, 20 nt, Homo sapiens
agcuugguuuggaugaucac

SEQ ID NO: 288309 - RNA, 22 nt, Homo sapiens
agcuuguauuuguagccuguug

SEQ ID NO: 288310 - RNA, 22 nt, Homo sapiens
agcuugugauuuagagugagag

SEQ ID NO: 288311 - RNA, 22 nt, Homo sapiens
agcuuguggugaauacugcuag

SEQ ID NO: 288312 - RNA, 21 nt, Homo sapiens
agcuuguguguaucacagugu

SEQ ID NO: 288313 - RNA, 22 nt, Homo sapiens
agcuuguuuuauagaaagucaa

SEQ ID NO: 288314 - RNA, 22 nt, Homo sapiens
agcuuuuugggcagcuauugac

SEQ ID NO: 288315 - RNA, 22 nt, Homo sapiens
aggaagguaaacuaacuugccu

SEQ ID NO: 288316 - RNA, 23 nt, Homo sapiens
aggaaguaacuaucuuuucuguc

SEQ ID NO: 288317 - RNA, 22 nt, Homo sapiens
aggacacugagcaugggagguu

SEQ ID NO: 288318 - RNA, 22 nt, Homo sapiens
aggaccaugguauugcuuuggg

SEQ ID NO: 288319 - RNA, 21 nt, Homo sapiens
aggagcauuguugugguggag

SEQ ID NO: 288320 - RNA, 22 nt, Homo sapiens
aggagguagaacauugccauuu

SEQ ID NO: 288321 - RNA, 22 nt, Homo sapiens
aggauacugguaugggcugaau

SEQ ID NO: 288322 - RNA, 22 nt, Homo sapiens
aggauaguaaugauagagaggc

SEQ ID NO: 288323 - RNA, 21 nt, Homo sapiens
aggcaaaugaagcagccgcuc

SEQ ID NO: 288324 - RNA, 22 nt, Homo sapiens
aggcaagagugacuacgugaaa

SEQ ID NO: 288325 - RNA, 22 nt, Homo sapiens
aggcaagcaucuugcucccuuc

SEQ ID NO: 288326 - RNA, 22 nt, Homo sapiens
aggcaagugggagacagcauuu

SEQ ID NO: 288327 - RNA, 22 nt, Homo sapiens
aggcaaugugagaguuuauuca

SEQ ID NO: 288328 - RNA, 22 nt, Homo sapiens
guagaggaauggcuccaccaua

SEQ ID NO: 288329 - RNA, 22 nt, Homo sapiens
guagagguagacuuccuugucu

SEQ ID NO: 288330 - RNA, 22 nt, Homo sapiens
guagaugcauggauuuacuucu

SEQ ID NO: 288331 - RNA, 22 nt, Homo sapiens
guagcagaacauguuccuugua

SEQ ID NO: 288332 - RNA, 22 nt, Homo sapiens
guagcagcuacuaaguugcugu

SEQ ID NO: 288333 - RNA, 18 nt, Homo sapiens
guaggucaguaccaagca

SEQ ID NO: 288334 - RNA, 22 nt, Homo sapiens
guaguaccauuaggauauuucu

SEQ ID NO: 288335 - RNA, 23 nt, Homo sapiens
guaguuugaugcaauccacuugu

SEQ ID NO: 288336 - RNA, 22 nt, Homo sapiens
guauacaugucaaaacucacau

SEQ ID NO: 288337 - RNA, 22 nt, Homo sapiens
guauacuucugaaaauagcuau

SEQ ID NO: 288338 - RNA, 22 nt, Homo sapiens
guauaugccucaguuauagcac

SEQ ID NO: 288339 - RNA, 22 nt, Homo sapiens
guaucaugaaguuucuucauuu

SEQ ID NO: 288340 - RNA, 22 nt, Homo sapiens
guaucauugccuaaugcucuca

SEQ ID NO: 288341 - RNA, 22 nt, Homo sapiens
guauggaagucaguuuguuggc

SEQ ID NO: 288342 - RNA, 22 nt, Homo sapiens
guaugguacuuuaugguuagug

SEQ ID NO: 288343 - RNA, 22 nt, Homo sapiens
guauugccugugugccagccac

SEQ ID NO: 288344 - RNA, 22 nt, Homo sapiens
gucaaagugauuguaauuaggu

SEQ ID NO: 288345 - RNA, 22 nt, Homo sapiens
gucaacauauuaauuauguucu

SEQ ID NO: 288346 - RNA, 22 nt, Homo sapiens
gucaagugaagcagugggagua

SEQ ID NO: 288347 - RNA, 22 nt, Homo sapiens
gucacagaaaaagauaugccaa

SEQ ID NO: 288348 - RNA, 22 nt, Homo sapiens
gucacagcacuuuuaguaagug

SEQ ID NO: 288349 - RNA, 22 nt, Homo sapiens
gucaccauugagucauuuccuc

SEQ ID NO: 288350 - RNA, 22 nt, Homo sapiens
gucacugacaagagagaagaac

SEQ ID NO: 288351 - RNA, 22 nt, Homo sapiens
gucacugagaagguuaguuugu

SEQ ID NO: 288352 - RNA, 22 nt, Homo sapiens
gucacugagcaauagaaaguuu

SEQ ID NO: 288353 - RNA, 22 nt, Homo sapiens
gucacuggcugucuuguaugau

SEQ ID NO: 288354 - RNA, 22 nt, Homo sapiens
gucacugggugcugcgccuguc

SEQ ID NO: 288355 - RNA, 22 nt, Homo sapiens
gucagaaucucagaugacaacg

SEQ ID NO: 288356 - RNA, 22 nt, Homo sapiens
gucagagcacugaguugugggc

SEQ ID NO: 288357 - RNA, 22 nt, Homo sapiens
gucagaugcagauuccaguucu

SEQ ID NO: 288358 - RNA, 22 nt, Homo sapiens
gucagcaaagaggaauaguuug

SEQ ID NO: 288359 - RNA, 22 nt, Homo sapiens
agugaacaaagaagugcagaua

SEQ ID NO: 288360 - RNA, 22 nt, Homo sapiens
agugacuagaauaugaauuuua

SEQ ID NO: 288361 - RNA, 22 nt, Homo sapiens
agugcaauggcgugaucuuggc

SEQ ID NO: 288362 - RNA, 22 nt, Homo sapiens
agugcaguggcucaaaaugccu

SEQ ID NO: 288363 - RNA, 22 nt, Homo sapiens
agugcauugagacuugugaguu

SEQ ID NO: 288364 - RNA, 22 nt, Homo sapiens
agugccaaaucgagggcucuga

SEQ ID NO: 288365 - RNA, 22 nt, Homo sapiens
aguggaaucuguuauacuaacu

SEQ ID NO: 288366 - RNA, 22 nt, Homo sapiens
agugggccccuagaggugaggu

SEQ ID NO: 288367 - RNA, 22 nt, Homo sapiens
agugucaggagacagguagcug

SEQ ID NO: 288368 - RNA, 22 nt, Homo sapiens
aguucaauggguuuucacucau

SEQ ID NO: 288369 - RNA, 22 nt, Homo sapiens
aguuggcacugagcugugauug

SEQ ID NO: 288370 - RNA, 22 nt, Homo sapiens
auaaaagcaggucuaggucagg

SEQ ID NO: 288371 - RNA, 22 nt, Homo sapiens
auaaaccuacauuuucacuucu

SEQ ID NO: 288372 - RNA, 19 nt, Homo sapiens
auaaacuagaacugucccc

SEQ ID NO: 288373 - RNA, 22 nt, Homo sapiens
auaaagcuauuccucucuuuuu

SEQ ID NO: 288374 - RNA, 22 nt, Homo sapiens
auaaagguaagcacuauccuga

SEQ ID NO: 288375 - RNA, 22 nt, Homo sapiens
auaaauaguaguugugguggcc

SEQ ID NO: 288376 - RNA, 20 nt, Homo sapiens
auaaauguauagguguacau

SEQ ID NO: 288377 - RNA, 18 nt, Homo sapiens
auaaccuggugcuuucaa

SEQ ID NO: 288378 - RNA, 22 nt, Homo sapiens
auaagaugaaggaagccauauc

SEQ ID NO: 288379 - RNA, 22 nt, Homo sapiens
auaaggcugguauagacauuca

SEQ ID NO: 288380 - RNA, 22 nt, Homo sapiens
auaaguauuuggacuuuacugu

SEQ ID NO: 288381 - RNA, 22 nt, Homo sapiens
auaauaccugccucagagaguu

SEQ ID NO: 288382 - RNA, 22 nt, Homo sapiens
auaauacugggaagaugagcau

SEQ ID NO: 288383 - RNA, 22 nt, Homo sapiens
auaauaguguuuagauuuggga

SEQ ID NO: 288384 - RNA, 22 nt, Homo sapiens
auaaugacuuccaguuccacuc

SEQ ID NO: 288385 - RNA, 22 nt, Homo sapiens
auaaugcuggaacuagagggca

SEQ ID NO: 288386 - RNA, 19 nt, Homo sapiens
auaauuagcagugaggaca

SEQ ID NO: 288387 - RNA, 22 nt, Homo sapiens
auacaaguuauuugaacugcgg

SEQ ID NO: 288388 - RNA, 22 nt, Homo sapiens
auacacauuccugggccucacc

SEQ ID NO: 288389 - RNA, 22 nt, Homo sapiens
auacacuagggcuccugcagaa

SEQ ID NO: 288390 - RNA, 22 nt, Homo sapiens
auacagacacagucagaggggu

SEQ ID NO: 288391 - RNA, 22 nt, Homo sapiens
auacagcuaaaauauuaaguua

SEQ ID NO: 288392 - RNA, 22 nt, Homo sapiens
auacaguaaugucuuaggcugu

SEQ ID NO: 288393 - RNA, 22 nt, Homo sapiens
auacaucugccauguuggugug

SEQ ID NO: 288394 - RNA, 22 nt, Homo sapiens
auacaugcauuugcacgagagu

SEQ ID NO: 288395 - RNA, 22 nt, Homo sapiens
auacaugugccauguugguaug

SEQ ID NO: 288396 - RNA, 22 nt, Homo sapiens
auacaugugucauguugguuug

SEQ ID NO: 288397 - RNA, 22 nt, Homo sapiens
auacaugugugagcgaagaugu

SEQ ID NO: 288398 - RNA, 20 nt, Homo sapiens
auaccacagacuggguaguu

SEQ ID NO: 288399 - RNA, 22 nt, Homo sapiens
auacugucucuugcuccugccc

SEQ ID NO: 288400 - RNA, 22 nt, Homo sapiens
auagaauguuugcgccagguga

SEQ ID NO: 288401 - RNA, 22 nt, Homo sapiens
auagaguuagaaagaaauguuu

SEQ ID NO: 288402 - RNA, 22 nt, Homo sapiens
auagaucauugucauuuuagau

SEQ ID NO: 288403 - RNA, 22 nt, Homo sapiens
auagaucuauuuauguaucccu

SEQ ID NO: 288404 - RNA, 22 nt, Homo sapiens
auagcacacuauagcuucaaac

SEQ ID NO: 288405 - RNA, 22 nt, Homo sapiens
auagcacaguguguguacacca

SEQ ID NO: 288406 - RNA, 22 nt, Homo sapiens
auagcacuuauagauuuggucu

SEQ ID NO: 288407 - RNA, 22 nt, Homo sapiens
auagcagcaccccacuaccuca

SEQ ID NO: 288408 - RNA, 22 nt, Homo sapiens
auagcagcaccucacucuacug

SEQ ID NO: 288409 - RNA, 22 nt, Homo sapiens
auagcagugccccaaacuccug

SEQ ID NO: 288410 - RNA, 22 nt, Homo sapiens
auagcagugugaaaacagacua

SEQ ID NO: 288411 - RNA, 22 nt, Homo sapiens
ccuugucacugaguggaaugaa

SEQ ID NO: 288412 - RNA, 22 nt, Homo sapiens
ccuuuguuaguuugcugagaau

SEQ ID NO: 288413 - RNA, 22 nt, Homo sapiens
ccuuuguuuaguugaauuguau

SEQ ID NO: 288414 - RNA, 22 nt, Homo sapiens
cgacuggccuagacuaguguuu

SEQ ID NO: 288415 - RNA, 22 nt, Homo sapiens
uccacuuuugugcugaauugga

SEQ ID NO: 288416 - RNA, 22 nt, Homo sapiens
uccaguggacagacauaccaug

SEQ ID NO: 288417 - RNA, 22 nt, Homo sapiens
uccaguguuauaauaugcgucu

SEQ ID NO: 288418 - RNA, 22 nt, Homo sapiens
uccaguguuucuuccacuauuu

SEQ ID NO: 288419 - RNA, 22 nt, Homo sapiens
uccauaguacuagaaacugacc

SEQ ID NO: 288420 - RNA, 22 nt, Homo sapiens
uccauagugagcagucaaugua

SEQ ID NO: 288421 - RNA, 22 nt, Homo sapiens
uccaugaguccauuagaaaaaa

SEQ ID NO: 288422 - RNA, 22 nt, Homo sapiens
uccauuuguagguagugagaca

SEQ ID NO: 288423 - RNA, 18 nt, Homo sapiens
uccauuuguaugggaugg

SEQ ID NO: 288424 - RNA, 22 nt, Homo sapiens
uccauuugucuauguuucuguu

SEQ ID NO: 288425 - RNA, 22 nt, Homo sapiens
ucccagucuagagccggauugg

SEQ ID NO: 288426 - RNA, 22 nt, Homo sapiens
uccccaguaggcaauuaacacc

SEQ ID NO: 288427 - RNA, 19 nt, Homo sapiens
uccccaguuuuccguucag

SEQ ID NO: 288428 - RNA, 22 nt, Homo sapiens
uccccugagaacuugcuagaaa

SEQ ID NO: 288429 - RNA, 22 nt, Homo sapiens
uccccugagaccccucagcacu

SEQ ID NO: 288430 - RNA, 22 nt, Homo sapiens
uccccugagucaccugcuucuc

SEQ ID NO: 288431 - RNA, 22 nt, Homo sapiens
uccccugauaccaaccaccaug

SEQ ID NO: 288432 - RNA, 22 nt, Homo sapiens
ucccguuauuaaccccugccuu

SEQ ID NO: 288433 - RNA, 22 nt, Homo sapiens
ucccuagacuccugccuuucag

SEQ ID NO: 288434 - RNA, 22 nt, Homo sapiens
ucccugaaaauuagcauuuuaa

SEQ ID NO: 288435 - RNA, 18 nt, Homo sapiens
ucccugacucaaauucuu

SEQ ID NO: 288436 - RNA, 22 nt, Homo sapiens
ucccugagguccuggauuauug

SEQ ID NO: 288437 - RNA, 22 nt, Homo sapiens
ucccuggacagccuugccuggg

SEQ ID NO: 288438 - RNA, 22 nt, Homo sapiens
ucccugguguuaguuuguucuu

SEQ ID NO: 288439 - RNA, 22 nt, Homo sapiens
ucccuguagugccuagaucaga

SEQ ID NO: 288440 - RNA, 22 nt, Homo sapiens
ucccuugguaauucuguuccuu

SEQ ID NO: 288441 - RNA, 19 nt, Homo sapiens
ucccuuuguagguaaccug

SEQ ID NO: 288442 - RNA, 22 nt, Homo sapiens
uccugagacugaggagcuuugg

SEQ ID NO: 288443 - RNA, 21 nt, Homo sapiens
uccugagagaggaguaacucu

SEQ ID NO: 288444 - RNA, 22 nt, Homo sapiens
uccugagagcagacccucuaua

SEQ ID NO: 288445 - RNA, 20 nt, Homo sapiens
uccugagauucccaguucuc

SEQ ID NO: 288446 - RNA, 22 nt, Homo sapiens
uccugagucagcauccguuugu

SEQ ID NO: 288447 - RNA, 22 nt, Homo sapiens
uccuucaguccaguggguuuug

SEQ ID NO: 288448 - RNA, 19 nt, Homo sapiens
uccuugauugcaccacugc

SEQ ID NO: 288449 - RNA, 22 nt, Homo sapiens
uccuuggugacauuucuugucu

SEQ ID NO: 288450 - RNA, 21 nt, Homo sapiens
uccuuggugaugcccugcagu

SEQ ID NO: 288451 - RNA, 23 nt, Homo sapiens
uccuugguuggcgcccuaugugu

SEQ ID NO: 288452 - RNA, 22 nt, Homo sapiens
uccuuuguuacaguuggcucug

SEQ ID NO: 288453 - RNA, 22 nt, Homo sapiens
ucgcagcucacuggagccucga

SEQ ID NO: 288454 - RNA, 22 nt, Homo sapiens
ucgcgccauucuccugccucag

SEQ ID NO: 288455 - RNA, 23 nt, Homo sapiens
ucgguccccuuggcugcccucgg

SEQ ID NO: 288456 - RNA, 22 nt, Homo sapiens
ucgugccacugcacuccagccu

SEQ ID NO: 288457 - RNA, 22 nt, Homo sapiens
ucuaaaacuagauugugaugau

SEQ ID NO: 288458 - RNA, 22 nt, Homo sapiens
ucuaagacuaagggcuagcuuc

SEQ ID NO: 288459 - RNA, 22 nt, Homo sapiens
ucuaaugcucugagaacagugc

SEQ ID NO: 288460 - RNA, 18 nt, Homo sapiens
ucuagacacugugucuau

SEQ ID NO: 288461 - RNA, 22 nt, Homo sapiens
ucuagccuaugaagcuugucca

SEQ ID NO: 288462 - RNA, 22 nt, Homo sapiens
ucuauguuuuugcuaguagugu

SEQ ID NO: 288463 - RNA, 22 nt, Homo sapiens
ucucaauggguuguagacaaag

SEQ ID NO: 288464 - RNA, 22 nt, Homo sapiens
ucucaauuugauuacauucaua

SEQ ID NO: 288465 - RNA, 22 nt, Homo sapiens
ucucacagaguugaacuuucuu

SEQ ID NO: 288466 - RNA, 22 nt, Homo sapiens
ucucacauuucacagggauggg

SEQ ID NO: 288467 - RNA, 22 nt, Homo sapiens
ucucagagccuaggguuuuuca

SEQ ID NO: 288468 - RNA, 22 nt, Homo sapiens
ucucagugaaauaaauuauuuu

SEQ ID NO: 288469 - RNA, 22 nt, Homo sapiens
ucucaguguuaucuaucugccu

SEQ ID NO: 288470 - RNA, 22 nt, Homo sapiens
ucucaguuuucuggggaagaaa

SEQ ID NO: 288471 - RNA, 22 nt, Homo sapiens
ucucaugaagauagagaauaga

SEQ ID NO: 288472 - RNA, 22 nt, Homo sapiens
ucucaugaagguggagaguagg

SEQ ID NO: 288473 - RNA, 20 nt, Homo sapiens
ucucauggagguagagaaua

SEQ ID NO: 288474 - RNA, 22 nt, Homo sapiens
ucuccauugaaauggacauaau

SEQ ID NO: 288475 - RNA, 22 nt, Homo sapiens
ucuccauuguccagaugaggaa

SEQ ID NO: 288476 - RNA, 20 nt, Homo sapiens
ucucccaaacagcaggcccu

SEQ ID NO: 288477 - RNA, 22 nt, Homo sapiens
ucucccauccaugaacuucugu

SEQ ID NO: 288478 - RNA, 22 nt, Homo sapiens
ucucugguuaugucauuaagca

SEQ ID NO: 288479 - RNA, 22 nt, Homo sapiens
ucucugguuuguggaaucuuag

SEQ ID NO: 288480 - RNA, 22 nt, Homo sapiens
ucucuguuugucuguuacuggu

SEQ ID NO: 288481 - RNA, 22 nt, Homo sapiens
ucucuuggcggaaguugcagug

SEQ ID NO: 288482 - RNA, 22 nt, Homo sapiens
ucugaaucguucccaugcagga

SEQ ID NO: 288483 - RNA, 22 nt, Homo sapiens
ucugacaaugaacaaucuauag

SEQ ID NO: 288484 - RNA, 22 nt, Homo sapiens
ucugacagugugaauauugacu

SEQ ID NO: 288485 - RNA, 22 nt, Homo sapiens
ucugagguaggugcauggauac

SEQ ID NO: 288486 - RNA, 22 nt, Homo sapiens
ucugaguggcagaaugagcuga

SEQ ID NO: 288487 - RNA, 22 nt, Homo sapiens
ucugcaagucuaaacuagccau

SEQ ID NO: 288488 - RNA, 22 nt, Homo sapiens
ucugccuacugagcacacagug

SEQ ID NO: 288489 - RNA, 23 nt, Homo sapiens
ucuggaucauucguagugccagc

SEQ ID NO: 288490 - RNA, 22 nt, Homo sapiens
ucuggauuuuugaggcaauaua

SEQ ID NO: 288491 - RNA, 22 nt, Homo sapiens
ucuggcacucagaggccuugcu

SEQ ID NO: 288492 - RNA, 21 nt, Homo sapiens
ucuggcccccucaaaucucau

SEQ ID NO: 288493 - RNA, 20 nt, Homo sapiens
ucuggccccuccaaaucuca

SEQ ID NO: 288494 - RNA, 22 nt, Homo sapiens
ucuggccccucucaaaucucau

SEQ ID NO: 288495 - RNA, 22 nt, Homo sapiens
ucuggcuuucuuuacuuaaugu

SEQ ID NO: 288496 - RNA, 23 nt, Homo sapiens
ucuggcuuugggaugcucaaggg

SEQ ID NO: 288497 - RNA, 22 nt, Homo sapiens
ucugggguuagucaaagguaug

SEQ ID NO: 288498 - RNA, 22 nt, Homo sapiens
ucugggguuuccacuuuuacuu

SEQ ID NO: 288499 - RNA, 20 nt, Homo sapiens
ucuggguuuuggccacgccc

SEQ ID NO: 288500 - RNA, 22 nt, Homo sapiens
ucugguguuauucauguaguuu

SEQ ID NO: 288501 - RNA, 19 nt, Homo sapiens
ucugucacuggggguauuc

SEQ ID NO: 288502 - RNA, 22 nt, Homo sapiens
ucugucuuugccuaaguuuguc

SEQ ID NO: 288503 - RNA, 22 nt, Homo sapiens
ucugucuuugucaggaccagag

SEQ ID NO: 288504 - RNA, 22 nt, Homo sapiens
ucugugcauggcagaggaauga

SEQ ID NO: 288505 - RNA, 22 nt, Homo sapiens
ucuguguugaugcucauuaauu

SEQ ID NO: 288506 - RNA, 22 nt, Homo sapiens
ucuguguuuagacccaggguag

SEQ ID NO: 288507 - RNA, 22 nt, Homo sapiens
ucuguugguucuuugaggagga

SEQ ID NO: 288508 - RNA, 22 nt, Homo sapiens
ucuguuguuaucauaauauuga

SEQ ID NO: 288509 - RNA, 22 nt, Homo sapiens
ucuuagugcggcugcugcagcc

SEQ ID NO: 288510 - RNA, 22 nt, Homo sapiens
ucuuaguuggaaugggauaagg

SEQ ID NO: 288511 - RNA, 22 nt, Homo sapiens
ucuucagucauauuggccugga

SEQ ID NO: 288512 - RNA, 22 nt, Homo sapiens
ucuucaugcuugaaauaauagc

SEQ ID NO: 288513 - RNA, 22 nt, Homo sapiens
ucuugcaauuuccuuaguggug

SEQ ID NO: 288514 - RNA, 22 nt, Homo sapiens
ucuugcacaaauuauuuuaacu

SEQ ID NO: 288515 - RNA, 22 nt, Homo sapiens
ucuuggcaaagaauuuuuggcu

SEQ ID NO: 288516 - RNA, 22 nt, Homo sapiens
ucuuggguuguuggcuucuccu

SEQ ID NO: 288517 - RNA, 22 nt, Homo sapiens
ucuugguugaaaauucauaaua

SEQ ID NO: 288518 - RNA, 22 nt, Homo sapiens
ucuugucacugcauccccagcu

SEQ ID NO: 288519 - RNA, 22 nt, Homo sapiens
ucuuuagguguuauaguucaag

SEQ ID NO: 288520 - RNA, 19 nt, Homo sapiens
ucuuugaggcaucgcccuc

SEQ ID NO: 288521 - RNA, 22 nt, Homo sapiens
ucuuugaguguauacuuagauu

SEQ ID NO: 288522 - RNA, 22 nt, Homo sapiens
ucuuugaguuauugugcagacu

SEQ ID NO: 288523 - RNA, 22 nt, Homo sapiens
ucuuugauaagauccagaagaa

SEQ ID NO: 288524 - RNA, 22 nt, Homo sapiens
ucuuugauguucugaaagaugg

SEQ ID NO: 288525 - RNA, 22 nt, Homo sapiens
ucuuugccuaacccaaggucau

SEQ ID NO: 288526 - RNA, 22 nt, Homo sapiens
ucuuuggcugugaagaauaaug

SEQ ID NO: 288527 - RNA, 22 nt, Homo sapiens
ucuuuggguguauuucacagcc

SEQ ID NO: 288528 - RNA, 21 nt, Homo sapiens
ucuuuggucaccaguuuucau

SEQ ID NO: 288529 - RNA, 22 nt, Homo sapiens
ucuuuggucagaaagauuacac

SEQ ID NO: 288530 - RNA, 22 nt, Homo sapiens
ucuuuggucuacuuucauaugu

SEQ ID NO: 288531 - RNA, 22 nt, Homo sapiens
ucuuugguucuguuuauguaau

SEQ ID NO: 288532 - RNA, 22 nt, Homo sapiens
ucuuuguugcauaggcuuguuc

SEQ ID NO: 288533 - RNA, 22 nt, Homo sapiens
ucuuuuguaaaaugaggaggug

SEQ ID NO: 288534 - RNA, 22 nt, Homo sapiens
ucuuuugugagucagccucucc

SEQ ID NO: 288535 - RNA, 22 nt, Homo sapiens
ugaaacacacagagaagggaga

SEQ ID NO: 288536 - RNA, 22 nt, Homo sapiens
ugaaacacacauugcccuuuau

SEQ ID NO: 288537 - RNA, 18 nt, Homo sapiens
ugaaacacauuuuuuccu

SEQ ID NO: 288538 - RNA, 22 nt, Homo sapiens
ugaaacauacacucugaugggg

SEQ ID NO: 288539 - RNA, 22 nt, Homo sapiens
ugaaaguuauauugugaaauuc

SEQ ID NO: 288540 - RNA, 22 nt, Homo sapiens
ugaaaucauguaguuauugcaa

SEQ ID NO: 288541 - RNA, 22 nt, Homo sapiens
ugaaaugccuugagauuuugac

SEQ ID NO: 288542 - RNA, 22 nt, Homo sapiens
ugaaaugcuaauucguagcuaa

SEQ ID NO: 288543 - RNA, 22 nt, Homo sapiens
ugaaaugcugucuaggggaaau

SEQ ID NO: 288544 - RNA, 22 nt, Homo sapiens
ugaaauguaaguugucuagucu

SEQ ID NO: 288545 - RNA, 22 nt, Homo sapiens
ugaaauguuaaacaaguggcuc

SEQ ID NO: 288546 - RNA, 22 nt, Homo sapiens
ugaaauuguuugcaaggauagg

SEQ ID NO: 288547 - RNA, 22 nt, Homo sapiens
ugaacacaucuccugguaccug

SEQ ID NO: 288548 - RNA, 22 nt, Homo sapiens
ugaagcuaacuugauugugaug

SEQ ID NO: 288549 - RNA, 22 nt, Homo sapiens
ugaagcuaggauuaauuuucau

SEQ ID NO: 288550 - RNA, 22 nt, Homo sapiens
ugaaggaguauggauaagucgu

SEQ ID NO: 288551 - RNA, 22 nt, Homo sapiens
ugaaggccgggcaugguggcuc

SEQ ID NO: 288552 - RNA, 21 nt, Homo sapiens
ugaaguagcauaggaugucaa

SEQ ID NO: 288553 - RNA, 22 nt, Homo sapiens
ugaaguaggcauaaguuaagcu

SEQ ID NO: 288554 - RNA, 22 nt, Homo sapiens
ugaaguagguucucguaucgcc

SEQ ID NO: 288555 - RNA, 18 nt, Homo sapiens
ugaauacagcguugggaa

SEQ ID NO: 288556 - RNA, 21 nt, Homo sapiens
ugaauacugcugcucccuuug

SEQ ID NO: 288557 - RNA, 22 nt, Homo sapiens
ugaauacuucguucaaagauaa

SEQ ID NO: 288558 - RNA, 22 nt, Homo sapiens
ugaauaguuugacagaacucuu

SEQ ID NO: 288559 - RNA, 22 nt, Homo sapiens
ugaauguauuuauuaccauuca

SEQ ID NO: 288560 - RNA, 22 nt, Homo sapiens
ugaaugugauggguuucaugug

SEQ ID NO: 288561 - RNA, 22 nt, Homo sapiens
ugaauguuugcuuacuuccaua

SEQ ID NO: 288562 - RNA, 22 nt, Homo sapiens
ugaauuguuucauucuuuacau

SEQ ID NO: 288563 - RNA, 23 nt, Homo sapiens
ugacaaccucaugcuuugucaug

SEQ ID NO: 288564 - RNA, 22 nt, Homo sapiens
ugacaagaaagcgucuucuuuu

SEQ ID NO: 288565 - RNA, 22 nt, Homo sapiens
ugacaagaguagagagggugcc

SEQ ID NO: 288566 - RNA, 22 nt, Homo sapiens
ugacaagauauggucuuaucaa

SEQ ID NO: 288567 - RNA, 22 nt, Homo sapiens
ugacaaguaaacagucagcacc

SEQ ID NO: 288568 - RNA, 19 nt, Homo sapiens
ugacacuguuggugggagg

SEQ ID NO: 288569 - RNA, 22 nt, Homo sapiens
ugacacuugcccuuagaaacau

SEQ ID NO: 288570 - RNA, 21 nt, Homo sapiens
ugacagaaaauugaguuugcu

SEQ ID NO: 288571 - RNA, 22 nt, Homo sapiens
ugacagagcaggacuucaucuc

SEQ ID NO: 288572 - RNA, 18 nt, Homo sapiens
ugacagcacaugugggga

SEQ ID NO: 288573 - RNA, 22 nt, Homo sapiens
ugacagcaucaggauuggagag

SEQ ID NO: 288574 - RNA, 22 nt, Homo sapiens
ugacagcugaagauguugaacc

SEQ ID NO: 288575 - RNA, 22 nt, Homo sapiens
ugacaggagauuaugugauguu

SEQ ID NO: 288576 - RNA, 22 nt, Homo sapiens
ugacaguaucuacagcuucuua

SEQ ID NO: 288577 - RNA, 22 nt, Homo sapiens
uggauggucagaggguuucugu

SEQ ID NO: 288578 - RNA, 22 nt, Homo sapiens
ugacauuacagucacuugcugu

SEQ ID NO: 288579 - RNA, 22 nt, Homo sapiens
ugaccacagaaagugagggagc

SEQ ID NO: 288580 - RNA, 22 nt, Homo sapiens
ugaccagaaaacaaauuaguuu

SEQ ID NO: 288581 - RNA, 22 nt, Homo sapiens
ugaccucugauagcaguaggug

SEQ ID NO: 288582 - RNA, 22 nt, Homo sapiens
ugaccuguuugaaauugccaau

SEQ ID NO: 288583 - RNA, 22 nt, Homo sapiens
ugacuacagauuugcugccaga

SEQ ID NO: 288584 - RNA, 22 nt, Homo sapiens
ugacuacauaaguaaucucaaa

SEQ ID NO: 288585 - RNA, 22 nt, Homo sapiens
ugacuagagacagaaacuaaaa

SEQ ID NO: 288586 - RNA, 22 nt, Homo sapiens
ugacuaggaggcuggaggauga

SEQ ID NO: 288587 - RNA, 22 nt, Homo sapiens
ugacuagggacauucuuccacg

SEQ ID NO: 288588 - RNA, 21 nt, Homo sapiens
ugacuagggauaugugccacu

SEQ ID NO: 288589 - RNA, 22 nt, Homo sapiens
ugacuaggggcccuggcuucuu

SEQ ID NO: 288590 - RNA, 22 nt, Homo sapiens
ugacuagucauaggcauggggg

SEQ ID NO: 288591 - RNA, 22 nt, Homo sapiens
ugacuaguuuugcuguuguuau

SEQ ID NO: 288592 - RNA, 22 nt, Homo sapiens
ugacucaagagccugacucauc

SEQ ID NO: 288593 - RNA, 22 nt, Homo sapiens
ugacuccagagacugugcuguc

SEQ ID NO: 288594 - RNA, 22 nt, Homo sapiens
ugacucgaggcgccuccagucc

SEQ ID NO: 288595 - RNA, 22 nt, Homo sapiens
ugacuucauuuuuggccaugag

SEQ ID NO: 288596 - RNA, 22 nt, Homo sapiens
ugacuugaggcucgcacaaguu

SEQ ID NO: 288597 - RNA, 22 nt, Homo sapiens
ugacuugauacauguuuuugaa

SEQ ID NO: 288598 - RNA, 22 nt, Homo sapiens
ugacuugaucacccccuaaggg

SEQ ID NO: 288599 - RNA, 22 nt, Homo sapiens
ugacuugaucauuacacauucu

SEQ ID NO: 288600 - RNA, 22 nt, Homo sapiens
ugacuuuagaauuuuauccaga

SEQ ID NO: 288601 - RNA, 16 nt, Homo sapiens
ugagaacaugcagcau

SEQ ID NO: 288602 - RNA, 19 nt, Homo sapiens
ugagaacaugugguauuug

SEQ ID NO: 288603 - RNA, 22 nt, Homo sapiens
ugagaacuaaaaugugguauau

SEQ ID NO: 288604 - RNA, 22 nt, Homo sapiens
ugagaacuaaugaagaauuuau

SEQ ID NO: 288605 - RNA, 22 nt, Homo sapiens
ugagaacugcagggagcugcau

SEQ ID NO: 288606 - RNA, 22 nt, Homo sapiens
ugagaacugguagcacuuguga

SEQ ID NO: 288607 - RNA, 22 nt, Homo sapiens
ugagaacuuauggugauuuuuu

SEQ ID NO: 288608 - RNA, 22 nt, Homo sapiens
ugagaacuuugucuuuuacucu

SEQ ID NO: 288609 - RNA, 22 nt, Homo sapiens
ugagaagacaucagcuuucgga

SEQ ID NO: 288610 - RNA, 22 nt, Homo sapiens
ugagaagcauaccagugucugu

SEQ ID NO: 288611 - RNA, 22 nt, Homo sapiens
ugagaaugacugggcaugcugc

SEQ ID NO: 288612 - RNA, 22 nt, Homo sapiens
ugagaaugaugauuuccaguuu

SEQ ID NO: 288613 - RNA, 22 nt, Homo sapiens
ugagacaaaguuguuggauguu

SEQ ID NO: 288614 - RNA, 22 nt, Homo sapiens
ugagacacuucccagaucccuu

SEQ ID NO: 288615 - RNA, 23 nt, Homo sapiens
ugagacauuggaaaguuaggcag

SEQ ID NO: 288616 - RNA, 22 nt, Homo sapiens
ugagacgaagucuugcucuguu

SEQ ID NO: 288617 - RNA, 22 nt, Homo sapiens
ugagacggagucuugcccuguc

SEQ ID NO: 288618 - RNA, 22 nt, Homo sapiens
ugagacugagucucgcucuauu

SEQ ID NO: 288619 - RNA, 22 nt, Homo sapiens
ugagacugaguuucacuuuugu

SEQ ID NO: 288620 - RNA, 22 nt, Homo sapiens
ugagacugaguuuccaucuugu

SEQ ID NO: 288621 - RNA, 22 nt, Homo sapiens
ugagacugaguuuugccuuugu

SEQ ID NO: 288622 - RNA, 22 nt, Homo sapiens
ugagacugaguuuugcucguug

SEQ ID NO: 288623 - RNA, 22 nt, Homo sapiens
ugagacugauaggacauuuucu

SEQ ID NO: 288624 - RNA, 22 nt, Homo sapiens
ugagacuguuuuggggaacuuc

SEQ ID NO: 288625 - RNA, 22 nt, Homo sapiens
ugagagacaguuuguuaaaauu

SEQ ID NO: 288626 - RNA, 22 nt, Homo sapiens
ugagagacauuuguuguagagu

SEQ ID NO: 288627 - RNA, 22 nt, Homo sapiens
ugagagaugaacucugauaugu

SEQ ID NO: 288628 - RNA, 19 nt, Homo sapiens
ugagagcacaacugaacaa

SEQ ID NO: 288629 - RNA, 22 nt, Homo sapiens
ugagagcuuugaugcacuguuu

SEQ ID NO: 288630 - RNA, 21 nt, Homo sapiens
ugagaguaguguauuauucuc

SEQ ID NO: 288631 - RNA, 22 nt, Homo sapiens
ugagaguauaaauugaugcagc

SEQ ID NO: 288632 - RNA, 22 nt, Homo sapiens
ugagagucacugaccugguaua

SEQ ID NO: 288633 - RNA, 22 nt, Homo sapiens
ugagauaaucaugugguuuuug

SEQ ID NO: 288634 - RNA, 22 nt, Homo sapiens
ugagauaaugcaugugaagauc

SEQ ID NO: 288635 - RNA, 22 nt, Homo sapiens
ugagaucaagauguuagggacu

SEQ ID NO: 288636 - RNA, 22 nt, Homo sapiens
ugagaucacuaagagguaaugg

SEQ ID NO: 288637 - RNA, 20 nt, Homo sapiens
ugagauccacgugaaguaug

SEQ ID NO: 288638 - RNA, 22 nt, Homo sapiens
ugagaucgagucucgcucuguc

SEQ ID NO: 288639 - RNA, 22 nt, Homo sapiens
ugagaucuuugcuguccucacc

SEQ ID NO: 288640 - RNA, 22 nt, Homo sapiens
ugagaugaagucucacucuguc

SEQ ID NO: 288641 - RNA, 22 nt, Homo sapiens
ugagaugacgacacaccucagu

SEQ ID NO: 288642 - RNA, 22 nt, Homo sapiens
ugagaugaggucucgcucuguc

SEQ ID NO: 288643 - RNA, 22 nt, Homo sapiens
ugagaugagucucgcucuguca

SEQ ID NO: 288644 - RNA, 22 nt, Homo sapiens
ugagaugauagauauguuaauu

SEQ ID NO: 288645 - RNA, 22 nt, Homo sapiens
ugagaugaucaaaguauaggcu

SEQ ID NO: 288646 - RNA, 21 nt, Homo sapiens
ugagaugauccugcaugcaug

SEQ ID NO: 288647 - RNA, 22 nt, Homo sapiens
ugagaugauuuaauggagccca

SEQ ID NO: 288648 - RNA, 22 nt, Homo sapiens
ugagauggcuuuauugcugaau

SEQ ID NO: 288649 - RNA, 22 nt, Homo sapiens
ugagauggguucugguccccug

SEQ ID NO: 288650 - RNA, 22 nt, Homo sapiens
ugagauguaaucucgcucuguc

SEQ ID NO: 288651 - RNA, 22 nt, Homo sapiens
ugagauguagauauggauuaga

SEQ ID NO: 288652 - RNA, 22 nt, Homo sapiens
ugagauguggcuagagagguug

SEQ ID NO: 288653 - RNA, 22 nt, Homo sapiens
ugagaugugugcauucaacuca

SEQ ID NO: 288654 - RNA, 22 nt, Homo sapiens
ugagauguuuguuucagugccu

SEQ ID NO: 288655 - RNA, 23 nt, Homo sapiens
ugagauuacccagaaagaguaua

SEQ ID NO: 288656 - RNA, 22 nt, Homo sapiens
cugaggucugaauccagguauc

SEQ ID NO: 288657 - RNA, 20 nt, Homo sapiens
cugagguugggguccuuccc

SEQ ID NO: 288658 - RNA, 22 nt, Homo sapiens
cugauauuuuaaaauuggcugg

SEQ ID NO: 288659 - RNA, 22 nt, Homo sapiens
cugaucuaugaacacaggauau

SEQ ID NO: 288660 - RNA, 22 nt, Homo sapiens
cugauuuguccccagccucaug

SEQ ID NO: 288661 - RNA, 22 nt, Homo sapiens
gucauggaggaugaauggccaa

SEQ ID NO: 288662 - RNA, 22 nt, Homo sapiens
gucauggugcuagcgggaaugu

SEQ ID NO: 288663 - RNA, 22 nt, Homo sapiens
gucauugagucagggaguaucu

SEQ ID NO: 288664 - RNA, 22 nt, Homo sapiens
gucauuguguggacauggagaa

SEQ ID NO: 288665 - RNA, 22 nt, Homo sapiens
guccaaagugggagaggugggg

SEQ ID NO: 288666 - RNA, 22 nt, Homo sapiens
guccaaauccaugggauguaca

SEQ ID NO: 288667 - RNA, 22 nt, Homo sapiens
gucccaguggaaccuccaagcu

SEQ ID NO: 288668 - RNA, 22 nt, Homo sapiens
gucucacagcuagcugcuuuau

SEQ ID NO: 288669 - RNA, 22 nt, Homo sapiens
gucucagugcgaaucucaaaga

SEQ ID NO: 288670 - RNA, 22 nt, Homo sapiens
gucugcaugucauaugauagua

SEQ ID NO: 288671 - RNA, 22 nt, Homo sapiens
gucuguuuggggaccuguggcc

SEQ ID NO: 288672 - RNA, 21 nt, Homo sapiens
gucuuacagccagaugccucu

SEQ ID NO: 288673 - RNA, 22 nt, Homo sapiens
gucuugaaggcugaguaccugu

SEQ ID NO: 288674 - RNA, 22 nt, Homo sapiens
gucuuggagacauugccauuga

SEQ ID NO: 288675 - RNA, 20 nt, Homo sapiens
gucuuguagcucaaguuauu

SEQ ID NO: 288676 - RNA, 22 nt, Homo sapiens
gucuuugcuuuuaaccagaggu

SEQ ID NO: 288677 - RNA, 22 nt, Homo sapiens
gucuuuggaaaaaaugucuguu

SEQ ID NO: 288678 - RNA, 22 nt, Homo sapiens
gucuuuguuauuaugaaucaac

SEQ ID NO: 288679 - RNA, 22 nt, Homo sapiens
gucuuuugcuagccagagagcu

SEQ ID NO: 288680 - RNA, 22 nt, Homo sapiens
gugaaaagaugagcaccauaca

SEQ ID NO: 288681 - RNA, 22 nt, Homo sapiens
gugaaagauuaaaccagugugu

SEQ ID NO: 288682 - RNA, 22 nt, Homo sapiens
gugaaauauuuaacguccaggu

SEQ ID NO: 288683 - RNA, 22 nt, Homo sapiens
gugaaaugaaacgcuaugucuu

SEQ ID NO: 288684 - RNA, 22 nt, Homo sapiens
gugaacaauguuuuauccuggg

SEQ ID NO: 288685 - RNA, 22 nt, Homo sapiens
gugaacuguuugaggaagagaa

SEQ ID NO: 288686 - RNA, 22 nt, Homo sapiens
gugaagugugaccucagcaucu

SEQ ID NO: 288687 - RNA, 22 nt, Homo sapiens
gugaaugaaugggugaauacau

SEQ ID NO: 288688 - RNA, 22 nt, Homo sapiens
gugaauguuuucuuacauggua

SEQ ID NO: 288689 - RNA, 22 nt, Homo sapiens
gugaauugagagaacuguguua

SEQ ID NO: 288690 - RNA, 22 nt, Homo sapiens
gugacacagcaagacuccgucu

SEQ ID NO: 288691 - RNA, 22 nt, Homo sapiens
gugacagaguaagacccuguau

SEQ ID NO: 288692 - RNA, 22 nt, Homo sapiens
gugacugcauccauccaggcuu

SEQ ID NO: 288693 - RNA, 22 nt, Homo sapiens
gugagaaucaaacuacauaaau

SEQ ID NO: 288694 - RNA, 18 nt, Homo sapiens
gugagaaugacuguucug

SEQ ID NO: 288695 - RNA, 22 nt, Homo sapiens
gugagacugguccugaacccag

SEQ ID NO: 288696 - RNA, 22 nt, Homo sapiens
gugagauaucuagacuagggaa

SEQ ID NO: 288697 - RNA, 22 nt, Homo sapiens
gugagaugaggucucacucugu

SEQ ID NO: 288698 - RNA, 22 nt, Homo sapiens
gugagaugauggguauguuaau

SEQ ID NO: 288699 - RNA, 22 nt, Homo sapiens
gugagaugguaucucauugugg

SEQ ID NO: 288700 - RNA, 22 nt, Homo sapiens
gugagaugugacuucugccucu

SEQ ID NO: 288701 - RNA, 22 nt, Homo sapiens
gugagauuagcugagauccuug

SEQ ID NO: 288702 - RNA, 22 nt, Homo sapiens
gugagcaguguccuugggggca

SEQ ID NO: 288703 - RNA, 22 nt, Homo sapiens
gugagcauaggaggcuucuguu

SEQ ID NO: 288704 - RNA, 22 nt, Homo sapiens
gugaggcugguccugccuccca

SEQ ID NO: 288705 - RNA, 22 nt, Homo sapiens
gugagguacgugucaagaacca

SEQ ID NO: 288706 - RNA, 22 nt, Homo sapiens
gugagucaaucugagggguuca

SEQ ID NO: 288707 - RNA, 22 nt, Homo sapiens
gugaguggacgugaccaauaaa

SEQ ID NO: 288708 - RNA, 22 nt, Homo sapiens
gugaucucagcucacuggaacc

SEQ ID NO: 288709 - RNA, 22 nt, Homo sapiens
gugaugacauucagagaugaag

SEQ ID NO: 288710 - RNA, 22 nt, Homo sapiens
gugauguguuuguucuaucucu

SEQ ID NO: 288711 - RNA, 22 nt, Homo sapiens
uuuguucuucguuccugagcca

SEQ ID NO: 288712 - RNA, 22 nt, Homo sapiens
uuuuacacaucaccgcucgugu

SEQ ID NO: 288713 - RNA, 22 nt, Homo sapiens
uuuuacacuguugguuggaaug

SEQ ID NO: 288714 - RNA, 22 nt, Homo sapiens
uuuuacagaggagguugcugau

SEQ ID NO: 288715 - RNA, 22 nt, Homo sapiens
uuuuagcaaagagacugguggc

SEQ ID NO: 288716 - RNA, 22 nt, Homo sapiens
uuuuagcagccaugacaaagau

SEQ ID NO: 288717 - RNA, 22 nt, Homo sapiens
uuuuaguggacaaagguauuua

SEQ ID NO: 288718 - RNA, 22 nt, Homo sapiens
uuuucaguuuuccagguagccg

SEQ ID NO: 288719 - RNA, 22 nt, Homo sapiens
uuuuccagugggacucccauua

SEQ ID NO: 288720 - RNA, 23 nt, Homo sapiens
uuuugcaauaagucacuggaaua

SEQ ID NO: 288721 - RNA, 22 nt, Homo sapiens
uuuugcaauauguuccugaaua

SEQ ID NO: 288722 - RNA, 22 nt, Homo sapiens
uuuugcacauugauuugguauc

SEQ ID NO: 288723 - RNA, 22 nt, Homo sapiens
uuuugcaccauccuaauaguau

SEQ ID NO: 288724 - RNA, 22 nt, Homo sapiens
uuuugcucuucauagguccugu

SEQ ID NO: 288725 - RNA, 22 nt, Homo sapiens
uuuugcuuuuccucggucccac

SEQ ID NO: 288726 - RNA, 19 nt, Homo sapiens
uuuuggaaaugugaacagc

SEQ ID NO: 288727 - RNA, 22 nt, Homo sapiens
uuuuggcucuugguaggucaga

SEQ ID NO: 288728 - RNA, 22 nt, Homo sapiens
uuuuguacgccuguguccauca

SEQ ID NO: 288729 - RNA, 19 nt, Homo sapiens
uuuuguacucugugacuug

SEQ ID NO: 288730 - RNA, 22 nt, Homo sapiens
uuuuugauuaauggguagacca

SEQ ID NO: 288731 - RNA, 21 nt, Homo sapiens
uuuuugguggucauggauaga

SEQ ID NO: 288732 - RNA, 22 nt, Homo sapiens
uuuuuuaguuagcugggcauga

SEQ ID NO: 288733 - RNA, 22 nt, Homo sapiens
gugggcaaagcuaguguguaga

SEQ ID NO: 288734 - RNA, 22 nt, Homo sapiens
gugggcucguucguguuagaca

SEQ ID NO: 288735 - RNA, 22 nt, Homo sapiens
gugggguagcaggcuccuaucu

SEQ ID NO: 288736 - RNA, 22 nt, Homo sapiens
gugguagaaauguagaugcuag

SEQ ID NO: 288737 - RNA, 22 nt, Homo sapiens
gugguaucauuuaaccauuaga

SEQ ID NO: 288738 - RNA, 22 nt, Homo sapiens
gugguucuagaauugaguaucc

SEQ ID NO: 288739 - RNA, 21 nt, Homo sapiens
gugguucuagagaaacagaau

SEQ ID NO: 288740 - RNA, 22 nt, Homo sapiens
gugguucuagagggacagaaug

SEQ ID NO: 288741 - RNA, 22 nt, Homo sapiens
gugguuuuuagauuucuacagu

SEQ ID NO: 288742 - RNA, 22 nt, Homo sapiens
guguaaaacaauuagaggauuu

SEQ ID NO: 288743 - RNA, 22 nt, Homo sapiens
guguaacaacagcacuccacug

SEQ ID NO: 288744 - RNA, 22 nt, Homo sapiens
guguagagaaaaguaccauuuu

SEQ ID NO: 288745 - RNA, 22 nt, Homo sapiens
guguauauccuauuaguucugu

SEQ ID NO: 288746 - RNA, 22 nt, Homo sapiens
guguauguuguccauggaugcg

SEQ ID NO: 288747 - RNA, 21 nt, Homo sapiens
gugucacagacaugacagaug

SEQ ID NO: 288748 - RNA, 22 nt, Homo sapiens
gugucaguggggagugaucuuc

SEQ ID NO: 288749 - RNA, 22 nt, Homo sapiens
gugucccagugugcauacaggu

SEQ ID NO: 288750 - RNA, 18 nt, Homo sapiens
gugucugguuaugggagu

SEQ ID NO: 288751 - RNA, 22 nt, Homo sapiens
gugugacagcuauagacaugau

SEQ ID NO: 288752 - RNA, 22 nt, Homo sapiens
gugugcaacuuucauuaauauu

SEQ ID NO: 288753 - RNA, 22 nt, Homo sapiens
gugugcaauuuugugggaggca

SEQ ID NO: 288754 - RNA, 22 nt, Homo sapiens
gugugcaugucuuuuuaguagg

SEQ ID NO: 288755 - RNA, 22 nt, Homo sapiens
gugugucuugaccaggaucgga

SEQ ID NO: 288756 - RNA, 22 nt, Homo sapiens
guguucaaacccaggucugucu

SEQ ID NO: 288757 - RNA, 22 nt, Homo sapiens
guguucauggaauuugcaauug

SEQ ID NO: 288758 - RNA, 22 nt, Homo sapiens
guuacagucuuguguaagguua

SEQ ID NO: 288759 - RNA, 22 nt, Homo sapiens
guuauauguuuggaaugaggaa

SEQ ID NO: 288760 - RNA, 22 nt, Homo sapiens
guuaugcagcuuagaaaaugaa

SEQ ID NO: 288761 - RNA, 22 nt, Homo sapiens
guuauggaguauaugugaacug

SEQ ID NO: 288762 - RNA, 22 nt, Homo sapiens
guuauguuaaauuguuguaugc

SEQ ID NO: 288763 - RNA, 22 nt, Homo sapiens
guuauguuaguuacaaggcuag

SEQ ID NO: 288764 - RNA, 22 nt, Homo sapiens
guuauguuauguuauguuaugu

SEQ ID NO: 288765 - RNA, 22 nt, Homo sapiens
guuauuguccauuuauuuagca

SEQ ID NO: 288766 - RNA, 22 nt, Homo sapiens
guucacaguuaggacaacugcu

SEQ ID NO: 288767 - RNA, 22 nt, Homo sapiens
guucagcaggggcuucaauggu

SEQ ID NO: 288768 - RNA, 22 nt, Homo sapiens
guucaucaggcuuucucuagag

SEQ ID NO: 288769 - RNA, 22 nt, Homo sapiens
guucaucagggauacuggcuua

SEQ ID NO: 288770 - RNA, 23 nt, Homo sapiens
guucaucagggauauuggccuga

SEQ ID NO: 288771 - RNA, 17 nt, Homo sapiens
guucccaguggcauuug

SEQ ID NO: 288772 - RNA, 22 nt, Homo sapiens
guuccuuguagaugcuggauau

SEQ ID NO: 288773 - RNA, 22 nt, Homo sapiens
guucucacuggugcugguaagu

SEQ ID NO: 288774 - RNA, 22 nt, Homo sapiens
guucuggagauaaagccaaggu

SEQ ID NO: 288775 - RNA, 22 nt, Homo sapiens
guugaaauccuaacccccuagu

SEQ ID NO: 288776 - RNA, 22 nt, Homo sapiens
guugaacaauagauucauauca

SEQ ID NO: 288777 - RNA, 22 nt, Homo sapiens
guugagcaagcuuuggagccua

SEQ ID NO: 288778 - RNA, 20 nt, Homo sapiens
guugaugcugaaguugcuua

SEQ ID NO: 288779 - RNA, 22 nt, Homo sapiens
guugcaugucugggaggccagc

SEQ ID NO: 288780 - RNA, 22 nt, Homo sapiens
guugccuaggcuggucuugaac

SEQ ID NO: 288781 - RNA, 22 nt, Homo sapiens
guugcucaggcugaagugcagu

SEQ ID NO: 288782 - RNA, 22 nt, Homo sapiens
guuggaauuaaaaggcaaguau

SEQ ID NO: 288783 - RNA, 22 nt, Homo sapiens
guuggaguuaagcaguaaugaa

SEQ ID NO: 288784 - RNA, 22 nt, Homo sapiens
guuggcuguuucccccaaguga

SEQ ID NO: 288785 - RNA, 22 nt, Homo sapiens
guuggucucguauaaaucaagg

SEQ ID NO: 288786 - RNA, 22 nt, Homo sapiens
guuguauaggcauggggagaau

SEQ ID NO: 288787 - RNA, 22 nt, Homo sapiens
guuugcacuccuaugagaaucu

SEQ ID NO: 288788 - RNA, 22 nt, Homo sapiens
guuugcagaucaugaagaaccc

SEQ ID NO: 288789 - RNA, 22 nt, Homo sapiens
guuugcauagugcugggagggg

SEQ ID NO: 288790 - RNA, 22 nt, Homo sapiens
guuugccuuuuagauaggaaug

SEQ ID NO: 288791 - RNA, 22 nt, Homo sapiens
guuuggauuuucuaauuucugu

SEQ ID NO: 288792 - RNA, 22 nt, Homo sapiens
guuuggcucuuguuucugucaa

SEQ ID NO: 288793 - RNA, 22 nt, Homo sapiens
guuuggcuuucucucuauccug

SEQ ID NO: 288794 - RNA, 22 nt, Homo sapiens
guuugugcuccuaugagaaucu

SEQ ID NO: 288795 - RNA, 22 nt, Homo sapiens
guuugugguuaaagccuuucau

SEQ ID NO: 288796 - RNA, 15 nt, Homo sapiens
guuuuuggauacaau

SEQ ID NO: 288797 - RNA, 22 nt, Homo sapiens
uaaacugcuugaggguaaguac

SEQ ID NO: 288798 - RNA, 22 nt, Homo sapiens
uaaagaugcugggaaggcuagg

SEQ ID NO: 288799 - RNA, 17 nt, Homo sapiens
uaaagccagucaaguca

SEQ ID NO: 288800 - RNA, 22 nt, Homo sapiens
uaaagcuacagagcggaaaauu

SEQ ID NO: 288801 - RNA, 22 nt, Homo sapiens
uaaagcuuagauccaugguggc

SEQ ID NO: 288802 - RNA, 21 nt, Homo sapiens
uaaagcuuagcuauaguggcu

SEQ ID NO: 288803 - RNA, 22 nt, Homo sapiens
uaaaguucuuuuaugggccggg

SEQ ID NO: 288804 - RNA, 22 nt, Homo sapiens
uaaaugcuugagaugauggaua

SEQ ID NO: 288805 - RNA, 18 nt, Homo sapiens
uaaauugcuucaccugag

SEQ ID NO: 288806 - RNA, 22 nt, Homo sapiens
uaacaaugucuuaugggcuuaa

SEQ ID NO: 288807 - RNA, 22 nt, Homo sapiens
uaacacagagcuccuaaucccu

SEQ ID NO: 288808 - RNA, 19 nt, Homo sapiens
uaacacaguuguguuugag

SEQ ID NO: 288809 - RNA, 21 nt, Homo sapiens
uaacagcuccacuccauucuc

SEQ ID NO: 288810 - RNA, 22 nt, Homo sapiens
uaacagcucuacagcugcucuu

SEQ ID NO: 288811 - RNA, 22 nt, Homo sapiens
uaacagucaagguuugaccagg

SEQ ID NO: 288812 - RNA, 18 nt, Homo sapiens
uaacagucucucaggauc

SEQ ID NO: 288813 - RNA, 22 nt, Homo sapiens
uaacauucacaugcugcaaaaa

SEQ ID NO: 288814 - RNA, 22 nt, Homo sapiens
uaacccacgcagaauggacaag

SEQ ID NO: 288815 - RNA, 21 nt, Homo sapiens
uaacccugaaggagcucugga

SEQ ID NO: 288816 - RNA, 22 nt, Homo sapiens
uaacccuuacaacuacacucgu

SEQ ID NO: 288817 - RNA, 22 nt, Homo sapiens
aucugugaaugaaguuauuuug

SEQ ID NO: 288818 - RNA, 22 nt, Homo sapiens
aucuuggauuaccugggugggu

SEQ ID NO: 288819 - RNA, 22 nt, Homo sapiens
aucuugggugggaacugagaau

SEQ ID NO: 288820 - RNA, 22 nt, Homo sapiens
aucuuguguugaauggugcaga

SEQ ID NO: 288821 - RNA, 22 nt, Homo sapiens
aucuuugcugagaugcauggca

SEQ ID NO: 288822 - RNA, 22 nt, Homo sapiens
augaaaagcauaaacgcugaag

SEQ ID NO: 288823 - RNA, 23 nt, Homo sapiens
augaaagcccuugcaaaugcugg

SEQ ID NO: 288824 - RNA, 22 nt, Homo sapiens
augaaaguguguggaaacuuga

SEQ ID NO: 288825 - RNA, 22 nt, Homo sapiens
augaacgugugcauauaagcag

SEQ ID NO: 288826 - RNA, 18 nt, Homo sapiens
augaacucaucaguucuu

SEQ ID NO: 288827 - RNA, 18 nt, Homo sapiens
augaacucaucauuuuuu

SEQ ID NO: 288828 - RNA, 22 nt, Homo sapiens
augaagagaaaguggaucuugg

SEQ ID NO: 288829 - RNA, 22 nt, Homo sapiens
augaagaucaugaagacggcuu

SEQ ID NO: 288830 - RNA, 22 nt, Homo sapiens
augaagauguugccuuuuuaau

SEQ ID NO: 288831 - RNA, 22 nt, Homo sapiens
augaaguauuaggacacauuua

SEQ ID NO: 288832 - RNA, 22 nt, Homo sapiens
augaauagaguuaauugaguac

SEQ ID NO: 288833 - RNA, 22 nt, Homo sapiens
augaaugcacugcggguggaug

SEQ ID NO: 288834 - RNA, 23 nt, Homo sapiens
augaauguaaagaaugugggaag

SEQ ID NO: 288835 - RNA, 22 nt, Homo sapiens
augaaugucuuauuuugagaaa

SEQ ID NO: 288836 - RNA, 22 nt, Homo sapiens
augacagugagugagcucucac

SEQ ID NO: 288837 - RNA, 22 nt, Homo sapiens
augacccugaccuaagccaauc

SEQ ID NO: 288838 - RNA, 22 nt, Homo sapiens
augacuaaaggguuuauguuga

SEQ ID NO: 288839 - RNA, 22 nt, Homo sapiens
augacugaguagcauuccauua

SEQ ID NO: 288840 - RNA, 22 nt, Homo sapiens
augacugucuugcagaggcuau

SEQ ID NO: 288841 - RNA, 17 nt, Homo sapiens
augacuucuucagugug

SEQ ID NO: 288842 - RNA, 22 nt, Homo sapiens
augacuuuucugaaaaccacca

SEQ ID NO: 288843 - RNA, 22 nt, Homo sapiens
augagaaugaagccuggcgugu

SEQ ID NO: 288844 - RNA, 22 nt, Homo sapiens
augagaaugauucuguuauggu

SEQ ID NO: 288845 - RNA, 22 nt, Homo sapiens
augagaauguaaguuaaugaaa

SEQ ID NO: 288846 - RNA, 22 nt, Homo sapiens
augagacuagaagagaauaaua

SEQ ID NO: 288847 - RNA, 22 nt, Homo sapiens
augagagcuaacuguggguaca

SEQ ID NO: 288848 - RNA, 22 nt, Homo sapiens
augagagcugacuuuaaggcaa

SEQ ID NO: 288849 - RNA, 22 nt, Homo sapiens
augagagugagagcagccccuu

SEQ ID NO: 288850 - RNA, 22 nt, Homo sapiens
augagauaaaccaucucuuaag

SEQ ID NO: 288851 - RNA, 22 nt, Homo sapiens
augagauacuacaaaugaguuu

SEQ ID NO: 288852 - RNA, 22 nt, Homo sapiens
augagauauuuuauaagaucau

SEQ ID NO: 288853 - RNA, 22 nt, Homo sapiens
augagaugaggaauggcccucc

SEQ ID NO: 288854 - RNA, 22 nt, Homo sapiens
augagauuauguaaagagacca

SEQ ID NO: 288855 - RNA, 22 nt, Homo sapiens
augagcugauuuccuuaccaua

SEQ ID NO: 288856 - RNA, 22 nt, Homo sapiens
augagcuguuuggaagacacuu

SEQ ID NO: 288857 - RNA, 22 nt, Homo sapiens
augaggaagucaggcccagggg

SEQ ID NO: 288858 - RNA, 22 nt, Homo sapiens
augaggagguaugauuuucuga

SEQ ID NO: 288859 - RNA, 21 nt, Homo sapiens
augagguguacuguggugaaa

SEQ ID NO: 288860 - RNA, 22 nt, Homo sapiens
augagguguuuauuguauccug

SEQ ID NO: 288861 - RNA, 22 nt, Homo sapiens
augaguaugagaauacauuaag

SEQ ID NO: 288862 - RNA, 22 nt, Homo sapiens
augauaucuuguuuuucaugca

SEQ ID NO: 288863 - RNA, 22 nt, Homo sapiens
augauauuauucuagcccagag

SEQ ID NO: 288864 - RNA, 22 nt, Homo sapiens
augaucacaccacugcacucca

SEQ ID NO: 288865 - RNA, 22 nt, Homo sapiens
augaucaucugaaagcuuuuac

SEQ ID NO: 288866 - RNA, 22 nt, Homo sapiens
augaugucauuuuaauuucuaa

SEQ ID NO: 288867 - RNA, 22 nt, Homo sapiens
augauucugaucuagagcuugg

SEQ ID NO: 288868 - RNA, 22 nt, Homo sapiens
augcaaacaucugaagagacau

SEQ ID NO: 288869 - RNA, 22 nt, Homo sapiens
augcaaaucuuaaguaugugug

SEQ ID NO: 288870 - RNA, 22 nt, Homo sapiens
augcaagaaauaucucuuuuuc

SEQ ID NO: 288871 - RNA, 22 nt, Homo sapiens
augcaagacaccgauuagcuuu

SEQ ID NO: 288872 - RNA, 22 nt, Homo sapiens
augcaauucuagauugauagua

SEQ ID NO: 288873 - RNA, 22 nt, Homo sapiens
augcacaucagcuccagggacc

SEQ ID NO: 288874 - RNA, 19 nt, Homo sapiens
augcacgugaaaugcauuu

SEQ ID NO: 288875 - RNA, 22 nt, Homo sapiens
augcacuguuguuauuggauaa

SEQ ID NO: 288876 - RNA, 22 nt, Homo sapiens
augcauggucugaagucaaccu

SEQ ID NO: 288877 - RNA, 22 nt, Homo sapiens
augcaugucaaauuuguagguu

SEQ ID NO: 288878 - RNA, 22 nt, Homo sapiens
augccaagaugagcacgcgucu

SEQ ID NO: 288879 - RNA, 19 nt, Homo sapiens
augccacagugaggucaga

SEQ ID NO: 288880 - RNA, 22 nt, Homo sapiens
augccacugcacuccaaccugg

SEQ ID NO: 288881 - RNA, 22 nt, Homo sapiens
augccacugcacuucagccugg

SEQ ID NO: 288882 - RNA, 22 nt, Homo sapiens
augccacugcacuucagcuugg

SEQ ID NO: 288883 - RNA, 22 nt, Homo sapiens
augccauugcacuccagccuag

SEQ ID NO: 288884 - RNA, 22 nt, Homo sapiens
augccuaagacccuguggggga

SEQ ID NO: 288885 - RNA, 19 nt, Homo sapiens
augccucaguuuuguacuu

SEQ ID NO: 288886 - RNA, 19 nt, Homo sapiens
augccuggagaugguuaua

SEQ ID NO: 288887 - RNA, 22 nt, Homo sapiens
augcuacauucuacaauuaggc

SEQ ID NO: 288888 - RNA, 22 nt, Homo sapiens
augcuggugcuagaaacuggaa

SEQ ID NO: 288889 - RNA, 22 nt, Homo sapiens
augcuggugguucacaugcgca

SEQ ID NO: 288890 - RNA, 22 nt, Homo sapiens
auggaacugaagugcugcccuu

SEQ ID NO: 288891 - RNA, 22 nt, Homo sapiens
auggaagcauaguauucuauug

SEQ ID NO: 288892 - RNA, 22 nt, Homo sapiens
auggaagucucuguuaaguuuc

SEQ ID NO: 288893 - RNA, 22 nt, Homo sapiens
auggaauggcacuuugaagauu

SEQ ID NO: 288894 - RNA, 22 nt, Homo sapiens
cuggaaggaaaaacaaccacag

SEQ ID NO: 288895 - RNA, 22 nt, Homo sapiens
cuggaauauuagcuggucuuaa

SEQ ID NO: 288896 - RNA, 22 nt, Homo sapiens
cuggacguugaggcugcaguga

SEQ ID NO: 288897 - RNA, 22 nt, Homo sapiens
cuggauagagauugaugaugcu

SEQ ID NO: 288898 - RNA, 22 nt, Homo sapiens
cuggcaagaggauaaaguccua

SEQ ID NO: 288899 - RNA, 22 nt, Homo sapiens
cuggucaagagcaaaggccagg

SEQ ID NO: 288900 - RNA, 22 nt, Homo sapiens
cuggucaugggggcacccucug

SEQ ID NO: 288901 - RNA, 22 nt, Homo sapiens
cuggugugugacuuuucauuau

SEQ ID NO: 288902 - RNA, 21 nt, Homo sapiens
cugguguuagcacuucuuccc

SEQ ID NO: 288903 - RNA, 22 nt, Homo sapiens
cugguuguuacaugcuugccag

SEQ ID NO: 288904 - RNA, 23 nt, Homo sapiens
cuguacacauauacaucuaagua

SEQ ID NO: 288905 - RNA, 22 nt, Homo sapiens
cugucacaguuuuggaggccag

SEQ ID NO: 288906 - RNA, 19 nt, Homo sapiens
cugucacugaggaagacug

SEQ ID NO: 288907 - RNA, 22 nt, Homo sapiens
cugucuagagggcacaugaugc

SEQ ID NO: 288908 - RNA, 17 nt, Homo sapiens
cugugaugaucuugucu

SEQ ID NO: 288909 - RNA, 22 nt, Homo sapiens
cugugauuauauaguuaaggua

SEQ ID NO: 288910 - RNA, 22 nt, Homo sapiens
cugugcacaucuggcggcccga

SEQ ID NO: 288911 - RNA, 22 nt, Homo sapiens
cugugcauaugacuuuauugga

SEQ ID NO: 288912 - RNA, 22 nt, Homo sapiens
cugugcauucuuaaaucaggaa

SEQ ID NO: 288913 - RNA, 22 nt, Homo sapiens
cugugcuaggcaaugugguaga

SEQ ID NO: 288914 - RNA, 22 nt, Homo sapiens
cugugguguaacucuuggggcg

SEQ ID NO: 288915 - RNA, 22 nt, Homo sapiens
cuguguaguacuagauugagca

SEQ ID NO: 288916 - RNA, 22 nt, Homo sapiens
cuguuugauuaagugguggaaa

SEQ ID NO: 288917 - RNA, 22 nt, Homo sapiens
cuuaaguaguuguggaaugaau

SEQ ID NO: 288918 - RNA, 22 nt, Homo sapiens
cuuacagucuaucagccacaac

SEQ ID NO: 288919 - RNA, 18 nt, Homo sapiens
cuuagguagcucauucca

SEQ ID NO: 288920 - RNA, 17 nt, Homo sapiens
cuucaaauaauuucccc

SEQ ID NO: 288921 - RNA, 22 nt, Homo sapiens
cuucagcaauauauccccuggg

SEQ ID NO: 288922 - RNA, 22 nt, Homo sapiens
cuucaugggagaaccacaggua

SEQ ID NO: 288923 - RNA, 18 nt, Homo sapiens
cuucauugcuguuuugcu

SEQ ID NO: 288924 - RNA, 22 nt, Homo sapiens
cuuccaguggcagccgggcaug

SEQ ID NO: 288925 - RNA, 22 nt, Homo sapiens
cuucucagugcucaucuuauuu

SEQ ID NO: 288926 - RNA, 22 nt, Homo sapiens
cuucugauugaaaauggaguag

SEQ ID NO: 288927 - RNA, 22 nt, Homo sapiens
cuucuugagggccugcugggaa

SEQ ID NO: 288928 - RNA, 21 nt, Homo sapiens
cuucuuggggcagggcagggu

SEQ ID NO: 288929 - RNA, 20 nt, Homo sapiens
cuugaagacuaugcugcuga

SEQ ID NO: 288930 - RNA, 22 nt, Homo sapiens
cuugaccaauauggugaaaccc

SEQ ID NO: 288931 - RNA, 22 nt, Homo sapiens
cuugagcauauucuauauuaaa

SEQ ID NO: 288932 - RNA, 22 nt, Homo sapiens
cuugcacucagaagauucaguu

SEQ ID NO: 288933 - RNA, 22 nt, Homo sapiens
cuugcagaggcccuggggagag

SEQ ID NO: 288934 - RNA, 22 nt, Homo sapiens
cuugcagagucauucuaauuuc

SEQ ID NO: 288935 - RNA, 22 nt, Homo sapiens
cuugcauagaguuauugcccuu

SEQ ID NO: 288936 - RNA, 22 nt, Homo sapiens
cuuggacaccucaugcccaccu

SEQ ID NO: 288937 - RNA, 22 nt, Homo sapiens
cuuggcuuguuguccccugcuc

SEQ ID NO: 288938 - RNA, 22 nt, Homo sapiens
cuugggcagugugcauguguau

SEQ ID NO: 288939 - RNA, 22 nt, Homo sapiens
cuugggccccacccaaaucuua

SEQ ID NO: 288940 - RNA, 18 nt, Homo sapiens
cuugucaaaucuuuccuc

SEQ ID NO: 288941 - RNA, 22 nt, Homo sapiens
cuuguggugcuuuuacgugggc

SEQ ID NO: 288942 - RNA, 17 nt, Homo sapiens
cuuguugugguaguuug

SEQ ID NO: 288943 - RNA, 22 nt, Homo sapiens
cuuuacacauccuaaccagugu

SEQ ID NO: 288944 - RNA, 22 nt, Homo sapiens
cuuuagcaauugauuaugccau

SEQ ID NO: 288945 - RNA, 22 nt, Homo sapiens
cuuuggagaaaaguucuugggc

SEQ ID NO: 288946 - RNA, 20 nt, Homo sapiens
cuuuggcaaugagaacaggg

SEQ ID NO: 288947 - RNA, 22 nt, Homo sapiens
cuuuggugauagauaccccaua

SEQ ID NO: 288948 - RNA, 22 nt, Homo sapiens
cuuugguugugcucuccacuuu

SEQ ID NO: 288949 - RNA, 20 nt, Homo sapiens
cuuuguccuccugcugugcu

SEQ ID NO: 288950 - RNA, 22 nt, Homo sapiens
cuuuguguaggugccucuggcu

SEQ ID NO: 288951 - RNA, 22 nt, Homo sapiens
cuuuuacacugcuggugggaau

SEQ ID NO: 288952 - RNA, 23 nt, Homo sapiens
cuuuugcaaugugaucuugccac

SEQ ID NO: 288953 - RNA, 22 nt, Homo sapiens
cuuuuggcuuagaauugucuug

SEQ ID NO: 288954 - RNA, 22 nt, Homo sapiens
cuuuuggucuaucagagaagca

SEQ ID NO: 288955 - RNA, 21 nt, Homo sapiens
cuuuuuacucguucauaugca

SEQ ID NO: 288956 - RNA, 22 nt, Homo sapiens
cuuuuugcugcagcaauacugg

SEQ ID NO: 288957 - RNA, 22 nt, Homo sapiens
gaaaauccauccccagggagua

SEQ ID NO: 288958 - RNA, 21 nt, Homo sapiens
gaaauacugccuuaggagcug

SEQ ID NO: 288959 - RNA, 18 nt, Homo sapiens
gaaaugccucuugcuuac

SEQ ID NO: 288960 - RNA, 22 nt, Homo sapiens
gaaaugcucagggguuuuccag

SEQ ID NO: 288961 - RNA, 23 nt, Homo sapiens
gaaauguaagugaugccccacag

SEQ ID NO: 288962 - RNA, 22 nt, Homo sapiens
gaaauguauuaaugaguugaaa

SEQ ID NO: 288963 - RNA, 22 nt, Homo sapiens
gaaaugucugagauguggcuca

SEQ ID NO: 288964 - RNA, 22 nt, Homo sapiens
gaaauguuuuucaugugggcaa

SEQ ID NO: 288965 - RNA, 22 nt, Homo sapiens
gaaccagcagacuuugacaggu

SEQ ID NO: 288966 - RNA, 22 nt, Homo sapiens
gaacuguaaagaaauucuaagg

SEQ ID NO: 288967 - RNA, 22 nt, Homo sapiens
gaacuguuucuggugaaagagu

SEQ ID NO: 288968 - RNA, 22 nt, Homo sapiens
gaacuuucuacauuaccucuuu

SEQ ID NO: 288969 - RNA, 22 nt, Homo sapiens
gaagaacuaggugagaucuaga

SEQ ID NO: 288970 - RNA, 22 nt, Homo sapiens
gaagauucaaccaaaccagaac

SEQ ID NO: 288971 - RNA, 22 nt, Homo sapiens
gaaguaguaaaauuuauugcag

SEQ ID NO: 288972 - RNA, 19 nt, Homo sapiens
gaaguguuguccuccagua

SEQ ID NO: 288973 - RNA, 17 nt, Homo sapiens
gaaguguuucagcagcu

SEQ ID NO: 288974 - RNA, 19 nt, Homo sapiens
gaaguguuuguucuccaug

SEQ ID NO: 288975 - RNA, 22 nt, Homo sapiens
gaauacugacuauuucaucugg

SEQ ID NO: 288976 - RNA, 22 nt, Homo sapiens
acugcacuccagccugcugaca

SEQ ID NO: 288977 - RNA, 22 nt, Homo sapiens
acugcacuccagccugcuggca

SEQ ID NO: 288978 - RNA, 22 nt, Homo sapiens
acugcacuccagccuggaccac

SEQ ID NO: 288979 - RNA, 22 nt, Homo sapiens
acugcacuccagccuggacgaa

SEQ ID NO: 288980 - RNA, 22 nt, Homo sapiens
acugcacuccagccugugagac

SEQ ID NO: 288981 - RNA, 22 nt, Homo sapiens
acugcacuccagccuuagugac

SEQ ID NO: 288982 - RNA, 22 nt, Homo sapiens
acugcacuccagccuucgugac

SEQ ID NO: 288983 - RNA, 22 nt, Homo sapiens
acugcacuccagccuugagagc

SEQ ID NO: 288984 - RNA, 22 nt, Homo sapiens
acugcacuccagccuuggagac

SEQ ID NO: 288985 - RNA, 22 nt, Homo sapiens
acugcacuccagccuugugaca

SEQ ID NO: 288986 - RNA, 22 nt, Homo sapiens
acugcacuccagccuuugcgau

SEQ ID NO: 288987 - RNA, 22 nt, Homo sapiens
acugcacuccaguuugggcagc

SEQ ID NO: 288988 - RNA, 22 nt, Homo sapiens
acugcacuccggccuggcaaca

SEQ ID NO: 288989 - RNA, 22 nt, Homo sapiens
acugcacucuagcauggguaau

SEQ ID NO: 288990 - RNA, 22 nt, Homo sapiens
acugcacucuagccccugcgac

SEQ ID NO: 288991 - RNA, 22 nt, Homo sapiens
acugcacugucaaccuccuggg

SEQ ID NO: 288992 - RNA, 22 nt, Homo sapiens
acugcacuguccuagaguccuc

SEQ ID NO: 288993 - RNA, 22 nt, Homo sapiens
acugcacuucaaccucauugac

SEQ ID NO: 288994 - RNA, 22 nt, Homo sapiens
acugcacuucagccuguugaca

SEQ ID NO: 288995 - RNA, 22 nt, Homo sapiens
acugcacuucagccuuggcuac

SEQ ID NO: 288996 - RNA, 22 nt, Homo sapiens
acugcacuucagccuugggaaa

SEQ ID NO: 288997 - RNA, 22 nt, Homo sapiens
acugcauuugguaaagucaaga

SEQ ID NO: 288998 - RNA, 22 nt, Homo sapiens
acugccuaaugacuuauguuuu

SEQ ID NO: 288999 - RNA, 22 nt, Homo sapiens
acuggaguuuguucaagaaaua

SEQ ID NO: 289000 - RNA, 22 nt, Homo sapiens
acuggcauagggcgggcacagu

SEQ ID NO: 289001 - RNA, 22 nt, Homo sapiens
acugggauauuauugguaauau

SEQ ID NO: 289002 - RNA, 22 nt, Homo sapiens
acugguuguuuaacugaauuga

SEQ ID NO: 289003 - RNA, 22 nt, Homo sapiens
acuuaguauggggcuuuugaga

SEQ ID NO: 289004 - RNA, 22 nt, Homo sapiens
acuuggcaaaguuuuaaacagc

SEQ ID NO: 289005 - RNA, 21 nt, Homo sapiens
acuuucuguggcaguccauuc

SEQ ID NO: 289006 - RNA, 22 nt, Homo sapiens
acuuugcuuaucccaggcacug

SEQ ID NO: 289007 - RNA, 22 nt, Homo sapiens
acuuuguguuacccagcaagga

SEQ ID NO: 289008 - RNA, 22 nt, Homo sapiens
acuuuuugaugaggucguuugu

SEQ ID NO: 289009 - RNA, 22 nt, Homo sapiens
agaaaugcagcaugaggcggca

SEQ ID NO: 289010 - RNA, 22 nt, Homo sapiens
agaaauguuuauucaaacccgu

SEQ ID NO: 289011 - RNA, 22 nt, Homo sapiens
agaacacugaguucagggucag

SEQ ID NO: 289012 - RNA, 22 nt, Homo sapiens
agaagaacauagggugacugaa

SEQ ID NO: 289013 - RNA, 20 nt, Homo sapiens
agaagcauugcucucuucag

SEQ ID NO: 289014 - RNA, 19 nt, Homo sapiens
agaagugcauggucuagag

SEQ ID NO: 289015 - RNA, 22 nt, Homo sapiens
agaauaauguccccccaaggga

SEQ ID NO: 289016 - RNA, 22 nt, Homo sapiens
agaauguaaacagaauagagga

SEQ ID NO: 289017 - RNA, 22 nt, Homo sapiens
agaauguaacucuaugaaggca

SEQ ID NO: 289018 - RNA, 22 nt, Homo sapiens
agaauguauauucuguaguugu

SEQ ID NO: 289019 - RNA, 22 nt, Homo sapiens
agaaugucagcuggauucagcu

SEQ ID NO: 289020 - RNA, 22 nt, Homo sapiens
agaaugugaccuuauuuggaga

SEQ ID NO: 289021 - RNA, 22 nt, Homo sapiens
agacacuguugaaaaggcccca

SEQ ID NO: 289022 - RNA, 22 nt, Homo sapiens
agacagcugggaaauggagugu

SEQ ID NO: 289023 - RNA, 22 nt, Homo sapiens
agacaguguguguauauauggu

SEQ ID NO: 289024 - RNA, 22 nt, Homo sapiens
agacuuagagagucuauucuau

SEQ ID NO: 289025 - RNA, 22 nt, Homo sapiens
agagacauugcuccaacucacc

SEQ ID NO: 289026 - RNA, 22 nt, Homo sapiens
agagagcuuuugguugcccuaa

SEQ ID NO: 289027 - RNA, 22 nt, Homo sapiens
agagauaguuuccaacucauac

SEQ ID NO: 289028 - RNA, 22 nt, Homo sapiens
agagaucaauaugaaggaaaug

SEQ ID NO: 289029 - RNA, 22 nt, Homo sapiens
agagcaccauuuagcaagguga

SEQ ID NO: 289030 - RNA, 22 nt, Homo sapiens
agagcacuguggguccaaauau

SEQ ID NO: 289031 - RNA, 22 nt, Homo sapiens
agagcuaguauuuacggagcau

SEQ ID NO: 289032 - RNA, 22 nt, Homo sapiens
agaggaguacuacuccaagucu

SEQ ID NO: 289033 - RNA, 22 nt, Homo sapiens
agagguauuggaaggaguguca

SEQ ID NO: 289034 - RNA, 22 nt, Homo sapiens
agagguuuaauugauucacagu

SEQ ID NO: 289035 - RNA, 22 nt, Homo sapiens
agaguaguuucuauauucuuca

SEQ ID NO: 289036 - RNA, 22 nt, Homo sapiens
agagucacaugaggcccuucau

SEQ ID NO: 289037 - RNA, 22 nt, Homo sapiens
agagugcuuuauuagauguagc

SEQ ID NO: 289038 - RNA, 22 nt, Homo sapiens
agauauuuguuaggucugucag

SEQ ID NO: 289039 - RNA, 20 nt, Homo sapiens
agaugcaugcacauaaacac

SEQ ID NO: 289040 - RNA, 22 nt, Homo sapiens
agauggauuuuguagccccagc

SEQ ID NO: 289041 - RNA, 23 nt, Homo sapiens
agauggcauuucaguucuuuagg

SEQ ID NO: 289042 - RNA, 22 nt, Homo sapiens
agaugguuuuguucacagcucu

SEQ ID NO: 289043 - RNA, 22 nt, Homo sapiens
agcaaaucuaugaauguauauu

SEQ ID NO: 289044 - RNA, 22 nt, Homo sapiens
agcaacauagugagacccccau

SEQ ID NO: 289045 - RNA, 22 nt, Homo sapiens
agcaacaucagcagcaggaaaa

SEQ ID NO: 289046 - RNA, 22 nt, Homo sapiens
agcaauaugacauugcuacauc

SEQ ID NO: 289047 - RNA, 22 nt, Homo sapiens
agcaccaauaaucagaguucuu

SEQ ID NO: 289048 - RNA, 17 nt, Homo sapiens
agcaccacacucucuug

SEQ ID NO: 289049 - RNA, 22 nt, Homo sapiens
agcaccaccguugcucuauccc

SEQ ID NO: 289050 - RNA, 22 nt, Homo sapiens
agcaccauugcacuccagccug

SEQ ID NO: 289051 - RNA, 22 nt, Homo sapiens
agcagagcaguggauuuuguga

SEQ ID NO: 289052 - RNA, 21 nt, Homo sapiens
agcagaguggcagcucuuuug

SEQ ID NO: 289053 - RNA, 22 nt, Homo sapiens
agcagcacaucccuuucuggcc

SEQ ID NO: 289054 - RNA, 22 nt, Homo sapiens
agcagcauuaugauauaucuua

SEQ ID NO: 289055 - RNA, 22 nt, Homo sapiens
agcagcauuccaaaaaucugcu

SEQ ID NO: 289056 - RNA, 22 nt, Homo sapiens
agcagcuuugcauggccuguga

SEQ ID NO: 289057 - RNA, 22 nt, Homo sapiens
agcagguauuuaagaaacucag

SEQ ID NO: 289058 - RNA, 22 nt, Homo sapiens
agcagguguccacaauguuugc

SEQ ID NO: 289059 - RNA, 22 nt, Homo sapiens
agucaguguguauugauggcac

SEQ ID NO: 289060 - RNA, 22 nt, Homo sapiens
agucaugggagagaugugaucg

SEQ ID NO: 289061 - RNA, 22 nt, Homo sapiens
aguccagguuuuguaauggcaa

SEQ ID NO: 289062 - RNA, 23 nt, Homo sapiens
agucuguguuuacaggcucucug

SEQ ID NO: 289063 - RNA, 22 nt, Homo sapiens
agugaaaucugaagaaggucau

SEQ ID NO: 289064 - RNA, 22 nt, Homo sapiens
agugacaugggaucaaaucuga

SEQ ID NO: 289065 - RNA, 22 nt, Homo sapiens
agugagcuggagaaaagaaacu

SEQ ID NO: 289066 - RNA, 22 nt, Homo sapiens
agugagcuguuuuuacuuucug

SEQ ID NO: 289067 - RNA, 22 nt, Homo sapiens
agugcaaagccgagguuucuug

SEQ ID NO: 289068 - RNA, 22 nt, Homo sapiens
agugcaauaaggauguagaacu

SEQ ID NO: 289069 - RNA, 22 nt, Homo sapiens
agugcacuccagccugggcaac

SEQ ID NO: 289070 - RNA, 22 nt, Homo sapiens
agugcaguggcacaaucuuggc

SEQ ID NO: 289071 - RNA, 22 nt, Homo sapiens
agugcaguggcauggucauaac

SEQ ID NO: 289072 - RNA, 22 nt, Homo sapiens
agugcaguggugccaucauaac

SEQ ID NO: 289073 - RNA, 22 nt, Homo sapiens
agugcaguugucacgugccuuc

SEQ ID NO: 289074 - RNA, 22 nt, Homo sapiens
agugcauuugcaucucaauaua

SEQ ID NO: 289075 - RNA, 22 nt, Homo sapiens
agugccacugcacucuagccug

SEQ ID NO: 289076 - RNA, 22 nt, Homo sapiens
agugccuacuugaauuguagug

SEQ ID NO: 289077 - RNA, 22 nt, Homo sapiens
agugccuauugauggaaagaua

SEQ ID NO: 289078 - RNA, 22 nt, Homo sapiens
aguggaguguaaagcgucuuuu

SEQ ID NO: 289079 - RNA, 22 nt, Homo sapiens
aguggcaaugugauguccugaa

SEQ ID NO: 289080 - RNA, 22 nt, Homo sapiens
aguggcacuauucucagaguca

SEQ ID NO: 289081 - RNA, 22 nt, Homo sapiens
agugguauaauauuauuuugaa

SEQ ID NO: 289082 - RNA, 22 nt, Homo sapiens
agugguuugaucacagcucacu

SEQ ID NO: 289083 - RNA, 22 nt, Homo sapiens
aguuaguguugugauaaaucca

SEQ ID NO: 289084 - RNA, 21 nt, Homo sapiens
aguucacauggcuccuguguu

SEQ ID NO: 289085 - RNA, 22 nt, Homo sapiens
aguugcaagucuugaguaaaga

SEQ ID NO: 289086 - RNA, 22 nt, Homo sapiens
auaaacagcuuauccucuauuc

SEQ ID NO: 289087 - RNA, 22 nt, Homo sapiens
auaaacugucaguggagaguaa

SEQ ID NO: 289088 - RNA, 22 nt, Homo sapiens
auaaagcaaauaggacuauugc

SEQ ID NO: 289089 - RNA, 22 nt, Homo sapiens
auaaagccaggagacguaauug

SEQ ID NO: 289090 - RNA, 22 nt, Homo sapiens
auaaagguaauaauaguugcau

SEQ ID NO: 289091 - RNA, 22 nt, Homo sapiens
auaaaguucugcuggcauauau

SEQ ID NO: 289092 - RNA, 22 nt, Homo sapiens
auaaaugcaaugguauuuuuga

SEQ ID NO: 289093 - RNA, 22 nt, Homo sapiens
auaaaugcauugagaacugcug

SEQ ID NO: 289094 - RNA, 22 nt, Homo sapiens
auaaaugcuuccagucauuaaa

SEQ ID NO: 289095 - RNA, 22 nt, Homo sapiens
auaacagcugcaaggcaaaagc

SEQ ID NO: 289096 - RNA, 22 nt, Homo sapiens
auaacucuguuuuuuucaugca

SEQ ID NO: 289097 - RNA, 22 nt, Homo sapiens
auaagagcaggcuucuggccag

SEQ ID NO: 289098 - RNA, 22 nt, Homo sapiens
auaagaguaguacauaugagac

SEQ ID NO: 289099 - RNA, 22 nt, Homo sapiens
auaaggcagcugcuaaaaggca

SEQ ID NO: 289100 - RNA, 22 nt, Homo sapiens
auaaggcuaguguaggagccag

SEQ ID NO: 289101 - RNA, 22 nt, Homo sapiens
auaagguuagcucugagaaagu

SEQ ID NO: 289102 - RNA, 22 nt, Homo sapiens
auaauaccugccacauuugaau

SEQ ID NO: 289103 - RNA, 22 nt, Homo sapiens
auaauagguugauugacauugc

SEQ ID NO: 289104 - RNA, 22 nt, Homo sapiens
auaauguuugauugagcagaua

SEQ ID NO: 289105 - RNA, 22 nt, Homo sapiens
auacaagcaguccaacuccaua

SEQ ID NO: 289106 - RNA, 22 nt, Homo sapiens
auacaaggaaugaagagauuug

SEQ ID NO: 289107 - RNA, 19 nt, Homo sapiens
auacacguguauacauaca

SEQ ID NO: 289108 - RNA, 22 nt, Homo sapiens
auacacuggagcaaaccuggag

SEQ ID NO: 289109 - RNA, 22 nt, Homo sapiens
auacaguugccauuucuugugc

SEQ ID NO: 289110 - RNA, 22 nt, Homo sapiens
auacauguuucauguuggugug

SEQ ID NO: 289111 - RNA, 22 nt, Homo sapiens
auacccugucgugagucagaga

SEQ ID NO: 289112 - RNA, 22 nt, Homo sapiens
auacguacauaugcacauaugg

SEQ ID NO: 289113 - RNA, 22 nt, Homo sapiens
auacuaugagauaauaaagacu

SEQ ID NO: 289114 - RNA, 22 nt, Homo sapiens
auacugguuuuugucaugugga

SEQ ID NO: 289115 - RNA, 20 nt, Homo sapiens
auagaagacuagugcagcag

SEQ ID NO: 289116 - RNA, 22 nt, Homo sapiens
auagaagcugccaacguuucag

SEQ ID NO: 289117 - RNA, 22 nt, Homo sapiens
auagaaucaucugugcacuagu

SEQ ID NO: 289118 - RNA, 22 nt, Homo sapiens
auagcaaugcaagaauggcuua

SEQ ID NO: 289119 - RNA, 22 nt, Homo sapiens
auagcaauuugggaaucagacu

SEQ ID NO: 289120 - RNA, 22 nt, Homo sapiens
auagcacuuaccacaggcugca

SEQ ID NO: 289121 - RNA, 22 nt, Homo sapiens
auagcagaagaagggacaauuc

SEQ ID NO: 289122 - RNA, 22 nt, Homo sapiens
auagcagaauuuggucaagucu

SEQ ID NO: 289123 - RNA, 22 nt, Homo sapiens
auagcagacauuucaaggcagg

SEQ ID NO: 289124 - RNA, 22 nt, Homo sapiens
auagcagcagcuaguagugaua

SEQ ID NO: 289125 - RNA, 22 nt, Homo sapiens
auagcagugugaaaacagacug

SEQ ID NO: 289126 - RNA, 22 nt, Homo sapiens
auagcagugugaaaauguacua

SEQ ID NO: 289127 - RNA, 22 nt, Homo sapiens
auagccaguagagagcuguuag

SEQ ID NO: 289128 - RNA, 22 nt, Homo sapiens
auaggagcacgaacucuagugu

SEQ ID NO: 289129 - RNA, 22 nt, Homo sapiens
auagucaguagucucauaauga

SEQ ID NO: 289130 - RNA, 22 nt, Homo sapiens
auagugcugcaaucaacauaca

SEQ ID NO: 289131 - RNA, 22 nt, Homo sapiens
auagugcugcacuaaacauaca

SEQ ID NO: 289132 - RNA, 22 nt, Homo sapiens
auagugcugccauaaacauacg

SEQ ID NO: 289133 - RNA, 19 nt, Homo sapiens
auauaacauccaggagcag

SEQ ID NO: 289134 - RNA, 22 nt, Homo sapiens
auauagcucuggcuggaugacu

SEQ ID NO: 289135 - RNA, 23 nt, Homo sapiens
auauaguagaugugcaguaacau

SEQ ID NO: 289136 - RNA, 22 nt, Homo sapiens
auaucacucccaauaucgcagg

SEQ ID NO: 289137 - RNA, 22 nt, Homo sapiens
auaucagugucuuacuguuuuu

SEQ ID NO: 289138 - RNA, 22 nt, Homo sapiens
auaugacuuuccucuacuuccu

SEQ ID NO: 289139 - RNA, 22 nt, Homo sapiens
auaugcacaguggaguacuauu

SEQ ID NO: 289140 - RNA, 20 nt, Homo sapiens
auaugcagacacauacauac

SEQ ID NO: 289141 - RNA, 22 nt, Homo sapiens
auauguaguauggaaacauugu

SEQ ID NO: 289142 - RNA, 22 nt, Homo sapiens
uggauaguucuucuacuagagu

SEQ ID NO: 289143 - RNA, 22 nt, Homo sapiens
uggauauguucuuuguguaagg

SEQ ID NO: 289144 - RNA, 19 nt, Homo sapiens
uggaugacugucugggucu

SEQ ID NO: 289145 - RNA, 22 nt, Homo sapiens
uggaugacuguuauaugcauau

SEQ ID NO: 289146 - RNA, 22 nt, Homo sapiens
uggauuguuucucuugguauga

SEQ ID NO: 289147 - RNA, 22 nt, Homo sapiens
uggcaaaaaucacaaguaccuu

SEQ ID NO: 289148 - RNA, 22 nt, Homo sapiens
uggcaaaugaaagaaagccagu

SEQ ID NO: 289149 - RNA, 22 nt, Homo sapiens
uggcaaaugugagaugagaacu

SEQ ID NO: 289150 - RNA, 21 nt, Homo sapiens
uggcaacauggauggauucug

SEQ ID NO: 289151 - RNA, 22 nt, Homo sapiens
uggcaacuugcaaccucauucu

SEQ ID NO: 289152 - RNA, 22 nt, Homo sapiens
uggcaagaaccacaauuacuuu

SEQ ID NO: 289153 - RNA, 22 nt, Homo sapiens
uggcaagagcaaaauguacagu

SEQ ID NO: 289154 - RNA, 22 nt, Homo sapiens
uggcaagagggaugcaagguuu

SEQ ID NO: 289155 - RNA, 20 nt, Homo sapiens
uggcaagauggcagaauaga

SEQ ID NO: 289156 - RNA, 22 nt, Homo sapiens
uggcaagcaggacuaaagcacc

SEQ ID NO: 289157 - RNA, 18 nt, Homo sapiens
uggcaagugccauacggu

SEQ ID NO: 289158 - RNA, 22 nt, Homo sapiens
uggcaauauccacaauuacuuu

SEQ ID NO: 289159 - RNA, 22 nt, Homo sapiens
uggcagcgugaauguggcugaa

SEQ ID NO: 289160 - RNA, 22 nt, Homo sapiens
uggcaguuucacauggcucaac

SEQ ID NO: 289161 - RNA, 22 nt, Homo sapiens
uggcaguuuuaugugguucaac

SEQ ID NO: 289162 - RNA, 22 nt, Homo sapiens
uggcaugaaguguguuuuaucu

SEQ ID NO: 289163 - RNA, 22 nt, Homo sapiens
uggcaugauauauauucguuug

SEQ ID NO: 289164 - RNA, 22 nt, Homo sapiens
uggcaugauccuagauucaaca

SEQ ID NO: 289165 - RNA, 22 nt, Homo sapiens
uggcaugcauuguggguaauua

SEQ ID NO: 289166 - RNA, 22 nt, Homo sapiens
uggcauguagucugggaccugg

SEQ ID NO: 289167 - RNA, 23 nt, Homo sapiens
uggccaagauaaucucaguuuuc

SEQ ID NO: 289168 - RNA, 22 nt, Homo sapiens
uggccagagggcaauuagcugu

SEQ ID NO: 289169 - RNA, 22 nt, Homo sapiens
uggcccccucccaaaucucaua

SEQ ID NO: 289170 - RNA, 22 nt, Homo sapiens
uggcgagaugcucgugugcaga

SEQ ID NO: 289171 - RNA, 22 nt, Homo sapiens
uggcuaaguuaaucaaggagau

SEQ ID NO: 289172 - RNA, 18 nt, Homo sapiens
uggcuacugaacuagaug

SEQ ID NO: 289173 - RNA, 22 nt, Homo sapiens
uggcuacugaccugcuaggggg

SEQ ID NO: 289174 - RNA, 22 nt, Homo sapiens
uggcuacugacugaugauuaua

SEQ ID NO: 289175 - RNA, 22 nt, Homo sapiens
uggcuacuguacuugagcuauu

SEQ ID NO: 289176 - RNA, 22 nt, Homo sapiens
uggcuccguuguacaggcugga

SEQ ID NO: 289177 - RNA, 22 nt, Homo sapiens
uggcuguuuauuucacaugggu

SEQ ID NO: 289178 - RNA, 21 nt, Homo sapiens
uggcuuauuugaaucuggcuu

SEQ ID NO: 289179 - RNA, 22 nt, Homo sapiens
uggcuuuguaagguuucauuuu

SEQ ID NO: 289180 - RNA, 22 nt, Homo sapiens
uggcuuuuccaggcauuacgau

SEQ ID NO: 289181 - RNA, 22 nt, Homo sapiens
ugggaaacauccagcacauacu

SEQ ID NO: 289182 - RNA, 22 nt, Homo sapiens
ugggaacaugaagguuaaagag

SEQ ID NO: 289183 - RNA, 22 nt, Homo sapiens
ugggaacugaggugaaaagaca

SEQ ID NO: 289184 - RNA, 19 nt, Homo sapiens
ugggaauguaaauuaguuc

SEQ ID NO: 289185 - RNA, 22 nt, Homo sapiens
ugggagacuacauuuuuaacaa

SEQ ID NO: 289186 - RNA, 22 nt, Homo sapiens
ugggaucagcugggcucucugu

SEQ ID NO: 289187 - RNA, 22 nt, Homo sapiens
ugggaucuuuccuauuagcgag

SEQ ID NO: 289188 - RNA, 22 nt, Homo sapiens
ugggaugaugaaaaggcuuucu

SEQ ID NO: 289189 - RNA, 22 nt, Homo sapiens
ugggaugauguuaaacguacuc

SEQ ID NO: 289190 - RNA, 22 nt, Homo sapiens
ugggcaaaugcuuuuuagucaa

SEQ ID NO: 289191 - RNA, 22 nt, Homo sapiens
ugggcauggaguggccuuaugu

SEQ ID NO: 289192 - RNA, 22 nt, Homo sapiens
ugggcauuguuccuaguuaucu

SEQ ID NO: 289193 - RNA, 22 nt, Homo sapiens
uggggugugagggagaaagaaa

SEQ ID NO: 289194 - RNA, 22 nt, Homo sapiens
uggguaaaucuguuuggggcuc

SEQ ID NO: 289195 - RNA, 22 nt, Homo sapiens
uggguagagcacugggggcgag

SEQ ID NO: 289196 - RNA, 22 nt, Homo sapiens
uggguagucauuggaggguuuu

SEQ ID NO: 289197 - RNA, 22 nt, Homo sapiens
ugggugaguaucuauuauucag

SEQ ID NO: 289198 - RNA, 22 nt, Homo sapiens
ugguaaacaacaggagaacuug

SEQ ID NO: 289199 - RNA, 22 nt, Homo sapiens
ugguaagaucugugagccaggc

SEQ ID NO: 289200 - RNA, 22 nt, Homo sapiens
ugguaaguuuaacaugcauccc

SEQ ID NO: 289201 - RNA, 22 nt, Homo sapiens
uggucaaaugccaaucuguagu

SEQ ID NO: 289202 - RNA, 22 nt, Homo sapiens
uggucaccuucuugcucugucu

SEQ ID NO: 289203 - RNA, 19 nt, Homo sapiens
uggucaguucugggagcug

SEQ ID NO: 289204 - RNA, 22 nt, Homo sapiens
uggucauggaaauagaaugcac

SEQ ID NO: 289205 - RNA, 22 nt, Homo sapiens
uggucuccuuuguacccugggc

SEQ ID NO: 289206 - RNA, 22 nt, Homo sapiens
uggucuucuggccuccagaacc

SEQ ID NO: 289207 - RNA, 22 nt, Homo sapiens
uggugagaaacuagauauuuuu

SEQ ID NO: 289208 - RNA, 17 nt, Homo sapiens
uggugcuugaaaguugc

SEQ ID NO: 289209 - RNA, 22 nt, Homo sapiens
ugguguccugucucugcgcuug

SEQ ID NO: 289210 - RNA, 21 nt, Homo sapiens
ugguucaguucguuacgugug

SEQ ID NO: 289211 - RNA, 22 nt, Homo sapiens
ugguuccauauuaauuuuagga

SEQ ID NO: 289212 - RNA, 23 nt, Homo sapiens
uguaaaagcauuugucagccugg

SEQ ID NO: 289213 - RNA, 22 nt, Homo sapiens
uguaaaccauauauguauguag

SEQ ID NO: 289214 - RNA, 22 nt, Homo sapiens
uguaaaucuauuuuuaguguuu

SEQ ID NO: 289215 - RNA, 22 nt, Homo sapiens
uguaacacacacuguuuacucc

SEQ ID NO: 289216 - RNA, 22 nt, Homo sapiens
uguaacaguaguuacuauucuu

SEQ ID NO: 289217 - RNA, 22 nt, Homo sapiens
uguaagugugcaauucagugau

SEQ ID NO: 289218 - RNA, 22 nt, Homo sapiens
uguacaaaacaagaugggggua

SEQ ID NO: 289219 - RNA, 22 nt, Homo sapiens
uguagacagcacguaguugagu

SEQ ID NO: 289220 - RNA, 22 nt, Homo sapiens
uguagauaucauuagugcugug

SEQ ID NO: 289221 - RNA, 22 nt, Homo sapiens
uguagguguacauacaugguua

SEQ ID NO: 289222 - RNA, 22 nt, Homo sapiens
uguaugguuauuuguggauggu

SEQ ID NO: 289223 - RNA, 22 nt, Homo sapiens
uguaugucuucuuuagauaagu

SEQ ID NO: 289224 - RNA, 16 nt, Homo sapiens
uguauugcuaaaaaga

SEQ ID NO: 289225 - RNA, 22 nt, Homo sapiens
ugucaaaugcagugauauuuga

SEQ ID NO: 289226 - RNA, 22 nt, Homo sapiens
uuaaaguguuuucaaaauguca

SEQ ID NO: 289227 - RNA, 22 nt, Homo sapiens
uuaaaugcucacauaaagguag

SEQ ID NO: 289228 - RNA, 21 nt, Homo sapiens
uuaacagacaagugucuuccc

SEQ ID NO: 289229 - RNA, 22 nt, Homo sapiens
uuaacaguugcaugagacugag

SEQ ID NO: 289230 - RNA, 22 nt, Homo sapiens
uuaagaagugauuuuccucauu

SEQ ID NO: 289231 - RNA, 22 nt, Homo sapiens
uuaagacaccaaucauuggauu

SEQ ID NO: 289232 - RNA, 22 nt, Homo sapiens
uuaagcaaagguaacaugagaa

SEQ ID NO: 289233 - RNA, 23 nt, Homo sapiens
uuaagcaacggcugcuuuucaga

SEQ ID NO: 289234 - RNA, 22 nt, Homo sapiens
uuaagcaguggauuagaauuuu

SEQ ID NO: 289235 - RNA, 22 nt, Homo sapiens
uuaagccaggugugguggcaca

SEQ ID NO: 289236 - RNA, 22 nt, Homo sapiens
uuaagcuaguuuauucaggaaa

SEQ ID NO: 289237 - RNA, 22 nt, Homo sapiens
uuaaggcuccuguuggcuuuua

SEQ ID NO: 289238 - RNA, 22 nt, Homo sapiens
uuaagggaggagcuucaagaug

SEQ ID NO: 289239 - RNA, 22 nt, Homo sapiens
uuaaguaaucagagaagagaac

SEQ ID NO: 289240 - RNA, 22 nt, Homo sapiens
uuaaguacuucccuguuggaca

SEQ ID NO: 289241 - RNA, 22 nt, Homo sapiens
uuaagugcucaguuacucaguu

SEQ ID NO: 289242 - RNA, 22 nt, Homo sapiens
uuaaguguaaguggugugggac

SEQ ID NO: 289243 - RNA, 22 nt, Homo sapiens
uuaaguuaggcuucagcagucu

SEQ ID NO: 289244 - RNA, 22 nt, Homo sapiens
uuaauagugacucauuuuccac

SEQ ID NO: 289245 - RNA, 22 nt, Homo sapiens
uuaaucacagcugaacucaaac

SEQ ID NO: 289246 - RNA, 22 nt, Homo sapiens
uuaaucacagugucuuccuuca

SEQ ID NO: 289247 - RNA, 22 nt, Homo sapiens
uuaaucaggccguuuccuaaga

SEQ ID NO: 289248 - RNA, 22 nt, Homo sapiens
uuaauccugccuuauuucagua

SEQ ID NO: 289249 - RNA, 22 nt, Homo sapiens
uuacaacugucuuacugguuau

SEQ ID NO: 289250 - RNA, 21 nt, Homo sapiens
uuacaauggcuccuugaaggu

SEQ ID NO: 289251 - RNA, 19 nt, Homo sapiens
uuacacaaccuaguggggc

SEQ ID NO: 289252 - RNA, 22 nt, Homo sapiens
uuacagauggcacacucaaggg

SEQ ID NO: 289253 - RNA, 22 nt, Homo sapiens
uuacagcugcuccccaucacuc

SEQ ID NO: 289254 - RNA, 22 nt, Homo sapiens
uuacagcugggugugucuggua

SEQ ID NO: 289255 - RNA, 22 nt, Homo sapiens
uuacagucuuaggcagugcuuu

SEQ ID NO: 289256 - RNA, 22 nt, Homo sapiens
uuacagugguugcuauugugaa

SEQ ID NO: 289257 - RNA, 22 nt, Homo sapiens
uuacaguucugguggagaggua

SEQ ID NO: 289258 - RNA, 21 nt, Homo sapiens
uuacaguugguugugaggugg

SEQ ID NO: 289259 - RNA, 22 nt, Homo sapiens
uuacaugagacugucgcuaguu

SEQ ID NO: 289260 - RNA, 22 nt, Homo sapiens
uuacaugucuugguaagguuag

SEQ ID NO: 289261 - RNA, 22 nt, Homo sapiens
uuacauugcuucaaauucagug

SEQ ID NO: 289262 - RNA, 22 nt, Homo sapiens
uuaccucuguggcucucggacu

SEQ ID NO: 289263 - RNA, 22 nt, Homo sapiens
uuacuugagaugaguuggacaa

SEQ ID NO: 289264 - RNA, 19 nt, Homo sapiens
uuagagaucaucugcuuca

SEQ ID NO: 289265 - RNA, 22 nt, Homo sapiens
uuagagcacugaucugcucuuu

SEQ ID NO: 289266 - RNA, 22 nt, Homo sapiens
uuagaugaaugucucuuaaaca

SEQ ID NO: 289267 - RNA, 22 nt, Homo sapiens
uuagcaauugauucucauaagc

SEQ ID NO: 289268 - RNA, 22 nt, Homo sapiens
uuagcacaguucauucauguua

SEQ ID NO: 289269 - RNA, 22 nt, Homo sapiens
uuagcacuaauucguuggggca

SEQ ID NO: 289270 - RNA, 22 nt, Homo sapiens
uuagcagcaugaaaauggacug

SEQ ID NO: 289271 - RNA, 20 nt, Homo sapiens
uuagcagcaugauuuauaau

SEQ ID NO: 289272 - RNA, 22 nt, Homo sapiens
uuagcaguggauggguggagaa

SEQ ID NO: 289273 - RNA, 22 nt, Homo sapiens
uuagcauccauaggagauuggu

SEQ ID NO: 289274 - RNA, 21 nt, Homo sapiens
uuagcauccauguucaucaac

SEQ ID NO: 289275 - RNA, 22 nt, Homo sapiens
uuagcccaucuugaggaaagua

SEQ ID NO: 289276 - RNA, 22 nt, Homo sapiens
uuaggacaauguucguuuuuug

SEQ ID NO: 289277 - RNA, 22 nt, Homo sapiens
uuaggagacuggauaucucuuu

SEQ ID NO: 289278 - RNA, 22 nt, Homo sapiens
uuaggcuaguuucuuaaacucu

SEQ ID NO: 289279 - RNA, 22 nt, Homo sapiens
uuaguaguagugcuguaauuuu

SEQ ID NO: 289280 - RNA, 22 nt, Homo sapiens
uuaguuuaucagugguuucuga

SEQ ID NO: 289281 - RNA, 22 nt, Homo sapiens
uuauaacagagacuccugugcu

SEQ ID NO: 289282 - RNA, 22 nt, Homo sapiens
uuauacuacuauaaagagguag

SEQ ID NO: 289283 - RNA, 22 nt, Homo sapiens
uuaucagcagcaugaaacugga

SEQ ID NO: 289284 - RNA, 22 nt, Homo sapiens
uuaucauagugcaguuuucuga

SEQ ID NO: 289285 - RNA, 21 nt, Homo sapiens
uuaucccagugucucugcagg

SEQ ID NO: 289286 - RNA, 22 nt, Homo sapiens
uuaugacauugacaguuuuuag

SEQ ID NO: 289287 - RNA, 22 nt, Homo sapiens
uuauggauuuauauucuguagu

SEQ ID NO: 289288 - RNA, 22 nt, Homo sapiens
uuaugguuuuuagcagaguaau

SEQ ID NO: 289289 - RNA, 22 nt, Homo sapiens
uuaugucuuuuguguucagcua

SEQ ID NO: 289290 - RNA, 22 nt, Homo sapiens
uuaugugccuuuuugccauuca

SEQ ID NO: 289291 - RNA, 22 nt, Homo sapiens
uuauuagguugguggaaaagua

SEQ ID NO: 289292 - RNA, 22 nt, Homo sapiens
uuauucagcaccugcuguguuc

SEQ ID NO: 289293 - RNA, 22 nt, Homo sapiens
uuauucauuaauugcuaagguu

SEQ ID NO: 289294 - RNA, 22 nt, Homo sapiens
uuauucugucuuuggucucaau

SEQ ID NO: 289295 - RNA, 16 nt, Homo sapiens
uuauugcauucuucuc

SEQ ID NO: 289296 - RNA, 22 nt, Homo sapiens
uuauugcuaaaucaugaccaca

SEQ ID NO: 289297 - RNA, 22 nt, Homo sapiens
uuauuguccaaguuucccuuug

SEQ ID NO: 289298 - RNA, 22 nt, Homo sapiens
uucaaaggauagauuaagauca

SEQ ID NO: 289299 - RNA, 22 nt, Homo sapiens
uucaaaguguugguuuugggcu

SEQ ID NO: 289300 - RNA, 22 nt, Homo sapiens
uucaaaguuggaggacaaacug

SEQ ID NO: 289301 - RNA, 22 nt, Homo sapiens
uucaaguaagaaagacaucagg

SEQ ID NO: 289302 - RNA, 22 nt, Homo sapiens
uucaauaugucauuggcaggca

SEQ ID NO: 289303 - RNA, 22 nt, Homo sapiens
uucacagaguuauuuuuaugcu

SEQ ID NO: 289304 - RNA, 22 nt, Homo sapiens
uucacagcuuaauaaggcucag

SEQ ID NO: 289305 - RNA, 22 nt, Homo sapiens
uucacaguguguacaccagggg

SEQ ID NO: 289306 - RNA, 22 nt, Homo sapiens
uucacaugacagggugaagcau

SEQ ID NO: 289307 - RNA, 22 nt, Homo sapiens
uucaccuugcccacagcagucu

SEQ ID NO: 289308 - RNA, 22 nt, Homo sapiens
uucacugcacuccagccugggu

SEQ ID NO: 289309 - RNA, 22 nt, Homo sapiens
uugaagacuauaugauucuuca

SEQ ID NO: 289310 - RNA, 22 nt, Homo sapiens
uugaagguaauugguuuuauga

SEQ ID NO: 289311 - RNA, 22 nt, Homo sapiens
uugaaguagcauuucaugucua

SEQ ID NO: 289312 - RNA, 22 nt, Homo sapiens
uugaauagaagguuuuuuguuc

SEQ ID NO: 289313 - RNA, 22 nt, Homo sapiens
uugaauagacagccagcuuuaa

SEQ ID NO: 289314 - RNA, 22 nt, Homo sapiens
uugaauagcauguuuagugcau

SEQ ID NO: 289315 - RNA, 22 nt, Homo sapiens
uugaauguaugcuggguuuacu

SEQ ID NO: 289316 - RNA, 22 nt, Homo sapiens
uugaaugucuauuaaguuguuu

SEQ ID NO: 289317 - RNA, 22 nt, Homo sapiens
uugacaguugggcagggaaguu

SEQ ID NO: 289318 - RNA, 22 nt, Homo sapiens
uugacauaguuucugaaauaga

SEQ ID NO: 289319 - RNA, 22 nt, Homo sapiens
uugacugugguaauggaagcug

SEQ ID NO: 289320 - RNA, 22 nt, Homo sapiens
uugagacugagucucgcccugu

SEQ ID NO: 289321 - RNA, 22 nt, Homo sapiens
uugagagaaaaaauuuauuggu

SEQ ID NO: 289322 - RNA, 22 nt, Homo sapiens
uugagagagaacauuuguuaca

SEQ ID NO: 289323 - RNA, 22 nt, Homo sapiens
uugagauagaauaggaauggga

SEQ ID NO: 289324 - RNA, 22 nt, Homo sapiens
uugagauaggaacucacuaugc

SEQ ID NO: 289325 - RNA, 22 nt, Homo sapiens
uugagauaggagcuguuguucu

SEQ ID NO: 289326 - RNA, 22 nt, Homo sapiens
uugagauggagccucacucugc

SEQ ID NO: 289327 - RNA, 22 nt, Homo sapiens
uugagauggagucucacucugc

SEQ ID NO: 289328 - RNA, 22 nt, Homo sapiens
uugagauggagucucgcugugu

SEQ ID NO: 289329 - RNA, 22 nt, Homo sapiens
uugagauggagucuugcacugu

SEQ ID NO: 289330 - RNA, 22 nt, Homo sapiens
uugagauggagucuuguucucu

SEQ ID NO: 289331 - RNA, 22 nt, Homo sapiens
uugagauggaguucauuuuugu

SEQ ID NO: 289332 - RNA, 22 nt, Homo sapiens
uugagauggaguuucacucugu

SEQ ID NO: 289333 - RNA, 22 nt, Homo sapiens
uugagauggaguuucgcucuuu

SEQ ID NO: 289334 - RNA, 22 nt, Homo sapiens
uugagauggugccacuguacuc

SEQ ID NO: 289335 - RNA, 22 nt, Homo sapiens
uugagauguauguauauaaugu

SEQ ID NO: 289336 - RNA, 22 nt, Homo sapiens
uugagauuuuccucaaauauuu

SEQ ID NO: 289337 - RNA, 22 nt, Homo sapiens
uugagcaaaacauuaauauuag

SEQ ID NO: 289338 - RNA, 22 nt, Homo sapiens
uugagcaaugaacgauucaggg

SEQ ID NO: 289339 - RNA, 22 nt, Homo sapiens
uugagcacaggaguuuugagac

SEQ ID NO: 289340 - RNA, 22 nt, Homo sapiens
uugagcacaguagguuguggcu

SEQ ID NO: 289341 - RNA, 22 nt, Homo sapiens
uugagcauugguauagguuuua

SEQ ID NO: 289342 - RNA, 22 nt, Homo sapiens
uugagcccuggagguggaggcu

SEQ ID NO: 289343 - RNA, 22 nt, Homo sapiens
uugaggacugagacagaccaag

SEQ ID NO: 289344 - RNA, 22 nt, Homo sapiens
uugaggacugcuaagcauuuga

SEQ ID NO: 289345 - RNA, 22 nt, Homo sapiens
uugaggaggcagucucuccauu

SEQ ID NO: 289346 - RNA, 22 nt, Homo sapiens
uugaggaggcagucuucccauu

SEQ ID NO: 289347 - RNA, 22 nt, Homo sapiens
uugagggagcauuuguuuugag

SEQ ID NO: 289348 - RNA, 22 nt, Homo sapiens
uugagggagccuguuagucccg

SEQ ID NO: 289349 - RNA, 22 nt, Homo sapiens
uugagggaggcagggcuugucu

SEQ ID NO: 289350 - RNA, 22 nt, Homo sapiens
uugagguaauaaacagccauuc

SEQ ID NO: 289351 - RNA, 22 nt, Homo sapiens
uugagguauaaagguagguugu

SEQ ID NO: 289352 - RNA, 22 nt, Homo sapiens
uugaggugggaggaucacuuga

SEQ ID NO: 289353 - RNA, 22 nt, Homo sapiens
uugagguguauuguacagcaca

SEQ ID NO: 289354 - RNA, 20 nt, Homo sapiens
uugaggugugaggggcagag

SEQ ID NO: 289355 - RNA, 22 nt, Homo sapiens
uugaguaguaagugguucaccg

SEQ ID NO: 289356 - RNA, 22 nt, Homo sapiens
uugagugaaggcuguguucuug

SEQ ID NO: 289357 - RNA, 22 nt, Homo sapiens
uugauaacauucugcauccuau

SEQ ID NO: 289358 - RNA, 22 nt, Homo sapiens
uugauaagaaaaauauaccaga

SEQ ID NO: 289359 - RNA, 22 nt, Homo sapiens
uugauaugguauaagauuucau

SEQ ID NO: 289360 - RNA, 22 nt, Homo sapiens
uugauauguggaauauuuaucu

SEQ ID NO: 289361 - RNA, 22 nt, Homo sapiens
uugauauguuguuagauucagu

SEQ ID NO: 289362 - RNA, 22 nt, Homo sapiens
uugauauuacucaguaacagau

SEQ ID NO: 289363 - RNA, 22 nt, Homo sapiens
uugaucacuguacuaugacuau

SEQ ID NO: 289364 - RNA, 22 nt, Homo sapiens
uugaucaucagcuuugucaucu

SEQ ID NO: 289365 - RNA, 22 nt, Homo sapiens
uugauguguuuccaggauuugu

SEQ ID NO: 289366 - RNA, 22 nt, Homo sapiens
uugauguugaggacauaaaccu

SEQ ID NO: 289367 - RNA, 22 nt, Homo sapiens
uugauuagauccaguugauuga

SEQ ID NO: 289368 - RNA, 22 nt, Homo sapiens
uugcaaagaccucuucacuucc

SEQ ID NO: 289369 - RNA, 22 nt, Homo sapiens
uugcaaaguuugccuccuguag

SEQ ID NO: 289370 - RNA, 22 nt, Homo sapiens
uugcaaaucucuuguguuuggu

SEQ ID NO: 289371 - RNA, 22 nt, Homo sapiens
uugcaacauguauucuggugau

SEQ ID NO: 289372 - RNA, 22 nt, Homo sapiens
uugcaacauuguaaguuuauau

SEQ ID NO: 289373 - RNA, 22 nt, Homo sapiens
uugcaagugccguaacuaccaa

SEQ ID NO: 289374 - RNA, 22 nt, Homo sapiens
uugcacaguguguacagcacca

SEQ ID NO: 289375 - RNA, 22 nt, Homo sapiens
uugcacauugauuuuguauccu

SEQ ID NO: 289376 - RNA, 22 nt, Homo sapiens
uugcaccuugaagccaauagca

SEQ ID NO: 289377 - RNA, 22 nt, Homo sapiens
uugcacucuagccugggugaca

SEQ ID NO: 289378 - RNA, 22 nt, Homo sapiens
uugcacuguaauuuauuuaugu

SEQ ID NO: 289379 - RNA, 19 nt, Homo sapiens
uugcaguauccuauauguu

SEQ ID NO: 289380 - RNA, 22 nt, Homo sapiens
uugcagugugacgacuauauuu

SEQ ID NO: 289381 - RNA, 23 nt, Homo sapiens
uugcauagacauccucauagauu

SEQ ID NO: 289382 - RNA, 19 nt, Homo sapiens
uugcauagguugaaccagc

SEQ ID NO: 289383 - RNA, 22 nt, Homo sapiens
uugcauauguugaaccagccuu

SEQ ID NO: 289384 - RNA, 22 nt, Homo sapiens
uugcaucagcuccugauguacu

SEQ ID NO: 289385 - RNA, 22 nt, Homo sapiens
uugcauuagugugguacauuug

SEQ ID NO: 289386 - RNA, 22 nt, Homo sapiens
uugcauuuucuaggagggcaaa

SEQ ID NO: 289387 - RNA, 22 nt, Homo sapiens
uugcccuuuagguaacuauaua

SEQ ID NO: 289388 - RNA, 22 nt, Homo sapiens
uugccuaguuuaggucugugcu

SEQ ID NO: 289389 - RNA, 22 nt, Homo sapiens
uugcuaagucaagagaaaugau

SEQ ID NO: 289390 - RNA, 22 nt, Homo sapiens
uugcuagaugaaaaugguaccu

SEQ ID NO: 289391 - RNA, 22 nt, Homo sapiens
uugcucaccugagaagaauaga

SEQ ID NO: 289392 - RNA, 22 nt, Homo sapiens
uugcagcaaauaggaaugagga

SEQ ID NO: 289393 - RNA, 22 nt, Homo sapiens
uugcauaaguugaaccagccuu

SEQ ID NO: 289394 - RNA, 22 nt, Homo sapiens
uugcauagaccgaugucuugga

SEQ ID NO: 289395 - RNA, 22 nt, Homo sapiens
uugcauagaggugaguauagua

SEQ ID NO: 289396 - RNA, 18 nt, Homo sapiens
uugcauaguguauccaaa

SEQ ID NO: 289397 - RNA, 19 nt, Homo sapiens
uugcauauguugaaccagg

SEQ ID NO: 289398 - RNA, 18 nt, Homo sapiens
uugcaucauuuuguuguu

SEQ ID NO: 289399 - RNA, 22 nt, Homo sapiens
uugcaugggagcugggugaagc

SEQ ID NO: 289400 - RNA, 22 nt, Homo sapiens
uugcaugguuuuuaucugaaau

SEQ ID NO: 289401 - RNA, 22 nt, Homo sapiens
uugcauugacacaugaagcuca

SEQ ID NO: 289402 - RNA, 22 nt, Homo sapiens
uugccaauauuuuacugagaag

SEQ ID NO: 289403 - RNA, 22 nt, Homo sapiens
uugccugagaagccaagaauaa

SEQ ID NO: 289404 - RNA, 22 nt, Homo sapiens
uugcucaggcuagaguucagcu

SEQ ID NO: 289405 - RNA, 22 nt, Homo sapiens
uugcugguuuucauaugagcag

SEQ ID NO: 289406 - RNA, 22 nt, Homo sapiens
uugcuuuguuacugcaguuucc

SEQ ID NO: 289407 - RNA, 22 nt, Homo sapiens
uuggaaacaccuggugagguua

SEQ ID NO: 289408 - RNA, 22 nt, Homo sapiens
uuggaaaccucugcagguguuu

SEQ ID NO: 289409 - RNA, 22 nt, Homo sapiens
uuggaauauaaccuguuucuaa

SEQ ID NO: 289410 - RNA, 22 nt, Homo sapiens
uuggaaugcaacagaaggauaa

SEQ ID NO: 289411 - RNA, 22 nt, Homo sapiens
uuggaauguacucuagccuaug

SEQ ID NO: 289412 - RNA, 22 nt, Homo sapiens
uuggaauuuauuuggaugggag

SEQ ID NO: 289413 - RNA, 19 nt, Homo sapiens
uuggaauuuuagaguuuga

SEQ ID NO: 289414 - RNA, 18 nt, Homo sapiens
uuggacggagagucaaau

SEQ ID NO: 289415 - RNA, 22 nt, Homo sapiens
uuggacuucucaaggcaauaaa

SEQ ID NO: 289416 - RNA, 22 nt, Homo sapiens
uuggagagucacuaguuagugc

SEQ ID NO: 289417 - RNA, 22 nt, Homo sapiens
uuggauggucuuuauauaguau

SEQ ID NO: 289418 - RNA, 22 nt, Homo sapiens
uuggauuauaaacugagauuug

SEQ ID NO: 289419 - RNA, 22 nt, Homo sapiens
uuggauugugaaaguauucucu

SEQ ID NO: 289420 - RNA, 22 nt, Homo sapiens
uuggcaacauagugagaccccc

SEQ ID NO: 289421 - RNA, 22 nt, Homo sapiens
uuggcaaguccccaccucucuc

SEQ ID NO: 289422 - RNA, 22 nt, Homo sapiens
uuggcaguaucuacuacagcua

SEQ ID NO: 289423 - RNA, 22 nt, Homo sapiens
uuggcagucugaggcacagacu

SEQ ID NO: 289424 - RNA, 22 nt, Homo sapiens
uuggcagugcccgaugcugggg

SEQ ID NO: 289425 - RNA, 22 nt, Homo sapiens
uuggccccuccaaaucucaugu

SEQ ID NO: 289426 - RNA, 22 nt, Homo sapiens
uuggccccuuucauccacagcu

SEQ ID NO: 289427 - RNA, 23 nt, Homo sapiens
uuggccuccuugugucuagggcu

SEQ ID NO: 289428 - RNA, 22 nt, Homo sapiens
uuggcuacagauuaugaauuuc

SEQ ID NO: 289429 - RNA, 22 nt, Homo sapiens
uuggcuauagauacauggauua

SEQ ID NO: 289430 - RNA, 22 nt, Homo sapiens
uuggcuuaguugaccacagucu

SEQ ID NO: 289431 - RNA, 22 nt, Homo sapiens
uuccugagaucagaauucaaau

SEQ ID NO: 289432 - RNA, 22 nt, Homo sapiens
uuccuguagcgauuuuaguaau

SEQ ID NO: 289433 - RNA, 22 nt, Homo sapiens
uuccuucaugcuugaaggguau

SEQ ID NO: 289434 - RNA, 22 nt, Homo sapiens
uuccuugagaaaguacaaggcu

SEQ ID NO: 289435 - RNA, 22 nt, Homo sapiens
uuccuuguuuauuuacaggagg

SEQ ID NO: 289436 - RNA, 20 nt, Homo sapiens
uucuacagucacaggaagau

SEQ ID NO: 289437 - RNA, 22 nt, Homo sapiens
uucuagcacuuugggagacuga

SEQ ID NO: 289438 - RNA, 22 nt, Homo sapiens
uucuauguuguuagacccacca

SEQ ID NO: 289439 - RNA, 22 nt, Homo sapiens
uucucagcccccugacagucag

SEQ ID NO: 289440 - RNA, 21 nt, Homo sapiens
uucucaggguguguccuaccc

SEQ ID NO: 289441 - RNA, 22 nt, Homo sapiens
uucucaguucgguggcagugcu

SEQ ID NO: 289442 - RNA, 22 nt, Homo sapiens
ucagugucugcauucuuauugu

SEQ ID NO: 289443 - RNA, 22 nt, Homo sapiens
ucaguuuagguguaacggccac

SEQ ID NO: 289444 - RNA, 22 nt, Homo sapiens
ucauaaaguuguuuuaauggga

SEQ ID NO: 289445 - RNA, 22 nt, Homo sapiens
ucauacuguuaaaugguuuagu

SEQ ID NO: 289446 - RNA, 22 nt, Homo sapiens
ucauagaucaaguaauaagaca

SEQ ID NO: 289447 - RNA, 22 nt, Homo sapiens
ucauaguagucacuuaauaaau

SEQ ID NO: 289448 - RNA, 16 nt, Homo sapiens
ucauaguaucucuucu

SEQ ID NO: 289449 - RNA, 22 nt, Homo sapiens
ucauaugucauaguaugaucuu

SEQ ID NO: 289450 - RNA, 21 nt, Homo sapiens
ucaucaagcuguagacaugau

SEQ ID NO: 289451 - RNA, 16 nt, Homo sapiens
ucaucacagucucugg

SEQ ID NO: 289452 - RNA, 22 nt, Homo sapiens
ucaucaggcucauucaagcuga

SEQ ID NO: 289453 - RNA, 20 nt, Homo sapiens
ucaucaguuggugcucgcug

SEQ ID NO: 289454 - RNA, 22 nt, Homo sapiens
ucaugaaguaguuaacugguug

SEQ ID NO: 289455 - RNA, 22 nt, Homo sapiens
ucauggcacugaugagaguuuc

SEQ ID NO: 289456 - RNA, 22 nt, Homo sapiens
ucauggcuuuuauuauguugag

SEQ ID NO: 289457 - RNA, 22 nt, Homo sapiens
ucauggggugcuuugcuagauu

SEQ ID NO: 289458 - RNA, 22 nt, Homo sapiens
ucauguauuaucauuagugggu

SEQ ID NO: 289459 - RNA, 22 nt, Homo sapiens
ucauuagagacagggugucacu

SEQ ID NO: 289460 - RNA, 22 nt, Homo sapiens
ucauucuuucuguggaggggcu

SEQ ID NO: 289461 - RNA, 22 nt, Homo sapiens
ucauugcauguuaauuaaacag

SEQ ID NO: 289462 - RNA, 21 nt, Homo sapiens
ucauugggugcagcccacccu

SEQ ID NO: 289463 - RNA, 22 nt, Homo sapiens
ucauugguugcguaauuugauu

SEQ ID NO: 289464 - RNA, 22 nt, Homo sapiens
uccaaaucucuggcacugggau

SEQ ID NO: 289465 - RNA, 22 nt, Homo sapiens
uccaauguaaucaucauugaau

SEQ ID NO: 289466 - RNA, 22 nt, Homo sapiens
uccacagugguugaacuaguaa

SEQ ID NO: 289467 - RNA, 22 nt, Homo sapiens
uccacagugguugaacuaguuu

SEQ ID NO: 289468 - RNA, 19 nt, Homo sapiens
uccaccgcgugcaccucua

SEQ ID NO: 289469 - RNA, 22 nt, Homo sapiens
uccacugagcuagaccacuugg

SEQ ID NO: 289470 - RNA, 21 nt, Homo sapiens
uccagcuuugagaguuguggu

SEQ ID NO: 289471 - RNA, 22 nt, Homo sapiens
uccagugcauucagacacuugg

SEQ ID NO: 289472 - RNA, 22 nt, Homo sapiens
uccaguuuucuuuccuagggcu

SEQ ID NO: 289473 - RNA, 22 nt, Homo sapiens
uccauugucuagauguaacaca

SEQ ID NO: 289474 - RNA, 22 nt, Homo sapiens
uccauuuguucagcuucaggaa

SEQ ID NO: 289475 - RNA, 22 nt, Homo sapiens
ucccacugucuucucgugcucg

SEQ ID NO: 289476 - RNA, 20 nt, Homo sapiens
ucccaguaggagaaggaagg

SEQ ID NO: 289477 - RNA, 22 nt, Homo sapiens
ucccaguggucuugaaacaggg

SEQ ID NO: 289478 - RNA, 22 nt, Homo sapiens
ucccauguagcuaggauuacag

SEQ ID NO: 289479 - RNA, 17 nt, Homo sapiens
ucccauguuucuucuac

SEQ ID NO: 289480 - RNA, 22 nt, Homo sapiens
uccccgagcccaggcugugacu

SEQ ID NO: 289481 - RNA, 23 nt, Homo sapiens
uccccgggagcaccagcuuguug

SEQ ID NO: 289482 - RNA, 19 nt, Homo sapiens
uccccgggucuagugcagc

SEQ ID NO: 289483 - RNA, 20 nt, Homo sapiens
ucccuaagagccuuuccuuc

SEQ ID NO: 289484 - RNA, 22 nt, Homo sapiens
ucccuacugggguacugccuag

SEQ ID NO: 289485 - RNA, 22 nt, Homo sapiens
ucccugaaaaauuggcuuaaca

SEQ ID NO: 289486 - RNA, 22 nt, Homo sapiens
ucccugaaagcugagauuggaa

SEQ ID NO: 289487 - RNA, 22 nt, Homo sapiens
ucccugaacacauguugagaag

SEQ ID NO: 289488 - RNA, 22 nt, Homo sapiens
ucccugacagggucugagcuuu

SEQ ID NO: 289489 - RNA, 22 nt, Homo sapiens
ucccugacagucacagagcuac

SEQ ID NO: 289490 - RNA, 22 nt, Homo sapiens
uggagguagggccuaggaaucu

SEQ ID NO: 289491 - RNA, 22 nt, Homo sapiens
uggaggucauuggaucaugggg

SEQ ID NO: 289492 - RNA, 19 nt, Homo sapiens
uggagucaucaugcugcua

SEQ ID NO: 289493 - RNA, 22 nt, Homo sapiens
uggagucuugcucuguugccca

SEQ ID NO: 289494 - RNA, 21 nt, Homo sapiens
uggagugaagaguuuauugac

SEQ ID NO: 289495 - RNA, 22 nt, Homo sapiens
uggagugcaauggugagaucuu

SEQ ID NO: 289496 - RNA, 22 nt, Homo sapiens
uggagugcgagggugaaacuuu

SEQ ID NO: 289497 - RNA, 22 nt, Homo sapiens
uggaguguguuaacuuuacaag

SEQ ID NO: 289498 - RNA, 22 nt, Homo sapiens
uggaguguguugcagaugaagg

SEQ ID NO: 289499 - RNA, 22 nt, Homo sapiens
uggauauguuuauauguugucu

SEQ ID NO: 289500 - RNA, 22 nt, Homo sapiens
uggaugacauccuuguaugcag

SEQ ID NO: 289501 - RNA, 22 nt, Homo sapiens
uggauugaaagcuuuaauauug

SEQ ID NO: 289502 - RNA, 18 nt, Homo sapiens
uggauuggaaaaguuccu

SEQ ID NO: 289503 - RNA, 22 nt, Homo sapiens
uggcaaaaaaacgcaauuacgu

SEQ ID NO: 289504 - RNA, 22 nt, Homo sapiens
uggcaaaauauuuugguuucug

SEQ ID NO: 289505 - RNA, 22 nt, Homo sapiens
uggcaaaauggaauauguuggg

SEQ ID NO: 289506 - RNA, 22 nt, Homo sapiens
uggcaaauuccaaaguuaauuc

SEQ ID NO: 289507 - RNA, 21 nt, Homo sapiens
uggcaacgaggugugcauuau

SEQ ID NO: 289508 - RNA, 22 nt, Homo sapiens
uggcaagaaccacaguuacuuu

SEQ ID NO: 289509 - RNA, 23 nt, Homo sapiens
uggcaagaauucuuaccgugugg

SEQ ID NO: 289510 - RNA, 22 nt, Homo sapiens
uggcaagagcugcauucaucug

SEQ ID NO: 289511 - RNA, 22 nt, Homo sapiens
uggcaaguuucaauccgaggga

SEQ ID NO: 289512 - RNA, 22 nt, Homo sapiens
uggcaauaaaaugcaguuacuu

SEQ ID NO: 289513 - RNA, 22 nt, Homo sapiens
uggcaauguggaaugguccagg

SEQ ID NO: 289514 - RNA, 19 nt, Homo sapiens
uggcacauguauacauaug

SEQ ID NO: 289515 - RNA, 22 nt, Homo sapiens
uggcaccugacuccgagaugca

SEQ ID NO: 289516 - RNA, 22 nt, Homo sapiens
uggcagaugagccgcgcuccaa

SEQ ID NO: 289517 - RNA, 22 nt, Homo sapiens
uggcagauggugacaccauuag

SEQ ID NO: 289518 - RNA, 22 nt, Homo sapiens
uggcaguuuuugccuucaauac

SEQ ID NO: 289519 - RNA, 22 nt, Homo sapiens
uggcaucuguucuacacauaaa

SEQ ID NO: 289520 - RNA, 22 nt, Homo sapiens
uggcauggaguggauggcccca

SEQ ID NO: 289521 - RNA, 22 nt, Homo sapiens
uggcauggggcagaacauuaca

SEQ ID NO: 289522 - RNA, 22 nt, Homo sapiens
uggcauggucugcccaaguuuc

SEQ ID NO: 289523 - RNA, 22 nt, Homo sapiens
uggcauguguuugaaugaguau

SEQ ID NO: 289524 - RNA, 23 nt, Homo sapiens
uggcauuuuaguuagcuucagug

SEQ ID NO: 289525 - RNA, 22 nt, Homo sapiens
uggccaagagcacagauauugg

SEQ ID NO: 289526 - RNA, 22 nt, Homo sapiens
uggccuguaacccucucauagg

SEQ ID NO: 289527 - RNA, 22 nt, Homo sapiens
uggccuguaacgcugucucagc

SEQ ID NO: 289528 - RNA, 22 nt, Homo sapiens
uggcgggaaaguugggagaaga

SEQ ID NO: 289529 - RNA, 22 nt, Homo sapiens
uggcuagauauccagaguucug

SEQ ID NO: 289530 - RNA, 22 nt, Homo sapiens
uggcuguguccucucccaaauc

SEQ ID NO: 289531 - RNA, 22 nt, Homo sapiens
uggcuguuguuacuaacaguuc

SEQ ID NO: 289532 - RNA, 22 nt, Homo sapiens
uggcuguuuauuucaccugggu

SEQ ID NO: 289533 - RNA, 22 nt, Homo sapiens
uggcuugauggcacaagguuuc

SEQ ID NO: 289534 - RNA, 22 nt, Homo sapiens
uggcuuuuccuugaaucugccu

SEQ ID NO: 289535 - RNA, 20 nt, Homo sapiens
ugggaaauguccaggacaua

SEQ ID NO: 289536 - RNA, 22 nt, Homo sapiens
ugggaagaugcugcuucuuccu

SEQ ID NO: 289537 - RNA, 22 nt, Homo sapiens
ugggagcauugcauuagaagcc

SEQ ID NO: 289538 - RNA, 22 nt, Homo sapiens
ugggauccaugugguuuaagca

SEQ ID NO: 289539 - RNA, 22 nt, Homo sapiens
ugggcaguauggucauuuucgu

SEQ ID NO: 289540 - RNA, 22 nt, Homo sapiens
ugggcggagacgugcagccgcc

SEQ ID NO: 289541 - RNA, 22 nt, Homo sapiens
uggggcaaugaacauuuuugca

SEQ ID NO: 289542 - RNA, 22 nt, Homo sapiens
uggguaaaucucuguucagggc

SEQ ID NO: 289543 - RNA, 22 nt, Homo sapiens
uggguaguguaaagcacuccag

SEQ ID NO: 289544 - RNA, 22 nt, Homo sapiens
uggguaguuucuuacaacucug

SEQ ID NO: 289545 - RNA, 19 nt, Homo sapiens
uggguaguuuucuggcugg

SEQ ID NO: 289546 - RNA, 22 nt, Homo sapiens
ugggucaguagcauguaugucu

SEQ ID NO: 289547 - RNA, 23 nt, Homo sapiens
ugggucaguuuuucugacaucau

SEQ ID NO: 289548 - RNA, 23 nt, Homo sapiens
uggguucauucuugaagucagug

SEQ ID NO: 289549 - RNA, 23 nt, Homo sapiens
uggguucccuaagcgcaugcugc

SEQ ID NO: 289550 - RNA, 22 nt, Homo sapiens
ugguacuucaugcucacagaua

SEQ ID NO: 289551 - RNA, 22 nt, Homo sapiens
ugguaucuaagaugcacguugu

SEQ ID NO: 289552 - RNA, 22 nt, Homo sapiens
uuuguggaaugcucauguguag

SEQ ID NO: 289553 - RNA, 21 nt, Homo sapiens
uuugugguuacugugugagcu

SEQ ID NO: 289554 - RNA, 22 nt, Homo sapiens
uuuguuugaagucgagacaacu

SEQ ID NO: 289555 - RNA, 22 nt, Homo sapiens
uuuuaacagccaggggacggcc

SEQ ID NO: 289556 - RNA, 22 nt, Homo sapiens
uuuuaagcuacaagagacauau

SEQ ID NO: 289557 - RNA, 22 nt, Homo sapiens
uuuuaugggcuauuugcauuag

SEQ ID NO: 289558 - RNA, 22 nt, Homo sapiens
uuuugcaaauuccaguggccau

SEQ ID NO: 289559 - RNA, 22 nt, Homo sapiens
uuuugcacuagaaccagagguu

SEQ ID NO: 289560 - RNA, 22 nt, Homo sapiens
uuuugcaguuacagagagugag

SEQ ID NO: 289561 - RNA, 22 nt, Homo sapiens
uuuugcauuggcugaggagugu

SEQ ID NO: 289562 - RNA, 20 nt, Homo sapiens
uuuuggacuaaaggcauccc

SEQ ID NO: 289563 - RNA, 22 nt, Homo sapiens
uuuuggacuugcuccccugucc

SEQ ID NO: 289564 - RNA, 17 nt, Homo sapiens
uuuuggauuagaaaucc

SEQ ID NO: 289565 - RNA, 22 nt, Homo sapiens
uuuuggcuagaaauauaccucc

SEQ ID NO: 289566 - RNA, 22 nt, Homo sapiens
uuuuggcucugucuguaucuuu

SEQ ID NO: 289567 - RNA, 22 nt, Homo sapiens
uuuuggcuuaaagagaauguau

SEQ ID NO: 289568 - RNA, 21 nt, Homo sapiens
uuuuggucauucaggaagaaa

SEQ ID NO: 289569 - RNA, 22 nt, Homo sapiens
uuuugugcauggcccaguggua

SEQ ID NO: 289570 - RNA, 21 nt, Homo sapiens
uuuuugggcuuucauaguguu

SEQ ID NO: 289571 - RNA, 22 nt, Homo sapiens
ucucaguggcacccccaacacc

SEQ ID NO: 289572 - RNA, 22 nt, Homo sapiens
ucucaguggugcuggcagggga

SEQ ID NO: 289573 - RNA, 19 nt, Homo sapiens
ucucaguguuggucaggug

SEQ ID NO: 289574 - RNA, 22 nt, Homo sapiens
ucucauggagguagagaguaaa

SEQ ID NO: 289575 - RNA, 21 nt, Homo sapiens
ucucauugugguuuuaauugg

SEQ ID NO: 289576 - RNA, 22 nt, Homo sapiens
ucucccauccguacacggauug

SEQ ID NO: 289577 - RNA, 22 nt, Homo sapiens
ucuccggguggcggcgaaggga

SEQ ID NO: 289578 - RNA, 21 nt, Homo sapiens
ucucucaaccaggaagugggc

SEQ ID NO: 289579 - RNA, 22 nt, Homo sapiens
ucucugagaccacuccaaacuc

SEQ ID NO: 289580 - RNA, 22 nt, Homo sapiens
ucucugauuauugcauuucauu

SEQ ID NO: 289581 - RNA, 19 nt, Homo sapiens
ucucugguguuggagggga

SEQ ID NO: 289582 - RNA, 22 nt, Homo sapiens
ucucugguuuucaaagcaguau

SEQ ID NO: 289583 - RNA, 22 nt, Homo sapiens
ucucuguuuagagccagcaauu

SEQ ID NO: 289584 - RNA, 22 nt, Homo sapiens
ucucuguuuauuuuugguguau

SEQ ID NO: 289585 - RNA, 22 nt, Homo sapiens
ucugacagugagagaaaucuga

SEQ ID NO: 289586 - RNA, 22 nt, Homo sapiens
ucugacucugugaugggcccaa

SEQ ID NO: 289587 - RNA, 22 nt, Homo sapiens
ucugagacuguuucuaacaagc

SEQ ID NO: 289588 - RNA, 22 nt, Homo sapiens
ucugagcaugcaucuugccugg

SEQ ID NO: 289589 - RNA, 22 nt, Homo sapiens
ucuggcauuuucucugcuugca

SEQ ID NO: 289590 - RNA, 22 nt, Homo sapiens
ucuggccuacaucauuuuuccg

SEQ ID NO: 289591 - RNA, 22 nt, Homo sapiens
ucuggcuccaaagucuauuuuu

SEQ ID NO: 289592 - RNA, 22 nt, Homo sapiens
ucuggguuuuuacaauguuuac

SEQ ID NO: 289593 - RNA, 22 nt, Homo sapiens
ucugguuccugcauucauucaa

SEQ ID NO: 289594 - RNA, 22 nt, Homo sapiens
ucuguacuccuugaguagugcu

SEQ ID NO: 289595 - RNA, 22 nt, Homo sapiens
ucuguacugccaaguuucuuua

SEQ ID NO: 289596 - RNA, 19 nt, Homo sapiens
ucuguaguuagggcuacag

SEQ ID NO: 289597 - RNA, 22 nt, Homo sapiens
ucugucaaaucuuauguuguag

SEQ ID NO: 289598 - RNA, 22 nt, Homo sapiens
ucugucacugguggacgaucac

SEQ ID NO: 289599 - RNA, 22 nt, Homo sapiens
ucugugaaugaacacuugaaaa

SEQ ID NO: 289600 - RNA, 22 nt, Homo sapiens
ucugugcauuguaggauguuua

SEQ ID NO: 289601 - RNA, 22 nt, Homo sapiens
ucugugcugagaguugaaaguu

SEQ ID NO: 289602 - RNA, 22 nt, Homo sapiens
ucugugguaagaaacgcauguc

SEQ ID NO: 289603 - RNA, 22 nt, Homo sapiens
ucuuaggugaugauugauguga

SEQ ID NO: 289604 - RNA, 22 nt, Homo sapiens
ucuuaguuuagauuagcaauuc

SEQ ID NO: 289605 - RNA, 19 nt, Homo sapiens
ucuugcacaugugaacuca

SEQ ID NO: 289606 - RNA, 22 nt, Homo sapiens
ucuugcuuguuguucccuucau

SEQ ID NO: 289607 - RNA, 22 nt, Homo sapiens
ucuugcuuuugcagagcuucuc

SEQ ID NO: 289608 - RNA, 22 nt, Homo sapiens
ucuuggguggauucauucuuuc

SEQ ID NO: 289609 - RNA, 22 nt, Homo sapiens
ucuuggguuugccuugcugcug

SEQ ID NO: 289610 - RNA, 17 nt, Homo sapiens
ucuugugguucuugaau

SEQ ID NO: 289611 - RNA, 22 nt, Homo sapiens
ucuuuggaggcgaucuguuuga

SEQ ID NO: 289612 - RNA, 22 nt, Homo sapiens
ucuuugguaugugcaugugcuu

SEQ ID NO: 289613 - RNA, 22 nt, Homo sapiens
ucuuuguguucaggagccacgu

SEQ ID NO: 289614 - RNA, 22 nt, Homo sapiens
ucuuuguucaggagccaacucc

SEQ ID NO: 289615 - RNA, 22 nt, Homo sapiens
ucuuuguuuucugauccugaag

SEQ ID NO: 289616 - RNA, 22 nt, Homo sapiens
ucuuuuguucuauucaggccuu

SEQ ID NO: 289617 - RNA, 22 nt, Homo sapiens
ucuuuuugagucaguuucggua

SEQ ID NO: 289618 - RNA, 22 nt, Homo sapiens
ugaaaagucuaagauuaagguu

SEQ ID NO: 289619 - RNA, 22 nt, Homo sapiens
ugaaagacugaagaauaggcau

SEQ ID NO: 289620 - RNA, 22 nt, Homo sapiens
ugaaagcuacagucuccuagga

SEQ ID NO: 289621 - RNA, 22 nt, Homo sapiens
ugaaagguuuaauucugugaga

SEQ ID NO: 289622 - RNA, 20 nt, Homo sapiens
ugaaaucuucacuaagucuc

SEQ ID NO: 289623 - RNA, 22 nt, Homo sapiens
ugaaaugccuuuaaugaauuua

SEQ ID NO: 289624 - RNA, 22 nt, Homo sapiens
ugaaauguguuaucugggccug

SEQ ID NO: 289625 - RNA, 22 nt, Homo sapiens
ugaaauuuuuuauucguuggcu

SEQ ID NO: 289626 - RNA, 22 nt, Homo sapiens
ugaagacucauacuugaaucag

SEQ ID NO: 289627 - RNA, 22 nt, Homo sapiens
ugaagcuaugacuauugagcau

SEQ ID NO: 289628 - RNA, 22 nt, Homo sapiens
ugaagcuuguuucuguaccuuu

SEQ ID NO: 289629 - RNA, 22 nt, Homo sapiens
ugaaggacauaaggcagaguga

SEQ ID NO: 289630 - RNA, 22 nt, Homo sapiens
ugaagggcauuguuuugccaaa

SEQ ID NO: 289631 - RNA, 19 nt, Homo sapiens
ugaaguauagggcuucuga

SEQ ID NO: 289632 - RNA, 22 nt, Homo sapiens
ugaagugcugugggccaggcgu

SEQ ID NO: 289633 - RNA, 22 nt, Homo sapiens
ugaaguguuuuuucaggcaugu

SEQ ID NO: 289634 - RNA, 22 nt, Homo sapiens
ugaauacagcacacccaugggu

SEQ ID NO: 289635 - RNA, 22 nt, Homo sapiens
ugaauacugugcaaaggauuug

SEQ ID NO: 289636 - RNA, 22 nt, Homo sapiens
ugaauacuucaaaaaaauagcu

SEQ ID NO: 289637 - RNA, 22 nt, Homo sapiens
ugaauagaaguuuacuccuuuu

SEQ ID NO: 289638 - RNA, 22 nt, Homo sapiens
ugaauagacagucacugccucc

SEQ ID NO: 289639 - RNA, 22 nt, Homo sapiens
ugaauauguuaaauaauguucu

SEQ ID NO: 289640 - RNA, 21 nt, Homo sapiens
ugaauauuuggguugugucca

SEQ ID NO: 289641 - RNA, 22 nt, Homo sapiens
ugaaucaugcugcuauaaagac

SEQ ID NO: 289642 - RNA, 22 nt, Homo sapiens
ugaaugcaucauguagggcuca

SEQ ID NO: 289643 - RNA, 22 nt, Homo sapiens
ugaaugcuucaugucugggcug

SEQ ID NO: 289644 - RNA, 21 nt, Homo sapiens
ugaaugcuuuaaauauuagaa

SEQ ID NO: 289645 - RNA, 22 nt, Homo sapiens
ugaauggauccaauucuuagua

SEQ ID NO: 289646 - RNA, 22 nt, Homo sapiens
ugaaugguaaagaaaagcacug

SEQ ID NO: 289647 - RNA, 22 nt, Homo sapiens
ugaauguaacuaaaccugugaa

SEQ ID NO: 289648 - RNA, 22 nt, Homo sapiens
ugaauguaacuaaaggacuuuu

SEQ ID NO: 289649 - RNA, 22 nt, Homo sapiens
ugaauguacuuaacacuggauu

SEQ ID NO: 289650 - RNA, 22 nt, Homo sapiens
ugaauucuguccaaaauaacug

SEQ ID NO: 289651 - RNA, 18 nt, Homo sapiens
ugacaaugcuaguccugg

SEQ ID NO: 289652 - RNA, 22 nt, Homo sapiens
ugacacauguagacaucuggug

SEQ ID NO: 289653 - RNA, 22 nt, Homo sapiens
gagaugucuauuucagagaugu

SEQ ID NO: 289654 - RNA, 22 nt, Homo sapiens
gagauguuuuguuaucaaagga

SEQ ID NO: 289655 - RNA, 22 nt, Homo sapiens
gagauucuucaauauuuauucu

SEQ ID NO: 289656 - RNA, 22 nt, Homo sapiens
gagcaaaaguauguauugguua

SEQ ID NO: 289657 - RNA, 22 nt, Homo sapiens
gagcaaugagcugccugcugag

SEQ ID NO: 289658 - RNA, 22 nt, Homo sapiens
gagcaucaauggcaugugggaa

SEQ ID NO: 289659 - RNA, 22 nt, Homo sapiens
gagcaucauucaacaaaagucu

SEQ ID NO: 289660 - RNA, 22 nt, Homo sapiens
gagccuguaggaggagaggugg

SEQ ID NO: 289661 - RNA, 22 nt, Homo sapiens
gagcucauuaaaguaggaccua

SEQ ID NO: 289662 - RNA, 20 nt, Homo sapiens
gagcugguguacugccgggc

SEQ ID NO: 289663 - RNA, 22 nt, Homo sapiens
gagcuuggguuaaaguugccuu

SEQ ID NO: 289664 - RNA, 22 nt, Homo sapiens
gaggacauuaugcuaaguggaa

SEQ ID NO: 289665 - RNA, 21 nt, Homo sapiens
gaggauauuuuuauguuugga

SEQ ID NO: 289666 - RNA, 22 nt, Homo sapiens
gaggcagucugacccuuagcag

SEQ ID NO: 289667 - RNA, 22 nt, Homo sapiens
gaggcuagauggggaugugucc

SEQ ID NO: 289668 - RNA, 22 nt, Homo sapiens
gagguaagaaagucaguccuuc

SEQ ID NO: 289669 - RNA, 22 nt, Homo sapiens
gagguaagagaauaaacaguuu

SEQ ID NO: 289670 - RNA, 22 nt, Homo sapiens
gagguaggaauaaacauuugaa

SEQ ID NO: 289671 - RNA, 22 nt, Homo sapiens
gagguagguacaauugccacca

SEQ ID NO: 289672 - RNA, 22 nt, Homo sapiens
gagguagguuugguuacaaaag

SEQ ID NO: 289673 - RNA, 22 nt, Homo sapiens
gagguaguuaaugcauucacua

SEQ ID NO: 289674 - RNA, 22 nt, Homo sapiens
gagguauaauugacaagcaaaa

SEQ ID NO: 289675 - RNA, 22 nt, Homo sapiens
gagguauggauaucuggagagg

SEQ ID NO: 289676 - RNA, 22 nt, Homo sapiens
gaggucaggacauuuuugcuuu

SEQ ID NO: 289677 - RNA, 22 nt, Homo sapiens
gaggugauaucucauugugguu

SEQ ID NO: 289678 - RNA, 23 nt, Homo sapiens
gaguacauuaaaagcccagacug

SEQ ID NO: 289679 - RNA, 22 nt, Homo sapiens
gaguaucuuuaaggugguuugg

SEQ ID NO: 289680 - RNA, 22 nt, Homo sapiens
gaguauguauaugagugugucu

SEQ ID NO: 289681 - RNA, 22 nt, Homo sapiens
gagucagugucuugcucuguca

SEQ ID NO: 289682 - RNA, 22 nt, Homo sapiens
gagugcaauggcagaucuccgc

SEQ ID NO: 289683 - RNA, 22 nt, Homo sapiens
gagugcaauggcgcgaucuggg

SEQ ID NO: 289684 - RNA, 22 nt, Homo sapiens
gagugcaauggugccaucucgg

SEQ ID NO: 289685 - RNA, 22 nt, Homo sapiens
gagugcauaugggccuguguca

SEQ ID NO: 289686 - RNA, 22 nt, Homo sapiens
gagugcuguuagcccuggguuu

SEQ ID NO: 289687 - RNA, 22 nt, Homo sapiens
gaguucaaaucucagcucuguu

SEQ ID NO: 289688 - RNA, 22 nt, Homo sapiens
gaguucauuuugaaaccuugau

SEQ ID NO: 289689 - RNA, 19 nt, Homo sapiens
gaguugggguuuacuguaa

SEQ ID NO: 289690 - RNA, 22 nt, Homo sapiens
gaguuguuuuaaggcacugacu

SEQ ID NO: 289691 - RNA, 22 nt, Homo sapiens
gauaaagauagcaauagggaca

SEQ ID NO: 289692 - RNA, 22 nt, Homo sapiens
gauaaaguauuggguacuaugc

SEQ ID NO: 289693 - RNA, 18 nt, Homo sapiens
gauaacaguggacuaugc

SEQ ID NO: 289694 - RNA, 22 nt, Homo sapiens
gauacuggcuuuauagaaugau

SEQ ID NO: 289695 - RNA, 19 nt, Homo sapiens
gauagacaucacagugcca

SEQ ID NO: 289696 - RNA, 22 nt, Homo sapiens
gauagugaaccaagggguaauu

SEQ ID NO: 289697 - RNA, 22 nt, Homo sapiens
gauauguacagcucucuaggau

SEQ ID NO: 289698 - RNA, 22 nt, Homo sapiens
gaucagagugaaccuuguuaug

SEQ ID NO: 289699 - RNA, 22 nt, Homo sapiens
gaucagauggcuguuggugugu

SEQ ID NO: 289700 - RNA, 22 nt, Homo sapiens
gaugaaacaucuuuggaaacug

SEQ ID NO: 289701 - RNA, 22 nt, Homo sapiens
gaugagaucauaaguguggagc

SEQ ID NO: 289702 - RNA, 22 nt, Homo sapiens
gaugagguaguguaccuagucu

SEQ ID NO: 289703 - RNA, 22 nt, Homo sapiens
gaugauguuugauaaauaauaa

SEQ ID NO: 289704 - RNA, 22 nt, Homo sapiens
gaugcaaauuaagcuugggaca

SEQ ID NO: 289705 - RNA, 22 nt, Homo sapiens
gauggaguaauguaaucuugag

SEQ ID NO: 289706 - RNA, 22 nt, Homo sapiens
gauggaguugacuaagacaaca

SEQ ID NO: 289707 - RNA, 22 nt, Homo sapiens
gauggcacuuaagagcaagagc

SEQ ID NO: 289708 - RNA, 22 nt, Homo sapiens
gauggcaugugcugccaccaag

SEQ ID NO: 289709 - RNA, 22 nt, Homo sapiens
gauggcuauucuuaccauuucu

SEQ ID NO: 289710 - RNA, 22 nt, Homo sapiens
gauggcucugcaggugagggua

SEQ ID NO: 289711 - RNA, 22 nt, Homo sapiens
gauggugucccaggcucaggcu

SEQ ID NO: 289712 - RNA, 22 nt, Homo sapiens
gaugguuuuucuccgauuuaua

SEQ ID NO: 289713 - RNA, 22 nt, Homo sapiens
gauguguuuguuucuggaggag

SEQ ID NO: 289714 - RNA, 22 nt, Homo sapiens
gauguuguuuagccuuugaugu

SEQ ID NO: 289715 - RNA, 22 nt, Homo sapiens
gauuccauugcgaauuuucaga

SEQ ID NO: 289716 - RNA, 21 nt, Homo sapiens
gcaaaggaauugccuaagcuu

SEQ ID NO: 289717 - RNA, 20 nt, Homo sapiens
gcaaaguuuagcucccacua

SEQ ID NO: 289718 - RNA, 22 nt, Homo sapiens
gcaaaucuuauguccucacauu

SEQ ID NO: 289719 - RNA, 22 nt, Homo sapiens
gcaagaaugagaaggauuaauu

SEQ ID NO: 289720 - RNA, 22 nt, Homo sapiens
gcaagugucugagguuuuguau

SEQ ID NO: 289721 - RNA, 22 nt, Homo sapiens
gcaaugcugucugugcacagau

SEQ ID NO: 289722 - RNA, 22 nt, Homo sapiens
gcaauggaaucccuugaucaau

SEQ ID NO: 289723 - RNA, 22 nt, Homo sapiens
gcaauguuacugaauguguuuu

SEQ ID NO: 289724 - RNA, 22 nt, Homo sapiens
gcacacguagaagcaugcauca

SEQ ID NO: 289725 - RNA, 22 nt, Homo sapiens
gcacaguggcucccgucuauaa

SEQ ID NO: 289726 - RNA, 22 nt, Homo sapiens
gcacaguguuacuugauauauu

SEQ ID NO: 289727 - RNA, 22 nt, Homo sapiens
gcacaguuaaagggucauguga

SEQ ID NO: 289728 - RNA, 22 nt, Homo sapiens
gcacauggccacuaggaauaaa

SEQ ID NO: 289729 - RNA, 22 nt, Homo sapiens
gcacauggccccaucgugccga

SEQ ID NO: 289730 - RNA, 22 nt, Homo sapiens
gcaccaugguagaauaauggua

SEQ ID NO: 289731 - RNA, 22 nt, Homo sapiens
gcaccccuuaccgggcuggguu

SEQ ID NO: 289732 - RNA, 22 nt, Homo sapiens
gcacgugcucauuugaggucuu

SEQ ID NO: 289733 - RNA, 22 nt, Homo sapiens
gcagaauugguuucuucuaagg

SEQ ID NO: 289734 - RNA, 22 nt, Homo sapiens
gcaggcaugacauuucacucuu

SEQ ID NO: 289735 - RNA, 22 nt, Homo sapiens
uggagugagaacuucaaugaug

SEQ ID NO: 289736 - RNA, 22 nt, Homo sapiens
uggagugauaugguuauauggg

SEQ ID NO: 289737 - RNA, 22 nt, Homo sapiens
uggagugcaauggcaccaucuu

SEQ ID NO: 289738 - RNA, 20 nt, Homo sapiens
uggagugcuguguugagaag

SEQ ID NO: 289739 - RNA, 22 nt, Homo sapiens
uggaguguaauuagccaucagu

SEQ ID NO: 289740 - RNA, 22 nt, Homo sapiens
uggaguguagcggcaccuauua

SEQ ID NO: 289741 - RNA, 22 nt, Homo sapiens
uggaguguuggggcaggaucuc

SEQ ID NO: 289742 - RNA, 22 nt, Homo sapiens
uggauagaaauguacuguuuuc

SEQ ID NO: 289743 - RNA, 22 nt, Homo sapiens
uggauaguuuacugaagagugg

SEQ ID NO: 289744 - RNA, 18 nt, Homo sapiens
uggauaugaaauucugga

SEQ ID NO: 289745 - RNA, 22 nt, Homo sapiens
uggauauguuuauuacccugaa

SEQ ID NO: 289746 - RNA, 22 nt, Homo sapiens
uggaucauucuuucuugcaggg

SEQ ID NO: 289747 - RNA, 22 nt, Homo sapiens
uggaucuguucuauuuaucuga

SEQ ID NO: 289748 - RNA, 22 nt, Homo sapiens
uggauggugauuggaucaugga

SEQ ID NO: 289749 - RNA, 22 nt, Homo sapiens
uggauguaauugauucauguug

SEQ ID NO: 289750 - RNA, 22 nt, Homo sapiens
uggauugagaagcuguggcuca

SEQ ID NO: 289751 - RNA, 21 nt, Homo sapiens
uggauuguacacccuaucauu

SEQ ID NO: 289752 - RNA, 18 nt, Homo sapiens
uggauuguacuguguucu

SEQ ID NO: 289753 - RNA, 22 nt, Homo sapiens
uggauugugaagaccaugggaa

SEQ ID NO: 289754 - RNA, 22 nt, Homo sapiens
uggauuuuaauuauucugucau

SEQ ID NO: 289755 - RNA, 22 nt, Homo sapiens
uggcaaaaaaccgcaguugccu

SEQ ID NO: 289756 - RNA, 21 nt, Homo sapiens
uggcaaaaugggcaguggguu

SEQ ID NO: 289757 - RNA, 22 nt, Homo sapiens
uggcaaaugaagucagcuguac

SEQ ID NO: 289758 - RNA, 22 nt, Homo sapiens
uggcaacaucuggggacauguu

SEQ ID NO: 289759 - RNA, 22 nt, Homo sapiens
uggcaagaacaacaauuacuuu

SEQ ID NO: 289760 - RNA, 22 nt, Homo sapiens
uggcaagaacgaaauguagggu

SEQ ID NO: 289761 - RNA, 22 nt, Homo sapiens
uggcaagaucacaauuacuuuu

SEQ ID NO: 289762 - RNA, 22 nt, Homo sapiens
uggcaagauuguuccgguuugg

SEQ ID NO: 289763 - RNA, 22 nt, Homo sapiens
uggcaagcuuuaauugacucuu

SEQ ID NO: 289764 - RNA, 20 nt, Homo sapiens
uggcaagugggaauuguggg

SEQ ID NO: 289765 - RNA, 19 nt, Homo sapiens
uggcacauguauacuuaug

SEQ ID NO: 289766 - RNA, 20 nt, Homo sapiens
uggcaccugacagauagcca

SEQ ID NO: 289767 - RNA, 22 nt, Homo sapiens
uggcacuaugugacaagguuuu

SEQ ID NO: 289768 - RNA, 22 nt, Homo sapiens
uggcacuggagauacauuaaua

SEQ ID NO: 289769 - RNA, 19 nt, Homo sapiens
uggcacuugacguccggau

SEQ ID NO: 289770 - RNA, 22 nt, Homo sapiens
uggcagacaaauuugagcauau

SEQ ID NO: 289771 - RNA, 22 nt, Homo sapiens
uggcagauaggauacaggacua

SEQ ID NO: 289772 - RNA, 22 nt, Homo sapiens
uggcagcgcaguugaaaaagaa

SEQ ID NO: 289773 - RNA, 22 nt, Homo sapiens
uggcaggugcacuggcuuugaa

SEQ ID NO: 289774 - RNA, 22 nt, Homo sapiens
uggcaguuuacagcuuuaggag

SEQ ID NO: 289775 - RNA, 22 nt, Homo sapiens
uggcaguuuugauguggagaga

SEQ ID NO: 289776 - RNA, 22 nt, Homo sapiens
uggcauaugguauuugauaucu

SEQ ID NO: 289777 - RNA, 19 nt, Homo sapiens
uggcaugaaugugaacuaa

SEQ ID NO: 289778 - RNA, 17 nt, Homo sapiens
uggcaugaggguguggg

SEQ ID NO: 289779 - RNA, 22 nt, Homo sapiens
uggcauggaaagcuuuucauac

SEQ ID NO: 289780 - RNA, 22 nt, Homo sapiens
uggcauggaacuacuuugaaac

SEQ ID NO: 289781 - RNA, 22 nt, Homo sapiens
uggcauuguccaauaaaauuuu

SEQ ID NO: 289782 - RNA, 22 nt, Homo sapiens
uggcauuuuguuuuagaauuag

SEQ ID NO: 289783 - RNA, 18 nt, Homo sapiens
uggccaauggcaaacaga

SEQ ID NO: 289784 - RNA, 22 nt, Homo sapiens
uggccagugucggaggccagga

SEQ ID NO: 289785 - RNA, 22 nt, Homo sapiens
uggccaguugaagacaaugcuc

SEQ ID NO: 289786 - RNA, 22 nt, Homo sapiens
uggcgagaaaccauaugcuuuc

SEQ ID NO: 289787 - RNA, 22 nt, Homo sapiens
uggcggagacauggacuucaga

SEQ ID NO: 289788 - RNA, 22 nt, Homo sapiens
uggcuacagaaaguacuaguga

SEQ ID NO: 289789 - RNA, 22 nt, Homo sapiens
uggcucuguuuguuaacuagac

SEQ ID NO: 289790 - RNA, 20 nt, Homo sapiens
uggcucuuugcugcuaaagu

SEQ ID NO: 289791 - RNA, 22 nt, Homo sapiens
uggcuguuuauuucaccugggc

SEQ ID NO: 289792 - RNA, 21 nt, Homo sapiens
uggcuguuuucaugcuagaac

SEQ ID NO: 289793 - RNA, 20 nt, Homo sapiens
uggcuucuuaauugcaggca

SEQ ID NO: 289794 - RNA, 22 nt, Homo sapiens
uggcuuuucauccugggacauu

SEQ ID NO: 289795 - RNA, 22 nt, Homo sapiens
ugggaaauguagccuagcugug

SEQ ID NO: 289796 - RNA, 20 nt, Homo sapiens
ugggaacaugugguauaugg

SEQ ID NO: 289797 - RNA, 18 nt, Homo sapiens
ugggaagaaauucuucuc

SEQ ID NO: 289798 - RNA, 22 nt, Homo sapiens
ugggaccccuacucuuuccaca

SEQ ID NO: 289799 - RNA, 22 nt, Homo sapiens
ugggaugaauacaaugggauca

SEQ ID NO: 289800 - RNA, 22 nt, Homo sapiens
ugggcaaaacuaagagcugugg

SEQ ID NO: 289801 - RNA, 22 nt, Homo sapiens
ugggcaagagagcaugacccug

SEQ ID NO: 289802 - RNA, 22 nt, Homo sapiens
ugggcagugggacagcuuugug

SEQ ID NO: 289803 - RNA, 22 nt, Homo sapiens
ugggguaggccugguuaugugc

SEQ ID NO: 289804 - RNA, 22 nt, Homo sapiens
ugggguaggcuguauacucugu

SEQ ID NO: 289805 - RNA, 22 nt, Homo sapiens
uggguagagaaucaggaucuua

SEQ ID NO: 289806 - RNA, 22 nt, Homo sapiens
uggguaggcccucauuggacag

SEQ ID NO: 289807 - RNA, 22 nt, Homo sapiens
uggguagugucagcugauccau

SEQ ID NO: 289808 - RNA, 22 nt, Homo sapiens
uggguccccuacucuuuccaca

SEQ ID NO: 289809 - RNA, 22 nt, Homo sapiens
ugggugugaccgcucaaggggg

SEQ ID NO: 289810 - RNA, 22 nt, Homo sapiens
uggguucccugucuguccuuga

SEQ ID NO: 289811 - RNA, 22 nt, Homo sapiens
ugguaagaaaaccauuauuagc

SEQ ID NO: 289812 - RNA, 22 nt, Homo sapiens
ugguaagaggcccugaguuugu

SEQ ID NO: 289813 - RNA, 22 nt, Homo sapiens
ugguaauguaauuuggagaagg

SEQ ID NO: 289814 - RNA, 22 nt, Homo sapiens
ugguacugucucuauuuuguag

SEQ ID NO: 289815 - RNA, 22 nt, Homo sapiens
ugguauguguucuaaaauuaug

SEQ ID NO: 289816 - RNA, 22 nt, Homo sapiens
ugguauguuuauaaguauagga

SEQ ID NO: 289817 - RNA, 19 nt, Homo sapiens
uugaaggccgccuugcaga

SEQ ID NO: 289818 - RNA, 22 nt, Homo sapiens
uugaaguagaaagacgaaauuu

SEQ ID NO: 289819 - RNA, 22 nt, Homo sapiens
uugaaguagguaccguucaauu

SEQ ID NO: 289820 - RNA, 22 nt, Homo sapiens
uugaagugaagaacaauaucac

SEQ ID NO: 289821 - RNA, 22 nt, Homo sapiens
uugaauagaaguguugaaagug

SEQ ID NO: 289822 - RNA, 22 nt, Homo sapiens
uugaauaggcucaugcuuauca

SEQ ID NO: 289823 - RNA, 22 nt, Homo sapiens
uugaauaguggugaaaguuuga

SEQ ID NO: 289824 - RNA, 18 nt, Homo sapiens
uugaauaguguccaaucu

SEQ ID NO: 289825 - RNA, 22 nt, Homo sapiens
uugaaugaaaugaugucauuug

SEQ ID NO: 289826 - RNA, 22 nt, Homo sapiens
uugaauguacuuguucucacua

SEQ ID NO: 289827 - RNA, 22 nt, Homo sapiens
uugaauguguugggaagcccuu

SEQ ID NO: 289828 - RNA, 23 nt, Homo sapiens
uugaauguuuccccucccaaauu

SEQ ID NO: 289829 - RNA, 22 nt, Homo sapiens
uugacaaggagccauugcaucu

SEQ ID NO: 289830 - RNA, 22 nt, Homo sapiens
uugacagagaaaagugugacuu

SEQ ID NO: 289831 - RNA, 22 nt, Homo sapiens
uugacaggaugcucagggccca

SEQ ID NO: 289832 - RNA, 20 nt, Homo sapiens
uugacaguggguuguuaaag

SEQ ID NO: 289833 - RNA, 22 nt, Homo sapiens
uugacauguaaguacucuauag

SEQ ID NO: 289834 - RNA, 22 nt, Homo sapiens
uugacauugcuguaguguccag

SEQ ID NO: 289835 - RNA, 22 nt, Homo sapiens
uugaccacugggcacaguaagu

SEQ ID NO: 289836 - RNA, 22 nt, Homo sapiens
uugagagcugaugaaagauaaa

SEQ ID NO: 289837 - RNA, 22 nt, Homo sapiens
uugagaguggaggcuauaucuu

SEQ ID NO: 289838 - RNA, 22 nt, Homo sapiens
uugagauagggucuaccucugu

SEQ ID NO: 289839 - RNA, 22 nt, Homo sapiens
uugagauggagcuucacucuug

SEQ ID NO: 289840 - RNA, 22 nt, Homo sapiens
uugagauggagucucacucugu

SEQ ID NO: 289841 - RNA, 22 nt, Homo sapiens
uugagauggagucucacucuuc

SEQ ID NO: 289842 - RNA, 22 nt, Homo sapiens
uugagauggagucucacucuuu

SEQ ID NO: 289843 - RNA, 22 nt, Homo sapiens
uugagauggagucucguucugu

SEQ ID NO: 289844 - RNA, 22 nt, Homo sapiens
uugagauggagucuugcgcugu

SEQ ID NO: 289845 - RNA, 22 nt, Homo sapiens
uugagauggagucuugcucuug

SEQ ID NO: 289846 - RNA, 22 nt, Homo sapiens
uugagauggagucuuguucuuu

SEQ ID NO: 289847 - RNA, 22 nt, Homo sapiens
uugagauggaguuucacucuug

SEQ ID NO: 289848 - RNA, 22 nt, Homo sapiens
uugagauguaagauguuaauau

SEQ ID NO: 289849 - RNA, 21 nt, Homo sapiens
uugagcaacuaggguuauagg

SEQ ID NO: 289850 - RNA, 22 nt, Homo sapiens
uugagcaauccuccugccaugu

SEQ ID NO: 289851 - RNA, 22 nt, Homo sapiens
uugagcaccaugccuggccaug

SEQ ID NO: 289852 - RNA, 22 nt, Homo sapiens
uugagcacugucugugugcagu

SEQ ID NO: 289853 - RNA, 22 nt, Homo sapiens
uugagcucuuccagccuggagc

SEQ ID NO: 289854 - RNA, 21 nt, Homo sapiens
uugagcuuuuaguacagacag

SEQ ID NO: 289855 - RNA, 22 nt, Homo sapiens
uugagcuuuuuacuuguccaau

SEQ ID NO: 289856 - RNA, 22 nt, Homo sapiens
uugaggaaugucauuuguguuu

SEQ ID NO: 289857 - RNA, 22 nt, Homo sapiens
uugaggaguacugauuagguau

SEQ ID NO: 289858 - RNA, 22 nt, Homo sapiens
uugaggcuuuugaccucaugug

SEQ ID NO: 289859 - RNA, 22 nt, Homo sapiens
uugaggucuuugagcaaacgca

SEQ ID NO: 289860 - RNA, 22 nt, Homo sapiens
uugaggugaagggcagagcagc

SEQ ID NO: 289861 - RNA, 22 nt, Homo sapiens
uugaguaguaagaagaugauag

SEQ ID NO: 289862 - RNA, 22 nt, Homo sapiens
uugaguccccacacuggguccc

SEQ ID NO: 289863 - RNA, 21 nt, Homo sapiens
uugaguugaagcaaggaggga

SEQ ID NO: 289864 - RNA, 22 nt, Homo sapiens
uugaguuuaucuaaagaccugg

SEQ ID NO: 289865 - RNA, 22 nt, Homo sapiens
uugauagguuuuauguauaguu

SEQ ID NO: 289866 - RNA, 22 nt, Homo sapiens
uugauaguccuguaucuauuuu

SEQ ID NO: 289867 - RNA, 22 nt, Homo sapiens
uugauaugaauggcuguuugug

SEQ ID NO: 289868 - RNA, 22 nt, Homo sapiens
uugauaugacuaucuuuuaugu

SEQ ID NO: 289869 - RNA, 22 nt, Homo sapiens
uugauauguguauagcaugugg

SEQ ID NO: 289870 - RNA, 22 nt, Homo sapiens
uugauauuaaguacugaagugg

SEQ ID NO: 289871 - RNA, 22 nt, Homo sapiens
uugauauucugagaagcugaag

SEQ ID NO: 289872 - RNA, 22 nt, Homo sapiens
uugauauucuuucuggauccca

SEQ ID NO: 289873 - RNA, 22 nt, Homo sapiens
uugaucaauagaauacaacaga

SEQ ID NO: 289874 - RNA, 20 nt, Homo sapiens
uugauucccucuaaacucgc

SEQ ID NO: 289875 - RNA, 22 nt, Homo sapiens
uugcaaacaucuuguuucacau

SEQ ID NO: 289876 - RNA, 22 nt, Homo sapiens
uugcaagaaaugcagauucuca

SEQ ID NO: 289877 - RNA, 22 nt, Homo sapiens
uugcaagauguuaacauuggag

SEQ ID NO: 289878 - RNA, 22 nt, Homo sapiens
uugcaaggugcagcuuaugcaa

SEQ ID NO: 289879 - RNA, 22 nt, Homo sapiens
uugcacaauggaauuuaucuuu

SEQ ID NO: 289880 - RNA, 22 nt, Homo sapiens
uugcacagucuagcuccaccuu

SEQ ID NO: 289881 - RNA, 22 nt, Homo sapiens
uugcacauggcaggugcucaau

SEQ ID NO: 289882 - RNA, 22 nt, Homo sapiens
uugcacauuuuuucuggcagaa

SEQ ID NO: 289883 - RNA, 22 nt, Homo sapiens
uugcaccccuacuauuugccaa

SEQ ID NO: 289884 - RNA, 18 nt, Homo sapiens
uugcacuccugccugggu

SEQ ID NO: 289885 - RNA, 22 nt, Homo sapiens
uugcagcaacauggaugaaacu

SEQ ID NO: 289886 - RNA, 22 nt, Homo sapiens
uugcagcauucugguuccuggu

SEQ ID NO: 289887 - RNA, 22 nt, Homo sapiens
uugcaggugguuuaugcaagac

SEQ ID NO: 289888 - RNA, 22 nt, Homo sapiens
uugcaguagucugaaagcaaua

SEQ ID NO: 289889 - RNA, 22 nt, Homo sapiens
uugcagugguuucacuggcaaa

SEQ ID NO: 289890 - RNA, 22 nt, Homo sapiens
uugcauauguugaaccaagcgu

SEQ ID NO: 289891 - RNA, 22 nt, Homo sapiens
uugcauauucucugaggcagga

SEQ ID NO: 289892 - RNA, 22 nt, Homo sapiens
uugccauggaguagaauugaag

SEQ ID NO: 289893 - RNA, 22 nt, Homo sapiens
uugccuaggcuggagugcagua

SEQ ID NO: 289894 - RNA, 22 nt, Homo sapiens
uugccuaggcuggaguucagug

SEQ ID NO: 289895 - RNA, 22 nt, Homo sapiens
uugccuaggcuggauugcagug

SEQ ID NO: 289896 - RNA, 22 nt, Homo sapiens
uugccuuuguuggaaacaagug

SEQ ID NO: 289897 - RNA, 22 nt, Homo sapiens
uugcgcuuuuccuauguugccc

SEQ ID NO: 289898 - RNA, 22 nt, Homo sapiens
uugcuauguugcccagucugga

SEQ ID NO: 289899 - RNA, 22 nt, Homo sapiens
gcagguauuagagagccugaaa

SEQ ID NO: 289900 - RNA, 22 nt, Homo sapiens
gcagguguuaugcaaacaacug

SEQ ID NO: 289901 - RNA, 22 nt, Homo sapiens
gcagugcaguggcgcgaucucg

SEQ ID NO: 289902 - RNA, 22 nt, Homo sapiens
gcagugcaugacgguauauaua

SEQ ID NO: 289903 - RNA, 22 nt, Homo sapiens
gcaguguucaaaucaugcccau

SEQ ID NO: 289904 - RNA, 22 nt, Homo sapiens
gcaguguucugggcaggaagaa

SEQ ID NO: 289905 - RNA, 22 nt, Homo sapiens
gcaguucuguaguugaaauuua

SEQ ID NO: 289906 - RNA, 17 nt, Homo sapiens
gcauaugucgaaccagc

SEQ ID NO: 289907 - RNA, 17 nt, Homo sapiens
gcauauguugaaccagc

SEQ ID NO: 289908 - RNA, 17 nt, Homo sapiens
gcauauguugaaccagu

SEQ ID NO: 289909 - RNA, 19 nt, Homo sapiens
gcaucauuaguugcuuuuc

SEQ ID NO: 289910 - RNA, 22 nt, Homo sapiens
gcauggccuuuaaaugucacag

SEQ ID NO: 289911 - RNA, 20 nt, Homo sapiens
gccacaguuaagcuucugcc

SEQ ID NO: 289912 - RNA, 22 nt, Homo sapiens
gccagugugaugugaucauggc

SEQ ID NO: 289913 - RNA, 22 nt, Homo sapiens
gccaguguguguuguucuccgc

SEQ ID NO: 289914 - RNA, 22 nt, Homo sapiens
gccauugcacuccgcccugggc

SEQ ID NO: 289915 - RNA, 22 nt, Homo sapiens
gcccagauguuuggggucaugg

SEQ ID NO: 289916 - RNA, 22 nt, Homo sapiens
gcccuguugcccaggcuggagu

SEQ ID NO: 289917 - RNA, 22 nt, Homo sapiens
gccgagagauuuggaaugggga

SEQ ID NO: 289918 - RNA, 22 nt, Homo sapiens
gccuagagaguuaucaggcugu

SEQ ID NO: 289919 - RNA, 22 nt, Homo sapiens
gccuuuggugacaggcaugugu

SEQ ID NO: 289920 - RNA, 19 nt, Homo sapiens
gcggcacuggagacacagc

SEQ ID NO: 289921 - RNA, 23 nt, Homo sapiens
gcuaggagagaugaaacacaggu

SEQ ID NO: 289922 - RNA, 22 nt, Homo sapiens
gcuaggagaucugcugcucucu

SEQ ID NO: 289923 - RNA, 19 nt, Homo sapiens
gcucaccuugcugcuccag

SEQ ID NO: 289924 - RNA, 22 nt, Homo sapiens
gcucaugagacaagcaggagua

SEQ ID NO: 289925 - RNA, 22 nt, Homo sapiens
gcuccauuuuccauuucucuaa

SEQ ID NO: 289926 - RNA, 22 nt, Homo sapiens
gcucguuuuugccucugguugc

SEQ ID NO: 289927 - RNA, 22 nt, Homo sapiens
gcucuuuugggguaauucugag

SEQ ID NO: 289928 - RNA, 22 nt, Homo sapiens
gcugacacugggcuauagaucu

SEQ ID NO: 289929 - RNA, 22 nt, Homo sapiens
gcugagacauugguuuucuccu

SEQ ID NO: 289930 - RNA, 22 nt, Homo sapiens
gcugcuguuucucuuucagcau

SEQ ID NO: 289931 - RNA, 22 nt, Homo sapiens
gcuggcaagaugcugaugcaac

SEQ ID NO: 289932 - RNA, 22 nt, Homo sapiens
gcuggcuuucuccugaucucag

SEQ ID NO: 289933 - RNA, 21 nt, Homo sapiens
gcugguaaucacuuugccaaa

SEQ ID NO: 289934 - RNA, 22 nt, Homo sapiens
gcuggugaaggcugaaaagugg

SEQ ID NO: 289935 - RNA, 22 nt, Homo sapiens
gcuguugguaaaaaggacauga

SEQ ID NO: 289936 - RNA, 18 nt, Homo sapiens
gcuguugucagagcacau

SEQ ID NO: 289937 - RNA, 22 nt, Homo sapiens
gcuguugugaacuauacaucua

SEQ ID NO: 289938 - RNA, 19 nt, Homo sapiens
gcuucuugaggacgaugac

SEQ ID NO: 289939 - RNA, 22 nt, Homo sapiens
gcuugguccccacccaaaucgc

SEQ ID NO: 289940 - RNA, 22 nt, Homo sapiens
gcuuugcaauggcauugaccau

SEQ ID NO: 289941 - RNA, 22 nt, Homo sapiens
gcuuuggauaaaugucaguuua

SEQ ID NO: 289942 - RNA, 19 nt, Homo sapiens
gcuuuguggggaaggagcc

SEQ ID NO: 289943 - RNA, 22 nt, Homo sapiens
ggaaagacuauuguaaaggaug

SEQ ID NO: 289944 - RNA, 22 nt, Homo sapiens
ggaaagaucagcuaaauguaag

SEQ ID NO: 289945 - RNA, 22 nt, Homo sapiens
ggaaaguccuucuguaggcucc

SEQ ID NO: 289946 - RNA, 22 nt, Homo sapiens
ggaagagugaauuaucuugacu

SEQ ID NO: 289947 - RNA, 18 nt, Homo sapiens
ggaagauuggcuaugugc

SEQ ID NO: 289948 - RNA, 17 nt, Homo sapiens
ggaagccuuugguuuaa

SEQ ID NO: 289949 - RNA, 22 nt, Homo sapiens
ggaagguaauugucagcucaua

SEQ ID NO: 289950 - RNA, 22 nt, Homo sapiens
ggaaggucaaagggaaagcaga

SEQ ID NO: 289951 - RNA, 22 nt, Homo sapiens
ggaagugcuguguggaagucug

SEQ ID NO: 289952 - RNA, 17 nt, Homo sapiens
ggaaugaauuccagccc

SEQ ID NO: 289953 - RNA, 22 nt, Homo sapiens
ggaaugcagugagcauuagaua

SEQ ID NO: 289954 - RNA, 19 nt, Homo sapiens
ggaaugcuauucaaccuuu

SEQ ID NO: 289955 - RNA, 22 nt, Homo sapiens
ggaauggaacaaagucuugaaa

SEQ ID NO: 289956 - RNA, 22 nt, Homo sapiens
ggaauguuaaagacuacacuga

SEQ ID NO: 289957 - RNA, 21 nt, Homo sapiens
ggaauuuagggaaugauuuag

SEQ ID NO: 289958 - RNA, 22 nt, Homo sapiens
ggacaagagacugggacacuga

SEQ ID NO: 289959 - RNA, 22 nt, Homo sapiens
ggacagaaaggguucaccaaac

SEQ ID NO: 289960 - RNA, 22 nt, Homo sapiens
ggacagugaaugccacuccucc

SEQ ID NO: 289961 - RNA, 22 nt, Homo sapiens
ggacuguaauaccaugaggaca

SEQ ID NO: 289962 - RNA, 19 nt, Homo sapiens
ggacugucauggaguaguu

SEQ ID NO: 289963 - RNA, 22 nt, Homo sapiens
ggagaucauuuccuauuugaag

SEQ ID NO: 289964 - RNA, 22 nt, Homo sapiens
ggagaucuuguuaaaguacaga

SEQ ID NO: 289965 - RNA, 22 nt, Homo sapiens
ggagaugauuaugaaucacuua

SEQ ID NO: 289966 - RNA, 22 nt, Homo sapiens
ggagcucaucuagcauagaggu

SEQ ID NO: 289967 - RNA, 22 nt, Homo sapiens
ggagcugugauuugaguccaga

SEQ ID NO: 289968 - RNA, 22 nt, Homo sapiens
ggaggcuaguaaaaagguagaa

SEQ ID NO: 289969 - RNA, 22 nt, Homo sapiens
ggagggugagaucaauuuggga

SEQ ID NO: 289970 - RNA, 22 nt, Homo sapiens
ggagguaauaaguuccagugua

SEQ ID NO: 289971 - RNA, 16 nt, Homo sapiens
ggaggucaucugggaa

SEQ ID NO: 289972 - RNA, 22 nt, Homo sapiens
ggaguaggaaggaaauguuaaa

SEQ ID NO: 289973 - RNA, 22 nt, Homo sapiens
ggagucugauguucuaaggcag

SEQ ID NO: 289974 - RNA, 22 nt, Homo sapiens
ggagugugauucaguauaauau

SEQ ID NO: 289975 - RNA, 22 nt, Homo sapiens
ggaguguguaggagaaagguaa

SEQ ID NO: 289976 - RNA, 22 nt, Homo sapiens
ggauaacagccaggucaaacaa

SEQ ID NO: 289977 - RNA, 22 nt, Homo sapiens
ggauacauuuuuccuccucuuc

SEQ ID NO: 289978 - RNA, 22 nt, Homo sapiens
ggaucgauuccaaauguagauc

SEQ ID NO: 289979 - RNA, 22 nt, Homo sapiens
ggauggcauuucuuuagcuuuu

SEQ ID NO: 289980 - RNA, 22 nt, Homo sapiens
ggcaacauggugaaacucuguc

SEQ ID NO: 289981 - RNA, 22 nt, Homo sapiens
uggucaccugaauuaugcaugu

SEQ ID NO: 289982 - RNA, 22 nt, Homo sapiens
uggucagaaaauuacuugauau

SEQ ID NO: 289983 - RNA, 22 nt, Homo sapiens
ugguccacuaacccucaguauc

SEQ ID NO: 289984 - RNA, 19 nt, Homo sapiens
uggucccccgcaaucucau

SEQ ID NO: 289985 - RNA, 21 nt, Homo sapiens
uggucccuucagaucggauuu

SEQ ID NO: 289986 - RNA, 22 nt, Homo sapiens
ugguccucugcuuccagaauuc

SEQ ID NO: 289987 - RNA, 22 nt, Homo sapiens
uggucuuuucaacaaaugguau

SEQ ID NO: 289988 - RNA, 22 nt, Homo sapiens
uggugcaaauguaauugugguu

SEQ ID NO: 289989 - RNA, 22 nt, Homo sapiens
uggugccgugguccuggggcca

SEQ ID NO: 289990 - RNA, 22 nt, Homo sapiens
ugguucaguugcacaggcuguu

SEQ ID NO: 289991 - RNA, 22 nt, Homo sapiens
ugguuguuuuaaaugucgucug

SEQ ID NO: 289992 - RNA, 22 nt, Homo sapiens
uguaaacucaguauguuuuacu

SEQ ID NO: 289993 - RNA, 22 nt, Homo sapiens
uguaaagaaagcuguuguugua

SEQ ID NO: 289994 - RNA, 20 nt, Homo sapiens
uguaacaaucuggauguugc

SEQ ID NO: 289995 - RNA, 20 nt, Homo sapiens
uguaacacauggagaacucu

SEQ ID NO: 289996 - RNA, 22 nt, Homo sapiens
uguaacaggaggaaaaugugaa

SEQ ID NO: 289997 - RNA, 21 nt, Homo sapiens
uguaacugcaaaccucagauu

SEQ ID NO: 289998 - RNA, 22 nt, Homo sapiens
uguaagcauugggcaugcaguc

SEQ ID NO: 289999 - RNA, 22 nt, Homo sapiens
uguaauaguaggcucacauuug

SEQ ID NO: 290000 - RNA, 20 nt, Homo sapiens
uguaaucuaaguuuuaagcc

SEQ ID NO: 290001 - RNA, 22 nt, Homo sapiens
uguaaugaucaaaucagaguaa

SEQ ID NO: 290002 - RNA, 22 nt, Homo sapiens
uguacaaauuucugugguggug

SEQ ID NO: 290003 - RNA, 22 nt, Homo sapiens
uguacuucaagauuaugguuua

SEQ ID NO: 290004 - RNA, 22 nt, Homo sapiens
uguagacaccaaagacagcaua

SEQ ID NO: 290005 - RNA, 22 nt, Homo sapiens
uguagcacauuugaagagaagc

SEQ ID NO: 290006 - RNA, 22 nt, Homo sapiens
uguagggagagggaguugcacc

SEQ ID NO: 290007 - RNA, 20 nt, Homo sapiens
uguagguguacaguaaggag

SEQ ID NO: 290008 - RNA, 22 nt, Homo sapiens
uguaguuugaaagcucccucug

SEQ ID NO: 290009 - RNA, 23 nt, Homo sapiens
uguauacacccugugcaucuggg

SEQ ID NO: 290010 - RNA, 22 nt, Homo sapiens
ugucaacauuuaucaaguuauu

SEQ ID NO: 290011 - RNA, 22 nt, Homo sapiens
ugucaagaaaucaaggugugag

SEQ ID NO: 290012 - RNA, 22 nt, Homo sapiens
ugucaauauguaauaacugaau

SEQ ID NO: 290013 - RNA, 22 nt, Homo sapiens
ugucacagagauuuugguaugu

SEQ ID NO: 290014 - RNA, 18 nt, Homo sapiens
ugucagaguggauuguaa

SEQ ID NO: 290015 - RNA, 22 nt, Homo sapiens
ugucagcacaacucagguuccu

SEQ ID NO: 290016 - RNA, 22 nt, Homo sapiens
ugucaggagcaaugauaaauuu

SEQ ID NO: 290017 - RNA, 22 nt, Homo sapiens
ugucaguggucuggaugcagcc

SEQ ID NO: 290018 - RNA, 21 nt, Homo sapiens
ugucaguuuccagaguucaac

SEQ ID NO: 290019 - RNA, 22 nt, Homo sapiens
ugucaguuucuugagauggaac

SEQ ID NO: 290020 - RNA, 22 nt, Homo sapiens
ugucaguuuuaacuagggaaua

SEQ ID NO: 290021 - RNA, 22 nt, Homo sapiens
ugucauauagaauguucuauga

SEQ ID NO: 290022 - RNA, 22 nt, Homo sapiens
ugucaugagucuccuccaucuu

SEQ ID NO: 290023 - RNA, 22 nt, Homo sapiens
ugucaugguguuaauuuuccug

SEQ ID NO: 290024 - RNA, 22 nt, Homo sapiens
ugucauguaaagaguaaauggu

SEQ ID NO: 290025 - RNA, 22 nt, Homo sapiens
ugucauucaggaaauucuaagu

SEQ ID NO: 290026 - RNA, 22 nt, Homo sapiens
uguccaaaucagagguaccaaa

SEQ ID NO: 290027 - RNA, 19 nt, Homo sapiens
ugucccagccauagaggca

SEQ ID NO: 290028 - RNA, 22 nt, Homo sapiens
uguccuggugaugcccaaauuc

SEQ ID NO: 290029 - RNA, 22 nt, Homo sapiens
ugucuagaucugaauguaauug

SEQ ID NO: 290030 - RNA, 22 nt, Homo sapiens
ugucucccuucccauuaggaag

SEQ ID NO: 290031 - RNA, 22 nt, Homo sapiens
ugucugagacuguuuuacuuuc

SEQ ID NO: 290032 - RNA, 22 nt, Homo sapiens
ugucuggaaggguggccuccug

SEQ ID NO: 290033 - RNA, 22 nt, Homo sapiens
ugucuggaguccauagaagugu

SEQ ID NO: 290034 - RNA, 22 nt, Homo sapiens
ugugaaaucagauagccuuuuu

SEQ ID NO: 290035 - RNA, 22 nt, Homo sapiens
ugugaacaaaauuuguugcaua

SEQ ID NO: 290036 - RNA, 22 nt, Homo sapiens
ugugaagaaagucauugguagc

SEQ ID NO: 290037 - RNA, 22 nt, Homo sapiens
ugugaagauguuucuuaauuga

SEQ ID NO: 290038 - RNA, 22 nt, Homo sapiens
ugugacaaauuuaguggacugu

SEQ ID NO: 290039 - RNA, 22 nt, Homo sapiens
ugugacagguauccuguguucu

SEQ ID NO: 290040 - RNA, 22 nt, Homo sapiens
ugugacaguuaguuugguguua

SEQ ID NO: 290041 - RNA, 22 nt, Homo sapiens
ugugacuaguggugaaugacgc

SEQ ID NO: 290042 - RNA, 19 nt, Homo sapiens
ugugacugggccagccuag

SEQ ID NO: 290043 - RNA, 22 nt, Homo sapiens
ugugagaucucagaauugaacu

SEQ ID NO: 290044 - RNA, 19 nt, Homo sapiens
ugugauaguugaaccugcc

SEQ ID NO: 290045 - RNA, 22 nt, Homo sapiens
ugugaucaugguauuaaucugc

SEQ ID NO: 290046 - RNA, 22 nt, Homo sapiens
ugugaucauuucaggaauuuug

SEQ ID NO: 290047 - RNA, 22 nt, Homo sapiens
ugugaugaagaguccaagaaca

SEQ ID NO: 290048 - RNA, 22 nt, Homo sapiens
ugugaugaaggcauagggaugu

SEQ ID NO: 290049 - RNA, 22 nt, Homo sapiens
ugugaugugaugagaaguuccu

SEQ ID NO: 290050 - RNA, 22 nt, Homo sapiens
ugugcaaaaacaauugcgguuu

SEQ ID NO: 290051 - RNA, 22 nt, Homo sapiens
ugugcacaacaugcagguuugu

SEQ ID NO: 290052 - RNA, 22 nt, Homo sapiens
ugugcacaaccugcagguuugu

SEQ ID NO: 290053 - RNA, 22 nt, Homo sapiens
ugugcacuggaccuugucuucu

SEQ ID NO: 290054 - RNA, 22 nt, Homo sapiens
ugugccaaucauagggcuuggu

SEQ ID NO: 290055 - RNA, 22 nt, Homo sapiens
ugugccacuccaaccuggguga

SEQ ID NO: 290056 - RNA, 22 nt, Homo sapiens
ugugccuucuaagaaggagucu

SEQ ID NO: 290057 - RNA, 22 nt, Homo sapiens
ugugcgcaucggggccugcuuc

SEQ ID NO: 290058 - RNA, 22 nt, Homo sapiens
ugugcuugcuucuucuccuagu

SEQ ID NO: 290059 - RNA, 22 nt, Homo sapiens
uguggcaaauggucaggaagaa

SEQ ID NO: 290060 - RNA, 22 nt, Homo sapiens
uguggcugguggcaccuuuucc

SEQ ID NO: 290061 - RNA, 22 nt, Homo sapiens
uguggcuuuuucuuggcugagg

SEQ ID NO: 290062 - RNA, 23 nt, Homo sapiens
ugugguauuauuccauuuauagg

SEQ ID NO: 290063 - RNA, 22 nt, Homo sapiens
ugagaggugaauggcaggcuca

SEQ ID NO: 290064 - RNA, 22 nt, Homo sapiens
ugagagucauacaaauaaaaau

SEQ ID NO: 290065 - RNA, 22 nt, Homo sapiens
ugagauaaagcauguacugugu

SEQ ID NO: 290066 - RNA, 22 nt, Homo sapiens
ugagauaaucaugugauuucau

SEQ ID NO: 290067 - RNA, 22 nt, Homo sapiens
ugagauaauuuacuuguugagg

SEQ ID NO: 290068 - RNA, 22 nt, Homo sapiens
ugagauagggucucacucuguc

SEQ ID NO: 290069 - RNA, 22 nt, Homo sapiens
ugagaucaacugagucagagca

SEQ ID NO: 290070 - RNA, 22 nt, Homo sapiens
ugagaucaaggugggcccuggg

SEQ ID NO: 290071 - RNA, 20 nt, Homo sapiens
ugagaucaggauuaaggcua

SEQ ID NO: 290072 - RNA, 22 nt, Homo sapiens
ugagaucagugaagaaguguuu

SEQ ID NO: 290073 - RNA, 22 nt, Homo sapiens
uaucacuuugauaguuuaaaug

SEQ ID NO: 290074 - RNA, 22 nt, Homo sapiens
uaucagaguuacacugaagacu

SEQ ID NO: 290075 - RNA, 22 nt, Homo sapiens
uaucauagacaaucaguuauug

SEQ ID NO: 290076 - RNA, 22 nt, Homo sapiens
uaucauuguguuauuucuucca

SEQ ID NO: 290077 - RNA, 22 nt, Homo sapiens
uaucccaauguaauaucacaaa

SEQ ID NO: 290078 - RNA, 22 nt, Homo sapiens
uaucccuguggacuucccaaca

SEQ ID NO: 290079 - RNA, 22 nt, Homo sapiens
uauccugaagcuuuauuuaagu

SEQ ID NO: 290080 - RNA, 22 nt, Homo sapiens
uaucucuguggguagugcugaa

SEQ ID NO: 290081 - RNA, 22 nt, Homo sapiens
uaucuuggaguuugacaaccaa

SEQ ID NO: 290082 - RNA, 22 nt, Homo sapiens
uaugaauuuuauccaggauaua

SEQ ID NO: 290083 - RNA, 20 nt, Homo sapiens
uaugacacugucauaaaaau

SEQ ID NO: 290084 - RNA, 23 nt, Homo sapiens
uaugacagaggaagggggagcug

SEQ ID NO: 290085 - RNA, 22 nt, Homo sapiens
uaugacauaguccuuaacccuc

SEQ ID NO: 290086 - RNA, 22 nt, Homo sapiens
uaugaccuuggacaaguuacuu

SEQ ID NO: 290087 - RNA, 22 nt, Homo sapiens
uaugaccuuguccccucucgcc

SEQ ID NO: 290088 - RNA, 22 nt, Homo sapiens
uaugagcacauauguaucuaug

SEQ ID NO: 290089 - RNA, 22 nt, Homo sapiens
uaugaucacuacagcagggaug

SEQ ID NO: 290090 - RNA, 22 nt, Homo sapiens
uaugaugcugagguuuggagug

SEQ ID NO: 290091 - RNA, 22 nt, Homo sapiens
uaugauuuuugggagaggucaa

SEQ ID NO: 290092 - RNA, 22 nt, Homo sapiens
uauggaaaucuuaccuuauggu

SEQ ID NO: 290093 - RNA, 22 nt, Homo sapiens
uauggauuucauuagacuugag

SEQ ID NO: 290094 - RNA, 22 nt, Homo sapiens
uauggcacuaguacuggaaagc

SEQ ID NO: 290095 - RNA, 22 nt, Homo sapiens
uauggcccuuaaguauugguug

SEQ ID NO: 290096 - RNA, 22 nt, Homo sapiens
uauggcuuuguuaacauuuucu

SEQ ID NO: 290097 - RNA, 22 nt, Homo sapiens
uaugggcuuuguuuuguacuag

SEQ ID NO: 290098 - RNA, 22 nt, Homo sapiens
uaugucacuugguuuggugcua

SEQ ID NO: 290099 - RNA, 22 nt, Homo sapiens
uaugucaugggguuuuugagau

SEQ ID NO: 290100 - RNA, 22 nt, Homo sapiens
uaugucuggaguuacugagcug

SEQ ID NO: 290101 - RNA, 22 nt, Homo sapiens
uauuacagaccauaucgccggg

SEQ ID NO: 290102 - RNA, 22 nt, Homo sapiens
uauuacauccauaggcucugcu

SEQ ID NO: 290103 - RNA, 22 nt, Homo sapiens
uauuaguuuucuguggauuaca

SEQ ID NO: 290104 - RNA, 22 nt, Homo sapiens
uauucaagccaaauucaagcca

SEQ ID NO: 290105 - RNA, 22 nt, Homo sapiens
uauuccauuugggucaggauga

SEQ ID NO: 290106 - RNA, 22 nt, Homo sapiens
uauugaacuggaucagaaggcc

SEQ ID NO: 290107 - RNA, 22 nt, Homo sapiens
uauugacuugagaagggauuag

SEQ ID NO: 290108 - RNA, 22 nt, Homo sapiens
uauugauuaauugugauuaggc

SEQ ID NO: 290109 - RNA, 22 nt, Homo sapiens
uauugauuuucaguguucagcu

SEQ ID NO: 290110 - RNA, 22 nt, Homo sapiens
uauugcaaauggugaucccagg

SEQ ID NO: 290111 - RNA, 22 nt, Homo sapiens
uauugcaacagaagaaagaguc

SEQ ID NO: 290112 - RNA, 22 nt, Homo sapiens
uauugcaauuggcagagugcua

SEQ ID NO: 290113 - RNA, 22 nt, Homo sapiens
uauugcacuccucaugcauuug

SEQ ID NO: 290114 - RNA, 22 nt, Homo sapiens
uauugcauauuauucuaguggc

SEQ ID NO: 290115 - RNA, 22 nt, Homo sapiens
uauugcuaaauucuuuuccuag

SEQ ID NO: 290116 - RNA, 22 nt, Homo sapiens
uauugcugaaaaugcuaaugau

SEQ ID NO: 290117 - RNA, 22 nt, Homo sapiens
uauuguacauguuauagauuuu

SEQ ID NO: 290118 - RNA, 22 nt, Homo sapiens
uauugucacuaaaggaagcugg

SEQ ID NO: 290119 - RNA, 22 nt, Homo sapiens
uauuucccuuaacuuuccugca

SEQ ID NO: 290120 - RNA, 22 nt, Homo sapiens
ucaaaaucucuuagcugugucu

SEQ ID NO: 290121 - RNA, 22 nt, Homo sapiens
ucaaacugcuugaggccauuua

SEQ ID NO: 290122 - RNA, 22 nt, Homo sapiens
ucaaaguauucuucugagaacc

SEQ ID NO: 290123 - RNA, 22 nt, Homo sapiens
ucaaagugacaaaguugcagca

SEQ ID NO: 290124 - RNA, 22 nt, Homo sapiens
ucaaagugcuauggcucagguu

SEQ ID NO: 290125 - RNA, 21 nt, Homo sapiens
ucaaaguguucuuuuguugaa

SEQ ID NO: 290126 - RNA, 17 nt, Homo sapiens
ucaaaugcucccaguga

SEQ ID NO: 290127 - RNA, 22 nt, Homo sapiens
ucaaaugcucuuugcagagagg

SEQ ID NO: 290128 - RNA, 22 nt, Homo sapiens
ucaaaugcuguauuguaguaau

SEQ ID NO: 290129 - RNA, 21 nt, Homo sapiens
ucaaauugaaauuaggucauu

SEQ ID NO: 290130 - RNA, 22 nt, Homo sapiens
ucaacaggucaauugcauagaa

SEQ ID NO: 290131 - RNA, 22 nt, Homo sapiens
ucaacagugauggaaaguuaua

SEQ ID NO: 290132 - RNA, 22 nt, Homo sapiens
ucaacauugcugucaggcaucu

SEQ ID NO: 290133 - RNA, 21 nt, Homo sapiens
ucaacccuugcgucaccaagc

SEQ ID NO: 290134 - RNA, 22 nt, Homo sapiens
ucaacguauuuauauagcagag

SEQ ID NO: 290135 - RNA, 22 nt, Homo sapiens
ucaacugcuugagaucacaaau

SEQ ID NO: 290136 - RNA, 22 nt, Homo sapiens
ucaagcaauucuccugccucag

SEQ ID NO: 290137 - RNA, 19 nt, Homo sapiens
ucaagcuauucuccugccu

SEQ ID NO: 290138 - RNA, 22 nt, Homo sapiens
ucaaggacucagagagggauua

SEQ ID NO: 290139 - RNA, 22 nt, Homo sapiens
ucaaggcacauuugacauuuuc

SEQ ID NO: 290140 - RNA, 22 nt, Homo sapiens
ucaaggcacuagcugagcugca

SEQ ID NO: 290141 - RNA, 22 nt, Homo sapiens
ucaaguaauacucccaucuugg

SEQ ID NO: 290142 - RNA, 22 nt, Homo sapiens
ucaaguacuuugcauagugccg

SEQ ID NO: 290143 - RNA, 22 nt, Homo sapiens
ucaagugauucuugugccuuag

SEQ ID NO: 290144 - RNA, 22 nt, Homo sapiens
ucaagugcauaugcuaacgguu

SEQ ID NO: 290145 - RNA, 22 nt, Homo sapiens
ucaaugcaugugacaaagagua

SEQ ID NO: 290146 - RNA, 22 nt, Homo sapiens
ugagccaaguucacaccauugc

SEQ ID NO: 290147 - RNA, 22 nt, Homo sapiens
ugagccaaugauuugaauagag

SEQ ID NO: 290148 - RNA, 22 nt, Homo sapiens
ugagcccauuguccugguuuau

SEQ ID NO: 290149 - RNA, 20 nt, Homo sapiens
ugagccccuggacucaagcg

SEQ ID NO: 290150 - RNA, 17 nt, Homo sapiens
ugagcuaugauccuguc

SEQ ID NO: 290151 - RNA, 22 nt, Homo sapiens
ugagcugagaucaugcuauugu

SEQ ID NO: 290152 - RNA, 22 nt, Homo sapiens
ugaggaguauguucuguagacc

SEQ ID NO: 290153 - RNA, 22 nt, Homo sapiens
ugaggagugagaaauugguuuc

SEQ ID NO: 290154 - RNA, 17 nt, Homo sapiens
ugagggaugccugguuc

SEQ ID NO: 290155 - RNA, 22 nt, Homo sapiens
ugagguaacagaagcgagcauu

SEQ ID NO: 290156 - RNA, 22 nt, Homo sapiens
ugagguaugugaugucuuuuag

SEQ ID NO: 290157 - RNA, 21 nt, Homo sapiens
ugaggucaugaugcugcuucc

SEQ ID NO: 290158 - RNA, 22 nt, Homo sapiens
ugaggucuuuauuuagugcuca

SEQ ID NO: 290159 - RNA, 22 nt, Homo sapiens
ugaggugagggguuaggugcua

SEQ ID NO: 290160 - RNA, 22 nt, Homo sapiens
ugaggugcagcaauccucaugu

SEQ ID NO: 290161 - RNA, 22 nt, Homo sapiens
ugaguagaacaucaagucauac

SEQ ID NO: 290162 - RNA, 22 nt, Homo sapiens
ugaguagauccaagacuguccu

SEQ ID NO: 290163 - RNA, 22 nt, Homo sapiens
ugaguagcuaagacgauaggca

SEQ ID NO: 290164 - RNA, 21 nt, Homo sapiens
ugaguagcuagaacuaggggc

SEQ ID NO: 290165 - RNA, 22 nt, Homo sapiens
ugaguagucagugggcaggaag

SEQ ID NO: 290166 - RNA, 22 nt, Homo sapiens
ugaguagugccacaauaagcau

SEQ ID NO: 290167 - RNA, 22 nt, Homo sapiens
ugaguauguaggaugugucuua

SEQ ID NO: 290168 - RNA, 22 nt, Homo sapiens
ugaguauguuuagaaguaaagg

SEQ ID NO: 290169 - RNA, 22 nt, Homo sapiens
ugagucaauggaggcucagagc

SEQ ID NO: 290170 - RNA, 22 nt, Homo sapiens
ugagucuguucucacauugcua

SEQ ID NO: 290171 - RNA, 22 nt, Homo sapiens
ugagugaacgcugagaccaaau

SEQ ID NO: 290172 - RNA, 22 nt, Homo sapiens
ugagugaaggggcucuguugug

SEQ ID NO: 290173 - RNA, 22 nt, Homo sapiens
ugagugaaugugaaggcuaggg

SEQ ID NO: 290174 - RNA, 22 nt, Homo sapiens
ugagugccuggagggcagggac

SEQ ID NO: 290175 - RNA, 22 nt, Homo sapiens
ugaguggagaucgcaccauugc

SEQ ID NO: 290176 - RNA, 22 nt, Homo sapiens
ugaguguccaaguaaggugaaa

SEQ ID NO: 290177 - RNA, 22 nt, Homo sapiens
ugagugugaggaagaauuagaa

SEQ ID NO: 290178 - RNA, 22 nt, Homo sapiens
ugaguuagguaauaauaaauau

SEQ ID NO: 290179 - RNA, 22 nt, Homo sapiens
ugaguucaauuguauuuuauua

SEQ ID NO: 290180 - RNA, 18 nt, Homo sapiens
ugaguucauuagacuucc

SEQ ID NO: 290181 - RNA, 22 nt, Homo sapiens
ugaguuccuugugugaccuugc

SEQ ID NO: 290182 - RNA, 22 nt, Homo sapiens
ugaguucuuccaccgggaccag

SEQ ID NO: 290183 - RNA, 22 nt, Homo sapiens
ugaguuguaggggucaccuggc

SEQ ID NO: 290184 - RNA, 23 nt, Homo sapiens
ugauaacagcauaugaagauucu

SEQ ID NO: 290185 - RNA, 22 nt, Homo sapiens
ugauaagugagauagcaaguga

SEQ ID NO: 290186 - RNA, 17 nt, Homo sapiens
ugauaagugugagguga

SEQ ID NO: 290187 - RNA, 22 nt, Homo sapiens
ugauacuggcuucauagaauga

SEQ ID NO: 290188 - RNA, 18 nt, Homo sapiens
ugauaucaucacaauuga

SEQ ID NO: 290189 - RNA, 22 nt, Homo sapiens
ugauaugaaagggaaauaagug

SEQ ID NO: 290190 - RNA, 22 nt, Homo sapiens
ugauaugaaguucaaaccaggu

SEQ ID NO: 290191 - RNA, 22 nt, Homo sapiens
ugauaugcuuugaacucucugg

SEQ ID NO: 290192 - RNA, 22 nt, Homo sapiens
ugauauguaacuacuccuuaua

SEQ ID NO: 290193 - RNA, 22 nt, Homo sapiens
ugauauguggauucagcucaaa

SEQ ID NO: 290194 - RNA, 22 nt, Homo sapiens
ugauauguguaaacaauguaua

SEQ ID NO: 290195 - RNA, 20 nt, Homo sapiens
ugauauuuucugagcaggaa

SEQ ID NO: 290196 - RNA, 22 nt, Homo sapiens
ugaucugucacuuaucacauuu

SEQ ID NO: 290197 - RNA, 22 nt, Homo sapiens
ugaucuuuuuaauguccauggg

SEQ ID NO: 290198 - RNA, 22 nt, Homo sapiens
ugaugacacugauuucuucaau

SEQ ID NO: 290199 - RNA, 22 nt, Homo sapiens
ugaugacauugucacagucuga

SEQ ID NO: 290200 - RNA, 22 nt, Homo sapiens
ugaugacucuguggccccaggc

SEQ ID NO: 290201 - RNA, 22 nt, Homo sapiens
ugaugcugaugccugccagaag

SEQ ID NO: 290202 - RNA, 22 nt, Homo sapiens
ugauggcaauggcauucauuuu

SEQ ID NO: 290203 - RNA, 22 nt, Homo sapiens
ugauggcacagugaguuccagg

SEQ ID NO: 290204 - RNA, 22 nt, Homo sapiens
ugaugguaguucagucaaugua

SEQ ID NO: 290205 - RNA, 22 nt, Homo sapiens
ugaugguuuuaaaaagaggagu

SEQ ID NO: 290206 - RNA, 20 nt, Homo sapiens
ugauguccaggcagagguuu

SEQ ID NO: 290207 - RNA, 22 nt, Homo sapiens
ugauguccaguucauagaaacu

SEQ ID NO: 290208 - RNA, 20 nt, Homo sapiens
ugauuaguccacuuggcucu

SEQ ID NO: 290209 - RNA, 20 nt, Homo sapiens
ugauugaccagagcaguuuu

SEQ ID NO: 290210 - RNA, 18 nt, Homo sapiens
ugauugacuuauuuaggu

SEQ ID NO: 290211 - RNA, 22 nt, Homo sapiens
ugauugcacaccugcacucaag

SEQ ID NO: 290212 - RNA, 22 nt, Homo sapiens
ugauuuguccauguggcacgug

SEQ ID NO: 290213 - RNA, 22 nt, Homo sapiens
ugauuuguuucaggaguuuucu

SEQ ID NO: 290214 - RNA, 18 nt, Homo sapiens
ugcaaacauguguguguu

SEQ ID NO: 290215 - RNA, 22 nt, Homo sapiens
ugcaaacuuccuugggcagcau

SEQ ID NO: 290216 - RNA, 22 nt, Homo sapiens
ugcaaagaaauuuuggugacca

SEQ ID NO: 290217 - RNA, 22 nt, Homo sapiens
ugcaaaucuuguguaguuguga

SEQ ID NO: 290218 - RNA, 22 nt, Homo sapiens
ugcaaaugcugcuauuucucuu

SEQ ID NO: 290219 - RNA, 22 nt, Homo sapiens
ugcaaauguuauuuugguuucu

SEQ ID NO: 290220 - RNA, 22 nt, Homo sapiens
cuuuggccauagcuaaaugauu

SEQ ID NO: 290221 - RNA, 22 nt, Homo sapiens
cuuuggucaaaauaaguaaguu

SEQ ID NO: 290222 - RNA, 18 nt, Homo sapiens
cuuugguccccgcacccu

SEQ ID NO: 290223 - RNA, 23 nt, Homo sapiens
cuuuguacagcuugacuacuggg

SEQ ID NO: 290224 - RNA, 22 nt, Homo sapiens
cuuugugcccuucugcccauca

SEQ ID NO: 290225 - RNA, 22 nt, Homo sapiens
cuuuguguggacauuucaggca

SEQ ID NO: 290226 - RNA, 22 nt, Homo sapiens
cuuuuggugugaagaagcucuu

SEQ ID NO: 290227 - RNA, 22 nt, Homo sapiens
cuuuugugauuccucaguuacu

SEQ ID NO: 290228 - RNA, 22 nt, Homo sapiens
cuuuugugauucuucaguuacu

SEQ ID NO: 290229 - RNA, 22 nt, Homo sapiens
cuuuugugauucuucaguugcu

SEQ ID NO: 290230 - RNA, 22 nt, Homo sapiens
uucacaguguuucucacgguua

SEQ ID NO: 290231 - RNA, 16 nt, Homo sapiens
uucacauggcagcagg

SEQ ID NO: 290232 - RNA, 22 nt, Homo sapiens
uucacugagccagacuaagaca

SEQ ID NO: 290233 - RNA, 22 nt, Homo sapiens
uucacugcacuccagccugagc

SEQ ID NO: 290234 - RNA, 22 nt, Homo sapiens
uucacuguagccucagccucuu

SEQ ID NO: 290235 - RNA, 22 nt, Homo sapiens
uucacugugugacccugggcca

SEQ ID NO: 290236 - RNA, 22 nt, Homo sapiens
uucagagugguaugaagugaug

SEQ ID NO: 290237 - RNA, 22 nt, Homo sapiens
uucagcaaugacagccuauaua

SEQ ID NO: 290238 - RNA, 22 nt, Homo sapiens
uucagcacaguguggaucauuc

SEQ ID NO: 290239 - RNA, 19 nt, Homo sapiens
uucagcagugucugcucuu

SEQ ID NO: 290240 - RNA, 22 nt, Homo sapiens
uucaggcuccgugccagcuccg

SEQ ID NO: 290241 - RNA, 22 nt, Homo sapiens
uucagggacuuuagacaagaga

SEQ ID NO: 290242 - RNA, 18 nt, Homo sapiens
uucagugaauucuuuuga

SEQ ID NO: 290243 - RNA, 22 nt, Homo sapiens
uucagugagacgaaaacaacaa

SEQ ID NO: 290244 - RNA, 18 nt, Homo sapiens
uucauaguagcaugauuu

SEQ ID NO: 290245 - RNA, 22 nt, Homo sapiens
uucaucaggaauauugaccugu

SEQ ID NO: 290246 - RNA, 18 nt, Homo sapiens
uucaucaguccucagcug

SEQ ID NO: 290247 - RNA, 21 nt, Homo sapiens
uucaucuggccguauuccagg

SEQ ID NO: 290248 - RNA, 22 nt, Homo sapiens
uucauggacucaauaguuucgc

SEQ ID NO: 290249 - RNA, 22 nt, Homo sapiens
uucauuggauguuacacugugu

SEQ ID NO: 290250 - RNA, 22 nt, Homo sapiens
uuccacagggauuugcauugau

SEQ ID NO: 290251 - RNA, 16 nt, Homo sapiens
uuccacagucgaggug

SEQ ID NO: 290252 - RNA, 23 nt, Homo sapiens
uuccaccauugacuaguuacaua

SEQ ID NO: 290253 - RNA, 22 nt, Homo sapiens
uuccacuuuuuccuugugcucc

SEQ ID NO: 290254 - RNA, 22 nt, Homo sapiens
uuccagagucaccuuucugucg

SEQ ID NO: 290255 - RNA, 22 nt, Homo sapiens
uuccagcugggggcaacucugc

SEQ ID NO: 290256 - RNA, 22 nt, Homo sapiens
uuccaguggacuacuucauccu

SEQ ID NO: 290257 - RNA, 22 nt, Homo sapiens
uuccaguguuugacucaccuuu

SEQ ID NO: 290258 - RNA, 22 nt, Homo sapiens
uuccaguuauuauaccucuuaa

SEQ ID NO: 290259 - RNA, 22 nt, Homo sapiens
uucccagagccugggagugagg

SEQ ID NO: 290260 - RNA, 22 nt, Homo sapiens
uucccagugguuagcucugguc

SEQ ID NO: 290261 - RNA, 22 nt, Homo sapiens
uucccucagaaacacacagccc

SEQ ID NO: 290262 - RNA, 22 nt, Homo sapiens
uucccugugggaguaggaaagu

SEQ ID NO: 290263 - RNA, 22 nt, Homo sapiens
uucccuuucugccuugaaucuu

SEQ ID NO: 290264 - RNA, 22 nt, Homo sapiens
uucccuuugaaacuaaacuugc

SEQ ID NO: 290265 - RNA, 22 nt, Homo sapiens
uucccuuugaauuggaaaggug

SEQ ID NO: 290266 - RNA, 22 nt, Homo sapiens
uucccuuuuuucuaguagguag

SEQ ID NO: 290267 - RNA, 22 nt, Homo sapiens
uuccuagagauuagcaagcugc

SEQ ID NO: 290268 - RNA, 22 nt, Homo sapiens
uuccuaguccugagucucugcg

SEQ ID NO: 290269 - RNA, 19 nt, Homo sapiens
uuccugagaacaagggcuu

SEQ ID NO: 290270 - RNA, 22 nt, Homo sapiens
uuccugagccuuguaucuagua

SEQ ID NO: 290271 - RNA, 22 nt, Homo sapiens
uuccugcacuugcuugccuaug

SEQ ID NO: 290272 - RNA, 22 nt, Homo sapiens
uuccugugacuguguggcaccc

SEQ ID NO: 290273 - RNA, 22 nt, Homo sapiens
uuccuugagaaaggcacaaguu

SEQ ID NO: 290274 - RNA, 22 nt, Homo sapiens
uucuaaacaucuuacaaugcau

SEQ ID NO: 290275 - RNA, 22 nt, Homo sapiens
uucuacagugacugcagccaua

SEQ ID NO: 290276 - RNA, 22 nt, Homo sapiens
uucucacaguacagggagcucu

SEQ ID NO: 290277 - RNA, 21 nt, Homo sapiens
uucucagaggcaggggauaaa

SEQ ID NO: 290278 - RNA, 22 nt, Homo sapiens
uucugaguggcuuucaacacug

SEQ ID NO: 290279 - RNA, 22 nt, Homo sapiens
uucugauggaguaguccacaga

SEQ ID NO: 290280 - RNA, 22 nt, Homo sapiens
uucugcacaucgaucacaagau

SEQ ID NO: 290281 - RNA, 22 nt, Homo sapiens
uucugcuugaucuaguguguug

SEQ ID NO: 290282 - RNA, 22 nt, Homo sapiens
uucuggaaaucagcagagggug

SEQ ID NO: 290283 - RNA, 22 nt, Homo sapiens
uucuggccuccauuuuucuccu

SEQ ID NO: 290284 - RNA, 22 nt, Homo sapiens
uucuucaggcauucccagaagc

SEQ ID NO: 290285 - RNA, 22 nt, Homo sapiens
uucuucaggccacaaaaauggu

SEQ ID NO: 290286 - RNA, 22 nt, Homo sapiens
uucuucaguuacaacaaggggg

SEQ ID NO: 290287 - RNA, 22 nt, Homo sapiens
uucuuccagccuugaggggccc

SEQ ID NO: 290288 - RNA, 22 nt, Homo sapiens
uucuucugguuaugaaauuuga

SEQ ID NO: 290289 - RNA, 22 nt, Homo sapiens
uucuugaggcaugccgcuggga

SEQ ID NO: 290290 - RNA, 20 nt, Homo sapiens
uucuugaguuaacaaguuac

SEQ ID NO: 290291 - RNA, 22 nt, Homo sapiens
uucuugguuggcaaccaacagu

SEQ ID NO: 290292 - RNA, 22 nt, Homo sapiens
uucuuuaguucacuugcuccag

SEQ ID NO: 290293 - RNA, 21 nt, Homo sapiens
uucuuugcucaguguuagagu

SEQ ID NO: 290294 - RNA, 22 nt, Homo sapiens
uucuuuggauaaaguuuuaugc

SEQ ID NO: 290295 - RNA, 22 nt, Homo sapiens
uugaaagaugaacuggauugga

SEQ ID NO: 290296 - RNA, 22 nt, Homo sapiens
uugaaagcuaucagagauucca

SEQ ID NO: 290297 - RNA, 22 nt, Homo sapiens
uugaaagcuaucucaaaucgcu

SEQ ID NO: 290298 - RNA, 22 nt, Homo sapiens
uugaaauguguaagcuccgaaa

SEQ ID NO: 290299 - RNA, 22 nt, Homo sapiens
uugaaccauucuuuugauagag

SEQ ID NO: 290300 - RNA, 22 nt, Homo sapiens
uugaaggaggugcucacucucg

SEQ ID NO: 290301 - RNA, 22 nt, Homo sapiens
ugcaaauuauugggccccaacu

SEQ ID NO: 290302 - RNA, 22 nt, Homo sapiens
ugcaagacuaaaccuuccccuc

SEQ ID NO: 290303 - RNA, 22 nt, Homo sapiens
ugcaaguaauuccagcuacuga

SEQ ID NO: 290304 - RNA, 20 nt, Homo sapiens
ugcaaguugccuuuggaggc

SEQ ID NO: 290305 - RNA, 22 nt, Homo sapiens
ugcaaucaucgcuguuggccac

SEQ ID NO: 290306 - RNA, 22 nt, Homo sapiens
ugcaaugucuucugaggggagc

SEQ ID NO: 290307 - RNA, 22 nt, Homo sapiens
ugcaauuuaaugugucccaauu

SEQ ID NO: 290308 - RNA, 22 nt, Homo sapiens
ugcaccacugcacuccacccug

SEQ ID NO: 290309 - RNA, 22 nt, Homo sapiens
ugcaccacugcacuccagcuug

SEQ ID NO: 290310 - RNA, 22 nt, Homo sapiens
ugcaccaucuugcuucuguggu

SEQ ID NO: 290311 - RNA, 19 nt, Homo sapiens
ugcagcaauguaaaagaca

SEQ ID NO: 290312 - RNA, 17 nt, Homo sapiens
ugcagcacacugauggg

SEQ ID NO: 290313 - RNA, 23 nt, Homo sapiens
ugcagcacacugaugggucuuga

SEQ ID NO: 290314 - RNA, 22 nt, Homo sapiens
uuugacuagaguguuuuacaac

SEQ ID NO: 290315 - RNA, 22 nt, Homo sapiens
uuugagcaagaggugacauuau

SEQ ID NO: 290316 - RNA, 22 nt, Homo sapiens
uuugagcauuagggcaaaggca

SEQ ID NO: 290317 - RNA, 22 nt, Homo sapiens
uuugagguguauggcaaguuga

SEQ ID NO: 290318 - RNA, 21 nt, Homo sapiens
uuugaucauuaaaagugaauc

SEQ ID NO: 290319 - RNA, 22 nt, Homo sapiens
uuugauugguguaccugaaagu

SEQ ID NO: 290320 - RNA, 22 nt, Homo sapiens
uuugcauaauaagauuagggug

SEQ ID NO: 290321 - RNA, 19 nt, Homo sapiens
uuugcauagugagaauaua

SEQ ID NO: 290322 - RNA, 21 nt, Homo sapiens
uuugcauauguugaaccagcc

SEQ ID NO: 290323 - RNA, 22 nt, Homo sapiens
uuugccaaugggaauuuuccua

SEQ ID NO: 290324 - RNA, 23 nt, Homo sapiens
uuugccacuuauuagcugggagg

SEQ ID NO: 290325 - RNA, 22 nt, Homo sapiens
uuugcuuaaaucuuaaucagau

SEQ ID NO: 290326 - RNA, 22 nt, Homo sapiens
uuugcuuaguaaauguagaaaa

SEQ ID NO: 290327 - RNA, 22 nt, Homo sapiens
uuugcuucacuguuuggcaaaa

SEQ ID NO: 290328 - RNA, 22 nt, Homo sapiens
uuuggauagugugguccuuuua

SEQ ID NO: 290329 - RNA, 22 nt, Homo sapiens
uuuggcaauaaacuccccuaac

SEQ ID NO: 290330 - RNA, 22 nt, Homo sapiens
uuuggcaauuugacuguauagg

SEQ ID NO: 290331 - RNA, 22 nt, Homo sapiens
uuuggcacuauagguaaauuug

SEQ ID NO: 290332 - RNA, 22 nt, Homo sapiens
uuuggcacuguaaauuucucuu

SEQ ID NO: 290333 - RNA, 22 nt, Homo sapiens
uuuggcagaugacccucaaguu

SEQ ID NO: 290334 - RNA, 22 nt, Homo sapiens
uuuggcaguuauuuacucagug

SEQ ID NO: 290335 - RNA, 22 nt, Homo sapiens
uuuggcauauuuuaagcugguu

SEQ ID NO: 290336 - RNA, 22 nt, Homo sapiens
uuuggcauuaagaugcuguauc

SEQ ID NO: 290337 - RNA, 22 nt, Homo sapiens
uuuggcauuuaaauaugcaugg

SEQ ID NO: 290338 - RNA, 22 nt, Homo sapiens
uuuggcuuuugugauacguaau

SEQ ID NO: 290339 - RNA, 22 nt, Homo sapiens
uuugggaaugaguuuaucauuu

SEQ ID NO: 290340 - RNA, 22 nt, Homo sapiens
uuugguccaguguucagguccu

SEQ ID NO: 290341 - RNA, 22 nt, Homo sapiens
uuugguccuccuacagggcagg

SEQ ID NO: 290342 - RNA, 18 nt, Homo sapiens
uuugguccuuuauaaaca

SEQ ID NO: 290343 - RNA, 22 nt, Homo sapiens
uuugguugcauucacauauuuc

SEQ ID NO: 290344 - RNA, 22 nt, Homo sapiens
uuugguugccucuaugagccug

SEQ ID NO: 290345 - RNA, 22 nt, Homo sapiens
uuuguacucccuuuagauaaaa

SEQ ID NO: 290346 - RNA, 22 nt, Homo sapiens
uuuguacuucauacaauaacuc

SEQ ID NO: 290347 - RNA, 22 nt, Homo sapiens
uuuguacuucauugguucuacu

SEQ ID NO: 290348 - RNA, 22 nt, Homo sapiens
uuugucaauaacuaccaacagg

SEQ ID NO: 290349 - RNA, 22 nt, Homo sapiens
uuugucacccugaauguaagau

SEQ ID NO: 290350 - RNA, 22 nt, Homo sapiens
uuugucuccuaagacucugugg

SEQ ID NO: 290351 - RNA, 22 nt, Homo sapiens
uuugugaggugauggauauguc

SEQ ID NO: 290352 - RNA, 22 nt, Homo sapiens
uuugugauugcacacucaagau

SEQ ID NO: 290353 - RNA, 22 nt, Homo sapiens
uuuguggaaugcccuuauuuau

SEQ ID NO: 290354 - RNA, 22 nt, Homo sapiens
uagguaguuagcauacuacaca

SEQ ID NO: 290355 - RNA, 23 nt, Homo sapiens
uagguuauuugguaaauauaugu

SEQ ID NO: 290356 - RNA, 22 nt, Homo sapiens
uaguagcaccucucaugagcuu

SEQ ID NO: 290357 - RNA, 22 nt, Homo sapiens
uagucccuuucuauuaaugaga

SEQ ID NO: 290358 - RNA, 22 nt, Homo sapiens
uagugacauugcugggaaugcu

SEQ ID NO: 290359 - RNA, 22 nt, Homo sapiens
uagugcccuuauaagagcagga

SEQ ID NO: 290360 - RNA, 22 nt, Homo sapiens
uaguguuuuucauuggcagagg

SEQ ID NO: 290361 - RNA, 22 nt, Homo sapiens
uauaacaaugcaagaauggccu

SEQ ID NO: 290362 - RNA, 22 nt, Homo sapiens
uauagagguagguuaauuggaa

SEQ ID NO: 290363 - RNA, 22 nt, Homo sapiens
uauagcacugagaauguaauuc

SEQ ID NO: 290364 - RNA, 22 nt, Homo sapiens
uauagcagugaguauugacuaa

SEQ ID NO: 290365 - RNA, 22 nt, Homo sapiens
uauagcuuuuuagggaauuugg

SEQ ID NO: 290366 - RNA, 22 nt, Homo sapiens
uauaguguuuucaaaaguaugu

SEQ ID NO: 290367 - RNA, 22 nt, Homo sapiens
uaucacacgccuugcuucauuu

SEQ ID NO: 290368 - RNA, 22 nt, Homo sapiens
uaucacagaggguauccuagag

SEQ ID NO: 290369 - RNA, 22 nt, Homo sapiens
uaucacagcauugucuauaaua

SEQ ID NO: 290370 - RNA, 22 nt, Homo sapiens
uaucacagcgggguguacaccc

SEQ ID NO: 290371 - RNA, 22 nt, Homo sapiens
uaucacaggucaggaaucuugc

SEQ ID NO: 290372 - RNA, 22 nt, Homo sapiens
uaucacagguggacugcacacc

SEQ ID NO: 290373 - RNA, 21 nt, Homo sapiens
uaucacaguagaauaggaucu

SEQ ID NO: 290374 - RNA, 22 nt, Homo sapiens
uaucacagugcuggaguauucc

SEQ ID NO: 290375 - RNA, 20 nt, Homo sapiens
uaucacauggggagaaaccu

SEQ ID NO: 290376 - RNA, 22 nt, Homo sapiens
uaucaguauggauucauggauu

SEQ ID NO: 290377 - RNA, 22 nt, Homo sapiens
uaucagugaaucuuauuuugcc

SEQ ID NO: 290378 - RNA, 22 nt, Homo sapiens
uaucccaguggauguaccccau

SEQ ID NO: 290379 - RNA, 23 nt, Homo sapiens
uaucccuugccuuaugaugugag

SEQ ID NO: 290380 - RNA, 20 nt, Homo sapiens
uaucuacuugcaaaugccau

SEQ ID NO: 290381 - RNA, 22 nt, Homo sapiens
uaucucacauauucaguagguu

SEQ ID NO: 290382 - RNA, 22 nt, Homo sapiens
uaucucagagaaucagauuuac

SEQ ID NO: 290383 - RNA, 22 nt, Homo sapiens
uaucucagaguguacaagauua

SEQ ID NO: 290384 - RNA, 22 nt, Homo sapiens
uaucucaguguacaggaugaua

SEQ ID NO: 290385 - RNA, 21 nt, Homo sapiens
uaucucaguuuuccuuugugg

SEQ ID NO: 290386 - RNA, 22 nt, Homo sapiens
uaucugcacauacacuuauagc

SEQ ID NO: 290387 - RNA, 22 nt, Homo sapiens
uaugaaagcuacuucucacaau

SEQ ID NO: 290388 - RNA, 22 nt, Homo sapiens
uaugaaucuggcuacuccaggg

SEQ ID NO: 290389 - RNA, 22 nt, Homo sapiens
uaugagacugugagugagaaau

SEQ ID NO: 290390 - RNA, 22 nt, Homo sapiens
uaugagcaaaaugaggguuagu

SEQ ID NO: 290391 - RNA, 22 nt, Homo sapiens
uaugagguagguaugacuauca

SEQ ID NO: 290392 - RNA, 22 nt, Homo sapiens
uaugaucauuauguuauugcag

SEQ ID NO: 290393 - RNA, 22 nt, Homo sapiens
uaugcacacacguguuuaugug

SEQ ID NO: 290394 - RNA, 22 nt, Homo sapiens
uaugcacaugcaugcuugaaua

SEQ ID NO: 290395 - RNA, 22 nt, Homo sapiens
uaugccucuucauaaaguauga

SEQ ID NO: 290396 - RNA, 23 nt, Homo sapiens
uaugccuguuucaaacaaacuuu

SEQ ID NO: 290397 - RNA, 22 nt, Homo sapiens
uugcuccucugccaggaccugu

SEQ ID NO: 290398 - RNA, 22 nt, Homo sapiens
uugcuggugguucgagcaacac

SEQ ID NO: 290399 - RNA, 20 nt, Homo sapiens
uugcugguguuagaggaggc

SEQ ID NO: 290400 - RNA, 22 nt, Homo sapiens
uuggaagacaaugcugauucuc

SEQ ID NO: 290401 - RNA, 22 nt, Homo sapiens
uuggaauacuuguuaaagucca

SEQ ID NO: 290402 - RNA, 22 nt, Homo sapiens
uuggaaugcacacugagccugc

SEQ ID NO: 290403 - RNA, 22 nt, Homo sapiens
uuggaauguauggcaucuugcg

SEQ ID NO: 290404 - RNA, 22 nt, Homo sapiens
uuggaauuagacaagugguggu

SEQ ID NO: 290405 - RNA, 22 nt, Homo sapiens
uuggaauuuuacuucuguaaga

SEQ ID NO: 290406 - RNA, 22 nt, Homo sapiens
uuggacagaugguuacauuuuu

SEQ ID NO: 290407 - RNA, 22 nt, Homo sapiens
uuggaccacuugauuucugguc

SEQ ID NO: 290408 - RNA, 22 nt, Homo sapiens
uuggacuggaacuauaccauug

SEQ ID NO: 290409 - RNA, 22 nt, Homo sapiens
uuggacugggauggccgaggcu

SEQ ID NO: 290410 - RNA, 22 nt, Homo sapiens
uuggacugugagguuucguggg

SEQ ID NO: 290411 - RNA, 22 nt, Homo sapiens
uuggacuuuuauucugcaggca

SEQ ID NO: 290412 - RNA, 22 nt, Homo sapiens
uuggagcccuaacucucaguac

SEQ ID NO: 290413 - RNA, 22 nt, Homo sapiens
uuggagugugcucauaacugcu

SEQ ID NO: 290414 - RNA, 22 nt, Homo sapiens
uuggauaguuuaugaaaaaugg

SEQ ID NO: 290415 - RNA, 22 nt, Homo sapiens
uuggauauucaguuuuuccauc

SEQ ID NO: 290416 - RNA, 22 nt, Homo sapiens
uuggauggugauaugguuugga

SEQ ID NO: 290417 - RNA, 22 nt, Homo sapiens
uuggauuguuucuagauugggg

SEQ ID NO: 290418 - RNA, 22 nt, Homo sapiens
uuggauuuuaacaaacuaggug

SEQ ID NO: 290419 - RNA, 22 nt, Homo sapiens
uuggcaaagaggaaugccacuu

SEQ ID NO: 290420 - RNA, 22 nt, Homo sapiens
uuggcaaagugucuggcauuua

SEQ ID NO: 290421 - RNA, 22 nt, Homo sapiens
uuggcaagcuguuaauuauaaa

SEQ ID NO: 290422 - RNA, 22 nt, Homo sapiens
uuggcaaguuucugucagcaaa

SEQ ID NO: 290423 - RNA, 22 nt, Homo sapiens
uuggcaauauuuacugaaguug

SEQ ID NO: 290424 - RNA, 21 nt, Homo sapiens
uuggcacucuucucuccuuau

SEQ ID NO: 290425 - RNA, 22 nt, Homo sapiens
uuggcacugagcaagaacaggg

SEQ ID NO: 290426 - RNA, 22 nt, Homo sapiens
uuggcagaaaaggucggggguu

SEQ ID NO: 290427 - RNA, 22 nt, Homo sapiens
uuggcagaauguuagaaacuua

SEQ ID NO: 290428 - RNA, 20 nt, Homo sapiens
uuggcagagucuuuagggua

SEQ ID NO: 290429 - RNA, 22 nt, Homo sapiens
uuggccagugucuuuuuuuccu

SEQ ID NO: 290430 - RNA, 22 nt, Homo sapiens
uuggccauaugacuugcuuugg

SEQ ID NO: 290431 - RNA, 22 nt, Homo sapiens
uuggcccugcugaccauucccu

SEQ ID NO: 290432 - RNA, 22 nt, Homo sapiens
uuggccuccuggucauauccag

SEQ ID NO: 290433 - RNA, 22 nt, Homo sapiens
uuggcuaagaucacgugagaau

SEQ ID NO: 290434 - RNA, 22 nt, Homo sapiens
uuggcuguguuucccuacaaau

SEQ ID NO: 290435 - RNA, 22 nt, Homo sapiens
uuggcuuuuaugcagcuuaggu

SEQ ID NO: 290436 - RNA, 22 nt, Homo sapiens
uugggaauguccuaauaucucg

SEQ ID NO: 290437 - RNA, 22 nt, Homo sapiens
uugggacuggaaggaguaaggg

SEQ ID NO: 290438 - RNA, 22 nt, Homo sapiens
uugggagugucucuggacugca

SEQ ID NO: 290439 - RNA, 22 nt, Homo sapiens
uugggcaaguggcaugaccaug

SEQ ID NO: 290440 - RNA, 22 nt, Homo sapiens
uugggccacuuuaguuuccuua

SEQ ID NO: 290441 - RNA, 22 nt, Homo sapiens
uuggucaggcuaaucucgaacg

SEQ ID NO: 290442 - RNA, 22 nt, Homo sapiens
uugguccucccaugcucaagag

SEQ ID NO: 290443 - RNA, 23 nt, Homo sapiens
uuggucucccaaaguguugagau

SEQ ID NO: 290444 - RNA, 22 nt, Homo sapiens
uuggucugcucugauguuuucu

SEQ ID NO: 290445 - RNA, 22 nt, Homo sapiens
uuggucuucuaauguaccuguu

SEQ ID NO: 290446 - RNA, 22 nt, Homo sapiens
uugguuaucaucauuucagcaa

SEQ ID NO: 290447 - RNA, 22 nt, Homo sapiens
uuguaagaaucuagcucuuuau

SEQ ID NO: 290448 - RNA, 22 nt, Homo sapiens
uuguaaucaacacaucauuggg

SEQ ID NO: 290449 - RNA, 22 nt, Homo sapiens
uuguacuauuuuuaucagugau

SEQ ID NO: 290450 - RNA, 22 nt, Homo sapiens
uuguaguagcauuauuuauaau

SEQ ID NO: 290451 - RNA, 22 nt, Homo sapiens
uugucaaacucauucuccaucc

SEQ ID NO: 290452 - RNA, 22 nt, Homo sapiens
uugucccauggggucuuccuuu

SEQ ID NO: 290453 - RNA, 22 nt, Homo sapiens
uuguccuggagguucuugcaag

SEQ ID NO: 290454 - RNA, 22 nt, Homo sapiens
uuguccuugagauaguuugcug

SEQ ID NO: 290455 - RNA, 22 nt, Homo sapiens
uugucuccuagacgaccaggcg

SEQ ID NO: 290456 - RNA, 22 nt, Homo sapiens
uugugaaaaaccucucguggaa

SEQ ID NO: 290457 - RNA, 22 nt, Homo sapiens
uugugaaaucuaggcagagguu

SEQ ID NO: 290458 - RNA, 22 nt, Homo sapiens
uugugaaugaugccgcaauaaa

SEQ ID NO: 290459 - RNA, 22 nt, Homo sapiens
uugugaauggaguagcaggauc

SEQ ID NO: 290460 - RNA, 22 nt, Homo sapiens
uugugaauggugccgcaguaaa

SEQ ID NO: 290461 - RNA, 22 nt, Homo sapiens
uugugaauggugcugcaguaaa

SEQ ID NO: 290462 - RNA, 22 nt, Homo sapiens
uugugauugagugauccuuguu

SEQ ID NO: 290463 - RNA, 22 nt, Homo sapiens
uugugcacauguacccuagaac

SEQ ID NO: 290464 - RNA, 22 nt, Homo sapiens
uugugcaugaugcauacauggu

SEQ ID NO: 290465 - RNA, 20 nt, Homo sapiens
uugugcauugggccauuggg

SEQ ID NO: 290466 - RNA, 18 nt, Homo sapiens
uugugccugagaaggugg

SEQ ID NO: 290467 - RNA, 22 nt, Homo sapiens
uugugcuuuugagcugagauga

SEQ ID NO: 290468 - RNA, 22 nt, Homo sapiens
uuguggcuuaucucauuuagcg

SEQ ID NO: 290469 - RNA, 22 nt, Homo sapiens
uugugguaggaguugccauguu

SEQ ID NO: 290470 - RNA, 22 nt, Homo sapiens
uugugguuauagagucucccug

SEQ ID NO: 290471 - RNA, 22 nt, Homo sapiens
uugugucccugcccaaaucuca

SEQ ID NO: 290472 - RNA, 22 nt, Homo sapiens
uuguuaagaugcagauucugga

SEQ ID NO: 290473 - RNA, 23 nt, Homo sapiens
uuguucccuuccacucagucucc

SEQ ID NO: 290474 - RNA, 22 nt, Homo sapiens
uuguuguggauuaaauuugcau

SEQ ID NO: 290475 - RNA, 22 nt, Homo sapiens
uuguuuagagacuggaauuaaa

SEQ ID NO: 290476 - RNA, 22 nt, Homo sapiens
uuuaaaguuagaaggaaagggc

SEQ ID NO: 290477 - RNA, 20 nt, Homo sapiens
uuuaagacaugcugaauuga

SEQ ID NO: 290478 - RNA, 22 nt, Homo sapiens
uuuaauguuacaguauugguau

SEQ ID NO: 290479 - RNA, 22 nt, Homo sapiens
uguguaaagcuuguuccagaaa

SEQ ID NO: 290480 - RNA, 22 nt, Homo sapiens
uguguuugauaaguccauaguu

SEQ ID NO: 290481 - RNA, 22 nt, Homo sapiens
uguuaacauuuuagagugggaa

SEQ ID NO: 290482 - RNA, 22 nt, Homo sapiens
uguuacagugacuaauguuuua

SEQ ID NO: 290483 - RNA, 22 nt, Homo sapiens
uguuauguauggagugauccca

SEQ ID NO: 290484 - RNA, 22 nt, Homo sapiens
uguucaauucccaccuaugagu

SEQ ID NO: 290485 - RNA, 22 nt, Homo sapiens
uguugcacugguaauguacuga

SEQ ID NO: 290486 - RNA, 22 nt, Homo sapiens
uguugcauuugucaaggucaag

SEQ ID NO: 290487 - RNA, 22 nt, Homo sapiens
uguuugcuguguggaguagcag

SEQ ID NO: 290488 - RNA, 22 nt, Homo sapiens
uguuugcuguuuucuccaauga

SEQ ID NO: 290489 - RNA, 22 nt, Homo sapiens
uguuuguuugagauggagucuc

SEQ ID NO: 290490 - RNA, 22 nt, Homo sapiens
uguuuuggaggccagaagucca

SEQ ID NO: 290491 - RNA, 21 nt, Homo sapiens
uguuuuugcuguguaucucuc

SEQ ID NO: 290492 - RNA, 22 nt, Homo sapiens
uuaaaagcuaucuccaagguca

SEQ ID NO: 290493 - RNA, 22 nt, Homo sapiens
uuaaagugcuguuuuugccggg

SEQ ID NO: 290494 - RNA, 22 nt, Homo sapiens
uuaaauacagcaugguguuucu

SEQ ID NO: 290495 - RNA, 20 nt, Homo sapiens
uuaaaucuagugcagacuca

SEQ ID NO: 290496 - RNA, 22 nt, Homo sapiens
uuaacagcacuacguggggauc

SEQ ID NO: 290497 - RNA, 22 nt, Homo sapiens
uuaacagucacuuagcucauuu

SEQ ID NO: 290498 - RNA, 22 nt, Homo sapiens
uuaacagugucaaucuguagua

SEQ ID NO: 290499 - RNA, 22 nt, Homo sapiens
uuaacaguuaauucuuuggcaa

SEQ ID NO: 290500 - RNA, 22 nt, Homo sapiens
uuaagagcauggugccagguug

SEQ ID NO: 290501 - RNA, 22 nt, Homo sapiens
uuaagaugcauuuugaaguuaa

SEQ ID NO: 290502 - RNA, 22 nt, Homo sapiens
uuaagcaguaguuaaggagagg

SEQ ID NO: 290503 - RNA, 22 nt, Homo sapiens
uuaagcugaauuuaagcuucgg

SEQ ID NO: 290504 - RNA, 22 nt, Homo sapiens
uuaaggaaagcauuuaauucag

SEQ ID NO: 290505 - RNA, 22 nt, Homo sapiens
uuaaggaguagugucugguauu

SEQ ID NO: 290506 - RNA, 22 nt, Homo sapiens
uuaaggcagugcaucuggaguu

SEQ ID NO: 290507 - RNA, 22 nt, Homo sapiens
uuaaggcagugucuaugccagu

SEQ ID NO: 290508 - RNA, 19 nt, Homo sapiens
uuaagguacuuagaugugu

SEQ ID NO: 290509 - RNA, 22 nt, Homo sapiens
uuaaggugaaguucucagaugc

SEQ ID NO: 290510 - RNA, 22 nt, Homo sapiens
uuaaguagcugggcaugguggu

SEQ ID NO: 290511 - RNA, 19 nt, Homo sapiens
uuaaguaguuagagggucu

SEQ ID NO: 290512 - RNA, 22 nt, Homo sapiens
uuaagucacacuagacaacuga

SEQ ID NO: 290513 - RNA, 20 nt, Homo sapiens
uuaagugcuuucugcuuaga

SEQ ID NO: 290514 - RNA, 21 nt, Homo sapiens
uuaagugcuuuguaugcacua

SEQ ID NO: 290515 - RNA, 22 nt, Homo sapiens
uuaagugguagguggugcccaa

SEQ ID NO: 290516 - RNA, 22 nt, Homo sapiens
uuaaucugucuaugauuuuggu

SEQ ID NO: 290517 - RNA, 22 nt, Homo sapiens
uuaaugacaucauaggugaagu

SEQ ID NO: 290518 - RNA, 22 nt, Homo sapiens
uuaaugcuuggggaguaguucu

SEQ ID NO: 290519 - RNA, 22 nt, Homo sapiens
uuaauucugucugcccucaucc

SEQ ID NO: 290520 - RNA, 22 nt, Homo sapiens
uuacacaguaggucccuaguaa

SEQ ID NO: 290521 - RNA, 22 nt, Homo sapiens
uuacacaguugguaggggcaga

SEQ ID NO: 290522 - RNA, 22 nt, Homo sapiens
uuacaggacuaagcagcuuugc

SEQ ID NO: 290523 - RNA, 22 nt, Homo sapiens
uuacagguggagaaguaaggcu

SEQ ID NO: 290524 - RNA, 22 nt, Homo sapiens
uuacaguaugaguaagaguucu

SEQ ID NO: 290525 - RNA, 22 nt, Homo sapiens
uuacaguauugcaaggacuagg

SEQ ID NO: 290526 - RNA, 22 nt, Homo sapiens
uuacagucaaguuacauuucuc

SEQ ID NO: 290527 - RNA, 20 nt, Homo sapiens
uuacagugggaccuuccuga

SEQ ID NO: 290528 - RNA, 19 nt, Homo sapiens
uuacauccauugcauuuca

SEQ ID NO: 290529 - RNA, 22 nt, Homo sapiens
uuacccauuagagaauuuaaga

SEQ ID NO: 290530 - RNA, 22 nt, Homo sapiens
uuacccuuuaacccuuuaaagu

SEQ ID NO: 290531 - RNA, 22 nt, Homo sapiens
uuacugcauaauuccugggaag

SEQ ID NO: 290532 - RNA, 22 nt, Homo sapiens
uuacuguauagaaucaucuuga

SEQ ID NO: 290533 - RNA, 22 nt, Homo sapiens
uuagaaaguagaaaagcugguu

SEQ ID NO: 290534 - RNA, 22 nt, Homo sapiens
uuagaacaguguuugccucgcu

SEQ ID NO: 290535 - RNA, 22 nt, Homo sapiens
uuagacacacauacauuuaucu

SEQ ID NO: 290536 - RNA, 22 nt, Homo sapiens
uuagaguacaggggaaucaagg

SEQ ID NO: 290537 - RNA, 22 nt, Homo sapiens
uuagcacaucuuucuauguaag

SEQ ID NO: 290538 - RNA, 22 nt, Homo sapiens
uuagcagcaccccacucuacug

SEQ ID NO: 290539 - RNA, 22 nt, Homo sapiens
uuagcagcucuggugacaaggu

SEQ ID NO: 290540 - RNA, 22 nt, Homo sapiens
uuaggcaaugcucucaaauuug

SEQ ID NO: 290541 - RNA, 22 nt, Homo sapiens
uuaggcaguuuauugauuuuca

SEQ ID NO: 290542 - RNA, 22 nt, Homo sapiens
uuaggcucuuuaucaguuaacu

SEQ ID NO: 290543 - RNA, 22 nt, Homo sapiens
uuaggucaucgcuguccuucag

SEQ ID NO: 290544 - RNA, 23 nt, Homo sapiens
uuaguaaacucaaugacaccaca

SEQ ID NO: 290545 - RNA, 22 nt, Homo sapiens
uuaguaguagcugcaugucagu

SEQ ID NO: 290546 - RNA, 22 nt, Homo sapiens
uuaguaguaguuugcauuuacc

SEQ ID NO: 290547 - RNA, 22 nt, Homo sapiens
uuaguaguugugauagguaccu

SEQ ID NO: 290548 - RNA, 22 nt, Homo sapiens
uuaguggaugcugaauaaagaa

SEQ ID NO: 290549 - RNA, 22 nt, Homo sapiens
uuauagcagugcaggaacagac

SEQ ID NO: 290550 - RNA, 20 nt, Homo sapiens
uuauagcuacaucuugacug

SEQ ID NO: 290551 - RNA, 18 nt, Homo sapiens
uuauaugcauguguagga

SEQ ID NO: 290552 - RNA, 22 nt, Homo sapiens
uuauauguuucuuagggacaga

SEQ ID NO: 290553 - RNA, 22 nt, Homo sapiens
uuauauguuuguacuuaggccu

SEQ ID NO: 290554 - RNA, 22 nt, Homo sapiens
uuaucaaacccuaggagguggu

SEQ ID NO: 290555 - RNA, 22 nt, Homo sapiens
uuaucagcagcaugaaaauaga

SEQ ID NO: 290556 - RNA, 22 nt, Homo sapiens
uuaucucaguguuuguaaacaa

SEQ ID NO: 290557 - RNA, 17 nt, Homo sapiens
uuaugagacuucuuagc

SEQ ID NO: 290558 - RNA, 22 nt, Homo sapiens
uuaugcuguuuucuggagauuu

SEQ ID NO: 290559 - RNA, 22 nt, Homo sapiens
uuaugcuugugugaauuuuccc

SEQ ID NO: 290560 - RNA, 22 nt, Homo sapiens
uuauggcuauugaugacaauug

SEQ ID NO: 290561 - RNA, 22 nt, Homo sapiens
ggcaagaaccacaauuacuuuu

SEQ ID NO: 290562 - RNA, 22 nt, Homo sapiens
ggcaagaaccagggauuugcgu

SEQ ID NO: 290563 - RNA, 21 nt, Homo sapiens
ggcaagagaauacaacauaaa

SEQ ID NO: 290564 - RNA, 22 nt, Homo sapiens
ggcaagaggagauucugcuccc

SEQ ID NO: 290565 - RNA, 23 nt, Homo sapiens
ggcaagaucucagcucacugcaa

SEQ ID NO: 290566 - RNA, 22 nt, Homo sapiens
ggcaagaucuuggcucacugaa

SEQ ID NO: 290567 - RNA, 22 nt, Homo sapiens
ggcaagugggagggaguguuuc

SEQ ID NO: 290568 - RNA, 22 nt, Homo sapiens
ggcaaguucuaaugauuagaau

SEQ ID NO: 290569 - RNA, 19 nt, Homo sapiens
ggcaauacuuucuuguugg

SEQ ID NO: 290570 - RNA, 22 nt, Homo sapiens
ggcaauauuauuaacccucugu

SEQ ID NO: 290571 - RNA, 22 nt, Homo sapiens
ggcaaugaggcggaccagcagg

SEQ ID NO: 290572 - RNA, 22 nt, Homo sapiens
ggcacgguggcucacaccugua

SEQ ID NO: 290573 - RNA, 22 nt, Homo sapiens
ggcacgguggcucacgccugua

SEQ ID NO: 290574 - RNA, 22 nt, Homo sapiens
ggcagcuguguccuucguaagg

SEQ ID NO: 290575 - RNA, 22 nt, Homo sapiens
ggcaguguauuacuuaggguuc

SEQ ID NO: 290576 - RNA, 22 nt, Homo sapiens
ggcaguuucucaggcaggggua

SEQ ID NO: 290577 - RNA, 22 nt, Homo sapiens
ggcaugaugcgcacgccuguag

SEQ ID NO: 290578 - RNA, 22 nt, Homo sapiens
ggcauguugauagguagaugua

SEQ ID NO: 290579 - RNA, 22 nt, Homo sapiens
ggcauguuuaguagaauguggu

SEQ ID NO: 290580 - RNA, 22 nt, Homo sapiens
ggccagaugcgguggcucacac

SEQ ID NO: 290581 - RNA, 22 nt, Homo sapiens
ggcccugauacaaguaaggucu

SEQ ID NO: 290582 - RNA, 22 nt, Homo sapiens
ggccggguggccauggcugccc

SEQ ID NO: 290583 - RNA, 22 nt, Homo sapiens
ggccugaugaaauguuagagua

SEQ ID NO: 290584 - RNA, 22 nt, Homo sapiens
ggccuguaaacuagagacccug

SEQ ID NO: 290585 - RNA, 22 nt, Homo sapiens
ggcucagugggguccugguucu

SEQ ID NO: 290586 - RNA, 22 nt, Homo sapiens
ggcucaguugcaaaucaguuca

SEQ ID NO: 290587 - RNA, 22 nt, Homo sapiens
ggcugguuuucaguuacugagu

SEQ ID NO: 290588 - RNA, 22 nt, Homo sapiens
gggaaaaugucuauugaaugaa

SEQ ID NO: 290589 - RNA, 22 nt, Homo sapiens
gggaagugugcagaguucucuu

SEQ ID NO: 290590 - RNA, 18 nt, Homo sapiens
gggaauauggggaguuga

SEQ ID NO: 290591 - RNA, 22 nt, Homo sapiens
gggagguagguauuagcuuuuc

SEQ ID NO: 290592 - RNA, 22 nt, Homo sapiens
gggaggucauuguaaggucuua

SEQ ID NO: 290593 - RNA, 22 nt, Homo sapiens
gggagugucuaaccuguuaaca

SEQ ID NO: 290594 - RNA, 22 nt, Homo sapiens
gggaguguguaggacccagugu

SEQ ID NO: 290595 - RNA, 22 nt, Homo sapiens
gggaugaagcccuaggguuggu

SEQ ID NO: 290596 - RNA, 22 nt, Homo sapiens
gggcaaaacuguacugccaagg

SEQ ID NO: 290597 - RNA, 20 nt, Homo sapiens
gggcaaguaugugggaaguc

SEQ ID NO: 290598 - RNA, 22 nt, Homo sapiens
gggcaugugugugcacacacau

SEQ ID NO: 290599 - RNA, 22 nt, Homo sapiens
gggcauugugggcagagggcag

SEQ ID NO: 290600 - RNA, 22 nt, Homo sapiens
ggggaauguuaaagaauuugca

SEQ ID NO: 290601 - RNA, 22 nt, Homo sapiens
gggggagugugguacccagcau

SEQ ID NO: 290602 - RNA, 22 nt, Homo sapiens
gguaaacauacugcugucuucu

SEQ ID NO: 290603 - RNA, 22 nt, Homo sapiens
gguaauguaacugguauucugu

SEQ ID NO: 290604 - RNA, 22 nt, Homo sapiens
gguauguaggucuacgguacaa

SEQ ID NO: 290605 - RNA, 22 nt, Homo sapiens
ggucaacaucaucaugguaagu

SEQ ID NO: 290606 - RNA, 22 nt, Homo sapiens
ggucacccugaugcuggugguc

SEQ ID NO: 290607 - RNA, 22 nt, Homo sapiens
ggucagaaagacaggcauucag

SEQ ID NO: 290608 - RNA, 19 nt, Homo sapiens
ggucauggagguuguguga

SEQ ID NO: 290609 - RNA, 22 nt, Homo sapiens
ggucauggauaagauccagaag

SEQ ID NO: 290610 - RNA, 22 nt, Homo sapiens
ggucauggauguuuauaguaca

SEQ ID NO: 290611 - RNA, 19 nt, Homo sapiens
ggucccucucaagucauuc

SEQ ID NO: 290612 - RNA, 22 nt, Homo sapiens
ggucugguguugaaauucuuca

SEQ ID NO: 290613 - RNA, 22 nt, Homo sapiens
ggugaauuguaccccauaggau

SEQ ID NO: 290614 - RNA, 22 nt, Homo sapiens
ggugagaaaaacauagucucag

SEQ ID NO: 290615 - RNA, 22 nt, Homo sapiens
ggugagaaagggauuccuguuc

SEQ ID NO: 290616 - RNA, 22 nt, Homo sapiens
ggugagauguucagacgaacug

SEQ ID NO: 290617 - RNA, 22 nt, Homo sapiens
ggugaguggugcuuaaguucag

SEQ ID NO: 290618 - RNA, 22 nt, Homo sapiens
ggugcagcacaccaacauggca

SEQ ID NO: 290619 - RNA, 22 nt, Homo sapiens
ggugcuugaggaacggaggcug

SEQ ID NO: 290620 - RNA, 22 nt, Homo sapiens
gguggucuuccccuggaguucg

SEQ ID NO: 290621 - RNA, 22 nt, Homo sapiens
ggugucaguuggccccuacugg

SEQ ID NO: 290622 - RNA, 22 nt, Homo sapiens
gguguguaaauuacuuaucucu

SEQ ID NO: 290623 - RNA, 22 nt, Homo sapiens
guaaauaccaguuucuggaaca

SEQ ID NO: 290624 - RNA, 22 nt, Homo sapiens
guaaaucucuguuuucauggac

SEQ ID NO: 290625 - RNA, 22 nt, Homo sapiens
guaaauguccccugugauauug

SEQ ID NO: 290626 - RNA, 22 nt, Homo sapiens
guaacccuguaggccuaaagua

SEQ ID NO: 290627 - RNA, 22 nt, Homo sapiens
guaaggcuucuggucaacagca

SEQ ID NO: 290628 - RNA, 22 nt, Homo sapiens
guaagucucaugagaucugaug

SEQ ID NO: 290629 - RNA, 22 nt, Homo sapiens
guaagugauagaauuaggauuc

SEQ ID NO: 290630 - RNA, 22 nt, Homo sapiens
guaagugguagagcugggcuau

SEQ ID NO: 290631 - RNA, 22 nt, Homo sapiens
guaauaacuguggaaaaagguu

SEQ ID NO: 290632 - RNA, 22 nt, Homo sapiens
guaauacuuuugggauauuaga

SEQ ID NO: 290633 - RNA, 19 nt, Homo sapiens
guaaucucaguacuuuggu

SEQ ID NO: 290634 - RNA, 17 nt, Homo sapiens
guacacuucuucuguga

SEQ ID NO: 290635 - RNA, 22 nt, Homo sapiens
guacaggugcaggaugggcagg

SEQ ID NO: 290636 - RNA, 22 nt, Homo sapiens
guacaguauaguaauaggauuu

SEQ ID NO: 290637 - RNA, 22 nt, Homo sapiens
guacagugcucacaaugagagc

SEQ ID NO: 290638 - RNA, 22 nt, Homo sapiens
guacaugcauacaugcacaucu

SEQ ID NO: 290639 - RNA, 22 nt, Homo sapiens
guacuguuucauuggagauuaa

SEQ ID NO: 290640 - RNA, 22 nt, Homo sapiens
guagaauguauacaguauacag

SEQ ID NO: 290641 - RNA, 22 nt, Homo sapiens
guagaccauuuaucuggggagu

SEQ ID NO: 290642 - RNA, 22 nt, Homo sapiens
guagaucucaacacuggaagua

SEQ ID NO: 290643 - RNA, 22 nt, Homo sapiens
uuuacagucuuuugugugaguc

SEQ ID NO: 290644 - RNA, 22 nt, Homo sapiens
uuuacccugaggaaucuauuuu

SEQ ID NO: 290645 - RNA, 22 nt, Homo sapiens
uuuacugucuucagucccucug

SEQ ID NO: 290646 - RNA, 22 nt, Homo sapiens
uuuacugugggguuucuuagag

SEQ ID NO: 290647 - RNA, 22 nt, Homo sapiens
uuuagcaaagcaauuuacacca

SEQ ID NO: 290648 - RNA, 22 nt, Homo sapiens
uuuagcagcaaagagcuguguu

SEQ ID NO: 290649 - RNA, 22 nt, Homo sapiens
uuuagggcagggacaguucuuc

SEQ ID NO: 290650 - RNA, 22 nt, Homo sapiens
uuuagguauuugguauagcagu

SEQ ID NO: 290651 - RNA, 22 nt, Homo sapiens
uuuauccagccucuagcaaggu

SEQ ID NO: 290652 - RNA, 22 nt, Homo sapiens
uuuaucuguuuaaaacuguuca

SEQ ID NO: 290653 - RNA, 22 nt, Homo sapiens
uuuaugcuacauguguuggaaa

SEQ ID NO: 290654 - RNA, 22 nt, Homo sapiens
uuuauggagagauauuuauggu

SEQ ID NO: 290655 - RNA, 22 nt, Homo sapiens
uuuauguggagcacuugacaca

SEQ ID NO: 290656 - RNA, 22 nt, Homo sapiens
uuucaacaggucuggggugguc

SEQ ID NO: 290657 - RNA, 22 nt, Homo sapiens
uuucaacuaauuuuuuggugag

SEQ ID NO: 290658 - RNA, 18 nt, Homo sapiens
uuucaagucuuaggugac

SEQ ID NO: 290659 - RNA, 22 nt, Homo sapiens
uuucacaguguucucccccaga

SEQ ID NO: 290660 - RNA, 22 nt, Homo sapiens
uuucacguuggggaguugagug

SEQ ID NO: 290661 - RNA, 17 nt, Homo sapiens
uuucagaguggaagugu

SEQ ID NO: 290662 - RNA, 22 nt, Homo sapiens
uuucaggcagggagcuucagug

SEQ ID NO: 290663 - RNA, 18 nt, Homo sapiens
uuucaggguggacaugag

SEQ ID NO: 290664 - RNA, 20 nt, Homo sapiens
uuucaguacuuucuacuggc

SEQ ID NO: 290665 - RNA, 22 nt, Homo sapiens
uuucauccggcuguguauuaug

SEQ ID NO: 290666 - RNA, 22 nt, Homo sapiens
uuucauggacgcaaugccuuuu

SEQ ID NO: 290667 - RNA, 22 nt, Homo sapiens
uuuccaguuguucuagaaagcu

SEQ ID NO: 290668 - RNA, 22 nt, Homo sapiens
uuucccugaaggcucugaaguc

SEQ ID NO: 290669 - RNA, 22 nt, Homo sapiens
uuucccuuuagcuuagugauuu

SEQ ID NO: 290670 - RNA, 22 nt, Homo sapiens
uuucccuuugcuuugucagcca

SEQ ID NO: 290671 - RNA, 22 nt, Homo sapiens
uuuccuguagggggcaaggccu

SEQ ID NO: 290672 - RNA, 22 nt, Homo sapiens
uuucucaguguuucaggguagg

SEQ ID NO: 290673 - RNA, 22 nt, Homo sapiens
uuucugugguccucuugaaggu

SEQ ID NO: 290674 - RNA, 22 nt, Homo sapiens
uuugaagacuacugggagugaa

SEQ ID NO: 290675 - RNA, 22 nt, Homo sapiens
uuugaagcaauugugaauggga

SEQ ID NO: 290676 - RNA, 22 nt, Homo sapiens
uuugaauggaaguuuugugaaa

SEQ ID NO: 290677 - RNA, 18 nt, Homo sapiens
uuugacugguguccuuau

SEQ ID NO: 290678 - RNA, 22 nt, Homo sapiens
uuugagcaugcagauugccagg

SEQ ID NO: 290679 - RNA, 22 nt, Homo sapiens
uuugagcuugacucagcuggag

SEQ ID NO: 290680 - RNA, 22 nt, Homo sapiens
uuugaugcaucucuacuuuguu

SEQ ID NO: 290681 - RNA, 22 nt, Homo sapiens
uuugauguccaccucagcccac

SEQ ID NO: 290682 - RNA, 22 nt, Homo sapiens
uuugauguugagacuauaaagc

SEQ ID NO: 290683 - RNA, 22 nt, Homo sapiens
uuugauguugauacuaccuuca

SEQ ID NO: 290684 - RNA, 22 nt, Homo sapiens
uuugcacuggagauucaauggg

SEQ ID NO: 290685 - RNA, 22 nt, Homo sapiens
uuugcacuucugagugugacau

SEQ ID NO: 290686 - RNA, 23 nt, Homo sapiens
uuugcacuugcuccuucuauggc

SEQ ID NO: 290687 - RNA, 22 nt, Homo sapiens
uuugcacuuuuguaauaugguu

SEQ ID NO: 290688 - RNA, 20 nt, Homo sapiens
uuugcagaaucuaagaagag

SEQ ID NO: 290689 - RNA, 22 nt, Homo sapiens
uuugcaguguaguuggccagca

SEQ ID NO: 290690 - RNA, 22 nt, Homo sapiens
uuugcaguuuauuccuggggcu

SEQ ID NO: 290691 - RNA, 22 nt, Homo sapiens
uuugcaugcuccuuaugagaau

SEQ ID NO: 290692 - RNA, 22 nt, Homo sapiens
uuugccaauauuuuauugagga

SEQ ID NO: 290693 - RNA, 22 nt, Homo sapiens
uuugccacugcaggcuguuuaa

SEQ ID NO: 290694 - RNA, 22 nt, Homo sapiens
uuugcuuaaaguccuuguggga

SEQ ID NO: 290695 - RNA, 22 nt, Homo sapiens
uuuggaagaugccacuguauca

SEQ ID NO: 290696 - RNA, 22 nt, Homo sapiens
uuuggcaaagaucaacauguua

SEQ ID NO: 290697 - RNA, 22 nt, Homo sapiens
uuuggcagaaaacaagaaucug

SEQ ID NO: 290698 - RNA, 22 nt, Homo sapiens
uuuggcauuagagagacuugca

SEQ ID NO: 290699 - RNA, 22 nt, Homo sapiens
uuuggcucugugucccacccaa

SEQ ID NO: 290700 - RNA, 22 nt, Homo sapiens
uuuggcuguuucuggacuaaga

SEQ ID NO: 290701 - RNA, 22 nt, Homo sapiens
uuuggcuuugagaagcagugga

SEQ ID NO: 290702 - RNA, 22 nt, Homo sapiens
uuuggucccaaugugauaaggu

SEQ ID NO: 290703 - RNA, 22 nt, Homo sapiens
uuugguuauauauauacacucu

SEQ ID NO: 290704 - RNA, 22 nt, Homo sapiens
uuugguuauuugaaacuagcau

SEQ ID NO: 290705 - RNA, 22 nt, Homo sapiens
uuugguugucacaacuggggga

SEQ ID NO: 290706 - RNA, 22 nt, Homo sapiens
uuuguaagaugcauagauugca

SEQ ID NO: 290707 - RNA, 22 nt, Homo sapiens
uuuguacuaugguuuuucacua

SEQ ID NO: 290708 - RNA, 22 nt, Homo sapiens
uuuguacuccuuggccagcuuc

SEQ ID NO: 290709 - RNA, 22 nt, Homo sapiens
uuuguacuugguguucuggaaa

SEQ ID NO: 290710 - RNA, 22 nt, Homo sapiens
uuuguccccgcccagaucucau

SEQ ID NO: 290711 - RNA, 22 nt, Homo sapiens
uuuguccugccaugguuuauuu

SEQ ID NO: 290712 - RNA, 22 nt, Homo sapiens
uuugugaaugucauaagcucca

SEQ ID NO: 290713 - RNA, 23 nt, Homo sapiens
uuugugacacucuccaucuccag

SEQ ID NO: 290714 - RNA, 22 nt, Homo sapiens
uuugugacuugcuucucagaau

SEQ ID NO: 290715 - RNA, 22 nt, Homo sapiens
uuugugagguggauagauugca

SEQ ID NO: 290716 - RNA, 22 nt, Homo sapiens
uuugugcuaaugcuagauuacu

SEQ ID NO: 290717 - RNA, 23 nt, Homo sapiens
uuugugcuaauuuaugggcucuu

SEQ ID NO: 290718 - RNA, 22 nt, Homo sapiens
uuugugcuccugugagaaucua

SEQ ID NO: 290719 - RNA, 22 nt, Homo sapiens
uuugugcuccuguugagaaucu

SEQ ID NO: 290720 - RNA, 22 nt, Homo sapiens
uuugugcugcaauuaauuuccc

SEQ ID NO: 290721 - RNA, 22 nt, Homo sapiens
uuugugucccucuaaaauuuau

SEQ ID NO: 290722 - RNA, 16 nt, Homo sapiens
uuugugugugacgaga

SEQ ID NO: 290723 - RNA, 22 nt, Homo sapiens
uuugugugugauuauaaaaggu

SEQ ID NO: 290724 - RNA, 22 nt, Homo sapiens
uuuguucaccucaaggauggga

SEQ ID NO: 290725 - RNA, 22 nt, Homo sapiens
uuauguaggcuauagcucugca

SEQ ID NO: 290726 - RNA, 22 nt, Homo sapiens
uuaugucacuguucagucuccc

SEQ ID NO: 290727 - RNA, 22 nt, Homo sapiens
uuauuacuccuauuuuguagau

SEQ ID NO: 290728 - RNA, 22 nt, Homo sapiens
uuauuagcacccuaccaugugg

SEQ ID NO: 290729 - RNA, 22 nt, Homo sapiens
uuauugaguaaaaagaaugguu

SEQ ID NO: 290730 - RNA, 17 nt, Homo sapiens
uuauugcuauaagcuga

SEQ ID NO: 290731 - RNA, 22 nt, Homo sapiens
uucaaaguaaaaauguguucac

SEQ ID NO: 290732 - RNA, 22 nt, Homo sapiens
uucaacugcuucagccucccaa

SEQ ID NO: 290733 - RNA, 22 nt, Homo sapiens
uucaagauggcaccagugagug

SEQ ID NO: 290734 - RNA, 22 nt, Homo sapiens
uucaaguagguaggaccacagg

SEQ ID NO: 290735 - RNA, 22 nt, Homo sapiens
uucaagucaaggaaagaggucu

SEQ ID NO: 290736 - RNA, 22 nt, Homo sapiens
uucaagucaauuuuugaaugac

SEQ ID NO: 290737 - RNA, 22 nt, Homo sapiens
uucaauacuguugauccuuaug

SEQ ID NO: 290738 - RNA, 21 nt, Homo sapiens
uucacaagggaaguagggggc

SEQ ID NO: 290739 - RNA, 22 nt, Homo sapiens
uucacacugggccuacucugug

SEQ ID NO: 290740 - RNA, 22 nt, Homo sapiens
uucacagagagaacucaaacca

SEQ ID NO: 290741 - RNA, 22 nt, Homo sapiens
uucacaugguugccuuuugauc

SEQ ID NO: 290742 - RNA, 22 nt, Homo sapiens
uucaccagggaagucucaacuc

SEQ ID NO: 290743 - RNA, 22 nt, Homo sapiens
uucaccaguuuugucacgaaug

SEQ ID NO: 290744 - RNA, 22 nt, Homo sapiens
uucacccugguuguagauggac

SEQ ID NO: 290745 - RNA, 23 nt, Homo sapiens
uucaccguguuggccaggcuggu

SEQ ID NO: 290746 - RNA, 22 nt, Homo sapiens
uucaccuggaguucaggauaag

SEQ ID NO: 290747 - RNA, 22 nt, Homo sapiens
uucaccuggguuggccaucauu

SEQ ID NO: 290748 - RNA, 22 nt, Homo sapiens
uucaccuguagcaugcccuugg

SEQ ID NO: 290749 - RNA, 22 nt, Homo sapiens
uucacugcauuucagccugggc

SEQ ID NO: 290750 - RNA, 22 nt, Homo sapiens
uucacuggagcccaggaguugg

SEQ ID NO: 290751 - RNA, 22 nt, Homo sapiens
uucacuguaaaaugaagagggu

SEQ ID NO: 290752 - RNA, 22 nt, Homo sapiens
uucacuguuaagcaguuaaacu

SEQ ID NO: 290753 - RNA, 22 nt, Homo sapiens
uucagauugcauaccgaaagua

SEQ ID NO: 290754 - RNA, 20 nt, Homo sapiens
uucagcaaaggaaugggagu

SEQ ID NO: 290755 - RNA, 22 nt, Homo sapiens
uucagcaguggccaguggaaau

SEQ ID NO: 290756 - RNA, 22 nt, Homo sapiens
uagagugcugucaaagacuugu

SEQ ID NO: 290757 - RNA, 22 nt, Homo sapiens
uagaguguuuuguuaggcagca

SEQ ID NO: 290758 - RNA, 21 nt, Homo sapiens
uagauaguugguucugaaucu

SEQ ID NO: 290759 - RNA, 23 nt, Homo sapiens
uagaucaucaaguuuacugugcu

SEQ ID NO: 290760 - RNA, 20 nt, Homo sapiens
uagaugcauuuagauucauu

SEQ ID NO: 290761 - RNA, 22 nt, Homo sapiens
uagauuaucccugauuugucca

SEQ ID NO: 290762 - RNA, 22 nt, Homo sapiens
uagcaagaugaauuugugcaaa

SEQ ID NO: 290763 - RNA, 23 nt, Homo sapiens
uagcacuuuuuacauauggacau

SEQ ID NO: 290764 - RNA, 22 nt, Homo sapiens
uagcagcaccccacucuacugg

SEQ ID NO: 290765 - RNA, 20 nt, Homo sapiens
uagcagcagacagagggagg

SEQ ID NO: 290766 - RNA, 22 nt, Homo sapiens
uagcagcaucucuggcuucuac

SEQ ID NO: 290767 - RNA, 22 nt, Homo sapiens
uagcagcuuuauugagguaaau

SEQ ID NO: 290768 - RNA, 22 nt, Homo sapiens
uagcaggaaaggggucagaucu

SEQ ID NO: 290769 - RNA, 20 nt, Homo sapiens
uagcaggugucaggugauau

SEQ ID NO: 290770 - RNA, 22 nt, Homo sapiens
uagcagguguuccacaaauauu

SEQ ID NO: 290771 - RNA, 22 nt, Homo sapiens
uagcaguauggagcgaggccca

SEQ ID NO: 290772 - RNA, 22 nt, Homo sapiens
uagcaguucauuguugugugaa

SEQ ID NO: 290773 - RNA, 22 nt, Homo sapiens
uagcauccuucucuaaacagga

SEQ ID NO: 290774 - RNA, 22 nt, Homo sapiens
uagcauggaggcggccauagug

SEQ ID NO: 290775 - RNA, 21 nt, Homo sapiens
uagcuacacugugauucaugg

SEQ ID NO: 290776 - RNA, 22 nt, Homo sapiens
uagcuccacagcuauauauaau

SEQ ID NO: 290777 - RNA, 22 nt, Homo sapiens
uagcuccagugggguuacugcu

SEQ ID NO: 290778 - RNA, 21 nt, Homo sapiens
uagcugaugauguaggggaug

SEQ ID NO: 290779 - RNA, 22 nt, Homo sapiens
uagcugcauccugugcacucaa

SEQ ID NO: 290780 - RNA, 22 nt, Homo sapiens
uagcuggaauuacuugcaccug

SEQ ID NO: 290781 - RNA, 22 nt, Homo sapiens
uagcuggaguuuuuguuauagg

SEQ ID NO: 290782 - RNA, 22 nt, Homo sapiens
uagcugguucuccaggagcuag

SEQ ID NO: 290783 - RNA, 22 nt, Homo sapiens
uaggaaguuucuugauuacuua

SEQ ID NO: 290784 - RNA, 22 nt, Homo sapiens
uaggacaaugguacagcagaaa

SEQ ID NO: 290785 - RNA, 22 nt, Homo sapiens
uaggacacagaccuggauggaa

SEQ ID NO: 290786 - RNA, 22 nt, Homo sapiens
uaggacacagauggagaaaagc

SEQ ID NO: 290787 - RNA, 22 nt, Homo sapiens
uaggacauugcccuuguggaga

SEQ ID NO: 290788 - RNA, 19 nt, Homo sapiens
uaggacccugguggccccc

SEQ ID NO: 290789 - RNA, 22 nt, Homo sapiens
uaggacuuuucuugagagugac

SEQ ID NO: 290790 - RNA, 22 nt, Homo sapiens
uaggagcauaggauuguuugag

SEQ ID NO: 290791 - RNA, 22 nt, Homo sapiens
uaggcacacaucuacuacaaau

SEQ ID NO: 290792 - RNA, 22 nt, Homo sapiens
uaggcuuuuggacccugucucu

SEQ ID NO: 290793 - RNA, 22 nt, Homo sapiens
uagggagugucuucauuuugua

SEQ ID NO: 290794 - RNA, 22 nt, Homo sapiens
uagggcuugugaucagguguag

SEQ ID NO: 290795 - RNA, 22 nt, Homo sapiens
uagguaaguaauauacagauga

SEQ ID NO: 290796 - RNA, 22 nt, Homo sapiens
uagguaaguaugugugaugggg

SEQ ID NO: 290797 - RNA, 22 nt, Homo sapiens
uagguagguggaaaaguaauug

SEQ ID NO: 290798 - RNA, 22 nt, Homo sapiens
aagugcaaaucuguggcugaaa

SEQ ID NO: 290799 - RNA, 22 nt, Homo sapiens
aagugcaaauucccaggcucug

SEQ ID NO: 290800 - RNA, 22 nt, Homo sapiens
aagugcccuauuuggcccuuga

SEQ ID NO: 290801 - RNA, 20 nt, Homo sapiens
aagugcuauuucuuuugugg

SEQ ID NO: 290802 - RNA, 22 nt, Homo sapiens
aagugcuucagaagacaauauu

SEQ ID NO: 290803 - RNA, 22 nt, Homo sapiens
aagugcuuuuuagauaugguuu

SEQ ID NO: 290804 - RNA, 22 nt, Homo sapiens
aaguggaauguuuguggcacaa

SEQ ID NO: 290805 - RNA, 22 nt, Homo sapiens
aaguggcauugaggaaaaaaau

SEQ ID NO: 290806 - RNA, 17 nt, Homo sapiens
aaguggcuuguucacca

SEQ ID NO: 290807 - RNA, 23 nt, Homo sapiens
aagugguuuugaacccggacccu

SEQ ID NO: 290808 - RNA, 22 nt, Homo sapiens
aaguuguaguuagagaguugcu

SEQ ID NO: 290809 - RNA, 21 nt, Homo sapiens
aauaaagcaaccuuaugccau

SEQ ID NO: 290810 - RNA, 22 nt, Homo sapiens
aauaaguugagaugaggucaua

SEQ ID NO: 290811 - RNA, 22 nt, Homo sapiens
aauaaugucacaggggguuagc

SEQ ID NO: 290812 - RNA, 22 nt, Homo sapiens
aauacucuauaagggaagcugu

SEQ ID NO: 290813 - RNA, 22 nt, Homo sapiens
aauacuggcacugaagaccaug

SEQ ID NO: 290814 - RNA, 22 nt, Homo sapiens
aauacuuccaaaucuagucauu

SEQ ID NO: 290815 - RNA, 23 nt, Homo sapiens
aauaucacaguggguguacaccc

SEQ ID NO: 290816 - RNA, 22 nt, Homo sapiens
aauauguccaguguuuugggag

SEQ ID NO: 290817 - RNA, 22 nt, Homo sapiens
aaucaacauuguuuuaagucaa

SEQ ID NO: 290818 - RNA, 22 nt, Homo sapiens
aaucacuaugccaugaaguaca

SEQ ID NO: 290819 - RNA, 22 nt, Homo sapiens
aaucacuuugcuacaaggcagu

SEQ ID NO: 290820 - RNA, 22 nt, Homo sapiens
aaucagcacacugugcuuucca

SEQ ID NO: 290821 - RNA, 22 nt, Homo sapiens
aaucccuuuguccagucucuuu

SEQ ID NO: 290822 - RNA, 20 nt, Homo sapiens
aaucuacuugcccauuuagc

SEQ ID NO: 290823 - RNA, 22 nt, Homo sapiens
aaucucagcauuuugggcugag

SEQ ID NO: 290824 - RNA, 22 nt, Homo sapiens
aaucugauguuaucagcuuaag

SEQ ID NO: 290825 - RNA, 22 nt, Homo sapiens
aaucugucuuuuguuauugagg

SEQ ID NO: 290826 - RNA, 22 nt, Homo sapiens
aaugcaagauguuaauuauagg

SEQ ID NO: 290827 - RNA, 22 nt, Homo sapiens
aaugcauaauuuguaugaggua

SEQ ID NO: 290828 - RNA, 22 nt, Homo sapiens
aaugccaucagagaaaacucuu

SEQ ID NO: 290829 - RNA, 22 nt, Homo sapiens
aauggcaagagccacagaggcg

SEQ ID NO: 290830 - RNA, 22 nt, Homo sapiens
aauggcacacaccuggucuaac

SEQ ID NO: 290831 - RNA, 22 nt, Homo sapiens
aauggcauuugccagggcaaag

SEQ ID NO: 290832 - RNA, 22 nt, Homo sapiens
aaugggacugacgccucccaga

SEQ ID NO: 290833 - RNA, 22 nt, Homo sapiens
aaugucaucuucaguuguacag

SEQ ID NO: 290834 - RNA, 22 nt, Homo sapiens
aaugugccuacagugggcuguu

SEQ ID NO: 290835 - RNA, 22 nt, Homo sapiens
aauuacauggcaauugggaaau

SEQ ID NO: 290836 - RNA, 22 nt, Homo sapiens
aauuacuucuacaccaaccuaa

SEQ ID NO: 290837 - RNA, 22 nt, Homo sapiens
aauuaggcuagaauguuauuaa

SEQ ID NO: 290838 - RNA, 22 nt, Homo sapiens
aauuaguugaaagucugcuuuu

SEQ ID NO: 290839 - RNA, 22 nt, Homo sapiens
aauugaaugcagaugccaggga

SEQ ID NO: 290840 - RNA, 22 nt, Homo sapiens
aauugcaauggacaaugcagca

SEQ ID NO: 290841 - RNA, 23 nt, Homo sapiens
aauugcacauuccuugcuggcag

SEQ ID NO: 290842 - RNA, 22 nt, Homo sapiens
aauugguuaagauaagaucaua

SEQ ID NO: 290843 - RNA, 22 nt, Homo sapiens
aauuguacucccauaauucccu

SEQ ID NO: 290844 - RNA, 20 nt, Homo sapiens
acaaaugcauucugugacau

SEQ ID NO: 290845 - RNA, 22 nt, Homo sapiens
acaagacuucuuguauucuagu

SEQ ID NO: 290846 - RNA, 22 nt, Homo sapiens
acacaugcuccacuguggccuc

SEQ ID NO: 290847 - RNA, 22 nt, Homo sapiens
acaccaugucuguuucugguuu

SEQ ID NO: 290848 - RNA, 22 nt, Homo sapiens
acacgugcguauauguacguau

SEQ ID NO: 290849 - RNA, 22 nt, Homo sapiens
acacguguugaaauuuaauugc

SEQ ID NO: 290850 - RNA, 22 nt, Homo sapiens
acacuggaguuaaaggugauuu

SEQ ID NO: 290851 - RNA, 22 nt, Homo sapiens
acacuguauccuucuguccuuu

SEQ ID NO: 290852 - RNA, 22 nt, Homo sapiens
acacugucaugucucacaggca

SEQ ID NO: 290853 - RNA, 22 nt, Homo sapiens
acacuguuuuaguuauuauagc

SEQ ID NO: 290854 - RNA, 22 nt, Homo sapiens
acacuguuuuguggagaaugua

SEQ ID NO: 290855 - RNA, 22 nt, Homo sapiens
acagaauucucagaacugggag

SEQ ID NO: 290856 - RNA, 22 nt, Homo sapiens
acagaccuauuucaaucauuua

SEQ ID NO: 290857 - RNA, 19 nt, Homo sapiens
acagcugguuuugguuucu

SEQ ID NO: 290858 - RNA, 22 nt, Homo sapiens
acaguacucugcucuuuugauu

SEQ ID NO: 290859 - RNA, 22 nt, Homo sapiens
acaguagugggcuacagaauca

SEQ ID NO: 290860 - RNA, 22 nt, Homo sapiens
acagugucugacacguaggaag

SEQ ID NO: 290861 - RNA, 18 nt, Homo sapiens
acaguguguaaggguucu

SEQ ID NO: 290862 - RNA, 22 nt, Homo sapiens
acaguuaugugagggccaccag

SEQ ID NO: 290863 - RNA, 22 nt, Homo sapiens
cacaaccuccgccuccuggguu

SEQ ID NO: 290864 - RNA, 22 nt, Homo sapiens
cacaaugucugguaggccacuu

SEQ ID NO: 290865 - RNA, 22 nt, Homo sapiens
cacacugucuucaauggguggu

SEQ ID NO: 290866 - RNA, 22 nt, Homo sapiens
cacagcuagucaaugguagaca

SEQ ID NO: 290867 - RNA, 23 nt, Homo sapiens
cacagggugaacaccccuaaucc

SEQ ID NO: 290868 - RNA, 22 nt, Homo sapiens
cacaguagaauagagcacuagg

SEQ ID NO: 290869 - RNA, 22 nt, Homo sapiens
cacagucuugcaauauugagau

SEQ ID NO: 290870 - RNA, 22 nt, Homo sapiens
cacaguguucauagccaucagg

SEQ ID NO: 290871 - RNA, 22 nt, Homo sapiens
cacauguuugcuacauuuuucu

SEQ ID NO: 290872 - RNA, 22 nt, Homo sapiens
cacauguuuuagcauggcuguu

SEQ ID NO: 290873 - RNA, 22 nt, Homo sapiens
caccacuacaccccaggcuggg

SEQ ID NO: 290874 - RNA, 22 nt, Homo sapiens
caccagguggcugaggccauga

SEQ ID NO: 290875 - RNA, 19 nt, Homo sapiens
caccagugcaugcuacuau

SEQ ID NO: 290876 - RNA, 22 nt, Homo sapiens
caccgagugugccaucuucuca

SEQ ID NO: 290877 - RNA, 19 nt, Homo sapiens
caccgccugcccccugcug

SEQ ID NO: 290878 - RNA, 22 nt, Homo sapiens
caccugagcgggaugcucgccu

SEQ ID NO: 290879 - RNA, 22 nt, Homo sapiens
caccuugugauccacccgccuu

SEQ ID NO: 290880 - RNA, 22 nt, Homo sapiens
cacuaccucuacaggcagcugg

SEQ ID NO: 290881 - RNA, 22 nt, Homo sapiens
cacuaggcuggagugcaguggc

SEQ ID NO: 290882 - RNA, 18 nt, Homo sapiens
cacugagcccuucacucu

SEQ ID NO: 290883 - RNA, 22 nt, Homo sapiens
cacugcacuccagucccgucuc

SEQ ID NO: 290884 - RNA, 22 nt, Homo sapiens
cacugcauccucugccuggcgg

SEQ ID NO: 290885 - RNA, 22 nt, Homo sapiens
cacugcauccuugaccuucugg

SEQ ID NO: 290886 - RNA, 22 nt, Homo sapiens
cacugcauggccacccauguua

SEQ ID NO: 290887 - RNA, 22 nt, Homo sapiens
cacugcgaccuccaccucccgg

SEQ ID NO: 290888 - RNA, 22 nt, Homo sapiens
cacugcgaccucugccuaccgg

SEQ ID NO: 290889 - RNA, 22 nt, Homo sapiens
cacugcgacguccgccucccgg

SEQ ID NO: 290890 - RNA, 23 nt, Homo sapiens
cacugggcagcagguguucccag

SEQ ID NO: 290891 - RNA, 22 nt, Homo sapiens
cacugggugagauccauguuua

SEQ ID NO: 290892 - RNA, 21 nt, Homo sapiens
cacugguguugcuauaucaaa

SEQ ID NO: 290893 - RNA, 22 nt, Homo sapiens
cacuguggauggaacuauguga

SEQ ID NO: 290894 - RNA, 18 nt, Homo sapiens
cacuuggcuuugccccuc

SEQ ID NO: 290895 - RNA, 22 nt, Homo sapiens
cagacaugucuuguggccgugg

SEQ ID NO: 290896 - RNA, 22 nt, Homo sapiens
cagagaacauucagagcuguag

SEQ ID NO: 290897 - RNA, 22 nt, Homo sapiens
cagagaaugucuuuuuuaacca

SEQ ID NO: 290898 - RNA, 22 nt, Homo sapiens
cagagcacugauacuggguucu

SEQ ID NO: 290899 - RNA, 22 nt, Homo sapiens
cagaugcaugaccugggcuugg

SEQ ID NO: 290900 - RNA, 22 nt, Homo sapiens
cagcacauuacaaguacuuggu

SEQ ID NO: 290901 - RNA, 22 nt, Homo sapiens
cagcagguuuuuaucaguuaag

SEQ ID NO: 290902 - RNA, 22 nt, Homo sapiens
cagcaguuguuucggauuggga

SEQ ID NO: 290903 - RNA, 23 nt, Homo sapiens
cagcucauuuggguccccuuguc

SEQ ID NO: 290904 - RNA, 22 nt, Homo sapiens
cagcuggugcugcaccaguggg

SEQ ID NO: 290905 - RNA, 22 nt, Homo sapiens
cagcugguguuacaaaccagag

SEQ ID NO: 290906 - RNA, 22 nt, Homo sapiens
caggcauuguccaugcugaagg

SEQ ID NO: 290907 - RNA, 22 nt, Homo sapiens
caggguccccuaccuuuugaug

SEQ ID NO: 290908 - RNA, 22 nt, Homo sapiens
caggugaaugccucuccuucug

SEQ ID NO: 290909 - RNA, 22 nt, Homo sapiens
caggugcauuggcugacaccug

SEQ ID NO: 290910 - RNA, 22 nt, Homo sapiens
caggugcuuacuuaauagccau

SEQ ID NO: 290911 - RNA, 22 nt, Homo sapiens
caguacaauguugauuagaagu

SEQ ID NO: 290912 - RNA, 22 nt, Homo sapiens
cagugcaaagccucugcccaga

SEQ ID NO: 290913 - RNA, 18 nt, Homo sapiens
cagugcaauacaggagag

SEQ ID NO: 290914 - RNA, 22 nt, Homo sapiens
cagugcauguggcacucuccag

SEQ ID NO: 290915 - RNA, 22 nt, Homo sapiens
cagugcuuuaucaaguccucca

SEQ ID NO: 290916 - RNA, 22 nt, Homo sapiens
caguggaugaacaagaagugau

SEQ ID NO: 290917 - RNA, 22 nt, Homo sapiens
cagugguuuucaacccugguug

SEQ ID NO: 290918 - RNA, 22 nt, Homo sapiens
cauaaagauggaggaggccagg

SEQ ID NO: 290919 - RNA, 22 nt, Homo sapiens
cauaaaucuuguugaauagcac

SEQ ID NO: 290920 - RNA, 22 nt, Homo sapiens
cauacagcuaguaaguguaaga

SEQ ID NO: 290921 - RNA, 22 nt, Homo sapiens
cauauucacuuuacagagcugu

SEQ ID NO: 290922 - RNA, 22 nt, Homo sapiens
caucacagcaaguagggagugg

SEQ ID NO: 290923 - RNA, 23 nt, Homo sapiens
caucacauagaggaaagaggaca

SEQ ID NO: 290924 - RNA, 22 nt, Homo sapiens
caucacaucugcaugguaagua

SEQ ID NO: 290925 - RNA, 21 nt, Homo sapiens
caucacauuacucaaaguccu

SEQ ID NO: 290926 - RNA, 22 nt, Homo sapiens
caucccugucgucaagucucug

SEQ ID NO: 290927 - RNA, 22 nt, Homo sapiens
caugacacauguuuaccuaugu

SEQ ID NO: 290928 - RNA, 22 nt, Homo sapiens
caugcacugagagggucucggc

SEQ ID NO: 290929 - RNA, 22 nt, Homo sapiens
cauggagcuaggcuugaucccu

SEQ ID NO: 290930 - RNA, 22 nt, Homo sapiens
cauggcacauauauaucuaggu

SEQ ID NO: 290931 - RNA, 22 nt, Homo sapiens
cauggcacugagcagguaugca

SEQ ID NO: 290932 - RNA, 22 nt, Homo sapiens
cauggcaucuguguggccucca

SEQ ID NO: 290933 - RNA, 22 nt, Homo sapiens
cauggcucuuguuuacucccag

SEQ ID NO: 290934 - RNA, 22 nt, Homo sapiens
cauggcucuuugcugcuaaagu

SEQ ID NO: 290935 - RNA, 22 nt, Homo sapiens
cauggcuuguauaagauucuca

SEQ ID NO: 290936 - RNA, 22 nt, Homo sapiens
cauguauagauuccauaguggu

SEQ ID NO: 290937 - RNA, 21 nt, Homo sapiens
caugucacugcacucuagccu

SEQ ID NO: 290938 - RNA, 22 nt, Homo sapiens
caugugcaugagcacauacgug

SEQ ID NO: 290939 - RNA, 22 nt, Homo sapiens
caugugcaugcuuucuuaugug

SEQ ID NO: 290940 - RNA, 22 nt, Homo sapiens
cauuaguugaagugcagggaga

SEQ ID NO: 290941 - RNA, 22 nt, Homo sapiens
cauuccacuggauaaacaaggu

SEQ ID NO: 290942 - RNA, 19 nt, Homo sapiens
cauugcacuccacccuggg

SEQ ID NO: 290943 - RNA, 22 nt, Homo sapiens
cauugcacuccagccucggcaa

SEQ ID NO: 290944 - RNA, 22 nt, Homo sapiens
cauugcacuccagccuggccaa

SEQ ID NO: 290945 - RNA, 22 nt, Homo sapiens
cauugcacuccagccuuggcaa

SEQ ID NO: 290946 - RNA, 22 nt, Homo sapiens
cuauggcucugguuauggcugu

SEQ ID NO: 290947 - RNA, 22 nt, Homo sapiens
cuauuagguuggugcaaaaguc

SEQ ID NO: 290948 - RNA, 22 nt, Homo sapiens
cuauucacaggcaauauguaca

SEQ ID NO: 290949 - RNA, 19 nt, Homo sapiens
cuauugcacauagcugaag

SEQ ID NO: 290950 - RNA, 22 nt, Homo sapiens
cucaaagugcuaagauuaggcu

SEQ ID NO: 290951 - RNA, 22 nt, Homo sapiens
cucaaaguguggucuguggguu

SEQ ID NO: 290952 - RNA, 18 nt, Homo sapiens
cucacacccuaaucagga

SEQ ID NO: 290953 - RNA, 20 nt, Homo sapiens
cucacagacagcuucuuucu

SEQ ID NO: 290954 - RNA, 18 nt, Homo sapiens
cucacaguaacuuuuaag

SEQ ID NO: 290955 - RNA, 22 nt, Homo sapiens
cucaccuugugauccuccugcc

SEQ ID NO: 290956 - RNA, 22 nt, Homo sapiens
cucacugugguguccuuaggua

SEQ ID NO: 290957 - RNA, 22 nt, Homo sapiens
cucagcaguggauuuaccacca

SEQ ID NO: 290958 - RNA, 22 nt, Homo sapiens
cucagcuacuugggaagcugag

SEQ ID NO: 290959 - RNA, 20 nt, Homo sapiens
cucagugcacccccauaaaa

SEQ ID NO: 290960 - RNA, 22 nt, Homo sapiens
cucaguggauuagauaaugcac

SEQ ID NO: 290961 - RNA, 22 nt, Homo sapiens
cucaguguucccauucuaccuu

SEQ ID NO: 290962 - RNA, 21 nt, Homo sapiens
cucauauugcuuuuccauggu

SEQ ID NO: 290963 - RNA, 22 nt, Homo sapiens
cucauggagaaccucugcuagg

SEQ ID NO: 290964 - RNA, 22 nt, Homo sapiens
cuccagugcaaagucaugauca

SEQ ID NO: 290965 - RNA, 22 nt, Homo sapiens
cuccauuuaguccuuuuagaag

SEQ ID NO: 290966 - RNA, 23 nt, Homo sapiens
cucccugaacaugacacaccaga

SEQ ID NO: 290967 - RNA, 20 nt, Homo sapiens
cucccugacaaauguggaaa

SEQ ID NO: 290968 - RNA, 22 nt, Homo sapiens
cuccuggugauuggagugugaa

SEQ ID NO: 290969 - RNA, 20 nt, Homo sapiens
cuccuucauuccuuuggacc

SEQ ID NO: 290970 - RNA, 22 nt, Homo sapiens
cuccuugauuagaguauagagu

SEQ ID NO: 290971 - RNA, 22 nt, Homo sapiens
cucgagagaaaaugcuucacug

SEQ ID NO: 290972 - RNA, 22 nt, Homo sapiens
cucucaagaugcugggauuaca

SEQ ID NO: 290973 - RNA, 22 nt, Homo sapiens
cucucaguguggaggccagaaa

SEQ ID NO: 290974 - RNA, 22 nt, Homo sapiens
cucucugagccauggcugcccu

SEQ ID NO: 290975 - RNA, 22 nt, Homo sapiens
cucugagguuauucguaauauu

SEQ ID NO: 290976 - RNA, 22 nt, Homo sapiens
cucugcuuaaugucccacuuga

SEQ ID NO: 290977 - RNA, 22 nt, Homo sapiens
cucugguuaaggcugaacuaua

SEQ ID NO: 290978 - RNA, 22 nt, Homo sapiens
cucugguuucgcaggaaauaga

SEQ ID NO: 290979 - RNA, 22 nt, Homo sapiens
cucuuacaguguguggugaaag

SEQ ID NO: 290980 - RNA, 22 nt, Homo sapiens
cucuuagauuagccauccuaau

SEQ ID NO: 290981 - RNA, 22 nt, Homo sapiens
cucuuggguagauuuugcagag

SEQ ID NO: 290982 - RNA, 22 nt, Homo sapiens
cugaaagguauacgcuuguuau

SEQ ID NO: 290983 - RNA, 22 nt, Homo sapiens
cugaagugcuugccacauaaaa

SEQ ID NO: 290984 - RNA, 22 nt, Homo sapiens
cugaagugugaaagucuuuuuu

SEQ ID NO: 290985 - RNA, 22 nt, Homo sapiens
cugaauagucaacgauggacug

SEQ ID NO: 290986 - RNA, 20 nt, Homo sapiens
cugaaugucaaggcagaggu

SEQ ID NO: 290987 - RNA, 22 nt, Homo sapiens
cugaauguucuauagaagccgc

SEQ ID NO: 290988 - RNA, 22 nt, Homo sapiens
cugaauguuucacucugaaaug

SEQ ID NO: 290989 - RNA, 22 nt, Homo sapiens
cugaccauagacuacucugggc

SEQ ID NO: 290990 - RNA, 17 nt, Homo sapiens
cugaccucauuguguac

SEQ ID NO: 290991 - RNA, 22 nt, Homo sapiens
cugaccucugucaaagacaccc

SEQ ID NO: 290992 - RNA, 22 nt, Homo sapiens
cugacguguuuuccagaccuuu

SEQ ID NO: 290993 - RNA, 22 nt, Homo sapiens
cugacugaggaucaguucauca

SEQ ID NO: 290994 - RNA, 22 nt, Homo sapiens
cugagaagaaacagguaaggac

SEQ ID NO: 290995 - RNA, 22 nt, Homo sapiens
cugagacuggguaauguauaaa

SEQ ID NO: 290996 - RNA, 22 nt, Homo sapiens
cugagagaugagaccucucacu

SEQ ID NO: 290997 - RNA, 22 nt, Homo sapiens
cugagcaaaguucuauuuaugg

SEQ ID NO: 290998 - RNA, 22 nt, Homo sapiens
cugagcaagucauuuuguuaaa

SEQ ID NO: 290999 - RNA, 22 nt, Homo sapiens
cugagcaauauagugagaucuu

SEQ ID NO: 291000 - RNA, 22 nt, Homo sapiens
cugagcucauuucuuuugcuac

SEQ ID NO: 291001 - RNA, 22 nt, Homo sapiens
cugaggcacggcgaccuuaagu

SEQ ID NO: 291002 - RNA, 22 nt, Homo sapiens
cugaggugggagaaucacauaa

SEQ ID NO: 291003 - RNA, 22 nt, Homo sapiens
cugaggugggaggauuacuuga

SEQ ID NO: 291004 - RNA, 22 nt, Homo sapiens
cugaggugggaggauuggcuug

SEQ ID NO: 291005 - RNA, 22 nt, Homo sapiens
cugaggugggaguuuuucucau

SEQ ID NO: 291006 - RNA, 22 nt, Homo sapiens
cugagguuguucuucucagugg

SEQ ID NO: 291007 - RNA, 22 nt, Homo sapiens
cugauaguucucuuuagaguuu

SEQ ID NO: 291008 - RNA, 22 nt, Homo sapiens
cugauugucaucaauauuauua

SEQ ID NO: 291009 - RNA, 19 nt, Homo sapiens
cugcacugagaaaaggagg

SEQ ID NO: 291010 - RNA, 22 nt, Homo sapiens
cugcacugagacccucuuugcu

SEQ ID NO: 291011 - RNA, 22 nt, Homo sapiens
cugcagucaucugaagauuuug

SEQ ID NO: 291012 - RNA, 22 nt, Homo sapiens
cugcauaaucaucucucugcau

SEQ ID NO: 291013 - RNA, 21 nt, Homo sapiens
cugcauccauuucugagugau

SEQ ID NO: 291014 - RNA, 19 nt, Homo sapiens
cugcaugagacaguugguu

SEQ ID NO: 291015 - RNA, 22 nt, Homo sapiens
cugccacugacaccucaaggac

SEQ ID NO: 291016 - RNA, 22 nt, Homo sapiens
cugccuaaagaaaaagacguug

SEQ ID NO: 291017 - RNA, 22 nt, Homo sapiens
cuggaaagcaaguccauugcuc

SEQ ID NO: 291018 - RNA, 22 nt, Homo sapiens
cuggaagaaaaucacgccaucu

SEQ ID NO: 291019 - RNA, 22 nt, Homo sapiens
cuggaagcacaacgcauuuauu

SEQ ID NO: 291020 - RNA, 22 nt, Homo sapiens
cuggaauguuccuaaagauuca

SEQ ID NO: 291021 - RNA, 22 nt, Homo sapiens
cuggaauucaaaaucugaauuu

SEQ ID NO: 291022 - RNA, 22 nt, Homo sapiens
cuggagcaaaggugacucuugu

SEQ ID NO: 291023 - RNA, 22 nt, Homo sapiens
cuggagcauugguggauuuguu

SEQ ID NO: 291024 - RNA, 22 nt, Homo sapiens
cuggaguuugaggcugcaguga

SEQ ID NO: 291025 - RNA, 22 nt, Homo sapiens
cuggcaaauguuuucuguaaag

SEQ ID NO: 291026 - RNA, 22 nt, Homo sapiens
cuggcacagugucagaaacaca

SEQ ID NO: 291027 - RNA, 22 nt, Homo sapiens
cuggcaccauuuugaucaaagg

SEQ ID NO: 291028 - RNA, 22 nt, Homo sapiens
cuggccagagacauucauuaaa

SEQ ID NO: 291029 - RNA, 22 nt, Homo sapiens
cuggcucugagguguuuagggc

SEQ ID NO: 291030 - RNA, 22 nt, Homo sapiens
gaaucacugugguaucccaugc

SEQ ID NO: 291031 - RNA, 22 nt, Homo sapiens
gaaucccuugcauuaucccuuu

SEQ ID NO: 291032 - RNA, 22 nt, Homo sapiens
gaaugcagcagugacagggcug

SEQ ID NO: 291033 - RNA, 22 nt, Homo sapiens
gaaugcaugaggggaucagaug

SEQ ID NO: 291034 - RNA, 22 nt, Homo sapiens
gacaccugguguggaacuggag

SEQ ID NO: 291035 - RNA, 22 nt, Homo sapiens
gacacuggguguuuguuggcgu

SEQ ID NO: 291036 - RNA, 22 nt, Homo sapiens
gacagacacaauugauccauga

SEQ ID NO: 291037 - RNA, 22 nt, Homo sapiens
gacagugugauacuuagucuca

SEQ ID NO: 291038 - RNA, 18 nt, Homo sapiens
gacaguguggcaauuccu

SEQ ID NO: 291039 - RNA, 20 nt, Homo sapiens
gacauaggcugguaucuggc

SEQ ID NO: 291040 - RNA, 22 nt, Homo sapiens
gacccucuagauggaagcacug

SEQ ID NO: 291041 - RNA, 22 nt, Homo sapiens
gacccuuagaaugugaucuuau

SEQ ID NO: 291042 - RNA, 22 nt, Homo sapiens
gaccuuguagaaucucaugauu

SEQ ID NO: 291043 - RNA, 22 nt, Homo sapiens
gacugaggaagcgcucucuccu

SEQ ID NO: 291044 - RNA, 22 nt, Homo sapiens
gacuggagcuguaugugguuac

SEQ ID NO: 291045 - RNA, 22 nt, Homo sapiens
gacuggcuguuuucuuuauuau

SEQ ID NO: 291046 - RNA, 22 nt, Homo sapiens
gacuggguuaguuugaaagacu

SEQ ID NO: 291047 - RNA, 20 nt, Homo sapiens
gacuucagaagcuucagagu

SEQ ID NO: 291048 - RNA, 18 nt, Homo sapiens
gacuuggaguuuacagug

SEQ ID NO: 291049 - RNA, 22 nt, Homo sapiens
gacuuugguagaggaaaaaucu

SEQ ID NO: 291050 - RNA, 22 nt, Homo sapiens
gagaacugacauuaucguguau

SEQ ID NO: 291051 - RNA, 22 nt, Homo sapiens
gagaacugagauaagugauauu

SEQ ID NO: 291052 - RNA, 21 nt, Homo sapiens
gagaaucaucauggcugcaua

SEQ ID NO: 291053 - RNA, 22 nt, Homo sapiens
gagaaugagaggggaaggccac

SEQ ID NO: 291054 - RNA, 22 nt, Homo sapiens
gagacauguuugcuuaucugag

SEQ ID NO: 291055 - RNA, 22 nt, Homo sapiens
gagacuaaagagcuugcccugg

SEQ ID NO: 291056 - RNA, 22 nt, Homo sapiens
gagacugagucuugcccuguca

SEQ ID NO: 291057 - RNA, 22 nt, Homo sapiens
gagacugagucuugcucuguca

SEQ ID NO: 291058 - RNA, 22 nt, Homo sapiens
gagacugagucuugcuuuguca

SEQ ID NO: 291059 - RNA, 22 nt, Homo sapiens
gagagugaaguuugcuaccugu

SEQ ID NO: 291060 - RNA, 22 nt, Homo sapiens
gagagugcuuggcaucugcuga

SEQ ID NO: 291061 - RNA, 22 nt, Homo sapiens
gagauaaauaggucacaguucu

SEQ ID NO: 291062 - RNA, 22 nt, Homo sapiens
gagauacuugguuucuguuucu

SEQ ID NO: 291063 - RNA, 21 nt, Homo sapiens
gagauagguaccgaagcuuag

SEQ ID NO: 291064 - RNA, 22 nt, Homo sapiens
gagauauuuagaaauguguucu

SEQ ID NO: 291065 - RNA, 22 nt, Homo sapiens
gagaucaugcugguucucucau

SEQ ID NO: 291066 - RNA, 22 nt, Homo sapiens
gagaucauguacuagaacaccu

SEQ ID NO: 291067 - RNA, 22 nt, Homo sapiens
gagaucauucugauccagaguc

SEQ ID NO: 291068 - RNA, 23 nt, Homo sapiens
gagaucauucuggaauuagagug

SEQ ID NO: 291069 - RNA, 22 nt, Homo sapiens
gagauggagucuuuuucuguca

SEQ ID NO: 291070 - RNA, 22 nt, Homo sapiens
gagauggugugcuguuggaagu

SEQ ID NO: 291071 - RNA, 22 nt, Homo sapiens
gagaugugugugauuauauaau

SEQ ID NO: 291072 - RNA, 22 nt, Homo sapiens
gagauguuuguuucacugucac

SEQ ID NO: 291073 - RNA, 22 nt, Homo sapiens
gagauuauuagauguucugcuu

SEQ ID NO: 291074 - RNA, 22 nt, Homo sapiens
gagauuauuuaaaaggugauuu

SEQ ID NO: 291075 - RNA, 22 nt, Homo sapiens
gagauugucaugauuacauugu

SEQ ID NO: 291076 - RNA, 22 nt, Homo sapiens
gagauuuucagcuugacuggga

SEQ ID NO: 291077 - RNA, 22 nt, Homo sapiens
gagcacauaugacauuuucuuc

SEQ ID NO: 291078 - RNA, 22 nt, Homo sapiens
gagcacauguggagagucuggg

SEQ ID NO: 291079 - RNA, 21 nt, Homo sapiens
gagcacauuguccucuaacgc

SEQ ID NO: 291080 - RNA, 22 nt, Homo sapiens
gagcagacaugaggaccgcugg

SEQ ID NO: 291081 - RNA, 22 nt, Homo sapiens
gagcaucauggggccaaagcgc

SEQ ID NO: 291082 - RNA, 22 nt, Homo sapiens
gagcuacauggauagucugcau

SEQ ID NO: 291083 - RNA, 22 nt, Homo sapiens
gagcuagaauauuuuguauagu

SEQ ID NO: 291084 - RNA, 22 nt, Homo sapiens
gagcucaccuuaccucuggagc

SEQ ID NO: 291085 - RNA, 22 nt, Homo sapiens
gagcucauuguugcuaaagaga

SEQ ID NO: 291086 - RNA, 22 nt, Homo sapiens
gagcuccuccccuuggcuuuca

SEQ ID NO: 291087 - RNA, 22 nt, Homo sapiens
gagcugaucuuuauguaaauuc

SEQ ID NO: 291088 - RNA, 22 nt, Homo sapiens
gagcugccuugccuaugcaaga

SEQ ID NO: 291089 - RNA, 22 nt, Homo sapiens
gagcuggacuucuuaccuuuuc

SEQ ID NO: 291090 - RNA, 22 nt, Homo sapiens
gaggaaguaauuuuaggccugu

SEQ ID NO: 291091 - RNA, 22 nt, Homo sapiens
gaggagauauucugcuggaugg

SEQ ID NO: 291092 - RNA, 22 nt, Homo sapiens
gaggaguagggcacaaagccuu

SEQ ID NO: 291093 - RNA, 22 nt, Homo sapiens
gaggcaauaugagggaggcuuc

SEQ ID NO: 291094 - RNA, 22 nt, Homo sapiens
gagguaaguaagaauggcaagc

SEQ ID NO: 291095 - RNA, 22 nt, Homo sapiens
gagguaggaggauugcuuaagg

SEQ ID NO: 291096 - RNA, 22 nt, Homo sapiens
gagguggauacauuaaauaaug

SEQ ID NO: 291097 - RNA, 22 nt, Homo sapiens
gagguggugguggaggcauagc

SEQ ID NO: 291098 - RNA, 22 nt, Homo sapiens
gagguguaaggacaacagagac

SEQ ID NO: 291099 - RNA, 22 nt, Homo sapiens
gagguguagucaugccaagauc

SEQ ID NO: 291100 - RNA, 22 nt, Homo sapiens
gaguaaaugucacuguugcugu

SEQ ID NO: 291101 - RNA, 22 nt, Homo sapiens
gaguaaauguccuagcuucuug

SEQ ID NO: 291102 - RNA, 22 nt, Homo sapiens
gaguagugcugcaauaaacaua

SEQ ID NO: 291103 - RNA, 22 nt, Homo sapiens
gaguauauuugcacuguuaugu

SEQ ID NO: 291104 - RNA, 22 nt, Homo sapiens
gagugcaauggcgcgaucucgg

SEQ ID NO: 291105 - RNA, 23 nt, Homo sapiens
gaguggagacucauugauuuccu

SEQ ID NO: 291106 - RNA, 18 nt, Homo sapiens
gaguggugcuucccuugu

SEQ ID NO: 291107 - RNA, 22 nt, Homo sapiens
gaguuccuuugagccugagagg

SEQ ID NO: 291108 - RNA, 22 nt, Homo sapiens
gaguuuguaaacuauucacuaa

SEQ ID NO: 291109 - RNA, 22 nt, Homo sapiens
gauaaaucuuggcuagucuaag

SEQ ID NO: 291110 - RNA, 22 nt, Homo sapiens
gauagcagccauucuuuuuauu

SEQ ID NO: 291111 - RNA, 22 nt, Homo sapiens
gauagcauucaauuaucuguug

SEQ ID NO: 291112 - RNA, 22 nt, Homo sapiens
gauauguaguaguugaaaaaga

SEQ ID NO: 291113 - RNA, 22 nt, Homo sapiens
ggaauauaaaacuuuugacagg

SEQ ID NO: 291114 - RNA, 22 nt, Homo sapiens
ggaaugcuaaaauaggaugcug

SEQ ID NO: 291115 - RNA, 22 nt, Homo sapiens
ggaaugggauuugaagucuggc

SEQ ID NO: 291116 - RNA, 22 nt, Homo sapiens
ggaauugcaucaaaugcaggua

SEQ ID NO: 291117 - RNA, 22 nt, Homo sapiens
ggacuagaucucccggcuucua

SEQ ID NO: 291118 - RNA, 22 nt, Homo sapiens
ggagauccucugcgggcaaaga

SEQ ID NO: 291119 - RNA, 22 nt, Homo sapiens
ggagauguuuaaccuuuuaucu

SEQ ID NO: 291120 - RNA, 22 nt, Homo sapiens
ggagguagucuuucccuuauca

SEQ ID NO: 291121 - RNA, 20 nt, Homo sapiens
ggagguuguauaaguacauc

SEQ ID NO: 291122 - RNA, 22 nt, Homo sapiens
ggaguaaaagaguaggaggaau

SEQ ID NO: 291123 - RNA, 22 nt, Homo sapiens
ggaguaggcuguccggcaccca

SEQ ID NO: 291124 - RNA, 22 nt, Homo sapiens
ggaguaugaaacccacuccaau

SEQ ID NO: 291125 - RNA, 22 nt, Homo sapiens
ggagucugacuuauaggaaccu

SEQ ID NO: 291126 - RNA, 22 nt, Homo sapiens
ggagucugauuuuuauguugcu

SEQ ID NO: 291127 - RNA, 23 nt, Homo sapiens
ggaguguaaauuauuucaaccau

SEQ ID NO: 291128 - RNA, 22 nt, Homo sapiens
ggagugucccaaucucagcuca

SEQ ID NO: 291129 - RNA, 22 nt, Homo sapiens
ggagugucugugcuggucaaag

SEQ ID NO: 291130 - RNA, 22 nt, Homo sapiens
ggaguguguuuuccaacuuggu

SEQ ID NO: 291131 - RNA, 22 nt, Homo sapiens
ggauauguagggcauaucuaca

SEQ ID NO: 291132 - RNA, 22 nt, Homo sapiens
ggaucacagagcuugggaaagg

SEQ ID NO: 291133 - RNA, 22 nt, Homo sapiens
ggaucacagccagcucccagaa

SEQ ID NO: 291134 - RNA, 22 nt, Homo sapiens
ggaucacuugagaccaggaguu

SEQ ID NO: 291135 - RNA, 22 nt, Homo sapiens
ggauuagagauguuauuaagag

SEQ ID NO: 291136 - RNA, 22 nt, Homo sapiens
ggcaaaucugcaauuacuuuug

SEQ ID NO: 291137 - RNA, 22 nt, Homo sapiens
ggcaacaugccgaaaccacguc

SEQ ID NO: 291138 - RNA, 21 nt, Homo sapiens
ggcaagaaacacaaucaagua

SEQ ID NO: 291139 - RNA, 20 nt, Homo sapiens
ggcaagacccaaagugugug

SEQ ID NO: 291140 - RNA, 22 nt, Homo sapiens
ggcaagcucaggccucaggugu

SEQ ID NO: 291141 - RNA, 22 nt, Homo sapiens
ggcaaggauguuuuucuggcaa

SEQ ID NO: 291142 - RNA, 22 nt, Homo sapiens
ggcaaguugcuauucuuuaaug

SEQ ID NO: 291143 - RNA, 23 nt, Homo sapiens
ggcacggaauucaaagaggcauu

SEQ ID NO: 291144 - RNA, 22 nt, Homo sapiens
ggcacuguggcucaagccugua

SEQ ID NO: 291145 - RNA, 22 nt, Homo sapiens
ggcacuguugccggccugaauu

SEQ ID NO: 291146 - RNA, 22 nt, Homo sapiens
ggcagcaugggugccuuuguga

SEQ ID NO: 291147 - RNA, 22 nt, Homo sapiens
ggcagcgugcacuuucgccacu

SEQ ID NO: 291148 - RNA, 22 nt, Homo sapiens
ggcagcucaggccccgcgcuga

SEQ ID NO: 291149 - RNA, 17 nt, Homo sapiens
ggcaggaauuaauguca

SEQ ID NO: 291150 - RNA, 22 nt, Homo sapiens
ggcaguggaagugccaguuucu

SEQ ID NO: 291151 - RNA, 22 nt, Homo sapiens
ggcaguuuggcaguuucauaaa

SEQ ID NO: 291152 - RNA, 21 nt, Homo sapiens
ggcaugaauggaaaagugaga

SEQ ID NO: 291153 - RNA, 22 nt, Homo sapiens
ggcauguguggguuauuaaaga

SEQ ID NO: 291154 - RNA, 22 nt, Homo sapiens
ggcccugagacaggaaaaagcu

SEQ ID NO: 291155 - RNA, 22 nt, Homo sapiens
ggccuguaggguauugguaggg

SEQ ID NO: 291156 - RNA, 22 nt, Homo sapiens
ggcgguguccuccaagugcuuc

SEQ ID NO: 291157 - RNA, 22 nt, Homo sapiens
ggcuacauuguuacaauuagua

SEQ ID NO: 291158 - RNA, 22 nt, Homo sapiens
ggcuagagaauagugccacuaa

SEQ ID NO: 291159 - RNA, 22 nt, Homo sapiens
ggcuagagacaaguugcugaga

SEQ ID NO: 291160 - RNA, 19 nt, Homo sapiens
ggcucagucaacugacugu

SEQ ID NO: 291161 - RNA, 18 nt, Homo sapiens
ggcugguguuuuaguaua

SEQ ID NO: 291162 - RNA, 22 nt, Homo sapiens
ggcuguguguuaaaauaggcuu

SEQ ID NO: 291163 - RNA, 22 nt, Homo sapiens
ggcuuggaggaaugugagggcu

SEQ ID NO: 291164 - RNA, 22 nt, Homo sapiens
gggaaauguaaagucauaagau

SEQ ID NO: 291165 - RNA, 22 nt, Homo sapiens
gggaacaugagaaugugaauga

SEQ ID NO: 291166 - RNA, 22 nt, Homo sapiens
gggaacauggaaauucugcucu

SEQ ID NO: 291167 - RNA, 22 nt, Homo sapiens
gggaagauauaggcugggcacc

SEQ ID NO: 291168 - RNA, 22 nt, Homo sapiens
gggaauguagcaaaucugcaau

SEQ ID NO: 291169 - RNA, 22 nt, Homo sapiens
gggagguaggaguuauuauuuu

SEQ ID NO: 291170 - RNA, 22 nt, Homo sapiens
gggagugugcacacaugguaua

SEQ ID NO: 291171 - RNA, 22 nt, Homo sapiens
gggaugaaguugauguagaaag

SEQ ID NO: 291172 - RNA, 22 nt, Homo sapiens
gggauguaugauauauguuggu

SEQ ID NO: 291173 - RNA, 23 nt, Homo sapiens
gggauuguaaaauaugagggcag

SEQ ID NO: 291174 - RNA, 22 nt, Homo sapiens
gggcaacauugaguacccugaa

SEQ ID NO: 291175 - RNA, 22 nt, Homo sapiens
gggcaugauggugcacacaugu

SEQ ID NO: 291176 - RNA, 22 nt, Homo sapiens
gggccagaugcauuuguuauuu

SEQ ID NO: 291177 - RNA, 22 nt, Homo sapiens
gggguaguuacuguuguucuuu

SEQ ID NO: 291178 - RNA, 22 nt, Homo sapiens
ggggucauuaaauuccgcuggu

SEQ ID NO: 291179 - RNA, 17 nt, Homo sapiens
gggucaccuugcaggua

SEQ ID NO: 291180 - RNA, 22 nt, Homo sapiens
ggguucaaaucuuggcucuuac

SEQ ID NO: 291181 - RNA, 22 nt, Homo sapiens
gguagacucuguaagugaucau

SEQ ID NO: 291182 - RNA, 22 nt, Homo sapiens
gguaggcacuggugggaagaga

SEQ ID NO: 291183 - RNA, 22 nt, Homo sapiens
gguauuauuugccuuuuacuga

SEQ ID NO: 291184 - RNA, 22 nt, Homo sapiens
gguauuuaaaguaccugucugc

SEQ ID NO: 291185 - RNA, 22 nt, Homo sapiens
ggucaagcuagauuuuaaugau

SEQ ID NO: 291186 - RNA, 19 nt, Homo sapiens
ggucacagggguuacaagg

SEQ ID NO: 291187 - RNA, 22 nt, Homo sapiens
ggucacauugcuagcauggguu

SEQ ID NO: 291188 - RNA, 22 nt, Homo sapiens
ggucacauuggacuaucaaguu

SEQ ID NO: 291189 - RNA, 22 nt, Homo sapiens
ggucauggauugucuuuucuug

SEQ ID NO: 291190 - RNA, 22 nt, Homo sapiens
ggucccccuccacucucgcaaa

SEQ ID NO: 291191 - RNA, 22 nt, Homo sapiens
ggugacugguuuaucuggcagu

SEQ ID NO: 291192 - RNA, 19 nt, Homo sapiens
ggugagaaauuaugggucu

SEQ ID NO: 291193 - RNA, 22 nt, Homo sapiens
gguggcuuuuugugauggcuga

SEQ ID NO: 291194 - RNA, 22 nt, Homo sapiens
gguggugguauuucagaaaaug

SEQ ID NO: 291195 - RNA, 20 nt, Homo sapiens
guaaacucucagcauagaug

SEQ ID NO: 291196 - RNA, 22 nt, Homo sapiens
guaaauguccugcuacagagug

SEQ ID NO: 291197 - RNA, 22 nt, Homo sapiens
gugagauggagucuugcuuugu

SEQ ID NO: 291198 - RNA, 22 nt, Homo sapiens
gugagauuaccauuuaaaucag

SEQ ID NO: 291199 - RNA, 22 nt, Homo sapiens
gugagcagagaucgcgugauug

SEQ ID NO: 291200 - RNA, 22 nt, Homo sapiens
gugagcuaagcaaauaugagcc

SEQ ID NO: 291201 - RNA, 22 nt, Homo sapiens
gugagcuauguccugguuuggg

SEQ ID NO: 291202 - RNA, 21 nt, Homo sapiens
gugaggaguuacuggcuuuga

SEQ ID NO: 291203 - RNA, 22 nt, Homo sapiens
gugaggcacugcugcuuuccag

SEQ ID NO: 291204 - RNA, 22 nt, Homo sapiens
gugaggcuuuuccuguuagacu

SEQ ID NO: 291205 - RNA, 22 nt, Homo sapiens
gugagguaauuagcucccuuag

SEQ ID NO: 291206 - RNA, 22 nt, Homo sapiens
gugaggucagggcuguggacag

SEQ ID NO: 291207 - RNA, 22 nt, Homo sapiens
gugaggucguagucauaggcaa

SEQ ID NO: 291208 - RNA, 17 nt, Homo sapiens
gugagguggguaguauc

SEQ ID NO: 291209 - RNA, 22 nt, Homo sapiens
gugagucagucuguguagggcu

SEQ ID NO: 291210 - RNA, 22 nt, Homo sapiens
gugaguuauuauuuauguaaac

SEQ ID NO: 291211 - RNA, 22 nt, Homo sapiens
gugauaguucuuacuccaaagu

SEQ ID NO: 291212 - RNA, 22 nt, Homo sapiens
gugaucaugauccugaagcauu

SEQ ID NO: 291213 - RNA, 22 nt, Homo sapiens
gugaucauuguauugggguuau

SEQ ID NO: 291214 - RNA, 22 nt, Homo sapiens
gugaucuucauggaaggugaaa

SEQ ID NO: 291215 - RNA, 22 nt, Homo sapiens
gugcaaauuccagcucaacucc

SEQ ID NO: 291216 - RNA, 22 nt, Homo sapiens
gugcaaccaucaccacugacuc

SEQ ID NO: 291217 - RNA, 22 nt, Homo sapiens
gugcaaugagaaggggcucugg

SEQ ID NO: 291218 - RNA, 22 nt, Homo sapiens
gugcaauguuaauuacuugacu

SEQ ID NO: 291219 - RNA, 22 nt, Homo sapiens
gugcaauucacuguuaugucug

SEQ ID NO: 291220 - RNA, 22 nt, Homo sapiens
gugcacaacaugcagguuuguu

SEQ ID NO: 291221 - RNA, 22 nt, Homo sapiens
gugcacaacgugcagguuaguu

SEQ ID NO: 291222 - RNA, 22 nt, Homo sapiens
gugcacaacguguagguuuguu

SEQ ID NO: 291223 - RNA, 22 nt, Homo sapiens
gugcacauauggugcauaagug

SEQ ID NO: 291224 - RNA, 22 nt, Homo sapiens
gugcacaucgugcagguuuguu

SEQ ID NO: 291225 - RNA, 22 nt, Homo sapiens
gugcacaucuguguuccagcua

SEQ ID NO: 291226 - RNA, 22 nt, Homo sapiens
gugcacaugcgugcgcacauau

SEQ ID NO: 291227 - RNA, 22 nt, Homo sapiens
gugcaguuuugagugaguuucu

SEQ ID NO: 291228 - RNA, 22 nt, Homo sapiens
gugcauauaaguuguuucuagu

SEQ ID NO: 291229 - RNA, 22 nt, Homo sapiens
gugcuuuguuguggcaguggca

SEQ ID NO: 291230 - RNA, 22 nt, Homo sapiens
guggaaaucucugugugacuua

SEQ ID NO: 291231 - RNA, 22 nt, Homo sapiens
guggaagaaaucagguuauuug

SEQ ID NO: 291232 - RNA, 20 nt, Homo sapiens
guggaaguagaaacauaugu

SEQ ID NO: 291233 - RNA, 22 nt, Homo sapiens
guggacaugaauuuuggaggca

SEQ ID NO: 291234 - RNA, 22 nt, Homo sapiens
guggacugggagagauaguucc

SEQ ID NO: 291235 - RNA, 22 nt, Homo sapiens
guggagacaaaggcugagugag

SEQ ID NO: 291236 - RNA, 22 nt, Homo sapiens
guggagcuguguggccuugggc

SEQ ID NO: 291237 - RNA, 22 nt, Homo sapiens
guggaguaugaaaacugacuuu

SEQ ID NO: 291238 - RNA, 22 nt, Homo sapiens
guggagucaucacucagagugg

SEQ ID NO: 291239 - RNA, 22 nt, Homo sapiens
guggcaaguguuccaagaggcg

SEQ ID NO: 291240 - RNA, 22 nt, Homo sapiens
guggcacgaugaucugggcuca

SEQ ID NO: 291241 - RNA, 22 nt, Homo sapiens
guggcagaaaagagaagcaaug

SEQ ID NO: 291242 - RNA, 21 nt, Homo sapiens
guggccuuuggagcaugucag

SEQ ID NO: 291243 - RNA, 22 nt, Homo sapiens
guggcgagaucauagcucauug

SEQ ID NO: 291244 - RNA, 22 nt, Homo sapiens
gugggaugaucacaguucacug

SEQ ID NO: 291245 - RNA, 22 nt, Homo sapiens
gugggguaggcaauuccuagug

SEQ ID NO: 291246 - RNA, 22 nt, Homo sapiens
gugggguaggguaggacucaac

SEQ ID NO: 291247 - RNA, 22 nt, Homo sapiens
gugggguaggugacuugaugag

SEQ ID NO: 291248 - RNA, 22 nt, Homo sapiens
guggucagaaaucucaguggca

SEQ ID NO: 291249 - RNA, 22 nt, Homo sapiens
gugguguuugagcugccaggga

SEQ ID NO: 291250 - RNA, 22 nt, Homo sapiens
gugguucuaaaccuuuuuuggu

SEQ ID NO: 291251 - RNA, 22 nt, Homo sapiens
gugguuguuggaguggcaauuu

SEQ ID NO: 291252 - RNA, 22 nt, Homo sapiens
gugguuuuaauauucagucuag

SEQ ID NO: 291253 - RNA, 22 nt, Homo sapiens
gugguuuuuuucugccuuauag

SEQ ID NO: 291254 - RNA, 22 nt, Homo sapiens
guguaaaucaaucuguugucuu

SEQ ID NO: 291255 - RNA, 22 nt, Homo sapiens
guguaaaucugcugugaacauu

SEQ ID NO: 291256 - RNA, 22 nt, Homo sapiens
guguaaaugagugcugaaggag

SEQ ID NO: 291257 - RNA, 20 nt, Homo sapiens
guguaagagcaagcuuccua

SEQ ID NO: 291258 - RNA, 22 nt, Homo sapiens
guguaauaaucguggacuaugu

SEQ ID NO: 291259 - RNA, 22 nt, Homo sapiens
guguagagaaauagccugaagg

SEQ ID NO: 291260 - RNA, 22 nt, Homo sapiens
guguaugguaggaugacggagu

SEQ ID NO: 291261 - RNA, 22 nt, Homo sapiens
guguauucaucuggcugaggua

SEQ ID NO: 291262 - RNA, 22 nt, Homo sapiens
gugucuccuguggagcuaugua

SEQ ID NO: 291263 - RNA, 22 nt, Homo sapiens
gugugauguaaagaacugggga

SEQ ID NO: 291264 - RNA, 22 nt, Homo sapiens
gugugauuauuucaauugaugc

SEQ ID NO: 291265 - RNA, 22 nt, Homo sapiens
gugugauuguuaauuuuaggug

SEQ ID NO: 291266 - RNA, 19 nt, Homo sapiens
gugugcauaucacagagca

SEQ ID NO: 291267 - RNA, 22 nt, Homo sapiens
gugugcauaugucuuuauagua

SEQ ID NO: 291268 - RNA, 21 nt, Homo sapiens
gugugcuugaauucagcuguc

SEQ ID NO: 291269 - RNA, 22 nt, Homo sapiens
guguggcaggugggggcucaga

SEQ ID NO: 291270 - RNA, 22 nt, Homo sapiens
gugugguaggauugguuacuca

SEQ ID NO: 291271 - RNA, 22 nt, Homo sapiens
guguucaaauucugacagagag

SEQ ID NO: 291272 - RNA, 22 nt, Homo sapiens
guuaaagacauccacauaggag

SEQ ID NO: 291273 - RNA, 22 nt, Homo sapiens
guuaaugcuggaauaaguuaag

SEQ ID NO: 291274 - RNA, 22 nt, Homo sapiens
guuagcuaguagacaauuuucc

SEQ ID NO: 291275 - RNA, 22 nt, Homo sapiens
guuaugcagcaauugauaaucu

SEQ ID NO: 291276 - RNA, 22 nt, Homo sapiens
guuauuaguugauauuaaguuc

SEQ ID NO: 291277 - RNA, 22 nt, Homo sapiens
guucaaggaauguuggcuucuc

SEQ ID NO: 291278 - RNA, 21 nt, Homo sapiens
guucaagugauccuccugucu

SEQ ID NO: 291279 - RNA, 22 nt, Homo sapiens
guucaagugauucuacugccuc

SEQ ID NO: 291280 - RNA, 22 nt, Homo sapiens
ugcauauguucaaaguauucug

SEQ ID NO: 291281 - RNA, 18 nt, Homo sapiens
ugcauauguugaaccagc

SEQ ID NO: 291282 - RNA, 22 nt, Homo sapiens
ugcauauguugaaccaggcuug

SEQ ID NO: 291283 - RNA, 22 nt, Homo sapiens
ugcauauguugagaugcauauu

SEQ ID NO: 291284 - RNA, 22 nt, Homo sapiens
ugcauauucuaggauuuuguau

SEQ ID NO: 291285 - RNA, 22 nt, Homo sapiens
ugcauauuuuauaaagauggaa

SEQ ID NO: 291286 - RNA, 22 nt, Homo sapiens
ugcaucacaguacuccagccug

SEQ ID NO: 291287 - RNA, 21 nt, Homo sapiens
ugcauggagaacacugagggu

SEQ ID NO: 291288 - RNA, 22 nt, Homo sapiens
ugcauggagauauacaguuuuu

SEQ ID NO: 291289 - RNA, 22 nt, Homo sapiens
ugcauggauguuugaacacacu

SEQ ID NO: 291290 - RNA, 20 nt, Homo sapiens
ugcauguccucacuuacuug

SEQ ID NO: 291291 - RNA, 22 nt, Homo sapiens
ugcauguucuuacucauacaug

SEQ ID NO: 291292 - RNA, 22 nt, Homo sapiens
ugcauuguuuagaaacacuggg

SEQ ID NO: 291293 - RNA, 22 nt, Homo sapiens
ugccaacaugccuggcuguuuu

SEQ ID NO: 291294 - RNA, 22 nt, Homo sapiens
ugccaagaacauuuucuguuuu

SEQ ID NO: 291295 - RNA, 22 nt, Homo sapiens
ugccaggaugaggucaauguuu

SEQ ID NO: 291296 - RNA, 22 nt, Homo sapiens
ugccaguauuuuauugaggauu

SEQ ID NO: 291297 - RNA, 22 nt, Homo sapiens
ugccaguauuuuguugaggauu

SEQ ID NO: 291298 - RNA, 22 nt, Homo sapiens
ugccaguguuuuguugaagauu

SEQ ID NO: 291299 - RNA, 22 nt, Homo sapiens
ugccaugaagaucccugaaaug

SEQ ID NO: 291300 - RNA, 22 nt, Homo sapiens
ugccaugaaguaauggcaaaaa

SEQ ID NO: 291301 - RNA, 19 nt, Homo sapiens
ugccauguaacaggaaaau

SEQ ID NO: 291302 - RNA, 22 nt, Homo sapiens
ugccaugucauagguuaagccu

SEQ ID NO: 291303 - RNA, 21 nt, Homo sapiens
ugcccaguggcuuggggucag

SEQ ID NO: 291304 - RNA, 22 nt, Homo sapiens
ugcccguaauuccagcacuuug

SEQ ID NO: 291305 - RNA, 22 nt, Homo sapiens
ugcccuguaucccacuguuuca

SEQ ID NO: 291306 - RNA, 22 nt, Homo sapiens
ugccuagaaacacuauuucucc

SEQ ID NO: 291307 - RNA, 22 nt, Homo sapiens
ugccuaggcuggaguguagugg

SEQ ID NO: 291308 - RNA, 22 nt, Homo sapiens
ugccuaguagaaggugaacaug

SEQ ID NO: 291309 - RNA, 20 nt, Homo sapiens
ugccugacacucuuugcuuc

SEQ ID NO: 291310 - RNA, 22 nt, Homo sapiens
ugccuggagagcuccuacauau

SEQ ID NO: 291311 - RNA, 16 nt, Homo sapiens
ugccuucuucuguauu

SEQ ID NO: 291312 - RNA, 22 nt, Homo sapiens
ugcgaucuuuuuccuuguuccu

SEQ ID NO: 291313 - RNA, 22 nt, Homo sapiens
ugcgauuauuaugucacuuccu

SEQ ID NO: 291314 - RNA, 22 nt, Homo sapiens
ugcgccauugaacuccaggcug

SEQ ID NO: 291315 - RNA, 22 nt, Homo sapiens
ugcuagaugcuguagggauuua

SEQ ID NO: 291316 - RNA, 22 nt, Homo sapiens
ugcuauagcuauaucaucuccu

SEQ ID NO: 291317 - RNA, 22 nt, Homo sapiens
ugcucaguuuaaaacuuuugag

SEQ ID NO: 291318 - RNA, 23 nt, Homo sapiens
ugcucgguguugacagucacauc

SEQ ID NO: 291319 - RNA, 21 nt, Homo sapiens
ugcugcacuucuuuugcugug

SEQ ID NO: 291320 - RNA, 22 nt, Homo sapiens
ugcugcuguuaucauuuuacca

SEQ ID NO: 291321 - RNA, 22 nt, Homo sapiens
ugcugguauuauguuauccaga

SEQ ID NO: 291322 - RNA, 22 nt, Homo sapiens
ugcugguauuuggaccagccug

SEQ ID NO: 291323 - RNA, 22 nt, Homo sapiens
ugcuggugauuaaauccugaag

SEQ ID NO: 291324 - RNA, 22 nt, Homo sapiens
ugcugguuuucaucaucagugg

SEQ ID NO: 291325 - RNA, 22 nt, Homo sapiens
ugcuguguugcuggcuuaaaga

SEQ ID NO: 291326 - RNA, 22 nt, Homo sapiens
ugcuguuguuugaugaaguaau

SEQ ID NO: 291327 - RNA, 21 nt, Homo sapiens
ugcuuacugaauguuaauuuc

SEQ ID NO: 291328 - RNA, 22 nt, Homo sapiens
ugcuuaggcuaacaaaaauagc

SEQ ID NO: 291329 - RNA, 22 nt, Homo sapiens
ugcuuaguuguauguuccacau

SEQ ID NO: 291330 - RNA, 22 nt, Homo sapiens
ugcuugagacacauaugaauuu

SEQ ID NO: 291331 - RNA, 21 nt, Homo sapiens
ugcuuuggucauacuucuucc

SEQ ID NO: 291332 - RNA, 22 nt, Homo sapiens
ugcuuuguugaaaaucauuugg

SEQ ID NO: 291333 - RNA, 22 nt, Homo sapiens
uggaaaacaugcacauuggauu

SEQ ID NO: 291334 - RNA, 20 nt, Homo sapiens
uggaaaguaagucaugauau

SEQ ID NO: 291335 - RNA, 22 nt, Homo sapiens
uggaaaguacugagguccaccu

SEQ ID NO: 291336 - RNA, 22 nt, Homo sapiens
uggaaaguaguucuaaucuaag

SEQ ID NO: 291337 - RNA, 22 nt, Homo sapiens
uggaaauaaaauagaguuugcc

SEQ ID NO: 291338 - RNA, 22 nt, Homo sapiens
uggaaauaaaugugccaagauc

SEQ ID NO: 291339 - RNA, 22 nt, Homo sapiens
ugagacugaguuuugcucuugu

SEQ ID NO: 291340 - RNA, 22 nt, Homo sapiens
ugagacugguaauguguagggc

SEQ ID NO: 291341 - RNA, 22 nt, Homo sapiens
ugagaggugauaaagcaagggu

SEQ ID NO: 291342 - RNA, 22 nt, Homo sapiens
ugagauaaggaaauugaggcuc

SEQ ID NO: 291343 - RNA, 22 nt, Homo sapiens
ugagauagcauaagggacagaa

SEQ ID NO: 291344 - RNA, 22 nt, Homo sapiens
ugagauaggaucuugcucuguu

SEQ ID NO: 291345 - RNA, 22 nt, Homo sapiens
ugagaucagaaggauuucucug

SEQ ID NO: 291346 - RNA, 22 nt, Homo sapiens
ugagaucaugccacugcacuuc

SEQ ID NO: 291347 - RNA, 22 nt, Homo sapiens
ugagauccugagaguugggacu

SEQ ID NO: 291348 - RNA, 22 nt, Homo sapiens
ugagaucgaguaucgcugucac

SEQ ID NO: 291349 - RNA, 23 nt, Homo sapiens
ugagaucuacagaucucagaucu

SEQ ID NO: 291350 - RNA, 22 nt, Homo sapiens
ugagaugaaagcagaaagacuu

SEQ ID NO: 291351 - RNA, 22 nt, Homo sapiens
ugagaugaacuugauuguuuua

SEQ ID NO: 291352 - RNA, 22 nt, Homo sapiens
ugagaugagggaagccuaggca

SEQ ID NO: 291353 - RNA, 22 nt, Homo sapiens
ugagaugagggcugcacucaaa

SEQ ID NO: 291354 - RNA, 20 nt, Homo sapiens
ugagaugcauugggauguuu

SEQ ID NO: 291355 - RNA, 22 nt, Homo sapiens
ugagauguuccaaugacuauua

SEQ ID NO: 291356 - RNA, 22 nt, Homo sapiens
ugagauguuuagauuguugucu

SEQ ID NO: 291357 - RNA, 22 nt, Homo sapiens
ugagauuaaucuuuaaguaaga

SEQ ID NO: 291358 - RNA, 22 nt, Homo sapiens
ugagauuaucguaauguaucuc

SEQ ID NO: 291359 - RNA, 22 nt, Homo sapiens
ugagauuaucuguacauaggag

SEQ ID NO: 291360 - RNA, 22 nt, Homo sapiens
ugagcacagagccugggguggc

SEQ ID NO: 291361 - RNA, 22 nt, Homo sapiens
ugagcagaaagcugcaaggucg

SEQ ID NO: 291362 - RNA, 22 nt, Homo sapiens
ugagcagaaguuuugauuggcg

SEQ ID NO: 291363 - RNA, 22 nt, Homo sapiens
ugagcagagggagaaguaaauu

SEQ ID NO: 291364 - RNA, 22 nt, Homo sapiens
ugagcagaguuguuucuccuga

SEQ ID NO: 291365 - RNA, 22 nt, Homo sapiens
ugagcagugagugugcugcagg

SEQ ID NO: 291366 - RNA, 22 nt, Homo sapiens
ugagcauauuuaagguaugcua

SEQ ID NO: 291367 - RNA, 22 nt, Homo sapiens
uuuggcccugagggauggcaua

SEQ ID NO: 291368 - RNA, 22 nt, Homo sapiens
uuugggaaugguuugucuccca

SEQ ID NO: 291369 - RNA, 22 nt, Homo sapiens
aaacugccuuccuuguaggugc

SEQ ID NO: 291370 - RNA, 22 nt, Homo sapiens
aaagcagcaggugguuuucaau

SEQ ID NO: 291371 - RNA, 22 nt, Homo sapiens
aaagcuaagguagcauuggaga

SEQ ID NO: 291372 - RNA, 22 nt, Homo sapiens
aaagcugucaaggcaggaggcu

SEQ ID NO: 291373 - RNA, 22 nt, Homo sapiens
aaaggcaucugcucggcucccu

SEQ ID NO: 291374 - RNA, 22 nt, Homo sapiens
aaaggcuucggaucagaaggua

SEQ ID NO: 291375 - RNA, 22 nt, Homo sapiens
aaagggcacugugcuuuggcaa

SEQ ID NO: 291376 - RNA, 19 nt, Homo sapiens
aaagguaguaaccucugau

SEQ ID NO: 291377 - RNA, 22 nt, Homo sapiens
aaaguaauugcaguuuuugcaa

SEQ ID NO: 291378 - RNA, 20 nt, Homo sapiens
aaaguaggcuaauaccaaaa

SEQ ID NO: 291379 - RNA, 17 nt, Homo sapiens
aaaguccuuugcuaucu

SEQ ID NO: 291380 - RNA, 22 nt, Homo sapiens
aaagugauugcgguuuuugcca

SEQ ID NO: 291381 - RNA, 22 nt, Homo sapiens
aaagugcuaggauuaccugggg

SEQ ID NO: 291382 - RNA, 22 nt, Homo sapiens
aaagugcuuacuaaguugccaa

SEQ ID NO: 291383 - RNA, 22 nt, Homo sapiens
aaagugguuuuucagacuuuga

SEQ ID NO: 291384 - RNA, 19 nt, Homo sapiens
aaaguguuuuaaagaggau

SEQ ID NO: 291385 - RNA, 22 nt, Homo sapiens
aaauaacugucagguucuggaa

SEQ ID NO: 291386 - RNA, 22 nt, Homo sapiens
aaaucccuugcucucucagacc

SEQ ID NO: 291387 - RNA, 22 nt, Homo sapiens
aaaugcaccacucuggugcagg

SEQ ID NO: 291388 - RNA, 22 nt, Homo sapiens
aaaugcaugaggugggaagaaa

SEQ ID NO: 291389 - RNA, 22 nt, Homo sapiens
aaaugccucccauucuacugac

SEQ ID NO: 291390 - RNA, 22 nt, Homo sapiens
aaaugcugucaaauuguguucu

SEQ ID NO: 291391 - RNA, 22 nt, Homo sapiens
aaaugcuguuccaggaccuauc

SEQ ID NO: 291392 - RNA, 22 nt, Homo sapiens
aaauggcaccggcucuucccuc

SEQ ID NO: 291393 - RNA, 22 nt, Homo sapiens
aaaugucauggaguguuucccc

SEQ ID NO: 291394 - RNA, 22 nt, Homo sapiens
aaauucaugucaccucuaggua

SEQ ID NO: 291395 - RNA, 22 nt, Homo sapiens
aaauucauuucagcucugggua

SEQ ID NO: 291396 - RNA, 22 nt, Homo sapiens
aacacuaucugccuuacaggga

SEQ ID NO: 291397 - RNA, 22 nt, Homo sapiens
aacacuggcugcucgaguucuc

SEQ ID NO: 291398 - RNA, 22 nt, Homo sapiens
aacaggguguuugcaguuucuu

SEQ ID NO: 291399 - RNA, 22 nt, Homo sapiens
aacagucaauugcugaugaccu

SEQ ID NO: 291400 - RNA, 22 nt, Homo sapiens
aacagucuccaguuguauccau

SEQ ID NO: 291401 - RNA, 22 nt, Homo sapiens
aacagugccugucauuuaguag

SEQ ID NO: 291402 - RNA, 20 nt, Homo sapiens
aacaguguguaaguuuccuu

SEQ ID NO: 291403 - RNA, 22 nt, Homo sapiens
aacauguuuagcagauaccugu

SEQ ID NO: 291404 - RNA, 22 nt, Homo sapiens
aacccugacacaagcagaauuu

SEQ ID NO: 291405 - RNA, 22 nt, Homo sapiens
aacuaugucaaauaaaaugagg

SEQ ID NO: 291406 - RNA, 22 nt, Homo sapiens
aacugcucuaauguggugggag

SEQ ID NO: 291407 - RNA, 22 nt, Homo sapiens
aacuggcauaugaacuuguucu

SEQ ID NO: 291408 - RNA, 22 nt, Homo sapiens
aacuggcauguuuuaaggcuua

SEQ ID NO: 291409 - RNA, 22 nt, Homo sapiens
aacugguauuucccaugaauuu

SEQ ID NO: 291410 - RNA, 22 nt, Homo sapiens
aacuggucuuaugcaagcacua

SEQ ID NO: 291411 - RNA, 20 nt, Homo sapiens
aagacacuguccccacugga

SEQ ID NO: 291412 - RNA, 22 nt, Homo sapiens
aagacuguaauccaucuugagu

SEQ ID NO: 291413 - RNA, 22 nt, Homo sapiens
aagagguagucugucccuuagc

SEQ ID NO: 291414 - RNA, 22 nt, Homo sapiens
aagagguuuaacugacucacag

SEQ ID NO: 291415 - RNA, 22 nt, Homo sapiens
aagaguaguaguggcacucucu

SEQ ID NO: 291416 - RNA, 22 nt, Homo sapiens
aagauauguuaguuauaaacuc

SEQ ID NO: 291417 - RNA, 22 nt, Homo sapiens
aagaucauucagggaaggcuga

SEQ ID NO: 291418 - RNA, 22 nt, Homo sapiens
aagaugauguuguguuuucacu

SEQ ID NO: 291419 - RNA, 22 nt, Homo sapiens
aagaugcagucauacuggagga

SEQ ID NO: 291420 - RNA, 22 nt, Homo sapiens
aagaugguauuucauuaguuuu

SEQ ID NO: 291421 - RNA, 22 nt, Homo sapiens
aagcaccaauaggagauuuguc

SEQ ID NO: 291422 - RNA, 22 nt, Homo sapiens
aagcacccagccucacgccugc

SEQ ID NO: 291423 - RNA, 22 nt, Homo sapiens
acaaaguguuuucugaaggccu

SEQ ID NO: 291424 - RNA, 17 nt, Homo sapiens
acaaauugccagcuagg

SEQ ID NO: 291425 - RNA, 22 nt, Homo sapiens
acacacgugcauguaugcguau

SEQ ID NO: 291426 - RNA, 22 nt, Homo sapiens
acacagucaaauccacuuggcu

SEQ ID NO: 291427 - RNA, 22 nt, Homo sapiens
acacaguguuuauugugguuag

SEQ ID NO: 291428 - RNA, 22 nt, Homo sapiens
acacauacacauaugguguaua

SEQ ID NO: 291429 - RNA, 22 nt, Homo sapiens
acacaugugaaaaaaauguuac

SEQ ID NO: 291430 - RNA, 22 nt, Homo sapiens
acacaugugcguagacucuuua

SEQ ID NO: 291431 - RNA, 22 nt, Homo sapiens
acaccauugcauuccagccugg

SEQ ID NO: 291432 - RNA, 22 nt, Homo sapiens
acacugcugaguaaauaauuuu

SEQ ID NO: 291433 - RNA, 22 nt, Homo sapiens
acacuggaggagagcuguugcu

SEQ ID NO: 291434 - RNA, 20 nt, Homo sapiens
acacuggcuuugagauuuag

SEQ ID NO: 291435 - RNA, 23 nt, Homo sapiens
acacuugcugaguaaaucaaaua

SEQ ID NO: 291436 - RNA, 22 nt, Homo sapiens
acacuugcuugcaauagccucc

SEQ ID NO: 291437 - RNA, 22 nt, Homo sapiens
acagagcaaugagcuacggucu

SEQ ID NO: 291438 - RNA, 22 nt, Homo sapiens
acagauugcugggccccagccc

SEQ ID NO: 291439 - RNA, 22 nt, Homo sapiens
acaggugaaguauuacacuaag

SEQ ID NO: 291440 - RNA, 19 nt, Homo sapiens
acaguaccuggcaugaggu

SEQ ID NO: 291441 - RNA, 21 nt, Homo sapiens
acaguacuugagaucuuuuga

SEQ ID NO: 291442 - RNA, 20 nt, Homo sapiens
acaguagaagggauuucaaa

SEQ ID NO: 291443 - RNA, 22 nt, Homo sapiens
acaguaugcuuuaaacuuuguu

SEQ ID NO: 291444 - RNA, 23 nt, Homo sapiens
acaguauguggauguggcuaagu

SEQ ID NO: 291445 - RNA, 22 nt, Homo sapiens
acagucacaauuuguaccuuuu

SEQ ID NO: 291446 - RNA, 18 nt, Homo sapiens
auauugccuucagacuag

SEQ ID NO: 291447 - RNA, 22 nt, Homo sapiens
auauuggucuucaagaccugug

SEQ ID NO: 291448 - RNA, 22 nt, Homo sapiens
auauugguuaaauauuauguga

SEQ ID NO: 291449 - RNA, 20 nt, Homo sapiens
aucaaagacuuagaggggga

SEQ ID NO: 291450 - RNA, 22 nt, Homo sapiens
aucaaaugcuggcagagugccu

SEQ ID NO: 291451 - RNA, 22 nt, Homo sapiens
aucaagcuacacccuuuggaaa

SEQ ID NO: 291452 - RNA, 22 nt, Homo sapiens
aucaagcuggcauauguaguuc

SEQ ID NO: 291453 - RNA, 22 nt, Homo sapiens
aucacagagucacgggcaacuu

SEQ ID NO: 291454 - RNA, 22 nt, Homo sapiens
aucacagguacuauggcugaca

SEQ ID NO: 291455 - RNA, 22 nt, Homo sapiens
aucacagugaaaacagucaauu

SEQ ID NO: 291456 - RNA, 22 nt, Homo sapiens
aucacagugagcauaugucuau

SEQ ID NO: 291457 - RNA, 22 nt, Homo sapiens
aucacaguuauaacauccuuuu

SEQ ID NO: 291458 - RNA, 22 nt, Homo sapiens
aucaccuggaggugaucacuug

SEQ ID NO: 291459 - RNA, 22 nt, Homo sapiens
aucacuuucuauuucugugcca

SEQ ID NO: 291460 - RNA, 22 nt, Homo sapiens
aucagaaucucuagaggacugu

SEQ ID NO: 291461 - RNA, 21 nt, Homo sapiens
aucagagacccaggcuuccuc

SEQ ID NO: 291462 - RNA, 20 nt, Homo sapiens
aucagagccggugaaagggc

SEQ ID NO: 291463 - RNA, 22 nt, Homo sapiens
aucagagccugugugcccugaa

SEQ ID NO: 291464 - RNA, 22 nt, Homo sapiens
aucagaguggguuuuaaaagug

SEQ ID NO: 291465 - RNA, 22 nt, Homo sapiens
aucagaguugucagggagcuuu

SEQ ID NO: 291466 - RNA, 23 nt, Homo sapiens
aucagauaguuguagguaugugg

SEQ ID NO: 291467 - RNA, 19 nt, Homo sapiens
aucagcacaagugugcuuu

SEQ ID NO: 291468 - RNA, 22 nt, Homo sapiens
aucauaucauuggugaacagug

SEQ ID NO: 291469 - RNA, 22 nt, Homo sapiens
aucaucacaguuguguguaaug

SEQ ID NO: 291470 - RNA, 22 nt, Homo sapiens
aucauggaguauuugcaagucu

SEQ ID NO: 291471 - RNA, 22 nt, Homo sapiens
aucccaguucagccucugacac

SEQ ID NO: 291472 - RNA, 22 nt, Homo sapiens
auccccuugcagugaccggggc

SEQ ID NO: 291473 - RNA, 22 nt, Homo sapiens
aucccuuccuagcacuuggugu

SEQ ID NO: 291474 - RNA, 22 nt, Homo sapiens
auccuguacuaagguuuuccca

SEQ ID NO: 291475 - RNA, 22 nt, Homo sapiens
auccuguagagaugagggugga

SEQ ID NO: 291476 - RNA, 22 nt, Homo sapiens
auccuguaggcuaguagacagu

SEQ ID NO: 291477 - RNA, 22 nt, Homo sapiens
auccuugagaaaauaaaugacc

SEQ ID NO: 291478 - RNA, 22 nt, Homo sapiens
auggacagacacuggccuucug

SEQ ID NO: 291479 - RNA, 21 nt, Homo sapiens
auggacaugguuaggcuuugu

SEQ ID NO: 291480 - RNA, 22 nt, Homo sapiens
auggagaugaacuuggguaaag

SEQ ID NO: 291481 - RNA, 22 nt, Homo sapiens
auggagcaaaacagauuuggga

SEQ ID NO: 291482 - RNA, 22 nt, Homo sapiens
auggaggacaaugucaccuuca

SEQ ID NO: 291483 - RNA, 22 nt, Homo sapiens
auggaguuuacuuaguguaaua

SEQ ID NO: 291484 - RNA, 22 nt, Homo sapiens
auggaucauauucuugaggagg

SEQ ID NO: 291485 - RNA, 22 nt, Homo sapiens
auggcacuaaugggaguuuacu

SEQ ID NO: 291486 - RNA, 22 nt, Homo sapiens
auggcacuacugggaaugucuu

SEQ ID NO: 291487 - RNA, 22 nt, Homo sapiens
auggcacucaaucaaguugaga

SEQ ID NO: 291488 - RNA, 22 nt, Homo sapiens
auggcacugauggaaguaccuu

SEQ ID NO: 291489 - RNA, 22 nt, Homo sapiens
gacauagagccuugacuucauu

SEQ ID NO: 291490 - RNA, 21 nt, Homo sapiens
gacauggcgauacuccgucuc

SEQ ID NO: 291491 - RNA, 22 nt, Homo sapiens
gacauuaucagguuuguuuucu

SEQ ID NO: 291492 - RNA, 22 nt, Homo sapiens
gaccugagagguacauguauuu

SEQ ID NO: 291493 - RNA, 21 nt, Homo sapiens
gaccuguaguaagcauucaca

SEQ ID NO: 291494 - RNA, 22 nt, Homo sapiens
gacuaaugaaagagugugauau

SEQ ID NO: 291495 - RNA, 22 nt, Homo sapiens
gacuaggagagcagcugcccau

SEQ ID NO: 291496 - RNA, 22 nt, Homo sapiens
gacuagggaccaugagcaaucc

SEQ ID NO: 291497 - RNA, 22 nt, Homo sapiens
gacuauaucaggaauggggauu

SEQ ID NO: 291498 - RNA, 18 nt, Homo sapiens
gacucaguuucuaaggca

SEQ ID NO: 291499 - RNA, 22 nt, Homo sapiens
gacugcagugcagcuguuaggc

SEQ ID NO: 291500 - RNA, 22 nt, Homo sapiens
gacuugaagaaucuaagggagg

SEQ ID NO: 291501 - RNA, 22 nt, Homo sapiens
gagaacagagauaauuuuacuu

SEQ ID NO: 291502 - RNA, 22 nt, Homo sapiens
gagaaugagauuaugguuacau

SEQ ID NO: 291503 - RNA, 22 nt, Homo sapiens
gagaaugaugauuuccaauuuc

SEQ ID NO: 291504 - RNA, 22 nt, Homo sapiens
gagacauugacuuuguuccaga

SEQ ID NO: 291505 - RNA, 22 nt, Homo sapiens
gagacggagucucgcucugucg

SEQ ID NO: 291506 - RNA, 22 nt, Homo sapiens
gagacggagucuugcucuguug

SEQ ID NO: 291507 - RNA, 22 nt, Homo sapiens
gagagcauuaagccaucaucau

SEQ ID NO: 291508 - RNA, 22 nt, Homo sapiens
gagagguaguuuuuuggucguc

SEQ ID NO: 291509 - RNA, 22 nt, Homo sapiens
gagagucacagugaauguggca

SEQ ID NO: 291510 - RNA, 22 nt, Homo sapiens
gagauaauagcuauaggaucuu

SEQ ID NO: 291511 - RNA, 22 nt, Homo sapiens
gagauauucugguuuacuaaau

SEQ ID NO: 291512 - RNA, 22 nt, Homo sapiens
gagaucaaugggauggaauuga

SEQ ID NO: 291513 - RNA, 22 nt, Homo sapiens
gagaucaucuaaucuggccucu

SEQ ID NO: 291514 - RNA, 22 nt, Homo sapiens
gagaucauugugggccaagcug

SEQ ID NO: 291515 - RNA, 22 nt, Homo sapiens
gagaucuuuaagaacuacugcu

SEQ ID NO: 291516 - RNA, 22 nt, Homo sapiens
gagaugaaguuaaggaucuuua

SEQ ID NO: 291517 - RNA, 22 nt, Homo sapiens
gagauggagacuuggccuuaaa

SEQ ID NO: 291518 - RNA, 22 nt, Homo sapiens
gagauggaguuucacuucgcuc

SEQ ID NO: 291519 - RNA, 22 nt, Homo sapiens
gagaugugguucaaggguguuu

SEQ ID NO: 291520 - RNA, 20 nt, Homo sapiens
gagauguugaucagggcuau

SEQ ID NO: 291521 - RNA, 22 nt, Homo sapiens
gagauuaauacacaucaaaugc

SEQ ID NO: 291522 - RNA, 22 nt, Homo sapiens
gagauucaucuagguccagaga

SEQ ID NO: 291523 - RNA, 22 nt, Homo sapiens
gagcaacaguggcagugguggg

SEQ ID NO: 291524 - RNA, 22 nt, Homo sapiens
gagcaaugauugagccacugua

SEQ ID NO: 291525 - RNA, 22 nt, Homo sapiens
gagcaccagucccugucagugc

SEQ ID NO: 291526 - RNA, 22 nt, Homo sapiens
gagcaguugagagugcuggcca

SEQ ID NO: 291527 - RNA, 20 nt, Homo sapiens
gagcaucacaggccucugcu

SEQ ID NO: 291528 - RNA, 22 nt, Homo sapiens
gagcaucaguggccucaucuca

SEQ ID NO: 291529 - RNA, 22 nt, Homo sapiens
gagcuacacugauucauuuguu

SEQ ID NO: 291530 - RNA, 22 nt, Homo sapiens
gagcuagggucaugcuacugca

SEQ ID NO: 291531 - RNA, 21 nt, Homo sapiens
gagcuaggugaggcuguaaug

SEQ ID NO: 291532 - RNA, 22 nt, Homo sapiens
gagcuagguuuugaauccagac

SEQ ID NO: 291533 - RNA, 22 nt, Homo sapiens
gagcugaaguuuccauuuguac

SEQ ID NO: 291534 - RNA, 22 nt, Homo sapiens
gagcugaauugcugccauuugc

SEQ ID NO: 291535 - RNA, 22 nt, Homo sapiens
gagcuguuuuucacuagaccaa

SEQ ID NO: 291536 - RNA, 22 nt, Homo sapiens
gagcuuguggucuucguguuau

SEQ ID NO: 291537 - RNA, 22 nt, Homo sapiens
gaggaaguuuacaaagcaucug

SEQ ID NO: 291538 - RNA, 22 nt, Homo sapiens
gaggaguauuuugucgaauguc

SEQ ID NO: 291539 - RNA, 22 nt, Homo sapiens
gaggaucucuugagcccagaag

SEQ ID NO: 291540 - RNA, 22 nt, Homo sapiens
gaggcauuauucccaucuuaca

SEQ ID NO: 291541 - RNA, 22 nt, Homo sapiens
gaggcauugaaauauugcuuau

SEQ ID NO: 291542 - RNA, 22 nt, Homo sapiens
gagguaaguggauuaugagguc

SEQ ID NO: 291543 - RNA, 21 nt, Homo sapiens
gagguaccucauguaagugga

SEQ ID NO: 291544 - RNA, 22 nt, Homo sapiens
gagguagagacuauguauuaga

SEQ ID NO: 291545 - RNA, 22 nt, Homo sapiens
gagguagagaguuuugauucug

SEQ ID NO: 291546 - RNA, 22 nt, Homo sapiens
gagguaucauuauguugcccag

SEQ ID NO: 291547 - RNA, 22 nt, Homo sapiens
gagguaugauugacauauaaaa

SEQ ID NO: 291548 - RNA, 22 nt, Homo sapiens
gaggucauguggcaggcagcca

SEQ ID NO: 291549 - RNA, 22 nt, Homo sapiens
gagguuauuggggugcuugugu

SEQ ID NO: 291550 - RNA, 22 nt, Homo sapiens
gagguugggaugagggauacag

SEQ ID NO: 291551 - RNA, 22 nt, Homo sapiens
gaguaacagcauaaauuuguga

SEQ ID NO: 291552 - RNA, 22 nt, Homo sapiens
gaguagaacugguuaucuaaua

SEQ ID NO: 291553 - RNA, 22 nt, Homo sapiens
gaguagugcugcaguaaacaca

SEQ ID NO: 291554 - RNA, 22 nt, Homo sapiens
gaguagugcugcaguaaacaua

SEQ ID NO: 291555 - RNA, 22 nt, Homo sapiens
gaguauuuuacaucguguaauu

SEQ ID NO: 291556 - RNA, 22 nt, Homo sapiens
gagugcaaagguccugaggugg

SEQ ID NO: 291557 - RNA, 22 nt, Homo sapiens
gagugcaauggcaagaucuugg

SEQ ID NO: 291558 - RNA, 22 nt, Homo sapiens
gagugcaauggcaccgucucgg

SEQ ID NO: 291559 - RNA, 22 nt, Homo sapiens
aaaacgcauccucacaggucug

SEQ ID NO: 291560 - RNA, 18 nt, Homo sapiens
aaacagugucucuuucug

SEQ ID NO: 291561 - RNA, 22 nt, Homo sapiens
aaaccacagugugcugcugggg

SEQ ID NO: 291562 - RNA, 22 nt, Homo sapiens
aaacccauauaccagcugugcu

SEQ ID NO: 291563 - RNA, 20 nt, Homo sapiens
aaacucugucuucuuuauca

SEQ ID NO: 291564 - RNA, 18 nt, Homo sapiens
aaacugcuuccuuggccu

SEQ ID NO: 291565 - RNA, 21 nt, Homo sapiens
aaacuggcccaauuguuccau

SEQ ID NO: 291566 - RNA, 22 nt, Homo sapiens
aaacugucuggaugcuugugga

SEQ ID NO: 291567 - RNA, 22 nt, Homo sapiens
aaacuugucuaauuauaagcau

SEQ ID NO: 291568 - RNA, 22 nt, Homo sapiens
aaagaagucagccuguccuuug

SEQ ID NO: 291569 - RNA, 22 nt, Homo sapiens
aaagagcugagaccugguggag

SEQ ID NO: 291570 - RNA, 22 nt, Homo sapiens
aaagcaucacuuuuccuacuuu

SEQ ID NO: 291571 - RNA, 22 nt, Homo sapiens
aaagcuacaggaccugcucauu

SEQ ID NO: 291572 - RNA, 22 nt, Homo sapiens
aaagcuaccagauucuguugga

SEQ ID NO: 291573 - RNA, 22 nt, Homo sapiens
aaagcuagagaagcugcuguca

SEQ ID NO: 291574 - RNA, 22 nt, Homo sapiens
aaaggaccacauauaugguggc

SEQ ID NO: 291575 - RNA, 22 nt, Homo sapiens
aaaggcacugugacuuuauagg

SEQ ID NO: 291576 - RNA, 22 nt, Homo sapiens
aaugguuuuaucagcguccaaa

SEQ ID NO: 291577 - RNA, 22 nt, Homo sapiens
aaugugcacuuggagccuugcu

SEQ ID NO: 291578 - RNA, 22 nt, Homo sapiens
aaugugcuuucuuucacacagu

SEQ ID NO: 291579 - RNA, 22 nt, Homo sapiens
aaugugcuuugaaaagagcuga

SEQ ID NO: 291580 - RNA, 22 nt, Homo sapiens
aauguguuuugaaaucaggaag

SEQ ID NO: 291581 - RNA, 22 nt, Homo sapiens
aauuacucgugucuuuacugcu

SEQ ID NO: 291582 - RNA, 22 nt, Homo sapiens
aauuaguaaccuaauuccaucu

SEQ ID NO: 291583 - RNA, 22 nt, Homo sapiens
aauugcauaugcaguagaucua

SEQ ID NO: 291584 - RNA, 22 nt, Homo sapiens
aauugcauugaauuuguagcuu

SEQ ID NO: 291585 - RNA, 23 nt, Homo sapiens
aauugcuuuugaggacuuaguug

SEQ ID NO: 291586 - RNA, 22 nt, Homo sapiens
aauuggugaccaagggaaggac

SEQ ID NO: 291587 - RNA, 22 nt, Homo sapiens
acaaagcuagggaauccaucuu

SEQ ID NO: 291588 - RNA, 21 nt, Homo sapiens
acaaagcuggagggagacugc

SEQ ID NO: 291589 - RNA, 22 nt, Homo sapiens
acaaccauuguaagggcuuugg

SEQ ID NO: 291590 - RNA, 23 nt, Homo sapiens
acacaguaaacuaaaagcuagcu

SEQ ID NO: 291591 - RNA, 22 nt, Homo sapiens
acacaguaaauauugucuccuc

SEQ ID NO: 291592 - RNA, 22 nt, Homo sapiens
acacagugucuguguauuuaaa

SEQ ID NO: 291593 - RNA, 22 nt, Homo sapiens
acacgugcagauuuauauaaau

SEQ ID NO: 291594 - RNA, 22 nt, Homo sapiens
acacucuaguguucuuaaucag

SEQ ID NO: 291595 - RNA, 22 nt, Homo sapiens
acacucucucauuacuuguuug

SEQ ID NO: 291596 - RNA, 20 nt, Homo sapiens
acacuggaguaucaaggccc

SEQ ID NO: 291597 - RNA, 22 nt, Homo sapiens
acacuggguaacauaucuguua

SEQ ID NO: 291598 - RNA, 22 nt, Homo sapiens
acacuguaacucuuugagggca

SEQ ID NO: 291599 - RNA, 22 nt, Homo sapiens
acacuguagcugagggcaugcg

SEQ ID NO: 291600 - RNA, 22 nt, Homo sapiens
acacugucugaugaaaguaguu

SEQ ID NO: 291601 - RNA, 20 nt, Homo sapiens
acacugugcuaaggauuuuc

SEQ ID NO: 291602 - RNA, 22 nt, Homo sapiens
acagaacugggcuugcuuuugg

SEQ ID NO: 291603 - RNA, 19 nt, Homo sapiens
acagauagaauguucuaca

SEQ ID NO: 291604 - RNA, 22 nt, Homo sapiens
acagaucagagauauuuagguu

SEQ ID NO: 291605 - RNA, 20 nt, Homo sapiens
acagcacugguuucaagcaa

SEQ ID NO: 291606 - RNA, 22 nt, Homo sapiens
acaggagugggauuugaguccu

SEQ ID NO: 291607 - RNA, 22 nt, Homo sapiens
acaguacaugauaaauaaggua

SEQ ID NO: 291608 - RNA, 22 nt, Homo sapiens
acaguacuuuuggauuugugaa

SEQ ID NO: 291609 - RNA, 22 nt, Homo sapiens
acaguagaaaacaauggauuug

SEQ ID NO: 291610 - RNA, 20 nt, Homo sapiens
acaguauguuuggaugcaua

SEQ ID NO: 291611 - RNA, 22 nt, Homo sapiens
acagucauagcagccuuuguua

SEQ ID NO: 291612 - RNA, 22 nt, Homo sapiens
acagucuggagaaugggugcuc

SEQ ID NO: 291613 - RNA, 18 nt, Homo sapiens
acagugcugucacugcuu

SEQ ID NO: 291614 - RNA, 22 nt, Homo sapiens
acagugcuguuguguuuucacg

SEQ ID NO: 291615 - RNA, 22 nt, Homo sapiens
acagugcuuucaauguucagua

SEQ ID NO: 291616 - RNA, 18 nt, Homo sapiens
acagugucuuacaccugu

SEQ ID NO: 291617 - RNA, 22 nt, Homo sapiens
acaguguguguguucaccuaga

SEQ ID NO: 291618 - RNA, 22 nt, Homo sapiens
acaguguuacuugauaguguau

SEQ ID NO: 291619 - RNA, 22 nt, Homo sapiens
acaucaggcuugugaugauuac

SEQ ID NO: 291620 - RNA, 22 nt, Homo sapiens
acaucauugggggcuacaggug

SEQ ID NO: 291621 - RNA, 22 nt, Homo sapiens
acaucccaugccuggguacucc

SEQ ID NO: 291622 - RNA, 18 nt, Homo sapiens
acaucccaugcuggggug

SEQ ID NO: 291623 - RNA, 22 nt, Homo sapiens
acaucccuugcucggggccccu

SEQ ID NO: 291624 - RNA, 22 nt, Homo sapiens
acaugagacuggguuuguaggg

SEQ ID NO: 291625 - RNA, 22 nt, Homo sapiens
acaugcauggcaugcauuguac

SEQ ID NO: 291626 - RNA, 23 nt, Homo sapiens
acauguauagacuuuuuuuccuu

SEQ ID NO: 291627 - RNA, 22 nt, Homo sapiens
acauguauauaaugcauagcga

SEQ ID NO: 291628 - RNA, 18 nt, Homo sapiens
acauucagcuugaagaua

SEQ ID NO: 291629 - RNA, 22 nt, Homo sapiens
acauugcagauguguuuaaugu

SEQ ID NO: 291630 - RNA, 22 nt, Homo sapiens
accacaggguaaaguuagauau

SEQ ID NO: 291631 - RNA, 22 nt, Homo sapiens
accaccauugcacugaacuuuc

SEQ ID NO: 291632 - RNA, 22 nt, Homo sapiens
accaguguuuaccaaguagcau

SEQ ID NO: 291633 - RNA, 22 nt, Homo sapiens
accauugcacuccagcccaggc

SEQ ID NO: 291634 - RNA, 23 nt, Homo sapiens
accccuacaggcuuguguccugc

SEQ ID NO: 291635 - RNA, 17 nt, Homo sapiens
accccuaccucagaagc

SEQ ID NO: 291636 - RNA, 22 nt, Homo sapiens
acccgcccagguguggccggga

SEQ ID NO: 291637 - RNA, 22 nt, Homo sapiens
acccggagagcaggcgagaagg

SEQ ID NO: 291638 - RNA, 22 nt, Homo sapiens
acccuacauaguagauccuaca

SEQ ID NO: 291639 - RNA, 22 nt, Homo sapiens
acccucagaccaguuucccugg

SEQ ID NO: 291640 - RNA, 22 nt, Homo sapiens
acccuggaggucuacagugcag

SEQ ID NO: 291641 - RNA, 22 nt, Homo sapiens
acccuguaggacuauucuaauc

SEQ ID NO: 291642 - RNA, 22 nt, Homo sapiens
acccugucagcuggccugggca

SEQ ID NO: 291643 - RNA, 22 nt, Homo sapiens
acccuguugagcaacuggccau

SEQ ID NO: 291644 - RNA, 22 nt, Homo sapiens
acccuguugguggaucagauug

SEQ ID NO: 291645 - RNA, 22 nt, Homo sapiens
acccuuuagguuggaugaggau

SEQ ID NO: 291646 - RNA, 22 nt, Homo sapiens
accucagcccggggaaguugag

SEQ ID NO: 291647 - RNA, 22 nt, Homo sapiens
accugagauuacaggugcuggc

SEQ ID NO: 291648 - RNA, 23 nt, Homo sapiens
accugugguuauuuuacucuucc

SEQ ID NO: 291649 - RNA, 22 nt, Homo sapiens
accuugcacugagccgagauug

SEQ ID NO: 291650 - RNA, 22 nt, Homo sapiens
accuuuacaacuuguuagagua

SEQ ID NO: 291651 - RNA, 22 nt, Homo sapiens
acuccauuucauuuuagcucuu

SEQ ID NO: 291652 - RNA, 22 nt, Homo sapiens
acugaauguaaacacggagugu

SEQ ID NO: 291653 - RNA, 21 nt, Homo sapiens
acugagagaucuggggcacau

SEQ ID NO: 291654 - RNA, 22 nt, Homo sapiens
acugagaucuuuaaauaaauaa

SEQ ID NO: 291655 - RNA, 22 nt, Homo sapiens
acugagucauugggugcccaga

SEQ ID NO: 291656 - RNA, 18 nt, Homo sapiens
acugcacuccaccuuggg

SEQ ID NO: 291657 - RNA, 22 nt, Homo sapiens
acugcacuccagcccgggugac

SEQ ID NO: 291658 - RNA, 22 nt, Homo sapiens
acugcacuccagccucaugaca

SEQ ID NO: 291659 - RNA, 22 nt, Homo sapiens
acugcacuccagccugaugaaa

SEQ ID NO: 291660 - RNA, 22 nt, Homo sapiens
augacauugaaaagcaagugga

SEQ ID NO: 291661 - RNA, 21 nt, Homo sapiens
augacccuggguguccuuucc

SEQ ID NO: 291662 - RNA, 20 nt, Homo sapiens
augacuagaggacaugguaa

SEQ ID NO: 291663 - RNA, 22 nt, Homo sapiens
augacuggauaauggacacaca

SEQ ID NO: 291664 - RNA, 19 nt, Homo sapiens
augagaacagacuccauuu

SEQ ID NO: 291665 - RNA, 22 nt, Homo sapiens
augagacaguucccuuuaucuu

SEQ ID NO: 291666 - RNA, 22 nt, Homo sapiens
augagaccagcagaaaaccugu

SEQ ID NO: 291667 - RNA, 22 nt, Homo sapiens
augagaucugugaacaccuguc

SEQ ID NO: 291668 - RNA, 21 nt, Homo sapiens
augagauguuagacuuuagac

SEQ ID NO: 291669 - RNA, 22 nt, Homo sapiens
augagcagaugcuccugccucu

SEQ ID NO: 291670 - RNA, 22 nt, Homo sapiens
augaggagauauuaaauaccau

SEQ ID NO: 291671 - RNA, 22 nt, Homo sapiens
augaggcuauaauuuuuaugua

SEQ ID NO: 291672 - RNA, 22 nt, Homo sapiens
augagggaagcucacgugucca

SEQ ID NO: 291673 - RNA, 22 nt, Homo sapiens
augagggagggcaccugaccuu

SEQ ID NO: 291674 - RNA, 22 nt, Homo sapiens
augagggagggguggugccgca

SEQ ID NO: 291675 - RNA, 22 nt, Homo sapiens
augagguaauaaguccuuggaa

SEQ ID NO: 291676 - RNA, 22 nt, Homo sapiens
augagguauccaagcccagaaa

SEQ ID NO: 291677 - RNA, 22 nt, Homo sapiens
augaggugaggucaguaaggua

SEQ ID NO: 291678 - RNA, 22 nt, Homo sapiens
augaguuccuuccuugccuagg

SEQ ID NO: 291679 - RNA, 22 nt, Homo sapiens
augauacuguucuaagauuuuu

SEQ ID NO: 291680 - RNA, 22 nt, Homo sapiens
augaucauggaagugcacccau

SEQ ID NO: 291681 - RNA, 22 nt, Homo sapiens
augaucauggaaguuuuccugu

SEQ ID NO: 291682 - RNA, 22 nt, Homo sapiens
augaugaaguaagugcuuagga

SEQ ID NO: 291683 - RNA, 22 nt, Homo sapiens
augcaaacagcuaucuggcugg

SEQ ID NO: 291684 - RNA, 22 nt, Homo sapiens
augcaacugcacuccagccugg

SEQ ID NO: 291685 - RNA, 22 nt, Homo sapiens
augcaacuugaaauuuuccgga

SEQ ID NO: 291686 - RNA, 22 nt, Homo sapiens
augcaaggaugguuagauauau

SEQ ID NO: 291687 - RNA, 22 nt, Homo sapiens
augcacauauguacugcccuau

SEQ ID NO: 291688 - RNA, 22 nt, Homo sapiens
augcacaugcgaaaacuugugu

SEQ ID NO: 291689 - RNA, 22 nt, Homo sapiens
augcacauggcuaacuuuuuuc

SEQ ID NO: 291690 - RNA, 22 nt, Homo sapiens
augcacuguauaggaucuugcg

SEQ ID NO: 291691 - RNA, 22 nt, Homo sapiens
augcacuguuuucuugaugaga

SEQ ID NO: 291692 - RNA, 22 nt, Homo sapiens
augcagcugaggguaguggagc

SEQ ID NO: 291693 - RNA, 22 nt, Homo sapiens
augcagguguuuugcacugagu

SEQ ID NO: 291694 - RNA, 22 nt, Homo sapiens
augcagugugcaacagauuaag

SEQ ID NO: 291695 - RNA, 22 nt, Homo sapiens
augcauaugucuuuauaguggc

SEQ ID NO: 291696 - RNA, 22 nt, Homo sapiens
augcauauuuuaccuagaagag

SEQ ID NO: 291697 - RNA, 22 nt, Homo sapiens
augcauggcagagucaggguac

SEQ ID NO: 291698 - RNA, 22 nt, Homo sapiens
augccucugacaauuggauucu

SEQ ID NO: 291699 - RNA, 22 nt, Homo sapiens
augcuacugaccccuacuuaca

SEQ ID NO: 291700 - RNA, 22 nt, Homo sapiens
augcuacuggauuuguauaaau

SEQ ID NO: 291701 - RNA, 22 nt, Homo sapiens
augcuaucauucaggauuuguu

SEQ ID NO: 291702 - RNA, 19 nt, Homo sapiens
augcugguguugcucaaac

SEQ ID NO: 291703 - RNA, 22 nt, Homo sapiens
augcuguuuuguagcucccucu

SEQ ID NO: 291704 - RNA, 22 nt, Homo sapiens
auggaaaugaagggcuggcccu

SEQ ID NO: 291705 - RNA, 22 nt, Homo sapiens
auggaaggagaauggucuuuga

SEQ ID NO: 291706 - RNA, 22 nt, Homo sapiens
auggaaggagaggaaugaauga

SEQ ID NO: 291707 - RNA, 22 nt, Homo sapiens
auggaaucauccuccugggagc

SEQ ID NO: 291708 - RNA, 22 nt, Homo sapiens
auggacauuaaagcgauguaga

SEQ ID NO: 291709 - RNA, 22 nt, Homo sapiens
auggagaugaauaucaucuguu

SEQ ID NO: 291710 - RNA, 22 nt, Homo sapiens
auggagugagaauggagguucc

SEQ ID NO: 291711 - RNA, 22 nt, Homo sapiens
auggauagucucacucacauac

SEQ ID NO: 291712 - RNA, 22 nt, Homo sapiens
auggauauugccuaggguagua

SEQ ID NO: 291713 - RNA, 22 nt, Homo sapiens
auggauguucuagggaugugau

SEQ ID NO: 291714 - RNA, 22 nt, Homo sapiens
auggcaaaaaaugcaauuacuu

SEQ ID NO: 291715 - RNA, 22 nt, Homo sapiens
auggcaaaauguuccuaguggu

SEQ ID NO: 291716 - RNA, 22 nt, Homo sapiens
auggcaauguaagucagaaaaa

SEQ ID NO: 291717 - RNA, 22 nt, Homo sapiens
auggcacagaguagaugcucaa

SEQ ID NO: 291718 - RNA, 22 nt, Homo sapiens
auggcacugaagcguauugaca

SEQ ID NO: 291719 - RNA, 22 nt, Homo sapiens
auggcacugccuggcuucaugg

SEQ ID NO: 291720 - RNA, 18 nt, Homo sapiens
auggcagaacaauuuaca

SEQ ID NO: 291721 - RNA, 22 nt, Homo sapiens
auggccugaugcaccuguccca

SEQ ID NO: 291722 - RNA, 22 nt, Homo sapiens
auggccuuucuggcacauuucc

SEQ ID NO: 291723 - RNA, 22 nt, Homo sapiens
auggcguguggcuuggaggcug

SEQ ID NO: 291724 - RNA, 22 nt, Homo sapiens
auggcucuuauuauuugaggua

SEQ ID NO: 291725 - RNA, 22 nt, Homo sapiens
auggcugugaaaugguaggugg

SEQ ID NO: 291726 - RNA, 22 nt, Homo sapiens
auggcuuguuaugcauuaguac

SEQ ID NO: 291727 - RNA, 22 nt, Homo sapiens
auggcuuuguguucagagcuga

SEQ ID NO: 291728 - RNA, 22 nt, Homo sapiens
auggcuuuuuaaaucauguugu

SEQ ID NO: 291729 - RNA, 22 nt, Homo sapiens
augggcacugauguauucugug

SEQ ID NO: 291730 - RNA, 22 nt, Homo sapiens
augggguagguagcucggggaa

SEQ ID NO: 291731 - RNA, 22 nt, Homo sapiens
auggucuuuucccuggauuaua

SEQ ID NO: 291732 - RNA, 22 nt, Homo sapiens
auggucuuuuuguuaugagaga

SEQ ID NO: 291733 - RNA, 21 nt, Homo sapiens
auggugagaaaguagugucaa

SEQ ID NO: 291734 - RNA, 22 nt, Homo sapiens
auguaacuaucugagccauggg

SEQ ID NO: 291735 - RNA, 22 nt, Homo sapiens
auguagugugauuuucacuaga

SEQ ID NO: 291736 - RNA, 17 nt, Homo sapiens
auguauacauccaugua

SEQ ID NO: 291737 - RNA, 22 nt, Homo sapiens
auguauacaugcaggucacagg

SEQ ID NO: 291738 - RNA, 22 nt, Homo sapiens
augucaacauagacaguagagu

SEQ ID NO: 291739 - RNA, 22 nt, Homo sapiens
augucacagguccuagccaagu

SEQ ID NO: 291740 - RNA, 20 nt, Homo sapiens
augucagaguguggguacgg

SEQ ID NO: 291741 - RNA, 20 nt, Homo sapiens
augucaggaagggagucagg

SEQ ID NO: 291742 - RNA, 22 nt, Homo sapiens
augucugguagccaccuggagg

SEQ ID NO: 291743 - RNA, 22 nt, Homo sapiens
caucccugaaccccagaaaucu

SEQ ID NO: 291744 - RNA, 22 nt, Homo sapiens
caugauauugcagaauguuggu

SEQ ID NO: 291745 - RNA, 22 nt, Homo sapiens
caugccacugcacuccaaccug

SEQ ID NO: 291746 - RNA, 22 nt, Homo sapiens
caugccacuguggacaaagaca

SEQ ID NO: 291747 - RNA, 19 nt, Homo sapiens
cauggcuuauaauuuuaau

SEQ ID NO: 291748 - RNA, 22 nt, Homo sapiens
cauggcuuuuauaacaagaaau

SEQ ID NO: 291749 - RNA, 22 nt, Homo sapiens
caugucacuuccucucugaugg

SEQ ID NO: 291750 - RNA, 22 nt, Homo sapiens
caugucuuuuauucugugugau

SEQ ID NO: 291751 - RNA, 22 nt, Homo sapiens
cauugcaaugaggucuugcagu

SEQ ID NO: 291752 - RNA, 22 nt, Homo sapiens
cauugcacacauuuaccuaugu

SEQ ID NO: 291753 - RNA, 22 nt, Homo sapiens
acagugacagaaagcugauuau

SEQ ID NO: 291754 - RNA, 18 nt, Homo sapiens
acagugcuggcaugagau

SEQ ID NO: 291755 - RNA, 17 nt, Homo sapiens
acagugcuuugcuuucc

SEQ ID NO: 291756 - RNA, 22 nt, Homo sapiens
acagugcuuuuguuccucuccu

SEQ ID NO: 291757 - RNA, 22 nt, Homo sapiens
acaguggaauguaggguuugag

SEQ ID NO: 291758 - RNA, 22 nt, Homo sapiens
acaguguacaauagccuuuuaa

SEQ ID NO: 291759 - RNA, 18 nt, Homo sapiens
acagugucauggcucaau

SEQ ID NO: 291760 - RNA, 22 nt, Homo sapiens
acagugucaugucguguucccc

SEQ ID NO: 291761 - RNA, 22 nt, Homo sapiens
acaguguuccuuuguugugacu

SEQ ID NO: 291762 - RNA, 22 nt, Homo sapiens
acauagaguaguggugaggaug

SEQ ID NO: 291763 - RNA, 22 nt, Homo sapiens
acaucacuguuugauugauuga

SEQ ID NO: 291764 - RNA, 22 nt, Homo sapiens
acaugacauugggguggggaua

SEQ ID NO: 291765 - RNA, 22 nt, Homo sapiens
acauggcacugcgggcuucuug

SEQ ID NO: 291766 - RNA, 22 nt, Homo sapiens
acauggcuuaugaauuuggaga

SEQ ID NO: 291767 - RNA, 22 nt, Homo sapiens
acaugguacugauuuacgaaau

SEQ ID NO: 291768 - RNA, 19 nt, Homo sapiens
acauugcauuuguaggcuu

SEQ ID NO: 291769 - RNA, 22 nt, Homo sapiens
accacagugcuuccugcucacg

SEQ ID NO: 291770 - RNA, 22 nt, Homo sapiens
accaccacucccgcauucuaaa

SEQ ID NO: 291771 - RNA, 17 nt, Homo sapiens
accagugcaugugcuuu

SEQ ID NO: 291772 - RNA, 22 nt, Homo sapiens
accaugcaguccaauaugcaca

SEQ ID NO: 291773 - RNA, 22 nt, Homo sapiens
acccagaagucauucaggaaca

SEQ ID NO: 291774 - RNA, 22 nt, Homo sapiens
acccagaauucagucuuaggcc

SEQ ID NO: 291775 - RNA, 17 nt, Homo sapiens
acccagucuuuuugcac

SEQ ID NO: 291776 - RNA, 21 nt, Homo sapiens
acccccacaccuccuuaguuc

SEQ ID NO: 291777 - RNA, 22 nt, Homo sapiens
acccguuacuuagcagaccagg

SEQ ID NO: 291778 - RNA, 22 nt, Homo sapiens
acccguuacuuagcagaccggg

SEQ ID NO: 291779 - RNA, 22 nt, Homo sapiens
acccucaagggacugacagaau

SEQ ID NO: 291780 - RNA, 21 nt, Homo sapiens
acccucuaguuuucaacaggc

SEQ ID NO: 291781 - RNA, 22 nt, Homo sapiens
acccuguaguuagaaacuuuca

SEQ ID NO: 291782 - RNA, 22 nt, Homo sapiens
acccugucacucccaucaauuu

SEQ ID NO: 291783 - RNA, 22 nt, Homo sapiens
acccugugaauauuuaaacuuc

SEQ ID NO: 291784 - RNA, 22 nt, Homo sapiens
acccuuaagcacuaguucagcu

SEQ ID NO: 291785 - RNA, 21 nt, Homo sapiens
accugauguuucaguuggagu

SEQ ID NO: 291786 - RNA, 22 nt, Homo sapiens
accuggcacuuagcaaaucuga

SEQ ID NO: 291787 - RNA, 22 nt, Homo sapiens
accugggugcugaugggcuuua

SEQ ID NO: 291788 - RNA, 22 nt, Homo sapiens
acgcagcacauucacagcuaug

SEQ ID NO: 291789 - RNA, 22 nt, Homo sapiens
acggcacugguggaaguguagc

SEQ ID NO: 291790 - RNA, 22 nt, Homo sapiens
acuacauaugacaucuucuuua

SEQ ID NO: 291791 - RNA, 22 nt, Homo sapiens
acuagaugauuauguuccauug

SEQ ID NO: 291792 - RNA, 22 nt, Homo sapiens
acuaugcuuuucuuagaauuaa

SEQ ID NO: 291793 - RNA, 22 nt, Homo sapiens
acucacagcaaccuccgccucc

SEQ ID NO: 291794 - RNA, 22 nt, Homo sapiens
acucagagaacauucccagucu

SEQ ID NO: 291795 - RNA, 22 nt, Homo sapiens
acucagagugggccccuagaua

SEQ ID NO: 291796 - RNA, 22 nt, Homo sapiens
acucuguauaaacauugcugua

SEQ ID NO: 291797 - RNA, 22 nt, Homo sapiens
acucuguugucuggccuuccug

SEQ ID NO: 291798 - RNA, 22 nt, Homo sapiens
acugagccuuuaaaugacuuca

SEQ ID NO: 291799 - RNA, 22 nt, Homo sapiens
acugagucauugaggcccucuc

SEQ ID NO: 291800 - RNA, 23 nt, Homo sapiens
acugcaauuacguuugcaccaac

SEQ ID NO: 291801 - RNA, 21 nt, Homo sapiens
acugcacuccaaccucaacag

SEQ ID NO: 291802 - RNA, 19 nt, Homo sapiens
acugcacuccaaccuccug

SEQ ID NO: 291803 - RNA, 22 nt, Homo sapiens
acugcacuccacccuuggcagc

SEQ ID NO: 291804 - RNA, 22 nt, Homo sapiens
acugcacuccaccuugggcaac

SEQ ID NO: 291805 - RNA, 22 nt, Homo sapiens
acugcacuccagacucugucuc

SEQ ID NO: 291806 - RNA, 22 nt, Homo sapiens
acugcacuccagccucccgucu

SEQ ID NO: 291807 - RNA, 22 nt, Homo sapiens
acugcacuccagccuccugggu

SEQ ID NO: 291808 - RNA, 22 nt, Homo sapiens
acugcacuccagccucgcaaca

SEQ ID NO: 291809 - RNA, 22 nt, Homo sapiens
acugcacuccagccucggcaau

SEQ ID NO: 291810 - RNA, 22 nt, Homo sapiens
acugcacuccagccucggggac

SEQ ID NO: 291811 - RNA, 22 nt, Homo sapiens
acugcacuccagccucguggac

SEQ ID NO: 291812 - RNA, 22 nt, Homo sapiens
acugcacuccagccugagccug

SEQ ID NO: 291813 - RNA, 22 nt, Homo sapiens
acugcacuccagccugcccaac

SEQ ID NO: 291814 - RNA, 22 nt, Homo sapiens
acugcacuccagccugccgaca

SEQ ID NO: 291815 - RNA, 22 nt, Homo sapiens
acugcacuccagccugcuggau

SEQ ID NO: 291816 - RNA, 22 nt, Homo sapiens
acugcacuccagccugugcgua

SEQ ID NO: 291817 - RNA, 22 nt, Homo sapiens
acugcacuccagccuguugaca

SEQ ID NO: 291818 - RNA, 22 nt, Homo sapiens
acugcacuccagccuucggaca

SEQ ID NO: 291819 - RNA, 22 nt, Homo sapiens
acugcacuccagccuugcgaca

SEQ ID NO: 291820 - RNA, 22 nt, Homo sapiens
acugcacuccagccuuggccac

SEQ ID NO: 291821 - RNA, 22 nt, Homo sapiens
acugcacuccagcuuuggguga

SEQ ID NO: 291822 - RNA, 20 nt, Homo sapiens
acugcacuccagucucuggg

SEQ ID NO: 291823 - RNA, 18 nt, Homo sapiens
acugcacuccauccuagg

SEQ ID NO: 291824 - RNA, 22 nt, Homo sapiens
acugcacuccuccuugggugac

SEQ ID NO: 291825 - RNA, 22 nt, Homo sapiens
acugcacucuagcuugggugac

SEQ ID NO: 291826 - RNA, 22 nt, Homo sapiens
acugcacugcagccuggccaac

SEQ ID NO: 291827 - RNA, 22 nt, Homo sapiens
acugcacuucagccuuggggac

SEQ ID NO: 291828 - RNA, 21 nt, Homo sapiens
acuggaccccuuccauacacc

SEQ ID NO: 291829 - RNA, 22 nt, Homo sapiens
acuggcaauggcagaaauaguu

SEQ ID NO: 291830 - RNA, 20 nt, Homo sapiens
acuggcacugguaggugugg

SEQ ID NO: 291831 - RNA, 22 nt, Homo sapiens
acuggcuuuugagaaaaacacu

SEQ ID NO: 291832 - RNA, 22 nt, Homo sapiens
acuggguuaauuugaagguuga

SEQ ID NO: 291833 - RNA, 22 nt, Homo sapiens
acuguacuccagccugggugac

SEQ ID NO: 291834 - RNA, 22 nt, Homo sapiens
acuguacucuacccugggcaac

SEQ ID NO: 291835 - RNA, 22 nt, Homo sapiens
auucaagggauuucaggaggcu

SEQ ID NO: 291836 - RNA, 23 nt, Homo sapiens
auucaaguagugagagugguuau

SEQ ID NO: 291837 - RNA, 22 nt, Homo sapiens
auucacagcuuuaaaaggcgug

SEQ ID NO: 291838 - RNA, 22 nt, Homo sapiens
auucaccauggaccaggggccu

SEQ ID NO: 291839 - RNA, 22 nt, Homo sapiens
auucauagugcuaagguguauc

SEQ ID NO: 291840 - RNA, 22 nt, Homo sapiens
auuccacaguuaacacagaccg

SEQ ID NO: 291841 - RNA, 22 nt, Homo sapiens
auuccacuuagugacucauuug

SEQ ID NO: 291842 - RNA, 22 nt, Homo sapiens
auuccacuuauaugagguaucu

SEQ ID NO: 291843 - RNA, 22 nt, Homo sapiens
auuccaguggguuuacauccca

SEQ ID NO: 291844 - RNA, 22 nt, Homo sapiens
auuccuuaggcccuuugguuag

SEQ ID NO: 291845 - RNA, 18 nt, Homo sapiens
auucuacaggccuuuuga

SEQ ID NO: 291846 - RNA, 22 nt, Homo sapiens
auugaacaugccauauguacca

SEQ ID NO: 291847 - RNA, 22 nt, Homo sapiens
auugaauuugguuugcuaagaa

SEQ ID NO: 291848 - RNA, 22 nt, Homo sapiens
auugacacugauuuuucuuuaa

SEQ ID NO: 291849 - RNA, 18 nt, Homo sapiens
auugagcaugacagaccu

SEQ ID NO: 291850 - RNA, 22 nt, Homo sapiens
auugaguaaaugaaaauugccu

SEQ ID NO: 291851 - RNA, 22 nt, Homo sapiens
auugauagaucauaugguaggu

SEQ ID NO: 291852 - RNA, 22 nt, Homo sapiens
auugcaccacugcccuccagcc

SEQ ID NO: 291853 - RNA, 22 nt, Homo sapiens
auugcacuccagccuaggcaac

SEQ ID NO: 291854 - RNA, 22 nt, Homo sapiens
auugcacuccagccuagguaac

SEQ ID NO: 291855 - RNA, 22 nt, Homo sapiens
auugcacuccagccuagucaac

SEQ ID NO: 291856 - RNA, 22 nt, Homo sapiens
auugcacuccagccugcggaac

SEQ ID NO: 291857 - RNA, 22 nt, Homo sapiens
auugcacuccagccuggccgag

SEQ ID NO: 291858 - RNA, 22 nt, Homo sapiens
auugcacuccagccugggcaac

SEQ ID NO: 291859 - RNA, 22 nt, Homo sapiens
auugcacuccagccugggcagc

SEQ ID NO: 291860 - RNA, 21 nt, Homo sapiens
auugcacuccagccugggcga

SEQ ID NO: 291861 - RNA, 22 nt, Homo sapiens
auugcacuccagccugggcgac

SEQ ID NO: 291862 - RNA, 22 nt, Homo sapiens
auugcacuccagccuugacaca

SEQ ID NO: 291863 - RNA, 22 nt, Homo sapiens
auugcacuccagucugggcaac

SEQ ID NO: 291864 - RNA, 22 nt, Homo sapiens
auugcacuccauccuaggugac

SEQ ID NO: 291865 - RNA, 22 nt, Homo sapiens
auugcacuccggccugggugac

SEQ ID NO: 291866 - RNA, 22 nt, Homo sapiens
auugcacucuagccugggugac

SEQ ID NO: 291867 - RNA, 22 nt, Homo sapiens
auugcacucuagccuuggcgac

SEQ ID NO: 291868 - RNA, 22 nt, Homo sapiens
auugcacuggggguuagaauuu

SEQ ID NO: 291869 - RNA, 22 nt, Homo sapiens
auugcagaaaugacagagcgcc

SEQ ID NO: 291870 - RNA, 22 nt, Homo sapiens
auugcaguuagaacagaagucu

SEQ ID NO: 291871 - RNA, 22 nt, Homo sapiens
auugcucacacaaagccuguuu

SEQ ID NO: 291872 - RNA, 22 nt, Homo sapiens
auugcucuuagaaauauuucuu

SEQ ID NO: 291873 - RNA, 22 nt, Homo sapiens
auugcuuaagucccuguauuag

SEQ ID NO: 291874 - RNA, 22 nt, Homo sapiens
auugcuuacccuguauuagauc

SEQ ID NO: 291875 - RNA, 22 nt, Homo sapiens
auuggacagcauuucuagacuu

SEQ ID NO: 291876 - RNA, 22 nt, Homo sapiens
auuggccccguuuuaaauguca

SEQ ID NO: 291877 - RNA, 22 nt, Homo sapiens
auuggcuuuugaaagucugcga

SEQ ID NO: 291878 - RNA, 22 nt, Homo sapiens
auuggucuauuaaaccuaaguu

SEQ ID NO: 291879 - RNA, 22 nt, Homo sapiens
auuguacucuagccucugggca

SEQ ID NO: 291880 - RNA, 22 nt, Homo sapiens
auugucauuuauaacuguguag

SEQ ID NO: 291881 - RNA, 22 nt, Homo sapiens
auuguucuuacaugcugucauc

SEQ ID NO: 291882 - RNA, 20 nt, Homo sapiens
auuuggcauaguuuaagcaa

SEQ ID NO: 291883 - RNA, 22 nt, Homo sapiens
auuugggaaugugcauuauacu

SEQ ID NO: 291884 - RNA, 22 nt, Homo sapiens
auuuggguaaugagugcaaggg

SEQ ID NO: 291885 - RNA, 22 nt, Homo sapiens
auuuggguuuuacaucaggcua

SEQ ID NO: 291886 - RNA, 22 nt, Homo sapiens
auuugguuauucaguuguucag

SEQ ID NO: 291887 - RNA, 22 nt, Homo sapiens
auuugucacuauguggcuaaua

SEQ ID NO: 291888 - RNA, 22 nt, Homo sapiens
auuuguccugccuuuuccuccu

SEQ ID NO: 291889 - RNA, 22 nt, Homo sapiens
auuuugcauugcuguaaaggaa

SEQ ID NO: 291890 - RNA, 22 nt, Homo sapiens
auuuugguuacauaguugagcu

SEQ ID NO: 291891 - RNA, 21 nt, Homo sapiens
auuuuugcagagcugguagug

SEQ ID NO: 291892 - RNA, 22 nt, Homo sapiens
auuuuugguugguaggcuauua

SEQ ID NO: 291893 - RNA, 22 nt, Homo sapiens
auuuuugguuucaccugcacgc

SEQ ID NO: 291894 - RNA, 22 nt, Homo sapiens
caaagugcugaaagaggccagg

SEQ ID NO: 291895 - RNA, 22 nt, Homo sapiens
caaagugcuggccgggcgcagu

SEQ ID NO: 291896 - RNA, 22 nt, Homo sapiens
caaagugcugggacuggccggg

SEQ ID NO: 291897 - RNA, 22 nt, Homo sapiens
caacacuguuuauuggauagcc

SEQ ID NO: 291898 - RNA, 22 nt, Homo sapiens
caacaguaaagcauuuuuaagu

SEQ ID NO: 291899 - RNA, 19 nt, Homo sapiens
caacccugcagagaaagga

SEQ ID NO: 291900 - RNA, 22 nt, Homo sapiens
caacucuguaggauccaggugg

SEQ ID NO: 291901 - RNA, 22 nt, Homo sapiens
caagagaccugagugucauucu

SEQ ID NO: 291902 - RNA, 22 nt, Homo sapiens
caagagagcugaugguuuuaaa

SEQ ID NO: 291903 - RNA, 22 nt, Homo sapiens
caagaggcuguguauaaagcca

SEQ ID NO: 291904 - RNA, 22 nt, Homo sapiens
caaggugcugagacaggagccc

SEQ ID NO: 291905 - RNA, 21 nt, Homo sapiens
caagugaugcuucugcuuuaa

SEQ ID NO: 291906 - RNA, 22 nt, Homo sapiens
caagugcuugaugaaugaucaa

SEQ ID NO: 291907 - RNA, 22 nt, Homo sapiens
caaguguuggcuuguauacaaa

SEQ ID NO: 291908 - RNA, 22 nt, Homo sapiens
caaguguuuccuuaaauacuug

SEQ ID NO: 291909 - RNA, 22 nt, Homo sapiens
caauacuguuaccugaaauagg

SEQ ID NO: 291910 - RNA, 22 nt, Homo sapiens
cacaaugucuaagauguuucua

SEQ ID NO: 291911 - RNA, 22 nt, Homo sapiens
cacagagugagacccugucucu

SEQ ID NO: 291912 - RNA, 22 nt, Homo sapiens
cacagcacaggcaugaguguca

SEQ ID NO: 291913 - RNA, 22 nt, Homo sapiens
cacagcgacuuccgccuaccgg

SEQ ID NO: 291914 - RNA, 22 nt, Homo sapiens
cacaggaagaggcacggucccu

SEQ ID NO: 291915 - RNA, 22 nt, Homo sapiens
cacaggccugucucuuucuaac

SEQ ID NO: 291916 - RNA, 22 nt, Homo sapiens
cacagugaacaauauccucugu

SEQ ID NO: 291917 - RNA, 22 nt, Homo sapiens
aucuagagacauaguaaagaau

SEQ ID NO: 291918 - RNA, 22 nt, Homo sapiens
aucucugagauguucugauuuu

SEQ ID NO: 291919 - RNA, 20 nt, Homo sapiens
aucucugggcaaaggaaaau

SEQ ID NO: 291920 - RNA, 22 nt, Homo sapiens
aucugacuuuuaauuugaaaac

SEQ ID NO: 291921 - RNA, 22 nt, Homo sapiens
aucugggguuggcaaaguuugg

SEQ ID NO: 291922 - RNA, 22 nt, Homo sapiens
auacaguguauguauaguacau

SEQ ID NO: 291923 - RNA, 22 nt, Homo sapiens
auacaugugcaggucagguuac

SEQ ID NO: 291924 - RNA, 22 nt, Homo sapiens
auacauguucaagggcauauau

SEQ ID NO: 291925 - RNA, 16 nt, Homo sapiens
auaccacagugacaca

SEQ ID NO: 291926 - RNA, 22 nt, Homo sapiens
auacccaguaguggaauugcua

SEQ ID NO: 291927 - RNA, 22 nt, Homo sapiens
auacuccugucucagcugagau

SEQ ID NO: 291928 - RNA, 22 nt, Homo sapiens
auacugccuuuagcaaaacagu

SEQ ID NO: 291929 - RNA, 22 nt, Homo sapiens
auacuggcuuuccaauugugau

SEQ ID NO: 291930 - RNA, 22 nt, Homo sapiens
auacuguuucugaacuuugauu

SEQ ID NO: 291931 - RNA, 22 nt, Homo sapiens
auagaauguauuaguaaauuug

SEQ ID NO: 291932 - RNA, 22 nt, Homo sapiens
auagacugaguggcuuaaacca

SEQ ID NO: 291933 - RNA, 23 nt, Homo sapiens
auagagcuaggaugcagacagau

SEQ ID NO: 291934 - RNA, 22 nt, Homo sapiens
auagagugcuucaucaguagua

SEQ ID NO: 291935 - RNA, 22 nt, Homo sapiens
auagcaaugccccaauccuugg

SEQ ID NO: 291936 - RNA, 22 nt, Homo sapiens
auagcaaugccccauucccagu

SEQ ID NO: 291937 - RNA, 22 nt, Homo sapiens
auagcacauggcauccucucuu

SEQ ID NO: 291938 - RNA, 22 nt, Homo sapiens
auagcacaugugcaaauggcug

SEQ ID NO: 291939 - RNA, 22 nt, Homo sapiens
auagcagaacagugucucacug

SEQ ID NO: 291940 - RNA, 22 nt, Homo sapiens
auagcagaccaccucucccacu

SEQ ID NO: 291941 - RNA, 20 nt, Homo sapiens
auagcagcaugauuuauaau

SEQ ID NO: 291942 - RNA, 20 nt, Homo sapiens
auagcagcaugauuuauagu

SEQ ID NO: 291943 - RNA, 22 nt, Homo sapiens
auagcagcucacuuauuuaugg

SEQ ID NO: 291944 - RNA, 22 nt, Homo sapiens
auagcauaucccacaugucaga

SEQ ID NO: 291945 - RNA, 22 nt, Homo sapiens
auagccucauucuucagaugag

SEQ ID NO: 291946 - RNA, 22 nt, Homo sapiens
auagggcacgagaugugagccu

SEQ ID NO: 291947 - RNA, 22 nt, Homo sapiens
auagguuauuagagcaaagcuu

SEQ ID NO: 291948 - RNA, 22 nt, Homo sapiens
auaguacuauugcaguguuaua

SEQ ID NO: 291949 - RNA, 22 nt, Homo sapiens
auaguagagagggcaaaaugcu

SEQ ID NO: 291950 - RNA, 22 nt, Homo sapiens
auagugaacuuugugagaacaa

SEQ ID NO: 291951 - RNA, 22 nt, Homo sapiens
auagugcagugaugaaccuagg

SEQ ID NO: 291952 - RNA, 21 nt, Homo sapiens
auagugcuagagaguagcagg

SEQ ID NO: 291953 - RNA, 22 nt, Homo sapiens
auagugcuauggcagaccuuga

SEQ ID NO: 291954 - RNA, 22 nt, Homo sapiens
auagugcugcaagaaacauacg

SEQ ID NO: 291955 - RNA, 22 nt, Homo sapiens
auagugcugcaauuaacauaca

SEQ ID NO: 291956 - RNA, 19 nt, Homo sapiens
auaguguaggaaaacagcu

SEQ ID NO: 291957 - RNA, 22 nt, Homo sapiens
auauagcaaugaaagagaugaa

SEQ ID NO: 291958 - RNA, 22 nt, Homo sapiens
auauaugcuaagugcuaauaaa

SEQ ID NO: 291959 - RNA, 22 nt, Homo sapiens
auaucccuguauaagugaaugu

SEQ ID NO: 291960 - RNA, 22 nt, Homo sapiens
auauggcauucagaacuguaua

SEQ ID NO: 291961 - RNA, 22 nt, Homo sapiens
auauggcuaugugagcauacca

SEQ ID NO: 291962 - RNA, 17 nt, Homo sapiens
auaugucugcuggggga

SEQ ID NO: 291963 - RNA, 22 nt, Homo sapiens
auaugucuguuuagucuguaau

SEQ ID NO: 291964 - RNA, 22 nt, Homo sapiens
auauuacuggccauaucgcagg

SEQ ID NO: 291965 - RNA, 22 nt, Homo sapiens
auauuacuggcuauaucgcaag

SEQ ID NO: 291966 - RNA, 22 nt, Homo sapiens
auauugacuuucucuuagauca

SEQ ID NO: 291967 - RNA, 22 nt, Homo sapiens
auauuguuggcugcuggcugau

SEQ ID NO: 291968 - RNA, 22 nt, Homo sapiens
aucaaacugcaaggcagcagca

SEQ ID NO: 291969 - RNA, 22 nt, Homo sapiens
aucaaagcagcauggcccaguc

SEQ ID NO: 291970 - RNA, 22 nt, Homo sapiens
aucaaaguaggcauauguuuuu

SEQ ID NO: 291971 - RNA, 22 nt, Homo sapiens
aucaaagugaauuaaugagaau

SEQ ID NO: 291972 - RNA, 22 nt, Homo sapiens
aucacacuguuauuuuaguuaa

SEQ ID NO: 291973 - RNA, 22 nt, Homo sapiens
aucacagaacuuugagcagaga

SEQ ID NO: 291974 - RNA, 22 nt, Homo sapiens
aucacagcuacuccucugucuu

SEQ ID NO: 291975 - RNA, 22 nt, Homo sapiens
aucacaggcaaaauuccuucuc

SEQ ID NO: 291976 - RNA, 22 nt, Homo sapiens
aucacaguggcucacaagagcc

SEQ ID NO: 291977 - RNA, 22 nt, Homo sapiens
aucacuagaucauagguaaaca

SEQ ID NO: 291978 - RNA, 20 nt, Homo sapiens
aucacuggagaaggaaaccu

SEQ ID NO: 291979 - RNA, 22 nt, Homo sapiens
aucacugggcaagauaucauga

SEQ ID NO: 291980 - RNA, 22 nt, Homo sapiens
aucacuggucaugagagaagua

SEQ ID NO: 291981 - RNA, 22 nt, Homo sapiens
aucacuguccacucaucuuucu

SEQ ID NO: 291982 - RNA, 22 nt, Homo sapiens
aucacugugauuucuacugugc

SEQ ID NO: 291983 - RNA, 22 nt, Homo sapiens
aucacuuugcucuccagugugg

SEQ ID NO: 291984 - RNA, 22 nt, Homo sapiens
aucagagugaugguuuaaguau

SEQ ID NO: 291985 - RNA, 22 nt, Homo sapiens
aucagauguuuguauaggagua

SEQ ID NO: 291986 - RNA, 22 nt, Homo sapiens
aucagcacugaucauacagcuu

SEQ ID NO: 291987 - RNA, 22 nt, Homo sapiens
aucagugagugguuagugaaug

SEQ ID NO: 291988 - RNA, 22 nt, Homo sapiens
aucagugauugauuuaaagacg

SEQ ID NO: 291989 - RNA, 22 nt, Homo sapiens
aucauagcucacugcagccucg

SEQ ID NO: 291990 - RNA, 22 nt, Homo sapiens
aucauccagccccagaagggag

SEQ ID NO: 291991 - RNA, 22 nt, Homo sapiens
aucauguaguaagacacauuua

SEQ ID NO: 291992 - RNA, 22 nt, Homo sapiens
aucauguuuauguguaggauau

SEQ ID NO: 291993 - RNA, 22 nt, Homo sapiens
auccaagagacugaugacuucc

SEQ ID NO: 291994 - RNA, 22 nt, Homo sapiens
auccacauucauggaccagucc

SEQ ID NO: 291995 - RNA, 23 nt, Homo sapiens
auccacauucuaguccuuuaugc

SEQ ID NO: 291996 - RNA, 20 nt, Homo sapiens
aucccauuccugaagauacu

SEQ ID NO: 291997 - RNA, 22 nt, Homo sapiens
aucccuguguccagcaccugug

SEQ ID NO: 291998 - RNA, 22 nt, Homo sapiens
aucccuuucucuggcuaggggg

SEQ ID NO: 291999 - RNA, 22 nt, Homo sapiens
aucccuuucugauacuuucccu

SEQ ID NO: 292000 - RNA, 22 nt, Homo sapiens
auccugaagcuuuacugaauuc

SEQ ID NO: 292001 - RNA, 20 nt, Homo sapiens
aucguggccugaggagauac

SEQ ID NO: 292002 - RNA, 22 nt, Homo sapiens
gucagcaaaguucuccugcaga

SEQ ID NO: 292003 - RNA, 22 nt, Homo sapiens
gucagcaucaccaugucuauga

SEQ ID NO: 292004 - RNA, 22 nt, Homo sapiens
gucaggaccucgguggcauucu

SEQ ID NO: 292005 - RNA, 22 nt, Homo sapiens
gucagguaccugaaagcagcca

SEQ ID NO: 292006 - RNA, 22 nt, Homo sapiens
gucaguggauacugucucuguc

SEQ ID NO: 292007 - RNA, 22 nt, Homo sapiens
gucagugucuuugcagcucaga

SEQ ID NO: 292008 - RNA, 22 nt, Homo sapiens
gucaguucuugugguugcauuc

SEQ ID NO: 292009 - RNA, 22 nt, Homo sapiens
gucaugggguacuacacauggg

SEQ ID NO: 292010 - RNA, 22 nt, Homo sapiens
gucauugcuuaaggguucaugc

SEQ ID NO: 292011 - RNA, 22 nt, Homo sapiens
gucauugucaauugacaauugu

SEQ ID NO: 292012 - RNA, 22 nt, Homo sapiens
guccaguuguuuucugagguug

SEQ ID NO: 292013 - RNA, 22 nt, Homo sapiens
gucccugcgauugugggauccu

SEQ ID NO: 292014 - RNA, 22 nt, Homo sapiens
guccuggagaagcguggaccgg

SEQ ID NO: 292015 - RNA, 22 nt, Homo sapiens
gucuaguuuuaauacauuaaga

SEQ ID NO: 292016 - RNA, 18 nt, Homo sapiens
gucucacaugguggaagc

SEQ ID NO: 292017 - RNA, 22 nt, Homo sapiens
gucucccagccuacauauuucu

SEQ ID NO: 292018 - RNA, 22 nt, Homo sapiens
gucucugagaugucaacaccua

SEQ ID NO: 292019 - RNA, 22 nt, Homo sapiens
gucucuuguuaucauuucugag

SEQ ID NO: 292020 - RNA, 22 nt, Homo sapiens
gucugagcauggggccggcagg

SEQ ID NO: 292021 - RNA, 22 nt, Homo sapiens
gucuggcuccuucuacuacaug

SEQ ID NO: 292022 - RNA, 22 nt, Homo sapiens
gucuggguuuguuuguacuugc

SEQ ID NO: 292023 - RNA, 22 nt, Homo sapiens
gucugguacuuguuuguaaggg

SEQ ID NO: 292024 - RNA, 22 nt, Homo sapiens
gucugguuccugggagauuucu

SEQ ID NO: 292025 - RNA, 20 nt, Homo sapiens
gucugucuccgaguagaauu

SEQ ID NO: 292026 - RNA, 22 nt, Homo sapiens
gucugugcauuaauacgugcug

SEQ ID NO: 292027 - RNA, 20 nt, Homo sapiens
gucuugcuccguugcccagg

SEQ ID NO: 292028 - RNA, 22 nt, Homo sapiens
gucuuggagaacucagcuuggc

SEQ ID NO: 292029 - RNA, 22 nt, Homo sapiens
gucuuuaguugaaacauguggu

SEQ ID NO: 292030 - RNA, 22 nt, Homo sapiens
gucuuugcauguauguucauga

SEQ ID NO: 292031 - RNA, 22 nt, Homo sapiens
gucuuuguuuugauuuaccaga

SEQ ID NO: 292032 - RNA, 22 nt, Homo sapiens
gugaaagacauauaugguuuga

SEQ ID NO: 292033 - RNA, 22 nt, Homo sapiens
gugaaguuuuugugaggccuaa

SEQ ID NO: 292034 - RNA, 22 nt, Homo sapiens
gugaaguuuuuugcugagaguc

SEQ ID NO: 292035 - RNA, 22 nt, Homo sapiens
gugaaucauaugccagucaugc

SEQ ID NO: 292036 - RNA, 22 nt, Homo sapiens
gugacaucagcuccagguauaa

SEQ ID NO: 292037 - RNA, 22 nt, Homo sapiens
gugacauuauuucagcuacaug

SEQ ID NO: 292038 - RNA, 22 nt, Homo sapiens
gugacugggaguggugaagaua

SEQ ID NO: 292039 - RNA, 22 nt, Homo sapiens
gugagaagaaaaauauggcugu

SEQ ID NO: 292040 - RNA, 22 nt, Homo sapiens
gugagaccaauguacuaccuuc

SEQ ID NO: 292041 - RNA, 22 nt, Homo sapiens
gugagauaaugucucauugugg

SEQ ID NO: 292042 - RNA, 22 nt, Homo sapiens
gugagauccucucuuauauggg

SEQ ID NO: 292043 - RNA, 22 nt, Homo sapiens
gugagauggaguuggugucuuu

SEQ ID NO: 292044 - RNA, 19 nt, Homo sapiens
gugagcaaugcauugcacu

SEQ ID NO: 292045 - RNA, 22 nt, Homo sapiens
gugagcacugaaagaaggcaag

SEQ ID NO: 292046 - RNA, 22 nt, Homo sapiens
gugagcauaacaacagaguuua

SEQ ID NO: 292047 - RNA, 22 nt, Homo sapiens
gugagcauucaaggaaggagcu

SEQ ID NO: 292048 - RNA, 22 nt, Homo sapiens
gugaggaaggaaaccugcuagc

SEQ ID NO: 292049 - RNA, 20 nt, Homo sapiens
gugagguagaggguuaccug

SEQ ID NO: 292050 - RNA, 22 nt, Homo sapiens
gugagguauacugggaucacua

SEQ ID NO: 292051 - RNA, 22 nt, Homo sapiens
gugagguguuaaccaaccugug

SEQ ID NO: 292052 - RNA, 22 nt, Homo sapiens
gugaguaaagguucauugaauu

SEQ ID NO: 292053 - RNA, 22 nt, Homo sapiens
gugagucaugucccaucugauu

SEQ ID NO: 292054 - RNA, 20 nt, Homo sapiens
gugagucauuaguaaccaaa

SEQ ID NO: 292055 - RNA, 22 nt, Homo sapiens
gugauacugcuuauuaauuuaa

SEQ ID NO: 292056 - RNA, 22 nt, Homo sapiens
gugauaucuuacaauucucuuu

SEQ ID NO: 292057 - RNA, 23 nt, Homo sapiens
gugaucauuguuguggguugaau

SEQ ID NO: 292058 - RNA, 22 nt, Homo sapiens
gugaucuuucaggcuugaccau

SEQ ID NO: 292059 - RNA, 22 nt, Homo sapiens
gugauuauccacgucuuuguga

SEQ ID NO: 292060 - RNA, 22 nt, Homo sapiens
gugauugucuaaucaagauaca

SEQ ID NO: 292061 - RNA, 22 nt, Homo sapiens
gugauuuaguagaugcuaguua

SEQ ID NO: 292062 - RNA, 22 nt, Homo sapiens
gugcaaauguuauugagguuuu

SEQ ID NO: 292063 - RNA, 22 nt, Homo sapiens
gugcaacaucccuccauaauuu

SEQ ID NO: 292064 - RNA, 22 nt, Homo sapiens
gugcaagagugauugcaguuuu

SEQ ID NO: 292065 - RNA, 22 nt, Homo sapiens
gugcacaacaugcaguuuuguu

SEQ ID NO: 292066 - RNA, 22 nt, Homo sapiens
gugcacaaucgugcauuccuug

SEQ ID NO: 292067 - RNA, 21 nt, Homo sapiens
gugcacaguaguguuuaauag

SEQ ID NO: 292068 - RNA, 22 nt, Homo sapiens
gugcacuguagaacccuuuguu

SEQ ID NO: 292069 - RNA, 22 nt, Homo sapiens
gugcagugugauccuuccguau

SEQ ID NO: 292070 - RNA, 22 nt, Homo sapiens
gugcaguuuacaguuacccagu

SEQ ID NO: 292071 - RNA, 22 nt, Homo sapiens
gugcauacgucuuuauaguagc

SEQ ID NO: 292072 - RNA, 19 nt, Homo sapiens
gugcauaguuauuaaagag

SEQ ID NO: 292073 - RNA, 22 nt, Homo sapiens
gugcauaugcaugugcaugcac

SEQ ID NO: 292074 - RNA, 22 nt, Homo sapiens
gugcaugucugugacgacccug

SEQ ID NO: 292075 - RNA, 22 nt, Homo sapiens
gugccacugcaccuggccuaag

SEQ ID NO: 292076 - RNA, 22 nt, Homo sapiens
gugcccacugucuguccuguag

SEQ ID NO: 292077 - RNA, 22 nt, Homo sapiens
gugccuucuagcuaugguuggc

SEQ ID NO: 292078 - RNA, 22 nt, Homo sapiens
gugccuuuucugagcaaugagc

SEQ ID NO: 292079 - RNA, 22 nt, Homo sapiens
gugcgggaggcgcgccuaggug

SEQ ID NO: 292080 - RNA, 22 nt, Homo sapiens
gugcuauguuauccagcaagau

SEQ ID NO: 292081 - RNA, 22 nt, Homo sapiens
guggaaaaguaguugcgguuuu

SEQ ID NO: 292082 - RNA, 22 nt, Homo sapiens
guggaaaauuauugcuguuuuu

SEQ ID NO: 292083 - RNA, 20 nt, Homo sapiens
guggaagauaaguagccuga

SEQ ID NO: 292084 - RNA, 22 nt, Homo sapiens
ucaguagagacaggauuucacc

SEQ ID NO: 292085 - RNA, 23 nt, Homo sapiens
ucaguagucauugggaaagugug

SEQ ID NO: 292086 - RNA, 18 nt, Homo sapiens
ucagucacugccuggcuu

SEQ ID NO: 292087 - RNA, 22 nt, Homo sapiens
ucagugauugguuauuuuaggc

SEQ ID NO: 292088 - RNA, 22 nt, Homo sapiens
ucaguggacuuagucuuucccc

SEQ ID NO: 292089 - RNA, 22 nt, Homo sapiens
ucaguggauuauuaaagucacc

SEQ ID NO: 292090 - RNA, 22 nt, Homo sapiens
ucagugucaucuggguuguuug

SEQ ID NO: 292091 - RNA, 23 nt, Homo sapiens
ucagugucuggauccugcucagu

SEQ ID NO: 292092 - RNA, 22 nt, Homo sapiens
ucagugucugugauggagaggu

SEQ ID NO: 292093 - RNA, 22 nt, Homo sapiens
ucagugucugugcaccgcugga

SEQ ID NO: 292094 - RNA, 21 nt, Homo sapiens
ucaguuacugagagagaagug

SEQ ID NO: 292095 - RNA, 22 nt, Homo sapiens
ucaguucauggaggugucugcu

SEQ ID NO: 292096 - RNA, 22 nt, Homo sapiens
ucauacaggccaccagggaagu

SEQ ID NO: 292097 - RNA, 20 nt, Homo sapiens
ucauacuguggaguaccagg

SEQ ID NO: 292098 - RNA, 22 nt, Homo sapiens
ucauacuguugugaaacaaaac

SEQ ID NO: 292099 - RNA, 20 nt, Homo sapiens
ucauagcuuuuuccacuuua

SEQ ID NO: 292100 - RNA, 20 nt, Homo sapiens
ucauagggugguggcagugg

SEQ ID NO: 292101 - RNA, 22 nt, Homo sapiens
ucauauguaugugcaauuuugu

SEQ ID NO: 292102 - RNA, 22 nt, Homo sapiens
ucaucagaaucccuuagggaug

SEQ ID NO: 292103 - RNA, 22 nt, Homo sapiens
ucauccauacaguuagcaaagg

SEQ ID NO: 292104 - RNA, 22 nt, Homo sapiens
ucaugacacuggcaggagcuaa

SEQ ID NO: 292105 - RNA, 23 nt, Homo sapiens
ucaugaggccauucaaauccauu

SEQ ID NO: 292106 - RNA, 22 nt, Homo sapiens
ucaugcaaugagucaggaggca

SEQ ID NO: 292107 - RNA, 20 nt, Homo sapiens
ucaugccacugcgcuccagc

SEQ ID NO: 292108 - RNA, 22 nt, Homo sapiens
ucauguaauuuugugucuauga

SEQ ID NO: 292109 - RNA, 22 nt, Homo sapiens
ucauucacucccuugaaguuag

SEQ ID NO: 292110 - RNA, 22 nt, Homo sapiens
ucauugcacuccagccugggug

SEQ ID NO: 292111 - RNA, 22 nt, Homo sapiens
ucauuggauggaaugcucugua

SEQ ID NO: 292112 - RNA, 18 nt, Homo sapiens
ucauuggugagcaccucc

SEQ ID NO: 292113 - RNA, 22 nt, Homo sapiens
uccaagaugcuggcagcuacag

SEQ ID NO: 292114 - RNA, 19 nt, Homo sapiens
uccacagugguugaacuag

SEQ ID NO: 292115 - RNA, 22 nt, Homo sapiens
uccacguggucuaucuguccuu

SEQ ID NO: 292116 - RNA, 22 nt, Homo sapiens
uccagaguggugaugcuggggc

SEQ ID NO: 292117 - RNA, 22 nt, Homo sapiens
uccagcuuuuucuaauucugug

SEQ ID NO: 292118 - RNA, 22 nt, Homo sapiens
uccagguuuggcuuuauaacuu

SEQ ID NO: 292119 - RNA, 22 nt, Homo sapiens
uccagguuuugugaguuuaaau

SEQ ID NO: 292120 - RNA, 22 nt, Homo sapiens
uccaguuuggaggcuugaugug

SEQ ID NO: 292121 - RNA, 20 nt, Homo sapiens
uccaguuuuggagacauucu

SEQ ID NO: 292122 - RNA, 22 nt, Homo sapiens
uccaugagaauaguuaggcucu

SEQ ID NO: 292123 - RNA, 19 nt, Homo sapiens
uccaugagcccacagugau

SEQ ID NO: 292124 - RNA, 22 nt, Homo sapiens
uccaugaggcuacaguaaucuc

SEQ ID NO: 292125 - RNA, 22 nt, Homo sapiens
uccauguaguugagcggcuuug

SEQ ID NO: 292126 - RNA, 22 nt, Homo sapiens
ucccaagaugagaugggggcug

SEQ ID NO: 292127 - RNA, 16 nt, Homo sapiens
ucccaccauugcuugu

SEQ ID NO: 292128 - RNA, 22 nt, Homo sapiens
ucccagaaacgcauauguucau

SEQ ID NO: 292129 - RNA, 22 nt, Homo sapiens
ucccagugcuaugcaaaagccu

SEQ ID NO: 292130 - RNA, 22 nt, Homo sapiens
ucccaguguguagcuugucucu

SEQ ID NO: 292131 - RNA, 22 nt, Homo sapiens
ucccaguuuuucugaauaguca

SEQ ID NO: 292132 - RNA, 22 nt, Homo sapiens
ucccauugucucugaccuugcc

SEQ ID NO: 292133 - RNA, 22 nt, Homo sapiens
uccccgaggcuggagugcagug

SEQ ID NO: 292134 - RNA, 22 nt, Homo sapiens
ucccgaggacaucugggggcaa

SEQ ID NO: 292135 - RNA, 18 nt, Homo sapiens
ucccucagaauuauagaa

SEQ ID NO: 292136 - RNA, 22 nt, Homo sapiens
ucccugagcaaaguuuucugua

SEQ ID NO: 292137 - RNA, 22 nt, Homo sapiens
ucccugaguaucuaauguguuu

SEQ ID NO: 292138 - RNA, 19 nt, Homo sapiens
ucccugagucuuagcuuga

SEQ ID NO: 292139 - RNA, 22 nt, Homo sapiens
ucccugagugauugaaaauaaa

SEQ ID NO: 292140 - RNA, 22 nt, Homo sapiens
ucccuugagccuggcuucucac

SEQ ID NO: 292141 - RNA, 22 nt, Homo sapiens
uccuacugucuucggggcacug

SEQ ID NO: 292142 - RNA, 22 nt, Homo sapiens
uccugagacucacaggcucccc

SEQ ID NO: 292143 - RNA, 22 nt, Homo sapiens
uccugcauucauccugguguug

SEQ ID NO: 292144 - RNA, 22 nt, Homo sapiens
uccuggcuccacuguuuauucc

SEQ ID NO: 292145 - RNA, 22 nt, Homo sapiens
uccuucacucuacaucuuuguu

SEQ ID NO: 292146 - RNA, 22 nt, Homo sapiens
uccuugagccucccagacucag

SEQ ID NO: 292147 - RNA, 22 nt, Homo sapiens
uccuugagccuuaaauuauaaa

SEQ ID NO: 292148 - RNA, 22 nt, Homo sapiens
uccuugcacuaacuuaaggagg

SEQ ID NO: 292149 - RNA, 22 nt, Homo sapiens
uccuuuggguagcuguucagau

SEQ ID NO: 292150 - RNA, 22 nt, Homo sapiens
uccuuugguggagucuuuaggg

SEQ ID NO: 292151 - RNA, 22 nt, Homo sapiens
ucgcaccauugcacuccagcca

SEQ ID NO: 292152 - RNA, 22 nt, Homo sapiens
ucuacccugugagggacacagu

SEQ ID NO: 292153 - RNA, 15 nt, Homo sapiens
ucuaguuuugaagac

SEQ ID NO: 292154 - RNA, 22 nt, Homo sapiens
ucuaucacagugauguuccaga

SEQ ID NO: 292155 - RNA, 22 nt, Homo sapiens
ucuauggauaaaaugcccucau

SEQ ID NO: 292156 - RNA, 22 nt, Homo sapiens
ucucaaccucccaaguagcugg

SEQ ID NO: 292157 - RNA, 22 nt, Homo sapiens
ucucacaccccucucauauacc

SEQ ID NO: 292158 - RNA, 22 nt, Homo sapiens
ucucacagaguugaauguuucu

SEQ ID NO: 292159 - RNA, 22 nt, Homo sapiens
ucucacagccauuucucccucu

SEQ ID NO: 292160 - RNA, 22 nt, Homo sapiens
ucucagugugguaaaaguuuuu

SEQ ID NO: 292161 - RNA, 22 nt, Homo sapiens
ucucauagaggcagagaguaaa

SEQ ID NO: 292162 - RNA, 20 nt, Homo sapiens
ucucauagagguagagaaua

SEQ ID NO: 292163 - RNA, 20 nt, Homo sapiens
ucucauggagggaaagagca

SEQ ID NO: 292164 - RNA, 22 nt, Homo sapiens
ucucauggagucaggagcagaa

SEQ ID NO: 292165 - RNA, 22 nt, Homo sapiens
ucucauggcucacccugcauag

SEQ ID NO: 292166 - RNA, 19 nt, Homo sapiens
aucaaacugcucuuugagg

SEQ ID NO: 292167 - RNA, 22 nt, Homo sapiens
aucaaagccaugcucaguuuuc

SEQ ID NO: 292168 - RNA, 22 nt, Homo sapiens
aucaaagugaaauauuaguuau

SEQ ID NO: 292169 - RNA, 22 nt, Homo sapiens
aucaaaguuucccagaaguugu

SEQ ID NO: 292170 - RNA, 22 nt, Homo sapiens
aucaaaucuccagaaccugucu

SEQ ID NO: 292171 - RNA, 22 nt, Homo sapiens
aucaagccaaagaaaguccuug

SEQ ID NO: 292172 - RNA, 22 nt, Homo sapiens
aucaagcugcuuguuugaaucu

SEQ ID NO: 292173 - RNA, 22 nt, Homo sapiens
aucaaguaguuauacguaaagg

SEQ ID NO: 292174 - RNA, 22 nt, Homo sapiens
aucacagcccuccucuuggaug

SEQ ID NO: 292175 - RNA, 22 nt, Homo sapiens
aucacaguggucagguauagau

SEQ ID NO: 292176 - RNA, 22 nt, Homo sapiens
aucacauggccuagccuaaccu

SEQ ID NO: 292177 - RNA, 22 nt, Homo sapiens
aucacauuuauaguggcacgca

SEQ ID NO: 292178 - RNA, 22 nt, Homo sapiens
aucaccagaugcuucaagcaga

SEQ ID NO: 292179 - RNA, 19 nt, Homo sapiens
aucaccagucuuuccacug

SEQ ID NO: 292180 - RNA, 22 nt, Homo sapiens
aucaccugagcaguauacacug

SEQ ID NO: 292181 - RNA, 22 nt, Homo sapiens
aucagagugaaacaugggagau

SEQ ID NO: 292182 - RNA, 22 nt, Homo sapiens
aucagagugaauaaugacaaaa

SEQ ID NO: 292183 - RNA, 22 nt, Homo sapiens
aucagauuccagaggcagcacc

SEQ ID NO: 292184 - RNA, 22 nt, Homo sapiens
aucagcauucccaaaugaugug

SEQ ID NO: 292185 - RNA, 22 nt, Homo sapiens
aucaggaaccuuuuuggugugu

SEQ ID NO: 292186 - RNA, 22 nt, Homo sapiens
aucaggcacacauuggaguuug

SEQ ID NO: 292187 - RNA, 18 nt, Homo sapiens
aucagggugaagagagga

SEQ ID NO: 292188 - RNA, 22 nt, Homo sapiens
aucagucacugcguuuuuggga

SEQ ID NO: 292189 - RNA, 22 nt, Homo sapiens
aucauacuguuuugauuacugu

SEQ ID NO: 292190 - RNA, 22 nt, Homo sapiens
aucauaucaucugcaaacaaag

SEQ ID NO: 292191 - RNA, 22 nt, Homo sapiens
aucauauccuagauauaacuuc

SEQ ID NO: 292192 - RNA, 22 nt, Homo sapiens
aucauugugugaguugauggga

SEQ ID NO: 292193 - RNA, 22 nt, Homo sapiens
auccacaugcaguuggaaacag

SEQ ID NO: 292194 - RNA, 22 nt, Homo sapiens
auccaguguuuucuuuugucac

SEQ ID NO: 292195 - RNA, 22 nt, Homo sapiens
auccaucagacggcaggcguug

SEQ ID NO: 292196 - RNA, 22 nt, Homo sapiens
auccauugcucaagagaaguca

SEQ ID NO: 292197 - RNA, 22 nt, Homo sapiens
auccauugucuaaugcuaagau

SEQ ID NO: 292198 - RNA, 22 nt, Homo sapiens
aucccugaggaauuucugcacu

SEQ ID NO: 292199 - RNA, 22 nt, Homo sapiens
aucccuguaguaauauucuagc

SEQ ID NO: 292200 - RNA, 22 nt, Homo sapiens
aucccugugacgagcaucccua

SEQ ID NO: 292201 - RNA, 22 nt, Homo sapiens
aucccugugauccaaucacuuc

SEQ ID NO: 292202 - RNA, 22 nt, Homo sapiens
aucccuugacguggagucucug

SEQ ID NO: 292203 - RNA, 22 nt, Homo sapiens
auccucaguggcuuaaguauag

SEQ ID NO: 292204 - RNA, 22 nt, Homo sapiens
auccucugagagaguuucauaa

SEQ ID NO: 292205 - RNA, 22 nt, Homo sapiens
auccucugagaucuaggcagag

SEQ ID NO: 292206 - RNA, 22 nt, Homo sapiens
auccugagacuuugcugaaguu

SEQ ID NO: 292207 - RNA, 22 nt, Homo sapiens
auccugaugacacagugcugca

SEQ ID NO: 292208 - RNA, 21 nt, Homo sapiens
auccuucuuuuucaaccugug

SEQ ID NO: 292209 - RNA, 22 nt, Homo sapiens
auccuuuagacuguccaguuga

SEQ ID NO: 292210 - RNA, 21 nt, Homo sapiens
aucgcacaauauaccccugua

SEQ ID NO: 292211 - RNA, 22 nt, Homo sapiens
aucuaaaucucauaugggcaca

SEQ ID NO: 292212 - RNA, 21 nt, Homo sapiens
aucucacuugaauguaaaagc

SEQ ID NO: 292213 - RNA, 22 nt, Homo sapiens
aucuccaggugccagcugcgcc

SEQ ID NO: 292214 - RNA, 22 nt, Homo sapiens
aucugcaaauaaugaagauugg

SEQ ID NO: 292215 - RNA, 22 nt, Homo sapiens
aucugcuccuggugaggguuuc

SEQ ID NO: 292216 - RNA, 22 nt, Homo sapiens
aucugguauuacugcaacugua

SEQ ID NO: 292217 - RNA, 22 nt, Homo sapiens
aucugugguuguaugcauauua

SEQ ID NO: 292218 - RNA, 21 nt, Homo sapiens
aucuugguauagucuuauugg

SEQ ID NO: 292219 - RNA, 22 nt, Homo sapiens
aucuuuaguggcuguuuucaga

SEQ ID NO: 292220 - RNA, 22 nt, Homo sapiens
aucuuugauuagacugauggau

SEQ ID NO: 292221 - RNA, 22 nt, Homo sapiens
aucuuuggauacuugauauagu

SEQ ID NO: 292222 - RNA, 22 nt, Homo sapiens
aucuuuggucaucacagcuaga

SEQ ID NO: 292223 - RNA, 22 nt, Homo sapiens
aucuuuggugaguucuuugguc

SEQ ID NO: 292224 - RNA, 22 nt, Homo sapiens
augaaacuggcuaauuuuugua

SEQ ID NO: 292225 - RNA, 22 nt, Homo sapiens
augaagcuagcugauugcugau

SEQ ID NO: 292226 - RNA, 18 nt, Homo sapiens
augaagucaucacuuuua

SEQ ID NO: 292227 - RNA, 22 nt, Homo sapiens
augaauccauuccugccacaga

SEQ ID NO: 292228 - RNA, 22 nt, Homo sapiens
augaaugcaugaagguugggug

SEQ ID NO: 292229 - RNA, 21 nt, Homo sapiens
augaauguaaagaauguggga

SEQ ID NO: 292230 - RNA, 22 nt, Homo sapiens
augaauguaaagaaugugggaa

SEQ ID NO: 292231 - RNA, 22 nt, Homo sapiens
augacaagaguguucagggaga

SEQ ID NO: 292232 - RNA, 22 nt, Homo sapiens
augacacugcagagauguccca

SEQ ID NO: 292233 - RNA, 22 nt, Homo sapiens
augacagcaucugugaaguugu

SEQ ID NO: 292234 - RNA, 22 nt, Homo sapiens
augacaguaugacuccaaaagu

SEQ ID NO: 292235 - RNA, 22 nt, Homo sapiens
augacaguguggauuauuguaa

SEQ ID NO: 292236 - RNA, 22 nt, Homo sapiens
augacauuccacagccguagag

SEQ ID NO: 292237 - RNA, 22 nt, Homo sapiens
augacauugaugcucuggcugg

SEQ ID NO: 292238 - RNA, 22 nt, Homo sapiens
augaccaugauccuugccgacc

SEQ ID NO: 292239 - RNA, 22 nt, Homo sapiens
augaccauuucaauugauaugg

SEQ ID NO: 292240 - RNA, 22 nt, Homo sapiens
augacguugugggcucucaagc

SEQ ID NO: 292241 - RNA, 22 nt, Homo sapiens
augacuauugcacuuuccuggu

SEQ ID NO: 292242 - RNA, 22 nt, Homo sapiens
augacugucagggcagucauug

SEQ ID NO: 292243 - RNA, 22 nt, Homo sapiens
augagaacauaucaagugauug

SEQ ID NO: 292244 - RNA, 22 nt, Homo sapiens
augagaaucauuucagcuugua

SEQ ID NO: 292245 - RNA, 22 nt, Homo sapiens
augagacauuaaaguguguuug

SEQ ID NO: 292246 - RNA, 22 nt, Homo sapiens
augagacuguucuuccucauug

SEQ ID NO: 292247 - RNA, 22 nt, Homo sapiens
augagagcaacaccuucacuug

SEQ ID NO: 292248 - RNA, 22 nt, Homo sapiens
guggaauggaaugauuguguau

SEQ ID NO: 292249 - RNA, 22 nt, Homo sapiens
guggaguacugagggucacuua

SEQ ID NO: 292250 - RNA, 17 nt, Homo sapiens
guggauagaacaaugaa

SEQ ID NO: 292251 - RNA, 22 nt, Homo sapiens
guggcagaacagguaggguucu

SEQ ID NO: 292252 - RNA, 22 nt, Homo sapiens
guggcagcacauauagguuguu

SEQ ID NO: 292253 - RNA, 22 nt, Homo sapiens
guggcaguuuuaaauaugaaaa

SEQ ID NO: 292254 - RNA, 22 nt, Homo sapiens
guggcuuguaggggucaaggga

SEQ ID NO: 292255 - RNA, 22 nt, Homo sapiens
gugggaugcaaguaaaauuguc

SEQ ID NO: 292256 - RNA, 22 nt, Homo sapiens
gugggauggagagaagguauga

SEQ ID NO: 292257 - RNA, 22 nt, Homo sapiens
gugggguaggaggaguacuucc

SEQ ID NO: 292258 - RNA, 22 nt, Homo sapiens
gugguguccugcaccuauaguc

SEQ ID NO: 292259 - RNA, 22 nt, Homo sapiens
guggugucuuguuuaauauaua

SEQ ID NO: 292260 - RNA, 22 nt, Homo sapiens
guggugucuuuuuugauuagga

SEQ ID NO: 292261 - RNA, 22 nt, Homo sapiens
gugguuuuaucccagaaauuaa

SEQ ID NO: 292262 - RNA, 22 nt, Homo sapiens
guguaaguccugaguuuggaua

SEQ ID NO: 292263 - RNA, 22 nt, Homo sapiens
guguaugugagaaugcucaugu

SEQ ID NO: 292264 - RNA, 22 nt, Homo sapiens
gugucacagcuuccaucucggu

SEQ ID NO: 292265 - RNA, 22 nt, Homo sapiens
gugucacugugaggauauugua

SEQ ID NO: 292266 - RNA, 22 nt, Homo sapiens
gugucuccugccuucaugcagc

SEQ ID NO: 292267 - RNA, 22 nt, Homo sapiens
gugugauggcgcacacagggug

SEQ ID NO: 292268 - RNA, 22 nt, Homo sapiens
gugugcauggagggggcaguga

SEQ ID NO: 292269 - RNA, 21 nt, Homo sapiens
gugugcuugagugaugggauu

SEQ ID NO: 292270 - RNA, 22 nt, Homo sapiens
gugugguauuauaacuagguau

SEQ ID NO: 292271 - RNA, 22 nt, Homo sapiens
guguuaaucucaaguacucuca

SEQ ID NO: 292272 - RNA, 22 nt, Homo sapiens
guguuauugagaaauagggugu

SEQ ID NO: 292273 - RNA, 22 nt, Homo sapiens
guguucaaagcugauugagauu

SEQ ID NO: 292274 - RNA, 22 nt, Homo sapiens
guuagaugaagaccaagggcaa

SEQ ID NO: 292275 - RNA, 22 nt, Homo sapiens
guuagugcuuauuaaauaguau

SEQ ID NO: 292276 - RNA, 22 nt, Homo sapiens
guuauugcucucgaagacucuc

SEQ ID NO: 292277 - RNA, 22 nt, Homo sapiens
guucaagugauagcugggauua

SEQ ID NO: 292278 - RNA, 22 nt, Homo sapiens
guucacagugguugccuuccag

SEQ ID NO: 292279 - RNA, 22 nt, Homo sapiens
guucaguuugcugaugcguuga

SEQ ID NO: 292280 - RNA, 22 nt, Homo sapiens
guucaguuuuaaagggaaauug

SEQ ID NO: 292281 - RNA, 22 nt, Homo sapiens
guucaucagggacacugguuug

SEQ ID NO: 292282 - RNA, 22 nt, Homo sapiens
guucaucagggauauuggcuua

SEQ ID NO: 292283 - RNA, 20 nt, Homo sapiens
guucccuguaggugugcgga

SEQ ID NO: 292284 - RNA, 22 nt, Homo sapiens
guugacuaggagcuacuacuac

SEQ ID NO: 292285 - RNA, 18 nt, Homo sapiens
guugagcuuuuccuuuag

SEQ ID NO: 292286 - RNA, 22 nt, Homo sapiens
guugcaauugauguaugucuga

SEQ ID NO: 292287 - RNA, 22 nt, Homo sapiens
guugcugagucccaucaccaga

SEQ ID NO: 292288 - RNA, 22 nt, Homo sapiens
guuggaauguauugcuacuucu

SEQ ID NO: 292289 - RNA, 22 nt, Homo sapiens
guuggguaauggggcgcaccgu

SEQ ID NO: 292290 - RNA, 22 nt, Homo sapiens
guuguggagucuucuguucugg

SEQ ID NO: 292291 - RNA, 22 nt, Homo sapiens
guuuacagucgacuugggaaua

SEQ ID NO: 292292 - RNA, 22 nt, Homo sapiens
guuuaggaaugagaauauuuag

SEQ ID NO: 292293 - RNA, 22 nt, Homo sapiens
guuuugguuauauggaucaguu

SEQ ID NO: 292294 - RNA, 22 nt, Homo sapiens
uaaaagucaucacaacuggagu

SEQ ID NO: 292295 - RNA, 22 nt, Homo sapiens
uaaaccacguuuacauuugaga

SEQ ID NO: 292296 - RNA, 22 nt, Homo sapiens
uaaacugucuugcaguuacaug

SEQ ID NO: 292297 - RNA, 22 nt, Homo sapiens
uaaagagcuuuugaggugucau

SEQ ID NO: 292298 - RNA, 22 nt, Homo sapiens
uaaagauaaggcucgcuuggau

SEQ ID NO: 292299 - RNA, 22 nt, Homo sapiens
uaaagcacaaguaaagaauacu

SEQ ID NO: 292300 - RNA, 22 nt, Homo sapiens
uaaagccauugucaaguuugua

SEQ ID NO: 292301 - RNA, 22 nt, Homo sapiens
uaaagccuagaacuuucagccc

SEQ ID NO: 292302 - RNA, 22 nt, Homo sapiens
uaaagcugaaaugauuaugaca

SEQ ID NO: 292303 - RNA, 20 nt, Homo sapiens
uaaagcugcucagggggcuc

SEQ ID NO: 292304 - RNA, 18 nt, Homo sapiens
uaaaggcacuguguuguu

SEQ ID NO: 292305 - RNA, 22 nt, Homo sapiens
uaaagugaggauggcaguaggu

SEQ ID NO: 292306 - RNA, 22 nt, Homo sapiens
uaaaugacugucaguagaugaa

SEQ ID NO: 292307 - RNA, 22 nt, Homo sapiens
uaaaugcucuuuaaaagugcuu

SEQ ID NO: 292308 - RNA, 22 nt, Homo sapiens
uaaauggauauugccaucuccu

SEQ ID NO: 292309 - RNA, 21 nt, Homo sapiens
uaaaugucauacaaagcaaug

SEQ ID NO: 292310 - RNA, 22 nt, Homo sapiens
uaacaacauucuaacugacggc

SEQ ID NO: 292311 - RNA, 22 nt, Homo sapiens
uaacaguauaugugguaucuau

SEQ ID NO: 292312 - RNA, 22 nt, Homo sapiens
uaacaguguauuuacuacuucc

SEQ ID NO: 292313 - RNA, 23 nt, Homo sapiens
uaacauugcaugauuaccugcau

SEQ ID NO: 292314 - RNA, 22 nt, Homo sapiens
uaacauuguugauuauacuaag

SEQ ID NO: 292315 - RNA, 22 nt, Homo sapiens
uaacuaaagagaagucaauguc

SEQ ID NO: 292316 - RNA, 22 nt, Homo sapiens
uaacuaguagauggcugacaua

SEQ ID NO: 292317 - RNA, 22 nt, Homo sapiens
uaacucugccuagugacauggu

SEQ ID NO: 292318 - RNA, 22 nt, Homo sapiens
uaacugcaaccucugccugcug

SEQ ID NO: 292319 - RNA, 22 nt, Homo sapiens
uaagaugaaggcucaccuagaa

SEQ ID NO: 292320 - RNA, 22 nt, Homo sapiens
uaagcaguaaaugaagucuugc

SEQ ID NO: 292321 - RNA, 22 nt, Homo sapiens
uaagcagugcaagaauggaaua

SEQ ID NO: 292322 - RNA, 22 nt, Homo sapiens
uaagcuauagugaauaaauugc

SEQ ID NO: 292323 - RNA, 22 nt, Homo sapiens
uaagcucauuccagccaugucc

SEQ ID NO: 292324 - RNA, 22 nt, Homo sapiens
uaaggcaaguuuuuaguggaca

SEQ ID NO: 292325 - RNA, 22 nt, Homo sapiens
uaaggcaaucagucaugguguu

SEQ ID NO: 292326 - RNA, 20 nt, Homo sapiens
uaaggcacugugcuuuuagg

SEQ ID NO: 292327 - RNA, 22 nt, Homo sapiens
uaaggcauuuuuuugaguugca

SEQ ID NO: 292328 - RNA, 22 nt, Homo sapiens
uaaggcccggccuuuccaagca

SEQ ID NO: 292329 - RNA, 22 nt, Homo sapiens
uaaggcuugaucuuggugagau

SEQ ID NO: 292330 - RNA, 23 nt, Homo sapiens
ucucauuccuugaaaauaaugac

SEQ ID NO: 292331 - RNA, 22 nt, Homo sapiens
ucucauuggucugagucaccug

SEQ ID NO: 292332 - RNA, 22 nt, Homo sapiens
ucuccauuuguaaggguuucuc

SEQ ID NO: 292333 - RNA, 17 nt, Homo sapiens
ucucccaucccuuucuc

SEQ ID NO: 292334 - RNA, 22 nt, Homo sapiens
ucucugacacugaccccaaaaa

SEQ ID NO: 292335 - RNA, 22 nt, Homo sapiens
ucucuuggugacuuaaaauguu

SEQ ID NO: 292336 - RNA, 22 nt, Homo sapiens
ucugacacagugauuaguaaau

SEQ ID NO: 292337 - RNA, 22 nt, Homo sapiens
ucugacacuucugcagaauuga

SEQ ID NO: 292338 - RNA, 22 nt, Homo sapiens
ucugacucuggagucucagguu

SEQ ID NO: 292339 - RNA, 22 nt, Homo sapiens
ucugagaugagacuuugaauuu

SEQ ID NO: 292340 - RNA, 22 nt, Homo sapiens
ucugagguuacugcuuuguaga

SEQ ID NO: 292341 - RNA, 22 nt, Homo sapiens
ucugagucaucacaaaugaugc

SEQ ID NO: 292342 - RNA, 23 nt, Homo sapiens
ucugauguuauaaaauucuuugg

SEQ ID NO: 292343 - RNA, 20 nt, Homo sapiens
ucugauugcaacugcaugag

SEQ ID NO: 292344 - RNA, 22 nt, Homo sapiens
ucugcauauucuagggcaccaa

SEQ ID NO: 292345 - RNA, 22 nt, Homo sapiens
ucugccacugucauugugugau

SEQ ID NO: 292346 - RNA, 22 nt, Homo sapiens
ucugccuacugguuggaggaac

SEQ ID NO: 292347 - RNA, 22 nt, Homo sapiens
ucugccuuuucaugugggaugg

SEQ ID NO: 292348 - RNA, 22 nt, Homo sapiens
ucuggcaagagccgagggcagu

SEQ ID NO: 292349 - RNA, 22 nt, Homo sapiens
ucuggcaagauauccauugcuu

SEQ ID NO: 292350 - RNA, 22 nt, Homo sapiens
ucuggcacugaugugggaugcu

SEQ ID NO: 292351 - RNA, 21 nt, Homo sapiens
ucuggccccuccaaaucucau

SEQ ID NO: 292352 - RNA, 22 nt, Homo sapiens
ucuggccccucccaaaucucau

SEQ ID NO: 292353 - RNA, 20 nt, Homo sapiens
ucuggccccucuaaaucuca

SEQ ID NO: 292354 - RNA, 22 nt, Homo sapiens
ucuggcuuuuaacaucuauaaa

SEQ ID NO: 292355 - RNA, 22 nt, Homo sapiens
ucuggguuuuguaccgugcucg

SEQ ID NO: 292356 - RNA, 22 nt, Homo sapiens
ucuguacuuccguaccuaaagu

SEQ ID NO: 292357 - RNA, 22 nt, Homo sapiens
ucugugaaugugaccuuauuug

SEQ ID NO: 292358 - RNA, 22 nt, Homo sapiens
ucugugcauuacacuuuucuca

SEQ ID NO: 292359 - RNA, 22 nt, Homo sapiens
ucugugcuugucauaugcuuug

SEQ ID NO: 292360 - RNA, 19 nt, Homo sapiens
ucugugcuugucccccugu

SEQ ID NO: 292361 - RNA, 22 nt, Homo sapiens
ucuguggucagaguccuuggcc

SEQ ID NO: 292362 - RNA, 22 nt, Homo sapiens
ucuguggucagcauccgccacu

SEQ ID NO: 292363 - RNA, 22 nt, Homo sapiens
ucuguggugggcuccacccagu

SEQ ID NO: 292364 - RNA, 18 nt, Homo sapiens
ucugugguguaaauacgu

SEQ ID NO: 292365 - RNA, 22 nt, Homo sapiens
ucuguguugaucacacugggag

SEQ ID NO: 292366 - RNA, 22 nt, Homo sapiens
ucuguguuugguuggcaauuuc

SEQ ID NO: 292367 - RNA, 22 nt, Homo sapiens
ucuguuguuguuuuaagagaca

SEQ ID NO: 292368 - RNA, 22 nt, Homo sapiens
ucuuaggugggccaucacccca

SEQ ID NO: 292369 - RNA, 22 nt, Homo sapiens
ucuuaguuugggguggggauag

SEQ ID NO: 292370 - RNA, 22 nt, Homo sapiens
ucuucuagcggaacccucuugu

SEQ ID NO: 292371 - RNA, 17 nt, Homo sapiens
ucuucuguuacuguggc

SEQ ID NO: 292372 - RNA, 22 nt, Homo sapiens
ucuugaacuucugcacacucag

SEQ ID NO: 292373 - RNA, 22 nt, Homo sapiens
ucuuggcauggcugaagauucc

SEQ ID NO: 292374 - RNA, 20 nt, Homo sapiens
ucuugggaauguagccuagg

SEQ ID NO: 292375 - RNA, 21 nt, Homo sapiens
ucuuggguugaauucucccag

SEQ ID NO: 292376 - RNA, 22 nt, Homo sapiens
ucuuggguuuguccuucuccua

SEQ ID NO: 292377 - RNA, 22 nt, Homo sapiens
ucuugguaaugucacauuuccu

SEQ ID NO: 292378 - RNA, 22 nt, Homo sapiens
ucuugguuaggggaaauaggca

SEQ ID NO: 292379 - RNA, 22 nt, Homo sapiens
ucuuucacuuagcaugauguuu

SEQ ID NO: 292380 - RNA, 22 nt, Homo sapiens
ucuuugaguggagcgaggcaga

SEQ ID NO: 292381 - RNA, 19 nt, Homo sapiens
ucuuugcuuuucuaagagg

SEQ ID NO: 292382 - RNA, 23 nt, Homo sapiens
ucuuuggcucuaauauaccuugu

SEQ ID NO: 292383 - RNA, 22 nt, Homo sapiens
ucuuuggguagauauguagcug

SEQ ID NO: 292384 - RNA, 22 nt, Homo sapiens
ucuuugguaauggaugucugau

SEQ ID NO: 292385 - RNA, 19 nt, Homo sapiens
ucuuugguacgugcuuuga

SEQ ID NO: 292386 - RNA, 22 nt, Homo sapiens
ucuuugguagaagcuauuuuau

SEQ ID NO: 292387 - RNA, 22 nt, Homo sapiens
ucuuugguuagguuuaguugau

SEQ ID NO: 292388 - RNA, 22 nt, Homo sapiens
ucuuugguucugugcagccuau

SEQ ID NO: 292389 - RNA, 22 nt, Homo sapiens
ucuuugguuguuuagggugcau

SEQ ID NO: 292390 - RNA, 22 nt, Homo sapiens
ucuuugguuucugucucuguaa

SEQ ID NO: 292391 - RNA, 22 nt, Homo sapiens
ucuuuguguaggucaaucuggc

SEQ ID NO: 292392 - RNA, 22 nt, Homo sapiens
ucuuuguuagaacccucuccuu

SEQ ID NO: 292393 - RNA, 22 nt, Homo sapiens
ucuuuuggguauggagccauca

SEQ ID NO: 292394 - RNA, 22 nt, Homo sapiens
ucuuuugguuucuagaggccgc

SEQ ID NO: 292395 - RNA, 20 nt, Homo sapiens
ucuuuuuguggccccagagu

SEQ ID NO: 292396 - RNA, 22 nt, Homo sapiens
ugaaagacacagaaguugccca

SEQ ID NO: 292397 - RNA, 22 nt, Homo sapiens
ugaaaguaauugcaguuuuuac

SEQ ID NO: 292398 - RNA, 22 nt, Homo sapiens
ugaaauacuuaauuucuccaug

SEQ ID NO: 292399 - RNA, 21 nt, Homo sapiens
ugaaaugcaugugcacauuaa

SEQ ID NO: 292400 - RNA, 22 nt, Homo sapiens
ugaaauggugcggucugcagca

SEQ ID NO: 292401 - RNA, 22 nt, Homo sapiens
ugaaaugguuaugugaggagau

SEQ ID NO: 292402 - RNA, 22 nt, Homo sapiens
ugaaaugucuuuaggaggcuuc

SEQ ID NO: 292403 - RNA, 22 nt, Homo sapiens
ugaacacagccugccucugcca

SEQ ID NO: 292404 - RNA, 22 nt, Homo sapiens
ugaacagcaccuccuagaguug

SEQ ID NO: 292405 - RNA, 22 nt, Homo sapiens
ugaacucagcauccagggccaa

SEQ ID NO: 292406 - RNA, 22 nt, Homo sapiens
ugaacugagacuagacuuguuc

SEQ ID NO: 292407 - RNA, 22 nt, Homo sapiens
ugaagacauuuuugggugugua

SEQ ID NO: 292408 - RNA, 22 nt, Homo sapiens
ugaagacucaauuauuaugaac

SEQ ID NO: 292409 - RNA, 22 nt, Homo sapiens
ugaagagucuaaaucugucuuc

SEQ ID NO: 292410 - RNA, 22 nt, Homo sapiens
ugaaggacauucuaugguagau

SEQ ID NO: 292411 - RNA, 22 nt, Homo sapiens
ugaaggcaggagggagaaaagu

SEQ ID NO: 292412 - RNA, 22 nt, Homo sapiens
augagauaggaacaaacuuaca

SEQ ID NO: 292413 - RNA, 22 nt, Homo sapiens
augagaugcaagauuagauggg

SEQ ID NO: 292414 - RNA, 22 nt, Homo sapiens
augagauuguuuguacuccaca

SEQ ID NO: 292415 - RNA, 19 nt, Homo sapiens
augagcaauaguuuuaauc

SEQ ID NO: 292416 - RNA, 22 nt, Homo sapiens
augagcagaagagauacacugu

SEQ ID NO: 292417 - RNA, 22 nt, Homo sapiens
augagcucauaaagagugauuu

SEQ ID NO: 292418 - RNA, 17 nt, Homo sapiens
augagcucaucauuuuu

SEQ ID NO: 292419 - RNA, 22 nt, Homo sapiens
augaggaaggagccuuugucug

SEQ ID NO: 292420 - RNA, 22 nt, Homo sapiens
augaggcacugcgcccuacuga

SEQ ID NO: 292421 - RNA, 22 nt, Homo sapiens
augagggcggacgcccuggaga

SEQ ID NO: 292422 - RNA, 22 nt, Homo sapiens
augagguaguagaaagucaggu

SEQ ID NO: 292423 - RNA, 20 nt, Homo sapiens
augagguguaugacacugaa

SEQ ID NO: 292424 - RNA, 22 nt, Homo sapiens
augaguauguucuguauuuuca

SEQ ID NO: 292425 - RNA, 22 nt, Homo sapiens
augagucacuuauuauuggggu

SEQ ID NO: 292426 - RNA, 18 nt, Homo sapiens
augagucauuguggaaau

SEQ ID NO: 292427 - RNA, 22 nt, Homo sapiens
augauacugaguugaguucuca

SEQ ID NO: 292428 - RNA, 22 nt, Homo sapiens
augauagucuugagaagcauuu

SEQ ID NO: 292429 - RNA, 22 nt, Homo sapiens
augaucacuguggaaauucagc

SEQ ID NO: 292430 - RNA, 22 nt, Homo sapiens
augauggagguagauuguccau

SEQ ID NO: 292431 - RNA, 22 nt, Homo sapiens
augcaagacaccacgugagaau

SEQ ID NO: 292432 - RNA, 19 nt, Homo sapiens
augcaaugucacaggcugc

SEQ ID NO: 292433 - RNA, 22 nt, Homo sapiens
augcagagucccagccccuagc

SEQ ID NO: 292434 - RNA, 22 nt, Homo sapiens
augcagauauuuuugugguugc

SEQ ID NO: 292435 - RNA, 22 nt, Homo sapiens
augcauauuccugggccucacu

SEQ ID NO: 292436 - RNA, 18 nt, Homo sapiens
augcauauuuuaaguugu

SEQ ID NO: 292437 - RNA, 22 nt, Homo sapiens
augcauggagucuuucacaagu

SEQ ID NO: 292438 - RNA, 22 nt, Homo sapiens
augccaagagacaaagggaauc

SEQ ID NO: 292439 - RNA, 22 nt, Homo sapiens
augccacagaaauaaccaaaau

SEQ ID NO: 292440 - RNA, 22 nt, Homo sapiens
augccacugcacucuagccugg

SEQ ID NO: 292441 - RNA, 22 nt, Homo sapiens
augccacugcacuucagccugc

SEQ ID NO: 292442 - RNA, 22 nt, Homo sapiens
augccacugcgcucuagccugg

SEQ ID NO: 292443 - RNA, 22 nt, Homo sapiens
augccacuguacucuagccuag

SEQ ID NO: 292444 - RNA, 22 nt, Homo sapiens
augccacuguccuccugccuag

SEQ ID NO: 292445 - RNA, 22 nt, Homo sapiens
augccacuucucuaagucaugu

SEQ ID NO: 292446 - RNA, 22 nt, Homo sapiens
augccaguguccagaguggguu

SEQ ID NO: 292447 - RNA, 22 nt, Homo sapiens
augccauugcacuccagccugg

SEQ ID NO: 292448 - RNA, 22 nt, Homo sapiens
augcccauuuguuuucugaaag

SEQ ID NO: 292449 - RNA, 22 nt, Homo sapiens
augcuaugugugacuucuuaug

SEQ ID NO: 292450 - RNA, 22 nt, Homo sapiens
auggaaacauaagaguauagau

SEQ ID NO: 292451 - RNA, 22 nt, Homo sapiens
auggaacauuauagauguaaaa

SEQ ID NO: 292452 - RNA, 20 nt, Homo sapiens
auggaacugugagccaauua

SEQ ID NO: 292453 - RNA, 22 nt, Homo sapiens
auggaagaauugucggggaugu

SEQ ID NO: 292454 - RNA, 22 nt, Homo sapiens
auggaaugguugggucauaagg

SEQ ID NO: 292455 - RNA, 22 nt, Homo sapiens
auggacagaaaaaaauagaugu

SEQ ID NO: 292456 - RNA, 21 nt, Homo sapiens
auggacugugugacccugcac

SEQ ID NO: 292457 - RNA, 22 nt, Homo sapiens
auggagaugugcgaacugagua

SEQ ID NO: 292458 - RNA, 22 nt, Homo sapiens
auggagcuugacaguuguagag

SEQ ID NO: 292459 - RNA, 22 nt, Homo sapiens
auggaggccuacagaauuuugg

SEQ ID NO: 292460 - RNA, 22 nt, Homo sapiens
auggagguguggggagugaguu

SEQ ID NO: 292461 - RNA, 22 nt, Homo sapiens
auggaguguaauauugagagcu

SEQ ID NO: 292462 - RNA, 22 nt, Homo sapiens
auggaguguucugaauccuuug

SEQ ID NO: 292463 - RNA, 22 nt, Homo sapiens
auggauuuuggggccagaggca

SEQ ID NO: 292464 - RNA, 22 nt, Homo sapiens
auggcacagacucuuggucaag

SEQ ID NO: 292465 - RNA, 22 nt, Homo sapiens
auggcacuccagccugggcaac

SEQ ID NO: 292466 - RNA, 22 nt, Homo sapiens
auggcacuguguauuuuucugu

SEQ ID NO: 292467 - RNA, 22 nt, Homo sapiens
auggcagagucagaaagucagg

SEQ ID NO: 292468 - RNA, 22 nt, Homo sapiens
auggcagcaccccacucuacug

SEQ ID NO: 292469 - RNA, 22 nt, Homo sapiens
auggcaguuuggucucugugcu

SEQ ID NO: 292470 - RNA, 22 nt, Homo sapiens
auggcaucgucaccuuuucagu

SEQ ID NO: 292471 - RNA, 22 nt, Homo sapiens
auggcauuuuuagggcugggug

SEQ ID NO: 292472 - RNA, 20 nt, Homo sapiens
auggcccugcugggaguguc

SEQ ID NO: 292473 - RNA, 22 nt, Homo sapiens
auggcccugggaaaggaggcau

SEQ ID NO: 292474 - RNA, 23 nt, Homo sapiens
auggcccuggugggagugucuuu

SEQ ID NO: 292475 - RNA, 22 nt, Homo sapiens
auggcuagauuguaugguaguu

SEQ ID NO: 292476 - RNA, 22 nt, Homo sapiens
auggcugugagaucgacuuauu

SEQ ID NO: 292477 - RNA, 22 nt, Homo sapiens
auggcuguuucugcaaugucua

SEQ ID NO: 292478 - RNA, 22 nt, Homo sapiens
auggcuuaagacaaccuuucau

SEQ ID NO: 292479 - RNA, 22 nt, Homo sapiens
auggcuuugggcugcucugccc

SEQ ID NO: 292480 - RNA, 22 nt, Homo sapiens
augggaaaaucagaaggccugg

SEQ ID NO: 292481 - RNA, 21 nt, Homo sapiens
augggacuaacugaugggucu

SEQ ID NO: 292482 - RNA, 22 nt, Homo sapiens
augggauaguaucaguggaaua

SEQ ID NO: 292483 - RNA, 22 nt, Homo sapiens
augggcaaauguuggaaauucc

SEQ ID NO: 292484 - RNA, 21 nt, Homo sapiens
augggguagaagagaaggcuu

SEQ ID NO: 292485 - RNA, 22 nt, Homo sapiens
augguacuagaguaagaauugu

SEQ ID NO: 292486 - RNA, 22 nt, Homo sapiens
auggucuuuauuguguugagug

SEQ ID NO: 292487 - RNA, 22 nt, Homo sapiens
auguaaacagaugugcagcuug

SEQ ID NO: 292488 - RNA, 22 nt, Homo sapiens
auguaacaguauuuggagaugu

SEQ ID NO: 292489 - RNA, 22 nt, Homo sapiens
auguaagugugcucaaauguua

SEQ ID NO: 292490 - RNA, 22 nt, Homo sapiens
auguaguagcagaaaauauuuu

SEQ ID NO: 292491 - RNA, 22 nt, Homo sapiens
auguauggagauauuuuugguu

SEQ ID NO: 292492 - RNA, 22 nt, Homo sapiens
auguauggaguuuaggggaugg

SEQ ID NO: 292493 - RNA, 22 nt, Homo sapiens
augucaaggugggugauaguuu

SEQ ID NO: 292494 - RNA, 22 nt, Homo sapiens
uaaggcuuuuguucagcguggg

SEQ ID NO: 292495 - RNA, 22 nt, Homo sapiens
uaagggcaugcugcaugagagu

SEQ ID NO: 292496 - RNA, 22 nt, Homo sapiens
uaagguguagacuggucacaag

SEQ ID NO: 292497 - RNA, 22 nt, Homo sapiens
uaaguaauugugguuuuugcca

SEQ ID NO: 292498 - RNA, 19 nt, Homo sapiens
uaaguagaugacugaugcu

SEQ ID NO: 292499 - RNA, 22 nt, Homo sapiens
uaaguagcugggaguacaggca

SEQ ID NO: 292500 - RNA, 22 nt, Homo sapiens
uaaguaguauaagguuuuuuga

SEQ ID NO: 292501 - RNA, 22 nt, Homo sapiens
uaaguagugugcauguauguau

SEQ ID NO: 292502 - RNA, 22 nt, Homo sapiens
uaaguaguguugagacaaguuu

SEQ ID NO: 292503 - RNA, 15 nt, Homo sapiens
uaaguaguuggcugu

SEQ ID NO: 292504 - RNA, 22 nt, Homo sapiens
uaaguaguuuucuuggaggcga

SEQ ID NO: 292505 - RNA, 22 nt, Homo sapiens
uaaguauuaggccccaggcugg

SEQ ID NO: 292506 - RNA, 22 nt, Homo sapiens
uaaguauuaugugcugcauuuu

SEQ ID NO: 292507 - RNA, 22 nt, Homo sapiens
uaagucuuuuuggaguuuauaa

SEQ ID NO: 292508 - RNA, 22 nt, Homo sapiens
uaagugaauauggacaguuagc

SEQ ID NO: 292509 - RNA, 22 nt, Homo sapiens
uaagugacuuugagauuccuca

SEQ ID NO: 292510 - RNA, 20 nt, Homo sapiens
uaagugcauaggauauuucu

SEQ ID NO: 292511 - RNA, 22 nt, Homo sapiens
uaagugcaugauuacaugcaua

SEQ ID NO: 292512 - RNA, 20 nt, Homo sapiens
uaagugcuugagacuucuga

SEQ ID NO: 292513 - RNA, 20 nt, Homo sapiens
uaagugcuugaugaaugaac

SEQ ID NO: 292514 - RNA, 20 nt, Homo sapiens
uaagugcuuuauauugauua

SEQ ID NO: 292515 - RNA, 22 nt, Homo sapiens
uaaguggugcauuguuaaaugg

SEQ ID NO: 292516 - RNA, 22 nt, Homo sapiens
uaaguuguagaacguuuucuua

SEQ ID NO: 292517 - RNA, 20 nt, Homo sapiens
uaaguuguauuugucaugaa

SEQ ID NO: 292518 - RNA, 22 nt, Homo sapiens
uaauacauucaaggugguaguu

SEQ ID NO: 292519 - RNA, 22 nt, Homo sapiens
uaauagagucauuauuauuguu

SEQ ID NO: 292520 - RNA, 22 nt, Homo sapiens
uaauagcucggauaaacaugau

SEQ ID NO: 292521 - RNA, 22 nt, Homo sapiens
uaauaguguuaaugcuagagcu

SEQ ID NO: 292522 - RNA, 22 nt, Homo sapiens
uaaugcuguggucugguuuaaa

SEQ ID NO: 292523 - RNA, 22 nt, Homo sapiens
uaauucugacaacaguggcguu

SEQ ID NO: 292524 - RNA, 22 nt, Homo sapiens
uaauugaaugcagacaccaggg

SEQ ID NO: 292525 - RNA, 22 nt, Homo sapiens
uaauuggaucucaaaaaagugu

SEQ ID NO: 292526 - RNA, 22 nt, Homo sapiens
uacaaagcuuucugcaaaucau

SEQ ID NO: 292527 - RNA, 22 nt, Homo sapiens
uacaaagcuuugaugugucuuu

SEQ ID NO: 292528 - RNA, 22 nt, Homo sapiens
uacaaagugggaaacgaagguu

SEQ ID NO: 292529 - RNA, 22 nt, Homo sapiens
uacaagcacaggcagcaggcug

SEQ ID NO: 292530 - RNA, 22 nt, Homo sapiens
uacaaguaauaagggaagaauu

SEQ ID NO: 292531 - RNA, 22 nt, Homo sapiens
uacaaguauuuuuauuagugcc

SEQ ID NO: 292532 - RNA, 22 nt, Homo sapiens
uacaccugaguuugugguuuuc

SEQ ID NO: 292533 - RNA, 22 nt, Homo sapiens
uacagaauugcagguguggcag

SEQ ID NO: 292534 - RNA, 22 nt, Homo sapiens
uacagcuaugugcaugcaugcu

SEQ ID NO: 292535 - RNA, 22 nt, Homo sapiens
uacaggacuauagaacuuuccc

SEQ ID NO: 292536 - RNA, 22 nt, Homo sapiens
uacaggugcuuauguggacaua

SEQ ID NO: 292537 - RNA, 22 nt, Homo sapiens
uacaguacacagguaccaagcu

SEQ ID NO: 292538 - RNA, 22 nt, Homo sapiens
uacagucacauuccugaccaua

SEQ ID NO: 292539 - RNA, 22 nt, Homo sapiens
uacagucauaaugccuagugac

SEQ ID NO: 292540 - RNA, 22 nt, Homo sapiens
uacagucuggaggccuguguug

SEQ ID NO: 292541 - RNA, 20 nt, Homo sapiens
uacauaguaaacugagagca

SEQ ID NO: 292542 - RNA, 22 nt, Homo sapiens
uacauuggcuagguuuggaggc

SEQ ID NO: 292543 - RNA, 22 nt, Homo sapiens
uacauugucauauucucucucu

SEQ ID NO: 292544 - RNA, 16 nt, Homo sapiens
uacauuuguuacaugg

SEQ ID NO: 292545 - RNA, 19 nt, Homo sapiens
uacccagaagcagcauugu

SEQ ID NO: 292546 - RNA, 22 nt, Homo sapiens
uaccuaguguugacuucucuuc

SEQ ID NO: 292547 - RNA, 22 nt, Homo sapiens
uaccucaguucaauaacagaua

SEQ ID NO: 292548 - RNA, 22 nt, Homo sapiens
uacuagaaccuuauucagagug

SEQ ID NO: 292549 - RNA, 22 nt, Homo sapiens
uacuagaguagugcagagggga

SEQ ID NO: 292550 - RNA, 22 nt, Homo sapiens
uacucaauugcagucaccuggc

SEQ ID NO: 292551 - RNA, 22 nt, Homo sapiens
uacucugcagccauaaaacaga

SEQ ID NO: 292552 - RNA, 22 nt, Homo sapiens
uacucugcaguaauuccagccc

SEQ ID NO: 292553 - RNA, 22 nt, Homo sapiens
uacugagagaggaauauugaaa

SEQ ID NO: 292554 - RNA, 20 nt, Homo sapiens
uacugcacuccauccugggu

SEQ ID NO: 292555 - RNA, 22 nt, Homo sapiens
uacugcagucagacuccugggc

SEQ ID NO: 292556 - RNA, 22 nt, Homo sapiens
uacugcaguugcagcuugagga

SEQ ID NO: 292557 - RNA, 22 nt, Homo sapiens
uacugcaucuacuuagagccag

SEQ ID NO: 292558 - RNA, 22 nt, Homo sapiens
uacugcugucagugccaaguag

SEQ ID NO: 292559 - RNA, 21 nt, Homo sapiens
uacuggagauacagucugcaa

SEQ ID NO: 292560 - RNA, 22 nt, Homo sapiens
uacugguuuuauauauuucucc

SEQ ID NO: 292561 - RNA, 22 nt, Homo sapiens
uacugguuuuggugggcaggug

SEQ ID NO: 292562 - RNA, 22 nt, Homo sapiens
uacuguguaguuagaccucaga

SEQ ID NO: 292563 - RNA, 22 nt, Homo sapiens
uacuuagagacaugcagcacug

SEQ ID NO: 292564 - RNA, 22 nt, Homo sapiens
uacuuuguagagugugagaauu

SEQ ID NO: 292565 - RNA, 22 nt, Homo sapiens
uacuuuguagauuguuuccuuu

SEQ ID NO: 292566 - RNA, 22 nt, Homo sapiens
uagaaugaaacaagcugugccu

SEQ ID NO: 292567 - RNA, 22 nt, Homo sapiens
uagaauggaagguugagaagaa

SEQ ID NO: 292568 - RNA, 22 nt, Homo sapiens
uagaauguaaauuccaagggca

SEQ ID NO: 292569 - RNA, 22 nt, Homo sapiens
uagaccauucuauuuccuaugc

SEQ ID NO: 292570 - RNA, 22 nt, Homo sapiens
uagagauaucaauuucauggug

SEQ ID NO: 292571 - RNA, 18 nt, Homo sapiens
uagagcacaagcuuuggc

SEQ ID NO: 292572 - RNA, 22 nt, Homo sapiens
uagagcacagugauuagaccua

SEQ ID NO: 292573 - RNA, 22 nt, Homo sapiens
uagagcaugugccauacguaca

SEQ ID NO: 292574 - RNA, 22 nt, Homo sapiens
uagagguauguauaguauucuu

SEQ ID NO: 292575 - RNA, 22 nt, Homo sapiens
uagaguguaaaccacauaguga

SEQ ID NO: 292576 - RNA, 22 nt, Homo sapiens
uagauaguaaagccauuagcuu

SEQ ID NO: 292577 - RNA, 22 nt, Homo sapiens
uagaucauauacuugccaugac

SEQ ID NO: 292578 - RNA, 22 nt, Homo sapiens
uagaucuuuaaaaggugcuaga

SEQ ID NO: 292579 - RNA, 19 nt, Homo sapiens
uagaugucuuugcauagau

SEQ ID NO: 292580 - RNA, 22 nt, Homo sapiens
uagauuauuccuuugaauggcc

SEQ ID NO: 292581 - RNA, 22 nt, Homo sapiens
uagauuauuggcugauuugauc

SEQ ID NO: 292582 - RNA, 22 nt, Homo sapiens
uagauucaucuguuccuuuuga

SEQ ID NO: 292583 - RNA, 23 nt, Homo sapiens
uagcaacaguuggaggugaggua

SEQ ID NO: 292584 - RNA, 20 nt, Homo sapiens
uagcacacauguagaauagu

SEQ ID NO: 292585 - RNA, 17 nt, Homo sapiens
uagcacagugccuggua

SEQ ID NO: 292586 - RNA, 22 nt, Homo sapiens
uagcacaguucacccucgauuu

SEQ ID NO: 292587 - RNA, 20 nt, Homo sapiens
uagcacaucuggcuguagag

SEQ ID NO: 292588 - RNA, 22 nt, Homo sapiens
uagcaccacaaucaagauacag

SEQ ID NO: 292589 - RNA, 22 nt, Homo sapiens
uagcaccugugcacaccaggca

SEQ ID NO: 292590 - RNA, 22 nt, Homo sapiens
uagcagaauaacuugccagccu

SEQ ID NO: 292591 - RNA, 22 nt, Homo sapiens
uagcagcaaagcaggaucugcu

SEQ ID NO: 292592 - RNA, 22 nt, Homo sapiens
uagcagcauuuuuguagaguau

SEQ ID NO: 292593 - RNA, 22 nt, Homo sapiens
uagcaggaaaccuguguugagg

SEQ ID NO: 292594 - RNA, 22 nt, Homo sapiens
uagcaguaccccaguauccugg

SEQ ID NO: 292595 - RNA, 22 nt, Homo sapiens
uagcaguaucccaccaucuggu

SEQ ID NO: 292596 - RNA, 22 nt, Homo sapiens
uagcauaauuuguagaaaauca

SEQ ID NO: 292597 - RNA, 22 nt, Homo sapiens
uagcaugucagucgccacacgu

SEQ ID NO: 292598 - RNA, 20 nt, Homo sapiens
uagccggguguugugucaug

SEQ ID NO: 292599 - RNA, 22 nt, Homo sapiens
uagccucacaaagugcuuaaga

SEQ ID NO: 292600 - RNA, 21 nt, Homo sapiens
uagcucagugguguugccaua

SEQ ID NO: 292601 - RNA, 17 nt, Homo sapiens
uagcucuauuucuagcc

SEQ ID NO: 292602 - RNA, 22 nt, Homo sapiens
uagcugauguuugucuaguagc

SEQ ID NO: 292603 - RNA, 22 nt, Homo sapiens
uagcugcaaaauauagacuucu

SEQ ID NO: 292604 - RNA, 21 nt, Homo sapiens
uagcugcacccaggccuccuu

SEQ ID NO: 292605 - RNA, 22 nt, Homo sapiens
uagcugcacuuacaagugagaa

SEQ ID NO: 292606 - RNA, 22 nt, Homo sapiens
uagcugcugcuaggcuaaggau

SEQ ID NO: 292607 - RNA, 22 nt, Homo sapiens
uagcuguuggugggaagucaga

SEQ ID NO: 292608 - RNA, 23 nt, Homo sapiens
uagcuucucccagaccugcuccc

SEQ ID NO: 292609 - RNA, 22 nt, Homo sapiens
uaggaaguacaucucagaaucu

SEQ ID NO: 292610 - RNA, 22 nt, Homo sapiens
uaggaaugaacgauuuauuggu

SEQ ID NO: 292611 - RNA, 22 nt, Homo sapiens
uaggagugugaacccuguuuug

SEQ ID NO: 292612 - RNA, 22 nt, Homo sapiens
uaggcaaaugcaagaguagaac

SEQ ID NO: 292613 - RNA, 22 nt, Homo sapiens
uaggcaaguugcccaaucucuc

SEQ ID NO: 292614 - RNA, 22 nt, Homo sapiens
uaggcaauggagauagaggaug

SEQ ID NO: 292615 - RNA, 22 nt, Homo sapiens
uaggcaauguggcgaaacucug

SEQ ID NO: 292616 - RNA, 22 nt, Homo sapiens
uaggcacugagaauaugaggau

SEQ ID NO: 292617 - RNA, 21 nt, Homo sapiens
uaggccgggugcaggaugcuu

SEQ ID NO: 292618 - RNA, 22 nt, Homo sapiens
uaggcuguguggccguggggcu

SEQ ID NO: 292619 - RNA, 22 nt, Homo sapiens
uaggcuuuucugggaugugggc

SEQ ID NO: 292620 - RNA, 22 nt, Homo sapiens
uagggaguguccuuucgggaaa

SEQ ID NO: 292621 - RNA, 22 nt, Homo sapiens
uagggcauuuagaggcuauuaa

SEQ ID NO: 292622 - RNA, 22 nt, Homo sapiens
uagggcuuuuccaagcugccac

SEQ ID NO: 292623 - RNA, 19 nt, Homo sapiens
uagguacauucaagucucc

SEQ ID NO: 292624 - RNA, 22 nt, Homo sapiens
uagguagugugugcaugagagg

SEQ ID NO: 292625 - RNA, 22 nt, Homo sapiens
uaggucacugcucugugucuaa

SEQ ID NO: 292626 - RNA, 22 nt, Homo sapiens
uaguagugucccugacuaucac

SEQ ID NO: 292627 - RNA, 22 nt, Homo sapiens
uaguauguuuauagcauugagu

SEQ ID NO: 292628 - RNA, 22 nt, Homo sapiens
uagucacacacucaacuuuuca

SEQ ID NO: 292629 - RNA, 22 nt, Homo sapiens
uagugaaugucacuggcuguug

SEQ ID NO: 292630 - RNA, 22 nt, Homo sapiens
uagugcugagauugagaagccc

SEQ ID NO: 292631 - RNA, 21 nt, Homo sapiens
uagugcugaggcaguauggga

SEQ ID NO: 292632 - RNA, 22 nt, Homo sapiens
uagugcugugauaaacauauau

SEQ ID NO: 292633 - RNA, 22 nt, Homo sapiens
uagugcugugauauuuuuggcc

SEQ ID NO: 292634 - RNA, 22 nt, Homo sapiens
uagugcugugauuaacauaaug

SEQ ID NO: 292635 - RNA, 20 nt, Homo sapiens
uaguggcaugcaccuguagc

SEQ ID NO: 292636 - RNA, 22 nt, Homo sapiens
uaguuaguagacucugauuauu

SEQ ID NO: 292637 - RNA, 22 nt, Homo sapiens
uaguucauuuuucuugcuuaga

SEQ ID NO: 292638 - RNA, 22 nt, Homo sapiens
uaguugcauuggcugcuaugcu

SEQ ID NO: 292639 - RNA, 22 nt, Homo sapiens
uaguuguugcagguaggaugua

SEQ ID NO: 292640 - RNA, 22 nt, Homo sapiens
uauaagacuagcagcugaauug

SEQ ID NO: 292641 - RNA, 22 nt, Homo sapiens
uauacuguuuucuauaguggcu

SEQ ID NO: 292642 - RNA, 22 nt, Homo sapiens
uauagcacaucuguguguacau

SEQ ID NO: 292643 - RNA, 22 nt, Homo sapiens
uauagcacugcaauauuucccu

SEQ ID NO: 292644 - RNA, 21 nt, Homo sapiens
uauagcagcacgauuuauagu

SEQ ID NO: 292645 - RNA, 19 nt, Homo sapiens
gcugauguuacauucuugc

SEQ ID NO: 292646 - RNA, 17 nt, Homo sapiens
gcugauguuugcauuuu

SEQ ID NO: 292647 - RNA, 22 nt, Homo sapiens
gcugauguuuucagguaauucu

SEQ ID NO: 292648 - RNA, 22 nt, Homo sapiens
gcugcuguggcagauuggauuc

SEQ ID NO: 292649 - RNA, 22 nt, Homo sapiens
gcuggguucagagugggcugcg

SEQ ID NO: 292650 - RNA, 22 nt, Homo sapiens
gcugguauuacaggcaugagcc

SEQ ID NO: 292651 - RNA, 22 nt, Homo sapiens
gcugguguugugaaucaggccg

SEQ ID NO: 292652 - RNA, 19 nt, Homo sapiens
gcugguuguccacucucuc

SEQ ID NO: 292653 - RNA, 22 nt, Homo sapiens
gcugucuggagucuguucaaug

SEQ ID NO: 292654 - RNA, 22 nt, Homo sapiens
gcugugguuuaguagaaagaag

SEQ ID NO: 292655 - RNA, 22 nt, Homo sapiens
gcuguguguuaucagaaauugc

SEQ ID NO: 292656 - RNA, 18 nt, Homo sapiens
ggaaaacuuuucuaagua

SEQ ID NO: 292657 - RNA, 22 nt, Homo sapiens
ggaaaucaucauucucgguaua

SEQ ID NO: 292658 - RNA, 22 nt, Homo sapiens
ggaaauguuuagcauccacuuu

SEQ ID NO: 292659 - RNA, 22 nt, Homo sapiens
ggaagaauaaugggccuuagag

SEQ ID NO: 292660 - RNA, 22 nt, Homo sapiens
ggaagacaguguggugauuccu

SEQ ID NO: 292661 - RNA, 19 nt, Homo sapiens
ggaaugcaccaguccuugc

SEQ ID NO: 292662 - RNA, 22 nt, Homo sapiens
ggaauuaaggcaauugaaagcu

SEQ ID NO: 292663 - RNA, 22 nt, Homo sapiens
ggacaaaguauuuucaaaugua

SEQ ID NO: 292664 - RNA, 22 nt, Homo sapiens
ggacacaucaugugaccaaggu

SEQ ID NO: 292665 - RNA, 22 nt, Homo sapiens
ggacuaggagcuaggaagaucu

SEQ ID NO: 292666 - RNA, 22 nt, Homo sapiens
ccuuuuugaguugccagaguuc

SEQ ID NO: 292667 - RNA, 22 nt, Homo sapiens
cgaggaguaucuuugugguguu

SEQ ID NO: 292668 - RNA, 22 nt, Homo sapiens
cgcccuguagcuagcuagaggu

SEQ ID NO: 292669 - RNA, 22 nt, Homo sapiens
cgccgggggaugggcaccagcg

SEQ ID NO: 292670 - RNA, 22 nt, Homo sapiens
cggaaugaaaauguccuucagu

SEQ ID NO: 292671 - RNA, 22 nt, Homo sapiens
cggucacagugauucaaggguc

SEQ ID NO: 292672 - RNA, 22 nt, Homo sapiens
cuaaagucacgauuugugggua

SEQ ID NO: 292673 - RNA, 17 nt, Homo sapiens
cuaaggcaagagucugc

SEQ ID NO: 292674 - RNA, 22 nt, Homo sapiens
cuaagggaggaagcugugcagg

SEQ ID NO: 292675 - RNA, 22 nt, Homo sapiens
cuaagugaacugucacugagaa

SEQ ID NO: 292676 - RNA, 22 nt, Homo sapiens
cuaaucuagccuuauaaguauu

SEQ ID NO: 292677 - RNA, 22 nt, Homo sapiens
cuacagaguaucuaaagaggua

SEQ ID NO: 292678 - RNA, 23 nt, Homo sapiens
cuacagugccugucucuuuggcc

SEQ ID NO: 292679 - RNA, 22 nt, Homo sapiens
cuacuauguagagauauugaau

SEQ ID NO: 292680 - RNA, 22 nt, Homo sapiens
cuagcagacacuuccagagagu

SEQ ID NO: 292681 - RNA, 22 nt, Homo sapiens
cuagcagacaggcugggagcag

SEQ ID NO: 292682 - RNA, 22 nt, Homo sapiens
cuagcagcaugagaauggacca

SEQ ID NO: 292683 - RNA, 22 nt, Homo sapiens
cuagcccugagauaaaugucau

SEQ ID NO: 292684 - RNA, 22 nt, Homo sapiens
cuaucucaggcccaggcccuug

SEQ ID NO: 292685 - RNA, 21 nt, Homo sapiens
cuaucucaguguuuacauuug

SEQ ID NO: 292686 - RNA, 18 nt, Homo sapiens
cuaugccacuuuauauca

SEQ ID NO: 292687 - RNA, 22 nt, Homo sapiens
cuauggauuuacuguauagggu

SEQ ID NO: 292688 - RNA, 22 nt, Homo sapiens
cuauggcagccacggccuggag

SEQ ID NO: 292689 - RNA, 22 nt, Homo sapiens
cuaugguaggggcuggaggaag

SEQ ID NO: 292690 - RNA, 22 nt, Homo sapiens
cuaugguuucuccauaucauca

SEQ ID NO: 292691 - RNA, 22 nt, Homo sapiens
cuaugucuuucauauuuugggg

SEQ ID NO: 292692 - RNA, 22 nt, Homo sapiens
cuauuagguuggugcaaaagua

SEQ ID NO: 292693 - RNA, 22 nt, Homo sapiens
cuauucacaauggugaagauau

SEQ ID NO: 292694 - RNA, 22 nt, Homo sapiens
cucaaagucaagggaaagcagg

SEQ ID NO: 292695 - RNA, 22 nt, Homo sapiens
cucaaguagugguuuucauuga

SEQ ID NO: 292696 - RNA, 22 nt, Homo sapiens
cucaauuuggaauugucaguaa

SEQ ID NO: 292697 - RNA, 22 nt, Homo sapiens
cucacagucagaagggacuugc

SEQ ID NO: 292698 - RNA, 20 nt, Homo sapiens
cucaccagguguaggcugag

SEQ ID NO: 292699 - RNA, 22 nt, Homo sapiens
cucaccuugugauccaccggcc

SEQ ID NO: 292700 - RNA, 22 nt, Homo sapiens
cucacggcccugcgcacuggca

SEQ ID NO: 292701 - RNA, 22 nt, Homo sapiens
cucagaguacuuuucccacuuc

SEQ ID NO: 292702 - RNA, 22 nt, Homo sapiens
cucagauacuugggagguugag

SEQ ID NO: 292703 - RNA, 22 nt, Homo sapiens
cucaggcacucugauuccagug

SEQ ID NO: 292704 - RNA, 22 nt, Homo sapiens
cucagggugguggacucuaaua

SEQ ID NO: 292705 - RNA, 20 nt, Homo sapiens
cucagguauuugaggcugca

SEQ ID NO: 292706 - RNA, 22 nt, Homo sapiens
cucagucuaugauacuuugcua

SEQ ID NO: 292707 - RNA, 22 nt, Homo sapiens
cucagugguugauuuauuuauc

SEQ ID NO: 292708 - RNA, 22 nt, Homo sapiens
cucaguguuaaggccaccucug

SEQ ID NO: 292709 - RNA, 22 nt, Homo sapiens
cucaugcugucuucugggguaa

SEQ ID NO: 292710 - RNA, 19 nt, Homo sapiens
cucauggagaaggagaaua

SEQ ID NO: 292711 - RNA, 22 nt, Homo sapiens
cucauggauggucuggcagcca

SEQ ID NO: 292712 - RNA, 22 nt, Homo sapiens
cucauugcaaucuccaccuccc

SEQ ID NO: 292713 - RNA, 22 nt, Homo sapiens
cucauuggcuacugaggcuugu

SEQ ID NO: 292714 - RNA, 22 nt, Homo sapiens
cuccacgugaaugccaaguauu

SEQ ID NO: 292715 - RNA, 23 nt, Homo sapiens
cuccaugagccguccagggccug

SEQ ID NO: 292716 - RNA, 22 nt, Homo sapiens
cuccauguggcuaacuuuuaaa

SEQ ID NO: 292717 - RNA, 22 nt, Homo sapiens
cucccauugcaaacaacagaag

SEQ ID NO: 292718 - RNA, 22 nt, Homo sapiens
cucucaguugucuaauuaguuu

SEQ ID NO: 292719 - RNA, 21 nt, Homo sapiens
cucucugcuuaugaauaguga

SEQ ID NO: 292720 - RNA, 17 nt, Homo sapiens
cucucugguuuaaagca

SEQ ID NO: 292721 - RNA, 22 nt, Homo sapiens
aagagcgcugauaacauguuug

SEQ ID NO: 292722 - RNA, 20 nt, Homo sapiens
aagagcucaccagaauaucu

SEQ ID NO: 292723 - RNA, 18 nt, Homo sapiens
aagagcucagcacagguu

SEQ ID NO: 292724 - RNA, 22 nt, Homo sapiens
aagagcucucuguagcauguga

SEQ ID NO: 292725 - RNA, 22 nt, Homo sapiens
aagagguagaagcuugccuucu

SEQ ID NO: 292726 - RNA, 22 nt, Homo sapiens
aagagguaggaaauggucauuu

SEQ ID NO: 292727 - RNA, 23 nt, Homo sapiens
aagagguaugacuaugaagugga

SEQ ID NO: 292728 - RNA, 22 nt, Homo sapiens
aagagguuguaccuaaaguguu

SEQ ID NO: 292729 - RNA, 22 nt, Homo sapiens
aagaugcagucauacuggagua

SEQ ID NO: 292730 - RNA, 22 nt, Homo sapiens
aagcaaacaucagcuugguuaa

SEQ ID NO: 292731 - RNA, 22 nt, Homo sapiens
aagcaacacaucugccccgguu

SEQ ID NO: 292732 - RNA, 22 nt, Homo sapiens
aagcacaauuucaccuucuugu

SEQ ID NO: 292733 - RNA, 21 nt, Homo sapiens
aagcacauugaguguguguga

SEQ ID NO: 292734 - RNA, 22 nt, Homo sapiens
aagcaggugaugagugggugug

SEQ ID NO: 292735 - RNA, 22 nt, Homo sapiens
aagcaguguggacuaaugggaa

SEQ ID NO: 292736 - RNA, 22 nt, Homo sapiens
aagcaucacuggaggcagccau

SEQ ID NO: 292737 - RNA, 22 nt, Homo sapiens
aagcaugguuuccaggggucac

SEQ ID NO: 292738 - RNA, 22 nt, Homo sapiens
aagccacuguaccugucucuua

SEQ ID NO: 292739 - RNA, 20 nt, Homo sapiens
aagcugaguguuuuuuuaau

SEQ ID NO: 292740 - RNA, 22 nt, Homo sapiens
aagcugccuugugaaggcauuc

SEQ ID NO: 292741 - RNA, 22 nt, Homo sapiens
aagcuggauuucgcauccuguu

SEQ ID NO: 292742 - RNA, 22 nt, Homo sapiens
aagcuguauuguguugcuauaa

SEQ ID NO: 292743 - RNA, 22 nt, Homo sapiens
aaggaacuggaauauuuugaac

SEQ ID NO: 292744 - RNA, 22 nt, Homo sapiens
aaggagcaguggacggguccua

SEQ ID NO: 292745 - RNA, 22 nt, Homo sapiens
aaggaguagaauagaugcaccu

SEQ ID NO: 292746 - RNA, 22 nt, Homo sapiens
aaggaguagacaacauggcgcc

SEQ ID NO: 292747 - RNA, 22 nt, Homo sapiens
aaggaguguggugaucuugggc

SEQ ID NO: 292748 - RNA, 22 nt, Homo sapiens
aaggauuguaacaccaagguua

SEQ ID NO: 292749 - RNA, 22 nt, Homo sapiens
aaggcuguuguguaauaggauu

SEQ ID NO: 292750 - RNA, 22 nt, Homo sapiens
gugcaaugaguguggcaaagcc

SEQ ID NO: 292751 - RNA, 22 nt, Homo sapiens
gugcacauuguuuaugucuguu

SEQ ID NO: 292752 - RNA, 22 nt, Homo sapiens
gugcagaugucuuuauaguagc

SEQ ID NO: 292753 - RNA, 22 nt, Homo sapiens
gugcauaucugugguuggcuga

SEQ ID NO: 292754 - RNA, 22 nt, Homo sapiens
gugcauguccacuaguccauau

SEQ ID NO: 292755 - RNA, 22 nt, Homo sapiens
gugccacugcacuccggccugg

SEQ ID NO: 292756 - RNA, 23 nt, Homo sapiens
gugccuucugagccuagucucca

SEQ ID NO: 292757 - RNA, 16 nt, Homo sapiens
gugcuguguuguuagg

SEQ ID NO: 292758 - RNA, 22 nt, Homo sapiens
guggaaaacauaugcuuguuga

SEQ ID NO: 292759 - RNA, 22 nt, Homo sapiens
guggaagauaguguguuaaugu

SEQ ID NO: 292760 - RNA, 22 nt, Homo sapiens
guggaagguaaugcagcuuacu

SEQ ID NO: 292761 - RNA, 22 nt, Homo sapiens
guggaaggucaugaauguucuu

SEQ ID NO: 292762 - RNA, 22 nt, Homo sapiens
guggaagucuuugguauuggua

SEQ ID NO: 292763 - RNA, 22 nt, Homo sapiens
guggaaguguaaaagcucuugg

SEQ ID NO: 292764 - RNA, 22 nt, Homo sapiens
guggaaguuaagugacuuucug

SEQ ID NO: 292765 - RNA, 22 nt, Homo sapiens
guggaaugauaucucauugugg

SEQ ID NO: 292766 - RNA, 22 nt, Homo sapiens
guggaaugcaguguugauucaa

SEQ ID NO: 292767 - RNA, 17 nt, Homo sapiens
guggaaugucaugucaa

SEQ ID NO: 292768 - RNA, 22 nt, Homo sapiens
guggacggagguugcagugagc

SEQ ID NO: 292769 - RNA, 22 nt, Homo sapiens
guggaggagaaagaagcauuuc

SEQ ID NO: 292770 - RNA, 18 nt, Homo sapiens
guggagugucuuccugga

SEQ ID NO: 292771 - RNA, 22 nt, Homo sapiens
guggcaaagaugccuucuccaa

SEQ ID NO: 292772 - RNA, 22 nt, Homo sapiens
guggcaagaauguacaaaaggu

SEQ ID NO: 292773 - RNA, 22 nt, Homo sapiens
guggcaagaugacuacucacug

SEQ ID NO: 292774 - RNA, 22 nt, Homo sapiens
guggcacaauuaaguagcuauu

SEQ ID NO: 292775 - RNA, 22 nt, Homo sapiens
guggcagagucagagggaaaug

SEQ ID NO: 292776 - RNA, 22 nt, Homo sapiens
guggcuaaagauuuggaaucug

SEQ ID NO: 292777 - RNA, 22 nt, Homo sapiens
guggcuauucaccuuuaugaaa

SEQ ID NO: 292778 - RNA, 22 nt, Homo sapiens
guggcuauuguucccugguugc

SEQ ID NO: 292779 - RNA, 22 nt, Homo sapiens
guggcuuuauuuagaagcaggg

SEQ ID NO: 292780 - RNA, 22 nt, Homo sapiens
gugggaugaucgcuugagccca

SEQ ID NO: 292781 - RNA, 22 nt, Homo sapiens
gugggauggaaaugggcuucag

SEQ ID NO: 292782 - RNA, 20 nt, Homo sapiens
gugggcaaauccuuuccucu

SEQ ID NO: 292783 - RNA, 22 nt, Homo sapiens
gugggcaagucacuucaguucu

SEQ ID NO: 292784 - RNA, 22 nt, Homo sapiens
guggggucaucucauuugugga

SEQ ID NO: 292785 - RNA, 22 nt, Homo sapiens
guggguaaaucucuguuugagg

SEQ ID NO: 292786 - RNA, 22 nt, Homo sapiens
gugguaaaauggcauagagcua

SEQ ID NO: 292787 - RNA, 22 nt, Homo sapiens
gugguaggaaagugcaaaugua

SEQ ID NO: 292788 - RNA, 22 nt, Homo sapiens
gugguuuucaacuccaccugca

SEQ ID NO: 292789 - RNA, 22 nt, Homo sapiens
gugguuuuuaaaguaccugugg

SEQ ID NO: 292790 - RNA, 22 nt, Homo sapiens
guguaauacacacauauaugca

SEQ ID NO: 292791 - RNA, 18 nt, Homo sapiens
guguauggauggaggcca

SEQ ID NO: 292792 - RNA, 22 nt, Homo sapiens
gugucaaggaugccugucaggc

SEQ ID NO: 292793 - RNA, 22 nt, Homo sapiens
gugucacuguauaauauuuauu

SEQ ID NO: 292794 - RNA, 22 nt, Homo sapiens
gugucacuguugagaaguccac

SEQ ID NO: 292795 - RNA, 22 nt, Homo sapiens
gugucaugaagguuuuaugcag

SEQ ID NO: 292796 - RNA, 22 nt, Homo sapiens
guguccucgaguacacaucagg

SEQ ID NO: 292797 - RNA, 22 nt, Homo sapiens
gugugacugcucuauuagggcg

SEQ ID NO: 292798 - RNA, 22 nt, Homo sapiens
gugugcacaaucuggcaugugc

SEQ ID NO: 292799 - RNA, 22 nt, Homo sapiens
guguguaaauggcagugagcuc

SEQ ID NO: 292800 - RNA, 22 nt, Homo sapiens
guguuauuuugcugggaaugau

SEQ ID NO: 292801 - RNA, 22 nt, Homo sapiens
cucugacagugguuagcacugu

SEQ ID NO: 292802 - RNA, 22 nt, Homo sapiens
cucugguggaagcagggggcaa

SEQ ID NO: 292803 - RNA, 15 nt, Homo sapiens
cucugguuuuucuuc

SEQ ID NO: 292804 - RNA, 22 nt, Homo sapiens
cucugguuuuucuuccauuaag

SEQ ID NO: 292805 - RNA, 22 nt, Homo sapiens
cucuuuggaugccuuaggguua

SEQ ID NO: 292806 - RNA, 22 nt, Homo sapiens
cucuuuuguuccuaguuugauc

SEQ ID NO: 292807 - RNA, 22 nt, Homo sapiens
cucuuuuguuuagcugagaggg

SEQ ID NO: 292808 - RNA, 22 nt, Homo sapiens
cugaaaguuauucaggggcaag

SEQ ID NO: 292809 - RNA, 22 nt, Homo sapiens
cugaaaugaauuauuuucuuuc

SEQ ID NO: 292810 - RNA, 22 nt, Homo sapiens
cugaaggcagguagaauagaga

SEQ ID NO: 292811 - RNA, 22 nt, Homo sapiens
cugaauagagcacacugauggg

SEQ ID NO: 292812 - RNA, 22 nt, Homo sapiens
cugaaucauugcauuaucaagg

SEQ ID NO: 292813 - RNA, 22 nt, Homo sapiens
cugaaucauugguuaugaguac

SEQ ID NO: 292814 - RNA, 22 nt, Homo sapiens
cugaauguuuucuucuauucug

SEQ ID NO: 292815 - RNA, 22 nt, Homo sapiens
cugacaagugaucacagcagca

SEQ ID NO: 292816 - RNA, 22 nt, Homo sapiens
cugacagaugacugccacugua

SEQ ID NO: 292817 - RNA, 22 nt, Homo sapiens
cugacaugcagccacugcaccu

SEQ ID NO: 292818 - RNA, 22 nt, Homo sapiens
cugagacuggugauuuaugaag

SEQ ID NO: 292819 - RNA, 22 nt, Homo sapiens
cugagagaggagcuaaaacugc

SEQ ID NO: 292820 - RNA, 22 nt, Homo sapiens
cugagagugguauguuuaagug

SEQ ID NO: 292821 - RNA, 22 nt, Homo sapiens
cugagaucguggggcugcuguc

SEQ ID NO: 292822 - RNA, 22 nt, Homo sapiens
cugagaucugaaccaggagugu

SEQ ID NO: 292823 - RNA, 22 nt, Homo sapiens
cugagaucuuauuagaaaugca

SEQ ID NO: 292824 - RNA, 22 nt, Homo sapiens
cugagauggagucucgcauugu

SEQ ID NO: 292825 - RNA, 22 nt, Homo sapiens
cugagcaaaaugaagacacgau

SEQ ID NO: 292826 - RNA, 18 nt, Homo sapiens
cugagcacugcuuuauga

SEQ ID NO: 292827 - RNA, 22 nt, Homo sapiens
cugagcaucauggcagaaucuu

SEQ ID NO: 292828 - RNA, 22 nt, Homo sapiens
cugagcuaguagcauuguguca

SEQ ID NO: 292829 - RNA, 22 nt, Homo sapiens
cugaggaaguucuuuaacaguu

SEQ ID NO: 292830 - RNA, 22 nt, Homo sapiens
cugaggacaucagggaagcauc

SEQ ID NO: 292831 - RNA, 22 nt, Homo sapiens
cugaggauauucagccucugug

SEQ ID NO: 292832 - RNA, 22 nt, Homo sapiens
cugagguaggcccugagaauau

SEQ ID NO: 292833 - RNA, 20 nt, Homo sapiens
cugaggugggagaaucgcuu

SEQ ID NO: 292834 - RNA, 22 nt, Homo sapiens
aauccauuugccgucuauccau

SEQ ID NO: 292835 - RNA, 22 nt, Homo sapiens
aaucucaacacuuugggaggcu

SEQ ID NO: 292836 - RNA, 22 nt, Homo sapiens
aaugaaguuagauguugagaag

SEQ ID NO: 292837 - RNA, 22 nt, Homo sapiens
aaugacagccagauucuucucu

SEQ ID NO: 292838 - RNA, 22 nt, Homo sapiens
aaugacugugauauuuuucuuc

SEQ ID NO: 292839 - RNA, 22 nt, Homo sapiens
aaugauauguuauguuuagguu

SEQ ID NO: 292840 - RNA, 22 nt, Homo sapiens
aaugaucaauguuugaggugau

SEQ ID NO: 292841 - RNA, 22 nt, Homo sapiens
aaugcacauaaaauccuccagg

SEQ ID NO: 292842 - RNA, 22 nt, Homo sapiens
aaugcaucuagaaaggugaauu

SEQ ID NO: 292843 - RNA, 22 nt, Homo sapiens
aaugccacugugccugccaagg

SEQ ID NO: 292844 - RNA, 22 nt, Homo sapiens
aaugcuguguuauuucaugacc

SEQ ID NO: 292845 - RNA, 22 nt, Homo sapiens
aauggagcugaguggccuuggg

SEQ ID NO: 292846 - RNA, 22 nt, Homo sapiens
aauggcacaagacaugaagaag

SEQ ID NO: 292847 - RNA, 22 nt, Homo sapiens
aauggcauugguccuuuuggau

SEQ ID NO: 292848 - RNA, 22 nt, Homo sapiens
aauggcuuucagcuuuucccca

SEQ ID NO: 292849 - RNA, 22 nt, Homo sapiens
aaugucacugugguccuccagu

SEQ ID NO: 292850 - RNA, 22 nt, Homo sapiens
aaugugccuacuggagcuugca

SEQ ID NO: 292851 - RNA, 22 nt, Homo sapiens
aaugugcuguucagaggagucc

SEQ ID NO: 292852 - RNA, 22 nt, Homo sapiens
aaugugcuucuggcugugguca

SEQ ID NO: 292853 - RNA, 22 nt, Homo sapiens
aauuaguuggcugccuaugauu

SEQ ID NO: 292854 - RNA, 22 nt, Homo sapiens
aauucacuucuuuuaggcaggg

SEQ ID NO: 292855 - RNA, 22 nt, Homo sapiens
aauucacuuguggcagauccuu

SEQ ID NO: 292856 - RNA, 22 nt, Homo sapiens
aauugcaccaucuagaucaaga

SEQ ID NO: 292857 - RNA, 22 nt, Homo sapiens
aauugcauaaaauucaacucug

SEQ ID NO: 292858 - RNA, 22 nt, Homo sapiens
aauugcuuuuauuuagggccag

SEQ ID NO: 292859 - RNA, 22 nt, Homo sapiens
aauuggcagugcucuugccaca

SEQ ID NO: 292860 - RNA, 22 nt, Homo sapiens
aauuguacucccaucauuccua

SEQ ID NO: 292861 - RNA, 16 nt, Homo sapiens
acaaagcuggcuaucu

SEQ ID NO: 292862 - RNA, 22 nt, Homo sapiens
acaaaguauggaauguuggugu

SEQ ID NO: 292863 - RNA, 22 nt, Homo sapiens
acaagcacaaaugcauagaugg

SEQ ID NO: 292864 - RNA, 22 nt, Homo sapiens
acaagugaauacaggauucucu

SEQ ID NO: 292865 - RNA, 22 nt, Homo sapiens
acaagugcuuuuccuggagaca

SEQ ID NO: 292866 - RNA, 22 nt, Homo sapiens
acaauguauauuuuacuguagg

SEQ ID NO: 292867 - RNA, 22 nt, Homo sapiens
acacaaugguaaguguuugugu

SEQ ID NO: 292868 - RNA, 22 nt, Homo sapiens
acacaguaaauauguauugaau

SEQ ID NO: 292869 - RNA, 22 nt, Homo sapiens
acacaguaagcacaguguagau

SEQ ID NO: 292870 - RNA, 22 nt, Homo sapiens
gaaggcaugcugcauggccaga

SEQ ID NO: 292871 - RNA, 22 nt, Homo sapiens
gaagguauauucuguuaaugcu

SEQ ID NO: 292872 - RNA, 22 nt, Homo sapiens
gaagugcuuuuggacuaacagu

SEQ ID NO: 292873 - RNA, 17 nt, Homo sapiens
gaaguguuucuucauga

SEQ ID NO: 292874 - RNA, 22 nt, Homo sapiens
gaaucacagauuaugaguaucu

SEQ ID NO: 292875 - RNA, 22 nt, Homo sapiens
gaaugcuaccagcaucuagugg

SEQ ID NO: 292876 - RNA, 20 nt, Homo sapiens
gacaaaccuagaugguacag

SEQ ID NO: 292877 - RNA, 22 nt, Homo sapiens
gacaccauuucaguacuagguu

SEQ ID NO: 292878 - RNA, 22 nt, Homo sapiens
gacagugagaugucaugugaaa

SEQ ID NO: 292879 - RNA, 22 nt, Homo sapiens
gacaguuucucaggcuuccuua

SEQ ID NO: 292880 - RNA, 17 nt, Homo sapiens
gacauaggaaaaggaga

SEQ ID NO: 292881 - RNA, 22 nt, Homo sapiens
gacauguuuacaguguugagag

SEQ ID NO: 292882 - RNA, 22 nt, Homo sapiens
gacauguuuucauguauuugga

SEQ ID NO: 292883 - RNA, 22 nt, Homo sapiens
gaccaaagaggcaggcauuaga

SEQ ID NO: 292884 - RNA, 22 nt, Homo sapiens
gaccccuagagauaggaggaac

SEQ ID NO: 292885 - RNA, 22 nt, Homo sapiens
gacccucuagagggaagcgcuu

SEQ ID NO: 292886 - RNA, 21 nt, Homo sapiens
gacuacaccaggaugcuaguu

SEQ ID NO: 292887 - RNA, 22 nt, Homo sapiens
gacuaguuaggucucucacaga

SEQ ID NO: 292888 - RNA, 19 nt, Homo sapiens
gacuccagaguugugugcu

SEQ ID NO: 292889 - RNA, 22 nt, Homo sapiens
gacugaguaagcagaagcaauu

SEQ ID NO: 292890 - RNA, 22 nt, Homo sapiens
gacuggccuauaauggcgaauu

SEQ ID NO: 292891 - RNA, 22 nt, Homo sapiens
gacuucaucauacuaugugugg

SEQ ID NO: 292892 - RNA, 22 nt, Homo sapiens
gagaacagaagcauuccuaauu

SEQ ID NO: 292893 - RNA, 22 nt, Homo sapiens
gagaacauacggcauuugguuu

SEQ ID NO: 292894 - RNA, 22 nt, Homo sapiens
gagaaccuccagcaagguagua

SEQ ID NO: 292895 - RNA, 20 nt, Homo sapiens
gagaacugagaugcguuuga

SEQ ID NO: 292896 - RNA, 22 nt, Homo sapiens
gagaaguaaauuuauuugcaaa

SEQ ID NO: 292897 - RNA, 22 nt, Homo sapiens
gagacauguuugccaauaauuu

SEQ ID NO: 292898 - RNA, 22 nt, Homo sapiens
gagacggagucacgcccuguca

SEQ ID NO: 292899 - RNA, 22 nt, Homo sapiens
gagacucuuagauuggaaaucu

SEQ ID NO: 292900 - RNA, 22 nt, Homo sapiens
gagacugagucuugcucugucg

SEQ ID NO: 292901 - RNA, 22 nt, Homo sapiens
gagagcaugugcuggcaucagu

SEQ ID NO: 292902 - RNA, 21 nt, Homo sapiens
gagaggauucgccagccucuu

SEQ ID NO: 292903 - RNA, 22 nt, Homo sapiens
gagagugugucagaggcugcga

SEQ ID NO: 292904 - RNA, 22 nt, Homo sapiens
gagauaauuugaaucauggggg

SEQ ID NO: 292905 - RNA, 22 nt, Homo sapiens
gagauauguuggcagcugguau

SEQ ID NO: 292906 - RNA, 22 nt, Homo sapiens
gagauauuauuucccuuucaca

SEQ ID NO: 292907 - RNA, 22 nt, Homo sapiens
gagaucaaguauucuccacuaa

SEQ ID NO: 292908 - RNA, 22 nt, Homo sapiens
gagaucacuguuuauauucucu

SEQ ID NO: 292909 - RNA, 22 nt, Homo sapiens
gagaucauuaugucagggguca

SEQ ID NO: 292910 - RNA, 22 nt, Homo sapiens
gagaucuauuccucacccuucu

SEQ ID NO: 292911 - RNA, 22 nt, Homo sapiens
gagaugaagugucaauaaggau

SEQ ID NO: 292912 - RNA, 22 nt, Homo sapiens
gagaugauuugccccauguauu

SEQ ID NO: 292913 - RNA, 22 nt, Homo sapiens
gagaugcaccuugucacguuuc

SEQ ID NO: 292914 - RNA, 22 nt, Homo sapiens
guguugcacauucuguggaugu

SEQ ID NO: 292915 - RNA, 22 nt, Homo sapiens
guguuugguugauagagccacu

SEQ ID NO: 292916 - RNA, 22 nt, Homo sapiens
guuaagaaguguaacuuaaguu

SEQ ID NO: 292917 - RNA, 23 nt, Homo sapiens
guuaagugaauguguacucuauu

SEQ ID NO: 292918 - RNA, 22 nt, Homo sapiens
guuacugucuuccugauugcuu

SEQ ID NO: 292919 - RNA, 22 nt, Homo sapiens
guuaggcagugugguauagcag

SEQ ID NO: 292920 - RNA, 22 nt, Homo sapiens
guuauccugucuuuacauacaa

SEQ ID NO: 292921 - RNA, 22 nt, Homo sapiens
guuauguaucuugauugggugg

SEQ ID NO: 292922 - RNA, 22 nt, Homo sapiens
guucaagcaauucugcugccuc

SEQ ID NO: 292923 - RNA, 20 nt, Homo sapiens
guucacagagguuaugauua

SEQ ID NO: 292924 - RNA, 22 nt, Homo sapiens
guucacaguuucuaaucccagc

SEQ ID NO: 292925 - RNA, 22 nt, Homo sapiens
guucagguauucuggaacagag

SEQ ID NO: 292926 - RNA, 20 nt, Homo sapiens
guucauguaauuaguucagg

SEQ ID NO: 292927 - RNA, 22 nt, Homo sapiens
guucccaguugaaaugauuagu

SEQ ID NO: 292928 - RNA, 22 nt, Homo sapiens
guugaaaucaucacuuggcaug

SEQ ID NO: 292929 - RNA, 22 nt, Homo sapiens
guugaggcaggagaauuacuug

SEQ ID NO: 292930 - RNA, 22 nt, Homo sapiens
guuggcuuuuuaaggaaauugc

SEQ ID NO: 292931 - RNA, 22 nt, Homo sapiens
guugggcccauagacugccagu

SEQ ID NO: 292932 - RNA, 22 nt, Homo sapiens
guugugcuuaagccuauugauu

SEQ ID NO: 292933 - RNA, 22 nt, Homo sapiens
guuuaacugguacuucaagucu

SEQ ID NO: 292934 - RNA, 22 nt, Homo sapiens
guuugguugcauggaaaauuua

SEQ ID NO: 292935 - RNA, 21 nt, Homo sapiens
uaaaacuguaacuuuguccug

SEQ ID NO: 292936 - RNA, 22 nt, Homo sapiens
uaaacacucacuucauagccau

SEQ ID NO: 292937 - RNA, 22 nt, Homo sapiens
uaaacugucuuuggagcuuugc

SEQ ID NO: 292938 - RNA, 22 nt, Homo sapiens
uaaagcauguaauuagguuaga

SEQ ID NO: 292939 - RNA, 22 nt, Homo sapiens
uaaagccagugauuaugucucu

SEQ ID NO: 292940 - RNA, 22 nt, Homo sapiens
uaaagcuacaguauaugguauu

SEQ ID NO: 292941 - RNA, 21 nt, Homo sapiens
uaaagcuagaaccuuagcuuu

SEQ ID NO: 292942 - RNA, 22 nt, Homo sapiens
uaaagcuauuauaguuauguuu

SEQ ID NO: 292943 - RNA, 22 nt, Homo sapiens
uaaaugcuuaauugaaugugga

SEQ ID NO: 292944 - RNA, 22 nt, Homo sapiens
uaaauggauaaaugaauaccua

SEQ ID NO: 292945 - RNA, 22 nt, Homo sapiens
uaaauugcauaaguacaaauga

SEQ ID NO: 292946 - RNA, 22 nt, Homo sapiens
uaacaggcaaggucacaccuug

SEQ ID NO: 292947 - RNA, 22 nt, Homo sapiens
uaacccuuaguaucuguggguu

SEQ ID NO: 292948 - RNA, 22 nt, Homo sapiens
uaacuacuucugcuucagagua

SEQ ID NO: 292949 - RNA, 22 nt, Homo sapiens
uaacuccauuuggacucaguau

SEQ ID NO: 292950 - RNA, 22 nt, Homo sapiens
uaacugcaaccuccgccucccg

SEQ ID NO: 292951 - RNA, 18 nt, Homo sapiens
uaacuggugugagauggu

SEQ ID NO: 292952 - RNA, 22 nt, Homo sapiens
uaacugucucaggccaugggcg

SEQ ID NO: 292953 - RNA, 20 nt, Homo sapiens
uaacuguggcuucuuuuggc

SEQ ID NO: 292954 - RNA, 23 nt, Homo sapiens
agaaaugucuauucagggucccu

SEQ ID NO: 292955 - RNA, 22 nt, Homo sapiens
agaaugucaguauuggcuaaaa

SEQ ID NO: 292956 - RNA, 22 nt, Homo sapiens
agacaagauggcuugagguuca

SEQ ID NO: 292957 - RNA, 20 nt, Homo sapiens
agacagcugcagcccacauc

SEQ ID NO: 292958 - RNA, 22 nt, Homo sapiens
agacagcuggaguaucauagcu

SEQ ID NO: 292959 - RNA, 20 nt, Homo sapiens
agacaguguggagauuccuu

SEQ ID NO: 292960 - RNA, 22 nt, Homo sapiens
agacaucauuugauggugggag

SEQ ID NO: 292961 - RNA, 22 nt, Homo sapiens
agacccuguauguguuuaguuu

SEQ ID NO: 292962 - RNA, 23 nt, Homo sapiens
agacugaaguaucugagacucag

SEQ ID NO: 292963 - RNA, 22 nt, Homo sapiens
agacuguaaugcauaauuuacu

SEQ ID NO: 292964 - RNA, 22 nt, Homo sapiens
agagaccuguaaaguucaggca

SEQ ID NO: 292965 - RNA, 22 nt, Homo sapiens
agagauccucauuuuauagaca

SEQ ID NO: 292966 - RNA, 22 nt, Homo sapiens
agagaugauuaacauuuuggua

SEQ ID NO: 292967 - RNA, 18 nt, Homo sapiens
agagcacugaguuuuaga

SEQ ID NO: 292968 - RNA, 22 nt, Homo sapiens
agagccacauuaaauaugggaa

SEQ ID NO: 292969 - RNA, 22 nt, Homo sapiens
agagcuguguuuuaacuuuuua

SEQ ID NO: 292970 - RNA, 22 nt, Homo sapiens
agaguacaggcaaguuagucau

SEQ ID NO: 292971 - RNA, 22 nt, Homo sapiens
agaguauacaugugagugagau

SEQ ID NO: 292972 - RNA, 19 nt, Homo sapiens
agaguauuguuacuucucu

SEQ ID NO: 292973 - RNA, 21 nt, Homo sapiens
agagucaucucuaucuguacc

SEQ ID NO: 292974 - RNA, 22 nt, Homo sapiens
agagugcaaagguuggggcugg

SEQ ID NO: 292975 - RNA, 22 nt, Homo sapiens
agagugcaauggcaccaucucg

SEQ ID NO: 292976 - RNA, 22 nt, Homo sapiens
agaucauaugcaguaaugaacu

SEQ ID NO: 292977 - RNA, 22 nt, Homo sapiens
agaugauguuuacugagcauca

SEQ ID NO: 292978 - RNA, 22 nt, Homo sapiens
agaugcauugguggcauauuca

SEQ ID NO: 292979 - RNA, 22 nt, Homo sapiens
agaugccuaugaagagaaauua

SEQ ID NO: 292980 - RNA, 22 nt, Homo sapiens
agauggguuuucacauguuggc

SEQ ID NO: 292981 - RNA, 22 nt, Homo sapiens
agauggucuucauaaguuuuaa

SEQ ID NO: 292982 - RNA, 22 nt, Homo sapiens
agauggugugcuaggaaaugua

SEQ ID NO: 292983 - RNA, 22 nt, Homo sapiens
agauguuguucaucugauuguu

SEQ ID NO: 292984 - RNA, 22 nt, Homo sapiens
agcaacauuguucauaauagcu

SEQ ID NO: 292985 - RNA, 22 nt, Homo sapiens
agcaaccagaggagaugaggcu

SEQ ID NO: 292986 - RNA, 22 nt, Homo sapiens
agcaagaaugaacucucccaga

SEQ ID NO: 292987 - RNA, 22 nt, Homo sapiens
agcaagacauggcuuccaaaug

SEQ ID NO: 292988 - RNA, 22 nt, Homo sapiens
agcaccacauacuacagagaua

SEQ ID NO: 292989 - RNA, 22 nt, Homo sapiens
agcaccaugggcugaguaagug

SEQ ID NO: 292990 - RNA, 22 nt, Homo sapiens
agcaccauuagcguugggccgg

SEQ ID NO: 292991 - RNA, 22 nt, Homo sapiens
agcaccauuguacuccagccug

SEQ ID NO: 292992 - RNA, 22 nt, Homo sapiens
agcaccauuuauugaaaagaca

SEQ ID NO: 292993 - RNA, 22 nt, Homo sapiens
agcagagcauauucauucgggg

SEQ ID NO: 292994 - RNA, 22 nt, Homo sapiens
gagaugguacacauacgauucu

SEQ ID NO: 292995 - RNA, 22 nt, Homo sapiens
gagaugguguuccacugccagu

SEQ ID NO: 292996 - RNA, 22 nt, Homo sapiens
gagauguagucuugcccuguca

SEQ ID NO: 292997 - RNA, 22 nt, Homo sapiens
gagauuauugucucccucacca

SEQ ID NO: 292998 - RNA, 22 nt, Homo sapiens
gagcacccuuuguugauugcaa

SEQ ID NO: 292999 - RNA, 18 nt, Homo sapiens
gagcaccuuuuuugcaga

SEQ ID NO: 293000 - RNA, 22 nt, Homo sapiens
gagcacugaauacugugguggu

SEQ ID NO: 293001 - RNA, 20 nt, Homo sapiens
gagcucaucuucuuuaccac

SEQ ID NO: 293002 - RNA, 22 nt, Homo sapiens
gagcugaucuuuucugauucca

SEQ ID NO: 293003 - RNA, 22 nt, Homo sapiens
gagcugguccuuuaaggaugca

SEQ ID NO: 293004 - RNA, 22 nt, Homo sapiens
gagcuuguagugugaaugguau

SEQ ID NO: 293005 - RNA, 22 nt, Homo sapiens
gaggaaguagcuacugucuuuc

SEQ ID NO: 293006 - RNA, 22 nt, Homo sapiens
gaggagucagacugugcaaggu

SEQ ID NO: 293007 - RNA, 22 nt, Homo sapiens
gaggcaaugugcccggcccaca

SEQ ID NO: 293008 - RNA, 22 nt, Homo sapiens
gaggcagucuguccauucucag

SEQ ID NO: 293009 - RNA, 22 nt, Homo sapiens
gaggcagucugucccuuagcag

SEQ ID NO: 293010 - RNA, 22 nt, Homo sapiens
gaggcaguguguccguucucgg

SEQ ID NO: 293011 - RNA, 22 nt, Homo sapiens
gaggcggugugaugucacaugc

SEQ ID NO: 293012 - RNA, 22 nt, Homo sapiens
gaggguguuguguugcuuaaua

SEQ ID NO: 293013 - RNA, 21 nt, Homo sapiens
gagguagggauuaaagaccuc

SEQ ID NO: 293014 - RNA, 22 nt, Homo sapiens
gagguaggggccuuaaagaugc

SEQ ID NO: 293015 - RNA, 22 nt, Homo sapiens
gagguagggucccacuauguug

SEQ ID NO: 293016 - RNA, 22 nt, Homo sapiens
gaggucaugucgggccccagga

SEQ ID NO: 293017 - RNA, 22 nt, Homo sapiens
gaggucuuacauuuuaauauuu

SEQ ID NO: 293018 - RNA, 22 nt, Homo sapiens
gaggugaaggucucaauaaaua

SEQ ID NO: 293019 - RNA, 22 nt, Homo sapiens
gaggugguagguucacagcagc

SEQ ID NO: 293020 - RNA, 22 nt, Homo sapiens
gaguaaaugucaaguacuuagg

SEQ ID NO: 293021 - RNA, 22 nt, Homo sapiens
gaguagugcuguaauaaacaua

SEQ ID NO: 293022 - RNA, 21 nt, Homo sapiens
gagugcaaauaaagagagggc

SEQ ID NO: 293023 - RNA, 22 nt, Homo sapiens
gagugcaagguuuuucugagug

SEQ ID NO: 293024 - RNA, 23 nt, Homo sapiens
gagugcaaugacaugaucucgga

SEQ ID NO: 293025 - RNA, 22 nt, Homo sapiens
gagugcaauggcaugaucuugg

SEQ ID NO: 293026 - RNA, 22 nt, Homo sapiens
gagugcaucguggccauuuuaa

SEQ ID NO: 293027 - RNA, 22 nt, Homo sapiens
gagugcauugguggucaggugu

SEQ ID NO: 293028 - RNA, 22 nt, Homo sapiens
gaguucauaucuaugagugugc

SEQ ID NO: 293029 - RNA, 22 nt, Homo sapiens
gaguuuguacuaauuuguugua

SEQ ID NO: 293030 - RNA, 22 nt, Homo sapiens
gauaagagaugauuuugccaug

SEQ ID NO: 293031 - RNA, 22 nt, Homo sapiens
gauacaguaugcaugugguauu

SEQ ID NO: 293032 - RNA, 22 nt, Homo sapiens
gauagguucuaagcagguguug

SEQ ID NO: 293033 - RNA, 22 nt, Homo sapiens
gauaguugugagaacucuuacu

SEQ ID NO: 293034 - RNA, 19 nt, Homo sapiens
gauaucuagggggagguuc

SEQ ID NO: 293035 - RNA, 22 nt, Homo sapiens
gauauguaaaaauuauaucuga

SEQ ID NO: 293036 - RNA, 22 nt, Homo sapiens
gauauuacuuccaauauugcaa

SEQ ID NO: 293037 - RNA, 19 nt, Homo sapiens
caugccacugcacuugagu

SEQ ID NO: 293038 - RNA, 22 nt, Homo sapiens
caugccauugcucuccugggug

SEQ ID NO: 293039 - RNA, 22 nt, Homo sapiens
cauggcacaucuuuucugacua

SEQ ID NO: 293040 - RNA, 22 nt, Homo sapiens
cauggcacuguaugaaaugugc

SEQ ID NO: 293041 - RNA, 22 nt, Homo sapiens
cauggcccuggguccauaggaa

SEQ ID NO: 293042 - RNA, 22 nt, Homo sapiens
cauggguuuucucaaguaguca

SEQ ID NO: 293043 - RNA, 22 nt, Homo sapiens
caugguacugccacagaagagu

SEQ ID NO: 293044 - RNA, 22 nt, Homo sapiens
cauggucaccuuccaaguuauu

SEQ ID NO: 293045 - RNA, 19 nt, Homo sapiens
caugugcacuacuggcuuc

SEQ ID NO: 293046 - RNA, 20 nt, Homo sapiens
cauuacacuccaaccugggu

SEQ ID NO: 293047 - RNA, 22 nt, Homo sapiens
cauuacacuccagccuggguga

SEQ ID NO: 293048 - RNA, 22 nt, Homo sapiens
cauuccacauguaggacaauuu

SEQ ID NO: 293049 - RNA, 22 nt, Homo sapiens
cauugcacuccagccugaccaa

SEQ ID NO: 293050 - RNA, 20 nt, Homo sapiens
cauugcacuccagcuugggc

SEQ ID NO: 293051 - RNA, 22 nt, Homo sapiens
cauugcacuccagcuugggcga

SEQ ID NO: 293052 - RNA, 22 nt, Homo sapiens
cauugcacuccaucuugggcaa

SEQ ID NO: 293053 - RNA, 22 nt, Homo sapiens
cauugcaguggaguggggaaga

SEQ ID NO: 293054 - RNA, 22 nt, Homo sapiens
cauugcaguuuuugguguaucu

SEQ ID NO: 293055 - RNA, 22 nt, Homo sapiens
cauugcaugcauauggcuuggu

SEQ ID NO: 293056 - RNA, 22 nt, Homo sapiens
cauugcauuccagucugggcaa

SEQ ID NO: 293057 - RNA, 20 nt, Homo sapiens
cauugcccuccagccugggc

SEQ ID NO: 293058 - RNA, 22 nt, Homo sapiens
cauugcccuccagccugggcaa

SEQ ID NO: 293059 - RNA, 22 nt, Homo sapiens
cauugggugagaacaugcuccu

SEQ ID NO: 293060 - RNA, 22 nt, Homo sapiens
cauugguuaguuaacuuuaaga

SEQ ID NO: 293061 - RNA, 22 nt, Homo sapiens
cauugguuccaguuuguccuua

SEQ ID NO: 293062 - RNA, 22 nt, Homo sapiens
cauugguugaacagauuguguu

SEQ ID NO: 293063 - RNA, 22 nt, Homo sapiens
cauuguccuccuggggcuauuu

SEQ ID NO: 293064 - RNA, 22 nt, Homo sapiens
cauuuugcaguuucugucucca

SEQ ID NO: 293065 - RNA, 22 nt, Homo sapiens
ccaagugcuuaaaauuucauuu

SEQ ID NO: 293066 - RNA, 22 nt, Homo sapiens
ccacaaccuccauauccugggu

SEQ ID NO: 293067 - RNA, 22 nt, Homo sapiens
ccacacugucuuggugggaaac

SEQ ID NO: 293068 - RNA, 23 nt, Homo sapiens
ccacacuguuuagaauggcauca

SEQ ID NO: 293069 - RNA, 22 nt, Homo sapiens
ccacagucuaugcaacaagguc

SEQ ID NO: 293070 - RNA, 22 nt, Homo sapiens
ccacccuuccacacccugggua

SEQ ID NO: 293071 - RNA, 22 nt, Homo sapiens
ccacugggcaguuuauuaucag

SEQ ID NO: 293072 - RNA, 22 nt, Homo sapiens
ccacugggcuagguguuuugga

SEQ ID NO: 293073 - RNA, 22 nt, Homo sapiens
ccacugugguaucugauacugg

SEQ ID NO: 293074 - RNA, 22 nt, Homo sapiens
ccagaauucucauuggaaggaa

SEQ ID NO: 293075 - RNA, 22 nt, Homo sapiens
ccagaguucuaggcauuggaaa

SEQ ID NO: 293076 - RNA, 22 nt, Homo sapiens
ccagaguuucugauucagcagg

SEQ ID NO: 293077 - RNA, 22 nt, Homo sapiens
ccagcaccauuuauuaaauagg

SEQ ID NO: 293078 - RNA, 22 nt, Homo sapiens
ccaggguugcuuuagauucuga

SEQ ID NO: 293079 - RNA, 22 nt, Homo sapiens
ccagguuucuagaauaauuccu

SEQ ID NO: 293080 - RNA, 17 nt, Homo sapiens
ccagugaucccuuuugu

SEQ ID NO: 293081 - RNA, 18 nt, Homo sapiens
ccagugcaaggaaagccc

SEQ ID NO: 293082 - RNA, 21 nt, Homo sapiens
ccaguguaaugauagcaggca

SEQ ID NO: 293083 - RNA, 19 nt, Homo sapiens
ccaguguucugauugcacu

SEQ ID NO: 293084 - RNA, 22 nt, Homo sapiens
ccaguguuuggauuagggaugc

SEQ ID NO: 293085 - RNA, 17 nt, Homo sapiens
ccaguuuucccucagug

SEQ ID NO: 293086 - RNA, 22 nt, Homo sapiens
ccauggcuucugcauucuguca

SEQ ID NO: 293087 - RNA, 21 nt, Homo sapiens
ccaugggacggaaugaauaca

SEQ ID NO: 293088 - RNA, 22 nt, Homo sapiens
ccauugaacaugaaggaaugug

SEQ ID NO: 293089 - RNA, 22 nt, Homo sapiens
ccauugcacuccagccuaggca

SEQ ID NO: 293090 - RNA, 22 nt, Homo sapiens
cccagcguucggcauggcugag

SEQ ID NO: 293091 - RNA, 22 nt, Homo sapiens
cccaguagagauugccgaauug

SEQ ID NO: 293092 - RNA, 22 nt, Homo sapiens
cccaguuuugcuucucaugagg

SEQ ID NO: 293093 - RNA, 22 nt, Homo sapiens
cccuaagacagugaggggugca

SEQ ID NO: 293094 - RNA, 23 nt, Homo sapiens
cccucagaagugcagggagagaa

SEQ ID NO: 293095 - RNA, 22 nt, Homo sapiens
cccucgagaaaccaucugcuga

SEQ ID NO: 293096 - RNA, 22 nt, Homo sapiens
cccugagaaaacuuuguccuua

SEQ ID NO: 293097 - RNA, 21 nt, Homo sapiens
cccugguguuuggaguuugag

SEQ ID NO: 293098 - RNA, 22 nt, Homo sapiens
cccugugaauauuaccuuauuu

SEQ ID NO: 293099 - RNA, 20 nt, Homo sapiens
ccuaguguucuuaggcugca

SEQ ID NO: 293100 - RNA, 22 nt, Homo sapiens
ccucaguguuuaucauuauuuu

SEQ ID NO: 293101 - RNA, 22 nt, Homo sapiens
ccucauggagaacaucugcuag

SEQ ID NO: 293102 - RNA, 21 nt, Homo sapiens
ccuccauuuguauucuugccc

SEQ ID NO: 293103 - RNA, 22 nt, Homo sapiens
ccucuuuguugagacuucacca

SEQ ID NO: 293104 - RNA, 21 nt, Homo sapiens
ccugaagaagugaccucugag

SEQ ID NO: 293105 - RNA, 22 nt, Homo sapiens
ccugagacugauugacucacaa

SEQ ID NO: 293106 - RNA, 21 nt, Homo sapiens
ccugaguacaacccacuccac

SEQ ID NO: 293107 - RNA, 22 nt, Homo sapiens
ccugaugacacgggagauguac

SEQ ID NO: 293108 - RNA, 19 nt, Homo sapiens
ccugcuguucuuuugcacc

SEQ ID NO: 293109 - RNA, 22 nt, Homo sapiens
ccuggaucauugucauucccaa

SEQ ID NO: 293110 - RNA, 22 nt, Homo sapiens
ccuggcaagagacugaagauag

SEQ ID NO: 293111 - RNA, 22 nt, Homo sapiens
ccuucacaggcacugguucaga

SEQ ID NO: 293112 - RNA, 22 nt, Homo sapiens
ccuucauugcaucuuuaagaga

SEQ ID NO: 293113 - RNA, 22 nt, Homo sapiens
ccuugcacuucccaagugaggc

SEQ ID NO: 293114 - RNA, 22 nt, Homo sapiens
ccuuggcaauggcuggggcuga

SEQ ID NO: 293115 - RNA, 22 nt, Homo sapiens
uguuugcuuaacguggagccag

SEQ ID NO: 293116 - RNA, 22 nt, Homo sapiens
uguuuguuugauaugggauaaa

SEQ ID NO: 293117 - RNA, 22 nt, Homo sapiens
uuaaacugcuugaauuggguuu

SEQ ID NO: 293118 - RNA, 22 nt, Homo sapiens
uuaaaugcacauacuugagaaa

SEQ ID NO: 293119 - RNA, 22 nt, Homo sapiens
uuaaaugcauagaauguguagu

SEQ ID NO: 293120 - RNA, 22 nt, Homo sapiens
uuaaaugucuguagaugugcug

SEQ ID NO: 293121 - RNA, 22 nt, Homo sapiens
uuaacagcacaugcugucccuu

SEQ ID NO: 293122 - RNA, 22 nt, Homo sapiens
uuaagagugggaguuggccaca

SEQ ID NO: 293123 - RNA, 22 nt, Homo sapiens
uuaagccacucaagagauagag

SEQ ID NO: 293124 - RNA, 22 nt, Homo sapiens
uuaaggaaggagucuuaaaugg

SEQ ID NO: 293125 - RNA, 18 nt, Homo sapiens
uuaaggcaggacuuuaag

SEQ ID NO: 293126 - RNA, 22 nt, Homo sapiens
uuaaggcuuguacuuguuuucu

SEQ ID NO: 293127 - RNA, 22 nt, Homo sapiens
uuaaggcuuuaaguaaacacag

SEQ ID NO: 293128 - RNA, 23 nt, Homo sapiens
uuaaggugaugucuuugugccuc

SEQ ID NO: 293129 - RNA, 21 nt, Homo sapiens
uuaaguaauuacccaacucuc

SEQ ID NO: 293130 - RNA, 22 nt, Homo sapiens
uuaauaccgucacauggcugaa

SEQ ID NO: 293131 - RNA, 22 nt, Homo sapiens
uuaaugcuuuugggauauuucu

SEQ ID NO: 293132 - RNA, 22 nt, Homo sapiens
uuaauguaauugauugauugac

SEQ ID NO: 293133 - RNA, 22 nt, Homo sapiens
uuaauguaucuaucacaucaca

SEQ ID NO: 293134 - RNA, 22 nt, Homo sapiens
uuaaugugaaucaggaugcauu

SEQ ID NO: 293135 - RNA, 22 nt, Homo sapiens
uuacaaguggcaucucucugga

SEQ ID NO: 293136 - RNA, 22 nt, Homo sapiens
uuacagcagugccccacuccca

SEQ ID NO: 293137 - RNA, 22 nt, Homo sapiens
uuacagucucaagagugcugca

SEQ ID NO: 293138 - RNA, 23 nt, Homo sapiens
uuacaguggcaugaucucugcuc

SEQ ID NO: 293139 - RNA, 22 nt, Homo sapiens
uuacaguguuuguucuguuacu

SEQ ID NO: 293140 - RNA, 22 nt, Homo sapiens
uuacaguugugagccaccaugc

SEQ ID NO: 293141 - RNA, 22 nt, Homo sapiens
uuacaucaucacauuaguuugc

SEQ ID NO: 293142 - RNA, 22 nt, Homo sapiens
uuacauguuguggguuguggcc

SEQ ID NO: 293143 - RNA, 22 nt, Homo sapiens
uuaccagagaagacgaggggga

SEQ ID NO: 293144 - RNA, 22 nt, Homo sapiens
uuaccucagaccugcucugugu

SEQ ID NO: 293145 - RNA, 22 nt, Homo sapiens
uuaccuugcacugagucugaaa

SEQ ID NO: 293146 - RNA, 22 nt, Homo sapiens
uuaccuuuuuaagacagguuag

SEQ ID NO: 293147 - RNA, 20 nt, Homo sapiens
uuacuauguaguauuggcuc

SEQ ID NO: 293148 - RNA, 22 nt, Homo sapiens
uuacugcucuuuugucaugagu

SEQ ID NO: 293149 - RNA, 22 nt, Homo sapiens
uuacugcuuaagugauucaaca

SEQ ID NO: 293150 - RNA, 22 nt, Homo sapiens
uuacuguagugucauaucguau

SEQ ID NO: 293151 - RNA, 20 nt, Homo sapiens
uuagaguaguaugauuuaua

SEQ ID NO: 293152 - RNA, 23 nt, Homo sapiens
uuagaucuuuaaggaaucuccac

SEQ ID NO: 293153 - RNA, 22 nt, Homo sapiens
uuagaugaagucacagaaccca

SEQ ID NO: 293154 - RNA, 22 nt, Homo sapiens
uuagauguuuagaagugggcca

SEQ ID NO: 293155 - RNA, 22 nt, Homo sapiens
uuagcacauuuccagcacaugg

SEQ ID NO: 293156 - RNA, 22 nt, Homo sapiens
uuagcacugucuacucuggauu

SEQ ID NO: 293157 - RNA, 22 nt, Homo sapiens
uuagcagcacaaaagcagacua

SEQ ID NO: 293158 - RNA, 22 nt, Homo sapiens
uuagcagcaugagaauggacua

SEQ ID NO: 293159 - RNA, 22 nt, Homo sapiens
uuagcagcucuaauaacugcua

SEQ ID NO: 293160 - RNA, 22 nt, Homo sapiens
uuagcaugucuacuaauuugcu

SEQ ID NO: 293161 - RNA, 22 nt, Homo sapiens
uuaggacacuguggguggguca

SEQ ID NO: 293162 - RNA, 22 nt, Homo sapiens
uuaggcaggauaguuacauauu

SEQ ID NO: 293163 - RNA, 21 nt, Homo sapiens
uuaggcagugucagaggugag

SEQ ID NO: 293164 - RNA, 22 nt, Homo sapiens
uuaggcucuuugaggugcccag

SEQ ID NO: 293165 - RNA, 22 nt, Homo sapiens
uuagggaggcucaggacaagag

SEQ ID NO: 293166 - RNA, 22 nt, Homo sapiens
uuagguauuuuguuaugucagc

SEQ ID NO: 293167 - RNA, 22 nt, Homo sapiens
uuaggugcauggaaguguuuuc

SEQ ID NO: 293168 - RNA, 22 nt, Homo sapiens
uuaguaguuugauaggaauagc

SEQ ID NO: 293169 - RNA, 22 nt, Homo sapiens
uuagugcaaacucuucaaugcu

SEQ ID NO: 293170 - RNA, 22 nt, Homo sapiens
uuaguucauugugacuggacuc

SEQ ID NO: 293171 - RNA, 20 nt, Homo sapiens
uuaguucauuuagaagguuu

SEQ ID NO: 293172 - RNA, 22 nt, Homo sapiens
uuauaaacaugaagauuugggg

SEQ ID NO: 293173 - RNA, 20 nt, Homo sapiens
uuauaacuuuuguucugggg

SEQ ID NO: 293174 - RNA, 22 nt, Homo sapiens
uuauacucgucugaaugauucu

SEQ ID NO: 293175 - RNA, 21 nt, Homo sapiens
uuauaguggcaugauuuauaa

SEQ ID NO: 293176 - RNA, 22 nt, Homo sapiens
uuaugacaggcucaggagcccc

SEQ ID NO: 293177 - RNA, 22 nt, Homo sapiens
uuauggccauucuuguaggagu

SEQ ID NO: 293178 - RNA, 22 nt, Homo sapiens
uuaugggucuuggaaugcaaua

SEQ ID NO: 293179 - RNA, 22 nt, Homo sapiens
uuaugucuuugagcaaugcugu

SEQ ID NO: 293180 - RNA, 22 nt, Homo sapiens
uuauguguuuaauguuucugaa

SEQ ID NO: 293181 - RNA, 22 nt, Homo sapiens
uuauuagagauauuugguuagg

SEQ ID NO: 293182 - RNA, 22 nt, Homo sapiens
uuauuauguuggugcaaaggua

SEQ ID NO: 293183 - RNA, 22 nt, Homo sapiens
uuauucauuaacagggaccaaa

SEQ ID NO: 293184 - RNA, 22 nt, Homo sapiens
uuauugcuuuugugcaggugag

SEQ ID NO: 293185 - RNA, 22 nt, Homo sapiens
uucaaaaccucugcuuaagccc

SEQ ID NO: 293186 - RNA, 22 nt, Homo sapiens
uucaaaguaaagggauggagac

SEQ ID NO: 293187 - RNA, 22 nt, Homo sapiens
uucaaaucuuuggcucccacua

SEQ ID NO: 293188 - RNA, 22 nt, Homo sapiens
uucaaauguucuuucaccaccc

SEQ ID NO: 293189 - RNA, 22 nt, Homo sapiens
uucaagaauuaaaguggcuuuu

SEQ ID NO: 293190 - RNA, 23 nt, Homo sapiens
ugagauuauaaucuuuuacuucu

SEQ ID NO: 293191 - RNA, 22 nt, Homo sapiens
ugagauucucugauuguagguc

SEQ ID NO: 293192 - RNA, 22 nt, Homo sapiens
ugagauuguaucugcaaugugu

SEQ ID NO: 293193 - RNA, 19 nt, Homo sapiens
ugagauuguaugaggagau

SEQ ID NO: 293194 - RNA, 22 nt, Homo sapiens
ugagcaacauuucaaaacucca

SEQ ID NO: 293195 - RNA, 22 nt, Homo sapiens
ugagcagagaucacggcauugu

SEQ ID NO: 293196 - RNA, 22 nt, Homo sapiens
ugagcagugaguguggugcagg

SEQ ID NO: 293197 - RNA, 22 nt, Homo sapiens
ugagcaucucuaaaaggagcaa

SEQ ID NO: 293198 - RNA, 22 nt, Homo sapiens
cuuuuugcuagagucuaggguc

SEQ ID NO: 293199 - RNA, 22 nt, Homo sapiens
gaaaacugcuucucuggguuuc

SEQ ID NO: 293200 - RNA, 22 nt, Homo sapiens
gaaacugcauuucuaacaagcu

SEQ ID NO: 293201 - RNA, 22 nt, Homo sapiens
gaaagauuuccugagcuagaaa

SEQ ID NO: 293202 - RNA, 22 nt, Homo sapiens
gaaagcugguauagauacauua

SEQ ID NO: 293203 - RNA, 22 nt, Homo sapiens
gaaagugcugcaaggccaugca

SEQ ID NO: 293204 - RNA, 22 nt, Homo sapiens
gaaagugcugcuugacugggau

SEQ ID NO: 293205 - RNA, 22 nt, Homo sapiens
gaaaugcucauuuuggauccuu

SEQ ID NO: 293206 - RNA, 22 nt, Homo sapiens
gaaauggaucagagcaagcuuu

SEQ ID NO: 293207 - RNA, 23 nt, Homo sapiens
gaaaugucuuagugaaauugcuu

SEQ ID NO: 293208 - RNA, 22 nt, Homo sapiens
gaaauguugauagugggcauug

SEQ ID NO: 293209 - RNA, 22 nt, Homo sapiens
gaagaaguacaagacaaauuuu

SEQ ID NO: 293210 - RNA, 22 nt, Homo sapiens
gaagauaucuaguaccauuguc

SEQ ID NO: 293211 - RNA, 22 nt, Homo sapiens
gaagauguugcuuaccuuggag

SEQ ID NO: 293212 - RNA, 22 nt, Homo sapiens
gaagcauugauccacaggcgug

SEQ ID NO: 293213 - RNA, 22 nt, Homo sapiens
gaagguacgcuuaggaaaugau

SEQ ID NO: 293214 - RNA, 22 nt, Homo sapiens
gaaguaauaaauggauucuuaa

SEQ ID NO: 293215 - RNA, 22 nt, Homo sapiens
gaaguaggugcuguuauuaucu

SEQ ID NO: 293216 - RNA, 23 nt, Homo sapiens
gaaguauagcaugcacauggaaa

SEQ ID NO: 293217 - RNA, 22 nt, Homo sapiens
gaagugcaguggcacagucaug

SEQ ID NO: 293218 - RNA, 22 nt, Homo sapiens
gaauagugcugcaauaaacaua

SEQ ID NO: 293219 - RNA, 22 nt, Homo sapiens
gaaucacaguuauuagagcagc

SEQ ID NO: 293220 - RNA, 22 nt, Homo sapiens
gaaucauuguuucuaaguuugu

SEQ ID NO: 293221 - RNA, 22 nt, Homo sapiens
gaaugaauguuuauccuuagau

SEQ ID NO: 293222 - RNA, 22 nt, Homo sapiens
gaaugcuaagcaugugggaauu

SEQ ID NO: 293223 - RNA, 22 nt, Homo sapiens
gaauggaacugacuauagcuga

SEQ ID NO: 293224 - RNA, 21 nt, Homo sapiens
gaauggcaccauuagcauaua

SEQ ID NO: 293225 - RNA, 20 nt, Homo sapiens
gaaugguuucgggguucuug

SEQ ID NO: 293226 - RNA, 22 nt, Homo sapiens
gaaugucuuauugcucguugua

SEQ ID NO: 293227 - RNA, 22 nt, Homo sapiens
gaauucugucgcuuacuagaug

SEQ ID NO: 293228 - RNA, 22 nt, Homo sapiens
gacaaguuugauuuauuccaag

SEQ ID NO: 293229 - RNA, 22 nt, Homo sapiens
gacagagcaagacccuauuuaa

SEQ ID NO: 293230 - RNA, 22 nt, Homo sapiens
gacagguuuucuguuucugaaa

SEQ ID NO: 293231 - RNA, 18 nt, Homo sapiens
gacagugugaagauuccu

SEQ ID NO: 293232 - RNA, 20 nt, Homo sapiens
gacauagagacucucaaaaa

SEQ ID NO: 293233 - RNA, 20 nt, Homo sapiens
gacauggaggaggauuauua

SEQ ID NO: 293234 - RNA, 22 nt, Homo sapiens
gacauguaaggcucucucuguu

SEQ ID NO: 293235 - RNA, 20 nt, Homo sapiens
gacauguugguuugcugcac

SEQ ID NO: 293236 - RNA, 20 nt, Homo sapiens
gacauguuuuguggccuaac

SEQ ID NO: 293237 - RNA, 22 nt, Homo sapiens
gacauguuuuuuaagguuuaug

SEQ ID NO: 293238 - RNA, 22 nt, Homo sapiens
gaccacagacuggaaagagggc

SEQ ID NO: 293239 - RNA, 21 nt, Homo sapiens
gaccacagcagggaaugucag

SEQ ID NO: 293240 - RNA, 22 nt, Homo sapiens
gaccuggugguccacccgccuu

SEQ ID NO: 293241 - RNA, 22 nt, Homo sapiens
gacuagggaaaauuauuuuguu

SEQ ID NO: 293242 - RNA, 22 nt, Homo sapiens
gacucagaacuaaggguguuuc

SEQ ID NO: 293243 - RNA, 18 nt, Homo sapiens
gacuccauuucagccaga

SEQ ID NO: 293244 - RNA, 22 nt, Homo sapiens
gacucuguagacaaucacaucu

SEQ ID NO: 293245 - RNA, 22 nt, Homo sapiens
gacuggccauugauacagaggu

SEQ ID NO: 293246 - RNA, 22 nt, Homo sapiens
gagaacaguguuguauuuuuuc

SEQ ID NO: 293247 - RNA, 22 nt, Homo sapiens
gagaacauuaauaguuaauuuu

SEQ ID NO: 293248 - RNA, 22 nt, Homo sapiens
gagaacauuuaagccacucagg

SEQ ID NO: 293249 - RNA, 22 nt, Homo sapiens
gagaaccauuuggagaaaaagu

SEQ ID NO: 293250 - RNA, 22 nt, Homo sapiens
gagaacuggcgugaacugcacg

SEQ ID NO: 293251 - RNA, 22 nt, Homo sapiens
gagaacuggcugauucaaggac

SEQ ID NO: 293252 - RNA, 22 nt, Homo sapiens
gagaaugaacagacugccucuu

SEQ ID NO: 293253 - RNA, 22 nt, Homo sapiens
gagacagugucagccauugaaa

SEQ ID NO: 293254 - RNA, 20 nt, Homo sapiens
gagaccugagauucacucaa

SEQ ID NO: 293255 - RNA, 22 nt, Homo sapiens
gagacggagucucgcucuguca

SEQ ID NO: 293256 - RNA, 22 nt, Homo sapiens
gagacugagucucacucuguca

SEQ ID NO: 293257 - RNA, 22 nt, Homo sapiens
gagacugagucucgcucugccg

SEQ ID NO: 293258 - RNA, 22 nt, Homo sapiens
gagacugaguuuugcucuuguu

SEQ ID NO: 293259 - RNA, 22 nt, Homo sapiens
gagagaguacuugauauaauuu

SEQ ID NO: 293260 - RNA, 22 nt, Homo sapiens
gagagcuaggccacuggggcuu

SEQ ID NO: 293261 - RNA, 22 nt, Homo sapiens
gagagugcuuuggguguaggcc

SEQ ID NO: 293262 - RNA, 22 nt, Homo sapiens
gagauacacccagugcagaggc

SEQ ID NO: 293263 - RNA, 22 nt, Homo sapiens
gagauaggauucacuuucaugu

SEQ ID NO: 293264 - RNA, 22 nt, Homo sapiens
gagaucaauucauggcauaguu

SEQ ID NO: 293265 - RNA, 22 nt, Homo sapiens
gagaucaguuaaugaagugagc

SEQ ID NO: 293266 - RNA, 22 nt, Homo sapiens
gagaucuucguguggggagaca

SEQ ID NO: 293267 - RNA, 22 nt, Homo sapiens
gagaucuuggccaaguuucuua

SEQ ID NO: 293268 - RNA, 22 nt, Homo sapiens
gagaugaaaucuugcucuguca

SEQ ID NO: 293269 - RNA, 22 nt, Homo sapiens
gagaugaucaugugguuuuguc

SEQ ID NO: 293270 - RNA, 22 nt, Homo sapiens
uucaagauggccccagugagcc

SEQ ID NO: 293271 - RNA, 22 nt, Homo sapiens
uucaaggacuaaggauuuuugg

SEQ ID NO: 293272 - RNA, 22 nt, Homo sapiens
uucaaguaguucucaugccuca

SEQ ID NO: 293273 - RNA, 20 nt, Homo sapiens
uucaagugauucucaugccu

SEQ ID NO: 293274 - RNA, 22 nt, Homo sapiens
uucaagugguucagaagucuga

SEQ ID NO: 293275 - RNA, 22 nt, Homo sapiens
uucacaaugccuuguugauggu

SEQ ID NO: 293276 - RNA, 22 nt, Homo sapiens
uucacaauuaaaugugguuauu

SEQ ID NO: 293277 - RNA, 22 nt, Homo sapiens
uucacacuagccacucugguag

SEQ ID NO: 293278 - RNA, 20 nt, Homo sapiens
uucacaggcagcuucuuucu

SEQ ID NO: 293279 - RNA, 22 nt, Homo sapiens
uucacaguacucccuggaauua

SEQ ID NO: 293280 - RNA, 22 nt, Homo sapiens
uucacaguggugggagacguca

SEQ ID NO: 293281 - RNA, 22 nt, Homo sapiens
ugcagcacaguagguuugcaau

SEQ ID NO: 293282 - RNA, 18 nt, Homo sapiens
ugcagcaucaguacccag

SEQ ID NO: 293283 - RNA, 22 nt, Homo sapiens
ugcagcucaaauuccuaacaag

SEQ ID NO: 293284 - RNA, 22 nt, Homo sapiens
ugcaggauguucaguaauuucc

SEQ ID NO: 293285 - RNA, 22 nt, Homo sapiens
ugcaggguccauugucccaagu

SEQ ID NO: 293286 - RNA, 22 nt, Homo sapiens
ugcaguacugucagacuucuua

SEQ ID NO: 293287 - RNA, 22 nt, Homo sapiens
ugcaguacuuugaaauauacug

SEQ ID NO: 293288 - RNA, 20 nt, Homo sapiens
ugcaguguccucacuuguca

SEQ ID NO: 293289 - RNA, 18 nt, Homo sapiens
ugcauacuaucugauuuu

SEQ ID NO: 293290 - RNA, 22 nt, Homo sapiens
ugcauacugaaauauuuuagag

SEQ ID NO: 293291 - RNA, 22 nt, Homo sapiens
ugcauaugucuuuauagcagca

SEQ ID NO: 293292 - RNA, 22 nt, Homo sapiens
ugcauaugucuuuauaguagca

SEQ ID NO: 293293 - RNA, 22 nt, Homo sapiens
ugcauauguugaaccagccuug

SEQ ID NO: 293294 - RNA, 22 nt, Homo sapiens
ugcauauucgaguuauuuuggg

SEQ ID NO: 293295 - RNA, 21 nt, Homo sapiens
ugcauauuggaacuuucucuc

SEQ ID NO: 293296 - RNA, 22 nt, Homo sapiens
ugcauccauucuagacucaucu

SEQ ID NO: 293297 - RNA, 22 nt, Homo sapiens
ugcauggaagggagggaaagag

SEQ ID NO: 293298 - RNA, 21 nt, Homo sapiens
ugcaugguagucacaugauuc

SEQ ID NO: 293299 - RNA, 22 nt, Homo sapiens
ugcauuguggaucuaaaugcau

SEQ ID NO: 293300 - RNA, 21 nt, Homo sapiens
ugcauuguugcugagagcagg

SEQ ID NO: 293301 - RNA, 22 nt, Homo sapiens
ugccagagacguagggaauauu

SEQ ID NO: 293302 - RNA, 22 nt, Homo sapiens
ugccagaugcaguguucaacaa

SEQ ID NO: 293303 - RNA, 22 nt, Homo sapiens
ugccaguguugccuuucacuag

SEQ ID NO: 293304 - RNA, 22 nt, Homo sapiens
ugccauagagacucaacagccu

SEQ ID NO: 293305 - RNA, 22 nt, Homo sapiens
ugccaucauuaauauuaggcau

SEQ ID NO: 293306 - RNA, 22 nt, Homo sapiens
ugccuaggcuggaaugcaaugg

SEQ ID NO: 293307 - RNA, 22 nt, Homo sapiens
ugccuaggcuggaaugcagugg

SEQ ID NO: 293308 - RNA, 22 nt, Homo sapiens
ugcuacccuucgucucucuggu

SEQ ID NO: 293309 - RNA, 22 nt, Homo sapiens
ugcuaucauugauuagugaugu

SEQ ID NO: 293310 - RNA, 22 nt, Homo sapiens
ugcugcaaacaggcaucugugg

SEQ ID NO: 293311 - RNA, 22 nt, Homo sapiens
ugcugcaaucucggcacuuugg

SEQ ID NO: 293312 - RNA, 22 nt, Homo sapiens
ugcugguaguuuaugacuaauu

SEQ ID NO: 293313 - RNA, 22 nt, Homo sapiens
ugcugguggucccauaugauua

SEQ ID NO: 293314 - RNA, 22 nt, Homo sapiens
ugcuggugucaucaaggcuuug

SEQ ID NO: 293315 - RNA, 22 nt, Homo sapiens
ugcugguguuuaggaauaagaa

SEQ ID NO: 293316 - RNA, 19 nt, Homo sapiens
ugcuuaguuuuauguguaa

SEQ ID NO: 293317 - RNA, 22 nt, Homo sapiens
uggaaaguccaagccaaccggg

SEQ ID NO: 293318 - RNA, 22 nt, Homo sapiens
uggaagacaaguguuagcaugg

SEQ ID NO: 293319 - RNA, 22 nt, Homo sapiens
uggaagacauugggugaagggu

SEQ ID NO: 293320 - RNA, 22 nt, Homo sapiens
uggaagauggaguuuuaucauu

SEQ ID NO: 293321 - RNA, 20 nt, Homo sapiens
uggaagccuggugcuaucuu

SEQ ID NO: 293322 - RNA, 22 nt, Homo sapiens
uggaaguaaccaugaauggaau

SEQ ID NO: 293323 - RNA, 22 nt, Homo sapiens
uggaaguagauagauuguguca

SEQ ID NO: 293324 - RNA, 22 nt, Homo sapiens
uggaaguauagauaauugaaag

SEQ ID NO: 293325 - RNA, 22 nt, Homo sapiens
uggaagugaacaaccaaggcag

SEQ ID NO: 293326 - RNA, 22 nt, Homo sapiens
uggaagugucugugcccagcuc

SEQ ID NO: 293327 - RNA, 22 nt, Homo sapiens
uggaaguuaaaugacucuuucu

SEQ ID NO: 293328 - RNA, 22 nt, Homo sapiens
uggaaguuaaauuaguugauga

SEQ ID NO: 293329 - RNA, 22 nt, Homo sapiens
uggaauaugagacgggguuguc

SEQ ID NO: 293330 - RNA, 22 nt, Homo sapiens
uggaaucaucaacgaaugaaau

SEQ ID NO: 293331 - RNA, 22 nt, Homo sapiens
uggaaucuacuaaagcaaaauc

SEQ ID NO: 293332 - RNA, 19 nt, Homo sapiens
uggaaugaaauguuagggg

SEQ ID NO: 293333 - RNA, 21 nt, Homo sapiens
uggaaugaauggccaacaugg

SEQ ID NO: 293334 - RNA, 20 nt, Homo sapiens
uggaaugcagccuccuucug

SEQ ID NO: 293335 - RNA, 19 nt, Homo sapiens
uggaauggauuuaaaugug

SEQ ID NO: 293336 - RNA, 22 nt, Homo sapiens
uggaaugggauuggaaauuuug

SEQ ID NO: 293337 - RNA, 22 nt, Homo sapiens
uggaaugguuggugugauuuua

SEQ ID NO: 293338 - RNA, 22 nt, Homo sapiens
uggaaugucagcuacaagaggg

SEQ ID NO: 293339 - RNA, 22 nt, Homo sapiens
uggacagagagaccggcauuuu

SEQ ID NO: 293340 - RNA, 22 nt, Homo sapiens
uggacaugaagggcacaggagg

SEQ ID NO: 293341 - RNA, 22 nt, Homo sapiens
uggaccccugcucgggagcccu

SEQ ID NO: 293342 - RNA, 22 nt, Homo sapiens
uggaccccuucuccuauuaaaa

SEQ ID NO: 293343 - RNA, 21 nt, Homo sapiens
uggaccccuuucuuacaccgu

SEQ ID NO: 293344 - RNA, 22 nt, Homo sapiens
uggacugagauuucagcugcca

SEQ ID NO: 293345 - RNA, 22 nt, Homo sapiens
uggacuguaauagagaacagaa

SEQ ID NO: 293346 - RNA, 19 nt, Homo sapiens
uggagauauccccuucaca

SEQ ID NO: 293347 - RNA, 22 nt, Homo sapiens
uggagguagacauugggaagag

SEQ ID NO: 293348 - RNA, 22 nt, Homo sapiens
uggagguaggacgaagaacucu

SEQ ID NO: 293349 - RNA, 16 nt, Homo sapiens
uggagucauccuugac

SEQ ID NO: 293350 - RNA, 22 nt, Homo sapiens
uauagcaguguaagaaucgagu

SEQ ID NO: 293351 - RNA, 22 nt, Homo sapiens
uauagcuugaaggaauggucau

SEQ ID NO: 293352 - RNA, 22 nt, Homo sapiens
uauaguuuuuccugggaggaaa

SEQ ID NO: 293353 - RNA, 22 nt, Homo sapiens
uauaucuguccauggcccugcu

SEQ ID NO: 293354 - RNA, 22 nt, Homo sapiens
uauauguucuugcacuggaaag

SEQ ID NO: 293355 - RNA, 22 nt, Homo sapiens
uauauguuuucauaaggcuaga

SEQ ID NO: 293356 - RNA, 22 nt, Homo sapiens
uaucaagauggauaaggauaga

SEQ ID NO: 293357 - RNA, 19 nt, Homo sapiens
uaucaaguaugcacuguac

SEQ ID NO: 293358 - RNA, 22 nt, Homo sapiens
uaucacaaacuuagcaguuuaa

SEQ ID NO: 293359 - RNA, 20 nt, Homo sapiens
uaucacaggucagaaacccu

SEQ ID NO: 293360 - RNA, 22 nt, Homo sapiens
uaucacaggucaggaaccuugu

SEQ ID NO: 293361 - RNA, 22 nt, Homo sapiens
uaucacaguaaaucugggugca

SEQ ID NO: 293362 - RNA, 20 nt, Homo sapiens
uaucacaguucaggaacucu

SEQ ID NO: 293363 - RNA, 22 nt, Homo sapiens
auguccauggaaucuguagcaa

SEQ ID NO: 293364 - RNA, 22 nt, Homo sapiens
auguccuggacccagacaaagc

SEQ ID NO: 293365 - RNA, 22 nt, Homo sapiens
augucuagagcaagagaugcug

SEQ ID NO: 293366 - RNA, 22 nt, Homo sapiens
augucuggcagaagacuucuca

SEQ ID NO: 293367 - RNA, 22 nt, Homo sapiens
augugacugauggagaauaugu

SEQ ID NO: 293368 - RNA, 22 nt, Homo sapiens
augugacugauguaaucagaca

SEQ ID NO: 293369 - RNA, 22 nt, Homo sapiens
augugacuggaucauggggacg

SEQ ID NO: 293370 - RNA, 21 nt, Homo sapiens
augugcacuaugucauuuaau

SEQ ID NO: 293371 - RNA, 20 nt, Homo sapiens
augugcaguguggcaaccaa

SEQ ID NO: 293372 - RNA, 20 nt, Homo sapiens
augugcuaauauuaauaugu

SEQ ID NO: 293373 - RNA, 22 nt, Homo sapiens
augugcuaguaucaaacgagac

SEQ ID NO: 293374 - RNA, 22 nt, Homo sapiens
augugggaggaauguguuucca

SEQ ID NO: 293375 - RNA, 19 nt, Homo sapiens
augugguuagcaugacugc

SEQ ID NO: 293376 - RNA, 22 nt, Homo sapiens
augugucaaaucuaggccaaag

SEQ ID NO: 293377 - RNA, 23 nt, Homo sapiens
augugugcuuggagagcaggaug

SEQ ID NO: 293378 - RNA, 22 nt, Homo sapiens
auguuagcaucaauauucauca

SEQ ID NO: 293379 - RNA, 20 nt, Homo sapiens
auguucuggaggacagaagc

SEQ ID NO: 293380 - RNA, 22 nt, Homo sapiens
auguuuagagagggugucaaau

SEQ ID NO: 293381 - RNA, 22 nt, Homo sapiens
auguuugguaagaauauuguua

SEQ ID NO: 293382 - RNA, 22 nt, Homo sapiens
auuaaauguuggacguauacau

SEQ ID NO: 293383 - RNA, 22 nt, Homo sapiens
auuaaguuaggauuuugagaua

SEQ ID NO: 293384 - RNA, 22 nt, Homo sapiens
auuacaugucuauccaugaaca

SEQ ID NO: 293385 - RNA, 22 nt, Homo sapiens
auuagguaauauaaucauggca

SEQ ID NO: 293386 - RNA, 22 nt, Homo sapiens
auuagguagugagaugcugcug

SEQ ID NO: 293387 - RNA, 22 nt, Homo sapiens
auuagguuaggcaaacuucugu

SEQ ID NO: 293388 - RNA, 22 nt, Homo sapiens
auuauugacucauagaaaggau

SEQ ID NO: 293389 - RNA, 20 nt, Homo sapiens
auucaaguaugccuugagaa

SEQ ID NO: 293390 - RNA, 22 nt, Homo sapiens
auucacagggggagaaggguau

SEQ ID NO: 293391 - RNA, 22 nt, Homo sapiens
auuccacuuccacuaguuucuc

SEQ ID NO: 293392 - RNA, 22 nt, Homo sapiens
auuccaguuugugagaagcugu

SEQ ID NO: 293393 - RNA, 22 nt, Homo sapiens
auucccuguagaauaaggaugg

SEQ ID NO: 293394 - RNA, 23 nt, Homo sapiens
auugaacacuuucauaugugagg

SEQ ID NO: 293395 - RNA, 22 nt, Homo sapiens
auugacuugauauauagcugau

SEQ ID NO: 293396 - RNA, 22 nt, Homo sapiens
auugagacaaauuuguaugcag

SEQ ID NO: 293397 - RNA, 22 nt, Homo sapiens
auugagcaaggucuccuaguau

SEQ ID NO: 293398 - RNA, 22 nt, Homo sapiens
auugagcaauuccuaugugcuu

SEQ ID NO: 293399 - RNA, 22 nt, Homo sapiens
auugcaaagcguagacucuaaa

SEQ ID NO: 293400 - RNA, 22 nt, Homo sapiens
auugcaauuaguccauagaguu

SEQ ID NO: 293401 - RNA, 21 nt, Homo sapiens
auugcacaauauacccaugua

SEQ ID NO: 293402 - RNA, 22 nt, Homo sapiens
auugcacaucugcacuacagcc

SEQ ID NO: 293403 - RNA, 22 nt, Homo sapiens
auugcacuccagcccugcugac

SEQ ID NO: 293404 - RNA, 23 nt, Homo sapiens
auugcacuccagccuaccugggc

SEQ ID NO: 293405 - RNA, 22 nt, Homo sapiens
auugcacuccagccugagcaaa

SEQ ID NO: 293406 - RNA, 22 nt, Homo sapiens
auugcacuccagccuggcaaua

SEQ ID NO: 293407 - RNA, 22 nt, Homo sapiens
auugcacuccagccugggggac

SEQ ID NO: 293408 - RNA, 22 nt, Homo sapiens
auugcacuccagccugggugag

SEQ ID NO: 293409 - RNA, 22 nt, Homo sapiens
auugcacuccagucucaccagg

SEQ ID NO: 293410 - RNA, 22 nt, Homo sapiens
auugcacucugaucugcacucc

SEQ ID NO: 293411 - RNA, 22 nt, Homo sapiens
auugcagauucgcuuuguguug

SEQ ID NO: 293412 - RNA, 19 nt, Homo sapiens
auugcaguguaaaacuauu

SEQ ID NO: 293413 - RNA, 22 nt, Homo sapiens
auugcauaaacacauuucuuau

SEQ ID NO: 293414 - RNA, 22 nt, Homo sapiens
auugcauuuucagguuggucug

SEQ ID NO: 293415 - RNA, 22 nt, Homo sapiens
auugcccaggcuggagugcagu

SEQ ID NO: 293416 - RNA, 22 nt, Homo sapiens
auugccuagccuggucucaaaa

SEQ ID NO: 293417 - RNA, 22 nt, Homo sapiens
auugcuaacugaaauaagacca

SEQ ID NO: 293418 - RNA, 22 nt, Homo sapiens
auugcugagacauugcuaaucu

SEQ ID NO: 293419 - RNA, 22 nt, Homo sapiens
auugcuuacuaaucaucuucag

SEQ ID NO: 293420 - RNA, 22 nt, Homo sapiens
auuggauagucuuuaucuguug

SEQ ID NO: 293421 - RNA, 22 nt, Homo sapiens
auuggcaauagcuuucuuacua

SEQ ID NO: 293422 - RNA, 22 nt, Homo sapiens
auuggucuugaaaccagagaga

SEQ ID NO: 293423 - RNA, 22 nt, Homo sapiens
auuguacuccagccuuggggac

SEQ ID NO: 293424 - RNA, 22 nt, Homo sapiens
auuguacugccccccuguugcu

SEQ ID NO: 293425 - RNA, 22 nt, Homo sapiens
auuguaguuugcuauggcaaua

SEQ ID NO: 293426 - RNA, 22 nt, Homo sapiens
auugucacccgggcaguaagca

SEQ ID NO: 293427 - RNA, 22 nt, Homo sapiens
auugucauuuucugagaaguaa

SEQ ID NO: 293428 - RNA, 20 nt, Homo sapiens
auuguccuugauuacacaga

SEQ ID NO: 293429 - RNA, 22 nt, Homo sapiens
auugugauugcugcuaggccua

SEQ ID NO: 293430 - RNA, 22 nt, Homo sapiens
auuguucuuguguccuuuuccu

SEQ ID NO: 293431 - RNA, 22 nt, Homo sapiens
auuuagcaauggagguagugua

SEQ ID NO: 293432 - RNA, 22 nt, Homo sapiens
auuuaugguuaauauaggaagu

SEQ ID NO: 293433 - RNA, 22 nt, Homo sapiens
ucaauugcaucaacaguguaca

SEQ ID NO: 293434 - RNA, 22 nt, Homo sapiens
ucacaaagcuuggccugcuucu

SEQ ID NO: 293435 - RNA, 18 nt, Homo sapiens
ucacaaccacagugcugu

SEQ ID NO: 293436 - RNA, 22 nt, Homo sapiens
ucacaaggcaggaaugaaaggg

SEQ ID NO: 293437 - RNA, 22 nt, Homo sapiens
ucacaagugagaggaauuagau

SEQ ID NO: 293438 - RNA, 22 nt, Homo sapiens
ucacaaguguauagacaugucc

SEQ ID NO: 293439 - RNA, 22 nt, Homo sapiens
ucacaccauucuucuacuucag

SEQ ID NO: 293440 - RNA, 19 nt, Homo sapiens
ucacacuguggcuucuuua

SEQ ID NO: 293441 - RNA, 22 nt, Homo sapiens
ucacacuguuuugauuauuaua

SEQ ID NO: 293442 - RNA, 22 nt, Homo sapiens
caaagucuucucauuaugucuu

SEQ ID NO: 293443 - RNA, 22 nt, Homo sapiens
caaagugcugggaugggccagg

SEQ ID NO: 293444 - RNA, 22 nt, Homo sapiens
caaauacuuucauguugucuug

SEQ ID NO: 293445 - RNA, 22 nt, Homo sapiens
caaauugcuugucuguagugga

SEQ ID NO: 293446 - RNA, 22 nt, Homo sapiens
caacacagugaaacccgucucu

SEQ ID NO: 293447 - RNA, 22 nt, Homo sapiens
caacauccaccuccuggguuca

SEQ ID NO: 293448 - RNA, 22 nt, Homo sapiens
caacugcucacuccuggguuca

SEQ ID NO: 293449 - RNA, 22 nt, Homo sapiens
caacugguuuuauacaguuuag

SEQ ID NO: 293450 - RNA, 22 nt, Homo sapiens
caagugaauaguugcucucaga

SEQ ID NO: 293451 - RNA, 22 nt, Homo sapiens
caagugcuacagagaaaucuuu

SEQ ID NO: 293452 - RNA, 22 nt, Homo sapiens
caagugcucuaggauccugagu

SEQ ID NO: 293453 - RNA, 21 nt, Homo sapiens
caaugacacuguagcugugcu

SEQ ID NO: 293454 - RNA, 22 nt, Homo sapiens
caaugcagcuuuuggagagaaa

SEQ ID NO: 293455 - RNA, 22 nt, Homo sapiens
caaugcauuauucucccacuuc

SEQ ID NO: 293456 - RNA, 22 nt, Homo sapiens
caauggcacgaucucgucucac

SEQ ID NO: 293457 - RNA, 22 nt, Homo sapiens
cacagcuaacaacuguuucuuc

SEQ ID NO: 293458 - RNA, 22 nt, Homo sapiens
cacagugaacugguggguuuuu

SEQ ID NO: 293459 - RNA, 22 nt, Homo sapiens
cacauugcaggaaaguucauua

SEQ ID NO: 293460 - RNA, 22 nt, Homo sapiens
caccagcuggcauugaauaccu

SEQ ID NO: 293461 - RNA, 22 nt, Homo sapiens
cacccagucaucuuggguuuuu

SEQ ID NO: 293462 - RNA, 22 nt, Homo sapiens
caccccuaccugagucaggagu

SEQ ID NO: 293463 - RNA, 22 nt, Homo sapiens
cacccuugcagggacagcuuug

SEQ ID NO: 293464 - RNA, 22 nt, Homo sapiens
cacucaguuugugguacuuugu

SEQ ID NO: 293465 - RNA, 22 nt, Homo sapiens
cacugcacuccagccuaagagg

SEQ ID NO: 293466 - RNA, 22 nt, Homo sapiens
cacugcacuccagcuuugguga

SEQ ID NO: 293467 - RNA, 22 nt, Homo sapiens
cacugcacuccagucuggcgac

SEQ ID NO: 293468 - RNA, 22 nt, Homo sapiens
cacugcacuccaguuucgguaa

SEQ ID NO: 293469 - RNA, 21 nt, Homo sapiens
cacugcacuugccuucugggu

SEQ ID NO: 293470 - RNA, 22 nt, Homo sapiens
cacugcaguggaagauuaagaa

SEQ ID NO: 293471 - RNA, 22 nt, Homo sapiens
cacugcaguguaauuaagguug

SEQ ID NO: 293472 - RNA, 22 nt, Homo sapiens
cacugcauggucuagcuggguu

SEQ ID NO: 293473 - RNA, 22 nt, Homo sapiens
cacugcauucuccaccucccag

SEQ ID NO: 293474 - RNA, 22 nt, Homo sapiens
cacugcauuggaugguuccucc

SEQ ID NO: 293475 - RNA, 22 nt, Homo sapiens
cacuggacauguugaagcuuuu

SEQ ID NO: 293476 - RNA, 22 nt, Homo sapiens
cacuggcacuguguuuagaugg

SEQ ID NO: 293477 - RNA, 22 nt, Homo sapiens
cacuggguuagaacaugcuccu

SEQ ID NO: 293478 - RNA, 22 nt, Homo sapiens
cacuggucagugaaacaguauu

SEQ ID NO: 293479 - RNA, 16 nt, Homo sapiens
cacuggucuuaccaug

SEQ ID NO: 293480 - RNA, 22 nt, Homo sapiens
cacuuugguucaccugaguuuc

SEQ ID NO: 293481 - RNA, 22 nt, Homo sapiens
cagagaacugaguuauuuucuu

SEQ ID NO: 293482 - RNA, 20 nt, Homo sapiens
cagagcaaagcaguccuggc

SEQ ID NO: 293483 - RNA, 22 nt, Homo sapiens
cagagcaaugcuuuugcuuuga

SEQ ID NO: 293484 - RNA, 22 nt, Homo sapiens
cagagguauugcaaaagccuag

SEQ ID NO: 293485 - RNA, 22 nt, Homo sapiens
cagagucaagcucuuguuccau

SEQ ID NO: 293486 - RNA, 22 nt, Homo sapiens
cagagugcauguuuagaugagu

SEQ ID NO: 293487 - RNA, 22 nt, Homo sapiens
cagaucaucuugagcuuaggaa

SEQ ID NO: 293488 - RNA, 22 nt, Homo sapiens
cagauggucuuaaggcagccuu

SEQ ID NO: 293489 - RNA, 22 nt, Homo sapiens
cagauguaguauuuuagugaaa

SEQ ID NO: 293490 - RNA, 22 nt, Homo sapiens
cagcaucauucaucugggguaa

SEQ ID NO: 293491 - RNA, 22 nt, Homo sapiens
cagccgggugagguggcuuguu

SEQ ID NO: 293492 - RNA, 22 nt, Homo sapiens
cagcgaggucugcgucacauug

SEQ ID NO: 293493 - RNA, 22 nt, Homo sapiens
cagcugguggcaagaagacaga

SEQ ID NO: 293494 - RNA, 22 nt, Homo sapiens
cagcuguguuauaaacuaccau

SEQ ID NO: 293495 - RNA, 22 nt, Homo sapiens
cagcuguuguugggguauagga

SEQ ID NO: 293496 - RNA, 22 nt, Homo sapiens
caggcagucuggggguguaucc

SEQ ID NO: 293497 - RNA, 22 nt, Homo sapiens
caggcagugggagacaaaacug

SEQ ID NO: 293498 - RNA, 20 nt, Homo sapiens
cagggcaaugaggagguaaa

SEQ ID NO: 293499 - RNA, 22 nt, Homo sapiens
cagggcauuggcugguaccugg

SEQ ID NO: 293500 - RNA, 22 nt, Homo sapiens
cagguaguguguagcacagcag

SEQ ID NO: 293501 - RNA, 22 nt, Homo sapiens
caguaaauaucugagcgagguc

SEQ ID NO: 293502 - RNA, 22 nt, Homo sapiens
caguagcaugccucagaaugag

SEQ ID NO: 293503 - RNA, 22 nt, Homo sapiens
cagugcauccauguucagcagu

SEQ ID NO: 293504 - RNA, 22 nt, Homo sapiens
cagugcuuguuauuguucuauu

SEQ ID NO: 293505 - RNA, 22 nt, Homo sapiens
caguggauuggauggauaaugc

SEQ ID NO: 293506 - RNA, 22 nt, Homo sapiens
cagugguuuuuagcuugcuggg

SEQ ID NO: 293507 - RNA, 22 nt, Homo sapiens
caguguaugcuucuauuuuugg

SEQ ID NO: 293508 - RNA, 22 nt, Homo sapiens
cagugucugcauuuggaacuca

SEQ ID NO: 293509 - RNA, 22 nt, Homo sapiens
caguuacuugacacaaccaauu

SEQ ID NO: 293510 - RNA, 22 nt, Homo sapiens
caguucaugguaggcaccauag

SEQ ID NO: 293511 - RNA, 21 nt, Homo sapiens
cauaaugcuacuuauuuuaug

SEQ ID NO: 293512 - RNA, 22 nt, Homo sapiens
cauacaugugcuugucuuaugc

SEQ ID NO: 293513 - RNA, 21 nt, Homo sapiens
caucaaauugucauggugggu

SEQ ID NO: 293514 - RNA, 22 nt, Homo sapiens
caucacuguugguacaaguaau

SEQ ID NO: 293515 - RNA, 22 nt, Homo sapiens
caucagcaauguaugaggguuc

SEQ ID NO: 293516 - RNA, 22 nt, Homo sapiens
caucauugcacccuauagagaa

SEQ ID NO: 293517 - RNA, 22 nt, Homo sapiens
caucccauucgaggggcacagc

SEQ ID NO: 293518 - RNA, 21 nt, Homo sapiens
cauccccugccauuguggucu

SEQ ID NO: 293519 - RNA, 19 nt, Homo sapiens
caucccugagcugaagugg

SEQ ID NO: 293520 - RNA, 23 nt, Homo sapiens
caugaacuaguuugcagccauga

SEQ ID NO: 293521 - RNA, 22 nt, Homo sapiens
caugcacugaguccaccucugg

SEQ ID NO: 293522 - RNA, 22 nt, Homo sapiens
caugcagcacacaugucugugc

SEQ ID NO: 293523 - RNA, 22 nt, Homo sapiens
caugcauuggucuauuauguga

SEQ ID NO: 293524 - RNA, 22 nt, Homo sapiens
ugagaucaguuguuauaauucu

SEQ ID NO: 293525 - RNA, 19 nt, Homo sapiens
ugagauccacugaagauuc

SEQ ID NO: 293526 - RNA, 22 nt, Homo sapiens
ugagaucuguaaagucugacau

SEQ ID NO: 293527 - RNA, 22 nt, Homo sapiens
ugagaucuuaccuuccugccuu

SEQ ID NO: 293528 - RNA, 22 nt, Homo sapiens
ugagaucuucgcucuucacaga

SEQ ID NO: 293529 - RNA, 22 nt, Homo sapiens
ugagaucuuggaggcuuuguga

SEQ ID NO: 293530 - RNA, 22 nt, Homo sapiens
ugagaugaagugauguaaaaca

SEQ ID NO: 293531 - RNA, 22 nt, Homo sapiens
ugagaugaggucucacucuguu

SEQ ID NO: 293532 - RNA, 22 nt, Homo sapiens
ugagaugaguugcgcucugucg

SEQ ID NO: 293533 - RNA, 22 nt, Homo sapiens
ugagaugaugggauaagagggc

SEQ ID NO: 293534 - RNA, 21 nt, Homo sapiens
ugagaugcaaucaccagggag

SEQ ID NO: 293535 - RNA, 22 nt, Homo sapiens
ugagaugcauauucuggcuccu

SEQ ID NO: 293536 - RNA, 22 nt, Homo sapiens
ugagauggaguuucacuuuugu

SEQ ID NO: 293537 - RNA, 22 nt, Homo sapiens
ugagauggaguuucgcccuugu

SEQ ID NO: 293538 - RNA, 22 nt, Homo sapiens
ugagauggaguuucgcuuuugu

SEQ ID NO: 293539 - RNA, 22 nt, Homo sapiens
ugagauggaucuuggauuugaa

SEQ ID NO: 293540 - RNA, 22 nt, Homo sapiens
ugagauggcugaauucagaaua

SEQ ID NO: 293541 - RNA, 22 nt, Homo sapiens
ugagauggguaauuaaauggug

SEQ ID NO: 293542 - RNA, 22 nt, Homo sapiens
ugagaugguaaauuuuuguugu

SEQ ID NO: 293543 - RNA, 22 nt, Homo sapiens
ugagaugugaagaucacaugaa

SEQ ID NO: 293544 - RNA, 21 nt, Homo sapiens
ugagaugugaccagggcauca

SEQ ID NO: 293545 - RNA, 22 nt, Homo sapiens
ugagauguguccagaucuaguu

SEQ ID NO: 293546 - RNA, 21 nt, Homo sapiens
ugagauuaaguuguuuagaag

SEQ ID NO: 293547 - RNA, 22 nt, Homo sapiens
ugagauuacguucggcccacuu

SEQ ID NO: 293548 - RNA, 21 nt, Homo sapiens
ugagauuauauuaacauggua

SEQ ID NO: 293549 - RNA, 22 nt, Homo sapiens
ugagauuaucuugaucuugaaa

SEQ ID NO: 293550 - RNA, 20 nt, Homo sapiens
ugagauuggugugguauaag

SEQ ID NO: 293551 - RNA, 22 nt, Homo sapiens
ugagauuguuagaucaaauggu

SEQ ID NO: 293552 - RNA, 22 nt, Homo sapiens
ugagcaaaauuuuggacauaga

SEQ ID NO: 293553 - RNA, 22 nt, Homo sapiens
ugagcacuguacuuuaucaggu

SEQ ID NO: 293554 - RNA, 22 nt, Homo sapiens
ugagcagagaagugcccugcgc

SEQ ID NO: 293555 - RNA, 22 nt, Homo sapiens
ugagcauauugugauaccuaaa

SEQ ID NO: 293556 - RNA, 22 nt, Homo sapiens
ugagccauggcaccuugucuaa

SEQ ID NO: 293557 - RNA, 22 nt, Homo sapiens
ugagcuagggccuggaauaggg

SEQ ID NO: 293558 - RNA, 20 nt, Homo sapiens
ugagcucaauuguugcaagu

SEQ ID NO: 293559 - RNA, 22 nt, Homo sapiens
ugagcucagcuuucuuuuucac

SEQ ID NO: 293560 - RNA, 22 nt, Homo sapiens
ugaggagugaacuauuucugau

SEQ ID NO: 293561 - RNA, 22 nt, Homo sapiens
ugaggcaagauacugauuucau

SEQ ID NO: 293562 - RNA, 22 nt, Homo sapiens
ugaggcaaggcugaaugaaggc

SEQ ID NO: 293563 - RNA, 22 nt, Homo sapiens
ugagguaacaaacuaugaguua

SEQ ID NO: 293564 - RNA, 22 nt, Homo sapiens
ugagguaauagauaauauuuuu

SEQ ID NO: 293565 - RNA, 20 nt, Homo sapiens
ugaggucaggaguuacagac

SEQ ID NO: 293566 - RNA, 22 nt, Homo sapiens
ugaggucauguucugucagguu

SEQ ID NO: 293567 - RNA, 22 nt, Homo sapiens
ugagguguauugggggaaauuc

SEQ ID NO: 293568 - RNA, 22 nt, Homo sapiens
ugagguguuauccagaguucuu

SEQ ID NO: 293569 - RNA, 22 nt, Homo sapiens
ugagguguuugugcaccaucug

SEQ ID NO: 293570 - RNA, 22 nt, Homo sapiens
ugaguagaacuagucuagagcu

SEQ ID NO: 293571 - RNA, 22 nt, Homo sapiens
ugaguagucuagaguggaaugu

SEQ ID NO: 293572 - RNA, 22 nt, Homo sapiens
ugaguagugcugcaauaaacau

SEQ ID NO: 293573 - RNA, 22 nt, Homo sapiens
ugaguauguuuaaugugacaau

SEQ ID NO: 293574 - RNA, 23 nt, Homo sapiens
ugagucacuuugcuggggucucu

SEQ ID NO: 293575 - RNA, 22 nt, Homo sapiens
ugagugaggcugggcagucccu

SEQ ID NO: 293576 - RNA, 22 nt, Homo sapiens
ugaguguccaccccuuucacag

SEQ ID NO: 293577 - RNA, 22 nt, Homo sapiens
ugaguguguaugugcauacaca

SEQ ID NO: 293578 - RNA, 22 nt, Homo sapiens
ugaguuagguguuuuaaauaua

SEQ ID NO: 293579 - RNA, 22 nt, Homo sapiens
ugauaacauugggggaagcuga

SEQ ID NO: 293580 - RNA, 22 nt, Homo sapiens
ugauaacugaucuggauuugua

SEQ ID NO: 293581 - RNA, 22 nt, Homo sapiens
ugauaauuuugucagguuuugg

SEQ ID NO: 293582 - RNA, 22 nt, Homo sapiens
ugauagucuuugcuggugaccu

SEQ ID NO: 293583 - RNA, 22 nt, Homo sapiens
ugauagugccuuuuauaucucu

SEQ ID NO: 293584 - RNA, 22 nt, Homo sapiens
ugauaugucccucgacaucagg

SEQ ID NO: 293585 - RNA, 22 nt, Homo sapiens
ugauauguuagaaucuugcaag

SEQ ID NO: 293586 - RNA, 20 nt, Homo sapiens
ugauauuucuggaaguggag

SEQ ID NO: 293587 - RNA, 22 nt, Homo sapiens
ugauauuuuugauccuuaaguu

SEQ ID NO: 293588 - RNA, 22 nt, Homo sapiens
ugaucaaagugcuggaauuaca

SEQ ID NO: 293589 - RNA, 22 nt, Homo sapiens
ugaucacagcuugacuaaagga

SEQ ID NO: 293590 - RNA, 22 nt, Homo sapiens
ugaugacccugcaguucucaag

SEQ ID NO: 293591 - RNA, 21 nt, Homo sapiens
ugaugcuuuucuuaaccuugc

SEQ ID NO: 293592 - RNA, 22 nt, Homo sapiens
ugauggccuguucuccauaugu

SEQ ID NO: 293593 - RNA, 22 nt, Homo sapiens
ugaugguuuuauuaauaggacc

SEQ ID NO: 293594 - RNA, 22 nt, Homo sapiens
ugauugacauacauaggugugg

SEQ ID NO: 293595 - RNA, 19 nt, Homo sapiens
ugcaaagucagugaagggu

SEQ ID NO: 293596 - RNA, 22 nt, Homo sapiens
ugcaaagucgaaacugcaguuu

SEQ ID NO: 293597 - RNA, 22 nt, Homo sapiens
ugcaaauguuaguaacaccacu

SEQ ID NO: 293598 - RNA, 22 nt, Homo sapiens
ugcaaccauuguuaagugugca

SEQ ID NO: 293599 - RNA, 21 nt, Homo sapiens
ugcaagaaucaggaagcugcc

SEQ ID NO: 293600 - RNA, 22 nt, Homo sapiens
ugcaagaggagacuguacucag

SEQ ID NO: 293601 - RNA, 22 nt, Homo sapiens
ugcacaaccucacccccgcucu

SEQ ID NO: 293602 - RNA, 22 nt, Homo sapiens
ugcacacucuguaugagaaucu

SEQ ID NO: 293603 - RNA, 23 nt, Homo sapiens
ugcaccacuacacacucuugggu

SEQ ID NO: 293604 - RNA, 22 nt, Homo sapiens
ugcaccacuacacuccaggcug

SEQ ID NO: 293605 - RNA, 22 nt, Homo sapiens
ugcaccacugcacugccugggu

SEQ ID NO: 293606 - RNA, 22 nt, Homo sapiens
ucacaggguguuauuagaauua

SEQ ID NO: 293607 - RNA, 18 nt, Homo sapiens
ucacagguaauuaggauu

SEQ ID NO: 293608 - RNA, 22 nt, Homo sapiens
ucacaguaaauccagaagaaau

SEQ ID NO: 293609 - RNA, 22 nt, Homo sapiens
ucacagugcaggaucaguuaau

SEQ ID NO: 293610 - RNA, 23 nt, Homo sapiens
ucacaguuacuuuugcaucaacc

SEQ ID NO: 293611 - RNA, 22 nt, Homo sapiens
ucacauagcugaguaaaaugga

SEQ ID NO: 293612 - RNA, 22 nt, Homo sapiens
ucacaugaauugucuuguucca

SEQ ID NO: 293613 - RNA, 22 nt, Homo sapiens
ucacauguguaugagcuuugau

SEQ ID NO: 293614 - RNA, 22 nt, Homo sapiens
ucacauuguuauguaaauguuu

SEQ ID NO: 293615 - RNA, 22 nt, Homo sapiens
ucaccaccuuccaggaccacug

SEQ ID NO: 293616 - RNA, 22 nt, Homo sapiens
ucaccaguaauaaagagccugc

SEQ ID NO: 293617 - RNA, 22 nt, Homo sapiens
ucaccaguggcacuccagccug

SEQ ID NO: 293618 - RNA, 22 nt, Homo sapiens
ucacccugacaugcggccgaac

SEQ ID NO: 293619 - RNA, 22 nt, Homo sapiens
ucacccuguguuuugcguuugc

SEQ ID NO: 293620 - RNA, 22 nt, Homo sapiens
ucaccgugaauuaacaacacuu

SEQ ID NO: 293621 - RNA, 18 nt, Homo sapiens
ucaccuugaugcuggguc

SEQ ID NO: 293622 - RNA, 19 nt, Homo sapiens
ucaccuugcccugcacaca

SEQ ID NO: 293623 - RNA, 22 nt, Homo sapiens
ucacgcugcugcaaccagccug

SEQ ID NO: 293624 - RNA, 23 nt, Homo sapiens
ucacggagaccugcaagaccaau

SEQ ID NO: 293625 - RNA, 22 nt, Homo sapiens
ucacgugcucuuguguguucug

SEQ ID NO: 293626 - RNA, 22 nt, Homo sapiens
ucacugaaacuguccuggguua

SEQ ID NO: 293627 - RNA, 22 nt, Homo sapiens
ucacuggacagaaauaaaggug

SEQ ID NO: 293628 - RNA, 20 nt, Homo sapiens
ucacuggagcucauuugauu

SEQ ID NO: 293629 - RNA, 22 nt, Homo sapiens
ucacuggagguuccugaaguuc

SEQ ID NO: 293630 - RNA, 22 nt, Homo sapiens
ucacuggcaaauauauccguug

SEQ ID NO: 293631 - RNA, 22 nt, Homo sapiens
ucacuggucuaaguggaggggg

SEQ ID NO: 293632 - RNA, 22 nt, Homo sapiens
ucacugugcacauaugauaggu

SEQ ID NO: 293633 - RNA, 22 nt, Homo sapiens
ucacugugcaugaaggaugcug

SEQ ID NO: 293634 - RNA, 22 nt, Homo sapiens
ucacugugguuuugaugugcau

SEQ ID NO: 293635 - RNA, 18 nt, Homo sapiens
ucacugugugucuugggu

SEQ ID NO: 293636 - RNA, 22 nt, Homo sapiens
ucacuuugacggccaacuucua

SEQ ID NO: 293637 - RNA, 22 nt, Homo sapiens
ucacuuuguauagcgacuggcu

SEQ ID NO: 293638 - RNA, 22 nt, Homo sapiens
ucacuuuguuuuuggauaaguu

SEQ ID NO: 293639 - RNA, 22 nt, Homo sapiens
ucagacacuguggccuuuggac

SEQ ID NO: 293640 - RNA, 22 nt, Homo sapiens
ucagagcaaagacacuuuauca

SEQ ID NO: 293641 - RNA, 22 nt, Homo sapiens
ucagagugcagggaguagcagc

SEQ ID NO: 293642 - RNA, 22 nt, Homo sapiens
ucagaguggagucugcagccuu

SEQ ID NO: 293643 - RNA, 22 nt, Homo sapiens
ucagauacuggugacaugaaug

SEQ ID NO: 293644 - RNA, 22 nt, Homo sapiens
ucagauugaugcauacuuaaau

SEQ ID NO: 293645 - RNA, 22 nt, Homo sapiens
ucagcaguggacagaaugguag

SEQ ID NO: 293646 - RNA, 22 nt, Homo sapiens
ucagcagugugaaaauggacua

SEQ ID NO: 293647 - RNA, 22 nt, Homo sapiens
ucaggcacucagcuuagagucu

SEQ ID NO: 293648 - RNA, 22 nt, Homo sapiens
ucaggcuuuucccagagugaug

SEQ ID NO: 293649 - RNA, 21 nt, Homo sapiens
ucaggcuuuuugagugccaau

SEQ ID NO: 293650 - RNA, 22 nt, Homo sapiens
ucagggacuuacaaaccagaag

SEQ ID NO: 293651 - RNA, 22 nt, Homo sapiens
ucagguagugccaugauugauu

SEQ ID NO: 293652 - RNA, 23 nt, Homo sapiens
ucagguaguuucagaggaccuug

SEQ ID NO: 293653 - RNA, 22 nt, Homo sapiens
ucaguaaaugcuguucucuuuu

SEQ ID NO: 293654 - RNA, 22 nt, Homo sapiens
ucagucauugauggaguagguc

SEQ ID NO: 293655 - RNA, 22 nt, Homo sapiens
ucagucuuuuaccauuaaguau

SEQ ID NO: 293656 - RNA, 22 nt, Homo sapiens
ucagucuuuuuuuggcaagcau

SEQ ID NO: 293657 - RNA, 22 nt, Homo sapiens
ucagugaauguuggccacuacu

SEQ ID NO: 293658 - RNA, 22 nt, Homo sapiens
ucagugacugcugcuuguauac

SEQ ID NO: 293659 - RNA, 22 nt, Homo sapiens
ucagugacuggguauuaaauca

SEQ ID NO: 293660 - RNA, 21 nt, Homo sapiens
ucagugcaauucuauggggaa

SEQ ID NO: 293661 - RNA, 22 nt, Homo sapiens
ucagugcgugcauagccuggau

SEQ ID NO: 293662 - RNA, 22 nt, Homo sapiens
ucagugcuguaccaucuaagga

SEQ ID NO: 293663 - RNA, 22 nt, Homo sapiens
ucauacgucuccuugugccacc

SEQ ID NO: 293664 - RNA, 18 nt, Homo sapiens
ucauagaucaugacagug

SEQ ID NO: 293665 - RNA, 22 nt, Homo sapiens
ucauagucuaagguucuuuugc

SEQ ID NO: 293666 - RNA, 22 nt, Homo sapiens
ucauaucauuagaucuacugua

SEQ ID NO: 293667 - RNA, 23 nt, Homo sapiens
ucaucacagcauuuccugguauu

SEQ ID NO: 293668 - RNA, 21 nt, Homo sapiens
ucaucagucaaagacaauggu

SEQ ID NO: 293669 - RNA, 22 nt, Homo sapiens
ucaucaguuuuuuauaugugau

SEQ ID NO: 293670 - RNA, 22 nt, Homo sapiens
ucaucucaguuucuugccguac

SEQ ID NO: 293671 - RNA, 22 nt, Homo sapiens
ucaugcaaugcaaggggaaauu

SEQ ID NO: 293672 - RNA, 22 nt, Homo sapiens
ucauggcauuguuaaggguuuu

SEQ ID NO: 293673 - RNA, 22 nt, Homo sapiens
ucaugggagcccccaucaugag

SEQ ID NO: 293674 - RNA, 22 nt, Homo sapiens
ucauggguuuugguccaagcaa

SEQ ID NO: 293675 - RNA, 22 nt, Homo sapiens
ucauguacuuguagucccggcu

SEQ ID NO: 293676 - RNA, 23 nt, Homo sapiens
ucauguauucccuguaaugggua

SEQ ID NO: 293677 - RNA, 22 nt, Homo sapiens
ucaugugagcacagagcaagau

SEQ ID NO: 293678 - RNA, 22 nt, Homo sapiens
ucauguguugcacugaggaccu

SEQ ID NO: 293679 - RNA, 22 nt, Homo sapiens
ucauuagucaccuagccagcuu

SEQ ID NO: 293680 - RNA, 22 nt, Homo sapiens
ucauucauucauccagcuugag

SEQ ID NO: 293681 - RNA, 22 nt, Homo sapiens
ucauucauucuucaguggguac

SEQ ID NO: 293682 - RNA, 22 nt, Homo sapiens
uccacaauggagaagaguauga

SEQ ID NO: 293683 - RNA, 22 nt, Homo sapiens
uccacaauggcugaacuagauu

SEQ ID NO: 293684 - RNA, 22 nt, Homo sapiens
uccacaguggugaggugcagca

SEQ ID NO: 293685 - RNA, 22 nt, Homo sapiens
uccacagugguggaauuguuca

SEQ ID NO: 293686 - RNA, 22 nt, Homo sapiens
uccaccgugggcugcggggcuc

SEQ ID NO: 293687 - RNA, 18 nt, Homo sapiens
uccacgugcuuuccagau

SEQ ID NO: 293688 - RNA, 22 nt, Homo sapiens
uugugcauaucagagguuugcu

SEQ ID NO: 293689 - RNA, 22 nt, Homo sapiens
uugugcuuaaugaguguaaggu

SEQ ID NO: 293690 - RNA, 22 nt, Homo sapiens
uugugcuugauuugccuagcug

SEQ ID NO: 293691 - RNA, 18 nt, Homo sapiens
uuguggccccuacaaauu

SEQ ID NO: 293692 - RNA, 16 nt, Homo sapiens
uuguggcuuuugcaca

SEQ ID NO: 293693 - RNA, 22 nt, Homo sapiens
uugugucccuacccaaaucuca

SEQ ID NO: 293694 - RNA, 22 nt, Homo sapiens
uuguuauguaucucaagauaaa

SEQ ID NO: 293695 - RNA, 22 nt, Homo sapiens
uuguuuuggagaugagcuaaaa

SEQ ID NO: 293696 - RNA, 22 nt, Homo sapiens
uuuaaagcaugacgagaagaag

SEQ ID NO: 293697 - RNA, 22 nt, Homo sapiens
uuuaaagcuaaaauauguuuau

SEQ ID NO: 293698 - RNA, 22 nt, Homo sapiens
uuuaacauuggaugagaucguc

SEQ ID NO: 293699 - RNA, 22 nt, Homo sapiens
uuuaaggcacuucaugguuuca

SEQ ID NO: 293700 - RNA, 22 nt, Homo sapiens
uuuaauacugcaucuuuacucu

SEQ ID NO: 293701 - RNA, 22 nt, Homo sapiens
uuuaauagcagggacuuccggg

SEQ ID NO: 293702 - RNA, 22 nt, Homo sapiens
uuuagcaaugcuguggggaagu

SEQ ID NO: 293703 - RNA, 22 nt, Homo sapiens
uuuagcacugugauugacaaaa

SEQ ID NO: 293704 - RNA, 22 nt, Homo sapiens
uuuagcucauucaauuucaguc

SEQ ID NO: 293705 - RNA, 22 nt, Homo sapiens
uuuauugcucuaaaguugccau

SEQ ID NO: 293706 - RNA, 22 nt, Homo sapiens
uuucacagagggcuucuuucua

SEQ ID NO: 293707 - RNA, 23 nt, Homo sapiens
uuucacaguagcuggaucagccu

SEQ ID NO: 293708 - RNA, 22 nt, Homo sapiens
uuucaccguguuggccaggcug

SEQ ID NO: 293709 - RNA, 22 nt, Homo sapiens
uuucagguauuuaagggccguu

SEQ ID NO: 293710 - RNA, 22 nt, Homo sapiens
uuucaguagagacacgguuuug

SEQ ID NO: 293711 - RNA, 22 nt, Homo sapiens
uuucaguguggcaggcauagcu

SEQ ID NO: 293712 - RNA, 22 nt, Homo sapiens
uuucauagccuucuaaugaguu

SEQ ID NO: 293713 - RNA, 22 nt, Homo sapiens
uuucauggagaaucuucuuacu

SEQ ID NO: 293714 - RNA, 22 nt, Homo sapiens
uuucauggcgaggcuucauggg

SEQ ID NO: 293715 - RNA, 18 nt, Homo sapiens
uuucauugagugugauau

SEQ ID NO: 293716 - RNA, 22 nt, Homo sapiens
uuuccaagaugcuuacuuucuc

SEQ ID NO: 293717 - RNA, 19 nt, Homo sapiens
uuuccaguaaucuuaugug

SEQ ID NO: 293718 - RNA, 22 nt, Homo sapiens
uuuccaguuggaaagccuguuu

SEQ ID NO: 293719 - RNA, 22 nt, Homo sapiens
uuuccaguuuggaggaugcauu

SEQ ID NO: 293720 - RNA, 22 nt, Homo sapiens
uuucccagugguacaguuuaua

SEQ ID NO: 293721 - RNA, 22 nt, Homo sapiens
uuucccuuacuuaaacuuacuc

SEQ ID NO: 293722 - RNA, 16 nt, Homo sapiens
uuucccuuugguguuu

SEQ ID NO: 293723 - RNA, 21 nt, Homo sapiens
uuuccuggagcguauggcuuc

SEQ ID NO: 293724 - RNA, 22 nt, Homo sapiens
uuuccuguaggaaggaaauaga

SEQ ID NO: 293725 - RNA, 22 nt, Homo sapiens
uuucuacagggcuugccaggua

SEQ ID NO: 293726 - RNA, 22 nt, Homo sapiens
uuucuugguuguauuuagacuu

SEQ ID NO: 293727 - RNA, 22 nt, Homo sapiens
uuugaaguguggcacugaguuu

SEQ ID NO: 293728 - RNA, 20 nt, Homo sapiens
uuugaauguaaagcauguca

SEQ ID NO: 293729 - RNA, 22 nt, Homo sapiens
uuugacaaugugugcuuguauu

SEQ ID NO: 293730 - RNA, 22 nt, Homo sapiens
uaugccuuugaccauuuuguga

SEQ ID NO: 293731 - RNA, 22 nt, Homo sapiens
uaugccuuuuggcucaagaaac

SEQ ID NO: 293732 - RNA, 19 nt, Homo sapiens
uaugcuauuuauuagaagu

SEQ ID NO: 293733 - RNA, 22 nt, Homo sapiens
uaugcuuauuaaaacagugugu

SEQ ID NO: 293734 - RNA, 22 nt, Homo sapiens
uauggcacacguuuaccuaugu

SEQ ID NO: 293735 - RNA, 22 nt, Homo sapiens
uauggcauuguuggugaugaua

SEQ ID NO: 293736 - RNA, 22 nt, Homo sapiens
uauggccccuacaugugcaaaa

SEQ ID NO: 293737 - RNA, 22 nt, Homo sapiens
uauggcuucuauaaggaagcuu

SEQ ID NO: 293738 - RNA, 22 nt, Homo sapiens
uauggcuucuuauucuuucccg

SEQ ID NO: 293739 - RNA, 22 nt, Homo sapiens
uauggcuucuuuaaauugaggu

SEQ ID NO: 293740 - RNA, 22 nt, Homo sapiens
uauggcuuuguucaacagccuc

SEQ ID NO: 293741 - RNA, 22 nt, Homo sapiens
uauggguauuuuauacauaacc

SEQ ID NO: 293742 - RNA, 22 nt, Homo sapiens
uaugguuuuaagguuaaggacu

SEQ ID NO: 293743 - RNA, 22 nt, Homo sapiens
uaugucuucuuuagagaaaugu

SEQ ID NO: 293744 - RNA, 22 nt, Homo sapiens
uauguuaucaaaaagcuaagga

SEQ ID NO: 293745 - RNA, 22 nt, Homo sapiens
uauuacugucaauaucacagaa

SEQ ID NO: 293746 - RNA, 22 nt, Homo sapiens
uauuacuguuauuccuaucaaa

SEQ ID NO: 293747 - RNA, 22 nt, Homo sapiens
uauuacuugucugugucucaau

SEQ ID NO: 293748 - RNA, 22 nt, Homo sapiens
uauuagguuggggcaaaaguaa

SEQ ID NO: 293749 - RNA, 22 nt, Homo sapiens
uauuagugucuuuugguuagaa

SEQ ID NO: 293750 - RNA, 22 nt, Homo sapiens
uauuauagugauaggucuacug

SEQ ID NO: 293751 - RNA, 22 nt, Homo sapiens
uauuauuguccuucuauaccca

SEQ ID NO: 293752 - RNA, 20 nt, Homo sapiens
uauucacucuccagucuugc

SEQ ID NO: 293753 - RNA, 22 nt, Homo sapiens
uauuccacucuguuggagguaa

SEQ ID NO: 293754 - RNA, 22 nt, Homo sapiens
uauugaacgugggauauugaag

SEQ ID NO: 293755 - RNA, 22 nt, Homo sapiens
uauugaauuugagcugucucuu

SEQ ID NO: 293756 - RNA, 22 nt, Homo sapiens
uauugacauuacagugggucuu

SEQ ID NO: 293757 - RNA, 22 nt, Homo sapiens
uauugacuugaugagggagggu

SEQ ID NO: 293758 - RNA, 22 nt, Homo sapiens
uauugcagauacccaggaaguu

SEQ ID NO: 293759 - RNA, 22 nt, Homo sapiens
uauugcagugagauccaucugg

SEQ ID NO: 293760 - RNA, 22 nt, Homo sapiens
uauugcccugcuuuguucuaaa

SEQ ID NO: 293761 - RNA, 22 nt, Homo sapiens
uauugccucuuuuguaaaagug

SEQ ID NO: 293762 - RNA, 22 nt, Homo sapiens
uauugccuugccuacuuuucca

SEQ ID NO: 293763 - RNA, 22 nt, Homo sapiens
uauuguuaaagauguuaaugau

SEQ ID NO: 293764 - RNA, 22 nt, Homo sapiens
uauuguuuuucccaggagucua

SEQ ID NO: 293765 - RNA, 22 nt, Homo sapiens
uauuucaguugcguuucccgag

SEQ ID NO: 293766 - RNA, 22 nt, Homo sapiens
uauuucaguugugcagguaguu

SEQ ID NO: 293767 - RNA, 22 nt, Homo sapiens
uauuugauuaacaagagccuaa

SEQ ID NO: 293768 - RNA, 22 nt, Homo sapiens
uauuugguagcuauuuugcagu

SEQ ID NO: 293769 - RNA, 22 nt, Homo sapiens
uauuugguuauaugaguaaguu

SEQ ID NO: 293770 - RNA, 22 nt, Homo sapiens
uauuuguccccuccaaaaguca

SEQ ID NO: 293771 - RNA, 22 nt, Homo sapiens
ucaaacugucagguugaccaga

SEQ ID NO: 293772 - RNA, 20 nt, Homo sapiens
ucaaaguaugcucugcacua

SEQ ID NO: 293773 - RNA, 22 nt, Homo sapiens
ucaaagucuucucaaguaacau

SEQ ID NO: 293774 - RNA, 22 nt, Homo sapiens
ucaaagugagcuccuucucacu

SEQ ID NO: 293775 - RNA, 22 nt, Homo sapiens
ucaaaugauucagaagccaccu

SEQ ID NO: 293776 - RNA, 22 nt, Homo sapiens
ucaaaugauucuccugccucag

SEQ ID NO: 293777 - RNA, 22 nt, Homo sapiens
ucaaaugcacguagagaaaaua

SEQ ID NO: 293778 - RNA, 20 nt, Homo sapiens
ucaaggcacgaauaaaaguu

SEQ ID NO: 293779 - RNA, 20 nt, Homo sapiens
ucaaggcaggaacuguacau

SEQ ID NO: 293780 - RNA, 22 nt, Homo sapiens
ucaaguagugacucgaguuauu

SEQ ID NO: 293781 - RNA, 18 nt, Homo sapiens
ucaauguggauguucuuu

SEQ ID NO: 293782 - RNA, 22 nt, Homo sapiens
ucaauugcuuaugaagauacau

SEQ ID NO: 293783 - RNA, 22 nt, Homo sapiens
ucacaagcuccugccuuugcuu

SEQ ID NO: 293784 - RNA, 22 nt, Homo sapiens
ucacacucucaccaacauuugg

SEQ ID NO: 293785 - RNA, 22 nt, Homo sapiens
ucacacugucuugguuacucuu

SEQ ID NO: 293786 - RNA, 22 nt, Homo sapiens
ucacagaggagaagaccuuuaa

SEQ ID NO: 293787 - RNA, 21 nt, Homo sapiens
ucacagccuaggaccugaaga

SEQ ID NO: 293788 - RNA, 22 nt, Homo sapiens
ucacaguagcaaauguuagaaa

SEQ ID NO: 293789 - RNA, 22 nt, Homo sapiens
ucacaguauucaugaacaugga

SEQ ID NO: 293790 - RNA, 22 nt, Homo sapiens
ucacagucacugucacguugaa

SEQ ID NO: 293791 - RNA, 22 nt, Homo sapiens
ucacagucggugacuucuugcu

SEQ ID NO: 293792 - RNA, 23 nt, Homo sapiens
ucacaguggcugcuuaauuguga

SEQ ID NO: 293793 - RNA, 22 nt, Homo sapiens
ucacaucucagguuucuugaca

SEQ ID NO: 293794 - RNA, 22 nt, Homo sapiens
ucacaugaagauuuuaguauac

SEQ ID NO: 293795 - RNA, 22 nt, Homo sapiens
ucacaugcacaucucuggaacc

SEQ ID NO: 293796 - RNA, 22 nt, Homo sapiens
ucacauggauuaacucauuuau

SEQ ID NO: 293797 - RNA, 18 nt, Homo sapiens
ucacauggccgagagaga

SEQ ID NO: 293798 - RNA, 22 nt, Homo sapiens
ucacauggggaagggacuagcu

SEQ ID NO: 293799 - RNA, 22 nt, Homo sapiens
ucaccaccugcugaucauagag

SEQ ID NO: 293800 - RNA, 22 nt, Homo sapiens
ucaccaccugcugauuguagag

SEQ ID NO: 293801 - RNA, 16 nt, Homo sapiens
ucaccccuagagaucc

SEQ ID NO: 293802 - RNA, 22 nt, Homo sapiens
ucaccuggagacaugaagacug

SEQ ID NO: 293803 - RNA, 22 nt, Homo sapiens
ucaccuggagagcuugcuaaua

SEQ ID NO: 293804 - RNA, 22 nt, Homo sapiens
ucaccuggagccuucacauucu

SEQ ID NO: 293805 - RNA, 22 nt, Homo sapiens
ucaccuguagcuaagaccuaau

SEQ ID NO: 293806 - RNA, 21 nt, Homo sapiens
ucaccuguagcugcauguucu

SEQ ID NO: 293807 - RNA, 18 nt, Homo sapiens
ucaccuugcuuuuagaac

SEQ ID NO: 293808 - RNA, 22 nt, Homo sapiens
ucacgguggaaucccagauccc

SEQ ID NO: 293809 - RNA, 22 nt, Homo sapiens
ucacuaaagaaaauggcaugga

SEQ ID NO: 293810 - RNA, 22 nt, Homo sapiens
ucacucagaccuggugauaugc

SEQ ID NO: 293811 - RNA, 22 nt, Homo sapiens
ucacugagcacaggagaugugc

SEQ ID NO: 293812 - RNA, 22 nt, Homo sapiens
ucacugaggucugagcuuuaug

SEQ ID NO: 293813 - RNA, 22 nt, Homo sapiens
ucacugcacuucaggcuuucuc

SEQ ID NO: 293814 - RNA, 22 nt, Homo sapiens
ucacugcgaccuccaccuccug

SEQ ID NO: 293815 - RNA, 20 nt, Homo sapiens
aaaggcugugagaacgagau

SEQ ID NO: 293816 - RNA, 22 nt, Homo sapiens
aaagucuagaggaucaugugug

SEQ ID NO: 293817 - RNA, 22 nt, Homo sapiens
aaagugaauguaucccguaagu

SEQ ID NO: 293818 - RNA, 18 nt, Homo sapiens
aaagugaugucauucuuu

SEQ ID NO: 293819 - RNA, 22 nt, Homo sapiens
aaagugcaguauuugggcagga

SEQ ID NO: 293820 - RNA, 22 nt, Homo sapiens
aaagugcugagauuguaggcau

SEQ ID NO: 293821 - RNA, 22 nt, Homo sapiens
aaagugcugagucuaggcgggg

SEQ ID NO: 293822 - RNA, 22 nt, Homo sapiens
aaagugcugggauuaggccagg

SEQ ID NO: 293823 - RNA, 22 nt, Homo sapiens
aaagugcugggauuuuaggcau

SEQ ID NO: 293824 - RNA, 22 nt, Homo sapiens
aaagugcuuccuuuuugagggu

SEQ ID NO: 293825 - RNA, 22 nt, Homo sapiens
aaagugcuucucuuuggugggu

SEQ ID NO: 293826 - RNA, 22 nt, Homo sapiens
aaaguggugggauuccaggcau

SEQ ID NO: 293827 - RNA, 22 nt, Homo sapiens
aaagugucuguuccuagcauga

SEQ ID NO: 293828 - RNA, 22 nt, Homo sapiens
aaaguguuucugcaguagguuu

SEQ ID NO: 293829 - RNA, 22 nt, Homo sapiens
aaaguucugcguuagggcuaaa

SEQ ID NO: 293830 - RNA, 19 nt, Homo sapiens
aaaguucuucccuuuggag

SEQ ID NO: 293831 - RNA, 22 nt, Homo sapiens
aaauccaucucuuggggcauug

SEQ ID NO: 293832 - RNA, 22 nt, Homo sapiens
aaaugcacagaaaggaugugga

SEQ ID NO: 293833 - RNA, 21 nt, Homo sapiens
aaaugcacauuacugcuggug

SEQ ID NO: 293834 - RNA, 22 nt, Homo sapiens
aaaugcagauucugcuuagguu

SEQ ID NO: 293835 - RNA, 22 nt, Homo sapiens
aaaugcauggacagcuggucuu

SEQ ID NO: 293836 - RNA, 22 nt, Homo sapiens
aaaugcucuuuaugaaguugga

SEQ ID NO: 293837 - RNA, 22 nt, Homo sapiens
aaaugcuucuauguggcauguu

SEQ ID NO: 293838 - RNA, 22 nt, Homo sapiens
aaauggauuaaguucacuugcu

SEQ ID NO: 293839 - RNA, 22 nt, Homo sapiens
aaauggcuuugaggguaggaca

SEQ ID NO: 293840 - RNA, 22 nt, Homo sapiens
aaauucaucaaaugguuuguau

SEQ ID NO: 293841 - RNA, 18 nt, Homo sapiens
aaauucugucccuucuuc

SEQ ID NO: 293842 - RNA, 22 nt, Homo sapiens
aaauugcaaugcgaggcagagg

SEQ ID NO: 293843 - RNA, 22 nt, Homo sapiens
aaauugcauugagcugcuuauu

SEQ ID NO: 293844 - RNA, 22 nt, Homo sapiens
aacaccaucccuuugaugcuuu

SEQ ID NO: 293845 - RNA, 22 nt, Homo sapiens
aacaccauucucuguaacaaga

SEQ ID NO: 293846 - RNA, 22 nt, Homo sapiens
aacagaauccucuuuuccuggg

SEQ ID NO: 293847 - RNA, 22 nt, Homo sapiens
aacagacugucacauaaaauug

SEQ ID NO: 293848 - RNA, 22 nt, Homo sapiens
aacagcauaguacccgugauaa

SEQ ID NO: 293849 - RNA, 22 nt, Homo sapiens
aacaggcuccuaggggugcacc

SEQ ID NO: 293850 - RNA, 22 nt, Homo sapiens
aacaggguggugccugguccau

SEQ ID NO: 293851 - RNA, 22 nt, Homo sapiens
aacaguaucuaacgagugauga

SEQ ID NO: 293852 - RNA, 22 nt, Homo sapiens
aacagugcauuccuguccauau

SEQ ID NO: 293853 - RNA, 22 nt, Homo sapiens
aaccacauggcucaguggacau

SEQ ID NO: 293854 - RNA, 22 nt, Homo sapiens
aaccuacauucuuaacuguugc

SEQ ID NO: 293855 - RNA, 22 nt, Homo sapiens
aaccuguggauuuugguaucug

SEQ ID NO: 293856 - RNA, 22 nt, Homo sapiens
aacugcucuuaccagauggguc

SEQ ID NO: 293857 - RNA, 22 nt, Homo sapiens
aacuggcacuacaucaagagcu

SEQ ID NO: 293858 - RNA, 22 nt, Homo sapiens
aacuggcauauucugguugcgg

SEQ ID NO: 293859 - RNA, 22 nt, Homo sapiens
aacuggccuccuugggaaauua

SEQ ID NO: 293860 - RNA, 22 nt, Homo sapiens
aacuggccuggcgugcagaggg

SEQ ID NO: 293861 - RNA, 22 nt, Homo sapiens
aacugggcaagcauuacauggu

SEQ ID NO: 293862 - RNA, 22 nt, Homo sapiens
aacuggucuuuggaggaggagg

SEQ ID NO: 293863 - RNA, 19 nt, Homo sapiens
aacuggugugagaugguau

SEQ ID NO: 293864 - RNA, 21 nt, Homo sapiens
aagaaagcuggacuugccgcu

SEQ ID NO: 293865 - RNA, 22 nt, Homo sapiens
aagaccuaugcaggaagaaaug

SEQ ID NO: 293866 - RNA, 22 nt, Homo sapiens
aagagcucauccauaguuguca

SEQ ID NO: 293867 - RNA, 22 nt, Homo sapiens
aagaggcuguaggauaaugccu

SEQ ID NO: 293868 - RNA, 22 nt, Homo sapiens
aagagguaauaacaaagcuucu

SEQ ID NO: 293869 - RNA, 22 nt, Homo sapiens
aagauagcuaagcuucuucuaa

SEQ ID NO: 293870 - RNA, 19 nt, Homo sapiens
aagaugauguuugggcuaa

SEQ ID NO: 293871 - RNA, 22 nt, Homo sapiens
aagaugcagaagcccagauguu

SEQ ID NO: 293872 - RNA, 22 nt, Homo sapiens
aagcacccuuugucuggacaug

SEQ ID NO: 293873 - RNA, 22 nt, Homo sapiens
aagcaggugucugugucuguaa

SEQ ID NO: 293874 - RNA, 22 nt, Homo sapiens
aagcaucauuuggaauuugaga

SEQ ID NO: 293875 - RNA, 21 nt, Homo sapiens
aagcaugguguaucuuuccau

SEQ ID NO: 293876 - RNA, 22 nt, Homo sapiens
aagccagugugacaggaaacuu

SEQ ID NO: 293877 - RNA, 22 nt, Homo sapiens
aagcgguguugaauuuuguuga

SEQ ID NO: 293878 - RNA, 22 nt, Homo sapiens
aagcuaccauuuguauauaaag

SEQ ID NO: 293879 - RNA, 22 nt, Homo sapiens
aagcucauugagaucuauggcu

SEQ ID NO: 293880 - RNA, 22 nt, Homo sapiens
aagcugcauuuucuagaugcuu

SEQ ID NO: 293881 - RNA, 22 nt, Homo sapiens
aagcuggagugcaguggugcga

SEQ ID NO: 293882 - RNA, 22 nt, Homo sapiens
aagcuggcauucauucguucuu

SEQ ID NO: 293883 - RNA, 22 nt, Homo sapiens
aagcugguguugcugcucuguu

SEQ ID NO: 293884 - RNA, 22 nt, Homo sapiens
aagcugguuuuauaucugugag

SEQ ID NO: 293885 - RNA, 22 nt, Homo sapiens
aagcugugucuugucagcuacc

SEQ ID NO: 293886 - RNA, 22 nt, Homo sapiens
aagcuguugguggauguaccau

SEQ ID NO: 293887 - RNA, 22 nt, Homo sapiens
aagcuuucaacuguuugccauu

SEQ ID NO: 293888 - RNA, 22 nt, Homo sapiens
aaggagcagagagcccuguuuc

SEQ ID NO: 293889 - RNA, 22 nt, Homo sapiens
aaggagcuaagagaucauacau

SEQ ID NO: 293890 - RNA, 22 nt, Homo sapiens
aaggagcuuaagugacuuguac

SEQ ID NO: 293891 - RNA, 22 nt, Homo sapiens
aaggaguagaggaauagcaaug

SEQ ID NO: 293892 - RNA, 22 nt, Homo sapiens
aaggauuguaaaguugacaaau

SEQ ID NO: 293893 - RNA, 22 nt, Homo sapiens
aaggcaagaaaauggauucucc

SEQ ID NO: 293894 - RNA, 22 nt, Homo sapiens
aaggcaagauacugguugcuga

SEQ ID NO: 293895 - RNA, 22 nt, Homo sapiens
aaggcaauuuguugugaggauu

SEQ ID NO: 293896 - RNA, 22 nt, Homo sapiens
aaggcagucacuaaauagugag

SEQ ID NO: 293897 - RNA, 19 nt, Homo sapiens
auaagugaaucacgggggc

SEQ ID NO: 293898 - RNA, 22 nt, Homo sapiens
auaagugcuuguugaauaauag

SEQ ID NO: 293899 - RNA, 22 nt, Homo sapiens
auaauacuuuuauuuugaggaa

SEQ ID NO: 293900 - RNA, 22 nt, Homo sapiens
auaauagcugaucauuuagaag

SEQ ID NO: 293901 - RNA, 22 nt, Homo sapiens
auaaucaugucugaaaccuuug

SEQ ID NO: 293902 - RNA, 18 nt, Homo sapiens
auacaagcagcagagauu

SEQ ID NO: 293903 - RNA, 22 nt, Homo sapiens
auacaagugccauguuggugug

SEQ ID NO: 293904 - RNA, 22 nt, Homo sapiens
auacacgugcagaacaugcagg

SEQ ID NO: 293905 - RNA, 22 nt, Homo sapiens
auacagguauacaaugcauaau

SEQ ID NO: 293906 - RNA, 22 nt, Homo sapiens
auacagucuguuagauuuccuc

SEQ ID NO: 293907 - RNA, 22 nt, Homo sapiens
auacaugugccauguucgugug

SEQ ID NO: 293908 - RNA, 22 nt, Homo sapiens
auacaugugccauguugguuug

SEQ ID NO: 293909 - RNA, 20 nt, Homo sapiens
auacccaguagcacaacagc

SEQ ID NO: 293910 - RNA, 22 nt, Homo sapiens
auaccugguagucuugcuacac

SEQ ID NO: 293911 - RNA, 22 nt, Homo sapiens
auacuagucaagaauguaugag

SEQ ID NO: 293912 - RNA, 22 nt, Homo sapiens
auagagcuaccauagaauccag

SEQ ID NO: 293913 - RNA, 22 nt, Homo sapiens
auagagcuggcagacacccuua

SEQ ID NO: 293914 - RNA, 22 nt, Homo sapiens
auagaggacugaggugaucuuu

SEQ ID NO: 293915 - RNA, 22 nt, Homo sapiens
auagcaagaugauugauccauu

SEQ ID NO: 293916 - RNA, 21 nt, Homo sapiens
auagcacaucagauuuuauua

SEQ ID NO: 293917 - RNA, 22 nt, Homo sapiens
auagcagcauauguaauguuga

SEQ ID NO: 293918 - RNA, 22 nt, Homo sapiens
auagcagcuugucagggcagac

SEQ ID NO: 293919 - RNA, 22 nt, Homo sapiens
auagcagugucccacuccuugg

SEQ ID NO: 293920 - RNA, 22 nt, Homo sapiens
auagcagugugagaaugaacua

SEQ ID NO: 293921 - RNA, 22 nt, Homo sapiens
auagcauagucagcuucgcuga

SEQ ID NO: 293922 - RNA, 22 nt, Homo sapiens
auagcugcucaggcuuuccuca

SEQ ID NO: 293923 - RNA, 22 nt, Homo sapiens
auagcuguccuuacuagcuagg

SEQ ID NO: 293924 - RNA, 22 nt, Homo sapiens
auaggcaagaugagguuuuuau

SEQ ID NO: 293925 - RNA, 22 nt, Homo sapiens
auagguagcauagcaggaauau

SEQ ID NO: 293926 - RNA, 22 nt, Homo sapiens
auagguauuuuuaaaugacugu

SEQ ID NO: 293927 - RNA, 22 nt, Homo sapiens
auaguauaguugaggauggcau

SEQ ID NO: 293928 - RNA, 22 nt, Homo sapiens
auagugcugcaacaaauauacg

SEQ ID NO: 293929 - RNA, 22 nt, Homo sapiens
auagugcugcaauaaacacacg

SEQ ID NO: 293930 - RNA, 22 nt, Homo sapiens
auagugcugcaauaaacauacg

SEQ ID NO: 293931 - RNA, 22 nt, Homo sapiens
auagugcugcaauaaacauaug

SEQ ID NO: 293932 - RNA, 22 nt, Homo sapiens
auagugcugcagucaauguacg

SEQ ID NO: 293933 - RNA, 22 nt, Homo sapiens
auaucaaggccauuuucuaaau

SEQ ID NO: 293934 - RNA, 22 nt, Homo sapiens
auauccuggagcauuuuugcaa

SEQ ID NO: 293935 - RNA, 17 nt, Homo sapiens
auaugaauuuuggagau

SEQ ID NO: 293936 - RNA, 22 nt, Homo sapiens
auaugcaaauccauagagacag

SEQ ID NO: 293937 - RNA, 22 nt, Homo sapiens
auaugcacgugcauacacacuu

SEQ ID NO: 293938 - RNA, 22 nt, Homo sapiens
auaugcauguacccacacaggc

SEQ ID NO: 293939 - RNA, 22 nt, Homo sapiens
auaugcuuauuagcaagaaaua

SEQ ID NO: 293940 - RNA, 21 nt, Homo sapiens
auauggaacuggugacguguu

SEQ ID NO: 293941 - RNA, 19 nt, Homo sapiens
auaugggguuugaacugug

SEQ ID NO: 293942 - RNA, 22 nt, Homo sapiens
auaugguacuuaugcucaaacu

SEQ ID NO: 293943 - RNA, 20 nt, Homo sapiens
auaugguugugagugauuuu

SEQ ID NO: 293944 - RNA, 21 nt, Homo sapiens
auaugugcuguggaagucagc

SEQ ID NO: 293945 - RNA, 22 nt, Homo sapiens
auauuagcacuaaugucacgau

SEQ ID NO: 293946 - RNA, 22 nt, Homo sapiens
auauucaagugaggauggcuaa

SEQ ID NO: 293947 - RNA, 22 nt, Homo sapiens
uagaggaaugaauuuggccaga

SEQ ID NO: 293948 - RNA, 22 nt, Homo sapiens
uagagguaggucuucgagucuc

SEQ ID NO: 293949 - RNA, 22 nt, Homo sapiens
uagauaauuagaggguuuuaag

SEQ ID NO: 293950 - RNA, 22 nt, Homo sapiens
uagauaguuaugauuugaugau

SEQ ID NO: 293951 - RNA, 22 nt, Homo sapiens
uagauuaucuaugaggcuucca

SEQ ID NO: 293952 - RNA, 22 nt, Homo sapiens
uagauuaucuguaugugcucuu

SEQ ID NO: 293953 - RNA, 22 nt, Homo sapiens
uagauuaucuuaaggagcauca

SEQ ID NO: 293954 - RNA, 22 nt, Homo sapiens
uagauuguaauaugcagaaugg

SEQ ID NO: 293955 - RNA, 21 nt, Homo sapiens
uagcaaauugcuauuaaggca

SEQ ID NO: 293956 - RNA, 22 nt, Homo sapiens
uagcacagggaauugguucucu

SEQ ID NO: 293957 - RNA, 22 nt, Homo sapiens
uagcacaugucagguaauuugc

SEQ ID NO: 293958 - RNA, 22 nt, Homo sapiens
uagcaccaaacauauacucagu

SEQ ID NO: 293959 - RNA, 22 nt, Homo sapiens
uagcacuauguuaucacauacu

SEQ ID NO: 293960 - RNA, 22 nt, Homo sapiens
uagcacugucuugcaccugugc

SEQ ID NO: 293961 - RNA, 18 nt, Homo sapiens
uagcagacaucauugggg

SEQ ID NO: 293962 - RNA, 22 nt, Homo sapiens
uagcagcauaaauggacuaaga

SEQ ID NO: 293963 - RNA, 22 nt, Homo sapiens
uagcaguaaagaaugugauguu

SEQ ID NO: 293964 - RNA, 22 nt, Homo sapiens
uagcaguaagaaacugacauug

SEQ ID NO: 293965 - RNA, 22 nt, Homo sapiens
uagcccagugagguugauuugg

SEQ ID NO: 293966 - RNA, 22 nt, Homo sapiens
uagccuguggugaauguuucug

SEQ ID NO: 293967 - RNA, 22 nt, Homo sapiens
uagcuaaauucagcucuaggua

SEQ ID NO: 293968 - RNA, 22 nt, Homo sapiens
uagcuaguauuuugcugaggau

SEQ ID NO: 293969 - RNA, 22 nt, Homo sapiens
uagcugagacuacaguaggugc

SEQ ID NO: 293970 - RNA, 22 nt, Homo sapiens
uagcuucuccauagcuccaugu

SEQ ID NO: 293971 - RNA, 18 nt, Homo sapiens
uaggaacauugauuggag

SEQ ID NO: 293972 - RNA, 22 nt, Homo sapiens
uaggaaguuuucuugcugggcc

SEQ ID NO: 293973 - RNA, 22 nt, Homo sapiens
uaggacacaggacauauguaga

SEQ ID NO: 293974 - RNA, 22 nt, Homo sapiens
uaggacacucucuccaccagua

SEQ ID NO: 293975 - RNA, 22 nt, Homo sapiens
uaggagcacaaaccccauugug

SEQ ID NO: 293976 - RNA, 22 nt, Homo sapiens
uaggagcacagcagcauguggg

SEQ ID NO: 293977 - RNA, 22 nt, Homo sapiens
uaggagugugaacccuaugaac

SEQ ID NO: 293978 - RNA, 22 nt, Homo sapiens
uaggcaauguacauaucggccc

SEQ ID NO: 293979 - RNA, 22 nt, Homo sapiens
uaggcacuguguuuguaggagu

SEQ ID NO: 293980 - RNA, 22 nt, Homo sapiens
uagggaguuuuggggugcagaa

SEQ ID NO: 293981 - RNA, 22 nt, Homo sapiens
uagggcuuuaguuugcuugugu

SEQ ID NO: 293982 - RNA, 22 nt, Homo sapiens
uaggguaguaauaguuguuuca

SEQ ID NO: 293983 - RNA, 22 nt, Homo sapiens
uaggugaauguaguaagguguu

SEQ ID NO: 293984 - RNA, 22 nt, Homo sapiens
gcagucacagggagauggugac

SEQ ID NO: 293985 - RNA, 22 nt, Homo sapiens
gcagugacaugugccaguuuau

SEQ ID NO: 293986 - RNA, 22 nt, Homo sapiens
gcagugaugugaucauagcuca

SEQ ID NO: 293987 - RNA, 22 nt, Homo sapiens
gcaguggugugugccagccuag

SEQ ID NO: 293988 - RNA, 20 nt, Homo sapiens
gcaguguucugaccugaauc

SEQ ID NO: 293989 - RNA, 22 nt, Homo sapiens
gcauauuuuaaaguguaaccug

SEQ ID NO: 293990 - RNA, 22 nt, Homo sapiens
gcaucacagcuccugugcuggc

SEQ ID NO: 293991 - RNA, 22 nt, Homo sapiens
gcauggagaaggggacugauuc

SEQ ID NO: 293992 - RNA, 22 nt, Homo sapiens
gccaaaaugcugggauuacagg

SEQ ID NO: 293993 - RNA, 18 nt, Homo sapiens
gccaacauguaaacaggu

SEQ ID NO: 293994 - RNA, 19 nt, Homo sapiens
gccaccuggugcguguucu

SEQ ID NO: 293995 - RNA, 22 nt, Homo sapiens
gccaguauuuuauugagaauuu

SEQ ID NO: 293996 - RNA, 21 nt, Homo sapiens
gccaguguggcaauuuuucaa

SEQ ID NO: 293997 - RNA, 22 nt, Homo sapiens
gccauggaggauuuauagaggc

SEQ ID NO: 293998 - RNA, 22 nt, Homo sapiens
gccauugcacuccagcuugggc

SEQ ID NO: 293999 - RNA, 22 nt, Homo sapiens
gcccacuguuaaauuuguuuua

SEQ ID NO: 294000 - RNA, 22 nt, Homo sapiens
gcccugauacauucuucugccu

SEQ ID NO: 294001 - RNA, 22 nt, Homo sapiens
gccuguagaagaguagaugacc

SEQ ID NO: 294002 - RNA, 22 nt, Homo sapiens
gcgugguguuagaaugagaagu

SEQ ID NO: 294003 - RNA, 22 nt, Homo sapiens
gcuaaaucuguaaaaugaggag

SEQ ID NO: 294004 - RNA, 22 nt, Homo sapiens
gcuaaggcaggagcauugcuug

SEQ ID NO: 294005 - RNA, 22 nt, Homo sapiens
gcuagcauucaaaugugcagcc

SEQ ID NO: 294006 - RNA, 22 nt, Homo sapiens
gcuaggagauccacugcucucu

SEQ ID NO: 294007 - RNA, 22 nt, Homo sapiens
gcucaguuuccucagcugcaaa

SEQ ID NO: 294008 - RNA, 22 nt, Homo sapiens
gcucugguuacaaaggcaaauu

SEQ ID NO: 294009 - RNA, 22 nt, Homo sapiens
gcugauggugcaguucuagccu

SEQ ID NO: 294010 - RNA, 22 nt, Homo sapiens
gcugauguuggccucugggcuu

SEQ ID NO: 294011 - RNA, 22 nt, Homo sapiens
gcugcacuuuaaggcauccccu

SEQ ID NO: 294012 - RNA, 22 nt, Homo sapiens
gcugcguguagaguucucacug

SEQ ID NO: 294013 - RNA, 22 nt, Homo sapiens
gcugcuguaccagaugugguua

SEQ ID NO: 294014 - RNA, 22 nt, Homo sapiens
gcugcuguuauucaucagaacu

SEQ ID NO: 294015 - RNA, 22 nt, Homo sapiens
gcuggaauuaacauagaugugc

SEQ ID NO: 294016 - RNA, 22 nt, Homo sapiens
gcuggauguuucaauacaaaua

SEQ ID NO: 294017 - RNA, 22 nt, Homo sapiens
gcuggcaaguggccuacuuugu

SEQ ID NO: 294018 - RNA, 22 nt, Homo sapiens
gcugguguucaggcccucaguc

SEQ ID NO: 294019 - RNA, 22 nt, Homo sapiens
gcuguaguugaggauuuuaaga

SEQ ID NO: 294020 - RNA, 22 nt, Homo sapiens
gcugugauucuguguagauagu

SEQ ID NO: 294021 - RNA, 22 nt, Homo sapiens
gcuucauggaggcugggcgcag

SEQ ID NO: 294022 - RNA, 19 nt, Homo sapiens
gcuuguccacgugagauaa

SEQ ID NO: 294023 - RNA, 23 nt, Homo sapiens
ggaaacauccagucuuucaccau

SEQ ID NO: 294024 - RNA, 22 nt, Homo sapiens
ggaaagcuagguguggguguac

SEQ ID NO: 294025 - RNA, 19 nt, Homo sapiens
ggaaaugucuauuaagauc

SEQ ID NO: 294026 - RNA, 22 nt, Homo sapiens
ggaaauguuggugucaugaguu

SEQ ID NO: 294027 - RNA, 23 nt, Homo sapiens
ggaaauguuuaagggguugggag

SEQ ID NO: 294028 - RNA, 20 nt, Homo sapiens
ggaagagugacacaagguau

SEQ ID NO: 294029 - RNA, 22 nt, Homo sapiens
ggaagccugcacucgggcaggg

SEQ ID NO: 294030 - RNA, 22 nt, Homo sapiens
aggcagucugaguuuugaaagg

SEQ ID NO: 294031 - RNA, 22 nt, Homo sapiens
aggcaguuucagugagagguga

SEQ ID NO: 294032 - RNA, 19 nt, Homo sapiens
aggcauugugcucaucugu

SEQ ID NO: 294033 - RNA, 22 nt, Homo sapiens
agggaauguaaguuuuaugaga

SEQ ID NO: 294034 - RNA, 22 nt, Homo sapiens
agggcaguguuaggacugucug

SEQ ID NO: 294035 - RNA, 22 nt, Homo sapiens
agggcuuguuuaacuaucauua

SEQ ID NO: 294036 - RNA, 22 nt, Homo sapiens
aggguuuuuauuuauguggcau

SEQ ID NO: 294037 - RNA, 22 nt, Homo sapiens
agguaagucucuaauuaugaau

SEQ ID NO: 294038 - RNA, 22 nt, Homo sapiens
agguaauuuucccagagggaaa

SEQ ID NO: 294039 - RNA, 22 nt, Homo sapiens
agguacuugagauucugaacug

SEQ ID NO: 294040 - RNA, 22 nt, Homo sapiens
agguauguauguaugggagaaa

SEQ ID NO: 294041 - RNA, 21 nt, Homo sapiens
aggucaguaagaaugcagcac

SEQ ID NO: 294042 - RNA, 22 nt, Homo sapiens
agguccauuauuuucauucaug

SEQ ID NO: 294043 - RNA, 22 nt, Homo sapiens
aggucccauguccucccugacc

SEQ ID NO: 294044 - RNA, 22 nt, Homo sapiens
aggugguauuuaaaauuauuug

SEQ ID NO: 294045 - RNA, 22 nt, Homo sapiens
aggugguuuuaggcagagacau

SEQ ID NO: 294046 - RNA, 20 nt, Homo sapiens
agguuauuauaauuagaaga

SEQ ID NO: 294047 - RNA, 22 nt, Homo sapiens
agguuguguuugugauuagaua

SEQ ID NO: 294048 - RNA, 22 nt, Homo sapiens
agguuuucagccccagccuagg

SEQ ID NO: 294049 - RNA, 22 nt, Homo sapiens
aguaaagcuacucacugugggc

SEQ ID NO: 294050 - RNA, 22 nt, Homo sapiens
aguaagauggcaacucuccaca

SEQ ID NO: 294051 - RNA, 22 nt, Homo sapiens
aguacaauguugaguagaagug

SEQ ID NO: 294052 - RNA, 22 nt, Homo sapiens
aguaccauuacucacuuauuuu

SEQ ID NO: 294053 - RNA, 21 nt, Homo sapiens
aguagcacugugucuuacaaa

SEQ ID NO: 294054 - RNA, 22 nt, Homo sapiens
aguaucaucuuguuggccaggc

SEQ ID NO: 294055 - RNA, 20 nt, Homo sapiens
aguauucacuuuuuucaugg

SEQ ID NO: 294056 - RNA, 22 nt, Homo sapiens
agucaagauggcaagguaaggc

SEQ ID NO: 294057 - RNA, 22 nt, Homo sapiens
agucaagugguuucugaguugg

SEQ ID NO: 294058 - RNA, 22 nt, Homo sapiens
agucacagguucuugggauuag

SEQ ID NO: 294059 - RNA, 22 nt, Homo sapiens
agucagugcauaagaaugaagu

SEQ ID NO: 294060 - RNA, 22 nt, Homo sapiens
agucaguggaguaaauguaauu

SEQ ID NO: 294061 - RNA, 22 nt, Homo sapiens
agucauggaucacaguagccuc

SEQ ID NO: 294062 - RNA, 22 nt, Homo sapiens
agucauggcagaaggcaccucu

SEQ ID NO: 294063 - RNA, 22 nt, Homo sapiens
agucugguguucucacacuagu

SEQ ID NO: 294064 - RNA, 22 nt, Homo sapiens
uaggugauccauuuguauuuua

SEQ ID NO: 294065 - RNA, 22 nt, Homo sapiens
uagguuguccaucucuagaagc

SEQ ID NO: 294066 - RNA, 22 nt, Homo sapiens
uagguugucucuucacucugau

SEQ ID NO: 294067 - RNA, 22 nt, Homo sapiens
uaguaaacagcucugccacaau

SEQ ID NO: 294068 - RNA, 23 nt, Homo sapiens
uaguaccauauuguuggcagcac

SEQ ID NO: 294069 - RNA, 22 nt, Homo sapiens
uaguagcauaccuaaguauacu

SEQ ID NO: 294070 - RNA, 22 nt, Homo sapiens
uaguaguuuuguguauaauaau

SEQ ID NO: 294071 - RNA, 20 nt, Homo sapiens
uagucaugagauucuccaag

SEQ ID NO: 294072 - RNA, 22 nt, Homo sapiens
uagugguaguagcaguaauauu

SEQ ID NO: 294073 - RNA, 22 nt, Homo sapiens
uaguucauuauguguugcucag

SEQ ID NO: 294074 - RNA, 22 nt, Homo sapiens
uaguuuaucuucuggauggaca

SEQ ID NO: 294075 - RNA, 22 nt, Homo sapiens
uauaaaguaauuucuaggggcu

SEQ ID NO: 294076 - RNA, 23 nt, Homo sapiens
uauaacuuuuaauuuacuggccu

SEQ ID NO: 294077 - RNA, 22 nt, Homo sapiens
uauacagcaaguuacugugcug

SEQ ID NO: 294078 - RNA, 22 nt, Homo sapiens
uauacaguaggcacucaguggc

SEQ ID NO: 294079 - RNA, 22 nt, Homo sapiens
uauacaugugggcaucaggaga

SEQ ID NO: 294080 - RNA, 22 nt, Homo sapiens
uauagcagccugaacaaaguaa

SEQ ID NO: 294081 - RNA, 22 nt, Homo sapiens
uauagcuaugggauguauuugc

SEQ ID NO: 294082 - RNA, 22 nt, Homo sapiens
uauagcuugauuauggugaugg

SEQ ID NO: 294083 - RNA, 21 nt, Homo sapiens
uauaguaguaugauuuacaau

SEQ ID NO: 294084 - RNA, 22 nt, Homo sapiens
uauauaagcugaugagccacaa

SEQ ID NO: 294085 - RNA, 22 nt, Homo sapiens
uauauagcuaugucuguccauu

SEQ ID NO: 294086 - RNA, 22 nt, Homo sapiens
uauaucuagagcggaccaggcu

SEQ ID NO: 294087 - RNA, 22 nt, Homo sapiens
uauaugcaacauaguguaugug

SEQ ID NO: 294088 - RNA, 22 nt, Homo sapiens
uauaugcacucagguguaugug

SEQ ID NO: 294089 - RNA, 22 nt, Homo sapiens
uauaugcucugggauccugaaa

SEQ ID NO: 294090 - RNA, 22 nt, Homo sapiens
uaucaacaggguggccagugua

SEQ ID NO: 294091 - RNA, 22 nt, Homo sapiens
uaucaaguguuagggagaugug

SEQ ID NO: 294092 - RNA, 22 nt, Homo sapiens
uaucacagauauuaugggccaa

SEQ ID NO: 294093 - RNA, 22 nt, Homo sapiens
uaucacagcaaggacccauuau

SEQ ID NO: 294094 - RNA, 22 nt, Homo sapiens
uaucacaguagaacucuuucca

SEQ ID NO: 294095 - RNA, 22 nt, Homo sapiens
uaucacccuuucauuguucuuc

SEQ ID NO: 294096 - RNA, 22 nt, Homo sapiens
uaucacuauucauccuagcucc

SEQ ID NO: 294097 - RNA, 22 nt, Homo sapiens
uaucacugucaggcccucauau

SEQ ID NO: 294098 - RNA, 19 nt, Homo sapiens
uaucacuucccuggaaaca

SEQ ID NO: 294099 - RNA, 21 nt, Homo sapiens
uaucagagacauugagaggca

SEQ ID NO: 294100 - RNA, 22 nt, Homo sapiens
uaucagagcugucagccuaccu

SEQ ID NO: 294101 - RNA, 22 nt, Homo sapiens
uaucagcacaguggguucaugg

SEQ ID NO: 294102 - RNA, 21 nt, Homo sapiens
uauccacuugcaacagagaag

SEQ ID NO: 294103 - RNA, 22 nt, Homo sapiens
uaucccuuagagcggggugguu

SEQ ID NO: 294104 - RNA, 22 nt, Homo sapiens
uauccuagugggguuucaguca

SEQ ID NO: 294105 - RNA, 22 nt, Homo sapiens
uaucuacauguagguauguaug

SEQ ID NO: 294106 - RNA, 22 nt, Homo sapiens
uaucucagaugagacuuguaac

SEQ ID NO: 294107 - RNA, 20 nt, Homo sapiens
uaucucaguuuguccuaaac

SEQ ID NO: 294108 - RNA, 22 nt, Homo sapiens
uaugaagccaggauuuauuauu

SEQ ID NO: 294109 - RNA, 22 nt, Homo sapiens
uaugaaucugagagaucuggaa

SEQ ID NO: 294110 - RNA, 20 nt, Homo sapiens
uaugacaaagccuagugagu

SEQ ID NO: 294111 - RNA, 22 nt, Homo sapiens
uaugacucagaaggcacacaca

SEQ ID NO: 294112 - RNA, 22 nt, Homo sapiens
uaugacuuuugaauacagaugg

SEQ ID NO: 294113 - RNA, 22 nt, Homo sapiens
ucacuggccaaauucuggguga

SEQ ID NO: 294114 - RNA, 22 nt, Homo sapiens
ucacugggagaccaaagccauc

SEQ ID NO: 294115 - RNA, 20 nt, Homo sapiens
ucacuggguucuugaagucu

SEQ ID NO: 294116 - RNA, 22 nt, Homo sapiens
ucacugugagaguuuauccugu

SEQ ID NO: 294117 - RNA, 22 nt, Homo sapiens
ucacugugguuggaaggcuuaa

SEQ ID NO: 294118 - RNA, 22 nt, Homo sapiens
ucacugugguuugggaaagugc

SEQ ID NO: 294119 - RNA, 22 nt, Homo sapiens
ucacuuggugaacacauuaugu

SEQ ID NO: 294120 - RNA, 22 nt, Homo sapiens
ucacuuuggguacuauggaaau

SEQ ID NO: 294121 - RNA, 22 nt, Homo sapiens
ucagacacugagcaaacgacua

SEQ ID NO: 294122 - RNA, 22 nt, Homo sapiens
ucagaguagaaacacuuccaua

SEQ ID NO: 294123 - RNA, 22 nt, Homo sapiens
ucagagucuagaucacucacug

SEQ ID NO: 294124 - RNA, 18 nt, Homo sapiens
ucagagugcagacuauac

SEQ ID NO: 294125 - RNA, 22 nt, Homo sapiens
ucagagugguuguaccauuuga

SEQ ID NO: 294126 - RNA, 22 nt, Homo sapiens
ucagaucauuaagguagguuua

SEQ ID NO: 294127 - RNA, 22 nt, Homo sapiens
ucagaugauucuguuguugugu

SEQ ID NO: 294128 - RNA, 19 nt, Homo sapiens
ucagaugcauuagggguua

SEQ ID NO: 294129 - RNA, 22 nt, Homo sapiens
ucagauguuuuguuuaucugcu

SEQ ID NO: 294130 - RNA, 22 nt, Homo sapiens
ucagcaaugcugcacucuacug

SEQ ID NO: 294131 - RNA, 22 nt, Homo sapiens
ucagcacauucaaggccugccu

SEQ ID NO: 294132 - RNA, 22 nt, Homo sapiens
ucagcaccauguaacaauugau

SEQ ID NO: 294133 - RNA, 22 nt, Homo sapiens
ucagcaucacgugggcucccgu

SEQ ID NO: 294134 - RNA, 22 nt, Homo sapiens
ucagguaaucuauuugucuuuu

SEQ ID NO: 294135 - RNA, 20 nt, Homo sapiens
ucagguagaucuuugagguc

SEQ ID NO: 294136 - RNA, 22 nt, Homo sapiens
ucagguagcauuuuggaaacag

SEQ ID NO: 294137 - RNA, 22 nt, Homo sapiens
ucagguaucucuauagcaaugu

SEQ ID NO: 294138 - RNA, 22 nt, Homo sapiens
ucagguccuuacugugcucccu

SEQ ID NO: 294139 - RNA, 22 nt, Homo sapiens
ucaggugcaguggcucugaccu

SEQ ID NO: 294140 - RNA, 22 nt, Homo sapiens
ucaguacuuuggagcucacaua

SEQ ID NO: 294141 - RNA, 22 nt, Homo sapiens
uggauggagaggcuugugaugc

SEQ ID NO: 294142 - RNA, 22 nt, Homo sapiens
cgcaguguuugugucccugggu

SEQ ID NO: 294143 - RNA, 22 nt, Homo sapiens
cgcuggugaucuagacccccaa

SEQ ID NO: 294144 - RNA, 22 nt, Homo sapiens
cgcuggugucuaagcgacagcu

SEQ ID NO: 294145 - RNA, 21 nt, Homo sapiens
cgucauggagauguguuguac

SEQ ID NO: 294146 - RNA, 22 nt, Homo sapiens
cuaaaacuuucugagugcagca

SEQ ID NO: 294147 - RNA, 22 nt, Homo sapiens
cuaaagauagugacaugauuug

SEQ ID NO: 294148 - RNA, 22 nt, Homo sapiens
cuaaaguauugagugguaaaga

SEQ ID NO: 294149 - RNA, 23 nt, Homo sapiens
cuaaagucugucacugaggacuu

SEQ ID NO: 294150 - RNA, 22 nt, Homo sapiens
cuaaagugcuuaaaaucucauu

SEQ ID NO: 294151 - RNA, 22 nt, Homo sapiens
cuaaaugucucuacuaaguuua

SEQ ID NO: 294152 - RNA, 22 nt, Homo sapiens
cuaagugaguauaauuuuaaga

SEQ ID NO: 294153 - RNA, 22 nt, Homo sapiens
cuaauucuggccaaagggauaa

SEQ ID NO: 294154 - RNA, 22 nt, Homo sapiens
cuacacaugcaggcucccugcc

SEQ ID NO: 294155 - RNA, 22 nt, Homo sapiens
cuacagcacugagcugugugca

SEQ ID NO: 294156 - RNA, 22 nt, Homo sapiens
cuacagcagcccaguccccgaa

SEQ ID NO: 294157 - RNA, 22 nt, Homo sapiens
cuacagguaugaaagggaguau

SEQ ID NO: 294158 - RNA, 22 nt, Homo sapiens
cuacauuguagguauucaaacu

SEQ ID NO: 294159 - RNA, 22 nt, Homo sapiens
cuaccuggguggcucaugacuu

SEQ ID NO: 294160 - RNA, 23 nt, Homo sapiens
cuacuagucaagucuuuuccagu

SEQ ID NO: 294161 - RNA, 22 nt, Homo sapiens
cuagagagaagcugugugaccu

SEQ ID NO: 294162 - RNA, 22 nt, Homo sapiens
cuagaggcacagccuaggcacu

SEQ ID NO: 294163 - RNA, 22 nt, Homo sapiens
cuagaguacuuaccacagcaug

SEQ ID NO: 294164 - RNA, 22 nt, Homo sapiens
cuagauuauccaacuuauuagc

SEQ ID NO: 294165 - RNA, 22 nt, Homo sapiens
cuagauuguuuccauaaugaca

SEQ ID NO: 294166 - RNA, 22 nt, Homo sapiens
cuagcagcauaagaaucaccaa

SEQ ID NO: 294167 - RNA, 22 nt, Homo sapiens
cuaggcuuuucuuggauccagg

SEQ ID NO: 294168 - RNA, 22 nt, Homo sapiens
cuagucacaggaguugaaggau

SEQ ID NO: 294169 - RNA, 22 nt, Homo sapiens
cuauauacugccugcugauuag

SEQ ID NO: 294170 - RNA, 22 nt, Homo sapiens
cuauaugucuguuuugguacca

SEQ ID NO: 294171 - RNA, 22 nt, Homo sapiens
cuauggccugcuuagaacauac

SEQ ID NO: 294172 - RNA, 22 nt, Homo sapiens
cuauuacuuuuauugaacucag

SEQ ID NO: 294173 - RNA, 22 nt, Homo sapiens
cucaaagugcugggacuggcug

SEQ ID NO: 294174 - RNA, 22 nt, Homo sapiens
cucaaaugguccagcuaguggu

SEQ ID NO: 294175 - RNA, 18 nt, Homo sapiens
cucaaccucaugcagggc

SEQ ID NO: 294176 - RNA, 22 nt, Homo sapiens
cucaaguaauccucccgccuug

SEQ ID NO: 294177 - RNA, 22 nt, Homo sapiens
cucacagucucucccuaauuuu

SEQ ID NO: 294178 - RNA, 22 nt, Homo sapiens
cucacagugacacgaaccccca

SEQ ID NO: 294179 - RNA, 22 nt, Homo sapiens
cucacaguucuaaaggcaagaa

SEQ ID NO: 294180 - RNA, 22 nt, Homo sapiens
cucaccuugugauccacccacc

SEQ ID NO: 294181 - RNA, 22 nt, Homo sapiens
cucaccuugugauccacccgcc

SEQ ID NO: 294182 - RNA, 22 nt, Homo sapiens
cucacuaggaaguaaaguuugu

SEQ ID NO: 294183 - RNA, 22 nt, Homo sapiens
cucacuaguaaggcuguuuagu

SEQ ID NO: 294184 - RNA, 22 nt, Homo sapiens
cucacugucaacauguauuugg

SEQ ID NO: 294185 - RNA, 20 nt, Homo sapiens
cucagauuauucugaagcaa

SEQ ID NO: 294186 - RNA, 22 nt, Homo sapiens
cucagcuacuugagaggcuuag

SEQ ID NO: 294187 - RNA, 22 nt, Homo sapiens
cucaggguacuucuccuuugcu

SEQ ID NO: 294188 - RNA, 22 nt, Homo sapiens
cucagugucuggcacacagaaa

SEQ ID NO: 294189 - RNA, 22 nt, Homo sapiens
cucagugucuggggccccaggg

SEQ ID NO: 294190 - RNA, 22 nt, Homo sapiens
cucaguguuucagcugcucaga

SEQ ID NO: 294191 - RNA, 22 nt, Homo sapiens
cucaguuuugccuuguuuaagg

SEQ ID NO: 294192 - RNA, 22 nt, Homo sapiens
cucauggaauacuucacagcca

SEQ ID NO: 294193 - RNA, 22 nt, Homo sapiens
cucauggagauagagaauagaa

SEQ ID NO: 294194 - RNA, 22 nt, Homo sapiens
cucauugcaaucucugccuccc

SEQ ID NO: 294195 - RNA, 22 nt, Homo sapiens
cuccacugagcaggugggaggc

SEQ ID NO: 294196 - RNA, 22 nt, Homo sapiens
cuccaggugucauccaccuccu

SEQ ID NO: 294197 - RNA, 22 nt, Homo sapiens
cuccaguacagagagguuccuc

SEQ ID NO: 294198 - RNA, 22 nt, Homo sapiens
cuccauuuaucugaaauuuuau

SEQ ID NO: 294199 - RNA, 22 nt, Homo sapiens
cucccacccucauuuuuaggca

SEQ ID NO: 294200 - RNA, 22 nt, Homo sapiens
cucccugagccagggcuuugac

SEQ ID NO: 294201 - RNA, 22 nt, Homo sapiens
cucccuuugcugaauguuuuuc

SEQ ID NO: 294202 - RNA, 22 nt, Homo sapiens
cuccgggugcgucggcgcccug

SEQ ID NO: 294203 - RNA, 22 nt, Homo sapiens
cucgcuccauuucggugaucaa

SEQ ID NO: 294204 - RNA, 22 nt, Homo sapiens
cucucuguuugucuguuauugg

SEQ ID NO: 294205 - RNA, 21 nt, Homo sapiens
cucugguuugcauuggauuau

SEQ ID NO: 294206 - RNA, 22 nt, Homo sapiens
cucuuuaguaagcaguugauga

SEQ ID NO: 294207 - RNA, 22 nt, Homo sapiens
cucuuugaugugaaccgugguu

SEQ ID NO: 294208 - RNA, 22 nt, Homo sapiens
cugaaagagcauuugaaugggu

SEQ ID NO: 294209 - RNA, 22 nt, Homo sapiens
cugacauuguugaucacagcca

SEQ ID NO: 294210 - RNA, 22 nt, Homo sapiens
cugacugugcaugcccagcccc

SEQ ID NO: 294211 - RNA, 22 nt, Homo sapiens
cugagaaugaugauuuccaguu

SEQ ID NO: 294212 - RNA, 22 nt, Homo sapiens
cugagaauguaaaugaagcuuu

SEQ ID NO: 294213 - RNA, 22 nt, Homo sapiens
cugagacacucuuaucugcaua

SEQ ID NO: 294214 - RNA, 22 nt, Homo sapiens
cugagaguugaugaaauauggu

SEQ ID NO: 294215 - RNA, 22 nt, Homo sapiens
cugagauacacuaauagucucu

SEQ ID NO: 294216 - RNA, 22 nt, Homo sapiens
cugagauaggacucugcuggcu

SEQ ID NO: 294217 - RNA, 22 nt, Homo sapiens
cugagaucaagucuugcucugu

SEQ ID NO: 294218 - RNA, 22 nt, Homo sapiens
cugagaucaugggucagguggu

SEQ ID NO: 294219 - RNA, 22 nt, Homo sapiens
cugagauuaagauauugggagu

SEQ ID NO: 294220 - RNA, 22 nt, Homo sapiens
cugagcaaagaagugauaauga

SEQ ID NO: 294221 - RNA, 22 nt, Homo sapiens
cugagcaugacaucaugugacu

SEQ ID NO: 294222 - RNA, 22 nt, Homo sapiens
cugagcuaugccuggaaaggca

SEQ ID NO: 294223 - RNA, 20 nt, Homo sapiens
cugagguacgaggguuaaau

SEQ ID NO: 294224 - RNA, 21 nt, Homo sapiens
ugucaagugggaaaacaugua

SEQ ID NO: 294225 - RNA, 22 nt, Homo sapiens
ugucaaguugugguucaauuuu

SEQ ID NO: 294226 - RNA, 22 nt, Homo sapiens
ugucacaguuuguacuuuauag

SEQ ID NO: 294227 - RNA, 22 nt, Homo sapiens
ugucacugugaguuugacugcu

SEQ ID NO: 294228 - RNA, 22 nt, Homo sapiens
ugucagaaucugagacgacaac

SEQ ID NO: 294229 - RNA, 22 nt, Homo sapiens
ugucaggaguuuuagaaucuua

SEQ ID NO: 294230 - RNA, 22 nt, Homo sapiens
ugucagggaggcucggccgcac

SEQ ID NO: 294231 - RNA, 22 nt, Homo sapiens
ugucaguguaugagccccggau

SEQ ID NO: 294232 - RNA, 22 nt, Homo sapiens
ugucaguuucaguguuagccuu

SEQ ID NO: 294233 - RNA, 22 nt, Homo sapiens
ugucauagaugauuuuuuucgg

SEQ ID NO: 294234 - RNA, 23 nt, Homo sapiens
ugucaucaagaugaggucacacu

SEQ ID NO: 294235 - RNA, 19 nt, Homo sapiens
ugucaucaucuuuucuugc

SEQ ID NO: 294236 - RNA, 22 nt, Homo sapiens
ugucaucauuggaaucugccuc

SEQ ID NO: 294237 - RNA, 22 nt, Homo sapiens
ugucaucuagguauuaagcccc

SEQ ID NO: 294238 - RNA, 22 nt, Homo sapiens
ugucaugaacucacauucuggg

SEQ ID NO: 294239 - RNA, 22 nt, Homo sapiens
ugucauggggaaaauaacagac

SEQ ID NO: 294240 - RNA, 22 nt, Homo sapiens
ugucauggugcucugggcccug

SEQ ID NO: 294241 - RNA, 22 nt, Homo sapiens
ugucauguauauaccacuucca

SEQ ID NO: 294242 - RNA, 22 nt, Homo sapiens
ugucauguugguguacugcacc

SEQ ID NO: 294243 - RNA, 22 nt, Homo sapiens
ugucauguuucuacugaccaaa

SEQ ID NO: 294244 - RNA, 22 nt, Homo sapiens
ugucauuguggugcagauauaa

SEQ ID NO: 294245 - RNA, 16 nt, Homo sapiens
uguccaaauaaauaca

SEQ ID NO: 294246 - RNA, 22 nt, Homo sapiens
uguccaguguuccucagaagaa

SEQ ID NO: 294247 - RNA, 22 nt, Homo sapiens
ugucccaguuggguauugaauu

SEQ ID NO: 294248 - RNA, 18 nt, Homo sapiens
ugucccuuugcuguucau

SEQ ID NO: 294249 - RNA, 22 nt, Homo sapiens
uguccugcagagguguuugccu

SEQ ID NO: 294250 - RNA, 22 nt, Homo sapiens
ugucuacugaugauguaguuaa

SEQ ID NO: 294251 - RNA, 20 nt, Homo sapiens
ugucuauggggguucucugc

SEQ ID NO: 294252 - RNA, 22 nt, Homo sapiens
ugucucaguucccuucucugga

SEQ ID NO: 294253 - RNA, 22 nt, Homo sapiens
ugucuuggacuugaaucucauu

SEQ ID NO: 294254 - RNA, 22 nt, Homo sapiens
ugucuuggagaauccuggguuu

SEQ ID NO: 294255 - RNA, 22 nt, Homo sapiens
ugucuuggaugaggauuaacag

SEQ ID NO: 294256 - RNA, 21 nt, Homo sapiens
ugugaaaucuaggcagagguu

SEQ ID NO: 294257 - RNA, 22 nt, Homo sapiens
ugugaacagaauuagucaccua

SEQ ID NO: 294258 - RNA, 22 nt, Homo sapiens
ugugaacagcuccaaaugugga

SEQ ID NO: 294259 - RNA, 19 nt, Homo sapiens
ugugaagaaaugcugcaag

SEQ ID NO: 294260 - RNA, 22 nt, Homo sapiens
ugugaagauggacuaauauagu

SEQ ID NO: 294261 - RNA, 22 nt, Homo sapiens
ugugaauggugcugccgugaag

SEQ ID NO: 294262 - RNA, 22 nt, Homo sapiens
ugugacacugaauggcagaacu

SEQ ID NO: 294263 - RNA, 18 nt, Homo sapiens
ugugacauugagcauguc

SEQ ID NO: 294264 - RNA, 19 nt, Homo sapiens
ugugacugguugucucgcu

SEQ ID NO: 294265 - RNA, 19 nt, Homo sapiens
ugugagcauuagcauuuag

SEQ ID NO: 294266 - RNA, 22 nt, Homo sapiens
ugugagcuauggaguuguagag

SEQ ID NO: 294267 - RNA, 22 nt, Homo sapiens
ugugauaguuggcuaaagcagu

SEQ ID NO: 294268 - RNA, 17 nt, Homo sapiens
ugugaucaucacccuug

SEQ ID NO: 294269 - RNA, 22 nt, Homo sapiens
ugugaucaugugugccuuaguc

SEQ ID NO: 294270 - RNA, 22 nt, Homo sapiens
ugugcaaaaguaauugcgguuu

SEQ ID NO: 294271 - RNA, 22 nt, Homo sapiens
ugugcaaauuagcacaacccga

SEQ ID NO: 294272 - RNA, 18 nt, Homo sapiens
ugugcaauauuaaccacc

SEQ ID NO: 294273 - RNA, 22 nt, Homo sapiens
ugugcaaucuuccauuuuuagg

SEQ ID NO: 294274 - RNA, 22 nt, Homo sapiens
ugugcaauucgauggagcucau

SEQ ID NO: 294275 - RNA, 22 nt, Homo sapiens
ugugcacaacgugcagguuugu

SEQ ID NO: 294276 - RNA, 23 nt, Homo sapiens
ugugcacauuuacauauauacac

SEQ ID NO: 294277 - RNA, 22 nt, Homo sapiens
ugugcaccucuucacacaggga

SEQ ID NO: 294278 - RNA, 22 nt, Homo sapiens
ugugcaguuuuagcguauuuua

SEQ ID NO: 294279 - RNA, 22 nt, Homo sapiens
ugugcaugacagcauacaaacg

SEQ ID NO: 294280 - RNA, 22 nt, Homo sapiens
ugugccacugcacucuggccug

SEQ ID NO: 294281 - RNA, 22 nt, Homo sapiens
ugugcguguaagagaucuaggu

SEQ ID NO: 294282 - RNA, 22 nt, Homo sapiens
ugugcuauguuauucacauggg

SEQ ID NO: 294283 - RNA, 22 nt, Homo sapiens
ugugcuuguaaaggccagagca

SEQ ID NO: 294284 - RNA, 22 nt, Homo sapiens
uguggaaauaaaagaaagguua

SEQ ID NO: 294285 - RNA, 22 nt, Homo sapiens
uguggaaauggugcuacgaaca

SEQ ID NO: 294286 - RNA, 21 nt, Homo sapiens
uguggcaauggccucacagau

SEQ ID NO: 294287 - RNA, 22 nt, Homo sapiens
uguggcacuguguccagagaaa

SEQ ID NO: 294288 - RNA, 22 nt, Homo sapiens
uguggcagugcuuuaugaaacc

SEQ ID NO: 294289 - RNA, 22 nt, Homo sapiens
uguggcauugaauaaccuugga

SEQ ID NO: 294290 - RNA, 22 nt, Homo sapiens
uguggcuucuuugguucaguau

SEQ ID NO: 294291 - RNA, 22 nt, Homo sapiens
ugugggaggugcuaauguaaau

SEQ ID NO: 294292 - RNA, 22 nt, Homo sapiens
ugugggugguaaaauacaauga

SEQ ID NO: 294293 - RNA, 19 nt, Homo sapiens
uguggucauccugggacga

SEQ ID NO: 294294 - RNA, 22 nt, Homo sapiens
uguguaaauaugauagaggaau

SEQ ID NO: 294295 - RNA, 22 nt, Homo sapiens
uguguagagaaauauuacuuau

SEQ ID NO: 294296 - RNA, 22 nt, Homo sapiens
uguguauaucacugcaugagug

SEQ ID NO: 294297 - RNA, 22 nt, Homo sapiens
ugugucacugaggguuagugua

SEQ ID NO: 294298 - RNA, 22 nt, Homo sapiens
ugugucuugagagucucgagaa

SEQ ID NO: 294299 - RNA, 22 nt, Homo sapiens
ugugucuuguuuuuucccaggc

SEQ ID NO: 294300 - RNA, 22 nt, Homo sapiens
uguguuuuuauguaaaauggaa

SEQ ID NO: 294301 - RNA, 22 nt, Homo sapiens
uguuacagcagaauugauugca

SEQ ID NO: 294302 - RNA, 22 nt, Homo sapiens
uguuacaguguaggccuugggu

SEQ ID NO: 294303 - RNA, 22 nt, Homo sapiens
uguuaguuguucauguuaagag

SEQ ID NO: 294304 - RNA, 23 nt, Homo sapiens
ugacagucucccgauggcuaggc

SEQ ID NO: 294305 - RNA, 22 nt, Homo sapiens
ugacagugugagauccugucuc

SEQ ID NO: 294306 - RNA, 22 nt, Homo sapiens
ugacaugaagaaaaacagauuu

SEQ ID NO: 294307 - RNA, 22 nt, Homo sapiens
ugacaugauuguauauuuagaa

SEQ ID NO: 294308 - RNA, 20 nt, Homo sapiens
cugcaaaugcugcugcugau

SEQ ID NO: 294309 - RNA, 22 nt, Homo sapiens
cugcaagaaucguaguauuuga

SEQ ID NO: 294310 - RNA, 22 nt, Homo sapiens
cugcaagaugcauaggaauuuu

SEQ ID NO: 294311 - RNA, 22 nt, Homo sapiens
cugcaauguuugaaauggcaaa

SEQ ID NO: 294312 - RNA, 22 nt, Homo sapiens
cugcagguaggggcagcuuugg

SEQ ID NO: 294313 - RNA, 22 nt, Homo sapiens
cugcauuugaugacguauggug

SEQ ID NO: 294314 - RNA, 22 nt, Homo sapiens
cugccaguuugauucgggccac

SEQ ID NO: 294315 - RNA, 18 nt, Homo sapiens
cuggaaggcuacuacagu

SEQ ID NO: 294316 - RNA, 22 nt, Homo sapiens
cuggaaucuauggauaacaucg

SEQ ID NO: 294317 - RNA, 22 nt, Homo sapiens
cuggaaugugagccccaaaaag

SEQ ID NO: 294318 - RNA, 22 nt, Homo sapiens
cuggagaucuugacauugaagu

SEQ ID NO: 294319 - RNA, 22 nt, Homo sapiens
cuggagauuaaccaauugccau

SEQ ID NO: 294320 - RNA, 22 nt, Homo sapiens
cuggauauuaacauugaugaaa

SEQ ID NO: 294321 - RNA, 22 nt, Homo sapiens
cuggauggugagauaaagaaaa

SEQ ID NO: 294322 - RNA, 20 nt, Homo sapiens
cuggaugucgaggcagaggu

SEQ ID NO: 294323 - RNA, 18 nt, Homo sapiens
cuggaugucgaguguguu

SEQ ID NO: 294324 - RNA, 22 nt, Homo sapiens
cuggcaaaaagagggcaauaau

SEQ ID NO: 294325 - RNA, 22 nt, Homo sapiens
cuggcaaauaguagagccagga

SEQ ID NO: 294326 - RNA, 19 nt, Homo sapiens
cuggcaaaugcuuuggcca

SEQ ID NO: 294327 - RNA, 22 nt, Homo sapiens
cuggcaagagugaaccagcugu

SEQ ID NO: 294328 - RNA, 22 nt, Homo sapiens
cuggcaauaaauuuuuguguug

SEQ ID NO: 294329 - RNA, 22 nt, Homo sapiens
cuggcaccauacacuguuguug

SEQ ID NO: 294330 - RNA, 22 nt, Homo sapiens
cuggcccaguucugcguuuugc

SEQ ID NO: 294331 - RNA, 22 nt, Homo sapiens
cuggcuaagugcuugagugugc

SEQ ID NO: 294332 - RNA, 22 nt, Homo sapiens
cuggcucauuucauuuagcaua

SEQ ID NO: 294333 - RNA, 22 nt, Homo sapiens
cuggcucugggcuaaagaaaua

SEQ ID NO: 294334 - RNA, 22 nt, Homo sapiens
cuggcucuguuagaagaaccag

SEQ ID NO: 294335 - RNA, 22 nt, Homo sapiens
cugggaucaguucuagucagaa

SEQ ID NO: 294336 - RNA, 22 nt, Homo sapiens
cugggguaggacuggcuuuuga

SEQ ID NO: 294337 - RNA, 22 nt, Homo sapiens
cugggucaguuucugauuauug

SEQ ID NO: 294338 - RNA, 21 nt, Homo sapiens
cugguccccuuuauguaugug

SEQ ID NO: 294339 - RNA, 22 nt, Homo sapiens
cuggugagaugucuuuccucuu

SEQ ID NO: 294340 - RNA, 22 nt, Homo sapiens
cugguuuguaaaguuccugaga

SEQ ID NO: 294341 - RNA, 22 nt, Homo sapiens
cuguaaaguucucauuguagcc

SEQ ID NO: 294342 - RNA, 22 nt, Homo sapiens
cuguaacagaauaaauuuguuu

SEQ ID NO: 294343 - RNA, 22 nt, Homo sapiens
cuguaagcauuauaaagagaua

SEQ ID NO: 294344 - RNA, 22 nt, Homo sapiens
cuguaguuagcagaugaugaau

SEQ ID NO: 294345 - RNA, 22 nt, Homo sapiens
cuguaugugagaaauaauaagu

SEQ ID NO: 294346 - RNA, 22 nt, Homo sapiens
cuguauguuucuaugaauguga

SEQ ID NO: 294347 - RNA, 22 nt, Homo sapiens
cugucacugggaggggcagcag

SEQ ID NO: 294348 - RNA, 22 nt, Homo sapiens
cugucuggaggccugcaaauaa

SEQ ID NO: 294349 - RNA, 22 nt, Homo sapiens
cugucuguuucaaaagugguua

SEQ ID NO: 294350 - RNA, 22 nt, Homo sapiens
cugugcauguaugcgugaguuc

SEQ ID NO: 294351 - RNA, 22 nt, Homo sapiens
cugugcauguuguccaauucuu

SEQ ID NO: 294352 - RNA, 22 nt, Homo sapiens
cugugcauuggaugucucccug

SEQ ID NO: 294353 - RNA, 19 nt, Homo sapiens
cugugcauuucuguggaag

SEQ ID NO: 294354 - RNA, 22 nt, Homo sapiens
cugugcuugagagaugacacag

SEQ ID NO: 294355 - RNA, 22 nt, Homo sapiens
cuguucaaauuguuugugaagu

SEQ ID NO: 294356 - RNA, 22 nt, Homo sapiens
cuguugcaguuauggcugcagg

SEQ ID NO: 294357 - RNA, 22 nt, Homo sapiens
cuguuuguuuaggguacucaga

SEQ ID NO: 294358 - RNA, 22 nt, Homo sapiens
cuuaagcauugacuuuggacag

SEQ ID NO: 294359 - RNA, 20 nt, Homo sapiens
cuuaaugcagcauuucucag

SEQ ID NO: 294360 - RNA, 22 nt, Homo sapiens
cuuaggguacuuuggugcauca

SEQ ID NO: 294361 - RNA, 22 nt, Homo sapiens
cuucaaaguuggcuaggagaca

SEQ ID NO: 294362 - RNA, 22 nt, Homo sapiens
cuucaagucuuuggauaauuag

SEQ ID NO: 294363 - RNA, 20 nt, Homo sapiens
cuucacagaaguggaaucau

SEQ ID NO: 294364 - RNA, 22 nt, Homo sapiens
cuucacggugccuacuuguguc

SEQ ID NO: 294365 - RNA, 22 nt, Homo sapiens
cuucacuggagucccuggauuc

SEQ ID NO: 294366 - RNA, 22 nt, Homo sapiens
cuuccauaguauuuuuacaaaa

SEQ ID NO: 294367 - RNA, 22 nt, Homo sapiens
cuuccauaguuacacccaggga

SEQ ID NO: 294368 - RNA, 22 nt, Homo sapiens
cuucuugcuguguccucacaug

SEQ ID NO: 294369 - RNA, 23 nt, Homo sapiens
cuugagacaaaugcgugugugca

SEQ ID NO: 294370 - RNA, 22 nt, Homo sapiens
cuugagcaaacaaaggugguag

SEQ ID NO: 294371 - RNA, 22 nt, Homo sapiens
cuugagcuugagauccuuucug

SEQ ID NO: 294372 - RNA, 22 nt, Homo sapiens
cuugcacauuacagaucugcau

SEQ ID NO: 294373 - RNA, 22 nt, Homo sapiens
cuugcacuugaaauuccaguuu

SEQ ID NO: 294374 - RNA, 22 nt, Homo sapiens
cuugcauuuuggagaaugcuga

SEQ ID NO: 294375 - RNA, 22 nt, Homo sapiens
cuugccuacucacugguuuacu

SEQ ID NO: 294376 - RNA, 20 nt, Homo sapiens
cuugccuagcccuuugccuc

SEQ ID NO: 294377 - RNA, 22 nt, Homo sapiens
cuuggcacugcucacccuccuu

SEQ ID NO: 294378 - RNA, 22 nt, Homo sapiens
cuuggcuccgacuccccuccaa

SEQ ID NO: 294379 - RNA, 22 nt, Homo sapiens
cuugguacucugugucccagcu

SEQ ID NO: 294380 - RNA, 19 nt, Homo sapiens
cuuguacucggcgcaguug

SEQ ID NO: 294381 - RNA, 22 nt, Homo sapiens
cuuuaguugucuccucaagggu

SEQ ID NO: 294382 - RNA, 22 nt, Homo sapiens
cuuucucagugagacccgagau

SEQ ID NO: 294383 - RNA, 21 nt, Homo sapiens
cuuugcacugcuccucagcuc

SEQ ID NO: 294384 - RNA, 22 nt, Homo sapiens
cuuuggcaaugucauuuucaau

SEQ ID NO: 294385 - RNA, 22 nt, Homo sapiens
uguuaugaagaugccugguaca

SEQ ID NO: 294386 - RNA, 22 nt, Homo sapiens
uguuauugagguuacuuauaag

SEQ ID NO: 294387 - RNA, 22 nt, Homo sapiens
uguucuggagaggcaggccaca

SEQ ID NO: 294388 - RNA, 22 nt, Homo sapiens
uguucuugagccuuuagaccua

SEQ ID NO: 294389 - RNA, 22 nt, Homo sapiens
uguugcacuccagccugggcaa

SEQ ID NO: 294390 - RNA, 22 nt, Homo sapiens
uguugguuaaaucagguuuuaa

SEQ ID NO: 294391 - RNA, 22 nt, Homo sapiens
uguuucuacugucucuguagua

SEQ ID NO: 294392 - RNA, 22 nt, Homo sapiens
uucucuaguuacuuuaauggag

SEQ ID NO: 294393 - RNA, 19 nt, Homo sapiens
uucucugguuguacuaccc

SEQ ID NO: 294394 - RNA, 22 nt, Homo sapiens
uucugcuagucugucagaucuu

SEQ ID NO: 294395 - RNA, 22 nt, Homo sapiens
uucuggcuaugggauacuaaau

SEQ ID NO: 294396 - RNA, 22 nt, Homo sapiens
uucuggcucgauucucugaccg

SEQ ID NO: 294397 - RNA, 22 nt, Homo sapiens
uucuggcuuauaaacgugacuu

SEQ ID NO: 294398 - RNA, 22 nt, Homo sapiens
uucuggcuuuuaaagaaauguu

SEQ ID NO: 294399 - RNA, 19 nt, Homo sapiens
uucugguguuuuaagccaa

SEQ ID NO: 294400 - RNA, 22 nt, Homo sapiens
uucugguuaauacuugcaaaaa

SEQ ID NO: 294401 - RNA, 22 nt, Homo sapiens
uucugugcuuguggaugaagug

SEQ ID NO: 294402 - RNA, 22 nt, Homo sapiens
uucugugguagaaaucucaaau

SEQ ID NO: 294403 - RNA, 22 nt, Homo sapiens
uucugugguuucauuuaccugu

SEQ ID NO: 294404 - RNA, 22 nt, Homo sapiens
uucuuagucaaguuguauuuca

SEQ ID NO: 294405 - RNA, 22 nt, Homo sapiens
uucuuaguggcaccacuuuuuu

SEQ ID NO: 294406 - RNA, 22 nt, Homo sapiens
uucuugcacuuggcccucauua

SEQ ID NO: 294407 - RNA, 22 nt, Homo sapiens
uucuugcuguauccucacaugg

SEQ ID NO: 294408 - RNA, 22 nt, Homo sapiens
uucuugguguaguaguugaaaa

SEQ ID NO: 294409 - RNA, 18 nt, Homo sapiens
uucuuguguugauauuuu

SEQ ID NO: 294410 - RNA, 22 nt, Homo sapiens
uucuuugcuuggaagcggggga

SEQ ID NO: 294411 - RNA, 22 nt, Homo sapiens
uucuuuggaaacaguacuaauu

SEQ ID NO: 294412 - RNA, 22 nt, Homo sapiens
uucuuugguacaagggccgacc

SEQ ID NO: 294413 - RNA, 19 nt, Homo sapiens
uucuuuguugugggggcug

SEQ ID NO: 294414 - RNA, 22 nt, Homo sapiens
uugaaagucauggcacaggcaa

SEQ ID NO: 294415 - RNA, 22 nt, Homo sapiens
uugaacugguaguuggaaaucu

SEQ ID NO: 294416 - RNA, 22 nt, Homo sapiens
uugaauggaauguuggaacuau

SEQ ID NO: 294417 - RNA, 22 nt, Homo sapiens
uugacagaccuuggucauaucc

SEQ ID NO: 294418 - RNA, 21 nt, Homo sapiens
uugacagugacagguaaaguu

SEQ ID NO: 294419 - RNA, 22 nt, Homo sapiens
uugacaguggcuuaaauugguu

SEQ ID NO: 294420 - RNA, 22 nt, Homo sapiens
uugaccaaagaagagucauugc

SEQ ID NO: 294421 - RNA, 22 nt, Homo sapiens
uugaccucaucacuucccaaag

SEQ ID NO: 294422 - RNA, 22 nt, Homo sapiens
uugacguaggaggauguugaga

SEQ ID NO: 294423 - RNA, 22 nt, Homo sapiens
uugacuacaccaugccaggaac

SEQ ID NO: 294424 - RNA, 22 nt, Homo sapiens
uugacuccagagugaguaaaug

SEQ ID NO: 294425 - RNA, 23 nt, Homo sapiens
uugacuguggguacaaugugaua

SEQ ID NO: 294426 - RNA, 22 nt, Homo sapiens
uugauugacaugucucuguuca

SEQ ID NO: 294427 - RNA, 21 nt, Homo sapiens
uugcaaaugcugcugccugau

SEQ ID NO: 294428 - RNA, 22 nt, Homo sapiens
uugcaagaaaucagagccuucc

SEQ ID NO: 294429 - RNA, 22 nt, Homo sapiens
uugcacaauccugugagugagu

SEQ ID NO: 294430 - RNA, 20 nt, Homo sapiens
uugcacagagaaggaggcag

SEQ ID NO: 294431 - RNA, 22 nt, Homo sapiens
uugcacauugauuuuguaucuu

SEQ ID NO: 294432 - RNA, 22 nt, Homo sapiens
uugcaccuuaugucuguucucu

SEQ ID NO: 294433 - RNA, 22 nt, Homo sapiens
uugcacuccggccuggguaaca

SEQ ID NO: 294434 - RNA, 22 nt, Homo sapiens
uugcacuucauguaggccaaag

SEQ ID NO: 294435 - RNA, 23 nt, Homo sapiens
ugacagaccuucuggaagaaguc

SEQ ID NO: 294436 - RNA, 22 nt, Homo sapiens
ugacagagaagcauugaguuca

SEQ ID NO: 294437 - RNA, 22 nt, Homo sapiens
ugacagcugaggcccagaguac

SEQ ID NO: 294438 - RNA, 22 nt, Homo sapiens
ugacagcuguugaggcauuuau

SEQ ID NO: 294439 - RNA, 22 nt, Homo sapiens
ugacagucaccaggacccacag

SEQ ID NO: 294440 - RNA, 22 nt, Homo sapiens
ugacagugaacagguuaccacu

SEQ ID NO: 294441 - RNA, 22 nt, Homo sapiens
ugacagugaauaagucucuuaa

SEQ ID NO: 294442 - RNA, 22 nt, Homo sapiens
ugacaguguccucauucccaac

SEQ ID NO: 294443 - RNA, 22 nt, Homo sapiens
ugacagugugagacuuugucuc

SEQ ID NO: 294444 - RNA, 22 nt, Homo sapiens
ugacaugaaggcaccucugucc

SEQ ID NO: 294445 - RNA, 22 nt, Homo sapiens
ugacauggagagagaagccuuu

SEQ ID NO: 294446 - RNA, 23 nt, Homo sapiens
ugacauguaauucaguccagcag

SEQ ID NO: 294447 - RNA, 22 nt, Homo sapiens
ugacauguagagaacuucucau

SEQ ID NO: 294448 - RNA, 21 nt, Homo sapiens
ugacauguugguguucugcac

SEQ ID NO: 294449 - RNA, 22 nt, Homo sapiens
ugaccacugucuaagauaggug

SEQ ID NO: 294450 - RNA, 22 nt, Homo sapiens
ugacccauagaaauguggauaa

SEQ ID NO: 294451 - RNA, 22 nt, Homo sapiens
ugacggaggacaccugcggaau

SEQ ID NO: 294452 - RNA, 22 nt, Homo sapiens
ugacggaggcauuggaagcuug

SEQ ID NO: 294453 - RNA, 22 nt, Homo sapiens
ugacuaaaacugaguuucauua

SEQ ID NO: 294454 - RNA, 22 nt, Homo sapiens
ugacuagacuugcaagguugca

SEQ ID NO: 294455 - RNA, 22 nt, Homo sapiens
ugacuagagggcuuuuguguag

SEQ ID NO: 294456 - RNA, 22 nt, Homo sapiens
ugacuagggcucuaaacagcuc

SEQ ID NO: 294457 - RNA, 22 nt, Homo sapiens
ugacuauaggauaacaugcauu

SEQ ID NO: 294458 - RNA, 22 nt, Homo sapiens
ugacuauaguaaucacuucaca

SEQ ID NO: 294459 - RNA, 22 nt, Homo sapiens
ugacuauugauuuagacgugcu

SEQ ID NO: 294460 - RNA, 22 nt, Homo sapiens
ugacucaguuucucagguagua

SEQ ID NO: 294461 - RNA, 23 nt, Homo sapiens
ugacugaguauauguuuggugcu

SEQ ID NO: 294462 - RNA, 22 nt, Homo sapiens
ugacuggagaccucaguagggu

SEQ ID NO: 294463 - RNA, 22 nt, Homo sapiens
ugacuuaugcaacucugaugug

SEQ ID NO: 294464 - RNA, 22 nt, Homo sapiens
ugacuugaaacgugaacagauc

SEQ ID NO: 294465 - RNA, 22 nt, Homo sapiens
ugacuugauccauggggcucca

SEQ ID NO: 294466 - RNA, 21 nt, Homo sapiens
ugagaacaacaggucaagcag

SEQ ID NO: 294467 - RNA, 16 nt, Homo sapiens
ugagaacaugggguau

SEQ ID NO: 294468 - RNA, 16 nt, Homo sapiens
ugagaacaugugacau

SEQ ID NO: 294469 - RNA, 22 nt, Homo sapiens
ugagaacaugugauauuuggug

SEQ ID NO: 294470 - RNA, 20 nt, Homo sapiens
ugagaacauguggcauuugg

SEQ ID NO: 294471 - RNA, 17 nt, Homo sapiens
ugagaacaugugguauu

SEQ ID NO: 294472 - RNA, 20 nt, Homo sapiens
ugagaacaugugguauuugg

SEQ ID NO: 294473 - RNA, 22 nt, Homo sapiens
ugagaacuagagaacaagguga

SEQ ID NO: 294474 - RNA, 22 nt, Homo sapiens
ugagaauauuugaagauguuag

SEQ ID NO: 294475 - RNA, 22 nt, Homo sapiens
ugagaaugaugauugguaaacc

SEQ ID NO: 294476 - RNA, 22 nt, Homo sapiens
ugagacaaucucaucucaguga

SEQ ID NO: 294477 - RNA, 22 nt, Homo sapiens
ugagacaugugaacuguaguuc

SEQ ID NO: 294478 - RNA, 22 nt, Homo sapiens
ugagacaugugaauauuuguac

SEQ ID NO: 294479 - RNA, 22 nt, Homo sapiens
ugagacggagucucacucuguu

SEQ ID NO: 294480 - RNA, 22 nt, Homo sapiens
ugagacggagucucgcucuguc

SEQ ID NO: 294481 - RNA, 22 nt, Homo sapiens
ugagacggagucucgcucuguu

SEQ ID NO: 294482 - RNA, 22 nt, Homo sapiens
ugagacggagucuugcuaaguu

SEQ ID NO: 294483 - RNA, 22 nt, Homo sapiens
ugagacggagucuugcucuguc

SEQ ID NO: 294484 - RNA, 22 nt, Homo sapiens
ugagacggaguuucacucuugu

SEQ ID NO: 294485 - RNA, 22 nt, Homo sapiens
ugagacggaguuucgcucuugu

SEQ ID NO: 294486 - RNA, 22 nt, Homo sapiens
ugagacugaaauuaggaaacug

SEQ ID NO: 294487 - RNA, 22 nt, Homo sapiens
ugagacugaguuucgcucuugu

SEQ ID NO: 294488 - RNA, 22 nt, Homo sapiens
ugagacugaguuucucucuugu

SEQ ID NO: 294489 - RNA, 22 nt, Homo sapiens
ugcaaguggauuuuuccccaga

SEQ ID NO: 294490 - RNA, 22 nt, Homo sapiens
ugcaaucauuuggaggagaaga

SEQ ID NO: 294491 - RNA, 18 nt, Homo sapiens
ugcaauggagaugcagcc

SEQ ID NO: 294492 - RNA, 22 nt, Homo sapiens
ugcaaugugaaauaagcacauc

SEQ ID NO: 294493 - RNA, 17 nt, Homo sapiens
ugcaauuuaagcuagau

SEQ ID NO: 294494 - RNA, 22 nt, Homo sapiens
ugcacaguccagugcccacuga

SEQ ID NO: 294495 - RNA, 22 nt, Homo sapiens
ugcaccaauucuaaacaguucu

SEQ ID NO: 294496 - RNA, 22 nt, Homo sapiens
ugcaccacacuccauccugggc

SEQ ID NO: 294497 - RNA, 22 nt, Homo sapiens
ugcaccacugcaccccagucug

SEQ ID NO: 294498 - RNA, 22 nt, Homo sapiens
ugcaccacugcacuccaggcug

SEQ ID NO: 294499 - RNA, 22 nt, Homo sapiens
ugcaccacugcacuucagccug

SEQ ID NO: 294500 - RNA, 22 nt, Homo sapiens
ugcaccacugcuagccugggua

SEQ ID NO: 294501 - RNA, 18 nt, Homo sapiens
ugcaccaguuuacacuuc

SEQ ID NO: 294502 - RNA, 22 nt, Homo sapiens
ugcaccauugcauacuuaauua

SEQ ID NO: 294503 - RNA, 20 nt, Homo sapiens
ugcagcacgggcccuuucca

SEQ ID NO: 294504 - RNA, 20 nt, Homo sapiens
ugcagcacugggaaugcagu

SEQ ID NO: 294505 - RNA, 22 nt, Homo sapiens
ugcagcauguaggcacguuauu

SEQ ID NO: 294506 - RNA, 21 nt, Homo sapiens
ugcagccauucagcccuaugc

SEQ ID NO: 294507 - RNA, 23 nt, Homo sapiens
ugcagcuacauguggccaugugc

SEQ ID NO: 294508 - RNA, 22 nt, Homo sapiens
ugcagguacuugacaacuuggg

SEQ ID NO: 294509 - RNA, 22 nt, Homo sapiens
ugcaguacauucagcauccucu

SEQ ID NO: 294510 - RNA, 22 nt, Homo sapiens
ugcaguagugugaucuuggcuc

SEQ ID NO: 294511 - RNA, 22 nt, Homo sapiens
ugcagugcaugacuguguuaug

SEQ ID NO: 294512 - RNA, 21 nt, Homo sapiens
ugcagugugguugcccugcug

SEQ ID NO: 294513 - RNA, 22 nt, Homo sapiens
ugcauacacaagcauacaugua

SEQ ID NO: 294514 - RNA, 22 nt, Homo sapiens
ugcauagaauguucuguaaaua

SEQ ID NO: 294515 - RNA, 22 nt, Homo sapiens
uugucaguguucacucaaagcu

SEQ ID NO: 294516 - RNA, 22 nt, Homo sapiens
uugucauuuucagaguguuacg

SEQ ID NO: 294517 - RNA, 22 nt, Homo sapiens
uuguccccacccaaaugucauc

SEQ ID NO: 294518 - RNA, 23 nt, Homo sapiens
uuguccccuccaaagcucauguu

SEQ ID NO: 294519 - RNA, 22 nt, Homo sapiens
uugucuagugaauacauuaaug

SEQ ID NO: 294520 - RNA, 22 nt, Homo sapiens
aaaagcuuagaugggcuuguau

SEQ ID NO: 294521 - RNA, 22 nt, Homo sapiens
aaacugcuuuccaugguggcug

SEQ ID NO: 294522 - RNA, 23 nt, Homo sapiens
aaagacuagucaggugcaguggu

SEQ ID NO: 294523 - RNA, 22 nt, Homo sapiens
aaagagaucuaugggcacuaug

SEQ ID NO: 294524 - RNA, 22 nt, Homo sapiens
aaagcacuggagucaucaucua

SEQ ID NO: 294525 - RNA, 22 nt, Homo sapiens
aaaggcacacacuccuuguuau

SEQ ID NO: 294526 - RNA, 22 nt, Homo sapiens
aaaggcacuagaaguuaccuuu

SEQ ID NO: 294527 - RNA, 22 nt, Homo sapiens
aaaggcacugaucuuauccagu

SEQ ID NO: 294528 - RNA, 22 nt, Homo sapiens
aaagggcuugaauacucuuuuu

SEQ ID NO: 294529 - RNA, 22 nt, Homo sapiens
aaagguaguacuucuagaaggg

SEQ ID NO: 294530 - RNA, 22 nt, Homo sapiens
aaaguacucaguucaguuccgu

SEQ ID NO: 294531 - RNA, 19 nt, Homo sapiens
aaaguacucugaugccucu

SEQ ID NO: 294532 - RNA, 22 nt, Homo sapiens
aaagucacuggagaaggaauau

SEQ ID NO: 294533 - RNA, 22 nt, Homo sapiens
aaagugacuuagugccccauuu

SEQ ID NO: 294534 - RNA, 22 nt, Homo sapiens
aaagugauuguaguuuuugcca

SEQ ID NO: 294535 - RNA, 22 nt, Homo sapiens
aaagugcaguacuucguauauu

SEQ ID NO: 294536 - RNA, 22 nt, Homo sapiens
aaagugccugacucauaguuag

SEQ ID NO: 294537 - RNA, 22 nt, Homo sapiens
aaagugcugagaguucuaacuu

SEQ ID NO: 294538 - RNA, 22 nt, Homo sapiens
aaagugcugggaucacacugaa

SEQ ID NO: 294539 - RNA, 22 nt, Homo sapiens
aaagugcugggauuggcugggc

SEQ ID NO: 294540 - RNA, 22 nt, Homo sapiens
aaaguggacuaagugaauauga

SEQ ID NO: 294541 - RNA, 22 nt, Homo sapiens
aaaguucuugcugaaggauuau

SEQ ID NO: 294542 - RNA, 15 nt, Homo sapiens
aaauaugucaguucu

SEQ ID NO: 294543 - RNA, 22 nt, Homo sapiens
aaauccauuuguucagcuaugc

SEQ ID NO: 294544 - RNA, 22 nt, Homo sapiens
aaaugcacgcuacccagcuaga

SEQ ID NO: 294545 - RNA, 22 nt, Homo sapiens
aaaugcagauuccuaggcccca

SEQ ID NO: 294546 - RNA, 22 nt, Homo sapiens
aaaugcagcacucaagugggaa

SEQ ID NO: 294547 - RNA, 22 nt, Homo sapiens
aaaugcauaucaagauugcccu

SEQ ID NO: 294548 - RNA, 22 nt, Homo sapiens
aaaugcaugaauaagcucgugu

SEQ ID NO: 294549 - RNA, 22 nt, Homo sapiens
aaaugcauugagggaaaaggca

SEQ ID NO: 294550 - RNA, 22 nt, Homo sapiens
aaaugcucucuacacguuucug

SEQ ID NO: 294551 - RNA, 22 nt, Homo sapiens
aaaugcugcuuuggccucuucu

SEQ ID NO: 294552 - RNA, 22 nt, Homo sapiens
aaaugcugucugugagccucau

SEQ ID NO: 294553 - RNA, 22 nt, Homo sapiens
aaaugcuuucuuggaccauuug

SEQ ID NO: 294554 - RNA, 22 nt, Homo sapiens
aaauggcacaguaagggcauuu

SEQ ID NO: 294555 - RNA, 22 nt, Homo sapiens
aaaugguguuaguagaucuuua

SEQ ID NO: 294556 - RNA, 19 nt, Homo sapiens
aaaugugcacuguuuucca

SEQ ID NO: 294557 - RNA, 21 nt, Homo sapiens
aaaugugcuuuaguacccuca

SEQ ID NO: 294558 - RNA, 22 nt, Homo sapiens
aaauugcaguuaggaugauggu

SEQ ID NO: 294559 - RNA, 22 nt, Homo sapiens
aaauugcuuuugaagacuuagu

SEQ ID NO: 294560 - RNA, 22 nt, Homo sapiens
aacacuguuuccagucaugauc

SEQ ID NO: 294561 - RNA, 22 nt, Homo sapiens
aacagagcuggugacuccaggu

SEQ ID NO: 294562 - RNA, 22 nt, Homo sapiens
aacagcacacccgcugcuucca

SEQ ID NO: 294563 - RNA, 20 nt, Homo sapiens
aacagcacugucugaagcuu

SEQ ID NO: 294564 - RNA, 22 nt, Homo sapiens
aacagugcauucagggauauau

SEQ ID NO: 294565 - RNA, 21 nt, Homo sapiens
aacagugcugaacagacaccu

SEQ ID NO: 294566 - RNA, 22 nt, Homo sapiens
aacagugcuucauucacacauu

SEQ ID NO: 294567 - RNA, 22 nt, Homo sapiens
aacaucaaccaugaggguugga

SEQ ID NO: 294568 - RNA, 19 nt, Homo sapiens
aaccgggagugcacauguu

SEQ ID NO: 294569 - RNA, 22 nt, Homo sapiens
aaccuucauuccuuucccugcc

SEQ ID NO: 294570 - RNA, 22 nt, Homo sapiens
aaccuuuagucagcucuuagga

SEQ ID NO: 294571 - RNA, 22 nt, Homo sapiens
aacuacaucucuuugaggcagg

SEQ ID NO: 294572 - RNA, 22 nt, Homo sapiens
aacucacauucuuucuugguac

SEQ ID NO: 294573 - RNA, 22 nt, Homo sapiens
aacucugucuccuucaaguuca

SEQ ID NO: 294574 - RNA, 22 nt, Homo sapiens
aacugcacauauuuguaugggu

SEQ ID NO: 294575 - RNA, 22 nt, Homo sapiens
aacugcauuuucugauugugug

SEQ ID NO: 294576 - RNA, 22 nt, Homo sapiens
aacugcuguuuggguacuggug

SEQ ID NO: 294577 - RNA, 22 nt, Homo sapiens
aacuggcauagccagacuucuc

SEQ ID NO: 294578 - RNA, 21 nt, Homo sapiens
aacuggugugagaugguaugu

SEQ ID NO: 294579 - RNA, 22 nt, Homo sapiens
aagagagcuaugugcauaauua

SEQ ID NO: 294580 - RNA, 22 nt, Homo sapiens
aagagaugaagguccugacugu

SEQ ID NO: 294581 - RNA, 22 nt, Homo sapiens
aagagcauuggauggggagauu

SEQ ID NO: 294582 - RNA, 22 nt, Homo sapiens
aagaggccuaggaaucuguauu

SEQ ID NO: 294583 - RNA, 22 nt, Homo sapiens
aagagguagcagucacaaaaga

SEQ ID NO: 294584 - RNA, 22 nt, Homo sapiens
aagagguuauagaguguauacu

SEQ ID NO: 294585 - RNA, 20 nt, Homo sapiens
agcaucauugcaauuuguca

SEQ ID NO: 294586 - RNA, 22 nt, Homo sapiens
agcaucauuugauguucccgag

SEQ ID NO: 294587 - RNA, 22 nt, Homo sapiens
agcauuacaugguacagagaag

SEQ ID NO: 294588 - RNA, 22 nt, Homo sapiens
agccaagacucuguuccccuug

SEQ ID NO: 294589 - RNA, 22 nt, Homo sapiens
agccaguauuuuauugaggauu

SEQ ID NO: 294590 - RNA, 21 nt, Homo sapiens
agccaguguuccuuguggcuc

SEQ ID NO: 294591 - RNA, 17 nt, Homo sapiens
agccccauuagcuaguu

SEQ ID NO: 294592 - RNA, 22 nt, Homo sapiens
agccccauuuguugaaaagacg

SEQ ID NO: 294593 - RNA, 23 nt, Homo sapiens
agcccugugacucgaacgaggag

SEQ ID NO: 294594 - RNA, 22 nt, Homo sapiens
agccuguagugagcugugauug

SEQ ID NO: 294595 - RNA, 22 nt, Homo sapiens
agccuguguugaauuauagaaa

SEQ ID NO: 294596 - RNA, 23 nt, Homo sapiens
agccuguugccuaggcagcucau

SEQ ID NO: 294597 - RNA, 22 nt, Homo sapiens
agcgccacugcacuccagccug

SEQ ID NO: 294598 - RNA, 22 nt, Homo sapiens
agcggcuguuccccuggucuau

SEQ ID NO: 294599 - RNA, 22 nt, Homo sapiens
agcuacaucuugcucugggaug

SEQ ID NO: 294600 - RNA, 23 nt, Homo sapiens
agcuagagaggcuggggauacag

SEQ ID NO: 294601 - RNA, 18 nt, Homo sapiens
agcucaguguuugcuuac

SEQ ID NO: 294602 - RNA, 22 nt, Homo sapiens
agcuccaucuucagggguucag

SEQ ID NO: 294603 - RNA, 22 nt, Homo sapiens
agcuccuacuguuacaucauug

SEQ ID NO: 294604 - RNA, 22 nt, Homo sapiens
agcugauuuuaaguccuugucc

SEQ ID NO: 294605 - RNA, 22 nt, Homo sapiens
agcugcaauguuuaguauaaua

SEQ ID NO: 294606 - RNA, 22 nt, Homo sapiens
agcugcacaaauggaugugagg

SEQ ID NO: 294607 - RNA, 22 nt, Homo sapiens
agcugcauuuacuuuugcacaa

SEQ ID NO: 294608 - RNA, 22 nt, Homo sapiens
agcuggauguauguuaagugaa

SEQ ID NO: 294609 - RNA, 22 nt, Homo sapiens
agcuggauuguuuaccuggggc

SEQ ID NO: 294610 - RNA, 22 nt, Homo sapiens
agcuggcuguagcugcaagucu

SEQ ID NO: 294611 - RNA, 23 nt, Homo sapiens
agcugguacuagaggcuugcgcc

SEQ ID NO: 294612 - RNA, 22 nt, Homo sapiens
agcugguauuuugucgaggacu

SEQ ID NO: 294613 - RNA, 21 nt, Homo sapiens
agcugguuucuucuuacuccu

SEQ ID NO: 294614 - RNA, 20 nt, Homo sapiens
agcuguuguuaugagguuua

SEQ ID NO: 294615 - RNA, 22 nt, Homo sapiens
agcuuguccuccacccacacug

SEQ ID NO: 294616 - RNA, 22 nt, Homo sapiens
agcuugugauucuccaucaugu

SEQ ID NO: 294617 - RNA, 22 nt, Homo sapiens
agcuuguguuugucugccuggg

SEQ ID NO: 294618 - RNA, 22 nt, Homo sapiens
agcuuuggauaccugcuguucc

SEQ ID NO: 294619 - RNA, 22 nt, Homo sapiens
aggaacuguaacuaugucucug

SEQ ID NO: 294620 - RNA, 22 nt, Homo sapiens
aggaaguaauaaguuugguucu

SEQ ID NO: 294621 - RNA, 22 nt, Homo sapiens
aggaagugugcaauuaauuucu

SEQ ID NO: 294622 - RNA, 22 nt, Homo sapiens
aggaaugcuaaguuuuccuccu

SEQ ID NO: 294623 - RNA, 18 nt, Homo sapiens
aggaaugguaauacuuca

SEQ ID NO: 294624 - RNA, 22 nt, Homo sapiens
aggagaauugguucuucuugau

SEQ ID NO: 294625 - RNA, 22 nt, Homo sapiens
aggagaugaagcuuuaucuaaa

SEQ ID NO: 294626 - RNA, 22 nt, Homo sapiens
aggagcacaauggucaugugga

SEQ ID NO: 294627 - RNA, 22 nt, Homo sapiens
aggagcacaggacuuugauuau

SEQ ID NO: 294628 - RNA, 20 nt, Homo sapiens
aggagcauuuacauuggcuc

SEQ ID NO: 294629 - RNA, 22 nt, Homo sapiens
aggagcuuuggggaaaacagau

SEQ ID NO: 294630 - RNA, 22 nt, Homo sapiens
aggaggauugcuuucaucuuuu

SEQ ID NO: 294631 - RNA, 22 nt, Homo sapiens
aggaguguguauuaaugaaauu

SEQ ID NO: 294632 - RNA, 21 nt, Homo sapiens
aggauaguagauuaaauauuu

SEQ ID NO: 294633 - RNA, 22 nt, Homo sapiens
aggaucauugacuauuauaagg

SEQ ID NO: 294634 - RNA, 22 nt, Homo sapiens
aggcaacaugguaaaacccugu

SEQ ID NO: 294635 - RNA, 22 nt, Homo sapiens
aggcaagaaugcuuguuucacc

SEQ ID NO: 294636 - RNA, 22 nt, Homo sapiens
aggcacgguggcucacaccugu

SEQ ID NO: 294637 - RNA, 22 nt, Homo sapiens
aggcacggugucucaugccugu

SEQ ID NO: 294638 - RNA, 22 nt, Homo sapiens
aggcagaugagguccucagcug

SEQ ID NO: 294639 - RNA, 22 nt, Homo sapiens
aggcaggugaaagauaguuuua

SEQ ID NO: 294640 - RNA, 22 nt, Homo sapiens
aggcaugaguucagaggguaug

SEQ ID NO: 294641 - RNA, 22 nt, Homo sapiens
aggcauggagacuaaaauuaua

SEQ ID NO: 294642 - RNA, 22 nt, Homo sapiens
aggcuagacuuugagaauuuuu

SEQ ID NO: 294643 - RNA, 22 nt, Homo sapiens
aggcuuuuggagaacacugcac

SEQ ID NO: 294644 - RNA, 22 nt, Homo sapiens
agggccuuuguagauguacuca

SEQ ID NO: 294645 - RNA, 22 nt, Homo sapiens
aggguaguaggcuugggauugg

SEQ ID NO: 294646 - RNA, 20 nt, Homo sapiens
agguagauagaugauagaua

SEQ ID NO: 294647 - RNA, 22 nt, Homo sapiens
aggugaaugcucacauucuaau

SEQ ID NO: 294648 - RNA, 22 nt, Homo sapiens
aggugaauggauaaacuguggg

SEQ ID NO: 294649 - RNA, 22 nt, Homo sapiens
aggugacugguuuaucuggcag

SEQ ID NO: 294650 - RNA, 22 nt, Homo sapiens
aggugcaugcuucacuggauau

SEQ ID NO: 294651 - RNA, 21 nt, Homo sapiens
aggugucuuggguucccuggc

SEQ ID NO: 294652 - RNA, 22 nt, Homo sapiens
aguaacaggauccaaagaaugu

SEQ ID NO: 294653 - RNA, 22 nt, Homo sapiens
aguaacauuucuaguagagagu

SEQ ID NO: 294654 - RNA, 22 nt, Homo sapiens
aguacacuguuaaaaagaagug

SEQ ID NO: 294655 - RNA, 22 nt, Homo sapiens
aguacacuguugaacagaagug

SEQ ID NO: 294656 - RNA, 23 nt, Homo sapiens
aguacuguaguaauugaggggaa

SEQ ID NO: 294657 - RNA, 22 nt, Homo sapiens
aguagcaauggcucugagcuau

SEQ ID NO: 294658 - RNA, 22 nt, Homo sapiens
aguagcacaugccacccugucu

SEQ ID NO: 294659 - RNA, 22 nt, Homo sapiens
aguagguguugguagagguuuc

SEQ ID NO: 294660 - RNA, 16 nt, Homo sapiens
aguaguuuuacagauu

SEQ ID NO: 294661 - RNA, 22 nt, Homo sapiens
aguaucaagccacacaugguca

SEQ ID NO: 294662 - RNA, 22 nt, Homo sapiens
aguauguuuugaaaccaagaag

SEQ ID NO: 294663 - RNA, 22 nt, Homo sapiens
agucaaaugcuuauguauaaag

SEQ ID NO: 294664 - RNA, 22 nt, Homo sapiens
agucaaguuuuuucagagaaua

SEQ ID NO: 294665 - RNA, 22 nt, Homo sapiens
agucacggugguuugcacuugu

SEQ ID NO: 294666 - RNA, 23 nt, Homo sapiens
agucaguaugcuccuuggauccc

SEQ ID NO: 294667 - RNA, 22 nt, Homo sapiens
agucagucuguccugugcugag

SEQ ID NO: 294668 - RNA, 22 nt, Homo sapiens
ugaaauguugggugauggaauc

SEQ ID NO: 294669 - RNA, 22 nt, Homo sapiens
ugaaauuauucuuaccaaggug

SEQ ID NO: 294670 - RNA, 22 nt, Homo sapiens
ugaacagagaaacacuggccau

SEQ ID NO: 294671 - RNA, 16 nt, Homo sapiens
ugaacagagaggauuc

SEQ ID NO: 294672 - RNA, 22 nt, Homo sapiens
ugaacagcuaucuugucagugu

SEQ ID NO: 294673 - RNA, 22 nt, Homo sapiens
ugaacagucaucucucuuguau

SEQ ID NO: 294674 - RNA, 22 nt, Homo sapiens
ugaagacucaguuugagggaca

SEQ ID NO: 294675 - RNA, 22 nt, Homo sapiens
ugaagaucauacugguggaggg

SEQ ID NO: 294676 - RNA, 20 nt, Homo sapiens
ugaaggaggucauuuauacc

SEQ ID NO: 294677 - RNA, 22 nt, Homo sapiens
ugaaguaauguuuuauucuauu

SEQ ID NO: 294678 - RNA, 22 nt, Homo sapiens
ugaagugaagacucacagaagg

SEQ ID NO: 294679 - RNA, 22 nt, Homo sapiens
ugaauaguaauguguuuggucu

SEQ ID NO: 294680 - RNA, 18 nt, Homo sapiens
ugaauaguguccccauga

SEQ ID NO: 294681 - RNA, 22 nt, Homo sapiens
ugaauauguuaauuagcaucau

SEQ ID NO: 294682 - RNA, 22 nt, Homo sapiens
ugaauauuugcuacucacucuu

SEQ ID NO: 294683 - RNA, 22 nt, Homo sapiens
ugaaucauuucuugucuucagu

SEQ ID NO: 294684 - RNA, 22 nt, Homo sapiens
ugaaugauuuuaaaagccucuc

SEQ ID NO: 294685 - RNA, 22 nt, Homo sapiens
ugaaugcaucuagaaauuuauu

SEQ ID NO: 294686 - RNA, 22 nt, Homo sapiens
ugaaugcauggggccaagaagg

SEQ ID NO: 294687 - RNA, 22 nt, Homo sapiens
ugaaugguuuuuagagaacaau

SEQ ID NO: 294688 - RNA, 22 nt, Homo sapiens
ugaauguccauugauguuuuga

SEQ ID NO: 294689 - RNA, 22 nt, Homo sapiens
ugaauugucucucacuggguuc

SEQ ID NO: 294690 - RNA, 22 nt, Homo sapiens
ugaauuguuuacgagaugugag

SEQ ID NO: 294691 - RNA, 22 nt, Homo sapiens
ugacacagcaagauggaaccau

SEQ ID NO: 294692 - RNA, 22 nt, Homo sapiens
ugacacagugggggauccuuuu

SEQ ID NO: 294693 - RNA, 17 nt, Homo sapiens
ugacagaaacuuguugu

SEQ ID NO: 294694 - RNA, 22 nt, Homo sapiens
ugacaggucuaauuuacugaca

SEQ ID NO: 294695 - RNA, 22 nt, Homo sapiens
ugacagguugauaggugcagca

SEQ ID NO: 294696 - RNA, 22 nt, Homo sapiens
ugacagguuggaauuaugggag

SEQ ID NO: 294697 - RNA, 22 nt, Homo sapiens
ugacaguaaacagucuugauua

SEQ ID NO: 294698 - RNA, 23 nt, Homo sapiens
ugacagugcuugaaauugcucuu

SEQ ID NO: 294699 - RNA, 18 nt, Homo sapiens
ugacaguuucuuuauauu

SEQ ID NO: 294700 - RNA, 20 nt, Homo sapiens
ugacaucagcaauguaauaa

SEQ ID NO: 294701 - RNA, 22 nt, Homo sapiens
ugacaugauguuccuacacugu

SEQ ID NO: 294702 - RNA, 22 nt, Homo sapiens
ugacauggugcucuuucaggca

SEQ ID NO: 294703 - RNA, 22 nt, Homo sapiens
ugacauguauaucuuacgcuau

SEQ ID NO: 294704 - RNA, 21 nt, Homo sapiens
ugacauguuggugugcugcac

SEQ ID NO: 294705 - RNA, 22 nt, Homo sapiens
ugaccaaugacauugaagagcu

SEQ ID NO: 294706 - RNA, 22 nt, Homo sapiens
ugacuagagcaauuggaaacaa

SEQ ID NO: 294707 - RNA, 22 nt, Homo sapiens
ugacucaguuguuagucuucau

SEQ ID NO: 294708 - RNA, 22 nt, Homo sapiens
ugacuggaaacaguguuauuug

SEQ ID NO: 294709 - RNA, 22 nt, Homo sapiens
ugacuggaacuuuagugagucu

SEQ ID NO: 294710 - RNA, 20 nt, Homo sapiens
ugacuggauacccuuuggcu

SEQ ID NO: 294711 - RNA, 22 nt, Homo sapiens
ugacugugcagcuccaucaggg

SEQ ID NO: 294712 - RNA, 23 nt, Homo sapiens
ugacuuaggccucaacuaugacu

SEQ ID NO: 294713 - RNA, 22 nt, Homo sapiens
ugacuucauuugguaauugggu

SEQ ID NO: 294714 - RNA, 22 nt, Homo sapiens
ugacuugaacuucuaugucacc

SEQ ID NO: 294715 - RNA, 22 nt, Homo sapiens
ugacuugaguaacuggcucagg

SEQ ID NO: 294716 - RNA, 22 nt, Homo sapiens
ugagaacagauggcuuuauuau

SEQ ID NO: 294717 - RNA, 22 nt, Homo sapiens
ugagaacagcagcuugggacac

SEQ ID NO: 294718 - RNA, 16 nt, Homo sapiens
ugagaacaugugauau

SEQ ID NO: 294719 - RNA, 22 nt, Homo sapiens
ugagaacauuccucuuccuggc

SEQ ID NO: 294720 - RNA, 22 nt, Homo sapiens
ugagaacggauacuaagggcug

SEQ ID NO: 294721 - RNA, 22 nt, Homo sapiens
ugagaacucaugaaucuuucca

SEQ ID NO: 294722 - RNA, 22 nt, Homo sapiens
ugagaacuguuuugguuugggu

SEQ ID NO: 294723 - RNA, 22 nt, Homo sapiens
ugagaagacaucuuugcuuugu

SEQ ID NO: 294724 - RNA, 22 nt, Homo sapiens
ugagaagugacgcagcaggguu

SEQ ID NO: 294725 - RNA, 22 nt, Homo sapiens
ugagaaugcagaaucucgugca

SEQ ID NO: 294726 - RNA, 22 nt, Homo sapiens
ugagacacugaauccggccuga

SEQ ID NO: 294727 - RNA, 22 nt, Homo sapiens
ugagacauacuuacaggggaug

SEQ ID NO: 294728 - RNA, 22 nt, Homo sapiens
ugagacauauuauacugcuuuu

SEQ ID NO: 294729 - RNA, 22 nt, Homo sapiens
ugagacaucucuccugagacag

SEQ ID NO: 294730 - RNA, 22 nt, Homo sapiens
ugagacggaguuuugcucuugu

SEQ ID NO: 294731 - RNA, 22 nt, Homo sapiens
ugagacgucuucucuucuucaa

SEQ ID NO: 294732 - RNA, 22 nt, Homo sapiens
ugagacugagucucccucuguc

SEQ ID NO: 294733 - RNA, 22 nt, Homo sapiens
ugagacugagucucgcucuugu

SEQ ID NO: 294734 - RNA, 22 nt, Homo sapiens
ugagacugagucuugcucuauu

SEQ ID NO: 294735 - RNA, 22 nt, Homo sapiens
ugagagacagacauuaucuuau

SEQ ID NO: 294736 - RNA, 22 nt, Homo sapiens
ugagagaugaacuauucuugaa

SEQ ID NO: 294737 - RNA, 22 nt, Homo sapiens
ugagaguagggguugggauugg

SEQ ID NO: 294738 - RNA, 22 nt, Homo sapiens
ugagauaacuaaaaacauuuug

SEQ ID NO: 294739 - RNA, 21 nt, Homo sapiens
ugagauaauauguuucugaug

SEQ ID NO: 294740 - RNA, 22 nt, Homo sapiens
ugagauagaaaacauaggagaa

SEQ ID NO: 294741 - RNA, 20 nt, Homo sapiens
ugagauaguaauccccuaca

SEQ ID NO: 294742 - RNA, 22 nt, Homo sapiens
ugagauaguacuuuuuuaaagg

SEQ ID NO: 294743 - RNA, 22 nt, Homo sapiens
ugagauauugggaguaauguca

SEQ ID NO: 294744 - RNA, 22 nt, Homo sapiens
ugagaucaagguuaauauaauc

SEQ ID NO: 294745 - RNA, 22 nt, Homo sapiens
ugagaucacgccacugcacucc

SEQ ID NO: 294746 - RNA, 18 nt, Homo sapiens
ugagaucagcaucaaggg

SEQ ID NO: 294747 - RNA, 22 nt, Homo sapiens
ugagaucauguguggaccccag

SEQ ID NO: 294748 - RNA, 22 nt, Homo sapiens
ugagaucgaguuucgcucuugu

SEQ ID NO: 294749 - RNA, 22 nt, Homo sapiens
ugagaucugauaggccuggguu

SEQ ID NO: 294750 - RNA, 22 nt, Homo sapiens
ugagaucuuuuguggcugagaa

SEQ ID NO: 294751 - RNA, 19 nt, Homo sapiens
ugagaugaagacagggguu

SEQ ID NO: 294752 - RNA, 22 nt, Homo sapiens
ugagaugaagcuagaagaaugg

SEQ ID NO: 294753 - RNA, 22 nt, Homo sapiens
ugagaugaagucuugcucuguu

SEQ ID NO: 294754 - RNA, 22 nt, Homo sapiens
ugagaugaguucucgcucuguc

SEQ ID NO: 294755 - RNA, 22 nt, Homo sapiens
ugagaugcaaaaugagaauugu

SEQ ID NO: 294756 - RNA, 22 nt, Homo sapiens
ugagaugcuccucuugcaaagc

SEQ ID NO: 294757 - RNA, 22 nt, Homo sapiens
ugagaugcucgccggccagcau

SEQ ID NO: 294758 - RNA, 22 nt, Homo sapiens
ugagauggagucuugucgccua

SEQ ID NO: 294759 - RNA, 22 nt, Homo sapiens
ugagauggaguuucgcucuugu

SEQ ID NO: 294760 - RNA, 23 nt, Homo sapiens
ugagaugucugauugcgaggguc

SEQ ID NO: 294761 - RNA, 22 nt, Homo sapiens
ugagaugugaucaccugaaggg

SEQ ID NO: 294762 - RNA, 22 nt, Homo sapiens
ugagauguugcucugaaacaag

SEQ ID NO: 294763 - RNA, 22 nt, Homo sapiens
ugagauuauauuucuuaacaga

SEQ ID NO: 294764 - RNA, 22 nt, Homo sapiens
ugagcaagaaauagaaacagau

SEQ ID NO: 294765 - RNA, 22 nt, Homo sapiens
ugagcaauaaaguuacacaguu

SEQ ID NO: 294766 - RNA, 23 nt, Homo sapiens
ugagcaauauucuacuauugagu

SEQ ID NO: 294767 - RNA, 22 nt, Homo sapiens
ugagcacagcgugugggagagc

SEQ ID NO: 294768 - RNA, 22 nt, Homo sapiens
ugagcacaggugcgcgguuacu

SEQ ID NO: 294769 - RNA, 22 nt, Homo sapiens
ugagcacauuuacaucaguucc

SEQ ID NO: 294770 - RNA, 22 nt, Homo sapiens
ugagcauuguguuugacuguga

SEQ ID NO: 294771 - RNA, 22 nt, Homo sapiens
ugagccaugguuagcuucucau

SEQ ID NO: 294772 - RNA, 22 nt, Homo sapiens
ugagcuaggaucacaccugcau

SEQ ID NO: 294773 - RNA, 20 nt, Homo sapiens
ugagcucaugacauuuuucu

SEQ ID NO: 294774 - RNA, 22 nt, Homo sapiens
ugagcuccuucauaaaaaggca

SEQ ID NO: 294775 - RNA, 22 nt, Homo sapiens
ugagcugagaaaugcagcagcu

SEQ ID NO: 294776 - RNA, 22 nt, Homo sapiens
ugagcugagacaauaaguuuuu

SEQ ID NO: 294777 - RNA, 22 nt, Homo sapiens
ugagcugagauuaagcugcugc

SEQ ID NO: 294778 - RNA, 22 nt, Homo sapiens
ugagcugguacuaauauuauca

SEQ ID NO: 294779 - RNA, 22 nt, Homo sapiens
ugaggacugagaggcacugugg

SEQ ID NO: 294780 - RNA, 22 nt, Homo sapiens
ugaggaguguauuucauucgcu

SEQ ID NO: 294781 - RNA, 22 nt, Homo sapiens
ugaggauaguguugaaggcagg

SEQ ID NO: 294782 - RNA, 17 nt, Homo sapiens
ugaggcacuaguaucac

SEQ ID NO: 294783 - RNA, 22 nt, Homo sapiens
ugaggcacucuagacuuauuca

SEQ ID NO: 294784 - RNA, 22 nt, Homo sapiens
ugaggcuagucagaucagauga

SEQ ID NO: 294785 - RNA, 22 nt, Homo sapiens
ugagguaggugaagaaugcacg

SEQ ID NO: 294786 - RNA, 22 nt, Homo sapiens
ugaggucacuuguuuuaugcuu

SEQ ID NO: 294787 - RNA, 22 nt, Homo sapiens
ugagguuggggucagggcuagc

SEQ ID NO: 294788 - RNA, 22 nt, Homo sapiens
ugagguuggguaauuuaugaag

SEQ ID NO: 294789 - RNA, 22 nt, Homo sapiens
ugagguugguauuacugucucu

SEQ ID NO: 294790 - RNA, 22 nt, Homo sapiens
ugagguuguccacuauaaucca

SEQ ID NO: 294791 - RNA, 22 nt, Homo sapiens
ugaguagaacuccuggagaugu

SEQ ID NO: 294792 - RNA, 22 nt, Homo sapiens
ugaguagaagugaagauagugg

SEQ ID NO: 294793 - RNA, 20 nt, Homo sapiens
ugaguagaggaguucuauca

SEQ ID NO: 294794 - RNA, 23 nt, Homo sapiens
ugaguagguccacguaugugagu

SEQ ID NO: 294795 - RNA, 22 nt, Homo sapiens
ugagugagguucuacucuguga

SEQ ID NO: 294796 - RNA, 21 nt, Homo sapiens
ugagugcugagugaggguuga

SEQ ID NO: 294797 - RNA, 22 nt, Homo sapiens
ugaguggagacuguguguagag

SEQ ID NO: 294798 - RNA, 22 nt, Homo sapiens
ugaguuaggagaguguggcucu

SEQ ID NO: 294799 - RNA, 22 nt, Homo sapiens
ugaguucuuccuaucucugccu

SEQ ID NO: 294800 - RNA, 22 nt, Homo sapiens
ugaguucuuuguagauucugug

SEQ ID NO: 294801 - RNA, 22 nt, Homo sapiens
ugaguucuuuuagggauauugc

SEQ ID NO: 294802 - RNA, 22 nt, Homo sapiens
ugaguugagauaagguuacauu

SEQ ID NO: 294803 - RNA, 22 nt, Homo sapiens
ugauaacauuucuucugguaca

SEQ ID NO: 294804 - RNA, 22 nt, Homo sapiens
ugauaauguuaggcuuuauuca

SEQ ID NO: 294805 - RNA, 22 nt, Homo sapiens
ugauauauugaaugaugaaaca

SEQ ID NO: 294806 - RNA, 22 nt, Homo sapiens
ugauaucugaucauccuugaua

SEQ ID NO: 294807 - RNA, 21 nt, Homo sapiens
ugauaugguagaagagagaca

SEQ ID NO: 294808 - RNA, 22 nt, Homo sapiens
ugauaugucacuugaucauggu

SEQ ID NO: 294809 - RNA, 17 nt, Homo sapiens
ugauauuuucccagaua

SEQ ID NO: 294810 - RNA, 21 nt, Homo sapiens
ugaucacaugaaaaccaugca

SEQ ID NO: 294811 - RNA, 22 nt, Homo sapiens
ugauccuguccuuaugauguua

SEQ ID NO: 294812 - RNA, 22 nt, Homo sapiens
ugaucucauuagcaccuuuagc

SEQ ID NO: 294813 - RNA, 22 nt, Homo sapiens
ugaucugucucggguuaucagu

SEQ ID NO: 294814 - RNA, 22 nt, Homo sapiens
ugaugaaguauaggaagggcuu

SEQ ID NO: 294815 - RNA, 23 nt, Homo sapiens
ugauguccacuuagggucuaggu

SEQ ID NO: 294816 - RNA, 22 nt, Homo sapiens
ugaugucuugcaggcacgagau

SEQ ID NO: 294817 - RNA, 22 nt, Homo sapiens
ugauuagagagcuggguguccu

SEQ ID NO: 294818 - RNA, 22 nt, Homo sapiens
ugauuagaggaaugguagauua

SEQ ID NO: 294819 - RNA, 22 nt, Homo sapiens
ugauugacauucuuuggaguau

SEQ ID NO: 294820 - RNA, 22 nt, Homo sapiens
ugauuggagaacaaacugcaua

SEQ ID NO: 294821 - RNA, 22 nt, Homo sapiens
ugauuuguuuagugccaaguuu

SEQ ID NO: 294822 - RNA, 22 nt, Homo sapiens
ugcaaaguccucauucuuaccc

SEQ ID NO: 294823 - RNA, 22 nt, Homo sapiens
ugcaaauguuaggugucauuau

SEQ ID NO: 294824 - RNA, 22 nt, Homo sapiens
ugcaacacauugccccugcucu

SEQ ID NO: 294825 - RNA, 22 nt, Homo sapiens
ugcaacauguguaccacucugu

SEQ ID NO: 294826 - RNA, 22 nt, Homo sapiens
ugcaagaaacauauuccacaag

SEQ ID NO: 294827 - RNA, 22 nt, Homo sapiens
ugcaagaaucagccuaucauua

SEQ ID NO: 294828 - RNA, 22 nt, Homo sapiens
ugcaagaugagauuuuggaugg

SEQ ID NO: 294829 - RNA, 22 nt, Homo sapiens
ugcaagcacacccagggauugu

SEQ ID NO: 294830 - RNA, 22 nt, Homo sapiens
ugcaauauccucuacuauaggu

SEQ ID NO: 294831 - RNA, 22 nt, Homo sapiens
ugcaccacuguacuccagucug

SEQ ID NO: 294832 - RNA, 22 nt, Homo sapiens
ugcaccauggcacuccaggcug

SEQ ID NO: 294833 - RNA, 22 nt, Homo sapiens
ugcagaaucccuucagauccga

SEQ ID NO: 294834 - RNA, 22 nt, Homo sapiens
ugcagcauugcacuccagccug

SEQ ID NO: 294835 - RNA, 18 nt, Homo sapiens
ugcagcuuugugauuggc

SEQ ID NO: 294836 - RNA, 22 nt, Homo sapiens
ugcagugugaaagagccugaca

SEQ ID NO: 294837 - RNA, 22 nt, Homo sapiens
ugcagugugauuuucuggcuga

SEQ ID NO: 294838 - RNA, 22 nt, Homo sapiens
ugcaguguggcucacgccugua

SEQ ID NO: 294839 - RNA, 22 nt, Homo sapiens
ugcaguguucuuuagaggaaau

SEQ ID NO: 294840 - RNA, 22 nt, Homo sapiens
ugcaguuuaggaacugguaaca

SEQ ID NO: 294841 - RNA, 22 nt, Homo sapiens
ugcauacuguaugcgugcauac

SEQ ID NO: 294842 - RNA, 22 nt, Homo sapiens
ugcaucaggcugcuuauuacaa

SEQ ID NO: 294843 - RNA, 22 nt, Homo sapiens
ugcauggagcucucuuuggacu

SEQ ID NO: 294844 - RNA, 22 nt, Homo sapiens
ugcauggaggagcuccccgcag

SEQ ID NO: 294845 - RNA, 22 nt, Homo sapiens
ugcauugcacuugcaugagaua

SEQ ID NO: 294846 - RNA, 22 nt, Homo sapiens
ugcauuguuuuugguucccagg

SEQ ID NO: 294847 - RNA, 20 nt, Homo sapiens
ugccaagaugacuauagcuc

SEQ ID NO: 294848 - RNA, 22 nt, Homo sapiens
ugccaaggagucagucccuaga

SEQ ID NO: 294849 - RNA, 19 nt, Homo sapiens
ugccauguagcacaugguc

SEQ ID NO: 294850 - RNA, 22 nt, Homo sapiens
ugccauugcacuccagccuggg

SEQ ID NO: 294851 - RNA, 22 nt, Homo sapiens
ugcccaguggacagaaagucau

SEQ ID NO: 294852 - RNA, 23 nt, Homo sapiens
ugccuagaccaucagccugaggu

SEQ ID NO: 294853 - RNA, 22 nt, Homo sapiens
ugccuaggcuggagugcagugg

SEQ ID NO: 294854 - RNA, 22 nt, Homo sapiens
ugccuaguguguugagaguuuu

SEQ ID NO: 294855 - RNA, 22 nt, Homo sapiens
ugccugcugucuaauauauucu

SEQ ID NO: 294856 - RNA, 22 nt, Homo sapiens
ugccuuauuccaacugagcucu

SEQ ID NO: 294857 - RNA, 22 nt, Homo sapiens
ugccuucuguuaaacgaggaug

SEQ ID NO: 294858 - RNA, 22 nt, Homo sapiens
ugccuuuguucuggaaugggaa

SEQ ID NO: 294859 - RNA, 22 nt, Homo sapiens
ugcgccauugaacuccuccugg

SEQ ID NO: 294860 - RNA, 21 nt, Homo sapiens
ugcuacugucacuuccuuugu

SEQ ID NO: 294861 - RNA, 22 nt, Homo sapiens
ugcuagaagaucacacacauca

SEQ ID NO: 294862 - RNA, 22 nt, Homo sapiens
ugcuagaugaaguuugaguuuu

SEQ ID NO: 294863 - RNA, 22 nt, Homo sapiens
ugcuaugucagccaggcugguc

SEQ ID NO: 294864 - RNA, 21 nt, Homo sapiens
ugcuauguuguccaggcuggc

SEQ ID NO: 294865 - RNA, 21 nt, Homo sapiens
ugcucaugaguaaugcaguga

SEQ ID NO: 294866 - RNA, 21 nt, Homo sapiens
ugcuccauuuucuagccugaa

SEQ ID NO: 294867 - RNA, 23 nt, Homo sapiens
ugcuccccucauggaugaauaaa

SEQ ID NO: 294868 - RNA, 18 nt, Homo sapiens
ugcuccccugggugagca

SEQ ID NO: 294869 - RNA, 23 nt, Homo sapiens
ugcugagaccuagauccuaaaga

SEQ ID NO: 294870 - RNA, 22 nt, Homo sapiens
ugcugaguguuaccggacaccg

SEQ ID NO: 294871 - RNA, 22 nt, Homo sapiens
ugcugcacaguucuuaagauua

SEQ ID NO: 294872 - RNA, 22 nt, Homo sapiens
ugcugcuguuguuguuacuagc

SEQ ID NO: 294873 - RNA, 22 nt, Homo sapiens
ugcugguguggucuagccgcuu

SEQ ID NO: 294874 - RNA, 22 nt, Homo sapiens
ugcuuaggcuuccuuacaguau

SEQ ID NO: 294875 - RNA, 22 nt, Homo sapiens
ugcuuagucuugcuuuagcuau

SEQ ID NO: 294876 - RNA, 22 nt, Homo sapiens
ugcuucauuggccaccaggaag

SEQ ID NO: 294877 - RNA, 22 nt, Homo sapiens
uggaaacuuauguucuucugug

SEQ ID NO: 294878 - RNA, 21 nt, Homo sapiens
uggaaacuucuagcuuacgua

SEQ ID NO: 294879 - RNA, 22 nt, Homo sapiens
uggaaauuaacagggauugucc

SEQ ID NO: 294880 - RNA, 20 nt, Homo sapiens
uggaaauuaaccuuucaggu

SEQ ID NO: 294881 - RNA, 22 nt, Homo sapiens
uggaaauuaagucuuuccugag

SEQ ID NO: 294882 - RNA, 19 nt, Homo sapiens
uggaacugauucaguucug

SEQ ID NO: 294883 - RNA, 22 nt, Homo sapiens
uggaagacaggcuguauuuuaa

SEQ ID NO: 294884 - RNA, 22 nt, Homo sapiens
uggaagauucuagaagauucca

SEQ ID NO: 294885 - RNA, 20 nt, Homo sapiens
uggaaguaagaauauaggug

SEQ ID NO: 294886 - RNA, 22 nt, Homo sapiens
uggaauacuauucugugcugga

SEQ ID NO: 294887 - RNA, 22 nt, Homo sapiens
uggaaucuuaggugaaggcuuu

SEQ ID NO: 294888 - RNA, 22 nt, Homo sapiens
uggaaugcuaagcaugugggag

SEQ ID NO: 294889 - RNA, 18 nt, Homo sapiens
uggaauguuuggguuaau

SEQ ID NO: 294890 - RNA, 21 nt, Homo sapiens
uggaauuaauggagagguguu

SEQ ID NO: 294891 - RNA, 22 nt, Homo sapiens
uggaauuuagguugauaguaua

SEQ ID NO: 294892 - RNA, 22 nt, Homo sapiens
uggacagaaacauguuuucagu

SEQ ID NO: 294893 - RNA, 22 nt, Homo sapiens
uggacauguacauauguguaug

SEQ ID NO: 294894 - RNA, 21 nt, Homo sapiens
uggaccccuacuucucaccau

SEQ ID NO: 294895 - RNA, 21 nt, Homo sapiens
uggaccccuuccagucaucau

SEQ ID NO: 294896 - RNA, 21 nt, Homo sapiens
uggaccccuuccuugcaccau

SEQ ID NO: 294897 - RNA, 22 nt, Homo sapiens
uggacuagagggugggcgaggu

SEQ ID NO: 294898 - RNA, 22 nt, Homo sapiens
uggacuguaaauuggggacucu

SEQ ID NO: 294899 - RNA, 22 nt, Homo sapiens
uggacuguaauuuuauaggcau

SEQ ID NO: 294900 - RNA, 18 nt, Homo sapiens
uggagauaagaagaacuu

SEQ ID NO: 294901 - RNA, 22 nt, Homo sapiens
uggagcaaaguugaggccaagc

SEQ ID NO: 294902 - RNA, 22 nt, Homo sapiens
uggagcccuaguuccucauaac

SEQ ID NO: 294903 - RNA, 23 nt, Homo sapiens
uggaggacaagcauggauaguga

SEQ ID NO: 294904 - RNA, 22 nt, Homo sapiens
uggagggcuagucauuucuuuu

SEQ ID NO: 294905 - RNA, 22 nt, Homo sapiens
uggagguagagaugggaucucc

SEQ ID NO: 294906 - RNA, 22 nt, Homo sapiens
uggagguaggugauauguagca

SEQ ID NO: 294907 - RNA, 20 nt, Homo sapiens
uggaggucaucugucacuac

SEQ ID NO: 294908 - RNA, 22 nt, Homo sapiens
uggagucuugaugauuuucaaa

SEQ ID NO: 294909 - RNA, 22 nt, Homo sapiens
uggagugaaaacacacuaaucu

SEQ ID NO: 294910 - RNA, 21 nt, Homo sapiens
uggagugcaacacuagguaua

SEQ ID NO: 294911 - RNA, 22 nt, Homo sapiens
uggaguguaaauuaguucagcc

SEQ ID NO: 294912 - RNA, 22 nt, Homo sapiens
uggaguguagaagccagccucc

SEQ ID NO: 294913 - RNA, 22 nt, Homo sapiens
uggagugucaguuuccagaguu

SEQ ID NO: 294914 - RNA, 16 nt, Homo sapiens
uggaguguuuguuaga

SEQ ID NO: 294915 - RNA, 20 nt, Homo sapiens
uggaguuugaguucuuggag

SEQ ID NO: 294916 - RNA, 22 nt, Homo sapiens
uggauagauacuauccaggacu

SEQ ID NO: 294917 - RNA, 22 nt, Homo sapiens
uggauaguaaagucagauuccc

SEQ ID NO: 294918 - RNA, 22 nt, Homo sapiens
uggauaguaauaaacauauagg

SEQ ID NO: 294919 - RNA, 21 nt, Homo sapiens
ugucaagaugacugcugcggc

SEQ ID NO: 294920 - RNA, 22 nt, Homo sapiens
ugucaccauuuguaggugagga

SEQ ID NO: 294921 - RNA, 22 nt, Homo sapiens
ugucacugugcagucaugcauu

SEQ ID NO: 294922 - RNA, 22 nt, Homo sapiens
ugucaggaugcuccuuuuggcu

SEQ ID NO: 294923 - RNA, 22 nt, Homo sapiens
ugucaguuucccuccucuuccu

SEQ ID NO: 294924 - RNA, 22 nt, Homo sapiens
ugucaucauuccaucagggcuu

SEQ ID NO: 294925 - RNA, 22 nt, Homo sapiens
ugucaugaaauauguuuuucua

SEQ ID NO: 294926 - RNA, 22 nt, Homo sapiens
ugucauggauucugagucuggg

SEQ ID NO: 294927 - RNA, 22 nt, Homo sapiens
ugucauggcauuuguaaacugc

SEQ ID NO: 294928 - RNA, 22 nt, Homo sapiens
ugucauggucacaggcauuuca

SEQ ID NO: 294929 - RNA, 22 nt, Homo sapiens
ugucaugugagggaacuuguuc

SEQ ID NO: 294930 - RNA, 22 nt, Homo sapiens
uguccaaauugaaucaucuggu

SEQ ID NO: 294931 - RNA, 22 nt, Homo sapiens
uguccauuuuuaugcuuauggu

SEQ ID NO: 294932 - RNA, 22 nt, Homo sapiens
ugucccugagccuggauuccug

SEQ ID NO: 294933 - RNA, 22 nt, Homo sapiens
uguccuagagggaugucacccc

SEQ ID NO: 294934 - RNA, 22 nt, Homo sapiens
uguccugaagcuuuguuaugua

SEQ ID NO: 294935 - RNA, 22 nt, Homo sapiens
ugucuaaagaauggcagacuca

SEQ ID NO: 294936 - RNA, 22 nt, Homo sapiens
ugucucagugauuggcuuucug

SEQ ID NO: 294937 - RNA, 22 nt, Homo sapiens
ugucucaguuacggcaauucca

SEQ ID NO: 294938 - RNA, 22 nt, Homo sapiens
ugucucaguuucuguggguuag

SEQ ID NO: 294939 - RNA, 22 nt, Homo sapiens
ugucuuagagauaaagaaugaa

SEQ ID NO: 294940 - RNA, 22 nt, Homo sapiens
ugucuuguagacaauguauagu

SEQ ID NO: 294941 - RNA, 22 nt, Homo sapiens
ugugaaacacgaaagucuaaaa

SEQ ID NO: 294942 - RNA, 22 nt, Homo sapiens
ugugaaauguuaucccgucgug

SEQ ID NO: 294943 - RNA, 22 nt, Homo sapiens
ugugaacagcagcugggcuuug

SEQ ID NO: 294944 - RNA, 22 nt, Homo sapiens
ugugaaugaagaaugcuaaccu

SEQ ID NO: 294945 - RNA, 22 nt, Homo sapiens
ugugaaugauggagugucgaau

SEQ ID NO: 294946 - RNA, 22 nt, Homo sapiens
ugugaauggugcugcaaugaac

SEQ ID NO: 294947 - RNA, 22 nt, Homo sapiens
ugugaauguaaccuuauuugga

SEQ ID NO: 294948 - RNA, 22 nt, Homo sapiens
ugugacagcacagcaucucuuu

SEQ ID NO: 294949 - RNA, 22 nt, Homo sapiens
ugugacagcacgguucaacugc

SEQ ID NO: 294950 - RNA, 22 nt, Homo sapiens
ugugacagguagguaauuuuug

SEQ ID NO: 294951 - RNA, 21 nt, Homo sapiens
ugugaccucugucucugaguc

SEQ ID NO: 294952 - RNA, 22 nt, Homo sapiens
ugugacugguugucccgcuuuc

SEQ ID NO: 294953 - RNA, 22 nt, Homo sapiens
ugugagaaaugcagaaucucag

SEQ ID NO: 294954 - RNA, 22 nt, Homo sapiens
ugugaguguguacuaguuauca

SEQ ID NO: 294955 - RNA, 22 nt, Homo sapiens
ugugaucaaccugcagggcugg

SEQ ID NO: 294956 - RNA, 20 nt, Homo sapiens
ugugauuauuuaguugcaug

SEQ ID NO: 294957 - RNA, 17 nt, Homo sapiens
ugugauugaagucaucc

SEQ ID NO: 294958 - RNA, 22 nt, Homo sapiens
ugugcaaauguuaaacuaacuu

SEQ ID NO: 294959 - RNA, 22 nt, Homo sapiens
ugugcaaucagcuucauuacau

SEQ ID NO: 294960 - RNA, 22 nt, Homo sapiens
ugugcacaauguacagguuagu

SEQ ID NO: 294961 - RNA, 22 nt, Homo sapiens
ugugcacaaugugcagguuugu

SEQ ID NO: 294962 - RNA, 22 nt, Homo sapiens
ugugcacauaacauuuuuuuag

SEQ ID NO: 294963 - RNA, 22 nt, Homo sapiens
ugugcacaugauauaucacaua

SEQ ID NO: 294964 - RNA, 22 nt, Homo sapiens
ugugcauaugucuuuauaguag

SEQ ID NO: 294965 - RNA, 22 nt, Homo sapiens
ugugccaaaucccauaauaaau

SEQ ID NO: 294966 - RNA, 22 nt, Homo sapiens
ugugccacuccagcucuagcuu

SEQ ID NO: 294967 - RNA, 22 nt, Homo sapiens
ugugccacugcacucccgccug

SEQ ID NO: 294968 - RNA, 22 nt, Homo sapiens
ugugccacugcacuccugccug

SEQ ID NO: 294969 - RNA, 22 nt, Homo sapiens
ugugcgugugccuguaagaauu

SEQ ID NO: 294970 - RNA, 22 nt, Homo sapiens
ugugcucaucucagucaacugu

SEQ ID NO: 294971 - RNA, 22 nt, Homo sapiens
ugugcugaucgggcacgguguc

SEQ ID NO: 294972 - RNA, 22 nt, Homo sapiens
ugugcuugaaauucaguuuuga

SEQ ID NO: 294973 - RNA, 22 nt, Homo sapiens
uguggaguguaugugacagaga

SEQ ID NO: 294974 - RNA, 22 nt, Homo sapiens
uguggccccuagcuacuagaga

SEQ ID NO: 294975 - RNA, 22 nt, Homo sapiens
uguggccuuuguuucaguuggg

SEQ ID NO: 294976 - RNA, 17 nt, Homo sapiens
uguggcucuuaugcuga

SEQ ID NO: 294977 - RNA, 18 nt, Homo sapiens
uguggcuguuuuccaaua

SEQ ID NO: 294978 - RNA, 22 nt, Homo sapiens
uguggcuuuacagcaugguuca

SEQ ID NO: 294979 - RNA, 22 nt, Homo sapiens
uguguaaauacaagugcuugaa

SEQ ID NO: 294980 - RNA, 22 nt, Homo sapiens
ugugucacugcacuccagcgug

SEQ ID NO: 294981 - RNA, 22 nt, Homo sapiens
ugugucuacugagaugaucaug

SEQ ID NO: 294982 - RNA, 22 nt, Homo sapiens
ugugucuuuuaucacacaaugu

SEQ ID NO: 294983 - RNA, 21 nt, Homo sapiens
uguuaacaugcagauuacugg

SEQ ID NO: 294984 - RNA, 22 nt, Homo sapiens
uguuaacauggucucagucugu

SEQ ID NO: 294985 - RNA, 22 nt, Homo sapiens
uguucauggauccaguggcuuc

SEQ ID NO: 294986 - RNA, 22 nt, Homo sapiens
uguucuggagccgguucaaaug

SEQ ID NO: 294987 - RNA, 22 nt, Homo sapiens
uguucuugaguugggaguacaa

SEQ ID NO: 294988 - RNA, 22 nt, Homo sapiens
uguugcaccugccuugcuuuag

SEQ ID NO: 294989 - RNA, 22 nt, Homo sapiens
uguugcacuccagccuagguga

SEQ ID NO: 294990 - RNA, 22 nt, Homo sapiens
uguugcacuccauccugggcga

SEQ ID NO: 294991 - RNA, 22 nt, Homo sapiens
uguugcacucuagccugggcaa

SEQ ID NO: 294992 - RNA, 20 nt, Homo sapiens
uguugcacucuagccugggu

SEQ ID NO: 294993 - RNA, 18 nt, Homo sapiens
uguugguguucacucacu

SEQ ID NO: 294994 - RNA, 22 nt, Homo sapiens
uguuuaguuaagacauagaauu

SEQ ID NO: 294995 - RNA, 22 nt, Homo sapiens
uguuuguuugugauacgguaca

SEQ ID NO: 294996 - RNA, 22 nt, Homo sapiens
uguuuugguugucccuggccag

SEQ ID NO: 294997 - RNA, 22 nt, Homo sapiens
uuaaaaguauaggccuggcaua

SEQ ID NO: 294998 - RNA, 22 nt, Homo sapiens
uuaaaggcaugguuagacaugg

SEQ ID NO: 294999 - RNA, 22 nt, Homo sapiens
uuaaaguaauugaaauggccuu

SEQ ID NO: 295000 - RNA, 22 nt, Homo sapiens
uuaaagugcacacgggucaggc

SEQ ID NO: 295001 - RNA, 22 nt, Homo sapiens
uuaaaguguuugcagacaggug

SEQ ID NO: 295002 - RNA, 22 nt, Homo sapiens
uucacugcaugaaaaggacagc

SEQ ID NO: 295003 - RNA, 22 nt, Homo sapiens
uucacugggugugguggcucac

SEQ ID NO: 295004 - RNA, 21 nt, Homo sapiens
uucacuggucuauuucccuuu

SEQ ID NO: 295005 - RNA, 22 nt, Homo sapiens
uucacuguagcuuggauguuua

SEQ ID NO: 295006 - RNA, 22 nt, Homo sapiens
uucagagcauugguuuuuugaa

SEQ ID NO: 295007 - RNA, 22 nt, Homo sapiens
uucagcacugaaaauaugucau

SEQ ID NO: 295008 - RNA, 22 nt, Homo sapiens
uucagcaggccaggcccugacu

SEQ ID NO: 295009 - RNA, 22 nt, Homo sapiens
uucagcuaccugggaugcugaa

SEQ ID NO: 295010 - RNA, 22 nt, Homo sapiens
uucaggcaccauugucauugau

SEQ ID NO: 295011 - RNA, 22 nt, Homo sapiens
uucaggcuuuuauuuacugaua

SEQ ID NO: 295012 - RNA, 22 nt, Homo sapiens
uucagguaucccuugucuauag

SEQ ID NO: 295013 - RNA, 22 nt, Homo sapiens
uucagguucauuugcugcuauu

SEQ ID NO: 295014 - RNA, 22 nt, Homo sapiens
uucaguaaauguucuuacuaua

SEQ ID NO: 295015 - RNA, 22 nt, Homo sapiens
uucaguacuucaaaaucuuuaa

SEQ ID NO: 295016 - RNA, 22 nt, Homo sapiens
uucaguccauuuccuuggucac

SEQ ID NO: 295017 - RNA, 22 nt, Homo sapiens
uucagugguuauuugugagauu

SEQ ID NO: 295018 - RNA, 22 nt, Homo sapiens
uucagugucauuaacacaguag

SEQ ID NO: 295019 - RNA, 22 nt, Homo sapiens
uucaguugcaucaguugaccag

SEQ ID NO: 295020 - RNA, 21 nt, Homo sapiens
uucauaaggcuucucuccugu

SEQ ID NO: 295021 - RNA, 22 nt, Homo sapiens
uucauacaguggcugcacucca

SEQ ID NO: 295022 - RNA, 22 nt, Homo sapiens
uucauaguauuuuucuccaaau

SEQ ID NO: 295023 - RNA, 22 nt, Homo sapiens
uucauaguguuuccuuccagug

SEQ ID NO: 295024 - RNA, 22 nt, Homo sapiens
uucaucaguuauauuggccuga

SEQ ID NO: 295025 - RNA, 22 nt, Homo sapiens
uucaucaguugagcugguugcu

SEQ ID NO: 295026 - RNA, 22 nt, Homo sapiens
uucauggagccauccuuugauc

SEQ ID NO: 295027 - RNA, 22 nt, Homo sapiens
uucauggaguugagaaggcuaa

SEQ ID NO: 295028 - RNA, 22 nt, Homo sapiens
uucauggaugcauuugaggggu

SEQ ID NO: 295029 - RNA, 22 nt, Homo sapiens
uucauggauggaaaugauuuug

SEQ ID NO: 295030 - RNA, 22 nt, Homo sapiens
uucauguaauuccauaagguaa

SEQ ID NO: 295031 - RNA, 22 nt, Homo sapiens
uucauguagucaucauccugcu

SEQ ID NO: 295032 - RNA, 22 nt, Homo sapiens
uucauugaaugauuuuuagaag

SEQ ID NO: 295033 - RNA, 22 nt, Homo sapiens
uucauugcugcuuaucuccaga

SEQ ID NO: 295034 - RNA, 22 nt, Homo sapiens
uuccacaauggcugaacuaguu

SEQ ID NO: 295035 - RNA, 22 nt, Homo sapiens
uuccacaaugguugaacuaauu

SEQ ID NO: 295036 - RNA, 22 nt, Homo sapiens
uuccacaaugguugaacuagcu

SEQ ID NO: 295037 - RNA, 22 nt, Homo sapiens
uuccacaaugguugaacuaguu

SEQ ID NO: 295038 - RNA, 20 nt, Homo sapiens
uuccagcacauuagggaagc

SEQ ID NO: 295039 - RNA, 21 nt, Homo sapiens
uuccagugagccuagaugccu

SEQ ID NO: 295040 - RNA, 22 nt, Homo sapiens
uuccaguggaguaaauggacaa

SEQ ID NO: 295041 - RNA, 22 nt, Homo sapiens
uuccauguugauacgugaaguu

SEQ ID NO: 295042 - RNA, 22 nt, Homo sapiens
uuccauuuguucggugucgcca

SEQ ID NO: 295043 - RNA, 22 nt, Homo sapiens
uucccagagaaaaggguuucuu

SEQ ID NO: 295044 - RNA, 22 nt, Homo sapiens
uucccaguggaacauguaguca

SEQ ID NO: 295045 - RNA, 22 nt, Homo sapiens
uucccaguuggggaaagcgacc

SEQ ID NO: 295046 - RNA, 22 nt, Homo sapiens
uucccugaaguguuacucuaga

SEQ ID NO: 295047 - RNA, 22 nt, Homo sapiens
uucccugaguaucuuaccaugg

SEQ ID NO: 295048 - RNA, 22 nt, Homo sapiens
uucccuugcaggaugaucugga

SEQ ID NO: 295049 - RNA, 22 nt, Homo sapiens
uucccuuuguuaaauuggaaga

SEQ ID NO: 295050 - RNA, 22 nt, Homo sapiens
uuccuacugugcaaaguugcaa

SEQ ID NO: 295051 - RNA, 22 nt, Homo sapiens
uuccugaggccuccccagaagc

SEQ ID NO: 295052 - RNA, 22 nt, Homo sapiens
uuccuggaggggaaguguccaa

SEQ ID NO: 295053 - RNA, 22 nt, Homo sapiens
uuccugugacccccaagcccac

SEQ ID NO: 295054 - RNA, 22 nt, Homo sapiens
uuccuuaguuauuugguccccu

SEQ ID NO: 295055 - RNA, 22 nt, Homo sapiens
uuccuugagucuuuuuccugag

SEQ ID NO: 295056 - RNA, 21 nt, Homo sapiens
uucuaaguaaauguuggacau

SEQ ID NO: 295057 - RNA, 22 nt, Homo sapiens
uucuacaggcuguucaagaagc

SEQ ID NO: 295058 - RNA, 22 nt, Homo sapiens
uucuacaugggucgucggugag

SEQ ID NO: 295059 - RNA, 21 nt, Homo sapiens
uucuacuccggcguuguuuuu

SEQ ID NO: 295060 - RNA, 20 nt, Homo sapiens
uucuaguacuucuguuucca

SEQ ID NO: 295061 - RNA, 22 nt, Homo sapiens
uucuauggucacagaugcuuga

SEQ ID NO: 295062 - RNA, 22 nt, Homo sapiens
uucuaugguuuaauaguuuggg

SEQ ID NO: 295063 - RNA, 22 nt, Homo sapiens
uucuauguuugaaaaugccaaa

SEQ ID NO: 295064 - RNA, 22 nt, Homo sapiens
uucuauugguaauauuuucugu

SEQ ID NO: 295065 - RNA, 22 nt, Homo sapiens
uucucaauggaugugggaccag

SEQ ID NO: 295066 - RNA, 22 nt, Homo sapiens
uucucaguaauuccagauuuuu

SEQ ID NO: 295067 - RNA, 22 nt, Homo sapiens
uucucagugaaguuuagaacau

SEQ ID NO: 295068 - RNA, 22 nt, Homo sapiens
uucucagugcuaucuuuuaugc

SEQ ID NO: 295069 - RNA, 22 nt, Homo sapiens
uucucaguuccuacuuugguga

SEQ ID NO: 295070 - RNA, 22 nt, Homo sapiens
uucucauggaacaucuguacug

SEQ ID NO: 295071 - RNA, 22 nt, Homo sapiens
uucucauggugauggcaaaauc

SEQ ID NO: 295072 - RNA, 22 nt, Homo sapiens
uucucugggacauaggucgggu

SEQ ID NO: 295073 - RNA, 22 nt, Homo sapiens
uucugagguuauauucucucaa

SEQ ID NO: 295074 - RNA, 23 nt, Homo sapiens
uucugccacugaaaaugccucag

SEQ ID NO: 295075 - RNA, 22 nt, Homo sapiens
uucuggccccucccaaucucau

SEQ ID NO: 295076 - RNA, 22 nt, Homo sapiens
uucuggcucaggucaacacuuc

SEQ ID NO: 295077 - RNA, 22 nt, Homo sapiens
uucuguguuuaggucacggcua

SEQ ID NO: 295078 - RNA, 22 nt, Homo sapiens
uucuugcacuuaacugacauuc

SEQ ID NO: 295079 - RNA, 23 nt, Homo sapiens
uugaaaagucaguagccucugau

SEQ ID NO: 295080 - RNA, 22 nt, Homo sapiens
uugaaagaaaggagacugaguu

SEQ ID NO: 295081 - RNA, 22 nt, Homo sapiens
uugaaagacagaggggcaaguu

SEQ ID NO: 295082 - RNA, 22 nt, Homo sapiens
uugaaagucauuucuucuaagu

SEQ ID NO: 295083 - RNA, 22 nt, Homo sapiens
uugaaagucuaggcuuacagua

SEQ ID NO: 295084 - RNA, 22 nt, Homo sapiens
uugaaaguguucacaaugguau

SEQ ID NO: 295085 - RNA, 21 nt, Homo sapiens
cagguagugucugaagccaga

SEQ ID NO: 295086 - RNA, 22 nt, Homo sapiens
cagucacugggauuauggucau

SEQ ID NO: 295087 - RNA, 20 nt, Homo sapiens
cagucaugaagaacugugag

SEQ ID NO: 295088 - RNA, 22 nt, Homo sapiens
cagugcaaccuccaucucucgg

SEQ ID NO: 295089 - RNA, 22 nt, Homo sapiens
cagugcauagaugugccacauu

SEQ ID NO: 295090 - RNA, 23 nt, Homo sapiens
cagugcauuguggcauucagcau

SEQ ID NO: 295091 - RNA, 22 nt, Homo sapiens
caguggaugauguuuucugugg

SEQ ID NO: 295092 - RNA, 22 nt, Homo sapiens
caguugguguacauauauguau

SEQ ID NO: 295093 - RNA, 22 nt, Homo sapiens
cauacaagcuacaaucacaaag

SEQ ID NO: 295094 - RNA, 22 nt, Homo sapiens
cauaguacuugcauaguacuau

SEQ ID NO: 295095 - RNA, 19 nt, Homo sapiens
caucacagagucuuccauu

SEQ ID NO: 295096 - RNA, 22 nt, Homo sapiens
caucacaugcuuauuuuccuca

SEQ ID NO: 295097 - RNA, 22 nt, Homo sapiens
caucacauucugagauacugag

SEQ ID NO: 295098 - RNA, 20 nt, Homo sapiens
caucaccuggcaggauuugu

SEQ ID NO: 295099 - RNA, 22 nt, Homo sapiens
caucacuuugccuccgucucua

SEQ ID NO: 295100 - RNA, 22 nt, Homo sapiens
caucagagugagauauaagauc

SEQ ID NO: 295101 - RNA, 22 nt, Homo sapiens
caugaaagugagaaacuccugg

SEQ ID NO: 295102 - RNA, 22 nt, Homo sapiens
caugaacacugugcggcuuccu

SEQ ID NO: 295103 - RNA, 22 nt, Homo sapiens
caugacacuggcauguuucuuu

SEQ ID NO: 295104 - RNA, 22 nt, Homo sapiens
caugaugcuagguauggaugaa

SEQ ID NO: 295105 - RNA, 22 nt, Homo sapiens
caugcauagccauucauucguu

SEQ ID NO: 295106 - RNA, 22 nt, Homo sapiens
caugccacugcacgccauccug

SEQ ID NO: 295107 - RNA, 22 nt, Homo sapiens
cauggauuuuuuugaauggcag

SEQ ID NO: 295108 - RNA, 22 nt, Homo sapiens
cauggcacagagaauguguucu

SEQ ID NO: 295109 - RNA, 22 nt, Homo sapiens
cauggcacuggugggagugucu

SEQ ID NO: 295110 - RNA, 22 nt, Homo sapiens
cauggcauuugcagaguugaaa

SEQ ID NO: 295111 - RNA, 22 nt, Homo sapiens
cauggcccugggcugggcgaac

SEQ ID NO: 295112 - RNA, 22 nt, Homo sapiens
cauggccuuuggaaugugucua

SEQ ID NO: 295113 - RNA, 22 nt, Homo sapiens
cauggcuacugcagauguaggg

SEQ ID NO: 295114 - RNA, 23 nt, Homo sapiens
cauggcuguuaacacuguuugag

SEQ ID NO: 295115 - RNA, 22 nt, Homo sapiens
cauggcuuuauuuucagcuucu

SEQ ID NO: 295116 - RNA, 22 nt, Homo sapiens
cauguaacaucccgcuguagga

SEQ ID NO: 295117 - RNA, 22 nt, Homo sapiens
caugucuuuuaaacauucaacu

SEQ ID NO: 295118 - RNA, 22 nt, Homo sapiens
cauuacacuuguaagguuuuuc

SEQ ID NO: 295119 - RNA, 20 nt, Homo sapiens
cauuccacuuuccugucagu

SEQ ID NO: 295120 - RNA, 22 nt, Homo sapiens
cauugcaacuucugccucccag

SEQ ID NO: 295121 - RNA, 22 nt, Homo sapiens
cauugcacuccagcccuggcaa

SEQ ID NO: 295122 - RNA, 22 nt, Homo sapiens
cauugcacuccagccugccugg

SEQ ID NO: 295123 - RNA, 22 nt, Homo sapiens
cauugcacuccagcuugggcaa

SEQ ID NO: 295124 - RNA, 22 nt, Homo sapiens
cauugcacuccauccuuggcaa

SEQ ID NO: 295125 - RNA, 22 nt, Homo sapiens
cauugcaguaagagugggcucu

SEQ ID NO: 295126 - RNA, 22 nt, Homo sapiens
cauugcuaaaagucauauauaa

SEQ ID NO: 295127 - RNA, 22 nt, Homo sapiens
cauugcucuuacagagugagua

SEQ ID NO: 295128 - RNA, 22 nt, Homo sapiens
cauuuuacuuuccagacgugga

SEQ ID NO: 295129 - RNA, 22 nt, Homo sapiens
cauuuugguuaaauagguagcu

SEQ ID NO: 295130 - RNA, 22 nt, Homo sapiens
ccaaggaauacccucccuuuuu

SEQ ID NO: 295131 - RNA, 22 nt, Homo sapiens
ccacaguggauuaaaguuacug

SEQ ID NO: 295132 - RNA, 22 nt, Homo sapiens
ccacccuggagaauuugagguc

SEQ ID NO: 295133 - RNA, 22 nt, Homo sapiens
ccacugcacuccagcccggcaa

SEQ ID NO: 295134 - RNA, 22 nt, Homo sapiens
ccacuguuuaaauggcugagga

SEQ ID NO: 295135 - RNA, 22 nt, Homo sapiens
ccagucuuggugucuguagcac

SEQ ID NO: 295136 - RNA, 22 nt, Homo sapiens
ccagugauggcugccucauuug

SEQ ID NO: 295137 - RNA, 22 nt, Homo sapiens
ccagugauuguauggugaaggu

SEQ ID NO: 295138 - RNA, 21 nt, Homo sapiens
ccagugguuggaaacuauggg

SEQ ID NO: 295139 - RNA, 22 nt, Homo sapiens
ccaguguuuuugaauuccagga

SEQ ID NO: 295140 - RNA, 22 nt, Homo sapiens
ccaguuuucaagauaaugguuu

SEQ ID NO: 295141 - RNA, 22 nt, Homo sapiens
ccaguuuucucacuguugcagu

SEQ ID NO: 295142 - RNA, 22 nt, Homo sapiens
ccaucacacugugauuauuauc

SEQ ID NO: 295143 - RNA, 22 nt, Homo sapiens
ccaucacaggccucagugggaa

SEQ ID NO: 295144 - RNA, 22 nt, Homo sapiens
ccaugaacuagaauagaacaug

SEQ ID NO: 295145 - RNA, 22 nt, Homo sapiens
uuaugcagcaaagugcuugaaa

SEQ ID NO: 295146 - RNA, 22 nt, Homo sapiens
uuaugccagugauuauaagggc

SEQ ID NO: 295147 - RNA, 23 nt, Homo sapiens
uuauggcuuuuauuauguugagg

SEQ ID NO: 295148 - RNA, 22 nt, Homo sapiens
uuaugguuuucucucacgcagg

SEQ ID NO: 295149 - RNA, 22 nt, Homo sapiens
uuaugguuuuucugugagaugg

SEQ ID NO: 295150 - RNA, 22 nt, Homo sapiens
uuauguaaaucaaucuggaauc

SEQ ID NO: 295151 - RNA, 22 nt, Homo sapiens
uuaugucauuuuuggauguuaa

SEQ ID NO: 295152 - RNA, 22 nt, Homo sapiens
uuauugcacuccagccugggua

SEQ ID NO: 295153 - RNA, 22 nt, Homo sapiens
uuauugcuccagaggcugauuu

SEQ ID NO: 295154 - RNA, 22 nt, Homo sapiens
uuauuugguuauuguaauuggg

SEQ ID NO: 295155 - RNA, 22 nt, Homo sapiens
uuauuugguugcugacuuggaa

SEQ ID NO: 295156 - RNA, 23 nt, Homo sapiens
uucaaaggaugcuuuauggaauu

SEQ ID NO: 295157 - RNA, 22 nt, Homo sapiens
uucaaaucuucguuuugccaua

SEQ ID NO: 295158 - RNA, 22 nt, Homo sapiens
uucaacagugauggccuuugua

SEQ ID NO: 295159 - RNA, 22 nt, Homo sapiens
uucaagcuauggugaucuuuuc

SEQ ID NO: 295160 - RNA, 22 nt, Homo sapiens
uucaauuaauauuauacucuca

SEQ ID NO: 295161 - RNA, 22 nt, Homo sapiens
uucacagaaaaaggcgaugagg

SEQ ID NO: 295162 - RNA, 22 nt, Homo sapiens
uucacagacaacuggucccuua

SEQ ID NO: 295163 - RNA, 22 nt, Homo sapiens
uucacagccgcaccccaucacu

SEQ ID NO: 295164 - RNA, 22 nt, Homo sapiens
uucacagucacccuucuccaug

SEQ ID NO: 295165 - RNA, 22 nt, Homo sapiens
uucacagugugaucuaugggca

SEQ ID NO: 295166 - RNA, 23 nt, Homo sapiens
uucaccugguuauuaauagccuc

SEQ ID NO: 295167 - RNA, 22 nt, Homo sapiens
uucaccuugggucccacuugcu

SEQ ID NO: 295168 - RNA, 22 nt, Homo sapiens
uucacgguguucacgggggucc

SEQ ID NO: 295169 - RNA, 20 nt, Homo sapiens
uucacugggcucucuguugg

SEQ ID NO: 295170 - RNA, 22 nt, Homo sapiens
uucacugugaacucauauucag

SEQ ID NO: 295171 - RNA, 22 nt, Homo sapiens
uucacugugaauaaaggcuccc

SEQ ID NO: 295172 - RNA, 22 nt, Homo sapiens
uucacugugcuuaaauucugcu

SEQ ID NO: 295173 - RNA, 22 nt, Homo sapiens
uucagagagggagggauaccua

SEQ ID NO: 295174 - RNA, 22 nt, Homo sapiens
uucagagugaggcucucggaac

SEQ ID NO: 295175 - RNA, 22 nt, Homo sapiens
uucagaguggacagaaauuaag

SEQ ID NO: 295176 - RNA, 22 nt, Homo sapiens
uucagcuacuuggaaacagcaa

SEQ ID NO: 295177 - RNA, 22 nt, Homo sapiens
uucagcuacuugggaggcugaa

SEQ ID NO: 295178 - RNA, 22 nt, Homo sapiens
uucaggcuccugugagaaucua

SEQ ID NO: 295179 - RNA, 22 nt, Homo sapiens
uucagggcauuggaguuucuga

SEQ ID NO: 295180 - RNA, 22 nt, Homo sapiens
uucaggguggagaguaugaggu

SEQ ID NO: 295181 - RNA, 22 nt, Homo sapiens
uucagguaauuaugguuugucu

SEQ ID NO: 295182 - RNA, 22 nt, Homo sapiens
uucagguacugggggaguaugg

SEQ ID NO: 295183 - RNA, 22 nt, Homo sapiens
uucaguagucuccauagaaccg

SEQ ID NO: 295184 - RNA, 22 nt, Homo sapiens
uucaguauugcaccuggagucc

SEQ ID NO: 295185 - RNA, 22 nt, Homo sapiens
uucaguggacuuaguagugcuu

SEQ ID NO: 295186 - RNA, 22 nt, Homo sapiens
uucaguggagaggcugaguggu

SEQ ID NO: 295187 - RNA, 22 nt, Homo sapiens
uucaguggguggaugaauauga

SEQ ID NO: 295188 - RNA, 22 nt, Homo sapiens
uucaguucugcucugaucuuag

SEQ ID NO: 295189 - RNA, 18 nt, Homo sapiens
uucaguuuguaucugggg

SEQ ID NO: 295190 - RNA, 22 nt, Homo sapiens
uucauagucacauucgaugucu

SEQ ID NO: 295191 - RNA, 22 nt, Homo sapiens
uucauaguucuuuuagucauua

SEQ ID NO: 295192 - RNA, 21 nt, Homo sapiens
uucauaugcacugagugccca

SEQ ID NO: 295193 - RNA, 21 nt, Homo sapiens
uucaucagccagaaaucaagc

SEQ ID NO: 295194 - RNA, 22 nt, Homo sapiens
uucaucagcuguagaugucaug

SEQ ID NO: 295195 - RNA, 20 nt, Homo sapiens
uucaucaggauauuggucua

SEQ ID NO: 295196 - RNA, 22 nt, Homo sapiens
uucaucagggagaaauaauuuc

SEQ ID NO: 295197 - RNA, 23 nt, Homo sapiens
uucaucagggauauuggccugaa

SEQ ID NO: 295198 - RNA, 22 nt, Homo sapiens
uucaucuggcaauucagagauu

SEQ ID NO: 295199 - RNA, 22 nt, Homo sapiens
uucauggguuaauuuguucgau

SEQ ID NO: 295200 - RNA, 22 nt, Homo sapiens
uuccaauguuccguguugcagu

SEQ ID NO: 295201 - RNA, 22 nt, Homo sapiens
uuccaggugggcgugggccugg

SEQ ID NO: 295202 - RNA, 22 nt, Homo sapiens
uuccagugggacgagaugugga

SEQ ID NO: 295203 - RNA, 22 nt, Homo sapiens
uuccaugagaugcaucaaagcu

SEQ ID NO: 295204 - RNA, 22 nt, Homo sapiens
uuccauguaguugagcaguuuu

SEQ ID NO: 295205 - RNA, 22 nt, Homo sapiens
uuccaugugggcuugucaagua

SEQ ID NO: 295206 - RNA, 22 nt, Homo sapiens
uucccagagagggacuucuaau

SEQ ID NO: 295207 - RNA, 22 nt, Homo sapiens
uucccagucaaacgaaggacuu

SEQ ID NO: 295208 - RNA, 22 nt, Homo sapiens
uucccagugccaggcacuggga

SEQ ID NO: 295209 - RNA, 22 nt, Homo sapiens
uucccuagaacacauggaggga

SEQ ID NO: 295210 - RNA, 20 nt, Homo sapiens
uucccucagccuugagggua

SEQ ID NO: 295211 - RNA, 22 nt, Homo sapiens
uucccugaaauauucacuuuca

SEQ ID NO: 295212 - RNA, 22 nt, Homo sapiens
uucccuguaucuucugccaugu

SEQ ID NO: 295213 - RNA, 22 nt, Homo sapiens
uucccuuucuuaaagaguuagg

SEQ ID NO: 295214 - RNA, 22 nt, Homo sapiens
uucccuuugugcauaggauuug

SEQ ID NO: 295215 - RNA, 22 nt, Homo sapiens
uuccuacugcccauuaaaaugg

SEQ ID NO: 295216 - RNA, 22 nt, Homo sapiens
uucucuggucagaggggagguu

SEQ ID NO: 295217 - RNA, 22 nt, Homo sapiens
uucucuguggauugggugagag

SEQ ID NO: 295218 - RNA, 22 nt, Homo sapiens
uucugacuggugugagauggua

SEQ ID NO: 295219 - RNA, 22 nt, Homo sapiens
uucugccaaucaacccacaucc

SEQ ID NO: 295220 - RNA, 22 nt, Homo sapiens
uucugugcugaaucaaagacug

SEQ ID NO: 295221 - RNA, 22 nt, Homo sapiens
uucugugguugaaaggagagau

SEQ ID NO: 295222 - RNA, 22 nt, Homo sapiens
uucuuagucauguaauagucca

SEQ ID NO: 295223 - RNA, 21 nt, Homo sapiens
uucuucaggcagaaggauuau

SEQ ID NO: 295224 - RNA, 22 nt, Homo sapiens
uucuugcugaauugugcccuuc

SEQ ID NO: 295225 - RNA, 22 nt, Homo sapiens
uucuuugcaugaucucaaaguc

SEQ ID NO: 295226 - RNA, 22 nt, Homo sapiens
uugaaagacaucaccuacugcu

SEQ ID NO: 295227 - RNA, 22 nt, Homo sapiens
uugaaaguaaacaucacaaaga

SEQ ID NO: 295228 - RNA, 22 nt, Homo sapiens
uugaaaucuuccacagcccaag

SEQ ID NO: 295229 - RNA, 22 nt, Homo sapiens
uugaaguaguacuuuauuauag

SEQ ID NO: 295230 - RNA, 22 nt, Homo sapiens
uugaaguauagaguuuaagaac

SEQ ID NO: 295231 - RNA, 22 nt, Homo sapiens
uugaaguaugaccgcugagaau

SEQ ID NO: 295232 - RNA, 22 nt, Homo sapiens
uugaaguguguauacauugugg

SEQ ID NO: 295233 - RNA, 22 nt, Homo sapiens
uugaauagugacuuugauucug

SEQ ID NO: 295234 - RNA, 22 nt, Homo sapiens
uugaaugaauggaaagaagggu

SEQ ID NO: 295235 - RNA, 18 nt, Homo sapiens
uugaaugcgucccagaga

SEQ ID NO: 295236 - RNA, 22 nt, Homo sapiens
uugacaaugcacugugcuaagu

SEQ ID NO: 295237 - RNA, 22 nt, Homo sapiens
uugacacuaauuauuauaggug

SEQ ID NO: 295238 - RNA, 20 nt, Homo sapiens
uugacagagggaaaguugcu

SEQ ID NO: 295239 - RNA, 22 nt, Homo sapiens
uugaccccuucuaauagccuca

SEQ ID NO: 295240 - RNA, 22 nt, Homo sapiens
uugacugggccagacagagauc

SEQ ID NO: 295241 - RNA, 22 nt, Homo sapiens
uugacuguaagauggcuauuac

SEQ ID NO: 295242 - RNA, 22 nt, Homo sapiens
uugacuucagagcugauucaag

SEQ ID NO: 295243 - RNA, 22 nt, Homo sapiens
uugacuuuuaggaggaaaauga

SEQ ID NO: 295244 - RNA, 22 nt, Homo sapiens
uugagaagugucuguucauguc

SEQ ID NO: 295245 - RNA, 21 nt, Homo sapiens
uugagacggagucucacucug

SEQ ID NO: 295246 - RNA, 22 nt, Homo sapiens
uugagacggagucucacucugu

SEQ ID NO: 295247 - RNA, 22 nt, Homo sapiens
uugagacggagucuugcucuuu

SEQ ID NO: 295248 - RNA, 22 nt, Homo sapiens
uugagacggaguuuugcucuug

SEQ ID NO: 295249 - RNA, 22 nt, Homo sapiens
uugagacugaacauuuguguac

SEQ ID NO: 295250 - RNA, 22 nt, Homo sapiens
uugagauauccauaaaugggaa

SEQ ID NO: 295251 - RNA, 22 nt, Homo sapiens
uugagauaucuuggccuuugca

SEQ ID NO: 295252 - RNA, 22 nt, Homo sapiens
uugagaucaugcuacugcacuc

SEQ ID NO: 295253 - RNA, 22 nt, Homo sapiens
uugagauggagucucacgcauu

SEQ ID NO: 295254 - RNA, 22 nt, Homo sapiens
uugagauggagucucacuccuu

SEQ ID NO: 295255 - RNA, 22 nt, Homo sapiens
uugagauggagucucacugugu

SEQ ID NO: 295256 - RNA, 22 nt, Homo sapiens
uugagauggagucucgcacugu

SEQ ID NO: 295257 - RNA, 22 nt, Homo sapiens
uugagauggagucucgcucugu

SEQ ID NO: 295258 - RNA, 22 nt, Homo sapiens
uugagauggagucucgcucuuu

SEQ ID NO: 295259 - RNA, 22 nt, Homo sapiens
uugagauggagucuugcucugu

SEQ ID NO: 295260 - RNA, 22 nt, Homo sapiens
uugagauggaguuucgcucuug

SEQ ID NO: 295261 - RNA, 22 nt, Homo sapiens
uugagauguaguuucacuccug

SEQ ID NO: 295262 - RNA, 22 nt, Homo sapiens
uugagauuauuguguuccuuua

SEQ ID NO: 295263 - RNA, 22 nt, Homo sapiens
uugagcaacauagugagacugu

SEQ ID NO: 295264 - RNA, 22 nt, Homo sapiens
uugagcaaugucacugaggcuu

SEQ ID NO: 295265 - RNA, 22 nt, Homo sapiens
uugagcacaggaguuugagacc

SEQ ID NO: 295266 - RNA, 22 nt, Homo sapiens
uugagccaaggauugucuuucc

SEQ ID NO: 295267 - RNA, 22 nt, Homo sapiens
uugaggaggcagucugcccauu

SEQ ID NO: 295268 - RNA, 22 nt, Homo sapiens
uugaggcaaugaggagaagcug

SEQ ID NO: 295269 - RNA, 23 nt, Homo sapiens
uugaggcauguaccaucaauauc

SEQ ID NO: 295270 - RNA, 16 nt, Homo sapiens
uugaggcaugucucag

SEQ ID NO: 295271 - RNA, 22 nt, Homo sapiens
uugaggccugauaacacacuga

SEQ ID NO: 295272 - RNA, 22 nt, Homo sapiens
uugagggaaacauucacaucau

SEQ ID NO: 295273 - RNA, 22 nt, Homo sapiens
uugagggagcacagauucuuau

SEQ ID NO: 295274 - RNA, 22 nt, Homo sapiens
uugagggcugaauaccaaucag

SEQ ID NO: 295275 - RNA, 22 nt, Homo sapiens
uugaggguggcauauauugauu

SEQ ID NO: 295276 - RNA, 21 nt, Homo sapiens
uugagguaaaauccuauggga

SEQ ID NO: 295277 - RNA, 22 nt, Homo sapiens
uugagguagcuuugauggaggu

SEQ ID NO: 295278 - RNA, 20 nt, Homo sapiens
uugaggucaggaguuuggga

SEQ ID NO: 295279 - RNA, 22 nt, Homo sapiens
uugaguauuggacugguaucuu

SEQ ID NO: 295280 - RNA, 22 nt, Homo sapiens
uugaguccauucgaugcugauu

SEQ ID NO: 295281 - RNA, 22 nt, Homo sapiens
uugauaauguuaacuuugguca

SEQ ID NO: 295282 - RNA, 22 nt, Homo sapiens
uugauagacaucugaguuguug

SEQ ID NO: 295283 - RNA, 22 nt, Homo sapiens
uugauagaucagggauuugauu

SEQ ID NO: 295284 - RNA, 22 nt, Homo sapiens
uugauaguaccauugggaaauu

SEQ ID NO: 295285 - RNA, 22 nt, Homo sapiens
uugauaguuuuaaaauuaaucu

SEQ ID NO: 295286 - RNA, 22 nt, Homo sapiens
uugaucaaaucugagugagaau

SEQ ID NO: 295287 - RNA, 22 nt, Homo sapiens
uugaucugugucccugcccaau

SEQ ID NO: 295288 - RNA, 22 nt, Homo sapiens
uugaucuguguuagaagcuaag

SEQ ID NO: 295289 - RNA, 22 nt, Homo sapiens
uuuggucagcugcgggucagcu

SEQ ID NO: 295290 - RNA, 22 nt, Homo sapiens
uuuggucuuuuauuuaaagcag

SEQ ID NO: 295291 - RNA, 22 nt, Homo sapiens
uuugguguauaaaaaugcuagu

SEQ ID NO: 295292 - RNA, 22 nt, Homo sapiens
uuuguaauaccugaggcugggu

SEQ ID NO: 295293 - RNA, 22 nt, Homo sapiens
uuuguaauccuauuccaaagga

SEQ ID NO: 295294 - RNA, 22 nt, Homo sapiens
uuuguacacgugggugaauugu

SEQ ID NO: 295295 - RNA, 22 nt, Homo sapiens
uuuguacuugaagaaucuuuau

SEQ ID NO: 295296 - RNA, 18 nt, Homo sapiens
uuuguacuuuuucuaaug

SEQ ID NO: 295297 - RNA, 22 nt, Homo sapiens
uuuguagcuacaaagugagaug

SEQ ID NO: 295298 - RNA, 21 nt, Homo sapiens
uuuguaguagcaugauuuaua

SEQ ID NO: 295299 - RNA, 23 nt, Homo sapiens
uuuguaguagcaugauuuauaau

SEQ ID NO: 295300 - RNA, 19 nt, Homo sapiens
uuuguauguuuccaguaau

SEQ ID NO: 295301 - RNA, 22 nt, Homo sapiens
uuugucacucuuggagguuguu

SEQ ID NO: 295302 - RNA, 22 nt, Homo sapiens
uuugucauagcagcaggaaugg

SEQ ID NO: 295303 - RNA, 21 nt, Homo sapiens
uuuguccaccuguguucacca

SEQ ID NO: 295304 - RNA, 22 nt, Homo sapiens
uuugucccccguaguucauaua

SEQ ID NO: 295305 - RNA, 22 nt, Homo sapiens
uuugugacucauggucuagugc

SEQ ID NO: 295306 - RNA, 22 nt, Homo sapiens
uuugugcaugaagagggggugc

SEQ ID NO: 295307 - RNA, 18 nt, Homo sapiens
uuugugcuccacaaagga

SEQ ID NO: 295308 - RNA, 21 nt, Homo sapiens
uuuguguccccacccaaaucu

SEQ ID NO: 295309 - RNA, 22 nt, Homo sapiens
uuuguguccccacccaaaucuc

SEQ ID NO: 295310 - RNA, 22 nt, Homo sapiens
uuuguguggccuuggccuggca

SEQ ID NO: 295311 - RNA, 22 nt, Homo sapiens
uuuuacacuucgguugugugca

SEQ ID NO: 295312 - RNA, 22 nt, Homo sapiens
uuuuagcuuuucccaggacucc

SEQ ID NO: 295313 - RNA, 20 nt, Homo sapiens
uuuugaacuuggcaaccugu

SEQ ID NO: 295314 - RNA, 21 nt, Homo sapiens
uuuugcacacuaugcagcuuu

SEQ ID NO: 295315 - RNA, 22 nt, Homo sapiens
uuuugcucuucggaagagcuug

SEQ ID NO: 295316 - RNA, 22 nt, Homo sapiens
uuuuggacuucaauuugacacu

SEQ ID NO: 295317 - RNA, 22 nt, Homo sapiens
uuuuggcuuuuccucagcaagc

SEQ ID NO: 295318 - RNA, 22 nt, Homo sapiens
uuuugguauaugcaggggucuu

SEQ ID NO: 295319 - RNA, 22 nt, Homo sapiens
uuuugucccaugggcuguuccc

SEQ ID NO: 295320 - RNA, 22 nt, Homo sapiens
uuuugugacuauuguaaauggg

SEQ ID NO: 295321 - RNA, 22 nt, Homo sapiens
uuuuugagaauuggugaaacac

SEQ ID NO: 295322 - RNA, 18 nt, Homo sapiens
uuuuugaggcacagggga

SEQ ID NO: 295323 - RNA, 22 nt, Homo sapiens
uuuuugagguauaguguggcua

SEQ ID NO: 295324 - RNA, 22 nt, Homo sapiens
uuuuugaguagcuggagagcag

SEQ ID NO: 295325 - RNA, 16 nt, Homo sapiens
uuuuugcagaaaugac

SEQ ID NO: 295326 - RNA, 22 nt, Homo sapiens
uuuuuggauaaugguacaugua

SEQ ID NO: 295327 - RNA, 22 nt, Homo sapiens
uuuuugguugguaggcuauuaa

SEQ ID NO: 295328 - RNA, 23 nt, Homo sapiens
uuuuuguguuucauggaaauagg

SEQ ID NO: 295329 - RNA, 22 nt, Homo sapiens
uuuuuugcuguaugcaaacauc

SEQ ID NO: 295330 - RNA, 22 nt, Homo sapiens
auuucacugagacaugugccca

SEQ ID NO: 295331 - RNA, 19 nt, Homo sapiens
auuuccuggagcuggucuc

SEQ ID NO: 295332 - RNA, 22 nt, Homo sapiens
auuuggcaauuuugaagaugcc

SEQ ID NO: 295333 - RNA, 21 nt, Homo sapiens
auuugguggcugugugacacu

SEQ ID NO: 295334 - RNA, 21 nt, Homo sapiens
auuugguguuagaaauaaauu

SEQ ID NO: 295335 - RNA, 22 nt, Homo sapiens
auuugucacuuaacagccauua

SEQ ID NO: 295336 - RNA, 18 nt, Homo sapiens
auuuuugcaguccacaug

SEQ ID NO: 295337 - RNA, 22 nt, Homo sapiens
caaaagugguucuuauccuuuu

SEQ ID NO: 295338 - RNA, 22 nt, Homo sapiens
caaaccuguaggggccaagagg

SEQ ID NO: 295339 - RNA, 22 nt, Homo sapiens
caaaggauucauuuccaggagu

SEQ ID NO: 295340 - RNA, 22 nt, Homo sapiens
caaaggcuguuauaggccagga

SEQ ID NO: 295341 - RNA, 22 nt, Homo sapiens
caaaguaauuacgguuuuggcc

SEQ ID NO: 295342 - RNA, 22 nt, Homo sapiens
ugaagugaaugguaaguaugcc

SEQ ID NO: 295343 - RNA, 22 nt, Homo sapiens
ugaagugggaaaugaguauuaa

SEQ ID NO: 295344 - RNA, 21 nt, Homo sapiens
ugaaguguaaccgugcagggc

SEQ ID NO: 295345 - RNA, 22 nt, Homo sapiens
ugaauagaaguggcaggaguag

SEQ ID NO: 295346 - RNA, 22 nt, Homo sapiens
ugaauagacacuaaagacugua

SEQ ID NO: 295347 - RNA, 22 nt, Homo sapiens
ugaauagugucacaauaaacau

SEQ ID NO: 295348 - RNA, 22 nt, Homo sapiens
ugaauauagacagggguagaga

SEQ ID NO: 295349 - RNA, 22 nt, Homo sapiens
ugaauauguuucuaaaagugca

SEQ ID NO: 295350 - RNA, 19 nt, Homo sapiens
ugaaugacaucuaaagucc

SEQ ID NO: 295351 - RNA, 22 nt, Homo sapiens
ugaaugcuaaaggaaaacagua

SEQ ID NO: 295352 - RNA, 22 nt, Homo sapiens
ugaaugguaauuuaguaggcac

SEQ ID NO: 295353 - RNA, 22 nt, Homo sapiens
ugaauguaagaugucugcuggu

SEQ ID NO: 295354 - RNA, 20 nt, Homo sapiens
ugaauguaauuacagaugua

SEQ ID NO: 295355 - RNA, 22 nt, Homo sapiens
ugaauguacacgcguacuuguu

SEQ ID NO: 295356 - RNA, 23 nt, Homo sapiens
ugaauguaucgaaugugggaaag

SEQ ID NO: 295357 - RNA, 22 nt, Homo sapiens
ugaauguccugacgcugcaguu

SEQ ID NO: 295358 - RNA, 21 nt, Homo sapiens
ugaaugucuaggcagaaguuu

SEQ ID NO: 295359 - RNA, 22 nt, Homo sapiens
ugaauguuguugguugagauau

SEQ ID NO: 295360 - RNA, 22 nt, Homo sapiens
ugaauguuugcagcuuauacca

SEQ ID NO: 295361 - RNA, 22 nt, Homo sapiens
ugacaacugauuaacuccuuua

SEQ ID NO: 295362 - RNA, 23 nt, Homo sapiens
ugacaagagcgagacuuggucuc

SEQ ID NO: 295363 - RNA, 22 nt, Homo sapiens
ugacaagcucccucugcaccuu

SEQ ID NO: 295364 - RNA, 22 nt, Homo sapiens
ugacaagugauuaaggcauauu

SEQ ID NO: 295365 - RNA, 22 nt, Homo sapiens
ugacagaggucuuuuaauagcu

SEQ ID NO: 295366 - RNA, 22 nt, Homo sapiens
ugacaguguccuccuccugaga

SEQ ID NO: 295367 - RNA, 20 nt, Homo sapiens
ugacaguuaagggauagaag

SEQ ID NO: 295368 - RNA, 18 nt, Homo sapiens
ugacaucauuuagaaagg

SEQ ID NO: 295369 - RNA, 22 nt, Homo sapiens
ugacaucugcuugugcccagga

SEQ ID NO: 295370 - RNA, 19 nt, Homo sapiens
ugacaugaaacccaagauc

SEQ ID NO: 295371 - RNA, 22 nt, Homo sapiens
ugacauggaagauguucaugau

SEQ ID NO: 295372 - RNA, 22 nt, Homo sapiens
ugacauggaaguagguauacau

SEQ ID NO: 295373 - RNA, 22 nt, Homo sapiens
ugacauggagggugcggcugca

SEQ ID NO: 295374 - RNA, 22 nt, Homo sapiens
ugacauggagguggaggaagau

SEQ ID NO: 295375 - RNA, 22 nt, Homo sapiens
ugacauguauuagcucagugcu

SEQ ID NO: 295376 - RNA, 22 nt, Homo sapiens
ugacauguccaggugguccugu

SEQ ID NO: 295377 - RNA, 22 nt, Homo sapiens
ugacauguugcauuauauuucc

SEQ ID NO: 295378 - RNA, 21 nt, Homo sapiens
ugacauuauuucaugucagua

SEQ ID NO: 295379 - RNA, 22 nt, Homo sapiens
ugacauugggagugaagugaag

SEQ ID NO: 295380 - RNA, 17 nt, Homo sapiens
ugaccacugauucuacu

SEQ ID NO: 295381 - RNA, 19 nt, Homo sapiens
ugaccagggacagaaacca

SEQ ID NO: 295382 - RNA, 22 nt, Homo sapiens
ugacccuguggcagcgucuaag

SEQ ID NO: 295383 - RNA, 22 nt, Homo sapiens
ugacuacaaccuccaccucccg

SEQ ID NO: 295384 - RNA, 22 nt, Homo sapiens
ugacuacaggucaggaagcugu

SEQ ID NO: 295385 - RNA, 21 nt, Homo sapiens
ugacuagauuccagauuggcc

SEQ ID NO: 295386 - RNA, 22 nt, Homo sapiens
ugacucagauagguguguauuc

SEQ ID NO: 295387 - RNA, 22 nt, Homo sapiens
ugacugaguaguauuccacuau

SEQ ID NO: 295388 - RNA, 23 nt, Homo sapiens
ugacuggagacuguugauccuuu

SEQ ID NO: 295389 - RNA, 22 nt, Homo sapiens
ugacuggagucuugcucugucg

SEQ ID NO: 295390 - RNA, 22 nt, Homo sapiens
ugacugguguuuaaugagucaa

SEQ ID NO: 295391 - RNA, 22 nt, Homo sapiens
ugacugucuagauagagcuugg

SEQ ID NO: 295392 - RNA, 22 nt, Homo sapiens
ugacuucagacugaaaugauuc

SEQ ID NO: 295393 - RNA, 22 nt, Homo sapiens
ugacuugaaguuaccauaugca

SEQ ID NO: 295394 - RNA, 22 nt, Homo sapiens
ugagaacaugcacuugagguug

SEQ ID NO: 295395 - RNA, 22 nt, Homo sapiens
ugagaacauggagaacccccca

SEQ ID NO: 295396 - RNA, 18 nt, Homo sapiens
ugagaacauguguacaca

SEQ ID NO: 295397 - RNA, 22 nt, Homo sapiens
ugagaaccucugugugcccacu

SEQ ID NO: 295398 - RNA, 22 nt, Homo sapiens
ugagaacugccuguauuuaucu

SEQ ID NO: 295399 - RNA, 22 nt, Homo sapiens
ugagaagaugaacuccuugguc

SEQ ID NO: 295400 - RNA, 22 nt, Homo sapiens
ugagaauauuuuccaugucuca

SEQ ID NO: 295401 - RNA, 22 nt, Homo sapiens
ugagaauguagggcucucccag

SEQ ID NO: 295402 - RNA, 19 nt, Homo sapiens
ugagaauguuaccaggucc

SEQ ID NO: 295403 - RNA, 21 nt, Homo sapiens
ugagacaauccuggucaauau

SEQ ID NO: 295404 - RNA, 22 nt, Homo sapiens
ugagaccaacagauuccaguuc

SEQ ID NO: 295405 - RNA, 22 nt, Homo sapiens
ugagaccuuucauuucucagug

SEQ ID NO: 295406 - RNA, 22 nt, Homo sapiens
ugagacggagucucgcucucua

SEQ ID NO: 295407 - RNA, 22 nt, Homo sapiens
ugagacggagucucgcuguguc

SEQ ID NO: 295408 - RNA, 22 nt, Homo sapiens
ugagacggagucuggcacuguc

SEQ ID NO: 295409 - RNA, 22 nt, Homo sapiens
ugagacggaguuauuuauaaua

SEQ ID NO: 295410 - RNA, 22 nt, Homo sapiens
ugagacugagucuugcucuugu

SEQ ID NO: 295411 - RNA, 22 nt, Homo sapiens
ugagacugguuaauugauaaag

SEQ ID NO: 295412 - RNA, 22 nt, Homo sapiens
ugagagaugauaaaauguuugu

SEQ ID NO: 295413 - RNA, 22 nt, Homo sapiens
ugagagcuuuuuugccugguga

SEQ ID NO: 295414 - RNA, 22 nt, Homo sapiens
uguagcaaauaaaagucuggau

SEQ ID NO: 295415 - RNA, 21 nt, Homo sapiens
uguagcagcauaauuuauaau

SEQ ID NO: 295416 - RNA, 21 nt, Homo sapiens
uguagcagcaugauucauagu

SEQ ID NO: 295417 - RNA, 21 nt, Homo sapiens
uguagcagcaugauuuauaau

SEQ ID NO: 295418 - RNA, 22 nt, Homo sapiens
uguagucauuccuuuuugcuuu

SEQ ID NO: 295419 - RNA, 22 nt, Homo sapiens
uguauacugucuaauauguugu

SEQ ID NO: 295420 - RNA, 22 nt, Homo sapiens
uguauagaucugauucaucucc

SEQ ID NO: 295421 - RNA, 21 nt, Homo sapiens
uguauauguuuauacacacac

SEQ ID NO: 295422 - RNA, 22 nt, Homo sapiens
uguauguaaagacaggauaaca

SEQ ID NO: 295423 - RNA, 22 nt, Homo sapiens
uguaugucugcucuuuggaacu

SEQ ID NO: 295424 - RNA, 22 nt, Homo sapiens
uguauguugggucaaaguacau

SEQ ID NO: 295425 - RNA, 22 nt, Homo sapiens
uguauuuguuguuaaauggaga

SEQ ID NO: 295426 - RNA, 22 nt, Homo sapiens
ugucaaauucuggguuaaaaca

SEQ ID NO: 295427 - RNA, 20 nt, Homo sapiens
ugucaagaaacauuacuuau

SEQ ID NO: 295428 - RNA, 20 nt, Homo sapiens
ugucaaggaauucccaaauc

SEQ ID NO: 295429 - RNA, 22 nt, Homo sapiens
ugucacauccaagaaggugcag

SEQ ID NO: 295430 - RNA, 22 nt, Homo sapiens
ugucacccuuuauccauuuccu

SEQ ID NO: 295431 - RNA, 22 nt, Homo sapiens
ugucaccuugcucauccucgga

SEQ ID NO: 295432 - RNA, 22 nt, Homo sapiens
ugucacuuugccuucuggacuu

SEQ ID NO: 295433 - RNA, 22 nt, Homo sapiens
ugucaggaggguccagagaaaa

SEQ ID NO: 295434 - RNA, 22 nt, Homo sapiens
ugucaguggacugugaaaggca

SEQ ID NO: 295435 - RNA, 22 nt, Homo sapiens
ugucaguguacuguaagaauua

SEQ ID NO: 295436 - RNA, 22 nt, Homo sapiens
ugucaucauuugagagaagaaa

SEQ ID NO: 295437 - RNA, 22 nt, Homo sapiens
ugucaucuagguuuuaagccuu

SEQ ID NO: 295438 - RNA, 22 nt, Homo sapiens
ugucaugguagcaaggacgagg

SEQ ID NO: 295439 - RNA, 22 nt, Homo sapiens
ugucauguagaaauuguccauu

SEQ ID NO: 295440 - RNA, 22 nt, Homo sapiens
ugucauguggcuaacgauucau

SEQ ID NO: 295441 - RNA, 20 nt, Homo sapiens
ugucccaaccccauggguuc

SEQ ID NO: 295442 - RNA, 22 nt, Homo sapiens
ugucccguuuucgaggcugcag

SEQ ID NO: 295443 - RNA, 21 nt, Homo sapiens
ugucgugcaggaucuguggga

SEQ ID NO: 295444 - RNA, 22 nt, Homo sapiens
ugucuaguuuugaaguauagca

SEQ ID NO: 295445 - RNA, 21 nt, Homo sapiens
ugucugagagaggagaucuac

SEQ ID NO: 295446 - RNA, 22 nt, Homo sapiens
ugucuguuugcgaaauugcuuc

SEQ ID NO: 295447 - RNA, 16 nt, Homo sapiens
ugucuguuugggcaca

SEQ ID NO: 295448 - RNA, 22 nt, Homo sapiens
ugucuugagagaggacaugacu

SEQ ID NO: 295449 - RNA, 21 nt, Homo sapiens
ugucuuggagccagacgccag

SEQ ID NO: 295450 - RNA, 22 nt, Homo sapiens
ugucuuguagacugaaggcuuc

SEQ ID NO: 295451 - RNA, 22 nt, Homo sapiens
ugugaaacauggauagaacugg

SEQ ID NO: 295452 - RNA, 22 nt, Homo sapiens
ugugaacacagaggcuauggca

SEQ ID NO: 295453 - RNA, 19 nt, Homo sapiens
ugugaacaucacagagugu

SEQ ID NO: 295454 - RNA, 22 nt, Homo sapiens
ugugaacauuuuguauauauua

SEQ ID NO: 295455 - RNA, 22 nt, Homo sapiens
ugugaacugagcauuaacuaca

SEQ ID NO: 295456 - RNA, 20 nt, Homo sapiens
ugugaacuguagauagucuu

SEQ ID NO: 295457 - RNA, 22 nt, Homo sapiens
ugugaagaugagaugacgcccu

SEQ ID NO: 295458 - RNA, 22 nt, Homo sapiens
ugugaauggugcuuccuagaug

SEQ ID NO: 295459 - RNA, 23 nt, Homo sapiens
ugugacacuuccgucaguucauu

SEQ ID NO: 295460 - RNA, 22 nt, Homo sapiens
ugugacaguguuacauuucaug

SEQ ID NO: 295461 - RNA, 22 nt, Homo sapiens
ugugaccaaaaucaacauaccu

SEQ ID NO: 295462 - RNA, 22 nt, Homo sapiens
ugugacugguugucccacuuuc

SEQ ID NO: 295463 - RNA, 22 nt, Homo sapiens
ugugagacugguucugaaccca

SEQ ID NO: 295464 - RNA, 16 nt, Homo sapiens
ugugaucuuuuuucuu

SEQ ID NO: 295465 - RNA, 22 nt, Homo sapiens
ugugauggaguuucauggacug

SEQ ID NO: 295466 - RNA, 22 nt, Homo sapiens
ugugauugauuaaugugugcua

SEQ ID NO: 295467 - RNA, 22 nt, Homo sapiens
ugugcacaaugugcagguuuga

SEQ ID NO: 295468 - RNA, 22 nt, Homo sapiens
ugugcacauugugcagguugau

SEQ ID NO: 295469 - RNA, 22 nt, Homo sapiens
ugugcaguuuugagugaauuuc

SEQ ID NO: 295470 - RNA, 22 nt, Homo sapiens
ugugcauauaaguguguauaua

SEQ ID NO: 295471 - RNA, 22 nt, Homo sapiens
ugugccacuccaggaggcuguu

SEQ ID NO: 295472 - RNA, 22 nt, Homo sapiens
ugugccacugcacuccugggug

SEQ ID NO: 295473 - RNA, 22 nt, Homo sapiens
ugugccacugcacucugggcaa

SEQ ID NO: 295474 - RNA, 22 nt, Homo sapiens
ugugccacugcacuucagccug

SEQ ID NO: 295475 - RNA, 22 nt, Homo sapiens
uguggaaauuguuguauuuaau

SEQ ID NO: 295476 - RNA, 22 nt, Homo sapiens
uguggcaaagucuugugaauau

SEQ ID NO: 295477 - RNA, 20 nt, Homo sapiens
uguggcacuguaucucucag

SEQ ID NO: 295478 - RNA, 22 nt, Homo sapiens
uguggcauuuucagaaaggaug

SEQ ID NO: 295479 - RNA, 22 nt, Homo sapiens
uguggcucuucuguucuccacu

SEQ ID NO: 295480 - RNA, 22 nt, Homo sapiens
uguggcuuuguaaccauggguc

SEQ ID NO: 295481 - RNA, 22 nt, Homo sapiens
ugugguagugcuuaccugcagu

SEQ ID NO: 295482 - RNA, 22 nt, Homo sapiens
ugugguccucugaaggcuuuuc

SEQ ID NO: 295483 - RNA, 22 nt, Homo sapiens
ugugguuuuaguaaaacuaugu

SEQ ID NO: 295484 - RNA, 22 nt, Homo sapiens
ugugguuuuucacauuuagaga

SEQ ID NO: 295485 - RNA, 22 nt, Homo sapiens
ugugguuuuuuucuccaauagg

SEQ ID NO: 295486 - RNA, 22 nt, Homo sapiens
uguguaauaccuuugacuauau

SEQ ID NO: 295487 - RNA, 22 nt, Homo sapiens
uguguaauacucuaaugaugca

SEQ ID NO: 295488 - RNA, 22 nt, Homo sapiens
uguguacaucucuacacacaug

SEQ ID NO: 295489 - RNA, 22 nt, Homo sapiens
uguguacugcagaguauucugu

SEQ ID NO: 295490 - RNA, 22 nt, Homo sapiens
ugugucacugcacuccagccug

SEQ ID NO: 295491 - RNA, 22 nt, Homo sapiens
ugugucuugaauuuuguaugua

SEQ ID NO: 295492 - RNA, 22 nt, Homo sapiens
ugugucuugcuggugccugcau

SEQ ID NO: 295493 - RNA, 22 nt, Homo sapiens
ugugucuuguuuauagcuuucu

SEQ ID NO: 295494 - RNA, 22 nt, Homo sapiens
uguuaagaugucaauuuuccac

SEQ ID NO: 295495 - RNA, 22 nt, Homo sapiens
uguuacacugugcacuaaauuu

SEQ ID NO: 295496 - RNA, 22 nt, Homo sapiens
uguuacagcagaauugaaagag

SEQ ID NO: 295497 - RNA, 22 nt, Homo sapiens
uguuacagcagcacaaaaugga

SEQ ID NO: 295498 - RNA, 22 nt, Homo sapiens
uguuauguuguuugagaaaguc

SEQ ID NO: 295499 - RNA, 22 nt, Homo sapiens
uguuauuuuguguuagggcaca

SEQ ID NO: 295500 - RNA, 22 nt, Homo sapiens
uguucacaguguuucuuugaga

SEQ ID NO: 295501 - RNA, 22 nt, Homo sapiens
uguugcacacacugaaauacac

SEQ ID NO: 295502 - RNA, 19 nt, Homo sapiens
uguugcacauaucaauaug

SEQ ID NO: 295503 - RNA, 22 nt, Homo sapiens
uguugcacuccagccuggguga

SEQ ID NO: 295504 - RNA, 19 nt, Homo sapiens
uguugcacuccagcuuggg

SEQ ID NO: 295505 - RNA, 22 nt, Homo sapiens
uguugccacuguuauuaaccua

SEQ ID NO: 295506 - RNA, 22 nt, Homo sapiens
uguuggacuuacuuggcagauu

SEQ ID NO: 295507 - RNA, 22 nt, Homo sapiens
uguuuuggagguccucacuaga

SEQ ID NO: 295508 - RNA, 22 nt, Homo sapiens
uguuuuggaguggacuuugcau

SEQ ID NO: 295509 - RNA, 22 nt, Homo sapiens
uguuuuguuagcacucugggaa

SEQ ID NO: 295510 - RNA, 22 nt, Homo sapiens
uuaaagcuggcguuacaguuug

SEQ ID NO: 295511 - RNA, 22 nt, Homo sapiens
uuaaaggcauguacacuagagu

SEQ ID NO: 295512 - RNA, 22 nt, Homo sapiens
uuaaaguauaguuccucugguu

SEQ ID NO: 295513 - RNA, 22 nt, Homo sapiens
uuaaagugaucauaaggauagu

SEQ ID NO: 295514 - RNA, 22 nt, Homo sapiens
uuaaaugcuagaauuuucuuug

SEQ ID NO: 295515 - RNA, 22 nt, Homo sapiens
uuaacacugccauugauacugu

SEQ ID NO: 295516 - RNA, 22 nt, Homo sapiens
uuaagaucagugcaaacuggag

SEQ ID NO: 295517 - RNA, 22 nt, Homo sapiens
uuaaggcauucuuugucuucau

SEQ ID NO: 295518 - RNA, 22 nt, Homo sapiens
uuaaggcuuucccuauguaaaa

SEQ ID NO: 295519 - RNA, 22 nt, Homo sapiens
uuaaggguuuuagaauuuucca

SEQ ID NO: 295520 - RNA, 22 nt, Homo sapiens
uuaaguagaugaaugugaaugu

SEQ ID NO: 295521 - RNA, 22 nt, Homo sapiens
uuaagugaauuaucuaacaugu

SEQ ID NO: 295522 - RNA, 19 nt, Homo sapiens
uuaagugugauaucucagu

SEQ ID NO: 295523 - RNA, 22 nt, Homo sapiens
uuaaguuguagcuacaaauaca

SEQ ID NO: 295524 - RNA, 22 nt, Homo sapiens
uuaauacucuucuaaguagucc

SEQ ID NO: 295525 - RNA, 22 nt, Homo sapiens
uuaauacugcuuaacuuuagga

SEQ ID NO: 295526 - RNA, 22 nt, Homo sapiens
uuaaugaacuuuauuuuguaga

SEQ ID NO: 295527 - RNA, 21 nt, Homo sapiens
uuaaugcuaugcagaaaaucu

SEQ ID NO: 295528 - RNA, 22 nt, Homo sapiens
uuaauuguaucuauagauguca

SEQ ID NO: 295529 - RNA, 22 nt, Homo sapiens
uuaauuguccaaguucaucucu

SEQ ID NO: 295530 - RNA, 22 nt, Homo sapiens
uuaauuguccauuauucuguuc

SEQ ID NO: 295531 - RNA, 22 nt, Homo sapiens
uuacaagaugucuguccaacac

SEQ ID NO: 295532 - RNA, 22 nt, Homo sapiens
uuacacguaauaguaagccugg

SEQ ID NO: 295533 - RNA, 22 nt, Homo sapiens
uuacagauggauggcagcuggc

SEQ ID NO: 295534 - RNA, 17 nt, Homo sapiens
uuacaggugcugagagu

SEQ ID NO: 295535 - RNA, 22 nt, Homo sapiens
uuacaguggugaccuuguauug

SEQ ID NO: 295536 - RNA, 19 nt, Homo sapiens
uuacagugugcccuuuuag

SEQ ID NO: 295537 - RNA, 22 nt, Homo sapiens
uuaccugagaaggugacauuug

SEQ ID NO: 295538 - RNA, 22 nt, Homo sapiens
uuaccuguguuuugggcccaga

SEQ ID NO: 295539 - RNA, 22 nt, Homo sapiens
uuacuacucucuaugaccaguu

SEQ ID NO: 295540 - RNA, 22 nt, Homo sapiens
uuacuagaaacagggcuucgcc

SEQ ID NO: 295541 - RNA, 22 nt, Homo sapiens
uuacuauguuucaaagugucuc

SEQ ID NO: 295542 - RNA, 22 nt, Homo sapiens
uuacugcuagcugugugcucuu

SEQ ID NO: 295543 - RNA, 22 nt, Homo sapiens
uuagaacagugcucaccacaaa

SEQ ID NO: 295544 - RNA, 22 nt, Homo sapiens
uuagaacuagaggaguuugagu

SEQ ID NO: 295545 - RNA, 22 nt, Homo sapiens
uuagacaguggugcacugcacu

SEQ ID NO: 295546 - RNA, 17 nt, Homo sapiens
uuagagguagacucauu

SEQ ID NO: 295547 - RNA, 18 nt, Homo sapiens
uuagagugcauuacuuug

SEQ ID NO: 295548 - RNA, 22 nt, Homo sapiens
uuagaguguagcaggaagaggc

SEQ ID NO: 295549 - RNA, 22 nt, Homo sapiens
uuagauguuugacugggccuua

SEQ ID NO: 295550 - RNA, 22 nt, Homo sapiens
uuagcaauagccugcaucugca

SEQ ID NO: 295551 - RNA, 22 nt, Homo sapiens
uuagcaccacacacuuuagagg

SEQ ID NO: 295552 - RNA, 22 nt, Homo sapiens
uuagcacugagaauggcuugcu

SEQ ID NO: 295553 - RNA, 22 nt, Homo sapiens
uuagcagcaucccuggccugua

SEQ ID NO: 295554 - RNA, 22 nt, Homo sapiens
uuagcagccuucaagcuccaag

SEQ ID NO: 295555 - RNA, 22 nt, Homo sapiens
uuagcccagugggugcuucucu

SEQ ID NO: 295556 - RNA, 22 nt, Homo sapiens
uuagcucaguuggugagagcgu

SEQ ID NO: 295557 - RNA, 22 nt, Homo sapiens
uuaggcuaguugauauaguuug

SEQ ID NO: 295558 - RNA, 22 nt, Homo sapiens
uuaggcuuuauugaaaacaaua

SEQ ID NO: 295559 - RNA, 22 nt, Homo sapiens
uuaggcuuuuuaaccaguuguu

SEQ ID NO: 295560 - RNA, 22 nt, Homo sapiens
uuagggcaggcaugagagaacu

SEQ ID NO: 295561 - RNA, 18 nt, Homo sapiens
uuagguaggucuuugugu

SEQ ID NO: 295562 - RNA, 22 nt, Homo sapiens
uuagguaggugcuuuuuucaca

SEQ ID NO: 295563 - RNA, 22 nt, Homo sapiens
uuagguuauuacugacaauaau

SEQ ID NO: 295564 - RNA, 22 nt, Homo sapiens
uuaguagcacagaguaucagca

SEQ ID NO: 295565 - RNA, 20 nt, Homo sapiens
uuagucuccucugcccuguc

SEQ ID NO: 295566 - RNA, 22 nt, Homo sapiens
uuagugaaugcaccacuucuga

SEQ ID NO: 295567 - RNA, 22 nt, Homo sapiens
uuauaacucugcagccugguau

SEQ ID NO: 295568 - RNA, 22 nt, Homo sapiens
uuauacacugugggaguguaaa

SEQ ID NO: 295569 - RNA, 19 nt, Homo sapiens
uuauacuguauuguuuagg

SEQ ID NO: 295570 - RNA, 22 nt, Homo sapiens
uuauagacacguuguaacaaac

SEQ ID NO: 295571 - RNA, 22 nt, Homo sapiens
uuauagcacuaagaagguaaua

SEQ ID NO: 295572 - RNA, 22 nt, Homo sapiens
uuauagguuucuacaggacuau

SEQ ID NO: 295573 - RNA, 22 nt, Homo sapiens
uuauauguuacucccucuagca

SEQ ID NO: 295574 - RNA, 22 nt, Homo sapiens
uuauauguuagacauggugggu

SEQ ID NO: 295575 - RNA, 22 nt, Homo sapiens
uuaucacauugacugauuugca

SEQ ID NO: 295576 - RNA, 22 nt, Homo sapiens
uuaucccacuuucuguuccugu

SEQ ID NO: 295577 - RNA, 22 nt, Homo sapiens
uuaugaaguagguuaagagcag

SEQ ID NO: 295578 - RNA, 22 nt, Homo sapiens
guacaaguaagaaaauugccca

SEQ ID NO: 295579 - RNA, 22 nt, Homo sapiens
guacaagugcaguuucguuaca

SEQ ID NO: 295580 - RNA, 22 nt, Homo sapiens
guacacaacaugcagguuuguu

SEQ ID NO: 295581 - RNA, 16 nt, Homo sapiens
guacacaguaaguaug

SEQ ID NO: 295582 - RNA, 22 nt, Homo sapiens
guacaguaguaaaagugaauga

SEQ ID NO: 295583 - RNA, 22 nt, Homo sapiens
guacaguucucuuuguugucag

SEQ ID NO: 295584 - RNA, 22 nt, Homo sapiens
guacaugcauaguuuauuucug

SEQ ID NO: 295585 - RNA, 22 nt, Homo sapiens
guacaugcaugcaugggugugc

SEQ ID NO: 295586 - RNA, 22 nt, Homo sapiens
guagaagcacagggccuguauu

SEQ ID NO: 295587 - RNA, 22 nt, Homo sapiens
guagagugcugggcacuggcuc

SEQ ID NO: 295588 - RNA, 22 nt, Homo sapiens
guagcagaauaucagauaauuu

SEQ ID NO: 295589 - RNA, 22 nt, Homo sapiens
guauaguaguacaaaaguuuuu

SEQ ID NO: 295590 - RNA, 22 nt, Homo sapiens
guauccugaaguucucagcacu

SEQ ID NO: 295591 - RNA, 22 nt, Homo sapiens
guaugaguuuucugaugugugg

SEQ ID NO: 295592 - RNA, 22 nt, Homo sapiens
guaugauacuguaacagugggu

SEQ ID NO: 295593 - RNA, 22 nt, Homo sapiens
guauggaauuugugaccuuaua

SEQ ID NO: 295594 - RNA, 22 nt, Homo sapiens
guaugucuugucuauggcugcu

SEQ ID NO: 295595 - RNA, 22 nt, Homo sapiens
guauuagaugguauuugaagau

SEQ ID NO: 295596 - RNA, 22 nt, Homo sapiens
guauuugauuauagcaugcuua

SEQ ID NO: 295597 - RNA, 19 nt, Homo sapiens
gucaaagucgguauucaaa

SEQ ID NO: 295598 - RNA, 22 nt, Homo sapiens
gucaagagaacuuucuaucacu

SEQ ID NO: 295599 - RNA, 22 nt, Homo sapiens
gucacugagauugguauuaaug

SEQ ID NO: 295600 - RNA, 22 nt, Homo sapiens
gucacuguuuccuauuauauuu

SEQ ID NO: 295601 - RNA, 22 nt, Homo sapiens
gucagcuuguccagagacucug

SEQ ID NO: 295602 - RNA, 22 nt, Homo sapiens
gucaggcaccgauacaguuuuu

SEQ ID NO: 295603 - RNA, 22 nt, Homo sapiens
gucagggagggauagaugauua

SEQ ID NO: 295604 - RNA, 22 nt, Homo sapiens
gucagggagucucuaucagugg

SEQ ID NO: 295605 - RNA, 22 nt, Homo sapiens
gucagucugucccugccuggcg

SEQ ID NO: 295606 - RNA, 22 nt, Homo sapiens
gucagugcuuuaguucaggaug

SEQ ID NO: 295607 - RNA, 22 nt, Homo sapiens
gucaucaucaguccucugugca

SEQ ID NO: 295608 - RNA, 22 nt, Homo sapiens
gucauccaggcuggagugaagc

SEQ ID NO: 295609 - RNA, 22 nt, Homo sapiens
gucauggacaaggugugagcca

SEQ ID NO: 295610 - RNA, 22 nt, Homo sapiens
gucauggagggacauaacuaac

SEQ ID NO: 295611 - RNA, 22 nt, Homo sapiens
gucauggguuaaagguggauac

SEQ ID NO: 295612 - RNA, 22 nt, Homo sapiens
gucauguuuaacuucuugagga

SEQ ID NO: 295613 - RNA, 22 nt, Homo sapiens
gucauucauucagcaagcacug

SEQ ID NO: 295614 - RNA, 22 nt, Homo sapiens
gucauugcacuccagccuggac

SEQ ID NO: 295615 - RNA, 22 nt, Homo sapiens
guccaagacuaggaguuggcag

SEQ ID NO: 295616 - RNA, 22 nt, Homo sapiens
guccagagaagucauuacuuca

SEQ ID NO: 295617 - RNA, 22 nt, Homo sapiens
guccaguguuggagguuuuacc

SEQ ID NO: 295618 - RNA, 22 nt, Homo sapiens
gucccagagauauugugucuuu

SEQ ID NO: 295619 - RNA, 22 nt, Homo sapiens
gucccugaggaacauccagggc

SEQ ID NO: 295620 - RNA, 22 nt, Homo sapiens
guccuugaggcuuugacugugg

SEQ ID NO: 295621 - RNA, 22 nt, Homo sapiens
gucgugcagaccucacagcauu

SEQ ID NO: 295622 - RNA, 22 nt, Homo sapiens
gucguggagucucuggcuugua

SEQ ID NO: 295623 - RNA, 22 nt, Homo sapiens
gucuccgagccguguggagccg

SEQ ID NO: 295624 - RNA, 22 nt, Homo sapiens
gucucugguugcuuuuguacca

SEQ ID NO: 295625 - RNA, 22 nt, Homo sapiens
gucucuugguuuagagcauuua

SEQ ID NO: 295626 - RNA, 22 nt, Homo sapiens
gucuggcacagggaaaguacaa

SEQ ID NO: 295627 - RNA, 21 nt, Homo sapiens
gucugguguuuuaaugaggac

SEQ ID NO: 295628 - RNA, 22 nt, Homo sapiens
gucugguuggaguaguuuucag

SEQ ID NO: 295629 - RNA, 22 nt, Homo sapiens
gucuuccagccuccaucuuucu

SEQ ID NO: 295630 - RNA, 22 nt, Homo sapiens
gucuuggcaugugcagcuggga

SEQ ID NO: 295631 - RNA, 22 nt, Homo sapiens
gucuuugagauaggguuauuuu

SEQ ID NO: 295632 - RNA, 22 nt, Homo sapiens
gucuuugaugucuaugugcuuc

SEQ ID NO: 295633 - RNA, 22 nt, Homo sapiens
gucuuuggaaagacaaaguuca

SEQ ID NO: 295634 - RNA, 17 nt, Homo sapiens
gucuuugguugaguuua

SEQ ID NO: 295635 - RNA, 19 nt, Homo sapiens
ccauggcaaugaucugaug

SEQ ID NO: 295636 - RNA, 22 nt, Homo sapiens
ccauggcuauucuguaaggguu

SEQ ID NO: 295637 - RNA, 22 nt, Homo sapiens
ccauuucacucuuccugaagga

SEQ ID NO: 295638 - RNA, 21 nt, Homo sapiens
cccagguucucugaggguaga

SEQ ID NO: 295639 - RNA, 22 nt, Homo sapiens
cccagugugaacuuggcauuuu

SEQ ID NO: 295640 - RNA, 22 nt, Homo sapiens
cccagugugcugggugacagcu

SEQ ID NO: 295641 - RNA, 22 nt, Homo sapiens
cccaguuuugccacuuacuagc

SEQ ID NO: 295642 - RNA, 22 nt, Homo sapiens
cccauuguuaaguugaguaucu

SEQ ID NO: 295643 - RNA, 22 nt, Homo sapiens
ccccggguggauguacauguga

SEQ ID NO: 295644 - RNA, 22 nt, Homo sapiens
ccccugaaacucacucauuauc

SEQ ID NO: 295645 - RNA, 20 nt, Homo sapiens
ccccuggaguggggcugcuu

SEQ ID NO: 295646 - RNA, 18 nt, Homo sapiens
cccgggugggcuguuccc

SEQ ID NO: 295647 - RNA, 22 nt, Homo sapiens
cccugaagacuccaccgucaug

SEQ ID NO: 295648 - RNA, 22 nt, Homo sapiens
cccugagagcagggucuuucuc

SEQ ID NO: 295649 - RNA, 22 nt, Homo sapiens
cccugagcagccugaguuuccc

SEQ ID NO: 295650 - RNA, 22 nt, Homo sapiens
cccuggacacacacuuuuauuc

SEQ ID NO: 295651 - RNA, 22 nt, Homo sapiens
cccuguagcagcauucuuaaau

SEQ ID NO: 295652 - RNA, 22 nt, Homo sapiens
cccuguguuuagcugaagguuu

SEQ ID NO: 295653 - RNA, 22 nt, Homo sapiens
cccuugcacuucagagcugcau

SEQ ID NO: 295654 - RNA, 22 nt, Homo sapiens
ccucauggagaacuucugcuag

SEQ ID NO: 295655 - RNA, 22 nt, Homo sapiens
ccucauugcuaucccaggcuga

SEQ ID NO: 295656 - RNA, 21 nt, Homo sapiens
ccucuuugagggaagaaaggg

SEQ ID NO: 295657 - RNA, 22 nt, Homo sapiens
ccuggcacugagcaguguucua

SEQ ID NO: 295658 - RNA, 22 nt, Homo sapiens
ccugguguuuugauggucgggu

SEQ ID NO: 295659 - RNA, 22 nt, Homo sapiens
ccuguagcauccaagaagcugc

SEQ ID NO: 295660 - RNA, 18 nt, Homo sapiens
ccuuaguuauagagaguc

SEQ ID NO: 295661 - RNA, 22 nt, Homo sapiens
ccuugcacuucccaggugaggc

SEQ ID NO: 295662 - RNA, 22 nt, Homo sapiens
aaggcuuuuugcugacguccuu

SEQ ID NO: 295663 - RNA, 22 nt, Homo sapiens
aagggaaugcgcugccuguguu

SEQ ID NO: 295664 - RNA, 22 nt, Homo sapiens
aagggaaugugguagcugguuu

SEQ ID NO: 295665 - RNA, 22 nt, Homo sapiens
aagggaauguuguggcugguuu

SEQ ID NO: 295666 - RNA, 22 nt, Homo sapiens
aagggagcugcauaaucuugug

SEQ ID NO: 295667 - RNA, 22 nt, Homo sapiens
aagguagguuccaaaauaccua

SEQ ID NO: 295668 - RNA, 22 nt, Homo sapiens
aagguaguuagaaaauauaacu

SEQ ID NO: 295669 - RNA, 22 nt, Homo sapiens
aaggugcucucuuauguagaaa

SEQ ID NO: 295670 - RNA, 17 nt, Homo sapiens
aaggugcuucgaccucc

SEQ ID NO: 295671 - RNA, 21 nt, Homo sapiens
aaggugguggugauugagaug

SEQ ID NO: 295672 - RNA, 22 nt, Homo sapiens
aagguggugucagagagcuuau

SEQ ID NO: 295673 - RNA, 22 nt, Homo sapiens
aagguucuugcuugcaugacug

SEQ ID NO: 295674 - RNA, 21 nt, Homo sapiens
aagguuuuuagugcuugacuu

SEQ ID NO: 295675 - RNA, 22 nt, Homo sapiens
aaguaaauauccgguaguccca

SEQ ID NO: 295676 - RNA, 22 nt, Homo sapiens
aaguaaaucuuaugucagggag

SEQ ID NO: 295677 - RNA, 22 nt, Homo sapiens
aaguaauugagguuuuugcugu

SEQ ID NO: 295678 - RNA, 22 nt, Homo sapiens
aaguagcuggaugcaguggcac

SEQ ID NO: 295679 - RNA, 22 nt, Homo sapiens
aagucaaggagagaggcgucag

SEQ ID NO: 295680 - RNA, 22 nt, Homo sapiens
aagucacugagacuuguggcug

SEQ ID NO: 295681 - RNA, 22 nt, Homo sapiens
aaguccaugaagucuugugggu

SEQ ID NO: 295682 - RNA, 22 nt, Homo sapiens
aaguccccugacagaggggagg

SEQ ID NO: 295683 - RNA, 22 nt, Homo sapiens
aagugaaugaugugaaguguaa

SEQ ID NO: 295684 - RNA, 22 nt, Homo sapiens
aagugcuggccuacucaaucga

SEQ ID NO: 295685 - RNA, 22 nt, Homo sapiens
aagugcugggauuggccgggca

SEQ ID NO: 295686 - RNA, 22 nt, Homo sapiens
aagugcuguaugggagccuagg

SEQ ID NO: 295687 - RNA, 22 nt, Homo sapiens
aagugcuuaggauagugugugg

SEQ ID NO: 295688 - RNA, 22 nt, Homo sapiens
aagugcuuccuuucagaggguu

SEQ ID NO: 295689 - RNA, 20 nt, Homo sapiens
aagugcuuccuuuuagaggg

SEQ ID NO: 295690 - RNA, 22 nt, Homo sapiens
aagugguguuuguauuuaugca

SEQ ID NO: 295691 - RNA, 19 nt, Homo sapiens
aagugguuuaaacuuguau

SEQ ID NO: 295692 - RNA, 22 nt, Homo sapiens
aaguugguguaugagacagaag

SEQ ID NO: 295693 - RNA, 22 nt, Homo sapiens
aauaaagcagcuuuuugggacu

SEQ ID NO: 295694 - RNA, 22 nt, Homo sapiens
aauaaagcugaauccuuccuga

SEQ ID NO: 295695 - RNA, 22 nt, Homo sapiens
aauacucaguccuggugaggcu

SEQ ID NO: 295696 - RNA, 21 nt, Homo sapiens
aauacucuagguuaagagagc

SEQ ID NO: 295697 - RNA, 22 nt, Homo sapiens
aauagcauugaaucuaccaauu

SEQ ID NO: 295698 - RNA, 22 nt, Homo sapiens
aauaucacaguggguguacacc

SEQ ID NO: 295699 - RNA, 22 nt, Homo sapiens
aauauguccuugaaauggugcu

SEQ ID NO: 295700 - RNA, 22 nt, Homo sapiens
aauaugucugcuaauuguuucu

SEQ ID NO: 295701 - RNA, 22 nt, Homo sapiens
aauaugucuugaaauuggguaa

SEQ ID NO: 295702 - RNA, 22 nt, Homo sapiens
aauauugucaaaauggauucca

SEQ ID NO: 295703 - RNA, 22 nt, Homo sapiens
aaucacaggucuuggcugcaug

SEQ ID NO: 295704 - RNA, 22 nt, Homo sapiens
aaucacaguguucuugugaggg

SEQ ID NO: 295705 - RNA, 21 nt, Homo sapiens
aaucacaguuguucugccuuc

SEQ ID NO: 295706 - RNA, 22 nt, Homo sapiens
aaucacauuaaugcucccucag

SEQ ID NO: 295707 - RNA, 22 nt, Homo sapiens
aaucacauugaaucugcuaccu

SEQ ID NO: 295708 - RNA, 22 nt, Homo sapiens
aaucagagcccucugagcuuca

SEQ ID NO: 295709 - RNA, 22 nt, Homo sapiens
aaucagauuccagugguuggaa

SEQ ID NO: 295710 - RNA, 17 nt, Homo sapiens
aaucagauuucugagga

SEQ ID NO: 295711 - RNA, 22 nt, Homo sapiens
aaucauauugucugccaagagg

SEQ ID NO: 295712 - RNA, 22 nt, Homo sapiens
aaucauggaguauuuguccuug

SEQ ID NO: 295713 - RNA, 22 nt, Homo sapiens
aauccaugugcuuuaccauuuu

SEQ ID NO: 295714 - RNA, 16 nt, Homo sapiens
aauccauuggcccugc

SEQ ID NO: 295715 - RNA, 22 nt, Homo sapiens
gucuuuguuuggucuguaucag

SEQ ID NO: 295716 - RNA, 22 nt, Homo sapiens
gugaaauacauaaucccaagug

SEQ ID NO: 295717 - RNA, 22 nt, Homo sapiens
gugaaaugaaucuggaaauauu

SEQ ID NO: 295718 - RNA, 22 nt, Homo sapiens
gugaaauguguagaggaucugg

SEQ ID NO: 295719 - RNA, 22 nt, Homo sapiens
gugaacaagcaaaggcaggagg

SEQ ID NO: 295720 - RNA, 22 nt, Homo sapiens
gugaacagaaccugggaucgaa

SEQ ID NO: 295721 - RNA, 22 nt, Homo sapiens
gugaacagcagaugagugagug

SEQ ID NO: 295722 - RNA, 22 nt, Homo sapiens
gugaagaugugcaucagaucca

SEQ ID NO: 295723 - RNA, 22 nt, Homo sapiens
gugacacuggagcuggcacaau

SEQ ID NO: 295724 - RNA, 22 nt, Homo sapiens
gugacaguggagacuuacuuca

SEQ ID NO: 295725 - RNA, 22 nt, Homo sapiens
gugaccaaagauagcucaaguu

SEQ ID NO: 295726 - RNA, 22 nt, Homo sapiens
gugaccucuguugcugucacua

SEQ ID NO: 295727 - RNA, 22 nt, Homo sapiens
gugagaauauuuuaaauacuaa

SEQ ID NO: 295728 - RNA, 22 nt, Homo sapiens
gugagacugguucugaacccag

SEQ ID NO: 295729 - RNA, 22 nt, Homo sapiens
gugagauuuucuccagguucag

SEQ ID NO: 295730 - RNA, 22 nt, Homo sapiens
gugagcauauuaguauugcacu

SEQ ID NO: 295731 - RNA, 22 nt, Homo sapiens
gugagccaugauuuuaccacug

SEQ ID NO: 295732 - RNA, 22 nt, Homo sapiens
gugagcuccucuucugcugcag

SEQ ID NO: 295733 - RNA, 22 nt, Homo sapiens
gugagggagcuggaauauuuau

SEQ ID NO: 295734 - RNA, 22 nt, Homo sapiens
gugagggaugugaaaaagguca

SEQ ID NO: 295735 - RNA, 22 nt, Homo sapiens
gugagguaagaguugcuuugcu

SEQ ID NO: 295736 - RNA, 22 nt, Homo sapiens
gugagguagagcaugugaaaga

SEQ ID NO: 295737 - RNA, 17 nt, Homo sapiens
gugagguauccucaaaa

SEQ ID NO: 295738 - RNA, 21 nt, Homo sapiens
gugaggucauugggcuuucug

SEQ ID NO: 295739 - RNA, 21 nt, Homo sapiens
gugaucaugucacugcacucc

SEQ ID NO: 295740 - RNA, 22 nt, Homo sapiens
gugaugguccagggaaucucuu

SEQ ID NO: 295741 - RNA, 22 nt, Homo sapiens
gugauuauuaugcacugcaugc

SEQ ID NO: 295742 - RNA, 20 nt, Homo sapiens
gugauuggucacugguuguu

SEQ ID NO: 295743 - RNA, 21 nt, Homo sapiens
gugcaaacaucauagaaugua

SEQ ID NO: 295744 - RNA, 21 nt, Homo sapiens
gugcaacucccucucccuaca

SEQ ID NO: 295745 - RNA, 22 nt, Homo sapiens
gugcaagcaucauggaguguac

SEQ ID NO: 295746 - RNA, 22 nt, Homo sapiens
cugaguauuugaggccgaagga

SEQ ID NO: 295747 - RNA, 22 nt, Homo sapiens
cugagugcaagugauccuccca

SEQ ID NO: 295748 - RNA, 22 nt, Homo sapiens
cugaucuguagcagccaccaca

SEQ ID NO: 295749 - RNA, 22 nt, Homo sapiens
cugaucuguuauacuuuucuau

SEQ ID NO: 295750 - RNA, 22 nt, Homo sapiens
cugcaaauacuugugggauuuu

SEQ ID NO: 295751 - RNA, 21 nt, Homo sapiens
cugcaaaugcugcugccugau

SEQ ID NO: 295752 - RNA, 19 nt, Homo sapiens
cugcaagguaauaggucag

SEQ ID NO: 295753 - RNA, 20 nt, Homo sapiens
cugcacauccacucuacuuc

SEQ ID NO: 295754 - RNA, 22 nt, Homo sapiens
cugcaguaaacuuucccauuca

SEQ ID NO: 295755 - RNA, 22 nt, Homo sapiens
cugcauuagucuguuuaguguu

SEQ ID NO: 295756 - RNA, 18 nt, Homo sapiens
cugccagugugcucuccg

SEQ ID NO: 295757 - RNA, 22 nt, Homo sapiens
cugcuaagagaaugagacuuag

SEQ ID NO: 295758 - RNA, 22 nt, Homo sapiens
cugcuguuguuaacuuuuggag

SEQ ID NO: 295759 - RNA, 22 nt, Homo sapiens
cuggaaagaaucaggcuaaacu

SEQ ID NO: 295760 - RNA, 22 nt, Homo sapiens
cuggaaaguagacaaucuaaaa

SEQ ID NO: 295761 - RNA, 22 nt, Homo sapiens
cuggaaucuagaaaagguaagg

SEQ ID NO: 295762 - RNA, 22 nt, Homo sapiens
cuggaaugcagcuuuaggggcu

SEQ ID NO: 295763 - RNA, 22 nt, Homo sapiens
cuggaauuacaggguugagcua

SEQ ID NO: 295764 - RNA, 22 nt, Homo sapiens
cuggagauauuggaagaaagaa

SEQ ID NO: 295765 - RNA, 22 nt, Homo sapiens
cuggaggccugaacauaaaugg

SEQ ID NO: 295766 - RNA, 22 nt, Homo sapiens
cuggaguaugaaccauguauca

SEQ ID NO: 295767 - RNA, 22 nt, Homo sapiens
cuggaguaugauguuagcguug

SEQ ID NO: 295768 - RNA, 22 nt, Homo sapiens
cuggagucugacugacacaagg

SEQ ID NO: 295769 - RNA, 20 nt, Homo sapiens
cuggaucaucaguaaaguua

SEQ ID NO: 295770 - RNA, 22 nt, Homo sapiens
cuggcaguguuucuugugggcu

SEQ ID NO: 295771 - RNA, 22 nt, Homo sapiens
cuggcaucuaaauacuugaugu

SEQ ID NO: 295772 - RNA, 22 nt, Homo sapiens
cugggauggaggagaauuagag

SEQ ID NO: 295773 - RNA, 22 nt, Homo sapiens
cugggcaaugcggcuggauaga

SEQ ID NO: 295774 - RNA, 22 nt, Homo sapiens
cuggguacccuuuaaacaggaa

SEQ ID NO: 295775 - RNA, 22 nt, Homo sapiens
cugguaugcuucauaugcaaac

SEQ ID NO: 295776 - RNA, 22 nt, Homo sapiens
cugguuguuacaaagagccugg

SEQ ID NO: 295777 - RNA, 22 nt, Homo sapiens
cuguaaagaucacagagcuggu

SEQ ID NO: 295778 - RNA, 22 nt, Homo sapiens
cuguaaaguaagagguaaguua

SEQ ID NO: 295779 - RNA, 22 nt, Homo sapiens
cuguagacauuaggccugcacu

SEQ ID NO: 295780 - RNA, 22 nt, Homo sapiens
cuguagcuuuuauaugcuuagc

SEQ ID NO: 295781 - RNA, 22 nt, Homo sapiens
cuguccugcagagucagaauga

SEQ ID NO: 295782 - RNA, 22 nt, Homo sapiens
cugucuggaguccuucgugugc

SEQ ID NO: 295783 - RNA, 22 nt, Homo sapiens
cugugcaaguuauaggccaggu

SEQ ID NO: 295784 - RNA, 22 nt, Homo sapiens
cugugcaugcgcggagcugaaa

SEQ ID NO: 295785 - RNA, 22 nt, Homo sapiens
cugugcauggauuuuaagauug

SEQ ID NO: 295786 - RNA, 22 nt, Homo sapiens
cugugcuugauuauaugagugu

SEQ ID NO: 295787 - RNA, 22 nt, Homo sapiens
cuguggauguauugcacagucu

SEQ ID NO: 295788 - RNA, 22 nt, Homo sapiens
cuguggguuuuacuguuuuacu

SEQ ID NO: 295789 - RNA, 22 nt, Homo sapiens
cugugguugagcuuugccauga

SEQ ID NO: 295790 - RNA, 22 nt, Homo sapiens
cuguuugguaaggaugccucag

SEQ ID NO: 295791 - RNA, 22 nt, Homo sapiens
cuuaaagcgaauauugguggua

SEQ ID NO: 295792 - RNA, 22 nt, Homo sapiens
cuuaacagugguauugaugacc

SEQ ID NO: 295793 - RNA, 18 nt, Homo sapiens
cuuaacauugggaugaua

SEQ ID NO: 295794 - RNA, 22 nt, Homo sapiens
cuuagcaaugucguguacucac

SEQ ID NO: 295795 - RNA, 22 nt, Homo sapiens
acacauuagcaagugcuguuau

SEQ ID NO: 295796 - RNA, 22 nt, Homo sapiens
acaccaguacuuuauacaagca

SEQ ID NO: 295797 - RNA, 22 nt, Homo sapiens
acaccaucuccuuauuucucuu

SEQ ID NO: 295798 - RNA, 22 nt, Homo sapiens
acaccuguggucccaguaacuu

SEQ ID NO: 295799 - RNA, 22 nt, Homo sapiens
acacuauugagguuuguuugca

SEQ ID NO: 295800 - RNA, 22 nt, Homo sapiens
acacuguacuuauguuuugcag

SEQ ID NO: 295801 - RNA, 22 nt, Homo sapiens
acacugucucuugcugaccaug

SEQ ID NO: 295802 - RNA, 22 nt, Homo sapiens
acacuguugacauuuuguagug

SEQ ID NO: 295803 - RNA, 22 nt, Homo sapiens
acacuguuggugggaguguaaa

SEQ ID NO: 295804 - RNA, 22 nt, Homo sapiens
acacuuucuggagcugcacaua

SEQ ID NO: 295805 - RNA, 22 nt, Homo sapiens
acagcagugccccacucuacug

SEQ ID NO: 295806 - RNA, 20 nt, Homo sapiens
acagcauagccuuuuaaagc

SEQ ID NO: 295807 - RNA, 22 nt, Homo sapiens
acagguacaagggauuaggaug

SEQ ID NO: 295808 - RNA, 22 nt, Homo sapiens
acagguacacagaauauccaga

SEQ ID NO: 295809 - RNA, 22 nt, Homo sapiens
acaguauaaugcuguagggaga

SEQ ID NO: 295810 - RNA, 23 nt, Homo sapiens
acagucuaguuugaagucaggua

SEQ ID NO: 295811 - RNA, 22 nt, Homo sapiens
acagugcuguggucaugggucu

SEQ ID NO: 295812 - RNA, 22 nt, Homo sapiens
acagugcuucugauaugaugcc

SEQ ID NO: 295813 - RNA, 22 nt, Homo sapiens
acagugcuuggcacacaguaau

SEQ ID NO: 295814 - RNA, 19 nt, Homo sapiens
acagugcuuugucagaagc

SEQ ID NO: 295815 - RNA, 22 nt, Homo sapiens
acaguggugcgaucucggcuca

SEQ ID NO: 295816 - RNA, 23 nt, Homo sapiens
acaguggugugaucuuggcucag

SEQ ID NO: 295817 - RNA, 17 nt, Homo sapiens
acagugucuaugaaaug

SEQ ID NO: 295818 - RNA, 19 nt, Homo sapiens
acagugucucuauaaugau

SEQ ID NO: 295819 - RNA, 22 nt, Homo sapiens
acauacacuagggauguggugu

SEQ ID NO: 295820 - RNA, 22 nt, Homo sapiens
acauaguagacacugaaaauau

SEQ ID NO: 295821 - RNA, 21 nt, Homo sapiens
acaucagaguugugaagguag

SEQ ID NO: 295822 - RNA, 22 nt, Homo sapiens
acaugcauauguuggaagaaag

SEQ ID NO: 295823 - RNA, 19 nt, Homo sapiens
acauggauuuugugcaaac

SEQ ID NO: 295824 - RNA, 22 nt, Homo sapiens
acauguaauugauuuuguguua

SEQ ID NO: 295825 - RNA, 22 nt, Homo sapiens
acauugcucuuaccaaguuugu

SEQ ID NO: 295826 - RNA, 19 nt, Homo sapiens
accagauugcauucuugga

SEQ ID NO: 295827 - RNA, 22 nt, Homo sapiens
accagucucagguaugucuuua

SEQ ID NO: 295828 - RNA, 22 nt, Homo sapiens
accauugcacuccagccuuggc

SEQ ID NO: 295829 - RNA, 22 nt, Homo sapiens
accauugcacuucagccuaggc

SEQ ID NO: 295830 - RNA, 22 nt, Homo sapiens
acccacuagaugccaguggcac

SEQ ID NO: 295831 - RNA, 22 nt, Homo sapiens
acccaguaacauaugggaggga

SEQ ID NO: 295832 - RNA, 22 nt, Homo sapiens
acccaguagccagauguagcug

SEQ ID NO: 295833 - RNA, 22 nt, Homo sapiens
acccauacacacauauuuaugu

SEQ ID NO: 295834 - RNA, 22 nt, Homo sapiens
accccugagaucgaaucaugcu

SEQ ID NO: 295835 - RNA, 22 nt, Homo sapiens
acccgggaggcaggagucauag

SEQ ID NO: 295836 - RNA, 22 nt, Homo sapiens
acccgugcugaauauguaggug

SEQ ID NO: 295837 - RNA, 20 nt, Homo sapiens
acccucuaggaugauuucuu

SEQ ID NO: 295838 - RNA, 22 nt, Homo sapiens
acccuggagagugcuguaguaa

SEQ ID NO: 295839 - RNA, 22 nt, Homo sapiens
acccuggauucguggccuugaa

SEQ ID NO: 295840 - RNA, 22 nt, Homo sapiens
acccugguagcuaugaagucuu

SEQ ID NO: 295841 - RNA, 19 nt, Homo sapiens
cuuaggugaccaguuccca

SEQ ID NO: 295842 - RNA, 22 nt, Homo sapiens
cuucaaguuggaagggaccuaa

SEQ ID NO: 295843 - RNA, 22 nt, Homo sapiens
cuucacuuuguuaaacuccaau

SEQ ID NO: 295844 - RNA, 22 nt, Homo sapiens
cuucaugagacuuuuggaaggc

SEQ ID NO: 295845 - RNA, 22 nt, Homo sapiens
cuuccagcuggguucagucagu

SEQ ID NO: 295846 - RNA, 22 nt, Homo sapiens
cuucuugagacuuaggcuuugg

SEQ ID NO: 295847 - RNA, 22 nt, Homo sapiens
cuugaacaaagagauuccauua

SEQ ID NO: 295848 - RNA, 22 nt, Homo sapiens
cuugaauguaaauaauguacag

SEQ ID NO: 295849 - RNA, 22 nt, Homo sapiens
cuugauagugguaaucauuuuu

SEQ ID NO: 295850 - RNA, 22 nt, Homo sapiens
cuugccuuugucuucaaaggcu

SEQ ID NO: 295851 - RNA, 22 nt, Homo sapiens
cuuggcacgugauagguguuga

SEQ ID NO: 295852 - RNA, 20 nt, Homo sapiens
cuuggcuuucuugguguuaa

SEQ ID NO: 295853 - RNA, 22 nt, Homo sapiens
cuugggauauguguuacucugu

SEQ ID NO: 295854 - RNA, 22 nt, Homo sapiens
cuuguacacuguuggugggaau

SEQ ID NO: 295855 - RNA, 22 nt, Homo sapiens
cuuuccauuguuggagcauaaa

SEQ ID NO: 295856 - RNA, 22 nt, Homo sapiens
cuuugaugagaaaauacuuugu

SEQ ID NO: 295857 - RNA, 22 nt, Homo sapiens
cuuuggauggaaccucucuuuc

SEQ ID NO: 295858 - RNA, 22 nt, Homo sapiens
cuuuggucaauugcugcgggga

SEQ ID NO: 295859 - RNA, 20 nt, Homo sapiens
cuuuggugagucaacuccuu

SEQ ID NO: 295860 - RNA, 22 nt, Homo sapiens
cuuugguggagucuuuagguuc

SEQ ID NO: 295861 - RNA, 22 nt, Homo sapiens
cuuugguguauuuucagagacc

SEQ ID NO: 295862 - RNA, 21 nt, Homo sapiens
cuuugguuucugacuugcaua

SEQ ID NO: 295863 - RNA, 22 nt, Homo sapiens
cuuuguaugucaugacaacugu

SEQ ID NO: 295864 - RNA, 22 nt, Homo sapiens
cuuuguggggucuuuccucaaa

SEQ ID NO: 295865 - RNA, 22 nt, Homo sapiens
cuuuuacacugguggugggaau

SEQ ID NO: 295866 - RNA, 22 nt, Homo sapiens
cuuuuacacuguuggcaggauu

SEQ ID NO: 295867 - RNA, 22 nt, Homo sapiens
cuuuuacacuguuggugggaau

SEQ ID NO: 295868 - RNA, 21 nt, Homo sapiens
cuuuugcacuccagccugggu

SEQ ID NO: 295869 - RNA, 22 nt, Homo sapiens
cuuuuggcuuaagauugucuug

SEQ ID NO: 295870 - RNA, 20 nt, Homo sapiens
cuuuuugcugugcugggagc

SEQ ID NO: 295871 - RNA, 22 nt, Homo sapiens
cuuuuugguagagcaggugugc

SEQ ID NO: 295872 - RNA, 22 nt, Homo sapiens
gaaagcuaaugacuuuggguga

SEQ ID NO: 295873 - RNA, 22 nt, Homo sapiens
gaaaguaauuaacgauuguugc

SEQ ID NO: 295874 - RNA, 22 nt, Homo sapiens
gaaaguguugagauuacaggca

SEQ ID NO: 295875 - RNA, 22 nt, Homo sapiens
gaacccuggaggcggagguugc

SEQ ID NO: 295876 - RNA, 22 nt, Homo sapiens
gaacuuguguugcuucacaugu

SEQ ID NO: 295877 - RNA, 18 nt, Homo sapiens
gaagaaguaggcauggca

SEQ ID NO: 295878 - RNA, 22 nt, Homo sapiens
gaagaucacacuguagaucuau

SEQ ID NO: 295879 - RNA, 22 nt, Homo sapiens
uaacuucaucauaagucaagaa

SEQ ID NO: 295880 - RNA, 22 nt, Homo sapiens
uaagacacuuaaaauguuacau

SEQ ID NO: 295881 - RNA, 22 nt, Homo sapiens
uaagacuuuuugggaauauaga

SEQ ID NO: 295882 - RNA, 22 nt, Homo sapiens
uaagagcuaggauuuuaaauca

SEQ ID NO: 295883 - RNA, 21 nt, Homo sapiens
uaagcuaaacauucaguuaac

SEQ ID NO: 295884 - RNA, 22 nt, Homo sapiens
uaaggaaccagaaguggguagc

SEQ ID NO: 295885 - RNA, 22 nt, Homo sapiens
uaaggaaggcugugugcuuuua

SEQ ID NO: 295886 - RNA, 22 nt, Homo sapiens
uaaggauuuuggugauuacacu

SEQ ID NO: 295887 - RNA, 22 nt, Homo sapiens
uaaggcaaaccuuggcugcagu

SEQ ID NO: 295888 - RNA, 22 nt, Homo sapiens
uaaggcacccuucugaguagag

SEQ ID NO: 295889 - RNA, 22 nt, Homo sapiens
uaaggcacuacuuuaggcuuuc

SEQ ID NO: 295890 - RNA, 18 nt, Homo sapiens
uaaggcacuauaggcauu

SEQ ID NO: 295891 - RNA, 22 nt, Homo sapiens
uaagggacgcccccuucucucu

SEQ ID NO: 295892 - RNA, 22 nt, Homo sapiens
uaagguccuuaaauguguaacc

SEQ ID NO: 295893 - RNA, 22 nt, Homo sapiens
uaagguuuuugauaugcugcug

SEQ ID NO: 295894 - RNA, 22 nt, Homo sapiens
uaaguaauugugguuucugcca

SEQ ID NO: 295895 - RNA, 22 nt, Homo sapiens
uaaguauagguaacagaagcaa

SEQ ID NO: 295896 - RNA, 22 nt, Homo sapiens
uaaguauuuuaauuccuggcau

SEQ ID NO: 295897 - RNA, 22 nt, Homo sapiens
uaagugaauguuggcuacugaa

SEQ ID NO: 295898 - RNA, 22 nt, Homo sapiens
uaaguguaaugucugaaguuug

SEQ ID NO: 295899 - RNA, 22 nt, Homo sapiens
uaaguuagugugagaauuuugc

SEQ ID NO: 295900 - RNA, 18 nt, Homo sapiens
uaauaacugugaccuuga

SEQ ID NO: 295901 - RNA, 21 nt, Homo sapiens
uaauaaugucucagacaccua

SEQ ID NO: 295902 - RNA, 22 nt, Homo sapiens
uaauacucuucucauuuuacag

SEQ ID NO: 295903 - RNA, 22 nt, Homo sapiens
uaauacuugucauaaaggcauu

SEQ ID NO: 295904 - RNA, 22 nt, Homo sapiens
uaauagcaguguuacuaggacu

SEQ ID NO: 295905 - RNA, 22 nt, Homo sapiens
uaauauguauacagacagauac

SEQ ID NO: 295906 - RNA, 22 nt, Homo sapiens
uaauaugugguugcuugggcac

SEQ ID NO: 295907 - RNA, 22 nt, Homo sapiens
uaaucacagagguuuggccuca

SEQ ID NO: 295908 - RNA, 22 nt, Homo sapiens
uaaucucagcuacucaggaggc

SEQ ID NO: 295909 - RNA, 22 nt, Homo sapiens
uaaugcaucagugguaguucuu

SEQ ID NO: 295910 - RNA, 21 nt, Homo sapiens
uaauggcaugaucucggcuca

SEQ ID NO: 295911 - RNA, 22 nt, Homo sapiens
uaaugugcuucucuaccauagg

SEQ ID NO: 295912 - RNA, 22 nt, Homo sapiens
uaauucacauaaagcacuuaga

SEQ ID NO: 295913 - RNA, 22 nt, Homo sapiens
uacaaguggguuugugcaggag

SEQ ID NO: 295914 - RNA, 22 nt, Homo sapiens
uacaauagugacaaaucagcau

SEQ ID NO: 295915 - RNA, 20 nt, Homo sapiens
uacacguaugagcacaugug

SEQ ID NO: 295916 - RNA, 22 nt, Homo sapiens
uacacgugcacaacgugcacgu

SEQ ID NO: 295917 - RNA, 22 nt, Homo sapiens
uacagaauauuucugcccugag

SEQ ID NO: 295918 - RNA, 22 nt, Homo sapiens
uacagaguauccauuugaguuc

SEQ ID NO: 295919 - RNA, 22 nt, Homo sapiens
uacagcacugugcauagugguu

SEQ ID NO: 295920 - RNA, 23 nt, Homo sapiens
uacagcugcagaaucaggcuaag

SEQ ID NO: 295921 - RNA, 22 nt, Homo sapiens
acccugucaaaacggaccaauc

SEQ ID NO: 295922 - RNA, 22 nt, Homo sapiens
acccugucaaaauggaccaauc

SEQ ID NO: 295923 - RNA, 22 nt, Homo sapiens
acccugucauccacauggugcu

SEQ ID NO: 295924 - RNA, 18 nt, Homo sapiens
acccuucagcacugggcc

SEQ ID NO: 295925 - RNA, 22 nt, Homo sapiens
accgggcugagcgcaggccccg

SEQ ID NO: 295926 - RNA, 23 nt, Homo sapiens
accugauguuucuguggggagcc

SEQ ID NO: 295927 - RNA, 22 nt, Homo sapiens
accugcacagccgaacauagac

SEQ ID NO: 295928 - RNA, 19 nt, Homo sapiens
accuguagaaaguacaaca

SEQ ID NO: 295929 - RNA, 22 nt, Homo sapiens
accuguagcagacuuaauauuu

SEQ ID NO: 295930 - RNA, 22 nt, Homo sapiens
accuguauaacaagugggaaau

SEQ ID NO: 295931 - RNA, 23 nt, Homo sapiens
accuucauucauucagcugaagu

SEQ ID NO: 295932 - RNA, 22 nt, Homo sapiens
acuaaggcacaauuuucucaua

SEQ ID NO: 295933 - RNA, 22 nt, Homo sapiens
acuacugucagacugccacuga

SEQ ID NO: 295934 - RNA, 22 nt, Homo sapiens
acuccauuuccagagcagcccc

SEQ ID NO: 295935 - RNA, 18 nt, Homo sapiens
acucuguauguggagugg

SEQ ID NO: 295936 - RNA, 22 nt, Homo sapiens
acucugucuaguuguaaaauuu

SEQ ID NO: 295937 - RNA, 23 nt, Homo sapiens
acugagcaauguuuacauacuug

SEQ ID NO: 295938 - RNA, 22 nt, Homo sapiens
acugcaaugucgaauagagaug

SEQ ID NO: 295939 - RNA, 22 nt, Homo sapiens
acugcacuccaaccuuggugac

SEQ ID NO: 295940 - RNA, 22 nt, Homo sapiens
acugcacuccagccuaggcgac

SEQ ID NO: 295941 - RNA, 22 nt, Homo sapiens
acugcacuccagccucgugaca

SEQ ID NO: 295942 - RNA, 22 nt, Homo sapiens
acugcacuccagccugcugggu

SEQ ID NO: 295943 - RNA, 22 nt, Homo sapiens
acugcacuccagccuggacgac

SEQ ID NO: 295944 - RNA, 22 nt, Homo sapiens
acugcacuccagccuggcggac

SEQ ID NO: 295945 - RNA, 22 nt, Homo sapiens
acugcacuccagcuuuggugac

SEQ ID NO: 295946 - RNA, 20 nt, Homo sapiens
acugcacuccaggcugccca

SEQ ID NO: 295947 - RNA, 22 nt, Homo sapiens
acugcacuccaguuccgggcaa

SEQ ID NO: 295948 - RNA, 22 nt, Homo sapiens
acugcacucccgcccgggugac

SEQ ID NO: 295949 - RNA, 22 nt, Homo sapiens
acugcacucuagccuuggcaac

SEQ ID NO: 295950 - RNA, 20 nt, Homo sapiens
acugcacuucagccugcugg

SEQ ID NO: 295951 - RNA, 18 nt, Homo sapiens
acuggaauuaaacuuuuu

SEQ ID NO: 295952 - RNA, 22 nt, Homo sapiens
acuggacuuaaugaugaauugu

SEQ ID NO: 295953 - RNA, 22 nt, Homo sapiens
acuggcuguuaggaauuaccuc

SEQ ID NO: 295954 - RNA, 20 nt, Homo sapiens
acugggcuaccgaaguaagg

SEQ ID NO: 295955 - RNA, 22 nt, Homo sapiens
acuguacuacagccugggugac

SEQ ID NO: 295956 - RNA, 22 nt, Homo sapiens
acuguacuccagccugggcaac

SEQ ID NO: 295957 - RNA, 22 nt, Homo sapiens
acuguauagauggaguugauuu

SEQ ID NO: 295958 - RNA, 22 nt, Homo sapiens
acuugacacuuauauuacucac

SEQ ID NO: 295959 - RNA, 22 nt, Homo sapiens
acuuuuguuauacagugugaua

SEQ ID NO: 295960 - RNA, 21 nt, Homo sapiens
agaaaaucuuaugggaaacau

SEQ ID NO: 295961 - RNA, 22 nt, Homo sapiens
agaaacacagguggaauugcuu

SEQ ID NO: 295962 - RNA, 22 nt, Homo sapiens
agaaagcgcuucccuuugcugg

SEQ ID NO: 295963 - RNA, 22 nt, Homo sapiens
gaucacauguguacucaaugug

SEQ ID NO: 295964 - RNA, 20 nt, Homo sapiens
gaucaguuuggaguaagugc

SEQ ID NO: 295965 - RNA, 19 nt, Homo sapiens
gaucuguugaucaaugugu

SEQ ID NO: 295966 - RNA, 22 nt, Homo sapiens
gaucuguuucaauugucuuagu

SEQ ID NO: 295967 - RNA, 22 nt, Homo sapiens
gaugacagcugacucccuugcu

SEQ ID NO: 295968 - RNA, 22 nt, Homo sapiens
gaugacuaagaauuuuauaauu

SEQ ID NO: 295969 - RNA, 22 nt, Homo sapiens
gaugagaugagcauuugaauug

SEQ ID NO: 295970 - RNA, 22 nt, Homo sapiens
gaugagauguucucauggauug

SEQ ID NO: 295971 - RNA, 22 nt, Homo sapiens
gaugauauuugagucauuagaa

SEQ ID NO: 295972 - RNA, 22 nt, Homo sapiens
gaugaugcuagguguuagggcu

SEQ ID NO: 295973 - RNA, 22 nt, Homo sapiens
gauggaguugucgccugggcug

SEQ ID NO: 295974 - RNA, 22 nt, Homo sapiens
gauggauuuuaagugaaugaaa

SEQ ID NO: 295975 - RNA, 22 nt, Homo sapiens
gauggcagugcagccccuggcu

SEQ ID NO: 295976 - RNA, 22 nt, Homo sapiens
gauggcauuucuggaucugaca

SEQ ID NO: 295977 - RNA, 22 nt, Homo sapiens
gaugugaaaucauaguuucuag

SEQ ID NO: 295978 - RNA, 22 nt, Homo sapiens
gauuagaacagaagucagauua

SEQ ID NO: 295979 - RNA, 22 nt, Homo sapiens
gauuccauuuguggcuauuuac

SEQ ID NO: 295980 - RNA, 22 nt, Homo sapiens
gauuggccaaacuaaagaacug

SEQ ID NO: 295981 - RNA, 22 nt, Homo sapiens
gauuucaucuuuagaggaagga

SEQ ID NO: 295982 - RNA, 22 nt, Homo sapiens
gauuugguguucuggcucaaga

SEQ ID NO: 295983 - RNA, 22 nt, Homo sapiens
gauuuguuggccugugagcuag

SEQ ID NO: 295984 - RNA, 21 nt, Homo sapiens
gcaaacauccuuugaugccag

SEQ ID NO: 295985 - RNA, 22 nt, Homo sapiens
gcaaagaaugcagauuugccuc

SEQ ID NO: 295986 - RNA, 22 nt, Homo sapiens
gcaaaguaauuguuguuuuugc

SEQ ID NO: 295987 - RNA, 22 nt, Homo sapiens
gcaaaugcuacaccauuuugua

SEQ ID NO: 295988 - RNA, 20 nt, Homo sapiens
gcaaauggaucccacaagcc

SEQ ID NO: 295989 - RNA, 22 nt, Homo sapiens
gcaagaauggaacaggagagcc

SEQ ID NO: 295990 - RNA, 22 nt, Homo sapiens
gcaagaguauuucaaggaagau

SEQ ID NO: 295991 - RNA, 22 nt, Homo sapiens
gcaauacugacagcauuaguuu

SEQ ID NO: 295992 - RNA, 22 nt, Homo sapiens
gcacagaugaggagaggucuca

SEQ ID NO: 295993 - RNA, 22 nt, Homo sapiens
gcacagucaacacuuauucacc

SEQ ID NO: 295994 - RNA, 22 nt, Homo sapiens
gcacugagagaagccccaagua

SEQ ID NO: 295995 - RNA, 17 nt, Homo sapiens
gcacuggcguaucccac

SEQ ID NO: 295996 - RNA, 22 nt, Homo sapiens
gcacugggccacauuuauuuuc

SEQ ID NO: 295997 - RNA, 22 nt, Homo sapiens
gcagaucuucgcgguaaguguu

SEQ ID NO: 295998 - RNA, 23 nt, Homo sapiens
gcagcaaugucacagggguccgg

SEQ ID NO: 295999 - RNA, 22 nt, Homo sapiens
gcaggaaucuugagaaggauuc

SEQ ID NO: 296000 - RNA, 22 nt, Homo sapiens
gcaggaauuucucugcagaccc

SEQ ID NO: 296001 - RNA, 22 nt, Homo sapiens
gcaguagugcgaucucagcuca

SEQ ID NO: 296002 - RNA, 22 nt, Homo sapiens
auugcuucugauuuuaaaugag

SEQ ID NO: 296003 - RNA, 22 nt, Homo sapiens
auugcuuuuacugggagcuuug

SEQ ID NO: 296004 - RNA, 22 nt, Homo sapiens
auuggaguuguacgcacgcuca

SEQ ID NO: 296005 - RNA, 22 nt, Homo sapiens
auuggccaaugggacgucagca

SEQ ID NO: 296006 - RNA, 22 nt, Homo sapiens
auuggugaccugcggcaguaug

SEQ ID NO: 296007 - RNA, 22 nt, Homo sapiens
auuguaauuuuagagaaagugg

SEQ ID NO: 296008 - RNA, 22 nt, Homo sapiens
auuguaccccaauguacaauau

SEQ ID NO: 296009 - RNA, 22 nt, Homo sapiens
auugucacugugcuccaccagu

SEQ ID NO: 296010 - RNA, 22 nt, Homo sapiens
auugucacuuaaaagugcaugu

SEQ ID NO: 296011 - RNA, 22 nt, Homo sapiens
auuguuccccggucauuuuugu

SEQ ID NO: 296012 - RNA, 22 nt, Homo sapiens
auuucacuucgcaugguguccg

SEQ ID NO: 296013 - RNA, 22 nt, Homo sapiens
auuucuacuccuguguccagaa

SEQ ID NO: 296014 - RNA, 19 nt, Homo sapiens
auuugaucaucaggcacag

SEQ ID NO: 296015 - RNA, 21 nt, Homo sapiens
auuugcacugagcuccugugc

SEQ ID NO: 296016 - RNA, 20 nt, Homo sapiens
auuugcauuauggagcaccc

SEQ ID NO: 296017 - RNA, 22 nt, Homo sapiens
auuuggcaacguagggaggcau

SEQ ID NO: 296018 - RNA, 22 nt, Homo sapiens
auuuggcauagaguaucauucu

SEQ ID NO: 296019 - RNA, 22 nt, Homo sapiens
auuugguguuguuuggagccua

SEQ ID NO: 296020 - RNA, 22 nt, Homo sapiens
auuugucaauacacuucuucca

SEQ ID NO: 296021 - RNA, 22 nt, Homo sapiens
auuuuugguugucagcacuagg

SEQ ID NO: 296022 - RNA, 22 nt, Homo sapiens
caaagcacuuggcuuggaagau

SEQ ID NO: 296023 - RNA, 22 nt, Homo sapiens
caaaggcuucugaaacugcaga

SEQ ID NO: 296024 - RNA, 22 nt, Homo sapiens
caaaguaauugugguuuugcca

SEQ ID NO: 296025 - RNA, 22 nt, Homo sapiens
caaagugguuuauacaugauug

SEQ ID NO: 296026 - RNA, 19 nt, Homo sapiens
caaaguguucuucuuugcc

SEQ ID NO: 296027 - RNA, 22 nt, Homo sapiens
caaauccucaccucaucaugaa

SEQ ID NO: 296028 - RNA, 22 nt, Homo sapiens
caaaugacaucauuucauucaa

SEQ ID NO: 296029 - RNA, 22 nt, Homo sapiens
caaaugcuucuauggacugucu

SEQ ID NO: 296030 - RNA, 22 nt, Homo sapiens
caaauugcuuguggaggauaau

SEQ ID NO: 296031 - RNA, 20 nt, Homo sapiens
caaauugcuuucuugguuuu

SEQ ID NO: 296032 - RNA, 22 nt, Homo sapiens
caagaucauuuaugcuaaaauu

SEQ ID NO: 296033 - RNA, 22 nt, Homo sapiens
caaggaauucucaauagaguua

SEQ ID NO: 296034 - RNA, 22 nt, Homo sapiens
caaggcacagccccuacuuccu

SEQ ID NO: 296035 - RNA, 21 nt, Homo sapiens
caauggcacgaucuuggcuca

SEQ ID NO: 296036 - RNA, 22 nt, Homo sapiens
caaugguacuagauaucuucag

SEQ ID NO: 296037 - RNA, 22 nt, Homo sapiens
cacacugucuucauuacuguag

SEQ ID NO: 296038 - RNA, 22 nt, Homo sapiens
cacacugucuuucagaaugguu

SEQ ID NO: 296039 - RNA, 22 nt, Homo sapiens
cacacuguuuuccauggggguu

SEQ ID NO: 296040 - RNA, 22 nt, Homo sapiens
cacagaauucauuggauuaccu

SEQ ID NO: 296041 - RNA, 22 nt, Homo sapiens
cacagggcuaacauuuuugccc

SEQ ID NO: 296042 - RNA, 22 nt, Homo sapiens
cacaggucauccuggaucaagg

SEQ ID NO: 296043 - RNA, 22 nt, Homo sapiens
cacagucugggcuuguuuguac

SEQ ID NO: 296044 - RNA, 22 nt, Homo sapiens
cacagugaaugucaucauugcc

SEQ ID NO: 296045 - RNA, 22 nt, Homo sapiens
cacaguguuacugguaugaagu

SEQ ID NO: 296046 - RNA, 22 nt, Homo sapiens
cacaguguuccagcuauuugaa

SEQ ID NO: 296047 - RNA, 22 nt, Homo sapiens
cacaguugccuaucuccugaag

SEQ ID NO: 296048 - RNA, 22 nt, Homo sapiens
cacauagucccugcuaaucuuc

SEQ ID NO: 296049 - RNA, 22 nt, Homo sapiens
caccacauuccauugaucaggc

SEQ ID NO: 296050 - RNA, 22 nt, Homo sapiens
caccaggugcccagcacggcca

SEQ ID NO: 296051 - RNA, 22 nt, Homo sapiens
caccagguuggagugcaguggu

SEQ ID NO: 296052 - RNA, 23 nt, Homo sapiens
caccaguagaaugugugggaggg

SEQ ID NO: 296053 - RNA, 23 nt, Homo sapiens
caccaguauaauuagcuuuuaaa

SEQ ID NO: 296054 - RNA, 22 nt, Homo sapiens
cacccaguaagcaugaggcccu

SEQ ID NO: 296055 - RNA, 22 nt, Homo sapiens
cacccgugcucccuccagcugc

SEQ ID NO: 296056 - RNA, 22 nt, Homo sapiens
cacccuuagaguuggaaguggg

SEQ ID NO: 296057 - RNA, 22 nt, Homo sapiens
caccgagguuggagugcagugg

SEQ ID NO: 296058 - RNA, 22 nt, Homo sapiens
caccuguacauggcaguguccu

SEQ ID NO: 296059 - RNA, 22 nt, Homo sapiens
cacgugcuuucuuuucauuuag

SEQ ID NO: 296060 - RNA, 22 nt, Homo sapiens
cacugcaauuacuuuugcacca

SEQ ID NO: 296061 - RNA, 22 nt, Homo sapiens
cacugcacuccagucugacgac

SEQ ID NO: 296062 - RNA, 22 nt, Homo sapiens
cacugcacuccaguuuggauga

SEQ ID NO: 296063 - RNA, 22 nt, Homo sapiens
cacugcauccuccaccuccugg

SEQ ID NO: 296064 - RNA, 22 nt, Homo sapiens
cacugcauccuccauauccugg

SEQ ID NO: 296065 - RNA, 22 nt, Homo sapiens
cacuggucucauggcaugagag

SEQ ID NO: 296066 - RNA, 22 nt, Homo sapiens
auaagugagugauucaguguua

SEQ ID NO: 296067 - RNA, 22 nt, Homo sapiens
auaauaucagguugugaugaug

SEQ ID NO: 296068 - RNA, 22 nt, Homo sapiens
auaaucacacccagguuaaaug

SEQ ID NO: 296069 - RNA, 22 nt, Homo sapiens
auaauguuuauccagaggaguu

SEQ ID NO: 296070 - RNA, 22 nt, Homo sapiens
auaauugcuaagugaagauggu

SEQ ID NO: 296071 - RNA, 22 nt, Homo sapiens
auacaguaucuucuggcaagca

SEQ ID NO: 296072 - RNA, 22 nt, Homo sapiens
auacagugaauacuuacagugu

SEQ ID NO: 296073 - RNA, 20 nt, Homo sapiens
cauugcacuccagccugcug

SEQ ID NO: 296074 - RNA, 22 nt, Homo sapiens
cauugcacuccagccugcugac

SEQ ID NO: 296075 - RNA, 22 nt, Homo sapiens
cauugcacuccagccuggcaac

SEQ ID NO: 296076 - RNA, 22 nt, Homo sapiens
cauugcacuccagcucugggcg

SEQ ID NO: 296077 - RNA, 22 nt, Homo sapiens
cauugcacucuagccucggcaa

SEQ ID NO: 296078 - RNA, 22 nt, Homo sapiens
cauugcacucuagucuggguga

SEQ ID NO: 296079 - RNA, 22 nt, Homo sapiens
cauugcagauccuucaaaugac

SEQ ID NO: 296080 - RNA, 22 nt, Homo sapiens
cauugcauuuucuuuguaccuu

SEQ ID NO: 296081 - RNA, 22 nt, Homo sapiens
cauuggugauuagugaaugaac

SEQ ID NO: 296082 - RNA, 22 nt, Homo sapiens
cauugguuuauagauggggaaa

SEQ ID NO: 296083 - RNA, 22 nt, Homo sapiens
cauuugcacugagacucagcuu

SEQ ID NO: 296084 - RNA, 22 nt, Homo sapiens
ccaaaguauuuucacugauauc

SEQ ID NO: 296085 - RNA, 22 nt, Homo sapiens
ccaagccucaguuucccucugu

SEQ ID NO: 296086 - RNA, 22 nt, Homo sapiens
ccaaggcacugauucuguacuc

SEQ ID NO: 296087 - RNA, 22 nt, Homo sapiens
ccaaguguuuucauuguuccau

SEQ ID NO: 296088 - RNA, 22 nt, Homo sapiens
ccacaaccucaacagcaucuau

SEQ ID NO: 296089 - RNA, 22 nt, Homo sapiens
ccacaguugaaauuuugacugu

SEQ ID NO: 296090 - RNA, 22 nt, Homo sapiens
ccacauuaccuugcuugcucca

SEQ ID NO: 296091 - RNA, 22 nt, Homo sapiens
ccaccgggucccagcucugcuc

SEQ ID NO: 296092 - RNA, 22 nt, Homo sapiens
ccaccuguacuuaagucacuuu

SEQ ID NO: 296093 - RNA, 22 nt, Homo sapiens
ccagaguggagccuuugcgagg

SEQ ID NO: 296094 - RNA, 22 nt, Homo sapiens
ccaggguugagacccacugacu

SEQ ID NO: 296095 - RNA, 22 nt, Homo sapiens
ccaguauuuuauugaggguuuu

SEQ ID NO: 296096 - RNA, 22 nt, Homo sapiens
ccagugaacugcaagguuuuuc

SEQ ID NO: 296097 - RNA, 22 nt, Homo sapiens
ccagugcugugcaguguaugag

SEQ ID NO: 296098 - RNA, 22 nt, Homo sapiens
ccagugguucccuguggccuga

SEQ ID NO: 296099 - RNA, 22 nt, Homo sapiens
ccagugucugacagacacggcg

SEQ ID NO: 296100 - RNA, 22 nt, Homo sapiens
ccaguguucuggaaggcugagu

SEQ ID NO: 296101 - RNA, 22 nt, Homo sapiens
ccaguucaaugauauggaaacu

SEQ ID NO: 296102 - RNA, 22 nt, Homo sapiens
ccaguuuuucauuuauacuagu

SEQ ID NO: 296103 - RNA, 22 nt, Homo sapiens
ccaguuuuuggcaaugaugaau

SEQ ID NO: 296104 - RNA, 22 nt, Homo sapiens
ccaucccuuucugagcaguucc

SEQ ID NO: 296105 - RNA, 22 nt, Homo sapiens
ccauggcaauggucagucuauu

SEQ ID NO: 296106 - RNA, 18 nt, Homo sapiens
ccauucaacagauuuguc

SEQ ID NO: 296107 - RNA, 22 nt, Homo sapiens
ccauugcacucuggccuaggug

SEQ ID NO: 296108 - RNA, 22 nt, Homo sapiens
cccacaguggccucauauccuu

SEQ ID NO: 296109 - RNA, 22 nt, Homo sapiens
cccagagacagaaugauaaacu

SEQ ID NO: 296110 - RNA, 22 nt, Homo sapiens
cccagaguucuuaaauacugag

SEQ ID NO: 296111 - RNA, 22 nt, Homo sapiens
cccaguaaucuugccaguuuuc

SEQ ID NO: 296112 - RNA, 22 nt, Homo sapiens
cccagugguuacauaaggagua

SEQ ID NO: 296113 - RNA, 22 nt, Homo sapiens
cccaguguuacgugacagccug

SEQ ID NO: 296114 - RNA, 22 nt, Homo sapiens
ccccagguuucaauaaagccca

SEQ ID NO: 296115 - RNA, 22 nt, Homo sapiens
ccccagugguugcaacagcaga

SEQ ID NO: 296116 - RNA, 22 nt, Homo sapiens
ccccaguguguaaaggccuugc

SEQ ID NO: 296117 - RNA, 22 nt, Homo sapiens
ccccauuugaacuccuucaacu

SEQ ID NO: 296118 - RNA, 22 nt, Homo sapiens
ccccguuacagccucagugccu

SEQ ID NO: 296119 - RNA, 17 nt, Homo sapiens
ccccugagcgaugcagu

SEQ ID NO: 296120 - RNA, 19 nt, Homo sapiens
ccccuguggauaccgaggg

SEQ ID NO: 296121 - RNA, 22 nt, Homo sapiens
cccgugucuuggucuagggccu

SEQ ID NO: 296122 - RNA, 22 nt, Homo sapiens
cccugagaugcuguuaaucugu

SEQ ID NO: 296123 - RNA, 19 nt, Homo sapiens
cccuggcacauggaaaaug

SEQ ID NO: 296124 - RNA, 22 nt, Homo sapiens
cccuucauucaaggguugugag

SEQ ID NO: 296125 - RNA, 22 nt, Homo sapiens
ccgugcacggaaaggcauauuu

SEQ ID NO: 296126 - RNA, 22 nt, Homo sapiens
ccuaggcacugggguccagccc

SEQ ID NO: 296127 - RNA, 22 nt, Homo sapiens
ccuccauuugugucaggaaguc

SEQ ID NO: 296128 - RNA, 22 nt, Homo sapiens
ccucccuuuguugcaagggaaa

SEQ ID NO: 296129 - RNA, 22 nt, Homo sapiens
ccugagacgaauggagugaaca

SEQ ID NO: 296130 - RNA, 22 nt, Homo sapiens
ccugagaucauacuguuaguaa

SEQ ID NO: 296131 - RNA, 22 nt, Homo sapiens
ccuggaagaaaggugcuaaaua

SEQ ID NO: 296132 - RNA, 22 nt, Homo sapiens
ccugucuugaagagauccuccu

SEQ ID NO: 296133 - RNA, 22 nt, Homo sapiens
ccugugguuaaccagcuagaug

SEQ ID NO: 296134 - RNA, 21 nt, Homo sapiens
ccuugagaacaucaauuugcu

SEQ ID NO: 296135 - RNA, 22 nt, Homo sapiens
ccuuggcacuuugccacagugc

SEQ ID NO: 296136 - RNA, 22 nt, Homo sapiens
ccuugguggccacaagacauug

SEQ ID NO: 296137 - RNA, 22 nt, Homo sapiens
cgaguagcacaaugugugugau

SEQ ID NO: 296138 - RNA, 22 nt, Homo sapiens
cgugaggaguauuuuuaggugc

SEQ ID NO: 296139 - RNA, 16 nt, Homo sapiens
cuaaaaugucuacuug

SEQ ID NO: 296140 - RNA, 22 nt, Homo sapiens
cuaaaguagccaggacugcagg

SEQ ID NO: 296141 - RNA, 22 nt, Homo sapiens
cuaaagugcugagauuauaggu

SEQ ID NO: 296142 - RNA, 22 nt, Homo sapiens
cuaaaguucuucugagagaaca

SEQ ID NO: 296143 - RNA, 22 nt, Homo sapiens
cuaaaugcacugucaaaggaag

SEQ ID NO: 296144 - RNA, 22 nt, Homo sapiens
cuaacacagagguuuauuucuc

SEQ ID NO: 296145 - RNA, 22 nt, Homo sapiens
cuaacuaugucucaggaugucc

SEQ ID NO: 296146 - RNA, 18 nt, Homo sapiens
cuaagacacuuggcagag

SEQ ID NO: 296147 - RNA, 22 nt, Homo sapiens
cuaagcaccuuaguggggaauc

SEQ ID NO: 296148 - RNA, 21 nt, Homo sapiens
cuaaggaaagcuaugaacccu

SEQ ID NO: 296149 - RNA, 20 nt, Homo sapiens
cuaaucaucccagaagaaau

SEQ ID NO: 296150 - RNA, 22 nt, Homo sapiens
cuagcccagugcuccuggauca

SEQ ID NO: 296151 - RNA, 22 nt, Homo sapiens
cuagccuggagugcaguggugc

SEQ ID NO: 296152 - RNA, 22 nt, Homo sapiens
cuaggcacgccugggucuccag

SEQ ID NO: 296153 - RNA, 22 nt, Homo sapiens
cuagguuauacucugaaauggu

SEQ ID NO: 296154 - RNA, 22 nt, Homo sapiens
cuaguaaugucugucuuaugga

SEQ ID NO: 296155 - RNA, 18 nt, Homo sapiens
cuaguguuucuugaauca

SEQ ID NO: 296156 - RNA, 22 nt, Homo sapiens
cuaugcuucuuaaauuaguuau

SEQ ID NO: 296157 - RNA, 22 nt, Homo sapiens
cuauggcuguagucccugugua

SEQ ID NO: 296158 - RNA, 21 nt, Homo sapiens
cucaaaguacugauauuacag

SEQ ID NO: 296159 - RNA, 22 nt, Homo sapiens
cucaaagugcugggauuggcca

SEQ ID NO: 296160 - RNA, 19 nt, Homo sapiens
cucaaagugguauuuggag

SEQ ID NO: 296161 - RNA, 22 nt, Homo sapiens
cucaaguacaugggauuacagg

SEQ ID NO: 296162 - RNA, 22 nt, Homo sapiens
cucacaugcucaccugguguuc

SEQ ID NO: 296163 - RNA, 22 nt, Homo sapiens
cucacggugcaggcuucuggga

SEQ ID NO: 296164 - RNA, 22 nt, Homo sapiens
cucacugcauuucaguuuuguu

SEQ ID NO: 296165 - RNA, 22 nt, Homo sapiens
cucacugggaccacucugaagu

SEQ ID NO: 296166 - RNA, 22 nt, Homo sapiens
cucacuggguguaaaacaugua

SEQ ID NO: 296167 - RNA, 22 nt, Homo sapiens
cucagagcacaguuuaugacag

SEQ ID NO: 296168 - RNA, 22 nt, Homo sapiens
cucaguagaaaauacauggacu

SEQ ID NO: 296169 - RNA, 22 nt, Homo sapiens
cucagugaagggcaagaggcaa

SEQ ID NO: 296170 - RNA, 22 nt, Homo sapiens
cucauggagaacaucugcuagg

SEQ ID NO: 296171 - RNA, 22 nt, Homo sapiens
cucauuaguuguuuuaagauga

SEQ ID NO: 296172 - RNA, 22 nt, Homo sapiens
cuccaggugagguuaagggacu

SEQ ID NO: 296173 - RNA, 22 nt, Homo sapiens
cuccauagucuucgaagaauga

SEQ ID NO: 296174 - RNA, 22 nt, Homo sapiens
cuccaugagauuguugaaguag

SEQ ID NO: 296175 - RNA, 22 nt, Homo sapiens
cuccauuuggaacagauguccu

SEQ ID NO: 296176 - RNA, 22 nt, Homo sapiens
cucccagagccaguuauaggcu

SEQ ID NO: 296177 - RNA, 22 nt, Homo sapiens
cucccagugacccaggaacagg

SEQ ID NO: 296178 - RNA, 22 nt, Homo sapiens
cuccuguagccccaucaucuuu

SEQ ID NO: 296179 - RNA, 22 nt, Homo sapiens
cucucugagccccagacaccuu

SEQ ID NO: 296180 - RNA, 22 nt, Homo sapiens
cucugagccugagguuccuacu

SEQ ID NO: 296181 - RNA, 22 nt, Homo sapiens
cucugguucugcagugcacccu

SEQ ID NO: 296182 - RNA, 20 nt, Homo sapiens
cucugguugugaauugucuu

SEQ ID NO: 296183 - RNA, 22 nt, Homo sapiens
cucuuugaggugagcugcccau

SEQ ID NO: 296184 - RNA, 22 nt, Homo sapiens
cucuuugaguuccuccuggugu

SEQ ID NO: 296185 - RNA, 22 nt, Homo sapiens
cucuuugcuucuggcaucauug

SEQ ID NO: 296186 - RNA, 19 nt, Homo sapiens
cucuuuggugucucuucuu

SEQ ID NO: 296187 - RNA, 22 nt, Homo sapiens
cugaaaagcaucugcauagcug

SEQ ID NO: 296188 - RNA, 19 nt, Homo sapiens
cugaaacacagagagggcu

SEQ ID NO: 296189 - RNA, 22 nt, Homo sapiens
cugaaagagcauguaacacagu

SEQ ID NO: 296190 - RNA, 22 nt, Homo sapiens
cugaaauggaaugugugcacag

SEQ ID NO: 296191 - RNA, 22 nt, Homo sapiens
cugaaauguccaucgacugaug

SEQ ID NO: 296192 - RNA, 22 nt, Homo sapiens
cugaauguccaggcagagguuu

SEQ ID NO: 296193 - RNA, 22 nt, Homo sapiens
cugaauguucuggauggaagag

SEQ ID NO: 296194 - RNA, 22 nt, Homo sapiens
cugacacuucaaaacugccaau

SEQ ID NO: 296195 - RNA, 22 nt, Homo sapiens
cugacagucucauugauuugcu

SEQ ID NO: 296196 - RNA, 22 nt, Homo sapiens
cugacaucuucaagugaggaga

SEQ ID NO: 296197 - RNA, 22 nt, Homo sapiens
cugacuuauguggacuauuuca

SEQ ID NO: 296198 - RNA, 22 nt, Homo sapiens
cugagaacaucauucagauauu

SEQ ID NO: 296199 - RNA, 22 nt, Homo sapiens
cugagauaauuucuagguguca

SEQ ID NO: 296200 - RNA, 22 nt, Homo sapiens
cugagcacugagauccucuagc

SEQ ID NO: 296201 - RNA, 22 nt, Homo sapiens
cugagcccauucuggggagaag

SEQ ID NO: 296202 - RNA, 22 nt, Homo sapiens
cugaggguagaaggaucacuug

SEQ ID NO: 296203 - RNA, 22 nt, Homo sapiens
cugagguaauuuguugccagua

SEQ ID NO: 296204 - RNA, 22 nt, Homo sapiens
cugagguaauuuuccagauaau

SEQ ID NO: 296205 - RNA, 22 nt, Homo sapiens
cugagguacugggggccaggau

SEQ ID NO: 296206 - RNA, 22 nt, Homo sapiens
cugagguagcucaggguauugc

SEQ ID NO: 296207 - RNA, 22 nt, Homo sapiens
cugagguaggugaucagugcuu

SEQ ID NO: 296208 - RNA, 22 nt, Homo sapiens
cugagguauaucccauuagaag

SEQ ID NO: 296209 - RNA, 22 nt, Homo sapiens
cugagguauuuaggugaaagaa

SEQ ID NO: 296210 - RNA, 22 nt, Homo sapiens
cugaggugauauauacauauuu

SEQ ID NO: 296211 - RNA, 22 nt, Homo sapiens
cugagguuaggaguuugagacc

SEQ ID NO: 296212 - RNA, 18 nt, Homo sapiens
cugagucauuccuggguc

SEQ ID NO: 296213 - RNA, 22 nt, Homo sapiens
cugauaaguuuuucuuuauaag

SEQ ID NO: 296214 - RNA, 22 nt, Homo sapiens
cugauacucuccuuuuagagag

SEQ ID NO: 296215 - RNA, 22 nt, Homo sapiens
cugauacugaaagcuguugguu

SEQ ID NO: 296216 - RNA, 22 nt, Homo sapiens
cugauaugaugggugauuuuca

SEQ ID NO: 296217 - RNA, 22 nt, Homo sapiens
cugaucuggaggugucugggga

SEQ ID NO: 296218 - RNA, 22 nt, Homo sapiens
cugaugaaguauuuguucugga

SEQ ID NO: 296219 - RNA, 22 nt, Homo sapiens
cugauguagguggucugugauc

SEQ ID NO: 296220 - RNA, 22 nt, Homo sapiens
cugauugucuauuuaguucacu

SEQ ID NO: 296221 - RNA, 22 nt, Homo sapiens
cugcaauggagaaagugagacu

SEQ ID NO: 296222 - RNA, 22 nt, Homo sapiens
cugcaguaaccacuguaggugu

SEQ ID NO: 296223 - RNA, 22 nt, Homo sapiens
cugcauuggguuaugcauuuuu

SEQ ID NO: 296224 - RNA, 22 nt, Homo sapiens
cugcccguaauccucuccccag

SEQ ID NO: 296225 - RNA, 22 nt, Homo sapiens
cugcccuuucuauaugauguaa

SEQ ID NO: 296226 - RNA, 22 nt, Homo sapiens
cugccuagaucugaaccuggcu

SEQ ID NO: 296227 - RNA, 22 nt, Homo sapiens
cugccugagaaaauggagggca

SEQ ID NO: 296228 - RNA, 20 nt, Homo sapiens
cugcuccccuacaaaucuca

SEQ ID NO: 296229 - RNA, 22 nt, Homo sapiens
cugcuggucuuuaaggucuagg

SEQ ID NO: 296230 - RNA, 22 nt, Homo sapiens
cuggaaagcaaagggugcauug

SEQ ID NO: 296231 - RNA, 22 nt, Homo sapiens
acaucccuuucccacccuucac

SEQ ID NO: 296232 - RNA, 22 nt, Homo sapiens
acaugcauccaugugaagagac

SEQ ID NO: 296233 - RNA, 22 nt, Homo sapiens
acaugccucccugguccgcugu

SEQ ID NO: 296234 - RNA, 21 nt, Homo sapiens
acauguacacauguaugcaca

SEQ ID NO: 296235 - RNA, 22 nt, Homo sapiens
acauucagcuguuguuucaaug

SEQ ID NO: 296236 - RNA, 22 nt, Homo sapiens
acauugcauauggcacccucuu

SEQ ID NO: 296237 - RNA, 22 nt, Homo sapiens
accauugcacuccagccugggc

SEQ ID NO: 296238 - RNA, 22 nt, Homo sapiens
acccagaguuccuugucuuuca

SEQ ID NO: 296239 - RNA, 22 nt, Homo sapiens
acccaguagucauucaggagca

SEQ ID NO: 296240 - RNA, 22 nt, Homo sapiens
acccaguguucaacauucacau

SEQ ID NO: 296241 - RNA, 22 nt, Homo sapiens
acccaguguucagacuaccugu

SEQ ID NO: 296242 - RNA, 22 nt, Homo sapiens
acccgugcucacugccucugcc

SEQ ID NO: 296243 - RNA, 22 nt, Homo sapiens
acccugaagccaugaguggaac

SEQ ID NO: 296244 - RNA, 22 nt, Homo sapiens
acccugacacgauucuucacuu

SEQ ID NO: 296245 - RNA, 22 nt, Homo sapiens
acccugcuaaacagcccccugc

SEQ ID NO: 296246 - RNA, 22 nt, Homo sapiens
acccuggaguaguaggaaucug

SEQ ID NO: 296247 - RNA, 22 nt, Homo sapiens
acccuguaacauacaagugguu

SEQ ID NO: 296248 - RNA, 22 nt, Homo sapiens
acccuguaggugcuggcagaga

SEQ ID NO: 296249 - RNA, 22 nt, Homo sapiens
acccugucaaaauagaccaauc

SEQ ID NO: 296250 - RNA, 22 nt, Homo sapiens
acccugugagagaguuaauauu

SEQ ID NO: 296251 - RNA, 22 nt, Homo sapiens
acccuuagguuaaaguugaguc

SEQ ID NO: 296252 - RNA, 20 nt, Homo sapiens
accgggugaaacccuaucuc

SEQ ID NO: 296253 - RNA, 22 nt, Homo sapiens
accugagacuaggcauuuuaua

SEQ ID NO: 296254 - RNA, 22 nt, Homo sapiens
accuggacacuuugggcuccuc

SEQ ID NO: 296255 - RNA, 22 nt, Homo sapiens
accuggguguauguucaguuug

SEQ ID NO: 296256 - RNA, 22 nt, Homo sapiens
accugugguuacagucugucuc

SEQ ID NO: 296257 - RNA, 22 nt, Homo sapiens
accuucauuguugccaugucca

SEQ ID NO: 296258 - RNA, 22 nt, Homo sapiens
acgugguaguacaguauuuuaa

SEQ ID NO: 296259 - RNA, 20 nt, Homo sapiens
acuaaaucucauuuuaugca

SEQ ID NO: 296260 - RNA, 22 nt, Homo sapiens
acuacaugugaugucaguauau

SEQ ID NO: 296261 - RNA, 22 nt, Homo sapiens
acuacuucuaaguuuuggaaga

SEQ ID NO: 296262 - RNA, 22 nt, Homo sapiens
acuagagaugcauuuguaguuu

SEQ ID NO: 296263 - RNA, 22 nt, Homo sapiens
acuauacugaagcaaauuaaca

SEQ ID NO: 296264 - RNA, 22 nt, Homo sapiens
acuauacuguaacuguauucag

SEQ ID NO: 296265 - RNA, 22 nt, Homo sapiens
acucagagauuagcacauguuu

SEQ ID NO: 296266 - RNA, 22 nt, Homo sapiens
acucauugcucauaccuuaucu

SEQ ID NO: 296267 - RNA, 22 nt, Homo sapiens
acugagacugagaauguuucuu

SEQ ID NO: 296268 - RNA, 19 nt, Homo sapiens
acugagcuaccugggggca

SEQ ID NO: 296269 - RNA, 22 nt, Homo sapiens
acugaguguugauuuagauuaa

SEQ ID NO: 296270 - RNA, 22 nt, Homo sapiens
acugaucaauguuaaggcuuau

SEQ ID NO: 296271 - RNA, 21 nt, Homo sapiens
acugauguuugaaauucgcug

SEQ ID NO: 296272 - RNA, 22 nt, Homo sapiens
acugcacuccaaccuguugggc

SEQ ID NO: 296273 - RNA, 20 nt, Homo sapiens
acugcacuccaaccuuugug

SEQ ID NO: 296274 - RNA, 22 nt, Homo sapiens
acugcacuccagcccaggugac

SEQ ID NO: 296275 - RNA, 22 nt, Homo sapiens
acugcacuccagccuccugaca

SEQ ID NO: 296276 - RNA, 22 nt, Homo sapiens
acugcacuccagccucggugac

SEQ ID NO: 296277 - RNA, 22 nt, Homo sapiens
acugcacuccagccuucaggac

SEQ ID NO: 296278 - RNA, 20 nt, Homo sapiens
acugcacuccagccuuccag

SEQ ID NO: 296279 - RNA, 22 nt, Homo sapiens
acugcacuccagccuugauggc

SEQ ID NO: 296280 - RNA, 22 nt, Homo sapiens
acugcacuccagccuuggcaac

SEQ ID NO: 296281 - RNA, 22 nt, Homo sapiens
acugcacuccagccuuggcggc

SEQ ID NO: 296282 - RNA, 22 nt, Homo sapiens
acugcacuccagcuccagggug

SEQ ID NO: 296283 - RNA, 22 nt, Homo sapiens
acugcacuccagcuugggugac

SEQ ID NO: 296284 - RNA, 22 nt, Homo sapiens
acugcacuccaucuuagguggc

SEQ ID NO: 296285 - RNA, 22 nt, Homo sapiens
acugcacuccggccucgugaca

SEQ ID NO: 296286 - RNA, 19 nt, Homo sapiens
acugcacuccuccuugggu

SEQ ID NO: 296287 - RNA, 22 nt, Homo sapiens
acugcacuuauccuccaauguu

SEQ ID NO: 296288 - RNA, 22 nt, Homo sapiens
acugcacuucagccuugugaca

SEQ ID NO: 296289 - RNA, 20 nt, Homo sapiens
acugcauuuaguccucagga

SEQ ID NO: 296290 - RNA, 22 nt, Homo sapiens
acugcauuugucugucucaauu

SEQ ID NO: 296291 - RNA, 22 nt, Homo sapiens
acuggcuuaaggaugggccacu

SEQ ID NO: 296292 - RNA, 22 nt, Homo sapiens
acuggcuuauuucacuuagcau

SEQ ID NO: 296293 - RNA, 22 nt, Homo sapiens
acugggucaaaguagaaaacua

SEQ ID NO: 296294 - RNA, 22 nt, Homo sapiens
acugguguaugggaggucccaa

SEQ ID NO: 296295 - RNA, 22 nt, Homo sapiens
acuguacuccauccugggugac

SEQ ID NO: 296296 - RNA, 22 nt, Homo sapiens
acuguguguuugucuagcacag

SEQ ID NO: 296297 - RNA, 22 nt, Homo sapiens
acuucauucucuggaucagaau

SEQ ID NO: 296298 - RNA, 17 nt, Homo sapiens
acuuuuugaggaggcau

SEQ ID NO: 296299 - RNA, 20 nt, Homo sapiens
acuuuuugaugaggucguuu

SEQ ID NO: 296300 - RNA, 22 nt, Homo sapiens
agaaauguuuacucacccccuu

SEQ ID NO: 296301 - RNA, 22 nt, Homo sapiens
agaaccaaucccacauggauac

SEQ ID NO: 296302 - RNA, 22 nt, Homo sapiens
agaaccauuagagggagauauu

SEQ ID NO: 296303 - RNA, 22 nt, Homo sapiens
agaacuguccauucagcaugaa

SEQ ID NO: 296304 - RNA, 22 nt, Homo sapiens
agacacugaaauguauugaaga

SEQ ID NO: 296305 - RNA, 22 nt, Homo sapiens
agacagcugguagcacuuccug

SEQ ID NO: 296306 - RNA, 22 nt, Homo sapiens
agaccacuuuagagauuguuca

SEQ ID NO: 296307 - RNA, 22 nt, Homo sapiens
agacuagagggaaaugaguugg

SEQ ID NO: 296308 - RNA, 19 nt, Homo sapiens
agacuggcccaggcgggug

SEQ ID NO: 296309 - RNA, 22 nt, Homo sapiens
agagaacuggcuucaccauucu

SEQ ID NO: 296310 - RNA, 22 nt, Homo sapiens
agagagguggguggagccccca

SEQ ID NO: 296311 - RNA, 22 nt, Homo sapiens
agagauaaagauuuuaauuuug

SEQ ID NO: 296312 - RNA, 22 nt, Homo sapiens
agagauaauuagguuaaaugag

SEQ ID NO: 296313 - RNA, 22 nt, Homo sapiens
aaggcaugcaaagaacauuuua

SEQ ID NO: 296314 - RNA, 22 nt, Homo sapiens
aaggcauucucaaacuaguucu

SEQ ID NO: 296315 - RNA, 22 nt, Homo sapiens
aaggcuauuugagaaugugugu

SEQ ID NO: 296316 - RNA, 22 nt, Homo sapiens
aagguauuucuaugggaauaga

SEQ ID NO: 296317 - RNA, 22 nt, Homo sapiens
aagguauuuuugucuauaucuu

SEQ ID NO: 296318 - RNA, 22 nt, Homo sapiens
aagguggaguugacaauuuuca

SEQ ID NO: 296319 - RNA, 22 nt, Homo sapiens
aaguaaacauugagagacaaga

SEQ ID NO: 296320 - RNA, 22 nt, Homo sapiens
aaguaagcauccaauaaauguu

SEQ ID NO: 296321 - RNA, 22 nt, Homo sapiens
aaguaauggaguuauuuuauga

SEQ ID NO: 296322 - RNA, 22 nt, Homo sapiens
aaguauagcuaugauaaacauu

SEQ ID NO: 296323 - RNA, 22 nt, Homo sapiens
aaguauuaugaguccuuguuuu

SEQ ID NO: 296324 - RNA, 19 nt, Homo sapiens
aagugaaugcuuuguucac

SEQ ID NO: 296325 - RNA, 22 nt, Homo sapiens
aagugaauguuugguagcagug

SEQ ID NO: 296326 - RNA, 22 nt, Homo sapiens
aagugacauugugcccauuuga

SEQ ID NO: 296327 - RNA, 22 nt, Homo sapiens
aagugacuagacuaugaaaccu

SEQ ID NO: 296328 - RNA, 22 nt, Homo sapiens
aagugagugacaaaaacugggc

SEQ ID NO: 296329 - RNA, 22 nt, Homo sapiens
aagugauguuauugggugacuc

SEQ ID NO: 296330 - RNA, 22 nt, Homo sapiens
agagauacauucugagaagugc

SEQ ID NO: 296331 - RNA, 22 nt, Homo sapiens
agagaucaacugaauuacugga

SEQ ID NO: 296332 - RNA, 22 nt, Homo sapiens
agagauuauccuggcuucucug

SEQ ID NO: 296333 - RNA, 20 nt, Homo sapiens
agagcaaagccgcaccccua

SEQ ID NO: 296334 - RNA, 22 nt, Homo sapiens
agagccacacucuccuaacuca

SEQ ID NO: 296335 - RNA, 21 nt, Homo sapiens
agaggacugaccacagcccua

SEQ ID NO: 296336 - RNA, 22 nt, Homo sapiens
agagguaagaauaguaguugga

SEQ ID NO: 296337 - RNA, 22 nt, Homo sapiens
agagguuuugcccucgagauaa

SEQ ID NO: 296338 - RNA, 22 nt, Homo sapiens
agaguacugacguuugcaaauu

SEQ ID NO: 296339 - RNA, 22 nt, Homo sapiens
agaguaguaggaugaauggacu

SEQ ID NO: 296340 - RNA, 22 nt, Homo sapiens
agaguaguuuauuaugcuaagg

SEQ ID NO: 296341 - RNA, 22 nt, Homo sapiens
agaguauagcaacuuaguaaaa

SEQ ID NO: 296342 - RNA, 22 nt, Homo sapiens
agagugaagcuuuuuauauucu

SEQ ID NO: 296343 - RNA, 23 nt, Homo sapiens
agagugcaauggugccaucucgg

SEQ ID NO: 296344 - RNA, 20 nt, Homo sapiens
agagugcuggacugaggagc

SEQ ID NO: 296345 - RNA, 20 nt, Homo sapiens
agagugcugucuguccugag

SEQ ID NO: 296346 - RNA, 22 nt, Homo sapiens
agaucacucagguuucucccug

SEQ ID NO: 296347 - RNA, 23 nt, Homo sapiens
agaugcaucuggcugcgaggcaa

SEQ ID NO: 296348 - RNA, 22 nt, Homo sapiens
agaugccucauguucuagguuc

SEQ ID NO: 296349 - RNA, 22 nt, Homo sapiens
agaugcuguuaucaacuguagc

SEQ ID NO: 296350 - RNA, 22 nt, Homo sapiens
agaugguguuggcugaguguau

SEQ ID NO: 296351 - RNA, 22 nt, Homo sapiens
agaugguguuuucucaccagau

SEQ ID NO: 296352 - RNA, 22 nt, Homo sapiens
agauucauccaaguuguugcau

SEQ ID NO: 296353 - RNA, 22 nt, Homo sapiens
agcaacauggaguuugugcgca

SEQ ID NO: 296354 - RNA, 22 nt, Homo sapiens
agcaacauugagacugcaguug

SEQ ID NO: 296355 - RNA, 22 nt, Homo sapiens
agcaagauccagucgcacagga

SEQ ID NO: 296356 - RNA, 22 nt, Homo sapiens
agcaagauugauggccugcagg

SEQ ID NO: 296357 - RNA, 22 nt, Homo sapiens
agcacacuggguggcuuaaaca

SEQ ID NO: 296358 - RNA, 22 nt, Homo sapiens
agcacagugaaugguuuacuca

SEQ ID NO: 296359 - RNA, 22 nt, Homo sapiens
agcacagugguuaaguuucuua

SEQ ID NO: 296360 - RNA, 22 nt, Homo sapiens
agcaccagaaucugaguuauuc

SEQ ID NO: 296361 - RNA, 22 nt, Homo sapiens
agcaccauuucucuaaagcacu

SEQ ID NO: 296362 - RNA, 22 nt, Homo sapiens
agcagcaauuuuguaugguuua

SEQ ID NO: 296363 - RNA, 22 nt, Homo sapiens
agcagcaccaaacagacuaaga

SEQ ID NO: 296364 - RNA, 22 nt, Homo sapiens
augucuguuugcugagcccggc

SEQ ID NO: 296365 - RNA, 22 nt, Homo sapiens
augugaacugaauuaauucaca

SEQ ID NO: 296366 - RNA, 22 nt, Homo sapiens
augugacuugugaaaaguucag

SEQ ID NO: 296367 - RNA, 22 nt, Homo sapiens
augugacuuuuuccugugccuu

SEQ ID NO: 296368 - RNA, 22 nt, Homo sapiens
augugcaaagcacuguucagca

SEQ ID NO: 296369 - RNA, 22 nt, Homo sapiens
augugcaauggugucaccacau

SEQ ID NO: 296370 - RNA, 22 nt, Homo sapiens
augugcuuaaaaaugcagagaa

SEQ ID NO: 296371 - RNA, 22 nt, Homo sapiens
augugcuuuuggugagagauuu

SEQ ID NO: 296372 - RNA, 22 nt, Homo sapiens
augugcuuuuuaaacagaugcu

SEQ ID NO: 296373 - RNA, 22 nt, Homo sapiens
auguggaaauguauaugugucu

SEQ ID NO: 296374 - RNA, 22 nt, Homo sapiens
auguggcauuucucauucauuu

SEQ ID NO: 296375 - RNA, 22 nt, Homo sapiens
augugugcuugauguaaaaagu

SEQ ID NO: 296376 - RNA, 22 nt, Homo sapiens
auguuauguuaaugauaaugga

SEQ ID NO: 296377 - RNA, 18 nt, Homo sapiens
auguuauguuuguagaag

SEQ ID NO: 296378 - RNA, 22 nt, Homo sapiens
auuaaggaguggguucauggug

SEQ ID NO: 296379 - RNA, 22 nt, Homo sapiens
auuaagugaaugaaguuguucc

SEQ ID NO: 296380 - RNA, 22 nt, Homo sapiens
auuaagugcuugcagaagucca

SEQ ID NO: 296381 - RNA, 22 nt, Homo sapiens
auuauauguguaugugcauacc

SEQ ID NO: 296382 - RNA, 22 nt, Homo sapiens
auuaucacaguuuugcauaugg

SEQ ID NO: 296383 - RNA, 22 nt, Homo sapiens
auuauuagucggccagcuguua

SEQ ID NO: 296384 - RNA, 22 nt, Homo sapiens
auuauuaguuguugaaugaagu

SEQ ID NO: 296385 - RNA, 22 nt, Homo sapiens
auucacuguggguccuuuggau

SEQ ID NO: 296386 - RNA, 22 nt, Homo sapiens
auucaucagggauauuggucug

SEQ ID NO: 296387 - RNA, 20 nt, Homo sapiens
auucauggaggagcaauugg

SEQ ID NO: 296388 - RNA, 22 nt, Homo sapiens
auuccagauggaguugaggguu

SEQ ID NO: 296389 - RNA, 22 nt, Homo sapiens
auuccauaguacagugaugagu

SEQ ID NO: 296390 - RNA, 22 nt, Homo sapiens
auuccauuuguuaucacacccg

SEQ ID NO: 296391 - RNA, 22 nt, Homo sapiens
auucccuuagcugccucagccu

SEQ ID NO: 296392 - RNA, 22 nt, Homo sapiens
auucuugcuugaacuuggugca

SEQ ID NO: 296393 - RNA, 22 nt, Homo sapiens
auugaacuuacuaucuaaacua

SEQ ID NO: 296394 - RNA, 16 nt, Homo sapiens
auugacaguggguguu

SEQ ID NO: 296395 - RNA, 22 nt, Homo sapiens
auugagcacugacucugugcca

SEQ ID NO: 296396 - RNA, 22 nt, Homo sapiens
auugaggcaggaggaccaucua

SEQ ID NO: 296397 - RNA, 22 nt, Homo sapiens
auugaggcauguaccaaugguc

SEQ ID NO: 296398 - RNA, 22 nt, Homo sapiens
auugagucauuucaaauccaag

SEQ ID NO: 296399 - RNA, 23 nt, Homo sapiens
auugauagugccuuugugcuaau

SEQ ID NO: 296400 - RNA, 22 nt, Homo sapiens
auugauaguuuaauaggaauug

SEQ ID NO: 296401 - RNA, 22 nt, Homo sapiens
auugcacacagaaucaggguaa

SEQ ID NO: 296402 - RNA, 22 nt, Homo sapiens
auugcacuccagccucggugac

SEQ ID NO: 296403 - RNA, 22 nt, Homo sapiens
auugcacuccagccuggcagca

SEQ ID NO: 296404 - RNA, 22 nt, Homo sapiens
auugcacuccagccugggcuag

SEQ ID NO: 296405 - RNA, 22 nt, Homo sapiens
auugcacuccagccugggugac

SEQ ID NO: 296406 - RNA, 22 nt, Homo sapiens
auugcacuccagccuggugaca

SEQ ID NO: 296407 - RNA, 22 nt, Homo sapiens
auugcacuccagccuugggcaa

SEQ ID NO: 296408 - RNA, 22 nt, Homo sapiens
auugcacuccagccuuggggau

SEQ ID NO: 296409 - RNA, 22 nt, Homo sapiens
auugcacuccagcuuaggcgac

SEQ ID NO: 296410 - RNA, 22 nt, Homo sapiens
auugcacuccauccugggcaau

SEQ ID NO: 296411 - RNA, 22 nt, Homo sapiens
auugcagcccacccugggugau

SEQ ID NO: 296412 - RNA, 18 nt, Homo sapiens
auugcccucauggggcuu

SEQ ID NO: 296413 - RNA, 23 nt, Homo sapiens
auugcccuugaaggcuaaacucu

SEQ ID NO: 296414 - RNA, 22 nt, Homo sapiens
auugcuauuauuugaccauugu

SEQ ID NO: 296415 - RNA, 22 nt, Homo sapiens
auuggcaauccauauauuuucu

SEQ ID NO: 296416 - RNA, 22 nt, Homo sapiens
auuggcaaucgucuccauuuuu

SEQ ID NO: 296417 - RNA, 22 nt, Homo sapiens
auuggcaauggcaaagcagagu

SEQ ID NO: 296418 - RNA, 22 nt, Homo sapiens
auuggcaauguacauaucuugc

SEQ ID NO: 296419 - RNA, 22 nt, Homo sapiens
auuggcuuuauacauaagaaua

SEQ ID NO: 296420 - RNA, 22 nt, Homo sapiens
auuggggaaugguggcuuuagu

SEQ ID NO: 296421 - RNA, 22 nt, Homo sapiens
auuggguuaaaggauaugaaca

SEQ ID NO: 296422 - RNA, 18 nt, Homo sapiens
auuguaagauguauggga

SEQ ID NO: 296423 - RNA, 22 nt, Homo sapiens
auugucccucuuaaucccagca

SEQ ID NO: 296424 - RNA, 22 nt, Homo sapiens
auuguccuacuaggguuccagu

SEQ ID NO: 296425 - RNA, 22 nt, Homo sapiens
auuuccuguaggggcuugcgaa

SEQ ID NO: 296426 - RNA, 22 nt, Homo sapiens
auuuggcaguauaaugcuuugg

SEQ ID NO: 296427 - RNA, 22 nt, Homo sapiens
auuuggcagugaagggaucaca

SEQ ID NO: 296428 - RNA, 22 nt, Homo sapiens
auuuuuggauauagggaaggau

SEQ ID NO: 296429 - RNA, 22 nt, Homo sapiens
caaagcuauagcaccagaggga

SEQ ID NO: 296430 - RNA, 22 nt, Homo sapiens
caaaggcuuccacugcauccuu

SEQ ID NO: 296431 - RNA, 22 nt, Homo sapiens
caaaguaauugcuguuuugcca

SEQ ID NO: 296432 - RNA, 22 nt, Homo sapiens
caaagucuauucuacccuuacc

SEQ ID NO: 296433 - RNA, 22 nt, Homo sapiens
caaagucuucaguugauucuga

SEQ ID NO: 296434 - RNA, 22 nt, Homo sapiens
caaagugcuggaauuggccggg

SEQ ID NO: 296435 - RNA, 22 nt, Homo sapiens
caaaugaucugcuggccucagc

SEQ ID NO: 296436 - RNA, 22 nt, Homo sapiens
caacagucagcccauccacaga

SEQ ID NO: 296437 - RNA, 22 nt, Homo sapiens
caagacuguccaacauauuggg

SEQ ID NO: 296438 - RNA, 22 nt, Homo sapiens
caaguacugggcuauggauauu

SEQ ID NO: 296439 - RNA, 22 nt, Homo sapiens
caagugcuuucuuggggauuua

SEQ ID NO: 296440 - RNA, 19 nt, Homo sapiens
caauacuucuuggcauaca

SEQ ID NO: 296441 - RNA, 22 nt, Homo sapiens
caauggcaaugaaauagugaga

SEQ ID NO: 296442 - RNA, 21 nt, Homo sapiens
caauggcacaaucucugcuca

SEQ ID NO: 296443 - RNA, 22 nt, Homo sapiens
caauggcacuauuggaaaaggu

SEQ ID NO: 296444 - RNA, 22 nt, Homo sapiens
caaugguuuuuuaguauaagua

SEQ ID NO: 296445 - RNA, 22 nt, Homo sapiens
caauugcacucuuagguguaca

SEQ ID NO: 296446 - RNA, 22 nt, Homo sapiens
cacaaaguagauuagucuucca

SEQ ID NO: 296447 - RNA, 22 nt, Homo sapiens
cauugcacuccagucugggcaa

SEQ ID NO: 296448 - RNA, 22 nt, Homo sapiens
cauugcacugcauucugggcaa

SEQ ID NO: 296449 - RNA, 22 nt, Homo sapiens
cauugcacuuagacaacuuuug

SEQ ID NO: 296450 - RNA, 22 nt, Homo sapiens
cauugguuggacaguucucucu

SEQ ID NO: 296451 - RNA, 22 nt, Homo sapiens
cauugguuuuucaggaguauau

SEQ ID NO: 296452 - RNA, 22 nt, Homo sapiens
cauugucccucaaugacuauga

SEQ ID NO: 296453 - RNA, 22 nt, Homo sapiens
cauuugguggcuacagaguaac

SEQ ID NO: 296454 - RNA, 22 nt, Homo sapiens
ccaaauccauccaaaucauaga

SEQ ID NO: 296455 - RNA, 22 nt, Homo sapiens
ccaaaucucauguugaaaugug

SEQ ID NO: 296456 - RNA, 22 nt, Homo sapiens
ccaaguguucucauuguucaau

SEQ ID NO: 296457 - RNA, 19 nt, Homo sapiens
ccacaaugguugaacuaga

SEQ ID NO: 296458 - RNA, 23 nt, Homo sapiens
ccacaaugguugaacuagauuac

SEQ ID NO: 296459 - RNA, 22 nt, Homo sapiens
ccagaguugccucagguuucug

SEQ ID NO: 296460 - RNA, 22 nt, Homo sapiens
ccagauguuuucauucagcaag

SEQ ID NO: 296461 - RNA, 22 nt, Homo sapiens
ccagcaccauuuguugaauagg

SEQ ID NO: 296462 - RNA, 20 nt, Homo sapiens
ccagcaucauuagauucugg

SEQ ID NO: 296463 - RNA, 22 nt, Homo sapiens
ccagccgggugcaguggcucac

SEQ ID NO: 296464 - RNA, 22 nt, Homo sapiens
ccaggguuccacgccuggcugu

SEQ ID NO: 296465 - RNA, 22 nt, Homo sapiens
ccagugcauggaucccaggggg

SEQ ID NO: 296466 - RNA, 22 nt, Homo sapiens
ccagugguugggccggagacgg

SEQ ID NO: 296467 - RNA, 20 nt, Homo sapiens
ccaguguuauuuauguucua

SEQ ID NO: 296468 - RNA, 19 nt, Homo sapiens
ccaguguugccagagcuga

SEQ ID NO: 296469 - RNA, 22 nt, Homo sapiens
ccaguuuucccagcaccauuaa

SEQ ID NO: 296470 - RNA, 22 nt, Homo sapiens
ccaucacgugcaguggccccac

SEQ ID NO: 296471 - RNA, 21 nt, Homo sapiens
ccauggcaaugguaaacugac

SEQ ID NO: 296472 - RNA, 22 nt, Homo sapiens
ccauugcacuccagccucggca

SEQ ID NO: 296473 - RNA, 22 nt, Homo sapiens
ccauugcacuucagccuaggug

SEQ ID NO: 296474 - RNA, 22 nt, Homo sapiens
cccagugaagagaaccuuacga

SEQ ID NO: 296475 - RNA, 18 nt, Homo sapiens
cccagugacuuauggccu

SEQ ID NO: 296476 - RNA, 19 nt, Homo sapiens
cccagugucagagaagggu

SEQ ID NO: 296477 - RNA, 20 nt, Homo sapiens
ccccaguuuuucuauuagcu

SEQ ID NO: 296478 - RNA, 22 nt, Homo sapiens
ccccggguucugucugcccuug

SEQ ID NO: 296479 - RNA, 22 nt, Homo sapiens
ccccuguaaacuggcuucccug

SEQ ID NO: 296480 - RNA, 22 nt, Homo sapiens
cccgggcugaaaucagauuugu

SEQ ID NO: 296481 - RNA, 17 nt, Homo sapiens
cccuaguagcugggacu

SEQ ID NO: 296482 - RNA, 22 nt, Homo sapiens
cccucauucauucauccuaugu

SEQ ID NO: 296483 - RNA, 22 nt, Homo sapiens
cccugaagaaagccuaggacau

SEQ ID NO: 296484 - RNA, 22 nt, Homo sapiens
cccugaagauacagaguuuggg

SEQ ID NO: 296485 - RNA, 22 nt, Homo sapiens
cccugacauucggagauguagu

SEQ ID NO: 296486 - RNA, 22 nt, Homo sapiens
cccugagaugugaauuucagag

SEQ ID NO: 296487 - RNA, 22 nt, Homo sapiens
cccuggacauucaucauuaugu

SEQ ID NO: 296488 - RNA, 22 nt, Homo sapiens
ccuaaguaauggcaguuuuugc

SEQ ID NO: 296489 - RNA, 19 nt, Homo sapiens
ccucaaguacuaauauguu

SEQ ID NO: 296490 - RNA, 22 nt, Homo sapiens
ccucacaaccuuuauugaagag

SEQ ID NO: 296491 - RNA, 22 nt, Homo sapiens
ccucauggagaaccucugcuag

SEQ ID NO: 296492 - RNA, 22 nt, Homo sapiens
ccugagacuugagggggcuucu

SEQ ID NO: 296493 - RNA, 21 nt, Homo sapiens
ccugaugaccucugagaguua

SEQ ID NO: 296494 - RNA, 21 nt, Homo sapiens
ccugauguucacuuggccuuc

SEQ ID NO: 296495 - RNA, 22 nt, Homo sapiens
ccugcauaguucaccgcugaua

SEQ ID NO: 296496 - RNA, 22 nt, Homo sapiens
ccuggaaugaagcuuauauugc

SEQ ID NO: 296497 - RNA, 22 nt, Homo sapiens
ccuggcacugggccccguggcu

SEQ ID NO: 296498 - RNA, 22 nt, Homo sapiens
ccuggguuacaggugugagcca

SEQ ID NO: 296499 - RNA, 22 nt, Homo sapiens
ccugucuugauuaaauuacuua

SEQ ID NO: 296500 - RNA, 22 nt, Homo sapiens
ccuguguuaugguuucuaaugu

SEQ ID NO: 296501 - RNA, 22 nt, Homo sapiens
ccuucauccuccagcaggcuag

SEQ ID NO: 296502 - RNA, 22 nt, Homo sapiens
ccuucauucauuaauuuagccc

SEQ ID NO: 296503 - RNA, 22 nt, Homo sapiens
ccuucuuuuguaaggcugaaua

SEQ ID NO: 296504 - RNA, 22 nt, Homo sapiens
ccuuggcacuacugacauugua

SEQ ID NO: 296505 - RNA, 22 nt, Homo sapiens
ccuuuuuguaguggaaguagga

SEQ ID NO: 296506 - RNA, 22 nt, Homo sapiens
cggugcaaauguaauugcaguu

SEQ ID NO: 296507 - RNA, 22 nt, Homo sapiens
cggugcaauucuccugucucag

SEQ ID NO: 296508 - RNA, 22 nt, Homo sapiens
cgugaggaaaacagaggguguu

SEQ ID NO: 296509 - RNA, 20 nt, Homo sapiens
cguugcacuccagccugggc

SEQ ID NO: 296510 - RNA, 22 nt, Homo sapiens
cguugcacuccagccugggcaa

SEQ ID NO: 296511 - RNA, 22 nt, Homo sapiens
cuaaggaaggacugaaaggaca

SEQ ID NO: 296512 - RNA, 22 nt, Homo sapiens
cuaaggcaguagccugaauaau

SEQ ID NO: 296513 - RNA, 18 nt, Homo sapiens
cuaauacuauucaacaag

SEQ ID NO: 296514 - RNA, 22 nt, Homo sapiens
cuaauccugugguagcacucaa

SEQ ID NO: 296515 - RNA, 22 nt, Homo sapiens
cuaaugcagucaggagaaggaa

SEQ ID NO: 296516 - RNA, 22 nt, Homo sapiens
cuaauucuguaccuggcacaua

SEQ ID NO: 296517 - RNA, 22 nt, Homo sapiens
cuacaguagagaggauguagaa

SEQ ID NO: 296518 - RNA, 22 nt, Homo sapiens
cuacaguucuuaauuaaguagu

SEQ ID NO: 296519 - RNA, 21 nt, Homo sapiens
cuacccuguauuagagaaaga

SEQ ID NO: 296520 - RNA, 22 nt, Homo sapiens
cuacugcacaucaucugaguua

SEQ ID NO: 296521 - RNA, 22 nt, Homo sapiens
cuagaagcauauucagaacaga

SEQ ID NO: 296522 - RNA, 22 nt, Homo sapiens
cuagcaacauuucagugaguuu

SEQ ID NO: 296523 - RNA, 22 nt, Homo sapiens
cuagcacauuuaucuuuauaca

SEQ ID NO: 296524 - RNA, 22 nt, Homo sapiens
cuagcaggcaagauaagauuca

SEQ ID NO: 296525 - RNA, 22 nt, Homo sapiens
cuagcuccauauaaagcaggau

SEQ ID NO: 296526 - RNA, 22 nt, Homo sapiens
cuagcugcacuuccugcuacug

SEQ ID NO: 296527 - RNA, 22 nt, Homo sapiens
cuagcuuuugauguaaagugag

SEQ ID NO: 296528 - RNA, 22 nt, Homo sapiens
cuauacuguacacugaaugagg

SEQ ID NO: 296529 - RNA, 22 nt, Homo sapiens
cuauaguauaguuugaagucag

SEQ ID NO: 296530 - RNA, 22 nt, Homo sapiens
cuaugagcuuuuuuaagccuca

SEQ ID NO: 296531 - RNA, 22 nt, Homo sapiens
cuggcugagugguaaguagagg

SEQ ID NO: 296532 - RNA, 22 nt, Homo sapiens
cugggaugauguaaauaggcua

SEQ ID NO: 296533 - RNA, 22 nt, Homo sapiens
cugggaugugacuguugccccc

SEQ ID NO: 296534 - RNA, 22 nt, Homo sapiens
cugguuguucuggaugggcagg

SEQ ID NO: 296535 - RNA, 22 nt, Homo sapiens
cuguaaggcacuaagcauaugu

SEQ ID NO: 296536 - RNA, 22 nt, Homo sapiens
cugucacuggggcacauguccc

SEQ ID NO: 296537 - RNA, 22 nt, Homo sapiens
cugucagugggaguucaggcuu

SEQ ID NO: 296538 - RNA, 22 nt, Homo sapiens
cugucaucauuucuaugugcca

SEQ ID NO: 296539 - RNA, 22 nt, Homo sapiens
cugucucagccucuccaguagc

SEQ ID NO: 296540 - RNA, 22 nt, Homo sapiens
cugucucagugaauugguuuua

SEQ ID NO: 296541 - RNA, 22 nt, Homo sapiens
cugugaacaugggagaaauggc

SEQ ID NO: 296542 - RNA, 22 nt, Homo sapiens
cugugaucuuuuuucauguggu

SEQ ID NO: 296543 - RNA, 22 nt, Homo sapiens
cugugcaaacaagugaaccccu

SEQ ID NO: 296544 - RNA, 22 nt, Homo sapiens
cugugccaagcuugcgaugugc

SEQ ID NO: 296545 - RNA, 23 nt, Homo sapiens
cuguggauaugaguuguaaaugg

SEQ ID NO: 296546 - RNA, 22 nt, Homo sapiens
cugugguauuauuagaaauauc

SEQ ID NO: 296547 - RNA, 19 nt, Homo sapiens
cuguggucauuauuuugcu

SEQ ID NO: 296548 - RNA, 23 nt, Homo sapiens
cuguggugaggcccuagaaucug

SEQ ID NO: 296549 - RNA, 22 nt, Homo sapiens
cuguuagguuaaggaauggcaa

SEQ ID NO: 296550 - RNA, 22 nt, Homo sapiens
cuguucaggaggcauuuggugg

SEQ ID NO: 296551 - RNA, 22 nt, Homo sapiens
cuguugguguuuaaucacugca

SEQ ID NO: 296552 - RNA, 22 nt, Homo sapiens
cuguugguuaaauuccaugcag

SEQ ID NO: 296553 - RNA, 22 nt, Homo sapiens
cuuaaggccagauaauuucuau

SEQ ID NO: 296554 - RNA, 20 nt, Homo sapiens
cuuaucaguggcaaguauaa

SEQ ID NO: 296555 - RNA, 22 nt, Homo sapiens
cuucaaguaauucugauggcua

SEQ ID NO: 296556 - RNA, 22 nt, Homo sapiens
cuucaaguguggccaccugacc

SEQ ID NO: 296557 - RNA, 22 nt, Homo sapiens
cuucaccaguuuggcagucuca

SEQ ID NO: 296558 - RNA, 22 nt, Homo sapiens
cuucaguucuguaaggacagca

SEQ ID NO: 296559 - RNA, 22 nt, Homo sapiens
cuucaucugguuugugaacuuu

SEQ ID NO: 296560 - RNA, 20 nt, Homo sapiens
cuuccaguggccccaucuuu

SEQ ID NO: 296561 - RNA, 22 nt, Homo sapiens
cuuccauauucuaggacaggcu

SEQ ID NO: 296562 - RNA, 22 nt, Homo sapiens
cuuccugaguccugggcucaca

SEQ ID NO: 296563 - RNA, 18 nt, Homo sapiens
cuuccuuagucugguuaa

SEQ ID NO: 296564 - RNA, 22 nt, Homo sapiens
cuucuguuaguucugauaacuu

SEQ ID NO: 296565 - RNA, 22 nt, Homo sapiens
cuugacacugucacucaggcca

SEQ ID NO: 296566 - RNA, 22 nt, Homo sapiens
cuugagacauuguuuuccaagu

SEQ ID NO: 296567 - RNA, 22 nt, Homo sapiens
cuugcacuccacuguucuccug

SEQ ID NO: 296568 - RNA, 19 nt, Homo sapiens
cuugccccauucauccucu

SEQ ID NO: 296569 - RNA, 22 nt, Homo sapiens
cuugccuaaucugcaugauuuu

SEQ ID NO: 296570 - RNA, 22 nt, Homo sapiens
cuuggcacucuguggaguuagg

SEQ ID NO: 296571 - RNA, 22 nt, Homo sapiens
cuuggcauugccccuggaauuu

SEQ ID NO: 296572 - RNA, 22 nt, Homo sapiens
cuuggcuucuuuauguggcuau

SEQ ID NO: 296573 - RNA, 22 nt, Homo sapiens
cuuggcuugguaucaaauaacc

SEQ ID NO: 296574 - RNA, 22 nt, Homo sapiens
cuugucacuguuggcuuuagaa

SEQ ID NO: 296575 - RNA, 22 nt, Homo sapiens
cuugucuugcacacgguugcca

SEQ ID NO: 296576 - RNA, 21 nt, Homo sapiens
cuugucuugcuuagaauagac

SEQ ID NO: 296577 - RNA, 22 nt, Homo sapiens
cuugugauugcacggcugccug

SEQ ID NO: 296578 - RNA, 22 nt, Homo sapiens
cuugugccugaucuuagggggc

SEQ ID NO: 296579 - RNA, 22 nt, Homo sapiens
cuuguucuccuaagaugaaugc

SEQ ID NO: 296580 - RNA, 22 nt, Homo sapiens
cuuuacaguuggacucacgagg

SEQ ID NO: 296581 - RNA, 22 nt, Homo sapiens
cuuuaugagguuggauggaucu

SEQ ID NO: 296582 - RNA, 22 nt, Homo sapiens
cuuucugaggagaauagagaac

SEQ ID NO: 296583 - RNA, 22 nt, Homo sapiens
cuuugauuauaaaaggguguuu

SEQ ID NO: 296584 - RNA, 22 nt, Homo sapiens
cuuugcaaaacauugagaccuc

SEQ ID NO: 296585 - RNA, 22 nt, Homo sapiens
cuuugcacaucucugcuuuccc

SEQ ID NO: 296586 - RNA, 18 nt, Homo sapiens
cuuugcagcuuccagagg

SEQ ID NO: 296587 - RNA, 22 nt, Homo sapiens
cuuuggcacuuccuaagugcca

SEQ ID NO: 296588 - RNA, 22 nt, Homo sapiens
cuuuggcauuagccuguauaga

SEQ ID NO: 296589 - RNA, 21 nt, Homo sapiens
cuuugguagaguuuuuagggu

SEQ ID NO: 296590 - RNA, 22 nt, Homo sapiens
cuuugguuaauaggauauggca

SEQ ID NO: 296591 - RNA, 23 nt, Homo sapiens
cuuuguccccacccaaaucucau

SEQ ID NO: 296592 - RNA, 22 nt, Homo sapiens
cuuuguccuucaagguguguca

SEQ ID NO: 296593 - RNA, 22 nt, Homo sapiens
cuuugugugggccaagggcugg

SEQ ID NO: 296594 - RNA, 22 nt, Homo sapiens
cuuuuacacuguuagugggaau

SEQ ID NO: 296595 - RNA, 20 nt, Homo sapiens
cuuuuagcagcagcaagaga

SEQ ID NO: 296596 - RNA, 22 nt, Homo sapiens
cuuuuggugguucugaugcagg

SEQ ID NO: 296597 - RNA, 22 nt, Homo sapiens
cuuuuguggaucuucuguugcu

SEQ ID NO: 296598 - RNA, 22 nt, Homo sapiens
cuuuuugcaaauacaacucuga

SEQ ID NO: 296599 - RNA, 20 nt, Homo sapiens
gaaacaucuauccucuccuu

SEQ ID NO: 296600 - RNA, 22 nt, Homo sapiens
gaaagacuuucugcuguggaua

SEQ ID NO: 296601 - RNA, 22 nt, Homo sapiens
gaaagauuuuaacugggagacu

SEQ ID NO: 296602 - RNA, 22 nt, Homo sapiens
gaaagguaggaacagggugcag

SEQ ID NO: 296603 - RNA, 22 nt, Homo sapiens
gaacacaucuuugguuagagga

SEQ ID NO: 296604 - RNA, 22 nt, Homo sapiens
gaacugggguuggguugcgaua

SEQ ID NO: 296605 - RNA, 22 nt, Homo sapiens
gaagacauuuacaugggagacc

SEQ ID NO: 296606 - RNA, 22 nt, Homo sapiens
gaagagacagguucccacaaaa

SEQ ID NO: 296607 - RNA, 22 nt, Homo sapiens
gaaggagcuuaucugccauuuc

SEQ ID NO: 296608 - RNA, 22 nt, Homo sapiens
gaaggcacugugugccacccug

SEQ ID NO: 296609 - RNA, 22 nt, Homo sapiens
gaauaaacuagagaggacugag

SEQ ID NO: 296610 - RNA, 22 nt, Homo sapiens
gaauagugcugcaaugaacaua

SEQ ID NO: 296611 - RNA, 22 nt, Homo sapiens
gaauagugcugcagcaaacaua

SEQ ID NO: 296612 - RNA, 22 nt, Homo sapiens
gaauagugcugcgauaaacaua

SEQ ID NO: 296613 - RNA, 22 nt, Homo sapiens
gaaucaauugaucuaugugucu

SEQ ID NO: 296614 - RNA, 22 nt, Homo sapiens
gauauguguaucuauguacaug

SEQ ID NO: 296615 - RNA, 22 nt, Homo sapiens
gauauguugaguagaguuuuug

SEQ ID NO: 296616 - RNA, 22 nt, Homo sapiens
gauauugacuuauucuauguuu

SEQ ID NO: 296617 - RNA, 17 nt, Homo sapiens
gaucacagucgucuccu

SEQ ID NO: 296618 - RNA, 22 nt, Homo sapiens
gaucacaguuccucacgggcau

SEQ ID NO: 296619 - RNA, 22 nt, Homo sapiens
gaucacauggccauuucuagcu

SEQ ID NO: 296620 - RNA, 22 nt, Homo sapiens
gaucacauuguuucauacauau

SEQ ID NO: 296621 - RNA, 22 nt, Homo sapiens
gaucucaguggauacugugaug

SEQ ID NO: 296622 - RNA, 22 nt, Homo sapiens
gaucugucuuuccuuauagucu

SEQ ID NO: 296623 - RNA, 22 nt, Homo sapiens
gaucugugugauuggaugcauu

SEQ ID NO: 296624 - RNA, 22 nt, Homo sapiens
gaugagcuaaguucucacagca

SEQ ID NO: 296625 - RNA, 22 nt, Homo sapiens
gaugagguaggccugcuuugaa

SEQ ID NO: 296626 - RNA, 22 nt, Homo sapiens
gauggcacuaagccauguagga

SEQ ID NO: 296627 - RNA, 22 nt, Homo sapiens
gauggcacuguagcaacacaaa

SEQ ID NO: 296628 - RNA, 22 nt, Homo sapiens
gauggcuacugauuaaauauag

SEQ ID NO: 296629 - RNA, 22 nt, Homo sapiens
gauguagaaagagugggcugga

SEQ ID NO: 296630 - RNA, 22 nt, Homo sapiens
gauuuguauuaaaagugugacg

SEQ ID NO: 296631 - RNA, 21 nt, Homo sapiens
gcaaaguggcuaccuugcucc

SEQ ID NO: 296632 - RNA, 23 nt, Homo sapiens
gcaaauaucguagagugucccug

SEQ ID NO: 296633 - RNA, 20 nt, Homo sapiens
gcaacauggccagagugaau

SEQ ID NO: 296634 - RNA, 22 nt, Homo sapiens
gcaagaaucugggaguaaaauu

SEQ ID NO: 296635 - RNA, 22 nt, Homo sapiens
gcaagacaugucuaagguuuaa

SEQ ID NO: 296636 - RNA, 22 nt, Homo sapiens
gcaagagguaucuuauuuuccc

SEQ ID NO: 296637 - RNA, 22 nt, Homo sapiens
gcaaggaugagugcccaugaga

SEQ ID NO: 296638 - RNA, 22 nt, Homo sapiens
gcacaggguuacauucuaaggu

SEQ ID NO: 296639 - RNA, 22 nt, Homo sapiens
gcaccacugcacucucagcuug

SEQ ID NO: 296640 - RNA, 22 nt, Homo sapiens
gcaccauugacaagaaauaggu

SEQ ID NO: 296641 - RNA, 22 nt, Homo sapiens
gcacccugucaaaauggaccaa

SEQ ID NO: 296642 - RNA, 22 nt, Homo sapiens
gcacgugcacccacaugcacgu

SEQ ID NO: 296643 - RNA, 19 nt, Homo sapiens
gcagagaugugguagcuug

SEQ ID NO: 296644 - RNA, 22 nt, Homo sapiens
gcagcacauggcagaacauauu

SEQ ID NO: 296645 - RNA, 20 nt, Homo sapiens
gcagcaccauauuucuaaga

SEQ ID NO: 296646 - RNA, 22 nt, Homo sapiens
gcagcaucaaaucacacaagau

SEQ ID NO: 296647 - RNA, 22 nt, Homo sapiens
gcagcauuaccaagacauggca

SEQ ID NO: 296648 - RNA, 22 nt, Homo sapiens
gcagguaguuucugacuuuuac

SEQ ID NO: 296649 - RNA, 22 nt, Homo sapiens
gcaguacacuguugguaggaau

SEQ ID NO: 296650 - RNA, 19 nt, Homo sapiens
gcaguauugaaggccaguc

SEQ ID NO: 296651 - RNA, 23 nt, Homo sapiens
gcagucauuuggaaaagguugaa

SEQ ID NO: 296652 - RNA, 22 nt, Homo sapiens
gcagugcuggagcccccgugug

SEQ ID NO: 296653 - RNA, 22 nt, Homo sapiens
gcagugugaucacagcuuacug

SEQ ID NO: 296654 - RNA, 22 nt, Homo sapiens
gcagugugugaggaauuugggu

SEQ ID NO: 296655 - RNA, 20 nt, Homo sapiens
gcaguguucacuguauuccu

SEQ ID NO: 296656 - RNA, 20 nt, Homo sapiens
gcauaugucuuuauagcaga

SEQ ID NO: 296657 - RNA, 22 nt, Homo sapiens
gcauaugucuuuauagcagcau

SEQ ID NO: 296658 - RNA, 22 nt, Homo sapiens
gcaucacagggagacaggccuc

SEQ ID NO: 296659 - RNA, 20 nt, Homo sapiens
gcaugagucuuuauaguaga

SEQ ID NO: 296660 - RNA, 22 nt, Homo sapiens
gcauggaguggaaauucuuggg

SEQ ID NO: 296661 - RNA, 22 nt, Homo sapiens
gcauggauguugauggcugcug

SEQ ID NO: 296662 - RNA, 22 nt, Homo sapiens
gccaagauuuaauucaucaguu

SEQ ID NO: 296663 - RNA, 22 nt, Homo sapiens
gccagauuguccaguuuuuuau

SEQ ID NO: 296664 - RNA, 22 nt, Homo sapiens
gccccugagacuugccucgggc

SEQ ID NO: 296665 - RNA, 22 nt, Homo sapiens
gcccuuugugucuggcuggggu

SEQ ID NO: 296666 - RNA, 22 nt, Homo sapiens
gccuagagaaguaaauauuauc

SEQ ID NO: 296667 - RNA, 22 nt, Homo sapiens
gccuagauccaaauauggugca

SEQ ID NO: 296668 - RNA, 22 nt, Homo sapiens
gcgcagugggcugugccaucca

SEQ ID NO: 296669 - RNA, 22 nt, Homo sapiens
gcguugcacuccagccugggua

SEQ ID NO: 296670 - RNA, 22 nt, Homo sapiens
gcucaugggcagugugauuguu

SEQ ID NO: 296671 - RNA, 22 nt, Homo sapiens
gcucguccccuccugacucugc

SEQ ID NO: 296672 - RNA, 22 nt, Homo sapiens
gcugacagugguuauacuuaga

SEQ ID NO: 296673 - RNA, 22 nt, Homo sapiens
gcugauguugaccuugaucacc

SEQ ID NO: 296674 - RNA, 17 nt, Homo sapiens
gcugcauucauguagaa

SEQ ID NO: 296675 - RNA, 22 nt, Homo sapiens
gcugcuguuuaguuucuccugg

SEQ ID NO: 296676 - RNA, 22 nt, Homo sapiens
gcugcuuuugaugacaaaaaca

SEQ ID NO: 296677 - RNA, 22 nt, Homo sapiens
gcuggguugccagguuacuuaa

SEQ ID NO: 296678 - RNA, 22 nt, Homo sapiens
gcuggucugccguaguaggugc

SEQ ID NO: 296679 - RNA, 22 nt, Homo sapiens
gcuggugacuuuaaguugaagc

SEQ ID NO: 296680 - RNA, 22 nt, Homo sapiens
gcugguguagagugcagaaagg

SEQ ID NO: 296681 - RNA, 22 nt, Homo sapiens
gcuguauuguugaaggaaaugu

SEQ ID NO: 296682 - RNA, 22 nt, Homo sapiens
gcugucaugagcaacacaugaa

SEQ ID NO: 296683 - RNA, 20 nt, Homo sapiens
gcugugcuuaauacacuuuc

SEQ ID NO: 296684 - RNA, 22 nt, Homo sapiens
gcuguguucucgaggcggggga

SEQ ID NO: 296685 - RNA, 22 nt, Homo sapiens
gcuguguugugcccagcaucau

SEQ ID NO: 296686 - RNA, 22 nt, Homo sapiens
gcuguugcuauuauuccgagaa

SEQ ID NO: 296687 - RNA, 22 nt, Homo sapiens
gcuguuugccgccaucgcagac

SEQ ID NO: 296688 - RNA, 22 nt, Homo sapiens
gcuuggugugcaagugguacua

SEQ ID NO: 296689 - RNA, 22 nt, Homo sapiens
gcuuguguucaagucacccuua

SEQ ID NO: 296690 - RNA, 21 nt, Homo sapiens
gcuuuuucggaagucuuuggc

SEQ ID NO: 296691 - RNA, 22 nt, Homo sapiens
ggaaagacaccuuacuauguua

SEQ ID NO: 296692 - RNA, 22 nt, Homo sapiens
ggaaagauguaauauuaucuaa

SEQ ID NO: 296693 - RNA, 22 nt, Homo sapiens
ggaaaguaacccauucucuuac

SEQ ID NO: 296694 - RNA, 21 nt, Homo sapiens
ggaaaguuaaggaaauacccc

SEQ ID NO: 296695 - RNA, 22 nt, Homo sapiens
ggaaauguaaacaauggggcua

SEQ ID NO: 296696 - RNA, 18 nt, Homo sapiens
ggaagccuauuuaguaac

SEQ ID NO: 296697 - RNA, 22 nt, Homo sapiens
ggaaguuaauacagauagagua

SEQ ID NO: 296698 - RNA, 22 nt, Homo sapiens
guaagagaauggguuacuuucc

SEQ ID NO: 296699 - RNA, 22 nt, Homo sapiens
guaaggaguaguguaacagugc

SEQ ID NO: 296700 - RNA, 22 nt, Homo sapiens
guaagguuguauuucaagaaac

SEQ ID NO: 296701 - RNA, 22 nt, Homo sapiens
guaaucucagcuacuugggagg

SEQ ID NO: 296702 - RNA, 22 nt, Homo sapiens
guaaucucagcuucuugggagg

SEQ ID NO: 296703 - RNA, 22 nt, Homo sapiens
guacacauacauauaugugugu

SEQ ID NO: 296704 - RNA, 22 nt, Homo sapiens
guacaguuuucaguguucacug

SEQ ID NO: 296705 - RNA, 22 nt, Homo sapiens
guacauagucacacauauacau

SEQ ID NO: 296706 - RNA, 22 nt, Homo sapiens
guacauggaaugaaauucaaaa

SEQ ID NO: 296707 - RNA, 22 nt, Homo sapiens
guacauguaugcaugcaugcau

SEQ ID NO: 296708 - RNA, 22 nt, Homo sapiens
guacaugugcacagugugcagg

SEQ ID NO: 296709 - RNA, 22 nt, Homo sapiens
guaccacaguugcucacggguu

SEQ ID NO: 296710 - RNA, 22 nt, Homo sapiens
guacccuauggauauagaugaa

SEQ ID NO: 296711 - RNA, 22 nt, Homo sapiens
guaccugggugacaggauuauu

SEQ ID NO: 296712 - RNA, 22 nt, Homo sapiens
guacuuuguuauaacccacagg

SEQ ID NO: 296713 - RNA, 22 nt, Homo sapiens
guagaaagcauuucagauuugc

SEQ ID NO: 296714 - RNA, 22 nt, Homo sapiens
guagcagcaauuuacuccauac

SEQ ID NO: 296715 - RNA, 22 nt, Homo sapiens
guagcagccacacuugauaacu

SEQ ID NO: 296716 - RNA, 22 nt, Homo sapiens
guagcagucacauagcagauug

SEQ ID NO: 296717 - RNA, 22 nt, Homo sapiens
guagcaucauuugcaauuucau

SEQ ID NO: 296718 - RNA, 22 nt, Homo sapiens
guaguuuaucagaaagaauagg

SEQ ID NO: 296719 - RNA, 22 nt, Homo sapiens
guauaaguugacucaaucuuug

SEQ ID NO: 296720 - RNA, 22 nt, Homo sapiens
guaugaaaaucggagauugggu

SEQ ID NO: 296721 - RNA, 22 nt, Homo sapiens
guaugacacaggaagcuuaacc

SEQ ID NO: 296722 - RNA, 22 nt, Homo sapiens
guauggguuuuguuucuucugg

SEQ ID NO: 296723 - RNA, 22 nt, Homo sapiens
guauuagguuggggcaaaagua

SEQ ID NO: 296724 - RNA, 18 nt, Homo sapiens
guauuccagccugaguga

SEQ ID NO: 296725 - RNA, 19 nt, Homo sapiens
guauuugacuuucuuguuu

SEQ ID NO: 296726 - RNA, 22 nt, Homo sapiens
guauuuguugcagcagcacuau

SEQ ID NO: 296727 - RNA, 22 nt, Homo sapiens
gucaaaugcacagaaccauuaa

SEQ ID NO: 296728 - RNA, 22 nt, Homo sapiens
gucaaggaauuuauccauuucu

SEQ ID NO: 296729 - RNA, 22 nt, Homo sapiens
gucacagaggcuaagaccccac

SEQ ID NO: 296730 - RNA, 22 nt, Homo sapiens
gucacaguggccagugauguuc

SEQ ID NO: 296731 - RNA, 22 nt, Homo sapiens
gucaccagcuguguuagccccu

SEQ ID NO: 296732 - RNA, 22 nt, Homo sapiens
gucacugagcagaaggaagcga

SEQ ID NO: 296733 - RNA, 22 nt, Homo sapiens
gucacugccugaggcugaugca

SEQ ID NO: 296734 - RNA, 20 nt, Homo sapiens
gucacuggcccagggcuugu

SEQ ID NO: 296735 - RNA, 21 nt, Homo sapiens
gucacuggggcuggauaauuc

SEQ ID NO: 296736 - RNA, 22 nt, Homo sapiens
gucaggaugauuuggggaggug

SEQ ID NO: 296737 - RNA, 22 nt, Homo sapiens
gucaggugcuuacgcggagauc

SEQ ID NO: 296738 - RNA, 22 nt, Homo sapiens
gucagugccugucccaggcuuu

SEQ ID NO: 296739 - RNA, 22 nt, Homo sapiens
gucaguggagaaaaggacaugu

SEQ ID NO: 296740 - RNA, 18 nt, Homo sapiens
gucauagaaugaugguuc

SEQ ID NO: 296741 - RNA, 22 nt, Homo sapiens
gucauaugcucggaaaauguua

SEQ ID NO: 296742 - RNA, 22 nt, Homo sapiens
gucaucaggacgggucaucugc

SEQ ID NO: 296743 - RNA, 22 nt, Homo sapiens
gucaugaacuguacuacuccua

SEQ ID NO: 296744 - RNA, 22 nt, Homo sapiens
gucaugaaguuuugaaugaaau

SEQ ID NO: 296745 - RNA, 22 nt, Homo sapiens
gucaugucugcacauaguaaaa

SEQ ID NO: 296746 - RNA, 22 nt, Homo sapiens
gucauugaaguggaaucaucca

SEQ ID NO: 296747 - RNA, 22 nt, Homo sapiens
gucauugcuuaucugcugacgu

SEQ ID NO: 296748 - RNA, 21 nt, Homo sapiens
guccaaaacaguguccaaugc

SEQ ID NO: 296749 - RNA, 22 nt, Homo sapiens
guccauuuguuuccagagcacu

SEQ ID NO: 296750 - RNA, 22 nt, Homo sapiens
gucccugugucuuuauguggcc

SEQ ID NO: 296751 - RNA, 22 nt, Homo sapiens
guccugaagaccuuccucugga

SEQ ID NO: 296752 - RNA, 22 nt, Homo sapiens
gucuagaacuucugaccuuagg

SEQ ID NO: 296753 - RNA, 22 nt, Homo sapiens
gucuaugguucaggguggagug

SEQ ID NO: 296754 - RNA, 22 nt, Homo sapiens
gucucacaggcaugaugccagc

SEQ ID NO: 296755 - RNA, 22 nt, Homo sapiens
gucucccaaccccugugcccag

SEQ ID NO: 296756 - RNA, 22 nt, Homo sapiens
gucucccagccuacaucuuucu

SEQ ID NO: 296757 - RNA, 22 nt, Homo sapiens
gucuggagacuugggucaucaa

SEQ ID NO: 296758 - RNA, 22 nt, Homo sapiens
gucuggcaauggcagacuggca

SEQ ID NO: 296759 - RNA, 22 nt, Homo sapiens
gucuggcuccugucuaaucacu

SEQ ID NO: 296760 - RNA, 22 nt, Homo sapiens
gucugguugacagcauguggcc

SEQ ID NO: 296761 - RNA, 22 nt, Homo sapiens
gucugguuuuuuauauccucac

SEQ ID NO: 296762 - RNA, 22 nt, Homo sapiens
gucugucuuuugucuuugaaau

SEQ ID NO: 296763 - RNA, 22 nt, Homo sapiens
gucugugguuccuaugucaccu

SEQ ID NO: 296764 - RNA, 22 nt, Homo sapiens
gucuguuugauccagaucaaaa

SEQ ID NO: 296765 - RNA, 22 nt, Homo sapiens
gucuuagguuuaaucacuucua

SEQ ID NO: 296766 - RNA, 22 nt, Homo sapiens
gugaaagcaucugacugugcca

SEQ ID NO: 296767 - RNA, 17 nt, Homo sapiens
gugaaaucaucauuuuu

SEQ ID NO: 296768 - RNA, 22 nt, Homo sapiens
gugaauguaaagucaugugacu

SEQ ID NO: 296769 - RNA, 20 nt, Homo sapiens
gugacacucguuaaccucug

SEQ ID NO: 296770 - RNA, 22 nt, Homo sapiens
gugacagucaaagacaugacuu

SEQ ID NO: 296771 - RNA, 22 nt, Homo sapiens
gugacauuuuuacugaugagag

SEQ ID NO: 296772 - RNA, 22 nt, Homo sapiens
gugaccagaugggcaggggugu

SEQ ID NO: 296773 - RNA, 22 nt, Homo sapiens
gugaccauuugacauauccuug

SEQ ID NO: 296774 - RNA, 22 nt, Homo sapiens
gugacuaagauucuuugauaug

SEQ ID NO: 296775 - RNA, 20 nt, Homo sapiens
gugacugagcacgggcacag

SEQ ID NO: 296776 - RNA, 22 nt, Homo sapiens
gugacuggacucugaagaaaau

SEQ ID NO: 296777 - RNA, 22 nt, Homo sapiens
gugagaacugugucuuauaaac

SEQ ID NO: 296778 - RNA, 22 nt, Homo sapiens
gugagacugaguuucgcucuug

SEQ ID NO: 296779 - RNA, 22 nt, Homo sapiens
gugagaggaggcagcuuuuaca

SEQ ID NO: 296780 - RNA, 22 nt, Homo sapiens
gugagauacuagagauauagug

SEQ ID NO: 296781 - RNA, 22 nt, Homo sapiens
guucaaguuuucucuugugggu

SEQ ID NO: 296782 - RNA, 22 nt, Homo sapiens
guucacacuugcaaccccagca

SEQ ID NO: 296783 - RNA, 22 nt, Homo sapiens
guucaguuuugaaauguuaauu

SEQ ID NO: 296784 - RNA, 22 nt, Homo sapiens
guugagcaaacagcuuaacagu

SEQ ID NO: 296785 - RNA, 22 nt, Homo sapiens
guugaucuauguugcuggcagu

SEQ ID NO: 296786 - RNA, 22 nt, Homo sapiens
guugcaaaguaauugugguuuu

SEQ ID NO: 296787 - RNA, 22 nt, Homo sapiens
guugcagaguucuuccuccuga

SEQ ID NO: 296788 - RNA, 22 nt, Homo sapiens
guugcagcacacaggcugucag

SEQ ID NO: 296789 - RNA, 22 nt, Homo sapiens
guugcccuuagcacuucagccu

SEQ ID NO: 296790 - RNA, 22 nt, Homo sapiens
guugccuaggcuggagugcagu

SEQ ID NO: 296791 - RNA, 22 nt, Homo sapiens
guugcucaggccggagugcagu

SEQ ID NO: 296792 - RNA, 22 nt, Homo sapiens
guugcucaggcuggagugcagu

SEQ ID NO: 296793 - RNA, 22 nt, Homo sapiens
guuggugaccugaagagaguaa

SEQ ID NO: 296794 - RNA, 22 nt, Homo sapiens
guugguuuccuguaacuggaca

SEQ ID NO: 296795 - RNA, 22 nt, Homo sapiens
guuguggcuugugauuaagcac

SEQ ID NO: 296796 - RNA, 22 nt, Homo sapiens
guuuggauauuaggcaagagua

SEQ ID NO: 296797 - RNA, 17 nt, Homo sapiens
guuuggguacuggguaa

SEQ ID NO: 296798 - RNA, 22 nt, Homo sapiens
guuuguaacucuagugacuaga

SEQ ID NO: 296799 - RNA, 22 nt, Homo sapiens
guuugugcuccuaugagaaccu

SEQ ID NO: 296800 - RNA, 22 nt, Homo sapiens
guuuuuggggucacuauuaccg

SEQ ID NO: 296801 - RNA, 22 nt, Homo sapiens
uaaaccuagcauuuugcauaug

SEQ ID NO: 296802 - RNA, 22 nt, Homo sapiens
uaaacugcuugaaaugguguca

SEQ ID NO: 296803 - RNA, 16 nt, Homo sapiens
uaaagcuaaucacuuu

SEQ ID NO: 296804 - RNA, 22 nt, Homo sapiens
uaaagcuagaauuguuccagca

SEQ ID NO: 296805 - RNA, 22 nt, Homo sapiens
uaaagcuagagcuggaguggca

SEQ ID NO: 296806 - RNA, 22 nt, Homo sapiens
uaaagcuaucacauuggugauu

SEQ ID NO: 296807 - RNA, 22 nt, Homo sapiens
uaaagcuaugagaacaccguag

SEQ ID NO: 296808 - RNA, 22 nt, Homo sapiens
uaaagcuuggauuuaggcuaau

SEQ ID NO: 296809 - RNA, 21 nt, Homo sapiens
uaaaggcuccaauuauacccc

SEQ ID NO: 296810 - RNA, 22 nt, Homo sapiens
uaaagugcugagaugaggcugg

SEQ ID NO: 296811 - RNA, 22 nt, Homo sapiens
uaaaguguuuguuauuaaaggu

SEQ ID NO: 296812 - RNA, 22 nt, Homo sapiens
uaaaguuauugccccucaguua

SEQ ID NO: 296813 - RNA, 20 nt, Homo sapiens
uaaaugccucaugcuuuauu

SEQ ID NO: 296814 - RNA, 22 nt, Homo sapiens
uaacaagagagucagucagucc

SEQ ID NO: 296815 - RNA, 16 nt, Homo sapiens
uaacacaguucccacc

SEQ ID NO: 296816 - RNA, 22 nt, Homo sapiens
uaacaccuuugauagcacuuuu

SEQ ID NO: 296817 - RNA, 22 nt, Homo sapiens
uaacaguauauuuaccaaaccu

SEQ ID NO: 296818 - RNA, 22 nt, Homo sapiens
uaacagucuccucaagguguug

SEQ ID NO: 296819 - RNA, 22 nt, Homo sapiens
uaacaguggucugugguaucug

SEQ ID NO: 296820 - RNA, 22 nt, Homo sapiens
uaacauagucauauacuugcuu

SEQ ID NO: 296821 - RNA, 23 nt, Homo sapiens
uaacauguuuuuaagggaagcuu

SEQ ID NO: 296822 - RNA, 22 nt, Homo sapiens
uaacauugucuugcuuaguuuu

SEQ ID NO: 296823 - RNA, 22 nt, Homo sapiens
uaacuaguggaauuugauuuca

SEQ ID NO: 296824 - RNA, 22 nt, Homo sapiens
uaacuguggaaaugacuuuaaa

SEQ ID NO: 296825 - RNA, 22 nt, Homo sapiens
uaagcaguguggauccaccuug

SEQ ID NO: 296826 - RNA, 22 nt, Homo sapiens
uaaggaacucugauaucuggaa

SEQ ID NO: 296827 - RNA, 22 nt, Homo sapiens
uaaggcccgugaguuucauauc

SEQ ID NO: 296828 - RNA, 22 nt, Homo sapiens
uaaggcuuaugguaaaguccug

SEQ ID NO: 296829 - RNA, 22 nt, Homo sapiens
uaaggcuucuuggaauacugca

SEQ ID NO: 296830 - RNA, 22 nt, Homo sapiens
uaaggcuugcuucagucuugaa

SEQ ID NO: 296831 - RNA, 22 nt, Homo sapiens
uaaggcuuugcuggacucaguc

SEQ ID NO: 296832 - RNA, 22 nt, Homo sapiens
uaaggcuuugucuuaggacuuu

SEQ ID NO: 296833 - RNA, 22 nt, Homo sapiens
uaagggacauguguugccuaag

SEQ ID NO: 296834 - RNA, 22 nt, Homo sapiens
uaagggcacuaaucccauuuau

SEQ ID NO: 296835 - RNA, 22 nt, Homo sapiens
uaaguaaaugaaagguugauuu

SEQ ID NO: 296836 - RNA, 22 nt, Homo sapiens
uaaguaauuuguauuuuaccca

SEQ ID NO: 296837 - RNA, 22 nt, Homo sapiens
uaaguacugucagaauuggacu

SEQ ID NO: 296838 - RNA, 22 nt, Homo sapiens
uaaguacuuuacagacauuauc

SEQ ID NO: 296839 - RNA, 22 nt, Homo sapiens
uaaguagaggaaucauuuugug

SEQ ID NO: 296840 - RNA, 22 nt, Homo sapiens
uaaguaucaguuuagcuaugau

SEQ ID NO: 296841 - RNA, 22 nt, Homo sapiens
uaagucguggaugauucuucgg

SEQ ID NO: 296842 - RNA, 22 nt, Homo sapiens
uaagugaauuucacuacugagu

SEQ ID NO: 296843 - RNA, 22 nt, Homo sapiens
uaagugcaacauaaguguuaaa

SEQ ID NO: 296844 - RNA, 22 nt, Homo sapiens
uaagugcuugacuuugauguuu

SEQ ID NO: 296845 - RNA, 18 nt, Homo sapiens
uaagugcuuuaaacacau

SEQ ID NO: 296846 - RNA, 22 nt, Homo sapiens
uaagugguguucauucuuuuga

SEQ ID NO: 296847 - RNA, 22 nt, Homo sapiens
uaaguucauucaugaaacuuag

SEQ ID NO: 296848 - RNA, 22 nt, Homo sapiens
uaaucucagcugagcugagauu

SEQ ID NO: 296849 - RNA, 22 nt, Homo sapiens
uaaugcaucaugguuggcaaac

SEQ ID NO: 296850 - RNA, 22 nt, Homo sapiens
uaaugcuugguuguuuggaaaa

SEQ ID NO: 296851 - RNA, 22 nt, Homo sapiens
uacaaagcuacucgagggcagg

SEQ ID NO: 296852 - RNA, 22 nt, Homo sapiens
uacaaaguaacaguuccuguau

SEQ ID NO: 296853 - RNA, 22 nt, Homo sapiens
uacaaaucuagguuuguuacug

SEQ ID NO: 296854 - RNA, 22 nt, Homo sapiens
uacaacacugguucgacaugug

SEQ ID NO: 296855 - RNA, 22 nt, Homo sapiens
uacaagcuaaaauggaagauca

SEQ ID NO: 296856 - RNA, 21 nt, Homo sapiens
uacaaugcacaggagagccuc

SEQ ID NO: 296857 - RNA, 22 nt, Homo sapiens
uacacacguguguauauauaca

SEQ ID NO: 296858 - RNA, 22 nt, Homo sapiens
uacacagucaaaaauuuccagg

SEQ ID NO: 296859 - RNA, 22 nt, Homo sapiens
uacacaugugaguucuuuucua

SEQ ID NO: 296860 - RNA, 22 nt, Homo sapiens
uacaccaauuuaaucaaaagca

SEQ ID NO: 296861 - RNA, 22 nt, Homo sapiens
uacaccauuugauucuuuaagc

SEQ ID NO: 296862 - RNA, 22 nt, Homo sapiens
uacaccugcacucuagccuggg

SEQ ID NO: 296863 - RNA, 18 nt, Homo sapiens
uacagaacuggaguagaa

SEQ ID NO: 296864 - RNA, 22 nt, Homo sapiens
uacaggcaccuggcuaauuuuu

SEQ ID NO: 296865 - RNA, 22 nt, Homo sapiens
uacaguaauguuaaucuuugug

SEQ ID NO: 296866 - RNA, 22 nt, Homo sapiens
uacaguagagaucagcaaacua

SEQ ID NO: 296867 - RNA, 22 nt, Homo sapiens
uacaguggaaguuaaccccauu

SEQ ID NO: 296868 - RNA, 22 nt, Homo sapiens
uacaguguuuugguauuccaca

SEQ ID NO: 296869 - RNA, 22 nt, Homo sapiens
uacauacuucacagacuuuaaa

SEQ ID NO: 296870 - RNA, 22 nt, Homo sapiens
uacauaguaagcaucuccugug

SEQ ID NO: 296871 - RNA, 22 nt, Homo sapiens
uacauaguagauauaggguuua

SEQ ID NO: 296872 - RNA, 22 nt, Homo sapiens
uacauccauccugcugggcagu

SEQ ID NO: 296873 - RNA, 22 nt, Homo sapiens
uacaugcaugggcaugugugca

SEQ ID NO: 296874 - RNA, 22 nt, Homo sapiens
uaccacaggcuggguaaucuau

SEQ ID NO: 296875 - RNA, 23 nt, Homo sapiens
uaccacauuccuucuuuccuguu

SEQ ID NO: 296876 - RNA, 22 nt, Homo sapiens
uaccacauuguagagggcauuc

SEQ ID NO: 296877 - RNA, 22 nt, Homo sapiens
uaccagugaauuccaggggcua

SEQ ID NO: 296878 - RNA, 22 nt, Homo sapiens
uaccaugcagguguauguuugu

SEQ ID NO: 296879 - RNA, 22 nt, Homo sapiens
uaccauguaucugggaugcuuu

SEQ ID NO: 296880 - RNA, 22 nt, Homo sapiens
uaccauguauguuucuccauug

SEQ ID NO: 296881 - RNA, 22 nt, Homo sapiens
uacccgucuacuuugaacaaaa

SEQ ID NO: 296882 - RNA, 22 nt, Homo sapiens
uacccugaaggaaaguauguuu

SEQ ID NO: 296883 - RNA, 22 nt, Homo sapiens
uacccuuagcuuacauucuagg

SEQ ID NO: 296884 - RNA, 23 nt, Homo sapiens
uaccugagacuggguaauuaaua

SEQ ID NO: 296885 - RNA, 22 nt, Homo sapiens
uacguaucagucguuucuguga

SEQ ID NO: 296886 - RNA, 22 nt, Homo sapiens
uacuauugcaucggugauuagg

SEQ ID NO: 296887 - RNA, 22 nt, Homo sapiens
uacucaguagacacucauaugu

SEQ ID NO: 296888 - RNA, 22 nt, Homo sapiens
uacuccccuuguucugugagcu

SEQ ID NO: 296889 - RNA, 22 nt, Homo sapiens
uacucugcagagaugcauaaca

SEQ ID NO: 296890 - RNA, 20 nt, Homo sapiens
uacugcacuccaaccuaggc

SEQ ID NO: 296891 - RNA, 22 nt, Homo sapiens
uacugcacuccagccucgguga

SEQ ID NO: 296892 - RNA, 22 nt, Homo sapiens
uacugcacuccagccuugccaa

SEQ ID NO: 296893 - RNA, 18 nt, Homo sapiens
uacugcacucuccagccu

SEQ ID NO: 296894 - RNA, 22 nt, Homo sapiens
uacugcacuugaccuccugggc

SEQ ID NO: 296895 - RNA, 22 nt, Homo sapiens
uacugcauuccaaucugggcga

SEQ ID NO: 296896 - RNA, 22 nt, Homo sapiens
uacuggccuugaacucuggugu

SEQ ID NO: 296897 - RNA, 22 nt, Homo sapiens
uagaaagcaugaccuucagaua

SEQ ID NO: 296898 - RNA, 22 nt, Homo sapiens
uagaaguaggcuacgugucugg

SEQ ID NO: 296899 - RNA, 22 nt, Homo sapiens
uagaauguaacaguuaaaagca

SEQ ID NO: 296900 - RNA, 22 nt, Homo sapiens
uagaaugucagcuucuugaggg

SEQ ID NO: 296901 - RNA, 22 nt, Homo sapiens
uagacacuagauaugugacuga

SEQ ID NO: 296902 - RNA, 22 nt, Homo sapiens
uagacccauuacguaguuucca

SEQ ID NO: 296903 - RNA, 21 nt, Homo sapiens
uagagcaacacacgcccucuc

SEQ ID NO: 296904 - RNA, 22 nt, Homo sapiens
uagagccauugcagauguuuga

SEQ ID NO: 296905 - RNA, 21 nt, Homo sapiens
uagagcuuggcacagaguaga

SEQ ID NO: 296906 - RNA, 22 nt, Homo sapiens
uagaggaaggauuggaaacgca

SEQ ID NO: 296907 - RNA, 22 nt, Homo sapiens
uagagguagagugacuucccca

SEQ ID NO: 296908 - RNA, 22 nt, Homo sapiens
uagagguagguguaugaacuag

SEQ ID NO: 296909 - RNA, 22 nt, Homo sapiens
uagagguauaccaaaaaggcau

SEQ ID NO: 296910 - RNA, 22 nt, Homo sapiens
uagagguucuaagauucucaga

SEQ ID NO: 296911 - RNA, 21 nt, Homo sapiens
uagauacuguauuaaaccuag

SEQ ID NO: 296912 - RNA, 22 nt, Homo sapiens
uagaucacucaggcaauaaaag

SEQ ID NO: 296913 - RNA, 22 nt, Homo sapiens
uagaucauauucagugcuuacu

SEQ ID NO: 296914 - RNA, 21 nt, Homo sapiens
uagaugguguucuagagagaa

SEQ ID NO: 296915 - RNA, 22 nt, Homo sapiens
uagauuaucauucauacaggga

SEQ ID NO: 296916 - RNA, 22 nt, Homo sapiens
uagauuauccggcugggacaau

SEQ ID NO: 296917 - RNA, 22 nt, Homo sapiens
uagauuaucucaccacucgagu

SEQ ID NO: 296918 - RNA, 22 nt, Homo sapiens
uagcaaaucaauggaauugaag

SEQ ID NO: 296919 - RNA, 22 nt, Homo sapiens
uagcaacauucagcucagguac

SEQ ID NO: 296920 - RNA, 19 nt, Homo sapiens
uagcacagggucccagacu

SEQ ID NO: 296921 - RNA, 22 nt, Homo sapiens
uagcacagugucauucuaggua

SEQ ID NO: 296922 - RNA, 22 nt, Homo sapiens
uagcacaucccuaaaaugcugu

SEQ ID NO: 296923 - RNA, 22 nt, Homo sapiens
uagcacaucuucuuggccugca

SEQ ID NO: 296924 - RNA, 22 nt, Homo sapiens
uagcaccaggguugacugaccu

SEQ ID NO: 296925 - RNA, 22 nt, Homo sapiens
uagcacccucuccuaguccugc

SEQ ID NO: 296926 - RNA, 22 nt, Homo sapiens
uagcacuauuuuucacuauccu

SEQ ID NO: 296927 - RNA, 22 nt, Homo sapiens
uagcagaauauaccucuuacuu

SEQ ID NO: 296928 - RNA, 22 nt, Homo sapiens
uagcagcagugguguauuuaga

SEQ ID NO: 296929 - RNA, 19 nt, Homo sapiens
uagcagcaugauuuauaau

SEQ ID NO: 296930 - RNA, 22 nt, Homo sapiens
uagcagccaggaagggcuggcu

SEQ ID NO: 296931 - RNA, 21 nt, Homo sapiens
uagcagcguuguugcaaaugu

SEQ ID NO: 296932 - RNA, 22 nt, Homo sapiens
uagcaguagacagacuuuggcu

SEQ ID NO: 296933 - RNA, 22 nt, Homo sapiens
uagcaguauacguacugggucc

SEQ ID NO: 296934 - RNA, 22 nt, Homo sapiens
uagcaguauaugagagcuauug

SEQ ID NO: 296935 - RNA, 22 nt, Homo sapiens
uagcaguauugaaagaugaggg

SEQ ID NO: 296936 - RNA, 22 nt, Homo sapiens
uagcagucaagauagucauuau

SEQ ID NO: 296937 - RNA, 22 nt, Homo sapiens
uagcaguuguuguuacuuguau

SEQ ID NO: 296938 - RNA, 22 nt, Homo sapiens
uagcaucagauuccauauucua

SEQ ID NO: 296939 - RNA, 22 nt, Homo sapiens
uagcauggagucaugcacggcu

SEQ ID NO: 296940 - RNA, 19 nt, Homo sapiens
uagcuagauuggguacuua

SEQ ID NO: 296941 - RNA, 22 nt, Homo sapiens
uagcucagcccagcuaagcuca

SEQ ID NO: 296942 - RNA, 22 nt, Homo sapiens
uagcugcccagcacgaaguugg

SEQ ID NO: 296943 - RNA, 22 nt, Homo sapiens
uaggacuuuuugguaggcggga

SEQ ID NO: 296944 - RNA, 20 nt, Homo sapiens
uaggagcaaugagaguagaa

SEQ ID NO: 296945 - RNA, 22 nt, Homo sapiens
uaggagcacaaacccuacugug

SEQ ID NO: 296946 - RNA, 22 nt, Homo sapiens
uaggcagccagcuguggauuga

SEQ ID NO: 296947 - RNA, 22 nt, Homo sapiens
uaggcauuuuucugauaaacua

SEQ ID NO: 296948 - RNA, 19 nt, Homo sapiens
uagggcacgaggcagaguc

SEQ ID NO: 296949 - RNA, 22 nt, Homo sapiens
uagggcuuuccggccugucaga

SEQ ID NO: 296950 - RNA, 22 nt, Homo sapiens
uaggggcacacuucgguuagca

SEQ ID NO: 296951 - RNA, 22 nt, Homo sapiens
uagguacuuaagaucucagcua

SEQ ID NO: 296952 - RNA, 22 nt, Homo sapiens
uagguacuuuacauguuaucuc

SEQ ID NO: 296953 - RNA, 22 nt, Homo sapiens
uagguagaaucuugaagccauu

SEQ ID NO: 296954 - RNA, 22 nt, Homo sapiens
uagguagcuuuggcguuucuug

SEQ ID NO: 296955 - RNA, 22 nt, Homo sapiens
uagguaguugugggcuugaaug

SEQ ID NO: 296956 - RNA, 22 nt, Homo sapiens
uaggucaguuuuggcuuggcuu

SEQ ID NO: 296957 - RNA, 22 nt, Homo sapiens
uaggucuuuuagcauaggagcu

SEQ ID NO: 296958 - RNA, 22 nt, Homo sapiens
uaggucuuuuaugaaauauauu

SEQ ID NO: 296959 - RNA, 22 nt, Homo sapiens
uaggugaaugcuggaagaaaug

SEQ ID NO: 296960 - RNA, 22 nt, Homo sapiens
uagguuaugauccaucuuggcu

SEQ ID NO: 296961 - RNA, 22 nt, Homo sapiens
uagguugucaucagucuccacu

SEQ ID NO: 296962 - RNA, 22 nt, Homo sapiens
uagguugucuguucacucugau

SEQ ID NO: 296963 - RNA, 22 nt, Homo sapiens
uaguaaacauuuuucuaucauu

SEQ ID NO: 296964 - RNA, 22 nt, Homo sapiens
uaguaacacauugaacgaucgc

SEQ ID NO: 296965 - RNA, 22 nt, Homo sapiens
uaguagagauggggcacaugcc

SEQ ID NO: 296966 - RNA, 22 nt, Homo sapiens
uaguaggacaggauuucaguua

SEQ ID NO: 296967 - RNA, 22 nt, Homo sapiens
uaguaucacauggucuuaauua

SEQ ID NO: 296968 - RNA, 22 nt, Homo sapiens
uagucaaaucugaaggaaauuu

SEQ ID NO: 296969 - RNA, 22 nt, Homo sapiens
uaguccauuuucaugcugcuau

SEQ ID NO: 296970 - RNA, 22 nt, Homo sapiens
uagugaauguuggcuauuaaua

SEQ ID NO: 296971 - RNA, 22 nt, Homo sapiens
uagugcaguggcuccaucucag

SEQ ID NO: 296972 - RNA, 21 nt, Homo sapiens
uagugcagugggguaugacuu

SEQ ID NO: 296973 - RNA, 22 nt, Homo sapiens
uagugcuguaauucuaaugaaa

SEQ ID NO: 296974 - RNA, 18 nt, Homo sapiens
uagugcuguucucaugau

SEQ ID NO: 296975 - RNA, 20 nt, Homo sapiens
uaguggaaaucagguccucu

SEQ ID NO: 296976 - RNA, 22 nt, Homo sapiens
uauaacacccacauauagucuu

SEQ ID NO: 296977 - RNA, 22 nt, Homo sapiens
uauacugucuuuguaugccuag

SEQ ID NO: 296978 - RNA, 20 nt, Homo sapiens
uauagcaauuuuuuucuccu

SEQ ID NO: 296979 - RNA, 21 nt, Homo sapiens
uauagcagcacgauuuauaau

SEQ ID NO: 296980 - RNA, 22 nt, Homo sapiens
uauagcagugugagaacagacu

SEQ ID NO: 296981 - RNA, 22 nt, Homo sapiens
uauagcuuaaaguuuagauccu

SEQ ID NO: 296982 - RNA, 22 nt, Homo sapiens
uauaucacaugcacucauuuuc

SEQ ID NO: 296983 - RNA, 21 nt, Homo sapiens
uauaugacuuacuauugccuc

SEQ ID NO: 296984 - RNA, 22 nt, Homo sapiens
uauaugucuuuguuauguugag

SEQ ID NO: 296985 - RNA, 22 nt, Homo sapiens
uauauguucugugucccuuucg

SEQ ID NO: 296986 - RNA, 22 nt, Homo sapiens
uaucaagaugacaaacuuugcu

SEQ ID NO: 296987 - RNA, 22 nt, Homo sapiens
uaucaaggccacucauuuuaug

SEQ ID NO: 296988 - RNA, 22 nt, Homo sapiens
uaucaaguuggaagagaaguaa

SEQ ID NO: 296989 - RNA, 23 nt, Homo sapiens
uaucacacuuucucugugccaca

SEQ ID NO: 296990 - RNA, 22 nt, Homo sapiens
uaucacagauucuccaggguuu

SEQ ID NO: 296991 - RNA, 22 nt, Homo sapiens
uaucacaguaucuagcacagug

SEQ ID NO: 296992 - RNA, 22 nt, Homo sapiens
uaucacaguugcauauuuaagg

SEQ ID NO: 296993 - RNA, 22 nt, Homo sapiens
uaucaccauguccguuuuaaaa

SEQ ID NO: 296994 - RNA, 22 nt, Homo sapiens
uaucaccuugcaguggaugcua

SEQ ID NO: 296995 - RNA, 22 nt, Homo sapiens
uaucagauugcugccaucugcu

SEQ ID NO: 296996 - RNA, 22 nt, Homo sapiens
uaucagcagagucauacuucaa

SEQ ID NO: 296997 - RNA, 22 nt, Homo sapiens
uaucagcagcaggggcugcaga

SEQ ID NO: 296998 - RNA, 22 nt, Homo sapiens
uaucauaguuuggacuuucauu

SEQ ID NO: 296999 - RNA, 22 nt, Homo sapiens
uaucaucauguuuuugcugugu

SEQ ID NO: 297000 - RNA, 22 nt, Homo sapiens
uaucaucauuggcaggugagaa

SEQ ID NO: 297001 - RNA, 18 nt, Homo sapiens
uaucauguagggaaguug

SEQ ID NO: 297002 - RNA, 22 nt, Homo sapiens
uaucaugucuguguguaccuag

SEQ ID NO: 297003 - RNA, 22 nt, Homo sapiens
uauccuguagcucauccaccgc

SEQ ID NO: 297004 - RNA, 22 nt, Homo sapiens
uaucucauccuccuugauccca

SEQ ID NO: 297005 - RNA, 18 nt, Homo sapiens
uaucucauuucuuagguc

SEQ ID NO: 297006 - RNA, 22 nt, Homo sapiens
uaucucuuuucauguguaaaug

SEQ ID NO: 297007 - RNA, 22 nt, Homo sapiens
uaucugguuauugcugcugauu

SEQ ID NO: 297008 - RNA, 20 nt, Homo sapiens
uaugaaacaguguagagcaa

SEQ ID NO: 297009 - RNA, 22 nt, Homo sapiens
uaugacugagacuuaaauugug

SEQ ID NO: 297010 - RNA, 22 nt, Homo sapiens
uaugacuguuugcucauucagg

SEQ ID NO: 297011 - RNA, 22 nt, Homo sapiens
uaugacuuuggaaaaauuacuu

SEQ ID NO: 297012 - RNA, 22 nt, Homo sapiens
uaugaggaguauaacccgguga

SEQ ID NO: 297013 - RNA, 22 nt, Homo sapiens
uaugaugcuguuuagaaucucu

SEQ ID NO: 297014 - RNA, 19 nt, Homo sapiens
uaugcaacuuauagugcug

SEQ ID NO: 297015 - RNA, 22 nt, Homo sapiens
uaugcacacguguccaugugca

SEQ ID NO: 297016 - RNA, 22 nt, Homo sapiens
uaugcacacucucccaggaggg

SEQ ID NO: 297017 - RNA, 22 nt, Homo sapiens
uaugcacuaggcacuguguuug

SEQ ID NO: 297018 - RNA, 22 nt, Homo sapiens
uaugcacuauggaaguagcuca

SEQ ID NO: 297019 - RNA, 22 nt, Homo sapiens
uaugcccauuuaaauugaacaa

SEQ ID NO: 297020 - RNA, 22 nt, Homo sapiens
uaugccuuucucacuaagcuua

SEQ ID NO: 297021 - RNA, 22 nt, Homo sapiens
uaugccuuuugguucaagcaac

SEQ ID NO: 297022 - RNA, 22 nt, Homo sapiens
uaugcuuauaaacauuugucag

SEQ ID NO: 297023 - RNA, 22 nt, Homo sapiens
uauggcaaugcauaggaaggaa

SEQ ID NO: 297024 - RNA, 22 nt, Homo sapiens
uauggcauuauuuugauagaca

SEQ ID NO: 297025 - RNA, 22 nt, Homo sapiens
uauggccacugucuuugaguca

SEQ ID NO: 297026 - RNA, 17 nt, Homo sapiens
uauggcuauguuuagau

SEQ ID NO: 297027 - RNA, 22 nt, Homo sapiens
uauggguaguacaaaguguaua

SEQ ID NO: 297028 - RNA, 22 nt, Homo sapiens
uauggguguuauugcaugggag

SEQ ID NO: 297029 - RNA, 21 nt, Homo sapiens
uaugguuucuaauucugcagg

SEQ ID NO: 297030 - RNA, 19 nt, Homo sapiens
uauguaguuuucucaauau

SEQ ID NO: 297031 - RNA, 22 nt, Homo sapiens
uaugucacagguuuuggugaaa

SEQ ID NO: 297032 - RNA, 22 nt, Homo sapiens
uaugucacuggacauaaguucu

SEQ ID NO: 297033 - RNA, 22 nt, Homo sapiens
uaugucuauuauguagcaggaa

SEQ ID NO: 297034 - RNA, 22 nt, Homo sapiens
uauuagguuggugcaaaaguaa

SEQ ID NO: 297035 - RNA, 22 nt, Homo sapiens
uauuaguuguaugauucccaag

SEQ ID NO: 297036 - RNA, 22 nt, Homo sapiens
uauuaugcacuuuauaaaaauu

SEQ ID NO: 297037 - RNA, 22 nt, Homo sapiens
uauucacaggugugggacaaag

SEQ ID NO: 297038 - RNA, 22 nt, Homo sapiens
uauucacuguaucauugauggg

SEQ ID NO: 297039 - RNA, 22 nt, Homo sapiens
uauugaauuuuuaagcccuuug

SEQ ID NO: 297040 - RNA, 22 nt, Homo sapiens
uauugcacuccagccuuggcaa

SEQ ID NO: 297041 - RNA, 22 nt, Homo sapiens
uauugcuaaaacucaugguugc

SEQ ID NO: 297042 - RNA, 22 nt, Homo sapiens
uauugcuccuaauaucacggug

SEQ ID NO: 297043 - RNA, 22 nt, Homo sapiens
uauugcuggauguauuacaugu

SEQ ID NO: 297044 - RNA, 22 nt, Homo sapiens
uauugcuggcacauaguagguc

SEQ ID NO: 297045 - RNA, 22 nt, Homo sapiens
uauugcuugaggaaaugguaau

SEQ ID NO: 297046 - RNA, 22 nt, Homo sapiens
uauugcuuuacucucuuauccu

SEQ ID NO: 297047 - RNA, 22 nt, Homo sapiens
uauugcuuuugauucaaggcag

SEQ ID NO: 297048 - RNA, 22 nt, Homo sapiens
uauuggcucuguuucucugaag

SEQ ID NO: 297049 - RNA, 22 nt, Homo sapiens
uauugggcuucucagaauagag

SEQ ID NO: 297050 - RNA, 22 nt, Homo sapiens
uauuguccacuuugcacugugu

SEQ ID NO: 297051 - RNA, 22 nt, Homo sapiens
uauuugauugacuuuagcagga

SEQ ID NO: 297052 - RNA, 22 nt, Homo sapiens
ucaaaaccucagagaguagagc

SEQ ID NO: 297053 - RNA, 20 nt, Homo sapiens
ucaaagacauggcugucaga

SEQ ID NO: 297054 - RNA, 18 nt, Homo sapiens
ucaaauacuuugggcagu

SEQ ID NO: 297055 - RNA, 22 nt, Homo sapiens
ucaaaugaucugcccgccuugg

SEQ ID NO: 297056 - RNA, 22 nt, Homo sapiens
ucaaauguucccuguacuggcc

SEQ ID NO: 297057 - RNA, 22 nt, Homo sapiens
ucaacagugggcacuguaaaug

SEQ ID NO: 297058 - RNA, 22 nt, Homo sapiens
ucaagaccucacauagaggaga

SEQ ID NO: 297059 - RNA, 22 nt, Homo sapiens
ucaagcaauucgccugucucag

SEQ ID NO: 297060 - RNA, 18 nt, Homo sapiens
ucaagcaauugucaugcc

SEQ ID NO: 297061 - RNA, 22 nt, Homo sapiens
ucaaggacuacauggggugaaa

SEQ ID NO: 297062 - RNA, 22 nt, Homo sapiens
ucaaggcaguggccuuccuucu

SEQ ID NO: 297063 - RNA, 22 nt, Homo sapiens
ucaaguaagaagugggcauaaa

SEQ ID NO: 297064 - RNA, 23 nt, Homo sapiens
ucaagugaugguggccacaaggg

SEQ ID NO: 297065 - RNA, 22 nt, Homo sapiens
ucaaugcaaccuccaccucugg

SEQ ID NO: 297066 - RNA, 22 nt, Homo sapiens
ucaauguaucuccaagaauuga

SEQ ID NO: 297067 - RNA, 20 nt, Homo sapiens
ucacaagccaagaucacguc

SEQ ID NO: 297068 - RNA, 22 nt, Homo sapiens
ucacaauggcugaacuaauuua

SEQ ID NO: 297069 - RNA, 22 nt, Homo sapiens
ucacacugaaacuaggguguga

SEQ ID NO: 297070 - RNA, 22 nt, Homo sapiens
ucacacugaauuugaagcaaug

SEQ ID NO: 297071 - RNA, 22 nt, Homo sapiens
ucacacugcaucuguuggaauu

SEQ ID NO: 297072 - RNA, 22 nt, Homo sapiens
ucacagacauugaggggaccuu

SEQ ID NO: 297073 - RNA, 19 nt, Homo sapiens
ucacaggguugacuugagg

SEQ ID NO: 297074 - RNA, 22 nt, Homo sapiens
ucacagucuccucuagggaggg

SEQ ID NO: 297075 - RNA, 22 nt, Homo sapiens
ucacagucugcgugaugagaca

SEQ ID NO: 297076 - RNA, 17 nt, Homo sapiens
ucacaguguuaggauga

SEQ ID NO: 297077 - RNA, 22 nt, Homo sapiens
ucacaguugauugaaacacagc

SEQ ID NO: 297078 - RNA, 22 nt, Homo sapiens
ucacaguuggccuggccuuuua

SEQ ID NO: 297079 - RNA, 22 nt, Homo sapiens
ucacauggaggugauaguugaa

SEQ ID NO: 297080 - RNA, 22 nt, Homo sapiens
ucacauuaagcuguuauuucuu

SEQ ID NO: 297081 - RNA, 22 nt, Homo sapiens
ucacauucaauuguaauccccg

SEQ ID NO: 297082 - RNA, 19 nt, Homo sapiens
ucaccaguacacaauacaa

SEQ ID NO: 297083 - RNA, 22 nt, Homo sapiens
ucaccaguacuccaaauugagg

SEQ ID NO: 297084 - RNA, 22 nt, Homo sapiens
ucaccagugucagggaacugcu

SEQ ID NO: 297085 - RNA, 22 nt, Homo sapiens
ucaccuggggaucuuguuuaca

SEQ ID NO: 297086 - RNA, 18 nt, Homo sapiens
ucacggggagcagcagcc

SEQ ID NO: 297087 - RNA, 22 nt, Homo sapiens
ucacgugguucauaaggcagaa

SEQ ID NO: 297088 - RNA, 22 nt, Homo sapiens
ucacuauugacaacagugugga

SEQ ID NO: 297089 - RNA, 22 nt, Homo sapiens
ucacugaaaccgccuccaccuc

SEQ ID NO: 297090 - RNA, 22 nt, Homo sapiens
ucacugaaaccuccaccucucg

SEQ ID NO: 297091 - RNA, 22 nt, Homo sapiens
ucacugaaaccuccgccuucug

SEQ ID NO: 297092 - RNA, 21 nt, Homo sapiens
ucacugagguuaaauaggguu

SEQ ID NO: 297093 - RNA, 20 nt, Homo sapiens
ucacugagugguccacagua

SEQ ID NO: 297094 - RNA, 22 nt, Homo sapiens
ucacugcacuagguaaugccac

SEQ ID NO: 297095 - RNA, 22 nt, Homo sapiens
ucacugcacuccagccuuuaug

SEQ ID NO: 297096 - RNA, 22 nt, Homo sapiens
ucacugcacucuccgccuugcg

SEQ ID NO: 297097 - RNA, 22 nt, Homo sapiens
ucacugcgaccuccaccucccg

SEQ ID NO: 297098 - RNA, 22 nt, Homo sapiens
ucacugcgaccucugccucccg

SEQ ID NO: 297099 - RNA, 22 nt, Homo sapiens
ucacuggagauagcaaucuggu

SEQ ID NO: 297100 - RNA, 22 nt, Homo sapiens
ucacugggagcauuugagccuu

SEQ ID NO: 297101 - RNA, 22 nt, Homo sapiens
ucacuguugaugggcaugcagg

SEQ ID NO: 297102 - RNA, 22 nt, Homo sapiens
ucacuuggccgcagccuucucu

SEQ ID NO: 297103 - RNA, 22 nt, Homo sapiens
ucacuugguggcaaaguuuaug

SEQ ID NO: 297104 - RNA, 22 nt, Homo sapiens
ucagaacugauacuagaacuuu

SEQ ID NO: 297105 - RNA, 21 nt, Homo sapiens
ucagaagcucccagggaggac

SEQ ID NO: 297106 - RNA, 22 nt, Homo sapiens
ucagaccauuucauuacagacu

SEQ ID NO: 297107 - RNA, 22 nt, Homo sapiens
ucagaguagagcgacuucuccu

SEQ ID NO: 297108 - RNA, 22 nt, Homo sapiens
ucagaguaguuccuggcagaaa

SEQ ID NO: 297109 - RNA, 22 nt, Homo sapiens
ucagaucacuggcgcuggcgga

SEQ ID NO: 297110 - RNA, 22 nt, Homo sapiens
ucagaucauauucuucgcugcu

SEQ ID NO: 297111 - RNA, 22 nt, Homo sapiens
ucagaucuucagcaggggcccc

SEQ ID NO: 297112 - RNA, 22 nt, Homo sapiens
ucagaugaucugguaagaacuu

SEQ ID NO: 297113 - RNA, 22 nt, Homo sapiens
ucagaugauuccguugacgaga

SEQ ID NO: 297114 - RNA, 22 nt, Homo sapiens
ucagauguuugagaaguauacu

SEQ ID NO: 297115 - RNA, 22 nt, Homo sapiens
ucagcaaugaccuaagcaaaua

SEQ ID NO: 297116 - RNA, 19 nt, Homo sapiens
ucagcaguaaucaacuuca

SEQ ID NO: 297117 - RNA, 20 nt, Homo sapiens
ucagcagucuggagcagagg

SEQ ID NO: 297118 - RNA, 22 nt, Homo sapiens
ucagcagugagagaccucaccc

SEQ ID NO: 297119 - RNA, 22 nt, Homo sapiens
ucagcagugccccacucuacug

SEQ ID NO: 297120 - RNA, 22 nt, Homo sapiens
ucagcaucacaggcagugagug

SEQ ID NO: 297121 - RNA, 22 nt, Homo sapiens
ucaggcaccuuccucuuaucug

SEQ ID NO: 297122 - RNA, 22 nt, Homo sapiens
ucaggcaugcagcaaugcagug

SEQ ID NO: 297123 - RNA, 21 nt, Homo sapiens
ucagggaccugcuguacugau

SEQ ID NO: 297124 - RNA, 22 nt, Homo sapiens
ucagggacgcuugacacaagcc

SEQ ID NO: 297125 - RNA, 20 nt, Homo sapiens
ucagguagggcuucaacauu

SEQ ID NO: 297126 - RNA, 22 nt, Homo sapiens
ucagguaguuugugggagauga

SEQ ID NO: 297127 - RNA, 22 nt, Homo sapiens
ucagguaucuucauagcaaugc

SEQ ID NO: 297128 - RNA, 22 nt, Homo sapiens
ucagguauuucuuuuagcugug

SEQ ID NO: 297129 - RNA, 22 nt, Homo sapiens
ucaggugcagagaagaaauggg

SEQ ID NO: 297130 - RNA, 22 nt, Homo sapiens
ucaggugcaguggcucaugcuu

SEQ ID NO: 297131 - RNA, 22 nt, Homo sapiens
ucagguugcuaaguauaauauu

SEQ ID NO: 297132 - RNA, 23 nt, Homo sapiens
ucaguacuccacuuucaauagug

SEQ ID NO: 297133 - RNA, 23 nt, Homo sapiens
ucaguacucuauaagugccagcu

SEQ ID NO: 297134 - RNA, 19 nt, Homo sapiens
ucaguagugcacauaagcc

SEQ ID NO: 297135 - RNA, 22 nt, Homo sapiens
ucagucauguuuaccagacgua

SEQ ID NO: 297136 - RNA, 22 nt, Homo sapiens
ucagucauucaauuguugaaug

SEQ ID NO: 297137 - RNA, 22 nt, Homo sapiens
ucaguccccucgcugagucuac

SEQ ID NO: 297138 - RNA, 22 nt, Homo sapiens
ucagugaauacauguacucaug

SEQ ID NO: 297139 - RNA, 22 nt, Homo sapiens
ucagugauugcuuucauggaaa

SEQ ID NO: 297140 - RNA, 20 nt, Homo sapiens
ucagugauugguuuaguuau

SEQ ID NO: 297141 - RNA, 20 nt, Homo sapiens
ucagugcagauuguccaagu

SEQ ID NO: 297142 - RNA, 17 nt, Homo sapiens
ucagugcauuuaagaga

SEQ ID NO: 297143 - RNA, 22 nt, Homo sapiens
ucagugccauugccauaugagu

SEQ ID NO: 297144 - RNA, 22 nt, Homo sapiens
ucagugcuuggcacagagagcu

SEQ ID NO: 297145 - RNA, 22 nt, Homo sapiens
ucaguggauuuaaccugaauca

SEQ ID NO: 297146 - RNA, 22 nt, Homo sapiens
ucagugggcuauguaauuaacu

SEQ ID NO: 297147 - RNA, 22 nt, Homo sapiens
ucagugguuaaaagauucuaga

SEQ ID NO: 297148 - RNA, 22 nt, Homo sapiens
ucaguguuuggaaucucaauuu

SEQ ID NO: 297149 - RNA, 22 nt, Homo sapiens
ucaguuaaugcugccugcugga

SEQ ID NO: 297150 - RNA, 22 nt, Homo sapiens
ucaguuuguauuucagguugca

SEQ ID NO: 297151 - RNA, 21 nt, Homo sapiens
ucauaagcucaacaucuguag

SEQ ID NO: 297152 - RNA, 22 nt, Homo sapiens
ucauacaguaguccucacuugu

SEQ ID NO: 297153 - RNA, 22 nt, Homo sapiens
ucauacuguccaauucuagugg

SEQ ID NO: 297154 - RNA, 21 nt, Homo sapiens
ucauauguaucuuugugccuc

SEQ ID NO: 297155 - RNA, 22 nt, Homo sapiens
ucaucagaguuuacaagcucag

SEQ ID NO: 297156 - RNA, 22 nt, Homo sapiens
ucaucaggaaacuuaugcagug

SEQ ID NO: 297157 - RNA, 22 nt, Homo sapiens
ucaucagguaugucagcggagu

SEQ ID NO: 297158 - RNA, 22 nt, Homo sapiens
ucaucagugcuugcaaauuauu

SEQ ID NO: 297159 - RNA, 22 nt, Homo sapiens
ucaucuggcgaaugugaagagu

SEQ ID NO: 297160 - RNA, 21 nt, Homo sapiens
ucaugccacugcacuuuagcc

SEQ ID NO: 297161 - RNA, 19 nt, Homo sapiens
ucauggcuuuuucagcugu

SEQ ID NO: 297162 - RNA, 22 nt, Homo sapiens
ucaugucuuguuguauuuauuu

SEQ ID NO: 297163 - RNA, 22 nt, Homo sapiens
ucauucauuugcucacuccaca

SEQ ID NO: 297164 - RNA, 22 nt, Homo sapiens
ucauugcaaucucugccucccg

SEQ ID NO: 297165 - RNA, 22 nt, Homo sapiens
ucauuguccaacuucuuucagu

SEQ ID NO: 297166 - RNA, 22 nt, Homo sapiens
uccacaguaaggacccugccuu

SEQ ID NO: 297167 - RNA, 22 nt, Homo sapiens
uccagguacucagggggcugag

SEQ ID NO: 297168 - RNA, 22 nt, Homo sapiens
uccagugugcaggcaaguuuga

SEQ ID NO: 297169 - RNA, 22 nt, Homo sapiens
uccaguguuccucagucacccc

SEQ ID NO: 297170 - RNA, 18 nt, Homo sapiens
uccaguuuucccagcauc

SEQ ID NO: 297171 - RNA, 22 nt, Homo sapiens
uccaguuuuguuaacauauggu

SEQ ID NO: 297172 - RNA, 22 nt, Homo sapiens
uccauggagacacauuuuauau

SEQ ID NO: 297173 - RNA, 22 nt, Homo sapiens
uccauguagaagacaggggaga

SEQ ID NO: 297174 - RNA, 22 nt, Homo sapiens
uccauguagaugcuauguuguc

SEQ ID NO: 297175 - RNA, 19 nt, Homo sapiens
ucccaagaugcucauacau

SEQ ID NO: 297176 - RNA, 22 nt, Homo sapiens
ucccagugaaaccccaccuuca

SEQ ID NO: 297177 - RNA, 22 nt, Homo sapiens
uccccuuuguaagauggaaacg

SEQ ID NO: 297178 - RNA, 22 nt, Homo sapiens
ucccuacuggggcacugccuag

SEQ ID NO: 297179 - RNA, 20 nt, Homo sapiens
ucccucaaacuuuuccacug

SEQ ID NO: 297180 - RNA, 22 nt, Homo sapiens
ucccugaagcugcagcaacaca

SEQ ID NO: 297181 - RNA, 22 nt, Homo sapiens
ucccugaaucucagguucugua

SEQ ID NO: 297182 - RNA, 19 nt, Homo sapiens
ucccuguagaccacagugc

SEQ ID NO: 297183 - RNA, 22 nt, Homo sapiens
ucccuguguccugggggcaccu

SEQ ID NO: 297184 - RNA, 22 nt, Homo sapiens
ucccuguguuccuuuugaauug

SEQ ID NO: 297185 - RNA, 22 nt, Homo sapiens
ucccuuagccaaauccccagcc

SEQ ID NO: 297186 - RNA, 22 nt, Homo sapiens
uccucugaacuccagacccaua

SEQ ID NO: 297187 - RNA, 22 nt, Homo sapiens
uccugagaauagaguugcaugu

SEQ ID NO: 297188 - RNA, 22 nt, Homo sapiens
uccugauacgguugcaguucuc

SEQ ID NO: 297189 - RNA, 22 nt, Homo sapiens
uccuugagccugggaguuauag

SEQ ID NO: 297190 - RNA, 22 nt, Homo sapiens
uccuuuggcuaacuuucuaagu

SEQ ID NO: 297191 - RNA, 22 nt, Homo sapiens
uccuuugguuauaggcaccucu

SEQ ID NO: 297192 - RNA, 18 nt, Homo sapiens
uccuuuugggguaggaga

SEQ ID NO: 297193 - RNA, 22 nt, Homo sapiens
ucgcauggucuccaggcagcuc

SEQ ID NO: 297194 - RNA, 22 nt, Homo sapiens
ucgugcaaacguaauugugguu

SEQ ID NO: 297195 - RNA, 22 nt, Homo sapiens
ucguucuugucaguuuauaaag

SEQ ID NO: 297196 - RNA, 22 nt, Homo sapiens
ucuaaagcauccagauugcuuc

SEQ ID NO: 297197 - RNA, 19 nt, Homo sapiens
ucuaaaucucuugauagac

SEQ ID NO: 297198 - RNA, 22 nt, Homo sapiens
ucuacagccaguucaggaagaa

SEQ ID NO: 297199 - RNA, 22 nt, Homo sapiens
ucuaguaaugagaggcaggaga

SEQ ID NO: 297200 - RNA, 22 nt, Homo sapiens
ucuaugguuuauuuccaagugu

SEQ ID NO: 297201 - RNA, 22 nt, Homo sapiens
ucucaaguaacugggacaauaa

SEQ ID NO: 297202 - RNA, 18 nt, Homo sapiens
ucucacagcaaucuguca

SEQ ID NO: 297203 - RNA, 19 nt, Homo sapiens
ucucacagcucuacuaugu

SEQ ID NO: 297204 - RNA, 22 nt, Homo sapiens
ucucacaggguuauugaggggg

SEQ ID NO: 297205 - RNA, 22 nt, Homo sapiens
ucucagcacaaacaaaauugcu

SEQ ID NO: 297206 - RNA, 22 nt, Homo sapiens
ucucagugaauugguuuugucu

SEQ ID NO: 297207 - RNA, 22 nt, Homo sapiens
ucucagugacugcugggucccc

SEQ ID NO: 297208 - RNA, 22 nt, Homo sapiens
ucucaguggcuuccucacuuuu

SEQ ID NO: 297209 - RNA, 21 nt, Homo sapiens
ucucauagaguuucacuuucu

SEQ ID NO: 297210 - RNA, 22 nt, Homo sapiens
ucucugaaacucuugacauccu

SEQ ID NO: 297211 - RNA, 22 nt, Homo sapiens
ucucugagaaaaguuucuccca

SEQ ID NO: 297212 - RNA, 22 nt, Homo sapiens
ucucuggauaucuacuuauguu

SEQ ID NO: 297213 - RNA, 22 nt, Homo sapiens
ucucuugguugaacaguuugga

SEQ ID NO: 297214 - RNA, 19 nt, Homo sapiens
ucugacagccccagucaac

SEQ ID NO: 297215 - RNA, 22 nt, Homo sapiens
ucugagaucaugucugugcugu

SEQ ID NO: 297216 - RNA, 22 nt, Homo sapiens
ucugagcaauaaacaacauauu

SEQ ID NO: 297217 - RNA, 22 nt, Homo sapiens
ucugagcaauagauguggauau

SEQ ID NO: 297218 - RNA, 22 nt, Homo sapiens
ucugagguuaaauuuuauaguu

SEQ ID NO: 297219 - RNA, 21 nt, Homo sapiens
ucugagucauucaguggccug

SEQ ID NO: 297220 - RNA, 22 nt, Homo sapiens
ucugauggaguugccagggaga

SEQ ID NO: 297221 - RNA, 22 nt, Homo sapiens
ucugcauaucaugcagaacuau

SEQ ID NO: 297222 - RNA, 22 nt, Homo sapiens
ucuggaauguaaaguuuauggg

SEQ ID NO: 297223 - RNA, 22 nt, Homo sapiens
ucuggagugugaaguggauaug

SEQ ID NO: 297224 - RNA, 22 nt, Homo sapiens
ucuggccuacaaguaauuuuau

SEQ ID NO: 297225 - RNA, 22 nt, Homo sapiens
ucuggccuccuaugagaaucga

SEQ ID NO: 297226 - RNA, 16 nt, Homo sapiens
ucuggcucuacaguuc

SEQ ID NO: 297227 - RNA, 22 nt, Homo sapiens
ucuggcuucugacuuaggggac

SEQ ID NO: 297228 - RNA, 17 nt, Homo sapiens
ucuggcuuucacaccug

SEQ ID NO: 297229 - RNA, 21 nt, Homo sapiens
ucuggcuuucauuccccuucu

SEQ ID NO: 297230 - RNA, 22 nt, Homo sapiens
ucuggcuuugugaguugccaga

SEQ ID NO: 297231 - RNA, 22 nt, Homo sapiens
ucuggguuuuuccauugccggu

SEQ ID NO: 297232 - RNA, 22 nt, Homo sapiens
ucuggucccugcacauauuuuc

SEQ ID NO: 297233 - RNA, 22 nt, Homo sapiens
ucugguggugaugagagacagu

SEQ ID NO: 297234 - RNA, 22 nt, Homo sapiens
ucugguuccuuggcuucggguc

SEQ ID NO: 297235 - RNA, 22 nt, Homo sapiens
ucuguaacauccaccuucuggg

SEQ ID NO: 297236 - RNA, 22 nt, Homo sapiens
ucuguaguuaacagcuucagcu

SEQ ID NO: 297237 - RNA, 22 nt, Homo sapiens
ucugucacugaaucccugucac

SEQ ID NO: 297238 - RNA, 22 nt, Homo sapiens
ucugucuuguccucacccuaga

SEQ ID NO: 297239 - RNA, 22 nt, Homo sapiens
ucugucuugugguuugagugcc

SEQ ID NO: 297240 - RNA, 22 nt, Homo sapiens
ucugugaaaucauuuccuguaa

SEQ ID NO: 297241 - RNA, 22 nt, Homo sapiens
ucugugcauuguaacaacuaaa

SEQ ID NO: 297242 - RNA, 22 nt, Homo sapiens
ucugugcauuuucuuuuagacu

SEQ ID NO: 297243 - RNA, 22 nt, Homo sapiens
ucugugguucaaaccagcaacu

SEQ ID NO: 297244 - RNA, 22 nt, Homo sapiens
ucugugguucaggcuggagugc

SEQ ID NO: 297245 - RNA, 22 nt, Homo sapiens
ucugugguucuagcuacuuugg

SEQ ID NO: 297246 - RNA, 22 nt, Homo sapiens
ucugugguuguugcauggaaug

SEQ ID NO: 297247 - RNA, 21 nt, Homo sapiens
ucuguguugaucucacuggga

SEQ ID NO: 297248 - RNA, 22 nt, Homo sapiens
ucuguguuugaucaagauugua

SEQ ID NO: 297249 - RNA, 22 nt, Homo sapiens
ucuuagguaagaaauuuuaaca

SEQ ID NO: 297250 - RNA, 22 nt, Homo sapiens
ucuuauuuggggaaaggguccu

SEQ ID NO: 297251 - RNA, 22 nt, Homo sapiens
ucuugcaccuacaugcuuuguc

SEQ ID NO: 297252 - RNA, 22 nt, Homo sapiens
ucuugcaguucccaaauucaca

SEQ ID NO: 297253 - RNA, 22 nt, Homo sapiens
ucuugcauuuuuaaauagugcu

SEQ ID NO: 297254 - RNA, 22 nt, Homo sapiens
ucuugccacuucauccccuuuc

SEQ ID NO: 297255 - RNA, 22 nt, Homo sapiens
ucuuggccaugaauggcaaggc

SEQ ID NO: 297256 - RNA, 22 nt, Homo sapiens
ucuuuaguaauuucuguaaggc

SEQ ID NO: 297257 - RNA, 19 nt, Homo sapiens
ucuuuagucacauuuuuau

SEQ ID NO: 297258 - RNA, 22 nt, Homo sapiens
ucuuuagugacaguugugcaag

SEQ ID NO: 297259 - RNA, 22 nt, Homo sapiens
ucuuuaguuaagggacauuuua

SEQ ID NO: 297260 - RNA, 15 nt, Homo sapiens
ucuuuaguuuuucuu

SEQ ID NO: 297261 - RNA, 20 nt, Homo sapiens
ucuuucgguuaccaggcagu

SEQ ID NO: 297262 - RNA, 22 nt, Homo sapiens
ucuuugagugcccugagucccu

SEQ ID NO: 297263 - RNA, 22 nt, Homo sapiens
ucuuugauuaugcagauggguu

SEQ ID NO: 297264 - RNA, 22 nt, Homo sapiens
ucuuugauuuuguuacuaagac

SEQ ID NO: 297265 - RNA, 22 nt, Homo sapiens
ucuuuggagacaaccccagucu

SEQ ID NO: 297266 - RNA, 22 nt, Homo sapiens
ucuuuggauggaaauuggaguc

SEQ ID NO: 297267 - RNA, 22 nt, Homo sapiens
ucuuugguaggaguaggaggcc

SEQ ID NO: 297268 - RNA, 22 nt, Homo sapiens
ucuuugguauugugaauagugu

SEQ ID NO: 297269 - RNA, 22 nt, Homo sapiens
ucuuugguauuuguggggaauu

SEQ ID NO: 297270 - RNA, 22 nt, Homo sapiens
ucuuuugggccucuugucagac

SEQ ID NO: 297271 - RNA, 22 nt, Homo sapiens
ugaaaaguuguugaaggcuuca

SEQ ID NO: 297272 - RNA, 22 nt, Homo sapiens
ugaaacacaccuccucuccauc

SEQ ID NO: 297273 - RNA, 20 nt, Homo sapiens
ugaaacacauggacuggggu

SEQ ID NO: 297274 - RNA, 22 nt, Homo sapiens
ugaaacugcagugggcuuggca

SEQ ID NO: 297275 - RNA, 22 nt, Homo sapiens
ugaaagacugaaagcuuuucuu

SEQ ID NO: 297276 - RNA, 22 nt, Homo sapiens
ugaaagcuacaggaaaguauuu

SEQ ID NO: 297277 - RNA, 22 nt, Homo sapiens
ugaaauacuuuggcucuuuguu

SEQ ID NO: 297278 - RNA, 22 nt, Homo sapiens
ugaaauaguuaaguugccuagu

SEQ ID NO: 297279 - RNA, 22 nt, Homo sapiens
ugaaaugaucaguuugguuacu

SEQ ID NO: 297280 - RNA, 22 nt, Homo sapiens
ugaaaugauuauaugguguuug

SEQ ID NO: 297281 - RNA, 22 nt, Homo sapiens
ugaaaugcagaacuuuaggucu

SEQ ID NO: 297282 - RNA, 22 nt, Homo sapiens
ugaaauggaaagaguguagacu

SEQ ID NO: 297283 - RNA, 22 nt, Homo sapiens
ugaaauggaagaagucccuuuu

SEQ ID NO: 297284 - RNA, 22 nt, Homo sapiens
uugcucaggcuggaguacaaug

SEQ ID NO: 297285 - RNA, 22 nt, Homo sapiens
uugcugagucuuucuagguugc

SEQ ID NO: 297286 - RNA, 22 nt, Homo sapiens
uuggaaagagguguuuaugacu

SEQ ID NO: 297287 - RNA, 22 nt, Homo sapiens
uuggaaaugguaaaggguuaau

SEQ ID NO: 297288 - RNA, 22 nt, Homo sapiens
uuggaaauguguuugcauucag

SEQ ID NO: 297289 - RNA, 22 nt, Homo sapiens
uuggaagacauucugucugcua

SEQ ID NO: 297290 - RNA, 22 nt, Homo sapiens
uuggaauuaaccuggugcugga

SEQ ID NO: 297291 - RNA, 22 nt, Homo sapiens
uuggaauuaagagauauuuucu

SEQ ID NO: 297292 - RNA, 22 nt, Homo sapiens
uuggaauuuuaaaauaggcaac

SEQ ID NO: 297293 - RNA, 22 nt, Homo sapiens
uuggacuuuaagauagagaugu

SEQ ID NO: 297294 - RNA, 22 nt, Homo sapiens
uuggagagagaggacucccggc

SEQ ID NO: 297295 - RNA, 22 nt, Homo sapiens
uuggagcacuggggcacugaca

SEQ ID NO: 297296 - RNA, 22 nt, Homo sapiens
uuggagucaucucuguacugua

SEQ ID NO: 297297 - RNA, 22 nt, Homo sapiens
uuggagugugucuuauuccauu

SEQ ID NO: 297298 - RNA, 22 nt, Homo sapiens
uuggaugauaaagaagccuaag

SEQ ID NO: 297299 - RNA, 22 nt, Homo sapiens
uuggcaaauagguuuuauugca

SEQ ID NO: 297300 - RNA, 22 nt, Homo sapiens
uuggcaagaauguaugccgauc

SEQ ID NO: 297301 - RNA, 22 nt, Homo sapiens
uuggcaauugcuaugauuugaa

SEQ ID NO: 297302 - RNA, 22 nt, Homo sapiens
uuggcacugggaaaaugaccac

SEQ ID NO: 297303 - RNA, 22 nt, Homo sapiens
uuggcagcauuccagccaagca

SEQ ID NO: 297304 - RNA, 20 nt, Homo sapiens
uuggcauuuagacaagaguu

SEQ ID NO: 297305 - RNA, 22 nt, Homo sapiens
uuggcauuuauucuaaggucaa

SEQ ID NO: 297306 - RNA, 22 nt, Homo sapiens
uuggccccucccaaauuucaug

SEQ ID NO: 297307 - RNA, 21 nt, Homo sapiens
uuggccuggaggccugaaugu

SEQ ID NO: 297308 - RNA, 22 nt, Homo sapiens
uuggcucuggcugggcuccagc

SEQ ID NO: 297309 - RNA, 22 nt, Homo sapiens
uugggcaauaggaagcaggugg

SEQ ID NO: 297310 - RNA, 22 nt, Homo sapiens
uugggcuugagggugcccaguc

SEQ ID NO: 297311 - RNA, 21 nt, Homo sapiens
uuggggaauggagagguuuuc

SEQ ID NO: 297312 - RNA, 22 nt, Homo sapiens
uuggggcacggccucuguugcc

SEQ ID NO: 297313 - RNA, 22 nt, Homo sapiens
uuggguagugaguuccuccagg

SEQ ID NO: 297314 - RNA, 22 nt, Homo sapiens
uugggucaguuccuugacuccu

SEQ ID NO: 297315 - RNA, 22 nt, Homo sapiens
uuggguccucugguccuugguu

SEQ ID NO: 297316 - RNA, 22 nt, Homo sapiens
uuggucaucucccuccuuuuag

SEQ ID NO: 297317 - RNA, 22 nt, Homo sapiens
uugguccccacuccccugccaa

SEQ ID NO: 297318 - RNA, 21 nt, Homo sapiens
uuggucuucucugugauucuu

SEQ ID NO: 297319 - RNA, 22 nt, Homo sapiens
uugguuauccugucgguaauuc

SEQ ID NO: 297320 - RNA, 22 nt, Homo sapiens
uugguucaguuuaacgaguaau

SEQ ID NO: 297321 - RNA, 22 nt, Homo sapiens
uugguucucuuuauaugcugga

SEQ ID NO: 297322 - RNA, 22 nt, Homo sapiens
uuguaaaguucucucccgaaaa

SEQ ID NO: 297323 - RNA, 22 nt, Homo sapiens
uuguaaaguucuuaggaagcuc

SEQ ID NO: 297324 - RNA, 22 nt, Homo sapiens
uuguaacucugaauacauccua

SEQ ID NO: 297325 - RNA, 23 nt, Homo sapiens
uuguaacuggagaguaacauucc

SEQ ID NO: 297326 - RNA, 22 nt, Homo sapiens
uuguacuagaaaauuauucuuu

SEQ ID NO: 297327 - RNA, 22 nt, Homo sapiens
uuguacuccagccugggugaca

SEQ ID NO: 297328 - RNA, 22 nt, Homo sapiens
uuguacuggguuuucuggaauu

SEQ ID NO: 297329 - RNA, 22 nt, Homo sapiens
uuguaguagucucguucuuuua

SEQ ID NO: 297330 - RNA, 22 nt, Homo sapiens
uuguauguuucugugcacauga

SEQ ID NO: 297331 - RNA, 22 nt, Homo sapiens
uuguauugucuugaugaguuga

SEQ ID NO: 297332 - RNA, 22 nt, Homo sapiens
uugucacuauaaauaagcauuu

SEQ ID NO: 297333 - RNA, 22 nt, Homo sapiens
uuguccacugcuagccucugca

SEQ ID NO: 297334 - RNA, 22 nt, Homo sapiens
uuguccauggacagcaccacag

SEQ ID NO: 297335 - RNA, 22 nt, Homo sapiens
uuguccccuuccaaaucucaug

SEQ ID NO: 297336 - RNA, 16 nt, Homo sapiens
uugucccuucccaaau

SEQ ID NO: 297337 - RNA, 22 nt, Homo sapiens
uuguccucuccaaaucucaugu

SEQ ID NO: 297338 - RNA, 22 nt, Homo sapiens
uugugaagaugugaagcaagca

SEQ ID NO: 297339 - RNA, 22 nt, Homo sapiens
uugugccacugaagcccuccag

SEQ ID NO: 297340 - RNA, 22 nt, Homo sapiens
uugugccauucuucugccucag

SEQ ID NO: 297341 - RNA, 22 nt, Homo sapiens
uugugcuuaauaaaaaguggua

SEQ ID NO: 297342 - RNA, 22 nt, Homo sapiens
uugugcuugcuguguucuaugc

SEQ ID NO: 297343 - RNA, 22 nt, Homo sapiens
uugugcuuguaacuacauucag

SEQ ID NO: 297344 - RNA, 22 nt, Homo sapiens
uugugcuuuacuuacuaccaga

SEQ ID NO: 297345 - RNA, 22 nt, Homo sapiens
uugugcuuuuuaaauagcuucc

SEQ ID NO: 297346 - RNA, 19 nt, Homo sapiens
uugugggaggacagagggg

SEQ ID NO: 297347 - RNA, 22 nt, Homo sapiens
uugugguaaucugugacagcag

SEQ ID NO: 297348 - RNA, 22 nt, Homo sapiens
uugugguaggcauguaagauga

SEQ ID NO: 297349 - RNA, 22 nt, Homo sapiens
uugugguugaugaagacugucu

SEQ ID NO: 297350 - RNA, 22 nt, Homo sapiens
uugugucaaauggcaauuagca

SEQ ID NO: 297351 - RNA, 19 nt, Homo sapiens
uuguguccccacaaaauuc

SEQ ID NO: 297352 - RNA, 22 nt, Homo sapiens
uuguguuugaugcugacacgca

SEQ ID NO: 297353 - RNA, 22 nt, Homo sapiens
uuguuauguuggucaguaaugu

SEQ ID NO: 297354 - RNA, 22 nt, Homo sapiens
uuuaaagcuccaagcaugucug

SEQ ID NO: 297355 - RNA, 22 nt, Homo sapiens
uuuaaggcaggucuggugguga

SEQ ID NO: 297356 - RNA, 22 nt, Homo sapiens
uuuaaggcaugccuguacaugc

SEQ ID NO: 297357 - RNA, 22 nt, Homo sapiens
uuuaaugcaucccaaaauguag

SEQ ID NO: 297358 - RNA, 22 nt, Homo sapiens
uuuaaugcgucucugaguuuug

SEQ ID NO: 297359 - RNA, 22 nt, Homo sapiens
uuuaaugcugcccagucauggg

SEQ ID NO: 297360 - RNA, 18 nt, Homo sapiens
uuuacaguagaaggacuu

SEQ ID NO: 297361 - RNA, 22 nt, Homo sapiens
uuuacagucucauagguggaag

SEQ ID NO: 297362 - RNA, 21 nt, Homo sapiens
uuuacuguggacccauugcuu

SEQ ID NO: 297363 - RNA, 19 nt, Homo sapiens
uuuagaucuuuuaugcagc

SEQ ID NO: 297364 - RNA, 22 nt, Homo sapiens
uuuagcgaaugcuugcuccugu

SEQ ID NO: 297365 - RNA, 22 nt, Homo sapiens
uuuaggcaauauauucaugucu

SEQ ID NO: 297366 - RNA, 22 nt, Homo sapiens
uuuaggcaugcaguucuauuua

SEQ ID NO: 297367 - RNA, 22 nt, Homo sapiens
uuuagguaauauuaaguagcug

SEQ ID NO: 297368 - RNA, 22 nt, Homo sapiens
uuuagguacgcaccggcucagu

SEQ ID NO: 297369 - RNA, 22 nt, Homo sapiens
uuuagguagucaaagguuaguc

SEQ ID NO: 297370 - RNA, 22 nt, Homo sapiens
uuuaguccucugaaaaucuaua

SEQ ID NO: 297371 - RNA, 22 nt, Homo sapiens
uuuagugcaucagacacccucu

SEQ ID NO: 297372 - RNA, 22 nt, Homo sapiens
uuuauucggcuaggagcuucgg

SEQ ID NO: 297373 - RNA, 21 nt, Homo sapiens
uuucacugugaguuuuucugu

SEQ ID NO: 297374 - RNA, 23 nt, Homo sapiens
uuucaggcaggugaaagaccagc

SEQ ID NO: 297375 - RNA, 23 nt, Homo sapiens
uuucaguaguuguauccuguugc

SEQ ID NO: 297376 - RNA, 22 nt, Homo sapiens
uuucauagccuuugucgucuga

SEQ ID NO: 297377 - RNA, 22 nt, Homo sapiens
uuucauaguuugcauagggcau

SEQ ID NO: 297378 - RNA, 22 nt, Homo sapiens
uuucauggaauauagucauuuu

SEQ ID NO: 297379 - RNA, 23 nt, Homo sapiens
uuucauggggauuuacucauucc

SEQ ID NO: 297380 - RNA, 22 nt, Homo sapiens
uuuccacauggacuuaccuucg

SEQ ID NO: 297381 - RNA, 22 nt, Homo sapiens
uuuccagguggccaacauuuua

SEQ ID NO: 297382 - RNA, 22 nt, Homo sapiens
uuuccauguuggugaaaugagg

SEQ ID NO: 297383 - RNA, 22 nt, Homo sapiens
uuucccauuguucugcucugug

SEQ ID NO: 297384 - RNA, 22 nt, Homo sapiens
uuuccuggagaaucuuaacaaa

SEQ ID NO: 297385 - RNA, 22 nt, Homo sapiens
uuucuacagugaacgauuucua

SEQ ID NO: 297386 - RNA, 22 nt, Homo sapiens
uuucugggggugcugauggaaa

SEQ ID NO: 297387 - RNA, 23 nt, Homo sapiens
uuucuugggcaugcuaugucagu

SEQ ID NO: 297388 - RNA, 22 nt, Homo sapiens
uuugaaaguaauuugguuggug

SEQ ID NO: 297389 - RNA, 22 nt, Homo sapiens
uuugaaugcaacaaaugcggga

SEQ ID NO: 297390 - RNA, 22 nt, Homo sapiens
uuugacacugggagugugggug

SEQ ID NO: 297391 - RNA, 22 nt, Homo sapiens
uuugacuguggagucgaugcuu

SEQ ID NO: 297392 - RNA, 22 nt, Homo sapiens
uuugagaaugcuaccagagaag

SEQ ID NO: 297393 - RNA, 22 nt, Homo sapiens
uuugagauaucuuccaucagua

SEQ ID NO: 297394 - RNA, 22 nt, Homo sapiens
uuugagcauggaaauggcauga

SEQ ID NO: 297395 - RNA, 22 nt, Homo sapiens
uuugagcuagagucucacucug

SEQ ID NO: 297396 - RNA, 22 nt, Homo sapiens
uuugcacuuuaauauaauguga

SEQ ID NO: 297397 - RNA, 22 nt, Homo sapiens
uuugcagugucagcuucugugu

SEQ ID NO: 297398 - RNA, 22 nt, Homo sapiens
uuugcaucuuagaaaguucucc

SEQ ID NO: 297399 - RNA, 22 nt, Homo sapiens
uuugccaaucagaggcaucuug

SEQ ID NO: 297400 - RNA, 18 nt, Homo sapiens
uuugccacuucccagaaa

SEQ ID NO: 297401 - RNA, 19 nt, Homo sapiens
uuugccuaggcacauggcc

SEQ ID NO: 297402 - RNA, 22 nt, Homo sapiens
uuugccuuugugauauggucua

SEQ ID NO: 297403 - RNA, 22 nt, Homo sapiens
uuugcugagucugacuucaugg

SEQ ID NO: 297404 - RNA, 22 nt, Homo sapiens
uuugcuugaggucuagcuaccc

SEQ ID NO: 297405 - RNA, 20 nt, Homo sapiens
uuuggcaauaggguuuuugu

SEQ ID NO: 297406 - RNA, 20 nt, Homo sapiens
uuuggcacugagugguauaa

SEQ ID NO: 297407 - RNA, 22 nt, Homo sapiens
uuuggcauuagauaauugugua

SEQ ID NO: 297408 - RNA, 21 nt, Homo sapiens
uuuggcauuaugucaccagag

SEQ ID NO: 297409 - RNA, 22 nt, Homo sapiens
uuuggcauuugaguuuguagga

SEQ ID NO: 297410 - RNA, 22 nt, Homo sapiens
uuuggccauguuggucaggcug

SEQ ID NO: 297411 - RNA, 22 nt, Homo sapiens
uuuggcccccagcucaggacau

SEQ ID NO: 297412 - RNA, 18 nt, Homo sapiens
uuuggcuguucaugacuc

SEQ ID NO: 297413 - RNA, 22 nt, Homo sapiens
uuuggcuuaagauugacugcaa

SEQ ID NO: 297414 - RNA, 21 nt, Homo sapiens
uuuggcuucucugcugcagcc

SEQ ID NO: 297415 - RNA, 22 nt, Homo sapiens
uuuggcuuuuguaauaacugcc

SEQ ID NO: 297416 - RNA, 22 nt, Homo sapiens
uuugggaaaugaaguugguaga

SEQ ID NO: 297417 - RNA, 22 nt, Homo sapiens
uuugguaauguuucauugcaga

SEQ ID NO: 297418 - RNA, 22 nt, Homo sapiens
uuuggucacugccgccgccagc

SEQ ID NO: 297419 - RNA, 22 nt, Homo sapiens
uuugguuuuuguuaucacucau

SEQ ID NO: 297420 - RNA, 22 nt, Homo sapiens
uuuguacacuguugguaggauu

SEQ ID NO: 297421 - RNA, 23 nt, Homo sapiens
uuuguacuaugucaguuuagaua

SEQ ID NO: 297422 - RNA, 22 nt, Homo sapiens
uuuguacugagccaagauggua

SEQ ID NO: 297423 - RNA, 19 nt, Homo sapiens
uuuguccugcccuuucuca

SEQ ID NO: 297424 - RNA, 22 nt, Homo sapiens
uuugugcuaacuuuaacucuua

SEQ ID NO: 297425 - RNA, 22 nt, Homo sapiens
uuugugcuauguuauauauucu

SEQ ID NO: 297426 - RNA, 22 nt, Homo sapiens
uuugugcuccuaugagaaucua

SEQ ID NO: 297427 - RNA, 22 nt, Homo sapiens
uuugugcuccucucaguaugug

SEQ ID NO: 297428 - RNA, 23 nt, Homo sapiens
uuuguguccccacccaaaucuca

SEQ ID NO: 297429 - RNA, 20 nt, Homo sapiens
uuuuagcacuuguuauggug

SEQ ID NO: 297430 - RNA, 20 nt, Homo sapiens
uuuuagcuuuuauugaaagc

SEQ ID NO: 297431 - RNA, 22 nt, Homo sapiens
uuuuaguggaauauuuacaguu

SEQ ID NO: 297432 - RNA, 22 nt, Homo sapiens
uuuuaguugcucagguauucuc

SEQ ID NO: 297433 - RNA, 22 nt, Homo sapiens
uuuuauguuuguucccugccaa

SEQ ID NO: 297434 - RNA, 22 nt, Homo sapiens
uuuucacggugucccagagagu

SEQ ID NO: 297435 - RNA, 22 nt, Homo sapiens
uuuucaguggccauaguggaga

SEQ ID NO: 297436 - RNA, 19 nt, Homo sapiens
uuuuccccuuucuuaagac

SEQ ID NO: 297437 - RNA, 20 nt, Homo sapiens
uuuugcacuccuacuaaggu

SEQ ID NO: 297438 - RNA, 22 nt, Homo sapiens
uuuugcacuguuuuaucugaca

SEQ ID NO: 297439 - RNA, 22 nt, Homo sapiens
uuuugcaggcauuggaaguuua

SEQ ID NO: 297440 - RNA, 22 nt, Homo sapiens
uuuugcucuugguaaugaaaga

SEQ ID NO: 297441 - RNA, 18 nt, Homo sapiens
uuuugcuuaacugcgcca

SEQ ID NO: 297442 - RNA, 22 nt, Homo sapiens
uuuugcuugugaauagccacau

SEQ ID NO: 297443 - RNA, 22 nt, Homo sapiens
uuuuggcacuuugucugauucu

SEQ ID NO: 297444 - RNA, 20 nt, Homo sapiens
uuuuggcuuaaagcagucug

SEQ ID NO: 297445 - RNA, 22 nt, Homo sapiens
uuuugggggugauucacacagu

SEQ ID NO: 297446 - RNA, 22 nt, Homo sapiens
uuuuggucuccaguuucugcug

SEQ ID NO: 297447 - RNA, 21 nt, Homo sapiens
uuuugugcaugugcagccugc

SEQ ID NO: 297448 - RNA, 22 nt, Homo sapiens
uuuuuauggccaauccucagaa

SEQ ID NO: 297449 - RNA, 22 nt, Homo sapiens
uuuuucacuuaaguuaggcuca

SEQ ID NO: 297450 - RNA, 22 nt, Homo sapiens
uuuuugaguaaauauaaauugu

SEQ ID NO: 297451 - RNA, 22 nt, Homo sapiens
uuuuuggaggagguuagaucau

SEQ ID NO: 297452 - RNA, 22 nt, Homo sapiens
uuuuugugguauauugcaacaa

SEQ ID NO: 297453 - RNA, 22 nt, Homo sapiens
uuuuuugguaauugaacaauga

SEQ ID NO: 297454 - RNA, 22 nt, Homo sapiens
aaaaggcuagcuaguaacagaa

SEQ ID NO: 297455 - RNA, 22 nt, Homo sapiens
aaaccaccauuacuuuugcacc

SEQ ID NO: 297456 - RNA, 18 nt, Homo sapiens
aaacugcuuccuuggccu

SEQ ID NO: 297457 - RNA, 22 nt, Homo sapiens
aaagcacuggagucaucaucua

SEQ ID NO: 297458 - RNA, 22 nt, Homo sapiens
aaaggcacugugacuuuauagg

SEQ ID NO: 297459 - RNA, 22 nt, Homo sapiens
aaagguaguacuucuagaaggg

SEQ ID NO: 297460 - RNA, 22 nt, Homo sapiens
aaagugcugagucuaggcgggg

SEQ ID NO: 297461 - RNA, 15 nt, Homo sapiens
aaauaugucaguucu

SEQ ID NO: 297462 - RNA, 22 nt, Homo sapiens
aaaucccuugcucucucagacc

SEQ ID NO: 297463 - RNA, 21 nt, Homo sapiens
aaaugcacauuacugcuggug

SEQ ID NO: 297464 - RNA, 22 nt, Homo sapiens
aaaugcaucauuaggugauuuu

SEQ ID NO: 297465 - RNA, 22 nt, Homo sapiens
aaaugcugucugugagccucau

SEQ ID NO: 297466 - RNA, 22 nt, Homo sapiens
aaaugcuuucuuggaccauuug

SEQ ID NO: 297467 - RNA, 22 nt, Homo sapiens
aaauggcaccggcucuucccuc

SEQ ID NO: 297468 - RNA, 22 nt, Homo sapiens
aaauugcacaaguggugauuug

SEQ ID NO: 297469 - RNA, 22 nt, Homo sapiens
aacaggguggugccugguccau

SEQ ID NO: 297470 - RNA, 22 nt, Homo sapiens
aacaggguguuugcaguuucuu

SEQ ID NO: 297471 - RNA, 21 nt, Homo sapiens
aacagugcuuaguagauguuc

SEQ ID NO: 297472 - RNA, 22 nt, Homo sapiens
aaccuacauucuuaacuguugc

SEQ ID NO: 297473 - RNA, 15 nt, Homo sapiens
aaccuggaggagcuu

SEQ ID NO: 297474 - RNA, 22 nt, Homo sapiens
aacugcacauauuuguaugggu

SEQ ID NO: 297475 - RNA, 22 nt, Homo sapiens
aacugcacuaggacagguuuuu

SEQ ID NO: 297476 - RNA, 22 nt, Homo sapiens
aacugcuguuuggguacuggug

SEQ ID NO: 297477 - RNA, 22 nt, Homo sapiens
aacuggccuggcgugcagaggg

SEQ ID NO: 297478 - RNA, 21 nt, Homo sapiens
aagaaagcuggacuugccgcu

SEQ ID NO: 297479 - RNA, 22 nt, Homo sapiens
aagagguagucugucccuuagc

SEQ ID NO: 297480 - RNA, 22 nt, Homo sapiens
aagagguuguaccuaaaguguu

SEQ ID NO: 297481 - RNA, 22 nt, Homo sapiens
aagagugucuuugugcuggccc

SEQ ID NO: 297482 - RNA, 22 nt, Homo sapiens
aagauauguuaguuauaaacuc

SEQ ID NO: 297483 - RNA, 22 nt, Homo sapiens
aagaugauguucuuuuucuuag

SEQ ID NO: 297484 - RNA, 22 nt, Homo sapiens
aagcaacacaucugccccgguu

SEQ ID NO: 297485 - RNA, 20 nt, Homo sapiens
aagcaagcauuugcaaucau

SEQ ID NO: 297486 - RNA, 22 nt, Homo sapiens
aagcacaauuucaccuucuugu

SEQ ID NO: 297487 - RNA, 22 nt, Homo sapiens
aagcaguguggacuaaugggaa

SEQ ID NO: 297488 - RNA, 22 nt, Homo sapiens
aagcaucauuuggaauuugaga

SEQ ID NO: 297489 - RNA, 22 nt, Homo sapiens
aaggauuguaacaccaagguua

SEQ ID NO: 297490 - RNA, 22 nt, Homo sapiens
aaggcucuuucaacguaaauua

SEQ ID NO: 297491 - RNA, 22 nt, Homo sapiens
aagguaguuuucuuuaaugcug

SEQ ID NO: 297492 - RNA, 22 nt, Homo sapiens
aagguucuugcuugcaugacug

SEQ ID NO: 297493 - RNA, 22 nt, Homo sapiens
aaguaaacauugagagacaaga

SEQ ID NO: 297494 - RNA, 22 nt, Homo sapiens
aaguaauggaguuauuuuauga

SEQ ID NO: 297495 - RNA, 22 nt, Homo sapiens
aaguagcuggaugcaguggcac

SEQ ID NO: 297496 - RNA, 19 nt, Homo sapiens
aaguaguugugacagaugc

SEQ ID NO: 297497 - RNA, 22 nt, Homo sapiens
aagugaguaauacgucaguugu

SEQ ID NO: 297498 - RNA, 22 nt, Homo sapiens
aagugcccuauuuggcccuuga

SEQ ID NO: 297499 - RNA, 22 nt, Homo sapiens
aagugcuguaugggagccuagg

SEQ ID NO: 297500 - RNA, 22 nt, Homo sapiens
aagugcuuuacacaugcaugau

SEQ ID NO: 297501 - RNA, 17 nt, Homo sapiens
aaguggcuuguucacca

SEQ ID NO: 297502 - RNA, 22 nt, Homo sapiens
aagugguguuugggagcuggac

SEQ ID NO: 297503 - RNA, 19 nt, Homo sapiens
aagugguuuaaacuuguau

SEQ ID NO: 297504 - RNA, 22 nt, Homo sapiens
aagugucagaguugcuaaugac

SEQ ID NO: 297505 - RNA, 22 nt, Homo sapiens
aagugucuuaccgggagggagu

SEQ ID NO: 297506 - RNA, 22 nt, Homo sapiens
aauaagaaguggaagggaccgg

SEQ ID NO: 297507 - RNA, 22 nt, Homo sapiens
aauaaguugagaugaggucaua

SEQ ID NO: 297508 - RNA, 22 nt, Homo sapiens
aauacuuccaaaucuagucauu

SEQ ID NO: 297509 - RNA, 22 nt, Homo sapiens
aauagcuguccuuagaagugug

SEQ ID NO: 297510 - RNA, 22 nt, Homo sapiens
aauauagcuauguacaugucca

SEQ ID NO: 297511 - RNA, 22 nt, Homo sapiens
aaucacacuugauguugagcaa

SEQ ID NO: 297512 - RNA, 21 nt, Homo sapiens
aaucacugucuguuuccccuu

SEQ ID NO: 297513 - RNA, 22 nt, Homo sapiens
aaucgcuuuugguaggcaagga

SEQ ID NO: 297514 - RNA, 22 nt, Homo sapiens
aaugcaagauguuaauuauagg

SEQ ID NO: 297515 - RNA, 22 nt, Homo sapiens
aauggcagaugaaauugucauu

SEQ ID NO: 297516 - RNA, 22 nt, Homo sapiens
aauggcuuucagcuuuucccca

SEQ ID NO: 297517 - RNA, 22 nt, Homo sapiens
aauggcuuuuaauauccauaau

SEQ ID NO: 297518 - RNA, 21 nt, Homo sapiens
aaugguguugccaacaaggug

SEQ ID NO: 297519 - RNA, 22 nt, Homo sapiens
aaugguguuuccguuaagcuga

SEQ ID NO: 297520 - RNA, 22 nt, Homo sapiens
aaugugcuucuggcugugguca

SEQ ID NO: 297521 - RNA, 23 nt, Homo sapiens
aauugcuuuugaggacuuaguug

SEQ ID NO: 297522 - RNA, 22 nt, Homo sapiens
aauugguuaagauaagaucaua

SEQ ID NO: 297523 - RNA, 22 nt, Homo sapiens
aauuguacucccauaauucccu

SEQ ID NO: 297524 - RNA, 22 nt, Homo sapiens
acacaaugguaaguguuugugu

SEQ ID NO: 297525 - RNA, 22 nt, Homo sapiens
acaccuguggucccaguaacuu

SEQ ID NO: 297526 - RNA, 22 nt, Homo sapiens
acacugcugaguaaauaauuuu

SEQ ID NO: 297527 - RNA, 22 nt, Homo sapiens
acacuuucuagacaagggaaua

SEQ ID NO: 297528 - RNA, 22 nt, Homo sapiens
acagcacugccaagugacccau

SEQ ID NO: 297529 - RNA, 22 nt, Homo sapiens
acaggagugggauuugaguccu

SEQ ID NO: 297530 - RNA, 22 nt, Homo sapiens
acaguacucugcucuuuugauu

SEQ ID NO: 297531 - RNA, 22 nt, Homo sapiens
acagucuggagaaugggugcuc

SEQ ID NO: 297532 - RNA, 18 nt, Homo sapiens
acagugcuggcaugagau

SEQ ID NO: 297533 - RNA, 22 nt, Homo sapiens
acagugcuuggcacacaguaau

SEQ ID NO: 297534 - RNA, 19 nt, Homo sapiens
acagugcuuugucagaagc

SEQ ID NO: 297535 - RNA, 23 nt, Homo sapiens
acaguggugugaucuuggcucag

SEQ ID NO: 297536 - RNA, 18 nt, Homo sapiens
acaguguguaaggguucu

SEQ ID NO: 297537 - RNA, 22 nt, Homo sapiens
acaguguguguguucaccuaga

SEQ ID NO: 297538 - RNA, 22 nt, Homo sapiens
acaguguuccuuuguugugacu

SEQ ID NO: 297539 - RNA, 22 nt, Homo sapiens
acaucacuguuugauugauuga

SEQ ID NO: 297540 - RNA, 18 nt, Homo sapiens
acaucccaugcuggggug

SEQ ID NO: 297541 - RNA, 22 nt, Homo sapiens
acaugagacuggguuuguaggg

SEQ ID NO: 297542 - RNA, 19 nt, Homo sapiens
acauggauuuugugcaaac

SEQ ID NO: 297543 - RNA, 22 nt, Homo sapiens
acauggcacugcgggcuucuug

SEQ ID NO: 297544 - RNA, 22 nt, Homo sapiens
acauucagcuguuguuucaaug

SEQ ID NO: 297545 - RNA, 18 nt, Homo sapiens
acauucagcuugaagaua

SEQ ID NO: 297546 - RNA, 22 nt, Homo sapiens
accaguguuuaccaaguagcau

SEQ ID NO: 297547 - RNA, 22 nt, Homo sapiens
accaugcaguccaauaugcaca

SEQ ID NO: 297548 - RNA, 22 nt, Homo sapiens
accauugcacuccagccuuggc

SEQ ID NO: 297549 - RNA, 22 nt, Homo sapiens
accauugcacuucagccuaggc

SEQ ID NO: 297550 - RNA, 22 nt, Homo sapiens
acccaguaacauaugggaggga

SEQ ID NO: 297551 - RNA, 17 nt, Homo sapiens
accccuaccucagaagc

SEQ ID NO: 297552 - RNA, 22 nt, Homo sapiens
acccucagaccaguuucccugg

SEQ ID NO: 297553 - RNA, 21 nt, Homo sapiens
acccucuaguuuucaacaggc

SEQ ID NO: 297554 - RNA, 22 nt, Homo sapiens
acuccacuuucaccacagcgga

SEQ ID NO: 297555 - RNA, 22 nt, Homo sapiens
acuccauuuggacucugggagg

SEQ ID NO: 297556 - RNA, 21 nt, Homo sapiens
acugagagaucuggggcacau

SEQ ID NO: 297557 - RNA, 22 nt, Homo sapiens
acugagaucuuuaaauaaauaa

SEQ ID NO: 297558 - RNA, 22 nt, Homo sapiens
acugagccuuuaaaugacuuca

SEQ ID NO: 297559 - RNA, 22 nt, Homo sapiens
acugcacuccagccugagccug

SEQ ID NO: 297560 - RNA, 22 nt, Homo sapiens
acugcacuccagccugcugaca

SEQ ID NO: 297561 - RNA, 22 nt, Homo sapiens
acugcacuccagccugcuggca

SEQ ID NO: 297562 - RNA, 22 nt, Homo sapiens
acugcacuccagccuggacgaa

SEQ ID NO: 297563 - RNA, 22 nt, Homo sapiens
acugcacuccagccuugugaca

SEQ ID NO: 297564 - RNA, 22 nt, Homo sapiens
acugcacuucagccuguugaca

SEQ ID NO: 297565 - RNA, 22 nt, Homo sapiens
acugcacuucagccuugugaca

SEQ ID NO: 297566 - RNA, 22 nt, Homo sapiens
acuugacacuuauauuacucac

SEQ ID NO: 297567 - RNA, 22 nt, Homo sapiens
agaaacauucucuugccuccuu

SEQ ID NO: 297568 - RNA, 22 nt, Homo sapiens
agaaaugcagcaugaggcggca

SEQ ID NO: 297569 - RNA, 22 nt, Homo sapiens
agaacuguccauucagcaugaa

SEQ ID NO: 297570 - RNA, 20 nt, Homo sapiens
agaagcauugcucucuucag

SEQ ID NO: 297571 - RNA, 22 nt, Homo sapiens
agaauaauguccccccaaggga

SEQ ID NO: 297572 - RNA, 22 nt, Homo sapiens
agaauacugucuauucauggua

SEQ ID NO: 297573 - RNA, 22 nt, Homo sapiens
agaaugucaguauuggcuaaaa

SEQ ID NO: 297574 - RNA, 22 nt, Homo sapiens
agacagcugggaaauggagugu

SEQ ID NO: 297575 - RNA, 20 nt, Homo sapiens
agacuagggagcagaaagcc

SEQ ID NO: 297576 - RNA, 22 nt, Homo sapiens
agagagcuuuaacuacccauuu

SEQ ID NO: 297577 - RNA, 22 nt, Homo sapiens
agagauacauucugagaagugc

SEQ ID NO: 297578 - RNA, 22 nt, Homo sapiens
agagcaaugacaugcuaugugg

SEQ ID NO: 297579 - RNA, 22 nt, Homo sapiens
agagcaauguuaucagucucug

SEQ ID NO: 297580 - RNA, 22 nt, Homo sapiens
agaguacaggcaaguuagucau

SEQ ID NO: 297581 - RNA, 20 nt, Homo sapiens
agaugcaugcacauaaacac

SEQ ID NO: 297582 - RNA, 22 nt, Homo sapiens
agaugcuguuaucaacuguagc

SEQ ID NO: 297583 - RNA, 22 nt, Homo sapiens
agauggguuuucacauguuggc

SEQ ID NO: 297584 - RNA, 22 nt, Homo sapiens
agauguuguucaucugauuguu

SEQ ID NO: 297585 - RNA, 22 nt, Homo sapiens
agcaacaucagcagcaggaaaa

SEQ ID NO: 297586 - RNA, 22 nt, Homo sapiens
agcaacauuguucauaauagcu

SEQ ID NO: 297587 - RNA, 22 nt, Homo sapiens
agcacacuggguggcuuaaaca

SEQ ID NO: 297588 - RNA, 22 nt, Homo sapiens
agcaccacaauuuccugccuaa

SEQ ID NO: 297589 - RNA, 22 nt, Homo sapiens
agcaccaccguugcucuauccc

SEQ ID NO: 297590 - RNA, 22 nt, Homo sapiens
agcaccagaaucugaguuauuc

SEQ ID NO: 297591 - RNA, 22 nt, Homo sapiens
agcaccauuuauugaaaagaca

SEQ ID NO: 297592 - RNA, 22 nt, Homo sapiens
agcagcauauuuuuauaaugua

SEQ ID NO: 297593 - RNA, 22 nt, Homo sapiens
agcagcaugaggggacuucugc

SEQ ID NO: 297594 - RNA, 22 nt, Homo sapiens
agcagcauggguauaaaucucc

SEQ ID NO: 297595 - RNA, 22 nt, Homo sapiens
agcagcuuugcauggccuguga

SEQ ID NO: 297596 - RNA, 21 nt, Homo sapiens
agccaguguuccuuguggcuc

SEQ ID NO: 297597 - RNA, 19 nt, Homo sapiens
agccaguuuucccagcacc

SEQ ID NO: 297598 - RNA, 22 nt, Homo sapiens
agcccauguggcugaggcuucu

SEQ ID NO: 297599 - RNA, 23 nt, Homo sapiens
agcuagagaggcuggggauacag

SEQ ID NO: 297600 - RNA, 22 nt, Homo sapiens
agcuaguguucaccagagguca

SEQ ID NO: 297601 - RNA, 22 nt, Homo sapiens
agcugcacaaauggaugugagg

SEQ ID NO: 297602 - RNA, 22 nt, Homo sapiens
agcugcauuuacuuuugcacaa

SEQ ID NO: 297603 - RNA, 22 nt, Homo sapiens
agcugccagucuuguaaggccu

SEQ ID NO: 297604 - RNA, 22 nt, Homo sapiens
agcuggauguggaugacccugu

SEQ ID NO: 297605 - RNA, 22 nt, Homo sapiens
agcugguauuuugucgaggacu

SEQ ID NO: 297606 - RNA, 21 nt, Homo sapiens
agcugguuuccacagugugcu

SEQ ID NO: 297607 - RNA, 22 nt, Homo sapiens
agcuuaugcuuggaagagauga

SEQ ID NO: 297608 - RNA, 18 nt, Homo sapiens
aggaaugguaauacuuca

SEQ ID NO: 297609 - RNA, 22 nt, Homo sapiens
aggacacugauguaugcugugg

SEQ ID NO: 297610 - RNA, 22 nt, Homo sapiens
aggagaauugguucuucuugau

SEQ ID NO: 297611 - RNA, 22 nt, Homo sapiens
aggagcuuuggggaaaacagau

SEQ ID NO: 297612 - RNA, 21 nt, Homo sapiens
aggcaaaugaagcagccgcuc

SEQ ID NO: 297613 - RNA, 22 nt, Homo sapiens
aggcaaaugccagcaaucacac

SEQ ID NO: 297614 - RNA, 22 nt, Homo sapiens
aggcaagagugacuacgugaaa

SEQ ID NO: 297615 - RNA, 22 nt, Homo sapiens
aggcacggugucucaugccugu

SEQ ID NO: 297616 - RNA, 22 nt, Homo sapiens
aggcagaugagguccucagcug

SEQ ID NO: 297617 - RNA, 22 nt, Homo sapiens
aggcagcuguuauauacugagu

SEQ ID NO: 297618 - RNA, 22 nt, Homo sapiens
aggcaugugugcagacugucug

SEQ ID NO: 297619 - RNA, 23 nt, Homo sapiens
aggcauuguacaguaauggaaaa

SEQ ID NO: 297620 - RNA, 22 nt, Homo sapiens
aggcuagaaucuuccaucuugg

SEQ ID NO: 297621 - RNA, 22 nt, Homo sapiens
aggcugguauuuacaaaagcuc

SEQ ID NO: 297622 - RNA, 22 nt, Homo sapiens
aggucccauguccucccugacc

SEQ ID NO: 297623 - RNA, 22 nt, Homo sapiens
aggugaaugcucacauucuaau

SEQ ID NO: 297624 - RNA, 22 nt, Homo sapiens
agguuaucccgcauuauuuggu

SEQ ID NO: 297625 - RNA, 22 nt, Homo sapiens
agguucccuuuuggccugggau

SEQ ID NO: 297626 - RNA, 22 nt, Homo sapiens
aguaacauuucuaguagagagu

SEQ ID NO: 297627 - RNA, 22 nt, Homo sapiens
aguaagauggcaacucuccaca

SEQ ID NO: 297628 - RNA, 22 nt, Homo sapiens
aguauuaggugaguguauuuca

SEQ ID NO: 297629 - RNA, 22 nt, Homo sapiens
agucaacaucaugaaguggaaa

SEQ ID NO: 297630 - RNA, 22 nt, Homo sapiens
agucacaugcauuuucuucaau

SEQ ID NO: 297631 - RNA, 22 nt, Homo sapiens
agugcaauggcgugaucuuggc

SEQ ID NO: 297632 - RNA, 22 nt, Homo sapiens
agugcaguggcucaaaaugccu

SEQ ID NO: 297633 - RNA, 22 nt, Homo sapiens
agugccuacuauguagaugcug

SEQ ID NO: 297634 - RNA, 22 nt, Homo sapiens
aguggcacaauuuugacucccc

SEQ ID NO: 297635 - RNA, 22 nt, Homo sapiens
aguggcacuauucucagaguca

SEQ ID NO: 297636 - RNA, 22 nt, Homo sapiens
agugucaggagacagguagcug

SEQ ID NO: 297637 - RNA, 22 nt, Homo sapiens
aguuccauuuauucucgucucu

SEQ ID NO: 297638 - RNA, 22 nt, Homo sapiens
auaaaguagaggugaggugcau

SEQ ID NO: 297639 - RNA, 19 nt, Homo sapiens
auaaaugccuacaagggug

SEQ ID NO: 297640 - RNA, 22 nt, Homo sapiens
auaaaugccuguuguuuuaagc

SEQ ID NO: 297641 - RNA, 22 nt, Homo sapiens
auaagaagugaaccagacgucu

SEQ ID NO: 297642 - RNA, 22 nt, Homo sapiens
auaauacugggaagaugagcau

SEQ ID NO: 297643 - RNA, 22 nt, Homo sapiens
auaauagcugaucauuuagaag

SEQ ID NO: 297644 - RNA, 22 nt, Homo sapiens
auaaucaugucugaaaccuuug

SEQ ID NO: 297645 - RNA, 22 nt, Homo sapiens
auaaugcuuuucuagguugcau

SEQ ID NO: 297646 - RNA, 22 nt, Homo sapiens
auacacuggagcaaaccuggag

SEQ ID NO: 297647 - RNA, 22 nt, Homo sapiens
auacaugugccauguucgugug

SEQ ID NO: 297648 - RNA, 22 nt, Homo sapiens
auacaugugugagcgaagaugu

SEQ ID NO: 297649 - RNA, 22 nt, Homo sapiens
auacauguucaagggcauauau

SEQ ID NO: 297650 - RNA, 22 nt, Homo sapiens
auacauguuucauguuggugug

SEQ ID NO: 297651 - RNA, 21 nt, Homo sapiens
auacuugagacuggguaauuu

SEQ ID NO: 297652 - RNA, 22 nt, Homo sapiens
auagaauguuugcgccagguga

SEQ ID NO: 297653 - RNA, 22 nt, Homo sapiens
auagaguuagaaagaaauguuu

SEQ ID NO: 297654 - RNA, 20 nt, Homo sapiens
auagcagcaugauuuauagu

SEQ ID NO: 297655 - RNA, 22 nt, Homo sapiens
auagcagcucacuuauuuaugg

SEQ ID NO: 297656 - RNA, 22 nt, Homo sapiens
auagcagugucccacuccuugg

SEQ ID NO: 297657 - RNA, 22 nt, Homo sapiens
auagcaucauuucuugaaaaga

SEQ ID NO: 297658 - RNA, 22 nt, Homo sapiens
auagccucauucuucagaugag

SEQ ID NO: 297659 - RNA, 22 nt, Homo sapiens
auagcucuugcuuacccacugu

SEQ ID NO: 297660 - RNA, 22 nt, Homo sapiens
auaggagugugcacagaguagg

SEQ ID NO: 297661 - RNA, 22 nt, Homo sapiens
auagugcuauggcagaccuuga

SEQ ID NO: 297662 - RNA, 23 nt, Homo sapiens
auauaguagaugugcaguaacau

SEQ ID NO: 297663 - RNA, 22 nt, Homo sapiens
auaucugcauugccauuuaugu

SEQ ID NO: 297664 - RNA, 22 nt, Homo sapiens
auaugcacaguggaguacuauu

SEQ ID NO: 297665 - RNA, 22 nt, Homo sapiens
auaugcacgugcauacacacuu

SEQ ID NO: 297666 - RNA, 22 nt, Homo sapiens
auaugcacuauacacacguaua

SEQ ID NO: 297667 - RNA, 22 nt, Homo sapiens
auaugcauguacccacacaggc

SEQ ID NO: 297668 - RNA, 22 nt, Homo sapiens
auaugugacuucaugcaaggcu

SEQ ID NO: 297669 - RNA, 22 nt, Homo sapiens
auauucaagugaggauggcuaa

SEQ ID NO: 297670 - RNA, 22 nt, Homo sapiens
auauuggccuaaaauucucuuu

SEQ ID NO: 297671 - RNA, 22 nt, Homo sapiens
auauuguacugcuacugguucu

SEQ ID NO: 297672 - RNA, 22 nt, Homo sapiens
aucaaaguaggcauauguuuuu

SEQ ID NO: 297673 - RNA, 22 nt, Homo sapiens
aucaaaguuucccagaaguugu

SEQ ID NO: 297674 - RNA, 22 nt, Homo sapiens
aucaaauugucauuuuaaggau

SEQ ID NO: 297675 - RNA, 22 nt, Homo sapiens
aucacacuguuauuuuaguuaa

SEQ ID NO: 297676 - RNA, 22 nt, Homo sapiens
aucacagaacuuugagcagaga

SEQ ID NO: 297677 - RNA, 20 nt, Homo sapiens
aucaccacagcucguucaug

SEQ ID NO: 297678 - RNA, 19 nt, Homo sapiens
aucaccagucuuuccacug

SEQ ID NO: 297679 - RNA, 22 nt, Homo sapiens
aucaccuggaggugaucacuug

SEQ ID NO: 297680 - RNA, 20 nt, Homo sapiens
aucacuggagaaggaaaccu

SEQ ID NO: 297681 - RNA, 22 nt, Homo sapiens
aucagaaucucuugagaguguu

SEQ ID NO: 297682 - RNA, 22 nt, Homo sapiens
aucagugcauguuuguugagcu

SEQ ID NO: 297683 - RNA, 22 nt, Homo sapiens
aucauggaguauuugcaagucu

SEQ ID NO: 297684 - RNA, 22 nt, Homo sapiens
auccacagugucaauguuguga

SEQ ID NO: 297685 - RNA, 22 nt, Homo sapiens
auccucugagagaguuucauaa

SEQ ID NO: 297686 - RNA, 22 nt, Homo sapiens
auccuguacuaagguuuuccca

SEQ ID NO: 297687 - RNA, 21 nt, Homo sapiens
auccuucuuuuucaaccugug

SEQ ID NO: 297688 - RNA, 22 nt, Homo sapiens
aucuaaaucucauaugggcaca

SEQ ID NO: 297689 - RNA, 22 nt, Homo sapiens
aucucaguuaauuccaucuuuc

SEQ ID NO: 297690 - RNA, 22 nt, Homo sapiens
aucuccaggugccagcugcgcc

SEQ ID NO: 297691 - RNA, 19 nt, Homo sapiens
aucuggaguuccuggggcu

SEQ ID NO: 297692 - RNA, 22 nt, Homo sapiens
aucuguguuuaaggucccagaa

SEQ ID NO: 297693 - RNA, 22 nt, Homo sapiens
aucuuuaguggcuguuuucaga

SEQ ID NO: 297694 - RNA, 22 nt, Homo sapiens
augaaaacaugauuugccuguu

SEQ ID NO: 297695 - RNA, 22 nt, Homo sapiens
augaaagugauaaaugucucua

SEQ ID NO: 297696 - RNA, 17 nt, Homo sapiens
augaacucaucauuuuu

SEQ ID NO: 297697 - RNA, 22 nt, Homo sapiens
augaagucguuacuaccaauug

SEQ ID NO: 297698 - RNA, 22 nt, Homo sapiens
augaauccauuccugccacaga

SEQ ID NO: 297699 - RNA, 21 nt, Homo sapiens
augaauguaaagaauguggga

SEQ ID NO: 297700 - RNA, 22 nt, Homo sapiens
augacagcaucugugaaguugu

SEQ ID NO: 297701 - RNA, 22 nt, Homo sapiens
augacauguauuuccaggauuu

SEQ ID NO: 297702 - RNA, 22 nt, Homo sapiens
augacauugaugcucuggcugg

SEQ ID NO: 297703 - RNA, 22 nt, Homo sapiens
augacuaaaggguuuauguuga

SEQ ID NO: 297704 - RNA, 22 nt, Homo sapiens
augagaugaggaauggcccucc

SEQ ID NO: 297705 - RNA, 22 nt, Homo sapiens
augagaugcaagauuagauggg

SEQ ID NO: 297706 - RNA, 22 nt, Homo sapiens
augaggaaggagccuuugucug

SEQ ID NO: 297707 - RNA, 22 nt, Homo sapiens
augauuguucucacucaagaga

SEQ ID NO: 297708 - RNA, 22 nt, Homo sapiens
augcacaugcgaaaacuugugu

SEQ ID NO: 297709 - RNA, 22 nt, Homo sapiens
augcacuguauaggaucuugcg

SEQ ID NO: 297710 - RNA, 22 nt, Homo sapiens
augccacugcacucuagccugg

SEQ ID NO: 297711 - RNA, 22 nt, Homo sapiens
augccacuguacucuagccuag

SEQ ID NO: 297712 - RNA, 22 nt, Homo sapiens
augccauugcacuccagccugg

SEQ ID NO: 297713 - RNA, 22 nt, Homo sapiens
augcuacugaccccuacuuaca

SEQ ID NO: 297714 - RNA, 22 nt, Homo sapiens
augcuacuggauuuguauaaau

SEQ ID NO: 297715 - RNA, 22 nt, Homo sapiens
augcuggugguucacaugcgca

SEQ ID NO: 297716 - RNA, 22 nt, Homo sapiens
augcuuguguuggggcagugga

SEQ ID NO: 297717 - RNA, 22 nt, Homo sapiens
auggaaagcuguuccuacacaa

SEQ ID NO: 297718 - RNA, 22 nt, Homo sapiens
auggaagacuccucuuugggua

SEQ ID NO: 297719 - RNA, 22 nt, Homo sapiens
auggaagucucuguuaaguuuc

SEQ ID NO: 297720 - RNA, 22 nt, Homo sapiens
auggcacugccuggcuucaugg

SEQ ID NO: 297721 - RNA, 22 nt, Homo sapiens
auggcacuguguauuuuucugu

SEQ ID NO: 297722 - RNA, 22 nt, Homo sapiens
auggcacuuuggacugcuagau

SEQ ID NO: 297723 - RNA, 22 nt, Homo sapiens
auggcagagucagaaagucagg

SEQ ID NO: 297724 - RNA, 22 nt, Homo sapiens
auggcuucuucuaaaagugggg

SEQ ID NO: 297725 - RNA, 22 nt, Homo sapiens
auggcuuguuaugcauuaguac

SEQ ID NO: 297726 - RNA, 22 nt, Homo sapiens
auggcuuugggcugcucugccc

SEQ ID NO: 297727 - RNA, 22 nt, Homo sapiens
auggcuuuuccugucuugcaug

SEQ ID NO: 297728 - RNA, 22 nt, Homo sapiens
auggcuuuuuucuugggcacuc

SEQ ID NO: 297729 - RNA, 22 nt, Homo sapiens
auggucccauucauucacguau

SEQ ID NO: 297730 - RNA, 22 nt, Homo sapiens
augguuuauuuguaagcagagu

SEQ ID NO: 297731 - RNA, 22 nt, Homo sapiens
auguaaacagaugugcagcuug

SEQ ID NO: 297732 - RNA, 22 nt, Homo sapiens
auguaaacuacagauuuugggu

SEQ ID NO: 297733 - RNA, 22 nt, Homo sapiens
auguaagugugcucaaauguua

SEQ ID NO: 297734 - RNA, 22 nt, Homo sapiens
auguaguagauauuuauggaaa

SEQ ID NO: 297735 - RNA, 22 nt, Homo sapiens
auguaguagcagaaaauauuuu

SEQ ID NO: 297736 - RNA, 22 nt, Homo sapiens
augucaaggugaagaaagauca

SEQ ID NO: 297737 - RNA, 22 nt, Homo sapiens
augucacugcacuccugccugg

SEQ ID NO: 297738 - RNA, 22 nt, Homo sapiens
auguccauggaaucuguagcaa

SEQ ID NO: 297739 - RNA, 22 nt, Homo sapiens
augugccaauuaggauuccaag

SEQ ID NO: 297740 - RNA, 22 nt, Homo sapiens
augugcuaguaucaaacgagac

SEQ ID NO: 297741 - RNA, 22 nt, Homo sapiens
augugcuuaaaaaugcagagaa

SEQ ID NO: 297742 - RNA, 22 nt, Homo sapiens
augugcuuuuggugagagauuu

SEQ ID NO: 297743 - RNA, 22 nt, Homo sapiens
auguggcauuucucauucauuu

SEQ ID NO: 297744 - RNA, 22 nt, Homo sapiens
augugguaggcccaugagucau

SEQ ID NO: 297745 - RNA, 19 nt, Homo sapiens
augugguuagcaugacugc

SEQ ID NO: 297746 - RNA, 23 nt, Homo sapiens
augugugcuuggagagcaggaug

SEQ ID NO: 297747 - RNA, 22 nt, Homo sapiens
auguugcaguuuaauuauccua

SEQ ID NO: 297748 - RNA, 23 nt, Homo sapiens
auuaagguuacuacaguaugagg

SEQ ID NO: 297749 - RNA, 22 nt, Homo sapiens
auuaaguuaggauuuugagaua

SEQ ID NO: 297750 - RNA, 22 nt, Homo sapiens
auuaauguaauuaguaaaguug

SEQ ID NO: 297751 - RNA, 22 nt, Homo sapiens
auuacacuuucuauucaaugag

SEQ ID NO: 297752 - RNA, 22 nt, Homo sapiens
auuacaugucuauccaugaaca

SEQ ID NO: 297753 - RNA, 22 nt, Homo sapiens
auuauaguguauacuugaaauu

SEQ ID NO: 297754 - RNA, 22 nt, Homo sapiens
auuauguuguauuuccuugcag

SEQ ID NO: 297755 - RNA, 22 nt, Homo sapiens
auucaaggacuggauugcggga

SEQ ID NO: 297756 - RNA, 22 nt, Homo sapiens
auucaagugaugcagcuguuuu

SEQ ID NO: 297757 - RNA, 22 nt, Homo sapiens
auucaagugaugugauucuucu

SEQ ID NO: 297758 - RNA, 22 nt, Homo sapiens
auucacagcuuuaaaaggcgug

SEQ ID NO: 297759 - RNA, 22 nt, Homo sapiens
auucagaggggcagcugucuug

SEQ ID NO: 297760 - RNA, 21 nt, Homo sapiens
auuccacuuuuccuucaggga

SEQ ID NO: 297761 - RNA, 22 nt, Homo sapiens
auucccuuggucaacggaugca

SEQ ID NO: 297762 - RNA, 22 nt, Homo sapiens
auugaacacagaguagcuuucc

SEQ ID NO: 297763 - RNA, 23 nt, Homo sapiens
auugaacacuuucauaugugagg

SEQ ID NO: 297764 - RNA, 22 nt, Homo sapiens
auugacacugauuuuucuuuaa

SEQ ID NO: 297765 - RNA, 22 nt, Homo sapiens
auugacuugauauauagcugau

SEQ ID NO: 297766 - RNA, 22 nt, Homo sapiens
auugcaacuuccgccuccuggg

SEQ ID NO: 297767 - RNA, 22 nt, Homo sapiens
auugcaaugggaaacuaugaaa

SEQ ID NO: 297768 - RNA, 22 nt, Homo sapiens
auugcaccacugcccuccagcc

SEQ ID NO: 297769 - RNA, 22 nt, Homo sapiens
auugccuaacauagauguucag

SEQ ID NO: 297770 - RNA, 22 nt, Homo sapiens
auugccuagccuggucucaaaa

SEQ ID NO: 297771 - RNA, 22 nt, Homo sapiens
auuggcaauggcaaagcagagu

SEQ ID NO: 297772 - RNA, 22 nt, Homo sapiens
auuggcagaaaucuuuauagua

SEQ ID NO: 297773 - RNA, 22 nt, Homo sapiens
auuggcuauuuggugagugauu

SEQ ID NO: 297774 - RNA, 21 nt, Homo sapiens
auuguauguaaaccaaaugag

SEQ ID NO: 297775 - RNA, 22 nt, Homo sapiens
auugucauuuauaacuguguag

SEQ ID NO: 297776 - RNA, 22 nt, Homo sapiens
auuuggcaacguagggaggcau

SEQ ID NO: 297777 - RNA, 22 nt, Homo sapiens
auuugguuauucaguuguucag

SEQ ID NO: 297778 - RNA, 22 nt, Homo sapiens
auuugucaauacacuucuucca

SEQ ID NO: 297779 - RNA, 18 nt, Homo sapiens
auuuuugcaguccacaug

SEQ ID NO: 297780 - RNA, 22 nt, Homo sapiens
auuuuugguugucagcacuagg

SEQ ID NO: 297781 - RNA, 22 nt, Homo sapiens
caaaagugauugcgguuuuugc

SEQ ID NO: 297782 - RNA, 22 nt, Homo sapiens
caaagugguuuauacaugauug

SEQ ID NO: 297783 - RNA, 19 nt, Homo sapiens
caaaguguucuucuuugcc

SEQ ID NO: 297784 - RNA, 22 nt, Homo sapiens
caaauccucaccucaucaugaa

SEQ ID NO: 297785 - RNA, 22 nt, Homo sapiens
caacagucagcccauccacaga

SEQ ID NO: 297786 - RNA, 22 nt, Homo sapiens
caacucuguaggauccaggugg

SEQ ID NO: 297787 - RNA, 22 nt, Homo sapiens
caaggaauucucaauagaguua

SEQ ID NO: 297788 - RNA, 22 nt, Homo sapiens
caagggguggaaaugguagugu

SEQ ID NO: 297789 - RNA, 22 nt, Homo sapiens
caauacuguuaccugaaauagg

SEQ ID NO: 297790 - RNA, 22 nt, Homo sapiens
caauggcaaugaaauagugaga

SEQ ID NO: 297791 - RNA, 21 nt, Homo sapiens
caauggcacgaucuuggcuca

SEQ ID NO: 297792 - RNA, 22 nt, Homo sapiens
cacaaugucuaagauguuucua

SEQ ID NO: 297793 - RNA, 22 nt, Homo sapiens
cacagagugagacccugucucu

SEQ ID NO: 297794 - RNA, 22 nt, Homo sapiens
cacagucuugcaauauugagau

SEQ ID NO: 297795 - RNA, 22 nt, Homo sapiens
cacagugaacaauauccucugu

SEQ ID NO: 297796 - RNA, 22 nt, Homo sapiens
cacaguguuccagcuauuugaa

SEQ ID NO: 297797 - RNA, 22 nt, Homo sapiens
cacauguucaggagcacuuaga

SEQ ID NO: 297798 - RNA, 22 nt, Homo sapiens
caccacagccauuauugucccc

SEQ ID NO: 297799 - RNA, 22 nt, Homo sapiens
cacccuugcagggacagcuuug

SEQ ID NO: 297800 - RNA, 19 nt, Homo sapiens
caccgccugcccccugcug

SEQ ID NO: 297801 - RNA, 22 nt, Homo sapiens
caccuguacauggcaguguccu

SEQ ID NO: 297802 - RNA, 22 nt, Homo sapiens
caccuguagucccagcugaggc

SEQ ID NO: 297803 - RNA, 22 nt, Homo sapiens
cacugcacuccaguuuggauga

SEQ ID NO: 297804 - RNA, 22 nt, Homo sapiens
cacugcauccuccauauccugg

SEQ ID NO: 297805 - RNA, 22 nt, Homo sapiens
cagagcacugauacuggguucu

SEQ ID NO: 297806 - RNA, 22 nt, Homo sapiens
cagauacuccuggucucaggag

SEQ ID NO: 297807 - RNA, 22 nt, Homo sapiens
caggcauuguccaugcugaagg

SEQ ID NO: 297808 - RNA, 22 nt, Homo sapiens
caggcuuuuccacacauggguu

SEQ ID NO: 297809 - RNA, 21 nt, Homo sapiens
cagguagugucugaagccaga

SEQ ID NO: 297810 - RNA, 22 nt, Homo sapiens
cagguaguguguagcacagcag

SEQ ID NO: 297811 - RNA, 22 nt, Homo sapiens
cagugcaugacuguauauuauc

SEQ ID NO: 297812 - RNA, 22 nt, Homo sapiens
cagugcuuguuauuguucuauu

SEQ ID NO: 297813 - RNA, 22 nt, Homo sapiens
cagugguuuucucaguucagca

SEQ ID NO: 297814 - RNA, 22 nt, Homo sapiens
caguuacuugacacaaccaauu

SEQ ID NO: 297815 - RNA, 22 nt, Homo sapiens
caguuacuuuugcaccaaccua

SEQ ID NO: 297816 - RNA, 22 nt, Homo sapiens
caucacauucugagauacugag

SEQ ID NO: 297817 - RNA, 20 nt, Homo sapiens
caucaccuggcaggauuugu

SEQ ID NO: 297818 - RNA, 22 nt, Homo sapiens
caucauugcacccuauagagaa

SEQ ID NO: 297819 - RNA, 22 nt, Homo sapiens
caucccugaaccccagaaaucu

SEQ ID NO: 297820 - RNA, 22 nt, Homo sapiens
caucgcacuccagcuugggcaa

SEQ ID NO: 297821 - RNA, 22 nt, Homo sapiens
caugauauugcagaauguuggu

SEQ ID NO: 297822 - RNA, 22 nt, Homo sapiens
caugccacuguggacaaagaca

SEQ ID NO: 297823 - RNA, 22 nt, Homo sapiens
cauggcacaucuuuucugacua

SEQ ID NO: 297824 - RNA, 22 nt, Homo sapiens
cauggcccugggcugggcgaac

SEQ ID NO: 297825 - RNA, 19 nt, Homo sapiens
cauggcuuauaauuuuaau

SEQ ID NO: 297826 - RNA, 22 nt, Homo sapiens
cauggcuuuauuuucagcuucu

SEQ ID NO: 297827 - RNA, 22 nt, Homo sapiens
cauguaguagaaggagccagac

SEQ ID NO: 297828 - RNA, 21 nt, Homo sapiens
caugucacugcacucuagccu

SEQ ID NO: 297829 - RNA, 22 nt, Homo sapiens
cauugcacuccagccugaggga

SEQ ID NO: 297830 - RNA, 22 nt, Homo sapiens
cauugcacuccagccuggcaac

SEQ ID NO: 297831 - RNA, 22 nt, Homo sapiens
cauugcacuccauccuuggcaa

SEQ ID NO: 297832 - RNA, 22 nt, Homo sapiens
cauugcacucuagccucggcaa

SEQ ID NO: 297833 - RNA, 22 nt, Homo sapiens
cauuuugguuaaauagguagcu

SEQ ID NO: 297834 - RNA, 22 nt, Homo sapiens
ccacaaccucaacagcaucuau

SEQ ID NO: 297835 - RNA, 22 nt, Homo sapiens
ccacaaccuccauauccugggu

SEQ ID NO: 297836 - RNA, 23 nt, Homo sapiens
ccacaaugguugaacuagauuac

SEQ ID NO: 297837 - RNA, 22 nt, Homo sapiens
ccagaguugccucagguuucug

SEQ ID NO: 297838 - RNA, 22 nt, Homo sapiens
ccagauguuuucauucagcaag

SEQ ID NO: 297839 - RNA, 22 nt, Homo sapiens
ccagugcauggaucccaggggg

SEQ ID NO: 297840 - RNA, 20 nt, Homo sapiens
ccaguguuauuuauguucua

SEQ ID NO: 297841 - RNA, 22 nt, Homo sapiens
ccaucccuuucugagcaguucc

SEQ ID NO: 297842 - RNA, 22 nt, Homo sapiens
ccauggcaauggucagucuauu

SEQ ID NO: 297843 - RNA, 22 nt, Homo sapiens
cccagagacagaaugauaaacu

SEQ ID NO: 297844 - RNA, 21 nt, Homo sapiens
cccagguucucugaggguaga

SEQ ID NO: 297845 - RNA, 22 nt, Homo sapiens
cccagugugcugggugacagcu

SEQ ID NO: 297846 - RNA, 22 nt, Homo sapiens
cccaguguuacgugacagccug

SEQ ID NO: 297847 - RNA, 22 nt, Homo sapiens
ccccuguaaacuggcuucccug

SEQ ID NO: 297848 - RNA, 22 nt, Homo sapiens
cccuaagacagugaggggugca

SEQ ID NO: 297849 - RNA, 19 nt, Homo sapiens
cccuggcacauggaaaaug

SEQ ID NO: 297850 - RNA, 21 nt, Homo sapiens
cccugguguuuggaguuugag

SEQ ID NO: 297851 - RNA, 22 nt, Homo sapiens
ccggguguuuuguucucucaga

SEQ ID NO: 297852 - RNA, 20 nt, Homo sapiens
ccuaguguucuuaggcugca

SEQ ID NO: 297853 - RNA, 19 nt, Homo sapiens
ccucaaguacuaauauguu

SEQ ID NO: 297854 - RNA, 22 nt, Homo sapiens
ccucuguaguccugcaagagga

SEQ ID NO: 297855 - RNA, 21 nt, Homo sapiens
ccugaagaagugaccucugag

SEQ ID NO: 297856 - RNA, 22 nt, Homo sapiens
ccugagaucauacuguuaguaa

SEQ ID NO: 297857 - RNA, 22 nt, Homo sapiens
ccugagguagaguuuauauuga

SEQ ID NO: 297858 - RNA, 22 nt, Homo sapiens
ccugcauugucaaggccaagcc

SEQ ID NO: 297859 - RNA, 19 nt, Homo sapiens
ccugcuguucuuuugcacc

SEQ ID NO: 297860 - RNA, 22 nt, Homo sapiens
ccugucuugauuaaauuacuua

SEQ ID NO: 297861 - RNA, 22 nt, Homo sapiens
ccuuuguuuaguugaauuguau

SEQ ID NO: 297862 - RNA, 22 nt, Homo sapiens
ccuuuuugaguugccagaguuc

SEQ ID NO: 297863 - RNA, 22 nt, Homo sapiens
cgccugagcugaggaagcugca

SEQ ID NO: 297864 - RNA, 22 nt, Homo sapiens
cggcaguggguaagccaagcuu

SEQ ID NO: 297865 - RNA, 22 nt, Homo sapiens
cggucacagugauucaaggguc

SEQ ID NO: 297866 - RNA, 22 nt, Homo sapiens
cuacaguguauuuauggagggu

SEQ ID NO: 297867 - RNA, 22 nt, Homo sapiens
cuacaguuauguuuuaaaugug

SEQ ID NO: 297868 - RNA, 22 nt, Homo sapiens
cuacauuguagguauucaaacu

SEQ ID NO: 297869 - RNA, 22 nt, Homo sapiens
cuagauuguuuccauaaugaca

SEQ ID NO: 297870 - RNA, 22 nt, Homo sapiens
cuaggaaguauguguuauugcu

SEQ ID NO: 297871 - RNA, 22 nt, Homo sapiens
cuagucacaggaguugaaggau

SEQ ID NO: 297872 - RNA, 18 nt, Homo sapiens
cuaugccacuuuauauca

SEQ ID NO: 297873 - RNA, 22 nt, Homo sapiens
cucacagucagaagggacuugc

SEQ ID NO: 297874 - RNA, 22 nt, Homo sapiens
cucacaguucuaaaggcaagaa

SEQ ID NO: 297875 - RNA, 20 nt, Homo sapiens
cucaccagguguaggcugag

SEQ ID NO: 297876 - RNA, 22 nt, Homo sapiens
cucagcuacuugggaagcugag

SEQ ID NO: 297877 - RNA, 22 nt, Homo sapiens
cucaguuuugccuuguuuaagg

SEQ ID NO: 297878 - RNA, 19 nt, Homo sapiens
cucauggagaaggagaaua

SEQ ID NO: 297879 - RNA, 22 nt, Homo sapiens
cucauugcaaucucugccuccc

SEQ ID NO: 297880 - RNA, 22 nt, Homo sapiens
cucauuggcuacugaggcuugu

SEQ ID NO: 297881 - RNA, 23 nt, Homo sapiens
cuccaugagccguccagggccug

SEQ ID NO: 297882 - RNA, 22 nt, Homo sapiens
cuccauuuaucugaaauuuuau

SEQ ID NO: 297883 - RNA, 22 nt, Homo sapiens
cuccauuuggaacagauguccu

SEQ ID NO: 297884 - RNA, 22 nt, Homo sapiens
cucccacccucauuuuuaggca

SEQ ID NO: 297885 - RNA, 20 nt, Homo sapiens
cucuaguaauaaaguuuccc

SEQ ID NO: 297886 - RNA, 22 nt, Homo sapiens
cucucugagccccagacaccuu

SEQ ID NO: 297887 - RNA, 22 nt, Homo sapiens
cucugagguuauucguaauauu

SEQ ID NO: 297888 - RNA, 22 nt, Homo sapiens
cucuuugcuucuggcaucauug

SEQ ID NO: 297889 - RNA, 22 nt, Homo sapiens
cugaaaguuauucaggggcaag

SEQ ID NO: 297890 - RNA, 22 nt, Homo sapiens
cugaaaugaauuauuuucuuuc

SEQ ID NO: 297891 - RNA, 22 nt, Homo sapiens
cugaaggcagguagaauagaga

SEQ ID NO: 297892 - RNA, 22 nt, Homo sapiens
cugaagugugaaagucuuuuuu

SEQ ID NO: 297893 - RNA, 22 nt, Homo sapiens
cugaaucauugcauuaucaagg

SEQ ID NO: 297894 - RNA, 22 nt, Homo sapiens
cugaauguuuucuucuauucug

SEQ ID NO: 297895 - RNA, 22 nt, Homo sapiens
cugacauuguugaucacagcca

SEQ ID NO: 297896 - RNA, 22 nt, Homo sapiens
cugacugaggaucaguucauca

SEQ ID NO: 297897 - RNA, 22 nt, Homo sapiens
cugacuuuagaacccaaaaagu

SEQ ID NO: 297898 - RNA, 22 nt, Homo sapiens
cugagaaugaugauuuccaguu

SEQ ID NO: 297899 - RNA, 22 nt, Homo sapiens
cugagauaggacucugcuggcu

SEQ ID NO: 297900 - RNA, 22 nt, Homo sapiens
cugagaucugaaccaggagugu

SEQ ID NO: 297901 - RNA, 22 nt, Homo sapiens
cugagauuaagauauugggagu

SEQ ID NO: 297902 - RNA, 22 nt, Homo sapiens
cugagcaaaaugaagacacgau

SEQ ID NO: 297903 - RNA, 22 nt, Homo sapiens
cugaggaaguucuuuaacaguu

SEQ ID NO: 297904 - RNA, 22 nt, Homo sapiens
cugagguaauuuguugccagua

SEQ ID NO: 297905 - RNA, 20 nt, Homo sapiens
cugaggugggagaaucgcuu

SEQ ID NO: 297906 - RNA, 22 nt, Homo sapiens
cugaggugggaggauuggcuug

SEQ ID NO: 297907 - RNA, 22 nt, Homo sapiens
cugagguuguucuucucagugg

SEQ ID NO: 297908 - RNA, 22 nt, Homo sapiens
cugauaaguuuuucuuuauaag

SEQ ID NO: 297909 - RNA, 22 nt, Homo sapiens
cugcaagaaucguaguauuuga

SEQ ID NO: 297910 - RNA, 22 nt, Homo sapiens
cugccacugacaccucaaggac

SEQ ID NO: 297911 - RNA, 20 nt, Homo sapiens
cugcuccccuacaaaucuca

SEQ ID NO: 297912 - RNA, 22 nt, Homo sapiens
cuggaaaguagacaaucuaaaa

SEQ ID NO: 297913 - RNA, 22 nt, Homo sapiens
cuggagauauuggaagaaagaa

SEQ ID NO: 297914 - RNA, 22 nt, Homo sapiens
cuggagauuaaccaauugccau

SEQ ID NO: 297915 - RNA, 20 nt, Homo sapiens
cuggaugucgaggcagaggu

SEQ ID NO: 297916 - RNA, 22 nt, Homo sapiens
cuggcaaaaagagggcaauaau

SEQ ID NO: 297917 - RNA, 22 nt, Homo sapiens
cuggcagucugccucuucacug

SEQ ID NO: 297918 - RNA, 22 nt, Homo sapiens
cuggcucugagguguuuagggc

SEQ ID NO: 297919 - RNA, 22 nt, Homo sapiens
cuggcugagugguaaguagagg

SEQ ID NO: 297920 - RNA, 22 nt, Homo sapiens
cugggauggaggagaauuagag

SEQ ID NO: 297921 - RNA, 22 nt, Homo sapiens
cuggucguuauuuaucuucuca

SEQ ID NO: 297922 - RNA, 22 nt, Homo sapiens
cugucucagugaauugguuuua

SEQ ID NO: 297923 - RNA, 22 nt, Homo sapiens
cugugauagguuagucaugaau

SEQ ID NO: 297924 - RNA, 22 nt, Homo sapiens
cugugcaugcgcggagcugaaa

SEQ ID NO: 297925 - RNA, 22 nt, Homo sapiens
cugugcauucuuaaaucaggaa

SEQ ID NO: 297926 - RNA, 22 nt, Homo sapiens
cugugcuaggcaaugugguaga

SEQ ID NO: 297927 - RNA, 22 nt, Homo sapiens
cugugguauuauuagaaauauc

SEQ ID NO: 297928 - RNA, 22 nt, Homo sapiens
cuguugguuaaauuccaugcag

SEQ ID NO: 297929 - RNA, 22 nt, Homo sapiens
cuguuugguuaucuuuuccugu

SEQ ID NO: 297930 - RNA, 22 nt, Homo sapiens
cuuccagcuggguucagucagu

SEQ ID NO: 297931 - RNA, 22 nt, Homo sapiens
cuuccugaguccugggcucaca

SEQ ID NO: 297932 - RNA, 18 nt, Homo sapiens
cuuccuuagucugguuaa

SEQ ID NO: 297933 - RNA, 22 nt, Homo sapiens
cuucuguuaguucugauaacuu

SEQ ID NO: 297934 - RNA, 19 nt, Homo sapiens
cuugccccauucauccucu

SEQ ID NO: 297935 - RNA, 22 nt, Homo sapiens
cuuggguaagucauuaaaauua

SEQ ID NO: 297936 - RNA, 17 nt, Homo sapiens
cuuguugugguaguuug

SEQ ID NO: 297937 - RNA, 22 nt, Homo sapiens
cuuuacacauccuaaccagugu

SEQ ID NO: 297938 - RNA, 22 nt, Homo sapiens
cuuuaguugucuccucaagggu

SEQ ID NO: 297939 - RNA, 22 nt, Homo sapiens
cuuuaugagguuggauggaucu

SEQ ID NO: 297940 - RNA, 22 nt, Homo sapiens
cuuugaugagaaaauacuuugu

SEQ ID NO: 297941 - RNA, 22 nt, Homo sapiens
cuuuggucaauugcugugggga

SEQ ID NO: 297942 - RNA, 22 nt, Homo sapiens
cuuuguguggacauuucaggca

SEQ ID NO: 297943 - RNA, 21 nt, Homo sapiens
cuuuugcacuccagccugggu

SEQ ID NO: 297944 - RNA, 22 nt, Homo sapiens
cuuuugcugggucagcgguggu

SEQ ID NO: 297945 - RNA, 22 nt, Homo sapiens
cuuuuggugguucugaugcagg

SEQ ID NO: 297946 - RNA, 22 nt, Homo sapiens
cuuuuggugugaagaagcucuu

SEQ ID NO: 297947 - RNA, 22 nt, Homo sapiens
cuuuugugauuccucaguuacu

SEQ ID NO: 297948 - RNA, 22 nt, Homo sapiens
cuuuugugauucuucaguugcu

SEQ ID NO: 297949 - RNA, 20 nt, Homo sapiens
cuuuuugcugugcugggagc

SEQ ID NO: 297950 - RNA, 22 nt, Homo sapiens
cuuuuugguagagcaggugugc

SEQ ID NO: 297951 - RNA, 22 nt, Homo sapiens
gaaagugcugcaaggccaugca

SEQ ID NO: 297952 - RNA, 22 nt, Homo sapiens
gaaaugcucagggguuuuccag

SEQ ID NO: 297953 - RNA, 22 nt, Homo sapiens
gaaauguauuaaugaguugaaa

SEQ ID NO: 297954 - RNA, 22 nt, Homo sapiens
gaaaugucugagauguggcuca

SEQ ID NO: 297955 - RNA, 22 nt, Homo sapiens
gaagaacuaggugagaucuaga

SEQ ID NO: 297956 - RNA, 22 nt, Homo sapiens
gaagcagcauucugguuuuugg

SEQ ID NO: 297957 - RNA, 22 nt, Homo sapiens
gaaggcaugcugcauggccaga

SEQ ID NO: 297958 - RNA, 23 nt, Homo sapiens
gaaguauagcaugcacauggaaa

SEQ ID NO: 297959 - RNA, 22 nt, Homo sapiens
gaauagugcugcaaugaacaua

SEQ ID NO: 297960 - RNA, 22 nt, Homo sapiens
gaaucacaguuauuagagcagc

SEQ ID NO: 297961 - RNA, 22 nt, Homo sapiens
gaaugaauguuuauccuuagau

SEQ ID NO: 297962 - RNA, 22 nt, Homo sapiens
gaaugauacuguuaacgaaaga

SEQ ID NO: 297963 - RNA, 21 nt, Homo sapiens
gaauggcaccauuagcauaua

SEQ ID NO: 297964 - RNA, 22 nt, Homo sapiens
gaauucugucgcuuacuagaug

SEQ ID NO: 297965 - RNA, 20 nt, Homo sapiens
gacaaaccuagaugguacag

SEQ ID NO: 297966 - RNA, 22 nt, Homo sapiens
gacagacacaauugauccauga

SEQ ID NO: 297967 - RNA, 20 nt, Homo sapiens
gacauagagacucucaaaaa

SEQ ID NO: 297968 - RNA, 22 nt, Homo sapiens
ggucacauuggacuaucaaguu

SEQ ID NO: 297969 - RNA, 19 nt, Homo sapiens
ggucagcaaagucuagcug

SEQ ID NO: 297970 - RNA, 22 nt, Homo sapiens
ggucauggagcuuuacuuuaug

SEQ ID NO: 297971 - RNA, 19 nt, Homo sapiens
ggucauggagguuguguga

SEQ ID NO: 297972 - RNA, 22 nt, Homo sapiens
ggugacagugguuaaaauuugu

SEQ ID NO: 297973 - RNA, 23 nt, Homo sapiens
ggugaggaguacagagucuucau

SEQ ID NO: 297974 - RNA, 22 nt, Homo sapiens
ggugagguaggaaaaguuagga

SEQ ID NO: 297975 - RNA, 22 nt, Homo sapiens
guaaauaccaguuucuggaaca

SEQ ID NO: 297976 - RNA, 22 nt, Homo sapiens
guaacacaugcugcucucuggu

SEQ ID NO: 297977 - RNA, 22 nt, Homo sapiens
guaacagucucaacaguggucu

SEQ ID NO: 297978 - RNA, 22 nt, Homo sapiens
guaauacuggacaggguaucag

SEQ ID NO: 297979 - RNA, 22 nt, Homo sapiens
guacaagugcaguuucguuaca

SEQ ID NO: 297980 - RNA, 22 nt, Homo sapiens
guagcagccacacuugauaacu

SEQ ID NO: 297981 - RNA, 22 nt, Homo sapiens
guaguuuaucagaaagaauagg

SEQ ID NO: 297982 - RNA, 22 nt, Homo sapiens
gucaaaugcacagaaccauuaa

SEQ ID NO: 297983 - RNA, 22 nt, Homo sapiens
gucaaguaaauguuaugguuau

SEQ ID NO: 297984 - RNA, 22 nt, Homo sapiens
gucacauugaugcccauggugg

SEQ ID NO: 297985 - RNA, 22 nt, Homo sapiens
gucaccauugagucauuuccuc

SEQ ID NO: 297986 - RNA, 22 nt, Homo sapiens
gucacggaauguaaguggaagu

SEQ ID NO: 297987 - RNA, 22 nt, Homo sapiens
gucagggagggauagaugauua

SEQ ID NO: 297988 - RNA, 22 nt, Homo sapiens
gucagucugucccugccuggcg

SEQ ID NO: 297989 - RNA, 22 nt, Homo sapiens
gucagugccugucccaggcuuu

SEQ ID NO: 297990 - RNA, 22 nt, Homo sapiens
gucauaugcucggaaaauguua

SEQ ID NO: 297991 - RNA, 22 nt, Homo sapiens
gucaugcaggguucgccagccc

SEQ ID NO: 297992 - RNA, 22 nt, Homo sapiens
gucauggaaaucuacauuguua

SEQ ID NO: 297993 - RNA, 21 nt, Homo sapiens
guccaaaacaguguccaaugc

SEQ ID NO: 297994 - RNA, 22 nt, Homo sapiens
guccaaauccaugggauguaca

SEQ ID NO: 297995 - RNA, 20 nt, Homo sapiens
guccauuugcugccauugcu

SEQ ID NO: 297996 - RNA, 18 nt, Homo sapiens
guccauuuguugguacac

SEQ ID NO: 297997 - RNA, 22 nt, Homo sapiens
guccauuuguuuccagagcacu

SEQ ID NO: 297998 - RNA, 22 nt, Homo sapiens
gucccaguggaaccuccaagcu

SEQ ID NO: 297999 - RNA, 22 nt, Homo sapiens
gucucauugcaguuagaccugu

SEQ ID NO: 298000 - RNA, 22 nt, Homo sapiens
gucucugguugcuuuuguacca

SEQ ID NO: 298001 - RNA, 22 nt, Homo sapiens
gucugguuuuuuauauccucac

SEQ ID NO: 298002 - RNA, 22 nt, Homo sapiens
gucuugaaggcugaguaccugu

SEQ ID NO: 298003 - RNA, 22 nt, Homo sapiens
gucuugcacuuaccuaagaacu

SEQ ID NO: 298004 - RNA, 22 nt, Homo sapiens
gucuuugcuuuuaaccagaggu

SEQ ID NO: 298005 - RNA, 22 nt, Homo sapiens
gucuuuguuuggucuguaucag

SEQ ID NO: 298006 - RNA, 22 nt, Homo sapiens
gucuuuugcuagccagagagcu

SEQ ID NO: 298007 - RNA, 22 nt, Homo sapiens
gugaauugagagaacuguguua

SEQ ID NO: 298008 - RNA, 22 nt, Homo sapiens
gugagauggagucuugcuuugu

SEQ ID NO: 298009 - RNA, 22 nt, Homo sapiens
gugagcauauuaguauugcacu

SEQ ID NO: 298010 - RNA, 22 nt, Homo sapiens
gugaguaaagguucauugaauu

SEQ ID NO: 298011 - RNA, 22 nt, Homo sapiens
gugagucaugucccaucugauu

SEQ ID NO: 298012 - RNA, 22 nt, Homo sapiens
gugcaaugaguguggcaaagcc

SEQ ID NO: 298013 - RNA, 22 nt, Homo sapiens
gugcaauguuaauuacuugacu

SEQ ID NO: 298014 - RNA, 22 nt, Homo sapiens
gugcacaaaucuuaaauguaca

SEQ ID NO: 298015 - RNA, 22 nt, Homo sapiens
guggaaaaguaguugcgguuuu

SEQ ID NO: 298016 - RNA, 22 nt, Homo sapiens
guggaaggucaugaauguucuu

SEQ ID NO: 298017 - RNA, 22 nt, Homo sapiens
guggaaguguaaaagcucuugg

SEQ ID NO: 298018 - RNA, 22 nt, Homo sapiens
guggaaguuaagugacuuucug

SEQ ID NO: 298019 - RNA, 22 nt, Homo sapiens
guggaaugauaucucauugugg

SEQ ID NO: 298020 - RNA, 22 nt, Homo sapiens
guggaauuauagagacaucuug

SEQ ID NO: 298021 - RNA, 22 nt, Homo sapiens
guggaggagaaagaagcauuuc

SEQ ID NO: 298022 - RNA, 22 nt, Homo sapiens
guggcagaaaagagaagcaaug

SEQ ID NO: 298023 - RNA, 22 nt, Homo sapiens
guggcagaacagguaggguucu

SEQ ID NO: 298024 - RNA, 22 nt, Homo sapiens
guggcagagucagagggaaaug

SEQ ID NO: 298025 - RNA, 22 nt, Homo sapiens
guggcaugaaagcagauaccac

SEQ ID NO: 298026 - RNA, 22 nt, Homo sapiens
guggcaugaaagcaucugugau

SEQ ID NO: 298027 - RNA, 22 nt, Homo sapiens
guggcauuucccaaaguauucu

SEQ ID NO: 298028 - RNA, 22 nt, Homo sapiens
gugguagaaaguaccaaacuag

SEQ ID NO: 298029 - RNA, 22 nt, Homo sapiens
gugguucuaaaccuuuuuuggu

SEQ ID NO: 298030 - RNA, 21 nt, Homo sapiens
gugguucuagagaaacagaau

SEQ ID NO: 298031 - RNA, 22 nt, Homo sapiens
gugguuuuaucccagaaauuaa

SEQ ID NO: 298032 - RNA, 22 nt, Homo sapiens
gugguuuucaacuccaccugca

SEQ ID NO: 298033 - RNA, 22 nt, Homo sapiens
gugguuuuuagauuucuacagu

SEQ ID NO: 298034 - RNA, 22 nt, Homo sapiens
guguaaaucaaucuguugucuu

SEQ ID NO: 298035 - RNA, 21 nt, Homo sapiens
gugucacagacaugacagaug

SEQ ID NO: 298036 - RNA, 22 nt, Homo sapiens
gugucaguggggagugaucuuc

SEQ ID NO: 298037 - RNA, 18 nt, Homo sapiens
gugucugguuaugggagu

SEQ ID NO: 298038 - RNA, 22 nt, Homo sapiens
gugugcaaauguguaccuacau

SEQ ID NO: 298039 - RNA, 21 nt, Homo sapiens
gugugcuugagugaugggauu

SEQ ID NO: 298040 - RNA, 22 nt, Homo sapiens
guguucaaacccaggucugucu

SEQ ID NO: 298041 - RNA, 22 nt, Homo sapiens
guuagaugaagaccaagggcaa

SEQ ID NO: 298042 - RNA, 22 nt, Homo sapiens
guuauauguuuggaaugaggaa

SEQ ID NO: 298043 - RNA, 20 nt, Homo sapiens
guucacaggcuuccuuucag

SEQ ID NO: 298044 - RNA, 22 nt, Homo sapiens
guucacagugguugccuuccag

SEQ ID NO: 298045 - RNA, 22 nt, Homo sapiens
guucaucagggauauuggcuua

SEQ ID NO: 298046 - RNA, 22 nt, Homo sapiens
guucccaguugaaaugauuagu

SEQ ID NO: 298047 - RNA, 22 nt, Homo sapiens
guucuggagauaaagccaaggu

SEQ ID NO: 298048 - RNA, 19 nt, Homo sapiens
guugacacuggcucuucag

SEQ ID NO: 298049 - RNA, 22 nt, Homo sapiens
guugcccuuagcacuucagccu

SEQ ID NO: 298050 - RNA, 22 nt, Homo sapiens
guugcucaggcugaagugcagu

SEQ ID NO: 298051 - RNA, 22 nt, Homo sapiens
guugcugagucccaucaccaga

SEQ ID NO: 298052 - RNA, 22 nt, Homo sapiens
guuggaauguauugcuacuucu

SEQ ID NO: 298053 - RNA, 22 nt, Homo sapiens
guuggcuuuuuaaggaaauugc

SEQ ID NO: 298054 - RNA, 22 nt, Homo sapiens
guuugugcuccuaugagaaccu

SEQ ID NO: 298055 - RNA, 22 nt, Homo sapiens
guuuugguuauauggaucaguu

SEQ ID NO: 298056 - RNA, 22 nt, Homo sapiens
guuuuuggggucacuauuaccg

SEQ ID NO: 298057 - RNA, 22 nt, Homo sapiens
uaaacugucuugcaguuacaug

SEQ ID NO: 298058 - RNA, 22 nt, Homo sapiens
uaaacugucuuuggagcuuugc

SEQ ID NO: 298059 - RNA, 22 nt, Homo sapiens
uaaagaugcugggaaggcuagg

SEQ ID NO: 298060 - RNA, 22 nt, Homo sapiens
uaaagcacuuuuuucugcaugg

SEQ ID NO: 298061 - RNA, 22 nt, Homo sapiens
uaaagcauguaauuagguuaga

SEQ ID NO: 298062 - RNA, 22 nt, Homo sapiens
uaaagccauugucaaguuugua

SEQ ID NO: 298063 - RNA, 22 nt, Homo sapiens
uaaagcuaucacauuggugauu

SEQ ID NO: 298064 - RNA, 22 nt, Homo sapiens
uaaagcuaugagaacaccguag

SEQ ID NO: 298065 - RNA, 18 nt, Homo sapiens
uaaaggcacuguguuguu

SEQ ID NO: 298066 - RNA, 21 nt, Homo sapiens
uaaaggcuccaauuauacccc

SEQ ID NO: 298067 - RNA, 22 nt, Homo sapiens
uaacagucuccucaagguguug

SEQ ID NO: 298068 - RNA, 22 nt, Homo sapiens
uaacauucacaugcugcaaaaa

SEQ ID NO: 298069 - RNA, 23 nt, Homo sapiens
uaacauugcaugauuaccugcau

SEQ ID NO: 298070 - RNA, 22 nt, Homo sapiens
uaacuacuucugcuucagagua

SEQ ID NO: 298071 - RNA, 22 nt, Homo sapiens
ugagaaugaugauuuccaguuu

SEQ ID NO: 298072 - RNA, 22 nt, Homo sapiens
ugagacauacuuacaggggaug

SEQ ID NO: 298073 - RNA, 22 nt, Homo sapiens
ugagacauauuauacugcuuuu

SEQ ID NO: 298074 - RNA, 22 nt, Homo sapiens
ugagacaucucuccugagacag

SEQ ID NO: 298075 - RNA, 22 nt, Homo sapiens
ugagacugagucucccucuguc

SEQ ID NO: 298076 - RNA, 22 nt, Homo sapiens
ugagauaacuaaaaacauuuug

SEQ ID NO: 298077 - RNA, 22 nt, Homo sapiens
ugagauagaaaacauaggagaa

SEQ ID NO: 298078 - RNA, 22 nt, Homo sapiens
ugagaucuguaaagucugacau

SEQ ID NO: 298079 - RNA, 22 nt, Homo sapiens
ugagaucuuugcuguccucacc

SEQ ID NO: 298080 - RNA, 22 nt, Homo sapiens
ugagaugaagucucacucuguc

SEQ ID NO: 298081 - RNA, 22 nt, Homo sapiens
ugagaugagagaaugcuugccu

SEQ ID NO: 298082 - RNA, 22 nt, Homo sapiens
ugagaugaggucucgcucuguc

SEQ ID NO: 298083 - RNA, 22 nt, Homo sapiens
ugagaugaucaaaguauaggcu

SEQ ID NO: 298084 - RNA, 22 nt, Homo sapiens
ugagaugcauauucuggcuccu

SEQ ID NO: 298085 - RNA, 20 nt, Homo sapiens
ugagaugcauugggauguuu

SEQ ID NO: 298086 - RNA, 22 nt, Homo sapiens
ugagauggaguuucgcccuugu

SEQ ID NO: 298087 - RNA, 22 nt, Homo sapiens
ugagauggaucuuggauuugaa

SEQ ID NO: 298088 - RNA, 22 nt, Homo sapiens
ugagauggcuuuauugcugaau

SEQ ID NO: 298089 - RNA, 22 nt, Homo sapiens
ugagauguugcucugaaacaag

SEQ ID NO: 298090 - RNA, 22 nt, Homo sapiens
ugagcagaaagcugcaaggucg

SEQ ID NO: 298091 - RNA, 20 nt, Homo sapiens
ugagcucaauuguugcaagu

SEQ ID NO: 298092 - RNA, 22 nt, Homo sapiens
ugaggcaaggcugaaugaaggc

SEQ ID NO: 298093 - RNA, 22 nt, Homo sapiens
ugaggcuaggauaggcugauuc

SEQ ID NO: 298094 - RNA, 22 nt, Homo sapiens
ugagguagaaugauucuaauau

SEQ ID NO: 298095 - RNA, 22 nt, Homo sapiens
ugagguagguaccauuaucacu

SEQ ID NO: 298096 - RNA, 20 nt, Homo sapiens
ugaggucaggaguuacagac

SEQ ID NO: 298097 - RNA, 22 nt, Homo sapiens
ugagguguauugggggaaauuc

SEQ ID NO: 298098 - RNA, 22 nt, Homo sapiens
ugaguagaacaucaagucauac

SEQ ID NO: 298099 - RNA, 22 nt, Homo sapiens
ugaguagaacuccuggagaugu

SEQ ID NO: 298100 - RNA, 22 nt, Homo sapiens
ugaguagagaauucagcuaagg

SEQ ID NO: 298101 - RNA, 22 nt, Homo sapiens
ugaguagucagugggcaggaag

SEQ ID NO: 298102 - RNA, 20 nt, Homo sapiens
ugaguuccuuguucagaagc

SEQ ID NO: 298103 - RNA, 22 nt, Homo sapiens
ugauaagugaaagugcucuauc

SEQ ID NO: 298104 - RNA, 22 nt, Homo sapiens
ugauacuggcuucauagaauga

SEQ ID NO: 298105 - RNA, 22 nt, Homo sapiens
ugauauauugaaugaugaaaca

SEQ ID NO: 298106 - RNA, 22 nt, Homo sapiens
ugauaugugaguauaugguuau

SEQ ID NO: 298107 - RNA, 22 nt, Homo sapiens
ugauauguguaaacaauguaua

SEQ ID NO: 298108 - RNA, 22 nt, Homo sapiens
ugauccagugcucaguuggagu

SEQ ID NO: 298109 - RNA, 22 nt, Homo sapiens
ugauguguuuuguaguucaacu

SEQ ID NO: 298110 - RNA, 22 nt, Homo sapiens
ugauucccucaagugccuuaug

SEQ ID NO: 298111 - RNA, 22 nt, Homo sapiens
ugauuggagaacaaacugcaua

SEQ ID NO: 298112 - RNA, 22 nt, Homo sapiens
ugcaaauguuaggugucauuau

SEQ ID NO: 298113 - RNA, 22 nt, Homo sapiens
ugcaaugugaaauaagcacauc

SEQ ID NO: 298114 - RNA, 17 nt, Homo sapiens
ugcaauuuaagcuagau

SEQ ID NO: 298115 - RNA, 22 nt, Homo sapiens
ugcacacucuguaugagaaucu

SEQ ID NO: 298116 - RNA, 22 nt, Homo sapiens
ugcaccacugcacuccacccug

SEQ ID NO: 298117 - RNA, 22 nt, Homo sapiens
ugcaccacugcacuccaggcug

SEQ ID NO: 298118 - RNA, 18 nt, Homo sapiens
ugcaccaguuuacacuuc

SEQ ID NO: 298119 - RNA, 22 nt, Homo sapiens
ugcacugucuugucgcauagca

SEQ ID NO: 298120 - RNA, 22 nt, Homo sapiens
ugcagagucuguccugccugcc

SEQ ID NO: 298121 - RNA, 20 nt, Homo sapiens
ugcagcacgggcccuuucca

SEQ ID NO: 298122 - RNA, 22 nt, Homo sapiens
ugcagcacugaacuucugggcu

SEQ ID NO: 298123 - RNA, 20 nt, Homo sapiens
ugcagcacugggaaugcagu

SEQ ID NO: 298124 - RNA, 18 nt, Homo sapiens
ugcagcuuugugauuggc

SEQ ID NO: 298125 - RNA, 22 nt, Homo sapiens
ugcauaugucuuuauagcagca

SEQ ID NO: 298126 - RNA, 22 nt, Homo sapiens
ugcauauguucaaaguauucug

SEQ ID NO: 298127 - RNA, 22 nt, Homo sapiens
ugcauggauguuugaacacacu

SEQ ID NO: 298128 - RNA, 22 nt, Homo sapiens
ugcauguucuuacucauacaug

SEQ ID NO: 298129 - RNA, 22 nt, Homo sapiens
ugccaacugguuucuuuuaguu

SEQ ID NO: 298130 - RNA, 19 nt, Homo sapiens
ugccaagaaagucagcuua

SEQ ID NO: 298131 - RNA, 20 nt, Homo sapiens
ugccaagaaaugaggguauu

SEQ ID NO: 298132 - RNA, 22 nt, Homo sapiens
ugccagagacguagggaauauu

SEQ ID NO: 298133 - RNA, 22 nt, Homo sapiens
ugccaguauuuuauugagcauu

SEQ ID NO: 298134 - RNA, 22 nt, Homo sapiens
ugccaugaaguaauggcaaaaa

SEQ ID NO: 298135 - RNA, 19 nt, Homo sapiens
ugccauguagcacaugguc

SEQ ID NO: 298136 - RNA, 22 nt, Homo sapiens
ugccuacuuugcaucugucagg

SEQ ID NO: 298137 - RNA, 22 nt, Homo sapiens
ugccuaggcccaguccucagaa

SEQ ID NO: 298138 - RNA, 22 nt, Homo sapiens
ugccugagccagguuuuaggag

SEQ ID NO: 298139 - RNA, 22 nt, Homo sapiens
ugccuuauuccaacugagcucu

SEQ ID NO: 298140 - RNA, 21 nt, Homo sapiens
ugcuauguuguccaggcuggc

SEQ ID NO: 298141 - RNA, 23 nt, Homo sapiens
ugcuccccucauggaugaauaaa

SEQ ID NO: 298142 - RNA, 22 nt, Homo sapiens
ugcugcacuuauggcucugagg

SEQ ID NO: 298143 - RNA, 22 nt, Homo sapiens
ugcuggugauuaaauccugaag

SEQ ID NO: 298144 - RNA, 22 nt, Homo sapiens
ugcugguguuuaggaauaagaa

SEQ ID NO: 298145 - RNA, 22 nt, Homo sapiens
ugcuuaguuguauguuccacau

SEQ ID NO: 298146 - RNA, 23 nt, Homo sapiens
uggaagacuccucucuuggcugc

SEQ ID NO: 298147 - RNA, 22 nt, Homo sapiens
uggaagcaugcaaucugugggg

SEQ ID NO: 298148 - RNA, 22 nt, Homo sapiens
uggaagucaugcugcaagaaca

SEQ ID NO: 298149 - RNA, 22 nt, Homo sapiens
uggaagucuauggcauuugagu

SEQ ID NO: 298150 - RNA, 22 nt, Homo sapiens
uggaaguuaaaugacucuuucu

SEQ ID NO: 298151 - RNA, 20 nt, Homo sapiens
uggaaugcagccuccuucug

SEQ ID NO: 298152 - RNA, 22 nt, Homo sapiens
uggaaugcuaagcaugugggag

SEQ ID NO: 298153 - RNA, 21 nt, Homo sapiens
uggaauguucugacuucaggg

SEQ ID NO: 298154 - RNA, 22 nt, Homo sapiens
uggaauguuuaucaaaacagua

SEQ ID NO: 298155 - RNA, 22 nt, Homo sapiens
uggacaagauagguucuauauu

SEQ ID NO: 298156 - RNA, 22 nt, Homo sapiens
uggacagagagaccggcauuuu

SEQ ID NO: 298157 - RNA, 22 nt, Homo sapiens
uggagguagacauugggaagag

SEQ ID NO: 298158 - RNA, 22 nt, Homo sapiens
uggagguagagaugggaucucc

SEQ ID NO: 298159 - RNA, 22 nt, Homo sapiens
uggaguguaauuagccaucagu

SEQ ID NO: 298160 - RNA, 22 nt, Homo sapiens
uggaguguuggggcaggaucuc

SEQ ID NO: 298161 - RNA, 22 nt, Homo sapiens
uggauagaaauguacuguuuuc

SEQ ID NO: 298162 - RNA, 22 nt, Homo sapiens
uggauagugauaagguagauga

SEQ ID NO: 298163 - RNA, 18 nt, Homo sapiens
uggauaugaaauucugga

SEQ ID NO: 298164 - RNA, 22 nt, Homo sapiens
uggaugacuguuauaugcauau

SEQ ID NO: 298165 - RNA, 22 nt, Homo sapiens
uggcaaaauauuuugguuucug

SEQ ID NO: 298166 - RNA, 22 nt, Homo sapiens
uggcaaaauggaauauguuggg

SEQ ID NO: 298167 - RNA, 21 nt, Homo sapiens
uggcaaaaugggcaguggguu

SEQ ID NO: 298168 - RNA, 22 nt, Homo sapiens
uggcaaauauuuuguuuuguaa

SEQ ID NO: 298169 - RNA, 22 nt, Homo sapiens
uggcaagaacaacaauuacuuu

SEQ ID NO: 298170 - RNA, 22 nt, Homo sapiens
uggcaagaaccacaauuacuuu

SEQ ID NO: 298171 - RNA, 22 nt, Homo sapiens
uggcaagaacugcaauugcuuu

SEQ ID NO: 298172 - RNA, 22 nt, Homo sapiens
uggcaagagcugcauucaucug

SEQ ID NO: 298173 - RNA, 19 nt, Homo sapiens
uggcaaugucagcagagau

SEQ ID NO: 298174 - RNA, 22 nt, Homo sapiens
uggcagauagaaaugugguuaa

SEQ ID NO: 298175 - RNA, 22 nt, Homo sapiens
uuguaaagaucauaugcuguuc

SEQ ID NO: 298176 - RNA, 22 nt, Homo sapiens
uuguaacaguuuauugacucga

SEQ ID NO: 298177 - RNA, 22 nt, Homo sapiens
uuguacaggaguguaagcuuca

SEQ ID NO: 298178 - RNA, 22 nt, Homo sapiens
uuguacccuuucuaugaggcca

SEQ ID NO: 298179 - RNA, 22 nt, Homo sapiens
uuguacuagaaaauuauucuuu

SEQ ID NO: 298180 - RNA, 22 nt, Homo sapiens
uuguacuucagacaugccaaag

SEQ ID NO: 298181 - RNA, 22 nt, Homo sapiens
uugucacccuacauaacaggga

SEQ ID NO: 298182 - RNA, 22 nt, Homo sapiens
uuguccuggagguucuugcaag

SEQ ID NO: 298183 - RNA, 19 nt, Homo sapiens
uugucuuagaguugucauu

SEQ ID NO: 298184 - RNA, 22 nt, Homo sapiens
uugugaauggaguagcaggauc

SEQ ID NO: 298185 - RNA, 22 nt, Homo sapiens
uugugaucauugucaaauagug

SEQ ID NO: 298186 - RNA, 22 nt, Homo sapiens
uugugcacauguacccuagaac

SEQ ID NO: 298187 - RNA, 22 nt, Homo sapiens
uugugcuugcuguguucuaugc

SEQ ID NO: 298188 - RNA, 19 nt, Homo sapiens
uugugggaggacagagggg

SEQ ID NO: 298189 - RNA, 22 nt, Homo sapiens
uugugguugauacacguaggaa

SEQ ID NO: 298190 - RNA, 22 nt, Homo sapiens
uugugguuuucagcuuauauau

SEQ ID NO: 298191 - RNA, 22 nt, Homo sapiens
uugugguuuuuaaaacuaggug

SEQ ID NO: 298192 - RNA, 22 nt, Homo sapiens
uugugucaaauggcaauuagca

SEQ ID NO: 298193 - RNA, 22 nt, Homo sapiens
uuguguuugaugcugacacgca

SEQ ID NO: 298194 - RNA, 22 nt, Homo sapiens
uuguuaugggguggcuugaaag

SEQ ID NO: 298195 - RNA, 22 nt, Homo sapiens
uuuaaagcacggaguuuguggc

SEQ ID NO: 298196 - RNA, 22 nt, Homo sapiens
uuuaaguguuuguuccugaaaa

SEQ ID NO: 298197 - RNA, 22 nt, Homo sapiens
uuuaauguuacaguauugguau

SEQ ID NO: 298198 - RNA, 18 nt, Homo sapiens
uuuacaguagaaggacuu

SEQ ID NO: 298199 - RNA, 22 nt, Homo sapiens
uuuacaguuuucuaggcuacca

SEQ ID NO: 298200 - RNA, 22 nt, Homo sapiens
uuuauccagccucuagcaaggu

SEQ ID NO: 298201 - RNA, 22 nt, Homo sapiens
uuuaugucuguacaucgggcgg

SEQ ID NO: 298202 - RNA, 19 nt, Homo sapiens
uuucaauguaaggauggag

SEQ ID NO: 298203 - RNA, 22 nt, Homo sapiens
uuucacagcaauugccuauugu

SEQ ID NO: 298204 - RNA, 22 nt, Homo sapiens
uuucauggcaguuuggggccug

SEQ ID NO: 298205 - RNA, 23 nt, Homo sapiens
uuucauggggauuuacucauucc

SEQ ID NO: 298206 - RNA, 19 nt, Homo sapiens
uuucccugcagaccuacua

SEQ ID NO: 298207 - RNA, 22 nt, Homo sapiens
uuuccuggagaaucuuaacaaa

SEQ ID NO: 298208 - RNA, 21 nt, Homo sapiens
uuuccuggagcguauggcuuc

SEQ ID NO: 298209 - RNA, 22 nt, Homo sapiens
uuucuauguugaccagucuaga

SEQ ID NO: 298210 - RNA, 22 nt, Homo sapiens
uuucucaguguuucaggguagg

SEQ ID NO: 298211 - RNA, 22 nt, Homo sapiens
uuugaagacuacugggagugaa

SEQ ID NO: 298212 - RNA, 22 nt, Homo sapiens
uuugacuacugaugguguacgc

SEQ ID NO: 298213 - RNA, 22 nt, Homo sapiens
uuugagauaucuuccaucagua

SEQ ID NO: 298214 - RNA, 22 nt, Homo sapiens
uuugaggaaaggcauaaguagg

SEQ ID NO: 298215 - RNA, 22 nt, Homo sapiens
uuugauguugauacuaccuuca

SEQ ID NO: 298216 - RNA, 23 nt, Homo sapiens
uuugccacuuauuagcugggagg

SEQ ID NO: 298217 - RNA, 22 nt, Homo sapiens
uuugcuaaucaacacuggccug

SEQ ID NO: 298218 - RNA, 22 nt, Homo sapiens
uuuggaaugaaacagcagagcc

SEQ ID NO: 298219 - RNA, 22 nt, Homo sapiens
uuuggcauuaagaugcuguauc

SEQ ID NO: 298220 - RNA, 22 nt, Homo sapiens
uuuggcccccagcucaggacau

SEQ ID NO: 298221 - RNA, 22 nt, Homo sapiens
uuuggcccugagggauggcaua

SEQ ID NO: 298222 - RNA, 22 nt, Homo sapiens
uuugggaaugaguuuaucauuu

SEQ ID NO: 298223 - RNA, 22 nt, Homo sapiens
uuuggucagcugcgggucagcu

SEQ ID NO: 298224 - RNA, 22 nt, Homo sapiens
uuugguccaguguucagguccu

SEQ ID NO: 298225 - RNA, 22 nt, Homo sapiens
uuugguccuccuacagggcagg

SEQ ID NO: 298226 - RNA, 22 nt, Homo sapiens
uuuguacacgugggugaauugu

SEQ ID NO: 298227 - RNA, 22 nt, Homo sapiens
uuuguacacuguuggugguuau

SEQ ID NO: 298228 - RNA, 22 nt, Homo sapiens
uuuguacuucauugguucuacu

SEQ ID NO: 298229 - RNA, 21 nt, Homo sapiens
uuuguccaccuguguucacca

SEQ ID NO: 298230 - RNA, 22 nt, Homo sapiens
uuugugaaugucauaagcucca

SEQ ID NO: 298231 - RNA, 22 nt, Homo sapiens
uuugugaggugauggauauguc

SEQ ID NO: 298232 - RNA, 22 nt, Homo sapiens
uuugugagguggauagauugca

SEQ ID NO: 298233 - RNA, 23 nt, Homo sapiens
uuugugcuaauuuaugggcucuu

SEQ ID NO: 298234 - RNA, 22 nt, Homo sapiens
uuugugcuccuguugagaaucu

SEQ ID NO: 298235 - RNA, 21 nt, Homo sapiens
uuugugguuacugugugagcu

SEQ ID NO: 298236 - RNA, 22 nt, Homo sapiens
uuuguguccccacccaaacauc

SEQ ID NO: 298237 - RNA, 22 nt, Homo sapiens
uuuguguccccacccacaucuc

SEQ ID NO: 298238 - RNA, 22 nt, Homo sapiens
uuuuccagugggacucccauua

SEQ ID NO: 298239 - RNA, 22 nt, Homo sapiens
uuuugcacauugauuugguauc

SEQ ID NO: 298240 - RNA, 22 nt, Homo sapiens
uuuugcaccauccuaauaguau

SEQ ID NO: 298241 - RNA, 22 nt, Homo sapiens
uuuugcaguuacagagagugag

SEQ ID NO: 298242 - RNA, 18 nt, Homo sapiens
uuuugcuuaacugcgcca

SEQ ID NO: 298243 - RNA, 22 nt, Homo sapiens
uuuugcuuuuccucggucccac

SEQ ID NO: 298244 - RNA, 19 nt, Homo sapiens
uuuuggaaaugugaacagc

SEQ ID NO: 298245 - RNA, 22 nt, Homo sapiens
uuuuggcuuaaagagaauguau

SEQ ID NO: 298246 - RNA, 22 nt, Homo sapiens
uuuugguguacaauucuaugga

SEQ ID NO: 298247 - RNA, 22 nt, Homo sapiens
uuuugguuaggauggguggcau

SEQ ID NO: 298248 - RNA, 22 nt, Homo sapiens
uuuugguuguuggguaagagua

SEQ ID NO: 298249 - RNA, 22 nt, Homo sapiens
uuuugugacuauuguaaauggg

SEQ ID NO: 298250 - RNA, 22 nt, Homo sapiens
uuuuugagaauuggugaaacac

SEQ ID NO: 298251 - RNA, 22 nt, Homo sapiens
uuuuugauuaauggguagacca

SEQ ID NO: 298252 - RNA, 22 nt, Homo sapiens
uuuuuggaggagguuagaucau

SEQ ID NO: 298253 - RNA, 21 nt, Homo sapiens
uuuuugguggucauggauaga

SEQ ID NO: 298254 - RNA, 23 nt, Homo sapiens
uuuuuguguuucauggaaauagg

SEQ ID NO: 298255 - RNA, 22 nt, Homo sapiens
uuuuuugcuguaugcaaacauc

SEQ ID NO: 298256 - RNA, 22 nt, Homo sapiens
uuuuuugguaauugaacaauga

SEQ ID NO: 298257 - RNA, 22 nt, Homo sapiens
uucccagagagggacuucuaau

SEQ ID NO: 298258 - RNA, 22 nt, Homo sapiens
uucccaguaaacucuaucccuc

SEQ ID NO: 298259 - RNA, 22 nt, Homo sapiens
uucccugugggaguaggaaagu

SEQ ID NO: 298260 - RNA, 22 nt, Homo sapiens
uucccuuuuuucuaguagguag

SEQ ID NO: 298261 - RNA, 22 nt, Homo sapiens
uuccuacuguucaucaggaacc

SEQ ID NO: 298262 - RNA, 22 nt, Homo sapiens
uuccuaguccugagucucugcg

SEQ ID NO: 298263 - RNA, 22 nt, Homo sapiens
uuccugagagggcugggugcag

SEQ ID NO: 298264 - RNA, 22 nt, Homo sapiens
uuccugagaucagaauucaaau

SEQ ID NO: 298265 - RNA, 22 nt, Homo sapiens
uuccugaggccuccccagaagc

SEQ ID NO: 298266 - RNA, 22 nt, Homo sapiens
uuccuugagucuuuuuccugag

SEQ ID NO: 298267 - RNA, 22 nt, Homo sapiens
uuccuugguucagggaaggucc

SEQ ID NO: 298268 - RNA, 22 nt, Homo sapiens
uucgcagcucaguucaacuagg

SEQ ID NO: 298269 - RNA, 22 nt, Homo sapiens
uucgucccuuuuggaauccucu

SEQ ID NO: 298270 - RNA, 22 nt, Homo sapiens
uucuauguuguuagacccacca

SEQ ID NO: 298271 - RNA, 22 nt, Homo sapiens
uucuauugguaauauuuucugu

SEQ ID NO: 298272 - RNA, 22 nt, Homo sapiens
ugcccuguaucccacuguuuca

SEQ ID NO: 298273 - RNA, 22 nt, Homo sapiens
ugccuaguggccuuaugaguau

SEQ ID NO: 298274 - RNA, 22 nt, Homo sapiens
ugcgauaguuugcugguaaauu

SEQ ID NO: 298275 - RNA, 22 nt, Homo sapiens
ugcuacccuucgucucucuggu

SEQ ID NO: 298276 - RNA, 22 nt, Homo sapiens
ugcuauagcuauaucaucuccu

SEQ ID NO: 298277 - RNA, 22 nt, Homo sapiens
ugcuaugucagccaggcugguc

SEQ ID NO: 298278 - RNA, 18 nt, Homo sapiens
ugcuccccugggugagca

SEQ ID NO: 298279 - RNA, 23 nt, Homo sapiens
ugcugagaccuagauccuaaaga

SEQ ID NO: 298280 - RNA, 22 nt, Homo sapiens
ugcuggugauucagauucaaau

SEQ ID NO: 298281 - RNA, 22 nt, Homo sapiens
uggaaauuaacagggauugucc

SEQ ID NO: 298282 - RNA, 22 nt, Homo sapiens
uggaagacaaguguuagcaugg

SEQ ID NO: 298283 - RNA, 22 nt, Homo sapiens
uggaagauggaguuuuaucauu

SEQ ID NO: 298284 - RNA, 22 nt, Homo sapiens
uggaagcauagcagcgugugug

SEQ ID NO: 298285 - RNA, 22 nt, Homo sapiens
uggaaguaaucaugagguagca

SEQ ID NO: 298286 - RNA, 20 nt, Homo sapiens
uggaaucuaggcggagguuu

SEQ ID NO: 298287 - RNA, 20 nt, Homo sapiens
uggaaucugaagaucucagu

SEQ ID NO: 298288 - RNA, 17 nt, Homo sapiens
uggaaugucuaagccug

SEQ ID NO: 298289 - RNA, 18 nt, Homo sapiens
uggaauguuuggguuaau

SEQ ID NO: 298290 - RNA, 21 nt, Homo sapiens
uggaauuaauggagagguguu

SEQ ID NO: 298291 - RNA, 22 nt, Homo sapiens
uggacaugaagggcacaggagg

SEQ ID NO: 298292 - RNA, 22 nt, Homo sapiens
uggacauguacauauguguaug

SEQ ID NO: 298293 - RNA, 22 nt, Homo sapiens
uggagacaaagauagaaaagca

SEQ ID NO: 298294 - RNA, 22 nt, Homo sapiens
uggagagucauuuauaguauuu

SEQ ID NO: 298295 - RNA, 22 nt, Homo sapiens
uggagagugauaaguaaaugga

SEQ ID NO: 298296 - RNA, 22 nt, Homo sapiens
uggagauguuuaaaauccacug

SEQ ID NO: 298297 - RNA, 19 nt, Homo sapiens
uggagucaucaugcugcua

SEQ ID NO: 298298 - RNA, 22 nt, Homo sapiens
uggauagauacuauccaggacu

SEQ ID NO: 298299 - RNA, 22 nt, Homo sapiens
uggauauguucuuuguguaagg

SEQ ID NO: 298300 - RNA, 22 nt, Homo sapiens
uggaucaugcgaggccuccccu

SEQ ID NO: 298301 - RNA, 19 nt, Homo sapiens
uggauuguuagagcagugu

SEQ ID NO: 298302 - RNA, 22 nt, Homo sapiens
uggcaaaaaaacgcaauuacgu

SEQ ID NO: 298303 - RNA, 22 nt, Homo sapiens
uggcaaaaaucacaaguaccuu

SEQ ID NO: 298304 - RNA, 22 nt, Homo sapiens
uggcaaaugaagucagcuguac

SEQ ID NO: 298305 - RNA, 22 nt, Homo sapiens
uggcaaaugugagaugagaacu

SEQ ID NO: 298306 - RNA, 22 nt, Homo sapiens
uggcaagagaacaacaucucuc

SEQ ID NO: 298307 - RNA, 22 nt, Homo sapiens
uggcaagagggaugcaagguuu

SEQ ID NO: 298308 - RNA, 22 nt, Homo sapiens
uggcaagaucacaauuacuuuu

SEQ ID NO: 298309 - RNA, 20 nt, Homo sapiens
uggcaagauggcagaauaga

SEQ ID NO: 298310 - RNA, 18 nt, Homo sapiens
uggcaauaugguucuacc

SEQ ID NO: 298311 - RNA, 22 nt, Homo sapiens
uggcaggugcacuggcuuugaa

SEQ ID NO: 298312 - RNA, 22 nt, Homo sapiens
uggcaguuuugauguggagaga

SEQ ID NO: 298313 - RNA, 19 nt, Homo sapiens
uggcaugaaugugaacuaa

SEQ ID NO: 298314 - RNA, 22 nt, Homo sapiens
uggcauguguuugaaugaguau

SEQ ID NO: 298315 - RNA, 23 nt, Homo sapiens
uggcauuuuaguuagcuucagug

SEQ ID NO: 298316 - RNA, 23 nt, Homo sapiens
uggccagaaacuucuuuucaucc

SEQ ID NO: 298317 - RNA, 22 nt, Homo sapiens
uggccuguaacgcugucucagc

SEQ ID NO: 298318 - RNA, 22 nt, Homo sapiens
uggccuuuuccaagaacuacua

SEQ ID NO: 298319 - RNA, 22 nt, Homo sapiens
uggcgagaaaccauaugcuuuc

SEQ ID NO: 298320 - RNA, 20 nt, Homo sapiens
uggcuaaaugaaugauagca

SEQ ID NO: 298321 - RNA, 22 nt, Homo sapiens
uggcuacagaaaguacuaguga

SEQ ID NO: 298322 - RNA, 22 nt, Homo sapiens
uggcuacuguacuugagcuauu

SEQ ID NO: 298323 - RNA, 22 nt, Homo sapiens
uggcuagauauccagaguucug

SEQ ID NO: 298324 - RNA, 22 nt, Homo sapiens
uggcucauuucuaaacccagcu

SEQ ID NO: 298325 - RNA, 22 nt, Homo sapiens
uggcuguuguuacuaacaguuc

SEQ ID NO: 298326 - RNA, 21 nt, Homo sapiens
uggcuguuuucaugcuagaac

SEQ ID NO: 298327 - RNA, 21 nt, Homo sapiens
uggcuuauuugaaucuggcuu

SEQ ID NO: 298328 - RNA, 22 nt, Homo sapiens
uggcuuuuaucuacucucaacu

SEQ ID NO: 298329 - RNA, 22 nt, Homo sapiens
uggcuuuuauuauguugaggua

SEQ ID NO: 298330 - RNA, 22 nt, Homo sapiens
uggcuuuucauccugggacauu

SEQ ID NO: 298331 - RNA, 18 nt, Homo sapiens
ugggaagaaauucuucuc

SEQ ID NO: 298332 - RNA, 22 nt, Homo sapiens
ugggaugaaaauagcuucuucc

SEQ ID NO: 298333 - RNA, 22 nt, Homo sapiens
ugggcaaaacuaagagcugugg

SEQ ID NO: 298334 - RNA, 22 nt, Homo sapiens
ugggcggagacgugcagccgcc

SEQ ID NO: 298335 - RNA, 22 nt, Homo sapiens
uggguaggaccagaaaugcacu

SEQ ID NO: 298336 - RNA, 22 nt, Homo sapiens
uggguaggcccucauuggacag

SEQ ID NO: 298337 - RNA, 22 nt, Homo sapiens
ugguaagaggcccugaguuugu

SEQ ID NO: 298338 - RNA, 22 nt, Homo sapiens
ugguaucuaagaugcacguugu

SEQ ID NO: 298339 - RNA, 22 nt, Homo sapiens
ugguaugucuagauggggaagu

SEQ ID NO: 298340 - RNA, 22 nt, Homo sapiens
uggucagaugcugaguggaucu

SEQ ID NO: 298341 - RNA, 20 nt, Homo sapiens
ugguccccugagucuggcuu

SEQ ID NO: 298342 - RNA, 23 nt, Homo sapiens
uggucccguguucuggcuuuagg

SEQ ID NO: 298343 - RNA, 22 nt, Homo sapiens
uggucucuuugcuuuagucauc

SEQ ID NO: 298344 - RNA, 22 nt, Homo sapiens
uggucuuuucaacaaaugguau

SEQ ID NO: 298345 - RNA, 23 nt, Homo sapiens
uguaaaagcauuugucagccugg

SEQ ID NO: 298346 - RNA, 22 nt, Homo sapiens
uguaaacauguauguguuuaug

SEQ ID NO: 298347 - RNA, 22 nt, Homo sapiens
uguaaaccauauauguauguag

SEQ ID NO: 298348 - RNA, 22 nt, Homo sapiens
uguaaacucaguauguuuuacu

SEQ ID NO: 298349 - RNA, 22 nt, Homo sapiens
uguaacaggaggaaaaugugaa

SEQ ID NO: 298350 - RNA, 22 nt, Homo sapiens
uguaacaguaguuacuauucuu

SEQ ID NO: 298351 - RNA, 22 nt, Homo sapiens
uguacacauaugugggguacau

SEQ ID NO: 298352 - RNA, 22 nt, Homo sapiens
uguagcaaauaaaagucuggau

SEQ ID NO: 298353 - RNA, 23 nt, Homo sapiens
uguauacacccugugcaucuggg

SEQ ID NO: 298354 - RNA, 22 nt, Homo sapiens
uguauguaaagacaggauaaca

SEQ ID NO: 298355 - RNA, 22 nt, Homo sapiens
uguauguugggucaaaguacau

SEQ ID NO: 298356 - RNA, 22 nt, Homo sapiens
uguauguuguaagacuuagacc

SEQ ID NO: 298357 - RNA, 22 nt, Homo sapiens
ugucaaaugcagugauauuuga

SEQ ID NO: 298358 - RNA, 22 nt, Homo sapiens
ugucaagaugguuugauguugu

SEQ ID NO: 298359 - RNA, 22 nt, Homo sapiens
ugucaggaguuuuagaaucuua

SEQ ID NO: 298360 - RNA, 22 nt, Homo sapiens
ugucaguuucccuccucuuccu

SEQ ID NO: 298361 - RNA, 23 nt, Homo sapiens
ugucaucaagaugaggucacacu

SEQ ID NO: 298362 - RNA, 20 nt, Homo sapiens
ugucauuaagcacugugcca

SEQ ID NO: 298363 - RNA, 22 nt, Homo sapiens
ugucauucaggaaauucuaagu

SEQ ID NO: 298364 - RNA, 22 nt, Homo sapiens
uguccugaagcuuuguuaugua

SEQ ID NO: 298365 - RNA, 22 nt, Homo sapiens
uguccuggugaugcccaaauuc

SEQ ID NO: 298366 - RNA, 22 nt, Homo sapiens
ugucuaaagaauggcagacuca

SEQ ID NO: 298367 - RNA, 22 nt, Homo sapiens
ugucucccuucccauuaggaag

SEQ ID NO: 298368 - RNA, 22 nt, Homo sapiens
ugucuuggacuugaaucucauu

SEQ ID NO: 298369 - RNA, 22 nt, Homo sapiens
ugucuuguagacaauguauagu

SEQ ID NO: 298370 - RNA, 22 nt, Homo sapiens
ugucuuuguuaguuguccuagu

SEQ ID NO: 298371 - RNA, 22 nt, Homo sapiens
ugugaaacauggauagaacugg

SEQ ID NO: 298372 - RNA, 22 nt, Homo sapiens
ugugaaaucagauagccuuuuu

SEQ ID NO: 298373 - RNA, 20 nt, Homo sapiens
ugugaacuguagauagucuu

SEQ ID NO: 298374 - RNA, 22 nt, Homo sapiens
ugugaagaugagaugacgcccu

SEQ ID NO: 298375 - RNA, 22 nt, Homo sapiens
uuuggucccaaugugauaaggu

SEQ ID NO: 298376 - RNA, 22 nt, Homo sapiens
uuugguuuuuguuaucacucau

SEQ ID NO: 298377 - RNA, 22 nt, Homo sapiens
uuuguacucccuuuagauaaaa

SEQ ID NO: 298378 - RNA, 18 nt, Homo sapiens
uuuguacuuuuucuaaug

SEQ ID NO: 298379 - RNA, 22 nt, Homo sapiens
uuuguagcuacaaagugagaug

SEQ ID NO: 298380 - RNA, 21 nt, Homo sapiens
uuuguaguagcaugauuuaua

SEQ ID NO: 298381 - RNA, 22 nt, Homo sapiens
uuugucaauaacuaccaacagg

SEQ ID NO: 298382 - RNA, 22 nt, Homo sapiens
uuugugcaaacuaggauugcga

SEQ ID NO: 298383 - RNA, 22 nt, Homo sapiens
uuugugcuaaugcuagauuacu

SEQ ID NO: 298384 - RNA, 22 nt, Homo sapiens
uuugugcuccugugagaaucua

SEQ ID NO: 298385 - RNA, 22 nt, Homo sapiens
uuuguguccccacccaaaucuc

SEQ ID NO: 298386 - RNA, 22 nt, Homo sapiens
uuuuaacagccaggggacggcc

SEQ ID NO: 298387 - RNA, 22 nt, Homo sapiens
uuuuacacuucgguugugugca

SEQ ID NO: 298388 - RNA, 22 nt, Homo sapiens
uuuuagcaaagagacugguggc

SEQ ID NO: 298389 - RNA, 20 nt, Homo sapiens
uuuuagcacuuguuauggug

SEQ ID NO: 298390 - RNA, 22 nt, Homo sapiens
uuuuauguuuguucccugccaa

SEQ ID NO: 298391 - RNA, 23 nt, Homo sapiens
uuuugcaauaagucacuggaaua

SEQ ID NO: 298392 - RNA, 22 nt, Homo sapiens
uuuugcacuagaaccagagguu

SEQ ID NO: 298393 - RNA, 20 nt, Homo sapiens
uuuugcacuccuacuaaggu

SEQ ID NO: 298394 - RNA, 22 nt, Homo sapiens
uuuugcacuguuuuaucugaca

SEQ ID NO: 298395 - RNA, 22 nt, Homo sapiens
uuuugcaggcauuggaaguuua

SEQ ID NO: 298396 - RNA, 22 nt, Homo sapiens
uuuugcuugugaauagccacau

SEQ ID NO: 298397 - RNA, 22 nt, Homo sapiens
uuuuggcuagaaauauaccucc

SEQ ID NO: 298398 - RNA, 22 nt, Homo sapiens
uuuuggcucuugguaggucaga

SEQ ID NO: 298399 - RNA, 22 nt, Homo sapiens
uuuugguguauuguauaaggua

SEQ ID NO: 298400 - RNA, 22 nt, Homo sapiens
uuuugguucaauuaauuugcua

SEQ ID NO: 298401 - RNA, 22 nt, Homo sapiens
uuuuucacuuaaguuaggcuca

SEQ ID NO: 298402 - RNA, 18 nt, Homo sapiens
aaaaagugcucaggccua

SEQ ID NO: 298403 - RNA, 22 nt, Homo sapiens
aaacucuguagcagagacagau

SEQ ID NO: 298404 - RNA, 22 nt, Homo sapiens
aaacugcuuuccaugguggcug

SEQ ID NO: 298405 - RNA, 22 nt, Homo sapiens
aaagcagcaggugguuuucaau

SEQ ID NO: 298406 - RNA, 22 nt, Homo sapiens
aaagcuaagguagcauuggaga

SEQ ID NO: 298407 - RNA, 22 nt, Homo sapiens
aaagcuaccagauucuguugga

SEQ ID NO: 298408 - RNA, 22 nt, Homo sapiens
aaagggcacugugcuuuggcaa

SEQ ID NO: 298409 - RNA, 19 nt, Homo sapiens
aaagguaguaaccucugau

SEQ ID NO: 298410 - RNA, 22 nt, Homo sapiens
aaagucacuggagaaggaauau

SEQ ID NO: 298411 - RNA, 22 nt, Homo sapiens
aaagucuguuuugucagagacu

SEQ ID NO: 298412 - RNA, 22 nt, Homo sapiens
aaagugcugagaguucuaacuu

SEQ ID NO: 298413 - RNA, 22 nt, Homo sapiens
aaaguggacuaagugaauauga

SEQ ID NO: 298414 - RNA, 22 nt, Homo sapiens
aaaguggugugaguauguaucu

SEQ ID NO: 298415 - RNA, 22 nt, Homo sapiens
aaaguucuguugauagugcuga

SEQ ID NO: 298416 - RNA, 22 nt, Homo sapiens
aaauaguagcugaaugagggaa

SEQ ID NO: 298417 - RNA, 22 nt, Homo sapiens
aaaugcacaaagauuuugcacu

SEQ ID NO: 298418 - RNA, 22 nt, Homo sapiens
aaaugcagucuuuguucugggc

SEQ ID NO: 298419 - RNA, 22 nt, Homo sapiens
aaauggcacaguaagggcauuu

SEQ ID NO: 298420 - RNA, 18 nt, Homo sapiens
aaauucugucccuucuuc

SEQ ID NO: 298421 - RNA, 22 nt, Homo sapiens
aacacuguuuccagucaugauc

SEQ ID NO: 298422 - RNA, 22 nt, Homo sapiens
aacagcauaguacccgugauaa

SEQ ID NO: 298423 - RNA, 22 nt, Homo sapiens
aacagucuccaguuguauccau

SEQ ID NO: 298424 - RNA, 22 nt, Homo sapiens
aacagugccugucauuuaguag

SEQ ID NO: 298425 - RNA, 22 nt, Homo sapiens
aacauguuuagcagauaccugu

SEQ ID NO: 298426 - RNA, 22 nt, Homo sapiens
aacccugagucaugagucuaga

SEQ ID NO: 298427 - RNA, 22 nt, Homo sapiens
aaccuguggauuuugguaucug

SEQ ID NO: 298428 - RNA, 22 nt, Homo sapiens
aaccuuuagucagcucuuagga

SEQ ID NO: 298429 - RNA, 22 nt, Homo sapiens
aacuaugucaaauaaaaugagg

SEQ ID NO: 298430 - RNA, 22 nt, Homo sapiens
aacugggcaagcauuacauggu

SEQ ID NO: 298431 - RNA, 19 nt, Homo sapiens
aacuggugugagaugguau

SEQ ID NO: 298432 - RNA, 22 nt, Homo sapiens
aagagagccagcugguauauuu

SEQ ID NO: 298433 - RNA, 22 nt, Homo sapiens
aagaggcuguaggauaaugccu

SEQ ID NO: 298434 - RNA, 22 nt, Homo sapiens
aagagguaauaacaaagcuucu

SEQ ID NO: 298435 - RNA, 22 nt, Homo sapiens
aagagguuuaacugacucacag

SEQ ID NO: 298436 - RNA, 22 nt, Homo sapiens
aagaguaguaguggcacucucu

SEQ ID NO: 298437 - RNA, 22 nt, Homo sapiens
aagaugcagaagcccagauguu

SEQ ID NO: 298438 - RNA, 22 nt, Homo sapiens
aagccacuguaccugucucuua

SEQ ID NO: 298439 - RNA, 22 nt, Homo sapiens
aagcugcauuuucuagaugcuu

SEQ ID NO: 298440 - RNA, 22 nt, Homo sapiens
aagcuguuguucauccugaauu

SEQ ID NO: 298441 - RNA, 22 nt, Homo sapiens
aaggaauucaaauuuucucugg

SEQ ID NO: 298442 - RNA, 22 nt, Homo sapiens
aaggagugugauucuucaguuu

SEQ ID NO: 298443 - RNA, 22 nt, Homo sapiens
aaggcaagagaaaauuucgagu

SEQ ID NO: 298444 - RNA, 22 nt, Homo sapiens
aaggcacugaacuuaaauucug

SEQ ID NO: 298445 - RNA, 22 nt, Homo sapiens
aaggcaguggcagaagauguca

SEQ ID NO: 298446 - RNA, 22 nt, Homo sapiens
aaggcaugcaguacguuucuau

SEQ ID NO: 298447 - RNA, 22 nt, Homo sapiens
aaggcauggugacuauuuaggc

SEQ ID NO: 298448 - RNA, 22 nt, Homo sapiens
aaggcuauuugagaaugugugu

SEQ ID NO: 298449 - RNA, 22 nt, Homo sapiens
aaggcuguuguguaauaggauu

SEQ ID NO: 298450 - RNA, 22 nt, Homo sapiens
aagggaaugcuuccaguuugug

SEQ ID NO: 298451 - RNA, 22 nt, Homo sapiens
aaggugcuguaagcauccaugu

SEQ ID NO: 298452 - RNA, 18 nt, Homo sapiens
aaggugcuucuguucuga

SEQ ID NO: 298453 - RNA, 21 nt, Homo sapiens
aaggugguggugauugagaug

SEQ ID NO: 298454 - RNA, 22 nt, Homo sapiens
uuguuauguuggucaguaaugu

SEQ ID NO: 298455 - RNA, 22 nt, Homo sapiens
uuuaacauuggaugagaucguc

SEQ ID NO: 298456 - RNA, 23 nt, Homo sapiens
uuuaagcuucauguccuaacauc

SEQ ID NO: 298457 - RNA, 22 nt, Homo sapiens
uuuaauagcagggacuuccggg

SEQ ID NO: 298458 - RNA, 19 nt, Homo sapiens
uuuagaucuuuuaugcagc

SEQ ID NO: 298459 - RNA, 22 nt, Homo sapiens
uuuagcaauggagggugacuuu

SEQ ID NO: 298460 - RNA, 22 nt, Homo sapiens
uuuaggcaauauauucaugucu

SEQ ID NO: 298461 - RNA, 22 nt, Homo sapiens
uuuaggcaugcaguucuauuua

SEQ ID NO: 298462 - RNA, 22 nt, Homo sapiens
uuuauagucaggaacuugagga

SEQ ID NO: 298463 - RNA, 22 nt, Homo sapiens
uuuauguggagcacuugacaca

SEQ ID NO: 298464 - RNA, 22 nt, Homo sapiens
uuuauugcucuaaaguugccau

SEQ ID NO: 298465 - RNA, 22 nt, Homo sapiens
uuucaacuaauuuuuuggugag

SEQ ID NO: 298466 - RNA, 22 nt, Homo sapiens
uuucacagagggcuucuuucua

SEQ ID NO: 298467 - RNA, 21 nt, Homo sapiens
aagguuuuuagugcuugacuu

SEQ ID NO: 298468 - RNA, 22 nt, Homo sapiens
aaguaucaggaauaguuauugg

SEQ ID NO: 298469 - RNA, 22 nt, Homo sapiens
aagucaaggagagaagcuucag

SEQ ID NO: 298470 - RNA, 23 nt, Homo sapiens
aagucauggaaucaaaugaggug

SEQ ID NO: 298471 - RNA, 22 nt, Homo sapiens
agcagcauuccaaaaaucugcu

SEQ ID NO: 298472 - RNA, 21 nt, Homo sapiens
agcagcuuugguugaagcaga

SEQ ID NO: 298473 - RNA, 22 nt, Homo sapiens
agcaggacaauaugggaucagg

SEQ ID NO: 298474 - RNA, 16 nt, Homo sapiens
agcagguguuagguga

SEQ ID NO: 298475 - RNA, 22 nt, Homo sapiens
agcaguagaauuccugcaucac

SEQ ID NO: 298476 - RNA, 22 nt, Homo sapiens
agcaucaugcaguugcuauuca

SEQ ID NO: 298477 - RNA, 23 nt, Homo sapiens
agccuguugccuaggcagcucau

SEQ ID NO: 298478 - RNA, 22 nt, Homo sapiens
agccuucauucugacaguagga

SEQ ID NO: 298479 - RNA, 22 nt, Homo sapiens
agcugguauuuugucaaggaua

SEQ ID NO: 298480 - RNA, 22 nt, Homo sapiens
agcuguaguuugguggauguaa

SEQ ID NO: 298481 - RNA, 22 nt, Homo sapiens
agcuuguagugauuugugguaa

SEQ ID NO: 298482 - RNA, 22 nt, Homo sapiens
agcuugugauuuagagugagag

SEQ ID NO: 298483 - RNA, 22 nt, Homo sapiens
agcuuguguuugucugccuggg

SEQ ID NO: 298484 - RNA, 22 nt, Homo sapiens
aggaagacugaaauugcuguuc

SEQ ID NO: 298485 - RNA, 23 nt, Homo sapiens
aggaaguaacuaucuuuucuguc

SEQ ID NO: 298486 - RNA, 22 nt, Homo sapiens
aggaaguaauaaguuugguucu

SEQ ID NO: 298487 - RNA, 22 nt, Homo sapiens
aggaauggaaacuuuugauggu

SEQ ID NO: 298488 - RNA, 22 nt, Homo sapiens
aggaauguuaguacuucuuagu

SEQ ID NO: 298489 - RNA, 22 nt, Homo sapiens
aggauaguaaugauagagaggc

SEQ ID NO: 298490 - RNA, 22 nt, Homo sapiens
aggaucauugacuauuauaagg

SEQ ID NO: 298491 - RNA, 22 nt, Homo sapiens
aggcaaugugagaguuuauuca

SEQ ID NO: 298492 - RNA, 22 nt, Homo sapiens
aggcacacaacccuggaccuga

SEQ ID NO: 298493 - RNA, 22 nt, Homo sapiens
aggcaugaaauacaugcauuga

SEQ ID NO: 298494 - RNA, 22 nt, Homo sapiens
aggcaugauggcuccagaucau

SEQ ID NO: 298495 - RNA, 22 nt, Homo sapiens
aggccaguuuuuggagggaaac

SEQ ID NO: 298496 - RNA, 22 nt, Homo sapiens
aggcuagacuuugagaauuuuu

SEQ ID NO: 298497 - RNA, 22 nt, Homo sapiens
aggcuguguggauaauauuggg

SEQ ID NO: 298498 - RNA, 22 nt, Homo sapiens
agggaauguaaguuuuaugaga

SEQ ID NO: 298499 - RNA, 22 nt, Homo sapiens
agggccuuuguagauguacuca

SEQ ID NO: 298500 - RNA, 22 nt, Homo sapiens
agggcuuguuuaacuaucauua

SEQ ID NO: 298501 - RNA, 22 nt, Homo sapiens
aggugcacucagaaaacagaua

SEQ ID NO: 298502 - RNA, 20 nt, Homo sapiens
agguucaaaucccaaucaug

SEQ ID NO: 298503 - RNA, 22 nt, Homo sapiens
aguaaauuucugugcuuucaua

SEQ ID NO: 298504 - RNA, 22 nt, Homo sapiens
aguaucaagccacacaugguca

SEQ ID NO: 298505 - RNA, 22 nt, Homo sapiens
aguaucacaggcaaaacagaau

SEQ ID NO: 298506 - RNA, 22 nt, Homo sapiens
agucacagccuuuuacuuuaga

SEQ ID NO: 298507 - RNA, 22 nt, Homo sapiens
agucacagguucuugggauuag

SEQ ID NO: 298508 - RNA, 22 nt, Homo sapiens
agucacagugaccuugucugac

SEQ ID NO: 298509 - RNA, 20 nt, Homo sapiens
agucaguuuauuuucucucu

SEQ ID NO: 298510 - RNA, 22 nt, Homo sapiens
agucaugggagagaugugaucg

SEQ ID NO: 298511 - RNA, 22 nt, Homo sapiens
agucauuguugagaugguguca

SEQ ID NO: 298512 - RNA, 19 nt, Homo sapiens
agugagccaagauccuacc

SEQ ID NO: 298513 - RNA, 21 nt, Homo sapiens
agugagucauuuggaaagcaa

SEQ ID NO: 298514 - RNA, 19 nt, Homo sapiens
agugcaauugccuuugugc

SEQ ID NO: 298515 - RNA, 22 nt, Homo sapiens
agugcaguggcauggucauaac

SEQ ID NO: 298516 - RNA, 22 nt, Homo sapiens
agugcauugagacuugugaguu

SEQ ID NO: 298517 - RNA, 22 nt, Homo sapiens
agugcauugcaucucugcuuca

SEQ ID NO: 298518 - RNA, 22 nt, Homo sapiens
aguggauuuuagacugagauuu

SEQ ID NO: 298519 - RNA, 22 nt, Homo sapiens
aguggcaaugugauguccugaa

SEQ ID NO: 298520 - RNA, 19 nt, Homo sapiens
aguggguguuuucuguuug

SEQ ID NO: 298521 - RNA, 22 nt, Homo sapiens
aguuggccccuacugggaggug

SEQ ID NO: 298522 - RNA, 18 nt, Homo sapiens
aguuguuuuauccugccc

SEQ ID NO: 298523 - RNA, 19 nt, Homo sapiens
auaaacuagaacugucccc

SEQ ID NO: 298524 - RNA, 22 nt, Homo sapiens
auaaagccaggagacguaauug

SEQ ID NO: 298525 - RNA, 22 nt, Homo sapiens
auaaagguaauaauaguugcau

SEQ ID NO: 298526 - RNA, 22 nt, Homo sapiens
auaaaugcuuagaucuguauau

SEQ ID NO: 298527 - RNA, 20 nt, Homo sapiens
auaccacagacuggguaguu

SEQ ID NO: 298528 - RNA, 22 nt, Homo sapiens
auacuagucaagaauguaugag

SEQ ID NO: 298529 - RNA, 22 nt, Homo sapiens
auagaagcugccaacguuucag

SEQ ID NO: 298530 - RNA, 22 nt, Homo sapiens
auagcacaguguguguacacca

SEQ ID NO: 298531 - RNA, 22 nt, Homo sapiens
auagcagaccaccucucccacu

SEQ ID NO: 298532 - RNA, 20 nt, Homo sapiens
auagcagcaugauuuauaau

SEQ ID NO: 298533 - RNA, 22 nt, Homo sapiens
auagcagugugagaaugaacua

SEQ ID NO: 298534 - RNA, 22 nt, Homo sapiens
auaguggcaugaucauagcuca

SEQ ID NO: 298535 - RNA, 22 nt, Homo sapiens
auaucaacaucgugucauuagu

SEQ ID NO: 298536 - RNA, 22 nt, Homo sapiens
auauguauuuuaacguguaagg

SEQ ID NO: 298537 - RNA, 22 nt, Homo sapiens
auauucacuauaugcagaacca

SEQ ID NO: 298538 - RNA, 22 nt, Homo sapiens
auauugcuuagugaugaagucu

SEQ ID NO: 298539 - RNA, 22 nt, Homo sapiens
aucacuagaucauagguaaaca

SEQ ID NO: 298540 - RNA, 22 nt, Homo sapiens
aucagaaucucuagaggacugu

SEQ ID NO: 298541 - RNA, 22 nt, Homo sapiens
aucagauggcuaaaacagaaga

SEQ ID NO: 298542 - RNA, 22 nt, Homo sapiens
aucagcacugaucauacagcuu

SEQ ID NO: 298543 - RNA, 22 nt, Homo sapiens
aucagcagcaugaaaacaggcu

SEQ ID NO: 298544 - RNA, 22 nt, Homo sapiens
aucagugagugguuagugaaug

SEQ ID NO: 298545 - RNA, 22 nt, Homo sapiens
aucauacuguuuugauuacugu

SEQ ID NO: 298546 - RNA, 22 nt, Homo sapiens
aucaucaugcacuacagccugg

SEQ ID NO: 298547 - RNA, 22 nt, Homo sapiens
aucauccugucaggagcuguga

SEQ ID NO: 298548 - RNA, 22 nt, Homo sapiens
aucaugucuucccagugauucu

SEQ ID NO: 298549 - RNA, 22 nt, Homo sapiens
aucauguuuauguguaggauau

SEQ ID NO: 298550 - RNA, 22 nt, Homo sapiens
auccaguguuuucuuuugucac

SEQ ID NO: 298551 - RNA, 22 nt, Homo sapiens
auccaucagacggcaggcguug

SEQ ID NO: 298552 - RNA, 22 nt, Homo sapiens
aucccagaaacucggguuucuc

SEQ ID NO: 298553 - RNA, 22 nt, Homo sapiens
aucccaguaaaaauggcuucua

SEQ ID NO: 298554 - RNA, 22 nt, Homo sapiens
aucccuguaguaauauucuagc

SEQ ID NO: 298555 - RNA, 22 nt, Homo sapiens
auccugaugacacagugcugca

SEQ ID NO: 298556 - RNA, 22 nt, Homo sapiens
auccuuuagacuguccaguuga

SEQ ID NO: 298557 - RNA, 22 nt, Homo sapiens
aucgcauaaucucuaaaaagca

SEQ ID NO: 298558 - RNA, 22 nt, Homo sapiens
aucgcgccauuguacuccagcc

SEQ ID NO: 298559 - RNA, 21 nt, Homo sapiens
aucucacuugaauguaaaagc

SEQ ID NO: 298560 - RNA, 22 nt, Homo sapiens
aucugacuuuuaauuugaaaac

SEQ ID NO: 298561 - RNA, 22 nt, Homo sapiens
aucugguguggcugugauccuc

SEQ ID NO: 298562 - RNA, 22 nt, Homo sapiens
aucuuguccugagguuuuauug

SEQ ID NO: 298563 - RNA, 22 nt, Homo sapiens
augaaauugcuaucgcaguacu

SEQ ID NO: 298564 - RNA, 22 nt, Homo sapiens
augaaguauuaggacacauuua

SEQ ID NO: 298565 - RNA, 22 nt, Homo sapiens
augaauagaguuaauugaguac

SEQ ID NO: 298566 - RNA, 22 nt, Homo sapiens
augaaugcaucuaucaaagcau

SEQ ID NO: 298567 - RNA, 22 nt, Homo sapiens
augaauguaaagaaugugggaa

SEQ ID NO: 298568 - RNA, 23 nt, Homo sapiens
augaauguaaggaguguaagaaa

SEQ ID NO: 298569 - RNA, 22 nt, Homo sapiens
augacacugcagagauguccca

SEQ ID NO: 298570 - RNA, 22 nt, Homo sapiens
augacagagauaugugaauuuu

SEQ ID NO: 298571 - RNA, 22 nt, Homo sapiens
augacaguaugacuccaaaagu

SEQ ID NO: 298572 - RNA, 22 nt, Homo sapiens
augaccagagagugcgcagggu

SEQ ID NO: 298573 - RNA, 17 nt, Homo sapiens
augacuucuucagugug

SEQ ID NO: 298574 - RNA, 22 nt, Homo sapiens
augacuuuucugaaaaccacca

SEQ ID NO: 298575 - RNA, 22 nt, Homo sapiens
augagaauguaaguuaaugaaa

SEQ ID NO: 298576 - RNA, 18 nt, Homo sapiens
augagagccgauuccugg

SEQ ID NO: 298577 - RNA, 22 nt, Homo sapiens
augagagcuaacuguggguaca

SEQ ID NO: 298578 - RNA, 22 nt, Homo sapiens
caacauccaccuccuggguuca

SEQ ID NO: 298579 - RNA, 22 nt, Homo sapiens
caacugcucacuccuggguuca

SEQ ID NO: 298580 - RNA, 22 nt, Homo sapiens
caagagaccugagugucauucu

SEQ ID NO: 298581 - RNA, 22 nt, Homo sapiens
caagagagcugaugguuuuaaa

SEQ ID NO: 298582 - RNA, 22 nt, Homo sapiens
caaggugcugagacaggagccc

SEQ ID NO: 298583 - RNA, 22 nt, Homo sapiens
caaguguuuccuuaaauacuug

SEQ ID NO: 298584 - RNA, 19 nt, Homo sapiens
caauacuucuuggcauaca

SEQ ID NO: 298585 - RNA, 22 nt, Homo sapiens
caauugcacucuuagguguaca

SEQ ID NO: 298586 - RNA, 22 nt, Homo sapiens
cacacugucuucaauggguggu

SEQ ID NO: 298587 - RNA, 22 nt, Homo sapiens
cacagcgacuuccgccuaccgg

SEQ ID NO: 298588 - RNA, 22 nt, Homo sapiens
cacagggcuaacauuuuugccc

SEQ ID NO: 298589 - RNA, 22 nt, Homo sapiens
cacagugaacugguggguuuuu

SEQ ID NO: 298590 - RNA, 22 nt, Homo sapiens
uaguaucacaagguguacaccc

SEQ ID NO: 298591 - RNA, 22 nt, Homo sapiens
uaguaucacauggucuuaauua

SEQ ID NO: 298592 - RNA, 22 nt, Homo sapiens
uaguaucauugaaacggcuugu

SEQ ID NO: 298593 - RNA, 22 nt, Homo sapiens
uaguauguuuauagcauugagu

SEQ ID NO: 298594 - RNA, 22 nt, Homo sapiens
uagucaaaucugaaggaaauuu

SEQ ID NO: 298595 - RNA, 22 nt, Homo sapiens
uagucccauaugauuuagugaa

SEQ ID NO: 298596 - RNA, 22 nt, Homo sapiens
uagugcugagauugagaagccc

SEQ ID NO: 298597 - RNA, 21 nt, Homo sapiens
uagugcugaggcaguauggga

SEQ ID NO: 298598 - RNA, 22 nt, Homo sapiens
uagugguaguagcaguaauauu

SEQ ID NO: 298599 - RNA, 22 nt, Homo sapiens
uaguguuuuucauuggcagagg

SEQ ID NO: 298600 - RNA, 22 nt, Homo sapiens
uauaugcaacauaguguaugug

SEQ ID NO: 298601 - RNA, 22 nt, Homo sapiens
uauaugucuuuguuauguugag

SEQ ID NO: 298602 - RNA, 22 nt, Homo sapiens
uauauguucuugcacuggaaag

SEQ ID NO: 298603 - RNA, 22 nt, Homo sapiens
uaucacacgccuugcuucauuu

SEQ ID NO: 298604 - RNA, 22 nt, Homo sapiens
uaucacaggucaggaaccuugu

SEQ ID NO: 298605 - RNA, 22 nt, Homo sapiens
uaucacaggucaggaaucuugc

SEQ ID NO: 298606 - RNA, 22 nt, Homo sapiens
uaucacaguaucuagcacagug

SEQ ID NO: 298607 - RNA, 22 nt, Homo sapiens
uaucaucauguuuuugcugugu

SEQ ID NO: 298608 - RNA, 22 nt, Homo sapiens
uaucaucauuggcaggugagaa

SEQ ID NO: 298609 - RNA, 22 nt, Homo sapiens
uaucauggaaagauguugaaau

SEQ ID NO: 298610 - RNA, 22 nt, Homo sapiens
uaucccaguggauguaccccau

SEQ ID NO: 298611 - RNA, 22 nt, Homo sapiens
uauccugaagcuuuauuuaagu

SEQ ID NO: 298612 - RNA, 22 nt, Homo sapiens
uaucuacauguagguauguaug

SEQ ID NO: 298613 - RNA, 22 nt, Homo sapiens
uaucucuguggguagugcugaa

SEQ ID NO: 298614 - RNA, 22 nt, Homo sapiens
uaugacuuuugaauacagaugg

SEQ ID NO: 298615 - RNA, 17 nt, Homo sapiens
uauguaguacuuauaaa

SEQ ID NO: 298616 - RNA, 22 nt, Homo sapiens
uaugucuuuugcuugcaaauag

SEQ ID NO: 298617 - RNA, 22 nt, Homo sapiens
uaugugcuuuguuaaacagaug

SEQ ID NO: 298618 - RNA, 22 nt, Homo sapiens
uauucacaggugugggacaaag

SEQ ID NO: 298619 - RNA, 22 nt, Homo sapiens
uauuccacuauuaguccagaug

SEQ ID NO: 298620 - RNA, 18 nt, Homo sapiens
uauuccucuuccucuauc

SEQ ID NO: 298621 - RNA, 22 nt, Homo sapiens
uauugaauuugagcugucucuu

SEQ ID NO: 298622 - RNA, 22 nt, Homo sapiens
uauugaauuuuuaagcccuuug

SEQ ID NO: 298623 - RNA, 20 nt, Homo sapiens
uauugcacuccagucugggc

SEQ ID NO: 298624 - RNA, 22 nt, Homo sapiens
uauugcauuugagguugguuga

SEQ ID NO: 298625 - RNA, 22 nt, Homo sapiens
uauugccugucuccaaaaauca

SEQ ID NO: 298626 - RNA, 22 nt, Homo sapiens
uauugcuugaggaaaugguaau

SEQ ID NO: 298627 - RNA, 22 nt, Homo sapiens
uauuguuuuucccaggagucua

SEQ ID NO: 298628 - RNA, 22 nt, Homo sapiens
uauuugauuaacaagagccuaa

SEQ ID NO: 298629 - RNA, 22 nt, Homo sapiens
uauuugcacucccaucauggug

SEQ ID NO: 298630 - RNA, 22 nt, Homo sapiens
uauuugguagcuauuuugcagu

SEQ ID NO: 298631 - RNA, 22 nt, Homo sapiens
uauuuggugaaugaaugcaugu

SEQ ID NO: 298632 - RNA, 22 nt, Homo sapiens
uauuugguuauaugaguaaguu

SEQ ID NO: 298633 - RNA, 22 nt, Homo sapiens
ucaaaaucucuuagcugugucu

SEQ ID NO: 298634 - RNA, 22 nt, Homo sapiens
ucaaacacuccauaucgcgauu

SEQ ID NO: 298635 - RNA, 20 nt, Homo sapiens
ucaaagacauggcugucaga

SEQ ID NO: 298636 - RNA, 20 nt, Homo sapiens
ucaaaguaugcucugcacua

SEQ ID NO: 298637 - RNA, 22 nt, Homo sapiens
ucaaagugacaaaguugcagca

SEQ ID NO: 298638 - RNA, 22 nt, Homo sapiens
ucaaagugcuauggcucagguu

SEQ ID NO: 298639 - RNA, 22 nt, Homo sapiens
ucaaaucaucuuuuccaaagcu

SEQ ID NO: 298640 - RNA, 22 nt, Homo sapiens
ucaaaugauucacccaccuuug

SEQ ID NO: 298641 - RNA, 17 nt, Homo sapiens
ucaaaugcucccaguga

SEQ ID NO: 298642 - RNA, 22 nt, Homo sapiens
ucaaaugcucuuugcagagagg

SEQ ID NO: 298643 - RNA, 22 nt, Homo sapiens
ucaaaugcuguauuguaguaau

SEQ ID NO: 298644 - RNA, 22 nt, Homo sapiens
ucaaauguucccuguacuggcc

SEQ ID NO: 298645 - RNA, 22 nt, Homo sapiens
ucaacugcuugagaucacaaau

SEQ ID NO: 298646 - RNA, 22 nt, Homo sapiens
ucaagaccucacauagaggaga

SEQ ID NO: 298647 - RNA, 22 nt, Homo sapiens
ucaagcaauucuccugccucag

SEQ ID NO: 298648 - RNA, 22 nt, Homo sapiens
ucaagcaauucugcugccucag

SEQ ID NO: 298649 - RNA, 19 nt, Homo sapiens
ucaagcuauucuccugccu

SEQ ID NO: 298650 - RNA, 21 nt, Homo sapiens
ucaaggaguauacguaugcca

SEQ ID NO: 298651 - RNA, 22 nt, Homo sapiens
ucaaugaaugaugguugguaug

SEQ ID NO: 298652 - RNA, 22 nt, Homo sapiens
ucaauugcaucaacaguguaca

SEQ ID NO: 298653 - RNA, 22 nt, Homo sapiens
ucacagauaaauaaagaugauu

SEQ ID NO: 298654 - RNA, 19 nt, Homo sapiens
ucacaggguugacuugagg

SEQ ID NO: 298655 - RNA, 22 nt, Homo sapiens
ucacaguaaauccagaagaaau

SEQ ID NO: 298656 - RNA, 22 nt, Homo sapiens
ucacagucuccucuagggaggg

SEQ ID NO: 298657 - RNA, 22 nt, Homo sapiens
ucacaguguuaaaccuuucuuu

SEQ ID NO: 298658 - RNA, 22 nt, Homo sapiens
ucacaugaagauuuuaguauac

SEQ ID NO: 298659 - RNA, 22 nt, Homo sapiens
ucacaugugacauauauauuug

SEQ ID NO: 298660 - RNA, 22 nt, Homo sapiens
ucacauuaagcuguuauuucuu

SEQ ID NO: 298661 - RNA, 22 nt, Homo sapiens
ucacauucaauuguaauccccg

SEQ ID NO: 298662 - RNA, 22 nt, Homo sapiens
ucaccaccuuccaggaccacug

SEQ ID NO: 298663 - RNA, 22 nt, Homo sapiens
ucaccuggagccuucacauucu

SEQ ID NO: 298664 - RNA, 22 nt, Homo sapiens
ucacuauugacaacagugugga

SEQ ID NO: 298665 - RNA, 22 nt, Homo sapiens
ucacugcgaccuccaccucccg

SEQ ID NO: 298666 - RNA, 22 nt, Homo sapiens
ucacugcgaccuccaccuccug

SEQ ID NO: 298667 - RNA, 22 nt, Homo sapiens
ucacuggagauagcaaucuggu

SEQ ID NO: 298668 - RNA, 22 nt, Homo sapiens
ucacuggaggagaggaagugga

SEQ ID NO: 298669 - RNA, 22 nt, Homo sapiens
ucacuuuguuuuuggauaaguu

SEQ ID NO: 298670 - RNA, 22 nt, Homo sapiens
ucagaacugaacaaaccagucu

SEQ ID NO: 298671 - RNA, 22 nt, Homo sapiens
ucagagcaaagacacuuuauca

SEQ ID NO: 298672 - RNA, 22 nt, Homo sapiens
ucagaguggagucugcagccuu

SEQ ID NO: 298673 - RNA, 22 nt, Homo sapiens
ucagauugaugcauacuuaaau

SEQ ID NO: 298674 - RNA, 21 nt, Homo sapiens
ucaggaccucuaguuagccag

SEQ ID NO: 298675 - RNA, 22 nt, Homo sapiens
ucaguacuuuggagcucacaua

SEQ ID NO: 298676 - RNA, 22 nt, Homo sapiens
ucagucauugauggaguagguc

SEQ ID NO: 298677 - RNA, 22 nt, Homo sapiens
ucagucuuuuuuuggcaagcau

SEQ ID NO: 298678 - RNA, 22 nt, Homo sapiens
ucagugcuguaccaucuaagga

SEQ ID NO: 298679 - RNA, 22 nt, Homo sapiens
ucagugcuuuuuguugucauca

SEQ ID NO: 298680 - RNA, 22 nt, Homo sapiens
ucaguguugauggcugcugacu

SEQ ID NO: 298681 - RNA, 19 nt, Homo sapiens
ucauagucuaagaugagaa

SEQ ID NO: 298682 - RNA, 22 nt, Homo sapiens
ucaucagaguuuacaagcucag

SEQ ID NO: 298683 - RNA, 22 nt, Homo sapiens
ucaucaguggggaugugguuga

SEQ ID NO: 298684 - RNA, 20 nt, Homo sapiens
ucaucaguuggugcucgcug

SEQ ID NO: 298685 - RNA, 22 nt, Homo sapiens
ucaugaaguaguuaacugguug

SEQ ID NO: 298686 - RNA, 22 nt, Homo sapiens
ucaugacacuggcaggagcuaa

SEQ ID NO: 298687 - RNA, 22 nt, Homo sapiens
ucaugaccaugguauagaccac

SEQ ID NO: 298688 - RNA, 22 nt, Homo sapiens
ucaugagacacacuggaaagga

SEQ ID NO: 298689 - RNA, 22 nt, Homo sapiens
ucaugcaucuuguggaauuuga

SEQ ID NO: 298690 - RNA, 22 nt, Homo sapiens
ucaugguuuuauaacccucuug

SEQ ID NO: 298691 - RNA, 22 nt, Homo sapiens
ucaugugaggauaacaauagug

SEQ ID NO: 298692 - RNA, 22 nt, Homo sapiens
ucauugcaaucucugccucccg

SEQ ID NO: 298693 - RNA, 22 nt, Homo sapiens
ucauugcuuauuuguuggugga

SEQ ID NO: 298694 - RNA, 22 nt, Homo sapiens
ucauugguagcucauggaaccg

SEQ ID NO: 298695 - RNA, 18 nt, Homo sapiens
ucauuggugagcaccucc

SEQ ID NO: 298696 - RNA, 21 nt, Homo sapiens
ugaaugcuuuaaauauuagaa

SEQ ID NO: 298697 - RNA, 20 nt, Homo sapiens
ugaauguaauuacagaugua

SEQ ID NO: 298698 - RNA, 22 nt, Homo sapiens
ugaauguacacgcguacuuguu

SEQ ID NO: 298699 - RNA, 22 nt, Homo sapiens
ugaauguuugcagcuuauacca

SEQ ID NO: 298700 - RNA, 22 nt, Homo sapiens
ugacaagagaccccuccgcagg

SEQ ID NO: 298701 - RNA, 19 nt, Homo sapiens
ugacacuguuggugggagg

SEQ ID NO: 298702 - RNA, 22 nt, Homo sapiens
ugacagagcaggacuucaucuc

SEQ ID NO: 298703 - RNA, 18 nt, Homo sapiens
ugacagcacaugugggga

SEQ ID NO: 298704 - RNA, 22 nt, Homo sapiens
ugacagcaucaggauuggagag

SEQ ID NO: 298705 - RNA, 22 nt, Homo sapiens
ugacagcugaagauguugaacc

SEQ ID NO: 298706 - RNA, 22 nt, Homo sapiens
ugacagugugagacuuugucuc

SEQ ID NO: 298707 - RNA, 22 nt, Homo sapiens
ugacagugugagauccugucuc

SEQ ID NO: 298708 - RNA, 18 nt, Homo sapiens
ugacaucauuuagaaagg

SEQ ID NO: 298709 - RNA, 22 nt, Homo sapiens
ugacaugaagaaaaacagauuu

SEQ ID NO: 298710 - RNA, 21 nt, Homo sapiens
ugacauuauuucaugucagua

SEQ ID NO: 298711 - RNA, 22 nt, Homo sapiens
ugaccucugauagcaguaggug

SEQ ID NO: 298712 - RNA, 23 nt, Homo sapiens
ugacugaguauauguuuggugcu

SEQ ID NO: 298713 - RNA, 22 nt, Homo sapiens
ugacuugaucauuacacauucu

SEQ ID NO: 298714 - RNA, 22 nt, Homo sapiens
ugagaacugccuguauuuaucu

SEQ ID NO: 298715 - RNA, 22 nt, Homo sapiens
ugagaauauuugaagauguuag

SEQ ID NO: 298716 - RNA, 22 nt, Homo sapiens
ugagacacuucccagaucccuu

SEQ ID NO: 298717 - RNA, 22 nt, Homo sapiens
ugagaccuuucauuucucagug

SEQ ID NO: 298718 - RNA, 22 nt, Homo sapiens
ugagacgaagucuugcucuguu

SEQ ID NO: 298719 - RNA, 22 nt, Homo sapiens
ugagagaugaacuauucuugaa

SEQ ID NO: 298720 - RNA, 22 nt, Homo sapiens
ugagagaugauaaaauguuugu

SEQ ID NO: 298721 - RNA, 22 nt, Homo sapiens
ugagaggugaauggcaggcuca

SEQ ID NO: 298722 - RNA, 22 nt, Homo sapiens
ugagaggugauaaagcaagggu

SEQ ID NO: 298723 - RNA, 22 nt, Homo sapiens
ugagagucauacaaauaaaaau

SEQ ID NO: 298724 - RNA, 18 nt, Homo sapiens
ugagauacuagaauaggu

SEQ ID NO: 298725 - RNA, 22 nt, Homo sapiens
ugugggaggugcuaauguaaau

SEQ ID NO: 298726 - RNA, 22 nt, Homo sapiens
uguguaaauaugauagaggaau

SEQ ID NO: 298727 - RNA, 22 nt, Homo sapiens
uguguacugcagaguauucugu

SEQ ID NO: 298728 - RNA, 22 nt, Homo sapiens
ugugucacugcacuccagccug

SEQ ID NO: 298729 - RNA, 22 nt, Homo sapiens
ugugucuacugagaugaucaug

SEQ ID NO: 298730 - RNA, 22 nt, Homo sapiens
ugugucuugaauuuuguaugua

SEQ ID NO: 298731 - RNA, 22 nt, Homo sapiens
ugugucuuguuuuuucccaggc

SEQ ID NO: 298732 - RNA, 22 nt, Homo sapiens
uguguuuuuauguaaaauggaa

SEQ ID NO: 298733 - RNA, 21 nt, Homo sapiens
uguuaacaugcagauuacugg

SEQ ID NO: 298734 - RNA, 22 nt, Homo sapiens
uguucuggagaguuuagucugg

SEQ ID NO: 298735 - RNA, 22 nt, Homo sapiens
uguugcuuaagccacccagucu

SEQ ID NO: 298736 - RNA, 18 nt, Homo sapiens
uguugguguucacucacu

SEQ ID NO: 298737 - RNA, 22 nt, Homo sapiens
uguuugcuguguggaguagcag

SEQ ID NO: 298738 - RNA, 22 nt, Homo sapiens
uguuugguggucucuucacaug

SEQ ID NO: 298739 - RNA, 22 nt, Homo sapiens
uuaaaaguauaggccuggcaua

SEQ ID NO: 298740 - RNA, 22 nt, Homo sapiens
uuaaaguaauugaaauggccuu

SEQ ID NO: 298741 - RNA, 22 nt, Homo sapiens
uuaaagugaucauaaggauagu

SEQ ID NO: 298742 - RNA, 22 nt, Homo sapiens
uuaacagcacuacguggggauc

SEQ ID NO: 298743 - RNA, 22 nt, Homo sapiens
uuaagaagugauuuuccucauu

SEQ ID NO: 298744 - RNA, 22 nt, Homo sapiens
uuaagccaggugugguggcaca

SEQ ID NO: 298745 - RNA, 19 nt, Homo sapiens
uuaagguacuuagaugugu

SEQ ID NO: 298746 - RNA, 22 nt, Homo sapiens
uuaaguaaucagagaagagaac

SEQ ID NO: 298747 - RNA, 21 nt, Homo sapiens
uuaaguaauuacccaacucuc

SEQ ID NO: 298748 - RNA, 22 nt, Homo sapiens
uuaauuguaucuauagauguca

SEQ ID NO: 298749 - RNA, 22 nt, Homo sapiens
uuacaaccucagcagugcaaag

SEQ ID NO: 298750 - RNA, 22 nt, Homo sapiens
uuacaagaugucuguccaacac

SEQ ID NO: 298751 - RNA, 22 nt, Homo sapiens
uuacaaguggcaucucucugga

SEQ ID NO: 298752 - RNA, 22 nt, Homo sapiens
uuacacaguaggucccuaguaa

SEQ ID NO: 298753 - RNA, 22 nt, Homo sapiens
uuacaccuguaauccagcacuu

SEQ ID NO: 298754 - RNA, 22 nt, Homo sapiens
uuacagauggcacacucaaggg

SEQ ID NO: 298755 - RNA, 22 nt, Homo sapiens
uuacagucaccugggggacaua

SEQ ID NO: 298756 - RNA, 22 nt, Homo sapiens
uuacauguuguggguuguggcc

SEQ ID NO: 298757 - RNA, 22 nt, Homo sapiens
uuacccauuagagaauuuaaga

SEQ ID NO: 298758 - RNA, 22 nt, Homo sapiens
uuacugcauaauuccugggaag

SEQ ID NO: 298759 - RNA, 22 nt, Homo sapiens
uuucuuggagcucuuagggucg

SEQ ID NO: 298760 - RNA, 22 nt, Homo sapiens
uuucuugguuguauuuagacuu

SEQ ID NO: 298761 - RNA, 19 nt, Homo sapiens
uuugaauauaaugcagcua

SEQ ID NO: 298762 - RNA, 22 nt, Homo sapiens
uuugagcaggcuaaucaauaua

SEQ ID NO: 298763 - RNA, 22 nt, Homo sapiens
uuugaguuugaggugcugauga

SEQ ID NO: 298764 - RNA, 22 nt, Homo sapiens
uuugcaagaugaaaaaguucua

SEQ ID NO: 298765 - RNA, 22 nt, Homo sapiens
uuugcaauguugugauggugaa

SEQ ID NO: 298766 - RNA, 22 nt, Homo sapiens
uuuggaaugugcacucagauug

SEQ ID NO: 298767 - RNA, 22 nt, Homo sapiens
uuuggcacuguaaauuucucuu

SEQ ID NO: 298768 - RNA, 22 nt, Homo sapiens
uuuggcaguuauuuacucagug

SEQ ID NO: 298769 - RNA, 22 nt, Homo sapiens
uuuggcauuagagagacuugca

SEQ ID NO: 298770 - RNA, 23 nt, Homo sapiens
uuuggcauuccagaaauuuucau

SEQ ID NO: 298771 - RNA, 22 nt, Homo sapiens
uuuggcuguuucuggacuaaga

SEQ ID NO: 298772 - RNA, 22 nt, Homo sapiens
uuuggcuuuuguaauaacugcc

SEQ ID NO: 298773 - RNA, 22 nt, Homo sapiens
uuugguguauauguaaacuaug

SEQ ID NO: 298774 - RNA, 22 nt, Homo sapiens
uuugguuauauauauacacucu

SEQ ID NO: 298775 - RNA, 22 nt, Homo sapiens
uuuguacacuguugguaggauu

SEQ ID NO: 298776 - RNA, 22 nt, Homo sapiens
uuuguacuaugguuuuucacua

SEQ ID NO: 298777 - RNA, 18 nt, Homo sapiens
uuugugcuccacaaagga

SEQ ID NO: 298778 - RNA, 22 nt, Homo sapiens
uuugugcugcaauuaauuuccc

SEQ ID NO: 298779 - RNA, 22 nt, Homo sapiens
uuuguggaaugcucauguguag

SEQ ID NO: 298780 - RNA, 23 nt, Homo sapiens
uuuguguccccacccaaaucuca

SEQ ID NO: 298781 - RNA, 22 nt, Homo sapiens
uuuuaagcuacaagagacauau

SEQ ID NO: 298782 - RNA, 20 nt, Homo sapiens
uuuuagcuuuuauugaaagc

SEQ ID NO: 298783 - RNA, 22 nt, Homo sapiens
uuuugcuccuggcaaacucaua

SEQ ID NO: 298784 - RNA, 22 nt, Homo sapiens
uuuugcucuucauagguccugu

SEQ ID NO: 298785 - RNA, 17 nt, Homo sapiens
uuuuggauuagaaaucc

SEQ ID NO: 298786 - RNA, 22 nt, Homo sapiens
uuuuggcuuuuccucagcaagc

SEQ ID NO: 298787 - RNA, 22 nt, Homo sapiens
uuuuggucuccaguuucugcug

SEQ ID NO: 298788 - RNA, 22 nt, Homo sapiens
uuuugguuuuauccagggucuc

SEQ ID NO: 298789 - RNA, 21 nt, Homo sapiens
uuuugugcaugugcagccugc

SEQ ID NO: 298790 - RNA, 22 nt, Homo sapiens
uuuuuauggccaauccucagaa

SEQ ID NO: 298791 - RNA, 22 nt, Homo sapiens
uuuuugaguagcuggagagcag

SEQ ID NO: 298792 - RNA, 22 nt, Homo sapiens
uuuuuggauaaugguacaugua

SEQ ID NO: 298793 - RNA, 22 nt, Homo sapiens
uuuuugguugguaggcuauuaa

SEQ ID NO: 298794 - RNA, 22 nt, Homo sapiens
uuuuugugguauauugcaacaa

SEQ ID NO: 298795 - RNA, 22 nt, Homo sapiens
gggaacauggaaauucugcucu

SEQ ID NO: 298796 - RNA, 22 nt, Homo sapiens
gggaugaagcccuaggguuggu

SEQ ID NO: 298797 - RNA, 22 nt, Homo sapiens
gggcacgugugugcugugcuca

SEQ ID NO: 298798 - RNA, 22 nt, Homo sapiens
ggggaauguuaaagaauuugca

SEQ ID NO: 298799 - RNA, 22 nt, Homo sapiens
gguaacaguggggcuaugcuua

SEQ ID NO: 298800 - RNA, 22 nt, Homo sapiens
gguauuauuugccuuuuacuga

SEQ ID NO: 298801 - RNA, 22 nt, Homo sapiens
ggucacauugcuagcauggguu

SEQ ID NO: 298802 - RNA, 22 nt, Homo sapiens
ggucauggauaagauccagaag

SEQ ID NO: 298803 - RNA, 21 nt, Homo sapiens
ggugagaaaggagacauagac

SEQ ID NO: 298804 - RNA, 22 nt, Homo sapiens
ggugagaaagggauuccuguuc

SEQ ID NO: 298805 - RNA, 22 nt, Homo sapiens
ggugaggaaaguugaguuucua

SEQ ID NO: 298806 - RNA, 22 nt, Homo sapiens
gguggcuuuuugugauggcuga

SEQ ID NO: 298807 - RNA, 22 nt, Homo sapiens
gguggucuuccccuggaguucg

SEQ ID NO: 298808 - RNA, 22 nt, Homo sapiens
ggugucaguuggccccuacugg

SEQ ID NO: 298809 - RNA, 22 nt, Homo sapiens
guaaauguccccugugauauug

SEQ ID NO: 298810 - RNA, 22 nt, Homo sapiens
guaacacucuaaagggaugcac

SEQ ID NO: 298811 - RNA, 22 nt, Homo sapiens
guaacccuguaggccuaaagua

SEQ ID NO: 298812 - RNA, 22 nt, Homo sapiens
guaagguuguauuucaagaaac

SEQ ID NO: 298813 - RNA, 22 nt, Homo sapiens
guaaucucagcuacucaggagg

SEQ ID NO: 298814 - RNA, 22 nt, Homo sapiens
guacacaacaugcagguuuguu

SEQ ID NO: 298815 - RNA, 22 nt, Homo sapiens
guacauggaaugaaauucaaaa

SEQ ID NO: 298816 - RNA, 22 nt, Homo sapiens
guagaaagcauuucagauuugc

SEQ ID NO: 298817 - RNA, 22 nt, Homo sapiens
guaggcacuggcucagcuuauc

SEQ ID NO: 298818 - RNA, 22 nt, Homo sapiens
guaucauugccuaaugcucuca

SEQ ID NO: 298819 - RNA, 22 nt, Homo sapiens
guaucauuggcauguaaccaga

SEQ ID NO: 298820 - RNA, 22 nt, Homo sapiens
guaugacacaggaagcuuaacc

SEQ ID NO: 298821 - RNA, 22 nt, Homo sapiens
guauuagaugguauuugaagau

SEQ ID NO: 298822 - RNA, 18 nt, Homo sapiens
guauuccagccugaguga

SEQ ID NO: 298823 - RNA, 19 nt, Homo sapiens
gucaaagucgguauucaaa

SEQ ID NO: 298824 - RNA, 22 nt, Homo sapiens
gucaggaugauuuggggaggug

SEQ ID NO: 298825 - RNA, 22 nt, Homo sapiens
gucagugcauguaaacauaaaa

SEQ ID NO: 298826 - RNA, 22 nt, Homo sapiens
gucauccaggcuggagugaagc

SEQ ID NO: 298827 - RNA, 22 nt, Homo sapiens
gucauggagggacauaacuaac

SEQ ID NO: 298828 - RNA, 22 nt, Homo sapiens
gucauugguucuguuuauguga

SEQ ID NO: 298829 - RNA, 22 nt, Homo sapiens
guccuggagaagcguggaccgg

SEQ ID NO: 298830 - RNA, 22 nt, Homo sapiens
gucuaugagucccugaauuuaa

SEQ ID NO: 298831 - RNA, 22 nt, Homo sapiens
gucucacagcuagcugcuuuau

SEQ ID NO: 298832 - RNA, 22 nt, Homo sapiens
gucucccaaccccugugcccag

SEQ ID NO: 298833 - RNA, 22 nt, Homo sapiens
gucuggcaauggcagacuggca

SEQ ID NO: 298834 - RNA, 22 nt, Homo sapiens
gugaaagcaucugacugugcca

SEQ ID NO: 298835 - RNA, 22 nt, Homo sapiens
gugaaauguguagaggaucugg

SEQ ID NO: 298836 - RNA, 22 nt, Homo sapiens
gugacauuuuuacugaugagag

SEQ ID NO: 298837 - RNA, 22 nt, Homo sapiens
gugacugcauccauccaggcuu

SEQ ID NO: 298838 - RNA, 22 nt, Homo sapiens
gugagaugaggucucacucugu

SEQ ID NO: 298839 - RNA, 22 nt, Homo sapiens
gugagcacugaaagaaggcaag

SEQ ID NO: 298840 - RNA, 22 nt, Homo sapiens
gugagcuaagcaaauaugagcc

SEQ ID NO: 298841 - RNA, 22 nt, Homo sapiens
gugaggaaggaaaccugcuagc

SEQ ID NO: 298842 - RNA, 22 nt, Homo sapiens
gugaggcacugcugcuuuccag

SEQ ID NO: 298843 - RNA, 22 nt, Homo sapiens
gugaggcugguccugccuccca

SEQ ID NO: 298844 - RNA, 22 nt, Homo sapiens
gugagguagagcaugugaaaga

SEQ ID NO: 298845 - RNA, 17 nt, Homo sapiens
gugagguauccucaaaa

SEQ ID NO: 298846 - RNA, 22 nt, Homo sapiens
gugaugacauucagagaugaag

SEQ ID NO: 298847 - RNA, 22 nt, Homo sapiens
gugcaaugagaaggggcucugg

SEQ ID NO: 298848 - RNA, 22 nt, Homo sapiens
gugcaaugucaggagaugcagc

SEQ ID NO: 298849 - RNA, 22 nt, Homo sapiens
gugcacuguagaacccuuuguu

SEQ ID NO: 298850 - RNA, 21 nt, Homo sapiens
gugcuuguagccucacuucug

SEQ ID NO: 298851 - RNA, 21 nt, Homo sapiens
guggaaauggaauuuacuaau

SEQ ID NO: 298852 - RNA, 22 nt, Homo sapiens
guggaagucuuugguauuggua

SEQ ID NO: 298853 - RNA, 17 nt, Homo sapiens
guggaaugucaugucaa

SEQ ID NO: 298854 - RNA, 22 nt, Homo sapiens
guggaucacuugaggucaagag

SEQ ID NO: 298855 - RNA, 22 nt, Homo sapiens
guggcacgaugaucugggcuca

SEQ ID NO: 298856 - RNA, 22 nt, Homo sapiens
gugguucuagagggacagaaug

SEQ ID NO: 298857 - RNA, 22 nt, Homo sapiens
guguaauacacacauauaugca

SEQ ID NO: 298858 - RNA, 22 nt, Homo sapiens
gugucaugagggggacaggaag

SEQ ID NO: 298859 - RNA, 22 nt, Homo sapiens
guguccucgaguacacaucagg

SEQ ID NO: 298860 - RNA, 22 nt, Homo sapiens
gugugcauaugucuuuauagua

SEQ ID NO: 298861 - RNA, 21 nt, Homo sapiens
gugugcuugaauucagcuguc

SEQ ID NO: 298862 - RNA, 22 nt, Homo sapiens
guuaaagacauccacauaggag

SEQ ID NO: 298863 - RNA, 23 nt, Homo sapiens
guuaagugaauguguacucuauu

SEQ ID NO: 298864 - RNA, 22 nt, Homo sapiens
guucaagugauucuacugccuc

SEQ ID NO: 298865 - RNA, 22 nt, Homo sapiens
guucaaguuuucucuugugggu

SEQ ID NO: 298866 - RNA, 22 nt, Homo sapiens
uuucauggaauauagucauuuu

SEQ ID NO: 298867 - RNA, 22 nt, Homo sapiens
uuucauggaggauuugcuucuu

SEQ ID NO: 298868 - RNA, 22 nt, Homo sapiens
uuucauguuuuucugugaggca

SEQ ID NO: 298869 - RNA, 19 nt, Homo sapiens
uuucauguuuuuggugaga

SEQ ID NO: 298870 - RNA, 22 nt, Homo sapiens
uuuccaguuggaaagccuguuu

SEQ ID NO: 298871 - RNA, 22 nt, Homo sapiens
uuucccuuacuuaaacuuacuc

SEQ ID NO: 298872 - RNA, 22 nt, Homo sapiens
uuucccuuuagcuuagugauuu

SEQ ID NO: 298873 - RNA, 22 nt, Homo sapiens
uuucccuuugcuuugucagcca

SEQ ID NO: 298874 - RNA, 20 nt, Homo sapiens
uuucuccccuauaaaucuca

SEQ ID NO: 298875 - RNA, 22 nt, Homo sapiens
uuucugcuugagagaauugcug

SEQ ID NO: 298876 - RNA, 22 nt, Homo sapiens
uuugaaaguaauuugguuggug

SEQ ID NO: 298877 - RNA, 22 nt, Homo sapiens
uuugacuaccaggaauguucuu

SEQ ID NO: 298878 - RNA, 22 nt, Homo sapiens
uuugacuuuuagaauaugaguu

SEQ ID NO: 298879 - RNA, 22 nt, Homo sapiens
uuugagaaugcuaccagagaag

SEQ ID NO: 298880 - RNA, 22 nt, Homo sapiens
uuugagaucuuuagaaucaggc

SEQ ID NO: 298881 - RNA, 22 nt, Homo sapiens
uuugagcaugcagauugccagg

SEQ ID NO: 298882 - RNA, 22 nt, Homo sapiens
uuugauguccaccucagcccac

SEQ ID NO: 298883 - RNA, 22 nt, Homo sapiens
uuugauguugagacuauaaagc

SEQ ID NO: 298884 - RNA, 22 nt, Homo sapiens
uuugcacuugaaaacacucuca

SEQ ID NO: 298885 - RNA, 22 nt, Homo sapiens
uuugcaguguaguuggccagca

SEQ ID NO: 298886 - RNA, 22 nt, Homo sapiens
uuugccaaugggaauuuuccua

SEQ ID NO: 298887 - RNA, 18 nt, Homo sapiens
uuugccacuucccagaaa

SEQ ID NO: 298888 - RNA, 22 nt, Homo sapiens
uuugcuuaaaucuuaaucagau

SEQ ID NO: 298889 - RNA, 20 nt, Homo sapiens
uuuggcaauaggguuuuugu

SEQ ID NO: 298890 - RNA, 22 nt, Homo sapiens
uuuggcaauuugacuguauagg

SEQ ID NO: 298891 - RNA, 22 nt, Homo sapiens
uuuggcacuauagguaaauuug

SEQ ID NO: 298892 - RNA, 22 nt, Homo sapiens
uuuggcagaaaacaagaaucug

SEQ ID NO: 298893 - RNA, 22 nt, Homo sapiens
uuuggcuuaagauugacugcaa

SEQ ID NO: 298894 - RNA, 21 nt, Homo sapiens
uuuggcuucucugcugcagcc

SEQ ID NO: 298895 - RNA, 22 nt, Homo sapiens
uuuggcuuugagaagcagugga

SEQ ID NO: 298896 - RNA, 22 nt, Homo sapiens
uuugggacuguauuaaaugccu

SEQ ID NO: 298897 - RNA, 22 nt, Homo sapiens
uuugguaauguuucauugcaga

SEQ ID NO: 298898 - RNA, 18 nt, Homo sapiens
uuugguccuuuauaaaca

SEQ ID NO: 298899 - RNA, 22 nt, Homo sapiens
uuugguguauaaaaaugcuagu

SEQ ID NO: 298900 - RNA, 22 nt, Homo sapiens
uuuguaagaugcauagauugca

SEQ ID NO: 298901 - RNA, 22 nt, Homo sapiens
uuugucacccugaauguaagau

SEQ ID NO: 298902 - RNA, 22 nt, Homo sapiens
uuugucauagcagcaggaaugg

SEQ ID NO: 298903 - RNA, 22 nt, Homo sapiens
uuugugacacaaacacauauau

SEQ ID NO: 298904 - RNA, 22 nt, Homo sapiens
uuugugcaugaagagggggugc

SEQ ID NO: 298905 - RNA, 22 nt, Homo sapiens
uuugugcuaacuuuaacucuua

SEQ ID NO: 298906 - RNA, 22 nt, Homo sapiens
uuugugcuauguuauauauucu

SEQ ID NO: 298907 - RNA, 22 nt, Homo sapiens
uuugugcuccuaugagaaucua

SEQ ID NO: 298908 - RNA, 22 nt, Homo sapiens
uuugugcuccucucaguaugug

SEQ ID NO: 298909 - RNA, 23 nt, Homo sapiens
uuugugucccucuagaauucaug

SEQ ID NO: 298910 - RNA, 22 nt, Homo sapiens
uuuuagcagccaugacaaagau

SEQ ID NO: 298911 - RNA, 22 nt, Homo sapiens
uuuuagcuuuucccaggacucc

SEQ ID NO: 298912 - RNA, 21 nt, Homo sapiens
uuuugcacacuaugcagcuuu

SEQ ID NO: 298913 - RNA, 22 nt, Homo sapiens
uuuugcucuucggaagagcuug

SEQ ID NO: 298914 - RNA, 19 nt, Homo sapiens
uuuugcucuuuauaccuau

SEQ ID NO: 298915 - RNA, 22 nt, Homo sapiens
uuuuggcucugucuguaucuuu

SEQ ID NO: 298916 - RNA, 20 nt, Homo sapiens
uuuuggcuuaaagcagucug

SEQ ID NO: 298917 - RNA, 21 nt, Homo sapiens
uuuuggucauucaggaagaaa

SEQ ID NO: 298918 - RNA, 22 nt, Homo sapiens
uuuugugcauggcccaguggua

SEQ ID NO: 298919 - RNA, 18 nt, Homo sapiens
uuuuugaggcacagggga

SEQ ID NO: 298920 - RNA, 22 nt, Homo sapiens
uuuuugagguauaguguggcua

SEQ ID NO: 298921 - RNA, 22 nt, Homo sapiens
uuuuugaguaaauauaaauugu

SEQ ID NO: 298922 - RNA, 16 nt, Homo sapiens
uuuuugcagaaaugac

SEQ ID NO: 298923 - RNA, 22 nt, Homo sapiens
uuuuuggguaaugauuaucaau

SEQ ID NO: 298924 - RNA, 22 nt, Homo sapiens
gcuggguucagagugggcugcg

SEQ ID NO: 298925 - RNA, 22 nt, Homo sapiens
gcuggguugccagguuacuuaa

SEQ ID NO: 298926 - RNA, 22 nt, Homo sapiens
gcuggucugccguaguaggugc

SEQ ID NO: 298927 - RNA, 22 nt, Homo sapiens
gcugugguuuaguagaaagaag

SEQ ID NO: 298928 - RNA, 19 nt, Homo sapiens
gcuuagagacaaaacauug

SEQ ID NO: 298929 - RNA, 19 nt, Homo sapiens
gcuucuugaggacgaugac

SEQ ID NO: 298930 - RNA, 22 nt, Homo sapiens
ggaaagacaccuuacuauguua

SEQ ID NO: 298931 - RNA, 22 nt, Homo sapiens
ggaaaguccuucuguaggcucc

SEQ ID NO: 298932 - RNA, 22 nt, Homo sapiens
ggaaaucucugaggcucccuuc

SEQ ID NO: 298933 - RNA, 22 nt, Homo sapiens
ggaacaccauuuuuccugccuu

SEQ ID NO: 298934 - RNA, 22 nt, Homo sapiens
ggaaugcagugagcauuagaua

SEQ ID NO: 298935 - RNA, 21 nt, Homo sapiens
ggaauguugccagcagccaga

SEQ ID NO: 298936 - RNA, 22 nt, Homo sapiens
ggacagugaaugccacuccucc

SEQ ID NO: 298937 - RNA, 22 nt, Homo sapiens
ggacauguauauauaugugugu

SEQ ID NO: 298938 - RNA, 22 nt, Homo sapiens
ggacuagggacauggggagcug

SEQ ID NO: 298939 - RNA, 22 nt, Homo sapiens
ggacugagaggacuacagugua

SEQ ID NO: 298940 - RNA, 22 nt, Homo sapiens
ggagauccucugcgggcaaaga

SEQ ID NO: 298941 - RNA, 22 nt, Homo sapiens
ggagaugaaaugagcuacuuaa

SEQ ID NO: 298942 - RNA, 22 nt, Homo sapiens
ggagguagucuuucccuuauca

SEQ ID NO: 298943 - RNA, 22 nt, Homo sapiens
ggagugucagaaacaguguccu

SEQ ID NO: 298944 - RNA, 22 nt, Homo sapiens
ggagugucccaaucucagcuca

SEQ ID NO: 298945 - RNA, 22 nt, Homo sapiens
ggaguguguaggagaaagguaa

SEQ ID NO: 298946 - RNA, 22 nt, Homo sapiens
ggauauguagggcauaucuaca

SEQ ID NO: 298947 - RNA, 22 nt, Homo sapiens
ggauugugauaauuguugcaaa

SEQ ID NO: 298948 - RNA, 22 nt, Homo sapiens
ggcaacaauuccuacuucuuuu

SEQ ID NO: 298949 - RNA, 22 nt, Homo sapiens
ggcaagaacuucacucacuuuu

SEQ ID NO: 298950 - RNA, 22 nt, Homo sapiens
ggcaaguauguuuuaggaugcu

SEQ ID NO: 298951 - RNA, 22 nt, Homo sapiens
ggcaaugucagcuaaugaugga

SEQ ID NO: 298952 - RNA, 22 nt, Homo sapiens
ggcacaaugucagcucacugca

SEQ ID NO: 298953 - RNA, 22 nt, Homo sapiens
ggcacugugaugugagggggua

SEQ ID NO: 298954 - RNA, 22 nt, Homo sapiens
ggcagcauugccuuugcaguga

SEQ ID NO: 298955 - RNA, 22 nt, Homo sapiens
ggcagcucaggccccgcgcuga

SEQ ID NO: 298956 - RNA, 22 nt, Homo sapiens
ggcaugcauuguacuaguaugc

SEQ ID NO: 298957 - RNA, 18 nt, Homo sapiens
ggcggguguuuuauucac

SEQ ID NO: 298958 - RNA, 22 nt, Homo sapiens
ggcuagauauucacauauggcu

SEQ ID NO: 298959 - RNA, 22 nt, Homo sapiens
ggcuuuggucacacaggggcaa

SEQ ID NO: 298960 - RNA, 22 nt, Homo sapiens
gggaaaaugucuauugaaugaa

SEQ ID NO: 298961 - RNA, 22 nt, Homo sapiens
aaaugacuuuuuaugcagagua

SEQ ID NO: 298962 - RNA, 22 nt, Homo sapiens
aaaugcuucuauguggcauguu

SEQ ID NO: 298963 - RNA, 22 nt, Homo sapiens
aaauggauuaaguucacuugcu

SEQ ID NO: 298964 - RNA, 22 nt, Homo sapiens
aaauggcuuuuugggcaaggug

SEQ ID NO: 298965 - RNA, 22 nt, Homo sapiens
aaaugguguuaguagaucuuua

SEQ ID NO: 298966 - RNA, 22 nt, Homo sapiens
aaauuguccuacugguuugagu

SEQ ID NO: 298967 - RNA, 21 nt, Homo sapiens
aacacggugaaaucccgucuc

SEQ ID NO: 298968 - RNA, 22 nt, Homo sapiens
aacagugcuguuauaaauguac

SEQ ID NO: 298969 - RNA, 22 nt, Homo sapiens
aagagguaggaaauggucauuu

SEQ ID NO: 298970 - RNA, 23 nt, Homo sapiens
aagagguaugacuaugaagugga

SEQ ID NO: 298971 - RNA, 22 nt, Homo sapiens
aagauagcuaagcuucuucuaa

SEQ ID NO: 298972 - RNA, 22 nt, Homo sapiens
aagaucauucagggaaggcuga

SEQ ID NO: 298973 - RNA, 19 nt, Homo sapiens
aagaugauguuugggcuaa

SEQ ID NO: 298974 - RNA, 22 nt, Homo sapiens
aagcagacauguucauuuugaa

SEQ ID NO: 298975 - RNA, 20 nt, Homo sapiens
aagcagacauuuggaugaaa

SEQ ID NO: 298976 - RNA, 22 nt, Homo sapiens
aagcaucacauaauggaucaug

SEQ ID NO: 298977 - RNA, 22 nt, Homo sapiens
aagcuacauuuuauuuauguca

SEQ ID NO: 298978 - RNA, 22 nt, Homo sapiens
aagcuacuuuggugguuccuua

SEQ ID NO: 298979 - RNA, 22 nt, Homo sapiens
aagcuggagugcaguggugcga

SEQ ID NO: 298980 - RNA, 22 nt, Homo sapiens
aaggcaacgugaguuguugauu

SEQ ID NO: 298981 - RNA, 20 nt, Homo sapiens
aaggcuuucgaguuccaggg

SEQ ID NO: 298982 - RNA, 23 nt, Homo sapiens
aagguaagcuagaaagauguaga

SEQ ID NO: 298983 - RNA, 17 nt, Homo sapiens
aaggugcuucgaccucc

SEQ ID NO: 298984 - RNA, 22 nt, Homo sapiens
aaggugguuuucucuuggaguc

SEQ ID NO: 298985 - RNA, 22 nt, Homo sapiens
aaguaaacauuuuguacaauaa

SEQ ID NO: 298986 - RNA, 22 nt, Homo sapiens
aaguacuguuuaaauugcagaa

SEQ ID NO: 298987 - RNA, 22 nt, Homo sapiens
aaguauagcuaugauaaacauu

SEQ ID NO: 298988 - RNA, 22 nt, Homo sapiens
aagugcacuguaagugcaggau

SEQ ID NO: 298989 - RNA, 22 nt, Homo sapiens
aagugcuggccuacucaaucga

SEQ ID NO: 298990 - RNA, 22 nt, Homo sapiens
aagugcuucagaagacaauauu

SEQ ID NO: 298991 - RNA, 22 nt, Homo sapiens
aaguguaaguuaauguuuaggu

SEQ ID NO: 298992 - RNA, 20 nt, Homo sapiens
aauaacagccccagggaggu

SEQ ID NO: 298993 - RNA, 21 nt, Homo sapiens
aauacucuagguuaagagagc

SEQ ID NO: 298994 - RNA, 22 nt, Homo sapiens
aauacugaaaguauuuucaaau

SEQ ID NO: 298995 - RNA, 22 nt, Homo sapiens
aauacugagaugugagguacua

SEQ ID NO: 298996 - RNA, 22 nt, Homo sapiens
aauaugucugcuaauuguuucu

SEQ ID NO: 298997 - RNA, 19 nt, Homo sapiens
aauauugacaguggugucu

SEQ ID NO: 298998 - RNA, 22 nt, Homo sapiens
aaucacaguguucuugugaggg

SEQ ID NO: 298999 - RNA, 22 nt, Homo sapiens
aaugauacuguguacaagggca

SEQ ID NO: 299000 - RNA, 22 nt, Homo sapiens
aaugcacauaaaauccuccagg

SEQ ID NO: 299001 - RNA, 22 nt, Homo sapiens
aaugcacauauauuuccuuauu

SEQ ID NO: 299002 - RNA, 22 nt, Homo sapiens
aaugcuaucuggaacauuguug

SEQ ID NO: 299003 - RNA, 22 nt, Homo sapiens
aauggcacuuuauaaauguuaa

SEQ ID NO: 299004 - RNA, 22 nt, Homo sapiens
aauggcaguagauggaugggua

SEQ ID NO: 299005 - RNA, 22 nt, Homo sapiens
aauucuguauuguuuagggacu

SEQ ID NO: 299006 - RNA, 21 nt, Homo sapiens
acaaagcuggagggagacugc

SEQ ID NO: 299007 - RNA, 22 nt, Homo sapiens
acacaguauaugacaaugcuuu

SEQ ID NO: 299008 - RNA, 22 nt, Homo sapiens
acaccaucuccuuauuucucuu

SEQ ID NO: 299009 - RNA, 22 nt, Homo sapiens
acacuggaggagagcuguugcu

SEQ ID NO: 299010 - RNA, 20 nt, Homo sapiens
acacuggaguaucaaggccc

SEQ ID NO: 299011 - RNA, 22 nt, Homo sapiens
acacuggguaacauaucuguua

SEQ ID NO: 299012 - RNA, 22 nt, Homo sapiens
acaggugaaguauuacacuaag

SEQ ID NO: 299013 - RNA, 22 nt, Homo sapiens
acaguagaaaacaauggauuug

SEQ ID NO: 299014 - RNA, 23 nt, Homo sapiens
acaguauguggauguggcuaagu

SEQ ID NO: 299015 - RNA, 22 nt, Homo sapiens
acagucauagcagccuuuguua

SEQ ID NO: 299016 - RNA, 22 nt, Homo sapiens
acagugcuguggucaugggucu

SEQ ID NO: 299017 - RNA, 22 nt, Homo sapiens
acagugcuucugauaugaugcc

SEQ ID NO: 299018 - RNA, 22 nt, Homo sapiens
acauaugaguacaugugccaug

SEQ ID NO: 299019 - RNA, 22 nt, Homo sapiens
acaucaggcuugugaugauuac

SEQ ID NO: 299020 - RNA, 22 nt, Homo sapiens
acaucauugggggcuacaggug

SEQ ID NO: 299021 - RNA, 22 nt, Homo sapiens
acaucccuuucccacccuucac

SEQ ID NO: 299022 - RNA, 22 nt, Homo sapiens
auggucuuuucccuggauuaua

SEQ ID NO: 299023 - RNA, 22 nt, Homo sapiens
augguuuuacugcaaaauggga

SEQ ID NO: 299024 - RNA, 22 nt, Homo sapiens
auguaacaguauuuggagaugu

SEQ ID NO: 299025 - RNA, 22 nt, Homo sapiens
augucaaggugggugauaguuu

SEQ ID NO: 299026 - RNA, 17 nt, Homo sapiens
augugaauguucaaaua

SEQ ID NO: 299027 - RNA, 22 nt, Homo sapiens
augugcaaauuuccaaacucuu

SEQ ID NO: 299028 - RNA, 22 nt, Homo sapiens
augugcacaugcuuacauguga

SEQ ID NO: 299029 - RNA, 22 nt, Homo sapiens
augugcacauucugguaaauau

SEQ ID NO: 299030 - RNA, 20 nt, Homo sapiens
augugcaguguggcaaccaa

SEQ ID NO: 299031 - RNA, 22 nt, Homo sapiens
augugcuuauagguguauguuu

SEQ ID NO: 299032 - RNA, 22 nt, Homo sapiens
augugcuugagggaaaucaguu

SEQ ID NO: 299033 - RNA, 22 nt, Homo sapiens
augugcuuuuuaaacagaugcu

SEQ ID NO: 299034 - RNA, 22 nt, Homo sapiens
auguggcacuugacuuucucgc

SEQ ID NO: 299035 - RNA, 22 nt, Homo sapiens
auguguauuaccucgauuguga

SEQ ID NO: 299036 - RNA, 20 nt, Homo sapiens
auguucuggaggacagaagc

SEQ ID NO: 299037 - RNA, 22 nt, Homo sapiens
auuaacaucuagaguuuuggug

SEQ ID NO: 299038 - RNA, 22 nt, Homo sapiens
auuaagugaaugaaguuguucc

SEQ ID NO: 299039 - RNA, 22 nt, Homo sapiens
auuaagugcuugcagaagucca

SEQ ID NO: 299040 - RNA, 22 nt, Homo sapiens
auuacauagucaaggugucuca

SEQ ID NO: 299041 - RNA, 22 nt, Homo sapiens
auuagugaaugugaugucuuga

SEQ ID NO: 299042 - RNA, 22 nt, Homo sapiens
auuauuaguuguugaaugaagu

SEQ ID NO: 299043 - RNA, 22 nt, Homo sapiens
auuccagauggaguugaggguu

SEQ ID NO: 299044 - RNA, 22 nt, Homo sapiens
auuccauaguacagugaugagu

SEQ ID NO: 299045 - RNA, 22 nt, Homo sapiens
auucccuguagaauaaggaugg

SEQ ID NO: 299046 - RNA, 22 nt, Homo sapiens
auugaggcauguaccaaugguc

SEQ ID NO: 299047 - RNA, 23 nt, Homo sapiens
auugauagugccuuugugcuaau

SEQ ID NO: 299048 - RNA, 22 nt, Homo sapiens
auugauaguuuaauaggaauug

SEQ ID NO: 299049 - RNA, 22 nt, Homo sapiens
auugcauaaacacauuucuuau

SEQ ID NO: 299050 - RNA, 22 nt, Homo sapiens
auugcuuaagucccuguauuag

SEQ ID NO: 299051 - RNA, 22 nt, Homo sapiens
auugcuucugauuuuaaaugag

SEQ ID NO: 299052 - RNA, 22 nt, Homo sapiens
auuggaguuguacgcacgcuca

SEQ ID NO: 299053 - RNA, 22 nt, Homo sapiens
auuggcuuuauacauaagaaua

SEQ ID NO: 299054 - RNA, 20 nt, Homo sapiens
auuguccuugauuacacaga

SEQ ID NO: 299055 - RNA, 22 nt, Homo sapiens
auuguucuuacaugcugucauc

SEQ ID NO: 299056 - RNA, 20 nt, Homo sapiens
auuuggcauaguuuaagcaa

SEQ ID NO: 299057 - RNA, 21 nt, Homo sapiens
auuugguguuagaaauaaauu

SEQ ID NO: 299058 - RNA, 22 nt, Homo sapiens
auuugguuauggucauggacac

SEQ ID NO: 299059 - RNA, 22 nt, Homo sapiens
auuugucacuuaacagccauua

SEQ ID NO: 299060 - RNA, 22 nt, Homo sapiens
auuuugcauugcuguaaaggaa

SEQ ID NO: 299061 - RNA, 22 nt, Homo sapiens
auuuuugguugguaggcuauua

SEQ ID NO: 299062 - RNA, 22 nt, Homo sapiens
auuuuugguuucaccugcacgc

SEQ ID NO: 299063 - RNA, 22 nt, Homo sapiens
caaaccuguaggggccaagagg

SEQ ID NO: 299064 - RNA, 22 nt, Homo sapiens
caaaugcuucuauggacugucu

SEQ ID NO: 299065 - RNA, 22 nt, Homo sapiens
caaccaguagcugaguucaaaa

SEQ ID NO: 299066 - RNA, 22 nt, Homo sapiens
caauggcacgaucucgucucac

SEQ ID NO: 299067 - RNA, 22 nt, Homo sapiens
caauggcacuauuggaaaaggu

SEQ ID NO: 299068 - RNA, 22 nt, Homo sapiens
cacaaaguagauuagucuucca

SEQ ID NO: 299069 - RNA, 22 nt, Homo sapiens
cacaguagaauagagcacuagg

SEQ ID NO: 299070 - RNA, 22 nt, Homo sapiens
cacauagcuagucaguagugaa

SEQ ID NO: 299071 - RNA, 22 nt, Homo sapiens
cacauagucccugcuaaucuuc

SEQ ID NO: 299072 - RNA, 22 nt, Homo sapiens
caccacuacaccccaggcuggg

SEQ ID NO: 299073 - RNA, 22 nt, Homo sapiens
caccagcuggcauugaauaccu

SEQ ID NO: 299074 - RNA, 23 nt, Homo sapiens
caccaguagaaugugugggaggg

SEQ ID NO: 299075 - RNA, 22 nt, Homo sapiens
cacugcauccuccaccuccugg

SEQ ID NO: 299076 - RNA, 22 nt, Homo sapiens
cacuggacauguugaagcuuuu

SEQ ID NO: 299077 - RNA, 22 nt, Homo sapiens
aagcuguugguggaucuaccau

SEQ ID NO: 299078 - RNA, 22 nt, Homo sapiens
aagcuguugguggauguaccau

SEQ ID NO: 299079 - RNA, 22 nt, Homo sapiens
aaggaagcuagcaggaauuggu

SEQ ID NO: 299080 - RNA, 22 nt, Homo sapiens
aaggagcuaagagaucauacau

SEQ ID NO: 299081 - RNA, 22 nt, Homo sapiens
aaggauuguaaaguugacaaau

SEQ ID NO: 299082 - RNA, 22 nt, Homo sapiens
aaggcaagaaaauggauucucc

SEQ ID NO: 299083 - RNA, 22 nt, Homo sapiens
aaggcaagguggauaaugaagc

SEQ ID NO: 299084 - RNA, 22 nt, Homo sapiens
aaggcaugcaaagaacauuuua

SEQ ID NO: 299085 - RNA, 22 nt, Homo sapiens
aaggcaugcugaguccuaaaag

SEQ ID NO: 299086 - RNA, 22 nt, Homo sapiens
aaggcuguucauuuagcacagu

SEQ ID NO: 299087 - RNA, 22 nt, Homo sapiens
aaggucauugugguuuuugcca

SEQ ID NO: 299088 - RNA, 22 nt, Homo sapiens
aaguauuagugaggauauggaa

SEQ ID NO: 299089 - RNA, 22 nt, Homo sapiens
aaguauuaugaguccuuguuuu

SEQ ID NO: 299090 - RNA, 22 nt, Homo sapiens
aagucaugaagaggaaaggaca

SEQ ID NO: 299091 - RNA, 22 nt, Homo sapiens
aaguccaugaagucuugugggu

SEQ ID NO: 299092 - RNA, 22 nt, Homo sapiens
aagugagaugcaguggaguucc

SEQ ID NO: 299093 - RNA, 22 nt, Homo sapiens
aagugguucuaugaguuugcaa

SEQ ID NO: 299094 - RNA, 22 nt, Homo sapiens
aagugguuuuaaucuggugagu

SEQ ID NO: 299095 - RNA, 22 nt, Homo sapiens
aauaaagcaggguccuugcacu

SEQ ID NO: 299096 - RNA, 22 nt, Homo sapiens
aaucaacauuguuuuaagucaa

SEQ ID NO: 299097 - RNA, 22 nt, Homo sapiens
aaucacaggucuuggcugcaug

SEQ ID NO: 299098 - RNA, 22 nt, Homo sapiens
aaucacaguuaguaagggagaa

SEQ ID NO: 299099 - RNA, 21 nt, Homo sapiens
aaucacaguuguucugccuuc

SEQ ID NO: 299100 - RNA, 22 nt, Homo sapiens
aaucagagcccucugagcuuca

SEQ ID NO: 299101 - RNA, 22 nt, Homo sapiens
aaucccuuuguccagucucuuu

SEQ ID NO: 299102 - RNA, 22 nt, Homo sapiens
aaucugauguuaucagcuuaag

SEQ ID NO: 299103 - RNA, 22 nt, Homo sapiens
aaugaaguuagauguugagaag

SEQ ID NO: 299104 - RNA, 22 nt, Homo sapiens
aaugacuaagaugguacauuuu

SEQ ID NO: 299105 - RNA, 22 nt, Homo sapiens
aaugacugugauauuuuucuuc

SEQ ID NO: 299106 - RNA, 22 nt, Homo sapiens
aaugucaugaguccaaccagaa

SEQ ID NO: 299107 - RNA, 22 nt, Homo sapiens
aauuacuucuacaccaaccuaa

SEQ ID NO: 299108 - RNA, 22 nt, Homo sapiens
aauucugugagauggugcagau

SEQ ID NO: 299109 - RNA, 22 nt, Homo sapiens
acaaagugccuccuuuuagagu

SEQ ID NO: 299110 - RNA, 22 nt, Homo sapiens
acaaaguguuuucugaaggccu

SEQ ID NO: 299111 - RNA, 20 nt, Homo sapiens
acaaaugcauucugugacau

SEQ ID NO: 299112 - RNA, 22 nt, Homo sapiens
acacacgugcauguaugcguau

SEQ ID NO: 299113 - RNA, 22 nt, Homo sapiens
acacaguguuuauugugguuag

SEQ ID NO: 299114 - RNA, 22 nt, Homo sapiens
acacaugugaaaaaaauguuac

SEQ ID NO: 299115 - RNA, 22 nt, Homo sapiens
acacauuagcaagugcuguuau

SEQ ID NO: 299116 - RNA, 22 nt, Homo sapiens
acacauuggcaauucuggagca

SEQ ID NO: 299117 - RNA, 22 nt, Homo sapiens
acacuggaguuaaaggugauuu

SEQ ID NO: 299118 - RNA, 22 nt, Homo sapiens
acacuguauccuucuguccuuu

SEQ ID NO: 299119 - RNA, 22 nt, Homo sapiens
acacugucugaugaaaguaguu

SEQ ID NO: 299120 - RNA, 22 nt, Homo sapiens
acaguacuguuguuugcugcca

SEQ ID NO: 299121 - RNA, 22 nt, Homo sapiens
acaguacuuuuggauuugugaa

SEQ ID NO: 299122 - RNA, 20 nt, Homo sapiens
acaguauguuuggaugcaua

SEQ ID NO: 299123 - RNA, 22 nt, Homo sapiens
acagugcuuucaauguucagua

SEQ ID NO: 299124 - RNA, 22 nt, Homo sapiens
augaagauguugccuuuuuaau

SEQ ID NO: 299125 - RNA, 18 nt, Homo sapiens
augaagucaucacuuuua

SEQ ID NO: 299126 - RNA, 22 nt, Homo sapiens
augacaagagccuucuuuccuu

SEQ ID NO: 299127 - RNA, 23 nt, Homo sapiens
augacacuguccuugaccauuuc

SEQ ID NO: 299128 - RNA, 22 nt, Homo sapiens
augaccuuguccucagugucau

SEQ ID NO: 299129 - RNA, 22 nt, Homo sapiens
augagauaaaccaucucuuaag

SEQ ID NO: 299130 - RNA, 22 nt, Homo sapiens
augagauauguuaaaaguuaaa

SEQ ID NO: 299131 - RNA, 22 nt, Homo sapiens
augagauauuuuauaagaucau

SEQ ID NO: 299132 - RNA, 22 nt, Homo sapiens
augagaugaauaccgacgaugu

SEQ ID NO: 299133 - RNA, 21 nt, Homo sapiens
augagauguuagacuuuagac

SEQ ID NO: 299134 - RNA, 22 nt, Homo sapiens
augagcagaugcuccugccucu

SEQ ID NO: 299135 - RNA, 22 nt, Homo sapiens
augaggaagucaggcccagggg

SEQ ID NO: 299136 - RNA, 22 nt, Homo sapiens
augauaugagaaaggaucaaca

SEQ ID NO: 299137 - RNA, 22 nt, Homo sapiens
augauggaggccgugauggacg

SEQ ID NO: 299138 - RNA, 22 nt, Homo sapiens
augauguccacagggguguuca

SEQ ID NO: 299139 - RNA, 22 nt, Homo sapiens
augauuagaacucauuuccagg

SEQ ID NO: 299140 - RNA, 22 nt, Homo sapiens
augcagaucacauuuuucuguc

SEQ ID NO: 299141 - RNA, 22 nt, Homo sapiens
augccacugcacuucagccugg

SEQ ID NO: 299142 - RNA, 22 nt, Homo sapiens
augccagggagaauuguucaag

SEQ ID NO: 299143 - RNA, 19 nt, Homo sapiens
augccucaguuuuguacuu

SEQ ID NO: 299144 - RNA, 21 nt, Homo sapiens
auggaaagacugccucuucaa

SEQ ID NO: 299145 - RNA, 19 nt, Homo sapiens
auggaacugcuggagccac

SEQ ID NO: 299146 - RNA, 22 nt, Homo sapiens
auggaacuggagaugguuauau

SEQ ID NO: 299147 - RNA, 22 nt, Homo sapiens
auggaauggcacuuugaagauu

SEQ ID NO: 299148 - RNA, 22 nt, Homo sapiens
auggaaugguugggucauaagg

SEQ ID NO: 299149 - RNA, 22 nt, Homo sapiens
auggaauguauagucauguagg

SEQ ID NO: 299150 - RNA, 22 nt, Homo sapiens
auggaauguggaaugguaagua

SEQ ID NO: 299151 - RNA, 22 nt, Homo sapiens
auggaguguaauauugagagcu

SEQ ID NO: 299152 - RNA, 22 nt, Homo sapiens
auggaguguggaacugggaauc

SEQ ID NO: 299153 - RNA, 22 nt, Homo sapiens
auggcaaaauguuccuaguggu

SEQ ID NO: 299154 - RNA, 22 nt, Homo sapiens
auggcacuaaguucaacacuua

SEQ ID NO: 299155 - RNA, 22 nt, Homo sapiens
auggcacuaaugggaguuuacu

SEQ ID NO: 299156 - RNA, 22 nt, Homo sapiens
auggcacugaagcguauugaca

SEQ ID NO: 299157 - RNA, 22 nt, Homo sapiens
auggcacugauggaaguaccuu

SEQ ID NO: 299158 - RNA, 18 nt, Homo sapiens
auggcagaacaauuuaca

SEQ ID NO: 299159 - RNA, 22 nt, Homo sapiens
auggcagcugacacuuccgucu

SEQ ID NO: 299160 - RNA, 22 nt, Homo sapiens
auggcagugagucucuaguauu

SEQ ID NO: 299161 - RNA, 22 nt, Homo sapiens
auggccauuacuaagaauguuu

SEQ ID NO: 299162 - RNA, 22 nt, Homo sapiens
auggccgggugcgguggcucac

SEQ ID NO: 299163 - RNA, 22 nt, Homo sapiens
auggccuuuacaauuugguaug

SEQ ID NO: 299164 - RNA, 22 nt, Homo sapiens
auggcucaguguguaucuauca

SEQ ID NO: 299165 - RNA, 22 nt, Homo sapiens
auggcucuguuccaugugucuu

SEQ ID NO: 299166 - RNA, 22 nt, Homo sapiens
auggcuucuuacucuucugcau

SEQ ID NO: 299167 - RNA, 22 nt, Homo sapiens
auggcuuuggucucccagugau

SEQ ID NO: 299168 - RNA, 22 nt, Homo sapiens
auggcuuuguguucagagcuga

SEQ ID NO: 299169 - RNA, 22 nt, Homo sapiens
auggcuuuuauuguguugaggu

SEQ ID NO: 299170 - RNA, 22 nt, Homo sapiens
auggcuuuucacagaggguucu

SEQ ID NO: 299171 - RNA, 22 nt, Homo sapiens
augggagugugguuagagaccu

SEQ ID NO: 299172 - RNA, 18 nt, Homo sapiens
auggguguuggaaaauga

SEQ ID NO: 299173 - RNA, 22 nt, Homo sapiens
augguacuccagagaagcagaa

SEQ ID NO: 299174 - RNA, 22 nt, Homo sapiens
augguacuggggucccggaguu

SEQ ID NO: 299175 - RNA, 22 nt, Homo sapiens
auggucccuguuccaugcuccu

SEQ ID NO: 299176 - RNA, 17 nt, Homo sapiens
ugcuuagagagccucag

SEQ ID NO: 299177 - RNA, 22 nt, Homo sapiens
uggaaaguacuugaguuuguau

SEQ ID NO: 299178 - RNA, 22 nt, Homo sapiens
uggaaauuaagucuuuccugag

SEQ ID NO: 299179 - RNA, 20 nt, Homo sapiens
uggaaguaagaauauaggug

SEQ ID NO: 299180 - RNA, 22 nt, Homo sapiens
uggaaguauagauaauugaaag

SEQ ID NO: 299181 - RNA, 22 nt, Homo sapiens
uggaagugaacaaccaaggcag

SEQ ID NO: 299182 - RNA, 19 nt, Homo sapiens
uggaaugaaauguuagggg

SEQ ID NO: 299183 - RNA, 21 nt, Homo sapiens
uggaaugaauggccaacaugg

SEQ ID NO: 299184 - RNA, 19 nt, Homo sapiens
uggaauggauuuaaaugug

SEQ ID NO: 299185 - RNA, 22 nt, Homo sapiens
uggagaacugaugucuccaaga

SEQ ID NO: 299186 - RNA, 22 nt, Homo sapiens
uggagguagggccuaggaaucu

SEQ ID NO: 299187 - RNA, 22 nt, Homo sapiens
uggaguaggccuaagaaugaca

SEQ ID NO: 299188 - RNA, 22 nt, Homo sapiens
uggagucuugcucuguugccca

SEQ ID NO: 299189 - RNA, 21 nt, Homo sapiens
uggagugcaacacuagguaua

SEQ ID NO: 299190 - RNA, 22 nt, Homo sapiens
uggagugcaauggcaccaucuu

SEQ ID NO: 299191 - RNA, 22 nt, Homo sapiens
uggaguguguugcagaugaagg

SEQ ID NO: 299192 - RNA, 20 nt, Homo sapiens
uggaguuguggcaguuugga

SEQ ID NO: 299193 - RNA, 22 nt, Homo sapiens
uggaguuugacaugccuuuggg

SEQ ID NO: 299194 - RNA, 22 nt, Homo sapiens
uggauggagaggcuugugaugc

SEQ ID NO: 299195 - RNA, 22 nt, Homo sapiens
uggauguaauugauucauguug

SEQ ID NO: 299196 - RNA, 22 nt, Homo sapiens
uggauuuuaauuauucugucau

SEQ ID NO: 299197 - RNA, 22 nt, Homo sapiens
uggcaaagugugacgugggggu

SEQ ID NO: 299198 - RNA, 22 nt, Homo sapiens
uggcaaauagcaauaggagggu

SEQ ID NO: 299199 - RNA, 22 nt, Homo sapiens
uggcaaauguaguacccaauag

SEQ ID NO: 299200 - RNA, 22 nt, Homo sapiens
uggcaaauuccaaaguuaauuc

SEQ ID NO: 299201 - RNA, 22 nt, Homo sapiens
uggcaagagauaugugucuaua

SEQ ID NO: 299202 - RNA, 22 nt, Homo sapiens
uggcaauguggaaugguccagg

SEQ ID NO: 299203 - RNA, 22 nt, Homo sapiens
uggcacaaugacccuugugggc

SEQ ID NO: 299204 - RNA, 19 nt, Homo sapiens
uggcacauguauacauaug

SEQ ID NO: 299205 - RNA, 22 nt, Homo sapiens
uggcaccauccaggugucucua

SEQ ID NO: 299206 - RNA, 22 nt, Homo sapiens
uggcaccugacuccgagaugca

SEQ ID NO: 299207 - RNA, 22 nt, Homo sapiens
uggcagcgugaauguggcugaa

SEQ ID NO: 299208 - RNA, 22 nt, Homo sapiens
cacauguuugcuacauuuuucu

SEQ ID NO: 299209 - RNA, 22 nt, Homo sapiens
caccgagguuggagugcagugg

SEQ ID NO: 299210 - RNA, 22 nt, Homo sapiens
cacugcacuccagucccgucuc

SEQ ID NO: 299211 - RNA, 21 nt, Homo sapiens
cacugcacuugccuucugggu

SEQ ID NO: 299212 - RNA, 22 nt, Homo sapiens
cacugcgaccuccaccucccgg

SEQ ID NO: 299213 - RNA, 17 nt, Homo sapiens
cacugggugcaagagga

SEQ ID NO: 299214 - RNA, 22 nt, Homo sapiens
cacugggugccauauguuugcu

SEQ ID NO: 299215 - RNA, 22 nt, Homo sapiens
cacuuugguucaccugaguuuc

SEQ ID NO: 299216 - RNA, 22 nt, Homo sapiens
cagacagugucccgagucccug

SEQ ID NO: 299217 - RNA, 22 nt, Homo sapiens
cagagaacugaguuauuuucuu

SEQ ID NO: 299218 - RNA, 22 nt, Homo sapiens
cagagaaugucuuuuuuaacca

SEQ ID NO: 299219 - RNA, 20 nt, Homo sapiens
cagagcaaagcaguccuggc

SEQ ID NO: 299220 - RNA, 22 nt, Homo sapiens
cagagguaagcaagucagcauu

SEQ ID NO: 299221 - RNA, 22 nt, Homo sapiens
cagauaguuguagauaugcagc

SEQ ID NO: 299222 - RNA, 22 nt, Homo sapiens
cagcacauagcaguugcucagu

SEQ ID NO: 299223 - RNA, 22 nt, Homo sapiens
cagcacauuacaaguacuuggu

SEQ ID NO: 299224 - RNA, 20 nt, Homo sapiens
cagcacgcacaugagacugu

SEQ ID NO: 299225 - RNA, 22 nt, Homo sapiens
cagcuguguuauaaacuaccau

SEQ ID NO: 299226 - RNA, 23 nt, Homo sapiens
cagcuucauugaacauaacuccu

SEQ ID NO: 299227 - RNA, 22 nt, Homo sapiens
caggcaaggugaaguguacugg

SEQ ID NO: 299228 - RNA, 22 nt, Homo sapiens
cagguagucaacgggucuugga

SEQ ID NO: 299229 - RNA, 23 nt, Homo sapiens
cagguaguucuuuauaguagugu

SEQ ID NO: 299230 - RNA, 22 nt, Homo sapiens
caggugcauuggcugacaccug

SEQ ID NO: 299231 - RNA, 22 nt, Homo sapiens
caguacaauguugauuagaagu

SEQ ID NO: 299232 - RNA, 19 nt, Homo sapiens
caguaucauugcacauagu

SEQ ID NO: 299233 - RNA, 22 nt, Homo sapiens
cagucacagugacaggaugugg

SEQ ID NO: 299234 - RNA, 22 nt, Homo sapiens
cagugcauagaugugccacauu

SEQ ID NO: 299235 - RNA, 22 nt, Homo sapiens
cagugcauaggaucuaaaauuu

SEQ ID NO: 299236 - RNA, 21 nt, Homo sapiens
cauaaugcuacuuauuuuaug

SEQ ID NO: 299237 - RNA, 23 nt, Homo sapiens
caucacagagccuuccuugacuc

SEQ ID NO: 299238 - RNA, 22 nt, Homo sapiens
caucacagcaaguagggagugg

SEQ ID NO: 299239 - RNA, 22 nt, Homo sapiens
caucacaguacuaaucgucaua

SEQ ID NO: 299240 - RNA, 23 nt, Homo sapiens
caucacauagaggaaagaggaca

SEQ ID NO: 299241 - RNA, 22 nt, Homo sapiens
caucucauugaauugcugagca

SEQ ID NO: 299242 - RNA, 22 nt, Homo sapiens
caugcacugaguccaccucugg

SEQ ID NO: 299243 - RNA, 22 nt, Homo sapiens
caugccauugcucuccugggug

SEQ ID NO: 299244 - RNA, 22 nt, Homo sapiens
cauggucaccuuccaaguuauu

SEQ ID NO: 299245 - RNA, 22 nt, Homo sapiens
caugucacuuccucucugaugg

SEQ ID NO: 299246 - RNA, 22 nt, Homo sapiens
caugucuuuuaaacauucaacu

SEQ ID NO: 299247 - RNA, 22 nt, Homo sapiens
cauugcaaugaggucuugcagu

SEQ ID NO: 299248 - RNA, 22 nt, Homo sapiens
cauugcacuccagccuagccaa

SEQ ID NO: 299249 - RNA, 19 nt, Homo sapiens
cauuggacuugcuuuugcc

SEQ ID NO: 299250 - RNA, 22 nt, Homo sapiens
ccaaguguuuucauuguuccau

SEQ ID NO: 299251 - RNA, 22 nt, Homo sapiens
ccacacugucuuggugggaaac

SEQ ID NO: 299252 - RNA, 22 nt, Homo sapiens
ccaccuguacuuaagucacuuu

SEQ ID NO: 299253 - RNA, 22 nt, Homo sapiens
ccaggguugcuuuagauucuga

SEQ ID NO: 299254 - RNA, 22 nt, Homo sapiens
ccagucuuggugucuguagcac

SEQ ID NO: 299255 - RNA, 22 nt, Homo sapiens
ccaguuuucucacuguugcagu

SEQ ID NO: 299256 - RNA, 22 nt, Homo sapiens
ccauggcuucugcauucuguca

SEQ ID NO: 299257 - RNA, 22 nt, Homo sapiens
cccacaguggccucauauccuu

SEQ ID NO: 299258 - RNA, 20 nt, Homo sapiens
ccccuggaguggggcugcuu

SEQ ID NO: 299259 - RNA, 22 nt, Homo sapiens
ccucaguguuuaucauuauuuu

SEQ ID NO: 299260 - RNA, 22 nt, Homo sapiens
ccugucuugaagagauccuccu

SEQ ID NO: 299261 - RNA, 22 nt, Homo sapiens
ccuucacaggcacugguucaga

SEQ ID NO: 299262 - RNA, 22 nt, Homo sapiens
ccuugguggccacaagacauug

SEQ ID NO: 299263 - RNA, 19 nt, Homo sapiens
ccuuugguuuccaugacau

SEQ ID NO: 299264 - RNA, 22 nt, Homo sapiens
cgccgggggaugggcaccagcg

SEQ ID NO: 299265 - RNA, 22 nt, Homo sapiens
cuaaaacuuucugagugcagca

SEQ ID NO: 299266 - RNA, 22 nt, Homo sapiens
cuaaagugcugagauuauaggu

SEQ ID NO: 299267 - RNA, 18 nt, Homo sapiens
cuaauacuauucaacaag

SEQ ID NO: 299268 - RNA, 20 nt, Homo sapiens
cuaaucaucccagaagaaau

SEQ ID NO: 299269 - RNA, 22 nt, Homo sapiens
cuacucuggagagugacaauca

SEQ ID NO: 299270 - RNA, 22 nt, Homo sapiens
cuagcaacauuucagugaguuu

SEQ ID NO: 299271 - RNA, 22 nt, Homo sapiens
cuagcagacaugggcugaacca

SEQ ID NO: 299272 - RNA, 22 nt, Homo sapiens
cuagcccagugcuccuggauca

SEQ ID NO: 299273 - RNA, 22 nt, Homo sapiens
cuagugcaguuccccugucuua

SEQ ID NO: 299274 - RNA, 22 nt, Homo sapiens
cuauauacugccugcugauuag

SEQ ID NO: 299275 - RNA, 21 nt, Homo sapiens
cucaaaguacugauauuacag

SEQ ID NO: 299276 - RNA, 22 nt, Homo sapiens
cucacggugcaggcuucuggga

SEQ ID NO: 299277 - RNA, 22 nt, Homo sapiens
cucacugcauuucaguuuuguu

SEQ ID NO: 299278 - RNA, 22 nt, Homo sapiens
cucaggcacucugauuccagug

SEQ ID NO: 299279 - RNA, 22 nt, Homo sapiens
cucauggagaaccucugcuagg

SEQ ID NO: 299280 - RNA, 22 nt, Homo sapiens
cucauggagauagagaauagaa

SEQ ID NO: 299281 - RNA, 22 nt, Homo sapiens
cucauuaguuguuuuaagauga

SEQ ID NO: 299282 - RNA, 22 nt, Homo sapiens
cuccaggugucauccaccuccu

SEQ ID NO: 299283 - RNA, 22 nt, Homo sapiens
cuccauuuaguccuuuuagaag

SEQ ID NO: 299284 - RNA, 23 nt, Homo sapiens
cucccugaacaugacacaccaga

SEQ ID NO: 299285 - RNA, 22 nt, Homo sapiens
cuccuggugauuggagugugaa

SEQ ID NO: 299286 - RNA, 22 nt, Homo sapiens
cuccuguagccccaucaucuuu

SEQ ID NO: 299287 - RNA, 22 nt, Homo sapiens
cucucuguuugucuguuauugg

SEQ ID NO: 299288 - RNA, 22 nt, Homo sapiens
cucugguggaagcagggggcaa

SEQ ID NO: 299289 - RNA, 22 nt, Homo sapiens
cucuuugaugugaaccgugguu

SEQ ID NO: 299290 - RNA, 22 nt, Homo sapiens
cugaaagagcauuugaaugggu

SEQ ID NO: 299291 - RNA, 22 nt, Homo sapiens
cugaauagucaacgauggacug

SEQ ID NO: 299292 - RNA, 22 nt, Homo sapiens
cugaccauagacuacucugggc

SEQ ID NO: 299293 - RNA, 22 nt, Homo sapiens
cugagacacucuuaucugcaua

SEQ ID NO: 299294 - RNA, 22 nt, Homo sapiens
cugaggcacggcgaccuuaagu

SEQ ID NO: 299295 - RNA, 18 nt, Homo sapiens
cugagucauuccuggguc

SEQ ID NO: 299296 - RNA, 22 nt, Homo sapiens
cugagugcaagugauccuccca

SEQ ID NO: 299297 - RNA, 22 nt, Homo sapiens
cugauaguucucuuuagaguuu

SEQ ID NO: 299298 - RNA, 21 nt, Homo sapiens
cugcaaaugcugcugccugau

SEQ ID NO: 299299 - RNA, 22 nt, Homo sapiens
uagaggaaugaauuuggccaga

SEQ ID NO: 299300 - RNA, 22 nt, Homo sapiens
uagagguagguguaugaacuag

SEQ ID NO: 299301 - RNA, 21 nt, Homo sapiens
uagauaguugguucugaaucu

SEQ ID NO: 299302 - RNA, 22 nt, Homo sapiens
uagaucuuuaaaaggugcuaga

SEQ ID NO: 299303 - RNA, 22 nt, Homo sapiens
uagauuaucccugauuugucca

SEQ ID NO: 299304 - RNA, 22 nt, Homo sapiens
uagauuauuggcugauuugauc

SEQ ID NO: 299305 - RNA, 22 nt, Homo sapiens
uagcacagugucauucuaggua

SEQ ID NO: 299306 - RNA, 22 nt, Homo sapiens
uagcacugucuugcaccugugc

SEQ ID NO: 299307 - RNA, 22 nt, Homo sapiens
uagcagaauauaccucuuacuu

SEQ ID NO: 299308 - RNA, 20 nt, Homo sapiens
uagcagcagacagagggagg

SEQ ID NO: 299309 - RNA, 22 nt, Homo sapiens
uagcagcaucucuggcuucuac

SEQ ID NO: 299310 - RNA, 22 nt, Homo sapiens
uagcaguauacguacugggucc

SEQ ID NO: 299311 - RNA, 22 nt, Homo sapiens
uagcagucucagaaugcauggu

SEQ ID NO: 299312 - RNA, 22 nt, Homo sapiens
uagccucacaaagugcuuaaga

SEQ ID NO: 299313 - RNA, 18 nt, Homo sapiens
uagcucuuguugguccau

SEQ ID NO: 299314 - RNA, 20 nt, Homo sapiens
uaggagcaaugagaguagaa

SEQ ID NO: 299315 - RNA, 22 nt, Homo sapiens
uaggagcacaaacccuacugug

SEQ ID NO: 299316 - RNA, 22 nt, Homo sapiens
uaggcaaaugcaagaguagaac

SEQ ID NO: 299317 - RNA, 22 nt, Homo sapiens
uaggcaaguugcccaaucucuc

SEQ ID NO: 299318 - RNA, 22 nt, Homo sapiens
uaggcacuguguuuguaggagu

SEQ ID NO: 299319 - RNA, 22 nt, Homo sapiens
uaggcuuuucugggaugugggc

SEQ ID NO: 299320 - RNA, 22 nt, Homo sapiens
uagggcuuuaguuugcuugugu

SEQ ID NO: 299321 - RNA, 22 nt, Homo sapiens
uagguaguaaauugauagagga

SEQ ID NO: 299322 - RNA, 22 nt, Homo sapiens
uccaccgugggcugcggggcuc

SEQ ID NO: 299323 - RNA, 22 nt, Homo sapiens
uccagaguggugaugcuggggc

SEQ ID NO: 299324 - RNA, 22 nt, Homo sapiens
uccagguuuggcuuuauaacuu

SEQ ID NO: 299325 - RNA, 22 nt, Homo sapiens
uccagguuuugugaguuuaaau

SEQ ID NO: 299326 - RNA, 22 nt, Homo sapiens
uccaguguuauaauaugcgucu

SEQ ID NO: 299327 - RNA, 22 nt, Homo sapiens
uccauaguacuagaaacugacc

SEQ ID NO: 299328 - RNA, 22 nt, Homo sapiens
uccauuugucuauguuucuguu

SEQ ID NO: 299329 - RNA, 22 nt, Homo sapiens
ucccaagaugagaugggggcug

SEQ ID NO: 299330 - RNA, 20 nt, Homo sapiens
ucccaguaggagaaggaagg

SEQ ID NO: 299331 - RNA, 22 nt, Homo sapiens
ucccugacagucacagagcuac

SEQ ID NO: 299332 - RNA, 22 nt, Homo sapiens
ucccuguguccugggggcaccu

SEQ ID NO: 299333 - RNA, 17 nt, Homo sapiens
ucccuguuuuuucaguc

SEQ ID NO: 299334 - RNA, 22 nt, Homo sapiens
uccuacugucuucggggcacug

SEQ ID NO: 299335 - RNA, 22 nt, Homo sapiens
uccugagucagcauccguuugu

SEQ ID NO: 299336 - RNA, 22 nt, Homo sapiens
uccugcauucugacuugcuuuc

SEQ ID NO: 299337 - RNA, 22 nt, Homo sapiens
uccuggcuccacuguuuauucc

SEQ ID NO: 299338 - RNA, 22 nt, Homo sapiens
uccuugaaacaggaagaauuca

SEQ ID NO: 299339 - RNA, 22 nt, Homo sapiens
ucgcauuucccucuguagcuuc

SEQ ID NO: 299340 - RNA, 22 nt, Homo sapiens
ucuacccugugagggacacagu

SEQ ID NO: 299341 - RNA, 22 nt, Homo sapiens
ucucaaguggucgcaguuagau

SEQ ID NO: 299342 - RNA, 22 nt, Homo sapiens
ucucagugacugcugggucccc

SEQ ID NO: 299343 - RNA, 22 nt, Homo sapiens
ucucagugugguaaaaguuuuu

SEQ ID NO: 299344 - RNA, 22 nt, Homo sapiens
ucucaguguuaucuaucugccu

SEQ ID NO: 299345 - RNA, 22 nt, Homo sapiens
ucuccauuguccagaugaggaa

SEQ ID NO: 299346 - RNA, 22 nt, Homo sapiens
ucucccauccaugaacuucugu

SEQ ID NO: 299347 - RNA, 22 nt, Homo sapiens
ucucccauccguacacggauug

SEQ ID NO: 299348 - RNA, 22 nt, Homo sapiens
ucucuagagagccugguguuca

SEQ ID NO: 299349 - RNA, 22 nt, Homo sapiens
ucucugaaacucuugacauccu

SEQ ID NO: 299350 - RNA, 22 nt, Homo sapiens
ucucugacacugaccccaaaaa

SEQ ID NO: 299351 - RNA, 22 nt, Homo sapiens
ucucuggauaucuacuuauguu

SEQ ID NO: 299352 - RNA, 22 nt, Homo sapiens
ucucugguuuguggaaucuuag

SEQ ID NO: 299353 - RNA, 22 nt, Homo sapiens
ucucuuggcggaaguugcagug

SEQ ID NO: 299354 - RNA, 22 nt, Homo sapiens
ucugacagugagagaaaucuga

SEQ ID NO: 299355 - RNA, 22 nt, Homo sapiens
ucugagaucaugucugugcugu

SEQ ID NO: 299356 - RNA, 22 nt, Homo sapiens
ucugagguuaaauuuuauaguu

SEQ ID NO: 299357 - RNA, 22 nt, Homo sapiens
ucugagguuacugcuuuguaga

SEQ ID NO: 299358 - RNA, 22 nt, Homo sapiens
ucugccacugucauugugugau

SEQ ID NO: 299359 - RNA, 20 nt, Homo sapiens
ucuggccccuccaaaucuca

SEQ ID NO: 299360 - RNA, 21 nt, Homo sapiens
ucuggccccuccaaaucucau

SEQ ID NO: 299361 - RNA, 22 nt, Homo sapiens
ucuggccccucccaaaucucau

SEQ ID NO: 299362 - RNA, 20 nt, Homo sapiens
ucuggccccucuaaaucuca

SEQ ID NO: 299363 - RNA, 22 nt, Homo sapiens
ucuggccuccuaugagaaucga

SEQ ID NO: 299364 - RNA, 22 nt, Homo sapiens
ucuggcuccaaagucuauuuuu

SEQ ID NO: 299365 - RNA, 17 nt, Homo sapiens
ucuggcuuucacaccug

SEQ ID NO: 299366 - RNA, 22 nt, Homo sapiens
ucugguuccuuggcuucggguc

SEQ ID NO: 299367 - RNA, 22 nt, Homo sapiens
ucugucacugaaucccugucac

SEQ ID NO: 299368 - RNA, 22 nt, Homo sapiens
ucugugcauggcagaggaauga

SEQ ID NO: 299369 - RNA, 22 nt, Homo sapiens
ucugugcauuacacuuuucuca

SEQ ID NO: 299370 - RNA, 21 nt, Homo sapiens
ucuguguugaucucacuggga

SEQ ID NO: 299371 - RNA, 22 nt, Homo sapiens
ucuguguugaugcucauuaauu

SEQ ID NO: 299372 - RNA, 22 nt, Homo sapiens
ucuguuguuguuuuaagagaca

SEQ ID NO: 299373 - RNA, 22 nt, Homo sapiens
ucuugggugaguuugugaauaa

SEQ ID NO: 299374 - RNA, 22 nt, Homo sapiens
ucuuggguuuguccuucuccua

SEQ ID NO: 299375 - RNA, 17 nt, Homo sapiens
ucuugugguucuugaau

SEQ ID NO: 299376 - RNA, 22 nt, Homo sapiens
ucuuucacuuagcaugauguuu

SEQ ID NO: 299377 - RNA, 22 nt, Homo sapiens
ucuuugaguggagcgaggcaga

SEQ ID NO: 299378 - RNA, 22 nt, Homo sapiens
ucuuugaguguauacuuagauu

SEQ ID NO: 299379 - RNA, 22 nt, Homo sapiens
ucuuugauaagauccagaagaa

SEQ ID NO: 299380 - RNA, 22 nt, Homo sapiens
ucuuugauguucugaaagaugg

SEQ ID NO: 299381 - RNA, 19 nt, Homo sapiens
ucuuugcuuuucuaagagg

SEQ ID NO: 299382 - RNA, 22 nt, Homo sapiens
ucuuuggucuacuuucauaugu

SEQ ID NO: 299383 - RNA, 22 nt, Homo sapiens
ucuuugguucuguuuauguaau

SEQ ID NO: 299384 - RNA, 22 nt, Homo sapiens
ucuuugguugcacugcaggugu

SEQ ID NO: 299385 - RNA, 22 nt, Homo sapiens
ucuuuguguaggucaaucuggc

SEQ ID NO: 299386 - RNA, 22 nt, Homo sapiens
ucuuuguguucaggagccacgu

SEQ ID NO: 299387 - RNA, 22 nt, Homo sapiens
ucuuuguuggaguccaaggaua

SEQ ID NO: 299388 - RNA, 20 nt, Homo sapiens
ugaaacacauggacuggggu

SEQ ID NO: 299389 - RNA, 22 nt, Homo sapiens
ugaaagguuuaauucugugaga

SEQ ID NO: 299390 - RNA, 22 nt, Homo sapiens
ugaaaucuaaaauguuccaaga

SEQ ID NO: 299391 - RNA, 22 nt, Homo sapiens
ugaaaugccuuuaaugaauuua

SEQ ID NO: 299392 - RNA, 22 nt, Homo sapiens
ugaaauuuuuuauucguuggcu

SEQ ID NO: 299393 - RNA, 22 nt, Homo sapiens
ugaacugagacuagacuuguuc

SEQ ID NO: 299394 - RNA, 22 nt, Homo sapiens
ugaagugaagacucacagaagg

SEQ ID NO: 299395 - RNA, 21 nt, Homo sapiens
ugaauacugcugcucccuuug

SEQ ID NO: 299396 - RNA, 22 nt, Homo sapiens
ugaauagacagucacugccucc

SEQ ID NO: 299397 - RNA, 21 nt, Homo sapiens
ugaauauuuggguugugucca

SEQ ID NO: 299398 - RNA, 22 nt, Homo sapiens
ugaaucauuucuugucuucagu

SEQ ID NO: 299399 - RNA, 22 nt, Homo sapiens
ugagauaguuguagauguacau

SEQ ID NO: 299400 - RNA, 22 nt, Homo sapiens
ugagaucaagguuaauauaauc

SEQ ID NO: 299401 - RNA, 18 nt, Homo sapiens
ugagaucagcaucaaggg

SEQ ID NO: 299402 - RNA, 19 nt, Homo sapiens
ugagauccacugaagauuc

SEQ ID NO: 299403 - RNA, 22 nt, Homo sapiens
ugagaucuucgcucuucacaga

SEQ ID NO: 299404 - RNA, 22 nt, Homo sapiens
ugagaugaagucuugcucuguu

SEQ ID NO: 299405 - RNA, 22 nt, Homo sapiens
ugagaugaggucucacucuguu

SEQ ID NO: 299406 - RNA, 22 nt, Homo sapiens
ugagaugagucucgcucuguca

SEQ ID NO: 299407 - RNA, 22 nt, Homo sapiens
ugagaugaguugcgcucugucg

SEQ ID NO: 299408 - RNA, 22 nt, Homo sapiens
ugagaugaguugcuggcucuga

SEQ ID NO: 299409 - RNA, 22 nt, Homo sapiens
ugagaugcuccucuugcaaagc

SEQ ID NO: 299410 - RNA, 22 nt, Homo sapiens
ugagaugcucgccggccagcau

SEQ ID NO: 299411 - RNA, 22 nt, Homo sapiens
ugagaugcuuguaaauucauuu

SEQ ID NO: 299412 - RNA, 22 nt, Homo sapiens
ugagauggaguuucgcuuuugu

SEQ ID NO: 299413 - RNA, 22 nt, Homo sapiens
ugagauguuccaaugacuauua

SEQ ID NO: 299414 - RNA, 22 nt, Homo sapiens
ugagauguuuguuucagugccu

SEQ ID NO: 299415 - RNA, 22 nt, Homo sapiens
ugagauuacguucggcccacuu

SEQ ID NO: 299416 - RNA, 22 nt, Homo sapiens
ugagcaagaucuuuauaauuag

SEQ ID NO: 299417 - RNA, 22 nt, Homo sapiens
ugagccaugguuagcuucucau

SEQ ID NO: 299418 - RNA, 22 nt, Homo sapiens
ugagcuaagugccaauauuaau

SEQ ID NO: 299419 - RNA, 22 nt, Homo sapiens
ugaggagugagaaauugguuuc

SEQ ID NO: 299420 - RNA, 22 nt, Homo sapiens
ugaggcuagucagaucagauga

SEQ ID NO: 299421 - RNA, 22 nt, Homo sapiens
ugagguaacaaacuaugaguua

SEQ ID NO: 299422 - RNA, 22 nt, Homo sapiens
ugagguagaggugaacuugacc

SEQ ID NO: 299423 - RNA, 22 nt, Homo sapiens
ugagguaugugaugucuuuuag

SEQ ID NO: 299424 - RNA, 22 nt, Homo sapiens
ugaggugagauggcuaccccaa

SEQ ID NO: 299425 - RNA, 23 nt, Homo sapiens
ugagguguuaagcagacuugucu

SEQ ID NO: 299426 - RNA, 22 nt, Homo sapiens
ugagguguuugugcaccaucug

SEQ ID NO: 299427 - RNA, 22 nt, Homo sapiens
ugaguacuacuaguuacugcua

SEQ ID NO: 299428 - RNA, 22 nt, Homo sapiens
ugaguagcuaagacgauaggca

SEQ ID NO: 299429 - RNA, 22 nt, Homo sapiens
ugagucagucucacucugcugc

SEQ ID NO: 299430 - RNA, 22 nt, Homo sapiens
ugaguucauggucauuugucac

SEQ ID NO: 299431 - RNA, 22 nt, Homo sapiens
ugaguucuuuuacauuuugaau

SEQ ID NO: 299432 - RNA, 22 nt, Homo sapiens
ugauaggucacucaacagugag

SEQ ID NO: 299433 - RNA, 20 nt, Homo sapiens
ugauauuucuggaaguggag

SEQ ID NO: 299434 - RNA, 22 nt, Homo sapiens
ugaucacagcuugacuaaagga

SEQ ID NO: 299435 - RNA, 22 nt, Homo sapiens
ugaugaaguauaggaagggcuu

SEQ ID NO: 299436 - RNA, 22 nt, Homo sapiens
ugaugcugaguggcuauuugaa

SEQ ID NO: 299437 - RNA, 22 nt, Homo sapiens
ugauguaggacauuauuauuuc

SEQ ID NO: 299438 - RNA, 22 nt, Homo sapiens
ugauugcacaccugcacucaag

SEQ ID NO: 299439 - RNA, 22 nt, Homo sapiens
ugauuuguuuagugccaaguuu

SEQ ID NO: 299440 - RNA, 19 nt, Homo sapiens
ugcaaagucagugaagggu

SEQ ID NO: 299441 - RNA, 22 nt, Homo sapiens
ugcaaagucgaaacugcaguuu

SEQ ID NO: 299442 - RNA, 19 nt, Homo sapiens
ugcaaagucuuuuccuauu

SEQ ID NO: 299443 - RNA, 22 nt, Homo sapiens
ugcaaauguuaguaacaccacu

SEQ ID NO: 299444 - RNA, 22 nt, Homo sapiens
ugcaaauguuauuuugguuucu

SEQ ID NO: 299445 - RNA, 22 nt, Homo sapiens
ugcaaguaauuccagcuacuga

SEQ ID NO: 299446 - RNA, 22 nt, Homo sapiens
ugcaauauccucuacuauaggu

SEQ ID NO: 299447 - RNA, 22 nt, Homo sapiens
ugcaccacuacacuccaggcug

SEQ ID NO: 299448 - RNA, 22 nt, Homo sapiens
ugcaccacugcacuucagccug

SEQ ID NO: 299449 - RNA, 22 nt, Homo sapiens
ugcaccacuguacuccagucug

SEQ ID NO: 299450 - RNA, 19 nt, Homo sapiens
ugcagcaauguaaaagaca

SEQ ID NO: 299451 - RNA, 22 nt, Homo sapiens
ugcagcacuguucacaauagcc

SEQ ID NO: 299452 - RNA, 18 nt, Homo sapiens
ugcagcaucaguacccag

SEQ ID NO: 299453 - RNA, 22 nt, Homo sapiens
ugcaguagugugaucuuggcuc

SEQ ID NO: 299454 - RNA, 22 nt, Homo sapiens
ugcagugugauuuucuggcuga

SEQ ID NO: 299455 - RNA, 22 nt, Homo sapiens
ugcagugugcuggggucuccau

SEQ ID NO: 299456 - RNA, 22 nt, Homo sapiens
ugcauaugcagcauuuaugauu

SEQ ID NO: 299457 - RNA, 22 nt, Homo sapiens
ugcauauguauacaugugccau

SEQ ID NO: 299458 - RNA, 22 nt, Homo sapiens
ugcauauguugaaccagccuug

SEQ ID NO: 299459 - RNA, 22 nt, Homo sapiens
ugcauauguugagaugcauauu

SEQ ID NO: 299460 - RNA, 22 nt, Homo sapiens
ugcauauucuaggauuuuguau

SEQ ID NO: 299461 - RNA, 22 nt, Homo sapiens
ugcauccauucuagacucaucu

SEQ ID NO: 299462 - RNA, 20 nt, Homo sapiens
ugcauguccucacuuacuug

SEQ ID NO: 299463 - RNA, 21 nt, Homo sapiens
ugcauuguugcugagagcagg

SEQ ID NO: 299464 - RNA, 22 nt, Homo sapiens
ugccagaugugcccucuccacc

SEQ ID NO: 299465 - RNA, 22 nt, Homo sapiens
ugccaguauuuuacugaggauu

SEQ ID NO: 299466 - RNA, 22 nt, Homo sapiens
ugccuaguggaaggagagcaaa

SEQ ID NO: 299467 - RNA, 22 nt, Homo sapiens
ugccugagcccagcccuguagu

SEQ ID NO: 299468 - RNA, 22 nt, Homo sapiens
ugccuggagagcuccuacauau

SEQ ID NO: 299469 - RNA, 21 nt, Homo sapiens
ugccuuuguaguaggugucuu

SEQ ID NO: 299470 - RNA, 22 nt, Homo sapiens
ugccuuuguucuggaaugggaa

SEQ ID NO: 299471 - RNA, 20 nt, Homo sapiens
ugcugcacuuaagcaugggc

SEQ ID NO: 299472 - RNA, 22 nt, Homo sapiens
ugcugguuuucaucaucagugg

SEQ ID NO: 299473 - RNA, 22 nt, Homo sapiens
cugcaagaugcauaggaauuuu

SEQ ID NO: 299474 - RNA, 22 nt, Homo sapiens
cugcaguaaccacuguaggugu

SEQ ID NO: 299475 - RNA, 18 nt, Homo sapiens
cugccagugugcucuccg

SEQ ID NO: 299476 - RNA, 22 nt, Homo sapiens
cugcccuuucuauaugauguaa

SEQ ID NO: 299477 - RNA, 22 nt, Homo sapiens
cuggaaggaaaaacaaccacag

SEQ ID NO: 299478 - RNA, 18 nt, Homo sapiens
cuggaaggcuacuacagu

SEQ ID NO: 299479 - RNA, 22 nt, Homo sapiens
cuggaaugugagccccaaaaag

SEQ ID NO: 299480 - RNA, 22 nt, Homo sapiens
cuggagaucuugacauugaagu

SEQ ID NO: 299481 - RNA, 22 nt, Homo sapiens
cuggagcaaaggugacucuugu

SEQ ID NO: 299482 - RNA, 22 nt, Homo sapiens
cuguaauguaaugagacuacau

SEQ ID NO: 299483 - RNA, 22 nt, Homo sapiens
cugucacaguuuuggaggccag

SEQ ID NO: 299484 - RNA, 22 nt, Homo sapiens
cugucucagccucuccaguagc

SEQ ID NO: 299485 - RNA, 22 nt, Homo sapiens
cugucuggaggccugcaaauaa

SEQ ID NO: 299486 - RNA, 22 nt, Homo sapiens
cugugcacaucuggcggcccga

SEQ ID NO: 299487 - RNA, 23 nt, Homo sapiens
cuguggauaugaguuguaaaugg

SEQ ID NO: 299488 - RNA, 22 nt, Homo sapiens
gcuagcacauugucaccucuca

SEQ ID NO: 299489 - RNA, 23 nt, Homo sapiens
gcuaggagagaugaaacacaggu

SEQ ID NO: 299490 - RNA, 22 nt, Homo sapiens
gcucaaguaauggcaguuuugc

SEQ ID NO: 299491 - RNA, 22 nt, Homo sapiens
gcuccauuuuccauuucucuaa

SEQ ID NO: 299492 - RNA, 22 nt, Homo sapiens
gcuccuuugaguagcuucugug

SEQ ID NO: 299493 - RNA, 22 nt, Homo sapiens
gcugagacauugguuuucuccu

SEQ ID NO: 299494 - RNA, 22 nt, Homo sapiens
gcugcuguuuaguuucuccugg

SEQ ID NO: 299495 - RNA, 22 nt, Homo sapiens
gcugcuguuucucuuucagcau

SEQ ID NO: 299496 - RNA, 22 nt, Homo sapiens
gcugcuuuugaugacaaaaaca

SEQ ID NO: 299497 - RNA, 22 nt, Homo sapiens
gcuggugaaggcugaaaagugg

SEQ ID NO: 299498 - RNA, 22 nt, Homo sapiens
gcuguaguugaggauuuuaaga

SEQ ID NO: 299499 - RNA, 22 nt, Homo sapiens
gcuugguccccacccaaaucgc

SEQ ID NO: 299500 - RNA, 22 nt, Homo sapiens
gcuuggugugcaagugguacua

SEQ ID NO: 299501 - RNA, 22 nt, Homo sapiens
ggaaagcuagguguggguguac

SEQ ID NO: 299502 - RNA, 21 nt, Homo sapiens
ggaaaguuaaggaaauacccc

SEQ ID NO: 299503 - RNA, 22 nt, Homo sapiens
ggaaauguuggugucaugaguu

SEQ ID NO: 299504 - RNA, 22 nt, Homo sapiens
ggaagaauauuaggggauuucg

SEQ ID NO: 299505 - RNA, 22 nt, Homo sapiens
ggaaugagaaauauuacacaau

SEQ ID NO: 299506 - RNA, 20 nt, Homo sapiens
ggaauguuaaucuccaugau

SEQ ID NO: 299507 - RNA, 22 nt, Homo sapiens
ggacuagagaugagauuuuuca

SEQ ID NO: 299508 - RNA, 22 nt, Homo sapiens
ggagaauguaauugguauuuug

SEQ ID NO: 299509 - RNA, 22 nt, Homo sapiens
ggagaguaauuagacugaaaga

SEQ ID NO: 299510 - RNA, 22 nt, Homo sapiens
ggagauaauccagggagggacu

SEQ ID NO: 299511 - RNA, 22 nt, Homo sapiens
ggagucugaacuggacaaugac

SEQ ID NO: 299512 - RNA, 22 nt, Homo sapiens
ggaguguuccauuugucacauu

SEQ ID NO: 299513 - RNA, 22 nt, Homo sapiens
ggcaaaaucgcaauuacuuuug

SEQ ID NO: 299514 - RNA, 22 nt, Homo sapiens
ggcaaagagacaugcaucgggg

SEQ ID NO: 299515 - RNA, 22 nt, Homo sapiens
ggcaaaugaagauggagaggcu

SEQ ID NO: 299516 - RNA, 22 nt, Homo sapiens
ggcaacaaagacauuucaacau

SEQ ID NO: 299517 - RNA, 22 nt, Homo sapiens
ggcaagaaccagggauuugcgu

SEQ ID NO: 299518 - RNA, 22 nt, Homo sapiens
ggcaagaggagauucugcuccc

SEQ ID NO: 299519 - RNA, 22 nt, Homo sapiens
ggcaagcucaggccucaggugu

SEQ ID NO: 299520 - RNA, 22 nt, Homo sapiens
ggcaaggauguuuuucuggcaa

SEQ ID NO: 299521 - RNA, 22 nt, Homo sapiens
ggcaaggauuagauucuccccu

SEQ ID NO: 299522 - RNA, 19 nt, Homo sapiens
ggcacugugugagugagga

SEQ ID NO: 299523 - RNA, 22 nt, Homo sapiens
ggcagaucauuggccucaguuu

SEQ ID NO: 299524 - RNA, 22 nt, Homo sapiens
ggcagcaugggugccuuuguga

SEQ ID NO: 299525 - RNA, 22 nt, Homo sapiens
ggcaguuuguucuugcuccuuu

SEQ ID NO: 299526 - RNA, 22 nt, Homo sapiens
ggcauguugauagguagaugua

SEQ ID NO: 299527 - RNA, 22 nt, Homo sapiens
ggcauugaguggguaggaguca

SEQ ID NO: 299528 - RNA, 23 nt, Homo sapiens
ggcauuguggcucacaucuguaa

SEQ ID NO: 299529 - RNA, 22 nt, Homo sapiens
ggccggguggccauggcugccc

SEQ ID NO: 299530 - RNA, 22 nt, Homo sapiens
ggccuguaggguauugguaggg

SEQ ID NO: 299531 - RNA, 22 nt, Homo sapiens
ggcuagagagcucagggauaug

SEQ ID NO: 299532 - RNA, 22 nt, Homo sapiens
ggcuagaugcuagagauaucau

SEQ ID NO: 299533 - RNA, 22 nt, Homo sapiens
ggcucaguugcaaaucaguuca

SEQ ID NO: 299534 - RNA, 22 nt, Homo sapiens
gggaaugaagagaaccuuccca

SEQ ID NO: 299535 - RNA, 22 nt, Homo sapiens
gggaauguagcaaaucugcaau

SEQ ID NO: 299536 - RNA, 22 nt, Homo sapiens
gggaugaagaagaauaguucgu

SEQ ID NO: 299537 - RNA, 22 nt, Homo sapiens
gggauguuuuauacugagccug

SEQ ID NO: 299538 - RNA, 18 nt, Homo sapiens
gggcaaguugccuggcuu

SEQ ID NO: 299539 - RNA, 16 nt, Homo sapiens
gggcaugugaagccua

SEQ ID NO: 299540 - RNA, 22 nt, Homo sapiens
gggguaggcuacacugaguucc

SEQ ID NO: 299541 - RNA, 22 nt, Homo sapiens
gggguauguaagugagugagug

SEQ ID NO: 299542 - RNA, 22 nt, Homo sapiens
ggguucaaaucuuggcucuuac

SEQ ID NO: 299543 - RNA, 22 nt, Homo sapiens
gguaaacauacugcugucuucu

SEQ ID NO: 299544 - RNA, 22 nt, Homo sapiens
gguagacaucgugcucugugau

SEQ ID NO: 299545 - RNA, 22 nt, Homo sapiens
gguauguagcaaaagaggugcu

SEQ ID NO: 299546 - RNA, 22 nt, Homo sapiens
gguggugguauuucagaaaaug

SEQ ID NO: 299547 - RNA, 22 nt, Homo sapiens
ggugucuuguuuaauacucauu

SEQ ID NO: 299548 - RNA, 22 nt, Homo sapiens
guaaaucucuguuuucauggac

SEQ ID NO: 299549 - RNA, 22 nt, Homo sapiens
guacacauacauauaugugugu

SEQ ID NO: 299550 - RNA, 22 nt, Homo sapiens
guacaguggguguagggaccag

SEQ ID NO: 299551 - RNA, 22 nt, Homo sapiens
guacaugcauaguuuauuucug

SEQ ID NO: 299552 - RNA, 22 nt, Homo sapiens
guacauguaugcaugcaugcau

SEQ ID NO: 299553 - RNA, 22 nt, Homo sapiens
guacaugugcacagugugcagg

SEQ ID NO: 299554 - RNA, 22 nt, Homo sapiens
guagcagucacauagcagauug

SEQ ID NO: 299555 - RNA, 22 nt, Homo sapiens
guaguggcaugaucuuggcuca

SEQ ID NO: 299556 - RNA, 22 nt, Homo sapiens
guauacaugucaaaacucacau

SEQ ID NO: 299557 - RNA, 22 nt, Homo sapiens
guaucaugaaguuucuucauuu

SEQ ID NO: 299558 - RNA, 22 nt, Homo sapiens
gucaacauauuaauuauguucu

SEQ ID NO: 299559 - RNA, 22 nt, Homo sapiens
gucacagcacuuuuaguaagug

SEQ ID NO: 299560 - RNA, 22 nt, Homo sapiens
gucacugagcaauagaaaguuu

SEQ ID NO: 299561 - RNA, 22 nt, Homo sapiens
gucaguggauacugucucuguc

SEQ ID NO: 299562 - RNA, 22 nt, Homo sapiens
gucagugucuuugcagcucaga

SEQ ID NO: 299563 - RNA, 22 nt, Homo sapiens
gucaucaucaguccucugugca

SEQ ID NO: 299564 - RNA, 22 nt, Homo sapiens
gucaugaaguuuugaaugaaau

SEQ ID NO: 299565 - RNA, 22 nt, Homo sapiens
gucauggaacaacuuaaaguca

SEQ ID NO: 299566 - RNA, 22 nt, Homo sapiens
gucauggaggaugaauggccaa

SEQ ID NO: 299567 - RNA, 22 nt, Homo sapiens
gucauucauucagcaagcacug

SEQ ID NO: 299568 - RNA, 22 nt, Homo sapiens
gucccugaggaacauccagggc

SEQ ID NO: 299569 - RNA, 22 nt, Homo sapiens
guccugaagaccuuccucugga

SEQ ID NO: 299570 - RNA, 22 nt, Homo sapiens
gucucccagccuacauauuucu

SEQ ID NO: 299571 - RNA, 22 nt, Homo sapiens
gucuggagacuugggucaucaa

SEQ ID NO: 299572 - RNA, 22 nt, Homo sapiens
gucugguuccugggagauuucu

SEQ ID NO: 299573 - RNA, 22 nt, Homo sapiens
gucugguuggaguaguuuucag

SEQ ID NO: 299574 - RNA, 22 nt, Homo sapiens
gucugucuuuugucuuugaaau

SEQ ID NO: 299575 - RNA, 22 nt, Homo sapiens
gucugugcauuaauacgugcug

SEQ ID NO: 299576 - RNA, 22 nt, Homo sapiens
gucuguuuggggaccuguggcc

SEQ ID NO: 299577 - RNA, 22 nt, Homo sapiens
gucuuccagccuccaucuuucu

SEQ ID NO: 299578 - RNA, 22 nt, Homo sapiens
gucuuuaguugaaacauguggu

SEQ ID NO: 299579 - RNA, 22 nt, Homo sapiens
gucuuugaugucuaugugcuuc

SEQ ID NO: 299580 - RNA, 22 nt, Homo sapiens
gugaaauacauaaucccaagug

SEQ ID NO: 299581 - RNA, 22 nt, Homo sapiens
gugaaaugaaucuggaaauauu

SEQ ID NO: 299582 - RNA, 22 nt, Homo sapiens
gugaauguaaagucaugugacu

SEQ ID NO: 299583 - RNA, 22 nt, Homo sapiens
gugaccucauuacggggccugc

SEQ ID NO: 299584 - RNA, 22 nt, Homo sapiens
gugagaugauggguauguuaau

SEQ ID NO: 299585 - RNA, 22 nt, Homo sapiens
gugagaugguaucucauugugg

SEQ ID NO: 299586 - RNA, 22 nt, Homo sapiens
gugagcuccucuucugcugcag

SEQ ID NO: 299587 - RNA, 21 nt, Homo sapiens
gugaucaugucacugcacucc

SEQ ID NO: 299588 - RNA, 21 nt, Homo sapiens
gugcagaugccacagucacuc

SEQ ID NO: 299589 - RNA, 22 nt, Homo sapiens
gugcauguccacuaguccauau

SEQ ID NO: 299590 - RNA, 22 nt, Homo sapiens
gugcaugucuaugcgagucuaa

SEQ ID NO: 299591 - RNA, 22 nt, Homo sapiens
gugccacugcaccuggccuaag

SEQ ID NO: 299592 - RNA, 23 nt, Homo sapiens
gugccuucugagccuagucucca

SEQ ID NO: 299593 - RNA, 22 nt, Homo sapiens
gugcuaggugcuaggaagauag

SEQ ID NO: 299594 - RNA, 22 nt, Homo sapiens
gugcuuguauuuaaaucaugug

SEQ ID NO: 299595 - RNA, 22 nt, Homo sapiens
gugcuuuguuguggcaguggca

SEQ ID NO: 299596 - RNA, 22 nt, Homo sapiens
guggaaaacauaugcuuguuga

SEQ ID NO: 299597 - RNA, 20 nt, Homo sapiens
guggaaguagaaacauaugu

SEQ ID NO: 299598 - RNA, 22 nt, Homo sapiens
guggaaugcaguguugauucaa

SEQ ID NO: 299599 - RNA, 22 nt, Homo sapiens
guggagcuguguggccuugggc

SEQ ID NO: 299600 - RNA, 22 nt, Homo sapiens
guggcuagaaugaagguagcug

SEQ ID NO: 299601 - RNA, 22 nt, Homo sapiens
guggcuauuguucccugguugc

SEQ ID NO: 299602 - RNA, 22 nt, Homo sapiens
guggcuuuaaguacgauugagg

SEQ ID NO: 299603 - RNA, 22 nt, Homo sapiens
guggcuuuauuuagaagcaggg

SEQ ID NO: 299604 - RNA, 22 nt, Homo sapiens
gugggaagcuggaacucccucc

SEQ ID NO: 299605 - RNA, 22 nt, Homo sapiens
gugggagugucccguuuuucca

SEQ ID NO: 299606 - RNA, 22 nt, Homo sapiens
gugggauggagagaagguauga

SEQ ID NO: 299607 - RNA, 22 nt, Homo sapiens
gugggguaggaggaguacuucc

SEQ ID NO: 299608 - RNA, 22 nt, Homo sapiens
gugguacuaucuuugguuucag

SEQ ID NO: 299609 - RNA, 22 nt, Homo sapiens
gugguuuuaauauucagucuag

SEQ ID NO: 299610 - RNA, 22 nt, Homo sapiens
gugguuuuuaaaguaccugugg

SEQ ID NO: 299611 - RNA, 22 nt, Homo sapiens
gugucuccuguggagcuaugua

SEQ ID NO: 299612 - RNA, 22 nt, Homo sapiens
gugugcacaaucuggcaugugc

SEQ ID NO: 299613 - RNA, 22 nt, Homo sapiens
gugugcauggagggggcaguga

SEQ ID NO: 299614 - RNA, 22 nt, Homo sapiens
guguggcaggugggggcucaga

SEQ ID NO: 299615 - RNA, 22 nt, Homo sapiens
guuagguagaaguuuacuuuga

SEQ ID NO: 299616 - RNA, 22 nt, Homo sapiens
guucaagcaauucugcugccuc

SEQ ID NO: 299617 - RNA, 22 nt, Homo sapiens
guucaagugauagcugggauua

SEQ ID NO: 299618 - RNA, 22 nt, Homo sapiens
guucagcaggggcuucaauggu

SEQ ID NO: 299619 - RNA, 22 nt, Homo sapiens
guugcaaaguaauugugguuuu

SEQ ID NO: 299620 - RNA, 22 nt, Homo sapiens
guugcuuauuccuguaauccca

SEQ ID NO: 299621 - RNA, 22 nt, Homo sapiens
guuggaguuaagcaguaaugaa

SEQ ID NO: 299622 - RNA, 22 nt, Homo sapiens
guugguuuccuguaacuggaca

SEQ ID NO: 299623 - RNA, 22 nt, Homo sapiens
guugugcuuaagccuauugauu

SEQ ID NO: 299624 - RNA, 22 nt, Homo sapiens
guuugugcuccuaugagaaucu

SEQ ID NO: 299625 - RNA, 15 nt, Homo sapiens
guuuuuggauacaau

SEQ ID NO: 299626 - RNA, 22 nt, Homo sapiens
uaaaccuagcauuuugcauaug

SEQ ID NO: 299627 - RNA, 22 nt, Homo sapiens
uaaacugcuugaaaugguguca

SEQ ID NO: 299628 - RNA, 22 nt, Homo sapiens
uaaagcuauuauaguuauguuu

SEQ ID NO: 299629 - RNA, 22 nt, Homo sapiens
uaaagcugaaaugauuaugaca

SEQ ID NO: 299630 - RNA, 22 nt, Homo sapiens
uaaagcuuagauccaugguggc

SEQ ID NO: 299631 - RNA, 22 nt, Homo sapiens
uaaagcuuggauuuaggcuaau

SEQ ID NO: 299632 - RNA, 22 nt, Homo sapiens
uaaaugcucuuuaaaagugcuu

SEQ ID NO: 299633 - RNA, 22 nt, Homo sapiens
uaaauggauauugccaucuccu

SEQ ID NO: 299634 - RNA, 18 nt, Homo sapiens
uaaauugcuucaccugag

SEQ ID NO: 299635 - RNA, 22 nt, Homo sapiens
uaacaccuuugauagcacuuuu

SEQ ID NO: 299636 - RNA, 22 nt, Homo sapiens
uaacagucaagguuugaccagg

SEQ ID NO: 299637 - RNA, 23 nt, Homo sapiens
uaacauguuuuuaagggaagcuu

SEQ ID NO: 299638 - RNA, 22 nt, Homo sapiens
uaacauuguugauuauacuaag

SEQ ID NO: 299639 - RNA, 22 nt, Homo sapiens
uaacugcaaccuccgccucccg

SEQ ID NO: 299640 - RNA, 22 nt, Homo sapiens
uaagaauucuguccgguauacu

SEQ ID NO: 299641 - RNA, 22 nt, Homo sapiens
uaagacuuuuugggaauauaga

SEQ ID NO: 299642 - RNA, 22 nt, Homo sapiens
uaagagagcuccaucuuuuccu

SEQ ID NO: 299643 - RNA, 22 nt, Homo sapiens
uaagccaccgugccuggccuaa

SEQ ID NO: 299644 - RNA, 22 nt, Homo sapiens
uaaggauuuuggugauuacacu

SEQ ID NO: 299645 - RNA, 22 nt, Homo sapiens
uaaguauuaggccccaggcugg

SEQ ID NO: 299646 - RNA, 22 nt, Homo sapiens
uaagugguguucauucuuuuga

SEQ ID NO: 299647 - RNA, 22 nt, Homo sapiens
uaauaauguuaggcuuacucaa

SEQ ID NO: 299648 - RNA, 22 nt, Homo sapiens
uaauccugucuugaccaucagg

SEQ ID NO: 299649 - RNA, 22 nt, Homo sapiens
uaaucucagcuacucaggaggc

SEQ ID NO: 299650 - RNA, 22 nt, Homo sapiens
uaaugcacucgaaucauggaau

SEQ ID NO: 299651 - RNA, 22 nt, Homo sapiens
uaaugcuguggucuaaugggga

SEQ ID NO: 299652 - RNA, 22 nt, Homo sapiens
uaauugcaguucuguguuauau

SEQ ID NO: 299653 - RNA, 22 nt, Homo sapiens
uacaaagcuuugaugugucuuu

SEQ ID NO: 299654 - RNA, 22 nt, Homo sapiens
uacaccaauuuaaucaaaagca

SEQ ID NO: 299655 - RNA, 22 nt, Homo sapiens
uacaggaaugucagguugcugu

SEQ ID NO: 299656 - RNA, 22 nt, Homo sapiens
uacaggacuucucagaguuauu

SEQ ID NO: 299657 - RNA, 22 nt, Homo sapiens
uacaggauagacaauuuauuaa

SEQ ID NO: 299658 - RNA, 22 nt, Homo sapiens
uacaggugcuuauguggacaua

SEQ ID NO: 299659 - RNA, 22 nt, Homo sapiens
uacagucuagaggagaaucagg

SEQ ID NO: 299660 - RNA, 22 nt, Homo sapiens
uacagucuggaggccuguguug

SEQ ID NO: 299661 - RNA, 22 nt, Homo sapiens
uacaguggcaugucaggugcuu

SEQ ID NO: 299662 - RNA, 22 nt, Homo sapiens
uacaguggugugaucucagcuc

SEQ ID NO: 299663 - RNA, 22 nt, Homo sapiens
uaccagugucagcuuccugugu

SEQ ID NO: 299664 - RNA, 22 nt, Homo sapiens
uaccuuugucaguuacucaccu

SEQ ID NO: 299665 - RNA, 16 nt, Homo sapiens
uacuacugccuauuau

SEQ ID NO: 299666 - RNA, 22 nt, Homo sapiens
uacucaguagacacucauaugu

SEQ ID NO: 299667 - RNA, 22 nt, Homo sapiens
uacucugcaguaauuccagccc

SEQ ID NO: 299668 - RNA, 22 nt, Homo sapiens
uacugcacuccagcuuaggaga

SEQ ID NO: 299669 - RNA, 22 nt, Homo sapiens
uacugcaucuacuuagagccag

SEQ ID NO: 299670 - RNA, 22 nt, Homo sapiens
uacuggccccaaaguagguagu

SEQ ID NO: 299671 - RNA, 22 nt, Homo sapiens
uacuuuguagagugugagaauu

SEQ ID NO: 299672 - RNA, 22 nt, Homo sapiens
uacuuuguagauuguuuccuuu

SEQ ID NO: 299673 - RNA, 22 nt, Homo sapiens
uacuuuguuauagcagcaggaa

SEQ ID NO: 299674 - RNA, 22 nt, Homo sapiens
uagaagcacuaucccuccuagu

SEQ ID NO: 299675 - RNA, 22 nt, Homo sapiens
uagagcacagugauuagaccua

SEQ ID NO: 299676 - RNA, 22 nt, Homo sapiens
ugaauacuucguucaaagauaa

SEQ ID NO: 299677 - RNA, 22 nt, Homo sapiens
ugaauagaaguggcaggaguag

SEQ ID NO: 299678 - RNA, 22 nt, Homo sapiens
ugaaugguuuuuagagaacaau

SEQ ID NO: 299679 - RNA, 23 nt, Homo sapiens
ugaauguaucgaaugugggaaag

SEQ ID NO: 299680 - RNA, 22 nt, Homo sapiens
ugaauguauuuauuaccauuca

SEQ ID NO: 299681 - RNA, 22 nt, Homo sapiens
ugaauguccauugauguuuuga

SEQ ID NO: 299682 - RNA, 22 nt, Homo sapiens
ugaauguuguugguugagauau

SEQ ID NO: 299683 - RNA, 23 nt, Homo sapiens
ugaauguuuauucucggugcaga

SEQ ID NO: 299684 - RNA, 22 nt, Homo sapiens
ugaauguuugcuuacuuccaua

SEQ ID NO: 299685 - RNA, 16 nt, Homo sapiens
ugaauguuuguggcug

SEQ ID NO: 299686 - RNA, 18 nt, Homo sapiens
ugacaaugcuaguccugg

SEQ ID NO: 299687 - RNA, 22 nt, Homo sapiens
ugacacagugggggauccuuuu

SEQ ID NO: 299688 - RNA, 21 nt, Homo sapiens
ugacagaaaauugaguuugcu

SEQ ID NO: 299689 - RNA, 22 nt, Homo sapiens
ugacagugaauaagucucuuaa

SEQ ID NO: 299690 - RNA, 23 nt, Homo sapiens
ugacagugcuugaaauugcucuu

SEQ ID NO: 299691 - RNA, 22 nt, Homo sapiens
ugacaguguccucauucccaac

SEQ ID NO: 299692 - RNA, 18 nt, Homo sapiens
ugacaguuucuuuauauu

SEQ ID NO: 299693 - RNA, 22 nt, Homo sapiens
ugacaucugcuugugcccagga

SEQ ID NO: 299694 - RNA, 22 nt, Homo sapiens
ugacaugauuguauauuuagaa

SEQ ID NO: 299695 - RNA, 22 nt, Homo sapiens
ugacauggagggugcggcugca

SEQ ID NO: 299696 - RNA, 22 nt, Homo sapiens
ugacauggagguggaggaagau

SEQ ID NO: 299697 - RNA, 22 nt, Homo sapiens
ugacauggugcucuuucaggca

SEQ ID NO: 299698 - RNA, 19 nt, Homo sapiens
ugaccagggacagaaacca

SEQ ID NO: 299699 - RNA, 22 nt, Homo sapiens
ugacuacauaaguaaucucaaa

SEQ ID NO: 299700 - RNA, 22 nt, Homo sapiens
ugacuauaucucuguauaaacu

SEQ ID NO: 299701 - RNA, 22 nt, Homo sapiens
ugacuggagaccucaguagggu

SEQ ID NO: 299702 - RNA, 22 nt, Homo sapiens
ugacuugaaguuaccauaugca

SEQ ID NO: 299703 - RNA, 18 nt, Homo sapiens
ugagaacauguguacaca

SEQ ID NO: 299704 - RNA, 22 nt, Homo sapiens
ugagaacuaaaaugugguauau

SEQ ID NO: 299705 - RNA, 22 nt, Homo sapiens
ugagaagugacgcagcaggguu

SEQ ID NO: 299706 - RNA, 22 nt, Homo sapiens
ugagaaugcagaaucucgugca

SEQ ID NO: 299707 - RNA, 19 nt, Homo sapiens
ugagaauguuaccaggucc

SEQ ID NO: 299708 - RNA, 21 nt, Homo sapiens
ugagacaauccuggucaauau

SEQ ID NO: 299709 - RNA, 22 nt, Homo sapiens
ugagacaugugaauauuuguac

SEQ ID NO: 299710 - RNA, 23 nt, Homo sapiens
ugagacauuggaaaguuaggcag

SEQ ID NO: 299711 - RNA, 22 nt, Homo sapiens
ugagaccaacagauuccaguuc

SEQ ID NO: 299712 - RNA, 22 nt, Homo sapiens
ugagacggagucucgcucuguu

SEQ ID NO: 299713 - RNA, 22 nt, Homo sapiens
ugagacugaguuuugccuuugu

SEQ ID NO: 299714 - RNA, 20 nt, Homo sapiens
ugagauccacgugaaguaug

SEQ ID NO: 299715 - RNA, 22 nt, Homo sapiens
ugagaucuuaccuuccugccuu

SEQ ID NO: 299716 - RNA, 22 nt, Homo sapiens
ugagaugagggaagccuaggca

SEQ ID NO: 299717 - RNA, 21 nt, Homo sapiens
ugagaugauccugcaugcaug

SEQ ID NO: 299718 - RNA, 22 nt, Homo sapiens
ugagaugaugggauaagagggc

SEQ ID NO: 299719 - RNA, 21 nt, Homo sapiens
ugagaugcaaucaccagggag

SEQ ID NO: 299720 - RNA, 22 nt, Homo sapiens
ugagauggagucuugucgccua

SEQ ID NO: 299721 - RNA, 22 nt, Homo sapiens
ugagauggaguuucgcucuugu

SEQ ID NO: 299722 - RNA, 22 nt, Homo sapiens
ugagauggcugaauucagaaua

SEQ ID NO: 299723 - RNA, 22 nt, Homo sapiens
ugagauggguaauuaaauggug

SEQ ID NO: 299724 - RNA, 22 nt, Homo sapiens
ugagauggguucugguccccug

SEQ ID NO: 299725 - RNA, 22 nt, Homo sapiens
ugagaugguaaauuuuuguugu

SEQ ID NO: 299726 - RNA, 22 nt, Homo sapiens
ugagauguguccagaucuaguu

SEQ ID NO: 299727 - RNA, 22 nt, Homo sapiens
ugagcuaugaucccaccucugu

SEQ ID NO: 299728 - RNA, 18 nt, Homo sapiens
ugaggaaaggguuugcua

SEQ ID NO: 299729 - RNA, 22 nt, Homo sapiens
ugaggaguguauuucauucgcu

SEQ ID NO: 299730 - RNA, 22 nt, Homo sapiens
ugaggcacucccuagcggggug

SEQ ID NO: 299731 - RNA, 22 nt, Homo sapiens
ugagguaggugaagaaugcacg

SEQ ID NO: 299732 - RNA, 20 nt, Homo sapiens
ugaguagaggaguucuauca

SEQ ID NO: 299733 - RNA, 23 nt, Homo sapiens
ugaguaggugguuuuccccucac

SEQ ID NO: 299734 - RNA, 22 nt, Homo sapiens
ugagucuguucucacauugcua

SEQ ID NO: 299735 - RNA, 22 nt, Homo sapiens
ugagugaaagaagcacuaagga

SEQ ID NO: 299736 - RNA, 22 nt, Homo sapiens
ugagugaaugugaaggcuaggg

SEQ ID NO: 299737 - RNA, 22 nt, Homo sapiens
ugagugccuggagggcagggac

SEQ ID NO: 299738 - RNA, 22 nt, Homo sapiens
ugaguucaauuguauuuuauua

SEQ ID NO: 299739 - RNA, 22 nt, Homo sapiens
ugaguucaugcuuguaguucua

SEQ ID NO: 299740 - RNA, 22 nt, Homo sapiens
ugaguucuuuguagauucugug

SEQ ID NO: 299741 - RNA, 22 nt, Homo sapiens
ugaguuguaggggucaccuggc

SEQ ID NO: 299742 - RNA, 22 nt, Homo sapiens
ugauaagaaauuguucauguag

SEQ ID NO: 299743 - RNA, 22 nt, Homo sapiens
ugauaauuuugucagguuuugg

SEQ ID NO: 299744 - RNA, 22 nt, Homo sapiens
ugauaucucuugccuccaaaug

SEQ ID NO: 299745 - RNA, 19 nt, Homo sapiens
ugugaacaucacagagugu

SEQ ID NO: 299746 - RNA, 19 nt, Homo sapiens
ugugaagaaaugcugcaag

SEQ ID NO: 299747 - RNA, 22 nt, Homo sapiens
ugugacagcacgguucaacugc

SEQ ID NO: 299748 - RNA, 22 nt, Homo sapiens
ugugaucauuucaggaauuuug

SEQ ID NO: 299749 - RNA, 23 nt, Homo sapiens
ugugcacauuuacauauauacac

SEQ ID NO: 299750 - RNA, 22 nt, Homo sapiens
ugugcauauaaguguguauaua

SEQ ID NO: 299751 - RNA, 22 nt, Homo sapiens
uguggaaauggugcuacgaaca

SEQ ID NO: 299752 - RNA, 22 nt, Homo sapiens
uguggcaaauggucaggaagaa

SEQ ID NO: 299753 - RNA, 22 nt, Homo sapiens
uguggccuuuguuucaguuggg

SEQ ID NO: 299754 - RNA, 22 nt, Homo sapiens
uguggcucuucuguucuccacu

SEQ ID NO: 299755 - RNA, 22 nt, Homo sapiens
uguggcuucuuugguucaguau

SEQ ID NO: 299756 - RNA, 22 nt, Homo sapiens
uguggcuuuacagcaugguuca

SEQ ID NO: 299757 - RNA, 19 nt, Homo sapiens
uguggucauccugggacga

SEQ ID NO: 299758 - RNA, 22 nt, Homo sapiens
uguguaauaccuuugacuauau

SEQ ID NO: 299759 - RNA, 22 nt, Homo sapiens
uguuacagcagaauugaaagag

SEQ ID NO: 299760 - RNA, 22 nt, Homo sapiens
uguuauguucuacuuuuaggug

SEQ ID NO: 299761 - RNA, 22 nt, Homo sapiens
uguuauugagguuacuuauaag

SEQ ID NO: 299762 - RNA, 22 nt, Homo sapiens
uguucuugagccuuuagaccua

SEQ ID NO: 299763 - RNA, 22 nt, Homo sapiens
uguugcacucuagccugggcaa

SEQ ID NO: 299764 - RNA, 22 nt, Homo sapiens
uguuggacuuacuuggcagauu

SEQ ID NO: 299765 - RNA, 22 nt, Homo sapiens
uuaaacugcuugaauuggguuu

SEQ ID NO: 299766 - RNA, 22 nt, Homo sapiens
uuaaaguguuuucaaaauguca

SEQ ID NO: 299767 - RNA, 22 nt, Homo sapiens
uuaacagucacuuagcucauuu

SEQ ID NO: 299768 - RNA, 22 nt, Homo sapiens
uuaaggcuuguacuuguuuucu

SEQ ID NO: 299769 - RNA, 22 nt, Homo sapiens
uuaaguagcugggcaugguggu

SEQ ID NO: 299770 - RNA, 22 nt, Homo sapiens
uuaaguuguagcuacaaauaca

SEQ ID NO: 299771 - RNA, 22 nt, Homo sapiens
uuaauguaauugauugauugac

SEQ ID NO: 299772 - RNA, 22 nt, Homo sapiens
uuaauguaucuaucacaucaca

SEQ ID NO: 299773 - RNA, 22 nt, Homo sapiens
uuaaugugaaucaggaugcauu

SEQ ID NO: 299774 - RNA, 22 nt, Homo sapiens
uuacauugcuucaaauucagug

SEQ ID NO: 299775 - RNA, 20 nt, Homo sapiens
uuacuccuuaaugagguuuu

SEQ ID NO: 299776 - RNA, 22 nt, Homo sapiens
cuguaaaguaagagguaaguua

SEQ ID NO: 299777 - RNA, 22 nt, Homo sapiens
cuguacucaucccauaugcacu

SEQ ID NO: 299778 - RNA, 22 nt, Homo sapiens
cugugccaagcuugcgaugugc

SEQ ID NO: 299779 - RNA, 22 nt, Homo sapiens
cugugcuugagagaugacacag

SEQ ID NO: 299780 - RNA, 22 nt, Homo sapiens
cugugcuugauuauaugagugu

SEQ ID NO: 299781 - RNA, 22 nt, Homo sapiens
cugugcuuggagucccccuagg

SEQ ID NO: 299782 - RNA, 22 nt, Homo sapiens
cugugguuacguucuuugugcu

SEQ ID NO: 299783 - RNA, 22 nt, Homo sapiens
cugugguuuaaggaauuuugac

SEQ ID NO: 299784 - RNA, 22 nt, Homo sapiens
cuguuugaggguuugcuuucag

SEQ ID NO: 299785 - RNA, 22 nt, Homo sapiens
cuuaaguaguuguggaaugaau

SEQ ID NO: 299786 - RNA, 22 nt, Homo sapiens
cuuacagucuaucagccacaac

SEQ ID NO: 299787 - RNA, 22 nt, Homo sapiens
cuucaguucuguaaggacagca

SEQ ID NO: 299788 - RNA, 22 nt, Homo sapiens
cuucaugagacuuuuggaaggc

SEQ ID NO: 299789 - RNA, 22 nt, Homo sapiens
cuucccguuauugcccuugggu

SEQ ID NO: 299790 - RNA, 22 nt, Homo sapiens
cuugagcauauucuauauuaaa

SEQ ID NO: 299791 - RNA, 22 nt, Homo sapiens
cuugcagaggcccuggggagag

SEQ ID NO: 299792 - RNA, 22 nt, Homo sapiens
cuugccuuugucuucaaaggcu

SEQ ID NO: 299793 - RNA, 22 nt, Homo sapiens
cuuggcacucuguggaguuagg

SEQ ID NO: 299794 - RNA, 22 nt, Homo sapiens
cuuggcauugccccuggaauuu

SEQ ID NO: 299795 - RNA, 22 nt, Homo sapiens
cuuggcauuguguugauagaag

SEQ ID NO: 299796 - RNA, 22 nt, Homo sapiens
cuugggauauguguuacucugu

SEQ ID NO: 299797 - RNA, 22 nt, Homo sapiens
cuugggcagugugcauguguau

SEQ ID NO: 299798 - RNA, 22 nt, Homo sapiens
cuugguuacauuuuccuagaaa

SEQ ID NO: 299799 - RNA, 22 nt, Homo sapiens
cuuguacacuguuggugggaau

SEQ ID NO: 299800 - RNA, 21 nt, Homo sapiens
cuugucuugcuuagaauagac

SEQ ID NO: 299801 - RNA, 22 nt, Homo sapiens
cuuucugaggagaauagagaac

SEQ ID NO: 299802 - RNA, 22 nt, Homo sapiens
cuuuggcacuuccuaagugcca

SEQ ID NO: 299803 - RNA, 22 nt, Homo sapiens
cuuugguggagucuuuagguuc

SEQ ID NO: 299804 - RNA, 22 nt, Homo sapiens
cuuugguucuguuuauaugcug

SEQ ID NO: 299805 - RNA, 19 nt, Homo sapiens
cuuugguugagcguguugg

SEQ ID NO: 299806 - RNA, 22 nt, Homo sapiens
cuuugguugugcucuccacuuu

SEQ ID NO: 299807 - RNA, 22 nt, Homo sapiens
cuuugguuuacuuggugcuagu

SEQ ID NO: 299808 - RNA, 22 nt, Homo sapiens
cuuuguguaggugccucuggcu

SEQ ID NO: 299809 - RNA, 22 nt, Homo sapiens
cuuugugugggccaagggcugg

SEQ ID NO: 299810 - RNA, 22 nt, Homo sapiens
cuuuuacacugguggugggaau

SEQ ID NO: 299811 - RNA, 23 nt, Homo sapiens
cuuuugcaaugugaucuugccac

SEQ ID NO: 299812 - RNA, 22 nt, Homo sapiens
cuuuuggcuuaagauugucuug

SEQ ID NO: 299813 - RNA, 22 nt, Homo sapiens
cuuuuggucuaucagagaagca

SEQ ID NO: 299814 - RNA, 22 nt, Homo sapiens
ucaccuuacuugcuucugaacu

SEQ ID NO: 299815 - RNA, 18 nt, Homo sapiens
ucaccuugcuuuuagaac

SEQ ID NO: 299816 - RNA, 22 nt, Homo sapiens
ucacugaaaccgccuccaccuc

SEQ ID NO: 299817 - RNA, 22 nt, Homo sapiens
ucacugaaaccuccaccucucg

SEQ ID NO: 299818 - RNA, 22 nt, Homo sapiens
ucacugagcuagaucacuugac

SEQ ID NO: 299819 - RNA, 22 nt, Homo sapiens
ucacugcacucuccgccuugcg

SEQ ID NO: 299820 - RNA, 22 nt, Homo sapiens
ucacuggacagaaauaaaggug

SEQ ID NO: 299821 - RNA, 22 nt, Homo sapiens
ucacuggacucuagccugggug

SEQ ID NO: 299822 - RNA, 22 nt, Homo sapiens
ucacuggccaaauucuggguga

SEQ ID NO: 299823 - RNA, 22 nt, Homo sapiens
ucacuugguggcaaaguuuaug

SEQ ID NO: 299824 - RNA, 22 nt, Homo sapiens
ucagaaccuccuagcaguguuc

SEQ ID NO: 299825 - RNA, 22 nt, Homo sapiens
ucagaacugauacuagaacuuu

SEQ ID NO: 299826 - RNA, 22 nt, Homo sapiens
ucagaguaguuccuggcagaaa

SEQ ID NO: 299827 - RNA, 22 nt, Homo sapiens
ucagauacuggugacaugaaug

SEQ ID NO: 299828 - RNA, 22 nt, Homo sapiens
ucagauuggugcaaaaguaauu

SEQ ID NO: 299829 - RNA, 22 nt, Homo sapiens
ucagcaccauguaacaauugau

SEQ ID NO: 299830 - RNA, 22 nt, Homo sapiens
ucaggugcagagaagaaauggg

SEQ ID NO: 299831 - RNA, 22 nt, Homo sapiens
ucaggugcaguggcucaugcuu

SEQ ID NO: 299832 - RNA, 22 nt, Homo sapiens
ucaggugcaguggcucugaccu

SEQ ID NO: 299833 - RNA, 22 nt, Homo sapiens
ucaguccccucgcugagucuac

SEQ ID NO: 299834 - RNA, 22 nt, Homo sapiens
ucagugacuggguauuaaauca

SEQ ID NO: 299835 - RNA, 22 nt, Homo sapiens
ucagugauugcuuucauggaaa

SEQ ID NO: 299836 - RNA, 22 nt, Homo sapiens
ucagugucaucuggguuguuug

SEQ ID NO: 299837 - RNA, 21 nt, Homo sapiens
ucaguuacugagagagaagug

SEQ ID NO: 299838 - RNA, 22 nt, Homo sapiens
ucauaguacuuuguuuugaaaa

SEQ ID NO: 299839 - RNA, 22 nt, Homo sapiens
ucauaucauuagaucuacugua

SEQ ID NO: 299840 - RNA, 22 nt, Homo sapiens
ucaucaggaaacuuaugcagug

SEQ ID NO: 299841 - RNA, 22 nt, Homo sapiens
ucaucagguaugucagcggagu

SEQ ID NO: 299842 - RNA, 22 nt, Homo sapiens
ucauggcuuuuauuauguugag

SEQ ID NO: 299843 - RNA, 22 nt, Homo sapiens
ucaugugagcacagagcaagau

SEQ ID NO: 299844 - RNA, 22 nt, Homo sapiens
ucauguguugcacugaggaccu

SEQ ID NO: 299845 - RNA, 22 nt, Homo sapiens
ucauucauucauccagcuugag

SEQ ID NO: 299846 - RNA, 22 nt, Homo sapiens
ucauucauuugcucacuccaca

SEQ ID NO: 299847 - RNA, 22 nt, Homo sapiens
ucauugguucuggguguuguug

SEQ ID NO: 299848 - RNA, 22 nt, Homo sapiens
ucauugguugcguaauuugauu

SEQ ID NO: 299849 - RNA, 22 nt, Homo sapiens
ucauuguccaacuucuuucagu

SEQ ID NO: 299850 - RNA, 22 nt, Homo sapiens
uccaauguaaucaucauugaau

SEQ ID NO: 299851 - RNA, 18 nt, Homo sapiens
uccacgugcuuuccagau

SEQ ID NO: 299852 - RNA, 22 nt, Homo sapiens
uccaguuuggaggcuugaugug

SEQ ID NO: 299853 - RNA, 22 nt, Homo sapiens
uccauagugagcagucaaugua

SEQ ID NO: 299854 - RNA, 22 nt, Homo sapiens
uccauugucuagauguaacaca

SEQ ID NO: 299855 - RNA, 22 nt, Homo sapiens
uccauuuguagguagugagaca

SEQ ID NO: 299856 - RNA, 18 nt, Homo sapiens
uccauuuguaugggaugg

SEQ ID NO: 299857 - RNA, 19 nt, Homo sapiens
ucccaauguuuccaggcag

SEQ ID NO: 299858 - RNA, 22 nt, Homo sapiens
ucccaguauucauuuacagaag

SEQ ID NO: 299859 - RNA, 22 nt, Homo sapiens
ucccagugaaaccccaccuuca

SEQ ID NO: 299860 - RNA, 22 nt, Homo sapiens
ucccaguggucuugaaacaggg

SEQ ID NO: 299861 - RNA, 22 nt, Homo sapiens
ucccuacugggguacugccuag

SEQ ID NO: 299862 - RNA, 20 nt, Homo sapiens
ucccucaaacuuuuccacug

SEQ ID NO: 299863 - RNA, 22 nt, Homo sapiens
ucccugaaagcugagauuggaa

SEQ ID NO: 299864 - RNA, 22 nt, Homo sapiens
ucccugacagggucugagcuuu

SEQ ID NO: 299865 - RNA, 22 nt, Homo sapiens
ucccuugguaauucuguuccuu

SEQ ID NO: 299866 - RNA, 22 nt, Homo sapiens
ucccuuucuggaguuucccaag

SEQ ID NO: 299867 - RNA, 19 nt, Homo sapiens
ucccuuuguauggacauac

SEQ ID NO: 299868 - RNA, 20 nt, Homo sapiens
uccugagauucccaguucuc

SEQ ID NO: 299869 - RNA, 22 nt, Homo sapiens
uccuuggucaaaaagaaagugu

SEQ ID NO: 299870 - RNA, 22 nt, Homo sapiens
ucgcaccauugcacuccagcca

SEQ ID NO: 299871 - RNA, 22 nt, Homo sapiens
ucuaaaacuagauugugaugau

SEQ ID NO: 299872 - RNA, 22 nt, Homo sapiens
ucucacaccccucucauauacc

SEQ ID NO: 299873 - RNA, 22 nt, Homo sapiens
ucucacauuucacagggauggg

SEQ ID NO: 299874 - RNA, 22 nt, Homo sapiens
ucucagcacaaacaaaauugcu

SEQ ID NO: 299875 - RNA, 22 nt, Homo sapiens
ucucagcacagucagggcgccu

SEQ ID NO: 299876 - RNA, 22 nt, Homo sapiens
ucucagugaaauaaauuauuuu

SEQ ID NO: 299877 - RNA, 22 nt, Homo sapiens
ucucaguggugcuggcagggga

SEQ ID NO: 299878 - RNA, 21 nt, Homo sapiens
ucucauagaguuucacuuucu

SEQ ID NO: 299879 - RNA, 21 nt, Homo sapiens
ucucauuacugaugagccaga

SEQ ID NO: 299880 - RNA, 22 nt, Homo sapiens
ucucauuggucugagucaccug

SEQ ID NO: 299881 - RNA, 17 nt, Homo sapiens
ucucccaucccuuucuc

SEQ ID NO: 299882 - RNA, 22 nt, Homo sapiens
ucugacagugugaauauugacu

SEQ ID NO: 299883 - RNA, 22 nt, Homo sapiens
ucugagguaggugcauggauac

SEQ ID NO: 299884 - RNA, 22 nt, Homo sapiens
ucuggagugugaaguggauaug

SEQ ID NO: 299885 - RNA, 22 nt, Homo sapiens
ucuggcuuugugaguugccaga

SEQ ID NO: 299886 - RNA, 22 nt, Homo sapiens
ucugggguuagucaaagguaug

SEQ ID NO: 299887 - RNA, 22 nt, Homo sapiens
ucuggucccugcacauauuuuc

SEQ ID NO: 299888 - RNA, 22 nt, Homo sapiens
ucugguuccugcauucauucaa

SEQ ID NO: 299889 - RNA, 22 nt, Homo sapiens
ucuguacuccuugaguagugcu

SEQ ID NO: 299890 - RNA, 22 nt, Homo sapiens
ucuguaguuaacagcuucagcu

SEQ ID NO: 299891 - RNA, 22 nt, Homo sapiens
ucugugcauuuucuuuuagacu

SEQ ID NO: 299892 - RNA, 19 nt, Homo sapiens
ucugugcuugucccccugu

SEQ ID NO: 299893 - RNA, 22 nt, Homo sapiens
ucuguggucagcauccgccacu

SEQ ID NO: 299894 - RNA, 22 nt, Homo sapiens
ucuguuguuaucauaauauuga

SEQ ID NO: 299895 - RNA, 22 nt, Homo sapiens
ucuuauuuggggaaaggguccu

SEQ ID NO: 299896 - RNA, 17 nt, Homo sapiens
ucuucuguuacuguggc

SEQ ID NO: 299897 - RNA, 22 nt, Homo sapiens
ucuugcaguucccaaauucaca

SEQ ID NO: 299898 - RNA, 22 nt, Homo sapiens
ucuuggguuguuggcuucuccu

SEQ ID NO: 299899 - RNA, 22 nt, Homo sapiens
ucuugucacugcauccccagcu

SEQ ID NO: 299900 - RNA, 22 nt, Homo sapiens
ucuuuggcugugaagaauaaug

SEQ ID NO: 299901 - RNA, 22 nt, Homo sapiens
ucuuugggauauucugaaaggg

SEQ ID NO: 299902 - RNA, 22 nt, Homo sapiens
ucuuugguagaagcuauuuuau

SEQ ID NO: 299903 - RNA, 22 nt, Homo sapiens
ucuuuggugaauggucauccag

SEQ ID NO: 299904 - RNA, 22 nt, Homo sapiens
ucuuugguuguuuagggugcau

SEQ ID NO: 299905 - RNA, 22 nt, Homo sapiens
ucuuugguuucugucucuguaa

SEQ ID NO: 299906 - RNA, 22 nt, Homo sapiens
ucuuuguuagaacccucuccuu

SEQ ID NO: 299907 - RNA, 22 nt, Homo sapiens
ucuuuguuuucugauccugaag

SEQ ID NO: 299908 - RNA, 22 nt, Homo sapiens
ucuuuugugagucagccucucc

SEQ ID NO: 299909 - RNA, 22 nt, Homo sapiens
ucuuuuugagucaguuucggua

SEQ ID NO: 299910 - RNA, 22 nt, Homo sapiens
ugaaacacaccuccucuccauc

SEQ ID NO: 299911 - RNA, 22 nt, Homo sapiens
ugaaaguaauugcaguuuuuac

SEQ ID NO: 299912 - RNA, 22 nt, Homo sapiens
ugaaaugcuaauucguagcuaa

SEQ ID NO: 299913 - RNA, 22 nt, Homo sapiens
ugaaauggaaagaguguagacu

SEQ ID NO: 299914 - RNA, 22 nt, Homo sapiens
ugaaauggugcggucugcagca

SEQ ID NO: 299915 - RNA, 22 nt, Homo sapiens
ugaacacaucuccugguaccug

SEQ ID NO: 299916 - RNA, 22 nt, Homo sapiens
ugaacucauccuuucuuauggc

SEQ ID NO: 299917 - RNA, 21 nt, Homo sapiens
cuuuuuacucguucauaugca

SEQ ID NO: 299918 - RNA, 22 nt, Homo sapiens
cuuuuugcaaauacaacucuga

SEQ ID NO: 299919 - RNA, 20 nt, Homo sapiens
gaaacaucuauccucuccuu

SEQ ID NO: 299920 - RNA, 22 nt, Homo sapiens
gaaagauuuccugagcuagaaa

SEQ ID NO: 299921 - RNA, 22 nt, Homo sapiens
gaaaguaauuaacgauuguugc

SEQ ID NO: 299922 - RNA, 22 nt, Homo sapiens
gaaaguguugagauuacaggca

SEQ ID NO: 299923 - RNA, 22 nt, Homo sapiens
gaaauggaucagagcaagcuuu

SEQ ID NO: 299924 - RNA, 23 nt, Homo sapiens
gaaauguaagugaugccccacag

SEQ ID NO: 299925 - RNA, 22 nt, Homo sapiens
gaaauguugauagugggcauug

SEQ ID NO: 299926 - RNA, 18 nt, Homo sapiens
gaagaaguaggcauggca

SEQ ID NO: 299927 - RNA, 22 nt, Homo sapiens
gaagguaguuuauagauguggu

SEQ ID NO: 299928 - RNA, 19 nt, Homo sapiens
gaaguguuuguucuccaug

SEQ ID NO: 299929 - RNA, 22 nt, Homo sapiens
gaaucacagauuaugaguaucu

SEQ ID NO: 299930 - RNA, 22 nt, Homo sapiens
gaaucauuggguugauucaaga

SEQ ID NO: 299931 - RNA, 22 nt, Homo sapiens
gacaagagaacacugcuauauu

SEQ ID NO: 299932 - RNA, 22 nt, Homo sapiens
gacagugagaugucaugugaaa

SEQ ID NO: 299933 - RNA, 22 nt, Homo sapiens
gacccuguugggguuuagggcu

SEQ ID NO: 299934 - RNA, 18 nt, Homo sapiens
gacuccauuucagccaga

SEQ ID NO: 299935 - RNA, 18 nt, Homo sapiens
gacuuggaguuuacagug

SEQ ID NO: 299936 - RNA, 22 nt, Homo sapiens
gagaacagagauaauuuuacuu

SEQ ID NO: 299937 - RNA, 22 nt, Homo sapiens
gagacauugacuuuguuccaga

SEQ ID NO: 299938 - RNA, 22 nt, Homo sapiens
gagacugagucuugcucuguca

SEQ ID NO: 299939 - RNA, 22 nt, Homo sapiens
gagagguaguuuuuuggucguc

SEQ ID NO: 299940 - RNA, 22 nt, Homo sapiens
gagauacacccagugcagaggc

SEQ ID NO: 299941 - RNA, 22 nt, Homo sapiens
gagauagguauuucauuuaccc

SEQ ID NO: 299942 - RNA, 22 nt, Homo sapiens
gagaugcaccuugucacguuuc

SEQ ID NO: 299943 - RNA, 22 nt, Homo sapiens
gagauggagacuuggccuuaaa

SEQ ID NO: 299944 - RNA, 22 nt, Homo sapiens
gagaugucuauuucagagaugu

SEQ ID NO: 299945 - RNA, 22 nt, Homo sapiens
gagauugucaugauuacauugu

SEQ ID NO: 299946 - RNA, 22 nt, Homo sapiens
gagcacugaauacugugguggu

SEQ ID NO: 299947 - RNA, 22 nt, Homo sapiens
gagcacugauuuauuuuugucu

SEQ ID NO: 299948 - RNA, 22 nt, Homo sapiens
gaggcauuauucccaucuuaca

SEQ ID NO: 299949 - RNA, 22 nt, Homo sapiens
gagguaaguggauuaugagguc

SEQ ID NO: 299950 - RNA, 22 nt, Homo sapiens
gaggugauaucucauugugguu

SEQ ID NO: 299951 - RNA, 22 nt, Homo sapiens
gagguggugguggaggcauagc

SEQ ID NO: 299952 - RNA, 23 nt, Homo sapiens
gagugcaaugacaugaucucgga

SEQ ID NO: 299953 - RNA, 22 nt, Homo sapiens
gagugcugagcccacuuccuug

SEQ ID NO: 299954 - RNA, 21 nt, Homo sapiens
gaguggcuuuuguuucaccag

SEQ ID NO: 299955 - RNA, 18 nt, Homo sapiens
gaguggugcuucccuugu

SEQ ID NO: 299956 - RNA, 22 nt, Homo sapiens
gaguuccuuugagccugagagg

SEQ ID NO: 299957 - RNA, 22 nt, Homo sapiens
gauagcagccauucuuuuuauu

SEQ ID NO: 299958 - RNA, 22 nt, Homo sapiens
gauauguaaaaauuauaucuga

SEQ ID NO: 299959 - RNA, 22 nt, Homo sapiens
gauauguucugagaaaugcauu

SEQ ID NO: 299960 - RNA, 19 nt, Homo sapiens
gauauguugagcacccuuu

SEQ ID NO: 299961 - RNA, 22 nt, Homo sapiens
gaucaguuucuggagauacgua

SEQ ID NO: 299962 - RNA, 22 nt, Homo sapiens
gaugauauuugagucauuagaa

SEQ ID NO: 299963 - RNA, 22 nt, Homo sapiens
gaugcaguaagaaugcauagcg

SEQ ID NO: 299964 - RNA, 22 nt, Homo sapiens
gauguguugggaagauuucaag

SEQ ID NO: 299965 - RNA, 22 nt, Homo sapiens
gauguuguuuagccuuugaugu

SEQ ID NO: 299966 - RNA, 22 nt, Homo sapiens
gauuccauuuguggcuauuuac

SEQ ID NO: 299967 - RNA, 22 nt, Homo sapiens
gauuugagagaggguguuuaua

SEQ ID NO: 299968 - RNA, 22 nt, Homo sapiens
gauuuguuggccugugagcuag

SEQ ID NO: 299969 - RNA, 22 nt, Homo sapiens
gauuuuuggggaagccucuuau

SEQ ID NO: 299970 - RNA, 22 nt, Homo sapiens
gcaaaguguuuuccaacuuggu

SEQ ID NO: 299971 - RNA, 22 nt, Homo sapiens
gcaaaucuuauguccucacauu

SEQ ID NO: 299972 - RNA, 22 nt, Homo sapiens
gcaaugcugucugugcacagau

SEQ ID NO: 299973 - RNA, 22 nt, Homo sapiens
gcacaaugccugacgaguccug

SEQ ID NO: 299974 - RNA, 22 nt, Homo sapiens
gcacaggguuacauucuaaggu

SEQ ID NO: 299975 - RNA, 22 nt, Homo sapiens
gcaggaaucuugagaaggauuc

SEQ ID NO: 299976 - RNA, 22 nt, Homo sapiens
gcauauguuuggguguguauau

SEQ ID NO: 299977 - RNA, 20 nt, Homo sapiens
gccacaguuaagcuucugcc

SEQ ID NO: 299978 - RNA, 22 nt, Homo sapiens
gcccaguagcaguacaucccuu

SEQ ID NO: 299979 - RNA, 22 nt, Homo sapiens
gcccugauacauucuucugccu

SEQ ID NO: 299980 - RNA, 22 nt, Homo sapiens
gcucugguuacaaaggcaaauu

SEQ ID NO: 299981 - RNA, 17 nt, Homo sapiens
gcugcauucauguagaa

SEQ ID NO: 299982 - RNA, 22 nt, Homo sapiens
gcugcuguuauucaucagaacu

SEQ ID NO: 299983 - RNA, 22 nt, Homo sapiens
uucuugguuuaucgcuuuaaaa

SEQ ID NO: 299984 - RNA, 18 nt, Homo sapiens
uucuuguguugauauuuu

SEQ ID NO: 299985 - RNA, 22 nt, Homo sapiens
uucuuuggauaaaguuuuaugc

SEQ ID NO: 299986 - RNA, 22 nt, Homo sapiens
uucuuugguacaagggccgacc

SEQ ID NO: 299987 - RNA, 23 nt, Homo sapiens
uugaaaagucaguagccucugau

SEQ ID NO: 299988 - RNA, 22 nt, Homo sapiens
uugaaagaaaggagacugaguu

SEQ ID NO: 299989 - RNA, 22 nt, Homo sapiens
uugaagguaauugguuuuauga

SEQ ID NO: 299990 - RNA, 22 nt, Homo sapiens
uugaaguaggaaaggaggaggu

SEQ ID NO: 299991 - RNA, 22 nt, Homo sapiens
uugaaguagguaccguucaauu

SEQ ID NO: 299992 - RNA, 22 nt, Homo sapiens
uugaauagaagguuuuuuguuc

SEQ ID NO: 299993 - RNA, 22 nt, Homo sapiens
uugaaugaaauuggugugggga

SEQ ID NO: 299994 - RNA, 22 nt, Homo sapiens
uugacauaaucauuucacagug

SEQ ID NO: 299995 - RNA, 22 nt, Homo sapiens
uugacauaguuucugaaauaga

SEQ ID NO: 299996 - RNA, 22 nt, Homo sapiens
uugaccccuucuaauagccuca

SEQ ID NO: 299997 - RNA, 21 nt, Homo sapiens
uugagacggagucucacucug

SEQ ID NO: 299998 - RNA, 22 nt, Homo sapiens
uugagaguggaggcuauaucuu

SEQ ID NO: 299999 - RNA, 22 nt, Homo sapiens
uugagaucaugcuacugcacuc

SEQ ID NO: 300000 - RNA, 22 nt, Homo sapiens
uugagaugaagucuugcucucu

SEQ ID NO: 300001 - RNA, 22 nt, Homo sapiens
uugagaugaaguuuugcucuuu

SEQ ID NO: 300002 - RNA, 22 nt, Homo sapiens
uugagauggagucucgcugugu

SEQ ID NO: 300003 - RNA, 22 nt, Homo sapiens
uugagauggagucuugcgcugu

SEQ ID NO: 300004 - RNA, 22 nt, Homo sapiens
uugagauggagucuugcucucu

SEQ ID NO: 300005 - RNA, 22 nt, Homo sapiens
uugagauggaguguugcucugu

SEQ ID NO: 300006 - RNA, 22 nt, Homo sapiens
uugagauguaagauguuaauau

SEQ ID NO: 300007 - RNA, 22 nt, Homo sapiens
uugagauguggcaguuuaugag

SEQ ID NO: 300008 - RNA, 22 nt, Homo sapiens
uugagauguggguuggugacuu

SEQ ID NO: 300009 - RNA, 22 nt, Homo sapiens
uugagcaauccuccugccaugu

SEQ ID NO: 300010 - RNA, 22 nt, Homo sapiens
uugagcacaggaguuuugagac

SEQ ID NO: 300011 - RNA, 22 nt, Homo sapiens
uugagcacaguagguuguggcu

SEQ ID NO: 300012 - RNA, 22 nt, Homo sapiens
uugagcaucauguuagcacuca

SEQ ID NO: 300013 - RNA, 22 nt, Homo sapiens
uugaggaagugguuccccagag

SEQ ID NO: 300014 - RNA, 22 nt, Homo sapiens
uugaggucagagguucgagacc

SEQ ID NO: 300015 - RNA, 22 nt, Homo sapiens
uugauaauguuaacuuugguca

SEQ ID NO: 300016 - RNA, 22 nt, Homo sapiens
uugauaugguauaagauuucau

SEQ ID NO: 300017 - RNA, 22 nt, Homo sapiens
uugaucaaaucugagugagaau

SEQ ID NO: 300018 - RNA, 22 nt, Homo sapiens
uugaucaauagaauacaacaga

SEQ ID NO: 300019 - RNA, 22 nt, Homo sapiens
auacaugugccauguugguaug

SEQ ID NO: 300020 - RNA, 22 nt, Homo sapiens
auacaugugccauguugguuug

SEQ ID NO: 300021 - RNA, 19 nt, Homo sapiens
auacccacuagguuacuua

SEQ ID NO: 300022 - RNA, 22 nt, Homo sapiens
auaccuuuuaggggaacguucu

SEQ ID NO: 300023 - RNA, 22 nt, Homo sapiens
auacuguacugaaguacccauu

SEQ ID NO: 300024 - RNA, 22 nt, Homo sapiens
auacuguuucugaacuuugauu

SEQ ID NO: 300025 - RNA, 22 nt, Homo sapiens
auagcagaacagugucucacug

SEQ ID NO: 300026 - RNA, 22 nt, Homo sapiens
auagcagaagaagggacaauuc

SEQ ID NO: 300027 - RNA, 22 nt, Homo sapiens
auagcagaauuuggucaagucu

SEQ ID NO: 300028 - RNA, 22 nt, Homo sapiens
auagcagacauuucaaggcagg

SEQ ID NO: 300029 - RNA, 20 nt, Homo sapiens
auagcauugauggacucaaa

SEQ ID NO: 300030 - RNA, 22 nt, Homo sapiens
auagucaaaucucauuaccccc

SEQ ID NO: 300031 - RNA, 21 nt, Homo sapiens
auagugcuagagaguagcagg

SEQ ID NO: 300032 - RNA, 22 nt, Homo sapiens
auagugcugcaauaaacacacg

SEQ ID NO: 300033 - RNA, 22 nt, Homo sapiens
auagugcugcaauaaccauggg

SEQ ID NO: 300034 - RNA, 22 nt, Homo sapiens
auauagcaaugaaagagaugaa

SEQ ID NO: 300035 - RNA, 22 nt, Homo sapiens
auauaugcuaagugcuaauaaa

SEQ ID NO: 300036 - RNA, 22 nt, Homo sapiens
auauauguuuucugggaagaaa

SEQ ID NO: 300037 - RNA, 22 nt, Homo sapiens
auaucacaaacaagucuguacu

SEQ ID NO: 300038 - RNA, 22 nt, Homo sapiens
auauccuggagcauuuuugcaa

SEQ ID NO: 300039 - RNA, 20 nt, Homo sapiens
auaugcauguguuuucacuu

SEQ ID NO: 300040 - RNA, 19 nt, Homo sapiens
auaugggguuugaacugug

SEQ ID NO: 300041 - RNA, 22 nt, Homo sapiens
auaugguguuugcuauucagcu

SEQ ID NO: 300042 - RNA, 22 nt, Homo sapiens
auauguucucauucauaugugg

SEQ ID NO: 300043 - RNA, 22 nt, Homo sapiens
auauugcuccuaauaccacggu

SEQ ID NO: 300044 - RNA, 19 nt, Homo sapiens
aucaaacugcucuuugagg

SEQ ID NO: 300045 - RNA, 22 nt, Homo sapiens
aucaaguacuguacugaaagug

SEQ ID NO: 300046 - RNA, 22 nt, Homo sapiens
aucacagaguuaaaacuuucuu

SEQ ID NO: 300047 - RNA, 22 nt, Homo sapiens
aucacauuuauaguggcacgca

SEQ ID NO: 300048 - RNA, 22 nt, Homo sapiens
aucagagccugugugcccugaa

SEQ ID NO: 300049 - RNA, 22 nt, Homo sapiens
aucagagugaauaaugacaaaa

SEQ ID NO: 300050 - RNA, 22 nt, Homo sapiens
aucagauuccacauuuuaucag

SEQ ID NO: 300051 - RNA, 19 nt, Homo sapiens
aucagcacaagugugcuuu

SEQ ID NO: 300052 - RNA, 22 nt, Homo sapiens
aucauagcucacugcagccucg

SEQ ID NO: 300053 - RNA, 22 nt, Homo sapiens
aucauugugcaucuucauucca

SEQ ID NO: 300054 - RNA, 22 nt, Homo sapiens
auccauguggauaaauguguau

SEQ ID NO: 300055 - RNA, 22 nt, Homo sapiens
aucccaguucagccucugacac

SEQ ID NO: 300056 - RNA, 22 nt, Homo sapiens
aucccugugauccaaucacuuc

SEQ ID NO: 300057 - RNA, 22 nt, Homo sapiens
aucccuugacguggagucucug

SEQ ID NO: 300058 - RNA, 22 nt, Homo sapiens
aucccuuucugauacuuucccu

SEQ ID NO: 300059 - RNA, 22 nt, Homo sapiens
auccugaagcuuuacugaauuc

SEQ ID NO: 300060 - RNA, 22 nt, Homo sapiens
auccugagacuuugcugaaguu

SEQ ID NO: 300061 - RNA, 22 nt, Homo sapiens
auccuguagucucacagcccca

SEQ ID NO: 300062 - RNA, 22 nt, Homo sapiens
aucucaguucaggcuggccaca

SEQ ID NO: 300063 - RNA, 20 nt, Homo sapiens
aucucugggcaaaggaaaau

SEQ ID NO: 300064 - RNA, 22 nt, Homo sapiens
aucugguguuuccuucacauug

SEQ ID NO: 300065 - RNA, 22 nt, Homo sapiens
aucuuggauuaccugggugggu

SEQ ID NO: 300066 - RNA, 22 nt, Homo sapiens
aucuuugauuagacugauggau

SEQ ID NO: 300067 - RNA, 22 nt, Homo sapiens
aucuuuggucaucacagcuaga

SEQ ID NO: 300068 - RNA, 22 nt, Homo sapiens
aucuuuggugaguucuuugguc

SEQ ID NO: 300069 - RNA, 22 nt, Homo sapiens
aucuuuggugcaugauacuuug

SEQ ID NO: 300070 - RNA, 21 nt, Homo sapiens
cacuggguucaggcuugugga

SEQ ID NO: 300071 - RNA, 22 nt, Homo sapiens
cacuggucucauggcaugagag

SEQ ID NO: 300072 - RNA, 22 nt, Homo sapiens
cagaaguauugguaugcucugu

SEQ ID NO: 300073 - RNA, 22 nt, Homo sapiens
cagagaacauucagagcuguag

SEQ ID NO: 300074 - RNA, 21 nt, Homo sapiens
cagagaucaucucuguuuuaa

SEQ ID NO: 300075 - RNA, 22 nt, Homo sapiens
cagcuugugguauugcugguug

SEQ ID NO: 300076 - RNA, 22 nt, Homo sapiens
caggaaugugaggguucccugc

SEQ ID NO: 300077 - RNA, 22 nt, Homo sapiens
caggaccucuugccuggaagcc

SEQ ID NO: 300078 - RNA, 22 nt, Homo sapiens
caggcacgcuugggagacacac

SEQ ID NO: 300079 - RNA, 22 nt, Homo sapiens
caggcauuguauuguaaucccc

SEQ ID NO: 300080 - RNA, 22 nt, Homo sapiens
cagguacauuuuaaagggcuca

SEQ ID NO: 300081 - RNA, 22 nt, Homo sapiens
caggugaaugccucuccuucug

SEQ ID NO: 300082 - RNA, 22 nt, Homo sapiens
cagugguuuucaacccugguug

SEQ ID NO: 300083 - RNA, 22 nt, Homo sapiens
cagugguuuuuagcuugcuggg

SEQ ID NO: 300084 - RNA, 22 nt, Homo sapiens
cagugucugcauuuggaacuca

SEQ ID NO: 300085 - RNA, 22 nt, Homo sapiens
caguguuuuuaacaggugcccg

SEQ ID NO: 300086 - RNA, 22 nt, Homo sapiens
cauaaagauggaggaggccagg

SEQ ID NO: 300087 - RNA, 22 nt, Homo sapiens
cauauucacuuuacagagcugu

SEQ ID NO: 300088 - RNA, 19 nt, Homo sapiens
caucacagagucuuccauu

SEQ ID NO: 300089 - RNA, 22 nt, Homo sapiens
caucacaucugcaugguaagua

SEQ ID NO: 300090 - RNA, 22 nt, Homo sapiens
caucagauugagaucaucuaag

SEQ ID NO: 300091 - RNA, 19 nt, Homo sapiens
caucccugagcugaagugg

SEQ ID NO: 300092 - RNA, 22 nt, Homo sapiens
caugaaagacugaggaauugga

SEQ ID NO: 300093 - RNA, 23 nt, Homo sapiens
caugaacuaguuugcagccauga

SEQ ID NO: 300094 - RNA, 22 nt, Homo sapiens
caugcacugagagggucucggc

SEQ ID NO: 300095 - RNA, 22 nt, Homo sapiens
caugccacugcacgccauccug

SEQ ID NO: 300096 - RNA, 22 nt, Homo sapiens
cauggagcuaggcuugaucccu

SEQ ID NO: 300097 - RNA, 22 nt, Homo sapiens
cauggcccuggguccauaggaa

SEQ ID NO: 300098 - RNA, 22 nt, Homo sapiens
cauggcuuuuauaacaagaaau

SEQ ID NO: 300099 - RNA, 22 nt, Homo sapiens
cauggguuuucucaaguaguca

SEQ ID NO: 300100 - RNA, 22 nt, Homo sapiens
cauguauagauuccauaguggu

SEQ ID NO: 300101 - RNA, 22 nt, Homo sapiens
caugucuuuuauucugugugau

SEQ ID NO: 300102 - RNA, 22 nt, Homo sapiens
cauugcacacauuuaccuaugu

SEQ ID NO: 300103 - RNA, 19 nt, Homo sapiens
cauugcacuccacccuggg

SEQ ID NO: 300104 - RNA, 22 nt, Homo sapiens
cauugcacuccagccucggcaa

SEQ ID NO: 300105 - RNA, 22 nt, Homo sapiens
cauugcacuccagccugcacga

SEQ ID NO: 300106 - RNA, 22 nt, Homo sapiens
cauugcacuccagccugcugac

SEQ ID NO: 300107 - RNA, 22 nt, Homo sapiens
cauugcacuccagccuuggcaa

SEQ ID NO: 300108 - RNA, 22 nt, Homo sapiens
ccaagccucaguuucccucugu

SEQ ID NO: 300109 - RNA, 22 nt, Homo sapiens
ccaaguguucucauuguucaau

SEQ ID NO: 300110 - RNA, 22 nt, Homo sapiens
ccacagucuaugcaacaagguc

SEQ ID NO: 300111 - RNA, 22 nt, Homo sapiens
ccacauuaccuugcuugcucca

SEQ ID NO: 300112 - RNA, 22 nt, Homo sapiens
ccacccuggagaauuugagguc

SEQ ID NO: 300113 - RNA, 22 nt, Homo sapiens
ccacccuuccauucuuccucuu

SEQ ID NO: 300114 - RNA, 22 nt, Homo sapiens
ccacuguuuaaauggcugagga

SEQ ID NO: 300115 - RNA, 22 nt, Homo sapiens
ccagaguucuaggcauuggaaa

SEQ ID NO: 300116 - RNA, 22 nt, Homo sapiens
ccagaguuucugauucagcagg

SEQ ID NO: 300117 - RNA, 22 nt, Homo sapiens
ccaggguuccacgccuggcugu

SEQ ID NO: 300118 - RNA, 22 nt, Homo sapiens
ccugcauaguucaccgcugaua

SEQ ID NO: 300119 - RNA, 22 nt, Homo sapiens
ccuugcacuucccaggugaggc

SEQ ID NO: 300120 - RNA, 22 nt, Homo sapiens
ccuuggcacuuugccacagugc

SEQ ID NO: 300121 - RNA, 22 nt, Homo sapiens
ccuugguugugcuucaacuucu

SEQ ID NO: 300122 - RNA, 22 nt, Homo sapiens
ccuuuguggggcgguggguaau

SEQ ID NO: 300123 - RNA, 22 nt, Homo sapiens
cgcccuguagcuagcuagaggu

SEQ ID NO: 300124 - RNA, 22 nt, Homo sapiens
cgcuggugucuaagcgacagcu

SEQ ID NO: 300125 - RNA, 22 nt, Homo sapiens
cggaaugaaaauguccuucagu

SEQ ID NO: 300126 - RNA, 22 nt, Homo sapiens
cuaaaguauugagugguaaaga

SEQ ID NO: 300127 - RNA, 22 nt, Homo sapiens
cuaaaugucucuacuaaguuua

SEQ ID NO: 300128 - RNA, 22 nt, Homo sapiens
cuaagguacuguuaacauugua

SEQ ID NO: 300129 - RNA, 22 nt, Homo sapiens
cuaaucuagccuuauaaguauu

SEQ ID NO: 300130 - RNA, 22 nt, Homo sapiens
cuaaugcagucaggagaaggaa

SEQ ID NO: 300131 - RNA, 22 nt, Homo sapiens
cuacagugggucuguaguccuu

SEQ ID NO: 300132 - RNA, 22 nt, Homo sapiens
cuacaguucuuaauuaaguagu

SEQ ID NO: 300133 - RNA, 22 nt, Homo sapiens
cuacugcacaucaucugaguua

SEQ ID NO: 300134 - RNA, 22 nt, Homo sapiens
cuagauuauccaacuuauuagc

SEQ ID NO: 300135 - RNA, 22 nt, Homo sapiens
cuagcagacaggcugggagcag

SEQ ID NO: 300136 - RNA, 22 nt, Homo sapiens
cuagccuggagugcaguggugc

SEQ ID NO: 300137 - RNA, 22 nt, Homo sapiens
cuagcuuuugauguaaagugag

SEQ ID NO: 300138 - RNA, 22 nt, Homo sapiens
cuaggcuguagagaaguucagu

SEQ ID NO: 300139 - RNA, 22 nt, Homo sapiens
cuaugcuucuuaaauuaguuau

SEQ ID NO: 300140 - RNA, 22 nt, Homo sapiens
cuaugguuucucaaacuccuga

SEQ ID NO: 300141 - RNA, 22 nt, Homo sapiens
cuauguaccuggaacuguauua

SEQ ID NO: 300142 - RNA, 22 nt, Homo sapiens
cuaugucuuucauauuuugggg

SEQ ID NO: 300143 - RNA, 22 nt, Homo sapiens
cuauuacuuuuauugaacucag

SEQ ID NO: 300144 - RNA, 22 nt, Homo sapiens
cuauucacaggcaauauguaca

SEQ ID NO: 300145 - RNA, 22 nt, Homo sapiens
cucaaagucaagggaaagcagg

SEQ ID NO: 300146 - RNA, 22 nt, Homo sapiens
cucaauuuggaauugucaguaa

SEQ ID NO: 300147 - RNA, 18 nt, Homo sapiens
cucacaguaacuuuuaag

SEQ ID NO: 300148 - RNA, 22 nt, Homo sapiens
cucacagucucucccuaauuuu

SEQ ID NO: 300149 - RNA, 22 nt, Homo sapiens
cucacagugacacgaaccccca

SEQ ID NO: 300150 - RNA, 22 nt, Homo sapiens
cucacugucaacauguauuugg

SEQ ID NO: 300151 - RNA, 22 nt, Homo sapiens
cucagcuacuugagaggcuuag

SEQ ID NO: 300152 - RNA, 22 nt, Homo sapiens
cucaguggauuagauaaugcac

SEQ ID NO: 300153 - RNA, 22 nt, Homo sapiens
cucaguguuucagcugcucaga

SEQ ID NO: 300154 - RNA, 22 nt, Homo sapiens
cucauggaauacuucacagcca

SEQ ID NO: 300155 - RNA, 22 nt, Homo sapiens
cucauggagaacaucugcuagg

SEQ ID NO: 300156 - RNA, 22 nt, Homo sapiens
cuccagugcaaagucaugauca

SEQ ID NO: 300157 - RNA, 22 nt, Homo sapiens
cucugacagugguuagcacugu

SEQ ID NO: 300158 - RNA, 22 nt, Homo sapiens
cucuuggguagauuuugcagag

SEQ ID NO: 300159 - RNA, 22 nt, Homo sapiens
cugaaagagcauguaacacagu

SEQ ID NO: 300160 - RNA, 22 nt, Homo sapiens
cugaagugcuugccacauaaaa

SEQ ID NO: 300161 - RNA, 20 nt, Homo sapiens
cugaaugucaaggcagaggu

SEQ ID NO: 300162 - RNA, 22 nt, Homo sapiens
cugaauguucuauagaagccgc

SEQ ID NO: 300163 - RNA, 22 nt, Homo sapiens
cugaauguucuggauggaagag

SEQ ID NO: 300164 - RNA, 22 nt, Homo sapiens
cugagauggagucucgcauugu

SEQ ID NO: 300165 - RNA, 22 nt, Homo sapiens
cugagcaugacaucaugugacu

SEQ ID NO: 300166 - RNA, 22 nt, Homo sapiens
cugagcccauucuggggagaag

SEQ ID NO: 300167 - RNA, 22 nt, Homo sapiens
cugagcuagaccacuuggcucc

SEQ ID NO: 300168 - RNA, 22 nt, Homo sapiens
cugaggguagaaggaucacuug

SEQ ID NO: 300169 - RNA, 22 nt, Homo sapiens
cugaggugauauauacauauuu

SEQ ID NO: 300170 - RNA, 20 nt, Homo sapiens
cugagguugggguccuuccc

SEQ ID NO: 300171 - RNA, 22 nt, Homo sapiens
cugauguagguggucugugauc

SEQ ID NO: 300172 - RNA, 20 nt, Homo sapiens
cugcaaaugcugcugcugau

SEQ ID NO: 300173 - RNA, 22 nt, Homo sapiens
cugcagguaggggcagcuuugg

SEQ ID NO: 300174 - RNA, 22 nt, Homo sapiens
cugcaguaaacuuucccauuca

SEQ ID NO: 300175 - RNA, 21 nt, Homo sapiens
cugcauccauuucugagugau

SEQ ID NO: 300176 - RNA, 22 nt, Homo sapiens
cuggaaagaaucaggcuaaacu

SEQ ID NO: 300177 - RNA, 22 nt, Homo sapiens
cuggaauguuccuaaagauuca

SEQ ID NO: 300178 - RNA, 22 nt, Homo sapiens
cuggacaaaucuggaaagaacc

SEQ ID NO: 300179 - RNA, 22 nt, Homo sapiens
cuggcaagagugaaccagcugu

SEQ ID NO: 300180 - RNA, 22 nt, Homo sapiens
cuggcaccauacacuguuguug

SEQ ID NO: 300181 - RNA, 22 nt, Homo sapiens
cugggucaguuucugauuauug

SEQ ID NO: 300182 - RNA, 21 nt, Homo sapiens
cugguccccuuuauguaugug

SEQ ID NO: 300183 - RNA, 22 nt, Homo sapiens
uaugacuuuggaaaaauuacuu

SEQ ID NO: 300184 - RNA, 22 nt, Homo sapiens
uauggcacuaguacuggaaagc

SEQ ID NO: 300185 - RNA, 22 nt, Homo sapiens
uauggcuucuuuaaauugaggu

SEQ ID NO: 300186 - RNA, 22 nt, Homo sapiens
uauggcuuuuaacugucguaug

SEQ ID NO: 300187 - RNA, 22 nt, Homo sapiens
uaugucuucuuuagagaaaugu

SEQ ID NO: 300188 - RNA, 22 nt, Homo sapiens
uauuacacuuuagugucuucca

SEQ ID NO: 300189 - RNA, 22 nt, Homo sapiens
uauuauuguccuucuauaccca

SEQ ID NO: 300190 - RNA, 20 nt, Homo sapiens
uauucacucuccagucuugc

SEQ ID NO: 300191 - RNA, 22 nt, Homo sapiens
uauuccacucuguuggagguaa

SEQ ID NO: 300192 - RNA, 22 nt, Homo sapiens
uauuccauuugugaaaggaagu

SEQ ID NO: 300193 - RNA, 22 nt, Homo sapiens
uauugcaauuggcagagugcua

SEQ ID NO: 300194 - RNA, 22 nt, Homo sapiens
uauugcuuaugaugcugaauua

SEQ ID NO: 300195 - RNA, 22 nt, Homo sapiens
uauugcuuuugauucaaggcag

SEQ ID NO: 300196 - RNA, 22 nt, Homo sapiens
uauuguacauguuauagauuuu

SEQ ID NO: 300197 - RNA, 22 nt, Homo sapiens
uauuguuaaagauguuaaugau

SEQ ID NO: 300198 - RNA, 22 nt, Homo sapiens
uauuuguccccuccaaaaguca

SEQ ID NO: 300199 - RNA, 22 nt, Homo sapiens
ucaaaguagaaaaggggcaauu

SEQ ID NO: 300200 - RNA, 22 nt, Homo sapiens
ucaaagugagcuccuucucacu

SEQ ID NO: 300201 - RNA, 22 nt, Homo sapiens
ucaaauguuuguuuaaggcuua

SEQ ID NO: 300202 - RNA, 22 nt, Homo sapiens
ucaacagugauggaaaguuaua

SEQ ID NO: 300203 - RNA, 22 nt, Homo sapiens
ucaagcaauucuccucucagcc

SEQ ID NO: 300204 - RNA, 22 nt, Homo sapiens
ucaaguaguaacuaacugugac

SEQ ID NO: 300205 - RNA, 22 nt, Homo sapiens
ucacacgugaacucaucacaga

SEQ ID NO: 300206 - RNA, 22 nt, Homo sapiens
ucacacucucaccaacauuugg

SEQ ID NO: 300207 - RNA, 22 nt, Homo sapiens
ucacagaggagaagaccuuuaa

SEQ ID NO: 300208 - RNA, 22 nt, Homo sapiens
ucacagaugaggcgagaggcag

SEQ ID NO: 300209 - RNA, 21 nt, Homo sapiens
ucacagccuaggaccugaaga

SEQ ID NO: 300210 - RNA, 20 nt, Homo sapiens
ucacagucacacauaauccu

SEQ ID NO: 300211 - RNA, 17 nt, Homo sapiens
uuagagguagacucauu

SEQ ID NO: 300212 - RNA, 22 nt, Homo sapiens
uuagcacugagaauggcuugcu

SEQ ID NO: 300213 - RNA, 21 nt, Homo sapiens
uuagcauccauguucaucaac

SEQ ID NO: 300214 - RNA, 22 nt, Homo sapiens
uuagccccuuugagccucaacu

SEQ ID NO: 300215 - RNA, 19 nt, Homo sapiens
uuagguacuggauaugccc

SEQ ID NO: 300216 - RNA, 23 nt, Homo sapiens
uuaguaaacucaaugacaccaca

SEQ ID NO: 300217 - RNA, 22 nt, Homo sapiens
uuauaacucugcagccugguau

SEQ ID NO: 300218 - RNA, 20 nt, Homo sapiens
uuauaacuuuuguucugggg

SEQ ID NO: 300219 - RNA, 21 nt, Homo sapiens
uuauaguggcaugauuuauaa

SEQ ID NO: 300220 - RNA, 22 nt, Homo sapiens
uuauauguuacucccucuagca

SEQ ID NO: 300221 - RNA, 22 nt, Homo sapiens
uuaucaaacccuaggagguggu

SEQ ID NO: 300222 - RNA, 22 nt, Homo sapiens
uuaucacauugacugauuugca

SEQ ID NO: 300223 - RNA, 22 nt, Homo sapiens
uuaucucaguguuuguaaacaa

SEQ ID NO: 300224 - RNA, 22 nt, Homo sapiens
uuaugguuguuaucuugguucg

SEQ ID NO: 300225 - RNA, 22 nt, Homo sapiens
uuaugguuuauuagcaggguua

SEQ ID NO: 300226 - RNA, 22 nt, Homo sapiens
uuauguccuuuaacuucaucac

SEQ ID NO: 300227 - RNA, 20 nt, Homo sapiens
uuaugucguuucuugcuuau

SEQ ID NO: 300228 - RNA, 22 nt, Homo sapiens
uuauuacuccuauuuuguagau

SEQ ID NO: 300229 - RNA, 22 nt, Homo sapiens
uuauuagcacccuaccaugugg

SEQ ID NO: 300230 - RNA, 22 nt, Homo sapiens
uucaaaguaaaaauguguucac

SEQ ID NO: 300231 - RNA, 22 nt, Homo sapiens
uucaaauguucuuucaccaccc

SEQ ID NO: 300232 - RNA, 22 nt, Homo sapiens
uucaagaauuaaaguggcuuuu

SEQ ID NO: 300233 - RNA, 22 nt, Homo sapiens
uucaagucaaggaaagaggucu

SEQ ID NO: 300234 - RNA, 22 nt, Homo sapiens
uucaauaugucauuggcaggca

SEQ ID NO: 300235 - RNA, 22 nt, Homo sapiens
uucacagacaacuggucccuua

SEQ ID NO: 300236 - RNA, 22 nt, Homo sapiens
uucacagccgcaccccaucacu

SEQ ID NO: 300237 - RNA, 22 nt, Homo sapiens
uucacagcuuaauaaggcucag

SEQ ID NO: 300238 - RNA, 20 nt, Homo sapiens
uucacaggcagcuucuuucu

SEQ ID NO: 300239 - RNA, 22 nt, Homo sapiens
uucaccaguuuugucacgaaug

SEQ ID NO: 300240 - RNA, 22 nt, Homo sapiens
uucaccuggaguucaggauaag

SEQ ID NO: 300241 - RNA, 22 nt, Homo sapiens
uucaccuggguuggccaucauu

SEQ ID NO: 300242 - RNA, 22 nt, Homo sapiens
uucaccuguagcaugcccuugg

SEQ ID NO: 300243 - RNA, 21 nt, Homo sapiens
uucacuggucuauuucccuuu

SEQ ID NO: 300244 - RNA, 22 nt, Homo sapiens
uucaggcuccugugagaaucua

SEQ ID NO: 300245 - RNA, 22 nt, Homo sapiens
uucaggcuuuuauuuacugaua

SEQ ID NO: 300246 - RNA, 22 nt, Homo sapiens
uucagggcauuggaguuucuga

SEQ ID NO: 300247 - RNA, 22 nt, Homo sapiens
uucaguacacguguucucauuu

SEQ ID NO: 300248 - RNA, 22 nt, Homo sapiens
uucaguucugcucugaucuuag

SEQ ID NO: 300249 - RNA, 22 nt, Homo sapiens
uucaugcaucuguagugguuaa

SEQ ID NO: 300250 - RNA, 22 nt, Homo sapiens
uucauggaugcauuugaggggu

SEQ ID NO: 300251 - RNA, 22 nt, Homo sapiens
uucauggauggaaaugauuuug

SEQ ID NO: 300252 - RNA, 22 nt, Homo sapiens
uucauggguuaauuuguucgau

SEQ ID NO: 300253 - RNA, 22 nt, Homo sapiens
uucauggugguacaaaagcaau

SEQ ID NO: 300254 - RNA, 22 nt, Homo sapiens
uucaugucuuggcuguuagagu

SEQ ID NO: 300255 - RNA, 22 nt, Homo sapiens
uucauuggacuuguguucuuga

SEQ ID NO: 300256 - RNA, 22 nt, Homo sapiens
uuccaagugggaaacaaaaaug

SEQ ID NO: 300257 - RNA, 22 nt, Homo sapiens
uuccacaaugguugaacuagcu

SEQ ID NO: 300258 - RNA, 23 nt, Homo sapiens
uuccaccauugacuaguuacaua

SEQ ID NO: 300259 - RNA, 20 nt, Homo sapiens
uuccagcacauuagggaagc

SEQ ID NO: 300260 - RNA, 22 nt, Homo sapiens
uuccaguguguucauccucaga

SEQ ID NO: 300261 - RNA, 22 nt, Homo sapiens
uuccaguguuugacucaccuuu

SEQ ID NO: 300262 - RNA, 22 nt, Homo sapiens
uuccauuuguucggugucgcca

SEQ ID NO: 300263 - RNA, 22 nt, Homo sapiens
uucccagagccugggagugagg

SEQ ID NO: 300264 - RNA, 22 nt, Homo sapiens
uucccguacugguguugccuau

SEQ ID NO: 300265 - RNA, 20 nt, Homo sapiens
uucccucagccuugagggua

SEQ ID NO: 300266 - RNA, 22 nt, Homo sapiens
uuccuacugcccauuaaaaugg

SEQ ID NO: 300267 - RNA, 22 nt, Homo sapiens
uuccuagagauuagcaagcugc

SEQ ID NO: 300268 - RNA, 22 nt, Homo sapiens
uuccuggaggggaaguguccaa

SEQ ID NO: 300269 - RNA, 22 nt, Homo sapiens
uuccuguagcgauuuuaguaau

SEQ ID NO: 300270 - RNA, 22 nt, Homo sapiens
uuccugugacccccaagcccac

SEQ ID NO: 300271 - RNA, 22 nt, Homo sapiens
uuccuugugacuaguagugacc

SEQ ID NO: 300272 - RNA, 22 nt, Homo sapiens
uucugccaaucaacccacaucc

SEQ ID NO: 300273 - RNA, 22 nt, Homo sapiens
uucuggcuuuuaaagaaauguu

SEQ ID NO: 300274 - RNA, 22 nt, Homo sapiens
uucugugguugaaaggagagau

SEQ ID NO: 300275 - RNA, 22 nt, Homo sapiens
uucuugcacuuaacugacauuc

SEQ ID NO: 300276 - RNA, 22 nt, Homo sapiens
uucuuuggaaacaguacuaauu

SEQ ID NO: 300277 - RNA, 22 nt, Homo sapiens
uugaaagaugaacuggauugga

SEQ ID NO: 300278 - RNA, 22 nt, Homo sapiens
uugaaagucauggcacaggcaa

SEQ ID NO: 300279 - RNA, 22 nt, Homo sapiens
uugaaaguguucacaaugguau

SEQ ID NO: 300280 - RNA, 22 nt, Homo sapiens
uugaaggaacgcuguucccuug

SEQ ID NO: 300281 - RNA, 22 nt, Homo sapiens
uugaaguauagaguuuaagaac

SEQ ID NO: 300282 - RNA, 22 nt, Homo sapiens
uugaaugaaaugaugucauuug

SEQ ID NO: 300283 - RNA, 22 nt, Homo sapiens
uugaaugaauggaaagaagggu

SEQ ID NO: 300284 - RNA, 17 nt, Homo sapiens
uugaaugcauuacuugg

SEQ ID NO: 300285 - RNA, 20 nt, Homo sapiens
uugacagagggaaaguugcu

SEQ ID NO: 300286 - RNA, 19 nt, Homo sapiens
ucucugguguuggagggga

SEQ ID NO: 300287 - RNA, 22 nt, Homo sapiens
ucugacaaugaacaaucuauag

SEQ ID NO: 300288 - RNA, 22 nt, Homo sapiens
ucugagaugagacuuugaauuu

SEQ ID NO: 300289 - RNA, 22 nt, Homo sapiens
ucugaguggcagaaugagcuga

SEQ ID NO: 300290 - RNA, 22 nt, Homo sapiens
ucugccaaccacaaaauuuauu

SEQ ID NO: 300291 - RNA, 21 nt, Homo sapiens
ucuggcccccucaaaucucau

SEQ ID NO: 300292 - RNA, 22 nt, Homo sapiens
ucuggccccucucaaaucucau

SEQ ID NO: 300293 - RNA, 22 nt, Homo sapiens
ucuguacugccaaguuucuuua

SEQ ID NO: 300294 - RNA, 22 nt, Homo sapiens
ucuguacuuccguaccuaaagu

SEQ ID NO: 300295 - RNA, 22 nt, Homo sapiens
ucugucaaaucuuauguuguag

SEQ ID NO: 300296 - RNA, 22 nt, Homo sapiens
ucugucuugugguuugagugcc

SEQ ID NO: 300297 - RNA, 22 nt, Homo sapiens
ucugucuuugccuaaguuuguc

SEQ ID NO: 300298 - RNA, 22 nt, Homo sapiens
ucugugcauuguaggauguuua

SEQ ID NO: 300299 - RNA, 22 nt, Homo sapiens
ucugugcugagaguugaaaguu

SEQ ID NO: 300300 - RNA, 22 nt, Homo sapiens
ucugugguucaggcuggagugc

SEQ ID NO: 300301 - RNA, 22 nt, Homo sapiens
ucugugguuguugcauggaaug

SEQ ID NO: 300302 - RNA, 22 nt, Homo sapiens
ucuguguuugaucaagauugua

SEQ ID NO: 300303 - RNA, 22 nt, Homo sapiens
ucuucagucauauuggccugga

SEQ ID NO: 300304 - RNA, 22 nt, Homo sapiens
ucuucaugcuugaaauaauagc

SEQ ID NO: 300305 - RNA, 22 nt, Homo sapiens
ucuugcuuuugcagagcuucuc

SEQ ID NO: 300306 - RNA, 22 nt, Homo sapiens
ucuuggcauggcugaagauucc

SEQ ID NO: 300307 - RNA, 22 nt, Homo sapiens
ucuuggccaugaauggcaaggc

SEQ ID NO: 300308 - RNA, 22 nt, Homo sapiens
ucuuuaguaauuucuguaaggc

SEQ ID NO: 300309 - RNA, 22 nt, Homo sapiens
ucuuuaguuaagggacauuuua

SEQ ID NO: 300310 - RNA, 22 nt, Homo sapiens
ucuuuggguguauuucacagcc

SEQ ID NO: 300311 - RNA, 19 nt, Homo sapiens
ucuuugguacgugcuuuga

SEQ ID NO: 300312 - RNA, 22 nt, Homo sapiens
ucuuuggucagaaagauuacac

SEQ ID NO: 300313 - RNA, 22 nt, Homo sapiens
aaaacgcauccucacaggucug

SEQ ID NO: 300314 - RNA, 22 nt, Homo sapiens
aaaagucuguagugaaagguga

SEQ ID NO: 300315 - RNA, 22 nt, Homo sapiens
aaaagugguguuguuucuaaau

SEQ ID NO: 300316 - RNA, 18 nt, Homo sapiens
aaacagugucucuuucug

SEQ ID NO: 300317 - RNA, 22 nt, Homo sapiens
aaacugucuggaugcuugugga

SEQ ID NO: 300318 - RNA, 22 nt, Homo sapiens
aaagaagucagccuguccuuug

SEQ ID NO: 300319 - RNA, 22 nt, Homo sapiens
aaaggcacuagaaguuaccuuu

SEQ ID NO: 300320 - RNA, 22 nt, Homo sapiens
aaaggcacugaucuuauccagu

SEQ ID NO: 300321 - RNA, 22 nt, Homo sapiens
aaaggcuucggaucagaaggua

SEQ ID NO: 300322 - RNA, 22 nt, Homo sapiens
aaagggcuugaauacucuuuuu

SEQ ID NO: 300323 - RNA, 22 nt, Homo sapiens
aaagucuguuacagcuauuucu

SEQ ID NO: 300324 - RNA, 22 nt, Homo sapiens
aaaguguguuuccaaccugugg

SEQ ID NO: 300325 - RNA, 22 nt, Homo sapiens
aaaugcaugaauaagcucgugu

SEQ ID NO: 300326 - RNA, 22 nt, Homo sapiens
aaaugcucucuacacguuucug

SEQ ID NO: 300327 - RNA, 21 nt, Homo sapiens
aaaugugcuuuaguacccuca

SEQ ID NO: 300328 - RNA, 22 nt, Homo sapiens
aaauugcaaugcgaggcagagg

SEQ ID NO: 300329 - RNA, 22 nt, Homo sapiens
aaauugcaguuaggaugauggu

SEQ ID NO: 300330 - RNA, 22 nt, Homo sapiens
aaauugcuuuugaagacuuagu

SEQ ID NO: 300331 - RNA, 22 nt, Homo sapiens
aacaccuugcagggauuaugac

SEQ ID NO: 300332 - RNA, 22 nt, Homo sapiens
aacacuggcugcucgaguucuc

SEQ ID NO: 300333 - RNA, 22 nt, Homo sapiens
aacaggcuccuaggggugcacc

SEQ ID NO: 300334 - RNA, 22 nt, Homo sapiens
aacagugcauuccuguccauau

SEQ ID NO: 300335 - RNA, 22 nt, Homo sapiens
aacccugacacaagcagaauuu

SEQ ID NO: 300336 - RNA, 22 nt, Homo sapiens
aacuggcacuacaucaagagcu

SEQ ID NO: 300337 - RNA, 21 nt, Homo sapiens
aacuggugugagaugguaugu

SEQ ID NO: 300338 - RNA, 22 nt, Homo sapiens
aagagagcuaugugcauaauua

SEQ ID NO: 300339 - RNA, 22 nt, Homo sapiens
aagagguagaagcuugccuucu

SEQ ID NO: 300340 - RNA, 22 nt, Homo sapiens
aagagguagcagucacaaaaga

SEQ ID NO: 300341 - RNA, 22 nt, Homo sapiens
aagcaaacaucagcuugguuaa

SEQ ID NO: 300342 - RNA, 22 nt, Homo sapiens
aagcaccaauaggagauuuguc

SEQ ID NO: 300343 - RNA, 22 nt, Homo sapiens
aagcagauguguugaaaguacu

SEQ ID NO: 300344 - RNA, 22 nt, Homo sapiens
aagcuggagugcaguggugcaa

SEQ ID NO: 300345 - RNA, 22 nt, Homo sapiens
agcuggcuguggagaaaccccu

SEQ ID NO: 300346 - RNA, 22 nt, Homo sapiens
agcuuguauuuguagccuguug

SEQ ID NO: 300347 - RNA, 23 nt, Homo sapiens
aggaauggaaaaccaaguaucau

SEQ ID NO: 300348 - RNA, 22 nt, Homo sapiens
aggaaugucaaugguaguuuaa

SEQ ID NO: 300349 - RNA, 22 nt, Homo sapiens
aggaccaugguauugcuuuggg

SEQ ID NO: 300350 - RNA, 22 nt, Homo sapiens
aggaccauuguguagcagacau

SEQ ID NO: 300351 - RNA, 22 nt, Homo sapiens
aggaccccucaucagcaccagu

SEQ ID NO: 300352 - RNA, 21 nt, Homo sapiens
aggagauguuuguccuuuuag

SEQ ID NO: 300353 - RNA, 23 nt, Homo sapiens
aggagcuuagaaguugccauugc

SEQ ID NO: 300354 - RNA, 22 nt, Homo sapiens
aggagguugguaccaucuguuu

SEQ ID NO: 300355 - RNA, 22 nt, Homo sapiens
aggcaagugggagacagcauuu

SEQ ID NO: 300356 - RNA, 22 nt, Homo sapiens
aggcaggugaaagauaguuuua

SEQ ID NO: 300357 - RNA, 22 nt, Homo sapiens
aggcaugaguucagaggguaug

SEQ ID NO: 300358 - RNA, 22 nt, Homo sapiens
aggcuuauuaagauucccuuau

SEQ ID NO: 300359 - RNA, 22 nt, Homo sapiens
agggaagugugcuaugcauuua

SEQ ID NO: 300360 - RNA, 23 nt, Homo sapiens
agggcacuauagauguuauucua

SEQ ID NO: 300361 - RNA, 22 nt, Homo sapiens
agggcaguguuaggacugucug

SEQ ID NO: 300362 - RNA, 22 nt, Homo sapiens
agggcuuuugagcugagauggu

SEQ ID NO: 300363 - RNA, 22 nt, Homo sapiens
agguagcauagcgggaauauca

SEQ ID NO: 300364 - RNA, 22 nt, Homo sapiens
agguauuuucaacuuagaaugg

SEQ ID NO: 300365 - RNA, 21 nt, Homo sapiens
aggucaguaagaaugcagcac

SEQ ID NO: 300366 - RNA, 22 nt, Homo sapiens
aguaacaggauccaaagaaugu

SEQ ID NO: 300367 - RNA, 22 nt, Homo sapiens
aguacacuguugaacagaagug

SEQ ID NO: 300368 - RNA, 22 nt, Homo sapiens
aguaccauuagauuaggaugac

SEQ ID NO: 300369 - RNA, 22 nt, Homo sapiens
agucaaaugcuuauguauaaag

SEQ ID NO: 300370 - RNA, 22 nt, Homo sapiens
agucaagaaucucagcaucuuu

SEQ ID NO: 300371 - RNA, 22 nt, Homo sapiens
agucacggugguuugcacuugu

SEQ ID NO: 300372 - RNA, 22 nt, Homo sapiens
agucaguguguauugauggcac

SEQ ID NO: 300373 - RNA, 22 nt, Homo sapiens
aguccauuugaugaugauucca

SEQ ID NO: 300374 - RNA, 22 nt, Homo sapiens
agugaaaucugaagaaggucau

SEQ ID NO: 300375 - RNA, 22 nt, Homo sapiens
agugacaugggaucaaaucuga

SEQ ID NO: 300376 - RNA, 22 nt, Homo sapiens
agugauguggaguuuggaugga

SEQ ID NO: 300377 - RNA, 22 nt, Homo sapiens
agugcaaagccgagguuucuug

SEQ ID NO: 300378 - RNA, 22 nt, Homo sapiens
agugcaguggcacaaucuuggc

SEQ ID NO: 300379 - RNA, 22 nt, Homo sapiens
aguggcuuuuuaguggcagaug

SEQ ID NO: 300380 - RNA, 22 nt, Homo sapiens
agugguuuuaaguagagcauac

SEQ ID NO: 300381 - RNA, 22 nt, Homo sapiens
aguugcaagucuugaguaaaga

SEQ ID NO: 300382 - RNA, 22 nt, Homo sapiens
auaaaccuacauuuucacuucu

SEQ ID NO: 300383 - RNA, 22 nt, Homo sapiens
auaaagacacuuggcaugauuu

SEQ ID NO: 300384 - RNA, 22 nt, Homo sapiens
auaaagcaaauaggacuauugc

SEQ ID NO: 300385 - RNA, 22 nt, Homo sapiens
auaaaugcuuccagucauuaaa

SEQ ID NO: 300386 - RNA, 20 nt, Homo sapiens
auaaauguauagguguacau

SEQ ID NO: 300387 - RNA, 22 nt, Homo sapiens
auaagaguaguacauaugagac

SEQ ID NO: 300388 - RNA, 22 nt, Homo sapiens
auaagaugaaggaagccauauc

SEQ ID NO: 300389 - RNA, 18 nt, Homo sapiens
ccagugcaaggaaagccc

SEQ ID NO: 300390 - RNA, 19 nt, Homo sapiens
ccaguguugccagagcuga

SEQ ID NO: 300391 - RNA, 22 nt, Homo sapiens
ccaguuuuucauuuauacuagu

SEQ ID NO: 300392 - RNA, 22 nt, Homo sapiens
cccagaguucuuaaauacugag

SEQ ID NO: 300393 - RNA, 18 nt, Homo sapiens
cccagugacuuauggccu

SEQ ID NO: 300394 - RNA, 18 nt, Homo sapiens
cccgggugggcuguuccc

SEQ ID NO: 300395 - RNA, 22 nt, Homo sapiens
cccuugcacuucagagcugcau

SEQ ID NO: 300396 - RNA, 22 nt, Homo sapiens
ccggcugugugacugugggcag

SEQ ID NO: 300397 - RNA, 22 nt, Homo sapiens
ccuaggcacugggguccagccc

SEQ ID NO: 300398 - RNA, 22 nt, Homo sapiens
ccuggaaugaagcuuauauugc

SEQ ID NO: 300399 - RNA, 22 nt, Homo sapiens
ccuggcacugagcaguguucua

SEQ ID NO: 300400 - RNA, 22 nt, Homo sapiens
ccugugguuaaccagcuagaug

SEQ ID NO: 300401 - RNA, 22 nt, Homo sapiens
ccuucauugcaucuuuaagaga

SEQ ID NO: 300402 - RNA, 22 nt, Homo sapiens
ccuucuuuuguaaggcugaaua

SEQ ID NO: 300403 - RNA, 22 nt, Homo sapiens
ccuuggcacuacugacauugua

SEQ ID NO: 300404 - RNA, 22 nt, Homo sapiens
ccuuuuuguaguggaaguagga

SEQ ID NO: 300405 - RNA, 22 nt, Homo sapiens
cgaggaguaucuuugugguguu

SEQ ID NO: 300406 - RNA, 22 nt, Homo sapiens
cgugaggaaaacagaggguguu

SEQ ID NO: 300407 - RNA, 16 nt, Homo sapiens
cuaaaaugucuacuug

SEQ ID NO: 300408 - RNA, 22 nt, Homo sapiens
cuaaaguagccaggacugcagg

SEQ ID NO: 300409 - RNA, 23 nt, Homo sapiens
cuaaagucugucacugaggacuu

SEQ ID NO: 300410 - RNA, 22 nt, Homo sapiens
cuaacuaugucucaggaugucc

SEQ ID NO: 300411 - RNA, 22 nt, Homo sapiens
cuaagugaacugucacugagaa

SEQ ID NO: 300412 - RNA, 22 nt, Homo sapiens
cuagaagcauauucagaacaga

SEQ ID NO: 300413 - RNA, 22 nt, Homo sapiens
cuagaguacuuaccacagcaug

SEQ ID NO: 300414 - RNA, 22 nt, Homo sapiens
cuagcacauuuaucuuuauaca

SEQ ID NO: 300415 - RNA, 22 nt, Homo sapiens
cuagcagacacuuccagagagu

SEQ ID NO: 300416 - RNA, 22 nt, Homo sapiens
cucaaaguguggucuguggguu

SEQ ID NO: 300417 - RNA, 22 nt, Homo sapiens
cucaaaugguccagcuaguggu

SEQ ID NO: 300418 - RNA, 22 nt, Homo sapiens
cucacuggguguaaaacaugua

SEQ ID NO: 300419 - RNA, 22 nt, Homo sapiens
cucagcaguggauuuaccacca

SEQ ID NO: 300420 - RNA, 22 nt, Homo sapiens
cucagucuaugauacuuugcua

SEQ ID NO: 300421 - RNA, 22 nt, Homo sapiens
cucagugaagggcaagaggcaa

SEQ ID NO: 300422 - RNA, 21 nt, Homo sapiens
cucauauugcuuuuccauggu

SEQ ID NO: 300423 - RNA, 22 nt, Homo sapiens
cucauggauggucuggcagcca

SEQ ID NO: 300424 - RNA, 22 nt, Homo sapiens
cucauugcaaucuccaccuccc

SEQ ID NO: 300425 - RNA, 22 nt, Homo sapiens
cuccaggugagguuaagggacu

SEQ ID NO: 300426 - RNA, 22 nt, Homo sapiens
cuccauguggcuaacuuuuaaa

SEQ ID NO: 300427 - RNA, 22 nt, Homo sapiens
cucccagagccaguuauaggcu

SEQ ID NO: 300428 - RNA, 22 nt, Homo sapiens
cucccagugacccaggaacagg

SEQ ID NO: 300429 - RNA, 20 nt, Homo sapiens
cucccugacaaauguggaaa

SEQ ID NO: 300430 - RNA, 22 nt, Homo sapiens
cucccuuugcugaauguuuuuc

SEQ ID NO: 300431 - RNA, 22 nt, Homo sapiens
cuccgggugcgucggcgcccug

SEQ ID NO: 300432 - RNA, 21 nt, Homo sapiens
cucucugcuuaugaauaguga

SEQ ID NO: 300433 - RNA, 22 nt, Homo sapiens
cucugguuaaggcugaacuaua

SEQ ID NO: 300434 - RNA, 22 nt, Homo sapiens
cucuuugaguuccuccuggugu

SEQ ID NO: 300435 - RNA, 22 nt, Homo sapiens
cucuuuggaugccuuaggguua

SEQ ID NO: 300436 - RNA, 22 nt, Homo sapiens
cucuuuuguuuagcugagaggg

SEQ ID NO: 300437 - RNA, 22 nt, Homo sapiens
cugaaauggaaugugugcacag

SEQ ID NO: 300438 - RNA, 22 nt, Homo sapiens
cugaauguuucacucugaaaug

SEQ ID NO: 300439 - RNA, 22 nt, Homo sapiens
cugacacuucaaaacugccaau

SEQ ID NO: 300440 - RNA, 17 nt, Homo sapiens
cugaccucauuguguac

SEQ ID NO: 300441 - RNA, 22 nt, Homo sapiens
cugaccucugucaaagacaccc

SEQ ID NO: 300442 - RNA, 22 nt, Homo sapiens
cugacuaguuuuaaugcagauu

SEQ ID NO: 300443 - RNA, 22 nt, Homo sapiens
cugacuuauguggacuauuuca

SEQ ID NO: 300444 - RNA, 22 nt, Homo sapiens
cugagagaugagaccucucacu

SEQ ID NO: 300445 - RNA, 22 nt, Homo sapiens
cugaucuguagcagccaccaca

SEQ ID NO: 300446 - RNA, 22 nt, Homo sapiens
cugcacugagacccucuuugcu

SEQ ID NO: 300447 - RNA, 22 nt, Homo sapiens
cugcauuagucuguuuaguguu

SEQ ID NO: 300448 - RNA, 17 nt, Homo sapiens
ugauauuuucccagaua

SEQ ID NO: 300449 - RNA, 22 nt, Homo sapiens
ugaugguccauaguucauggua

SEQ ID NO: 300450 - RNA, 22 nt, Homo sapiens
ugauuagagcccaagcuuugaa

SEQ ID NO: 300451 - RNA, 18 nt, Homo sapiens
ugauugacuuauuuaggu

SEQ ID NO: 300452 - RNA, 18 nt, Homo sapiens
ugcaaacauguguguguu

SEQ ID NO: 300453 - RNA, 22 nt, Homo sapiens
ugcaagacacuguccugggcau

SEQ ID NO: 300454 - RNA, 22 nt, Homo sapiens
ugcaagcacacccagggauugu

SEQ ID NO: 300455 - RNA, 22 nt, Homo sapiens
ugcaaugucuucugaggggagc

SEQ ID NO: 300456 - RNA, 22 nt, Homo sapiens
ugcaccacugcaccccagucug

SEQ ID NO: 300457 - RNA, 23 nt, Homo sapiens
ugcagcacacugaugggucuuga

SEQ ID NO: 300458 - RNA, 22 nt, Homo sapiens
ugcagcauguaggcacguuauu

SEQ ID NO: 300459 - RNA, 22 nt, Homo sapiens
ugcagcauugcacuccagccug

SEQ ID NO: 300460 - RNA, 22 nt, Homo sapiens
ugcaguaggcccagcgggaggc

SEQ ID NO: 300461 - RNA, 23 nt, Homo sapiens
ugcaguagugagaucuaggcuca

SEQ ID NO: 300462 - RNA, 22 nt, Homo sapiens
ugcagugugaaagagccugaca

SEQ ID NO: 300463 - RNA, 22 nt, Homo sapiens
ugcaguguucuuuagaggaaau

SEQ ID NO: 300464 - RNA, 22 nt, Homo sapiens
ugcaguuuaggaacugguaaca

SEQ ID NO: 300465 - RNA, 22 nt, Homo sapiens
ugcauacacaagcauacaugua

SEQ ID NO: 300466 - RNA, 18 nt, Homo sapiens
ugcauauguugaaccagc

SEQ ID NO: 300467 - RNA, 22 nt, Homo sapiens
ugcauauucgaguuauuuuggg

SEQ ID NO: 300468 - RNA, 22 nt, Homo sapiens
ugcauuguggaucuaaaugcau

SEQ ID NO: 300469 - RNA, 22 nt, Homo sapiens
ugccaaggagucagucccuaga

SEQ ID NO: 300470 - RNA, 22 nt, Homo sapiens
ugccaugaagaucccugaaaug

SEQ ID NO: 300471 - RNA, 22 nt, Homo sapiens
ugccaugucauagguuaagccu

SEQ ID NO: 300472 - RNA, 22 nt, Homo sapiens
uugauuagauccaguugauuga

SEQ ID NO: 300473 - RNA, 21 nt, Homo sapiens
uugcaaaugcugcugccugau

SEQ ID NO: 300474 - RNA, 22 nt, Homo sapiens
uugcaaugugaugugauuugga

SEQ ID NO: 300475 - RNA, 22 nt, Homo sapiens
uugcagcaaauaggaaugagga

SEQ ID NO: 300476 - RNA, 22 nt, Homo sapiens
uugcagcauucugguuccuggu

SEQ ID NO: 300477 - RNA, 19 nt, Homo sapiens
uugcauauguugaaccagc

SEQ ID NO: 300478 - RNA, 22 nt, Homo sapiens
uugcauauguugaaccagccuu

SEQ ID NO: 300479 - RNA, 22 nt, Homo sapiens
uugcauuagugugguacauuug

SEQ ID NO: 300480 - RNA, 22 nt, Homo sapiens
uugcauugacacaugaagcuca

SEQ ID NO: 300481 - RNA, 22 nt, Homo sapiens
uugccacuucucuugccccauu

SEQ ID NO: 300482 - RNA, 22 nt, Homo sapiens
uugccauagugcugccagauau

SEQ ID NO: 300483 - RNA, 22 nt, Homo sapiens
uugccaucaucucuuacucagu

SEQ ID NO: 300484 - RNA, 22 nt, Homo sapiens
uuggaaaaauccaccuugaucu

SEQ ID NO: 300485 - RNA, 22 nt, Homo sapiens
uuggaaguguguauguauagcu

SEQ ID NO: 300486 - RNA, 22 nt, Homo sapiens
uuggaauacucaaaagguuggg

SEQ ID NO: 300487 - RNA, 23 nt, Homo sapiens
uuggaaugagaccuaagaguuuu

SEQ ID NO: 300488 - RNA, 22 nt, Homo sapiens
uuggaauguauggcaucuugcg

SEQ ID NO: 300489 - RNA, 22 nt, Homo sapiens
uuggaaugugacugauaauauu

SEQ ID NO: 300490 - RNA, 22 nt, Homo sapiens
uuggaauuuuacuucuguaaga

SEQ ID NO: 300491 - RNA, 19 nt, Homo sapiens
uuggaauuuuagaguuuga

SEQ ID NO: 300492 - RNA, 22 nt, Homo sapiens
uuggacuucuaacugacaugga

SEQ ID NO: 300493 - RNA, 22 nt, Homo sapiens
uuggcaaagaggaaugccacuu

SEQ ID NO: 300494 - RNA, 22 nt, Homo sapiens
uuggcacugagcaagaacaggg

SEQ ID NO: 300495 - RNA, 22 nt, Homo sapiens
uuggcagaauguuagaaacuua

SEQ ID NO: 300496 - RNA, 22 nt, Homo sapiens
uuggcauugccaaacugucaac

SEQ ID NO: 300497 - RNA, 22 nt, Homo sapiens
uuggccccucccaaauuucaug

SEQ ID NO: 300498 - RNA, 22 nt, Homo sapiens
uuggcuauagauacauggauua

SEQ ID NO: 300499 - RNA, 22 nt, Homo sapiens
uuggcuguguuccucaaggagu

SEQ ID NO: 300500 - RNA, 22 nt, Homo sapiens
uuggcuguguuucccuacaaau

SEQ ID NO: 300501 - RNA, 22 nt, Homo sapiens
uuggcuuggagaguugaaaugu

SEQ ID NO: 300502 - RNA, 22 nt, Homo sapiens
uugggcaauaggaagcaggugg

SEQ ID NO: 300503 - RNA, 22 nt, Homo sapiens
uugguccccacuccccugccaa

SEQ ID NO: 300504 - RNA, 19 nt, Homo sapiens
uugguugguuauuucuuac

SEQ ID NO: 300505 - RNA, 22 nt, Homo sapiens
uugguuuccuuccugcuuaacu

SEQ ID NO: 300506 - RNA, 22 nt, Homo sapiens
uuguaagaaucuagcucuuuau

SEQ ID NO: 300507 - RNA, 22 nt, Homo sapiens
uuguaccacagggcaugaagug

SEQ ID NO: 300508 - RNA, 22 nt, Homo sapiens
uuguagcaaauguguaaacaaa

SEQ ID NO: 300509 - RNA, 22 nt, Homo sapiens
uuguccacugcuagccucugca

SEQ ID NO: 300510 - RNA, 23 nt, Homo sapiens
uuguccccuccaaagcucauguu

SEQ ID NO: 300511 - RNA, 22 nt, Homo sapiens
uugucucacuggaguuuaguaa

SEQ ID NO: 300512 - RNA, 22 nt, Homo sapiens
uugugaaaucuaggcagagguu

SEQ ID NO: 300513 - RNA, 22 nt, Homo sapiens
uugugcaaaaguaauugcgguu

SEQ ID NO: 300514 - RNA, 22 nt, Homo sapiens
uugugcaaaguugugguuucug

SEQ ID NO: 300515 - RNA, 18 nt, Homo sapiens
uugugccugagaaggugg

SEQ ID NO: 300516 - RNA, 22 nt, Homo sapiens
uugugcuacugaguuggggugg

SEQ ID NO: 300517 - RNA, 22 nt, Homo sapiens
uugugcuucaucaccuagcaga

SEQ ID NO: 300518 - RNA, 22 nt, Homo sapiens
uugugcuuguaacuacauucag

SEQ ID NO: 300519 - RNA, 22 nt, Homo sapiens
uugugcuuuacuuacuaccaga

SEQ ID NO: 300520 - RNA, 22 nt, Homo sapiens
uugugguaggcauguaagauga

SEQ ID NO: 300521 - RNA, 22 nt, Homo sapiens
uugugguuuuagcacuguggau

SEQ ID NO: 300522 - RNA, 22 nt, Homo sapiens
uuuaaaguuagaaggaaagggc

SEQ ID NO: 300523 - RNA, 20 nt, Homo sapiens
uuuaagacaugcugaauuga

SEQ ID NO: 300524 - RNA, 22 nt, Homo sapiens
uuuagcaauucauuuugugucu

SEQ ID NO: 300525 - RNA, 22 nt, Homo sapiens
uuuaucuguuuaaaacuguuca

SEQ ID NO: 300526 - RNA, 22 nt, Homo sapiens
uuuaugcgucuguaauuucuuu

SEQ ID NO: 300527 - RNA, 19 nt, Homo sapiens
uuucacacucgccuacuuc

SEQ ID NO: 300528 - RNA, 22 nt, Homo sapiens
uuuccaguuuggaggaugcauu

SEQ ID NO: 300529 - RNA, 22 nt, Homo sapiens
uuuccauguuggugaaaugagg

SEQ ID NO: 300530 - RNA, 17 nt, Homo sapiens
uuucucagcccucuucu

SEQ ID NO: 300531 - RNA, 22 nt, Homo sapiens
uuucugagaccaaaacuuguaa

SEQ ID NO: 300532 - RNA, 22 nt, Homo sapiens
uuucugugguccucuugaaggu

SEQ ID NO: 300533 - RNA, 22 nt, Homo sapiens
uuugaaccauuugaagaaugau

SEQ ID NO: 300534 - RNA, 22 nt, Homo sapiens
uuugacaaugugugcuuguauu

SEQ ID NO: 300535 - RNA, 22 nt, Homo sapiens
uuugacuagaguguuuuacaac

SEQ ID NO: 300536 - RNA, 22 nt, Homo sapiens
uuugagcauggaaauggcauga

SEQ ID NO: 300537 - RNA, 23 nt, Homo sapiens
uuugagugugauaaacacuguca

SEQ ID NO: 300538 - RNA, 21 nt, Homo sapiens
uuugaucauuaaaagugaauc

SEQ ID NO: 300539 - RNA, 22 nt, Homo sapiens
uuugcaccuuccuaguggcuga

SEQ ID NO: 300540 - RNA, 23 nt, Homo sapiens
uuugcacuugcuccuucuauggc

SEQ ID NO: 300541 - RNA, 22 nt, Homo sapiens
uuugcagugucagcuucugugu

SEQ ID NO: 300542 - RNA, 22 nt, Homo sapiens
uuugcaguuuauuccuggggcu

SEQ ID NO: 300543 - RNA, 22 nt, Homo sapiens
uuugcuuaaaguccuuguggga

SEQ ID NO: 300544 - RNA, 22 nt, Homo sapiens
uuugcuuaguaaauguagaaaa

SEQ ID NO: 300545 - RNA, 22 nt, Homo sapiens
uuugcuucacuguuuggcaaaa

SEQ ID NO: 300546 - RNA, 22 nt, Homo sapiens
uuugcuugaggucuagcuaccc

SEQ ID NO: 300547 - RNA, 20 nt, Homo sapiens
uuuggcacugagugguauaa

SEQ ID NO: 300548 - RNA, 22 nt, Homo sapiens
uuuggcagaaaacuaaaaggua

SEQ ID NO: 300549 - RNA, 22 nt, Homo sapiens
uuuggcagaugacccucaaguu

SEQ ID NO: 300550 - RNA, 22 nt, Homo sapiens
uuuggcaugggcuauuugcuuu

SEQ ID NO: 300551 - RNA, 22 nt, Homo sapiens
uuuggccauguuggucaggcug

SEQ ID NO: 300552 - RNA, 22 nt, Homo sapiens
cagguacuucugggcugagcag

SEQ ID NO: 300553 - RNA, 22 nt, Homo sapiens
cagguaguauuugguuacauaa

SEQ ID NO: 300554 - RNA, 19 nt, Homo sapiens
cagguagugugcugacaug

SEQ ID NO: 300555 - RNA, 22 nt, Homo sapiens
cagguauagucacuugcccaag

SEQ ID NO: 300556 - RNA, 22 nt, Homo sapiens
cagugcaaccuccaucucucgg

SEQ ID NO: 300557 - RNA, 18 nt, Homo sapiens
cagugcaauacaggagag

SEQ ID NO: 300558 - RNA, 23 nt, Homo sapiens
cagugguguuagagaaaucuuuu

SEQ ID NO: 300559 - RNA, 22 nt, Homo sapiens
cauacaagcuacaaucacaaag

SEQ ID NO: 300560 - RNA, 22 nt, Homo sapiens
cauacaugugcuugucuuaugc

SEQ ID NO: 300561 - RNA, 18 nt, Homo sapiens
cauagcacuucagcacau

SEQ ID NO: 300562 - RNA, 22 nt, Homo sapiens
cauaguacuugcauaguacuau

SEQ ID NO: 300563 - RNA, 21 nt, Homo sapiens
caucaaauugucauggugggu

SEQ ID NO: 300564 - RNA, 22 nt, Homo sapiens
caucacacuuggauguaagaca

SEQ ID NO: 300565 - RNA, 22 nt, Homo sapiens
caucacaugcuuauuuuccuca

SEQ ID NO: 300566 - RNA, 22 nt, Homo sapiens
caucagcaauguaugaggguuc

SEQ ID NO: 300567 - RNA, 22 nt, Homo sapiens
caucccugucgucaagucucug

SEQ ID NO: 300568 - RNA, 22 nt, Homo sapiens
cauggcacauauauaucuaggu

SEQ ID NO: 300569 - RNA, 22 nt, Homo sapiens
cauggcauuugcagaguugaaa

SEQ ID NO: 300570 - RNA, 22 nt, Homo sapiens
cauggcuuuaagcaacaccaag

SEQ ID NO: 300571 - RNA, 22 nt, Homo sapiens
cauggcuuucacaguaaagccu

SEQ ID NO: 300572 - RNA, 22 nt, Homo sapiens
cauugcacuccagccuaggcaa

SEQ ID NO: 300573 - RNA, 22 nt, Homo sapiens
cauugcacuccagccugaccaa

SEQ ID NO: 300574 - RNA, 20 nt, Homo sapiens
cauugcccuccagccugggc

SEQ ID NO: 300575 - RNA, 22 nt, Homo sapiens
cauugcccuccagccugggcaa

SEQ ID NO: 300576 - RNA, 22 nt, Homo sapiens
cauuugguggcuacagaguaac

SEQ ID NO: 300577 - RNA, 22 nt, Homo sapiens
cauuuuacuuuccagacgugga

SEQ ID NO: 300578 - RNA, 22 nt, Homo sapiens
ccaaaguauuuucacugauauc

SEQ ID NO: 300579 - RNA, 22 nt, Homo sapiens
ccaaauccauccaaaucauaga

SEQ ID NO: 300580 - RNA, 19 nt, Homo sapiens
ccacaaugguugaacuaga

SEQ ID NO: 300581 - RNA, 23 nt, Homo sapiens
ccacacuguuuagaauggcauca

SEQ ID NO: 300582 - RNA, 22 nt, Homo sapiens
ccacugcacuccagcccggcaa

SEQ ID NO: 300583 - RNA, 22 nt, Homo sapiens
ccagguuucuagaauaauuccu

SEQ ID NO: 300584 - RNA, 21 nt, Homo sapiens
ccaguguaaugauagcaggca

SEQ ID NO: 300585 - RNA, 22 nt, Homo sapiens
ccaguguuuuugaauuccagga

SEQ ID NO: 300586 - RNA, 22 nt, Homo sapiens
ccaguucaaugauauggaaacu

SEQ ID NO: 300587 - RNA, 22 nt, Homo sapiens
ccaguuuucaagauaaugguuu

SEQ ID NO: 300588 - RNA, 22 nt, Homo sapiens
ccaucacacugugauuauuauc

SEQ ID NO: 300589 - RNA, 22 nt, Homo sapiens
ccauuucacucuuccugaagga

SEQ ID NO: 300590 - RNA, 22 nt, Homo sapiens
ccccagguuucaauaaagccca

SEQ ID NO: 300591 - RNA, 23 nt, Homo sapiens
cccucagaagugcagggagagaa

SEQ ID NO: 300592 - RNA, 21 nt, Homo sapiens
ccucuuugagggaagaaaggg

SEQ ID NO: 300593 - RNA, 22 nt, Homo sapiens
ccucuuuguugagacuucacca

SEQ ID NO: 300594 - RNA, 17 nt, Homo sapiens
ggcaagaaguggaacuc

SEQ ID NO: 300595 - RNA, 19 nt, Homo sapiens
ggcaagaguuguucugugu

SEQ ID NO: 300596 - RNA, 22 nt, Homo sapiens
ggcaagugucagcagcaacacc

SEQ ID NO: 300597 - RNA, 22 nt, Homo sapiens
ggcacgguggcucacaccugua

SEQ ID NO: 300598 - RNA, 22 nt, Homo sapiens
ggcacgguggcucacgccugua

SEQ ID NO: 300599 - RNA, 22 nt, Homo sapiens
ggcagcacaauuuucugaugga

SEQ ID NO: 300600 - RNA, 22 nt, Homo sapiens
ggcaugaaguagcccacaggca

SEQ ID NO: 300601 - RNA, 22 nt, Homo sapiens
ggcauguaauuauucaaagugg

SEQ ID NO: 300602 - RNA, 22 nt, Homo sapiens
ggcuagagaauagugccacuaa

SEQ ID NO: 300603 - RNA, 22 nt, Homo sapiens
ggcuagagacaaguugcugaga

SEQ ID NO: 300604 - RNA, 22 nt, Homo sapiens
ggcuguguguuaaaauaggcuu

SEQ ID NO: 300605 - RNA, 22 nt, Homo sapiens
gggaaauguaaagucauaagau

SEQ ID NO: 300606 - RNA, 22 nt, Homo sapiens
gggaagaaggagugguuuacuc

SEQ ID NO: 300607 - RNA, 22 nt, Homo sapiens
gggaagugugguuucuuuacag

SEQ ID NO: 300608 - RNA, 22 nt, Homo sapiens
gggaauggaagacauuaugaug

SEQ ID NO: 300609 - RNA, 19 nt, Homo sapiens
gggaggaugcgucuucagg

SEQ ID NO: 300610 - RNA, 19 nt, Homo sapiens
gggcaaaucuggaaauuua

SEQ ID NO: 300611 - RNA, 22 nt, Homo sapiens
gggcaagaagucuuguaguuuu

SEQ ID NO: 300612 - RNA, 23 nt, Homo sapiens
gggcuagaugagagcuuccuggg

SEQ ID NO: 300613 - RNA, 22 nt, Homo sapiens
gggguuuuaccuucguauucuu

SEQ ID NO: 300614 - RNA, 22 nt, Homo sapiens
ggguaggcaagcggaugucaga

SEQ ID NO: 300615 - RNA, 22 nt, Homo sapiens
gggugguuuuaucucuucccuu

SEQ ID NO: 300616 - RNA, 22 nt, Homo sapiens
gguaucuuggagagagaaguga

SEQ ID NO: 300617 - RNA, 22 nt, Homo sapiens
ggucaguguuaucaccgaagga

SEQ ID NO: 300618 - RNA, 22 nt, Homo sapiens
ggucccccuccacucucgcaaa

SEQ ID NO: 300619 - RNA, 22 nt, Homo sapiens
ggugagguaguaagguacaaua

SEQ ID NO: 300620 - RNA, 22 nt, Homo sapiens
ggugcuugaggaacggaggcug

SEQ ID NO: 300621 - RNA, 22 nt, Homo sapiens
guaaacuuccccucaugaauga

SEQ ID NO: 300622 - RNA, 22 nt, Homo sapiens
guaaaguaaagcacaucaaggu

SEQ ID NO: 300623 - RNA, 22 nt, Homo sapiens
guaaaugcagaugcaugaccuu

SEQ ID NO: 300624 - RNA, 22 nt, Homo sapiens
guaaguagcuuuagauauaaau

SEQ ID NO: 300625 - RNA, 22 nt, Homo sapiens
guaagugguagagcugggcuau

SEQ ID NO: 300626 - RNA, 22 nt, Homo sapiens
guacaaguaagaaaauugccca

SEQ ID NO: 300627 - RNA, 22 nt, Homo sapiens
guacaggcagcaaacaccauaa

SEQ ID NO: 300628 - RNA, 22 nt, Homo sapiens
guacccuauggauauagaugaa

SEQ ID NO: 300629 - RNA, 22 nt, Homo sapiens
guagagagaaauacaaagcugu

SEQ ID NO: 300630 - RNA, 22 nt, Homo sapiens
guagagugcugggcacuggcuc

SEQ ID NO: 300631 - RNA, 22 nt, Homo sapiens
guaugugacuggaacaguagga

SEQ ID NO: 300632 - RNA, 22 nt, Homo sapiens
guauuuguugcagcagcacuau

SEQ ID NO: 300633 - RNA, 22 nt, Homo sapiens
gucacaggaaacuaauaugcgc

SEQ ID NO: 300634 - RNA, 20 nt, Homo sapiens
gucacuggcccagggcuugu

SEQ ID NO: 300635 - RNA, 22 nt, Homo sapiens
gucaggugcuuacgcggagauc

SEQ ID NO: 300636 - RNA, 22 nt, Homo sapiens
gucauggacaaggugugagcca

SEQ ID NO: 300637 - RNA, 22 nt, Homo sapiens
gucauggacaguuugcuaauug

SEQ ID NO: 300638 - RNA, 22 nt, Homo sapiens
gucauugagucagggaguaucu

SEQ ID NO: 300639 - RNA, 22 nt, Homo sapiens
gucauugcuuaucugcugacgu

SEQ ID NO: 300640 - RNA, 22 nt, Homo sapiens
gucccugcgauugugggauccu

SEQ ID NO: 300641 - RNA, 22 nt, Homo sapiens
gucuagaacuucugaccuuagg

SEQ ID NO: 300642 - RNA, 22 nt, Homo sapiens
gucucccagccuacaucuuucu

SEQ ID NO: 300643 - RNA, 22 nt, Homo sapiens
gucuccgagccguguggagccg

SEQ ID NO: 300644 - RNA, 22 nt, Homo sapiens
gucucuugguuuagagcauuua

SEQ ID NO: 300645 - RNA, 22 nt, Homo sapiens
gucugcaugucauaugauagua

SEQ ID NO: 300646 - RNA, 22 nt, Homo sapiens
gucuggcuuaucucacuuacca

SEQ ID NO: 300647 - RNA, 22 nt, Homo sapiens
gucugguugacagcauguggcc

SEQ ID NO: 300648 - RNA, 20 nt, Homo sapiens
gucuugcuccguugcccagg

SEQ ID NO: 300649 - RNA, 22 nt, Homo sapiens
gucuuuguuauuaugaaucaac

SEQ ID NO: 300650 - RNA, 22 nt, Homo sapiens
gucuuuguuuugauuuaccaga

SEQ ID NO: 300651 - RNA, 22 nt, Homo sapiens
gugaaaagaugagcaccauaca

SEQ ID NO: 300652 - RNA, 22 nt, Homo sapiens
gugaacagcagaugagugagug

SEQ ID NO: 300653 - RNA, 22 nt, Homo sapiens
gugaagaucccuguccuguucc

SEQ ID NO: 300654 - RNA, 22 nt, Homo sapiens
gugaaugaaugggugaauacau

SEQ ID NO: 300655 - RNA, 22 nt, Homo sapiens
gugaauguuuucuuacauggua

SEQ ID NO: 300656 - RNA, 21 nt, Homo sapiens
uagugcagugggguaugacuu

SEQ ID NO: 300657 - RNA, 22 nt, Homo sapiens
uagugcuagaugacuuugccau

SEQ ID NO: 300658 - RNA, 22 nt, Homo sapiens
uaguuuaucuucuggauggaca

SEQ ID NO: 300659 - RNA, 22 nt, Homo sapiens
uauacaugugggcaucaggaga

SEQ ID NO: 300660 - RNA, 22 nt, Homo sapiens
uauagcagccugaacaaaguaa

SEQ ID NO: 300661 - RNA, 22 nt, Homo sapiens
uauagcuagucacugcuggauu

SEQ ID NO: 300662 - RNA, 22 nt, Homo sapiens
uauaugucugagacugggggau

SEQ ID NO: 300663 - RNA, 22 nt, Homo sapiens
uaucaccacccugggaaacaua

SEQ ID NO: 300664 - RNA, 22 nt, Homo sapiens
uaucaugggggguguacacucc

SEQ ID NO: 300665 - RNA, 21 nt, Homo sapiens
uaucauggugaaacccugucu

SEQ ID NO: 300666 - RNA, 18 nt, Homo sapiens
uaucauguagggaaguug

SEQ ID NO: 300667 - RNA, 22 nt, Homo sapiens
uaugaaacucuaagauucacau

SEQ ID NO: 300668 - RNA, 20 nt, Homo sapiens
uaugacaaagccuagugagu

SEQ ID NO: 300669 - RNA, 22 nt, Homo sapiens
uaugagagcugguagguagaga

SEQ ID NO: 300670 - RNA, 22 nt, Homo sapiens
uaugcacuaggcacuguguuug

SEQ ID NO: 300671 - RNA, 22 nt, Homo sapiens
uaugccuuugaccauuuuguga

SEQ ID NO: 300672 - RNA, 21 nt, Homo sapiens
uaugguuucuaauucugcagg

SEQ ID NO: 300673 - RNA, 22 nt, Homo sapiens
uauuaugcacuuuauaaaaauu

SEQ ID NO: 300674 - RNA, 22 nt, Homo sapiens
uauuccucuuuguugagguuau

SEQ ID NO: 300675 - RNA, 22 nt, Homo sapiens
uauuccuuuugcauuuccacau

SEQ ID NO: 300676 - RNA, 22 nt, Homo sapiens
uauugcauguugagcaguaccu

SEQ ID NO: 300677 - RNA, 22 nt, Homo sapiens
uauugcuggcucugucuucauu

SEQ ID NO: 300678 - RNA, 22 nt, Homo sapiens
uauuggcucuguuucucugaag

SEQ ID NO: 300679 - RNA, 20 nt, Homo sapiens
uauuugguuauuuccauggu

SEQ ID NO: 300680 - RNA, 18 nt, Homo sapiens
ucaaauacuuugggcagu

SEQ ID NO: 300681 - RNA, 22 nt, Homo sapiens
ucaaaugauucagaagccaccu

SEQ ID NO: 300682 - RNA, 22 nt, Homo sapiens
ucaaaugcacguagagaaaaua

SEQ ID NO: 300683 - RNA, 22 nt, Homo sapiens
ucaaauuccaagucuagguagg

SEQ ID NO: 300684 - RNA, 20 nt, Homo sapiens
ucaaauucuuggccuccagc

SEQ ID NO: 300685 - RNA, 22 nt, Homo sapiens
ucaacagugggcacuguaaaug

SEQ ID NO: 300686 - RNA, 18 nt, Homo sapiens
ucaagcaauugucaugcc

SEQ ID NO: 300687 - RNA, 20 nt, Homo sapiens
ucaaggcaggaacuguacau

SEQ ID NO: 300688 - RNA, 23 nt, Homo sapiens
ucaagugaugguggccacaaggg

SEQ ID NO: 300689 - RNA, 23 nt, Homo sapiens
ucacacuuaagagaaaugcagcu

SEQ ID NO: 300690 - RNA, 22 nt, Homo sapiens
ucacagcuaaaaugaaaguagu

SEQ ID NO: 300691 - RNA, 22 nt, Homo sapiens
ucacaguagcaaauguuagaaa

SEQ ID NO: 300692 - RNA, 22 nt, Homo sapiens
ucacaguagggaacugacaaag

SEQ ID NO: 300693 - RNA, 22 nt, Homo sapiens
ucacaguauucaugaacaugga

SEQ ID NO: 300694 - RNA, 22 nt, Homo sapiens
ucacauguguaaauugguguaa

SEQ ID NO: 300695 - RNA, 20 nt, Homo sapiens
ucacccugacaucugcccag

SEQ ID NO: 300696 - RNA, 21 nt, Homo sapiens
ucaccuguugcgaugaagcug

SEQ ID NO: 300697 - RNA, 22 nt, Homo sapiens
uucucaguaauuccagauuuuu

SEQ ID NO: 300698 - RNA, 17 nt, Homo sapiens
uucucaguucugaucuc

SEQ ID NO: 300699 - RNA, 22 nt, Homo sapiens
uucuuagucauguaauagucca

SEQ ID NO: 300700 - RNA, 21 nt, Homo sapiens
uucuucaggcagaaggauuau

SEQ ID NO: 300701 - RNA, 22 nt, Homo sapiens
uucuucugguuaugaaauuuga

SEQ ID NO: 300702 - RNA, 20 nt, Homo sapiens
uucuugaguuaacaaguuac

SEQ ID NO: 300703 - RNA, 22 nt, Homo sapiens
uucuugguguaguaguugaaaa

SEQ ID NO: 300704 - RNA, 22 nt, Homo sapiens
uucuugguuggcaaccaacagu

SEQ ID NO: 300705 - RNA, 19 nt, Homo sapiens
uucuuuguugugggggcug

SEQ ID NO: 300706 - RNA, 22 nt, Homo sapiens
uugaaagcuaucagagauucca

SEQ ID NO: 300707 - RNA, 22 nt, Homo sapiens
uugaaagcuaucucaaaucgcu

SEQ ID NO: 300708 - RNA, 22 nt, Homo sapiens
uugaaaguaaacaucacaaaga

SEQ ID NO: 300709 - RNA, 22 nt, Homo sapiens
uugaaagucuaggcuuacagua

SEQ ID NO: 300710 - RNA, 22 nt, Homo sapiens
uugaacugguaguuggaaaucu

SEQ ID NO: 300711 - RNA, 22 nt, Homo sapiens
uugaagguaggaugugcuauca

SEQ ID NO: 300712 - RNA, 22 nt, Homo sapiens
uugaaguagcauuucaugucua

SEQ ID NO: 300713 - RNA, 22 nt, Homo sapiens
uugaaguaugaccgcugagaau

SEQ ID NO: 300714 - RNA, 22 nt, Homo sapiens
uugaauagacagccagcuuuaa

SEQ ID NO: 300715 - RNA, 18 nt, Homo sapiens
uugaauagagccaagcac

SEQ ID NO: 300716 - RNA, 22 nt, Homo sapiens
uugaccaaagaagagucauugc

SEQ ID NO: 300717 - RNA, 22 nt, Homo sapiens
uugagaucuacuacuguaggag

SEQ ID NO: 300718 - RNA, 22 nt, Homo sapiens
uugagaugauggauaugcuaau

SEQ ID NO: 300719 - RNA, 22 nt, Homo sapiens
uugagauggagucucacucuuu

SEQ ID NO: 300720 - RNA, 22 nt, Homo sapiens
uugagauggagucucguucugu

SEQ ID NO: 300721 - RNA, 22 nt, Homo sapiens
uugagauggagucuuguucucu

SEQ ID NO: 300722 - RNA, 22 nt, Homo sapiens
uugagauggagucuuguucuuu

SEQ ID NO: 300723 - RNA, 22 nt, Homo sapiens
uugagauggaguucauuuuugu

SEQ ID NO: 300724 - RNA, 22 nt, Homo sapiens
uugagauggaguuucaauauug

SEQ ID NO: 300725 - RNA, 22 nt, Homo sapiens
uugagauggaguuucgcucuug

SEQ ID NO: 300726 - RNA, 22 nt, Homo sapiens
uugagauguaguuucacuccug

SEQ ID NO: 300727 - RNA, 22 nt, Homo sapiens
uugagauguauguauauaaugu

SEQ ID NO: 300728 - RNA, 22 nt, Homo sapiens
uugagcaaugucacugaggcuu

SEQ ID NO: 300729 - RNA, 21 nt, Homo sapiens
uugagcuuuuaguacagacag

SEQ ID NO: 300730 - RNA, 22 nt, Homo sapiens
uugaggaaugucauuuguguuu

SEQ ID NO: 300731 - RNA, 16 nt, Homo sapiens
uugaggcaugucucag

SEQ ID NO: 300732 - RNA, 22 nt, Homo sapiens
uugaggcuuuugaccucaugug

SEQ ID NO: 300733 - RNA, 22 nt, Homo sapiens
uugauagaucagggauuugauu

SEQ ID NO: 300734 - RNA, 22 nt, Homo sapiens
uugauaguuuuaaaauuaaucu

SEQ ID NO: 300735 - RNA, 22 nt, Homo sapiens
uugauguugaggacauaaaccu

SEQ ID NO: 300736 - RNA, 22 nt, Homo sapiens
uugcaagugccguaacuaccaa

SEQ ID NO: 300737 - RNA, 22 nt, Homo sapiens
uugcacauugauuuuguaucuu

SEQ ID NO: 300738 - RNA, 22 nt, Homo sapiens
uugcacauugcaccuuuuguau

SEQ ID NO: 300739 - RNA, 19 nt, Homo sapiens
uugcauagguugaaccagc

SEQ ID NO: 300740 - RNA, 22 nt, Homo sapiens
uugcauguacguacagagagag

SEQ ID NO: 300741 - RNA, 22 nt, Homo sapiens
uugcaugucauaacugauggaa

SEQ ID NO: 300742 - RNA, 22 nt, Homo sapiens
uugccauggaguagaauugaag

SEQ ID NO: 300743 - RNA, 22 nt, Homo sapiens
uugcuuuguuacugcaguuucc

SEQ ID NO: 300744 - RNA, 22 nt, Homo sapiens
uuggaacacauguuuuucuacc

SEQ ID NO: 300745 - RNA, 22 nt, Homo sapiens
uuggaaugcaacagaaggauaa

SEQ ID NO: 300746 - RNA, 22 nt, Homo sapiens
uuggacuucucaaggcaauaaa

SEQ ID NO: 300747 - RNA, 22 nt, Homo sapiens
uuggagcccuaacucucaguac

SEQ ID NO: 300748 - RNA, 22 nt, Homo sapiens
uuggagugugucuuauuccauu

SEQ ID NO: 300749 - RNA, 22 nt, Homo sapiens
uuggaguguucugguccgggcu

SEQ ID NO: 300750 - RNA, 22 nt, Homo sapiens
uuggcaaagugucuggcauuua

SEQ ID NO: 300751 - RNA, 22 nt, Homo sapiens
uuggcaagaauguaugccgauc

SEQ ID NO: 300752 - RNA, 22 nt, Homo sapiens
uuggcaagcuguuaauuauaaa

SEQ ID NO: 300753 - RNA, 22 nt, Homo sapiens
uuggcaauucagauucuuuuau

SEQ ID NO: 300754 - RNA, 22 nt, Homo sapiens
uuggcacugggaaaaugaccac

SEQ ID NO: 300755 - RNA, 22 nt, Homo sapiens
uuggcagaaaaggucggggguu

SEQ ID NO: 300756 - RNA, 22 nt, Homo sapiens
uuggcagaguuaauuuguugag

SEQ ID NO: 300757 - RNA, 19 nt, Homo sapiens
uuggcagaguugcccccua

SEQ ID NO: 300758 - RNA, 22 nt, Homo sapiens
uuggcaguaucuacuacagcua

SEQ ID NO: 300759 - RNA, 22 nt, Homo sapiens
uuggccccuuucauccacagcu

SEQ ID NO: 300760 - RNA, 22 nt, Homo sapiens
uuggcuacagauuaugaauuuc

SEQ ID NO: 300761 - RNA, 21 nt, Homo sapiens
uuggcuacugcuucagaggga

SEQ ID NO: 300762 - RNA, 22 nt, Homo sapiens
uuggcuaugaguccuaugugca

SEQ ID NO: 300763 - RNA, 22 nt, Homo sapiens
uugggaaugcuaaaccucuauu

SEQ ID NO: 300764 - RNA, 22 nt, Homo sapiens
uugggaauguccuaauaucucg

SEQ ID NO: 300765 - RNA, 23 nt, Homo sapiens
uugggcaaaucacuaacgucucc

SEQ ID NO: 300766 - RNA, 22 nt, Homo sapiens
uugggcaaguggcaugaccaug

SEQ ID NO: 300767 - RNA, 21 nt, Homo sapiens
uuggggaauggagagguuuuc

SEQ ID NO: 300768 - RNA, 19 nt, Homo sapiens
uuggucccuuuggguucuu

SEQ ID NO: 300769 - RNA, 22 nt, Homo sapiens
uuguaauguuaccaaauggugu

SEQ ID NO: 300770 - RNA, 22 nt, Homo sapiens
uuguaauguuaggguguccaug

SEQ ID NO: 300771 - RNA, 23 nt, Homo sapiens
uuguacacuaagaaucgcagaug

SEQ ID NO: 300772 - RNA, 22 nt, Homo sapiens
uuguacuagucauauuuugaaa

SEQ ID NO: 300773 - RNA, 22 nt, Homo sapiens
uuguacuauuuuuaucagugau

SEQ ID NO: 300774 - RNA, 22 nt, Homo sapiens
uuguauugucuugaugaguuga

SEQ ID NO: 300775 - RNA, 22 nt, Homo sapiens
uugucaaacucauucuccaucc

SEQ ID NO: 300776 - RNA, 22 nt, Homo sapiens
uugucacccucucuuggugucu

SEQ ID NO: 300777 - RNA, 22 nt, Homo sapiens
uugugaaaaaccucucguggaa

SEQ ID NO: 300778 - RNA, 22 nt, Homo sapiens
uugugagggagcuaagaugagu

SEQ ID NO: 300779 - RNA, 22 nt, Homo sapiens
uugugcuccuaugagaaucuaa

SEQ ID NO: 300780 - RNA, 22 nt, Homo sapiens
uugugcuuaaugaguguaaggu

SEQ ID NO: 300781 - RNA, 22 nt, Homo sapiens
uugugcuuuuuaaauagcuucc

SEQ ID NO: 300782 - RNA, 22 nt, Homo sapiens
uugugggaggugauuagaucau

SEQ ID NO: 300783 - RNA, 22 nt, Homo sapiens
uugugguuauagagucucccug

SEQ ID NO: 300784 - RNA, 22 nt, Homo sapiens
uugugguugacuaaauuuguaa

SEQ ID NO: 300785 - RNA, 22 nt, Homo sapiens
uugugguugaugaagacugucu

SEQ ID NO: 300786 - RNA, 22 nt, Homo sapiens
uuguguuuuuaguagggaaggg

SEQ ID NO: 300787 - RNA, 17 nt, Homo sapiens
augaagucaucauuuuu

SEQ ID NO: 300788 - RNA, 22 nt, Homo sapiens
augaauacagcuaugcgugcau

SEQ ID NO: 300789 - RNA, 22 nt, Homo sapiens
augacauugaaaagcaagugga

SEQ ID NO: 300790 - RNA, 22 nt, Homo sapiens
augaccuuggggaaccaugucu

SEQ ID NO: 300791 - RNA, 22 nt, Homo sapiens
augacugucagggcagucauug

SEQ ID NO: 300792 - RNA, 22 nt, Homo sapiens
augagacauuaaaguguguuug

SEQ ID NO: 300793 - RNA, 22 nt, Homo sapiens
augagagcaacaccuucacuug

SEQ ID NO: 300794 - RNA, 22 nt, Homo sapiens
augaguuccuuccuugccuagg

SEQ ID NO: 300795 - RNA, 22 nt, Homo sapiens
augauacuggcuucauagaaug

SEQ ID NO: 300796 - RNA, 22 nt, Homo sapiens
augaucaucugaaagcuuuuac

SEQ ID NO: 300797 - RNA, 22 nt, Homo sapiens
augauugaccaucugcugggcu

SEQ ID NO: 300798 - RNA, 22 nt, Homo sapiens
augcaaacaucugaagagacau

SEQ ID NO: 300799 - RNA, 22 nt, Homo sapiens
augcacauggcuaacuuuuuuc

SEQ ID NO: 300800 - RNA, 22 nt, Homo sapiens
augcacuuggcaggaugauucc

SEQ ID NO: 300801 - RNA, 22 nt, Homo sapiens
augcauaugucuuuauaguggc

SEQ ID NO: 300802 - RNA, 22 nt, Homo sapiens
augcauggcagagucaggguac

SEQ ID NO: 300803 - RNA, 22 nt, Homo sapiens
augcaugucaaauuuguagguu

SEQ ID NO: 300804 - RNA, 22 nt, Homo sapiens
augccacugcacuucagccugc

SEQ ID NO: 300805 - RNA, 22 nt, Homo sapiens
augccacuguccuccugccuag

SEQ ID NO: 300806 - RNA, 22 nt, Homo sapiens
augccauugcacuccagccuag

SEQ ID NO: 300807 - RNA, 22 nt, Homo sapiens
augcuuguugcagccugagccu

SEQ ID NO: 300808 - RNA, 22 nt, Homo sapiens
auggaaggagaggaaugaauga

SEQ ID NO: 300809 - RNA, 22 nt, Homo sapiens
auggagguguggggagugaguu

SEQ ID NO: 300810 - RNA, 22 nt, Homo sapiens
auggagugagaauggagguucc

SEQ ID NO: 300811 - RNA, 22 nt, Homo sapiens
auggcaagaagagcaauuauuu

SEQ ID NO: 300812 - RNA, 22 nt, Homo sapiens
auggcaauaauagcuaccauuu

SEQ ID NO: 300813 - RNA, 22 nt, Homo sapiens
auggcacagaguagaugcucaa

SEQ ID NO: 300814 - RNA, 22 nt, Homo sapiens
auggcagcccucuuuauccaug

SEQ ID NO: 300815 - RNA, 22 nt, Homo sapiens
auggcucuguuuuuuaugcucu

SEQ ID NO: 300816 - RNA, 22 nt, Homo sapiens
auggcuuaagacaaccuuucau

SEQ ID NO: 300817 - RNA, 22 nt, Homo sapiens
auggcuugugacccaugcuuca

SEQ ID NO: 300818 - RNA, 22 nt, Homo sapiens
auggcuuuuuaaaucauguugu

SEQ ID NO: 300819 - RNA, 22 nt, Homo sapiens
augggugaguaugaguugacuu

SEQ ID NO: 300820 - RNA, 22 nt, Homo sapiens
augguaagcugaaaauaucgaa

SEQ ID NO: 300821 - RNA, 22 nt, Homo sapiens
augguacucucuugucugcaaa

SEQ ID NO: 300822 - RNA, 21 nt, Homo sapiens
augguacugucucuggagaua

SEQ ID NO: 300823 - RNA, 22 nt, Homo sapiens
augguauuuugugauaccuugu

SEQ ID NO: 300824 - RNA, 22 nt, Homo sapiens
auggucuuuuuguuaugagaga

SEQ ID NO: 300825 - RNA, 21 nt, Homo sapiens
auguaacugggaaugugagag

SEQ ID NO: 300826 - RNA, 17 nt, Homo sapiens
auguaauccucaucucu

SEQ ID NO: 300827 - RNA, 20 nt, Homo sapiens
auguaauguaugauauguac

SEQ ID NO: 300828 - RNA, 22 nt, Homo sapiens
auguaguauuaaugagagauaa

SEQ ID NO: 300829 - RNA, 22 nt, Homo sapiens
augucaacauagacaguagagu

SEQ ID NO: 300830 - RNA, 22 nt, Homo sapiens
auguccuggacccagacaaagc

SEQ ID NO: 300831 - RNA, 22 nt, Homo sapiens
ugugacagcacagcaucucuuu

SEQ ID NO: 300832 - RNA, 22 nt, Homo sapiens
ugugaugaagaguccaagaaca

SEQ ID NO: 300833 - RNA, 22 nt, Homo sapiens
ugugaugaaggcauagggaugu

SEQ ID NO: 300834 - RNA, 20 nt, Homo sapiens
ugugauuauuuaguugcaug

SEQ ID NO: 300835 - RNA, 22 nt, Homo sapiens
ugugcauaugucuuuauaguag

SEQ ID NO: 300836 - RNA, 22 nt, Homo sapiens
ugugccuacugauagagccaag

SEQ ID NO: 300837 - RNA, 22 nt, Homo sapiens
uguggaaauaaaagaaagguua

SEQ ID NO: 300838 - RNA, 22 nt, Homo sapiens
uguggaaauuguuguauuuaau

SEQ ID NO: 300839 - RNA, 22 nt, Homo sapiens
uguggaguguaugugacagaga

SEQ ID NO: 300840 - RNA, 18 nt, Homo sapiens
uguggcuguuuuccaaua

SEQ ID NO: 300841 - RNA, 22 nt, Homo sapiens
ugugguagugcuuaccugcagu

SEQ ID NO: 300842 - RNA, 22 nt, Homo sapiens
ugugguccucugaaggcuuuuc

SEQ ID NO: 300843 - RNA, 22 nt, Homo sapiens
ugugguuuuauaaacgugaccu

SEQ ID NO: 300844 - RNA, 22 nt, Homo sapiens
ugugguuuuucacauuuagaga

SEQ ID NO: 300845 - RNA, 22 nt, Homo sapiens
uguguacaucucuacacacaug

SEQ ID NO: 300846 - RNA, 22 nt, Homo sapiens
uguguagagaaauauuacuuau

SEQ ID NO: 300847 - RNA, 22 nt, Homo sapiens
ugugucacugcacuccagcgug

SEQ ID NO: 300848 - RNA, 22 nt, Homo sapiens
ugugucuugagagucucgagaa

SEQ ID NO: 300849 - RNA, 22 nt, Homo sapiens
uguuaagauguguuuuguggcu

SEQ ID NO: 300850 - RNA, 22 nt, Homo sapiens
uguuaucauuacguucuuaguu

SEQ ID NO: 300851 - RNA, 22 nt, Homo sapiens
uguucuugaguugggaguacaa

SEQ ID NO: 300852 - RNA, 19 nt, Homo sapiens
uguugcacuccagcuuggg

SEQ ID NO: 300853 - RNA, 22 nt, Homo sapiens
uguuuguuugagauggagucuc

SEQ ID NO: 300854 - RNA, 22 nt, Homo sapiens
uuaaaguauaguuccucugguu

SEQ ID NO: 300855 - RNA, 22 nt, Homo sapiens
uuaacacugccauugauacugu

SEQ ID NO: 300856 - RNA, 22 nt, Homo sapiens
uuaagcaaagguaacaugagaa

SEQ ID NO: 300857 - RNA, 22 nt, Homo sapiens
uuaaguacuucccuguuggaca

SEQ ID NO: 300858 - RNA, 22 nt, Homo sapiens
uuaauagugacucauuuuccac

SEQ ID NO: 300859 - RNA, 22 nt, Homo sapiens
uuaauuguccaaguucaucucu

SEQ ID NO: 300860 - RNA, 22 nt, Homo sapiens
uuacacaguugguaggggcaga

SEQ ID NO: 300861 - RNA, 22 nt, Homo sapiens
uuacauguuuauggggguacau

SEQ ID NO: 300862 - RNA, 22 nt, Homo sapiens
uuacccuuuaacccuuuaaagu

SEQ ID NO: 300863 - RNA, 22 nt, Homo sapiens
uuacugcuuaagugauucaaca

SEQ ID NO: 300864 - RNA, 22 nt, Homo sapiens
uuagaguacaggggaaucaagg

SEQ ID NO: 300865 - RNA, 22 nt, Homo sapiens
uuagcacaucuuucuauguaag

SEQ ID NO: 300866 - RNA, 22 nt, Homo sapiens
uuaggcucuuuaucaguuaacu

SEQ ID NO: 300867 - RNA, 22 nt, Homo sapiens
uuaggcuuuauugaaaacaaua

SEQ ID NO: 300868 - RNA, 22 nt, Homo sapiens
uuaggcuuuuuaaccaguuguu

SEQ ID NO: 300869 - RNA, 22 nt, Homo sapiens
uuagguacuuuggagagauuca

SEQ ID NO: 300870 - RNA, 22 nt, Homo sapiens
uuaguaguuugauaggaauagc

SEQ ID NO: 300871 - RNA, 22 nt, Homo sapiens
uuagugcuuacgaugagcuaag

SEQ ID NO: 300872 - RNA, 22 nt, Homo sapiens
uuaguuuaucagugguuucuga

SEQ ID NO: 300873 - RNA, 22 nt, Homo sapiens
uuauaaacaugaagauuugggg

SEQ ID NO: 300874 - RNA, 22 nt, Homo sapiens
uuauaacagagacuccugugcu

SEQ ID NO: 300875 - RNA, 22 nt, Homo sapiens
uuaucagcagcaugaaaauaga

SEQ ID NO: 300876 - RNA, 22 nt, Homo sapiens
uuauccagcgcuguuuuggaga

SEQ ID NO: 300877 - RNA, 21 nt, Homo sapiens
uuaucccagugucucugcagg

SEQ ID NO: 300878 - RNA, 22 nt, Homo sapiens
uuauggcuauugaugacaauug

SEQ ID NO: 300879 - RNA, 22 nt, Homo sapiens
uuauguaaaucaaucuggaauc

SEQ ID NO: 300880 - RNA, 22 nt, Homo sapiens
uuauuagagauauuugguuagg

SEQ ID NO: 300881 - RNA, 22 nt, Homo sapiens
uuauuauguuggugcaaaggua

SEQ ID NO: 300882 - RNA, 22 nt, Homo sapiens
uuauugcuaaaucaugaccaca

SEQ ID NO: 300883 - RNA, 22 nt, Homo sapiens
uuauuugguuauuguaauuggg

SEQ ID NO: 300884 - RNA, 22 nt, Homo sapiens
uuauuugguugcugacuuggaa

SEQ ID NO: 300885 - RNA, 22 nt, Homo sapiens
uucaaaguaaagggauggagac

SEQ ID NO: 300886 - RNA, 23 nt, Homo sapiens
uucaaauguucucugguugucag

SEQ ID NO: 300887 - RNA, 22 nt, Homo sapiens
uucaacugcuucagccucccaa

SEQ ID NO: 300888 - RNA, 22 nt, Homo sapiens
uucaagucaauuuuugaaugac

SEQ ID NO: 300889 - RNA, 20 nt, Homo sapiens
uucaagugauucucaugccu

SEQ ID NO: 300890 - RNA, 22 nt, Homo sapiens
uucacagaaaaaggcgaugagg

SEQ ID NO: 300891 - RNA, 22 nt, Homo sapiens
uucacaguacucccuggaauua

SEQ ID NO: 300892 - RNA, 23 nt, Homo sapiens
uucaccugguuauuaauagccuc

SEQ ID NO: 300893 - RNA, 22 nt, Homo sapiens
uucacugcauuucagccugggc

SEQ ID NO: 300894 - RNA, 22 nt, Homo sapiens
uucacugugugacccugggcca

SEQ ID NO: 300895 - RNA, 22 nt, Homo sapiens
uucagcacugaaaauaugucau

SEQ ID NO: 300896 - RNA, 22 nt, Homo sapiens
uucagcaguggccaguggaaau

SEQ ID NO: 300897 - RNA, 22 nt, Homo sapiens
uucagcuacuugggaggcugaa

SEQ ID NO: 300898 - RNA, 22 nt, Homo sapiens
uucaguaaauguucuuacuaua

SEQ ID NO: 300899 - RNA, 22 nt, Homo sapiens
uucaguaguaaguuggaacucu

SEQ ID NO: 300900 - RNA, 18 nt, Homo sapiens
uucagugaauucuuuuga

SEQ ID NO: 300901 - RNA, 22 nt, Homo sapiens
uucagugucauuaacacaguag

SEQ ID NO: 300902 - RNA, 22 nt, Homo sapiens
uucauaguguuuccuuccagug

SEQ ID NO: 300903 - RNA, 22 nt, Homo sapiens
uucauaguucuuuuagucauua

SEQ ID NO: 300904 - RNA, 22 nt, Homo sapiens
uucauaguuuauacugauauuu

SEQ ID NO: 300905 - RNA, 22 nt, Homo sapiens
uucaucuggcaauucagagauu

SEQ ID NO: 300906 - RNA, 21 nt, Homo sapiens
uucaucuggccguauuccagg

SEQ ID NO: 300907 - RNA, 22 nt, Homo sapiens
uucauggaauauugaccauuuu

SEQ ID NO: 300908 - RNA, 22 nt, Homo sapiens
uucauggaguugagaaggcuaa

SEQ ID NO: 300909 - RNA, 22 nt, Homo sapiens
uucauugaaugauuuuuagaag

SEQ ID NO: 300910 - RNA, 22 nt, Homo sapiens
uuccaauguuccguguugcagu

SEQ ID NO: 300911 - RNA, 22 nt, Homo sapiens
uuccagaugggaguucuauucu

SEQ ID NO: 300912 - RNA, 22 nt, Homo sapiens
uuccaggugggcgugggccugg

SEQ ID NO: 300913 - RNA, 22 nt, Homo sapiens
uuccaguggaguaaauggacaa

SEQ ID NO: 300914 - RNA, 22 nt, Homo sapiens
uuccaguugugagcuauccggg

SEQ ID NO: 300915 - RNA, 22 nt, Homo sapiens
uuccaguuuuauggguauagag

SEQ ID NO: 300916 - RNA, 22 nt, Homo sapiens
uuccauagucauagugcugaug

SEQ ID NO: 300917 - RNA, 22 nt, Homo sapiens
uuccauguaguugaacgguuuu

SEQ ID NO: 300918 - RNA, 22 nt, Homo sapiens
uuccauugugucaucuuggugg

SEQ ID NO: 300919 - RNA, 22 nt, Homo sapiens
aagugaauucauuguguuauau

SEQ ID NO: 300920 - RNA, 22 nt, Homo sapiens
aagugacuagacuaugaaaccu

SEQ ID NO: 300921 - RNA, 22 nt, Homo sapiens
aagugcugggauuggccgggca

SEQ ID NO: 300922 - RNA, 22 nt, Homo sapiens
aagugcuguccuaccuuuggga

SEQ ID NO: 300923 - RNA, 22 nt, Homo sapiens
aagugcuuaggauagugugugg

SEQ ID NO: 300924 - RNA, 22 nt, Homo sapiens
aaguggcauugaggaaaaaaau

SEQ ID NO: 300925 - RNA, 23 nt, Homo sapiens
aagugguuuugaacccggacccu

SEQ ID NO: 300926 - RNA, 23 nt, Homo sapiens
aaguucaugcucaucuguuacac

SEQ ID NO: 300927 - RNA, 22 nt, Homo sapiens
aaguugcuuuagguaagucaau

SEQ ID NO: 300928 - RNA, 22 nt, Homo sapiens
aauaaagccugucucuuuagag

SEQ ID NO: 300929 - RNA, 22 nt, Homo sapiens
aauaagcugagagaauucuaca

SEQ ID NO: 300930 - RNA, 22 nt, Homo sapiens
aauauguccuugaaauggugcu

SEQ ID NO: 300931 - RNA, 22 nt, Homo sapiens
aaucacauugaaucugcuaccu

SEQ ID NO: 300932 - RNA, 22 nt, Homo sapiens
aaucagcacacugugcuuucca

SEQ ID NO: 300933 - RNA, 22 nt, Homo sapiens
aaucauggaguauuuguccuug

SEQ ID NO: 300934 - RNA, 22 nt, Homo sapiens
aaucugggguuguuuggggagu

SEQ ID NO: 300935 - RNA, 22 nt, Homo sapiens
aaucugucuagacaaggagucu

SEQ ID NO: 300936 - RNA, 22 nt, Homo sapiens
aaugacacugagcaucuuucau

SEQ ID NO: 300937 - RNA, 22 nt, Homo sapiens
aaugacagccagauucuucucu

SEQ ID NO: 300938 - RNA, 17 nt, Homo sapiens
aaugagacauuucugcu

SEQ ID NO: 300939 - RNA, 22 nt, Homo sapiens
aaugauauguuauguuuagguu

SEQ ID NO: 300940 - RNA, 22 nt, Homo sapiens
aauggcacaagacaugaagaag

SEQ ID NO: 300941 - RNA, 19 nt, Homo sapiens
aauggcuuuuccuguuccc

SEQ ID NO: 300942 - RNA, 22 nt, Homo sapiens
aaugucaucuucaguuguacag

SEQ ID NO: 300943 - RNA, 22 nt, Homo sapiens
aaugugcuguucagaggagucc

SEQ ID NO: 300944 - RNA, 22 nt, Homo sapiens
aauuacucgugucuuuacugcu

SEQ ID NO: 300945 - RNA, 22 nt, Homo sapiens
aauuaguaaccuaauuccaucu

SEQ ID NO: 300946 - RNA, 22 nt, Homo sapiens
aauugcaauggacaaugcagca

SEQ ID NO: 300947 - RNA, 22 nt, Homo sapiens
aauuggcagugcucuugccaca

SEQ ID NO: 300948 - RNA, 22 nt, Homo sapiens
aauuugucaccucucucccuuu

SEQ ID NO: 300949 - RNA, 22 nt, Homo sapiens
acaaagcuagggaauccaucuu

SEQ ID NO: 300950 - RNA, 22 nt, Homo sapiens
acaaaguauggaauguuggugu

SEQ ID NO: 300951 - RNA, 22 nt, Homo sapiens
acaacaguuuuaucaccccaga

SEQ ID NO: 300952 - RNA, 22 nt, Homo sapiens
acaagcacaaaugcauagaugg

SEQ ID NO: 300953 - RNA, 22 nt, Homo sapiens
acaauguauauuuuacuguagg

SEQ ID NO: 300954 - RNA, 22 nt, Homo sapiens
acacagucaaauccacuuggcu

SEQ ID NO: 300955 - RNA, 22 nt, Homo sapiens
acacagugucuguguauuuaaa

SEQ ID NO: 300956 - RNA, 22 nt, Homo sapiens
acacauacacauaugguguaua

SEQ ID NO: 300957 - RNA, 22 nt, Homo sapiens
acacaugugcguagacucuuua

SEQ ID NO: 300958 - RNA, 22 nt, Homo sapiens
acacuuucuggagcugcacaua

SEQ ID NO: 300959 - RNA, 22 nt, Homo sapiens
acagaaccauucacuccccugg

SEQ ID NO: 300960 - RNA, 22 nt, Homo sapiens
acagaacugggcuugcuuuugg

SEQ ID NO: 300961 - RNA, 22 nt, Homo sapiens
acagagcaaugagcuacggucu

SEQ ID NO: 300962 - RNA, 22 nt, Homo sapiens
acagauagacauauauagcuca

SEQ ID NO: 300963 - RNA, 20 nt, Homo sapiens
acagcacugguuucaagcaa

SEQ ID NO: 300964 - RNA, 22 nt, Homo sapiens
acagcagugccccacucuacug

SEQ ID NO: 300965 - RNA, 21 nt, Homo sapiens
acaguacuugagaucuuuuga

SEQ ID NO: 300966 - RNA, 22 nt, Homo sapiens
acaguggugcgaucucggcuca

SEQ ID NO: 300967 - RNA, 18 nt, Homo sapiens
acagugucauggcucaau

SEQ ID NO: 300968 - RNA, 19 nt, Homo sapiens
acagugucucuauaaugau

SEQ ID NO: 300969 - RNA, 22 nt, Homo sapiens
acagugucugacacguaggaag

SEQ ID NO: 300970 - RNA, 22 nt, Homo sapiens
acauacacuagggauguggugu

SEQ ID NO: 300971 - RNA, 21 nt, Homo sapiens
acaucagaguugugaagguag

SEQ ID NO: 300972 - RNA, 22 nt, Homo sapiens
acaucccaugccuggguacucc

SEQ ID NO: 300973 - RNA, 22 nt, Homo sapiens
accacaggguaaaguuagauau

SEQ ID NO: 300974 - RNA, 22 nt, Homo sapiens
accauugcacuccagccugggc

SEQ ID NO: 300975 - RNA, 22 nt, Homo sapiens
acccaguguucaacauucacau

SEQ ID NO: 300976 - RNA, 22 nt, Homo sapiens
acccaguguugggcagaacugu

SEQ ID NO: 300977 - RNA, 23 nt, Homo sapiens
accccuacaggcuuguguccugc

SEQ ID NO: 300978 - RNA, 22 nt, Homo sapiens
acccgggaggcaggagucauag

SEQ ID NO: 300979 - RNA, 22 nt, Homo sapiens
acccuuaagcacuaguucagcu

SEQ ID NO: 300980 - RNA, 22 nt, Homo sapiens
accucagcccggggaaguugag

SEQ ID NO: 300981 - RNA, 23 nt, Homo sapiens
accugauguuucuguggggagcc

SEQ ID NO: 300982 - RNA, 22 nt, Homo sapiens
accugcacagccgaacauagac

SEQ ID NO: 300983 - RNA, 22 nt, Homo sapiens
acuagagaugcauuuguaguuu

SEQ ID NO: 300984 - RNA, 22 nt, Homo sapiens
acugcacuccagccucaugaca

SEQ ID NO: 300985 - RNA, 22 nt, Homo sapiens
acugcacuccagccuccugaca

SEQ ID NO: 300986 - RNA, 22 nt, Homo sapiens
acugcacuccagccucggcaau

SEQ ID NO: 300987 - RNA, 22 nt, Homo sapiens
acugcacuccagccugaugaaa

SEQ ID NO: 300988 - RNA, 22 nt, Homo sapiens
acugcacuccagccugccgaca

SEQ ID NO: 300989 - RNA, 22 nt, Homo sapiens
acugcacuccagccugcuggau

SEQ ID NO: 300990 - RNA, 22 nt, Homo sapiens
acugcacuccagccuggacgac

SEQ ID NO: 300991 - RNA, 22 nt, Homo sapiens
acugcacuccagccuugagagc

SEQ ID NO: 300992 - RNA, 22 nt, Homo sapiens
acugcacugcagccuggccaac

SEQ ID NO: 300993 - RNA, 22 nt, Homo sapiens
acugcauuugucugucucaauu

SEQ ID NO: 300994 - RNA, 21 nt, Homo sapiens
acuggaccccuuccauacacc

SEQ ID NO: 300995 - RNA, 22 nt, Homo sapiens
acuggcuguuaggaauuaccuc

SEQ ID NO: 300996 - RNA, 21 nt, Homo sapiens
acuuucuguggcaguccauuc

SEQ ID NO: 300997 - RNA, 22 nt, Homo sapiens
acuuuguguuacccagcaagga

SEQ ID NO: 300998 - RNA, 22 nt, Homo sapiens
agaaauguuuacucacccccuu

SEQ ID NO: 300999 - RNA, 22 nt, Homo sapiens
agaaauguuuauucaaacccgu

SEQ ID NO: 301000 - RNA, 22 nt, Homo sapiens
agaaccauuagagggagauauu

SEQ ID NO: 301001 - RNA, 22 nt, Homo sapiens
agaauguaaacagaauagagga

SEQ ID NO: 301002 - RNA, 22 nt, Homo sapiens
agaaugucagcuggauucagcu

SEQ ID NO: 301003 - RNA, 22 nt, Homo sapiens
agaauucugucauguuuauauu

SEQ ID NO: 301004 - RNA, 22 nt, Homo sapiens
agacaagauggcuugagguuca

SEQ ID NO: 301005 - RNA, 22 nt, Homo sapiens
agacagcugguagcacuuccug

SEQ ID NO: 301006 - RNA, 20 nt, Homo sapiens
agacaguguggagauuccuu

SEQ ID NO: 301007 - RNA, 22 nt, Homo sapiens
agacaguguguguauauauggu

SEQ ID NO: 301008 - RNA, 22 nt, Homo sapiens
agacuagacagaugaacagcac

SEQ ID NO: 301009 - RNA, 22 nt, Homo sapiens
agagagcuuuugguugcccuaa

SEQ ID NO: 301010 - RNA, 22 nt, Homo sapiens
agagauaauuagguuaaaugag

SEQ ID NO: 301011 - RNA, 20 nt, Homo sapiens
agagaucaguaauucaucaa

SEQ ID NO: 301012 - RNA, 22 nt, Homo sapiens
agagauccucauuuuauagaca

SEQ ID NO: 301013 - RNA, 21 nt, Homo sapiens
agaggacugaccacagcccua

SEQ ID NO: 301014 - RNA, 22 nt, Homo sapiens
agagugaagcuuuuuauauucu

SEQ ID NO: 301015 - RNA, 22 nt, Homo sapiens
agauaugucugcuauuugcugu

SEQ ID NO: 301016 - RNA, 23 nt, Homo sapiens
agcaaaugcucuagcacuccaac

SEQ ID NO: 301017 - RNA, 22 nt, Homo sapiens
agcaacauagugagacccccau

SEQ ID NO: 301018 - RNA, 22 nt, Homo sapiens
agcaacauggaguuugugcgca

SEQ ID NO: 301019 - RNA, 22 nt, Homo sapiens
agcacauuaguaucuaagaaca

SEQ ID NO: 301020 - RNA, 22 nt, Homo sapiens
agcaccguucaaacccagguua

SEQ ID NO: 301021 - RNA, 21 nt, Homo sapiens
agcagaguggcagcucuuuug

SEQ ID NO: 301022 - RNA, 22 nt, Homo sapiens
agcagcaccaaacagacuaaga

SEQ ID NO: 301023 - RNA, 22 nt, Homo sapiens
agcagcaucgggaaguuggcca

SEQ ID NO: 301024 - RNA, 22 nt, Homo sapiens
uggcaugcauuguggguaauua

SEQ ID NO: 301025 - RNA, 23 nt, Homo sapiens
uggcauuuuuggcaaugccuucu

SEQ ID NO: 301026 - RNA, 23 nt, Homo sapiens
uggccaagauaaucucaguuuuc

SEQ ID NO: 301027 - RNA, 22 nt, Homo sapiens
uggccagagggcaauuagcugu

SEQ ID NO: 301028 - RNA, 22 nt, Homo sapiens
uggccagugucggaggccagga

SEQ ID NO: 301029 - RNA, 22 nt, Homo sapiens
uggcgggaaaguugggagaaga

SEQ ID NO: 301030 - RNA, 22 nt, Homo sapiens
uggcuaaguuaaucaaggagau

SEQ ID NO: 301031 - RNA, 19 nt, Homo sapiens
uggcuagagcagauauccu

SEQ ID NO: 301032 - RNA, 19 nt, Homo sapiens
uggcuagaggccaggcguu

SEQ ID NO: 301033 - RNA, 22 nt, Homo sapiens
uggcuccguuguacaggcugga

SEQ ID NO: 301034 - RNA, 22 nt, Homo sapiens
uggcucuguuuguuaacuagac

SEQ ID NO: 301035 - RNA, 22 nt, Homo sapiens
uggcuguuuauuucacgugggu

SEQ ID NO: 301036 - RNA, 22 nt, Homo sapiens
uggcuuuuccaggcauuacgau

SEQ ID NO: 301037 - RNA, 22 nt, Homo sapiens
uggcuuuuccuugaaucugccu

SEQ ID NO: 301038 - RNA, 22 nt, Homo sapiens
ugggaagaagguuuacuugcca

SEQ ID NO: 301039 - RNA, 22 nt, Homo sapiens
ugggaagcugcauuuuaacaag

SEQ ID NO: 301040 - RNA, 22 nt, Homo sapiens
ugggaauaugauacaggucuuu

SEQ ID NO: 301041 - RNA, 19 nt, Homo sapiens
ugggaauguaaauuaguuc

SEQ ID NO: 301042 - RNA, 22 nt, Homo sapiens
ugggcagugggacagcuuugug

SEQ ID NO: 301043 - RNA, 22 nt, Homo sapiens
uggguccccuacucuuuccaca

SEQ ID NO: 301044 - RNA, 22 nt, Homo sapiens
ugggugaguaucuauuauucag

SEQ ID NO: 301045 - RNA, 22 nt, Homo sapiens
ugggugugaccgcucaaggggg

SEQ ID NO: 301046 - RNA, 22 nt, Homo sapiens
ugguaagaaaaccauuauuagc

SEQ ID NO: 301047 - RNA, 22 nt, Homo sapiens
ugguaaguuuaacaugcauccc

SEQ ID NO: 301048 - RNA, 21 nt, Homo sapiens
uggucaguuuucucacuagga

SEQ ID NO: 301049 - RNA, 21 nt, Homo sapiens
uggucccauaagauuauaaug

SEQ ID NO: 301050 - RNA, 22 nt, Homo sapiens
ugguccccaauacuucuauaga

SEQ ID NO: 301051 - RNA, 22 nt, Homo sapiens
uggugcccuguccuucuguggc

SEQ ID NO: 301052 - RNA, 20 nt, Homo sapiens
uggugguuuuaugugguuua

SEQ ID NO: 301053 - RNA, 22 nt, Homo sapiens
ugguguccugucucugcgcuug

SEQ ID NO: 301054 - RNA, 22 nt, Homo sapiens
ugguuagucuguguguauauau

SEQ ID NO: 301055 - RNA, 22 nt, Homo sapiens
uguaaugaucaaaucagaguaa

SEQ ID NO: 301056 - RNA, 22 nt, Homo sapiens
uguaauuuaaaugauccuugga

SEQ ID NO: 301057 - RNA, 20 nt, Homo sapiens
uguacacaguguacccacau

SEQ ID NO: 301058 - RNA, 21 nt, Homo sapiens
uguagcagcaugauucauagu

SEQ ID NO: 301059 - RNA, 22 nt, Homo sapiens
uguauacauauguauguuuugu

SEQ ID NO: 301060 - RNA, 22 nt, Homo sapiens
uguauauguuuguacauauguc

SEQ ID NO: 301061 - RNA, 22 nt, Homo sapiens
uguauuuguuguuaaauggaga

SEQ ID NO: 301062 - RNA, 20 nt, Homo sapiens
ugucaagaaacauuacuuau

SEQ ID NO: 301063 - RNA, 22 nt, Homo sapiens
ugucaagaaaucaaggugugag

SEQ ID NO: 301064 - RNA, 22 nt, Homo sapiens
ugucaccauuuguaggugagga

SEQ ID NO: 301065 - RNA, 22 nt, Homo sapiens
ugucagcacaacucagguuccu

SEQ ID NO: 301066 - RNA, 22 nt, Homo sapiens
ugucagggaggcucggccgcac

SEQ ID NO: 301067 - RNA, 22 nt, Homo sapiens
ugucaguuuuaacuagggaaua

SEQ ID NO: 301068 - RNA, 22 nt, Homo sapiens
ugucaugagucuccuccaucuu

SEQ ID NO: 301069 - RNA, 22 nt, Homo sapiens
ugucauguauauaccacuucca

SEQ ID NO: 301070 - RNA, 22 nt, Homo sapiens
ugucauuguggugcagauauaa

SEQ ID NO: 301071 - RNA, 22 nt, Homo sapiens
ugucccugagccuggauuccug

SEQ ID NO: 301072 - RNA, 22 nt, Homo sapiens
ugucucagugauuggcuuucug

SEQ ID NO: 301073 - RNA, 22 nt, Homo sapiens
ugucucaguucccuucucugga

SEQ ID NO: 301074 - RNA, 18 nt, Homo sapiens
ugucuuagagcuugaccc

SEQ ID NO: 301075 - RNA, 22 nt, Homo sapiens
ugugaacagcuccaaaugugga

SEQ ID NO: 301076 - RNA, 22 nt, Homo sapiens
ugugacagguagguaauuuuug

SEQ ID NO: 301077 - RNA, 22 nt, Homo sapiens
ugugacaguguuacauuucaug

SEQ ID NO: 301078 - RNA, 22 nt, Homo sapiens
ugugacaguuaguuugguguua

SEQ ID NO: 301079 - RNA, 22 nt, Homo sapiens
ugugagacugguucugaaccca

SEQ ID NO: 301080 - RNA, 19 nt, Homo sapiens
ugugagcauuagcauuuag

SEQ ID NO: 301081 - RNA, 22 nt, Homo sapiens
ugugaucaugugugccuuaguc

SEQ ID NO: 301082 - RNA, 22 nt, Homo sapiens
ugugcaaaaacaauugcgguuu

SEQ ID NO: 301083 - RNA, 22 nt, Homo sapiens
ugugcaaaaguaauugcgguuu

SEQ ID NO: 301084 - RNA, 22 nt, Homo sapiens
ugugcaaauguuaaacuaacuu

SEQ ID NO: 301085 - RNA, 22 nt, Homo sapiens
ugugccacuccagcucuagcuu

SEQ ID NO: 301086 - RNA, 22 nt, Homo sapiens
ugugccacugcacucugggcaa

SEQ ID NO: 301087 - RNA, 22 nt, Homo sapiens
ugugccuaguaauguguccaga

SEQ ID NO: 301088 - RNA, 22 nt, Homo sapiens
ugugcuaaaaugggacuucuaa

SEQ ID NO: 301089 - RNA, 22 nt, Homo sapiens
ugugcuauguuauucacauggg

SEQ ID NO: 301090 - RNA, 22 nt, Homo sapiens
ugugcucaucucagucaacugu

SEQ ID NO: 301091 - RNA, 22 nt, Homo sapiens
ugugcuugaaauucaguuuuga

SEQ ID NO: 301092 - RNA, 22 nt, Homo sapiens
uguggcacuguguccagagaaa

SEQ ID NO: 301093 - RNA, 22 nt, Homo sapiens
uguggcauuuucagaaaggaug

SEQ ID NO: 301094 - RNA, 22 nt, Homo sapiens
uguggccccuagcuacuagaga

SEQ ID NO: 301095 - RNA, 22 nt, Homo sapiens
uuagaacuagaggaguuugagu

SEQ ID NO: 301096 - RNA, 22 nt, Homo sapiens
uuagagcacugaucugcucuuu

SEQ ID NO: 301097 - RNA, 22 nt, Homo sapiens
uuagauguuugacugggccuua

SEQ ID NO: 301098 - RNA, 22 nt, Homo sapiens
uuagcauccauaggagauuggu

SEQ ID NO: 301099 - RNA, 22 nt, Homo sapiens
uuaggcaguuuauugauuuuca

SEQ ID NO: 301100 - RNA, 22 nt, Homo sapiens
uuaguagcacagaguaucagca

SEQ ID NO: 301101 - RNA, 22 nt, Homo sapiens
uuagugaaugggugugauuugu

SEQ ID NO: 301102 - RNA, 22 nt, Homo sapiens
uuauacucgucugaaugauucu

SEQ ID NO: 301103 - RNA, 22 nt, Homo sapiens
uuauagcacuaagaagguaaua

SEQ ID NO: 301104 - RNA, 20 nt, Homo sapiens
uuauagcuacaucuugacug

SEQ ID NO: 301105 - RNA, 22 nt, Homo sapiens
uuauggauuuauauucuguagu

SEQ ID NO: 301106 - RNA, 17 nt, Homo sapiens
uuauugcuauaagcuga

SEQ ID NO: 301107 - RNA, 22 nt, Homo sapiens
uuauugcuccagaggcugauuu

SEQ ID NO: 301108 - RNA, 22 nt, Homo sapiens
uucaaaaccucugcuuaagccc

SEQ ID NO: 301109 - RNA, 22 nt, Homo sapiens
uucaagugaacaaaaugaggag

SEQ ID NO: 301110 - RNA, 22 nt, Homo sapiens
uucaauuaauauuauacucuca

SEQ ID NO: 301111 - RNA, 22 nt, Homo sapiens
uucacacuagccacucugguag

SEQ ID NO: 301112 - RNA, 22 nt, Homo sapiens
uucacacugggccuacucugug

SEQ ID NO: 301113 - RNA, 22 nt, Homo sapiens
uucacagucacccuucuccaug

SEQ ID NO: 301114 - RNA, 22 nt, Homo sapiens
uucacccugguuguagauggac

SEQ ID NO: 301115 - RNA, 23 nt, Homo sapiens
uucaccguguuggccaggcuggu

SEQ ID NO: 301116 - RNA, 22 nt, Homo sapiens
uucaccuugggucccacuugcu

SEQ ID NO: 301117 - RNA, 22 nt, Homo sapiens
uucacgguguucacgggggucc

SEQ ID NO: 301118 - RNA, 22 nt, Homo sapiens
uucacugugcuuaaauucugcu

SEQ ID NO: 301119 - RNA, 22 nt, Homo sapiens
uucagagugguaugaagugaug

SEQ ID NO: 301120 - RNA, 22 nt, Homo sapiens
uucagcacaguguggaucauuc

SEQ ID NO: 301121 - RNA, 22 nt, Homo sapiens
uucagcaggccaggcccugacu

SEQ ID NO: 301122 - RNA, 22 nt, Homo sapiens
uucagcuacuuggaaacagcaa

SEQ ID NO: 301123 - RNA, 22 nt, Homo sapiens
uucagguaauuaugguuugucu

SEQ ID NO: 301124 - RNA, 22 nt, Homo sapiens
uucagguaucccuugucuauag

SEQ ID NO: 301125 - RNA, 22 nt, Homo sapiens
uucagugagacgaaaacaacaa

SEQ ID NO: 301126 - RNA, 22 nt, Homo sapiens
uucaguucugcacugaucuuag

SEQ ID NO: 301127 - RNA, 21 nt, Homo sapiens
uucauaaggcuucucuccugu

SEQ ID NO: 301128 - RNA, 22 nt, Homo sapiens
uucauaguaacaguaacuaugg

SEQ ID NO: 301129 - RNA, 22 nt, Homo sapiens
uucauggaacaaguggguucaa

SEQ ID NO: 301130 - RNA, 22 nt, Homo sapiens
uucauggagccauccuuugauc

SEQ ID NO: 301131 - RNA, 22 nt, Homo sapiens
uucauggaguuuaaauuguagu

SEQ ID NO: 301132 - RNA, 22 nt, Homo sapiens
uucauguaauuccauaagguaa

SEQ ID NO: 301133 - RNA, 22 nt, Homo sapiens
uucaugugagucuguauuaacu

SEQ ID NO: 301134 - RNA, 22 nt, Homo sapiens
uucauuggauguuacacugugu

SEQ ID NO: 301135 - RNA, 22 nt, Homo sapiens
uuccacaaugguugaacuaguu

SEQ ID NO: 301136 - RNA, 22 nt, Homo sapiens
uuccaguggacuacuucauccu

SEQ ID NO: 301137 - RNA, 22 nt, Homo sapiens
uucccagucaaacgaaggacuu

SEQ ID NO: 301138 - RNA, 22 nt, Homo sapiens
uucccagugccaggcacuggga

SEQ ID NO: 301139 - RNA, 22 nt, Homo sapiens
uucccaguggaacauguaguca

SEQ ID NO: 301140 - RNA, 22 nt, Homo sapiens
uucccuugcaggaugaucugga

SEQ ID NO: 301141 - RNA, 22 nt, Homo sapiens
uucccuuucugccuugaaucuu

SEQ ID NO: 301142 - RNA, 22 nt, Homo sapiens
uucccuuucuuaaagaguuagg

SEQ ID NO: 301143 - RNA, 19 nt, Homo sapiens
uuccugagaacaagggcuu

SEQ ID NO: 301144 - RNA, 22 nt, Homo sapiens
uuccugucuuccaagagagauu

SEQ ID NO: 301145 - RNA, 22 nt, Homo sapiens
uuccuuaguuauuugguccccu

SEQ ID NO: 301146 - RNA, 22 nt, Homo sapiens
uucuaaacaucuuacaaugcau

SEQ ID NO: 301147 - RNA, 22 nt, Homo sapiens
uucuacaggcuguucaagaagc

SEQ ID NO: 301148 - RNA, 22 nt, Homo sapiens
uucuagcacuuugggagacuga

SEQ ID NO: 301149 - RNA, 20 nt, Homo sapiens
uucuaguacuucuguuucca

SEQ ID NO: 301150 - RNA, 22 nt, Homo sapiens
uucucaauggcaacuuguugcu

SEQ ID NO: 301151 - RNA, 21 nt, Homo sapiens
uucucagaggcaggggauaaa

SEQ ID NO: 301152 - RNA, 22 nt, Homo sapiens
uucucagugaaguuuagaacau

SEQ ID NO: 301153 - RNA, 22 nt, Homo sapiens
uucucagugcuaucuuuuaugc

SEQ ID NO: 301154 - RNA, 22 nt, Homo sapiens
uucucaguuccuacuuugguga

SEQ ID NO: 301155 - RNA, 22 nt, Homo sapiens
uucucaguucgguggcagugcu

SEQ ID NO: 301156 - RNA, 22 nt, Homo sapiens
uucucuggucagaggggagguu

SEQ ID NO: 301157 - RNA, 22 nt, Homo sapiens
uucucuguggauugggugagag

SEQ ID NO: 301158 - RNA, 22 nt, Homo sapiens
uucugaguggcuuucaacacug

SEQ ID NO: 301159 - RNA, 23 nt, Homo sapiens
uucugccacugaaaaugccucag

SEQ ID NO: 301160 - RNA, 22 nt, Homo sapiens
uucuguguuuaggucacggcua

SEQ ID NO: 301161 - RNA, 22 nt, Homo sapiens
uucuucaggccacaaaaauggu

SEQ ID NO: 301162 - RNA, 22 nt, Homo sapiens
uucuuccagccuugaggggccc

SEQ ID NO: 301163 - RNA, 22 nt, Homo sapiens
uucuugcuguauccucacaugg

SEQ ID NO: 301164 - RNA, 22 nt, Homo sapiens
agcucuuguuaguauuagcagu

SEQ ID NO: 301165 - RNA, 20 nt, Homo sapiens
agcuggguguguuggugcau

SEQ ID NO: 301166 - RNA, 22 nt, Homo sapiens
agcugguauuuguuagggaguu

SEQ ID NO: 301167 - RNA, 19 nt, Homo sapiens
agcuguguugccugugaga

SEQ ID NO: 301168 - RNA, 22 nt, Homo sapiens
agcuguguugucugaagucaga

SEQ ID NO: 301169 - RNA, 22 nt, Homo sapiens
agcuguuguucucagaggcuuu

SEQ ID NO: 301170 - RNA, 21 nt, Homo sapiens
agcuuguguguaucacagugu

SEQ ID NO: 301171 - RNA, 22 nt, Homo sapiens
agcuuguuuuauagaaagucaa

SEQ ID NO: 301172 - RNA, 21 nt, Homo sapiens
aggagcauucaugacgagguu

SEQ ID NO: 301173 - RNA, 21 nt, Homo sapiens
aggagcauucucuugcuuugu

SEQ ID NO: 301174 - RNA, 22 nt, Homo sapiens
aggagguagaacauugccauuu

SEQ ID NO: 301175 - RNA, 22 nt, Homo sapiens
aggagguaggaauugugcuagg

SEQ ID NO: 301176 - RNA, 22 nt, Homo sapiens
aggcaagcaucuugcucccuuc

SEQ ID NO: 301177 - RNA, 22 nt, Homo sapiens
aggcacgguggcucacaccugu

SEQ ID NO: 301178 - RNA, 22 nt, Homo sapiens
aggcaugguggcacauacaugu

SEQ ID NO: 301179 - RNA, 21 nt, Homo sapiens
aggcuguuguuuugggaugga

SEQ ID NO: 301180 - RNA, 22 nt, Homo sapiens
aggcuuuauuacagggucucag

SEQ ID NO: 301181 - RNA, 22 nt, Homo sapiens
agggcaagacuuguuaagaaca

SEQ ID NO: 301182 - RNA, 22 nt, Homo sapiens
agggcauuguacaaaucaucau

SEQ ID NO: 301183 - RNA, 22 nt, Homo sapiens
agguaguguuauuugcagcuga

SEQ ID NO: 301184 - RNA, 20 nt, Homo sapiens
agguaguuauacaaaugugu

SEQ ID NO: 301185 - RNA, 22 nt, Homo sapiens
agguccauugguauuauagcau

SEQ ID NO: 301186 - RNA, 22 nt, Homo sapiens
aggugaauggauaaacuguggg

SEQ ID NO: 301187 - RNA, 22 nt, Homo sapiens
aggugguauuuaaaauuauuug

SEQ ID NO: 301188 - RNA, 22 nt, Homo sapiens
aguaccauuugacaugggaccc

SEQ ID NO: 301189 - RNA, 22 nt, Homo sapiens
aguaucaucuuguuggccaggc

SEQ ID NO: 301190 - RNA, 22 nt, Homo sapiens
aguauguagugcaaucagucag

SEQ ID NO: 301191 - RNA, 22 nt, Homo sapiens
agucacaugccagcacacccag

SEQ ID NO: 301192 - RNA, 22 nt, Homo sapiens
agucaugguaguaaauuuggac

SEQ ID NO: 301193 - RNA, 22 nt, Homo sapiens
aguccagguuuuguaauggcaa

SEQ ID NO: 301194 - RNA, 22 nt, Homo sapiens
aguccaguguuaugaucaguag

SEQ ID NO: 301195 - RNA, 23 nt, Homo sapiens
agucuguguuuacaggcucucug

SEQ ID NO: 301196 - RNA, 22 nt, Homo sapiens
agugaaaugucaccuuuuagga

SEQ ID NO: 301197 - RNA, 17 nt, Homo sapiens
agugagaucauggcuua

SEQ ID NO: 301198 - RNA, 22 nt, Homo sapiens
agugcauuugcaucucaauaua

SEQ ID NO: 301199 - RNA, 22 nt, Homo sapiens
agugccacugcacucuagccug

SEQ ID NO: 301200 - RNA, 22 nt, Homo sapiens
aguggguguuccauuggauaaa

SEQ ID NO: 301201 - RNA, 23 nt, Homo sapiens
aguggucuccugggcccagcugu

SEQ ID NO: 301202 - RNA, 22 nt, Homo sapiens
agugguuugaucacagcucacu

SEQ ID NO: 301203 - RNA, 22 nt, Homo sapiens
aguguuuuuaucaugaaagggu

SEQ ID NO: 301204 - RNA, 22 nt, Homo sapiens
aguguuuuucaugggauacuuu

SEQ ID NO: 301205 - RNA, 21 nt, Homo sapiens
aguucacauggcuccuguguu

SEQ ID NO: 301206 - RNA, 22 nt, Homo sapiens
aguuuugguugaguuacuagca

SEQ ID NO: 301207 - RNA, 22 nt, Homo sapiens
auaaacagcuuauccucuauuc

SEQ ID NO: 301208 - RNA, 18 nt, Homo sapiens
auaaacucaucauuuuua

SEQ ID NO: 301209 - RNA, 22 nt, Homo sapiens
auaaagcaagucucuggccuca

SEQ ID NO: 301210 - RNA, 22 nt, Homo sapiens
auaaauucauuuaagcuccuua

SEQ ID NO: 301211 - RNA, 22 nt, Homo sapiens
auaacauccuuucuuaucguug

SEQ ID NO: 301212 - RNA, 22 nt, Homo sapiens
auaacauggaguuugucauuua

SEQ ID NO: 301213 - RNA, 22 nt, Homo sapiens
auaaguagaaugauggucaaaa

SEQ ID NO: 301214 - RNA, 22 nt, Homo sapiens
auaauaccugccacauuugaau

SEQ ID NO: 301215 - RNA, 22 nt, Homo sapiens
auaauagguaguaauggauuga

SEQ ID NO: 301216 - RNA, 22 nt, Homo sapiens
auacaguguucugggaagaagu

SEQ ID NO: 301217 - RNA, 22 nt, Homo sapiens
auacaugugccaugcuggugug

SEQ ID NO: 301218 - RNA, 22 nt, Homo sapiens
auacaugugccauggugguuug

SEQ ID NO: 301219 - RNA, 22 nt, Homo sapiens
aaaaugcugauauugggcccca

SEQ ID NO: 301220 - RNA, 22 nt, Homo sapiens
aaagcuagagaagcugcuguca

SEQ ID NO: 301221 - RNA, 20 nt, Homo sapiens
aaaggcugugagaacgagau

SEQ ID NO: 301222 - RNA, 22 nt, Homo sapiens
aaagggcuguuucuugacuugg

SEQ ID NO: 301223 - RNA, 22 nt, Homo sapiens
aaagggcuuuguaaacuucaag

SEQ ID NO: 301224 - RNA, 22 nt, Homo sapiens
aaaguaauugcaguuuuugcaa

SEQ ID NO: 301225 - RNA, 22 nt, Homo sapiens
aaagugacuuagugccccauuu

SEQ ID NO: 301226 - RNA, 22 nt, Homo sapiens
aaagugauguccaggcuuucag

SEQ ID NO: 301227 - RNA, 22 nt, Homo sapiens
aaagugcuaggauuaccugggg

SEQ ID NO: 301228 - RNA, 22 nt, Homo sapiens
aaagugcugagacagacuggga

SEQ ID NO: 301229 - RNA, 22 nt, Homo sapiens
aaagugcugggaucacacugaa

SEQ ID NO: 301230 - RNA, 22 nt, Homo sapiens
aaaguggugggauuccaggcau

SEQ ID NO: 301231 - RNA, 22 nt, Homo sapiens
aaagugguuuuucagacuuuga

SEQ ID NO: 301232 - RNA, 22 nt, Homo sapiens
aaauaacugucagguucuggaa

SEQ ID NO: 301233 - RNA, 22 nt, Homo sapiens
gaccacagacuggaaagagggc

SEQ ID NO: 301234 - RNA, 21 nt, Homo sapiens
gaccacagcagggaaugucag

SEQ ID NO: 301235 - RNA, 22 nt, Homo sapiens
gacugaggaagcgcucucuccu

SEQ ID NO: 301236 - RNA, 22 nt, Homo sapiens
gacugcagugcagcuguuaggc

SEQ ID NO: 301237 - RNA, 22 nt, Homo sapiens
gagaacagaagcauuccuaauu

SEQ ID NO: 301238 - RNA, 22 nt, Homo sapiens
gagaacauuuaagccacucagg

SEQ ID NO: 301239 - RNA, 22 nt, Homo sapiens
gagauaacuacuggauuaaguu

SEQ ID NO: 301240 - RNA, 22 nt, Homo sapiens
gagaugaaaucuugcucuguca

SEQ ID NO: 301241 - RNA, 22 nt, Homo sapiens
gagaugaugagauguucacagu

SEQ ID NO: 301242 - RNA, 22 nt, Homo sapiens
gagaugguacacauacgauucu

SEQ ID NO: 301243 - RNA, 22 nt, Homo sapiens
gagcaccagucccugucagugc

SEQ ID NO: 301244 - RNA, 22 nt, Homo sapiens
gagcccauuucacuuguccagc

SEQ ID NO: 301245 - RNA, 22 nt, Homo sapiens
gagcuagcauuuagacaucugg

SEQ ID NO: 301246 - RNA, 22 nt, Homo sapiens
gagcugaauugcugccauuugc

SEQ ID NO: 301247 - RNA, 20 nt, Homo sapiens
gagcugguguacugccgggc

SEQ ID NO: 301248 - RNA, 22 nt, Homo sapiens
gaggacauuaugcuaaguggaa

SEQ ID NO: 301249 - RNA, 22 nt, Homo sapiens
gaggcggugugaugucacaugc

SEQ ID NO: 301250 - RNA, 22 nt, Homo sapiens
gagguaagaaagucaguccuuc

SEQ ID NO: 301251 - RNA, 22 nt, Homo sapiens
gagguaagagaauaaacaguuu

SEQ ID NO: 301252 - RNA, 22 nt, Homo sapiens
gagguaaguaagaauggcaagc

SEQ ID NO: 301253 - RNA, 22 nt, Homo sapiens
gagguagagaguuuugauucug

SEQ ID NO: 301254 - RNA, 22 nt, Homo sapiens
gagguaguuaaugcauucacua

SEQ ID NO: 301255 - RNA, 22 nt, Homo sapiens
gagguugggaugagggauacag

SEQ ID NO: 301256 - RNA, 22 nt, Homo sapiens
gagugcauaugggccuguguca

SEQ ID NO: 301257 - RNA, 22 nt, Homo sapiens
gaguuagguugucaaugucuua

SEQ ID NO: 301258 - RNA, 22 nt, Homo sapiens
gauauguaguaguugaaaaaga

SEQ ID NO: 301259 - RNA, 22 nt, Homo sapiens
gauauguguaucuauguacaug

SEQ ID NO: 301260 - RNA, 22 nt, Homo sapiens
gaucacaguuccucacgggcau

SEQ ID NO: 301261 - RNA, 22 nt, Homo sapiens
gaucacauguguacucaaugug

SEQ ID NO: 301262 - RNA, 22 nt, Homo sapiens
gaugagaugagcauuugaauug

SEQ ID NO: 301263 - RNA, 22 nt, Homo sapiens
gauggcacuuaagagcaagagc

SEQ ID NO: 301264 - RNA, 22 nt, Homo sapiens
gauggcaugugcugccaccaag

SEQ ID NO: 301265 - RNA, 22 nt, Homo sapiens
gauggcuacugauuaaauauag

SEQ ID NO: 301266 - RNA, 22 nt, Homo sapiens
gaugugaaaucauaguuucuag

SEQ ID NO: 301267 - RNA, 22 nt, Homo sapiens
gauuuugguuagggaaggauac

SEQ ID NO: 301268 - RNA, 21 nt, Homo sapiens
gcaaaguggcuaccuugcucc

SEQ ID NO: 301269 - RNA, 22 nt, Homo sapiens
gcacacuuacacgaaccuagau

SEQ ID NO: 301270 - RNA, 22 nt, Homo sapiens
gcacauauguaaauagcugccu

SEQ ID NO: 301271 - RNA, 22 nt, Homo sapiens
gcacauuacaaguauuagcuca

SEQ ID NO: 301272 - RNA, 22 nt, Homo sapiens
gcaccacugcacucucagcuug

SEQ ID NO: 301273 - RNA, 22 nt, Homo sapiens
gcagagaaacaggucuaaggag

SEQ ID NO: 301274 - RNA, 22 nt, Homo sapiens
gcagaucuucgcgguaaguguu

SEQ ID NO: 301275 - RNA, 22 nt, Homo sapiens
gcagcauuaccaagacauggca

SEQ ID NO: 301276 - RNA, 20 nt, Homo sapiens
gcaguacuuuuaguucuaag

SEQ ID NO: 301277 - RNA, 22 nt, Homo sapiens
gcagucacagggagauggugac

SEQ ID NO: 301278 - RNA, 22 nt, Homo sapiens
gcagugaugugaucauagcuca

SEQ ID NO: 301279 - RNA, 22 nt, Homo sapiens
gcagugugaucacagcuuacug

SEQ ID NO: 301280 - RNA, 22 nt, Homo sapiens
gcagugugauguuuuaaucuau

SEQ ID NO: 301281 - RNA, 22 nt, Homo sapiens
gcauggaaggcgcuuugugacu

SEQ ID NO: 301282 - RNA, 22 nt, Homo sapiens
gcauggagaaggggacugauuc

SEQ ID NO: 301283 - RNA, 22 nt, Homo sapiens
gcauggagcauacauuucuguu

SEQ ID NO: 301284 - RNA, 22 nt, Homo sapiens
gcaugguaguaaccuacauuug

SEQ ID NO: 301285 - RNA, 22 nt, Homo sapiens
gccagugugaugugaucauggc

SEQ ID NO: 301286 - RNA, 22 nt, Homo sapiens
gcccauuguuccuaggcuacaa

SEQ ID NO: 301287 - RNA, 22 nt, Homo sapiens
gccccugagacuugccucgggc

SEQ ID NO: 301288 - RNA, 22 nt, Homo sapiens
gcccuuugugucuggcuggggu

SEQ ID NO: 301289 - RNA, 22 nt, Homo sapiens
gccuagagacuugguaucuugc

SEQ ID NO: 301290 - RNA, 22 nt, Homo sapiens
gccuguagaagaguagaugacc

SEQ ID NO: 301291 - RNA, 22 nt, Homo sapiens
gcgguagcauagacugcaggac

SEQ ID NO: 301292 - RNA, 22 nt, Homo sapiens
gcgguuuuaagugaguuucuua

SEQ ID NO: 301293 - RNA, 22 nt, Homo sapiens
gcugagcuaugccauauaugcc

SEQ ID NO: 301294 - RNA, 22 nt, Homo sapiens
gcugagguucaagaagguuaaa

SEQ ID NO: 301295 - RNA, 17 nt, Homo sapiens
gcugauguuugcauuuu

SEQ ID NO: 301296 - RNA, 22 nt, Homo sapiens
gcugcuguaccagaugugguua

SEQ ID NO: 301297 - RNA, 22 nt, Homo sapiens
gcuggcuuucuccugaucucag

SEQ ID NO: 301298 - RNA, 22 nt, Homo sapiens
gcuggugacuuuaaguugaagc

SEQ ID NO: 301299 - RNA, 22 nt, Homo sapiens
gcugguguucaggcccucaguc

SEQ ID NO: 301300 - RNA, 20 nt, Homo sapiens
gcugugcuuaauacacuuuc

SEQ ID NO: 301301 - RNA, 22 nt, Homo sapiens
gcuuugguucaaccaggcaauu

SEQ ID NO: 301302 - RNA, 22 nt, Homo sapiens
gcuuuguuaaaacacagccaca

SEQ ID NO: 301303 - RNA, 22 nt, Homo sapiens
ggaaaguaacccauucucuuac

SEQ ID NO: 301304 - RNA, 22 nt, Homo sapiens
ggaaaucaucauucucgguaua

SEQ ID NO: 301305 - RNA, 19 nt, Homo sapiens
ggaaaugucuauuaagauc

SEQ ID NO: 301306 - RNA, 22 nt, Homo sapiens
ggaaguauaaacuuaguggagu

SEQ ID NO: 301307 - RNA, 22 nt, Homo sapiens
ggaagugcuguguggaagucug

SEQ ID NO: 301308 - RNA, 22 nt, Homo sapiens
ggaauaguauaaauaccacaaa

SEQ ID NO: 301309 - RNA, 20 nt, Homo sapiens
ggaauagucuacacucugac

SEQ ID NO: 301310 - RNA, 22 nt, Homo sapiens
ggaauguaguaauuugguuagu

SEQ ID NO: 301311 - RNA, 22 nt, Homo sapiens
ggaauguuaaagacuacacuga

SEQ ID NO: 301312 - RNA, 22 nt, Homo sapiens
ggacaaaguauuuucaaaugua

SEQ ID NO: 301313 - RNA, 22 nt, Homo sapiens
ggacauuaacugcaagauagau

SEQ ID NO: 301314 - RNA, 22 nt, Homo sapiens
ggagguaauaaguuccagugua

SEQ ID NO: 301315 - RNA, 22 nt, Homo sapiens
ggagguagguuugugauuugua

SEQ ID NO: 301316 - RNA, 22 nt, Homo sapiens
ggaguaaaagaguaggaggaau

SEQ ID NO: 301317 - RNA, 22 nt, Homo sapiens
ggagugcuguuguuacacaagg

SEQ ID NO: 301318 - RNA, 22 nt, Homo sapiens
ggaucacagagcuugggaaagg

SEQ ID NO: 301319 - RNA, 22 nt, Homo sapiens
ggcaaaauauugucugguauag

SEQ ID NO: 301320 - RNA, 22 nt, Homo sapiens
ggcaaaauggccagugggucac

SEQ ID NO: 301321 - RNA, 21 nt, Homo sapiens
ggcaagagaauacaacauaaa

SEQ ID NO: 301322 - RNA, 22 nt, Homo sapiens
ggcaccacagacgccaggcgug

SEQ ID NO: 301323 - RNA, 22 nt, Homo sapiens
ggcaguguauuacuuaggguuc

SEQ ID NO: 301324 - RNA, 22 nt, Homo sapiens
ggcaugguggugugugccuaua

SEQ ID NO: 301325 - RNA, 22 nt, Homo sapiens
ggcauguuuaguagaauguggu

SEQ ID NO: 301326 - RNA, 22 nt, Homo sapiens
ggcuauagauaugugaacacuu

SEQ ID NO: 301327 - RNA, 21 nt, Homo sapiens
ggcucuguggucucagguuuc

SEQ ID NO: 301328 - RNA, 22 nt, Homo sapiens
gggaagugugcagaguucucuu

SEQ ID NO: 301329 - RNA, 22 nt, Homo sapiens
gggagguaggaguuauuauuuu

SEQ ID NO: 301330 - RNA, 22 nt, Homo sapiens
gggagguagguauuagcuuuuc

SEQ ID NO: 301331 - RNA, 22 nt, Homo sapiens
gggaugaaguugauguagaaag

SEQ ID NO: 301332 - RNA, 20 nt, Homo sapiens
gggaugugagguacacucuu

SEQ ID NO: 301333 - RNA, 22 nt, Homo sapiens
gggcaaaacuguacugccaagg

SEQ ID NO: 301334 - RNA, 22 nt, Homo sapiens
ggggaguguggacaucacccug

SEQ ID NO: 301335 - RNA, 22 nt, Homo sapiens
gguaauguaacugguauucugu

SEQ ID NO: 301336 - RNA, 22 nt, Homo sapiens
uaacuauagagaauguugagua

SEQ ID NO: 301337 - RNA, 22 nt, Homo sapiens
uaacuucaucauaagucaagaa

SEQ ID NO: 301338 - RNA, 22 nt, Homo sapiens
uaagacacuuaaaauguuacau

SEQ ID NO: 301339 - RNA, 22 nt, Homo sapiens
uaaggcaaguuuuuaguggaca

SEQ ID NO: 301340 - RNA, 22 nt, Homo sapiens
uaaggcuuugucuuaggacuuu

SEQ ID NO: 301341 - RNA, 22 nt, Homo sapiens
uaagggacauguguugccuaag

SEQ ID NO: 301342 - RNA, 22 nt, Homo sapiens
uaaguaaaugaaagguugauuu

SEQ ID NO: 301343 - RNA, 22 nt, Homo sapiens
uaaguaguauaagguuuuuuga

SEQ ID NO: 301344 - RNA, 22 nt, Homo sapiens
uaagugacuuugagauuccuca

SEQ ID NO: 301345 - RNA, 22 nt, Homo sapiens
uaagugcuugacuuugauguuu

SEQ ID NO: 301346 - RNA, 22 nt, Homo sapiens
uaauacuugucauaaaggcauu

SEQ ID NO: 301347 - RNA, 22 nt, Homo sapiens
uaauagcucggauaaacaugau

SEQ ID NO: 301348 - RNA, 22 nt, Homo sapiens
uaauaguuucagaaguuguuuu

SEQ ID NO: 301349 - RNA, 21 nt, Homo sapiens
uaauggcaugaucucggcuca

SEQ ID NO: 301350 - RNA, 22 nt, Homo sapiens
uacaaaucuagguuuguuacug

SEQ ID NO: 301351 - RNA, 22 nt, Homo sapiens
uacaagcaggaaaugguauaug

SEQ ID NO: 301352 - RNA, 22 nt, Homo sapiens
uacagccacauaauguaugauu

SEQ ID NO: 301353 - RNA, 22 nt, Homo sapiens
uacaggcagguguucccugguu

SEQ ID NO: 301354 - RNA, 22 nt, Homo sapiens
uacagugcuuuuugguggagaa

SEQ ID NO: 301355 - RNA, 22 nt, Homo sapiens
uacaguguuuugguauuccaca

SEQ ID NO: 301356 - RNA, 19 nt, Homo sapiens
uacauaguauuuaguggca

SEQ ID NO: 301357 - RNA, 19 nt, Homo sapiens
uacaugcagcaggcacgca

SEQ ID NO: 301358 - RNA, 22 nt, Homo sapiens
uacauguauccauuguuuuugg

SEQ ID NO: 301359 - RNA, 22 nt, Homo sapiens
uacaugugccauguugguuugc

SEQ ID NO: 301360 - RNA, 23 nt, Homo sapiens
uaccacauuccuucuuuccuguu

SEQ ID NO: 301361 - RNA, 22 nt, Homo sapiens
uaccacccuuuuuccagaagcc

SEQ ID NO: 301362 - RNA, 22 nt, Homo sapiens
uaccaguaaugguucuagagga

SEQ ID NO: 301363 - RNA, 22 nt, Homo sapiens
uagaaaguagggaagguaggau

SEQ ID NO: 301364 - RNA, 22 nt, Homo sapiens
uagaacauuccaggugauguug

SEQ ID NO: 301365 - RNA, 18 nt, Homo sapiens
uagaauauaggucauucu

SEQ ID NO: 301366 - RNA, 22 nt, Homo sapiens
uagaccauucuauuuccuaugc

SEQ ID NO: 301367 - RNA, 20 nt, Homo sapiens
uagagagauauggggguucc

SEQ ID NO: 301368 - RNA, 22 nt, Homo sapiens
uagagguauuaacaguagaaga

SEQ ID NO: 301369 - RNA, 22 nt, Homo sapiens
uagaucaacuuugguaagagaa

SEQ ID NO: 301370 - RNA, 22 nt, Homo sapiens
uagauuaucucaccacucgagu

SEQ ID NO: 301371 - RNA, 22 nt, Homo sapiens
uagcacaguucacccucgauuu

SEQ ID NO: 301372 - RNA, 22 nt, Homo sapiens
uagcagcauaaauggacuaaga

SEQ ID NO: 301373 - RNA, 19 nt, Homo sapiens
uagcagcaugauuuauaau

SEQ ID NO: 301374 - RNA, 22 nt, Homo sapiens
uagcagcuuuauugagguaaau

SEQ ID NO: 301375 - RNA, 22 nt, Homo sapiens
uagcaggaaaccuguguugagg

SEQ ID NO: 301376 - RNA, 22 nt, Homo sapiens
uagcaguaagaaacugacauug

SEQ ID NO: 301377 - RNA, 22 nt, Homo sapiens
uagcaguauaugagagcuauug

SEQ ID NO: 301378 - RNA, 21 nt, Homo sapiens
uagcucagugguguugccaua

SEQ ID NO: 301379 - RNA, 22 nt, Homo sapiens
uagcugaucuuuuaaagaauga

SEQ ID NO: 301380 - RNA, 22 nt, Homo sapiens
uaggcacugagaauaugaggau

SEQ ID NO: 301381 - RNA, 22 nt, Homo sapiens
uagggaguuuuggggugcagaa

SEQ ID NO: 301382 - RNA, 22 nt, Homo sapiens
uagggcuuuccggccugucaga

SEQ ID NO: 301383 - RNA, 22 nt, Homo sapiens
uagggcuuuuccaagcugccac

SEQ ID NO: 301384 - RNA, 22 nt, Homo sapiens
uagguaguuacacagcaaugua

SEQ ID NO: 301385 - RNA, 22 nt, Homo sapiens
uagguaucuuuauagcaguagc

SEQ ID NO: 301386 - RNA, 22 nt, Homo sapiens
uaggucaguuuuggcuuggcuu

SEQ ID NO: 301387 - RNA, 23 nt, Homo sapiens
uagguuauuugguaaauauaugu

SEQ ID NO: 301388 - RNA, 22 nt, Homo sapiens
uaguccauuuucaugcugcuau

SEQ ID NO: 301389 - RNA, 22 nt, Homo sapiens
uagugcaguggcuccaucucag

SEQ ID NO: 301390 - RNA, 20 nt, Homo sapiens
uaguggcaugcaccuguagc

SEQ ID NO: 301391 - RNA, 21 nt, Homo sapiens
uauaccuagaagagggauugc

SEQ ID NO: 301392 - RNA, 22 nt, Homo sapiens
uauagcuagugauuguguguau

SEQ ID NO: 301393 - RNA, 22 nt, Homo sapiens
uauaucacaugcacucauuuuc

SEQ ID NO: 301394 - RNA, 22 nt, Homo sapiens
uauaugcacucagguguaugug

SEQ ID NO: 301395 - RNA, 22 nt, Homo sapiens
uaucacagcaaggacccauuau

SEQ ID NO: 301396 - RNA, 22 nt, Homo sapiens
uaucacagcauugucuauaaua

SEQ ID NO: 301397 - RNA, 22 nt, Homo sapiens
uaucacagguggacugcacacc

SEQ ID NO: 301398 - RNA, 20 nt, Homo sapiens
uaucacauggggagaaaccu

SEQ ID NO: 301399 - RNA, 21 nt, Homo sapiens
uaucacauuggugauuaaguu

SEQ ID NO: 301400 - RNA, 22 nt, Homo sapiens
uaucagcacaguggguucaugg

SEQ ID NO: 301401 - RNA, 22 nt, Homo sapiens
uaucauggggacugcagccuag

SEQ ID NO: 301402 - RNA, 22 nt, Homo sapiens
uaucucauccuccuugauccca

SEQ ID NO: 301403 - RNA, 22 nt, Homo sapiens
uaugaucauuauguuauugcag

SEQ ID NO: 301404 - RNA, 22 nt, Homo sapiens
uaugccuuuugguucaagcaac

SEQ ID NO: 301405 - RNA, 22 nt, Homo sapiens
uauggcuucuauaaggaagcuu

SEQ ID NO: 301406 - RNA, 22 nt, Homo sapiens
uauggcuuucuacuugaguucu

SEQ ID NO: 301407 - RNA, 22 nt, Homo sapiens
uauggcuuuguuaacauuuucu

SEQ ID NO: 301408 - RNA, 22 nt, Homo sapiens
uauggcuuuuauuauguuguag

SEQ ID NO: 301409 - RNA, 22 nt, Homo sapiens
uaugguuuuaagguuaaggacu

SEQ ID NO: 301410 - RNA, 22 nt, Homo sapiens
uaugguuuucucuuacguguug

SEQ ID NO: 301411 - RNA, 22 nt, Homo sapiens
uaugucacuugguuuggugcua

SEQ ID NO: 301412 - RNA, 22 nt, Homo sapiens
uauucaagccaaauucaagcca

SEQ ID NO: 301413 - RNA, 22 nt, Homo sapiens
uauucacuguaucauugauggg

SEQ ID NO: 301414 - RNA, 22 nt, Homo sapiens
uauuccauuugggucaggauga

SEQ ID NO: 301415 - RNA, 22 nt, Homo sapiens
uauugauuaauugugauuaggc

SEQ ID NO: 301416 - RNA, 22 nt, Homo sapiens
uauugcaauuggggaaacuggg

SEQ ID NO: 301417 - RNA, 22 nt, Homo sapiens
uauugcauauuauucuaguggc

SEQ ID NO: 301418 - RNA, 22 nt, Homo sapiens
uauugcuacuuugccuuccaaa

SEQ ID NO: 301419 - RNA, 22 nt, Homo sapiens
uauugcucugacugauuggaug

SEQ ID NO: 301420 - RNA, 18 nt, Homo sapiens
uauugcuugguuuggaga

SEQ ID NO: 301421 - RNA, 22 nt, Homo sapiens
uauugcuuuacucucuuauccu

SEQ ID NO: 301422 - RNA, 22 nt, Homo sapiens
uauugcuuuuaacccaaucucu

SEQ ID NO: 301423 - RNA, 22 nt, Homo sapiens
uauuucaguugcguuucccgag

SEQ ID NO: 301424 - RNA, 22 nt, Homo sapiens
uauuugauugacuuuagcagga

SEQ ID NO: 301425 - RNA, 22 nt, Homo sapiens
ucaaaguaaagccucaggaugg

SEQ ID NO: 301426 - RNA, 22 nt, Homo sapiens
ucaaaguauucuucugagaacc

SEQ ID NO: 301427 - RNA, 22 nt, Homo sapiens
ucaaagucuucucaaguaacau

SEQ ID NO: 301428 - RNA, 21 nt, Homo sapiens
ucaaaguguucuuuuguugaa

SEQ ID NO: 301429 - RNA, 22 nt, Homo sapiens
ucaacaggucaauugcauagaa

SEQ ID NO: 301430 - RNA, 22 nt, Homo sapiens
ucaacauugcugucaggcaucu

SEQ ID NO: 301431 - RNA, 21 nt, Homo sapiens
ucaacccuugcgucaccaagc

SEQ ID NO: 301432 - RNA, 22 nt, Homo sapiens
ucaagcaauucgccugucucag

SEQ ID NO: 301433 - RNA, 22 nt, Homo sapiens
ucaaggcacuagcugagcugca

SEQ ID NO: 301434 - RNA, 22 nt, Homo sapiens
ucaaguaauacucccaucuugg

SEQ ID NO: 301435 - RNA, 22 nt, Homo sapiens
ucacaaggcaggaaugaaaggg

SEQ ID NO: 301436 - RNA, 22 nt, Homo sapiens
ucacagucaaaguaaucauaga

SEQ ID NO: 301437 - RNA, 22 nt, Homo sapiens
ucacagucacugucacguugaa

SEQ ID NO: 301438 - RNA, 22 nt, Homo sapiens
ucacaguccuguuuaggagagg

SEQ ID NO: 301439 - RNA, 22 nt, Homo sapiens
uggcaguuuuugccuucaauac

SEQ ID NO: 301440 - RNA, 20 nt, Homo sapiens
uggcaugaaauuuuccaagc

SEQ ID NO: 301441 - RNA, 22 nt, Homo sapiens
uggcauggaguggauggcccca

SEQ ID NO: 301442 - RNA, 22 nt, Homo sapiens
uggcauuuuguuuuagaauuag

SEQ ID NO: 301443 - RNA, 22 nt, Homo sapiens
uggcuacugacugaugauuaua

SEQ ID NO: 301444 - RNA, 22 nt, Homo sapiens
uggcucuuucuagacuuaauua

SEQ ID NO: 301445 - RNA, 20 nt, Homo sapiens
uggcucuuugcugcuaaagu

SEQ ID NO: 301446 - RNA, 22 nt, Homo sapiens
uggcuuucuggggcuucuguuc

SEQ ID NO: 301447 - RNA, 22 nt, Homo sapiens
uggcuuuguaagguuucauuuu

SEQ ID NO: 301448 - RNA, 22 nt, Homo sapiens
uggcuuuuguuauuuggaagcu

SEQ ID NO: 301449 - RNA, 22 nt, Homo sapiens
ugggaaacauccagcacauacu

SEQ ID NO: 301450 - RNA, 22 nt, Homo sapiens
ugggaagagggagcgauuuugg

SEQ ID NO: 301451 - RNA, 22 nt, Homo sapiens
ugggaagaugcugcuucuuccu

SEQ ID NO: 301452 - RNA, 22 nt, Homo sapiens
ugggaagcugcugaacuacagu

SEQ ID NO: 301453 - RNA, 22 nt, Homo sapiens
ugggagcauugcauuagaagcc

SEQ ID NO: 301454 - RNA, 22 nt, Homo sapiens
ugggaucaugagcaccgcuucc

SEQ ID NO: 301455 - RNA, 22 nt, Homo sapiens
ugggaucauuaugcauagugua

SEQ ID NO: 301456 - RNA, 22 nt, Homo sapiens
ugggaucauucaaugacgaaau

SEQ ID NO: 301457 - RNA, 22 nt, Homo sapiens
ugggaugaugaaaaggcuuucu

SEQ ID NO: 301458 - RNA, 22 nt, Homo sapiens
ugggcaagagagcaugacccug

SEQ ID NO: 301459 - RNA, 22 nt, Homo sapiens
ugggcaguauggucauuuucgu

SEQ ID NO: 301460 - RNA, 23 nt, Homo sapiens
uggguucauucuugaagucagug

SEQ ID NO: 301461 - RNA, 22 nt, Homo sapiens
ugguacuucaugcucacagaua

SEQ ID NO: 301462 - RNA, 21 nt, Homo sapiens
uggucccauaagauuacaaug

SEQ ID NO: 301463 - RNA, 22 nt, Homo sapiens
uguaaaaagcccagccgcugag

SEQ ID NO: 301464 - RNA, 22 nt, Homo sapiens
uguaugaguuguuuauaaauuu

SEQ ID NO: 301465 - RNA, 22 nt, Homo sapiens
ugucaaacauuaugaugcucua

SEQ ID NO: 301466 - RNA, 22 nt, Homo sapiens
ugucaacauuuaucaaguuauu

SEQ ID NO: 301467 - RNA, 21 nt, Homo sapiens
ugucaagugggaaaacaugua

SEQ ID NO: 301468 - RNA, 22 nt, Homo sapiens
ugucaaugggaauuuguuuuag

SEQ ID NO: 301469 - RNA, 22 nt, Homo sapiens
ugucacauccaagaaggugcag

SEQ ID NO: 301470 - RNA, 22 nt, Homo sapiens
ugucaguggucuggaugcagcc

SEQ ID NO: 301471 - RNA, 22 nt, Homo sapiens
ugucaguuucuugagauggaac

SEQ ID NO: 301472 - RNA, 22 nt, Homo sapiens
ugucauggcauuuguaaacugc

SEQ ID NO: 301473 - RNA, 22 nt, Homo sapiens
uguccaaauugaaucaucuggu

SEQ ID NO: 301474 - RNA, 20 nt, Homo sapiens
ugucccaaccccauggguuc

SEQ ID NO: 301475 - RNA, 22 nt, Homo sapiens
ugucuugagagaggacaugacu

SEQ ID NO: 301476 - RNA, 22 nt, Homo sapiens
ugugaaauguuaucccgucgug

SEQ ID NO: 301477 - RNA, 22 nt, Homo sapiens
ugugaacagaauuagucaccua

SEQ ID NO: 301478 - RNA, 22 nt, Homo sapiens
ugugaagauggacuaauauagu

SEQ ID NO: 301479 - RNA, 22 nt, Homo sapiens
ugugaauggugcugccgugaag

SEQ ID NO: 301480 - RNA, 22 nt, Homo sapiens
ugugaauggugcuuccuagaug

SEQ ID NO: 301481 - RNA, 22 nt, Homo sapiens
ugugacagguauccuguguucu

SEQ ID NO: 301482 - RNA, 22 nt, Homo sapiens
ugugaucaugguauuaaucugc

SEQ ID NO: 301483 - RNA, 22 nt, Homo sapiens
ugugaugauuugauaaacguau

SEQ ID NO: 301484 - RNA, 22 nt, Homo sapiens
ugugccacuccaggaggcuguu

SEQ ID NO: 301485 - RNA, 22 nt, Homo sapiens
ugugcuaauacauacagugcua

SEQ ID NO: 301486 - RNA, 22 nt, Homo sapiens
ugugcugaucgggcacgguguc

SEQ ID NO: 301487 - RNA, 22 nt, Homo sapiens
ugugcuugcuucuucuccuagu

SEQ ID NO: 301488 - RNA, 22 nt, Homo sapiens
uguggcauugaauaaccuugga

SEQ ID NO: 301489 - RNA, 22 nt, Homo sapiens
uguggcuuuuucuuggcugagg

SEQ ID NO: 301490 - RNA, 22 nt, Homo sapiens
uguggucaucacuugaagguaa

SEQ ID NO: 301491 - RNA, 22 nt, Homo sapiens
ugugguuuuaguaaaacuaugu

SEQ ID NO: 301492 - RNA, 22 nt, Homo sapiens
ugugguuuuuuucuccaauagg

SEQ ID NO: 301493 - RNA, 22 nt, Homo sapiens
uguguaaauauauacacacgug

SEQ ID NO: 301494 - RNA, 22 nt, Homo sapiens
ugugucuuguuuauagcuuucu

SEQ ID NO: 301495 - RNA, 22 nt, Homo sapiens
uguuacagcagcacaaaaugga

SEQ ID NO: 301496 - RNA, 22 nt, Homo sapiens
uguucacaguguuucuuugaga

SEQ ID NO: 301497 - RNA, 22 nt, Homo sapiens
uguucauggauccaguggcuuc

SEQ ID NO: 301498 - RNA, 22 nt, Homo sapiens
uguugcacuccagccugggcaa

SEQ ID NO: 301499 - RNA, 22 nt, Homo sapiens
uguugcacuccauccugggcga

SEQ ID NO: 301500 - RNA, 22 nt, Homo sapiens
uguuuaguuaagacauagaauu

SEQ ID NO: 301501 - RNA, 21 nt, Homo sapiens
uguuuuugcuguguaucucuc

SEQ ID NO: 301502 - RNA, 22 nt, Homo sapiens
uuaaagccauaccugagagagu

SEQ ID NO: 301503 - RNA, 22 nt, Homo sapiens
uuaaaugcauagaauguguagu

SEQ ID NO: 301504 - RNA, 22 nt, Homo sapiens
uuaaaugucuguagaugugcug

SEQ ID NO: 301505 - RNA, 21 nt, Homo sapiens
uuaacagacaagugucuuccc

SEQ ID NO: 301506 - RNA, 22 nt, Homo sapiens
uuaagagugggaguuggccaca

SEQ ID NO: 301507 - RNA, 22 nt, Homo sapiens
uuaaggaaggagucuuaaaugg

SEQ ID NO: 301508 - RNA, 22 nt, Homo sapiens
uuaagugaauuaucuaacaugu

SEQ ID NO: 301509 - RNA, 19 nt, Homo sapiens
uuaagugugauaucucagu

SEQ ID NO: 301510 - RNA, 22 nt, Homo sapiens
uuaaguuaggcuucagcagucu

SEQ ID NO: 301511 - RNA, 22 nt, Homo sapiens
uuaauacugcuuaacuuuagga

SEQ ID NO: 301512 - RNA, 22 nt, Homo sapiens
uuaauuguccauuauucuguuc

SEQ ID NO: 301513 - RNA, 22 nt, Homo sapiens
uuacaggacuaagcagcuuugc

SEQ ID NO: 301514 - RNA, 22 nt, Homo sapiens
uuacagucucaagagugcugca

SEQ ID NO: 301515 - RNA, 22 nt, Homo sapiens
uuacagucuuaggcagugcuuu

SEQ ID NO: 301516 - RNA, 23 nt, Homo sapiens
uuacaguggcaugaucucugcuc

SEQ ID NO: 301517 - RNA, 22 nt, Homo sapiens
uuacaugucuugguaagguuag

SEQ ID NO: 301518 - RNA, 22 nt, Homo sapiens
uuacauguggugugaagaagag

SEQ ID NO: 301519 - RNA, 22 nt, Homo sapiens
uuacuguagugucauaucguau

SEQ ID NO: 301520 - RNA, 22 nt, Homo sapiens
uuagagguaggauuucaccaug

SEQ ID NO: 301521 - RNA, 22 nt, Homo sapiens
uuagcagugugagcacagacua

SEQ ID NO: 301522 - RNA, 22 nt, Homo sapiens
uuagugaaugcaccacuucuga

SEQ ID NO: 301523 - RNA, 22 nt, Homo sapiens
uuagugcaaacucuucaaugcu

SEQ ID NO: 301524 - RNA, 21 nt, Homo sapiens
uuagugcucaguuugacaaaa

SEQ ID NO: 301525 - RNA, 19 nt, Homo sapiens
uuauacuguauuguuuagg

SEQ ID NO: 301526 - RNA, 22 nt, Homo sapiens
uuauagacacguuguaacaaac

SEQ ID NO: 301527 - RNA, 22 nt, Homo sapiens
uuauagcagugcaggaacagac

SEQ ID NO: 301528 - RNA, 22 nt, Homo sapiens
uuauagcagugcccaacuccug

SEQ ID NO: 301529 - RNA, 22 nt, Homo sapiens
uuauagcuaacaucugugaaaa

SEQ ID NO: 301530 - RNA, 22 nt, Homo sapiens
uuaugacauugacaguuuuuag

SEQ ID NO: 301531 - RNA, 22 nt, Homo sapiens
uuaugcuugugugaauuuuccc

SEQ ID NO: 301532 - RNA, 22 nt, Homo sapiens
uuaugggucuuggaaugcaaua

SEQ ID NO: 301533 - RNA, 22 nt, Homo sapiens
uuaugucuuuuguguucagcua

SEQ ID NO: 301534 - RNA, 22 nt, Homo sapiens
uuauucauuaauugcuaagguu

SEQ ID NO: 301535 - RNA, 22 nt, Homo sapiens
uuauugaguaaaaagaaugguu

SEQ ID NO: 301536 - RNA, 22 nt, Homo sapiens
uuauuguccaaguuucccuuug

SEQ ID NO: 301537 - RNA, 22 nt, Homo sapiens
uucaaaguguugguuuugggcu

SEQ ID NO: 301538 - RNA, 22 nt, Homo sapiens
uucaaguaagaaagacaucagg

SEQ ID NO: 301539 - RNA, 22 nt, Homo sapiens
uucaagugguucagaagucuga

SEQ ID NO: 301540 - RNA, 22 nt, Homo sapiens
uucacagaguuauuuuuaugcu

SEQ ID NO: 301541 - RNA, 19 nt, Homo sapiens
uucacguaggagaaagaag

SEQ ID NO: 301542 - RNA, 22 nt, Homo sapiens
ucuuuuguucuauucaggccuu

SEQ ID NO: 301543 - RNA, 22 nt, Homo sapiens
ugaaaaguuguugaaggcuuca

SEQ ID NO: 301544 - RNA, 22 nt, Homo sapiens
ugaaacugcagugggcuuggca

SEQ ID NO: 301545 - RNA, 22 nt, Homo sapiens
ugaaagacugaaagcuuuucuu

SEQ ID NO: 301546 - RNA, 22 nt, Homo sapiens
ugaaagguauagguucuggagg

SEQ ID NO: 301547 - RNA, 22 nt, Homo sapiens
ugaaaugccuugagauuuugac

SEQ ID NO: 301548 - RNA, 22 nt, Homo sapiens
ugaaaugguuaugugaggagau

SEQ ID NO: 301549 - RNA, 22 nt, Homo sapiens
ugaaauuauucuuaccaaggug

SEQ ID NO: 301550 - RNA, 22 nt, Homo sapiens
ugaacagcaccuccuagaguug

SEQ ID NO: 301551 - RNA, 22 nt, Homo sapiens
ugaacuguaagguauaggugau

SEQ ID NO: 301552 - RNA, 22 nt, Homo sapiens
ugaagaucuuaggagcugaggg

SEQ ID NO: 301553 - RNA, 22 nt, Homo sapiens
ugaaggacauucuaugguagau

SEQ ID NO: 301554 - RNA, 22 nt, Homo sapiens
ugaagggcauuguuuugccaaa

SEQ ID NO: 301555 - RNA, 22 nt, Homo sapiens
ugaaguaauguuuuauucuauu

SEQ ID NO: 301556 - RNA, 22 nt, Homo sapiens
ugaauacuucaaaaaaauagcu

SEQ ID NO: 301557 - RNA, 22 nt, Homo sapiens
ugaauaguaauguguuuggucu

SEQ ID NO: 301558 - RNA, 22 nt, Homo sapiens
ugaauauuugcuacucacucuu

SEQ ID NO: 301559 - RNA, 22 nt, Homo sapiens
ugaauguaacuaaaggacuuuu

SEQ ID NO: 301560 - RNA, 22 nt, Homo sapiens
ugaauguaagaugucugcuggu

SEQ ID NO: 301561 - RNA, 22 nt, Homo sapiens
ugaauguucuuaaaacccuugu

SEQ ID NO: 301562 - RNA, 22 nt, Homo sapiens
ugacaagaaagcgucuucuuuu

SEQ ID NO: 301563 - RNA, 22 nt, Homo sapiens
ugacaagacuacauaucccauu

SEQ ID NO: 301564 - RNA, 22 nt, Homo sapiens
ugacaagauauggucuuaucaa

SEQ ID NO: 301565 - RNA, 22 nt, Homo sapiens
ugacagcuguugaggcauuuau

SEQ ID NO: 301566 - RNA, 22 nt, Homo sapiens
ugacaggauggagaucgguauu

SEQ ID NO: 301567 - RNA, 22 nt, Homo sapiens
ugacagguugauaggugcagca

SEQ ID NO: 301568 - RNA, 22 nt, Homo sapiens
ugacaguaucuacagcuucuua

SEQ ID NO: 301569 - RNA, 22 nt, Homo sapiens
ugacagugaacagguuaccacu

SEQ ID NO: 301570 - RNA, 22 nt, Homo sapiens
ugacaguguccuccuccugaga

SEQ ID NO: 301571 - RNA, 22 nt, Homo sapiens
ugacauagcuauuaagugaugc

SEQ ID NO: 301572 - RNA, 22 nt, Homo sapiens
ugacaugagauuugggaggggc

SEQ ID NO: 301573 - RNA, 22 nt, Homo sapiens
ugaccacugucuaagauaggug

SEQ ID NO: 301574 - RNA, 22 nt, Homo sapiens
ugacuauaggauaacaugcauu

SEQ ID NO: 301575 - RNA, 22 nt, Homo sapiens
ugacucaguuucucagguagua

SEQ ID NO: 301576 - RNA, 22 nt, Homo sapiens
ugacucuagagcugccuguggc

SEQ ID NO: 301577 - RNA, 22 nt, Homo sapiens
ugagaacaugugauauuuggug

SEQ ID NO: 301578 - RNA, 19 nt, Homo sapiens
ugagaacaugugguauuug

SEQ ID NO: 301579 - RNA, 22 nt, Homo sapiens
ugagaaccucugugugcccacu

SEQ ID NO: 301580 - RNA, 22 nt, Homo sapiens
ugagaauauuuuccaugucuca

SEQ ID NO: 301581 - RNA, 22 nt, Homo sapiens
ugagaauguagggcucucccag

SEQ ID NO: 301582 - RNA, 22 nt, Homo sapiens
ugagacaaaguuguuggauguu

SEQ ID NO: 301583 - RNA, 22 nt, Homo sapiens
ugagacaaucucaucucaguga

SEQ ID NO: 301584 - RNA, 22 nt, Homo sapiens
ugagacaucugagauuuuaagc

SEQ ID NO: 301585 - RNA, 22 nt, Homo sapiens
ugagacaugugaacuguaguuc

SEQ ID NO: 301586 - RNA, 22 nt, Homo sapiens
ugagacgaagucucguucugua

SEQ ID NO: 301587 - RNA, 22 nt, Homo sapiens
ugagacggagucucacucuguu

SEQ ID NO: 301588 - RNA, 22 nt, Homo sapiens
ugagacggagucucgcucuguc

SEQ ID NO: 301589 - RNA, 22 nt, Homo sapiens
ugagacugguaauguguagggc

SEQ ID NO: 301590 - RNA, 22 nt, Homo sapiens
ugagagcugguuguuuaaagga

SEQ ID NO: 301591 - RNA, 22 nt, Homo sapiens
ugagagcuuuuuugccugguga

SEQ ID NO: 301592 - RNA, 23 nt, Homo sapiens
ugagaucuacagaucucagaucu

SEQ ID NO: 301593 - RNA, 22 nt, Homo sapiens
ugagaucuuggaggcuuuguga

SEQ ID NO: 301594 - RNA, 22 nt, Homo sapiens
ugagaugaaagcagaaagacuu

SEQ ID NO: 301595 - RNA, 22 nt, Homo sapiens
ugagaugaacuugauuguuuua

SEQ ID NO: 301596 - RNA, 19 nt, Homo sapiens
ugagaugaagacagggguu

SEQ ID NO: 301597 - RNA, 22 nt, Homo sapiens
ugagaugaguucucgcucuguc

SEQ ID NO: 301598 - RNA, 22 nt, Homo sapiens
ugagaugauaucuuauuguaau

SEQ ID NO: 301599 - RNA, 22 nt, Homo sapiens
ugagaugcaaaaugagaauugu

SEQ ID NO: 301600 - RNA, 22 nt, Homo sapiens
ugagauggaguuucacuuuugu

SEQ ID NO: 301601 - RNA, 22 nt, Homo sapiens
ugagaugugaagaucacaugaa

SEQ ID NO: 301602 - RNA, 21 nt, Homo sapiens
ugagaugugaccagggcauca

SEQ ID NO: 301603 - RNA, 22 nt, Homo sapiens
ugagaugugaucaccugaaggg

SEQ ID NO: 301604 - RNA, 22 nt, Homo sapiens
ugagaugugugcauucaacuca

SEQ ID NO: 301605 - RNA, 21 nt, Homo sapiens
ugagauuaaguuguuuagaag

SEQ ID NO: 301606 - RNA, 22 nt, Homo sapiens
ugagauuaaucuuuaaguaaga

SEQ ID NO: 301607 - RNA, 22 nt, Homo sapiens
ugagcagaguuguuucuccuga

SEQ ID NO: 301608 - RNA, 22 nt, Homo sapiens
ugagcaucauucacaccuuggu

SEQ ID NO: 301609 - RNA, 22 nt, Homo sapiens
ugagcuacuacacccagcuugg

SEQ ID NO: 301610 - RNA, 22 nt, Homo sapiens
ugagcuagggccuggaauaggg

SEQ ID NO: 301611 - RNA, 20 nt, Homo sapiens
ugagcuuguaaacacuguuu

SEQ ID NO: 301612 - RNA, 22 nt, Homo sapiens
ugaggaaugaccccgugugguc

SEQ ID NO: 301613 - RNA, 22 nt, Homo sapiens
ugaggaauguguguuaaagaua

SEQ ID NO: 301614 - RNA, 22 nt, Homo sapiens
ugagguugaaggacauuuuuau

SEQ ID NO: 301615 - RNA, 22 nt, Homo sapiens
ugaguaggauugguauuucuuc

SEQ ID NO: 301616 - RNA, 23 nt, Homo sapiens
ugaguaggcaguuuuccccucac

SEQ ID NO: 301617 - RNA, 23 nt, Homo sapiens
ugauaacagcauaugaagauucu

SEQ ID NO: 301618 - RNA, 22 nt, Homo sapiens
ugauagugccuuuuauaucucu

SEQ ID NO: 301619 - RNA, 22 nt, Homo sapiens
ugauaucugaauagauacacaa

SEQ ID NO: 301620 - RNA, 22 nt, Homo sapiens
ugauauguuagaaucuugcaag

SEQ ID NO: 301621 - RNA, 22 nt, Homo sapiens
cugccuaaagaaaaagacguug

SEQ ID NO: 301622 - RNA, 22 nt, Homo sapiens
cugcuauauugguucaggcuug

SEQ ID NO: 301623 - RNA, 22 nt, Homo sapiens
cugcuggucuuuaaggucuagg

SEQ ID NO: 301624 - RNA, 22 nt, Homo sapiens
cuggaaagcaaguccauugcuc

SEQ ID NO: 301625 - RNA, 22 nt, Homo sapiens
cuggagcauugguggauuuguu

SEQ ID NO: 301626 - RNA, 22 nt, Homo sapiens
cuggauagucaggagauauaua

SEQ ID NO: 301627 - RNA, 22 nt, Homo sapiens
cuggcucauuucauuuagcaua

SEQ ID NO: 301628 - RNA, 22 nt, Homo sapiens
cugggaucaguucuagucagaa

SEQ ID NO: 301629 - RNA, 22 nt, Homo sapiens
cugggaugauguaaauaggcua

SEQ ID NO: 301630 - RNA, 21 nt, Homo sapiens
cugguguuagcacuucuuccc

SEQ ID NO: 301631 - RNA, 23 nt, Homo sapiens
cuguacacauauacaucuaagua

SEQ ID NO: 301632 - RNA, 22 nt, Homo sapiens
cugucuaugagccaggaagcca

SEQ ID NO: 301633 - RNA, 22 nt, Homo sapiens
cugugcaaguuauaggccaggu

SEQ ID NO: 301634 - RNA, 22 nt, Homo sapiens
cuguucaaauuguuugugaagu

SEQ ID NO: 301635 - RNA, 22 nt, Homo sapiens
cuguugcaguuauggcugcagg

SEQ ID NO: 301636 - RNA, 22 nt, Homo sapiens
cuuagcaugucagcaccggguu

SEQ ID NO: 301637 - RNA, 22 nt, Homo sapiens
cuucaaaguuggcuaggagaca

SEQ ID NO: 301638 - RNA, 18 nt, Homo sapiens
cuucauugcuguuuugcu

SEQ ID NO: 301639 - RNA, 22 nt, Homo sapiens
cuuccaguggcagccgggcaug

SEQ ID NO: 301640 - RNA, 22 nt, Homo sapiens
cuuccauaguauuuuuacaaaa

SEQ ID NO: 301641 - RNA, 22 nt, Homo sapiens
cuuccauaguuacacccaggga

SEQ ID NO: 301642 - RNA, 22 nt, Homo sapiens
cuucucagugcucaucuuauuu

SEQ ID NO: 301643 - RNA, 22 nt, Homo sapiens
cuucuugagacuuaggcuuugg

SEQ ID NO: 301644 - RNA, 22 nt, Homo sapiens
cuucuugagggccugcugggaa

SEQ ID NO: 301645 - RNA, 22 nt, Homo sapiens
cuugaacaaagagauuccauua

SEQ ID NO: 301646 - RNA, 22 nt, Homo sapiens
cuugacacugguuuucugaaua

SEQ ID NO: 301647 - RNA, 23 nt, Homo sapiens
cuugagacaaaugcgugugugca

SEQ ID NO: 301648 - RNA, 22 nt, Homo sapiens
cuugagacauuguuuuccaagu

SEQ ID NO: 301649 - RNA, 22 nt, Homo sapiens
cuugccuacucacugguuuacu

SEQ ID NO: 301650 - RNA, 20 nt, Homo sapiens
cuuggcuuucuugguguuaa

SEQ ID NO: 301651 - RNA, 22 nt, Homo sapiens
cuugucacuguuggcuuuagaa

SEQ ID NO: 301652 - RNA, 22 nt, Homo sapiens
cuuguggugcuuuuacgugggc

SEQ ID NO: 301653 - RNA, 22 nt, Homo sapiens
cuuuagcaaggauauggggaug

SEQ ID NO: 301654 - RNA, 22 nt, Homo sapiens
cuuuagcaauugauuaugccau

SEQ ID NO: 301655 - RNA, 22 nt, Homo sapiens
cuuuggcauuagccuguauaga

SEQ ID NO: 301656 - RNA, 22 nt, Homo sapiens
cuuuggucaauugcugcgggga

SEQ ID NO: 301657 - RNA, 22 nt, Homo sapiens
cuuugguuaauaggauauggca

SEQ ID NO: 301658 - RNA, 23 nt, Homo sapiens
cuuuguccccacccaaaucucau

SEQ ID NO: 301659 - RNA, 22 nt, Homo sapiens
cuuugugcccuucugcccauca

SEQ ID NO: 301660 - RNA, 22 nt, Homo sapiens
cuuuguggggucuuuccucaaa

SEQ ID NO: 301661 - RNA, 22 nt, Homo sapiens
cuuuuacacuguuggcaggauu

SEQ ID NO: 301662 - RNA, 22 nt, Homo sapiens
cuuuuacacuguuggugggaau

SEQ ID NO: 301663 - RNA, 22 nt, Homo sapiens
cuuuuggcuuagaauugucuug

SEQ ID NO: 301664 - RNA, 22 nt, Homo sapiens
cuuuuguggaucuucuguugcu

SEQ ID NO: 301665 - RNA, 22 nt, Homo sapiens
auacaaggaaugaagagauuug

SEQ ID NO: 301666 - RNA, 22 nt, Homo sapiens
auacaagugccauguuggugug

SEQ ID NO: 301667 - RNA, 22 nt, Homo sapiens
auacaaguuauuugaacugcgg

SEQ ID NO: 301668 - RNA, 22 nt, Homo sapiens
auacacauuccugggccucacc

SEQ ID NO: 301669 - RNA, 22 nt, Homo sapiens
auacagugaauacuuacagugu

SEQ ID NO: 301670 - RNA, 22 nt, Homo sapiens
auacagugaauaucuggggcag

SEQ ID NO: 301671 - RNA, 22 nt, Homo sapiens
auacaguguauguauaguacau

SEQ ID NO: 301672 - RNA, 22 nt, Homo sapiens
auacaguugccauuucuugugc

SEQ ID NO: 301673 - RNA, 22 nt, Homo sapiens
auacaugugcaggucagguuac

SEQ ID NO: 301674 - RNA, 22 nt, Homo sapiens
auacaugugucauguugguuug

SEQ ID NO: 301675 - RNA, 22 nt, Homo sapiens
auagaauguaauguaccuccuu

SEQ ID NO: 301676 - RNA, 22 nt, Homo sapiens
auagaauguauuaguaaauuug

SEQ ID NO: 301677 - RNA, 22 nt, Homo sapiens
auagacugaguggcuuaaacca

SEQ ID NO: 301678 - RNA, 22 nt, Homo sapiens
auagaguccugcucgaguugcu

SEQ ID NO: 301679 - RNA, 22 nt, Homo sapiens
auaggagcacgaacucuagugu

SEQ ID NO: 301680 - RNA, 19 nt, Homo sapiens
auagggcuagcauauacug

SEQ ID NO: 301681 - RNA, 22 nt, Homo sapiens
auagucaguagucucauaauga

SEQ ID NO: 301682 - RNA, 22 nt, Homo sapiens
auagugaacuuugugagaacaa

SEQ ID NO: 301683 - RNA, 22 nt, Homo sapiens
auauagcucuggcuggaugacu

SEQ ID NO: 301684 - RNA, 22 nt, Homo sapiens
auaucacaggaaaggaagauac

SEQ ID NO: 301685 - RNA, 22 nt, Homo sapiens
auauccaugccauagguuuuga

SEQ ID NO: 301686 - RNA, 22 nt, Homo sapiens
auaugcauacauguaugcagga

SEQ ID NO: 301687 - RNA, 22 nt, Homo sapiens
auaugucuguuuagucuguaau

SEQ ID NO: 301688 - RNA, 22 nt, Homo sapiens
auauuacagagaggaccuggga

SEQ ID NO: 301689 - RNA, 22 nt, Homo sapiens
auauucacagguaucagagauu

SEQ ID NO: 301690 - RNA, 22 nt, Homo sapiens
auauugcuugaggccaggaggu

SEQ ID NO: 301691 - RNA, 22 nt, Homo sapiens
aucaaagcagcauggcccaguc

SEQ ID NO: 301692 - RNA, 22 nt, Homo sapiens
aucaaaguaucucaauauggua

SEQ ID NO: 301693 - RNA, 22 nt, Homo sapiens
aucaaagugaauuaaugagaau

SEQ ID NO: 301694 - RNA, 22 nt, Homo sapiens
aucaaaucuccagaaccugucu

SEQ ID NO: 301695 - RNA, 22 nt, Homo sapiens
aucaaaugcuggcagagugccu

SEQ ID NO: 301696 - RNA, 22 nt, Homo sapiens
aucacacucaccuucuguccuu

SEQ ID NO: 301697 - RNA, 22 nt, Homo sapiens
aucacagauauggguuuaaauc

SEQ ID NO: 301698 - RNA, 22 nt, Homo sapiens
aucacagcccuccucuuggaug

SEQ ID NO: 301699 - RNA, 22 nt, Homo sapiens
aucacagugaaaacagucaauu

SEQ ID NO: 301700 - RNA, 22 nt, Homo sapiens
aucaccagaugcuucaagcaga

SEQ ID NO: 301701 - RNA, 22 nt, Homo sapiens
aucacuggccuuuuuaaaugcu

SEQ ID NO: 301702 - RNA, 22 nt, Homo sapiens
aucacuuugcucuccagugugg

SEQ ID NO: 301703 - RNA, 22 nt, Homo sapiens
aucagaaucucuagugggacca

SEQ ID NO: 301704 - RNA, 20 nt, Homo sapiens
aucagagccggugaaagggc

SEQ ID NO: 301705 - RNA, 22 nt, Homo sapiens
aucagucuguuggaauaucgcu

SEQ ID NO: 301706 - RNA, 22 nt, Homo sapiens
aucaugcacaugcauagguaug

SEQ ID NO: 301707 - RNA, 22 nt, Homo sapiens
aucauguaguaagacacauuua

SEQ ID NO: 301708 - RNA, 22 nt, Homo sapiens
aucauugugugaguugauggga

SEQ ID NO: 301709 - RNA, 22 nt, Homo sapiens
aucccuuccuagcacuuggugu

SEQ ID NO: 301710 - RNA, 22 nt, Homo sapiens
auccucugagaucuaggcagag

SEQ ID NO: 301711 - RNA, 22 nt, Homo sapiens
auccugagacuuuucugaaguu

SEQ ID NO: 301712 - RNA, 22 nt, Homo sapiens
aucgcugagaaagggacuuuca

SEQ ID NO: 301713 - RNA, 22 nt, Homo sapiens
aucuacuugcugggucucugga

SEQ ID NO: 301714 - RNA, 22 nt, Homo sapiens
aucucagagaaaauuacuaaga

SEQ ID NO: 301715 - RNA, 22 nt, Homo sapiens
aucucauggagguagagaguaa

SEQ ID NO: 301716 - RNA, 22 nt, Homo sapiens
aucuuguguugaauggugcaga

SEQ ID NO: 301717 - RNA, 22 nt, Homo sapiens
augaaaagcauaaacgcugaag

SEQ ID NO: 301718 - RNA, 23 nt, Homo sapiens
augaaagcccuugcaaaugcugg

SEQ ID NO: 301719 - RNA, 22 nt, Homo sapiens
augaaaguguguggaaacuuga

SEQ ID NO: 301720 - RNA, 22 nt, Homo sapiens
augaaaucuuuggcagaucuua

SEQ ID NO: 301721 - RNA, 22 nt, Homo sapiens
augaacucaucauuuuuauggc

SEQ ID NO: 301722 - RNA, 23 nt, Homo sapiens
augaacucaucauuuuuuauggc

SEQ ID NO: 301723 - RNA, 22 nt, Homo sapiens
augaagagaaaguggaucuugg

SEQ ID NO: 301724 - RNA, 22 nt, Homo sapiens
uaagugaugucuuuuugugugc

SEQ ID NO: 301725 - RNA, 20 nt, Homo sapiens
uaagugcuugaugaaugaac

SEQ ID NO: 301726 - RNA, 21 nt, Homo sapiens
uaauaaugucucagacaccua

SEQ ID NO: 301727 - RNA, 22 nt, Homo sapiens
uaauaguuggcacuggagaaag

SEQ ID NO: 301728 - RNA, 22 nt, Homo sapiens
uaaucacagagguuuggccuca

SEQ ID NO: 301729 - RNA, 22 nt, Homo sapiens
uaauccuggcacuuugggaggc

SEQ ID NO: 301730 - RNA, 22 nt, Homo sapiens
uaauucugacaacaguggcguu

SEQ ID NO: 301731 - RNA, 22 nt, Homo sapiens
uacaaguaauaagggaagaauu

SEQ ID NO: 301732 - RNA, 22 nt, Homo sapiens
uacaaguauuuuuauuagugcc

SEQ ID NO: 301733 - RNA, 22 nt, Homo sapiens
uacaauagugacaaaucagcau

SEQ ID NO: 301734 - RNA, 22 nt, Homo sapiens
uacacacguguguauauauaca

SEQ ID NO: 301735 - RNA, 21 nt, Homo sapiens
uacacuacugguggaaaugca

SEQ ID NO: 301736 - RNA, 18 nt, Homo sapiens
uacagaacuggaguagaa

SEQ ID NO: 301737 - RNA, 22 nt, Homo sapiens
uacagaauauuucugcccugag

SEQ ID NO: 301738 - RNA, 22 nt, Homo sapiens
uacagaguagaagauuugcaga

SEQ ID NO: 301739 - RNA, 22 nt, Homo sapiens
uacaguaauguuaaucuuugug

SEQ ID NO: 301740 - RNA, 22 nt, Homo sapiens
uacagucacauuccugaccaua

SEQ ID NO: 301741 - RNA, 22 nt, Homo sapiens
uacauagucuucuuuugguuau

SEQ ID NO: 301742 - RNA, 22 nt, Homo sapiens
uacaucagccugaaagagcucg

SEQ ID NO: 301743 - RNA, 22 nt, Homo sapiens
uacauguauguguuuauggcug

SEQ ID NO: 301744 - RNA, 22 nt, Homo sapiens
uaccacagucauuacacuugua

SEQ ID NO: 301745 - RNA, 22 nt, Homo sapiens
uacccaguaacaaguauuuugg

SEQ ID NO: 301746 - RNA, 22 nt, Homo sapiens
uacuacagccugagcgacugag

SEQ ID NO: 301747 - RNA, 22 nt, Homo sapiens
uacuagaaccuuauucagagug

SEQ ID NO: 301748 - RNA, 20 nt, Homo sapiens
uacugcacuccaaccuaggc

SEQ ID NO: 301749 - RNA, 22 nt, Homo sapiens
uacugcagucagacuccugggc

SEQ ID NO: 301750 - RNA, 22 nt, Homo sapiens
uacugcauuccaaucugggcga

SEQ ID NO: 301751 - RNA, 22 nt, Homo sapiens
uacugcugucagugccaaguag

SEQ ID NO: 301752 - RNA, 22 nt, Homo sapiens
uagaaagcaugaccuucagaua

SEQ ID NO: 301753 - RNA, 22 nt, Homo sapiens
uagaauguauaauauuuuacuu

SEQ ID NO: 301754 - RNA, 23 nt, Homo sapiens
uagaauguuuuuccauguuucuu

SEQ ID NO: 301755 - RNA, 22 nt, Homo sapiens
uagagccauugcagauguuuga

SEQ ID NO: 301756 - RNA, 22 nt, Homo sapiens
uagagguagccuacuacacacc

SEQ ID NO: 301757 - RNA, 22 nt, Homo sapiens
uagauaauuagaggguuuuaag

SEQ ID NO: 301758 - RNA, 22 nt, Homo sapiens
uagauuguuuaaguggcacaca

SEQ ID NO: 301759 - RNA, 21 nt, Homo sapiens
uagcaaauugcuauuaaggca

SEQ ID NO: 301760 - RNA, 20 nt, Homo sapiens
uagcacacauguagaauagu

SEQ ID NO: 301761 - RNA, 19 nt, Homo sapiens
uagcacagggucccagacu

SEQ ID NO: 301762 - RNA, 17 nt, Homo sapiens
uagcacagugccuggua

SEQ ID NO: 301763 - RNA, 22 nt, Homo sapiens
uagcaccaaacauauacucagu

SEQ ID NO: 301764 - RNA, 22 nt, Homo sapiens
uagcagcaaagcaggaucugcu

SEQ ID NO: 301765 - RNA, 22 nt, Homo sapiens
uagcagcaccccacucuacugg

SEQ ID NO: 301766 - RNA, 22 nt, Homo sapiens
uaggaaguacaucucagaaucu

SEQ ID NO: 301767 - RNA, 22 nt, Homo sapiens
uaggagcacagcagcauguggg

SEQ ID NO: 301768 - RNA, 22 nt, Homo sapiens
uaggauaguccuccugagaccu

SEQ ID NO: 301769 - RNA, 22 nt, Homo sapiens
uaggcaauguggcgaaacucug

SEQ ID NO: 301770 - RNA, 22 nt, Homo sapiens
uaggcacacaucuacuacaaau

SEQ ID NO: 301771 - RNA, 22 nt, Homo sapiens
uaggcagccagcuguggauuga

SEQ ID NO: 301772 - RNA, 22 nt, Homo sapiens
uagggcuugugaucagguguag

SEQ ID NO: 301773 - RNA, 22 nt, Homo sapiens
uagguacuuaagaucucagcua

SEQ ID NO: 301774 - RNA, 22 nt, Homo sapiens
uaggugaaugcuggaagaaaug

SEQ ID NO: 301775 - RNA, 22 nt, Homo sapiens
uaggugaauguaguaagguguu

SEQ ID NO: 301776 - RNA, 22 nt, Homo sapiens
uaggugauccauuuguauuuua

SEQ ID NO: 301777 - RNA, 19 nt, Homo sapiens
uaggugguuuuccccucac

SEQ ID NO: 301778 - RNA, 22 nt, Homo sapiens
uaguaaacauaguucuuuugcu

SEQ ID NO: 301779 - RNA, 22 nt, Homo sapiens
uaguaacacauugaacgaucgc

SEQ ID NO: 301780 - RNA, 22 nt, Homo sapiens
uaguaccauucccaaaccaacu

SEQ ID NO: 301781 - RNA, 22 nt, Homo sapiens
uaguuauggaguaauuuuaagc

SEQ ID NO: 301782 - RNA, 22 nt, Homo sapiens
uauaacacccacauauagucuu

SEQ ID NO: 301783 - RNA, 22 nt, Homo sapiens
uauagcaaugugccacucucug

SEQ ID NO: 301784 - RNA, 22 nt, Homo sapiens
uauagcagugugagaacagacu

SEQ ID NO: 301785 - RNA, 22 nt, Homo sapiens
uauagcuaugggauguauuugc

SEQ ID NO: 301786 - RNA, 22 nt, Homo sapiens
uauaguguuuucaaaaguaugu

SEQ ID NO: 301787 - RNA, 22 nt, Homo sapiens
uaucaaggccacucauuuuaug

SEQ ID NO: 301788 - RNA, 23 nt, Homo sapiens
uaucacacuuucucugugccaca

SEQ ID NO: 301789 - RNA, 22 nt, Homo sapiens
uaucacagaggguauccuagag

SEQ ID NO: 301790 - RNA, 22 nt, Homo sapiens
uaucacccuuucauuguucuuc

SEQ ID NO: 301791 - RNA, 22 nt, Homo sapiens
uaucacuuugauaguuuaaaug

SEQ ID NO: 301792 - RNA, 22 nt, Homo sapiens
uaucauggaaugagguuggaca

SEQ ID NO: 301793 - RNA, 21 nt, Homo sapiens
uaucauggccauccucuucuc

SEQ ID NO: 301794 - RNA, 22 nt, Homo sapiens
uaucucaguguacaggaugaua

SEQ ID NO: 301795 - RNA, 22 nt, Homo sapiens
uaugaaagcuacuucucacaau

SEQ ID NO: 301796 - RNA, 22 nt, Homo sapiens
uaugacauaguccuuaacccuc

SEQ ID NO: 301797 - RNA, 22 nt, Homo sapiens
uaugaccuuggacaaguuacuu

SEQ ID NO: 301798 - RNA, 22 nt, Homo sapiens
uaugacugagacuuaaauugug

SEQ ID NO: 301799 - RNA, 22 nt, Homo sapiens
uugacauguaaguacucuauag

SEQ ID NO: 301800 - RNA, 22 nt, Homo sapiens
uugaccuaugggaguuugacua

SEQ ID NO: 301801 - RNA, 22 nt, Homo sapiens
uugacuguaagauggcuauuac

SEQ ID NO: 301802 - RNA, 22 nt, Homo sapiens
uugacuuagacauucaguugga

SEQ ID NO: 301803 - RNA, 22 nt, Homo sapiens
uugagacgaagucucacucuug

SEQ ID NO: 301804 - RNA, 22 nt, Homo sapiens
uugagacggagucucacucugu

SEQ ID NO: 301805 - RNA, 20 nt, Homo sapiens
uugagaucuguaucugguuu

SEQ ID NO: 301806 - RNA, 22 nt, Homo sapiens
uugagauggagucucacucugc

SEQ ID NO: 301807 - RNA, 22 nt, Homo sapiens
uugagauggagucucacucugu

SEQ ID NO: 301808 - RNA, 22 nt, Homo sapiens
uugagauggagucucacucuug

SEQ ID NO: 301809 - RNA, 22 nt, Homo sapiens
uugagauggagucucgcacugu

SEQ ID NO: 301810 - RNA, 22 nt, Homo sapiens
uugagauggagucucgcucuuu

SEQ ID NO: 301811 - RNA, 22 nt, Homo sapiens
uugagauggagucuugcucuug

SEQ ID NO: 301812 - RNA, 22 nt, Homo sapiens
uugagauggaguuucacucucg

SEQ ID NO: 301813 - RNA, 22 nt, Homo sapiens
uugagauggaguuucacucugu

SEQ ID NO: 301814 - RNA, 22 nt, Homo sapiens
uugagauggaguuucacucuug

SEQ ID NO: 301815 - RNA, 22 nt, Homo sapiens
uugagauggaguuucgcucuuu

SEQ ID NO: 301816 - RNA, 22 nt, Homo sapiens
uugagauggaguuuugcucuug

SEQ ID NO: 301817 - RNA, 22 nt, Homo sapiens
uugagcaacauagugagacugu

SEQ ID NO: 301818 - RNA, 22 nt, Homo sapiens
uugagcucaucaagauagagaa

SEQ ID NO: 301819 - RNA, 23 nt, Homo sapiens
uugaggcauguaccaucaauauc

SEQ ID NO: 301820 - RNA, 22 nt, Homo sapiens
uugagguagcuuugauggaggu

SEQ ID NO: 301821 - RNA, 22 nt, Homo sapiens
uugagguauuuugucaacugua

SEQ ID NO: 301822 - RNA, 22 nt, Homo sapiens
uugaggugggaggaucacuuga

SEQ ID NO: 301823 - RNA, 20 nt, Homo sapiens
uugaggugugaggggcagag

SEQ ID NO: 301824 - RNA, 22 nt, Homo sapiens
uugaguaguaagugguucaccg

SEQ ID NO: 301825 - RNA, 22 nt, Homo sapiens
uugaguccauucgaugcugauu

SEQ ID NO: 301826 - RNA, 22 nt, Homo sapiens
uugauauguggaauauuuaucu

SEQ ID NO: 301827 - RNA, 22 nt, Homo sapiens
ucacagucggugacuucuugcu

SEQ ID NO: 301828 - RNA, 22 nt, Homo sapiens
ucacagucugcgugaugagaca

SEQ ID NO: 301829 - RNA, 22 nt, Homo sapiens
ucacauagcugaguaaaaugga

SEQ ID NO: 301830 - RNA, 22 nt, Homo sapiens
ucacaucucagguuucuugaca

SEQ ID NO: 301831 - RNA, 22 nt, Homo sapiens
ucaccaguaauaaagagccugc

SEQ ID NO: 301832 - RNA, 22 nt, Homo sapiens
ucaccuguagcuaagaccuaau

SEQ ID NO: 301833 - RNA, 22 nt, Homo sapiens
ucacgcugcugcaaccagccug

SEQ ID NO: 301834 - RNA, 22 nt, Homo sapiens
ucacuaaagaaaauggcaugga

SEQ ID NO: 301835 - RNA, 22 nt, Homo sapiens
ucacugcgaccuccgccucccg

SEQ ID NO: 301836 - RNA, 20 nt, Homo sapiens
ucacuggagcucauuugauu

SEQ ID NO: 301837 - RNA, 22 nt, Homo sapiens
ucacuggagguuccugaaguuc

SEQ ID NO: 301838 - RNA, 20 nt, Homo sapiens
ucacuggguucuugaagucu

SEQ ID NO: 301839 - RNA, 22 nt, Homo sapiens
ucagaaccucugauuuauacuu

SEQ ID NO: 301840 - RNA, 21 nt, Homo sapiens
ucagaagcucccagggaggac

SEQ ID NO: 301841 - RNA, 19 nt, Homo sapiens
ucagaugcauuagggguua

SEQ ID NO: 301842 - RNA, 20 nt, Homo sapiens
ucagcagucuggagcagagg

SEQ ID NO: 301843 - RNA, 21 nt, Homo sapiens
ucagcucaucacugccuggag

SEQ ID NO: 301844 - RNA, 22 nt, Homo sapiens
ucaggcaccuuccucuuaucug

SEQ ID NO: 301845 - RNA, 22 nt, Homo sapiens
ucaggcuuuucccagagugaug

SEQ ID NO: 301846 - RNA, 21 nt, Homo sapiens
ucaggcuuuuugagugccaau

SEQ ID NO: 301847 - RNA, 20 nt, Homo sapiens
ucagguagaucuuugagguc

SEQ ID NO: 301848 - RNA, 22 nt, Homo sapiens
ucaggucauuccaggagggcca

SEQ ID NO: 301849 - RNA, 22 nt, Homo sapiens
ucaggugccuuggcuaauuguu

SEQ ID NO: 301850 - RNA, 22 nt, Homo sapiens
ucaguaaaugcuguucucuuuu

SEQ ID NO: 301851 - RNA, 23 nt, Homo sapiens
ucaguacuccacuuucaauagug

SEQ ID NO: 301852 - RNA, 22 nt, Homo sapiens
ucagucauucaauuguugaaug

SEQ ID NO: 301853 - RNA, 22 nt, Homo sapiens
ucagucuuuuaccauuaaguau

SEQ ID NO: 301854 - RNA, 23 nt, Homo sapiens
ucagugaaggaacaacuaaauag

SEQ ID NO: 301855 - RNA, 22 nt, Homo sapiens
ucagugcaggaaucucuagcca

SEQ ID NO: 301856 - RNA, 22 nt, Homo sapiens
ucagugcaggaauuuccuuaga

SEQ ID NO: 301857 - RNA, 17 nt, Homo sapiens
ucagugcauuuaagaga

SEQ ID NO: 301858 - RNA, 19 nt, Homo sapiens
ucagugcuauguaauguag

SEQ ID NO: 301859 - RNA, 21 nt, Homo sapiens
ucagugcugugggcaaggugc

SEQ ID NO: 301860 - RNA, 22 nt, Homo sapiens
ucaguggauuauuaaagucacc

SEQ ID NO: 301861 - RNA, 22 nt, Homo sapiens
ucagugguuaaaagauucuaga

SEQ ID NO: 301862 - RNA, 22 nt, Homo sapiens
ucagugucugugauggagaggu

SEQ ID NO: 301863 - RNA, 22 nt, Homo sapiens
ucauacuguugugaaacaaaac

SEQ ID NO: 301864 - RNA, 23 nt, Homo sapiens
ucaucacagcauuuccugguauu

SEQ ID NO: 301865 - RNA, 16 nt, Homo sapiens
ucaucacagucucugg

SEQ ID NO: 301866 - RNA, 22 nt, Homo sapiens
ucaucaggcucauucaagcuga

SEQ ID NO: 301867 - RNA, 22 nt, Homo sapiens
ucaugacacagcauacugacuu

SEQ ID NO: 301868 - RNA, 22 nt, Homo sapiens
ucaugcaaugagucaggaggca

SEQ ID NO: 301869 - RNA, 22 nt, Homo sapiens
ucauggcacugaugagaguuuc

SEQ ID NO: 301870 - RNA, 22 nt, Homo sapiens
ucaugucuuguuguauuuauuu

SEQ ID NO: 301871 - RNA, 22 nt, Homo sapiens
ucauucacucccuugaaguuag

SEQ ID NO: 301872 - RNA, 22 nt, Homo sapiens
uccagcuuuuucuaauucugug

SEQ ID NO: 301873 - RNA, 22 nt, Homo sapiens
uccagguuucaugcucuuuauu

SEQ ID NO: 301874 - RNA, 22 nt, Homo sapiens
uccaguacaggucucucauuuc

SEQ ID NO: 301875 - RNA, 22 nt, Homo sapiens
uccaguggacagacauaccaug

SEQ ID NO: 301876 - RNA, 22 nt, Homo sapiens
uccaguguuccucagucacccc

SEQ ID NO: 301877 - RNA, 22 nt, Homo sapiens
uccaguuguuauuuuuauaaag

SEQ ID NO: 301878 - RNA, 18 nt, Homo sapiens
uccaguuuucccagcauc

SEQ ID NO: 301879 - RNA, 22 nt, Homo sapiens
uccauguagaagacaggggaga

SEQ ID NO: 301880 - RNA, 22 nt, Homo sapiens
ucccaguguguagcuugucucu

SEQ ID NO: 301881 - RNA, 22 nt, Homo sapiens
uccccgucacacgcaggcuuac

SEQ ID NO: 301882 - RNA, 22 nt, Homo sapiens
ucccuacuggggcacugccuag

SEQ ID NO: 301883 - RNA, 18 nt, Homo sapiens
ucccucagaauuauagaa

SEQ ID NO: 301884 - RNA, 18 nt, Homo sapiens
ucccugacucaaauucuu

SEQ ID NO: 301885 - RNA, 22 nt, Homo sapiens
uccugagacugaggagcuuugg

SEQ ID NO: 301886 - RNA, 22 nt, Homo sapiens
uccuucaugcaucaauguaucc

SEQ ID NO: 301887 - RNA, 22 nt, Homo sapiens
uccuucauuugucaacucuagu

SEQ ID NO: 301888 - RNA, 22 nt, Homo sapiens
uccuugagaggacagagccaua

SEQ ID NO: 301889 - RNA, 22 nt, Homo sapiens
uccuugguugauccugugcaga

SEQ ID NO: 301890 - RNA, 22 nt, Homo sapiens
uccuuuggcuaacuuucuaagu

SEQ ID NO: 301891 - RNA, 22 nt, Homo sapiens
uccuuuggguagcuguucagau

SEQ ID NO: 301892 - RNA, 22 nt, Homo sapiens
uccuuuguuacaguuggcucug

SEQ ID NO: 301893 - RNA, 22 nt, Homo sapiens
ucgcugggaagacugaaguguc

SEQ ID NO: 301894 - RNA, 22 nt, Homo sapiens
ucguucuugucaguuuauaaag

SEQ ID NO: 301895 - RNA, 22 nt, Homo sapiens
ucuaaguaguagcuggucagaa

SEQ ID NO: 301896 - RNA, 22 nt, Homo sapiens
ucuauggaguuugaaugagaaa

SEQ ID NO: 301897 - RNA, 22 nt, Homo sapiens
ucucacagaguugaacuuucuu

SEQ ID NO: 301898 - RNA, 22 nt, Homo sapiens
ucucaguggcuuccucacuuuu

SEQ ID NO: 301899 - RNA, 19 nt, Homo sapiens
ucucaguguuggucaggug

SEQ ID NO: 301900 - RNA, 20 nt, Homo sapiens
ucucauggagguagagaaua

SEQ ID NO: 301901 - RNA, 22 nt, Homo sapiens
ucucauggagguagagaguaaa

SEQ ID NO: 301902 - RNA, 21 nt, Homo sapiens
ucucucaaccaggaagugggc

SEQ ID NO: 301903 - RNA, 22 nt, Homo sapiens
cuuuuugcuagagucuaggguc

SEQ ID NO: 301904 - RNA, 21 nt, Homo sapiens
gaaauacugccuuaggagcug

SEQ ID NO: 301905 - RNA, 23 nt, Homo sapiens
gaaaugucuuagugaaauugcuu

SEQ ID NO: 301906 - RNA, 22 nt, Homo sapiens
gaaauguuuuucaugugggcaa

SEQ ID NO: 301907 - RNA, 22 nt, Homo sapiens
gaaccagcagacuuugacaggu

SEQ ID NO: 301908 - RNA, 22 nt, Homo sapiens
gaagaaguacaagacaaauuuu

SEQ ID NO: 301909 - RNA, 22 nt, Homo sapiens
gaagauucaaccaaaccagaac

SEQ ID NO: 301910 - RNA, 22 nt, Homo sapiens
gaagcgaggugauuagcagaca

SEQ ID NO: 301911 - RNA, 22 nt, Homo sapiens
gaaggagcuuaucugccauuuc

SEQ ID NO: 301912 - RNA, 22 nt, Homo sapiens
gaagugguaggauugcuuuuga

SEQ ID NO: 301913 - RNA, 17 nt, Homo sapiens
gaaguguuucuucauga

SEQ ID NO: 301914 - RNA, 22 nt, Homo sapiens
gaauagugcugcaagaaacaua

SEQ ID NO: 301915 - RNA, 22 nt, Homo sapiens
gaauagugcugcaauaaacaua

SEQ ID NO: 301916 - RNA, 22 nt, Homo sapiens
gacaccauuucaguacuagguu

SEQ ID NO: 301917 - RNA, 22 nt, Homo sapiens
gacagugugauacuuagucuca

SEQ ID NO: 301918 - RNA, 22 nt, Homo sapiens
gacaguuuggugaggaagacga

SEQ ID NO: 301919 - RNA, 22 nt, Homo sapiens
gacauagagccuugacuucauu

SEQ ID NO: 301920 - RNA, 22 nt, Homo sapiens
gacauguuucucucuguuuacu

SEQ ID NO: 301921 - RNA, 22 nt, Homo sapiens
gacccauagaagcgagcuugug

SEQ ID NO: 301922 - RNA, 22 nt, Homo sapiens
gaccuggugguccacccgccuu

SEQ ID NO: 301923 - RNA, 22 nt, Homo sapiens
gaccuguaguuuaguugccugu

SEQ ID NO: 301924 - RNA, 22 nt, Homo sapiens
gacguagagaaaugugaaaugg

SEQ ID NO: 301925 - RNA, 21 nt, Homo sapiens
gacuacaccaggaugcuaguu

SEQ ID NO: 301926 - RNA, 20 nt, Homo sapiens
gacuugagagugggagagua

SEQ ID NO: 301927 - RNA, 22 nt, Homo sapiens
gagaacaguguuguauuuuuuc

SEQ ID NO: 301928 - RNA, 21 nt, Homo sapiens
gagaaucaucauggcugcaua

SEQ ID NO: 301929 - RNA, 23 nt, Homo sapiens
gagaccagcuucagaaagcacga

SEQ ID NO: 301930 - RNA, 22 nt, Homo sapiens
gagaccauuuacugccuacuua

SEQ ID NO: 301931 - RNA, 22 nt, Homo sapiens
gagacggagucucgcucugucg

SEQ ID NO: 301932 - RNA, 22 nt, Homo sapiens
gagacggagucuugcucuguug

SEQ ID NO: 301933 - RNA, 22 nt, Homo sapiens
gagagugugucagaggcugcga

SEQ ID NO: 301934 - RNA, 22 nt, Homo sapiens
gagauaaauaggucacaguucu

SEQ ID NO: 301935 - RNA, 22 nt, Homo sapiens
gagauaggauucacuuucaugu

SEQ ID NO: 301936 - RNA, 22 nt, Homo sapiens
gagaucuauuccucacccuucu

SEQ ID NO: 301937 - RNA, 22 nt, Homo sapiens
gagaugaaguuaaggaucuuua

SEQ ID NO: 301938 - RNA, 22 nt, Homo sapiens
gagauggagucuuuuucuguca

SEQ ID NO: 301939 - RNA, 22 nt, Homo sapiens
gagauguagucuugcccuguca

SEQ ID NO: 301940 - RNA, 20 nt, Homo sapiens
gagauguugaucagggcuau

SEQ ID NO: 301941 - RNA, 22 nt, Homo sapiens
gagauguuuuguuaucaaagga

SEQ ID NO: 301942 - RNA, 22 nt, Homo sapiens
gagcagacaugaggaccgcugg

SEQ ID NO: 301943 - RNA, 22 nt, Homo sapiens
gagccauggagaaaacagcuau

SEQ ID NO: 301944 - RNA, 22 nt, Homo sapiens
gaggaaguuuacaaagcaucug

SEQ ID NO: 301945 - RNA, 22 nt, Homo sapiens
gaggagauauucugcuggaugg

SEQ ID NO: 301946 - RNA, 22 nt, Homo sapiens
gaggagucagacugugcaaggu

SEQ ID NO: 301947 - RNA, 22 nt, Homo sapiens
gaggaucucuugagcccagaag

SEQ ID NO: 301948 - RNA, 21 nt, Homo sapiens
gagguagggauuaaagaccuc

SEQ ID NO: 301949 - RNA, 22 nt, Homo sapiens
gagguaggggccuuaaagaugc

SEQ ID NO: 301950 - RNA, 22 nt, Homo sapiens
gaggucaggacauuuuugcuuu

SEQ ID NO: 301951 - RNA, 22 nt, Homo sapiens
gagugcuguuagcccuggguuu

SEQ ID NO: 301952 - RNA, 22 nt, Homo sapiens
gaguuacauuguaauugccgag

SEQ ID NO: 301953 - RNA, 22 nt, Homo sapiens
gaguucaaaucucagcucuguu

SEQ ID NO: 301954 - RNA, 22 nt, Homo sapiens
gaguuuguaaacuauucacuaa

SEQ ID NO: 301955 - RNA, 22 nt, Homo sapiens
gauauguucuuucacguuggug

SEQ ID NO: 301956 - RNA, 22 nt, Homo sapiens
gaucauggaguuggguucaagg

SEQ ID NO: 301957 - RNA, 22 nt, Homo sapiens
gaucuggagguuuuccucauga

SEQ ID NO: 301958 - RNA, 22 nt, Homo sapiens
gauuuuccaguggcccugauca

SEQ ID NO: 301959 - RNA, 22 nt, Homo sapiens
gcaaaaaguagugcugguuagg

SEQ ID NO: 301960 - RNA, 21 nt, Homo sapiens
gcaaacauccuuugaugccag

SEQ ID NO: 301961 - RNA, 20 nt, Homo sapiens
gcaaauggaucccacaagcc

SEQ ID NO: 301962 - RNA, 22 nt, Homo sapiens
gcaccauugacaagaaauaggu

SEQ ID NO: 301963 - RNA, 22 nt, Homo sapiens
gcacugagagaagccccaagua

SEQ ID NO: 301964 - RNA, 22 nt, Homo sapiens
gcagaauugguuucuucuaagg

SEQ ID NO: 301965 - RNA, 19 nt, Homo sapiens
gcagagaugugguagcuug

SEQ ID NO: 301966 - RNA, 22 nt, Homo sapiens
gcagaguauagagggcugggcc

SEQ ID NO: 301967 - RNA, 22 nt, Homo sapiens
gcagcacauggcagaacauauu

SEQ ID NO: 301968 - RNA, 22 nt, Homo sapiens
gcagcaucaaaucacacaagau

SEQ ID NO: 301969 - RNA, 22 nt, Homo sapiens
gcaggauuggagccucucugaa

SEQ ID NO: 301970 - RNA, 22 nt, Homo sapiens
gcaggcaugacauuucacucuu

SEQ ID NO: 301971 - RNA, 22 nt, Homo sapiens
gcagguguuaugcaaacaacug

SEQ ID NO: 301972 - RNA, 22 nt, Homo sapiens
gcaguagugcgaucucagcuca

SEQ ID NO: 301973 - RNA, 22 nt, Homo sapiens
gcagugcaugacgguauauaua

SEQ ID NO: 301974 - RNA, 22 nt, Homo sapiens
gcaguguggguagagggcaaga

SEQ ID NO: 301975 - RNA, 22 nt, Homo sapiens
gcagugugugaggaauuugggu

SEQ ID NO: 301976 - RNA, 20 nt, Homo sapiens
gcaguguucugaccugaauc

SEQ ID NO: 301977 - RNA, 20 nt, Homo sapiens
gcaugagucuuuauaguaga

SEQ ID NO: 301978 - RNA, 22 nt, Homo sapiens
gcaugcacuguauuuaaguauc

SEQ ID NO: 301979 - RNA, 22 nt, Homo sapiens
gcccacuguuaaauuuguuuua

SEQ ID NO: 301980 - RNA, 22 nt, Homo sapiens
gccuagagaguuaucaggcugu

SEQ ID NO: 301981 - RNA, 19 nt, Homo sapiens
gcggcacuggagacacagc

SEQ ID NO: 301982 - RNA, 19 nt, Homo sapiens
gcucaccuugcugcuccag

SEQ ID NO: 301983 - RNA, 22 nt, Homo sapiens
gcucuuuugggguaauucugag

SEQ ID NO: 301984 - RNA, 22 nt, Homo sapiens
gcugacagugguuauacuuaga

SEQ ID NO: 301985 - RNA, 22 nt, Homo sapiens
gcugcacuuuaaggcauccccu

SEQ ID NO: 301986 - RNA, 22 nt, Homo sapiens
gcugcuguggcagauuggauuc

SEQ ID NO: 301987 - RNA, 22 nt, Homo sapiens
gcugguguagagugcagaaagg

SEQ ID NO: 301988 - RNA, 22 nt, Homo sapiens
gcugugauucuguguagauagu

SEQ ID NO: 301989 - RNA, 19 nt, Homo sapiens
gcuuuguggggaaggagcc

SEQ ID NO: 301990 - RNA, 21 nt, Homo sapiens
gcuuuuucggaagucuuuggc

SEQ ID NO: 301991 - RNA, 18 nt, Homo sapiens
ggaaaacuuuucuaagua

SEQ ID NO: 301992 - RNA, 22 nt, Homo sapiens
ggaaagaucagcuaaauguaag

SEQ ID NO: 301993 - RNA, 22 nt, Homo sapiens
ggaaagauguaauauuaucuaa

SEQ ID NO: 301994 - RNA, 22 nt, Homo sapiens
ggaagacuuagaguagcaucag

SEQ ID NO: 301995 - RNA, 22 nt, Homo sapiens
ggaagagugaauuaucuugacu

SEQ ID NO: 301996 - RNA, 20 nt, Homo sapiens
ggaagagugacacaagguau

SEQ ID NO: 301997 - RNA, 22 nt, Homo sapiens
ggaagguaauuggguaaugaga

SEQ ID NO: 301998 - RNA, 22 nt, Homo sapiens
ggaagguaauugucagcucaua

SEQ ID NO: 301999 - RNA, 22 nt, Homo sapiens
ggaauauaaaaagccccagaau

SEQ ID NO: 302000 - RNA, 22 nt, Homo sapiens
ggaauguauuaaggcauugggc

SEQ ID NO: 302001 - RNA, 22 nt, Homo sapiens
ggaauguuaaggcgcuguuggu

SEQ ID NO: 302002 - RNA, 22 nt, Homo sapiens
ggagagcuaggcagagguuugu

SEQ ID NO: 302003 - RNA, 22 nt, Homo sapiens
ggagucugauuuuuauguugcu

SEQ ID NO: 302004 - RNA, 22 nt, Homo sapiens
ggauaucauuauuucuagggcu

SEQ ID NO: 302005 - RNA, 22 nt, Homo sapiens
ggcaagaaagaaaucaucuguc

SEQ ID NO: 302006 - RNA, 22 nt, Homo sapiens
augugcagauguuacaaauugu

SEQ ID NO: 302007 - RNA, 22 nt, Homo sapiens
augugcuagguacuguuuagca

SEQ ID NO: 302008 - RNA, 22 nt, Homo sapiens
augugguaguuauagugauaag

SEQ ID NO: 302009 - RNA, 23 nt, Homo sapiens
augugguuuuagguguugaacug

SEQ ID NO: 302010 - RNA, 22 nt, Homo sapiens
auguguaaagcuuuucuuuguu

SEQ ID NO: 302011 - RNA, 22 nt, Homo sapiens
augugugcuugugacacagccu

SEQ ID NO: 302012 - RNA, 22 nt, Homo sapiens
auguuguaguaugagucaaaau

SEQ ID NO: 302013 - RNA, 22 nt, Homo sapiens
auguuugguagugaauauggua

SEQ ID NO: 302014 - RNA, 22 nt, Homo sapiens
auuacuuugcaccaaccuaaua

SEQ ID NO: 302015 - RNA, 20 nt, Homo sapiens
auuagacuugccuuauccuu

SEQ ID NO: 302016 - RNA, 22 nt, Homo sapiens
auuauaugucaucacagacacc

SEQ ID NO: 302017 - RNA, 22 nt, Homo sapiens
auuauuagucggccagcuguua

SEQ ID NO: 302018 - RNA, 22 nt, Homo sapiens
auuauugacucauagaaaggau

SEQ ID NO: 302019 - RNA, 23 nt, Homo sapiens
auucaaguagugagagugguuau

SEQ ID NO: 302020 - RNA, 20 nt, Homo sapiens
auucaaguaugccuugagaa

SEQ ID NO: 302021 - RNA, 22 nt, Homo sapiens
auucacugugcuuggccaaauu

SEQ ID NO: 302022 - RNA, 22 nt, Homo sapiens
auucaucagggauauugguuga

SEQ ID NO: 302023 - RNA, 22 nt, Homo sapiens
auuccacuuacaugaaguaccu

SEQ ID NO: 302024 - RNA, 22 nt, Homo sapiens
auuccacuuagugacucauuug

SEQ ID NO: 302025 - RNA, 22 nt, Homo sapiens
auuccauuuguuaucacacccg

SEQ ID NO: 302026 - RNA, 22 nt, Homo sapiens
auugaacaugccauauguacca

SEQ ID NO: 302027 - RNA, 22 nt, Homo sapiens
auugacaguuggccaguaagug

SEQ ID NO: 302028 - RNA, 22 nt, Homo sapiens
auugagcaauuccuaugugcuu

SEQ ID NO: 302029 - RNA, 21 nt, Homo sapiens
auugagcacaugaaacauggc

SEQ ID NO: 302030 - RNA, 22 nt, Homo sapiens
auugcaacaguguugagaggug

SEQ ID NO: 302031 - RNA, 22 nt, Homo sapiens
auugcaauuaguccauagaguu

SEQ ID NO: 302032 - RNA, 22 nt, Homo sapiens
auugcucacacaaagccuguuu

SEQ ID NO: 302033 - RNA, 22 nt, Homo sapiens
auugcuuacccuguauuagauc

SEQ ID NO: 302034 - RNA, 22 nt, Homo sapiens
auugcuuacuaaucaucuucag

SEQ ID NO: 302035 - RNA, 22 nt, Homo sapiens
auugcuuuuacugggagcuuug

SEQ ID NO: 302036 - RNA, 22 nt, Homo sapiens
auuggcaagauagcauaugagg

SEQ ID NO: 302037 - RNA, 22 nt, Homo sapiens
auuguacugccccccuguugcu

SEQ ID NO: 302038 - RNA, 22 nt, Homo sapiens
auuuagcaauggagguagugua

SEQ ID NO: 302039 - RNA, 22 nt, Homo sapiens
auuugacacugagagccucagu

SEQ ID NO: 302040 - RNA, 22 nt, Homo sapiens
auuuggcagugaagggaucaca

SEQ ID NO: 302041 - RNA, 22 nt, Homo sapiens
auuugggaaugugcauuauacu

SEQ ID NO: 302042 - RNA, 22 nt, Homo sapiens
auuugguugggugcgguggcuu

SEQ ID NO: 302043 - RNA, 22 nt, Homo sapiens
auuuugguuacauaguugagcu

SEQ ID NO: 302044 - RNA, 22 nt, Homo sapiens
caaagugcugaaagaggccagg

SEQ ID NO: 302045 - RNA, 22 nt, Homo sapiens
caaagugcuggccgggcgcagu

SEQ ID NO: 302046 - RNA, 22 nt, Homo sapiens
caaagugcugggaugggccagg

SEQ ID NO: 302047 - RNA, 22 nt, Homo sapiens
caaaugacaucauuucauucaa

SEQ ID NO: 302048 - RNA, 19 nt, Homo sapiens
caacccugcagagaaagga

SEQ ID NO: 302049 - RNA, 21 nt, Homo sapiens
caaugacacuguagcugugcu

SEQ ID NO: 302050 - RNA, 21 nt, Homo sapiens
caauggcacaaucucugcuca

SEQ ID NO: 302051 - RNA, 22 nt, Homo sapiens
cacagaauucauuggauuaccu

SEQ ID NO: 302052 - RNA, 23 nt, Homo sapiens
cacagggugaacaccccuaaucc

SEQ ID NO: 302053 - RNA, 22 nt, Homo sapiens
cacagucugggcuuguuuguac

SEQ ID NO: 302054 - RNA, 22 nt, Homo sapiens
cacaguguuacugguaugaagu

SEQ ID NO: 302055 - RNA, 22 nt, Homo sapiens
caccaguuuuucagugauucaa

SEQ ID NO: 302056 - RNA, 22 nt, Homo sapiens
cacugcacuccagccuaagagg

SEQ ID NO: 302057 - RNA, 22 nt, Homo sapiens
cacugcacuccagcuuugguga

SEQ ID NO: 302058 - RNA, 22 nt, Homo sapiens
cacugcacuccagucugacgac

SEQ ID NO: 302059 - RNA, 22 nt, Homo sapiens
cacugcaguaaauugcgucggu

SEQ ID NO: 302060 - RNA, 22 nt, Homo sapiens
cacugcauucuccaccucccag

SEQ ID NO: 302061 - RNA, 22 nt, Homo sapiens
cacugugcaaccuccaccuccc

SEQ ID NO: 302062 - RNA, 22 nt, Homo sapiens
cagagaucaugcaacugcucgc

SEQ ID NO: 302063 - RNA, 22 nt, Homo sapiens
cagagguauugcaaaagccuag

SEQ ID NO: 302064 - RNA, 22 nt, Homo sapiens
cagagugcauguuuagaugagu

SEQ ID NO: 302065 - RNA, 22 nt, Homo sapiens
cagauacuggaguccugaaguu

SEQ ID NO: 302066 - RNA, 22 nt, Homo sapiens
cagauacuggccuggagcugug

SEQ ID NO: 302067 - RNA, 22 nt, Homo sapiens
gugagaaucaaacuacauaaau

SEQ ID NO: 302068 - RNA, 22 nt, Homo sapiens
gugagauggaguuggugucuuu

SEQ ID NO: 302069 - RNA, 22 nt, Homo sapiens
gugagaugugacuucugccucu

SEQ ID NO: 302070 - RNA, 22 nt, Homo sapiens
gugagccaugauuuuaccacug

SEQ ID NO: 302071 - RNA, 21 nt, Homo sapiens
gugaggaguuacuggcuuuga

SEQ ID NO: 302072 - RNA, 22 nt, Homo sapiens
gugagggaugugaaaaagguca

SEQ ID NO: 302073 - RNA, 22 nt, Homo sapiens
gugaucaugauccugaagcauu

SEQ ID NO: 302074 - RNA, 22 nt, Homo sapiens
gugaucucagcucacuggaacc

SEQ ID NO: 302075 - RNA, 18 nt, Homo sapiens
gugcaaugaauagcagag

SEQ ID NO: 302076 - RNA, 23 nt, Homo sapiens
gugcaguggcgagauuucggcuc

SEQ ID NO: 302077 - RNA, 22 nt, Homo sapiens
gugcuuauccccauucuggagg

SEQ ID NO: 302078 - RNA, 22 nt, Homo sapiens
gugcuuguguuaauauguagcu

SEQ ID NO: 302079 - RNA, 22 nt, Homo sapiens
guggaaaauuauugcuguuuuu

SEQ ID NO: 302080 - RNA, 22 nt, Homo sapiens
guggaagguaaugcagcuuacu

SEQ ID NO: 302081 - RNA, 22 nt, Homo sapiens
guggaagugucuggggccaggg

SEQ ID NO: 302082 - RNA, 22 nt, Homo sapiens
guggaaugaaaacucucucaca

SEQ ID NO: 302083 - RNA, 18 nt, Homo sapiens
guggagugucuuccugga

SEQ ID NO: 302084 - RNA, 22 nt, Homo sapiens
guggcaaguguuccaagaggcg

SEQ ID NO: 302085 - RNA, 22 nt, Homo sapiens
guggcgagaucauagcucauug

SEQ ID NO: 302086 - RNA, 22 nt, Homo sapiens
guggcuaaagauuuggaaucug

SEQ ID NO: 302087 - RNA, 22 nt, Homo sapiens
gugguuuuacaaagagaaagau

SEQ ID NO: 302088 - RNA, 22 nt, Homo sapiens
gugguuuuuuucugccuuauag

SEQ ID NO: 302089 - RNA, 22 nt, Homo sapiens
guguaaaacaauuagaggauuu

SEQ ID NO: 302090 - RNA, 22 nt, Homo sapiens
guguaaaucugcugugaacauu

SEQ ID NO: 302091 - RNA, 22 nt, Homo sapiens
gugugacagcuauagacaugau

SEQ ID NO: 302092 - RNA, 22 nt, Homo sapiens
gugugcaugucuuuuuaguagg

SEQ ID NO: 302093 - RNA, 22 nt, Homo sapiens
guuauggaguauaugugaacug

SEQ ID NO: 302094 - RNA, 22 nt, Homo sapiens
guuauguguuuccuuaauugcu

SEQ ID NO: 302095 - RNA, 22 nt, Homo sapiens
guuauuguccauuuauuuagca

SEQ ID NO: 302096 - RNA, 22 nt, Homo sapiens
guucaaggaauguuggcuucuc

SEQ ID NO: 302097 - RNA, 22 nt, Homo sapiens
guucacacuugcaaccccagca

SEQ ID NO: 302098 - RNA, 20 nt, Homo sapiens
guucacagagguuaugauua

SEQ ID NO: 302099 - RNA, 22 nt, Homo sapiens
guucaguaguucauucauuuau

SEQ ID NO: 302100 - RNA, 22 nt, Homo sapiens
guugcucaggccggagugcagu

SEQ ID NO: 302101 - RNA, 22 nt, Homo sapiens
guugcucaggcuggagugcagu

SEQ ID NO: 302102 - RNA, 22 nt, Homo sapiens
guuguggcuugugauuaagcac

SEQ ID NO: 302103 - RNA, 22 nt, Homo sapiens
guuuacagucgacuugggaaua

SEQ ID NO: 302104 - RNA, 22 nt, Homo sapiens
guuugcagaucaugaagaaccc

SEQ ID NO: 302105 - RNA, 22 nt, Homo sapiens
guuuggauuuucuaauuucugu

SEQ ID NO: 302106 - RNA, 22 nt, Homo sapiens
uaaagccagugauuaugucucu

SEQ ID NO: 302107 - RNA, 22 nt, Homo sapiens
uaaagcuacagagcggaaaauu

SEQ ID NO: 302108 - RNA, 22 nt, Homo sapiens
uaaagugaggauggcaguaggu

SEQ ID NO: 302109 - RNA, 20 nt, Homo sapiens
uaaaugccucaugcuuuauu

SEQ ID NO: 302110 - RNA, 22 nt, Homo sapiens
uaaauggauaaaugaauaccua

SEQ ID NO: 302111 - RNA, 21 nt, Homo sapiens
uaacccugaaggagcucugga

SEQ ID NO: 302112 - RNA, 22 nt, Homo sapiens
uaacucugccuagugacauggu

SEQ ID NO: 302113 - RNA, 22 nt, Homo sapiens
uaagccuaggucugugcucuuc

SEQ ID NO: 302114 - RNA, 22 nt, Homo sapiens
uaagcuauagugaauaaauugc

SEQ ID NO: 302115 - RNA, 22 nt, Homo sapiens
uaaguauuaugugcugcauuuu

SEQ ID NO: 302116 - RNA, 22 nt, Homo sapiens
uaaguauuuuaauuccuggcau

SEQ ID NO: 302117 - RNA, 22 nt, Homo sapiens
uaaguggugcauuguuaaaugg

SEQ ID NO: 302118 - RNA, 22 nt, Homo sapiens
uaaguucauucaugaaacuuag

SEQ ID NO: 302119 - RNA, 22 nt, Homo sapiens
uaaguugcagguugugauucca

SEQ ID NO: 302120 - RNA, 22 nt, Homo sapiens
uaauacauucaaggugguaguu

SEQ ID NO: 302121 - RNA, 22 nt, Homo sapiens
uaauacuagugaauagcaggau

SEQ ID NO: 302122 - RNA, 22 nt, Homo sapiens
uaauucuguauguaucagaguu

SEQ ID NO: 302123 - RNA, 22 nt, Homo sapiens
uacaaagcuuucugcaaaucau

SEQ ID NO: 302124 - RNA, 22 nt, Homo sapiens
uacaacacugguucgacaugug

SEQ ID NO: 302125 - RNA, 16 nt, Homo sapiens
uacaacagugaguaug

SEQ ID NO: 302126 - RNA, 22 nt, Homo sapiens
uacaagcacaggcagcaggcug

SEQ ID NO: 302127 - RNA, 22 nt, Homo sapiens
uacaaguggguuugugcaggag

SEQ ID NO: 302128 - RNA, 22 nt, Homo sapiens
uacagaauugcagguguggcag

SEQ ID NO: 302129 - RNA, 19 nt, Homo sapiens
uacaggacugagcugaggu

SEQ ID NO: 302130 - RNA, 22 nt, Homo sapiens
uacaggcaccuggcuaauuuuu

SEQ ID NO: 302131 - RNA, 22 nt, Homo sapiens
uacaugcaugggcaugugugca

SEQ ID NO: 302132 - RNA, 22 nt, Homo sapiens
uacaugugcaggucuguggggg

SEQ ID NO: 302133 - RNA, 22 nt, Homo sapiens
uaccacaggcuggguaaucuau

SEQ ID NO: 302134 - RNA, 22 nt, Homo sapiens
uaccacugccgagaaaacagau

SEQ ID NO: 302135 - RNA, 22 nt, Homo sapiens
uaccagugaauuccaggggcua

SEQ ID NO: 302136 - RNA, 22 nt, Homo sapiens
uaccauguaucugggaugcuuu

SEQ ID NO: 302137 - RNA, 19 nt, Homo sapiens
uacccuaguauauacagaa

SEQ ID NO: 302138 - RNA, 22 nt, Homo sapiens
uacccuuuaguauaaaaucaga

SEQ ID NO: 302139 - RNA, 22 nt, Homo sapiens
uacuacuuucugacaucuuuaa

SEQ ID NO: 302140 - RNA, 22 nt, Homo sapiens
uacucaauugcagucaccuggc

SEQ ID NO: 302141 - RNA, 22 nt, Homo sapiens
uacugcacuccaaccugagaga

SEQ ID NO: 302142 - RNA, 21 nt, Homo sapiens
uacuggagauacagucugcaa

SEQ ID NO: 302143 - RNA, 22 nt, Homo sapiens
uacuggccuugaacucuggugu

SEQ ID NO: 302144 - RNA, 22 nt, Homo sapiens
uacuguacugcaguucugcaaa

SEQ ID NO: 302145 - RNA, 20 nt, Homo sapiens
uagaaaguagaguggugguu

SEQ ID NO: 302146 - RNA, 22 nt, Homo sapiens
uagaaguaggcuacgugucugg

SEQ ID NO: 302147 - RNA, 22 nt, Homo sapiens
uagaauguaacuuccaugucau

SEQ ID NO: 302148 - RNA, 22 nt, Homo sapiens
uagagcuugacacuuuccaugg

SEQ ID NO: 302149 - RNA, 22 nt, Homo sapiens
uagagguagagugacuucccca

SEQ ID NO: 302150 - RNA, 22 nt, Homo sapiens
uagagguaggucuucgagucuc

SEQ ID NO: 302151 - RNA, 22 nt, Homo sapiens
uagagguauaccaaaaaggcau

SEQ ID NO: 302152 - RNA, 22 nt, Homo sapiens
uagagguauguauaguauucuu

SEQ ID NO: 302153 - RNA, 22 nt, Homo sapiens
uagaguguuuuguuaggcagca

SEQ ID NO: 302154 - RNA, 21 nt, Homo sapiens
uagauacuguauuaaaccuag

SEQ ID NO: 302155 - RNA, 22 nt, Homo sapiens
uagaucauauucagugcuuacu

SEQ ID NO: 302156 - RNA, 22 nt, Homo sapiens
uagauuguaauaugcagaaugg

SEQ ID NO: 302157 - RNA, 22 nt, Homo sapiens
uagcaacauucagcucagguac

SEQ ID NO: 302158 - RNA, 22 nt, Homo sapiens
uagcacagggaauugguucucu

SEQ ID NO: 302159 - RNA, 22 nt, Homo sapiens
uagcacaucccuaaaaugcugu

SEQ ID NO: 302160 - RNA, 19 nt, Homo sapiens
uagcacuacagaguuuagc

SEQ ID NO: 302161 - RNA, 22 nt, Homo sapiens
uagcagcagugguguauuuaga

SEQ ID NO: 302162 - RNA, 22 nt, Homo sapiens
uagcagcauuuuuguagaguau

SEQ ID NO: 302163 - RNA, 22 nt, Homo sapiens
uagcagucaagauagucauuau

SEQ ID NO: 302164 - RNA, 22 nt, Homo sapiens
uaggaaguuuucuugcugggcc

SEQ ID NO: 302165 - RNA, 22 nt, Homo sapiens
uagguaaguaauauacagauga

SEQ ID NO: 302166 - RNA, 22 nt, Homo sapiens
uagguagugugugcaugagagg

SEQ ID NO: 302167 - RNA, 22 nt, Homo sapiens
uaggugauugaagguggaaugu

SEQ ID NO: 302168 - RNA, 22 nt, Homo sapiens
uagucacacacucaacuuuuca

SEQ ID NO: 302169 - RNA, 22 nt, Homo sapiens
uagugaaugucacuggcuguug

SEQ ID NO: 302170 - RNA, 17 nt, Homo sapiens
acagugcuuugcuuucc

SEQ ID NO: 302171 - RNA, 22 nt, Homo sapiens
acauaaagaagcaggacauugu

SEQ ID NO: 302172 - RNA, 22 nt, Homo sapiens
acauagaguagcuaccuguaga

SEQ ID NO: 302173 - RNA, 22 nt, Homo sapiens
acauccauuugcuuuauuugcu

SEQ ID NO: 302174 - RNA, 21 nt, Homo sapiens
acauguacacauguaugcaca

SEQ ID NO: 302175 - RNA, 22 nt, Homo sapiens
accaccacucccgcauucuaaa

SEQ ID NO: 302176 - RNA, 22 nt, Homo sapiens
acccuacauaguagauccuaca

SEQ ID NO: 302177 - RNA, 21 nt, Homo sapiens
accugauguuucaguuggagu

SEQ ID NO: 302178 - RNA, 22 nt, Homo sapiens
accugugguuacagucugucuc

SEQ ID NO: 302179 - RNA, 23 nt, Homo sapiens
accugugguuauuuuacucuucc

SEQ ID NO: 302180 - RNA, 22 nt, Homo sapiens
accuuguaucuguuaggauugc

SEQ ID NO: 302181 - RNA, 22 nt, Homo sapiens
acugcacuccagcccaggugac

SEQ ID NO: 302182 - RNA, 22 nt, Homo sapiens
acugcacuccagccugcugggu

SEQ ID NO: 302183 - RNA, 22 nt, Homo sapiens
acugcacuccagccuggaccac

SEQ ID NO: 302184 - RNA, 22 nt, Homo sapiens
acugcacuccagccugugcgua

SEQ ID NO: 302185 - RNA, 22 nt, Homo sapiens
acugcacuccagccuguugaca

SEQ ID NO: 302186 - RNA, 22 nt, Homo sapiens
acugcacuccagcuccagggug

SEQ ID NO: 302187 - RNA, 18 nt, Homo sapiens
acugcacuccauccuagg

SEQ ID NO: 302188 - RNA, 22 nt, Homo sapiens
acugcacugucaaccuccuggg

SEQ ID NO: 302189 - RNA, 22 nt, Homo sapiens
acuuugguuaucauacuuucag

SEQ ID NO: 302190 - RNA, 22 nt, Homo sapiens
acuuuuugcaaccauuuggacc

SEQ ID NO: 302191 - RNA, 22 nt, Homo sapiens
agaacccuuugaaauguguuug

SEQ ID NO: 302192 - RNA, 22 nt, Homo sapiens
agaauguauauucuguaguugu

SEQ ID NO: 302193 - RNA, 22 nt, Homo sapiens
agaauguuuuagaccaauacaa

SEQ ID NO: 302194 - RNA, 22 nt, Homo sapiens
agacucauuuccauagucagcu

SEQ ID NO: 302195 - RNA, 21 nt, Homo sapiens
agagaacugaaacaugugacu

SEQ ID NO: 302196 - RNA, 22 nt, Homo sapiens
agagaccuguaaaguucaggca

SEQ ID NO: 302197 - RNA, 22 nt, Homo sapiens
agagagguggguggagccccca

SEQ ID NO: 302198 - RNA, 22 nt, Homo sapiens
agagaucaacugaauuacugga

SEQ ID NO: 302199 - RNA, 22 nt, Homo sapiens
agagaugauuaacauuuuggua

SEQ ID NO: 302200 - RNA, 22 nt, Homo sapiens
agagcacugcugcaggguucug

SEQ ID NO: 302201 - RNA, 22 nt, Homo sapiens
agagguaagcaguggcaagugc

SEQ ID NO: 302202 - RNA, 22 nt, Homo sapiens
agaggucuuaucaaacaugcuu

SEQ ID NO: 302203 - RNA, 22 nt, Homo sapiens
agagucacaugaggcccuucau

SEQ ID NO: 302204 - RNA, 22 nt, Homo sapiens
agagugcaaagguuggggcugg

SEQ ID NO: 302205 - RNA, 18 nt, Homo sapiens
agaugguguugcuucugu

SEQ ID NO: 302206 - RNA, 22 nt, Homo sapiens
agaugguguuuucucaccagau

SEQ ID NO: 302207 - RNA, 22 nt, Homo sapiens
agcaacauagaaauuugggugg

SEQ ID NO: 302208 - RNA, 22 nt, Homo sapiens
agcaacauugagacugcaguug

SEQ ID NO: 302209 - RNA, 22 nt, Homo sapiens
agcaaccuugaauagcccuuuc

SEQ ID NO: 302210 - RNA, 22 nt, Homo sapiens
agcacagccuuguguuuucuug

SEQ ID NO: 302211 - RNA, 22 nt, Homo sapiens
agcaccaugggcugaguaagug

SEQ ID NO: 302212 - RNA, 22 nt, Homo sapiens
agcagcaugcaaauggacuaau

SEQ ID NO: 302213 - RNA, 22 nt, Homo sapiens
agcagcauuaguggaaucuugu

SEQ ID NO: 302214 - RNA, 22 nt, Homo sapiens
agcagcauuaugauauaucuua

SEQ ID NO: 302215 - RNA, 22 nt, Homo sapiens
agcagcuuugaucugaaugauu

SEQ ID NO: 302216 - RNA, 22 nt, Homo sapiens
agcagcuuugcauggccugugg

SEQ ID NO: 302217 - RNA, 22 nt, Homo sapiens
agcagguauucgggucaugggg

SEQ ID NO: 302218 - RNA, 22 nt, Homo sapiens
agcagguguggcuuauccugaa

SEQ ID NO: 302219 - RNA, 22 nt, Homo sapiens
agcagugucauuuucuggugag

SEQ ID NO: 302220 - RNA, 19 nt, Homo sapiens
agcaucauuauuguuuugg

SEQ ID NO: 302221 - RNA, 22 nt, Homo sapiens
agcauggucacuuugggcccca

SEQ ID NO: 302222 - RNA, 22 nt, Homo sapiens
agccaguauuuccacagagugg

SEQ ID NO: 302223 - RNA, 22 nt, Homo sapiens
agcccuuagauggcuccuucca

SEQ ID NO: 302224 - RNA, 22 nt, Homo sapiens
agcuaaaucucauguugaauug

SEQ ID NO: 302225 - RNA, 22 nt, Homo sapiens
agcuacaucuugcucugggaug

SEQ ID NO: 302226 - RNA, 22 nt, Homo sapiens
agcucacagccuagcacuguga

SEQ ID NO: 302227 - RNA, 22 nt, Homo sapiens
agcugcaauguuuaguauaaua

SEQ ID NO: 302228 - RNA, 20 nt, Homo sapiens
agcugcagauauaaauccgc

SEQ ID NO: 302229 - RNA, 22 nt, Homo sapiens
augagauacuacaaaugaguuu

SEQ ID NO: 302230 - RNA, 22 nt, Homo sapiens
augagaugauaggcguucuaac

SEQ ID NO: 302231 - RNA, 22 nt, Homo sapiens
augagcuaauauggguaaguug

SEQ ID NO: 302232 - RNA, 22 nt, Homo sapiens
augaggcacugcgcccuacuga

SEQ ID NO: 302233 - RNA, 22 nt, Homo sapiens
augaggcaggaaaggcguaucu

SEQ ID NO: 302234 - RNA, 22 nt, Homo sapiens
augagggcggacgcccuggaga

SEQ ID NO: 302235 - RNA, 22 nt, Homo sapiens
augaggugaggucaguaaggua

SEQ ID NO: 302236 - RNA, 22 nt, Homo sapiens
augaggugggagaaucacuuga

SEQ ID NO: 302237 - RNA, 19 nt, Homo sapiens
augaguuaggggaaauuuc

SEQ ID NO: 302238 - RNA, 22 nt, Homo sapiens
augauacugaguugaguucuca

SEQ ID NO: 302239 - RNA, 22 nt, Homo sapiens
augcaagcacacaagaggaaau

SEQ ID NO: 302240 - RNA, 19 nt, Homo sapiens
augcaaugucacaggcugc

SEQ ID NO: 302241 - RNA, 22 nt, Homo sapiens
augcacuguuguuauuggauaa

SEQ ID NO: 302242 - RNA, 22 nt, Homo sapiens
augcauggucugaagucaaccu

SEQ ID NO: 302243 - RNA, 22 nt, Homo sapiens
augccaagagacaaagggaauc

SEQ ID NO: 302244 - RNA, 22 nt, Homo sapiens
augccacugcgcucuagccugg

SEQ ID NO: 302245 - RNA, 22 nt, Homo sapiens
augcuacauucuacaauuaggc

SEQ ID NO: 302246 - RNA, 22 nt, Homo sapiens
auggaaaugaagggcuggcccu

SEQ ID NO: 302247 - RNA, 22 nt, Homo sapiens
auggaagaaaguuggguucuug

SEQ ID NO: 302248 - RNA, 22 nt, Homo sapiens
auggaaugccauuuauaaugga

SEQ ID NO: 302249 - RNA, 22 nt, Homo sapiens
auggacagaaaaaaauagaugu

SEQ ID NO: 302250 - RNA, 22 nt, Homo sapiens
auggagagaauuauucucucag

SEQ ID NO: 302251 - RNA, 22 nt, Homo sapiens
auggagaugaauaucaucuguu

SEQ ID NO: 302252 - RNA, 22 nt, Homo sapiens
auggaggacaaugucaccuuca

SEQ ID NO: 302253 - RNA, 22 nt, Homo sapiens
auggaguguucugaauccuuug

SEQ ID NO: 302254 - RNA, 22 nt, Homo sapiens
auggauauuuuuugaacauaga

SEQ ID NO: 302255 - RNA, 22 nt, Homo sapiens
auggauuuuaggauacaguuga

SEQ ID NO: 302256 - RNA, 22 nt, Homo sapiens
auggcaccauguuaugauaaua

SEQ ID NO: 302257 - RNA, 22 nt, Homo sapiens
auggcacuacugggaaugucuu

SEQ ID NO: 302258 - RNA, 22 nt, Homo sapiens
auggcacucaaucaaguugaga

SEQ ID NO: 302259 - RNA, 22 nt, Homo sapiens
auggcacuccagccugggcaac

SEQ ID NO: 302260 - RNA, 22 nt, Homo sapiens
auggcacuguguccugggguca

SEQ ID NO: 302261 - RNA, 22 nt, Homo sapiens
auggcagaaucaagccgacagc

SEQ ID NO: 302262 - RNA, 22 nt, Homo sapiens
auggcagcaccccacucuacug

SEQ ID NO: 302263 - RNA, 22 nt, Homo sapiens
auggccugaugcaccuguccca

SEQ ID NO: 302264 - RNA, 22 nt, Homo sapiens
auggcucuuauuauuugaggua

SEQ ID NO: 302265 - RNA, 22 nt, Homo sapiens
auggcuuuaagagugucugaau

SEQ ID NO: 302266 - RNA, 22 nt, Homo sapiens
auggcuuucaggacguggcgag

SEQ ID NO: 302267 - RNA, 22 nt, Homo sapiens
auggcuuuugaccugguaggau

SEQ ID NO: 302268 - RNA, 22 nt, Homo sapiens
auggcuuuugcccuaaauggau

SEQ ID NO: 302269 - RNA, 22 nt, Homo sapiens
augguacuagaguaagaauugu

SEQ ID NO: 302270 - RNA, 22 nt, Homo sapiens
augguacuggguaaaagugggg

SEQ ID NO: 302271 - RNA, 22 nt, Homo sapiens
augguauuuaacagucuuucua

SEQ ID NO: 302272 - RNA, 22 nt, Homo sapiens
auggucuuuauuguguugagug

SEQ ID NO: 302273 - RNA, 22 nt, Homo sapiens
auguaaacauuuggucuaaauu

SEQ ID NO: 302274 - RNA, 22 nt, Homo sapiens
auguaauguuaaauugcuaauu

SEQ ID NO: 302275 - RNA, 22 nt, Homo sapiens
augucaaagaggaaaacuggau

SEQ ID NO: 302276 - RNA, 22 nt, Homo sapiens
augucuagagugauacugaagc

SEQ ID NO: 302277 - RNA, 22 nt, Homo sapiens
augucuuucauagagacccaga

SEQ ID NO: 302278 - RNA, 22 nt, Homo sapiens
augugaccaucucuccacuaau

SEQ ID NO: 302279 - RNA, 22 nt, Homo sapiens
augugcacaacgugcagguuug

SEQ ID NO: 302280 - RNA, 21 nt, Homo sapiens
augugcacuaugucauuuaau

SEQ ID NO: 302281 - RNA, 20 nt, Homo sapiens
augugcuaauauuaauaugu

SEQ ID NO: 302282 - RNA, 22 nt, Homo sapiens
auguuugguaagaauauuguua

SEQ ID NO: 302283 - RNA, 22 nt, Homo sapiens
auuaaguaaugguuccaauaau

SEQ ID NO: 302284 - RNA, 22 nt, Homo sapiens
auuaaucaggcaaugcuugcua

SEQ ID NO: 302285 - RNA, 22 nt, Homo sapiens
auuauauguguaugugcauacc

SEQ ID NO: 302286 - RNA, 22 nt, Homo sapiens
auuaucacaguuuugcauaugg

SEQ ID NO: 302287 - RNA, 22 nt, Homo sapiens
auucaaggagucuucgucccaa

SEQ ID NO: 302288 - RNA, 22 nt, Homo sapiens
auucaagggauuucaggaggcu

SEQ ID NO: 302289 - RNA, 22 nt, Homo sapiens
auuccacaguuaacacagaccg

SEQ ID NO: 302290 - RNA, 22 nt, Homo sapiens
auuccacuuccacuaguuucuc

SEQ ID NO: 302291 - RNA, 22 nt, Homo sapiens
auuccauagugucuguggcaga

SEQ ID NO: 302292 - RNA, 22 nt, Homo sapiens
auuccauuuguguggaauggcu

SEQ ID NO: 302293 - RNA, 22 nt, Homo sapiens
auucccuuagcugccucagccu

SEQ ID NO: 302294 - RNA, 22 nt, Homo sapiens
auugaacuuuugucacugacau

SEQ ID NO: 302295 - RNA, 22 nt, Homo sapiens
auugagcacugacucugugcca

SEQ ID NO: 302296 - RNA, 22 nt, Homo sapiens
auugaguaaaaaauagugaugu

SEQ ID NO: 302297 - RNA, 19 nt, Homo sapiens
auugauuaaguuugcuguc

SEQ ID NO: 302298 - RNA, 22 nt, Homo sapiens
auugcacuccagccuugugaca

SEQ ID NO: 302299 - RNA, 22 nt, Homo sapiens
auugcauugugaucuucccaga

SEQ ID NO: 302300 - RNA, 22 nt, Homo sapiens
auugcuaacugaaauaagacca

SEQ ID NO: 302301 - RNA, 22 nt, Homo sapiens
auuggcaaucgucuccauuuuu

SEQ ID NO: 302302 - RNA, 22 nt, Homo sapiens
auuguacauacaccggugugua

SEQ ID NO: 302303 - RNA, 22 nt, Homo sapiens
auuguaccccaauguacaauau

SEQ ID NO: 302304 - RNA, 22 nt, Homo sapiens
auugucauuuucugagaaguaa

SEQ ID NO: 302305 - RNA, 22 nt, Homo sapiens
auugugcuaaaguaauaaguca

SEQ ID NO: 302306 - RNA, 22 nt, Homo sapiens
auuguguagucuuacugcuugc

SEQ ID NO: 302307 - RNA, 22 nt, Homo sapiens
auugugucuuguagagagauau

SEQ ID NO: 302308 - RNA, 22 nt, Homo sapiens
auuguguuugaaugaggcucca

SEQ ID NO: 302309 - RNA, 22 nt, Homo sapiens
auuucacugagacaugugccca

SEQ ID NO: 302310 - RNA, 22 nt, Homo sapiens
auuuggcaauuuugaagaugcc

SEQ ID NO: 302311 - RNA, 22 nt, Homo sapiens
auuuggcauagaguaucauucu

SEQ ID NO: 302312 - RNA, 21 nt, Homo sapiens
auuuuugcagagcugguagug

SEQ ID NO: 302313 - RNA, 22 nt, Homo sapiens
auuuuuggauauagggaaggau

SEQ ID NO: 302314 - RNA, 22 nt, Homo sapiens
caaaagugguucuuauccuuuu

SEQ ID NO: 302315 - RNA, 22 nt, Homo sapiens
caaagcuauagcaccagaggga

SEQ ID NO: 302316 - RNA, 22 nt, Homo sapiens
caaaggcuuccacugcauccuu

SEQ ID NO: 302317 - RNA, 22 nt, Homo sapiens
caaagucuucaguugauucuga

SEQ ID NO: 302318 - RNA, 22 nt, Homo sapiens
caaagucuucucauuaugucuu

SEQ ID NO: 302319 - RNA, 22 nt, Homo sapiens
caaagugcuggaauuggccggg

SEQ ID NO: 302320 - RNA, 22 nt, Homo sapiens
caaagugcugggacuggccggg

SEQ ID NO: 302321 - RNA, 22 nt, Homo sapiens
caaauacuuucauguugucuug

SEQ ID NO: 302322 - RNA, 22 nt, Homo sapiens
guucacaguuucuaaucccagc

SEQ ID NO: 302323 - RNA, 22 nt, Homo sapiens
guucaucagggauacuggcuua

SEQ ID NO: 302324 - RNA, 17 nt, Homo sapiens
guucccaguggcauuug

SEQ ID NO: 302325 - RNA, 22 nt, Homo sapiens
guuccuuguagaugcuggauau

SEQ ID NO: 302326 - RNA, 22 nt, Homo sapiens
guugggcccauagacugccagu

SEQ ID NO: 302327 - RNA, 22 nt, Homo sapiens
guuuaacugguacuucaagucu

SEQ ID NO: 302328 - RNA, 22 nt, Homo sapiens
guuuggcucuuguuucugucaa

SEQ ID NO: 302329 - RNA, 22 nt, Homo sapiens
guuugguugcauggaaaauuua

SEQ ID NO: 302330 - RNA, 22 nt, Homo sapiens
uaaagauaaggcucgcuuggau

SEQ ID NO: 302331 - RNA, 17 nt, Homo sapiens
uaaagccagucaaguca

SEQ ID NO: 302332 - RNA, 22 nt, Homo sapiens
uaaagcuacaguauaugguauu

SEQ ID NO: 302333 - RNA, 22 nt, Homo sapiens
uaaaguguuuguuauuaaaggu

SEQ ID NO: 302334 - RNA, 22 nt, Homo sapiens
uaaaugcuuaauugaaugugga

SEQ ID NO: 302335 - RNA, 22 nt, Homo sapiens
uaaaugcuugagaugauggaua

SEQ ID NO: 302336 - RNA, 22 nt, Homo sapiens
uaaauugcauaaguacaaauga

SEQ ID NO: 302337 - RNA, 22 nt, Homo sapiens
uaacaacauucuaacugacggc

SEQ ID NO: 302338 - RNA, 22 nt, Homo sapiens
uaacaguggucugugguaucug

SEQ ID NO: 302339 - RNA, 22 nt, Homo sapiens
uaacauagucauauacuugcuu

SEQ ID NO: 302340 - RNA, 22 nt, Homo sapiens
uaacuaaagagaagucaauguc

SEQ ID NO: 302341 - RNA, 18 nt, Homo sapiens
uaacuggugugagauggu

SEQ ID NO: 302342 - RNA, 22 nt, Homo sapiens
uaagagcuaggauuuuaaauca

SEQ ID NO: 302343 - RNA, 22 nt, Homo sapiens
uaagcagugcaagaauggaaua

SEQ ID NO: 302344 - RNA, 20 nt, Homo sapiens
uaagcauaguugucaggguc

SEQ ID NO: 302345 - RNA, 22 nt, Homo sapiens
uaaggaaggcugugugcuuuua

SEQ ID NO: 302346 - RNA, 22 nt, Homo sapiens
uaagguuacaaaggacuucaua

SEQ ID NO: 302347 - RNA, 22 nt, Homo sapiens
uaaguaauugugguuucugcca

SEQ ID NO: 302348 - RNA, 22 nt, Homo sapiens
uaaguacaugcuagauggaaug

SEQ ID NO: 302349 - RNA, 22 nt, Homo sapiens
uaaguagugugcauguauguau

SEQ ID NO: 302350 - RNA, 22 nt, Homo sapiens
uaaguaguuuucuuggaggcga

SEQ ID NO: 302351 - RNA, 22 nt, Homo sapiens
uaaguaucaguuuagcuaugau

SEQ ID NO: 302352 - RNA, 22 nt, Homo sapiens
uaagucuuuuuggaguuuauaa

SEQ ID NO: 302353 - RNA, 22 nt, Homo sapiens
uaagugaaggaaguguguuuac

SEQ ID NO: 302354 - RNA, 22 nt, Homo sapiens
uggaagacauuuuggaccuugg

SEQ ID NO: 302355 - RNA, 22 nt, Homo sapiens
uggaaguaaccaugaauggaau

SEQ ID NO: 302356 - RNA, 22 nt, Homo sapiens
uggaaguagauagauuguguca

SEQ ID NO: 302357 - RNA, 23 nt, Homo sapiens
uggaaguauggaggaggcagaau

SEQ ID NO: 302358 - RNA, 22 nt, Homo sapiens
uggaaguuaaauuaguugauga

SEQ ID NO: 302359 - RNA, 21 nt, Homo sapiens
uggaaucuauagaggcaguag

SEQ ID NO: 302360 - RNA, 22 nt, Homo sapiens
uggaaugguuggugugauuuua

SEQ ID NO: 302361 - RNA, 22 nt, Homo sapiens
uggaauuaauuaaaauauacug

SEQ ID NO: 302362 - RNA, 22 nt, Homo sapiens
uggacagaaacauguuuucagu

SEQ ID NO: 302363 - RNA, 18 nt, Homo sapiens
uggacagugauuauccau

SEQ ID NO: 302364 - RNA, 22 nt, Homo sapiens
uggacugagauuucagcugcca

SEQ ID NO: 302365 - RNA, 22 nt, Homo sapiens
uggagggcuagucauuucuuuu

SEQ ID NO: 302366 - RNA, 22 nt, Homo sapiens
uggagugcaauggugagaucuu

SEQ ID NO: 302367 - RNA, 22 nt, Homo sapiens
uggagugcgagggugaaacuuu

SEQ ID NO: 302368 - RNA, 22 nt, Homo sapiens
uggaguguaaauuaguucagcc

SEQ ID NO: 302369 - RNA, 22 nt, Homo sapiens
uggauagaacuaagugcuuaga

SEQ ID NO: 302370 - RNA, 22 nt, Homo sapiens
uggauaguaauaaacauauagg

SEQ ID NO: 302371 - RNA, 22 nt, Homo sapiens
uggcaaaaaaccgcaguugccu

SEQ ID NO: 302372 - RNA, 22 nt, Homo sapiens
uggcaaaucagaggcauggaca

SEQ ID NO: 302373 - RNA, 22 nt, Homo sapiens
uggcaagaaccacaguuacuuu

SEQ ID NO: 302374 - RNA, 22 nt, Homo sapiens
uggcaagaagagcaugagacca

SEQ ID NO: 302375 - RNA, 22 nt, Homo sapiens
uggcaagaaggauuuauuccuu

SEQ ID NO: 302376 - RNA, 20 nt, Homo sapiens
uggcaagugggaauuguggg

SEQ ID NO: 302377 - RNA, 22 nt, Homo sapiens
uggcaauaauucagugugggcu

SEQ ID NO: 302378 - RNA, 19 nt, Homo sapiens
uggcacauguauacuuaug

SEQ ID NO: 302379 - RNA, 20 nt, Homo sapiens
uggcaccugacagauagcca

SEQ ID NO: 302380 - RNA, 22 nt, Homo sapiens
uggcagaugggugagcuggaga

SEQ ID NO: 302381 - RNA, 22 nt, Homo sapiens
uggcagugggagauauuuuauu

SEQ ID NO: 302382 - RNA, 22 nt, Homo sapiens
uggcaguuuacaaaugccauga

SEQ ID NO: 302383 - RNA, 22 nt, Homo sapiens
uggcauaugguauuugauaucu

SEQ ID NO: 302384 - RNA, 22 nt, Homo sapiens
uggcauggucugcccaaguuuc

SEQ ID NO: 302385 - RNA, 22 nt, Homo sapiens
uggcaugucguuuuucauagga

SEQ ID NO: 302386 - RNA, 22 nt, Homo sapiens
uggcauuuucucuguucuuaga

SEQ ID NO: 302387 - RNA, 22 nt, Homo sapiens
uggcauuuugugugaauuagaa

SEQ ID NO: 302388 - RNA, 22 nt, Homo sapiens
uggcuagaccugcauaacagcu

SEQ ID NO: 302389 - RNA, 23 nt, Homo sapiens
uggcuagacguccuuuccugaug

SEQ ID NO: 302390 - RNA, 22 nt, Homo sapiens
uggcuguguccucucccaaauc

SEQ ID NO: 302391 - RNA, 22 nt, Homo sapiens
uggcuguuuauuucacaugggu

SEQ ID NO: 302392 - RNA, 22 nt, Homo sapiens
uggcuguuuauuucaccuggau

SEQ ID NO: 302393 - RNA, 22 nt, Homo sapiens
uggcuguuuauuucaccugggc

SEQ ID NO: 302394 - RNA, 22 nt, Homo sapiens
uggcuguuuauuucaccugggu

SEQ ID NO: 302395 - RNA, 20 nt, Homo sapiens
uggcuucuuaauugcaggca

SEQ ID NO: 302396 - RNA, 22 nt, Homo sapiens
ugggaagauucuguguuuuucc

SEQ ID NO: 302397 - RNA, 22 nt, Homo sapiens
ugggaucagcugggcucucugu

SEQ ID NO: 302398 - RNA, 22 nt, Homo sapiens
ugggaucagucuggaauauuga

SEQ ID NO: 302399 - RNA, 22 nt, Homo sapiens
ugggaugaugcuugagaauauc

SEQ ID NO: 302400 - RNA, 22 nt, Homo sapiens
uggggucguaggugcccgccag

SEQ ID NO: 302401 - RNA, 22 nt, Homo sapiens
ugguaaaaugucauuuaccaga

SEQ ID NO: 302402 - RNA, 22 nt, Homo sapiens
ugguauuuaauauaugagaguu

SEQ ID NO: 302403 - RNA, 22 nt, Homo sapiens
uggucagaaaauuacuugauau

SEQ ID NO: 302404 - RNA, 22 nt, Homo sapiens
uggucauggggcagcugacacu

SEQ ID NO: 302405 - RNA, 22 nt, Homo sapiens
uggucccaugaacuuuagguca

SEQ ID NO: 302406 - RNA, 20 nt, Homo sapiens
ugguccccaccaaaucucau

SEQ ID NO: 302407 - RNA, 22 nt, Homo sapiens
uggugagaaacuagauauuuuu

SEQ ID NO: 302408 - RNA, 22 nt, Homo sapiens
uggugcaaugaagugaucucaa

SEQ ID NO: 302409 - RNA, 22 nt, Homo sapiens
ugguggcuuuucguagguucac

SEQ ID NO: 302410 - RNA, 22 nt, Homo sapiens
ugguuaucauagcuaugcuacu

SEQ ID NO: 302411 - RNA, 22 nt, Homo sapiens
ugguuccauauuaauuuuagga

SEQ ID NO: 302412 - RNA, 22 nt, Homo sapiens
uguaaggcaguuagagcaaauu

SEQ ID NO: 302413 - RNA, 22 nt, Homo sapiens
uguagcacauuugaagagaagc

SEQ ID NO: 302414 - RNA, 22 nt, Homo sapiens
uguauaacucacauugaaguuu

SEQ ID NO: 302415 - RNA, 22 nt, Homo sapiens
ugucaaagagacaucugcacuc

SEQ ID NO: 302416 - RNA, 21 nt, Homo sapiens
ugucaagaugacugcugcggc

SEQ ID NO: 302417 - RNA, 18 nt, Homo sapiens
ugucacuggauaaugguc

SEQ ID NO: 302418 - RNA, 22 nt, Homo sapiens
ugucacugugcagucaugcauu

SEQ ID NO: 302419 - RNA, 22 nt, Homo sapiens
ugucaguguacuguaagaauua

SEQ ID NO: 302420 - RNA, 22 nt, Homo sapiens
ugucaucauuggaaucugccuc

SEQ ID NO: 302421 - RNA, 22 nt, Homo sapiens
ugucauguugguguacugcacc

SEQ ID NO: 302422 - RNA, 22 nt, Homo sapiens
ugucuuggaugaggauuaacag

SEQ ID NO: 302423 - RNA, 22 nt, Homo sapiens
ugucuuugguucaggcaaggag

SEQ ID NO: 302424 - RNA, 22 nt, Homo sapiens
ugugaaacacgaaagucuaaaa

SEQ ID NO: 302425 - RNA, 21 nt, Homo sapiens
ugugaaaucuaggcagagguu

SEQ ID NO: 302426 - RNA, 22 nt, Homo sapiens
cugugguugagcuuugccauga

SEQ ID NO: 302427 - RNA, 18 nt, Homo sapiens
cuuaacauugggaugaua

SEQ ID NO: 302428 - RNA, 22 nt, Homo sapiens
cuuagguuaugauaaauuuagu

SEQ ID NO: 302429 - RNA, 20 nt, Homo sapiens
cuuaucaguggcaaguauaa

SEQ ID NO: 302430 - RNA, 17 nt, Homo sapiens
cuucaaauaauuucccc

SEQ ID NO: 302431 - RNA, 22 nt, Homo sapiens
cuucaaguguggccaccugacc

SEQ ID NO: 302432 - RNA, 22 nt, Homo sapiens
cuucaccaguuuggcagucuca

SEQ ID NO: 302433 - RNA, 22 nt, Homo sapiens
cuuccaaguggggcacgugcca

SEQ ID NO: 302434 - RNA, 22 nt, Homo sapiens
cuugacaaugcuucaggcugaa

SEQ ID NO: 302435 - RNA, 20 nt, Homo sapiens
cuugcuccccuuguucuaga

SEQ ID NO: 302436 - RNA, 22 nt, Homo sapiens
cuuggcacugcucacccuccuu

SEQ ID NO: 302437 - RNA, 22 nt, Homo sapiens
cuuggcuagucaaaccuccccg

SEQ ID NO: 302438 - RNA, 22 nt, Homo sapiens
cuugugauugcacggcugccug

SEQ ID NO: 302439 - RNA, 22 nt, Homo sapiens
cuuguguuacauauuuaagaga

SEQ ID NO: 302440 - RNA, 22 nt, Homo sapiens
cuuguuguggaggggagugcag

SEQ ID NO: 302441 - RNA, 22 nt, Homo sapiens
cuuucacacuguuggugggaau

SEQ ID NO: 302442 - RNA, 22 nt, Homo sapiens
cuuuggagaaaaguucuugggc

SEQ ID NO: 302443 - RNA, 20 nt, Homo sapiens
cuuuggcaaugagaacaggg

SEQ ID NO: 302444 - RNA, 22 nt, Homo sapiens
cuuuggcaaugucauuuucaau

SEQ ID NO: 302445 - RNA, 22 nt, Homo sapiens
cuuugggaccgcgguuuauacu

SEQ ID NO: 302446 - RNA, 23 nt, Homo sapiens
cuuuggucucugguugacuucag

SEQ ID NO: 302447 - RNA, 22 nt, Homo sapiens
cuuugguguauuuucagagacc

SEQ ID NO: 302448 - RNA, 21 nt, Homo sapiens
cuuugguuucugacuugcaua

SEQ ID NO: 302449 - RNA, 22 nt, Homo sapiens
cuuuuacacugcuggugggaau

SEQ ID NO: 302450 - RNA, 22 nt, Homo sapiens
cuuuuacacuguuagugggaau

SEQ ID NO: 302451 - RNA, 22 nt, Homo sapiens
cuuuugugauucuucaguuacu

SEQ ID NO: 302452 - RNA, 22 nt, Homo sapiens
cuuuuugcugcagcaauacugg

SEQ ID NO: 302453 - RNA, 22 nt, Homo sapiens
gaaaauccauccccagggagua

SEQ ID NO: 302454 - RNA, 22 nt, Homo sapiens
gaaagguaggaacagggugcag

SEQ ID NO: 302455 - RNA, 22 nt, Homo sapiens
gaaagugcugcuugacugggau

SEQ ID NO: 302456 - RNA, 22 nt, Homo sapiens
gaaaugcucauuuuggauccuu

SEQ ID NO: 302457 - RNA, 22 nt, Homo sapiens
gaacuggcuuagugaaacuucc

SEQ ID NO: 302458 - RNA, 22 nt, Homo sapiens
gaacuguuucuggugaaagagu

SEQ ID NO: 302459 - RNA, 22 nt, Homo sapiens
gaauagugcugcaguaaacaua

SEQ ID NO: 302460 - RNA, 22 nt, Homo sapiens
gaauagugcugcgauaaacaua

SEQ ID NO: 302461 - RNA, 22 nt, Homo sapiens
gaaucauuguuucuaaguuugu

SEQ ID NO: 302462 - RNA, 22 nt, Homo sapiens
gaaugcuaccagcaucuagugg

SEQ ID NO: 302463 - RNA, 22 nt, Homo sapiens
gacaguuucucaggcuuccuua

SEQ ID NO: 302464 - RNA, 22 nt, Homo sapiens
gacuggagcuguaugugguuac

SEQ ID NO: 302465 - RNA, 20 nt, Homo sapiens
gacuucagaagcuucagagu

SEQ ID NO: 302466 - RNA, 22 nt, Homo sapiens
gagaacuggcgugaacugcacg

SEQ ID NO: 302467 - RNA, 22 nt, Homo sapiens
gagaaguaaauuuauuugcaaa

SEQ ID NO: 302468 - RNA, 22 nt, Homo sapiens
gagaaugagauuaugguuacau

SEQ ID NO: 302469 - RNA, 22 nt, Homo sapiens
gagacggagucucgcucuguca

SEQ ID NO: 302470 - RNA, 22 nt, Homo sapiens
gagacugagucucacucuguca

SEQ ID NO: 302471 - RNA, 22 nt, Homo sapiens
gagacugagucuugcucugucg

SEQ ID NO: 302472 - RNA, 22 nt, Homo sapiens
gagauacuugguuucuguuucu

SEQ ID NO: 302473 - RNA, 22 nt, Homo sapiens
gagaucaucuaaucuggccucu

SEQ ID NO: 302474 - RNA, 22 nt, Homo sapiens
gagauguuuguuucacugucac

SEQ ID NO: 302475 - RNA, 22 nt, Homo sapiens
gagauucuucaauauuuauucu

SEQ ID NO: 302476 - RNA, 22 nt, Homo sapiens
gagauuuucagcuugacuggga

SEQ ID NO: 302477 - RNA, 22 nt, Homo sapiens
gagcaaaaguauguauugguua

SEQ ID NO: 302478 - RNA, 22 nt, Homo sapiens
gagcaacaguggcagugguggg

SEQ ID NO: 302479 - RNA, 22 nt, Homo sapiens
gagcuuguagugugaaugguau

SEQ ID NO: 302480 - RNA, 22 nt, Homo sapiens
gagcuuguggucuucguguuau

SEQ ID NO: 302481 - RNA, 22 nt, Homo sapiens
gaggaaguagcuacugucuuuc

SEQ ID NO: 302482 - RNA, 22 nt, Homo sapiens
gaggcaaguggccaccgagucu

SEQ ID NO: 302483 - RNA, 22 nt, Homo sapiens
gaggcacucuguacaaaucugc

SEQ ID NO: 302484 - RNA, 22 nt, Homo sapiens
gaggcuagauggggaugugucc

SEQ ID NO: 302485 - RNA, 22 nt, Homo sapiens
gagggcacugcuuuccuuucaa

SEQ ID NO: 302486 - RNA, 22 nt, Homo sapiens
gagguagaauguuuuucagcug

SEQ ID NO: 302487 - RNA, 22 nt, Homo sapiens
gaggugaaggucucaauaaaua

SEQ ID NO: 302488 - RNA, 22 nt, Homo sapiens
gaggugguagguucacagcagc

SEQ ID NO: 302489 - RNA, 22 nt, Homo sapiens
gagucuauucaauguaguuaga

SEQ ID NO: 302490 - RNA, 22 nt, Homo sapiens
gaguucaauuuccagcuguucu

SEQ ID NO: 302491 - RNA, 22 nt, Homo sapiens
gauaaagauagcaauagggaca

SEQ ID NO: 302492 - RNA, 22 nt, Homo sapiens
gauaauucuagcagauacaggc

SEQ ID NO: 302493 - RNA, 22 nt, Homo sapiens
gauagguucuaagcagguguug

SEQ ID NO: 302494 - RNA, 21 nt, Homo sapiens
gauaugacauggguaaaacca

SEQ ID NO: 302495 - RNA, 22 nt, Homo sapiens
gauauguugaguagaguuuuug

SEQ ID NO: 302496 - RNA, 20 nt, Homo sapiens
gaucaguuuggaguaagugc

SEQ ID NO: 302497 - RNA, 22 nt, Homo sapiens
gaucucaguggauacugugaug

SEQ ID NO: 302498 - RNA, 22 nt, Homo sapiens
gaugagaucauaaguguggagc

SEQ ID NO: 302499 - RNA, 22 nt, Homo sapiens
gaugagguaguguaccuagucu

SEQ ID NO: 302500 - RNA, 22 nt, Homo sapiens
gaugaucucuggugguaaagac

SEQ ID NO: 302501 - RNA, 22 nt, Homo sapiens
gaugccuuuuuguccucaguua

SEQ ID NO: 302502 - RNA, 22 nt, Homo sapiens
gauggcagugcagccccuggcu

SEQ ID NO: 302503 - RNA, 22 nt, Homo sapiens
gaugguuuucaccugcaugcuu

SEQ ID NO: 302504 - RNA, 22 nt, Homo sapiens
gauguguuuuaggaucucagca

SEQ ID NO: 302505 - RNA, 22 nt, Homo sapiens
gauuccauugcgaauuuucaga

SEQ ID NO: 302506 - RNA, 22 nt, Homo sapiens
gauuugguguucuggcucaaga

SEQ ID NO: 302507 - RNA, 22 nt, Homo sapiens
gcaaaauugagaagggaauaua

SEQ ID NO: 302508 - RNA, 22 nt, Homo sapiens
gcaaagaaugcagauuugccuc

SEQ ID NO: 302509 - RNA, 22 nt, Homo sapiens
gcaaaguguuuuuaggaagucu

SEQ ID NO: 302510 - RNA, 22 nt, Homo sapiens
gcaagaugagagcccgggcagu

SEQ ID NO: 302511 - RNA, 22 nt, Homo sapiens
gcaagugucugagguuuuguau

SEQ ID NO: 302512 - RNA, 22 nt, Homo sapiens
gcacagucaacacuuauucacc

SEQ ID NO: 302513 - RNA, 22 nt, Homo sapiens
gcacaguguuacuugauauauu

SEQ ID NO: 302514 - RNA, 22 nt, Homo sapiens
gcagcagugcccuggauggaaa

SEQ ID NO: 302515 - RNA, 22 nt, Homo sapiens
gcagguauuagagagccugaaa

SEQ ID NO: 302516 - RNA, 17 nt, Homo sapiens
gcaguacuuaguaagga

SEQ ID NO: 302517 - RNA, 22 nt, Homo sapiens
gcaguacuuuauguccuaauua

SEQ ID NO: 302518 - RNA, 22 nt, Homo sapiens
gcagugcaguggcgcgaucucg

SEQ ID NO: 302519 - RNA, 16 nt, Homo sapiens
gcaguguguuuaauag

SEQ ID NO: 302520 - RNA, 22 nt, Homo sapiens
gcaguguucugggcaggaagaa

SEQ ID NO: 302521 - RNA, 22 nt, Homo sapiens
gcauaaagcuaauaagacgaag

SEQ ID NO: 302522 - RNA, 22 nt, Homo sapiens
gcauauuuuaaaguguaaccug

SEQ ID NO: 302523 - RNA, 22 nt, Homo sapiens
gcaucacagggagacaggccuc

SEQ ID NO: 302524 - RNA, 19 nt, Homo sapiens
gcaucauuaguugcuuuuc

SEQ ID NO: 302525 - RNA, 22 nt, Homo sapiens
gcauggaguggaaauucuuggg

SEQ ID NO: 302526 - RNA, 22 nt, Homo sapiens
gccaagauuuaauucaucaguu

SEQ ID NO: 302527 - RNA, 19 nt, Homo sapiens
gccaccuggugcguguucu

SEQ ID NO: 302528 - RNA, 22 nt, Homo sapiens
gcccuguugcccaggcuggagu

SEQ ID NO: 302529 - RNA, 22 nt, Homo sapiens
gccuagauccaaauauggugca

SEQ ID NO: 302530 - RNA, 22 nt, Homo sapiens
gcggguguuuuacccuugcaga

SEQ ID NO: 302531 - RNA, 22 nt, Homo sapiens
gcuacugucuaucugugcuucu

SEQ ID NO: 302532 - RNA, 22 nt, Homo sapiens
ugaucaaagugcuggaauuaca

SEQ ID NO: 302533 - RNA, 22 nt, Homo sapiens
ugauccccucacauuauuauau

SEQ ID NO: 302534 - RNA, 22 nt, Homo sapiens
ugaucucauuagcaccuuuagc

SEQ ID NO: 302535 - RNA, 22 nt, Homo sapiens
ugaugacacugauuucuucaau

SEQ ID NO: 302536 - RNA, 22 nt, Homo sapiens
ugauguugacuguaggcagaga

SEQ ID NO: 302537 - RNA, 20 nt, Homo sapiens
ugauuaguccacuuggcucu

SEQ ID NO: 302538 - RNA, 22 nt, Homo sapiens
ugauuugucucucagcccuacu

SEQ ID NO: 302539 - RNA, 22 nt, Homo sapiens
ugcaaaguccucauucuuaccc

SEQ ID NO: 302540 - RNA, 20 nt, Homo sapiens
ugcaaguugccuuuggaggc

SEQ ID NO: 302541 - RNA, 22 nt, Homo sapiens
ugcaccacugcacuccagcuug

SEQ ID NO: 302542 - RNA, 22 nt, Homo sapiens
ugcaccacugcacugccugggu

SEQ ID NO: 302543 - RNA, 22 nt, Homo sapiens
ugcaccaucuugcuucuguggu

SEQ ID NO: 302544 - RNA, 17 nt, Homo sapiens
ugcagcacacugauggg

SEQ ID NO: 302545 - RNA, 22 nt, Homo sapiens
ugcagcacaguagguuugcaau

SEQ ID NO: 302546 - RNA, 22 nt, Homo sapiens
ugcagugcaugacuguguuaug

SEQ ID NO: 302547 - RNA, 22 nt, Homo sapiens
ugcauaugucuuuauaguagca

SEQ ID NO: 302548 - RNA, 22 nt, Homo sapiens
ugcauauguugaaccaggcuug

SEQ ID NO: 302549 - RNA, 22 nt, Homo sapiens
ugcaugcaucuuuuauaguagc

SEQ ID NO: 302550 - RNA, 22 nt, Homo sapiens
ugcauuguuuagaaacacuggg

SEQ ID NO: 302551 - RNA, 22 nt, Homo sapiens
ugccagaugcaguguucaacaa

SEQ ID NO: 302552 - RNA, 22 nt, Homo sapiens
ugccaguauuuuauuaagaauu

SEQ ID NO: 302553 - RNA, 22 nt, Homo sapiens
ugccaugaagagaggaagcagu

SEQ ID NO: 302554 - RNA, 22 nt, Homo sapiens
ugcccguaauuccagcacuuug

SEQ ID NO: 302555 - RNA, 22 nt, Homo sapiens
ugccuaguagaaggugaacaug

SEQ ID NO: 302556 - RNA, 22 nt, Homo sapiens
ugcuaucauugauuagugaugu

SEQ ID NO: 302557 - RNA, 21 nt, Homo sapiens
ugcucaugaguaaugcaguga

SEQ ID NO: 302558 - RNA, 18 nt, Homo sapiens
ugcuuagucauuuucaau

SEQ ID NO: 302559 - RNA, 22 nt, Homo sapiens
ugcuuagucuugcuuuagcuau

SEQ ID NO: 302560 - RNA, 22 nt, Homo sapiens
uggaaaacaugcacauuggauu

SEQ ID NO: 302561 - RNA, 22 nt, Homo sapiens
uggaaaauuaggggagguuaua

SEQ ID NO: 302562 - RNA, 22 nt, Homo sapiens
uggaaaguaguucuaaucuaag

SEQ ID NO: 302563 - RNA, 22 nt, Homo sapiens
uggaaauaaaauagaguuugcc

SEQ ID NO: 302564 - RNA, 22 nt, Homo sapiens
uggaaauaaaugugccaagauc

SEQ ID NO: 302565 - RNA, 22 nt, Homo sapiens
uggaagacauugggugaagggu

SEQ ID NO: 302566 - RNA, 22 nt, Homo sapiens
uugcaaggugcagcuuaugcaa

SEQ ID NO: 302567 - RNA, 22 nt, Homo sapiens
uugcacaauggaauuuaucuuu

SEQ ID NO: 302568 - RNA, 22 nt, Homo sapiens
uugcacagugcuuucuuugccc

SEQ ID NO: 302569 - RNA, 22 nt, Homo sapiens
uugcacagugguuuagagccug

SEQ ID NO: 302570 - RNA, 22 nt, Homo sapiens
uugcacauugauuuuguauccu

SEQ ID NO: 302571 - RNA, 22 nt, Homo sapiens
uugcauauguugaaccaagcgu

SEQ ID NO: 302572 - RNA, 22 nt, Homo sapiens
uugcauauucucugaggcagga

SEQ ID NO: 302573 - RNA, 22 nt, Homo sapiens
uugccuauucacucugaugaua

SEQ ID NO: 302574 - RNA, 22 nt, Homo sapiens
uugcgcuuuuccuauguugccc

SEQ ID NO: 302575 - RNA, 22 nt, Homo sapiens
uugcuacuuggauguacaugug

SEQ ID NO: 302576 - RNA, 22 nt, Homo sapiens
uugcuccucugccaggaccugu

SEQ ID NO: 302577 - RNA, 22 nt, Homo sapiens
uugcuucuuucgucuggcccca

SEQ ID NO: 302578 - RNA, 22 nt, Homo sapiens
uuggaaacgucaccuuuuccuu

SEQ ID NO: 302579 - RNA, 22 nt, Homo sapiens
uuggaauacuuguuaaagucca

SEQ ID NO: 302580 - RNA, 22 nt, Homo sapiens
uuggacaagauugcagagaauu

SEQ ID NO: 302581 - RNA, 22 nt, Homo sapiens
uuggagugugcucauaacugcu

SEQ ID NO: 302582 - RNA, 22 nt, Homo sapiens
uuggcaaaugucacaaaucagg

SEQ ID NO: 302583 - RNA, 22 nt, Homo sapiens
uuggcaagaaccuucuuccaag

SEQ ID NO: 302584 - RNA, 22 nt, Homo sapiens
uuggcaauauuuacugaaguug

SEQ ID NO: 302585 - RNA, 22 nt, Homo sapiens
uuggcaaucaauucugacgucu

SEQ ID NO: 302586 - RNA, 22 nt, Homo sapiens
uuggcacuugauaauauucugg

SEQ ID NO: 302587 - RNA, 20 nt, Homo sapiens
uuggcagagucuuuagggua

SEQ ID NO: 302588 - RNA, 22 nt, Homo sapiens
uuggcagucugaggcacagacu

SEQ ID NO: 302589 - RNA, 22 nt, Homo sapiens
uuggcauuguggauggaaucau

SEQ ID NO: 302590 - RNA, 22 nt, Homo sapiens
uuggccccuccaaaucucaugu

SEQ ID NO: 302591 - RNA, 21 nt, Homo sapiens
uuggccuggaggccugaaugu

SEQ ID NO: 302592 - RNA, 22 nt, Homo sapiens
uuggcuguguuuauaugcugga

SEQ ID NO: 302593 - RNA, 22 nt, Homo sapiens
uuggcuuaguugaccacagucu

SEQ ID NO: 302594 - RNA, 22 nt, Homo sapiens
uuggcuucuggacuauugugca

SEQ ID NO: 302595 - RNA, 22 nt, Homo sapiens
uugggagugucucuggacugca

SEQ ID NO: 302596 - RNA, 22 nt, Homo sapiens
uuggggcacggccucuguugcc

SEQ ID NO: 302597 - RNA, 22 nt, Homo sapiens
uugggucaguuccuugacuccu

SEQ ID NO: 302598 - RNA, 22 nt, Homo sapiens
uuggguccucugguccuugguu

SEQ ID NO: 302599 - RNA, 22 nt, Homo sapiens
uugguacuaaaaaguagggugu

SEQ ID NO: 302600 - RNA, 22 nt, Homo sapiens
uugguacuagcugaucgcagag

SEQ ID NO: 302601 - RNA, 22 nt, Homo sapiens
uugguucaguuuaacgaguaau

SEQ ID NO: 302602 - RNA, 22 nt, Homo sapiens
uuguaaucaacacaucauuggg

SEQ ID NO: 302603 - RNA, 22 nt, Homo sapiens
uuguaguagcauuauuuauaau

SEQ ID NO: 302604 - RNA, 22 nt, Homo sapiens
uuguauguuucugugcacauga

SEQ ID NO: 302605 - RNA, 22 nt, Homo sapiens
uugucaaugggugagugcagag

SEQ ID NO: 302606 - RNA, 22 nt, Homo sapiens
uugucacuauaaauaagcauuu

SEQ ID NO: 302607 - RNA, 22 nt, Homo sapiens
uugucacugcacuccagucugg

SEQ ID NO: 302608 - RNA, 22 nt, Homo sapiens
uugucauuuucagaguguuacg

SEQ ID NO: 302609 - RNA, 22 nt, Homo sapiens
uugugcuccugugagaaucuag

SEQ ID NO: 302610 - RNA, 22 nt, Homo sapiens
uugugcuuaauaaaaaguggua

SEQ ID NO: 302611 - RNA, 22 nt, Homo sapiens
uugugcuugauuugccuagcug

SEQ ID NO: 302612 - RNA, 22 nt, Homo sapiens
uugugcuuuugagcugagauga

SEQ ID NO: 302613 - RNA, 22 nt, Homo sapiens
uugugguaggaguugccauguu

SEQ ID NO: 302614 - RNA, 22 nt, Homo sapiens
uugugguagugaaugagucuca

SEQ ID NO: 302615 - RNA, 22 nt, Homo sapiens
uugugguuuuaucuaccuuugg

SEQ ID NO: 302616 - RNA, 17 nt, Homo sapiens
uuguucccauuaaaaag

SEQ ID NO: 302617 - RNA, 22 nt, Homo sapiens
uuguucccuucuggcuuuuaug

SEQ ID NO: 302618 - RNA, 22 nt, Homo sapiens
uuuaaacugucuuggguuugga

SEQ ID NO: 302619 - RNA, 21 nt, Homo sapiens
uuuacuguggacccauugcuu

SEQ ID NO: 302620 - RNA, 22 nt, Homo sapiens
uuuagcaaagcaauuuacacca

SEQ ID NO: 302621 - RNA, 22 nt, Homo sapiens
uuuagcagcaaagagcuguguu

SEQ ID NO: 302622 - RNA, 22 nt, Homo sapiens
uuuauucggcuaggagcuucgg

SEQ ID NO: 302623 - RNA, 22 nt, Homo sapiens
uuucacaguguucucccccaga

SEQ ID NO: 302624 - RNA, 22 nt, Homo sapiens
uuucaccguguuggccaggcug

SEQ ID NO: 302625 - RNA, 21 nt, Homo sapiens
uuucacugugaguuuuucugu

SEQ ID NO: 302626 - RNA, 20 nt, Homo sapiens
uuucaguacuuucuacuggc

SEQ ID NO: 302627 - RNA, 22 nt, Homo sapiens
uuucaguagagacacgguuuug

SEQ ID NO: 302628 - RNA, 18 nt, Homo sapiens
uuucauugagugugauau

SEQ ID NO: 302629 - RNA, 22 nt, Homo sapiens
uuuccaagaugcuuacuuucuc

SEQ ID NO: 302630 - RNA, 22 nt, Homo sapiens
uuucccagugguacaguuuaua

SEQ ID NO: 302631 - RNA, 16 nt, Homo sapiens
uuucccuuugguguuu

SEQ ID NO: 302632 - RNA, 22 nt, Homo sapiens
uuucugggggugcugauggaaa

SEQ ID NO: 302633 - RNA, 22 nt, Homo sapiens
acaucuguacaguggguguggu

SEQ ID NO: 302634 - RNA, 22 nt, Homo sapiens
acaugcauauguuggaagaaag

SEQ ID NO: 302635 - RNA, 22 nt, Homo sapiens
acauguaauugauuuuguguua

SEQ ID NO: 302636 - RNA, 23 nt, Homo sapiens
acauguauagacuuuuuuuccuu

SEQ ID NO: 302637 - RNA, 22 nt, Homo sapiens
accacagugcuuccugcucacg

SEQ ID NO: 302638 - RNA, 17 nt, Homo sapiens
accagugcaugugcuuu

SEQ ID NO: 302639 - RNA, 22 nt, Homo sapiens
acccacuagaugccaguggcac

SEQ ID NO: 302640 - RNA, 22 nt, Homo sapiens
acccagaagucauucaggaaca

SEQ ID NO: 302641 - RNA, 22 nt, Homo sapiens
acccaguagccagauguagcug

SEQ ID NO: 302642 - RNA, 22 nt, Homo sapiens
acccaguagucauucaggagca

SEQ ID NO: 302643 - RNA, 22 nt, Homo sapiens
acccaguguucagacuaccugu

SEQ ID NO: 302644 - RNA, 22 nt, Homo sapiens
acccugcuaaacagcccccugc

SEQ ID NO: 302645 - RNA, 22 nt, Homo sapiens
acccugguagcuaugaagucuu

SEQ ID NO: 302646 - RNA, 22 nt, Homo sapiens
acccugucacucccaucaauuu

SEQ ID NO: 302647 - RNA, 22 nt, Homo sapiens
accuggacacuuugggcuccuc

SEQ ID NO: 302648 - RNA, 22 nt, Homo sapiens
acuacauaugacaucuucuuua

SEQ ID NO: 302649 - RNA, 22 nt, Homo sapiens
acucacagcaaccuccgccucc

SEQ ID NO: 302650 - RNA, 22 nt, Homo sapiens
acucagagaacauucccagucu

SEQ ID NO: 302651 - RNA, 22 nt, Homo sapiens
acugagucauugggugcccaga

SEQ ID NO: 302652 - RNA, 20 nt, Homo sapiens
acugauauguuccuguucuc

SEQ ID NO: 302653 - RNA, 22 nt, Homo sapiens
acugcacuccagccuucgugac

SEQ ID NO: 302654 - RNA, 22 nt, Homo sapiens
acuggcuuauuucacuuagcau

SEQ ID NO: 302655 - RNA, 20 nt, Homo sapiens
acugggcuaccgaaguaagg

SEQ ID NO: 302656 - RNA, 22 nt, Homo sapiens
acugguguaugggaggucccaa

SEQ ID NO: 302657 - RNA, 17 nt, Homo sapiens
acuuuuugaggaggcau

SEQ ID NO: 302658 - RNA, 22 nt, Homo sapiens
acuuuuugaugaggucguuugu

SEQ ID NO: 302659 - RNA, 22 nt, Homo sapiens
agaaacacagguggaauugcuu

SEQ ID NO: 302660 - RNA, 22 nt, Homo sapiens
agaaagugcuucccuuugguga

SEQ ID NO: 302661 - RNA, 23 nt, Homo sapiens
agaaaugucuauucagggucccu

SEQ ID NO: 302662 - RNA, 22 nt, Homo sapiens
agagccacacucuccuaacuca

SEQ ID NO: 302663 - RNA, 22 nt, Homo sapiens
agaggaguacuacuccaagucu

SEQ ID NO: 302664 - RNA, 22 nt, Homo sapiens
agagguagaagauaggcuacag

SEQ ID NO: 302665 - RNA, 22 nt, Homo sapiens
agaguaguaggaugaauggacu

SEQ ID NO: 302666 - RNA, 20 nt, Homo sapiens
agagugcuggacugaggagc

SEQ ID NO: 302667 - RNA, 22 nt, Homo sapiens
agauauguuauugauguuaaug

SEQ ID NO: 302668 - RNA, 22 nt, Homo sapiens
agauauguuuaguuucaaaaug

SEQ ID NO: 302669 - RNA, 22 nt, Homo sapiens
agauauuuguuaggucugucag

SEQ ID NO: 302670 - RNA, 22 nt, Homo sapiens
agaucacaguaccguaaggcug

SEQ ID NO: 302671 - RNA, 22 nt, Homo sapiens
agcaacauuuuugaccuuucuu

SEQ ID NO: 302672 - RNA, 22 nt, Homo sapiens
agcaccaauaacaguuucuagc

SEQ ID NO: 302673 - RNA, 22 nt, Homo sapiens
agcagagcaguggauuuuguga

SEQ ID NO: 302674 - RNA, 22 nt, Homo sapiens
agcagagcauauucauucgggg

SEQ ID NO: 302675 - RNA, 22 nt, Homo sapiens
agcagcacaucccuuucuggcc

SEQ ID NO: 302676 - RNA, 20 nt, Homo sapiens
agcagccacagauuccucag

SEQ ID NO: 302677 - RNA, 22 nt, Homo sapiens
agcagguguccacaauguuugc

SEQ ID NO: 302678 - RNA, 22 nt, Homo sapiens
agcaucauguuuucgagguuca

SEQ ID NO: 302679 - RNA, 22 nt, Homo sapiens
agccccauuuguugaaaagacg

SEQ ID NO: 302680 - RNA, 22 nt, Homo sapiens
agcuagugugauucuuuggggu

SEQ ID NO: 302681 - RNA, 22 nt, Homo sapiens
ucacagugaguggaguggggug

SEQ ID NO: 302682 - RNA, 23 nt, Homo sapiens
ucacaguuacuuuugcaucaacc

SEQ ID NO: 302683 - RNA, 22 nt, Homo sapiens
ucacaguucagcauggcugagg

SEQ ID NO: 302684 - RNA, 22 nt, Homo sapiens
ucaccaguacuccaaauugagg

SEQ ID NO: 302685 - RNA, 22 nt, Homo sapiens
ucaccagugucagggaacugcu

SEQ ID NO: 302686 - RNA, 22 nt, Homo sapiens
ucacccacacaggagacaggga

SEQ ID NO: 302687 - RNA, 22 nt, Homo sapiens
ucaccuugcacaguuguguggg

SEQ ID NO: 302688 - RNA, 22 nt, Homo sapiens
ucacgugguucauaaggcagaa

SEQ ID NO: 302689 - RNA, 22 nt, Homo sapiens
ucacuagaucaagggagagaaa

SEQ ID NO: 302690 - RNA, 22 nt, Homo sapiens
ucacugagcacaggagaugugc

SEQ ID NO: 302691 - RNA, 22 nt, Homo sapiens
ucacugcacuccagccuuuaug

SEQ ID NO: 302692 - RNA, 19 nt, Homo sapiens
ucacuggacagcacacuca

SEQ ID NO: 302693 - RNA, 22 nt, Homo sapiens
ucagagucuagaucacucacug

SEQ ID NO: 302694 - RNA, 22 nt, Homo sapiens
ucagauguuuuguuuaucugcu

SEQ ID NO: 302695 - RNA, 22 nt, Homo sapiens
ucagcacauucaaggccugccu

SEQ ID NO: 302696 - RNA, 19 nt, Homo sapiens
ucagcaguaaucaacuuca

SEQ ID NO: 302697 - RNA, 22 nt, Homo sapiens
ucagcagugugaaaacaaacua

SEQ ID NO: 302698 - RNA, 22 nt, Homo sapiens
ucaggcacucagcuuagagucu

SEQ ID NO: 302699 - RNA, 22 nt, Homo sapiens
ucaggcaugcagcaaugcagug

SEQ ID NO: 302700 - RNA, 20 nt, Homo sapiens
ucaggcuccgcauuaacuua

SEQ ID NO: 302701 - RNA, 23 nt, Homo sapiens
ucaguacucuauaagugccagcu

SEQ ID NO: 302702 - RNA, 22 nt, Homo sapiens
ucagucauguuuaccagacgua

SEQ ID NO: 302703 - RNA, 22 nt, Homo sapiens
ucagugaauauauaacagcgau

SEQ ID NO: 302704 - RNA, 21 nt, Homo sapiens
ucagugcaauucuauggggaa

SEQ ID NO: 302705 - RNA, 20 nt, Homo sapiens
ucagugcagauuguccaagu

SEQ ID NO: 302706 - RNA, 22 nt, Homo sapiens
ucagugcuuggcacagagagcu

SEQ ID NO: 302707 - RNA, 22 nt, Homo sapiens
ucaguggagagcuuccaggauu

SEQ ID NO: 302708 - RNA, 22 nt, Homo sapiens
ucauaugucauaguaugaucuu

SEQ ID NO: 302709 - RNA, 21 nt, Homo sapiens
ucaugccacugcacuuuagcc

SEQ ID NO: 302710 - RNA, 19 nt, Homo sapiens
ucauggcuuuuucagcugu

SEQ ID NO: 302711 - RNA, 22 nt, Homo sapiens
ucauuggaugucugaaaugauu

SEQ ID NO: 302712 - RNA, 19 nt, Homo sapiens
uccaccgcgugcaccucua

SEQ ID NO: 302713 - RNA, 17 nt, Homo sapiens
uccagauuucaauugaa

SEQ ID NO: 302714 - RNA, 22 nt, Homo sapiens
uccagugugcaggcaaguuuga

SEQ ID NO: 302715 - RNA, 22 nt, Homo sapiens
uccaguuuucuuuccuagggcu

SEQ ID NO: 302716 - RNA, 22 nt, Homo sapiens
uccauguagaugcuauguuguc

SEQ ID NO: 302717 - RNA, 22 nt, Homo sapiens
uccaugugaaaaggucgugaua

SEQ ID NO: 302718 - RNA, 16 nt, Homo sapiens
ucccaccauugcuugu

SEQ ID NO: 302719 - RNA, 22 nt, Homo sapiens
ucccacugucuucucgugcucg

SEQ ID NO: 302720 - RNA, 22 nt, Homo sapiens
ucccagugcuaugcaaaagccu

SEQ ID NO: 302721 - RNA, 22 nt, Homo sapiens
ucccugaguaucuaauguguuu

SEQ ID NO: 302722 - RNA, 22 nt, Homo sapiens
uccuucacucuacaucuuuguu

SEQ ID NO: 302723 - RNA, 22 nt, Homo sapiens
uccuugagucuuugcucagaug

SEQ ID NO: 302724 - RNA, 21 nt, Homo sapiens
uccuuggugaugcccugcagu

SEQ ID NO: 302725 - RNA, 23 nt, Homo sapiens
uccuugguuggcgcccuaugugu

SEQ ID NO: 302726 - RNA, 22 nt, Homo sapiens
uccuuugguucuugucacccca

SEQ ID NO: 302727 - RNA, 18 nt, Homo sapiens
uccuuuugggguaggaga

SEQ ID NO: 302728 - RNA, 22 nt, Homo sapiens
ucgcugggaaccagagguaaag

SEQ ID NO: 302729 - RNA, 22 nt, Homo sapiens
ucuaagaauucauuuauaagcc

SEQ ID NO: 302730 - RNA, 22 nt, Homo sapiens
ucucaagaugguagaugggaau

SEQ ID NO: 302731 - RNA, 22 nt, Homo sapiens
ucucaaguaacugggacaauaa

SEQ ID NO: 302732 - RNA, 22 nt, Homo sapiens
ucucaauuugauuacauucaua

SEQ ID NO: 302733 - RNA, 19 nt, Homo sapiens
ucucacagcucuacuaugu

SEQ ID NO: 302734 - RNA, 22 nt, Homo sapiens
ucucagagccuaggguuuuuca

SEQ ID NO: 302735 - RNA, 22 nt, Homo sapiens
ucucaguuuucuggggaagaaa

SEQ ID NO: 302736 - RNA, 20 nt, Homo sapiens
ucucauggagggaaagagca

SEQ ID NO: 302737 - RNA, 22 nt, Homo sapiens
ucuccauuuguaaggguuucuc

SEQ ID NO: 302738 - RNA, 20 nt, Homo sapiens
ucucccaaacagcaggcccu

SEQ ID NO: 302739 - RNA, 19 nt, Homo sapiens
ucugacagccccagucaac

SEQ ID NO: 302740 - RNA, 22 nt, Homo sapiens
ucugacucuggagucucagguu

SEQ ID NO: 302741 - RNA, 23 nt, Homo sapiens
ucuggaucauucguagugccagc

SEQ ID NO: 302742 - RNA, 16 nt, Homo sapiens
ucuggcucuacaguuc

SEQ ID NO: 302743 - RNA, 18 nt, Homo sapiens
ucuggcuucuuuguucca

SEQ ID NO: 302744 - RNA, 22 nt, Homo sapiens
ucugggguuuccacuuuuacuu

SEQ ID NO: 302745 - RNA, 22 nt, Homo sapiens
ucugguguuauucauguaguuu

SEQ ID NO: 302746 - RNA, 22 nt, Homo sapiens
ucugugcauuguaacaacuaaa

SEQ ID NO: 302747 - RNA, 22 nt, Homo sapiens
ucugugcuugucauaugcuuug

SEQ ID NO: 302748 - RNA, 18 nt, Homo sapiens
ucugugguguaaauacgu

SEQ ID NO: 302749 - RNA, 22 nt, Homo sapiens
ucuguguugaucacacugggag

SEQ ID NO: 302750 - RNA, 22 nt, Homo sapiens
ucuuaguuuagauuagcaauuc

SEQ ID NO: 302751 - RNA, 22 nt, Homo sapiens
ucuugcuuguuguucccuucau

SEQ ID NO: 302752 - RNA, 22 nt, Homo sapiens
ucuuggcaaagaauuuuuggcu

SEQ ID NO: 302753 - RNA, 21 nt, Homo sapiens
ucuuggguugaauucucccag

SEQ ID NO: 302754 - RNA, 20 nt, Homo sapiens
ucuuucgguuaccaggcagu

SEQ ID NO: 302755 - RNA, 22 nt, Homo sapiens
ucuuugccuaacccaaggucau

SEQ ID NO: 302756 - RNA, 22 nt, Homo sapiens
ucuuuggguagauauguagcug

SEQ ID NO: 302757 - RNA, 22 nt, Homo sapiens
ucuuugguuagguuuaguugau

SEQ ID NO: 302758 - RNA, 22 nt, Homo sapiens
ucuuugucuacauccuguuaaa

SEQ ID NO: 302759 - RNA, 22 nt, Homo sapiens
ucuuuugggccucuugucagac

SEQ ID NO: 302760 - RNA, 20 nt, Homo sapiens
ucuuuuuguggccccagagu

SEQ ID NO: 302761 - RNA, 22 nt, Homo sapiens
ugaaacacacagagaagggaga

SEQ ID NO: 302762 - RNA, 18 nt, Homo sapiens
ugaaacacauuuuuuccu

SEQ ID NO: 302763 - RNA, 22 nt, Homo sapiens
ugaaagcuacagucuccuagga

SEQ ID NO: 302764 - RNA, 22 nt, Homo sapiens
ugaaaucauguaguuauugcaa

SEQ ID NO: 302765 - RNA, 20 nt, Homo sapiens
ugaaaucuucacuaagucuc

SEQ ID NO: 302766 - RNA, 22 nt, Homo sapiens
ugaaauguaaguugucuagucu

SEQ ID NO: 302767 - RNA, 22 nt, Homo sapiens
ugaaauguugggugauggaauc

SEQ ID NO: 302768 - RNA, 22 nt, Homo sapiens
ugaagagucuaaaucugucuuc

SEQ ID NO: 302769 - RNA, 22 nt, Homo sapiens
ugaauacugugcaaaggauuug

SEQ ID NO: 302770 - RNA, 22 nt, Homo sapiens
ugaauagaaguuuacuccuuuu

SEQ ID NO: 302771 - RNA, 22 nt, Homo sapiens
ugaauauguuucuaaaagugca

SEQ ID NO: 302772 - RNA, 22 nt, Homo sapiens
ugacaagaguagagagggugcc

SEQ ID NO: 302773 - RNA, 22 nt, Homo sapiens
ugacaggagauuaugugauguu

SEQ ID NO: 302774 - RNA, 22 nt, Homo sapiens
ugacaguaaacagucuugauua

SEQ ID NO: 302775 - RNA, 22 nt, Homo sapiens
ugacaugaugagcaauaauggc

SEQ ID NO: 302776 - RNA, 22 nt, Homo sapiens
ugacuaaaacugaguuucauua

SEQ ID NO: 302777 - RNA, 22 nt, Homo sapiens
ugacuaggaaauuagaacuuuu

SEQ ID NO: 302778 - RNA, 22 nt, Homo sapiens
ugacuauugauuuagacgugcu

SEQ ID NO: 302779 - RNA, 22 nt, Homo sapiens
ugacuucauuugguaauugggu

SEQ ID NO: 302780 - RNA, 20 nt, Homo sapiens
ugagaacauguggcauuugg

SEQ ID NO: 302781 - RNA, 19 nt, Homo sapiens
ugagaaccucuacagaguc

SEQ ID NO: 302782 - RNA, 22 nt, Homo sapiens
ugagaagcauaccagugucugu

SEQ ID NO: 302783 - RNA, 22 nt, Homo sapiens
ugagaaugacugggcaugcugc

SEQ ID NO: 302784 - RNA, 22 nt, Homo sapiens
ugagaaugaugauugguaaacc

SEQ ID NO: 302785 - RNA, 22 nt, Homo sapiens
uucacugcacuccagccugggu

SEQ ID NO: 302786 - RNA, 22 nt, Homo sapiens
uucagaguggacagaaauuaag

SEQ ID NO: 302787 - RNA, 19 nt, Homo sapiens
uucagcagugucugcucuu

SEQ ID NO: 302788 - RNA, 22 nt, Homo sapiens
uucaggcuccgugccagcuccg

SEQ ID NO: 302789 - RNA, 22 nt, Homo sapiens
uucaguacuucaaaaucuuuaa

SEQ ID NO: 302790 - RNA, 18 nt, Homo sapiens
uucauaguagcaugauuu

SEQ ID NO: 302791 - RNA, 22 nt, Homo sapiens
uucauagucuaugcaaguaaga

SEQ ID NO: 302792 - RNA, 22 nt, Homo sapiens
uucaucaguugagcugguugcu

SEQ ID NO: 302793 - RNA, 22 nt, Homo sapiens
uucauccccuccaaaucucaug

SEQ ID NO: 302794 - RNA, 22 nt, Homo sapiens
uucauggacucaauaguuucgc

SEQ ID NO: 302795 - RNA, 22 nt, Homo sapiens
uucauguagucaucauccugcu

SEQ ID NO: 302796 - RNA, 22 nt, Homo sapiens
uuccacaauggcugaacuaguu

SEQ ID NO: 302797 - RNA, 22 nt, Homo sapiens
uuccagcugggggcaacucugc

SEQ ID NO: 302798 - RNA, 22 nt, Homo sapiens
uuccagugggacgagaugugga

SEQ ID NO: 302799 - RNA, 22 nt, Homo sapiens
uuccaguuauuauaccucuuaa

SEQ ID NO: 302800 - RNA, 22 nt, Homo sapiens
uuccaugagaugcaucaaagcu

SEQ ID NO: 302801 - RNA, 22 nt, Homo sapiens
uuccauguaguugagcaguuuu

SEQ ID NO: 302802 - RNA, 22 nt, Homo sapiens
uuccaugugggcuugucaagua

SEQ ID NO: 302803 - RNA, 22 nt, Homo sapiens
uuccauguugauacgugaaguu

SEQ ID NO: 302804 - RNA, 22 nt, Homo sapiens
uucccagugguuagcucugguc

SEQ ID NO: 302805 - RNA, 22 nt, Homo sapiens
uucccaguuggggaaagcgacc

SEQ ID NO: 302806 - RNA, 22 nt, Homo sapiens
uuccccgugaaacuuucucauu

SEQ ID NO: 302807 - RNA, 22 nt, Homo sapiens
uucccucagaaacacacagccc

SEQ ID NO: 302808 - RNA, 22 nt, Homo sapiens
uucccuguaucuucugccaugu

SEQ ID NO: 302809 - RNA, 22 nt, Homo sapiens
uucccuuucugaaaaucucauu

SEQ ID NO: 302810 - RNA, 22 nt, Homo sapiens
uucccuuugaauuggaaaggug

SEQ ID NO: 302811 - RNA, 22 nt, Homo sapiens
uuccuacugugcaaaguugcaa

SEQ ID NO: 302812 - RNA, 22 nt, Homo sapiens
uuccugagccuuguaucuagua

SEQ ID NO: 302813 - RNA, 22 nt, Homo sapiens
uuccuugagaaaggcacaaguu

SEQ ID NO: 302814 - RNA, 22 nt, Homo sapiens
uucuacuucauuaggaggauug

SEQ ID NO: 302815 - RNA, 22 nt, Homo sapiens
uucuaugguuuaauaguuuggg

SEQ ID NO: 302816 - RNA, 22 nt, Homo sapiens
uucucaaggagccuucguaacu

SEQ ID NO: 302817 - RNA, 22 nt, Homo sapiens
uucucagcccccugacagucag

SEQ ID NO: 302818 - RNA, 22 nt, Homo sapiens
uucucugggacauaggucgggu

SEQ ID NO: 302819 - RNA, 19 nt, Homo sapiens
uucucugguuguacuaccc

SEQ ID NO: 302820 - RNA, 22 nt, Homo sapiens
uucugauggaguaguccacaga

SEQ ID NO: 302821 - RNA, 22 nt, Homo sapiens
uucugcuugaucuaguguguug

SEQ ID NO: 302822 - RNA, 22 nt, Homo sapiens
uucuggccuccauuuuucuccu

SEQ ID NO: 302823 - RNA, 22 nt, Homo sapiens
uucuggcuuauaaacgugacuu

SEQ ID NO: 302824 - RNA, 22 nt, Homo sapiens
uucugguuaauacuugcaaaaa

SEQ ID NO: 302825 - RNA, 22 nt, Homo sapiens
uucugugguuucauuuaccugu

SEQ ID NO: 302826 - RNA, 22 nt, Homo sapiens
uucuucaggcauucccagaagc

SEQ ID NO: 302827 - RNA, 22 nt, Homo sapiens
uucuucaguuacaacaaggggg

SEQ ID NO: 302828 - RNA, 22 nt, Homo sapiens
uucuuuaguucacuugcuccag

SEQ ID NO: 302829 - RNA, 22 nt, Homo sapiens
uugaacuguaagggucugugug

SEQ ID NO: 302830 - RNA, 22 nt, Homo sapiens
uugaaguagaaagacgaaauuu

SEQ ID NO: 302831 - RNA, 22 nt, Homo sapiens
uugaaguaguacuuuauuauag

SEQ ID NO: 302832 - RNA, 22 nt, Homo sapiens
uugaagugaagaacaauaucac

SEQ ID NO: 302833 - RNA, 22 nt, Homo sapiens
uugaauagcauguuuagugcau

SEQ ID NO: 302834 - RNA, 22 nt, Homo sapiens
uugaauaggcucaugcuuauca

SEQ ID NO: 302835 - RNA, 22 nt, Homo sapiens
uugaauagugacuuugauucug

SEQ ID NO: 302836 - RNA, 22 nt, Homo sapiens
uugacaaugcacugugcuaagu

SEQ ID NO: 302837 - RNA, 22 nt, Homo sapiens
uugagauggaaucucgcuuugu

SEQ ID NO: 302838 - RNA, 22 nt, Homo sapiens
uugagauggagccucacucugc

SEQ ID NO: 302839 - RNA, 22 nt, Homo sapiens
uugagauggagcuucacucuug

SEQ ID NO: 302840 - RNA, 22 nt, Homo sapiens
uugagauggagucucacgcauu

SEQ ID NO: 302841 - RNA, 22 nt, Homo sapiens
uugagauggagucucacuccuu

SEQ ID NO: 302842 - RNA, 22 nt, Homo sapiens
uugagauggagucucacucuuc

SEQ ID NO: 302843 - RNA, 22 nt, Homo sapiens
uugagauggagucucacugugu

SEQ ID NO: 302844 - RNA, 22 nt, Homo sapiens
uugagauggagucucgcucugu

SEQ ID NO: 302845 - RNA, 22 nt, Homo sapiens
uugagauggagucuugcacugu

SEQ ID NO: 302846 - RNA, 22 nt, Homo sapiens
uugagauggagucuugcucugu

SEQ ID NO: 302847 - RNA, 22 nt, Homo sapiens
uugagauggauagacauagcau

SEQ ID NO: 302848 - RNA, 22 nt, Homo sapiens
uugagauggugccacuguacuc

SEQ ID NO: 302849 - RNA, 19 nt, Homo sapiens
uugagaugugaacucacac

SEQ ID NO: 302850 - RNA, 22 nt, Homo sapiens
uugagauuuuccucaaauauuu

SEQ ID NO: 302851 - RNA, 22 nt, Homo sapiens
uugagcacaggaguuugagacc

SEQ ID NO: 302852 - RNA, 22 nt, Homo sapiens
uugaggaaugugauuucaaaua

SEQ ID NO: 302853 - RNA, 22 nt, Homo sapiens
uugaggcaaugaggagaagcug

SEQ ID NO: 302854 - RNA, 22 nt, Homo sapiens
uugaggguggcauauauugauu

SEQ ID NO: 302855 - RNA, 22 nt, Homo sapiens
uugagguaguacuuauuauugg

SEQ ID NO: 302856 - RNA, 22 nt, Homo sapiens
uugaggugaauuugcaggaugc

SEQ ID NO: 302857 - RNA, 22 nt, Homo sapiens
uugagucguuaccuauaacaga

SEQ ID NO: 302858 - RNA, 22 nt, Homo sapiens
uugagugaaggcuguguucuug

SEQ ID NO: 302859 - RNA, 22 nt, Homo sapiens
uugaguuugaguauucuaaagc

SEQ ID NO: 302860 - RNA, 22 nt, Homo sapiens
uugauaguccuguaucuauuuu

SEQ ID NO: 302861 - RNA, 22 nt, Homo sapiens
uugaucuaugugucuguuuuua

SEQ ID NO: 302862 - RNA, 22 nt, Homo sapiens
uugcacaguguguacagcacca

SEQ ID NO: 302863 - RNA, 22 nt, Homo sapiens
uugcaccuugaagccaauagca

SEQ ID NO: 302864 - RNA, 22 nt, Homo sapiens
uugcagcaaagagggaggggca

SEQ ID NO: 302865 - RNA, 19 nt, Homo sapiens
uugcauauguugaaccagg

SEQ ID NO: 302866 - RNA, 22 nt, Homo sapiens
uugccuaggcuggaguguggug

SEQ ID NO: 302867 - RNA, 22 nt, Homo sapiens
uugcuuagagccaaucuugauu

SEQ ID NO: 302868 - RNA, 22 nt, Homo sapiens
uugcuucauucaacauugaggg

SEQ ID NO: 302869 - RNA, 22 nt, Homo sapiens
uuggaaugcacacugagccugc

SEQ ID NO: 302870 - RNA, 22 nt, Homo sapiens
uuggaauguacucuagccuaug

SEQ ID NO: 302871 - RNA, 22 nt, Homo sapiens
uuggacugagaguuccaccauu

SEQ ID NO: 302872 - RNA, 22 nt, Homo sapiens
uuggagugugagagcagccugg

SEQ ID NO: 302873 - RNA, 22 nt, Homo sapiens
uuggcaacauagugagaccccc

SEQ ID NO: 302874 - RNA, 22 nt, Homo sapiens
uuggcaauugcuaugauuugaa

SEQ ID NO: 302875 - RNA, 21 nt, Homo sapiens
uuggcacucuucucuccuuau

SEQ ID NO: 302876 - RNA, 22 nt, Homo sapiens
uuggcauugaguuucaaaucau

SEQ ID NO: 302877 - RNA, 20 nt, Homo sapiens
uuggcauuuagacaagaguu

SEQ ID NO: 302878 - RNA, 22 nt, Homo sapiens
uuggcuuguaaaaugaaaagcu

SEQ ID NO: 302879 - RNA, 22 nt, Homo sapiens
uuggcuuuuaugcagcuuaggu

SEQ ID NO: 302880 - RNA, 23 nt, Homo sapiens
uugggcaaaucacugagggcaga

SEQ ID NO: 302881 - RNA, 22 nt, Homo sapiens
uugguacuacacuucuaaucuu

SEQ ID NO: 302882 - RNA, 22 nt, Homo sapiens
uuggucaaaucugaugggagaa

SEQ ID NO: 302883 - RNA, 22 nt, Homo sapiens
uuggucacugacauguuugaaa

SEQ ID NO: 302884 - RNA, 22 nt, Homo sapiens
uuggucaggcuaaucucgaacg

SEQ ID NO: 302885 - RNA, 21 nt, Homo sapiens
uugguccacaugucauaguua

SEQ ID NO: 302886 - RNA, 22 nt, Homo sapiens
uugguccccuucaaccagcugu

SEQ ID NO: 302887 - RNA, 23 nt, Homo sapiens
uuggucucccaaaguguugagau

SEQ ID NO: 302888 - RNA, 22 nt, Homo sapiens
aaaggcuucggaucagaaggua

SEQ ID NO: 302889 - RNA, 22 nt, Homo sapiens
aaagucuagaggaucaugugug

SEQ ID NO: 302890 - RNA, 22 nt, Homo sapiens
aaagugcacuuggaagagggcc

SEQ ID NO: 302891 - RNA, 22 nt, Homo sapiens
aaauucaugucaccucuaggua

SEQ ID NO: 302892 - RNA, 22 nt, Homo sapiens
aacugguauuucccaugaauuu

SEQ ID NO: 302893 - RNA, 22 nt, Homo sapiens
aagaugcagucauacuggagga

SEQ ID NO: 302894 - RNA, 22 nt, Homo sapiens
aagcacaauuucaccuucuugu

SEQ ID NO: 302895 - RNA, 20 nt, Homo sapiens
aaggcuuucgaguuccaggg

SEQ ID NO: 302896 - RNA, 22 nt, Homo sapiens
aaguauuagugaggauauggaa

SEQ ID NO: 302897 - RNA, 22 nt, Homo sapiens
aagucacugagacuuguggcug

SEQ ID NO: 302898 - RNA, 22 nt, Homo sapiens
aagucauggagaagguggaggu

SEQ ID NO: 302899 - RNA, 22 nt, Homo sapiens
aagugaaugugcuggaauagcu

SEQ ID NO: 302900 - RNA, 22 nt, Homo sapiens
aagugucuuaccgggagggagu

SEQ ID NO: 302901 - RNA, 22 nt, Homo sapiens
aauauagcuauguacaugucca

SEQ ID NO: 302902 - RNA, 22 nt, Homo sapiens
aaucaacauuguuuuaagucaa

SEQ ID NO: 302903 - RNA, 22 nt, Homo sapiens
aaucacaguguucuugugaggg

SEQ ID NO: 302904 - RNA, 22 nt, Homo sapiens
aaugcacuccagccugggcgac

SEQ ID NO: 302905 - RNA, 22 nt, Homo sapiens
aauggcacacaccuggucuaac

SEQ ID NO: 302906 - RNA, 22 nt, Homo sapiens
aaugugcuguucagaggagucc

SEQ ID NO: 302907 - RNA, 22 nt, Homo sapiens
aaugugcuuucuuucacacagu

SEQ ID NO: 302908 - RNA, 22 nt, Homo sapiens
acaguacaugauaaauaaggua

SEQ ID NO: 302909 - RNA, 22 nt, Homo sapiens
acaguguuacuugauaguguau

SEQ ID NO: 302910 - RNA, 22 nt, Homo sapiens
acugcacuccagccuggacgaa

SEQ ID NO: 302911 - RNA, 22 nt, Homo sapiens
acugcacuccagccugugcgua

SEQ ID NO: 302912 - RNA, 22 nt, Homo sapiens
acugcacuccagccuuggcggc

SEQ ID NO: 302913 - RNA, 20 nt, Homo sapiens
acugggcuaccgaaguaagg

SEQ ID NO: 302914 - RNA, 22 nt, Homo sapiens
agaauguaaacagaauagagga

SEQ ID NO: 302915 - RNA, 22 nt, Homo sapiens
agacaagauggcuugagguuca

SEQ ID NO: 302916 - RNA, 22 nt, Homo sapiens
agaggucuuaucaaacaugcuu

SEQ ID NO: 302917 - RNA, 22 nt, Homo sapiens
agagguuuaacuggcuuauggu

SEQ ID NO: 302918 - RNA, 23 nt, Homo sapiens
agagguuuaaucaggcaguugcu

SEQ ID NO: 302919 - RNA, 22 nt, Homo sapiens
agagguuuugcccucgagauaa

SEQ ID NO: 302920 - RNA, 22 nt, Homo sapiens
agagguuuuggggcugagagcu

SEQ ID NO: 302921 - RNA, 22 nt, Homo sapiens
agagugaagcuuuuuauauucu

SEQ ID NO: 302922 - RNA, 22 nt, Homo sapiens
agcaagacauggcuuccaaaug

SEQ ID NO: 302923 - RNA, 22 nt, Homo sapiens
agcacauuaguaucuaagaaca

SEQ ID NO: 302924 - RNA, 22 nt, Homo sapiens
agcaccacaauuuccugccuaa

SEQ ID NO: 302925 - RNA, 17 nt, Homo sapiens
agcaccacacucucuug

SEQ ID NO: 302926 - RNA, 22 nt, Homo sapiens
agcagcaugcaaauggacuaau

SEQ ID NO: 302927 - RNA, 22 nt, Homo sapiens
agcuguaguuuauucauguuaa

SEQ ID NO: 302928 - RNA, 22 nt, Homo sapiens
agcugugucuucuuaaagauuu

SEQ ID NO: 302929 - RNA, 22 nt, Homo sapiens
aggcaagaaugcuuguuucacc

SEQ ID NO: 302930 - RNA, 16 nt, Homo sapiens
aggcaagaauugaggu

SEQ ID NO: 302931 - RNA, 22 nt, Homo sapiens
agggaagugugcuaugcauuua

SEQ ID NO: 302932 - RNA, 22 nt, Homo sapiens
aggucccauguccucccugacc

SEQ ID NO: 302933 - RNA, 22 nt, Homo sapiens
aguaacacaccugcauggugug

SEQ ID NO: 302934 - RNA, 22 nt, Homo sapiens
aguaacaggauccaaagaaugu

SEQ ID NO: 302935 - RNA, 22 nt, Homo sapiens
aguagcacaugccacccugucu

SEQ ID NO: 302936 - RNA, 22 nt, Homo sapiens
agucugguguucucacacuagu

SEQ ID NO: 302937 - RNA, 17 nt, Homo sapiens
agugagaucauggcuua

SEQ ID NO: 302938 - RNA, 22 nt, Homo sapiens
agugcaguugucacgugccuuc

SEQ ID NO: 302939 - RNA, 22 nt, Homo sapiens
agugcauuuguucugugucagg

SEQ ID NO: 302940 - RNA, 22 nt, Homo sapiens
auaaguauuuggacuuuacugu

SEQ ID NO: 302941 - RNA, 22 nt, Homo sapiens
auagaaucaucugugcacuagu

SEQ ID NO: 302942 - RNA, 22 nt, Homo sapiens
auagcacaugugcaaauggcug

SEQ ID NO: 302943 - RNA, 22 nt, Homo sapiens
auagcaucauuucuugaaaaga

SEQ ID NO: 302944 - RNA, 22 nt, Homo sapiens
auauagcaaugaaagagaugaa

SEQ ID NO: 302945 - RNA, 22 nt, Homo sapiens
auauguaguauggaaacauugu

SEQ ID NO: 302946 - RNA, 22 nt, Homo sapiens
auauguauuuuaacguguaagg

SEQ ID NO: 302947 - RNA, 22 nt, Homo sapiens
auauuggccuaaaauucucuuu

SEQ ID NO: 302948 - RNA, 18 nt, Homo sapiens
cucacaguaacuuuuaag

SEQ ID NO: 302949 - RNA, 22 nt, Homo sapiens
cucagugaagggcaagaggcaa

SEQ ID NO: 302950 - RNA, 22 nt, Homo sapiens
cuccagugcaaagucaugauca

SEQ ID NO: 302951 - RNA, 23 nt, Homo sapiens
cucccugaacaugacacaccaga

SEQ ID NO: 302952 - RNA, 20 nt, Homo sapiens
cucccugacaaauguggaaa

SEQ ID NO: 302953 - RNA, 22 nt, Homo sapiens
cucccugagccagggcuuugac

SEQ ID NO: 302954 - RNA, 22 nt, Homo sapiens
cucucaguugucuaauuaguuu

SEQ ID NO: 302955 - RNA, 22 nt, Homo sapiens
cugcccuuucuauaugauguaa

SEQ ID NO: 302956 - RNA, 22 nt, Homo sapiens
cuggcucauuucauuuagcaua

SEQ ID NO: 302957 - RNA, 22 nt, Homo sapiens
cugugacugcagggcauauuug

SEQ ID NO: 302958 - RNA, 20 nt, Homo sapiens
cuucacagaaguggaaucau

SEQ ID NO: 302959 - RNA, 22 nt, Homo sapiens
cuucaucugguuugugaacuuu

SEQ ID NO: 302960 - RNA, 22 nt, Homo sapiens
cuugaauguaaauaauguacag

SEQ ID NO: 302961 - RNA, 22 nt, Homo sapiens
cuugcacuagugcagaggcgcu

SEQ ID NO: 302962 - RNA, 21 nt, Homo sapiens
cuuuaugcuguguuagaaaag

SEQ ID NO: 302963 - RNA, 22 nt, Homo sapiens
cuuugcaaaacauugagaccuc

SEQ ID NO: 302964 - RNA, 21 nt, Homo sapiens
cuuugguuucugacuugcaua

SEQ ID NO: 302965 - RNA, 22 nt, Homo sapiens
cuuuugugauuccucaguuacu

SEQ ID NO: 302966 - RNA, 22 nt, Homo sapiens
gaaagugcugcuugacugggau

SEQ ID NO: 302967 - RNA, 22 nt, Homo sapiens
gaacuuguguugcuucacaugu

SEQ ID NO: 302968 - RNA, 22 nt, Homo sapiens
gaagcauugauccacaggcgug

SEQ ID NO: 302969 - RNA, 22 nt, Homo sapiens
gaaugauacuguuaacgaaaga

SEQ ID NO: 302970 - RNA, 22 nt, Homo sapiens
gaaugcaugaggggaucagaug

SEQ ID NO: 302971 - RNA, 22 nt, Homo sapiens
gaauggaacugacuauagcuga

SEQ ID NO: 302972 - RNA, 22 nt, Homo sapiens
gacacugucuucugcucuuaaa

SEQ ID NO: 302973 - RNA, 22 nt, Homo sapiens
gacauuaucagguuuguuuucu

SEQ ID NO: 302974 - RNA, 22 nt, Homo sapiens
gagaacauacggcauuugguuu

SEQ ID NO: 302975 - RNA, 22 nt, Homo sapiens
gagaaugagaggggaaggccac

SEQ ID NO: 302976 - RNA, 22 nt, Homo sapiens
gagauugucaugauuacauugu

SEQ ID NO: 302977 - RNA, 22 nt, Homo sapiens
gagcuggacuucuuaccuuuuc

SEQ ID NO: 302978 - RNA, 22 nt, Homo sapiens
gaggaaguagcuacugucuuuc

SEQ ID NO: 302979 - RNA, 22 nt, Homo sapiens
gagguaugugggcagacauuua

SEQ ID NO: 302980 - RNA, 22 nt, Homo sapiens
gaggucuuacauuuuaauauuu

SEQ ID NO: 302981 - RNA, 22 nt, Homo sapiens
gaguuccuuugagccugagagg

SEQ ID NO: 302982 - RNA, 19 nt, Homo sapiens
gauagacaucacagugcca

SEQ ID NO: 302983 - RNA, 22 nt, Homo sapiens
gaucuguuuuccuauuguuugu

SEQ ID NO: 302984 - RNA, 22 nt, Homo sapiens
gcaaaguguuuuccaacuuggu

SEQ ID NO: 302985 - RNA, 22 nt, Homo sapiens
gcagaauugacucuguuuuuuc

SEQ ID NO: 302986 - RNA, 22 nt, Homo sapiens
gcagugcaguggcgcgaucucg

SEQ ID NO: 302987 - RNA, 22 nt, Homo sapiens
gcauggagaaggggacugauuc

SEQ ID NO: 302988 - RNA, 22 nt, Homo sapiens
gccauugcacuccgcccugggc

SEQ ID NO: 302989 - RNA, 22 nt, Homo sapiens
gcccugagauucuuggauucug

SEQ ID NO: 302990 - RNA, 22 nt, Homo sapiens
gcccuguugcccaggcuggagu

SEQ ID NO: 302991 - RNA, 22 nt, Homo sapiens
ggaaagauguaauauuaucuaa

SEQ ID NO: 302992 - RNA, 22 nt, Homo sapiens
ggaagacaguguggugauuccu

SEQ ID NO: 302993 - RNA, 22 nt, Homo sapiens
ggaauauaaaaagccccagaau

SEQ ID NO: 302994 - RNA, 22 nt, Homo sapiens
ggaauggaacaaagucuugaaa

SEQ ID NO: 302995 - RNA, 22 nt, Homo sapiens
ggagauaauccagggagggacu

SEQ ID NO: 302996 - RNA, 22 nt, Homo sapiens
ggagaucuuuaggaguuggacu

SEQ ID NO: 302997 - RNA, 22 nt, Homo sapiens
ggagaugaaaugagcuacuuaa

SEQ ID NO: 302998 - RNA, 22 nt, Homo sapiens
ggcaagaggagauucugcuccc

SEQ ID NO: 302999 - RNA, 22 nt, Homo sapiens
ggcaagugggagggaguguuuc

SEQ ID NO: 303000 - RNA, 22 nt, Homo sapiens
ggcaagugucagcagcaacacc

SEQ ID NO: 303001 - RNA, 22 nt, Homo sapiens
ggcccugauacaaguaaggucu

SEQ ID NO: 303002 - RNA, 22 nt, Homo sapiens
ggugaucauugucucuaguaug

SEQ ID NO: 303003 - RNA, 22 nt, Homo sapiens
ggugauguuugaguugagacag

SEQ ID NO: 303004 - RNA, 22 nt, Homo sapiens
guaaauaccaguuucuggaaca

SEQ ID NO: 303005 - RNA, 23 nt, Homo sapiens
guaguuugaugcaauccacuugu

SEQ ID NO: 303006 - RNA, 22 nt, Homo sapiens
guauccugaaguucucagcacu

SEQ ID NO: 303007 - RNA, 22 nt, Homo sapiens
guaugacacaggaagcuuaacc

SEQ ID NO: 303008 - RNA, 22 nt, Homo sapiens
gucagugugauaucugcagggg

SEQ ID NO: 303009 - RNA, 18 nt, Homo sapiens
gucauagaaugaugguuc

SEQ ID NO: 303010 - RNA, 22 nt, Homo sapiens
gucucagugcgaaucucaaaga

SEQ ID NO: 303011 - RNA, 22 nt, Homo sapiens
gucugguugacagcauguggcc

SEQ ID NO: 303012 - RNA, 22 nt, Homo sapiens
gucugguuggaguaguuuucag

SEQ ID NO: 303013 - RNA, 22 nt, Homo sapiens
gucugguuuuuuauauccucac

SEQ ID NO: 303014 - RNA, 22 nt, Homo sapiens
gucuugaaggcugaguaccugu

SEQ ID NO: 303015 - RNA, 22 nt, Homo sapiens
gucuuugagauaggguuauuuu

SEQ ID NO: 303016 - RNA, 22 nt, Homo sapiens
gugaacaagcaaaggcaggagg

SEQ ID NO: 303017 - RNA, 22 nt, Homo sapiens
gugagaauugacacccuugucu

SEQ ID NO: 303018 - RNA, 21 nt, Homo sapiens
gugcaaacaucauagaaugua

SEQ ID NO: 303019 - RNA, 22 nt, Homo sapiens
gugcaugcaucuuuauaguagc

SEQ ID NO: 303020 - RNA, 22 nt, Homo sapiens
gugccacugcacuccggccugg

SEQ ID NO: 303021 - RNA, 20 nt, Homo sapiens
guggaaguagaaacauaugu

SEQ ID NO: 303022 - RNA, 22 nt, Homo sapiens
guggcagaaaagagaagcaaug

SEQ ID NO: 303023 - RNA, 22 nt, Homo sapiens
guguauguuguccauggaugcg

SEQ ID NO: 303024 - RNA, 22 nt, Homo sapiens
gugucaugggcauguccuuaac

SEQ ID NO: 303025 - RNA, 21 nt, Homo sapiens
gugugcuugagugaugggauu

SEQ ID NO: 303026 - RNA, 22 nt, Homo sapiens
guguuugauugcaaauaaucua

SEQ ID NO: 303027 - RNA, 22 nt, Homo sapiens
guucuggagauaaagccaaggu

SEQ ID NO: 303028 - RNA, 22 nt, Homo sapiens
guuuggauuuucuaauuucugu

SEQ ID NO: 303029 - RNA, 22 nt, Homo sapiens
guuugugguuaaagccuuucau

SEQ ID NO: 303030 - RNA, 22 nt, Homo sapiens
uaaacugcuugaggguaaguac

SEQ ID NO: 303031 - RNA, 22 nt, Homo sapiens
uaaacugucuuuggagcuuugc

SEQ ID NO: 303032 - RNA, 22 nt, Homo sapiens
uaaagcauguaauuagguuaga

SEQ ID NO: 303033 - RNA, 22 nt, Homo sapiens
uaaaugcucuuuaaaagugcuu

SEQ ID NO: 303034 - RNA, 22 nt, Homo sapiens
uaagugaaggaaguguguuuac

SEQ ID NO: 303035 - RNA, 23 nt, Homo sapiens
uaaguucaucucuaauaggugga

SEQ ID NO: 303036 - RNA, 22 nt, Homo sapiens
uaaguucauucaugaaacuuag

SEQ ID NO: 303037 - RNA, 22 nt, Homo sapiens
uaauauguauacagacagauac

SEQ ID NO: 303038 - RNA, 22 nt, Homo sapiens
uacagaguauccauuugaguuc

SEQ ID NO: 303039 - RNA, 22 nt, Homo sapiens
uacagucauaaugccuagugac

SEQ ID NO: 303040 - RNA, 22 nt, Homo sapiens
uaccuguagacuacagcuucag

SEQ ID NO: 303041 - RNA, 22 nt, Homo sapiens
uacucacauucuguuucuugcu

SEQ ID NO: 303042 - RNA, 22 nt, Homo sapiens
acaaaguauggaauguuggugu

SEQ ID NO: 303043 - RNA, 22 nt, Homo sapiens
acaccuguggucccaguaacuu

SEQ ID NO: 303044 - RNA, 20 nt, Homo sapiens
acaguagaagggauuucaaa

SEQ ID NO: 303045 - RNA, 22 nt, Homo sapiens
acagugcuucugauaugaugcc

SEQ ID NO: 303046 - RNA, 22 nt, Homo sapiens
acaugagacuggguuuguaggg

SEQ ID NO: 303047 - RNA, 22 nt, Homo sapiens
acccugacacgauucuucacuu

SEQ ID NO: 303048 - RNA, 22 nt, Homo sapiens
acccuugaguguguuucaggca

SEQ ID NO: 303049 - RNA, 22 nt, Homo sapiens
agaagugcuggguucaggcugg

SEQ ID NO: 303050 - RNA, 22 nt, Homo sapiens
agaauaauguccccccaaggga

SEQ ID NO: 303051 - RNA, 19 nt, Homo sapiens
ugcaaauucuaaaaacuga

SEQ ID NO: 303052 - RNA, 21 nt, Homo sapiens
ugcaagaaucaggaagcugcc

SEQ ID NO: 303053 - RNA, 22 nt, Homo sapiens
ugcaggauguucaguaauuucc

SEQ ID NO: 303054 - RNA, 22 nt, Homo sapiens
uggaaaauuaggggagguuaua

SEQ ID NO: 303055 - RNA, 22 nt, Homo sapiens
uggaagacauugggugaagggu

SEQ ID NO: 303056 - RNA, 22 nt, Homo sapiens
uggaagacauuuuggaccuugg

SEQ ID NO: 303057 - RNA, 22 nt, Homo sapiens
uggaagucuucauuauguauag

SEQ ID NO: 303058 - RNA, 22 nt, Homo sapiens
uggagucuugaugauuuucaaa

SEQ ID NO: 303059 - RNA, 22 nt, Homo sapiens
uggauggucagaggguuucugu

SEQ ID NO: 303060 - RNA, 22 nt, Homo sapiens
uggcaagaacaacaauuacuuu

SEQ ID NO: 303061 - RNA, 22 nt, Homo sapiens
uggcaagaaccacaguuacuuu

SEQ ID NO: 303062 - RNA, 22 nt, Homo sapiens
uggcauguguuugaaugaguau

SEQ ID NO: 303063 - RNA, 22 nt, Homo sapiens
ugggaaugaaauuacauagcuu

SEQ ID NO: 303064 - RNA, 22 nt, Homo sapiens
uggguagagaaucaggaucuua

SEQ ID NO: 303065 - RNA, 22 nt, Homo sapiens
ugguaaaaugucauuuaccaga

SEQ ID NO: 303066 - RNA, 22 nt, Homo sapiens
uguaaacuuuugagauugacuu

SEQ ID NO: 303067 - RNA, 22 nt, Homo sapiens
uguaauuuaaaugauccuugga

SEQ ID NO: 303068 - RNA, 22 nt, Homo sapiens
uguacccuuagagagugaucga

SEQ ID NO: 303069 - RNA, 22 nt, Homo sapiens
uguagacagcacguaguugagu

SEQ ID NO: 303070 - RNA, 22 nt, Homo sapiens
uguagucauuuggaguccagcu

SEQ ID NO: 303071 - RNA, 22 nt, Homo sapiens
uguauauguuuguacauauguc

SEQ ID NO: 303072 - RNA, 22 nt, Homo sapiens
ugucauagauugcuuggaaaaa

SEQ ID NO: 303073 - RNA, 22 nt, Homo sapiens
ugucauggggaaaauaacagac

SEQ ID NO: 303074 - RNA, 22 nt, Homo sapiens
ugugaacauuuuguauauauua

SEQ ID NO: 303075 - RNA, 22 nt, Homo sapiens
ugugacaguguuacauuucaug

SEQ ID NO: 303076 - RNA, 22 nt, Homo sapiens
ugugacuaguggugaaugacgc

SEQ ID NO: 303077 - RNA, 22 nt, Homo sapiens
ugugauguggagggcagaucca

SEQ ID NO: 303078 - RNA, 20 nt, Homo sapiens
ugugauuauuuaguugcaug

SEQ ID NO: 303079 - RNA, 17 nt, Homo sapiens
ugugauugaagucaucc

SEQ ID NO: 303080 - RNA, 22 nt, Homo sapiens
ugugcaaauguuaaacuaacuu

SEQ ID NO: 303081 - RNA, 22 nt, Homo sapiens
uguguaaagcuuguuccagaaa

SEQ ID NO: 303082 - RNA, 22 nt, Homo sapiens
ugugucuugagagucucgagaa

SEQ ID NO: 303083 - RNA, 22 nt, Homo sapiens
uguucacaguguuucuuugaga

SEQ ID NO: 303084 - RNA, 22 nt, Homo sapiens
uguucuggagaguuuagucugg

SEQ ID NO: 303085 - RNA, 22 nt, Homo sapiens
uguucuugagccuuuagaccua

SEQ ID NO: 303086 - RNA, 22 nt, Homo sapiens
uguuugguggucucuucacaug

SEQ ID NO: 303087 - RNA, 20 nt, Homo sapiens
uuaguucauuuagaagguuu

SEQ ID NO: 303088 - RNA, 22 nt, Homo sapiens
uuauaaacaugaagauuugggg

SEQ ID NO: 303089 - RNA, 22 nt, Homo sapiens
uuauagcagugcaggaacagac

SEQ ID NO: 303090 - RNA, 22 nt, Homo sapiens
uuaucauagugcaguuuucuga

SEQ ID NO: 303091 - RNA, 16 nt, Homo sapiens
uuauugcauucuucuc

SEQ ID NO: 303092 - RNA, 22 nt, Homo sapiens
uucaagaauuaaaguggcuuuu

SEQ ID NO: 303093 - RNA, 22 nt, Homo sapiens
uucaauacuguugauccuuaug

SEQ ID NO: 303094 - RNA, 22 nt, Homo sapiens
uucacagucacccuucuccaug

SEQ ID NO: 303095 - RNA, 22 nt, Homo sapiens
uucagagugguaugaagugaug

SEQ ID NO: 303096 - RNA, 22 nt, Homo sapiens
uucauggacucaauaguuucgc

SEQ ID NO: 303097 - RNA, 22 nt, Homo sapiens
uucccagagagggacuucuaau

SEQ ID NO: 303098 - RNA, 22 nt, Homo sapiens
uucucagugaacuccagcuugu

SEQ ID NO: 303099 - RNA, 22 nt, Homo sapiens
uucucagugaaguuuagaacau

SEQ ID NO: 303100 - RNA, 22 nt, Homo sapiens
uucucagugcuaucuuuuaugc

SEQ ID NO: 303101 - RNA, 17 nt, Homo sapiens
uucucaguucugaucuc

SEQ ID NO: 303102 - RNA, 22 nt, Homo sapiens
uucuggcuuuuaaagaaauguu

SEQ ID NO: 303103 - RNA, 22 nt, Homo sapiens
uucugugcuuguggaugaagug

SEQ ID NO: 303104 - RNA, 22 nt, Homo sapiens
uucuuugcaugaucucaaaguc

SEQ ID NO: 303105 - RNA, 22 nt, Homo sapiens
uucuuugcuuggaagcggggga

SEQ ID NO: 303106 - RNA, 22 nt, Homo sapiens
uugaaagucauuucuucuaagu

SEQ ID NO: 303107 - RNA, 22 nt, Homo sapiens
uugaagacuaaguuaucaggau

SEQ ID NO: 303108 - RNA, 22 nt, Homo sapiens
uugaaguagcauuucaugucua

SEQ ID NO: 303109 - RNA, 22 nt, Homo sapiens
uugaauguacuuguucucacua

SEQ ID NO: 303110 - RNA, 20 nt, Homo sapiens
uugacaguggguuguuaaag

SEQ ID NO: 303111 - RNA, 22 nt, Homo sapiens
uugacauaguuucugaaauaga

SEQ ID NO: 303112 - RNA, 22 nt, Homo sapiens
uugagaaucuuucgaauguucu

SEQ ID NO: 303113 - RNA, 22 nt, Homo sapiens
uugagauuauuguguuccuuua

SEQ ID NO: 303114 - RNA, 22 nt, Homo sapiens
uugaggaggcagucucuccauu

SEQ ID NO: 303115 - RNA, 22 nt, Homo sapiens
uugaggaggcagucuucccauu

SEQ ID NO: 303116 - RNA, 22 nt, Homo sapiens
uugcacauugauuuuguauccu

SEQ ID NO: 303117 - RNA, 22 nt, Homo sapiens
uugcauaagugcauucugugau

SEQ ID NO: 303118 - RNA, 22 nt, Homo sapiens
uugcauuagugugguacauuug

SEQ ID NO: 303119 - RNA, 22 nt, Homo sapiens
uuggaagacaaugcugauucuc

SEQ ID NO: 303120 - RNA, 23 nt, Homo sapiens
uuggaaugagaccuaagaguuuu

SEQ ID NO: 303121 - RNA, 22 nt, Homo sapiens
uuggcagucugaggcacagacu

SEQ ID NO: 303122 - RNA, 22 nt, Homo sapiens
uuggcauugaguuucaaaucau

SEQ ID NO: 303123 - RNA, 22 nt, Homo sapiens
uuggccauaugacuugcuuugg

SEQ ID NO: 303124 - RNA, 22 nt, Homo sapiens
uuguaaagaucauaugcuguuc

SEQ ID NO: 303125 - RNA, 22 nt, Homo sapiens
uuguacuagucauauuuugaaa

SEQ ID NO: 303126 - RNA, 22 nt, Homo sapiens
uugugcuugauuugccuagcug

SEQ ID NO: 303127 - RNA, 19 nt, Homo sapiens
uugugggaggacagagggg

SEQ ID NO: 303128 - RNA, 22 nt, Homo sapiens
uugugucaaauggcaauuagca

SEQ ID NO: 303129 - RNA, 22 nt, Homo sapiens
uuucaucaagcacagaguagau

SEQ ID NO: 303130 - RNA, 16 nt, Homo sapiens
uuucaucaguuuuaau

SEQ ID NO: 303131 - RNA, 22 nt, Homo sapiens
uuugacacugggagugugggug

SEQ ID NO: 303132 - RNA, 22 nt, Homo sapiens
uuuguacugagccaagauggua

SEQ ID NO: 303133 - RNA, 22 nt, Homo sapiens
uuugugagguggauagauugca

SEQ ID NO: 303134 - RNA, 22 nt, Homo sapiens
uuuguggaaugcccuuauuuau

SEQ ID NO: 303135 - RNA, 20 nt, Homo sapiens
uuuuagcacuuguuauggug

SEQ ID NO: 303136 - RNA, 22 nt, Homo sapiens
uuuugcaauauguuccugaaua

SEQ ID NO: 303137 - RNA, 23 nt, Homo sapiens
ccaguauuuauguaaggaagugu

SEQ ID NO: 303138 - RNA, 22 nt, Homo sapiens
ccugucuugauuaaauuacuua

SEQ ID NO: 303139 - RNA, 22 nt, Homo sapiens
cuaaaguagccaggacugcagg

SEQ ID NO: 303140 - RNA, 22 nt, Homo sapiens
cuacaguuauguuuuaaaugug

SEQ ID NO: 303141 - RNA, 22 nt, Homo sapiens
cuacaguucuuaauuaaguagu

SEQ ID NO: 303142 - RNA, 22 nt, Homo sapiens
cuagaagcauauucagaacaga

SEQ ID NO: 303143 - RNA, 21 nt, Homo sapiens
cucaaaguacugauauuacag

SEQ ID NO: 303144 - RNA, 22 nt, Homo sapiens
accacagugcuuccugcucacg

SEQ ID NO: 303145 - RNA, 19 nt, Homo sapiens
accagauugcauucuugga

SEQ ID NO: 303146 - RNA, 22 nt, Homo sapiens
acugcacuccagccuggacgac

SEQ ID NO: 303147 - RNA, 22 nt, Homo sapiens
agaagaacauagggugacugaa

SEQ ID NO: 303148 - RNA, 22 nt, Homo sapiens
agagacauugcuccaacucacc

SEQ ID NO: 303149 - RNA, 22 nt, Homo sapiens
agaucauaugcaguaaugaacu

SEQ ID NO: 303150 - RNA, 20 nt, Homo sapiens
agaugcaugcacauaaacac

SEQ ID NO: 303151 - RNA, 22 nt, Homo sapiens
agaugguguuuucucaccagau

SEQ ID NO: 303152 - RNA, 22 nt, Homo sapiens
agcaccaccguugcucuauccc

SEQ ID NO: 303153 - RNA, 22 nt, Homo sapiens
agcagguguccacaauguuugc

SEQ ID NO: 303154 - RNA, 23 nt, Homo sapiens
agccugguuucccugcuucuccc

SEQ ID NO: 303155 - RNA, 22 nt, Homo sapiens
agcuguaguuugguggauguaa

SEQ ID NO: 303156 - RNA, 22 nt, Homo sapiens
agcuuguuuucccauaacuaga

SEQ ID NO: 303157 - RNA, 23 nt, Homo sapiens
aggaauggaaaaccaaguaucau

SEQ ID NO: 303158 - RNA, 22 nt, Homo sapiens
aggagaucagccucccugcaac

SEQ ID NO: 303159 - RNA, 22 nt, Homo sapiens
aggauaguaaugauagagaggc

SEQ ID NO: 303160 - RNA, 21 nt, Homo sapiens
aggcaagauuacuuacgagca

SEQ ID NO: 303161 - RNA, 22 nt, Homo sapiens
agggagcaaaguggucuuucuc

SEQ ID NO: 303162 - RNA, 18 nt, Homo sapiens
agguuauuucccaagacu

SEQ ID NO: 303163 - RNA, 22 nt, Homo sapiens
agucacaugcauuuucuucaau

SEQ ID NO: 303164 - RNA, 22 nt, Homo sapiens
auaaauaguaguugugguggcc

SEQ ID NO: 303165 - RNA, 22 nt, Homo sapiens
auacauguucaagggcauauau

SEQ ID NO: 303166 - RNA, 22 nt, Homo sapiens
auaccuuguagugcuauuugau

SEQ ID NO: 303167 - RNA, 22 nt, Homo sapiens
auagaagcugccaacguuucag

SEQ ID NO: 303168 - RNA, 22 nt, Homo sapiens
auagcaaugccccaauccuugg

SEQ ID NO: 303169 - RNA, 21 nt, Homo sapiens
auagcacaucagauuuuauua

SEQ ID NO: 303170 - RNA, 23 nt, Homo sapiens
auauaguagaugugcaguaacau

SEQ ID NO: 303171 - RNA, 22 nt, Homo sapiens
auauaugcacacgugugcauau

SEQ ID NO: 303172 - RNA, 17 nt, Homo sapiens
auaugaauuuuggagau

SEQ ID NO: 303173 - RNA, 22 nt, Homo sapiens
auaugcauguacccacacaggc

SEQ ID NO: 303174 - RNA, 22 nt, Homo sapiens
auauguucucauucauaugugg

SEQ ID NO: 303175 - RNA, 18 nt, Homo sapiens
auauugcauuggauggau

SEQ ID NO: 303176 - RNA, 22 nt, Homo sapiens
aucacagugagcauaugucuau

SEQ ID NO: 303177 - RNA, 22 nt, Homo sapiens
aucccugagccugacucucaga

SEQ ID NO: 303178 - RNA, 22 nt, Homo sapiens
auccuguaggcuaguagacagu

SEQ ID NO: 303179 - RNA, 22 nt, Homo sapiens
aucucaguuaaugacccuaugc

SEQ ID NO: 303180 - RNA, 22 nt, Homo sapiens
aucuuguguugaauggugcaga

SEQ ID NO: 303181 - RNA, 22 nt, Homo sapiens
augaaaacaugauuugccuguu

SEQ ID NO: 303182 - RNA, 19 nt, Homo sapiens
augacauuuggggguggac

SEQ ID NO: 303183 - RNA, 22 nt, Homo sapiens
augagauuauguaaagagacca

SEQ ID NO: 303184 - RNA, 22 nt, Homo sapiens
augagauuguuugugugaaaua

SEQ ID NO: 303185 - RNA, 18 nt, Homo sapiens
augcauauuuuaaguugu

SEQ ID NO: 303186 - RNA, 22 nt, Homo sapiens
auggcaaugcgauggugacuga

SEQ ID NO: 303187 - RNA, 22 nt, Homo sapiens
auggcacagacucuuggucaag

SEQ ID NO: 303188 - RNA, 22 nt, Homo sapiens
auggcagugagucucuaguauu

SEQ ID NO: 303189 - RNA, 22 nt, Homo sapiens
auggcucuuauuauuuugaggu

SEQ ID NO: 303190 - RNA, 22 nt, Homo sapiens
auggcuucuuacucuucugcau

SEQ ID NO: 303191 - RNA, 21 nt, Homo sapiens
augucauggaugacuaauuca

SEQ ID NO: 303192 - RNA, 22 nt, Homo sapiens
augugcaaagcacuguucagca

SEQ ID NO: 303193 - RNA, 22 nt, Homo sapiens
augugcaagaucauuaaagcuc

SEQ ID NO: 303194 - RNA, 22 nt, Homo sapiens
augugcaugcuguucugccaga

SEQ ID NO: 303195 - RNA, 22 nt, Homo sapiens
auguggcacuugacuuucucgc

SEQ ID NO: 303196 - RNA, 22 nt, Homo sapiens
augugggaggaauguguuucca

SEQ ID NO: 303197 - RNA, 20 nt, Homo sapiens
auguucuggaggacagaagc

SEQ ID NO: 303198 - RNA, 22 nt, Homo sapiens
auguugcaguuuaauuauccua

SEQ ID NO: 303199 - RNA, 22 nt, Homo sapiens
auuaaucaggcaaugcuugcua

SEQ ID NO: 303200 - RNA, 22 nt, Homo sapiens
auuauauguguaugugcauacc

SEQ ID NO: 303201 - RNA, 22 nt, Homo sapiens
auucaagugaugcagcuguuuu

SEQ ID NO: 303202 - RNA, 22 nt, Homo sapiens
auucaucagggauauugguuga

SEQ ID NO: 303203 - RNA, 22 nt, Homo sapiens
auugaguaaaugaaaauugccu

SEQ ID NO: 303204 - RNA, 21 nt, Homo sapiens
auugcacuccagccugggcga

SEQ ID NO: 303205 - RNA, 22 nt, Homo sapiens
auuggaguuguacgcacgcuca

SEQ ID NO: 303206 - RNA, 22 nt, Homo sapiens
auuggcaauccauauauuuucu

SEQ ID NO: 303207 - RNA, 22 nt, Homo sapiens
auuggcaauguacauaucuugc

SEQ ID NO: 303208 - RNA, 22 nt, Homo sapiens
auugucacccgggcaguaagca

SEQ ID NO: 303209 - RNA, 22 nt, Homo sapiens
caaagugcuggaauuggccggg

SEQ ID NO: 303210 - RNA, 22 nt, Homo sapiens
cacacugucuuucagaaugguu

SEQ ID NO: 303211 - RNA, 22 nt, Homo sapiens
cacagugaacugguggguuuuu

SEQ ID NO: 303212 - RNA, 22 nt, Homo sapiens
cacaguguuccagcuauuugaa

SEQ ID NO: 303213 - RNA, 22 nt, Homo sapiens
cacauugcaggaaaguucauua

SEQ ID NO: 303214 - RNA, 22 nt, Homo sapiens
cagagguauugcaaaagccuag

SEQ ID NO: 303215 - RNA, 22 nt, Homo sapiens
cagauacuggaguccugaaguu

SEQ ID NO: 303216 - RNA, 22 nt, Homo sapiens
caguucaugguaggcaccauag

SEQ ID NO: 303217 - RNA, 22 nt, Homo sapiens
cauaaaucuuguugaauagcac

SEQ ID NO: 303218 - RNA, 22 nt, Homo sapiens
cauagcacacauuuaccuaugu

SEQ ID NO: 303219 - RNA, 22 nt, Homo sapiens
cauagcacugcacuucagccug

SEQ ID NO: 303220 - RNA, 22 nt, Homo sapiens
caucacacuuggauguaagaca

SEQ ID NO: 303221 - RNA, 22 nt, Homo sapiens
cauuugcacugagacucagcuu

SEQ ID NO: 303222 - RNA, 22 nt, Homo sapiens
ccagaguuucugauucagcagg

SEQ ID NO: 303223 - RNA, 22 nt, Homo sapiens
ccagguuucuagaauaauuccu

SEQ ID NO: 303224 - RNA, 21 nt, Homo sapiens
ccaguguaaugauagcaggca

SEQ ID NO: 303225 - RNA, 19 nt, Homo sapiens
ccaguguucugauugcacu

SEQ ID NO: 303226 - RNA, 22 nt, Homo sapiens
ccaguuuucucacuguugcagu

SEQ ID NO: 303227 - RNA, 22 nt, Homo sapiens
ccauugcacuccagccucggca

SEQ ID NO: 303228 - RNA, 22 nt, Homo sapiens
ccauugcacuucagccuaggug

SEQ ID NO: 303229 - RNA, 22 nt, Homo sapiens
ccuguguuaugguuucuaaugu

SEQ ID NO: 303230 - RNA, 22 nt, Homo sapiens
cuaaagugcugagauuauaggu

SEQ ID NO: 303231 - RNA, 22 nt, Homo sapiens
cuaaaguucuucugagagaaca

SEQ ID NO: 303232 - RNA, 22 nt, Homo sapiens
cuccauuuaguccuuuuagaag

SEQ ID NO: 303233 - RNA, 22 nt, Homo sapiens
cucccauugcaaacaacagaag

SEQ ID NO: 303234 - RNA, 22 nt, Homo sapiens
cucugguuucgcaggaaauaga

SEQ ID NO: 303235 - RNA, 22 nt, Homo sapiens
cugaaaguuauucaggggcaag

SEQ ID NO: 303236 - RNA, 22 nt, Homo sapiens
cugacauggggauccaccuuag

SEQ ID NO: 303237 - RNA, 22 nt, Homo sapiens
cugacauuguugaucacagcca

SEQ ID NO: 303238 - RNA, 22 nt, Homo sapiens
cugagaauguaaaugaagcuuu

SEQ ID NO: 303239 - RNA, 22 nt, Homo sapiens
guggaaguguaaaagcucuugg

SEQ ID NO: 303240 - RNA, 22 nt, Homo sapiens
guggaaguuaagugacuuucug

SEQ ID NO: 303241 - RNA, 17 nt, Homo sapiens
guggauagaacaaugaa

SEQ ID NO: 303242 - RNA, 22 nt, Homo sapiens
gugggaagcuggaacucccucc

SEQ ID NO: 303243 - RNA, 21 nt, Homo sapiens
gugguucuagagaaacagaau

SEQ ID NO: 303244 - RNA, 22 nt, Homo sapiens
guguaauacacacauauaugca

SEQ ID NO: 303245 - RNA, 22 nt, Homo sapiens
gugucccagugugcauacaggu

SEQ ID NO: 303246 - RNA, 22 nt, Homo sapiens
gugugauuauuucaauugaugc

SEQ ID NO: 303247 - RNA, 22 nt, Homo sapiens
gugugauuguuaauuuuaggug

SEQ ID NO: 303248 - RNA, 22 nt, Homo sapiens
guguucaaagcugauugagauu

SEQ ID NO: 303249 - RNA, 22 nt, Homo sapiens
guguucauggaauuugcaauug

SEQ ID NO: 303250 - RNA, 22 nt, Homo sapiens
guuaugcagcaauugauaaucu

SEQ ID NO: 303251 - RNA, 22 nt, Homo sapiens
guugcaaaguaauugugguuuu

SEQ ID NO: 303252 - RNA, 22 nt, Homo sapiens
guugcccuuagcacuucagccu

SEQ ID NO: 303253 - RNA, 22 nt, Homo sapiens
guuguggagucuucuguucugg

SEQ ID NO: 303254 - RNA, 22 nt, Homo sapiens
uaaaccuagcauuuugcauaug

SEQ ID NO: 303255 - RNA, 22 nt, Homo sapiens
uaacauucacaugcugcaaaaa

SEQ ID NO: 303256 - RNA, 22 nt, Homo sapiens
uaacauuguugauuauacuaag

SEQ ID NO: 303257 - RNA, 22 nt, Homo sapiens
uaacccuuaguaucuguggguu

SEQ ID NO: 303258 - RNA, 22 nt, Homo sapiens
uaacucugccuagugacauggu

SEQ ID NO: 303259 - RNA, 22 nt, Homo sapiens
uaaguaauugugguuucugcca

SEQ ID NO: 303260 - RNA, 20 nt, Homo sapiens
uaagugcauaggauauuucu

SEQ ID NO: 303261 - RNA, 22 nt, Homo sapiens
uaauagagucauuauuauuguu

SEQ ID NO: 303262 - RNA, 22 nt, Homo sapiens
uaaugcaucaugguuggcaaac

SEQ ID NO: 303263 - RNA, 22 nt, Homo sapiens
uacagucuagaggagaaucagg

SEQ ID NO: 303264 - RNA, 22 nt, Homo sapiens
uaccaaaguuucggccucuguu

SEQ ID NO: 303265 - RNA, 22 nt, Homo sapiens
uacuacuuucugacaucuuuaa

SEQ ID NO: 303266 - RNA, 22 nt, Homo sapiens
uacuuagagacaugcagcacug

SEQ ID NO: 303267 - RNA, 22 nt, Homo sapiens
uagagugcugucaaagacuugu

SEQ ID NO: 303268 - RNA, 22 nt, Homo sapiens
uagcacuauuuuucacuauccu

SEQ ID NO: 303269 - RNA, 22 nt, Homo sapiens
uagcaugacacuuguugaaugc

SEQ ID NO: 303270 - RNA, 22 nt, Homo sapiens
uaggaaguacaucucagaaucu

SEQ ID NO: 303271 - RNA, 22 nt, Homo sapiens
uaggacacaggacauauguaga

SEQ ID NO: 303272 - RNA, 22 nt, Homo sapiens
uagucccuuucuauuaaugaga

SEQ ID NO: 303273 - RNA, 22 nt, Homo sapiens
uagugcacuacuugugggaaug

SEQ ID NO: 303274 - RNA, 22 nt, Homo sapiens
uauaguguuuucaaaaguaugu

SEQ ID NO: 303275 - RNA, 22 nt, Homo sapiens
uauaugcacucagguguaugug

SEQ ID NO: 303276 - RNA, 22 nt, Homo sapiens
uaucaucauguuuuugcugugu

SEQ ID NO: 303277 - RNA, 22 nt, Homo sapiens
uaucaugucuguguguaccuag

SEQ ID NO: 303278 - RNA, 22 nt, Homo sapiens
uaucauugccucaaucuguauu

SEQ ID NO: 303279 - RNA, 22 nt, Homo sapiens
uaugacuguuugcucauucagg

SEQ ID NO: 303280 - RNA, 22 nt, Homo sapiens
uaugcacacguguccaugugca

SEQ ID NO: 303281 - RNA, 22 nt, Homo sapiens
uaugccuuuuggcucaagaaac

SEQ ID NO: 303282 - RNA, 22 nt, Homo sapiens
uaugugcaaauuaauugcuaga

SEQ ID NO: 303283 - RNA, 22 nt, Homo sapiens
uauugccugucuccaaaaauca

SEQ ID NO: 303284 - RNA, 22 nt, Homo sapiens
ucaaagacacacaaggagaagg

SEQ ID NO: 303285 - RNA, 22 nt, Homo sapiens
ucaacagugauggaaaguuaua

SEQ ID NO: 303286 - RNA, 22 nt, Homo sapiens
ucaacauugcugucaggcaucu

SEQ ID NO: 303287 - RNA, 22 nt, Homo sapiens
ucaacguauuuauauagcagag

SEQ ID NO: 303288 - RNA, 23 nt, Homo sapiens
ucaagugaugguggccacaaggg

SEQ ID NO: 303289 - RNA, 21 nt, Homo sapiens
ucacaaugaacagcagcagaa

SEQ ID NO: 303290 - RNA, 22 nt, Homo sapiens
ucacacugaauuugaagcaaug

SEQ ID NO: 303291 - RNA, 22 nt, Homo sapiens
ucacacugucuugguuacucuu

SEQ ID NO: 303292 - RNA, 23 nt, Homo sapiens
ucacacuuaagagaaaugcagcu

SEQ ID NO: 303293 - RNA, 22 nt, Homo sapiens
ucacaguccuguuuaggagagg

SEQ ID NO: 303294 - RNA, 23 nt, Homo sapiens
ucacaguggcugcuuaauuguga

SEQ ID NO: 303295 - RNA, 22 nt, Homo sapiens
ucacaucucagguuucuugaca

SEQ ID NO: 303296 - RNA, 22 nt, Homo sapiens
ucacauuaagcuguuauuucuu

SEQ ID NO: 303297 - RNA, 22 nt, Homo sapiens
ucacuaaagaaaauggcaugga

SEQ ID NO: 303298 - RNA, 19 nt, Homo sapiens
ucagaucagcccaagggau

SEQ ID NO: 303299 - RNA, 22 nt, Homo sapiens
ucagaucauauucuucgcugcu

SEQ ID NO: 303300 - RNA, 22 nt, Homo sapiens
ucagaucaugcuuaugauggga

SEQ ID NO: 303301 - RNA, 22 nt, Homo sapiens
ucagaugauuccguugacgaga

SEQ ID NO: 303302 - RNA, 22 nt, Homo sapiens
ucagauugaugcauacuuaaau

SEQ ID NO: 303303 - RNA, 22 nt, Homo sapiens
ucagcagugugaaaacaaacua

SEQ ID NO: 303304 - RNA, 22 nt, Homo sapiens
ucaguagagacaggauuucacc

SEQ ID NO: 303305 - RNA, 22 nt, Homo sapiens
ucagugucugugauggagaggu

SEQ ID NO: 303306 - RNA, 22 nt, Homo sapiens
ucaguucauggaggugucugcu

SEQ ID NO: 303307 - RNA, 21 nt, Homo sapiens
ucaucaagcuguagacaugau

SEQ ID NO: 303308 - RNA, 22 nt, Homo sapiens
ucauucauuugcucacuccaca

SEQ ID NO: 303309 - RNA, 19 nt, Homo sapiens
uccacagugguugaacuag

SEQ ID NO: 303310 - RNA, 22 nt, Homo sapiens
uccagguuuggcuuuauaacuu

SEQ ID NO: 303311 - RNA, 22 nt, Homo sapiens
ucgugccacugcacuccagccu

SEQ ID NO: 303312 - RNA, 22 nt, Homo sapiens
ucucaugaagauagagaauaga

SEQ ID NO: 303313 - RNA, 22 nt, Homo sapiens
ucucccauccaugaacuucugu

SEQ ID NO: 303314 - RNA, 22 nt, Homo sapiens
ucugucuugugguuugagugcc

SEQ ID NO: 303315 - RNA, 22 nt, Homo sapiens
ucugugaaugaacacuugaaaa

SEQ ID NO: 303316 - RNA, 19 nt, Homo sapiens
ucugugcuugucccccugu

SEQ ID NO: 303317 - RNA, 22 nt, Homo sapiens
ucuguguuugguuggcaauuuc

SEQ ID NO: 303318 - RNA, 22 nt, Homo sapiens
ucuugguuaggggaaauaggca

SEQ ID NO: 303319 - RNA, 22 nt, Homo sapiens
ucuuuagugacaguugugcaag

SEQ ID NO: 303320 - RNA, 22 nt, Homo sapiens
ugaaacacacagagaagggaga

SEQ ID NO: 303321 - RNA, 22 nt, Homo sapiens
ugaaacacacauugcccuuuau

SEQ ID NO: 303322 - RNA, 22 nt, Homo sapiens
ugaaaguuauauugugaaauuc

SEQ ID NO: 303323 - RNA, 22 nt, Homo sapiens
ugaauacuucaaaaaaauagcu

SEQ ID NO: 303324 - RNA, 22 nt, Homo sapiens
ugaauagaaguggcaggaguag

SEQ ID NO: 303325 - RNA, 23 nt, Homo sapiens
ugacagucucccgauggcuaggc

SEQ ID NO: 303326 - RNA, 22 nt, Homo sapiens
ugacaugauuguauauuuagaa

SEQ ID NO: 303327 - RNA, 22 nt, Homo sapiens
ugacuagagggcuuuuguguag

SEQ ID NO: 303328 - RNA, 22 nt, Homo sapiens
ugacuuuagaauuuuauccaga

SEQ ID NO: 303329 - RNA, 22 nt, Homo sapiens
ugagauauugggaguaauguca

SEQ ID NO: 303330 - RNA, 22 nt, Homo sapiens
ugagauggaucuuggauuugaa

SEQ ID NO: 303331 - RNA, 22 nt, Homo sapiens
ugagauggguaauuaaauggug

SEQ ID NO: 303332 - RNA, 23 nt, Homo sapiens
ugagauuauaaucuuuuacuucu

SEQ ID NO: 303333 - RNA, 22 nt, Homo sapiens
ugagauuaucuugaucuugaaa

SEQ ID NO: 303334 - RNA, 22 nt, Homo sapiens
ugagccauggcaccuugucuaa

SEQ ID NO: 303335 - RNA, 22 nt, Homo sapiens
ugaggagugaacuauuucugau

SEQ ID NO: 303336 - RNA, 19 nt, Homo sapiens
ugaguaucuuuacacaucu

SEQ ID NO: 303337 - RNA, 22 nt, Homo sapiens
ugaguauguuuagaaguaaagg

SEQ ID NO: 303338 - RNA, 22 nt, Homo sapiens
ugagucaugcuggagucauggc

SEQ ID NO: 303339 - RNA, 22 nt, Homo sapiens
ugaguuaaucucuacgauagaa

SEQ ID NO: 303340 - RNA, 22 nt, Homo sapiens
ugauauguuagaaucuugcaag

SEQ ID NO: 303341 - RNA, 20 nt, Homo sapiens
ugauauuucuggaaguggag

SEQ ID NO: 303342 - RNA, 20 nt, Homo sapiens
ugauauuuucugagcaggaa

SEQ ID NO: 303343 - RNA, 22 nt, Homo sapiens
ugauggccuguucuccauaugu

SEQ ID NO: 303344 - RNA, 19 nt, Homo sapiens
ugcaaagucagugaagggu

SEQ ID NO: 303345 - RNA, 22 nt, Homo sapiens
ugcaaaucuuguguaguuguga

SEQ ID NO: 303346 - RNA, 22 nt, Homo sapiens
ugcaaugugaaauaagcacauc

SEQ ID NO: 303347 - RNA, 22 nt, Homo sapiens
ugcaauuuaaugugucccaauu

SEQ ID NO: 303348 - RNA, 22 nt, Homo sapiens
ugcauugcacuugcaugagaua

SEQ ID NO: 303349 - RNA, 22 nt, Homo sapiens
ugcccuuugucagaugaguagg

SEQ ID NO: 303350 - RNA, 22 nt, Homo sapiens
ugcuauguaacacauuaccuuu

SEQ ID NO: 303351 - RNA, 21 nt, Homo sapiens
ugcuauguuguccaggcuggc

SEQ ID NO: 303352 - RNA, 20 nt, Homo sapiens
uggaaaguaagucaugauau

SEQ ID NO: 303353 - RNA, 22 nt, Homo sapiens
uggaaaguacuugaguuuguau

SEQ ID NO: 303354 - RNA, 22 nt, Homo sapiens
uggaagacaggcuguauuuuaa

SEQ ID NO: 303355 - RNA, 23 nt, Homo sapiens
uggaagacuccucucuuggcugc

SEQ ID NO: 303356 - RNA, 22 nt, Homo sapiens
uggaagucaugcugcaagaaca

SEQ ID NO: 303357 - RNA, 22 nt, Homo sapiens
uggaagucuauggcauuugagu

SEQ ID NO: 303358 - RNA, 22 nt, Homo sapiens
uggaaugucuuuuccccaaagc

SEQ ID NO: 303359 - RNA, 18 nt, Homo sapiens
uggagauaagaagaacuu

SEQ ID NO: 303360 - RNA, 22 nt, Homo sapiens
uggagugagaacuucaaugaug

SEQ ID NO: 303361 - RNA, 22 nt, Homo sapiens
uggcaagaacugcaauugcuuu

SEQ ID NO: 303362 - RNA, 20 nt, Homo sapiens
uggcaagauggcagaauaga

SEQ ID NO: 303363 - RNA, 22 nt, Homo sapiens
uggcauuuucucuguucuuaga

SEQ ID NO: 303364 - RNA, 22 nt, Homo sapiens
ugggaagauucuguguuuuucc

SEQ ID NO: 303365 - RNA, 22 nt, Homo sapiens
ugggaugaugaaaaggcuuucu

SEQ ID NO: 303366 - RNA, 22 nt, Homo sapiens
uguagcacauuugaagagaagc

SEQ ID NO: 303367 - RNA, 22 nt, Homo sapiens
ugucauggugcucugggcccug

SEQ ID NO: 303368 - RNA, 19 nt, Homo sapiens
ugugaacaucacagagugu

SEQ ID NO: 303369 - RNA, 22 nt, Homo sapiens
ugugauuggccuggcguggguc

SEQ ID NO: 303370 - RNA, 22 nt, Homo sapiens
ugugcauauaaguguguauaua

SEQ ID NO: 303371 - RNA, 22 nt, Homo sapiens
ugugcuugaaauucaguuuuga

SEQ ID NO: 303372 - RNA, 22 nt, Homo sapiens
uguguaaauaugauagaggaau

SEQ ID NO: 303373 - RNA, 22 nt, Homo sapiens
ugugucuuguuuuuucccaggc

SEQ ID NO: 303374 - RNA, 22 nt, Homo sapiens
uuaaaaguauaggccuggcaua

SEQ ID NO: 303375 - RNA, 22 nt, Homo sapiens
uuaaugaacuuuauuuuguaga

SEQ ID NO: 303376 - RNA, 22 nt, Homo sapiens
uuacauguuguggguuguggcc

SEQ ID NO: 303377 - RNA, 22 nt, Homo sapiens
uuagcacaguucauucauguua

SEQ ID NO: 303378 - RNA, 22 nt, Homo sapiens
uuagcacaucuuucuauguaag

SEQ ID NO: 303379 - RNA, 22 nt, Homo sapiens
uuauauguuucuuagggacaga

SEQ ID NO: 303380 - RNA, 22 nt, Homo sapiens
uucauagaggacauuacuggag

SEQ ID NO: 303381 - RNA, 22 nt, Homo sapiens
uucauagugaaaaauucaaagu

SEQ ID NO: 303382 - RNA, 22 nt, Homo sapiens
uucaucagggagaaauaauuuc

SEQ ID NO: 303383 - RNA, 22 nt, Homo sapiens
uuccagcugggggcaacucugc

SEQ ID NO: 303384 - RNA, 22 nt, Homo sapiens
uucccagagaaaaggguuucuu

SEQ ID NO: 303385 - RNA, 22 nt, Homo sapiens
uucccuugcaggaugaucugga

SEQ ID NO: 303386 - RNA, 22 nt, Homo sapiens
uucccuuuguuaaauuggaaga

SEQ ID NO: 303387 - RNA, 22 nt, Homo sapiens
uucuauugguaauauuuucugu

SEQ ID NO: 303388 - RNA, 22 nt, Homo sapiens
uacuuuguagagugugagaauu

SEQ ID NO: 303389 - RNA, 22 nt, Homo sapiens
uagaacauuccaggugauguug

SEQ ID NO: 303390 - RNA, 18 nt, Homo sapiens
uagaauauaggucauucu

SEQ ID NO: 303391 - RNA, 22 nt, Homo sapiens
uagauaauuagaggguuuuaag

SEQ ID NO: 303392 - RNA, 22 nt, Homo sapiens
uagcacuauguuaucacauacu

SEQ ID NO: 303393 - RNA, 22 nt, Homo sapiens
uagcaucagauuccauauucua

SEQ ID NO: 303394 - RNA, 22 nt, Homo sapiens
uagcauggaggcggccauagug

SEQ ID NO: 303395 - RNA, 22 nt, Homo sapiens
uaggcaaaugcaagaguagaac

SEQ ID NO: 303396 - RNA, 22 nt, Homo sapiens
uaggucuuuuagcauaggagcu

SEQ ID NO: 303397 - RNA, 22 nt, Homo sapiens
uaguaaacauuuuucuaucauu

SEQ ID NO: 303398 - RNA, 20 nt, Homo sapiens
uauagcaauuuuuuucuccu

SEQ ID NO: 303399 - RNA, 22 nt, Homo sapiens
uauaugcauugugggguacuga

SEQ ID NO: 303400 - RNA, 22 nt, Homo sapiens
uaucaacaggguggccagugua

SEQ ID NO: 303401 - RNA, 22 nt, Homo sapiens
uaucacacgccuugcuucauuu

SEQ ID NO: 303402 - RNA, 22 nt, Homo sapiens
uaucacacuguuggauuugauu

SEQ ID NO: 303403 - RNA, 23 nt, Homo sapiens
uaucacacuuucucugugccaca

SEQ ID NO: 303404 - RNA, 22 nt, Homo sapiens
uaucaccauguccguuuuaaaa

SEQ ID NO: 303405 - RNA, 22 nt, Homo sapiens
uaucccaauguaauaucacaaa

SEQ ID NO: 303406 - RNA, 22 nt, Homo sapiens
uaugccucuucauaaaguauga

SEQ ID NO: 303407 - RNA, 22 nt, Homo sapiens
uauggauucuagcucaguaggu

SEQ ID NO: 303408 - RNA, 22 nt, Homo sapiens
uauggauuuuuuugacaagagc

SEQ ID NO: 303409 - RNA, 22 nt, Homo sapiens
uauggguauuuuauacauaacc

SEQ ID NO: 303410 - RNA, 22 nt, Homo sapiens
uauguuaucaaaaagcuaagga

SEQ ID NO: 303411 - RNA, 22 nt, Homo sapiens
uauuccauuugugaaaggaagu

SEQ ID NO: 303412 - RNA, 22 nt, Homo sapiens
ucaaaugcuguauuguaguaau

SEQ ID NO: 303413 - RNA, 19 nt, Homo sapiens
ucacacuguggcuucuuua

SEQ ID NO: 303414 - RNA, 22 nt, Homo sapiens
ucacagugcaggaucaguuaau

SEQ ID NO: 303415 - RNA, 22 nt, Homo sapiens
ucaccuggagacaugaagacug

SEQ ID NO: 303416 - RNA, 20 nt, Homo sapiens
ucacuggagcucauuugauu

SEQ ID NO: 303417 - RNA, 22 nt, Homo sapiens
ucacuguguauguauaugcagg

SEQ ID NO: 303418 - RNA, 22 nt, Homo sapiens
ucacuugguggcaaaguuuaug

SEQ ID NO: 303419 - RNA, 22 nt, Homo sapiens
ucagagucuagaucacucacug

SEQ ID NO: 303420 - RNA, 22 nt, Homo sapiens
ucagauuggugcaaaaguaauu

SEQ ID NO: 303421 - RNA, 22 nt, Homo sapiens
ucauauguaugugcaauuuugu

SEQ ID NO: 303422 - RNA, 22 nt, Homo sapiens
ucaugugaggauaacaauagug

SEQ ID NO: 303423 - RNA, 22 nt, Homo sapiens
ucauucacucccuugaaguuag

SEQ ID NO: 303424 - RNA, 22 nt, Homo sapiens
ucauugcacuccagccugggug

SEQ ID NO: 303425 - RNA, 22 nt, Homo sapiens
uccacagugguggaauuguuca

SEQ ID NO: 303426 - RNA, 22 nt, Homo sapiens
uccagcuuuuucuaauucugug

SEQ ID NO: 303427 - RNA, 22 nt, Homo sapiens
uccaguagaauuuuauucaaca

SEQ ID NO: 303428 - RNA, 18 nt, Homo sapiens
uccaguuuucccagcauc

SEQ ID NO: 303429 - RNA, 22 nt, Homo sapiens
uccauagacauuuuaagguagu

SEQ ID NO: 303430 - RNA, 19 nt, Homo sapiens
uccccaguuuuccguucag

SEQ ID NO: 303431 - RNA, 22 nt, Homo sapiens
ucccugacagggucugagcuuu

SEQ ID NO: 303432 - RNA, 22 nt, Homo sapiens
uccuuuggucaguauucuuuug

SEQ ID NO: 303433 - RNA, 21 nt, Homo sapiens
ucuggcuuucauuccccuucu

SEQ ID NO: 303434 - RNA, 19 nt, Homo sapiens
ucuguaguuagggcuacag

SEQ ID NO: 303435 - RNA, 22 nt, Homo sapiens
ucugucacugaaucccugucac

SEQ ID NO: 303436 - RNA, 22 nt, Homo sapiens
ucuguguuuagacccaggguag

SEQ ID NO: 303437 - RNA, 22 nt, Homo sapiens
ucuguguuugaucaagauugua

SEQ ID NO: 303438 - RNA, 19 nt, Homo sapiens
ucuuuagucacauuuuuau

SEQ ID NO: 303439 - RNA, 18 nt, Homo sapiens
ugaaacacauuuuuuccu

SEQ ID NO: 303440 - RNA, 22 nt, Homo sapiens
ugaaaugccuuuaaugaauuua

SEQ ID NO: 303441 - RNA, 22 nt, Homo sapiens
ugaaauggaaagaguguagacu

SEQ ID NO: 303442 - RNA, 22 nt, Homo sapiens
ugaaauguaaguugucuagucu

SEQ ID NO: 303443 - RNA, 22 nt, Homo sapiens
ugaacagcuaucuugucagugu

SEQ ID NO: 303444 - RNA, 22 nt, Homo sapiens
ugaauggauccaauucuuagua

SEQ ID NO: 303445 - RNA, 22 nt, Homo sapiens
ugaauuguuucauucuuuacau

SEQ ID NO: 303446 - RNA, 22 nt, Homo sapiens
ugacaaguaaacagucagcacc

SEQ ID NO: 303447 - RNA, 18 nt, Homo sapiens
ugacaucauuuagaaagg

SEQ ID NO: 303448 - RNA, 22 nt, Homo sapiens
ugacaugaugagcaauaauggc

SEQ ID NO: 303449 - RNA, 22 nt, Homo sapiens
ugacuacauaaguaaucucaaa

SEQ ID NO: 303450 - RNA, 22 nt, Homo sapiens
ugacucaagagccugacucauc

SEQ ID NO: 303451 - RNA, 22 nt, Homo sapiens
ugacucaguuguuagucuucau

SEQ ID NO: 303452 - RNA, 22 nt, Homo sapiens
ugagaacugguagcacuuguga

SEQ ID NO: 303453 - RNA, 22 nt, Homo sapiens
ugagacaaaguuguuggauguu

SEQ ID NO: 303454 - RNA, 22 nt, Homo sapiens
ugagaucacgccacugcacucc

SEQ ID NO: 303455 - RNA, 22 nt, Homo sapiens
ugagaucaugccacugcacuuc

SEQ ID NO: 303456 - RNA, 22 nt, Homo sapiens
ugagaugauagauauguuaauu

SEQ ID NO: 303457 - RNA, 21 nt, Homo sapiens
ugagaugauccugcaugcaug

SEQ ID NO: 303458 - RNA, 20 nt, Homo sapiens
ugagauuggugugguauaag

SEQ ID NO: 303459 - RNA, 22 nt, Homo sapiens
ugagcaucucuaaaaggagcaa

SEQ ID NO: 303460 - RNA, 22 nt, Homo sapiens
ugagccaugguuagcuucucau

SEQ ID NO: 303461 - RNA, 22 nt, Homo sapiens
ugaggcaaggcugaaugaaggc

SEQ ID NO: 303462 - RNA, 22 nt, Homo sapiens
ugaggcuaggauaggcugauuc

SEQ ID NO: 303463 - RNA, 20 nt, Homo sapiens
ugaggucugagaaagaauga

SEQ ID NO: 303464 - RNA, 22 nt, Homo sapiens
ugaggugaaguaauauucuaag

SEQ ID NO: 303465 - RNA, 22 nt, Homo sapiens
ugaguagaacuccuggagaugu

SEQ ID NO: 303466 - RNA, 22 nt, Homo sapiens
ugauauauugaaugaugaaaca

SEQ ID NO: 303467 - RNA, 18 nt, Homo sapiens
ugauaucaucacaauuga

SEQ ID NO: 303468 - RNA, 22 nt, Homo sapiens
ugaucugucucggguuaucagu

SEQ ID NO: 303469 - RNA, 22 nt, Homo sapiens
ugauggcauuucauguuuguaa

SEQ ID NO: 303470 - RNA, 22 nt, Homo sapiens
ugcaaauguuaguaacaccacu

SEQ ID NO: 303471 - RNA, 22 nt, Homo sapiens
ugcaagaugauuucaauugaua

SEQ ID NO: 303472 - RNA, 17 nt, Homo sapiens
ugcaauuuaagcuagau

SEQ ID NO: 303473 - RNA, 22 nt, Homo sapiens
ugcauacacaagcauacaugua

SEQ ID NO: 303474 - RNA, 22 nt, Homo sapiens
ugcauccauucuagacucaucu

SEQ ID NO: 303475 - RNA, 22 nt, Homo sapiens
ugccaguguuuuguugaagauu

SEQ ID NO: 303476 - RNA, 22 nt, Homo sapiens
ugcugcaaacaugagaggaagu

SEQ ID NO: 303477 - RNA, 22 nt, Homo sapiens
uggaaaguacugagguccaccu

SEQ ID NO: 303478 - RNA, 22 nt, Homo sapiens
uggaagucauugagguguguua

SEQ ID NO: 303479 - RNA, 22 nt, Homo sapiens
uggagucuugcucuguugccca

SEQ ID NO: 303480 - RNA, 20 nt, Homo sapiens
uggagugaagguucuggacc

SEQ ID NO: 303481 - RNA, 22 nt, Homo sapiens
uggauauguucuuuguguaagg

SEQ ID NO: 303482 - RNA, 22 nt, Homo sapiens
guggaagucuuugguauuggua

SEQ ID NO: 303483 - RNA, 22 nt, Homo sapiens
guggacagagacuaaauguugu

SEQ ID NO: 303484 - RNA, 22 nt, Homo sapiens
guggaggacuggauaaagaaaa

SEQ ID NO: 303485 - RNA, 22 nt, Homo sapiens
guggcagugugaggauccugcu

SEQ ID NO: 303486 - RNA, 22 nt, Homo sapiens
gugucuccuguggagcuaugua

SEQ ID NO: 303487 - RNA, 22 nt, Homo sapiens
guguggaacucaauacaacgca

SEQ ID NO: 303488 - RNA, 22 nt, Homo sapiens
guguucaaauucugacagagag

SEQ ID NO: 303489 - RNA, 22 nt, Homo sapiens
guuaagaaguguaacuuaaguu

SEQ ID NO: 303490 - RNA, 22 nt, Homo sapiens
guucacacuugcaaccccagca

SEQ ID NO: 303491 - RNA, 22 nt, Homo sapiens
guucaucagggauacuggcuua

SEQ ID NO: 303492 - RNA, 22 nt, Homo sapiens
uaaagugcugagaugaggcugg

SEQ ID NO: 303493 - RNA, 22 nt, Homo sapiens
uaaaugcuugagaugauggaua

SEQ ID NO: 303494 - RNA, 22 nt, Homo sapiens
uaacauagucauauacuugcuu

SEQ ID NO: 303495 - RNA, 22 nt, Homo sapiens
uaagugcaacauaaguguuaaa

SEQ ID NO: 303496 - RNA, 22 nt, Homo sapiens
uaaugcauguaaugggcugaua

SEQ ID NO: 303497 - RNA, 22 nt, Homo sapiens
uagaauguaaauuccaagggca

SEQ ID NO: 303498 - RNA, 20 nt, Homo sapiens
uagacagcuagauuagauag

SEQ ID NO: 303499 - RNA, 22 nt, Homo sapiens
uagagagcuguuugaaagcagg

SEQ ID NO: 303500 - RNA, 22 nt, Homo sapiens
uagagauaucaauuucauggug

SEQ ID NO: 303501 - RNA, 22 nt, Homo sapiens
uagcacaugucagguaauuugc

SEQ ID NO: 303502 - RNA, 22 nt, Homo sapiens
uaggaaguuucuugauuacuua

SEQ ID NO: 303503 - RNA, 22 nt, Homo sapiens
uaggucuuuuaugaaauauauu

SEQ ID NO: 303504 - RNA, 22 nt, Homo sapiens
uauacugucuuuguaugccuag

SEQ ID NO: 303505 - RNA, 22 nt, Homo sapiens
uauacuguuuucuauaguggcu

SEQ ID NO: 303506 - RNA, 22 nt, Homo sapiens
uauagcaaugugccacucucug

SEQ ID NO: 303507 - RNA, 19 nt, Homo sapiens
uaucaaguaugcacuguac

SEQ ID NO: 303508 - RNA, 22 nt, Homo sapiens
uaucacacaucaugguaaaucu

SEQ ID NO: 303509 - RNA, 21 nt, Homo sapiens
uaucacauuggugauuaaguu

SEQ ID NO: 303510 - RNA, 22 nt, Homo sapiens
uaucagcgugcaaaucuuugga

SEQ ID NO: 303511 - RNA, 22 nt, Homo sapiens
uaucauaguuuggacuuucauu

SEQ ID NO: 303512 - RNA, 22 nt, Homo sapiens
uaucucuuuucauguguaaaug

SEQ ID NO: 303513 - RNA, 17 nt, Homo sapiens
uauguaguacuuauaaa

SEQ ID NO: 303514 - RNA, 19 nt, Homo sapiens
uauguaguuuucucaauau

SEQ ID NO: 303515 - RNA, 22 nt, Homo sapiens
uauucaagccaaauucaagcca

SEQ ID NO: 303516 - RNA, 22 nt, Homo sapiens
uauugcccugcuuuguucuaaa

SEQ ID NO: 303517 - RNA, 22 nt, Homo sapiens
uauugcucaugcauuuaauuuc

SEQ ID NO: 303518 - RNA, 22 nt, Homo sapiens
ucaaagucuucucaaguaacau

SEQ ID NO: 303519 - RNA, 18 nt, Homo sapiens
ucaagcaauugucaugcc

SEQ ID NO: 303520 - RNA, 22 nt, Homo sapiens
ucaagugauucuugugccuuag

SEQ ID NO: 303521 - RNA, 22 nt, Homo sapiens
ucacaaagcuuggccugcuucu

SEQ ID NO: 303522 - RNA, 22 nt, Homo sapiens
ucacacugaaacuaggguguga

SEQ ID NO: 303523 - RNA, 22 nt, Homo sapiens
ucacacugcaucuguuggaauu

SEQ ID NO: 303524 - RNA, 22 nt, Homo sapiens
ucacagucaaaguaaucauaga

SEQ ID NO: 303525 - RNA, 22 nt, Homo sapiens
ucacugagcuagaucacuugac

SEQ ID NO: 303526 - RNA, 21 nt, Homo sapiens
ucagggaccugcuguacugau

SEQ ID NO: 303527 - RNA, 22 nt, Homo sapiens
ucagguaucuucauagcaaugc

SEQ ID NO: 303528 - RNA, 22 nt, Homo sapiens
ucaggucauuccaggagggcca

SEQ ID NO: 303529 - RNA, 22 nt, Homo sapiens
ucagugaauguuggccacuacu

SEQ ID NO: 303530 - RNA, 22 nt, Homo sapiens
ucauacuguugugaaacaaaac

SEQ ID NO: 303531 - RNA, 22 nt, Homo sapiens
ucauaguagucacuuaauaaau

SEQ ID NO: 303532 - RNA, 22 nt, Homo sapiens
ucauucuuucuguggaggggcu

SEQ ID NO: 303533 - RNA, 22 nt, Homo sapiens
uccacaguaaggacccugccuu

SEQ ID NO: 303534 - RNA, 22 nt, Homo sapiens
uccagguuucaugcucuuuauu

SEQ ID NO: 303535 - RNA, 22 nt, Homo sapiens
uccagguuuugugaguuuaaau

SEQ ID NO: 303536 - RNA, 22 nt, Homo sapiens
ucccugagguccuggauuauug

SEQ ID NO: 303537 - RNA, 22 nt, Homo sapiens
ucccugaguaucuaauguguuu

SEQ ID NO: 303538 - RNA, 19 nt, Homo sapiens
ucccugagucuuagcuuga

SEQ ID NO: 303539 - RNA, 22 nt, Homo sapiens
uccuacaugcaguacauucaaa

SEQ ID NO: 303540 - RNA, 17 nt, Homo sapiens
ucucccaucccuuucuc

SEQ ID NO: 303541 - RNA, 22 nt, Homo sapiens
ucucuugguugaacaguuugga

SEQ ID NO: 303542 - RNA, 22 nt, Homo sapiens
ucugagaucaugucugugcugu

SEQ ID NO: 303543 - RNA, 22 nt, Homo sapiens
ucugucuuguccucacccuaga

SEQ ID NO: 303544 - RNA, 22 nt, Homo sapiens
ucuugcuuuugcagagcuucuc

SEQ ID NO: 303545 - RNA, 22 nt, Homo sapiens
ucuuuaguuaagggacauuuua

SEQ ID NO: 303546 - RNA, 22 nt, Homo sapiens
ucuuugauuuuguuacuaagac

SEQ ID NO: 303547 - RNA, 21 nt, Homo sapiens
ucuuuggucaccaguuuucau

SEQ ID NO: 303548 - RNA, 22 nt, Homo sapiens
ucuuuguuuucugauccugaag

SEQ ID NO: 303549 - RNA, 22 nt, Homo sapiens
ugaaagacugaagaauaggcau

SEQ ID NO: 303550 - RNA, 22 nt, Homo sapiens
ugaaagcuacagucuccuagga

SEQ ID NO: 303551 - RNA, 22 nt, Homo sapiens
ugaaaugauuauaugguguuug

SEQ ID NO: 303552 - RNA, 22 nt, Homo sapiens
ugaaaugcagaacuuuaggucu

SEQ ID NO: 303553 - RNA, 22 nt, Homo sapiens
ugaaaugcugucuaggggaaau

SEQ ID NO: 303554 - RNA, 22 nt, Homo sapiens
ugaaauguuaaacaaguggcuc

SEQ ID NO: 303555 - RNA, 22 nt, Homo sapiens
ugaacagcacguuuauucagaa

SEQ ID NO: 303556 - RNA, 22 nt, Homo sapiens
ugaacuaguaguuuacuugaug

SEQ ID NO: 303557 - RNA, 22 nt, Homo sapiens
ugaaggcaggagggagaaaagu

SEQ ID NO: 303558 - RNA, 22 nt, Homo sapiens
ugaagugaaugguaaguaugcc

SEQ ID NO: 303559 - RNA, 22 nt, Homo sapiens
ugaauacuucguucaaagauaa

SEQ ID NO: 303560 - RNA, 22 nt, Homo sapiens
ugaauagacacuaaagacugua

SEQ ID NO: 303561 - RNA, 22 nt, Homo sapiens
ugaauauuugcuacucacucuu

SEQ ID NO: 303562 - RNA, 22 nt, Homo sapiens
ugaaugguaauuuaguaggcac

SEQ ID NO: 303563 - RNA, 22 nt, Homo sapiens
ugaaugguuuuuagagaacaau

SEQ ID NO: 303564 - RNA, 21 nt, Homo sapiens
ugacagaaaauugaguuugcu

SEQ ID NO: 303565 - RNA, 22 nt, Homo sapiens
ugacuagacuugcaagguugca

SEQ ID NO: 303566 - RNA, 22 nt, Homo sapiens
ugacuucagacugaaaugauuc

SEQ ID NO: 303567 - RNA, 22 nt, Homo sapiens
ugagauaguuguagauguacau

SEQ ID NO: 303568 - RNA, 22 nt, Homo sapiens
ugagaugaaagcagaaagacuu

SEQ ID NO: 303569 - RNA, 22 nt, Homo sapiens
ugagaugaugggauaagagggc

SEQ ID NO: 303570 - RNA, 19 nt, Homo sapiens
ugagauuguaugaggagau

SEQ ID NO: 303571 - RNA, 22 nt, Homo sapiens
ugagauuguucuaugucugguu

SEQ ID NO: 303572 - RNA, 20 nt, Homo sapiens
ugagcuuguaaacacuguuu

SEQ ID NO: 303573 - RNA, 22 nt, Homo sapiens
ugauaugaaguucaaaccaggu

SEQ ID NO: 303574 - RNA, 22 nt, Homo sapiens
ugauguguuuuguaguucaacu

SEQ ID NO: 303575 - RNA, 22 nt, Homo sapiens
ugcaaaguccucauucuuaccc

SEQ ID NO: 303576 - RNA, 22 nt, Homo sapiens
guacagugcucacaaugagagc

SEQ ID NO: 303577 - RNA, 22 nt, Homo sapiens
guagaaagcauuucagauuugc

SEQ ID NO: 303578 - RNA, 22 nt, Homo sapiens
guagaagcacagggccuguauu

SEQ ID NO: 303579 - RNA, 19 nt, Homo sapiens
guauuugacuuucuuguuu

SEQ ID NO: 303580 - RNA, 22 nt, Homo sapiens
gucacauugaugcccauggugg

SEQ ID NO: 303581 - RNA, 22 nt, Homo sapiens
gucaucaggacgggucaucugc

SEQ ID NO: 303582 - RNA, 22 nt, Homo sapiens
guccagagaagucauuacuuca

SEQ ID NO: 303583 - RNA, 22 nt, Homo sapiens
gucccagagauauugugucuuu

SEQ ID NO: 303584 - RNA, 22 nt, Homo sapiens
gucucacagcuagcugcuuuau

SEQ ID NO: 303585 - RNA, 22 nt, Homo sapiens
gucugugguuccuaugucaccu

SEQ ID NO: 303586 - RNA, 22 nt, Homo sapiens
gugaaucauaugccagucaugc

SEQ ID NO: 303587 - RNA, 22 nt, Homo sapiens
gugcaaauguuauugagguuuu

SEQ ID NO: 303588 - RNA, 22 nt, Homo sapiens
gugcacaacguguagguuuguu

SEQ ID NO: 303589 - RNA, 22 nt, Homo sapiens
guggaaagaacacaaaauuagg

SEQ ID NO: 303590 - RNA, 22 nt, Homo sapiens
ucagaucacuggcgcuggcgga

SEQ ID NO: 303591 - RNA, 22 nt, Homo sapiens
ucagaucaguuccacaagaacu

SEQ ID NO: 303592 - RNA, 22 nt, Homo sapiens
ucagaucauuaagguagguuua

SEQ ID NO: 303593 - RNA, 20 nt, Homo sapiens
ucagguagaucuuugagguc

SEQ ID NO: 303594 - RNA, 22 nt, Homo sapiens
ucagguaucucuauagcaaugu

SEQ ID NO: 303595 - RNA, 22 nt, Homo sapiens
ucaggugcagagaagaaauggg

SEQ ID NO: 303596 - RNA, 22 nt, Homo sapiens
ucagugaauacauguacucaug

SEQ ID NO: 303597 - RNA, 22 nt, Homo sapiens
ucaguggauuauuaaagucacc

SEQ ID NO: 303598 - RNA, 22 nt, Homo sapiens
ucauagaucaaguaauaagaca

SEQ ID NO: 303599 - RNA, 18 nt, Homo sapiens
ucauagaucaugacagug

SEQ ID NO: 303600 - RNA, 22 nt, Homo sapiens
ucauaguacuuuguuuugaaaa

SEQ ID NO: 303601 - RNA, 22 nt, Homo sapiens
ucauugcauuccagcccaagca

SEQ ID NO: 303602 - RNA, 22 nt, Homo sapiens
ucccugacagucacagagcuac

SEQ ID NO: 303603 - RNA, 18 nt, Homo sapiens
ucccugacucaaauucuu

SEQ ID NO: 303604 - RNA, 22 nt, Homo sapiens
ucccugagcaaaguuuucugua

SEQ ID NO: 303605 - RNA, 22 nt, Homo sapiens
ucccugagugauugaaaauaaa

SEQ ID NO: 303606 - RNA, 22 nt, Homo sapiens
ucccuugagccuggcuucucac

SEQ ID NO: 303607 - RNA, 22 nt, Homo sapiens
ucguucuugucaguuuauaaag

SEQ ID NO: 303608 - RNA, 22 nt, Homo sapiens
ucucaguguuaucuaucugccu

SEQ ID NO: 303609 - RNA, 22 nt, Homo sapiens
ucugagcaugcaucuugccugg

SEQ ID NO: 303610 - RNA, 22 nt, Homo sapiens
ucugugaaugugaccuuauuug

SEQ ID NO: 303611 - RNA, 21 nt, Homo sapiens
ucuguguugaucucacuggga

SEQ ID NO: 303612 - RNA, 22 nt, Homo sapiens
ucuugcaguucccaaauucaca

SEQ ID NO: 303613 - RNA, 22 nt, Homo sapiens
ucuuuaguaauuucuguaaggc

SEQ ID NO: 303614 - RNA, 19 nt, Homo sapiens
ucuuugcuuuucuaagagg

SEQ ID NO: 303615 - RNA, 22 nt, Homo sapiens
ugaaacacaccuccucuccauc

SEQ ID NO: 303616 - RNA, 20 nt, Homo sapiens
ugaaacacauggacuggggu

SEQ ID NO: 303617 - RNA, 22 nt, Homo sapiens
ugaagaucuuaggagcugaggg

SEQ ID NO: 303618 - RNA, 22 nt, Homo sapiens
ugaaggacauaaggcagaguga

SEQ ID NO: 303619 - RNA, 22 nt, Homo sapiens
ugaagugaagcaguaguguggg

SEQ ID NO: 303620 - RNA, 22 nt, Homo sapiens
ugaauauguuaaauaauguucu

SEQ ID NO: 303621 - RNA, 22 nt, Homo sapiens
ugaauguauuuauuaccauuca

SEQ ID NO: 303622 - RNA, 22 nt, Homo sapiens
ugacaucaccaccuccgucauc

SEQ ID NO: 303623 - RNA, 20 nt, Homo sapiens
ugacaucagcaauguaauaa

SEQ ID NO: 303624 - RNA, 21 nt, Homo sapiens
ugacuagauuccagauuggcc

SEQ ID NO: 303625 - RNA, 22 nt, Homo sapiens
ugagaacauggagaacccccca

SEQ ID NO: 303626 - RNA, 22 nt, Homo sapiens
ugagagaugaacucugauaugu

SEQ ID NO: 303627 - RNA, 19 nt, Homo sapiens
ugagagcacaacugaacaa

SEQ ID NO: 303628 - RNA, 22 nt, Homo sapiens
ugagaucuguaaagucugacau

SEQ ID NO: 303629 - RNA, 22 nt, Homo sapiens
ugagaugaagcuagaagaaugg

SEQ ID NO: 303630 - RNA, 22 nt, Homo sapiens
ugagaugaagugauguaaaaca

SEQ ID NO: 303631 - RNA, 22 nt, Homo sapiens
ugagaugauaucuuauuguaau

SEQ ID NO: 303632 - RNA, 22 nt, Homo sapiens
ugagaugauuuaauggagccca

SEQ ID NO: 303633 - RNA, 22 nt, Homo sapiens
ugagauuaucguaauguaucuc

SEQ ID NO: 303634 - RNA, 22 nt, Homo sapiens
ugagcacauuuacaucaguucc

SEQ ID NO: 303635 - RNA, 22 nt, Homo sapiens
ugaggaaugaccccgugugguc

SEQ ID NO: 303636 - RNA, 22 nt, Homo sapiens
ugaggauaguguugaaggcagg

SEQ ID NO: 303637 - RNA, 20 nt, Homo sapiens
ugaguagaggaguucuauca

SEQ ID NO: 303638 - RNA, 22 nt, Homo sapiens
ugaguaugaguucaggaaaggc

SEQ ID NO: 303639 - RNA, 22 nt, Homo sapiens
ugauaugaaagggaaauaagug

SEQ ID NO: 303640 - RNA, 22 nt, Homo sapiens
ugauauguguaaacaauguaua

SEQ ID NO: 303641 - RNA, 22 nt, Homo sapiens
ugaucuuuuuaauguccauggg

SEQ ID NO: 303642 - RNA, 22 nt, Homo sapiens
ugauguugaauuguucagcguc

SEQ ID NO: 303643 - RNA, 22 nt, Homo sapiens
ugcaaguggauuuuuccccaga

SEQ ID NO: 303644 - RNA, 22 nt, Homo sapiens
ugcaauauccucuacuauaggu

SEQ ID NO: 303645 - RNA, 22 nt, Homo sapiens
ugcauagaauguucuguaaaua

SEQ ID NO: 303646 - RNA, 23 nt, Homo sapiens
ugcauaguacccaauacuuuauc

SEQ ID NO: 303647 - RNA, 22 nt, Homo sapiens
ugcaucaggcugcuuauuacaa

SEQ ID NO: 303648 - RNA, 20 nt, Homo sapiens
ugcauguccucacuuacuug

SEQ ID NO: 303649 - RNA, 22 nt, Homo sapiens
ugccauugcacuccagccuggg

SEQ ID NO: 303650 - RNA, 22 nt, Homo sapiens
ugccuaguggaaggagagcaaa

SEQ ID NO: 303651 - RNA, 22 nt, Homo sapiens
ugcugguuuucaucaucagugg

SEQ ID NO: 303652 - RNA, 22 nt, Homo sapiens
uggaaaguccaagccaaccggg

SEQ ID NO: 303653 - RNA, 20 nt, Homo sapiens
uggaaguaagaauauaggug

SEQ ID NO: 303654 - RNA, 22 nt, Homo sapiens
uggagaacauucauuugcaaga

SEQ ID NO: 303655 - RNA, 22 nt, Homo sapiens
uggagacaaagauagaaaagca

SEQ ID NO: 303656 - RNA, 22 nt, Homo sapiens
uggaguaggccuaagaaugaca

SEQ ID NO: 303657 - RNA, 22 nt, Homo sapiens
uggagugaaaacacacuaaucu

SEQ ID NO: 303658 - RNA, 21 nt, Homo sapiens
uggagugaagaguuuauugac

SEQ ID NO: 303659 - RNA, 22 nt, Homo sapiens
uggagugauaugguuauauggg

SEQ ID NO: 303660 - RNA, 22 nt, Homo sapiens
uggauagauacuauccaggacu

SEQ ID NO: 303661 - RNA, 22 nt, Homo sapiens
uggcaaaauauuuugguuucug

SEQ ID NO: 303662 - RNA, 22 nt, Homo sapiens
uggcaaauagcaauaggagggu

SEQ ID NO: 303663 - RNA, 22 nt, Homo sapiens
uggcaaaucagaggcauggaca

SEQ ID NO: 303664 - RNA, 22 nt, Homo sapiens
uggcaauaaggacuccuuaggu

SEQ ID NO: 303665 - RNA, 22 nt, Homo sapiens
uggcaugcauuguggguaauua

SEQ ID NO: 303666 - RNA, 23 nt, Homo sapiens
uggcauuuuaguuagcuucagug

SEQ ID NO: 303667 - RNA, 23 nt, Homo sapiens
uggcauuuuuggcaaugccuucu

SEQ ID NO: 303668 - RNA, 22 nt, Homo sapiens
uggcuuuuaucuacucucaacu

SEQ ID NO: 303669 - RNA, 22 nt, Homo sapiens
ugggaaauguagccuagcugug

SEQ ID NO: 303670 - RNA, 20 nt, Homo sapiens
ugggaacaugugguauaugg

SEQ ID NO: 303671 - RNA, 22 nt, Homo sapiens
ugggaagagggagcgauuuugg

SEQ ID NO: 303672 - RNA, 22 nt, Homo sapiens
ugggcaagugacuuggcuucuc

SEQ ID NO: 303673 - RNA, 22 nt, Homo sapiens
ugguauuuaauauaugagaguu

SEQ ID NO: 303674 - RNA, 22 nt, Homo sapiens
uggucaguugugccucaauucc

SEQ ID NO: 303675 - RNA, 22 nt, Homo sapiens
uggucuucuggccuccagaacc

SEQ ID NO: 303676 - RNA, 22 nt, Homo sapiens
uguaugaguuguuuauaaauuu

SEQ ID NO: 303677 - RNA, 22 nt, Homo sapiens
uguauguaaagacaggauaaca

SEQ ID NO: 303678 - RNA, 22 nt, Homo sapiens
ugucagggaggcucggccgcac

SEQ ID NO: 303679 - RNA, 22 nt, Homo sapiens
ugugaagauggacuaauauagu

SEQ ID NO: 303680 - RNA, 22 nt, Homo sapiens
ugugaguguguacuaguuauca

SEQ ID NO: 303681 - RNA, 22 nt, Homo sapiens
ugugauugauuaaugugugcua

SEQ ID NO: 303682 - RNA, 18 nt, Homo sapiens
ugugcaauauuaaccacc

SEQ ID NO: 303683 - RNA, 22 nt, Homo sapiens
ugugcaugacagcauacaaacg

SEQ ID NO: 303684 - RNA, 22 nt, Homo sapiens
ugugccuucuaagaaggagucu

SEQ ID NO: 303685 - RNA, 22 nt, Homo sapiens
aucaaaguuucccagaaguugu

SEQ ID NO: 303686 - RNA, 22 nt, Homo sapiens
aucacagugaaaacagucaauu

SEQ ID NO: 303687 - RNA, 20 nt, Homo sapiens
aucagagacuaggauugcca

SEQ ID NO: 303688 - RNA, 22 nt, Homo sapiens
aucagcacugaucauacagcuu

SEQ ID NO: 303689 - RNA, 22 nt, Homo sapiens
aucaggaaccuuuuuggugugu

SEQ ID NO: 303690 - RNA, 22 nt, Homo sapiens
aucagugagugguuagugaaug

SEQ ID NO: 303691 - RNA, 22 nt, Homo sapiens
aucccugagaacuuuuaauguu

SEQ ID NO: 303692 - RNA, 22 nt, Homo sapiens
auccugagacuuugcugaaguu

SEQ ID NO: 303693 - RNA, 23 nt, Homo sapiens
augaaagcccuugcaaaugcugg

SEQ ID NO: 303694 - RNA, 22 nt, Homo sapiens
augaaagugauaaaugucucua

SEQ ID NO: 303695 - RNA, 22 nt, Homo sapiens
augacauuccacagccguagag

SEQ ID NO: 303696 - RNA, 22 nt, Homo sapiens
augagauacuacaaaugaguuu

SEQ ID NO: 303697 - RNA, 22 nt, Homo sapiens
augagauaggaacaaacuuaca

SEQ ID NO: 303698 - RNA, 22 nt, Homo sapiens
augaggaaggagccuuugucug

SEQ ID NO: 303699 - RNA, 22 nt, Homo sapiens
augaggcaggaaaggcguaucu

SEQ ID NO: 303700 - RNA, 22 nt, Homo sapiens
augaguauguucuguauuuuca

SEQ ID NO: 303701 - RNA, 19 nt, Homo sapiens
augccuggagaugguuaua

SEQ ID NO: 303702 - RNA, 22 nt, Homo sapiens
auggaagaaacgauuuucugga

SEQ ID NO: 303703 - RNA, 22 nt, Homo sapiens
auggauguucuagggaugugau

SEQ ID NO: 303704 - RNA, 22 nt, Homo sapiens
auggcagcccucuuuauccaug

SEQ ID NO: 303705 - RNA, 22 nt, Homo sapiens
auggccuuuacaauuugguaug

SEQ ID NO: 303706 - RNA, 22 nt, Homo sapiens
augugcacaugcuuacauguga

SEQ ID NO: 303707 - RNA, 22 nt, Homo sapiens
auguggaaagcagcaugauaug

SEQ ID NO: 303708 - RNA, 19 nt, Homo sapiens
augugguuagcaugacugc

SEQ ID NO: 303709 - RNA, 22 nt, Homo sapiens
auuauaugucaucacagacacc

SEQ ID NO: 303710 - RNA, 22 nt, Homo sapiens
auuccacuuagugacucauuug

SEQ ID NO: 303711 - RNA, 22 nt, Homo sapiens
auugagcaaggucuccuaguau

SEQ ID NO: 303712 - RNA, 22 nt, Homo sapiens
auugagcaauuccuaugugcuu

SEQ ID NO: 303713 - RNA, 22 nt, Homo sapiens
auugcacuccagccugggcgac

SEQ ID NO: 303714 - RNA, 22 nt, Homo sapiens
auugcacuccagccugggugag

SEQ ID NO: 303715 - RNA, 22 nt, Homo sapiens
auugcacuccagccuuggggau

SEQ ID NO: 303716 - RNA, 22 nt, Homo sapiens
auugcacucuagccugggugac

SEQ ID NO: 303717 - RNA, 23 nt, Homo sapiens
auugcagucuugaacuccugggc

SEQ ID NO: 303718 - RNA, 18 nt, Homo sapiens
auugcccucauggggcuu

SEQ ID NO: 303719 - RNA, 22 nt, Homo sapiens
auuggcaauagcuuucuuacua

SEQ ID NO: 303720 - RNA, 22 nt, Homo sapiens
auuguacuccagccuuggggac

SEQ ID NO: 303721 - RNA, 22 nt, Homo sapiens
auuguguuugaaugaggcucca

SEQ ID NO: 303722 - RNA, 22 nt, Homo sapiens
uuuuggcucuugguaggucaga

SEQ ID NO: 303723 - RNA, 22 nt, Homo sapiens
agaaugugaacaucuugaaagu

SEQ ID NO: 303724 - RNA, 22 nt, Homo sapiens
agacuguaaugcauaauuuacu

SEQ ID NO: 303725 - RNA, 21 nt, Homo sapiens
agagucaucucuaucuguacc

SEQ ID NO: 303726 - RNA, 22 nt, Homo sapiens
agagugcuaaggaaguaauuua

SEQ ID NO: 303727 - RNA, 22 nt, Homo sapiens
agaugcuguuaucaacuguagc

SEQ ID NO: 303728 - RNA, 22 nt, Homo sapiens
agcaacauuguucauaauagcu

SEQ ID NO: 303729 - RNA, 23 nt, Homo sapiens
agcaccaccccaggucacaagug

SEQ ID NO: 303730 - RNA, 16 nt, Homo sapiens
agccaccauuuacuug

SEQ ID NO: 303731 - RNA, 22 nt, Homo sapiens
aggaagguaaacuaacuugccu

SEQ ID NO: 303732 - RNA, 22 nt, Homo sapiens
aggaagugucuucuuuuaggca

SEQ ID NO: 303733 - RNA, 22 nt, Homo sapiens
aggaauggaaacuuuugauggu

SEQ ID NO: 303734 - RNA, 19 nt, Homo sapiens
aggacuaaagacuagaagu

SEQ ID NO: 303735 - RNA, 21 nt, Homo sapiens
aggagcauuguugugguggag

SEQ ID NO: 303736 - RNA, 22 nt, Homo sapiens
aggagcuuuggggaaaacagau

SEQ ID NO: 303737 - RNA, 22 nt, Homo sapiens
aggaggauugcuuucaucuuuu

SEQ ID NO: 303738 - RNA, 21 nt, Homo sapiens
aggcaagacuuuuagguuugu

SEQ ID NO: 303739 - RNA, 23 nt, Homo sapiens
aggccaguuuuuccugcuugcug

SEQ ID NO: 303740 - RNA, 22 nt, Homo sapiens
aguaucaagccacacaugguca

SEQ ID NO: 303741 - RNA, 20 nt, Homo sapiens
aguauucacuuuuuucaugg

SEQ ID NO: 303742 - RNA, 22 nt, Homo sapiens
agucagugucuguaaggagaac

SEQ ID NO: 303743 - RNA, 22 nt, Homo sapiens
agucauggaucacaguagccuc

SEQ ID NO: 303744 - RNA, 22 nt, Homo sapiens
agugcaguggcacaaucuuggc

SEQ ID NO: 303745 - RNA, 18 nt, Homo sapiens
aguuguuuuauccugccc

SEQ ID NO: 303746 - RNA, 22 nt, Homo sapiens
auaaaguucugcuggcauauau

SEQ ID NO: 303747 - RNA, 22 nt, Homo sapiens
auagaagcuauguauaggggcc

SEQ ID NO: 303748 - RNA, 22 nt, Homo sapiens
auagcacaguguguguacacca

SEQ ID NO: 303749 - RNA, 22 nt, Homo sapiens
auagugaacuuugugagaacaa

SEQ ID NO: 303750 - RNA, 19 nt, Homo sapiens
auaguguaggaaaacagcu

SEQ ID NO: 303751 - RNA, 22 nt, Homo sapiens
auaucaacaugguaggguuggu

SEQ ID NO: 303752 - RNA, 22 nt, Homo sapiens
auaucccaguguguaaacacug

SEQ ID NO: 303753 - RNA, 22 nt, Homo sapiens
auaugcauacccucaccaacua

SEQ ID NO: 303754 - RNA, 20 nt, Homo sapiens
auaugcauguguuuucacuu

SEQ ID NO: 303755 - RNA, 22 nt, Homo sapiens
aucaaagugaaauauuaguuau

SEQ ID NO: 303756 - RNA, 22 nt, Homo sapiens
aucaccauguguacauuagacc

SEQ ID NO: 303757 - RNA, 22 nt, Homo sapiens
aucagauuccacauuuuaucag

SEQ ID NO: 303758 - RNA, 22 nt, Homo sapiens
aucagugauugauuuaaagacg

SEQ ID NO: 303759 - RNA, 22 nt, Homo sapiens
aucccagaaacucggguuucuc

SEQ ID NO: 303760 - RNA, 22 nt, Homo sapiens
auccugagacuuuucugaaguu

SEQ ID NO: 303761 - RNA, 22 nt, Homo sapiens
aucgcgccauuguacuccagcc

SEQ ID NO: 303762 - RNA, 21 nt, Homo sapiens
aucucacuugaauguaaaagc

SEQ ID NO: 303763 - RNA, 22 nt, Homo sapiens
aucucaguuaauuccaucuuuc

SEQ ID NO: 303764 - RNA, 22 nt, Homo sapiens
aucugugaaugaaguuauuuug

SEQ ID NO: 303765 - RNA, 21 nt, Homo sapiens
aucugugagaccuuggggguu

SEQ ID NO: 303766 - RNA, 22 nt, Homo sapiens
augaaagucaauccccaagugu

SEQ ID NO: 303767 - RNA, 22 nt, Homo sapiens
augacauugaaaagcaagugga

SEQ ID NO: 303768 - RNA, 22 nt, Homo sapiens
augagauauuuuauaagaucau

SEQ ID NO: 303769 - RNA, 22 nt, Homo sapiens
augagauucuuagagaagucug

SEQ ID NO: 303770 - RNA, 22 nt, Homo sapiens
augcacuuggcaggaugauucc

SEQ ID NO: 303771 - RNA, 22 nt, Homo sapiens
augccauugcacuccagccugg

SEQ ID NO: 303772 - RNA, 19 nt, Homo sapiens
augccucaguuuuguacuu

SEQ ID NO: 303773 - RNA, 22 nt, Homo sapiens
augcuacugaccccuacuuaca

SEQ ID NO: 303774 - RNA, 22 nt, Homo sapiens
auggcaauguaagucagaaaaa

SEQ ID NO: 303775 - RNA, 22 nt, Homo sapiens
auggcaguuucagcuauaguuu

SEQ ID NO: 303776 - RNA, 22 nt, Homo sapiens
auggccuuguauaccuggcaaa

SEQ ID NO: 303777 - RNA, 20 nt, Homo sapiens
auguaauguaugauauguac

SEQ ID NO: 303778 - RNA, 22 nt, Homo sapiens
auguagauaucaagaggcauau

SEQ ID NO: 303779 - RNA, 20 nt, Homo sapiens
augucaggaagggagucagg

SEQ ID NO: 303780 - RNA, 22 nt, Homo sapiens
augucuuucauagagacccaga

SEQ ID NO: 303781 - RNA, 22 nt, Homo sapiens
augugcauaugaagcacagaca

SEQ ID NO: 303782 - RNA, 22 nt, Homo sapiens
auguggaaauguauaugugucu

SEQ ID NO: 303783 - RNA, 22 nt, Homo sapiens
auguguauuaccucgauuguga

SEQ ID NO: 303784 - RNA, 22 nt, Homo sapiens
augugugcuugauguaaaaagu

SEQ ID NO: 303785 - RNA, 22 nt, Homo sapiens
auuaacaucuagaguuuuggug

SEQ ID NO: 303786 - RNA, 22 nt, Homo sapiens
auuacacuuucuauucaaugag

SEQ ID NO: 303787 - RNA, 22 nt, Homo sapiens
auugaauuugguuugcuaagaa

SEQ ID NO: 303788 - RNA, 22 nt, Homo sapiens
auugagcacugacucugugcca

SEQ ID NO: 303789 - RNA, 22 nt, Homo sapiens
auugcacuccagccugggugac

SEQ ID NO: 303790 - RNA, 22 nt, Homo sapiens
auugcacuccggccugggugac

SEQ ID NO: 303791 - RNA, 22 nt, Homo sapiens
caaagucuauucuacccuuacc

SEQ ID NO: 303792 - RNA, 22 nt, Homo sapiens
caaagucuucucauuaugucuu

SEQ ID NO: 303793 - RNA, 22 nt, Homo sapiens
caaagugcuggccgggcgcagu

SEQ ID NO: 303794 - RNA, 22 nt, Homo sapiens
caaagugcugggacuggccggg

SEQ ID NO: 303795 - RNA, 22 nt, Homo sapiens
caacaguaaagcauuuuuaagu

SEQ ID NO: 303796 - RNA, 22 nt, Homo sapiens
caagugcuuucuuggggauuua

SEQ ID NO: 303797 - RNA, 22 nt, Homo sapiens
caauggcacuauuggaaaaggu

SEQ ID NO: 303798 - RNA, 22 nt, Homo sapiens
cacagucugggcuuguuuguac

SEQ ID NO: 303799 - RNA, 22 nt, Homo sapiens
cacauagucccugcuaaucuuc

SEQ ID NO: 303800 - RNA, 22 nt, Homo sapiens
cacauguucaggagcacuuaga

SEQ ID NO: 303801 - RNA, 22 nt, Homo sapiens
cagagguaagcaagucagcauu

SEQ ID NO: 303802 - RNA, 22 nt, Homo sapiens
cagauacuggccuggagcugug

SEQ ID NO: 303803 - RNA, 22 nt, Homo sapiens
caggcagucuggcucccaagug

SEQ ID NO: 303804 - RNA, 19 nt, Homo sapiens
caucccugagcugaagugg

SEQ ID NO: 303805 - RNA, 22 nt, Homo sapiens
cauugcacuccagccugaggga

SEQ ID NO: 303806 - RNA, 22 nt, Homo sapiens
cauugcaugccagccugggcaa

SEQ ID NO: 303807 - RNA, 22 nt, Homo sapiens
ccacacugucuuggugggaaac

SEQ ID NO: 303808 - RNA, 23 nt, Homo sapiens
ccacacuguuuagaauggcauca

SEQ ID NO: 303809 - RNA, 22 nt, Homo sapiens
ccacagucuaugcaacaagguc

SEQ ID NO: 303810 - RNA, 22 nt, Homo sapiens
uucucaguuccuacuuugguga

SEQ ID NO: 303811 - RNA, 22 nt, Homo sapiens
uucucaguucgguggcagugcu

SEQ ID NO: 303812 - RNA, 22 nt, Homo sapiens
uucuccugguggacccuaaacg

SEQ ID NO: 303813 - RNA, 22 nt, Homo sapiens
uucugguuaauacuugcaaaaa

SEQ ID NO: 303814 - RNA, 22 nt, Homo sapiens
uugaaguagaaagacgaaauuu

SEQ ID NO: 303815 - RNA, 22 nt, Homo sapiens
uugagauggagucucacgcauu

SEQ ID NO: 303816 - RNA, 22 nt, Homo sapiens
uugagauggagucuugcacugu

SEQ ID NO: 303817 - RNA, 22 nt, Homo sapiens
uugagauggugccacuguacuc

SEQ ID NO: 303818 - RNA, 22 nt, Homo sapiens
uugagauguggcaguuuaugag

SEQ ID NO: 303819 - RNA, 22 nt, Homo sapiens
uugagcacaggaguuuugagac

SEQ ID NO: 303820 - RNA, 22 nt, Homo sapiens
uugaggaaugucauuuguguuu

SEQ ID NO: 303821 - RNA, 23 nt, Homo sapiens
uugaggcauguaccaucaauauc

SEQ ID NO: 303822 - RNA, 22 nt, Homo sapiens
uugaggucuuugagcaaacgca

SEQ ID NO: 303823 - RNA, 23 nt, Homo sapiens
uugcaaagccugaaacucuucag

SEQ ID NO: 303824 - RNA, 22 nt, Homo sapiens
uugcccuuuagguaacuauaua

SEQ ID NO: 303825 - RNA, 22 nt, Homo sapiens
uugcuuaggcuggagugcagug

SEQ ID NO: 303826 - RNA, 22 nt, Homo sapiens
uuggagagucacuaguuagugc

SEQ ID NO: 303827 - RNA, 22 nt, Homo sapiens
uuggagagugauauucagaugc

SEQ ID NO: 303828 - RNA, 22 nt, Homo sapiens
uuggcaauugcuaugauuugaa

SEQ ID NO: 303829 - RNA, 22 nt, Homo sapiens
uugucaaacucauucuccaucc

SEQ ID NO: 303830 - RNA, 22 nt, Homo sapiens
uugucacauggggcggcugccc

SEQ ID NO: 303831 - RNA, 22 nt, Homo sapiens
uugugauugagugauccuuguu

SEQ ID NO: 303832 - RNA, 22 nt, Homo sapiens
uugugcuucaucaccuagcaga

SEQ ID NO: 303833 - RNA, 22 nt, Homo sapiens
uuucagagucaucugcccaagu

SEQ ID NO: 303834 - RNA, 22 nt, Homo sapiens
uuucauagccuuugucgucuga

SEQ ID NO: 303835 - RNA, 22 nt, Homo sapiens
uuucugugguccucuugaaggu

SEQ ID NO: 303836 - RNA, 22 nt, Homo sapiens
uuugacuuuuagaauaugaguu

SEQ ID NO: 303837 - RNA, 22 nt, Homo sapiens
uuugagcauuagggcaaaggca

SEQ ID NO: 303838 - RNA, 22 nt, Homo sapiens
uuugcacuuuaauauaauguga

SEQ ID NO: 303839 - RNA, 21 nt, Homo sapiens
uuugcauauguugaaccagcc

SEQ ID NO: 303840 - RNA, 22 nt, Homo sapiens
uuugcuugaggucuagcuaccc

SEQ ID NO: 303841 - RNA, 22 nt, Homo sapiens
uuuggcuuugagaagcagugga

SEQ ID NO: 303842 - RNA, 22 nt, Homo sapiens
uuuggucuuuuguaaguuaucu

SEQ ID NO: 303843 - RNA, 18 nt, Homo sapiens
aaaaagugcucaggccua

SEQ ID NO: 303844 - RNA, 22 nt, Homo sapiens
aaaacgcauccucacaggucug

SEQ ID NO: 303845 - RNA, 22 nt, Homo sapiens
aaaagucuguagugaaagguga

SEQ ID NO: 303846 - RNA, 20 nt, Homo sapiens
aaaguaggcuaauaccaaaa

SEQ ID NO: 303847 - RNA, 18 nt, Homo sapiens
aaagugaugucauucuuu

SEQ ID NO: 303848 - RNA, 22 nt, Homo sapiens
aaagugcaguacuucguauauu

SEQ ID NO: 303849 - RNA, 22 nt, Homo sapiens
aaagugcaguauuugggcagga

SEQ ID NO: 303850 - RNA, 22 nt, Homo sapiens
aaagugcugggaucacacugaa

SEQ ID NO: 303851 - RNA, 22 nt, Homo sapiens
aaagugcugggauuuuaggcau

SEQ ID NO: 303852 - RNA, 19 nt, Homo sapiens
aaaguucuucccuuuggag

SEQ ID NO: 303853 - RNA, 22 nt, Homo sapiens
aaaugcuuucuuggaccauuug

SEQ ID NO: 303854 - RNA, 22 nt, Homo sapiens
aaauucaucaaaugguuuguau

SEQ ID NO: 303855 - RNA, 22 nt, Homo sapiens
aaauucauuucagcucugggua

SEQ ID NO: 303856 - RNA, 22 nt, Homo sapiens
aacagucaauugcugaugaccu

SEQ ID NO: 303857 - RNA, 22 nt, Homo sapiens
aacagugccugucauuuaguag

SEQ ID NO: 303858 - RNA, 22 nt, Homo sapiens
aagagcauuauuuaguaauuuc

SEQ ID NO: 303859 - RNA, 22 nt, Homo sapiens
aagauauguuaguuauaaacuc

SEQ ID NO: 303860 - RNA, 22 nt, Homo sapiens
aagaucauucagggaaggcuga

SEQ ID NO: 303861 - RNA, 21 nt, Homo sapiens
aagcaugguguaucuuuccau

SEQ ID NO: 303862 - RNA, 22 nt, Homo sapiens
aagcuggauuuaguguggagca

SEQ ID NO: 303863 - RNA, 22 nt, Homo sapiens
aaguaauugagguuuuugcugu

SEQ ID NO: 303864 - RNA, 22 nt, Homo sapiens
aaguaucaggaauaguuauugg

SEQ ID NO: 303865 - RNA, 22 nt, Homo sapiens
aagugcauguauuaguguaguc

SEQ ID NO: 303866 - RNA, 22 nt, Homo sapiens
aagugcucuugaaacugucuua

SEQ ID NO: 303867 - RNA, 23 nt, Homo sapiens
aaguucaugcucaucuguuacac

SEQ ID NO: 303868 - RNA, 21 nt, Homo sapiens
aauacucuagguuaagagagc

SEQ ID NO: 303869 - RNA, 22 nt, Homo sapiens
aauacugugauaucgagcgauu

SEQ ID NO: 303870 - RNA, 22 nt, Homo sapiens
aauagcuguuuuuaauuccugc

SEQ ID NO: 303871 - RNA, 22 nt, Homo sapiens
aaugcacauauauuuccuuauu

SEQ ID NO: 303872 - RNA, 22 nt, Homo sapiens
aauggcaaauguuuucuguuga

SEQ ID NO: 303873 - RNA, 22 nt, Homo sapiens
aauggcaagagccacagaggcg

SEQ ID NO: 303874 - RNA, 22 nt, Homo sapiens
aaugugcacuauuagggugaua

SEQ ID NO: 303875 - RNA, 22 nt, Homo sapiens
aaagcuagagaagcugcuguca

SEQ ID NO: 303876 - RNA, 22 nt, Homo sapiens
caaauugcuuguggaggauaau

SEQ ID NO: 303877 - RNA, 22 nt, Homo sapiens
caagaggcuguguauaaagcca

SEQ ID NO: 303878 - RNA, 22 nt, Homo sapiens
caaugcagcuuuuggagagaaa

SEQ ID NO: 303879 - RNA, 22 nt, Homo sapiens
caauggcaaugaaauagugaga

SEQ ID NO: 303880 - RNA, 22 nt, Homo sapiens
cacacugucuucauuacuguag

SEQ ID NO: 303881 - RNA, 22 nt, Homo sapiens
cacacuguuuuccauggggguu

SEQ ID NO: 303882 - RNA, 22 nt, Homo sapiens
cacagugaaugucaucauugcc

SEQ ID NO: 303883 - RNA, 22 nt, Homo sapiens
cacugcauccucugccuggcgg

SEQ ID NO: 303884 - RNA, 23 nt, Homo sapiens
cagcuucauugaacauaacuccu

SEQ ID NO: 303885 - RNA, 19 nt, Homo sapiens
caguaucauugcacauagu

SEQ ID NO: 303886 - RNA, 22 nt, Homo sapiens
cauugcaacuucugccucccag

SEQ ID NO: 303887 - RNA, 22 nt, Homo sapiens
cauugcaaugaggucuugcagu

SEQ ID NO: 303888 - RNA, 22 nt, Homo sapiens
cauugcacuccagcucugggcg

SEQ ID NO: 303889 - RNA, 22 nt, Homo sapiens
ccauugcacuccagccuaggca

SEQ ID NO: 303890 - RNA, 22 nt, Homo sapiens
cccagagacagaaugauaaacu

SEQ ID NO: 303891 - RNA, 17 nt, Homo sapiens
ccccugagcgaugcagu

SEQ ID NO: 303892 - RNA, 22 nt, Homo sapiens
cccucauucauucauccuaugu

SEQ ID NO: 303893 - RNA, 22 nt, Homo sapiens
cccugaagaaagccuaggacau

SEQ ID NO: 303894 - RNA, 22 nt, Homo sapiens
ccugagaucauacuguuaguaa

SEQ ID NO: 303895 - RNA, 22 nt, Homo sapiens
ccuucuuuuguaaggcugaaua

SEQ ID NO: 303896 - RNA, 22 nt, Homo sapiens
cuacagcagcccaguccccgaa

SEQ ID NO: 303897 - RNA, 22 nt, Homo sapiens
cuagcacauaguuauucacuca

SEQ ID NO: 303898 - RNA, 22 nt, Homo sapiens
cuaggaaguauguguuauugcu

SEQ ID NO: 303899 - RNA, 22 nt, Homo sapiens
cuagucacaggaguugaaggau

SEQ ID NO: 303900 - RNA, 22 nt, Homo sapiens
cuagucacauuuucaucaaaua

SEQ ID NO: 303901 - RNA, 19 nt, Homo sapiens
cuauugcacauagcugaag

SEQ ID NO: 303902 - RNA, 22 nt, Homo sapiens
cucaguggauuagauaaugcac

SEQ ID NO: 303903 - RNA, 22 nt, Homo sapiens
cucucaguguggaggccagaaa

SEQ ID NO: 303904 - RNA, 22 nt, Homo sapiens
cugacuuuagaacccaaaaagu

SEQ ID NO: 303905 - RNA, 20 nt, Homo sapiens
cugagguacgaggguuaaau

SEQ ID NO: 303906 - RNA, 22 nt, Homo sapiens
cugaugaaguauuuguucugga

SEQ ID NO: 303907 - RNA, 22 nt, Homo sapiens
cugauuguuugccucuaaaauc

SEQ ID NO: 303908 - RNA, 22 nt, Homo sapiens
cuggcaauaggcagugucccaa

SEQ ID NO: 303909 - RNA, 22 nt, Homo sapiens
cuguagacauuaggccugcacu

SEQ ID NO: 303910 - RNA, 22 nt, Homo sapiens
cugugauuauauaguuaaggua

SEQ ID NO: 303911 - RNA, 22 nt, Homo sapiens
cuguguaguacuagauugagca

SEQ ID NO: 303912 - RNA, 22 nt, Homo sapiens
cuguuugaggguuugcuuucag

SEQ ID NO: 303913 - RNA, 18 nt, Homo sapiens
cuuaacauugggaugaua

SEQ ID NO: 303914 - RNA, 22 nt, Homo sapiens
cuuggcauuguguugauagaag

SEQ ID NO: 303915 - RNA, 22 nt, Homo sapiens
cuuugcaaauggccuuuccaag

SEQ ID NO: 303916 - RNA, 22 nt, Homo sapiens
cuuugggaccgcgguuuauacu

SEQ ID NO: 303917 - RNA, 22 nt, Homo sapiens
gaagacauuuacaugggagacc

SEQ ID NO: 303918 - RNA, 22 nt, Homo sapiens
gaagugcaguggcacagucaug

SEQ ID NO: 303919 - RNA, 22 nt, Homo sapiens
gaaucauuggguugauucaaga

SEQ ID NO: 303920 - RNA, 22 nt, Homo sapiens
gaaugcuaccagcaucuagugg

SEQ ID NO: 303921 - RNA, 22 nt, Homo sapiens
gacagugagaugucaugugaaa

SEQ ID NO: 303922 - RNA, 22 nt, Homo sapiens
gagaacauuaauaguuaauuuu

SEQ ID NO: 303923 - RNA, 21 nt, Homo sapiens
gagaaucaucauggcugcaua

SEQ ID NO: 303924 - RNA, 22 nt, Homo sapiens
gagaugauuugccccauguauu

SEQ ID NO: 303925 - RNA, 22 nt, Homo sapiens
gagaugguguuccacugccagu

SEQ ID NO: 303926 - RNA, 18 nt, Homo sapiens
gagcaccuuuuuugcaga

SEQ ID NO: 303927 - RNA, 22 nt, Homo sapiens
gagugcaauggcaagaucuugg

SEQ ID NO: 303928 - RNA, 22 nt, Homo sapiens
gauacuguauccuaaaagcuuu

SEQ ID NO: 303929 - RNA, 22 nt, Homo sapiens
gauauguaaaaauuauaucuga

SEQ ID NO: 303930 - RNA, 22 nt, Homo sapiens
gauauguaguaguugaaaaaga

SEQ ID NO: 303931 - RNA, 22 nt, Homo sapiens
gauguguuuguuucuggaggag

SEQ ID NO: 303932 - RNA, 22 nt, Homo sapiens
gauuggcauugcugcaccugag

SEQ ID NO: 303933 - RNA, 22 nt, Homo sapiens
uggcaaaugaagucagcuguac

SEQ ID NO: 303934 - RNA, 22 nt, Homo sapiens
uggcaagaaccacaauuacuuu

SEQ ID NO: 303935 - RNA, 22 nt, Homo sapiens
uggcaagaucacaauuacuuuu

SEQ ID NO: 303936 - RNA, 22 nt, Homo sapiens
uggcagauaggauacaggacua

SEQ ID NO: 303937 - RNA, 22 nt, Homo sapiens
uggcauauaaagauguguucaa

SEQ ID NO: 303938 - RNA, 22 nt, Homo sapiens
ugggaauaugauacaggucuuu

SEQ ID NO: 303939 - RNA, 22 nt, Homo sapiens
uggucaguugaguccuugccaa

SEQ ID NO: 303940 - RNA, 23 nt, Homo sapiens
ugguuuguaagagauggacugga

SEQ ID NO: 303941 - RNA, 22 nt, Homo sapiens
uguaacaguaguuacuauucuu

SEQ ID NO: 303942 - RNA, 22 nt, Homo sapiens
uguacacauaugugggguacau

SEQ ID NO: 303943 - RNA, 22 nt, Homo sapiens
uguagucauuugaaggaugucc

SEQ ID NO: 303944 - RNA, 21 nt, Homo sapiens
ugucaagugggaaaacaugua

SEQ ID NO: 303945 - RNA, 22 nt, Homo sapiens
ugucacuuugccuucuggacuu

SEQ ID NO: 303946 - RNA, 22 nt, Homo sapiens
ugucaguggucuggaugcagcc

SEQ ID NO: 303947 - RNA, 22 nt, Homo sapiens
ugucauggauucugagucuggg

SEQ ID NO: 303948 - RNA, 22 nt, Homo sapiens
ugucaugugagggaacuuguuc

SEQ ID NO: 303949 - RNA, 22 nt, Homo sapiens
ugugauuauuuauagacaguca

SEQ ID NO: 303950 - RNA, 22 nt, Homo sapiens
ugugcaaucagcuucauuacau

SEQ ID NO: 303951 - RNA, 22 nt, Homo sapiens
ugugcaaucuuccauuuuuagg

SEQ ID NO: 303952 - RNA, 22 nt, Homo sapiens
ugugcuauguuauucacauggg

SEQ ID NO: 303953 - RNA, 22 nt, Homo sapiens
ugugucuuuuaucacacaaugu

SEQ ID NO: 303954 - RNA, 22 nt, Homo sapiens
uguuauuuuguguuagggcaca

SEQ ID NO: 303955 - RNA, 22 nt, Homo sapiens
uguucuugaguugggaguacaa

SEQ ID NO: 303956 - RNA, 22 nt, Homo sapiens
uuaagcaguggauuagaauuuu

SEQ ID NO: 303957 - RNA, 22 nt, Homo sapiens
uuaguaucauccuucugcauuc

SEQ ID NO: 303958 - RNA, 22 nt, Homo sapiens
uuauacacugugggaguguaaa

SEQ ID NO: 303959 - RNA, 22 nt, Homo sapiens
uucacugcacuccagccugagc

SEQ ID NO: 303960 - RNA, 22 nt, Homo sapiens
uucacugcauuucagccugggc

SEQ ID NO: 303961 - RNA, 18 nt, Homo sapiens
uucagugaauucuuuuga

SEQ ID NO: 303962 - RNA, 22 nt, Homo sapiens
uucauaguguuuccuuccagug

SEQ ID NO: 303963 - RNA, 22 nt, Homo sapiens
uucccagagccugggagugagg

SEQ ID NO: 303964 - RNA, 22 nt, Homo sapiens
uucccugaaauauucacuuuca

SEQ ID NO: 303965 - RNA, 22 nt, Homo sapiens
uucccugagcaucuguugagcc

SEQ ID NO: 303966 - RNA, 22 nt, Homo sapiens
uucccugaguaucuuaccaugg

SEQ ID NO: 303967 - RNA, 22 nt, Homo sapiens
uuccuggaggggaaguguccaa

SEQ ID NO: 303968 - RNA, 22 nt, Homo sapiens
uucucaguaauuccagauuuuu

SEQ ID NO: 303969 - RNA, 22 nt, Homo sapiens
uucuggcucaggucaacacuuc

SEQ ID NO: 303970 - RNA, 22 nt, Homo sapiens
uucugugguugaaaggagagau

SEQ ID NO: 303971 - RNA, 21 nt, Homo sapiens
uucuuugcucaguguuagagu

SEQ ID NO: 303972 - RNA, 22 nt, Homo sapiens
uugaaagucauggcacaggcaa

SEQ ID NO: 303973 - RNA, 22 nt, Homo sapiens
uugaaagucuaggcuuacagua

SEQ ID NO: 303974 - RNA, 22 nt, Homo sapiens
uugaaaguguucacaaugguau

SEQ ID NO: 303975 - RNA, 22 nt, Homo sapiens
uugaaugaaaugaugucauuug

SEQ ID NO: 303976 - RNA, 22 nt, Homo sapiens
uugaccacugggcacaguaagu

SEQ ID NO: 303977 - RNA, 22 nt, Homo sapiens
uugacuuagacauucaguugga

SEQ ID NO: 303978 - RNA, 22 nt, Homo sapiens
uugagaaucuuugcuaaaggaa

SEQ ID NO: 303979 - RNA, 22 nt, Homo sapiens
uugagaucaugcuacugcacuc

SEQ ID NO: 303980 - RNA, 22 nt, Homo sapiens
uugagauguauguauauaaugu

SEQ ID NO: 303981 - RNA, 22 nt, Homo sapiens
uugagcucuucuagcaauucua

SEQ ID NO: 303982 - RNA, 22 nt, Homo sapiens
uugaggaaugugauuucaaaua

SEQ ID NO: 303983 - RNA, 22 nt, Homo sapiens
uugauauguggaauauuuaucu

SEQ ID NO: 303984 - RNA, 22 nt, Homo sapiens
uuggaaugcacacugagccugc

SEQ ID NO: 303985 - RNA, 22 nt, Homo sapiens
uuggcaagaaccuucuuccaag

SEQ ID NO: 303986 - RNA, 22 nt, Homo sapiens
uuggcaauucagauucuuuuau

SEQ ID NO: 303987 - RNA, 22 nt, Homo sapiens
uugggcuuuuagguccuuaaca

SEQ ID NO: 303988 - RNA, 22 nt, Homo sapiens
uugucacuauaaauaagcauuu

SEQ ID NO: 303989 - RNA, 22 nt, Homo sapiens
uugucacugcacuccagucugg

SEQ ID NO: 303990 - RNA, 22 nt, Homo sapiens
uugugagggagcuaagaugagu

SEQ ID NO: 303991 - RNA, 22 nt, Homo sapiens
uugugccauucuucugccucag

SEQ ID NO: 303992 - RNA, 22 nt, Homo sapiens
uugugggaggugauuagaucau

SEQ ID NO: 303993 - RNA, 22 nt, Homo sapiens
uuguguuugaugcugacacgca

SEQ ID NO: 303994 - RNA, 22 nt, Homo sapiens
uuuaaagcuaaaauauguuuau

SEQ ID NO: 303995 - RNA, 17 nt, Homo sapiens
uuucagaguggaagugu

SEQ ID NO: 303996 - RNA, 22 nt, Homo sapiens
uuucauagaucaugcuuuugga

SEQ ID NO: 303997 - RNA, 22 nt, Homo sapiens
uuucauagccuucuaaugaguu

SEQ ID NO: 303998 - RNA, 22 nt, Homo sapiens
uuucauaguuugcauagggcau

SEQ ID NO: 303999 - RNA, 22 nt, Homo sapiens
uuucauccggcuguguauuaug

SEQ ID NO: 304000 - RNA, 22 nt, Homo sapiens
uuucauggaauauagucauuuu

SEQ ID NO: 304001 - RNA, 23 nt, Homo sapiens
uuucuugggcaugcuaugucagu

SEQ ID NO: 304002 - RNA, 22 nt, Homo sapiens
uuugacaaugugugcuuguauu

SEQ ID NO: 304003 - RNA, 22 nt, Homo sapiens
uuugacuaccaggaauguucuu

SEQ ID NO: 304004 - RNA, 22 nt, Homo sapiens
uuugacuagaguguuuuacaac

SEQ ID NO: 304005 - RNA, 22 nt, Homo sapiens
uuugaggaaaggcauaaguagg

SEQ ID NO: 304006 - RNA, 21 nt, Homo sapiens
uuugaucauuaaaagugaauc

SEQ ID NO: 304007 - RNA, 22 nt, Homo sapiens
uuugauuguacuaaaauuguac

SEQ ID NO: 304008 - RNA, 22 nt, Homo sapiens
uuuguaauccuauuccaaagga

SEQ ID NO: 304009 - RNA, 23 nt, Homo sapiens
uuuguacuaugucaguuuagaua

SEQ ID NO: 304010 - RNA, 21 nt, Homo sapiens
uuuguaguagcaugauuuaua

SEQ ID NO: 304011 - RNA, 22 nt, Homo sapiens
uuugugcuauguuauauauucu

SEQ ID NO: 304012 - RNA, 22 nt, Homo sapiens
aaagaguucagguagauuucaa

SEQ ID NO: 304013 - RNA, 22 nt, Homo sapiens
aaagcugucaaggcaggaggcu

SEQ ID NO: 304014 - RNA, 19 nt, Homo sapiens
aaagguaguaaccucugau

SEQ ID NO: 304015 - RNA, 22 nt, Homo sapiens
aaagucuguuuugucagagacu

SEQ ID NO: 304016 - RNA, 22 nt, Homo sapiens
aaagugcugagacagacuggga

SEQ ID NO: 304017 - RNA, 22 nt, Homo sapiens
aaaguucuguugauagugcuga

SEQ ID NO: 304018 - RNA, 22 nt, Homo sapiens
aacacuguuuccagucaugauc

SEQ ID NO: 304019 - RNA, 22 nt, Homo sapiens
aacagaccuagauaguauaguc

SEQ ID NO: 304020 - RNA, 21 nt, Homo sapiens
aacagugcugaacagacaccu

SEQ ID NO: 304021 - RNA, 22 nt, Homo sapiens
aaccuguaaccauaugaucagu

SEQ ID NO: 304022 - RNA, 22 nt, Homo sapiens
aacugcacuaggacagguuuuu

SEQ ID NO: 304023 - RNA, 21 nt, Homo sapiens
aacuggugugagaugguaugu

SEQ ID NO: 304024 - RNA, 22 nt, Homo sapiens
aagaugcagaagcccagauguu

SEQ ID NO: 304025 - RNA, 22 nt, Homo sapiens
aagccagugugacaggaaacuu

SEQ ID NO: 304026 - RNA, 22 nt, Homo sapiens
aagggagcugcauaaucuugug

SEQ ID NO: 304027 - RNA, 22 nt, Homo sapiens
aaguaaacauuuuguacaauaa

SEQ ID NO: 304028 - RNA, 19 nt, Homo sapiens
aagugaaugcuuuguucac

SEQ ID NO: 304029 - RNA, 20 nt, Homo sapiens
aagugcaucguugugucugc

SEQ ID NO: 304030 - RNA, 22 nt, Homo sapiens
aaguguaaguuaauguuuaggu

SEQ ID NO: 304031 - RNA, 22 nt, Homo sapiens
aaguugcuuuagguaagucaau

SEQ ID NO: 304032 - RNA, 22 nt, Homo sapiens
aauaaagcagcuuuuugggacu

SEQ ID NO: 304033 - RNA, 22 nt, Homo sapiens
aauagcacuguagauggaggaa

SEQ ID NO: 304034 - RNA, 22 nt, Homo sapiens
aaucacacuugauguugagcaa

SEQ ID NO: 304035 - RNA, 22 nt, Homo sapiens
aauuacauggcaauugggaaau

SEQ ID NO: 304036 - RNA, 22 nt, Homo sapiens
aauugaaugauaugggacauuu

SEQ ID NO: 304037 - RNA, 22 nt, Homo sapiens
aauugcaucuguucuuugccag

SEQ ID NO: 304038 - RNA, 22 nt, Homo sapiens
acaaaguguuuucugaaggccu

SEQ ID NO: 304039 - RNA, 22 nt, Homo sapiens
acaagugaauacaggauucucu

SEQ ID NO: 304040 - RNA, 22 nt, Homo sapiens
acaccauugcauuccagccugg

SEQ ID NO: 304041 - RNA, 22 nt, Homo sapiens
acaguguguguguucaccuaga

SEQ ID NO: 304042 - RNA, 23 nt, Homo sapiens
acugagcaauguuuacauacuug

SEQ ID NO: 304043 - RNA, 22 nt, Homo sapiens
acugcacuccagccuaggcgac

SEQ ID NO: 304044 - RNA, 22 nt, Homo sapiens
acuuggcaaaguuuuaaacagc

SEQ ID NO: 304045 - RNA, 22 nt, Homo sapiens
acuuuuguuauacagugugaua

SEQ ID NO: 304046 - RNA, 22 nt, Homo sapiens
agaaacacagguggaauugcuu

SEQ ID NO: 304047 - RNA, 22 nt, Homo sapiens
agacagcuggaguaucauagcu

SEQ ID NO: 304048 - RNA, 22 nt, Homo sapiens
agagaugauuaacauuuuggua

SEQ ID NO: 304049 - RNA, 18 nt, Homo sapiens
agcaucacugaucauccu

SEQ ID NO: 304050 - RNA, 22 nt, Homo sapiens
agccaguauuuccacagagugg

SEQ ID NO: 304051 - RNA, 22 nt, Homo sapiens
agcccuuagauggcuccuucca

SEQ ID NO: 304052 - RNA, 22 nt, Homo sapiens
agcuuguauuuguagccuguug

SEQ ID NO: 304053 - RNA, 22 nt, Homo sapiens
aggaagugugcaauuaauuucu

SEQ ID NO: 304054 - RNA, 22 nt, Homo sapiens
aggaauguuaguacuucuuagu

SEQ ID NO: 304055 - RNA, 21 nt, Homo sapiens
aggagauguuuguccuuuuag

SEQ ID NO: 304056 - RNA, 18 nt, Homo sapiens
aggagcauagugcuauga

SEQ ID NO: 304057 - RNA, 22 nt, Homo sapiens
aggcaagagugacuacgugaaa

SEQ ID NO: 304058 - RNA, 22 nt, Homo sapiens
aggcauugugcaucgaugauuu

SEQ ID NO: 304059 - RNA, 22 nt, Homo sapiens
aggugcuugagggaagaaauua

SEQ ID NO: 304060 - RNA, 21 nt, Homo sapiens
aguagcacugugucuuacaaa

SEQ ID NO: 304061 - RNA, 22 nt, Homo sapiens
agucaguguguauugauggcac

SEQ ID NO: 304062 - RNA, 22 nt, Homo sapiens
agugaacaaagaagugcagaua

SEQ ID NO: 304063 - RNA, 22 nt, Homo sapiens
agugauuuuaacuuccagcaau

SEQ ID NO: 304064 - RNA, 21 nt, Homo sapiens
aguucacauggcuccuguguu

SEQ ID NO: 304065 - RNA, 22 nt, Homo sapiens
auaaagacacuuggcaugauuu

SEQ ID NO: 304066 - RNA, 22 nt, Homo sapiens
auaaaugcaaugguauuuuuga

SEQ ID NO: 304067 - RNA, 22 nt, Homo sapiens
auagcauaucccacaugucaga

SEQ ID NO: 304068 - RNA, 20 nt, Homo sapiens
auagcauugauggacucaaa

SEQ ID NO: 304069 - RNA, 22 nt, Homo sapiens
auaugcauacauguaugcagga

SEQ ID NO: 304070 - RNA, 22 nt, Homo sapiens
auauucaagugaggauggcuaa

SEQ ID NO: 304071 - RNA, 22 nt, Homo sapiens
aucacaggcaaaauuccuucuc

SEQ ID NO: 304072 - RNA, 22 nt, Homo sapiens
aucagauuccagaggcagcacc

SEQ ID NO: 304073 - RNA, 22 nt, Homo sapiens
aucagugaaagugaaaucuccg

SEQ ID NO: 304074 - RNA, 22 nt, Homo sapiens
aucaucacaguuguguguaaug

SEQ ID NO: 304075 - RNA, 22 nt, Homo sapiens
aucccugaggaauuucugcacu

SEQ ID NO: 304076 - RNA, 22 nt, Homo sapiens
auccugaagcuuuacugaauuc

SEQ ID NO: 304077 - RNA, 22 nt, Homo sapiens
auccuugagaaaauaaaugacc

SEQ ID NO: 304078 - RNA, 22 nt, Homo sapiens
aucucaguucaggcuggccaca

SEQ ID NO: 304079 - RNA, 22 nt, Homo sapiens
aucuccaggugccagcugcgcc

SEQ ID NO: 304080 - RNA, 22 nt, Homo sapiens
augaaaguguguggaaacuuga

SEQ ID NO: 304081 - RNA, 22 nt, Homo sapiens
augaaaucuuuggcagaucuua

SEQ ID NO: 304082 - RNA, 22 nt, Homo sapiens
augaauacugcugcaaugaaca

SEQ ID NO: 304083 - RNA, 22 nt, Homo sapiens
augacauugaugcucuggcugg

SEQ ID NO: 304084 - RNA, 22 nt, Homo sapiens
augacugucagggcagucauug

SEQ ID NO: 304085 - RNA, 22 nt, Homo sapiens
augagacuagaagagaauaaua

SEQ ID NO: 304086 - RNA, 22 nt, Homo sapiens
augagaucugugaacaccuguc

SEQ ID NO: 304087 - RNA, 22 nt, Homo sapiens
augagcacuuguuuugggcaca

SEQ ID NO: 304088 - RNA, 22 nt, Homo sapiens
augaguaugagaauacauuaag

SEQ ID NO: 304089 - RNA, 22 nt, Homo sapiens
augaucaucugaaagcuuuuac

SEQ ID NO: 304090 - RNA, 22 nt, Homo sapiens
augaugucauuuuaauuucuaa

SEQ ID NO: 304091 - RNA, 22 nt, Homo sapiens
augccauugcacuccagccuag

SEQ ID NO: 304092 - RNA, 22 nt, Homo sapiens
augcuacuggauuuguauaaau

SEQ ID NO: 304093 - RNA, 21 nt, Homo sapiens
auggaaagacugccucuucaa

SEQ ID NO: 304094 - RNA, 22 nt, Homo sapiens
auggagaugugcgaacugagua

SEQ ID NO: 304095 - RNA, 22 nt, Homo sapiens
auggauuuuggggccagaggca

SEQ ID NO: 304096 - RNA, 22 nt, Homo sapiens
auggcaguguaugauuauauua

SEQ ID NO: 304097 - RNA, 22 nt, Homo sapiens
augggaaaaucagaaggccugg

SEQ ID NO: 304098 - RNA, 22 nt, Homo sapiens
augugcaacugcuggaacaguc

SEQ ID NO: 304099 - RNA, 22 nt, Homo sapiens
augugcagauguuacaaauugu

SEQ ID NO: 304100 - RNA, 22 nt, Homo sapiens
augugggaggacuuggcuguug

SEQ ID NO: 304101 - RNA, 22 nt, Homo sapiens
augugugaaucccagaaccugu

SEQ ID NO: 304102 - RNA, 22 nt, Homo sapiens
auuaagugaaugaaguuguucc

SEQ ID NO: 304103 - RNA, 22 nt, Homo sapiens
auucaaagugcauguucccacu

SEQ ID NO: 304104 - RNA, 22 nt, Homo sapiens
auuccagguggcgccauucaca

SEQ ID NO: 304105 - RNA, 22 nt, Homo sapiens
auuccuuaggcccuuugguuag

SEQ ID NO: 304106 - RNA, 22 nt, Homo sapiens
auugaacaugccauauguacca

SEQ ID NO: 304107 - RNA, 22 nt, Homo sapiens
auugcaaagcguagacucuaaa

SEQ ID NO: 304108 - RNA, 22 nt, Homo sapiens
auugcaaugggaaacuaugaaa

SEQ ID NO: 304109 - RNA, 22 nt, Homo sapiens
auugcacaucugcacuacagcc

SEQ ID NO: 304110 - RNA, 22 nt, Homo sapiens
auugcacuccagccugggcuag

SEQ ID NO: 304111 - RNA, 19 nt, Homo sapiens
auugcaguguaaaacuauu

SEQ ID NO: 304112 - RNA, 22 nt, Homo sapiens
auugcaguuagaacagaagucu

SEQ ID NO: 304113 - RNA, 23 nt, Homo sapiens
auugcccuugaaggcuaaacucu

SEQ ID NO: 304114 - RNA, 22 nt, Homo sapiens
auuggcaagauagcauaugagg

SEQ ID NO: 304115 - RNA, 22 nt, Homo sapiens
auuggcaaucgucuccauuuuu

SEQ ID NO: 304116 - RNA, 22 nt, Homo sapiens
auuggcuuuugaaagucugcga

SEQ ID NO: 304117 - RNA, 21 nt, Homo sapiens
auuugguggcugugugacacu

SEQ ID NO: 304118 - RNA, 22 nt, Homo sapiens
caaaagugguucuuauccuuuu

SEQ ID NO: 304119 - RNA, 22 nt, Homo sapiens
caaagucuucaguugauucuga

SEQ ID NO: 304120 - RNA, 22 nt, Homo sapiens
caaagugcugaaagaggccagg

SEQ ID NO: 304121 - RNA, 22 nt, Homo sapiens
caaagugcugggaugggccagg

SEQ ID NO: 304122 - RNA, 22 nt, Homo sapiens
caaagugguuuauacaugauug

SEQ ID NO: 304123 - RNA, 22 nt, Homo sapiens
cacacugucuucaauggguggu

SEQ ID NO: 304124 - RNA, 22 nt, Homo sapiens
cacauguuugcuacauuuuucu

SEQ ID NO: 304125 - RNA, 22 nt, Homo sapiens
caguaguagccccuuagaugga

SEQ ID NO: 304126 - RNA, 22 nt, Homo sapiens
cauagcacacguauaccuaugu

SEQ ID NO: 304127 - RNA, 22 nt, Homo sapiens
cauagcacugagcucuacccuc

SEQ ID NO: 304128 - RNA, 21 nt, Homo sapiens
caugucacugcacucuagccu

SEQ ID NO: 304129 - RNA, 22 nt, Homo sapiens
ccaaaguauuuucacugauauc

SEQ ID NO: 304130 - RNA, 22 nt, Homo sapiens
ccaaguguucucauuguucaau

SEQ ID NO: 304131 - RNA, 22 nt, Homo sapiens
ccaaguguuuucauuguuccau

SEQ ID NO: 304132 - RNA, 22 nt, Homo sapiens
ccacaguggauuaaaguuacug

SEQ ID NO: 304133 - RNA, 18 nt, Homo sapiens
ccagugcaaggaaagccc

SEQ ID NO: 304134 - RNA, 22 nt, Homo sapiens
ccauugcacuccauccugggca

SEQ ID NO: 304135 - RNA, 22 nt, Homo sapiens
ccauugcacucuggccuaggug

SEQ ID NO: 304136 - RNA, 22 nt, Homo sapiens
ccauuucacucuuccugaagga

SEQ ID NO: 304137 - RNA, 22 nt, Homo sapiens
ccucacaaccuuuauugaagag

SEQ ID NO: 304138 - RNA, 21 nt, Homo sapiens
ccuccauuuguauucuugccc

SEQ ID NO: 304139 - RNA, 22 nt, Homo sapiens
ccuccauuugugucaggaaguc

SEQ ID NO: 304140 - RNA, 22 nt, Homo sapiens
ccuggcacugagcaguguucua

SEQ ID NO: 304141 - RNA, 22 nt, Homo sapiens
cuaggcuguagagaaguucagu

SEQ ID NO: 304142 - RNA, 22 nt, Homo sapiens
cuagguucucaaaccagcguca

SEQ ID NO: 304143 - RNA, 22 nt, Homo sapiens
cucccagagccaguuauaggcu

SEQ ID NO: 304144 - RNA, 22 nt, Homo sapiens
cucuuacaguguguggugaaag

SEQ ID NO: 304145 - RNA, 22 nt, Homo sapiens
cugagacacucuuaucugcaua

SEQ ID NO: 304146 - RNA, 22 nt, Homo sapiens
cugagauggagucucgcauugu

SEQ ID NO: 304147 - RNA, 22 nt, Homo sapiens
cugaggcacggcgaccuuaagu

SEQ ID NO: 304148 - RNA, 22 nt, Homo sapiens
cuggagcaaaggugacucuugu

SEQ ID NO: 304149 - RNA, 21 nt, Homo sapiens
cugguguuagcacuucuuccc

SEQ ID NO: 304150 - RNA, 22 nt, Homo sapiens
cuuuggagaaaaguucuugggc

SEQ ID NO: 304151 - RNA, 23 nt, Homo sapiens
cuuuguacagcuugacuacuggg

SEQ ID NO: 304152 - RNA, 22 nt, Homo sapiens
cuuuugugauucuucaguuacu

SEQ ID NO: 304153 - RNA, 22 nt, Homo sapiens
gaagaaguacaagacaaauuuu

SEQ ID NO: 304154 - RNA, 22 nt, Homo sapiens
gaagauaucuaguaccauuguc

SEQ ID NO: 304155 - RNA, 22 nt, Homo sapiens
gacauagagccuugacuucauu

SEQ ID NO: 304156 - RNA, 22 nt, Homo sapiens
gacuagaaauuauuuagugagc

SEQ ID NO: 304157 - RNA, 22 nt, Homo sapiens
gacuagauauuguucuauguca

SEQ ID NO: 304158 - RNA, 22 nt, Homo sapiens
gacuuagagauguuguauuugg

SEQ ID NO: 304159 - RNA, 22 nt, Homo sapiens
gagaacauuuaagccacucagg

SEQ ID NO: 304160 - RNA, 22 nt, Homo sapiens
gagacagugucagccauugaaa

SEQ ID NO: 304161 - RNA, 22 nt, Homo sapiens
gagacauugacuuuguuccaga

SEQ ID NO: 304162 - RNA, 22 nt, Homo sapiens
gaggcggugugaugucacaugc

SEQ ID NO: 304163 - RNA, 22 nt, Homo sapiens
gauauguacagcucucuaggau

SEQ ID NO: 304164 - RNA, 22 nt, Homo sapiens
gauauguguaucuauguacaug

SEQ ID NO: 304165 - RNA, 22 nt, Homo sapiens
gaucacauggccauuucuagcu

SEQ ID NO: 304166 - RNA, 22 nt, Homo sapiens
gaucacauguguacucaaugug

SEQ ID NO: 304167 - RNA, 22 nt, Homo sapiens
gaucugugugauuggaugcauu

SEQ ID NO: 304168 - RNA, 22 nt, Homo sapiens
gaugauauuugagucauuagaa

SEQ ID NO: 304169 - RNA, 22 nt, Homo sapiens
gauguguuuuaggaucucagca

SEQ ID NO: 304170 - RNA, 22 nt, Homo sapiens
gauuagcacuucaguuacagua

SEQ ID NO: 304171 - RNA, 22 nt, Homo sapiens
gauuucaucuuuagaggaagga

SEQ ID NO: 304172 - RNA, 22 nt, Homo sapiens
gcaucacagcuccugugcuggc

SEQ ID NO: 304173 - RNA, 22 nt, Homo sapiens
gcauugcacuuggcauagacug

SEQ ID NO: 304174 - RNA, 20 nt, Homo sapiens
gccacaguuaagcuucugcc

SEQ ID NO: 304175 - RNA, 22 nt, Homo sapiens
ggacuagagaugagauuuuuca

SEQ ID NO: 304176 - RNA, 22 nt, Homo sapiens
ggagauccucugcgggcaaaga

SEQ ID NO: 304177 - RNA, 22 nt, Homo sapiens
ggaugcauucaacuuccaguuc

SEQ ID NO: 304178 - RNA, 22 nt, Homo sapiens
ggcaaaauggccagugggucac

SEQ ID NO: 304179 - RNA, 22 nt, Homo sapiens
gggauguaugauauauguuggu

SEQ ID NO: 304180 - RNA, 22 nt, Homo sapiens
guaauacuuuugggauauuaga

SEQ ID NO: 304181 - RNA, 22 nt, Homo sapiens
gauuguguucauaggcauguua

SEQ ID NO: 304182 - RNA, 22 nt, Homo sapiens
gcaaaauugagaagggaauaua

SEQ ID NO: 304183 - RNA, 22 nt, Homo sapiens
gcaaaguguuuuuaggaagucu

SEQ ID NO: 304184 - RNA, 22 nt, Homo sapiens
gcaagaaucugggaguaaaauu

SEQ ID NO: 304185 - RNA, 22 nt, Homo sapiens
gcaagaaugagaaggauuaauu

SEQ ID NO: 304186 - RNA, 22 nt, Homo sapiens
gcacaguuaaagggucauguga

SEQ ID NO: 304187 - RNA, 22 nt, Homo sapiens
gcacauggccacuaggaauaaa

SEQ ID NO: 304188 - RNA, 22 nt, Homo sapiens
gcacauuacaaguauuagcuca

SEQ ID NO: 304189 - RNA, 19 nt, Homo sapiens
gcagagaugugguagcuug

SEQ ID NO: 304190 - RNA, 22 nt, Homo sapiens
gcaguacacuguugguaggaau

SEQ ID NO: 304191 - RNA, 22 nt, Homo sapiens
gcugugauucuguguagauagu

SEQ ID NO: 304192 - RNA, 22 nt, Homo sapiens
ggaauauaaaacuuuugacagg

SEQ ID NO: 304193 - RNA, 20 nt, Homo sapiens
ggaauguuaaucuccaugau

SEQ ID NO: 304194 - RNA, 22 nt, Homo sapiens
ggacaaaguauuuucaaaugua

SEQ ID NO: 304195 - RNA, 22 nt, Homo sapiens
ggagucugaacuggacaaugac

SEQ ID NO: 304196 - RNA, 23 nt, Homo sapiens
ggaguguaaauuauuucaaccau

SEQ ID NO: 304197 - RNA, 22 nt, Homo sapiens
ggcaccauggaaggacgggagc

SEQ ID NO: 304198 - RNA, 22 nt, Homo sapiens
ggcaccauuuuacuccuucccu

SEQ ID NO: 304199 - RNA, 22 nt, Homo sapiens
ggcacgguggcucacaccugua

SEQ ID NO: 304200 - RNA, 22 nt, Homo sapiens
ggcuagagagcucagggauaug

SEQ ID NO: 304201 - RNA, 22 nt, Homo sapiens
gggaugaagaagaauaguucgu

SEQ ID NO: 304202 - RNA, 22 nt, Homo sapiens
gggauguuuuauacugagccug

SEQ ID NO: 304203 - RNA, 22 nt, Homo sapiens
ggucugguguugaaauucuuca

SEQ ID NO: 304204 - RNA, 22 nt, Homo sapiens
gucagcaucaccaugucuauga

SEQ ID NO: 304205 - RNA, 22 nt, Homo sapiens
gucagggagucucuaucagugg

SEQ ID NO: 304206 - RNA, 22 nt, Homo sapiens
gucccugaggaacauccagggc

SEQ ID NO: 304207 - RNA, 22 nt, Homo sapiens
gucuagaacuucugaccuuagg

SEQ ID NO: 304208 - RNA, 22 nt, Homo sapiens
gucucccagccuacaucuuucu

SEQ ID NO: 304209 - RNA, 22 nt, Homo sapiens
gucuguuuggggaccuguggcc

SEQ ID NO: 304210 - RNA, 22 nt, Homo sapiens
gugaaagacagcauuaauggcu

SEQ ID NO: 304211 - RNA, 22 nt, Homo sapiens
gugacauuuuuacugaugagag

SEQ ID NO: 304212 - RNA, 22 nt, Homo sapiens
gugagaugaggucucacucugu

SEQ ID NO: 304213 - RNA, 22 nt, Homo sapiens
gugagguagagcaugugaaaga

SEQ ID NO: 304214 - RNA, 22 nt, Homo sapiens
gugaucaugauccugaagcauu

SEQ ID NO: 304215 - RNA, 22 nt, Homo sapiens
gugcacaacgugcaggcuuguu

SEQ ID NO: 304216 - RNA, 22 nt, Homo sapiens
gugcacaaugugcagguuuguu

SEQ ID NO: 304217 - RNA, 22 nt, Homo sapiens
gugcacauauggugcauaagug

SEQ ID NO: 304218 - RNA, 22 nt, Homo sapiens
gugccuucuagcuaugguuggc

SEQ ID NO: 304219 - RNA, 22 nt, Homo sapiens
cugagcacugagauccucuagc

SEQ ID NO: 304220 - RNA, 18 nt, Homo sapiens
cugagcacugcuuuauga

SEQ ID NO: 304221 - RNA, 22 nt, Homo sapiens
cugaggguagaaggaucacuug

SEQ ID NO: 304222 - RNA, 22 nt, Homo sapiens
cuggagcauugguggauuuguu

SEQ ID NO: 304223 - RNA, 22 nt, Homo sapiens
cugggaugauguaaauaggcua

SEQ ID NO: 304224 - RNA, 22 nt, Homo sapiens
cuguuugauuaagugguggaaa

SEQ ID NO: 304225 - RNA, 18 nt, Homo sapiens
cuucauugcuguuuugcu

SEQ ID NO: 304226 - RNA, 22 nt, Homo sapiens
cuuguacacuguuggugggaau

SEQ ID NO: 304227 - RNA, 22 nt, Homo sapiens
cuuuaguugucuccucaagggu

SEQ ID NO: 304228 - RNA, 22 nt, Homo sapiens
cuuugauuauaaaaggguguuu

SEQ ID NO: 304229 - RNA, 22 nt, Homo sapiens
gaaagugcugcaaggccaugca

SEQ ID NO: 304230 - RNA, 22 nt, Homo sapiens
gaagaucacacuguagaucuau

SEQ ID NO: 304231 - RNA, 22 nt, Homo sapiens
gaaggcaugcugcauggccaga

SEQ ID NO: 304232 - RNA, 22 nt, Homo sapiens
gaaucauuguuucuaaguuugu

SEQ ID NO: 304233 - RNA, 22 nt, Homo sapiens
gaaugaauguuuauccuuagau

SEQ ID NO: 304234 - RNA, 22 nt, Homo sapiens
gacagacacaauugauccauga

SEQ ID NO: 304235 - RNA, 22 nt, Homo sapiens
gagagugaaguuugcuaccugu

SEQ ID NO: 304236 - RNA, 22 nt, Homo sapiens
gagaucaguuaaugaagugagc

SEQ ID NO: 304237 - RNA, 22 nt, Homo sapiens
gagaugugguucaaggguguuu

SEQ ID NO: 304238 - RNA, 22 nt, Homo sapiens
gagcugguccuuuaaggaugca

SEQ ID NO: 304239 - RNA, 22 nt, Homo sapiens
gaucacaugggagaaugagagu

SEQ ID NO: 304240 - RNA, 22 nt, Homo sapiens
gcaaagaaugcagauuugccuc

SEQ ID NO: 304241 - RNA, 22 nt, Homo sapiens
gcaauguuacugaauguguuuu

SEQ ID NO: 304242 - RNA, 22 nt, Homo sapiens
gcaguucuguaguugaaauuua

SEQ ID NO: 304243 - RNA, 20 nt, Homo sapiens
gcaugagucuuuauaguaga

SEQ ID NO: 304244 - RNA, 22 nt, Homo sapiens
gccaguguuuuauugagaauuu

SEQ ID NO: 304245 - RNA, 22 nt, Homo sapiens
gcguugcacuccagccugggua

SEQ ID NO: 304246 - RNA, 22 nt, Homo sapiens
gcuuuguugauggugagucugu

SEQ ID NO: 304247 - RNA, 22 nt, Homo sapiens
ggaaagacaccuuacuauguua

SEQ ID NO: 304248 - RNA, 22 nt, Homo sapiens
ggaaagaucagcuaaauguaag

SEQ ID NO: 304249 - RNA, 22 nt, Homo sapiens
ggaaguauaaacuuaguggagu

SEQ ID NO: 304250 - RNA, 22 nt, Homo sapiens
ggaaugagaaauauuacacaau

SEQ ID NO: 304251 - RNA, 22 nt, Homo sapiens
ggagaucuuguuaaaguacaga

SEQ ID NO: 304252 - RNA, 22 nt, Homo sapiens
ggaugcauuuuugguugucaca

SEQ ID NO: 304253 - RNA, 21 nt, Homo sapiens
ggcaagagaauacaacauaaa

SEQ ID NO: 304254 - RNA, 19 nt, Homo sapiens
ggcaagaguuguucugugu

SEQ ID NO: 304255 - RNA, 21 nt, Homo sapiens
ggcaagugugagguuuggggu

SEQ ID NO: 304256 - RNA, 22 nt, Homo sapiens
ggcccugagacaggaaaaagcu

SEQ ID NO: 304257 - RNA, 22 nt, Homo sapiens
gggaaaaugucuauugaaugaa

SEQ ID NO: 304258 - RNA, 22 nt, Homo sapiens
gggagcaaaaaugaugcccaag

SEQ ID NO: 304259 - RNA, 21 nt, Homo sapiens
ggugagaaaggagacauagac

SEQ ID NO: 304260 - RNA, 22 nt, Homo sapiens
guacacaacaugcagguuuguu

SEQ ID NO: 304261 - RNA, 16 nt, Homo sapiens
guacacaguaaguaug

SEQ ID NO: 304262 - RNA, 22 nt, Homo sapiens
guacauguaugcaugcaugcau

SEQ ID NO: 304263 - RNA, 22 nt, Homo sapiens
guagaagcacaggugaguuggu

SEQ ID NO: 304264 - RNA, 22 nt, Homo sapiens
guagcaugcaauauuauagaga

SEQ ID NO: 304265 - RNA, 22 nt, Homo sapiens
gucagugauugauuuaaagacg

SEQ ID NO: 304266 - RNA, 22 nt, Homo sapiens
gucauggacaaggugugagcca

SEQ ID NO: 304267 - RNA, 22 nt, Homo sapiens
gucaugucuugaaauucaguuu

SEQ ID NO: 304268 - RNA, 22 nt, Homo sapiens
gucucccaaccccugugcccag

SEQ ID NO: 304269 - RNA, 22 nt, Homo sapiens
gucugguuccugggagauuucu

SEQ ID NO: 304270 - RNA, 22 nt, Homo sapiens
gucuuugaugucuaugugcuuc

SEQ ID NO: 304271 - RNA, 22 nt, Homo sapiens
gugacauuauuucagcuacaug

SEQ ID NO: 304272 - RNA, 22 nt, Homo sapiens
gugauuuaguagaugcuaguua

SEQ ID NO: 304273 - RNA, 22 nt, Homo sapiens
gugcacaacaugcagguuuguu

SEQ ID NO: 304274 - RNA, 22 nt, Homo sapiens
gugcacaacgugcagguuuguu

SEQ ID NO: 304275 - RNA, 22 nt, Homo sapiens
gugcacaugguagguauugagu

SEQ ID NO: 304276 - RNA, 23 nt, Homo sapiens
gugcaugagucuuuauaguagca

SEQ ID NO: 304277 - RNA, 22 nt, Homo sapiens
guggaagugucuggggccaggg

SEQ ID NO: 304278 - RNA, 22 nt, Homo sapiens
guggcagagucagagggaaaug

SEQ ID NO: 304279 - RNA, 22 nt, Homo sapiens
guguagagaaauagccugaagg

SEQ ID NO: 304280 - RNA, 22 nt, Homo sapiens
guuaaagacauccacauaggag

SEQ ID NO: 304281 - RNA, 22 nt, Homo sapiens
guuauugcucucgaagacucuc

SEQ ID NO: 304282 - RNA, 22 nt, Homo sapiens
uaacccuuacaacuacacucgu

SEQ ID NO: 304283 - RNA, 22 nt, Homo sapiens
uaaguaaaugaaagguugauuu

SEQ ID NO: 304284 - RNA, 22 nt, Homo sapiens
uaagugcaugauuacaugcaua

SEQ ID NO: 304285 - RNA, 22 nt, Homo sapiens
uaaguugcagguugugauucca

SEQ ID NO: 304286 - RNA, 22 nt, Homo sapiens
uaauacuugucauaaaggcauu

SEQ ID NO: 304287 - RNA, 22 nt, Homo sapiens
uaaucacagagguuuggccuca

SEQ ID NO: 304288 - RNA, 22 nt, Homo sapiens
uacagaauucugucccuugagu

SEQ ID NO: 304289 - RNA, 22 nt, Homo sapiens
uacauacuucacagacuuuaaa

SEQ ID NO: 304290 - RNA, 22 nt, Homo sapiens
uagacaacugaaacacugugca

SEQ ID NO: 304291 - RNA, 22 nt, Homo sapiens
uagaucacucaggcaauaaaag

SEQ ID NO: 304292 - RNA, 22 nt, Homo sapiens
uagcacaucuucuuggccugca

SEQ ID NO: 304293 - RNA, 20 nt, Homo sapiens
uagccggguguugugucaug

SEQ ID NO: 304294 - RNA, 23 nt, Homo sapiens
uauaacuuuuaauuuacuggccu

SEQ ID NO: 304295 - RNA, 22 nt, Homo sapiens
uauagcaaugccccacuccuga

SEQ ID NO: 304296 - RNA, 22 nt, Homo sapiens
uauagcauuuugauccuguaga

SEQ ID NO: 304297 - RNA, 22 nt, Homo sapiens
uauaugcaacauaguguaugug

SEQ ID NO: 304298 - RNA, 22 nt, Homo sapiens
uaucacacuggaagaaguuaag

SEQ ID NO: 304299 - RNA, 22 nt, Homo sapiens
uaucagcacaguggguucaugg

SEQ ID NO: 304300 - RNA, 22 nt, Homo sapiens
uauggauuugccuauucuguau

SEQ ID NO: 304301 - RNA, 22 nt, Homo sapiens
uauggcuuuucacuuaaguccu

SEQ ID NO: 304302 - RNA, 22 nt, Homo sapiens
uauugaacgugggauauugaag

SEQ ID NO: 304303 - RNA, 22 nt, Homo sapiens
uauuguuaaagauguuaaugau

SEQ ID NO: 304304 - RNA, 22 nt, Homo sapiens
uauuugauugacuuuagcagga

SEQ ID NO: 304305 - RNA, 22 nt, Homo sapiens
ucaaagugacaaaguugcagca

SEQ ID NO: 304306 - RNA, 22 nt, Homo sapiens
ucaaaugcacguagagaaaaua

SEQ ID NO: 304307 - RNA, 22 nt, Homo sapiens
ucacacuguuuugauuauuaua

SEQ ID NO: 304308 - RNA, 22 nt, Homo sapiens
ucacagucuccucuagggaggg

SEQ ID NO: 304309 - RNA, 22 nt, Homo sapiens
ucacaugugcguuuuggcaugu

SEQ ID NO: 304310 - RNA, 22 nt, Homo sapiens
ucacugaaaccacugccuccug

SEQ ID NO: 304311 - RNA, 22 nt, Homo sapiens
ucacugaaaccuccaccucucg

SEQ ID NO: 304312 - RNA, 22 nt, Homo sapiens
ucacuuggugaacacauuaugu

SEQ ID NO: 304313 - RNA, 22 nt, Homo sapiens
ucagaacugauacuagaacuuu

SEQ ID NO: 304314 - RNA, 22 nt, Homo sapiens
uguggcagugcuuuaugaaacc

SEQ ID NO: 304315 - RNA, 22 nt, Homo sapiens
uguguaauaccuuugacuauau

SEQ ID NO: 304316 - RNA, 22 nt, Homo sapiens
uguuaguuguucauguuaagag

SEQ ID NO: 304317 - RNA, 22 nt, Homo sapiens
uuaaaguguuugcagacaggug

SEQ ID NO: 304318 - RNA, 22 nt, Homo sapiens
uuaaauacagcaugguguuucu

SEQ ID NO: 304319 - RNA, 20 nt, Homo sapiens
uuaaaucuagugcagacuca

SEQ ID NO: 304320 - RNA, 22 nt, Homo sapiens
uuaaugcuuuugggauauuucu

SEQ ID NO: 304321 - RNA, 22 nt, Homo sapiens
uuaauucugucugcccucaucc

SEQ ID NO: 304322 - RNA, 22 nt, Homo sapiens
uuacacaguaggucccuaguaa

SEQ ID NO: 304323 - RNA, 22 nt, Homo sapiens
uuacauugcuucaaauucagug

SEQ ID NO: 304324 - RNA, 22 nt, Homo sapiens
uuagaacaguguuugccucgcu

SEQ ID NO: 304325 - RNA, 22 nt, Homo sapiens
uuagaugaaugucucuuaaaca

SEQ ID NO: 304326 - RNA, 22 nt, Homo sapiens
uuagggaggcucaggacaagag

SEQ ID NO: 304327 - RNA, 22 nt, Homo sapiens
uuaucaaacccuaggagguggu

SEQ ID NO: 304328 - RNA, 22 nt, Homo sapiens
uuaugcaucuuccacacucauu

SEQ ID NO: 304329 - RNA, 22 nt, Homo sapiens
uuauugcacuccagccugggua

SEQ ID NO: 304330 - RNA, 22 nt, Homo sapiens
uucacagugugaucuaugggca

SEQ ID NO: 304331 - RNA, 22 nt, Homo sapiens
uucaccuguagcaugcccuugg

SEQ ID NO: 304332 - RNA, 22 nt, Homo sapiens
uucaccuugggucccacuugcu

SEQ ID NO: 304333 - RNA, 22 nt, Homo sapiens
uucacugcacuccagccugggu

SEQ ID NO: 304334 - RNA, 22 nt, Homo sapiens
uucagugagacgaaaacaacaa

SEQ ID NO: 304335 - RNA, 22 nt, Homo sapiens
uucauagucacauucgaugucu

SEQ ID NO: 304336 - RNA, 22 nt, Homo sapiens
uucauagucuaauuuuuuccac

SEQ ID NO: 304337 - RNA, 21 nt, Homo sapiens
uucaucagccagaaaucaagc

SEQ ID NO: 304338 - RNA, 22 nt, Homo sapiens
uuccauuuguucggugucgcca

SEQ ID NO: 304339 - RNA, 22 nt, Homo sapiens
uucccugaaguguuacucuaga

SEQ ID NO: 304340 - RNA, 22 nt, Homo sapiens
uucuggcuaugggauacuaaau

SEQ ID NO: 304341 - RNA, 22 nt, Homo sapiens
uucuuuggauaaaguuuuaugc

SEQ ID NO: 304342 - RNA, 22 nt, Homo sapiens
uugaaaguaaacaucacaaaga

SEQ ID NO: 304343 - RNA, 22 nt, Homo sapiens
uugaaauguguaagcuccgaaa

SEQ ID NO: 304344 - RNA, 22 nt, Homo sapiens
uugaaguagguaccguucaauu

SEQ ID NO: 304345 - RNA, 22 nt, Homo sapiens
uugaaguaguacuuuauuauag

SEQ ID NO: 304346 - RNA, 22 nt, Homo sapiens
uugacauugcuguaguguccag

SEQ ID NO: 304347 - RNA, 22 nt, Homo sapiens
uugagaugauggauaugcuaau

SEQ ID NO: 304348 - RNA, 22 nt, Homo sapiens
uugagauggagucucgcacugu

SEQ ID NO: 304349 - RNA, 22 nt, Homo sapiens
uugagauggauagacauagcau

SEQ ID NO: 304350 - RNA, 19 nt, Homo sapiens
uugagaugugaacucacac

SEQ ID NO: 304351 - RNA, 22 nt, Homo sapiens
uugagcacugucugugugcagu

SEQ ID NO: 304352 - RNA, 22 nt, Homo sapiens
uugagcaucauguuagcacuca

SEQ ID NO: 304353 - RNA, 22 nt, Homo sapiens
uugaggaggcagucugcccauu

SEQ ID NO: 304354 - RNA, 22 nt, Homo sapiens
uugagggagcauuuguuuugag

SEQ ID NO: 304355 - RNA, 22 nt, Homo sapiens
uugagguagcuuugauggaggu

SEQ ID NO: 304356 - RNA, 22 nt, Homo sapiens
uugauauggcugcuuaccauaa

SEQ ID NO: 304357 - RNA, 22 nt, Homo sapiens
uugauuagauccaguugauuga

SEQ ID NO: 304358 - RNA, 22 nt, Homo sapiens
uugcaaagaccucuucacuucc

SEQ ID NO: 304359 - RNA, 18 nt, Homo sapiens
uugcaaauucuucccugu

SEQ ID NO: 304360 - RNA, 22 nt, Homo sapiens
uugcacauugauuuuguaucuu

SEQ ID NO: 304361 - RNA, 23 nt, Homo sapiens
uugcauagacauccucauagauu

SEQ ID NO: 304362 - RNA, 22 nt, Homo sapiens
uugcaugcuccuuaugagaauc

SEQ ID NO: 304363 - RNA, 22 nt, Homo sapiens
uugcuucuuucgucuggcccca

SEQ ID NO: 304364 - RNA, 22 nt, Homo sapiens
uuggagugugcucauaacugcu

SEQ ID NO: 304365 - RNA, 22 nt, Homo sapiens
uuggcaagcuguuaauuauaaa

SEQ ID NO: 304366 - RNA, 22 nt, Homo sapiens
uugugcuuuugagcugagauga

SEQ ID NO: 304367 - RNA, 22 nt, Homo sapiens
uugugguugaugaagacugucu

SEQ ID NO: 304368 - RNA, 22 nt, Homo sapiens
uuuaacauuggaugagaucguc

SEQ ID NO: 304369 - RNA, 22 nt, Homo sapiens
uuuauccagccucuagcaaggu

SEQ ID NO: 304370 - RNA, 22 nt, Homo sapiens
uuucauggacgcaaugccuuuu

SEQ ID NO: 304371 - RNA, 22 nt, Homo sapiens
uuucccuuuagcuuagugauuu

SEQ ID NO: 304372 - RNA, 22 nt, Homo sapiens
uuuccuggagaaucuuaacaaa

SEQ ID NO: 304373 - RNA, 22 nt, Homo sapiens
uuugagguguauggcaaguuga

SEQ ID NO: 304374 - RNA, 22 nt, Homo sapiens
uuugcaguguaguuggccagca

SEQ ID NO: 304375 - RNA, 18 nt, Homo sapiens
uuuggcuguucaugacuc

SEQ ID NO: 304376 - RNA, 22 nt, Homo sapiens
uuuguacucccuuuagauaaaa

SEQ ID NO: 304377 - RNA, 22 nt, Homo sapiens
uuuguccugccaugguuuauuu

SEQ ID NO: 304378 - RNA, 22 nt, Homo sapiens
uuugugcuaaugcuagauuacu

SEQ ID NO: 304379 - RNA, 22 nt, Homo sapiens
uuugugcuccuguugagaaucu

SEQ ID NO: 304380 - RNA, 22 nt, Homo sapiens
uuuguggaaugcucauguguag

SEQ ID NO: 304381 - RNA, 22 nt, Homo sapiens
uuuguguggccuuggccuggca

SEQ ID NO: 304382 - RNA, 22 nt, Homo sapiens
uuuuggcucugucuguaucuuu

SEQ ID NO: 304383 - RNA, 22 nt, Homo sapiens
uuuuggcuuaaagagaauguau

SEQ ID NO: 304384 - RNA, 22 nt, Homo sapiens
uuuugggggugauucacacagu

SEQ ID NO: 304385 - RNA, 22 nt, Homo sapiens
aaaagcauucagagugcugggc

SEQ ID NO: 304386 - RNA, 22 nt, Homo sapiens
aaaguaauugcaguuuuugcaa

SEQ ID NO: 304387 - RNA, 22 nt, Homo sapiens
aaagugcaguauuugggcagaa

SEQ ID NO: 304388 - RNA, 22 nt, Homo sapiens
aaauugcaaugcgaggcagagg

SEQ ID NO: 304389 - RNA, 22 nt, Homo sapiens
aaauugcauugagcugcuuauu

SEQ ID NO: 304390 - RNA, 22 nt, Homo sapiens
aacuaugucaaauaaaaugagg

SEQ ID NO: 304391 - RNA, 22 nt, Homo sapiens
aagaugcagucauacuggagua

SEQ ID NO: 304392 - RNA, 22 nt, Homo sapiens
aagcaucacauaauggaucaug

SEQ ID NO: 304393 - RNA, 22 nt, Homo sapiens
aagcaucauuuggaauuugaga

SEQ ID NO: 304394 - RNA, 22 nt, Homo sapiens
aaggaauacuggugguugcuau

SEQ ID NO: 304395 - RNA, 22 nt, Homo sapiens
aaguauguaucaagucauacuu

SEQ ID NO: 304396 - RNA, 22 nt, Homo sapiens
aaucagcacacugugcuuucca

SEQ ID NO: 304397 - RNA, 22 nt, Homo sapiens
aaugacuaagaugguacauuuu

SEQ ID NO: 304398 - RNA, 22 nt, Homo sapiens
aaugugcacuuggagccuugcu

SEQ ID NO: 304399 - RNA, 22 nt, Homo sapiens
aauugcaauggacaaugcagca

SEQ ID NO: 304400 - RNA, 22 nt, Homo sapiens
aauuggcagugcucuugccaca

SEQ ID NO: 304401 - RNA, 22 nt, Homo sapiens
acacuggguaacauaucuguua

SEQ ID NO: 304402 - RNA, 22 nt, Homo sapiens
acagaucagagauauuuagguu

SEQ ID NO: 304403 - RNA, 22 nt, Homo sapiens
acauaaagaagcaggacauugu

SEQ ID NO: 304404 - RNA, 21 nt, Homo sapiens
acauguacacauguaugcaca

SEQ ID NO: 304405 - RNA, 22 nt, Homo sapiens
aaacucuguagcagagacagau

SEQ ID NO: 304406 - RNA, 22 nt, Homo sapiens
aaagugcugggauuggcugggc

SEQ ID NO: 304407 - RNA, 22 nt, Homo sapiens
aaaugcuucuauguggcauguu

SEQ ID NO: 304408 - RNA, 22 nt, Homo sapiens
aacagacugucacauaaaauug

SEQ ID NO: 304409 - RNA, 22 nt, Homo sapiens
aacuaugucaaauaaaaugagg

SEQ ID NO: 304410 - RNA, 22 nt, Homo sapiens
aagagcauuggauggggagauu

SEQ ID NO: 304411 - RNA, 22 nt, Homo sapiens
aagaugcagaagcccagauguu

SEQ ID NO: 304412 - RNA, 22 nt, Homo sapiens
aagcagauguguugaaaguacu

SEQ ID NO: 304413 - RNA, 22 nt, Homo sapiens
aagcuggcuuucauugagugcu

SEQ ID NO: 304414 - RNA, 21 nt, Homo sapiens
aaggugguggugauugagaug

SEQ ID NO: 304415 - RNA, 22 nt, Homo sapiens
aagugcacuguaagugcaggau

SEQ ID NO: 304416 - RNA, 22 nt, Homo sapiens
aaucaacauuguuuuaagucaa

SEQ ID NO: 304417 - RNA, 22 nt, Homo sapiens
aaucacacuugauguugagcaa

SEQ ID NO: 304418 - RNA, 22 nt, Homo sapiens
aaugacucugccuaaauuucac

SEQ ID NO: 304419 - RNA, 22 nt, Homo sapiens
aauggcaagagccacagaggcg

SEQ ID NO: 304420 - RNA, 22 nt, Homo sapiens
aauuacauggcaauugggaaau

SEQ ID NO: 304421 - RNA, 22 nt, Homo sapiens
acaaagcuagggaauccaucuu

SEQ ID NO: 304422 - RNA, 20 nt, Homo sapiens
acaaaugcauucugugacau

SEQ ID NO: 304423 - RNA, 19 nt, Homo sapiens
acagauagaauguucuaca

SEQ ID NO: 304424 - RNA, 22 nt, Homo sapiens
acagucuggagaaugggugcuc

SEQ ID NO: 304425 - RNA, 21 nt, Homo sapiens
acaucagaguugugaagguag

SEQ ID NO: 304426 - RNA, 22 nt, Homo sapiens
acauccauuugcuuuauuugcu

SEQ ID NO: 304427 - RNA, 18 nt, Homo sapiens
acaucccaugcuggggug

SEQ ID NO: 304428 - RNA, 20 nt, Homo sapiens
acuaaaucucauuuuaugca

SEQ ID NO: 304429 - RNA, 22 nt, Homo sapiens
cauggcucuuguuuacucccag

SEQ ID NO: 304430 - RNA, 21 nt, Homo sapiens
caugucacugcacucuagccu

SEQ ID NO: 304431 - RNA, 22 nt, Homo sapiens
ccaaguguuuucauuguuccau

SEQ ID NO: 304432 - RNA, 22 nt, Homo sapiens
ccacugggcaguuuauuaucag

SEQ ID NO: 304433 - RNA, 22 nt, Homo sapiens
ccaucccuuucugagcaguucc

SEQ ID NO: 304434 - RNA, 22 nt, Homo sapiens
cccucauucauucauccuaugu

SEQ ID NO: 304435 - RNA, 22 nt, Homo sapiens
cuagcacauaguuauucacuca

SEQ ID NO: 304436 - RNA, 22 nt, Homo sapiens
cucaaguagugguuuucauuga

SEQ ID NO: 304437 - RNA, 22 nt, Homo sapiens
cucaccuugugauccaccggcc

SEQ ID NO: 304438 - RNA, 20 nt, Homo sapiens
cucccugacaaauguggaaa

SEQ ID NO: 304439 - RNA, 22 nt, Homo sapiens
cuccuguagccccaucaucuuu

SEQ ID NO: 304440 - RNA, 22 nt, Homo sapiens
cucucugagccauggcugcccu

SEQ ID NO: 304441 - RNA, 17 nt, Homo sapiens
cucucugguuuaaagca

SEQ ID NO: 304442 - RNA, 22 nt, Homo sapiens
cucugagguuauucguaauauu

SEQ ID NO: 304443 - RNA, 22 nt, Homo sapiens
cucuuuaguaagcaguugauga

SEQ ID NO: 304444 - RNA, 22 nt, Homo sapiens
cugaaaguuauucaggggcaag

SEQ ID NO: 304445 - RNA, 22 nt, Homo sapiens
cugaggcacggcgaccuuaagu

SEQ ID NO: 304446 - RNA, 22 nt, Homo sapiens
cuggaagaaaaucacgccaucu

SEQ ID NO: 304447 - RNA, 22 nt, Homo sapiens
cuggaauuacaggguugagcua

SEQ ID NO: 304448 - RNA, 17 nt, Homo sapiens
cugugaugaucuugucu

SEQ ID NO: 304449 - RNA, 22 nt, Homo sapiens
cugugcauggauuuuaagauug

SEQ ID NO: 304450 - RNA, 22 nt, Homo sapiens
cuuacagucuaucagccacaac

SEQ ID NO: 304451 - RNA, 19 nt, Homo sapiens
cuugccccauucauccucu

SEQ ID NO: 304452 - RNA, 22 nt, Homo sapiens
cuuugauuauaaaaggguguuu

SEQ ID NO: 304453 - RNA, 22 nt, Homo sapiens
cuuugugcccuucugcccauca

SEQ ID NO: 304454 - RNA, 22 nt, Homo sapiens
cuuuuacacugcuggugggaau

SEQ ID NO: 304455 - RNA, 22 nt, Homo sapiens
cuuuuacacuguuggcaggauu

SEQ ID NO: 304456 - RNA, 22 nt, Homo sapiens
cuuuuggugugaagaagcucuu

SEQ ID NO: 304457 - RNA, 22 nt, Homo sapiens
gaaagacuuucugcuguggaua

SEQ ID NO: 304458 - RNA, 22 nt, Homo sapiens
gaaagauuuuaacugggagacu

SEQ ID NO: 304459 - RNA, 22 nt, Homo sapiens
gaaagugcugcaaggccaugca

SEQ ID NO: 304460 - RNA, 21 nt, Homo sapiens
gaaauacugccuuaggagcug

SEQ ID NO: 304461 - RNA, 23 nt, Homo sapiens
gaaauguaagugaugccccacag

SEQ ID NO: 304462 - RNA, 22 nt, Homo sapiens
gaaauguuuuucaugugggcaa

SEQ ID NO: 304463 - RNA, 22 nt, Homo sapiens
gaacugggguuggguugcgaua

SEQ ID NO: 304464 - RNA, 22 nt, Homo sapiens
gaaucauuggguugauucaaga

SEQ ID NO: 304465 - RNA, 22 nt, Homo sapiens
gacuagagagccaaccgucagg

SEQ ID NO: 304466 - RNA, 20 nt, Homo sapiens
gacuugagagugggagagua

SEQ ID NO: 304467 - RNA, 22 nt, Homo sapiens
gagaacauacggcauuugguuu

SEQ ID NO: 304468 - RNA, 22 nt, Homo sapiens
gagaacuaaugauguacuaggc

SEQ ID NO: 304469 - RNA, 22 nt, Homo sapiens
gagacauugacuuuguuccaga

SEQ ID NO: 304470 - RNA, 22 nt, Homo sapiens
gagcacauguggagagucuggg

SEQ ID NO: 304471 - RNA, 18 nt, Homo sapiens
gagcaccuuuuuugcaga

SEQ ID NO: 304472 - RNA, 22 nt, Homo sapiens
gaggucaggacauuuuugcuuu

SEQ ID NO: 304473 - RNA, 22 nt, Homo sapiens
gagguugggaugagggauacag

SEQ ID NO: 304474 - RNA, 22 nt, Homo sapiens
gauaacagauaaugucaguuau

SEQ ID NO: 304475 - RNA, 22 nt, Homo sapiens
gauacuggcuuuauagaaugau

SEQ ID NO: 304476 - RNA, 22 nt, Homo sapiens
gaugguuuuucuccgauuuaua

SEQ ID NO: 304477 - RNA, 22 nt, Homo sapiens
gauuuguauuaaaagugugacg

SEQ ID NO: 304478 - RNA, 22 nt, Homo sapiens
gcaaaauugagaagggaauaua

SEQ ID NO: 304479 - RNA, 22 nt, Homo sapiens
gcaagagguaucuuauuuuccc

SEQ ID NO: 304480 - RNA, 22 nt, Homo sapiens
gcacaguuaaagggucauguga

SEQ ID NO: 304481 - RNA, 19 nt, Homo sapiens
gcagagaugugguagcuug

SEQ ID NO: 304482 - RNA, 22 nt, Homo sapiens
gcaucacagcuccugugcuggc

SEQ ID NO: 304483 - RNA, 22 nt, Homo sapiens
gcauggagaaggggacugauuc

SEQ ID NO: 304484 - RNA, 22 nt, Homo sapiens
gcauugcacuuggcauagacug

SEQ ID NO: 304485 - RNA, 19 nt, Homo sapiens
gcucaccuugcugcuccag

SEQ ID NO: 304486 - RNA, 22 nt, Homo sapiens
gcugugauucuguguagauagu

SEQ ID NO: 304487 - RNA, 22 nt, Homo sapiens
ggaaauguuggugucaugaguu

SEQ ID NO: 304488 - RNA, 22 nt, Homo sapiens
ggaagccugcacucgggcaggg

SEQ ID NO: 304489 - RNA, 19 nt, Homo sapiens
ggaaugcaccaguccuugc

SEQ ID NO: 304490 - RNA, 22 nt, Homo sapiens
ggaaugcagugagcauuagaua

SEQ ID NO: 304491 - RNA, 23 nt, Homo sapiens
ggaguguaaugacucgaucucgg

SEQ ID NO: 304492 - RNA, 22 nt, Homo sapiens
ggauacaucuggacagccgaau

SEQ ID NO: 304493 - RNA, 22 nt, Homo sapiens
ggaugcauucaacuuccaguuc

SEQ ID NO: 304494 - RNA, 22 nt, Homo sapiens
ggcaaagaugaccauuacuuuu

SEQ ID NO: 304495 - RNA, 21 nt, Homo sapiens
ggcaagaaacacaaucaagua

SEQ ID NO: 304496 - RNA, 22 nt, Homo sapiens
ggcagcaugggugccuuuguga

SEQ ID NO: 304497 - RNA, 22 nt, Homo sapiens
ggcagcauugccuuugcaguga

SEQ ID NO: 304498 - RNA, 22 nt, Homo sapiens
ggcccugauacaaguaaggucu

SEQ ID NO: 304499 - RNA, 22 nt, Homo sapiens
ggcucaguugcaaaucaguuca

SEQ ID NO: 304500 - RNA, 22 nt, Homo sapiens
gggaacauggaaauucugcucu

SEQ ID NO: 304501 - RNA, 22 nt, Homo sapiens
gggcaugauggugcacacaugu

SEQ ID NO: 304502 - RNA, 22 nt, Homo sapiens
guaacucugucacuuacuaguu

SEQ ID NO: 304503 - RNA, 22 nt, Homo sapiens
guaauaccuuccccugcuggag

SEQ ID NO: 304504 - RNA, 22 nt, Homo sapiens
guauuugauuauagcaugcuua

SEQ ID NO: 304505 - RNA, 22 nt, Homo sapiens
gucaugucuugaaauucaguuu

SEQ ID NO: 304506 - RNA, 22 nt, Homo sapiens
gucuagaacuucugaccuuagg

SEQ ID NO: 304507 - RNA, 22 nt, Homo sapiens
gucucccagccuacauauuucu

SEQ ID NO: 304508 - RNA, 22 nt, Homo sapiens
gucucccagccuacaucuuucu

SEQ ID NO: 304509 - RNA, 22 nt, Homo sapiens
gucugguugacagcauguggcc

SEQ ID NO: 304510 - RNA, 22 nt, Homo sapiens
gucuuuggaaagacaaaguuca

SEQ ID NO: 304511 - RNA, 22 nt, Homo sapiens
gugaaucauaugccagucaugc

SEQ ID NO: 304512 - RNA, 22 nt, Homo sapiens
gugaaugcauuaagaaggggga

SEQ ID NO: 304513 - RNA, 22 nt, Homo sapiens
gugacauuauuucagcuacaug

SEQ ID NO: 304514 - RNA, 22 nt, Homo sapiens
gugaggcacugcugcuuuccag

SEQ ID NO: 304515 - RNA, 22 nt, Homo sapiens
gugauuuaguagaugcuaguua

SEQ ID NO: 304516 - RNA, 22 nt, Homo sapiens
gugcaaauguuauugagguuuu

SEQ ID NO: 304517 - RNA, 22 nt, Homo sapiens
gugcacaacgugcaggcuuguu

SEQ ID NO: 304518 - RNA, 22 nt, Homo sapiens
gugcacaaugugcagguuuguu

SEQ ID NO: 304519 - RNA, 22 nt, Homo sapiens
gugcaguuugaaaguagaaaca

SEQ ID NO: 304520 - RNA, 22 nt, Homo sapiens
guggcaaagaugccuucuccaa

SEQ ID NO: 304521 - RNA, 22 nt, Homo sapiens
gugguuuucaacuccaccugca

SEQ ID NO: 304522 - RNA, 22 nt, Homo sapiens
gugucccagugugcauacaggu

SEQ ID NO: 304523 - RNA, 22 nt, Homo sapiens
gugugauuauuucaauugaugc

SEQ ID NO: 304524 - RNA, 22 nt, Homo sapiens
gugugcaacuuucauuaauauu

SEQ ID NO: 304525 - RNA, 22 nt, Homo sapiens
guuauguaucuugauugggugg

SEQ ID NO: 304526 - RNA, 22 nt, Homo sapiens
ugagcauuguguuugacuguga

SEQ ID NO: 304527 - RNA, 22 nt, Homo sapiens
ugagccauggcaccuugucuaa

SEQ ID NO: 304528 - RNA, 22 nt, Homo sapiens
ugagcugguacuaauauuauca

SEQ ID NO: 304529 - RNA, 22 nt, Homo sapiens
ugaggugaaguaauauucuaag

SEQ ID NO: 304530 - RNA, 18 nt, Homo sapiens
ugauaucaucacaauuga

SEQ ID NO: 304531 - RNA, 22 nt, Homo sapiens
ugauaucucuugccuccaaaug

SEQ ID NO: 304532 - RNA, 22 nt, Homo sapiens
ugcaaagucgaaacugcaguuu

SEQ ID NO: 304533 - RNA, 19 nt, Homo sapiens
ugcaaauucuaaaaacuga

SEQ ID NO: 304534 - RNA, 18 nt, Homo sapiens
ugcagcaucaguacccag

SEQ ID NO: 304535 - RNA, 22 nt, Homo sapiens
ugcaguguucuuuagaggaaau

SEQ ID NO: 304536 - RNA, 22 nt, Homo sapiens
ugcauagaauguucuguaaaua

SEQ ID NO: 304537 - RNA, 22 nt, Homo sapiens
ugcauccauucuagacucaucu

SEQ ID NO: 304538 - RNA, 20 nt, Homo sapiens
ugcauguccucacuuacuug

SEQ ID NO: 304539 - RNA, 22 nt, Homo sapiens
ugcauugcacuugcaugagaua

SEQ ID NO: 304540 - RNA, 22 nt, Homo sapiens
ugcauugccgugauuacugucu

SEQ ID NO: 304541 - RNA, 21 nt, Homo sapiens
ugcauuggagaauguuucuca

SEQ ID NO: 304542 - RNA, 22 nt, Homo sapiens
uggaaaguacugagguccaccu

SEQ ID NO: 304543 - RNA, 22 nt, Homo sapiens
uggaaauaaaugugccaagauc

SEQ ID NO: 304544 - RNA, 22 nt, Homo sapiens
uggaagauggaguuuuaucauu

SEQ ID NO: 304545 - RNA, 22 nt, Homo sapiens
uggaaucaucaacgaaugaaau

SEQ ID NO: 304546 - RNA, 21 nt, Homo sapiens
uggaaucuauuauuccaguuu

SEQ ID NO: 304547 - RNA, 20 nt, Homo sapiens
uggaaucugaagaucucagu

SEQ ID NO: 304548 - RNA, 21 nt, Homo sapiens
uggaaugaauggccaacaugg

SEQ ID NO: 304549 - RNA, 22 nt, Homo sapiens
uggagagcaaaaucaauccaaa

SEQ ID NO: 304550 - RNA, 22 nt, Homo sapiens
uggagugaaaacacacuaaucu

SEQ ID NO: 304551 - RNA, 20 nt, Homo sapiens
uggagugaagguucuggacc

SEQ ID NO: 304552 - RNA, 22 nt, Homo sapiens
uggaguuugacaugccuuuggg

SEQ ID NO: 304553 - RNA, 20 nt, Homo sapiens
uggaguuugaguucuuggag

SEQ ID NO: 304554 - RNA, 22 nt, Homo sapiens
uggcaaaauggaauauguuggg

SEQ ID NO: 304555 - RNA, 22 nt, Homo sapiens
uggcaaagugugacgugggggu

SEQ ID NO: 304556 - RNA, 22 nt, Homo sapiens
uggcaaauauuuuguuuuguaa

SEQ ID NO: 304557 - RNA, 20 nt, Homo sapiens
uggcaccugacagauagcca

SEQ ID NO: 304558 - RNA, 22 nt, Homo sapiens
uggcaugcauuguggguaauua

SEQ ID NO: 304559 - RNA, 22 nt, Homo sapiens
uggcuugauggcacaagguuuc

SEQ ID NO: 304560 - RNA, 22 nt, Homo sapiens
ugggaaauguagccuagcugug

SEQ ID NO: 304561 - RNA, 22 nt, Homo sapiens
ugggaacaugaagguuaaagag

SEQ ID NO: 304562 - RNA, 22 nt, Homo sapiens
ugggagcauugcauuagaagcc

SEQ ID NO: 304563 - RNA, 22 nt, Homo sapiens
ugggaugauguuaaacguacuc

SEQ ID NO: 304564 - RNA, 22 nt, Homo sapiens
ugggcaagugacuuggcuucuc

SEQ ID NO: 304565 - RNA, 22 nt, Homo sapiens
uguagcaaaucgauacuauugg

SEQ ID NO: 304566 - RNA, 22 nt, Homo sapiens
ugucauagauugcuuggaaaaa

SEQ ID NO: 304567 - RNA, 22 nt, Homo sapiens
ugucauguagaaauuguccauu

SEQ ID NO: 304568 - RNA, 22 nt, Homo sapiens
ugucauucaggaaauucuaagu

SEQ ID NO: 304569 - RNA, 22 nt, Homo sapiens
ugucugagacuguuuuacuuuc

SEQ ID NO: 304570 - RNA, 22 nt, Homo sapiens
ugugaaaucagauagccuuuuu

SEQ ID NO: 304571 - RNA, 20 nt, Homo sapiens
ugugauuauuuaguugcaug

SEQ ID NO: 304572 - RNA, 22 nt, Homo sapiens
ugugcaaucagcuucauuacau

SEQ ID NO: 304573 - RNA, 22 nt, Homo sapiens
ugugcaaucuuccauuuuuagg

SEQ ID NO: 304574 - RNA, 22 nt, Homo sapiens
ugugcaugacagcauacaaacg

SEQ ID NO: 304575 - RNA, 22 nt, Homo sapiens
uguggaguguaugugacagaga

SEQ ID NO: 304576 - RNA, 22 nt, Homo sapiens
uguuacagcagaauugaaagag

SEQ ID NO: 304577 - RNA, 22 nt, Homo sapiens
uuaaaaguauaggccuggcaua

SEQ ID NO: 304578 - RNA, 22 nt, Homo sapiens
uuaaaccugucuucucacuaau

SEQ ID NO: 304579 - RNA, 22 nt, Homo sapiens
uuaaucaggccguuuccuaaga

SEQ ID NO: 304580 - RNA, 22 nt, Homo sapiens
uuacaugucuugguaagguuag

SEQ ID NO: 304581 - RNA, 22 nt, Homo sapiens
uuagcacaucuuucuauguaag

SEQ ID NO: 304582 - RNA, 22 nt, Homo sapiens
uuagcaugucuacuaauuugcu

SEQ ID NO: 304583 - RNA, 20 nt, Homo sapiens
uuaguucauuuagaagguuu

SEQ ID NO: 304584 - RNA, 22 nt, Homo sapiens
uuaugcagcaaagugcuugaaa

SEQ ID NO: 304585 - RNA, 16 nt, Homo sapiens
uuauugcauucuucuc

SEQ ID NO: 304586 - RNA, 22 nt, Homo sapiens
uuauuugguugcugacuuggaa

SEQ ID NO: 304587 - RNA, 22 nt, Homo sapiens
uucaccuugcccacagcagucu

SEQ ID NO: 304588 - RNA, 22 nt, Homo sapiens
uucaccuugggucccacuugcu

SEQ ID NO: 304589 - RNA, 22 nt, Homo sapiens
uucagggacuuuagacaagaga

SEQ ID NO: 304590 - RNA, 22 nt, Homo sapiens
uucauagugaaaaauucaaagu

SEQ ID NO: 304591 - RNA, 22 nt, Homo sapiens
uuccaagugggaaacaaaaaug

SEQ ID NO: 304592 - RNA, 22 nt, Homo sapiens
uuccacaauggcugaacuaguu

SEQ ID NO: 304593 - RNA, 22 nt, Homo sapiens
uuccacaaugguugaacuagcu

SEQ ID NO: 304594 - RNA, 22 nt, Homo sapiens
uuccaguggaguaaauggacaa

SEQ ID NO: 304595 - RNA, 22 nt, Homo sapiens
uucccugaaguguuacucuaga

SEQ ID NO: 304596 - RNA, 22 nt, Homo sapiens
uucccugugggaguaggaaagu

SEQ ID NO: 304597 - RNA, 22 nt, Homo sapiens
uuccuggaggggaaguguccaa

SEQ ID NO: 304598 - RNA, 22 nt, Homo sapiens
uucucgcuuuuuccaccuguau

SEQ ID NO: 304599 - RNA, 22 nt, Homo sapiens
uucucuggucagaggggagguu

SEQ ID NO: 304600 - RNA, 22 nt, Homo sapiens
uucugagguuauauucucucaa

SEQ ID NO: 304601 - RNA, 22 nt, Homo sapiens
uucugugguagaaaucucaaau

SEQ ID NO: 304602 - RNA, 22 nt, Homo sapiens
uucuucaggccacaaaaauggu

SEQ ID NO: 304603 - RNA, 22 nt, Homo sapiens
uucuuuggauaaaguuuuaugc

SEQ ID NO: 304604 - RNA, 22 nt, Homo sapiens
uugaaaguaaacaucacaaaga

SEQ ID NO: 304605 - RNA, 17 nt, Homo sapiens
uugaaugcauuacuugg

SEQ ID NO: 304606 - RNA, 22 nt, Homo sapiens
uugagauggagucuugcacugu

SEQ ID NO: 304607 - RNA, 19 nt, Homo sapiens
uugagaugugaacucacac

SEQ ID NO: 304608 - RNA, 22 nt, Homo sapiens
uugagcucuucuagcaauucua

SEQ ID NO: 304609 - RNA, 16 nt, Homo sapiens
uugaggcaugucucag

SEQ ID NO: 304610 - RNA, 22 nt, Homo sapiens
uugaggugggaggaucacuuga

SEQ ID NO: 304611 - RNA, 22 nt, Homo sapiens
uugauuagauccaguugauuga

SEQ ID NO: 304612 - RNA, 22 nt, Homo sapiens
uugcaaaucucuuguguuuggu

SEQ ID NO: 304613 - RNA, 22 nt, Homo sapiens
uugcacaauggaauuuaucuuu

SEQ ID NO: 304614 - RNA, 22 nt, Homo sapiens
uugcaugcuccuuaugagaauc

SEQ ID NO: 304615 - RNA, 22 nt, Homo sapiens
uuggaacacauguuuuucuacc

SEQ ID NO: 304616 - RNA, 22 nt, Homo sapiens
uuggaagauuacuuaguuuucu

SEQ ID NO: 304617 - RNA, 22 nt, Homo sapiens
uuggacagaugguuacauuuuu

SEQ ID NO: 304618 - RNA, 22 nt, Homo sapiens
uuggcaaauagguuuuauugca

SEQ ID NO: 304619 - RNA, 22 nt, Homo sapiens
uuggcaaguccccaccucucuc

SEQ ID NO: 304620 - RNA, 22 nt, Homo sapiens
uuggccccucccaaauuucaug

SEQ ID NO: 304621 - RNA, 22 nt, Homo sapiens
uugggauggaaauuuguacccc

SEQ ID NO: 304622 - RNA, 21 nt, Homo sapiens
uugguccacaugucauaguua

SEQ ID NO: 304623 - RNA, 22 nt, Homo sapiens
gugagaagaaaaauauggcugu

SEQ ID NO: 304624 - RNA, 22 nt, Homo sapiens
gugagaaucaaacuacauaaau

SEQ ID NO: 304625 - RNA, 22 nt, Homo sapiens
gugagcaguguccuugggggca

SEQ ID NO: 304626 - RNA, 22 nt, Homo sapiens
gugaucauuguauugggguuau

SEQ ID NO: 304627 - RNA, 22 nt, Homo sapiens
gugaucucagcucacuggaacc

SEQ ID NO: 304628 - RNA, 22 nt, Homo sapiens
gugcacaacgugcagguuuguu

SEQ ID NO: 304629 - RNA, 22 nt, Homo sapiens
gugcacaacguguagguuuguu

SEQ ID NO: 304630 - RNA, 22 nt, Homo sapiens
gugcacaaucgugcauuccuug

SEQ ID NO: 304631 - RNA, 23 nt, Homo sapiens
gugcaugagucuuuauaguagca

SEQ ID NO: 304632 - RNA, 22 nt, Homo sapiens
gugcaugcaucuuuauaguagc

SEQ ID NO: 304633 - RNA, 21 nt, Homo sapiens
guggaaauggaauuuacuaau

SEQ ID NO: 304634 - RNA, 22 nt, Homo sapiens
guggacagagacuaaauguugu

SEQ ID NO: 304635 - RNA, 22 nt, Homo sapiens
guggcuuguaggggucaaggga

SEQ ID NO: 304636 - RNA, 22 nt, Homo sapiens
guucacacuugcaaccccagca

SEQ ID NO: 304637 - RNA, 22 nt, Homo sapiens
guugaacaauagauucauauca

SEQ ID NO: 304638 - RNA, 22 nt, Homo sapiens
guuuggcuuucucucuauccug

SEQ ID NO: 304639 - RNA, 22 nt, Homo sapiens
uaagcuauagugaauaaauugc

SEQ ID NO: 304640 - RNA, 22 nt, Homo sapiens
uaaguugcagguugugauucca

SEQ ID NO: 304641 - RNA, 22 nt, Homo sapiens
uaauaauguuaggcuuacucaa

SEQ ID NO: 304642 - RNA, 22 nt, Homo sapiens
uaaugcauguaaugggcugaua

SEQ ID NO: 304643 - RNA, 22 nt, Homo sapiens
uacaaguaauaagggaagaauu

SEQ ID NO: 304644 - RNA, 22 nt, Homo sapiens
uacauccauccugcugggcagu

SEQ ID NO: 304645 - RNA, 22 nt, Homo sapiens
uacuagaggcgggguuucgcca

SEQ ID NO: 304646 - RNA, 22 nt, Homo sapiens
uacucugcagagaugcauaaca

SEQ ID NO: 304647 - RNA, 20 nt, Homo sapiens
uacugcacuccaaccuaggc

SEQ ID NO: 304648 - RNA, 22 nt, Homo sapiens
uacugcacuccagccugggaga

SEQ ID NO: 304649 - RNA, 20 nt, Homo sapiens
uacugcacuuuccucauggu

SEQ ID NO: 304650 - RNA, 22 nt, Homo sapiens
uagagcuagggacucgcaaugu

SEQ ID NO: 304651 - RNA, 22 nt, Homo sapiens
uagagguucuaagauucucaga

SEQ ID NO: 304652 - RNA, 22 nt, Homo sapiens
uagcaccaaacauauacucagu

SEQ ID NO: 304653 - RNA, 22 nt, Homo sapiens
uagcaccacaaucaagauacag

SEQ ID NO: 304654 - RNA, 22 nt, Homo sapiens
uagcaccugugcacaccaggca

SEQ ID NO: 304655 - RNA, 22 nt, Homo sapiens
uagcaccuuagcauuucuagug

SEQ ID NO: 304656 - RNA, 22 nt, Homo sapiens
uagcagaauaacuugccagccu

SEQ ID NO: 304657 - RNA, 18 nt, Homo sapiens
uagcagacaucauugggg

SEQ ID NO: 304658 - RNA, 22 nt, Homo sapiens
uagcagccaggaagggcuggcu

SEQ ID NO: 304659 - RNA, 22 nt, Homo sapiens
uagcauaauuuguagaaaauca

SEQ ID NO: 304660 - RNA, 22 nt, Homo sapiens
uagcauggaggcggccauagug

SEQ ID NO: 304661 - RNA, 22 nt, Homo sapiens
uaggagcacaaacccuacugug

SEQ ID NO: 304662 - RNA, 22 nt, Homo sapiens
uaggagcacagcagcauguggg

SEQ ID NO: 304663 - RNA, 19 nt, Homo sapiens
uaggugguuuuccccucac

SEQ ID NO: 304664 - RNA, 22 nt, Homo sapiens
uauacuguuuucuauaguggcu

SEQ ID NO: 304665 - RNA, 22 nt, Homo sapiens
uauagcagugaguauugacuaa

SEQ ID NO: 304666 - RNA, 22 nt, Homo sapiens
uaucaacaggguggccagugua

SEQ ID NO: 304667 - RNA, 22 nt, Homo sapiens
uaucacacaucaugguaaaucu

SEQ ID NO: 304668 - RNA, 18 nt, Homo sapiens
aaaaagugcucaggccua

SEQ ID NO: 304669 - RNA, 22 nt, Homo sapiens
aaaacgcauccucacaggucug

SEQ ID NO: 304670 - RNA, 22 nt, Homo sapiens
aaaagucuguagugaaagguga

SEQ ID NO: 304671 - RNA, 22 nt, Homo sapiens
aaaagugguguuguuucuaaau

SEQ ID NO: 304672 - RNA, 22 nt, Homo sapiens
aaagugcaguauuugggcagga

SEQ ID NO: 304673 - RNA, 22 nt, Homo sapiens
aaagugcuucucuuuggugggu

SEQ ID NO: 304674 - RNA, 22 nt, Homo sapiens
aaagugguuuuucagacuuuga

SEQ ID NO: 304675 - RNA, 22 nt, Homo sapiens
aaaguucuguugauagugcuga

SEQ ID NO: 304676 - RNA, 18 nt, Homo sapiens
aaaugcucuucuggaaua

SEQ ID NO: 304677 - RNA, 22 nt, Homo sapiens
aaauggcuuuuugggcaaggug

SEQ ID NO: 304678 - RNA, 19 nt, Homo sapiens
aaaugugcacuguuuucca

SEQ ID NO: 304679 - RNA, 22 nt, Homo sapiens
aaauucaugucaccucuaggua

SEQ ID NO: 304680 - RNA, 22 nt, Homo sapiens
aaauugcauugagcugcuuauu

SEQ ID NO: 304681 - RNA, 19 nt, Homo sapiens
aaccgggagugcacauguu

SEQ ID NO: 304682 - RNA, 15 nt, Homo sapiens
aaccuggaggagcuu

SEQ ID NO: 304683 - RNA, 21 nt, Homo sapiens
ugccuuuguaguaggugucuu

SEQ ID NO: 304684 - RNA, 22 nt, Homo sapiens
ugcuuuguugaaaaucauuugg

SEQ ID NO: 304685 - RNA, 22 nt, Homo sapiens
uggaaaguacuugaguuuguau

SEQ ID NO: 304686 - RNA, 22 nt, Homo sapiens
uggaaaguaguucuaaucuaag

SEQ ID NO: 304687 - RNA, 22 nt, Homo sapiens
uggaaaguccaagccaaccggg

SEQ ID NO: 304688 - RNA, 20 nt, Homo sapiens
uggaaauuaaccuuucaggu

SEQ ID NO: 304689 - RNA, 22 nt, Homo sapiens
uggaaucuuaggugaaggcuuu

SEQ ID NO: 304690 - RNA, 22 nt, Homo sapiens
uggaguaggccuaagaaugaca

SEQ ID NO: 304691 - RNA, 22 nt, Homo sapiens
uggagugagaacuucaaugaug

SEQ ID NO: 304692 - RNA, 22 nt, Homo sapiens
uggauaguaauaaacauauagg

SEQ ID NO: 304693 - RNA, 22 nt, Homo sapiens
uggcaaaauauuuugguuucug

SEQ ID NO: 304694 - RNA, 22 nt, Homo sapiens
uggcaaaucagaggcauggaca

SEQ ID NO: 304695 - RNA, 22 nt, Homo sapiens
uggcaaaugaaagaaagccagu

SEQ ID NO: 304696 - RNA, 22 nt, Homo sapiens
uggcaaauguaguacccaauag

SEQ ID NO: 304697 - RNA, 22 nt, Homo sapiens
uggcaaauuccaaaguuaauuc

SEQ ID NO: 304698 - RNA, 22 nt, Homo sapiens
uggcaagaagagcaugagacca

SEQ ID NO: 304699 - RNA, 22 nt, Homo sapiens
uggcaauauccacaauuacuuu

SEQ ID NO: 304700 - RNA, 22 nt, Homo sapiens
uggcaccugacuccgagaugca

SEQ ID NO: 304701 - RNA, 22 nt, Homo sapiens
uggcauuuucucuguucuuaga

SEQ ID NO: 304702 - RNA, 20 nt, Homo sapiens
ugggaaauguccaggacaua

SEQ ID NO: 304703 - RNA, 22 nt, Homo sapiens
ugggaagagggagcgauuuugg

SEQ ID NO: 304704 - RNA, 22 nt, Homo sapiens
ugggaugaaaauagcuucuucc

SEQ ID NO: 304705 - RNA, 22 nt, Homo sapiens
ugggcaaaugcuuuuuagucaa

SEQ ID NO: 304706 - RNA, 22 nt, Homo sapiens
uggucaaaugccaaucuguagu

SEQ ID NO: 304707 - RNA, 22 nt, Homo sapiens
ugguccacuaacccucaguauc

SEQ ID NO: 304708 - RNA, 22 nt, Homo sapiens
uguaacaggaggaaaaugugaa

SEQ ID NO: 304709 - RNA, 22 nt, Homo sapiens
ugucaguggucuggaugcagcc

SEQ ID NO: 304710 - RNA, 22 nt, Homo sapiens
ugucaugucaacuauggaauuu

SEQ ID NO: 304711 - RNA, 22 nt, Homo sapiens
ugugaacagcuccaaaugugga

SEQ ID NO: 304712 - RNA, 23 nt, Homo sapiens
ugugacacuuccgucaguucauu

SEQ ID NO: 304713 - RNA, 18 nt, Homo sapiens
ugugacauugagcauguc

SEQ ID NO: 304714 - RNA, 22 nt, Homo sapiens
ugugauguggagggcagaucca

SEQ ID NO: 304715 - RNA, 22 nt, Homo sapiens
uguucacaguguuucuuugaga

SEQ ID NO: 304716 - RNA, 22 nt, Homo sapiens
uguucuggagaguuuagucugg

SEQ ID NO: 304717 - RNA, 22 nt, Homo sapiens
uuaacagugucaaucuguagua

SEQ ID NO: 304718 - RNA, 22 nt, Homo sapiens
uuaauacugcuuaacuuuagga

SEQ ID NO: 304719 - RNA, 21 nt, Homo sapiens
uuacaguugguugugaggugg

SEQ ID NO: 304720 - RNA, 22 nt, Homo sapiens
uuacauguggugugaagaagag

SEQ ID NO: 304721 - RNA, 22 nt, Homo sapiens
uuagacaguggugcacugcacu

SEQ ID NO: 304722 - RNA, 22 nt, Homo sapiens
uuauaaacaugaagauuugggg

SEQ ID NO: 304723 - RNA, 22 nt, Homo sapiens
uuauacacugugggaguguaaa

SEQ ID NO: 304724 - RNA, 22 nt, Homo sapiens
uuauagcagugcaggaacagac

SEQ ID NO: 304725 - RNA, 22 nt, Homo sapiens
uuauggauuuauauucuguagu

SEQ ID NO: 304726 - RNA, 22 nt, Homo sapiens
uucaauuaauauuauacucuca

SEQ ID NO: 304727 - RNA, 22 nt, Homo sapiens
uucauagucuaauuuuuuccac

SEQ ID NO: 304728 - RNA, 22 nt, Homo sapiens
uucaucagggagaaauaauuuc

SEQ ID NO: 304729 - RNA, 22 nt, Homo sapiens
uucauggacucaauaguuucgc

SEQ ID NO: 304730 - RNA, 22 nt, Homo sapiens
uucaugucuuggcuguuagagu

SEQ ID NO: 304731 - RNA, 22 nt, Homo sapiens
uuccacaaugguugaacuaauu

SEQ ID NO: 304732 - RNA, 22 nt, Homo sapiens
uuccagcugggggcaacucugc

SEQ ID NO: 304733 - RNA, 22 nt, Homo sapiens
uucccucagaaacacacagccc

SEQ ID NO: 304734 - RNA, 19 nt, Homo sapiens
uuccugagaacaagggcuu

SEQ ID NO: 304735 - RNA, 22 nt, Homo sapiens
uucucaguaauuccagauuuuu

SEQ ID NO: 304736 - RNA, 22 nt, Homo sapiens
uucucagugaaguuuagaacau

SEQ ID NO: 304737 - RNA, 22 nt, Homo sapiens
uucucaguuccuacuuugguga

SEQ ID NO: 304738 - RNA, 22 nt, Homo sapiens
uucucuaguuacuuuaauggag

SEQ ID NO: 304739 - RNA, 19 nt, Homo sapiens
uucucugguuguacuaccc

SEQ ID NO: 304740 - RNA, 22 nt, Homo sapiens
uucuggcucgauucucugaccg

SEQ ID NO: 304741 - RNA, 22 nt, Homo sapiens
uucuuugcaugaucucaaaguc

SEQ ID NO: 304742 - RNA, 22 nt, Homo sapiens
uugaaagucauuucuucuaagu

SEQ ID NO: 304743 - RNA, 22 nt, Homo sapiens
uugaaaguguucacaaugguau

SEQ ID NO: 304744 - RNA, 22 nt, Homo sapiens
uugaagacuaaguuaucaggau

SEQ ID NO: 304745 - RNA, 22 nt, Homo sapiens
uugaagacuaauuuagauaaug

SEQ ID NO: 304746 - RNA, 22 nt, Homo sapiens
uugagauggauagacauagcau

SEQ ID NO: 304747 - RNA, 22 nt, Homo sapiens
uugagauguauguauauaaugu

SEQ ID NO: 304748 - RNA, 22 nt, Homo sapiens
uugaggucuucaggaucaggcu

SEQ ID NO: 304749 - RNA, 22 nt, Homo sapiens
uugaggugaagggcagagcagc

SEQ ID NO: 304750 - RNA, 22 nt, Homo sapiens
uuggaaaguuguuguaguuauu

SEQ ID NO: 304751 - RNA, 22 nt, Homo sapiens
uuggauuauaaacugagauuug

SEQ ID NO: 304752 - RNA, 22 nt, Homo sapiens
uuggccccuccaaaucucaugu

SEQ ID NO: 304753 - RNA, 22 nt, Homo sapiens
uugguccauuacauugaugaca

SEQ ID NO: 304754 - RNA, 22 nt, Homo sapiens
uuguaaaguucuuaggaagcuc

SEQ ID NO: 304755 - RNA, 22 nt, Homo sapiens
uugugaauggugccgcgauaaa

SEQ ID NO: 304756 - RNA, 22 nt, Homo sapiens
uugugaauggugcugcaguaaa

SEQ ID NO: 304757 - RNA, 22 nt, Homo sapiens
uugugcuucaucaccuagcaga

SEQ ID NO: 304758 - RNA, 22 nt, Homo sapiens
uuguuugguuagaugggcaagu

SEQ ID NO: 304759 - RNA, 22 nt, Homo sapiens
uuuacugugggguuucuuagag

SEQ ID NO: 304760 - RNA, 22 nt, Homo sapiens
uuucauagccuuugucgucuga

SEQ ID NO: 304761 - RNA, 21 nt, Homo sapiens
uuuccuggagcguauggcuuc

SEQ ID NO: 304762 - RNA, 22 nt, Homo sapiens
uuuccuguagggggcaaggccu

SEQ ID NO: 304763 - RNA, 20 nt, Homo sapiens
uuucuccccuauaaaucuca

SEQ ID NO: 304764 - RNA, 22 nt, Homo sapiens
uuugacuaccaggaauguucuu

SEQ ID NO: 304765 - RNA, 22 nt, Homo sapiens
uuugacuagaguguuuuacaac

SEQ ID NO: 304766 - RNA, 22 nt, Homo sapiens
uuugagcauuagggcaaaggca

SEQ ID NO: 304767 - RNA, 22 nt, Homo sapiens
uuugagugugauaucgauugga

SEQ ID NO: 304768 - RNA, 22 nt, Homo sapiens
uuugauguugauacuaccuuca

SEQ ID NO: 304769 - RNA, 22 nt, Homo sapiens
uuuggcauuugaguuuguagga

SEQ ID NO: 304770 - RNA, 22 nt, Homo sapiens
uuuggcuuaagauugacugcaa

SEQ ID NO: 304771 - RNA, 22 nt, Homo sapiens
uuugggaaugguuugucuccca

SEQ ID NO: 304772 - RNA, 22 nt, Homo sapiens
uuugguccuccuacagggcagg

SEQ ID NO: 304773 - RNA, 22 nt, Homo sapiens
uuugugacuugcuucucagaau

SEQ ID NO: 304774 - RNA, 19 nt, Homo sapiens
uuuuccccuuucuuaagac

SEQ ID NO: 304775 - RNA, 22 nt, Homo sapiens
uuuuggacuucaauuugacacu

SEQ ID NO: 304776 - RNA, 22 nt, Homo sapiens
uuuuugguugguaggcuauuaa

SEQ ID NO: 304777 - RNA, 22 nt, Homo sapiens
uuuuuugguaauugaacaauga

SEQ ID NO: 304778 - RNA, 22 nt, Homo sapiens
uaaugcuguggucuaaugggga

SEQ ID NO: 304779 - RNA, 22 nt, Homo sapiens
uacauugucauauucucucucu

SEQ ID NO: 304780 - RNA, 22 nt, Homo sapiens
uacguguauuguuuucacaaga

SEQ ID NO: 304781 - RNA, 16 nt, Homo sapiens
uacuacugccuauuau

SEQ ID NO: 304782 - RNA, 22 nt, Homo sapiens
uacuagaggaaaacuugaagac

SEQ ID NO: 304783 - RNA, 22 nt, Homo sapiens
uacuagaggaauugcuauaacu

SEQ ID NO: 304784 - RNA, 22 nt, Homo sapiens
uacugcacuccagccugccaac

SEQ ID NO: 304785 - RNA, 22 nt, Homo sapiens
uacugcacuccagcuuaggaga

SEQ ID NO: 304786 - RNA, 22 nt, Homo sapiens
uagagcuugacacuuuccaugg

SEQ ID NO: 304787 - RNA, 22 nt, Homo sapiens
uagcacuauuuauugaaaagga

SEQ ID NO: 304788 - RNA, 22 nt, Homo sapiens
uagcagucucagaaugcauggu

SEQ ID NO: 304789 - RNA, 22 nt, Homo sapiens
uagcaugacacuuguugaaugc

SEQ ID NO: 304790 - RNA, 22 nt, Homo sapiens
uaggugcacaguaaauauaugu

SEQ ID NO: 304791 - RNA, 22 nt, Homo sapiens
uaggugguuugaaauacucaag

SEQ ID NO: 304792 - RNA, 21 nt, Homo sapiens
uagugcagugggguaugacuu

SEQ ID NO: 304793 - RNA, 22 nt, Homo sapiens
uaucacagaggguauccuagag

SEQ ID NO: 304794 - RNA, 22 nt, Homo sapiens
uaugaaagcuacuucucacaau

SEQ ID NO: 304795 - RNA, 22 nt, Homo sapiens
uaugacuguuugcucauucagg

SEQ ID NO: 304796 - RNA, 22 nt, Homo sapiens
uauggcuucuauaaggaagcuu

SEQ ID NO: 304797 - RNA, 22 nt, Homo sapiens
uauggguuuuucauaaauaggu

SEQ ID NO: 304798 - RNA, 22 nt, Homo sapiens
uaugugcaaauuaauugcuaga

SEQ ID NO: 304799 - RNA, 22 nt, Homo sapiens
uauuacauccauaggcucugcu

SEQ ID NO: 304800 - RNA, 22 nt, Homo sapiens
uauugacuugagaagggauuag

SEQ ID NO: 304801 - RNA, 22 nt, Homo sapiens
uauugcuuuuaacccaaucucu

SEQ ID NO: 304802 - RNA, 22 nt, Homo sapiens
ucaaaguauucuucugagaacc

SEQ ID NO: 304803 - RNA, 22 nt, Homo sapiens
ucaaagugagcuccuucucacu

SEQ ID NO: 304804 - RNA, 22 nt, Homo sapiens
ucacaaggcaggaaugaaaggg

SEQ ID NO: 304805 - RNA, 22 nt, Homo sapiens
ucacaaguguauagacaugucc

SEQ ID NO: 304806 - RNA, 22 nt, Homo sapiens
ucacacugaaacuaggguguga

SEQ ID NO: 304807 - RNA, 22 nt, Homo sapiens
ucacacugaauuugaagcaaug

SEQ ID NO: 304808 - RNA, 22 nt, Homo sapiens
ucaccuggagacaugaagacug

SEQ ID NO: 304809 - RNA, 22 nt, Homo sapiens
ucagaucacuggcgcuggcgga

SEQ ID NO: 304810 - RNA, 22 nt, Homo sapiens
ucagaucaugcuuaugauggga

SEQ ID NO: 304811 - RNA, 22 nt, Homo sapiens
ucagaugauuccguugacgaga

SEQ ID NO: 304812 - RNA, 21 nt, Homo sapiens
ucagcucaucacugccuggag

SEQ ID NO: 304813 - RNA, 22 nt, Homo sapiens
ucaggcacucagcuuagagucu

SEQ ID NO: 304814 - RNA, 22 nt, Homo sapiens
ucagugauugguuauuuuaggc

SEQ ID NO: 304815 - RNA, 22 nt, Homo sapiens
ucauaguacuuuguuuugaaaa

SEQ ID NO: 304816 - RNA, 20 nt, Homo sapiens
ucccucaaacuuuuccacug

SEQ ID NO: 304817 - RNA, 18 nt, Homo sapiens
ucccugacucaaauucuu

SEQ ID NO: 304818 - RNA, 17 nt, Homo sapiens
ucccuguuuuuucaguc

SEQ ID NO: 304819 - RNA, 22 nt, Homo sapiens
uccuuugguggagucuuuaggg

SEQ ID NO: 304820 - RNA, 22 nt, Homo sapiens
ucucaaguaacugggacaauaa

SEQ ID NO: 304821 - RNA, 20 nt, Homo sapiens
ucucauggagggaaagagca

SEQ ID NO: 304822 - RNA, 22 nt, Homo sapiens
ucucccauccaugaacuucugu

SEQ ID NO: 304823 - RNA, 22 nt, Homo sapiens
ucugagcaauagauguggauau

SEQ ID NO: 304824 - RNA, 23 nt, Homo sapiens
ucugauguuauaaaauucuuugg

SEQ ID NO: 304825 - RNA, 22 nt, Homo sapiens
ucugucacugaaucccugucac

SEQ ID NO: 304826 - RNA, 22 nt, Homo sapiens
ucuguggugggcuccacccagu

SEQ ID NO: 304827 - RNA, 22 nt, Homo sapiens
ucuuggguuugccuugcugcug

SEQ ID NO: 304828 - RNA, 19 nt, Homo sapiens
ucuuugaggcaucgcccuc

SEQ ID NO: 304829 - RNA, 22 nt, Homo sapiens
ucuuugauuuuguuacuaagac

SEQ ID NO: 304830 - RNA, 22 nt, Homo sapiens
ucuuugguugcacugcaggugu

SEQ ID NO: 304831 - RNA, 22 nt, Homo sapiens
ugaaacauacacucugaugggg

SEQ ID NO: 304832 - RNA, 22 nt, Homo sapiens
ugaaagcuacagucuccuagga

SEQ ID NO: 304833 - RNA, 22 nt, Homo sapiens
ugaaauggaagaagucccuuuu

SEQ ID NO: 304834 - RNA, 22 nt, Homo sapiens
ugaaauggugcggucugcagca

SEQ ID NO: 304835 - RNA, 22 nt, Homo sapiens
ugaaauguaaguugucuagucu

SEQ ID NO: 304836 - RNA, 21 nt, Homo sapiens
ugaaccccugcucucaagaaa

SEQ ID NO: 304837 - RNA, 22 nt, Homo sapiens
ugaauacuucguucaaagauaa

SEQ ID NO: 304838 - RNA, 22 nt, Homo sapiens
ugaauucaucucacagaguuaa

SEQ ID NO: 304839 - RNA, 21 nt, Homo sapiens
ugacagaaaauugaguuugcu

SEQ ID NO: 304840 - RNA, 22 nt, Homo sapiens
ugacagagaagcauugaguuca

SEQ ID NO: 304841 - RNA, 22 nt, Homo sapiens
ugacagagcaggacuucaucuc

SEQ ID NO: 304842 - RNA, 22 nt, Homo sapiens
ugacaucaccaccuccgucauc

SEQ ID NO: 304843 - RNA, 20 nt, Homo sapiens
ugacaucagcaauguaauaa

SEQ ID NO: 304844 - RNA, 18 nt, Homo sapiens
ugacaucauuuagaaagg

SEQ ID NO: 304845 - RNA, 22 nt, Homo sapiens
ugacauggagguggaggaagau

SEQ ID NO: 304846 - RNA, 22 nt, Homo sapiens
ugacuaaaacugaguuucauua

SEQ ID NO: 304847 - RNA, 22 nt, Homo sapiens
ugacuacauaaguaaucucaaa

SEQ ID NO: 304848 - RNA, 22 nt, Homo sapiens
ugacuagacuugcaagguugca

SEQ ID NO: 304849 - RNA, 22 nt, Homo sapiens
ugacuagagggcuuuuguguag

SEQ ID NO: 304850 - RNA, 22 nt, Homo sapiens
ugacucaagagccugacucauc

SEQ ID NO: 304851 - RNA, 22 nt, Homo sapiens
ugacuucagacugaaaugauuc

SEQ ID NO: 304852 - RNA, 16 nt, Homo sapiens
ugagaacaugugacau

SEQ ID NO: 304853 - RNA, 22 nt, Homo sapiens
ugagaauauuuuccaugucuca

SEQ ID NO: 304854 - RNA, 22 nt, Homo sapiens
ugagaucuuaucagaaauggug

SEQ ID NO: 304855 - RNA, 22 nt, Homo sapiens
ugagaugaagcuagaagaaugg

SEQ ID NO: 304856 - RNA, 22 nt, Homo sapiens
ugagaugaugggauaagagggc

SEQ ID NO: 304857 - RNA, 22 nt, Homo sapiens
ugagauggguaauuaaauggug

SEQ ID NO: 304858 - RNA, 23 nt, Homo sapiens
ugagauuauaaucuuuuacuucu

SEQ ID NO: 304859 - RNA, 20 nt, Homo sapiens
ugagauuggugugguauaag

SEQ ID NO: 304860 - RNA, 22 nt, Homo sapiens
ugagcaaaauuuuggacauaga

SEQ ID NO: 304861 - RNA, 22 nt, Homo sapiens
ugagccaugguuagcuucucau

SEQ ID NO: 304862 - RNA, 18 nt, Homo sapiens
ugaggaaaggguuugcua

SEQ ID NO: 304863 - RNA, 22 nt, Homo sapiens
ugagguaagauguucauuuuuc

SEQ ID NO: 304864 - RNA, 23 nt, Homo sapiens
ugagguguuaagcagacuugucu

SEQ ID NO: 304865 - RNA, 22 nt, Homo sapiens
ugaguagaacuccuggagaugu

SEQ ID NO: 304866 - RNA, 22 nt, Homo sapiens
ugagucuguucucacauugcua

SEQ ID NO: 304867 - RNA, 20 nt, Homo sapiens
ugauauuucuggaaguggag

SEQ ID NO: 304868 - RNA, 20 nt, Homo sapiens
ugaugcaaaucuuuaaaagu

SEQ ID NO: 304869 - RNA, 22 nt, Homo sapiens
ugcacacucuguaugagaaucu

SEQ ID NO: 304870 - RNA, 22 nt, Homo sapiens
ugcagcauguaggcacguuauu

SEQ ID NO: 304871 - RNA, 22 nt, Homo sapiens
ugcagcucaaauuccuaacaag

SEQ ID NO: 304872 - RNA, 22 nt, Homo sapiens
ugcauacacaagcauacaugua

SEQ ID NO: 304873 - RNA, 22 nt, Homo sapiens
ugcauuaucagauguuugcuuu

SEQ ID NO: 304874 - RNA, 22 nt, Homo sapiens
aaggaauacuggugguugcuau

SEQ ID NO: 304875 - RNA, 22 nt, Homo sapiens
aaggcagucacuaaauagugag

SEQ ID NO: 304876 - RNA, 22 nt, Homo sapiens
aaggugguuuucucuuggaguc

SEQ ID NO: 304877 - RNA, 22 nt, Homo sapiens
aaguagcagaggcaagacuuga

SEQ ID NO: 304878 - RNA, 22 nt, Homo sapiens
aagucaaggagagaagcuucag

SEQ ID NO: 304879 - RNA, 22 nt, Homo sapiens
aagugguguuuguauuuaugca

SEQ ID NO: 304880 - RNA, 22 nt, Homo sapiens
aauacuggcacugaagaccaug

SEQ ID NO: 304881 - RNA, 22 nt, Homo sapiens
aaucacuaugccaugaaguaca

SEQ ID NO: 304882 - RNA, 22 nt, Homo sapiens
aaugacagccagauucuucucu

SEQ ID NO: 304883 - RNA, 22 nt, Homo sapiens
aauugcuuuuauuuagggccag

SEQ ID NO: 304884 - RNA, 22 nt, Homo sapiens
acacuggguaacauaucuguua

SEQ ID NO: 304885 - RNA, 22 nt, Homo sapiens
acaggugaaguauuacacuaag

SEQ ID NO: 304886 - RNA, 22 nt, Homo sapiens
acauggcuuaugaauuuggaga

SEQ ID NO: 304887 - RNA, 22 nt, Homo sapiens
acccaguguucaacauucacau

SEQ ID NO: 304888 - RNA, 22 nt, Homo sapiens
acccugacacgauucuucacuu

SEQ ID NO: 304889 - RNA, 22 nt, Homo sapiens
acccuugaguguguuucaggca

SEQ ID NO: 304890 - RNA, 22 nt, Homo sapiens
acugcacuccagccuuggcaac

SEQ ID NO: 304891 - RNA, 22 nt, Homo sapiens
acugcacuguccuagaguccuc

SEQ ID NO: 304892 - RNA, 22 nt, Homo sapiens
agagagguggguggagccccca

SEQ ID NO: 304893 - RNA, 22 nt, Homo sapiens
agaugguguuggcugaguguau

SEQ ID NO: 304894 - RNA, 17 nt, Homo sapiens
agcaccacacucucuug

SEQ ID NO: 304895 - RNA, 23 nt, Homo sapiens
agcaccaccccaggucacaagug

SEQ ID NO: 304896 - RNA, 22 nt, Homo sapiens
agcaccaccguugcucuauccc

SEQ ID NO: 304897 - RNA, 22 nt, Homo sapiens
agcaccauuuauugaaaagaca

SEQ ID NO: 304898 - RNA, 23 nt, Homo sapiens
agcaccuuuccuccacuaucugc

SEQ ID NO: 304899 - RNA, 22 nt, Homo sapiens
agcagcaugcaaauggacuaau

SEQ ID NO: 304900 - RNA, 22 nt, Homo sapiens
agcagguguggcuuauccugaa

SEQ ID NO: 304901 - RNA, 16 nt, Homo sapiens
agcagguguuagguga

SEQ ID NO: 304902 - RNA, 23 nt, Homo sapiens
agccugguuucccugcuucuccc

SEQ ID NO: 304903 - RNA, 21 nt, Homo sapiens
agcuaaauuggaaauuucugu

SEQ ID NO: 304904 - RNA, 22 nt, Homo sapiens
agcuucauucugaauagguuga

SEQ ID NO: 304905 - RNA, 22 nt, Homo sapiens
agcuucauuguuaugaauguca

SEQ ID NO: 304906 - RNA, 21 nt, Homo sapiens
aggagcauuguugugguggag

SEQ ID NO: 304907 - RNA, 22 nt, Homo sapiens
aggaguguguauuaaugaaauu

SEQ ID NO: 304908 - RNA, 22 nt, Homo sapiens
aggcaguuucagugagagguga

SEQ ID NO: 304909 - RNA, 22 nt, Homo sapiens
aguaacaggauccaaagaaugu

SEQ ID NO: 304910 - RNA, 22 nt, Homo sapiens
agucacaugcauuuucuucaau

SEQ ID NO: 304911 - RNA, 22 nt, Homo sapiens
agugaacaaagaagugcagaua

SEQ ID NO: 304912 - RNA, 22 nt, Homo sapiens
agugcaguggcacaaucuuggc

SEQ ID NO: 304913 - RNA, 22 nt, Homo sapiens
agugcauuuguucugugucagg

SEQ ID NO: 304914 - RNA, 22 nt, Homo sapiens
aguggaaucuguuauacuaacu

SEQ ID NO: 304915 - RNA, 22 nt, Homo sapiens
aguggcaaugugauguccugaa

SEQ ID NO: 304916 - RNA, 22 nt, Homo sapiens
auaacucuguuuuuuucaugca

SEQ ID NO: 304917 - RNA, 22 nt, Homo sapiens
auaauaccugccacauuugaau

SEQ ID NO: 304918 - RNA, 22 nt, Homo sapiens
auacaguaaugucuuaggcugu

SEQ ID NO: 304919 - RNA, 22 nt, Homo sapiens
auagaagcugccaacguuucag

SEQ ID NO: 304920 - RNA, 22 nt, Homo sapiens
auagaucauugucauuuuagau

SEQ ID NO: 304921 - RNA, 20 nt, Homo sapiens
auagcaccagacagcccuag

SEQ ID NO: 304922 - RNA, 22 nt, Homo sapiens
auagcagcauauguaauguuga

SEQ ID NO: 304923 - RNA, 22 nt, Homo sapiens
auagcagcuugucagggcagac

SEQ ID NO: 304924 - RNA, 22 nt, Homo sapiens
auagucaguagucucauaauga

SEQ ID NO: 304925 - RNA, 19 nt, Homo sapiens
auauaacauccaggagcag

SEQ ID NO: 304926 - RNA, 22 nt, Homo sapiens
auauuacuggcuauaucgcaag

SEQ ID NO: 304927 - RNA, 22 nt, Homo sapiens
aucaucacaguuguguguaaug

SEQ ID NO: 304928 - RNA, 22 nt, Homo sapiens
aucccugagaacuuuuaauguu

SEQ ID NO: 304929 - RNA, 22 nt, Homo sapiens
auccugagacuuugcugaaguu

SEQ ID NO: 304930 - RNA, 22 nt, Homo sapiens
auccugagacuuuucugaaguu

SEQ ID NO: 304931 - RNA, 22 nt, Homo sapiens
aucuaaaucucauaugggcaca

SEQ ID NO: 304932 - RNA, 22 nt, Homo sapiens
aucucaguuaaugacccuaugc

SEQ ID NO: 304933 - RNA, 22 nt, Homo sapiens
aucucaguucaggcuggccaca

SEQ ID NO: 304934 - RNA, 22 nt, Homo sapiens
aucugugaaugaaguuauuuug

SEQ ID NO: 304935 - RNA, 22 nt, Homo sapiens
aucuugcauuugcuaaaaugca

SEQ ID NO: 304936 - RNA, 22 nt, Homo sapiens
augaaaguguguggaaacuuga

SEQ ID NO: 304937 - RNA, 22 nt, Homo sapiens
augaauagaguuaauugaguac

SEQ ID NO: 304938 - RNA, 22 nt, Homo sapiens
augaaugcacugcggguggaug

SEQ ID NO: 304939 - RNA, 22 nt, Homo sapiens
augaaugcaugaagguugggug

SEQ ID NO: 304940 - RNA, 22 nt, Homo sapiens
augaugcaguacuuugggaaca

SEQ ID NO: 304941 - RNA, 22 nt, Homo sapiens
augcacauggcuaacuuuuuuc

SEQ ID NO: 304942 - RNA, 22 nt, Homo sapiens
augccaagagacaaagggaauc

SEQ ID NO: 304943 - RNA, 22 nt, Homo sapiens
auggaaugccauuuauaaugga

SEQ ID NO: 304944 - RNA, 22 nt, Homo sapiens
auggagaugaauaucaucuguu

SEQ ID NO: 304945 - RNA, 22 nt, Homo sapiens
auggaucauauucuugaggagg

SEQ ID NO: 304946 - RNA, 22 nt, Homo sapiens
auggcucaguguguaucuauca

SEQ ID NO: 304947 - RNA, 22 nt, Homo sapiens
augugcaugcuguucugccaga

SEQ ID NO: 304948 - RNA, 22 nt, Homo sapiens
augugugcuugauguaaaaagu

SEQ ID NO: 304949 - RNA, 22 nt, Homo sapiens
auugcaaugggaaacuaugaaa

SEQ ID NO: 304950 - RNA, 22 nt, Homo sapiens
auugcacuccagucugggcaac

SEQ ID NO: 304951 - RNA, 22 nt, Homo sapiens
auugcucuuagaaauauuucuu

SEQ ID NO: 304952 - RNA, 22 nt, Homo sapiens
auugcuuuuacugggagcuuug

SEQ ID NO: 304953 - RNA, 22 nt, Homo sapiens
auugugauggucaaaggaaaua

SEQ ID NO: 304954 - RNA, 22 nt, Homo sapiens
auuguuccccggucauuuuugu

SEQ ID NO: 304955 - RNA, 22 nt, Homo sapiens
auuuggguuuuacaucaggcua

SEQ ID NO: 304956 - RNA, 22 nt, Homo sapiens
auuuuuggauauagggaaggau

SEQ ID NO: 304957 - RNA, 22 nt, Homo sapiens
caaaccuguaggggccaagagg

SEQ ID NO: 304958 - RNA, 22 nt, Homo sapiens
caaaggcuucugaaacugcaga

SEQ ID NO: 304959 - RNA, 22 nt, Homo sapiens
caaagugcugaaagaggccagg

SEQ ID NO: 304960 - RNA, 22 nt, Homo sapiens
caaagugcugggacuggccggg

SEQ ID NO: 304961 - RNA, 22 nt, Homo sapiens
caaaugaucugcuggccucagc

SEQ ID NO: 304962 - RNA, 22 nt, Homo sapiens
caagugaauaguugcucucaga

SEQ ID NO: 304963 - RNA, 22 nt, Homo sapiens
cacaaugucuaagauguuucua

SEQ ID NO: 304964 - RNA, 22 nt, Homo sapiens
cacagcacaggcaugaguguca

SEQ ID NO: 304965 - RNA, 22 nt, Homo sapiens
cacuagagaauagguaguucug

SEQ ID NO: 304966 - RNA, 22 nt, Homo sapiens
aagcacaauuucaccuucuugu

SEQ ID NO: 304967 - RNA, 22 nt, Homo sapiens
aagcagacauguucauuuugaa

SEQ ID NO: 304968 - RNA, 22 nt, Homo sapiens
aagccacuguaccugucucuua

SEQ ID NO: 304969 - RNA, 22 nt, Homo sapiens
aagcuggcauucaugagauuac

SEQ ID NO: 304970 - RNA, 22 nt, Homo sapiens
aagcuggcauucauucguucuu

SEQ ID NO: 304971 - RNA, 22 nt, Homo sapiens
aaggagcagagagcccuguuuc

SEQ ID NO: 304972 - RNA, 22 nt, Homo sapiens
aaggagcaguggacggguccua

SEQ ID NO: 304973 - RNA, 22 nt, Homo sapiens
aagguggaguugacaauuuuca

SEQ ID NO: 304974 - RNA, 22 nt, Homo sapiens
aagguggugucagagagcuuau

SEQ ID NO: 304975 - RNA, 22 nt, Homo sapiens
aagugaauucauuguguuauau

SEQ ID NO: 304976 - RNA, 22 nt, Homo sapiens
aagugcucuugugggaagagag

SEQ ID NO: 304977 - RNA, 22 nt, Homo sapiens
aauaauggcaccaaagcacaag

SEQ ID NO: 304978 - RNA, 22 nt, Homo sapiens
aauacugugauaucgagcgauu

SEQ ID NO: 304979 - RNA, 22 nt, Homo sapiens
aauagcacugcuaugguuugaa

SEQ ID NO: 304980 - RNA, 22 nt, Homo sapiens
aauagcacuguagauggaggaa

SEQ ID NO: 304981 - RNA, 22 nt, Homo sapiens
aaugguuuuaucagcguccaaa

SEQ ID NO: 304982 - RNA, 22 nt, Homo sapiens
aauugcuucuguauuuuggaca

SEQ ID NO: 304983 - RNA, 23 nt, Homo sapiens
aauugcuuuugaggacuuaguug

SEQ ID NO: 304984 - RNA, 22 nt, Homo sapiens
aauuggcagugcucuugccaca

SEQ ID NO: 304985 - RNA, 21 nt, Homo sapiens
acaaagcuggagggagacugc

SEQ ID NO: 304986 - RNA, 22 nt, Homo sapiens
acaguguuacuugauaguguau

SEQ ID NO: 304987 - RNA, 22 nt, Homo sapiens
acccgcccagguguggccggga

SEQ ID NO: 304988 - RNA, 22 nt, Homo sapiens
acccuggaggucuacagugcag

SEQ ID NO: 304989 - RNA, 22 nt, Homo sapiens
acugacaugaucaggcauguuc

SEQ ID NO: 304990 - RNA, 22 nt, Homo sapiens
acugcacuccacccuuggcagc

SEQ ID NO: 304991 - RNA, 22 nt, Homo sapiens
acugcacuccagccuggaccac

SEQ ID NO: 304992 - RNA, 22 nt, Homo sapiens
acugcacucuagccuuggcaac

SEQ ID NO: 304993 - RNA, 20 nt, Homo sapiens
acugggcuaccgaaguaagg

SEQ ID NO: 304994 - RNA, 22 nt, Homo sapiens
agaauaauguccccccaaggga

SEQ ID NO: 304995 - RNA, 22 nt, Homo sapiens
agaaugugaacaucuugaaagu

SEQ ID NO: 304996 - RNA, 22 nt, Homo sapiens
agagauaaagauuuuaauuuug

SEQ ID NO: 304997 - RNA, 22 nt, Homo sapiens
agagaucaauaugaaggaaaug

SEQ ID NO: 304998 - RNA, 22 nt, Homo sapiens
agauacaucuaugugucugugu

SEQ ID NO: 304999 - RNA, 23 nt, Homo sapiens
agauggcauuucaguucuuuagg

SEQ ID NO: 305000 - RNA, 22 nt, Homo sapiens
agcagcaauuuuguaugguuua

SEQ ID NO: 305001 - RNA, 22 nt, Homo sapiens
agcagcauuaguggaaucuugu

SEQ ID NO: 305002 - RNA, 17 nt, Homo sapiens
agcauguguuugagauu

SEQ ID NO: 305003 - RNA, 22 nt, Homo sapiens
agcccuuagauggcuccuucca

SEQ ID NO: 305004 - RNA, 22 nt, Homo sapiens
agccgguguccacgaagaagag

SEQ ID NO: 305005 - RNA, 22 nt, Homo sapiens
agcucuuguuaguauuagcagu

SEQ ID NO: 305006 - RNA, 20 nt, Homo sapiens
agcuguuguuaugagguuua

SEQ ID NO: 305007 - RNA, 22 nt, Homo sapiens
aggaagguaaacuaacuugccu

SEQ ID NO: 305008 - RNA, 22 nt, Homo sapiens
aggaccccucaucagcaccagu

SEQ ID NO: 305009 - RNA, 21 nt, Homo sapiens
agguaguuuuccuuuuggagu

SEQ ID NO: 305010 - RNA, 22 nt, Homo sapiens
aggucccauguccucccugacc

SEQ ID NO: 305011 - RNA, 18 nt, Homo sapiens
agguuauuucccaagacu

SEQ ID NO: 305012 - RNA, 22 nt, Homo sapiens
agguucccuuuuggccugggau

SEQ ID NO: 305013 - RNA, 22 nt, Homo sapiens
aguggguguuccauuggauaaa

SEQ ID NO: 305014 - RNA, 22 nt, Homo sapiens
auaauaguguuuagauuuggga

SEQ ID NO: 305015 - RNA, 22 nt, Homo sapiens
auacauguucaagggcauauau

SEQ ID NO: 305016 - RNA, 22 nt, Homo sapiens
gugguuuuaauauucagucuag

SEQ ID NO: 305017 - RNA, 22 nt, Homo sapiens
gugguuuuaucccagaaauuaa

SEQ ID NO: 305018 - RNA, 22 nt, Homo sapiens
gugguuuuuaaaguaccugugg

SEQ ID NO: 305019 - RNA, 22 nt, Homo sapiens
gugguuuuuagauuucuacagu

SEQ ID NO: 305020 - RNA, 22 nt, Homo sapiens
gugucuccuguggagcuaugua

SEQ ID NO: 305021 - RNA, 22 nt, Homo sapiens
gugugacugcucuauuagggcg

SEQ ID NO: 305022 - RNA, 22 nt, Homo sapiens
guuauguuaaauuguuguaugc

SEQ ID NO: 305023 - RNA, 22 nt, Homo sapiens
guuggucaaugugauuaggcca

SEQ ID NO: 305024 - RNA, 17 nt, Homo sapiens
guuuggguacuggguaa

SEQ ID NO: 305025 - RNA, 22 nt, Homo sapiens
guuuguaacucuagugacuaga

SEQ ID NO: 305026 - RNA, 22 nt, Homo sapiens
uaacccuuaguaucuguggguu

SEQ ID NO: 305027 - RNA, 22 nt, Homo sapiens
uaaugcaucaugguuggcaaac

SEQ ID NO: 305028 - RNA, 22 nt, Homo sapiens
uacagaauucugucccuugagu

SEQ ID NO: 305029 - RNA, 22 nt, Homo sapiens
uacugcacuggaggccucagau

SEQ ID NO: 305030 - RNA, 22 nt, Homo sapiens
uacuuagagacaugcagcacug

SEQ ID NO: 305031 - RNA, 22 nt, Homo sapiens
uagcaaaucaauggaauugaag

SEQ ID NO: 305032 - RNA, 22 nt, Homo sapiens
uagcacaucuucuuggccugca

SEQ ID NO: 305033 - RNA, 22 nt, Homo sapiens
uagcacaugucagguaauuugc

SEQ ID NO: 305034 - RNA, 22 nt, Homo sapiens
uagcaccaggguugacugaccu

SEQ ID NO: 305035 - RNA, 22 nt, Homo sapiens
uagcagacuauuuugugauaau

SEQ ID NO: 305036 - RNA, 22 nt, Homo sapiens
uagcauccuucucuaaacagga

SEQ ID NO: 305037 - RNA, 22 nt, Homo sapiens
uaggacacagauggagaaaagc

SEQ ID NO: 305038 - RNA, 20 nt, Homo sapiens
uaggagcaaugagaguagaa

SEQ ID NO: 305039 - RNA, 22 nt, Homo sapiens
uagggcaaggaacaguuaaaaa

SEQ ID NO: 305040 - RNA, 22 nt, Homo sapiens
uauacugucuuuguaugccuag

SEQ ID NO: 305041 - RNA, 22 nt, Homo sapiens
uaucacacuggaagaaguuaag

SEQ ID NO: 305042 - RNA, 22 nt, Homo sapiens
uaucaccauguccguuuuaaaa

SEQ ID NO: 305043 - RNA, 22 nt, Homo sapiens
uaucuacauguagguauguaug

SEQ ID NO: 305044 - RNA, 22 nt, Homo sapiens
uaugaucauuauguuauugcag

SEQ ID NO: 305045 - RNA, 22 nt, Homo sapiens
uaugccuuuugguucaagcaac

SEQ ID NO: 305046 - RNA, 22 nt, Homo sapiens
uauggauuugccuauucuguau

SEQ ID NO: 305047 - RNA, 22 nt, Homo sapiens
uaugguuuuggaauccugcaga

SEQ ID NO: 305048 - RNA, 22 nt, Homo sapiens
uauucacuguaucauugauggg

SEQ ID NO: 305049 - RNA, 22 nt, Homo sapiens
uauugaauuugagcugucucuu

SEQ ID NO: 305050 - RNA, 22 nt, Homo sapiens
uauugcuuuacucucuuauccu

SEQ ID NO: 305051 - RNA, 22 nt, Homo sapiens
uauugcuuuugauucaaggcag

SEQ ID NO: 305052 - RNA, 22 nt, Homo sapiens
ucaaauuccaagucuagguagg

SEQ ID NO: 305053 - RNA, 20 nt, Homo sapiens
ucaaauucuuggccuccagc

SEQ ID NO: 305054 - RNA, 22 nt, Homo sapiens
ucaacguauuuauauagcagag

SEQ ID NO: 305055 - RNA, 22 nt, Homo sapiens
ucacacugcaucuguuggaauu

SEQ ID NO: 305056 - RNA, 22 nt, Homo sapiens
ucacacuguuuugauuauuaua

SEQ ID NO: 305057 - RNA, 22 nt, Homo sapiens
ucacagcuaaaaugaaaguagu

SEQ ID NO: 305058 - RNA, 22 nt, Homo sapiens
ucacugaaaccacugccuccug

SEQ ID NO: 305059 - RNA, 22 nt, Homo sapiens
ucagaacugaacaaaccagucu

SEQ ID NO: 305060 - RNA, 19 nt, Homo sapiens
ucagaucagcccaagggau

SEQ ID NO: 305061 - RNA, 22 nt, Homo sapiens
ucagaucauauucuucgcugcu

SEQ ID NO: 305062 - RNA, 22 nt, Homo sapiens
ucagcaccauguaacaauugau

SEQ ID NO: 305063 - RNA, 22 nt, Homo sapiens
ucauacuguugugaaacaaaac

SEQ ID NO: 305064 - RNA, 20 nt, Homo sapiens
ucauagggugguggcagugg

SEQ ID NO: 305065 - RNA, 22 nt, Homo sapiens
ucauugcauuccagcccaagca

SEQ ID NO: 305066 - RNA, 22 nt, Homo sapiens
uccaguguuccucagucacccc

SEQ ID NO: 305067 - RNA, 22 nt, Homo sapiens
uccauagacauuuuaagguagu

SEQ ID NO: 305068 - RNA, 17 nt, Homo sapiens
ucccauguuucuucuac

SEQ ID NO: 305069 - RNA, 19 nt, Homo sapiens
uccccaguuuuccguucag

SEQ ID NO: 305070 - RNA, 22 nt, Homo sapiens
ucccugacagggucugagcuuu

SEQ ID NO: 305071 - RNA, 22 nt, Homo sapiens
ucccugacagucacagagcuac

SEQ ID NO: 305072 - RNA, 22 nt, Homo sapiens
ucccugagugauugaaaauaaa

SEQ ID NO: 305073 - RNA, 22 nt, Homo sapiens
ucccuggagcaagagaagaagg

SEQ ID NO: 305074 - RNA, 22 nt, Homo sapiens
ucucauggagucaggagcagaa

SEQ ID NO: 305075 - RNA, 22 nt, Homo sapiens
ucucugagaccacuccaaacuc

SEQ ID NO: 305076 - RNA, 23 nt, Homo sapiens
ucuggcuuugggaugcucaaggg

SEQ ID NO: 305077 - RNA, 22 nt, Homo sapiens
ucugggguuuccacuuuuacuu

SEQ ID NO: 305078 - RNA, 22 nt, Homo sapiens
ucuggguuuuuacaauguuuac

SEQ ID NO: 305079 - RNA, 22 nt, Homo sapiens
ucuuggguuuguccuucuccua

SEQ ID NO: 305080 - RNA, 19 nt, Homo sapiens
ucuuugcuuuucuaagagg

SEQ ID NO: 305081 - RNA, 22 nt, Homo sapiens
ucuuugguaauggaugucugau

SEQ ID NO: 305082 - RNA, 22 nt, Homo sapiens
ucuuuggucuacuuucauaugu

SEQ ID NO: 305083 - RNA, 22 nt, Homo sapiens
ucuuuugguuucuagaggccgc

SEQ ID NO: 305084 - RNA, 22 nt, Homo sapiens
ugaaacacacauugcccuuuau

SEQ ID NO: 305085 - RNA, 22 nt, Homo sapiens
ugaaacacaccuccucuccauc

SEQ ID NO: 305086 - RNA, 18 nt, Homo sapiens
ugaaacacauuuuuuccu

SEQ ID NO: 305087 - RNA, 22 nt, Homo sapiens
ugaaaugguuaugugaggagau

SEQ ID NO: 305088 - RNA, 16 nt, Homo sapiens
ugaacagagaggauuc

SEQ ID NO: 305089 - RNA, 22 nt, Homo sapiens
ugaagacucaauuauuaugaac

SEQ ID NO: 305090 - RNA, 22 nt, Homo sapiens
ugacaagggaaaugcaaaaugu

SEQ ID NO: 305091 - RNA, 22 nt, Homo sapiens
ugacagguugauaggugcagca

SEQ ID NO: 305092 - RNA, 21 nt, Homo sapiens
ugacuagauuccagauuggcc

SEQ ID NO: 305093 - RNA, 22 nt, Homo sapiens
ugacuauugauuuagacgugcu

SEQ ID NO: 305094 - RNA, 22 nt, Homo sapiens
ugagaggugauaaagcaagggu

SEQ ID NO: 305095 - RNA, 22 nt, Homo sapiens
ugagauaguuguagauguacau

SEQ ID NO: 305096 - RNA, 22 nt, Homo sapiens
ugagaugaagugauguaaaaca

SEQ ID NO: 305097 - RNA, 21 nt, Homo sapiens
ugagaugauccugcaugcaug

SEQ ID NO: 305098 - RNA, 22 nt, Homo sapiens
ugagauuaucguaauguaucuc

SEQ ID NO: 305099 - RNA, 22 nt, Homo sapiens
ugagcagaguuguuucuccuga

SEQ ID NO: 305100 - RNA, 22 nt, Homo sapiens
ugagcaucucuaaaaggagcaa

SEQ ID NO: 305101 - RNA, 22 nt, Homo sapiens
ugagggaugccugguuuguuuu

SEQ ID NO: 305102 - RNA, 22 nt, Homo sapiens
cauugcuuuuggugguuuagac

SEQ ID NO: 305103 - RNA, 22 nt, Homo sapiens
cauugguuccaguuuguccuua

SEQ ID NO: 305104 - RNA, 22 nt, Homo sapiens
cauuuuacuuuccagacgugga

SEQ ID NO: 305105 - RNA, 22 nt, Homo sapiens
ccaaguguucucauuguucaau

SEQ ID NO: 305106 - RNA, 23 nt, Homo sapiens
ccacaaugguugaacuagauuac

SEQ ID NO: 305107 - RNA, 22 nt, Homo sapiens
ccuggaagaaaggugcuaaaua

SEQ ID NO: 305108 - RNA, 22 nt, Homo sapiens
ccuggcaagagacugaagauag

SEQ ID NO: 305109 - RNA, 22 nt, Homo sapiens
cuaaucugugcauagaagaggc

SEQ ID NO: 305110 - RNA, 22 nt, Homo sapiens
cuagguucucaaaccagcguca

SEQ ID NO: 305111 - RNA, 21 nt, Homo sapiens
cucaaaguacugauauuacag

SEQ ID NO: 305112 - RNA, 22 nt, Homo sapiens
cucaccuugugauccacccacc

SEQ ID NO: 305113 - RNA, 22 nt, Homo sapiens
cucaccuugugauccacccgcc

SEQ ID NO: 305114 - RNA, 22 nt, Homo sapiens
cucagagcacaguuuaugacag

SEQ ID NO: 305115 - RNA, 22 nt, Homo sapiens
cucagugguugauuuauuuauc

SEQ ID NO: 305116 - RNA, 22 nt, Homo sapiens
cucccauugcaaacaacagaag

SEQ ID NO: 305117 - RNA, 22 nt, Homo sapiens
cucccugagccagggcuuugac

SEQ ID NO: 305118 - RNA, 22 nt, Homo sapiens
cucucaguugucuaauuaguuu

SEQ ID NO: 305119 - RNA, 22 nt, Homo sapiens
cugaagugcuugccacauaaaa

SEQ ID NO: 305120 - RNA, 22 nt, Homo sapiens
cugacauuguugaucacagcca

SEQ ID NO: 305121 - RNA, 22 nt, Homo sapiens
cugagaauguaaaugaagcuuu

SEQ ID NO: 305122 - RNA, 22 nt, Homo sapiens
cugagauggagucucgcauugu

SEQ ID NO: 305123 - RNA, 18 nt, Homo sapiens
cugagucauuccuggguc

SEQ ID NO: 305124 - RNA, 22 nt, Homo sapiens
cuggaaacaucuuaggaaugca

SEQ ID NO: 305125 - RNA, 22 nt, Homo sapiens
cuggaaucuauggauaacaucg

SEQ ID NO: 305126 - RNA, 22 nt, Homo sapiens
cuggagcaaaggugacucuugu

SEQ ID NO: 305127 - RNA, 20 nt, Homo sapiens
cuggaucaucaguaaaguua

SEQ ID NO: 305128 - RNA, 22 nt, Homo sapiens
cuggcaaauaguagagccagga

SEQ ID NO: 305129 - RNA, 22 nt, Homo sapiens
cuggcacagugucagaaacaca

SEQ ID NO: 305130 - RNA, 22 nt, Homo sapiens
cugggaugauguaaauaggcua

SEQ ID NO: 305131 - RNA, 22 nt, Homo sapiens
cugggauggaggagaauuagag

SEQ ID NO: 305132 - RNA, 22 nt, Homo sapiens
cugucacuggggcacauguccc

SEQ ID NO: 305133 - RNA, 22 nt, Homo sapiens
cugucuagagggcacaugaugc

SEQ ID NO: 305134 - RNA, 22 nt, Homo sapiens
cugugacugcagggcauauuug

SEQ ID NO: 305135 - RNA, 22 nt, Homo sapiens
cuugcacucagaagauucaguu

SEQ ID NO: 305136 - RNA, 22 nt, Homo sapiens
cuuggcauuguguugauagaag

SEQ ID NO: 305137 - RNA, 21 nt, Homo sapiens
cuuuaugcuguguuagaaaag

SEQ ID NO: 305138 - RNA, 21 nt, Homo sapiens
cuuugguuucugacuugcaua

SEQ ID NO: 305139 - RNA, 22 nt, Homo sapiens
cuuuuggcuuaagauugucuug

SEQ ID NO: 305140 - RNA, 22 nt, Homo sapiens
cuuuuggugguucugaugcagg

SEQ ID NO: 305141 - RNA, 22 nt, Homo sapiens
cuuuuugguagagcaggugugc

SEQ ID NO: 305142 - RNA, 22 nt, Homo sapiens
gaaagugcugcuugacugggau

SEQ ID NO: 305143 - RNA, 18 nt, Homo sapiens
gaagaaguaggcauggca

SEQ ID NO: 305144 - RNA, 22 nt, Homo sapiens
gaagacauuuacaugggagacc

SEQ ID NO: 305145 - RNA, 22 nt, Homo sapiens
gaaucauuguuucuaaguuugu

SEQ ID NO: 305146 - RNA, 22 nt, Homo sapiens
gacauagagccuugacuucauu

SEQ ID NO: 305147 - RNA, 20 nt, Homo sapiens
gacauaggcugguaucuggc

SEQ ID NO: 305148 - RNA, 16 nt, Homo sapiens
gacuaauacaaaggaa

SEQ ID NO: 305149 - RNA, 22 nt, Homo sapiens
gacuagagcugaucauguuacu

SEQ ID NO: 305150 - RNA, 22 nt, Homo sapiens
gacuagaggcaggcaccgcugc

SEQ ID NO: 305151 - RNA, 22 nt, Homo sapiens
gacuuagagauguuguauuugg

SEQ ID NO: 305152 - RNA, 21 nt, Homo sapiens
gagaaucaucauggcugcaua

SEQ ID NO: 305153 - RNA, 22 nt, Homo sapiens
gagagaguacuugauauaauuu

SEQ ID NO: 305154 - RNA, 22 nt, Homo sapiens
gagagugugucagaggcugcga

SEQ ID NO: 305155 - RNA, 22 nt, Homo sapiens
gaggcaguguguccguucucgg

SEQ ID NO: 305156 - RNA, 22 nt, Homo sapiens
gagguaaguaagaauggcaagc

SEQ ID NO: 305157 - RNA, 22 nt, Homo sapiens
gagguagaauguuuuucagcug

SEQ ID NO: 305158 - RNA, 22 nt, Homo sapiens
gagguaggaggauugcuuaagg

SEQ ID NO: 305159 - RNA, 22 nt, Homo sapiens
gaggugguagguucacagcagc

SEQ ID NO: 305160 - RNA, 22 nt, Homo sapiens
gagugcaauggcaagaucuugg

SEQ ID NO: 305161 - RNA, 22 nt, Homo sapiens
gcagcacaugacuguauguaua

SEQ ID NO: 305162 - RNA, 22 nt, Homo sapiens
gcagugugaucacagcuuacug

SEQ ID NO: 305163 - RNA, 22 nt, Homo sapiens
gcccugauacauucuucugccu

SEQ ID NO: 305164 - RNA, 22 nt, Homo sapiens
gcuaaaucuguaaaaugaggag

SEQ ID NO: 305165 - RNA, 23 nt, Homo sapiens
ggaaacauccagucuuucaccau

SEQ ID NO: 305166 - RNA, 22 nt, Homo sapiens
ggaaagaucagcuaaauguaag

SEQ ID NO: 305167 - RNA, 23 nt, Homo sapiens
ggaaauguuuaagggguugggag

SEQ ID NO: 305168 - RNA, 22 nt, Homo sapiens
ggagaucuuuaggaguuggacu

SEQ ID NO: 305169 - RNA, 22 nt, Homo sapiens
ggagcucaucuagcauagaggu

SEQ ID NO: 305170 - RNA, 22 nt, Homo sapiens
ggaugcauuuuugguugucaca

SEQ ID NO: 305171 - RNA, 22 nt, Homo sapiens
ggcaaggaggggcacuuucacu

SEQ ID NO: 305172 - RNA, 21 nt, Homo sapiens
ggcaagugugagguuuggggu

SEQ ID NO: 305173 - RNA, 22 nt, Homo sapiens
ggcaugaaguagcccacaggca

SEQ ID NO: 305174 - RNA, 22 nt, Homo sapiens
ggcucagugggguccugguucu

SEQ ID NO: 305175 - RNA, 22 nt, Homo sapiens
gggaagaaggagugguuuacuc

SEQ ID NO: 305176 - RNA, 22 nt, Homo sapiens
gggauguuuuauacugagccug

SEQ ID NO: 305177 - RNA, 20 nt, Homo sapiens
gggcaaguaugugggaaguc

SEQ ID NO: 305178 - RNA, 22 nt, Homo sapiens
ggugagauguucagacgaacug

SEQ ID NO: 305179 - RNA, 22 nt, Homo sapiens
ggugagcacagaaugcccugag

SEQ ID NO: 305180 - RNA, 22 nt, Homo sapiens
guaauacuuuugggauauuaga

SEQ ID NO: 305181 - RNA, 22 nt, Homo sapiens
guagaagcacaggugaguuggu

SEQ ID NO: 305182 - RNA, 22 nt, Homo sapiens
guagcaccagugcucuucucaa

SEQ ID NO: 305183 - RNA, 22 nt, Homo sapiens
guagcaugcaauauuauagaga

SEQ ID NO: 305184 - RNA, 22 nt, Homo sapiens
gucagggagggauagaugauua

SEQ ID NO: 305185 - RNA, 22 nt, Homo sapiens
gucagucugucccugccuggcg

SEQ ID NO: 305186 - RNA, 22 nt, Homo sapiens
gucauaugcucggaaaauguua

SEQ ID NO: 305187 - RNA, 22 nt, Homo sapiens
gucauggaacaacuuaaaguca

SEQ ID NO: 305188 - RNA, 22 nt, Homo sapiens
gucuuuggaaaaaaugucuguu

SEQ ID NO: 305189 - RNA, 22 nt, Homo sapiens
gugaaucuguuuucuucuguuc

SEQ ID NO: 305190 - RNA, 19 nt, Homo sapiens
aacuggugugagaugguau

SEQ ID NO: 305191 - RNA, 22 nt, Homo sapiens
aagauauguuaguuauaaacuc

SEQ ID NO: 305192 - RNA, 20 nt, Homo sapiens
aagcagacauuuggaugaaa

SEQ ID NO: 305193 - RNA, 20 nt, Homo sapiens
aagcauggguuuuaggguca

SEQ ID NO: 305194 - RNA, 22 nt, Homo sapiens
aagcuggauuuaguguggagca

SEQ ID NO: 305195 - RNA, 22 nt, Homo sapiens
aaggcaagauacugguugcuga

SEQ ID NO: 305196 - RNA, 22 nt, Homo sapiens
aauaucacaguggguguacacc

SEQ ID NO: 305197 - RNA, 22 nt, Homo sapiens
aauaugguuuuaugaagcaauu

SEQ ID NO: 305198 - RNA, 22 nt, Homo sapiens
aaucacaguguucuugugaggg

SEQ ID NO: 305199 - RNA, 22 nt, Homo sapiens
aaucacuuugcuacaaggcagu

SEQ ID NO: 305200 - RNA, 22 nt, Homo sapiens
aauggcaaauguuuucuguuga

SEQ ID NO: 305201 - RNA, 22 nt, Homo sapiens
aaugugcuuucuuucacacagu

SEQ ID NO: 305202 - RNA, 22 nt, Homo sapiens
acagaucagagauauuuagguu

SEQ ID NO: 305203 - RNA, 22 nt, Homo sapiens
acaugcauccaugugaagagac

SEQ ID NO: 305204 - RNA, 22 nt, Homo sapiens
acauggcacugcgggcuucuug

SEQ ID NO: 305205 - RNA, 22 nt, Homo sapiens
acugcacuccagccuggacgaa

SEQ ID NO: 305206 - RNA, 22 nt, Homo sapiens
acugcacuccagccuuggagac

SEQ ID NO: 305207 - RNA, 18 nt, Homo sapiens
acugcacuccauccuagg

SEQ ID NO: 305208 - RNA, 22 nt, Homo sapiens
acugcacuucagccuugggaaa

SEQ ID NO: 305209 - RNA, 22 nt, Homo sapiens
acuuugcuuagagggcauuaaa

SEQ ID NO: 305210 - RNA, 22 nt, Homo sapiens
acuuuuugaugaggucguuugu

SEQ ID NO: 305211 - RNA, 22 nt, Homo sapiens
agaaacacagguggaauugcuu

SEQ ID NO: 305212 - RNA, 22 nt, Homo sapiens
agaaacauucucuugccuccuu

SEQ ID NO: 305213 - RNA, 22 nt, Homo sapiens
agagacauugcuccaacucacc

SEQ ID NO: 305214 - RNA, 22 nt, Homo sapiens
agagaugauuaacauuuuggua

SEQ ID NO: 305215 - RNA, 22 nt, Homo sapiens
agaucacagucuuugguuuuag

SEQ ID NO: 305216 - RNA, 22 nt, Homo sapiens
agaugauguuucuggcacauga

SEQ ID NO: 305217 - RNA, 22 nt, Homo sapiens
agauggugugcuaggaaaugua

SEQ ID NO: 305218 - RNA, 22 nt, Homo sapiens
agcaagacauggcuuccaaaug

SEQ ID NO: 305219 - RNA, 22 nt, Homo sapiens
agcaagaugaaguugagcuagg

SEQ ID NO: 305220 - RNA, 22 nt, Homo sapiens
agcagcaucgggaaguuggcca

SEQ ID NO: 305221 - RNA, 22 nt, Homo sapiens
agcagcaugaggggacuucugc

SEQ ID NO: 305222 - RNA, 22 nt, Homo sapiens
agcaggucuuaacuugugaggu

SEQ ID NO: 305223 - RNA, 22 nt, Homo sapiens
agcagguguccacaauguuugc

SEQ ID NO: 305224 - RNA, 16 nt, Homo sapiens
agccaccauuuacuug

SEQ ID NO: 305225 - RNA, 20 nt, Homo sapiens
agcuggguguguuggugcau

SEQ ID NO: 305226 - RNA, 22 nt, Homo sapiens
agcuguuguucucagaggcuuu

SEQ ID NO: 305227 - RNA, 18 nt, Homo sapiens
aggaaugguaauacuuca

SEQ ID NO: 305228 - RNA, 18 nt, Homo sapiens
aggagcauagugcuauga

SEQ ID NO: 305229 - RNA, 23 nt, Homo sapiens
aggccaguuuuuccugcuugcug

SEQ ID NO: 305230 - RNA, 22 nt, Homo sapiens
agggcaagacuuguuaagaaca

SEQ ID NO: 305231 - RNA, 22 nt, Homo sapiens
agguaaacauggggacugcuac

SEQ ID NO: 305232 - RNA, 22 nt, Homo sapiens
aggugcaauggugguuuugugg

SEQ ID NO: 305233 - RNA, 22 nt, Homo sapiens
agugcaauaaggauguagaacu

SEQ ID NO: 305234 - RNA, 22 nt, Homo sapiens
agugcaauggugccaucauagc

SEQ ID NO: 305235 - RNA, 22 nt, Homo sapiens
auaaggcugguauagacauuca

SEQ ID NO: 305236 - RNA, 22 nt, Homo sapiens
auaauagcugaucauuuagaag

SEQ ID NO: 305237 - RNA, 22 nt, Homo sapiens
auacaucugccauguuggugug

SEQ ID NO: 305238 - RNA, 22 nt, Homo sapiens
auagaagcuauguauaggggcc

SEQ ID NO: 305239 - RNA, 22 nt, Homo sapiens
auagcagcaccccacuaccuca

SEQ ID NO: 305240 - RNA, 22 nt, Homo sapiens
auagugaacuuugugagaacaa

SEQ ID NO: 305241 - RNA, 22 nt, Homo sapiens
auaucaacaugguaggguuggu

SEQ ID NO: 305242 - RNA, 20 nt, Homo sapiens
auaugguugugagugauuuu

SEQ ID NO: 305243 - RNA, 22 nt, Homo sapiens
auauuacuggccauaucgcagg

SEQ ID NO: 305244 - RNA, 22 nt, Homo sapiens
aucaccauguguacauuagacc

SEQ ID NO: 305245 - RNA, 22 nt, Homo sapiens
aucagaaucucuagaggacugu

SEQ ID NO: 305246 - RNA, 22 nt, Homo sapiens
aucauguaguaagacacauuua

SEQ ID NO: 305247 - RNA, 22 nt, Homo sapiens
aucccugagccugacucucaga

SEQ ID NO: 305248 - RNA, 22 nt, Homo sapiens
aucugcaaauaaugaagauugg

SEQ ID NO: 305249 - RNA, 22 nt, Homo sapiens
augaaagucaauccccaagugu

SEQ ID NO: 305250 - RNA, 22 nt, Homo sapiens
augaaugcaucuaucaaagcau

SEQ ID NO: 305251 - RNA, 22 nt, Homo sapiens
augacauugaaaagcaagugga

SEQ ID NO: 305252 - RNA, 22 nt, Homo sapiens
augagauucuuagagaagucug

SEQ ID NO: 305253 - RNA, 22 nt, Homo sapiens
augaggagguaugauuuucuga

SEQ ID NO: 305254 - RNA, 22 nt, Homo sapiens
augauguguguuuaagaugucu

SEQ ID NO: 305255 - RNA, 22 nt, Homo sapiens
augcaauucuagauugauagua

SEQ ID NO: 305256 - RNA, 22 nt, Homo sapiens
auggagaugugcgaacugagua

SEQ ID NO: 305257 - RNA, 22 nt, Homo sapiens
auggaucuuucugcuuuugaau

SEQ ID NO: 305258 - RNA, 22 nt, Homo sapiens
auggcaaaaaaugcaauuacuu

SEQ ID NO: 305259 - RNA, 22 nt, Homo sapiens
auggcucaauucuuucccugaa

SEQ ID NO: 305260 - RNA, 22 nt, Homo sapiens
auggcucuuauuauuugaggua

SEQ ID NO: 305261 - RNA, 22 nt, Homo sapiens
augugcaacugcuggaacaguc

SEQ ID NO: 305262 - RNA, 22 nt, Homo sapiens
augugcauaugaagcacagaca

SEQ ID NO: 305263 - RNA, 22 nt, Homo sapiens
auguggaaagcagcaugauaug

SEQ ID NO: 305264 - RNA, 22 nt, Homo sapiens
auuaacaucuagaguuuuggug

SEQ ID NO: 305265 - RNA, 22 nt, Homo sapiens
auugcacuccagccugggcaac

SEQ ID NO: 305266 - RNA, 22 nt, Homo sapiens
auugcaugucauguuuagugua

SEQ ID NO: 305267 - RNA, 22 nt, Homo sapiens
auugcuucugauuuuaaaugag

SEQ ID NO: 305268 - RNA, 22 nt, Homo sapiens
auuggcagaaaucuuuauagua

SEQ ID NO: 305269 - RNA, 22 nt, Homo sapiens
auuuuugguugucagcacuagg

SEQ ID NO: 305270 - RNA, 22 nt, Homo sapiens
auuuuugguuucaccugcacgc

SEQ ID NO: 305271 - RNA, 22 nt, Homo sapiens
caaaguaauugugguuuugcca

SEQ ID NO: 305272 - RNA, 22 nt, Homo sapiens
caaagucuauucuacccuuacc

SEQ ID NO: 305273 - RNA, 22 nt, Homo sapiens
caaagucuucaguugauucuga

SEQ ID NO: 305274 - RNA, 22 nt, Homo sapiens
caaagucuucucauuaugucuu

SEQ ID NO: 305275 - RNA, 22 nt, Homo sapiens
caaagugcugggaugggccagg

SEQ ID NO: 305276 - RNA, 22 nt, Homo sapiens
caaggaauucucaauagaguua

SEQ ID NO: 305277 - RNA, 22 nt, Homo sapiens
caaguguuuccuuaaauacuug

SEQ ID NO: 305278 - RNA, 22 nt, Homo sapiens
cacauagucccugcuaaucuuc

SEQ ID NO: 305279 - RNA, 22 nt, Homo sapiens
cacauguucaggagcacuuaga

SEQ ID NO: 305280 - RNA, 22 nt, Homo sapiens
caccacauuccauugaucaggc

SEQ ID NO: 305281 - RNA, 22 nt, Homo sapiens
aaagagaucuaugggcacuaug

SEQ ID NO: 305282 - RNA, 22 nt, Homo sapiens
aaagcuagagaagcugcuguca

SEQ ID NO: 305283 - RNA, 22 nt, Homo sapiens
aaaggcuucggaucagaaggua

SEQ ID NO: 305284 - RNA, 22 nt, Homo sapiens
aaagucuagaggaucaugugug

SEQ ID NO: 305285 - RNA, 22 nt, Homo sapiens
aaagugcaguauuugggcagaa

SEQ ID NO: 305286 - RNA, 22 nt, Homo sapiens
aaagugcugggauuuuaggcau

SEQ ID NO: 305287 - RNA, 22 nt, Homo sapiens
aaaguggugugaguauguaucu

SEQ ID NO: 305288 - RNA, 22 nt, Homo sapiens
aaaguguuucugcaguagguuu

SEQ ID NO: 305289 - RNA, 22 nt, Homo sapiens
aaaugcacaaagauuuugcacu

SEQ ID NO: 305290 - RNA, 22 nt, Homo sapiens
aaaugcuuucuuggaccauuug

SEQ ID NO: 305291 - RNA, 22 nt, Homo sapiens
aaaugggacugggguccuuuga

SEQ ID NO: 305292 - RNA, 20 nt, Homo sapiens
aagagcucaccagaauaucu

SEQ ID NO: 305293 - RNA, 22 nt, Homo sapiens
uaugaauuuuauccaggauaua

SEQ ID NO: 305294 - RNA, 22 nt, Homo sapiens
uauuccucuuuguugagguuau

SEQ ID NO: 305295 - RNA, 22 nt, Homo sapiens
uauugacauuacagugggucuu

SEQ ID NO: 305296 - RNA, 22 nt, Homo sapiens
uauugccugucuccaaaaauca

SEQ ID NO: 305297 - RNA, 22 nt, Homo sapiens
uauugcuuaugaugcugaauua

SEQ ID NO: 305298 - RNA, 22 nt, Homo sapiens
uauugcuugaggaaaugguaau

SEQ ID NO: 305299 - RNA, 19 nt, Homo sapiens
ucaauucugucaauggcuu

SEQ ID NO: 305300 - RNA, 22 nt, Homo sapiens
ucacaagugagaggaauuagau

SEQ ID NO: 305301 - RNA, 22 nt, Homo sapiens
ucacaauucacuacaggcuuga

SEQ ID NO: 305302 - RNA, 22 nt, Homo sapiens
ucacacugucuugguuacucuu

SEQ ID NO: 305303 - RNA, 19 nt, Homo sapiens
ucacacuguggcuucuuua

SEQ ID NO: 305304 - RNA, 23 nt, Homo sapiens
ucacacuuaagagaaaugcagcu

SEQ ID NO: 305305 - RNA, 22 nt, Homo sapiens
ucacaguagcaaauguuagaaa

SEQ ID NO: 305306 - RNA, 22 nt, Homo sapiens
ucacugaaaccuccaccucucg

SEQ ID NO: 305307 - RNA, 22 nt, Homo sapiens
ucagaacugauacuagaacuuu

SEQ ID NO: 305308 - RNA, 22 nt, Homo sapiens
ucagaucaguuccacaagaacu

SEQ ID NO: 305309 - RNA, 22 nt, Homo sapiens
ucagaucauuaagguagguuua

SEQ ID NO: 305310 - RNA, 22 nt, Homo sapiens
ucaguacuuuggagcucacaua

SEQ ID NO: 305311 - RNA, 22 nt, Homo sapiens
ucauagaucaaguaauaagaca

SEQ ID NO: 305312 - RNA, 22 nt, Homo sapiens
ucauaguagucacuuaauaaau

SEQ ID NO: 305313 - RNA, 20 nt, Homo sapiens
ucaucaguuggugcucgcug

SEQ ID NO: 305314 - RNA, 22 nt, Homo sapiens
uccagcuuuuucuaauucugug

SEQ ID NO: 305315 - RNA, 22 nt, Homo sapiens
uccaguguuauaauaugcgucu

SEQ ID NO: 305316 - RNA, 22 nt, Homo sapiens
uccaguguuucuuccacuauuu

SEQ ID NO: 305317 - RNA, 22 nt, Homo sapiens
ucccugagguccuggauuauug

SEQ ID NO: 305318 - RNA, 22 nt, Homo sapiens
ucccuguuaggcacagauuuau

SEQ ID NO: 305319 - RNA, 22 nt, Homo sapiens
ucccuugagccuggcuucucac

SEQ ID NO: 305320 - RNA, 22 nt, Homo sapiens
ucucaauggguuguagacaaag

SEQ ID NO: 305321 - RNA, 22 nt, Homo sapiens
ucucaauuugauuacauucaua

SEQ ID NO: 305322 - RNA, 22 nt, Homo sapiens
ucucauggcucacccugcauag

SEQ ID NO: 305323 - RNA, 23 nt, Homo sapiens
ucucauuccuugaaaauaaugac

SEQ ID NO: 305324 - RNA, 22 nt, Homo sapiens
ucugagaucaugucugugcugu

SEQ ID NO: 305325 - RNA, 22 nt, Homo sapiens
ucuggagugugaaguggauaug

SEQ ID NO: 305326 - RNA, 22 nt, Homo sapiens
ucuguuguuaucauaauauuga

SEQ ID NO: 305327 - RNA, 22 nt, Homo sapiens
ucuuggccaugaauggcaaggc

SEQ ID NO: 305328 - RNA, 22 nt, Homo sapiens
ucuugggugaguuugugaauaa

SEQ ID NO: 305329 - RNA, 22 nt, Homo sapiens
ucuuggguggauucauucuuuc

SEQ ID NO: 305330 - RNA, 22 nt, Homo sapiens
ucuuuugggccucuugucagac

SEQ ID NO: 305331 - RNA, 22 nt, Homo sapiens
ucuuuuggguauggagccauca

SEQ ID NO: 305332 - RNA, 20 nt, Homo sapiens
ugaaacacauggacuggggu

SEQ ID NO: 305333 - RNA, 22 nt, Homo sapiens
ugaaauggaaagaguguagacu

SEQ ID NO: 305334 - RNA, 22 nt, Homo sapiens
ugaaauuauucuuaccaaggug

SEQ ID NO: 305335 - RNA, 22 nt, Homo sapiens
ugaacagagaaacacuggccau

SEQ ID NO: 305336 - RNA, 22 nt, Homo sapiens
ugaaguaauguuuuauucuauu

SEQ ID NO: 305337 - RNA, 22 nt, Homo sapiens
ugaaugcuaaaggaaaacagua

SEQ ID NO: 305338 - RNA, 22 nt, Homo sapiens
ugaaugcuucaugucugggcug

SEQ ID NO: 305339 - RNA, 21 nt, Homo sapiens
ugaaugcuuuaaauauuagaa

SEQ ID NO: 305340 - RNA, 22 nt, Homo sapiens
ugacaaguaaacagucagcacc

SEQ ID NO: 305341 - RNA, 22 nt, Homo sapiens
ugacuuuagaauuuuauccaga

SEQ ID NO: 305342 - RNA, 19 nt, Homo sapiens
ugagaaccucuacagaguc

SEQ ID NO: 305343 - RNA, 22 nt, Homo sapiens
ugagacauacuuacaggggaug

SEQ ID NO: 305344 - RNA, 22 nt, Homo sapiens
ugagaugauagauauguuaauu

SEQ ID NO: 305345 - RNA, 22 nt, Homo sapiens
ugagaugauaucuuauuguaau

SEQ ID NO: 305346 - RNA, 22 nt, Homo sapiens
ugagaugauuuaauggagccca

SEQ ID NO: 305347 - RNA, 22 nt, Homo sapiens
gaaauguugauagugggcauug

SEQ ID NO: 305348 - RNA, 22 nt, Homo sapiens
gaagaaguacaagacaaauuuu

SEQ ID NO: 305349 - RNA, 22 nt, Homo sapiens
gaaugcaugaggggaucagaug

SEQ ID NO: 305350 - RNA, 22 nt, Homo sapiens
gaauugcacaaaaacugcuugu

SEQ ID NO: 305351 - RNA, 22 nt, Homo sapiens
gacacagugaagucucuacuug

SEQ ID NO: 305352 - RNA, 22 nt, Homo sapiens
gacaguuucucaggcuuccuua

SEQ ID NO: 305353 - RNA, 22 nt, Homo sapiens
gagcuggacuucuuaccuuuuc

SEQ ID NO: 305354 - RNA, 22 nt, Homo sapiens
gagcuguugguuugaaagaauu

SEQ ID NO: 305355 - RNA, 22 nt, Homo sapiens
gaggcagucugacccuuagcag

SEQ ID NO: 305356 - RNA, 22 nt, Homo sapiens
gagguggugguggaggcauagc

SEQ ID NO: 305357 - RNA, 22 nt, Homo sapiens
gaguagaacugguuaucuaaua

SEQ ID NO: 305358 - RNA, 22 nt, Homo sapiens
gaguggugguucugaaacuuuu

SEQ ID NO: 305359 - RNA, 22 nt, Homo sapiens
gauauuacuuccaauauugcaa

SEQ ID NO: 305360 - RNA, 22 nt, Homo sapiens
gauuagcacuucaguuacagua

SEQ ID NO: 305361 - RNA, 22 nt, Homo sapiens
gauuuuccaguggcccugauca

SEQ ID NO: 305362 - RNA, 22 nt, Homo sapiens
gcagcacauggcagaacauauu

SEQ ID NO: 305363 - RNA, 19 nt, Homo sapiens
gcaguauugaaggccaguc

SEQ ID NO: 305364 - RNA, 20 nt, Homo sapiens
gcaugagucuuuauaguaga

SEQ ID NO: 305365 - RNA, 22 nt, Homo sapiens
gcauggccuuuaaaugucacag

SEQ ID NO: 305366 - RNA, 20 nt, Homo sapiens
gccacaguuaagcuucugcc

SEQ ID NO: 305367 - RNA, 22 nt, Homo sapiens
gccaguguuuuauugagaauuu

SEQ ID NO: 305368 - RNA, 22 nt, Homo sapiens
gcgugguguuagaaugagaagu

SEQ ID NO: 305369 - RNA, 22 nt, Homo sapiens
gcuggcaaaugguuauaaggcc

SEQ ID NO: 305370 - RNA, 22 nt, Homo sapiens
gcuggcaagaugcugaugcaac

SEQ ID NO: 305371 - RNA, 22 nt, Homo sapiens
ggaaaucaucauucucgguaua

SEQ ID NO: 305372 - RNA, 22 nt, Homo sapiens
ggaaugggauuugaagucuggc

SEQ ID NO: 305373 - RNA, 22 nt, Homo sapiens
ggagggugagaucaauuuggga

SEQ ID NO: 305374 - RNA, 16 nt, Homo sapiens
ggaggucaucugggaa

SEQ ID NO: 305375 - RNA, 22 nt, Homo sapiens
ggaguuuaagucuugugcaucu

SEQ ID NO: 305376 - RNA, 22 nt, Homo sapiens
ggcaaagagacaugcaucgggg

SEQ ID NO: 305377 - RNA, 22 nt, Homo sapiens
ggcaagaggagauucugcuccc

SEQ ID NO: 305378 - RNA, 19 nt, Homo sapiens
ggcaccuuuuccaaaaaug

SEQ ID NO: 305379 - RNA, 22 nt, Homo sapiens
ggcacugugaugugagggggua

SEQ ID NO: 305380 - RNA, 22 nt, Homo sapiens
ggcucagugaucuguuucugua

SEQ ID NO: 305381 - RNA, 22 nt, Homo sapiens
ggcuuggaggaaugugagggcu

SEQ ID NO: 305382 - RNA, 22 nt, Homo sapiens
gggaggucauuguucaaugcug

SEQ ID NO: 305383 - RNA, 22 nt, Homo sapiens
gggcaacauugaguacccugaa

SEQ ID NO: 305384 - RNA, 22 nt, Homo sapiens
gguauuuaaaguaccugucugc

SEQ ID NO: 305385 - RNA, 21 nt, Homo sapiens
ggugagaaaggagacauagac

SEQ ID NO: 305386 - RNA, 23 nt, Homo sapiens
guaauacuagucauaguagcagg

SEQ ID NO: 305387 - RNA, 22 nt, Homo sapiens
guagaagcacagggccuguauu

SEQ ID NO: 305388 - RNA, 22 nt, Homo sapiens
guauuugguuauugcagccuga

SEQ ID NO: 305389 - RNA, 22 nt, Homo sapiens
gucaaggaauuuauccauuucu

SEQ ID NO: 305390 - RNA, 22 nt, Homo sapiens
gucagcaaaguucuccugcaga

SEQ ID NO: 305391 - RNA, 22 nt, Homo sapiens
gucagggagucucuaucagugg

SEQ ID NO: 305392 - RNA, 18 nt, Homo sapiens
gucauagaaugaugguuc

SEQ ID NO: 305393 - RNA, 22 nt, Homo sapiens
gucccugaggaacauccagggc

SEQ ID NO: 305394 - RNA, 22 nt, Homo sapiens
gucucagugcgaaucucaaaga

SEQ ID NO: 305395 - RNA, 17 nt, Homo sapiens
gugaaaucaucauuuuu

SEQ ID NO: 305396 - RNA, 22 nt, Homo sapiens
gugaacagcagaugagugagug

SEQ ID NO: 305397 - RNA, 22 nt, Homo sapiens
gugacauuuuuacugaugagag

SEQ ID NO: 305398 - RNA, 22 nt, Homo sapiens
ugauaauuuugucagguuuugg

SEQ ID NO: 305399 - RNA, 20 nt, Homo sapiens
ugauauuuucugagcaggaa

SEQ ID NO: 305400 - RNA, 22 nt, Homo sapiens
ugaugguguuaccaucuuuacu

SEQ ID NO: 305401 - RNA, 22 nt, Homo sapiens
ugcaaauguuauuuugguuucu

SEQ ID NO: 305402 - RNA, 22 nt, Homo sapiens
uggaagaugggaccucaguuuu

SEQ ID NO: 305403 - RNA, 21 nt, Homo sapiens
uggaccccuuccagucaucau

SEQ ID NO: 305404 - RNA, 22 nt, Homo sapiens
uggagacaaagauagaaaagca

SEQ ID NO: 305405 - RNA, 22 nt, Homo sapiens
uggagagcaaagaauuuguuag

SEQ ID NO: 305406 - RNA, 22 nt, Homo sapiens
uggaggacugcagaacugaggc

SEQ ID NO: 305407 - RNA, 22 nt, Homo sapiens
uggaguauuauguaauuucaau

SEQ ID NO: 305408 - RNA, 22 nt, Homo sapiens
uggaugaagagaugguaguugc

SEQ ID NO: 305409 - RNA, 22 nt, Homo sapiens
uggcagauaggauacaggacua

SEQ ID NO: 305410 - RNA, 22 nt, Homo sapiens
uggcagugggagauauuuuauu

SEQ ID NO: 305411 - RNA, 19 nt, Homo sapiens
caucccugagcugaagugg

SEQ ID NO: 305412 - RNA, 22 nt, Homo sapiens
ccacacugucuuggugggaaac

SEQ ID NO: 305413 - RNA, 23 nt, Homo sapiens
ccacacuguuuagaauggcauca

SEQ ID NO: 305414 - RNA, 23 nt, Homo sapiens
ccaguauuuauguaaggaagugu

SEQ ID NO: 305415 - RNA, 22 nt, Homo sapiens
ccaguguuuuugaauuccagga

SEQ ID NO: 305416 - RNA, 22 nt, Homo sapiens
ccaguuuucucacuguugcagu

SEQ ID NO: 305417 - RNA, 20 nt, Homo sapiens
ccaucaguccucucuuguuc

SEQ ID NO: 305418 - RNA, 17 nt, Homo sapiens
ccccugagcgaugcagu

SEQ ID NO: 305419 - RNA, 22 nt, Homo sapiens
cccuguguuuagcugaagguuu

SEQ ID NO: 305420 - RNA, 22 nt, Homo sapiens
ccuggcacugagcaguguucua

SEQ ID NO: 305421 - RNA, 22 nt, Homo sapiens
ccuucuuuuguaaggcugaaua

SEQ ID NO: 305422 - RNA, 22 nt, Homo sapiens
cuaaagauagugacaugauuug

SEQ ID NO: 305423 - RNA, 18 nt, Homo sapiens
cuaagacacuuggcagag

SEQ ID NO: 305424 - RNA, 22 nt, Homo sapiens
cuagaagcauauucagaacaga

SEQ ID NO: 305425 - RNA, 20 nt, Homo sapiens
cuauugacauuuggggcuag

SEQ ID NO: 305426 - RNA, 22 nt, Homo sapiens
cucucugagccccagacaccuu

SEQ ID NO: 305427 - RNA, 22 nt, Homo sapiens
cugaauagucaacgauggacug

SEQ ID NO: 305428 - RNA, 22 nt, Homo sapiens
cugagcacugagauccucuagc

SEQ ID NO: 305429 - RNA, 18 nt, Homo sapiens
cugagcacugcuuuauga

SEQ ID NO: 305430 - RNA, 22 nt, Homo sapiens
cugauuguuugccucuaaaauc

SEQ ID NO: 305431 - RNA, 22 nt, Homo sapiens
cugugaacaugggagaaauggc

SEQ ID NO: 305432 - RNA, 22 nt, Homo sapiens
cuguuugguuaucuuuuccugu

SEQ ID NO: 305433 - RNA, 22 nt, Homo sapiens
cuugugauugcacggcugccug

SEQ ID NO: 305434 - RNA, 22 nt, Homo sapiens
cuuuuacacuguuggugggaau

SEQ ID NO: 305435 - RNA, 22 nt, Homo sapiens
cuuuuggcuuagaauugucuug

SEQ ID NO: 305436 - RNA, 22 nt, Homo sapiens
cuuuuggucuaucagagaagca

SEQ ID NO: 305437 - RNA, 22 nt, Homo sapiens
cuuuugugauucuucaguugcu

SEQ ID NO: 305438 - RNA, 22 nt, Homo sapiens
cuuuuguggaucuucuguugcu

SEQ ID NO: 305439 - RNA, 22 nt, Homo sapiens
gaauguuuacuuuguuuaauac

SEQ ID NO: 305440 - RNA, 22 nt, Homo sapiens
gacuagaaauuauuuagugagc

SEQ ID NO: 305441 - RNA, 22 nt, Homo sapiens
gagaacugagugugcuggcgga

SEQ ID NO: 305442 - RNA, 22 nt, Homo sapiens
gagagcaugugcuggcaucagu

SEQ ID NO: 305443 - RNA, 22 nt, Homo sapiens
gagagugaaguuugcuaccugu

SEQ ID NO: 305444 - RNA, 22 nt, Homo sapiens
gagaucaguuaaugaagugagc

SEQ ID NO: 305445 - RNA, 22 nt, Homo sapiens
gagaugaugagauguucacagu

SEQ ID NO: 305446 - RNA, 21 nt, Homo sapiens
gagcacauuguccucuaacgc

SEQ ID NO: 305447 - RNA, 22 nt, Homo sapiens
gaggcagucuguccauucucag

SEQ ID NO: 305448 - RNA, 22 nt, Homo sapiens
gaggcagucugucccuuagcag

SEQ ID NO: 305449 - RNA, 22 nt, Homo sapiens
gauacuguauccuaaaagcuuu

SEQ ID NO: 305450 - RNA, 22 nt, Homo sapiens
gaucaauuggcugaagacacgu

SEQ ID NO: 305451 - RNA, 22 nt, Homo sapiens
gaucacaugggagaaugagagu

SEQ ID NO: 305452 - RNA, 22 nt, Homo sapiens
gcaauacugacagcauuaguuu

SEQ ID NO: 305453 - RNA, 22 nt, Homo sapiens
gcacauggccacuaggaauaaa

SEQ ID NO: 305454 - RNA, 22 nt, Homo sapiens
gcccugagauucuuggauucug

SEQ ID NO: 305455 - RNA, 22 nt, Homo sapiens
gcugcacuuuaaggcauccccu

SEQ ID NO: 305456 - RNA, 22 nt, Homo sapiens
gcuuuugcaggaaaggaagaau

SEQ ID NO: 305457 - RNA, 21 nt, Homo sapiens
gcuuuuucggaagucuuuggc

SEQ ID NO: 305458 - RNA, 22 nt, Homo sapiens
ggagauccucugcgggcaaaga

SEQ ID NO: 305459 - RNA, 22 nt, Homo sapiens
ggagaucuuguuaaaguacaga

SEQ ID NO: 305460 - RNA, 23 nt, Homo sapiens
ggaguguauuggcacgaucucag

SEQ ID NO: 305461 - RNA, 22 nt, Homo sapiens
ggaucacagagcuugggaaagg

SEQ ID NO: 305462 - RNA, 19 nt, Homo sapiens
ggcacugugugagugagga

SEQ ID NO: 305463 - RNA, 22 nt, Homo sapiens
ggcccugagacaggaaaaagcu

SEQ ID NO: 305464 - RNA, 19 nt, Homo sapiens
ggcucagucaacugacugu

SEQ ID NO: 305465 - RNA, 22 nt, Homo sapiens
ggcucaguuuccuccgucugcu

SEQ ID NO: 305466 - RNA, 22 nt, Homo sapiens
gggaacaugagaaugugaauga

SEQ ID NO: 305467 - RNA, 22 nt, Homo sapiens
gggaggucauuguaaggucuua

SEQ ID NO: 305468 - RNA, 22 nt, Homo sapiens
gggaugauuaugguucacuaca

SEQ ID NO: 305469 - RNA, 22 nt, Homo sapiens
ggguucccuucuggcucagggu

SEQ ID NO: 305470 - RNA, 19 nt, Homo sapiens
ggucagcaaagucuagcug

SEQ ID NO: 305471 - RNA, 22 nt, Homo sapiens
ggugacagugguuaaaauuugu

SEQ ID NO: 305472 - RNA, 22 nt, Homo sapiens
gguggugguauuucagaaaaug

SEQ ID NO: 305473 - RNA, 22 nt, Homo sapiens
guauacaugucaaaacucacau

SEQ ID NO: 305474 - RNA, 22 nt, Homo sapiens
guaugacacaggaagcuuaacc

SEQ ID NO: 305475 - RNA, 22 nt, Homo sapiens
guauuaguuaucuacugcugug

SEQ ID NO: 305476 - RNA, 22 nt, Homo sapiens
guauugacauuuuuaaggaacu

SEQ ID NO: 305477 - RNA, 22 nt, Homo sapiens
guauugacuaucaaucaugugc

SEQ ID NO: 305478 - RNA, 22 nt, Homo sapiens
guauuuguugcagcagcacuau

SEQ ID NO: 305479 - RNA, 22 nt, Homo sapiens
gucauguuuaacuucuugagga

SEQ ID NO: 305480 - RNA, 22 nt, Homo sapiens
gucauucauucagcaagcacug

SEQ ID NO: 305481 - RNA, 22 nt, Homo sapiens
guccuggagaagcguggaccgg

SEQ ID NO: 305482 - RNA, 22 nt, Homo sapiens
gucuugcacuuaccuaagaacu

SEQ ID NO: 305483 - RNA, 22 nt, Homo sapiens
gugagcuccucuucugcugcag

SEQ ID NO: 305484 - RNA, 22 nt, Homo sapiens
gugaucaugauccugaagcauu

SEQ ID NO: 305485 - RNA, 22 nt, Homo sapiens
gugcaauucacuguuaugucug

SEQ ID NO: 305486 - RNA, 22 nt, Homo sapiens
gugcacaaaucuuaaauguaca

SEQ ID NO: 305487 - RNA, 22 nt, Homo sapiens
gugcacaugguagguauugagu

SEQ ID NO: 305488 - RNA, 22 nt, Homo sapiens
guggcaaguguuccaagaggcg

SEQ ID NO: 305489 - RNA, 22 nt, Homo sapiens
guggcagagucagagggaaaug

SEQ ID NO: 305490 - RNA, 22 nt, Homo sapiens
gugguuuuacaaagagaaagau

SEQ ID NO: 305491 - RNA, 22 nt, Homo sapiens
gugguuuuuuucugccuuauag

SEQ ID NO: 305492 - RNA, 22 nt, Homo sapiens
gugucaugggcauguccuuaac

SEQ ID NO: 305493 - RNA, 22 nt, Homo sapiens
gugugauuguuaauuuuaggug

SEQ ID NO: 305494 - RNA, 22 nt, Homo sapiens
guguuauggagccaaacuacua

SEQ ID NO: 305495 - RNA, 22 nt, Homo sapiens
guuacagucuuguguaagguua

SEQ ID NO: 305496 - RNA, 22 nt, Homo sapiens
guuaugacacucuuuuuaucau

SEQ ID NO: 305497 - RNA, 22 nt, Homo sapiens
guuaugcagcaauugauaaucu

SEQ ID NO: 305498 - RNA, 22 nt, Homo sapiens
guucaucagggacacugguuug

SEQ ID NO: 305499 - RNA, 22 nt, Homo sapiens
guuuggcucuuguuucugucaa

SEQ ID NO: 305500 - RNA, 22 nt, Homo sapiens
guuuuuggggucacuauuaccg

SEQ ID NO: 305501 - RNA, 22 nt, Homo sapiens
uaaaugcucuuuaaaagugcuu

SEQ ID NO: 305502 - RNA, 22 nt, Homo sapiens
uaacccuuacaacuacacucgu

SEQ ID NO: 305503 - RNA, 22 nt, Homo sapiens
uaacuaguggaauuugauuuca

SEQ ID NO: 305504 - RNA, 22 nt, Homo sapiens
uaacucugccuagugacauggu

SEQ ID NO: 305505 - RNA, 22 nt, Homo sapiens
uaaggcuugaucuuggugagau

SEQ ID NO: 305506 - RNA, 22 nt, Homo sapiens
uggcauauaaagauguguucaa

SEQ ID NO: 305507 - RNA, 22 nt, Homo sapiens
uggcuaaguuaaucaaggagau

SEQ ID NO: 305508 - RNA, 22 nt, Homo sapiens
ugggaccccuacucuuuccaca

SEQ ID NO: 305509 - RNA, 22 nt, Homo sapiens
ugggaugaugcuugagaauauc

SEQ ID NO: 305510 - RNA, 22 nt, Homo sapiens
uggguagagaaucaggaucuua

SEQ ID NO: 305511 - RNA, 22 nt, Homo sapiens
ugguagugugagucuaaauugg

SEQ ID NO: 305512 - RNA, 22 nt, Homo sapiens
uggucuuuucaacaaaugguau

SEQ ID NO: 305513 - RNA, 22 nt, Homo sapiens
uggugagaaaagaugucuuugu

SEQ ID NO: 305514 - RNA, 22 nt, Homo sapiens
ugucaaggaaugucauugguuu

SEQ ID NO: 305515 - RNA, 22 nt, Homo sapiens
ugucauggggaaaauaacagac

SEQ ID NO: 305516 - RNA, 22 nt, Homo sapiens
ugucauguugguguacugcacc

SEQ ID NO: 305517 - RNA, 22 nt, Homo sapiens
ugugacuaguggugaaugacgc

SEQ ID NO: 305518 - RNA, 22 nt, Homo sapiens
ugugauuauuuauagacaguca

SEQ ID NO: 305519 - RNA, 17 nt, Homo sapiens
ugugauugaagucaucc

SEQ ID NO: 305520 - RNA, 18 nt, Homo sapiens
ugugcaauauuaaccacc

SEQ ID NO: 305521 - RNA, 22 nt, Homo sapiens
uguggaaauuguuguauuuaau

SEQ ID NO: 305522 - RNA, 22 nt, Homo sapiens
uguggcuucuuugguucaguau

SEQ ID NO: 305523 - RNA, 22 nt, Homo sapiens
ugugguuuuuuucuccaauagg

SEQ ID NO: 305524 - RNA, 22 nt, Homo sapiens
uguuaacauggucucagucugu

SEQ ID NO: 305525 - RNA, 22 nt, Homo sapiens
uguucauggauccaguggcuuc

SEQ ID NO: 305526 - RNA, 22 nt, Homo sapiens
uguuuguuugugauacgguaca

SEQ ID NO: 305527 - RNA, 22 nt, Homo sapiens
uuaauacucuucuaaguagucc

SEQ ID NO: 305528 - RNA, 22 nt, Homo sapiens
uuagcaccacacacuuuagagg

SEQ ID NO: 305529 - RNA, 22 nt, Homo sapiens
uuaggacaauguucguuuuuug

SEQ ID NO: 305530 - RNA, 22 nt, Homo sapiens
uuaggacacuguggguggguca

SEQ ID NO: 305531 - RNA, 22 nt, Homo sapiens
uuaucacauugacugauuugca

SEQ ID NO: 305532 - RNA, 22 nt, Homo sapiens
uuaugucacuguucagucuccc

SEQ ID NO: 305533 - RNA, 22 nt, Homo sapiens
uuauugcacuccagccugggua

SEQ ID NO: 305534 - RNA, 22 nt, Homo sapiens
uuauuugguuauuguaauuggg

SEQ ID NO: 305535 - RNA, 22 nt, Homo sapiens
uucaccuguagcaugcccuugg

SEQ ID NO: 305536 - RNA, 22 nt, Homo sapiens
uucacugugaacucauauucag

SEQ ID NO: 305537 - RNA, 20 nt, Homo sapiens
uucagcaaaggaaugggagu

SEQ ID NO: 305538 - RNA, 22 nt, Homo sapiens
uucagggagaaggcaaacguug

SEQ ID NO: 305539 - RNA, 22 nt, Homo sapiens
uucauguaauauauuucaggcc

SEQ ID NO: 305540 - RNA, 22 nt, Homo sapiens
uuccacaaugguugaacuaguu

SEQ ID NO: 305541 - RNA, 22 nt, Homo sapiens
uuccaguguguucauccucaga

SEQ ID NO: 305542 - RNA, 22 nt, Homo sapiens
uuccauagucauagugcugaug

SEQ ID NO: 305543 - RNA, 22 nt, Homo sapiens
uucccugagcaucuguugagcc

SEQ ID NO: 305544 - RNA, 22 nt, Homo sapiens
uucccugaguaucuuaccaugg

SEQ ID NO: 305545 - RNA, 22 nt, Homo sapiens
uucccuguaucuucugccaugu

SEQ ID NO: 305546 - RNA, 22 nt, Homo sapiens
uucccugugguauagaagccgu

SEQ ID NO: 305547 - RNA, 22 nt, Homo sapiens
uuccugagccuuguaucuagua

SEQ ID NO: 305548 - RNA, 22 nt, Homo sapiens
uuccugaggccuccccagaagc

SEQ ID NO: 305549 - RNA, 22 nt, Homo sapiens
uucuacaugggucgucggugag

SEQ ID NO: 305550 - RNA, 22 nt, Homo sapiens
uucuagcacuuugggagacuga

SEQ ID NO: 305551 - RNA, 22 nt, Homo sapiens
uucucaguucgguggcagugcu

SEQ ID NO: 305552 - RNA, 17 nt, Homo sapiens
uucucaguucugaucuc

SEQ ID NO: 305553 - RNA, 22 nt, Homo sapiens
uucucugggacauaggucgggu

SEQ ID NO: 305554 - RNA, 22 nt, Homo sapiens
uucugacuggugugagauggua

SEQ ID NO: 305555 - RNA, 22 nt, Homo sapiens
uucugcuugaucuaguguguug

SEQ ID NO: 305556 - RNA, 22 nt, Homo sapiens
uucuggcucaggucaacacuuc

SEQ ID NO: 305557 - RNA, 22 nt, Homo sapiens
uucugguuaauacuugcaaaaa

SEQ ID NO: 305558 - RNA, 22 nt, Homo sapiens
uucuucaguuacaacaaggggg

SEQ ID NO: 305559 - RNA, 22 nt, Homo sapiens
uucuugcacuuaacugacauuc

SEQ ID NO: 305560 - RNA, 21 nt, Homo sapiens
uucuuugcucaguguuagagu

SEQ ID NO: 305561 - RNA, 18 nt, Homo sapiens
uugaaugcgucccagaga

SEQ ID NO: 305562 - RNA, 22 nt, Homo sapiens
uugaaugcguuguguggcccgu

SEQ ID NO: 305563 - RNA, 20 nt, Homo sapiens
uugacaguggguuguuaaag

SEQ ID NO: 305564 - RNA, 22 nt, Homo sapiens
uugagauggagucucacgcauu

SEQ ID NO: 305565 - RNA, 22 nt, Homo sapiens
uugagauggugccacuguacuc

SEQ ID NO: 305566 - RNA, 22 nt, Homo sapiens
uugagauguggguuggugacuu

SEQ ID NO: 305567 - RNA, 22 nt, Homo sapiens
uugaggaggcagucuucccauu

SEQ ID NO: 305568 - RNA, 23 nt, Homo sapiens
uugaggcauguaccaucaauauc

SEQ ID NO: 305569 - RNA, 21 nt, Homo sapiens
uugagguaaaauccuauggga

SEQ ID NO: 305570 - RNA, 22 nt, Homo sapiens
uugaucaucagcuuugucaucu

SEQ ID NO: 305571 - RNA, 22 nt, Homo sapiens
uugcacauugcaccuuuuguau

SEQ ID NO: 305572 - RNA, 22 nt, Homo sapiens
uugcacuccagccuggaugaca

SEQ ID NO: 305573 - RNA, 22 nt, Homo sapiens
uugcacuugcugaggagugauu

SEQ ID NO: 305574 - RNA, 22 nt, Homo sapiens
uugcauaagugcauucugugau

SEQ ID NO: 305575 - RNA, 22 nt, Homo sapiens
uugcauuagugugguacauuug

SEQ ID NO: 305576 - RNA, 22 nt, Homo sapiens
uugcuuaggcuggagugcagug

SEQ ID NO: 305577 - RNA, 22 nt, Homo sapiens
uugcuuuguugucuggggaaua

SEQ ID NO: 305578 - RNA, 22 nt, Homo sapiens
uuggaaagagguguuuaugacu

SEQ ID NO: 305579 - RNA, 22 nt, Homo sapiens
uuggcaaagaggaaugccacuu

SEQ ID NO: 305580 - RNA, 22 nt, Homo sapiens
uuggcaaagugucuggcauuua

SEQ ID NO: 305581 - RNA, 22 nt, Homo sapiens
uuggccccuuucauccacagcu

SEQ ID NO: 305582 - RNA, 22 nt, Homo sapiens
uugucacauggggcggcugccc

SEQ ID NO: 305583 - RNA, 22 nt, Homo sapiens
uugucauuuucagaguguuacg

SEQ ID NO: 305584 - RNA, 22 nt, Homo sapiens
uugugaaugaugucgcaguaaa

SEQ ID NO: 305585 - RNA, 22 nt, Homo sapiens
uugugaauggugccgcaauaaa

SEQ ID NO: 305586 - RNA, 22 nt, Homo sapiens
uugugcuuuugagcugagauga

SEQ ID NO: 305587 - RNA, 22 nt, Homo sapiens
uuuacagucuuuugugugaguc

SEQ ID NO: 305588 - RNA, 22 nt, Homo sapiens
uuuauccagccucuagcaaggu

SEQ ID NO: 305589 - RNA, 22 nt, Homo sapiens
aaacauugaccucauccuggca

SEQ ID NO: 305590 - RNA, 19 nt, Homo sapiens
aaagguaguaaccucugau

SEQ ID NO: 305591 - RNA, 22 nt, Homo sapiens
aaagucuguuuugucagagacu

SEQ ID NO: 305592 - RNA, 22 nt, Homo sapiens
aaagugcaguacuucguauauu

SEQ ID NO: 305593 - RNA, 22 nt, Homo sapiens
aacaccguagaaacacaaggga

SEQ ID NO: 305594 - RNA, 22 nt, Homo sapiens
aacacuaucugccuuacaggga

SEQ ID NO: 305595 - RNA, 22 nt, Homo sapiens
aacuggcacuacaucaagagcu

SEQ ID NO: 305596 - RNA, 22 nt, Homo sapiens
uuucaucaagcacagaguagau

SEQ ID NO: 305597 - RNA, 22 nt, Homo sapiens
uuucauggaauauagucauuuu

SEQ ID NO: 305598 - RNA, 22 nt, Homo sapiens
uuucuauguugaccagucuaga

SEQ ID NO: 305599 - RNA, 21 nt, Homo sapiens
uuucugggggagcauggcagg

SEQ ID NO: 305600 - RNA, 23 nt, Homo sapiens
uuucuugggcaugcuaugucagu

SEQ ID NO: 305601 - RNA, 21 nt, Homo sapiens
uuugaucauuaaaagugaauc

SEQ ID NO: 305602 - RNA, 22 nt, Homo sapiens
uuugauguugagacuauaaagc

SEQ ID NO: 305603 - RNA, 22 nt, Homo sapiens
uuugcuugaggucuagcuaccc

SEQ ID NO: 305604 - RNA, 22 nt, Homo sapiens
uuuggcauuaagaugcuguauc

SEQ ID NO: 305605 - RNA, 22 nt, Homo sapiens
uuuggucccaaugugauaaggu

SEQ ID NO: 305606 - RNA, 22 nt, Homo sapiens
uuugguugcauucacauauuuc

SEQ ID NO: 305607 - RNA, 22 nt, Homo sapiens
uuugguuuuuguuaucacucau

SEQ ID NO: 305608 - RNA, 23 nt, Homo sapiens
uuugugcuaauuuaugggcucuu

SEQ ID NO: 305609 - RNA, 18 nt, Homo sapiens
uuuugcuuaacugcgcca

SEQ ID NO: 305610 - RNA, 22 nt, Homo sapiens
uuuuggcucuugguaggucaga

SEQ ID NO: 305611 - RNA, 22 nt, Homo sapiens
uuuuggucuccaguuucugcug

SEQ ID NO: 305612 - RNA, 22 nt, Homo sapiens
uucagcacaguguggaucauuc

SEQ ID NO: 305613 - RNA, 22 nt, Homo sapiens
uucagcacugaaaauaugucau

SEQ ID NO: 305614 - RNA, 22 nt, Homo sapiens
uucauagaggacauuacuggag

SEQ ID NO: 305615 - RNA, 18 nt, Homo sapiens
uucauaguagcaugauuu

SEQ ID NO: 305616 - RNA, 21 nt, Homo sapiens
uucaucagccagaaaucaagc

SEQ ID NO: 305617 - RNA, 21 nt, Homo sapiens
uucaucuggccguauuccagg

SEQ ID NO: 305618 - RNA, 22 nt, Homo sapiens
uuccagugggacgagaugugga

SEQ ID NO: 305619 - RNA, 22 nt, Homo sapiens
uucccugaaauauucacuuuca

SEQ ID NO: 305620 - RNA, 22 nt, Homo sapiens
uucccugugggcuggugcucca

SEQ ID NO: 305621 - RNA, 22 nt, Homo sapiens
uucccugugugcagaugggugu

SEQ ID NO: 305622 - RNA, 22 nt, Homo sapiens
uuccugagagggcugggugcag

SEQ ID NO: 305623 - RNA, 22 nt, Homo sapiens
uuccugagaucagaauucaaau

SEQ ID NO: 305624 - RNA, 22 nt, Homo sapiens
uucucagugaacuccagcuugu

SEQ ID NO: 305625 - RNA, 22 nt, Homo sapiens
uucucagugcuaucuuuuaugc

SEQ ID NO: 305626 - RNA, 22 nt, Homo sapiens
uucuccugguggacccuaaacg

SEQ ID NO: 305627 - RNA, 22 nt, Homo sapiens
uucuggcuaugggauacuaaau

SEQ ID NO: 305628 - RNA, 22 nt, Homo sapiens
uugaaagucauggcacaggcaa

SEQ ID NO: 305629 - RNA, 22 nt, Homo sapiens
uugaaagucuaggcuuacagua

SEQ ID NO: 305630 - RNA, 22 nt, Homo sapiens
uugaauagacagccagcuuuaa

SEQ ID NO: 305631 - RNA, 22 nt, Homo sapiens
uugacauugcuguaguguccag

SEQ ID NO: 305632 - RNA, 22 nt, Homo sapiens
uugacuuagacauucaguugga

SEQ ID NO: 305633 - RNA, 22 nt, Homo sapiens
uugagaugauggauaugcuaau

SEQ ID NO: 305634 - RNA, 22 nt, Homo sapiens
uugagauggagucucgcacugu

SEQ ID NO: 305635 - RNA, 22 nt, Homo sapiens
uugagauggagucucguucugu

SEQ ID NO: 305636 - RNA, 22 nt, Homo sapiens
uugagauguggcaguuuaugag

SEQ ID NO: 305637 - RNA, 22 nt, Homo sapiens
uugagcacaggaguuuugagac

SEQ ID NO: 305638 - RNA, 22 nt, Homo sapiens
uugagcacugucugugugcagu

SEQ ID NO: 305639 - RNA, 22 nt, Homo sapiens
uugagcaucauguuagcacuca

SEQ ID NO: 305640 - RNA, 22 nt, Homo sapiens
uugaggcaaugaggagaagcug

SEQ ID NO: 305641 - RNA, 22 nt, Homo sapiens
uugaugauguuucugccuugcc

SEQ ID NO: 305642 - RNA, 22 nt, Homo sapiens
uugcacuuccgccugggugaca

SEQ ID NO: 305643 - RNA, 22 nt, Homo sapiens
uugccuuuguuggaaacaagug

SEQ ID NO: 305644 - RNA, 22 nt, Homo sapiens
uugcuuuguuacugcaguuucc

SEQ ID NO: 305645 - RNA, 22 nt, Homo sapiens
uuggcaaaugucacaaaucagg

SEQ ID NO: 305646 - RNA, 22 nt, Homo sapiens
uuggcaagaauguaugccgauc

SEQ ID NO: 305647 - RNA, 23 nt, Homo sapiens
uugggcaaaucacugagggcaga

SEQ ID NO: 305648 - RNA, 22 nt, Homo sapiens
uugguccacugugaaauuggga

SEQ ID NO: 305649 - RNA, 22 nt, Homo sapiens
uugguccccacuccccugccaa

SEQ ID NO: 305650 - RNA, 22 nt, Homo sapiens
uugugaauggugccacaauaaa

SEQ ID NO: 305651 - RNA, 22 nt, Homo sapiens
uugugauugagugauccuuguu

SEQ ID NO: 305652 - RNA, 22 nt, Homo sapiens
uugugcuugauuugccuagcug

SEQ ID NO: 305653 - RNA, 22 nt, Homo sapiens
uugugcuuuacuuacuaccaga

SEQ ID NO: 305654 - RNA, 22 nt, Homo sapiens
uugugguuuuaucuaccuuugg

SEQ ID NO: 305655 - RNA, 18 nt, Homo sapiens
uuuacaguagaaggacuu

SEQ ID NO: 305656 - RNA, 19 nt, Homo sapiens
uuucccugcagaccuacua

SEQ ID NO: 305657 - RNA, 22 nt, Homo sapiens
uuugaaccauuugaagaaugau

SEQ ID NO: 305658 - RNA, 22 nt, Homo sapiens
uuugacaaugugugcuuguauu

SEQ ID NO: 305659 - RNA, 22 nt, Homo sapiens
uuugagcaagaggugacauuau

SEQ ID NO: 305660 - RNA, 22 nt, Homo sapiens
uuugcagugucagcuucugugu

SEQ ID NO: 305661 - RNA, 22 nt, Homo sapiens
uuugggaaaugaaguugguaga

SEQ ID NO: 305662 - RNA, 22 nt, Homo sapiens
uuugguccaguguucagguccu

SEQ ID NO: 305663 - RNA, 21 nt, Homo sapiens
uuugugguuacugugugagcu

SEQ ID NO: 305664 - RNA, 20 nt, Homo sapiens
uuuuagcacuuguuauggug

SEQ ID NO: 305665 - RNA, 22 nt, Homo sapiens
uuuugguauauacggggguccu

SEQ ID NO: 305666 - RNA, 21 nt, Homo sapiens
uuuuggucauucaggaagaaa

SEQ ID NO: 305667 - RNA, 22 nt, Homo sapiens
uuuugguucaauuaauuugcua

SEQ ID NO: 305668 - RNA, 22 nt, Homo sapiens
gugagcagagaucgcgugauug

SEQ ID NO: 305669 - RNA, 22 nt, Homo sapiens
gugcacaacaugcagguuuguu

SEQ ID NO: 305670 - RNA, 22 nt, Homo sapiens
gugcacauauggugcauaagug

SEQ ID NO: 305671 - RNA, 23 nt, Homo sapiens
gugccuucugagccuagucucca

SEQ ID NO: 305672 - RNA, 22 nt, Homo sapiens
gugcuuuguuguggcaguggca

SEQ ID NO: 305673 - RNA, 22 nt, Homo sapiens
guggaagauaguguguuaaugu

SEQ ID NO: 305674 - RNA, 22 nt, Homo sapiens
guggaaguuaagugacuuucug

SEQ ID NO: 305675 - RNA, 22 nt, Homo sapiens
guggaaucuagagaggcaguag

SEQ ID NO: 305676 - RNA, 22 nt, Homo sapiens
guggcaaacucagcaugcccca

SEQ ID NO: 305677 - RNA, 21 nt, Homo sapiens
gugguucuagagaaacagaau

SEQ ID NO: 305678 - RNA, 23 nt, Homo sapiens
acugagcaauguuuacauacuug

SEQ ID NO: 305679 - RNA, 22 nt, Homo sapiens
acugcacuccagccucaugaca

SEQ ID NO: 305680 - RNA, 22 nt, Homo sapiens
acugcacuccagccugagccug

SEQ ID NO: 305681 - RNA, 22 nt, Homo sapiens
acugcacuccagccuggacgac

SEQ ID NO: 305682 - RNA, 22 nt, Homo sapiens
acugcacuccagccuugcgaca

SEQ ID NO: 305683 - RNA, 22 nt, Homo sapiens
agaauacugucuauucauggua

SEQ ID NO: 305684 - RNA, 22 nt, Homo sapiens
agagauaauuagguuaaaugag

SEQ ID NO: 305685 - RNA, 22 nt, Homo sapiens
agagcuaguauuuacggagcau

SEQ ID NO: 305686 - RNA, 21 nt, Homo sapiens
agaggacugaccacagcccua

SEQ ID NO: 305687 - RNA, 22 nt, Homo sapiens
agagguuuaacuggcuuauggu

SEQ ID NO: 305688 - RNA, 23 nt, Homo sapiens
agagguuuaaucaggcaguugcu

SEQ ID NO: 305689 - RNA, 22 nt, Homo sapiens
agagguuuaauugauucacagu

SEQ ID NO: 305690 - RNA, 22 nt, Homo sapiens
agauacauuggauaaugguggg

SEQ ID NO: 305691 - RNA, 22 nt, Homo sapiens
agaucauaugcaguaaugaacu

SEQ ID NO: 305692 - RNA, 22 nt, Homo sapiens
agaugauguuuacugagcauca

SEQ ID NO: 305693 - RNA, 20 nt, Homo sapiens
agaugcaugcacauaaacac

SEQ ID NO: 305694 - RNA, 22 nt, Homo sapiens
agcaccauuucucuaaagcacu

SEQ ID NO: 305695 - RNA, 19 nt, Homo sapiens
agcagaacaaauguguggg

SEQ ID NO: 305696 - RNA, 22 nt, Homo sapiens
agcagcauauuuuuauaaugua

SEQ ID NO: 305697 - RNA, 22 nt, Homo sapiens
agcagcauggguauaaaucucc

SEQ ID NO: 305698 - RNA, 22 nt, Homo sapiens
agcagcauuaugauauaucuua

SEQ ID NO: 305699 - RNA, 22 nt, Homo sapiens
agcagcauuccaaaaaucugcu

SEQ ID NO: 305700 - RNA, 22 nt, Homo sapiens
agcuaaaucucauguugaauug

SEQ ID NO: 305701 - RNA, 22 nt, Homo sapiens
agcuugugauuuagagugagag

SEQ ID NO: 305702 - RNA, 22 nt, Homo sapiens
agcuuguuuucccauaacuaga

SEQ ID NO: 305703 - RNA, 23 nt, Homo sapiens
aggaauggaaaaccaaguaucau

SEQ ID NO: 305704 - RNA, 22 nt, Homo sapiens
aggagaucagccucccugcaac

SEQ ID NO: 305705 - RNA, 22 nt, Homo sapiens
aggagcuuuggggaaaacagau

SEQ ID NO: 305706 - RNA, 22 nt, Homo sapiens
aggcauugugcaucgaugauuu

SEQ ID NO: 305707 - RNA, 22 nt, Homo sapiens
agguccauuauuuucauucaug

SEQ ID NO: 305708 - RNA, 22 nt, Homo sapiens
aggugguguuggguuccagccc

SEQ ID NO: 305709 - RNA, 22 nt, Homo sapiens
aggugguuuuaggcagagacau

SEQ ID NO: 305710 - RNA, 22 nt, Homo sapiens
aguaucaucuuguuggccaggc

SEQ ID NO: 305711 - RNA, 20 nt, Homo sapiens
aguauucacuuuuuucaugg

SEQ ID NO: 305712 - RNA, 22 nt, Homo sapiens
agugaucauuugaauugaugau

SEQ ID NO: 305713 - RNA, 22 nt, Homo sapiens
agugauuuuaacuuccagcaau

SEQ ID NO: 305714 - RNA, 19 nt, Homo sapiens
aguggguguuuucuguuug

SEQ ID NO: 305715 - RNA, 22 nt, Homo sapiens
aguguuuuuaacaagaaagggu

SEQ ID NO: 305716 - RNA, 21 nt, Homo sapiens
aguucacauggcuccuguguu

SEQ ID NO: 305717 - RNA, 22 nt, Homo sapiens
auagcagaagaagggacaauuc

SEQ ID NO: 305718 - RNA, 22 nt, Homo sapiens
auagcagcagcuaguagugaua

SEQ ID NO: 305719 - RNA, 20 nt, Homo sapiens
auagcagcaugauuuauagu

SEQ ID NO: 305720 - RNA, 22 nt, Homo sapiens
auagcagcucacuuauuuaugg

SEQ ID NO: 305721 - RNA, 22 nt, Homo sapiens
auagcauaucccacaugucaga

SEQ ID NO: 305722 - RNA, 21 nt, Homo sapiens
auagggcuuguugauaguuaa

SEQ ID NO: 305723 - RNA, 22 nt, Homo sapiens
auaugcauacauguaugcagga

SEQ ID NO: 305724 - RNA, 22 nt, Homo sapiens
auauguucucauucauaugugg

SEQ ID NO: 305725 - RNA, 18 nt, Homo sapiens
auauugcauuggauggau

SEQ ID NO: 305726 - RNA, 22 nt, Homo sapiens
aucaaauugucauuuuaaggau

SEQ ID NO: 305727 - RNA, 22 nt, Homo sapiens
aucagaaucucuagugggacca

SEQ ID NO: 305728 - RNA, 22 nt, Homo sapiens
aucagcauucccaaaugaugug

SEQ ID NO: 305729 - RNA, 22 nt, Homo sapiens
aucagucuguuggaauaucgcu

SEQ ID NO: 305730 - RNA, 22 nt, Homo sapiens
aucauccugucaggagcuguga

SEQ ID NO: 305731 - RNA, 22 nt, Homo sapiens
aucucaguuaauuccaucuuuc

SEQ ID NO: 305732 - RNA, 22 nt, Homo sapiens
augaaugcagcacuguuuuucu

SEQ ID NO: 305733 - RNA, 22 nt, Homo sapiens
augaaugcuuuuggauguaucu

SEQ ID NO: 305734 - RNA, 22 nt, Homo sapiens
augacauuccacagccguagag

SEQ ID NO: 305735 - RNA, 19 nt, Homo sapiens
augacauuuggggguggac

SEQ ID NO: 305736 - RNA, 22 nt, Homo sapiens
augagaucugugaacaccuguc

SEQ ID NO: 305737 - RNA, 22 nt, Homo sapiens
augagauuauguaaagagacca

SEQ ID NO: 305738 - RNA, 22 nt, Homo sapiens
augaggcacugcgcccuacuga

SEQ ID NO: 305739 - RNA, 22 nt, Homo sapiens
augauacugaguugaguucuca

SEQ ID NO: 305740 - RNA, 22 nt, Homo sapiens
augauacuggcuucauagaaug

SEQ ID NO: 305741 - RNA, 19 nt, Homo sapiens
augccuggagaugguuaua

SEQ ID NO: 305742 - RNA, 22 nt, Homo sapiens
augggugaguaugaguugacuu

SEQ ID NO: 305743 - RNA, 22 nt, Homo sapiens
auggugugugaauuaaauguua

SEQ ID NO: 305744 - RNA, 22 nt, Homo sapiens
augugcacauucugguaaauau

SEQ ID NO: 305745 - RNA, 22 nt, Homo sapiens
auguggcuuuccuagaucuuag

SEQ ID NO: 305746 - RNA, 20 nt, Homo sapiens
auguucuggaggacagaagc

SEQ ID NO: 305747 - RNA, 22 nt, Homo sapiens
auguugcaguuuaauuauccua

SEQ ID NO: 305748 - RNA, 22 nt, Homo sapiens
auucccuguagaauaaggaugg

SEQ ID NO: 305749 - RNA, 22 nt, Homo sapiens
auuccuuaggcccuuugguuag

SEQ ID NO: 305750 - RNA, 22 nt, Homo sapiens
auugagcaaggucuccuaguau

SEQ ID NO: 305751 - RNA, 22 nt, Homo sapiens
auugagcaauuccuaugugcuu

SEQ ID NO: 305752 - RNA, 22 nt, Homo sapiens
auugcacuccacccugggcaac

SEQ ID NO: 305753 - RNA, 22 nt, Homo sapiens
auugcacuccagccuggcaaua

SEQ ID NO: 305754 - RNA, 22 nt, Homo sapiens
auugcacuccauccugggcaau

SEQ ID NO: 305755 - RNA, 22 nt, Homo sapiens
auugcccaggcuggagugcagu

SEQ ID NO: 305756 - RNA, 22 nt, Homo sapiens
auuguacuccagccuaggcaac

SEQ ID NO: 305757 - RNA, 22 nt, Homo sapiens
auugucccucuuaaucccagca

SEQ ID NO: 305758 - RNA, 20 nt, Homo sapiens
auuguccuugauuacacaga

SEQ ID NO: 305759 - RNA, 22 nt, Homo sapiens
auugugauugcugcuaggccua

SEQ ID NO: 305760 - RNA, 22 nt, Homo sapiens
auuugggaaugugcauuauacu

SEQ ID NO: 305761 - RNA, 22 nt, Homo sapiens
auuuuugguugguaggcuauua

SEQ ID NO: 305762 - RNA, 22 nt, Homo sapiens
caaaagugauugcgguuuuugc

SEQ ID NO: 305763 - RNA, 22 nt, Homo sapiens
caaaguaauugcuguuuugcca

SEQ ID NO: 305764 - RNA, 22 nt, Homo sapiens
caacaguaaagcauuuuuaagu

SEQ ID NO: 305765 - RNA, 22 nt, Homo sapiens
caauggcacuauuggaaaaggu

SEQ ID NO: 305766 - RNA, 22 nt, Homo sapiens
cacaaaguagauuagucuucca

SEQ ID NO: 305767 - RNA, 22 nt, Homo sapiens
cacagucugggcuuguuuguac

SEQ ID NO: 305768 - RNA, 21 nt, Homo sapiens
cacauggaggcagagagugua

SEQ ID NO: 305769 - RNA, 22 nt, Homo sapiens
cacauguuugcuacauuuuucu

SEQ ID NO: 305770 - RNA, 22 nt, Homo sapiens
cagccggguggcuccuagggua

SEQ ID NO: 305771 - RNA, 22 nt, Homo sapiens
cagguaguauuugguuacauaa

SEQ ID NO: 305772 - RNA, 22 nt, Homo sapiens
cagguaguguguagcacagcag

SEQ ID NO: 305773 - RNA, 22 nt, Homo sapiens
caggugguauuugguuuucugu

SEQ ID NO: 305774 - RNA, 22 nt, Homo sapiens
caugaaagacugaggaauugga

SEQ ID NO: 305775 - RNA, 22 nt, Homo sapiens
guuauugcucucgaagacucuc

SEQ ID NO: 305776 - RNA, 22 nt, Homo sapiens
guucagguauucuggaacagag

SEQ ID NO: 305777 - RNA, 22 nt, Homo sapiens
guucuggagauaaagccaaggu

SEQ ID NO: 305778 - RNA, 22 nt, Homo sapiens
guuggcaaguggcugagcuggg

SEQ ID NO: 305779 - RNA, 22 nt, Homo sapiens
guuugguugcauggaaaauuua

SEQ ID NO: 305780 - RNA, 22 nt, Homo sapiens
guuuugguuauauggaucaguu

SEQ ID NO: 305781 - RNA, 22 nt, Homo sapiens
uaaagcuacaguauaugguauu

SEQ ID NO: 305782 - RNA, 22 nt, Homo sapiens
uaagaauucuguccgguauacu

SEQ ID NO: 305783 - RNA, 22 nt, Homo sapiens
uaagguuuuugauaugcugcug

SEQ ID NO: 305784 - RNA, 22 nt, Homo sapiens
uaaugcuguggucugguuuaaa

SEQ ID NO: 305785 - RNA, 22 nt, Homo sapiens
uaaugcuugguuguuuggaaaa

SEQ ID NO: 305786 - RNA, 22 nt, Homo sapiens
uacagguauagauguguguucu

SEQ ID NO: 305787 - RNA, 22 nt, Homo sapiens
uacaguacagugacaccauuau

SEQ ID NO: 305788 - RNA, 22 nt, Homo sapiens
uacuagaguagugcagagggga

SEQ ID NO: 305789 - RNA, 22 nt, Homo sapiens
uacucacauucuguuucuugcu

SEQ ID NO: 305790 - RNA, 22 nt, Homo sapiens
uacugcacuccagccuugccaa

SEQ ID NO: 305791 - RNA, 22 nt, Homo sapiens
uagacaacugaaacacugugca

SEQ ID NO: 305792 - RNA, 22 nt, Homo sapiens
uagauuauuggcugauuugauc

SEQ ID NO: 305793 - RNA, 21 nt, Homo sapiens
uagcaaauugcuauuaaggca

SEQ ID NO: 305794 - RNA, 22 nt, Homo sapiens
uagcacaucccuaaaaugcugu

SEQ ID NO: 305795 - RNA, 22 nt, Homo sapiens
uagcaccucuuuggccuuucgu

SEQ ID NO: 305796 - RNA, 22 nt, Homo sapiens
uagcagcaaagcaggaucugcu

SEQ ID NO: 305797 - RNA, 22 nt, Homo sapiens
uagcagcaccccacucuacugg

SEQ ID NO: 305798 - RNA, 22 nt, Homo sapiens
uagcagcauaaauggacuaaga

SEQ ID NO: 305799 - RNA, 22 nt, Homo sapiens
uagcauggagucaugcacggcu

SEQ ID NO: 305800 - RNA, 22 nt, Homo sapiens
uagccgggugugguggaacucc

SEQ ID NO: 305801 - RNA, 20 nt, Homo sapiens
uagccggguguugugucaug

SEQ ID NO: 305802 - RNA, 22 nt, Homo sapiens
uaguauguuuauagcauugagu

SEQ ID NO: 305803 - RNA, 22 nt, Homo sapiens
uauagcacaucuguguguacau

SEQ ID NO: 305804 - RNA, 22 nt, Homo sapiens
uauagcacugaaagaggugauu

SEQ ID NO: 305805 - RNA, 22 nt, Homo sapiens
uauagcacugagaauguaauuc

SEQ ID NO: 305806 - RNA, 22 nt, Homo sapiens
uauagcauuuugauccuguaga

SEQ ID NO: 305807 - RNA, 22 nt, Homo sapiens
uaucacacgccuugcuucauuu

SEQ ID NO: 305808 - RNA, 22 nt, Homo sapiens
uaucacacuguuggauuugauu

SEQ ID NO: 305809 - RNA, 23 nt, Homo sapiens
uaucacacuuucucugugccaca

SEQ ID NO: 305810 - RNA, 22 nt, Homo sapiens
uaucacagauucuccaggguuu

SEQ ID NO: 305811 - RNA, 22 nt, Homo sapiens
uaucauaguuuggacuuucauu

SEQ ID NO: 305812 - RNA, 22 nt, Homo sapiens
uaucauugccucaaucuguauu

SEQ ID NO: 305813 - RNA, 22 nt, Homo sapiens
uaucucuguggguagugcugaa

SEQ ID NO: 305814 - RNA, 21 nt, Homo sapiens
uauggcuuagucaguguuucc

SEQ ID NO: 305815 - RNA, 22 nt, Homo sapiens
uauuacuugucugugucucaau

SEQ ID NO: 305816 - RNA, 18 nt, Homo sapiens
uauugcuugguuuggaga

SEQ ID NO: 305817 - RNA, 20 nt, Homo sapiens
uauuugguuauuuccauggu

SEQ ID NO: 305818 - RNA, 22 nt, Homo sapiens
ucaacauugcugucaggcaucu

SEQ ID NO: 305819 - RNA, 18 nt, Homo sapiens
ucaagcaauugucaugcc

SEQ ID NO: 305820 - RNA, 22 nt, Homo sapiens
ucacaauucucaauuugugaaa

SEQ ID NO: 305821 - RNA, 22 nt, Homo sapiens
ucacugaaaccgccuccaccuc

SEQ ID NO: 305822 - RNA, 22 nt, Homo sapiens
ucacuguguauguauaugcagg

SEQ ID NO: 305823 - RNA, 22 nt, Homo sapiens
ucagcagugugaaaacaaacua

SEQ ID NO: 305824 - RNA, 18 nt, Homo sapiens
ucauagaucaugacagug

SEQ ID NO: 305825 - RNA, 22 nt, Homo sapiens
ucauguauuaucauuagugggu

SEQ ID NO: 305826 - RNA, 22 nt, Homo sapiens
ucauucuuucuguggaggggcu

SEQ ID NO: 305827 - RNA, 22 nt, Homo sapiens
uccagugugcaggcaaguuuga

SEQ ID NO: 305828 - RNA, 20 nt, Homo sapiens
uccaguuuuggagacauucu

SEQ ID NO: 305829 - RNA, 22 nt, Homo sapiens
ucccugagcaaaguuuucugua

SEQ ID NO: 305830 - RNA, 22 nt, Homo sapiens
ucccugaguaucuaauguguuu

SEQ ID NO: 305831 - RNA, 19 nt, Homo sapiens
ucccugagucuuagcuuga

SEQ ID NO: 305832 - RNA, 22 nt, Homo sapiens
ucccuguuguuucauaauuuua

SEQ ID NO: 305833 - RNA, 22 nt, Homo sapiens
ucucacauuucacagggauggg

SEQ ID NO: 305834 - RNA, 17 nt, Homo sapiens
ucucccaucccuuucuc

SEQ ID NO: 305835 - RNA, 22 nt, Homo sapiens
ucucuggauaucuacuuauguu

SEQ ID NO: 305836 - RNA, 19 nt, Homo sapiens
ucucugguguuggagggga

SEQ ID NO: 305837 - RNA, 22 nt, Homo sapiens
ucucuugguugaacaguuugga

SEQ ID NO: 305838 - RNA, 22 nt, Homo sapiens
ucugacagugagagaaaucuga

SEQ ID NO: 305839 - RNA, 22 nt, Homo sapiens
ucugacucuggagucucagguu

SEQ ID NO: 305840 - RNA, 22 nt, Homo sapiens
ucugggguuagucaaagguaug

SEQ ID NO: 305841 - RNA, 22 nt, Homo sapiens
ucugucuuugucaggaccagag

SEQ ID NO: 305842 - RNA, 22 nt, Homo sapiens
ucugugaaugaacacuugaaaa

SEQ ID NO: 305843 - RNA, 22 nt, Homo sapiens
ucugugaaugugaccuuauuug

SEQ ID NO: 305844 - RNA, 22 nt, Homo sapiens
ucugugguuguugcauggaaug

SEQ ID NO: 305845 - RNA, 22 nt, Homo sapiens
ucuguugguucuuugaggagga

SEQ ID NO: 305846 - RNA, 22 nt, Homo sapiens
ucuuaggauacugaagucgguu

SEQ ID NO: 305847 - RNA, 22 nt, Homo sapiens
ucuugcuuuugcagagcuucuc

SEQ ID NO: 305848 - RNA, 21 nt, Homo sapiens
ucuuggguugaauucucccag

SEQ ID NO: 305849 - RNA, 22 nt, Homo sapiens
ucuuucacuuagcaugauguuu

SEQ ID NO: 305850 - RNA, 22 nt, Homo sapiens
ucuuugaguguauacuuagauu

SEQ ID NO: 305851 - RNA, 22 nt, Homo sapiens
ugaaacacacagagaagggaga

SEQ ID NO: 305852 - RNA, 22 nt, Homo sapiens
ugaaacugcagugggcuuggca

SEQ ID NO: 305853 - RNA, 22 nt, Homo sapiens
ugaagaucuuaggagcugaggg

SEQ ID NO: 305854 - RNA, 22 nt, Homo sapiens
ugaauacugugcaaaggauuug

SEQ ID NO: 305855 - RNA, 22 nt, Homo sapiens
ugaauacuucaaaaaaauagcu

SEQ ID NO: 305856 - RNA, 22 nt, Homo sapiens
ugaaugcaucauguagggcuca

SEQ ID NO: 305857 - RNA, 22 nt, Homo sapiens
ugaaugcaucuagaaauuuauu

SEQ ID NO: 305858 - RNA, 22 nt, Homo sapiens
ugaaugcauggggccaagaagg

SEQ ID NO: 305859 - RNA, 22 nt, Homo sapiens
ugacauguugcauuauauuucc

SEQ ID NO: 305860 - RNA, 22 nt, Homo sapiens
ugacauuacagucacuugcugu

SEQ ID NO: 305861 - RNA, 21 nt, Homo sapiens
ugacauuauuucaugucagua

SEQ ID NO: 305862 - RNA, 22 nt, Homo sapiens
ugacucaguuguuagucuucau

SEQ ID NO: 305863 - RNA, 22 nt, Homo sapiens
ugacuuaugcaacucugaugug

SEQ ID NO: 305864 - RNA, 18 nt, Homo sapiens
ugagaacauguguacaca

SEQ ID NO: 305865 - RNA, 22 nt, Homo sapiens
ugagaucuucgcucuucacaga

SEQ ID NO: 305866 - RNA, 22 nt, Homo sapiens
ugagaugaaagcagaaagacuu

SEQ ID NO: 305867 - RNA, 22 nt, Homo sapiens
ugagauuguucuaugucugguu

SEQ ID NO: 305868 - RNA, 22 nt, Homo sapiens
ugagcagaaagcugcaaggucg

SEQ ID NO: 305869 - RNA, 22 nt, Homo sapiens
ugagcagaaguuuugauuggcg

SEQ ID NO: 305870 - RNA, 22 nt, Homo sapiens
ugagcagagaagugcccugcgc

SEQ ID NO: 305871 - RNA, 22 nt, Homo sapiens
ugagcagagggagaaguaaauu

SEQ ID NO: 305872 - RNA, 22 nt, Homo sapiens
uugugaaugaugccgcaauaaa

SEQ ID NO: 305873 - RNA, 22 nt, Homo sapiens
uugugaaugaugucgcaauaaa

SEQ ID NO: 305874 - RNA, 22 nt, Homo sapiens
uugugaauggaguagcaggauc

SEQ ID NO: 305875 - RNA, 22 nt, Homo sapiens
uugugaauggugccgcaguaaa

SEQ ID NO: 305876 - RNA, 22 nt, Homo sapiens
uugugguuuucagcuuauauau

SEQ ID NO: 305877 - RNA, 22 nt, Homo sapiens
uuguuugguugaguauggaagu

SEQ ID NO: 305878 - RNA, 22 nt, Homo sapiens
uuuaaagcacggaguuuguggc

SEQ ID NO: 305879 - RNA, 22 nt, Homo sapiens
uuuaaagcaugacgagaagaag

SEQ ID NO: 305880 - RNA, 22 nt, Homo sapiens
uuuaaagcuaaaauauguuuau

SEQ ID NO: 305881 - RNA, 22 nt, Homo sapiens
uuuacagucucauagguggaag

SEQ ID NO: 305882 - RNA, 22 nt, Homo sapiens
uuuacaguuuucuaggcuacca

SEQ ID NO: 305883 - RNA, 22 nt, Homo sapiens
uuucaacuaauuuuuuggugag

SEQ ID NO: 305884 - RNA, 21 nt, Homo sapiens
uuucacugugaguuuuucugu

SEQ ID NO: 305885 - RNA, 22 nt, Homo sapiens
uuucauagaucaugcuuuugga

SEQ ID NO: 305886 - RNA, 16 nt, Homo sapiens
uuucaucaguuuuaau

SEQ ID NO: 305887 - RNA, 22 nt, Homo sapiens
uuucauggacgcaaugccuuuu

SEQ ID NO: 305888 - RNA, 23 nt, Homo sapiens
uuucauggggauuuacucauucc

SEQ ID NO: 305889 - RNA, 18 nt, Homo sapiens
uuucauugagugugauau

SEQ ID NO: 305890 - RNA, 22 nt, Homo sapiens
uuucccugaaggcucugaaguc

SEQ ID NO: 305891 - RNA, 22 nt, Homo sapiens
uuuccuggagaaucuuaacaaa

SEQ ID NO: 305892 - RNA, 17 nt, Homo sapiens
uuucucagcccucuucu

SEQ ID NO: 305893 - RNA, 22 nt, Homo sapiens
uuucugagaccaaaacuuguaa

SEQ ID NO: 305894 - RNA, 22 nt, Homo sapiens
uuucuuggagcucuuagggucg

SEQ ID NO: 305895 - RNA, 20 nt, Homo sapiens
uuugaauguaaagcauguca

SEQ ID NO: 305896 - RNA, 22 nt, Homo sapiens
uuugauguccaccucagcccac

SEQ ID NO: 305897 - RNA, 22 nt, Homo sapiens
uuugggaaugaguuuaucauuu

SEQ ID NO: 305898 - RNA, 22 nt, Homo sapiens
uuuggguuaguuuuccaaucuu

SEQ ID NO: 305899 - RNA, 18 nt, Homo sapiens
uuugguccuuuauaaaca

SEQ ID NO: 305900 - RNA, 22 nt, Homo sapiens
uuugugagguggauagauugca

SEQ ID NO: 305901 - RNA, 22 nt, Homo sapiens
uuugugauugcacacucaagau

SEQ ID NO: 305902 - RNA, 22 nt, Homo sapiens
uuuugcuugugaauagccacau

SEQ ID NO: 305903 - RNA, 22 nt, Homo sapiens
uuuugcuuuuccucggucccac

SEQ ID NO: 305904 - RNA, 22 nt, Homo sapiens
uuuuggcacuuugucugauucu

SEQ ID NO: 305905 - RNA, 22 nt, Homo sapiens
uuuuggcucugucuguaucuuu

SEQ ID NO: 305906 - RNA, 22 nt, Homo sapiens
uuuuggugguuaugugucaaug

SEQ ID NO: 305907 - RNA, 22 nt, Homo sapiens
uuuugguguacaauucuaugga

SEQ ID NO: 305908 - RNA, 22 nt, Homo sapiens
uuuugguuaggauggguggcau

SEQ ID NO: 305909 - RNA, 22 nt, Homo sapiens
uuuugucccaugggcuguuccc

SEQ ID NO: 305910 - RNA, 21 nt, Homo sapiens
uuuuugguggucauggauaga

SEQ ID NO: 305911 - RNA, 22 nt, Homo sapiens
uaagguuacaaaggacuucaua

SEQ ID NO: 305912 - RNA, 22 nt, Homo sapiens
aacucugucuccuucaaguuca

SEQ ID NO: 305913 - RNA, 19 nt, Homo sapiens
aacuggugugagaugauau

SEQ ID NO: 305914 - RNA, 22 nt, Homo sapiens
aagagcauuauuuaguaauuuc

SEQ ID NO: 305915 - RNA, 22 nt, Homo sapiens
aagcaugguuuccaggggucac

SEQ ID NO: 305916 - RNA, 22 nt, Homo sapiens
auagcacauggcauccucucuu

SEQ ID NO: 305917 - RNA, 20 nt, Homo sapiens
auagcagcaugauuuauaau

SEQ ID NO: 305918 - RNA, 22 nt, Homo sapiens
auagcagugugaaaauggacua

SEQ ID NO: 305919 - RNA, 22 nt, Homo sapiens
auagcauagucagcuucgcuga

SEQ ID NO: 305920 - RNA, 22 nt, Homo sapiens
auagcaucauuucuugaaaaga

SEQ ID NO: 305921 - RNA, 20 nt, Homo sapiens
auagcauugauggacucaaa

SEQ ID NO: 305922 - RNA, 19 nt, Homo sapiens
auagggcuagcauauacug

SEQ ID NO: 305923 - RNA, 20 nt, Homo sapiens
auaugcauguguuuucacuu

SEQ ID NO: 305924 - RNA, 22 nt, Homo sapiens
auauggguuuuauauuaggcuc

SEQ ID NO: 305925 - RNA, 22 nt, Homo sapiens
auauugacuuucucuuagauca

SEQ ID NO: 305926 - RNA, 22 nt, Homo sapiens
aucaccuuucccuuucugaauc

SEQ ID NO: 305927 - RNA, 19 nt, Homo sapiens
aucagcacaagugugcuuu

SEQ ID NO: 305928 - RNA, 22 nt, Homo sapiens
aucccugaggaauuucugcacu

SEQ ID NO: 305929 - RNA, 20 nt, Homo sapiens
aucucugggcaaaggaaaau

SEQ ID NO: 305930 - RNA, 21 nt, Homo sapiens
aucugugagaccuuggggguu

SEQ ID NO: 305931 - RNA, 22 nt, Homo sapiens
augaaagugauaaaugucucua

SEQ ID NO: 305932 - RNA, 22 nt, Homo sapiens
augacauugaugcucuggcugg

SEQ ID NO: 305933 - RNA, 22 nt, Homo sapiens
augacugucagggcagucauug

SEQ ID NO: 305934 - RNA, 22 nt, Homo sapiens
augagaauguaaguuaaugaaa

SEQ ID NO: 305935 - RNA, 22 nt, Homo sapiens
augagacuagaagagaauaaua

SEQ ID NO: 305936 - RNA, 22 nt, Homo sapiens
augagauuguuugugugaaaua

SEQ ID NO: 305937 - RNA, 22 nt, Homo sapiens
augagcacuuguuuugggcaca

SEQ ID NO: 305938 - RNA, 22 nt, Homo sapiens
augaggaaggagccuuugucug

SEQ ID NO: 305939 - RNA, 22 nt, Homo sapiens
augaggcaggaaaggcguaucu

SEQ ID NO: 305940 - RNA, 22 nt, Homo sapiens
augauacuguucuaagauuuuu

SEQ ID NO: 305941 - RNA, 22 nt, Homo sapiens
augaucaucugaaagcuuuuac

SEQ ID NO: 305942 - RNA, 22 nt, Homo sapiens
augcagugugcaacagauuaag

SEQ ID NO: 305943 - RNA, 22 nt, Homo sapiens
augcauggagucuuucacaagu

SEQ ID NO: 305944 - RNA, 22 nt, Homo sapiens
auggaacauaacuauuugggga

SEQ ID NO: 305945 - RNA, 22 nt, Homo sapiens
auggaacauuauagauguaaaa

SEQ ID NO: 305946 - RNA, 22 nt, Homo sapiens
auggaagaaacgauuuucugga

SEQ ID NO: 305947 - RNA, 22 nt, Homo sapiens
auggaagacuccucuuugggua

SEQ ID NO: 305948 - RNA, 22 nt, Homo sapiens
auggaagucucuguuaaguuuc

SEQ ID NO: 305949 - RNA, 22 nt, Homo sapiens
auggauuuugaacuugagaguu

SEQ ID NO: 305950 - RNA, 22 nt, Homo sapiens
auggcagcccucuuuauccaug

SEQ ID NO: 305951 - RNA, 22 nt, Homo sapiens
auggcuguuuaagaguuucauu

SEQ ID NO: 305952 - RNA, 22 nt, Homo sapiens
augggauaguaucaguggaaua

SEQ ID NO: 305953 - RNA, 22 nt, Homo sapiens
augggucuccugaauacagcac

SEQ ID NO: 305954 - RNA, 22 nt, Homo sapiens
augguuuuacugcaaaauggga

SEQ ID NO: 305955 - RNA, 22 nt, Homo sapiens
auguagauaucaagaggcauau

SEQ ID NO: 305956 - RNA, 22 nt, Homo sapiens
auguagugugauuuucacuaga

SEQ ID NO: 305957 - RNA, 22 nt, Homo sapiens
auguccauggaaucuguagcaa

SEQ ID NO: 305958 - RNA, 22 nt, Homo sapiens
auguggaaauguauaugugucu

SEQ ID NO: 305959 - RNA, 19 nt, Homo sapiens
augugguuagcaugacugc

SEQ ID NO: 305960 - RNA, 22 nt, Homo sapiens
auuaaucaggcaaugcuugcua

SEQ ID NO: 305961 - RNA, 22 nt, Homo sapiens
auucaucagggauauuggucug

SEQ ID NO: 305962 - RNA, 22 nt, Homo sapiens
auucaucagggauauugguuga

SEQ ID NO: 305963 - RNA, 22 nt, Homo sapiens
auugacacugauuuuucuuuaa

SEQ ID NO: 305964 - RNA, 22 nt, Homo sapiens
auugcacuccagccugggcagc

SEQ ID NO: 305965 - RNA, 22 nt, Homo sapiens
cacccaguaagcaugaggcccu

SEQ ID NO: 305966 - RNA, 22 nt, Homo sapiens
cagcccguaaucccagcacuuu

SEQ ID NO: 305967 - RNA, 22 nt, Homo sapiens
cagcuguuguuaugucugcagg

SEQ ID NO: 305968 - RNA, 22 nt, Homo sapiens
caguucaugguaggcaccauag

SEQ ID NO: 305969 - RNA, 22 nt, Homo sapiens
cauaugguuuuauguucuucau

SEQ ID NO: 305970 - RNA, 19 nt, Homo sapiens
ugagauuguaugaggagau

SEQ ID NO: 305971 - RNA, 22 nt, Homo sapiens
ugagguguuaacuuuacuuuua

SEQ ID NO: 305972 - RNA, 22 nt, Homo sapiens
ugaugguuuuauuaauaggacc

SEQ ID NO: 305973 - RNA, 22 nt, Homo sapiens
ugcaaaucuuguguaguuguga

SEQ ID NO: 305974 - RNA, 22 nt, Homo sapiens
ugcagcauugcacuccagccug

SEQ ID NO: 305975 - RNA, 22 nt, Homo sapiens
ugcaguaggcccagcgggaggc

SEQ ID NO: 305976 - RNA, 22 nt, Homo sapiens
ugccuaguggaaggagagcaaa

SEQ ID NO: 305977 - RNA, 22 nt, Homo sapiens
ugccuggagagcuccuacauau

SEQ ID NO: 305978 - RNA, 22 nt, Homo sapiens
ugcuuuguuauauggggauucu

SEQ ID NO: 305979 - RNA, 20 nt, Homo sapiens
uggaaaguaagucaugauau

SEQ ID NO: 305980 - RNA, 22 nt, Homo sapiens
uggaagucuauggcauuugagu

SEQ ID NO: 305981 - RNA, 21 nt, Homo sapiens
uggaccccuuccuuacaucau

SEQ ID NO: 305982 - RNA, 22 nt, Homo sapiens
uggacuagagggugggcgaggu

SEQ ID NO: 305983 - RNA, 23 nt, Homo sapiens
uggaggacaagcauggauaguga

SEQ ID NO: 305984 - RNA, 22 nt, Homo sapiens
uggagguagacauugggaagag

SEQ ID NO: 305985 - RNA, 22 nt, Homo sapiens
uggagucuugaugauuuucaaa

SEQ ID NO: 305986 - RNA, 22 nt, Homo sapiens
uggagucuugcucuguugccca

SEQ ID NO: 305987 - RNA, 22 nt, Homo sapiens
uggauuuuaauuauucugucau

SEQ ID NO: 305988 - RNA, 22 nt, Homo sapiens
uggcaaaugugagaugagaacu

SEQ ID NO: 305989 - RNA, 22 nt, Homo sapiens
uggcuacugacugaugauuaua

SEQ ID NO: 305990 - RNA, 22 nt, Homo sapiens
uggcuuuuaucuacucucaacu

SEQ ID NO: 305991 - RNA, 22 nt, Homo sapiens
ugggaugaauacaaugggauca

SEQ ID NO: 305992 - RNA, 22 nt, Homo sapiens
ugggaugaugaaaaggcuuucu

SEQ ID NO: 305993 - RNA, 22 nt, Homo sapiens
uggguagaugaauccauuccaa

SEQ ID NO: 305994 - RNA, 22 nt, Homo sapiens
ugguaaaaugucauuuaccaga

SEQ ID NO: 305995 - RNA, 22 nt, Homo sapiens
ugguaccuuuuaaugacuaauu

SEQ ID NO: 305996 - RNA, 15 nt, Homo sapiens
uggugguguugagac

SEQ ID NO: 305997 - RNA, 22 nt, Homo sapiens
ugucaaauucuggguuaaaaca

SEQ ID NO: 305998 - RNA, 22 nt, Homo sapiens
ugucagcacaacucagguuccu

SEQ ID NO: 305999 - RNA, 22 nt, Homo sapiens
ugugccaaaucccauaauaaau

SEQ ID NO: 306000 - RNA, 22 nt, Homo sapiens
uguggcaaagucuugugaauau

SEQ ID NO: 306001 - RNA, 22 nt, Homo sapiens
uguggcagugcuuuaugaaacc

SEQ ID NO: 306002 - RNA, 19 nt, Homo sapiens
uguugcacauaucaauaug

SEQ ID NO: 306003 - RNA, 22 nt, Homo sapiens
uuaaucugucuaugauuuuggu

SEQ ID NO: 306004 - RNA, 22 nt, Homo sapiens
uuacagauggauggcagcuggc

SEQ ID NO: 306005 - RNA, 22 nt, Homo sapiens
uuagagcacugaucugcucuuu

SEQ ID NO: 306006 - RNA, 22 nt, Homo sapiens
uuagcacaguucauucauguua

SEQ ID NO: 306007 - RNA, 22 nt, Homo sapiens
uuagcagcacaaaagcagacua

SEQ ID NO: 306008 - RNA, 22 nt, Homo sapiens
uuaucauagugcaguuuucuga

SEQ ID NO: 306009 - RNA, 22 nt, Homo sapiens
uuaugacaggcucaggagcccc

SEQ ID NO: 306010 - RNA, 22 nt, Homo sapiens
uucaaaaccucugcuuaagccc

SEQ ID NO: 306011 - RNA, 22 nt, Homo sapiens
uucaaggacuaaggauuuuugg

SEQ ID NO: 306012 - RNA, 22 nt, Homo sapiens
auugcacugcagccugggcaac

SEQ ID NO: 306013 - RNA, 22 nt, Homo sapiens
auuuggcauagaguaucauucu

SEQ ID NO: 306014 - RNA, 22 nt, Homo sapiens
auuuggguaaugagugcaaggg

SEQ ID NO: 306015 - RNA, 22 nt, Homo sapiens
auuuugguuacauaguugagcu

SEQ ID NO: 306016 - RNA, 22 nt, Homo sapiens
caaaagugguucuuauccuuuu

SEQ ID NO: 306017 - RNA, 22 nt, Homo sapiens
caaagugguuuauacaugauug

SEQ ID NO: 306018 - RNA, 19 nt, Homo sapiens
caaaguguucuucuuugcc

SEQ ID NO: 306019 - RNA, 22 nt, Homo sapiens
caagugcuugaugaaugaucaa

SEQ ID NO: 306020 - RNA, 22 nt, Homo sapiens
cagagguaagcaagucagcauu

SEQ ID NO: 306021 - RNA, 20 nt, Homo sapiens
cagggcaaugaggagguaaa

SEQ ID NO: 306022 - RNA, 19 nt, Homo sapiens
cagguagugugcugacaug

SEQ ID NO: 306023 - RNA, 22 nt, Homo sapiens
caggugaaugccucuccuucug

SEQ ID NO: 306024 - RNA, 22 nt, Homo sapiens
cauggcacaucuuuucugacua

SEQ ID NO: 306025 - RNA, 22 nt, Homo sapiens
cauggcuuguauaagauucuca

SEQ ID NO: 306026 - RNA, 22 nt, Homo sapiens
cauugcaaugaggucuugcagu

SEQ ID NO: 306027 - RNA, 22 nt, Homo sapiens
cauugucccucaaugucuauga

SEQ ID NO: 306028 - RNA, 22 nt, Homo sapiens
ccagaguuucugauucagcagg

SEQ ID NO: 306029 - RNA, 22 nt, Homo sapiens
ccaggguugagacccacugacu

SEQ ID NO: 306030 - RNA, 19 nt, Homo sapiens
ccaguguucugauugcacu

SEQ ID NO: 306031 - RNA, 21 nt, Homo sapiens
ccugaagaagugaccucugag

SEQ ID NO: 306032 - RNA, 18 nt, Homo sapiens
cuaauacuauucaacaag

SEQ ID NO: 306033 - RNA, 22 nt, Homo sapiens
cuacagcagcccaguccccgaa

SEQ ID NO: 306034 - RNA, 22 nt, Homo sapiens
cuaggaaguauguguuauugcu

SEQ ID NO: 306035 - RNA, 19 nt, Homo sapiens
cuauugcacauagcugaag

SEQ ID NO: 306036 - RNA, 20 nt, Homo sapiens
cucaccagguguaggcugag

SEQ ID NO: 306037 - RNA, 22 nt, Homo sapiens
cucaccuugugauccuccugcc

SEQ ID NO: 306038 - RNA, 22 nt, Homo sapiens
cucagucuaugauacuuugcua

SEQ ID NO: 306039 - RNA, 23 nt, Homo sapiens
cucccugaacaugacacaccaga

SEQ ID NO: 306040 - RNA, 22 nt, Homo sapiens
cucucaguguggaggccagaaa

SEQ ID NO: 306041 - RNA, 22 nt, Homo sapiens
cucucuguuugucuguuauugg

SEQ ID NO: 306042 - RNA, 22 nt, Homo sapiens
cucuuugaggugagcugcccau

SEQ ID NO: 306043 - RNA, 22 nt, Homo sapiens
cugacauggggauccaccuuag

SEQ ID NO: 306044 - RNA, 22 nt, Homo sapiens
cugagacacucuuaucugcaua

SEQ ID NO: 306045 - RNA, 22 nt, Homo sapiens
cugaggugggaggauuacuuga

SEQ ID NO: 306046 - RNA, 22 nt, Homo sapiens
cuggagcauugguggauuuguu

SEQ ID NO: 306047 - RNA, 22 nt, Homo sapiens
cuggaguuugaggcugcaguga

SEQ ID NO: 306048 - RNA, 22 nt, Homo sapiens
cugggaugugacuguugccccc

SEQ ID NO: 306049 - RNA, 22 nt, Homo sapiens
cugggcaaugcggcuggauaga

SEQ ID NO: 306050 - RNA, 22 nt, Homo sapiens
cugugauuauauaguuaaggua

SEQ ID NO: 306051 - RNA, 22 nt, Homo sapiens
cuucaaaguuggcuaggagaca

SEQ ID NO: 306052 - RNA, 22 nt, Homo sapiens
cuugccuaaucugcaugauuuu

SEQ ID NO: 306053 - RNA, 22 nt, Homo sapiens
cuuugggaccgcgguuuauacu

SEQ ID NO: 306054 - RNA, 23 nt, Homo sapiens
cuuugguaggaaauuugaauuau

SEQ ID NO: 306055 - RNA, 22 nt, Homo sapiens
cuuuuacacugguggugggaau

SEQ ID NO: 306056 - RNA, 20 nt, Homo sapiens
cuuuuagcagcagcaagaga

SEQ ID NO: 306057 - RNA, 22 nt, Homo sapiens
gaaaugcucagggguuuuccag

SEQ ID NO: 306058 - RNA, 22 nt, Homo sapiens
gaaauggaucagagcaagcuuu

SEQ ID NO: 306059 - RNA, 22 nt, Homo sapiens
cacuguggauggaacuauguga

SEQ ID NO: 306060 - RNA, 22 nt, Homo sapiens
cagcaaaucauccuauuugagc

SEQ ID NO: 306061 - RNA, 22 nt, Homo sapiens
cagcagguuuuuaucaguuaag

SEQ ID NO: 306062 - RNA, 22 nt, Homo sapiens
cagccgggugagguggcuuguu

SEQ ID NO: 306063 - RNA, 22 nt, Homo sapiens
cagggcauuggcugguaccugg

SEQ ID NO: 306064 - RNA, 22 nt, Homo sapiens
cauauaguaggugcucuguguu

SEQ ID NO: 306065 - RNA, 22 nt, Homo sapiens
caucaaaguggagggaaggacc

SEQ ID NO: 306066 - RNA, 22 nt, Homo sapiens
caucacacuuggauguaagaca

SEQ ID NO: 306067 - RNA, 22 nt, Homo sapiens
guuuggcuuucucucuauccug

SEQ ID NO: 306068 - RNA, 22 nt, Homo sapiens
uaaagcuuagauccaugguggc

SEQ ID NO: 306069 - RNA, 21 nt, Homo sapiens
uaaagcuuagcuauaguggcu

SEQ ID NO: 306070 - RNA, 22 nt, Homo sapiens
uaacagucaagguuugaccagg

SEQ ID NO: 306071 - RNA, 22 nt, Homo sapiens
uaacaguggucugugguaucug

SEQ ID NO: 306072 - RNA, 20 nt, Homo sapiens
uaagugcuuuauauugauua

SEQ ID NO: 306073 - RNA, 22 nt, Homo sapiens
uaauacugcugugcuugaguug

SEQ ID NO: 306074 - RNA, 22 nt, Homo sapiens
uaccuaguaggagggaggugga

SEQ ID NO: 306075 - RNA, 22 nt, Homo sapiens
uacuucauucuugaccuugcau

SEQ ID NO: 306076 - RNA, 23 nt, Homo sapiens
uagcaacaguuggaggugaggua

SEQ ID NO: 306077 - RNA, 22 nt, Homo sapiens
uagcaccacaaucaagauacag

SEQ ID NO: 306078 - RNA, 22 nt, Homo sapiens
uaggaucauuuuauguugccca

SEQ ID NO: 306079 - RNA, 22 nt, Homo sapiens
uaguaucacauggucuuaauua

SEQ ID NO: 306080 - RNA, 22 nt, Homo sapiens
uagugaauguuggcuauuaaua

SEQ ID NO: 306081 - RNA, 19 nt, Homo sapiens
uaucaaguaugcacuguac

SEQ ID NO: 306082 - RNA, 22 nt, Homo sapiens
uaucacagcauugucuauaaua

SEQ ID NO: 306083 - RNA, 22 nt, Homo sapiens
uaucacaggucaggaaucuugc

SEQ ID NO: 306084 - RNA, 22 nt, Homo sapiens
uaucucagaugagacuuguaac

SEQ ID NO: 306085 - RNA, 22 nt, Homo sapiens
uaugaucacuacagcagggaug

SEQ ID NO: 306086 - RNA, 21 nt, Homo sapiens
uaugguuucuaauucugcagg

SEQ ID NO: 306087 - RNA, 22 nt, Homo sapiens
uaugguuuuggaauccugcaga

SEQ ID NO: 306088 - RNA, 22 nt, Homo sapiens
uauuacugucaauaucacagaa

SEQ ID NO: 306089 - RNA, 22 nt, Homo sapiens
uauugauuuucaguguucagcu

SEQ ID NO: 306090 - RNA, 22 nt, Homo sapiens
uauugccucagugacuuugggg

SEQ ID NO: 306091 - RNA, 22 nt, Homo sapiens
ucaaaucaucuuuuccaaagcu

SEQ ID NO: 306092 - RNA, 22 nt, Homo sapiens
ucaaaugcacguagagaaaaua

SEQ ID NO: 306093 - RNA, 22 nt, Homo sapiens
ucaaaugcuguauuguaguaau

SEQ ID NO: 306094 - RNA, 22 nt, Homo sapiens
ucaagcaauucuccucucagcc

SEQ ID NO: 306095 - RNA, 22 nt, Homo sapiens
ucacaauucucaauuugugaaa

SEQ ID NO: 306096 - RNA, 22 nt, Homo sapiens
ucacagaugcuugacccauuuc

SEQ ID NO: 306097 - RNA, 18 nt, Homo sapiens
ucaccuugaugcuggguc

SEQ ID NO: 306098 - RNA, 19 nt, Homo sapiens
ucacuggacagcacacuca

SEQ ID NO: 306099 - RNA, 16 nt, Homo sapiens
ucaucacagucucugg

SEQ ID NO: 306100 - RNA, 22 nt, Homo sapiens
ucauugcacuucuuuaguugca

SEQ ID NO: 306101 - RNA, 22 nt, Homo sapiens
ucccagugaaaccccaccuuca

SEQ ID NO: 306102 - RNA, 18 nt, Homo sapiens
ucccucagaauuauagaa

SEQ ID NO: 306103 - RNA, 22 nt, Homo sapiens
uccuugcacuaacuuaaggagg

SEQ ID NO: 306104 - RNA, 23 nt, Homo sapiens
ucucauuccuugaaaauaaugac

SEQ ID NO: 306105 - RNA, 18 nt, Homo sapiens
ucugugguguaaauacgu

SEQ ID NO: 306106 - RNA, 22 nt, Homo sapiens
ucuguuguuaucauaauauuga

SEQ ID NO: 306107 - RNA, 17 nt, Homo sapiens
ucuugugguucuugaau

SEQ ID NO: 306108 - RNA, 22 nt, Homo sapiens
ucuuuugggccucuugucagac

SEQ ID NO: 306109 - RNA, 22 nt, Homo sapiens
ugaaaucuaaaauguuccaaga

SEQ ID NO: 306110 - RNA, 22 nt, Homo sapiens
ugaagagucuaaaucugucuuc

SEQ ID NO: 306111 - RNA, 22 nt, Homo sapiens
ugacauggaagauguucaugau

SEQ ID NO: 306112 - RNA, 22 nt, Homo sapiens
ugacuucagacugaaaugauuc

SEQ ID NO: 306113 - RNA, 22 nt, Homo sapiens
ugagaauauuugaagauguuag

SEQ ID NO: 306114 - RNA, 22 nt, Homo sapiens
ugagccaaugauuugaauagag

SEQ ID NO: 306115 - RNA, 22 nt, Homo sapiens
ugagugaaagaagcacuaagga

SEQ ID NO: 306116 - RNA, 22 nt, Homo sapiens
ugagugaaggggcucuguugug

SEQ ID NO: 306117 - RNA, 22 nt, Homo sapiens
ugagugaaugugaaggcuaggg

SEQ ID NO: 306118 - RNA, 22 nt, Homo sapiens
ugaucuguccaccucagcuucc

SEQ ID NO: 306119 - RNA, 22 nt, Homo sapiens
ugcaaucaucgcuguuggccac

SEQ ID NO: 306120 - RNA, 23 nt, Homo sapiens
ugcaccacuacacacucuugggu

SEQ ID NO: 306121 - RNA, 22 nt, Homo sapiens
uggcauuguccaauaaaauuuu

SEQ ID NO: 306122 - RNA, 20 nt, Homo sapiens
uggucaccuucaggagguuc

SEQ ID NO: 306123 - RNA, 22 nt, Homo sapiens
ugucauguaaagaguaaauggu

SEQ ID NO: 306124 - RNA, 22 nt, Homo sapiens
ugucaugucuuuguguaucaau

SEQ ID NO: 306125 - RNA, 22 nt, Homo sapiens
ugugcaauucgauggagcucau

SEQ ID NO: 306126 - RNA, 22 nt, Homo sapiens
ugugcacaaccugcagguuugu

SEQ ID NO: 306127 - RNA, 22 nt, Homo sapiens
uuaaauacagcaugguguuucu

SEQ ID NO: 306128 - RNA, 22 nt, Homo sapiens
uuaaaugucuguagaugugcug

SEQ ID NO: 306129 - RNA, 22 nt, Homo sapiens
uuaagccacucaagagauagag

SEQ ID NO: 306130 - RNA, 19 nt, Homo sapiens
uuacacaaccuaguggggc

SEQ ID NO: 306131 - RNA, 22 nt, Homo sapiens
uuacuagaacauuuagggaacu

SEQ ID NO: 306132 - RNA, 22 nt, Homo sapiens
uuagaucaacauggaacucuau

SEQ ID NO: 306133 - RNA, 18 nt, Homo sapiens
uuagaugguuuuaaaacu

SEQ ID NO: 306134 - RNA, 22 nt, Homo sapiens
uuagugaaugcaccacuucuga

SEQ ID NO: 306135 - RNA, 23 nt, Homo sapiens
uucaccguguuggccaggcuggu

SEQ ID NO: 306136 - RNA, 22 nt, Homo sapiens
uuccagaugggaguucuauucu

SEQ ID NO: 306137 - RNA, 22 nt, Homo sapiens
uugaacugguaguuggaaaucu

SEQ ID NO: 306138 - RNA, 22 nt, Homo sapiens
uugaauguguugggaagcccuu

SEQ ID NO: 306139 - RNA, 22 nt, Homo sapiens
uugaguaguaagugguucaccg

SEQ ID NO: 306140 - RNA, 22 nt, Homo sapiens
uugcagugugacgacuauauuu

SEQ ID NO: 306141 - RNA, 22 nt, Homo sapiens
uugcaugguuuuuaucugaaau

SEQ ID NO: 306142 - RNA, 22 nt, Homo sapiens
uuggucugcucugauguuuucu

SEQ ID NO: 306143 - RNA, 22 nt, Homo sapiens
uuguauguuguuugucagagaa

SEQ ID NO: 306144 - RNA, 22 nt, Homo sapiens
uuguccacugcuagccucugca

SEQ ID NO: 306145 - RNA, 22 nt, Homo sapiens
uugucuagugaauacauuaaug

SEQ ID NO: 306146 - RNA, 22 nt, Homo sapiens
uugugcaugaugcauacauggu

SEQ ID NO: 306147 - RNA, 20 nt, Homo sapiens
uugugcauugggccauuggg

SEQ ID NO: 306148 - RNA, 22 nt, Homo sapiens
uuuaaugcgucucugaguuuug

SEQ ID NO: 306149 - RNA, 21 nt, Homo sapiens
uuucacugugaguuuuucugu

SEQ ID NO: 306150 - RNA, 21 nt, Homo sapiens
uuugaucauuaaaagugaauc

SEQ ID NO: 306151 - RNA, 18 nt, Homo sapiens
uuuguacuuuuucuaaug

SEQ ID NO: 306152 - RNA, 22 nt, Homo sapiens
uguucuggagccgguucaaaug

SEQ ID NO: 306153 - RNA, 22 nt, Homo sapiens
uuaacacugccauugauacugu

SEQ ID NO: 306154 - RNA, 22 nt, Homo sapiens
uuaguagcacagaguaucagca

SEQ ID NO: 306155 - RNA, 22 nt, Homo sapiens
uuauucauuaacagggaccaaa

SEQ ID NO: 306156 - RNA, 22 nt, Homo sapiens
uucacugcacuccagccugggu

SEQ ID NO: 306157 - RNA, 20 nt, Homo sapiens
uucaugggagcaaagaggcc

SEQ ID NO: 306158 - RNA, 22 nt, Homo sapiens
uuccaguuauuauaccucuuaa

SEQ ID NO: 306159 - RNA, 22 nt, Homo sapiens
uuccauugugucaucuuggugg

SEQ ID NO: 306160 - RNA, 22 nt, Homo sapiens
uucuaugguuuaauaguuuggg

SEQ ID NO: 306161 - RNA, 22 nt, Homo sapiens
uucugacuggugugagauggua

SEQ ID NO: 306162 - RNA, 22 nt, Homo sapiens
uucuuccagccuugaggggccc

SEQ ID NO: 306163 - RNA, 22 nt, Homo sapiens
uugaacuguaagggucugugug

SEQ ID NO: 306164 - RNA, 22 nt, Homo sapiens
uugaauguacuuguucucacua

SEQ ID NO: 306165 - RNA, 23 nt, Homo sapiens
uugaauguuuccccucccaaauu

SEQ ID NO: 306166 - RNA, 17 nt, Homo sapiens
uugagaguauaucuuac

SEQ ID NO: 306167 - RNA, 22 nt, Homo sapiens
uugaucaucagcuuugucaucu

SEQ ID NO: 306168 - RNA, 22 nt, Homo sapiens
uugguacuaaaaaguagggugu

SEQ ID NO: 306169 - RNA, 22 nt, Homo sapiens
uugguucucuuagccaucuuaa

SEQ ID NO: 306170 - RNA, 22 nt, Homo sapiens
uugguuuccuuccugcuuaacu

SEQ ID NO: 306171 - RNA, 22 nt, Homo sapiens
uugucaguguucacucaaagcu

SEQ ID NO: 306172 - RNA, 22 nt, Homo sapiens
uugugcauguauauuaguucac

SEQ ID NO: 306173 - RNA, 22 nt, Homo sapiens
uuuaaggcaugccuguacaugc

SEQ ID NO: 306174 - RNA, 22 nt, Homo sapiens
uuuauggagagauauuuauggu

SEQ ID NO: 306175 - RNA, 22 nt, Homo sapiens
uuucaccguguuggccaggcug

SEQ ID NO: 306176 - RNA, 23 nt, Homo sapiens
uuucaguaguuguauccuguugc

SEQ ID NO: 306177 - RNA, 22 nt, Homo sapiens
uuugcaugcuccuuaugagaau

SEQ ID NO: 306178 - RNA, 22 nt, Homo sapiens
uuugcuucacuguuuggcaaaa

SEQ ID NO: 306179 - RNA, 22 nt, Homo sapiens
uuuggucuuuuauuuaaagcag

SEQ ID NO: 306180 - RNA, 22 nt, Homo sapiens
uuuguguccccacccaaaucuc

SEQ ID NO: 306181 - RNA, 22 nt, Homo sapiens
uuuguucaccucaaggauggga

SEQ ID NO: 306182 - RNA, 22 nt, Homo sapiens
uuuguucuucguuccugagcca

SEQ ID NO: 306183 - RNA, 22 nt, Homo sapiens
ugaguaucuugaugaauuugaa

SEQ ID NO: 306184 - RNA, 22 nt, Homo sapiens
ugaucuguguauauugaaccag

SEQ ID NO: 306185 - RNA, 22 nt, Homo sapiens
ugaucuuuuuaauguccauggg

SEQ ID NO: 306186 - RNA, 22 nt, Homo sapiens
ugcaagaaucagccuaucauua

SEQ ID NO: 306187 - RNA, 21 nt, Homo sapiens
uggaaguguacaauuauaccc

SEQ ID NO: 306188 - RNA, 20 nt, Homo sapiens
uggcaugaaauuuuccaagc

SEQ ID NO: 306189 - RNA, 23 nt, Homo sapiens
uggccaagauaaucucaguuuuc

SEQ ID NO: 306190 - RNA, 23 nt, Homo sapiens
uggccagaaacuucuuuucaucc

SEQ ID NO: 306191 - RNA, 22 nt, Homo sapiens
ugucaccauuuguaggugagga

SEQ ID NO: 306192 - RNA, 22 nt, Homo sapiens
ugugaaauguuaucccgucgug

SEQ ID NO: 306193 - RNA, 22 nt, Homo sapiens
ugugaacauuuuguauauauua

SEQ ID NO: 306194 - RNA, 22 nt, Homo sapiens
uguggaaauaaaagaaagguua

SEQ ID NO: 306195 - RNA, 22 nt, Homo sapiens
uguguaauaccuuugacuauau

SEQ ID NO: 306196 - RNA, 22 nt, Homo sapiens
uguuucuacugucucuguagua

SEQ ID NO: 306197 - RNA, 22 nt, Homo sapiens
uuaaaugcauagaauguguagu

SEQ ID NO: 306198 - RNA, 22 nt, Homo sapiens
uuacaaccucagcagugcaaag

SEQ ID NO: 306199 - RNA, 22 nt, Homo sapiens
uuacaguugugagccaccaugc

SEQ ID NO: 306200 - RNA, 22 nt, Homo sapiens
uuaucacauugacugauuugca

SEQ ID NO: 306201 - RNA, 22 nt, Homo sapiens
uucacugcaugaaaaggacagc

SEQ ID NO: 306202 - RNA, 22 nt, Homo sapiens
uucacugcauuucagccugggc

SEQ ID NO: 306203 - RNA, 22 nt, Homo sapiens
uucaucagggguauuggccaau

SEQ ID NO: 306204 - RNA, 22 nt, Homo sapiens
uucaucaguuauauuggccuga

SEQ ID NO: 306205 - RNA, 22 nt, Homo sapiens
uuccaauguuccguguugcagu

SEQ ID NO: 306206 - RNA, 22 nt, Homo sapiens
uuccaguggacuacuucauccu

SEQ ID NO: 306207 - RNA, 22 nt, Homo sapiens
uuccuguagcgauuuuaguaau

SEQ ID NO: 306208 - RNA, 22 nt, Homo sapiens
uucucaauggcaacuuguugcu

SEQ ID NO: 306209 - RNA, 22 nt, Homo sapiens
uucuucaggccacaaaaauggu

SEQ ID NO: 306210 - RNA, 22 nt, Homo sapiens
uucuugaggcaugccgcuggga

SEQ ID NO: 306211 - RNA, 22 nt, Homo sapiens
uucuuuggauaaaguuuuaugc

SEQ ID NO: 306212 - RNA, 22 nt, Homo sapiens
uugaauguaugcuggguuuacu

SEQ ID NO: 306213 - RNA, 22 nt, Homo sapiens
uugagacugaacauuuguguac

SEQ ID NO: 306214 - RNA, 22 nt, Homo sapiens
uugcacuccagucuggggggca

SEQ ID NO: 306215 - RNA, 22 nt, Homo sapiens
uugcucaggcuggaguacaaug

SEQ ID NO: 306216 - RNA, 22 nt, Homo sapiens
uugcuucauucaacauugaggg

SEQ ID NO: 306217 - RNA, 22 nt, Homo sapiens
uuguauguugaaugaugguaua

SEQ ID NO: 306218 - RNA, 22 nt, Homo sapiens
uugucacucuuccuaggguagg

SEQ ID NO: 306219 - RNA, 22 nt, Homo sapiens
uugugaagaaaccagaaaaguu

SEQ ID NO: 306220 - RNA, 22 nt, Homo sapiens
uuuagcaaagcaauuuacacca

SEQ ID NO: 306221 - RNA, 22 nt, Homo sapiens
uuugagcauuagggcaaaggca

SEQ ID NO: 306222 - RNA, 23 nt, Homo sapiens
uuugccacuuauuagcugggagg

SEQ ID NO: 306223 - RNA, 22 nt, Homo sapiens
uuuguacuaugguuuuucacua

SEQ ID NO: 306224 - RNA, 18 nt, Homo sapiens
uuugugcuccacaaagga

SEQ ID NO: 306225 - RNA, 22 nt, Homo sapiens
uuugugcuccuaugagaaucua

SEQ ID NO: 306226 - RNA, 22 nt, Homo sapiens
uuugugcuccugugagaaucua

SEQ ID NO: 306227 - RNA, 23 nt, Homo sapiens
uuuguguccccacccaaaucuca

SEQ ID NO: 306228 - RNA, 22 nt, Homo sapiens
aagugaaugugcuggaauagcu

SEQ ID NO: 306229 - RNA, 22 nt, Homo sapiens
aaugacucugccuaaauuucac

SEQ ID NO: 306230 - RNA, 22 nt, Homo sapiens
aaugcuaucuggaacauuguug

SEQ ID NO: 306231 - RNA, 22 nt, Homo sapiens
acaauguauauuuuacuguagg

SEQ ID NO: 306232 - RNA, 22 nt, Homo sapiens
acacaaugguaaguguuugugu

SEQ ID NO: 306233 - RNA, 22 nt, Homo sapiens
acaccaugucuguuucugguuu

SEQ ID NO: 306234 - RNA, 19 nt, Homo sapiens
acagugcuuugucagaagc

SEQ ID NO: 306235 - RNA, 19 nt, Homo sapiens
acauggauuuugugcaaac

SEQ ID NO: 306236 - RNA, 22 nt, Homo sapiens
accaccauugcacugaacuuuc

SEQ ID NO: 306237 - RNA, 22 nt, Homo sapiens
acuacauaugacaucuucuuua

SEQ ID NO: 306238 - RNA, 22 nt, Homo sapiens
agaauucugucauguuuauauu

SEQ ID NO: 306239 - RNA, 22 nt, Homo sapiens
agagaacugauucagggaaaau

SEQ ID NO: 306240 - RNA, 22 nt, Homo sapiens
agagauaguuuccaacucauac

SEQ ID NO: 306241 - RNA, 22 nt, Homo sapiens
agagcaaugggugaauauuaaa

SEQ ID NO: 306242 - RNA, 22 nt, Homo sapiens
agaguacugacguuugcaaauu

SEQ ID NO: 306243 - RNA, 22 nt, Homo sapiens
agagugaagcuuuuuauauucu

SEQ ID NO: 306244 - RNA, 22 nt, Homo sapiens
agauacauuggauaaugguggg

SEQ ID NO: 306245 - RNA, 22 nt, Homo sapiens
agcaccaugggcugaguaagug

SEQ ID NO: 306246 - RNA, 22 nt, Homo sapiens
aggugaaugcucacauucuaau

SEQ ID NO: 306247 - RNA, 22 nt, Homo sapiens
agugaaaugucaccuuuuagga

SEQ ID NO: 306248 - RNA, 22 nt, Homo sapiens
agugacuagaauaugaauuuua

SEQ ID NO: 306249 - RNA, 22 nt, Homo sapiens
agugcaauggcgugaucuuggc

SEQ ID NO: 306250 - RNA, 22 nt, Homo sapiens
agugcauugagacuugugaguu

SEQ ID NO: 306251 - RNA, 22 nt, Homo sapiens
agugcauuuguucugugucagg

SEQ ID NO: 306252 - RNA, 22 nt, Homo sapiens
auagaggacugaggugaucuuu

SEQ ID NO: 306253 - RNA, 22 nt, Homo sapiens
auagccaguagagagcuguuag

SEQ ID NO: 306254 - RNA, 22 nt, Homo sapiens
auauuacuggccauaucgcagg

SEQ ID NO: 306255 - RNA, 22 nt, Homo sapiens
auauugacuuucucuuagauca

SEQ ID NO: 306256 - RNA, 22 nt, Homo sapiens
aucaaagugaaauauuaguuau

SEQ ID NO: 306257 - RNA, 22 nt, Homo sapiens
aucagcauucccaaaugaugug

SEQ ID NO: 306258 - RNA, 22 nt, Homo sapiens
augaaaucuuuggcagaucuua

SEQ ID NO: 306259 - RNA, 22 nt, Homo sapiens
augcaagaaauaucucuuuuuc

SEQ ID NO: 306260 - RNA, 22 nt, Homo sapiens
augcuaucauucaggauuuguu

SEQ ID NO: 306261 - RNA, 21 nt, Homo sapiens
auggaaagacugccucuucaa

SEQ ID NO: 306262 - RNA, 22 nt, Homo sapiens
auggcaauguaagucagaaaaa

SEQ ID NO: 306263 - RNA, 22 nt, Homo sapiens
auggcugugagaucgacuuauu

SEQ ID NO: 306264 - RNA, 21 nt, Homo sapiens
augggguagaagagaaggcuu

SEQ ID NO: 306265 - RNA, 22 nt, Homo sapiens
augucacagguccuagccaagu

SEQ ID NO: 306266 - RNA, 20 nt, Homo sapiens
uaagugcuugagacuucuga

SEQ ID NO: 306267 - RNA, 20 nt, Homo sapiens
uacacguaugagcacaugug

SEQ ID NO: 306268 - RNA, 22 nt, Homo sapiens
uacaggauagacaauuuauuaa

SEQ ID NO: 306269 - RNA, 22 nt, Homo sapiens
uaccaaaguuucggccucuguu

SEQ ID NO: 306270 - RNA, 22 nt, Homo sapiens
uagaaaguagggaagguaggau

SEQ ID NO: 306271 - RNA, 22 nt, Homo sapiens
uagaucauauucagugcuuacu

SEQ ID NO: 306272 - RNA, 22 nt, Homo sapiens
uagauuaucauucauacaggga

SEQ ID NO: 306273 - RNA, 22 nt, Homo sapiens
uaucacagauauuaugggccaa

SEQ ID NO: 306274 - RNA, 22 nt, Homo sapiens
uaugaaacucuaagauucacau

SEQ ID NO: 306275 - RNA, 22 nt, Homo sapiens
uaugaucauuauguuauugcag

SEQ ID NO: 306276 - RNA, 22 nt, Homo sapiens
uauuacagaccauaucgccggg

SEQ ID NO: 306277 - RNA, 22 nt, Homo sapiens
uauuacuguuauuccuaucaaa

SEQ ID NO: 306278 - RNA, 22 nt, Homo sapiens
ucacacucucaccaacauuugg

SEQ ID NO: 306279 - RNA, 22 nt, Homo sapiens
ucacaguucagcauggcugagg

SEQ ID NO: 306280 - RNA, 22 nt, Homo sapiens
ucucacaccccucucauauacc

SEQ ID NO: 306281 - RNA, 22 nt, Homo sapiens
ucuggauuuuugaggcaauaua

SEQ ID NO: 306282 - RNA, 22 nt, Homo sapiens
ucuuuagugacaguugugcaag

SEQ ID NO: 306283 - RNA, 22 nt, Homo sapiens
ucuuugggauauucugaaaggg

SEQ ID NO: 306284 - RNA, 22 nt, Homo sapiens
aaagugccuucuauuuuaguga

SEQ ID NO: 306285 - RNA, 22 nt, Homo sapiens
aaauugcauugagcugcuuauu

SEQ ID NO: 306286 - RNA, 22 nt, Homo sapiens
aacacuaucugccuuacaggga

SEQ ID NO: 306287 - RNA, 22 nt, Homo sapiens
aacagauugcugagccccaccc

SEQ ID NO: 306288 - RNA, 22 nt, Homo sapiens
aagugaauucauuguguuauau

SEQ ID NO: 306289 - RNA, 22 nt, Homo sapiens
aaucacuuugcuacaaggcagu

SEQ ID NO: 306290 - RNA, 17 nt, Homo sapiens
aaucagauuucugagga

SEQ ID NO: 306291 - RNA, 22 nt, Homo sapiens
acaacaguuuuaucaccccaga

SEQ ID NO: 306292 - RNA, 22 nt, Homo sapiens
acacagucaaauccacuuggcu

SEQ ID NO: 306293 - RNA, 22 nt, Homo sapiens
acaucacuguuugauugauuga

SEQ ID NO: 306294 - RNA, 22 nt, Homo sapiens
acaucauugggggcuacaggug

SEQ ID NO: 306295 - RNA, 22 nt, Homo sapiens
acugggauauuauugguaauau

SEQ ID NO: 306296 - RNA, 22 nt, Homo sapiens
acuucauucucuggaucagaau

SEQ ID NO: 306297 - RNA, 21 nt, Homo sapiens
acuuucuguggcaguccauuc

SEQ ID NO: 306298 - RNA, 22 nt, Homo sapiens
agaucauaugcaguaaugaacu

SEQ ID NO: 306299 - RNA, 22 nt, Homo sapiens
agcaccauuucucuaaagcacu

SEQ ID NO: 306300 - RNA, 22 nt, Homo sapiens
agccaguauuuuauugaggauu

SEQ ID NO: 306301 - RNA, 22 nt, Homo sapiens
agcuguuguuaauuaacucauu

SEQ ID NO: 306302 - RNA, 22 nt, Homo sapiens
agcuuuggauaccugcuguucc

SEQ ID NO: 306303 - RNA, 23 nt, Homo sapiens
aggcauuguacaguaauggaaaa

SEQ ID NO: 306304 - RNA, 22 nt, Homo sapiens
aggcauugugcaucgaugauuu

SEQ ID NO: 306305 - RNA, 19 nt, Homo sapiens
aggcauugugcucaucugu

SEQ ID NO: 306306 - RNA, 22 nt, Homo sapiens
agucaacaucaugaaguggaaa

SEQ ID NO: 306307 - RNA, 22 nt, Homo sapiens
agugaaaucugaagaaggucau

SEQ ID NO: 306308 - RNA, 22 nt, Homo sapiens
auaugcauacauguaugcagga

SEQ ID NO: 306309 - RNA, 22 nt, Homo sapiens
auauuacuggcuauaucgcaag

SEQ ID NO: 306310 - RNA, 22 nt, Homo sapiens
aucugacuuuuaauuugaaaac

SEQ ID NO: 306311 - RNA, 22 nt, Homo sapiens
aucuucucuugaagggugggga

SEQ ID NO: 306312 - RNA, 15 nt, Homo sapiens
augaguuuuauggag

SEQ ID NO: 306313 - RNA, 22 nt, Homo sapiens
augaucacuguggaaauucagc

SEQ ID NO: 306314 - RNA, 22 nt, Homo sapiens
augcaagacaccgauuagcuuu

SEQ ID NO: 306315 - RNA, 22 nt, Homo sapiens
auguuugguagugaauauggua

SEQ ID NO: 306316 - RNA, 22 nt, Homo sapiens
auuuugguuacauaguugagcu

SEQ ID NO: 306317 - RNA, 22 nt, Homo sapiens
caaggcacagccccuacuuccu

SEQ ID NO: 306318 - RNA, 22 nt, Homo sapiens
cacugcauucuccaccucccag

SEQ ID NO: 306319 - RNA, 22 nt, Homo sapiens
cccuugcacuucagagcugcau

SEQ ID NO: 306320 - RNA, 18 nt, Homo sapiens
ccuuaguuauagagaguc

SEQ ID NO: 306321 - RNA, 21 nt, Homo sapiens
cucaaaguacugauauuacag

SEQ ID NO: 306322 - RNA, 22 nt, Homo sapiens
cucaauuuggaauugucaguaa

SEQ ID NO: 306323 - RNA, 22 nt, Homo sapiens
cucagauacuugggagguugag

SEQ ID NO: 306324 - RNA, 22 nt, Homo sapiens
cucuuagauuagccauccuaau

SEQ ID NO: 306325 - RNA, 22 nt, Homo sapiens
cucuuugcuucuggcaucauug

SEQ ID NO: 306326 - RNA, 22 nt, Homo sapiens
cuggcucugggcuaaagaaaua

SEQ ID NO: 306327 - RNA, 22 nt, Homo sapiens
cugugcaaagcgcucucggggu

SEQ ID NO: 306328 - RNA, 22 nt, Homo sapiens
cuucaaguguggccaccugacc

SEQ ID NO: 306329 - RNA, 20 nt, Homo sapiens
cuuccaguggccccaucuuu

SEQ ID NO: 306330 - RNA, 22 nt, Homo sapiens
cuuuaugagguuggauggaucu

SEQ ID NO: 306331 - RNA, 22 nt, Homo sapiens
gaacacaucuuugguuagagga

SEQ ID NO: 306332 - RNA, 22 nt, Homo sapiens
gacuucaucauacuaugugugg

SEQ ID NO: 306333 - RNA, 21 nt, Homo sapiens
gagaaucuuuucagggcaaac

SEQ ID NO: 306334 - RNA, 22 nt, Homo sapiens
gagauacuugguuucuguuucu

SEQ ID NO: 306335 - RNA, 22 nt, Homo sapiens
gagaucaugcugguucucucau

SEQ ID NO: 306336 - RNA, 22 nt, Homo sapiens
gagaucuucguguggggagaca

SEQ ID NO: 306337 - RNA, 22 nt, Homo sapiens
gaggaaguagcuacugucuuuc

SEQ ID NO: 306338 - RNA, 22 nt, Homo sapiens
gagugcaauggcaugaucuugg

SEQ ID NO: 306339 - RNA, 22 nt, Homo sapiens
gagugcauaugggccuguguca

SEQ ID NO: 306340 - RNA, 22 nt, Homo sapiens
gcuggaauuaacauagaugugc

SEQ ID NO: 306341 - RNA, 22 nt, Homo sapiens
ggaauguuaaggcgcuguuggu

SEQ ID NO: 306342 - RNA, 22 nt, Homo sapiens
guaaauaccaguuucuggaaca

SEQ ID NO: 306343 - RNA, 22 nt, Homo sapiens
guacaguuuagugcuuugagaa

SEQ ID NO: 306344 - RNA, 22 nt, Homo sapiens
guagagugcugggcacuggcuc

SEQ ID NO: 306345 - RNA, 22 nt, Homo sapiens
gucagcaaagaggaauaguuug

SEQ ID NO: 306346 - RNA, 22 nt, Homo sapiens
gucauguuuaacuucuugagga

SEQ ID NO: 306347 - RNA, 22 nt, Homo sapiens
gucuuuugcuagccagagagcu

SEQ ID NO: 306348 - RNA, 22 nt, Homo sapiens
gugcaguguuugcauggaauca

SEQ ID NO: 306349 - RNA, 21 nt, Homo sapiens
gugucacagacaugacagaug

SEQ ID NO: 306350 - RNA, 22 nt, Homo sapiens
guguccucgaguacacaucagg

SEQ ID NO: 306351 - RNA, 22 nt, Homo sapiens
gugugcauaugucuuuauagua

SEQ ID NO: 306352 - RNA, 22 nt, Homo sapiens
gugugcauggagggggcaguga

SEQ ID NO: 306353 - RNA, 22 nt, Homo sapiens
gugugcaugucuuuuuaguagg

SEQ ID NO: 306354 - RNA, 22 nt, Homo sapiens
guguguaaauggcagugagcuc

SEQ ID NO: 306355 - RNA, 22 nt, Homo sapiens
guucuggagauaaagccaaggu

SEQ ID NO: 306356 - RNA, 22 nt, Homo sapiens
guugcaugucugggaggccagc

SEQ ID NO: 306357 - RNA, 22 nt, Homo sapiens
uaaagcuuggauuuaggcuaau

SEQ ID NO: 306358 - RNA, 20 nt, Homo sapiens
uaaaugccucaugcuuuauu

SEQ ID NO: 306359 - RNA, 22 nt, Homo sapiens
uaagacacuuaaaauguuacau

SEQ ID NO: 306360 - RNA, 22 nt, Homo sapiens
uaagggacauguguugccuaag

SEQ ID NO: 306361 - RNA, 22 nt, Homo sapiens
uaagugcuguguuguuaccuaa

SEQ ID NO: 306362 - RNA, 22 nt, Homo sapiens
acaugguacugauuuacgaaau

SEQ ID NO: 306363 - RNA, 22 nt, Homo sapiens
acuacuucuaaguuuuggaaga

SEQ ID NO: 306364 - RNA, 22 nt, Homo sapiens
acucagagauuagcacauguuu

SEQ ID NO: 306365 - RNA, 22 nt, Homo sapiens
acucuguaagcaagcuggggaa

SEQ ID NO: 306366 - RNA, 22 nt, Homo sapiens
acucuguauaaacauugcugua

SEQ ID NO: 306367 - RNA, 22 nt, Homo sapiens
agaauguuuuagaccaauacaa

SEQ ID NO: 306368 - RNA, 22 nt, Homo sapiens
agauacaucuaugugucugugu

SEQ ID NO: 306369 - RNA, 22 nt, Homo sapiens
agauggguuuucacauguuggc

SEQ ID NO: 306370 - RNA, 22 nt, Homo sapiens
agcaacauuguucauaauagcu

SEQ ID NO: 306371 - RNA, 22 nt, Homo sapiens
agcaccauuuauugaaaagaca

SEQ ID NO: 306372 - RNA, 20 nt, Homo sapiens
agcaucauugcaauuuguca

SEQ ID NO: 306373 - RNA, 22 nt, Homo sapiens
agguccauuauuuucauucaug

SEQ ID NO: 306374 - RNA, 22 nt, Homo sapiens
aguaacauuucuaguagagagu

SEQ ID NO: 306375 - RNA, 20 nt, Homo sapiens
agucaguuuauuuucucucu

SEQ ID NO: 306376 - RNA, 19 nt, Homo sapiens
agugcaauugccuuugugc

SEQ ID NO: 306377 - RNA, 22 nt, Homo sapiens
agugcauugcaucucugcuuca

SEQ ID NO: 306378 - RNA, 22 nt, Homo sapiens
auaauguuugauugagcagaua

SEQ ID NO: 306379 - RNA, 22 nt, Homo sapiens
auagaucauugucauuuuagau

SEQ ID NO: 306380 - RNA, 22 nt, Homo sapiens
auagcagacauuucaaggcagg

SEQ ID NO: 306381 - RNA, 22 nt, Homo sapiens
augaccagagguaugauguuug

SEQ ID NO: 306382 - RNA, 22 nt, Homo sapiens
augccacugcauaagguuuuca

SEQ ID NO: 306383 - RNA, 22 nt, Homo sapiens
auggcaguuuggucucugugcu

SEQ ID NO: 306384 - RNA, 22 nt, Homo sapiens
augucuagagugauacugaagc

SEQ ID NO: 306385 - RNA, 22 nt, Homo sapiens
auuuagcaauggagguagugua

SEQ ID NO: 306386 - RNA, 22 nt, Homo sapiens
cacaaccuccgccuccuggguu

SEQ ID NO: 306387 - RNA, 22 nt, Homo sapiens
cacaaugucuaagauguuucua

SEQ ID NO: 306388 - RNA, 22 nt, Homo sapiens
caccacagccauuauugucccc

SEQ ID NO: 306389 - RNA, 22 nt, Homo sapiens
cacugcgaccuccaccucccgg

SEQ ID NO: 306390 - RNA, 22 nt, Homo sapiens
cagaguuaguagccuuugacaa

SEQ ID NO: 306391 - RNA, 22 nt, Homo sapiens
caguagcaugccucagaaugag

SEQ ID NO: 306392 - RNA, 21 nt, Homo sapiens
cauaaugcuacuuauuuuaug

SEQ ID NO: 306393 - RNA, 22 nt, Homo sapiens
caugauauugcagaauguuggu

SEQ ID NO: 306394 - RNA, 22 nt, Homo sapiens
ccaaggcacugauucuguacuc

SEQ ID NO: 306395 - RNA, 22 nt, Homo sapiens
ccaccuguacuuaagucacuuu

SEQ ID NO: 306396 - RNA, 22 nt, Homo sapiens
cuuguucuccuaagaugaaugc

SEQ ID NO: 306397 - RNA, 22 nt, Homo sapiens
gacucuguagacaaucacaucu

SEQ ID NO: 306398 - RNA, 22 nt, Homo sapiens
gagaagugcgucguuugaugau

SEQ ID NO: 306399 - RNA, 22 nt, Homo sapiens
gagaucuuuaagaacuacugcu

SEQ ID NO: 306400 - RNA, 22 nt, Homo sapiens
gcaauguuacugaauguguuuu

SEQ ID NO: 306401 - RNA, 18 nt, Homo sapiens
gccaacauguaaacaggu

SEQ ID NO: 306402 - RNA, 22 nt, Homo sapiens
gcugucaugagcaacacaugaa

SEQ ID NO: 306403 - RNA, 22 nt, Homo sapiens
ggaaaucucugaggcucccuuc

SEQ ID NO: 306404 - RNA, 22 nt, Homo sapiens
ggaauguuaaagacuacacuga

SEQ ID NO: 306405 - RNA, 17 nt, Homo sapiens
gggucaccuugcaggua

SEQ ID NO: 306406 - RNA, 22 nt, Homo sapiens
guaaaucucuguuuucauggac

SEQ ID NO: 306407 - RNA, 17 nt, Homo sapiens
guacacuucuucuguga

SEQ ID NO: 306408 - RNA, 21 nt, Homo sapiens
gucauaugucucugauuagug

SEQ ID NO: 306409 - RNA, 22 nt, Homo sapiens
gugaacuguuugaggaagagaa

SEQ ID NO: 306410 - RNA, 18 nt, Homo sapiens
gugcaaugaauagcagag

SEQ ID NO: 306411 - RNA, 22 nt, Homo sapiens
gugcaaugucaggagaugcagc

SEQ ID NO: 306412 - RNA, 22 nt, Homo sapiens
uaacagucuccucaagguguug

SEQ ID NO: 306413 - RNA, 18 nt, Homo sapiens
uaacagucucucaggauc

SEQ ID NO: 306414 - RNA, 22 nt, Homo sapiens
uaacugccuacugugcaaauau

SEQ ID NO: 306415 - RNA, 22 nt, Homo sapiens
uaagugcuugacuuugauguuu

SEQ ID NO: 306416 - RNA, 22 nt, Homo sapiens
uacagcacaggugcagguguug

SEQ ID NO: 306417 - RNA, 23 nt, Homo sapiens
uaccacauuccuucuuuccuguu

SEQ ID NO: 306418 - RNA, 22 nt, Homo sapiens
uaccuuaucccuaacuucccau

SEQ ID NO: 306419 - RNA, 22 nt, Homo sapiens
uaccuuugucaguuacucaccu

SEQ ID NO: 306420 - RNA, 22 nt, Homo sapiens
uagaucauauacuugccaugac

SEQ ID NO: 306421 - RNA, 23 nt, Homo sapiens
uagaucaucaaguuuacugugcu

SEQ ID NO: 306422 - RNA, 22 nt, Homo sapiens
uagaucuuuaaaaggugcuaga

SEQ ID NO: 306423 - RNA, 22 nt, Homo sapiens
uagauucaucuguuccuuuuga

SEQ ID NO: 306424 - RNA, 22 nt, Homo sapiens
uagcaacauucagcucagguac

SEQ ID NO: 306425 - RNA, 22 nt, Homo sapiens
uagcacaucuucuuggccugca

SEQ ID NO: 306426 - RNA, 22 nt, Homo sapiens
uagcaccaaacauauacucagu

SEQ ID NO: 306427 - RNA, 22 nt, Homo sapiens
uaggucacugcucugugucuaa

SEQ ID NO: 306428 - RNA, 22 nt, Homo sapiens
uaguucauuauguguugcucag

SEQ ID NO: 306429 - RNA, 20 nt, Homo sapiens
uaucacaguucaggaacucu

SEQ ID NO: 306430 - RNA, 22 nt, Homo sapiens
uauggguauuuuauacauaacc

SEQ ID NO: 306431 - RNA, 20 nt, Homo sapiens
uauuacagaguaauggugga

SEQ ID NO: 306432 - RNA, 22 nt, Homo sapiens
uauuacuugucugugucucaau

SEQ ID NO: 306433 - RNA, 22 nt, Homo sapiens
ucaaaguauucuucugagaacc

SEQ ID NO: 306434 - RNA, 22 nt, Homo sapiens
ucacaauucacuacaggcuuga

SEQ ID NO: 306435 - RNA, 22 nt, Homo sapiens
ucacaguagccccucccaucau

SEQ ID NO: 306436 - RNA, 22 nt, Homo sapiens
ucacugcacuccagccuuuaug

SEQ ID NO: 306437 - RNA, 22 nt, Homo sapiens
ucacugcgaccuccaccucccg

SEQ ID NO: 306438 - RNA, 22 nt, Homo sapiens
ucacugcgaccuccaccuccug

SEQ ID NO: 306439 - RNA, 22 nt, Homo sapiens
ucagaacugauacuagaacuuu

SEQ ID NO: 306440 - RNA, 22 nt, Homo sapiens
ucaguuuguauuucagguugca

SEQ ID NO: 306441 - RNA, 19 nt, Homo sapiens
ucccaauguuuccaggcag

SEQ ID NO: 306442 - RNA, 22 nt, Homo sapiens
ucccuugagccuggcuucucac

SEQ ID NO: 306443 - RNA, 22 nt, Homo sapiens
ucucaauuugauuacauucaua

SEQ ID NO: 306444 - RNA, 20 nt, Homo sapiens
ucucauggagguagagaaua

SEQ ID NO: 306445 - RNA, 23 nt, Homo sapiens
ucugauguuauaaaauucuuugg

SEQ ID NO: 306446 - RNA, 23 nt, Homo sapiens
ucuggcuuugggaugcucaaggg

SEQ ID NO: 306447 - RNA, 22 nt, Homo sapiens
ucugucuuguccucacccuaga

SEQ ID NO: 306448 - RNA, 22 nt, Homo sapiens
ugaaugauuuuaaaagccucuc

SEQ ID NO: 306449 - RNA, 22 nt, Homo sapiens
ugaauguucuuaaaacccuugu

SEQ ID NO: 306450 - RNA, 23 nt, Homo sapiens
ugaauguuuauucucggugcaga

SEQ ID NO: 306451 - RNA, 22 nt, Homo sapiens
aaaagcuuagaugggcuuguau

SEQ ID NO: 306452 - RNA, 17 nt, Homo sapiens
aaaguccuuugcuaucu

SEQ ID NO: 306453 - RNA, 22 nt, Homo sapiens
aaauugcuuuugaagacuuagu

SEQ ID NO: 306454 - RNA, 22 nt, Homo sapiens
aagcaacacaucugccccgguu

SEQ ID NO: 306455 - RNA, 22 nt, Homo sapiens
aagucaaggagagaagcuucag

SEQ ID NO: 306456 - RNA, 22 nt, Homo sapiens
aagugaaugaugugaaguguaa

SEQ ID NO: 306457 - RNA, 22 nt, Homo sapiens
aagugaauguuugguagcagug

SEQ ID NO: 306458 - RNA, 22 nt, Homo sapiens
aauaaaguaggaggugaggaaa

SEQ ID NO: 306459 - RNA, 22 nt, Homo sapiens
aauaaagucugaagugugcuua

SEQ ID NO: 306460 - RNA, 22 nt, Homo sapiens
aaucagagcccucugagcuuca

SEQ ID NO: 306461 - RNA, 22 nt, Homo sapiens
aaucugucaguuuuguguuaau

SEQ ID NO: 306462 - RNA, 22 nt, Homo sapiens
agaagugcuggguucaggcugg

SEQ ID NO: 306463 - RNA, 22 nt, Homo sapiens
agagaacuggcuucaccauucu

SEQ ID NO: 306464 - RNA, 22 nt, Homo sapiens
agcugauuuuaaguccuugucc

SEQ ID NO: 306465 - RNA, 22 nt, Homo sapiens
agugauauguuugccuugaggg

SEQ ID NO: 306466 - RNA, 22 nt, Homo sapiens
agugauggagccaggauuuaau

SEQ ID NO: 306467 - RNA, 22 nt, Homo sapiens
agugcaauaaggauguagaacu

SEQ ID NO: 306468 - RNA, 21 nt, Homo sapiens
aguucacauggcuccuguguu

SEQ ID NO: 306469 - RNA, 22 nt, Homo sapiens
auaaaguucugcuggcauauau

SEQ ID NO: 306470 - RNA, 22 nt, Homo sapiens
auaauguuuauccagaggaguu

SEQ ID NO: 306471 - RNA, 22 nt, Homo sapiens
auaucacucccaauaucgcagg

SEQ ID NO: 306472 - RNA, 22 nt, Homo sapiens
aucacuuucuauuucugugcca

SEQ ID NO: 306473 - RNA, 22 nt, Homo sapiens
aucuuugauugaagggacccug

SEQ ID NO: 306474 - RNA, 20 nt, Homo sapiens
augcaaacccugcuuugugg

SEQ ID NO: 306475 - RNA, 22 nt, Homo sapiens
augccaagaugagcacgcgucu

SEQ ID NO: 306476 - RNA, 22 nt, Homo sapiens
augcuacauucuacaauuaggc

SEQ ID NO: 306477 - RNA, 22 nt, Homo sapiens
augcuguuuuguagcucccucu

SEQ ID NO: 306478 - RNA, 22 nt, Homo sapiens
auggauauuuuuugaacauaga

SEQ ID NO: 306479 - RNA, 22 nt, Homo sapiens
augggguaggcuuugcugcagu

SEQ ID NO: 306480 - RNA, 22 nt, Homo sapiens
auguguauuaccucgauuguga

SEQ ID NO: 306481 - RNA, 22 nt, Homo sapiens
auucaagugaugcagcuguuuu

SEQ ID NO: 306482 - RNA, 22 nt, Homo sapiens
auugaguaacaauuuuguucaa

SEQ ID NO: 306483 - RNA, 22 nt, Homo sapiens
auuguucuuacaugcugucauc

SEQ ID NO: 306484 - RNA, 22 nt, Homo sapiens
auuguucuuguguccuuuuccu

SEQ ID NO: 306485 - RNA, 22 nt, Homo sapiens
cauguauagauuccauaguggu

SEQ ID NO: 306486 - RNA, 22 nt, Homo sapiens
cauuuuacuuuccagacgugga

SEQ ID NO: 306487 - RNA, 22 nt, Homo sapiens
cauuuugcaguuucugucucca

SEQ ID NO: 306488 - RNA, 20 nt, Homo sapiens
ccaguguuauuuauguucua

SEQ ID NO: 306489 - RNA, 23 nt, Homo sapiens
ccauugcacuccagccucaguga

SEQ ID NO: 306490 - RNA, 22 nt, Homo sapiens
cuaagggaggaagcugugcagg

SEQ ID NO: 306491 - RNA, 22 nt, Homo sapiens
cugaauagucaacgauggacug

SEQ ID NO: 306492 - RNA, 22 nt, Homo sapiens
cugagauggagucucgcauugu

SEQ ID NO: 306493 - RNA, 22 nt, Homo sapiens
cuucaagucuuuggauaauuag

SEQ ID NO: 306494 - RNA, 22 nt, Homo sapiens
cuucagcaauauauccccuggg

SEQ ID NO: 306495 - RNA, 22 nt, Homo sapiens
cuuguacacuguuggugggaau

SEQ ID NO: 306496 - RNA, 18 nt, Homo sapiens
cuuugguccccgcacccu

SEQ ID NO: 306497 - RNA, 22 nt, Homo sapiens
gagcaacaguggcagugguggg

SEQ ID NO: 306498 - RNA, 22 nt, Homo sapiens
gcaaaaaguagugcugguuagg

SEQ ID NO: 306499 - RNA, 22 nt, Homo sapiens
gcaaaauugagaagggaauaua

SEQ ID NO: 306500 - RNA, 20 nt, Homo sapiens
ggaauguuaaucuccaugau

SEQ ID NO: 306501 - RNA, 21 nt, Homo sapiens
ggaauguugccagcagccaga

SEQ ID NO: 306502 - RNA, 21 nt, Homo sapiens
ggcauugugcccuugcucuag

SEQ ID NO: 306503 - RNA, 22 nt, Homo sapiens
guacacaacaugcagguuuguu

SEQ ID NO: 306504 - RNA, 22 nt, Homo sapiens
gucaucaggacgggucaucugc

SEQ ID NO: 306505 - RNA, 22 nt, Homo sapiens
gucucuuguuaucauuucugag

SEQ ID NO: 306506 - RNA, 22 nt, Homo sapiens
gugaaaugaaucuggaaauauu

SEQ ID NO: 306507 - RNA, 22 nt, Homo sapiens
gugcauaugcaugugcaugcac

SEQ ID NO: 306508 - RNA, 19 nt, Homo sapiens
aagugaaugcuuuguucac

SEQ ID NO: 306509 - RNA, 20 nt, Homo sapiens
ugaaaucuucacuaagucuc

SEQ ID NO: 306510 - RNA, 22 nt, Homo sapiens
ugaaaucuuugaugguggcauu

SEQ ID NO: 306511 - RNA, 22 nt, Homo sapiens
ugaacacagccugccucugcca

SEQ ID NO: 306512 - RNA, 22 nt, Homo sapiens
ugaacugagacuagacuuguuc

SEQ ID NO: 306513 - RNA, 22 nt, Homo sapiens
ugaauguaacuaaaccugugaa

SEQ ID NO: 306514 - RNA, 16 nt, Homo sapiens
ugaauguuuguggcug

SEQ ID NO: 306515 - RNA, 22 nt, Homo sapiens
ugacaguuuccagggcugucuc

SEQ ID NO: 306516 - RNA, 22 nt, Homo sapiens
ugaggaauguguguuaaagaua

SEQ ID NO: 306517 - RNA, 22 nt, Homo sapiens
ugagugaacgcugagaccaaau

SEQ ID NO: 306518 - RNA, 23 nt, Homo sapiens
ugauaacagcauaugaagauucu

SEQ ID NO: 306519 - RNA, 20 nt, Homo sapiens
ugaugcaaaucuuuaaaagu

SEQ ID NO: 306520 - RNA, 22 nt, Homo sapiens
ugauggcauuucauguuuguaa

SEQ ID NO: 306521 - RNA, 22 nt, Homo sapiens
ugauucccucaagugccuuaug

SEQ ID NO: 306522 - RNA, 22 nt, Homo sapiens
ugcaccacacuccauccugggc

SEQ ID NO: 306523 - RNA, 22 nt, Homo sapiens
ugcaccacugcacugccugggu

SEQ ID NO: 306524 - RNA, 21 nt, Homo sapiens
uggaauuaauggagagguguu

SEQ ID NO: 306525 - RNA, 21 nt, Homo sapiens
uggauuguacacccuaucauu

SEQ ID NO: 306526 - RNA, 22 nt, Homo sapiens
uggcauguuggguguugacucc

SEQ ID NO: 306527 - RNA, 22 nt, Homo sapiens
ugguguccugucucugcgcuug

SEQ ID NO: 306528 - RNA, 22 nt, Homo sapiens
ugucagaaucuagaggcugcua

SEQ ID NO: 306529 - RNA, 22 nt, Homo sapiens
ugucagaaucugagacgacaac

SEQ ID NO: 306530 - RNA, 21 nt, Homo sapiens
ugugaaaucuaggcagagguu

SEQ ID NO: 306531 - RNA, 22 nt, Homo sapiens
ugugcacaacaugcagguuugu

SEQ ID NO: 306532 - RNA, 22 nt, Homo sapiens
ugugcacaaugugcagguuuga

SEQ ID NO: 306533 - RNA, 18 nt, Homo sapiens
uguggcuguuuuccaaua

SEQ ID NO: 306534 - RNA, 22 nt, Homo sapiens
uguuacagcagcacaaaaugga

SEQ ID NO: 306535 - RNA, 22 nt, Homo sapiens
uguuugguggucucuucacaug

SEQ ID NO: 306536 - RNA, 22 nt, Homo sapiens
uuaauggagaguuucauuggug

SEQ ID NO: 306537 - RNA, 22 nt, Homo sapiens
uuacaggacuaagcagcuuugc

SEQ ID NO: 306538 - RNA, 22 nt, Homo sapiens
uuauacuacuauaaagagguag

SEQ ID NO: 306539 - RNA, 22 nt, Homo sapiens
uuaugucuuugagcaaugcugu

SEQ ID NO: 306540 - RNA, 22 nt, Homo sapiens
uuauuagagauauuugguuagg

SEQ ID NO: 306541 - RNA, 22 nt, Homo sapiens
uuauucauuaauugcuaagguu

SEQ ID NO: 306542 - RNA, 22 nt, Homo sapiens
uucaauacuguugauccuuaug

SEQ ID NO: 306543 - RNA, 22 nt, Homo sapiens
uucacaauuaaaugugguuauu

SEQ ID NO: 306544 - RNA, 22 nt, Homo sapiens
uucacugcacuccagccugagc

SEQ ID NO: 306545 - RNA, 20 nt, Homo sapiens
uucagcaaaggaaugggagu

SEQ ID NO: 306546 - RNA, 22 nt, Homo sapiens
uucagcaaugacagccuauaua

SEQ ID NO: 306547 - RNA, 22 nt, Homo sapiens
uucaucacagucuccgaugccc

SEQ ID NO: 306548 - RNA, 20 nt, Homo sapiens
uucuaguacuucuguuucca

SEQ ID NO: 306549 - RNA, 22 nt, Homo sapiens
uucuuugcaugaucucaaaguc

SEQ ID NO: 306550 - RNA, 21 nt, Homo sapiens
uucuuugcucaguguuagagu

SEQ ID NO: 306551 - RNA, 22 nt, Homo sapiens
uugaaugucuauuaaguuguuu

SEQ ID NO: 306552 - RNA, 22 nt, Homo sapiens
uugagaucuugauauguuugaa

SEQ ID NO: 306553 - RNA, 22 nt, Homo sapiens
uugagccaaggauugucuuucc

SEQ ID NO: 306554 - RNA, 22 nt, Homo sapiens
uugaguaguaagaagaugauag

SEQ ID NO: 306555 - RNA, 22 nt, Homo sapiens
uugaucaaaucugagugagaau

SEQ ID NO: 306556 - RNA, 22 nt, Homo sapiens
uugcaugcuccuuaugagaauc

SEQ ID NO: 306557 - RNA, 22 nt, Homo sapiens
uugcaugggagcugggugaggc

SEQ ID NO: 306558 - RNA, 22 nt, Homo sapiens
uuguaccacagggcaugaagug

SEQ ID NO: 306559 - RNA, 22 nt, Homo sapiens
uugugaaaaaccucucguggaa

SEQ ID NO: 306560 - RNA, 22 nt, Homo sapiens
uugugaaaucuaggcagagguu

SEQ ID NO: 306561 - RNA, 22 nt, Homo sapiens
uugugaagaugugaagcaagca

SEQ ID NO: 306562 - RNA, 22 nt, Homo sapiens
uuguggcuuaucucauuuagcg

SEQ ID NO: 306563 - RNA, 22 nt, Homo sapiens
uuuagcaauucauuuugugucu

SEQ ID NO: 306564 - RNA, 22 nt, Homo sapiens
uuuguacuucauacaauaacuc

SEQ ID NO: 306565 - RNA, 19 nt, Homo sapiens
uuuguccugcccuuucuca

SEQ ID NO: 306566 - RNA, 22 nt, Homo sapiens
uuugugcuccuguugagaaucu

SEQ ID NO: 306567 - RNA, 22 nt, Homo sapiens
uuuuugagaauuggugaaacac

SEQ ID NO: 306568 - RNA, 22 nt, Homo sapiens
auuacaugucuauccaugaaca

SEQ ID NO: 306569 - RNA, 22 nt, Homo sapiens
auugacaguuggccaguaagug

SEQ ID NO: 306570 - RNA, 22 nt, Homo sapiens
auugcccaggcuggagugcagu

SEQ ID NO: 306571 - RNA, 22 nt, Homo sapiens
cagcuguuguuaugucugcagg

SEQ ID NO: 306572 - RNA, 22 nt, Homo sapiens
cagugaauuucaggucaagagu

SEQ ID NO: 306573 - RNA, 22 nt, Homo sapiens
caguuguuuuaugacauaagau

SEQ ID NO: 306574 - RNA, 19 nt, Homo sapiens
caucacagagucuuccauu

SEQ ID NO: 306575 - RNA, 22 nt, Homo sapiens
cauggcauuucaagauuuacca

SEQ ID NO: 306576 - RNA, 23 nt, Homo sapiens
ccacaaugguugaacuagauuac

SEQ ID NO: 306577 - RNA, 22 nt, Homo sapiens
ccagauguuuucauucagcaag

SEQ ID NO: 306578 - RNA, 22 nt, Homo sapiens
ccaguguucuggaaggcugagu

SEQ ID NO: 306579 - RNA, 19 nt, Homo sapiens
ccaguguugccagagcuga

SEQ ID NO: 306580 - RNA, 22 nt, Homo sapiens
ccugagguagaguuuauauuga

SEQ ID NO: 306581 - RNA, 22 nt, Homo sapiens
cuaaggcaguagccugaauaau

SEQ ID NO: 306582 - RNA, 22 nt, Homo sapiens
cuacaguuauguuuuaaaugug

SEQ ID NO: 306583 - RNA, 22 nt, Homo sapiens
cucaguagaaaauacauggacu

SEQ ID NO: 306584 - RNA, 22 nt, Homo sapiens
cucauugcaaucuccaccuccc

SEQ ID NO: 306585 - RNA, 22 nt, Homo sapiens
cucucugagccccagacaccuu

SEQ ID NO: 306586 - RNA, 22 nt, Homo sapiens
cugugaagaaagucauugguag

SEQ ID NO: 306587 - RNA, 22 nt, Homo sapiens
cuuccaaguggggcacgugcca

SEQ ID NO: 306588 - RNA, 22 nt, Homo sapiens
cuuccagcuggguucagucagu

SEQ ID NO: 306589 - RNA, 22 nt, Homo sapiens
gaaacugcauuucuaacaagcu

SEQ ID NO: 306590 - RNA, 21 nt, Homo sapiens
gaccacagcagggaaugucag

SEQ ID NO: 306591 - RNA, 22 nt, Homo sapiens
gagaucuuggccaaguuucuua

SEQ ID NO: 306592 - RNA, 22 nt, Homo sapiens
gagcugaaguuuccauuuguac

SEQ ID NO: 306593 - RNA, 22 nt, Homo sapiens
gauauuacuuccaauauugcaa

SEQ ID NO: 306594 - RNA, 22 nt, Homo sapiens
gaucugucuuuccuuauagucu

SEQ ID NO: 306595 - RNA, 19 nt, Homo sapiens
gaucuguugaucaaugugu

SEQ ID NO: 306596 - RNA, 22 nt, Homo sapiens
gaucuguuucaauugucuuagu

SEQ ID NO: 306597 - RNA, 22 nt, Homo sapiens
gaugugaaaucauaguuucuag

SEQ ID NO: 306598 - RNA, 22 nt, Homo sapiens
gcaccaugguagaauaauggua

SEQ ID NO: 306599 - RNA, 22 nt, Homo sapiens
gcuccuuugaguagcuucugug

SEQ ID NO: 306600 - RNA, 22 nt, Homo sapiens
gcuggcuuucuccugaucucag

SEQ ID NO: 306601 - RNA, 22 nt, Homo sapiens
ggagaauguaauugguauuuug

SEQ ID NO: 306602 - RNA, 22 nt, Homo sapiens
ggaguguuccauuugucacauu

SEQ ID NO: 306603 - RNA, 22 nt, Homo sapiens
ggaucauaugauagcucaauuu

SEQ ID NO: 306604 - RNA, 22 nt, Homo sapiens
gggcauugugggcagagggcag

SEQ ID NO: 306605 - RNA, 22 nt, Homo sapiens
guauuagaugguauuugaagau

SEQ ID NO: 306606 - RNA, 22 nt, Homo sapiens
gucagcaaaguucuccugcaga

SEQ ID NO: 306607 - RNA, 22 nt, Homo sapiens
gucuuccagccuccaucuuucu

SEQ ID NO: 306608 - RNA, 22 nt, Homo sapiens
gugcauguccacuaguccauau

SEQ ID NO: 306609 - RNA, 22 nt, Homo sapiens
gugcuuauccccauucuggagg

SEQ ID NO: 306610 - RNA, 22 nt, Homo sapiens
guuauuaguugauauuaaguuc

SEQ ID NO: 306611 - RNA, 22 nt, Homo sapiens
guucagcaggggcuucaauggu

SEQ ID NO: 306612 - RNA, 22 nt, Homo sapiens
guuuggcucuuguuucugucaa

SEQ ID NO: 306613 - RNA, 17 nt, Homo sapiens
guuuggguacuggguaa

SEQ ID NO: 306614 - RNA, 22 nt, Homo sapiens
uaagccaccgugccuggccuaa

SEQ ID NO: 306615 - RNA, 22 nt, Homo sapiens
uacaaccucugccucccaaguu

SEQ ID NO: 306616 - RNA, 22 nt, Homo sapiens
uaccacccuuuuuccagaagcc

SEQ ID NO: 306617 - RNA, 22 nt, Homo sapiens
uacucacauucuguuucuugcu

SEQ ID NO: 306618 - RNA, 22 nt, Homo sapiens
uagauuaucccugauuugucca

SEQ ID NO: 306619 - RNA, 22 nt, Homo sapiens
uagcagaauauaccucuuacuu

SEQ ID NO: 306620 - RNA, 22 nt, Homo sapiens
uagugaaugucacuggcuguug

SEQ ID NO: 306621 - RNA, 22 nt, Homo sapiens
uaucaaguguuagggagaugug

SEQ ID NO: 306622 - RNA, 22 nt, Homo sapiens
uaucacagcgggguguacaccc

SEQ ID NO: 306623 - RNA, 20 nt, Homo sapiens
uaucacaggucagaaacccu

SEQ ID NO: 306624 - RNA, 22 nt, Homo sapiens
uaucauagucacuuccaguuug

SEQ ID NO: 306625 - RNA, 22 nt, Homo sapiens
uauccuagugggguuucaguca

SEQ ID NO: 306626 - RNA, 22 nt, Homo sapiens
uaugaaucuggcuacuccaggg

SEQ ID NO: 306627 - RNA, 22 nt, Homo sapiens
uauggccugaauuagaaaagug

SEQ ID NO: 306628 - RNA, 22 nt, Homo sapiens
ucacugaaaccgccuccaccuc

SEQ ID NO: 306629 - RNA, 22 nt, Homo sapiens
ucagcaaugcugcacucuacug

SEQ ID NO: 306630 - RNA, 22 nt, Homo sapiens
ucagguaguuugugggagauga

SEQ ID NO: 306631 - RNA, 22 nt, Homo sapiens
ucaucagaaucccuuagggaug

SEQ ID NO: 306632 - RNA, 22 nt, Homo sapiens
ucauucuuucuguggaggggcu

SEQ ID NO: 306633 - RNA, 22 nt, Homo sapiens
ucccagaaacgcauauguucau

SEQ ID NO: 306634 - RNA, 22 nt, Homo sapiens
ucucacacugaauguguguggg

SEQ ID NO: 306635 - RNA, 20 nt, Homo sapiens
ucucauggagggaaagagca

SEQ ID NO: 306636 - RNA, 19 nt, Homo sapiens
ucuuugcuuuucuaagagg

SEQ ID NO: 306637 - RNA, 21 nt, Homo sapiens
ugaauauuuggguugugucca

SEQ ID NO: 306638 - RNA, 22 nt, Homo sapiens
ugaauguuguugguugagauau

SEQ ID NO: 306639 - RNA, 22 nt, Homo sapiens
ugaauguuugcuuacuuccaua

SEQ ID NO: 306640 - RNA, 22 nt, Homo sapiens
ugacagcugaagauguugaacc

SEQ ID NO: 306641 - RNA, 22 nt, Homo sapiens
ugacuggagaccucaguagggu

SEQ ID NO: 306642 - RNA, 22 nt, Homo sapiens
ugagaacuaaugaagaauuuau

SEQ ID NO: 306643 - RNA, 22 nt, Homo sapiens
ugagaauauuuuccaugucuca

SEQ ID NO: 306644 - RNA, 22 nt, Homo sapiens
ugaggguauagccagcccuuag

SEQ ID NO: 306645 - RNA, 22 nt, Homo sapiens
ugaguguccaccccuuucacag

SEQ ID NO: 306646 - RNA, 22 nt, Homo sapiens
ugcaaugugaaauaagcacauc

SEQ ID NO: 306647 - RNA, 22 nt, Homo sapiens
ugcagagaaacauuuuguauuu

SEQ ID NO: 306648 - RNA, 22 nt, Homo sapiens
uggaagacucuagucucuugag

SEQ ID NO: 306649 - RNA, 22 nt, Homo sapiens
uggaauuaauuaaaauauacug

SEQ ID NO: 306650 - RNA, 22 nt, Homo sapiens
uggagugucaguuuccagaguu

SEQ ID NO: 306651 - RNA, 22 nt, Homo sapiens
uggcauguauuuuguguauuaa

SEQ ID NO: 306652 - RNA, 22 nt, Homo sapiens
uguauauguuuguacauauguc

SEQ ID NO: 306653 - RNA, 22 nt, Homo sapiens
ugugaaaucagauagccuuuuu

SEQ ID NO: 306654 - RNA, 22 nt, Homo sapiens
ugugaagauggacuaauauagu

SEQ ID NO: 306655 - RNA, 22 nt, Homo sapiens
ugugcacaacgugcagguuugu

SEQ ID NO: 306656 - RNA, 22 nt, Homo sapiens
ugugcacaaugugcagguuugu

SEQ ID NO: 306657 - RNA, 22 nt, Homo sapiens
ugugcaugacagcauacaaacg

SEQ ID NO: 306658 - RNA, 22 nt, Homo sapiens
ugugcuauguuauucacauggg

SEQ ID NO: 306659 - RNA, 22 nt, Homo sapiens
uguggcucuucuguucuccacu

SEQ ID NO: 306660 - RNA, 22 nt, Homo sapiens
uguuacagugacuaauguuuua

SEQ ID NO: 306661 - RNA, 22 nt, Homo sapiens
uguucacaguguuucuuugaga

SEQ ID NO: 306662 - RNA, 22 nt, Homo sapiens
ugaauguuugcagcuuauacca

SEQ ID NO: 306663 - RNA, 22 nt, Homo sapiens
ugacuggaacuuuagugagucu

SEQ ID NO: 306664 - RNA, 21 nt, Homo sapiens
ugagaguaguguauuauucuc

SEQ ID NO: 306665 - RNA, 22 nt, Homo sapiens
ugaggaaugaccccgugugguc

SEQ ID NO: 306666 - RNA, 22 nt, Homo sapiens
ugaguagaacuccuggagaugu

SEQ ID NO: 306667 - RNA, 22 nt, Homo sapiens
ugaguauagaucaguucaagug

SEQ ID NO: 306668 - RNA, 22 nt, Homo sapiens
aagcucauugagaucuauggcu

SEQ ID NO: 306669 - RNA, 22 nt, Homo sapiens
aaguauuaugaguccuuguuuu

SEQ ID NO: 306670 - RNA, 22 nt, Homo sapiens
aauaaagcugaauccuuccuga

SEQ ID NO: 306671 - RNA, 22 nt, Homo sapiens
aauauugucaaaauggauucca

SEQ ID NO: 306672 - RNA, 22 nt, Homo sapiens
acacuuucuggagcugcacaua

SEQ ID NO: 306673 - RNA, 20 nt, Homo sapiens
aaaguaggcuaauaccaaaa

SEQ ID NO: 306674 - RNA, 22 nt, Homo sapiens
accugggugcugaugggcuuua

SEQ ID NO: 306675 - RNA, 21 nt, Homo sapiens
acugagagaucuggggcacau

SEQ ID NO: 306676 - RNA, 22 nt, Homo sapiens
acugcacuccagccugagccug

SEQ ID NO: 306677 - RNA, 22 nt, Homo sapiens
acugcacuccagccuggaccac

SEQ ID NO: 306678 - RNA, 22 nt, Homo sapiens
acugcacugcagccuggccaac

SEQ ID NO: 306679 - RNA, 22 nt, Homo sapiens
agagagcuugggguguuaaauu

SEQ ID NO: 306680 - RNA, 22 nt, Homo sapiens
agagcaccauuuagcaagguga

SEQ ID NO: 306681 - RNA, 23 nt, Homo sapiens
agcaccuuuccuccacuaucugc

SEQ ID NO: 306682 - RNA, 20 nt, Homo sapiens
agcagccacagauuccucag

SEQ ID NO: 306683 - RNA, 22 nt, Homo sapiens
agcccauguggcugaggcuucu

SEQ ID NO: 306684 - RNA, 22 nt, Homo sapiens
agcugauggucuuguaugaugu

SEQ ID NO: 306685 - RNA, 21 nt, Homo sapiens
aggauaguagauuaaauauuu

SEQ ID NO: 306686 - RNA, 22 nt, Homo sapiens
aggcaagcaucuugcucccuuc

SEQ ID NO: 306687 - RNA, 22 nt, Homo sapiens
auaaacagcuuauccucuauuc

SEQ ID NO: 306688 - RNA, 17 nt, Homo sapiens
auaaacucaucauuuuu

SEQ ID NO: 306689 - RNA, 22 nt, Homo sapiens
auaaaugcuuagaucuguauau

SEQ ID NO: 306690 - RNA, 22 nt, Homo sapiens
auaagucaauggaacagauuaa

SEQ ID NO: 306691 - RNA, 22 nt, Homo sapiens
aucaaagcagcauggcccaguc

SEQ ID NO: 306692 - RNA, 22 nt, Homo sapiens
auccagaugggcuuaauguaau

SEQ ID NO: 306693 - RNA, 22 nt, Homo sapiens
augccauugcacuccagccuag

SEQ ID NO: 306694 - RNA, 22 nt, Homo sapiens
augccauugcacuccagccugg

SEQ ID NO: 306695 - RNA, 22 nt, Homo sapiens
auggacagacacuggccuucug

SEQ ID NO: 306696 - RNA, 22 nt, Homo sapiens
auguccuggacccagacaaagc

SEQ ID NO: 306697 - RNA, 22 nt, Homo sapiens
caacacuguuuauuggauagcc

SEQ ID NO: 306698 - RNA, 22 nt, Homo sapiens
cacagugaaugucaucauugcc

SEQ ID NO: 306699 - RNA, 22 nt, Homo sapiens
cacauguucaggagcacuuaga

SEQ ID NO: 306700 - RNA, 22 nt, Homo sapiens
cagauacuggccuggagcugug

SEQ ID NO: 306701 - RNA, 22 nt, Homo sapiens
cagggcauuggcugguaccugg

SEQ ID NO: 306702 - RNA, 22 nt, Homo sapiens
caggugaaugccucuccuucug

SEQ ID NO: 306703 - RNA, 22 nt, Homo sapiens
ccaucacaggccucagugggaa

SEQ ID NO: 306704 - RNA, 19 nt, Homo sapiens
cuaaaugggucccuagugg

SEQ ID NO: 306705 - RNA, 19 nt, Homo sapiens
cugcaagguaauaggucag

SEQ ID NO: 306706 - RNA, 22 nt, Homo sapiens
cuggaaggaaaaacaaccacag

SEQ ID NO: 306707 - RNA, 22 nt, Homo sapiens
gaacccuggaggcggagguugc

SEQ ID NO: 306708 - RNA, 22 nt, Homo sapiens
gacauguuuucaagauuuauaa

SEQ ID NO: 306709 - RNA, 22 nt, Homo sapiens
gaccacagacuggaaagagggc

SEQ ID NO: 306710 - RNA, 22 nt, Homo sapiens
gacuggccauugauacagaggu

SEQ ID NO: 306711 - RNA, 22 nt, Homo sapiens
gagaacauacggcauuugguuu

SEQ ID NO: 306712 - RNA, 22 nt, Homo sapiens
gagcugaucuuuauguaaauuc

SEQ ID NO: 306713 - RNA, 22 nt, Homo sapiens
gagggcacugcuuuccuuucaa

SEQ ID NO: 306714 - RNA, 22 nt, Homo sapiens
gaugccuuuuuguccucaguua

SEQ ID NO: 306715 - RNA, 22 nt, Homo sapiens
ggcacaaugucagcucacugca

SEQ ID NO: 306716 - RNA, 22 nt, Homo sapiens
gggaggucauuguaaggucuua

SEQ ID NO: 306717 - RNA, 22 nt, Homo sapiens
guaugaaaaucggagauugggu

SEQ ID NO: 306718 - RNA, 22 nt, Homo sapiens
gucagggagucucuaucagugg

SEQ ID NO: 306719 - RNA, 22 nt, Homo sapiens
gucauuguguggacauggagaa

SEQ ID NO: 306720 - RNA, 22 nt, Homo sapiens
guggaagguaaugcagcuuacu

SEQ ID NO: 306721 - RNA, 22 nt, Homo sapiens
guggcaaacucagcaugcccca

SEQ ID NO: 306722 - RNA, 22 nt, Homo sapiens
guguggcaggugggggcucaga

SEQ ID NO: 306723 - RNA, 23 nt, Homo sapiens
uaagucacacagauuaauuuauu

SEQ ID NO: 306724 - RNA, 22 nt, Homo sapiens
uaauagagucauuauuauuguu

SEQ ID NO: 306725 - RNA, 22 nt, Homo sapiens
uaauauguauacagacagauac

SEQ ID NO: 306726 - RNA, 22 nt, Homo sapiens
uaaugugaauagugcuguaaug

SEQ ID NO: 306727 - RNA, 22 nt, Homo sapiens
uacaacacugguucgacaugug

SEQ ID NO: 306728 - RNA, 22 nt, Homo sapiens
uaccacauuguagagggcauuc

SEQ ID NO: 306729 - RNA, 19 nt, Homo sapiens
uagcacagggucccagacu

SEQ ID NO: 306730 - RNA, 22 nt, Homo sapiens
uagcauggaggcggccauagug

SEQ ID NO: 306731 - RNA, 20 nt, Homo sapiens
uauagcaauuuuuuucuccu

SEQ ID NO: 306732 - RNA, 22 nt, Homo sapiens
uauggcacacguuuaccuaugu

SEQ ID NO: 306733 - RNA, 18 nt, Homo sapiens
ucaagcuauugucaugcc

SEQ ID NO: 306734 - RNA, 22 nt, Homo sapiens
ucacauggaggugauaguugaa

SEQ ID NO: 306735 - RNA, 22 nt, Homo sapiens
ucacauggcagagaagaagcuc

SEQ ID NO: 306736 - RNA, 22 nt, Homo sapiens
ucacaugucagccguggggaag

SEQ ID NO: 306737 - RNA, 22 nt, Homo sapiens
ucacaugugacauauauauuug

SEQ ID NO: 306738 - RNA, 22 nt, Homo sapiens
ucaccuggggaucuuguuuaca

SEQ ID NO: 306739 - RNA, 20 nt, Homo sapiens
ucacugugaacuucuugagg

SEQ ID NO: 306740 - RNA, 22 nt, Homo sapiens
ucagggacgcuugacacaagcc

SEQ ID NO: 306741 - RNA, 22 nt, Homo sapiens
ucgcaccauugcacuccagcca

SEQ ID NO: 306742 - RNA, 17 nt, Homo sapiens
ucuaauaauaugcauuu

SEQ ID NO: 306743 - RNA, 22 nt, Homo sapiens
ucucaaguggucgcaguuagau

SEQ ID NO: 306744 - RNA, 22 nt, Homo sapiens
ugacaagcucccucugcaccuu

SEQ ID NO: 306745 - RNA, 22 nt, Homo sapiens
ugagacauacuuacaggggaug

SEQ ID NO: 306746 - RNA, 22 nt, Homo sapiens
ugagauaaugcaugugaagauc

SEQ ID NO: 306747 - RNA, 23 nt, Homo sapiens
ugagauuauaaucuuuuacuucu

SEQ ID NO: 306748 - RNA, 22 nt, Homo sapiens
ugaugcugaugccugccagaag

SEQ ID NO: 306749 - RNA, 20 nt, Homo sapiens
ugccugacacucuuugcuuc

SEQ ID NO: 306750 - RNA, 22 nt, Homo sapiens
uggaagacaaguguuagcaugg

SEQ ID NO: 306751 - RNA, 22 nt, Homo sapiens
uggaagacaggcuguauuuuaa

SEQ ID NO: 306752 - RNA, 21 nt, Homo sapiens
uggaccccuacuucucaccau

SEQ ID NO: 306753 - RNA, 21 nt, Homo sapiens
uggaccccuuccuuacaucau

SEQ ID NO: 306754 - RNA, 22 nt, Homo sapiens
uggagugcaauggcaccaucuu

SEQ ID NO: 306755 - RNA, 22 nt, Homo sapiens
uggcauggaguggauggcccca

SEQ ID NO: 306756 - RNA, 22 nt, Homo sapiens
uggcauuuucucuguucuuaga

SEQ ID NO: 306757 - RNA, 22 nt, Homo sapiens
ugggaccccuacucuuuccaca

SEQ ID NO: 306758 - RNA, 22 nt, Homo sapiens
ugggugugaccgcucaaggggg

SEQ ID NO: 306759 - RNA, 22 nt, Homo sapiens
uggugcccuguccuucuguggc

SEQ ID NO: 306760 - RNA, 22 nt, Homo sapiens
uguccguuuuggcuuucucccu

SEQ ID NO: 306761 - RNA, 22 nt, Homo sapiens
ugugacucuggcacauggugag

SEQ ID NO: 306762 - RNA, 22 nt, Homo sapiens
uguguacaucucuacacacaug

SEQ ID NO: 306763 - RNA, 22 nt, Homo sapiens
uuccaguguguucauccucaga

SEQ ID NO: 306764 - RNA, 22 nt, Homo sapiens
uuccuggaggggaaguguccaa

SEQ ID NO: 306765 - RNA, 22 nt, Homo sapiens
uuccuugagucuuuuuccugag

SEQ ID NO: 306766 - RNA, 22 nt, Homo sapiens
uucucagugcuaucuuuuaugc

SEQ ID NO: 306767 - RNA, 17 nt, Homo sapiens
uucucaguucugaucuc

SEQ ID NO: 306768 - RNA, 22 nt, Homo sapiens
uucuuuaguucacuugcuccag

SEQ ID NO: 306769 - RNA, 22 nt, Homo sapiens
augaaaagcauaaacgcugaag

SEQ ID NO: 306770 - RNA, 22 nt, Homo sapiens
augaggugggagaaucacuuga

SEQ ID NO: 306771 - RNA, 22 nt, Homo sapiens
augaucaucugaaagcuuuuac

SEQ ID NO: 306772 - RNA, 22 nt, Homo sapiens
auggccauuacuaagaauguuu

SEQ ID NO: 306773 - RNA, 22 nt, Homo sapiens
augguuagauguauccuuucca

SEQ ID NO: 306774 - RNA, 22 nt, Homo sapiens
augugggaggacuuggcuguug

SEQ ID NO: 306775 - RNA, 22 nt, Homo sapiens
auuagguuaggcaaacuucugu

SEQ ID NO: 306776 - RNA, 22 nt, Homo sapiens
auuagguuguugcaaaaguaau

SEQ ID NO: 306777 - RNA, 22 nt, Homo sapiens
cacaaugucugguaggccacuu

SEQ ID NO: 306778 - RNA, 22 nt, Homo sapiens
cagcccuacacagacugacuca

SEQ ID NO: 306779 - RNA, 22 nt, Homo sapiens
cagcuggugcugcaccaguggg

SEQ ID NO: 306780 - RNA, 22 nt, Homo sapiens
cauauaguaguacuguuagguu

SEQ ID NO: 306781 - RNA, 22 nt, Homo sapiens
ccccauguucucucugcagcuc

SEQ ID NO: 306782 - RNA, 22 nt, Homo sapiens
cuacaguguauuuauggagggu

SEQ ID NO: 306783 - RNA, 22 nt, Homo sapiens
cucucaguguggaggccagaaa

SEQ ID NO: 306784 - RNA, 22 nt, Homo sapiens
cucucaguugucuaauuaguuu

SEQ ID NO: 306785 - RNA, 22 nt, Homo sapiens
cugagcaugacaucaugugacu

SEQ ID NO: 306786 - RNA, 18 nt, Homo sapiens
cuggaaggcuacuacagu

SEQ ID NO: 306787 - RNA, 22 nt, Homo sapiens
cuucagcaauauauccccuggg

SEQ ID NO: 306788 - RNA, 22 nt, Homo sapiens
gacauguuuacaguguugagag

SEQ ID NO: 306789 - RNA, 22 nt, Homo sapiens
aaagugacuuagugccccauuu

SEQ ID NO: 306790 - RNA, 22 nt, Homo sapiens
aaguaaaucuuaugucagggag

SEQ ID NO: 306791 - RNA, 22 nt, Homo sapiens
aauacugugauaucgagcgauu

SEQ ID NO: 306792 - RNA, 22 nt, Homo sapiens
acccuggaggucuacagugcag

SEQ ID NO: 306793 - RNA, 22 nt, Homo sapiens
agagaacuggcuucaccauucu

SEQ ID NO: 306794 - RNA, 19 nt, Homo sapiens
agagacucauuguagcauu

SEQ ID NO: 306795 - RNA, 22 nt, Homo sapiens
agaguauagcaacuuaguaaaa

SEQ ID NO: 306796 - RNA, 22 nt, Homo sapiens
agcagcucaugccuuugggagg

SEQ ID NO: 306797 - RNA, 22 nt, Homo sapiens
aggcauggagacuaaaauuaua

SEQ ID NO: 306798 - RNA, 22 nt, Homo sapiens
aggcaugguggcacauacaugu

SEQ ID NO: 306799 - RNA, 22 nt, Homo sapiens
aguacacuguuaaaaagaagug

SEQ ID NO: 306800 - RNA, 22 nt, Homo sapiens
auaaaguguuuaguauaggcaa

SEQ ID NO: 306801 - RNA, 23 nt, Homo sapiens
auauaguagaugugcaguaacau

SEQ ID NO: 306802 - RNA, 22 nt, Homo sapiens
aucacauggccagguaguaauc

SEQ ID NO: 306803 - RNA, 22 nt, Homo sapiens
aucacauggccuagccuaaccu

SEQ ID NO: 306804 - RNA, 22 nt, Homo sapiens
aucaccuggaguagcccguccc

SEQ ID NO: 306805 - RNA, 22 nt, Homo sapiens
aucucaguuaauuccaucuuuc

SEQ ID NO: 306806 - RNA, 22 nt, Homo sapiens
gacauguuucucucuguuuacu

SEQ ID NO: 306807 - RNA, 20 nt, Homo sapiens
gacauguuuuguggccuaac

SEQ ID NO: 306808 - RNA, 21 nt, Homo sapiens
gaccacagcagggaaugucag

SEQ ID NO: 306809 - RNA, 22 nt, Homo sapiens
gagacagugucagccauugaaa

SEQ ID NO: 306810 - RNA, 22 nt, Homo sapiens
gauugguugaaaguagaauacu

SEQ ID NO: 306811 - RNA, 22 nt, Homo sapiens
gcacaggguuacauucuaaggu

SEQ ID NO: 306812 - RNA, 22 nt, Homo sapiens
gcaccguggaguauggggagga

SEQ ID NO: 306813 - RNA, 22 nt, Homo sapiens
gcagugcaguggcgcgaucucg

SEQ ID NO: 306814 - RNA, 22 nt, Homo sapiens
ggaaagacuauuguaaaggaug

SEQ ID NO: 306815 - RNA, 22 nt, Homo sapiens
ggaauauaaaacuuuugacagg

SEQ ID NO: 306816 - RNA, 21 nt, Homo sapiens
ggcauugugcccuugcucuag

SEQ ID NO: 306817 - RNA, 22 nt, Homo sapiens
gggcgagaaucggcugcucagc

SEQ ID NO: 306818 - RNA, 19 nt, Homo sapiens
guaaucucaguacuuuggu

SEQ ID NO: 306819 - RNA, 22 nt, Homo sapiens
gucucagugcgaaucucaaaga

SEQ ID NO: 306820 - RNA, 22 nt, Homo sapiens
guggaagauaguguguuaaugu

SEQ ID NO: 306821 - RNA, 22 nt, Homo sapiens
uacagcacugugcauagugguu

SEQ ID NO: 306822 - RNA, 23 nt, Homo sapiens
uaccugagacuggguaauuaaua

SEQ ID NO: 306823 - RNA, 22 nt, Homo sapiens
uagaaaguagggaagguaggau

SEQ ID NO: 306824 - RNA, 22 nt, Homo sapiens
uagaggaaggauuggaaacgca

SEQ ID NO: 306825 - RNA, 22 nt, Homo sapiens
uagaggaaugaauuuggccaga

SEQ ID NO: 306826 - RNA, 21 nt, Homo sapiens
uagaugguguucuagagagaa

SEQ ID NO: 306827 - RNA, 22 nt, Homo sapiens
uagcacagggaauugguucucu

SEQ ID NO: 306828 - RNA, 22 nt, Homo sapiens
uagcacaguucacccucgauuu

SEQ ID NO: 306829 - RNA, 22 nt, Homo sapiens
uaucccaguggauguaccccau

SEQ ID NO: 306830 - RNA, 22 nt, Homo sapiens
uaugagagcugguagguagaga

SEQ ID NO: 306831 - RNA, 22 nt, Homo sapiens
uauggcuuuguucaacagccuc

SEQ ID NO: 306832 - RNA, 22 nt, Homo sapiens
uauuacuguuauuccuaucaaa

SEQ ID NO: 306833 - RNA, 21 nt, Homo sapiens
ucaaggaguauacguaugcca

SEQ ID NO: 306834 - RNA, 22 nt, Homo sapiens
ucacaugugcguuuuggcaugu

SEQ ID NO: 306835 - RNA, 22 nt, Homo sapiens
ucacauguguaugagcuuugau

SEQ ID NO: 306836 - RNA, 22 nt, Homo sapiens
ucaccuggagaagauggaucau

SEQ ID NO: 306837 - RNA, 22 nt, Homo sapiens
ucaccuggagagcuugcuaaua

SEQ ID NO: 306838 - RNA, 21 nt, Homo sapiens
ucagggaccugcuguacugau

SEQ ID NO: 306839 - RNA, 22 nt, Homo sapiens
ucaucagugcuugcaaauuauu

SEQ ID NO: 306840 - RNA, 22 nt, Homo sapiens
ucccuuucuggaguuucccaag

SEQ ID NO: 306841 - RNA, 22 nt, Homo sapiens
ucucaguggcacccccaacacc

SEQ ID NO: 306842 - RNA, 22 nt, Homo sapiens
ugaagacauuuuugggugugua

SEQ ID NO: 306843 - RNA, 22 nt, Homo sapiens
ugaaugccauucuguguuagcu

SEQ ID NO: 306844 - RNA, 23 nt, Homo sapiens
ugagacauuggaaaguuaggcag

SEQ ID NO: 306845 - RNA, 21 nt, Homo sapiens
ugagauaauauguuucugaug

SEQ ID NO: 306846 - RNA, 22 nt, Homo sapiens
ugagauuaaucuuuaaguaaga

SEQ ID NO: 306847 - RNA, 21 nt, Homo sapiens
ugagcauuaguacaguaggga

SEQ ID NO: 306848 - RNA, 17 nt, Homo sapiens
ugcaauuuaagcuagau

SEQ ID NO: 306849 - RNA, 22 nt, Homo sapiens
ugcccuuugucagaugaguagg

SEQ ID NO: 306850 - RNA, 23 nt, Homo sapiens
uggaagacuccucucuuggcugc

SEQ ID NO: 306851 - RNA, 22 nt, Homo sapiens
uggaaggucauuguucauuuga

SEQ ID NO: 306852 - RNA, 22 nt, Homo sapiens
uggagggcuagucauuucuuuu

SEQ ID NO: 306853 - RNA, 22 nt, Homo sapiens
uguggcaaauggucaggaagaa

SEQ ID NO: 306854 - RNA, 21 nt, Homo sapiens
uguggcaauggccucacagau

SEQ ID NO: 306855 - RNA, 22 nt, Homo sapiens
uguuaagaugucaauuuuccac

SEQ ID NO: 306856 - RNA, 22 nt, Homo sapiens
uuaagaagugauuuuccucauu

SEQ ID NO: 306857 - RNA, 22 nt, Homo sapiens
uucacugcacuccagccugagc

SEQ ID NO: 306858 - RNA, 22 nt, Homo sapiens
uucagggacuuuagacaagaga

SEQ ID NO: 306859 - RNA, 22 nt, Homo sapiens
uuccuugaaacagucaagagaa

SEQ ID NO: 306860 - RNA, 20 nt, Homo sapiens
uucuacagucacaggaagau

SEQ ID NO: 306861 - RNA, 22 nt, Homo sapiens
uugaggugggaggaucacuuga

SEQ ID NO: 306862 - RNA, 20 nt, Homo sapiens
uugaggugugaggggcagag

SEQ ID NO: 306863 - RNA, 22 nt, Homo sapiens
uuggaaggcugaauggccucuc

SEQ ID NO: 306864 - RNA, 22 nt, Homo sapiens
uuuagcaaagcaauuuacacca

SEQ ID NO: 306865 - RNA, 22 nt, Homo sapiens
uuuagcaaugcuguggggaagu

SEQ ID NO: 306866 - RNA, 22 nt, Homo sapiens
uuucccugaaggcucugaaguc

SEQ ID NO: 306867 - RNA, 17 nt, Homo sapiens
uuucucagcccucuucu

SEQ ID NO: 306868 - RNA, 22 nt, Homo sapiens
gucaggaccucgguggcauucu

SEQ ID NO: 306869 - RNA, 22 nt, Homo sapiens
gucagggagggauagaugauua

SEQ ID NO: 306870 - RNA, 22 nt, Homo sapiens
gugaaaagaugagcaccauaca

SEQ ID NO: 306871 - RNA, 22 nt, Homo sapiens
gugaucucagcucacuggaacc

SEQ ID NO: 306872 - RNA, 22 nt, Homo sapiens
guggaggacuggauaaagaaaa

SEQ ID NO: 306873 - RNA, 22 nt, Homo sapiens
guggcaugaaagcagauaccac

SEQ ID NO: 306874 - RNA, 22 nt, Homo sapiens
uaauaauguuaggcuuacucaa

SEQ ID NO: 306875 - RNA, 22 nt, Homo sapiens
uaccugagcccucugcugaguu

SEQ ID NO: 306876 - RNA, 22 nt, Homo sapiens
uagaaugcauuagguugcccag

SEQ ID NO: 306877 - RNA, 17 nt, Homo sapiens
uagcacagugccuggua

SEQ ID NO: 306878 - RNA, 22 nt, Homo sapiens
uagcacagugucauucuaggua

SEQ ID NO: 306879 - RNA, 22 nt, Homo sapiens
uagcagaauaacuugccagccu

SEQ ID NO: 306880 - RNA, 22 nt, Homo sapiens
uagcaguaagaaacugacauug

SEQ ID NO: 306881 - RNA, 20 nt, Homo sapiens
uagccggguguugugucaug

SEQ ID NO: 306882 - RNA, 22 nt, Homo sapiens
uagcugauguuugucuaguagc

SEQ ID NO: 306883 - RNA, 19 nt, Homo sapiens
uaucacuucccuggaaaca

SEQ ID NO: 306884 - RNA, 22 nt, Homo sapiens
uauuacugucaauaucacagaa

SEQ ID NO: 306885 - RNA, 22 nt, Homo sapiens
uauuccagcccuggugagccag

SEQ ID NO: 306886 - RNA, 22 nt, Homo sapiens
ucacaugugaagauugggagua

SEQ ID NO: 306887 - RNA, 22 nt, Homo sapiens
ucacauguguaaauugguguaa

SEQ ID NO: 306888 - RNA, 22 nt, Homo sapiens
ucacugggagcauuugagccuu

SEQ ID NO: 306889 - RNA, 22 nt, Homo sapiens
ucagggacuuacaaaccagaag

SEQ ID NO: 306890 - RNA, 21 nt, Homo sapiens
uccugagagaggaguaacucu

SEQ ID NO: 306891 - RNA, 22 nt, Homo sapiens
ucuaaaacuagauugugaugau

SEQ ID NO: 306892 - RNA, 19 nt, Homo sapiens
ucucaguguuggucaggug

SEQ ID NO: 306893 - RNA, 20 nt, Homo sapiens
ugaaacacauggacuggggu

SEQ ID NO: 306894 - RNA, 22 nt, Homo sapiens
ugaacagcacguuuauucagaa

SEQ ID NO: 306895 - RNA, 22 nt, Homo sapiens
ugaccucugauagcaguaggug

SEQ ID NO: 306896 - RNA, 22 nt, Homo sapiens
ugagucaugcuggagucauggc

SEQ ID NO: 306897 - RNA, 22 nt, Homo sapiens
ugagugaacgcugagaccaaau

SEQ ID NO: 306898 - RNA, 22 nt, Homo sapiens
ugaugugucaucugagagagug

SEQ ID NO: 306899 - RNA, 22 nt, Homo sapiens
uggaaaacaugcacauuggauu

SEQ ID NO: 306900 - RNA, 22 nt, Homo sapiens
uggaagacucaagguggugaau

SEQ ID NO: 306901 - RNA, 22 nt, Homo sapiens
uggaagacucuagucucuugag

SEQ ID NO: 306902 - RNA, 20 nt, Homo sapiens
uggaagccuggugcuaucuu

SEQ ID NO: 306903 - RNA, 19 nt, Homo sapiens
uggaccccuuccuuacacc

SEQ ID NO: 306904 - RNA, 21 nt, Homo sapiens
uggaccccuuccuugcaccau

SEQ ID NO: 306905 - RNA, 21 nt, Homo sapiens
uggaccccuuucuuacaccgu

SEQ ID NO: 306906 - RNA, 22 nt, Homo sapiens
uggcacuggagauacauuaaua

SEQ ID NO: 306907 - RNA, 22 nt, Homo sapiens
uggcauggggcagaacauuaca

SEQ ID NO: 306908 - RNA, 21 nt, Homo sapiens
uguccagcuuuuggaauauaa

SEQ ID NO: 306909 - RNA, 22 nt, Homo sapiens
uguggcaaagucuugugaauau

SEQ ID NO: 306910 - RNA, 22 nt, Homo sapiens
uguuaagauguguuuuguggcu

SEQ ID NO: 306911 - RNA, 22 nt, Homo sapiens
uuaaagcuggcguuacaguuug

SEQ ID NO: 306912 - RNA, 22 nt, Homo sapiens
uuaaggaaggagucuuaaaugg

SEQ ID NO: 306913 - RNA, 22 nt, Homo sapiens
uuagcacauuuccagcacaugg

SEQ ID NO: 306914 - RNA, 22 nt, Homo sapiens
uuagcagcaccccacucuacug

SEQ ID NO: 306915 - RNA, 22 nt, Homo sapiens
uuauagacacguuguaacaaac

SEQ ID NO: 306916 - RNA, 22 nt, Homo sapiens
uucacaugacagggugaagcau

SEQ ID NO: 306917 - RNA, 22 nt, Homo sapiens
uucaccuugggucccacuugcu

SEQ ID NO: 306918 - RNA, 22 nt, Homo sapiens
uucaggguggagaguaugaggu

SEQ ID NO: 306919 - RNA, 22 nt, Homo sapiens
uuccagaugggaguucuauucu

SEQ ID NO: 306920 - RNA, 20 nt, Homo sapiens
uuccagcacauuagggaagc

SEQ ID NO: 306921 - RNA, 22 nt, Homo sapiens
uuccugaggccuccccagaagc

SEQ ID NO: 306922 - RNA, 22 nt, Homo sapiens
uucucagugaacuccagcuugu

SEQ ID NO: 306923 - RNA, 22 nt, Homo sapiens
uucucaguucgguggcagugcu

SEQ ID NO: 306924 - RNA, 22 nt, Homo sapiens
uucuucaggcauucccagaagc

SEQ ID NO: 306925 - RNA, 22 nt, Homo sapiens
uuggaagagaagggagauaaac

SEQ ID NO: 306926 - RNA, 22 nt, Homo sapiens
cacaggccugucucuuucuaac

SEQ ID NO: 306927 - RNA, 23 nt, Homo sapiens
cacagggugaacaccccuaaucc

SEQ ID NO: 306928 - RNA, 22 nt, Homo sapiens
cacauguuugcuacauuuuucu

SEQ ID NO: 306929 - RNA, 22 nt, Homo sapiens
caucacaugcuuauuuuccuca

SEQ ID NO: 306930 - RNA, 22 nt, Homo sapiens
caugggacugucuuggcuauac

SEQ ID NO: 306931 - RNA, 22 nt, Homo sapiens
cuagcagacacuuccagagagu

SEQ ID NO: 306932 - RNA, 22 nt, Homo sapiens
cugaaaagcaucugcauagcug

SEQ ID NO: 306933 - RNA, 22 nt, Homo sapiens
cuguccugcagagucagaauga

SEQ ID NO: 306934 - RNA, 22 nt, Homo sapiens
cuuugcuaauccaacccucauc

SEQ ID NO: 306935 - RNA, 20 nt, Homo sapiens
gacauggaggaggauuauua

SEQ ID NO: 306936 - RNA, 20 nt, Homo sapiens
gacauguugguuugcugcac

SEQ ID NO: 306937 - RNA, 22 nt, Homo sapiens
gacauguuuucauguauuugga

SEQ ID NO: 306938 - RNA, 22 nt, Homo sapiens
gacauguuuuuuaagguuuaug

SEQ ID NO: 306939 - RNA, 22 nt, Homo sapiens
gacuggccuauaauggcgaauu

SEQ ID NO: 306940 - RNA, 18 nt, Homo sapiens
gacuuggaguuuacagug

SEQ ID NO: 306941 - RNA, 22 nt, Homo sapiens
gagaacagagauaauuuuacuu

SEQ ID NO: 306942 - RNA, 22 nt, Homo sapiens
gauauguaaaaauuauaucuga

SEQ ID NO: 306943 - RNA, 22 nt, Homo sapiens
gauauguuucuucaauaccuag

SEQ ID NO: 306944 - RNA, 22 nt, Homo sapiens
gauggcauuucuggaucugaca

SEQ ID NO: 306945 - RNA, 22 nt, Homo sapiens
gauggcauuucuggaucugccc

SEQ ID NO: 306946 - RNA, 22 nt, Homo sapiens
gcugauguuggccucugggcuu

SEQ ID NO: 306947 - RNA, 22 nt, Homo sapiens
gcugauguuuucagguaauucu

SEQ ID NO: 306948 - RNA, 22 nt, Homo sapiens
ggaaaucaucauucucgguaua

SEQ ID NO: 306949 - RNA, 22 nt, Homo sapiens
ggaauauaaaaagccccagaau

SEQ ID NO: 306950 - RNA, 22 nt, Homo sapiens
ggagcugugauuugaguccaga

SEQ ID NO: 306951 - RNA, 22 nt, Homo sapiens
ggauggcauuucuuuagcuuuu

SEQ ID NO: 306952 - RNA, 22 nt, Homo sapiens
ggcaaaauauugucugguauag

SEQ ID NO: 306953 - RNA, 22 nt, Homo sapiens
ggcaagcucaggccucaggugu

SEQ ID NO: 306954 - RNA, 22 nt, Homo sapiens
ggcaugcauuguacuaguaugc

SEQ ID NO: 306955 - RNA, 22 nt, Homo sapiens
ggcuagagacaaguugcugaga

SEQ ID NO: 306956 - RNA, 22 nt, Homo sapiens
ggugaggaaaguugaguuucua

SEQ ID NO: 306957 - RNA, 22 nt, Homo sapiens
guauugcuugagcccaggaguu

SEQ ID NO: 306958 - RNA, 22 nt, Homo sapiens
gucacugagcaauagaaaguuu

SEQ ID NO: 306959 - RNA, 22 nt, Homo sapiens
gucuuuggaaaaaaugucuguu

SEQ ID NO: 306960 - RNA, 22 nt, Homo sapiens
guggcaaagaugccuucuccaa

SEQ ID NO: 306961 - RNA, 23 nt, Homo sapiens
uugaaaagucaguagccucugau

SEQ ID NO: 306962 - RNA, 22 nt, Homo sapiens
uugccgggugcaguggcucaug

SEQ ID NO: 306963 - RNA, 22 nt, Homo sapiens
uugggagugucucuggacugca

SEQ ID NO: 306964 - RNA, 22 nt, Homo sapiens
uugugcuuuacuuacuaccaga

SEQ ID NO: 306965 - RNA, 22 nt, Homo sapiens
uuuaguccucugaaaaucuaua

SEQ ID NO: 306966 - RNA, 22 nt, Homo sapiens
uuuccaguuggaaagccuguuu

SEQ ID NO: 306967 - RNA, 22 nt, Homo sapiens
uuuuccagugggacucccauua

SEQ ID NO: 306968 - RNA, 22 nt, Homo sapiens
aacuggccuggcgugcagaggg

SEQ ID NO: 306969 - RNA, 22 nt, Homo sapiens
aagaggcuguaggauaaugccu

SEQ ID NO: 306970 - RNA, 22 nt, Homo sapiens
aagauauguuaguuauaaacuc

SEQ ID NO: 306971 - RNA, 22 nt, Homo sapiens
acaaaguaggcagugggcugga

SEQ ID NO: 306972 - RNA, 22 nt, Homo sapiens
accauugcacuccagccugggc

SEQ ID NO: 306973 - RNA, 22 nt, Homo sapiens
accuggguguauguucaguuug

SEQ ID NO: 306974 - RNA, 22 nt, Homo sapiens
acugcacuccagccuuggccac

SEQ ID NO: 306975 - RNA, 22 nt, Homo sapiens
agaacacugaguucagggucag

SEQ ID NO: 306976 - RNA, 21 nt, Homo sapiens
agagaacugaaacaugugacu

SEQ ID NO: 306977 - RNA, 22 nt, Homo sapiens
agagaacuguuuacacguuaau

SEQ ID NO: 306978 - RNA, 22 nt, Homo sapiens
agcaucacacacuacagggaaa

SEQ ID NO: 306979 - RNA, 22 nt, Homo sapiens
aggaccccucaucagcaccagu

SEQ ID NO: 306980 - RNA, 21 nt, Homo sapiens
aggagauguuuguccuuuuag

SEQ ID NO: 306981 - RNA, 22 nt, Homo sapiens
aguggcacaauuuugacucccc

SEQ ID NO: 306982 - RNA, 20 nt, Homo sapiens
auagaccauugguagguagg

SEQ ID NO: 306983 - RNA, 22 nt, Homo sapiens
auaugguuuuuggaagcauauc

SEQ ID NO: 306984 - RNA, 22 nt, Homo sapiens
auauguucucauucauaugugg

SEQ ID NO: 306985 - RNA, 22 nt, Homo sapiens
aucaccuggaggugaucacuug

SEQ ID NO: 306986 - RNA, 22 nt, Homo sapiens
aucagcagcaugaaaacaggcu

SEQ ID NO: 306987 - RNA, 22 nt, Homo sapiens
aucucaguuaaugacccuaugc

SEQ ID NO: 306988 - RNA, 22 nt, Homo sapiens
augaaagugauaaaugucucua

SEQ ID NO: 306989 - RNA, 22 nt, Homo sapiens
augcagcugaggguaguggagc

SEQ ID NO: 306990 - RNA, 22 nt, Homo sapiens
auggaaggagaauggucuuuga

SEQ ID NO: 306991 - RNA, 20 nt, Homo sapiens
augucaggaagggagucagg

SEQ ID NO: 306992 - RNA, 22 nt, Homo sapiens
augucuggcagaagacuucuca

SEQ ID NO: 306993 - RNA, 22 nt, Homo sapiens
auguuaagauggaacaugggaa

SEQ ID NO: 306994 - RNA, 22 nt, Homo sapiens
auuagguuggugcaaaaguaau

SEQ ID NO: 306995 - RNA, 22 nt, Homo sapiens
caagguacuuuuacaauuuccc

SEQ ID NO: 306996 - RNA, 21 nt, Homo sapiens
cacauggaggcagagagugua

SEQ ID NO: 306997 - RNA, 22 nt, Homo sapiens
cacauguuuuagcauggcuguu

SEQ ID NO: 306998 - RNA, 22 nt, Homo sapiens
cagagagcuugcccuuguauau

SEQ ID NO: 306999 - RNA, 23 nt, Homo sapiens
cagcuggugauuuuaaguugaag

SEQ ID NO: 307000 - RNA, 22 nt, Homo sapiens
cagcugguggcaagaagacaga

SEQ ID NO: 307001 - RNA, 22 nt, Homo sapiens
cagcugguguuacaaaccagag

SEQ ID NO: 307002 - RNA, 22 nt, Homo sapiens
caggcaaggugaaguguacugg

SEQ ID NO: 307003 - RNA, 22 nt, Homo sapiens
cauggccuuuggaaugugucua

SEQ ID NO: 307004 - RNA, 22 nt, Homo sapiens
cucagagcacaguuuaugacag

SEQ ID NO: 307005 - RNA, 22 nt, Homo sapiens
cuggaagaaaaucacgccaucu

SEQ ID NO: 307006 - RNA, 18 nt, Homo sapiens
cuucauugcuguuuugcu

SEQ ID NO: 307007 - RNA, 22 nt, Homo sapiens
gaaggcacugugugccacccug

SEQ ID NO: 307008 - RNA, 22 nt, Homo sapiens
gaaggcaugcugcauggccaga

SEQ ID NO: 307009 - RNA, 22 nt, Homo sapiens
gaaugauacuguuaacgaaaga

SEQ ID NO: 307010 - RNA, 21 nt, Homo sapiens
aaacuggcccaauuguuccau

SEQ ID NO: 307011 - RNA, 21 nt, Homo sapiens
aaaugugcuuuaguacccuca

SEQ ID NO: 307012 - RNA, 22 nt, Homo sapiens
aacaggcuccuaggggugcacc

SEQ ID NO: 307013 - RNA, 22 nt, Homo sapiens
aaguaauggaguuauuuuauga

SEQ ID NO: 307014 - RNA, 22 nt, Homo sapiens
aagugguguuuguauuuaugca

SEQ ID NO: 307015 - RNA, 22 nt, Homo sapiens
aaucccuggacuuucggaggcu

SEQ ID NO: 307016 - RNA, 22 nt, Homo sapiens
acacaugugaaaaaaauguuac

SEQ ID NO: 307017 - RNA, 22 nt, Homo sapiens
acacaugugcguagacucuuua

SEQ ID NO: 307018 - RNA, 20 nt, Homo sapiens
acacuggaguaucaaggccc

SEQ ID NO: 307019 - RNA, 22 nt, Homo sapiens
acacuugcuugcaauagccucc

SEQ ID NO: 307020 - RNA, 22 nt, Homo sapiens
acccaguaacauaugggaggga

SEQ ID NO: 307021 - RNA, 22 nt, Homo sapiens
agaaagugcuucccuuugguga

SEQ ID NO: 307022 - RNA, 23 nt, Homo sapiens
agagguuuaaucaggcaguugcu

SEQ ID NO: 307023 - RNA, 22 nt, Homo sapiens
agaucacaguaccguaaggcug

SEQ ID NO: 307024 - RNA, 22 nt, Homo sapiens
aggaaaucuuagcugaggggau

SEQ ID NO: 307025 - RNA, 19 nt, Homo sapiens
agugagccaagauccuacc

SEQ ID NO: 307026 - RNA, 22 nt, Homo sapiens
auaugugacuucaugcaaggcu

SEQ ID NO: 307027 - RNA, 22 nt, Homo sapiens
aucaccugagcaguauacacug

SEQ ID NO: 307028 - RNA, 22 nt, Homo sapiens
auccacauucauggaccagucc

SEQ ID NO: 307029 - RNA, 22 nt, Homo sapiens
aucgcaccauugcacuccagca

SEQ ID NO: 307030 - RNA, 22 nt, Homo sapiens
aucucaguucaggcuggccaca

SEQ ID NO: 307031 - RNA, 22 nt, Homo sapiens
aucugggguuggcaaaguuugg

SEQ ID NO: 307032 - RNA, 22 nt, Homo sapiens
auggccgggugcgguggcucac

SEQ ID NO: 307033 - RNA, 22 nt, Homo sapiens
augguuuauuuguaagcagagu

SEQ ID NO: 307034 - RNA, 22 nt, Homo sapiens
auuagguuagugcaaaaguaau

SEQ ID NO: 307035 - RNA, 21 nt, Homo sapiens
auugcacuccagccugggcga

SEQ ID NO: 307036 - RNA, 22 nt, Homo sapiens
auugcuuuuacugggagcuuug

SEQ ID NO: 307037 - RNA, 22 nt, Homo sapiens
auuugucacuauguggcuaaua

SEQ ID NO: 307038 - RNA, 22 nt, Homo sapiens
guuaagaaguguaacuuaaguu

SEQ ID NO: 307039 - RNA, 22 nt, Homo sapiens
uaccugagucuagagucuagaa

SEQ ID NO: 307040 - RNA, 22 nt, Homo sapiens
uagucccauaugauuuagugaa

SEQ ID NO: 307041 - RNA, 21 nt, Homo sapiens
uaucccagucacaucuaccca

SEQ ID NO: 307042 - RNA, 22 nt, Homo sapiens
ucaacguauuuauauagcagag

SEQ ID NO: 307043 - RNA, 16 nt, Homo sapiens
ucacaaacucuagcag

SEQ ID NO: 307044 - RNA, 19 nt, Homo sapiens
ucacacuguggcuucuuua

SEQ ID NO: 307045 - RNA, 22 nt, Homo sapiens
ucaccuggagacaugaagacug

SEQ ID NO: 307046 - RNA, 22 nt, Homo sapiens
ucaccuggagccuucacauucu

SEQ ID NO: 307047 - RNA, 22 nt, Homo sapiens
ucaccuggggcacagcugaaga

SEQ ID NO: 307048 - RNA, 22 nt, Homo sapiens
ucacugggagaccaaagccauc

SEQ ID NO: 307049 - RNA, 22 nt, Homo sapiens
ucacugugguuuugaugugcau

SEQ ID NO: 307050 - RNA, 22 nt, Homo sapiens
ucauauguaugugcaauuuugu

SEQ ID NO: 307051 - RNA, 22 nt, Homo sapiens
ucauaugucauaguaugaucuu

SEQ ID NO: 307052 - RNA, 22 nt, Homo sapiens
ucaugggagcccccaucaugag

SEQ ID NO: 307053 - RNA, 22 nt, Homo sapiens
ucucaguggugcuggcagggga

SEQ ID NO: 307054 - RNA, 22 nt, Homo sapiens
ugaauacuucaaaaaaauagcu

SEQ ID NO: 307055 - RNA, 22 nt, Homo sapiens
ugaauauagacagggguagaga

SEQ ID NO: 307056 - RNA, 22 nt, Homo sapiens
ugagaagugauauagaaguuaa

SEQ ID NO: 307057 - RNA, 22 nt, Homo sapiens
ugagaccuuucauuucucagug

SEQ ID NO: 307058 - RNA, 22 nt, Homo sapiens
ugauccagugcucaguuggagu

SEQ ID NO: 307059 - RNA, 20 nt, Homo sapiens
ugcugcacuuaagcaugggc

SEQ ID NO: 307060 - RNA, 22 nt, Homo sapiens
uggaagugaacaaccaaggcag

SEQ ID NO: 307061 - RNA, 22 nt, Homo sapiens
uggaccccugcucgggagcccu

SEQ ID NO: 307062 - RNA, 21 nt, Homo sapiens
uggaccccuuccagucaucau

SEQ ID NO: 307063 - RNA, 22 nt, Homo sapiens
uggaccccuucuccuauuaaaa

SEQ ID NO: 307064 - RNA, 22 nt, Homo sapiens
uggaguuugacaugccuuuggg

SEQ ID NO: 307065 - RNA, 20 nt, Homo sapiens
uggaguuugaguucuuggag

SEQ ID NO: 307066 - RNA, 21 nt, Homo sapiens
uggauugagaaccccaggagg

SEQ ID NO: 307067 - RNA, 22 nt, Homo sapiens
ugguacuguccuucuagauucc

SEQ ID NO: 307068 - RNA, 22 nt, Homo sapiens
ugguccucugcuuccagaauuc

SEQ ID NO: 307069 - RNA, 22 nt, Homo sapiens
uuaaaugcauagaauguguagu

SEQ ID NO: 307070 - RNA, 22 nt, Homo sapiens
uuacugcauaauuccugggaag

SEQ ID NO: 307071 - RNA, 22 nt, Homo sapiens
uuccagagucaccuuucugucg

SEQ ID NO: 307072 - RNA, 22 nt, Homo sapiens
uuccuugagaaaggcacaaguu

SEQ ID NO: 307073 - RNA, 22 nt, Homo sapiens
uucucaguaauuccagauuuuu

SEQ ID NO: 307074 - RNA, 22 nt, Homo sapiens
uucucagugaaguuuagaacau

SEQ ID NO: 307075 - RNA, 22 nt, Homo sapiens
uucucaguuccuacuuugguga

SEQ ID NO: 307076 - RNA, 22 nt, Homo sapiens
uucuugcacugaucccauaagc

SEQ ID NO: 307077 - RNA, 22 nt, Homo sapiens
uucuugcacuuggcccucauua

SEQ ID NO: 307078 - RNA, 22 nt, Homo sapiens
uugaggugaauuugcaggaugc

SEQ ID NO: 307079 - RNA, 22 nt, Homo sapiens
uuugucauagcagcaggaaugg

SEQ ID NO: 307080 - RNA, 22 nt, Homo sapiens
gagauacuugguuucuguuucu

SEQ ID NO: 307081 - RNA, 22 nt, Homo sapiens
gauggcaucugagaguguuaga

SEQ ID NO: 307082 - RNA, 22 nt, Homo sapiens
gaugguuuuucuccgauuuaua

SEQ ID NO: 307083 - RNA, 17 nt, Homo sapiens
gcaguacuuaguaagga

SEQ ID NO: 307084 - RNA, 22 nt, Homo sapiens
gcuaaaugcaugaggcgaugug

SEQ ID NO: 307085 - RNA, 22 nt, Homo sapiens
ggccggguggccauggcugccc

SEQ ID NO: 307086 - RNA, 22 nt, Homo sapiens
gggggagugugguacccagcau

SEQ ID NO: 307087 - RNA, 22 nt, Homo sapiens
guaaugcacucccaaagaucca

SEQ ID NO: 307088 - RNA, 22 nt, Homo sapiens
guagcagaauaucagauaauuu

SEQ ID NO: 307089 - RNA, 22 nt, Homo sapiens
aaaagugguguuguuucuaaau

SEQ ID NO: 307090 - RNA, 18 nt, Homo sapiens
aaagugaugucauucuuu

SEQ ID NO: 307091 - RNA, 22 nt, Homo sapiens
aacauguuuagcagauaccugu

SEQ ID NO: 307092 - RNA, 22 nt, Homo sapiens
aauaagaaguggaagggaccgg

SEQ ID NO: 307093 - RNA, 22 nt, Homo sapiens
aaugggacugacgccucccaga

SEQ ID NO: 307094 - RNA, 22 nt, Homo sapiens
acaaagcuagggaauccaucuu

SEQ ID NO: 307095 - RNA, 20 nt, Homo sapiens
acagcauagccuuuuaaagc

SEQ ID NO: 307096 - RNA, 22 nt, Homo sapiens
acaguacuguuguuugcugcca

SEQ ID NO: 307097 - RNA, 18 nt, Homo sapiens
acagugcuggcaugagau

SEQ ID NO: 307098 - RNA, 19 nt, Homo sapiens
acauggauuuugugcaaac

SEQ ID NO: 307099 - RNA, 22 nt, Homo sapiens
ggacagugaaugccacuccucc

SEQ ID NO: 307100 - RNA, 22 nt, Homo sapiens
ggacauguauauauaugugugu

SEQ ID NO: 307101 - RNA, 22 nt, Homo sapiens
ggagguaauaaguuccagugua

SEQ ID NO: 307102 - RNA, 22 nt, Homo sapiens
ggagucugaacuggacaaugac

SEQ ID NO: 307103 - RNA, 22 nt, Homo sapiens
ggcaaagaugaccauuacuuuu

SEQ ID NO: 307104 - RNA, 22 nt, Homo sapiens
ggcaacaaagacauuucaacau

SEQ ID NO: 307105 - RNA, 22 nt, Homo sapiens
ggcaagaaccagggauuugcgu

SEQ ID NO: 307106 - RNA, 22 nt, Homo sapiens
ggcagcacaauuuucugaugga

SEQ ID NO: 307107 - RNA, 22 nt, Homo sapiens
ggcaguguggcugcauauagca

SEQ ID NO: 307108 - RNA, 22 nt, Homo sapiens
ggccagaugcaguggcucacac

SEQ ID NO: 307109 - RNA, 22 nt, Homo sapiens
gguggugguauuucagaaaaug

SEQ ID NO: 307110 - RNA, 22 nt, Homo sapiens
gguguguaaauuacuuaucucu

SEQ ID NO: 307111 - RNA, 22 nt, Homo sapiens
guaacccuguaggccuaaagua

SEQ ID NO: 307112 - RNA, 22 nt, Homo sapiens
guacaguauaguaauaggauuu

SEQ ID NO: 307113 - RNA, 22 nt, Homo sapiens
guacaguggguguagggaccag

SEQ ID NO: 307114 - RNA, 22 nt, Homo sapiens
guagaauguauacaguauacag

SEQ ID NO: 307115 - RNA, 22 nt, Homo sapiens
guaugcacauauguguauguau

SEQ ID NO: 307116 - RNA, 22 nt, Homo sapiens
guaugucuugucuauggcugcu

SEQ ID NO: 307117 - RNA, 22 nt, Homo sapiens
gucacagaggcuaagaccccac

SEQ ID NO: 307118 - RNA, 22 nt, Homo sapiens
gucaguggauacugucucuguc

SEQ ID NO: 307119 - RNA, 18 nt, Homo sapiens
guccauuuguugguacac

SEQ ID NO: 307120 - RNA, 22 nt, Homo sapiens
gucguggagucucuggcuugua

SEQ ID NO: 307121 - RNA, 22 nt, Homo sapiens
gucucacagcuagcugcuuuau

SEQ ID NO: 307122 - RNA, 22 nt, Homo sapiens
gugaaagauuaaaccagugugu

SEQ ID NO: 307123 - RNA, 22 nt, Homo sapiens
gugaaugaaugggugaauacau

SEQ ID NO: 307124 - RNA, 22 nt, Homo sapiens
gugacagucaaagacaugacuu

SEQ ID NO: 307125 - RNA, 22 nt, Homo sapiens
gugagggagcuggaauauuuau

SEQ ID NO: 307126 - RNA, 22 nt, Homo sapiens
gugauuuaguagaugcuaguua

SEQ ID NO: 307127 - RNA, 20 nt, Homo sapiens
guggaagauaaguagccuga

SEQ ID NO: 307128 - RNA, 22 nt, Homo sapiens
guggcaugaaagcaucugugau

SEQ ID NO: 307129 - RNA, 22 nt, Homo sapiens
gugguucuagaauugaguaucc

SEQ ID NO: 307130 - RNA, 22 nt, Homo sapiens
guguaaaugagugcugaaggag

SEQ ID NO: 307131 - RNA, 22 nt, Homo sapiens
gugucacuguugagaaguccac

SEQ ID NO: 307132 - RNA, 22 nt, Homo sapiens
gugugcaauuuugugggaggca

SEQ ID NO: 307133 - RNA, 22 nt, Homo sapiens
guguuugguugauagagccacu

SEQ ID NO: 307134 - RNA, 22 nt, Homo sapiens
guucucacuggugcugguaagu

SEQ ID NO: 307135 - RNA, 22 nt, Homo sapiens
guuugguugcauggaaaauuua

SEQ ID NO: 307136 - RNA, 22 nt, Homo sapiens
uaaagauaaggcucgcuuggau

SEQ ID NO: 307137 - RNA, 22 nt, Homo sapiens
uaaagaugcugggaaggcuagg

SEQ ID NO: 307138 - RNA, 22 nt, Homo sapiens
uaaagugcugagaugaggcugg

SEQ ID NO: 307139 - RNA, 22 nt, Homo sapiens
uaagcaguaaaugaagucuugc

SEQ ID NO: 307140 - RNA, 22 nt, Homo sapiens
uaaggcacuacuuuaggcuuuc

SEQ ID NO: 307141 - RNA, 18 nt, Homo sapiens
uaaggcacuauaggcauu

SEQ ID NO: 307142 - RNA, 20 nt, Homo sapiens
uaaggcacugugcuuuuagg

SEQ ID NO: 307143 - RNA, 22 nt, Homo sapiens
uaagggcaugcugcaugagagu

SEQ ID NO: 307144 - RNA, 20 nt, Homo sapiens
uaagugcauaggauauuucu

SEQ ID NO: 307145 - RNA, 22 nt, Homo sapiens
uaauacuguaauggugguuccg

SEQ ID NO: 307146 - RNA, 22 nt, Homo sapiens
uaaugcacuuuccuccaaggcu

SEQ ID NO: 307147 - RNA, 22 nt, Homo sapiens
uacaguagaaugucuuucaaaa

SEQ ID NO: 307148 - RNA, 22 nt, Homo sapiens
uacaguagagaucagcaaacua

SEQ ID NO: 307149 - RNA, 22 nt, Homo sapiens
uacagucauaaugccuagugac

SEQ ID NO: 307150 - RNA, 22 nt, Homo sapiens
uacauguauccauuguuuuugg

SEQ ID NO: 307151 - RNA, 22 nt, Homo sapiens
uaccacccuuuuuccagaagcc

SEQ ID NO: 307152 - RNA, 22 nt, Homo sapiens
uacuagaguagugcagagggga

SEQ ID NO: 307153 - RNA, 22 nt, Homo sapiens
uacugcauuucacuguuaaaga

SEQ ID NO: 307154 - RNA, 19 nt, Homo sapiens
uacuggcucgggaauuuuc

SEQ ID NO: 307155 - RNA, 23 nt, Homo sapiens
uagaauguuuuuccauguuucuu

SEQ ID NO: 307156 - RNA, 20 nt, Homo sapiens
uagacagcuagauuagauag

SEQ ID NO: 307157 - RNA, 22 nt, Homo sapiens
uagagguaggucuucgagucuc

SEQ ID NO: 307158 - RNA, 22 nt, Homo sapiens
uagagguauguauaguauucuu

SEQ ID NO: 307159 - RNA, 22 nt, Homo sapiens
uagcaguauugaaagaugaggg

SEQ ID NO: 307160 - RNA, 22 nt, Homo sapiens
uaggacauugcccuuguggaga

SEQ ID NO: 307161 - RNA, 22 nt, Homo sapiens
uaggugaauguaguaagguguu

SEQ ID NO: 307162 - RNA, 22 nt, Homo sapiens
uaguaaacauaguucuuuugcu

SEQ ID NO: 307163 - RNA, 22 nt, Homo sapiens
uaguaucacauggucuuaauua

SEQ ID NO: 307164 - RNA, 22 nt, Homo sapiens
uagugcugagauugagaagccc

SEQ ID NO: 307165 - RNA, 22 nt, Homo sapiens
uaguguuuuucauuggcagagg

SEQ ID NO: 307166 - RNA, 22 nt, Homo sapiens
uauagcacugaccuuccaggac

SEQ ID NO: 307167 - RNA, 22 nt, Homo sapiens
uaucacaguugcauauuuaagg

SEQ ID NO: 307168 - RNA, 22 nt, Homo sapiens
uaugcacacucucccaggaggg

SEQ ID NO: 307169 - RNA, 22 nt, Homo sapiens
uaugcacaugugccugggugug

SEQ ID NO: 307170 - RNA, 22 nt, Homo sapiens
uaugucaugggguuuuugagau

SEQ ID NO: 307171 - RNA, 22 nt, Homo sapiens
uauugucaccaucccuguuuua

SEQ ID NO: 307172 - RNA, 22 nt, Homo sapiens
ucaaaugcacguagagaaaaua

SEQ ID NO: 307173 - RNA, 21 nt, Homo sapiens
ucaaauugaaauuaggucauu

SEQ ID NO: 307174 - RNA, 22 nt, Homo sapiens
ucaacagugggcacuguaaaug

SEQ ID NO: 307175 - RNA, 22 nt, Homo sapiens
ucaaggacuacauggggugaaa

SEQ ID NO: 307176 - RNA, 22 nt, Homo sapiens
ucaaugcaugugacaaagagua

SEQ ID NO: 307177 - RNA, 22 nt, Homo sapiens
ucaccaccugcugaucauagag

SEQ ID NO: 307178 - RNA, 22 nt, Homo sapiens
ucaccaccugcugauuguagag

SEQ ID NO: 307179 - RNA, 22 nt, Homo sapiens
ucaccaguaauaaagagccugc

SEQ ID NO: 307180 - RNA, 20 nt, Homo sapiens
ucacccugacaucugcccag

SEQ ID NO: 307181 - RNA, 22 nt, Homo sapiens
ucagaugaucugguaagaacuu

SEQ ID NO: 307182 - RNA, 22 nt, Homo sapiens
ucagauguuugagaaguauacu

SEQ ID NO: 307183 - RNA, 22 nt, Homo sapiens
ucagauguuuuguuuaucugcu

SEQ ID NO: 307184 - RNA, 20 nt, Homo sapiens
ucagguagggcuucaacauu

SEQ ID NO: 307185 - RNA, 22 nt, Homo sapiens
ucaggugcagagaagaaauggg

SEQ ID NO: 307186 - RNA, 22 nt, Homo sapiens
ucaguaguaaauggauuuggaa

SEQ ID NO: 307187 - RNA, 22 nt, Homo sapiens
ucagucuuuuaccauuaaguau

SEQ ID NO: 307188 - RNA, 22 nt, Homo sapiens
ucagugcaggaaucucuagcca

SEQ ID NO: 307189 - RNA, 22 nt, Homo sapiens
ucagugccauugccauaugagu

SEQ ID NO: 307190 - RNA, 18 nt, Homo sapiens
aaacagugucucuuucug

SEQ ID NO: 307191 - RNA, 22 nt, Homo sapiens
aaagagaucuaugggcacuaug

SEQ ID NO: 307192 - RNA, 22 nt, Homo sapiens
aaagcugucaaggcaggaggcu

SEQ ID NO: 307193 - RNA, 22 nt, Homo sapiens
aaaggcacuagaaguuaccuuu

SEQ ID NO: 307194 - RNA, 22 nt, Homo sapiens
aaagggcuugaauacucuuuuu

SEQ ID NO: 307195 - RNA, 17 nt, Homo sapiens
aaaguccuuugcuaucu

SEQ ID NO: 307196 - RNA, 22 nt, Homo sapiens
aaagugcugggauuaggccagg

SEQ ID NO: 307197 - RNA, 22 nt, Homo sapiens
aaagugcugggauuggcugggc

SEQ ID NO: 307198 - RNA, 22 nt, Homo sapiens
aaaguggugugaguauguaucu

SEQ ID NO: 307199 - RNA, 22 nt, Homo sapiens
aaaucccuugcucucucagacc

SEQ ID NO: 307200 - RNA, 22 nt, Homo sapiens
aacugccucugacauaggcagg

SEQ ID NO: 307201 - RNA, 22 nt, Homo sapiens
aagagaugaagguccugacugu

SEQ ID NO: 307202 - RNA, 22 nt, Homo sapiens
aagagcgcugauaacauguuug

SEQ ID NO: 307203 - RNA, 22 nt, Homo sapiens
aagagguaauaacaaagcuucu

SEQ ID NO: 307204 - RNA, 22 nt, Homo sapiens
aagagguaggaaauggucauuu

SEQ ID NO: 307205 - RNA, 22 nt, Homo sapiens
aagagguagucugucccuuagc

SEQ ID NO: 307206 - RNA, 22 nt, Homo sapiens
aagagguuuaacugacucacag

SEQ ID NO: 307207 - RNA, 22 nt, Homo sapiens
aagaugauguucuuuuucuuag

SEQ ID NO: 307208 - RNA, 22 nt, Homo sapiens
uuguaaagaucauaugcuguuc

SEQ ID NO: 307209 - RNA, 22 nt, Homo sapiens
uuguagcaaauguguaaacaaa

SEQ ID NO: 307210 - RNA, 22 nt, Homo sapiens
uuuaaggcaugccuguacaugc

SEQ ID NO: 307211 - RNA, 22 nt, Homo sapiens
uuuacagucucauagguggaag

SEQ ID NO: 307212 - RNA, 22 nt, Homo sapiens
uuucacuagccagcccuuuauu

SEQ ID NO: 307213 - RNA, 22 nt, Homo sapiens
uuucccuuacuuaaacuuacuc

SEQ ID NO: 307214 - RNA, 21 nt, Homo sapiens
uuucugggggagcauggcagg

SEQ ID NO: 307215 - RNA, 20 nt, Homo sapiens
uuugaauguaaagcauguca

SEQ ID NO: 307216 - RNA, 17 nt, Homo sapiens
uuuuggauuagaaaucc

SEQ ID NO: 307217 - RNA, 22 nt, Homo sapiens
guggcagagucagagggaaaug

SEQ ID NO: 307218 - RNA, 22 nt, Homo sapiens
gugggcaaagcuaguguguaga

SEQ ID NO: 307219 - RNA, 20 nt, Homo sapiens
gugggcaaauccuuuccucu

SEQ ID NO: 307220 - RNA, 21 nt, Homo sapiens
gugguucuagagaaacagaau

SEQ ID NO: 307221 - RNA, 22 nt, Homo sapiens
guguggcaggugggggcucaga

SEQ ID NO: 307222 - RNA, 22 nt, Homo sapiens
guuauguaucuugauugggugg

SEQ ID NO: 307223 - RNA, 22 nt, Homo sapiens
guuauuguccauuuauuuagca

SEQ ID NO: 307224 - RNA, 22 nt, Homo sapiens
guuugcagaucaugaagaaccc

SEQ ID NO: 307225 - RNA, 22 nt, Homo sapiens
guuugugcuccuaugagaaccu

SEQ ID NO: 307226 - RNA, 22 nt, Homo sapiens
uaaaagucaucacaacuggagu

SEQ ID NO: 307227 - RNA, 22 nt, Homo sapiens
uaaacacucacuucauagccau

SEQ ID NO: 307228 - RNA, 22 nt, Homo sapiens
uaaaguguuuguuauuaaaggu

SEQ ID NO: 307229 - RNA, 22 nt, Homo sapiens
uaaaugcucuuuaaaagugcuu

SEQ ID NO: 307230 - RNA, 22 nt, Homo sapiens
uaacaaugucuuaugggcuuaa

SEQ ID NO: 307231 - RNA, 22 nt, Homo sapiens
uaacaguguauuccuuuggaca

SEQ ID NO: 307232 - RNA, 22 nt, Homo sapiens
uaacccacgcagaauggacaag

SEQ ID NO: 307233 - RNA, 22 nt, Homo sapiens
uaacccuuaguaucuguggguu

SEQ ID NO: 307234 - RNA, 22 nt, Homo sapiens
uaagcuguguggacuaugccuc

SEQ ID NO: 307235 - RNA, 22 nt, Homo sapiens
uaaggcacauaggccuggaaac

SEQ ID NO: 307236 - RNA, 22 nt, Homo sapiens
uaaguaguauaagguuuuuuga

SEQ ID NO: 307237 - RNA, 22 nt, Homo sapiens
uaaguauagguaacagaagcaa

SEQ ID NO: 307238 - RNA, 22 nt, Homo sapiens
uaagugcuguguuguuaccuaa

SEQ ID NO: 307239 - RNA, 20 nt, Homo sapiens
uaagugcuugagacuucuga

SEQ ID NO: 307240 - RNA, 20 nt, Homo sapiens
uaagugcuuuauauugauua

SEQ ID NO: 307241 - RNA, 22 nt, Homo sapiens
uaauaguguuaaugcuagagcu

SEQ ID NO: 307242 - RNA, 22 nt, Homo sapiens
uaaugcacauuuauuuuaccuu

SEQ ID NO: 307243 - RNA, 22 nt, Homo sapiens
uacaaagcuacucgagggcagg

SEQ ID NO: 307244 - RNA, 22 nt, Homo sapiens
uacaaagcuuucugcaaaucau

SEQ ID NO: 307245 - RNA, 22 nt, Homo sapiens
uacaaagcuuugaugugucuuu

SEQ ID NO: 307246 - RNA, 22 nt, Homo sapiens
uagaagcacuaucccuccuagu

SEQ ID NO: 307247 - RNA, 22 nt, Homo sapiens
uagaauguaacuuccaugucau

SEQ ID NO: 307248 - RNA, 22 nt, Homo sapiens
uagacccauuguucagagagug

SEQ ID NO: 307249 - RNA, 22 nt, Homo sapiens
uagcacaguucacccucgauuu

SEQ ID NO: 307250 - RNA, 22 nt, Homo sapiens
uagcaccugugcacaccaggca

SEQ ID NO: 307251 - RNA, 22 nt, Homo sapiens
uagguacuuuacauguuaucuc

SEQ ID NO: 307252 - RNA, 21 nt, Homo sapiens
uagugcugaggcaguauggga

SEQ ID NO: 307253 - RNA, 22 nt, Homo sapiens
uagugcugugauauuuuuggcc

SEQ ID NO: 307254 - RNA, 22 nt, Homo sapiens
uagugcugugauuaacauaaug

SEQ ID NO: 307255 - RNA, 18 nt, Homo sapiens
uagugcuguucucaugau

SEQ ID NO: 307256 - RNA, 22 nt, Homo sapiens
uauagcacugagaauguaauuc

SEQ ID NO: 307257 - RNA, 22 nt, Homo sapiens
uaucacagauauuaugggccaa

SEQ ID NO: 307258 - RNA, 23 nt, Homo sapiens
uaugacagaggaagggggagcug

SEQ ID NO: 307259 - RNA, 19 nt, Homo sapiens
uaugcaacuuauagugcug

SEQ ID NO: 307260 - RNA, 22 nt, Homo sapiens
uaugcacacacguguuuaugug

SEQ ID NO: 307261 - RNA, 22 nt, Homo sapiens
uaugcacacguguccaugugca

SEQ ID NO: 307262 - RNA, 22 nt, Homo sapiens
uaugucuucuuuagagaaaugu

SEQ ID NO: 307263 - RNA, 22 nt, Homo sapiens
uauugccugucuccaaaaauca

SEQ ID NO: 307264 - RNA, 22 nt, Homo sapiens
ucaaaugcucuuugcagagagg

SEQ ID NO: 307265 - RNA, 22 nt, Homo sapiens
ucaaaugcuguauuguaguaau

SEQ ID NO: 307266 - RNA, 22 nt, Homo sapiens
ucaagcaauucuccugccucag

SEQ ID NO: 307267 - RNA, 22 nt, Homo sapiens
ucaagcaauucugcugccucag

SEQ ID NO: 307268 - RNA, 22 nt, Homo sapiens
ucacaauucucaauuugugaaa

SEQ ID NO: 307269 - RNA, 22 nt, Homo sapiens
ucacagaugaggcgagaggcag

SEQ ID NO: 307270 - RNA, 21 nt, Homo sapiens
ucacagccuaggaccugaaga

SEQ ID NO: 307271 - RNA, 22 nt, Homo sapiens
ucacagccuaguuuuauacauu

SEQ ID NO: 307272 - RNA, 22 nt, Homo sapiens
ucacccugacaugcggccgaac

SEQ ID NO: 307273 - RNA, 22 nt, Homo sapiens
ucaccuggagagcuugcuaaua

SEQ ID NO: 307274 - RNA, 22 nt, Homo sapiens
ucacgugguucauaaggcagaa

SEQ ID NO: 307275 - RNA, 21 nt, Homo sapiens
ucacugagcaucaugguuuca

SEQ ID NO: 307276 - RNA, 22 nt, Homo sapiens
ucagaucauuaagguagguuua

SEQ ID NO: 307277 - RNA, 22 nt, Homo sapiens
ucagcaaugaccuaagcaaaua

SEQ ID NO: 307278 - RNA, 22 nt, Homo sapiens
ucaggugcaguggcucaugcuu

SEQ ID NO: 307279 - RNA, 20 nt, Homo sapiens
ucagugauugguuuaguuau

SEQ ID NO: 307280 - RNA, 22 nt, Homo sapiens
uccagguacucagggggcugag

SEQ ID NO: 307281 - RNA, 18 nt, Homo sapiens
uccaguuuucccagcauc

SEQ ID NO: 307282 - RNA, 19 nt, Homo sapiens
ucccaagaugcucauacau

SEQ ID NO: 307283 - RNA, 16 nt, Homo sapiens
ucccaccauugcuugu

SEQ ID NO: 307284 - RNA, 22 nt, Homo sapiens
ucccagugaaaccccaccuuca

SEQ ID NO: 307285 - RNA, 22 nt, Homo sapiens
ucccugaguaucuaauguguuu

SEQ ID NO: 307286 - RNA, 23 nt, Homo sapiens
ucgguccccuuggcugcccucgg

SEQ ID NO: 307287 - RNA, 21 nt, Homo sapiens
ucuaccuacugcucacaggcu

SEQ ID NO: 307288 - RNA, 22 nt, Homo sapiens
ucucaagaugguagaugggaau

SEQ ID NO: 307289 - RNA, 22 nt, Homo sapiens
ucucagugaauguggaaaaagc

SEQ ID NO: 307290 - RNA, 19 nt, Homo sapiens
ucugacagccccagucaac

SEQ ID NO: 307291 - RNA, 22 nt, Homo sapiens
cagugaauuucaggucaagagu

SEQ ID NO: 307292 - RNA, 22 nt, Homo sapiens
cagugacacugaaaaguucggg

SEQ ID NO: 307293 - RNA, 18 nt, Homo sapiens
cagugcaauacaggagag

SEQ ID NO: 307294 - RNA, 22 nt, Homo sapiens
cagugcauaggaucuaaaauuu

SEQ ID NO: 307295 - RNA, 22 nt, Homo sapiens
cauauucacuuuacagagcugu

SEQ ID NO: 307296 - RNA, 22 nt, Homo sapiens
caugccacugcacgccauccug

SEQ ID NO: 307297 - RNA, 22 nt, Homo sapiens
caugucuuuuaaacauucaacu

SEQ ID NO: 307298 - RNA, 20 nt, Homo sapiens
cauuccacuuuccugucagu

SEQ ID NO: 307299 - RNA, 22 nt, Homo sapiens
cauugcacuccagccugcugac

SEQ ID NO: 307300 - RNA, 22 nt, Homo sapiens
cauugcacucuagucuggguga

SEQ ID NO: 307301 - RNA, 22 nt, Homo sapiens
ccacaaccucaacagcaucuau

SEQ ID NO: 307302 - RNA, 17 nt, Homo sapiens
ccagugaucccuuuugu

SEQ ID NO: 307303 - RNA, 22 nt, Homo sapiens
cccacaguggccucauauccuu

SEQ ID NO: 307304 - RNA, 22 nt, Homo sapiens
cccagugugcugggugacagcu

SEQ ID NO: 307305 - RNA, 20 nt, Homo sapiens
aaacucugucuucuuuauca

SEQ ID NO: 307306 - RNA, 22 nt, Homo sapiens
aaagggcuuuguaaacuucaag

SEQ ID NO: 307307 - RNA, 22 nt, Homo sapiens
aaagguaguacuucuagaaggg

SEQ ID NO: 307308 - RNA, 22 nt, Homo sapiens
aaagugcugagacagacuggga

SEQ ID NO: 307309 - RNA, 22 nt, Homo sapiens
aaagugcuuacuaaguugccaa

SEQ ID NO: 307310 - RNA, 22 nt, Homo sapiens
aaaugcacagaaaggaugugga

SEQ ID NO: 307311 - RNA, 22 nt, Homo sapiens
aaaugcacgcuacccagcuaga

SEQ ID NO: 307312 - RNA, 22 nt, Homo sapiens
aaauugcaaugcgaggcagagg

SEQ ID NO: 307313 - RNA, 22 nt, Homo sapiens
aacagagcuggugacuccaggu

SEQ ID NO: 307314 - RNA, 22 nt, Homo sapiens
aagagcauuauuuaguaauuuc

SEQ ID NO: 307315 - RNA, 22 nt, Homo sapiens
aagagguagaagcuugccuucu

SEQ ID NO: 307316 - RNA, 22 nt, Homo sapiens
aagagguagcagucacaaaaga

SEQ ID NO: 307317 - RNA, 22 nt, Homo sapiens
aagcaugguuuccaggggucac

SEQ ID NO: 307318 - RNA, 22 nt, Homo sapiens
aagccacuguaccugucucuua

SEQ ID NO: 307319 - RNA, 22 nt, Homo sapiens
aagcgguguugaauuuuguuga

SEQ ID NO: 307320 - RNA, 22 nt, Homo sapiens
aaggaguagacaacauggcgcc

SEQ ID NO: 307321 - RNA, 22 nt, Homo sapiens
aaggaguaucuguuuucucacc

SEQ ID NO: 307322 - RNA, 22 nt, Homo sapiens
aagguacuggaaagaggaaugg

SEQ ID NO: 307323 - RNA, 22 nt, Homo sapiens
aaguaauugagguuuuugcugu

SEQ ID NO: 307324 - RNA, 22 nt, Homo sapiens
aauaaagccugucucuuuagag

SEQ ID NO: 307325 - RNA, 22 nt, Homo sapiens
aauacugagaugugagguacua

SEQ ID NO: 307326 - RNA, 22 nt, Homo sapiens
aaucaacauuguuuuaagucaa

SEQ ID NO: 307327 - RNA, 22 nt, Homo sapiens
aaugcacauaaaauccuccagg

SEQ ID NO: 307328 - RNA, 22 nt, Homo sapiens
aauuaguugucgugagaguggu

SEQ ID NO: 307329 - RNA, 22 nt, Homo sapiens
aauugcauaugcaguagaucua

SEQ ID NO: 307330 - RNA, 22 nt, Homo sapiens
acaaagcgcuucucuuuagagu

SEQ ID NO: 307331 - RNA, 22 nt, Homo sapiens
acaaaguguuuucugaaggccu

SEQ ID NO: 307332 - RNA, 22 nt, Homo sapiens
acacauuagcaagugcuguuau

SEQ ID NO: 307333 - RNA, 20 nt, Homo sapiens
acacuggcuuugagauuuag

SEQ ID NO: 307334 - RNA, 22 nt, Homo sapiens
acacugucucuugcugaccaug

SEQ ID NO: 307335 - RNA, 22 nt, Homo sapiens
acaggugaaguauuacacuaag

SEQ ID NO: 307336 - RNA, 18 nt, Homo sapiens
acagugcuggcaugagau

SEQ ID NO: 307337 - RNA, 22 nt, Homo sapiens
acagugcuucugauaugaugcc

SEQ ID NO: 307338 - RNA, 22 nt, Homo sapiens
acccagaguuccuugucuuuca

SEQ ID NO: 307339 - RNA, 22 nt, Homo sapiens
accuggcacuuagcaaaucuga

SEQ ID NO: 307340 - RNA, 22 nt, Homo sapiens
agaauguauauucuguaguugu

SEQ ID NO: 307341 - RNA, 22 nt, Homo sapiens
agagaugaagauggggcucccg

SEQ ID NO: 307342 - RNA, 22 nt, Homo sapiens
agagcacugcugcaggguucug

SEQ ID NO: 307343 - RNA, 22 nt, Homo sapiens
agaugguguuggcugaguguau

SEQ ID NO: 307344 - RNA, 20 nt, Homo sapiens
agcagccacagauuccucag

SEQ ID NO: 307345 - RNA, 22 nt, Homo sapiens
agcgccacugcacuccagccug

SEQ ID NO: 307346 - RNA, 22 nt, Homo sapiens
agcugccagucuuguaaggccu

SEQ ID NO: 307347 - RNA, 22 nt, Homo sapiens
agcuguuguucucagaggcuuu

SEQ ID NO: 307348 - RNA, 22 nt, Homo sapiens
agcuguuguuuuaagauacuaa

SEQ ID NO: 307349 - RNA, 22 nt, Homo sapiens
agcuugugauuuagagugagag

SEQ ID NO: 307350 - RNA, 19 nt, Homo sapiens
agcuuuggcuaacuuucuc

SEQ ID NO: 307351 - RNA, 23 nt, Homo sapiens
aggaauggaaaaccaaguaucau

SEQ ID NO: 307352 - RNA, 22 nt, Homo sapiens
aggagaauugguucuucuugau

SEQ ID NO: 307353 - RNA, 20 nt, Homo sapiens
aggagcauuuacauuggcuc

SEQ ID NO: 307354 - RNA, 22 nt, Homo sapiens
aggagguaggaauugugcuagg

SEQ ID NO: 307355 - RNA, 22 nt, Homo sapiens
aggcaugauuguauuuugcucu

SEQ ID NO: 307356 - RNA, 20 nt, Homo sapiens
aguauucacuuuuuucaugg

SEQ ID NO: 307357 - RNA, 22 nt, Homo sapiens
agugcauuuguucugugucagg

SEQ ID NO: 307358 - RNA, 22 nt, Homo sapiens
auaauacuuuuauuuugaggaa

SEQ ID NO: 307359 - RNA, 22 nt, Homo sapiens
auaauaguguuuagauuuggga

SEQ ID NO: 307360 - RNA, 22 nt, Homo sapiens
auacuaugagauaauaaagacu

SEQ ID NO: 307361 - RNA, 22 nt, Homo sapiens
auacuguauaggauuguagccu

SEQ ID NO: 307362 - RNA, 22 nt, Homo sapiens
auagcacauggcauccucucuu

SEQ ID NO: 307363 - RNA, 17 nt, Homo sapiens
auaugaauuuuggagau

SEQ ID NO: 307364 - RNA, 22 nt, Homo sapiens
auaugcacaguggaguacuauu

SEQ ID NO: 307365 - RNA, 22 nt, Homo sapiens
auaugcacgugcauacacacuu

SEQ ID NO: 307366 - RNA, 20 nt, Homo sapiens
aucaaagacuuagaggggga

SEQ ID NO: 307367 - RNA, 22 nt, Homo sapiens
aucacagauauggguuuaaauc

SEQ ID NO: 307368 - RNA, 22 nt, Homo sapiens
aucauccagccccagaagggag

SEQ ID NO: 307369 - RNA, 22 nt, Homo sapiens
augaacucaucauuuuuauggc

SEQ ID NO: 307370 - RNA, 22 nt, Homo sapiens
augaacucaucauuuuuuaugg

SEQ ID NO: 307371 - RNA, 20 nt, Homo sapiens
augaagugaaguuagggaac

SEQ ID NO: 307372 - RNA, 22 nt, Homo sapiens
augaaugcacugcggguggaug

SEQ ID NO: 307373 - RNA, 22 nt, Homo sapiens
augaccauuucaauugauaugg

SEQ ID NO: 307374 - RNA, 21 nt, Homo sapiens
augacccuggguguccuuucc

SEQ ID NO: 307375 - RNA, 22 nt, Homo sapiens
augaccuuguccucagugucau

SEQ ID NO: 307376 - RNA, 22 nt, Homo sapiens
augagauaaaccaucucuuaag

SEQ ID NO: 307377 - RNA, 21 nt, Homo sapiens
augagauguuagacuuuagac

SEQ ID NO: 307378 - RNA, 22 nt, Homo sapiens
augcauggagucuuucacaagu

SEQ ID NO: 307379 - RNA, 22 nt, Homo sapiens
auggaaggagaggaaugaauga

SEQ ID NO: 307380 - RNA, 22 nt, Homo sapiens
auggacagacacuggccuucug

SEQ ID NO: 307381 - RNA, 22 nt, Homo sapiens
auggaguguucugaauccuuug

SEQ ID NO: 307382 - RNA, 18 nt, Homo sapiens
auggcagaacaauuuaca

SEQ ID NO: 307383 - RNA, 22 nt, Homo sapiens
auggcagaaucaagccgacagc

SEQ ID NO: 307384 - RNA, 17 nt, Homo sapiens
auguaauccucaucucu

SEQ ID NO: 307385 - RNA, 22 nt, Homo sapiens
auguagugugauuuucacuaga

SEQ ID NO: 307386 - RNA, 22 nt, Homo sapiens
augugcaaauuuccaaacucuu

SEQ ID NO: 307387 - RNA, 22 nt, Homo sapiens
augugugaaucccagaaccugu

SEQ ID NO: 307388 - RNA, 23 nt, Homo sapiens
auuaagguuacuacaguaugagg

SEQ ID NO: 307389 - RNA, 23 nt, Homo sapiens
auuccaguggcaauuggagaaac

SEQ ID NO: 307390 - RNA, 22 nt, Homo sapiens
ucgcauggucuccaggcagcuc

SEQ ID NO: 307391 - RNA, 22 nt, Homo sapiens
ucucaaguggucgcaguuagau

SEQ ID NO: 307392 - RNA, 22 nt, Homo sapiens
ucucagagccuaggguuuuuca

SEQ ID NO: 307393 - RNA, 22 nt, Homo sapiens
ucucauagaggcagagaguaaa

SEQ ID NO: 307394 - RNA, 22 nt, Homo sapiens
ucucugguuuucaaagcaguau

SEQ ID NO: 307395 - RNA, 22 nt, Homo sapiens
ucuggccuacaucauuuuuccg

SEQ ID NO: 307396 - RNA, 22 nt, Homo sapiens
ucuggccuccuaugagaaucga

SEQ ID NO: 307397 - RNA, 22 nt, Homo sapiens
ucuggcuuucuuuacuuaaugu

SEQ ID NO: 307398 - RNA, 22 nt, Homo sapiens
ucuggcuuuuaacaucuauaaa

SEQ ID NO: 307399 - RNA, 23 nt, Homo sapiens
ucugguguugucaaaugcugguu

SEQ ID NO: 307400 - RNA, 17 nt, Homo sapiens
ucuucuguuacuguggc

SEQ ID NO: 307401 - RNA, 22 nt, Homo sapiens
ucuuugguauuuguggggaauu

SEQ ID NO: 307402 - RNA, 22 nt, Homo sapiens
ugaaaguaauugcaguuuuuac

SEQ ID NO: 307403 - RNA, 22 nt, Homo sapiens
ugaaaucauguaguuauugcaa

SEQ ID NO: 307404 - RNA, 22 nt, Homo sapiens
ugaaugcaucuagaaauuuauu

SEQ ID NO: 307405 - RNA, 22 nt, Homo sapiens
ugaauguccauugauguuuuga

SEQ ID NO: 307406 - RNA, 22 nt, Homo sapiens
ugacagcaucaggauuggagag

SEQ ID NO: 307407 - RNA, 22 nt, Homo sapiens
ugacugaguaguauuccacuau

SEQ ID NO: 307408 - RNA, 17 nt, Homo sapiens
ugagaacaugugguauu

SEQ ID NO: 307409 - RNA, 22 nt, Homo sapiens
ugagaagacaucuuugcuuugu

SEQ ID NO: 307410 - RNA, 22 nt, Homo sapiens
ugagaauauuugaagauguuag

SEQ ID NO: 307411 - RNA, 22 nt, Homo sapiens
ugagacaaaguuguuggauguu

SEQ ID NO: 307412 - RNA, 22 nt, Homo sapiens
ugagaccuuucauuucucagug

SEQ ID NO: 307413 - RNA, 22 nt, Homo sapiens
ugagacgaagucuugcucuguu

SEQ ID NO: 307414 - RNA, 22 nt, Homo sapiens
ugagagcuuuuuugccugguga

SEQ ID NO: 307415 - RNA, 22 nt, Homo sapiens
ugagaggugauaaagcaagggu

SEQ ID NO: 307416 - RNA, 22 nt, Homo sapiens
ugagaguauaaauugaugcagc

SEQ ID NO: 307417 - RNA, 22 nt, Homo sapiens
ugagagucauacaaauaaaaau

SEQ ID NO: 307418 - RNA, 21 nt, Homo sapiens
ugagauaauauguuucugaug

SEQ ID NO: 307419 - RNA, 22 nt, Homo sapiens
ugagauaaucaugugguuuuug

SEQ ID NO: 307420 - RNA, 22 nt, Homo sapiens
ugagauagcauaagggacagaa

SEQ ID NO: 307421 - RNA, 22 nt, Homo sapiens
ugagaucaaggugggcccuggg

SEQ ID NO: 307422 - RNA, 22 nt, Homo sapiens
ugagaucuucgcucuucacaga

SEQ ID NO: 307423 - RNA, 22 nt, Homo sapiens
ugagaugaguugcgcucugucg

SEQ ID NO: 307424 - RNA, 22 nt, Homo sapiens
ugagaugauagauauguuaauu

SEQ ID NO: 307425 - RNA, 22 nt, Homo sapiens
ugagaugaucaaaguauaggcu

SEQ ID NO: 307426 - RNA, 22 nt, Homo sapiens
ugagaugcauauucuggcuccu

SEQ ID NO: 307427 - RNA, 22 nt, Homo sapiens
ugagauggaguuucacuuuugu

SEQ ID NO: 307428 - RNA, 22 nt, Homo sapiens
ugagauuaucguaauguaucuc

SEQ ID NO: 307429 - RNA, 22 nt, Homo sapiens
ugagcugagacaauaaguuuuu

SEQ ID NO: 307430 - RNA, 22 nt, Homo sapiens
ugagguaacaaacuaugaguua

SEQ ID NO: 307431 - RNA, 22 nt, Homo sapiens
ugagguaagauguucauuuuuc

SEQ ID NO: 307432 - RNA, 22 nt, Homo sapiens
ugaguauagaucaguucaagug

SEQ ID NO: 307433 - RNA, 21 nt, Homo sapiens
ugaugcaauccgcuaggucgc

SEQ ID NO: 307434 - RNA, 22 nt, Homo sapiens
ugaugcugaguggcuauuugaa

SEQ ID NO: 307435 - RNA, 20 nt, Homo sapiens
ugauuaguccacuuggcucu

SEQ ID NO: 307436 - RNA, 22 nt, Homo sapiens
ugcaagcacacccagggauugu

SEQ ID NO: 307437 - RNA, 18 nt, Homo sapiens
ugcaccaguuuacacuuc

SEQ ID NO: 307438 - RNA, 22 nt, Homo sapiens
ugcauauguugagaugcauauu

SEQ ID NO: 307439 - RNA, 22 nt, Homo sapiens
ugcauuguggaucuaaaugcau

SEQ ID NO: 307440 - RNA, 22 nt, Homo sapiens
ugccagaugcaguguucaacaa

SEQ ID NO: 307441 - RNA, 22 nt, Homo sapiens
ugccuaggcccaguccucagaa

SEQ ID NO: 307442 - RNA, 22 nt, Homo sapiens
uggaaugguaucuuguuggggu

SEQ ID NO: 307443 - RNA, 22 nt, Homo sapiens
uggaaugugaauaacuuccuuc

SEQ ID NO: 307444 - RNA, 22 nt, Homo sapiens
uggaccccuucuccuauuaaaa

SEQ ID NO: 307445 - RNA, 22 nt, Homo sapiens
uggcaaaauggaauauguuggg

SEQ ID NO: 307446 - RNA, 21 nt, Homo sapiens
uggcaacauggauggauucug

SEQ ID NO: 307447 - RNA, 22 nt, Homo sapiens
uggcaagaagagcaugagacca

SEQ ID NO: 307448 - RNA, 22 nt, Homo sapiens
uggcacaaugacccuugugggc

SEQ ID NO: 307449 - RNA, 22 nt, Homo sapiens
uggcaccauccaggugucucua

SEQ ID NO: 307450 - RNA, 22 nt, Homo sapiens
uggcagcugcuucaugggaugc

SEQ ID NO: 307451 - RNA, 19 nt, Homo sapiens
uggcaugaaugugaacuaa

SEQ ID NO: 307452 - RNA, 22 nt, Homo sapiens
uggcaugauauauauucguuug

SEQ ID NO: 307453 - RNA, 22 nt, Homo sapiens
uggcaugauguguucauugaaa

SEQ ID NO: 307454 - RNA, 22 nt, Homo sapiens
uggcucauuucuaaacccagcu

SEQ ID NO: 307455 - RNA, 22 nt, Homo sapiens
uggcuuuguaagguuucauuuu

SEQ ID NO: 307456 - RNA, 22 nt, Homo sapiens
ugggccgcugcaggaugguccc

SEQ ID NO: 307457 - RNA, 19 nt, Homo sapiens
uggguaguuuucuggcugg

SEQ ID NO: 307458 - RNA, 22 nt, Homo sapiens
ugucauggcauuuguaaacugc

SEQ ID NO: 307459 - RNA, 22 nt, Homo sapiens
ugucauggggaaaauaacagac

SEQ ID NO: 307460 - RNA, 22 nt, Homo sapiens
ugucuuggacuugaaucucauu

SEQ ID NO: 307461 - RNA, 22 nt, Homo sapiens
ugucuuguagacaauguauagu

SEQ ID NO: 307462 - RNA, 22 nt, Homo sapiens
ugugacagcacagcaucucuuu

SEQ ID NO: 307463 - RNA, 22 nt, Homo sapiens
ugugacaguuaguuugguguua

SEQ ID NO: 307464 - RNA, 22 nt, Homo sapiens
ugugagcuauggaguuguagag

SEQ ID NO: 307465 - RNA, 19 nt, Homo sapiens
ugugauaguugaaccugcc

SEQ ID NO: 307466 - RNA, 20 nt, Homo sapiens
ugugauuauuuaguugcaug

SEQ ID NO: 307467 - RNA, 22 nt, Homo sapiens
ugugcauauaaguguguauaua

SEQ ID NO: 307468 - RNA, 22 nt, Homo sapiens
ugugcucaucucagucaacugu

SEQ ID NO: 307469 - RNA, 22 nt, Homo sapiens
ugugcugaucgggcacgguguc

SEQ ID NO: 307470 - RNA, 22 nt, Homo sapiens
uguggcaaagucuugugaauau

SEQ ID NO: 307471 - RNA, 22 nt, Homo sapiens
uguggcucuucuguucuccacu

SEQ ID NO: 307472 - RNA, 22 nt, Homo sapiens
uuaaaggcauguacacuagagu

SEQ ID NO: 307473 - RNA, 22 nt, Homo sapiens
uuaagagugggaguuggccaca

SEQ ID NO: 307474 - RNA, 22 nt, Homo sapiens
uuaauccugccuuauuucagua

SEQ ID NO: 307475 - RNA, 22 nt, Homo sapiens
uuacaguagaugaggguauaau

SEQ ID NO: 307476 - RNA, 22 nt, Homo sapiens
uuacaguauugcaaggacuagg

SEQ ID NO: 307477 - RNA, 22 nt, Homo sapiens
uuauguaggcuauagcucugca

SEQ ID NO: 307478 - RNA, 22 nt, Homo sapiens
uuauucauuaauugcuaagguu

SEQ ID NO: 307479 - RNA, 22 nt, Homo sapiens
uucaacagugauggccuuugua

SEQ ID NO: 307480 - RNA, 21 nt, Homo sapiens
uucacaagggaaguagggggc

SEQ ID NO: 307481 - RNA, 22 nt, Homo sapiens
uugaauggaauguuggaacuau

SEQ ID NO: 307482 - RNA, 22 nt, Homo sapiens
uugacaggaugcucagggccca

SEQ ID NO: 307483 - RNA, 22 nt, Homo sapiens
uugaccucaucacuucccaaag

SEQ ID NO: 307484 - RNA, 22 nt, Homo sapiens
uugagauagaauaggaauggga

SEQ ID NO: 307485 - RNA, 22 nt, Homo sapiens
uugagauaggaacucacuaugc

SEQ ID NO: 307486 - RNA, 22 nt, Homo sapiens
uugagauauccauaaaugggaa

SEQ ID NO: 307487 - RNA, 22 nt, Homo sapiens
uugagauaucuuggccuuugca

SEQ ID NO: 307488 - RNA, 21 nt, Homo sapiens
uugagcuuuuaguacagacag

SEQ ID NO: 307489 - RNA, 22 nt, Homo sapiens
uugauaguuuuaaaauuaaucu

SEQ ID NO: 307490 - RNA, 22 nt, Homo sapiens
uugcacaauggaauuuaucuuu

SEQ ID NO: 307491 - RNA, 22 nt, Homo sapiens
uugcgcuuuuccuauguugccc

SEQ ID NO: 307492 - RNA, 22 nt, Homo sapiens
uuggaaagagguguuuaugacu

SEQ ID NO: 307493 - RNA, 22 nt, Homo sapiens
uuggcaaauagguuuuauugca

SEQ ID NO: 307494 - RNA, 22 nt, Homo sapiens
uuggcagaaaaggucggggguu

SEQ ID NO: 307495 - RNA, 20 nt, Homo sapiens
uuggcagagucuuuagggua

SEQ ID NO: 307496 - RNA, 19 nt, Homo sapiens
uuggcagaguugcccccua

SEQ ID NO: 307497 - RNA, 22 nt, Homo sapiens
uugggagugucucuggacugca

SEQ ID NO: 307498 - RNA, 22 nt, Homo sapiens
uugggcaaguggcaugaccaug

SEQ ID NO: 307499 - RNA, 22 nt, Homo sapiens
uuguaaacaucuguacauugcu

SEQ ID NO: 307500 - RNA, 22 nt, Homo sapiens
uuguuaagaugcagauucugga

SEQ ID NO: 307501 - RNA, 18 nt, Homo sapiens
uuuacaguagaaggacuu

SEQ ID NO: 307502 - RNA, 22 nt, Homo sapiens
uuuacagucuuuugugugaguc

SEQ ID NO: 307503 - RNA, 22 nt, Homo sapiens
uuuagguuacauauaauccaaa

SEQ ID NO: 307504 - RNA, 22 nt, Homo sapiens
uuucuuggagcucuuagggucg

SEQ ID NO: 307505 - RNA, 22 nt, Homo sapiens
uuugagaucuuuagaaucaggc

SEQ ID NO: 307506 - RNA, 20 nt, Homo sapiens
uuugcagaaucuaagaagag

SEQ ID NO: 307507 - RNA, 22 nt, Homo sapiens
uuugcuugaggucuagcuaccc

SEQ ID NO: 307508 - RNA, 22 nt, Homo sapiens
uuuggauagugugguccuuuua

SEQ ID NO: 307509 - RNA, 22 nt, Homo sapiens
uuugguguauauguaaacuaug

SEQ ID NO: 307510 - RNA, 22 nt, Homo sapiens
uuuguacuugaagaaucuuuau

SEQ ID NO: 307511 - RNA, 19 nt, Homo sapiens
uuuguauguuuccaguaau

SEQ ID NO: 307512 - RNA, 23 nt, Homo sapiens
gggauuguaaaauaugagggcag

SEQ ID NO: 307513 - RNA, 22 nt, Homo sapiens
gggcaacauugaguacccugaa

SEQ ID NO: 307514 - RNA, 22 nt, Homo sapiens
gggguauguaagugagugagug

SEQ ID NO: 307515 - RNA, 22 nt, Homo sapiens
ggugaguggugcuuaaguucag

SEQ ID NO: 307516 - RNA, 23 nt, Homo sapiens
guaguuugaugcaauccacuugu

SEQ ID NO: 307517 - RNA, 22 nt, Homo sapiens
gucauggagggacauaacuaac

SEQ ID NO: 307518 - RNA, 22 nt, Homo sapiens
gucuugaaggcugaguaccugu

SEQ ID NO: 307519 - RNA, 22 nt, Homo sapiens
gugaaauauuuaacguccaggu

SEQ ID NO: 307520 - RNA, 22 nt, Homo sapiens
gugaaguuuuugugaggccuaa

SEQ ID NO: 307521 - RNA, 22 nt, Homo sapiens
gugaaguuuuuugcugagaguc

SEQ ID NO: 307522 - RNA, 22 nt, Homo sapiens
gugaauugagagaacuguguua

SEQ ID NO: 307523 - RNA, 22 nt, Homo sapiens
gugagauacuagagauauagug

SEQ ID NO: 307524 - RNA, 22 nt, Homo sapiens
gugaggcacugcugcuuuccag

SEQ ID NO: 307525 - RNA, 20 nt, Homo sapiens
gugagguagaggguuaccug

SEQ ID NO: 307526 - RNA, 22 nt, Homo sapiens
gugcaaaucucugaguaucuuu

SEQ ID NO: 307527 - RNA, 22 nt, Homo sapiens
gugcacaacgugcagguuaguu

SEQ ID NO: 307528 - RNA, 22 nt, Homo sapiens
gugcauaugcaugugcaugcac

SEQ ID NO: 307529 - RNA, 22 nt, Homo sapiens
guggacggagguugcagugagc

SEQ ID NO: 307530 - RNA, 22 nt, Homo sapiens
guggcagaaaagagaagcaaug

SEQ ID NO: 307531 - RNA, 22 nt, Homo sapiens
guggcagaacagguaggguucu

SEQ ID NO: 307532 - RNA, 22 nt, Homo sapiens
gugggcaagucacuucaguucu

SEQ ID NO: 307533 - RNA, 22 nt, Homo sapiens
gugguaggaaagugcaaaugua

SEQ ID NO: 307534 - RNA, 22 nt, Homo sapiens
gugguucuagagggacagaaug

SEQ ID NO: 307535 - RNA, 22 nt, Homo sapiens
guguaaaacaauuagaggauuu

SEQ ID NO: 307536 - RNA, 22 nt, Homo sapiens
gugucuccugccuucaugcagc

SEQ ID NO: 307537 - RNA, 22 nt, Homo sapiens
gugucuccuguggagcuaugua

SEQ ID NO: 307538 - RNA, 22 nt, Homo sapiens
gugugacagcuauagacaugau

SEQ ID NO: 307539 - RNA, 22 nt, Homo sapiens
caagaucauuuaugcuaaaauu

SEQ ID NO: 307540 - RNA, 22 nt, Homo sapiens
caagugcuacagagaaaucuuu

SEQ ID NO: 307541 - RNA, 22 nt, Homo sapiens
caaugguacuagauaucuucag

SEQ ID NO: 307542 - RNA, 22 nt, Homo sapiens
cacaggccugucucuuucuaac

SEQ ID NO: 307543 - RNA, 22 nt, Homo sapiens
cacuggcacuguguuuagaugg

SEQ ID NO: 307544 - RNA, 20 nt, Homo sapiens
cagagcaaagcaguccuggc

SEQ ID NO: 307545 - RNA, 22 nt, Homo sapiens
cagcaaaucauccuauuugagc

SEQ ID NO: 307546 - RNA, 22 nt, Homo sapiens
cagggcauugucuucuuaguac

SEQ ID NO: 307547 - RNA, 21 nt, Homo sapiens
cagguagugucugaagccaga

SEQ ID NO: 307548 - RNA, 22 nt, Homo sapiens
caggugaaugccucuccuucug

SEQ ID NO: 307549 - RNA, 22 nt, Homo sapiens
caguaaauaucugagcgagguc

SEQ ID NO: 307550 - RNA, 22 nt, Homo sapiens
caguacaauguggaaaaggagu

SEQ ID NO: 307551 - RNA, 22 nt, Homo sapiens
caucacacuuggauguaagaca

SEQ ID NO: 307552 - RNA, 20 nt, Homo sapiens
cauugcacuccagcuugggc

SEQ ID NO: 307553 - RNA, 22 nt, Homo sapiens
cauugucccucaaugucuauga

SEQ ID NO: 307554 - RNA, 22 nt, Homo sapiens
ccagccgggugcaguggcucac

SEQ ID NO: 307555 - RNA, 22 nt, Homo sapiens
ccagugauggcugccucauuug

SEQ ID NO: 307556 - RNA, 22 nt, Homo sapiens
ccaguuuuucauuuauacuagu

SEQ ID NO: 307557 - RNA, 23 nt, Homo sapiens
cccucagaagugcagggagagaa

SEQ ID NO: 307558 - RNA, 22 nt, Homo sapiens
ccuaggcacugggguccagccc

SEQ ID NO: 307559 - RNA, 22 nt, Homo sapiens
cggaaugaaaauguccuucagu

SEQ ID NO: 307560 - RNA, 22 nt, Homo sapiens
cuacagaguaucuaaagaggua

SEQ ID NO: 307561 - RNA, 22 nt, Homo sapiens
cuacucuggagagugacaauca

SEQ ID NO: 307562 - RNA, 22 nt, Homo sapiens
cucaaagugcugggacuggcug

SEQ ID NO: 307563 - RNA, 22 nt, Homo sapiens
cucaaagugcugggauuggcca

SEQ ID NO: 307564 - RNA, 22 nt, Homo sapiens
cucaauuuggaauugucaguaa

SEQ ID NO: 307565 - RNA, 22 nt, Homo sapiens
cucacugugguguccuuaggua

SEQ ID NO: 307566 - RNA, 22 nt, Homo sapiens
cucaguggauuagauaaugcac

SEQ ID NO: 307567 - RNA, 22 nt, Homo sapiens
cucagugguugauuuauuuauc

SEQ ID NO: 307568 - RNA, 22 nt, Homo sapiens
cucaguuuugccuuguuuaagg

SEQ ID NO: 307569 - RNA, 22 nt, Homo sapiens
gugaaugcauuaagaaggggga

SEQ ID NO: 307570 - RNA, 22 nt, Homo sapiens
gugacacuggagcuggcacaau

SEQ ID NO: 307571 - RNA, 22 nt, Homo sapiens
gugacagaguaagacccuguau

SEQ ID NO: 307572 - RNA, 22 nt, Homo sapiens
gugagaaucaaacuacauaaau

SEQ ID NO: 307573 - RNA, 22 nt, Homo sapiens
gugagauccucucuuauauggg

SEQ ID NO: 307574 - RNA, 22 nt, Homo sapiens
gugaguggacgugaccaauaaa

SEQ ID NO: 307575 - RNA, 22 nt, Homo sapiens
gugauaucuuacaauucucuuu

SEQ ID NO: 307576 - RNA, 22 nt, Homo sapiens
gugcaaguguaauacagcuagg

SEQ ID NO: 307577 - RNA, 22 nt, Homo sapiens
gugcacaaaucuuaaauguaca

SEQ ID NO: 307578 - RNA, 22 nt, Homo sapiens
gugcacaacgugcaaguuuguu

SEQ ID NO: 307579 - RNA, 22 nt, Homo sapiens
gugcacaacgugcaggcuuguu

SEQ ID NO: 307580 - RNA, 22 nt, Homo sapiens
gugcacaacgugcagguuuguu

SEQ ID NO: 307581 - RNA, 22 nt, Homo sapiens
gugcacaaugugcagguuuguu

SEQ ID NO: 307582 - RNA, 21 nt, Homo sapiens
gugcacaguaguguuuaauag

SEQ ID NO: 307583 - RNA, 22 nt, Homo sapiens
guggacagagacuaaauguugu

SEQ ID NO: 307584 - RNA, 22 nt, Homo sapiens
gugggaugcaaguaaaauuguc

SEQ ID NO: 307585 - RNA, 22 nt, Homo sapiens
gugguucuaaaccuuuuuuggu

SEQ ID NO: 307586 - RNA, 22 nt, Homo sapiens
gugugauuauuucaauugaugc

SEQ ID NO: 307587 - RNA, 22 nt, Homo sapiens
guugccuaggcuggucuugaac

SEQ ID NO: 307588 - RNA, 22 nt, Homo sapiens
guugugcuuaagccuauugauu

SEQ ID NO: 307589 - RNA, 22 nt, Homo sapiens
guuguggagucuucuguucugg

SEQ ID NO: 307590 - RNA, 22 nt, Homo sapiens
guuuggauuuucuaauuucugu

SEQ ID NO: 307591 - RNA, 22 nt, Homo sapiens
guuugugcuccuaugagaaucu

SEQ ID NO: 307592 - RNA, 22 nt, Homo sapiens
uaaaguuauugccccucaguua

SEQ ID NO: 307593 - RNA, 22 nt, Homo sapiens
uaaauggauaaaugaauaccua

SEQ ID NO: 307594 - RNA, 22 nt, Homo sapiens
uaacauagucauauacuugcuu

SEQ ID NO: 307595 - RNA, 22 nt, Homo sapiens
uaaggcacucuucugugugccu

SEQ ID NO: 307596 - RNA, 23 nt, Homo sapiens
uuugugcuaauuuaugggcucuu

SEQ ID NO: 307597 - RNA, 22 nt, Homo sapiens
uuugugcuccuaugagaaucua

SEQ ID NO: 307598 - RNA, 22 nt, Homo sapiens
uuugugcuccucucaguaugug

SEQ ID NO: 307599 - RNA, 22 nt, Homo sapiens
uuugugcuccugugagaaucua

SEQ ID NO: 307600 - RNA, 22 nt, Homo sapiens
uuugugcugcaauuaauuuccc

SEQ ID NO: 307601 - RNA, 22 nt, Homo sapiens
uuuuacagaggagguugcugau

SEQ ID NO: 307602 - RNA, 23 nt, Homo sapiens
uuuuuguguuucauggaaauagg

SEQ ID NO: 307603 - RNA, 22 nt, Homo sapiens
uuuuuuaguuagcugggcauga

SEQ ID NO: 307604 - RNA, 22 nt, Homo sapiens
aaaguguuucugcaguagguuu

SEQ ID NO: 307605 - RNA, 21 nt, Homo sapiens
aaaugcacauuacugcuggug

SEQ ID NO: 307606 - RNA, 22 nt, Homo sapiens
aaaugcaccacucuggugcagg

SEQ ID NO: 307607 - RNA, 18 nt, Homo sapiens
aaaugcucuucuggaaua

SEQ ID NO: 307608 - RNA, 22 nt, Homo sapiens
aaaugcucuuuaugaaguugga

SEQ ID NO: 307609 - RNA, 22 nt, Homo sapiens
aacacggcccgcagagcaagcu

SEQ ID NO: 307610 - RNA, 22 nt, Homo sapiens
aacagugccugucauuuaguag

SEQ ID NO: 307611 - RNA, 22 nt, Homo sapiens
aacugcuguuuggguacuggug

SEQ ID NO: 307612 - RNA, 22 nt, Homo sapiens
aacuggccuggcgugcagaggg

SEQ ID NO: 307613 - RNA, 21 nt, Homo sapiens
aagaaagcuggacuugccgcu

SEQ ID NO: 307614 - RNA, 22 nt, Homo sapiens
aagagagcuaugugcauaauua

SEQ ID NO: 307615 - RNA, 22 nt, Homo sapiens
aagagugucuuugugcuggccc

SEQ ID NO: 307616 - RNA, 19 nt, Homo sapiens
aagaugauguuugggcuaa

SEQ ID NO: 307617 - RNA, 22 nt, Homo sapiens
aagcagauguguugaaaguacu

SEQ ID NO: 307618 - RNA, 22 nt, Homo sapiens
aaggaguagaauagaugcaccu

SEQ ID NO: 307619 - RNA, 22 nt, Homo sapiens
aaggcaugcaguacguuucuau

SEQ ID NO: 307620 - RNA, 22 nt, Homo sapiens
aagggaauguuguggcugguug

SEQ ID NO: 307621 - RNA, 22 nt, Homo sapiens
aagggaauguuguggcugguuu

SEQ ID NO: 307622 - RNA, 22 nt, Homo sapiens
aagguauuucuaugggaauaga

SEQ ID NO: 307623 - RNA, 22 nt, Homo sapiens
aagugcaaauucccaggcucug

SEQ ID NO: 307624 - RNA, 22 nt, Homo sapiens
aagugcuguaugggagccuagg

SEQ ID NO: 307625 - RNA, 22 nt, Homo sapiens
aagugcuguccuaccuuuggga

SEQ ID NO: 307626 - RNA, 22 nt, Homo sapiens
augggaaaaucagaaggccugg

SEQ ID NO: 307627 - RNA, 21 nt, Homo sapiens
augggacuaacugaugggucu

SEQ ID NO: 307628 - RNA, 22 nt, Homo sapiens
augggacugggugccguggagc

SEQ ID NO: 307629 - RNA, 22 nt, Homo sapiens
augggagugugguuagagaccu

SEQ ID NO: 307630 - RNA, 22 nt, Homo sapiens
augugcaacugcuggaacaguc

SEQ ID NO: 307631 - RNA, 22 nt, Homo sapiens
auguuugguaagaauauuguua

SEQ ID NO: 307632 - RNA, 22 nt, Homo sapiens
auuagguagugagaugcugcug

SEQ ID NO: 307633 - RNA, 22 nt, Homo sapiens
auucacagggggagaaggguau

SEQ ID NO: 307634 - RNA, 22 nt, Homo sapiens
caaaagugguucuuauccuuuu

SEQ ID NO: 307635 - RNA, 22 nt, Homo sapiens
caaagugcuggaauuggccggg

SEQ ID NO: 307636 - RNA, 22 nt, Homo sapiens
caacacagugaaacccgucucu

SEQ ID NO: 307637 - RNA, 22 nt, Homo sapiens
caaggcacagccccuacuuccu

SEQ ID NO: 307638 - RNA, 22 nt, Homo sapiens
caagugcuuucuuggggauuua

SEQ ID NO: 307639 - RNA, 22 nt, Homo sapiens
cagagaucaugcaacugcucgc

SEQ ID NO: 307640 - RNA, 22 nt, Homo sapiens
cagagcacugauacuggguucu

SEQ ID NO: 307641 - RNA, 22 nt, Homo sapiens
cagagguaagcaagucagcauu

SEQ ID NO: 307642 - RNA, 22 nt, Homo sapiens
cagauguaguauuuuagugaaa

SEQ ID NO: 307643 - RNA, 22 nt, Homo sapiens
cagcgaggucugcgucacauug

SEQ ID NO: 307644 - RNA, 22 nt, Homo sapiens
cagguacuucugggcugagcag

SEQ ID NO: 307645 - RNA, 19 nt, Homo sapiens
cagguagugugcugacaug

SEQ ID NO: 307646 - RNA, 19 nt, Homo sapiens
caguaucauugcacauagu

SEQ ID NO: 307647 - RNA, 22 nt, Homo sapiens
cagugcaaccuccaucucucgg

SEQ ID NO: 307648 - RNA, 22 nt, Homo sapiens
cauauaguaguacuguuagguu

SEQ ID NO: 307649 - RNA, 21 nt, Homo sapiens
caucaaauugucauggugggu

SEQ ID NO: 307650 - RNA, 22 nt, Homo sapiens
ugccaguauuuuauugaagauu

SEQ ID NO: 307651 - RNA, 22 nt, Homo sapiens
ugccuaguggaaggagagcaaa

SEQ ID NO: 307652 - RNA, 22 nt, Homo sapiens
ugccuaguguguugagaguuuu

SEQ ID NO: 307653 - RNA, 23 nt, Homo sapiens
ugcugagaccuagauccuaaaga

SEQ ID NO: 307654 - RNA, 22 nt, Homo sapiens
uggaagugucugugcccagcuc

SEQ ID NO: 307655 - RNA, 22 nt, Homo sapiens
uggagggcuagucauuucuuuu

SEQ ID NO: 307656 - RNA, 22 nt, Homo sapiens
uggagguagagaugggaucucc

SEQ ID NO: 307657 - RNA, 22 nt, Homo sapiens
uggauugaaagcuuuaauauug

SEQ ID NO: 307658 - RNA, 22 nt, Homo sapiens
uggcaagagauaugugucuaua

SEQ ID NO: 307659 - RNA, 22 nt, Homo sapiens
uggcaugaaguguguuuuaucu

SEQ ID NO: 307660 - RNA, 22 nt, Homo sapiens
ugggaacaugaagguuaaagag

SEQ ID NO: 307661 - RNA, 22 nt, Homo sapiens
ugggagugugcacaauuucagc

SEQ ID NO: 307662 - RNA, 22 nt, Homo sapiens
ugggcaagagagcaugacccug

SEQ ID NO: 307663 - RNA, 22 nt, Homo sapiens
uggggcaaugaacauuuuugca

SEQ ID NO: 307664 - RNA, 19 nt, Homo sapiens
uggucaguucugggagcug

SEQ ID NO: 307665 - RNA, 22 nt, Homo sapiens
uggucguggagucccuggcuuc

SEQ ID NO: 307666 - RNA, 22 nt, Homo sapiens
uggugagaaaugagaugcuuuu

SEQ ID NO: 307667 - RNA, 23 nt, Homo sapiens
uguaaaagcauuugucagccugg

SEQ ID NO: 307668 - RNA, 22 nt, Homo sapiens
uguaagugugcaauucagugau

SEQ ID NO: 307669 - RNA, 22 nt, Homo sapiens
uguagucauuugaaggaugucc

SEQ ID NO: 307670 - RNA, 22 nt, Homo sapiens
ugucaaaugcagugauauuuga

SEQ ID NO: 307671 - RNA, 22 nt, Homo sapiens
ugucaggaugcuccuuuuggcu

SEQ ID NO: 307672 - RNA, 22 nt, Homo sapiens
ugucaugaacucacauucuggg

SEQ ID NO: 307673 - RNA, 22 nt, Homo sapiens
ugucauggauucugagucuggg

SEQ ID NO: 307674 - RNA, 22 nt, Homo sapiens
ugucaugguguuaauuuuccug

SEQ ID NO: 307675 - RNA, 22 nt, Homo sapiens
ugucauguaaagaguaaauggu

SEQ ID NO: 307676 - RNA, 18 nt, Homo sapiens
ugugacauugagcauguc

SEQ ID NO: 307677 - RNA, 22 nt, Homo sapiens
ugugaccaaaaucaacauaccu

SEQ ID NO: 307678 - RNA, 22 nt, Homo sapiens
ugugcacauaacauuuuuuuag

SEQ ID NO: 307679 - RNA, 22 nt, Homo sapiens
ugugguuuuaguaaaacuaugu

SEQ ID NO: 307680 - RNA, 22 nt, Homo sapiens
uuaaaggcaugguuagacaugg

SEQ ID NO: 307681 - RNA, 22 nt, Homo sapiens
uuaaggugaaguucucagaugc

SEQ ID NO: 307682 - RNA, 22 nt, Homo sapiens
uuaagguuuuuguagcaaggau

SEQ ID NO: 307683 - RNA, 22 nt, Homo sapiens
uuaagugcucaguuacucaguu

SEQ ID NO: 307684 - RNA, 19 nt, Homo sapiens
uuaagugugauaucucagu

SEQ ID NO: 307685 - RNA, 22 nt, Homo sapiens
uuaaugcuuuugggauauuucu

SEQ ID NO: 307686 - RNA, 22 nt, Homo sapiens
uuacaaccucagcagugcaaag

SEQ ID NO: 307687 - RNA, 22 nt, Homo sapiens
uuacagcugggugugucuggua

SEQ ID NO: 307688 - RNA, 22 nt, Homo sapiens
uuacaguaugaguaagaguucu

SEQ ID NO: 307689 - RNA, 22 nt, Homo sapiens
uuacaguugugagccaccaugc

SEQ ID NO: 307690 - RNA, 22 nt, Homo sapiens
uuauaaacaugaagauuugggg

SEQ ID NO: 307691 - RNA, 22 nt, Homo sapiens
uuauggccauucuuguaggagu

SEQ ID NO: 307692 - RNA, 22 nt, Homo sapiens
uucacagagagaacucaaacca

SEQ ID NO: 307693 - RNA, 22 nt, Homo sapiens
uucacugugaauaaaggcuccc

SEQ ID NO: 307694 - RNA, 22 nt, Homo sapiens
uucaguggagaggcugaguggu

SEQ ID NO: 307695 - RNA, 22 nt, Homo sapiens
uucauaguguuuccuuccagug

SEQ ID NO: 307696 - RNA, 22 nt, Homo sapiens
uucccuagaacacauggaggga

SEQ ID NO: 307697 - RNA, 22 nt, Homo sapiens
uucccuuucugaaaaucucauu

SEQ ID NO: 307698 - RNA, 22 nt, Homo sapiens
uucuaaacaucuuacaaugcau

SEQ ID NO: 307699 - RNA, 22 nt, Homo sapiens
uucucagcccccugacagucag

SEQ ID NO: 307700 - RNA, 22 nt, Homo sapiens
uucucuggucagaggggagguu

SEQ ID NO: 307701 - RNA, 22 nt, Homo sapiens
uucuggcucaggucaacacuuc

SEQ ID NO: 307702 - RNA, 19 nt, Homo sapiens
uucuuuguugugggggcug

SEQ ID NO: 307703 - RNA, 22 nt, Homo sapiens
uugaaguagguaccguucaauu

SEQ ID NO: 307704 - RNA, 22 nt, Homo sapiens
uugaauaguggugaaaguuuga

SEQ ID NO: 307705 - RNA, 22 nt, Homo sapiens
uugacacuaauuauuauaggug

SEQ ID NO: 307706 - RNA, 22 nt, Homo sapiens
uugagagcugaugaaagauaaa

SEQ ID NO: 307707 - RNA, 22 nt, Homo sapiens
uugagauacauaauuaugaaug

SEQ ID NO: 307708 - RNA, 22 nt, Homo sapiens
uugagauagggucuaccucugu

SEQ ID NO: 307709 - RNA, 22 nt, Homo sapiens
uugagcuuuuuacuuguccaau

SEQ ID NO: 307710 - RNA, 20 nt, Homo sapiens
uugaggucaggaguuuggga

SEQ ID NO: 307711 - RNA, 22 nt, Homo sapiens
uugcacaauccugugagugagu

SEQ ID NO: 307712 - RNA, 22 nt, Homo sapiens
uuggauuauaaacugagauuug

SEQ ID NO: 307713 - RNA, 22 nt, Homo sapiens
uuggcaaagugucuggcauuua

SEQ ID NO: 307714 - RNA, 22 nt, Homo sapiens
uuggcaaaugucacaaaucagg

SEQ ID NO: 307715 - RNA, 22 nt, Homo sapiens
uuggcaauauuuacugaaguug

SEQ ID NO: 307716 - RNA, 22 nt, Homo sapiens
uuggcagaauguuagaaacuua

SEQ ID NO: 307717 - RNA, 23 nt, Homo sapiens
uugggcaaaucacuaacgucucc

SEQ ID NO: 307718 - RNA, 17 nt, Homo sapiens
uugggcaagguagguga

SEQ ID NO: 307719 - RNA, 22 nt, Homo sapiens
aaacagucuucuccugagggac

SEQ ID NO: 307720 - RNA, 22 nt, Homo sapiens
aaaggcacacacuccuuguuau

SEQ ID NO: 307721 - RNA, 22 nt, Homo sapiens
aaaggcacugaucuuauccagu

SEQ ID NO: 307722 - RNA, 22 nt, Homo sapiens
aaaggcacugugacuuuauagg

SEQ ID NO: 307723 - RNA, 22 nt, Homo sapiens
aaagugcuaggauuaccugggg

SEQ ID NO: 307724 - RNA, 22 nt, Homo sapiens
aaagugcugggaucacacugaa

SEQ ID NO: 307725 - RNA, 22 nt, Homo sapiens
aaagugcugggauuuuaggcau

SEQ ID NO: 307726 - RNA, 22 nt, Homo sapiens
aaagugcuguagacugggcgca

SEQ ID NO: 307727 - RNA, 22 nt, Homo sapiens
aaaugcacaaagauuuugcacu

SEQ ID NO: 307728 - RNA, 22 nt, Homo sapiens
aaauugcaguuaggaugauggu

SEQ ID NO: 307729 - RNA, 20 nt, Homo sapiens
aacagcacugucugaagcuu

SEQ ID NO: 307730 - RNA, 22 nt, Homo sapiens
aacaggcuccuaggggugcacc

SEQ ID NO: 307731 - RNA, 22 nt, Homo sapiens
aacagucaauugcugaugaccu

SEQ ID NO: 307732 - RNA, 21 nt, Homo sapiens
aacagugcugaacagacaccu

SEQ ID NO: 307733 - RNA, 23 nt, Homo sapiens
aagagguaugacuaugaagugga

SEQ ID NO: 307734 - RNA, 22 nt, Homo sapiens
aagaugguauuucauuaguuuu

SEQ ID NO: 307735 - RNA, 22 nt, Homo sapiens
aaggaguagaggaauagcaaug

SEQ ID NO: 307736 - RNA, 22 nt, Homo sapiens
aaggcaugcugaguccuaaaag

SEQ ID NO: 307737 - RNA, 22 nt, Homo sapiens
aagggaauguuguagcugguuu

SEQ ID NO: 307738 - RNA, 22 nt, Homo sapiens
aaguaaaucuuaugucagggag

SEQ ID NO: 307739 - RNA, 22 nt, Homo sapiens
aagucaugaagaggaaaggaca

SEQ ID NO: 307740 - RNA, 22 nt, Homo sapiens
aagugcuggccuacucaaucga

SEQ ID NO: 307741 - RNA, 22 nt, Homo sapiens
aagugcugggauuggccgggca

SEQ ID NO: 307742 - RNA, 22 nt, Homo sapiens
aagugguuuuuacaaagacaga

SEQ ID NO: 307743 - RNA, 22 nt, Homo sapiens
aauacuggcacugaagaccaug

SEQ ID NO: 307744 - RNA, 22 nt, Homo sapiens
aaucaccaugcacuacagccuu

SEQ ID NO: 307745 - RNA, 22 nt, Homo sapiens
aaaccaccauuacuuuugcacc

SEQ ID NO: 307746 - RNA, 22 nt, Homo sapiens
aaagaguucagguagauuucaa

SEQ ID NO: 307747 - RNA, 22 nt, Homo sapiens
aaagggcacugugcuuuggcaa

SEQ ID NO: 307748 - RNA, 22 nt, Homo sapiens
aaagggcuguuucuugacuugg

SEQ ID NO: 307749 - RNA, 22 nt, Homo sapiens
aaagucacuggagaaggaauau

SEQ ID NO: 307750 - RNA, 22 nt, Homo sapiens
aaagugcugagaguucuaacuu

SEQ ID NO: 307751 - RNA, 22 nt, Homo sapiens
aaagugcugagauuguaggcau

SEQ ID NO: 307752 - RNA, 22 nt, Homo sapiens
aaagugcugagucuaggcgggg

SEQ ID NO: 307753 - RNA, 22 nt, Homo sapiens
aaagugcugggauuggccgggc

SEQ ID NO: 307754 - RNA, 22 nt, Homo sapiens
aaagugcuuccuuuuugagggu

SEQ ID NO: 307755 - RNA, 22 nt, Homo sapiens
aaagugcuucucuuuggugggu

SEQ ID NO: 307756 - RNA, 22 nt, Homo sapiens
aauccauuugccgucuauccau

SEQ ID NO: 307757 - RNA, 22 nt, Homo sapiens
aaugacagccagauucuucucu

SEQ ID NO: 307758 - RNA, 22 nt, Homo sapiens
aaugcacauauauuuccuuauu

SEQ ID NO: 307759 - RNA, 22 nt, Homo sapiens
aauggcacuuuauaaauguuaa

SEQ ID NO: 307760 - RNA, 22 nt, Homo sapiens
aauucugugagauggugcagau

SEQ ID NO: 307761 - RNA, 22 nt, Homo sapiens
acagguacacagaauauccaga

SEQ ID NO: 307762 - RNA, 22 nt, Homo sapiens
acaguguguguguucaccuaga

SEQ ID NO: 307763 - RNA, 22 nt, Homo sapiens
acauggcacugcgggcuucuug

SEQ ID NO: 307764 - RNA, 22 nt, Homo sapiens
accaugcaguccaauaugcaca

SEQ ID NO: 307765 - RNA, 21 nt, Homo sapiens
acccucuaguuuucaacaggc

SEQ ID NO: 307766 - RNA, 22 nt, Homo sapiens
acuauacugaagcaaauuaaca

SEQ ID NO: 307767 - RNA, 22 nt, Homo sapiens
acucagagaacauucccagucu

SEQ ID NO: 307768 - RNA, 22 nt, Homo sapiens
acuggcaauggcagaaauaguu

SEQ ID NO: 307769 - RNA, 20 nt, Homo sapiens
agaagcauugcucucuucag

SEQ ID NO: 307770 - RNA, 22 nt, Homo sapiens
agagaacugauuggaguugggc

SEQ ID NO: 307771 - RNA, 22 nt, Homo sapiens
agagguaagcaguggcaagugc

SEQ ID NO: 307772 - RNA, 22 nt, Homo sapiens
agagguagaagauaggcuacag

SEQ ID NO: 307773 - RNA, 22 nt, Homo sapiens
agagugaagcuuuuuauauucu

SEQ ID NO: 307774 - RNA, 22 nt, Homo sapiens
agagugcuauagauuagauuuc

SEQ ID NO: 307775 - RNA, 22 nt, Homo sapiens
agauacaucuaugugucugugu

SEQ ID NO: 307776 - RNA, 22 nt, Homo sapiens
agauggugauaaaugugguacc

SEQ ID NO: 307777 - RNA, 22 nt, Homo sapiens
agauguuguucaucugauuguu

SEQ ID NO: 307778 - RNA, 22 nt, Homo sapiens
agcaacaucagcagcaggaaaa

SEQ ID NO: 307779 - RNA, 22 nt, Homo sapiens
agcaacauugagacugcaguug

SEQ ID NO: 307780 - RNA, 22 nt, Homo sapiens
agcaacauuuuugaccuuucuu

SEQ ID NO: 307781 - RNA, 22 nt, Homo sapiens
agcagcacaucccuuucuggcc

SEQ ID NO: 307782 - RNA, 19 nt, Homo sapiens
agcaguguggagauuucuc

SEQ ID NO: 307783 - RNA, 22 nt, Homo sapiens
agccuguguugaauuauagaaa

SEQ ID NO: 307784 - RNA, 22 nt, Homo sapiens
agcuggucuacguguguaugag

SEQ ID NO: 307785 - RNA, 22 nt, Homo sapiens
agcuuuggauaccugcuguucc

SEQ ID NO: 307786 - RNA, 22 nt, Homo sapiens
aggcacacaacccuggaccuga

SEQ ID NO: 307787 - RNA, 21 nt, Homo sapiens
aggcuguuguuuugggaugga

SEQ ID NO: 307788 - RNA, 22 nt, Homo sapiens
agggccuuuguagauguacuca

SEQ ID NO: 307789 - RNA, 22 nt, Homo sapiens
aggguuuuuauuuauguggcau

SEQ ID NO: 307790 - RNA, 22 nt, Homo sapiens
agguaaacauggggacugcuac

SEQ ID NO: 307791 - RNA, 22 nt, Homo sapiens
aguaaaucacuaauggcuuccg

SEQ ID NO: 307792 - RNA, 22 nt, Homo sapiens
aguaaauuucugugcuuucaua

SEQ ID NO: 307793 - RNA, 22 nt, Homo sapiens
aguacacuguugaacagaagug

SEQ ID NO: 307794 - RNA, 22 nt, Homo sapiens
agucaaaugcuuauguauaaag

SEQ ID NO: 307795 - RNA, 22 nt, Homo sapiens
agugcaguggugccaucauaac

SEQ ID NO: 307796 - RNA, 22 nt, Homo sapiens
agugguguugccuguugaccua

SEQ ID NO: 307797 - RNA, 22 nt, Homo sapiens
aguuggcacugagcugugauug

SEQ ID NO: 307798 - RNA, 22 nt, Homo sapiens
auaaagccaugagcuugagaug

SEQ ID NO: 307799 - RNA, 22 nt, Homo sapiens
auaaaguucugcuggcauauau

SEQ ID NO: 307800 - RNA, 22 nt, Homo sapiens
auaaaugcauugagaacugcug

SEQ ID NO: 307801 - RNA, 22 nt, Homo sapiens
auagaauguauuaguaaauuug

SEQ ID NO: 307802 - RNA, 22 nt, Homo sapiens
auagcauaucccacaugucaga

SEQ ID NO: 307803 - RNA, 22 nt, Homo sapiens
auagugaacuuugugagaacaa

SEQ ID NO: 307804 - RNA, 22 nt, Homo sapiens
auauucaagugaggauggcuaa

SEQ ID NO: 307805 - RNA, 18 nt, Homo sapiens
auauugccuucagacuag

SEQ ID NO: 307806 - RNA, 22 nt, Homo sapiens
aucaaaguuucccagaaguugu

SEQ ID NO: 307807 - RNA, 22 nt, Homo sapiens
aucaaaucuccagaaccugucu

SEQ ID NO: 307808 - RNA, 22 nt, Homo sapiens
aucacaauuguacguaggagcc

SEQ ID NO: 307809 - RNA, 22 nt, Homo sapiens
aucacagaacuuugagcagaga

SEQ ID NO: 307810 - RNA, 22 nt, Homo sapiens
auccacagugucaauguuguga

SEQ ID NO: 307811 - RNA, 22 nt, Homo sapiens
aucccuguaacuagcagccccu

SEQ ID NO: 307812 - RNA, 22 nt, Homo sapiens
aucccuuucucuggcuaggggg

SEQ ID NO: 307813 - RNA, 22 nt, Homo sapiens
aucccuuucugauacuuucccu

SEQ ID NO: 307814 - RNA, 22 nt, Homo sapiens
augaaaucacugugaugcccua

SEQ ID NO: 307815 - RNA, 22 nt, Homo sapiens
augaaaucuuuccugugaggau

SEQ ID NO: 307816 - RNA, 23 nt, Homo sapiens
augaacucaucauuuuuuauggc

SEQ ID NO: 307817 - RNA, 22 nt, Homo sapiens
augagaccagcagaaaaccugu

SEQ ID NO: 307818 - RNA, 22 nt, Homo sapiens
augagauacuacaaaugaguuu

SEQ ID NO: 307819 - RNA, 22 nt, Homo sapiens
augagauaggaacaaacuuaca

SEQ ID NO: 307820 - RNA, 22 nt, Homo sapiens
augagauauuuuauaagaucau

SEQ ID NO: 307821 - RNA, 21 nt, Homo sapiens
augagguguacuguggugaaa

SEQ ID NO: 307822 - RNA, 22 nt, Homo sapiens
augauaaguuauuagaagaaga

SEQ ID NO: 307823 - RNA, 22 nt, Homo sapiens
augaucaucugaaagcuuuuac

SEQ ID NO: 307824 - RNA, 22 nt, Homo sapiens
augaucuagaguaggaaacaga

SEQ ID NO: 307825 - RNA, 22 nt, Homo sapiens
augcacuguauaggaucuugcg

SEQ ID NO: 307826 - RNA, 22 nt, Homo sapiens
augcauggcagagucaggguac

SEQ ID NO: 307827 - RNA, 19 nt, Homo sapiens
augccuggagaugguuaua

SEQ ID NO: 307828 - RNA, 22 nt, Homo sapiens
auggaaaugaagggcuggcccu

SEQ ID NO: 307829 - RNA, 22 nt, Homo sapiens
auggaaugguugggucauaagg

SEQ ID NO: 307830 - RNA, 21 nt, Homo sapiens
auggacaugguuaggcuuugu

SEQ ID NO: 307831 - RNA, 22 nt, Homo sapiens
auguaugagaguuccagcugau

SEQ ID NO: 307832 - RNA, 22 nt, Homo sapiens
augugcaagaucauuaaagcuc

SEQ ID NO: 307833 - RNA, 22 nt, Homo sapiens
augugcuuuuuaaacagaugcu

SEQ ID NO: 307834 - RNA, 22 nt, Homo sapiens
auuaaggaguggguucauggug

SEQ ID NO: 307835 - RNA, 22 nt, Homo sapiens
auuaaguugugccugaaaacuu

SEQ ID NO: 307836 - RNA, 22 nt, Homo sapiens
auuaauguaauuaguaaaguug

SEQ ID NO: 307837 - RNA, 22 nt, Homo sapiens
auuacauagucaaggugucuca

SEQ ID NO: 307838 - RNA, 20 nt, Homo sapiens
auugaacucaguauucugaa

SEQ ID NO: 307839 - RNA, 22 nt, Homo sapiens
auuguucuuguguccuuuuccu

SEQ ID NO: 307840 - RNA, 21 nt, Homo sapiens
auuugguggcugugugacacu

SEQ ID NO: 307841 - RNA, 22 nt, Homo sapiens
caaugguuuuuuaguauaagua

SEQ ID NO: 307842 - RNA, 22 nt, Homo sapiens
cacagagugagacccugucucu

SEQ ID NO: 307843 - RNA, 22 nt, Homo sapiens
cacaguagaauagagcacuagg

SEQ ID NO: 307844 - RNA, 22 nt, Homo sapiens
cacagugaacaauauccucugu

SEQ ID NO: 307845 - RNA, 22 nt, Homo sapiens
cacagugaacugguggguuuuu

SEQ ID NO: 307846 - RNA, 22 nt, Homo sapiens
aagcaucacauaauggaucaug

SEQ ID NO: 307847 - RNA, 22 nt, Homo sapiens
aagcaucauuuggaauuugaga

SEQ ID NO: 307848 - RNA, 22 nt, Homo sapiens
aaggcauggugacuauuuaggc

SEQ ID NO: 307849 - RNA, 22 nt, Homo sapiens
aagggaaugcgcugccuguguu

SEQ ID NO: 307850 - RNA, 22 nt, Homo sapiens
aagggaaugugguagcugguuu

SEQ ID NO: 307851 - RNA, 22 nt, Homo sapiens
aaggugcucucuuauguagaaa

SEQ ID NO: 307852 - RNA, 22 nt, Homo sapiens
aagguggugucagagagcuuau

SEQ ID NO: 307853 - RNA, 22 nt, Homo sapiens
aaguauagcuaugauaaacauu

SEQ ID NO: 307854 - RNA, 22 nt, Homo sapiens
aaguauuagugaggauauggaa

SEQ ID NO: 307855 - RNA, 20 nt, Homo sapiens
aagugcaucguugugucugc

SEQ ID NO: 307856 - RNA, 22 nt, Homo sapiens
aaucacuaugccaugaaguaca

SEQ ID NO: 307857 - RNA, 22 nt, Homo sapiens
aaugacagugcuaaagaacccu

SEQ ID NO: 307858 - RNA, 22 nt, Homo sapiens
aauggcacaagaguaaacuguu

SEQ ID NO: 307859 - RNA, 22 nt, Homo sapiens
aauggcaguagauggaugggua

SEQ ID NO: 307860 - RNA, 22 nt, Homo sapiens
aauggcuucuuauugugguuca

SEQ ID NO: 307861 - RNA, 22 nt, Homo sapiens
aauggguaguacugugguaaca

SEQ ID NO: 307862 - RNA, 22 nt, Homo sapiens
aaugucaugaguccaaccagaa

SEQ ID NO: 307863 - RNA, 22 nt, Homo sapiens
aauucuguauuguuuagggacu

SEQ ID NO: 307864 - RNA, 19 nt, Homo sapiens
acaguaccuggcaugaggu

SEQ ID NO: 307865 - RNA, 22 nt, Homo sapiens
acaucccaugccuggguacucc

SEQ ID NO: 307866 - RNA, 22 nt, Homo sapiens
accaccacucccgcauucuaaa

SEQ ID NO: 307867 - RNA, 22 nt, Homo sapiens
accagucucagguaugucuuua

SEQ ID NO: 307868 - RNA, 22 nt, Homo sapiens
accauugcacuccagcccaggc

SEQ ID NO: 307869 - RNA, 22 nt, Homo sapiens
acccugguagcuaugaagucuu

SEQ ID NO: 307870 - RNA, 22 nt, Homo sapiens
accuggacacuuugggcuccuc

SEQ ID NO: 307871 - RNA, 22 nt, Homo sapiens
acugagaucuuuaaauaaauaa

SEQ ID NO: 307872 - RNA, 22 nt, Homo sapiens
agaauguaaacagaauagagga

SEQ ID NO: 307873 - RNA, 22 nt, Homo sapiens
agagauaaagauuuuaauuuug

SEQ ID NO: 307874 - RNA, 20 nt, Homo sapiens
agagugcuggacugaggagc

SEQ ID NO: 307875 - RNA, 22 nt, Homo sapiens
agaucacagucuuugguuuuag

SEQ ID NO: 307876 - RNA, 18 nt, Homo sapiens
agaugcaugcucacuaca

SEQ ID NO: 307877 - RNA, 22 nt, Homo sapiens
agaugcuguuaucaacuguagc

SEQ ID NO: 307878 - RNA, 22 nt, Homo sapiens
ugacauuacagucacuugcugu

SEQ ID NO: 307879 - RNA, 22 nt, Homo sapiens
ugacuagacuugcaagguugca

SEQ ID NO: 307880 - RNA, 22 nt, Homo sapiens
ugacucgaggcgccuccagucc

SEQ ID NO: 307881 - RNA, 22 nt, Homo sapiens
ugagaagacaucagcuuucgga

SEQ ID NO: 307882 - RNA, 22 nt, Homo sapiens
ugagaagaugaacuccuugguc

SEQ ID NO: 307883 - RNA, 22 nt, Homo sapiens
ugagauaaagcauguacugugu

SEQ ID NO: 307884 - RNA, 22 nt, Homo sapiens
ugagaucacuaagagguaaugg

SEQ ID NO: 307885 - RNA, 22 nt, Homo sapiens
ugagaucaugccacugcacuuc

SEQ ID NO: 307886 - RNA, 22 nt, Homo sapiens
ugagaugaggucucgcucuguc

SEQ ID NO: 307887 - RNA, 21 nt, Homo sapiens
ugagaugauccugcaugcaug

SEQ ID NO: 307888 - RNA, 22 nt, Homo sapiens
ugagaugcaaaaugagaauugu

SEQ ID NO: 307889 - RNA, 20 nt, Homo sapiens
ugagaugcauugggauguuu

SEQ ID NO: 307890 - RNA, 20 nt, Homo sapiens
ugagccccuggacucaagcg

SEQ ID NO: 307891 - RNA, 22 nt, Homo sapiens
ugagugccuggagggcagggac

SEQ ID NO: 307892 - RNA, 22 nt, Homo sapiens
ugauaacauuucuucugguaca

SEQ ID NO: 307893 - RNA, 22 nt, Homo sapiens
ugauauguaacuacuccuuaua

SEQ ID NO: 307894 - RNA, 22 nt, Homo sapiens
ugaugacucuguggccccaggc

SEQ ID NO: 307895 - RNA, 22 nt, Homo sapiens
ugaugucuugcaggcacgagau

SEQ ID NO: 307896 - RNA, 22 nt, Homo sapiens
ugcaaaugcugcuauuucucuu

SEQ ID NO: 307897 - RNA, 22 nt, Homo sapiens
ugcaaauguuaggugucauuau

SEQ ID NO: 307898 - RNA, 22 nt, Homo sapiens
ugcaccaucuugcuucuguggu

SEQ ID NO: 307899 - RNA, 21 nt, Homo sapiens
ugcagccauucagcccuaugc

SEQ ID NO: 307900 - RNA, 22 nt, Homo sapiens
ugccagaugcuggugugagggg

SEQ ID NO: 307901 - RNA, 22 nt, Homo sapiens
gugugauuguuaauuuuaggug

SEQ ID NO: 307902 - RNA, 22 nt, Homo sapiens
guucacaguuucuaaucccagc

SEQ ID NO: 307903 - RNA, 22 nt, Homo sapiens
guucaguuugcugaugcguuga

SEQ ID NO: 307904 - RNA, 22 nt, Homo sapiens
guucaguuuugaaauguuaauu

SEQ ID NO: 307905 - RNA, 22 nt, Homo sapiens
guuggcuguuucccccaaguga

SEQ ID NO: 307906 - RNA, 22 nt, Homo sapiens
guuuggauauuaggcaagagua

SEQ ID NO: 307907 - RNA, 18 nt, Homo sapiens
uaaaggcacuguguuguu

SEQ ID NO: 307908 - RNA, 22 nt, Homo sapiens
uaacaguguauuuacuacuucc

SEQ ID NO: 307909 - RNA, 22 nt, Homo sapiens
uaacccuuacaacuacacucgu

SEQ ID NO: 307910 - RNA, 22 nt, Homo sapiens
uaagcagugcaagaauggaaua

SEQ ID NO: 307911 - RNA, 22 nt, Homo sapiens
uaaggcacccuucugaguagag

SEQ ID NO: 307912 - RNA, 22 nt, Homo sapiens
uaagggcacuaaucccauuuau

SEQ ID NO: 307913 - RNA, 22 nt, Homo sapiens
uaagguuacaaaggacuucaua

SEQ ID NO: 307914 - RNA, 22 nt, Homo sapiens
uaagugcaacauaaguguuaaa

SEQ ID NO: 307915 - RNA, 22 nt, Homo sapiens
uaaguguaaugucugaaguuug

SEQ ID NO: 307916 - RNA, 19 nt, Homo sapiens
uacaggacugagcugaggu

SEQ ID NO: 307917 - RNA, 22 nt, Homo sapiens
uacagugcauagaggcaugaua

SEQ ID NO: 307918 - RNA, 22 nt, Homo sapiens
uacagugcuugguaucuaguaa

SEQ ID NO: 307919 - RNA, 22 nt, Homo sapiens
uacauacuguaugguucuguuu

SEQ ID NO: 307920 - RNA, 22 nt, Homo sapiens
uacugcugucagugccaaguag

SEQ ID NO: 307921 - RNA, 22 nt, Homo sapiens
uacugguuuuauauauuucucc

SEQ ID NO: 307922 - RNA, 22 nt, Homo sapiens
uagaauguaaauuccaagggca

SEQ ID NO: 307923 - RNA, 22 nt, Homo sapiens
uagaauguaacaguuaaaagca

SEQ ID NO: 307924 - RNA, 22 nt, Homo sapiens
uagaauguauaauauuuuacuu

SEQ ID NO: 307925 - RNA, 22 nt, Homo sapiens
uagacccauuacguaguuucca

SEQ ID NO: 307926 - RNA, 22 nt, Homo sapiens
uagagguagagugacuucccca

SEQ ID NO: 307927 - RNA, 22 nt, Homo sapiens
uagagguagccuacuacacacc

SEQ ID NO: 307928 - RNA, 22 nt, Homo sapiens
uagagguauaccaaaaaggcau

SEQ ID NO: 307929 - RNA, 22 nt, Homo sapiens
uaggguaguaauaguuguuuca

SEQ ID NO: 307930 - RNA, 22 nt, Homo sapiens
uagguacuuaagaucucagcua

SEQ ID NO: 307931 - RNA, 22 nt, Homo sapiens
uaggugaaugcuggaagaaaug

SEQ ID NO: 307932 - RNA, 22 nt, Homo sapiens
uagugcuguaauucuaaugaaa

SEQ ID NO: 307933 - RNA, 22 nt, Homo sapiens
uagugcugugauaaacauauau

SEQ ID NO: 307934 - RNA, 22 nt, Homo sapiens
uauaugucuuuguuauguugag

SEQ ID NO: 307935 - RNA, 21 nt, Homo sapiens
uaucccagucacaucuaccca

SEQ ID NO: 307936 - RNA, 22 nt, Homo sapiens
uauccuguagcucauccaccgc

SEQ ID NO: 307937 - RNA, 22 nt, Homo sapiens
uaucugcacauacacuuauagc

SEQ ID NO: 307938 - RNA, 20 nt, Homo sapiens
uaugaaacaguguagagcaa

SEQ ID NO: 307939 - RNA, 22 nt, Homo sapiens
uaugaggaguauaacccgguga

SEQ ID NO: 307940 - RNA, 22 nt, Homo sapiens
uaugcacaugcaugcuugaaua

SEQ ID NO: 307941 - RNA, 22 nt, Homo sapiens
uauggauguuaagguucacagc

SEQ ID NO: 307942 - RNA, 22 nt, Homo sapiens
uaugugcaaauuaauugcuaga

SEQ ID NO: 307943 - RNA, 22 nt, Homo sapiens
uauuucccuuaacuuuccugca

SEQ ID NO: 307944 - RNA, 22 nt, Homo sapiens
ucaagcaauucgccugucucag

SEQ ID NO: 307945 - RNA, 22 nt, Homo sapiens
ucaauguaucuccaagaauuga

SEQ ID NO: 307946 - RNA, 18 nt, Homo sapiens
ucacaaccacagugcugu

SEQ ID NO: 307947 - RNA, 22 nt, Homo sapiens
ucacagaggagaagaccuuuaa

SEQ ID NO: 307948 - RNA, 22 nt, Homo sapiens
ucacagauaaauaaagaugauu

SEQ ID NO: 307949 - RNA, 22 nt, Homo sapiens
ucaccaccuuccaggaccacug

SEQ ID NO: 307950 - RNA, 19 nt, Homo sapiens
ucaccaguacacaauacaa

SEQ ID NO: 307951 - RNA, 22 nt, Homo sapiens
ucaccuggggcacagcugaaga

SEQ ID NO: 307952 - RNA, 19 nt, Homo sapiens
ucacuggacagcacacuca

SEQ ID NO: 307953 - RNA, 22 nt, Homo sapiens
ucacugugguuggaaggcuuaa

SEQ ID NO: 307954 - RNA, 22 nt, Homo sapiens
ucagaguagaaacacuuccaua

SEQ ID NO: 307955 - RNA, 22 nt, Homo sapiens
ucagaguagcugucugaggugc

SEQ ID NO: 307956 - RNA, 22 nt, Homo sapiens
ucagaucacuggcgcuggcgga

SEQ ID NO: 307957 - RNA, 22 nt, Homo sapiens
ucagcaucacaggcagugagug

SEQ ID NO: 307958 - RNA, 22 nt, Homo sapiens
ucagguagcauuuuggaaacag

SEQ ID NO: 307959 - RNA, 22 nt, Homo sapiens
ucagugaauauauaacagcgau

SEQ ID NO: 307960 - RNA, 22 nt, Homo sapiens
ucagugauugcuuucauggaaa

SEQ ID NO: 307961 - RNA, 22 nt, Homo sapiens
ucagugcuuuuuguugucauca

SEQ ID NO: 307962 - RNA, 19 nt, Homo sapiens
ucauggcuuuuucagcugu

SEQ ID NO: 307963 - RNA, 22 nt, Homo sapiens
ucauucacucccuugaaguuag

SEQ ID NO: 307964 - RNA, 22 nt, Homo sapiens
guccaaagugggagaggugggg

SEQ ID NO: 307965 - RNA, 20 nt, Homo sapiens
guccauuugcugccauugcu

SEQ ID NO: 307966 - RNA, 22 nt, Homo sapiens
guccauuuguuuccagagcacu

SEQ ID NO: 307967 - RNA, 22 nt, Homo sapiens
gucugguacuuguuuguaaggg

SEQ ID NO: 307968 - RNA, 22 nt, Homo sapiens
gucuuagguuuaaucacuucua

SEQ ID NO: 307969 - RNA, 22 nt, Homo sapiens
gugagauaaugucucauugugg

SEQ ID NO: 307970 - RNA, 22 nt, Homo sapiens
gugagauaucuagacuagggaa

SEQ ID NO: 307971 - RNA, 22 nt, Homo sapiens
gugagguaauuagcucccuuag

SEQ ID NO: 307972 - RNA, 22 nt, Homo sapiens
gugagguguuaaccaaccugug

SEQ ID NO: 307973 - RNA, 22 nt, Homo sapiens
gugcacaacaugcagguuuguu

SEQ ID NO: 307974 - RNA, 22 nt, Homo sapiens
gugcacaacaugcaguuuuguu

SEQ ID NO: 307975 - RNA, 22 nt, Homo sapiens
gugcacaacguguagguuuguu

SEQ ID NO: 307976 - RNA, 22 nt, Homo sapiens
gugcacaaucgugcauuccuug

SEQ ID NO: 307977 - RNA, 22 nt, Homo sapiens
gugcaguuugaaaguagaaaca

SEQ ID NO: 307978 - RNA, 23 nt, Homo sapiens
gugcaugagucuuuauaguagca

SEQ ID NO: 307979 - RNA, 22 nt, Homo sapiens
guggagucaucacucagagugg

SEQ ID NO: 307980 - RNA, 22 nt, Homo sapiens
ucuggccuacaaguaauuuuau

SEQ ID NO: 307981 - RNA, 22 nt, Homo sapiens
ucugguuccugcauucauucaa

SEQ ID NO: 307982 - RNA, 22 nt, Homo sapiens
ucugguuccuuggcuucggguc

SEQ ID NO: 307983 - RNA, 22 nt, Homo sapiens
ucugucuugugguuugagugcc

SEQ ID NO: 307984 - RNA, 18 nt, Homo sapiens
ucugugguguaaauacgu

SEQ ID NO: 307985 - RNA, 22 nt, Homo sapiens
ugaaaguuauauugugaaauuc

SEQ ID NO: 307986 - RNA, 22 nt, Homo sapiens
ugaauugucucucacuggguuc

SEQ ID NO: 307987 - RNA, 22 nt, Homo sapiens
ugacagagaagcauugaguuca

SEQ ID NO: 307988 - RNA, 22 nt, Homo sapiens
ugacagagcaggacuucaucuc

SEQ ID NO: 307989 - RNA, 22 nt, Homo sapiens
ugacugugcagcuccaucaggg

SEQ ID NO: 307990 - RNA, 22 nt, Homo sapiens
ugagaaugacugggcaugcugc

SEQ ID NO: 307991 - RNA, 22 nt, Homo sapiens
ugagaggugaauggcaggcuca

SEQ ID NO: 307992 - RNA, 21 nt, Homo sapiens
ugagaguaguguauuauucuc

SEQ ID NO: 307993 - RNA, 22 nt, Homo sapiens
ugagauaacuaaaaacauuuug

SEQ ID NO: 307994 - RNA, 22 nt, Homo sapiens
ugagauaaucaugugauuucau

SEQ ID NO: 307995 - RNA, 22 nt, Homo sapiens
ugagauaaugcaugugaagauc

SEQ ID NO: 307996 - RNA, 22 nt, Homo sapiens
ugagaucacgccacugcacucc

SEQ ID NO: 307997 - RNA, 18 nt, Homo sapiens
ugagaucagcaucaaggg

SEQ ID NO: 307998 - RNA, 18 nt, Homo sapiens
uuugugcuccacaaagga

SEQ ID NO: 307999 - RNA, 22 nt, Homo sapiens
uuugugcuccuguugagaaucu

SEQ ID NO: 308000 - RNA, 22 nt, Homo sapiens
uuuugcacuguuuuaucugaca

SEQ ID NO: 308001 - RNA, 21 nt, Homo sapiens
uuuugugcaugugcagccugc

SEQ ID NO: 308002 - RNA, 23 nt, Homo sapiens
cccaguuaauccuuaaucuccac

SEQ ID NO: 308003 - RNA, 22 nt, Homo sapiens
cccugagcagccugaguuuccc

SEQ ID NO: 308004 - RNA, 22 nt, Homo sapiens
ccuuggcacuacugacauugua

SEQ ID NO: 308005 - RNA, 22 nt, Homo sapiens
cuaaagauagugacaugauuug

SEQ ID NO: 308006 - RNA, 22 nt, Homo sapiens
cuaauccugugguagcacucaa

SEQ ID NO: 308007 - RNA, 22 nt, Homo sapiens
cuacaguagagaggauguagaa

SEQ ID NO: 308008 - RNA, 22 nt, Homo sapiens
cuacaguaugaaaccuuuacuc

SEQ ID NO: 308009 - RNA, 22 nt, Homo sapiens
cuauggcuguaaggauaguaac

SEQ ID NO: 308010 - RNA, 22 nt, Homo sapiens
cuauggcuguaugacgugcaug

SEQ ID NO: 308011 - RNA, 22 nt, Homo sapiens
cuauuacuuuuauugaacucag

SEQ ID NO: 308012 - RNA, 22 nt, Homo sapiens
cucaccuugugauccacccacc

SEQ ID NO: 308013 - RNA, 22 nt, Homo sapiens
cuccaguacagagagguuccuc

SEQ ID NO: 308014 - RNA, 22 nt, Homo sapiens
cuccauuuaucugaaauuuuau

SEQ ID NO: 308015 - RNA, 22 nt, Homo sapiens
cuccauuuggaacagauguccu

SEQ ID NO: 308016 - RNA, 22 nt, Homo sapiens
cucugguuuuucuuccauuaag

SEQ ID NO: 308017 - RNA, 22 nt, Homo sapiens
cugaaucauugcauuaucaagg

SEQ ID NO: 308018 - RNA, 22 nt, Homo sapiens
cugacagaugacugccacugua

SEQ ID NO: 308019 - RNA, 22 nt, Homo sapiens
cugaccucugucaaagacaccc

SEQ ID NO: 308020 - RNA, 22 nt, Homo sapiens
cugagauaauuucuagguguca

SEQ ID NO: 308021 - RNA, 22 nt, Homo sapiens
cugaggacaucagggaagcauc

SEQ ID NO: 308022 - RNA, 22 nt, Homo sapiens
cugaucuggaggugucugggga

SEQ ID NO: 308023 - RNA, 19 nt, Homo sapiens
cuggcaaaugcuuuggcca

SEQ ID NO: 308024 - RNA, 22 nt, Homo sapiens
cuggcccaguucugcguuuugc

SEQ ID NO: 308025 - RNA, 22 nt, Homo sapiens
cuguaaaguaagagguaaguua

SEQ ID NO: 308026 - RNA, 22 nt, Homo sapiens
cugucacugggaggggcagcag

SEQ ID NO: 308027 - RNA, 22 nt, Homo sapiens
cugugcaaagcgcucucggggu

SEQ ID NO: 308028 - RNA, 22 nt, Homo sapiens
cuguuugguuaucuuuuccugu

SEQ ID NO: 308029 - RNA, 22 nt, Homo sapiens
cuucaucugguuugugaacuuu

SEQ ID NO: 308030 - RNA, 22 nt, Homo sapiens
cuuuggagaaaaguucuugggc

SEQ ID NO: 308031 - RNA, 22 nt, Homo sapiens
cuuuggauggaaccucucuuuc

SEQ ID NO: 308032 - RNA, 22 nt, Homo sapiens
cuuuguguggacauuucaggca

SEQ ID NO: 308033 - RNA, 22 nt, Homo sapiens
cuuuuacacuguuagugggaau

SEQ ID NO: 308034 - RNA, 22 nt, Homo sapiens
gaaaacugcuucucuggguuuc

SEQ ID NO: 308035 - RNA, 18 nt, Homo sapiens
gaagaaguaggcauggca

SEQ ID NO: 308036 - RNA, 22 nt, Homo sapiens
gacacugucuucugcucuuaaa

SEQ ID NO: 308037 - RNA, 22 nt, Homo sapiens
gacauuaucagguuuguuuucu

SEQ ID NO: 308038 - RNA, 22 nt, Homo sapiens
gaccuggugguccacccgccuu

SEQ ID NO: 308039 - RNA, 22 nt, Homo sapiens
gagacugagucucgcucugccg

SEQ ID NO: 308040 - RNA, 22 nt, Homo sapiens
gagauaauuugaaucauggggg

SEQ ID NO: 308041 - RNA, 22 nt, Homo sapiens
gagauacacccagugcagaggc

SEQ ID NO: 308042 - RNA, 22 nt, Homo sapiens
gagauguagucuugcccuguca

SEQ ID NO: 308043 - RNA, 22 nt, Homo sapiens
gagaugugguucaaggguguuu

SEQ ID NO: 308044 - RNA, 22 nt, Homo sapiens
gagguaagaugauucguguccu

SEQ ID NO: 308045 - RNA, 22 nt, Homo sapiens
gaguucaaaucucagcucuguu

SEQ ID NO: 308046 - RNA, 22 nt, Homo sapiens
gauauguaaaaauuauaucuga

SEQ ID NO: 308047 - RNA, 22 nt, Homo sapiens
gaucugagaaagugucauaaca

SEQ ID NO: 308048 - RNA, 22 nt, Homo sapiens
gaugacagugaguaaccccaac

SEQ ID NO: 308049 - RNA, 22 nt, Homo sapiens
gcaaaugcuaugccauuuuaua

SEQ ID NO: 308050 - RNA, 20 nt, Homo sapiens
gcaacauggccagagugaau

SEQ ID NO: 308051 - RNA, 22 nt, Homo sapiens
gcagagaaacaggucuaaggag

SEQ ID NO: 308052 - RNA, 22 nt, Homo sapiens
gcagcaucaaaucacacaagau

SEQ ID NO: 308053 - RNA, 20 nt, Homo sapiens
gcauaugucuuuauagcaga

SEQ ID NO: 308054 - RNA, 22 nt, Homo sapiens
ggaaagacuauuguaaaggaug

SEQ ID NO: 308055 - RNA, 22 nt, Homo sapiens
ggaaggucaaagggaaagcaga

SEQ ID NO: 308056 - RNA, 22 nt, Homo sapiens
ggagauaauccagggagggacu

SEQ ID NO: 308057 - RNA, 22 nt, Homo sapiens
ggcaaaugaagauggagaggcu

SEQ ID NO: 308058 - RNA, 22 nt, Homo sapiens
ggcaagaaccacaauuacuuuu

SEQ ID NO: 308059 - RNA, 22 nt, Homo sapiens
ggcaaggauuagauucuccccu

SEQ ID NO: 308060 - RNA, 22 nt, Homo sapiens
ggcaccacagacgccaggcgug

SEQ ID NO: 308061 - RNA, 22 nt, Homo sapiens
ggccagaugcgguggcucacac

SEQ ID NO: 308062 - RNA, 22 nt, Homo sapiens
ggcuagauauucacauauggcu

SEQ ID NO: 308063 - RNA, 22 nt, Homo sapiens
ggcucagugggguccugguucu

SEQ ID NO: 308064 - RNA, 22 nt, Homo sapiens
gggaggucauuguaaggucuua

SEQ ID NO: 308065 - RNA, 22 nt, Homo sapiens
gggcaugauggugcacacaugu

SEQ ID NO: 308066 - RNA, 22 nt, Homo sapiens
gggcaugaugucuuaugccuau

SEQ ID NO: 308067 - RNA, 22 nt, Homo sapiens
gguaaguuuggggcuaauuugu

SEQ ID NO: 308068 - RNA, 19 nt, Homo sapiens
ggucacagggguuacaagg

SEQ ID NO: 308069 - RNA, 22 nt, Homo sapiens
ggugacagugguuaaaauuugu

SEQ ID NO: 308070 - RNA, 22 nt, Homo sapiens
guaacacaugcugcucucuggu

SEQ ID NO: 308071 - RNA, 22 nt, Homo sapiens
guacaguacugaaugaauguau

SEQ ID NO: 308072 - RNA, 22 nt, Homo sapiens
guacaguuuucaguguucacug

SEQ ID NO: 308073 - RNA, 18 nt, Homo sapiens
guaggucaguaccaagca

SEQ ID NO: 308074 - RNA, 22 nt, Homo sapiens
guaugauacuguaacagugggu

SEQ ID NO: 308075 - RNA, 22 nt, Homo sapiens
gucaaagugauuguaauuaggu

SEQ ID NO: 308076 - RNA, 22 nt, Homo sapiens
gucacagaaaaagauaugccaa

SEQ ID NO: 308077 - RNA, 22 nt, Homo sapiens
gucauggacaaggugugagcca

SEQ ID NO: 308078 - RNA, 22 nt, Homo sapiens
auuccauagugucuguggcaga

SEQ ID NO: 308079 - RNA, 22 nt, Homo sapiens
auucuauaguccuaggauuggg

SEQ ID NO: 308080 - RNA, 23 nt, Homo sapiens
auugauagugccuuugugcuaau

SEQ ID NO: 308081 - RNA, 22 nt, Homo sapiens
auuguaguuugcuauggcaaua

SEQ ID NO: 308082 - RNA, 22 nt, Homo sapiens
caaagucuucaguugauucuga

SEQ ID NO: 308083 - RNA, 22 nt, Homo sapiens
caaagugcugaaagaggccagg

SEQ ID NO: 308084 - RNA, 22 nt, Homo sapiens
caaagugcugggaugggccagg

SEQ ID NO: 308085 - RNA, 22 nt, Homo sapiens
caacagucagcccauccacaga

SEQ ID NO: 308086 - RNA, 22 nt, Homo sapiens
caaggaauucucaauagaguua

SEQ ID NO: 308087 - RNA, 22 nt, Homo sapiens
caagugcucuaggauccugagu

SEQ ID NO: 308088 - RNA, 22 nt, Homo sapiens
caagugcuugaugaaugaucaa

SEQ ID NO: 308089 - RNA, 21 nt, Homo sapiens
caauggcacaaucucugcuca

SEQ ID NO: 308090 - RNA, 22 nt, Homo sapiens
cacaggucauccuggaucaagg

SEQ ID NO: 308091 - RNA, 22 nt, Homo sapiens
cacauugaauuucugaugacaa

SEQ ID NO: 308092 - RNA, 22 nt, Homo sapiens
caccacuacaccccaggcuggg

SEQ ID NO: 308093 - RNA, 22 nt, Homo sapiens
cagagguauugcaaaagccuag

SEQ ID NO: 308094 - RNA, 22 nt, Homo sapiens
cagagugcauguuuagaugagu

SEQ ID NO: 308095 - RNA, 22 nt, Homo sapiens
cagauggucuuaaggcagccuu

SEQ ID NO: 308096 - RNA, 22 nt, Homo sapiens
cagggcaugugggucuauuggc

SEQ ID NO: 308097 - RNA, 18 nt, Homo sapiens
cauagcacuucagcacau

SEQ ID NO: 308098 - RNA, 22 nt, Homo sapiens
cauggcuuguauaagauucuca

SEQ ID NO: 308099 - RNA, 22 nt, Homo sapiens
caugugcaugcuuucuuaugug

SEQ ID NO: 308100 - RNA, 22 nt, Homo sapiens
cauugcacuccagucugggcaa

SEQ ID NO: 308101 - RNA, 22 nt, Homo sapiens
cauugguuccaguuuguccuua

SEQ ID NO: 308102 - RNA, 22 nt, Homo sapiens
cauuuuacuuuccagacgugga

SEQ ID NO: 308103 - RNA, 22 nt, Homo sapiens
ccacauuggaaaggaucccccc

SEQ ID NO: 308104 - RNA, 22 nt, Homo sapiens
ccagaguggagccuuugcgagg

SEQ ID NO: 308105 - RNA, 22 nt, Homo sapiens
ccagauguuuucauucagcaag

SEQ ID NO: 308106 - RNA, 22 nt, Homo sapiens
ccauugaacaugaaggaaugug

SEQ ID NO: 308107 - RNA, 20 nt, Homo sapiens
ccccuggaguggggcugcuu

SEQ ID NO: 308108 - RNA, 22 nt, Homo sapiens
ccucacaaccuuuauugaagag

SEQ ID NO: 308109 - RNA, 22 nt, Homo sapiens
ccugaugacacgggagauguac

SEQ ID NO: 308110 - RNA, 21 nt, Homo sapiens
ccugaugaccucugagaguua

SEQ ID NO: 308111 - RNA, 22 nt, Homo sapiens
ccuggcaagagacugaagauag

SEQ ID NO: 308112 - RNA, 22 nt, Homo sapiens
cuaaagugcugagauuauaggu

SEQ ID NO: 308113 - RNA, 22 nt, Homo sapiens
cuaacacagggcaagucaggcu

SEQ ID NO: 308114 - RNA, 22 nt, Homo sapiens
cuaugagucugcagaucuauua

SEQ ID NO: 308115 - RNA, 22 nt, Homo sapiens
cucaaagugcuaagauuaggcu

SEQ ID NO: 308116 - RNA, 19 nt, Homo sapiens
cucaaagugguauuuggag

SEQ ID NO: 308117 - RNA, 20 nt, Homo sapiens
cucacagacagcuucuuucu

SEQ ID NO: 308118 - RNA, 22 nt, Homo sapiens
cucacggcccugcgcacuggca

SEQ ID NO: 308119 - RNA, 22 nt, Homo sapiens
cuccauuuaguccuuuuagaag

SEQ ID NO: 308120 - RNA, 22 nt, Homo sapiens
cugagaagaaacagguaaggac

SEQ ID NO: 308121 - RNA, 22 nt, Homo sapiens
cugauaguucucuuuagaguuu

SEQ ID NO: 308122 - RNA, 22 nt, Homo sapiens
cugccuagaucugaaccuggcu

SEQ ID NO: 308123 - RNA, 22 nt, Homo sapiens
cugcuggucuuuaaggucuagg

SEQ ID NO: 308124 - RNA, 22 nt, Homo sapiens
cuggaaggaaaaacaaccacag

SEQ ID NO: 308125 - RNA, 22 nt, Homo sapiens
cugggauggaggagaauuagag

SEQ ID NO: 308126 - RNA, 22 nt, Homo sapiens
cugggaugugacuguugccccc

SEQ ID NO: 308127 - RNA, 22 nt, Homo sapiens
cugggcaaugcggcuggauaga

SEQ ID NO: 308128 - RNA, 22 nt, Homo sapiens
cugguuuguaaaguuccugaga

SEQ ID NO: 308129 - RNA, 22 nt, Homo sapiens
cuguaaagaucacagagcuggu

SEQ ID NO: 308130 - RNA, 22 nt, Homo sapiens
cugugcauggauuuuaagauug

SEQ ID NO: 308131 - RNA, 19 nt, Homo sapiens
cugugcauuucuguggaag

SEQ ID NO: 308132 - RNA, 22 nt, Homo sapiens
cugugguugagcuuugccauga

SEQ ID NO: 308133 - RNA, 22 nt, Homo sapiens
cuugagcauauucuauauuaaa

SEQ ID NO: 308134 - RNA, 22 nt, Homo sapiens
cuuuagcaauugauuaugccau

SEQ ID NO: 308135 - RNA, 22 nt, Homo sapiens
cuuugguggagucuuuagguuc

SEQ ID NO: 308136 - RNA, 21 nt, Homo sapiens
cuuugguuucugacuugcaua

SEQ ID NO: 308137 - RNA, 22 nt, Homo sapiens
cuuuuacacugguggugggaau

SEQ ID NO: 308138 - RNA, 22 nt, Homo sapiens
cuuuuacacuguuggugggaau

SEQ ID NO: 308139 - RNA, 22 nt, Homo sapiens
gaaagguaggaacagggugcag

SEQ ID NO: 308140 - RNA, 22 nt, Homo sapiens
gaaagugcugcuugacugggau

SEQ ID NO: 308141 - RNA, 22 nt, Homo sapiens
gaacuuguguugcuucacaugu

SEQ ID NO: 308142 - RNA, 22 nt, Homo sapiens
gaaucacagauuaugaguaucu

SEQ ID NO: 308143 - RNA, 22 nt, Homo sapiens
gaaucacaguuauuagagcagc

SEQ ID NO: 308144 - RNA, 22 nt, Homo sapiens
gaaugauacuguuaacgaaaga

SEQ ID NO: 308145 - RNA, 22 nt, Homo sapiens
gacagacacaauugauccauga

SEQ ID NO: 308146 - RNA, 22 nt, Homo sapiens
gacuggccauugauacagaggu

SEQ ID NO: 308147 - RNA, 22 nt, Homo sapiens
gagauaauagcuauaggaucuu

SEQ ID NO: 308148 - RNA, 22 nt, Homo sapiens
gagauuauuuaaaaggugauuu

SEQ ID NO: 308149 - RNA, 22 nt, Homo sapiens
gagcacugaauacugugguggu

SEQ ID NO: 308150 - RNA, 22 nt, Homo sapiens
gagccuguaggaggagaggugg

SEQ ID NO: 308151 - RNA, 22 nt, Homo sapiens
gagcugguccuuuaaggaugca

SEQ ID NO: 308152 - RNA, 22 nt, Homo sapiens
gagguagguacaauugccacca

SEQ ID NO: 308153 - RNA, 22 nt, Homo sapiens
gaguucaauuuccagcuguucu

SEQ ID NO: 308154 - RNA, 19 nt, Homo sapiens
gauaucuagggggagguuc

SEQ ID NO: 308155 - RNA, 21 nt, Homo sapiens
gauaucuuuauucccaagagc

SEQ ID NO: 308156 - RNA, 22 nt, Homo sapiens
gauaucuuuuguauggugagcu

SEQ ID NO: 308157 - RNA, 22 nt, Homo sapiens
gaugagauguucucauggauug

SEQ ID NO: 308158 - RNA, 22 nt, Homo sapiens
gaugcaguaagaaugcauagcg

SEQ ID NO: 308159 - RNA, 22 nt, Homo sapiens
gcaagaaucugggaguaaaauu

SEQ ID NO: 308160 - RNA, 22 nt, Homo sapiens
gcaagaaugagaaggauuaauu

SEQ ID NO: 308161 - RNA, 19 nt, Homo sapiens
gcagagaugugguagcuug

SEQ ID NO: 308162 - RNA, 22 nt, Homo sapiens
gcagaucuucgcgguaaguguu

SEQ ID NO: 308163 - RNA, 22 nt, Homo sapiens
gcaggcaugacauuucacucuu

SEQ ID NO: 308164 - RNA, 22 nt, Homo sapiens
gccaagauuuaauucaucaguu

SEQ ID NO: 308165 - RNA, 19 nt, Homo sapiens
gcggcacuggagacacagc

SEQ ID NO: 308166 - RNA, 22 nt, Homo sapiens
gcucugguuacaaaggcaaauu

SEQ ID NO: 308167 - RNA, 22 nt, Homo sapiens
gcugcuuuugaugacaaaaaca

SEQ ID NO: 308168 - RNA, 22 nt, Homo sapiens
ggacaaaguauuuucaaaugua

SEQ ID NO: 308169 - RNA, 22 nt, Homo sapiens
uucacagacaacuggucccuua

SEQ ID NO: 308170 - RNA, 22 nt, Homo sapiens
uucaccuguagcaugcccuugg

SEQ ID NO: 308171 - RNA, 22 nt, Homo sapiens
uucaguggacuuaguagugcuu

SEQ ID NO: 308172 - RNA, 18 nt, Homo sapiens
uucaguuuguaucugggg

SEQ ID NO: 308173 - RNA, 22 nt, Homo sapiens
uucccguugcugugcuccugcc

SEQ ID NO: 308174 - RNA, 22 nt, Homo sapiens
uucccuuucuuaaagaguuagg

SEQ ID NO: 308175 - RNA, 22 nt, Homo sapiens
uucccuuuguuaaauuggaaga

SEQ ID NO: 308176 - RNA, 22 nt, Homo sapiens
uucucagugaaguuuagaacau

SEQ ID NO: 308177 - RNA, 22 nt, Homo sapiens
uugaaagucauuucuucuaagu

SEQ ID NO: 308178 - RNA, 22 nt, Homo sapiens
uugaagugaagaacaauaucac

SEQ ID NO: 308179 - RNA, 21 nt, Homo sapiens
uugagaagaauuagcucuucc

SEQ ID NO: 308180 - RNA, 22 nt, Homo sapiens
uugagauaggagcuguuguucu

SEQ ID NO: 308181 - RNA, 22 nt, Homo sapiens
uugaguuuaucuaaagaccugg

SEQ ID NO: 308182 - RNA, 22 nt, Homo sapiens
uugauaguccuguaucuauuuu

SEQ ID NO: 308183 - RNA, 22 nt, Homo sapiens
uugcagcaacauggaugaaacu

SEQ ID NO: 308184 - RNA, 22 nt, Homo sapiens
uugcaugggagcugggugaagc

SEQ ID NO: 308185 - RNA, 22 nt, Homo sapiens
uugcaugguggaacuuggagcu

SEQ ID NO: 308186 - RNA, 22 nt, Homo sapiens
uugccuaguuuaggucugugcu

SEQ ID NO: 308187 - RNA, 22 nt, Homo sapiens
uuggaagacauucugucugcua

SEQ ID NO: 308188 - RNA, 22 nt, Homo sapiens
uuggacagaugguuacauuuuu

SEQ ID NO: 308189 - RNA, 22 nt, Homo sapiens
uuggcaacauagugagaccccc

SEQ ID NO: 308190 - RNA, 22 nt, Homo sapiens
uugggacuggaaggaguaaggg

SEQ ID NO: 308191 - RNA, 22 nt, Homo sapiens
uugggguagaauugcaacauau

SEQ ID NO: 308192 - RNA, 22 nt, Homo sapiens
uugguucucuuagccaucuuaa

SEQ ID NO: 308193 - RNA, 22 nt, Homo sapiens
uuguauacucuauuuuagcagu

SEQ ID NO: 308194 - RNA, 22 nt, Homo sapiens
uugugcaugaugcauacauggu

SEQ ID NO: 308195 - RNA, 22 nt, Homo sapiens
uugugcuuuugagcugagauga

SEQ ID NO: 308196 - RNA, 22 nt, Homo sapiens
uuuaauguuacaguauugguau

SEQ ID NO: 308197 - RNA, 22 nt, Homo sapiens
uuuacaguuuucuaggcuacca

SEQ ID NO: 308198 - RNA, 22 nt, Homo sapiens
uuucauggaauauagucauuuu

SEQ ID NO: 308199 - RNA, 17 nt, Homo sapiens
uuucucagcccucuucu

SEQ ID NO: 308200 - RNA, 22 nt, Homo sapiens
uuucucaguguuucaggguagg

SEQ ID NO: 308201 - RNA, 22 nt, Homo sapiens
uuucugcuugagagaauugcug

SEQ ID NO: 308202 - RNA, 22 nt, Homo sapiens
uuucugggggugcugauggaaa

SEQ ID NO: 308203 - RNA, 22 nt, Homo sapiens
uuugaaaguaauuugguuggug

SEQ ID NO: 308204 - RNA, 22 nt, Homo sapiens
uuugaauggaaguuuugugaaa

SEQ ID NO: 308205 - RNA, 21 nt, Homo sapiens
uuugaucauuaaaagugaauc

SEQ ID NO: 308206 - RNA, 22 nt, Homo sapiens
uuugaugcaucucuacuuuguu

SEQ ID NO: 308207 - RNA, 22 nt, Homo sapiens
uuugauuguacuaaaauuguac

SEQ ID NO: 308208 - RNA, 18 nt, Homo sapiens
uuuggcuguucaugacuc

SEQ ID NO: 308209 - RNA, 22 nt, Homo sapiens
uuugguuuuuguuaucacucau

SEQ ID NO: 308210 - RNA, 23 nt, Homo sapiens
uuuguaguagcaugauuuauaau

SEQ ID NO: 308211 - RNA, 22 nt, Homo sapiens
uuugugcuaaugcuagauuacu

SEQ ID NO: 308212 - RNA, 22 nt, Homo sapiens
uuuguggaaugcucauguguag

SEQ ID NO: 308213 - RNA, 22 nt, Homo sapiens
uuugugucccucuaaaauuuau

SEQ ID NO: 308214 - RNA, 22 nt, Homo sapiens
uuuugugcauggcccaguggua

SEQ ID NO: 308215 - RNA, 22 nt, Homo sapiens
uuuuuugcuguaugcaaacauc

SEQ ID NO: 308216 - RNA, 23 nt, Homo sapiens
ugagaucuacagaucucagaucu

SEQ ID NO: 308217 - RNA, 22 nt, Homo sapiens
ugagaucuuugcuguccucacc

SEQ ID NO: 308218 - RNA, 22 nt, Homo sapiens
ugagaugaagucuugcucuguu

SEQ ID NO: 308219 - RNA, 22 nt, Homo sapiens
ugagaugagucucgcucuguca

SEQ ID NO: 308220 - RNA, 22 nt, Homo sapiens
ugagauggaguuucgcuuuugu

SEQ ID NO: 308221 - RNA, 22 nt, Homo sapiens
ugagguaaaacaaggauuggau

SEQ ID NO: 308222 - RNA, 22 nt, Homo sapiens
ugagguaacagaagcgagcauu

SEQ ID NO: 308223 - RNA, 22 nt, Homo sapiens
ugagguaauagauaauauuuuu

SEQ ID NO: 308224 - RNA, 22 nt, Homo sapiens
ugaggugagggguuaggugcua

SEQ ID NO: 308225 - RNA, 22 nt, Homo sapiens
ugaguuaauuuuuguaucaugu

SEQ ID NO: 308226 - RNA, 22 nt, Homo sapiens
ugaguuagguaauaauaaauau

SEQ ID NO: 308227 - RNA, 22 nt, Homo sapiens
ugaguuguugcauucuuggugu

SEQ ID NO: 308228 - RNA, 22 nt, Homo sapiens
ugcaaaugucaaggguuagugu

SEQ ID NO: 308229 - RNA, 19 nt, Homo sapiens
ugcagcaauguaaaagaca

SEQ ID NO: 308230 - RNA, 22 nt, Homo sapiens
ugcagcucaaauuccuaacaag

SEQ ID NO: 308231 - RNA, 22 nt, Homo sapiens
ugcagcucagcugcggaguuuu

SEQ ID NO: 308232 - RNA, 22 nt, Homo sapiens
ugcauguucuuacucauacaug

SEQ ID NO: 308233 - RNA, 22 nt, Homo sapiens
ugcauuguuuagaaacacuggg

SEQ ID NO: 308234 - RNA, 22 nt, Homo sapiens
ugccuagucuauugagagucuu

SEQ ID NO: 308235 - RNA, 22 nt, Homo sapiens
uggacuagagggugggcgaggu

SEQ ID NO: 308236 - RNA, 22 nt, Homo sapiens
uggcagauagaaaugugguuaa

SEQ ID NO: 308237 - RNA, 22 nt, Homo sapiens
uggcagaugagccgcgcuccaa

SEQ ID NO: 308238 - RNA, 22 nt, Homo sapiens
uggcaugauccuagauucaaca

SEQ ID NO: 308239 - RNA, 22 nt, Homo sapiens
uggcuguguccucucccaaauc

SEQ ID NO: 308240 - RNA, 20 nt, Homo sapiens
ugggaacaugugguauaugg

SEQ ID NO: 308241 - RNA, 22 nt, Homo sapiens
ugggcuagaugcuuugggguca

SEQ ID NO: 308242 - RNA, 22 nt, Homo sapiens
ugggugugaccgcucaaggggg

SEQ ID NO: 308243 - RNA, 22 nt, Homo sapiens
ugguccacuaacccucaguauc

SEQ ID NO: 308244 - RNA, 22 nt, Homo sapiens
uguaauuuaaaugauccuugga

SEQ ID NO: 308245 - RNA, 22 nt, Homo sapiens
uguagacagcacguaguugagu

SEQ ID NO: 308246 - RNA, 22 nt, Homo sapiens
uguagauaucuaucaggucaau

SEQ ID NO: 308247 - RNA, 22 nt, Homo sapiens
uguagcaaaucgauacuauugg

SEQ ID NO: 308248 - RNA, 22 nt, Homo sapiens
uguauacugucuaauauguugu

SEQ ID NO: 308249 - RNA, 22 nt, Homo sapiens
uguaugucugcucuuuggaacu

SEQ ID NO: 308250 - RNA, 22 nt, Homo sapiens
uguaugucuucuuuagauaagu

SEQ ID NO: 308251 - RNA, 21 nt, Homo sapiens
ugucaagaugacugcugcggc

SEQ ID NO: 308252 - RNA, 22 nt, Homo sapiens
ugucaagaugguuugauguugu

SEQ ID NO: 308253 - RNA, 22 nt, Homo sapiens
ugucaguguaugagccccggau

SEQ ID NO: 308254 - RNA, 22 nt, Homo sapiens
ugucauggucacaggcauuuca

SEQ ID NO: 308255 - RNA, 22 nt, Homo sapiens
uguccauuuuuaugcuuauggu

SEQ ID NO: 308256 - RNA, 22 nt, Homo sapiens
ugugacaguguuacauuucaug

SEQ ID NO: 308257 - RNA, 22 nt, Homo sapiens
ugugauugauuaaugugugcua

SEQ ID NO: 308258 - RNA, 22 nt, Homo sapiens
ugugccaaaucccauaauaaau

SEQ ID NO: 308259 - RNA, 22 nt, Homo sapiens
ugugccacugcacuucagccug

SEQ ID NO: 308260 - RNA, 22 nt, Homo sapiens
uguggaguguaugugacagaga

SEQ ID NO: 308261 - RNA, 22 nt, Homo sapiens
uguguaaauaugauagaggaau

SEQ ID NO: 308262 - RNA, 22 nt, Homo sapiens
uguugcauuugucaaggucaag

SEQ ID NO: 308263 - RNA, 22 nt, Homo sapiens
uuaaaugcauagaauguguagu

SEQ ID NO: 308264 - RNA, 22 nt, Homo sapiens
uuaagaugcauuuugaaguuaa

SEQ ID NO: 308265 - RNA, 22 nt, Homo sapiens
uuacuguauagaaucaucuuga

SEQ ID NO: 308266 - RNA, 22 nt, Homo sapiens
uuauucugucuuuggucucaau

SEQ ID NO: 308267 - RNA, 22 nt, Homo sapiens
uucaagucaaggaaagaggucu

SEQ ID NO: 308268 - RNA, 22 nt, Homo sapiens
uucacaaugccuuguugauggu

SEQ ID NO: 308269 - RNA, 22 nt, Homo sapiens
uucacaauuaaaugugguuauu

SEQ ID NO: 308270 - RNA, 22 nt, Homo sapiens
uucacagaaaaaggcgaugagg

SEQ ID NO: 308271 - RNA, 22 nt, Homo sapiens
uucagguacugggggaguaugg

SEQ ID NO: 308272 - RNA, 22 nt, Homo sapiens
uucagugguuauuugugagauu

SEQ ID NO: 308273 - RNA, 21 nt, Homo sapiens
uucauaugcacugagugccca

SEQ ID NO: 308274 - RNA, 22 nt, Homo sapiens
uuccaagugggaaacaaaaaug

SEQ ID NO: 308275 - RNA, 22 nt, Homo sapiens
uuccaugagaugcaucaaagcu

SEQ ID NO: 308276 - RNA, 22 nt, Homo sapiens
uuccauguaguugagcaguuuu

SEQ ID NO: 308277 - RNA, 22 nt, Homo sapiens
uucccucagaaacacacagccc

SEQ ID NO: 308278 - RNA, 22 nt, Homo sapiens
uucccuuucugccuugaaucuu

SEQ ID NO: 308279 - RNA, 22 nt, Homo sapiens
uucccuuugugcauaggauuug

SEQ ID NO: 308280 - RNA, 22 nt, Homo sapiens
uucucauggaacaucuguacug

SEQ ID NO: 308281 - RNA, 22 nt, Homo sapiens
uucugguuaauacuugcaaaaa

SEQ ID NO: 308282 - RNA, 22 nt, Homo sapiens
uugaacuguaagggucugugug

SEQ ID NO: 308283 - RNA, 22 nt, Homo sapiens
uugacagagaaaagugugacuu

SEQ ID NO: 308284 - RNA, 22 nt, Homo sapiens
uugagcccuggagguggaggcu

SEQ ID NO: 308285 - RNA, 22 nt, Homo sapiens
uugaggaggcagucuguccguu

SEQ ID NO: 308286 - RNA, 22 nt, Homo sapiens
uugauaguaccauugggaaauu

SEQ ID NO: 308287 - RNA, 22 nt, Homo sapiens
uugaucaauagaauacaacaga

SEQ ID NO: 308288 - RNA, 22 nt, Homo sapiens
uugcaagauguuaacauuggag

SEQ ID NO: 308289 - RNA, 22 nt, Homo sapiens
uugcagugugacgacuauauuu

SEQ ID NO: 308290 - RNA, 23 nt, Homo sapiens
uugcauagacauccucauagauu

SEQ ID NO: 308291 - RNA, 22 nt, Homo sapiens
uugcaugggagcugggugaggc

SEQ ID NO: 308292 - RNA, 22 nt, Homo sapiens
uugcaugguuuuuaucugaaau

SEQ ID NO: 308293 - RNA, 22 nt, Homo sapiens
uuggcagaguuaauuuguugag

SEQ ID NO: 308294 - RNA, 23 nt, Homo sapiens
uugggcaaaucacugagggcaga

SEQ ID NO: 308295 - RNA, 22 nt, Homo sapiens
uugggcaauaggaagcaggugg

SEQ ID NO: 308296 - RNA, 22 nt, Homo sapiens
uugguccacugugaaauuggga

SEQ ID NO: 308297 - RNA, 22 nt, Homo sapiens
uugguucucuuuauaugcugga

SEQ ID NO: 308298 - RNA, 22 nt, Homo sapiens
uugugacacagcugggccuaua

SEQ ID NO: 308299 - RNA, 22 nt, Homo sapiens
uugugccccuucucagucgggc

SEQ ID NO: 308300 - RNA, 22 nt, Homo sapiens
uugugcuugcuguguucuaugc

SEQ ID NO: 308301 - RNA, 22 nt, Homo sapiens
uugugcuuuacuuacuaccaga

SEQ ID NO: 308302 - RNA, 22 nt, Homo sapiens
uuuaaugcaucccaaaauguag

SEQ ID NO: 308303 - RNA, 23 nt, Homo sapiens
uuucacaguagcuggaucagccu

SEQ ID NO: 308304 - RNA, 22 nt, Homo sapiens
uuugcagugucagcuucugugu

SEQ ID NO: 308305 - RNA, 22 nt, Homo sapiens
uuugcaguuuauuccuggggcu

SEQ ID NO: 308306 - RNA, 18 nt, Homo sapiens
uuugccacuucccagaaa

SEQ ID NO: 308307 - RNA, 22 nt, Homo sapiens
uuuggcuguuucuggacuaaga

SEQ ID NO: 308308 - RNA, 22 nt, Homo sapiens
uuugugacucauggucuagugc

SEQ ID NO: 308309 - RNA, 22 nt, Homo sapiens
aauaaagcuuugagcuuugcug

SEQ ID NO: 308310 - RNA, 22 nt, Homo sapiens
aauaaagucugaagugugcuua

SEQ ID NO: 308311 - RNA, 22 nt, Homo sapiens
aauggcagaugaaauugucauu

SEQ ID NO: 308312 - RNA, 22 nt, Homo sapiens
aaugguguuuccguuaagcuga

SEQ ID NO: 308313 - RNA, 22 nt, Homo sapiens
aauugcacuaagcauaguccag

SEQ ID NO: 308314 - RNA, 20 nt, Homo sapiens
acaaaugcauucugugacau

SEQ ID NO: 308315 - RNA, 22 nt, Homo sapiens
acacaaugguaaguguuugugu

SEQ ID NO: 308316 - RNA, 22 nt, Homo sapiens
acacagugucuguguauuuaaa

SEQ ID NO: 308317 - RNA, 22 nt, Homo sapiens
acagugcuuggcacacaguaau

SEQ ID NO: 308318 - RNA, 22 nt, Homo sapiens
acccggcaguaauccugcgcgc

SEQ ID NO: 308319 - RNA, 22 nt, Homo sapiens
accucagcccggggaaguugag

SEQ ID NO: 308320 - RNA, 22 nt, Homo sapiens
acucagagauuagcacauguuu

SEQ ID NO: 308321 - RNA, 22 nt, Homo sapiens
acugcacuccagccugugagac

SEQ ID NO: 308322 - RNA, 22 nt, Homo sapiens
agaaagcgcuucccuuugcugg

SEQ ID NO: 308323 - RNA, 22 nt, Homo sapiens
agaaugauccuucucagaggca

SEQ ID NO: 308324 - RNA, 22 nt, Homo sapiens
agagaacugauucagggaaaau

SEQ ID NO: 308325 - RNA, 22 nt, Homo sapiens
agagauaauuagguuaaaugag

SEQ ID NO: 308326 - RNA, 22 nt, Homo sapiens
agagguaagaauaguaguugga

SEQ ID NO: 308327 - RNA, 22 nt, Homo sapiens
agauauguuauugauguuaaug

SEQ ID NO: 308328 - RNA, 22 nt, Homo sapiens
agcaccagaaucugaguuauuc

SEQ ID NO: 308329 - RNA, 22 nt, Homo sapiens
agcagauguuuagugagcgccu

SEQ ID NO: 308330 - RNA, 22 nt, Homo sapiens
agcagcaccaaacagacuaaga

SEQ ID NO: 308331 - RNA, 22 nt, Homo sapiens
agcauagugccuugaaaacaau

SEQ ID NO: 308332 - RNA, 22 nt, Homo sapiens
agcuggucugauacuuaccucc

SEQ ID NO: 308333 - RNA, 22 nt, Homo sapiens
agcuuguggugaauacugcuag

SEQ ID NO: 308334 - RNA, 22 nt, Homo sapiens
aggaacuguaacuaugucucug

SEQ ID NO: 308335 - RNA, 22 nt, Homo sapiens
aggacacugauagucuuuggca

SEQ ID NO: 308336 - RNA, 22 nt, Homo sapiens
aggacacugauguaugcugugg

SEQ ID NO: 308337 - RNA, 21 nt, Homo sapiens
aggagauguuuguccuuuuag

SEQ ID NO: 308338 - RNA, 22 nt, Homo sapiens
aggcaagaaugcuuguuucacc

SEQ ID NO: 308339 - RNA, 22 nt, Homo sapiens
aggcagcuguuauauacugagu

SEQ ID NO: 308340 - RNA, 22 nt, Homo sapiens
aggcaugguggcacauacaugu

SEQ ID NO: 308341 - RNA, 22 nt, Homo sapiens
agggcaguguuaggacugucug

SEQ ID NO: 308342 - RNA, 22 nt, Homo sapiens
agguaagucucuaauuaugaau

SEQ ID NO: 308343 - RNA, 20 nt, Homo sapiens
agguaguuauacaaaugugu

SEQ ID NO: 308344 - RNA, 22 nt, Homo sapiens
agguccacuuacuacuccuguu

SEQ ID NO: 308345 - RNA, 22 nt, Homo sapiens
aggugaauggauaaacuguggg

SEQ ID NO: 308346 - RNA, 17 nt, Homo sapiens
aguacugucccauccuu

SEQ ID NO: 308347 - RNA, 22 nt, Homo sapiens
aguagguguugguagagguuuc

SEQ ID NO: 308348 - RNA, 22 nt, Homo sapiens
aguaucaagccacacaugguca

SEQ ID NO: 308349 - RNA, 22 nt, Homo sapiens
agugaauguuggaaaguuauuu

SEQ ID NO: 308350 - RNA, 22 nt, Homo sapiens
agugcacucuuuccucucuuac

SEQ ID NO: 308351 - RNA, 22 nt, Homo sapiens
agugcaguggcauggucauaac

SEQ ID NO: 308352 - RNA, 22 nt, Homo sapiens
agugcauugcaucucugcuuca

SEQ ID NO: 308353 - RNA, 22 nt, Homo sapiens
agugccuacuauguagaugcug

SEQ ID NO: 308354 - RNA, 22 nt, Homo sapiens
auaaaccuacauuuucacuucu

SEQ ID NO: 308355 - RNA, 22 nt, Homo sapiens
auacaguaaugucuuaggcugu

SEQ ID NO: 308356 - RNA, 22 nt, Homo sapiens
auacaguauggagggcccagcu

SEQ ID NO: 308357 - RNA, 22 nt, Homo sapiens
auacaguugccauuucuugugc

SEQ ID NO: 308358 - RNA, 20 nt, Homo sapiens
auaccacagacuggguaguu

SEQ ID NO: 308359 - RNA, 15 nt, Homo sapiens
auagaaugaaaggga

SEQ ID NO: 308360 - RNA, 22 nt, Homo sapiens
auagaauguuugcgccagguga

SEQ ID NO: 308361 - RNA, 22 nt, Homo sapiens
auaucacagguguuuaccugau

SEQ ID NO: 308362 - RNA, 22 nt, Homo sapiens
auauguaguuucagaaguggaa

SEQ ID NO: 308363 - RNA, 22 nt, Homo sapiens
aucaaaugcuggcagagugccu

SEQ ID NO: 308364 - RNA, 22 nt, Homo sapiens
aucaaauugucauuuuaaggau

SEQ ID NO: 308365 - RNA, 22 nt, Homo sapiens
aucacaggcaaaauuccuucuc

SEQ ID NO: 308366 - RNA, 22 nt, Homo sapiens
aucacuggucaugagagaagua

SEQ ID NO: 308367 - RNA, 22 nt, Homo sapiens
auccuuuagacuguccaguuga

SEQ ID NO: 308368 - RNA, 22 nt, Homo sapiens
aucgcgccauuguacuccagcc

SEQ ID NO: 308369 - RNA, 22 nt, Homo sapiens
augaaaguguguggaaacuuga

SEQ ID NO: 308370 - RNA, 23 nt, Homo sapiens
augaauguaaagaaugugggaag

SEQ ID NO: 308371 - RNA, 22 nt, Homo sapiens
augacagagauaugugaauuuu

SEQ ID NO: 308372 - RNA, 22 nt, Homo sapiens
augacccugaccuaagccaauc

SEQ ID NO: 308373 - RNA, 22 nt, Homo sapiens
augagauuguuugugugaaaua

SEQ ID NO: 308374 - RNA, 22 nt, Homo sapiens
augaggagguaugauuuucuga

SEQ ID NO: 308375 - RNA, 22 nt, Homo sapiens
augauaucuuguuuuucaugca

SEQ ID NO: 308376 - RNA, 22 nt, Homo sapiens
auggacagaaaaaaauagaugu

SEQ ID NO: 308377 - RNA, 22 nt, Homo sapiens
uccaguuguuauuuuuauaaag

SEQ ID NO: 308378 - RNA, 22 nt, Homo sapiens
uccaguuuucuuuccuagggcu

SEQ ID NO: 308379 - RNA, 22 nt, Homo sapiens
ucccgaggacaucugggggcaa

SEQ ID NO: 308380 - RNA, 22 nt, Homo sapiens
ucuccggguggcggcgaaggga

SEQ ID NO: 308381 - RNA, 22 nt, Homo sapiens
ucugacagugagagaaaucuga

SEQ ID NO: 308382 - RNA, 22 nt, Homo sapiens
ucugagacuguuucuaacaagc

SEQ ID NO: 308383 - RNA, 22 nt, Homo sapiens
ucuggccuagaacaauuaauua

SEQ ID NO: 308384 - RNA, 22 nt, Homo sapiens
ucugguggugaugagagacagu

SEQ ID NO: 308385 - RNA, 22 nt, Homo sapiens
ucugucuuugccuaaguuuguc

SEQ ID NO: 308386 - RNA, 22 nt, Homo sapiens
ucugugcauggcagaggaauga

SEQ ID NO: 308387 - RNA, 22 nt, Homo sapiens
ucuucagucauauuggccugga

SEQ ID NO: 308388 - RNA, 22 nt, Homo sapiens
ucuugcacaaauuauuuuaacu

SEQ ID NO: 308389 - RNA, 19 nt, Homo sapiens
ucuuuagucacauuuuuau

SEQ ID NO: 308390 - RNA, 19 nt, Homo sapiens
ucuuugguacgugcuuuga

SEQ ID NO: 308391 - RNA, 22 nt, Homo sapiens
ucuuugguaggaguaggaggcc

SEQ ID NO: 308392 - RNA, 22 nt, Homo sapiens
ucuuuggucuacuuucauaugu

SEQ ID NO: 308393 - RNA, 22 nt, Homo sapiens
ucuuugguuucugucucuguaa

SEQ ID NO: 308394 - RNA, 22 nt, Homo sapiens
ugaagagucuaaaucugucuuc

SEQ ID NO: 308395 - RNA, 22 nt, Homo sapiens
ugaagcuuguuucuguaccuuu

SEQ ID NO: 308396 - RNA, 22 nt, Homo sapiens
ugaagggcauuguuuugccaaa

SEQ ID NO: 308397 - RNA, 22 nt, Homo sapiens
ugaaugguuuuuagagaacaau

SEQ ID NO: 308398 - RNA, 23 nt, Homo sapiens
ugacaagagcgagacuuggucuc

SEQ ID NO: 308399 - RNA, 22 nt, Homo sapiens
ugacaagauauggucuuaucaa

SEQ ID NO: 308400 - RNA, 22 nt, Homo sapiens
ugacagguugauaggugcagca

SEQ ID NO: 308401 - RNA, 22 nt, Homo sapiens
ugacaugaagaaaaacagauuu

SEQ ID NO: 308402 - RNA, 22 nt, Homo sapiens
ugacaugauguuccuacacugu

SEQ ID NO: 308403 - RNA, 23 nt, Homo sapiens
ugacugaguauauguuuggugcu

SEQ ID NO: 308404 - RNA, 22 nt, Homo sapiens
ugagaagcauaccagugucugu

SEQ ID NO: 308405 - RNA, 22 nt, Homo sapiens
ugagagaugaacucugauaugu

SEQ ID NO: 308406 - RNA, 22 nt, Homo sapiens
ugagauaaggaaauugaggcuc

SEQ ID NO: 308407 - RNA, 22 nt, Homo sapiens
ugagauaauuuacuuguugagg

SEQ ID NO: 308408 - RNA, 22 nt, Homo sapiens
ugagauauugggaguaauguca

SEQ ID NO: 308409 - RNA, 22 nt, Homo sapiens
ugagaucaacugagucagagca

SEQ ID NO: 308410 - RNA, 22 nt, Homo sapiens
ugagaucagugaagaaguguuu

SEQ ID NO: 308411 - RNA, 22 nt, Homo sapiens
ugagaugaacuugauuguuuua

SEQ ID NO: 308412 - RNA, 22 nt, Homo sapiens
ugagaugaguucucgcucuguc

SEQ ID NO: 308413 - RNA, 21 nt, Homo sapiens
ugagauuaaguuguuuagaag

SEQ ID NO: 308414 - RNA, 22 nt, Homo sapiens
ugagauuaaucuuuaaguaaga

SEQ ID NO: 308415 - RNA, 23 nt, Homo sapiens
ugagauuacccagaaagaguaua

SEQ ID NO: 308416 - RNA, 22 nt, Homo sapiens
ugaggagugaacuauuucugau

SEQ ID NO: 308417 - RNA, 22 nt, Homo sapiens
ugagguaaugcuguagcuguga

SEQ ID NO: 308418 - RNA, 22 nt, Homo sapiens
ugagugugacuuagcagaagga

SEQ ID NO: 308419 - RNA, 22 nt, Homo sapiens
ugaugcugaugccugccagaag

SEQ ID NO: 308420 - RNA, 22 nt, Homo sapiens
ugcaaauguuaguaacaccacu

SEQ ID NO: 308421 - RNA, 22 nt, Homo sapiens
ugcaaauguuauuuugguuucu

SEQ ID NO: 308422 - RNA, 21 nt, Homo sapiens
ugcaagaaucaggaagcugcc

SEQ ID NO: 308423 - RNA, 22 nt, Homo sapiens
ugcacaguccagugcccacuga

SEQ ID NO: 308424 - RNA, 22 nt, Homo sapiens
ugccaguauuuuguugaagauu

SEQ ID NO: 308425 - RNA, 22 nt, Homo sapiens
uggcaacaucuggggacauguu

SEQ ID NO: 308426 - RNA, 22 nt, Homo sapiens
uggcaagaaccacaguuacuuu

SEQ ID NO: 308427 - RNA, 22 nt, Homo sapiens
uggcagaugggugagcuggaga

SEQ ID NO: 308428 - RNA, 22 nt, Homo sapiens
uggcaugaagaccccauccuuu

SEQ ID NO: 308429 - RNA, 17 nt, Homo sapiens
uggcaugaggguguggg

SEQ ID NO: 308430 - RNA, 22 nt, Homo sapiens
uggcauuguccaauaaaauuuu

SEQ ID NO: 308431 - RNA, 22 nt, Homo sapiens
ugggaaacauccagcacauacu

SEQ ID NO: 308432 - RNA, 22 nt, Homo sapiens
ugggaacugaggugaaaagaca

SEQ ID NO: 308433 - RNA, 19 nt, Homo sapiens
ugggaauguaaauuaguuc

SEQ ID NO: 308434 - RNA, 22 nt, Homo sapiens
ugggaucuuuccuauuagcgag

SEQ ID NO: 308435 - RNA, 22 nt, Homo sapiens
ugggaugaauacaaugggauca

SEQ ID NO: 308436 - RNA, 18 nt, Homo sapiens
uguaaacuaccucaaccu

SEQ ID NO: 308437 - RNA, 22 nt, Homo sapiens
uguaaagaaagcuguuguugua

SEQ ID NO: 308438 - RNA, 22 nt, Homo sapiens
uguaauguuucaucauuauuaa

SEQ ID NO: 308439 - RNA, 22 nt, Homo sapiens
uguauauguuuguacauauguc

SEQ ID NO: 308440 - RNA, 22 nt, Homo sapiens
uguauguagugaccagggccag

SEQ ID NO: 308441 - RNA, 22 nt, Homo sapiens
ugucaagaaaucaaggugugag

SEQ ID NO: 308442 - RNA, 22 nt, Homo sapiens
ugucaugguagcaaggacgagg

SEQ ID NO: 308443 - RNA, 22 nt, Homo sapiens
ugucauggugcucugggcccug

SEQ ID NO: 308444 - RNA, 22 nt, Homo sapiens
ugucuagaucugaauguaauug

SEQ ID NO: 308445 - RNA, 22 nt, Homo sapiens
ugucucagugauuggcuuucug

SEQ ID NO: 308446 - RNA, 22 nt, Homo sapiens
ugucucaguucccuucucugga

SEQ ID NO: 308447 - RNA, 22 nt, Homo sapiens
ugugacagcacgguucaacugc

SEQ ID NO: 308448 - RNA, 22 nt, Homo sapiens
ugugacagguagguaauuuuug

SEQ ID NO: 308449 - RNA, 22 nt, Homo sapiens
ugugacagguauccuguguucu

SEQ ID NO: 308450 - RNA, 19 nt, Homo sapiens
ugugacugggccagccuag

SEQ ID NO: 308451 - RNA, 22 nt, Homo sapiens
ugugauaguuggcuaaagcagu

SEQ ID NO: 308452 - RNA, 22 nt, Homo sapiens
ugugcaugacagcauacaaacg

SEQ ID NO: 308453 - RNA, 22 nt, Homo sapiens
uuaagcaguaguuaaggagagg

SEQ ID NO: 308454 - RNA, 22 nt, Homo sapiens
uuaccucuguggcucucggacu

SEQ ID NO: 308455 - RNA, 22 nt, Homo sapiens
uuagaacagugcucaccacaaa

SEQ ID NO: 308456 - RNA, 22 nt, Homo sapiens
uuauacacugugggaguguaaa

SEQ ID NO: 308457 - RNA, 22 nt, Homo sapiens
uucaacugcuucagccucccaa

SEQ ID NO: 308458 - RNA, 22 nt, Homo sapiens
uucacagaguuauuuuuaugcu

SEQ ID NO: 308459 - RNA, 22 nt, Homo sapiens
uucacagugugaucuaugggca

SEQ ID NO: 308460 - RNA, 22 nt, Homo sapiens
uucaguggguggaugaauauga

SEQ ID NO: 308461 - RNA, 22 nt, Homo sapiens
uuccauuuguucggugucgcca

SEQ ID NO: 308462 - RNA, 22 nt, Homo sapiens
uucccuuugaaacuaaacuugc

SEQ ID NO: 308463 - RNA, 22 nt, Homo sapiens
uucccuuugaauuggaaaggug

SEQ ID NO: 308464 - RNA, 22 nt, Homo sapiens
uucccuuuuuucuaguagguag

SEQ ID NO: 308465 - RNA, 19 nt, Homo sapiens
uuccugagaacaagggcuu

SEQ ID NO: 308466 - RNA, 22 nt, Homo sapiens
uugaaagaugaacuggauugga

SEQ ID NO: 308467 - RNA, 22 nt, Homo sapiens
caugccacuguggacaaagaca

SEQ ID NO: 308468 - RNA, 22 nt, Homo sapiens
caugucuuuuauucugugugau

SEQ ID NO: 308469 - RNA, 19 nt, Homo sapiens
caugugcacuacuggcuuc

SEQ ID NO: 308470 - RNA, 22 nt, Homo sapiens
cauugcacuccagcucugggcg

SEQ ID NO: 308471 - RNA, 22 nt, Homo sapiens
cauugcacugcauucugggcaa

SEQ ID NO: 308472 - RNA, 22 nt, Homo sapiens
ccaggguuccacgccuggcugu

SEQ ID NO: 308473 - RNA, 22 nt, Homo sapiens
ccaguuuucaagauaaugguuu

SEQ ID NO: 308474 - RNA, 22 nt, Homo sapiens
ccccauuguugugguuuuaucu

SEQ ID NO: 308475 - RNA, 22 nt, Homo sapiens
ccccuguaaacuggcuucccug

SEQ ID NO: 308476 - RNA, 22 nt, Homo sapiens
cccgugucuuggucuagggccu

SEQ ID NO: 308477 - RNA, 22 nt, Homo sapiens
cuaaggaaggacugaaaggaca

SEQ ID NO: 308478 - RNA, 22 nt, Homo sapiens
cuagaguacuuaccacagcaug

SEQ ID NO: 308479 - RNA, 22 nt, Homo sapiens
cuauggugauagaaaucagaau

SEQ ID NO: 308480 - RNA, 22 nt, Homo sapiens
cucaccuugugauccacccgcc

SEQ ID NO: 308481 - RNA, 22 nt, Homo sapiens
cucagcuacuugggaagcugag

SEQ ID NO: 308482 - RNA, 22 nt, Homo sapiens
cuccacugagcaggugggaggc

SEQ ID NO: 308483 - RNA, 22 nt, Homo sapiens
cucccuuugcugaauguuuuuc

SEQ ID NO: 308484 - RNA, 22 nt, Homo sapiens
cucugagccugagguuccuacu

SEQ ID NO: 308485 - RNA, 22 nt, Homo sapiens
cugaaaagcaucugcauagcug

SEQ ID NO: 308486 - RNA, 22 nt, Homo sapiens
cugagauaggacucugcuggcu

SEQ ID NO: 308487 - RNA, 22 nt, Homo sapiens
cugaggcacggcgaccuuaagu

SEQ ID NO: 308488 - RNA, 22 nt, Homo sapiens
cugagguacugggggccaggau

SEQ ID NO: 308489 - RNA, 22 nt, Homo sapiens
cugaggugggaggauuggcuug

SEQ ID NO: 308490 - RNA, 22 nt, Homo sapiens
cugagguuguucuucucagugg

SEQ ID NO: 308491 - RNA, 20 nt, Homo sapiens
cuggaugucgaggcagaggu

SEQ ID NO: 308492 - RNA, 22 nt, Homo sapiens
cugggaugauguaaauaggcua

SEQ ID NO: 308493 - RNA, 22 nt, Homo sapiens
cuggguacccuuuaaacaggaa

SEQ ID NO: 308494 - RNA, 22 nt, Homo sapiens
cuguaagcauuauaaagagaua

SEQ ID NO: 308495 - RNA, 22 nt, Homo sapiens
cuguaugugagaaauaauaagu

SEQ ID NO: 308496 - RNA, 20 nt, Homo sapiens
cuucacagaaguggaaucau

SEQ ID NO: 308497 - RNA, 18 nt, Homo sapiens
cuucauugcuguuuugcu

SEQ ID NO: 308498 - RNA, 22 nt, Homo sapiens
cuucucagugcucaucuuauuu

SEQ ID NO: 308499 - RNA, 22 nt, Homo sapiens
cuugagacauuguuuuccaagu

SEQ ID NO: 308500 - RNA, 22 nt, Homo sapiens
cuugauagugguaaucauuuuu

SEQ ID NO: 308501 - RNA, 22 nt, Homo sapiens
cuuugugugggccaagggcugg

SEQ ID NO: 308502 - RNA, 22 nt, Homo sapiens
gaaaguguugagauuacaggca

SEQ ID NO: 308503 - RNA, 22 nt, Homo sapiens
gaacugggguuggguugcgaua

SEQ ID NO: 308504 - RNA, 22 nt, Homo sapiens
gaagauaucuaguaccauuguc

SEQ ID NO: 308505 - RNA, 22 nt, Homo sapiens
gaagugcuuuuggacuaacagu

SEQ ID NO: 308506 - RNA, 22 nt, Homo sapiens
gacauguuuucauguauuugga

SEQ ID NO: 308507 - RNA, 22 nt, Homo sapiens
gacuggccuauaauggcgaauu

SEQ ID NO: 308508 - RNA, 22 nt, Homo sapiens
gagaaccauuuggagaaaaagu

SEQ ID NO: 308509 - RNA, 22 nt, Homo sapiens
gagauaaauaggucacaguucu

SEQ ID NO: 308510 - RNA, 22 nt, Homo sapiens
gagaugguguuccacugccagu

SEQ ID NO: 308511 - RNA, 22 nt, Homo sapiens
gagcaaaaguauguauugguua

SEQ ID NO: 308512 - RNA, 22 nt, Homo sapiens
gagcaucauucaacaaaagucu

SEQ ID NO: 308513 - RNA, 22 nt, Homo sapiens
gagguggugguggaggcauagc

SEQ ID NO: 308514 - RNA, 22 nt, Homo sapiens
gagguugggaugagggauacag

SEQ ID NO: 308515 - RNA, 22 nt, Homo sapiens
gaguaacagcauaaauuuguga

SEQ ID NO: 308516 - RNA, 22 nt, Homo sapiens
gagugcugagcccacuuccuug

SEQ ID NO: 308517 - RNA, 22 nt, Homo sapiens
gagugcuguuagcccuggguuu

SEQ ID NO: 308518 - RNA, 19 nt, Homo sapiens
gaguugggguuuacuguaa

SEQ ID NO: 308519 - RNA, 22 nt, Homo sapiens
gaguuuguacuaauuuguugua

SEQ ID NO: 308520 - RNA, 22 nt, Homo sapiens
gaucugugugauuggaugcauu

SEQ ID NO: 308521 - RNA, 22 nt, Homo sapiens
gauguagaaagagugggcugga

SEQ ID NO: 308522 - RNA, 22 nt, Homo sapiens
gcaccacugcacucucagcuug

SEQ ID NO: 308523 - RNA, 22 nt, Homo sapiens
gcagaguauagagggcugggcc

SEQ ID NO: 308524 - RNA, 22 nt, Homo sapiens
gcagugaugugaucauagcuca

SEQ ID NO: 308525 - RNA, 22 nt, Homo sapiens
gcugcuguaccagaugugguua

SEQ ID NO: 308526 - RNA, 22 nt, Homo sapiens
gcugguguugugaaucaggccg

SEQ ID NO: 308527 - RNA, 22 nt, Homo sapiens
gcuuggugugcaagugguacua

SEQ ID NO: 308528 - RNA, 18 nt, Homo sapiens
ggaaaacuuuucuaagua

SEQ ID NO: 308529 - RNA, 22 nt, Homo sapiens
ggaagccugcacucgggcaggg

SEQ ID NO: 308530 - RNA, 22 nt, Homo sapiens
ggcagaauugcugaggaugcua

SEQ ID NO: 308531 - RNA, 19 nt, Homo sapiens
ggcucagucaacugacugu

SEQ ID NO: 308532 - RNA, 22 nt, Homo sapiens
gggaugaagcccuaggguuggu

SEQ ID NO: 308533 - RNA, 23 nt, Homo sapiens
agcaaaugcucuagcacuccaac

SEQ ID NO: 308534 - RNA, 22 nt, Homo sapiens
agcaagaaugaacucucccaga

SEQ ID NO: 308535 - RNA, 19 nt, Homo sapiens
agcagaacaaauguguggg

SEQ ID NO: 308536 - RNA, 21 nt, Homo sapiens
agccugugggucauaguugcc

SEQ ID NO: 308537 - RNA, 21 nt, Homo sapiens
agcuaaauuggaaauuucugu

SEQ ID NO: 308538 - RNA, 22 nt, Homo sapiens
agcuccuacuguuacaucauug

SEQ ID NO: 308539 - RNA, 22 nt, Homo sapiens
agcugguaugaaaaucucccca

SEQ ID NO: 308540 - RNA, 22 nt, Homo sapiens
agcuuguguuugucugccuggg

SEQ ID NO: 308541 - RNA, 22 nt, Homo sapiens
aggcaacaugguaaaacccugu

SEQ ID NO: 308542 - RNA, 22 nt, Homo sapiens
agguauguaugucuguacagcg

SEQ ID NO: 308543 - RNA, 22 nt, Homo sapiens
agucaagauggcaagguaaggc

SEQ ID NO: 308544 - RNA, 22 nt, Homo sapiens
agucauggcagaaggcaccucu

SEQ ID NO: 308545 - RNA, 22 nt, Homo sapiens
agugacaugggaucaaaucuga

SEQ ID NO: 308546 - RNA, 22 nt, Homo sapiens
agugcacugcccgcuuccuguc

SEQ ID NO: 308547 - RNA, 22 nt, Homo sapiens
agugcaguggcucaaaaugccu

SEQ ID NO: 308548 - RNA, 22 nt, Homo sapiens
agugccaaaucgagggcucuga

SEQ ID NO: 308549 - RNA, 23 nt, Homo sapiens
agugccuaguauauaggaggcgc

SEQ ID NO: 308550 - RNA, 22 nt, Homo sapiens
agugggccccuagaggugaggu

SEQ ID NO: 308551 - RNA, 19 nt, Homo sapiens
agugggcuagaaaucaggg

SEQ ID NO: 308552 - RNA, 22 nt, Homo sapiens
auaauacugggaagaugagcau

SEQ ID NO: 308553 - RNA, 22 nt, Homo sapiens
auaauagguugauugacauugc

SEQ ID NO: 308554 - RNA, 22 nt, Homo sapiens
auacaguaucuucuggcaagca

SEQ ID NO: 308555 - RNA, 22 nt, Homo sapiens
auacaucugccauguuggugug

SEQ ID NO: 308556 - RNA, 22 nt, Homo sapiens
auacuguacugaaguacccauu

SEQ ID NO: 308557 - RNA, 22 nt, Homo sapiens
auagugcagugaugaaccuagg

SEQ ID NO: 308558 - RNA, 22 nt, Homo sapiens
auauagcaaugaaagagaugaa

SEQ ID NO: 308559 - RNA, 22 nt, Homo sapiens
auaugcauacauguaugcagga

SEQ ID NO: 308560 - RNA, 22 nt, Homo sapiens
aucaaagugaaauauuaguuau

SEQ ID NO: 308561 - RNA, 22 nt, Homo sapiens
aucaaagugaauuaaugagaau

SEQ ID NO: 308562 - RNA, 22 nt, Homo sapiens
aucacagagucacgggcaacuu

SEQ ID NO: 308563 - RNA, 22 nt, Homo sapiens
aucacagaguuaaaacuuucuu

SEQ ID NO: 308564 - RNA, 22 nt, Homo sapiens
aucacugggcaagauaucauga

SEQ ID NO: 308565 - RNA, 22 nt, Homo sapiens
aucacuuugcucuccagugugg

SEQ ID NO: 308566 - RNA, 22 nt, Homo sapiens
aucucauggagguagagaguaa

SEQ ID NO: 308567 - RNA, 22 nt, Homo sapiens
augacugagacuaacuuacuuu

SEQ ID NO: 308568 - RNA, 22 nt, Homo sapiens
augacugaguagcauuccauua

SEQ ID NO: 308569 - RNA, 22 nt, Homo sapiens
augagaaugauucuguuauggu

SEQ ID NO: 308570 - RNA, 22 nt, Homo sapiens
augagauauguuaaaaguuaaa

SEQ ID NO: 308571 - RNA, 22 nt, Homo sapiens
augagcuaggacagaaugucag

SEQ ID NO: 308572 - RNA, 22 nt, Homo sapiens
augaggaaggagccuuugucug

SEQ ID NO: 308573 - RNA, 22 nt, Homo sapiens
augauacuguucuaagauuuuu

SEQ ID NO: 308574 - RNA, 22 nt, Homo sapiens
augauagucuugagaagcauuu

SEQ ID NO: 308575 - RNA, 22 nt, Homo sapiens
augcaaaucuuaaguaugugug

SEQ ID NO: 308576 - RNA, 22 nt, Homo sapiens
augcauggucugaagucaaccu

SEQ ID NO: 308577 - RNA, 22 nt, Homo sapiens
augccucugacaauuggauucu

SEQ ID NO: 308578 - RNA, 22 nt, Homo sapiens
augcuacauucuacaauuaggc

SEQ ID NO: 308579 - RNA, 22 nt, Homo sapiens
auggaauguauagucauguagg

SEQ ID NO: 308580 - RNA, 22 nt, Homo sapiens
auggcagagucagaaagucagg

SEQ ID NO: 308581 - RNA, 22 nt, Homo sapiens
augggcaaauguuggaaauucc

SEQ ID NO: 308582 - RNA, 22 nt, Homo sapiens
augguaagcugaaaauaucgaa

SEQ ID NO: 308583 - RNA, 22 nt, Homo sapiens
augugacagcaacccccagccc

SEQ ID NO: 308584 - RNA, 22 nt, Homo sapiens
augugacagugguuuuaagcgu

SEQ ID NO: 308585 - RNA, 18 nt, Homo sapiens
augugcaauuuuguauuu

SEQ ID NO: 308586 - RNA, 22 nt, Homo sapiens
auuaaguuaggauuuugagaua

SEQ ID NO: 308587 - RNA, 22 nt, Homo sapiens
auuguaauuuuagagaaagugg

SEQ ID NO: 308588 - RNA, 22 nt, Homo sapiens
auuguacucuagccucugggca

SEQ ID NO: 308589 - RNA, 22 nt, Homo sapiens
caaagugcuggccgggcgcagu

SEQ ID NO: 308590 - RNA, 22 nt, Homo sapiens
caaagugcugggacuggccggg

SEQ ID NO: 308591 - RNA, 19 nt, Homo sapiens
caaaguguucuucuuugcc

SEQ ID NO: 308592 - RNA, 22 nt, Homo sapiens
caaaugacaucauuucauucaa

SEQ ID NO: 308593 - RNA, 22 nt, Homo sapiens
cucauggagauagagaauagaa

SEQ ID NO: 308594 - RNA, 22 nt, Homo sapiens
cucugguuaaggcugaacuaua

SEQ ID NO: 308595 - RNA, 20 nt, Homo sapiens
cucugguugugaauugucuu

SEQ ID NO: 308596 - RNA, 20 nt, Homo sapiens
cugaaugucaaggcagaggu

SEQ ID NO: 308597 - RNA, 22 nt, Homo sapiens
cugaauguucuauagaagccgc

SEQ ID NO: 308598 - RNA, 22 nt, Homo sapiens
cugaauguucuggauggaagag

SEQ ID NO: 308599 - RNA, 22 nt, Homo sapiens
cugagauacacuaauagucucu

SEQ ID NO: 308600 - RNA, 22 nt, Homo sapiens
cugagcaaaaugaagacacgau

SEQ ID NO: 308601 - RNA, 19 nt, Homo sapiens
cugcaagguaauaggucag

SEQ ID NO: 308602 - RNA, 22 nt, Homo sapiens
cuguagacauuaggccugcacu

SEQ ID NO: 308603 - RNA, 22 nt, Homo sapiens
cugugcauguuguccaauucuu

SEQ ID NO: 308604 - RNA, 22 nt, Homo sapiens
cuucuugagggccugcugggaa

SEQ ID NO: 308605 - RNA, 20 nt, Homo sapiens
cuugaagacuaugcugcuga

SEQ ID NO: 308606 - RNA, 22 nt, Homo sapiens
cuugaauguaaauaauguacag

SEQ ID NO: 308607 - RNA, 23 nt, Homo sapiens
cuugagacaaaugcgugugugca

SEQ ID NO: 308608 - RNA, 22 nt, Homo sapiens
cuuucucagugagacccgagau

SEQ ID NO: 308609 - RNA, 20 nt, Homo sapiens
cuuuggcaaugagaacaggg

SEQ ID NO: 308610 - RNA, 22 nt, Homo sapiens
cuuugugcccuucugcccauca

SEQ ID NO: 308611 - RNA, 22 nt, Homo sapiens
cuuuguguaggugccucuggcu

SEQ ID NO: 308612 - RNA, 22 nt, Homo sapiens
cuuuuacacugcuggugggaau

SEQ ID NO: 308613 - RNA, 22 nt, Homo sapiens
cuuuuacacuguuggcaggauu

SEQ ID NO: 308614 - RNA, 22 nt, Homo sapiens
cuuuuguggaucuucuguugcu

SEQ ID NO: 308615 - RNA, 22 nt, Homo sapiens
gaaaauccauccccagggagua

SEQ ID NO: 308616 - RNA, 22 nt, Homo sapiens
gaaagugcugcaaggccaugca

SEQ ID NO: 308617 - RNA, 22 nt, Homo sapiens
gaaggcacugugugccacccug

SEQ ID NO: 308618 - RNA, 22 nt, Homo sapiens
gacagugagaugucaugugaaa

SEQ ID NO: 308619 - RNA, 22 nt, Homo sapiens
gacugaguaagcagaagcaauu

SEQ ID NO: 308620 - RNA, 22 nt, Homo sapiens
gagagguaguuuuuuggucguc

SEQ ID NO: 308621 - RNA, 22 nt, Homo sapiens
gagaggucguauaugauuucug

SEQ ID NO: 308622 - RNA, 22 nt, Homo sapiens
gagauauuuagaaauguguucu

SEQ ID NO: 308623 - RNA, 22 nt, Homo sapiens
gaggugguagguucacagcagc

SEQ ID NO: 308624 - RNA, 22 nt, Homo sapiens
gaguuaggaucucacuguguca

SEQ ID NO: 308625 - RNA, 22 nt, Homo sapiens
gaugacagcugacucccuugcu

SEQ ID NO: 308626 - RNA, 22 nt, Homo sapiens
gaugagaucauaaguguggagc

SEQ ID NO: 308627 - RNA, 22 nt, Homo sapiens
gaugccuuuuuguccucaguua

SEQ ID NO: 308628 - RNA, 21 nt, Homo sapiens
gcaaaggaauugccuaagcuu

SEQ ID NO: 308629 - RNA, 22 nt, Homo sapiens
gcaaaugcuacaccauuuugua

SEQ ID NO: 308630 - RNA, 20 nt, Homo sapiens
gcaaauggaucccacaagcc

SEQ ID NO: 308631 - RNA, 22 nt, Homo sapiens
gcacgugcacccacaugcacgu

SEQ ID NO: 308632 - RNA, 17 nt, Homo sapiens
gcacuggcguaucccac

SEQ ID NO: 308633 - RNA, 22 nt, Homo sapiens
gccaagaagugucuaagcagga

SEQ ID NO: 308634 - RNA, 22 nt, Homo sapiens
gccuagagaguuaucaggcugu

SEQ ID NO: 308635 - RNA, 22 nt, Homo sapiens
ggaaagcuagguguggguguac

SEQ ID NO: 308636 - RNA, 22 nt, Homo sapiens
ggacauuaacugcaagauagau

SEQ ID NO: 308637 - RNA, 22 nt, Homo sapiens
ggagcugugauuugaguccaga

SEQ ID NO: 308638 - RNA, 22 nt, Homo sapiens
ggagucugacuuauaggaaccu

SEQ ID NO: 308639 - RNA, 22 nt, Homo sapiens
ggagugcuguuguuacacaagg

SEQ ID NO: 308640 - RNA, 22 nt, Homo sapiens
ggcaagaggagauucugcuccc

SEQ ID NO: 308641 - RNA, 22 nt, Homo sapiens
ggcaaggaggggcacuuucacu

SEQ ID NO: 308642 - RNA, 23 nt, Homo sapiens
ggcauuguggcucacaucuguaa

SEQ ID NO: 308643 - RNA, 22 nt, Homo sapiens
gggauuguaauacugaguuggu

SEQ ID NO: 308644 - RNA, 22 nt, Homo sapiens
gggcagaugucuggacaccuca

SEQ ID NO: 308645 - RNA, 22 nt, Homo sapiens
ggggcaaaaugccacgagucuc

SEQ ID NO: 308646 - RNA, 22 nt, Homo sapiens
ggguaggcaagcggaugucaga

SEQ ID NO: 308647 - RNA, 22 nt, Homo sapiens
gguaauguaacugguauucugu

SEQ ID NO: 308648 - RNA, 22 nt, Homo sapiens
ggugacugguuuaucuggcagu

SEQ ID NO: 308649 - RNA, 22 nt, Homo sapiens
guacaguaguaaaagugaauga

SEQ ID NO: 308650 - RNA, 22 nt, Homo sapiens
gucaggaccucgguggcauucu

SEQ ID NO: 308651 - RNA, 22 nt, Homo sapiens
gucaguggagaaaaggacaugu

SEQ ID NO: 308652 - RNA, 22 nt, Homo sapiens
gucguggagcucacagugugcc

SEQ ID NO: 308653 - RNA, 22 nt, Homo sapiens
gucuggcuuaucucacuuacca

SEQ ID NO: 308654 - RNA, 22 nt, Homo sapiens
gucuuuguuuggucuguaucag

SEQ ID NO: 308655 - RNA, 22 nt, Homo sapiens
gugaacuguuugaggaagagaa

SEQ ID NO: 308656 - RNA, 22 nt, Homo sapiens
uaagugcuugacuuugauguuu

SEQ ID NO: 308657 - RNA, 20 nt, Homo sapiens
uaagugcuugaugaaugaac

SEQ ID NO: 308658 - RNA, 18 nt, Homo sapiens
uaagugcuuuaaacacau

SEQ ID NO: 308659 - RNA, 22 nt, Homo sapiens
uaaucacagagguuuggccuca

SEQ ID NO: 308660 - RNA, 22 nt, Homo sapiens
uaaugcacucgaaucauggaau

SEQ ID NO: 308661 - RNA, 22 nt, Homo sapiens
uaaugcuaucugggccaggggu

SEQ ID NO: 308662 - RNA, 22 nt, Homo sapiens
uagaaagcaugaccuucagaua

SEQ ID NO: 308663 - RNA, 22 nt, Homo sapiens
uagaaugucagcuucuugaggg

SEQ ID NO: 308664 - RNA, 22 nt, Homo sapiens
uagaggaaggauuggaaacgca

SEQ ID NO: 308665 - RNA, 22 nt, Homo sapiens
uagagguagguguaugaacuag

SEQ ID NO: 308666 - RNA, 22 nt, Homo sapiens
uagagguauuaacaguagaaga

SEQ ID NO: 308667 - RNA, 22 nt, Homo sapiens
uagauaauuagaggguuuuaag

SEQ ID NO: 308668 - RNA, 22 nt, Homo sapiens
uagguaaguaauauacagauga

SEQ ID NO: 308669 - RNA, 22 nt, Homo sapiens
uaguuguugcagguaggaugua

SEQ ID NO: 308670 - RNA, 22 nt, Homo sapiens
uauacagcaaguuacugugcug

SEQ ID NO: 308671 - RNA, 22 nt, Homo sapiens
uaucacaaacuuagcaguuuaa

SEQ ID NO: 308672 - RNA, 22 nt, Homo sapiens
uaucccaguggauguaccccau

SEQ ID NO: 308673 - RNA, 22 nt, Homo sapiens
uauggaaaucuuaccuuauggu

SEQ ID NO: 308674 - RNA, 22 nt, Homo sapiens
uauggauuugccuauucuguau

SEQ ID NO: 308675 - RNA, 22 nt, Homo sapiens
uaugucuuuugcuugcaaauag

SEQ ID NO: 308676 - RNA, 22 nt, Homo sapiens
uauuuguccccuccaaaaguca

SEQ ID NO: 308677 - RNA, 17 nt, Homo sapiens
ucaaaugcucccaguga

SEQ ID NO: 308678 - RNA, 22 nt, Homo sapiens
ucaaauguucccuguacuggcc

SEQ ID NO: 308679 - RNA, 22 nt, Homo sapiens
ucaaauguuuguuuaaggcuua

SEQ ID NO: 308680 - RNA, 22 nt, Homo sapiens
ucaacguauuuauauagcagag

SEQ ID NO: 308681 - RNA, 22 nt, Homo sapiens
ucaagcaauucuccucucagcc

SEQ ID NO: 308682 - RNA, 19 nt, Homo sapiens
ucaagcuauucuccugccu

SEQ ID NO: 308683 - RNA, 22 nt, Homo sapiens
ucacaagugagaggaauuagau

SEQ ID NO: 308684 - RNA, 22 nt, Homo sapiens
ucacauuaagcuguuauuucuu

SEQ ID NO: 308685 - RNA, 22 nt, Homo sapiens
ucacauucaauuguaauccccg

SEQ ID NO: 308686 - RNA, 22 nt, Homo sapiens
ucacccacacaggagacaggga

SEQ ID NO: 308687 - RNA, 22 nt, Homo sapiens
ucagacacugcccuccaccugu

SEQ ID NO: 308688 - RNA, 22 nt, Homo sapiens
ucagaguaguuccuggcagaaa

SEQ ID NO: 308689 - RNA, 22 nt, Homo sapiens
ucagaucauauucuucgcugcu

SEQ ID NO: 308690 - RNA, 22 nt, Homo sapiens
ucagauguuucuuuaacgcaug

SEQ ID NO: 308691 - RNA, 22 nt, Homo sapiens
ucaggugcaguggcucugaccu

SEQ ID NO: 308692 - RNA, 22 nt, Homo sapiens
ucagugccucaguuuuuaaaga

SEQ ID NO: 308693 - RNA, 22 nt, Homo sapiens
ucauauguaugugcaauuuugu

SEQ ID NO: 308694 - RNA, 22 nt, Homo sapiens
uccauuugucuauguuucuguu

SEQ ID NO: 308695 - RNA, 23 nt, Homo sapiens
ucccaagauggaccagaccaagg

SEQ ID NO: 308696 - RNA, 22 nt, Homo sapiens
ucccugagcaaaguuuucugua

SEQ ID NO: 308697 - RNA, 22 nt, Homo sapiens
uccuuggucaaaaagaaagugu

SEQ ID NO: 308698 - RNA, 23 nt, Homo sapiens
ucgcagcauucaauaccaggcag

SEQ ID NO: 308699 - RNA, 22 nt, Homo sapiens
ucucacacugaauguguguggg

SEQ ID NO: 308700 - RNA, 22 nt, Homo sapiens
ucucacaggguuauugaggggg

SEQ ID NO: 308701 - RNA, 22 nt, Homo sapiens
ucucaugaagguggagaguagg

SEQ ID NO: 308702 - RNA, 19 nt, Homo sapiens
ucucugguguuggagggga

SEQ ID NO: 308703 - RNA, 22 nt, Homo sapiens
ucucugguuaugucauuaagca

SEQ ID NO: 308704 - RNA, 22 nt, Homo sapiens
ucucugguuuguggaaucuuag

SEQ ID NO: 308705 - RNA, 22 nt, Homo sapiens
ucugacagugugaauauugacu

SEQ ID NO: 308706 - RNA, 22 nt, Homo sapiens
ucugagcaugcaucuugccugg

SEQ ID NO: 308707 - RNA, 22 nt, Homo sapiens
ucugucuuugucaggaccagag

SEQ ID NO: 308708 - RNA, 22 nt, Homo sapiens
ucugugcauuacacuuuucuca

SEQ ID NO: 308709 - RNA, 22 nt, Homo sapiens
ucugugcauuguaggauguuua

SEQ ID NO: 308710 - RNA, 22 nt, Homo sapiens
ucuuaggugggccaucacccca

SEQ ID NO: 308711 - RNA, 22 nt, Homo sapiens
ucuuugauuaugcagauggguu

SEQ ID NO: 308712 - RNA, 19 nt, Homo sapiens
ucuuugcuuuucuaagagg

SEQ ID NO: 308713 - RNA, 22 nt, Homo sapiens
ugaacagagaaacacuggccau

SEQ ID NO: 308714 - RNA, 20 nt, Homo sapiens
ugaacugguuacuuucuguc

SEQ ID NO: 308715 - RNA, 22 nt, Homo sapiens
ugaagcuaacuugauugugaug

SEQ ID NO: 308716 - RNA, 22 nt, Homo sapiens
ugaauagaaguggcaggaguag

SEQ ID NO: 308717 - RNA, 22 nt, Homo sapiens
ugaaugauuuuaaaagccucuc

SEQ ID NO: 308718 - RNA, 22 nt, Homo sapiens
ugaauguccugacgcugcaguu

SEQ ID NO: 308719 - RNA, 22 nt, Homo sapiens
ugaauuguuuacgagaugugag

SEQ ID NO: 308720 - RNA, 22 nt, Homo sapiens
ugaauuguuucauucuuuacau

SEQ ID NO: 308721 - RNA, 22 nt, Homo sapiens
ugacaagaaagcgucuucuuuu

SEQ ID NO: 308722 - RNA, 23 nt, Homo sapiens
ugacagaccuucuggaagaaguc

SEQ ID NO: 308723 - RNA, 15 nt, Homo sapiens
uggugguguugagac

SEQ ID NO: 308724 - RNA, 22 nt, Homo sapiens
ugucauggucacaggcauuuca

SEQ ID NO: 308725 - RNA, 22 nt, Homo sapiens
ugucuacugaugauguaguuaa

SEQ ID NO: 308726 - RNA, 22 nt, Homo sapiens
ugugaacauuuuguauauauua

SEQ ID NO: 308727 - RNA, 21 nt, Homo sapiens
ugugaccucugucucugaguc

SEQ ID NO: 308728 - RNA, 22 nt, Homo sapiens
ugugagcuauggaguuguagag

SEQ ID NO: 308729 - RNA, 22 nt, Homo sapiens
ugugcacaacgugcagguuugu

SEQ ID NO: 308730 - RNA, 23 nt, Homo sapiens
ugugcacauuuacauauauacac

SEQ ID NO: 308731 - RNA, 22 nt, Homo sapiens
ugugucuuguuuuuucccaggc

SEQ ID NO: 308732 - RNA, 22 nt, Homo sapiens
uguguuugauaaguccauaguu

SEQ ID NO: 308733 - RNA, 22 nt, Homo sapiens
uguguuuuuauguaaaauggaa

SEQ ID NO: 308734 - RNA, 22 nt, Homo sapiens
uguuacagcagaauugauugca

SEQ ID NO: 308735 - RNA, 22 nt, Homo sapiens
uuaaaugcauagaauguguagu

SEQ ID NO: 308736 - RNA, 22 nt, Homo sapiens
uuaaaugcucacauaaagguag

SEQ ID NO: 308737 - RNA, 22 nt, Homo sapiens
uuaauagcaaagaguuuagacu

SEQ ID NO: 308738 - RNA, 22 nt, Homo sapiens
uuaaucugucuaugauuuuggu

SEQ ID NO: 308739 - RNA, 22 nt, Homo sapiens
uuacaugucuugguaagguuag

SEQ ID NO: 308740 - RNA, 21 nt, Homo sapiens
uuaggcagugucagaggugag

SEQ ID NO: 308741 - RNA, 22 nt, Homo sapiens
uuauauguuacucccucuagca

SEQ ID NO: 308742 - RNA, 22 nt, Homo sapiens
uuauggcaaugccccacuccua

SEQ ID NO: 308743 - RNA, 22 nt, Homo sapiens
uuaugguuuuucugugagaugg

SEQ ID NO: 308744 - RNA, 22 nt, Homo sapiens
uuauuagguuaaccuauagcua

SEQ ID NO: 308745 - RNA, 22 nt, Homo sapiens
uuauugaguaaaaagaaugguu

SEQ ID NO: 308746 - RNA, 22 nt, Homo sapiens
uuauugcuuaugauuagguguu

SEQ ID NO: 308747 - RNA, 22 nt, Homo sapiens
uuauugcuuuugugcaggugag

SEQ ID NO: 308748 - RNA, 22 nt, Homo sapiens
uuauuugguugcugacuuggaa

SEQ ID NO: 308749 - RNA, 22 nt, Homo sapiens
uucacaguacucccuggaauua

SEQ ID NO: 308750 - RNA, 22 nt, Homo sapiens
uucacaguguguacaccagggg

SEQ ID NO: 308751 - RNA, 22 nt, Homo sapiens
uucagaugcacacuguagucua

SEQ ID NO: 308752 - RNA, 22 nt, Homo sapiens
uucagcuacuugggaggcugaa

SEQ ID NO: 308753 - RNA, 22 nt, Homo sapiens
uucagguaucccuugucuauag

SEQ ID NO: 308754 - RNA, 22 nt, Homo sapiens
uucaguccauuuccuuggucac

SEQ ID NO: 308755 - RNA, 22 nt, Homo sapiens
uucagugucauuaacacaguag

SEQ ID NO: 308756 - RNA, 22 nt, Homo sapiens
uucauacaguggcugcacucca

SEQ ID NO: 308757 - RNA, 22 nt, Homo sapiens
uucauggacucaauaguuucgc

SEQ ID NO: 308758 - RNA, 22 nt, Homo sapiens
uucauguaauauuucacagcuu

SEQ ID NO: 308759 - RNA, 22 nt, Homo sapiens
uucauuggauguuacacugugu

SEQ ID NO: 308760 - RNA, 22 nt, Homo sapiens
uuccaugagaugcaucaaagcu

SEQ ID NO: 308761 - RNA, 22 nt, Homo sapiens
uuccauuuguucggugucgcca

SEQ ID NO: 308762 - RNA, 22 nt, Homo sapiens
uucccagugccaggcacuggga

SEQ ID NO: 308763 - RNA, 22 nt, Homo sapiens
uucccaguuggggaaagcgacc

SEQ ID NO: 308764 - RNA, 22 nt, Homo sapiens
uucccuguaucuucugccaugu

SEQ ID NO: 308765 - RNA, 21 nt, Homo sapiens
uucuaaguaaauguuggacau

SEQ ID NO: 308766 - RNA, 22 nt, Homo sapiens
uucucuggucagaggggagguu

SEQ ID NO: 308767 - RNA, 22 nt, Homo sapiens
uucuuagucaaguuguauuuca

SEQ ID NO: 308768 - RNA, 22 nt, Homo sapiens
uugaagacuaccuaccauacuu

SEQ ID NO: 308769 - RNA, 22 nt, Homo sapiens
uugaccuggagaguacuuugac

SEQ ID NO: 308770 - RNA, 22 nt, Homo sapiens
uugagaaucuuucgaauguucu

SEQ ID NO: 308771 - RNA, 22 nt, Homo sapiens
uugagacugaacauuuguguac

SEQ ID NO: 308772 - RNA, 22 nt, Homo sapiens
uugagauaggaacucacuaugc

SEQ ID NO: 308773 - RNA, 22 nt, Homo sapiens
uugagauccuuuugcucaucag

SEQ ID NO: 308774 - RNA, 22 nt, Homo sapiens
uugagaucugugcuuuugcguu

SEQ ID NO: 308775 - RNA, 22 nt, Homo sapiens
uugagauggagucuugcucucu

SEQ ID NO: 308776 - RNA, 22 nt, Homo sapiens
uugagauggaguguugcucugu

SEQ ID NO: 308777 - RNA, 22 nt, Homo sapiens
uugagcucaucaagauagagaa

SEQ ID NO: 308778 - RNA, 22 nt, Homo sapiens
uugcaacuuagaaaaaucauuu

SEQ ID NO: 308779 - RNA, 22 nt, Homo sapiens
uugcacauggcaggugcucaau

SEQ ID NO: 308780 - RNA, 22 nt, Homo sapiens
uugcacauugauuuuguauccu

SEQ ID NO: 308781 - RNA, 22 nt, Homo sapiens
uugcacuccagccugggugaca

SEQ ID NO: 308782 - RNA, 22 nt, Homo sapiens
uugcacuccagucuggggggca

SEQ ID NO: 308783 - RNA, 18 nt, Homo sapiens
uugcacuccugccugggu

SEQ ID NO: 308784 - RNA, 22 nt, Homo sapiens
uugcacucugaagaccuacugu

SEQ ID NO: 308785 - RNA, 22 nt, Homo sapiens
uugcacuguaauuuauuuaugu

SEQ ID NO: 308786 - RNA, 22 nt, Homo sapiens
uugcaucagcuccugauguacu

SEQ ID NO: 308787 - RNA, 22 nt, Homo sapiens
uugcuucuuucgucuggcccca

SEQ ID NO: 308788 - RNA, 22 nt, Homo sapiens
uuggagagagaggacucccggc

SEQ ID NO: 308789 - RNA, 22 nt, Homo sapiens
uuggcaagaaccuucuuccaag

SEQ ID NO: 308790 - RNA, 22 nt, Homo sapiens
uuggcuuuuaugcagcuuaggu

SEQ ID NO: 308791 - RNA, 22 nt, Homo sapiens
uugguaugaaaaggaauuagac

SEQ ID NO: 308792 - RNA, 22 nt, Homo sapiens
uuguaacaugcuuucacuucag

SEQ ID NO: 308793 - RNA, 22 nt, Homo sapiens
uuguacuagucauauuuugaaa

SEQ ID NO: 308794 - RNA, 22 nt, Homo sapiens
uuguauacucuauuuuagcagu

SEQ ID NO: 308795 - RNA, 22 nt, Homo sapiens
uuguccuugagauaguuugcag

SEQ ID NO: 308796 - RNA, 22 nt, Homo sapiens
uugucucacuggaguuuaguaa

SEQ ID NO: 308797 - RNA, 19 nt, Homo sapiens
uugucuuagaguugucauu

SEQ ID NO: 308798 - RNA, 21 nt, Homo sapiens
uugugccaaacccuggaggga

SEQ ID NO: 308799 - RNA, 22 nt, Homo sapiens
uugugcuuguaacuacauucag

SEQ ID NO: 308800 - RNA, 22 nt, Homo sapiens
uugugcuuuuuaaauagcuucc

SEQ ID NO: 308801 - RNA, 19 nt, Homo sapiens
uugugggaggacagagggg

SEQ ID NO: 308802 - RNA, 22 nt, Homo sapiens
uugugguuuuagcacuguggau

SEQ ID NO: 308803 - RNA, 22 nt, Homo sapiens
uuuccagguggccaacauuuua

SEQ ID NO: 308804 - RNA, 22 nt, Homo sapiens
uuuccuggagaaucuuaacaaa

SEQ ID NO: 308805 - RNA, 22 nt, Homo sapiens
uuugaagacuacugggagugaa

SEQ ID NO: 308806 - RNA, 20 nt, Homo sapiens
uuugaauguaaagcauguca

SEQ ID NO: 308807 - RNA, 22 nt, Homo sapiens
uuugacuagaguguuuuacaac

SEQ ID NO: 308808 - RNA, 22 nt, Homo sapiens
uuugagguguauggcaaguuga

SEQ ID NO: 308809 - RNA, 22 nt, Homo sapiens
uuugaguaggcuuauauuuugg

SEQ ID NO: 308810 - RNA, 22 nt, Homo sapiens
uauagcuaugggauguauuugc

SEQ ID NO: 308811 - RNA, 22 nt, Homo sapiens
uaucaacaggguggccagugua

SEQ ID NO: 308812 - RNA, 22 nt, Homo sapiens
uaucaaggccacucauuuuaug

SEQ ID NO: 308813 - RNA, 20 nt, Homo sapiens
uaucacauggggagaaaccu

SEQ ID NO: 308814 - RNA, 22 nt, Homo sapiens
uaucagaguuacacugaagacu

SEQ ID NO: 308815 - RNA, 21 nt, Homo sapiens
uaucccagucacaucuaccca

SEQ ID NO: 308816 - RNA, 22 nt, Homo sapiens
uaucccaguggauguaccccau

SEQ ID NO: 308817 - RNA, 22 nt, Homo sapiens
uaucugguuauugcugcugauu

SEQ ID NO: 308818 - RNA, 22 nt, Homo sapiens
uaugcacacacguguuuaugug

SEQ ID NO: 308819 - RNA, 22 nt, Homo sapiens
uaugcacaugcaugcuugaaua

SEQ ID NO: 308820 - RNA, 22 nt, Homo sapiens
uaugggauuucauuaagugucu

SEQ ID NO: 308821 - RNA, 19 nt, Homo sapiens
uaugggauuuuuagggugu

SEQ ID NO: 308822 - RNA, 22 nt, Homo sapiens
uauggguaguacaaaguguaua

SEQ ID NO: 308823 - RNA, 22 nt, Homo sapiens
uauugaauuuuuaagcccuuug

SEQ ID NO: 308824 - RNA, 22 nt, Homo sapiens
uauugcaacagaagaaagaguc

SEQ ID NO: 308825 - RNA, 22 nt, Homo sapiens
uauugcaauuggcagagugcua

SEQ ID NO: 308826 - RNA, 22 nt, Homo sapiens
uauugcuggauguauuacaugu

SEQ ID NO: 308827 - RNA, 22 nt, Homo sapiens
uauugcuggcacauaguagguc

SEQ ID NO: 308828 - RNA, 22 nt, Homo sapiens
uauugcuuuacucucuuauccu

SEQ ID NO: 308829 - RNA, 22 nt, Homo sapiens
uauuugauuaacaagagccuaa

SEQ ID NO: 308830 - RNA, 22 nt, Homo sapiens
ucaacauugcugucaggcaucu

SEQ ID NO: 308831 - RNA, 22 nt, Homo sapiens
ucaauugcaucaacaguguaca

SEQ ID NO: 308832 - RNA, 22 nt, Homo sapiens
ucacaguguuaaaccuuucuuu

SEQ ID NO: 308833 - RNA, 22 nt, Homo sapiens
ucaccaguaauaaagagccugc

SEQ ID NO: 308834 - RNA, 21 nt, Homo sapiens
ucacugagguuaaauaggguu

SEQ ID NO: 308835 - RNA, 22 nt, Homo sapiens
ucacugcacuccagccuuuaug

SEQ ID NO: 308836 - RNA, 19 nt, Homo sapiens
ucacuggacagcacacuca

SEQ ID NO: 308837 - RNA, 22 nt, Homo sapiens
ucacuggacucuagccugggug

SEQ ID NO: 308838 - RNA, 22 nt, Homo sapiens
ucagagcaaagacacuuuauca

SEQ ID NO: 308839 - RNA, 22 nt, Homo sapiens
ucagaugauuccguugacgaga

SEQ ID NO: 308840 - RNA, 22 nt, Homo sapiens
ucagcagugagagaccucaccc

SEQ ID NO: 308841 - RNA, 22 nt, Homo sapiens
ucaggugcaguggcucaugcuu

SEQ ID NO: 308842 - RNA, 20 nt, Homo sapiens
ucaguauauuguuuccacag

SEQ ID NO: 308843 - RNA, 22 nt, Homo sapiens
ucauugguagcuugaaggggau

SEQ ID NO: 308844 - RNA, 18 nt, Homo sapiens
ucauuggugagcaccucc

SEQ ID NO: 308845 - RNA, 22 nt, Homo sapiens
uccagugugcaggcaaguuuga

SEQ ID NO: 308846 - RNA, 22 nt, Homo sapiens
uccaugaggcuacaguaaucuc

SEQ ID NO: 308847 - RNA, 22 nt, Homo sapiens
uccaugaguccauuagaaaaaa

SEQ ID NO: 308848 - RNA, 22 nt, Homo sapiens
uccauggagacacauuuuauau

SEQ ID NO: 308849 - RNA, 19 nt, Homo sapiens
uccccaguuuuccguucag

SEQ ID NO: 308850 - RNA, 22 nt, Homo sapiens
uccccgaggcuggagugcagug

SEQ ID NO: 308851 - RNA, 22 nt, Homo sapiens
uccuacugucuucggggcacug

SEQ ID NO: 308852 - RNA, 22 nt, Homo sapiens
uccugcauucugacuugcuuuc

SEQ ID NO: 308853 - RNA, 22 nt, Homo sapiens
uccuucacucuacaucuuuguu

SEQ ID NO: 308854 - RNA, 22 nt, Homo sapiens
ucgcgccauucuccugccucag

SEQ ID NO: 308855 - RNA, 22 nt, Homo sapiens
ucuaaaguacuacuacuguugg

SEQ ID NO: 308856 - RNA, 21 nt, Homo sapiens
ucuggcuuucauuccccuucu

SEQ ID NO: 308857 - RNA, 22 nt, Homo sapiens
ucugugcauuacacuuuucuca

SEQ ID NO: 308858 - RNA, 20 nt, Homo sapiens
ucuugaacuuagucaacagg

SEQ ID NO: 308859 - RNA, 22 nt, Homo sapiens
ucuuugggauauucugaaaggg

SEQ ID NO: 308860 - RNA, 22 nt, Homo sapiens
ucuuuggguguauuucacagcc

SEQ ID NO: 308861 - RNA, 22 nt, Homo sapiens
ugaaaugauuauaugguguuug

SEQ ID NO: 308862 - RNA, 22 nt, Homo sapiens
ugaaggacauucuaugguagau

SEQ ID NO: 308863 - RNA, 22 nt, Homo sapiens
ugaauagacacuaaagacugua

SEQ ID NO: 308864 - RNA, 22 nt, Homo sapiens
ugacaagcucccucugcaccuu

SEQ ID NO: 308865 - RNA, 22 nt, Homo sapiens
uauuccacucuguuggagguaa

SEQ ID NO: 308866 - RNA, 22 nt, Homo sapiens
uauugaauuugagcugucucuu

SEQ ID NO: 308867 - RNA, 22 nt, Homo sapiens
uauugauuaauugugauuaggc

SEQ ID NO: 308868 - RNA, 22 nt, Homo sapiens
uauuugauugacuuuagcagga

SEQ ID NO: 308869 - RNA, 22 nt, Homo sapiens
uauuuggugaaugaaugcaugu

SEQ ID NO: 308870 - RNA, 22 nt, Homo sapiens
uauuugguuauaugaguaaguu

SEQ ID NO: 308871 - RNA, 23 nt, Homo sapiens
ucacacuuaagagaaaugcagcu

SEQ ID NO: 308872 - RNA, 22 nt, Homo sapiens
ucacagugaguggaguggggug

SEQ ID NO: 308873 - RNA, 22 nt, Homo sapiens
ucacgguggaaucccagauccc

SEQ ID NO: 308874 - RNA, 22 nt, Homo sapiens
ucacugaaacuguccuggguua

SEQ ID NO: 308875 - RNA, 22 nt, Homo sapiens
ucacuggacagaaauaaaggug

SEQ ID NO: 308876 - RNA, 22 nt, Homo sapiens
ucacuggagauagcaaucuggu

SEQ ID NO: 308877 - RNA, 22 nt, Homo sapiens
ucacuuuggguacuauggaaau

SEQ ID NO: 308878 - RNA, 22 nt, Homo sapiens
ucacuuuguuuuuggauaaguu

SEQ ID NO: 308879 - RNA, 22 nt, Homo sapiens
ucagaugauucuguuguugugu

SEQ ID NO: 308880 - RNA, 22 nt, Homo sapiens
ucaggugcaguggcucugaccu

SEQ ID NO: 308881 - RNA, 22 nt, Homo sapiens
ucaguguuuggaaucucaauuu

SEQ ID NO: 308882 - RNA, 22 nt, Homo sapiens
ucauaguagucacuuaauaaau

SEQ ID NO: 308883 - RNA, 20 nt, Homo sapiens
ucaucaguuggugcucgcug

SEQ ID NO: 308884 - RNA, 22 nt, Homo sapiens
ucauugcacuccagccugggug

SEQ ID NO: 308885 - RNA, 22 nt, Homo sapiens
uccagguuuggcuuuauaacuu

SEQ ID NO: 308886 - RNA, 22 nt, Homo sapiens
uccaguguuauaauaugcgucu

SEQ ID NO: 308887 - RNA, 22 nt, Homo sapiens
ucccacugucuucucgugcucg

SEQ ID NO: 308888 - RNA, 22 nt, Homo sapiens
ucccauguagcuaggauuacag

SEQ ID NO: 308889 - RNA, 19 nt, Homo sapiens
uccccuguggauaccaaga

SEQ ID NO: 308890 - RNA, 19 nt, Homo sapiens
uccuugauugcaccacugc

SEQ ID NO: 308891 - RNA, 22 nt, Homo sapiens
ucgcaccauugcacuccagcca

SEQ ID NO: 308892 - RNA, 22 nt, Homo sapiens
ucguucuugucaguuuauaaag

SEQ ID NO: 308893 - RNA, 22 nt, Homo sapiens
ucucaauuugauuacauucaua

SEQ ID NO: 308894 - RNA, 22 nt, Homo sapiens
ucucacaccccucucauauacc

SEQ ID NO: 308895 - RNA, 22 nt, Homo sapiens
ucucaguggcuuccucacuuuu

SEQ ID NO: 308896 - RNA, 22 nt, Homo sapiens
ucuccauuuguaaggguuucuc

SEQ ID NO: 308897 - RNA, 22 nt, Homo sapiens
ucugagaugagacuuugaauuu

SEQ ID NO: 308898 - RNA, 22 nt, Homo sapiens
ucugauggaguugccagggaga

SEQ ID NO: 308899 - RNA, 22 nt, Homo sapiens
ucugugaaugaacacuugaaaa

SEQ ID NO: 308900 - RNA, 22 nt, Homo sapiens
ucugugcauggcagaggaauga

SEQ ID NO: 308901 - RNA, 22 nt, Homo sapiens
ucuugaacuucauaggucuaga

SEQ ID NO: 308902 - RNA, 22 nt, Homo sapiens
ucuugaacuucugcacacucag

SEQ ID NO: 308903 - RNA, 22 nt, Homo sapiens
ucuuggcaaagaauuuuuggcu

SEQ ID NO: 308904 - RNA, 22 nt, Homo sapiens
ugaaauguguuaucugggccug

SEQ ID NO: 308905 - RNA, 22 nt, Homo sapiens
ugaacacagccugccucugcca

SEQ ID NO: 308906 - RNA, 22 nt, Homo sapiens
ugaaguaggcauaaguuaagcu

SEQ ID NO: 308907 - RNA, 22 nt, Homo sapiens
ugaaguagguucucguaucgcc

SEQ ID NO: 308908 - RNA, 22 nt, Homo sapiens
ugaagugggaaaugaguauuaa

SEQ ID NO: 308909 - RNA, 22 nt, Homo sapiens
ugaauguaacuaaaggacuuuu

SEQ ID NO: 308910 - RNA, 22 nt, Homo sapiens
ugacacauguagacaucuggug

SEQ ID NO: 308911 - RNA, 22 nt, Homo sapiens
ugacagcugaagauguugaacc

SEQ ID NO: 308912 - RNA, 22 nt, Homo sapiens
ugacaguaucuacagcuucuua

SEQ ID NO: 308913 - RNA, 22 nt, Homo sapiens
ugacccauagaaauguggauaa

SEQ ID NO: 308914 - RNA, 21 nt, Homo sapiens
ugagaacaacaggucaagcag

SEQ ID NO: 308915 - RNA, 16 nt, Homo sapiens
ugagaacaugcagcau

SEQ ID NO: 308916 - RNA, 19 nt, Homo sapiens
ugagaacaugugguauuug

SEQ ID NO: 308917 - RNA, 22 nt, Homo sapiens
ugagaauguagggcucucccag

SEQ ID NO: 308918 - RNA, 21 nt, Homo sapiens
ugagacaauccuggucaauau

SEQ ID NO: 308919 - RNA, 22 nt, Homo sapiens
ugagacaucugagauuuuaagc

SEQ ID NO: 308920 - RNA, 22 nt, Homo sapiens
ugagacggagucuugcucuguc

SEQ ID NO: 308921 - RNA, 22 nt, Homo sapiens
ugagacugagucucccucuguc

SEQ ID NO: 308922 - RNA, 22 nt, Homo sapiens
ugagacugaguuuugcucguug

SEQ ID NO: 308923 - RNA, 22 nt, Homo sapiens
ugagagacagacauuaucuuau

SEQ ID NO: 308924 - RNA, 22 nt, Homo sapiens
ugagagaugaacuauucuugaa

SEQ ID NO: 308925 - RNA, 19 nt, Homo sapiens
ugagagcacaacugaacaa

SEQ ID NO: 308926 - RNA, 21 nt, Homo sapiens
ugagauaauauguuucugaug

SEQ ID NO: 308927 - RNA, 22 nt, Homo sapiens
ugagauaaucaugugauuucau

SEQ ID NO: 308928 - RNA, 18 nt, Homo sapiens
ugagauacuagaauaggu

SEQ ID NO: 308929 - RNA, 22 nt, Homo sapiens
ugagauauauauauuugagaca

SEQ ID NO: 308930 - RNA, 22 nt, Homo sapiens
ugagaucacgccacugcacucc

SEQ ID NO: 308931 - RNA, 22 nt, Homo sapiens
uugagauggagucucgcacugu

SEQ ID NO: 308932 - RNA, 22 nt, Homo sapiens
uugagauggagucuugcacugu

SEQ ID NO: 308933 - RNA, 22 nt, Homo sapiens
uugagauggagucuugcucuug

SEQ ID NO: 308934 - RNA, 22 nt, Homo sapiens
uugagauggaguuuugcucuug

SEQ ID NO: 308935 - RNA, 22 nt, Homo sapiens
uugagauggugccacuguacuc

SEQ ID NO: 308936 - RNA, 22 nt, Homo sapiens
uugagauguaguuucacuccug

SEQ ID NO: 308937 - RNA, 22 nt, Homo sapiens
uugagcacugucugugugcagu

SEQ ID NO: 308938 - RNA, 21 nt, Homo sapiens
uugagguaaaauccuauggga

SEQ ID NO: 308939 - RNA, 22 nt, Homo sapiens
uugagguaggaggagcuuggau

SEQ ID NO: 308940 - RNA, 22 nt, Homo sapiens
uugagguauaaagguagguugu

SEQ ID NO: 308941 - RNA, 22 nt, Homo sapiens
uugaggugaagggcagagcagc

SEQ ID NO: 308942 - RNA, 20 nt, Homo sapiens
uugaguauugccagggaggc

SEQ ID NO: 308943 - RNA, 22 nt, Homo sapiens
uugcaacauuguaaguuuauau

SEQ ID NO: 308944 - RNA, 22 nt, Homo sapiens
uugcacaguguguacagcacca

SEQ ID NO: 308945 - RNA, 22 nt, Homo sapiens
uugcacauggcuggggaggccu

SEQ ID NO: 308946 - RNA, 22 nt, Homo sapiens
uugcacauugauuuuguaucuu

SEQ ID NO: 308947 - RNA, 22 nt, Homo sapiens
uugcacauuuuuucuggcagaa

SEQ ID NO: 308948 - RNA, 22 nt, Homo sapiens
uugcacuccagccuggaugaca

SEQ ID NO: 308949 - RNA, 22 nt, Homo sapiens
uugcacuccauccuggguugac

SEQ ID NO: 308950 - RNA, 22 nt, Homo sapiens
uugcacuccggccuggguaaca

SEQ ID NO: 308951 - RNA, 22 nt, Homo sapiens
uugcacuugcugaggagugauu

SEQ ID NO: 308952 - RNA, 22 nt, Homo sapiens
uugcagugguuucacuggcaaa

SEQ ID NO: 308953 - RNA, 22 nt, Homo sapiens
uuggaaugcaacagaaggauaa

SEQ ID NO: 308954 - RNA, 22 nt, Homo sapiens
uuggaaugcacacugagccugc

SEQ ID NO: 308955 - RNA, 22 nt, Homo sapiens
uuggaauguauggcaucuugcg

SEQ ID NO: 308956 - RNA, 22 nt, Homo sapiens
uuggaaugugacugauaauauu

SEQ ID NO: 308957 - RNA, 19 nt, Homo sapiens
uuggaauuuuagaguuuga

SEQ ID NO: 308958 - RNA, 22 nt, Homo sapiens
uuggagagaaaggcaguuccug

SEQ ID NO: 308959 - RNA, 22 nt, Homo sapiens
uuggagagugauauucagaugc

SEQ ID NO: 308960 - RNA, 22 nt, Homo sapiens
uuggauaguuuaugaaaaaugg

SEQ ID NO: 308961 - RNA, 22 nt, Homo sapiens
uuggauuuuaacaaacuaggug

SEQ ID NO: 308962 - RNA, 22 nt, Homo sapiens
uugguaagguggaugaugaaua

SEQ ID NO: 308963 - RNA, 22 nt, Homo sapiens
uugguacuagcugaucgcagag

SEQ ID NO: 308964 - RNA, 22 nt, Homo sapiens
uugucaguguucacucaaagcu

SEQ ID NO: 308965 - RNA, 22 nt, Homo sapiens
uugucccauggggucuuccuuu

SEQ ID NO: 308966 - RNA, 22 nt, Homo sapiens
uugugauugagugauccuuguu

SEQ ID NO: 308967 - RNA, 22 nt, Homo sapiens
uuucaggcagggagcuucagug

SEQ ID NO: 308968 - RNA, 22 nt, Homo sapiens
uuucauggacgcaaugccuuuu

SEQ ID NO: 308969 - RNA, 19 nt, Homo sapiens
uuuccaguaaucuuaugug

SEQ ID NO: 308970 - RNA, 22 nt, Homo sapiens
uuuccauguuggugaaaugagg

SEQ ID NO: 308971 - RNA, 21 nt, Homo sapiens
uuuccuggagcguauggcuuc

SEQ ID NO: 308972 - RNA, 22 nt, Homo sapiens
uuucugagaccaaaacuuguaa

SEQ ID NO: 308973 - RNA, 21 nt, Homo sapiens
uuucugggggagcauggcagg

SEQ ID NO: 308974 - RNA, 22 nt, Homo sapiens
uuucuugguuguauuuagacuu

SEQ ID NO: 308975 - RNA, 22 nt, Homo sapiens
uuugcuucacuguuuggcaaaa

SEQ ID NO: 308976 - RNA, 22 nt, Homo sapiens
uuuugcuugugaauagccacau

SEQ ID NO: 308977 - RNA, 18 nt, Homo sapiens
uuuuugaggcacagggga

SEQ ID NO: 308978 - RNA, 22 nt, Homo sapiens
aaugggacugacgccucccaga

SEQ ID NO: 308979 - RNA, 22 nt, Homo sapiens
aauugaaugauaugggacauuu

SEQ ID NO: 308980 - RNA, 22 nt, Homo sapiens
aauugcauaaaauucaacucug

SEQ ID NO: 308981 - RNA, 22 nt, Homo sapiens
acaccuguggucccaguaacuu

SEQ ID NO: 308982 - RNA, 22 nt, Homo sapiens
acacuggaguuaaaggugauuu

SEQ ID NO: 308983 - RNA, 22 nt, Homo sapiens
acagguacacagaauauccaga

SEQ ID NO: 308984 - RNA, 22 nt, Homo sapiens
acaugcaucauuaggugguuua

SEQ ID NO: 308985 - RNA, 22 nt, Homo sapiens
acccacuagaugccaguggcac

SEQ ID NO: 308986 - RNA, 22 nt, Homo sapiens
acccuugaguguguuucaggca

SEQ ID NO: 308987 - RNA, 22 nt, Homo sapiens
acuaaggcacaauuuucucaua

SEQ ID NO: 308988 - RNA, 22 nt, Homo sapiens
acuauacuguaacuguauucag

SEQ ID NO: 308989 - RNA, 18 nt, Homo sapiens
acucuguauguggagugg

SEQ ID NO: 308990 - RNA, 21 nt, Homo sapiens
acugagagaucuggggcacau

SEQ ID NO: 308991 - RNA, 22 nt, Homo sapiens
acugaucaauguuaaggcuuau

SEQ ID NO: 308992 - RNA, 22 nt, Homo sapiens
acugcacuccaaccuguugggc

SEQ ID NO: 308993 - RNA, 22 nt, Homo sapiens
acugcacuccagcccaggugac

SEQ ID NO: 308994 - RNA, 22 nt, Homo sapiens
acugcacuccagcccgggugac

SEQ ID NO: 308995 - RNA, 22 nt, Homo sapiens
acugcacuccagccuaggcgac

SEQ ID NO: 308996 - RNA, 22 nt, Homo sapiens
acugcacuccagccucccgucu

SEQ ID NO: 308997 - RNA, 22 nt, Homo sapiens
acugcacuccagccucggcaau

SEQ ID NO: 308998 - RNA, 22 nt, Homo sapiens
acugcacuccagccucggggac

SEQ ID NO: 308999 - RNA, 22 nt, Homo sapiens
acugcacuccagccugccgaca

SEQ ID NO: 309000 - RNA, 22 nt, Homo sapiens
acugcacuccagccugcuggca

SEQ ID NO: 309001 - RNA, 22 nt, Homo sapiens
acugcacuccagccugcugggu

SEQ ID NO: 309002 - RNA, 22 nt, Homo sapiens
acugcacuccagccugugagac

SEQ ID NO: 309003 - RNA, 22 nt, Homo sapiens
acugcacuccagccuguugaca

SEQ ID NO: 309004 - RNA, 22 nt, Homo sapiens
acugcacuccagccuuagugac

SEQ ID NO: 309005 - RNA, 22 nt, Homo sapiens
acugcacuccagcuugggugac

SEQ ID NO: 309006 - RNA, 20 nt, Homo sapiens
acugcacuccaggcugccca

SEQ ID NO: 309007 - RNA, 22 nt, Homo sapiens
acugcacuccaguuccgggcaa

SEQ ID NO: 309008 - RNA, 22 nt, Homo sapiens
acugcacuccaucuuagguggc

SEQ ID NO: 309009 - RNA, 22 nt, Homo sapiens
acugcacuccggccucgugaca

SEQ ID NO: 309010 - RNA, 22 nt, Homo sapiens
acugcacucuagccuuggcaac

SEQ ID NO: 309011 - RNA, 22 nt, Homo sapiens
acugcacucuagcuugggugac

SEQ ID NO: 309012 - RNA, 22 nt, Homo sapiens
acuggguuaauuugaagguuga

SEQ ID NO: 309013 - RNA, 22 nt, Homo sapiens
acuguacuacagccugggugac

SEQ ID NO: 309014 - RNA, 22 nt, Homo sapiens
acuguacuccagccugggugac

SEQ ID NO: 309015 - RNA, 22 nt, Homo sapiens
acuuaguauggggcuuuugaga

SEQ ID NO: 309016 - RNA, 17 nt, Homo sapiens
acuuuuugaggaggcau

SEQ ID NO: 309017 - RNA, 23 nt, Homo sapiens
agaaaugucuauucagggucccu

SEQ ID NO: 309018 - RNA, 22 nt, Homo sapiens
agaaauguuuauucaaacccgu

SEQ ID NO: 309019 - RNA, 22 nt, Homo sapiens
agaauguaacucuaugaaggca

SEQ ID NO: 309020 - RNA, 22 nt, Homo sapiens
agaauguauauucuguaguugu

SEQ ID NO: 309021 - RNA, 23 nt, Homo sapiens
agacugaaguaucugagacucag

SEQ ID NO: 309022 - RNA, 22 nt, Homo sapiens
agagaacugauuggaguugggc

SEQ ID NO: 309023 - RNA, 22 nt, Homo sapiens
agagugcaaagguuggggcugg

SEQ ID NO: 309024 - RNA, 22 nt, Homo sapiens
agauacauuggauaaugguggg

SEQ ID NO: 309025 - RNA, 22 nt, Homo sapiens
agauggugauaaaugugguacc

SEQ ID NO: 309026 - RNA, 22 nt, Homo sapiens
agauucauccaaguuguugcau

SEQ ID NO: 309027 - RNA, 22 nt, Homo sapiens
agcaagauugauggccugcagg

SEQ ID NO: 309028 - RNA, 21 nt, Homo sapiens
agcagaguggcagcucuuuug

SEQ ID NO: 309029 - RNA, 21 nt, Homo sapiens
agcagcuuugguugaagcaga

SEQ ID NO: 309030 - RNA, 22 nt, Homo sapiens
agcagguguccacaauguuugc

SEQ ID NO: 309031 - RNA, 16 nt, Homo sapiens
agcagguguuagguga

SEQ ID NO: 309032 - RNA, 22 nt, Homo sapiens
agccuucauucugacaguagga

SEQ ID NO: 309033 - RNA, 22 nt, Homo sapiens
agcugcaaagggagagaugauu

SEQ ID NO: 309034 - RNA, 22 nt, Homo sapiens
agcuggauguggaugacccugu

SEQ ID NO: 309035 - RNA, 22 nt, Homo sapiens
agcuggauuguuuaccuggggc

SEQ ID NO: 309036 - RNA, 22 nt, Homo sapiens
agcugguauuuugucaaggaua

SEQ ID NO: 309037 - RNA, 22 nt, Homo sapiens
agcuguguugucugaagucaga

SEQ ID NO: 309038 - RNA, 19 nt, Homo sapiens
aggcauugugcucaucugu

SEQ ID NO: 309039 - RNA, 22 nt, Homo sapiens
agucacagccuuuuacuuuaga

SEQ ID NO: 309040 - RNA, 22 nt, Homo sapiens
agucaguggaguaaauguaauu

SEQ ID NO: 309041 - RNA, 22 nt, Homo sapiens
agugagcugcagucuggggucc

SEQ ID NO: 309042 - RNA, 22 nt, Homo sapiens
agugagcuguuuuuacuuucug

SEQ ID NO: 309043 - RNA, 22 nt, Homo sapiens
aguuuuugcugauagcaugcuu

SEQ ID NO: 309044 - RNA, 22 nt, Homo sapiens
auacagacacagucagaggggu

SEQ ID NO: 309045 - RNA, 22 nt, Homo sapiens
auacagucuguuagauuuccuc

SEQ ID NO: 309046 - RNA, 20 nt, Homo sapiens
auagaagacuagugcagcag

SEQ ID NO: 309047 - RNA, 21 nt, Homo sapiens
auagcacaucagauuuuauua

SEQ ID NO: 309048 - RNA, 22 nt, Homo sapiens
auagcauagucagcuucgcuga

SEQ ID NO: 309049 - RNA, 22 nt, Homo sapiens
auagccucauucuucagaugag

SEQ ID NO: 309050 - RNA, 22 nt, Homo sapiens
auaggacuauugugaggauuaa

SEQ ID NO: 309051 - RNA, 22 nt, Homo sapiens
auaggagcacgaacucuagugu

SEQ ID NO: 309052 - RNA, 22 nt, Homo sapiens
auaguauaguugaggauggcau

SEQ ID NO: 309053 - RNA, 20 nt, Homo sapiens
auaugcagacacauacauac

SEQ ID NO: 309054 - RNA, 22 nt, Homo sapiens
auauucaagugaggauggcuaa

SEQ ID NO: 309055 - RNA, 22 nt, Homo sapiens
aucacagguacuauggcugaca

SEQ ID NO: 309056 - RNA, 22 nt, Homo sapiens
aucacaguggucagguauagau

SEQ ID NO: 309057 - RNA, 22 nt, Homo sapiens
aucacaguuaagaggugaugaa

SEQ ID NO: 309058 - RNA, 22 nt, Homo sapiens
aucacaguuauaacauccuuuu

SEQ ID NO: 309059 - RNA, 22 nt, Homo sapiens
aucgcaccauugcacuccagca

SEQ ID NO: 309060 - RNA, 22 nt, Homo sapiens
aucucagagaaaauuacuaaga

SEQ ID NO: 309061 - RNA, 22 nt, Homo sapiens
aucugguauuacugcaacugua

SEQ ID NO: 309062 - RNA, 20 nt, Homo sapiens
augacuagaggacaugguaa

SEQ ID NO: 309063 - RNA, 22 nt, Homo sapiens
augagauucuuagagaagucug

SEQ ID NO: 309064 - RNA, 19 nt, Homo sapiens
augagcaauaguuuuaauc

SEQ ID NO: 309065 - RNA, 22 nt, Homo sapiens
augagcaucaccagaaucaaua

SEQ ID NO: 309066 - RNA, 22 nt, Homo sapiens
augagcuguuuggaagacacuu

SEQ ID NO: 309067 - RNA, 22 nt, Homo sapiens
augaggugauuucuguucgggu

SEQ ID NO: 309068 - RNA, 22 nt, Homo sapiens
augaucacaccacugcacucca

SEQ ID NO: 309069 - RNA, 19 nt, Homo sapiens
augcaaugucacaggcugc

SEQ ID NO: 309070 - RNA, 22 nt, Homo sapiens
augcacaucagcuccagggacc

SEQ ID NO: 309071 - RNA, 22 nt, Homo sapiens
augcacauggcuaacuuuuuuc

SEQ ID NO: 309072 - RNA, 22 nt, Homo sapiens
augcacuuggcaggaugauucc

SEQ ID NO: 309073 - RNA, 22 nt, Homo sapiens
augccacugcacuccaaccugg

SEQ ID NO: 309074 - RNA, 22 nt, Homo sapiens
augccacugcacuucagcuugg

SEQ ID NO: 309075 - RNA, 22 nt, Homo sapiens
auggaaugguugggucauaagg

SEQ ID NO: 309076 - RNA, 22 nt, Homo sapiens
auggaauguauagucauguagg

SEQ ID NO: 309077 - RNA, 22 nt, Homo sapiens
auggagagaauuauucucucag

SEQ ID NO: 309078 - RNA, 22 nt, Homo sapiens
auggaguuuacuuaguguaaua

SEQ ID NO: 309079 - RNA, 22 nt, Homo sapiens
auggccuuucuggcacauuucc

SEQ ID NO: 309080 - RNA, 22 nt, Homo sapiens
augggacugggugccguggagc

SEQ ID NO: 309081 - RNA, 21 nt, Homo sapiens
augguacugucucuggagaua

SEQ ID NO: 309082 - RNA, 17 nt, Homo sapiens
augugaauguucaaaua

SEQ ID NO: 309083 - RNA, 22 nt, Homo sapiens
augugaugguuaauuuuaugug

SEQ ID NO: 309084 - RNA, 22 nt, Homo sapiens
augugguaggcccaugagucau

SEQ ID NO: 309085 - RNA, 22 nt, Homo sapiens
augugugcuugauguaaaaagu

SEQ ID NO: 309086 - RNA, 23 nt, Homo sapiens
augugugcuuggagagcaggaug

SEQ ID NO: 309087 - RNA, 22 nt, Homo sapiens
auuagguagggaauauggaggu

SEQ ID NO: 309088 - RNA, 22 nt, Homo sapiens
auuagguauuuucuggacaggg

SEQ ID NO: 309089 - RNA, 22 nt, Homo sapiens
auucaucagggauauugguuga

SEQ ID NO: 309090 - RNA, 22 nt, Homo sapiens
auuccagauggaguugaggguu

SEQ ID NO: 309091 - RNA, 22 nt, Homo sapiens
auuccauuuguguggaauggcu

SEQ ID NO: 309092 - RNA, 22 nt, Homo sapiens
auugaguaaaugaaaauugccu

SEQ ID NO: 309093 - RNA, 22 nt, Homo sapiens
auugcacuccagccugggugag

SEQ ID NO: 309094 - RNA, 22 nt, Homo sapiens
auugcacucuagccugggugac

SEQ ID NO: 309095 - RNA, 22 nt, Homo sapiens
auugcacuggggguuagaauuu

SEQ ID NO: 309096 - RNA, 23 nt, Homo sapiens
auugcagucuugaacuccugggc

SEQ ID NO: 309097 - RNA, 19 nt, Homo sapiens
auugcaguguaaaacuauu

SEQ ID NO: 309098 - RNA, 22 nt, Homo sapiens
auugcaguuagaacagaagucu

SEQ ID NO: 309099 - RNA, 22 nt, Homo sapiens
auugcaguuucaacuccagggc

SEQ ID NO: 309100 - RNA, 22 nt, Homo sapiens
auuguacuccagccuuggggac

SEQ ID NO: 309101 - RNA, 22 nt, Homo sapiens
auuucacugagacaugugccca

SEQ ID NO: 309102 - RNA, 22 nt, Homo sapiens
auuuccuguaggggcuugcgaa

SEQ ID NO: 309103 - RNA, 22 nt, Homo sapiens
auuugggaaugugcauuauacu

SEQ ID NO: 309104 - RNA, 22 nt, Homo sapiens
caaaccuguaggggccaagagg

SEQ ID NO: 309105 - RNA, 22 nt, Homo sapiens
cacaaugucuaagauguuucua

SEQ ID NO: 309106 - RNA, 22 nt, Homo sapiens
cacagcgacuuccgccuaccgg

SEQ ID NO: 309107 - RNA, 22 nt, Homo sapiens
cacauagucccugcuaaucuuc

SEQ ID NO: 309108 - RNA, 22 nt, Homo sapiens
caccacagccauuauugucccc

SEQ ID NO: 309109 - RNA, 22 nt, Homo sapiens
cacccaguaagcaugaggcccu

SEQ ID NO: 309110 - RNA, 22 nt, Homo sapiens
caccuguagucccagcugaggc

SEQ ID NO: 309111 - RNA, 22 nt, Homo sapiens
cacugcacuccagcuuugguga

SEQ ID NO: 309112 - RNA, 22 nt, Homo sapiens
cacugcacuccagucccgucuc

SEQ ID NO: 309113 - RNA, 22 nt, Homo sapiens
cacugcacuccagucugacgac

SEQ ID NO: 309114 - RNA, 22 nt, Homo sapiens
cacugcacucuucuucugggca

SEQ ID NO: 309115 - RNA, 22 nt, Homo sapiens
cacugcauccucugccuggcgg

SEQ ID NO: 309116 - RNA, 22 nt, Homo sapiens
cacugcauggucuagcuggguu

SEQ ID NO: 309117 - RNA, 22 nt, Homo sapiens
cagcuugugguauugcugguug

SEQ ID NO: 309118 - RNA, 22 nt, Homo sapiens
caggguccccuaccuuuugaug

SEQ ID NO: 309119 - RNA, 22 nt, Homo sapiens
cagguacuucugggcugagcag

SEQ ID NO: 309120 - RNA, 22 nt, Homo sapiens
caggugcauuggcugacaccug

SEQ ID NO: 309121 - RNA, 22 nt, Homo sapiens
cauggagcuaggcuugaucccu

SEQ ID NO: 309122 - RNA, 22 nt, Homo sapiens
caugguguuaggcacugggaau

SEQ ID NO: 309123 - RNA, 22 nt, Homo sapiens
ccaguuuucucacuguugcagu

SEQ ID NO: 309124 - RNA, 22 nt, Homo sapiens
ccgugcacggaaaggcauauuu

SEQ ID NO: 309125 - RNA, 22 nt, Homo sapiens
ccuguagcauccaagaagcugc

SEQ ID NO: 309126 - RNA, 22 nt, Homo sapiens
ccuguguuaugguuucuaaugu

SEQ ID NO: 309127 - RNA, 22 nt, Homo sapiens
ccuucuuuuguaaggcugaaua

SEQ ID NO: 309128 - RNA, 22 nt, Homo sapiens
ccuuuuugaguugccagaguuc

SEQ ID NO: 309129 - RNA, 22 nt, Homo sapiens
cuaaucugugcauagaagaggc

SEQ ID NO: 309130 - RNA, 22 nt, Homo sapiens
cuauggauuuacuguauagggu

SEQ ID NO: 309131 - RNA, 22 nt, Homo sapiens
cucacagugacacgaaccccca

SEQ ID NO: 309132 - RNA, 22 nt, Homo sapiens
cucacggugcaggcuucuggga

SEQ ID NO: 309133 - RNA, 22 nt, Homo sapiens
cucagcuacuugagaggcuuag

SEQ ID NO: 309134 - RNA, 22 nt, Homo sapiens
cucaggcacucugauuccagug

SEQ ID NO: 309135 - RNA, 20 nt, Homo sapiens
cucagguauuugaggcugca

SEQ ID NO: 309136 - RNA, 22 nt, Homo sapiens
cucagugucuggcacacagaaa

SEQ ID NO: 309137 - RNA, 22 nt, Homo sapiens
cuccaugagauuguugaaguag

SEQ ID NO: 309138 - RNA, 23 nt, Homo sapiens
cuccaugagccguccagggccug

SEQ ID NO: 309139 - RNA, 22 nt, Homo sapiens
cuccauuuaguccuuuuagaag

SEQ ID NO: 309140 - RNA, 22 nt, Homo sapiens
cugagaaugaugauuuccaguu

SEQ ID NO: 309141 - RNA, 22 nt, Homo sapiens
cugagaucuuauuagaaaugca

SEQ ID NO: 309142 - RNA, 22 nt, Homo sapiens
cugagauggagucucgcauugu

SEQ ID NO: 309143 - RNA, 22 nt, Homo sapiens
cugaggugggaguuuuucucau

SEQ ID NO: 309144 - RNA, 22 nt, Homo sapiens
cugagguuguucuucucagugg

SEQ ID NO: 309145 - RNA, 22 nt, Homo sapiens
cugauuuguccccagccucaug

SEQ ID NO: 309146 - RNA, 22 nt, Homo sapiens
cuggaauguuccuaaagauuca

SEQ ID NO: 309147 - RNA, 22 nt, Homo sapiens
cuggagauauuggaagaaagaa

SEQ ID NO: 309148 - RNA, 22 nt, Homo sapiens
cugggucaguuucugauuauug

SEQ ID NO: 309149 - RNA, 22 nt, Homo sapiens
cugucacugggaggggcagcag

SEQ ID NO: 309150 - RNA, 22 nt, Homo sapiens
cugucucagccucuccaguagc

SEQ ID NO: 309151 - RNA, 22 nt, Homo sapiens
cugucucagugaauugguuuua

SEQ ID NO: 309152 - RNA, 22 nt, Homo sapiens
cuuaagcauugacuuuggacag

SEQ ID NO: 309153 - RNA, 22 nt, Homo sapiens
cuucaugggagaaccacaggua

SEQ ID NO: 309154 - RNA, 22 nt, Homo sapiens
cuuuuguggaucuucuguugcu

SEQ ID NO: 309155 - RNA, 21 nt, Homo sapiens
cuuuuuacucguucauaugca

SEQ ID NO: 309156 - RNA, 22 nt, Homo sapiens
gaacccuggaggcggagguugc

SEQ ID NO: 309157 - RNA, 22 nt, Homo sapiens
gaaguaguaaaauuuauugcag

SEQ ID NO: 309158 - RNA, 22 nt, Homo sapiens
gaaugcagcagugacagggcug

SEQ ID NO: 309159 - RNA, 22 nt, Homo sapiens
gacugcauuugccccaucgaau

SEQ ID NO: 309160 - RNA, 22 nt, Homo sapiens
gacuggagcuguaugugguuac

SEQ ID NO: 309161 - RNA, 22 nt, Homo sapiens
gagaacauacggcauuugguuu

SEQ ID NO: 309162 - RNA, 22 nt, Homo sapiens
gagaacugagugugcuggcgga

SEQ ID NO: 309163 - RNA, 22 nt, Homo sapiens
gagaaguaaauuuauuugcaaa

SEQ ID NO: 309164 - RNA, 22 nt, Homo sapiens
gagacauguuugcuuaucugag

SEQ ID NO: 309165 - RNA, 22 nt, Homo sapiens
gagacugagucuugcucugucg

SEQ ID NO: 309166 - RNA, 22 nt, Homo sapiens
gagaggucguauaugauuucug

SEQ ID NO: 309167 - RNA, 22 nt, Homo sapiens
gagagugaaguuugcuaccugu

SEQ ID NO: 309168 - RNA, 22 nt, Homo sapiens
gagauacacccagugcagaggc

SEQ ID NO: 309169 - RNA, 22 nt, Homo sapiens
gagaugcaccuugucacguuuc

SEQ ID NO: 309170 - RNA, 22 nt, Homo sapiens
uaucagagcugucagccuaccu

SEQ ID NO: 309171 - RNA, 22 nt, Homo sapiens
uaucucagagaaucagauuuac

SEQ ID NO: 309172 - RNA, 21 nt, Homo sapiens
uaucucaguuuuccuuugugg

SEQ ID NO: 309173 - RNA, 22 nt, Homo sapiens
uaugaacacuuuugggaggcau

SEQ ID NO: 309174 - RNA, 22 nt, Homo sapiens
uaugaauuuuauccaggauaua

SEQ ID NO: 309175 - RNA, 19 nt, Homo sapiens
uaugcaacuuauagugcug

SEQ ID NO: 309176 - RNA, 22 nt, Homo sapiens
uaugcuuauaaacauuugucag

SEQ ID NO: 309177 - RNA, 22 nt, Homo sapiens
uauucaagccaaauucaagcca

SEQ ID NO: 309178 - RNA, 22 nt, Homo sapiens
uauuccauuugggucaggauga

SEQ ID NO: 309179 - RNA, 22 nt, Homo sapiens
uauuccauuugugaaaggaagu

SEQ ID NO: 309180 - RNA, 22 nt, Homo sapiens
uauugcagugagauccaucugg

SEQ ID NO: 309181 - RNA, 22 nt, Homo sapiens
uauugcugaaaaugcuaaugau

SEQ ID NO: 309182 - RNA, 22 nt, Homo sapiens
ucaaaguauucuucugagaacc

SEQ ID NO: 309183 - RNA, 22 nt, Homo sapiens
ucaaauguucccuguacuggcc

SEQ ID NO: 309184 - RNA, 22 nt, Homo sapiens
ucaagcaauucgccugucucag

SEQ ID NO: 309185 - RNA, 22 nt, Homo sapiens
ucaagcaauucuccugccucag

SEQ ID NO: 309186 - RNA, 20 nt, Homo sapiens
aucucugggcaaaggaaaau

SEQ ID NO: 309187 - RNA, 22 nt, Homo sapiens
aucugcauucccauguuuauug

SEQ ID NO: 309188 - RNA, 22 nt, Homo sapiens
augaaagguauguuuucuguga

SEQ ID NO: 309189 - RNA, 22 nt, Homo sapiens
augaaauguaugagucuggguu

SEQ ID NO: 309190 - RNA, 22 nt, Homo sapiens
augaagagaaaguggaucuugg

SEQ ID NO: 309191 - RNA, 19 nt, Homo sapiens
augacauuuggggguggac

SEQ ID NO: 309192 - RNA, 17 nt, Homo sapiens
augacuucuucagugug

SEQ ID NO: 309193 - RNA, 22 nt, Homo sapiens
augagaaucauuucagcuugua

SEQ ID NO: 309194 - RNA, 22 nt, Homo sapiens
augagaauguaaguuaaugaaa

SEQ ID NO: 309195 - RNA, 22 nt, Homo sapiens
augagagcuaacuguggguaca

SEQ ID NO: 309196 - RNA, 22 nt, Homo sapiens
augagagcugacuuuaaggcaa

SEQ ID NO: 309197 - RNA, 22 nt, Homo sapiens
augagaugcaagauuagauggg

SEQ ID NO: 309198 - RNA, 22 nt, Homo sapiens
augagcagaagagauacacugu

SEQ ID NO: 309199 - RNA, 22 nt, Homo sapiens
augauaucuuguuuuucaugca

SEQ ID NO: 309200 - RNA, 22 nt, Homo sapiens
augauccagugaguuucaguuc

SEQ ID NO: 309201 - RNA, 22 nt, Homo sapiens
augcacauauguacugcccuau

SEQ ID NO: 309202 - RNA, 22 nt, Homo sapiens
augcauaugucuuuauaguggc

SEQ ID NO: 309203 - RNA, 22 nt, Homo sapiens
auggaaaugaagggcuggcccu

SEQ ID NO: 309204 - RNA, 22 nt, Homo sapiens
auggaagaaacgauuuucugga

SEQ ID NO: 309205 - RNA, 22 nt, Homo sapiens
auggaaugccauuuauaaugga

SEQ ID NO: 309206 - RNA, 22 nt, Homo sapiens
auggaucauauucuugaggagg

SEQ ID NO: 309207 - RNA, 22 nt, Homo sapiens
auggauuuguaguacaugguug

SEQ ID NO: 309208 - RNA, 22 nt, Homo sapiens
auggcacuccagccugggcaac

SEQ ID NO: 309209 - RNA, 22 nt, Homo sapiens
auguaauguuaaauugcuaauu

SEQ ID NO: 309210 - RNA, 22 nt, Homo sapiens
augugaacaucauagaaugcac

SEQ ID NO: 309211 - RNA, 22 nt, Homo sapiens
augugaacugaauuaauucaca

SEQ ID NO: 309212 - RNA, 22 nt, Homo sapiens
augugcacaacgugcagguuug

SEQ ID NO: 309213 - RNA, 22 nt, Homo sapiens
augugguaguuauagugauaag

SEQ ID NO: 309214 - RNA, 22 nt, Homo sapiens
auuccaguggguuuacauccca

SEQ ID NO: 309215 - RNA, 20 nt, Homo sapiens
auugaagacuccggggcaga

SEQ ID NO: 309216 - RNA, 22 nt, Homo sapiens
auugaguaaaaaauagugaugu

SEQ ID NO: 309217 - RNA, 19 nt, Homo sapiens
auugauuaaguuugcuguc

SEQ ID NO: 309218 - RNA, 22 nt, Homo sapiens
auugcacaccagucugggcaaa

SEQ ID NO: 309219 - RNA, 22 nt, Homo sapiens
auugcacuccggccugggugac

SEQ ID NO: 309220 - RNA, 22 nt, Homo sapiens
auugcagaaaugacagagcgcc

SEQ ID NO: 309221 - RNA, 22 nt, Homo sapiens
auugcagcccacccugggugau

SEQ ID NO: 309222 - RNA, 22 nt, Homo sapiens
auugcuucugauuuuaaaugag

SEQ ID NO: 309223 - RNA, 22 nt, Homo sapiens
auuggcaauccauauauuuucu

SEQ ID NO: 309224 - RNA, 22 nt, Homo sapiens
auuggcuauuuggugagugauu

SEQ ID NO: 309225 - RNA, 22 nt, Homo sapiens
auuggucuugaaaccagagaga

SEQ ID NO: 309226 - RNA, 22 nt, Homo sapiens
auuuugcauugcuguaaaggaa

SEQ ID NO: 309227 - RNA, 21 nt, Homo sapiens
auuuuugcagagcugguagug

SEQ ID NO: 309228 - RNA, 22 nt, Homo sapiens
caacacagugaaacccgucucu

SEQ ID NO: 309229 - RNA, 22 nt, Homo sapiens
caaggcacagccccuacuuccu

SEQ ID NO: 309230 - RNA, 21 nt, Homo sapiens
caagugaugcuucugcuuuaa

SEQ ID NO: 309231 - RNA, 23 nt, Homo sapiens
cacagggugaacaccccuaaucc

SEQ ID NO: 309232 - RNA, 22 nt, Homo sapiens
cacuaggcuggagugcaguggc

SEQ ID NO: 309233 - RNA, 22 nt, Homo sapiens
cacugcacuccagcuugugggc

SEQ ID NO: 309234 - RNA, 21 nt, Homo sapiens
cacugcacuugccuucugggu

SEQ ID NO: 309235 - RNA, 22 nt, Homo sapiens
cacugcaguaaauugcgucggu

SEQ ID NO: 309236 - RNA, 22 nt, Homo sapiens
cacugcaguggaagauuaagaa

SEQ ID NO: 309237 - RNA, 22 nt, Homo sapiens
cacugcauccuccaccugccag

SEQ ID NO: 309238 - RNA, 22 nt, Homo sapiens
cacugcauccuugaccuucugg

SEQ ID NO: 309239 - RNA, 22 nt, Homo sapiens
cacugcauuacucaugagcaug

SEQ ID NO: 309240 - RNA, 22 nt, Homo sapiens
cagaaguauugguaugcucugu

SEQ ID NO: 309241 - RNA, 22 nt, Homo sapiens
cagagagcuugcccuuguauau

SEQ ID NO: 309242 - RNA, 22 nt, Homo sapiens
cagccggguggcuccuagggua

SEQ ID NO: 309243 - RNA, 22 nt, Homo sapiens
caggugaaugccucuccuucug

SEQ ID NO: 309244 - RNA, 22 nt, Homo sapiens
caggugcuuacuuaauagccau

SEQ ID NO: 309245 - RNA, 22 nt, Homo sapiens
cauacagcuaguaaguguaaga

SEQ ID NO: 309246 - RNA, 22 nt, Homo sapiens
cauagcacugagcucuacccuc

SEQ ID NO: 309247 - RNA, 22 nt, Homo sapiens
cauauucacuuuacagagcugu

SEQ ID NO: 309248 - RNA, 22 nt, Homo sapiens
aaauucaucaaaugguuuguau

SEQ ID NO: 309249 - RNA, 22 nt, Homo sapiens
aagcacaauuucaccuucuugu

SEQ ID NO: 309250 - RNA, 22 nt, Homo sapiens
aagcuccauuucugccaugaga

SEQ ID NO: 309251 - RNA, 22 nt, Homo sapiens
aagggaauguuguggcugguuu

SEQ ID NO: 309252 - RNA, 17 nt, Homo sapiens
aaggugcuucgaccucc

SEQ ID NO: 309253 - RNA, 19 nt, Homo sapiens
aaguaguugugacagaugc

SEQ ID NO: 309254 - RNA, 23 nt, Homo sapiens
aagugagcuccaauugggugaga

SEQ ID NO: 309255 - RNA, 22 nt, Homo sapiens
aauacuggcacugaagaccaug

SEQ ID NO: 309256 - RNA, 22 nt, Homo sapiens
aauaugucugcuaauuguuucu

SEQ ID NO: 309257 - RNA, 22 nt, Homo sapiens
aaucuguagaaggugcacauuc

SEQ ID NO: 309258 - RNA, 17 nt, Homo sapiens
aaugagacauuucugcu

SEQ ID NO: 309259 - RNA, 23 nt, Homo sapiens
aauugcuuuugaggacuuaguug

SEQ ID NO: 309260 - RNA, 22 nt, Homo sapiens
acacuggaggagagcuguugcu

SEQ ID NO: 309261 - RNA, 20 nt, Homo sapiens
acacuggaguaucaaggccc

SEQ ID NO: 309262 - RNA, 22 nt, Homo sapiens
acaggagugggauuugaguccu

SEQ ID NO: 309263 - RNA, 23 nt, Homo sapiens
acaguggugugaucuuggcucag

SEQ ID NO: 309264 - RNA, 18 nt, Homo sapiens
acagugucauggcucaau

SEQ ID NO: 309265 - RNA, 19 nt, Homo sapiens
acagugucucuauaaugau

SEQ ID NO: 309266 - RNA, 22 nt, Homo sapiens
acaguuaugugagggccaccag

SEQ ID NO: 309267 - RNA, 22 nt, Homo sapiens
acaugcauauguuggaagaaag

SEQ ID NO: 309268 - RNA, 22 nt, Homo sapiens
acauucagcuguuguuucaaug

SEQ ID NO: 309269 - RNA, 19 nt, Homo sapiens
accagauugcauucuugga

SEQ ID NO: 309270 - RNA, 22 nt, Homo sapiens
acccggagagcaggcgagaagg

SEQ ID NO: 309271 - RNA, 22 nt, Homo sapiens
acccucagaccaguuucccugg

SEQ ID NO: 309272 - RNA, 23 nt, Homo sapiens
accugugguuauuuuacucuucc

SEQ ID NO: 309273 - RNA, 22 nt, Homo sapiens
acugcacuccacccuuggcagc

SEQ ID NO: 309274 - RNA, 18 nt, Homo sapiens
acugcacuccaccuuggg

SEQ ID NO: 309275 - RNA, 22 nt, Homo sapiens
acugcacuccagccucaugaca

SEQ ID NO: 309276 - RNA, 22 nt, Homo sapiens
acugcacuccagccuccugggu

SEQ ID NO: 309277 - RNA, 22 nt, Homo sapiens
acugcacuccagccucgugaca

SEQ ID NO: 309278 - RNA, 22 nt, Homo sapiens
acugcacuccagccucguggac

SEQ ID NO: 309279 - RNA, 22 nt, Homo sapiens
acugcacuccagccugcccaac

SEQ ID NO: 309280 - RNA, 22 nt, Homo sapiens
acugcacuccagccugcuggau

SEQ ID NO: 309281 - RNA, 20 nt, Homo sapiens
acugcacuccagccuuccag

SEQ ID NO: 309282 - RNA, 22 nt, Homo sapiens
acugcacuccagccuucggaca

SEQ ID NO: 309283 - RNA, 22 nt, Homo sapiens
acugcacuccagccuucgugac

SEQ ID NO: 309284 - RNA, 22 nt, Homo sapiens
acugcacuccagccuugauggc

SEQ ID NO: 309285 - RNA, 22 nt, Homo sapiens
acugcacuccagccuugcgaca

SEQ ID NO: 309286 - RNA, 22 nt, Homo sapiens
acugcacuccagccuuggcaac

SEQ ID NO: 309287 - RNA, 22 nt, Homo sapiens
acugcacuccagccuuggcggc

SEQ ID NO: 309288 - RNA, 22 nt, Homo sapiens
acugcacuccagccuugugaca

SEQ ID NO: 309289 - RNA, 22 nt, Homo sapiens
acugcacuccagcuuuggguga

SEQ ID NO: 309290 - RNA, 22 nt, Homo sapiens
acugcacuccagcuuuggugac

SEQ ID NO: 309291 - RNA, 20 nt, Homo sapiens
acugcacuccagucucuggg

SEQ ID NO: 309292 - RNA, 22 nt, Homo sapiens
acugcacuccuccuugggugac

SEQ ID NO: 309293 - RNA, 22 nt, Homo sapiens
acugcacucuagccccugcgac

SEQ ID NO: 309294 - RNA, 22 nt, Homo sapiens
acugcacugcagccuggccaac

SEQ ID NO: 309295 - RNA, 22 nt, Homo sapiens
uucccagagccugggagugagg

SEQ ID NO: 309296 - RNA, 22 nt, Homo sapiens
uuccugugacuguguggcaccc

SEQ ID NO: 309297 - RNA, 22 nt, Homo sapiens
uucucugggacauaggucgggu

SEQ ID NO: 309298 - RNA, 22 nt, Homo sapiens
uucuucaggcauucccagaagc

SEQ ID NO: 309299 - RNA, 22 nt, Homo sapiens
uucuucaguuacaacaaggggg

SEQ ID NO: 309300 - RNA, 20 nt, Homo sapiens
uucuugaguuaacaaguuac

SEQ ID NO: 309301 - RNA, 22 nt, Homo sapiens
uucuuuggauaaaguuuuaugc

SEQ ID NO: 309302 - RNA, 22 nt, Homo sapiens
uugaaagucuaggcuuacagua

SEQ ID NO: 309303 - RNA, 22 nt, Homo sapiens
uugaacuagaaccugcaaauuu

SEQ ID NO: 309304 - RNA, 22 nt, Homo sapiens
uugaaguagguaccguucaauu

SEQ ID NO: 309305 - RNA, 22 nt, Homo sapiens
uugacuacaccaugccaggaac

SEQ ID NO: 309306 - RNA, 22 nt, Homo sapiens
uugagauggagucuugcgcugu

SEQ ID NO: 309307 - RNA, 22 nt, Homo sapiens
uugagauggagucuugcucugu

SEQ ID NO: 309308 - RNA, 22 nt, Homo sapiens
uugagauggagucuuguucucu

SEQ ID NO: 309309 - RNA, 22 nt, Homo sapiens
uugagauggagucuuguucuuu

SEQ ID NO: 309310 - RNA, 22 nt, Homo sapiens
uugagcacauguguuaaggggu

SEQ ID NO: 309311 - RNA, 22 nt, Homo sapiens
uugagcucuuccagccuggagc

SEQ ID NO: 309312 - RNA, 22 nt, Homo sapiens
uugauauucugagaagcugaag

SEQ ID NO: 309313 - RNA, 22 nt, Homo sapiens
uugaucaauagaauacaacaga

SEQ ID NO: 309314 - RNA, 22 nt, Homo sapiens
uugcacuccagccuuggggaga

SEQ ID NO: 309315 - RNA, 22 nt, Homo sapiens
uugcacuccagcucgggugaca

SEQ ID NO: 309316 - RNA, 22 nt, Homo sapiens
uugcacucuagccugggugaca

SEQ ID NO: 309317 - RNA, 22 nt, Homo sapiens
uugcacucuccagccucggcaa

SEQ ID NO: 309318 - RNA, 22 nt, Homo sapiens
uugcagaucccacacucacccu

SEQ ID NO: 309319 - RNA, 22 nt, Homo sapiens
uugcagcauucugguuccuggu

SEQ ID NO: 309320 - RNA, 22 nt, Homo sapiens
uuggaaauauguuaagugucau

SEQ ID NO: 309321 - RNA, 22 nt, Homo sapiens
uuggaaaugguaaaggguuaau

SEQ ID NO: 309322 - RNA, 23 nt, Homo sapiens
uuggaaugagaccuaagaguuuu

SEQ ID NO: 309323 - RNA, 22 nt, Homo sapiens
uuggaauguacucuagccuaug

SEQ ID NO: 309324 - RNA, 22 nt, Homo sapiens
uuggaauuuuaaaauaggcaac

SEQ ID NO: 309325 - RNA, 22 nt, Homo sapiens
uuggcaaauagguuuuauugca

SEQ ID NO: 309326 - RNA, 22 nt, Homo sapiens
uuguaacaguucugcgagcagc

SEQ ID NO: 309327 - RNA, 22 nt, Homo sapiens
uuguaguagcauuauuuauaau

SEQ ID NO: 309328 - RNA, 22 nt, Homo sapiens
uuguauaggcucaguaagaauc

SEQ ID NO: 309329 - RNA, 22 nt, Homo sapiens
uugucacuauaaauaagcauuu

SEQ ID NO: 309330 - RNA, 21 nt, Homo sapiens
uugucuagagaaauauaucuc

SEQ ID NO: 309331 - RNA, 22 nt, Homo sapiens
uugugaaaucuaggcagagguu

SEQ ID NO: 309332 - RNA, 23 nt, Homo sapiens
uuguucccuuccacucagucucc

SEQ ID NO: 309333 - RNA, 22 nt, Homo sapiens
uuuagcaauucauuuugugucu

SEQ ID NO: 309334 - RNA, 22 nt, Homo sapiens
uuuauugcucuaaaguugccau

SEQ ID NO: 309335 - RNA, 22 nt, Homo sapiens
uuucauggcgaggcuucauggg

SEQ ID NO: 309336 - RNA, 22 nt, Homo sapiens
uuucugugguccucuugaaggu

SEQ ID NO: 309337 - RNA, 19 nt, Homo sapiens
uuugaauauaaugcagcua

SEQ ID NO: 309338 - RNA, 18 nt, Homo sapiens
uuugacugguguccuuau

SEQ ID NO: 309339 - RNA, 22 nt, Homo sapiens
uuugcaguguaguuggccagca

SEQ ID NO: 309340 - RNA, 22 nt, Homo sapiens
uuugcugagucugacuucaugg

SEQ ID NO: 309341 - RNA, 22 nt, Homo sapiens
uuugcuugaggucuagcuaccc

SEQ ID NO: 309342 - RNA, 22 nt, Homo sapiens
uuugggacuguauuaaaugccu

SEQ ID NO: 309343 - RNA, 22 nt, Homo sapiens
uuugguuauauauauacacucu

SEQ ID NO: 309344 - RNA, 22 nt, Homo sapiens
uuugguuauuugaaacuagcau

SEQ ID NO: 309345 - RNA, 22 nt, Homo sapiens
uuuguacucccuuuagauaaaa

SEQ ID NO: 309346 - RNA, 21 nt, Homo sapiens
uuuuugguggucauggauaga

SEQ ID NO: 309347 - RNA, 22 nt, Homo sapiens
aaaguaguagcaguuucugcca

SEQ ID NO: 309348 - RNA, 22 nt, Homo sapiens
aaaugcuuucuuggaccauuug

SEQ ID NO: 309349 - RNA, 22 nt, Homo sapiens
aaaugucauggaguguuucccc

SEQ ID NO: 309350 - RNA, 22 nt, Homo sapiens
aaauucaugucaccucuaggua

SEQ ID NO: 309351 - RNA, 22 nt, Homo sapiens
aacaggguggugccugguccau

SEQ ID NO: 309352 - RNA, 22 nt, Homo sapiens
aacugcacauauuuguaugggu

SEQ ID NO: 309353 - RNA, 22 nt, Homo sapiens
aacugcacuaggacagguuuuu

SEQ ID NO: 309354 - RNA, 22 nt, Homo sapiens
aagauaguaaacauuuucugcu

SEQ ID NO: 309355 - RNA, 22 nt, Homo sapiens
aaggcaagguggauaaugaagc

SEQ ID NO: 309356 - RNA, 22 nt, Homo sapiens
aaggcaguggcagaagauguca

SEQ ID NO: 309357 - RNA, 22 nt, Homo sapiens
aaggcagugugcacauaacacu

SEQ ID NO: 309358 - RNA, 22 nt, Homo sapiens
aagggaauguuguggcugguug

SEQ ID NO: 309359 - RNA, 18 nt, Homo sapiens
aaggugcuucuguucuga

SEQ ID NO: 309360 - RNA, 22 nt, Homo sapiens
aaguaauggaguuauuuuauga

SEQ ID NO: 309361 - RNA, 22 nt, Homo sapiens
aaguaguuaggaacauucucuc

SEQ ID NO: 309362 - RNA, 22 nt, Homo sapiens
aagugcugggauuggccgggca

SEQ ID NO: 309363 - RNA, 22 nt, Homo sapiens
aagugguagggucaggauugga

SEQ ID NO: 309364 - RNA, 22 nt, Homo sapiens
aauaagaaguggaagggaccgg

SEQ ID NO: 309365 - RNA, 22 nt, Homo sapiens
aauacagcacacagaugggucu

SEQ ID NO: 309366 - RNA, 22 nt, Homo sapiens
aaucucagcauuuugggcugag

SEQ ID NO: 309367 - RNA, 22 nt, Homo sapiens
aaugcacauaaaauccuccagg

SEQ ID NO: 309368 - RNA, 22 nt, Homo sapiens
aauggcuucuuauugugguuca

SEQ ID NO: 309369 - RNA, 22 nt, Homo sapiens
acagcacugccaagugacccau

SEQ ID NO: 309370 - RNA, 22 nt, Homo sapiens
acagugcuuuuguuccucuccu

SEQ ID NO: 309371 - RNA, 22 nt, Homo sapiens
acaugagacuggguuuguaggg

SEQ ID NO: 309372 - RNA, 22 nt, Homo sapiens
acauugcagauguguuuaaugu

SEQ ID NO: 309373 - RNA, 22 nt, Homo sapiens
acccuuaagcacuaguucagcu

SEQ ID NO: 309374 - RNA, 21 nt, Homo sapiens
accugauguuucaguuggagu

SEQ ID NO: 309375 - RNA, 19 nt, Homo sapiens
acuaggccuacaaagcuau

SEQ ID NO: 309376 - RNA, 22 nt, Homo sapiens
acucugucuaguuguaaaauuu

SEQ ID NO: 309377 - RNA, 22 nt, Homo sapiens
acugagaucuuuaaauaaauaa

SEQ ID NO: 309378 - RNA, 22 nt, Homo sapiens
acugcacuccaaccuuggugac

SEQ ID NO: 309379 - RNA, 20 nt, Homo sapiens
acugcacuccaaccuuugug

SEQ ID NO: 309380 - RNA, 22 nt, Homo sapiens
acugcacuccagccuccugaca

SEQ ID NO: 309381 - RNA, 22 nt, Homo sapiens
acugcacuccagccucgcaaca

SEQ ID NO: 309382 - RNA, 22 nt, Homo sapiens
acugcacuccagccucggugac

SEQ ID NO: 309383 - RNA, 22 nt, Homo sapiens
acugcacuccagccugaugaaa

SEQ ID NO: 309384 - RNA, 22 nt, Homo sapiens
acugcacuccagccugcugaca

SEQ ID NO: 309385 - RNA, 22 nt, Homo sapiens
acugcacuccagccuggaccac

SEQ ID NO: 309386 - RNA, 22 nt, Homo sapiens
acugcacuccagccuggacgaa

SEQ ID NO: 309387 - RNA, 22 nt, Homo sapiens
acugcacuccagccugugcgua

SEQ ID NO: 309388 - RNA, 22 nt, Homo sapiens
acugcacuccagccuugagagc

SEQ ID NO: 309389 - RNA, 22 nt, Homo sapiens
acugcacuccagccuuugcgau

SEQ ID NO: 309390 - RNA, 22 nt, Homo sapiens
acugcacuccagcuccagggug

SEQ ID NO: 309391 - RNA, 22 nt, Homo sapiens
acugcacuccaguuugggcagc

SEQ ID NO: 309392 - RNA, 18 nt, Homo sapiens
acugcacuccauccuagg

SEQ ID NO: 309393 - RNA, 22 nt, Homo sapiens
acugcacucccgcccgggugac

SEQ ID NO: 309394 - RNA, 22 nt, Homo sapiens
acugcacuguccuagaguccuc

SEQ ID NO: 309395 - RNA, 22 nt, Homo sapiens
acugcacuucagccuguugaca

SEQ ID NO: 309396 - RNA, 22 nt, Homo sapiens
acugcacuucagccuugggaaa

SEQ ID NO: 309397 - RNA, 18 nt, Homo sapiens
acuggauguaaagggucc

SEQ ID NO: 309398 - RNA, 20 nt, Homo sapiens
acugggcuaccgaaguaagg

SEQ ID NO: 309399 - RNA, 22 nt, Homo sapiens
acuucauucucuggaucagaau

SEQ ID NO: 309400 - RNA, 19 nt, Homo sapiens
acuuuggugauuagaggga

SEQ ID NO: 309401 - RNA, 22 nt, Homo sapiens
agaaauguuuacucacccccuu

SEQ ID NO: 309402 - RNA, 22 nt, Homo sapiens
agaagaacauagggugacugaa

SEQ ID NO: 309403 - RNA, 22 nt, Homo sapiens
agacacuguugaaaaggcccca

SEQ ID NO: 309404 - RNA, 19 nt, Homo sapiens
agacuggcccaggcgggug

SEQ ID NO: 309405 - RNA, 22 nt, Homo sapiens
agagacauugcuccaacucacc

SEQ ID NO: 309406 - RNA, 20 nt, Homo sapiens
gacauguuuuguggccuaac

SEQ ID NO: 309407 - RNA, 22 nt, Homo sapiens
gaccuguaguuuaguugccugu

SEQ ID NO: 309408 - RNA, 22 nt, Homo sapiens
gacucagaacuaaggguguuuc

SEQ ID NO: 309409 - RNA, 22 nt, Homo sapiens
gagaacauuaauaguuaauuuu

SEQ ID NO: 309410 - RNA, 22 nt, Homo sapiens
gagaacugacauuaucguguau

SEQ ID NO: 309411 - RNA, 22 nt, Homo sapiens
gagacauugacuuuguuccaga

SEQ ID NO: 309412 - RNA, 22 nt, Homo sapiens
gagacugagucuugcucuguca

SEQ ID NO: 309413 - RNA, 22 nt, Homo sapiens
gagacugagucuugcuuuguca

SEQ ID NO: 309414 - RNA, 22 nt, Homo sapiens
gagagaguacuugauauaauuu

SEQ ID NO: 309415 - RNA, 22 nt, Homo sapiens
gagagcaugugcuggcaucagu

SEQ ID NO: 309416 - RNA, 22 nt, Homo sapiens
gagauaaauaggucacaguucu

SEQ ID NO: 309417 - RNA, 22 nt, Homo sapiens
gaggcagucuguccauucucag

SEQ ID NO: 309418 - RNA, 22 nt, Homo sapiens
gaggcaguguguccguucucgg

SEQ ID NO: 309419 - RNA, 22 nt, Homo sapiens
gaggcuagauggggaugugucc

SEQ ID NO: 309420 - RNA, 22 nt, Homo sapiens
gagguaagaaagucaguccuuc

SEQ ID NO: 309421 - RNA, 22 nt, Homo sapiens
gagguauggauaucuggagagg

SEQ ID NO: 309422 - RNA, 22 nt, Homo sapiens
gauaauucuagcagauacaggc

SEQ ID NO: 309423 - RNA, 22 nt, Homo sapiens
gauagcagccauucuuuuuauu

SEQ ID NO: 309424 - RNA, 22 nt, Homo sapiens
gauauguaaaaauuauaucuga

SEQ ID NO: 309425 - RNA, 22 nt, Homo sapiens
gauauugacuuauucuauguuu

SEQ ID NO: 309426 - RNA, 22 nt, Homo sapiens
gaugagguaguguaccuagucu

SEQ ID NO: 309427 - RNA, 22 nt, Homo sapiens
gcacauauguaaauagcugccu

SEQ ID NO: 309428 - RNA, 22 nt, Homo sapiens
gcacgugcucauuugaggucuu

SEQ ID NO: 309429 - RNA, 19 nt, Homo sapiens
gcaucauuaguugcuuuuc

SEQ ID NO: 309430 - RNA, 22 nt, Homo sapiens
gcauggccuuuaaaugucacag

SEQ ID NO: 309431 - RNA, 22 nt, Homo sapiens
gcuaugucuguugcucuugggc

SEQ ID NO: 309432 - RNA, 22 nt, Homo sapiens
gcugauggugcaguucuagccu

SEQ ID NO: 309433 - RNA, 22 nt, Homo sapiens
gcugcuuuugaugacaaaaaca

SEQ ID NO: 309434 - RNA, 22 nt, Homo sapiens
ggaagaauaaugggccuuagag

SEQ ID NO: 309435 - RNA, 22 nt, Homo sapiens
ggaaugcagugagcauuagaua

SEQ ID NO: 309436 - RNA, 20 nt, Homo sapiens
ggaauguuaaucuccaugau

SEQ ID NO: 309437 - RNA, 22 nt, Homo sapiens
ggaggcuaguaaaaagguagaa

SEQ ID NO: 309438 - RNA, 22 nt, Homo sapiens
ggauacauuuuuccuccucuuc

SEQ ID NO: 309439 - RNA, 22 nt, Homo sapiens
ggauggcauuucuuuagcuuuu

SEQ ID NO: 309440 - RNA, 22 nt, Homo sapiens
ggcagguaaggagugggagccu

SEQ ID NO: 309441 - RNA, 22 nt, Homo sapiens
ggcuagagacaaguugcugaga

SEQ ID NO: 309442 - RNA, 22 nt, Homo sapiens
ggcuauagauaugugaacacuu

SEQ ID NO: 309443 - RNA, 22 nt, Homo sapiens
ggcuuggaggaaugugagggcu

SEQ ID NO: 309444 - RNA, 22 nt, Homo sapiens
gggaggucauuguaaggucuua

SEQ ID NO: 309445 - RNA, 22 nt, Homo sapiens
ggucaggagaaugguaacugag

SEQ ID NO: 309446 - RNA, 22 nt, Homo sapiens
ggucuagagagagggguggacu

SEQ ID NO: 309447 - RNA, 23 nt, Homo sapiens
ggugaggaguacagagucuucau

SEQ ID NO: 309448 - RNA, 22 nt, Homo sapiens
guaagagcauguaguggcucua

SEQ ID NO: 309449 - RNA, 22 nt, Homo sapiens
guaaucucagcuacucgggaga

SEQ ID NO: 309450 - RNA, 22 nt, Homo sapiens
guaaucucagcuacuugggagg

SEQ ID NO: 309451 - RNA, 22 nt, Homo sapiens
guaaucucagcuacuugggagu

SEQ ID NO: 309452 - RNA, 22 nt, Homo sapiens
guaaucucagcuucuugggagg

SEQ ID NO: 309453 - RNA, 22 nt, Homo sapiens
guauacaguugacccuugaacc

SEQ ID NO: 309454 - RNA, 22 nt, Homo sapiens
guaugcacauauguguauguau

SEQ ID NO: 309455 - RNA, 22 nt, Homo sapiens
guauuagaugguauuugaagau

SEQ ID NO: 309456 - RNA, 22 nt, Homo sapiens
guauuugauuauagcaugcuua

SEQ ID NO: 309457 - RNA, 22 nt, Homo sapiens
gucacaguguuuguucauccca

SEQ ID NO: 309458 - RNA, 22 nt, Homo sapiens
guccaugagaugaauccacaca

SEQ ID NO: 309459 - RNA, 22 nt, Homo sapiens
gucugucuuuugucuuugaaau

SEQ ID NO: 309460 - RNA, 22 nt, Homo sapiens
gucuugaaggcugaguaccugu

SEQ ID NO: 309461 - RNA, 20 nt, Homo sapiens
gugagaacaugugguauuug

SEQ ID NO: 309462 - RNA, 22 nt, Homo sapiens
gugagaacugcuggggccacag

SEQ ID NO: 309463 - RNA, 22 nt, Homo sapiens
gugagaauauuuuaaauacuaa

SEQ ID NO: 309464 - RNA, 22 nt, Homo sapiens
gugagaugguaucucauugugg

SEQ ID NO: 309465 - RNA, 22 nt, Homo sapiens
gagcacauaugacauuuucuuc

SEQ ID NO: 309466 - RNA, 22 nt, Homo sapiens
gaggcauugaaauauugcuuau

SEQ ID NO: 309467 - RNA, 22 nt, Homo sapiens
gagguguaaggacaacagagac

SEQ ID NO: 309468 - RNA, 22 nt, Homo sapiens
gaguaacagcauaaauuuguga

SEQ ID NO: 309469 - RNA, 22 nt, Homo sapiens
gagugcaauggugccaucucgg

SEQ ID NO: 309470 - RNA, 23 nt, Homo sapiens
gaguggagacucauugauuuccu

SEQ ID NO: 309471 - RNA, 22 nt, Homo sapiens
gaguuguuuuaaggcacugacu

SEQ ID NO: 309472 - RNA, 22 nt, Homo sapiens
gaucacauuguuucauacauau

SEQ ID NO: 309473 - RNA, 22 nt, Homo sapiens
gaugcagcuaggauuugugaca

SEQ ID NO: 309474 - RNA, 22 nt, Homo sapiens
gauggaauuaaaaucagaauca

SEQ ID NO: 309475 - RNA, 22 nt, Homo sapiens
gcacauuacaaguauuagcuca

SEQ ID NO: 309476 - RNA, 22 nt, Homo sapiens
gcagcauuaccaagacauggca

SEQ ID NO: 309477 - RNA, 22 nt, Homo sapiens
gcauggauguugauggcugcug

SEQ ID NO: 309478 - RNA, 22 nt, Homo sapiens
gcauguaguagauguugaauaa

SEQ ID NO: 309479 - RNA, 22 nt, Homo sapiens
gcgcagugggcugugccaucca

SEQ ID NO: 309480 - RNA, 22 nt, Homo sapiens
gcugagaucucuugccugaacu

SEQ ID NO: 309481 - RNA, 22 nt, Homo sapiens
gcuggguucagagugggcugcg

SEQ ID NO: 309482 - RNA, 22 nt, Homo sapiens
gcuguauuguugaaggaaaugu

SEQ ID NO: 309483 - RNA, 22 nt, Homo sapiens
ggaagaauauuaggggauuucg

SEQ ID NO: 309484 - RNA, 20 nt, Homo sapiens
ggagagugacauaauucugg

SEQ ID NO: 309485 - RNA, 22 nt, Homo sapiens
ggcuagaugcuagagauaucau

SEQ ID NO: 309486 - RNA, 22 nt, Homo sapiens
gggauuguaauacugaguuggu

SEQ ID NO: 309487 - RNA, 22 nt, Homo sapiens
guaaucucagcuacuugggagc

SEQ ID NO: 309488 - RNA, 19 nt, Homo sapiens
guaaucucaguacuuuggu

SEQ ID NO: 309489 - RNA, 23 nt, Homo sapiens
guaguuugaugcaauccacuugu

SEQ ID NO: 309490 - RNA, 22 nt, Homo sapiens
guauacuucugaaaauagcuau

SEQ ID NO: 309491 - RNA, 22 nt, Homo sapiens
guauagcacauaauacuugaug

SEQ ID NO: 309492 - RNA, 22 nt, Homo sapiens
gucaacauauuaauuauguucu

SEQ ID NO: 309493 - RNA, 22 nt, Homo sapiens
gucacugucuacuguaauagcc

SEQ ID NO: 309494 - RNA, 22 nt, Homo sapiens
gucacuguuuccuauuauauuu

SEQ ID NO: 309495 - RNA, 22 nt, Homo sapiens
gucagauaauuugcauccaucu

SEQ ID NO: 309496 - RNA, 22 nt, Homo sapiens
gucagugauugauuuaaagacg

SEQ ID NO: 309497 - RNA, 22 nt, Homo sapiens
gucauugcacuccagccuggac

SEQ ID NO: 309498 - RNA, 22 nt, Homo sapiens
guccaaagugggagaggugggg

SEQ ID NO: 309499 - RNA, 22 nt, Homo sapiens
gucgugcagaccucacagcauu

SEQ ID NO: 309500 - RNA, 22 nt, Homo sapiens
gugacauuauuucagcuacaug

SEQ ID NO: 309501 - RNA, 22 nt, Homo sapiens
gugagaaucaaacuacauaaau

SEQ ID NO: 309502 - RNA, 22 nt, Homo sapiens
gugagaugaggucucacucugu

SEQ ID NO: 309503 - RNA, 22 nt, Homo sapiens
gugagguaagaguugcuuugcu

SEQ ID NO: 309504 - RNA, 22 nt, Homo sapiens
gugaucuuucaggcuugaccau

SEQ ID NO: 309505 - RNA, 22 nt, Homo sapiens
gugcacauauggugcauaagug

SEQ ID NO: 309506 - RNA, 22 nt, Homo sapiens
gugcacaugguagguauugagu

SEQ ID NO: 309507 - RNA, 22 nt, Homo sapiens
guggaaugauaucucauugugg

SEQ ID NO: 309508 - RNA, 22 nt, Homo sapiens
guggacggagguugcagugagc

SEQ ID NO: 309509 - RNA, 22 nt, Homo sapiens
guguaaaacaauuagaggauuu

SEQ ID NO: 309510 - RNA, 22 nt, Homo sapiens
guuaaagacauccacauaggag

SEQ ID NO: 309511 - RNA, 17 nt, Homo sapiens
guucccaguggcauuug

SEQ ID NO: 309512 - RNA, 22 nt, Homo sapiens
guugcacagucuuuccuggacu

SEQ ID NO: 309513 - RNA, 22 nt, Homo sapiens
guugguauuacagaaauuaguu

SEQ ID NO: 309514 - RNA, 22 nt, Homo sapiens
uaaacugucuugcaguuacaug

SEQ ID NO: 309515 - RNA, 20 nt, Homo sapiens
uaaagcugcucagggggcuc

SEQ ID NO: 309516 - RNA, 22 nt, Homo sapiens
uaacaagagagucagucagucc

SEQ ID NO: 309517 - RNA, 22 nt, Homo sapiens
uaacagucaagguuugaccagg

SEQ ID NO: 309518 - RNA, 22 nt, Homo sapiens
uaagacuuuuugggaauauaga

SEQ ID NO: 309519 - RNA, 22 nt, Homo sapiens
uaaggcauuuuuuugaguugca

SEQ ID NO: 309520 - RNA, 22 nt, Homo sapiens
uaaguaguauaagguuuuuuga

SEQ ID NO: 309521 - RNA, 22 nt, Homo sapiens
uaauagagucauuauuauuguu

SEQ ID NO: 309522 - RNA, 22 nt, Homo sapiens
uaaugcuugguuguuuggaaaa

SEQ ID NO: 309523 - RNA, 22 nt, Homo sapiens
uacagguaugugucuauauaca

SEQ ID NO: 309524 - RNA, 16 nt, Homo sapiens
uacauuuguuacaugg

SEQ ID NO: 309525 - RNA, 22 nt, Homo sapiens
uacugcacuccaaccugagaga

SEQ ID NO: 309526 - RNA, 22 nt, Homo sapiens
uacugcacuccacccuggguga

SEQ ID NO: 309527 - RNA, 22 nt, Homo sapiens
uacugcacuccagccugggaga

SEQ ID NO: 309528 - RNA, 22 nt, Homo sapiens
uacugcacuccagccuugccaa

SEQ ID NO: 309529 - RNA, 19 nt, Homo sapiens
uacugcacuccagucuggg

SEQ ID NO: 309530 - RNA, 18 nt, Homo sapiens
uacugcacucuccagccu

SEQ ID NO: 309531 - RNA, 22 nt, Homo sapiens
uacugcacuggaggccucagau

SEQ ID NO: 309532 - RNA, 20 nt, Homo sapiens
uacugcacuuuccucauggu

SEQ ID NO: 309533 - RNA, 22 nt, Homo sapiens
uacugcauuucacuguuaaaga

SEQ ID NO: 309534 - RNA, 22 nt, Homo sapiens
uagaauggaagguugagaagaa

SEQ ID NO: 309535 - RNA, 22 nt, Homo sapiens
uagagauccuucacuaggggca

SEQ ID NO: 309536 - RNA, 22 nt, Homo sapiens
uagagguauguauaguauucuu

SEQ ID NO: 309537 - RNA, 22 nt, Homo sapiens
uagauaguaaagccauuagcuu

SEQ ID NO: 309538 - RNA, 22 nt, Homo sapiens
uagauucaucuguuccuuuuga

SEQ ID NO: 309539 - RNA, 22 nt, Homo sapiens
uaggcaaaugcaagaguagaac

SEQ ID NO: 309540 - RNA, 19 nt, Homo sapiens
uagggcacgaggcagaguc

SEQ ID NO: 309541 - RNA, 22 nt, Homo sapiens
uaguagagauggggcacaugcc

SEQ ID NO: 309542 - RNA, 22 nt, Homo sapiens
uauagagguagguuaauuggaa

SEQ ID NO: 309543 - RNA, 22 nt, Homo sapiens
uauagcagugaguauugacuaa

SEQ ID NO: 309544 - RNA, 21 nt, Homo sapiens
uaucagagacauugagaggca

SEQ ID NO: 309545 - RNA, 22 nt, Homo sapiens
ucaagcaauucugcugccucag

SEQ ID NO: 309546 - RNA, 22 nt, Homo sapiens
ucacauggaaaaguccaguaaa

SEQ ID NO: 309547 - RNA, 22 nt, Homo sapiens
ucacugcacuagguaaugccac

SEQ ID NO: 309548 - RNA, 22 nt, Homo sapiens
ucacugcacucuccgccuugcg

SEQ ID NO: 309549 - RNA, 22 nt, Homo sapiens
ucacuggaggagaggaagugga

SEQ ID NO: 309550 - RNA, 22 nt, Homo sapiens
ucacuggagguuccugaaguuc

SEQ ID NO: 309551 - RNA, 22 nt, Homo sapiens
ucagaucaguuccacaagaacu

SEQ ID NO: 309552 - RNA, 22 nt, Homo sapiens
ucagcagugccccacucuacug

SEQ ID NO: 309553 - RNA, 22 nt, Homo sapiens
ucagugcuuggcacagagagcu

SEQ ID NO: 309554 - RNA, 22 nt, Homo sapiens
ucagugucugcauucuuauugu

SEQ ID NO: 309555 - RNA, 23 nt, Homo sapiens
ucagugucuggauccugcucagu

SEQ ID NO: 309556 - RNA, 22 nt, Homo sapiens
ucauaucauuagaucuacugua

SEQ ID NO: 309557 - RNA, 22 nt, Homo sapiens
uccaauguaaucaucauugaau

SEQ ID NO: 309558 - RNA, 22 nt, Homo sapiens
uccaugagaauaguuaggcucu

SEQ ID NO: 309559 - RNA, 19 nt, Homo sapiens
uccaugagcccacagugau

SEQ ID NO: 309560 - RNA, 22 nt, Homo sapiens
ucccuggagcaagagaagaagg

SEQ ID NO: 309561 - RNA, 22 nt, Homo sapiens
uccuucauuugucaacucuagu

SEQ ID NO: 309562 - RNA, 22 nt, Homo sapiens
uccuugagaggacagagccaua

SEQ ID NO: 309563 - RNA, 21 nt, Homo sapiens
uccuuggugaugcccugcagu

SEQ ID NO: 309564 - RNA, 22 nt, Homo sapiens
uccuugguugauccugugcaga

SEQ ID NO: 309565 - RNA, 19 nt, Homo sapiens
ucgcgccauucuccugccu

SEQ ID NO: 309566 - RNA, 22 nt, Homo sapiens
ucgugccacugcacuccagccu

SEQ ID NO: 309567 - RNA, 22 nt, Homo sapiens
ucucagcacagucagggcgccu

SEQ ID NO: 309568 - RNA, 22 nt, Homo sapiens
ucucagugaauugguuuugucu

SEQ ID NO: 309569 - RNA, 22 nt, Homo sapiens
ucuccauuguccagaugaggaa

SEQ ID NO: 309570 - RNA, 19 nt, Homo sapiens
ucugacagccccagucaac

SEQ ID NO: 309571 - RNA, 22 nt, Homo sapiens
ucugagaucaugucugugcugu

SEQ ID NO: 309572 - RNA, 22 nt, Homo sapiens
ucugugaaaucauuuccuguaa

SEQ ID NO: 309573 - RNA, 22 nt, Homo sapiens
ucuuaguuggaaugggauaagg

SEQ ID NO: 309574 - RNA, 22 nt, Homo sapiens
ucuugcuuuugcagagcuucuc

SEQ ID NO: 309575 - RNA, 22 nt, Homo sapiens
ucuugguuuauugauggagagg

SEQ ID NO: 309576 - RNA, 22 nt, Homo sapiens
ucuuuagguguuauaguucaag

SEQ ID NO: 309577 - RNA, 22 nt, Homo sapiens
ugaaacacacauugcccuuuau

SEQ ID NO: 309578 - RNA, 20 nt, Homo sapiens
ugaaacacauggacuggggu

SEQ ID NO: 309579 - RNA, 22 nt, Homo sapiens
ugaaaugaucaguuugguuacu

SEQ ID NO: 309580 - RNA, 22 nt, Homo sapiens
ugaaauguaaguugucuagucu

SEQ ID NO: 309581 - RNA, 22 nt, Homo sapiens
ugaacagcaccuccuagaguug

SEQ ID NO: 309582 - RNA, 22 nt, Homo sapiens
ugaauagaaguggcaggaguag

SEQ ID NO: 309583 - RNA, 18 nt, Homo sapiens
ugacagcacaugugggga

SEQ ID NO: 309584 - RNA, 22 nt, Homo sapiens
ugacuauaguaaucacuucaca

SEQ ID NO: 309585 - RNA, 22 nt, Homo sapiens
ugacuugaacuucuaugucacc

SEQ ID NO: 309586 - RNA, 22 nt, Homo sapiens
ugagaacagauggcuuuauuau

SEQ ID NO: 309587 - RNA, 18 nt, Homo sapiens
ugagaacauguguacaca

SEQ ID NO: 309588 - RNA, 22 nt, Homo sapiens
ugagacggagucuugcuaaguu

SEQ ID NO: 309589 - RNA, 22 nt, Homo sapiens
ugagacugaguuuccaucuugu

SEQ ID NO: 309590 - RNA, 22 nt, Homo sapiens
ugagacugaguuucgcucuugu

SEQ ID NO: 309591 - RNA, 22 nt, Homo sapiens
ugagacugaguuuugccuuugu

SEQ ID NO: 309592 - RNA, 22 nt, Homo sapiens
ugagacugaguuuugcucuugu

SEQ ID NO: 309593 - RNA, 22 nt, Homo sapiens
ugagacugguaauguguagggc

SEQ ID NO: 309594 - RNA, 22 nt, Homo sapiens
ugagagcugguuguuuaaagga

SEQ ID NO: 309595 - RNA, 22 nt, Homo sapiens
ugagauaguuguagauguacau

SEQ ID NO: 309596 - RNA, 22 nt, Homo sapiens
ugagaucaguuguuauaauucu

SEQ ID NO: 309597 - RNA, 22 nt, Homo sapiens
ugagaucaugccacugcacuuc

SEQ ID NO: 309598 - RNA, 22 nt, Homo sapiens
ugagaucuucgcucuucacaga

SEQ ID NO: 309599 - RNA, 22 nt, Homo sapiens
ugagaugaagucucacucuguc

SEQ ID NO: 309600 - RNA, 22 nt, Homo sapiens
ugagaugaugggauaagagggc

SEQ ID NO: 309601 - RNA, 22 nt, Homo sapiens
ugagcaauaaaguuacacaguu

SEQ ID NO: 309602 - RNA, 21 nt, Homo sapiens
ugagcauuaguacaguaggga

SEQ ID NO: 309603 - RNA, 22 nt, Homo sapiens
ugagcuccuucauaaaaaggca

SEQ ID NO: 309604 - RNA, 22 nt, Homo sapiens
ugagcugagaucaugcuauugu

SEQ ID NO: 309605 - RNA, 22 nt, Homo sapiens
ugagcugagaucgugccauugu

SEQ ID NO: 309606 - RNA, 22 nt, Homo sapiens
ugagggaugcguacccuaugcc

SEQ ID NO: 309607 - RNA, 22 nt, Homo sapiens
ugagguuggguaauuuaugaag

SEQ ID NO: 309608 - RNA, 22 nt, Homo sapiens
ugagguugguauuacugucucu

SEQ ID NO: 309609 - RNA, 22 nt, Homo sapiens
ugaguacugauuuaagauacac

SEQ ID NO: 309610 - RNA, 22 nt, Homo sapiens
ugagugaggcugggcagucccu

SEQ ID NO: 309611 - RNA, 17 nt, Homo sapiens
ugauaagugugagguga

SEQ ID NO: 309612 - RNA, 22 nt, Homo sapiens
ugaugguuuuauaagggagagu

SEQ ID NO: 309613 - RNA, 18 nt, Homo sapiens
ugauugacuuauuuaggu

SEQ ID NO: 309614 - RNA, 22 nt, Homo sapiens
ugcacaguccagugcccacuga

SEQ ID NO: 309615 - RNA, 22 nt, Homo sapiens
ugcaccauugucaccuggguga

SEQ ID NO: 309616 - RNA, 20 nt, Homo sapiens
ugcaguguccucacuuguca

SEQ ID NO: 309617 - RNA, 22 nt, Homo sapiens
ugcauacacaagcauacaugua

SEQ ID NO: 309618 - RNA, 20 nt, Homo sapiens
ugcauguccucacuuacuug

SEQ ID NO: 309619 - RNA, 22 nt, Homo sapiens
ugccuggagagcuccuacauau

SEQ ID NO: 309620 - RNA, 22 nt, Homo sapiens
ugcuagaugaaguuugaguuuu

SEQ ID NO: 309621 - RNA, 22 nt, Homo sapiens
ugcugcaaacaggcaucugugg

SEQ ID NO: 309622 - RNA, 20 nt, Homo sapiens
ugcugcacuuaagcaugggc

SEQ ID NO: 309623 - RNA, 22 nt, Homo sapiens
uggaagugaacaaccaaggcag

SEQ ID NO: 309624 - RNA, 22 nt, Homo sapiens
uggaaguuaaaugacucuuucu

SEQ ID NO: 309625 - RNA, 17 nt, Homo sapiens
uggaaugucuaagccug

SEQ ID NO: 309626 - RNA, 22 nt, Homo sapiens
uggaauguggacucuuaugggg

SEQ ID NO: 309627 - RNA, 22 nt, Homo sapiens
uggacaugaagggcacaggagg

SEQ ID NO: 309628 - RNA, 22 nt, Homo sapiens
uggacugagauuucagcugcca

SEQ ID NO: 309629 - RNA, 22 nt, Homo sapiens
uggaauguuauggcuuuaaucu

SEQ ID NO: 309630 - RNA, 22 nt, Homo sapiens
uggaugaagagaugguaguugc

SEQ ID NO: 309631 - RNA, 23 nt, Homo sapiens
uggcauuuuuggcaaugccuucu

SEQ ID NO: 309632 - RNA, 22 nt, Homo sapiens
uggcucauuucuaaacccagcu

SEQ ID NO: 309633 - RNA, 22 nt, Homo sapiens
ugggguagaauagaauugauau

SEQ ID NO: 309634 - RNA, 22 nt, Homo sapiens
ugggugugaccgcucaaggggg

SEQ ID NO: 309635 - RNA, 22 nt, Homo sapiens
ugguguccugucucugcgcuug

SEQ ID NO: 309636 - RNA, 22 nt, Homo sapiens
ugucaugguguuaauuuuccug

SEQ ID NO: 309637 - RNA, 22 nt, Homo sapiens
ugucauucaggaaauucuaagu

SEQ ID NO: 309638 - RNA, 22 nt, Homo sapiens
ugugaugugaugagaaguuccu

SEQ ID NO: 309639 - RNA, 22 nt, Homo sapiens
ugugcacaaugugcagguuuga

SEQ ID NO: 309640 - RNA, 22 nt, Homo sapiens
ugugcgugugccuguaagaauu

SEQ ID NO: 309641 - RNA, 22 nt, Homo sapiens
uguguauaucacugcaugagug

SEQ ID NO: 309642 - RNA, 22 nt, Homo sapiens
uguuacagcagaauugaaagag

SEQ ID NO: 309643 - RNA, 22 nt, Homo sapiens
uguuauugagguuacuuauaag

SEQ ID NO: 309644 - RNA, 22 nt, Homo sapiens
uguuugcuuaacguggagccag

SEQ ID NO: 309645 - RNA, 22 nt, Homo sapiens
uuaaucucaggaguuugggacc

SEQ ID NO: 309646 - RNA, 22 nt, Homo sapiens
uuaauuguccaaguucaucucu

SEQ ID NO: 309647 - RNA, 22 nt, Homo sapiens
uuacaccuguaauccagcacuu

SEQ ID NO: 309648 - RNA, 22 nt, Homo sapiens
uuacagauggcacacucaaggg

SEQ ID NO: 309649 - RNA, 22 nt, Homo sapiens
uuaguuuaucagugguuucuga

SEQ ID NO: 309650 - RNA, 22 nt, Homo sapiens
uuauggccauucuuguaggagu

SEQ ID NO: 309651 - RNA, 22 nt, Homo sapiens
uuaugggucuuggaaugcaaua

SEQ ID NO: 309652 - RNA, 22 nt, Homo sapiens
uuauucagcaccugcuguguuc

SEQ ID NO: 309653 - RNA, 22 nt, Homo sapiens
uuauugcucauuugggcauucu

SEQ ID NO: 309654 - RNA, 22 nt, Homo sapiens
uuauugcuccagaggcugauuu

SEQ ID NO: 309655 - RNA, 23 nt, Homo sapiens
uucaacagguagacccucccugc

SEQ ID NO: 309656 - RNA, 22 nt, Homo sapiens
uucaacagugauggccuuugua

SEQ ID NO: 309657 - RNA, 22 nt, Homo sapiens
uucacagaguuauuuuuaugcu

SEQ ID NO: 309658 - RNA, 22 nt, Homo sapiens
uuccagaugggaguucuauucu

SEQ ID NO: 309659 - RNA, 22 nt, Homo sapiens
uuccaguguguucauccucaga

SEQ ID NO: 309660 - RNA, 22 nt, Homo sapiens
uucccaguaaacucuaucccuc

SEQ ID NO: 309661 - RNA, 22 nt, Homo sapiens
uucccucagaaacacacagccc

SEQ ID NO: 309662 - RNA, 22 nt, Homo sapiens
uuccuacugugcaaaguugcaa

SEQ ID NO: 309663 - RNA, 22 nt, Homo sapiens
uuccugagccuuguaucuagua

SEQ ID NO: 309664 - RNA, 22 nt, Homo sapiens
uuccugugacccccaagcccac

SEQ ID NO: 309665 - RNA, 20 nt, Homo sapiens
uuccuuaggcauuggaagaa

SEQ ID NO: 309666 - RNA, 22 nt, Homo sapiens
uucucaaggagccuucguaacu

SEQ ID NO: 309667 - RNA, 22 nt, Homo sapiens
uucucagcccccugacagucag

SEQ ID NO: 309668 - RNA, 19 nt, Homo sapiens
uucucugguuguacuaccc

SEQ ID NO: 309669 - RNA, 22 nt, Homo sapiens
uucuucaggccacaaaaauggu

SEQ ID NO: 309670 - RNA, 22 nt, Homo sapiens
uugaaaucuuccacagcccaag

SEQ ID NO: 309671 - RNA, 22 nt, Homo sapiens
uugaaguagcauuucaugucua

SEQ ID NO: 309672 - RNA, 22 nt, Homo sapiens
uugaaguauagaguuuaagaac

SEQ ID NO: 309673 - RNA, 22 nt, Homo sapiens
uugaaguaugaccgcugagaau

SEQ ID NO: 309674 - RNA, 22 nt, Homo sapiens
uugaauaguggugaaaguuuga

SEQ ID NO: 309675 - RNA, 22 nt, Homo sapiens
uugaaugucuauuaaguuguuu

SEQ ID NO: 309676 - RNA, 22 nt, Homo sapiens
uugacugggccagacagagauc

SEQ ID NO: 309677 - RNA, 22 nt, Homo sapiens
uugacugugguaauggaagcug

SEQ ID NO: 309678 - RNA, 22 nt, Homo sapiens
uugagaaucuuugcuaaaggaa

SEQ ID NO: 309679 - RNA, 22 nt, Homo sapiens
uugagauaggagcuguuguucu

SEQ ID NO: 309680 - RNA, 22 nt, Homo sapiens
uugagaucuuuuaggccuuugu

SEQ ID NO: 309681 - RNA, 22 nt, Homo sapiens
cuggagcaaaggugacucuugu

SEQ ID NO: 309682 - RNA, 19 nt, Homo sapiens
cuggcaaaugcuuuggcca

SEQ ID NO: 309683 - RNA, 22 nt, Homo sapiens
cugggaugugacuguugccccc

SEQ ID NO: 309684 - RNA, 22 nt, Homo sapiens
cuguaguuagcagaugaugaau

SEQ ID NO: 309685 - RNA, 19 nt, Homo sapiens
cugucacugaggaagacug

SEQ ID NO: 309686 - RNA, 22 nt, Homo sapiens
cuguccugcagagucagaauga

SEQ ID NO: 309687 - RNA, 22 nt, Homo sapiens
cuugacaaugcuucaggcugaa

SEQ ID NO: 309688 - RNA, 22 nt, Homo sapiens
cuuugauuauaaaaggguguuu

SEQ ID NO: 309689 - RNA, 22 nt, Homo sapiens
cuuugcacaucucugcuuuccc

SEQ ID NO: 309690 - RNA, 22 nt, Homo sapiens
cuuugggaccgcgguuuauacu

SEQ ID NO: 309691 - RNA, 22 nt, Homo sapiens
cuuugguuaauaggauauggca

SEQ ID NO: 309692 - RNA, 22 nt, Homo sapiens
gaaauguauuaaugaguugaaa

SEQ ID NO: 309693 - RNA, 22 nt, Homo sapiens
gaagaaguacaagacaaauuuu

SEQ ID NO: 309694 - RNA, 22 nt, Homo sapiens
gacagacacaauugauccauga

SEQ ID NO: 309695 - RNA, 22 nt, Homo sapiens
gagaacagaagcauuccuaauu

SEQ ID NO: 309696 - RNA, 22 nt, Homo sapiens
gagaacaguguuguauuuuuuc

SEQ ID NO: 309697 - RNA, 22 nt, Homo sapiens
gagaacugagauaagugauauu

SEQ ID NO: 309698 - RNA, 21 nt, Homo sapiens
gagaaucuuuucagggcaaac

SEQ ID NO: 309699 - RNA, 22 nt, Homo sapiens
gagacugagucucgcucugccg

SEQ ID NO: 309700 - RNA, 22 nt, Homo sapiens
gagacugagucuugcccuguca

SEQ ID NO: 309701 - RNA, 22 nt, Homo sapiens
gagacugaguuuugcucuuguu

SEQ ID NO: 309702 - RNA, 22 nt, Homo sapiens
gagagcuaggccacuggggcuu

SEQ ID NO: 309703 - RNA, 22 nt, Homo sapiens
gagaugaaaucuugcucuguca

SEQ ID NO: 309704 - RNA, 22 nt, Homo sapiens
gagaugaaguuaaggaucuuua

SEQ ID NO: 309705 - RNA, 22 nt, Homo sapiens
gagauggagacuuggccuuaaa

SEQ ID NO: 309706 - RNA, 22 nt, Homo sapiens
gagauggagucuuuuucuguca

SEQ ID NO: 309707 - RNA, 22 nt, Homo sapiens
gagaugguguuccacugccagu

SEQ ID NO: 309708 - RNA, 22 nt, Homo sapiens
gagauuaauacacaucaaaugc

SEQ ID NO: 309709 - RNA, 22 nt, Homo sapiens
agugguuuuaaguagagcauac

SEQ ID NO: 309710 - RNA, 22 nt, Homo sapiens
auaaagacacuuggcaugauuu

SEQ ID NO: 309711 - RNA, 22 nt, Homo sapiens
auaagucaauggaacagauuaa

SEQ ID NO: 309712 - RNA, 22 nt, Homo sapiens
auaaucaugucugaaaccuuug

SEQ ID NO: 309713 - RNA, 22 nt, Homo sapiens
auacugcacauuuagggaggga

SEQ ID NO: 309714 - RNA, 21 nt, Homo sapiens
auacuugcauccuuggagaga

SEQ ID NO: 309715 - RNA, 22 nt, Homo sapiens
auagagcuaccauagaauccag

SEQ ID NO: 309716 - RNA, 23 nt, Homo sapiens
auagagcuaggaugcagacagau

SEQ ID NO: 309717 - RNA, 22 nt, Homo sapiens
auagaggacugaggugaucuuu

SEQ ID NO: 309718 - RNA, 22 nt, Homo sapiens
auagcagacauuucaaggcagg

SEQ ID NO: 309719 - RNA, 22 nt, Homo sapiens
auagcauaucccacaugucaga

SEQ ID NO: 309720 - RNA, 22 nt, Homo sapiens
auagguauuuuuaaaugacugu

SEQ ID NO: 309721 - RNA, 22 nt, Homo sapiens
auauagcucuggcuggaugacu

SEQ ID NO: 309722 - RNA, 21 nt, Homo sapiens
auauuacuguuagaggacugc

SEQ ID NO: 309723 - RNA, 22 nt, Homo sapiens
auauuggucuucaagaccugug

SEQ ID NO: 309724 - RNA, 22 nt, Homo sapiens
aucacaguuuuaccauuuggua

SEQ ID NO: 309725 - RNA, 22 nt, Homo sapiens
aucacuguaaguuuacacuuug

SEQ ID NO: 309726 - RNA, 22 nt, Homo sapiens
aucacuguccacucaucuuucu

SEQ ID NO: 309727 - RNA, 22 nt, Homo sapiens
aucacugugauuucuacugugc

SEQ ID NO: 309728 - RNA, 21 nt, Homo sapiens
auccuucuuuuucaaccugug

SEQ ID NO: 309729 - RNA, 22 nt, Homo sapiens
aucgcgccauuguacuccagcc

SEQ ID NO: 309730 - RNA, 18 nt, Homo sapiens
augaccugcggguuauau

SEQ ID NO: 309731 - RNA, 22 nt, Homo sapiens
augagaaugauucuguuauggu

SEQ ID NO: 309732 - RNA, 22 nt, Homo sapiens
augagacuagaagagaauaaua

SEQ ID NO: 309733 - RNA, 22 nt, Homo sapiens
augagagcaacaccuucacuug

SEQ ID NO: 309734 - RNA, 22 nt, Homo sapiens
uuugauugguguaccugaaagu

SEQ ID NO: 309735 - RNA, 22 nt, Homo sapiens
uuugcaguuuauuccuggggcu

SEQ ID NO: 309736 - RNA, 22 nt, Homo sapiens
uuugcaugcuccuuaugagaau

SEQ ID NO: 309737 - RNA, 22 nt, Homo sapiens
uuuggcaacguuggaucccuca

SEQ ID NO: 309738 - RNA, 22 nt, Homo sapiens
uuugugaaugucauaagcucca

SEQ ID NO: 309739 - RNA, 22 nt, Homo sapiens
uuuugcacuagaaccagagguu

SEQ ID NO: 309740 - RNA, 22 nt, Homo sapiens
uuuuuauggccaauccucagaa

SEQ ID NO: 309741 - RNA, 22 nt, Homo sapiens
cccugagaugugaauuucagag

SEQ ID NO: 309742 - RNA, 22 nt, Homo sapiens
cggcaguggguaagccaagcuu

SEQ ID NO: 309743 - RNA, 22 nt, Homo sapiens
cuaaaguauugagugguaaaga

SEQ ID NO: 309744 - RNA, 22 nt, Homo sapiens
cuagcagacacuuccagagagu

SEQ ID NO: 309745 - RNA, 22 nt, Homo sapiens
cuauaguauaguuugaagucag

SEQ ID NO: 309746 - RNA, 18 nt, Homo sapiens
cucacacccuaaucagga

SEQ ID NO: 309747 - RNA, 22 nt, Homo sapiens
cucaguuuugccuuguuuaagg

SEQ ID NO: 309748 - RNA, 17 nt, Homo sapiens
cucucugguuuaaagca

SEQ ID NO: 309749 - RNA, 19 nt, Homo sapiens
cugaaacacagagagggcu

SEQ ID NO: 309750 - RNA, 22 nt, Homo sapiens
cugacaugcagccacugcaccu

SEQ ID NO: 309751 - RNA, 22 nt, Homo sapiens
cugaggguagaaggaucacuug

SEQ ID NO: 309752 - RNA, 22 nt, Homo sapiens
cugaggugggaggauuggcuug

SEQ ID NO: 309753 - RNA, 22 nt, Homo sapiens
cugauugucuauuuaguucacu

SEQ ID NO: 309754 - RNA, 22 nt, Homo sapiens
cugcuggucuuuaaggucuagg

SEQ ID NO: 309755 - RNA, 22 nt, Homo sapiens
cuggaguuugaggcugcaguga

SEQ ID NO: 309756 - RNA, 22 nt, Homo sapiens
cuggauggugagauaaagaaaa

SEQ ID NO: 309757 - RNA, 22 nt, Homo sapiens
cuggucguuauuuaucuucuca

SEQ ID NO: 309758 - RNA, 21 nt, Homo sapiens
cugguguuagcacuucuuccc

SEQ ID NO: 309759 - RNA, 22 nt, Homo sapiens
cugugaacaugggagaaauggc

SEQ ID NO: 309760 - RNA, 22 nt, Homo sapiens
cugugcacaucuggcggcccga

SEQ ID NO: 309761 - RNA, 18 nt, Homo sapiens
cuuccuuagucugguuaa

SEQ ID NO: 309762 - RNA, 22 nt, Homo sapiens
cuuggcuccgacuccccuccaa

SEQ ID NO: 309763 - RNA, 22 nt, Homo sapiens
cuugguuacauuuuccuagaaa

SEQ ID NO: 309764 - RNA, 22 nt, Homo sapiens
cuuuugcugggucagcgguggu

SEQ ID NO: 309765 - RNA, 18 nt, Homo sapiens
gaagaaguaggcauggca

SEQ ID NO: 309766 - RNA, 21 nt, Homo sapiens
gaccuguaguaagcauucaca

SEQ ID NO: 309767 - RNA, 22 nt, Homo sapiens
gacucuguagacaaucacaucu

SEQ ID NO: 309768 - RNA, 22 nt, Homo sapiens
gacugcagugcagcuguuaggc

SEQ ID NO: 309769 - RNA, 22 nt, Homo sapiens
gacuggccuauaauggcgaauu

SEQ ID NO: 309770 - RNA, 22 nt, Homo sapiens
gagaacagagauaauuuuacuu

SEQ ID NO: 309771 - RNA, 21 nt, Homo sapiens
gagaaucaucauggcugcaua

SEQ ID NO: 309772 - RNA, 22 nt, Homo sapiens
gagacugagucucacucuguca

SEQ ID NO: 309773 - RNA, 22 nt, Homo sapiens
gagagucacagugaauguggca

SEQ ID NO: 309774 - RNA, 22 nt, Homo sapiens
gagaugaagugucaauaaggau

SEQ ID NO: 309775 - RNA, 22 nt, Homo sapiens
gagauggaguuucacuucgcuc

SEQ ID NO: 309776 - RNA, 22 nt, Homo sapiens
gagauucuucaauauuuauucu

SEQ ID NO: 309777 - RNA, 22 nt, Homo sapiens
gagcacugaauacugugguggu

SEQ ID NO: 309778 - RNA, 22 nt, Homo sapiens
gaggagauauucugcuggaugg

SEQ ID NO: 309779 - RNA, 22 nt, Homo sapiens
gagguggugguggaggcauagc

SEQ ID NO: 309780 - RNA, 22 nt, Homo sapiens
gaguaacauugacaacuucaug

SEQ ID NO: 309781 - RNA, 22 nt, Homo sapiens
gauaacagauaaugucaguuau

SEQ ID NO: 309782 - RNA, 22 nt, Homo sapiens
gauauuacuuccaauauugcaa

SEQ ID NO: 309783 - RNA, 22 nt, Homo sapiens
gauuccauuuguggcuauuuac

SEQ ID NO: 309784 - RNA, 22 nt, Homo sapiens
gcacauggccccaucgugccga

SEQ ID NO: 309785 - RNA, 22 nt, Homo sapiens
gcaccccuuaccgggcuggguu

SEQ ID NO: 309786 - RNA, 19 nt, Homo sapiens
gcagagaugugguagcuug

SEQ ID NO: 309787 - RNA, 22 nt, Homo sapiens
gccaacauggcgcuccauucuu

SEQ ID NO: 309788 - RNA, 18 nt, Homo sapiens
gccaacauguaaacaggu

SEQ ID NO: 309789 - RNA, 20 nt, Homo sapiens
gccacaguuaagcuucugcc

SEQ ID NO: 309790 - RNA, 22 nt, Homo sapiens
gcccacuguuaaauuuguuuua

SEQ ID NO: 309791 - RNA, 22 nt, Homo sapiens
gcugcacuuuaaggcauccccu

SEQ ID NO: 309792 - RNA, 22 nt, Homo sapiens
gcuggugacuuuaaguugaagc

SEQ ID NO: 309793 - RNA, 22 nt, Homo sapiens
ggaaauguaaacaauggggcua

SEQ ID NO: 309794 - RNA, 19 nt, Homo sapiens
ggaaaugucuauuaagauc

SEQ ID NO: 309795 - RNA, 22 nt, Homo sapiens
ggaaauguuggugucaugaguu

SEQ ID NO: 309796 - RNA, 22 nt, Homo sapiens
ggaaauguuuagcauccacuuu

SEQ ID NO: 309797 - RNA, 22 nt, Homo sapiens
ggagaguaauuagacugaaaga

SEQ ID NO: 309798 - RNA, 20 nt, Homo sapiens
ggagguuguauaaguacauc

SEQ ID NO: 309799 - RNA, 22 nt, Homo sapiens
ggauacaucuggacagccgaau

SEQ ID NO: 309800 - RNA, 22 nt, Homo sapiens
ggcaagaggagauucugcuccc

SEQ ID NO: 309801 - RNA, 22 nt, Homo sapiens
gggaaauguaaagucauaagau

SEQ ID NO: 309802 - RNA, 22 nt, Homo sapiens
gggaauguagcaaaucugcaau

SEQ ID NO: 309803 - RNA, 22 nt, Homo sapiens
gggguaggcuacacugaguucc

SEQ ID NO: 309804 - RNA, 22 nt, Homo sapiens
gguaggcacuggugggaagaga

SEQ ID NO: 309805 - RNA, 22 nt, Homo sapiens
ggucacauuggacuaucaaguu

SEQ ID NO: 309806 - RNA, 22 nt, Homo sapiens
ggugaggaaaguugaguuucua

SEQ ID NO: 309807 - RNA, 22 nt, Homo sapiens
ggugauguuugaguugagacag

SEQ ID NO: 309808 - RNA, 22 nt, Homo sapiens
ggugcuugaggaacggaggcug

SEQ ID NO: 309809 - RNA, 22 nt, Homo sapiens
guaaucucaccuacuugggagg

SEQ ID NO: 309810 - RNA, 22 nt, Homo sapiens
guaaucucagcuacucgggagg

SEQ ID NO: 309811 - RNA, 22 nt, Homo sapiens
guacauagucacacauauacau

SEQ ID NO: 309812 - RNA, 22 nt, Homo sapiens
guaucauugccuaaugcucuca

SEQ ID NO: 309813 - RNA, 19 nt, Homo sapiens
guauuugacuuucuuguuu

SEQ ID NO: 309814 - RNA, 22 nt, Homo sapiens
gucagcuuguccagagacucug

SEQ ID NO: 309815 - RNA, 22 nt, Homo sapiens
guccaguguuggagguuuuacc

SEQ ID NO: 309816 - RNA, 22 nt, Homo sapiens
gucucugguugcuuuuguacca

SEQ ID NO: 309817 - RNA, 20 nt, Homo sapiens
gucugucuccgaguagaauu

SEQ ID NO: 309818 - RNA, 22 nt, Homo sapiens
gucugugguuccuaugucaccu

SEQ ID NO: 309819 - RNA, 22 nt, Homo sapiens
gucuuuguuauuaugaaucaac

SEQ ID NO: 309820 - RNA, 22 nt, Homo sapiens
gugaaguuuuuugcugagaguc

SEQ ID NO: 309821 - RNA, 22 nt, Homo sapiens
gugacacagcaagacuccgucu

SEQ ID NO: 309822 - RNA, 22 nt, Homo sapiens
gugaccauuugacauauccuug

SEQ ID NO: 309823 - RNA, 22 nt, Homo sapiens
gugacugcauccauccaggcuu

SEQ ID NO: 309824 - RNA, 18 nt, Homo sapiens
gugagaaugacuguucug

SEQ ID NO: 309825 - RNA, 22 nt, Homo sapiens
gugagaauugacacccuugucu

SEQ ID NO: 309826 - RNA, 22 nt, Homo sapiens
gugagacugaguuucgcucuug

SEQ ID NO: 309827 - RNA, 22 nt, Homo sapiens
gugagagaaugacuauguguuu

SEQ ID NO: 309828 - RNA, 22 nt, Homo sapiens
gugagaggaggcagcuuuuaca

SEQ ID NO: 309829 - RNA, 22 nt, Homo sapiens
gugagauccucucuuauauggg

SEQ ID NO: 309830 - RNA, 22 nt, Homo sapiens
gugagauggagucuugcuuugu

SEQ ID NO: 309831 - RNA, 22 nt, Homo sapiens
gugauagaucugggauucagaa

SEQ ID NO: 309832 - RNA, 22 nt, Homo sapiens
gugcacaaucgugcauuccuug

SEQ ID NO: 309833 - RNA, 22 nt, Homo sapiens
gugcauacgucuuuauaguagc

SEQ ID NO: 309834 - RNA, 22 nt, Homo sapiens
guggaucacuugagguuagaag

SEQ ID NO: 309835 - RNA, 22 nt, Homo sapiens
gugggauggaaaugggcuucag

SEQ ID NO: 309836 - RNA, 22 nt, Homo sapiens
gugggguaggguaggacucaac

SEQ ID NO: 309837 - RNA, 22 nt, Homo sapiens
gugguauaaguaccuccuuuca

SEQ ID NO: 309838 - RNA, 22 nt, Homo sapiens
gaggugguagguucacagcagc

SEQ ID NO: 309839 - RNA, 22 nt, Homo sapiens
gauaaagauagcaauagggaca

SEQ ID NO: 309840 - RNA, 22 nt, Homo sapiens
gauaguugugagaacucuuacu

SEQ ID NO: 309841 - RNA, 22 nt, Homo sapiens
gaucacauggccauuucuagcu

SEQ ID NO: 309842 - RNA, 22 nt, Homo sapiens
gaucacaugggagaaugagagu

SEQ ID NO: 309843 - RNA, 22 nt, Homo sapiens
gaugagauguucucauggauug

SEQ ID NO: 309844 - RNA, 22 nt, Homo sapiens
gaugagguaggccugcuuugaa

SEQ ID NO: 309845 - RNA, 22 nt, Homo sapiens
gaugcaaauuaagcuugggaca

SEQ ID NO: 309846 - RNA, 19 nt, Homo sapiens
gaugcaaugcacugagguc

SEQ ID NO: 309847 - RNA, 22 nt, Homo sapiens
gauuccauugcgaauuuucaga

SEQ ID NO: 309848 - RNA, 22 nt, Homo sapiens
gauuuguauuaaaagugugacg

SEQ ID NO: 309849 - RNA, 22 nt, Homo sapiens
gcagguguuaugcaaacaacug

SEQ ID NO: 309850 - RNA, 23 nt, Homo sapiens
gcuaggagagaugaaacacaggu

SEQ ID NO: 309851 - RNA, 22 nt, Homo sapiens
gcuggauguuucaauacaaaua

SEQ ID NO: 309852 - RNA, 19 nt, Homo sapiens
gcuuguccacgugagauaa

SEQ ID NO: 309853 - RNA, 22 nt, Homo sapiens
ggaaaucaucauucucgguaua

SEQ ID NO: 309854 - RNA, 23 nt, Homo sapiens
ggaaauguuuaagggguugggag

SEQ ID NO: 309855 - RNA, 23 nt, Homo sapiens
ggaaugaaaccugguuaugauau

SEQ ID NO: 309856 - RNA, 22 nt, Homo sapiens
ggacauguauauauaugugugu

SEQ ID NO: 309857 - RNA, 22 nt, Homo sapiens
ggagaauugcuuggacccggga

SEQ ID NO: 309858 - RNA, 22 nt, Homo sapiens
ggagggugagaucaauuuggga

SEQ ID NO: 309859 - RNA, 23 nt, Homo sapiens
ggauggaaaguuuugagggccac

SEQ ID NO: 309860 - RNA, 22 nt, Homo sapiens
ggcacgguggcucacaccugua

SEQ ID NO: 309861 - RNA, 22 nt, Homo sapiens
ggcuagagaauagugccacuaa

SEQ ID NO: 309862 - RNA, 22 nt, Homo sapiens
ggcuagauauucacauauggcu

SEQ ID NO: 309863 - RNA, 22 nt, Homo sapiens
gggaugaaguugauguagaaag

SEQ ID NO: 309864 - RNA, 22 nt, Homo sapiens
gggcauaucacuugaggucagg

SEQ ID NO: 309865 - RNA, 22 nt, Homo sapiens
ggguaggcaagcggaugucaga

SEQ ID NO: 309866 - RNA, 22 nt, Homo sapiens
gguggucuuccccuggaguucg

SEQ ID NO: 309867 - RNA, 22 nt, Homo sapiens
guaauaacuguggaaaaagguu

SEQ ID NO: 309868 - RNA, 22 nt, Homo sapiens
guaaucuguaguaaagcaccau

SEQ ID NO: 309869 - RNA, 22 nt, Homo sapiens
guaguggcaugaucuuggcuca

SEQ ID NO: 309870 - RNA, 22 nt, Homo sapiens
guauaguaguacaaaaguuuuu

SEQ ID NO: 309871 - RNA, 21 nt, Homo sapiens
guaugguugaagugacaagcc

SEQ ID NO: 309872 - RNA, 22 nt, Homo sapiens
gucacaguggccagugauguuc

SEQ ID NO: 309873 - RNA, 22 nt, Homo sapiens
gucacuguggagaagaaagugg

SEQ ID NO: 309874 - RNA, 22 nt, Homo sapiens
gucagugucuuugcagcucaga

SEQ ID NO: 309875 - RNA, 22 nt, Homo sapiens
gucccaguggaaccuccaagcu

SEQ ID NO: 309876 - RNA, 22 nt, Homo sapiens
gucugcaugucauaugauagua

SEQ ID NO: 309877 - RNA, 22 nt, Homo sapiens
gugagaacugugucuuauaaac

SEQ ID NO: 309878 - RNA, 22 nt, Homo sapiens
gugagaccaauguacuaccuuc

SEQ ID NO: 309879 - RNA, 22 nt, Homo sapiens
gugagauggaguuggugucuuu

SEQ ID NO: 309880 - RNA, 22 nt, Homo sapiens
gugaggcugguccugccuccca

SEQ ID NO: 309881 - RNA, 22 nt, Homo sapiens
gugagguauacugggaucacua

SEQ ID NO: 309882 - RNA, 22 nt, Homo sapiens
gugaugcaguacguagaggaga

SEQ ID NO: 309883 - RNA, 22 nt, Homo sapiens
gugauguguuucaacagcuccu

SEQ ID NO: 309884 - RNA, 22 nt, Homo sapiens
gugcacaucgugcagguuuguu

SEQ ID NO: 309885 - RNA, 22 nt, Homo sapiens
gugcacaucuguguuccagcua

SEQ ID NO: 309886 - RNA, 22 nt, Homo sapiens
gugcacuguagaacccuuuguu

SEQ ID NO: 309887 - RNA, 23 nt, Homo sapiens
gugccuucugagccuagucucca

SEQ ID NO: 309888 - RNA, 22 nt, Homo sapiens
guggaagguaaugcagcuuacu

SEQ ID NO: 309889 - RNA, 22 nt, Homo sapiens
guggaaggucaugaauguucuu

SEQ ID NO: 309890 - RNA, 22 nt, Homo sapiens
guggaaugaaaacucucucaca

SEQ ID NO: 309891 - RNA, 22 nt, Homo sapiens
guggaaugcaguguugauucaa

SEQ ID NO: 309892 - RNA, 22 nt, Homo sapiens
guggaauggaaugauuguguau

SEQ ID NO: 309893 - RNA, 17 nt, Homo sapiens
guggaaugucaugucaa

SEQ ID NO: 309894 - RNA, 22 nt, Homo sapiens
gugucccagugugcauacaggu

SEQ ID NO: 309895 - RNA, 22 nt, Homo sapiens
gugucucagcccagaccuauuu

SEQ ID NO: 309896 - RNA, 22 nt, Homo sapiens
gugugucuugaccaggaucgga

SEQ ID NO: 309897 - RNA, 22 nt, Homo sapiens
guucccaguugaaaugauuagu

SEQ ID NO: 309898 - RNA, 22 nt, Homo sapiens
guuggcuguuucccccaaguga

SEQ ID NO: 309899 - RNA, 18 nt, Homo sapiens
uaaauugcuucaccugag

SEQ ID NO: 309900 - RNA, 22 nt, Homo sapiens
uaacaccuuugauagcacuuuu

SEQ ID NO: 309901 - RNA, 22 nt, Homo sapiens
uaacugcaaccuccgccucccg

SEQ ID NO: 309902 - RNA, 22 nt, Homo sapiens
uaagacugccccagacagcaag

SEQ ID NO: 309903 - RNA, 22 nt, Homo sapiens
uaaggcaaguuuuuaguggaca

SEQ ID NO: 309904 - RNA, 22 nt, Homo sapiens
uaaggcuuuuguucagcguggg

SEQ ID NO: 309905 - RNA, 15 nt, Homo sapiens
uaaguaguuggcugu

SEQ ID NO: 309906 - RNA, 18 nt, Homo sapiens
augagagccgauuccugg

SEQ ID NO: 309907 - RNA, 22 nt, Homo sapiens
augagauaggaacaaacuuaca

SEQ ID NO: 309908 - RNA, 22 nt, Homo sapiens
augagauuauguaaagagacca

SEQ ID NO: 309909 - RNA, 22 nt, Homo sapiens
augagcaaagagaugagacccu

SEQ ID NO: 309910 - RNA, 22 nt, Homo sapiens
augagcugauuuccuuaccaua

SEQ ID NO: 309911 - RNA, 22 nt, Homo sapiens
augagguaauaaguccuuggaa

SEQ ID NO: 309912 - RNA, 22 nt, Homo sapiens
augaucuguuuggugaucuugu

SEQ ID NO: 309913 - RNA, 22 nt, Homo sapiens
augauguguucuguguucccau

SEQ ID NO: 309914 - RNA, 22 nt, Homo sapiens
augcagaucacauuuuucuguc

SEQ ID NO: 309915 - RNA, 18 nt, Homo sapiens
augcauauuuuaaguugu

SEQ ID NO: 309916 - RNA, 22 nt, Homo sapiens
auggacuuuuuguucagugucu

SEQ ID NO: 309917 - RNA, 22 nt, Homo sapiens
auggcaguguaugauuauauua

SEQ ID NO: 309918 - RNA, 22 nt, Homo sapiens
auggcccccuguuugugaacau

SEQ ID NO: 309919 - RNA, 22 nt, Homo sapiens
auggcucuguuuuuuaugcucu

SEQ ID NO: 309920 - RNA, 21 nt, Homo sapiens
auggugagaaaguagugucaa

SEQ ID NO: 309921 - RNA, 22 nt, Homo sapiens
auguccaugagcacauguauca

SEQ ID NO: 309922 - RNA, 22 nt, Homo sapiens
augugcacaugcuuacauguga

SEQ ID NO: 309923 - RNA, 22 nt, Homo sapiens
auuauugacucauagaaaggau

SEQ ID NO: 309924 - RNA, 22 nt, Homo sapiens
auucaucagggauacuggccug

SEQ ID NO: 309925 - RNA, 22 nt, Homo sapiens
auugaauuugguuugcuaagaa

SEQ ID NO: 309926 - RNA, 22 nt, Homo sapiens
auugcaacuuccgccuccuggg

SEQ ID NO: 309927 - RNA, 22 nt, Homo sapiens
auugcugagacauugcuaaucu

SEQ ID NO: 309928 - RNA, 22 nt, Homo sapiens
auuggugaccugcggcaguaug

SEQ ID NO: 309929 - RNA, 20 nt, Homo sapiens
auuguccuugauuacacaga

SEQ ID NO: 309930 - RNA, 22 nt, Homo sapiens
auuguguagucuuacugcuugc

SEQ ID NO: 309931 - RNA, 22 nt, Homo sapiens
auuguucuuguguccuuuuccu

SEQ ID NO: 309932 - RNA, 22 nt, Homo sapiens
auuugguaauauuuaaggacuu

SEQ ID NO: 309933 - RNA, 22 nt, Homo sapiens
auuuuugguugguaggcuauua

SEQ ID NO: 309934 - RNA, 22 nt, Homo sapiens
auuuuugguuucaccugcacgc

SEQ ID NO: 309935 - RNA, 22 nt, Homo sapiens
cacaggccugucucuuucuaac

SEQ ID NO: 309936 - RNA, 22 nt, Homo sapiens
cacauguuugcuacauuuuucu

SEQ ID NO: 309937 - RNA, 22 nt, Homo sapiens
caccacuacaccccaggcuggg

SEQ ID NO: 309938 - RNA, 22 nt, Homo sapiens
caccaggugcccagcacggcca

SEQ ID NO: 309939 - RNA, 22 nt, Homo sapiens
caccgagguuggagugcagugg

SEQ ID NO: 309940 - RNA, 22 nt, Homo sapiens
caccuguacauggcaguguccu

SEQ ID NO: 309941 - RNA, 22 nt, Homo sapiens
cacugcacuccaguuucgguaa

SEQ ID NO: 309942 - RNA, 22 nt, Homo sapiens
cacugcacuccaguuuggauga

SEQ ID NO: 309943 - RNA, 22 nt, Homo sapiens
cacugcauccuccauauccugg

SEQ ID NO: 309944 - RNA, 22 nt, Homo sapiens
cacugcauggccacccauguua

SEQ ID NO: 309945 - RNA, 22 nt, Homo sapiens
cagagguaagcaagucagcauu

SEQ ID NO: 309946 - RNA, 22 nt, Homo sapiens
cagcuguuguugggguauagga

SEQ ID NO: 309947 - RNA, 21 nt, Homo sapiens
cauaaugcuacuuauuuuaug

SEQ ID NO: 309948 - RNA, 22 nt, Homo sapiens
caucacauucugagauacugag

SEQ ID NO: 309949 - RNA, 22 nt, Homo sapiens
cauggccuuuggaaugugucua

SEQ ID NO: 309950 - RNA, 22 nt, Homo sapiens
cauggcucuuguuuacucccag

SEQ ID NO: 309951 - RNA, 22 nt, Homo sapiens
cauugcacuccagccuggcaac

SEQ ID NO: 309952 - RNA, 22 nt, Homo sapiens
ccaccgggucccagcucugcuc

SEQ ID NO: 309953 - RNA, 22 nt, Homo sapiens
ccacugugguaucugauacugg

SEQ ID NO: 309954 - RNA, 18 nt, Homo sapiens
ccagugcaaggaaagccc

SEQ ID NO: 309955 - RNA, 23 nt, Homo sapiens
cccucagaagugcagggagagaa

SEQ ID NO: 309956 - RNA, 22 nt, Homo sapiens
ccugagaucauacuguuaguaa

SEQ ID NO: 309957 - RNA, 22 nt, Homo sapiens
ccuggaucauugucauucccaa

SEQ ID NO: 309958 - RNA, 20 nt, Homo sapiens
cuaaucaucccagaagaaau

SEQ ID NO: 309959 - RNA, 22 nt, Homo sapiens
cuagaagguaagagcuggaugc

SEQ ID NO: 309960 - RNA, 22 nt, Homo sapiens
cuagauuauccaacuuauuagc

SEQ ID NO: 309961 - RNA, 22 nt, Homo sapiens
cuagcagacaggcugggagcag

SEQ ID NO: 309962 - RNA, 22 nt, Homo sapiens
cuaugcuucuuaaauuaguuau

SEQ ID NO: 309963 - RNA, 22 nt, Homo sapiens
cucacagucagaagggacuugc

SEQ ID NO: 309964 - RNA, 22 nt, Homo sapiens
cucagauacuugggagguugag

SEQ ID NO: 309965 - RNA, 22 nt, Homo sapiens
cucagcaguggauuuaccacca

SEQ ID NO: 309966 - RNA, 22 nt, Homo sapiens
cucaguguuucagcugcucaga

SEQ ID NO: 309967 - RNA, 22 nt, Homo sapiens
cucuuuuguuuagcugagaggg

SEQ ID NO: 309968 - RNA, 22 nt, Homo sapiens
cugacagaugacugccacugua

SEQ ID NO: 309969 - RNA, 22 nt, Homo sapiens
cugagaucaagucuugcucugu

SEQ ID NO: 309970 - RNA, 22 nt, Homo sapiens
cugagaucaugggucagguggu

SEQ ID NO: 309971 - RNA, 22 nt, Homo sapiens
cugagaucugaaccaggagugu

SEQ ID NO: 309972 - RNA, 22 nt, Homo sapiens
cugaggacaucagggaagcauc

SEQ ID NO: 309973 - RNA, 22 nt, Homo sapiens
cugaggugggaggauuacuuga

SEQ ID NO: 309974 - RNA, 22 nt, Homo sapiens
cugagguuaggaguuugagacc

SEQ ID NO: 309975 - RNA, 20 nt, Homo sapiens
cugcacauccacucuacuuc

SEQ ID NO: 309976 - RNA, 22 nt, Homo sapiens
cuggaaugugagccccaaaaag

SEQ ID NO: 309977 - RNA, 22 nt, Homo sapiens
aaagucacuggagaaggaauau

SEQ ID NO: 309978 - RNA, 22 nt, Homo sapiens
aaaugcugucaaauuguguucu

SEQ ID NO: 309979 - RNA, 22 nt, Homo sapiens
aaauucauuucagcucugggua

SEQ ID NO: 309980 - RNA, 22 nt, Homo sapiens
aagaggccuaggaaucuguauu

SEQ ID NO: 309981 - RNA, 22 nt, Homo sapiens
aagaguuaguaaaauuuccucu

SEQ ID NO: 309982 - RNA, 22 nt, Homo sapiens
aagaugauguucuuuuucuuag

SEQ ID NO: 309983 - RNA, 22 nt, Homo sapiens
aagaugauguuguguuuucacu

SEQ ID NO: 309984 - RNA, 19 nt, Homo sapiens
aagaugauguuugggcuaa

SEQ ID NO: 309985 - RNA, 20 nt, Homo sapiens
aagcugaguguuuuuuuaau

SEQ ID NO: 309986 - RNA, 22 nt, Homo sapiens
aagcuggagugcaguggugcga

SEQ ID NO: 309987 - RNA, 22 nt, Homo sapiens
aaggugcuguaagcauccaugu

SEQ ID NO: 309988 - RNA, 23 nt, Homo sapiens
aaguucaugcucaucuguuacac

SEQ ID NO: 309989 - RNA, 19 nt, Homo sapiens
aauauugacaguggugucu

SEQ ID NO: 309990 - RNA, 22 nt, Homo sapiens
aaugcacauauauuuccuuauu

SEQ ID NO: 309991 - RNA, 22 nt, Homo sapiens
aauggcauugguccuuuuggau

SEQ ID NO: 309992 - RNA, 22 nt, Homo sapiens
aauugcauaugcaguagaucua

SEQ ID NO: 309993 - RNA, 22 nt, Homo sapiens
acauaguagacacugaaaauau

SEQ ID NO: 309994 - RNA, 22 nt, Homo sapiens
accaguuuuuuauacaucuucu

SEQ ID NO: 309995 - RNA, 22 nt, Homo sapiens
accugagauuacaggugcuggc

SEQ ID NO: 309996 - RNA, 23 nt, Homo sapiens
accugauguuucuguggggagcc

SEQ ID NO: 309997 - RNA, 21 nt, Homo sapiens
acugcacuccaaccucaacag

SEQ ID NO: 309998 - RNA, 19 nt, Homo sapiens
acugcacuccaaccuccug

SEQ ID NO: 309999 - RNA, 22 nt, Homo sapiens
acugcacuccaccuugggcaac

SEQ ID NO: 310000 - RNA, 22 nt, Homo sapiens
acugcacuccagacucugucuc

SEQ ID NO: 310001 - RNA, 22 nt, Homo sapiens
acugcacuccagccugagccug

SEQ ID NO: 310002 - RNA, 22 nt, Homo sapiens
acugcacuccagccuggacgac

SEQ ID NO: 310003 - RNA, 22 nt, Homo sapiens
acugcacuccagccuggcggac

SEQ ID NO: 310004 - RNA, 22 nt, Homo sapiens
acugcacuccagccuucaggac

SEQ ID NO: 310005 - RNA, 22 nt, Homo sapiens
acugcacuccagccuuggagac

SEQ ID NO: 310006 - RNA, 22 nt, Homo sapiens
acugcacuccagccuuggccac

SEQ ID NO: 310007 - RNA, 22 nt, Homo sapiens
acugcacuccggccuggcaaca

SEQ ID NO: 310008 - RNA, 19 nt, Homo sapiens
acugcacuccuccuugggu

SEQ ID NO: 310009 - RNA, 22 nt, Homo sapiens
acugcacucuagcauggguaau

SEQ ID NO: 310010 - RNA, 22 nt, Homo sapiens
acugcacuucaaccucauugac

SEQ ID NO: 310011 - RNA, 22 nt, Homo sapiens
acugcacuucagccuuggcuac

SEQ ID NO: 310012 - RNA, 22 nt, Homo sapiens
acugcacuucagccuuggggac

SEQ ID NO: 310013 - RNA, 22 nt, Homo sapiens
acugggauauuauugguaauau

SEQ ID NO: 310014 - RNA, 22 nt, Homo sapiens
acuguacuccauccugggugac

SEQ ID NO: 310015 - RNA, 22 nt, Homo sapiens
acuuauuguggcugacccaaac

SEQ ID NO: 310016 - RNA, 22 nt, Homo sapiens
acuuuuugauggggagaacauu

SEQ ID NO: 310017 - RNA, 22 nt, Homo sapiens
acuuuuugcaaccauuuggacc

SEQ ID NO: 310018 - RNA, 22 nt, Homo sapiens
agaauguuuuagaccaauacaa

SEQ ID NO: 310019 - RNA, 22 nt, Homo sapiens
agagaacugauucagggaaaau

SEQ ID NO: 310020 - RNA, 22 nt, Homo sapiens
agagaacugauuggaugugggc

SEQ ID NO: 310021 - RNA, 22 nt, Homo sapiens
agagaccuguaaaguucaggca

SEQ ID NO: 310022 - RNA, 22 nt, Homo sapiens
agagcacugcugcaggguucug

SEQ ID NO: 310023 - RNA, 22 nt, Homo sapiens
agauacaucuaugugucugugu

SEQ ID NO: 310024 - RNA, 22 nt, Homo sapiens
agauggguuuucacauguuggc

SEQ ID NO: 310025 - RNA, 18 nt, Homo sapiens
agaugguguugcuucugu

SEQ ID NO: 310026 - RNA, 22 nt, Homo sapiens
agaugguguuuucucaccagau

SEQ ID NO: 310027 - RNA, 22 nt, Homo sapiens
agcaagauccagucgcacagga

SEQ ID NO: 310028 - RNA, 22 nt, Homo sapiens
agcacauuaguaucuaagaaca

SEQ ID NO: 310029 - RNA, 22 nt, Homo sapiens
agcagcauggguauaaaucucc

SEQ ID NO: 310030 - RNA, 22 nt, Homo sapiens
agcagcuuugcauggccugugg

SEQ ID NO: 310031 - RNA, 22 nt, Homo sapiens
agcagguguggcuuauccugaa

SEQ ID NO: 310032 - RNA, 22 nt, Homo sapiens
agcuggauguauguuaagugaa

SEQ ID NO: 310033 - RNA, 22 nt, Homo sapiens
agcuggcuguagcugcaagucu

SEQ ID NO: 310034 - RNA, 20 nt, Homo sapiens
agcuguuguuaugagguuua

SEQ ID NO: 310035 - RNA, 22 nt, Homo sapiens
agcuugugauuuagagugagag

SEQ ID NO: 310036 - RNA, 22 nt, Homo sapiens
aggcaggugaaagauaguuuua

SEQ ID NO: 310037 - RNA, 22 nt, Homo sapiens
aggcaugaaauacaugcauuga

SEQ ID NO: 310038 - RNA, 22 nt, Homo sapiens
aggcuagacuuugagaauuuuu

SEQ ID NO: 310039 - RNA, 23 nt, Homo sapiens
agggcacuauagauguuauucua

SEQ ID NO: 310040 - RNA, 22 nt, Homo sapiens
aggugcugacaggauagguuuc

SEQ ID NO: 310041 - RNA, 22 nt, Homo sapiens
aggugcugagcagagaauccug

SEQ ID NO: 310042 - RNA, 21 nt, Homo sapiens
gugaggaguuacuggcuuuga

SEQ ID NO: 310043 - RNA, 22 nt, Homo sapiens
gugaggucguagucauaggcaa

SEQ ID NO: 310044 - RNA, 21 nt, Homo sapiens
gugaucaugucacugcacucc

SEQ ID NO: 310045 - RNA, 22 nt, Homo sapiens
gugaucuucauggaaggugaaa

SEQ ID NO: 310046 - RNA, 22 nt, Homo sapiens
gugcacaugcgugcgcacauau

SEQ ID NO: 310047 - RNA, 22 nt, Homo sapiens
gugcacauuguuuaugucuguu

SEQ ID NO: 310048 - RNA, 22 nt, Homo sapiens
guggaagcacaggccuccugga

SEQ ID NO: 310049 - RNA, 22 nt, Homo sapiens
guggaucacuugaggucaagag

SEQ ID NO: 310050 - RNA, 22 nt, Homo sapiens
guggcuaaagauuuggaaucug

SEQ ID NO: 310051 - RNA, 22 nt, Homo sapiens
guggcuagaaugaagguagcug

SEQ ID NO: 310052 - RNA, 22 nt, Homo sapiens
guguagagaaauagccugaagg

SEQ ID NO: 310053 - RNA, 22 nt, Homo sapiens
gugucacugugaggauauugua

SEQ ID NO: 310054 - RNA, 22 nt, Homo sapiens
guguccucgaguacacaucagg

SEQ ID NO: 310055 - RNA, 22 nt, Homo sapiens
uaacuagaaaggagacaguugc

SEQ ID NO: 310056 - RNA, 22 nt, Homo sapiens
uaaguaguccugauuuaaccuu

SEQ ID NO: 310057 - RNA, 22 nt, Homo sapiens
uaaguaguuucuggauauucuc

SEQ ID NO: 310058 - RNA, 22 nt, Homo sapiens
uaagucuuuuuggaguuuauaa

SEQ ID NO: 310059 - RNA, 22 nt, Homo sapiens
uaauccuagcacuuuggaagac

SEQ ID NO: 310060 - RNA, 22 nt, Homo sapiens
uacaauagugacaaaucagcau

SEQ ID NO: 310061 - RNA, 22 nt, Homo sapiens
uacacaugugaguucuuuucua

SEQ ID NO: 310062 - RNA, 22 nt, Homo sapiens
uacagaguauccauuugaguuc

SEQ ID NO: 310063 - RNA, 22 nt, Homo sapiens
uacccuguaaucugaaacauga

SEQ ID NO: 310064 - RNA, 22 nt, Homo sapiens
uaccuguagacuacagcuucag

SEQ ID NO: 310065 - RNA, 19 nt, Homo sapiens
uacugcaccucaaccuggg

SEQ ID NO: 310066 - RNA, 20 nt, Homo sapiens
uacugcacuccaaccuaggc

SEQ ID NO: 310067 - RNA, 22 nt, Homo sapiens
uacugcacuccagccucgguga

SEQ ID NO: 310068 - RNA, 22 nt, Homo sapiens
uacugcacuccagccugccaac

SEQ ID NO: 310069 - RNA, 22 nt, Homo sapiens
uacugcacucuagccuggguga

SEQ ID NO: 310070 - RNA, 22 nt, Homo sapiens
uacugcagucagacuccugggc

SEQ ID NO: 310071 - RNA, 22 nt, Homo sapiens
uacugcaguugcagcuugagga

SEQ ID NO: 310072 - RNA, 22 nt, Homo sapiens
uacugcaucgaaaugcuuuuau

SEQ ID NO: 310073 - RNA, 22 nt, Homo sapiens
uacugcauucuccgccuccggg

SEQ ID NO: 310074 - RNA, 22 nt, Homo sapiens
uagagagcuguuugaaagcagg

SEQ ID NO: 310075 - RNA, 22 nt, Homo sapiens
uagagcacauuaucauuuccaa

SEQ ID NO: 310076 - RNA, 22 nt, Homo sapiens
uagcacaugucagguaauuugc

SEQ ID NO: 310077 - RNA, 18 nt, Homo sapiens
uagcagacaucauugggg

SEQ ID NO: 310078 - RNA, 22 nt, Homo sapiens
uagcagacuauuuugugauaau

SEQ ID NO: 310079 - RNA, 22 nt, Homo sapiens
uagcugagacuacaguaggugc

SEQ ID NO: 310080 - RNA, 19 nt, Homo sapiens
uaggugguuuuccccucac

SEQ ID NO: 310081 - RNA, 22 nt, Homo sapiens
uagugguauuagcgauacuacu

SEQ ID NO: 310082 - RNA, 22 nt, Homo sapiens
uauagcagugugagaacagacu

SEQ ID NO: 310083 - RNA, 22 nt, Homo sapiens
ugagaucaugucauuugcacuc

SEQ ID NO: 310084 - RNA, 22 nt, Homo sapiens
ugagaucgagucucgcucuguc

SEQ ID NO: 310085 - RNA, 22 nt, Homo sapiens
ugagaugagggcugcacucaaa

SEQ ID NO: 310086 - RNA, 22 nt, Homo sapiens
ugagaugcucgccggccagcau

SEQ ID NO: 310087 - RNA, 23 nt, Homo sapiens
ugagcaauauucuacuauugagu

SEQ ID NO: 310088 - RNA, 20 nt, Homo sapiens
ugagccccuggacucaagcg

SEQ ID NO: 310089 - RNA, 22 nt, Homo sapiens
ugagcugagaaaugcagcagcu

SEQ ID NO: 310090 - RNA, 22 nt, Homo sapiens
ugagcugagacaauaaguuuuu

SEQ ID NO: 310091 - RNA, 22 nt, Homo sapiens
ugagguagaggugaacuugacc

SEQ ID NO: 310092 - RNA, 22 nt, Homo sapiens
ugagguuggggucagggcuagc

SEQ ID NO: 310093 - RNA, 22 nt, Homo sapiens
ugaguaauguugaucuuugaua

SEQ ID NO: 310094 - RNA, 22 nt, Homo sapiens
ugaguagcuaauguuuacugag

SEQ ID NO: 310095 - RNA, 22 nt, Homo sapiens
ugauguugacuguaggcagaga

SEQ ID NO: 310096 - RNA, 19 nt, Homo sapiens
ugauuguaagcuuggugag

SEQ ID NO: 310097 - RNA, 22 nt, Homo sapiens
ugcaaaucuuguguaguuguga

SEQ ID NO: 310098 - RNA, 22 nt, Homo sapiens
ugcagagaaacauuuuguauuu

SEQ ID NO: 310099 - RNA, 22 nt, Homo sapiens
ugcagugugauuuucuggcuga

SEQ ID NO: 310100 - RNA, 22 nt, Homo sapiens
ugcauauucuaggauuuuguau

SEQ ID NO: 310101 - RNA, 21 nt, Homo sapiens
ugcauggagaacacugagggu

SEQ ID NO: 310102 - RNA, 22 nt, Homo sapiens
ugccaacaugccuggcuguuuu

SEQ ID NO: 310103 - RNA, 22 nt, Homo sapiens
ugccaguguuuuguugaagauu

SEQ ID NO: 310104 - RNA, 22 nt, Homo sapiens
ugcugcaaacaugagaggaagu

SEQ ID NO: 310105 - RNA, 22 nt, Homo sapiens
uggaauguauaucguuuuuugu

SEQ ID NO: 310106 - RNA, 22 nt, Homo sapiens
uggaaugucuauguuuuugauu

SEQ ID NO: 310107 - RNA, 18 nt, Homo sapiens
uggaauguuuggguuaau

SEQ ID NO: 310108 - RNA, 22 nt, Homo sapiens
uggacauguacauauguguaug

SEQ ID NO: 310109 - RNA, 20 nt, Homo sapiens
uggaguuguggcaguuugga

SEQ ID NO: 310110 - RNA, 22 nt, Homo sapiens
ugggaaauguagccuagcugug

SEQ ID NO: 310111 - RNA, 22 nt, Homo sapiens
ugggaagagggagcgauuuugg

SEQ ID NO: 310112 - RNA, 22 nt, Homo sapiens
ugggaugugagucuucgcuuuc

SEQ ID NO: 310113 - RNA, 22 nt, Homo sapiens
uggguagagaaucaggaucuua

SEQ ID NO: 310114 - RNA, 22 nt, Homo sapiens
ugguccucugcuuccagaauuc

SEQ ID NO: 310115 - RNA, 22 nt, Homo sapiens
uguagggagagggaguugcacc

SEQ ID NO: 310116 - RNA, 22 nt, Homo sapiens
uguauagaucugauucaucucc

SEQ ID NO: 310117 - RNA, 22 nt, Homo sapiens
ugucacuuugccuucuggacuu

SEQ ID NO: 310118 - RNA, 22 nt, Homo sapiens
ugucaguuuuaacuagggaaua

SEQ ID NO: 310119 - RNA, 22 nt, Homo sapiens
ugugaaacacgaaagucuaaaa

SEQ ID NO: 310120 - RNA, 22 nt, Homo sapiens
ugugaaacauggauagaacugg

SEQ ID NO: 310121 - RNA, 19 nt, Homo sapiens
ugugaagaaaugcugcaag

SEQ ID NO: 310122 - RNA, 19 nt, Homo sapiens
ugugagcauuagcauuuag

SEQ ID NO: 310123 - RNA, 22 nt, Homo sapiens
ugugcacaacaugcagguuugu

SEQ ID NO: 310124 - RNA, 22 nt, Homo sapiens
ugugcguguaagagaucuaggu

SEQ ID NO: 310125 - RNA, 22 nt, Homo sapiens
uguggcucuucuguucuccacu

SEQ ID NO: 310126 - RNA, 22 nt, Homo sapiens
uguguacugcagaguauucugu

SEQ ID NO: 310127 - RNA, 22 nt, Homo sapiens
ugugucuuguuuauagcuuucu

SEQ ID NO: 310128 - RNA, 22 nt, Homo sapiens
uguuacagugacuaauguuuua

SEQ ID NO: 310129 - RNA, 22 nt, Homo sapiens
uuaauguaucuaucacaucaca

SEQ ID NO: 310130 - RNA, 22 nt, Homo sapiens
uuaauuguaucuauagauguca

SEQ ID NO: 310131 - RNA, 22 nt, Homo sapiens
uuacagauggauggcagcuggc

SEQ ID NO: 310132 - RNA, 22 nt, Homo sapiens
uuagcacugagaauggcuugcu

SEQ ID NO: 310133 - RNA, 22 nt, Homo sapiens
uuauagguuucuacaggacuau

SEQ ID NO: 310134 - RNA, 22 nt, Homo sapiens
uuauaguuuuucaccuggagaa

SEQ ID NO: 310135 - RNA, 22 nt, Homo sapiens
uuaugguuuuuagcagaguaau

SEQ ID NO: 310136 - RNA, 22 nt, Homo sapiens
uuauugcacuccagccugggua

SEQ ID NO: 310137 - RNA, 22 nt, Homo sapiens
uucaagaauuaaaguggcuuuu

SEQ ID NO: 310138 - RNA, 22 nt, Homo sapiens
uucaauacuguugauccuuaug

SEQ ID NO: 310139 - RNA, 22 nt, Homo sapiens
uucacaauuaaaugugguuauu

SEQ ID NO: 310140 - RNA, 22 nt, Homo sapiens
uucacagucacccuucuccaug

SEQ ID NO: 310141 - RNA, 22 nt, Homo sapiens
uucacagugugaucuaugggca

SEQ ID NO: 310142 - RNA, 22 nt, Homo sapiens
uucagacugggugaagagggua

SEQ ID NO: 310143 - RNA, 22 nt, Homo sapiens
uucauguaauuccauaagguaa

SEQ ID NO: 310144 - RNA, 22 nt, Homo sapiens
uuccagcugggggcaacucugc

SEQ ID NO: 310145 - RNA, 17 nt, Homo sapiens
uucucaguucugaucuc

SEQ ID NO: 310146 - RNA, 22 nt, Homo sapiens
uucugacuggugugagauggua

SEQ ID NO: 310147 - RNA, 22 nt, Homo sapiens
uucugugcuuguggaugaagug

SEQ ID NO: 310148 - RNA, 22 nt, Homo sapiens
uucugugguugaaaggagagau

SEQ ID NO: 310149 - RNA, 21 nt, Homo sapiens
uucuucaggcagaaggauuau

SEQ ID NO: 310150 - RNA, 22 nt, Homo sapiens
uucuugguguaguaguugaaaa

SEQ ID NO: 310151 - RNA, 22 nt, Homo sapiens
uucuuuggaaacaguacuaauu

SEQ ID NO: 310152 - RNA, 22 nt, Homo sapiens
uucuuugguacaagggccgacc

SEQ ID NO: 310153 - RNA, 22 nt, Homo sapiens
uugaagacuaaguuaucaggau

SEQ ID NO: 310154 - RNA, 22 nt, Homo sapiens
uugacuucagagcugauucaag

SEQ ID NO: 310155 - RNA, 22 nt, Homo sapiens
uugagacggagucuugcucuuu

SEQ ID NO: 310156 - RNA, 22 nt, Homo sapiens
uugagacggaguuuugcucuug

SEQ ID NO: 310157 - RNA, 22 nt, Homo sapiens
uugagagcugaugaaagauaaa

SEQ ID NO: 310158 - RNA, 22 nt, Homo sapiens
uugagauacauaauuaugaaug

SEQ ID NO: 310159 - RNA, 22 nt, Homo sapiens
uugagaucaugcuacugcacuc

SEQ ID NO: 310160 - RNA, 22 nt, Homo sapiens
uugagaucuacuacuguaggag

SEQ ID NO: 310161 - RNA, 22 nt, Homo sapiens
uugagaucuugauauguuugaa

SEQ ID NO: 310162 - RNA, 22 nt, Homo sapiens
uugagaugaagucuugcucucu

SEQ ID NO: 310163 - RNA, 22 nt, Homo sapiens
uugagaugaaguuuugcucuuu

SEQ ID NO: 310164 - RNA, 22 nt, Homo sapiens
uugagauggagucucacuccuu

SEQ ID NO: 310165 - RNA, 22 nt, Homo sapiens
uugagauggagucucgcucugu

SEQ ID NO: 310166 - RNA, 22 nt, Homo sapiens
uugagauggagucucgcucuuu

SEQ ID NO: 310167 - RNA, 22 nt, Homo sapiens
uugagauggaguuucgcucuug

SEQ ID NO: 310168 - RNA, 22 nt, Homo sapiens
uugagauggaguuucgcucuuu

SEQ ID NO: 310169 - RNA, 22 nt, Homo sapiens
uugagcacaguagguuguggcu

SEQ ID NO: 310170 - RNA, 22 nt, Homo sapiens
uugaggguggcauauauugauu

SEQ ID NO: 310171 - RNA, 22 nt, Homo sapiens
uugagguagcuuugauggaggu

SEQ ID NO: 310172 - RNA, 22 nt, Homo sapiens
uugaggucagagguucgagacc

SEQ ID NO: 310173 - RNA, 20 nt, Homo sapiens
uugaggucaggaguuuggga

SEQ ID NO: 310174 - RNA, 22 nt, Homo sapiens
uugagguggugucuugcucugu

SEQ ID NO: 310175 - RNA, 22 nt, Homo sapiens
uugaguauuugcagucugaaca

SEQ ID NO: 310176 - RNA, 22 nt, Homo sapiens
uugcaacauguauucuggugau

SEQ ID NO: 310177 - RNA, 22 nt, Homo sapiens
uugcacauguugaaccagcaaa

SEQ ID NO: 310178 - RNA, 22 nt, Homo sapiens
uugcacauugcaccuuuuguau

SEQ ID NO: 310179 - RNA, 22 nt, Homo sapiens
uacagaguagaagauuugcaga

SEQ ID NO: 310180 - RNA, 22 nt, Homo sapiens
uacagcacugugcauagugguu

SEQ ID NO: 310181 - RNA, 22 nt, Homo sapiens
uacauaguagauauaggguuua

SEQ ID NO: 310182 - RNA, 22 nt, Homo sapiens
uacauaguuacuuccauuucca

SEQ ID NO: 310183 - RNA, 22 nt, Homo sapiens
uacauguauguguuuauggcug

SEQ ID NO: 310184 - RNA, 22 nt, Homo sapiens
uacugcacuccagcuuaggaga

SEQ ID NO: 310185 - RNA, 22 nt, Homo sapiens
uacugcacuccaggcucaccug

SEQ ID NO: 310186 - RNA, 20 nt, Homo sapiens
uacugcacuccauccugggu

SEQ ID NO: 310187 - RNA, 22 nt, Homo sapiens
uacugcacuugaccuccugggc

SEQ ID NO: 310188 - RNA, 23 nt, Homo sapiens
uacugcauccuccgccucuaggg

SEQ ID NO: 310189 - RNA, 21 nt, Homo sapiens
uacuggagauacagucugcaa

SEQ ID NO: 310190 - RNA, 22 nt, Homo sapiens
uagaaguaggcuacgugucugg

SEQ ID NO: 310191 - RNA, 23 nt, Homo sapiens
uagaauguuuuuccauguuucuu

SEQ ID NO: 310192 - RNA, 22 nt, Homo sapiens
uagagcacaagguagauuucua

SEQ ID NO: 310193 - RNA, 22 nt, Homo sapiens
uagagcacagugauuagaccua

SEQ ID NO: 310194 - RNA, 22 nt, Homo sapiens
uagcagcaccccacucuacugg

SEQ ID NO: 310195 - RNA, 18 nt, Homo sapiens
uagcaugaugcugagugc

SEQ ID NO: 310196 - RNA, 22 nt, Homo sapiens
uagcuccacagcuauauauaau

SEQ ID NO: 310197 - RNA, 22 nt, Homo sapiens
uagcuccagugggguuacugcu

SEQ ID NO: 310198 - RNA, 22 nt, Homo sapiens
uaguaguuuuguguauaauaau

SEQ ID NO: 310199 - RNA, 22 nt, Homo sapiens
uaguaucacauggucuuaauua

SEQ ID NO: 310200 - RNA, 22 nt, Homo sapiens
uagucacacacucaacuuuuca

SEQ ID NO: 310201 - RNA, 22 nt, Homo sapiens
uaguugcaucuuaggucuguga

SEQ ID NO: 310202 - RNA, 22 nt, Homo sapiens
uauagcaguguaagaaucgagu

SEQ ID NO: 310203 - RNA, 22 nt, Homo sapiens
uaucagcacaguggguucaugg

SEQ ID NO: 310204 - RNA, 22 nt, Homo sapiens
uaucauaguuuggacuuucauu

SEQ ID NO: 310205 - RNA, 20 nt, Homo sapiens
uaugagacugggagaaguuc

SEQ ID NO: 310206 - RNA, 22 nt, Homo sapiens
uaugcacacucucccaggaggg

SEQ ID NO: 310207 - RNA, 22 nt, Homo sapiens
uauggguguuauugcaugggag

SEQ ID NO: 310208 - RNA, 22 nt, Homo sapiens
uauuagguugguggaaaaguaa

SEQ ID NO: 310209 - RNA, 22 nt, Homo sapiens
ugacagguugauaggugcagca

SEQ ID NO: 310210 - RNA, 22 nt, Homo sapiens
ugaccuguuugaaauugccaau

SEQ ID NO: 310211 - RNA, 20 nt, Homo sapiens
ugagaacaugugguauuugg

SEQ ID NO: 310212 - RNA, 22 nt, Homo sapiens
ugagaagcauaccagugucugu

SEQ ID NO: 310213 - RNA, 22 nt, Homo sapiens
ugagaaugaugauugguaaacc

SEQ ID NO: 310214 - RNA, 22 nt, Homo sapiens
ugagacaucucuccugagacag

SEQ ID NO: 310215 - RNA, 22 nt, Homo sapiens
ugagacugagucucgcucuauu

SEQ ID NO: 310216 - RNA, 22 nt, Homo sapiens
ugagacugagucucgcucuugu

SEQ ID NO: 310217 - RNA, 22 nt, Homo sapiens
ugagacugaguuucacuuuugu

SEQ ID NO: 310218 - RNA, 22 nt, Homo sapiens
ugagacugguuaauugauaaag

SEQ ID NO: 310219 - RNA, 22 nt, Homo sapiens
ugagacuguuuuggggaacuuc

SEQ ID NO: 310220 - RNA, 22 nt, Homo sapiens
ugagagacauuuguuguagagu

SEQ ID NO: 310221 - RNA, 22 nt, Homo sapiens
ugagaggugaauggcaggcuca

SEQ ID NO: 310222 - RNA, 22 nt, Homo sapiens
ugagauaggaucuugcucuguu

SEQ ID NO: 310223 - RNA, 22 nt, Homo sapiens
ugagauccugagaguugggacu

SEQ ID NO: 310224 - RNA, 22 nt, Homo sapiens
ugagaucgaguaucgcugucac

SEQ ID NO: 310225 - RNA, 22 nt, Homo sapiens
ugagaugagucucgcucuguca

SEQ ID NO: 310226 - RNA, 22 nt, Homo sapiens
ugagaugaguucucgcucuguc

SEQ ID NO: 310227 - RNA, 22 nt, Homo sapiens
ugagaugcuuguaaauucauuu

SEQ ID NO: 310228 - RNA, 21 nt, Homo sapiens
ugagauuauauuaacauggua

SEQ ID NO: 310229 - RNA, 22 nt, Homo sapiens
ugagcuaggaucacaccugcau

SEQ ID NO: 310230 - RNA, 22 nt, Homo sapiens
ugagcugagauuaagcugcugc

SEQ ID NO: 310231 - RNA, 22 nt, Homo sapiens
ugaggaauguguguuaaagaua

SEQ ID NO: 310232 - RNA, 22 nt, Homo sapiens
ugagggaugccugguuuguuuu

SEQ ID NO: 310233 - RNA, 22 nt, Homo sapiens
ugagguaacaaacuaugaguua

SEQ ID NO: 310234 - RNA, 22 nt, Homo sapiens
ugagguugucagugucauucuu

SEQ ID NO: 310235 - RNA, 22 nt, Homo sapiens
ugagguuguccacuauaaucca

SEQ ID NO: 310236 - RNA, 22 nt, Homo sapiens
ugauaugugaguauaugguuau

SEQ ID NO: 310237 - RNA, 20 nt, Homo sapiens
ugauauuuucugagcaggaa

SEQ ID NO: 310238 - RNA, 22 nt, Homo sapiens
ugaucacagcuugacuaaagga

SEQ ID NO: 310239 - RNA, 22 nt, Homo sapiens
ugauguauuauuaagaccuggc

SEQ ID NO: 310240 - RNA, 22 nt, Homo sapiens
ugaugucuugcaggcacgagau

SEQ ID NO: 310241 - RNA, 22 nt, Homo sapiens
ugcagauucguuuugaggggua

SEQ ID NO: 310242 - RNA, 22 nt, Homo sapiens
ugcaggguccauugucccaagu

SEQ ID NO: 310243 - RNA, 17 nt, Homo sapiens
ugcauaggcaggcucag

SEQ ID NO: 310244 - RNA, 22 nt, Homo sapiens
ugcauauucgaguuauuuuggg

SEQ ID NO: 310245 - RNA, 21 nt, Homo sapiens
ugcauuggagaauguuucuca

SEQ ID NO: 310246 - RNA, 23 nt, Homo sapiens
ugcugagaccuagauccuaaaga

SEQ ID NO: 310247 - RNA, 22 nt, Homo sapiens
ugcugcacuuauggcucugagg

SEQ ID NO: 310248 - RNA, 22 nt, Homo sapiens
ugcuguguugcuggcuuaaaga

SEQ ID NO: 310249 - RNA, 22 nt, Homo sapiens
uggaaauuaagucuuuccugag

SEQ ID NO: 310250 - RNA, 22 nt, Homo sapiens
uggaagcauagcagcgugugug

SEQ ID NO: 310251 - RNA, 22 nt, Homo sapiens
uggaagugucugugcccagcuc

SEQ ID NO: 310252 - RNA, 21 nt, Homo sapiens
uggaaugaauggccaacaugg

SEQ ID NO: 310253 - RNA, 22 nt, Homo sapiens
ugacugaguaguauuccacuau

SEQ ID NO: 310254 - RNA, 22 nt, Homo sapiens
ugagaacaugugauauuuggug

SEQ ID NO: 310255 - RNA, 20 nt, Homo sapiens
ugagaacauguggcauuugg

SEQ ID NO: 310256 - RNA, 22 nt, Homo sapiens
ugagaacuagagaacaagguga

SEQ ID NO: 310257 - RNA, 22 nt, Homo sapiens
ugagaagugacgcagcaggguu

SEQ ID NO: 310258 - RNA, 19 nt, Homo sapiens
ugagaauguuaccaggucc

SEQ ID NO: 310259 - RNA, 22 nt, Homo sapiens
ugagacugaaauuaggaaacug

SEQ ID NO: 310260 - RNA, 22 nt, Homo sapiens
ugagacugagucuugcucuauu

SEQ ID NO: 310261 - RNA, 22 nt, Homo sapiens
ugagacugagucuugcucuugu

SEQ ID NO: 310262 - RNA, 22 nt, Homo sapiens
ugagacugaguuucucucuugu

SEQ ID NO: 310263 - RNA, 22 nt, Homo sapiens
ugagacugauaggacauuuucu

SEQ ID NO: 310264 - RNA, 22 nt, Homo sapiens
ugagagcuuugaugcacuguuu

SEQ ID NO: 310265 - RNA, 22 nt, Homo sapiens
ugagaggugauaaagcaagggu

SEQ ID NO: 310266 - RNA, 21 nt, Homo sapiens
ugagaguaguguauuauucuc

SEQ ID NO: 310267 - RNA, 22 nt, Homo sapiens
ugagaugaagucuugcucuguu

SEQ ID NO: 310268 - RNA, 22 nt, Homo sapiens
ugagaugaggucucacucuguu

SEQ ID NO: 310269 - RNA, 22 nt, Homo sapiens
ugagaugaggucucgcucuguc

SEQ ID NO: 310270 - RNA, 22 nt, Homo sapiens
ugagaugaguugcgcucugucg

SEQ ID NO: 310271 - RNA, 21 nt, Homo sapiens
ugagaugauccugcaugcaug

SEQ ID NO: 310272 - RNA, 22 nt, Homo sapiens
ugagaugcauauucuggcuccu

SEQ ID NO: 310273 - RNA, 22 nt, Homo sapiens
ugagauuacguucggcccacuu

SEQ ID NO: 310274 - RNA, 22 nt, Homo sapiens
ugagauuauauuucuuaacaga

SEQ ID NO: 310275 - RNA, 22 nt, Homo sapiens
ugagcagagaagugcccugcgc

SEQ ID NO: 310276 - RNA, 22 nt, Homo sapiens
ugagcugagaucacacuacugu

SEQ ID NO: 310277 - RNA, 22 nt, Homo sapiens
ugagcugagaucuuaccacugc

SEQ ID NO: 310278 - RNA, 17 nt, Homo sapiens
ugagggaugccugguuc

SEQ ID NO: 310279 - RNA, 22 nt, Homo sapiens
ugagguugaaggacauuuuuau

SEQ ID NO: 310280 - RNA, 22 nt, Homo sapiens
ugaguauguaggaugugucuua

SEQ ID NO: 310281 - RNA, 22 nt, Homo sapiens
ugagucuguucucacauugcua

SEQ ID NO: 310282 - RNA, 22 nt, Homo sapiens
ugaguggagacuguguguagag

SEQ ID NO: 310283 - RNA, 22 nt, Homo sapiens
ugauaagugagauagcaaguga

SEQ ID NO: 310284 - RNA, 22 nt, Homo sapiens
ugauauguuagaaucuugcaag

SEQ ID NO: 310285 - RNA, 20 nt, Homo sapiens
ugauauuucuggaaguggag

SEQ ID NO: 310286 - RNA, 22 nt, Homo sapiens
ugauccuguccuuaugauguua

SEQ ID NO: 310287 - RNA, 22 nt, Homo sapiens
ugaugguguuaccaucuuuacu

SEQ ID NO: 310288 - RNA, 22 nt, Homo sapiens
ugaugguuuuaaaaagaggagu

SEQ ID NO: 310289 - RNA, 22 nt, Homo sapiens
ugauuugucugcaggaauagug

SEQ ID NO: 310290 - RNA, 19 nt, Homo sapiens
ugcaaagucagugaagggu

SEQ ID NO: 310291 - RNA, 22 nt, Homo sapiens
ugcaaagucgaaacugcaguuu

SEQ ID NO: 310292 - RNA, 22 nt, Homo sapiens
ugcaccaucuugcuucuguggu

SEQ ID NO: 310293 - RNA, 17 nt, Homo sapiens
ugcaccauuugauuuuu

SEQ ID NO: 310294 - RNA, 22 nt, Homo sapiens
ugcuauagcuauaucaucuccu

SEQ ID NO: 310295 - RNA, 22 nt, Homo sapiens
ugcugcaaucucggcacuuugg

SEQ ID NO: 310296 - RNA, 22 nt, Homo sapiens
ugcuuagucuugcuuuagcuau

SEQ ID NO: 310297 - RNA, 22 nt, Homo sapiens
uggaaauaaaauagaguuugcc

SEQ ID NO: 310298 - RNA, 22 nt, Homo sapiens
uggaaauuaacagggauugucc

SEQ ID NO: 310299 - RNA, 21 nt, Homo sapiens
uggaacgcaaaugagaugaau

SEQ ID NO: 310300 - RNA, 22 nt, Homo sapiens
uggaaguuaaauuaguugauga

SEQ ID NO: 310301 - RNA, 22 nt, Homo sapiens
uggagacaaagauagaaaagca

SEQ ID NO: 310302 - RNA, 22 nt, Homo sapiens
uggagcccuaguuccucauaac

SEQ ID NO: 310303 - RNA, 22 nt, Homo sapiens
uggagggcuagucauuucuuuu

SEQ ID NO: 310304 - RNA, 22 nt, Homo sapiens
uggagguagacauugggaagag

SEQ ID NO: 310305 - RNA, 22 nt, Homo sapiens
uggagguagagaugggaucucc

SEQ ID NO: 310306 - RNA, 20 nt, Homo sapiens
uggaggucaucugucacuac

SEQ ID NO: 310307 - RNA, 19 nt, Homo sapiens
uggaugacugucugggucu

SEQ ID NO: 310308 - RNA, 22 nt, Homo sapiens
uggcaggugcacuggcuuugaa

SEQ ID NO: 310309 - RNA, 22 nt, Homo sapiens
uggcauauaaagauguguucaa

SEQ ID NO: 310310 - RNA, 23 nt, Homo sapiens
ugggauguuuuuggaaacuucug

SEQ ID NO: 310311 - RNA, 22 nt, Homo sapiens
ugggcggagacgugcagccgcc

SEQ ID NO: 310312 - RNA, 22 nt, Homo sapiens
ugggguaggcuguauacucugu

SEQ ID NO: 310313 - RNA, 22 nt, Homo sapiens
uggguaggcccucauuggacag

SEQ ID NO: 310314 - RNA, 22 nt, Homo sapiens
ugguaagaucagaacuggaguc

SEQ ID NO: 310315 - RNA, 22 nt, Homo sapiens
uggucauggggcagcugacacu

SEQ ID NO: 310316 - RNA, 22 nt, Homo sapiens
uguaagcauuauauaauuguug

SEQ ID NO: 310317 - RNA, 22 nt, Homo sapiens
uguacuucaagauuaugguuua

SEQ ID NO: 310318 - RNA, 22 nt, Homo sapiens
uguauauguuuguacauauguc

SEQ ID NO: 310319 - RNA, 22 nt, Homo sapiens
ugucaauauguaauaacugaau

SEQ ID NO: 310320 - RNA, 22 nt, Homo sapiens
ugucuuagagauaaagaaugaa

SEQ ID NO: 310321 - RNA, 22 nt, Homo sapiens
ugucuugagagaggacaugacu

SEQ ID NO: 310322 - RNA, 22 nt, Homo sapiens
ugugaccaaaaucaacauaccu

SEQ ID NO: 310323 - RNA, 22 nt, Homo sapiens
ugugauggaguuucauggacug

SEQ ID NO: 310324 - RNA, 22 nt, Homo sapiens
ugugcacaaccugcagguuugu

SEQ ID NO: 310325 - RNA, 22 nt, Homo sapiens
ugugcacaaugugcagguuugu

SEQ ID NO: 310326 - RNA, 22 nt, Homo sapiens
ugugcacauaacauuuuuuuag

SEQ ID NO: 310327 - RNA, 22 nt, Homo sapiens
ugugcacauugugcagguugau

SEQ ID NO: 310328 - RNA, 22 nt, Homo sapiens
ugugcaccucuucacacaggga

SEQ ID NO: 310329 - RNA, 22 nt, Homo sapiens
uguggcuuuguaaccauggguc

SEQ ID NO: 310330 - RNA, 22 nt, Homo sapiens
uguggcuuuuucuuggcugagg

SEQ ID NO: 310331 - RNA, 22 nt, Homo sapiens
ugugguauuagguguaguaucu

SEQ ID NO: 310332 - RNA, 22 nt, Homo sapiens
uguguagagaaauauuacuuau

SEQ ID NO: 310333 - RNA, 22 nt, Homo sapiens
uguuugcuguguggaguagcag

SEQ ID NO: 310334 - RNA, 22 nt, Homo sapiens
uuaaaguguuuucaaaauguca

SEQ ID NO: 310335 - RNA, 22 nt, Homo sapiens
uuaagcaguggauuagaauuuu

SEQ ID NO: 310336 - RNA, 22 nt, Homo sapiens
uuaaggcagugcaucuggaguu

SEQ ID NO: 310337 - RNA, 22 nt, Homo sapiens
uuaaucacagcugaacucaaac

SEQ ID NO: 310338 - RNA, 22 nt, Homo sapiens
uuacaugcaugacaaggugcca

SEQ ID NO: 310339 - RNA, 22 nt, Homo sapiens
uuaccugagaaggugacauuug

SEQ ID NO: 310340 - RNA, 22 nt, Homo sapiens
uuauagcacuaagaagguaaua

SEQ ID NO: 310341 - RNA, 22 nt, Homo sapiens
uuauccugucaguaaauauuuu

SEQ ID NO: 310342 - RNA, 22 nt, Homo sapiens
uuauugcuaaaucaugaccaca

SEQ ID NO: 310343 - RNA, 17 nt, Homo sapiens
uuauugcuauaagcuga

SEQ ID NO: 310344 - RNA, 22 nt, Homo sapiens
uucacaguggugggagacguca

SEQ ID NO: 310345 - RNA, 22 nt, Homo sapiens
uucacaguguuucucacgguua

SEQ ID NO: 310346 - RNA, 22 nt, Homo sapiens
uucaguacacguguucucauuu

SEQ ID NO: 310347 - RNA, 22 nt, Homo sapiens
uucauugaaugauuuuuagaag

SEQ ID NO: 310348 - RNA, 22 nt, Homo sapiens
uuccaauguuccguguugcagu

SEQ ID NO: 310349 - RNA, 20 nt, Homo sapiens
uuccagcacauuagggaagc

SEQ ID NO: 310350 - RNA, 22 nt, Homo sapiens
agagauaauuagguuaaaugag

SEQ ID NO: 310351 - RNA, 22 nt, Homo sapiens
agagaugauuaacauuuuggua

SEQ ID NO: 310352 - RNA, 22 nt, Homo sapiens
agauggucuucauaaguuuuaa

SEQ ID NO: 310353 - RNA, 22 nt, Homo sapiens
agcagcauuccaaaaaucugcu

SEQ ID NO: 310354 - RNA, 22 nt, Homo sapiens
agcagcuuugaucugaaugauu

SEQ ID NO: 310355 - RNA, 22 nt, Homo sapiens
agcagcuuugcauggccuguga

SEQ ID NO: 310356 - RNA, 22 nt, Homo sapiens
agcagugucauuuucuggugag

SEQ ID NO: 310357 - RNA, 22 nt, Homo sapiens
agcagugugaaaauggacuaau

SEQ ID NO: 310358 - RNA, 21 nt, Homo sapiens
agccugugggucauaguugcc

SEQ ID NO: 310359 - RNA, 22 nt, Homo sapiens
agcugcaauguuuaguauaaua

SEQ ID NO: 310360 - RNA, 22 nt, Homo sapiens
agcuguaguuuauucauguuaa

SEQ ID NO: 310361 - RNA, 22 nt, Homo sapiens
agcugugucuucuuaaagauuu

SEQ ID NO: 310362 - RNA, 22 nt, Homo sapiens
aggcaugugugcagacugucug

SEQ ID NO: 310363 - RNA, 22 nt, Homo sapiens
aggcuagaaucuuccaucuugg

SEQ ID NO: 310364 - RNA, 21 nt, Homo sapiens
aggcuguuguuuugggaugga

SEQ ID NO: 310365 - RNA, 20 nt, Homo sapiens
aguauucacuuuuuucaugg

SEQ ID NO: 310366 - RNA, 22 nt, Homo sapiens
agucagauuggcauuuguuggg

SEQ ID NO: 310367 - RNA, 22 nt, Homo sapiens
agucaguguguauugauggcac

SEQ ID NO: 310368 - RNA, 22 nt, Homo sapiens
agucgguguuacugacagaaug

SEQ ID NO: 310369 - RNA, 22 nt, Homo sapiens
agugagcuggagaaaagaaacu

SEQ ID NO: 310370 - RNA, 22 nt, Homo sapiens
auaacagcugcaaggcaaaagc

SEQ ID NO: 310371 - RNA, 22 nt, Homo sapiens
auaauagguugauugacauugc

SEQ ID NO: 310372 - RNA, 22 nt, Homo sapiens
auacaucugccauguuggugug

SEQ ID NO: 310373 - RNA, 22 nt, Homo sapiens
auagaaucaucugugcacuagu

SEQ ID NO: 310374 - RNA, 22 nt, Homo sapiens
auagaucauugucauuuuagau

SEQ ID NO: 310375 - RNA, 22 nt, Homo sapiens
auagcaggagaauggucauggg

SEQ ID NO: 310376 - RNA, 22 nt, Homo sapiens
auauugguuaaauauuauguga

SEQ ID NO: 310377 - RNA, 22 nt, Homo sapiens
aucacagugaaaacagucaauu

SEQ ID NO: 310378 - RNA, 22 nt, Homo sapiens
aucacagugagcauaugucuau

SEQ ID NO: 310379 - RNA, 22 nt, Homo sapiens
aucacaguggcucacaagagcc

SEQ ID NO: 310380 - RNA, 22 nt, Homo sapiens
aucagauaccuguugggaaaug

SEQ ID NO: 310381 - RNA, 23 nt, Homo sapiens
aucagauaguuguagguaugugg

SEQ ID NO: 310382 - RNA, 19 nt, Homo sapiens
aucagcacaagugugcuuu

SEQ ID NO: 310383 - RNA, 22 nt, Homo sapiens
auccugaugacacagugcugca

SEQ ID NO: 310384 - RNA, 22 nt, Homo sapiens
uugcaccacugcguuccagccu

SEQ ID NO: 310385 - RNA, 22 nt, Homo sapiens
uugcacuccagcucuaggugac

SEQ ID NO: 310386 - RNA, 20 nt, Homo sapiens
uugcagagcccaacccugga

SEQ ID NO: 310387 - RNA, 22 nt, Homo sapiens
uugcagugugacgacuauauuu

SEQ ID NO: 310388 - RNA, 22 nt, Homo sapiens
uugcauuuucuaggagggcaaa

SEQ ID NO: 310389 - RNA, 22 nt, Homo sapiens
uuggaaaccucugcagguguuu

SEQ ID NO: 310390 - RNA, 22 nt, Homo sapiens
uuggaacuguucguauugaaau

SEQ ID NO: 310391 - RNA, 22 nt, Homo sapiens
uuggacugggauggccgaggcu

SEQ ID NO: 310392 - RNA, 22 nt, Homo sapiens
uuggagagucacuaguuagugc

SEQ ID NO: 310393 - RNA, 22 nt, Homo sapiens
uuggaugauaaagaagccuaag

SEQ ID NO: 310394 - RNA, 22 nt, Homo sapiens
uuggcauagaggcucucaagcu

SEQ ID NO: 310395 - RNA, 22 nt, Homo sapiens
uugguacuaaaaaguagggugu

SEQ ID NO: 310396 - RNA, 22 nt, Homo sapiens
uuguccuugagauaguuugcug

SEQ ID NO: 310397 - RNA, 22 nt, Homo sapiens
uugugcacauguacccuagaac

SEQ ID NO: 310398 - RNA, 22 nt, Homo sapiens
uugugcuucaucaccuagcaga

SEQ ID NO: 310399 - RNA, 22 nt, Homo sapiens
uuuaaugcaucccaaaauguag

SEQ ID NO: 310400 - RNA, 22 nt, Homo sapiens
uuuaugucuguacaucgggcgg

SEQ ID NO: 310401 - RNA, 22 nt, Homo sapiens
uuuauguggagcacuugacaca

SEQ ID NO: 310402 - RNA, 22 nt, Homo sapiens
uuuauucggcuaggagcuucgg

SEQ ID NO: 310403 - RNA, 22 nt, Homo sapiens
uuucaacaggucuggggugguc

SEQ ID NO: 310404 - RNA, 22 nt, Homo sapiens
uuucagcguggggugcugaaga

SEQ ID NO: 310405 - RNA, 22 nt, Homo sapiens
uuugaagugugaugccuugaug

SEQ ID NO: 310406 - RNA, 22 nt, Homo sapiens
uuugaaugcaacaaaugcggga

SEQ ID NO: 310407 - RNA, 22 nt, Homo sapiens
uuugagauaucuuccaucagua

SEQ ID NO: 310408 - RNA, 22 nt, Homo sapiens
uuugagaucuuuagaaucaggc

SEQ ID NO: 310409 - RNA, 21 nt, Homo sapiens
uuugaucauuaaaagugaauc

SEQ ID NO: 310410 - RNA, 22 nt, Homo sapiens
uuugcuuaaaucuuaaucagau

SEQ ID NO: 310411 - RNA, 22 nt, Homo sapiens
uuuguuugaagucgagacaacu

SEQ ID NO: 310412 - RNA, 22 nt, Homo sapiens
uuuuccagugggacucccauua

SEQ ID NO: 310413 - RNA, 22 nt, Homo sapiens
uuuugcaaauuccaguggccau

SEQ ID NO: 310414 - RNA, 22 nt, Homo sapiens
uuuugguaaugaacuuaggaag

SEQ ID NO: 310415 - RNA, 16 nt, Homo sapiens
uuuuugcagaaaugac

SEQ ID NO: 310416 - RNA, 22 nt, Homo sapiens
aaagaagucagccuguccuuug

SEQ ID NO: 310417 - RNA, 23 nt, Homo sapiens
aaauuugccuauuauuccuaugg

SEQ ID NO: 310418 - RNA, 22 nt, Homo sapiens
aacagauugcugagccccaccc

SEQ ID NO: 310419 - RNA, 22 nt, Homo sapiens
aacaggguguuugcaguuucuu

SEQ ID NO: 310420 - RNA, 22 nt, Homo sapiens
aacugcauuuucugauugugug

SEQ ID NO: 310421 - RNA, 22 nt, Homo sapiens
aacugccucugacauaggcagg

SEQ ID NO: 310422 - RNA, 22 nt, Homo sapiens
aagcacccagccucacgccugc

SEQ ID NO: 310423 - RNA, 21 nt, Homo sapiens
aagcaugguguaucuuuccau

SEQ ID NO: 310424 - RNA, 22 nt, Homo sapiens
aagcuggagugcaguggugcaa

SEQ ID NO: 310425 - RNA, 22 nt, Homo sapiens
aagggaaugcgcugccuguguu

SEQ ID NO: 310426 - RNA, 22 nt, Homo sapiens
aagggaaugcuuccaguuugug

SEQ ID NO: 310427 - RNA, 22 nt, Homo sapiens
aaggugcucucuuauguagaaa

SEQ ID NO: 310428 - RNA, 22 nt, Homo sapiens
aaugauauguuauguuuagguu

SEQ ID NO: 310429 - RNA, 22 nt, Homo sapiens
uggagagcaaagaauuuguuag

SEQ ID NO: 310430 - RNA, 22 nt, Homo sapiens
uggauagauacuauccaggacu

SEQ ID NO: 310431 - RNA, 22 nt, Homo sapiens
uggcaaauauuuuguuuuguaa

SEQ ID NO: 310432 - RNA, 19 nt, Homo sapiens
uggcacauguauacuuaug

SEQ ID NO: 310433 - RNA, 22 nt, Homo sapiens
uggcaugucagguuucuggguu

SEQ ID NO: 310434 - RNA, 22 nt, Homo sapiens
ugggauauaaaaaacgcuauuc

SEQ ID NO: 310435 - RNA, 22 nt, Homo sapiens
ugggaucagcugggcucucugu

SEQ ID NO: 310436 - RNA, 21 nt, Homo sapiens
ugggccccuuccuuacaucau

SEQ ID NO: 310437 - RNA, 22 nt, Homo sapiens
ugggguaggccugguuaugugc

SEQ ID NO: 310438 - RNA, 22 nt, Homo sapiens
uggguaggaccagaaaugcacu

SEQ ID NO: 310439 - RNA, 22 nt, Homo sapiens
ugguaaaaugucauuuaccaga

SEQ ID NO: 310440 - RNA, 22 nt, Homo sapiens
ugguccaguucugugauauugc

SEQ ID NO: 310441 - RNA, 22 nt, Homo sapiens
caucagcaauguaugaggguuc

SEQ ID NO: 310442 - RNA, 22 nt, Homo sapiens
caugaaagacugaggaauugga

SEQ ID NO: 310443 - RNA, 22 nt, Homo sapiens
caugugcaugcuuucuuaugug

SEQ ID NO: 310444 - RNA, 22 nt, Homo sapiens
ccacaguugaaauuuugacugu

SEQ ID NO: 310445 - RNA, 22 nt, Homo sapiens
ccacugcacuccagcccggcaa

SEQ ID NO: 310446 - RNA, 22 nt, Homo sapiens
ccagugcugugcaguguaugag

SEQ ID NO: 310447 - RNA, 22 nt, Homo sapiens
ccauggcaauggucagucuauu

SEQ ID NO: 310448 - RNA, 22 nt, Homo sapiens
cccaguguuacgugacagccug

SEQ ID NO: 310449 - RNA, 19 nt, Homo sapiens
ccucaaguacuaauauguu

SEQ ID NO: 310450 - RNA, 21 nt, Homo sapiens
ccugaagaagugaccucugag

SEQ ID NO: 310451 - RNA, 18 nt, Homo sapiens
ccuuaguuauagagaguc

SEQ ID NO: 310452 - RNA, 18 nt, Homo sapiens
cuaauacuauucaacaag

SEQ ID NO: 310453 - RNA, 22 nt, Homo sapiens
cucacagucucucccuaauuuu

SEQ ID NO: 310454 - RNA, 22 nt, Homo sapiens
cucacaguucuaaaggcaagaa

SEQ ID NO: 310455 - RNA, 22 nt, Homo sapiens
cucacuaguaaggcuguuuagu

SEQ ID NO: 310456 - RNA, 22 nt, Homo sapiens
cucagcuacuugggaagcugag

SEQ ID NO: 310457 - RNA, 22 nt, Homo sapiens
cucaguguucccauucuaccuu

SEQ ID NO: 310458 - RNA, 22 nt, Homo sapiens
cucccuuugcugaauguuuuuc

SEQ ID NO: 310459 - RNA, 22 nt, Homo sapiens
cugagaauguaaaugaagcuuu

SEQ ID NO: 310460 - RNA, 22 nt, Homo sapiens
cugagaucguggggcugcuguc

SEQ ID NO: 310461 - RNA, 22 nt, Homo sapiens
cugaggauauucagccucugug

SEQ ID NO: 310462 - RNA, 20 nt, Homo sapiens
cugaggugggagaaucgcuu

SEQ ID NO: 310463 - RNA, 19 nt, Homo sapiens
cugcaugagacaguugguu

SEQ ID NO: 310464 - RNA, 22 nt, Homo sapiens
cugccacugacaccucaaggac

SEQ ID NO: 310465 - RNA, 22 nt, Homo sapiens
cugccuaaagaaaaagacguug

SEQ ID NO: 310466 - RNA, 22 nt, Homo sapiens
cuggaaugcagcuuuaggggcu

SEQ ID NO: 310467 - RNA, 22 nt, Homo sapiens
cuggagaucuugacauugaagu

SEQ ID NO: 310468 - RNA, 17 nt, Homo sapiens
cugugaugaucuugucu

SEQ ID NO: 310469 - RNA, 22 nt, Homo sapiens
cuucacuggagucccuggauuc

SEQ ID NO: 310470 - RNA, 21 nt, Homo sapiens
cuugucuugcuuagaauagac

SEQ ID NO: 310471 - RNA, 22 nt, Homo sapiens
cuuuacacauccuaaccagugu

SEQ ID NO: 310472 - RNA, 22 nt, Homo sapiens
cuuugguuuacuuggugcuagu

SEQ ID NO: 310473 - RNA, 22 nt, Homo sapiens
gaaagauuuuaacugggagacu

SEQ ID NO: 310474 - RNA, 22 nt, Homo sapiens
gaacugggguuggguugcgaua

SEQ ID NO: 310475 - RNA, 22 nt, Homo sapiens
gaacuguaaagaaauucuaagg

SEQ ID NO: 310476 - RNA, 22 nt, Homo sapiens
gacagugugauacuuagucuca

SEQ ID NO: 310477 - RNA, 20 nt, Homo sapiens
gacauguugguuugcugcac

SEQ ID NO: 310478 - RNA, 22 nt, Homo sapiens
acugcacugucaaccuccuggg

SEQ ID NO: 310479 - RNA, 22 nt, Homo sapiens
acugcacuuauccuccaauguu

SEQ ID NO: 310480 - RNA, 20 nt, Homo sapiens
acugcacuucagccugcugg

SEQ ID NO: 310481 - RNA, 22 nt, Homo sapiens
acugcacuucagccuugugaca

SEQ ID NO: 310482 - RNA, 22 nt, Homo sapiens
acuggauguuagggauuuuauu

SEQ ID NO: 310483 - RNA, 20 nt, Homo sapiens
acuggcacugguaggugugg

SEQ ID NO: 310484 - RNA, 22 nt, Homo sapiens
agaaacacagguggaauugcuu

SEQ ID NO: 310485 - RNA, 20 nt, Homo sapiens
agaagcauugcucucuucag

SEQ ID NO: 310486 - RNA, 22 nt, Homo sapiens
agacuagacagaugaacagcac

SEQ ID NO: 310487 - RNA, 22 nt, Homo sapiens
agacuagagggaaaugaguugg

SEQ ID NO: 310488 - RNA, 22 nt, Homo sapiens
agagauaaagauuuuaauuuug

SEQ ID NO: 310489 - RNA, 22 nt, Homo sapiens
agaguacaggcaaguuagucau

SEQ ID NO: 310490 - RNA, 22 nt, Homo sapiens
agagugcuuuauuagauguagc

SEQ ID NO: 310491 - RNA, 22 nt, Homo sapiens
agcacgaaaccaaauucuguga

SEQ ID NO: 310492 - RNA, 22 nt, Homo sapiens
agcagcauuaugauauaucuua

SEQ ID NO: 310493 - RNA, 22 nt, Homo sapiens
agcaggucuuaacuugugaggu

SEQ ID NO: 310494 - RNA, 22 nt, Homo sapiens
agcagugugagaauggacuaau

SEQ ID NO: 310495 - RNA, 22 nt, Homo sapiens
agcauggucacuuugggcccca

SEQ ID NO: 310496 - RNA, 22 nt, Homo sapiens
agcgccacugcacuccagccug

SEQ ID NO: 310497 - RNA, 22 nt, Homo sapiens
agcugcacugguauaggagaaa

SEQ ID NO: 310498 - RNA, 20 nt, Homo sapiens
agcuggguguguuggugcau

SEQ ID NO: 310499 - RNA, 22 nt, Homo sapiens
agcuguuguucucagaggcuuu

SEQ ID NO: 310500 - RNA, 22 nt, Homo sapiens
agcuugugcuguaugaagggcc

SEQ ID NO: 310501 - RNA, 22 nt, Homo sapiens
aggaaauguuggucccauuucu

SEQ ID NO: 310502 - RNA, 22 nt, Homo sapiens
aggaauuuaauguaugauaaua

SEQ ID NO: 310503 - RNA, 22 nt, Homo sapiens
agggaagugugcuaugcauuua

SEQ ID NO: 310504 - RNA, 22 nt, Homo sapiens
agggaauguaaguuuuaugaga

SEQ ID NO: 310505 - RNA, 22 nt, Homo sapiens
aggguuuuuauuuauguggcau

SEQ ID NO: 310506 - RNA, 22 nt, Homo sapiens
agucagugcauaagaaugaagu

SEQ ID NO: 310507 - RNA, 23 nt, Homo sapiens
aguggucuccugggcccagcugu

SEQ ID NO: 310508 - RNA, 22 nt, Homo sapiens
auaaagccaggagacguaauug

SEQ ID NO: 310509 - RNA, 22 nt, Homo sapiens
auaagugcuuguugaauaauag

SEQ ID NO: 310510 - RNA, 22 nt, Homo sapiens
auagcagaagaagggacaauuc

SEQ ID NO: 310511 - RNA, 22 nt, Homo sapiens
auagcccuuuucuaacuaugug

SEQ ID NO: 310512 - RNA, 22 nt, Homo sapiens
aucacuuucuauuucugugcca

SEQ ID NO: 310513 - RNA, 22 nt, Homo sapiens
aucacuuugcucuccagugugg

SEQ ID NO: 310514 - RNA, 22 nt, Homo sapiens
aucagcagcaugaaaacaggcu

SEQ ID NO: 310515 - RNA, 22 nt, Homo sapiens
aucauguaguaagacacauuua

SEQ ID NO: 310516 - RNA, 22 nt, Homo sapiens
aucugugaaugaaguuauuuug

SEQ ID NO: 310517 - RNA, 22 nt, Homo sapiens
augaaaugcauguuaaguccgu

SEQ ID NO: 310518 - RNA, 22 nt, Homo sapiens
augaaguauuaggacacauuua

SEQ ID NO: 310519 - RNA, 22 nt, Homo sapiens
augacugagacuaacuuacuuu

SEQ ID NO: 310520 - RNA, 22 nt, Homo sapiens
augagaaugaagccuggcgugu

SEQ ID NO: 310521 - RNA, 22 nt, Homo sapiens
augagauuguuugugugaaaua

SEQ ID NO: 310522 - RNA, 22 nt, Homo sapiens
augaggugggagaaucacuuga

SEQ ID NO: 310523 - RNA, 22 nt, Homo sapiens
augauuuuuguaucgccugaug

SEQ ID NO: 310524 - RNA, 22 nt, Homo sapiens
augcacaugcgaaaacuugugu

SEQ ID NO: 310525 - RNA, 22 nt, Homo sapiens
augcagauauuuuugugguugc

SEQ ID NO: 310526 - RNA, 22 nt, Homo sapiens
auggaauggcacuuugaagauu

SEQ ID NO: 310527 - RNA, 22 nt, Homo sapiens
auggaauguaaguuauguuugc

SEQ ID NO: 310528 - RNA, 22 nt, Homo sapiens
auggaauguggaaugguaagua

SEQ ID NO: 310529 - RNA, 22 nt, Homo sapiens
augguauuuugugauaccuugu

SEQ ID NO: 310530 - RNA, 22 nt, Homo sapiens
augguugguuaaaucuguguau

SEQ ID NO: 310531 - RNA, 20 nt, Homo sapiens
augucaggaagggagucagg

SEQ ID NO: 310532 - RNA, 22 nt, Homo sapiens
auguccuaaucuccuguucuua

SEQ ID NO: 310533 - RNA, 22 nt, Homo sapiens
augugacagugguuuuaagcgu

SEQ ID NO: 310534 - RNA, 22 nt, Homo sapiens
augugcacauucugguaaauau

SEQ ID NO: 310535 - RNA, 21 nt, Homo sapiens
augugcacuaugucauuuaau

SEQ ID NO: 310536 - RNA, 22 nt, Homo sapiens
augugugcuugugacacagccu

SEQ ID NO: 310537 - RNA, 22 nt, Homo sapiens
auuaagagcacauguucugggu

SEQ ID NO: 310538 - RNA, 22 nt, Homo sapiens
auuagguagugagaugcugcug

SEQ ID NO: 310539 - RNA, 22 nt, Homo sapiens
auucaucagggauauuggucug

SEQ ID NO: 310540 - RNA, 22 nt, Homo sapiens
auuccauagugucuguggcaga

SEQ ID NO: 310541 - RNA, 22 nt, Homo sapiens
auuccauuuguuaucacacccg

SEQ ID NO: 310542 - RNA, 22 nt, Homo sapiens
auucccuuagcugccucagccu

SEQ ID NO: 310543 - RNA, 22 nt, Homo sapiens
auucuugcuugaacuuggugca

SEQ ID NO: 310544 - RNA, 19 nt, Homo sapiens
auugcacuccaaccugggu

SEQ ID NO: 310545 - RNA, 22 nt, Homo sapiens
auugcacuccagccuggcaaua

SEQ ID NO: 310546 - RNA, 22 nt, Homo sapiens
auugcacuccagccugggugac

SEQ ID NO: 310547 - RNA, 22 nt, Homo sapiens
auugcagauucgcuuuguguug

SEQ ID NO: 310548 - RNA, 22 nt, Homo sapiens
auugccuaugauugagguacua

SEQ ID NO: 310549 - RNA, 22 nt, Homo sapiens
auuggcaauagcuuucuuacua

SEQ ID NO: 310550 - RNA, 22 nt, Homo sapiens
auuggucuauuaaaccuaaguu

SEQ ID NO: 310551 - RNA, 22 nt, Homo sapiens
auuguacuagguccuagggcuu

SEQ ID NO: 310552 - RNA, 22 nt, Homo sapiens
auuuaacuggucuaggggccca

SEQ ID NO: 310553 - RNA, 22 nt, Homo sapiens
caaguguuuccuuaaauacuug

SEQ ID NO: 310554 - RNA, 22 nt, Homo sapiens
cacugcacuccagccuaagagg

SEQ ID NO: 310555 - RNA, 22 nt, Homo sapiens
cacugcacuccagucuggcgac

SEQ ID NO: 310556 - RNA, 22 nt, Homo sapiens
cacugcaguguaauuaagguug

SEQ ID NO: 310557 - RNA, 21 nt, Homo sapiens
cacugcaucacaggacagcau

SEQ ID NO: 310558 - RNA, 22 nt, Homo sapiens
cacugcauccuccaccuccugg

SEQ ID NO: 310559 - RNA, 22 nt, Homo sapiens
cacugcauucuccaccucccag

SEQ ID NO: 310560 - RNA, 22 nt, Homo sapiens
cacugcauuggaugguuccucc

SEQ ID NO: 310561 - RNA, 22 nt, Homo sapiens
cacuggacauguugaagcuuuu

SEQ ID NO: 310562 - RNA, 22 nt, Homo sapiens
cacugggugccauauguuugcu

SEQ ID NO: 310563 - RNA, 22 nt, Homo sapiens
cagagaacugaguuauuuucuu

SEQ ID NO: 310564 - RNA, 22 nt, Homo sapiens
cagcugguggcaagaagacaga

SEQ ID NO: 310565 - RNA, 22 nt, Homo sapiens
cagucacugggauuauggucau

SEQ ID NO: 310566 - RNA, 22 nt, Homo sapiens
cagugauaggugguuguuggca

SEQ ID NO: 310567 - RNA, 22 nt, Homo sapiens
caugcacugaguccaccucugg

SEQ ID NO: 310568 - RNA, 22 nt, Homo sapiens
caugccacugcacuccaaccug

SEQ ID NO: 310569 - RNA, 22 nt, Homo sapiens
cauugguuuuucaggaguauau

SEQ ID NO: 310570 - RNA, 22 nt, Homo sapiens
cauuuuacuuuccagacgugga

SEQ ID NO: 310571 - RNA, 22 nt, Homo sapiens
ccagaguggagccuuugcgagg

SEQ ID NO: 310572 - RNA, 22 nt, Homo sapiens
ccagauguuuucauucagcaag

SEQ ID NO: 310573 - RNA, 22 nt, Homo sapiens
ccagucuuggugucuguagcac

SEQ ID NO: 310574 - RNA, 22 nt, Homo sapiens
ccccauguucucucugcagcuc

SEQ ID NO: 310575 - RNA, 22 nt, Homo sapiens
gugugcacaaucuggcaugugc

SEQ ID NO: 310576 - RNA, 22 nt, Homo sapiens
guucacagugguugccuuccag

SEQ ID NO: 310577 - RNA, 22 nt, Homo sapiens
guucaguuugcugaugcguuga

SEQ ID NO: 310578 - RNA, 22 nt, Homo sapiens
uaaagcugaaaugauuaugaca

SEQ ID NO: 310579 - RNA, 22 nt, Homo sapiens
uaacuaaagagaagucaauguc

SEQ ID NO: 310580 - RNA, 22 nt, Homo sapiens
uaacugcaaccucugccugcug

SEQ ID NO: 310581 - RNA, 22 nt, Homo sapiens
uaagcaguaaaugaagucuugc

SEQ ID NO: 310582 - RNA, 22 nt, Homo sapiens
uaaguagugugcauguauguau

SEQ ID NO: 310583 - RNA, 22 nt, Homo sapiens
uaaguaguguugagacaaguuu

SEQ ID NO: 310584 - RNA, 22 nt, Homo sapiens
uaaguaguuuucuuggaggcga

SEQ ID NO: 310585 - RNA, 22 nt, Homo sapiens
uaaguucauucaugaaacuuag

SEQ ID NO: 310586 - RNA, 22 nt, Homo sapiens
uaauacauucaaggugguaguu

SEQ ID NO: 310587 - RNA, 22 nt, Homo sapiens
uaaugcuguggucugguuuaaa

SEQ ID NO: 310588 - RNA, 22 nt, Homo sapiens
uacagaucaguuauuuuguaga

SEQ ID NO: 310589 - RNA, 22 nt, Homo sapiens
uacagcacaggugcagguguug

SEQ ID NO: 310590 - RNA, 22 nt, Homo sapiens
uacagcuaugugcaugcaugcu

SEQ ID NO: 310591 - RNA, 23 nt, Homo sapiens
uacagcugcagaaucaggcuaag

SEQ ID NO: 310592 - RNA, 22 nt, Homo sapiens
uacuagaggaaaacuugaagac

SEQ ID NO: 310593 - RNA, 22 nt, Homo sapiens
uacuagaguagugcagagggga

SEQ ID NO: 310594 - RNA, 22 nt, Homo sapiens
uacugcacauaugaagguuccc

SEQ ID NO: 310595 - RNA, 22 nt, Homo sapiens
uacugcacuccagccuggguga

SEQ ID NO: 310596 - RNA, 22 nt, Homo sapiens
uacugcaucuacuuagagccag

SEQ ID NO: 310597 - RNA, 22 nt, Homo sapiens
uacugcauuccaaucugggcga

SEQ ID NO: 310598 - RNA, 22 nt, Homo sapiens
uagacuguaagauccaggagag

SEQ ID NO: 310599 - RNA, 22 nt, Homo sapiens
uagagcaugugccauacguaca

SEQ ID NO: 310600 - RNA, 21 nt, Homo sapiens
uagauaguugguucugaaucu

SEQ ID NO: 310601 - RNA, 23 nt, Homo sapiens
uagcacuuuuuacauauggacau

SEQ ID NO: 310602 - RNA, 22 nt, Homo sapiens
uagcuggaguuuuuguuauagg

SEQ ID NO: 310603 - RNA, 22 nt, Homo sapiens
uaggcagccagcuguggauuga

SEQ ID NO: 310604 - RNA, 22 nt, Homo sapiens
uaggccuuuuucagauggguag

SEQ ID NO: 310605 - RNA, 22 nt, Homo sapiens
uaggucuccuuuuugccuaaau

SEQ ID NO: 310606 - RNA, 20 nt, Homo sapiens
uaguuggugauacagugcau

SEQ ID NO: 310607 - RNA, 22 nt, Homo sapiens
uaucucagaugagacuuguaac

SEQ ID NO: 310608 - RNA, 22 nt, Homo sapiens
uaugagagcugguagguagaga

SEQ ID NO: 310609 - RNA, 22 nt, Homo sapiens
uaugcacacguguccaugugca

SEQ ID NO: 310610 - RNA, 22 nt, Homo sapiens
uaugcacaugugccugggugug

SEQ ID NO: 310611 - RNA, 22 nt, Homo sapiens
uaugcagacauuguuccaacca

SEQ ID NO: 310612 - RNA, 22 nt, Homo sapiens
uauggauuuuuuugacaagagc

SEQ ID NO: 310613 - RNA, 22 nt, Homo sapiens
uauggccugcguccagugguau

SEQ ID NO: 310614 - RNA, 22 nt, Homo sapiens
uauggcguaugaauuauaucuc

SEQ ID NO: 310615 - RNA, 22 nt, Homo sapiens
uauuaguuuucuguggauuaca

SEQ ID NO: 310616 - RNA, 22 nt, Homo sapiens
uauugcugaugcugaagggaag

SEQ ID NO: 310617 - RNA, 22 nt, Homo sapiens
uauugcuuuugauucaaggcag

SEQ ID NO: 310618 - RNA, 22 nt, Homo sapiens
uauuugguuacuugaauagcua

SEQ ID NO: 310619 - RNA, 22 nt, Homo sapiens
ucaaacugucagguugaccaga

SEQ ID NO: 310620 - RNA, 22 nt, Homo sapiens
ucaaaugauucacccaccuuug

SEQ ID NO: 310621 - RNA, 22 nt, Homo sapiens
ucaaauguuuguuuaaggcuua

SEQ ID NO: 310622 - RNA, 22 nt, Homo sapiens
ucaagcaauucuccucucagcc

SEQ ID NO: 310623 - RNA, 22 nt, Homo sapiens
ucaaggcacuagcugagcugca

SEQ ID NO: 310624 - RNA, 22 nt, Homo sapiens
ucaaguaauacucccaucuugg

SEQ ID NO: 310625 - RNA, 17 nt, Homo sapiens
ucacaguguuaggauga

SEQ ID NO: 310626 - RNA, 23 nt, Homo sapiens
ucacuagaguccuggaguuugag

SEQ ID NO: 310627 - RNA, 22 nt, Homo sapiens
ucacuagaucaagggagagaaa

SEQ ID NO: 310628 - RNA, 22 nt, Homo sapiens
ucacugcacuucaggcuuucuc

SEQ ID NO: 310629 - RNA, 20 nt, Homo sapiens
ucacuggagcucauuugauu

SEQ ID NO: 310630 - RNA, 22 nt, Homo sapiens
ucacuuuguauagcgacuggcu

SEQ ID NO: 310631 - RNA, 22 nt, Homo sapiens
ucagaguagaaacacuuccaua

SEQ ID NO: 310632 - RNA, 22 nt, Homo sapiens
ucagauacuggugacaugaaug

SEQ ID NO: 310633 - RNA, 22 nt, Homo sapiens
ucaggugcagagaagaaauggg

SEQ ID NO: 310634 - RNA, 22 nt, Homo sapiens
ucaggugccuuggcuaauuguu

SEQ ID NO: 310635 - RNA, 21 nt, Homo sapiens
ucagugcugugggcaaggugc

SEQ ID NO: 310636 - RNA, 22 nt, Homo sapiens
ucauagucuaagguucuuuugc

SEQ ID NO: 310637 - RNA, 22 nt, Homo sapiens
ucauguaauuuugugucuauga

SEQ ID NO: 310638 - RNA, 22 nt, Homo sapiens
ucauugguagcucauggaaccg

SEQ ID NO: 310639 - RNA, 22 nt, Homo sapiens
uccacaguaaggacccugccuu

SEQ ID NO: 310640 - RNA, 17 nt, Homo sapiens
uccagauuucaauugaa

SEQ ID NO: 310641 - RNA, 22 nt, Homo sapiens
uccaguguuucuuccacuauuu

SEQ ID NO: 310642 - RNA, 22 nt, Homo sapiens
uccccaguaggcaauuaacacc

SEQ ID NO: 310643 - RNA, 22 nt, Homo sapiens
uccccgagcccaggcugugacu

SEQ ID NO: 310644 - RNA, 22 nt, Homo sapiens
ucccgaggacaucugggggcaa

SEQ ID NO: 310645 - RNA, 22 nt, Homo sapiens
uccuucaguccaguggguuuug

SEQ ID NO: 310646 - RNA, 22 nt, Homo sapiens
ucuauugguaggggcugaggca

SEQ ID NO: 310647 - RNA, 22 nt, Homo sapiens
ucucagcacaaacaaaauugcu

SEQ ID NO: 310648 - RNA, 22 nt, Homo sapiens
ucugacagugagagaaaucuga

SEQ ID NO: 310649 - RNA, 22 nt, Homo sapiens
ucugguggugaugagagacagu

SEQ ID NO: 310650 - RNA, 22 nt, Homo sapiens
ucugugcauuguaggauguuua

SEQ ID NO: 310651 - RNA, 22 nt, Homo sapiens
ucugugcauuuucuuuuagacu

SEQ ID NO: 310652 - RNA, 22 nt, Homo sapiens
ucugugguuguugcauggaaug

SEQ ID NO: 310653 - RNA, 22 nt, Homo sapiens
ucuuaguuuagauuagcaauuc

SEQ ID NO: 310654 - RNA, 22 nt, Homo sapiens
ucuuaguuugggguggggauag

SEQ ID NO: 310655 - RNA, 22 nt, Homo sapiens
ucuuuggguagauauguagcug

SEQ ID NO: 310656 - RNA, 22 nt, Homo sapiens
ugaaacacacagagaagggaga

SEQ ID NO: 310657 - RNA, 22 nt, Homo sapiens
ugaaacacaccuccucuccauc

SEQ ID NO: 310658 - RNA, 18 nt, Homo sapiens
ugaaacacauuuuuuccu

SEQ ID NO: 310659 - RNA, 22 nt, Homo sapiens
ugaaaugucuuuaggaggcuuc

SEQ ID NO: 310660 - RNA, 22 nt, Homo sapiens
ugaaauguuaaacaaguggcuc

SEQ ID NO: 310661 - RNA, 22 nt, Homo sapiens
ugaaauguugggugauggaauc

SEQ ID NO: 310662 - RNA, 22 nt, Homo sapiens
ugaacugagacuagacuuguuc

SEQ ID NO: 310663 - RNA, 22 nt, Homo sapiens
ugaaggacauaaggcagaguga

SEQ ID NO: 310664 - RNA, 22 nt, Homo sapiens
ugaagggcauuguuuugccaaa

SEQ ID NO: 310665 - RNA, 22 nt, Homo sapiens
ugaaguaauguuuuauucuauu

SEQ ID NO: 310666 - RNA, 21 nt, Homo sapiens
ugaaguagcauaggaugucaa

SEQ ID NO: 310667 - RNA, 22 nt, Homo sapiens
ugaauauuugcuacucacucuu

SEQ ID NO: 310668 - RNA, 21 nt, Homo sapiens
ugaauauuuggguugugucca

SEQ ID NO: 310669 - RNA, 22 nt, Homo sapiens
ugaaucaugcugcuauaaagac

SEQ ID NO: 310670 - RNA, 19 nt, Homo sapiens
ugacacuguuggugggagg

SEQ ID NO: 310671 - RNA, 22 nt, Homo sapiens
ugacagcaucaggauuggagag

SEQ ID NO: 310672 - RNA, 22 nt, Homo sapiens
agguacuuucccaaccauacug

SEQ ID NO: 310673 - RNA, 22 nt, Homo sapiens
agguaguguuauuugcagcuga

SEQ ID NO: 310674 - RNA, 22 nt, Homo sapiens
aggucccauguccucccugacc

SEQ ID NO: 310675 - RNA, 22 nt, Homo sapiens
aggugcugagcagagaauccug

SEQ ID NO: 310676 - RNA, 22 nt, Homo sapiens
aggugguuuugaugagcaggua

SEQ ID NO: 310677 - RNA, 20 nt, Homo sapiens
agguuauuauaauuagaaga

SEQ ID NO: 310678 - RNA, 20 nt, Homo sapiens
agguucaaaucccaaucaug

SEQ ID NO: 310679 - RNA, 22 nt, Homo sapiens
aguaaagcaucagcuagaugug

SEQ ID NO: 310680 - RNA, 22 nt, Homo sapiens
aguaacauuucuaguagagagu

SEQ ID NO: 310681 - RNA, 22 nt, Homo sapiens
aguaagucucaagguaggguag

SEQ ID NO: 310682 - RNA, 22 nt, Homo sapiens
aguaccacgugaugccauuuuc

SEQ ID NO: 310683 - RNA, 22 nt, Homo sapiens
agucacaugcauuuucuucaau

SEQ ID NO: 310684 - RNA, 22 nt, Homo sapiens
agucaguguguauugauggcac

SEQ ID NO: 310685 - RNA, 22 nt, Homo sapiens
agugcacuccagccugggcaac

SEQ ID NO: 310686 - RNA, 22 nt, Homo sapiens
agugcaguggcauggucauaac

SEQ ID NO: 310687 - RNA, 22 nt, Homo sapiens
agugccaaaucgagggcucuga

SEQ ID NO: 310688 - RNA, 22 nt, Homo sapiens
aguggaguguaaagcgucuuuu

SEQ ID NO: 310689 - RNA, 22 nt, Homo sapiens
aguggcacuauucucagaguca

SEQ ID NO: 310690 - RNA, 22 nt, Homo sapiens
agugggccccuagaggugaggu

SEQ ID NO: 310691 - RNA, 19 nt, Homo sapiens
agugggcuagaaaucaggg

SEQ ID NO: 310692 - RNA, 22 nt, Homo sapiens
agugucaggagacagguagcug

SEQ ID NO: 310693 - RNA, 22 nt, Homo sapiens
aguguuuuucaugggauacuuu

SEQ ID NO: 310694 - RNA, 22 nt, Homo sapiens
auaaagcaagucucuggccuca

SEQ ID NO: 310695 - RNA, 22 nt, Homo sapiens
auaaagcuauuccucucuuuuu

SEQ ID NO: 310696 - RNA, 18 nt, Homo sapiens
auaaccuggugcuuucaa

SEQ ID NO: 310697 - RNA, 22 nt, Homo sapiens
auaaggaguaucauauuaaaac

SEQ ID NO: 310698 - RNA, 22 nt, Homo sapiens
auaauagcugaucauuuagaag

SEQ ID NO: 310699 - RNA, 22 nt, Homo sapiens
auaauguuugauugagcagaua

SEQ ID NO: 310700 - RNA, 18 nt, Homo sapiens
auacaagcagcagagauu

SEQ ID NO: 310701 - RNA, 22 nt, Homo sapiens
auacagacacagucagaggggu

SEQ ID NO: 310702 - RNA, 22 nt, Homo sapiens
auacagcuaaaauauuaaguua

SEQ ID NO: 310703 - RNA, 22 nt, Homo sapiens
auacagguauacaaugcauaau

SEQ ID NO: 310704 - RNA, 22 nt, Homo sapiens
auacaugugugagcgaagaugu

SEQ ID NO: 310705 - RNA, 22 nt, Homo sapiens
auacccaguaguggaauugcua

SEQ ID NO: 310706 - RNA, 22 nt, Homo sapiens
auaccugguagucuugcuacac

SEQ ID NO: 310707 - RNA, 22 nt, Homo sapiens
auagcacauggcauccucucuu

SEQ ID NO: 310708 - RNA, 22 nt, Homo sapiens
auagcagcuugucagggcagac

SEQ ID NO: 310709 - RNA, 22 nt, Homo sapiens
auagcagugugaaaauguacua

SEQ ID NO: 310710 - RNA, 22 nt, Homo sapiens
auaggcacauuaggaacuuuug

SEQ ID NO: 310711 - RNA, 22 nt, Homo sapiens
auagugcugcaacaaauauacg

SEQ ID NO: 310712 - RNA, 22 nt, Homo sapiens
auagugcugcagucaauguacg

SEQ ID NO: 310713 - RNA, 19 nt, Homo sapiens
auauaacauccaggagcag

SEQ ID NO: 310714 - RNA, 22 nt, Homo sapiens
auauaugcacacgugugcauau

SEQ ID NO: 310715 - RNA, 22 nt, Homo sapiens
auaugcacgugcauacacacuu

SEQ ID NO: 310716 - RNA, 22 nt, Homo sapiens
auaugguuuuuggaagcauauc

SEQ ID NO: 310717 - RNA, 22 nt, Homo sapiens
auauguaguauggaaacauugu

SEQ ID NO: 310718 - RNA, 22 nt, Homo sapiens
auaugucuauuauuagggcagg

SEQ ID NO: 310719 - RNA, 22 nt, Homo sapiens
auauuacuggcuauaucgcaag

SEQ ID NO: 310720 - RNA, 22 nt, Homo sapiens
auauucacagguaucagagauu

SEQ ID NO: 310721 - RNA, 22 nt, Homo sapiens
auauuguuggcugcuggcugau

SEQ ID NO: 310722 - RNA, 22 nt, Homo sapiens
aucaaaucuccagaaccugucu

SEQ ID NO: 310723 - RNA, 22 nt, Homo sapiens
aucacaauuguacguaggagcc

SEQ ID NO: 310724 - RNA, 22 nt, Homo sapiens
aucacagauauggguuuaaauc

SEQ ID NO: 310725 - RNA, 22 nt, Homo sapiens
aucacaguggcucacaagagcc

SEQ ID NO: 310726 - RNA, 22 nt, Homo sapiens
aucacuuugcucuccagugugg

SEQ ID NO: 310727 - RNA, 20 nt, Homo sapiens
aucagagacuaggauugcca

SEQ ID NO: 310728 - RNA, 22 nt, Homo sapiens
aucauauccuagauauaacuuc

SEQ ID NO: 310729 - RNA, 22 nt, Homo sapiens
aucauccugucaggagcuguga

SEQ ID NO: 310730 - RNA, 22 nt, Homo sapiens
aucauggaguauuugcaagucu

SEQ ID NO: 310731 - RNA, 22 nt, Homo sapiens
aucccaguaaaaauggcuucua

SEQ ID NO: 310732 - RNA, 22 nt, Homo sapiens
aucuccaggugccagcugcgcc

SEQ ID NO: 310733 - RNA, 22 nt, Homo sapiens
aucuggcuccuuuugacaaugc

SEQ ID NO: 310734 - RNA, 22 nt, Homo sapiens
aucuggcuucuuuuaguccaca

SEQ ID NO: 310735 - RNA, 22 nt, Homo sapiens
aucugguguuuccuucacauug

SEQ ID NO: 310736 - RNA, 22 nt, Homo sapiens
aucuuguguugaauggugcaga

SEQ ID NO: 310737 - RNA, 22 nt, Homo sapiens
augaaaagcauaaacgcugaag

SEQ ID NO: 310738 - RNA, 22 nt, Homo sapiens
augaacagagccuugagaaccu

SEQ ID NO: 310739 - RNA, 22 nt, Homo sapiens
augaagacaucgucugggauua

SEQ ID NO: 310740 - RNA, 22 nt, Homo sapiens
augaagagaaaguggaucuugg

SEQ ID NO: 310741 - RNA, 20 nt, Homo sapiens
augaaggcaggugugaguuu

SEQ ID NO: 310742 - RNA, 22 nt, Homo sapiens
augaaguguguguucaagucuu

SEQ ID NO: 310743 - RNA, 22 nt, Homo sapiens
augaccuuguccucagugucau

SEQ ID NO: 310744 - RNA, 22 nt, Homo sapiens
augacuaaaggguuuauguuga

SEQ ID NO: 310745 - RNA, 22 nt, Homo sapiens
augacuagaggagggauggcca

SEQ ID NO: 310746 - RNA, 22 nt, Homo sapiens
augacugagacuaacuuacuuu

SEQ ID NO: 310747 - RNA, 22 nt, Homo sapiens
augacugucagggcagucauug

SEQ ID NO: 310748 - RNA, 22 nt, Homo sapiens
augacuuuucugaaaaccacca

SEQ ID NO: 310749 - RNA, 22 nt, Homo sapiens
augagacauuaaaguguguuug

SEQ ID NO: 310750 - RNA, 22 nt, Homo sapiens
augagauaggaacaaacuuaca

SEQ ID NO: 310751 - RNA, 22 nt, Homo sapiens
augagauauuuuauaagaucau

SEQ ID NO: 310752 - RNA, 22 nt, Homo sapiens
augaggagguaugauuuucuga

SEQ ID NO: 310753 - RNA, 18 nt, Homo sapiens
augagucauuguggaaau

SEQ ID NO: 310754 - RNA, 22 nt, Homo sapiens
augauauggguugucaguugua

SEQ ID NO: 310755 - RNA, 22 nt, Homo sapiens
augaucacaccacugcacucca

SEQ ID NO: 310756 - RNA, 22 nt, Homo sapiens
augcaaacaucauagaguguac

SEQ ID NO: 310757 - RNA, 20 nt, Homo sapiens
augcaaacccugcuuugugg

SEQ ID NO: 310758 - RNA, 22 nt, Homo sapiens
augcaauucuagauugauagua

SEQ ID NO: 310759 - RNA, 22 nt, Homo sapiens
augcacuguuuucuugaugaga

SEQ ID NO: 310760 - RNA, 22 nt, Homo sapiens
augcagguguuuugcacugagu

SEQ ID NO: 310761 - RNA, 20 nt, Homo sapiens
augccacugagcagugguga

SEQ ID NO: 310762 - RNA, 22 nt, Homo sapiens
augccagggagaauuguucaag

SEQ ID NO: 310763 - RNA, 22 nt, Homo sapiens
augcuguuuuguagcucccucu

SEQ ID NO: 310764 - RNA, 22 nt, Homo sapiens
auggagaugugcgaacugagua

SEQ ID NO: 310765 - RNA, 22 nt, Homo sapiens
auggcaaaauguuccuaguggu

SEQ ID NO: 310766 - RNA, 22 nt, Homo sapiens
auggcaagaagagcaauuauuu

SEQ ID NO: 310767 - RNA, 22 nt, Homo sapiens
auggcacuaaugggaguuuacu

SEQ ID NO: 310768 - RNA, 22 nt, Homo sapiens
auggcacugauggaaguaccuu

SEQ ID NO: 310769 - RNA, 22 nt, Homo sapiens
auggcacuguguauuuuucugu

SEQ ID NO: 310770 - RNA, 22 nt, Homo sapiens
auggcagcccucuuuauccaug

SEQ ID NO: 310771 - RNA, 22 nt, Homo sapiens
auggcccuguguggagcugcug

SEQ ID NO: 310772 - RNA, 22 nt, Homo sapiens
auggccuuuuuaucucaccaag

SEQ ID NO: 310773 - RNA, 22 nt, Homo sapiens
caugggacugucuuggcuauac

SEQ ID NO: 310774 - RNA, 21 nt, Homo sapiens
caugucacugcacucuagccu

SEQ ID NO: 310775 - RNA, 22 nt, Homo sapiens
caugucuuuuauucugugugau

SEQ ID NO: 310776 - RNA, 20 nt, Homo sapiens
cauuccacuuuccugucagu

SEQ ID NO: 310777 - RNA, 20 nt, Homo sapiens
cauugcccuccagccugggc

SEQ ID NO: 310778 - RNA, 22 nt, Homo sapiens
cauugcuuuuggugguuuagac

SEQ ID NO: 310779 - RNA, 22 nt, Homo sapiens
cauugguuggacaguucucucu

SEQ ID NO: 310780 - RNA, 19 nt, Homo sapiens
ccacaaugguugaacuaga

SEQ ID NO: 310781 - RNA, 22 nt, Homo sapiens
ccacacugucuuggugggaaac

SEQ ID NO: 310782 - RNA, 22 nt, Homo sapiens
ccacagucuaugcaacaagguc

SEQ ID NO: 310783 - RNA, 22 nt, Homo sapiens
ccacaguugaaauuuugacugu

SEQ ID NO: 310784 - RNA, 22 nt, Homo sapiens
ccaggguuccacgccuggcugu

SEQ ID NO: 310785 - RNA, 18 nt, Homo sapiens
ccagugcaaggaaagccc

SEQ ID NO: 310786 - RNA, 21 nt, Homo sapiens
ccaugggacggaaugaauaca

SEQ ID NO: 310787 - RNA, 22 nt, Homo sapiens
cccagagacagaaugauaaacu

SEQ ID NO: 310788 - RNA, 18 nt, Homo sapiens
cccagugacuuauggccu

SEQ ID NO: 310789 - RNA, 19 nt, Homo sapiens
cccagugucagagaagggu

SEQ ID NO: 310790 - RNA, 22 nt, Homo sapiens
cccagugugcugggugacagcu

SEQ ID NO: 310791 - RNA, 22 nt, Homo sapiens
cccaguguguuguggauauuua

SEQ ID NO: 310792 - RNA, 17 nt, Homo sapiens
ccccugagcgaugcagu

SEQ ID NO: 310793 - RNA, 23 nt, Homo sapiens
cccucagaagugcagggagagaa

SEQ ID NO: 310794 - RNA, 22 nt, Homo sapiens
ccuccauuugugucaggaaguc

SEQ ID NO: 310795 - RNA, 21 nt, Homo sapiens
ccugaagaagugaccucugag

SEQ ID NO: 310796 - RNA, 22 nt, Homo sapiens
ccuggcacugggccccguggcu

SEQ ID NO: 310797 - RNA, 22 nt, Homo sapiens
ccuguguuaugguuucuaaugu

SEQ ID NO: 310798 - RNA, 22 nt, Homo sapiens
cgcuggugucuaagcgacagcu

SEQ ID NO: 310799 - RNA, 22 nt, Homo sapiens
cggcaguggguaagccaagcuu

SEQ ID NO: 310800 - RNA, 22 nt, Homo sapiens
cuacaguguauuuauggagggu

SEQ ID NO: 310801 - RNA, 22 nt, Homo sapiens
cuaggcuguagagaaguucagu

SEQ ID NO: 310802 - RNA, 22 nt, Homo sapiens
cuauuagguuggugcaaaaguc

SEQ ID NO: 310803 - RNA, 22 nt, Homo sapiens
cuauuugcauucagaggcaugu

SEQ ID NO: 310804 - RNA, 22 nt, Homo sapiens
cucaaagucaagggaaagcagg

SEQ ID NO: 310805 - RNA, 22 nt, Homo sapiens
cucaaagugcugggacuggcug

SEQ ID NO: 310806 - RNA, 22 nt, Homo sapiens
cucagcuacuugagaggcuuag

SEQ ID NO: 310807 - RNA, 22 nt, Homo sapiens
cucagucuaugauacuuugcua

SEQ ID NO: 310808 - RNA, 22 nt, Homo sapiens
cucaguuuugccuuguuuaagg

SEQ ID NO: 310809 - RNA, 21 nt, Homo sapiens
cucauauugcuuuuccauggu

SEQ ID NO: 310810 - RNA, 22 nt, Homo sapiens
cucauggagauagagaauagaa

SEQ ID NO: 310811 - RNA, 22 nt, Homo sapiens
cucgcuccauuucggugaucaa

SEQ ID NO: 310812 - RNA, 22 nt, Homo sapiens
cucucugagccauggcugcccu

SEQ ID NO: 310813 - RNA, 22 nt, Homo sapiens
cucucuguuugucuguuauugg

SEQ ID NO: 310814 - RNA, 22 nt, Homo sapiens
cugaaagguauacgcuuguuau

SEQ ID NO: 310815 - RNA, 22 nt, Homo sapiens
cugaagugcuugccacauaaaa

SEQ ID NO: 310816 - RNA, 22 nt, Homo sapiens
cugaaucauugcauuaucaagg

SEQ ID NO: 310817 - RNA, 22 nt, Homo sapiens
cugaauguucuggauggaagag

SEQ ID NO: 310818 - RNA, 22 nt, Homo sapiens
cugaccucugucaaagacaccc

SEQ ID NO: 310819 - RNA, 22 nt, Homo sapiens
cugagaaugaugauuuccaguu

SEQ ID NO: 310820 - RNA, 22 nt, Homo sapiens
cugagaauguaaaugaagcuuu

SEQ ID NO: 310821 - RNA, 22 nt, Homo sapiens
cugagacacucuuaucugcaua

SEQ ID NO: 310822 - RNA, 22 nt, Homo sapiens
cugagaucaagucuugcucugu

SEQ ID NO: 310823 - RNA, 22 nt, Homo sapiens
cugagaucugaaccaggagugu

SEQ ID NO: 310824 - RNA, 22 nt, Homo sapiens
cugagcuaugccuggaaaggca

SEQ ID NO: 310825 - RNA, 22 nt, Homo sapiens
cugagguuguucuucucagugg

SEQ ID NO: 310826 - RNA, 22 nt, Homo sapiens
cugauuuguccccagccucaug

SEQ ID NO: 310827 - RNA, 22 nt, Homo sapiens
cugcaaauacuugugggauuuu

SEQ ID NO: 310828 - RNA, 22 nt, Homo sapiens
cugccuagaucugaaccuggcu

SEQ ID NO: 310829 - RNA, 22 nt, Homo sapiens
cuggaaagcaaagggugcauug

SEQ ID NO: 310830 - RNA, 22 nt, Homo sapiens
cuggaagcacaacgcauuuauu

SEQ ID NO: 310831 - RNA, 22 nt, Homo sapiens
cuggcaaauaguagagccagga

SEQ ID NO: 310832 - RNA, 22 nt, Homo sapiens
cuggugagaugucuuuccucuu

SEQ ID NO: 310833 - RNA, 22 nt, Homo sapiens
cugugacugcagggcauauuug

SEQ ID NO: 310834 - RNA, 22 nt, Homo sapiens
cugugaucuuuuuucauguggu

SEQ ID NO: 310835 - RNA, 22 nt, Homo sapiens
cugugcauggauuuuaagauug

SEQ ID NO: 310836 - RNA, 22 nt, Homo sapiens
cuguucaaauuguuugugaagu

SEQ ID NO: 310837 - RNA, 22 nt, Homo sapiens
cuucaaguaauucugauggcua

SEQ ID NO: 310838 - RNA, 20 nt, Homo sapiens
cuucacagaaguggaaucau

SEQ ID NO: 310839 - RNA, 22 nt, Homo sapiens
cuucaugggagaaccacaggua

SEQ ID NO: 310840 - RNA, 18 nt, Homo sapiens
cuucauugcuguuuugcu

SEQ ID NO: 310841 - RNA, 22 nt, Homo sapiens
cuuccauaguauuuuuacaaaa

SEQ ID NO: 310842 - RNA, 22 nt, Homo sapiens
cuucuguuaguucugauaacuu

SEQ ID NO: 310843 - RNA, 22 nt, Homo sapiens
cuugccuuugucuucaaaggcu

SEQ ID NO: 310844 - RNA, 22 nt, Homo sapiens
cuuggcaugaagaauaauuuuu

SEQ ID NO: 310845 - RNA, 21 nt, Homo sapiens
cuugucuugcuuagaauagac

SEQ ID NO: 310846 - RNA, 22 nt, Homo sapiens
cuuucugaggagaauagagaac

SEQ ID NO: 310847 - RNA, 22 nt, Homo sapiens
cuuugcaaaacauugagaccuc

SEQ ID NO: 310848 - RNA, 22 nt, Homo sapiens
cuuugguugugcucuccacuuu

SEQ ID NO: 310849 - RNA, 22 nt, Homo sapiens
cuuuuggucuaucagagaagca

SEQ ID NO: 310850 - RNA, 22 nt, Homo sapiens
cuuuuggugugaagaagcucuu

SEQ ID NO: 310851 - RNA, 22 nt, Homo sapiens
gaagaucacacuguagaucuau

SEQ ID NO: 310852 - RNA, 22 nt, Homo sapiens
gaaggcacugugugccacccug

SEQ ID NO: 310853 - RNA, 23 nt, Homo sapiens
gaaguaauaaauggauucuuaac

SEQ ID NO: 310854 - RNA, 22 nt, Homo sapiens
gaagugcuuuuggacuaacagu

SEQ ID NO: 310855 - RNA, 19 nt, Homo sapiens
gaaguguuuguucuccaug

SEQ ID NO: 310856 - RNA, 22 nt, Homo sapiens
gaaucacugugguaucccaugc

SEQ ID NO: 310857 - RNA, 22 nt, Homo sapiens
gacagacacaauugauccauga

SEQ ID NO: 310858 - RNA, 22 nt, Homo sapiens
gacagguuuucuguuucugaaa

SEQ ID NO: 310859 - RNA, 22 nt, Homo sapiens
gacaguuucucaggcuuccuua

SEQ ID NO: 310860 - RNA, 20 nt, Homo sapiens
gacauggaggaggauuauua

SEQ ID NO: 310861 - RNA, 22 nt, Homo sapiens
gacccucuagagggaagcgcuu

SEQ ID NO: 310862 - RNA, 17 nt, Homo sapiens
gacgaucaucaggaggc

SEQ ID NO: 310863 - RNA, 20 nt, Homo sapiens
gacuucagaagcuucagagu

SEQ ID NO: 310864 - RNA, 22 nt, Homo sapiens
gagaacagagauaauuuuacuu

SEQ ID NO: 310865 - RNA, 22 nt, Homo sapiens
gagaacuaaugguuugauaagg

SEQ ID NO: 310866 - RNA, 22 nt, Homo sapiens
gagaaguaaauuuauuugcaaa

SEQ ID NO: 310867 - RNA, 22 nt, Homo sapiens
gagacagugucagccauugaaa

SEQ ID NO: 310868 - RNA, 22 nt, Homo sapiens
gagagugugucagaggcugcga

SEQ ID NO: 310869 - RNA, 22 nt, Homo sapiens
gagauacacccagugcagaggc

SEQ ID NO: 310870 - RNA, 22 nt, Homo sapiens
gagaucacuguuuauauucucu

SEQ ID NO: 310871 - RNA, 22 nt, Homo sapiens
gagaucacuucuguauucuaca

SEQ ID NO: 310872 - RNA, 22 nt, Homo sapiens
gagaucaugcugguucucucau

SEQ ID NO: 310873 - RNA, 22 nt, Homo sapiens
gagaugaugagauguucacagu

SEQ ID NO: 310874 - RNA, 22 nt, Homo sapiens
cauguauagauuccauaguggu

SEQ ID NO: 310875 - RNA, 22 nt, Homo sapiens
cauugguuuuucaggaguauau

SEQ ID NO: 310876 - RNA, 22 nt, Homo sapiens
ccaaaguauuuucacugauauc

SEQ ID NO: 310877 - RNA, 22 nt, Homo sapiens
ccaaaucucauguugaaaugug

SEQ ID NO: 310878 - RNA, 22 nt, Homo sapiens
ccaaggcacugauucuguacuc

SEQ ID NO: 310879 - RNA, 23 nt, Homo sapiens
ccacacuguuuagaauggcauca

SEQ ID NO: 310880 - RNA, 22 nt, Homo sapiens
ccacccuggagaauuugagguc

SEQ ID NO: 310881 - RNA, 22 nt, Homo sapiens
ccacccuuccacacccugggua

SEQ ID NO: 310882 - RNA, 22 nt, Homo sapiens
ccagugcauggaucccaggggg

SEQ ID NO: 310883 - RNA, 22 nt, Homo sapiens
ccagugcugugcaguguaugag

SEQ ID NO: 310884 - RNA, 19 nt, Homo sapiens
ccaguguucugauugcacu

SEQ ID NO: 310885 - RNA, 19 nt, Homo sapiens
ccaguguugccagagcuga

SEQ ID NO: 310886 - RNA, 18 nt, Homo sapiens
ccauucaacagauuuguc

SEQ ID NO: 310887 - RNA, 22 nt, Homo sapiens
cccagaguucuuaaauacugag

SEQ ID NO: 310888 - RNA, 22 nt, Homo sapiens
cccaguguuuauuuugagccaa

SEQ ID NO: 310889 - RNA, 21 nt, Homo sapiens
cccugguguuuggaguuugag

SEQ ID NO: 310890 - RNA, 22 nt, Homo sapiens
cccuucauucaaggguugugag

SEQ ID NO: 310891 - RNA, 22 nt, Homo sapiens
ccucauggagaacaucugcuag

SEQ ID NO: 310892 - RNA, 22 nt, Homo sapiens
ccucauugcuaucccaggcuga

SEQ ID NO: 310893 - RNA, 22 nt, Homo sapiens
ccugagacugauugacucacaa

SEQ ID NO: 310894 - RNA, 22 nt, Homo sapiens
ccugagaucauacuguuaguaa

SEQ ID NO: 310895 - RNA, 22 nt, Homo sapiens
ccugucuugaagagauccuccu

SEQ ID NO: 310896 - RNA, 22 nt, Homo sapiens
ccuucuuuuguaaggcugaaua

SEQ ID NO: 310897 - RNA, 22 nt, Homo sapiens
ccuuuguuuaguugaauuguau

SEQ ID NO: 310898 - RNA, 22 nt, Homo sapiens
cuaacacagagguuuauuucuc

SEQ ID NO: 310899 - RNA, 22 nt, Homo sapiens
cuaagcaccuuaguggggaauc

SEQ ID NO: 310900 - RNA, 18 nt, Homo sapiens
cuaauacuauucaacaag

SEQ ID NO: 310901 - RNA, 21 nt, Homo sapiens
cuaaucucacccuuuucuggg

SEQ ID NO: 310902 - RNA, 22 nt, Homo sapiens
cuacaguaugaaaccuuuacuc

SEQ ID NO: 310903 - RNA, 22 nt, Homo sapiens
cuacauuguagguauucaaacu

SEQ ID NO: 310904 - RNA, 22 nt, Homo sapiens
cuagauuguuuccauaaugaca

SEQ ID NO: 310905 - RNA, 22 nt, Homo sapiens
cuagcagaacaauacaauucgg

SEQ ID NO: 310906 - RNA, 22 nt, Homo sapiens
cuagcuuuuuaugacaaucuug

SEQ ID NO: 310907 - RNA, 22 nt, Homo sapiens
cuagucacauuuucaucaaaua

SEQ ID NO: 310908 - RNA, 22 nt, Homo sapiens
cuaucucaggcccaggcccuug

SEQ ID NO: 310909 - RNA, 18 nt, Homo sapiens
cucacaguaacuuuuaag

SEQ ID NO: 310910 - RNA, 22 nt, Homo sapiens
cucacugcauuucaguuuuguu

SEQ ID NO: 310911 - RNA, 22 nt, Homo sapiens
cucacugggaccacucugaagu

SEQ ID NO: 310912 - RNA, 22 nt, Homo sapiens
cucagugucuggggccccaggg

SEQ ID NO: 310913 - RNA, 22 nt, Homo sapiens
cucccugagccagggcuuugac

SEQ ID NO: 310914 - RNA, 21 nt, Homo sapiens
cucucugcuuaugaauaguga

SEQ ID NO: 310915 - RNA, 22 nt, Homo sapiens
cugacagaugacugccacugua

SEQ ID NO: 310916 - RNA, 22 nt, Homo sapiens
cugagaacaucauucagauauu

SEQ ID NO: 310917 - RNA, 22 nt, Homo sapiens
cugagauaggacucugcuggcu

SEQ ID NO: 310918 - RNA, 22 nt, Homo sapiens
cugagaucaugggucagguggu

SEQ ID NO: 310919 - RNA, 22 nt, Homo sapiens
cugagcaaaguucuauuuaugg

SEQ ID NO: 310920 - RNA, 22 nt, Homo sapiens
cugagcaagucauuuuguuaaa

SEQ ID NO: 310921 - RNA, 22 nt, Homo sapiens
cugaggaaguucuuuaacaguu

SEQ ID NO: 310922 - RNA, 22 nt, Homo sapiens
cugaggauauucagccucugug

SEQ ID NO: 310923 - RNA, 20 nt, Homo sapiens
cugcacauccacucuacuuc

SEQ ID NO: 310924 - RNA, 22 nt, Homo sapiens
cugcauuggguuaugcauuuuu

SEQ ID NO: 310925 - RNA, 22 nt, Homo sapiens
cugccuagauguuguagggggu

SEQ ID NO: 310926 - RNA, 22 nt, Homo sapiens
cuggcaaaaagagggcaauaau

SEQ ID NO: 310927 - RNA, 22 nt, Homo sapiens
cuggcaagagugaaccagcugu

SEQ ID NO: 310928 - RNA, 22 nt, Homo sapiens
cuggcccaguucugcguuuugc

SEQ ID NO: 310929 - RNA, 22 nt, Homo sapiens
cugggguaggacuggcuuuuga

SEQ ID NO: 310930 - RNA, 22 nt, Homo sapiens
cugguuuguaaaguuccugaga

SEQ ID NO: 310931 - RNA, 22 nt, Homo sapiens
cuguaagcauuauaaagagaua

SEQ ID NO: 310932 - RNA, 19 nt, Homo sapiens
cugucacugaggaagacug

SEQ ID NO: 310933 - RNA, 22 nt, Homo sapiens
cugucuagagggcacaugaugc

SEQ ID NO: 310934 - RNA, 22 nt, Homo sapiens
ugaagggcauuguuuugccaaa

SEQ ID NO: 310935 - RNA, 22 nt, Homo sapiens
ugaauacugugcaaaggauuug

SEQ ID NO: 310936 - RNA, 22 nt, Homo sapiens
ugaauagugucacaauaaacau

SEQ ID NO: 310937 - RNA, 22 nt, Homo sapiens
ugaauauguuucuaaaagugca

SEQ ID NO: 310938 - RNA, 22 nt, Homo sapiens
ugaaucaugcugcuauaaagac

SEQ ID NO: 310939 - RNA, 22 nt, Homo sapiens
ugaaugcaucuagaaauuuauu

SEQ ID NO: 310940 - RNA, 22 nt, Homo sapiens
ugaauucuguccaaaauaacug

SEQ ID NO: 310941 - RNA, 22 nt, Homo sapiens
ugacaagggaaaugcaaaaugu

SEQ ID NO: 310942 - RNA, 20 nt, Homo sapiens
ugacaaggugcaaagaauca

SEQ ID NO: 310943 - RNA, 20 nt, Homo sapiens
ugacaagugagaauuauggg

SEQ ID NO: 310944 - RNA, 22 nt, Homo sapiens
ugacaagugauuaaggcauauu

SEQ ID NO: 310945 - RNA, 22 nt, Homo sapiens
ugacacagcaagauggaaccau

SEQ ID NO: 310946 - RNA, 22 nt, Homo sapiens
ugacaggagauuaugugauguu

SEQ ID NO: 310947 - RNA, 22 nt, Homo sapiens
ugacaggauggagaucgguauu

SEQ ID NO: 310948 - RNA, 23 nt, Homo sapiens
ugacagucucccgauggcuaggc

SEQ ID NO: 310949 - RNA, 22 nt, Homo sapiens
ugacagugugagauccugucuc

SEQ ID NO: 310950 - RNA, 18 nt, Homo sapiens
ugacaguuucuuuauauu

SEQ ID NO: 310951 - RNA, 22 nt, Homo sapiens
ugacaugaugagcaauaauggc

SEQ ID NO: 310952 - RNA, 22 nt, Homo sapiens
ugacggaggcauuggaagcuug

SEQ ID NO: 310953 - RNA, 22 nt, Homo sapiens
ugacuaaggaaggauuaugugc

SEQ ID NO: 310954 - RNA, 22 nt, Homo sapiens
ugacuagagggcuuuuguguag

SEQ ID NO: 310955 - RNA, 19 nt, Homo sapiens
ugacuauagccugaucagu

SEQ ID NO: 310956 - RNA, 22 nt, Homo sapiens
ugacuauaguaaucacuucaca

SEQ ID NO: 310957 - RNA, 22 nt, Homo sapiens
ugacuuuagaauuuuauccaga

SEQ ID NO: 310958 - RNA, 21 nt, Homo sapiens
ugagaacaacaggucaagcag

SEQ ID NO: 310959 - RNA, 22 nt, Homo sapiens
ugagaacauggagaacccccca

SEQ ID NO: 310960 - RNA, 16 nt, Homo sapiens
ugagaacaugggguau

SEQ ID NO: 310961 - RNA, 16 nt, Homo sapiens
ugagaacaugugacau

SEQ ID NO: 310962 - RNA, 22 nt, Homo sapiens
ugagaacuaaaaugugguauau

SEQ ID NO: 310963 - RNA, 22 nt, Homo sapiens
ugagaagacaucagcuuucgga

SEQ ID NO: 310964 - RNA, 22 nt, Homo sapiens
ugagaagacaucuuugcuuugu

SEQ ID NO: 310965 - RNA, 22 nt, Homo sapiens
ugagaauauuuuccaugucuca

SEQ ID NO: 310966 - RNA, 22 nt, Homo sapiens
ugagaaugaugauugguaaacc

SEQ ID NO: 310967 - RNA, 22 nt, Homo sapiens
ugagacacugaauccggccuga

SEQ ID NO: 310968 - RNA, 22 nt, Homo sapiens
ugagacaucacaaaauccucaa

SEQ ID NO: 310969 - RNA, 22 nt, Homo sapiens
ugagagacagacauuaucuuau

SEQ ID NO: 310970 - RNA, 22 nt, Homo sapiens
ugagagacaguuuguuaaaauu

SEQ ID NO: 310971 - RNA, 21 nt, Homo sapiens
ugagauaauauguuucugaug

SEQ ID NO: 310972 - RNA, 22 nt, Homo sapiens
ugagauaaucaugugguuuuug

SEQ ID NO: 310973 - RNA, 22 nt, Homo sapiens
ugagauaguacuuuuuuaaagg

SEQ ID NO: 310974 - RNA, 22 nt, Homo sapiens
ugagaucauguguggaccccag

SEQ ID NO: 310975 - RNA, 20 nt, Homo sapiens
ugagauccacgugaaguaug

SEQ ID NO: 310976 - RNA, 23 nt, Homo sapiens
ugagaucuacagaucucagaucu

SEQ ID NO: 310977 - RNA, 22 nt, Homo sapiens
ugagaucugauaggccuggguu

SEQ ID NO: 310978 - RNA, 22 nt, Homo sapiens
ugagaucugucuuuauaguauu

SEQ ID NO: 310979 - RNA, 22 nt, Homo sapiens
ugagaucuuaucagaaauggug

SEQ ID NO: 310980 - RNA, 22 nt, Homo sapiens
ugagaugcauauucuggcuccu

SEQ ID NO: 310981 - RNA, 20 nt, Homo sapiens
ugagaugcauugggauguuu

SEQ ID NO: 310982 - RNA, 22 nt, Homo sapiens
ugagcaagaucuuuauaauuag

SEQ ID NO: 310983 - RNA, 22 nt, Homo sapiens
ugagccaaguucacaccauugc

SEQ ID NO: 310984 - RNA, 22 nt, Homo sapiens
ugagcccauuguccugguuuau

SEQ ID NO: 310985 - RNA, 22 nt, Homo sapiens
ugagcuaggaucacaccugcau

SEQ ID NO: 310986 - RNA, 22 nt, Homo sapiens
ugagcuguuugaagaagcauuu

SEQ ID NO: 310987 - RNA, 22 nt, Homo sapiens
ugaggauaguguugaaggcagg

SEQ ID NO: 310988 - RNA, 22 nt, Homo sapiens
ugagguaauagauaauauuuuu

SEQ ID NO: 310989 - RNA, 22 nt, Homo sapiens
ugagguaugacuuauuauucuu

SEQ ID NO: 310990 - RNA, 20 nt, Homo sapiens
ugaggucaggaguuacagac

SEQ ID NO: 310991 - RNA, 22 nt, Homo sapiens
ugagucauguaauaaugcugcu

SEQ ID NO: 310992 - RNA, 22 nt, Homo sapiens
ugagugaaagaagcacuaagga

SEQ ID NO: 310993 - RNA, 22 nt, Homo sapiens
ugaguuccuugugugaccuugc

SEQ ID NO: 310994 - RNA, 22 nt, Homo sapiens
ugaguuguagcuauaguuucuu

SEQ ID NO: 310995 - RNA, 22 nt, Homo sapiens
ugaguuguaggggucaccuggc

SEQ ID NO: 310996 - RNA, 22 nt, Homo sapiens
ugaguuguugcauucuuggugu

SEQ ID NO: 310997 - RNA, 22 nt, Homo sapiens
ugauaggucuguuuugaaaagg

SEQ ID NO: 310998 - RNA, 18 nt, Homo sapiens
ugauaucaaugauagcca

SEQ ID NO: 310999 - RNA, 22 nt, Homo sapiens
ugauaugaaagggaaauaagug

SEQ ID NO: 311000 - RNA, 23 nt, Homo sapiens
ugauaugccuaggaguauauuuu

SEQ ID NO: 311001 - RNA, 22 nt, Homo sapiens
ugauauguggauucagcucaaa

SEQ ID NO: 311002 - RNA, 21 nt, Homo sapiens
ugaucacaugaaaaccaugca

SEQ ID NO: 311003 - RNA, 22 nt, Homo sapiens
ugaugacucuguggccccaggc

SEQ ID NO: 311004 - RNA, 22 nt, Homo sapiens
ugaugcugaguggcuauuugaa

SEQ ID NO: 311005 - RNA, 22 nt, Homo sapiens
ugaugucuugcaggcacgagau

SEQ ID NO: 311006 - RNA, 22 nt, Homo sapiens
ugauguguuuuguaguucaacu

SEQ ID NO: 311007 - RNA, 22 nt, Homo sapiens
ugauuggagaugaauuucguuu

SEQ ID NO: 311008 - RNA, 19 nt, Homo sapiens
ugauuguaagcuuggugag

SEQ ID NO: 311009 - RNA, 22 nt, Homo sapiens
ugcaagacacuguccugggcau

SEQ ID NO: 311010 - RNA, 22 nt, Homo sapiens
ugcaagacugcaguuacuuuug

SEQ ID NO: 311011 - RNA, 22 nt, Homo sapiens
ugcaaguaauuccagcuacuga

SEQ ID NO: 311012 - RNA, 22 nt, Homo sapiens
guggcagugugaggauccugcu

SEQ ID NO: 311013 - RNA, 22 nt, Homo sapiens
guggcaugaaagcaucugugau

SEQ ID NO: 311014 - RNA, 22 nt, Homo sapiens
guggcuagaaugaagguagcug

SEQ ID NO: 311015 - RNA, 22 nt, Homo sapiens
gugggguagcaggcuccuaucu

SEQ ID NO: 311016 - RNA, 22 nt, Homo sapiens
gugggguaggugacuugaugag

SEQ ID NO: 311017 - RNA, 22 nt, Homo sapiens
gugguucuagaauugaguaucc

SEQ ID NO: 311018 - RNA, 22 nt, Homo sapiens
guguaaaacaauuagaggauuu

SEQ ID NO: 311019 - RNA, 22 nt, Homo sapiens
guguauacauagaauuguguau

SEQ ID NO: 311020 - RNA, 22 nt, Homo sapiens
guguaugugagaaugcucaugu

SEQ ID NO: 311021 - RNA, 22 nt, Homo sapiens
guguccucgaguacacaucagg

SEQ ID NO: 311022 - RNA, 22 nt, Homo sapiens
gugucuccuguggagcuaugua

SEQ ID NO: 311023 - RNA, 21 nt, Homo sapiens
gugugcuugaauucagcuguc

SEQ ID NO: 311024 - RNA, 22 nt, Homo sapiens
guguugcacauucuguggaugu

SEQ ID NO: 311025 - RNA, 22 nt, Homo sapiens
guucaucagggauauuggcuua

SEQ ID NO: 311026 - RNA, 22 nt, Homo sapiens
guugaaaucaucacuuggcaug

SEQ ID NO: 311027 - RNA, 22 nt, Homo sapiens
guugaucuauguugcuggcagu

SEQ ID NO: 311028 - RNA, 20 nt, Homo sapiens
guugaugcugaaguugcuua

SEQ ID NO: 311029 - RNA, 22 nt, Homo sapiens
guugcaaaguaauugugguuuu

SEQ ID NO: 311030 - RNA, 22 nt, Homo sapiens
guugguuuccuguaacuggaca

SEQ ID NO: 311031 - RNA, 22 nt, Homo sapiens
guuuacagucgacuugggaaua

SEQ ID NO: 311032 - RNA, 22 nt, Homo sapiens
guuuuuggggucacuauuaccg

SEQ ID NO: 311033 - RNA, 22 nt, Homo sapiens
uaaacugcuugaaaugguguca

SEQ ID NO: 311034 - RNA, 22 nt, Homo sapiens
uaaagcacuuuuuucugcaugg

SEQ ID NO: 311035 - RNA, 22 nt, Homo sapiens
uaaagccauugucaaguuugua

SEQ ID NO: 311036 - RNA, 22 nt, Homo sapiens
uaaagcuacagagcggaaaauu

SEQ ID NO: 311037 - RNA, 20 nt, Homo sapiens
uaaagcugcucagggggcuc

SEQ ID NO: 311038 - RNA, 22 nt, Homo sapiens
uaaagugcugagaugaggcugg

SEQ ID NO: 311039 - RNA, 20 nt, Homo sapiens
uaaaugccucaugcuuuauu

SEQ ID NO: 311040 - RNA, 22 nt, Homo sapiens
uaaauggauauugccaucuccu

SEQ ID NO: 311041 - RNA, 22 nt, Homo sapiens
uaacuguggaaaugacuuuaaa

SEQ ID NO: 311042 - RNA, 20 nt, Homo sapiens
uaacuguggcuucuuuuggc

SEQ ID NO: 311043 - RNA, 16 nt, Homo sapiens
uaagccccacgugcau

SEQ ID NO: 311044 - RNA, 22 nt, Homo sapiens
uaaggcuuugguagguuugguc

SEQ ID NO: 311045 - RNA, 22 nt, Homo sapiens
uaaggcuuugucuuaggacuuu

SEQ ID NO: 311046 - RNA, 22 nt, Homo sapiens
uaaguauuaugugcugcauuuu

SEQ ID NO: 311047 - RNA, 22 nt, Homo sapiens
uaagugcaugauuacaugcaua

SEQ ID NO: 311048 - RNA, 21 nt, Homo sapiens
ucacauggccagaguaggaac

SEQ ID NO: 311049 - RNA, 22 nt, Homo sapiens
ucacaugugacauauauauuug

SEQ ID NO: 311050 - RNA, 22 nt, Homo sapiens
ucacauguguaaauugguguaa

SEQ ID NO: 311051 - RNA, 22 nt, Homo sapiens
ucacauuaagcuguuauuucuu

SEQ ID NO: 311052 - RNA, 22 nt, Homo sapiens
ucacauuguacaaacagguaag

SEQ ID NO: 311053 - RNA, 22 nt, Homo sapiens
ucaccuggagccuucacauucu

SEQ ID NO: 311054 - RNA, 18 nt, Homo sapiens
ucacggggagcagcagcc

SEQ ID NO: 311055 - RNA, 22 nt, Homo sapiens
ucacugcacuagguaaugccac

SEQ ID NO: 311056 - RNA, 22 nt, Homo sapiens
ucacugcgaccuccaccucccg

SEQ ID NO: 311057 - RNA, 22 nt, Homo sapiens
ucacugcgaccucugccucccg

SEQ ID NO: 311058 - RNA, 22 nt, Homo sapiens
ucacuggagguuccugaaguuc

SEQ ID NO: 311059 - RNA, 22 nt, Homo sapiens
ucacugugguuuugaugugcau

SEQ ID NO: 311060 - RNA, 22 nt, Homo sapiens
ucagagucuagaucacucacug

SEQ ID NO: 311061 - RNA, 22 nt, Homo sapiens
ucagaucaguuccacaagaacu

SEQ ID NO: 311062 - RNA, 22 nt, Homo sapiens
ucagcaucacgugggcucccgu

SEQ ID NO: 311063 - RNA, 19 nt, Homo sapiens
ucaguagugcacauaagcc

SEQ ID NO: 311064 - RNA, 22 nt, Homo sapiens
ucaguggauuuaaccugaauca

SEQ ID NO: 311065 - RNA, 22 nt, Homo sapiens
ucaguguuuggaaucucaauuu

SEQ ID NO: 311066 - RNA, 22 nt, Homo sapiens
ucaguuaaugcugccugcugga

SEQ ID NO: 311067 - RNA, 22 nt, Homo sapiens
ucauagaucaaguaauaagaca

SEQ ID NO: 311068 - RNA, 16 nt, Homo sapiens
ucaucacagucucugg

SEQ ID NO: 311069 - RNA, 22 nt, Homo sapiens
ucaucagaaucccuuagggaug

SEQ ID NO: 311070 - RNA, 22 nt, Homo sapiens
ucaucaggcucauucaagcuga

SEQ ID NO: 311071 - RNA, 22 nt, Homo sapiens
ucaucagguaugucagcggagu

SEQ ID NO: 311072 - RNA, 22 nt, Homo sapiens
ucauggggugagcuacaggcac

SEQ ID NO: 311073 - RNA, 23 nt, Homo sapiens
ucauguauucccuguaaugggua

SEQ ID NO: 311074 - RNA, 22 nt, Homo sapiens
ucauucauucauccagcuugag

SEQ ID NO: 311075 - RNA, 22 nt, Homo sapiens
ucauugcacuucuuuaguugca

SEQ ID NO: 311076 - RNA, 22 nt, Homo sapiens
ucauugguagcucauggaaccg

SEQ ID NO: 311077 - RNA, 22 nt, Homo sapiens
uccacaauggcugaacuagauu

SEQ ID NO: 311078 - RNA, 19 nt, Homo sapiens
uccacagugguugaacuag

SEQ ID NO: 311079 - RNA, 22 nt, Homo sapiens
uccacuuuugugcugaauugga

SEQ ID NO: 311080 - RNA, 22 nt, Homo sapiens
uccagugugcaggcaaguuuga

SEQ ID NO: 311081 - RNA, 22 nt, Homo sapiens
uccauuuguagguagugagaca

SEQ ID NO: 311082 - RNA, 22 nt, Homo sapiens
uccauuuguucagcuucaggaa

SEQ ID NO: 311083 - RNA, 22 nt, Homo sapiens
uccauuuguuguaggguauagu

SEQ ID NO: 311084 - RNA, 19 nt, Homo sapiens
uccccgggucuagugcagc

SEQ ID NO: 311085 - RNA, 22 nt, Homo sapiens
uccccgucacacgcaggcuuac

SEQ ID NO: 311086 - RNA, 22 nt, Homo sapiens
ucccugacagucacagagcuac

SEQ ID NO: 311087 - RNA, 19 nt, Homo sapiens
ucccugagucuuagcuuga

SEQ ID NO: 311088 - RNA, 22 nt, Homo sapiens
ucccuguguccugggggcaccu

SEQ ID NO: 311089 - RNA, 22 nt, Homo sapiens
uccuucaguccaguggguuuug

SEQ ID NO: 311090 - RNA, 22 nt, Homo sapiens
uccuugguugauccugugcaga

SEQ ID NO: 311091 - RNA, 22 nt, Homo sapiens
uccuuuagacugaauccugaga

SEQ ID NO: 311092 - RNA, 22 nt, Homo sapiens
uccuuuaguuaauaaagacaag

SEQ ID NO: 311093 - RNA, 22 nt, Homo sapiens
uccuuuggucaguauucuuuug

SEQ ID NO: 311094 - RNA, 22 nt, Homo sapiens
uccuuugguuauaggcaccucu

SEQ ID NO: 311095 - RNA, 22 nt, Homo sapiens
ucgcauggucuccaggcagcuc

SEQ ID NO: 311096 - RNA, 23 nt, Homo sapiens
ucgguccccuuggcugcccucgg

SEQ ID NO: 311097 - RNA, 22 nt, Homo sapiens
ucgugcugugucaucuuguggc

SEQ ID NO: 311098 - RNA, 22 nt, Homo sapiens
ucuacagccaguucaggaagaa

SEQ ID NO: 311099 - RNA, 22 nt, Homo sapiens
ucuacccugugagggacacagu

SEQ ID NO: 311100 - RNA, 22 nt, Homo sapiens
ucuaucacagccccacacucuc

SEQ ID NO: 311101 - RNA, 22 nt, Homo sapiens
ucucaauuugauuacauucaua

SEQ ID NO: 311102 - RNA, 22 nt, Homo sapiens
ucucacacugaauguguguggg

SEQ ID NO: 311103 - RNA, 18 nt, Homo sapiens
ucucacagcaaucuguca

SEQ ID NO: 311104 - RNA, 22 nt, Homo sapiens
ucucaguggugcuggcagggga

SEQ ID NO: 311105 - RNA, 22 nt, Homo sapiens
ucucaugaagguggagaguagg

SEQ ID NO: 311106 - RNA, 22 nt, Homo sapiens
ucucauggagguagagaguaaa

SEQ ID NO: 311107 - RNA, 22 nt, Homo sapiens
ucucccauccguacacggauug

SEQ ID NO: 311108 - RNA, 22 nt, Homo sapiens
ucucccuaccugagccgagcca

SEQ ID NO: 311109 - RNA, 22 nt, Homo sapiens
ucuccggguggcggcgaaggga

SEQ ID NO: 311110 - RNA, 22 nt, Homo sapiens
ucucuguuuauuuuugguguau

SEQ ID NO: 311111 - RNA, 22 nt, Homo sapiens
ucugacaaugaacaaucuauag

SEQ ID NO: 311112 - RNA, 20 nt, Homo sapiens
ucuggccccucuaaaucuca

SEQ ID NO: 311113 - RNA, 22 nt, Homo sapiens
ucuggccuagaacaauuaauua

SEQ ID NO: 311114 - RNA, 22 nt, Homo sapiens
ucuggcuccacacuuuauuaac

SEQ ID NO: 311115 - RNA, 16 nt, Homo sapiens
ucuggcucuacaguuc

SEQ ID NO: 311116 - RNA, 22 nt, Homo sapiens
ucuggcuuauuucacuuagcau

SEQ ID NO: 311117 - RNA, 22 nt, Homo sapiens
ucuggcuucugacuuaggggac

SEQ ID NO: 311118 - RNA, 22 nt, Homo sapiens
ucuggcuuuuaacaucuauaaa

SEQ ID NO: 311119 - RNA, 22 nt, Homo sapiens
ucugguuccugcauucauucaa

SEQ ID NO: 311120 - RNA, 22 nt, Homo sapiens
ucuguaguuaacagcuucagcu

SEQ ID NO: 311121 - RNA, 22 nt, Homo sapiens
uaucuacauguagguauguaug

SEQ ID NO: 311122 - RNA, 22 nt, Homo sapiens
uaugaacacuuuugggaggcau

SEQ ID NO: 311123 - RNA, 22 nt, Homo sapiens
uaugaaucugagagaucuggaa

SEQ ID NO: 311124 - RNA, 22 nt, Homo sapiens
uaugaaucuggcuacuccaggg

SEQ ID NO: 311125 - RNA, 22 nt, Homo sapiens
uaugacauaguccuuaacccuc

SEQ ID NO: 311126 - RNA, 22 nt, Homo sapiens
uaugacuguuugcucauucagg

SEQ ID NO: 311127 - RNA, 22 nt, Homo sapiens
uaugcuguuucugauuuaggga

SEQ ID NO: 311128 - RNA, 22 nt, Homo sapiens
uauggauuugccuauucuguau

SEQ ID NO: 311129 - RNA, 22 nt, Homo sapiens
uauggccccuacaugugcaaaa

SEQ ID NO: 311130 - RNA, 22 nt, Homo sapiens
uauggcccuuaaguauugguug

SEQ ID NO: 311131 - RNA, 22 nt, Homo sapiens
uauggcugugacuuaucuuguu

SEQ ID NO: 311132 - RNA, 22 nt, Homo sapiens
uaugguuuuggaauccugcaga

SEQ ID NO: 311133 - RNA, 22 nt, Homo sapiens
uauuacagaccauaucgccggg

SEQ ID NO: 311134 - RNA, 22 nt, Homo sapiens
uauuacuguuauuccuaucaaa

SEQ ID NO: 311135 - RNA, 22 nt, Homo sapiens
uauuagguugguggaaaaguaa

SEQ ID NO: 311136 - RNA, 22 nt, Homo sapiens
uauuccacacuguuggugggau

SEQ ID NO: 311137 - RNA, 22 nt, Homo sapiens
uauugauuaauugugauuaggc

SEQ ID NO: 311138 - RNA, 22 nt, Homo sapiens
uauugcaauuggggaaacuggg

SEQ ID NO: 311139 - RNA, 22 nt, Homo sapiens
uauugcuuaugaugcugaauua

SEQ ID NO: 311140 - RNA, 22 nt, Homo sapiens
uauuguccacuuugcacugugu

SEQ ID NO: 311141 - RNA, 22 nt, Homo sapiens
uauuguuaaagauguuaaugau

SEQ ID NO: 311142 - RNA, 22 nt, Homo sapiens
ucaaacugcuugaggccauuua

SEQ ID NO: 311143 - RNA, 20 nt, Homo sapiens
ucaaaguaugcucugcacua

SEQ ID NO: 311144 - RNA, 20 nt, Homo sapiens
ucaaauucuuggccuccagc

SEQ ID NO: 311145 - RNA, 22 nt, Homo sapiens
ucaacugcuugagaucacaaau

SEQ ID NO: 311146 - RNA, 22 nt, Homo sapiens
ucacaguccuguuuaggagagg

SEQ ID NO: 311147 - RNA, 22 nt, Homo sapiens
ucacagucuccucuagggaggg

SEQ ID NO: 311148 - RNA, 22 nt, Homo sapiens
ucacagugaguggaguggggug

SEQ ID NO: 311149 - RNA, 23 nt, Homo sapiens
ucacaguggcugcuuaauuguga

SEQ ID NO: 311150 - RNA, 22 nt, Homo sapiens
ucacaguguuaaaccuuucuuu

SEQ ID NO: 311151 - RNA, 17 nt, Homo sapiens
ucacaguguuaggauga

SEQ ID NO: 311152 - RNA, 22 nt, Homo sapiens
ucacaguugauugaaacacagc

SEQ ID NO: 311153 - RNA, 22 nt, Homo sapiens
ucacauggaggugauaguugaa

SEQ ID NO: 311154 - RNA, 22 nt, Homo sapiens
aagucaugaagaggaaaggaca

SEQ ID NO: 311155 - RNA, 22 nt, Homo sapiens
aaguccccugacagaggggagg

SEQ ID NO: 311156 - RNA, 22 nt, Homo sapiens
aagugagugacaaaaacugggc

SEQ ID NO: 311157 - RNA, 22 nt, Homo sapiens
aagugcucuugugggaagagag

SEQ ID NO: 311158 - RNA, 22 nt, Homo sapiens
aagugcuuaggauagugugugg

SEQ ID NO: 311159 - RNA, 22 nt, Homo sapiens
aagugcuuuacacaugcaugau

SEQ ID NO: 311160 - RNA, 22 nt, Homo sapiens
aagugcuuuguacagggguuga

SEQ ID NO: 311161 - RNA, 22 nt, Homo sapiens
aagugguagggucaggauugga

SEQ ID NO: 311162 - RNA, 19 nt, Homo sapiens
aauaaugccagaugucugu

SEQ ID NO: 311163 - RNA, 22 nt, Homo sapiens
aauaugguuuuaugaagcaauu

SEQ ID NO: 311164 - RNA, 22 nt, Homo sapiens
aauaugucuugaaauuggguaa

SEQ ID NO: 311165 - RNA, 19 nt, Homo sapiens
aauauugacaguggugucu

SEQ ID NO: 311166 - RNA, 22 nt, Homo sapiens
aaucacagccagcuuccgcuau

SEQ ID NO: 311167 - RNA, 22 nt, Homo sapiens
aaucacauuaaugcucccucag

SEQ ID NO: 311168 - RNA, 22 nt, Homo sapiens
aaucagagcccucugagcuuca

SEQ ID NO: 311169 - RNA, 16 nt, Homo sapiens
aauccauuggcccugc

SEQ ID NO: 311170 - RNA, 22 nt, Homo sapiens
aaucucagagauaucugugucc

SEQ ID NO: 311171 - RNA, 22 nt, Homo sapiens
aaucucagcauuuugggcugag

SEQ ID NO: 311172 - RNA, 22 nt, Homo sapiens
aaucugucuagacaaggagucu

SEQ ID NO: 311173 - RNA, 22 nt, Homo sapiens
aauggcaaauguuuucuguuga

SEQ ID NO: 311174 - RNA, 22 nt, Homo sapiens
aauggcaagagccacagaggcg

SEQ ID NO: 311175 - RNA, 22 nt, Homo sapiens
aauggcagaugaaauugucauu

SEQ ID NO: 311176 - RNA, 22 nt, Homo sapiens
aauggcauugguccuuuuggau

SEQ ID NO: 311177 - RNA, 22 nt, Homo sapiens
aaugugccuacuggagcuugca

SEQ ID NO: 311178 - RNA, 22 nt, Homo sapiens
aauuaggcuagaauguuauuaa

SEQ ID NO: 311179 - RNA, 22 nt, Homo sapiens
aauucacuucuuuuaggcaggg

SEQ ID NO: 311180 - RNA, 22 nt, Homo sapiens
aauucacuuguggcagauccuu

SEQ ID NO: 311181 - RNA, 22 nt, Homo sapiens
aauucuguauuguuuagggacu

SEQ ID NO: 311182 - RNA, 22 nt, Homo sapiens
aauugcuucuguauuuuggaca

SEQ ID NO: 311183 - RNA, 22 nt, Homo sapiens
acaagacuucuuguauucuagu

SEQ ID NO: 311184 - RNA, 22 nt, Homo sapiens
acaagcacaaauuuaauccugu

SEQ ID NO: 311185 - RNA, 22 nt, Homo sapiens
acaagugaauacaggauucucu

SEQ ID NO: 311186 - RNA, 22 nt, Homo sapiens
acacuguagcugagggcaugcg

SEQ ID NO: 311187 - RNA, 22 nt, Homo sapiens
acacuuucuagacaagggaaua

SEQ ID NO: 311188 - RNA, 20 nt, Homo sapiens
acagcacugguuucaagcaa

SEQ ID NO: 311189 - RNA, 22 nt, Homo sapiens
acagugcugucugcuuuggcua

SEQ ID NO: 311190 - RNA, 22 nt, Homo sapiens
acagugcuuggcacacaguaau

SEQ ID NO: 311191 - RNA, 19 nt, Homo sapiens
acagugucucuauaaugau

SEQ ID NO: 311192 - RNA, 22 nt, Homo sapiens
acaguguguguguucaccuaga

SEQ ID NO: 311193 - RNA, 22 nt, Homo sapiens
acauaguagacacugaaaauau

SEQ ID NO: 311194 - RNA, 22 nt, Homo sapiens
acaucccuuucccacccuucac

SEQ ID NO: 311195 - RNA, 22 nt, Homo sapiens
acauggcuuaugaauuuggaga

SEQ ID NO: 311196 - RNA, 22 nt, Homo sapiens
acauugcucuuaccaaguuugu

SEQ ID NO: 311197 - RNA, 19 nt, Homo sapiens
accagauugcauucuugga

SEQ ID NO: 311198 - RNA, 22 nt, Homo sapiens
accaguguuuaccaaguagcau

SEQ ID NO: 311199 - RNA, 22 nt, Homo sapiens
acccagaguuccuugucuuuca

SEQ ID NO: 311200 - RNA, 22 nt, Homo sapiens
acccaguguucaacauucacau

SEQ ID NO: 311201 - RNA, 22 nt, Homo sapiens
acccaguguucagacuaccugu

SEQ ID NO: 311202 - RNA, 17 nt, Homo sapiens
accccuaccucagaagc

SEQ ID NO: 311203 - RNA, 22 nt, Homo sapiens
acccuggaguaguaggaaucug

SEQ ID NO: 311204 - RNA, 18 nt, Homo sapiens
accuucauuccuuugccu

SEQ ID NO: 311205 - RNA, 22 nt, Homo sapiens
accuugcacugagccgagauug

SEQ ID NO: 311206 - RNA, 22 nt, Homo sapiens
uggcuacugaccugcuaggggg

SEQ ID NO: 311207 - RNA, 19 nt, Homo sapiens
uggcuagaggccaggcguu

SEQ ID NO: 311208 - RNA, 22 nt, Homo sapiens
uggcucauuucuaaacccagcu

SEQ ID NO: 311209 - RNA, 22 nt, Homo sapiens
uggcuuuuccuugaaucugccu

SEQ ID NO: 311210 - RNA, 22 nt, Homo sapiens
ugggaagaagguuuacuugcca

SEQ ID NO: 311211 - RNA, 22 nt, Homo sapiens
ugggaagauucuguguuuuucc

SEQ ID NO: 311212 - RNA, 22 nt, Homo sapiens
ugggagugugcacaauuucagc

SEQ ID NO: 311213 - RNA, 22 nt, Homo sapiens
ugggcaaaacuaagagcugugg

SEQ ID NO: 311214 - RNA, 22 nt, Homo sapiens
uggguaggaccagaaaugcacu

SEQ ID NO: 311215 - RNA, 21 nt, Homo sapiens
uggguaguuuucaaggccccg

SEQ ID NO: 311216 - RNA, 19 nt, Homo sapiens
uggguaguuuucuggcugg

SEQ ID NO: 311217 - RNA, 22 nt, Homo sapiens
uggguaguuuuucagcucuugc

SEQ ID NO: 311218 - RNA, 22 nt, Homo sapiens
ugguaaaaugucauuuaccaga

SEQ ID NO: 311219 - RNA, 22 nt, Homo sapiens
ugguaagaaaaccauuauuagc

SEQ ID NO: 311220 - RNA, 22 nt, Homo sapiens
uggucaccuucuugcucugucu

SEQ ID NO: 311221 - RNA, 22 nt, Homo sapiens
uggucccucugaaaauugggug

SEQ ID NO: 311222 - RNA, 21 nt, Homo sapiens
uggucccuucagaucggauuu

SEQ ID NO: 311223 - RNA, 22 nt, Homo sapiens
uggugcccuguccuucuguggc

SEQ ID NO: 311224 - RNA, 22 nt, Homo sapiens
uggugcuuaaauaaggcuuuca

SEQ ID NO: 311225 - RNA, 20 nt, Homo sapiens
ugguguuugaacagugaaug

SEQ ID NO: 311226 - RNA, 22 nt, Homo sapiens
uguaaaaagcccagccgcugag

SEQ ID NO: 311227 - RNA, 22 nt, Homo sapiens
uguaagcauuauauaauuguug

SEQ ID NO: 311228 - RNA, 22 nt, Homo sapiens
uguacaaaacaagaugggggua

SEQ ID NO: 311229 - RNA, 22 nt, Homo sapiens
uguagcaaauaaaagucuggau

SEQ ID NO: 311230 - RNA, 22 nt, Homo sapiens
uguauagaucugauucaucucc

SEQ ID NO: 311231 - RNA, 22 nt, Homo sapiens
uguauauguuuguacauauguc

SEQ ID NO: 311232 - RNA, 22 nt, Homo sapiens
uguauguugauguuauauucug

SEQ ID NO: 311233 - RNA, 22 nt, Homo sapiens
uguauuuguuguuaaauggaga

SEQ ID NO: 311234 - RNA, 22 nt, Homo sapiens
ugucacugugaguuugacugcu

SEQ ID NO: 311235 - RNA, 22 nt, Homo sapiens
ugucaggaguuuuagaaucuua

SEQ ID NO: 311236 - RNA, 18 nt, Homo sapiens
ugucccuuugcuguucau

SEQ ID NO: 311237 - RNA, 21 nt, Homo sapiens
ugucuuggagccagacgccag

SEQ ID NO: 311238 - RNA, 22 nt, Homo sapiens
ugugaacagaauuagucaccua

SEQ ID NO: 311239 - RNA, 22 nt, Homo sapiens
ugugacagcacagcaucucuuu

SEQ ID NO: 311240 - RNA, 22 nt, Homo sapiens
ugugacagcacgguucaacugc

SEQ ID NO: 311241 - RNA, 22 nt, Homo sapiens
ugugacagguauccuguguucu

SEQ ID NO: 311242 - RNA, 22 nt, Homo sapiens
ugugacaguguuacauuucaug

SEQ ID NO: 311243 - RNA, 22 nt, Homo sapiens
ugugaugaagaguccaagaaca

SEQ ID NO: 311244 - RNA, 15 nt, Homo sapiens
aaacccugucucaag

SEQ ID NO: 311245 - RNA, 22 nt, Homo sapiens
aaacugucuucugacaguuucc

SEQ ID NO: 311246 - RNA, 22 nt, Homo sapiens
aaagagaucuaugggcacuaug

SEQ ID NO: 311247 - RNA, 22 nt, Homo sapiens
aaagcacuggagucaucaucua

SEQ ID NO: 311248 - RNA, 22 nt, Homo sapiens
aaaggauucuaauggaaaugcu

SEQ ID NO: 311249 - RNA, 22 nt, Homo sapiens
aaaggcacacacuccuuguuau

SEQ ID NO: 311250 - RNA, 22 nt, Homo sapiens
aaaggcaucugcucggcucccu

SEQ ID NO: 311251 - RNA, 22 nt, Homo sapiens
aaaggcuucggaucagaaggua

SEQ ID NO: 311252 - RNA, 22 nt, Homo sapiens
aaagucuagaggaucaugugug

SEQ ID NO: 311253 - RNA, 22 nt, Homo sapiens
aaagugcugagaguucuaacuu

SEQ ID NO: 311254 - RNA, 22 nt, Homo sapiens
aaagugcugggauuggcugggc

SEQ ID NO: 311255 - RNA, 22 nt, Homo sapiens
aaagugcuuccuuuuugagggu

SEQ ID NO: 311256 - RNA, 22 nt, Homo sapiens
aaagugcuucucuuuggugggu

SEQ ID NO: 311257 - RNA, 22 nt, Homo sapiens
aaaguguuucugcaguagguuu

SEQ ID NO: 311258 - RNA, 22 nt, Homo sapiens
aaaugcacagaaaggaugugga

SEQ ID NO: 311259 - RNA, 22 nt, Homo sapiens
aaaugcagauucugcuuagguu

SEQ ID NO: 311260 - RNA, 22 nt, Homo sapiens
aaaugcugcuuuggccucuucu

SEQ ID NO: 311261 - RNA, 22 nt, Homo sapiens
aaauggauuaaguucacuugcu

SEQ ID NO: 311262 - RNA, 22 nt, Homo sapiens
aaauggcuuuuugggcaaggug

SEQ ID NO: 311263 - RNA, 22 nt, Homo sapiens
aaauucaugucaccucuaggua

SEQ ID NO: 311264 - RNA, 18 nt, Homo sapiens
aaauucugucccuucuuc

SEQ ID NO: 311265 - RNA, 22 nt, Homo sapiens
aaauugcuuuugaagacuuagu

SEQ ID NO: 311266 - RNA, 22 nt, Homo sapiens
aaauuguccuauugguuuaagc

SEQ ID NO: 311267 - RNA, 22 nt, Homo sapiens
aacaguaucuaacgagugauga

SEQ ID NO: 311268 - RNA, 22 nt, Homo sapiens
aacagugccugucauuuaguag

SEQ ID NO: 311269 - RNA, 21 nt, Homo sapiens
aacagugcuuaguagauguuc

SEQ ID NO: 311270 - RNA, 22 nt, Homo sapiens
aacaucaaccaugaggguugga

SEQ ID NO: 311271 - RNA, 22 nt, Homo sapiens
aacccugacacaagcagaauuu

SEQ ID NO: 311272 - RNA, 21 nt, Homo sapiens
aacuggugugagaugguaugu

SEQ ID NO: 311273 - RNA, 22 nt, Homo sapiens
aagagguaauaacaaagcuucu

SEQ ID NO: 311274 - RNA, 22 nt, Homo sapiens
aagagguaggaaauggucauuu

SEQ ID NO: 311275 - RNA, 22 nt, Homo sapiens
aagagguagucugucccuuagc

SEQ ID NO: 311276 - RNA, 22 nt, Homo sapiens
aagaucaucauagagggcauga

SEQ ID NO: 311277 - RNA, 22 nt, Homo sapiens
aagcacccagccucacgccugc

SEQ ID NO: 311278 - RNA, 22 nt, Homo sapiens
aagcacccuuugucuggacaug

SEQ ID NO: 311279 - RNA, 22 nt, Homo sapiens
aagcuggagugcaguggugcaa

SEQ ID NO: 311280 - RNA, 22 nt, Homo sapiens
aagcuggauuuaguguggagca

SEQ ID NO: 311281 - RNA, 22 nt, Homo sapiens
aagcuggcuuucauugagugcu

SEQ ID NO: 311282 - RNA, 22 nt, Homo sapiens
aaggauuguaacaccaagguua

SEQ ID NO: 311283 - RNA, 22 nt, Homo sapiens
aaggcaagaaaauggauucucc

SEQ ID NO: 311284 - RNA, 22 nt, Homo sapiens
aaggcaagaaugcgugcuuuca

SEQ ID NO: 311285 - RNA, 22 nt, Homo sapiens
aaggcaguggcagaagauguca

SEQ ID NO: 311286 - RNA, 22 nt, Homo sapiens
aagggaauguuguagcugguuu

SEQ ID NO: 311287 - RNA, 22 nt, Homo sapiens
aagggaauguuguggcugguug

SEQ ID NO: 311288 - RNA, 22 nt, Homo sapiens
aagggaauguugugguugguuu

SEQ ID NO: 311289 - RNA, 22 nt, Homo sapiens
aagguggaguugacaauuuuca

SEQ ID NO: 311290 - RNA, 22 nt, Homo sapiens
aagguggugucagagagcuuau

SEQ ID NO: 311291 - RNA, 22 nt, Homo sapiens
aagguguagucucuggauaagc

SEQ ID NO: 311292 - RNA, 22 nt, Homo sapiens
aaguauagcuaugauaaacauu

SEQ ID NO: 311293 - RNA, 22 nt, Homo sapiens
aaguaucaggaauaguuauugg

SEQ ID NO: 311294 - RNA, 22 nt, Homo sapiens
aagucaaggagagaggcgucag

SEQ ID NO: 311295 - RNA, 22 nt, Homo sapiens
cuuccugaguccugggcucaca

SEQ ID NO: 311296 - RNA, 19 nt, Homo sapiens
cuugccccauucauccucu

SEQ ID NO: 311297 - RNA, 22 nt, Homo sapiens
cuuggauuauaauggaauauuu

SEQ ID NO: 311298 - RNA, 22 nt, Homo sapiens
cuuggcuuguuguccccugcuc

SEQ ID NO: 311299 - RNA, 22 nt, Homo sapiens
cuuguacacuguuggugggaau

SEQ ID NO: 311300 - RNA, 22 nt, Homo sapiens
cuugugcaugaccccagguggg

SEQ ID NO: 311301 - RNA, 22 nt, Homo sapiens
cuuuacaguuggacucacgagg

SEQ ID NO: 311302 - RNA, 22 nt, Homo sapiens
cuuugaugagaaaauacuuugu

SEQ ID NO: 311303 - RNA, 22 nt, Homo sapiens
cuuugcaaauggccuuuccaag

SEQ ID NO: 311304 - RNA, 22 nt, Homo sapiens
cuuugguuaauaggauauggca

SEQ ID NO: 311305 - RNA, 22 nt, Homo sapiens
cuuuuggcuuaagauugucuug

SEQ ID NO: 311306 - RNA, 22 nt, Homo sapiens
gaaagacuuucugcuguggaua

SEQ ID NO: 311307 - RNA, 22 nt, Homo sapiens
gaaagcuaaugacuuuggguga

SEQ ID NO: 311308 - RNA, 22 nt, Homo sapiens
gaaagcugguauagauacauua

SEQ ID NO: 311309 - RNA, 22 nt, Homo sapiens
gaaagguaggaacagggugcag

SEQ ID NO: 311310 - RNA, 22 nt, Homo sapiens
gaaaguaauuaacgauuguugc

SEQ ID NO: 311311 - RNA, 22 nt, Homo sapiens
gaaauggaucagagcaagcuuu

SEQ ID NO: 311312 - RNA, 22 nt, Homo sapiens
gaaauguuuuucaugugggcaa

SEQ ID NO: 311313 - RNA, 22 nt, Homo sapiens
gaacuguuucuggugaaagagu

SEQ ID NO: 311314 - RNA, 22 nt, Homo sapiens
gaagaacuaggugagaucuaga

SEQ ID NO: 311315 - RNA, 18 nt, Homo sapiens
gaagaaguaggcauggca

SEQ ID NO: 311316 - RNA, 22 nt, Homo sapiens
gaaggcaugcugcauggccaga

SEQ ID NO: 311317 - RNA, 22 nt, Homo sapiens
gaaggugcuuggugaaugcauu

SEQ ID NO: 311318 - RNA, 22 nt, Homo sapiens
gaaguaggugcuguuauuaucu

SEQ ID NO: 311319 - RNA, 17 nt, Homo sapiens
gaaguguuucagcagcu

SEQ ID NO: 311320 - RNA, 17 nt, Homo sapiens
gaaguguuucuucauga

SEQ ID NO: 311321 - RNA, 22 nt, Homo sapiens
gaaucacaguuauuagagcagc

SEQ ID NO: 311322 - RNA, 22 nt, Homo sapiens
gaaugcuaccagcaucuagugg

SEQ ID NO: 311323 - RNA, 22 nt, Homo sapiens
gacaguguggcgauuccucaag

SEQ ID NO: 311324 - RNA, 22 nt, Homo sapiens
gacauagagccuugacuucauu

SEQ ID NO: 311325 - RNA, 20 nt, Homo sapiens
gacauaggcugguaucuggc

SEQ ID NO: 311326 - RNA, 22 nt, Homo sapiens
gacauguaaggcucucucuguu

SEQ ID NO: 311327 - RNA, 22 nt, Homo sapiens
gaccacagacuggaaagagggc

SEQ ID NO: 311328 - RNA, 22 nt, Homo sapiens
gacccucuagauggaagcacug

SEQ ID NO: 311329 - RNA, 22 nt, Homo sapiens
gacuagaaauuauuuagugagc

SEQ ID NO: 311330 - RNA, 22 nt, Homo sapiens
gacugaggaagcgcucucuccu

SEQ ID NO: 311331 - RNA, 22 nt, Homo sapiens
gacuuagagauguuguauuugg

SEQ ID NO: 311332 - RNA, 22 nt, Homo sapiens
gacuucaucauacuaugugugg

SEQ ID NO: 311333 - RNA, 22 nt, Homo sapiens
gagaacagaagcauuccuaauu

SEQ ID NO: 311334 - RNA, 22 nt, Homo sapiens
gagaagugcgucguuugaugau

SEQ ID NO: 311335 - RNA, 21 nt, Homo sapiens
gagaaucaucauggcugcaua

SEQ ID NO: 311336 - RNA, 22 nt, Homo sapiens
gagaaugagaggggaaggccac

SEQ ID NO: 311337 - RNA, 22 nt, Homo sapiens
gagagugcuuggcaucugcuga

SEQ ID NO: 311338 - RNA, 22 nt, Homo sapiens
gagauauucugguuuacuaaau

SEQ ID NO: 311339 - RNA, 22 nt, Homo sapiens
gagaucaaugggauggaauuga

SEQ ID NO: 311340 - RNA, 22 nt, Homo sapiens
gagcacccuuuguugauugcaa

SEQ ID NO: 311341 - RNA, 22 nt, Homo sapiens
gagcucaccuuaccucuggagc

SEQ ID NO: 311342 - RNA, 22 nt, Homo sapiens
gagcugaaguuuccauuuguac

SEQ ID NO: 311343 - RNA, 22 nt, Homo sapiens
gagcugaauugcugccauuugc

SEQ ID NO: 311344 - RNA, 22 nt, Homo sapiens
gagcugguccuuuaaggaugca

SEQ ID NO: 311345 - RNA, 22 nt, Homo sapiens
aguugcaagucuugaguaaaga

SEQ ID NO: 311346 - RNA, 22 nt, Homo sapiens
auaagaguaguacauaugagac

SEQ ID NO: 311347 - RNA, 22 nt, Homo sapiens
auaaggcugguauagacauuca

SEQ ID NO: 311348 - RNA, 22 nt, Homo sapiens
auaaguauuuggacuuuacugu

SEQ ID NO: 311349 - RNA, 22 nt, Homo sapiens
auaauaucagguugugaugaug

SEQ ID NO: 311350 - RNA, 22 nt, Homo sapiens
auaaucaugucugaaaccuuug

SEQ ID NO: 311351 - RNA, 22 nt, Homo sapiens
auacaguaaugucuuaggcugu

SEQ ID NO: 311352 - RNA, 22 nt, Homo sapiens
auacaguguauguauaguacau

SEQ ID NO: 311353 - RNA, 22 nt, Homo sapiens
auacauguuucauguuggugug

SEQ ID NO: 311354 - RNA, 22 nt, Homo sapiens
auacuagucaagaauguaugag

SEQ ID NO: 311355 - RNA, 22 nt, Homo sapiens
auacuaugagauaauaaagacu

SEQ ID NO: 311356 - RNA, 22 nt, Homo sapiens
auacugucucuugcuccugccc

SEQ ID NO: 311357 - RNA, 22 nt, Homo sapiens
auagaauguuugcgccagguga

SEQ ID NO: 311358 - RNA, 22 nt, Homo sapiens
auagcaaugccccaauccuugg

SEQ ID NO: 311359 - RNA, 22 nt, Homo sapiens
auagcagugugaaaauugacug

SEQ ID NO: 311360 - RNA, 19 nt, Homo sapiens
auaguguaggaaaacagcu

SEQ ID NO: 311361 - RNA, 23 nt, Homo sapiens
auauaguagaugugcaguaacau

SEQ ID NO: 311362 - RNA, 22 nt, Homo sapiens
auaugcaaauccauagagacag

SEQ ID NO: 311363 - RNA, 22 nt, Homo sapiens
auauggcuaugugagcauacca

SEQ ID NO: 311364 - RNA, 21 nt, Homo sapiens
auaugugcuguggaagucagc

SEQ ID NO: 311365 - RNA, 22 nt, Homo sapiens
auauuagguuggugccaaagua

SEQ ID NO: 311366 - RNA, 22 nt, Homo sapiens
auauuugguuaccugugggucu

SEQ ID NO: 311367 - RNA, 22 nt, Homo sapiens
aucacagcccuccucuuggaug

SEQ ID NO: 311368 - RNA, 22 nt, Homo sapiens
aucacagcuacuccucugucuu

SEQ ID NO: 311369 - RNA, 22 nt, Homo sapiens
aucacagguacuauggcugaca

SEQ ID NO: 311370 - RNA, 22 nt, Homo sapiens
aucacagugaaaacagucaauu

SEQ ID NO: 311371 - RNA, 22 nt, Homo sapiens
aucacauggccagguaguaauc

SEQ ID NO: 311372 - RNA, 19 nt, Homo sapiens
aucaccauuauuuggaaca

SEQ ID NO: 311373 - RNA, 22 nt, Homo sapiens
aucaccuuucccuuucugaauc

SEQ ID NO: 311374 - RNA, 22 nt, Homo sapiens
aucagaaucucuugagaguguu

SEQ ID NO: 311375 - RNA, 21 nt, Homo sapiens
aucagagacccaggcuuccuc

SEQ ID NO: 311376 - RNA, 22 nt, Homo sapiens
aucagaguggguuuuaaaagug

SEQ ID NO: 311377 - RNA, 23 nt, Homo sapiens
aucagauaguuguagguaugugg

SEQ ID NO: 311378 - RNA, 22 nt, Homo sapiens
aucagauguuuguauaggagua

SEQ ID NO: 311379 - RNA, 22 nt, Homo sapiens
aucagcauucccaaaugaugug

SEQ ID NO: 311380 - RNA, 22 nt, Homo sapiens
aucagugagugguuagugaaug

SEQ ID NO: 311381 - RNA, 22 nt, Homo sapiens
aucaucacaguuguguguaaug

SEQ ID NO: 311382 - RNA, 22 nt, Homo sapiens
aucauguaguaagacacauuua

SEQ ID NO: 311383 - RNA, 23 nt, Homo sapiens
auccacauucuaguccuuuaugc

SEQ ID NO: 311384 - RNA, 22 nt, Homo sapiens
auccauugcucaagagaaguca

SEQ ID NO: 311385 - RNA, 22 nt, Homo sapiens
aucccugagaacuuuuaauguu

SEQ ID NO: 311386 - RNA, 22 nt, Homo sapiens
aucccugaggaauuucugcacu

SEQ ID NO: 311387 - RNA, 22 nt, Homo sapiens
aucccuguaacuagcagccccu

SEQ ID NO: 311388 - RNA, 22 nt, Homo sapiens
aucccugugauccaaucacuuc

SEQ ID NO: 311389 - RNA, 22 nt, Homo sapiens
aucccuugacguggagucucug

SEQ ID NO: 311390 - RNA, 22 nt, Homo sapiens
aucuaaucaucgcaaccuucaa

SEQ ID NO: 311391 - RNA, 22 nt, Homo sapiens
aucuagagaggcagucuggccg

SEQ ID NO: 311392 - RNA, 21 nt, Homo sapiens
aucucacuugaauguaaaagc

SEQ ID NO: 311393 - RNA, 22 nt, Homo sapiens
aucucagagaaaauuacuaaga

SEQ ID NO: 311394 - RNA, 22 nt, Homo sapiens
aucucauggagguagagaguaa

SEQ ID NO: 311395 - RNA, 20 nt, Homo sapiens
aucucugggcaaaggaaaau

SEQ ID NO: 311396 - RNA, 22 nt, Homo sapiens
aucugcauuagggugaagaccu

SEQ ID NO: 311397 - RNA, 22 nt, Homo sapiens
augaaacuggcuaauuuuugua

SEQ ID NO: 311398 - RNA, 22 nt, Homo sapiens
augaaagguauguuuucuguga

SEQ ID NO: 311399 - RNA, 22 nt, Homo sapiens
augaaguauuaggacacauuua

SEQ ID NO: 311400 - RNA, 22 nt, Homo sapiens
augaagugcaugauaguugguu

SEQ ID NO: 311401 - RNA, 22 nt, Homo sapiens
augaaguuagcucauuucuuuu

SEQ ID NO: 311402 - RNA, 22 nt, Homo sapiens
augaauacugcugcaaugaaca

SEQ ID NO: 311403 - RNA, 22 nt, Homo sapiens
augaauuuucugauguugggua

SEQ ID NO: 311404 - RNA, 22 nt, Homo sapiens
augacagagauaugugaauuuu

SEQ ID NO: 311405 - RNA, 22 nt, Homo sapiens
augacagcaucugugaaguugu

SEQ ID NO: 311406 - RNA, 22 nt, Homo sapiens
augacagugagugagcucucac

SEQ ID NO: 311407 - RNA, 22 nt, Homo sapiens
augacauagaagcaauccccua

SEQ ID NO: 311408 - RNA, 19 nt, Homo sapiens
augagaacagacuccauuu

SEQ ID NO: 311409 - RNA, 22 nt, Homo sapiens
augagacaguucccuuuaucuu

SEQ ID NO: 311410 - RNA, 19 nt, Homo sapiens
augagcaauaguuuuaauc

SEQ ID NO: 311411 - RNA, 22 nt, Homo sapiens
augagcagaagagauacacugu

SEQ ID NO: 311412 - RNA, 22 nt, Homo sapiens
augaggaagucaggcccagggg

SEQ ID NO: 311413 - RNA, 22 nt, Homo sapiens
augagggagggcaccugaccuu

SEQ ID NO: 311414 - RNA, 22 nt, Homo sapiens
augaggugcagaggaaaugagu

SEQ ID NO: 311415 - RNA, 19 nt, Homo sapiens
augagucugcaagaaccag

SEQ ID NO: 311416 - RNA, 22 nt, Homo sapiens
augaguugaagcuacaagaggc

SEQ ID NO: 311417 - RNA, 22 nt, Homo sapiens
augauacuguucuaagauuuuu

SEQ ID NO: 311418 - RNA, 22 nt, Homo sapiens
augauauguuuguagcuaucuc

SEQ ID NO: 311419 - RNA, 22 nt, Homo sapiens
augaugaaguaagugcuuagga

SEQ ID NO: 311420 - RNA, 22 nt, Homo sapiens
augcagagucccagccccuagc

SEQ ID NO: 311421 - RNA, 22 nt, Homo sapiens
augcagugugcaacagauuaag

SEQ ID NO: 311422 - RNA, 22 nt, Homo sapiens
augcauagugggaugcucugug

SEQ ID NO: 311423 - RNA, 22 nt, Homo sapiens
augcauauuuuaccuagaagag

SEQ ID NO: 311424 - RNA, 22 nt, Homo sapiens
augccacagaaauaaccaaaau

SEQ ID NO: 311425 - RNA, 22 nt, Homo sapiens
augccacuucucuaagucaugu

SEQ ID NO: 311426 - RNA, 22 nt, Homo sapiens
auggaaacauaagaguauagau

SEQ ID NO: 311427 - RNA, 22 nt, Homo sapiens
auggaacuggagaucauuaugu

SEQ ID NO: 311428 - RNA, 22 nt, Homo sapiens
auggaacuggagaugguuauau

SEQ ID NO: 311429 - RNA, 22 nt, Homo sapiens
auggaagcugauuagauaguac

SEQ ID NO: 311430 - RNA, 22 nt, Homo sapiens
auggagcuugacaguuguagag

SEQ ID NO: 311431 - RNA, 19 nt, Homo sapiens
auggauacauuuucugcua

SEQ ID NO: 311432 - RNA, 22 nt, Homo sapiens
auggaucauauucuugaggagg

SEQ ID NO: 311433 - RNA, 22 nt, Homo sapiens
auggaucuuucugcuuuugaau

SEQ ID NO: 311434 - RNA, 22 nt, Homo sapiens
auggauuuugaacuugagaguu

SEQ ID NO: 311435 - RNA, 22 nt, Homo sapiens
auggcacuacugggaaugucuu

SEQ ID NO: 311436 - RNA, 22 nt, Homo sapiens
auggcaguuuauucuaaaucaa

SEQ ID NO: 311437 - RNA, 22 nt, Homo sapiens
auggcaguuuggucucugugcu

SEQ ID NO: 311438 - RNA, 22 nt, Homo sapiens
auggccauuacuaagaauguuu

SEQ ID NO: 311439 - RNA, 22 nt, Homo sapiens
auggcccaguuugcuaucccua

SEQ ID NO: 311440 - RNA, 22 nt, Homo sapiens
auggcccccuguuugugaacau

SEQ ID NO: 311441 - RNA, 22 nt, Homo sapiens
auggccuuguauaccuggcaaa

SEQ ID NO: 311442 - RNA, 22 nt, Homo sapiens
auggcuagauuguaugguaguu

SEQ ID NO: 311443 - RNA, 22 nt, Homo sapiens
auggcucuguuuuuuaugcucu

SEQ ID NO: 311444 - RNA, 22 nt, Homo sapiens
auggcuuuguguucagagcuga

SEQ ID NO: 311445 - RNA, 22 nt, Homo sapiens
ggcuagagaauagugccacuaa

SEQ ID NO: 311446 - RNA, 22 nt, Homo sapiens
ggcucaguugcaaaucaguuca

SEQ ID NO: 311447 - RNA, 22 nt, Homo sapiens
gggagcacaagaaauguuucau

SEQ ID NO: 311448 - RNA, 22 nt, Homo sapiens
gggaggucauuguucaaugcug

SEQ ID NO: 311449 - RNA, 22 nt, Homo sapiens
gggcagaugucuggacaccuca

SEQ ID NO: 311450 - RNA, 22 nt, Homo sapiens
gggguaguuacuguuguucuuu

SEQ ID NO: 311451 - RNA, 15 nt, Homo sapiens
ggguccucucccaaa

SEQ ID NO: 311452 - RNA, 22 nt, Homo sapiens
gguauuauuugccuuuuacuga

SEQ ID NO: 311453 - RNA, 22 nt, Homo sapiens
gguauuuaaaguaccugucugc

SEQ ID NO: 311454 - RNA, 22 nt, Homo sapiens
ggucauagagaauucaccagga

SEQ ID NO: 311455 - RNA, 19 nt, Homo sapiens
ggugagaaauuaugggucu

SEQ ID NO: 311456 - RNA, 22 nt, Homo sapiens
gguggcaaaucugaguggcgcu

SEQ ID NO: 311457 - RNA, 22 nt, Homo sapiens
uaaugcauacagaagguguuuu

SEQ ID NO: 311458 - RNA, 22 nt, Homo sapiens
uaaugcaucagugguaguucuu

SEQ ID NO: 311459 - RNA, 22 nt, Homo sapiens
uaauucugacaacaguggcguu

SEQ ID NO: 311460 - RNA, 22 nt, Homo sapiens
uacaaaguaacaguuccuguau

SEQ ID NO: 311461 - RNA, 22 nt, Homo sapiens
uacaaguauuuuuauuagugcc

SEQ ID NO: 311462 - RNA, 22 nt, Homo sapiens
uacagaguagaagauuugcaga

SEQ ID NO: 311463 - RNA, 22 nt, Homo sapiens
uacagucauaaugccuagugac

SEQ ID NO: 311464 - RNA, 22 nt, Homo sapiens
uacagucuggaggccuguguug

SEQ ID NO: 311465 - RNA, 22 nt, Homo sapiens
uacaugcaugggcaugugugca

SEQ ID NO: 311466 - RNA, 16 nt, Homo sapiens
uacauuuguuacaugg

SEQ ID NO: 311467 - RNA, 22 nt, Homo sapiens
uaccaaguauuuucacaugaac

SEQ ID NO: 311468 - RNA, 22 nt, Homo sapiens
uaccacauuguagagggcauuc

SEQ ID NO: 311469 - RNA, 22 nt, Homo sapiens
uaccaucauuauacguagaaau

SEQ ID NO: 311470 - RNA, 18 nt, Homo sapiens
uacugcacucuccagccu

SEQ ID NO: 311471 - RNA, 20 nt, Homo sapiens
uacugcacuuuccucauggu

SEQ ID NO: 311472 - RNA, 22 nt, Homo sapiens
uacugcaucgaaaugcuuuuau

SEQ ID NO: 311473 - RNA, 22 nt, Homo sapiens
uacugcaucuacuuagagccag

SEQ ID NO: 311474 - RNA, 21 nt, Homo sapiens
uacuugagacagggucuugcu

SEQ ID NO: 311475 - RNA, 22 nt, Homo sapiens
uacuuuguuauagcagcaggaa

SEQ ID NO: 311476 - RNA, 22 nt, Homo sapiens
uagaaugucagcuucuugaggg

SEQ ID NO: 311477 - RNA, 22 nt, Homo sapiens
uagagauaucaauuucauggug

SEQ ID NO: 311478 - RNA, 22 nt, Homo sapiens
uagcaagaugaauuugugcaaa

SEQ ID NO: 311479 - RNA, 22 nt, Homo sapiens
uagcaccacaaucaagauacag

SEQ ID NO: 311480 - RNA, 22 nt, Homo sapiens
uagcaccucuuuggccuuucgu

SEQ ID NO: 311481 - RNA, 22 nt, Homo sapiens
uagcacugucuugcaccugugc

SEQ ID NO: 311482 - RNA, 19 nt, Homo sapiens
uagcagcaugauuuauaau

SEQ ID NO: 311483 - RNA, 22 nt, Homo sapiens
uaggaaguacaucucagaaucu

SEQ ID NO: 311484 - RNA, 20 nt, Homo sapiens
uaggagcaaugagaguagaa

SEQ ID NO: 311485 - RNA, 22 nt, Homo sapiens
uaggcacugagaauaugaggau

SEQ ID NO: 311486 - RNA, 22 nt, Homo sapiens
uaggcagccagcuguggauuga

SEQ ID NO: 311487 - RNA, 22 nt, Homo sapiens
uagggaguuuuggggugcagaa

SEQ ID NO: 311488 - RNA, 22 nt, Homo sapiens
uagguaaguaauauacagauga

SEQ ID NO: 311489 - RNA, 22 nt, Homo sapiens
uaguaaacaccucagguaauuc

SEQ ID NO: 311490 - RNA, 22 nt, Homo sapiens
uagugcugagauugagaagccc

SEQ ID NO: 311491 - RNA, 20 nt, Homo sapiens
uaguggcaugcaccuguagc

SEQ ID NO: 311492 - RNA, 22 nt, Homo sapiens
uaguucauuuuucuugcuuaga

SEQ ID NO: 311493 - RNA, 22 nt, Homo sapiens
uaguugcaucuuaggucuguga

SEQ ID NO: 311494 - RNA, 22 nt, Homo sapiens
uaguugcauucaggauaugacg

SEQ ID NO: 311495 - RNA, 22 nt, Homo sapiens
uauagcaaugugccacucucug

SEQ ID NO: 311496 - RNA, 20 nt, Homo sapiens
uauagcaauuuuuuucuccu

SEQ ID NO: 311497 - RNA, 22 nt, Homo sapiens
uauagcagccugaacaaaguaa

SEQ ID NO: 311498 - RNA, 22 nt, Homo sapiens
uauagcuugaaggaauggucau

SEQ ID NO: 311499 - RNA, 21 nt, Homo sapiens
uauaugacuuacuauugccuc

SEQ ID NO: 311500 - RNA, 22 nt, Homo sapiens
uauaugcauugugggguacuga

SEQ ID NO: 311501 - RNA, 22 nt, Homo sapiens
uaucacagauucuccaggguuu

SEQ ID NO: 311502 - RNA, 20 nt, Homo sapiens
uaucacauggggagaaaccu

SEQ ID NO: 311503 - RNA, 21 nt, Homo sapiens
uaucacauuggugauuaaguu

SEQ ID NO: 311504 - RNA, 22 nt, Homo sapiens
uaucacuuugauaguuuaaaug

SEQ ID NO: 311505 - RNA, 21 nt, Homo sapiens
uaucagagacauugagaggca

SEQ ID NO: 311506 - RNA, 22 nt, Homo sapiens
uaucccuuagagcggggugguu

SEQ ID NO: 311507 - RNA, 22 nt, Homo sapiens
uaucucuuuucauguguaaaug

SEQ ID NO: 311508 - RNA, 20 nt, Homo sapiens
uaugacaaagccuagugagu

SEQ ID NO: 311509 - RNA, 22 nt, Homo sapiens
uaugaccuuggacaaguuacuu

SEQ ID NO: 311510 - RNA, 22 nt, Homo sapiens
uaugcacacguguccaugugca

SEQ ID NO: 311511 - RNA, 22 nt, Homo sapiens
uaugcacaugugccugggugug

SEQ ID NO: 311512 - RNA, 22 nt, Homo sapiens
uauggaaaucuuaccuuauggu

SEQ ID NO: 311513 - RNA, 22 nt, Homo sapiens
uauggcuaugggaacugggagu

SEQ ID NO: 311514 - RNA, 22 nt, Homo sapiens
uauggcuuucuacuugaguucu

SEQ ID NO: 311515 - RNA, 22 nt, Homo sapiens
uauggguaguacaaaguguaua

SEQ ID NO: 311516 - RNA, 22 nt, Homo sapiens
uaugguuuuaagguuaaggacu

SEQ ID NO: 311517 - RNA, 20 nt, Homo sapiens
uaugguuuuagguauagcau

SEQ ID NO: 311518 - RNA, 22 nt, Homo sapiens
uauucaucuuaagcuuuggcuu

SEQ ID NO: 311519 - RNA, 22 nt, Homo sapiens
uauugcacgccagccugagcaa

SEQ ID NO: 311520 - RNA, 20 nt, Homo sapiens
uauugcacuccagucugggc

SEQ ID NO: 311521 - RNA, 22 nt, Homo sapiens
uauugcacuuuuccauaggagu

SEQ ID NO: 311522 - RNA, 22 nt, Homo sapiens
uauugccucagugacuuugggg

SEQ ID NO: 311523 - RNA, 18 nt, Homo sapiens
uauugcuugguuuggaga

SEQ ID NO: 311524 - RNA, 22 nt, Homo sapiens
uauugcuuuugauucaaggcag

SEQ ID NO: 311525 - RNA, 22 nt, Homo sapiens
uauuggcucuguuucucugaag

SEQ ID NO: 311526 - RNA, 22 nt, Homo sapiens
uauuguacauguuauagauuuu

SEQ ID NO: 311527 - RNA, 22 nt, Homo sapiens
uauuucaguugcguuucccgag

SEQ ID NO: 311528 - RNA, 22 nt, Homo sapiens
uauuugauuaacaagagccuaa

SEQ ID NO: 311529 - RNA, 22 nt, Homo sapiens
uauuugauugacuuuagcagga

SEQ ID NO: 311530 - RNA, 22 nt, Homo sapiens
uauuugcacucccaucauggug

SEQ ID NO: 311531 - RNA, 22 nt, Homo sapiens
ucaaaucaucuuuuccaaagcu

SEQ ID NO: 311532 - RNA, 22 nt, Homo sapiens
ucaacagugauggaaaguuaua

SEQ ID NO: 311533 - RNA, 18 nt, Homo sapiens
ucaagcaauugucaugcc

SEQ ID NO: 311534 - RNA, 22 nt, Homo sapiens
ucaaguacuuugcauagugccg

SEQ ID NO: 311535 - RNA, 22 nt, Homo sapiens
ucaauguaucuccaagaauuga

SEQ ID NO: 311536 - RNA, 19 nt, Homo sapiens
ucaauucugucaauggcuu

SEQ ID NO: 311537 - RNA, 22 nt, Homo sapiens
ucacacucucaccaacauuugg

SEQ ID NO: 311538 - RNA, 22 nt, Homo sapiens
ucacagacugagccaaauagag

SEQ ID NO: 311539 - RNA, 22 nt, Homo sapiens
ucacagcuaaaaugaaaguagu

SEQ ID NO: 311540 - RNA, 22 nt, Homo sapiens
ucacaggguguuauuagaauua

SEQ ID NO: 311541 - RNA, 18 nt, Homo sapiens
ucacagguaauuaggauu

SEQ ID NO: 311542 - RNA, 22 nt, Homo sapiens
ucugucuuguccucacccuaga

SEQ ID NO: 311543 - RNA, 22 nt, Homo sapiens
ucugugcauuacacuuuucuca

SEQ ID NO: 311544 - RNA, 22 nt, Homo sapiens
ucugugcauuguaacaacuaaa

SEQ ID NO: 311545 - RNA, 22 nt, Homo sapiens
ucugugcugagaguugaaaguu

SEQ ID NO: 311546 - RNA, 22 nt, Homo sapiens
ucugugcuugucauaugcuuug

SEQ ID NO: 311547 - RNA, 22 nt, Homo sapiens
ucugugguaagaaacgcauguc

SEQ ID NO: 311548 - RNA, 22 nt, Homo sapiens
ucugugguucaaaccagcaacu

SEQ ID NO: 311549 - RNA, 22 nt, Homo sapiens
ucuguugguucuuugaggagga

SEQ ID NO: 311550 - RNA, 22 nt, Homo sapiens
ucuugcaguucccaaauucaca

SEQ ID NO: 311551 - RNA, 23 nt, Homo sapiens
ucuuguacuuugagugagcaugg

SEQ ID NO: 311552 - RNA, 19 nt, Homo sapiens
ucuuuagucacauuuuuau

SEQ ID NO: 311553 - RNA, 22 nt, Homo sapiens
ucuuugaguguauacuuagauu

SEQ ID NO: 311554 - RNA, 22 nt, Homo sapiens
ucuuugauguucugaaagaugg

SEQ ID NO: 311555 - RNA, 22 nt, Homo sapiens
ucuuugauuuuguuacuaagac

SEQ ID NO: 311556 - RNA, 22 nt, Homo sapiens
ucuuugggauauucugaaaggg

SEQ ID NO: 311557 - RNA, 22 nt, Homo sapiens
ugaaaagucuaagauuaagguu

SEQ ID NO: 311558 - RNA, 22 nt, Homo sapiens
ugaaacugcagugggcuuggca

SEQ ID NO: 311559 - RNA, 22 nt, Homo sapiens
ugaaaguaauugcaguuuuuac

SEQ ID NO: 311560 - RNA, 22 nt, Homo sapiens
ugaaaugguuaugugaggagau

SEQ ID NO: 311561 - RNA, 22 nt, Homo sapiens
uggacagaaacauguuuucagu

SEQ ID NO: 311562 - RNA, 22 nt, Homo sapiens
uggaccccugcucgggagcccu

SEQ ID NO: 311563 - RNA, 19 nt, Homo sapiens
uggaccccuuccuuacacc

SEQ ID NO: 311564 - RNA, 22 nt, Homo sapiens
uggaguuugacaugccuuuggg

SEQ ID NO: 311565 - RNA, 22 nt, Homo sapiens
uggauaguucuucuacuagagu

SEQ ID NO: 311566 - RNA, 22 nt, Homo sapiens
uggauggagaggcuugugaugc

SEQ ID NO: 311567 - RNA, 22 nt, Homo sapiens
uggcaacaucuggggacauguu

SEQ ID NO: 311568 - RNA, 22 nt, Homo sapiens
uggcaacuugcaaccucauucu

SEQ ID NO: 311569 - RNA, 22 nt, Homo sapiens
uggcaagaaggauuuauuccuu

SEQ ID NO: 311570 - RNA, 22 nt, Homo sapiens
uggcaauaauucagugugggcu

SEQ ID NO: 311571 - RNA, 22 nt, Homo sapiens
uggcaauauccacaauuacuuu

SEQ ID NO: 311572 - RNA, 19 nt, Homo sapiens
uggcaugaaugugaacuaa

SEQ ID NO: 311573 - RNA, 22 nt, Homo sapiens
uggcaugauguguucauugaaa

SEQ ID NO: 311574 - RNA, 22 nt, Homo sapiens
uggcccccucccaaaucucaua

SEQ ID NO: 311575 - RNA, 22 nt, Homo sapiens
uggccuguaacgcugucucagc

SEQ ID NO: 311576 - RNA, 22 nt, Homo sapiens
uggcuccguuguacaggcugga

SEQ ID NO: 311577 - RNA, 22 nt, Homo sapiens
uggcuguguccucucccaaauc

SEQ ID NO: 311578 - RNA, 22 nt, Homo sapiens
uggcuguuuauuucacgugggu

SEQ ID NO: 311579 - RNA, 20 nt, Homo sapiens
uggcuucuuaauugcaggca

SEQ ID NO: 311580 - RNA, 22 nt, Homo sapiens
uggcuuucuggggcuucuguuc

SEQ ID NO: 311581 - RNA, 22 nt, Homo sapiens
ugggaacaugaagguuaaagag

SEQ ID NO: 311582 - RNA, 22 nt, Homo sapiens
ugggaauaugauacaggucuuu

SEQ ID NO: 311583 - RNA, 22 nt, Homo sapiens
ugggaugaaaauagcuucuucc

SEQ ID NO: 311584 - RNA, 22 nt, Homo sapiens
ugggcaguauggucauuuucgu

SEQ ID NO: 311585 - RNA, 22 nt, Homo sapiens
ugggcagugggacagcuuugug

SEQ ID NO: 311586 - RNA, 22 nt, Homo sapiens
ugggccgcugcaggaugguccc

SEQ ID NO: 311587 - RNA, 22 nt, Homo sapiens
uggggcuuuuucuuguauucuc

SEQ ID NO: 311588 - RNA, 22 nt, Homo sapiens
uggguaggcccucauuggacag

SEQ ID NO: 311589 - RNA, 22 nt, Homo sapiens
uggguaguuucuuacaacucug

SEQ ID NO: 311590 - RNA, 22 nt, Homo sapiens
uggucaaaugccaaucuguagu

SEQ ID NO: 311591 - RNA, 22 nt, Homo sapiens
uggugagaaaagaugucuuugu

SEQ ID NO: 311592 - RNA, 20 nt, Homo sapiens
uguaaaggagauugcagcug

SEQ ID NO: 311593 - RNA, 22 nt, Homo sapiens
uguaagcauugggcaugcaguc

SEQ ID NO: 311594 - RNA, 22 nt, Homo sapiens
uguacaaauuucugugguggug

SEQ ID NO: 311595 - RNA, 22 nt, Homo sapiens
uguauacauauguauguuuugu

SEQ ID NO: 311596 - RNA, 16 nt, Homo sapiens
uguauugcuaaaaaga

SEQ ID NO: 311597 - RNA, 19 nt, Homo sapiens
ugucaaaugucuccugggg

SEQ ID NO: 311598 - RNA, 22 nt, Homo sapiens
ugucaagaugguuugauguugu

SEQ ID NO: 311599 - RNA, 22 nt, Homo sapiens
ugucacagagauuuugguaugu

SEQ ID NO: 311600 - RNA, 22 nt, Homo sapiens
ugucagcacaacucagguuccu

SEQ ID NO: 311601 - RNA, 22 nt, Homo sapiens
ugucaggagcaaugauaaauuu

SEQ ID NO: 311602 - RNA, 22 nt, Homo sapiens
ugucauauagaauguucuauga

SEQ ID NO: 311603 - RNA, 22 nt, Homo sapiens
uguccaaaucagagguaccaaa

SEQ ID NO: 311604 - RNA, 20 nt, Homo sapiens
ugucccaaccccauggguuc

SEQ ID NO: 311605 - RNA, 21 nt, Homo sapiens
ugucuagaccucauccuacag

SEQ ID NO: 311606 - RNA, 22 nt, Homo sapiens
ugucuggaguccauagaagugu

SEQ ID NO: 311607 - RNA, 22 nt, Homo sapiens
ugucuuggagaauccuggguuu

SEQ ID NO: 311608 - RNA, 22 nt, Homo sapiens
ugugaacugagcauuaacuaca

SEQ ID NO: 311609 - RNA, 22 nt, Homo sapiens
ugugaagaaagucauugguagc

SEQ ID NO: 311610 - RNA, 19 nt, Homo sapiens
ugugaagaaaugcugcaag

SEQ ID NO: 311611 - RNA, 22 nt, Homo sapiens
ugugaagauggacuaauauagu

SEQ ID NO: 311612 - RNA, 22 nt, Homo sapiens
ugugacaguuaguuugguguua

SEQ ID NO: 311613 - RNA, 21 nt, Homo sapiens
ugugacuguugcauuugucgu

SEQ ID NO: 311614 - RNA, 22 nt, Homo sapiens
ugugagaaaugcagaaucucag

SEQ ID NO: 311615 - RNA, 22 nt, Homo sapiens
ugugauaguuggcuaaagcagu

SEQ ID NO: 311616 - RNA, 17 nt, Homo sapiens
ugugaucaucacccuug

SEQ ID NO: 311617 - RNA, 22 nt, Homo sapiens
ugugcacuggaccuugucuucu

SEQ ID NO: 311618 - RNA, 22 nt, Homo sapiens
ugugcaguuuuagcguauuuua

SEQ ID NO: 311619 - RNA, 22 nt, Homo sapiens
ugugccacugcacuccugccug

SEQ ID NO: 311620 - RNA, 22 nt, Homo sapiens
ugugccacugcacucugggcaa

SEQ ID NO: 311621 - RNA, 22 nt, Homo sapiens
ugugccacuguucuguaaagug

SEQ ID NO: 311622 - RNA, 22 nt, Homo sapiens
ugugcucaucucagucaacugu

SEQ ID NO: 311623 - RNA, 22 nt, Homo sapiens
ugugcuugcuucuucuccuagu

SEQ ID NO: 311624 - RNA, 22 nt, Homo sapiens
ugugcuuguaaaggccagagca

SEQ ID NO: 311625 - RNA, 22 nt, Homo sapiens
uguggcaaagucuugugaauau

SEQ ID NO: 311626 - RNA, 22 nt, Homo sapiens
uguggcaaauggucaggaagaa

SEQ ID NO: 311627 - RNA, 22 nt, Homo sapiens
uguggcuuuguaaccauggguc

SEQ ID NO: 311628 - RNA, 22 nt, Homo sapiens
ugugucacugaggguuagugua

SEQ ID NO: 311629 - RNA, 22 nt, Homo sapiens
uguuaacauggucucagucugu

SEQ ID NO: 311630 - RNA, 22 nt, Homo sapiens
uguuaaggcagagauaauacau

SEQ ID NO: 311631 - RNA, 22 nt, Homo sapiens
uguuggacuuacuuggcagauu

SEQ ID NO: 311632 - RNA, 22 nt, Homo sapiens
uguuucuacugucucuguagua

SEQ ID NO: 311633 - RNA, 22 nt, Homo sapiens
uuaaagugcacacgggucaggc

SEQ ID NO: 311634 - RNA, 20 nt, Homo sapiens
uuaaaucuagugcagacuca

SEQ ID NO: 311635 - RNA, 22 nt, Homo sapiens
uuaacaguuaauucuuuggcaa

SEQ ID NO: 311636 - RNA, 22 nt, Homo sapiens
uuaagagcauggugccagguug

SEQ ID NO: 311637 - RNA, 22 nt, Homo sapiens
uuaagcaaagguaacaugagaa

SEQ ID NO: 311638 - RNA, 23 nt, Homo sapiens
uuaagcaacggcugcuuuucaga

SEQ ID NO: 311639 - RNA, 22 nt, Homo sapiens
uuaagguaugugggcauuuugu

SEQ ID NO: 311640 - RNA, 22 nt, Homo sapiens
uuuaaguguuuguuccugaaaa

SEQ ID NO: 311641 - RNA, 22 nt, Homo sapiens
uuuaaugcgucucugaguuuug

SEQ ID NO: 311642 - RNA, 22 nt, Homo sapiens
uuuauagucaggaacuugagga

SEQ ID NO: 311643 - RNA, 18 nt, Homo sapiens
uuucaagucuuaggugac

SEQ ID NO: 311644 - RNA, 21 nt, Homo sapiens
uuucacugugaguuuuucugu

SEQ ID NO: 311645 - RNA, 19 nt, Homo sapiens
uuucccugcagaccuacua

SEQ ID NO: 311646 - RNA, 22 nt, Homo sapiens
uuuccuguagggggcaaggccu

SEQ ID NO: 311647 - RNA, 22 nt, Homo sapiens
uuucuacagggcuugccaggua

SEQ ID NO: 311648 - RNA, 16 nt, Homo sapiens
uuucuauguuuuacua

SEQ ID NO: 311649 - RNA, 22 nt, Homo sapiens
uuucugugguccucuugaaggu

SEQ ID NO: 311650 - RNA, 22 nt, Homo sapiens
uuucuuggagcucuuagggucg

SEQ ID NO: 311651 - RNA, 22 nt, Homo sapiens
uuugaagcaauugugaauggga

SEQ ID NO: 311652 - RNA, 19 nt, Homo sapiens
uuugaauauaaugcagcua

SEQ ID NO: 311653 - RNA, 22 nt, Homo sapiens
uuugacuuuuagaauaugaguu

SEQ ID NO: 311654 - RNA, 16 nt, Homo sapiens
uuugcaagaucagaag

SEQ ID NO: 311655 - RNA, 22 nt, Homo sapiens
uuuggaaugaaacagcagagcc

SEQ ID NO: 311656 - RNA, 22 nt, Homo sapiens
uuugggccucugauuucuuugg

SEQ ID NO: 311657 - RNA, 22 nt, Homo sapiens
uuuguacacgugggugaauugu

SEQ ID NO: 311658 - RNA, 22 nt, Homo sapiens
uuuguacacuguugguaggauu

SEQ ID NO: 311659 - RNA, 21 nt, Homo sapiens
uuuguaguagcaugauuuaua

SEQ ID NO: 311660 - RNA, 23 nt, Homo sapiens
uuuguaguagcaugauuuauaau

SEQ ID NO: 311661 - RNA, 22 nt, Homo sapiens
uuugugugugauuauaaaaggu

SEQ ID NO: 311662 - RNA, 22 nt, Homo sapiens
uuuuaacagccaggggacggcc

SEQ ID NO: 311663 - RNA, 22 nt, Homo sapiens
uuuuaagcuacaagagacauau

SEQ ID NO: 311664 - RNA, 22 nt, Homo sapiens
uuuuacacaucaccgcucgugu

SEQ ID NO: 311665 - RNA, 22 nt, Homo sapiens
uuuuacacuucgguugugugca

SEQ ID NO: 311666 - RNA, 22 nt, Homo sapiens
uuuuacagaggagguugcugau

SEQ ID NO: 311667 - RNA, 22 nt, Homo sapiens
uuuuccagugggacucccauua

SEQ ID NO: 311668 - RNA, 23 nt, Homo sapiens
uuuugcaauaagucacuggaaua

SEQ ID NO: 311669 - RNA, 22 nt, Homo sapiens
uuuuggcacuuugucugauucu

SEQ ID NO: 311670 - RNA, 22 nt, Homo sapiens
uuuuguacaacagcucugggga

SEQ ID NO: 311671 - RNA, 18 nt, Homo sapiens
uuuuugaggcacagggga

SEQ ID NO: 311672 - RNA, 22 nt, Homo sapiens
uuuuuugguaauugaacaauga

SEQ ID NO: 311673 - RNA, 18 nt, Homo sapiens
aaaaagugcucaggccua

SEQ ID NO: 311674 - RNA, 18 nt, Homo sapiens
aaacagugucucuuucug

SEQ ID NO: 311675 - RNA, 22 nt, Homo sapiens
aaaccacagugugcugcugggg

SEQ ID NO: 311676 - RNA, 22 nt, Homo sapiens
aaagcagcaggugguuuucaau

SEQ ID NO: 311677 - RNA, 22 nt, Homo sapiens
aaagggcacugugcuuuggcaa

SEQ ID NO: 311678 - RNA, 22 nt, Homo sapiens
aaaguacucaguucaguuccgu

SEQ ID NO: 311679 - RNA, 18 nt, Homo sapiens
aaagugaugucauucuuu

SEQ ID NO: 311680 - RNA, 22 nt, Homo sapiens
aaagugcacuuggaagagggcc

SEQ ID NO: 311681 - RNA, 22 nt, Homo sapiens
aaagugccugacucauaguuag

SEQ ID NO: 311682 - RNA, 22 nt, Homo sapiens
aaagugcugagacagacuggga

SEQ ID NO: 311683 - RNA, 22 nt, Homo sapiens
aaaguggacuaagugaauauga

SEQ ID NO: 311684 - RNA, 22 nt, Homo sapiens
aaaguucuguugauagugcuga

SEQ ID NO: 311685 - RNA, 22 nt, Homo sapiens
aaaucccuugcucucucagacc

SEQ ID NO: 311686 - RNA, 22 nt, Homo sapiens
aaaugcacaaagauuuugcacu

SEQ ID NO: 311687 - RNA, 22 nt, Homo sapiens
aaaugcagucuuuguucugggc

SEQ ID NO: 311688 - RNA, 22 nt, Homo sapiens
aaaugcaucauuaggugauuuu

SEQ ID NO: 311689 - RNA, 22 nt, Homo sapiens
aaaugccucccauucuacugac

SEQ ID NO: 311690 - RNA, 22 nt, Homo sapiens
aaaugcuguuccaggaccuauc

SEQ ID NO: 311691 - RNA, 22 nt, Homo sapiens
aaauggcuuugaggguaggaca

SEQ ID NO: 311692 - RNA, 19 nt, Homo sapiens
aaaugugcacuguuuucca

SEQ ID NO: 311693 - RNA, 22 nt, Homo sapiens
aacacuaucugccuuacaggga

SEQ ID NO: 311694 - RNA, 22 nt, Homo sapiens
aacaggcuccuaggggugcacc

SEQ ID NO: 311695 - RNA, 22 nt, Homo sapiens
aacagucaauugcugaugaccu

SEQ ID NO: 311696 - RNA, 22 nt, Homo sapiens
aaccuacauucuuaacuguugc

SEQ ID NO: 311697 - RNA, 22 nt, Homo sapiens
aaccuguaaccauaugaucagu

SEQ ID NO: 311698 - RNA, 22 nt, Homo sapiens
aacuggcauauucugguugcgg

SEQ ID NO: 311699 - RNA, 19 nt, Homo sapiens
aacuggugugagaugauau

SEQ ID NO: 311700 - RNA, 19 nt, Homo sapiens
aacuggugugagaugguau

SEQ ID NO: 311701 - RNA, 22 nt, Homo sapiens
aagagcauuauuuaguaauuuc

SEQ ID NO: 311702 - RNA, 22 nt, Homo sapiens
aagagcauuggauggggagauu

SEQ ID NO: 311703 - RNA, 20 nt, Homo sapiens
aagagcucaccagaauaucu

SEQ ID NO: 311704 - RNA, 22 nt, Homo sapiens
aagaggccuaggaaucuguauu

SEQ ID NO: 311705 - RNA, 22 nt, Homo sapiens
aagagguagaagcuugccuucu

SEQ ID NO: 311706 - RNA, 22 nt, Homo sapiens
aagagguagcagucacaaaaga

SEQ ID NO: 311707 - RNA, 22 nt, Homo sapiens
aagaugauguucuuuuucuuag

SEQ ID NO: 311708 - RNA, 22 nt, Homo sapiens
aagcaguguggacuaaugggaa

SEQ ID NO: 311709 - RNA, 22 nt, Homo sapiens
aagccacuguaccugucucuua

SEQ ID NO: 311710 - RNA, 22 nt, Homo sapiens
aagcugccaggcaugguggcug

SEQ ID NO: 311711 - RNA, 22 nt, Homo sapiens
aagcugccuugugaaggcauuc

SEQ ID NO: 311712 - RNA, 22 nt, Homo sapiens
aagcuggagugcaguggugcga

SEQ ID NO: 311713 - RNA, 22 nt, Homo sapiens
aagcuguguguaagcucucaca

SEQ ID NO: 311714 - RNA, 22 nt, Homo sapiens
aaggcaauuuguugugaggauu

SEQ ID NO: 311715 - RNA, 22 nt, Homo sapiens
aaggcaugcaaagaacauuuua

SEQ ID NO: 311716 - RNA, 22 nt, Homo sapiens
aaggcauucucaaacuaguucu

SEQ ID NO: 311717 - RNA, 22 nt, Homo sapiens
aaggcgguguggauccuacagc

SEQ ID NO: 311718 - RNA, 22 nt, Homo sapiens
aaggcuuuuugcugacguccuu

SEQ ID NO: 311719 - RNA, 22 nt, Homo sapiens
aagggagcugcauaaucuugug

SEQ ID NO: 311720 - RNA, 23 nt, Homo sapiens
aagguaagcuagaaagauguaga

SEQ ID NO: 311721 - RNA, 22 nt, Homo sapiens
aaggugcuguaagcauccaugu

SEQ ID NO: 311722 - RNA, 21 nt, Homo sapiens
aaggugguggugauugagaug

SEQ ID NO: 311723 - RNA, 22 nt, Homo sapiens
aaggugguuuucucuuggaguc

SEQ ID NO: 311724 - RNA, 22 nt, Homo sapiens
aaguaaacauuuuguacaauaa

SEQ ID NO: 311725 - RNA, 22 nt, Homo sapiens
aaguaguuaggaacauucucuc

SEQ ID NO: 311726 - RNA, 22 nt, Homo sapiens
aaguauuagcuaauugugcuua

SEQ ID NO: 311727 - RNA, 22 nt, Homo sapiens
aagucaaggagagaagcuucag

SEQ ID NO: 311728 - RNA, 20 nt, Homo sapiens
aagugcaucguugugucugc

SEQ ID NO: 311729 - RNA, 22 nt, Homo sapiens
aagugccauguggaugggcccu

SEQ ID NO: 311730 - RNA, 22 nt, Homo sapiens
aagugcuuacagggaacaugau

SEQ ID NO: 311731 - RNA, 22 nt, Homo sapiens
aagugcuucuuuccucgagaag

SEQ ID NO: 311732 - RNA, 22 nt, Homo sapiens
aagugcuuuuuagauaugguuu

SEQ ID NO: 311733 - RNA, 23 nt, Homo sapiens
aaguucaugcucaucuguuacac

SEQ ID NO: 311734 - RNA, 22 nt, Homo sapiens
aauaaagcagcuuuuugggacu

SEQ ID NO: 311735 - RNA, 22 nt, Homo sapiens
aauaaagcauggcuacuccaua

SEQ ID NO: 311736 - RNA, 22 nt, Homo sapiens
aauaaaguaggaggugaggaaa

SEQ ID NO: 311737 - RNA, 20 nt, Homo sapiens
aauaacagccccagggaggu

SEQ ID NO: 311738 - RNA, 22 nt, Homo sapiens
aauaucacaggguguacacuca

SEQ ID NO: 311739 - RNA, 22 nt, Homo sapiens
aauauugucaaaauggauucca

SEQ ID NO: 311740 - RNA, 21 nt, Homo sapiens
aaucacaguuguucugccuuc

SEQ ID NO: 311741 - RNA, 22 nt, Homo sapiens
aaucccuggacuuucggaggcu

SEQ ID NO: 311742 - RNA, 22 nt, Homo sapiens
aaucugucaguuuuguguuaau

SEQ ID NO: 311743 - RNA, 22 nt, Homo sapiens
aaugacuaagaugguacauuuu

SEQ ID NO: 311744 - RNA, 22 nt, Homo sapiens
aaugauauguuauguuuagguu

SEQ ID NO: 311745 - RNA, 22 nt, Homo sapiens
aaugcaucuagaaaggugaauu

SEQ ID NO: 311746 - RNA, 22 nt, Homo sapiens
aaugcuguguuauuucaugacc

SEQ ID NO: 311747 - RNA, 22 nt, Homo sapiens
aauggcacacaccuggucuaac

SEQ ID NO: 311748 - RNA, 22 nt, Homo sapiens
aauggcacuuuauaaauguuaa

SEQ ID NO: 311749 - RNA, 22 nt, Homo sapiens
aaugucaucuucaguuguacag

SEQ ID NO: 311750 - RNA, 22 nt, Homo sapiens
aauguguuuugaaaucaggaag

SEQ ID NO: 311751 - RNA, 22 nt, Homo sapiens
aauugaaugcagaugccaggga

SEQ ID NO: 311752 - RNA, 22 nt, Homo sapiens
acaaagugccuccuuuuagagu

SEQ ID NO: 311753 - RNA, 22 nt, Homo sapiens
acaccaugucuguuucugguuu

SEQ ID NO: 311754 - RNA, 22 nt, Homo sapiens
acacguguugaaauuuaauugc

SEQ ID NO: 311755 - RNA, 22 nt, Homo sapiens
acacuguuggugggaguguaaa

SEQ ID NO: 311756 - RNA, 22 nt, Homo sapiens
acacuguuuuguggagaaugua

SEQ ID NO: 311757 - RNA, 22 nt, Homo sapiens
acagaacugggcuugcuuuugg

SEQ ID NO: 311758 - RNA, 19 nt, Homo sapiens
acagauagaauguucuaca

SEQ ID NO: 311759 - RNA, 22 nt, Homo sapiens
acagauagacauauauagcuca

SEQ ID NO: 311760 - RNA, 22 nt, Homo sapiens
acagugacagaaagcugauuau

SEQ ID NO: 311761 - RNA, 18 nt, Homo sapiens
acagugcugucacugcuu

SEQ ID NO: 311762 - RNA, 22 nt, Homo sapiens
acagugcuguggucaugggucu

SEQ ID NO: 311763 - RNA, 19 nt, Homo sapiens
acagugcuuugucagaagc

SEQ ID NO: 311764 - RNA, 22 nt, Homo sapiens
acauaugaguacaugugccaug

SEQ ID NO: 311765 - RNA, 22 nt, Homo sapiens
acaucaggcuugugaugauuac

SEQ ID NO: 311766 - RNA, 22 nt, Homo sapiens
acaucauugggggcuacaggug

SEQ ID NO: 311767 - RNA, 22 nt, Homo sapiens
acaugcauccaugugaagagac

SEQ ID NO: 311768 - RNA, 19 nt, Homo sapiens
acauggauuuugugcaaac

SEQ ID NO: 311769 - RNA, 22 nt, Homo sapiens
acaugguacugauuuacgaaau

SEQ ID NO: 311770 - RNA, 22 nt, Homo sapiens
acauguaauugauuuuguguua

SEQ ID NO: 311771 - RNA, 22 nt, Homo sapiens
acauugcagauguguuuaaugu

SEQ ID NO: 311772 - RNA, 19 nt, Homo sapiens
acauugcauuuguaggcuu

SEQ ID NO: 311773 - RNA, 22 nt, Homo sapiens
accaccacucccgcauucuaaa

SEQ ID NO: 311774 - RNA, 22 nt, Homo sapiens
accagucucagguaugucuuua

SEQ ID NO: 311775 - RNA, 22 nt, Homo sapiens
accauugcacuccuuucugggc

SEQ ID NO: 311776 - RNA, 22 nt, Homo sapiens
acccagaagucauucaggaaca

SEQ ID NO: 311777 - RNA, 22 nt, Homo sapiens
acccugcuaaacagcccccugc

SEQ ID NO: 311778 - RNA, 22 nt, Homo sapiens
acccugucaaaauagaccaauc

SEQ ID NO: 311779 - RNA, 22 nt, Homo sapiens
acccugucauccacauggugcu

SEQ ID NO: 311780 - RNA, 22 nt, Homo sapiens
acccuugaguguguuucaggca

SEQ ID NO: 311781 - RNA, 22 nt, Homo sapiens
accucagcccggggaaguugag

SEQ ID NO: 311782 - RNA, 22 nt, Homo sapiens
accugagacuaggcauuuuaua

SEQ ID NO: 311783 - RNA, 22 nt, Homo sapiens
accugugguuacagucugucuc

SEQ ID NO: 311784 - RNA, 23 nt, Homo sapiens
accuucauucauucagcugaagu

SEQ ID NO: 311785 - RNA, 22 nt, Homo sapiens
accuucauuguugccaugucca

SEQ ID NO: 311786 - RNA, 22 nt, Homo sapiens
acuacuucuaaguuuuggaaga

SEQ ID NO: 311787 - RNA, 18 nt, Homo sapiens
acugcacuccaccuuggg

SEQ ID NO: 311788 - RNA, 22 nt, Homo sapiens
acugcacuccagccucggcaau

SEQ ID NO: 311789 - RNA, 22 nt, Homo sapiens
acugcacuccagccucggugac

SEQ ID NO: 311790 - RNA, 22 nt, Homo sapiens
acugcacuccagccugagccug

SEQ ID NO: 311791 - RNA, 22 nt, Homo sapiens
acugcacuccagccuuggccac

SEQ ID NO: 311792 - RNA, 21 nt, Homo sapiens
acuggaccccuuccauacacc

SEQ ID NO: 311793 - RNA, 22 nt, Homo sapiens
acuggcaauggcagaaauaguu

SEQ ID NO: 311794 - RNA, 22 nt, Homo sapiens
acuguacuacagccugggugac

SEQ ID NO: 311795 - RNA, 22 nt, Homo sapiens
acuguacuccagccugggugac

SEQ ID NO: 311796 - RNA, 22 nt, Homo sapiens
acuguacuccauccugggugac

SEQ ID NO: 311797 - RNA, 22 nt, Homo sapiens
agaauaauguccccccaaggga

SEQ ID NO: 311798 - RNA, 22 nt, Homo sapiens
agaauguauauucuguaguugu

SEQ ID NO: 311799 - RNA, 20 nt, Homo sapiens
agacagcugcagcccacauc

SEQ ID NO: 311800 - RNA, 22 nt, Homo sapiens
agacagcuggaguaucauagcu

SEQ ID NO: 311801 - RNA, 22 nt, Homo sapiens
agacuagagggaaaugaguugg

SEQ ID NO: 311802 - RNA, 19 nt, Homo sapiens
agacuggcccaggcgggug

SEQ ID NO: 311803 - RNA, 22 nt, Homo sapiens
agagaccuguaaaguucaggca

SEQ ID NO: 311804 - RNA, 22 nt, Homo sapiens
agagccacacucuccuaacuca

SEQ ID NO: 311805 - RNA, 22 nt, Homo sapiens
agagguuuuggggcugagagcu

SEQ ID NO: 311806 - RNA, 22 nt, Homo sapiens
agauacaucuaugugucugugu

SEQ ID NO: 311807 - RNA, 22 nt, Homo sapiens
agaucaauugcugauucgcucu

SEQ ID NO: 311808 - RNA, 22 nt, Homo sapiens
agcaauaugacauugcuacauc

SEQ ID NO: 311809 - RNA, 22 nt, Homo sapiens
agcaccacaauuuccugccuaa

SEQ ID NO: 311810 - RNA, 22 nt, Homo sapiens
agcaccauugcacuccagccug

SEQ ID NO: 311811 - RNA, 22 nt, Homo sapiens
agcaccauuuauugaaaagaca

SEQ ID NO: 311812 - RNA, 22 nt, Homo sapiens
agcaccauuucucuaaagcacu

SEQ ID NO: 311813 - RNA, 22 nt, Homo sapiens
agcagagcauauucauucgggg

SEQ ID NO: 311814 - RNA, 22 nt, Homo sapiens
agcagcaauuuuguaugguuua

SEQ ID NO: 311815 - RNA, 22 nt, Homo sapiens
agcagcacaucccuuucuggcc

SEQ ID NO: 311816 - RNA, 22 nt, Homo sapiens
agcagcuuugcauggccuguga

SEQ ID NO: 311817 - RNA, 21 nt, Homo sapiens
agcagcuuugguugaagcaga

SEQ ID NO: 311818 - RNA, 22 nt, Homo sapiens
agcaucagugauuuuguugaag

SEQ ID NO: 311819 - RNA, 19 nt, Homo sapiens
agcaucauuauuguuuugg

SEQ ID NO: 311820 - RNA, 17 nt, Homo sapiens
agcauguguuugagauu

SEQ ID NO: 311821 - RNA, 22 nt, Homo sapiens
agccaguauuuccacagagugg

SEQ ID NO: 311822 - RNA, 21 nt, Homo sapiens
agccaguguuccuuguggcuc

SEQ ID NO: 311823 - RNA, 23 nt, Homo sapiens
agcccugugacucgaacgaggag

SEQ ID NO: 311824 - RNA, 22 nt, Homo sapiens
agccuucauucugacaguagga

SEQ ID NO: 311825 - RNA, 22 nt, Homo sapiens
agcgccacugcacuccagccug

SEQ ID NO: 311826 - RNA, 22 nt, Homo sapiens
agcuccuuugcuuuuuccagga

SEQ ID NO: 311827 - RNA, 22 nt, Homo sapiens
agcugcacugguauaggagaaa

SEQ ID NO: 311828 - RNA, 22 nt, Homo sapiens
agcuggcuguagcugcaagucu

SEQ ID NO: 311829 - RNA, 22 nt, Homo sapiens
agcuggcuguggagaaaccccu

SEQ ID NO: 311830 - RNA, 22 nt, Homo sapiens
agcuguaguuuauucauguuaa

SEQ ID NO: 311831 - RNA, 22 nt, Homo sapiens
agcuguguugucugaagucaga

SEQ ID NO: 311832 - RNA, 22 nt, Homo sapiens
agcuuguauuuguagccuguug

SEQ ID NO: 311833 - RNA, 22 nt, Homo sapiens
aggaacuguaacuaugucucug

SEQ ID NO: 311834 - RNA, 22 nt, Homo sapiens
aggaagacauauagaacuaaaa

SEQ ID NO: 311835 - RNA, 16 nt, Homo sapiens
aggaagacuuagagau

SEQ ID NO: 311836 - RNA, 22 nt, Homo sapiens
aggacacugauagucuuuggca

SEQ ID NO: 311837 - RNA, 22 nt, Homo sapiens
aggaccccucaucagcaccagu

SEQ ID NO: 311838 - RNA, 19 nt, Homo sapiens
aggacuaaagacuagaagu

SEQ ID NO: 311839 - RNA, 22 nt, Homo sapiens
aggagcacaggacuuugauuau

SEQ ID NO: 311840 - RNA, 22 nt, Homo sapiens
auggacagacacuggccuucug

SEQ ID NO: 311841 - RNA, 22 nt, Homo sapiens
auggauauugccuaggguagua

SEQ ID NO: 311842 - RNA, 22 nt, Homo sapiens
auggauuuuggggccagaggca

SEQ ID NO: 311843 - RNA, 22 nt, Homo sapiens
auggcaaaaaaugcaauuacuu

SEQ ID NO: 311844 - RNA, 22 nt, Homo sapiens
auggcaauguaagucagaaaaa

SEQ ID NO: 311845 - RNA, 22 nt, Homo sapiens
auggcacagacucuuggucaag

SEQ ID NO: 311846 - RNA, 22 nt, Homo sapiens
auggcaccauguuaugauaaua

SEQ ID NO: 311847 - RNA, 22 nt, Homo sapiens
auggcacuaaguucaacacuua

SEQ ID NO: 311848 - RNA, 22 nt, Homo sapiens
auggcacucaaucaaguugaga

SEQ ID NO: 311849 - RNA, 22 nt, Homo sapiens
auggcacugccuggcuucaugg

SEQ ID NO: 311850 - RNA, 22 nt, Homo sapiens
auggcagagucagaaagucagg

SEQ ID NO: 311851 - RNA, 22 nt, Homo sapiens
auggcaguuucacucugggauu

SEQ ID NO: 311852 - RNA, 22 nt, Homo sapiens
auggcaucgucaccuuuucagu

SEQ ID NO: 311853 - RNA, 22 nt, Homo sapiens
auggcauugaagaguugucccu

SEQ ID NO: 311854 - RNA, 23 nt, Homo sapiens
auggcccuggugggagugucuuu

SEQ ID NO: 311855 - RNA, 22 nt, Homo sapiens
auggcucaauucuuucccugaa

SEQ ID NO: 311856 - RNA, 22 nt, Homo sapiens
auggcucuggauagaaugcagg

SEQ ID NO: 311857 - RNA, 22 nt, Homo sapiens
auggcucuuauuauuugaggua

SEQ ID NO: 311858 - RNA, 22 nt, Homo sapiens
auggcuguuuaagaguuucauu

SEQ ID NO: 311859 - RNA, 22 nt, Homo sapiens
auguaagugugcucaaauguua

SEQ ID NO: 311860 - RNA, 22 nt, Homo sapiens
auguccauggaaucuguagcaa

SEQ ID NO: 311861 - RNA, 22 nt, Homo sapiens
augugcagauguuacaaauugu

SEQ ID NO: 311862 - RNA, 22 nt, Homo sapiens
augugcuuuuuaaacagaugcu

SEQ ID NO: 311863 - RNA, 22 nt, Homo sapiens
auguggaaauguauaugugucu

SEQ ID NO: 311864 - RNA, 22 nt, Homo sapiens
auguggcacuugacuuucucgc

SEQ ID NO: 311865 - RNA, 22 nt, Homo sapiens
auguggcauuucucauucauuu

SEQ ID NO: 311866 - RNA, 22 nt, Homo sapiens
auguggcuuuucaacuguguga

SEQ ID NO: 311867 - RNA, 22 nt, Homo sapiens
auuaagagcacauguucugggu

SEQ ID NO: 311868 - RNA, 22 nt, Homo sapiens
auuaaggaguggguucauggug

SEQ ID NO: 311869 - RNA, 22 nt, Homo sapiens
auuaagugcuugcagaagucca

SEQ ID NO: 311870 - RNA, 21 nt, Homo sapiens
auuaaugcucugguuagaggc

SEQ ID NO: 311871 - RNA, 22 nt, Homo sapiens
auuacaugucuauccaugaaca

SEQ ID NO: 311872 - RNA, 22 nt, Homo sapiens
auuacuuugcaccaaccuaaua

SEQ ID NO: 311873 - RNA, 22 nt, Homo sapiens
auuauaugucaucacagacacc

SEQ ID NO: 311874 - RNA, 22 nt, Homo sapiens
auuauuagucggccagcuguua

SEQ ID NO: 311875 - RNA, 22 nt, Homo sapiens
auucaagggauuucaggaggcu

SEQ ID NO: 311876 - RNA, 22 nt, Homo sapiens
auuccacagccgauaccaugac

SEQ ID NO: 311877 - RNA, 22 nt, Homo sapiens
auugcaaugggaaacuaugaaa

SEQ ID NO: 311878 - RNA, 22 nt, Homo sapiens
auugcacaaagagggaaacuga

SEQ ID NO: 311879 - RNA, 18 nt, Homo sapiens
auugcacaccagccuggg

SEQ ID NO: 311880 - RNA, 22 nt, Homo sapiens
auugcacaucugcacuacagcc

SEQ ID NO: 311881 - RNA, 22 nt, Homo sapiens
auugcacuccacccugggcaac

SEQ ID NO: 311882 - RNA, 22 nt, Homo sapiens
auugcacuccauccugggcaau

SEQ ID NO: 311883 - RNA, 22 nt, Homo sapiens
auugcauaaacacauuucuuau

SEQ ID NO: 311884 - RNA, 22 nt, Homo sapiens
auugcucaaaucaguacuugag

SEQ ID NO: 311885 - RNA, 22 nt, Homo sapiens
auugcuucugauuuuaaaugag

SEQ ID NO: 311886 - RNA, 22 nt, Homo sapiens
auuggcaauagcuuucuuacua

SEQ ID NO: 311887 - RNA, 22 nt, Homo sapiens
auuggcaaucgucuccauuuuu

SEQ ID NO: 311888 - RNA, 22 nt, Homo sapiens
auuguacauacaccggugugua

SEQ ID NO: 311889 - RNA, 22 nt, Homo sapiens
auuguaccccaauguacaauau

SEQ ID NO: 311890 - RNA, 22 nt, Homo sapiens
auuguacuagguccuagggcuu

SEQ ID NO: 311891 - RNA, 22 nt, Homo sapiens
auuguacuccagccugggcagc

SEQ ID NO: 311892 - RNA, 22 nt, Homo sapiens
auuguacucuagccucugggca

SEQ ID NO: 311893 - RNA, 19 nt, Homo sapiens
auuuccuggagcuggucuc

SEQ ID NO: 311894 - RNA, 22 nt, Homo sapiens
auuuggcaauuuugaagaugcc

SEQ ID NO: 311895 - RNA, 22 nt, Homo sapiens
auuuggcauagaguaucauucu

SEQ ID NO: 311896 - RNA, 22 nt, Homo sapiens
auuugucacuuaacagccauua

SEQ ID NO: 311897 - RNA, 22 nt, Homo sapiens
uuaaguaaucagagaagagaac

SEQ ID NO: 311898 - RNA, 22 nt, Homo sapiens
uuaaugacaucauaggugaagu

SEQ ID NO: 311899 - RNA, 22 nt, Homo sapiens
uuaauguaauugauugauugac

SEQ ID NO: 311900 - RNA, 22 nt, Homo sapiens
uuaauuguaucuauagauguca

SEQ ID NO: 311901 - RNA, 22 nt, Homo sapiens
uuacaagaugucuguccaacac

SEQ ID NO: 311902 - RNA, 19 nt, Homo sapiens
uuacacaaccuaguggggc

SEQ ID NO: 311903 - RNA, 22 nt, Homo sapiens
uuagagcacugaucugcucuuu

SEQ ID NO: 311904 - RNA, 22 nt, Homo sapiens
uuagcacauuuccagcacaugg

SEQ ID NO: 311905 - RNA, 22 nt, Homo sapiens
uuagcacuugggaguauuuauu

SEQ ID NO: 311906 - RNA, 22 nt, Homo sapiens
uuaggcuuuucagacacuucau

SEQ ID NO: 311907 - RNA, 22 nt, Homo sapiens
uuagggaggacaguuacaacag

SEQ ID NO: 311908 - RNA, 22 nt, Homo sapiens
uuagggaguaaucuaaaaaugg

SEQ ID NO: 311909 - RNA, 20 nt, Homo sapiens
uuauagcuacaucuugacug

SEQ ID NO: 311910 - RNA, 21 nt, Homo sapiens
uuauaguggcaugauuuauaa

SEQ ID NO: 311911 - RNA, 22 nt, Homo sapiens
uuauauguuucuuagggacaga

SEQ ID NO: 311912 - RNA, 22 nt, Homo sapiens
uuauggcaaugccccacuccua

SEQ ID NO: 311913 - RNA, 22 nt, Homo sapiens
uuauuagguuagugcaaaaguu

SEQ ID NO: 311914 - RNA, 22 nt, Homo sapiens
uuauuagguugguggaaaagua

SEQ ID NO: 311915 - RNA, 22 nt, Homo sapiens
uuauucagcaccugcuguguuc

SEQ ID NO: 311916 - RNA, 22 nt, Homo sapiens
uuauucauuaacagggaccaaa

SEQ ID NO: 311917 - RNA, 22 nt, Homo sapiens
uuauucauuaauugcuaagguu

SEQ ID NO: 311918 - RNA, 22 nt, Homo sapiens
uuauugcacuccagccugggua

SEQ ID NO: 311919 - RNA, 22 nt, Homo sapiens
uuauugcuuaugauuagguguu

SEQ ID NO: 311920 - RNA, 22 nt, Homo sapiens
aucaccauguguacauuagacc

SEQ ID NO: 311921 - RNA, 22 nt, Homo sapiens
aucagagugaauaaugacaaaa

SEQ ID NO: 311922 - RNA, 22 nt, Homo sapiens
aucagauggcuaaaacagaaga

SEQ ID NO: 311923 - RNA, 22 nt, Homo sapiens
aucagcagcaugaaaacaggcu

SEQ ID NO: 311924 - RNA, 22 nt, Homo sapiens
auccaucagacggcaggcguug

SEQ ID NO: 311925 - RNA, 22 nt, Homo sapiens
auccauguggauaaauguguau

SEQ ID NO: 311926 - RNA, 22 nt, Homo sapiens
aucccugugacgagcaucccua

SEQ ID NO: 311927 - RNA, 22 nt, Homo sapiens
aucccuguguccagcaccugug

SEQ ID NO: 311928 - RNA, 22 nt, Homo sapiens
auccucugagaucuaggcagag

SEQ ID NO: 311929 - RNA, 22 nt, Homo sapiens
auccugaagcuuuacugaauuc

SEQ ID NO: 311930 - RNA, 21 nt, Homo sapiens
auccuucuuuuucaaccugug

SEQ ID NO: 311931 - RNA, 22 nt, Homo sapiens
aucuacuugcugggucucugga

SEQ ID NO: 311932 - RNA, 22 nt, Homo sapiens
aucucagcaacuaaagauccuu

SEQ ID NO: 311933 - RNA, 22 nt, Homo sapiens
aucugguguuuuucucccucgu

SEQ ID NO: 311934 - RNA, 22 nt, Homo sapiens
aucuguagauucagcacaagcu

SEQ ID NO: 311935 - RNA, 22 nt, Homo sapiens
aucuucucuugaagggugggga

SEQ ID NO: 311936 - RNA, 22 nt, Homo sapiens
augaaaugcauguuaaguccgu

SEQ ID NO: 311937 - RNA, 22 nt, Homo sapiens
augaaauugcuaucgcaguacu

SEQ ID NO: 311938 - RNA, 22 nt, Homo sapiens
augaagauguugccuuuuuaau

SEQ ID NO: 311939 - RNA, 22 nt, Homo sapiens
augaauacagcuaugcgugcau

SEQ ID NO: 311940 - RNA, 22 nt, Homo sapiens
augacaaugaaucccuguuuca

SEQ ID NO: 311941 - RNA, 22 nt, Homo sapiens
augacauugaaaagcaagugga

SEQ ID NO: 311942 - RNA, 22 nt, Homo sapiens
augacguugugggcucucaagc

SEQ ID NO: 311943 - RNA, 18 nt, Homo sapiens
augacucuggguguuccu

SEQ ID NO: 311944 - RNA, 22 nt, Homo sapiens
augacugaguagcauuccauua

SEQ ID NO: 311945 - RNA, 22 nt, Homo sapiens
augagaaugauucuguuauggu

SEQ ID NO: 311946 - RNA, 22 nt, Homo sapiens
augagauauguuaaaaguuaaa

SEQ ID NO: 311947 - RNA, 22 nt, Homo sapiens
augagcucauugggugacuggg

SEQ ID NO: 311948 - RNA, 22 nt, Homo sapiens
augaggaaggagccuuugucug

SEQ ID NO: 311949 - RNA, 22 nt, Homo sapiens
augaggcuauaauuuuuaugua

SEQ ID NO: 311950 - RNA, 22 nt, Homo sapiens
augagguguuuauuguauccug

SEQ ID NO: 311951 - RNA, 22 nt, Homo sapiens
augaguaguugcuaaauauuga

SEQ ID NO: 311952 - RNA, 22 nt, Homo sapiens
augaguaugagaauacauuaag

SEQ ID NO: 311953 - RNA, 22 nt, Homo sapiens
augaguuccuuccuugccuagg

SEQ ID NO: 311954 - RNA, 22 nt, Homo sapiens
augcaaaucuuaaguaugugug

SEQ ID NO: 311955 - RNA, 22 nt, Homo sapiens
augcaagaaauaucucuuuuuc

SEQ ID NO: 311956 - RNA, 19 nt, Homo sapiens
augcacgugaaaugcauuu

SEQ ID NO: 311957 - RNA, 22 nt, Homo sapiens
augcacuuggcaggaugauucc

SEQ ID NO: 311958 - RNA, 22 nt, Homo sapiens
augcagaucacauuuuucuguc

SEQ ID NO: 311959 - RNA, 18 nt, Homo sapiens
augcauauuuuaaguugu

SEQ ID NO: 311960 - RNA, 22 nt, Homo sapiens
augccacuguuuaugucacuua

SEQ ID NO: 311961 - RNA, 19 nt, Homo sapiens
augccuggagaugguuaua

SEQ ID NO: 311962 - RNA, 22 nt, Homo sapiens
augcuguuuugaauucucuaga

SEQ ID NO: 311963 - RNA, 22 nt, Homo sapiens
auggaagcauaguauucuauug

SEQ ID NO: 311964 - RNA, 22 nt, Homo sapiens
auggaagucucuguuaaguuuc

SEQ ID NO: 311965 - RNA, 22 nt, Homo sapiens
auggacagaaaaaaauagaugu

SEQ ID NO: 311966 - RNA, 22 nt, Homo sapiens
guggcaagaugacuacucacug

SEQ ID NO: 311967 - RNA, 22 nt, Homo sapiens
guggcaaguguuccaagaggcg

SEQ ID NO: 311968 - RNA, 22 nt, Homo sapiens
guggcuauuguucccugguugc

SEQ ID NO: 311969 - RNA, 22 nt, Homo sapiens
guggcuuuauuuagaagcaggg

SEQ ID NO: 311970 - RNA, 22 nt, Homo sapiens
gugggguaggaggaguacuucc

SEQ ID NO: 311971 - RNA, 22 nt, Homo sapiens
gugggguaggcaauuccuagug

SEQ ID NO: 311972 - RNA, 22 nt, Homo sapiens
gugguguccugcaccuauaguc

SEQ ID NO: 311973 - RNA, 22 nt, Homo sapiens
guguaauacacacauauaugca

SEQ ID NO: 311974 - RNA, 22 nt, Homo sapiens
gugucacuguauaauauuuauu

SEQ ID NO: 311975 - RNA, 22 nt, Homo sapiens
gugucacugugaggauauugua

SEQ ID NO: 311976 - RNA, 22 nt, Homo sapiens
gugucuccugccuucaugcagc

SEQ ID NO: 311977 - RNA, 22 nt, Homo sapiens
guuaugcagcaauugauaaucu

SEQ ID NO: 311978 - RNA, 22 nt, Homo sapiens
guuauguuaaauuguuguaugc

SEQ ID NO: 311979 - RNA, 20 nt, Homo sapiens
guucacagagguuaugauua

SEQ ID NO: 311980 - RNA, 22 nt, Homo sapiens
guucacaguuaggacaacugcu

SEQ ID NO: 311981 - RNA, 22 nt, Homo sapiens
guucaucaggcuuucucuagag

SEQ ID NO: 311982 - RNA, 22 nt, Homo sapiens
guucuauguugggaguucacua

SEQ ID NO: 311983 - RNA, 22 nt, Homo sapiens
guucucacuggacugugaaaau

SEQ ID NO: 311984 - RNA, 22 nt, Homo sapiens
guucuggagauaaagccaaggu

SEQ ID NO: 311985 - RNA, 22 nt, Homo sapiens
guugcagcacacaggcugucag

SEQ ID NO: 311986 - RNA, 22 nt, Homo sapiens
guuggaauguauugcuacuucu

SEQ ID NO: 311987 - RNA, 22 nt, Homo sapiens
guuugguugcauggaaaauuua

SEQ ID NO: 311988 - RNA, 22 nt, Homo sapiens
guuugugcuccuaugagaaucu

SEQ ID NO: 311989 - RNA, 16 nt, Homo sapiens
uaaagcuaaucacuuu

SEQ ID NO: 311990 - RNA, 22 nt, Homo sapiens
uaaagcuacaguauaugguauu

SEQ ID NO: 311991 - RNA, 21 nt, Homo sapiens
uaaagcuagaaccuuagcuuu

SEQ ID NO: 311992 - RNA, 22 nt, Homo sapiens
uaaagcuagagcuggaguggca

SEQ ID NO: 311993 - RNA, 22 nt, Homo sapiens
uaaaguguuuguuauuaaaggu

SEQ ID NO: 311994 - RNA, 22 nt, Homo sapiens
uaacaggcuacucuugcauugc

SEQ ID NO: 311995 - RNA, 22 nt, Homo sapiens
uaacaguguauuuacuacuucc

SEQ ID NO: 311996 - RNA, 22 nt, Homo sapiens
uaacccagugucugugaugggu

SEQ ID NO: 311997 - RNA, 21 nt, Homo sapiens
uaacccugaaggagcucugga

SEQ ID NO: 311998 - RNA, 22 nt, Homo sapiens
uaacuaaagagaagucaauguc

SEQ ID NO: 311999 - RNA, 18 nt, Homo sapiens
uaacugugggaacuaacu

SEQ ID NO: 312000 - RNA, 22 nt, Homo sapiens
uaagcaguaaaugaagucuugc

SEQ ID NO: 312001 - RNA, 22 nt, Homo sapiens
uaagcagugcaagaauggaaua

SEQ ID NO: 312002 - RNA, 22 nt, Homo sapiens
uaagcuaauguguuuucucuua

SEQ ID NO: 312003 - RNA, 22 nt, Homo sapiens
uaaggcuuaugguaaaguccug

SEQ ID NO: 312004 - RNA, 22 nt, Homo sapiens
uaaggcuugcuucagucuugaa

SEQ ID NO: 312005 - RNA, 22 nt, Homo sapiens
uaaggcuuuuguucagcguggg

SEQ ID NO: 312006 - RNA, 22 nt, Homo sapiens
uaagguuuuugauaugcugcug

SEQ ID NO: 312007 - RNA, 22 nt, Homo sapiens
uaaguauuaggccccaggcugg

SEQ ID NO: 312008 - RNA, 22 nt, Homo sapiens
uaaguauuuuaauuccuggcau

SEQ ID NO: 312009 - RNA, 22 nt, Homo sapiens
uaagugaauauggacaguuagc

SEQ ID NO: 312010 - RNA, 22 nt, Homo sapiens
uaaguugcagguugugauucca

SEQ ID NO: 312011 - RNA, 22 nt, Homo sapiens
uaaguuguagaacguuuucuua

SEQ ID NO: 312012 - RNA, 22 nt, Homo sapiens
uaaguuguugacauuaggggaa

SEQ ID NO: 312013 - RNA, 21 nt, Homo sapiens
uaauaaugucucagacaccua

SEQ ID NO: 312014 - RNA, 22 nt, Homo sapiens
uaauagagucauuauuauuguu

SEQ ID NO: 312015 - RNA, 22 nt, Homo sapiens
uaauauguuuugaaaucaggaa

SEQ ID NO: 312016 - RNA, 22 nt, Homo sapiens
uaaucucagcugagcugagauu

SEQ ID NO: 312017 - RNA, 22 nt, Homo sapiens
uaaugcaucaugguuggcaaac

SEQ ID NO: 312018 - RNA, 22 nt, Homo sapiens
uaauucacauaaagcacuuaga

SEQ ID NO: 312019 - RNA, 22 nt, Homo sapiens
uaauugaaugcagacaccaggg

SEQ ID NO: 312020 - RNA, 22 nt, Homo sapiens
uacaaagcuuugaugugucuuu

SEQ ID NO: 312021 - RNA, 22 nt, Homo sapiens
uaauaauguuaggcuuacucaa

SEQ ID NO: 312022 - RNA, 22 nt, Homo sapiens
uaauagcaguguuacuaggacu

SEQ ID NO: 312023 - RNA, 22 nt, Homo sapiens
uaauaguuucagaaguuguuuu

SEQ ID NO: 312024 - RNA, 22 nt, Homo sapiens
uaauaugugguugcuugggcac

SEQ ID NO: 312025 - RNA, 22 nt, Homo sapiens
uaaucacagagguuuggccuca

SEQ ID NO: 312026 - RNA, 22 nt, Homo sapiens
uaaugcauguaaugggcugaua

SEQ ID NO: 312027 - RNA, 22 nt, Homo sapiens
uaaugcuguggucugguuuaaa

SEQ ID NO: 312028 - RNA, 22 nt, Homo sapiens
uacaagcuaaaauggaagauca

SEQ ID NO: 312029 - RNA, 22 nt, Homo sapiens
uacaauagugacaaaucagcau

SEQ ID NO: 312030 - RNA, 20 nt, Homo sapiens
uacacguaugagcacaugug

SEQ ID NO: 312031 - RNA, 22 nt, Homo sapiens
uacagaguauccauuugaguuc

SEQ ID NO: 312032 - RNA, 22 nt, Homo sapiens
uacaggauagacaauuuauuaa

SEQ ID NO: 312033 - RNA, 22 nt, Homo sapiens
uacauugcacuuuauuagauac

SEQ ID NO: 312034 - RNA, 22 nt, Homo sapiens
uaccacagucauuacacuugua

SEQ ID NO: 312035 - RNA, 23 nt, Homo sapiens
uaccacauuccuucuuuccuguu

SEQ ID NO: 312036 - RNA, 22 nt, Homo sapiens
uaccagcauuucucuuuaagua

SEQ ID NO: 312037 - RNA, 22 nt, Homo sapiens
uacuagaaccuuauucagagug

SEQ ID NO: 312038 - RNA, 22 nt, Homo sapiens
uacucuuuagcuccuuaaggaa

SEQ ID NO: 312039 - RNA, 22 nt, Homo sapiens
uacugcuuaaaagucaauuacu

SEQ ID NO: 312040 - RNA, 22 nt, Homo sapiens
uagaacauuccaggugauguug

SEQ ID NO: 312041 - RNA, 22 nt, Homo sapiens
uagaaucuaacucgcaugaaaa

SEQ ID NO: 312042 - RNA, 22 nt, Homo sapiens
uagagcacaagguagauuucua

SEQ ID NO: 312043 - RNA, 22 nt, Homo sapiens
uagagguaggucuucgagucuc

SEQ ID NO: 312044 - RNA, 22 nt, Homo sapiens
uagagguagguguaugaacuag

SEQ ID NO: 312045 - RNA, 22 nt, Homo sapiens
uagagguauaccaaaaaggcau

SEQ ID NO: 312046 - RNA, 22 nt, Homo sapiens
uagagguauguauaguauucuu

SEQ ID NO: 312047 - RNA, 22 nt, Homo sapiens
uagauucaucuguuccuuuuga

SEQ ID NO: 312048 - RNA, 20 nt, Homo sapiens
uagcacacauguagaauagu

SEQ ID NO: 312049 - RNA, 22 nt, Homo sapiens
uagcaccaaacauauacucagu

SEQ ID NO: 312050 - RNA, 22 nt, Homo sapiens
uagcacuauguuaucacauacu

SEQ ID NO: 312051 - RNA, 23 nt, Homo sapiens
uagcacuuuuuacauauggacau

SEQ ID NO: 312052 - RNA, 22 nt, Homo sapiens
uagcagcaccccacucuacugg

SEQ ID NO: 312053 - RNA, 22 nt, Homo sapiens
uagcagcauaaauggacuaaga

SEQ ID NO: 312054 - RNA, 22 nt, Homo sapiens
uagcagcaucucuggcuucuac

SEQ ID NO: 312055 - RNA, 22 nt, Homo sapiens
uagcagcauuuuuguagaguau

SEQ ID NO: 312056 - RNA, 22 nt, Homo sapiens
uagcagccaggaagggcuggcu

SEQ ID NO: 312057 - RNA, 22 nt, Homo sapiens
uagcaucaauucauguuaugau

SEQ ID NO: 312058 - RNA, 22 nt, Homo sapiens
uagcuucuccauagcuccaugu

SEQ ID NO: 312059 - RNA, 22 nt, Homo sapiens
uaggacacagaccuggauggaa

SEQ ID NO: 312060 - RNA, 22 nt, Homo sapiens
uaggacauugcccuuguggaga

SEQ ID NO: 312061 - RNA, 22 nt, Homo sapiens
uaggagugugaacccuaugaac

SEQ ID NO: 312062 - RNA, 22 nt, Homo sapiens
uaggauaguccuccugagaccu

SEQ ID NO: 312063 - RNA, 22 nt, Homo sapiens
uaggcacuguguuuguaggagu

SEQ ID NO: 312064 - RNA, 22 nt, Homo sapiens
uaggcaguuuuccuuucacagu

SEQ ID NO: 312065 - RNA, 22 nt, Homo sapiens
uaggcauuuuucugauaaacua

SEQ ID NO: 312066 - RNA, 22 nt, Homo sapiens
uaggccuuuuucagauggguag

SEQ ID NO: 312067 - RNA, 22 nt, Homo sapiens
uagggcauugaacugaauucuu

SEQ ID NO: 312068 - RNA, 22 nt, Homo sapiens
uaggugaaugcuggaagaaaug

SEQ ID NO: 312069 - RNA, 22 nt, Homo sapiens
uaggugaauguaguaagguguu

SEQ ID NO: 312070 - RNA, 22 nt, Homo sapiens
uaguaacacauugaacgaucgc

SEQ ID NO: 312071 - RNA, 23 nt, Homo sapiens
uaguaccauauuguuggcagcac

SEQ ID NO: 312072 - RNA, 22 nt, Homo sapiens
uaguaccauucccaaaccaacu

SEQ ID NO: 312073 - RNA, 22 nt, Homo sapiens
uagugcuagaugacuuugccau

SEQ ID NO: 312074 - RNA, 18 nt, Homo sapiens
uagugcuguucucaugau

SEQ ID NO: 312075 - RNA, 22 nt, Homo sapiens
uaguugcauuggcugcuaugcu

SEQ ID NO: 312076 - RNA, 22 nt, Homo sapiens
uauaacacccacauauagucuu

SEQ ID NO: 312077 - RNA, 22 nt, Homo sapiens
uauagcuugauuauggugaugg

SEQ ID NO: 312078 - RNA, 22 nt, Homo sapiens
uauaguguuuucaaaaguaugu

SEQ ID NO: 312079 - RNA, 22 nt, Homo sapiens
uaucaaacccaaggaggggguu

SEQ ID NO: 312080 - RNA, 22 nt, Homo sapiens
uaucaagauggauaaggauaga

SEQ ID NO: 312081 - RNA, 22 nt, Homo sapiens
uaucaaucuagggaaacuccaa

SEQ ID NO: 312082 - RNA, 22 nt, Homo sapiens
uaucacagcauugucuauaaua

SEQ ID NO: 312083 - RNA, 22 nt, Homo sapiens
uaucacagugcuggaguauucc

SEQ ID NO: 312084 - RNA, 20 nt, Homo sapiens
uaucacaguucaggaacucu

SEQ ID NO: 312085 - RNA, 22 nt, Homo sapiens
uaucagcacaguggguucaugg

SEQ ID NO: 312086 - RNA, 22 nt, Homo sapiens
uaucauaguuuggacuuucauu

SEQ ID NO: 312087 - RNA, 22 nt, Homo sapiens
uaucauuguguuauuucuucca

SEQ ID NO: 312088 - RNA, 22 nt, Homo sapiens
gaggagauauucugcuggaugg

SEQ ID NO: 312089 - RNA, 22 nt, Homo sapiens
gaggcagucuguccauucucag

SEQ ID NO: 312090 - RNA, 22 nt, Homo sapiens
gaggcauuauucccaucuuaca

SEQ ID NO: 312091 - RNA, 22 nt, Homo sapiens
gagggcacugcuuuccuuucaa

SEQ ID NO: 312092 - RNA, 22 nt, Homo sapiens
gagguaagagaauaaacaguuu

SEQ ID NO: 312093 - RNA, 22 nt, Homo sapiens
gagguaguuuaguuuuggggaa

SEQ ID NO: 312094 - RNA, 22 nt, Homo sapiens
gaggucaggacauuuuugcuuu

SEQ ID NO: 312095 - RNA, 22 nt, Homo sapiens
gagugguaguuucuagaggugu

SEQ ID NO: 312096 - RNA, 22 nt, Homo sapiens
gauacuguauccuaaaagcuuu

SEQ ID NO: 312097 - RNA, 22 nt, Homo sapiens
gauauguaaaaauuauaucuga

SEQ ID NO: 312098 - RNA, 22 nt, Homo sapiens
gauauguacagcucucuaggau

SEQ ID NO: 312099 - RNA, 17 nt, Homo sapiens
gaucacagucgucuccu

SEQ ID NO: 312100 - RNA, 22 nt, Homo sapiens
gaucacaugggagaaugagagu

SEQ ID NO: 312101 - RNA, 22 nt, Homo sapiens
gaucacauuguuucauacauau

SEQ ID NO: 312102 - RNA, 22 nt, Homo sapiens
gaugagaugagcauuugaauug

SEQ ID NO: 312103 - RNA, 22 nt, Homo sapiens
gauggauuuuaagugaaugaaa

SEQ ID NO: 312104 - RNA, 22 nt, Homo sapiens
gauuagagaaauacugcugcua

SEQ ID NO: 312105 - RNA, 20 nt, Homo sapiens
gauuagagagaggcugugca

SEQ ID NO: 312106 - RNA, 22 nt, Homo sapiens
gauuuguuggccugugagcuag

SEQ ID NO: 312107 - RNA, 22 nt, Homo sapiens
gcaaaguguuuuuaggaagucu

SEQ ID NO: 312108 - RNA, 20 nt, Homo sapiens
gcaaauggaucccacaagcc

SEQ ID NO: 312109 - RNA, 22 nt, Homo sapiens
gcacauggccacuaggaauaaa

SEQ ID NO: 312110 - RNA, 22 nt, Homo sapiens
gcaccguggaguauggggagga

SEQ ID NO: 312111 - RNA, 22 nt, Homo sapiens
gcacugggccacauuuauuuuc

SEQ ID NO: 312112 - RNA, 22 nt, Homo sapiens
gcagugaugugaucauagcuca

SEQ ID NO: 312113 - RNA, 22 nt, Homo sapiens
gcagugcaugacgguauauaua

SEQ ID NO: 312114 - RNA, 20 nt, Homo sapiens
gcaguguucacuguauuccu

SEQ ID NO: 312115 - RNA, 22 nt, Homo sapiens
gcaguguugugauccaggucuu

SEQ ID NO: 312116 - RNA, 22 nt, Homo sapiens
gcauaaagcuaauaagacgaag

SEQ ID NO: 312117 - RNA, 22 nt, Homo sapiens
gcauauguuuggguguguauau

SEQ ID NO: 312118 - RNA, 22 nt, Homo sapiens
gcaucaaugucuauaguguuug

SEQ ID NO: 312119 - RNA, 22 nt, Homo sapiens
gcaugaugaauaauaucacaag

SEQ ID NO: 312120 - RNA, 22 nt, Homo sapiens
gcauggaaggcgcuuugugacu

SEQ ID NO: 312121 - RNA, 22 nt, Homo sapiens
gcauggagcauacauuucuguu

SEQ ID NO: 312122 - RNA, 22 nt, Homo sapiens
gcauggaguggaaauucuuggg

SEQ ID NO: 312123 - RNA, 22 nt, Homo sapiens
gccaagaugcugcccacagaca

SEQ ID NO: 312124 - RNA, 21 nt, Homo sapiens
gccaguguggcaauuuuucaa

SEQ ID NO: 312125 - RNA, 22 nt, Homo sapiens
gccaguguguguuguucuccgc

SEQ ID NO: 312126 - RNA, 22 nt, Homo sapiens
gccauugcacuccagcuugggc

SEQ ID NO: 312127 - RNA, 22 nt, Homo sapiens
gcccacuguuaaauuuguuuua

SEQ ID NO: 312128 - RNA, 22 nt, Homo sapiens
gcccagcguucagggaggggcu

SEQ ID NO: 312129 - RNA, 22 nt, Homo sapiens
gcccuguugcccugaauacaua

SEQ ID NO: 312130 - RNA, 22 nt, Homo sapiens
gccugagaggauaugauccccu

SEQ ID NO: 312131 - RNA, 22 nt, Homo sapiens
gccuuuggugacaggcaugugu

SEQ ID NO: 312132 - RNA, 22 nt, Homo sapiens
gcugcacuuuaaggcauccccu

SEQ ID NO: 312133 - RNA, 22 nt, Homo sapiens
gcuggcuuucuccugaucucag

SEQ ID NO: 312134 - RNA, 22 nt, Homo sapiens
gcuggugaaggcugaaaagugg

SEQ ID NO: 312135 - RNA, 22 nt, Homo sapiens
gcuguguguuaucagaaauugc

SEQ ID NO: 312136 - RNA, 22 nt, Homo sapiens
gcuguguugugcccagcaucau

SEQ ID NO: 312137 - RNA, 22 nt, Homo sapiens
gcuuuguugauggugagucugu

SEQ ID NO: 312138 - RNA, 22 nt, Homo sapiens
ugugcaguuuugagugaauuuc

SEQ ID NO: 312139 - RNA, 22 nt, Homo sapiens
ugugccacuccaaccuggguga

SEQ ID NO: 312140 - RNA, 22 nt, Homo sapiens
ugugcuaauacauacagugcua

SEQ ID NO: 312141 - RNA, 22 nt, Homo sapiens
ugugcugaucgggcacgguguc

SEQ ID NO: 312142 - RNA, 22 nt, Homo sapiens
uguggcacuguguccagagaaa

SEQ ID NO: 312143 - RNA, 22 nt, Homo sapiens
uguggccuuuguuucaguuggg

SEQ ID NO: 312144 - RNA, 22 nt, Homo sapiens
uguggcuuuuucuuggcugagg

SEQ ID NO: 312145 - RNA, 22 nt, Homo sapiens
ugugguauuagguguaguaucu

SEQ ID NO: 312146 - RNA, 23 nt, Homo sapiens
ugugguauuauuccauuuauagg

SEQ ID NO: 312147 - RNA, 22 nt, Homo sapiens
uguguaaauauauacacacgug

SEQ ID NO: 312148 - RNA, 22 nt, Homo sapiens
ugugucacugcacuccagccug

SEQ ID NO: 312149 - RNA, 22 nt, Homo sapiens
ugugucuacugagaugaucaug

SEQ ID NO: 312150 - RNA, 22 nt, Homo sapiens
ugugucuugaauuuuguaugua

SEQ ID NO: 312151 - RNA, 22 nt, Homo sapiens
uguuacagugacuaauguuuua

SEQ ID NO: 312152 - RNA, 22 nt, Homo sapiens
uguuaugaagaugccugguaca

SEQ ID NO: 312153 - RNA, 22 nt, Homo sapiens
uguucauggauccaguggcuuc

SEQ ID NO: 312154 - RNA, 22 nt, Homo sapiens
uguuuuggagguccucacuaga

SEQ ID NO: 312155 - RNA, 22 nt, Homo sapiens
uuaaaccugucuucucacuaau

SEQ ID NO: 312156 - RNA, 22 nt, Homo sapiens
uuaaaguguuuucaaaauguca

SEQ ID NO: 312157 - RNA, 22 nt, Homo sapiens
uuaagaagugauuuuccucauu

SEQ ID NO: 312158 - RNA, 22 nt, Homo sapiens
uuaagacaccaaucauuggauu

SEQ ID NO: 312159 - RNA, 22 nt, Homo sapiens
uuaaggaaggagucuuaaaugg

SEQ ID NO: 312160 - RNA, 22 nt, Homo sapiens
uuaauacugcuuaacuuuagga

SEQ ID NO: 312161 - RNA, 22 nt, Homo sapiens
uuaaucaggccguuuccuaaga

SEQ ID NO: 312162 - RNA, 22 nt, Homo sapiens
uuaaugcuuuugggauauuucu

SEQ ID NO: 312163 - RNA, 22 nt, Homo sapiens
uuaauuguccaaguucaucucu

SEQ ID NO: 312164 - RNA, 22 nt, Homo sapiens
uuaauuguccauuauucuguuc

SEQ ID NO: 312165 - RNA, 22 nt, Homo sapiens
uuacaaccucagcagugcaaag

SEQ ID NO: 312166 - RNA, 22 nt, Homo sapiens
uuacacaguugguaggggcaga

SEQ ID NO: 312167 - RNA, 22 nt, Homo sapiens
uuacaggacuaagcagcuuugc

SEQ ID NO: 312168 - RNA, 22 nt, Homo sapiens
uuacaguagaugaggguauaau

SEQ ID NO: 312169 - RNA, 22 nt, Homo sapiens
uuacaguaugaguaagaguucu

SEQ ID NO: 312170 - RNA, 22 nt, Homo sapiens
uuacaguauugcaaggacuagg

SEQ ID NO: 312171 - RNA, 22 nt, Homo sapiens
uuacagucuuaggcagugcuuu

SEQ ID NO: 312172 - RNA, 20 nt, Homo sapiens
uuacagugggaccuuccuga

SEQ ID NO: 312173 - RNA, 22 nt, Homo sapiens
uuagaucaacauggaacucuau

SEQ ID NO: 312174 - RNA, 22 nt, Homo sapiens
uuagcagcaucccuggccugua

SEQ ID NO: 312175 - RNA, 22 nt, Homo sapiens
uuagcagugugagcacagacua

SEQ ID NO: 312176 - RNA, 22 nt, Homo sapiens
uuaggacacuguggguggguca

SEQ ID NO: 312177 - RNA, 21 nt, Homo sapiens
uuaggcagugucagaggugag

SEQ ID NO: 312178 - RNA, 22 nt, Homo sapiens
uuaggcaguuuauugauuuuca

SEQ ID NO: 312179 - RNA, 22 nt, Homo sapiens
uuagggaggcucaggacaagag

SEQ ID NO: 312180 - RNA, 22 nt, Homo sapiens
uuagugcaaacucuucaaugcu

SEQ ID NO: 312181 - RNA, 22 nt, Homo sapiens
uuauacacugugggaguguaaa

SEQ ID NO: 312182 - RNA, 22 nt, Homo sapiens
uuauagcagugcaggaacagac

SEQ ID NO: 312183 - RNA, 22 nt, Homo sapiens
uuauauguuuguacuuaggccu

SEQ ID NO: 312184 - RNA, 22 nt, Homo sapiens
uuaucccacuuucuguuccugu

SEQ ID NO: 312185 - RNA, 22 nt, Homo sapiens
uuaucucagugaacugagugga

SEQ ID NO: 312186 - RNA, 22 nt, Homo sapiens
uuaucucaguguuuguaaacaa

SEQ ID NO: 312187 - RNA, 22 nt, Homo sapiens
uuauggauuuauauucuguagu

SEQ ID NO: 312188 - RNA, 22 nt, Homo sapiens
uuauuagguuaaccuauagcua

SEQ ID NO: 312189 - RNA, 22 nt, Homo sapiens
uuauugcucauuugggcauucu

SEQ ID NO: 312190 - RNA, 22 nt, Homo sapiens
uucaacagugauggccuuugua

SEQ ID NO: 312191 - RNA, 22 nt, Homo sapiens
uucaagucaaggaaagaggucu

SEQ ID NO: 312192 - RNA, 22 nt, Homo sapiens
uucaagucaauuuuugaaugac

SEQ ID NO: 312193 - RNA, 22 nt, Homo sapiens
uucacuguaaaaugaagagggu

SEQ ID NO: 312194 - RNA, 22 nt, Homo sapiens
uucacuguagccucagccucuu

SEQ ID NO: 312195 - RNA, 22 nt, Homo sapiens
uucacugugaacucauauucag

SEQ ID NO: 312196 - RNA, 20 nt, Homo sapiens
uucagcaaaggaaugggagu

SEQ ID NO: 312197 - RNA, 22 nt, Homo sapiens
uucagcacugaaaauaugucau

SEQ ID NO: 312198 - RNA, 22 nt, Homo sapiens
uucagguucauuugcugcuauu

SEQ ID NO: 312199 - RNA, 22 nt, Homo sapiens
uucaguggguggaugaauauga

SEQ ID NO: 312200 - RNA, 18 nt, Homo sapiens
uucaguuuguaucugggg

SEQ ID NO: 312201 - RNA, 22 nt, Homo sapiens
auuauugacucauagaaaggau

SEQ ID NO: 312202 - RNA, 22 nt, Homo sapiens
auucaacuaauuauugaagaug

SEQ ID NO: 312203 - RNA, 22 nt, Homo sapiens
auucaagugaugcagcuguuuu

SEQ ID NO: 312204 - RNA, 22 nt, Homo sapiens
auucacugugcuuggccaaauu

SEQ ID NO: 312205 - RNA, 22 nt, Homo sapiens
auucagaggggcagcugucuug

SEQ ID NO: 312206 - RNA, 22 nt, Homo sapiens
auucaucagggauauuggucug

SEQ ID NO: 312207 - RNA, 20 nt, Homo sapiens
auucauggugguacguuguc

SEQ ID NO: 312208 - RNA, 22 nt, Homo sapiens
auuccacaguuaacacagaccg

SEQ ID NO: 312209 - RNA, 20 nt, Homo sapiens
auuccacuuguuugagguac

SEQ ID NO: 312210 - RNA, 22 nt, Homo sapiens
auucccuuggucaacggaugca

SEQ ID NO: 312211 - RNA, 18 nt, Homo sapiens
auucuacaggccuuuuga

SEQ ID NO: 312212 - RNA, 22 nt, Homo sapiens
auugacaguuggccaguaagug

SEQ ID NO: 312213 - RNA, 22 nt, Homo sapiens
auugagcaaggucuccuaguau

SEQ ID NO: 312214 - RNA, 22 nt, Homo sapiens
auugagcaauuccuaugugcuu

SEQ ID NO: 312215 - RNA, 22 nt, Homo sapiens
auugagcuuuuuaaaauauagu

SEQ ID NO: 312216 - RNA, 22 nt, Homo sapiens
auugcaauuaguccauagaguu

SEQ ID NO: 312217 - RNA, 21 nt, Homo sapiens
auugcacaauauacccaugua

SEQ ID NO: 312218 - RNA, 22 nt, Homo sapiens
auugcacaccagucugggcaaa

SEQ ID NO: 312219 - RNA, 22 nt, Homo sapiens
auugcacuccagccugggcaac

SEQ ID NO: 312220 - RNA, 22 nt, Homo sapiens
auugcacuccagccugggcagc

SEQ ID NO: 312221 - RNA, 21 nt, Homo sapiens
auugcacuccagccugggcga

SEQ ID NO: 312222 - RNA, 22 nt, Homo sapiens
auugcacuccagucugggcaac

SEQ ID NO: 312223 - RNA, 22 nt, Homo sapiens
auugcucuuagaaauauuucuu

SEQ ID NO: 312224 - RNA, 22 nt, Homo sapiens
auuggcaagauagcauaugagg

SEQ ID NO: 312225 - RNA, 22 nt, Homo sapiens
auuguacuccagccugggcugc

SEQ ID NO: 312226 - RNA, 22 nt, Homo sapiens
auuguacuccagccuguggagc

SEQ ID NO: 312227 - RNA, 22 nt, Homo sapiens
auuguacuuaagccugggugaa

SEQ ID NO: 312228 - RNA, 22 nt, Homo sapiens
auuucuacuccuguguccagaa

SEQ ID NO: 312229 - RNA, 20 nt, Homo sapiens
auuuggcauaguuuaagcaa

SEQ ID NO: 312230 - RNA, 22 nt, Homo sapiens
auuugggaaugugcauuauacu

SEQ ID NO: 312231 - RNA, 22 nt, Homo sapiens
caaaguaauuacgguuuuggcc

SEQ ID NO: 312232 - RNA, 22 nt, Homo sapiens
caaaguaauugcuguuuugcca

SEQ ID NO: 312233 - RNA, 22 nt, Homo sapiens
caaaguaauugugguuuugcca

SEQ ID NO: 312234 - RNA, 22 nt, Homo sapiens
caaagucuucaguugauucuga

SEQ ID NO: 312235 - RNA, 22 nt, Homo sapiens
caaagugcugggacuggccggg

SEQ ID NO: 312236 - RNA, 22 nt, Homo sapiens
caaaugacaucauuucauucaa

SEQ ID NO: 312237 - RNA, 22 nt, Homo sapiens
caaauugcuugucuguagugga

SEQ ID NO: 312238 - RNA, 22 nt, Homo sapiens
caacaguaaagcauuuuuaagu

SEQ ID NO: 312239 - RNA, 22 nt, Homo sapiens
caaggaauucucaauagaguua

SEQ ID NO: 312240 - RNA, 22 nt, Homo sapiens
caauacuguguugaauaagagu

SEQ ID NO: 312241 - RNA, 22 nt, Homo sapiens
caauacuguuaccugaaauagg

SEQ ID NO: 312242 - RNA, 22 nt, Homo sapiens
cacacugucuucauuacuguag

SEQ ID NO: 312243 - RNA, 22 nt, Homo sapiens
cacagcgacuuccgccuaccgg

SEQ ID NO: 312244 - RNA, 22 nt, Homo sapiens
cacagggcuaacauuuuugccc

SEQ ID NO: 312245 - RNA, 22 nt, Homo sapiens
cacagugaaugucaucauugcc

SEQ ID NO: 312246 - RNA, 22 nt, Homo sapiens
caccacagccauuauugucccc

SEQ ID NO: 312247 - RNA, 22 nt, Homo sapiens
caccuagacuggagugcagugg

SEQ ID NO: 312248 - RNA, 22 nt, Homo sapiens
cacucaguuugugguacuuugu

SEQ ID NO: 312249 - RNA, 22 nt, Homo sapiens
cacugcacuccagucccgucuc

SEQ ID NO: 312250 - RNA, 22 nt, Homo sapiens
cacugcauccuugaccuucugg

SEQ ID NO: 312251 - RNA, 22 nt, Homo sapiens
cagacaugucuuguggccgugg

SEQ ID NO: 312252 - RNA, 22 nt, Homo sapiens
cagagcacuaaagguaaaaggc

SEQ ID NO: 312253 - RNA, 22 nt, Homo sapiens
caggcagucuggcucccaagug

SEQ ID NO: 312254 - RNA, 22 nt, Homo sapiens
caggcuuuuccacacauggguu

SEQ ID NO: 312255 - RNA, 22 nt, Homo sapiens
cagguaguauuugguuacauaa

SEQ ID NO: 312256 - RNA, 22 nt, Homo sapiens
cagugauaggugguuguuggca

SEQ ID NO: 312257 - RNA, 17 nt, Homo sapiens
acaugagacuggauucu

SEQ ID NO: 312258 - RNA, 22 nt, Homo sapiens
acaugcauauguuggaagaaag

SEQ ID NO: 312259 - RNA, 22 nt, Homo sapiens
acaugcauggcaugcauuguac

SEQ ID NO: 312260 - RNA, 18 nt, Homo sapiens
acauucagcuugaagaua

SEQ ID NO: 312261 - RNA, 22 nt, Homo sapiens
accacaggguaaaguuagauau

SEQ ID NO: 312262 - RNA, 21 nt, Homo sapiens
acccccacaccuccuuaguuc

SEQ ID NO: 312263 - RNA, 22 nt, Homo sapiens
acccuggagagugcuguaguaa

SEQ ID NO: 312264 - RNA, 22 nt, Homo sapiens
acccuggaggucuacagugcag

SEQ ID NO: 312265 - RNA, 22 nt, Homo sapiens
acccuguaguuagaaacuuuca

SEQ ID NO: 312266 - RNA, 22 nt, Homo sapiens
acccugucaaaacggaccaauc

SEQ ID NO: 312267 - RNA, 22 nt, Homo sapiens
acccugucaaaauggaccaauc

SEQ ID NO: 312268 - RNA, 22 nt, Homo sapiens
acccugucagcuggccugggca

SEQ ID NO: 312269 - RNA, 22 nt, Homo sapiens
acccuuuagguuggaugaggau

SEQ ID NO: 312270 - RNA, 22 nt, Homo sapiens
accuggacacuuugggcuccuc

SEQ ID NO: 312271 - RNA, 22 nt, Homo sapiens
acggcaguguggugcggucagg

SEQ ID NO: 312272 - RNA, 22 nt, Homo sapiens
acuacauaugacaucuucuuua

SEQ ID NO: 312273 - RNA, 22 nt, Homo sapiens
acugcacuccaccuugggcaac

SEQ ID NO: 312274 - RNA, 22 nt, Homo sapiens
acugcacuccagccuccugaca

SEQ ID NO: 312275 - RNA, 22 nt, Homo sapiens
acugcacuccagccuucaggac

SEQ ID NO: 312276 - RNA, 22 nt, Homo sapiens
acugcacuccagccuuggcaac

SEQ ID NO: 312277 - RNA, 22 nt, Homo sapiens
acugcacuccaguuugggcagc

SEQ ID NO: 312278 - RNA, 22 nt, Homo sapiens
acugcacuccggccuggcaaca

SEQ ID NO: 312279 - RNA, 22 nt, Homo sapiens
acuguauagauggaguugauuu

SEQ ID NO: 312280 - RNA, 22 nt, Homo sapiens
acuuugguuuauagaauuuagg

SEQ ID NO: 312281 - RNA, 22 nt, Homo sapiens
agaaacauucucuugccuccuu

SEQ ID NO: 312282 - RNA, 22 nt, Homo sapiens
agaaagugcuucccuuugguga

SEQ ID NO: 312283 - RNA, 22 nt, Homo sapiens
agaaugucagcuggauucagcu

SEQ ID NO: 312284 - RNA, 22 nt, Homo sapiens
agaaugucaguauuggcuaaaa

SEQ ID NO: 312285 - RNA, 22 nt, Homo sapiens
agacacuguugaaaaggcccca

SEQ ID NO: 312286 - RNA, 22 nt, Homo sapiens
agacaguauuggcaaagugugu

SEQ ID NO: 312287 - RNA, 22 nt, Homo sapiens
agacaguguguguauauauggu

SEQ ID NO: 312288 - RNA, 22 nt, Homo sapiens
agacuagaaaucauuuguugag

SEQ ID NO: 312289 - RNA, 22 nt, Homo sapiens
agagagguggguggagccccca

SEQ ID NO: 312290 - RNA, 22 nt, Homo sapiens
agagauaauuagguuaaaugag

SEQ ID NO: 312291 - RNA, 22 nt, Homo sapiens
agagccacauuaaauaugggaa

SEQ ID NO: 312292 - RNA, 22 nt, Homo sapiens
agaggaguacuacuccaagucu

SEQ ID NO: 312293 - RNA, 22 nt, Homo sapiens
agagguaagaauaguaguugga

SEQ ID NO: 312294 - RNA, 22 nt, Homo sapiens
agauacauuggauaaugguggg

SEQ ID NO: 312295 - RNA, 22 nt, Homo sapiens
agauauguuuaguuucaaaaug

SEQ ID NO: 312296 - RNA, 23 nt, Homo sapiens
agaugcauucuuguaggauauau

SEQ ID NO: 312297 - RNA, 22 nt, Homo sapiens
agauucauccaaguuguugcau

SEQ ID NO: 312298 - RNA, 22 nt, Homo sapiens
agcaagacauggcuuccaaaug

SEQ ID NO: 312299 - RNA, 22 nt, Homo sapiens
agcacauuaguaucuaagaaca

SEQ ID NO: 312300 - RNA, 22 nt, Homo sapiens
agcaccaugggcugaguaagug

SEQ ID NO: 312301 - RNA, 22 nt, Homo sapiens
agcaccauuagcguugggccgg

SEQ ID NO: 312302 - RNA, 22 nt, Homo sapiens
agcagcauuaugauauaucuua

SEQ ID NO: 312303 - RNA, 22 nt, Homo sapiens
agcagcauuccaaaaaucugcu

SEQ ID NO: 312304 - RNA, 16 nt, Homo sapiens
agcagguguuagguga

SEQ ID NO: 312305 - RNA, 22 nt, Homo sapiens
agcauuaguugugaagccuuua

SEQ ID NO: 312306 - RNA, 22 nt, Homo sapiens
agccaagacucuguuccccuug

SEQ ID NO: 312307 - RNA, 22 nt, Homo sapiens
agcccagagacuguguaaauuu

SEQ ID NO: 312308 - RNA, 22 nt, Homo sapiens
agcgccauugcacuccagccuu

SEQ ID NO: 312309 - RNA, 21 nt, Homo sapiens
agcuccacucguucccaaagc

SEQ ID NO: 312310 - RNA, 22 nt, Homo sapiens
agcuccaucuucagggguucag

SEQ ID NO: 312311 - RNA, 22 nt, Homo sapiens
agcuccaugauaguaugucugu

SEQ ID NO: 312312 - RNA, 22 nt, Homo sapiens
agcugccagucuuguaaggccu

SEQ ID NO: 312313 - RNA, 22 nt, Homo sapiens
agcugguuuauuucucacaaca

SEQ ID NO: 312314 - RNA, 22 nt, Homo sapiens
agcuugugauuuagagugagag

SEQ ID NO: 312315 - RNA, 22 nt, Homo sapiens
agcuuguggugaauacugcuag

SEQ ID NO: 312316 - RNA, 21 nt, Homo sapiens
agcuuguguguaucacagugu

SEQ ID NO: 312317 - RNA, 22 nt, Homo sapiens
agcuuguuuuccugcaacuaga

SEQ ID NO: 312318 - RNA, 22 nt, Homo sapiens
aggaaauguuggucccauuucu

SEQ ID NO: 312319 - RNA, 22 nt, Homo sapiens
aggaagacugaaauugcuguuc

SEQ ID NO: 312320 - RNA, 22 nt, Homo sapiens
aggagcacuggccuuggaguca

SEQ ID NO: 312321 - RNA, 21 nt, Homo sapiens
aggagcauucaugacgagguu

SEQ ID NO: 312322 - RNA, 22 nt, Homo sapiens
aggauacugguaugggcugaau

SEQ ID NO: 312323 - RNA, 22 nt, Homo sapiens
aggauuagagacuucucuaccu

SEQ ID NO: 312324 - RNA, 21 nt, Homo sapiens
aggcaagguguuauuauugaa

SEQ ID NO: 312325 - RNA, 22 nt, Homo sapiens
aggcaaugugagaguuuauuca

SEQ ID NO: 312326 - RNA, 22 nt, Homo sapiens
aggcacggugucucaugccugu

SEQ ID NO: 312327 - RNA, 22 nt, Homo sapiens
aggcauguggcucuguucugac

SEQ ID NO: 312328 - RNA, 20 nt, Homo sapiens
aggcauguugguuugcgugu

SEQ ID NO: 312329 - RNA, 19 nt, Homo sapiens
aggcauugugcucaucugu

SEQ ID NO: 312330 - RNA, 22 nt, Homo sapiens
agggagcaaaguggucuuucuc

SEQ ID NO: 312331 - RNA, 22 nt, Homo sapiens
agggcaguguuaggacugucug

SEQ ID NO: 312332 - RNA, 22 nt, Homo sapiens
agguagcauagcgggaauauca

SEQ ID NO: 312333 - RNA, 22 nt, Homo sapiens
agguauauuggacagauguaaa

SEQ ID NO: 312334 - RNA, 22 nt, Homo sapiens
agguauguaugucuguacagcg

SEQ ID NO: 312335 - RNA, 22 nt, Homo sapiens
aggugguauuuaaaauuauuug

SEQ ID NO: 312336 - RNA, 23 nt, Homo sapiens
agguuaugauuauagagcgagga

SEQ ID NO: 312337 - RNA, 22 nt, Homo sapiens
agguuuucagccccagccuagg

SEQ ID NO: 312338 - RNA, 22 nt, Homo sapiens
aguaacaggauccaaagaaugu

SEQ ID NO: 312339 - RNA, 22 nt, Homo sapiens
agucaaaugcuuauguauaaag

SEQ ID NO: 312340 - RNA, 22 nt, Homo sapiens
agucaagugggguuagauaguu

SEQ ID NO: 312341 - RNA, 22 nt, Homo sapiens
agucagucuguccugugcugag

SEQ ID NO: 312342 - RNA, 22 nt, Homo sapiens
agucagugucuguaaggagaac

SEQ ID NO: 312343 - RNA, 22 nt, Homo sapiens
aguccaguguuaugaucaguag

SEQ ID NO: 312344 - RNA, 23 nt, Homo sapiens
agucuguguuuacaggcucucug

SEQ ID NO: 312345 - RNA, 22 nt, Homo sapiens
agugacuagaauaugaauuuua

SEQ ID NO: 312346 - RNA, 17 nt, Homo sapiens
agugagaucauggcuua

SEQ ID NO: 312347 - RNA, 22 nt, Homo sapiens
agugaucauuugaauugaugau

SEQ ID NO: 312348 - RNA, 22 nt, Homo sapiens
agugcacucuuuccucucuuac

SEQ ID NO: 312349 - RNA, 22 nt, Homo sapiens
agugcaguggcacaaucuuggc

SEQ ID NO: 312350 - RNA, 22 nt, Homo sapiens
agugcaguggugccaucauaac

SEQ ID NO: 312351 - RNA, 22 nt, Homo sapiens
aguggcaaugugauguccugaa

SEQ ID NO: 312352 - RNA, 22 nt, Homo sapiens
aguggcuuuuuaguggcagaug

SEQ ID NO: 312353 - RNA, 19 nt, Homo sapiens
agugucauggucauuauuu

SEQ ID NO: 312354 - RNA, 22 nt, Homo sapiens
aguucaauggguuuucacucau

SEQ ID NO: 312355 - RNA, 22 nt, Homo sapiens
guaaaucucuguuuucauggac

SEQ ID NO: 312356 - RNA, 22 nt, Homo sapiens
guaacguaaugucaaaaucuau

SEQ ID NO: 312357 - RNA, 22 nt, Homo sapiens
guaauacuggacaggguaucag

SEQ ID NO: 312358 - RNA, 22 nt, Homo sapiens
guagcagucacauagcagauug

SEQ ID NO: 312359 - RNA, 22 nt, Homo sapiens
guaguagcacgagcucugucuc

SEQ ID NO: 312360 - RNA, 22 nt, Homo sapiens
guauagaucguagaccaauaaa

SEQ ID NO: 312361 - RNA, 22 nt, Homo sapiens
guauggcacuauccucucugau

SEQ ID NO: 312362 - RNA, 22 nt, Homo sapiens
guauggcauuuguggauuggcc

SEQ ID NO: 312363 - RNA, 22 nt, Homo sapiens
guauuugguuauugcagccuga

SEQ ID NO: 312364 - RNA, 22 nt, Homo sapiens
guauuuguugcagcagcacuau

SEQ ID NO: 312365 - RNA, 22 nt, Homo sapiens
gucacauugaugcccauggugg

SEQ ID NO: 312366 - RNA, 20 nt, Homo sapiens
gucacuggcccagggcuugu

SEQ ID NO: 312367 - RNA, 22 nt, Homo sapiens
gucagcuuguccagagacucug

SEQ ID NO: 312368 - RNA, 22 nt, Homo sapiens
gucagggagucucuaucagugg

SEQ ID NO: 312369 - RNA, 22 nt, Homo sapiens
gucaguggauacugucucuguc

SEQ ID NO: 312370 - RNA, 22 nt, Homo sapiens
gucaugaaguuuugaaugaaau

SEQ ID NO: 312371 - RNA, 22 nt, Homo sapiens
gucauggaaaucuacauuguua

SEQ ID NO: 312372 - RNA, 20 nt, Homo sapiens
guccauuugcugccauugcu

SEQ ID NO: 312373 - RNA, 22 nt, Homo sapiens
gucuggcuccuucuacuacaug

SEQ ID NO: 312374 - RNA, 22 nt, Homo sapiens
gucugguuuuuuauauccucac

SEQ ID NO: 312375 - RNA, 22 nt, Homo sapiens
gucugugcauuaauacgugcug

SEQ ID NO: 312376 - RNA, 22 nt, Homo sapiens
gucuugcacuuaccuaagaacu

SEQ ID NO: 312377 - RNA, 22 nt, Homo sapiens
gucuuugcauguauguucauga

SEQ ID NO: 312378 - RNA, 17 nt, Homo sapiens
gucuuugguugaguuua

SEQ ID NO: 312379 - RNA, 22 nt, Homo sapiens
gugaaagauuaaaccagugugu

SEQ ID NO: 312380 - RNA, 22 nt, Homo sapiens
gugaaguuuuugugaggccuaa

SEQ ID NO: 312381 - RNA, 22 nt, Homo sapiens
gugacacuggagcuggcacaau

SEQ ID NO: 312382 - RNA, 22 nt, Homo sapiens
gugacaguggagacuuacuuca

SEQ ID NO: 312383 - RNA, 22 nt, Homo sapiens
gugaccucuguugcugucacua

SEQ ID NO: 312384 - RNA, 20 nt, Homo sapiens
gugacugagcacgggcacag

SEQ ID NO: 312385 - RNA, 22 nt, Homo sapiens
gugacugggaguggugaagaua

SEQ ID NO: 312386 - RNA, 22 nt, Homo sapiens
gugagaagaaaaauauggcugu

SEQ ID NO: 312387 - RNA, 22 nt, Homo sapiens
gugagaugauggguauguuaau

SEQ ID NO: 312388 - RNA, 22 nt, Homo sapiens
gugaggaaggaaaccugcuagc

SEQ ID NO: 312389 - RNA, 22 nt, Homo sapiens
gugaggcugguccugccuccca

SEQ ID NO: 312390 - RNA, 22 nt, Homo sapiens
gugaggcuuuuccuguuagacu

SEQ ID NO: 312391 - RNA, 21 nt, Homo sapiens
gugaggucauugggcuuucug

SEQ ID NO: 312392 - RNA, 22 nt, Homo sapiens
gugauaucuuacaauucucuuu

SEQ ID NO: 312393 - RNA, 21 nt, Homo sapiens
gugaucaugucacugcacucc

SEQ ID NO: 312394 - RNA, 23 nt, Homo sapiens
gugaucauuguuguggguugaau

SEQ ID NO: 312395 - RNA, 22 nt, Homo sapiens
gugauuauccacgucuuuguga

SEQ ID NO: 312396 - RNA, 22 nt, Homo sapiens
gugauugcauuaugaauauuau

SEQ ID NO: 312397 - RNA, 22 nt, Homo sapiens
gugcaaugagaaggggcucugg

SEQ ID NO: 312398 - RNA, 22 nt, Homo sapiens
gugcaguuugaaaguagaaaca

SEQ ID NO: 312399 - RNA, 22 nt, Homo sapiens
gugccacugcaccuggccuaag

SEQ ID NO: 312400 - RNA, 22 nt, Homo sapiens
gugccuucuagcuaugguuggc

SEQ ID NO: 312401 - RNA, 16 nt, Homo sapiens
gugcuguguuguuagg

SEQ ID NO: 312402 - RNA, 22 nt, Homo sapiens
gugcuuguauuuaaaucaugug

SEQ ID NO: 312403 - RNA, 22 nt, Homo sapiens
guggaaguuaagugacuuucug

SEQ ID NO: 312404 - RNA, 22 nt, Homo sapiens
guggacaugaauuuuggaggca

SEQ ID NO: 312405 - RNA, 22 nt, Homo sapiens
guggcuuuaaguacgauugagg

SEQ ID NO: 312406 - RNA, 22 nt, Homo sapiens
guggguaaaucucuggggcucu

SEQ ID NO: 312407 - RNA, 22 nt, Homo sapiens
gugguauaaguaccuccuuuca

SEQ ID NO: 312408 - RNA, 22 nt, Homo sapiens
gugguuguuggaguggcaauuu

SEQ ID NO: 312409 - RNA, 22 nt, Homo sapiens
gugucacuguugagaaguccac

SEQ ID NO: 312410 - RNA, 22 nt, Homo sapiens
gugucaugagggggacaggaag

SEQ ID NO: 312411 - RNA, 18 nt, Homo sapiens
gugucugguuaugggagu

SEQ ID NO: 312412 - RNA, 22 nt, Homo sapiens
gugugauggcgcacacagggug

SEQ ID NO: 312413 - RNA, 22 nt, Homo sapiens
gugugcaauuuugugggaggca

SEQ ID NO: 312414 - RNA, 22 nt, Homo sapiens
gugugcauggagggggcaguga

SEQ ID NO: 312415 - RNA, 22 nt, Homo sapiens
guguggaacucaauacaacgca

SEQ ID NO: 312416 - RNA, 22 nt, Homo sapiens
guguggcaggugggggcucaga

SEQ ID NO: 312417 - RNA, 22 nt, Homo sapiens
gugugguauuauaacuagguau

SEQ ID NO: 312418 - RNA, 22 nt, Homo sapiens
gugugucuugaccaggaucgga

SEQ ID NO: 312419 - RNA, 22 nt, Homo sapiens
guuaagaaguguaacuuaaguu

SEQ ID NO: 312420 - RNA, 22 nt, Homo sapiens
guuaaugcuggaauaaguuaag

SEQ ID NO: 312421 - RNA, 22 nt, Homo sapiens
guuacugucuuccugauugcuu

SEQ ID NO: 312422 - RNA, 22 nt, Homo sapiens
guuauguuauguuauguuaugu

SEQ ID NO: 312423 - RNA, 22 nt, Homo sapiens
guucacacuugcaaccccagca

SEQ ID NO: 312424 - RNA, 22 nt, Homo sapiens
guucagcaggggcuucaauggu

SEQ ID NO: 312425 - RNA, 20 nt, Homo sapiens
guucauguaauuaguucagg

SEQ ID NO: 312426 - RNA, 22 nt, Homo sapiens
guucucacuggugcugguaagu

SEQ ID NO: 312427 - RNA, 22 nt, Homo sapiens
guuggaauuaaaaggcaaguau

SEQ ID NO: 312428 - RNA, 22 nt, Homo sapiens
guuuaggaaugagaauauuuag

SEQ ID NO: 312429 - RNA, 17 nt, Homo sapiens
guuuggguacuggguaa

SEQ ID NO: 312430 - RNA, 15 nt, Homo sapiens
guuuuuggauacaau

SEQ ID NO: 312431 - RNA, 22 nt, Homo sapiens
uaaacacucacuucauagccau

SEQ ID NO: 312432 - RNA, 22 nt, Homo sapiens
uaaagauaaggcucgcuuggau

SEQ ID NO: 312433 - RNA, 22 nt, Homo sapiens
uaaagcacaaguaaagaauacu

SEQ ID NO: 312434 - RNA, 22 nt, Homo sapiens
uaaagcuaugagaacaccguag

SEQ ID NO: 312435 - RNA, 22 nt, Homo sapiens
uaaagcuauuauaguuauguuu

SEQ ID NO: 312436 - RNA, 22 nt, Homo sapiens
uaaaguuauugccccucaguua

SEQ ID NO: 312437 - RNA, 22 nt, Homo sapiens
uaacaacauucuaacugacggc

SEQ ID NO: 312438 - RNA, 22 nt, Homo sapiens
uaacaagagagucagucagucc

SEQ ID NO: 312439 - RNA, 22 nt, Homo sapiens
uaacaccuugcucugucaauaa

SEQ ID NO: 312440 - RNA, 22 nt, Homo sapiens
uaacccugaggggcuuggggac

SEQ ID NO: 312441 - RNA, 22 nt, Homo sapiens
uaacuauagagaauguugagua

SEQ ID NO: 312442 - RNA, 22 nt, Homo sapiens
uaacugcaaccucugccugcug

SEQ ID NO: 312443 - RNA, 22 nt, Homo sapiens
acagugcuucugauaugaugcc

SEQ ID NO: 312444 - RNA, 22 nt, Homo sapiens
acagugcuuucaauguucagua

SEQ ID NO: 312445 - RNA, 17 nt, Homo sapiens
acagugcuuugcuuucc

SEQ ID NO: 312446 - RNA, 22 nt, Homo sapiens
acaguggaauguaggguuugag

SEQ ID NO: 312447 - RNA, 22 nt, Homo sapiens
acaguguagugacugccaacuu

SEQ ID NO: 312448 - RNA, 22 nt, Homo sapiens
acaucacuguuugauugauuga

SEQ ID NO: 312449 - RNA, 22 nt, Homo sapiens
uaaggaaggcugugugcuuuua

SEQ ID NO: 312450 - RNA, 22 nt, Homo sapiens
uaaggaguagaauaguaaggca

SEQ ID NO: 312451 - RNA, 22 nt, Homo sapiens
uaaggcauuuuuuugaguugca

SEQ ID NO: 312452 - RNA, 22 nt, Homo sapiens
uaaggcuucuuggaauacugca

SEQ ID NO: 312453 - RNA, 22 nt, Homo sapiens
uaaggcuugaucuuggugagau

SEQ ID NO: 312454 - RNA, 22 nt, Homo sapiens
uaaggcuuugcuggacucaguc

SEQ ID NO: 312455 - RNA, 22 nt, Homo sapiens
uaaguauagguaacagaagcaa

SEQ ID NO: 312456 - RNA, 22 nt, Homo sapiens
uaagugaugucuuuuugugugc

SEQ ID NO: 312457 - RNA, 22 nt, Homo sapiens
uaagugcaacauaaguguuaaa

SEQ ID NO: 312458 - RNA, 22 nt, Homo sapiens
uaagugcuguguuguuaccuaa

SEQ ID NO: 312459 - RNA, 22 nt, Homo sapiens
uaagugcuugacuuugauguuu

SEQ ID NO: 312460 - RNA, 18 nt, Homo sapiens
uaagugcuuuaaacacau

SEQ ID NO: 312461 - RNA, 22 nt, Homo sapiens
uaaguucauucaugaaacuuag

SEQ ID NO: 312462 - RNA, 20 nt, Homo sapiens
uaaguuguauuugucaugaa

SEQ ID NO: 312463 - RNA, 22 nt, Homo sapiens
uaauacuugucauaaaggcauu

SEQ ID NO: 312464 - RNA, 22 nt, Homo sapiens
uaauauguauacagacagauac

SEQ ID NO: 312465 - RNA, 22 nt, Homo sapiens
ucacugugugucucuguaucug

SEQ ID NO: 312466 - RNA, 22 nt, Homo sapiens
ucacuuuggguacuauggaaau

SEQ ID NO: 312467 - RNA, 22 nt, Homo sapiens
ucagauguuuuguuuaucugcu

SEQ ID NO: 312468 - RNA, 22 nt, Homo sapiens
ucagauuggugcaaaaguaauu

SEQ ID NO: 312469 - RNA, 22 nt, Homo sapiens
ucagcacauucaaggccugccu

SEQ ID NO: 312470 - RNA, 22 nt, Homo sapiens
ucagcaucacaggcagugagug

SEQ ID NO: 312471 - RNA, 21 nt, Homo sapiens
ucaggaccucuaguuagccag

SEQ ID NO: 312472 - RNA, 22 nt, Homo sapiens
ucagggacuuacaaaccagaag

SEQ ID NO: 312473 - RNA, 22 nt, Homo sapiens
ucagguaaucuauuugucuuuu

SEQ ID NO: 312474 - RNA, 21 nt, Homo sapiens
ucagugcaauucuauggggaa

SEQ ID NO: 312475 - RNA, 20 nt, Homo sapiens
ucagugcagauuguccaagu

SEQ ID NO: 312476 - RNA, 22 nt, Homo sapiens
ucagugcaggaauuuccuuaga

SEQ ID NO: 312477 - RNA, 17 nt, Homo sapiens
ucagugcauuuaagaga

SEQ ID NO: 312478 - RNA, 22 nt, Homo sapiens
ucagugccauugccauaugagu

SEQ ID NO: 312479 - RNA, 22 nt, Homo sapiens
ucagugcuguaccaucuaagga

SEQ ID NO: 312480 - RNA, 22 nt, Homo sapiens
ucagugcuuggcacagagagcu

SEQ ID NO: 312481 - RNA, 22 nt, Homo sapiens
ucaguggacuuagucuuucccc

SEQ ID NO: 312482 - RNA, 22 nt, Homo sapiens
ucaguggagccucacucugugg

SEQ ID NO: 312483 - RNA, 22 nt, Homo sapiens
ucaguggauuauuaaagucacc

SEQ ID NO: 312484 - RNA, 22 nt, Homo sapiens
ucauacuguugugaaacaaaac

SEQ ID NO: 312485 - RNA, 22 nt, Homo sapiens
ucauaugucauaguaugaucuu

SEQ ID NO: 312486 - RNA, 23 nt, Homo sapiens
ucaucacagcauuuccugguauu

SEQ ID NO: 312487 - RNA, 22 nt, Homo sapiens
ucaucagaguuuacaagcucag

SEQ ID NO: 312488 - RNA, 22 nt, Homo sapiens
ucaucaggaaacuuaugcagug

SEQ ID NO: 312489 - RNA, 22 nt, Homo sapiens
ucaugaaguaguuaacugguug

SEQ ID NO: 312490 - RNA, 22 nt, Homo sapiens
ucauggggugcuuugcuagauu

SEQ ID NO: 312491 - RNA, 22 nt, Homo sapiens
ucauguaauuuugugucuauga

SEQ ID NO: 312492 - RNA, 22 nt, Homo sapiens
ucaugugaggauaacaauagug

SEQ ID NO: 312493 - RNA, 22 nt, Homo sapiens
ucauuagagaucuuggggaaaa

SEQ ID NO: 312494 - RNA, 22 nt, Homo sapiens
ucauucauuugcucacuccaca

SEQ ID NO: 312495 - RNA, 18 nt, Homo sapiens
ucauuggugagcaccucc

SEQ ID NO: 312496 - RNA, 21 nt, Homo sapiens
ucauugguuggcugcccugua

SEQ ID NO: 312497 - RNA, 22 nt, Homo sapiens
uccaagaugcuggcagcuacag

SEQ ID NO: 312498 - RNA, 22 nt, Homo sapiens
uccacaguaaggacccugccuu

SEQ ID NO: 312499 - RNA, 22 nt, Homo sapiens
uccacagugguggaauuguuca

SEQ ID NO: 312500 - RNA, 22 nt, Homo sapiens
uccacagugguugaacuaguaa

SEQ ID NO: 312501 - RNA, 22 nt, Homo sapiens
uccacugagcuagaccacuugg

SEQ ID NO: 312502 - RNA, 22 nt, Homo sapiens
uccaguggacagacauaccaug

SEQ ID NO: 312503 - RNA, 22 nt, Homo sapiens
uccaguguuauaauaugcgucu

SEQ ID NO: 312504 - RNA, 22 nt, Homo sapiens
uccaguguuucuuccacuauuu

SEQ ID NO: 312505 - RNA, 22 nt, Homo sapiens
uccauggagacacauuuuauau

SEQ ID NO: 312506 - RNA, 22 nt, Homo sapiens
uccauguagaugcuauguuguc

SEQ ID NO: 312507 - RNA, 18 nt, Homo sapiens
uccauuuguaugggaugg

SEQ ID NO: 312508 - RNA, 19 nt, Homo sapiens
ucccaagaugcucauacau

SEQ ID NO: 312509 - RNA, 16 nt, Homo sapiens
ucccaccauugcuugu

SEQ ID NO: 312510 - RNA, 22 nt, Homo sapiens
ucccacugucuucucgugcucg

SEQ ID NO: 312511 - RNA, 18 nt, Homo sapiens
ucccucagaauuauagaa

SEQ ID NO: 312512 - RNA, 22 nt, Homo sapiens
ucccuugagccuggcuucucac

SEQ ID NO: 312513 - RNA, 22 nt, Homo sapiens
uccugcauucauccugguguug

SEQ ID NO: 312514 - RNA, 22 nt, Homo sapiens
uccugcauucugaaauacaagu

SEQ ID NO: 312515 - RNA, 22 nt, Homo sapiens
uccuguaaucccagcuaccaga

SEQ ID NO: 312516 - RNA, 22 nt, Homo sapiens
uccuugcacuaacuuaaggagg

SEQ ID NO: 312517 - RNA, 22 nt, Homo sapiens
uccuuggugacauuucuugucu

SEQ ID NO: 312518 - RNA, 22 nt, Homo sapiens
uccuuuggguagcuguucagau

SEQ ID NO: 312519 - RNA, 20 nt, Homo sapiens
ucgcaccacuauacuccagc

SEQ ID NO: 312520 - RNA, 22 nt, Homo sapiens
ucgcugggaaccagagguaaag

SEQ ID NO: 312521 - RNA, 22 nt, Homo sapiens
ucggcucagugcaagcucugcc

SEQ ID NO: 312522 - RNA, 22 nt, Homo sapiens
ucuaaaacuagauugugaugau

SEQ ID NO: 312523 - RNA, 22 nt, Homo sapiens
ucuaauguaaccugcaaauauu

SEQ ID NO: 312524 - RNA, 22 nt, Homo sapiens
ucucacaggguuauugaggggg

SEQ ID NO: 312525 - RNA, 22 nt, Homo sapiens
ucucaguggcuuccucacuuuu

SEQ ID NO: 312526 - RNA, 21 nt, Homo sapiens
ucucauagaguuucacuuucu

SEQ ID NO: 312527 - RNA, 22 nt, Homo sapiens
ucucauggagucaggagcagaa

SEQ ID NO: 312528 - RNA, 21 nt, Homo sapiens
ucucauuacugaugagccaga

SEQ ID NO: 312529 - RNA, 22 nt, Homo sapiens
ucuccauuuguaaggguuucuc

SEQ ID NO: 312530 - RNA, 22 nt, Homo sapiens
ucucccauccaugaacuucugu

SEQ ID NO: 312531 - RNA, 22 nt, Homo sapiens
ucucugauuauugcauuucauu

SEQ ID NO: 312532 - RNA, 22 nt, Homo sapiens
ucucuuggcggaaguugcagug

SEQ ID NO: 312533 - RNA, 22 nt, Homo sapiens
ucugaaucguucccaugcagga

SEQ ID NO: 312534 - RNA, 19 nt, Homo sapiens
ucugacagccccagucaac

SEQ ID NO: 312535 - RNA, 22 nt, Homo sapiens
ucugacuagacaagcaguguac

SEQ ID NO: 312536 - RNA, 22 nt, Homo sapiens
ucugagacuguuucuaacaagc

SEQ ID NO: 312537 - RNA, 22 nt, Homo sapiens
ucugagcaauagauguggauau

SEQ ID NO: 312538 - RNA, 22 nt, Homo sapiens
ucugagguaggugcauggauac

SEQ ID NO: 312539 - RNA, 22 nt, Homo sapiens
ucugcaagucuaaacuagccau

SEQ ID NO: 312540 - RNA, 22 nt, Homo sapiens
ucugccacugucauugugugau

SEQ ID NO: 312541 - RNA, 22 nt, Homo sapiens
ucugccuacugagcacacagug

SEQ ID NO: 312542 - RNA, 21 nt, Homo sapiens
ucuggcccccucaaaucucau

SEQ ID NO: 312543 - RNA, 20 nt, Homo sapiens
ucuggccccuccaaaucuca

SEQ ID NO: 312544 - RNA, 21 nt, Homo sapiens
ucuggccccuccaaaucucau

SEQ ID NO: 312545 - RNA, 22 nt, Homo sapiens
ucuggccuacaucauuuuuccg

SEQ ID NO: 312546 - RNA, 17 nt, Homo sapiens
ucuggcuuucacaccug

SEQ ID NO: 312547 - RNA, 22 nt, Homo sapiens
ucugggguuuccacuuuuacuu

SEQ ID NO: 312548 - RNA, 22 nt, Homo sapiens
ucugguggugaugagagacagu

SEQ ID NO: 312549 - RNA, 22 nt, Homo sapiens
ugaacagcuaucuugucagugu

SEQ ID NO: 312550 - RNA, 22 nt, Homo sapiens
ugaagaucuuaggagcugaggg

SEQ ID NO: 312551 - RNA, 22 nt, Homo sapiens
ugaaguaauguuuuauucuauu

SEQ ID NO: 312552 - RNA, 19 nt, Homo sapiens
ugaaguauagggcuucuga

SEQ ID NO: 312553 - RNA, 22 nt, Homo sapiens
ugaagugaagacucacagaagg

SEQ ID NO: 312554 - RNA, 22 nt, Homo sapiens
ugaagugaaugguaaguaugcc

SEQ ID NO: 312555 - RNA, 22 nt, Homo sapiens
ugaagugcugugggccaggcgu

SEQ ID NO: 312556 - RNA, 22 nt, Homo sapiens
ugaauauguuaaauaauguucu

SEQ ID NO: 312557 - RNA, 22 nt, Homo sapiens
ugaaucauuucuugucuucagu

SEQ ID NO: 312558 - RNA, 22 nt, Homo sapiens
ugaaugcauggggccaagaagg

SEQ ID NO: 312559 - RNA, 18 nt, Homo sapiens
ugacaaugcuaguccugg

SEQ ID NO: 312560 - RNA, 22 nt, Homo sapiens
ugacagagaagcauugaguuca

SEQ ID NO: 312561 - RNA, 22 nt, Homo sapiens
ugacagguugauaggugcagca

SEQ ID NO: 312562 - RNA, 22 nt, Homo sapiens
ugacagugaacagguuaccacu

SEQ ID NO: 312563 - RNA, 22 nt, Homo sapiens
ugacaguguccuccuccugaga

SEQ ID NO: 312564 - RNA, 22 nt, Homo sapiens
ugacaugauguuccuacacugu

SEQ ID NO: 312565 - RNA, 22 nt, Homo sapiens
ugacauguagagaacuucucau

SEQ ID NO: 312566 - RNA, 21 nt, Homo sapiens
ugacauuauuucaugucagua

SEQ ID NO: 312567 - RNA, 22 nt, Homo sapiens
ugacuaagaugaggucuggaua

SEQ ID NO: 312568 - RNA, 22 nt, Homo sapiens
ugacuacacacaauuugucaag

SEQ ID NO: 312569 - RNA, 22 nt, Homo sapiens
ugacuaggaggcuggaggauga

SEQ ID NO: 312570 - RNA, 22 nt, Homo sapiens
ugagaacaugugauauuuggug

SEQ ID NO: 312571 - RNA, 19 nt, Homo sapiens
ugagaacaugugguauuug

SEQ ID NO: 312572 - RNA, 18 nt, Homo sapiens
ugagaacauguguacaca

SEQ ID NO: 312573 - RNA, 22 nt, Homo sapiens
ugagaccaacagauuccaguuc

SEQ ID NO: 312574 - RNA, 22 nt, Homo sapiens
ugagagcuuugaugcacuguuu

SEQ ID NO: 312575 - RNA, 21 nt, Homo sapiens
ugagaguaguguauuauucuc

SEQ ID NO: 312576 - RNA, 19 nt, Homo sapiens
ugagauccacugaagauuc

SEQ ID NO: 312577 - RNA, 22 nt, Homo sapiens
ugagaucuuaccuuccugccuu

SEQ ID NO: 312578 - RNA, 22 nt, Homo sapiens
ugagaucuuggaggcuuuguga

SEQ ID NO: 312579 - RNA, 22 nt, Homo sapiens
ugagaucuuugcuguccucacc

SEQ ID NO: 312580 - RNA, 22 nt, Homo sapiens
ugagaugagggaagccuaggca

SEQ ID NO: 312581 - RNA, 22 nt, Homo sapiens
ugagaugcaaaaugagaauugu

SEQ ID NO: 312582 - RNA, 21 nt, Homo sapiens
ugagaugcaaucaccagggag

SEQ ID NO: 312583 - RNA, 23 nt, Homo sapiens
ugagauuauaaucuuuuacuucu

SEQ ID NO: 312584 - RNA, 22 nt, Homo sapiens
ugagauuguaucugcaaugugu

SEQ ID NO: 312585 - RNA, 22 nt, Homo sapiens
ugagauuguuagaucaaauggu

SEQ ID NO: 312586 - RNA, 22 nt, Homo sapiens
ugagcacaggugcgcgguuacu

SEQ ID NO: 312587 - RNA, 22 nt, Homo sapiens
ugagcuaagugccaauauuaau

SEQ ID NO: 312588 - RNA, 22 nt, Homo sapiens
ugagcuaggauccugucacugu

SEQ ID NO: 312589 - RNA, 22 nt, Homo sapiens
ugagcucaguauuucauaaaca

SEQ ID NO: 312590 - RNA, 20 nt, Homo sapiens
ugagcucaugacauuuuucu

SEQ ID NO: 312591 - RNA, 22 nt, Homo sapiens
ugagcugagaaaugcagcagcu

SEQ ID NO: 312592 - RNA, 22 nt, Homo sapiens
ugagcugagauuaagcugcugc

SEQ ID NO: 312593 - RNA, 22 nt, Homo sapiens
ugagcugguacuaauauuauca

SEQ ID NO: 312594 - RNA, 20 nt, Homo sapiens
ugagcuuguaaacacuguuu

SEQ ID NO: 312595 - RNA, 22 nt, Homo sapiens
ugaggacugagaggcacugugg

SEQ ID NO: 312596 - RNA, 22 nt, Homo sapiens
ugaggaguauguucuguagacc

SEQ ID NO: 312597 - RNA, 22 nt, Homo sapiens
ugaggagugaacuauuucugau

SEQ ID NO: 312598 - RNA, 22 nt, Homo sapiens
ugaggagugagaaauugguuuc

SEQ ID NO: 312599 - RNA, 22 nt, Homo sapiens
ugagggaugccugguuuguuuu

SEQ ID NO: 312600 - RNA, 22 nt, Homo sapiens
ugagggaugcguacccuaugcc

SEQ ID NO: 312601 - RNA, 22 nt, Homo sapiens
ugaggucauguucugucagguu

SEQ ID NO: 312602 - RNA, 22 nt, Homo sapiens
ugaggugcagcaauccucaugu

SEQ ID NO: 312603 - RNA, 22 nt, Homo sapiens
ugagguuauuuguucaagaagu

SEQ ID NO: 312604 - RNA, 22 nt, Homo sapiens
ugagguugaaggacauuuuuau

SEQ ID NO: 312605 - RNA, 22 nt, Homo sapiens
ugagguuggggucagggcuagc

SEQ ID NO: 312606 - RNA, 22 nt, Homo sapiens
ugaguauguuuaaugugacaau

SEQ ID NO: 312607 - RNA, 22 nt, Homo sapiens
ugagucaugcuggagucauggc

SEQ ID NO: 312608 - RNA, 22 nt, Homo sapiens
ugagugaaugugaaggcuaggg

SEQ ID NO: 312609 - RNA, 22 nt, Homo sapiens
ugagugaggcugggcagucccu

SEQ ID NO: 312610 - RNA, 22 nt, Homo sapiens
ugaguuauuaguagaggcuaug

SEQ ID NO: 312611 - RNA, 22 nt, Homo sapiens
ugaguucauggucauuugucac

SEQ ID NO: 312612 - RNA, 23 nt, Homo sapiens
ugauaacagcauaugaagauucu

SEQ ID NO: 312613 - RNA, 22 nt, Homo sapiens
ugauaacauuucuucugguaca

SEQ ID NO: 312614 - RNA, 22 nt, Homo sapiens
ugauagugccuuuuauaucucu

SEQ ID NO: 312615 - RNA, 22 nt, Homo sapiens
ugauauggcuuggcuaugucac

SEQ ID NO: 312616 - RNA, 22 nt, Homo sapiens
ugauaugugaguauaugguuau

SEQ ID NO: 312617 - RNA, 20 nt, Homo sapiens
ugaugcaaaucuuuaaaagu

SEQ ID NO: 312618 - RNA, 22 nt, Homo sapiens
ugaugcugaugccugccagaag

SEQ ID NO: 312619 - RNA, 23 nt, Homo sapiens
ugauguccacuuagggucuaggu

SEQ ID NO: 312620 - RNA, 22 nt, Homo sapiens
ugauuggagaacaaacugcaua

SEQ ID NO: 312621 - RNA, 22 nt, Homo sapiens
ugauuuccaugagaacaugccu

SEQ ID NO: 312622 - RNA, 22 nt, Homo sapiens
ugauuugucugcaggaauagug

SEQ ID NO: 312623 - RNA, 22 nt, Homo sapiens
ugcaagacuaaaccuuccccuc

SEQ ID NO: 312624 - RNA, 22 nt, Homo sapiens
ugcaagaugauuucaauugaua

SEQ ID NO: 312625 - RNA, 22 nt, Homo sapiens
ugcagagaaacauuuuguauuu

SEQ ID NO: 312626 - RNA, 22 nt, Homo sapiens
ugcagugcaugacuguguuaug

SEQ ID NO: 312627 - RNA, 19 nt, Homo sapiens
ugcauaggguuacauacuc

SEQ ID NO: 312628 - RNA, 22 nt, Homo sapiens
ugcauggucauacauggcaccc

SEQ ID NO: 312629 - RNA, 21 nt, Homo sapiens
ugcauugucuugaguuuaaau

SEQ ID NO: 312630 - RNA, 22 nt, Homo sapiens
uugcuuagucaugaaucacuga

SEQ ID NO: 312631 - RNA, 22 nt, Homo sapiens
uuggaaaaauccaccuugaucu

SEQ ID NO: 312632 - RNA, 22 nt, Homo sapiens
uuggaaacauuuaugguaacag

SEQ ID NO: 312633 - RNA, 22 nt, Homo sapiens
uuggaaacgucaccuuuuccuu

SEQ ID NO: 312634 - RNA, 22 nt, Homo sapiens
uuggaaagagguguuuaugacu

SEQ ID NO: 312635 - RNA, 22 nt, Homo sapiens
uuggaaguguguauguauagcu

SEQ ID NO: 312636 - RNA, 22 nt, Homo sapiens
uuggaauuagacaagugguggu

SEQ ID NO: 312637 - RNA, 22 nt, Homo sapiens
uuggaccacuugauuucugguc

SEQ ID NO: 312638 - RNA, 22 nt, Homo sapiens
uuggaugauaaagaagccuaag

SEQ ID NO: 312639 - RNA, 22 nt, Homo sapiens
uuggcacugagcaagaacaggg

SEQ ID NO: 312640 - RNA, 22 nt, Homo sapiens
uuggccauggagcacuuuucua

SEQ ID NO: 312641 - RNA, 23 nt, Homo sapiens
uuggccuccuugugucuagggcu

SEQ ID NO: 312642 - RNA, 22 nt, Homo sapiens
uuggcuuuuaugcagcuuaggu

SEQ ID NO: 312643 - RNA, 22 nt, Homo sapiens
uugggcaauaggaagcaggugg

SEQ ID NO: 312644 - RNA, 22 nt, Homo sapiens
uugggguagaauugcaacauau

SEQ ID NO: 312645 - RNA, 22 nt, Homo sapiens
uugggguaggaauauggaauga

SEQ ID NO: 312646 - RNA, 22 nt, Homo sapiens
uuguaaacaucuguacauugcu

SEQ ID NO: 312647 - RNA, 22 nt, Homo sapiens
uuguacaggaguguaagcuuca

SEQ ID NO: 312648 - RNA, 22 nt, Homo sapiens
uuguccucuccaaaucucaugu

SEQ ID NO: 312649 - RNA, 22 nt, Homo sapiens
uugugaagaaaccagaaaaguu

SEQ ID NO: 312650 - RNA, 22 nt, Homo sapiens
uugugaagaugugaagcaagca

SEQ ID NO: 312651 - RNA, 22 nt, Homo sapiens
uuguuaugggguggcuugaaag

SEQ ID NO: 312652 - RNA, 22 nt, Homo sapiens
uuguuauguaucucaagauaaa

SEQ ID NO: 312653 - RNA, 22 nt, Homo sapiens
uuguuauguuggucaguaaugu

SEQ ID NO: 312654 - RNA, 22 nt, Homo sapiens
uuguucccuucuggcuuuuaug

SEQ ID NO: 312655 - RNA, 22 nt, Homo sapiens
guauuugauuauagcaugcuua

SEQ ID NO: 312656 - RNA, 22 nt, Homo sapiens
guauuuggugaugccuccaaac

SEQ ID NO: 312657 - RNA, 22 nt, Homo sapiens
guauuuuguuagggugugguau

SEQ ID NO: 312658 - RNA, 22 nt, Homo sapiens
gucaacauauuaauuauguucu

SEQ ID NO: 312659 - RNA, 22 nt, Homo sapiens
gucagaugcagauuccaguucu

SEQ ID NO: 312660 - RNA, 22 nt, Homo sapiens
gucagcaaaguucuccugcaga

SEQ ID NO: 312661 - RNA, 22 nt, Homo sapiens
gucaguuugguuaaucauucca

SEQ ID NO: 312662 - RNA, 18 nt, Homo sapiens
gucauagaaugaugguuc

SEQ ID NO: 312663 - RNA, 22 nt, Homo sapiens
gucauauaggguuuaccuguau

SEQ ID NO: 312664 - RNA, 21 nt, Homo sapiens
guccaaaacaguguccaaugc

SEQ ID NO: 312665 - RNA, 22 nt, Homo sapiens
guccugaagaccuuccucugga

SEQ ID NO: 312666 - RNA, 22 nt, Homo sapiens
gucucuugguuuagagcauuua

SEQ ID NO: 312667 - RNA, 22 nt, Homo sapiens
gucugcaugucauaugauagua

SEQ ID NO: 312668 - RNA, 22 nt, Homo sapiens
gucuggcuccugucuaaucacu

SEQ ID NO: 312669 - RNA, 22 nt, Homo sapiens
gucuggcuuaucucacuuacca

SEQ ID NO: 312670 - RNA, 22 nt, Homo sapiens
gucuuggcaugugcagcuggga

SEQ ID NO: 312671 - RNA, 22 nt, Homo sapiens
gugaaagacauauaugguuuga

SEQ ID NO: 312672 - RNA, 22 nt, Homo sapiens
gugacauuuuuacugaugagag

SEQ ID NO: 312673 - RNA, 22 nt, Homo sapiens
gugacgucauuguuccuggcuc

SEQ ID NO: 312674 - RNA, 22 nt, Homo sapiens
gugagcacugaaagaaggcaag

SEQ ID NO: 312675 - RNA, 22 nt, Homo sapiens
gugagcuccucuucugcugcag

SEQ ID NO: 312676 - RNA, 22 nt, Homo sapiens
gugaucaugauccugaagcauu

SEQ ID NO: 312677 - RNA, 22 nt, Homo sapiens
gugaugacauucagagaugaag

SEQ ID NO: 312678 - RNA, 22 nt, Homo sapiens
gugauguguuuguucuaucucu

SEQ ID NO: 312679 - RNA, 22 nt, Homo sapiens
gugcaguuuugagugaguuucu

SEQ ID NO: 312680 - RNA, 22 nt, Homo sapiens
gugcaugcaucuuuauaguagc

SEQ ID NO: 312681 - RNA, 22 nt, Homo sapiens
gugcauguccacuaguccauau

SEQ ID NO: 312682 - RNA, 22 nt, Homo sapiens
gugccacugcacuccggccugg

SEQ ID NO: 312683 - RNA, 23 nt, Homo sapiens
gugccuucugagccuagucucca

SEQ ID NO: 312684 - RNA, 22 nt, Homo sapiens
gugcucauuuagagagaagcac

SEQ ID NO: 312685 - RNA, 22 nt, Homo sapiens
guggaagucuuugguauuggua

SEQ ID NO: 312686 - RNA, 22 nt, Homo sapiens
guggaagugucuggggccaggg

SEQ ID NO: 312687 - RNA, 22 nt, Homo sapiens
guggagacaaaggcugagugag

SEQ ID NO: 312688 - RNA, 22 nt, Homo sapiens
guggcaaacucagcaugcccca

SEQ ID NO: 312689 - RNA, 22 nt, Homo sapiens
guggcagagucagagggaaaug

SEQ ID NO: 312690 - RNA, 22 nt, Homo sapiens
gugggaagcuggaacucccucc

SEQ ID NO: 312691 - RNA, 22 nt, Homo sapiens
gugggguaggguaggacucaac

SEQ ID NO: 312692 - RNA, 22 nt, Homo sapiens
guggggucaucucauuugugga

SEQ ID NO: 312693 - RNA, 22 nt, Homo sapiens
guguaaguccugaguuuggaua

SEQ ID NO: 312694 - RNA, 22 nt, Homo sapiens
guguagagaaauagccugaagg

SEQ ID NO: 312695 - RNA, 22 nt, Homo sapiens
guguaugguaggaugacggagu

SEQ ID NO: 312696 - RNA, 22 nt, Homo sapiens
gugugcaacuuucauuaauauu

SEQ ID NO: 312697 - RNA, 22 nt, Homo sapiens
gugugcacaaucuggcaugugc

SEQ ID NO: 312698 - RNA, 22 nt, Homo sapiens
guuaggcagugugguauagcag

SEQ ID NO: 312699 - RNA, 22 nt, Homo sapiens
guuauugcucucgaagacucuc

SEQ ID NO: 312700 - RNA, 22 nt, Homo sapiens
guuauuguccauuuauuuagca

SEQ ID NO: 312701 - RNA, 22 nt, Homo sapiens
guucaagcaauucugcugccuc

SEQ ID NO: 312702 - RNA, 22 nt, Homo sapiens
guucagguauucuggaacagag

SEQ ID NO: 312703 - RNA, 22 nt, Homo sapiens
guucaguuugcugaugcguuga

SEQ ID NO: 312704 - RNA, 22 nt, Homo sapiens
guuugcagaucaugaagaaccc

SEQ ID NO: 312705 - RNA, 22 nt, Homo sapiens
uaaagcuagaauuguuccagca

SEQ ID NO: 312706 - RNA, 22 nt, Homo sapiens
uaaagcuaucacauuggugauu

SEQ ID NO: 312707 - RNA, 22 nt, Homo sapiens
uaaagcuuagauccaugguggc

SEQ ID NO: 312708 - RNA, 21 nt, Homo sapiens
uaaagcuuagcuauaguggcu

SEQ ID NO: 312709 - RNA, 22 nt, Homo sapiens
uaaaugcucuuuaaaagugcuu

SEQ ID NO: 312710 - RNA, 22 nt, Homo sapiens
uaacaguggucugugguaucug

SEQ ID NO: 312711 - RNA, 22 nt, Homo sapiens
uaacaguguauuccuuuggaca

SEQ ID NO: 312712 - RNA, 22 nt, Homo sapiens
uaacauucacaugcugcaaaaa

SEQ ID NO: 312713 - RNA, 18 nt, Homo sapiens
uaacuggugugagauggu

SEQ ID NO: 312714 - RNA, 22 nt, Homo sapiens
uaagacacauguguucccaggc

SEQ ID NO: 312715 - RNA, 22 nt, Homo sapiens
uaagagcuaggauuuuaaauca

SEQ ID NO: 312716 - RNA, 19 nt, Homo sapiens
uaagaugaagcugucuggg

SEQ ID NO: 312717 - RNA, 21 nt, Homo sapiens
uaagcuaaacauucaguuaac

SEQ ID NO: 312718 - RNA, 22 nt, Homo sapiens
uaaggcucuuguuauuuugagg

SEQ ID NO: 312719 - RNA, 22 nt, Homo sapiens
uaagggcaugcugcaugagagu

SEQ ID NO: 312720 - RNA, 22 nt, Homo sapiens
uaaguaguguugagacaaguuu

SEQ ID NO: 312721 - RNA, 22 nt, Homo sapiens
uaagugaaggaaguguguuuac

SEQ ID NO: 312722 - RNA, 20 nt, Homo sapiens
uaagugcuugaugaaugaac

SEQ ID NO: 312723 - RNA, 22 nt, Homo sapiens
uaaguggaagaugucaaucaua

SEQ ID NO: 312724 - RNA, 22 nt, Homo sapiens
uaauacauucaaggugguaguu

SEQ ID NO: 312725 - RNA, 22 nt, Homo sapiens
uaauagcucggauaaacaugau

SEQ ID NO: 312726 - RNA, 19 nt, Homo sapiens
uaaugccacugccuggcau

SEQ ID NO: 312727 - RNA, 22 nt, Homo sapiens
uaauucuguauguaucagaguu

SEQ ID NO: 312728 - RNA, 22 nt, Homo sapiens
uaauugcaguucuguguuauau

SEQ ID NO: 312729 - RNA, 22 nt, Homo sapiens
uacaaguaauaagggaagaauu

SEQ ID NO: 312730 - RNA, 20 nt, Homo sapiens
uacacguguagcauucucua

SEQ ID NO: 312731 - RNA, 22 nt, Homo sapiens
uacagaauugcagguguggcag

SEQ ID NO: 312732 - RNA, 22 nt, Homo sapiens
uacagccacauaauguaugauu

SEQ ID NO: 312733 - RNA, 23 nt, Homo sapiens
uacagcugcagaaucaggcuaag

SEQ ID NO: 312734 - RNA, 19 nt, Homo sapiens
uacaggacugagcugaggu

SEQ ID NO: 312735 - RNA, 22 nt, Homo sapiens
uacaggacuucucagaguuauu

SEQ ID NO: 312736 - RNA, 22 nt, Homo sapiens
uacaguaggauuuucagggucu

SEQ ID NO: 312737 - RNA, 22 nt, Homo sapiens
uacagugcuuuuugguggagaa

SEQ ID NO: 312738 - RNA, 22 nt, Homo sapiens
uacaguggaaguuaaccccauu

SEQ ID NO: 312739 - RNA, 22 nt, Homo sapiens
uacaucagccugaaagagcucg

SEQ ID NO: 312740 - RNA, 22 nt, Homo sapiens
uacauguauguguuuauggcug

SEQ ID NO: 312741 - RNA, 22 nt, Homo sapiens
uaccacaggcuggguaaucuau

SEQ ID NO: 312742 - RNA, 22 nt, Homo sapiens
uaccacugccgagaaaacagau

SEQ ID NO: 312743 - RNA, 22 nt, Homo sapiens
uacccuuuaguauaaaaucaga

SEQ ID NO: 312744 - RNA, 22 nt, Homo sapiens
uacucaguagucuguugcuguc

SEQ ID NO: 312745 - RNA, 19 nt, Homo sapiens
uacugcaccucaaccuggg

SEQ ID NO: 312746 - RNA, 22 nt, Homo sapiens
uacugcacuccaaccugagaga

SEQ ID NO: 312747 - RNA, 22 nt, Homo sapiens
uacugcacuccaggcucaccug

SEQ ID NO: 312748 - RNA, 22 nt, Homo sapiens
uacugcaguugcagcuugagga

SEQ ID NO: 312749 - RNA, 22 nt, Homo sapiens
uagaauguaaauuccaagggca

SEQ ID NO: 312750 - RNA, 23 nt, Homo sapiens
uagaauguuuuuccauguuucuu

SEQ ID NO: 312751 - RNA, 22 nt, Homo sapiens
uagacccauuguucagagagug

SEQ ID NO: 312752 - RNA, 22 nt, Homo sapiens
uagagguagagugacuucccca

SEQ ID NO: 312753 - RNA, 22 nt, Homo sapiens
uagagguagccuacuacacacc

SEQ ID NO: 312754 - RNA, 22 nt, Homo sapiens
uagaguacucugguaaguucuu

SEQ ID NO: 312755 - RNA, 20 nt, Homo sapiens
uagaugcauuuagauucauu

SEQ ID NO: 312756 - RNA, 23 nt, Homo sapiens
ucaugguagcaccaacaauaacu

SEQ ID NO: 312757 - RNA, 22 nt, Homo sapiens
ucauugagacuuguuuuguggc

SEQ ID NO: 312758 - RNA, 22 nt, Homo sapiens
ucauugcuuauuuguuggugga

SEQ ID NO: 312759 - RNA, 22 nt, Homo sapiens
ucauuggaugagaccccugucc

SEQ ID NO: 312760 - RNA, 22 nt, Homo sapiens
ucauugguugcguaauuugauu

SEQ ID NO: 312761 - RNA, 22 nt, Homo sapiens
uccagguacucagggggcugag

SEQ ID NO: 312762 - RNA, 22 nt, Homo sapiens
uccaguguuccucagucacccc

SEQ ID NO: 312763 - RNA, 22 nt, Homo sapiens
uccaguuguucucgaagcuccu

SEQ ID NO: 312764 - RNA, 22 nt, Homo sapiens
ucccagaaacgcauauguucau

SEQ ID NO: 312765 - RNA, 22 nt, Homo sapiens
ucccagugcuaugcaaaagccu

SEQ ID NO: 312766 - RNA, 22 nt, Homo sapiens
uccccugauaccaaccaccaug

SEQ ID NO: 312767 - RNA, 22 nt, Homo sapiens
ucccugagguccuggauuauug

SEQ ID NO: 312768 - RNA, 22 nt, Homo sapiens
ucccuggacagccuugccuggg

SEQ ID NO: 312769 - RNA, 22 nt, Homo sapiens
uccugagacucacaggcucccc

SEQ ID NO: 312770 - RNA, 22 nt, Homo sapiens
uccugcauucugacuugcuuuc

SEQ ID NO: 312771 - RNA, 22 nt, Homo sapiens
uccuucaugcaucaauguaucc

SEQ ID NO: 312772 - RNA, 22 nt, Homo sapiens
uccuucauuugucaacucuagu

SEQ ID NO: 312773 - RNA, 22 nt, Homo sapiens
uccuuggucaaaaagaaagugu

SEQ ID NO: 312774 - RNA, 21 nt, Homo sapiens
uccuuggugaugcccugcagu

SEQ ID NO: 312775 - RNA, 17 nt, Homo sapiens
ucuaauaauaugcauuu

SEQ ID NO: 312776 - RNA, 22 nt, Homo sapiens
ucuagaugaaguauaaaguagu

SEQ ID NO: 312777 - RNA, 22 nt, Homo sapiens
ucucacagccauuucucccucu

SEQ ID NO: 312778 - RNA, 22 nt, Homo sapiens
ucucagcacagucagggcgccu

SEQ ID NO: 312779 - RNA, 19 nt, Homo sapiens
ucucaguguuggucaggug

SEQ ID NO: 312780 - RNA, 22 nt, Homo sapiens
ucucaugaagauagagaauaga

SEQ ID NO: 312781 - RNA, 20 nt, Homo sapiens
ucucauggagguagagaaua

SEQ ID NO: 312782 - RNA, 22 nt, Homo sapiens
ucucauggcucacccugcauag

SEQ ID NO: 312783 - RNA, 22 nt, Homo sapiens
ucucugagaaaaguuucuccca

SEQ ID NO: 312784 - RNA, 22 nt, Homo sapiens
ucucugauuaaacaagauagug

SEQ ID NO: 312785 - RNA, 22 nt, Homo sapiens
ucuggagugugaaguggauaug

SEQ ID NO: 312786 - RNA, 22 nt, Homo sapiens
ucuggauuuuugaggcaauaua

SEQ ID NO: 312787 - RNA, 22 nt, Homo sapiens
ucuggcaagagccgagggcagu

SEQ ID NO: 312788 - RNA, 22 nt, Homo sapiens
ucuggccccucccaaaucucau

SEQ ID NO: 312789 - RNA, 22 nt, Homo sapiens
ucuggccccucucaaaucucau

SEQ ID NO: 312790 - RNA, 22 nt, Homo sapiens
ucuggccuacaaguaauuuuau

SEQ ID NO: 312791 - RNA, 22 nt, Homo sapiens
ucuggccuccuaugagaaucga

SEQ ID NO: 312792 - RNA, 15 nt, Homo sapiens
ucuggcucugucacu

SEQ ID NO: 312793 - RNA, 22 nt, Homo sapiens
ucugggguuagucaaagguaug

SEQ ID NO: 312794 - RNA, 22 nt, Homo sapiens
ucugugcauuuucuuuuagacu

SEQ ID NO: 312795 - RNA, 22 nt, Homo sapiens
ucugugcggucuguguuaugaa

SEQ ID NO: 312796 - RNA, 19 nt, Homo sapiens
ucugugcuugucccccugu

SEQ ID NO: 312797 - RNA, 22 nt, Homo sapiens
ucuguggucagcauccgccacu

SEQ ID NO: 312798 - RNA, 22 nt, Homo sapiens
ucuguguuugaucaagauugua

SEQ ID NO: 312799 - RNA, 22 nt, Homo sapiens
ucuuucacuuagcaugauguuu

SEQ ID NO: 312800 - RNA, 22 nt, Homo sapiens
ucuuuggguagauauguagcug

SEQ ID NO: 312801 - RNA, 22 nt, Homo sapiens
ucuuuggguguauuucacagcc

SEQ ID NO: 312802 - RNA, 22 nt, Homo sapiens
ucuuuugggccucuugucagac

SEQ ID NO: 312803 - RNA, 18 nt, Homo sapiens
ugaaacacauuuuuuccu

SEQ ID NO: 312804 - RNA, 22 nt, Homo sapiens
ugaaacauacacucugaugggg

SEQ ID NO: 312805 - RNA, 22 nt, Homo sapiens
ugaaagguuuaauucugugaga

SEQ ID NO: 312806 - RNA, 22 nt, Homo sapiens
ugaaaucauguaguuauugcaa

SEQ ID NO: 312807 - RNA, 22 nt, Homo sapiens
ugaaaugcugucuaggggaaau

SEQ ID NO: 312808 - RNA, 22 nt, Homo sapiens
ugaacagcaccuccuagaguug

SEQ ID NO: 312809 - RNA, 22 nt, Homo sapiens
ugaacucagcauccagggccaa

SEQ ID NO: 312810 - RNA, 22 nt, Homo sapiens
ugaaggccgggcaugguggcuc

SEQ ID NO: 312811 - RNA, 22 nt, Homo sapiens
ugaagugaagcaguaguguggg

SEQ ID NO: 312812 - RNA, 22 nt, Homo sapiens
ugaauacagcacacccaugggu

SEQ ID NO: 312813 - RNA, 22 nt, Homo sapiens
ugaauagacacuaaagacugua

SEQ ID NO: 312814 - RNA, 22 nt, Homo sapiens
ugacacagugggggauccuuuu

SEQ ID NO: 312815 - RNA, 22 nt, Homo sapiens
ugacagagcaggacuucaucuc

SEQ ID NO: 312816 - RNA, 22 nt, Homo sapiens
ugacagcugaggcccagaguac

SEQ ID NO: 312817 - RNA, 22 nt, Homo sapiens
ugacaggucuaauuuacugaca

SEQ ID NO: 312818 - RNA, 23 nt, Homo sapiens
ugacagugcuugaaauugcucuu

SEQ ID NO: 312819 - RNA, 22 nt, Homo sapiens
ugacaguguccucauucccaac

SEQ ID NO: 312820 - RNA, 20 nt, Homo sapiens
ugacaguuaagggauagaag

SEQ ID NO: 312821 - RNA, 22 nt, Homo sapiens
ugacaguuuccagggcugucuc

SEQ ID NO: 312822 - RNA, 22 nt, Homo sapiens
ugacaugaagucucccucuguu

SEQ ID NO: 312823 - RNA, 22 nt, Homo sapiens
ugacaugauuguauauuuagaa

SEQ ID NO: 312824 - RNA, 22 nt, Homo sapiens
ugacauggagggugcggcugca

SEQ ID NO: 312825 - RNA, 22 nt, Homo sapiens
ugacauggagguggaggaagau

SEQ ID NO: 312826 - RNA, 22 nt, Homo sapiens
ugacauuacagucacuugcugu

SEQ ID NO: 312827 - RNA, 22 nt, Homo sapiens
ugacccauagaaauguggauaa

SEQ ID NO: 312828 - RNA, 22 nt, Homo sapiens
ugacuacauaaguaaucucaaa

SEQ ID NO: 312829 - RNA, 22 nt, Homo sapiens
ugacuaggggcccuggcuucuu

SEQ ID NO: 312830 - RNA, 23 nt, Homo sapiens
ugacugaguauauguuuggugcu

SEQ ID NO: 312831 - RNA, 22 nt, Homo sapiens
ugacuggaaacaguguuauuug

SEQ ID NO: 312832 - RNA, 22 nt, Homo sapiens
ugacuucauuuuuggccaugag

SEQ ID NO: 312833 - RNA, 22 nt, Homo sapiens
ugagaacagcagcuugggacac

SEQ ID NO: 312834 - RNA, 22 nt, Homo sapiens
ugagaacaugcacuugagguug

SEQ ID NO: 312835 - RNA, 16 nt, Homo sapiens
ugagaacaugcagcau

SEQ ID NO: 312836 - RNA, 16 nt, Homo sapiens
ugagaacaugugauau

SEQ ID NO: 312837 - RNA, 22 nt, Homo sapiens
ugagaaccucugugugcccacu

SEQ ID NO: 312838 - RNA, 22 nt, Homo sapiens
ugagaacuagagaacaagguga

SEQ ID NO: 312839 - RNA, 22 nt, Homo sapiens
ugagaagugacgcagcaggguu

SEQ ID NO: 312840 - RNA, 22 nt, Homo sapiens
ugagaaugaugauuuccaguuu

SEQ ID NO: 312841 - RNA, 19 nt, Homo sapiens
ugagaauguuaccaggucc

SEQ ID NO: 312842 - RNA, 22 nt, Homo sapiens
ugagagacaguuucgucggagg

SEQ ID NO: 312843 - RNA, 22 nt, Homo sapiens
ugagagaugaacuauucuugaa

SEQ ID NO: 312844 - RNA, 22 nt, Homo sapiens
ugagaggugaauggcaggcuca

SEQ ID NO: 312845 - RNA, 22 nt, Homo sapiens
ugagauaaucaugugauuucau

SEQ ID NO: 312846 - RNA, 22 nt, Homo sapiens
ugagaucaacugagucagagca

SEQ ID NO: 312847 - RNA, 22 nt, Homo sapiens
ugagaucucauuaugguuuuaa

SEQ ID NO: 312848 - RNA, 22 nt, Homo sapiens
ugagaugcucgccggccagcau

SEQ ID NO: 312849 - RNA, 22 nt, Homo sapiens
ugagauuaaucuuuaaguaaga

SEQ ID NO: 312850 - RNA, 22 nt, Homo sapiens
ugagcagaaagcugcaaggucg

SEQ ID NO: 312851 - RNA, 17 nt, Homo sapiens
ugagcuaagauuacccc

SEQ ID NO: 312852 - RNA, 22 nt, Homo sapiens
ugagcuagggccuggaauaggg

SEQ ID NO: 312853 - RNA, 22 nt, Homo sapiens
ugagcugagaucaugcuauugu

SEQ ID NO: 312854 - RNA, 22 nt, Homo sapiens
ugagcugagaucgugccauugu

SEQ ID NO: 312855 - RNA, 22 nt, Homo sapiens
ugagguagaggugaacuugacc

SEQ ID NO: 312856 - RNA, 22 nt, Homo sapiens
ugaggugaaguaauauucuaag

SEQ ID NO: 312857 - RNA, 22 nt, Homo sapiens
ugucaucauuugagagaagaaa

SEQ ID NO: 312858 - RNA, 22 nt, Homo sapiens
ugucaugaaauauguuuuucua

SEQ ID NO: 312859 - RNA, 21 nt, Homo sapiens
ugucaugcagagacccuggag

SEQ ID NO: 312860 - RNA, 22 nt, Homo sapiens
ugucauggugcucugggcccug

SEQ ID NO: 312861 - RNA, 22 nt, Homo sapiens
ugucauguggcuaacgauucau

SEQ ID NO: 312862 - RNA, 22 nt, Homo sapiens
ugucauucaggaaauucuaagu

SEQ ID NO: 312863 - RNA, 19 nt, Homo sapiens
ugucccagccauagaggca

SEQ ID NO: 312864 - RNA, 22 nt, Homo sapiens
ugucccugagccuggauuccug

SEQ ID NO: 312865 - RNA, 22 nt, Homo sapiens
uguccuggugaugcccaaauuc

SEQ ID NO: 312866 - RNA, 22 nt, Homo sapiens
ugucuagaaaagccugccuucu

SEQ ID NO: 312867 - RNA, 21 nt, Homo sapiens
ugucugagagaggagaucuac

SEQ ID NO: 312868 - RNA, 22 nt, Homo sapiens
ugucuggaaggguggccuccug

SEQ ID NO: 312869 - RNA, 22 nt, Homo sapiens
ugucuguuugcgaaauugcuuc

SEQ ID NO: 312870 - RNA, 22 nt, Homo sapiens
ugugaaacacgaaagucuaaaa

SEQ ID NO: 312871 - RNA, 22 nt, Homo sapiens
ugugaagaugagaugacgcccu

SEQ ID NO: 312872 - RNA, 22 nt, Homo sapiens
ugugacacugaauggcagaacu

SEQ ID NO: 312873 - RNA, 22 nt, Homo sapiens
ugugaccaaaaucaacauaccu

SEQ ID NO: 312874 - RNA, 22 nt, Homo sapiens
ugugcaaauguuaaacuaacuu

SEQ ID NO: 312875 - RNA, 22 nt, Homo sapiens
ugugcaccucuucacacaggga

SEQ ID NO: 312876 - RNA, 22 nt, Homo sapiens
uguggucaucacuugaagguaa

SEQ ID NO: 312877 - RNA, 22 nt, Homo sapiens
ugugguuuuucacauuuagaga

SEQ ID NO: 312878 - RNA, 22 nt, Homo sapiens
ugugguuuuuuucuccaauagg

SEQ ID NO: 312879 - RNA, 22 nt, Homo sapiens
uguguaaauagcuacggaucug

SEQ ID NO: 312880 - RNA, 22 nt, Homo sapiens
ugugucuugagagucucgagaa

SEQ ID NO: 312881 - RNA, 22 nt, Homo sapiens
ugugucuuguuuauagcuuucu

SEQ ID NO: 312882 - RNA, 22 nt, Homo sapiens
uguuauguucuacuuuuaggug

SEQ ID NO: 312883 - RNA, 22 nt, Homo sapiens
uguuauguuuuagagguuucaa

SEQ ID NO: 312884 - RNA, 22 nt, Homo sapiens
uguuauugagguuacuuauaag

SEQ ID NO: 312885 - RNA, 22 nt, Homo sapiens
uguuauuuuguguuagggcaca

SEQ ID NO: 312886 - RNA, 22 nt, Homo sapiens
uguugcaccugccuugcuuuag

SEQ ID NO: 312887 - RNA, 22 nt, Homo sapiens
uguugcacugguaauguacuga

SEQ ID NO: 312888 - RNA, 22 nt, Homo sapiens
uguugcauuugucaaggucaag

SEQ ID NO: 312889 - RNA, 22 nt, Homo sapiens
uguugcuuaagccacccagucu

SEQ ID NO: 312890 - RNA, 22 nt, Homo sapiens
uuaaagcuggcguuacaguuug

SEQ ID NO: 312891 - RNA, 22 nt, Homo sapiens
uuaacagucacuuagcucauuu

SEQ ID NO: 312892 - RNA, 21 nt, Homo sapiens
uuaaguaauuacccaacucuc

SEQ ID NO: 312893 - RNA, 22 nt, Homo sapiens
uuaaguagaugaaugugaaugu

SEQ ID NO: 312894 - RNA, 22 nt, Homo sapiens
uuaauagugacucauuuuccac

SEQ ID NO: 312895 - RNA, 22 nt, Homo sapiens
uuacauugcuucaaauucagug

SEQ ID NO: 312896 - RNA, 22 nt, Homo sapiens
uuagaacagugcucaccacaaa

SEQ ID NO: 312897 - RNA, 22 nt, Homo sapiens
uuagauuauugagcauccacug

SEQ ID NO: 312898 - RNA, 22 nt, Homo sapiens
uuagauuauugguguuuugcaa

SEQ ID NO: 312899 - RNA, 22 nt, Homo sapiens
uuagcagugugaaaaaagacua

SEQ ID NO: 312900 - RNA, 22 nt, Homo sapiens
uuaggcaggauaguuacauauu

SEQ ID NO: 312901 - RNA, 22 nt, Homo sapiens
uuaggugcauggaaguguuuuc

SEQ ID NO: 312902 - RNA, 23 nt, Homo sapiens
uuaguaaacucaaugacaccaca

SEQ ID NO: 312903 - RNA, 22 nt, Homo sapiens
uuauaacagagacuccugugcu

SEQ ID NO: 312904 - RNA, 22 nt, Homo sapiens
uuauagacacguuguaacaaac

SEQ ID NO: 312905 - RNA, 22 nt, Homo sapiens
uuauauguuacucccucuagca

SEQ ID NO: 312906 - RNA, 22 nt, Homo sapiens
uuauauguuucuguuuggaggc

SEQ ID NO: 312907 - RNA, 22 nt, Homo sapiens
uuaucagcagcaugaaaauaga

SEQ ID NO: 312908 - RNA, 22 nt, Homo sapiens
uuaucagcagugcgaaaacaga

SEQ ID NO: 312909 - RNA, 22 nt, Homo sapiens
uuauuagcacccuaccaugugg

SEQ ID NO: 312910 - RNA, 16 nt, Homo sapiens
uuauugcauucuucuc

SEQ ID NO: 312911 - RNA, 22 nt, Homo sapiens
uuauugcuccagaggcugauuu

SEQ ID NO: 312912 - RNA, 22 nt, Homo sapiens
uuauuugguuauuguaauuggg

SEQ ID NO: 312913 - RNA, 22 nt, Homo sapiens
uucaagcuauggugaucuuuuc

SEQ ID NO: 312914 - RNA, 22 nt, Homo sapiens
uucaauaugucauuggcaggca

SEQ ID NO: 312915 - RNA, 22 nt, Homo sapiens
uucacaaugccuuguugauggu

SEQ ID NO: 312916 - RNA, 22 nt, Homo sapiens
uucacagccgcaccccaucacu

SEQ ID NO: 312917 - RNA, 22 nt, Homo sapiens
uucacagucacccuucuccaug

SEQ ID NO: 312918 - RNA, 22 nt, Homo sapiens
uucagaugcacacuguagucua

SEQ ID NO: 312919 - RNA, 22 nt, Homo sapiens
uucagcaaugacagccuauaua

SEQ ID NO: 312920 - RNA, 22 nt, Homo sapiens
uucagcaggccaggcccugacu

SEQ ID NO: 312921 - RNA, 22 nt, Homo sapiens
uucagcaguggccaguggaaau

SEQ ID NO: 312922 - RNA, 19 nt, Homo sapiens
uucagcagugucugcucuu

SEQ ID NO: 312923 - RNA, 22 nt, Homo sapiens
uucaguggacuuaguagugcuu

SEQ ID NO: 312924 - RNA, 22 nt, Homo sapiens
uucauaguauuuuucuccaaau

SEQ ID NO: 312925 - RNA, 22 nt, Homo sapiens
uucauagugaaaaauucaaagu

SEQ ID NO: 312926 - RNA, 20 nt, Homo sapiens
uucaucaggauauuggucua

SEQ ID NO: 312927 - RNA, 22 nt, Homo sapiens
uucaucagggagaaauaauuuc

SEQ ID NO: 312928 - RNA, 23 nt, Homo sapiens
uucaucagggauauuggccugaa

SEQ ID NO: 312929 - RNA, 22 nt, Homo sapiens
uucaucuggcaauucagagauu

SEQ ID NO: 312930 - RNA, 22 nt, Homo sapiens
uucauggguuaauuuguucgau

SEQ ID NO: 312931 - RNA, 22 nt, Homo sapiens
uucauguaauauauuucaggcc

SEQ ID NO: 312932 - RNA, 22 nt, Homo sapiens
uucauguaauauuucacagcuu

SEQ ID NO: 312933 - RNA, 22 nt, Homo sapiens
uucauuggacuuguguucuuga

SEQ ID NO: 312934 - RNA, 20 nt, Homo sapiens
uuccagcacauuagggaagc

SEQ ID NO: 312935 - RNA, 21 nt, Homo sapiens
uuccagugagccuagaugccu

SEQ ID NO: 312936 - RNA, 22 nt, Homo sapiens
uuccaguggacuacuucauccu

SEQ ID NO: 312937 - RNA, 22 nt, Homo sapiens
uuccaguggaguaaauggacaa

SEQ ID NO: 312938 - RNA, 22 nt, Homo sapiens
uuccauagucauagugcugaug

SEQ ID NO: 312939 - RNA, 22 nt, Homo sapiens
uuccauuuguucggugucgcca

SEQ ID NO: 312940 - RNA, 22 nt, Homo sapiens
uucccauuguuggccagcaugu

SEQ ID NO: 312941 - RNA, 22 nt, Homo sapiens
uucccugaaauauucacuuuca

SEQ ID NO: 312942 - RNA, 22 nt, Homo sapiens
uucccugaaguguuacucuaga

SEQ ID NO: 312943 - RNA, 22 nt, Homo sapiens
uucccuguaucuucugccaugu

SEQ ID NO: 312944 - RNA, 22 nt, Homo sapiens
uucccuugcaggaugaucugga

SEQ ID NO: 312945 - RNA, 22 nt, Homo sapiens
uuccuacuguucaucaggaacc

SEQ ID NO: 312946 - RNA, 22 nt, Homo sapiens
uuccuggaggggaaguguccaa

SEQ ID NO: 312947 - RNA, 22 nt, Homo sapiens
uuccuugguucagggaaggucc

SEQ ID NO: 312948 - RNA, 22 nt, Homo sapiens
uuccuuguuuauuuacaggagg

SEQ ID NO: 312949 - RNA, 22 nt, Homo sapiens
uucuaaacaucuuacaaugcau

SEQ ID NO: 312950 - RNA, 20 nt, Homo sapiens
uucuacagucacaggaagau

SEQ ID NO: 312951 - RNA, 22 nt, Homo sapiens
uucucacaguacagggagcucu

SEQ ID NO: 312952 - RNA, 22 nt, Homo sapiens
uucugugguagaaaucucaaau

SEQ ID NO: 312953 - RNA, 22 nt, Homo sapiens
uucuuccagccuugaggggccc

SEQ ID NO: 312954 - RNA, 22 nt, Homo sapiens
uucuucugguuaugaaauuuga

SEQ ID NO: 312955 - RNA, 18 nt, Homo sapiens
uucuuguguugauauuuu

SEQ ID NO: 312956 - RNA, 21 nt, Homo sapiens
uucuuugcucaguguuagagu

SEQ ID NO: 312957 - RNA, 22 nt, Homo sapiens
uugaaagaugaacuggauugga

SEQ ID NO: 312958 - RNA, 22 nt, Homo sapiens
uuuugggggugauucacacagu

SEQ ID NO: 312959 - RNA, 22 nt, Homo sapiens
uuuugguguacaauucuaugga

SEQ ID NO: 312960 - RNA, 22 nt, Homo sapiens
uuuugguuaggauggguggcau

SEQ ID NO: 312961 - RNA, 22 nt, Homo sapiens
uuuugguucaauuaauuugcua

SEQ ID NO: 312962 - RNA, 22 nt, Homo sapiens
uuuuuauggccaauccucagaa

SEQ ID NO: 312963 - RNA, 22 nt, Homo sapiens
aauacucaguccuggugaggcu

SEQ ID NO: 312964 - RNA, 21 nt, Homo sapiens
aauacucuagguuaagagagc

SEQ ID NO: 312965 - RNA, 22 nt, Homo sapiens
aauacugugauaucgagcgauu

SEQ ID NO: 312966 - RNA, 22 nt, Homo sapiens
aauauguccuugaaauggugcu

SEQ ID NO: 312967 - RNA, 22 nt, Homo sapiens
aaucacauugaaucugcuaccu

SEQ ID NO: 312968 - RNA, 22 nt, Homo sapiens
aauccauuugccgucuauccau

SEQ ID NO: 312969 - RNA, 22 nt, Homo sapiens
aaugacacugagcaucuuucau

SEQ ID NO: 312970 - RNA, 22 nt, Homo sapiens
aaugacagugcuaaagaacccu

SEQ ID NO: 312971 - RNA, 22 nt, Homo sapiens
aauggcuucuuauugugguuca

SEQ ID NO: 312972 - RNA, 22 nt, Homo sapiens
aaugugccuacagugggcuguu

SEQ ID NO: 312973 - RNA, 22 nt, Homo sapiens
aauugaaugauaugggacauuu

SEQ ID NO: 312974 - RNA, 22 nt, Homo sapiens
aauugcaauggacaaugcagca

SEQ ID NO: 312975 - RNA, 22 nt, Homo sapiens
aauugcaccaucuagaucaaga

SEQ ID NO: 312976 - RNA, 22 nt, Homo sapiens
aauuguacucccaucauuccua

SEQ ID NO: 312977 - RNA, 22 nt, Homo sapiens
aauuugucaccucucucccuuu

SEQ ID NO: 312978 - RNA, 23 nt, Homo sapiens
acacaguaaacuaaaagcuagcu

SEQ ID NO: 312979 - RNA, 22 nt, Homo sapiens
acacaguguuuauugugguuag

SEQ ID NO: 312980 - RNA, 22 nt, Homo sapiens
acacauacacauaugguguaua

SEQ ID NO: 312981 - RNA, 22 nt, Homo sapiens
acacaugugaaaaaaauguuac

SEQ ID NO: 312982 - RNA, 22 nt, Homo sapiens
acacauuggcaauucuggagca

SEQ ID NO: 312983 - RNA, 22 nt, Homo sapiens
acacuggaguuaaaggugauuu

SEQ ID NO: 312984 - RNA, 22 nt, Homo sapiens
acacugucugaugaaaguaguu

SEQ ID NO: 312985 - RNA, 22 nt, Homo sapiens
acacuguugacauuuuguagug

SEQ ID NO: 312986 - RNA, 22 nt, Homo sapiens
acacuuucuggagcugcacaua

SEQ ID NO: 312987 - RNA, 22 nt, Homo sapiens
acagauagcacuaagggaucug

SEQ ID NO: 312988 - RNA, 18 nt, Homo sapiens
acagugcuggcaugagau

SEQ ID NO: 312989 - RNA, 22 nt, Homo sapiens
acagugcuuuuguuccucuccu

SEQ ID NO: 312990 - RNA, 22 nt, Homo sapiens
acaguggugcgaucucggcuca

SEQ ID NO: 312991 - RNA, 17 nt, Homo sapiens
acagugucuaugaaaug

SEQ ID NO: 312992 - RNA, 22 nt, Homo sapiens
acaguguuacuugauaguguau

SEQ ID NO: 312993 - RNA, 22 nt, Homo sapiens
acaguguuccuuuguugugacu

SEQ ID NO: 312994 - RNA, 22 nt, Homo sapiens
acaucccaugccuggguacucc

SEQ ID NO: 312995 - RNA, 22 nt, Homo sapiens
acaugagacuggguuuguaggg

SEQ ID NO: 312996 - RNA, 22 nt, Homo sapiens
acaugcaucauuaggugguuua

SEQ ID NO: 312997 - RNA, 22 nt, Homo sapiens
acauguauauaaugcauagcga

SEQ ID NO: 312998 - RNA, 22 nt, Homo sapiens
accacagugcuuccugcucacg

SEQ ID NO: 312999 - RNA, 22 nt, Homo sapiens
accaccauugcacugaacuuuc

SEQ ID NO: 313000 - RNA, 22 nt, Homo sapiens
accauugcacuccagccugggc

SEQ ID NO: 313001 - RNA, 22 nt, Homo sapiens
acccuacauaguagauccuaca

SEQ ID NO: 313002 - RNA, 22 nt, Homo sapiens
acccucagaccaguuucccugg

SEQ ID NO: 313003 - RNA, 19 nt, Homo sapiens
acccuguccccaccuuuac

SEQ ID NO: 313004 - RNA, 18 nt, Homo sapiens
acccuucagcacugggcc

SEQ ID NO: 313005 - RNA, 23 nt, Homo sapiens
accugauguuucuguggggagcc

SEQ ID NO: 313006 - RNA, 22 nt, Homo sapiens
accugcacagccgaacauagac

SEQ ID NO: 313007 - RNA, 23 nt, Homo sapiens
accugugguuauuuuacucuucc

SEQ ID NO: 313008 - RNA, 22 nt, Homo sapiens
acucagagauuagcacauguuu

SEQ ID NO: 313009 - RNA, 22 nt, Homo sapiens
acucagagugggccccuagaua

SEQ ID NO: 313010 - RNA, 22 nt, Homo sapiens
acuccacuuucaccacagcgga

SEQ ID NO: 313011 - RNA, 21 nt, Homo sapiens
acugagagaucuggggcacau

SEQ ID NO: 313012 - RNA, 22 nt, Homo sapiens
acugcaaugucgaauagagaug

SEQ ID NO: 313013 - RNA, 22 nt, Homo sapiens
acugcacuccacccuuggcagc

SEQ ID NO: 313014 - RNA, 22 nt, Homo sapiens
acuggcucugcuuuacaaacag

SEQ ID NO: 313015 - RNA, 22 nt, Homo sapiens
acuuugcuuagagggcauuaaa

SEQ ID NO: 313016 - RNA, 22 nt, Homo sapiens
agaacacugaguucagggucag

SEQ ID NO: 313017 - RNA, 22 nt, Homo sapiens
agaagaacauagggugacugaa

SEQ ID NO: 313018 - RNA, 20 nt, Homo sapiens
agaagcauugcucucuucag

SEQ ID NO: 313019 - RNA, 22 nt, Homo sapiens
agaauacugucuauucauggua

SEQ ID NO: 313020 - RNA, 22 nt, Homo sapiens
agaauguaaacagaauagagga

SEQ ID NO: 313021 - RNA, 22 nt, Homo sapiens
agaauguuuuagaccaauacaa

SEQ ID NO: 313022 - RNA, 20 nt, Homo sapiens
agacaguguggagauuccuu

SEQ ID NO: 313023 - RNA, 22 nt, Homo sapiens
agacuuagagagucuauucuau

SEQ ID NO: 313024 - RNA, 22 nt, Homo sapiens
agagaacuguuuacacguuaau

SEQ ID NO: 313025 - RNA, 22 nt, Homo sapiens
agagcacugcugcaggguucug

SEQ ID NO: 313026 - RNA, 22 nt, Homo sapiens
agagucacaugaggcccuucau

SEQ ID NO: 313027 - RNA, 22 nt, Homo sapiens
agagugaagcuuuuuauauucu

SEQ ID NO: 313028 - RNA, 22 nt, Homo sapiens
agagugcuauagauuagauuuc

SEQ ID NO: 313029 - RNA, 20 nt, Homo sapiens
agagugcugucuguccugag

SEQ ID NO: 313030 - RNA, 22 nt, Homo sapiens
agauauuuguuaggucugucag

SEQ ID NO: 313031 - RNA, 22 nt, Homo sapiens
agaugcuguuaucaacuguagc

SEQ ID NO: 313032 - RNA, 22 nt, Homo sapiens
agcaacauggaguuugugcgca

SEQ ID NO: 313033 - RNA, 22 nt, Homo sapiens
agcacagccuuguguuuucuug

SEQ ID NO: 313034 - RNA, 22 nt, Homo sapiens
agcaccaccguugcucuauccc

SEQ ID NO: 313035 - RNA, 22 nt, Homo sapiens
agcaccauuguacuccagccug

SEQ ID NO: 313036 - RNA, 22 nt, Homo sapiens
agcagcaccaaacagacuaaga

SEQ ID NO: 313037 - RNA, 22 nt, Homo sapiens
agcagcauggguauaaaucucc

SEQ ID NO: 313038 - RNA, 22 nt, Homo sapiens
agcagcauuaguggaaucuugu

SEQ ID NO: 313039 - RNA, 22 nt, Homo sapiens
agcagcuuugcauggccugugg

SEQ ID NO: 313040 - RNA, 22 nt, Homo sapiens
agcagguauucgggucaugggg

SEQ ID NO: 313041 - RNA, 22 nt, Homo sapiens
agcagguguccacaauguuugc

SEQ ID NO: 313042 - RNA, 22 nt, Homo sapiens
agcaucacacacuacagggaaa

SEQ ID NO: 313043 - RNA, 22 nt, Homo sapiens
agcauggucacuuugggcccca

SEQ ID NO: 313044 - RNA, 17 nt, Homo sapiens
agccccauuagcuaguu

SEQ ID NO: 313045 - RNA, 23 nt, Homo sapiens
agcuagagaggcuggggauacag

SEQ ID NO: 313046 - RNA, 22 nt, Homo sapiens
agcucauugcaaccuccgccuc

SEQ ID NO: 313047 - RNA, 22 nt, Homo sapiens
agcugguauuuugucaaggaua

SEQ ID NO: 313048 - RNA, 22 nt, Homo sapiens
agcugguuuaauaugcugucug

SEQ ID NO: 313049 - RNA, 19 nt, Homo sapiens
agcuguguugccugugaga

SEQ ID NO: 313050 - RNA, 22 nt, Homo sapiens
agcuucauuguuaugaauguca

SEQ ID NO: 313051 - RNA, 22 nt, Homo sapiens
agcuuguagugauuugugguaa

SEQ ID NO: 313052 - RNA, 22 nt, Homo sapiens
agcuuguuuucccauaacuaga

SEQ ID NO: 313053 - RNA, 22 nt, Homo sapiens
aggaauuuaauguaugauaaua

SEQ ID NO: 313054 - RNA, 23 nt, Homo sapiens
aggagcuuagaaguugccauugc

SEQ ID NO: 313055 - RNA, 22 nt, Homo sapiens
aggcacacaacccuggaccuga

SEQ ID NO: 313056 - RNA, 22 nt, Homo sapiens
aggcacgguggcucacaccugu

SEQ ID NO: 313057 - RNA, 22 nt, Homo sapiens
aggcaguuucagugagagguga

SEQ ID NO: 313058 - RNA, 22 nt, Homo sapiens
aggcaugaaauacaugcauuga

SEQ ID NO: 313059 - RNA, 22 nt, Homo sapiens
aggcaugugugcagacugucug

SEQ ID NO: 313060 - RNA, 22 nt, Homo sapiens
aggcuaagaugacuccaccccc

SEQ ID NO: 313061 - RNA, 22 nt, Homo sapiens
aggcuuuuggagaacacugcac

SEQ ID NO: 313062 - RNA, 22 nt, Homo sapiens
agggcaagacuuguuaagaaca

SEQ ID NO: 313063 - RNA, 22 nt, Homo sapiens
agggcacuguagguccugccuc

SEQ ID NO: 313064 - RNA, 22 nt, Homo sapiens
auggcuagaaccuguauauuca

SEQ ID NO: 313065 - RNA, 22 nt, Homo sapiens
auggcucuuauuauuuugaggu

SEQ ID NO: 313066 - RNA, 22 nt, Homo sapiens
auggcuuaagacaaccuuucau

SEQ ID NO: 313067 - RNA, 22 nt, Homo sapiens
auggcuucuuacucuucugcau

SEQ ID NO: 313068 - RNA, 22 nt, Homo sapiens
auggcuuuuccugucuugcaug

SEQ ID NO: 313069 - RNA, 22 nt, Homo sapiens
augggguaggcuugcuguagua

SEQ ID NO: 313070 - RNA, 22 nt, Homo sapiens
augggguaggcuuugcugcagu

SEQ ID NO: 313071 - RNA, 22 nt, Homo sapiens
augguauggaaggucuggagga

SEQ ID NO: 313072 - RNA, 22 nt, Homo sapiens
augguauuuaacagucuuucua

SEQ ID NO: 313073 - RNA, 22 nt, Homo sapiens
auggucccauucauucacguau

SEQ ID NO: 313074 - RNA, 22 nt, Homo sapiens
augguuuauuuguaagcagagu

SEQ ID NO: 313075 - RNA, 22 nt, Homo sapiens
augucaaggugaagaaagauca

SEQ ID NO: 313076 - RNA, 22 nt, Homo sapiens
augucacagguccuagccaagu

SEQ ID NO: 313077 - RNA, 20 nt, Homo sapiens
augucagaguguggguacgg

SEQ ID NO: 313078 - RNA, 22 nt, Homo sapiens
augucauagaagccugugaacc

SEQ ID NO: 313079 - RNA, 22 nt, Homo sapiens
auguccaugagcacauguauca

SEQ ID NO: 313080 - RNA, 22 nt, Homo sapiens
augucugguagccaccuggagg

SEQ ID NO: 313081 - RNA, 22 nt, Homo sapiens
augugacuuuuuccugugccuu

SEQ ID NO: 313082 - RNA, 20 nt, Homo sapiens
augugcaguguggcaaccaa

SEQ ID NO: 313083 - RNA, 22 nt, Homo sapiens
augugcauaugaagcacagaca

SEQ ID NO: 313084 - RNA, 22 nt, Homo sapiens
augugcuuaaaaaugcagagaa

SEQ ID NO: 313085 - RNA, 22 nt, Homo sapiens
augugcuuauagguguauguuu

SEQ ID NO: 313086 - RNA, 22 nt, Homo sapiens
augugcuuuuggugagagauuu

SEQ ID NO: 313087 - RNA, 22 nt, Homo sapiens
augugugcuugauguaaaaagu

SEQ ID NO: 313088 - RNA, 22 nt, Homo sapiens
auguguucaucacagcacaauu

SEQ ID NO: 313089 - RNA, 18 nt, Homo sapiens
auguuauguuuguagaag

SEQ ID NO: 313090 - RNA, 22 nt, Homo sapiens
auguugcuugaaggcauuuugu

SEQ ID NO: 313091 - RNA, 22 nt, Homo sapiens
auguuguaguaugagucaaaau

SEQ ID NO: 313092 - RNA, 22 nt, Homo sapiens
auguuuagagagggugucaaau

SEQ ID NO: 313093 - RNA, 22 nt, Homo sapiens
auucaaagugcauguucccacu

SEQ ID NO: 313094 - RNA, 22 nt, Homo sapiens
auucacuguggguccuuuggau

SEQ ID NO: 313095 - RNA, 20 nt, Homo sapiens
auucauggaggagcaauugg

SEQ ID NO: 313096 - RNA, 22 nt, Homo sapiens
auugaauuugguuugcuaagaa

SEQ ID NO: 313097 - RNA, 22 nt, Homo sapiens
auugagcacugacucugugcca

SEQ ID NO: 313098 - RNA, 18 nt, Homo sapiens
auugagcaugacagaccu

SEQ ID NO: 313099 - RNA, 22 nt, Homo sapiens
auugcacacagaaucaggguaa

SEQ ID NO: 313100 - RNA, 22 nt, Homo sapiens
auugcacuccagccugggcuag

SEQ ID NO: 313101 - RNA, 19 nt, Homo sapiens
auugcaguguaaaacuauu

SEQ ID NO: 313102 - RNA, 22 nt, Homo sapiens
auugcuaacugaaauaagacca

SEQ ID NO: 313103 - RNA, 22 nt, Homo sapiens
auugcugagacauugcuaaucu

SEQ ID NO: 313104 - RNA, 22 nt, Homo sapiens
auugcuuacccuguauuagauc

SEQ ID NO: 313105 - RNA, 22 nt, Homo sapiens
auugcuuuuacugggagcuuug

SEQ ID NO: 313106 - RNA, 22 nt, Homo sapiens
auuggacagcauuucuagacuu

SEQ ID NO: 313107 - RNA, 22 nt, Homo sapiens
auuggcaauccauauauuuucu

SEQ ID NO: 313108 - RNA, 22 nt, Homo sapiens
auuggcaauguacauaucuugc

SEQ ID NO: 313109 - RNA, 22 nt, Homo sapiens
auuggcuuuauacauaagaaua

SEQ ID NO: 313110 - RNA, 22 nt, Homo sapiens
auuguacuccagccuaggcaac

SEQ ID NO: 313111 - RNA, 22 nt, Homo sapiens
auuguacuccagccugggcaag

SEQ ID NO: 313112 - RNA, 22 nt, Homo sapiens
auuguacuccagccugggcgac

SEQ ID NO: 313113 - RNA, 22 nt, Homo sapiens
auuguaguuugcuauggcaaua

SEQ ID NO: 313114 - RNA, 22 nt, Homo sapiens
auugucacugugcuccaccagu

SEQ ID NO: 313115 - RNA, 22 nt, Homo sapiens
auuuggcaacguagggaggcau

SEQ ID NO: 313116 - RNA, 22 nt, Homo sapiens
auuuuuggauauagggaaggau

SEQ ID NO: 313117 - RNA, 22 nt, Homo sapiens
auuuuugguugguaggcuauua

SEQ ID NO: 313118 - RNA, 22 nt, Homo sapiens
auuuuugguugucagcacuagg

SEQ ID NO: 313119 - RNA, 22 nt, Homo sapiens
auuuuugguuucaccugcacgc

SEQ ID NO: 313120 - RNA, 22 nt, Homo sapiens
caaaagugauugcgguuuuugc

SEQ ID NO: 313121 - RNA, 22 nt, Homo sapiens
caaaagugguucuuauccuuuu

SEQ ID NO: 313122 - RNA, 22 nt, Homo sapiens
caaaccuguaggggccaagagg

SEQ ID NO: 313123 - RNA, 22 nt, Homo sapiens
caaagugcugggaugggccagg

SEQ ID NO: 313124 - RNA, 19 nt, Homo sapiens
caaaguguucuucuuugcc

SEQ ID NO: 313125 - RNA, 22 nt, Homo sapiens
caagacuguccaacauauuggg

SEQ ID NO: 313126 - RNA, 22 nt, Homo sapiens
caagugcuugaugaaugaucaa

SEQ ID NO: 313127 - RNA, 22 nt, Homo sapiens
caaugcauuauucucccacuuc

SEQ ID NO: 313128 - RNA, 22 nt, Homo sapiens
cacaaccuccgccuccuggguu

SEQ ID NO: 313129 - RNA, 22 nt, Homo sapiens
cacaccuacuagggccgugggc

SEQ ID NO: 313130 - RNA, 22 nt, Homo sapiens
cacagugaacaauauccucugu

SEQ ID NO: 313131 - RNA, 22 nt, Homo sapiens
cacauguuuuagcauggcuguu

SEQ ID NO: 313132 - RNA, 22 nt, Homo sapiens
caccauguguucagaaggauug

SEQ ID NO: 313133 - RNA, 22 nt, Homo sapiens
caccccuaccugagucaggagu

SEQ ID NO: 313134 - RNA, 19 nt, Homo sapiens
caccgccugcccccugcug

SEQ ID NO: 313135 - RNA, 22 nt, Homo sapiens
cacugcacuccagccuaagagg

SEQ ID NO: 313136 - RNA, 22 nt, Homo sapiens
cacugcacuccagcuuugguga

SEQ ID NO: 313137 - RNA, 22 nt, Homo sapiens
cacugcacuccagucugacgac

SEQ ID NO: 313138 - RNA, 22 nt, Homo sapiens
cacugcacuccagucuggcgac

SEQ ID NO: 313139 - RNA, 22 nt, Homo sapiens
cacugcauccuccaccuccugg

SEQ ID NO: 313140 - RNA, 22 nt, Homo sapiens
cacugcauggucuagcuggguu

SEQ ID NO: 313141 - RNA, 22 nt, Homo sapiens
cacuggguuagaacaugcuccu

SEQ ID NO: 313142 - RNA, 22 nt, Homo sapiens
cagagaacauucagagcuguag

SEQ ID NO: 313143 - RNA, 22 nt, Homo sapiens
cagagcaaugcuuuugcuuuga

SEQ ID NO: 313144 - RNA, 22 nt, Homo sapiens
cagcaaaucauccuauuugagc

SEQ ID NO: 313145 - RNA, 22 nt, Homo sapiens
cagccggguggcuccuagggua

SEQ ID NO: 313146 - RNA, 22 nt, Homo sapiens
cagcuaguaauuuauugaagau

SEQ ID NO: 313147 - RNA, 22 nt, Homo sapiens
cagcugaugucgaaugcacucu

SEQ ID NO: 313148 - RNA, 22 nt, Homo sapiens
cagcuguuguugggguauagga

SEQ ID NO: 313149 - RNA, 22 nt, Homo sapiens
caggaccucuugccuggaagcc

SEQ ID NO: 313150 - RNA, 19 nt, Homo sapiens
cagguagugugcugacaug

SEQ ID NO: 313151 - RNA, 23 nt, Homo sapiens
cagguaguucuuuauaguagugu

SEQ ID NO: 313152 - RNA, 22 nt, Homo sapiens
caggugaaugccucuccuucug

SEQ ID NO: 313153 - RNA, 18 nt, Homo sapiens
cagugcaauacaggagag

SEQ ID NO: 313154 - RNA, 20 nt, Homo sapiens
cagugcacuuucccacuggu

SEQ ID NO: 313155 - RNA, 22 nt, Homo sapiens
cagugcuuguuauuguucuauu

SEQ ID NO: 313156 - RNA, 22 nt, Homo sapiens
cagugcuuuaucaaguccucca

SEQ ID NO: 313157 - RNA, 22 nt, Homo sapiens
caguuacuugacacaaccaauu

SEQ ID NO: 313158 - RNA, 22 nt, Homo sapiens
cauagcacacauuuaccuaugu

SEQ ID NO: 313159 - RNA, 22 nt, Homo sapiens
caucagcaauguaugaggguuc

SEQ ID NO: 313160 - RNA, 22 nt, Homo sapiens
caugaaagacugaggaauugga

SEQ ID NO: 313161 - RNA, 22 nt, Homo sapiens
cauggcaucuguguggccucca

SEQ ID NO: 313162 - RNA, 22 nt, Homo sapiens
cauggcccugggcugggcgaac

SEQ ID NO: 313163 - RNA, 22 nt, Homo sapiens
cauggcccuggguccauaggaa

SEQ ID NO: 313164 - RNA, 22 nt, Homo sapiens
cauggcuacugcagauguaggg

SEQ ID NO: 313165 - RNA, 22 nt, Homo sapiens
guacacauacauauaugugugu

SEQ ID NO: 313166 - RNA, 17 nt, Homo sapiens
guacacuucuucuguga

SEQ ID NO: 313167 - RNA, 22 nt, Homo sapiens
guacaguaguaaaagugaauga

SEQ ID NO: 313168 - RNA, 22 nt, Homo sapiens
guacaguauaguaauaggauuu

SEQ ID NO: 313169 - RNA, 22 nt, Homo sapiens
guacaugcauacaugcacaucu

SEQ ID NO: 313170 - RNA, 22 nt, Homo sapiens
guacuuuguuauaacccacagg

SEQ ID NO: 313171 - RNA, 22 nt, Homo sapiens
guagagugcugggcacuggcuc

SEQ ID NO: 313172 - RNA, 22 nt, Homo sapiens
guaucacguuguuuuggugaaa

SEQ ID NO: 313173 - RNA, 22 nt, Homo sapiens
guaugcacauauguguauguau

SEQ ID NO: 313174 - RNA, 22 nt, Homo sapiens
guauuguacuacaagcucuuua

SEQ ID NO: 313175 - RNA, 22 nt, Homo sapiens
gucaccagcuguguuagccccu

SEQ ID NO: 313176 - RNA, 22 nt, Homo sapiens
gucacuggcugucuuguaugau

SEQ ID NO: 313177 - RNA, 22 nt, Homo sapiens
gucagugccugucccaggcuuu

SEQ ID NO: 313178 - RNA, 22 nt, Homo sapiens
gucaguggagaaaaggacaugu

SEQ ID NO: 313179 - RNA, 22 nt, Homo sapiens
gucaguucuugugguugcauuc

SEQ ID NO: 313180 - RNA, 22 nt, Homo sapiens
gucauggaggaugaauggccaa

SEQ ID NO: 313181 - RNA, 22 nt, Homo sapiens
gucaugggguacuacacauggg

SEQ ID NO: 313182 - RNA, 22 nt, Homo sapiens
gucauuguguggacauggagaa

SEQ ID NO: 313183 - RNA, 22 nt, Homo sapiens
guccaaagugggagaggugggg

SEQ ID NO: 313184 - RNA, 22 nt, Homo sapiens
guccauuuguuuccagagcacu

SEQ ID NO: 313185 - RNA, 22 nt, Homo sapiens
gucccugcgauugugggauccu

SEQ ID NO: 313186 - RNA, 22 nt, Homo sapiens
gucucccaaccccugugcccag

SEQ ID NO: 313187 - RNA, 22 nt, Homo sapiens
gucucugguugcuuuuguacca

SEQ ID NO: 313188 - RNA, 22 nt, Homo sapiens
gucuggcacagggaaaguacaa

SEQ ID NO: 313189 - RNA, 22 nt, Homo sapiens
gucuuccagccuccaucuuucu

SEQ ID NO: 313190 - RNA, 22 nt, Homo sapiens
gugaacaagcaaaggcaggagg

SEQ ID NO: 313191 - RNA, 22 nt, Homo sapiens
gugaaguuuuuugcugagaguc

SEQ ID NO: 313192 - RNA, 22 nt, Homo sapiens
gugagacugaguuucgcucuug

SEQ ID NO: 313193 - RNA, 22 nt, Homo sapiens
gugagauuuucuccagguucag

SEQ ID NO: 313194 - RNA, 22 nt, Homo sapiens
gugagcagagaucgcgugauug

SEQ ID NO: 313195 - RNA, 22 nt, Homo sapiens
gugagcaguguccuugggggca

SEQ ID NO: 313196 - RNA, 22 nt, Homo sapiens
gugagccaugauuuuaccacug

SEQ ID NO: 313197 - RNA, 22 nt, Homo sapiens
gugagcuagaccacuuggcucc

SEQ ID NO: 313198 - RNA, 22 nt, Homo sapiens
gugauuuaguagaugcuaguua

SEQ ID NO: 313199 - RNA, 22 nt, Homo sapiens
gugcaaguguaauacagcuagg

SEQ ID NO: 313200 - RNA, 22 nt, Homo sapiens
gugcacaugguagguauugagu

SEQ ID NO: 313201 - RNA, 22 nt, Homo sapiens
gugcacgucuuaggaggucacg

SEQ ID NO: 313202 - RNA, 21 nt, Homo sapiens
gugcagaugccacagucacuc

SEQ ID NO: 313203 - RNA, 22 nt, Homo sapiens
gugcaguuuacaguuacccagu

SEQ ID NO: 313204 - RNA, 22 nt, Homo sapiens
gugcaugucuaugcgagucuaa

SEQ ID NO: 313205 - RNA, 22 nt, Homo sapiens
gugccacaguguuaagggauuc

SEQ ID NO: 313206 - RNA, 22 nt, Homo sapiens
guggaagaccagacuuuccaac

SEQ ID NO: 313207 - RNA, 22 nt, Homo sapiens
guggaagcacaggccuccugga

SEQ ID NO: 313208 - RNA, 20 nt, Homo sapiens
guggaaguagaaacauaugu

SEQ ID NO: 313209 - RNA, 22 nt, Homo sapiens
guggaaucuagagaggcaguag

SEQ ID NO: 313210 - RNA, 22 nt, Homo sapiens
guggagcuguguggccuugggc

SEQ ID NO: 313211 - RNA, 22 nt, Homo sapiens
guggaguaugaaaacugacuuu

SEQ ID NO: 313212 - RNA, 22 nt, Homo sapiens
guggagucaucacucagagugg

SEQ ID NO: 313213 - RNA, 22 nt, Homo sapiens
aaaagcuuagaugggcuuguau

SEQ ID NO: 313214 - RNA, 22 nt, Homo sapiens
aaacaccacgcggucccucgga

SEQ ID NO: 313215 - RNA, 21 nt, Homo sapiens
aguucacauggcuccuguguu

SEQ ID NO: 313216 - RNA, 22 nt, Homo sapiens
aguuccauuuauucucgucucu

SEQ ID NO: 313217 - RNA, 22 nt, Homo sapiens
uuggccuccuggucauauccag

SEQ ID NO: 313218 - RNA, 22 nt, Homo sapiens
uugggacccuguccuguaacaa

SEQ ID NO: 313219 - RNA, 22 nt, Homo sapiens
uugggacuggaaggaguaaggg

SEQ ID NO: 313220 - RNA, 22 nt, Homo sapiens
uugguccacugugaaauuggga

SEQ ID NO: 313221 - RNA, 19 nt, Homo sapiens
uuggucccuuuggguucuu

SEQ ID NO: 313222 - RNA, 22 nt, Homo sapiens
uugguuaccuucagaaaugagu

SEQ ID NO: 313223 - RNA, 22 nt, Homo sapiens
uugguuccauuuuaccagcucu

SEQ ID NO: 313224 - RNA, 22 nt, Homo sapiens
uugguucucuuuauaugcugga

SEQ ID NO: 313225 - RNA, 22 nt, Homo sapiens
uuguaacaugcuuucacuucag

SEQ ID NO: 313226 - RNA, 22 nt, Homo sapiens
uuguacuagucauauuuugaaa

SEQ ID NO: 313227 - RNA, 22 nt, Homo sapiens
uuguagaucuucaguugcuaca

SEQ ID NO: 313228 - RNA, 22 nt, Homo sapiens
uugugacacagcugggccuaua

SEQ ID NO: 313229 - RNA, 22 nt, Homo sapiens
uugugcauaucagagguuugcu

SEQ ID NO: 313230 - RNA, 22 nt, Homo sapiens
uugugguaggaguugccauguu

SEQ ID NO: 313231 - RNA, 22 nt, Homo sapiens
uugugucaaauggcaauuagca

SEQ ID NO: 313232 - RNA, 22 nt, Homo sapiens
uuguuuagagacuggaauuaaa

SEQ ID NO: 313233 - RNA, 22 nt, Homo sapiens
uuguuuuggagaugagcuaaaa

SEQ ID NO: 313234 - RNA, 22 nt, Homo sapiens
uuuaaagcuaaaauauguuuau

SEQ ID NO: 313235 - RNA, 20 nt, Homo sapiens
uuuaagacaugcugaauuga

SEQ ID NO: 313236 - RNA, 22 nt, Homo sapiens
uuuaaggcaugccuguacaugc

SEQ ID NO: 313237 - RNA, 22 nt, Homo sapiens
uuuaaugcacuaggugguguuc

SEQ ID NO: 313238 - RNA, 22 nt, Homo sapiens
uuuaaugcaucccaaaauguag

SEQ ID NO: 313239 - RNA, 22 nt, Homo sapiens
uuuaauguuacaguauugguau

SEQ ID NO: 313240 - RNA, 21 nt, Homo sapiens
uuuacuguggacccauugcuu

SEQ ID NO: 313241 - RNA, 22 nt, Homo sapiens
uuuagcaauucauuuugugucu

SEQ ID NO: 313242 - RNA, 22 nt, Homo sapiens
uuuauugcucuaaaguugccau

SEQ ID NO: 313243 - RNA, 22 nt, Homo sapiens
uuucaggcaagggugacccuga

SEQ ID NO: 313244 - RNA, 22 nt, Homo sapiens
uuucaggcagggagcuucagug

SEQ ID NO: 313245 - RNA, 22 nt, Homo sapiens
uuucaguagagacacgguuuug

SEQ ID NO: 313246 - RNA, 22 nt, Homo sapiens
uuucaucaagcacagaguagau

SEQ ID NO: 313247 - RNA, 22 nt, Homo sapiens
uuuccacauggacuuaccuucg

SEQ ID NO: 313248 - RNA, 22 nt, Homo sapiens
uuuccuguaggaaggaaauaga

SEQ ID NO: 313249 - RNA, 22 nt, Homo sapiens
uuucgugucuggucugugaugg

SEQ ID NO: 313250 - RNA, 21 nt, Homo sapiens
uuucugggggagcauggcagg

SEQ ID NO: 313251 - RNA, 22 nt, Homo sapiens
uuugaaguguggcacugaguuu

SEQ ID NO: 313252 - RNA, 22 nt, Homo sapiens
uuugaaugcaacaaaugcggga

SEQ ID NO: 313253 - RNA, 22 nt, Homo sapiens
uuugacuguggagucgaugcuu

SEQ ID NO: 313254 - RNA, 22 nt, Homo sapiens
uuuggcucugugucccacccaa

SEQ ID NO: 313255 - RNA, 22 nt, Homo sapiens
uuugggaaugaguuuaucauuu

SEQ ID NO: 313256 - RNA, 22 nt, Homo sapiens
uuugguccaguguucagguccu

SEQ ID NO: 313257 - RNA, 22 nt, Homo sapiens
uuugguccuccuacagggcagg

SEQ ID NO: 313258 - RNA, 18 nt, Homo sapiens
uuugguccuuuauaaaca

SEQ ID NO: 313259 - RNA, 22 nt, Homo sapiens
uuuguaauccuauuccaaagga

SEQ ID NO: 313260 - RNA, 23 nt, Homo sapiens
uuugugcuaauuuaugggcucuu

SEQ ID NO: 313261 - RNA, 22 nt, Homo sapiens
uuuguggaaugcucauguguag

SEQ ID NO: 313262 - RNA, 23 nt, Homo sapiens
uuugugucccucuagaauucaug

SEQ ID NO: 313263 - RNA, 18 nt, Homo sapiens
uuuugcuuaacugcgcca

SEQ ID NO: 313264 - RNA, 22 nt, Homo sapiens
uuuugguauacacaaggguccu

SEQ ID NO: 313265 - RNA, 22 nt, Homo sapiens
uuuuugaguaaauauaaauugu

SEQ ID NO: 313266 - RNA, 22 nt, Homo sapiens
uuuuuuaguuagcugggcauga

SEQ ID NO: 313267 - RNA, 22 nt, Homo sapiens
auggcuuuugaccugguaggau

SEQ ID NO: 313268 - RNA, 22 nt, Homo sapiens
auggcuuuugcccuaaauggau

SEQ ID NO: 313269 - RNA, 22 nt, Homo sapiens
auggcuuuuuucuugggcacuc

SEQ ID NO: 313270 - RNA, 22 nt, Homo sapiens
augggcaaauguuggaaauucc

SEQ ID NO: 313271 - RNA, 22 nt, Homo sapiens
ucacaguaaauccagaagaaau

SEQ ID NO: 313272 - RNA, 22 nt, Homo sapiens
ucacagucaaaguaaucauaga

SEQ ID NO: 313273 - RNA, 20 nt, Homo sapiens
ucacagucacacauaauccu

SEQ ID NO: 313274 - RNA, 22 nt, Homo sapiens
ucacagugcaggaucaguuaau

SEQ ID NO: 313275 - RNA, 22 nt, Homo sapiens
ucacaugaagauuuuaguauac

SEQ ID NO: 313276 - RNA, 22 nt, Homo sapiens
ucacaugcacaucucuggaacc

SEQ ID NO: 313277 - RNA, 18 nt, Homo sapiens
ucacauggccgagagaga

SEQ ID NO: 313278 - RNA, 22 nt, Homo sapiens
ucacauggggaagggacuagcu

SEQ ID NO: 313279 - RNA, 22 nt, Homo sapiens
ucacaugggugcaauauaauca

SEQ ID NO: 313280 - RNA, 22 nt, Homo sapiens
ucacauuguuauguaaauguuu

SEQ ID NO: 313281 - RNA, 22 nt, Homo sapiens
ucacgugguucauaaggcagaa

SEQ ID NO: 313282 - RNA, 22 nt, Homo sapiens
ucacuagggagaaacugaggcu

SEQ ID NO: 313283 - RNA, 20 nt, Homo sapiens
ucacugagugguccacagua

SEQ ID NO: 313284 - RNA, 20 nt, Homo sapiens
ucacuggagcucauuugauu

SEQ ID NO: 313285 - RNA, 22 nt, Homo sapiens
ucacuggccaaauucuggguga

SEQ ID NO: 313286 - RNA, 20 nt, Homo sapiens
ucacuggguucuugaagucu

SEQ ID NO: 313287 - RNA, 22 nt, Homo sapiens
ucacugugguuggaaggcuuaa

SEQ ID NO: 313288 - RNA, 22 nt, Homo sapiens
ugcauuguggaucuaaaugcau

SEQ ID NO: 313289 - RNA, 22 nt, Homo sapiens
ugccaagaacauuuucuguuuu

SEQ ID NO: 313290 - RNA, 22 nt, Homo sapiens
ugccaaggagucagucccuaga

SEQ ID NO: 313291 - RNA, 22 nt, Homo sapiens
ugccauagcaaugguaagcuga

SEQ ID NO: 313292 - RNA, 19 nt, Homo sapiens
ugccauguagcacaugguc

SEQ ID NO: 313293 - RNA, 22 nt, Homo sapiens
ugccuaggcccaguccucagaa

SEQ ID NO: 313294 - RNA, 22 nt, Homo sapiens
ugccuaggcuggagugcagugg

SEQ ID NO: 313295 - RNA, 22 nt, Homo sapiens
ugccuucuguuaaacgaggaug

SEQ ID NO: 313296 - RNA, 22 nt, Homo sapiens
ugcuagaugaaguuugaguuuu

SEQ ID NO: 313297 - RNA, 21 nt, Homo sapiens
ugcucaugaguaaugcaguga

SEQ ID NO: 313298 - RNA, 19 nt, Homo sapiens
ugcugcauugugaccuugc

SEQ ID NO: 313299 - RNA, 22 nt, Homo sapiens
ugcugguuuaaaaugcaaauuc

SEQ ID NO: 313300 - RNA, 22 nt, Homo sapiens
uggaaaauuaggggagguuaua

SEQ ID NO: 313301 - RNA, 20 nt, Homo sapiens
uggaaaguaagucaugauau

SEQ ID NO: 313302 - RNA, 22 nt, Homo sapiens
uggaaaguacuugaguuuguau

SEQ ID NO: 313303 - RNA, 22 nt, Homo sapiens
uggaaauaaaauagaguuugcc

SEQ ID NO: 313304 - RNA, 22 nt, Homo sapiens
uggaagacucaagguggugaau

SEQ ID NO: 313305 - RNA, 22 nt, Homo sapiens
uggaagauggaguuuuaucauu

SEQ ID NO: 313306 - RNA, 22 nt, Homo sapiens
uggaagccuagauucuuuucuu

SEQ ID NO: 313307 - RNA, 22 nt, Homo sapiens
uggaaucaucaacgaaugaaau

SEQ ID NO: 313308 - RNA, 21 nt, Homo sapiens
uggaauuaauggagagguguu

SEQ ID NO: 313309 - RNA, 22 nt, Homo sapiens
uuauugcuuuugugcaggugag

SEQ ID NO: 313310 - RNA, 22 nt, Homo sapiens
uucaagaauuaaaguggcuuuu

SEQ ID NO: 313311 - RNA, 22 nt, Homo sapiens
uucaauuaauauuauacucuca

SEQ ID NO: 313312 - RNA, 22 nt, Homo sapiens
uucacagagagaacucaaacca

SEQ ID NO: 313313 - RNA, 22 nt, Homo sapiens
uucacaguacucccuggaauua

SEQ ID NO: 313314 - RNA, 22 nt, Homo sapiens
uucaccaguuuugucacgaaug

SEQ ID NO: 313315 - RNA, 22 nt, Homo sapiens
uucacugcacuccagccugagc

SEQ ID NO: 313316 - RNA, 20 nt, Homo sapiens
uucacugggcucucuguugg

SEQ ID NO: 313317 - RNA, 22 nt, Homo sapiens
uucagagagggagggauaccua

SEQ ID NO: 313318 - RNA, 22 nt, Homo sapiens
uucaggcaccauugucauugau

SEQ ID NO: 313319 - RNA, 22 nt, Homo sapiens
uucaguacacguguucucauuu

SEQ ID NO: 313320 - RNA, 22 nt, Homo sapiens
uucaguggagaggcugaguggu

SEQ ID NO: 313321 - RNA, 19 nt, Homo sapiens
uucauacagugagagcagc

SEQ ID NO: 313322 - RNA, 22 nt, Homo sapiens
uucauacaguggcugcacucca

SEQ ID NO: 313323 - RNA, 22 nt, Homo sapiens
uucauagaggacauuacuggag

SEQ ID NO: 313324 - RNA, 18 nt, Homo sapiens
uucauaguagcaugauuu

SEQ ID NO: 313325 - RNA, 22 nt, Homo sapiens
uucauaguucuuuuagucauua

SEQ ID NO: 313326 - RNA, 22 nt, Homo sapiens
uucaucacagucuccgaugccc

SEQ ID NO: 313327 - RNA, 22 nt, Homo sapiens
uucaucagcuguagaugucaug

SEQ ID NO: 313328 - RNA, 22 nt, Homo sapiens
uucaucaguuauauuggccuga

SEQ ID NO: 313329 - RNA, 22 nt, Homo sapiens
uucauggaauauugaccauuuu

SEQ ID NO: 313330 - RNA, 22 nt, Homo sapiens
uucauggugguacaaaagcaau

SEQ ID NO: 313331 - RNA, 22 nt, Homo sapiens
uucauguaauuccauaagguaa

SEQ ID NO: 313332 - RNA, 22 nt, Homo sapiens
uucaugucuuggcuguuagagu

SEQ ID NO: 313333 - RNA, 22 nt, Homo sapiens
uuccacagggauuugcauugau

SEQ ID NO: 313334 - RNA, 22 nt, Homo sapiens
uuccaggugggcgugggccugg

SEQ ID NO: 313335 - RNA, 22 nt, Homo sapiens
uuccaguaauagcacagcauug

SEQ ID NO: 313336 - RNA, 22 nt, Homo sapiens
uuccaguguuugacucaccuuu

SEQ ID NO: 313337 - RNA, 22 nt, Homo sapiens
uuccauaggcuagaucaaccag

SEQ ID NO: 313338 - RNA, 22 nt, Homo sapiens
uucccugagcaucuguugagcc

SEQ ID NO: 313339 - RNA, 22 nt, Homo sapiens
uucccuuucugaaaaucucauu

SEQ ID NO: 313340 - RNA, 22 nt, Homo sapiens
uucccuuucugccuugaaucuu

SEQ ID NO: 313341 - RNA, 22 nt, Homo sapiens
uucccuuucuuaaagaguuagg

SEQ ID NO: 313342 - RNA, 22 nt, Homo sapiens
uuccuaguccugagucucugcg

SEQ ID NO: 313343 - RNA, 22 nt, Homo sapiens
uuccugugacccccaagcccac

SEQ ID NO: 313344 - RNA, 22 nt, Homo sapiens
uucuacagugacugcagccaua

SEQ ID NO: 313345 - RNA, 22 nt, Homo sapiens
uucuaugguuuuuaugguguua

SEQ ID NO: 313346 - RNA, 22 nt, Homo sapiens
uucucaguaauuccagauuuuu

SEQ ID NO: 313347 - RNA, 22 nt, Homo sapiens
uucucugggacauaggucgggu

SEQ ID NO: 313348 - RNA, 22 nt, Homo sapiens
uucucuggucagaggggagguu

SEQ ID NO: 313349 - RNA, 19 nt, Homo sapiens
uucucugguuguacuaccc

SEQ ID NO: 313350 - RNA, 22 nt, Homo sapiens
uucugugguugaaaggagagau

SEQ ID NO: 313351 - RNA, 22 nt, Homo sapiens
uucugugguuucauuuaccugu

SEQ ID NO: 313352 - RNA, 22 nt, Homo sapiens
uucuucaggccacaaaaauggu

SEQ ID NO: 313353 - RNA, 22 nt, Homo sapiens
uugaaagaaaggagacugaguu

SEQ ID NO: 313354 - RNA, 22 nt, Homo sapiens
uugaaaucuuccacagcccaag

SEQ ID NO: 313355 - RNA, 22 nt, Homo sapiens
uugaagacuaaguuaucaggau

SEQ ID NO: 313356 - RNA, 22 nt, Homo sapiens
uugaaggaggugcucacucucg

SEQ ID NO: 313357 - RNA, 22 nt, Homo sapiens
uugaagguaauugguuuuauga

SEQ ID NO: 313358 - RNA, 22 nt, Homo sapiens
uugaagguaggaugugcuauca

SEQ ID NO: 313359 - RNA, 22 nt, Homo sapiens
uugaaguaggaaaggaggaggu

SEQ ID NO: 313360 - RNA, 22 nt, Homo sapiens
uugaaguguguauacauugugg

SEQ ID NO: 313361 - RNA, 23 nt, Homo sapiens
uugaauguuuccccucccaaauu

SEQ ID NO: 313362 - RNA, 20 nt, Homo sapiens
uugacaguggguuguuaaag

SEQ ID NO: 313363 - RNA, 22 nt, Homo sapiens
uugacugggccagacagagauc

SEQ ID NO: 313364 - RNA, 22 nt, Homo sapiens
uugagauaggaacucacuaugc

SEQ ID NO: 313365 - RNA, 22 nt, Homo sapiens
uugagaucaugcuacugcacuc

SEQ ID NO: 313366 - RNA, 22 nt, Homo sapiens
uugagauggagucuugcgcugu

SEQ ID NO: 313367 - RNA, 22 nt, Homo sapiens
uugagcaaaacauuaauauuag

SEQ ID NO: 313368 - RNA, 22 nt, Homo sapiens
uugagcauugguauagguuuua

SEQ ID NO: 313369 - RNA, 22 nt, Homo sapiens
uugaggacugagacagaccaag

SEQ ID NO: 313370 - RNA, 22 nt, Homo sapiens
uugaggaggcagucuguccguu

SEQ ID NO: 313371 - RNA, 22 nt, Homo sapiens
uugaggccugauaacacacuga

SEQ ID NO: 313372 - RNA, 22 nt, Homo sapiens
uugagggaggcagggcuugucu

SEQ ID NO: 313373 - RNA, 22 nt, Homo sapiens
uugagguuggaggccuugccug

SEQ ID NO: 313374 - RNA, 22 nt, Homo sapiens
uugauauuacucaguaacagau

SEQ ID NO: 313375 - RNA, 22 nt, Homo sapiens
uugauauucugagaagcugaag

SEQ ID NO: 313376 - RNA, 22 nt, Homo sapiens
uugaucacuguacuaugacuau

SEQ ID NO: 313377 - RNA, 20 nt, Homo sapiens
uugauucccucuaaacucgc

SEQ ID NO: 313378 - RNA, 22 nt, Homo sapiens
uugcagcaaagagggaggggca

SEQ ID NO: 313379 - RNA, 22 nt, Homo sapiens
uugcauaagugcauucugugau

SEQ ID NO: 313380 - RNA, 22 nt, Homo sapiens
uugcaucagcaggcauaauugg

SEQ ID NO: 313381 - RNA, 22 nt, Homo sapiens
uugcaugcacaguucucaauag

SEQ ID NO: 313382 - RNA, 22 nt, Homo sapiens
uugcaugcuccuuaugagaauc

SEQ ID NO: 313383 - RNA, 22 nt, Homo sapiens
uugcauuuucuaggagggcaaa

SEQ ID NO: 313384 - RNA, 22 nt, Homo sapiens
uugccugagaagccaagaauaa

SEQ ID NO: 313385 - RNA, 22 nt, Homo sapiens
uugcuccucugccaggaccugu

SEQ ID NO: 313386 - RNA, 22 nt, Homo sapiens
cagugcauagaugugccacauu

SEQ ID NO: 313387 - RNA, 22 nt, Homo sapiens
caguguaugcuucuauuuuugg

SEQ ID NO: 313388 - RNA, 22 nt, Homo sapiens
cagugucugcauuuggaacuca

SEQ ID NO: 313389 - RNA, 22 nt, Homo sapiens
cauacaagcuacaaucacaaag

SEQ ID NO: 313390 - RNA, 22 nt, Homo sapiens
cauagcacacguauaccuaugu

SEQ ID NO: 313391 - RNA, 18 nt, Homo sapiens
cauagcacuucagcacau

SEQ ID NO: 313392 - RNA, 22 nt, Homo sapiens
caucagagugagauauaagauc

SEQ ID NO: 313393 - RNA, 22 nt, Homo sapiens
caugcauuggucuauuauguga

SEQ ID NO: 313394 - RNA, 22 nt, Homo sapiens
caugccauugcucuccugggug

SEQ ID NO: 313395 - RNA, 22 nt, Homo sapiens
cauggucaccuuccaaguuauu

SEQ ID NO: 313396 - RNA, 22 nt, Homo sapiens
cauugcauuuucuuuguaccuu

SEQ ID NO: 313397 - RNA, 22 nt, Homo sapiens
cauugcccuccagccugggcaa

SEQ ID NO: 313398 - RNA, 22 nt, Homo sapiens
cauugguuccaguuuguccuua

SEQ ID NO: 313399 - RNA, 22 nt, Homo sapiens
cauugguugaacagauuguguu

SEQ ID NO: 313400 - RNA, 22 nt, Homo sapiens
cauugguuuauagauggggaaa

SEQ ID NO: 313401 - RNA, 22 nt, Homo sapiens
cauuugcacugagacucagcuu

SEQ ID NO: 313402 - RNA, 22 nt, Homo sapiens
ccaagccucaguuucccucugu

SEQ ID NO: 313403 - RNA, 22 nt, Homo sapiens
ccaagugcuuaaaauuucauuu

SEQ ID NO: 313404 - RNA, 23 nt, Homo sapiens
ccacaaugguugaacuagauuac

SEQ ID NO: 313405 - RNA, 22 nt, Homo sapiens
ccacccuuccauucuuccucuu

SEQ ID NO: 313406 - RNA, 22 nt, Homo sapiens
ccacugggcuagguguuuugga

SEQ ID NO: 313407 - RNA, 22 nt, Homo sapiens
ccagucuuggugucuguagcac

SEQ ID NO: 313408 - RNA, 21 nt, Homo sapiens
ccaguguaaugauagcaggca

SEQ ID NO: 313409 - RNA, 22 nt, Homo sapiens
ccagugucugacagacacggcg

SEQ ID NO: 313410 - RNA, 22 nt, Homo sapiens
ccaguguucuggaaggcugagu

SEQ ID NO: 313411 - RNA, 22 nt, Homo sapiens
ccaguguuuggauuagggaugc

SEQ ID NO: 313412 - RNA, 22 nt, Homo sapiens
ccaguguuuuugaauuccagga

SEQ ID NO: 313413 - RNA, 22 nt, Homo sapiens
ccauugcacuccauccugggca

SEQ ID NO: 313414 - RNA, 22 nt, Homo sapiens
ccauuugguuauguaucgaaac

SEQ ID NO: 313415 - RNA, 22 nt, Homo sapiens
cccacaguggccucauauccuu

SEQ ID NO: 313416 - RNA, 21 nt, Homo sapiens
cccagguucucugaggguaga

SEQ ID NO: 313417 - RNA, 22 nt, Homo sapiens
cccaguguuacgugacagccug

SEQ ID NO: 313418 - RNA, 22 nt, Homo sapiens
ccccggguucugucugcccuug

SEQ ID NO: 313419 - RNA, 20 nt, Homo sapiens
ccccuggaguggggcugcuu

SEQ ID NO: 313420 - RNA, 22 nt, Homo sapiens
cccuggacacacacuuuuauuc

SEQ ID NO: 313421 - RNA, 22 nt, Homo sapiens
cccuggacauucaucauuaugu

SEQ ID NO: 313422 - RNA, 22 nt, Homo sapiens
ccucacaaccuuuauugaagag

SEQ ID NO: 313423 - RNA, 21 nt, Homo sapiens
ccuccauuuguauucuugccc

SEQ ID NO: 313424 - RNA, 21 nt, Homo sapiens
ccucuuugagggaagaaaggg

SEQ ID NO: 313425 - RNA, 22 nt, Homo sapiens
ccugagacgaauggagugaaca

SEQ ID NO: 313426 - RNA, 19 nt, Homo sapiens
ccugcuguucuuuugcacc

SEQ ID NO: 313427 - RNA, 22 nt, Homo sapiens
ccuguagcauccaagaagcugc

SEQ ID NO: 313428 - RNA, 22 nt, Homo sapiens
ccuugucacugaguggaaugaa

SEQ ID NO: 313429 - RNA, 22 nt, Homo sapiens
cuaaagauagugacaugauuug

SEQ ID NO: 313430 - RNA, 22 nt, Homo sapiens
cuaagggaggaagcugugcagg

SEQ ID NO: 313431 - RNA, 22 nt, Homo sapiens
cuaaugcagucaggagaaggaa

SEQ ID NO: 313432 - RNA, 22 nt, Homo sapiens
cuacacaugcaggcucccugcc

SEQ ID NO: 313433 - RNA, 22 nt, Homo sapiens
cuacaguagagaggauguagaa

SEQ ID NO: 313434 - RNA, 23 nt, Homo sapiens
cuacagugccugucucuuuggcc

SEQ ID NO: 313435 - RNA, 22 nt, Homo sapiens
cuacagugggucuguaguccuu

SEQ ID NO: 313436 - RNA, 22 nt, Homo sapiens
cuacugcacaucaucugaguua

SEQ ID NO: 313437 - RNA, 22 nt, Homo sapiens
cuagauuauccaacuuauuagc

SEQ ID NO: 313438 - RNA, 22 nt, Homo sapiens
cuaugguaggggcuggaggaag

SEQ ID NO: 313439 - RNA, 22 nt, Homo sapiens
cuauuacuuuuauugaacucag

SEQ ID NO: 313440 - RNA, 22 nt, Homo sapiens
cuauuagguuggugcaaaagua

SEQ ID NO: 313441 - RNA, 20 nt, Homo sapiens
cuauugacauuuggggcuag

SEQ ID NO: 313442 - RNA, 22 nt, Homo sapiens
cuauuugguuggugaaaaaagu

SEQ ID NO: 313443 - RNA, 20 nt, Homo sapiens
cucacagacagcuucuuucu

SEQ ID NO: 313444 - RNA, 22 nt, Homo sapiens
cucacuggguguaaaacaugua

SEQ ID NO: 313445 - RNA, 22 nt, Homo sapiens
cucacugugguguccuuaggua

SEQ ID NO: 313446 - RNA, 22 nt, Homo sapiens
cucagauacuugggagguugag

SEQ ID NO: 313447 - RNA, 22 nt, Homo sapiens
cucaggcacucugauuccagug

SEQ ID NO: 313448 - RNA, 22 nt, Homo sapiens
cucagugucuggcacacagaaa

SEQ ID NO: 313449 - RNA, 22 nt, Homo sapiens
cucauggaauacuucacagcca

SEQ ID NO: 313450 - RNA, 22 nt, Homo sapiens
cucauuggcuacugaggcuugu

SEQ ID NO: 313451 - RNA, 22 nt, Homo sapiens
cuccaguuucagaaucccaugu

SEQ ID NO: 313452 - RNA, 23 nt, Homo sapiens
cuccaugagccguccagggccug

SEQ ID NO: 313453 - RNA, 22 nt, Homo sapiens
cuccccuuuaguuucuuaauaa

SEQ ID NO: 313454 - RNA, 23 nt, Homo sapiens
cucccugaacaugacacaccaga

SEQ ID NO: 313455 - RNA, 22 nt, Homo sapiens
cucccuuugcugaauguuuuuc

SEQ ID NO: 313456 - RNA, 22 nt, Homo sapiens
cucucugagccccagacaccuu

SEQ ID NO: 313457 - RNA, 17 nt, Homo sapiens
cucucugguuuaaagca

SEQ ID NO: 313458 - RNA, 22 nt, Homo sapiens
cucuggauauuccugucuaaaa

SEQ ID NO: 313459 - RNA, 22 nt, Homo sapiens
cucuuuuguuccuaguuugauc

SEQ ID NO: 313460 - RNA, 22 nt, Homo sapiens
cugaaauggaaugugugcacag

SEQ ID NO: 313461 - RNA, 22 nt, Homo sapiens
cugacacuucaaaacugccaau

SEQ ID NO: 313462 - RNA, 22 nt, Homo sapiens
cugacuaguuuuaaugcagauu

SEQ ID NO: 313463 - RNA, 22 nt, Homo sapiens
cugagacuggugauuuaugaag

SEQ ID NO: 313464 - RNA, 22 nt, Homo sapiens
cugaggacaucagggaagcauc

SEQ ID NO: 313465 - RNA, 22 nt, Homo sapiens
cugaggguagaaggaucacuug

SEQ ID NO: 313466 - RNA, 20 nt, Homo sapiens
cugagguugggguccuuccc

SEQ ID NO: 313467 - RNA, 22 nt, Homo sapiens
cugcaagaaucguaguauuuga

SEQ ID NO: 313468 - RNA, 19 nt, Homo sapiens
cugcaagguaauaggucag

SEQ ID NO: 313469 - RNA, 22 nt, Homo sapiens
cugcagaucuuggggcuugcca

SEQ ID NO: 313470 - RNA, 21 nt, Homo sapiens
cugcauccauuucugagugau

SEQ ID NO: 313471 - RNA, 20 nt, Homo sapiens
cugcuccccuacaaaucuca

SEQ ID NO: 313472 - RNA, 22 nt, Homo sapiens
cuggaaacaucuuaggaaugca

SEQ ID NO: 313473 - RNA, 22 nt, Homo sapiens
cuggaaagaaucaggcuaaacu

SEQ ID NO: 313474 - RNA, 22 nt, Homo sapiens
cuggagcaaaggugacucuugu

SEQ ID NO: 313475 - RNA, 22 nt, Homo sapiens
cuggagcauugguggauuuguu

SEQ ID NO: 313476 - RNA, 22 nt, Homo sapiens
cuggaggccugaacauaaaugg

SEQ ID NO: 313477 - RNA, 20 nt, Homo sapiens
cuggaugucgaggcagaggu

SEQ ID NO: 313478 - RNA, 22 nt, Homo sapiens
cuggcaguguuucuugugggcu

SEQ ID NO: 313479 - RNA, 21 nt, Homo sapiens
cugguccccuuuauguaugug

SEQ ID NO: 313480 - RNA, 22 nt, Homo sapiens
cuguaaaguucucauuguagcc

SEQ ID NO: 313481 - RNA, 22 nt, Homo sapiens
cugucuggaguccuucgugugc

SEQ ID NO: 313482 - RNA, 20 nt, Homo sapiens
cugugguagggaccaggaau

SEQ ID NO: 313483 - RNA, 22 nt, Homo sapiens
cugugguugagcuuugccauga

SEQ ID NO: 313484 - RNA, 22 nt, Homo sapiens
cuucaaaguuggcuaggagaca

SEQ ID NO: 313485 - RNA, 22 nt, Homo sapiens
cuucaccaguuuggcagucuca

SEQ ID NO: 313486 - RNA, 22 nt, Homo sapiens
uugacauaaucauuucacagug

SEQ ID NO: 313487 - RNA, 22 nt, Homo sapiens
uugacauguaggcagggaaugg

SEQ ID NO: 313488 - RNA, 22 nt, Homo sapiens
uugagaagugucuguucauguc

SEQ ID NO: 313489 - RNA, 22 nt, Homo sapiens
uugagggaagccagaggucugc

SEQ ID NO: 313490 - RNA, 22 nt, Homo sapiens
uugaggguggcauauauugauu

SEQ ID NO: 313491 - RNA, 22 nt, Homo sapiens
uugagguagcuuugauggaggu

SEQ ID NO: 313492 - RNA, 22 nt, Homo sapiens
uugaggugaagggcagagcagc

SEQ ID NO: 313493 - RNA, 22 nt, Homo sapiens
uugaggugggaggaucacuuga

SEQ ID NO: 313494 - RNA, 22 nt, Homo sapiens
uugaguuuaucuaaagaccugg

SEQ ID NO: 313495 - RNA, 22 nt, Homo sapiens
uugauagguuuuauguauaguu

SEQ ID NO: 313496 - RNA, 22 nt, Homo sapiens
uugaucaucagcuuugucaucu

SEQ ID NO: 313497 - RNA, 22 nt, Homo sapiens
uugauccucugagaaucuaucg

SEQ ID NO: 313498 - RNA, 22 nt, Homo sapiens
uugaugauguuucugccuugcc

SEQ ID NO: 313499 - RNA, 22 nt, Homo sapiens
uugcaaagaccucuucacuucc

SEQ ID NO: 313500 - RNA, 22 nt, Homo sapiens
uugcaacauuguaaguuuauau

SEQ ID NO: 313501 - RNA, 22 nt, Homo sapiens
uugcacauuuuuucuggcagaa

SEQ ID NO: 313502 - RNA, 22 nt, Homo sapiens
uugcacuauuaguauagauguc

SEQ ID NO: 313503 - RNA, 22 nt, Homo sapiens
uugcacucugaagaccuacugu

SEQ ID NO: 313504 - RNA, 22 nt, Homo sapiens
uugcagagccccacacugggcu

SEQ ID NO: 313505 - RNA, 22 nt, Homo sapiens
uugcagagccccugcaaggguc

SEQ ID NO: 313506 - RNA, 22 nt, Homo sapiens
uugcauagacaauauuaaucuu

SEQ ID NO: 313507 - RNA, 23 nt, Homo sapiens
uugcauagacauccucauagauu

SEQ ID NO: 313508 - RNA, 22 nt, Homo sapiens
uugcauuagugugguacauuug

SEQ ID NO: 313509 - RNA, 22 nt, Homo sapiens
uugcauugacacaugaagcuca

SEQ ID NO: 313510 - RNA, 22 nt, Homo sapiens
uugccaauauuuuacugagaag

SEQ ID NO: 313511 - RNA, 22 nt, Homo sapiens
uugccgggugcaguggcucaug

SEQ ID NO: 313512 - RNA, 22 nt, Homo sapiens
uugccuaggcuggaguguggug

SEQ ID NO: 313513 - RNA, 22 nt, Homo sapiens
uugcuucauucaacauugaggg

SEQ ID NO: 313514 - RNA, 22 nt, Homo sapiens
uuggaaacaccuggugagguua

SEQ ID NO: 313515 - RNA, 22 nt, Homo sapiens
uuggaaaccucugcagguguuu

SEQ ID NO: 313516 - RNA, 22 nt, Homo sapiens
uuggaacacauguuuuucuacc

SEQ ID NO: 313517 - RNA, 22 nt, Homo sapiens
uuggaacuguucguauugaaau

SEQ ID NO: 313518 - RNA, 22 nt, Homo sapiens
uuggaagacaaugcugauucuc

SEQ ID NO: 313519 - RNA, 22 nt, Homo sapiens
uuggaauuuuaaaauaggcaac

SEQ ID NO: 313520 - RNA, 22 nt, Homo sapiens
uuggaauuuuacuucuguaaga

SEQ ID NO: 313521 - RNA, 22 nt, Homo sapiens
uuggacugugagguuucguggg

SEQ ID NO: 313522 - RNA, 22 nt, Homo sapiens
uuggagagucacuaguuagugc

SEQ ID NO: 313523 - RNA, 22 nt, Homo sapiens
uuggagugugagagcagccugg

SEQ ID NO: 313524 - RNA, 22 nt, Homo sapiens
uuggcaaagugucuggcauuua

SEQ ID NO: 313525 - RNA, 22 nt, Homo sapiens
uuggcaaauagguuuuauugca

SEQ ID NO: 313526 - RNA, 21 nt, Homo sapiens
uuggcacucuucucuccuuau

SEQ ID NO: 313527 - RNA, 22 nt, Homo sapiens
uuggcacugggaaaaugaccac

SEQ ID NO: 313528 - RNA, 22 nt, Homo sapiens
uuggccccuccaaaucucaugu

SEQ ID NO: 313529 - RNA, 22 nt, Homo sapiens
uuggccccucccaaauuucaug

SEQ ID NO: 313530 - RNA, 21 nt, Homo sapiens
uuggggaauggagagguuuuc

SEQ ID NO: 313531 - RNA, 21 nt, Homo sapiens
uugguccacaugucauaguua

SEQ ID NO: 313532 - RNA, 22 nt, Homo sapiens
uugguccccuucaaccagcugu

SEQ ID NO: 313533 - RNA, 22 nt, Homo sapiens
uuguauccaucuuucaggcaac

SEQ ID NO: 313534 - RNA, 22 nt, Homo sapiens
uugucaaacucauucuccaucc

SEQ ID NO: 313535 - RNA, 22 nt, Homo sapiens
uuguccaagucccauuuguuga

SEQ ID NO: 313536 - RNA, 16 nt, Homo sapiens
uugucccuucccaaau

SEQ ID NO: 313537 - RNA, 22 nt, Homo sapiens
uuguccuccacauuugaucagu

SEQ ID NO: 313538 - RNA, 21 nt, Homo sapiens
uugucuagagaaauauaucuc

SEQ ID NO: 313539 - RNA, 22 nt, Homo sapiens
uugucuagugaauacauuaaug

SEQ ID NO: 313540 - RNA, 22 nt, Homo sapiens
uugugaaaucuaggcagagguu

SEQ ID NO: 313541 - RNA, 22 nt, Homo sapiens
uugugcaaaaguaauugcgguu

SEQ ID NO: 313542 - RNA, 22 nt, Homo sapiens
uugugccauucuucugccucag

SEQ ID NO: 313543 - RNA, 22 nt, Homo sapiens
uuguguuuuuaguagggaaggg

SEQ ID NO: 313544 - RNA, 22 nt, Homo sapiens
uuguuauguuaaacuacugaaa

SEQ ID NO: 313545 - RNA, 22 nt, Homo sapiens
uuuaaugcugcccagucauggg

SEQ ID NO: 313546 - RNA, 18 nt, Homo sapiens
uuuacaguagaaggacuu

SEQ ID NO: 313547 - RNA, 22 nt, Homo sapiens
uuuauucggcuaggagcuucgg

SEQ ID NO: 313548 - RNA, 23 nt, Homo sapiens
uuucacaguagcuggaucagccu

SEQ ID NO: 313549 - RNA, 22 nt, Homo sapiens
uuucacaguguucucccccaga

SEQ ID NO: 313550 - RNA, 22 nt, Homo sapiens
uuucauagccuucuaaugaguu

SEQ ID NO: 313551 - RNA, 20 nt, Homo sapiens
uacaggacugagaaucugug

SEQ ID NO: 313552 - RNA, 22 nt, Homo sapiens
uacagguauagauguguguucu

SEQ ID NO: 313553 - RNA, 22 nt, Homo sapiens
uacaggugcuuauguggacaua

SEQ ID NO: 313554 - RNA, 22 nt, Homo sapiens
uacaguaauguuaaucuuugug

SEQ ID NO: 313555 - RNA, 22 nt, Homo sapiens
uacaguauuaugagugauugaa

SEQ ID NO: 313556 - RNA, 22 nt, Homo sapiens
uacauugucauauucucucucu

SEQ ID NO: 313557 - RNA, 22 nt, Homo sapiens
uaccaguaaugguucuagagga

SEQ ID NO: 313558 - RNA, 22 nt, Homo sapiens
uacguuaucagguaugcaagag

SEQ ID NO: 313559 - RNA, 22 nt, Homo sapiens
uacucacauucuguuucuugcu

SEQ ID NO: 313560 - RNA, 22 nt, Homo sapiens
uacucaguaagugcuggcugcu

SEQ ID NO: 313561 - RNA, 22 nt, Homo sapiens
uacugcacauaugaagguuccc

SEQ ID NO: 313562 - RNA, 22 nt, Homo sapiens
uagaaagcaugaccuucagaua

SEQ ID NO: 313563 - RNA, 22 nt, Homo sapiens
uagaagcacuaucccuccuagu

SEQ ID NO: 313564 - RNA, 22 nt, Homo sapiens
uagaaguaggcuacgugucugg

SEQ ID NO: 313565 - RNA, 18 nt, Homo sapiens
uagaauauaggucauucu

SEQ ID NO: 313566 - RNA, 22 nt, Homo sapiens
uagagguauuaacaguagaaga

SEQ ID NO: 313567 - RNA, 22 nt, Homo sapiens
uagaucacucaggcaauaaaag

SEQ ID NO: 313568 - RNA, 23 nt, Homo sapiens
uagaucaucaaguuuacugugcu

SEQ ID NO: 313569 - RNA, 22 nt, Homo sapiens
uagcaaaucaauggaauugaag

SEQ ID NO: 313570 - RNA, 17 nt, Homo sapiens
uagcacagugccuggua

SEQ ID NO: 313571 - RNA, 20 nt, Homo sapiens
uagcacaucuggcuguagag

SEQ ID NO: 313572 - RNA, 22 nt, Homo sapiens
uagcacaugucagguaauuugc

SEQ ID NO: 313573 - RNA, 22 nt, Homo sapiens
uagcagaauaacuugccagccu

SEQ ID NO: 313574 - RNA, 20 nt, Homo sapiens
uagcagcagacagagggagg

SEQ ID NO: 313575 - RNA, 22 nt, Homo sapiens
uagcauccuucucuaaacagga

SEQ ID NO: 313576 - RNA, 20 nt, Homo sapiens
uagccggguguugugucaug

SEQ ID NO: 313577 - RNA, 22 nt, Homo sapiens
uagcuccagugggguuacugcu

SEQ ID NO: 313578 - RNA, 21 nt, Homo sapiens
uagcugcacccaggccuccuu

SEQ ID NO: 313579 - RNA, 22 nt, Homo sapiens
uaggacacaggacauauguaga

SEQ ID NO: 313580 - RNA, 22 nt, Homo sapiens
uaggagcacagcagcauguggg

SEQ ID NO: 313581 - RNA, 22 nt, Homo sapiens
uaggcaaguugcccaaucucuc

SEQ ID NO: 313582 - RNA, 21 nt, Homo sapiens
uaggccgggugcaggaugcuu

SEQ ID NO: 313583 - RNA, 22 nt, Homo sapiens
uagggaguguccuuucgggaaa

SEQ ID NO: 313584 - RNA, 19 nt, Homo sapiens
uagggcacgaggcagaguc

SEQ ID NO: 313585 - RNA, 22 nt, Homo sapiens
uaggggcacacuucgguuagca

SEQ ID NO: 313586 - RNA, 22 nt, Homo sapiens
uagguaaguaugugugaugggg

SEQ ID NO: 313587 - RNA, 20 nt, Homo sapiens
uagguuuucacagaauugcc

SEQ ID NO: 313588 - RNA, 22 nt, Homo sapiens
uaguaaacauaguucuuuugcu

SEQ ID NO: 313589 - RNA, 22 nt, Homo sapiens
uaguagcauaccuaaguauacu

SEQ ID NO: 313590 - RNA, 22 nt, Homo sapiens
uaguccauuuucaugcugcuau

SEQ ID NO: 313591 - RNA, 22 nt, Homo sapiens
uagugcacuacuugugggaaug

SEQ ID NO: 313592 - RNA, 22 nt, Homo sapiens
uagugcaguggcuccaucucag

SEQ ID NO: 313593 - RNA, 22 nt, Homo sapiens
uauacaugugggcaucaggaga

SEQ ID NO: 313594 - RNA, 22 nt, Homo sapiens
uauacuguuuucuauaguggcu

SEQ ID NO: 313595 - RNA, 22 nt, Homo sapiens
uauagcauuuugauccuguaga

SEQ ID NO: 313596 - RNA, 22 nt, Homo sapiens
uucauaguaacaguaacuaugg

SEQ ID NO: 313597 - RNA, 22 nt, Homo sapiens
uucauagucacauucgaugucu

SEQ ID NO: 313598 - RNA, 22 nt, Homo sapiens
uucauagucuaugcaaguaaga

SEQ ID NO: 313599 - RNA, 22 nt, Homo sapiens
uucauggaguugagaaggcuaa

SEQ ID NO: 313600 - RNA, 22 nt, Homo sapiens
uucauggaugcauuugaggggu

SEQ ID NO: 313601 - RNA, 20 nt, Homo sapiens
uucaugggagcaaagaggcc

SEQ ID NO: 313602 - RNA, 22 nt, Homo sapiens
uucauugaaugauuuuuagaag

SEQ ID NO: 313603 - RNA, 22 nt, Homo sapiens
uuccaauguuccguguugcagu

SEQ ID NO: 313604 - RNA, 23 nt, Homo sapiens
uuccaccauugacuaguuacaua

SEQ ID NO: 313605 - RNA, 22 nt, Homo sapiens
uuccacgugaaguauucuaaag

SEQ ID NO: 313606 - RNA, 22 nt, Homo sapiens
uuccacuuuuuccuugugcucc

SEQ ID NO: 313607 - RNA, 22 nt, Homo sapiens
uuccagaugggaguucuauucu

SEQ ID NO: 313608 - RNA, 22 nt, Homo sapiens
uuccaguguguucauccucaga

SEQ ID NO: 313609 - RNA, 22 nt, Homo sapiens
uuccaugagaugcaucaaagcu

SEQ ID NO: 313610 - RNA, 22 nt, Homo sapiens
uucccucagaaacacacagccc

SEQ ID NO: 313611 - RNA, 20 nt, Homo sapiens
uucccucagccuugagggua

SEQ ID NO: 313612 - RNA, 22 nt, Homo sapiens
uucccugugggaguaggaaagu

SEQ ID NO: 313613 - RNA, 22 nt, Homo sapiens
uucccugugguauagaagccgu

SEQ ID NO: 313614 - RNA, 22 nt, Homo sapiens
uucccugugugcagaugggugu

SEQ ID NO: 313615 - RNA, 22 nt, Homo sapiens
uucccuuugaaacuaaacuugc

SEQ ID NO: 313616 - RNA, 22 nt, Homo sapiens
uucccuuuguuaaauuggaaga

SEQ ID NO: 313617 - RNA, 22 nt, Homo sapiens
uuccuagagauuagcaagcugc

SEQ ID NO: 313618 - RNA, 22 nt, Homo sapiens
uuccugugacuguguggcaccc

SEQ ID NO: 313619 - RNA, 21 nt, Homo sapiens
uucuaaguaaauguuggacau

SEQ ID NO: 313620 - RNA, 22 nt, Homo sapiens
uucuauggucacagaugcuuga

SEQ ID NO: 313621 - RNA, 21 nt, Homo sapiens
uucucaggguguguccuaccc

SEQ ID NO: 313622 - RNA, 22 nt, Homo sapiens
uucucuaguuacuuuaauggag

SEQ ID NO: 313623 - RNA, 22 nt, Homo sapiens
uucugaguggcuuucaacacug

SEQ ID NO: 313624 - RNA, 23 nt, Homo sapiens
uucugccacugaaaaugccucag

SEQ ID NO: 313625 - RNA, 22 nt, Homo sapiens
uucuggccccucccaaucucau

SEQ ID NO: 313626 - RNA, 22 nt, Homo sapiens
uucuggcuaugggauacuaaau

SEQ ID NO: 313627 - RNA, 22 nt, Homo sapiens
uucuggcucgauucucugaccg

SEQ ID NO: 313628 - RNA, 21 nt, Homo sapiens
uucuucaggcagaaggauuau

SEQ ID NO: 313629 - RNA, 22 nt, Homo sapiens
uucuugaggcaugccgcuggga

SEQ ID NO: 313630 - RNA, 22 nt, Homo sapiens
uucuugcacuuggcccucauua

SEQ ID NO: 313631 - RNA, 22 nt, Homo sapiens
uugaaagucuaggcuuacagua

SEQ ID NO: 313632 - RNA, 22 nt, Homo sapiens
uugaagacuauaugauucuuca

SEQ ID NO: 313633 - RNA, 22 nt, Homo sapiens
guaaacuuccccucaugaauga

SEQ ID NO: 313634 - RNA, 22 nt, Homo sapiens
guaaggaguaguguaacagugc

SEQ ID NO: 313635 - RNA, 22 nt, Homo sapiens
guaauacuuuugggauauuaga

SEQ ID NO: 313636 - RNA, 22 nt, Homo sapiens
guaaucucaccuacuugggagg

SEQ ID NO: 313637 - RNA, 22 nt, Homo sapiens
guaaucucagcuacucgggaga

SEQ ID NO: 313638 - RNA, 22 nt, Homo sapiens
guacaguggguguagggaccag

SEQ ID NO: 313639 - RNA, 22 nt, Homo sapiens
guacaguuuagugcuuugagaa

SEQ ID NO: 313640 - RNA, 22 nt, Homo sapiens
guacaugcaugcaugggugugc

SEQ ID NO: 313641 - RNA, 22 nt, Homo sapiens
guaccacaguugcucacggguu

SEQ ID NO: 313642 - RNA, 22 nt, Homo sapiens
guagaucucaacacuggaagua

SEQ ID NO: 313643 - RNA, 22 nt, Homo sapiens
guagcagaauaucagauaauuu

SEQ ID NO: 313644 - RNA, 22 nt, Homo sapiens
guaguuuaucagaaagaauagg

SEQ ID NO: 313645 - RNA, 22 nt, Homo sapiens
guauacacccugugauauuauu

SEQ ID NO: 313646 - RNA, 22 nt, Homo sapiens
guaucauugccuaaugcucuca

SEQ ID NO: 313647 - RNA, 22 nt, Homo sapiens
guaucucaguucucgugauuag

SEQ ID NO: 313648 - RNA, 21 nt, Homo sapiens
guauggcauugauuaguuacu

SEQ ID NO: 313649 - RNA, 22 nt, Homo sapiens
guauuagguuggggcaaaagua

SEQ ID NO: 313650 - RNA, 22 nt, Homo sapiens
guauugacuaucaaucaugugc

SEQ ID NO: 313651 - RNA, 19 nt, Homo sapiens
guauuugguaaacucucca

SEQ ID NO: 313652 - RNA, 21 nt, Homo sapiens
gucacuggggcuggauaauuc

SEQ ID NO: 313653 - RNA, 22 nt, Homo sapiens
gucacugggugcugcgccuguc

SEQ ID NO: 313654 - RNA, 22 nt, Homo sapiens
gucagcaaagaggaauaguuug

SEQ ID NO: 313655 - RNA, 22 nt, Homo sapiens
gucaggugcuuacgcggagauc

SEQ ID NO: 313656 - RNA, 22 nt, Homo sapiens
gucaucaggacgggucaucugc

SEQ ID NO: 313657 - RNA, 22 nt, Homo sapiens
gucauggguuaaagguggauac

SEQ ID NO: 313658 - RNA, 18 nt, Homo sapiens
guccauuuguugguacac

SEQ ID NO: 313659 - RNA, 22 nt, Homo sapiens
gucccugaggaacauccagggc

SEQ ID NO: 313660 - RNA, 22 nt, Homo sapiens
gucccugugucuuuauguggcc

SEQ ID NO: 313661 - RNA, 22 nt, Homo sapiens
guccuggagaagcguggaccgg

SEQ ID NO: 313662 - RNA, 22 nt, Homo sapiens
gucguggagcucacagugugcc

SEQ ID NO: 313663 - RNA, 22 nt, Homo sapiens
gucguggagucucuggcuugua

SEQ ID NO: 313664 - RNA, 22 nt, Homo sapiens
gucucccagccuacauauuucu

SEQ ID NO: 313665 - RNA, 22 nt, Homo sapiens
gucucccagccuacaucuuucu

SEQ ID NO: 313666 - RNA, 22 nt, Homo sapiens
gucuggagacuugggucaucaa

SEQ ID NO: 313667 - RNA, 22 nt, Homo sapiens
gucuggcaauggcagacuggca

SEQ ID NO: 313668 - RNA, 21 nt, Homo sapiens
gucuuacagccagaugccucu

SEQ ID NO: 313669 - RNA, 22 nt, Homo sapiens
gucuuggagaacucagcuuggc

SEQ ID NO: 313670 - RNA, 22 nt, Homo sapiens
gugaaauguguagaggaucugg

SEQ ID NO: 313671 - RNA, 22 nt, Homo sapiens
gugaagugugaccucagcaucu

SEQ ID NO: 313672 - RNA, 22 nt, Homo sapiens
gugaaucuguuuucuucuguuc

SEQ ID NO: 313673 - RNA, 22 nt, Homo sapiens
gugacagaguaagacccuguau

SEQ ID NO: 313674 - RNA, 22 nt, Homo sapiens
gugacagucaaagacaugacuu

SEQ ID NO: 313675 - RNA, 22 nt, Homo sapiens
gugaggucguagucauaggcaa

SEQ ID NO: 313676 - RNA, 22 nt, Homo sapiens
gugaucauuguauugggguuau

SEQ ID NO: 313677 - RNA, 22 nt, Homo sapiens
gugaugcaguacguagaggaga

SEQ ID NO: 313678 - RNA, 22 nt, Homo sapiens
gugauuauuaugcacugcaugc

SEQ ID NO: 313679 - RNA, 22 nt, Homo sapiens
gugcaaauguuauugagguuuu

SEQ ID NO: 313680 - RNA, 18 nt, Homo sapiens
gugcaaugaauagcagag

SEQ ID NO: 313681 - RNA, 22 nt, Homo sapiens
gugcaaugaguguggcaaagcc

SEQ ID NO: 313682 - RNA, 22 nt, Homo sapiens
gugcacaaaucuuaaauguaca

SEQ ID NO: 313683 - RNA, 23 nt, Homo sapiens
gugcaguggcgagauuucggcuc

SEQ ID NO: 313684 - RNA, 22 nt, Homo sapiens
gugcaguuuuaagugaguuucu

SEQ ID NO: 313685 - RNA, 19 nt, Homo sapiens
gugcauaguuauuaaagag

SEQ ID NO: 313686 - RNA, 22 nt, Homo sapiens
gugcauauaaguuguuucuagu

SEQ ID NO: 313687 - RNA, 22 nt, Homo sapiens
gugcaugucugugacgacccug

SEQ ID NO: 313688 - RNA, 22 nt, Homo sapiens
gugcuaggugcuaggaagauag

SEQ ID NO: 313689 - RNA, 22 nt, Homo sapiens
guggaaagaacacaaaauuagg

SEQ ID NO: 313690 - RNA, 22 nt, Homo sapiens
guggaaguguaaaagcucuugg

SEQ ID NO: 313691 - RNA, 22 nt, Homo sapiens
guggaaugcaguguugauucaa

SEQ ID NO: 313692 - RNA, 22 nt, Homo sapiens
guggaauuauagagacaucuug

SEQ ID NO: 313693 - RNA, 22 nt, Homo sapiens
guggacagagacuaaauguugu

SEQ ID NO: 313694 - RNA, 22 nt, Homo sapiens
guggcaaagaugccuucuccaa

SEQ ID NO: 313695 - RNA, 22 nt, Homo sapiens
guggcaaggaaaugcugcucac

SEQ ID NO: 313696 - RNA, 22 nt, Homo sapiens
guggcacaauuaaguagcuauu

SEQ ID NO: 313697 - RNA, 22 nt, Homo sapiens
uugcaaggugcucgaagggcuc

SEQ ID NO: 313698 - RNA, 22 nt, Homo sapiens
uugcacaauggaauuuaucuuu

SEQ ID NO: 313699 - RNA, 22 nt, Homo sapiens
uugcacauggcaggugcucaau

SEQ ID NO: 313700 - RNA, 22 nt, Homo sapiens
uugcacauugauuuuguauccu

SEQ ID NO: 313701 - RNA, 22 nt, Homo sapiens
uugcacauugauuuuguaucuu

SEQ ID NO: 313702 - RNA, 22 nt, Homo sapiens
uugcacuccggccuggguaaca

SEQ ID NO: 313703 - RNA, 22 nt, Homo sapiens
uugcaggugguuuaugcaagac

SEQ ID NO: 313704 - RNA, 22 nt, Homo sapiens
uugcauagaccgaugucuugga

SEQ ID NO: 313705 - RNA, 22 nt, Homo sapiens
uugcauguacguacagagagag

SEQ ID NO: 313706 - RNA, 18 nt, Homo sapiens
uugccuauucacucugau

SEQ ID NO: 313707 - RNA, 22 nt, Homo sapiens
uuggaaaguuguuguaguuauu

SEQ ID NO: 313708 - RNA, 22 nt, Homo sapiens
uuggaaaugguaaaggguuaau

SEQ ID NO: 313709 - RNA, 20 nt, Homo sapiens
uuggaaaugugaauugggag

SEQ ID NO: 313710 - RNA, 22 nt, Homo sapiens
uuggaaauguguuugcauucag

SEQ ID NO: 313711 - RNA, 22 nt, Homo sapiens
uuggaagauuacuuaguuuucu

SEQ ID NO: 313712 - RNA, 22 nt, Homo sapiens
uuggccccuuucauccacagcu

SEQ ID NO: 313713 - RNA, 21 nt, Homo sapiens
cuuugguuucugacuugcaua

SEQ ID NO: 313714 - RNA, 22 nt, Homo sapiens
cuuuuggugguucugaugcagg

SEQ ID NO: 313715 - RNA, 22 nt, Homo sapiens
cuuuuugguagagcaggugugc

SEQ ID NO: 313716 - RNA, 22 nt, Homo sapiens
gaaacugcauuucuaacaagcu

SEQ ID NO: 313717 - RNA, 22 nt, Homo sapiens
gaaauguugauagugggcauug

SEQ ID NO: 313718 - RNA, 22 nt, Homo sapiens
gaagguacgcuuaggaaaugau

SEQ ID NO: 313719 - RNA, 22 nt, Homo sapiens
gaagguauauucuguuaaugcu

SEQ ID NO: 313720 - RNA, 22 nt, Homo sapiens
gaauacuguccaagagugaugg

SEQ ID NO: 313721 - RNA, 22 nt, Homo sapiens
gaauagugcugcaaugaacaua

SEQ ID NO: 313722 - RNA, 22 nt, Homo sapiens
gaaucauuggguugauucaaga

SEQ ID NO: 313723 - RNA, 22 nt, Homo sapiens
cugugcauuggaugucucccug

SEQ ID NO: 313724 - RNA, 22 nt, Homo sapiens
cugugccaagcuugcgaugugc

SEQ ID NO: 313725 - RNA, 22 nt, Homo sapiens
cugugcuugagagaugacacag

SEQ ID NO: 313726 - RNA, 22 nt, Homo sapiens
cugugcuugauuauaugagugu

SEQ ID NO: 313727 - RNA, 22 nt, Homo sapiens
cugugguuacguucuuugugcu

SEQ ID NO: 313728 - RNA, 20 nt, Homo sapiens
cuuaucaguggcaaguauaa

SEQ ID NO: 313729 - RNA, 22 nt, Homo sapiens
cuuccaaguggggcacgugcca

SEQ ID NO: 313730 - RNA, 22 nt, Homo sapiens
cuuccaguggcagccgggcaug

SEQ ID NO: 313731 - RNA, 22 nt, Homo sapiens
cuucugauugaaaauggaguag

SEQ ID NO: 313732 - RNA, 22 nt, Homo sapiens
cuugagacauuguuuuccaagu

SEQ ID NO: 313733 - RNA, 22 nt, Homo sapiens
cuugcauagaguuauugcccuu

SEQ ID NO: 313734 - RNA, 22 nt, Homo sapiens
cuuugguuuacuuggugcuagu

SEQ ID NO: 313735 - RNA, 20 nt, Homo sapiens
cuuuguccuccugcugugcu

SEQ ID NO: 313736 - RNA, 22 nt, Homo sapiens
cuuuguguggacauuucaggca

SEQ ID NO: 313737 - RNA, 20 nt, Homo sapiens
cuuuuagcagcagcaagaga

SEQ ID NO: 313738 - RNA, 22 nt, Homo sapiens
cuuuuggcuuagaauugucuug

SEQ ID NO: 313739 - RNA, 21 nt, Homo sapiens
gaaauacugccuuaggagcug

SEQ ID NO: 313740 - RNA, 22 nt, Homo sapiens
gaacccuggaggcggagguugc

SEQ ID NO: 313741 - RNA, 22 nt, Homo sapiens
gaacuuguguugcuucacaugu

SEQ ID NO: 313742 - RNA, 22 nt, Homo sapiens
gaagaaguacaagacaaauuuu

SEQ ID NO: 313743 - RNA, 23 nt, Homo sapiens
gaaguauagcaugcacauggaaa

SEQ ID NO: 313744 - RNA, 19 nt, Homo sapiens
gaaguguuguccuccagua

SEQ ID NO: 313745 - RNA, 22 nt, Homo sapiens
gaaucaauugaucuaugugucu

SEQ ID NO: 313746 - RNA, 22 nt, Homo sapiens
gaaucacagauuaugaguaucu

SEQ ID NO: 313747 - RNA, 22 nt, Homo sapiens
gaaucauuguuucuaaguuugu

SEQ ID NO: 313748 - RNA, 22 nt, Homo sapiens
gaaugcagcagugacagggcug

SEQ ID NO: 313749 - RNA, 22 nt, Homo sapiens
gaauggaacugacuauagcuga

SEQ ID NO: 313750 - RNA, 22 nt, Homo sapiens
gaauguuuacuuuguuuaauac

SEQ ID NO: 313751 - RNA, 22 nt, Homo sapiens
gacagugagaugucaugugaaa

SEQ ID NO: 313752 - RNA, 22 nt, Homo sapiens
gacaguuuggugaggaagacga

SEQ ID NO: 313753 - RNA, 22 nt, Homo sapiens
gacauguuuucauguauuugga

SEQ ID NO: 313754 - RNA, 20 nt, Homo sapiens
gacauguuuuguggccuaac

SEQ ID NO: 313755 - RNA, 22 nt, Homo sapiens
gaccacauuccacacaggcuuu

SEQ ID NO: 313756 - RNA, 22 nt, Homo sapiens
gacuaggagagcagcugcccau

SEQ ID NO: 313757 - RNA, 22 nt, Homo sapiens
gacuaggagauauguuuucuuc

SEQ ID NO: 313758 - RNA, 22 nt, Homo sapiens
gacuauguuaccuuacacauca

SEQ ID NO: 313759 - RNA, 22 nt, Homo sapiens
gacugcagugcagcuguuaggc

SEQ ID NO: 313760 - RNA, 22 nt, Homo sapiens
gagaaccauuuggagaaaaagu

SEQ ID NO: 313761 - RNA, 22 nt, Homo sapiens
gagaacuaaugauguacuaggc

SEQ ID NO: 313762 - RNA, 22 nt, Homo sapiens
gagaaugaacagacugccucuu

SEQ ID NO: 313763 - RNA, 22 nt, Homo sapiens
ucccugagugauugaaaauaaa

SEQ ID NO: 313764 - RNA, 22 nt, Homo sapiens
ucccuuucuggaguuucccaag

SEQ ID NO: 313765 - RNA, 22 nt, Homo sapiens
uccuugagccuuaaauuauaaa

SEQ ID NO: 313766 - RNA, 22 nt, Homo sapiens
uccuuggucauggaagagacag

SEQ ID NO: 313767 - RNA, 23 nt, Homo sapiens
uccuugguuggcgcccuaugugu

SEQ ID NO: 313768 - RNA, 22 nt, Homo sapiens
uccuuugguucuugucacccca

SEQ ID NO: 313769 - RNA, 22 nt, Homo sapiens
ucgcaccauugcacuccagcca

SEQ ID NO: 313770 - RNA, 22 nt, Homo sapiens
ucgcugggaagacugaaguguc

SEQ ID NO: 313771 - RNA, 22 nt, Homo sapiens
ucucagcacaaacaaaauugcu

SEQ ID NO: 313772 - RNA, 20 nt, Homo sapiens
ucucauagagguagagaaua

SEQ ID NO: 313773 - RNA, 20 nt, Homo sapiens
ucucauggagggaaagagca

SEQ ID NO: 313774 - RNA, 20 nt, Homo sapiens
ucucccaaacagcaggcccu

SEQ ID NO: 313775 - RNA, 17 nt, Homo sapiens
ucucccaucccuuucuc

SEQ ID NO: 313776 - RNA, 22 nt, Homo sapiens
ucucugagaccacuccaaacuc

SEQ ID NO: 313777 - RNA, 22 nt, Homo sapiens
ucucuggauaucuacuuauguu

SEQ ID NO: 313778 - RNA, 22 nt, Homo sapiens
ucugacucuggagucucagguu

SEQ ID NO: 313779 - RNA, 22 nt, Homo sapiens
ucugagaugagacuuugaauuu

SEQ ID NO: 313780 - RNA, 22 nt, Homo sapiens
ucugagcaauaaacaacauauu

SEQ ID NO: 313781 - RNA, 22 nt, Homo sapiens
ucugccuacugguuggaggaac

SEQ ID NO: 313782 - RNA, 22 nt, Homo sapiens
ucuggcacucagaggccuugcu

SEQ ID NO: 313783 - RNA, 22 nt, Homo sapiens
ucuggcacugaugugggaugcu

SEQ ID NO: 313784 - RNA, 22 nt, Homo sapiens
ucuggcuccaaagucuauuuuu

SEQ ID NO: 313785 - RNA, 22 nt, Homo sapiens
ucuggcuuuagcaugugggaag

SEQ ID NO: 313786 - RNA, 22 nt, Homo sapiens
ucugucaaaucuuauguuguag

SEQ ID NO: 313787 - RNA, 22 nt, Homo sapiens
ucugugaaugaacacuugaaaa

SEQ ID NO: 313788 - RNA, 22 nt, Homo sapiens
ucugugcauggcagaggaauga

SEQ ID NO: 313789 - RNA, 22 nt, Homo sapiens
ucugugguuguugcauggaaug

SEQ ID NO: 313790 - RNA, 22 nt, Homo sapiens
ucuguguuugguuggcaauuuc

SEQ ID NO: 313791 - RNA, 22 nt, Homo sapiens
ucuuaguuggaaugggauaagg

SEQ ID NO: 313792 - RNA, 22 nt, Homo sapiens
ucuucaugcuugaaauaauagc

SEQ ID NO: 313793 - RNA, 22 nt, Homo sapiens
ucuuggcaaagaauuuuuggcu

SEQ ID NO: 313794 - RNA, 22 nt, Homo sapiens
ucuuugguuguuuagggugcau

SEQ ID NO: 313795 - RNA, 22 nt, Homo sapiens
ucuuuguucaggagccaacucc

SEQ ID NO: 313796 - RNA, 22 nt, Homo sapiens
ugaaacacacagagaagggaga

SEQ ID NO: 313797 - RNA, 22 nt, Homo sapiens
ugaaacacacauugcccuuuau

SEQ ID NO: 313798 - RNA, 22 nt, Homo sapiens
ugaaaguuauauugugaaauuc

SEQ ID NO: 313799 - RNA, 22 nt, Homo sapiens
ugaaauacuuuggcucuuuguu

SEQ ID NO: 313800 - RNA, 22 nt, Homo sapiens
ugaaaugauuauaugguguuug

SEQ ID NO: 313801 - RNA, 22 nt, Homo sapiens
ugaaaugccuuuaaugaauuua

SEQ ID NO: 313802 - RNA, 22 nt, Homo sapiens
ugaaauguaaguugucuagucu

SEQ ID NO: 313803 - RNA, 22 nt, Homo sapiens
ugaaauuauucuuaccaaggug

SEQ ID NO: 313804 - RNA, 22 nt, Homo sapiens
ugaacagcacguuuauucagaa

SEQ ID NO: 313805 - RNA, 21 nt, Homo sapiens
ugaaccccugcucucaagaaa

SEQ ID NO: 313806 - RNA, 22 nt, Homo sapiens
ugaagacucaauuauuaugaac

SEQ ID NO: 313807 - RNA, 22 nt, Homo sapiens
ugaaggcaggagggagaaaagu

SEQ ID NO: 313808 - RNA, 21 nt, Homo sapiens
ugaaguagcauaggaugucaa

SEQ ID NO: 313809 - RNA, 21 nt, Homo sapiens
ugaauauuuggguugugucca

SEQ ID NO: 313810 - RNA, 22 nt, Homo sapiens
ugaaugcaucauguagggcuca

SEQ ID NO: 313811 - RNA, 22 nt, Homo sapiens
ugaauggauccaauucuuagua

SEQ ID NO: 313812 - RNA, 22 nt, Homo sapiens
ugaauguuguugguugagauau

SEQ ID NO: 313813 - RNA, 19 nt, Homo sapiens
ugacacuguuggugggagg

SEQ ID NO: 313814 - RNA, 18 nt, Homo sapiens
ugacagcacaugugggga

SEQ ID NO: 313815 - RNA, 22 nt, Homo sapiens
ugacagguuggaauuaugggag

SEQ ID NO: 313816 - RNA, 22 nt, Homo sapiens
ugacagugaauaagucucuuaa

SEQ ID NO: 313817 - RNA, 22 nt, Homo sapiens
ugacagugugagacuuugucuc

SEQ ID NO: 313818 - RNA, 20 nt, Homo sapiens
ugacaucagcaauguaauaa

SEQ ID NO: 313819 - RNA, 22 nt, Homo sapiens
ugacaucugcuugugcccagga

SEQ ID NO: 313820 - RNA, 17 nt, Homo sapiens
ugaccacugauucuacu

SEQ ID NO: 313821 - RNA, 22 nt, Homo sapiens
ugacuagagacagaaacuaaaa

SEQ ID NO: 313822 - RNA, 22 nt, Homo sapiens
ugagaacagauggcuuuauuau

SEQ ID NO: 313823 - RNA, 20 nt, Homo sapiens
ugagaacauguggcauuugg

SEQ ID NO: 313824 - RNA, 17 nt, Homo sapiens
ugagaacaugugguauu

SEQ ID NO: 313825 - RNA, 20 nt, Homo sapiens
ugagaacaugugguauuugg

SEQ ID NO: 313826 - RNA, 22 nt, Homo sapiens
ugagaacauuccucuuccuggc

SEQ ID NO: 313827 - RNA, 22 nt, Homo sapiens
ugagaacugguagcacuuguga

SEQ ID NO: 313828 - RNA, 22 nt, Homo sapiens
ugagaagaugaacuccuugguc

SEQ ID NO: 313829 - RNA, 22 nt, Homo sapiens
ugagacauauuauacugcuuuu

SEQ ID NO: 313830 - RNA, 22 nt, Homo sapiens
ugagacugguuaauugauaaag

SEQ ID NO: 313831 - RNA, 22 nt, Homo sapiens
ugagagacauuuguuguagagu

SEQ ID NO: 313832 - RNA, 22 nt, Homo sapiens
ugagaucaagguuaauauaauc

SEQ ID NO: 313833 - RNA, 22 nt, Homo sapiens
ugagaucuguaaagucugacau

SEQ ID NO: 313834 - RNA, 22 nt, Homo sapiens
ugagaucuucgcucuucacaga

SEQ ID NO: 313835 - RNA, 19 nt, Homo sapiens
ugagaucuuuacuggguuu

SEQ ID NO: 313836 - RNA, 22 nt, Homo sapiens
ugagaucuuuuguggcugagaa

SEQ ID NO: 313837 - RNA, 19 nt, Homo sapiens
ugagaugaagacagggguu

SEQ ID NO: 313838 - RNA, 22 nt, Homo sapiens
ugagaugagaaucaguucuaau

SEQ ID NO: 313839 - RNA, 22 nt, Homo sapiens
ugagaugaucaaaguauaggcu

SEQ ID NO: 313840 - RNA, 22 nt, Homo sapiens
ugagaugcuccucuugcaaagc

SEQ ID NO: 313841 - RNA, 22 nt, Homo sapiens
ugagaugcuuguaaauucauuu

SEQ ID NO: 313842 - RNA, 22 nt, Homo sapiens
ugagauguuccaaugacuauua

SEQ ID NO: 313843 - RNA, 23 nt, Homo sapiens
ugagauuacccagaaagaguaua

SEQ ID NO: 313844 - RNA, 22 nt, Homo sapiens
ugagauuauauuucuuaacaga

SEQ ID NO: 313845 - RNA, 19 nt, Homo sapiens
ugagauuguaugaggagau

SEQ ID NO: 313846 - RNA, 18 nt, Homo sapiens
ugaggaaaggguuugcua

SEQ ID NO: 313847 - RNA, 22 nt, Homo sapiens
ugaggaguguauuucauucgcu

SEQ ID NO: 313848 - RNA, 22 nt, Homo sapiens
ugaggugaggguaucaaaugcu

SEQ ID NO: 313849 - RNA, 22 nt, Homo sapiens
ugagguugguauuacugucucu

SEQ ID NO: 313850 - RNA, 22 nt, Homo sapiens
ugaguagugccacaauaagcau

SEQ ID NO: 313851 - RNA, 22 nt, Homo sapiens
ugaguaugaguucaggaaaggc

SEQ ID NO: 313852 - RNA, 22 nt, Homo sapiens
ugagugugaggaagaauuagaa

SEQ ID NO: 313853 - RNA, 22 nt, Homo sapiens
ugauaggagauuuucaucugua

SEQ ID NO: 313854 - RNA, 22 nt, Homo sapiens
ugauaucugaucauccuugaua

SEQ ID NO: 313855 - RNA, 22 nt, Homo sapiens
ugauaugucacuugaucauggu

SEQ ID NO: 313856 - RNA, 22 nt, Homo sapiens
ugauaugucccucgacaucagg

SEQ ID NO: 313857 - RNA, 22 nt, Homo sapiens
ugauauguuagaaucuugcaag

SEQ ID NO: 313858 - RNA, 20 nt, Homo sapiens
ugauauuucuggaaguggag

SEQ ID NO: 313859 - RNA, 17 nt, Homo sapiens
ugauauuuucccagaua

SEQ ID NO: 313860 - RNA, 20 nt, Homo sapiens
ugauauuuucugagcaggaa

SEQ ID NO: 313861 - RNA, 22 nt, Homo sapiens
ugaucugucucggguuaucagu

SEQ ID NO: 313862 - RNA, 22 nt, Homo sapiens
ugaugacacugauuucuucaau

SEQ ID NO: 313863 - RNA, 22 nt, Homo sapiens
ugaugcuacuaccugggcugaa

SEQ ID NO: 313864 - RNA, 22 nt, Homo sapiens
auuuugcauugcuguaaaggaa

SEQ ID NO: 313865 - RNA, 22 nt, Homo sapiens
caaagugcuggaauuggccggg

SEQ ID NO: 313866 - RNA, 22 nt, Homo sapiens
caaauacuuucauguugucuug

SEQ ID NO: 313867 - RNA, 22 nt, Homo sapiens
caacacuguuuauuggauagcc

SEQ ID NO: 313868 - RNA, 22 nt, Homo sapiens
caacagucagcccauccacaga

SEQ ID NO: 313869 - RNA, 22 nt, Homo sapiens
caacauccaccuccuggguuca

SEQ ID NO: 313870 - RNA, 22 nt, Homo sapiens
caagaucauuuaugcuaaaauu

SEQ ID NO: 313871 - RNA, 22 nt, Homo sapiens
caagugcuacagagaaaucuuu

SEQ ID NO: 313872 - RNA, 22 nt, Homo sapiens
caaguguuggcuuguauacaaa

SEQ ID NO: 313873 - RNA, 21 nt, Homo sapiens
caauggcacgaucuuggcuca

SEQ ID NO: 313874 - RNA, 22 nt, Homo sapiens
cacacugucuucaauggguggu

SEQ ID NO: 313875 - RNA, 22 nt, Homo sapiens
cacacugucuuucagaaugguu

SEQ ID NO: 313876 - RNA, 22 nt, Homo sapiens
cacaguguuacugguaugaagu

SEQ ID NO: 313877 - RNA, 22 nt, Homo sapiens
cacauagucccugcuaaucuuc

SEQ ID NO: 313878 - RNA, 22 nt, Homo sapiens
cacauugaauuucugaugacaa

SEQ ID NO: 313879 - RNA, 22 nt, Homo sapiens
caccacauuccauugaucaggc

SEQ ID NO: 313880 - RNA, 23 nt, Homo sapiens
caccaguagaaugugugggaggg

SEQ ID NO: 313881 - RNA, 22 nt, Homo sapiens
cacugcaguggaagauuaagaa

SEQ ID NO: 313882 - RNA, 21 nt, Homo sapiens
cacugcaucacaggacagcau

SEQ ID NO: 313883 - RNA, 22 nt, Homo sapiens
cacugcauuggaugguuccucc

SEQ ID NO: 313884 - RNA, 22 nt, Homo sapiens
cagagcacugauacuggguucu

SEQ ID NO: 313885 - RNA, 22 nt, Homo sapiens
cagagguaagcaagucagcauu

SEQ ID NO: 313886 - RNA, 22 nt, Homo sapiens
cagaucaucuugagcuuaggaa

SEQ ID NO: 313887 - RNA, 22 nt, Homo sapiens
cagaugguggucccacagccca

SEQ ID NO: 313888 - RNA, 22 nt, Homo sapiens
cagcacauagcaguugcucagu

SEQ ID NO: 313889 - RNA, 20 nt, Homo sapiens
cagcacgcacaugagacugu

SEQ ID NO: 313890 - RNA, 22 nt, Homo sapiens
caguagcaugccucagaaugag

SEQ ID NO: 313891 - RNA, 20 nt, Homo sapiens
cagucauagacaucagaguc

SEQ ID NO: 313892 - RNA, 22 nt, Homo sapiens
cagugacacugaaaaguucggg

SEQ ID NO: 313893 - RNA, 22 nt, Homo sapiens
cagugguuuucucaguucagca

SEQ ID NO: 313894 - RNA, 22 nt, Homo sapiens
cauagcacugcacuucagccug

SEQ ID NO: 313895 - RNA, 22 nt, Homo sapiens
cauaugguuuuauguucuucau

SEQ ID NO: 313896 - RNA, 19 nt, Homo sapiens
caucacagagucuuccauu

SEQ ID NO: 313897 - RNA, 21 nt, Homo sapiens
caucacauuacucaaaguccu

SEQ ID NO: 313898 - RNA, 22 nt, Homo sapiens
caucacauucugagauacugag

SEQ ID NO: 313899 - RNA, 20 nt, Homo sapiens
caucaccuggcaggauuugu

SEQ ID NO: 313900 - RNA, 22 nt, Homo sapiens
caucacuguugguacaaguaau

SEQ ID NO: 313901 - RNA, 22 nt, Homo sapiens
caugaacacugugcggcuuccu

SEQ ID NO: 313902 - RNA, 22 nt, Homo sapiens
caugacacauguuuaccuaugu

SEQ ID NO: 313903 - RNA, 22 nt, Homo sapiens
caugcacugaguccaccucugg

SEQ ID NO: 313904 - RNA, 22 nt, Homo sapiens
cauggcacugagcagguaugca

SEQ ID NO: 313905 - RNA, 22 nt, Homo sapiens
cauggcucuuguuuacucccag

SEQ ID NO: 313906 - RNA, 22 nt, Homo sapiens
cauggcucuuugcugcuaaagu

SEQ ID NO: 313907 - RNA, 22 nt, Homo sapiens
uauaugauugguagacccugca

SEQ ID NO: 313908 - RNA, 22 nt, Homo sapiens
uauaugcaacauaguguaugug

SEQ ID NO: 313909 - RNA, 22 nt, Homo sapiens
uauaugcacucagguguaugug

SEQ ID NO: 313910 - RNA, 22 nt, Homo sapiens
uauaugcucugggauccugaaa

SEQ ID NO: 313911 - RNA, 22 nt, Homo sapiens
uauauguucugugucccuuucg

SEQ ID NO: 313912 - RNA, 22 nt, Homo sapiens
uauauguuuucauaaggcuaga

SEQ ID NO: 313913 - RNA, 22 nt, Homo sapiens
uaucacagcgggguguacaccc

SEQ ID NO: 313914 - RNA, 22 nt, Homo sapiens
uaucacaguaucuagcacagug

SEQ ID NO: 313915 - RNA, 22 nt, Homo sapiens
uaucaccuugcaggagcuauga

SEQ ID NO: 313916 - RNA, 22 nt, Homo sapiens
uaucaguauggauucauggauu

SEQ ID NO: 313917 - RNA, 22 nt, Homo sapiens
uaucauagacaaucaguuauug

SEQ ID NO: 313918 - RNA, 22 nt, Homo sapiens
uaucucagaugagacuuguaac

SEQ ID NO: 313919 - RNA, 22 nt, Homo sapiens
uaucucaguguacaggaugaua

SEQ ID NO: 313920 - RNA, 22 nt, Homo sapiens
uaucucauccuccuugauccca

SEQ ID NO: 313921 - RNA, 22 nt, Homo sapiens
uaugaagccaggauuuauuauu

SEQ ID NO: 313922 - RNA, 22 nt, Homo sapiens
uaugagaugaggccacugggua

SEQ ID NO: 313923 - RNA, 22 nt, Homo sapiens
uaugagcacauauguaucuaug

SEQ ID NO: 313924 - RNA, 22 nt, Homo sapiens
uaugcacacucucccaggaggg

SEQ ID NO: 313925 - RNA, 22 nt, Homo sapiens
uauggauguuaagguucacagc

SEQ ID NO: 313926 - RNA, 22 nt, Homo sapiens
uauggcuacuacgaauaaugcu

SEQ ID NO: 313927 - RNA, 22 nt, Homo sapiens
uauggcuuuguuaacauuuucu

SEQ ID NO: 313928 - RNA, 22 nt, Homo sapiens
uauuacugucaauaucacagaa

SEQ ID NO: 313929 - RNA, 22 nt, Homo sapiens
uauuagguuggggcaaaaguaa

SEQ ID NO: 313930 - RNA, 22 nt, Homo sapiens
uauuagguuggugcaaaaguaa

SEQ ID NO: 313931 - RNA, 22 nt, Homo sapiens
uauuagguuggugcaaaaguua

SEQ ID NO: 313932 - RNA, 22 nt, Homo sapiens
uauuagguuggugcaacaguaa

SEQ ID NO: 313933 - RNA, 22 nt, Homo sapiens
uauuauuguccuucuauaccca

SEQ ID NO: 313934 - RNA, 22 nt, Homo sapiens
uauugacauuacagugggucuu

SEQ ID NO: 313935 - RNA, 22 nt, Homo sapiens
uauugauuuucaguguucagcu

SEQ ID NO: 313936 - RNA, 22 nt, Homo sapiens
uauugcacaugaggagacauug

SEQ ID NO: 313937 - RNA, 22 nt, Homo sapiens
uauugcagugagauccaucugg

SEQ ID NO: 313938 - RNA, 22 nt, Homo sapiens
uauugcuaacaucccuuaugua

SEQ ID NO: 313939 - RNA, 22 nt, Homo sapiens
uauugcuugaggaaaugguaau

SEQ ID NO: 313940 - RNA, 22 nt, Homo sapiens
uauugcuuuuaacccaaucucu

SEQ ID NO: 313941 - RNA, 22 nt, Homo sapiens
uauuguacauauccucccuuca

SEQ ID NO: 313942 - RNA, 22 nt, Homo sapiens
uauuguuuuucccaggagucua

SEQ ID NO: 313943 - RNA, 22 nt, Homo sapiens
uauuuggauagucuggaaaaaa

SEQ ID NO: 313944 - RNA, 22 nt, Homo sapiens
uauuugguuauaugaguaaguu

SEQ ID NO: 313945 - RNA, 22 nt, Homo sapiens
ucaaacugucagguugaccaga

SEQ ID NO: 313946 - RNA, 22 nt, Homo sapiens
ucaaagacacacaaggagaagg

SEQ ID NO: 313947 - RNA, 22 nt, Homo sapiens
ucaaaguauucuucugagaacc

SEQ ID NO: 313948 - RNA, 22 nt, Homo sapiens
ucaaaugcacguagagaaaaua

SEQ ID NO: 313949 - RNA, 22 nt, Homo sapiens
ucaaaugguccacgugaacauu

SEQ ID NO: 313950 - RNA, 22 nt, Homo sapiens
ucaagcaauucuccucucagcc

SEQ ID NO: 313951 - RNA, 22 nt, Homo sapiens
ucaaggcacuagcugagcugca

SEQ ID NO: 313952 - RNA, 22 nt, Homo sapiens
ucaaggcaguggccuuccuucu

SEQ ID NO: 313953 - RNA, 23 nt, Homo sapiens
ucaagugaugguggccacaaggg

SEQ ID NO: 313954 - RNA, 22 nt, Homo sapiens
ucacaagugagaggaauuagau

SEQ ID NO: 313955 - RNA, 21 nt, Homo sapiens
ucacaaugaacagcagcagaa

SEQ ID NO: 313956 - RNA, 22 nt, Homo sapiens
ucacaauucucaauuugugaaa

SEQ ID NO: 313957 - RNA, 22 nt, Homo sapiens
ucacagacauugaggggaccuu

SEQ ID NO: 313958 - RNA, 22 nt, Homo sapiens
ucacagauaaauaaagaugauu

SEQ ID NO: 313959 - RNA, 22 nt, Homo sapiens
ucacaguagggaacugacaaag

SEQ ID NO: 313960 - RNA, 22 nt, Homo sapiens
ucacaguucagcauggcugagg

SEQ ID NO: 313961 - RNA, 22 nt, Homo sapiens
ucacaugaauugucuuguucca

SEQ ID NO: 313962 - RNA, 22 nt, Homo sapiens
ucacauggcagagaagaagcuc

SEQ ID NO: 313963 - RNA, 22 nt, Homo sapiens
ucacaugugcguuuuggcaugu

SEQ ID NO: 313964 - RNA, 22 nt, Homo sapiens
ucaccaguaauaaagagccugc

SEQ ID NO: 313965 - RNA, 22 nt, Homo sapiens
ucacccuguguuuugcguuugc

SEQ ID NO: 313966 - RNA, 22 nt, Homo sapiens
ucaccuggagacaugaagacug

SEQ ID NO: 313967 - RNA, 20 nt, Homo sapiens
ucacuauggagcucuuucuu

SEQ ID NO: 313968 - RNA, 22 nt, Homo sapiens
ucacugcacucuccgccuugcg

SEQ ID NO: 313969 - RNA, 22 nt, Homo sapiens
ucacugcacuucaggcuuucuc

SEQ ID NO: 313970 - RNA, 19 nt, Homo sapiens
ucacuggacagcacacuca

SEQ ID NO: 313971 - RNA, 22 nt, Homo sapiens
ucacuggagauagcaaucuggu

SEQ ID NO: 313972 - RNA, 22 nt, Homo sapiens
ucacugugcacauaugauaggu

SEQ ID NO: 313973 - RNA, 22 nt, Homo sapiens
ucacuuuguuuuuggauaaguu

SEQ ID NO: 313974 - RNA, 22 nt, Homo sapiens
ucagagcaaagacacuuuauca

SEQ ID NO: 313975 - RNA, 22 nt, Homo sapiens
ucagaguagaaacacuuccaua

SEQ ID NO: 313976 - RNA, 22 nt, Homo sapiens
ucagagugguuguaccauuuga

SEQ ID NO: 313977 - RNA, 22 nt, Homo sapiens
ucagaugaugucccuguucuaa

SEQ ID NO: 313978 - RNA, 22 nt, Homo sapiens
ucagcaguggacagaaugguag

SEQ ID NO: 313979 - RNA, 23 nt, Homo sapiens
ucaguagucauugggaaagugug

SEQ ID NO: 313980 - RNA, 22 nt, Homo sapiens
ucagucauugauggaguagguc

SEQ ID NO: 313981 - RNA, 22 nt, Homo sapiens
ucagugcaggaaucucuagcca

SEQ ID NO: 313982 - RNA, 22 nt, Homo sapiens
ucagugccucaguuuuuaaaga

SEQ ID NO: 313983 - RNA, 18 nt, Homo sapiens
ucauagaucaugacagug

SEQ ID NO: 313984 - RNA, 22 nt, Homo sapiens
ucauaguagucacuuaauaaau

SEQ ID NO: 313985 - RNA, 21 nt, Homo sapiens
ucauauguaucuuugugccuc

SEQ ID NO: 313986 - RNA, 22 nt, Homo sapiens
ucauauugcgguucauugacuu

SEQ ID NO: 313987 - RNA, 21 nt, Homo sapiens
ucaucaagcuguagacaugau

SEQ ID NO: 313988 - RNA, 22 nt, Homo sapiens
ucaucaguuuuuuauaugugau

SEQ ID NO: 313989 - RNA, 23 nt, Homo sapiens
ucaugaggccauucaaauccauu

SEQ ID NO: 313990 - RNA, 22 nt, Homo sapiens
ucauggcacugaugagaguuuc

SEQ ID NO: 313991 - RNA, 22 nt, Homo sapiens
ucauguauuaucauuagugggu

SEQ ID NO: 313992 - RNA, 19 nt, Homo sapiens
ucaugugcauacauuuggg

SEQ ID NO: 313993 - RNA, 22 nt, Homo sapiens
ucauuagagacagggugucacu

SEQ ID NO: 313994 - RNA, 22 nt, Homo sapiens
ucauugcauguuaauuaaacag

SEQ ID NO: 313995 - RNA, 22 nt, Homo sapiens
ucauugguagcuugaaggggau

SEQ ID NO: 313996 - RNA, 22 nt, Homo sapiens
ucauugguucuggguguuguug

SEQ ID NO: 313997 - RNA, 22 nt, Homo sapiens
uccacaguggugaggugcagca

SEQ ID NO: 313998 - RNA, 22 nt, Homo sapiens
uccacagugguugaacuaguuu

SEQ ID NO: 313999 - RNA, 20 nt, Homo sapiens
uccacugagcgucacggcag

SEQ ID NO: 314000 - RNA, 19 nt, Homo sapiens
uccaugagcccacagugau

SEQ ID NO: 314001 - RNA, 22 nt, Homo sapiens
uccauguagaagacaggggaga

SEQ ID NO: 314002 - RNA, 22 nt, Homo sapiens
uccauuugucuauguuucuguu

SEQ ID NO: 314003 - RNA, 17 nt, Homo sapiens
ucccauguuucuucuac

SEQ ID NO: 314004 - RNA, 22 nt, Homo sapiens
ucccugacagggucugagcuuu

SEQ ID NO: 314005 - RNA, 22 nt, Homo sapiens
ucccugagcaaaguuuucugua

SEQ ID NO: 314006 - RNA, 22 nt, Homo sapiens
ucccugaguaucuaauguguuu

SEQ ID NO: 314007 - RNA, 22 nt, Homo sapiens
aaaagagcugagagguauucuu

SEQ ID NO: 314008 - RNA, 22 nt, Homo sapiens
aaaagucuguagugaaagguga

SEQ ID NO: 314009 - RNA, 22 nt, Homo sapiens
aaacuugucuaauuauaagcau

SEQ ID NO: 314010 - RNA, 22 nt, Homo sapiens
aaagcacugaauaaauuugcuu

SEQ ID NO: 314011 - RNA, 22 nt, Homo sapiens
aaagcaucacuuuuccuacuuu

SEQ ID NO: 314012 - RNA, 22 nt, Homo sapiens
aaagcuaagguagcauuggaga

SEQ ID NO: 314013 - RNA, 22 nt, Homo sapiens
aaagcugucaaggcaggaggcu

SEQ ID NO: 314014 - RNA, 20 nt, Homo sapiens
aaaggcugugagaacgagau

SEQ ID NO: 314015 - RNA, 22 nt, Homo sapiens
aaagggcuugaauacucuuuuu

SEQ ID NO: 314016 - RNA, 22 nt, Homo sapiens
aaagucuguuuugucagagacu

SEQ ID NO: 314017 - RNA, 22 nt, Homo sapiens
aaagugcugagucuaggcgggg

SEQ ID NO: 314018 - RNA, 19 nt, Homo sapiens
aaaguguuuuaaagaggau

SEQ ID NO: 314019 - RNA, 15 nt, Homo sapiens
aaauaugucaguucu

SEQ ID NO: 314020 - RNA, 22 nt, Homo sapiens
aaaugcaccacucuggugcagg

SEQ ID NO: 314021 - RNA, 22 nt, Homo sapiens
aaaugcauugagggaaaaggca

SEQ ID NO: 314022 - RNA, 22 nt, Homo sapiens
aaauucaucaaaugguuuguau

SEQ ID NO: 314023 - RNA, 22 nt, Homo sapiens
aaauugcaguuaggaugauggu

SEQ ID NO: 314024 - RNA, 22 nt, Homo sapiens
aacacuguuuccagucaugauc

SEQ ID NO: 314025 - RNA, 22 nt, Homo sapiens
aacauguuuagcagauaccugu

SEQ ID NO: 314026 - RNA, 22 nt, Homo sapiens
aaccuauaguauugaaaucaag

SEQ ID NO: 314027 - RNA, 22 nt, Homo sapiens
aacuaugucaaauaaaaugagg

SEQ ID NO: 314028 - RNA, 21 nt, Homo sapiens
aagaaagcuggacuugccgcu

SEQ ID NO: 314029 - RNA, 22 nt, Homo sapiens
aagagagcuaugugcauaauua

SEQ ID NO: 314030 - RNA, 18 nt, Homo sapiens
aagagcucagcacagguu

SEQ ID NO: 314031 - RNA, 22 nt, Homo sapiens
aagcaggugaugagugggugug

SEQ ID NO: 314032 - RNA, 22 nt, Homo sapiens
aagcaucacauaauggaucaug

SEQ ID NO: 314033 - RNA, 22 nt, Homo sapiens
aagcaucacuggaggcagccau

SEQ ID NO: 314034 - RNA, 22 nt, Homo sapiens
aagcugcauuuucuagaugcuu

SEQ ID NO: 314035 - RNA, 22 nt, Homo sapiens
aagcugccuugcugaggagaaa

SEQ ID NO: 314036 - RNA, 22 nt, Homo sapiens
aagcuggcauucaugagauuac

SEQ ID NO: 314037 - RNA, 22 nt, Homo sapiens
aaggagcaguggacggguccua

SEQ ID NO: 314038 - RNA, 22 nt, Homo sapiens
aaggagugugauucuucaguuu

SEQ ID NO: 314039 - RNA, 22 nt, Homo sapiens
aaggcagugugcacauaacacu

SEQ ID NO: 314040 - RNA, 22 nt, Homo sapiens
aaggcauggugacuauuuaggc

SEQ ID NO: 314041 - RNA, 20 nt, Homo sapiens
aaggcuuucgaguuccaggg

SEQ ID NO: 314042 - RNA, 22 nt, Homo sapiens
aagggaauguuguggcugguuu

SEQ ID NO: 314043 - RNA, 17 nt, Homo sapiens
aaggugcuucgaccucc

SEQ ID NO: 314044 - RNA, 22 nt, Homo sapiens
aaguaaacauugagagacaaga

SEQ ID NO: 314045 - RNA, 22 nt, Homo sapiens
aaguaauggaguuauuuuauga

SEQ ID NO: 314046 - RNA, 22 nt, Homo sapiens
aaguaauugagguuuuugcugu

SEQ ID NO: 314047 - RNA, 22 nt, Homo sapiens
aagucacugagacuuguggcug

SEQ ID NO: 314048 - RNA, 22 nt, Homo sapiens
aagucaguuugggagaagcuau

SEQ ID NO: 314049 - RNA, 22 nt, Homo sapiens
aagugacauugugcccauuuga

SEQ ID NO: 314050 - RNA, 22 nt, Homo sapiens
aagugaguaauacgucaguugu

SEQ ID NO: 314051 - RNA, 22 nt, Homo sapiens
aagugcauguauuaguguaguc

SEQ ID NO: 314052 - RNA, 17 nt, Homo sapiens
aaguggcuuguucacca

SEQ ID NO: 314053 - RNA, 22 nt, Homo sapiens
aaguugcuuuagguaagucaau

SEQ ID NO: 314054 - RNA, 22 nt, Homo sapiens
aggaggauugcuuucaucuuuu

SEQ ID NO: 314055 - RNA, 22 nt, Homo sapiens
aggauaguaaugauagagaggc

SEQ ID NO: 314056 - RNA, 21 nt, Homo sapiens
aggauaguagauuaaauauuu

SEQ ID NO: 314057 - RNA, 22 nt, Homo sapiens
aggcaaaugccagcaaucacac

SEQ ID NO: 314058 - RNA, 22 nt, Homo sapiens
aggcaacaugguaaaacccugu

SEQ ID NO: 314059 - RNA, 22 nt, Homo sapiens
aggcaugaguucagaggguaug

SEQ ID NO: 314060 - RNA, 22 nt, Homo sapiens
aggcaugauuguauuuugcucu

SEQ ID NO: 314061 - RNA, 22 nt, Homo sapiens
aggguaguaggcuugggauugg

SEQ ID NO: 314062 - RNA, 22 nt, Homo sapiens
agguaauuuucccagagggaaa

SEQ ID NO: 314063 - RNA, 22 nt, Homo sapiens
agguccauuauuuucauucaug

SEQ ID NO: 314064 - RNA, 22 nt, Homo sapiens
agguccauugguauuauagcau

SEQ ID NO: 314065 - RNA, 22 nt, Homo sapiens
aggugcuugagggaagaaauua

SEQ ID NO: 314066 - RNA, 22 nt, Homo sapiens
aggugguauuucaaaguggcag

SEQ ID NO: 314067 - RNA, 22 nt, Homo sapiens
agguguuguugaggagauuuca

SEQ ID NO: 314068 - RNA, 22 nt, Homo sapiens
agguuaugauuguagagcgagg

SEQ ID NO: 314069 - RNA, 22 nt, Homo sapiens
aguagcacaugccacccugucu

SEQ ID NO: 314070 - RNA, 22 nt, Homo sapiens
aguaucaagccacacaugguca

SEQ ID NO: 314071 - RNA, 22 nt, Homo sapiens
agucaagaaucucagcaucuuu

SEQ ID NO: 314072 - RNA, 21 nt, Homo sapiens
agucauaggaguacauaaugc

SEQ ID NO: 314073 - RNA, 22 nt, Homo sapiens
agucauggaucacaguagccuc

SEQ ID NO: 314074 - RNA, 22 nt, Homo sapiens
agucaugggagagaugugaucg

SEQ ID NO: 314075 - RNA, 22 nt, Homo sapiens
agugaacaaagaagugcagaua

SEQ ID NO: 314076 - RNA, 22 nt, Homo sapiens
agugcaguugucacgugccuuc

SEQ ID NO: 314077 - RNA, 22 nt, Homo sapiens
agugcauuugcaucucaauaua

SEQ ID NO: 314078 - RNA, 22 nt, Homo sapiens
aguggauuuuauuugacaacua

SEQ ID NO: 314079 - RNA, 22 nt, Homo sapiens
aguggcacaauuuugacucccc

SEQ ID NO: 314080 - RNA, 22 nt, Homo sapiens
aguggugucugaguggccaggg

SEQ ID NO: 314081 - RNA, 22 nt, Homo sapiens
auaaaugcaaugguauuuuuga

SEQ ID NO: 314082 - RNA, 22 nt, Homo sapiens
auaagauaguggaagugggauu

SEQ ID NO: 314083 - RNA, 22 nt, Homo sapiens
auaagugcuuguugaauaauag

SEQ ID NO: 314084 - RNA, 22 nt, Homo sapiens
auaauagguaguaauggauuga

SEQ ID NO: 314085 - RNA, 22 nt, Homo sapiens
auaauagguugauugacauugc

SEQ ID NO: 314086 - RNA, 22 nt, Homo sapiens
auacaguauggagggcccagcu

SEQ ID NO: 314087 - RNA, 22 nt, Homo sapiens
auacagugaauaucuggggcag

SEQ ID NO: 314088 - RNA, 22 nt, Homo sapiens
auacaguguucugggaagaagu

SEQ ID NO: 314089 - RNA, 22 nt, Homo sapiens
auacugccuuuagcaaaacagu

SEQ ID NO: 314090 - RNA, 22 nt, Homo sapiens
auagaauguauuaguaaauuug

SEQ ID NO: 314091 - RNA, 22 nt, Homo sapiens
auagacugaguggcuuaaacca

SEQ ID NO: 314092 - RNA, 22 nt, Homo sapiens
auagcagcaccucacucuacug

SEQ ID NO: 314093 - RNA, 22 nt, Homo sapiens
auaggucaucaugggaguggga

SEQ ID NO: 314094 - RNA, 22 nt, Homo sapiens
uuaggcuuuuuaaccaguuguu

SEQ ID NO: 314095 - RNA, 22 nt, Homo sapiens
uuagggaggagucccucuuuuu

SEQ ID NO: 314096 - RNA, 22 nt, Homo sapiens
uuagguagaauugauuaaguuu

SEQ ID NO: 314097 - RNA, 22 nt, Homo sapiens
uuauagcagugcccaacuccug

SEQ ID NO: 314098 - RNA, 22 nt, Homo sapiens
uuauagcuaacaucugugaaaa

SEQ ID NO: 314099 - RNA, 22 nt, Homo sapiens
uuaucaaacccuaggagguggu

SEQ ID NO: 314100 - RNA, 22 nt, Homo sapiens
uuaucacauugacugauuugca

SEQ ID NO: 314101 - RNA, 22 nt, Homo sapiens
uuauggcuuugcgguguuagca

SEQ ID NO: 314102 - RNA, 23 nt, Homo sapiens
uuauggcuuuuauuauguugagg

SEQ ID NO: 314103 - RNA, 22 nt, Homo sapiens
uuauguguuuaauguuucugaa

SEQ ID NO: 314104 - RNA, 22 nt, Homo sapiens
uuauuugguugcugacuuggaa

SEQ ID NO: 314105 - RNA, 22 nt, Homo sapiens
uucaaaggauagauuaagauca

SEQ ID NO: 314106 - RNA, 22 nt, Homo sapiens
uucaaaucuuuggcucccacua

SEQ ID NO: 314107 - RNA, 22 nt, Homo sapiens
uucaaguaguucucaugccuca

SEQ ID NO: 314108 - RNA, 22 nt, Homo sapiens
uucaagugaacaaaaugaggag

SEQ ID NO: 314109 - RNA, 22 nt, Homo sapiens
uucacaauuaaaugugguuauu

SEQ ID NO: 314110 - RNA, 20 nt, Homo sapiens
uucacaggcagcuucuuucu

SEQ ID NO: 314111 - RNA, 22 nt, Homo sapiens
uucacaugguugccuuuugauc

SEQ ID NO: 314112 - RNA, 22 nt, Homo sapiens
uucaccagggaagucucaacuc

SEQ ID NO: 314113 - RNA, 21 nt, Homo sapiens
uucaccauggcuccacacucu

SEQ ID NO: 314114 - RNA, 21 nt, Homo sapiens
uucacuggucuauuucccuuu

SEQ ID NO: 314115 - RNA, 22 nt, Homo sapiens
uucacugugugacccugggcca

SEQ ID NO: 314116 - RNA, 22 nt, Homo sapiens
uucacuguuaagcaguuaaacu

SEQ ID NO: 314117 - RNA, 22 nt, Homo sapiens
uucaggcaccauggucauugau

SEQ ID NO: 314118 - RNA, 22 nt, Homo sapiens
uucaggcuccugugagaaucua

SEQ ID NO: 314119 - RNA, 22 nt, Homo sapiens
uucaggcuuuuauuuacugaua

SEQ ID NO: 314120 - RNA, 22 nt, Homo sapiens
uucaguaaauguucuuacuaua

SEQ ID NO: 314121 - RNA, 22 nt, Homo sapiens
uucagugguuauuugugagauu

SEQ ID NO: 314122 - RNA, 21 nt, Homo sapiens
uucaucagccagaaaucaagc

SEQ ID NO: 314123 - RNA, 22 nt, Homo sapiens
uucaucaggaauauugaccugu

SEQ ID NO: 314124 - RNA, 22 nt, Homo sapiens
uucaucagggguauuggccaau

SEQ ID NO: 314125 - RNA, 18 nt, Homo sapiens
uucaucaguccucagcug

SEQ ID NO: 314126 - RNA, 22 nt, Homo sapiens
uucaucaguugagcugguugcu

SEQ ID NO: 314127 - RNA, 22 nt, Homo sapiens
uucauggaguuuaaauuguagu

SEQ ID NO: 314128 - RNA, 22 nt, Homo sapiens
uucauguaaucaaggcagcuaa

SEQ ID NO: 314129 - RNA, 22 nt, Homo sapiens
uuccacaggguugaacuaguuu

SEQ ID NO: 314130 - RNA, 22 nt, Homo sapiens
uuccaguuauuauaccucuuaa

SEQ ID NO: 314131 - RNA, 22 nt, Homo sapiens
uucccugaguaucuuaccaugg

SEQ ID NO: 314132 - RNA, 22 nt, Homo sapiens
uucccugugggcuggugcucca

SEQ ID NO: 314133 - RNA, 22 nt, Homo sapiens
uucccuuugaauuggaaaggug

SEQ ID NO: 314134 - RNA, 22 nt, Homo sapiens
uucccuuugugcauaggauuug

SEQ ID NO: 314135 - RNA, 22 nt, Homo sapiens
uucccuuuuuucuaguagguag

SEQ ID NO: 314136 - RNA, 22 nt, Homo sapiens
uucucauggugauggcaaaauc

SEQ ID NO: 314137 - RNA, 22 nt, Homo sapiens
uucuccugguggacccuaaacg

SEQ ID NO: 314138 - RNA, 22 nt, Homo sapiens
uucuggaaaucagcagagggug

SEQ ID NO: 314139 - RNA, 22 nt, Homo sapiens
uucuggcucaggucaacacuuc

SEQ ID NO: 314140 - RNA, 22 nt, Homo sapiens
uucuggcuuauaaacgugacuu

SEQ ID NO: 314141 - RNA, 22 nt, Homo sapiens
uucuggcuuuuaaagaaauguu

SEQ ID NO: 314142 - RNA, 20 nt, Homo sapiens
uucuugaguuaacaaguuac

SEQ ID NO: 314143 - RNA, 22 nt, Homo sapiens
uucuugcugaauugugcccuuc

SEQ ID NO: 314144 - RNA, 22 nt, Homo sapiens
uucuuuaguucacuugcuccag

SEQ ID NO: 314145 - RNA, 22 nt, Homo sapiens
uugaaagacaucaccuacugcu

SEQ ID NO: 314146 - RNA, 22 nt, Homo sapiens
uugaaagucauggcacaggcaa

SEQ ID NO: 314147 - RNA, 22 nt, Homo sapiens
uugaacuagaaccugcaaauuu

SEQ ID NO: 314148 - RNA, 22 nt, Homo sapiens
uugaagacuaauuuagauaaug

SEQ ID NO: 314149 - RNA, 22 nt, Homo sapiens
uugaagagaaccgcggcuuauu

SEQ ID NO: 314150 - RNA, 22 nt, Homo sapiens
uugaaugaaaugaugucauuug

SEQ ID NO: 314151 - RNA, 17 nt, Homo sapiens
uugaaugcauuacuugg

SEQ ID NO: 314152 - RNA, 18 nt, Homo sapiens
uugaaugcgucccagaga

SEQ ID NO: 314153 - RNA, 22 nt, Homo sapiens
uugaauguguugggaagcccuu

SEQ ID NO: 314154 - RNA, 22 nt, Homo sapiens
uugacauaguuucugaaauaga

SEQ ID NO: 314155 - RNA, 23 nt, Homo sapiens
uugacuguggguacaaugugaua

SEQ ID NO: 314156 - RNA, 22 nt, Homo sapiens
uugagaaucuuucgaauguucu

SEQ ID NO: 314157 - RNA, 22 nt, Homo sapiens
uugagacugaacauuuguguac

SEQ ID NO: 314158 - RNA, 22 nt, Homo sapiens
uugagagaaaaggccaugccuu

SEQ ID NO: 314159 - RNA, 22 nt, Homo sapiens
uugagauggauagacauagcau

SEQ ID NO: 314160 - RNA, 22 nt, Homo sapiens
uugagauguaagauguuaauau

SEQ ID NO: 314161 - RNA, 22 nt, Homo sapiens
uugagauuauuguguuccuuua

SEQ ID NO: 314162 - RNA, 22 nt, Homo sapiens
uugagcaucauguuagcacuca

SEQ ID NO: 314163 - RNA, 21 nt, Homo sapiens
uugagcuuuuaguacagacag

SEQ ID NO: 314164 - RNA, 22 nt, Homo sapiens
uugagcuuuuuacuuguccaau

SEQ ID NO: 314165 - RNA, 22 nt, Homo sapiens
uugaggaagugguuccccagag

SEQ ID NO: 314166 - RNA, 22 nt, Homo sapiens
uugaggaaugucauuuguguuu

SEQ ID NO: 314167 - RNA, 22 nt, Homo sapiens
uugaggacuggaacacaggucu

SEQ ID NO: 314168 - RNA, 22 nt, Homo sapiens
uugaggaucauuguuuucggag

SEQ ID NO: 314169 - RNA, 22 nt, Homo sapiens
uugagggaaacauucacaucau

SEQ ID NO: 314170 - RNA, 22 nt, Homo sapiens
uugagggagcauuuguuuugag

SEQ ID NO: 314171 - RNA, 22 nt, Homo sapiens
uugagggagccuguuagucccg

SEQ ID NO: 314172 - RNA, 22 nt, Homo sapiens
uugagugaaugaaugauuaaau

SEQ ID NO: 314173 - RNA, 22 nt, Homo sapiens
uugcaaacaucuuguuucacau

SEQ ID NO: 314174 - RNA, 18 nt, Homo sapiens
uugcaaauucuucccugu

SEQ ID NO: 314175 - RNA, 22 nt, Homo sapiens
uugcaacuuagaaaaaucauuu

SEQ ID NO: 314176 - RNA, 22 nt, Homo sapiens
uugcaagaaaugcagauucuca

SEQ ID NO: 314177 - RNA, 22 nt, Homo sapiens
uugcaaggugcagcuuaugcaa

SEQ ID NO: 314178 - RNA, 22 nt, Homo sapiens
augggguagguagcucggggaa

SEQ ID NO: 314179 - RNA, 22 nt, Homo sapiens
auggucccuguuccaugcuccu

SEQ ID NO: 314180 - RNA, 22 nt, Homo sapiens
augucuggcagaagacuucuca

SEQ ID NO: 314181 - RNA, 22 nt, Homo sapiens
augugaacaucauagaaugcac

SEQ ID NO: 314182 - RNA, 22 nt, Homo sapiens
augugaacugaauuaauucaca

SEQ ID NO: 314183 - RNA, 22 nt, Homo sapiens
augugacagugguuuuaagcgu

SEQ ID NO: 314184 - RNA, 22 nt, Homo sapiens
augugcaaagcacuguucagca

SEQ ID NO: 314185 - RNA, 22 nt, Homo sapiens
augugugcuugugacacagccu

SEQ ID NO: 314186 - RNA, 22 nt, Homo sapiens
auuaaguaaugguuccaauaau

SEQ ID NO: 314187 - RNA, 22 nt, Homo sapiens
auuauguuguauuuccuugcag

SEQ ID NO: 314188 - RNA, 22 nt, Homo sapiens
auucacuguggcuuucucugau

SEQ ID NO: 314189 - RNA, 22 nt, Homo sapiens
auucauagugcuaagguguauc

SEQ ID NO: 314190 - RNA, 22 nt, Homo sapiens
auucaucagggauacuggccug

SEQ ID NO: 314191 - RNA, 22 nt, Homo sapiens
auucaucagggauauugguuga

SEQ ID NO: 314192 - RNA, 22 nt, Homo sapiens
auucaugggagcuacuuuaaaa

SEQ ID NO: 314193 - RNA, 22 nt, Homo sapiens
auuccagguggcgccauucaca

SEQ ID NO: 314194 - RNA, 22 nt, Homo sapiens
auucccuuagcugccucagccu

SEQ ID NO: 314195 - RNA, 22 nt, Homo sapiens
auugaacacuucugugugccag

SEQ ID NO: 314196 - RNA, 22 nt, Homo sapiens
auugaacaugccauauguacca

SEQ ID NO: 314197 - RNA, 20 nt, Homo sapiens
auugaacucaguauucugaa

SEQ ID NO: 314198 - RNA, 21 nt, Homo sapiens
auugagcacaugaaacauggc

SEQ ID NO: 314199 - RNA, 22 nt, Homo sapiens
auugaggcaggaggaccaucua

SEQ ID NO: 314200 - RNA, 22 nt, Homo sapiens
auugcaaagcguagacucuaaa

SEQ ID NO: 314201 - RNA, 22 nt, Homo sapiens
auugcacugcagccugggcaac

SEQ ID NO: 314202 - RNA, 18 nt, Homo sapiens
auugcccucauggggcuu

SEQ ID NO: 314203 - RNA, 22 nt, Homo sapiens
auugcuauuauuugaccauugu

SEQ ID NO: 314204 - RNA, 22 nt, Homo sapiens
auuggaacugaaauaauaacuu

SEQ ID NO: 314205 - RNA, 22 nt, Homo sapiens
auuggggaaugguggcuuuagu

SEQ ID NO: 314206 - RNA, 22 nt, Homo sapiens
auuguaauuuuagagaaagugg

SEQ ID NO: 314207 - RNA, 22 nt, Homo sapiens
auuguacuccagccugggcaaa

SEQ ID NO: 314208 - RNA, 22 nt, Homo sapiens
auuguacuccagccugggcuaa

SEQ ID NO: 314209 - RNA, 22 nt, Homo sapiens
auuguacuccagccugggugac

SEQ ID NO: 314210 - RNA, 22 nt, Homo sapiens
auuguacugccccccuguugcu

SEQ ID NO: 314211 - RNA, 22 nt, Homo sapiens
auugucacuuaaaagugcaugu

SEQ ID NO: 314212 - RNA, 22 nt, Homo sapiens
auuuccuguaggggcuugcgaa

SEQ ID NO: 314213 - RNA, 19 nt, Homo sapiens
auuugaucaucaggcacag

SEQ ID NO: 314214 - RNA, 22 nt, Homo sapiens
auuuggcaguauaaugcuuugg

SEQ ID NO: 314215 - RNA, 22 nt, Homo sapiens
auuuggcagugaagggaucaca

SEQ ID NO: 314216 - RNA, 22 nt, Homo sapiens
caaagcacuuggcuuggaagau

SEQ ID NO: 314217 - RNA, 22 nt, Homo sapiens
caaagcuauagcaccagaggga

SEQ ID NO: 314218 - RNA, 22 nt, Homo sapiens
caaauccucaccucaucaugaa

SEQ ID NO: 314219 - RNA, 19 nt, Homo sapiens
caacccugcagagaaagga

SEQ ID NO: 314220 - RNA, 22 nt, Homo sapiens
caaguguuuccuuaaauacuug

SEQ ID NO: 314221 - RNA, 23 nt, Homo sapiens
caauacugaccucacguuaauag

SEQ ID NO: 314222 - RNA, 19 nt, Homo sapiens
caauacuucuuggcauaca

SEQ ID NO: 314223 - RNA, 22 nt, Homo sapiens
cacagcacaggcaugaguguca

SEQ ID NO: 314224 - RNA, 22 nt, Homo sapiens
cacagcuagucaaugguagaca

SEQ ID NO: 314225 - RNA, 22 nt, Homo sapiens
cacagucugggcuuguuuguac

SEQ ID NO: 314226 - RNA, 22 nt, Homo sapiens
cacagugaacugguggguuuuu

SEQ ID NO: 314227 - RNA, 22 nt, Homo sapiens
cacaguguuccagcuauuugaa

SEQ ID NO: 314228 - RNA, 21 nt, Homo sapiens
cacauggaggcagagagugua

SEQ ID NO: 314229 - RNA, 22 nt, Homo sapiens
cacauguuugcuacauuuuucu

SEQ ID NO: 314230 - RNA, 22 nt, Homo sapiens
cacauugcaggaaaguucauua

SEQ ID NO: 314231 - RNA, 16 nt, Homo sapiens
cacauugcugcauggc

SEQ ID NO: 314232 - RNA, 22 nt, Homo sapiens
cacugcauccuccaccugccag

SEQ ID NO: 314233 - RNA, 22 nt, Homo sapiens
cacugcauccucugccuggcgg

SEQ ID NO: 314234 - RNA, 22 nt, Homo sapiens
cacugcauucuccaccucccag

SEQ ID NO: 314235 - RNA, 23 nt, Homo sapiens
cacugggcagcagguguucccag

SEQ ID NO: 314236 - RNA, 18 nt, Homo sapiens
cacuuggcuuugccccuc

SEQ ID NO: 314237 - RNA, 22 nt, Homo sapiens
cagagguauugcaaaagccuag

SEQ ID NO: 314238 - RNA, 22 nt, Homo sapiens
cagauacucauggaacuggguu

SEQ ID NO: 314239 - RNA, 22 nt, Homo sapiens
cagauacuccuggucucaggag

SEQ ID NO: 314240 - RNA, 20 nt, Homo sapiens
cagcaaccugcucucuuccu

SEQ ID NO: 314241 - RNA, 22 nt, Homo sapiens
cagcuggugcugcaccaguggg

SEQ ID NO: 314242 - RNA, 22 nt, Homo sapiens
cagcuguguuauaaacuaccau

SEQ ID NO: 314243 - RNA, 22 nt, Homo sapiens
cagcuguuguuaugucugcagg

SEQ ID NO: 314244 - RNA, 23 nt, Homo sapiens
cagcuucauugaacauaacuccu

SEQ ID NO: 314245 - RNA, 22 nt, Homo sapiens
caggcacgcuugggagacacac

SEQ ID NO: 314246 - RNA, 22 nt, Homo sapiens
caggcagucuggggguguaucc

SEQ ID NO: 314247 - RNA, 22 nt, Homo sapiens
cagggaauguuauuuaauagca

SEQ ID NO: 314248 - RNA, 20 nt, Homo sapiens
cagggcaaugaggagguaaa

SEQ ID NO: 314249 - RNA, 22 nt, Homo sapiens
cagggcauuggcugguaccugg

SEQ ID NO: 314250 - RNA, 22 nt, Homo sapiens
cagguaagaugcuuucucuuau

SEQ ID NO: 314251 - RNA, 22 nt, Homo sapiens
cagguacaugcaugugugugca

SEQ ID NO: 314252 - RNA, 22 nt, Homo sapiens
caggugcuuacuuaauagccau

SEQ ID NO: 314253 - RNA, 22 nt, Homo sapiens
caggugguauuugguuuucugu

SEQ ID NO: 314254 - RNA, 23 nt, Homo sapiens
cagugcaugacuguauaugcaaa

SEQ ID NO: 314255 - RNA, 22 nt, Homo sapiens
caguucaugguaggcaccauag

SEQ ID NO: 314256 - RNA, 22 nt, Homo sapiens
caguugcacuagccccguuuca

SEQ ID NO: 314257 - RNA, 22 nt, Homo sapiens
cauaaagauggaggaggccagg

SEQ ID NO: 314258 - RNA, 21 nt, Homo sapiens
cauaaugcuacuuauuuuaug

SEQ ID NO: 314259 - RNA, 22 nt, Homo sapiens
cauacaguaggcacuauuugua

SEQ ID NO: 314260 - RNA, 22 nt, Homo sapiens
caucacagcaaguagggagugg

SEQ ID NO: 314261 - RNA, 23 nt, Homo sapiens
caucacauagaggaaagaggaca

SEQ ID NO: 314262 - RNA, 22 nt, Homo sapiens
caucacaucugcaugguaagua

SEQ ID NO: 314263 - RNA, 22 nt, Homo sapiens
caucacaugcuuauuuuccuca

SEQ ID NO: 314264 - RNA, 22 nt, Homo sapiens
cauccccugcaccaaccuuuac

SEQ ID NO: 314265 - RNA, 22 nt, Homo sapiens
caucccugucgucaagucucug

SEQ ID NO: 314266 - RNA, 22 nt, Homo sapiens
caugauauugcagaauguuggu

SEQ ID NO: 314267 - RNA, 22 nt, Homo sapiens
caugcagcacacaugucugugc

SEQ ID NO: 314268 - RNA, 22 nt, Homo sapiens
caugccacugcacgccauccug

SEQ ID NO: 314269 - RNA, 22 nt, Homo sapiens
cauggccuuuggaaugugucua

SEQ ID NO: 314270 - RNA, 19 nt, Homo sapiens
cauggcuuauaauuuuaau

SEQ ID NO: 314271 - RNA, 22 nt, Homo sapiens
cauguaguagaaggagccagac

SEQ ID NO: 314272 - RNA, 22 nt, Homo sapiens
caugucacuuccucucugaugg

SEQ ID NO: 314273 - RNA, 22 nt, Homo sapiens
cauugcuaaaagucauauauaa

SEQ ID NO: 314274 - RNA, 22 nt, Homo sapiens
cauugguuaguuaacuuuaaga

SEQ ID NO: 314275 - RNA, 22 nt, Homo sapiens
cauuguacauaaguauggagua

SEQ ID NO: 314276 - RNA, 22 nt, Homo sapiens
cauuugguggcuacagaguaac

SEQ ID NO: 314277 - RNA, 22 nt, Homo sapiens
ccacaguggauuaaaguuacug

SEQ ID NO: 314278 - RNA, 22 nt, Homo sapiens
ccacauuggaaaggaucccccc

SEQ ID NO: 314279 - RNA, 22 nt, Homo sapiens
ccacugcacuccagcccggcaa

SEQ ID NO: 314280 - RNA, 22 nt, Homo sapiens
ccagaguggagccuuugcgagg

SEQ ID NO: 314281 - RNA, 20 nt, Homo sapiens
ccagcaucauuagauucugg

SEQ ID NO: 314282 - RNA, 22 nt, Homo sapiens
ccagccgggugcaguggcucac

SEQ ID NO: 314283 - RNA, 23 nt, Homo sapiens
ccaguauuuauguaaggaagugu

SEQ ID NO: 314284 - RNA, 22 nt, Homo sapiens
ccagugguucccuguggccuga

SEQ ID NO: 314285 - RNA, 20 nt, Homo sapiens
ccaguguuauuuauguucua

SEQ ID NO: 314286 - RNA, 22 nt, Homo sapiens
ccauggcuauucuguaaggguu

SEQ ID NO: 314287 - RNA, 22 nt, Homo sapiens
cccagugguuacauaaggagua

SEQ ID NO: 314288 - RNA, 22 nt, Homo sapiens
cccagugugaacuuggcauuuu

SEQ ID NO: 314289 - RNA, 22 nt, Homo sapiens
ccccagguuucaauaaagccca

SEQ ID NO: 314290 - RNA, 22 nt, Homo sapiens
ccccaguguguaaaggccuugc

SEQ ID NO: 314291 - RNA, 22 nt, Homo sapiens
ccccauuguugugguuuuaucu

SEQ ID NO: 314292 - RNA, 22 nt, Homo sapiens
ccccugaaacucacucauuauc

SEQ ID NO: 314293 - RNA, 22 nt, Homo sapiens
cccuugcacuucagagcugcau

SEQ ID NO: 314294 - RNA, 22 nt, Homo sapiens
ccucauggagaaccucugcuag

SEQ ID NO: 314295 - RNA, 22 nt, Homo sapiens
ccucauggagaacuucugcuag

SEQ ID NO: 314296 - RNA, 22 nt, Homo sapiens
ccucuuuguugagacuucacca

SEQ ID NO: 314297 - RNA, 22 nt, Homo sapiens
ccugugguuaaccagcuagaug

SEQ ID NO: 314298 - RNA, 21 nt, Homo sapiens
ccuugagaacaucaauuugcu

SEQ ID NO: 314299 - RNA, 22 nt, Homo sapiens
ccuuggcaauggcuggggcuga

SEQ ID NO: 314300 - RNA, 19 nt, Homo sapiens
ccuuugguuuccaugacau

SEQ ID NO: 314301 - RNA, 22 nt, Homo sapiens
ccuuuguuaguuugcugagaau

SEQ ID NO: 314302 - RNA, 22 nt, Homo sapiens
cgccgggggaugggcaccagcg

SEQ ID NO: 314303 - RNA, 22 nt, Homo sapiens
cgccugagcugaggaagcugca

SEQ ID NO: 314304 - RNA, 23 nt, Homo sapiens
cuaaagucugucacugaggacuu

SEQ ID NO: 314305 - RNA, 22 nt, Homo sapiens
cuaacuaugucucaggaugucc

SEQ ID NO: 314306 - RNA, 18 nt, Homo sapiens
cuaagacacuuggcagag

SEQ ID NO: 314307 - RNA, 20 nt, Homo sapiens
cuaaucaucccagaagaaau

SEQ ID NO: 314308 - RNA, 22 nt, Homo sapiens
cuagaagguaagagcuggaugc

SEQ ID NO: 314309 - RNA, 22 nt, Homo sapiens
cuagagagaagcugugugaccu

SEQ ID NO: 314310 - RNA, 22 nt, Homo sapiens
cuagaggcacagccuaggcacu

SEQ ID NO: 314311 - RNA, 22 nt, Homo sapiens
cuagcacauuuaucuuuauaca

SEQ ID NO: 314312 - RNA, 22 nt, Homo sapiens
cuauggcagccacggccuggag

SEQ ID NO: 314313 - RNA, 22 nt, Homo sapiens
cuauggcucugguuauggcugu

SEQ ID NO: 314314 - RNA, 22 nt, Homo sapiens
cuauuagguuggggcgaaagua

SEQ ID NO: 314315 - RNA, 19 nt, Homo sapiens
cucaaagugguauuuggag

SEQ ID NO: 314316 - RNA, 22 nt, Homo sapiens
cucaauuuggaauugucaguaa

SEQ ID NO: 314317 - RNA, 22 nt, Homo sapiens
cucacagucucucccuaauuuu

SEQ ID NO: 314318 - RNA, 22 nt, Homo sapiens
cucacaguucuaaaggcaagaa

SEQ ID NO: 314319 - RNA, 20 nt, Homo sapiens
cucaccagguguaggcugag

SEQ ID NO: 314320 - RNA, 22 nt, Homo sapiens
cucacggcccugcgcacuggca

SEQ ID NO: 314321 - RNA, 22 nt, Homo sapiens
cucacggugcaggcuucuggga

SEQ ID NO: 314322 - RNA, 22 nt, Homo sapiens
cucacuaguaaggcuguuuagu

SEQ ID NO: 314323 - RNA, 22 nt, Homo sapiens
cucagcaguggauuuaccacca

SEQ ID NO: 314324 - RNA, 22 nt, Homo sapiens
cuccacugagcaggugggaggc

SEQ ID NO: 314325 - RNA, 20 nt, Homo sapiens
cucccugacaaauguggaaa

SEQ ID NO: 314326 - RNA, 22 nt, Homo sapiens
cucugguggaagcagggggcaa

SEQ ID NO: 314327 - RNA, 22 nt, Homo sapiens
cucuuggguagauuuugcagag

SEQ ID NO: 314328 - RNA, 22 nt, Homo sapiens
cugaaaguuauucaggggcaag

SEQ ID NO: 314329 - RNA, 22 nt, Homo sapiens
cugacugaggaucaguucauca

SEQ ID NO: 314330 - RNA, 22 nt, Homo sapiens
cugagagaggagcuaaaacugc

SEQ ID NO: 314331 - RNA, 22 nt, Homo sapiens
cugagagaugagaccucucacu

SEQ ID NO: 314332 - RNA, 22 nt, Homo sapiens
cugagauacacuaauagucucu

SEQ ID NO: 314333 - RNA, 22 nt, Homo sapiens
cugagaucguggggcugcuguc

SEQ ID NO: 314334 - RNA, 22 nt, Homo sapiens
cugagcaaagaagugauaauga

SEQ ID NO: 314335 - RNA, 22 nt, Homo sapiens
cugagcaauauagugagaucuu

SEQ ID NO: 314336 - RNA, 22 nt, Homo sapiens
cugagcuagaccacuuggcucc

SEQ ID NO: 314337 - RNA, 22 nt, Homo sapiens
cugagcucauuucuuuugcuac

SEQ ID NO: 314338 - RNA, 22 nt, Homo sapiens
cugcaagaugcauaggaauuuu

SEQ ID NO: 314339 - RNA, 19 nt, Homo sapiens
cugcacugagaaaaggagg

SEQ ID NO: 314340 - RNA, 22 nt, Homo sapiens
cugcagguaggggcagcuuugg

SEQ ID NO: 314341 - RNA, 22 nt, Homo sapiens
cugcauuugaugacguauggug

SEQ ID NO: 314342 - RNA, 22 nt, Homo sapiens
cugccacugacaccucaaggac

SEQ ID NO: 314343 - RNA, 18 nt, Homo sapiens
cugccagugugcucuccg

SEQ ID NO: 314344 - RNA, 22 nt, Homo sapiens
cugccugagaaaauggagggca

SEQ ID NO: 314345 - RNA, 22 nt, Homo sapiens
cuggaaagaaacccuuaauucu

SEQ ID NO: 314346 - RNA, 22 nt, Homo sapiens
cuggaaagcaaguccauugcuc

SEQ ID NO: 314347 - RNA, 22 nt, Homo sapiens
cuggaaggaaaaacaaccacag

SEQ ID NO: 314348 - RNA, 22 nt, Homo sapiens
cuggaguuugaggcugcaguga

SEQ ID NO: 314349 - RNA, 22 nt, Homo sapiens
cuggcaaauguuuucuguaaag

SEQ ID NO: 314350 - RNA, 22 nt, Homo sapiens
cugggaugugacuguugccccc

SEQ ID NO: 314351 - RNA, 22 nt, Homo sapiens
cugucagugggaguucaggcuu

SEQ ID NO: 314352 - RNA, 22 nt, Homo sapiens
cugucuggaggccugcaaauaa

SEQ ID NO: 314353 - RNA, 17 nt, Homo sapiens
cugugaugaucuugucu

SEQ ID NO: 314354 - RNA, 22 nt, Homo sapiens
cuguugguuaaauuccaugcag

SEQ ID NO: 314355 - RNA, 22 nt, Homo sapiens
cuguuuguuuaggguacucaga

SEQ ID NO: 314356 - RNA, 21 nt, Homo sapiens
cuuaagccacuaaguuuugga

SEQ ID NO: 314357 - RNA, 19 nt, Homo sapiens
cuuaggugaccaguuccca

SEQ ID NO: 314358 - RNA, 22 nt, Homo sapiens
cuuagguuaugauaaauuuagu

SEQ ID NO: 314359 - RNA, 22 nt, Homo sapiens
cuucacuggagucccuggauuc

SEQ ID NO: 314360 - RNA, 22 nt, Homo sapiens
cuuccagcuggguucagucagu

SEQ ID NO: 314361 - RNA, 20 nt, Homo sapiens
cuuccaguggccccaucuuu

SEQ ID NO: 314362 - RNA, 22 nt, Homo sapiens
cuucuugcuguguccucacaug

SEQ ID NO: 314363 - RNA, 22 nt, Homo sapiens
cuugaauguaaauaauguacag

SEQ ID NO: 314364 - RNA, 22 nt, Homo sapiens
cuuggcauuguguugauagaag

SEQ ID NO: 314365 - RNA, 22 nt, Homo sapiens
cuuggcuccgacuccccuccaa

SEQ ID NO: 314366 - RNA, 18 nt, Homo sapiens
cuugucaaaucuuuccuc

SEQ ID NO: 314367 - RNA, 21 nt, Homo sapiens
cuuuaugcuguguuagaaaag

SEQ ID NO: 314368 - RNA, 22 nt, Homo sapiens
cuuucacacuguuggugggaau

SEQ ID NO: 314369 - RNA, 22 nt, Homo sapiens
cuuugauuauaaaaggguguuu

SEQ ID NO: 314370 - RNA, 22 nt, Homo sapiens
cuuugcuaauccaacccucauc

SEQ ID NO: 314371 - RNA, 22 nt, Homo sapiens
cuuugggaccgcgguuuauacu

SEQ ID NO: 314372 - RNA, 22 nt, Homo sapiens
cuuugguucuguuuauaugcug

SEQ ID NO: 314373 - RNA, 19 nt, Homo sapiens
cuuugguugagcguguugg

SEQ ID NO: 314374 - RNA, 22 nt, Homo sapiens
gaaugaauguuuauccuuagau

SEQ ID NO: 314375 - RNA, 22 nt, Homo sapiens
gaaugcaugaggggaucagaug

SEQ ID NO: 314376 - RNA, 22 nt, Homo sapiens
gaauucugucgcuuacuagaug

SEQ ID NO: 314377 - RNA, 22 nt, Homo sapiens
gacacagugaagucucuacuug

SEQ ID NO: 314378 - RNA, 21 nt, Homo sapiens
gaccacagcagggaaugucag

SEQ ID NO: 314379 - RNA, 18 nt, Homo sapiens
gacucaguuucuaaggca

SEQ ID NO: 314380 - RNA, 19 nt, Homo sapiens
gacuccagaguugugugcu

SEQ ID NO: 314381 - RNA, 22 nt, Homo sapiens
gagaacaguguuguauuuuuuc

SEQ ID NO: 314382 - RNA, 22 nt, Homo sapiens
gagacauguuugccaauaauuu

SEQ ID NO: 314383 - RNA, 23 nt, Homo sapiens
gagaccagcuucagaaagcacga

SEQ ID NO: 314384 - RNA, 22 nt, Homo sapiens
gagauaggauucacuuucaugu

SEQ ID NO: 314385 - RNA, 22 nt, Homo sapiens
gagauaguguggguacagcuau

SEQ ID NO: 314386 - RNA, 22 nt, Homo sapiens
gagaucuuuaagaacuacugcu

SEQ ID NO: 314387 - RNA, 22 nt, Homo sapiens
gagcaccagucccugucagugc

SEQ ID NO: 314388 - RNA, 22 nt, Homo sapiens
gagcuacauggauagucugcau

SEQ ID NO: 314389 - RNA, 22 nt, Homo sapiens
gaggcaauaugagggaggcuuc

SEQ ID NO: 314390 - RNA, 22 nt, Homo sapiens
gaggcaguguguccguucucgg

SEQ ID NO: 314391 - RNA, 22 nt, Homo sapiens
gagguaagaugauucguguccu

SEQ ID NO: 314392 - RNA, 22 nt, Homo sapiens
gagguaggaauaaacauuugaa

SEQ ID NO: 314393 - RNA, 22 nt, Homo sapiens
gagguauggauaucuggagagg

SEQ ID NO: 314394 - RNA, 22 nt, Homo sapiens
gagguggauacauuaaauaaug

SEQ ID NO: 314395 - RNA, 22 nt, Homo sapiens
gaggugguagguucacagcagc

SEQ ID NO: 314396 - RNA, 22 nt, Homo sapiens
gagguggugguggaggcauagc

SEQ ID NO: 314397 - RNA, 22 nt, Homo sapiens
gaguauuuuacaucguguaauu

SEQ ID NO: 314398 - RNA, 22 nt, Homo sapiens
gauauguaguaguugaaaaaga

SEQ ID NO: 314399 - RNA, 22 nt, Homo sapiens
gauauguguaucuauguacaug

SEQ ID NO: 314400 - RNA, 22 nt, Homo sapiens
gauauguguuuuagucaggguu

SEQ ID NO: 314401 - RNA, 22 nt, Homo sapiens
gaucacauggccauuucuagcu

SEQ ID NO: 314402 - RNA, 22 nt, Homo sapiens
gaucugugugauuggaugcauu

SEQ ID NO: 314403 - RNA, 22 nt, Homo sapiens
gaucuguguuuguaugcauaag

SEQ ID NO: 314404 - RNA, 22 nt, Homo sapiens
gaugcaguaagaaugcauagcg

SEQ ID NO: 314405 - RNA, 22 nt, Homo sapiens
gauggaauuaaaaucagaauca

SEQ ID NO: 314406 - RNA, 22 nt, Homo sapiens
gaugguuuuuuaagaagagccu

SEQ ID NO: 314407 - RNA, 22 nt, Homo sapiens
gauuccacuuacuuagcauucc

SEQ ID NO: 314408 - RNA, 22 nt, Homo sapiens
gauuggcauugcugcaccugag

SEQ ID NO: 314409 - RNA, 22 nt, Homo sapiens
gcaaagaaugcagauuugccuc

SEQ ID NO: 314410 - RNA, 22 nt, Homo sapiens
gcaagacaugucuaagguuuaa

SEQ ID NO: 314411 - RNA, 22 nt, Homo sapiens
gcacaaugccugacgaguccug

SEQ ID NO: 314412 - RNA, 22 nt, Homo sapiens
gcacaguggcucccgucuauaa

SEQ ID NO: 314413 - RNA, 22 nt, Homo sapiens
gcacaguguuacuugauauauu

SEQ ID NO: 314414 - RNA, 22 nt, Homo sapiens
gcaccaugguagaauaauggua

SEQ ID NO: 314415 - RNA, 22 nt, Homo sapiens
gcagcacauggcagaacauauu

SEQ ID NO: 314416 - RNA, 22 nt, Homo sapiens
gcagcagugcccuggauggaaa

SEQ ID NO: 314417 - RNA, 22 nt, Homo sapiens
gcagcaucaaaucacacaagau

SEQ ID NO: 314418 - RNA, 22 nt, Homo sapiens
gcaggcaugacauuucacucuu

SEQ ID NO: 314419 - RNA, 17 nt, Homo sapiens
gcaguacuuaguaagga

SEQ ID NO: 314420 - RNA, 23 nt, Homo sapiens
gcagucauuuggaaaagguugaa

SEQ ID NO: 314421 - RNA, 22 nt, Homo sapiens
gcagugugugaggaauuugggu

SEQ ID NO: 314422 - RNA, 20 nt, Homo sapiens
gcaguguucugaccugaauc

SEQ ID NO: 314423 - RNA, 22 nt, Homo sapiens
gcaguguucugggcaggaagaa

SEQ ID NO: 314424 - RNA, 22 nt, Homo sapiens
gcauaugucuuuauagcagcau

SEQ ID NO: 314425 - RNA, 20 nt, Homo sapiens
gcauaugucuuuauggcagc

SEQ ID NO: 314426 - RNA, 20 nt, Homo sapiens
gcaugagucuuuauaguaga

SEQ ID NO: 314427 - RNA, 22 nt, Homo sapiens
gcaugcauuuuccuaacuagaa

SEQ ID NO: 314428 - RNA, 22 nt, Homo sapiens
gccaagaucugaauaauuaaga

SEQ ID NO: 314429 - RNA, 22 nt, Homo sapiens
gccauggaggauuuauagaggc

SEQ ID NO: 314430 - RNA, 22 nt, Homo sapiens
gccccgggugaugcagccguca

SEQ ID NO: 314431 - RNA, 22 nt, Homo sapiens
gcuccuuugaguagcuucugug

SEQ ID NO: 314432 - RNA, 22 nt, Homo sapiens
gcugauguuggccucugggcuu

SEQ ID NO: 314433 - RNA, 22 nt, Homo sapiens
gcugcuguaccagaugugguua

SEQ ID NO: 314434 - RNA, 22 nt, Homo sapiens
gcugcuguggcagauuggauuc

SEQ ID NO: 314435 - RNA, 22 nt, Homo sapiens
gcuggauguuucaauacaaaua

SEQ ID NO: 314436 - RNA, 22 nt, Homo sapiens
gcugguauuacaggcaugagcc

SEQ ID NO: 314437 - RNA, 22 nt, Homo sapiens
gcugguguucaggcccucaguc

SEQ ID NO: 314438 - RNA, 22 nt, Homo sapiens
gcugugguuuaguagaaagaag

SEQ ID NO: 314439 - RNA, 22 nt, Homo sapiens
gcuucauggaggcugggcgcag

SEQ ID NO: 314440 - RNA, 22 nt, Homo sapiens
gcuuugcaauggcauugaccau

SEQ ID NO: 314441 - RNA, 18 nt, Homo sapiens
ggaaaacuuuucuaagua

SEQ ID NO: 314442 - RNA, 22 nt, Homo sapiens
ggaaaguaacccauucucuuac

SEQ ID NO: 314443 - RNA, 18 nt, Homo sapiens
ggaagccuauuuaguaac

SEQ ID NO: 314444 - RNA, 17 nt, Homo sapiens
ggaagccuuugguuuaa

SEQ ID NO: 314445 - RNA, 22 nt, Homo sapiens
ggaaugagaaauauuacacaau

SEQ ID NO: 314446 - RNA, 20 nt, Homo sapiens
ggaauguuaaucuccaugau

SEQ ID NO: 314447 - RNA, 22 nt, Homo sapiens
ggacaaaguauuuucaaaugua

SEQ ID NO: 314448 - RNA, 22 nt, Homo sapiens
ggacagugaaugccacuccucc

SEQ ID NO: 314449 - RNA, 22 nt, Homo sapiens
ggagaucuuguuaaaguacaga

SEQ ID NO: 314450 - RNA, 22 nt, Homo sapiens
ggaggcuaguaaaaagguagaa

SEQ ID NO: 314451 - RNA, 16 nt, Homo sapiens
ggaggucaucugggaa

SEQ ID NO: 314452 - RNA, 20 nt, Homo sapiens
ggagguuguauaaguacauc

SEQ ID NO: 314453 - RNA, 22 nt, Homo sapiens
ggagucugauuuuuauguugcu

SEQ ID NO: 314454 - RNA, 22 nt, Homo sapiens
ggagugugauuguucucuguua

SEQ ID NO: 314455 - RNA, 22 nt, Homo sapiens
ggcaaaaucgcaauuacuuuug

SEQ ID NO: 314456 - RNA, 22 nt, Homo sapiens
ggcaaaauggccagugggucac

SEQ ID NO: 314457 - RNA, 22 nt, Homo sapiens
ggcaagaaaaugcaauuacugu

SEQ ID NO: 314458 - RNA, 17 nt, Homo sapiens
ggcaagaaguggaacuc

SEQ ID NO: 314459 - RNA, 22 nt, Homo sapiens
ggcaccauggaaggacgggagc

SEQ ID NO: 314460 - RNA, 22 nt, Homo sapiens
ggcacuguggcucaagccugua

SEQ ID NO: 314461 - RNA, 22 nt, Homo sapiens
ggcagagucuugcaucuuuaga

SEQ ID NO: 314462 - RNA, 17 nt, Homo sapiens
ggcaggaauuaauguca

SEQ ID NO: 314463 - RNA, 22 nt, Homo sapiens
ggcauguuuaguagaauguggu

SEQ ID NO: 314464 - RNA, 22 nt, Homo sapiens
ggcgguguccuccaagugcuuc

SEQ ID NO: 314465 - RNA, 22 nt, Homo sapiens
ugcuuaggcuuccuuacaguau

SEQ ID NO: 314466 - RNA, 22 nt, Homo sapiens
ugcuuugguagaaaucuuuggu

SEQ ID NO: 314467 - RNA, 22 nt, Homo sapiens
ugcuuuguugaaaaucauuugg

SEQ ID NO: 314468 - RNA, 22 nt, Homo sapiens
uggaaaguccaagccaaccggg

SEQ ID NO: 314469 - RNA, 22 nt, Homo sapiens
uggaaauuaacagggauugucc

SEQ ID NO: 314470 - RNA, 20 nt, Homo sapiens
uggaaauuaaccuuucaggu

SEQ ID NO: 314471 - RNA, 22 nt, Homo sapiens
uggaaauuaagucuuuccugag

SEQ ID NO: 314472 - RNA, 19 nt, Homo sapiens
uggaacauaaaaguugguu

SEQ ID NO: 314473 - RNA, 22 nt, Homo sapiens
uggaagacaggcuguauuuuaa

SEQ ID NO: 314474 - RNA, 23 nt, Homo sapiens
uggaagacuccucucuuggcugc

SEQ ID NO: 314475 - RNA, 22 nt, Homo sapiens
uggaagacuuuagaggcuuaua

SEQ ID NO: 314476 - RNA, 20 nt, Homo sapiens
uggaagccuggugcuaucuu

SEQ ID NO: 314477 - RNA, 20 nt, Homo sapiens
uggaaggcaucugcauuauu

SEQ ID NO: 314478 - RNA, 22 nt, Homo sapiens
uggaagguaaguuuugagcauu

SEQ ID NO: 314479 - RNA, 22 nt, Homo sapiens
uggaagucauugagguguguua

SEQ ID NO: 314480 - RNA, 22 nt, Homo sapiens
uggaaucuagagaaaugcaaac

SEQ ID NO: 314481 - RNA, 22 nt, Homo sapiens
uggaauuuagguugauaguaua

SEQ ID NO: 314482 - RNA, 22 nt, Homo sapiens
uggacagacaagguuauagauc

SEQ ID NO: 314483 - RNA, 21 nt, Homo sapiens
uggaccccuacuucucaccau

SEQ ID NO: 314484 - RNA, 22 nt, Homo sapiens
uggaguaggccuaagaaugaca

SEQ ID NO: 314485 - RNA, 22 nt, Homo sapiens
uggagugcgugucugaguuuuu

SEQ ID NO: 314486 - RNA, 22 nt, Homo sapiens
uggauccaucacgccucuuccc

SEQ ID NO: 314487 - RNA, 22 nt, Homo sapiens
uggauggucagaggguuucugu

SEQ ID NO: 314488 - RNA, 18 nt, Homo sapiens
uggauuggaaaaguuccu

SEQ ID NO: 314489 - RNA, 22 nt, Homo sapiens
uggcaaaauauuuugguuucug

SEQ ID NO: 314490 - RNA, 22 nt, Homo sapiens
uggcaaauuccaaaguuaauuc

SEQ ID NO: 314491 - RNA, 22 nt, Homo sapiens
uggcaagaacgaaauguagggu

SEQ ID NO: 314492 - RNA, 22 nt, Homo sapiens
uggcaagaagagcaugagacca

SEQ ID NO: 314493 - RNA, 22 nt, Homo sapiens
uggcaagagaacaacaucucuc

SEQ ID NO: 314494 - RNA, 22 nt, Homo sapiens
uggcaagaucacaauuacuuuu

SEQ ID NO: 314495 - RNA, 20 nt, Homo sapiens
uggcaccugacagauagcca

SEQ ID NO: 314496 - RNA, 22 nt, Homo sapiens
uggcagugggagauauuuuauu

SEQ ID NO: 314497 - RNA, 22 nt, Homo sapiens
uggcaguuuuugccuucaauac

SEQ ID NO: 314498 - RNA, 22 nt, Homo sapiens
uggcaugauccuagauucaaca

SEQ ID NO: 314499 - RNA, 22 nt, Homo sapiens
uggcauuuugugugaauuagaa

SEQ ID NO: 314500 - RNA, 20 nt, Homo sapiens
uggcuaaaugaaugauagca

SEQ ID NO: 314501 - RNA, 22 nt, Homo sapiens
uggcuagaccugcauaacagcu

SEQ ID NO: 314502 - RNA, 22 nt, Homo sapiens
uggcuguuuauuucaccugggu

SEQ ID NO: 314503 - RNA, 22 nt, Homo sapiens
uggcuuuuauuauguugaggua

SEQ ID NO: 314504 - RNA, 22 nt, Homo sapiens
uggcuuuuccaggcauuacgau

SEQ ID NO: 314505 - RNA, 18 nt, Homo sapiens
ugggaagaaauucuucuc

SEQ ID NO: 314506 - RNA, 22 nt, Homo sapiens
ugggaagaugcugcuucuuccu

SEQ ID NO: 314507 - RNA, 22 nt, Homo sapiens
ugggaagcugcugaacuacagu

SEQ ID NO: 314508 - RNA, 19 nt, Homo sapiens
ugggaauguaaauuaguuc

SEQ ID NO: 314509 - RNA, 22 nt, Homo sapiens
ugggaucagcugggcucucugu

SEQ ID NO: 314510 - RNA, 22 nt, Homo sapiens
ugggcuagaugcuuugggguca

SEQ ID NO: 314511 - RNA, 22 nt, Homo sapiens
ugggguagaauagaauugauau

SEQ ID NO: 314512 - RNA, 22 nt, Homo sapiens
ugggguaggccugguuaugugc

SEQ ID NO: 314513 - RNA, 22 nt, Homo sapiens
uggguagucauuggaggguuuu

SEQ ID NO: 314514 - RNA, 19 nt, Homo sapiens
uggguagugaugagacaua

SEQ ID NO: 314515 - RNA, 20 nt, Homo sapiens
ugguccccugagucuggcuu

SEQ ID NO: 314516 - RNA, 23 nt, Homo sapiens
uggucccguguucuggcuuuagg

SEQ ID NO: 314517 - RNA, 22 nt, Homo sapiens
ugguggcuuuucguagguucac

SEQ ID NO: 314518 - RNA, 22 nt, Homo sapiens
ugguguccugucucugcgcuug

SEQ ID NO: 314519 - RNA, 22 nt, Homo sapiens
uguaaacauguauguguuuaug

SEQ ID NO: 314520 - RNA, 22 nt, Homo sapiens
uguaacugcuuagaagguuuua

SEQ ID NO: 314521 - RNA, 22 nt, Homo sapiens
ugucaaagagacaucugcacuc

SEQ ID NO: 314522 - RNA, 22 nt, Homo sapiens
ugucacaguuuguacuuuauag

SEQ ID NO: 314523 - RNA, 18 nt, Homo sapiens
ugucacuggauaaugguc

SEQ ID NO: 314524 - RNA, 22 nt, Homo sapiens
ugucacugugcagucaugcauu

SEQ ID NO: 314525 - RNA, 22 nt, Homo sapiens
ugucagaaucugagacgacaac

SEQ ID NO: 314526 - RNA, 22 nt, Homo sapiens
ugucauggauucugagucuggg

SEQ ID NO: 314527 - RNA, 22 nt, Homo sapiens
ugucaugucuuuguguaucaau

SEQ ID NO: 314528 - RNA, 20 nt, Homo sapiens
ugucauuaagcacugugcca

SEQ ID NO: 314529 - RNA, 22 nt, Homo sapiens
uguccauuuuuaugcuuauggu

SEQ ID NO: 314530 - RNA, 22 nt, Homo sapiens
ugucccaguuggguauugaauu

SEQ ID NO: 314531 - RNA, 22 nt, Homo sapiens
ugucccguuuucgaggcugcag

SEQ ID NO: 314532 - RNA, 22 nt, Homo sapiens
ugucucccuucccauuaggaag

SEQ ID NO: 314533 - RNA, 22 nt, Homo sapiens
ugucuuguagacaauguauagu

SEQ ID NO: 314534 - RNA, 19 nt, Homo sapiens
ugugaacaucacagagugu

SEQ ID NO: 314535 - RNA, 18 nt, Homo sapiens
ugugacauugagcauguc

SEQ ID NO: 314536 - RNA, 22 nt, Homo sapiens
ugugcaaucagcuucauuacau

SEQ ID NO: 314537 - RNA, 22 nt, Homo sapiens
ugugccacugcacucuggccug

SEQ ID NO: 314538 - RNA, 21 nt, Homo sapiens
uguggcaauggccucacagau

SEQ ID NO: 314539 - RNA, 20 nt, Homo sapiens
uguggcacuguaucucucag

SEQ ID NO: 314540 - RNA, 22 nt, Homo sapiens
uguggcuuuacagcaugguuca

SEQ ID NO: 314541 - RNA, 22 nt, Homo sapiens
ugugggaggugcuaauguaaau

SEQ ID NO: 314542 - RNA, 22 nt, Homo sapiens
uguguaaauaugauagaggaau

SEQ ID NO: 314543 - RNA, 22 nt, Homo sapiens
uguguaauacucuaaugaugca

SEQ ID NO: 314544 - RNA, 22 nt, Homo sapiens
ugugucacugcacuccagcgug

SEQ ID NO: 314545 - RNA, 22 nt, Homo sapiens
ugugucuuuuaucacacaaugu

SEQ ID NO: 314546 - RNA, 22 nt, Homo sapiens
uguuacacugugcacuaaauuu

SEQ ID NO: 314547 - RNA, 22 nt, Homo sapiens
uguuacagcagaauugauugca

SEQ ID NO: 314548 - RNA, 22 nt, Homo sapiens
uguuauguauggagugauccca

SEQ ID NO: 314549 - RNA, 22 nt, Homo sapiens
uguucacaguguuucuuugaga

SEQ ID NO: 314550 - RNA, 22 nt, Homo sapiens
uuaaagccauaccugagagagu

SEQ ID NO: 314551 - RNA, 22 nt, Homo sapiens
uuaaaguguuugcagacaggug

SEQ ID NO: 314552 - RNA, 22 nt, Homo sapiens
uuaaaugcacauacuugagaaa

SEQ ID NO: 314553 - RNA, 22 nt, Homo sapiens
uuaagcaguggauuagaauuuu

SEQ ID NO: 314554 - RNA, 22 nt, Homo sapiens
uuaaggugaaguucucagaugc

SEQ ID NO: 314555 - RNA, 22 nt, Homo sapiens
uuaagugaauuaucuaacaugu

SEQ ID NO: 314556 - RNA, 22 nt, Homo sapiens
uuaauacucuucuaaguagucc

SEQ ID NO: 314557 - RNA, 19 nt, Homo sapiens
uuacagugugcccuuuuag

SEQ ID NO: 314558 - RNA, 22 nt, Homo sapiens
uuaccacagugccugucuaaug

SEQ ID NO: 314559 - RNA, 22 nt, Homo sapiens
uuagaacuagaggaguuugagu

SEQ ID NO: 314560 - RNA, 17 nt, Homo sapiens
uuagagguagacucauu

SEQ ID NO: 314561 - RNA, 22 nt, Homo sapiens
uuagaugaaugucucuuaaaca

SEQ ID NO: 314562 - RNA, 22 nt, Homo sapiens
uuagcagcucuggugacaaggu

SEQ ID NO: 314563 - RNA, 21 nt, Homo sapiens
uuagcauccauguucaucaac

SEQ ID NO: 314564 - RNA, 16 nt, Homo sapiens
uuaggcagugugauac

SEQ ID NO: 314565 - RNA, 22 nt, Homo sapiens
uuaggcuaguugauauaguuug

SEQ ID NO: 314566 - RNA, 22 nt, Homo sapiens
gagagguaguuuuuuggucguc

SEQ ID NO: 314567 - RNA, 22 nt, Homo sapiens
gagauaaauaggucacaguucu

SEQ ID NO: 314568 - RNA, 22 nt, Homo sapiens
gagauauuauuucccuuucaca

SEQ ID NO: 314569 - RNA, 22 nt, Homo sapiens
gagauauuuagaaauguguucu

SEQ ID NO: 314570 - RNA, 22 nt, Homo sapiens
gagaugaaaucuugcucuguca

SEQ ID NO: 314571 - RNA, 22 nt, Homo sapiens
gagaugaagugucaauaaggau

SEQ ID NO: 314572 - RNA, 22 nt, Homo sapiens
gagaugucuauuucagagaugu

SEQ ID NO: 314573 - RNA, 22 nt, Homo sapiens
gagcagacaugaggaccgcugg

SEQ ID NO: 314574 - RNA, 22 nt, Homo sapiens
gagcucauuguugcuaaagaga

SEQ ID NO: 314575 - RNA, 22 nt, Homo sapiens
gaggcggugugaugucacaugc

SEQ ID NO: 314576 - RNA, 22 nt, Homo sapiens
gagguaagaaagucaguccuuc

SEQ ID NO: 314577 - RNA, 22 nt, Homo sapiens
gagguaagaguuuuccauuucu

SEQ ID NO: 314578 - RNA, 17 nt, Homo sapiens
gagguaguuuacuuuca

SEQ ID NO: 314579 - RNA, 22 nt, Homo sapiens
gagguguaaggacaacagagac

SEQ ID NO: 314580 - RNA, 22 nt, Homo sapiens
gagugcauaugggccuguguca

SEQ ID NO: 314581 - RNA, 22 nt, Homo sapiens
gagugcuguuagcccuggguuu

SEQ ID NO: 314582 - RNA, 23 nt, Homo sapiens
gaguggagacucauugauuuccu

SEQ ID NO: 314583 - RNA, 22 nt, Homo sapiens
gaguucauuuugaaaccuugau

SEQ ID NO: 314584 - RNA, 22 nt, Homo sapiens
gauaaagauagcaauagggaca

SEQ ID NO: 314585 - RNA, 22 nt, Homo sapiens
gauaaaguauuggguacuaugc

SEQ ID NO: 314586 - RNA, 22 nt, Homo sapiens
gauaaaucuuggcuagucuaag

SEQ ID NO: 314587 - RNA, 22 nt, Homo sapiens
gauagugaaccaagggguaauu

SEQ ID NO: 314588 - RNA, 22 nt, Homo sapiens
gaucacaguuccucacgggcau

SEQ ID NO: 314589 - RNA, 22 nt, Homo sapiens
gaucacauguguacucaaugug

SEQ ID NO: 314590 - RNA, 22 nt, Homo sapiens
gaucuggucuuugauuagacac

SEQ ID NO: 314591 - RNA, 22 nt, Homo sapiens
gaugacuaagaauuuuauaauu

SEQ ID NO: 314592 - RNA, 22 nt, Homo sapiens
gaugagaucauaaguguggagc

SEQ ID NO: 314593 - RNA, 22 nt, Homo sapiens
gaugccuuuuuguccucaguua

SEQ ID NO: 314594 - RNA, 22 nt, Homo sapiens
gauggcagugcagccccuggcu

SEQ ID NO: 314595 - RNA, 22 nt, Homo sapiens
gauuucaucuuuagaggaagga

SEQ ID NO: 314596 - RNA, 22 nt, Homo sapiens
gauuuuuggggaagccucuuau

SEQ ID NO: 314597 - RNA, 20 nt, Homo sapiens
gcaaaguuuagcucccacua

SEQ ID NO: 314598 - RNA, 22 nt, Homo sapiens
gcaagaauggaacaggagagcc

SEQ ID NO: 314599 - RNA, 22 nt, Homo sapiens
gcaauguuacugaauguguuuu

SEQ ID NO: 314600 - RNA, 22 nt, Homo sapiens
gcacacuuacacgaaccuagau

SEQ ID NO: 314601 - RNA, 23 nt, Homo sapiens
gcagcaaugucacagggguccgg

SEQ ID NO: 314602 - RNA, 22 nt, Homo sapiens
gcagcaguggcaguuaauauuu

SEQ ID NO: 314603 - RNA, 22 nt, Homo sapiens
gcaguguggguagagggcaaga

SEQ ID NO: 314604 - RNA, 22 nt, Homo sapiens
gcaguguucaaaucaugcccau

SEQ ID NO: 314605 - RNA, 22 nt, Homo sapiens
gcaguguuggggccggaggcug

SEQ ID NO: 314606 - RNA, 17 nt, Homo sapiens
gcauaugucgaaccagc

SEQ ID NO: 314607 - RNA, 17 nt, Homo sapiens
gcauauguugaaccagu

SEQ ID NO: 314608 - RNA, 22 nt, Homo sapiens
gcaucacagggagacaggccuc

SEQ ID NO: 314609 - RNA, 22 nt, Homo sapiens
gcauggagaaggggacugauuc

SEQ ID NO: 314610 - RNA, 22 nt, Homo sapiens
gcauggccuuuaaaugucacag

SEQ ID NO: 314611 - RNA, 22 nt, Homo sapiens
gcaugguacuggaugguaguau

SEQ ID NO: 314612 - RNA, 22 nt, Homo sapiens
gcaugguaguaaccuacauuug

SEQ ID NO: 314613 - RNA, 22 nt, Homo sapiens
gcauugcacuuggcauagacug

SEQ ID NO: 314614 - RNA, 22 nt, Homo sapiens
gccaagauugguuuaauauucc

SEQ ID NO: 314615 - RNA, 20 nt, Homo sapiens
gccacaguuaagcuucugcc

SEQ ID NO: 314616 - RNA, 22 nt, Homo sapiens
gcccugagauucuuggauucug

SEQ ID NO: 314617 - RNA, 22 nt, Homo sapiens
gcccugauacauucuucugccu

SEQ ID NO: 314618 - RNA, 22 nt, Homo sapiens
gccuagggacaaaccguccgac

SEQ ID NO: 314619 - RNA, 22 nt, Homo sapiens
gccucaguuguggccagggauu

SEQ ID NO: 314620 - RNA, 22 nt, Homo sapiens
gcuaaaucuguaaaaugaggag

SEQ ID NO: 314621 - RNA, 22 nt, Homo sapiens
gcucaugggcagugugauuguu

SEQ ID NO: 314622 - RNA, 22 nt, Homo sapiens
gcugacacugggcuauagaucu

SEQ ID NO: 314623 - RNA, 22 nt, Homo sapiens
gcugcuguuauucaucagaacu

SEQ ID NO: 314624 - RNA, 22 nt, Homo sapiens
gcugcuguuuaguuucuccugg

SEQ ID NO: 314625 - RNA, 22 nt, Homo sapiens
gcugcuguuucucuuucagcau

SEQ ID NO: 314626 - RNA, 22 nt, Homo sapiens
gcuguauugacuuuguaucaua

SEQ ID NO: 314627 - RNA, 22 nt, Homo sapiens
gcuuuguuaaaacacagccaca

SEQ ID NO: 314628 - RNA, 21 nt, Homo sapiens
gcuuuuucggaagucuuuggc

SEQ ID NO: 314629 - RNA, 22 nt, Homo sapiens
ggaaagauguaauauuaucuaa

SEQ ID NO: 314630 - RNA, 22 nt, Homo sapiens
ggaaauguuggugucaugaguu

SEQ ID NO: 314631 - RNA, 22 nt, Homo sapiens
ggaagccuggaaaaaauuguga

SEQ ID NO: 314632 - RNA, 22 nt, Homo sapiens
ggaaguauaaacuuaguggagu

SEQ ID NO: 314633 - RNA, 22 nt, Homo sapiens
ggaauggaacaaagucuugaaa

SEQ ID NO: 314634 - RNA, 22 nt, Homo sapiens
ggaauguuaaggcgcuguuggu

SEQ ID NO: 314635 - RNA, 22 nt, Homo sapiens
ggacagaaaggguucaccaaac

SEQ ID NO: 314636 - RNA, 22 nt, Homo sapiens
ggacuagggacauggggagcug

SEQ ID NO: 314637 - RNA, 22 nt, Homo sapiens
ggagagcuaggcagagguuugu

SEQ ID NO: 314638 - RNA, 22 nt, Homo sapiens
ggagaucuuuaggaguuggacu

SEQ ID NO: 314639 - RNA, 22 nt, Homo sapiens
ggagaucuuugaaguguugugc

SEQ ID NO: 314640 - RNA, 22 nt, Homo sapiens
ggagaucuuuguuaucuuuuga

SEQ ID NO: 314641 - RNA, 22 nt, Homo sapiens
ggagcucaucuagcauagaggu

SEQ ID NO: 314642 - RNA, 22 nt, Homo sapiens
ggauacauuuuuccuccucuuc

SEQ ID NO: 314643 - RNA, 23 nt, Homo sapiens
ggauggaaaguuuugagggccac

SEQ ID NO: 314644 - RNA, 23 nt, Homo sapiens
ggauucaucuguuuguucgcugu

SEQ ID NO: 314645 - RNA, 22 nt, Homo sapiens
ggcaaaauauugucugguauag

SEQ ID NO: 314646 - RNA, 20 nt, Homo sapiens
ggcaagacccaaagugugug

SEQ ID NO: 314647 - RNA, 20 nt, Homo sapiens
ggcaagguagcauuucuucu

SEQ ID NO: 314648 - RNA, 22 nt, Homo sapiens
ggcaaggugaugaaugucuaca

SEQ ID NO: 314649 - RNA, 22 nt, Homo sapiens
ggcaaggugcuacagacaguga

SEQ ID NO: 314650 - RNA, 22 nt, Homo sapiens
ggcaagugucagcagcaacacc

SEQ ID NO: 314651 - RNA, 22 nt, Homo sapiens
ggcacaauugcagcaauaaaca

SEQ ID NO: 314652 - RNA, 22 nt, Homo sapiens
ggcaccacagacgccaggcgug

SEQ ID NO: 314653 - RNA, 19 nt, Homo sapiens
ggcacugugugagugagga

SEQ ID NO: 314654 - RNA, 22 nt, Homo sapiens
ggcagcacaauuuucugaugga

SEQ ID NO: 314655 - RNA, 22 nt, Homo sapiens
ggcaguguuauuauauuuuugg

SEQ ID NO: 314656 - RNA, 21 nt, Homo sapiens
ggcauugugcccuugcucuag

SEQ ID NO: 314657 - RNA, 22 nt, Homo sapiens
ggcuagagacaaguugcugaga

SEQ ID NO: 314658 - RNA, 22 nt, Homo sapiens
ggcuguguguuaaaauaggcuu

SEQ ID NO: 314659 - RNA, 19 nt, Homo sapiens
gggaggaugcgucuucagg

SEQ ID NO: 314660 - RNA, 22 nt, Homo sapiens
gggaguagagaguuucucugac

SEQ ID NO: 314661 - RNA, 22 nt, Homo sapiens
gggggagugugguacccagcau

SEQ ID NO: 314662 - RNA, 22 nt, Homo sapiens
gguagacaucgugcucugugau

SEQ ID NO: 314663 - RNA, 22 nt, Homo sapiens
ggucccccuccacucucgcaaa

SEQ ID NO: 314664 - RNA, 22 nt, Homo sapiens
ggugagaaagggauuccuguuc

SEQ ID NO: 314665 - RNA, 22 nt, Homo sapiens
ggugcagcacaccaacauggca

SEQ ID NO: 314666 - RNA, 22 nt, Homo sapiens
ugauggcacagugaguuccagg

SEQ ID NO: 314667 - RNA, 22 nt, Homo sapiens
ugauuuguuuagugccaaguuu

SEQ ID NO: 314668 - RNA, 22 nt, Homo sapiens
ugcaaacuuccuugggcagcau

SEQ ID NO: 314669 - RNA, 22 nt, Homo sapiens
ugcaaaguccucauucuuaccc

SEQ ID NO: 314670 - RNA, 22 nt, Homo sapiens
ugcaagaaacauauuccacaag

SEQ ID NO: 314671 - RNA, 21 nt, Homo sapiens
ugcaagaaucaggaagcugcc

SEQ ID NO: 314672 - RNA, 22 nt, Homo sapiens
ugcaagauaggcaguuugcacu

SEQ ID NO: 314673 - RNA, 22 nt, Homo sapiens
ugcaagaugagauuuuggaugg

SEQ ID NO: 314674 - RNA, 22 nt, Homo sapiens
ugcaccauugcauacuuaauua

SEQ ID NO: 314675 - RNA, 22 nt, Homo sapiens
ugcagagucuguccugccugcc

SEQ ID NO: 314676 - RNA, 17 nt, Homo sapiens
ugcagcacacugauggg

SEQ ID NO: 314677 - RNA, 22 nt, Homo sapiens
ugcagcauguaggcacguuauu

SEQ ID NO: 314678 - RNA, 22 nt, Homo sapiens
ugcaguguggcucacgccugua

SEQ ID NO: 314679 - RNA, 22 nt, Homo sapiens
ugcaguguucuuuagaggaaau

SEQ ID NO: 314680 - RNA, 22 nt, Homo sapiens
ugcauggagcucucuuuggacu

SEQ ID NO: 314681 - RNA, 22 nt, Homo sapiens
ugccaggaugaggucaauguuu

SEQ ID NO: 314682 - RNA, 22 nt, Homo sapiens
ugccaguguugccuuucacuag

SEQ ID NO: 314683 - RNA, 22 nt, Homo sapiens
ugccaucauuaauauuaggcau

SEQ ID NO: 314684 - RNA, 22 nt, Homo sapiens
ugccaugaagagaggaagcagu

SEQ ID NO: 314685 - RNA, 22 nt, Homo sapiens
ugcccuguaucccacuguuuca

SEQ ID NO: 314686 - RNA, 22 nt, Homo sapiens
ugcccuuugucagaugaguagg

SEQ ID NO: 314687 - RNA, 22 nt, Homo sapiens
ugccuaggcuggaaugcagugg

SEQ ID NO: 314688 - RNA, 22 nt, Homo sapiens
ugcgccauugcacuccagucuu

SEQ ID NO: 314689 - RNA, 22 nt, Homo sapiens
ugcgccauugcacucuagccug

SEQ ID NO: 314690 - RNA, 22 nt, Homo sapiens
ugcuacccuucgucucucuggu

SEQ ID NO: 314691 - RNA, 22 nt, Homo sapiens
ugcuaugucuucucucacagag

SEQ ID NO: 314692 - RNA, 22 nt, Homo sapiens
ugcuguguugcuggcuuaaaga

SEQ ID NO: 314693 - RNA, 18 nt, Homo sapiens
ugcuuagucauuuucaau

SEQ ID NO: 314694 - RNA, 22 nt, Homo sapiens
uggaaaacaugcacauuggauu

SEQ ID NO: 314695 - RNA, 22 nt, Homo sapiens
uggaaaguacugagguccaccu

SEQ ID NO: 314696 - RNA, 22 nt, Homo sapiens
uggaaaguaguucuaaucuaag

SEQ ID NO: 314697 - RNA, 22 nt, Homo sapiens
uggaacaccaggcuggcguggc

SEQ ID NO: 314698 - RNA, 22 nt, Homo sapiens
uggaagcauagcagcgugugug

SEQ ID NO: 314699 - RNA, 22 nt, Homo sapiens
uggaaggucauuguucauuuga

SEQ ID NO: 314700 - RNA, 22 nt, Homo sapiens
uggaagucaugcugcaagaaca

SEQ ID NO: 314701 - RNA, 22 nt, Homo sapiens
uggaaguuaaaugacucuuucu

SEQ ID NO: 314702 - RNA, 22 nt, Homo sapiens
uggaaucuuaggugaaggcuuu

SEQ ID NO: 314703 - RNA, 22 nt, Homo sapiens
uggaaugguaucuuguuggggu

SEQ ID NO: 314704 - RNA, 22 nt, Homo sapiens
uggaaugucuauguuuuugauu

SEQ ID NO: 314705 - RNA, 22 nt, Homo sapiens
uggacaagugcccuccaccuca

SEQ ID NO: 314706 - RNA, 22 nt, Homo sapiens
uggacacuggagauucgucagu

SEQ ID NO: 314707 - RNA, 21 nt, Homo sapiens
uggaccccuuccuugcaccau

SEQ ID NO: 314708 - RNA, 22 nt, Homo sapiens
uggacuagagggugggcgaggu

SEQ ID NO: 314709 - RNA, 22 nt, Homo sapiens
uggagaacugaugucuccaaga

SEQ ID NO: 314710 - RNA, 22 nt, Homo sapiens
uggagagcaaaaucaauccaaa

SEQ ID NO: 314711 - RNA, 18 nt, Homo sapiens
uggagauaagaagaacuu

SEQ ID NO: 314712 - RNA, 22 nt, Homo sapiens
uggagcccuaaacuucuaauau

SEQ ID NO: 314713 - RNA, 22 nt, Homo sapiens
uggagcccuaguuccucauaac

SEQ ID NO: 314714 - RNA, 22 nt, Homo sapiens
uggagguaggacgaagaacucu

SEQ ID NO: 314715 - RNA, 20 nt, Homo sapiens
uggaggucaucugucacuac

SEQ ID NO: 314716 - RNA, 22 nt, Homo sapiens
uggaggucauuggaucaugggg

SEQ ID NO: 314717 - RNA, 22 nt, Homo sapiens
uggcaaagugugacgugggggu

SEQ ID NO: 314718 - RNA, 22 nt, Homo sapiens
uggcaaauagcaauaggagggu

SEQ ID NO: 314719 - RNA, 22 nt, Homo sapiens
uggcaaauauuuuguuuuguaa

SEQ ID NO: 314720 - RNA, 22 nt, Homo sapiens
uggcaagaaccacaguuacuuu

SEQ ID NO: 314721 - RNA, 22 nt, Homo sapiens
uggcaagaacugcaauugcuuu

SEQ ID NO: 314722 - RNA, 23 nt, Homo sapiens
uggcaagaauucuuaccgugugg

SEQ ID NO: 314723 - RNA, 18 nt, Homo sapiens
uggcaauaugguucuacc

SEQ ID NO: 314724 - RNA, 22 nt, Homo sapiens
uggcacuggagauacauuaaua

SEQ ID NO: 314725 - RNA, 22 nt, Homo sapiens
uggcauggaguggauggcccca

SEQ ID NO: 314726 - RNA, 22 nt, Homo sapiens
uggcauguauuuuguguauuaa

SEQ ID NO: 314727 - RNA, 22 nt, Homo sapiens
uggcggagacauggacuucaga

SEQ ID NO: 314728 - RNA, 22 nt, Homo sapiens
auagguuuucacuguagauucu

SEQ ID NO: 314729 - RNA, 22 nt, Homo sapiens
auagugcuggaauaaauauacg

SEQ ID NO: 314730 - RNA, 22 nt, Homo sapiens
auauagcaaugaaagagaugaa

SEQ ID NO: 314731 - RNA, 22 nt, Homo sapiens
auauauguuuucugggaagaaa

SEQ ID NO: 314732 - RNA, 22 nt, Homo sapiens
auaucacaaacaagucuguacu

SEQ ID NO: 314733 - RNA, 22 nt, Homo sapiens
auaucacagguguuuaccugau

SEQ ID NO: 314734 - RNA, 22 nt, Homo sapiens
auaucacucccaauaucgcagg

SEQ ID NO: 314735 - RNA, 22 nt, Homo sapiens
auaugcacaguggaguacuauu

SEQ ID NO: 314736 - RNA, 20 nt, Homo sapiens
auaugcagacacauacauac

SEQ ID NO: 314737 - RNA, 22 nt, Homo sapiens
auauguauuuuaacguguaagg

SEQ ID NO: 314738 - RNA, 22 nt, Homo sapiens
auauuagguuggugcaaaagua

SEQ ID NO: 314739 - RNA, 18 nt, Homo sapiens
auauugcauuggauggau

SEQ ID NO: 314740 - RNA, 22 nt, Homo sapiens
auauugcuuagugaugaagucu

SEQ ID NO: 314741 - RNA, 22 nt, Homo sapiens
aucaagcuggcauauguaguuc

SEQ ID NO: 314742 - RNA, 22 nt, Homo sapiens
aucaagcuugacuccuuaaagg

SEQ ID NO: 314743 - RNA, 22 nt, Homo sapiens
aucacagaacuuugagcagaga

SEQ ID NO: 314744 - RNA, 22 nt, Homo sapiens
aucacagaguuaaaacuuucuu

SEQ ID NO: 314745 - RNA, 22 nt, Homo sapiens
aucacaguuauaacauccuuuu

SEQ ID NO: 314746 - RNA, 22 nt, Homo sapiens
aucacaguuuuaccauuuggua

SEQ ID NO: 314747 - RNA, 22 nt, Homo sapiens
aucacauuuauaguggcacgca

SEQ ID NO: 314748 - RNA, 22 nt, Homo sapiens
aucacugggcaagauaucauga

SEQ ID NO: 314749 - RNA, 22 nt, Homo sapiens
aucacuguccacucaucuuucu

SEQ ID NO: 314750 - RNA, 22 nt, Homo sapiens
aucagugauugauuuaaagacg

SEQ ID NO: 314751 - RNA, 22 nt, Homo sapiens
aucauacuguuuugauuacugu

SEQ ID NO: 314752 - RNA, 22 nt, Homo sapiens
auccacaugcaguuggaaacag

SEQ ID NO: 314753 - RNA, 22 nt, Homo sapiens
aucccugagccugacucucaga

SEQ ID NO: 314754 - RNA, 22 nt, Homo sapiens
aucccuguaguaauauucuagc

SEQ ID NO: 314755 - RNA, 22 nt, Homo sapiens
auccucaguggcuuaaguauag

SEQ ID NO: 314756 - RNA, 22 nt, Homo sapiens
auccugagacuuugcugaaguu

SEQ ID NO: 314757 - RNA, 22 nt, Homo sapiens
aucgcaccauugcacuccagca

SEQ ID NO: 314758 - RNA, 22 nt, Homo sapiens
aucgcgccauuguacuccagcc

SEQ ID NO: 314759 - RNA, 22 nt, Homo sapiens
aucucauuccuucugggcugau

SEQ ID NO: 314760 - RNA, 22 nt, Homo sapiens
aucuggcguuuacuuccuuccu

SEQ ID NO: 314761 - RNA, 22 nt, Homo sapiens
augaaagguugucuuaagccau

SEQ ID NO: 314762 - RNA, 22 nt, Homo sapiens
augaaagugauaaaugucucua

SEQ ID NO: 314763 - RNA, 22 nt, Homo sapiens
augaaaucuuuccugugaggau

SEQ ID NO: 314764 - RNA, 22 nt, Homo sapiens
augacacugcagagauguccca

SEQ ID NO: 314765 - RNA, 22 nt, Homo sapiens
augacauagcauggugccugcu

SEQ ID NO: 314766 - RNA, 22 nt, Homo sapiens
augaccagagagugcgcagggu

SEQ ID NO: 314767 - RNA, 22 nt, Homo sapiens
augagagcuaacuguggguaca

SEQ ID NO: 314768 - RNA, 22 nt, Homo sapiens
augagauacuacaaaugaguuu

SEQ ID NO: 314769 - RNA, 22 nt, Homo sapiens
augagaugauaggcguucuaac

SEQ ID NO: 314770 - RNA, 22 nt, Homo sapiens
augagauuguuuguacuccaca

SEQ ID NO: 314771 - RNA, 22 nt, Homo sapiens
augagcuauggagacagggcca

SEQ ID NO: 314772 - RNA, 22 nt, Homo sapiens
augagcuccucaaggucagaga

SEQ ID NO: 314773 - RNA, 22 nt, Homo sapiens
augagcuguuuggaagacacuu

SEQ ID NO: 314774 - RNA, 22 nt, Homo sapiens
augaggugggagaaucacuuga

SEQ ID NO: 314775 - RNA, 21 nt, Homo sapiens
augagguguacuguggugaaa

SEQ ID NO: 314776 - RNA, 22 nt, Homo sapiens
augauacuggcuucauagaaug

SEQ ID NO: 314777 - RNA, 22 nt, Homo sapiens
augauaucuuguuuuucaugca

SEQ ID NO: 314778 - RNA, 22 nt, Homo sapiens
augauaugagaaaggaucaaca

SEQ ID NO: 314779 - RNA, 22 nt, Homo sapiens
augauuuuuguaucgccugaug

SEQ ID NO: 314780 - RNA, 22 nt, Homo sapiens
augcaaacaucugaagagacau

SEQ ID NO: 314781 - RNA, 22 nt, Homo sapiens
augcaacugcacuccagccugg

SEQ ID NO: 314782 - RNA, 22 nt, Homo sapiens
augcaagacaccgauuagcuuu

SEQ ID NO: 314783 - RNA, 22 nt, Homo sapiens
augcacauggcuaacuuuuuuc

SEQ ID NO: 314784 - RNA, 22 nt, Homo sapiens
augcauaugucuuuauaguggc

SEQ ID NO: 314785 - RNA, 22 nt, Homo sapiens
augcauggagucuuucacaagu

SEQ ID NO: 314786 - RNA, 22 nt, Homo sapiens
augcauggucugaagucaaccu

SEQ ID NO: 314787 - RNA, 22 nt, Homo sapiens
augccaagaugagcacgcgucu

SEQ ID NO: 314788 - RNA, 22 nt, Homo sapiens
aaacugaucugaaggccaggcu

SEQ ID NO: 314789 - RNA, 22 nt, Homo sapiens
aaagaagucagccuguccuuug

SEQ ID NO: 314790 - RNA, 22 nt, Homo sapiens
aaaggaccacauauaugguggc

SEQ ID NO: 314791 - RNA, 22 nt, Homo sapiens
aaagguaguacuucuagaaggg

SEQ ID NO: 314792 - RNA, 22 nt, Homo sapiens
aaagugaauguaucccguaagu

SEQ ID NO: 314793 - RNA, 22 nt, Homo sapiens
aaagugcaguacuucguauauu

SEQ ID NO: 314794 - RNA, 22 nt, Homo sapiens
aaagugcugggauuaggccagg

SEQ ID NO: 314795 - RNA, 22 nt, Homo sapiens
aaagugcugggauuggccgggc

SEQ ID NO: 314796 - RNA, 22 nt, Homo sapiens
aaagugcuguagacugggcgca

SEQ ID NO: 314797 - RNA, 22 nt, Homo sapiens
aaauccauuuguucagcuaugc

SEQ ID NO: 314798 - RNA, 22 nt, Homo sapiens
aaaugcauaucaagauugcccu

SEQ ID NO: 314799 - RNA, 22 nt, Homo sapiens
aaaugcaugaauaagcucgugu

SEQ ID NO: 314800 - RNA, 22 nt, Homo sapiens
aaaugcaugaggugggaagaaa

SEQ ID NO: 314801 - RNA, 22 nt, Homo sapiens
aaaugcauggacagcuggucuu

SEQ ID NO: 314802 - RNA, 22 nt, Homo sapiens
aaauggcaccggcucuucccuc

SEQ ID NO: 314803 - RNA, 22 nt, Homo sapiens
aacaccuugcagggauuaugac

SEQ ID NO: 314804 - RNA, 22 nt, Homo sapiens
aacagaauccucuuuuccuggg

SEQ ID NO: 314805 - RNA, 22 nt, Homo sapiens
aacagacugucacauaaaauug

SEQ ID NO: 314806 - RNA, 22 nt, Homo sapiens
aacagugcauuccuguccauau

SEQ ID NO: 314807 - RNA, 22 nt, Homo sapiens
aacagugcuguuauaaauguac

SEQ ID NO: 314808 - RNA, 22 nt, Homo sapiens
aaccacauggcucaguggacau

SEQ ID NO: 314809 - RNA, 22 nt, Homo sapiens
aacuccauuuuagacccuagau

SEQ ID NO: 314810 - RNA, 22 nt, Homo sapiens
aacuggcauagccagacuucuc

SEQ ID NO: 314811 - RNA, 20 nt, Homo sapiens
aagacacuguccccacugga

SEQ ID NO: 314812 - RNA, 23 nt, Homo sapiens
aagagguaugacuaugaagugga

SEQ ID NO: 314813 - RNA, 22 nt, Homo sapiens
aagagguuguaccuaaaguguu

SEQ ID NO: 314814 - RNA, 22 nt, Homo sapiens
aagaguuaguaaaauuuccucu

SEQ ID NO: 314815 - RNA, 22 nt, Homo sapiens
aagauaguaaacauuuucugcu

SEQ ID NO: 314816 - RNA, 22 nt, Homo sapiens
aagauauguuaguuauaaacuc

SEQ ID NO: 314817 - RNA, 22 nt, Homo sapiens
aagaucauucagggaaggcuga

SEQ ID NO: 314818 - RNA, 22 nt, Homo sapiens
aagaugcagucauacuggagga

SEQ ID NO: 314819 - RNA, 22 nt, Homo sapiens
aagaugcagucauacuggagua

SEQ ID NO: 314820 - RNA, 21 nt, Homo sapiens
aagcacauugaguguguguga

SEQ ID NO: 314821 - RNA, 22 nt, Homo sapiens
aagcauccagcauggaacugaa

SEQ ID NO: 314822 - RNA, 22 nt, Homo sapiens
aagcuggcauucauucguucuu

SEQ ID NO: 314823 - RNA, 22 nt, Homo sapiens
aagcugugucuugucagcuacc

SEQ ID NO: 314824 - RNA, 22 nt, Homo sapiens
aagcuguugguggaucuaccau

SEQ ID NO: 314825 - RNA, 22 nt, Homo sapiens
aaggaauucaaauuuucucugg

SEQ ID NO: 314826 - RNA, 22 nt, Homo sapiens
aaggaguaucuguuuucucacc

SEQ ID NO: 314827 - RNA, 22 nt, Homo sapiens
aaggaguguggugaucuugggc

SEQ ID NO: 314828 - RNA, 22 nt, Homo sapiens
aaggcacugaacuuaaauucug

SEQ ID NO: 314829 - RNA, 22 nt, Homo sapiens
aaggcuauuugagaaugugugu

SEQ ID NO: 314830 - RNA, 22 nt, Homo sapiens
aaggcuguuguguaauaggauu

SEQ ID NO: 314831 - RNA, 22 nt, Homo sapiens
aagggaaugcuuccaguuugug

SEQ ID NO: 314832 - RNA, 22 nt, Homo sapiens
aagggaaugugguagcugguuu

SEQ ID NO: 314833 - RNA, 22 nt, Homo sapiens
aagguauuuuugucuauaucuu

SEQ ID NO: 314834 - RNA, 22 nt, Homo sapiens
aaggucauugugguuuuugcca

SEQ ID NO: 314835 - RNA, 22 nt, Homo sapiens
aaguccaugaagucuugugggu

SEQ ID NO: 314836 - RNA, 22 nt, Homo sapiens
aagugacuagacuaugaaaccu

SEQ ID NO: 314837 - RNA, 20 nt, Homo sapiens
aagugaguguuaaacugaac

SEQ ID NO: 314838 - RNA, 22 nt, Homo sapiens
aagugcuguccuaccuuuggga

SEQ ID NO: 314839 - RNA, 22 nt, Homo sapiens
aagugcuucagaagacaauauu

SEQ ID NO: 314840 - RNA, 20 nt, Homo sapiens
aagugcuuccuuuuagaggg

SEQ ID NO: 314841 - RNA, 22 nt, Homo sapiens
aaguggaauguuuguggcacaa

SEQ ID NO: 314842 - RNA, 22 nt, Homo sapiens
aaguggccuagagcgaccauuu

SEQ ID NO: 314843 - RNA, 22 nt, Homo sapiens
aauaaagcugaauccuuccuga

SEQ ID NO: 314844 - RNA, 22 nt, Homo sapiens
aauacucuauaagggaagcugu

SEQ ID NO: 314845 - RNA, 22 nt, Homo sapiens
aauacuuccaaaucuagucauu

SEQ ID NO: 314846 - RNA, 22 nt, Homo sapiens
aauauguccaguguuuugggag

SEQ ID NO: 314847 - RNA, 22 nt, Homo sapiens
aauaugucugcuaauuguuucu

SEQ ID NO: 314848 - RNA, 22 nt, Homo sapiens
aaucaacauuguuuuaagucaa

SEQ ID NO: 314849 - RNA, 22 nt, Homo sapiens
aaucacaguuaguaagggagaa

SEQ ID NO: 314850 - RNA, 22 nt, Homo sapiens
aaucaccaugcacuacagccuu

SEQ ID NO: 314851 - RNA, 22 nt, Homo sapiens
aaucacuaugccaugaaguaca

SEQ ID NO: 314852 - RNA, 22 nt, Homo sapiens
aaucacuuugcuacaaggcagu

SEQ ID NO: 314853 - RNA, 22 nt, Homo sapiens
aaucagcacacugugcuuucca

SEQ ID NO: 314854 - RNA, 22 nt, Homo sapiens
aaucccugagcuagacacaaag

SEQ ID NO: 314855 - RNA, 17 nt, Homo sapiens
aaugagacauuucugcu

SEQ ID NO: 314856 - RNA, 22 nt, Homo sapiens
aaugccaucagagaaaacucuu

SEQ ID NO: 314857 - RNA, 22 nt, Homo sapiens
aaugccuagugugugacaggug

SEQ ID NO: 314858 - RNA, 22 nt, Homo sapiens
aauggagcugaguggccuuggg

SEQ ID NO: 314859 - RNA, 22 nt, Homo sapiens
aauggagcuguuuggaugacuu

SEQ ID NO: 314860 - RNA, 22 nt, Homo sapiens
aauggcaucuagaguggugaau

SEQ ID NO: 314861 - RNA, 22 nt, Homo sapiens
aauggcucugauguuguuguga

SEQ ID NO: 314862 - RNA, 18 nt, Homo sapiens
aauggcucuggguucuaa

SEQ ID NO: 314863 - RNA, 22 nt, Homo sapiens
aauuaguuggcugccuaugauu

SEQ ID NO: 314864 - RNA, 22 nt, Homo sapiens
aauugcauugaauuuguagcuu

SEQ ID NO: 314865 - RNA, 22 nt, Homo sapiens
aauugcuuuuauuuagggccag

SEQ ID NO: 314866 - RNA, 23 nt, Homo sapiens
aauugcuuuugaggacuuaguug

SEQ ID NO: 314867 - RNA, 22 nt, Homo sapiens
aauuguacucccauaauucccu

SEQ ID NO: 314868 - RNA, 20 nt, Homo sapiens
acaaaugcauucugugacau

SEQ ID NO: 314869 - RNA, 22 nt, Homo sapiens
acaagcacaaaugcauagaugg

SEQ ID NO: 314870 - RNA, 22 nt, Homo sapiens
acacaaugguaaguguuugugu

SEQ ID NO: 314871 - RNA, 22 nt, Homo sapiens
acacaguaagcacaguguagau

SEQ ID NO: 314872 - RNA, 22 nt, Homo sapiens
acacaguauaugacaaugcuuu

SEQ ID NO: 314873 - RNA, 22 nt, Homo sapiens
acacagugucuguguauuuaaa

SEQ ID NO: 314874 - RNA, 22 nt, Homo sapiens
acacauuagcaagugcuguuau

SEQ ID NO: 314875 - RNA, 22 nt, Homo sapiens
acaccaguacuuuauacaagca

SEQ ID NO: 314876 - RNA, 22 nt, Homo sapiens
acacucuaguguucuuaaucag

SEQ ID NO: 314877 - RNA, 22 nt, Homo sapiens
acacugcugaguaaauaauuuu

SEQ ID NO: 314878 - RNA, 16 nt, Homo sapiens
acacuguuuagggaca

SEQ ID NO: 314879 - RNA, 22 nt, Homo sapiens
acacuguuuuaguuauuauagc

SEQ ID NO: 314880 - RNA, 22 nt, Homo sapiens
acaguacaugauaaauaaggua

SEQ ID NO: 314881 - RNA, 22 nt, Homo sapiens
acaguauaaugcuguagggaga

SEQ ID NO: 314882 - RNA, 22 nt, Homo sapiens
augcccauuuguuuucugaaag

SEQ ID NO: 314883 - RNA, 22 nt, Homo sapiens
augccuaagacccuguggggga

SEQ ID NO: 314884 - RNA, 22 nt, Homo sapiens
auggaaagcuguuccuacacaa

SEQ ID NO: 314885 - RNA, 22 nt, Homo sapiens
auggaauguaaguuauguuugc

SEQ ID NO: 314886 - RNA, 22 nt, Homo sapiens
auggacucauugaauuaagucc

SEQ ID NO: 314887 - RNA, 22 nt, Homo sapiens
auggagaugaauaucaucuguu

SEQ ID NO: 314888 - RNA, 22 nt, Homo sapiens
auggagcaaaacagauuuggga

SEQ ID NO: 314889 - RNA, 22 nt, Homo sapiens
auggagguguggggagugaguu

SEQ ID NO: 314890 - RNA, 22 nt, Homo sapiens
auggaguguggaacugggaauc

SEQ ID NO: 314891 - RNA, 22 nt, Homo sapiens
auggauaugcuuccaacugccu

SEQ ID NO: 314892 - RNA, 22 nt, Homo sapiens
auggauuuguaguacaugguug

SEQ ID NO: 314893 - RNA, 22 nt, Homo sapiens
auggauuuuaggauacaguuga

SEQ ID NO: 314894 - RNA, 22 nt, Homo sapiens
auggcacuccagccugggcaac

SEQ ID NO: 314895 - RNA, 22 nt, Homo sapiens
auggcacugaagcguauugaca

SEQ ID NO: 314896 - RNA, 22 nt, Homo sapiens
auggcacuguguccugggguca

SEQ ID NO: 314897 - RNA, 22 nt, Homo sapiens
auggcacuuuggacugcuagau

SEQ ID NO: 314898 - RNA, 22 nt, Homo sapiens
auggcagcaccccacucuacug

SEQ ID NO: 314899 - RNA, 22 nt, Homo sapiens
auggcccugaguucaauauauu

SEQ ID NO: 314900 - RNA, 20 nt, Homo sapiens
auggcccugcugggaguguc

SEQ ID NO: 314901 - RNA, 22 nt, Homo sapiens
auggcccugggaaaggaggcau

SEQ ID NO: 314902 - RNA, 22 nt, Homo sapiens
auggccgggugcgguggcucac

SEQ ID NO: 314903 - RNA, 22 nt, Homo sapiens
auggccugaugcaccuguccca

SEQ ID NO: 314904 - RNA, 22 nt, Homo sapiens
auggcucuguuccaugugucuu

SEQ ID NO: 314905 - RNA, 22 nt, Homo sapiens
auggcuuuuauuguguugaggu

SEQ ID NO: 314906 - RNA, 21 nt, Homo sapiens
augggacuaacugaugggucu

SEQ ID NO: 314907 - RNA, 22 nt, Homo sapiens
augggacugggugccguggagc

SEQ ID NO: 314908 - RNA, 22 nt, Homo sapiens
augggcacugauguauucugug

SEQ ID NO: 314909 - RNA, 21 nt, Homo sapiens
augggguagaagagaaggcuu

SEQ ID NO: 314910 - RNA, 22 nt, Homo sapiens
auggucuuuauuguguugagug

SEQ ID NO: 314911 - RNA, 22 nt, Homo sapiens
auguaguaugaagaagaugcuu

SEQ ID NO: 314912 - RNA, 22 nt, Homo sapiens
augucuagagcaagagaugcug

SEQ ID NO: 314913 - RNA, 22 nt, Homo sapiens
augucuagagugauacugaagc

SEQ ID NO: 314914 - RNA, 22 nt, Homo sapiens
augugacugauggagaauaugu

SEQ ID NO: 314915 - RNA, 20 nt, Homo sapiens
augugcuaauauuaauaugu

SEQ ID NO: 314916 - RNA, 22 nt, Homo sapiens
augugcuaguaucaaacgagac

SEQ ID NO: 314917 - RNA, 22 nt, Homo sapiens
augugcuugagggaaaucaguu

SEQ ID NO: 314918 - RNA, 22 nt, Homo sapiens
auguggaaagcagcaugauaug

SEQ ID NO: 314919 - RNA, 22 nt, Homo sapiens
augugggaggacuuggcuguug

SEQ ID NO: 314920 - RNA, 22 nt, Homo sapiens
augugucaaaucuaggccaaag

SEQ ID NO: 314921 - RNA, 22 nt, Homo sapiens
augugugaaucccagaaccugu

SEQ ID NO: 314922 - RNA, 23 nt, Homo sapiens
augugugcuuggagagcaggaug

SEQ ID NO: 314923 - RNA, 20 nt, Homo sapiens
auuagagcuacauggcuaca

SEQ ID NO: 314924 - RNA, 22 nt, Homo sapiens
auuagaugguuauaggugugag

SEQ ID NO: 314925 - RNA, 22 nt, Homo sapiens
auuauauguguaugugcauacc

SEQ ID NO: 314926 - RNA, 22 nt, Homo sapiens
acggaacugcuccauucuuugc

SEQ ID NO: 314927 - RNA, 22 nt, Homo sapiens
acugacaugaucaggcauguuc

SEQ ID NO: 314928 - RNA, 23 nt, Homo sapiens
acugagcaauguuuacauacuug

SEQ ID NO: 314929 - RNA, 20 nt, Homo sapiens
acugauauguuccuguucuc

SEQ ID NO: 314930 - RNA, 22 nt, Homo sapiens
acugcacuccagccugaugaaa

SEQ ID NO: 314931 - RNA, 22 nt, Homo sapiens
acugcacucuagccuuggcaac

SEQ ID NO: 314932 - RNA, 22 nt, Homo sapiens
acugcacugcagccuggccaac

SEQ ID NO: 314933 - RNA, 22 nt, Homo sapiens
acugcauaaauauguguaauau

SEQ ID NO: 314934 - RNA, 22 nt, Homo sapiens
acuguacuccagccugggcaac

SEQ ID NO: 314935 - RNA, 22 nt, Homo sapiens
acuguacucuacccugggcaac

SEQ ID NO: 314936 - RNA, 22 nt, Homo sapiens
acuucauucucuggaucagaau

SEQ ID NO: 314937 - RNA, 19 nt, Homo sapiens
acuuuggugauuagaggga

SEQ ID NO: 314938 - RNA, 22 nt, Homo sapiens
acuuugguuaucauacuuucag

SEQ ID NO: 314939 - RNA, 19 nt, Homo sapiens
agaagugcauggucuagag

SEQ ID NO: 314940 - RNA, 22 nt, Homo sapiens
agaagugcuggguucaggcugg

SEQ ID NO: 314941 - RNA, 22 nt, Homo sapiens
agaauguaacucuaugaaggca

SEQ ID NO: 314942 - RNA, 22 nt, Homo sapiens
agacagcugggaaauggagugu

SEQ ID NO: 314943 - RNA, 22 nt, Homo sapiens
agagaacugauucagggaaaau

SEQ ID NO: 314944 - RNA, 22 nt, Homo sapiens
agagaacugauuggaugugggc

SEQ ID NO: 314945 - RNA, 19 nt, Homo sapiens
agagacucauuguagcauu

SEQ ID NO: 314946 - RNA, 22 nt, Homo sapiens
agagagcuuuugguugcccuaa

SEQ ID NO: 314947 - RNA, 20 nt, Homo sapiens
agagaucaguaauucaucaa

SEQ ID NO: 314948 - RNA, 22 nt, Homo sapiens
agagauuauccuggcuucucug

SEQ ID NO: 314949 - RNA, 22 nt, Homo sapiens
agagguauacauuugagagcca

SEQ ID NO: 314950 - RNA, 22 nt, Homo sapiens
agagguauuggaaggaguguca

SEQ ID NO: 314951 - RNA, 22 nt, Homo sapiens
agagugcuuuauuagauguagc

SEQ ID NO: 314952 - RNA, 22 nt, Homo sapiens
agauaugucugcuauuugcugu

SEQ ID NO: 314953 - RNA, 22 nt, Homo sapiens
agaugccucauguucuagguuc

SEQ ID NO: 314954 - RNA, 22 nt, Homo sapiens
agauggguuuucacauguuggc

SEQ ID NO: 314955 - RNA, 22 nt, Homo sapiens
agcaaaucuaugaauguauauu

SEQ ID NO: 314956 - RNA, 22 nt, Homo sapiens
agcaacauuguucauaauagcu

SEQ ID NO: 314957 - RNA, 22 nt, Homo sapiens
agcacagugaaugguuuacuca

SEQ ID NO: 314958 - RNA, 17 nt, Homo sapiens
agcaccacacucucuug

SEQ ID NO: 314959 - RNA, 23 nt, Homo sapiens
agcaccaccccaggucacaagug

SEQ ID NO: 314960 - RNA, 22 nt, Homo sapiens
agcagcauauuuuuauaaugua

SEQ ID NO: 314961 - RNA, 22 nt, Homo sapiens
agcagcaucgggaaguuggcca

SEQ ID NO: 314962 - RNA, 22 nt, Homo sapiens
agcagcaugcaaauggacuaau

SEQ ID NO: 314963 - RNA, 17 nt, Homo sapiens
agcagcccauaucccca

SEQ ID NO: 314964 - RNA, 22 nt, Homo sapiens
agcaggacaauaugggaucagg

SEQ ID NO: 314965 - RNA, 22 nt, Homo sapiens
agcagguguggcuuauccugaa

SEQ ID NO: 314966 - RNA, 22 nt, Homo sapiens
agcgguguuaggaaggugaggg

SEQ ID NO: 314967 - RNA, 22 nt, Homo sapiens
agcuaaaucucauguugaauug

SEQ ID NO: 314968 - RNA, 22 nt, Homo sapiens
agcuaacauuuuuccucuucca

SEQ ID NO: 314969 - RNA, 22 nt, Homo sapiens
agcuccuacuguuacaucauug

SEQ ID NO: 314970 - RNA, 22 nt, Homo sapiens
agcuucauuccaacuuccuucu

SEQ ID NO: 314971 - RNA, 22 nt, Homo sapiens
agcuuguguuuuucuaaguauc

SEQ ID NO: 314972 - RNA, 22 nt, Homo sapiens
aggaaaucuuagcugaggggau

SEQ ID NO: 314973 - RNA, 21 nt, Homo sapiens
aggaagacuaugaucaauugg

SEQ ID NO: 314974 - RNA, 22 nt, Homo sapiens
aggacacugagcaugggagguu

SEQ ID NO: 314975 - RNA, 21 nt, Homo sapiens
ggaaaguuaaggaaauacccc

SEQ ID NO: 314976 - RNA, 22 nt, Homo sapiens
ggaaaucaucauucucgguaua

SEQ ID NO: 314977 - RNA, 22 nt, Homo sapiens
ggaaauguaaacaauggggcua

SEQ ID NO: 314978 - RNA, 22 nt, Homo sapiens
ggaagacuuagaguagcaucag

SEQ ID NO: 314979 - RNA, 22 nt, Homo sapiens
ggaagccugcacucgggcaggg

SEQ ID NO: 314980 - RNA, 22 nt, Homo sapiens
ggaagugcuguguggaagucug

SEQ ID NO: 314981 - RNA, 20 nt, Homo sapiens
ggaauagucuacacucugac

SEQ ID NO: 314982 - RNA, 22 nt, Homo sapiens
ggacugagaggacuacagugua

SEQ ID NO: 314983 - RNA, 22 nt, Homo sapiens
ggagaguaauuagacugaaaga

SEQ ID NO: 314984 - RNA, 22 nt, Homo sapiens
ggagaugauuaugaaucacuua

SEQ ID NO: 314985 - RNA, 22 nt, Homo sapiens
ggagguaauaaguuccagugua

SEQ ID NO: 314986 - RNA, 20 nt, Homo sapiens
ggagguguugauuuuucuuu

SEQ ID NO: 314987 - RNA, 22 nt, Homo sapiens
ggaguaaaagaguaggaggaau

SEQ ID NO: 314988 - RNA, 22 nt, Homo sapiens
ggagugugauucaguauaauau

SEQ ID NO: 314989 - RNA, 22 nt, Homo sapiens
ggaguguguaggagaaagguaa

SEQ ID NO: 314990 - RNA, 22 nt, Homo sapiens
ggcaagaaccacaauuacuuuu

SEQ ID NO: 314991 - RNA, 22 nt, Homo sapiens
ggcaagaagaacuauaacuuuu

SEQ ID NO: 314992 - RNA, 22 nt, Homo sapiens
ggcaagaagagaguuuaaacau

SEQ ID NO: 314993 - RNA, 21 nt, Homo sapiens
ggcaagagaauacaacauaaa

SEQ ID NO: 314994 - RNA, 19 nt, Homo sapiens
ggcaagaguuguucugugu

SEQ ID NO: 314995 - RNA, 22 nt, Homo sapiens
ggcacgguggcucacaccugua

SEQ ID NO: 314996 - RNA, 22 nt, Homo sapiens
ggcagcucaggccccgcgcuga

SEQ ID NO: 314997 - RNA, 22 nt, Homo sapiens
ggcaguggaagugccaguuucu

SEQ ID NO: 314998 - RNA, 22 nt, Homo sapiens
ggcaguguaauaauuuauuaau

SEQ ID NO: 314999 - RNA, 22 nt, Homo sapiens
ggcaugcauuguacuaguaugc

SEQ ID NO: 315000 - RNA, 22 nt, Homo sapiens
ggccggguggccauggcugccc

SEQ ID NO: 315001 - RNA, 22 nt, Homo sapiens
ggcucagugaucuguuucugua

SEQ ID NO: 315002 - RNA, 18 nt, Homo sapiens
gggaauauggggaguuga

SEQ ID NO: 315003 - RNA, 20 nt, Homo sapiens
gggaaugcaaauucucaucc

SEQ ID NO: 315004 - RNA, 22 nt, Homo sapiens
gggaauggaagacauuaugaug

SEQ ID NO: 315005 - RNA, 18 nt, Homo sapiens
gggcaaguugccuggcuu

SEQ ID NO: 315006 - RNA, 23 nt, Homo sapiens
gggcuagaugagagcuuccuggg

SEQ ID NO: 315007 - RNA, 22 nt, Homo sapiens
gggguaggcuacacugaguucc

SEQ ID NO: 315008 - RNA, 22 nt, Homo sapiens
gggguauguaagugagugagug

SEQ ID NO: 315009 - RNA, 22 nt, Homo sapiens
ggguucaaaucuuggcucuuac

SEQ ID NO: 315010 - RNA, 22 nt, Homo sapiens
gguaaaucuucacuaagacuga

SEQ ID NO: 315011 - RNA, 22 nt, Homo sapiens
gguaggcacuggugggaagaga

SEQ ID NO: 315012 - RNA, 22 nt, Homo sapiens
gguauguaggucuacgguacaa

SEQ ID NO: 315013 - RNA, 22 nt, Homo sapiens
ggucaaguaauccuggguguca

SEQ ID NO: 315014 - RNA, 22 nt, Homo sapiens
ggucauggauaagauccagaag

SEQ ID NO: 315015 - RNA, 22 nt, Homo sapiens
ggucuagagagagggguggacu

SEQ ID NO: 315016 - RNA, 22 nt, Homo sapiens
ggucuuggagaauuguccuggg

SEQ ID NO: 315017 - RNA, 22 nt, Homo sapiens
ggugagaaaaacauagucucag

SEQ ID NO: 315018 - RNA, 22 nt, Homo sapiens
ggugagcacagaaugcccugag

SEQ ID NO: 315019 - RNA, 22 nt, Homo sapiens
gguggcuuuuugugauggcuga

SEQ ID NO: 315020 - RNA, 22 nt, Homo sapiens
gguguguaaauuacuuaucucu

SEQ ID NO: 315021 - RNA, 22 nt, Homo sapiens
gguuagaaacagguccucagga

SEQ ID NO: 315022 - RNA, 22 nt, Homo sapiens
guaaaguaaagcacaucaaggu

SEQ ID NO: 315023 - RNA, 22 nt, Homo sapiens
guaaggcuguuaucuucacguc

SEQ ID NO: 315024 - RNA, 23 nt, Homo sapiens
guaauacuagucauaguagcagg

SEQ ID NO: 315025 - RNA, 22 nt, Homo sapiens
guaaucucagcuacucgggagg

SEQ ID NO: 315026 - RNA, 22 nt, Homo sapiens
guaaucucagcuacuugggagc

SEQ ID NO: 315027 - RNA, 22 nt, Homo sapiens
ugcacacucuguaugagaaucu

SEQ ID NO: 315028 - RNA, 22 nt, Homo sapiens
ugcaguacauucagcauccucu

SEQ ID NO: 315029 - RNA, 20 nt, Homo sapiens
ugcaguguccucacuuguca

SEQ ID NO: 315030 - RNA, 21 nt, Homo sapiens
ugcagugugguugcccugcug

SEQ ID NO: 315031 - RNA, 22 nt, Homo sapiens
ugcauacacaagcauacaugua

SEQ ID NO: 315032 - RNA, 22 nt, Homo sapiens
ugcauacugaaauauuuuagag

SEQ ID NO: 315033 - RNA, 22 nt, Homo sapiens
ugcaugcaucuuuuauaguagc

SEQ ID NO: 315034 - RNA, 22 nt, Homo sapiens
ugcauggaagggagggaaagag

SEQ ID NO: 315035 - RNA, 22 nt, Homo sapiens
ugcauuguuccgaauguguccu

SEQ ID NO: 315036 - RNA, 19 nt, Homo sapiens
ugccaagaaagucagcuua

SEQ ID NO: 315037 - RNA, 22 nt, Homo sapiens
ugccaguguuuuguugaagauu

SEQ ID NO: 315038 - RNA, 22 nt, Homo sapiens
ugccauagagauuuguggaacu

SEQ ID NO: 315039 - RNA, 23 nt, Homo sapiens
ugccuagaccaucagccugaggu

SEQ ID NO: 315040 - RNA, 22 nt, Homo sapiens
ugccuaggcuggaaugcaaugg

SEQ ID NO: 315041 - RNA, 20 nt, Homo sapiens
ugccugacacucuuugcuuc

SEQ ID NO: 315042 - RNA, 16 nt, Homo sapiens
ugccuucuucuguauu

SEQ ID NO: 315043 - RNA, 22 nt, Homo sapiens
ugcgccauugaacuccuccugg

SEQ ID NO: 315044 - RNA, 22 nt, Homo sapiens
ugcuagaagaucacacacauca

SEQ ID NO: 315045 - RNA, 22 nt, Homo sapiens
ugcucaccugcugcucaccucc

SEQ ID NO: 315046 - RNA, 18 nt, Homo sapiens
ugcuccccugggugagca

SEQ ID NO: 315047 - RNA, 22 nt, Homo sapiens
ugcugguauuauguuauccaga

SEQ ID NO: 315048 - RNA, 22 nt, Homo sapiens
ugcuggugauuaaauccugaag

SEQ ID NO: 315049 - RNA, 22 nt, Homo sapiens
ugcugguuuucaucaucagugg

SEQ ID NO: 315050 - RNA, 22 nt, Homo sapiens
ucugucuugugguuugagugcc

SEQ ID NO: 315051 - RNA, 22 nt, Homo sapiens
ucuguggugggcuccacccagu

SEQ ID NO: 315052 - RNA, 22 nt, Homo sapiens
ucuguguugaugcucauuaauu

SEQ ID NO: 315053 - RNA, 22 nt, Homo sapiens
ucuguuguuaucauaauauuga

SEQ ID NO: 315054 - RNA, 22 nt, Homo sapiens
ucuuaguuuagauuagcaauuc

SEQ ID NO: 315055 - RNA, 22 nt, Homo sapiens
ucuucuagcggaacccucuugu

SEQ ID NO: 315056 - RNA, 17 nt, Homo sapiens
ucuucuguuacuguggc

SEQ ID NO: 315057 - RNA, 22 nt, Homo sapiens
ucuugaacuucugcacacucag

SEQ ID NO: 315058 - RNA, 22 nt, Homo sapiens
ucuugcaauuuccuuaguggug

SEQ ID NO: 315059 - RNA, 22 nt, Homo sapiens
ucuuggccaugaauggcaaggc

SEQ ID NO: 315060 - RNA, 21 nt, Homo sapiens
ucuuggguugaauucucccag

SEQ ID NO: 315061 - RNA, 22 nt, Homo sapiens
ucuuggguuuguccuucuccua

SEQ ID NO: 315062 - RNA, 22 nt, Homo sapiens
ucuuuaguuaagggacauuuua

SEQ ID NO: 315063 - RNA, 22 nt, Homo sapiens
ucuuugaguuauugugcagacu

SEQ ID NO: 315064 - RNA, 22 nt, Homo sapiens
ucuuugauuaugcagauggguu

SEQ ID NO: 315065 - RNA, 22 nt, Homo sapiens
ucuuugccuaacccaaggucau

SEQ ID NO: 315066 - RNA, 22 nt, Homo sapiens
ucuuuggaggcgaucuguuuga

SEQ ID NO: 315067 - RNA, 22 nt, Homo sapiens
ucuuugguugcacugcaggugu

SEQ ID NO: 315068 - RNA, 22 nt, Homo sapiens
ucuuuguguaggucaaucuggc

SEQ ID NO: 315069 - RNA, 22 nt, Homo sapiens
ucuuuguuagaacccucuccuu

SEQ ID NO: 315070 - RNA, 22 nt, Homo sapiens
ucuuuugugagucagccucucc

SEQ ID NO: 315071 - RNA, 20 nt, Homo sapiens
ugaaacacauggacuggggu

SEQ ID NO: 315072 - RNA, 22 nt, Homo sapiens
ugaaauacuuaauuucuccaug

SEQ ID NO: 315073 - RNA, 20 nt, Homo sapiens
ugaaaucuucacuaagucuc

SEQ ID NO: 315074 - RNA, 22 nt, Homo sapiens
ugaaaugaucaguuugguuacu

SEQ ID NO: 315075 - RNA, 21 nt, Homo sapiens
ugaaaugcaugugcacauuaa

SEQ ID NO: 315076 - RNA, 22 nt, Homo sapiens
ugaaauggaagaagucccuuuu

SEQ ID NO: 315077 - RNA, 22 nt, Homo sapiens
aggacacugauguaugcugugg

SEQ ID NO: 315078 - RNA, 20 nt, Homo sapiens
aggagcauuuacauuggcuc

SEQ ID NO: 315079 - RNA, 22 nt, Homo sapiens
aggcaagcaucuugcucccuuc

SEQ ID NO: 315080 - RNA, 22 nt, Homo sapiens
aggcaugauggcuccagaucau

SEQ ID NO: 315081 - RNA, 22 nt, Homo sapiens
aggcauguugcuucgggcuuug

SEQ ID NO: 315082 - RNA, 22 nt, Homo sapiens
aggcuuguuuuacuaacuggua

SEQ ID NO: 315083 - RNA, 20 nt, Homo sapiens
agguacacugacaugccuuc

SEQ ID NO: 315084 - RNA, 22 nt, Homo sapiens
aggugaaugcucacauucuaau

SEQ ID NO: 315085 - RNA, 22 nt, Homo sapiens
agguuaugauuauagagcgagg

SEQ ID NO: 315086 - RNA, 22 nt, Homo sapiens
aguaacacaccugcauggugug

SEQ ID NO: 315087 - RNA, 22 nt, Homo sapiens
aguauuuguuggaauaccuguu

SEQ ID NO: 315088 - RNA, 22 nt, Homo sapiens
agucaagauggcaagguaaggc

SEQ ID NO: 315089 - RNA, 22 nt, Homo sapiens
agugacaugggaucaaaucuga

SEQ ID NO: 315090 - RNA, 21 nt, Homo sapiens
agugagucauuuggaaagcaa

SEQ ID NO: 315091 - RNA, 22 nt, Homo sapiens
agugauauguuugccuugaggg

SEQ ID NO: 315092 - RNA, 22 nt, Homo sapiens
agugcaguggcucaaaaugccu

SEQ ID NO: 315093 - RNA, 22 nt, Homo sapiens
agugccauggcugcuagauggc

SEQ ID NO: 315094 - RNA, 22 nt, Homo sapiens
agugguauaauauuauuuugaa

SEQ ID NO: 315095 - RNA, 20 nt, Homo sapiens
agugguuuucaaauaugucu

SEQ ID NO: 315096 - RNA, 22 nt, Homo sapiens
agugguuuuggaauggaauuca

SEQ ID NO: 315097 - RNA, 22 nt, Homo sapiens
aguucaaugcucuuucuacuau

SEQ ID NO: 315098 - RNA, 22 nt, Homo sapiens
auaaaccuacauuuucacuucu

SEQ ID NO: 315099 - RNA, 22 nt, Homo sapiens
auaacauggaguuugucauuua

SEQ ID NO: 315100 - RNA, 22 nt, Homo sapiens
auaacucuguuuuuuucaugca

SEQ ID NO: 315101 - RNA, 22 nt, Homo sapiens
auaagagcaggcuucuggccag

SEQ ID NO: 315102 - RNA, 22 nt, Homo sapiens
auaauacugggaagaugagcau

SEQ ID NO: 315103 - RNA, 22 nt, Homo sapiens
auaauacuuuuauuuugaggaa

SEQ ID NO: 315104 - RNA, 22 nt, Homo sapiens
auaaucacacccagguuaaaug

SEQ ID NO: 315105 - RNA, 23 nt, Homo sapiens
auaaugcaaguggugguaaucug

SEQ ID NO: 315106 - RNA, 22 nt, Homo sapiens
auaauguuuauccagaggaguu

SEQ ID NO: 315107 - RNA, 22 nt, Homo sapiens
auacaagcaguccaacuccaua

SEQ ID NO: 315108 - RNA, 22 nt, Homo sapiens
auacaguaucuucuggcaagca

SEQ ID NO: 315109 - RNA, 20 nt, Homo sapiens
auaccacagacuggguaguu

SEQ ID NO: 315110 - RNA, 16 nt, Homo sapiens
auaccacagugacaca

SEQ ID NO: 315111 - RNA, 22 nt, Homo sapiens
auacccugucgugagucagaga

SEQ ID NO: 315112 - RNA, 22 nt, Homo sapiens
auacuccugucucagcugagau

SEQ ID NO: 315113 - RNA, 22 nt, Homo sapiens
auagaaucaucugugcacuagu

SEQ ID NO: 315114 - RNA, 22 nt, Homo sapiens
auagaucauugucauuuuagau

SEQ ID NO: 315115 - RNA, 22 nt, Homo sapiens
auagcaauuugggaaucagacu

SEQ ID NO: 315116 - RNA, 22 nt, Homo sapiens
auagcagacauuucaaggcagg

SEQ ID NO: 315117 - RNA, 22 nt, Homo sapiens
auagcuguccuuacuagcuagg

SEQ ID NO: 315118 - RNA, 22 nt, Homo sapiens
auaguauaguugaggauggcau

SEQ ID NO: 315119 - RNA, 22 nt, Homo sapiens
auagugcugcaauaaccauggg

SEQ ID NO: 315120 - RNA, 22 nt, Homo sapiens
auaucaaggccauuuucuaaau

SEQ ID NO: 315121 - RNA, 21 nt, Homo sapiens
auauggaacuggugacguguu

SEQ ID NO: 315122 - RNA, 22 nt, Homo sapiens
auauggcauucagaacuguaua

SEQ ID NO: 315123 - RNA, 22 nt, Homo sapiens
auaugucuguuuagucuguaau

SEQ ID NO: 315124 - RNA, 22 nt, Homo sapiens
auaugucuuaguuaccuugggc

SEQ ID NO: 315125 - RNA, 22 nt, Homo sapiens
auauuacuggccauaucgcagg

SEQ ID NO: 315126 - RNA, 22 nt, Homo sapiens
auauuguacugcuacugguucu

SEQ ID NO: 315127 - RNA, 20 nt, Homo sapiens
aucaaagacuuagaggggga

SEQ ID NO: 315128 - RNA, 22 nt, Homo sapiens
aucaaauugucauuuuaaggau

SEQ ID NO: 315129 - RNA, 22 nt, Homo sapiens
aucacacuguuauuuuaguuaa

SEQ ID NO: 315130 - RNA, 20 nt, Homo sapiens
aucaccacagcucguucaug

SEQ ID NO: 315131 - RNA, 18 nt, Homo sapiens
uuucauugagugugauau

SEQ ID NO: 315132 - RNA, 22 nt, Homo sapiens
uuuccaagaugcuuacuuucuc

SEQ ID NO: 315133 - RNA, 22 nt, Homo sapiens
uuuccagguggccaacauuuua

SEQ ID NO: 315134 - RNA, 19 nt, Homo sapiens
uuuccaguaaucuuaugug

SEQ ID NO: 315135 - RNA, 22 nt, Homo sapiens
uuucccugaaggcucugaaguc

SEQ ID NO: 315136 - RNA, 22 nt, Homo sapiens
uuucccuuacuuaaacuuacuc

SEQ ID NO: 315137 - RNA, 16 nt, Homo sapiens
uuucccuuugguguuu

SEQ ID NO: 315138 - RNA, 22 nt, Homo sapiens
uuucuacagugaacgauuucua

SEQ ID NO: 315139 - RNA, 22 nt, Homo sapiens
uuugaagacuacugggagugaa

SEQ ID NO: 315140 - RNA, 22 nt, Homo sapiens
uuugaagugugaugccuugaug

SEQ ID NO: 315141 - RNA, 20 nt, Homo sapiens
uuugaauguaaagcauguca

SEQ ID NO: 315142 - RNA, 18 nt, Homo sapiens
uuugacugguguccuuau

SEQ ID NO: 315143 - RNA, 22 nt, Homo sapiens
uuugagaaugcuaccagagaag

SEQ ID NO: 315144 - RNA, 22 nt, Homo sapiens
uuugagugugauaucgauugga

SEQ ID NO: 315145 - RNA, 22 nt, Homo sapiens
uuugauugguguaccugaaagu

SEQ ID NO: 315146 - RNA, 22 nt, Homo sapiens
uuugauuguacuaaaauuguac

SEQ ID NO: 315147 - RNA, 22 nt, Homo sapiens
uuugcaagaugaaaaaguucua

SEQ ID NO: 315148 - RNA, 22 nt, Homo sapiens
uuugcugagucugacuucaugg

SEQ ID NO: 315149 - RNA, 22 nt, Homo sapiens
uuuggaagaugccacuguauca

SEQ ID NO: 315150 - RNA, 22 nt, Homo sapiens
uuuggcaaagaucaacauguua

SEQ ID NO: 315151 - RNA, 22 nt, Homo sapiens
uuuggcuuuugugauacguaau

SEQ ID NO: 315152 - RNA, 22 nt, Homo sapiens
uuugggaaugguuugucuccca

SEQ ID NO: 315153 - RNA, 22 nt, Homo sapiens
uuuguacacuguuggugguuau

SEQ ID NO: 315154 - RNA, 22 nt, Homo sapiens
uuugugaggugauggauauguc

SEQ ID NO: 315155 - RNA, 22 nt, Homo sapiens
uuuuacacuguugguuggaaug

SEQ ID NO: 315156 - RNA, 20 nt, Homo sapiens
uuuuagcacuuguuauggug

SEQ ID NO: 315157 - RNA, 22 nt, Homo sapiens
uuuuaguugcucagguauucuc

SEQ ID NO: 315158 - RNA, 22 nt, Homo sapiens
uuuucaguggccauaguggaga

SEQ ID NO: 315159 - RNA, 19 nt, Homo sapiens
uuuuggaaaugugaacagc

SEQ ID NO: 315160 - RNA, 22 nt, Homo sapiens
uuuuggcucugucuguaucuuu

SEQ ID NO: 315161 - RNA, 22 nt, Homo sapiens
uuuuggcuuuuccucagcaagc

SEQ ID NO: 315162 - RNA, 22 nt, Homo sapiens
uuuuggugguuaugugucaaug

SEQ ID NO: 315163 - RNA, 22 nt, Homo sapiens
gagaugugguucaaggguguuu

SEQ ID NO: 315164 - RNA, 22 nt, Homo sapiens
gagccuguaggaggagaggugg

SEQ ID NO: 315165 - RNA, 20 nt, Homo sapiens
gagcugguguacugccgggc

SEQ ID NO: 315166 - RNA, 22 nt, Homo sapiens
gaggaucucuugagcccagaag

SEQ ID NO: 315167 - RNA, 22 nt, Homo sapiens
gagguaaguaagaauggcaagc

SEQ ID NO: 315168 - RNA, 22 nt, Homo sapiens
gagguaaguggauuaugagguc

SEQ ID NO: 315169 - RNA, 22 nt, Homo sapiens
gagguagagacuauguauuaga

SEQ ID NO: 315170 - RNA, 22 nt, Homo sapiens
gaggucauguggcaggcagcca

SEQ ID NO: 315171 - RNA, 22 nt, Homo sapiens
gaggugaaggucucaauaaaua

SEQ ID NO: 315172 - RNA, 22 nt, Homo sapiens
gaguucaaaucucagcucuguu

SEQ ID NO: 315173 - RNA, 22 nt, Homo sapiens
gaguucauaucuaugagugugc

SEQ ID NO: 315174 - RNA, 22 nt, Homo sapiens
gaguuuguaaacuauucacuaa

SEQ ID NO: 315175 - RNA, 22 nt, Homo sapiens
gauacaguaugcaugugguauu

SEQ ID NO: 315176 - RNA, 22 nt, Homo sapiens
gauauugacuuauucuauguuu

SEQ ID NO: 315177 - RNA, 22 nt, Homo sapiens
gaucagauggcuguuggugugu

SEQ ID NO: 315178 - RNA, 22 nt, Homo sapiens
gaucauggaguuggguucaagg

SEQ ID NO: 315179 - RNA, 22 nt, Homo sapiens
gaugagguaguguaccuagucu

SEQ ID NO: 315180 - RNA, 22 nt, Homo sapiens
gaugauauuugagucauuagaa

SEQ ID NO: 315181 - RNA, 22 nt, Homo sapiens
gaugaugcuagguguuagggcu

SEQ ID NO: 315182 - RNA, 22 nt, Homo sapiens
gaugauguugaauguucucacc

SEQ ID NO: 315183 - RNA, 22 nt, Homo sapiens
gauguguugggaagauuucaag

SEQ ID NO: 315184 - RNA, 22 nt, Homo sapiens
gauguguuuccaggauuuguuu

SEQ ID NO: 315185 - RNA, 22 nt, Homo sapiens
gauguguuuguuucuggaggag

SEQ ID NO: 315186 - RNA, 22 nt, Homo sapiens
gauuagaacagaagucagauua

SEQ ID NO: 315187 - RNA, 22 nt, Homo sapiens
gcaaaauugagaagggaauaua

SEQ ID NO: 315188 - RNA, 21 nt, Homo sapiens
gcaaaguggcuaccuugcucc

SEQ ID NO: 315189 - RNA, 22 nt, Homo sapiens
gcaaaugcuaugccauuuuaua

SEQ ID NO: 315190 - RNA, 22 nt, Homo sapiens
gcaacugguuucaguuuuucag

SEQ ID NO: 315191 - RNA, 22 nt, Homo sapiens
gcaaggacucccugggucauuc

SEQ ID NO: 315192 - RNA, 22 nt, Homo sapiens
gcacagucaacacuuauucacc

SEQ ID NO: 315193 - RNA, 22 nt, Homo sapiens
gcacccguagugcuuucaauua

SEQ ID NO: 315194 - RNA, 22 nt, Homo sapiens
gcagcacaugacuguauguaua

SEQ ID NO: 315195 - RNA, 22 nt, Homo sapiens
gcagguguuaugcaaacaacug

SEQ ID NO: 315196 - RNA, 20 nt, Homo sapiens
gcaguacuuuuaguucuaag

SEQ ID NO: 315197 - RNA, 22 nt, Homo sapiens
gcaguagugugaucuuggcuca

SEQ ID NO: 315198 - RNA, 22 nt, Homo sapiens
gcagugcaguggcgcgaucucg

SEQ ID NO: 315199 - RNA, 22 nt, Homo sapiens
gcagugugauguuuuaaucuau

SEQ ID NO: 315200 - RNA, 20 nt, Homo sapiens
gcauaugucuuuauagcaga

SEQ ID NO: 315201 - RNA, 17 nt, Homo sapiens
gcauauguugaaccagc

SEQ ID NO: 315202 - RNA, 22 nt, Homo sapiens
gcauauuuuaaaguguaaccug

SEQ ID NO: 315203 - RNA, 22 nt, Homo sapiens
gcaucacagcuccugugcuggc

SEQ ID NO: 315204 - RNA, 22 nt, Homo sapiens
gccaagauuuaauucaucaguu

SEQ ID NO: 315205 - RNA, 22 nt, Homo sapiens
gccagugugaugugaucauggc

SEQ ID NO: 315206 - RNA, 22 nt, Homo sapiens
gccaguguuuuauugagaauuu

SEQ ID NO: 315207 - RNA, 22 nt, Homo sapiens
gccccugagacuugccucgggc

SEQ ID NO: 315208 - RNA, 22 nt, Homo sapiens
gccgagagauuuggaaugggga

SEQ ID NO: 315209 - RNA, 22 nt, Homo sapiens
gccuagagaguuaucaggcugu

SEQ ID NO: 315210 - RNA, 22 nt, Homo sapiens
gcuaggagauccacugcucucu

SEQ ID NO: 315211 - RNA, 22 nt, Homo sapiens
gcuaggagaucugcugcucucu

SEQ ID NO: 315212 - RNA, 19 nt, Homo sapiens
gcucaccuugcugcuccag

SEQ ID NO: 315213 - RNA, 22 nt, Homo sapiens
gcucugguuacaaaggcaaauu

SEQ ID NO: 315214 - RNA, 17 nt, Homo sapiens
gcugcauucauguagaa

SEQ ID NO: 315215 - RNA, 22 nt, Homo sapiens
gcuguaguugaggauuuuaaga

SEQ ID NO: 315216 - RNA, 22 nt, Homo sapiens
gcuguuugccgccaucgcagac

SEQ ID NO: 315217 - RNA, 22 nt, Homo sapiens
gcuugguccccacccaaaucgc

SEQ ID NO: 315218 - RNA, 19 nt, Homo sapiens
gcuuguccacgugagauaa

SEQ ID NO: 315219 - RNA, 22 nt, Homo sapiens
gcuuugguucaaccaggcaauu

SEQ ID NO: 315220 - RNA, 23 nt, Homo sapiens
ggaaacauccagucuuucaccau

SEQ ID NO: 315221 - RNA, 20 nt, Homo sapiens
ggaagagugacacaagguau

SEQ ID NO: 315222 - RNA, 23 nt, Homo sapiens
ggaaugaaaccugguuaugauau

SEQ ID NO: 315223 - RNA, 22 nt, Homo sapiens
ggaaugggauuugaagucuggc

SEQ ID NO: 315224 - RNA, 21 nt, Homo sapiens
ggaauguugccagcagccaga

SEQ ID NO: 315225 - RNA, 22 nt, Homo sapiens
ggagcugugauuugaguccaga

SEQ ID NO: 315226 - RNA, 22 nt, Homo sapiens
ggagggugagaucaauuuggga

SEQ ID NO: 315227 - RNA, 22 nt, Homo sapiens
ggaguaugaaacccacuccaau

SEQ ID NO: 315228 - RNA, 22 nt, Homo sapiens
ggagucugaacuggacaaugac

SEQ ID NO: 315229 - RNA, 22 nt, Homo sapiens
ggagucugauguucuaaggcag

SEQ ID NO: 315230 - RNA, 21 nt, Homo sapiens
ggauucaucccucaugaauuu

SEQ ID NO: 315231 - RNA, 22 nt, Homo sapiens
ggcaagaggagauucugcuccc

SEQ ID NO: 315232 - RNA, 22 nt, Homo sapiens
ggcaagugggagggaguguuuc

SEQ ID NO: 315233 - RNA, 22 nt, Homo sapiens
ggcacugugaugugagggggua

SEQ ID NO: 315234 - RNA, 22 nt, Homo sapiens
ggcagaauugcugaggaugcua

SEQ ID NO: 315235 - RNA, 22 nt, Homo sapiens
ggcaguguauuacuuaggguuc

SEQ ID NO: 315236 - RNA, 23 nt, Homo sapiens
ggcauuguggcucacaucuguaa

SEQ ID NO: 315237 - RNA, 22 nt, Homo sapiens
ggcucagugggguccugguucu

SEQ ID NO: 315238 - RNA, 22 nt, Homo sapiens
ggcucguguuuucuguccaguu

SEQ ID NO: 315239 - RNA, 22 nt, Homo sapiens
ggcuuggaggaaugugagggcu

SEQ ID NO: 315240 - RNA, 22 nt, Homo sapiens
gggaaauguaaagucauaagau

SEQ ID NO: 315241 - RNA, 22 nt, Homo sapiens
gggaagaaggagugguuuacuc

SEQ ID NO: 315242 - RNA, 22 nt, Homo sapiens
gggaagauauaggcugggcacc

SEQ ID NO: 315243 - RNA, 22 nt, Homo sapiens
gggagguagguauuagcuuuuc

SEQ ID NO: 315244 - RNA, 20 nt, Homo sapiens
gggcaaguaugugggaaguc

SEQ ID NO: 315245 - RNA, 22 nt, Homo sapiens
gggcacgugugugcugugcuca

SEQ ID NO: 315246 - RNA, 16 nt, Homo sapiens
gggcaugugaagccua

SEQ ID NO: 315247 - RNA, 22 nt, Homo sapiens
ggguaggcaagcggaugucaga

SEQ ID NO: 315248 - RNA, 17 nt, Homo sapiens
gggucaccuugcaggua

SEQ ID NO: 315249 - RNA, 19 nt, Homo sapiens
ggucagcaaagucuagcug

SEQ ID NO: 315250 - RNA, 21 nt, Homo sapiens
ggugagaaaggagacauagac

SEQ ID NO: 315251 - RNA, 23 nt, Homo sapiens
ggugaggaguacagagucuucau

SEQ ID NO: 315252 - RNA, 22 nt, Homo sapiens
guaaucucagcuacuugggagg

SEQ ID NO: 315253 - RNA, 22 nt, Homo sapiens
guaaucucagcuacuugggagu

SEQ ID NO: 315254 - RNA, 22 nt, Homo sapiens
guaaucucagcuucuugggagg

SEQ ID NO: 315255 - RNA, 22 nt, Homo sapiens
guacacguggcuguguaggagu

SEQ ID NO: 315256 - RNA, 22 nt, Homo sapiens
guacaggugcaggaugggcagg

SEQ ID NO: 315257 - RNA, 22 nt, Homo sapiens
guacaguacugaaugaauguau

SEQ ID NO: 315258 - RNA, 22 nt, Homo sapiens
guagcagaacauguuccuugua

SEQ ID NO: 315259 - RNA, 22 nt, Homo sapiens
guagugcaguuugagaaucagu

SEQ ID NO: 315260 - RNA, 22 nt, Homo sapiens
guaugaaaaucggagauugggu

SEQ ID NO: 315261 - RNA, 22 nt, Homo sapiens
guaugacacaggaagcuuaacc

SEQ ID NO: 315262 - RNA, 22 nt, Homo sapiens
guauggcaugcaugagaauuuc

SEQ ID NO: 315263 - RNA, 19 nt, Homo sapiens
guauuugacuuucuuguuu

SEQ ID NO: 315264 - RNA, 19 nt, Homo sapiens
uagaugucuuugcauagau

SEQ ID NO: 315265 - RNA, 22 nt, Homo sapiens
uagcacaguucacccucgauuu

SEQ ID NO: 315266 - RNA, 22 nt, Homo sapiens
uagcagcaaagcaggaucugcu

SEQ ID NO: 315267 - RNA, 22 nt, Homo sapiens
uagcagcagugguguauuuaga

SEQ ID NO: 315268 - RNA, 22 nt, Homo sapiens
uagcugcacuuacaagugagaa

SEQ ID NO: 315269 - RNA, 22 nt, Homo sapiens
uaggacacagauggagaaaagc

SEQ ID NO: 315270 - RNA, 22 nt, Homo sapiens
uaggacacucucuccaccagua

SEQ ID NO: 315271 - RNA, 22 nt, Homo sapiens
uaggagcacaaaccccauugug

SEQ ID NO: 315272 - RNA, 22 nt, Homo sapiens
uaggcaaaugcaagaguagaac

SEQ ID NO: 315273 - RNA, 22 nt, Homo sapiens
uaggcgagauguguguuucaug

SEQ ID NO: 315274 - RNA, 22 nt, Homo sapiens
uaggcuuuucugggaugugggc

SEQ ID NO: 315275 - RNA, 22 nt, Homo sapiens
uaggcuuuuggacccugucucu

SEQ ID NO: 315276 - RNA, 22 nt, Homo sapiens
uagguaagauguuaacagcuga

SEQ ID NO: 315277 - RNA, 22 nt, Homo sapiens
uaggugguuugaaauacucaag

SEQ ID NO: 315278 - RNA, 19 nt, Homo sapiens
uaggugguuuuccccucac

SEQ ID NO: 315279 - RNA, 22 nt, Homo sapiens
uaguaucacauggucuuaauua

SEQ ID NO: 315280 - RNA, 22 nt, Homo sapiens
uagucacacacucaacuuuuca

SEQ ID NO: 315281 - RNA, 22 nt, Homo sapiens
uagucccauaugauuuagugaa

SEQ ID NO: 315282 - RNA, 22 nt, Homo sapiens
uagugacauugcugggaaugcu

SEQ ID NO: 315283 - RNA, 21 nt, Homo sapiens
uagugcagugggguaugacuu

SEQ ID NO: 315284 - RNA, 22 nt, Homo sapiens
uaguucauuauguguugcucag

SEQ ID NO: 315285 - RNA, 22 nt, Homo sapiens
uauaacaaugcaagaauggccu

SEQ ID NO: 315286 - RNA, 20 nt, Homo sapiens
uauaacaguuuggacccagu

SEQ ID NO: 315287 - RNA, 22 nt, Homo sapiens
uauaaccauuucuucucucuuc

SEQ ID NO: 315288 - RNA, 22 nt, Homo sapiens
uauacacgugugcauauauaca

SEQ ID NO: 315289 - RNA, 22 nt, Homo sapiens
uauacaguaggcacucaguggc

SEQ ID NO: 315290 - RNA, 22 nt, Homo sapiens
uauacugucuuuguaugccuag

SEQ ID NO: 315291 - RNA, 22 nt, Homo sapiens
uaucacaaacuuagcaguuuaa

SEQ ID NO: 315292 - RNA, 20 nt, Homo sapiens
uaucacaggucagaaacccu

SEQ ID NO: 315293 - RNA, 22 nt, Homo sapiens
uaucacaguaaaucugggugca

SEQ ID NO: 315294 - RNA, 22 nt, Homo sapiens
uaucacaguugcauauuuaagg

SEQ ID NO: 315295 - RNA, 22 nt, Homo sapiens
uaucagcagagucauacuucaa

SEQ ID NO: 315296 - RNA, 22 nt, Homo sapiens
uaucagcagcaggggcugcaga

SEQ ID NO: 315297 - RNA, 22 nt, Homo sapiens
uaucagugaaucuuauuuugcc

SEQ ID NO: 315298 - RNA, 21 nt, Homo sapiens
uauccacuugcaacagagaag

SEQ ID NO: 315299 - RNA, 23 nt, Homo sapiens
uaucucaaugcacagagaggaaa

SEQ ID NO: 315300 - RNA, 22 nt, Homo sapiens
uaucucagagaaucagauuuac

SEQ ID NO: 315301 - RNA, 22 nt, Homo sapiens
uaugaauuuuauccaggauaua

SEQ ID NO: 315302 - RNA, 19 nt, Homo sapiens
uaugcaacuuauagugcug

SEQ ID NO: 315303 - RNA, 22 nt, Homo sapiens
uauggauuuuuuugacaagagc

SEQ ID NO: 315304 - RNA, 22 nt, Homo sapiens
uauggcaaugcauaggaaggaa

SEQ ID NO: 315305 - RNA, 22 nt, Homo sapiens
uauggcauuauuuugauagaca

SEQ ID NO: 315306 - RNA, 22 nt, Homo sapiens
uauggcauuguuggugaugaua

SEQ ID NO: 315307 - RNA, 22 nt, Homo sapiens
uauggcucuauuuccuugucua

SEQ ID NO: 315308 - RNA, 22 nt, Homo sapiens
uauggcuuuucacuuaaguccu

SEQ ID NO: 315309 - RNA, 22 nt, Homo sapiens
uaugggauuucauuaagugucu

SEQ ID NO: 315310 - RNA, 22 nt, Homo sapiens
uauggguuucagagggugauag

SEQ ID NO: 315311 - RNA, 22 nt, Homo sapiens
uauggucuuugagaggugacug

SEQ ID NO: 315312 - RNA, 22 nt, Homo sapiens
uaugucaugggguuuuugagau

SEQ ID NO: 315313 - RNA, 22 nt, Homo sapiens
uauguuaucaaaaagcuaagga

SEQ ID NO: 315314 - RNA, 20 nt, Homo sapiens
uauuacagaguaauggugga

SEQ ID NO: 315315 - RNA, 22 nt, Homo sapiens
uauuacuugucugugucucaau

SEQ ID NO: 315316 - RNA, 22 nt, Homo sapiens
uauuaguuuucuguggauuaca

SEQ ID NO: 315317 - RNA, 22 nt, Homo sapiens
uauucacaggugugggacaaag

SEQ ID NO: 315318 - RNA, 20 nt, Homo sapiens
uauucacucuccagucuugc

SEQ ID NO: 315319 - RNA, 22 nt, Homo sapiens
uauuccuuuugcauuuccacau

SEQ ID NO: 315320 - RNA, 22 nt, Homo sapiens
uauugaacgugggauauugaag

SEQ ID NO: 315321 - RNA, 22 nt, Homo sapiens
uauugacuugaugagggagggu

SEQ ID NO: 315322 - RNA, 22 nt, Homo sapiens
uauugcacuccagccuuggcaa

SEQ ID NO: 315323 - RNA, 22 nt, Homo sapiens
uauugcuuuacucucuuauccu

SEQ ID NO: 315324 - RNA, 17 nt, Homo sapiens
ucaaaugcucccaguga

SEQ ID NO: 315325 - RNA, 22 nt, Homo sapiens
ucaacauugcugucaggcaucu

SEQ ID NO: 315326 - RNA, 22 nt, Homo sapiens
ucaagaccucacauagaggaga

SEQ ID NO: 315327 - RNA, 21 nt, Homo sapiens
ucaaggaguauacguaugcca

SEQ ID NO: 315328 - RNA, 22 nt, Homo sapiens
ucacaagcuccugccuuugcuu

SEQ ID NO: 315329 - RNA, 22 nt, Homo sapiens
ucacacugcaucuguuggaauu

SEQ ID NO: 315330 - RNA, 21 nt, Homo sapiens
ucacagccuaggaccugaaga

SEQ ID NO: 315331 - RNA, 23 nt, Homo sapiens
ucacaguuacuuuugcaucaacc

SEQ ID NO: 315332 - RNA, 22 nt, Homo sapiens
ucacauuguauauguaccuauc

SEQ ID NO: 315333 - RNA, 22 nt, Homo sapiens
ucacauuguguagccugcucac

SEQ ID NO: 315334 - RNA, 22 nt, Homo sapiens
ucacccacacaggagacaggga

SEQ ID NO: 315335 - RNA, 20 nt, Homo sapiens
ucacccugacaucugcccag

SEQ ID NO: 315336 - RNA, 22 nt, Homo sapiens
ucaccuguagcuaagaccuaau

SEQ ID NO: 315337 - RNA, 22 nt, Homo sapiens
ucacuagggaucacuuuacccg

SEQ ID NO: 315338 - RNA, 22 nt, Homo sapiens
ucacugagcacaggagaugugc

SEQ ID NO: 315339 - RNA, 22 nt, Homo sapiens
ucacugcgaccuccaccuccug

SEQ ID NO: 315340 - RNA, 22 nt, Homo sapiens
ucacugcgaccuccgccucccg

SEQ ID NO: 315341 - RNA, 22 nt, Homo sapiens
ucacuggacagaaauaaaggug

SEQ ID NO: 315342 - RNA, 22 nt, Homo sapiens
ucacuggacucuagccugggug

SEQ ID NO: 315343 - RNA, 22 nt, Homo sapiens
ucacuggaggagaggaagugga

SEQ ID NO: 315344 - RNA, 22 nt, Homo sapiens
ucacuggcaaauauauccguug

SEQ ID NO: 315345 - RNA, 22 nt, Homo sapiens
ucacugugcaugaaggaugcug

SEQ ID NO: 315346 - RNA, 22 nt, Homo sapiens
ucacuuggugaacacauuaugu

SEQ ID NO: 315347 - RNA, 22 nt, Homo sapiens
ucacuuugacggccaacuucua

SEQ ID NO: 315348 - RNA, 18 nt, Homo sapiens
ucagagugcagacuauac

SEQ ID NO: 315349 - RNA, 22 nt, Homo sapiens
ucagaugaucugguaagaacuu

SEQ ID NO: 315350 - RNA, 21 nt, Homo sapiens
ucagcucaucacugccuggag

SEQ ID NO: 315351 - RNA, 22 nt, Homo sapiens
ucaguauaugaaucuggggcag

SEQ ID NO: 315352 - RNA, 20 nt, Homo sapiens
ucaguauauuguuuccacag

SEQ ID NO: 315353 - RNA, 23 nt, Homo sapiens
ucagugaaggaacaacuaaauag

SEQ ID NO: 315354 - RNA, 21 nt, Homo sapiens
ucagugcugugggcaaggugc

SEQ ID NO: 315355 - RNA, 22 nt, Homo sapiens
ucaguggagagcuuccaggauu

SEQ ID NO: 315356 - RNA, 22 nt, Homo sapiens
ucaguggagcuacaauucuggg

SEQ ID NO: 315357 - RNA, 23 nt, Homo sapiens
ucagugucuggauccugcucagu

SEQ ID NO: 315358 - RNA, 22 nt, Homo sapiens
ucaguguugauggcugcugacu

SEQ ID NO: 315359 - RNA, 22 nt, Homo sapiens
ucaguguuuuauccuccagagc

SEQ ID NO: 315360 - RNA, 22 nt, Homo sapiens
ucauauguaugugcaauuuugu

SEQ ID NO: 315361 - RNA, 22 nt, Homo sapiens
ucaucagugcuugcaaauuauu

SEQ ID NO: 315362 - RNA, 22 nt, Homo sapiens
ucaugacacagcauacugacuu

SEQ ID NO: 315363 - RNA, 22 nt, Homo sapiens
ucaugagacacacuggaaagga

SEQ ID NO: 315364 - RNA, 22 nt, Homo sapiens
ucaugcaucuuguggaauuuga

SEQ ID NO: 315365 - RNA, 22 nt, Homo sapiens
ugagguugucagugucauucuu

SEQ ID NO: 315366 - RNA, 22 nt, Homo sapiens
ugagugugacuuagcagaagga

SEQ ID NO: 315367 - RNA, 22 nt, Homo sapiens
ugaguucaauuguauuuuauua

SEQ ID NO: 315368 - RNA, 22 nt, Homo sapiens
ugaguuuaucuaaagaccuggg

SEQ ID NO: 315369 - RNA, 22 nt, Homo sapiens
ugauacuggcuucauagaauga

SEQ ID NO: 315370 - RNA, 22 nt, Homo sapiens
ugauaggucacucaacagugag

SEQ ID NO: 315371 - RNA, 22 nt, Homo sapiens
ugauaggucagaugauauugaa

SEQ ID NO: 315372 - RNA, 22 nt, Homo sapiens
ugaucaaagugcuggaauuaca

SEQ ID NO: 315373 - RNA, 22 nt, Homo sapiens
ugaucacagcuugacuaaagga

SEQ ID NO: 315374 - RNA, 22 nt, Homo sapiens
ugauucccucaagugccuuaug

SEQ ID NO: 315375 - RNA, 18 nt, Homo sapiens
ugcaaacauguguguguu

SEQ ID NO: 315376 - RNA, 22 nt, Homo sapiens
ugcaaagucgaaacugcaguuu

SEQ ID NO: 315377 - RNA, 22 nt, Homo sapiens
ugcaaaugcugcuauuucucuu

SEQ ID NO: 315378 - RNA, 22 nt, Homo sapiens
ugcaaaugucaaggguuagugu

SEQ ID NO: 315379 - RNA, 22 nt, Homo sapiens
ugcaaauguuaggugucauuau

SEQ ID NO: 315380 - RNA, 22 nt, Homo sapiens
ugcaaauguuauuuugguuucu

SEQ ID NO: 315381 - RNA, 22 nt, Homo sapiens
ugcaagaaucagccuaucauua

SEQ ID NO: 315382 - RNA, 22 nt, Homo sapiens
ugcaagaaucuuucaggcuagc

SEQ ID NO: 315383 - RNA, 22 nt, Homo sapiens
ugcaagacaucguauuuugguc

SEQ ID NO: 315384 - RNA, 22 nt, Homo sapiens
ugcaagucaucuguccuucaga

SEQ ID NO: 315385 - RNA, 17 nt, Homo sapiens
ugcaauuuaagcuagau

SEQ ID NO: 315386 - RNA, 18 nt, Homo sapiens
ugcaccaguuuacacuuc

SEQ ID NO: 315387 - RNA, 22 nt, Homo sapiens
ugcagauucguuuugaggggua

SEQ ID NO: 315388 - RNA, 22 nt, Homo sapiens
ugcagcacaguagguuugcaau

SEQ ID NO: 315389 - RNA, 22 nt, Homo sapiens
ugcagcacugaacuucugggcu

SEQ ID NO: 315390 - RNA, 22 nt, Homo sapiens
ugcagugugcuggggucuccau

SEQ ID NO: 315391 - RNA, 18 nt, Homo sapiens
ugcauacuaucugauuuu

SEQ ID NO: 315392 - RNA, 22 nt, Homo sapiens
ugcauagaauguucuguaaaua

SEQ ID NO: 315393 - RNA, 21 nt, Homo sapiens
ugcauauuggaacuuucucuc

SEQ ID NO: 315394 - RNA, 21 nt, Homo sapiens
ugcauggagaacacugagggu

SEQ ID NO: 315395 - RNA, 21 nt, Homo sapiens
ugcaugguagucacaugauuc

SEQ ID NO: 315396 - RNA, 22 nt, Homo sapiens
ugcauguucuuacucauacaug

SEQ ID NO: 315397 - RNA, 22 nt, Homo sapiens
ugccaaaaugggcuuuauaccg

SEQ ID NO: 315398 - RNA, 20 nt, Homo sapiens
ugccagugugucaauuuaua

SEQ ID NO: 315399 - RNA, 22 nt, Homo sapiens
ugccugagcccagcccuguagu

SEQ ID NO: 315400 - RNA, 22 nt, Homo sapiens
ugccuggagagcuccuacauau

SEQ ID NO: 315401 - RNA, 23 nt, Homo sapiens
ugcugagaccuagauccuaaaga

SEQ ID NO: 315402 - RNA, 20 nt, Homo sapiens
ugcugcacuuaagcaugggc

SEQ ID NO: 315403 - RNA, 22 nt, Homo sapiens
ugcugcacuuauggcucugagg

SEQ ID NO: 315404 - RNA, 22 nt, Homo sapiens
ugcuggugauucagauucaaau

SEQ ID NO: 315405 - RNA, 22 nt, Homo sapiens
ugcuggugucaucaaggcuuug

SEQ ID NO: 315406 - RNA, 22 nt, Homo sapiens
ugcuuaggcuaacaaaaauagc

SEQ ID NO: 315407 - RNA, 21 nt, Homo sapiens
ugcuuuggucauacuucuucc

SEQ ID NO: 315408 - RNA, 22 nt, Homo sapiens
uggaaauaaaugugccaagauc

SEQ ID NO: 315409 - RNA, 22 nt, Homo sapiens
uggaagaugggaccucaguuuu

SEQ ID NO: 315410 - RNA, 22 nt, Homo sapiens
uggaaggcuucauauguaaaga

SEQ ID NO: 315411 - RNA, 22 nt, Homo sapiens
uggaagucuauggcauuugagu

SEQ ID NO: 315412 - RNA, 22 nt, Homo sapiens
uggaagucuucauuauguauag

SEQ ID NO: 315413 - RNA, 22 nt, Homo sapiens
uggaauaugagacgggguuguc

SEQ ID NO: 315414 - RNA, 22 nt, Homo sapiens
uggaaugcuaagcaugugggag

SEQ ID NO: 315415 - RNA, 22 nt, Homo sapiens
uggaauuuacuuauuuaggggc

SEQ ID NO: 315416 - RNA, 22 nt, Homo sapiens
uggacagagagaccggcauuuu

SEQ ID NO: 315417 - RNA, 18 nt, Homo sapiens
uggacagugauuauccau

SEQ ID NO: 315418 - RNA, 20 nt, Homo sapiens
uggaccagagagguggggac

SEQ ID NO: 315419 - RNA, 22 nt, Homo sapiens
uggagggcuagucauuucuuuu

SEQ ID NO: 315420 - RNA, 19 nt, Homo sapiens
uggagucaucaugcugcua

SEQ ID NO: 315421 - RNA, 22 nt, Homo sapiens
uggauagaacuaagugcuuaga

SEQ ID NO: 315422 - RNA, 22 nt, Homo sapiens
uggaugaagagaugguaguugc

SEQ ID NO: 315423 - RNA, 22 nt, Homo sapiens
uggauggugauuggaucaugga

SEQ ID NO: 315424 - RNA, 22 nt, Homo sapiens
uggcaagagcaaaauguacagu

SEQ ID NO: 315425 - RNA, 22 nt, Homo sapiens
uggcaagagggaugcaagguuu

SEQ ID NO: 315426 - RNA, 19 nt, Homo sapiens
uggcaaugucagcagagau

SEQ ID NO: 315427 - RNA, 22 nt, Homo sapiens
uggcacaaugacccuugugggc

SEQ ID NO: 315428 - RNA, 19 nt, Homo sapiens
uggcacauguauacauaug

SEQ ID NO: 315429 - RNA, 17 nt, Homo sapiens
uggcaugaggguguggg

SEQ ID NO: 315430 - RNA, 22 nt, Homo sapiens
uggcaugcauuguggguaauua

SEQ ID NO: 315431 - RNA, 22 nt, Homo sapiens
uggcauguaaugcagaaguugc

SEQ ID NO: 315432 - RNA, 18 nt, Homo sapiens
uggccaauggcaaacaga

SEQ ID NO: 315433 - RNA, 22 nt, Homo sapiens
uggccagugucggaggccagga

SEQ ID NO: 315434 - RNA, 22 nt, Homo sapiens
uggcuguuuauuucacaugggu

SEQ ID NO: 315435 - RNA, 22 nt, Homo sapiens
uggcuguuuauuucaccuggau

SEQ ID NO: 315436 - RNA, 22 nt, Homo sapiens
uggcuguuuauuucaccugggc

SEQ ID NO: 315437 - RNA, 22 nt, Homo sapiens
uggcuuuucauccugggacauu

SEQ ID NO: 315438 - RNA, 22 nt, Homo sapiens
uggcuuuuguuauuuggaagcu

SEQ ID NO: 315439 - RNA, 22 nt, Homo sapiens
ugggaagagggagcgauuuugg

SEQ ID NO: 315440 - RNA, 22 nt, Homo sapiens
ugggaagcugcauuuuaacaag

SEQ ID NO: 315441 - RNA, 22 nt, Homo sapiens
ugggaccccuacucuuuccaca

SEQ ID NO: 315442 - RNA, 22 nt, Homo sapiens
ugggagcauugcauuagaagcc

SEQ ID NO: 315443 - RNA, 21 nt, Homo sapiens
ugggccccuuccuuacaucau

SEQ ID NO: 315444 - RNA, 22 nt, Homo sapiens
ugggcggagacgugcagccgcc

SEQ ID NO: 315445 - RNA, 22 nt, Homo sapiens
ugggguaggcuguauacucugu

SEQ ID NO: 315446 - RNA, 22 nt, Homo sapiens
uggguaguguaaagcacuccag

SEQ ID NO: 315447 - RNA, 22 nt, Homo sapiens
uggguagugucagcugauccau

SEQ ID NO: 315448 - RNA, 22 nt, Homo sapiens
ugggucaguagcauguaugucu

SEQ ID NO: 315449 - RNA, 23 nt, Homo sapiens
ugggucaguuuuucugacaucau

SEQ ID NO: 315450 - RNA, 22 nt, Homo sapiens
ugguauuuaauauaugagaguu

SEQ ID NO: 315451 - RNA, 22 nt, Homo sapiens
uggucuccuuuguacccugggc

SEQ ID NO: 315452 - RNA, 22 nt, Homo sapiens
uguaaaccauauauguauguag

SEQ ID NO: 315453 - RNA, 22 nt, Homo sapiens
uguaaaucuauuuuuaguguuu

SEQ ID NO: 315454 - RNA, 20 nt, Homo sapiens
uguaacaaucuggauguugc

SEQ ID NO: 315455 - RNA, 22 nt, Homo sapiens
uguaauaguaggcucacauuug

SEQ ID NO: 315456 - RNA, 22 nt, Homo sapiens
uguagacaccaaagacagcaua

SEQ ID NO: 315457 - RNA, 22 nt, Homo sapiens
uguagauauucuuucaguuuuu

SEQ ID NO: 315458 - RNA, 22 nt, Homo sapiens
uguagggagagggaguugcacc

SEQ ID NO: 315459 - RNA, 22 nt, Homo sapiens
uguaugucugcucuuuggaacu

SEQ ID NO: 315460 - RNA, 22 nt, Homo sapiens
ugucaaauucuggguuaaaaca

SEQ ID NO: 315461 - RNA, 20 nt, Homo sapiens
ugucaaggaauucccaaauc

SEQ ID NO: 315462 - RNA, 22 nt, Homo sapiens
ugucacuuugccuucuggacuu

SEQ ID NO: 315463 - RNA, 22 nt, Homo sapiens
ugucaggaggguccagagaaaa

SEQ ID NO: 315464 - RNA, 22 nt, Homo sapiens
ugucagggaggcucggccgcac

SEQ ID NO: 315465 - RNA, 22 nt, Homo sapiens
ugucaguguaugagccccggau

SEQ ID NO: 315466 - RNA, 22 nt, Homo sapiens
uugaaagucauuucuucuaagu

SEQ ID NO: 315467 - RNA, 22 nt, Homo sapiens
uugaagacuaccuaccauacuu

SEQ ID NO: 315468 - RNA, 22 nt, Homo sapiens
uugaaggaacgcuguucccuug

SEQ ID NO: 315469 - RNA, 22 nt, Homo sapiens
uugaagguagaaguucucaauu

SEQ ID NO: 315470 - RNA, 22 nt, Homo sapiens
uugaagugaagaacaauaucac

SEQ ID NO: 315471 - RNA, 22 nt, Homo sapiens
uugaaugucuauuaaguuguuu

SEQ ID NO: 315472 - RNA, 21 nt, Homo sapiens
uugacagugacagguaaaguu

SEQ ID NO: 315473 - RNA, 22 nt, Homo sapiens
uugacaguugggcagggaaguu

SEQ ID NO: 315474 - RNA, 22 nt, Homo sapiens
uugacauauguguguccacaua

SEQ ID NO: 315475 - RNA, 22 nt, Homo sapiens
uugacauauuugugcuuaagaa

SEQ ID NO: 315476 - RNA, 22 nt, Homo sapiens
uugacauugcuguaguguccag

SEQ ID NO: 315477 - RNA, 22 nt, Homo sapiens
uugacugugguaauggaagcug

SEQ ID NO: 315478 - RNA, 22 nt, Homo sapiens
uugacuucagagcugauucaag

SEQ ID NO: 315479 - RNA, 22 nt, Homo sapiens
uugacuuuuaggaggaaaauga

SEQ ID NO: 315480 - RNA, 22 nt, Homo sapiens
uugagauagggucuaccucugu

SEQ ID NO: 315481 - RNA, 22 nt, Homo sapiens
uugagaugauggauaugcuaau

SEQ ID NO: 315482 - RNA, 22 nt, Homo sapiens
uugagauggaguuucaauauug

SEQ ID NO: 315483 - RNA, 22 nt, Homo sapiens
uugagauguauguauauaaugu

SEQ ID NO: 315484 - RNA, 22 nt, Homo sapiens
uugagauguggcaguuuaugag

SEQ ID NO: 315485 - RNA, 22 nt, Homo sapiens
uugaggaaugugauuucaaaua

SEQ ID NO: 315486 - RNA, 22 nt, Homo sapiens
uugaggaggcagucucuccauu

SEQ ID NO: 315487 - RNA, 22 nt, Homo sapiens
uugaggcuuuugaccucaugug

SEQ ID NO: 315488 - RNA, 22 nt, Homo sapiens
uugagggagcacagauucuuau

SEQ ID NO: 315489 - RNA, 20 nt, Homo sapiens
uugaggugugaggggcagag

SEQ ID NO: 315490 - RNA, 22 nt, Homo sapiens
uugaguccccacacuggguccc

SEQ ID NO: 315491 - RNA, 22 nt, Homo sapiens
uugcacuauaggaaaauguguc

SEQ ID NO: 315492 - RNA, 22 nt, Homo sapiens
uugcagagaaauuucugguuua

SEQ ID NO: 315493 - RNA, 22 nt, Homo sapiens
uugcagcaaauaggaaugagga

SEQ ID NO: 315494 - RNA, 22 nt, Homo sapiens
uugcaggcaugagccaccgugc

SEQ ID NO: 315495 - RNA, 22 nt, Homo sapiens
uugcaugggagcugggugaagc

SEQ ID NO: 315496 - RNA, 22 nt, Homo sapiens
uugcaugggagcugggugaggc

SEQ ID NO: 315497 - RNA, 22 nt, Homo sapiens
uugcaugucugcuucuccuccu

SEQ ID NO: 315498 - RNA, 22 nt, Homo sapiens
uugccauggaguagaauugaag

SEQ ID NO: 315499 - RNA, 22 nt, Homo sapiens
uugccuaggcuggaguucagug

SEQ ID NO: 315500 - RNA, 22 nt, Homo sapiens
uugcuaagucaagagaaaugau

SEQ ID NO: 315501 - RNA, 22 nt, Homo sapiens
uugcuacauugauugccucuuu

SEQ ID NO: 315502 - RNA, 22 nt, Homo sapiens
uugcuuuguugucuggggaaua

SEQ ID NO: 315503 - RNA, 22 nt, Homo sapiens
uuggaaauauguuaagugucau

SEQ ID NO: 315504 - RNA, 22 nt, Homo sapiens
uuggaauauaaccuguuucuaa

SEQ ID NO: 315505 - RNA, 22 nt, Homo sapiens
uuggaauauuauuauugggcag

SEQ ID NO: 315506 - RNA, 22 nt, Homo sapiens
uuggaaugcaacagaaggauaa

SEQ ID NO: 315507 - RNA, 22 nt, Homo sapiens
uuggaauguauggcaucuugcg

SEQ ID NO: 315508 - RNA, 22 nt, Homo sapiens
uuggaaugugacugauaauauu

SEQ ID NO: 315509 - RNA, 22 nt, Homo sapiens
uuggaauuaaccuggugcugga

SEQ ID NO: 315510 - RNA, 22 nt, Homo sapiens
uuggaauuaagagauauuuucu

SEQ ID NO: 315511 - RNA, 22 nt, Homo sapiens
uuggauccauccugucuucucu

SEQ ID NO: 315512 - RNA, 22 nt, Homo sapiens
uuggauuauaaacugagauuug

SEQ ID NO: 315513 - RNA, 22 nt, Homo sapiens
uuggauuuuaacaaacuaggug

SEQ ID NO: 315514 - RNA, 22 nt, Homo sapiens
uuggauuuugguggcaacucau

SEQ ID NO: 315515 - RNA, 22 nt, Homo sapiens
uuggcacuugauaauauucugg

SEQ ID NO: 315516 - RNA, 22 nt, Homo sapiens
uuggcauagaggcucucaagcu

SEQ ID NO: 315517 - RNA, 22 nt, Homo sapiens
uuggccauaugacuugcuuugg

SEQ ID NO: 315518 - RNA, 22 nt, Homo sapiens
uuggcuucuggacuauugugca

SEQ ID NO: 315519 - RNA, 22 nt, Homo sapiens
uugggauggaacuuuucaguga

SEQ ID NO: 315520 - RNA, 22 nt, Homo sapiens
uugguauguaauuuauauugua

SEQ ID NO: 315521 - RNA, 22 nt, Homo sapiens
uugguccauuacauugaugaca

SEQ ID NO: 315522 - RNA, 22 nt, Homo sapiens
uugguccccacuccccugccaa

SEQ ID NO: 315523 - RNA, 22 nt, Homo sapiens
uugguucucuuagccaucuuaa

SEQ ID NO: 315524 - RNA, 22 nt, Homo sapiens
uuguacuuuuaguagagacggg

SEQ ID NO: 315525 - RNA, 22 nt, Homo sapiens
uuguaugucuucauuugaaaaa

SEQ ID NO: 315526 - RNA, 22 nt, Homo sapiens
uugugaaaaaccucucguggaa

SEQ ID NO: 315527 - RNA, 22 nt, Homo sapiens
uugugcaaaguugugguuucug

SEQ ID NO: 315528 - RNA, 22 nt, Homo sapiens
uugugcaugaugcauacauggu

SEQ ID NO: 315529 - RNA, 20 nt, Homo sapiens
uugugcauugggccauuggg

SEQ ID NO: 315530 - RNA, 22 nt, Homo sapiens
uugugccccuucucagucgggc

SEQ ID NO: 315531 - RNA, 22 nt, Homo sapiens
uugugggaggugauuagaucau

SEQ ID NO: 315532 - RNA, 22 nt, Homo sapiens
uugugucccugcggcugaggag

SEQ ID NO: 315533 - RNA, 22 nt, Homo sapiens
uuguguuugaugcugacacgca

SEQ ID NO: 315534 - RNA, 22 nt, Homo sapiens
uuuaagguauguggugaaaauu

SEQ ID NO: 315535 - RNA, 17 nt, Homo sapiens
uuuaaugcuaggacucu

SEQ ID NO: 315536 - RNA, 22 nt, Homo sapiens
uuuacagucucauagguggaag

SEQ ID NO: 315537 - RNA, 22 nt, Homo sapiens
uuuacagucuuuugugugaguc

SEQ ID NO: 315538 - RNA, 22 nt, Homo sapiens
uuuacaguuuucuaggcuacca

SEQ ID NO: 315539 - RNA, 22 nt, Homo sapiens
uuuacugucuucagucccucug

SEQ ID NO: 315540 - RNA, 22 nt, Homo sapiens
uuuaucuguuuaaaacuguuca

SEQ ID NO: 315541 - RNA, 22 nt, Homo sapiens
uuucagguauuuaagggccguu

SEQ ID NO: 315542 - RNA, 16 nt, Homo sapiens
uuucaucaguuuuaau

SEQ ID NO: 315543 - RNA, 22 nt, Homo sapiens
uuucauggcgaggcuucauggg

SEQ ID NO: 315544 - RNA, 22 nt, Homo sapiens
uuucccauuguucugcucugug

SEQ ID NO: 315545 - RNA, 22 nt, Homo sapiens
uuucccuuuagcuuagugauuu

SEQ ID NO: 315546 - RNA, 22 nt, Homo sapiens
uuucccuuugcuuugucagcca

SEQ ID NO: 315547 - RNA, 21 nt, Homo sapiens
uuuccuggagcguauggcuuc

SEQ ID NO: 315548 - RNA, 22 nt, Homo sapiens
uuugaauguaaugagcaggaag

SEQ ID NO: 315549 - RNA, 22 nt, Homo sapiens
uuugacuaccaggaauguucuu

SEQ ID NO: 315550 - RNA, 22 nt, Homo sapiens
uuugagcuagagucucacucug

SEQ ID NO: 315551 - RNA, 22 nt, Homo sapiens
uuugagcuugacucagcuggag

SEQ ID NO: 315552 - RNA, 22 nt, Homo sapiens
uuugaggaaaggcauaaguagg

SEQ ID NO: 315553 - RNA, 22 nt, Homo sapiens
uuugagguguauggcaaguuga

SEQ ID NO: 315554 - RNA, 22 nt, Homo sapiens
uuugcaauguugugauggugaa

SEQ ID NO: 315555 - RNA, 22 nt, Homo sapiens
uuugccaaugggaauuuuccua

SEQ ID NO: 315556 - RNA, 22 nt, Homo sapiens
uuugcuaaucaacacuggccug

SEQ ID NO: 315557 - RNA, 22 nt, Homo sapiens
uuugcuuguguaaaaaucugga

SEQ ID NO: 315558 - RNA, 22 nt, Homo sapiens
uuuggaaugugcacucagauug

SEQ ID NO: 315559 - RNA, 22 nt, Homo sapiens
uuuggcagaaaacuaaaaggua

SEQ ID NO: 315560 - RNA, 22 nt, Homo sapiens
uuuggucccaaugugauaaggu

SEQ ID NO: 315561 - RNA, 22 nt, Homo sapiens
uuugguuuuuguuaucacucau

SEQ ID NO: 315562 - RNA, 22 nt, Homo sapiens
uuugucaauaacuaccaacagg

SEQ ID NO: 315563 - RNA, 22 nt, Homo sapiens
uuuguucaccucaaggauggga

SEQ ID NO: 315564 - RNA, 22 nt, Homo sapiens
uuuguuugaagucgagacaacu

SEQ ID NO: 315565 - RNA, 22 nt, Homo sapiens
uuuuagcuuuucccaggacucc

SEQ ID NO: 315566 - RNA, 22 nt, Homo sapiens
uuuuaguggacaaagguauuua

SEQ ID NO: 315567 - RNA, 22 nt, Homo sapiens
auugcuaauaugcuucaggcaa

SEQ ID NO: 315568 - RNA, 22 nt, Homo sapiens
auugcuuacccuguauuagauc

SEQ ID NO: 315569 - RNA, 22 nt, Homo sapiens
auuggucuugaaaccagagaga

SEQ ID NO: 315570 - RNA, 22 nt, Homo sapiens
auuguacauacaccggugugua

SEQ ID NO: 315571 - RNA, 22 nt, Homo sapiens
auuguucuuguguccuuuuccu

SEQ ID NO: 315572 - RNA, 22 nt, Homo sapiens
auuucacuucgcaugguguccg

SEQ ID NO: 315573 - RNA, 22 nt, Homo sapiens
caaaggcuucugaaacugcaga

SEQ ID NO: 315574 - RNA, 22 nt, Homo sapiens
caaagucuauucuacccuuacc

SEQ ID NO: 315575 - RNA, 22 nt, Homo sapiens
caaagucuucucauuaugucuu

SEQ ID NO: 315576 - RNA, 22 nt, Homo sapiens
caaccaguagcugaguucaaaa

SEQ ID NO: 315577 - RNA, 22 nt, Homo sapiens
caaccguagauuguucugggcu

SEQ ID NO: 315578 - RNA, 22 nt, Homo sapiens
caacucuguaggauccaggugg

SEQ ID NO: 315579 - RNA, 22 nt, Homo sapiens
caagagagcugaugguuuuaaa

SEQ ID NO: 315580 - RNA, 22 nt, Homo sapiens
caaugguuuuuuaguauaagua

SEQ ID NO: 315581 - RNA, 22 nt, Homo sapiens
caccgagguuggagugcagugg

SEQ ID NO: 315582 - RNA, 18 nt, Homo sapiens
cacugagcccuucacucu

SEQ ID NO: 315583 - RNA, 22 nt, Homo sapiens
cacugcacuccagccuaagagg

SEQ ID NO: 315584 - RNA, 21 nt, Homo sapiens
cacugcacuugccuucugggu

SEQ ID NO: 315585 - RNA, 22 nt, Homo sapiens
cacuggcacuguguuuagaugg

SEQ ID NO: 315586 - RNA, 22 nt, Homo sapiens
cagagcacugauacuggguucu

SEQ ID NO: 315587 - RNA, 22 nt, Homo sapiens
cagagguaagcaagucagcauu

SEQ ID NO: 315588 - RNA, 22 nt, Homo sapiens
cagcuguuguuaugucugcagg

SEQ ID NO: 315589 - RNA, 22 nt, Homo sapiens
caggcagugggagacaaaacug

SEQ ID NO: 315590 - RNA, 22 nt, Homo sapiens
cagguaguguguagcacagcag

SEQ ID NO: 315591 - RNA, 22 nt, Homo sapiens
caguaaauaucugagcgagguc

SEQ ID NO: 315592 - RNA, 22 nt, Homo sapiens
caguacaauguggaaaaggagu

SEQ ID NO: 315593 - RNA, 22 nt, Homo sapiens
cagucacagugacaggaugugg

SEQ ID NO: 315594 - RNA, 18 nt, Homo sapiens
cauagcacuucagcacau

SEQ ID NO: 315595 - RNA, 22 nt, Homo sapiens
caugaaagacugaggaauugga

SEQ ID NO: 315596 - RNA, 22 nt, Homo sapiens
caugcauuggucuauuauguga

SEQ ID NO: 315597 - RNA, 22 nt, Homo sapiens
cauggcuuguauaagauucuca

SEQ ID NO: 315598 - RNA, 22 nt, Homo sapiens
cauugucccucaaugucuauga

SEQ ID NO: 315599 - RNA, 22 nt, Homo sapiens
cauuuugcaguuucugucucca

SEQ ID NO: 315600 - RNA, 22 nt, Homo sapiens
ccacaaccucaacagcaucuau

SEQ ID NO: 315601 - RNA, 22 nt, Homo sapiens
ccagugucugacagacacggcg

SEQ ID NO: 315602 - RNA, 22 nt, Homo sapiens
ccaguuuucucacuguugcagu

SEQ ID NO: 315603 - RNA, 22 nt, Homo sapiens
cccagaguucuuaaauacugag

SEQ ID NO: 315604 - RNA, 22 nt, Homo sapiens
cccagugguuacauaaggagua

SEQ ID NO: 315605 - RNA, 22 nt, Homo sapiens
ccccauuguugugguuuuaucu

SEQ ID NO: 315606 - RNA, 22 nt, Homo sapiens
ccugagaucauacuguuaguaa

SEQ ID NO: 315607 - RNA, 19 nt, Homo sapiens
ccugcuguucuuuugcacc

SEQ ID NO: 315608 - RNA, 22 nt, Homo sapiens
ccuucauccuccagcaggcuag

SEQ ID NO: 315609 - RNA, 22 nt, Homo sapiens
ccuucauucauuaauuuagccc

SEQ ID NO: 315610 - RNA, 22 nt, Homo sapiens
cuaaagauagugacaugauuug

SEQ ID NO: 315611 - RNA, 22 nt, Homo sapiens
cuaagguacuguuaacauugua

SEQ ID NO: 315612 - RNA, 22 nt, Homo sapiens
cuagaauguauaaaaccaagcu

SEQ ID NO: 315613 - RNA, 22 nt, Homo sapiens
cuagcagaacaauacaauucgg

SEQ ID NO: 315614 - RNA, 22 nt, Homo sapiens
cuagcagacaugggcugaacca

SEQ ID NO: 315615 - RNA, 22 nt, Homo sapiens
cuauguaccuggaacuguauua

SEQ ID NO: 315616 - RNA, 22 nt, Homo sapiens
cuauucacaauagccaagauuu

SEQ ID NO: 315617 - RNA, 22 nt, Homo sapiens
cucaaagugcuaagauuaggcu

SEQ ID NO: 315618 - RNA, 22 nt, Homo sapiens
cucaaguacaugggauuacagg

SEQ ID NO: 315619 - RNA, 18 nt, Homo sapiens
cucacacccuaaucagga

SEQ ID NO: 315620 - RNA, 18 nt, Homo sapiens
cucacaguaacuuuuaag

SEQ ID NO: 315621 - RNA, 22 nt, Homo sapiens
cucaguguucccauucuaccuu

SEQ ID NO: 315622 - RNA, 22 nt, Homo sapiens
cucaugcugucuucugggguaa

SEQ ID NO: 315623 - RNA, 22 nt, Homo sapiens
cuccauuuaucugaaauuuuau

SEQ ID NO: 315624 - RNA, 22 nt, Homo sapiens
cucccacccucauuuuuaggca

SEQ ID NO: 315625 - RNA, 20 nt, Homo sapiens
cuccuucauuccuuuggacc

SEQ ID NO: 315626 - RNA, 22 nt, Homo sapiens
cugaaagagcauguaacacagu

SEQ ID NO: 315627 - RNA, 22 nt, Homo sapiens
cugaauguccaggcagagguuu

SEQ ID NO: 315628 - RNA, 22 nt, Homo sapiens
cugagauacacuaauagucucu

SEQ ID NO: 315629 - RNA, 22 nt, Homo sapiens
cugaggugggaggauuggcuug

SEQ ID NO: 315630 - RNA, 22 nt, Homo sapiens
cugaucuggaggugucugggga

SEQ ID NO: 315631 - RNA, 22 nt, Homo sapiens
cugcuggucuuuaaggucuagg

SEQ ID NO: 315632 - RNA, 22 nt, Homo sapiens
cuggcagucugccucuucacug

SEQ ID NO: 315633 - RNA, 22 nt, Homo sapiens
cugggaugugacuguugccccc

SEQ ID NO: 315634 - RNA, 22 nt, Homo sapiens
cugguuuguaaaguuccugaga

SEQ ID NO: 315635 - RNA, 22 nt, Homo sapiens
cuguauguuucuaugaauguga

SEQ ID NO: 315636 - RNA, 22 nt, Homo sapiens
cuguucaaauuguuugugaagu

SEQ ID NO: 315637 - RNA, 22 nt, Homo sapiens
cuguugguuaaauuccaugcag

SEQ ID NO: 315638 - RNA, 21 nt, Homo sapiens
cuuaagccacuaaguuuugga

SEQ ID NO: 315639 - RNA, 22 nt, Homo sapiens
cuuaaggccagauaauuucuau

SEQ ID NO: 315640 - RNA, 17 nt, Homo sapiens
cuucaaauaauuucccc

SEQ ID NO: 315641 - RNA, 22 nt, Homo sapiens
cuucaucugguuugugaacuuu

SEQ ID NO: 315642 - RNA, 18 nt, Homo sapiens
cuucauugcuguuuugcu

SEQ ID NO: 315643 - RNA, 22 nt, Homo sapiens
cuuccaaguggggcacgugcca

SEQ ID NO: 315644 - RNA, 22 nt, Homo sapiens
cuuccagcuggguucagucagu

SEQ ID NO: 315645 - RNA, 22 nt, Homo sapiens
cuugcagaggcccuggggagag

SEQ ID NO: 315646 - RNA, 22 nt, Homo sapiens
cuuguuguggaggggagugcag

SEQ ID NO: 315647 - RNA, 22 nt, Homo sapiens
cuuuggauggaaccucucuuuc

SEQ ID NO: 315648 - RNA, 22 nt, Homo sapiens
cuuugugugggccaagggcugg

SEQ ID NO: 315649 - RNA, 22 nt, Homo sapiens
gaaaacugcuucucuggguuuc

SEQ ID NO: 315650 - RNA, 20 nt, Homo sapiens
gaacugguguauguuuaacu

SEQ ID NO: 315651 - RNA, 22 nt, Homo sapiens
gaacuguaaagaaauucuaagg

SEQ ID NO: 315652 - RNA, 22 nt, Homo sapiens
gaaugguuuacaaguguaaucu

SEQ ID NO: 315653 - RNA, 18 nt, Homo sapiens
gacaguguggcaauuccu

SEQ ID NO: 315654 - RNA, 22 nt, Homo sapiens
gacaguguggcgauuccucaag

SEQ ID NO: 315655 - RNA, 22 nt, Homo sapiens
gacauguuucucucuguuuacu

SEQ ID NO: 315656 - RNA, 22 nt, Homo sapiens
gacuauguuaccuuacacauca

SEQ ID NO: 315657 - RNA, 22 nt, Homo sapiens
gacuuugguaaacucgguggca

SEQ ID NO: 315658 - RNA, 22 nt, Homo sapiens
gagaaguaaauuuauuugcaaa

SEQ ID NO: 315659 - RNA, 22 nt, Homo sapiens
gagacugagucuugcuuuguca

SEQ ID NO: 315660 - RNA, 22 nt, Homo sapiens
gagacugaguuuugcucuuguu

SEQ ID NO: 315661 - RNA, 18 nt, Homo sapiens
aaacagugucucuuucug

SEQ ID NO: 315662 - RNA, 22 nt, Homo sapiens
aaacauugaccucauccuggca

SEQ ID NO: 315663 - RNA, 22 nt, Homo sapiens
aaacucuguagcagagacagau

SEQ ID NO: 315664 - RNA, 22 nt, Homo sapiens
agagugcuaaggaaguaauuua

SEQ ID NO: 315665 - RNA, 22 nt, Homo sapiens
agagugcuauagauuagauuuc

SEQ ID NO: 315666 - RNA, 22 nt, Homo sapiens
agauauguuuaguuucaaaaug

SEQ ID NO: 315667 - RNA, 22 nt, Homo sapiens
agaucacaguaccguaaggcug

SEQ ID NO: 315668 - RNA, 22 nt, Homo sapiens
agaugcuguuaucaacuguagc

SEQ ID NO: 315669 - RNA, 22 nt, Homo sapiens
agaugguguuuucucaccagau

SEQ ID NO: 315670 - RNA, 22 nt, Homo sapiens
agcaaccagaggagaugaggcu

SEQ ID NO: 315671 - RNA, 22 nt, Homo sapiens
agcaccagaaucugaguuauuc

SEQ ID NO: 315672 - RNA, 22 nt, Homo sapiens
agcagcucaagacuuaaauuug

SEQ ID NO: 315673 - RNA, 22 nt, Homo sapiens
agcagcucaugccuuugggagg

SEQ ID NO: 315674 - RNA, 22 nt, Homo sapiens
agcggcuguuccccuggucuau

SEQ ID NO: 315675 - RNA, 22 nt, Homo sapiens
agcuaguguucaccagagguca

SEQ ID NO: 315676 - RNA, 22 nt, Homo sapiens
agcugcacaaauggaugugagg

SEQ ID NO: 315677 - RNA, 22 nt, Homo sapiens
agcugcacgugguaaauguaaa

SEQ ID NO: 315678 - RNA, 20 nt, Homo sapiens
agcugguuuuaugaaucuuu

SEQ ID NO: 315679 - RNA, 20 nt, Homo sapiens
agcuguuguuaugagguuua

SEQ ID NO: 315680 - RNA, 22 nt, Homo sapiens
agcuuguggugaauacugcuag

SEQ ID NO: 315681 - RNA, 22 nt, Homo sapiens
agcuuuggauaccugcuguucc

SEQ ID NO: 315682 - RNA, 19 nt, Homo sapiens
aggacuaaagacuagaagu

SEQ ID NO: 315683 - RNA, 22 nt, Homo sapiens
aggagaauugguucuucuugau

SEQ ID NO: 315684 - RNA, 21 nt, Homo sapiens
aggagauguuuguccuuuuag

SEQ ID NO: 315685 - RNA, 20 nt, Homo sapiens
aggagcauuuacauuggcuc

SEQ ID NO: 315686 - RNA, 22 nt, Homo sapiens
aggcaaguugcucaaaugcaaa

SEQ ID NO: 315687 - RNA, 22 nt, Homo sapiens
aggcacgguggcucacaccugu

SEQ ID NO: 315688 - RNA, 22 nt, Homo sapiens
aggcagaugagguccucagcug

SEQ ID NO: 315689 - RNA, 22 nt, Homo sapiens
aggcagucucugccggcugagg

SEQ ID NO: 315690 - RNA, 22 nt, Homo sapiens
aggcagucugaguuuugaaagg

SEQ ID NO: 315691 - RNA, 22 nt, Homo sapiens
aggcuagacuuugagaauuuuu

SEQ ID NO: 315692 - RNA, 21 nt, Homo sapiens
aggcuguuguuuugggaugga

SEQ ID NO: 315693 - RNA, 22 nt, Homo sapiens
gccuagagaguuaucaggcugu

SEQ ID NO: 315694 - RNA, 22 nt, Homo sapiens
gcuacugucuaucugugcuucu

SEQ ID NO: 315695 - RNA, 19 nt, Homo sapiens
gcugauguuacauucuugc

SEQ ID NO: 315696 - RNA, 22 nt, Homo sapiens
gcuguauuguugaaggaaaugu

SEQ ID NO: 315697 - RNA, 21 nt, Homo sapiens
gcuuuuucggaagucuuuggc

SEQ ID NO: 315698 - RNA, 22 nt, Homo sapiens
ggacaaaguauuuucaaaugua

SEQ ID NO: 315699 - RNA, 22 nt, Homo sapiens
ggacugagaggacuacagugua

SEQ ID NO: 315700 - RNA, 22 nt, Homo sapiens
ggagguaauaaguuccagugua

SEQ ID NO: 315701 - RNA, 22 nt, Homo sapiens
ggcaaaaucgcaauuacuuuug

SEQ ID NO: 315702 - RNA, 22 nt, Homo sapiens
ggcaaaauggccagugggucac

SEQ ID NO: 315703 - RNA, 22 nt, Homo sapiens
ggcaacaaagacauuucaacau

SEQ ID NO: 315704 - RNA, 22 nt, Homo sapiens
ggcagaauugcugaggaugcua

SEQ ID NO: 315705 - RNA, 22 nt, Homo sapiens
ggcagcucaggccccgcgcuga

SEQ ID NO: 315706 - RNA, 22 nt, Homo sapiens
ggccagaugcaguggcucacac

SEQ ID NO: 315707 - RNA, 22 nt, Homo sapiens
ggccagaugcgguggcucacac

SEQ ID NO: 315708 - RNA, 22 nt, Homo sapiens
ggcuagauauucacauauggcu

SEQ ID NO: 315709 - RNA, 19 nt, Homo sapiens
ggcucagucaacugacugu

SEQ ID NO: 315710 - RNA, 22 nt, Homo sapiens
gggaagaaggagugguuuacuc

SEQ ID NO: 315711 - RNA, 22 nt, Homo sapiens
gggagcacaagaaauguuucau

SEQ ID NO: 315712 - RNA, 22 nt, Homo sapiens
gggccagaugcauuuguuauuu

SEQ ID NO: 315713 - RNA, 22 nt, Homo sapiens
gggugguuuuaucucuucccuu

SEQ ID NO: 315714 - RNA, 22 nt, Homo sapiens
gguaaaucuucacuaagacuga

SEQ ID NO: 315715 - RNA, 22 nt, Homo sapiens
ggugagauaucugcugauguuu

SEQ ID NO: 315716 - RNA, 22 nt, Homo sapiens
guacauguaugcaugcaugcau

SEQ ID NO: 315717 - RNA, 22 nt, Homo sapiens
guaucauuggcauguaaccaga

SEQ ID NO: 315718 - RNA, 22 nt, Homo sapiens
gucaaagugauuguaauuaggu

SEQ ID NO: 315719 - RNA, 22 nt, Homo sapiens
gucacauugaugcccauggugg

SEQ ID NO: 315720 - RNA, 22 nt, Homo sapiens
gucauccaggcuggagugaagc

SEQ ID NO: 315721 - RNA, 22 nt, Homo sapiens
guccauuuguuuccagagcacu

SEQ ID NO: 315722 - RNA, 22 nt, Homo sapiens
gucucccagccuacaucuuucu

SEQ ID NO: 315723 - RNA, 22 nt, Homo sapiens
gucugcaugucauaugauagua

SEQ ID NO: 315724 - RNA, 22 nt, Homo sapiens
gucugguuuuuuauauccucac

SEQ ID NO: 315725 - RNA, 22 nt, Homo sapiens
gugaaagacagcauuaauggcu

SEQ ID NO: 315726 - RNA, 22 nt, Homo sapiens
gugaaauauuuaacguccaggu

SEQ ID NO: 315727 - RNA, 22 nt, Homo sapiens
gugaaaugaaacgcuaugucuu

SEQ ID NO: 315728 - RNA, 22 nt, Homo sapiens
gugaguaaagguucauugaauu

SEQ ID NO: 315729 - RNA, 22 nt, Homo sapiens
gugauaucuuacaauucucuuu

SEQ ID NO: 315730 - RNA, 22 nt, Homo sapiens
gugcaaugucaggagaugcagc

SEQ ID NO: 315731 - RNA, 23 nt, Homo sapiens
gugcaguggcgagauuucggcuc

SEQ ID NO: 315732 - RNA, 22 nt, Homo sapiens
guggacagagacuaaauguugu

SEQ ID NO: 315733 - RNA, 22 nt, Homo sapiens
gugggagugucccguuuuucca

SEQ ID NO: 315734 - RNA, 22 nt, Homo sapiens
guggggucaucucauuugugga

SEQ ID NO: 315735 - RNA, 18 nt, Homo sapiens
gugucugguuaugggagu

SEQ ID NO: 315736 - RNA, 21 nt, Homo sapiens
gugugcuugaauucagcuguc

SEQ ID NO: 315737 - RNA, 22 nt, Homo sapiens
guuaagaaguguaacuuaaguu

SEQ ID NO: 315738 - RNA, 22 nt, Homo sapiens
guuaaugcuggaauaaguuaag

SEQ ID NO: 315739 - RNA, 22 nt, Homo sapiens
guucaguaguucauucauuuau

SEQ ID NO: 315740 - RNA, 22 nt, Homo sapiens
guugcccuuagcacuucagccu

SEQ ID NO: 315741 - RNA, 22 nt, Homo sapiens
guuuggauuuucuaauuucugu

SEQ ID NO: 315742 - RNA, 22 nt, Homo sapiens
uaacuccauuuggacucaguau

SEQ ID NO: 315743 - RNA, 22 nt, Homo sapiens
uaagaauucuguccgguauacu

SEQ ID NO: 315744 - RNA, 22 nt, Homo sapiens
uaagcuauagugaauaaauugc

SEQ ID NO: 315745 - RNA, 22 nt, Homo sapiens
uaaggcuaggaauucucugaag

SEQ ID NO: 315746 - RNA, 22 nt, Homo sapiens
uaagggcaugcugcaugagagu

SEQ ID NO: 315747 - RNA, 22 nt, Homo sapiens
uaaguauuuuaauuccuggcau

SEQ ID NO: 315748 - RNA, 23 nt, Homo sapiens
uaaguucaucucuaauaggugga

SEQ ID NO: 315749 - RNA, 22 nt, Homo sapiens
uaaucucagcugagcugagauu

SEQ ID NO: 315750 - RNA, 22 nt, Homo sapiens
uaaugcuugguuguuuggaaaa

SEQ ID NO: 315751 - RNA, 22 nt, Homo sapiens
uacaggaaugucagguugcugu

SEQ ID NO: 315752 - RNA, 19 nt, Homo sapiens
uacaggacugagcugaggu

SEQ ID NO: 315753 - RNA, 22 nt, Homo sapiens
uacagugcauagaggcaugaua

SEQ ID NO: 315754 - RNA, 22 nt, Homo sapiens
uacagugcuugguaucuaguaa

SEQ ID NO: 315755 - RNA, 22 nt, Homo sapiens
uacaugugccauguugguuugc

SEQ ID NO: 315756 - RNA, 21 nt, Homo sapiens
uaccuacugcaugccaggcac

SEQ ID NO: 315757 - RNA, 22 nt, Homo sapiens
uacuuuguuauagcagcaggaa

SEQ ID NO: 315758 - RNA, 22 nt, Homo sapiens
uagaaguaggcuacgugucugg

SEQ ID NO: 315759 - RNA, 22 nt, Homo sapiens
uagaaugucagcuucuugaggg

SEQ ID NO: 315760 - RNA, 22 nt, Homo sapiens
uagagcaugugccauacguaca

SEQ ID NO: 315761 - RNA, 22 nt, Homo sapiens
uagagcuugacacuuuccaugg

SEQ ID NO: 315762 - RNA, 22 nt, Homo sapiens
uagagguauguauaguauucuu

SEQ ID NO: 315763 - RNA, 22 nt, Homo sapiens
uagaguguaaaccacauaguga

SEQ ID NO: 315764 - RNA, 22 nt, Homo sapiens
uagaucauauucagugcuuacu

SEQ ID NO: 315765 - RNA, 22 nt, Homo sapiens
aauaaagcuuugagcuuugcug

SEQ ID NO: 315766 - RNA, 21 nt, Homo sapiens
aauacucuagguuaagagagc

SEQ ID NO: 315767 - RNA, 22 nt, Homo sapiens
aauacugaaaguauuuucaaau

SEQ ID NO: 315768 - RNA, 22 nt, Homo sapiens
aauacugagaugugagguacua

SEQ ID NO: 315769 - RNA, 22 nt, Homo sapiens
aaugcacauaaaauccuccagg

SEQ ID NO: 315770 - RNA, 22 nt, Homo sapiens
aaugcuaucuggaacauuguug

SEQ ID NO: 315771 - RNA, 22 nt, Homo sapiens
aauggcauuugccagggcaaag

SEQ ID NO: 315772 - RNA, 22 nt, Homo sapiens
aauggcucuuuaggcaauagau

SEQ ID NO: 315773 - RNA, 22 nt, Homo sapiens
aauugcaauggacaaugcagca

SEQ ID NO: 315774 - RNA, 22 nt, Homo sapiens
aauugccucaagugaucauggc

SEQ ID NO: 315775 - RNA, 22 nt, Homo sapiens
aucagcagcaugaaaacggacu

SEQ ID NO: 315776 - RNA, 22 nt, Homo sapiens
aucaggaaccuuuuuggugugu

SEQ ID NO: 315777 - RNA, 22 nt, Homo sapiens
aucaucacaguuguguguaaug

SEQ ID NO: 315778 - RNA, 22 nt, Homo sapiens
aucaugucuucccagugauucu

SEQ ID NO: 315779 - RNA, 22 nt, Homo sapiens
aucccagaaacucggguuucuc

SEQ ID NO: 315780 - RNA, 22 nt, Homo sapiens
auccuuuagacuguccaguuga

SEQ ID NO: 315781 - RNA, 22 nt, Homo sapiens
cugaucuguuauacuuuucuau

SEQ ID NO: 315782 - RNA, 20 nt, Homo sapiens
cugcuccccuacaaaucuca

SEQ ID NO: 315783 - RNA, 22 nt, Homo sapiens
cuggcagugcuuguuauccugg

SEQ ID NO: 315784 - RNA, 22 nt, Homo sapiens
cugggcaaugcggcuggauaga

SEQ ID NO: 315785 - RNA, 22 nt, Homo sapiens
uagauuaucauucauacaggga

SEQ ID NO: 315786 - RNA, 22 nt, Homo sapiens
uagcaaaucaauggaauugaag

SEQ ID NO: 315787 - RNA, 22 nt, Homo sapiens
uagcagcauaaauggacuaaga

SEQ ID NO: 315788 - RNA, 22 nt, Homo sapiens
uagcagcaucucuggcuucuac

SEQ ID NO: 315789 - RNA, 22 nt, Homo sapiens
uagcugagacuacaguaggugc

SEQ ID NO: 315790 - RNA, 22 nt, Homo sapiens
uaggacacucucuccaccagua

SEQ ID NO: 315791 - RNA, 22 nt, Homo sapiens
uaggacauugcccuuguggaga

SEQ ID NO: 315792 - RNA, 22 nt, Homo sapiens
uagugcugugauaaacauauau

SEQ ID NO: 315793 - RNA, 22 nt, Homo sapiens
uagugcugugauauuuuuggcc

SEQ ID NO: 315794 - RNA, 22 nt, Homo sapiens
uagugcugugauuaacauaaug

SEQ ID NO: 315795 - RNA, 19 nt, Homo sapiens
uaucaaguaugcacuguac

SEQ ID NO: 315796 - RNA, 22 nt, Homo sapiens
uaucacacuggaagaaguuaag

SEQ ID NO: 315797 - RNA, 23 nt, Homo sapiens
uaucacacuuucucugugccaca

SEQ ID NO: 315798 - RNA, 22 nt, Homo sapiens
uaucacaguaucuagcacagug

SEQ ID NO: 315799 - RNA, 22 nt, Homo sapiens
uaucagagcugucagccuaccu

SEQ ID NO: 315800 - RNA, 22 nt, Homo sapiens
uaucuacauguagguauguaug

SEQ ID NO: 315801 - RNA, 20 nt, Homo sapiens
uaugacaaagccuagugagu

SEQ ID NO: 315802 - RNA, 22 nt, Homo sapiens
uaugagcaaaaugaggguuagu

SEQ ID NO: 315803 - RNA, 22 nt, Homo sapiens
uaugcacacacguguuuaugug

SEQ ID NO: 315804 - RNA, 22 nt, Homo sapiens
uaugccuuugaccauuuuguga

SEQ ID NO: 315805 - RNA, 22 nt, Homo sapiens
uauugauuaauugugauuaggc

SEQ ID NO: 315806 - RNA, 22 nt, Homo sapiens
uauugcucugacugauuggaug

SEQ ID NO: 315807 - RNA, 22 nt, Homo sapiens
uauuguacauguuauagauuuu

SEQ ID NO: 315808 - RNA, 22 nt, Homo sapiens
uauuugauugacuuuagcagga

SEQ ID NO: 315809 - RNA, 18 nt, Homo sapiens
ucaaauacuuugggcagu

SEQ ID NO: 315810 - RNA, 22 nt, Homo sapiens
ucaaauguucccuguacuggcc

SEQ ID NO: 315811 - RNA, 22 nt, Homo sapiens
ucaaggacuacauggggugaaa

SEQ ID NO: 315812 - RNA, 22 nt, Homo sapiens
ucacaaagcuuggccugcuucu

SEQ ID NO: 315813 - RNA, 22 nt, Homo sapiens
ucacaauucucaauuugugaaa

SEQ ID NO: 315814 - RNA, 22 nt, Homo sapiens
ucacacuguuuugauuauuaua

SEQ ID NO: 315815 - RNA, 22 nt, Homo sapiens
ucacagaggagaagaccuuuaa

SEQ ID NO: 315816 - RNA, 22 nt, Homo sapiens
ucacagucugcgugaugagaca

SEQ ID NO: 315817 - RNA, 22 nt, Homo sapiens
ucacauagcauaaugucugcaa

SEQ ID NO: 315818 - RNA, 22 nt, Homo sapiens
ucacauagcugaguaaaaugga

SEQ ID NO: 315819 - RNA, 22 nt, Homo sapiens
ucacaucucagguuucuugaca

SEQ ID NO: 315820 - RNA, 22 nt, Homo sapiens
ucacaugugacauauauauuug

SEQ ID NO: 315821 - RNA, 22 nt, Homo sapiens
ucacauuguauauguaccuauc

SEQ ID NO: 315822 - RNA, 18 nt, Homo sapiens
ucaccuugugagagagag

SEQ ID NO: 315823 - RNA, 21 nt, Homo sapiens
ucagaagcucccagggaggac

SEQ ID NO: 315824 - RNA, 22 nt, Homo sapiens
ucagaguagcugucugaggugc

SEQ ID NO: 315825 - RNA, 22 nt, Homo sapiens
ucagaguaguuccuggcagaaa

SEQ ID NO: 315826 - RNA, 22 nt, Homo sapiens
ucagcaaugcugcacucuacug

SEQ ID NO: 315827 - RNA, 22 nt, Homo sapiens
ucaggcacuaguaagaaaaagg

SEQ ID NO: 315828 - RNA, 22 nt, Homo sapiens
ucaggcacucagcuuagagucu

SEQ ID NO: 315829 - RNA, 22 nt, Homo sapiens
ucagguccuuacugugcucccu

SEQ ID NO: 315830 - RNA, 22 nt, Homo sapiens
ucagguugcuaaguauaauauu

SEQ ID NO: 315831 - RNA, 22 nt, Homo sapiens
ucagugacuggguauuaaauca

SEQ ID NO: 315832 - RNA, 22 nt, Homo sapiens
ucagugcaggaaucucuagcca

SEQ ID NO: 315833 - RNA, 22 nt, Homo sapiens
ucaugaaguaguuaacugguug

SEQ ID NO: 315834 - RNA, 19 nt, Homo sapiens
ucaugugcauacauuuggg

SEQ ID NO: 315835 - RNA, 22 nt, Homo sapiens
ucauuagagacagggugucacu

SEQ ID NO: 315836 - RNA, 22 nt, Homo sapiens
ucauuggcuaagcuuguuacac

SEQ ID NO: 315837 - RNA, 22 nt, Homo sapiens
uccacaauggcugaacuagauu

SEQ ID NO: 315838 - RNA, 21 nt, Homo sapiens
uccagcuuugagaguuguggu

SEQ ID NO: 315839 - RNA, 22 nt, Homo sapiens
uccagguacucagggggcugag

SEQ ID NO: 315840 - RNA, 22 nt, Homo sapiens
uccagguuuugugaguuuaaau

SEQ ID NO: 315841 - RNA, 22 nt, Homo sapiens
uccauuuguucagcuucaggaa

SEQ ID NO: 315842 - RNA, 16 nt, Homo sapiens
ucccaccauugcuugu

SEQ ID NO: 315843 - RNA, 20 nt, Homo sapiens
ucccaguaggagaaggaagg

SEQ ID NO: 315844 - RNA, 18 nt, Homo sapiens
ucccucagaauuauagaa

SEQ ID NO: 315845 - RNA, 22 nt, Homo sapiens
uccucugaacuccagacccaua

SEQ ID NO: 315846 - RNA, 22 nt, Homo sapiens
uccugcauucugacuugcuuuc

SEQ ID NO: 315847 - RNA, 22 nt, Homo sapiens
ucuauugguugaaauugcuuuu

SEQ ID NO: 315848 - RNA, 22 nt, Homo sapiens
ucucagagccuaggguuuuuca

SEQ ID NO: 315849 - RNA, 22 nt, Homo sapiens
ucucagcacagucagggcgccu

SEQ ID NO: 315850 - RNA, 21 nt, Homo sapiens
ucucucaaccaggaagugggc

SEQ ID NO: 315851 - RNA, 22 nt, Homo sapiens
ucucugaaacucuugacauccu

SEQ ID NO: 315852 - RNA, 22 nt, Homo sapiens
ucuggcacugaugugggaugcu

SEQ ID NO: 315853 - RNA, 22 nt, Homo sapiens
ucuguaguuaacagcuucagcu

SEQ ID NO: 315854 - RNA, 22 nt, Homo sapiens
ucugucuugugguuugagugcc

SEQ ID NO: 315855 - RNA, 22 nt, Homo sapiens
ucuucagucauauuggccugga

SEQ ID NO: 315856 - RNA, 17 nt, Homo sapiens
ucuucuguuacuguggc

SEQ ID NO: 315857 - RNA, 22 nt, Homo sapiens
ucuuugaguguauacuuagauu

SEQ ID NO: 315858 - RNA, 22 nt, Homo sapiens
ucuuugccuaacccaaggucau

SEQ ID NO: 315859 - RNA, 22 nt, Homo sapiens
ugaaauacuuaauuucuccaug

SEQ ID NO: 315860 - RNA, 21 nt, Homo sapiens
ugaaaugcaugugcacauuaa

SEQ ID NO: 315861 - RNA, 22 nt, Homo sapiens
ugaaaugguuaugugaggagau

SEQ ID NO: 315862 - RNA, 22 nt, Homo sapiens
ugaacagcaccuccuagaguug

SEQ ID NO: 315863 - RNA, 22 nt, Homo sapiens
ugaacagcacguuuauucagaa

SEQ ID NO: 315864 - RNA, 22 nt, Homo sapiens
ugaauagaaguggcaggaguag

SEQ ID NO: 315865 - RNA, 22 nt, Homo sapiens
ugaauagugucacaauaaacau

SEQ ID NO: 315866 - RNA, 22 nt, Homo sapiens
ugaauauuugcuacucacucuu

SEQ ID NO: 315867 - RNA, 22 nt, Homo sapiens
ugaaugcuucaugucugggcug

SEQ ID NO: 315868 - RNA, 22 nt, Homo sapiens
ugaauguuugcuuacuuccaua

SEQ ID NO: 315869 - RNA, 22 nt, Homo sapiens
ugacaagaaagcgucuucuuuu

SEQ ID NO: 315870 - RNA, 23 nt, Homo sapiens
ugacaagagcgagacuuggucuc

SEQ ID NO: 315871 - RNA, 22 nt, Homo sapiens
ugacaagauauggucuuaucaa

SEQ ID NO: 315872 - RNA, 22 nt, Homo sapiens
ugacacagcaagauggaaccau

SEQ ID NO: 315873 - RNA, 23 nt, Homo sapiens
ugacagaccuucuggaagaaguc

SEQ ID NO: 315874 - RNA, 22 nt, Homo sapiens
ugacagugaauaagucucuuaa

SEQ ID NO: 315875 - RNA, 22 nt, Homo sapiens
ugacaugagauuugggaggggc

SEQ ID NO: 315876 - RNA, 22 nt, Homo sapiens
ugacuauugauuuagacgugcu

SEQ ID NO: 315877 - RNA, 23 nt, Homo sapiens
ugacugaguauauguuuggugcu

SEQ ID NO: 315878 - RNA, 16 nt, Homo sapiens
ugagaacaugcagcau

SEQ ID NO: 315879 - RNA, 22 nt, Homo sapiens
ugagaacuuauggugauuuuuu

SEQ ID NO: 315880 - RNA, 22 nt, Homo sapiens
ugagacaaaguuguuggauguu

SEQ ID NO: 315881 - RNA, 22 nt, Homo sapiens
ugagagcuuuuuugccugguga

SEQ ID NO: 315882 - RNA, 22 nt, Homo sapiens
ugagaggugaauggcaggcuca

SEQ ID NO: 315883 - RNA, 21 nt, Homo sapiens
ugagaguaguguauuauucuc

SEQ ID NO: 315884 - RNA, 23 nt, Homo sapiens
ugagaucuacagaucucagaucu

SEQ ID NO: 315885 - RNA, 22 nt, Homo sapiens
ugagaugaguugcgcucugucg

SEQ ID NO: 315886 - RNA, 21 nt, Homo sapiens
ugagaugcaaucaccagggag

SEQ ID NO: 315887 - RNA, 22 nt, Homo sapiens
ugagaugcauauucuggcuccu

SEQ ID NO: 315888 - RNA, 22 nt, Homo sapiens
ugagaugguaaauuuuuguugu

SEQ ID NO: 315889 - RNA, 20 nt, Homo sapiens
ugagccccuggacucaagcg

SEQ ID NO: 315890 - RNA, 22 nt, Homo sapiens
ugagcugagaaaugcagcagcu

SEQ ID NO: 315891 - RNA, 22 nt, Homo sapiens
ugagcugagaucacacuacugu

SEQ ID NO: 315892 - RNA, 22 nt, Homo sapiens
ugagguaagauguucauuuuuc

SEQ ID NO: 315893 - RNA, 22 nt, Homo sapiens
ugaggugagggguuaggugcua

SEQ ID NO: 315894 - RNA, 22 nt, Homo sapiens
ugaguguccaaguaaggugaaa

SEQ ID NO: 315895 - RNA, 22 nt, Homo sapiens
ugagugugacuuagcagaagga

SEQ ID NO: 315896 - RNA, 22 nt, Homo sapiens
ugaugcugaguggcuauuugaa

SEQ ID NO: 315897 - RNA, 22 nt, Homo sapiens
ugauguguuuuguaguucaacu

SEQ ID NO: 315898 - RNA, 22 nt, Homo sapiens
uuggcagaauguuagaaacuua

SEQ ID NO: 315899 - RNA, 22 nt, Homo sapiens
uuggcagugcccgaugcugggg

SEQ ID NO: 315900 - RNA, 22 nt, Homo sapiens
uuggcauagaggcucucaagcu

SEQ ID NO: 315901 - RNA, 22 nt, Homo sapiens
uuggcauuuuggacacccagga

SEQ ID NO: 315902 - RNA, 22 nt, Homo sapiens
uuggccauaugacuugcuuugg

SEQ ID NO: 315903 - RNA, 22 nt, Homo sapiens
uugggagugucucuggacugca

SEQ ID NO: 315904 - RNA, 21 nt, Homo sapiens
uuggggaauggagagguuuuc

SEQ ID NO: 315905 - RNA, 22 nt, Homo sapiens
uuggucaucucccuccuuuuag

SEQ ID NO: 315906 - RNA, 23 nt, Homo sapiens
uuguacacuaagaaucgcagaug

SEQ ID NO: 315907 - RNA, 20 nt, Homo sapiens
agaagcauugcucucuucag

SEQ ID NO: 315908 - RNA, 22 nt, Homo sapiens
agaauguaaacagaauagagga

SEQ ID NO: 315909 - RNA, 22 nt, Homo sapiens
agaauucugucauguuuauauu

SEQ ID NO: 315910 - RNA, 21 nt, Homo sapiens
agacacuuggaagguuuuaga

SEQ ID NO: 315911 - RNA, 20 nt, Homo sapiens
agacaguguggagauuccuu

SEQ ID NO: 315912 - RNA, 22 nt, Homo sapiens
agagaacugauucagggaaaau

SEQ ID NO: 315913 - RNA, 22 nt, Homo sapiens
agagacauugcuccaacucacc

SEQ ID NO: 315914 - RNA, 22 nt, Homo sapiens
agagcaauguuaucagucucug

SEQ ID NO: 315915 - RNA, 22 nt, Homo sapiens
agaguaguaggaugaauggacu

SEQ ID NO: 315916 - RNA, 22 nt, Homo sapiens
agaugauguuuacugagcauca

SEQ ID NO: 315917 - RNA, 23 nt, Homo sapiens
agcaccuuuccuccacuaucugc

SEQ ID NO: 315918 - RNA, 22 nt, Homo sapiens
agcaggucuuaacuugugaggu

SEQ ID NO: 315919 - RNA, 22 nt, Homo sapiens
agcuaugucugaugccugauua

SEQ ID NO: 315920 - RNA, 22 nt, Homo sapiens
agcugcaaagggagagaugauu

SEQ ID NO: 315921 - RNA, 22 nt, Homo sapiens
agcuggaauuuaagguagauag

SEQ ID NO: 315922 - RNA, 22 nt, Homo sapiens
agcugguuuaauaugcugucug

SEQ ID NO: 315923 - RNA, 22 nt, Homo sapiens
agcuguuguacacuuuaccuuu

SEQ ID NO: 315924 - RNA, 22 nt, Homo sapiens
agcuguuguuuuaagauacuaa

SEQ ID NO: 315925 - RNA, 22 nt, Homo sapiens
agcuugugcuguaugaagggcc

SEQ ID NO: 315926 - RNA, 22 nt, Homo sapiens
agcuuguguuugucugccuggg

SEQ ID NO: 315927 - RNA, 21 nt, Homo sapiens
aggagcauucaugacgagguu

SEQ ID NO: 315928 - RNA, 22 nt, Homo sapiens
aggagguaggaauugugcuagg

SEQ ID NO: 315929 - RNA, 22 nt, Homo sapiens
aggcaacaugguaaaacccugu

SEQ ID NO: 315930 - RNA, 22 nt, Homo sapiens
aggcaagugauagcugcguaau

SEQ ID NO: 315931 - RNA, 22 nt, Homo sapiens
aggcaaugugagaguuuauuca

SEQ ID NO: 315932 - RNA, 22 nt, Homo sapiens
aggcacggugucucaugccugu

SEQ ID NO: 315933 - RNA, 22 nt, Homo sapiens
aggcuaagaugacuccaccccc

SEQ ID NO: 315934 - RNA, 22 nt, Homo sapiens
aggcuguguggauaauauuggg

SEQ ID NO: 315935 - RNA, 23 nt, Homo sapiens
agggcacuauagauguuauucua

SEQ ID NO: 315936 - RNA, 22 nt, Homo sapiens
agucaaaugcuuauguauaaag

SEQ ID NO: 315937 - RNA, 22 nt, Homo sapiens
agucacaugcauuuucuucaau

SEQ ID NO: 315938 - RNA, 17 nt, Homo sapiens
agugagaucauggcuua

SEQ ID NO: 315939 - RNA, 22 nt, Homo sapiens
agugcagugguuaggagccagg

SEQ ID NO: 315940 - RNA, 22 nt, Homo sapiens
agugccacugcacucuagccug

SEQ ID NO: 315941 - RNA, 22 nt, Homo sapiens
aguggcacuauucucagaguca

SEQ ID NO: 315942 - RNA, 19 nt, Homo sapiens
agugucauggucauuauuu

SEQ ID NO: 315943 - RNA, 22 nt, Homo sapiens
aguguuuuucaugggauacuuu

SEQ ID NO: 315944 - RNA, 22 nt, Homo sapiens
aguuccuacuggcuguaaagaa

SEQ ID NO: 315945 - RNA, 22 nt, Homo sapiens
aguuggcacugagcugugauug

SEQ ID NO: 315946 - RNA, 22 nt, Homo sapiens
auaaaagcaggucuaggucagg

SEQ ID NO: 315947 - RNA, 22 nt, Homo sapiens
auacacguguauauguguaucu

SEQ ID NO: 315948 - RNA, 22 nt, Homo sapiens
auacacuagggcuccugcagaa

SEQ ID NO: 315949 - RNA, 22 nt, Homo sapiens
auacaugugcaggucagguuac

SEQ ID NO: 315950 - RNA, 22 nt, Homo sapiens
auacaugugccaugcuggugug

SEQ ID NO: 315951 - RNA, 22 nt, Homo sapiens
auacaugugccauguugguuug

SEQ ID NO: 315952 - RNA, 22 nt, Homo sapiens
auacaugugugagcgaagaugu

SEQ ID NO: 315953 - RNA, 22 nt, Homo sapiens
auacauguucaagggcauauau

SEQ ID NO: 315954 - RNA, 22 nt, Homo sapiens
auagcacaguguguguacacca

SEQ ID NO: 315955 - RNA, 22 nt, Homo sapiens
auagcagcucacuuauuuaugg

SEQ ID NO: 315956 - RNA, 22 nt, Homo sapiens
auaucacaaacaagucuguacu

SEQ ID NO: 315957 - RNA, 22 nt, Homo sapiens
auaucacagguguuuaccugau

SEQ ID NO: 315958 - RNA, 22 nt, Homo sapiens
auaugacuuuccucuacuuccu

SEQ ID NO: 315959 - RNA, 22 nt, Homo sapiens
aucaaacugcaaggcagcagca

SEQ ID NO: 315960 - RNA, 22 nt, Homo sapiens
aucaagcugcuuguuugaaucu

SEQ ID NO: 315961 - RNA, 22 nt, Homo sapiens
aucacagugagcauaugucuau

SEQ ID NO: 315962 - RNA, 22 nt, Homo sapiens
aucacaguuuuaccauuuggua

SEQ ID NO: 315963 - RNA, 22 nt, Homo sapiens
aucagcagcaugaaaacaggcu

SEQ ID NO: 315964 - RNA, 22 nt, Homo sapiens
aucagucacugcguuuuuggga

SEQ ID NO: 315965 - RNA, 22 nt, Homo sapiens
aucauacuguuuugauuacugu

SEQ ID NO: 315966 - RNA, 22 nt, Homo sapiens
auccacagugucaauguuguga

SEQ ID NO: 315967 - RNA, 22 nt, Homo sapiens
auccccugcacggggugucauu

SEQ ID NO: 315968 - RNA, 22 nt, Homo sapiens
aucuacagccagucugguuugu

SEQ ID NO: 315969 - RNA, 22 nt, Homo sapiens
augaaaagcauaaacgcugaag

SEQ ID NO: 315970 - RNA, 22 nt, Homo sapiens
augaaacuggcuaauuuuugua

SEQ ID NO: 315971 - RNA, 22 nt, Homo sapiens
augaaaucacugugaugcccua

SEQ ID NO: 315972 - RNA, 22 nt, Homo sapiens
augaaaugcauguuaaguccgu

SEQ ID NO: 315973 - RNA, 18 nt, Homo sapiens
uccaguuuucccagcauc

SEQ ID NO: 315974 - RNA, 22 nt, Homo sapiens
uccaguuuucuuuccuagggcu

SEQ ID NO: 315975 - RNA, 22 nt, Homo sapiens
ucccacugucuucucgugcucg

SEQ ID NO: 315976 - RNA, 22 nt, Homo sapiens
uccccugagucaccugcuucuc

SEQ ID NO: 315977 - RNA, 22 nt, Homo sapiens
uccuacaugcaguacauucaaa

SEQ ID NO: 315978 - RNA, 22 nt, Homo sapiens
ucuacagccaguucaggaagaa

SEQ ID NO: 315979 - RNA, 23 nt, Homo sapiens
ucucauuccuugaaaauaaugac

SEQ ID NO: 315980 - RNA, 22 nt, Homo sapiens
ucuccaguuuccuucgucuauc

SEQ ID NO: 315981 - RNA, 22 nt, Homo sapiens
ucuccauuuguaaggguuucuc

SEQ ID NO: 315982 - RNA, 22 nt, Homo sapiens
ucuggcuuuuaacaucuauaaa

SEQ ID NO: 315983 - RNA, 22 nt, Homo sapiens
ucugggguuagucaaagguaug

SEQ ID NO: 315984 - RNA, 22 nt, Homo sapiens
ucugggguuuccacuuuuacuu

SEQ ID NO: 315985 - RNA, 22 nt, Homo sapiens
ucuguuguuaucauaauauuga

SEQ ID NO: 315986 - RNA, 22 nt, Homo sapiens
ucuucaugcuugaaauaauagc

SEQ ID NO: 315987 - RNA, 22 nt, Homo sapiens
ucuuuaguaauuucuguaaggc

SEQ ID NO: 315988 - RNA, 22 nt, Homo sapiens
ucuuuagugacaguugugcaag

SEQ ID NO: 315989 - RNA, 22 nt, Homo sapiens
ucuuugucuacauccuguuaaa

SEQ ID NO: 315990 - RNA, 22 nt, Homo sapiens
ucuuuguugcauaggcuuguuc

SEQ ID NO: 315991 - RNA, 22 nt, Homo sapiens
ugaaaugaucaguuugguuacu

SEQ ID NO: 315992 - RNA, 22 nt, Homo sapiens
ugaauacuucguucaaagauaa

SEQ ID NO: 315993 - RNA, 22 nt, Homo sapiens
ugaaugguuuuuagagaacaau

SEQ ID NO: 315994 - RNA, 22 nt, Homo sapiens
ugaauucuguccaaaauaacug

SEQ ID NO: 315995 - RNA, 22 nt, Homo sapiens
ugacacagugggggauccuuuu

SEQ ID NO: 315996 - RNA, 22 nt, Homo sapiens
ugacagagaagcauugaguuca

SEQ ID NO: 315997 - RNA, 23 nt, Homo sapiens
ugacagugcuugaaauugcucuu

SEQ ID NO: 315998 - RNA, 22 nt, Homo sapiens
ugacaugauuguauauuuagaa

SEQ ID NO: 315999 - RNA, 22 nt, Homo sapiens
ugacuagagacagaaacuaaaa

SEQ ID NO: 316000 - RNA, 22 nt, Homo sapiens
ugacuuuagaauuuuauccaga

SEQ ID NO: 316001 - RNA, 22 nt, Homo sapiens
ugagaacugccuguauuuaucu

SEQ ID NO: 316002 - RNA, 22 nt, Homo sapiens
ugagaguagggguugggauugg

SEQ ID NO: 316003 - RNA, 22 nt, Homo sapiens
ugagaguauaaauugaugcagc

SEQ ID NO: 316004 - RNA, 22 nt, Homo sapiens
ugagaucugucuuuauaguauu

SEQ ID NO: 316005 - RNA, 22 nt, Homo sapiens
ugagaucuucgcucuucacaga

SEQ ID NO: 316006 - RNA, 19 nt, Homo sapiens
ugagaucuuuacuggguuu

SEQ ID NO: 316007 - RNA, 22 nt, Homo sapiens
ugagaugagucucgcucuguca

SEQ ID NO: 316008 - RNA, 22 nt, Homo sapiens
ugagaugaguucucgcucuguc

SEQ ID NO: 316009 - RNA, 22 nt, Homo sapiens
ugagauggaguuucacuuuugu

SEQ ID NO: 316010 - RNA, 21 nt, Homo sapiens
ugagauuaaguuguuuagaag

SEQ ID NO: 316011 - RNA, 22 nt, Homo sapiens
ugagcagagaagugcccugcgc

SEQ ID NO: 316012 - RNA, 20 nt, Homo sapiens
ugagcuuguaaacacuguuu

SEQ ID NO: 316013 - RNA, 22 nt, Homo sapiens
ugagguaacaaacuaugaguua

SEQ ID NO: 316014 - RNA, 22 nt, Homo sapiens
ugagguaacagaagcgagcauu

SEQ ID NO: 316015 - RNA, 22 nt, Homo sapiens
ugagguaauagauaauauuuuu

SEQ ID NO: 316016 - RNA, 22 nt, Homo sapiens
ugagugaggcugggcagucccu

SEQ ID NO: 316017 - RNA, 22 nt, Homo sapiens
ugagugugaggaagaauuagaa

SEQ ID NO: 316018 - RNA, 22 nt, Homo sapiens
ugaguuagguguuuuaaauaua

SEQ ID NO: 316019 - RNA, 17 nt, Homo sapiens
ugauauuuucccagaua

SEQ ID NO: 316020 - RNA, 22 nt, Homo sapiens
ugaugugucaucugagagagug

SEQ ID NO: 316021 - RNA, 19 nt, Homo sapiens
ugcaaagucagugaagggu

SEQ ID NO: 316022 - RNA, 22 nt, Homo sapiens
ugcaaagucgaaacugcaguuu

SEQ ID NO: 316023 - RNA, 19 nt, Homo sapiens
ugcaaagucuuuuccuauu

SEQ ID NO: 316024 - RNA, 22 nt, Homo sapiens
ugcaagaggagacuguacucag

SEQ ID NO: 316025 - RNA, 22 nt, Homo sapiens
ugcaaguaauuccagcuacuga

SEQ ID NO: 316026 - RNA, 22 nt, Homo sapiens
ugcagagucuguccugccugcc

SEQ ID NO: 316027 - RNA, 22 nt, Homo sapiens
ugcagugcaugacuguguuaug

SEQ ID NO: 316028 - RNA, 22 nt, Homo sapiens
ugcagugugaaagagccugaca

SEQ ID NO: 316029 - RNA, 21 nt, Homo sapiens
ugcauacuucucagaugauua

SEQ ID NO: 316030 - RNA, 22 nt, Homo sapiens
ugcauaucuucuuuugagaaau

SEQ ID NO: 316031 - RNA, 22 nt, Homo sapiens
ugcauauucgaguuauuuuggg

SEQ ID NO: 316032 - RNA, 22 nt, Homo sapiens
ugccaugaagagaggaagcagu

SEQ ID NO: 316033 - RNA, 22 nt, Homo sapiens
ugcuauguuuucccuccuuauc

SEQ ID NO: 316034 - RNA, 22 nt, Homo sapiens
ugcugcauuggggauuaaguuu

SEQ ID NO: 316035 - RNA, 22 nt, Homo sapiens
ugcugcuguuguuguuacuagc

SEQ ID NO: 316036 - RNA, 22 nt, Homo sapiens
ugcuuuguugaaaaucauuugg

SEQ ID NO: 316037 - RNA, 22 nt, Homo sapiens
uggaaaauuaggggagguuaua

SEQ ID NO: 316038 - RNA, 22 nt, Homo sapiens
uggaaaguacugagguccaccu

SEQ ID NO: 316039 - RNA, 22 nt, Homo sapiens
uggaagacauuuuggaccuugg

SEQ ID NO: 316040 - RNA, 22 nt, Homo sapiens
uggaagcauagcagcgugugug

SEQ ID NO: 316041 - RNA, 23 nt, Homo sapiens
uggaaguauggaggaggcagaau

SEQ ID NO: 316042 - RNA, 22 nt, Homo sapiens
uggaagucuauggcauuugagu

SEQ ID NO: 316043 - RNA, 21 nt, Homo sapiens
uggaaugaauggccaacaugg

SEQ ID NO: 316044 - RNA, 22 nt, Homo sapiens
uggaauuaauuaaaauauacug

SEQ ID NO: 316045 - RNA, 22 nt, Homo sapiens
uggagacaaagauagaaaagca

SEQ ID NO: 316046 - RNA, 22 nt, Homo sapiens
uggaguaggccuaagaaugaca

SEQ ID NO: 316047 - RNA, 22 nt, Homo sapiens
uggcaaaaaaacgcaauuacgu

SEQ ID NO: 316048 - RNA, 22 nt, Homo sapiens
uggcaagagauaugugucuaua

SEQ ID NO: 316049 - RNA, 22 nt, Homo sapiens
uggcaauauccacaauuacuuu

SEQ ID NO: 316050 - RNA, 22 nt, Homo sapiens
uggcaccauccaggugucucua

SEQ ID NO: 316051 - RNA, 22 nt, Homo sapiens
uggcagaugcucuuggugccca

SEQ ID NO: 316052 - RNA, 22 nt, Homo sapiens
uggcauauaauauagaagacua

SEQ ID NO: 316053 - RNA, 17 nt, Homo sapiens
uggcaugaggguguggg

SEQ ID NO: 316054 - RNA, 22 nt, Homo sapiens
uggcauuuugugugaauuagaa

SEQ ID NO: 316055 - RNA, 23 nt, Homo sapiens
uggcauuuuuggcaaugccuucu

SEQ ID NO: 316056 - RNA, 22 nt, Homo sapiens
uggcuuuuauuauguugaggua

SEQ ID NO: 316057 - RNA, 22 nt, Homo sapiens
uggcuuuuguuauuuggaagcu

SEQ ID NO: 316058 - RNA, 22 nt, Homo sapiens
ugggaacaugaagguuaaagag

SEQ ID NO: 316059 - RNA, 21 nt, Homo sapiens
ugggccccuuccuuacaucau

SEQ ID NO: 316060 - RNA, 22 nt, Homo sapiens
ugggcuagaugcuuugggguca

SEQ ID NO: 316061 - RNA, 18 nt, Homo sapiens
ugcaccaguuuacacuuc

SEQ ID NO: 316062 - RNA, 21 nt, Homo sapiens
ugcauuguugcugagagcagg

SEQ ID NO: 316063 - RNA, 23 nt, Homo sapiens
ugcuauguaagcauuuauuaaau

SEQ ID NO: 316064 - RNA, 16 nt, Homo sapiens
ugcuauguuggccagg

SEQ ID NO: 316065 - RNA, 22 nt, Homo sapiens
ugcugcaaucucggcacuuugg

SEQ ID NO: 316066 - RNA, 22 nt, Homo sapiens
ugcuguuguuugaugaaguaau

SEQ ID NO: 316067 - RNA, 22 nt, Homo sapiens
ugcuucauuggccaccaggaag

SEQ ID NO: 316068 - RNA, 22 nt, Homo sapiens
uggaaaguacuugaguuuguau

SEQ ID NO: 316069 - RNA, 22 nt, Homo sapiens
uggaaguuaaauuaguugauga

SEQ ID NO: 316070 - RNA, 19 nt, Homo sapiens
uggaaugaaauguuagggg

SEQ ID NO: 316071 - RNA, 22 nt, Homo sapiens
uggcaauaaaaugcaguuacuu

SEQ ID NO: 316072 - RNA, 22 nt, Homo sapiens
uggcauguguuugaaugaguau

SEQ ID NO: 316073 - RNA, 23 nt, Homo sapiens
uggcauuuuaguuagcuucagug

SEQ ID NO: 316074 - RNA, 22 nt, Homo sapiens
uggcauuuuguuuuagaauuag

SEQ ID NO: 316075 - RNA, 21 nt, Homo sapiens
uggcuuauuugaaucuggcuu

SEQ ID NO: 316076 - RNA, 22 nt, Homo sapiens
uggcuuucuggggcuucuguuc

SEQ ID NO: 316077 - RNA, 22 nt, Homo sapiens
ugggaagauucuguguuuuucc

SEQ ID NO: 316078 - RNA, 22 nt, Homo sapiens
ugggagugugcacaauuucagc

SEQ ID NO: 316079 - RNA, 22 nt, Homo sapiens
ugggcaagugacuuggcuucuc

SEQ ID NO: 316080 - RNA, 22 nt, Homo sapiens
ugguccuuuccauuggagacac

SEQ ID NO: 316081 - RNA, 23 nt, Homo sapiens
uguaaagcuaugaauuauucuuu

SEQ ID NO: 316082 - RNA, 22 nt, Homo sapiens
uguacuagaaauuaaggcaggg

SEQ ID NO: 316083 - RNA, 22 nt, Homo sapiens
uguauacugucuaauauguugu

SEQ ID NO: 316084 - RNA, 22 nt, Homo sapiens
uguaugucugcucuuuggaacu

SEQ ID NO: 316085 - RNA, 22 nt, Homo sapiens
uguauguugauguuauauucug

SEQ ID NO: 316086 - RNA, 22 nt, Homo sapiens
ugucaggaugcuccuuuuggcu

SEQ ID NO: 316087 - RNA, 22 nt, Homo sapiens
ugucaguuucccuccucuuccu

SEQ ID NO: 316088 - RNA, 22 nt, Homo sapiens
ugucauggauucugagucuggg

SEQ ID NO: 316089 - RNA, 22 nt, Homo sapiens
ugucauggggaaaauaacagac

SEQ ID NO: 316090 - RNA, 22 nt, Homo sapiens
ugucauggucacaggcauuuca

SEQ ID NO: 316091 - RNA, 16 nt, Homo sapiens
uguccaaauaaauaca

SEQ ID NO: 316092 - RNA, 22 nt, Homo sapiens
uguccauuuuuaugcuuauggu

SEQ ID NO: 316093 - RNA, 22 nt, Homo sapiens
ugucuuggagaauccuggguuu

SEQ ID NO: 316094 - RNA, 19 nt, Homo sapiens
ugugaagaaaugcugcaag

SEQ ID NO: 316095 - RNA, 22 nt, Homo sapiens
ugugaugugaugagaaguuccu

SEQ ID NO: 316096 - RNA, 22 nt, Homo sapiens
ugugcacaacaugcagguuugu

SEQ ID NO: 316097 - RNA, 22 nt, Homo sapiens
ugugcacaaccugcagguuugu

SEQ ID NO: 316098 - RNA, 22 nt, Homo sapiens
ugugcacauugugcagguugau

SEQ ID NO: 316099 - RNA, 22 nt, Homo sapiens
ugugccacugcacuccugccug

SEQ ID NO: 316100 - RNA, 22 nt, Homo sapiens
uguggcauugaauaaccuugga

SEQ ID NO: 316101 - RNA, 22 nt, Homo sapiens
uguggcauuuucagaaaggaug

SEQ ID NO: 316102 - RNA, 22 nt, Homo sapiens
uguguaaauacaagugcuugaa

SEQ ID NO: 316103 - RNA, 22 nt, Homo sapiens
uguguuugauaaguccauaguu

SEQ ID NO: 316104 - RNA, 22 nt, Homo sapiens
uguuacagugacuaauguuuua

SEQ ID NO: 316105 - RNA, 22 nt, Homo sapiens
uuaaagcuggcguuacaguuug

SEQ ID NO: 316106 - RNA, 22 nt, Homo sapiens
uuaaugaacuuuauuuuguaga

SEQ ID NO: 316107 - RNA, 22 nt, Homo sapiens
uuaaugcuuuugggauauuucu

SEQ ID NO: 316108 - RNA, 22 nt, Homo sapiens
uuacagcugggugugucuggua

SEQ ID NO: 316109 - RNA, 22 nt, Homo sapiens
uuacagucucaagagugcugca

SEQ ID NO: 316110 - RNA, 22 nt, Homo sapiens
uuacaugucuugguaagguuag

SEQ ID NO: 316111 - RNA, 22 nt, Homo sapiens
uuacauguuguggguuguggcc

SEQ ID NO: 316112 - RNA, 22 nt, Homo sapiens
uuagcagugugagcacagacua

SEQ ID NO: 316113 - RNA, 21 nt, Homo sapiens
uuagugcucaguuugacaaaa

SEQ ID NO: 316114 - RNA, 22 nt, Homo sapiens
uuaugucacuguucagucuccc

SEQ ID NO: 316115 - RNA, 22 nt, Homo sapiens
uuauuauguuggugcaaaggua

SEQ ID NO: 316116 - RNA, 23 nt, Homo sapiens
uucaaauguucucugguugucag

SEQ ID NO: 316117 - RNA, 22 nt, Homo sapiens
uucacacugggccuacucugug

SEQ ID NO: 316118 - RNA, 22 nt, Homo sapiens
uucacccugguuguagauggac

SEQ ID NO: 316119 - RNA, 22 nt, Homo sapiens
uucagggcauuggaguuucuga

SEQ ID NO: 316120 - RNA, 22 nt, Homo sapiens
uucaguacuucaaaaucuuuaa

SEQ ID NO: 316121 - RNA, 22 nt, Homo sapiens
uuccacuuuuuccuugugcucc

SEQ ID NO: 316122 - RNA, 22 nt, Homo sapiens
uuccauuuguucggugucgcca

SEQ ID NO: 316123 - RNA, 22 nt, Homo sapiens
uucuauguuugaaaaugccaaa

SEQ ID NO: 316124 - RNA, 22 nt, Homo sapiens
uucucaauggaugugggaccag

SEQ ID NO: 316125 - RNA, 22 nt, Homo sapiens
uucucagcccccugacagucag

SEQ ID NO: 316126 - RNA, 22 nt, Homo sapiens
uucucaguuccuacuuugguga

SEQ ID NO: 316127 - RNA, 17 nt, Homo sapiens
uucucaguucugaucuc

SEQ ID NO: 316128 - RNA, 22 nt, Homo sapiens
uucucauggugauggcaaaauc

SEQ ID NO: 316129 - RNA, 22 nt, Homo sapiens
uucuggcucaggucaacacuuc

SEQ ID NO: 316130 - RNA, 22 nt, Homo sapiens
uucuugcacuuaacugacauuc

SEQ ID NO: 316131 - RNA, 22 nt, Homo sapiens
uucuugcuguauccucacaugg

SEQ ID NO: 316132 - RNA, 22 nt, Homo sapiens
uugaaagacagaggggcaaguu

SEQ ID NO: 316133 - RNA, 22 nt, Homo sapiens
uugaaaucuuccacagcccaag

SEQ ID NO: 316134 - RNA, 22 nt, Homo sapiens
uugacuuuuauucacucugcua

SEQ ID NO: 316135 - RNA, 22 nt, Homo sapiens
uugagaguggaggcuauaucuu

SEQ ID NO: 316136 - RNA, 22 nt, Homo sapiens
uugagauuuuccucaaauauuu

SEQ ID NO: 316137 - RNA, 22 nt, Homo sapiens
uuguaguguuuauucugucaac

SEQ ID NO: 316138 - RNA, 22 nt, Homo sapiens
uuguauguuguuugucagagaa

SEQ ID NO: 316139 - RNA, 22 nt, Homo sapiens
uuguauguuuguucuuucagau

SEQ ID NO: 316140 - RNA, 22 nt, Homo sapiens
uugucaacaugaaacuguguuu

SEQ ID NO: 316141 - RNA, 16 nt, Homo sapiens
uugucccuucccaaau

SEQ ID NO: 316142 - RNA, 22 nt, Homo sapiens
uugugaagaaaccagaaaaguu

SEQ ID NO: 316143 - RNA, 22 nt, Homo sapiens
uugugacacagcugggccuaua

SEQ ID NO: 316144 - RNA, 22 nt, Homo sapiens
uugugccugguacauggagaaa

SEQ ID NO: 316145 - RNA, 22 nt, Homo sapiens
uugugguuuuaucuaccuuugg

SEQ ID NO: 316146 - RNA, 22 nt, Homo sapiens
uuguuaugggguggcuugaaag

SEQ ID NO: 316147 - RNA, 22 nt, Homo sapiens
uuuaaaguuagaaggaaagggc

SEQ ID NO: 316148 - RNA, 23 nt, Homo sapiens
uuuaagcuucauguccuaacauc

SEQ ID NO: 316149 - RNA, 22 nt, Homo sapiens
uuuaauacugcaucuuuacucu

SEQ ID NO: 316150 - RNA, 18 nt, Homo sapiens
uuuacaguagaaggacuu

SEQ ID NO: 316151 - RNA, 22 nt, Homo sapiens
uuuagcaaugcuguggggaagu

SEQ ID NO: 316152 - RNA, 22 nt, Homo sapiens
uuuagcaauucauuuugugucu

SEQ ID NO: 316153 - RNA, 22 nt, Homo sapiens
uuuagguaauauuaaguagcug

SEQ ID NO: 316154 - RNA, 21 nt, Homo sapiens
uuuagguagcuuuucugggag

SEQ ID NO: 316155 - RNA, 18 nt, Homo sapiens
uuucaagucuuaggugac

SEQ ID NO: 316156 - RNA, 22 nt, Homo sapiens
uuucacaguguucucccccaga

SEQ ID NO: 316157 - RNA, 22 nt, Homo sapiens
uuucauguuuuucugugaggca

SEQ ID NO: 316158 - RNA, 22 nt, Homo sapiens
uuucuauguugaccagucuaga

SEQ ID NO: 316159 - RNA, 22 nt, Homo sapiens
uuucucaguguuucaggguagg

SEQ ID NO: 316160 - RNA, 19 nt, Homo sapiens
uuugaauauaaugcagcua

SEQ ID NO: 316161 - RNA, 20 nt, Homo sapiens
uuugcagaaucuaagaagag

SEQ ID NO: 316162 - RNA, 22 nt, Homo sapiens
uuugcagagucuuucgcugggc

SEQ ID NO: 316163 - RNA, 23 nt, Homo sapiens
uuugccacuuauuagcugggagg

SEQ ID NO: 316164 - RNA, 22 nt, Homo sapiens
uuugcugagucugacuucaugg

SEQ ID NO: 316165 - RNA, 22 nt, Homo sapiens
uuugggcuuuuaaucuagagca

SEQ ID NO: 316166 - RNA, 22 nt, Homo sapiens
uuuggucuuuuguaaguuaucu

SEQ ID NO: 316167 - RNA, 22 nt, Homo sapiens
uuuguaauccuauuccaaagga

SEQ ID NO: 316168 - RNA, 22 nt, Homo sapiens
uuuguacuaugguuuuucacua

SEQ ID NO: 316169 - RNA, 22 nt, Homo sapiens
uuugucccucucaccaacgggg

SEQ ID NO: 316170 - RNA, 22 nt, Homo sapiens
uuugucccuuugcaguggcaca

SEQ ID NO: 316171 - RNA, 22 nt, Homo sapiens
uuugugaaugucauaagcucca

SEQ ID NO: 316172 - RNA, 22 nt, Homo sapiens
uuugugcuauguuauauauucu

SEQ ID NO: 316173 - RNA, 22 nt, Homo sapiens
uuugugcugcaauuaauuuccc

SEQ ID NO: 316174 - RNA, 22 nt, Homo sapiens
uugagcaaugucacugaggcuu

SEQ ID NO: 316175 - RNA, 22 nt, Homo sapiens
uugaggaggcagucugcccauu

SEQ ID NO: 316176 - RNA, 22 nt, Homo sapiens
uugaggaggcagucuucccauu

SEQ ID NO: 316177 - RNA, 22 nt, Homo sapiens
uugagguauuuugucaacugua

SEQ ID NO: 316178 - RNA, 22 nt, Homo sapiens
uugauuuguagaaugccccaac

SEQ ID NO: 316179 - RNA, 22 nt, Homo sapiens
uugcaaagaccucuucacuucc

SEQ ID NO: 316180 - RNA, 22 nt, Homo sapiens
uugcaaaguuugccuccuguag

SEQ ID NO: 316181 - RNA, 22 nt, Homo sapiens
uugcagagaaauuucugguuua

SEQ ID NO: 316182 - RNA, 23 nt, Homo sapiens
uugcauugcccuccauaguacuc

SEQ ID NO: 316183 - RNA, 22 nt, Homo sapiens
uugccauggaguagaauugaag

SEQ ID NO: 316184 - RNA, 22 nt, Homo sapiens
uugcuauguugcccagucugga

SEQ ID NO: 316185 - RNA, 22 nt, Homo sapiens
uugcuccucugccaggaccugu

SEQ ID NO: 316186 - RNA, 22 nt, Homo sapiens
uugcuucauucaacauugaggg

SEQ ID NO: 316187 - RNA, 22 nt, Homo sapiens
uuggaaaaauccaccuugaucu

SEQ ID NO: 316188 - RNA, 22 nt, Homo sapiens
uuggagagugauauucagaugc

SEQ ID NO: 316189 - RNA, 22 nt, Homo sapiens
uuggcaaagugucuggcauuua

SEQ ID NO: 316190 - RNA, 22 nt, Homo sapiens
ucagugauugcuuucauggaaa

SEQ ID NO: 316191 - RNA, 17 nt, Homo sapiens
ucagugcauuuaagaga

SEQ ID NO: 316192 - RNA, 22 nt, Homo sapiens
ucauauugguuaaaauaguggg

SEQ ID NO: 316193 - RNA, 22 nt, Homo sapiens
ucaucagaguuuacaagcucag

SEQ ID NO: 316194 - RNA, 19 nt, Homo sapiens
ucauggcuuuuucagcugu

SEQ ID NO: 316195 - RNA, 20 nt, Homo sapiens
uuggcagagucuuuagggua

SEQ ID NO: 316196 - RNA, 22 nt, Homo sapiens
uuggcauuuauucuaaggucaa

SEQ ID NO: 316197 - RNA, 22 nt, Homo sapiens
uuggccauggagcacuuuucua

SEQ ID NO: 316198 - RNA, 22 nt, Homo sapiens
uugguccacugugaaauuggga

SEQ ID NO: 316199 - RNA, 22 nt, Homo sapiens
uugguuuccuuccugcuuaacu

SEQ ID NO: 316200 - RNA, 22 nt, Homo sapiens
uuguaaagaucauaugcuguuc

SEQ ID NO: 316201 - RNA, 22 nt, Homo sapiens
uuguaaagucugucucagucag

SEQ ID NO: 316202 - RNA, 22 nt, Homo sapiens
uuguaacaguucugcgagcagc

SEQ ID NO: 316203 - RNA, 22 nt, Homo sapiens
uuguauguaaccauuuggcaaa

SEQ ID NO: 316204 - RNA, 22 nt, Homo sapiens
uugucaugguuaauuuuaugua

SEQ ID NO: 316205 - RNA, 22 nt, Homo sapiens
uuguccuggagguucuugcaag

SEQ ID NO: 316206 - RNA, 22 nt, Homo sapiens
uugugaucauugucaaauagug

SEQ ID NO: 316207 - RNA, 22 nt, Homo sapiens
uuuaauguuacaguauugguau

SEQ ID NO: 316208 - RNA, 22 nt, Homo sapiens
uuuacagucuuuugugugaguc

SEQ ID NO: 316209 - RNA, 22 nt, Homo sapiens
uuuacaguuuucuaggcuacca

SEQ ID NO: 316210 - RNA, 22 nt, Homo sapiens
uuucaagugcugucuuagcugu

SEQ ID NO: 316211 - RNA, 17 nt, Homo sapiens
uuucagaguggaagugu

SEQ ID NO: 316212 - RNA, 22 nt, Homo sapiens
uuucauagaucaugcuuuugga

SEQ ID NO: 316213 - RNA, 22 nt, Homo sapiens
uuucauggagaaucuucuuacu

SEQ ID NO: 316214 - RNA, 22 nt, Homo sapiens
uuucugggggugcugauggaaa

SEQ ID NO: 316215 - RNA, 22 nt, Homo sapiens
uuugccaaucagaggcaucuug

SEQ ID NO: 316216 - RNA, 22 nt, Homo sapiens
uuuggauagugugguccuuuua

SEQ ID NO: 316217 - RNA, 20 nt, Homo sapiens
uuuggcaauaggguuuuugu

SEQ ID NO: 316218 - RNA, 22 nt, Homo sapiens
uuuggcaugggcuauuugcuuu

SEQ ID NO: 316219 - RNA, 22 nt, Homo sapiens
uuuggcauuaagaugcuguauc

SEQ ID NO: 316220 - RNA, 22 nt, Homo sapiens
uuuggcauuuaaauaugcaugg

SEQ ID NO: 316221 - RNA, 22 nt, Homo sapiens
uuugggaaugaguuuaucauuu

SEQ ID NO: 316222 - RNA, 22 nt, Homo sapiens
uuugguccaguguucagguccu

SEQ ID NO: 316223 - RNA, 22 nt, Homo sapiens
uuuguacacuguugguaggauu

SEQ ID NO: 316224 - RNA, 22 nt, Homo sapiens
uuuguacacuguuggugguuau

SEQ ID NO: 316225 - RNA, 22 nt, Homo sapiens
uuugucaauaacuaccaacagg

SEQ ID NO: 316226 - RNA, 22 nt, Homo sapiens
uuugugcuaaugcuagauuacu

SEQ ID NO: 316227 - RNA, 23 nt, Homo sapiens
uuuugcaauaagucacuggaaua

SEQ ID NO: 316228 - RNA, 22 nt, Homo sapiens
uuuuggcuuaaagagaauguau

SEQ ID NO: 316229 - RNA, 22 nt, Homo sapiens
uuuugucccaugggcuguuccc

SEQ ID NO: 316230 - RNA, 22 nt, Homo sapiens
uuuuugaguaaauauaaauugu

SEQ ID NO: 316231 - RNA, 22 nt, Homo sapiens
uuuuugugguauauugcaacaa

SEQ ID NO: 316232 - RNA, 22 nt, Homo sapiens
ugguaaaaugucauuuaccaga

SEQ ID NO: 316233 - RNA, 20 nt, Homo sapiens
uguaacacauggagaacucu

SEQ ID NO: 316234 - RNA, 22 nt, Homo sapiens
uguagcaaaucgauacuauugg

SEQ ID NO: 316235 - RNA, 21 nt, Homo sapiens
uguagcagcaugauucauagu

SEQ ID NO: 316236 - RNA, 22 nt, Homo sapiens
uguauacauauguauguuuugu

SEQ ID NO: 316237 - RNA, 22 nt, Homo sapiens
ugucaacauuuaucaaguuauu

SEQ ID NO: 316238 - RNA, 22 nt, Homo sapiens
ugucauggcauuuguaaacugc

SEQ ID NO: 316239 - RNA, 22 nt, Homo sapiens
ugucaugugagggaacuuguuc

SEQ ID NO: 316240 - RNA, 20 nt, Homo sapiens
ugucuauggggguucucugc

SEQ ID NO: 316241 - RNA, 22 nt, Homo sapiens
ugucuuguagacaauguauagu

SEQ ID NO: 316242 - RNA, 22 nt, Homo sapiens
ugucuuuguuaguuguccuagu

SEQ ID NO: 316243 - RNA, 22 nt, Homo sapiens
ugugacagguagguaauuuuug

SEQ ID NO: 316244 - RNA, 22 nt, Homo sapiens
ugugacagguauccuguguucu

SEQ ID NO: 316245 - RNA, 22 nt, Homo sapiens
ugugaucaaccugcagggcugg

SEQ ID NO: 316246 - RNA, 22 nt, Homo sapiens
ugugaucaugguauuaaucugc

SEQ ID NO: 316247 - RNA, 22 nt, Homo sapiens
ugugauugauuaaugugugcua

SEQ ID NO: 316248 - RNA, 22 nt, Homo sapiens
ugugcacaacgugcagguuugu

SEQ ID NO: 316249 - RNA, 22 nt, Homo sapiens
ugugcacaauguacagguuagu

SEQ ID NO: 316250 - RNA, 22 nt, Homo sapiens
ugugcacaaugugcagguuugu

SEQ ID NO: 316251 - RNA, 22 nt, Homo sapiens
ugugccacugcacucuggccug

SEQ ID NO: 316252 - RNA, 22 nt, Homo sapiens
ugugcguguaagagaucuaggu

SEQ ID NO: 316253 - RNA, 22 nt, Homo sapiens
uguggcacuguguccagagaaa

SEQ ID NO: 316254 - RNA, 22 nt, Homo sapiens
uguggcuuuguaaccauggguc

SEQ ID NO: 316255 - RNA, 22 nt, Homo sapiens
ugugguuuuucacauuuagaga

SEQ ID NO: 316256 - RNA, 22 nt, Homo sapiens
uguguaaagcuuguuccagaaa

SEQ ID NO: 316257 - RNA, 22 nt, Homo sapiens
uguguauaucacugcaugagug

SEQ ID NO: 316258 - RNA, 22 nt, Homo sapiens
ugugucuugcuggugccugcau

SEQ ID NO: 316259 - RNA, 22 nt, Homo sapiens
ugugucuuguuuauagcuuucu

SEQ ID NO: 316260 - RNA, 22 nt, Homo sapiens
uguucacaguguuucuuugaga

SEQ ID NO: 316261 - RNA, 22 nt, Homo sapiens
uguucaugaguucucauuuuua

SEQ ID NO: 316262 - RNA, 22 nt, Homo sapiens
uguucuggagccgguucaaaug

SEQ ID NO: 316263 - RNA, 22 nt, Homo sapiens
uguuugcuuaacguggagccag

SEQ ID NO: 316264 - RNA, 22 nt, Homo sapiens
uuaaagugaucauaaggauagu

SEQ ID NO: 316265 - RNA, 21 nt, Homo sapiens
uuaacagacaagugucuuccc

SEQ ID NO: 316266 - RNA, 22 nt, Homo sapiens
uuaacagcacuacguggggauc

SEQ ID NO: 316267 - RNA, 22 nt, Homo sapiens
uuaaggcuuucccuauguaaaa

SEQ ID NO: 316268 - RNA, 21 nt, Homo sapiens
uuaagugcuuuguaugcacua

SEQ ID NO: 316269 - RNA, 22 nt, Homo sapiens
uuaauacugcuuaacuuuagga

SEQ ID NO: 316270 - RNA, 22 nt, Homo sapiens
uuaaucacagcugaacucaaac

SEQ ID NO: 316271 - RNA, 21 nt, Homo sapiens
uuaaugcuaugcagaaaaucu

SEQ ID NO: 316272 - RNA, 22 nt, Homo sapiens
uuaauuguccaaguucaucucu

SEQ ID NO: 316273 - RNA, 22 nt, Homo sapiens
uuaauuguccauuauucuguuc

SEQ ID NO: 316274 - RNA, 22 nt, Homo sapiens
uuacacaguaggucccuaguaa

SEQ ID NO: 316275 - RNA, 22 nt, Homo sapiens
uuacaguggugaccuuguauug

SEQ ID NO: 316276 - RNA, 19 nt, Homo sapiens
uuacagugugcccuuuuag

SEQ ID NO: 316277 - RNA, 22 nt, Homo sapiens
uuacaugagacugucgcuaguu

SEQ ID NO: 316278 - RNA, 18 nt, Homo sapiens
uuagaugguuuuaaaacu

SEQ ID NO: 316279 - RNA, 22 nt, Homo sapiens
uuaggcuuuuuaaccaguuguu

SEQ ID NO: 316280 - RNA, 22 nt, Homo sapiens
uuagugaaugcaccacuucuga

SEQ ID NO: 316281 - RNA, 17 nt, Homo sapiens
uuaugagacuucuuagc

SEQ ID NO: 316282 - RNA, 22 nt, Homo sapiens
uuauggcaaugccccacuccua

SEQ ID NO: 316283 - RNA, 22 nt, Homo sapiens
uuaugucauuuuuggauguuaa

SEQ ID NO: 316284 - RNA, 22 nt, Homo sapiens
uucacaguacucccuggaauua

SEQ ID NO: 316285 - RNA, 22 nt, Homo sapiens
uucagcaaugacagccuauaua

SEQ ID NO: 316286 - RNA, 22 nt, Homo sapiens
uucaguacacguguucucauuu

SEQ ID NO: 316287 - RNA, 22 nt, Homo sapiens
uucaguagucaaaagauaaggg

SEQ ID NO: 316288 - RNA, 22 nt, Homo sapiens
uucauggauggaaaugauuuug

SEQ ID NO: 316289 - RNA, 22 nt, Homo sapiens
uucauguagucaucauccugcu

SEQ ID NO: 316290 - RNA, 22 nt, Homo sapiens
uucauugaaugauuuuuagaag

SEQ ID NO: 316291 - RNA, 22 nt, Homo sapiens
uuccacaauggcugaacuaguu

SEQ ID NO: 316292 - RNA, 22 nt, Homo sapiens
uuccacaaugguugaacuagcu

SEQ ID NO: 316293 - RNA, 22 nt, Homo sapiens
uuccaguaauagcacagcauug

SEQ ID NO: 316294 - RNA, 22 nt, Homo sapiens
uucccguugcugugcuccugcc

SEQ ID NO: 316295 - RNA, 22 nt, Homo sapiens
uucccugugggcuggugcucca

SEQ ID NO: 316296 - RNA, 22 nt, Homo sapiens
uucccuuucugccuugaaucuu

SEQ ID NO: 316297 - RNA, 22 nt, Homo sapiens
uucccuuucuuaaagaguuagg

SEQ ID NO: 316298 - RNA, 22 nt, Homo sapiens
uucccuuugaaacuaaacuugc

SEQ ID NO: 316299 - RNA, 21 nt, Homo sapiens
uucuauggucagaauucaaua

SEQ ID NO: 316300 - RNA, 22 nt, Homo sapiens
uucuaugguuuaauaguuuggg

SEQ ID NO: 316301 - RNA, 22 nt, Homo sapiens
uucugugguuucauuuaccugu

SEQ ID NO: 316302 - RNA, 22 nt, Homo sapiens
uucuucugguuaugaaauuuga

SEQ ID NO: 316303 - RNA, 22 nt, Homo sapiens
uucuugguuuaucgcuuuaaaa

SEQ ID NO: 316304 - RNA, 19 nt, Homo sapiens
uucuuuguugugggggcug

SEQ ID NO: 316305 - RNA, 22 nt, Homo sapiens
uugaagacuaccuaccauacuu

SEQ ID NO: 316306 - RNA, 22 nt, Homo sapiens
uugaaguaugaccgcugagaau

SEQ ID NO: 316307 - RNA, 21 nt, Homo sapiens
uugagaagaauuagcucuucc

SEQ ID NO: 316308 - RNA, 22 nt, Homo sapiens
uugagauaggaacucacuaugc

SEQ ID NO: 316309 - RNA, 22 nt, Homo sapiens
uugagauggagucucacugugu

SEQ ID NO: 316310 - RNA, 21 nt, Homo sapiens
uugagcuuuuaguacagacag

SEQ ID NO: 316311 - RNA, 22 nt, Homo sapiens
uugaggaggcagucucuccauu

SEQ ID NO: 316312 - RNA, 22 nt, Homo sapiens
uugaggugggaggaucacuuga

SEQ ID NO: 316313 - RNA, 22 nt, Homo sapiens
uugaguauuggacugguaucuu

SEQ ID NO: 316314 - RNA, 22 nt, Homo sapiens
uugauagaucagggauuugauu

SEQ ID NO: 316315 - RNA, 22 nt, Homo sapiens
uugauuagugacuggcuacacg

SEQ ID NO: 316316 - RNA, 22 nt, Homo sapiens
uugcagagccccacacugggcu

SEQ ID NO: 316317 - RNA, 22 nt, Homo sapiens
uugcagagccccugcaaggguc

SEQ ID NO: 316318 - RNA, 22 nt, Homo sapiens
uugcagcaaagagggaggggca

SEQ ID NO: 316319 - RNA, 19 nt, Homo sapiens
uugcaguauccuauauguu

SEQ ID NO: 316320 - RNA, 22 nt, Homo sapiens
uugcugagucuuucuagguugc

SEQ ID NO: 316321 - RNA, 22 nt, Homo sapiens
uuggaaauguguuugcauucag

SEQ ID NO: 316322 - RNA, 22 nt, Homo sapiens
uuggaacacauguuuuucuacc

SEQ ID NO: 316323 - RNA, 22 nt, Homo sapiens
uuggagcacuggggcacugaca

SEQ ID NO: 316324 - RNA, 22 nt, Homo sapiens
aauggcacuuuauaaauguuaa

SEQ ID NO: 316325 - RNA, 22 nt, Homo sapiens
aauggcaucuacguuaaauguc

SEQ ID NO: 316326 - RNA, 22 nt, Homo sapiens
aauggcuuuuaauauccauaau

SEQ ID NO: 316327 - RNA, 22 nt, Homo sapiens
aaugugcacuauuagggugaua

SEQ ID NO: 316328 - RNA, 22 nt, Homo sapiens
aauugcacuaagcauaguccag

SEQ ID NO: 316329 - RNA, 23 nt, Homo sapiens
aauugcuuuugaggacuuaguug

SEQ ID NO: 316330 - RNA, 21 nt, Homo sapiens
acaaagcuggagggagacugc

SEQ ID NO: 316331 - RNA, 20 nt, Homo sapiens
acaaaugcauucugugacau

SEQ ID NO: 316332 - RNA, 22 nt, Homo sapiens
acacacgugcauguaugcguau

SEQ ID NO: 316333 - RNA, 22 nt, Homo sapiens
acacaugugcguagacucuuua

SEQ ID NO: 316334 - RNA, 18 nt, Homo sapiens
acagugucauggcucaau

SEQ ID NO: 316335 - RNA, 19 nt, Homo sapiens
acagugucucuauaaugau

SEQ ID NO: 316336 - RNA, 22 nt, Homo sapiens
acauaugaguacaugugccaug

SEQ ID NO: 316337 - RNA, 22 nt, Homo sapiens
acaucccaugccuggguacucc

SEQ ID NO: 316338 - RNA, 18 nt, Homo sapiens
acauucagcuugaagaua

SEQ ID NO: 316339 - RNA, 22 nt, Homo sapiens
accaccacucccgcauucuaaa

SEQ ID NO: 316340 - RNA, 22 nt, Homo sapiens
acccagaguuccuugucuuuca

SEQ ID NO: 316341 - RNA, 21 nt, Homo sapiens
acccccacaccuccuuaguuc

SEQ ID NO: 316342 - RNA, 17 nt, Homo sapiens
accccuaccucagaagc

SEQ ID NO: 316343 - RNA, 22 nt, Homo sapiens
acccugacacgauucuucacuu

SEQ ID NO: 316344 - RNA, 22 nt, Homo sapiens
acccugcuaaacagcccccugc

SEQ ID NO: 316345 - RNA, 22 nt, Homo sapiens
acccugucaaaauagaccaauc

SEQ ID NO: 316346 - RNA, 22 nt, Homo sapiens
acccugucagcuggccugggca

SEQ ID NO: 316347 - RNA, 22 nt, Homo sapiens
accucagcccggggaaguugag

SEQ ID NO: 316348 - RNA, 22 nt, Homo sapiens
agaaacauucucuugccuccuu

SEQ ID NO: 316349 - RNA, 22 nt, Homo sapiens
agaaagugcuucccuuugguga

SEQ ID NO: 316350 - RNA, 23 nt, Homo sapiens
augaauguaaggaguguaagaaa

SEQ ID NO: 316351 - RNA, 22 nt, Homo sapiens
augagaaucauuucagcuugua

SEQ ID NO: 316352 - RNA, 22 nt, Homo sapiens
augagauaggaacaaacuuaca

SEQ ID NO: 316353 - RNA, 22 nt, Homo sapiens
augagcaucaccagaaucaaua

SEQ ID NO: 316354 - RNA, 22 nt, Homo sapiens
augaggaaggagccuuugucug

SEQ ID NO: 316355 - RNA, 22 nt, Homo sapiens
augaggugcagaggaaaugagu

SEQ ID NO: 316356 - RNA, 22 nt, Homo sapiens
augauaaguuauuagaagaaga

SEQ ID NO: 316357 - RNA, 22 nt, Homo sapiens
augccagggagaauuguucaag

SEQ ID NO: 316358 - RNA, 19 nt, Homo sapiens
augccuggagaugguuaua

SEQ ID NO: 316359 - RNA, 22 nt, Homo sapiens
augcuguuuuguagcucccucu

SEQ ID NO: 316360 - RNA, 22 nt, Homo sapiens
auggaauguaaguuauguuugc

SEQ ID NO: 316361 - RNA, 22 nt, Homo sapiens
auggaauguggaaugguaagua

SEQ ID NO: 316362 - RNA, 22 nt, Homo sapiens
auggacagacacuggccuucug

SEQ ID NO: 316363 - RNA, 22 nt, Homo sapiens
augguuuuacugcaaaauggga

SEQ ID NO: 316364 - RNA, 22 nt, Homo sapiens
auguaaacauuuggucuaaauu

SEQ ID NO: 316365 - RNA, 22 nt, Homo sapiens
auguaaacuacagauuuugggu

SEQ ID NO: 316366 - RNA, 22 nt, Homo sapiens
auguaacacagugcggcugggc

SEQ ID NO: 316367 - RNA, 22 nt, Homo sapiens
auguaguagauauuuauggaaa

SEQ ID NO: 316368 - RNA, 22 nt, Homo sapiens
augucaacauagacaguagagu

SEQ ID NO: 316369 - RNA, 22 nt, Homo sapiens
augugcuuuuuaaacagaugcu

SEQ ID NO: 316370 - RNA, 22 nt, Homo sapiens
augugguaggcccaugagucau

SEQ ID NO: 316371 - RNA, 22 nt, Homo sapiens
auguguaaagcuuuucuuuguu

SEQ ID NO: 316372 - RNA, 22 nt, Homo sapiens
auguguauuaccucgauuguga

SEQ ID NO: 316373 - RNA, 22 nt, Homo sapiens
augugugcuugauguaaaaagu

SEQ ID NO: 316374 - RNA, 22 nt, Homo sapiens
auuccagauggaguugaggguu

SEQ ID NO: 316375 - RNA, 22 nt, Homo sapiens
auugcacuccagccugggugac

SEQ ID NO: 316376 - RNA, 22 nt, Homo sapiens
auugcacuccggccugggugac

SEQ ID NO: 316377 - RNA, 22 nt, Homo sapiens
auugcauugugaucuucccaga

SEQ ID NO: 316378 - RNA, 22 nt, Homo sapiens
gagagguaguuuuuuggucguc

SEQ ID NO: 316379 - RNA, 22 nt, Homo sapiens
gagagugugucagaggcugcga

SEQ ID NO: 316380 - RNA, 22 nt, Homo sapiens
gagaucuauuccucacccuucu

SEQ ID NO: 316381 - RNA, 22 nt, Homo sapiens
gagcaaugauugagccacugua

SEQ ID NO: 316382 - RNA, 22 nt, Homo sapiens
gagcacauaugacauuuucuuc

SEQ ID NO: 316383 - RNA, 22 nt, Homo sapiens
gagcuagggucaugcuacugca

SEQ ID NO: 316384 - RNA, 22 nt, Homo sapiens
gagcuuggguuaaaguugccuu

SEQ ID NO: 316385 - RNA, 22 nt, Homo sapiens
gagcuuguggucuucguguuau

SEQ ID NO: 316386 - RNA, 22 nt, Homo sapiens
gagggcacugcuuuccuuucaa

SEQ ID NO: 316387 - RNA, 22 nt, Homo sapiens
gauaaagauagcaauagggaca

SEQ ID NO: 316388 - RNA, 22 nt, Homo sapiens
gauauguucugagaaaugcauu

SEQ ID NO: 316389 - RNA, 22 nt, Homo sapiens
gaucugagaaagugucauaaca

SEQ ID NO: 316390 - RNA, 22 nt, Homo sapiens
gaucugugugauuggaugcauu

SEQ ID NO: 316391 - RNA, 22 nt, Homo sapiens
gaugauauuugagucauuagaa

SEQ ID NO: 316392 - RNA, 22 nt, Homo sapiens
gaugcaguaagaaugcauagcg

SEQ ID NO: 316393 - RNA, 22 nt, Homo sapiens
gaugccuuuuuguccucaguua

SEQ ID NO: 316394 - RNA, 21 nt, Homo sapiens
gcaaaggaauugccuaagcuu

SEQ ID NO: 316395 - RNA, 22 nt, Homo sapiens
gcaauggaaucccuugaucaau

SEQ ID NO: 316396 - RNA, 22 nt, Homo sapiens
gcacgugcacccacaugcacgu

SEQ ID NO: 316397 - RNA, 22 nt, Homo sapiens
gcacugggccacauuuauuuuc

SEQ ID NO: 316398 - RNA, 22 nt, Homo sapiens
gcagcagugugggcugaaccua

SEQ ID NO: 316399 - RNA, 22 nt, Homo sapiens
gcagcauuaccaagacauggca

SEQ ID NO: 316400 - RNA, 22 nt, Homo sapiens
gcagugaugugaucauagcuca

SEQ ID NO: 316401 - RNA, 20 nt, Homo sapiens
gcaguguucugaccugaauc

SEQ ID NO: 316402 - RNA, 22 nt, Homo sapiens
gcccacuguuaaauuuguuuua

SEQ ID NO: 316403 - RNA, 19 nt, Homo sapiens
gcggcacuggagacacagc

SEQ ID NO: 316404 - RNA, 23 nt, Homo sapiens
gcuaggagagaugaaacacaggu

SEQ ID NO: 316405 - RNA, 22 nt, Homo sapiens
gcuaugucuguugcucuugggc

SEQ ID NO: 316406 - RNA, 22 nt, Homo sapiens
gcucuuuugggguaauucugag

SEQ ID NO: 316407 - RNA, 22 nt, Homo sapiens
gcugauguugaccuugaucacc

SEQ ID NO: 316408 - RNA, 22 nt, Homo sapiens
gcugucaugagcaacacaugaa

SEQ ID NO: 316409 - RNA, 19 nt, Homo sapiens
gcuucuugaggacgaugac

SEQ ID NO: 316410 - RNA, 22 nt, Homo sapiens
gcuuuguuaaaacacagccaca

SEQ ID NO: 316411 - RNA, 22 nt, Homo sapiens
ggaaggucaaagggaaagcaga

SEQ ID NO: 316412 - RNA, 22 nt, Homo sapiens
ggaaugcuaaaauaggaugcug

SEQ ID NO: 316413 - RNA, 19 nt, Homo sapiens
ggaaugcuauucaaccuuu

SEQ ID NO: 316414 - RNA, 22 nt, Homo sapiens
ggacuagggacauggggagcug

SEQ ID NO: 316415 - RNA, 22 nt, Homo sapiens
ggagaugauuaugaaucacuua

SEQ ID NO: 316416 - RNA, 22 nt, Homo sapiens
ggagcucaucuagcauagaggu

SEQ ID NO: 316417 - RNA, 22 nt, Homo sapiens
ggaggcuaguaaaaagguagaa

SEQ ID NO: 316418 - RNA, 22 nt, Homo sapiens
ggcaaaauauugucugguauag

SEQ ID NO: 316419 - RNA, 22 nt, Homo sapiens
ggcaagaggagauucugcuccc

SEQ ID NO: 316420 - RNA, 22 nt, Homo sapiens
ggcaaggaggggcacuuucacu

SEQ ID NO: 316421 - RNA, 22 nt, Homo sapiens
ggcaaguugcuauucuuuaaug

SEQ ID NO: 316422 - RNA, 23 nt, Homo sapiens
ggcacggaauucaaagaggcauu

SEQ ID NO: 316423 - RNA, 22 nt, Homo sapiens
gggaaugaagagaaccuuccca

SEQ ID NO: 316424 - RNA, 22 nt, Homo sapiens
gggcaugaugucuuaugccuau

SEQ ID NO: 316425 - RNA, 22 nt, Homo sapiens
ggguaggcaagcggaugucaga

SEQ ID NO: 316426 - RNA, 15 nt, Homo sapiens
ggguccucucccaaa

SEQ ID NO: 316427 - RNA, 19 nt, Homo sapiens
ggucauggagguuguguga

SEQ ID NO: 316428 - RNA, 22 nt, Homo sapiens
guacaguaguaaaagugaauga

SEQ ID NO: 316429 - RNA, 22 nt, Homo sapiens
guacuuagagauagggucuuua

SEQ ID NO: 316430 - RNA, 22 nt, Homo sapiens
guagcagaacauguuccuugua

SEQ ID NO: 316431 - RNA, 22 nt, Homo sapiens
guagcagcuacuaaguugcugu

SEQ ID NO: 316432 - RNA, 18 nt, Homo sapiens
guccauuuguugguacac

SEQ ID NO: 316433 - RNA, 22 nt, Homo sapiens
gucuggcuuaucucacuuacca

SEQ ID NO: 316434 - RNA, 22 nt, Homo sapiens
gucugguugacagcauguggcc

SEQ ID NO: 316435 - RNA, 22 nt, Homo sapiens
gucugguuggaguaguuuucag

SEQ ID NO: 316436 - RNA, 22 nt, Homo sapiens
gucuuuggaaagacaaaguuca

SEQ ID NO: 316437 - RNA, 22 nt, Homo sapiens
gugaaagacauauaugguuuga

SEQ ID NO: 316438 - RNA, 22 nt, Homo sapiens
gugagauggagucuugcuuugu

SEQ ID NO: 316439 - RNA, 22 nt, Homo sapiens
gugagcauucaaggaaggagcu

SEQ ID NO: 316440 - RNA, 22 nt, Homo sapiens
gugagcuccucuucugcugcag

SEQ ID NO: 316441 - RNA, 22 nt, Homo sapiens
gugagguguuaaccaaccugug

SEQ ID NO: 316442 - RNA, 18 nt, Homo sapiens
gugcaaugaauagcagag

SEQ ID NO: 316443 - RNA, 22 nt, Homo sapiens
gugcacaacaugcagguuuguu

SEQ ID NO: 316444 - RNA, 22 nt, Homo sapiens
gugcacaacaugcaguuuuguu

SEQ ID NO: 316445 - RNA, 22 nt, Homo sapiens
gugcacaacgugcaaguuuguu

SEQ ID NO: 316446 - RNA, 22 nt, Homo sapiens
gugcacaacgugcaggcuuguu

SEQ ID NO: 316447 - RNA, 22 nt, Homo sapiens
gugcacaacgugcagguuuguu

SEQ ID NO: 316448 - RNA, 22 nt, Homo sapiens
gugcacaacguguagguuuguu

SEQ ID NO: 316449 - RNA, 22 nt, Homo sapiens
gugcacaaucgugcauuccuug

SEQ ID NO: 316450 - RNA, 22 nt, Homo sapiens
gugcacaaugugcagguuuguu

SEQ ID NO: 316451 - RNA, 23 nt, Homo sapiens
gugcaugagucuuuauaguagca

SEQ ID NO: 316452 - RNA, 22 nt, Homo sapiens
gugcuuauccccauucuggagg

SEQ ID NO: 316453 - RNA, 22 nt, Homo sapiens
guggaagcacaggccuccugga

SEQ ID NO: 316454 - RNA, 22 nt, Homo sapiens
guggcagagucagagggaaaug

SEQ ID NO: 316455 - RNA, 20 nt, Homo sapiens
gugggcaaauccuuuccucu

SEQ ID NO: 316456 - RNA, 22 nt, Homo sapiens
guggguaaaucucuggggcucu

SEQ ID NO: 316457 - RNA, 22 nt, Homo sapiens
gugguguuugagcugccaggga

SEQ ID NO: 316458 - RNA, 22 nt, Homo sapiens
gugguuuuacaaagagaaagau

SEQ ID NO: 316459 - RNA, 22 nt, Homo sapiens
gugguuuuaucccagaaauuaa

SEQ ID NO: 316460 - RNA, 22 nt, Homo sapiens
gugguuuuuagauuucuacagu

SEQ ID NO: 316461 - RNA, 22 nt, Homo sapiens
guguaaaacaauuagaggauuu

SEQ ID NO: 316462 - RNA, 22 nt, Homo sapiens
gugucaguggggagugaucuuc

SEQ ID NO: 316463 - RNA, 22 nt, Homo sapiens
gugugacagcuauagacaugau

SEQ ID NO: 316464 - RNA, 22 nt, Homo sapiens
guguggcaggugggggcucaga

SEQ ID NO: 316465 - RNA, 22 nt, Homo sapiens
guucaucagggauacuggcuua

SEQ ID NO: 316466 - RNA, 22 nt, Homo sapiens
guucuggagauaaagccaaggu

SEQ ID NO: 316467 - RNA, 22 nt, Homo sapiens
guugcugagucccaucaccaga

SEQ ID NO: 316468 - RNA, 20 nt, Homo sapiens
uaaaugccucaugcuuuauu

SEQ ID NO: 316469 - RNA, 22 nt, Homo sapiens
uaaaugcuuaauugaaugugga

SEQ ID NO: 316470 - RNA, 22 nt, Homo sapiens
uaacaacauucuaacugacggc

SEQ ID NO: 316471 - RNA, 22 nt, Homo sapiens
uaacagcauuugugucuaguag

SEQ ID NO: 316472 - RNA, 22 nt, Homo sapiens
uaaggcuagcaagaugagaaua

SEQ ID NO: 316473 - RNA, 22 nt, Homo sapiens
uaaggcuucuuggaauacugca

SEQ ID NO: 316474 - RNA, 22 nt, Homo sapiens
uaaggcuugcuucagucuugaa

SEQ ID NO: 316475 - RNA, 22 nt, Homo sapiens
uaaggcuuugguagguuugguc

SEQ ID NO: 316476 - RNA, 22 nt, Homo sapiens
caucacagcaaguagggagugg

SEQ ID NO: 316477 - RNA, 22 nt, Homo sapiens
caucacaucugcaugguaagua

SEQ ID NO: 316478 - RNA, 22 nt, Homo sapiens
caugccacuguggacaaagaca

SEQ ID NO: 316479 - RNA, 23 nt, Homo sapiens
cauggcuguuaacacuguuugag

SEQ ID NO: 316480 - RNA, 22 nt, Homo sapiens
caugucuuuuaaacauucaacu

SEQ ID NO: 316481 - RNA, 20 nt, Homo sapiens
cauuccacuuuccugucagu

SEQ ID NO: 316482 - RNA, 22 nt, Homo sapiens
ccaaaucucauguugaaaugug

SEQ ID NO: 316483 - RNA, 23 nt, Homo sapiens
ccacaaugguugaacuagauuac

SEQ ID NO: 316484 - RNA, 22 nt, Homo sapiens
ccacagucuaugcaacaagguc

SEQ ID NO: 316485 - RNA, 22 nt, Homo sapiens
ccacccuggagaauuugagguc

SEQ ID NO: 316486 - RNA, 22 nt, Homo sapiens
ccagauguuuucauucagcaag

SEQ ID NO: 316487 - RNA, 22 nt, Homo sapiens
ccagucuuggugucuguagcac

SEQ ID NO: 316488 - RNA, 17 nt, Homo sapiens
ccagugaucccuuuugu

SEQ ID NO: 316489 - RNA, 22 nt, Homo sapiens
ccagugauggcugccucauuug

SEQ ID NO: 316490 - RNA, 19 nt, Homo sapiens
ccauggcaaugaucugaug

SEQ ID NO: 316491 - RNA, 22 nt, Homo sapiens
cccacaguggccucauauccuu

SEQ ID NO: 316492 - RNA, 21 nt, Homo sapiens
cccagguucucugaggguaga

SEQ ID NO: 316493 - RNA, 17 nt, Homo sapiens
ccccugagcgaugcagu

SEQ ID NO: 316494 - RNA, 22 nt, Homo sapiens
cccugagagcagggucuuucuc

SEQ ID NO: 316495 - RNA, 22 nt, Homo sapiens
cccugagaugcuguuaaucugu

SEQ ID NO: 316496 - RNA, 22 nt, Homo sapiens
cccugagaugugaauuucagag

SEQ ID NO: 316497 - RNA, 21 nt, Homo sapiens
ccucuuugagggaagaaaggg

SEQ ID NO: 316498 - RNA, 22 nt, Homo sapiens
ccuugguaauguguuuuauucu

SEQ ID NO: 316499 - RNA, 22 nt, Homo sapiens
cgcccuguagcuagcuagaggu

SEQ ID NO: 316500 - RNA, 16 nt, Homo sapiens
cuaaaaugucuacuug

SEQ ID NO: 316501 - RNA, 22 nt, Homo sapiens
cuaaaguagccaggacugcagg

SEQ ID NO: 316502 - RNA, 22 nt, Homo sapiens
cuaacacagagguuuauuucuc

SEQ ID NO: 316503 - RNA, 22 nt, Homo sapiens
cuaaugcagucaggagaaggaa

SEQ ID NO: 316504 - RNA, 22 nt, Homo sapiens
cuacagaguaucuaaagaggua

SEQ ID NO: 316505 - RNA, 22 nt, Homo sapiens
cuacaguguauuuauggagggu

SEQ ID NO: 316506 - RNA, 22 nt, Homo sapiens
cuagugcaguuccccugucuua

SEQ ID NO: 316507 - RNA, 18 nt, Homo sapiens
cuaugccacuuuauauca

SEQ ID NO: 316508 - RNA, 22 nt, Homo sapiens
cuauggcagccacggccuggag

SEQ ID NO: 316509 - RNA, 20 nt, Homo sapiens
cucaccagguguaggcugag

SEQ ID NO: 316510 - RNA, 22 nt, Homo sapiens
cucaccuugugauccacccacc

SEQ ID NO: 316511 - RNA, 22 nt, Homo sapiens
cucaggcacucugauuccagug

SEQ ID NO: 316512 - RNA, 22 nt, Homo sapiens
cuccaguacagagagguuccuc

SEQ ID NO: 316513 - RNA, 22 nt, Homo sapiens
cucugguggaagcagggggcaa

SEQ ID NO: 316514 - RNA, 22 nt, Homo sapiens
cucuuuuguuuagcugagaggg

SEQ ID NO: 316515 - RNA, 22 nt, Homo sapiens
cugaaauggaaugugugcacag

SEQ ID NO: 316516 - RNA, 22 nt, Homo sapiens
cugaauguucuauagaagccgc

SEQ ID NO: 316517 - RNA, 22 nt, Homo sapiens
cugaauguucuggauggaagag

SEQ ID NO: 316518 - RNA, 22 nt, Homo sapiens
cugaauguuucacucugaaaug

SEQ ID NO: 316519 - RNA, 22 nt, Homo sapiens
cugacauuguugaucacagcca

SEQ ID NO: 316520 - RNA, 22 nt, Homo sapiens
cugagaauguaaaugaagcuuu

SEQ ID NO: 316521 - RNA, 20 nt, Homo sapiens
cugcacauccacucuacuuc

SEQ ID NO: 316522 - RNA, 23 nt, Homo sapiens
cuguacacauauacaucuaagua

SEQ ID NO: 316523 - RNA, 22 nt, Homo sapiens
cugucaucauuucuaugugcca

SEQ ID NO: 316524 - RNA, 22 nt, Homo sapiens
cuguuuguuuaggguacucaga

SEQ ID NO: 316525 - RNA, 22 nt, Homo sapiens
cuuaaagcgaauauugguggua

SEQ ID NO: 316526 - RNA, 22 nt, Homo sapiens
cuuccauaguuacacccaggga

SEQ ID NO: 316527 - RNA, 22 nt, Homo sapiens
cuugccuaaucugcaugauuuu

SEQ ID NO: 316528 - RNA, 22 nt, Homo sapiens
cuugggcagugugcauguguau

SEQ ID NO: 316529 - RNA, 22 nt, Homo sapiens
cuuucugaggagaauagagaac

SEQ ID NO: 316530 - RNA, 18 nt, Homo sapiens
cuuugcagcuuccagagg

SEQ ID NO: 316531 - RNA, 22 nt, Homo sapiens
cuuugguugugcucuccacuuu

SEQ ID NO: 316532 - RNA, 22 nt, Homo sapiens
cuuuuacacugcuggugggaau

SEQ ID NO: 316533 - RNA, 22 nt, Homo sapiens
cuuuuggcuuaagauugucuug

SEQ ID NO: 316534 - RNA, 22 nt, Homo sapiens
gaaagacuuucugcuguggaua

SEQ ID NO: 316535 - RNA, 22 nt, Homo sapiens
gaacugggguuggguugcgaua

SEQ ID NO: 316536 - RNA, 22 nt, Homo sapiens
gaaguaguaaaauuuauugcag

SEQ ID NO: 316537 - RNA, 22 nt, Homo sapiens
gaagugcaguggcacagucaug

SEQ ID NO: 316538 - RNA, 22 nt, Homo sapiens
gaagugguaggauugcuuuuga

SEQ ID NO: 316539 - RNA, 22 nt, Homo sapiens
gaauaaacuagagaggacugag

SEQ ID NO: 316540 - RNA, 20 nt, Homo sapiens
gaaugguuucgggguucuug

SEQ ID NO: 316541 - RNA, 22 nt, Homo sapiens
gacauagagccuugacuucauu

SEQ ID NO: 316542 - RNA, 22 nt, Homo sapiens
gacauuaucagguuuguuuucu

SEQ ID NO: 316543 - RNA, 19 nt, Homo sapiens
gacuccagaguugugugcu

SEQ ID NO: 316544 - RNA, 22 nt, Homo sapiens
gagaacagaagcauuccuaauu

SEQ ID NO: 316545 - RNA, 22 nt, Homo sapiens
gagaacaguguuguauuuuuuc

SEQ ID NO: 316546 - RNA, 22 nt, Homo sapiens
ucuguguuugaucaagauugua

SEQ ID NO: 316547 - RNA, 22 nt, Homo sapiens
ucuguuguuguuuuaagagaca

SEQ ID NO: 316548 - RNA, 22 nt, Homo sapiens
ucuugcaguucccaaauucaca

SEQ ID NO: 316549 - RNA, 22 nt, Homo sapiens
ucuuggcaaagaauuuuuggcu

SEQ ID NO: 316550 - RNA, 22 nt, Homo sapiens
ucuuuagguguuauaguucaag

SEQ ID NO: 316551 - RNA, 19 nt, Homo sapiens
ucuuuagucacauuuuuau

SEQ ID NO: 316552 - RNA, 22 nt, Homo sapiens
ucuuugauuaugcagauggguu

SEQ ID NO: 316553 - RNA, 22 nt, Homo sapiens
ucuuuguuagaacccucuccuu

SEQ ID NO: 316554 - RNA, 22 nt, Homo sapiens
ucuuuguucaggagccaacucc

SEQ ID NO: 316555 - RNA, 22 nt, Homo sapiens
ucuuuguuuucugauccugaag

SEQ ID NO: 316556 - RNA, 22 nt, Homo sapiens
ucuuuugggccucuugucagac

SEQ ID NO: 316557 - RNA, 22 nt, Homo sapiens
ugaaaaguuguugaaggcuuca

SEQ ID NO: 316558 - RNA, 20 nt, Homo sapiens
ugaaaucuucacuaagucuc

SEQ ID NO: 316559 - RNA, 22 nt, Homo sapiens
ugaaaugauuauaugguguuug

SEQ ID NO: 316560 - RNA, 22 nt, Homo sapiens
ugaaaugccuuuaaugaauuua

SEQ ID NO: 316561 - RNA, 22 nt, Homo sapiens
ugaacucagcauccagggccaa

SEQ ID NO: 316562 - RNA, 22 nt, Homo sapiens
ugaagaucuuaggagcugaggg

SEQ ID NO: 316563 - RNA, 22 nt, Homo sapiens
ugaagggcauuguuuugccaaa

SEQ ID NO: 316564 - RNA, 21 nt, Homo sapiens
ugacagaaaauugaguuugcu

SEQ ID NO: 316565 - RNA, 22 nt, Homo sapiens
ugacaguguccuccuccugaga

SEQ ID NO: 316566 - RNA, 22 nt, Homo sapiens
ugacagugugagacuuugucuc

SEQ ID NO: 316567 - RNA, 22 nt, Homo sapiens
ugacagugugagauccugucuc

SEQ ID NO: 316568 - RNA, 22 nt, Homo sapiens
ugacuaaaacugaguuucauua

SEQ ID NO: 316569 - RNA, 22 nt, Homo sapiens
ugacuauaguaaucacuucaca

SEQ ID NO: 316570 - RNA, 18 nt, Homo sapiens
ugagaacauguguacaca

SEQ ID NO: 316571 - RNA, 22 nt, Homo sapiens
ugagaacuuugucuuuuacucu

SEQ ID NO: 316572 - RNA, 22 nt, Homo sapiens
ugagaagugacgcagcaggguu

SEQ ID NO: 316573 - RNA, 22 nt, Homo sapiens
ugagaagugauauagaaguuaa

SEQ ID NO: 316574 - RNA, 22 nt, Homo sapiens
ugagaucuuugcuguccucacc

SEQ ID NO: 316575 - RNA, 22 nt, Homo sapiens
ugagaugaagucuugcucuguu

SEQ ID NO: 316576 - RNA, 20 nt, Homo sapiens
ugagaugcauugggauguuu

SEQ ID NO: 316577 - RNA, 22 nt, Homo sapiens
ugagauggagucuugucgccua

SEQ ID NO: 316578 - RNA, 22 nt, Homo sapiens
ugagauggaguuucgcuuuugu

SEQ ID NO: 316579 - RNA, 22 nt, Homo sapiens
ugaggauaguguugaaggcagg

SEQ ID NO: 316580 - RNA, 22 nt, Homo sapiens
ugaggaucucuaggaauuuauc

SEQ ID NO: 316581 - RNA, 22 nt, Homo sapiens
ugagguaucauugcccaggcug

SEQ ID NO: 316582 - RNA, 22 nt, Homo sapiens
ugaggugaaguaauauucuaag

SEQ ID NO: 316583 - RNA, 22 nt, Homo sapiens
ugaggugaggguaucaaaugcu

SEQ ID NO: 316584 - RNA, 22 nt, Homo sapiens
ugaggugcagcaauccucaugu

SEQ ID NO: 316585 - RNA, 22 nt, Homo sapiens
ugagugagguucuacucuguga

SEQ ID NO: 316586 - RNA, 22 nt, Homo sapiens
ugaguguccaccccuuucacag

SEQ ID NO: 316587 - RNA, 22 nt, Homo sapiens
ugaugacccugcaguucucaag

SEQ ID NO: 316588 - RNA, 22 nt, Homo sapiens
ugaugcugaugccugccagaag

SEQ ID NO: 316589 - RNA, 22 nt, Homo sapiens
ugauuugucugcaggaauagug

SEQ ID NO: 316590 - RNA, 22 nt, Homo sapiens
ugcaaauguuauuuugguuucu

SEQ ID NO: 316591 - RNA, 21 nt, Homo sapiens
ugcaagaaucaggaagcugcc

SEQ ID NO: 316592 - RNA, 22 nt, Homo sapiens
ugcaaguaauuggcgaggaguu

SEQ ID NO: 316593 - RNA, 22 nt, Homo sapiens
ugcaccaauucuaaacaguucu

SEQ ID NO: 316594 - RNA, 22 nt, Homo sapiens
ugcagcucaaauuccuaacaag

SEQ ID NO: 316595 - RNA, 22 nt, Homo sapiens
ugcagcucagcugcggaguuuu

SEQ ID NO: 316596 - RNA, 22 nt, Homo sapiens
ugcauccauucuagacucaucu

SEQ ID NO: 316597 - RNA, 22 nt, Homo sapiens
ugccaugaagaucccugaaaug

SEQ ID NO: 316598 - RNA, 22 nt, Homo sapiens
ugccaugaaguaauggcaaaaa

SEQ ID NO: 316599 - RNA, 22 nt, Homo sapiens
ugcuauguccccacccaaaucu

SEQ ID NO: 316600 - RNA, 22 nt, Homo sapiens
ugcugcacaguucuuaagauua

SEQ ID NO: 316601 - RNA, 19 nt, Homo sapiens
uggaacugauucaguucug

SEQ ID NO: 316602 - RNA, 22 nt, Homo sapiens
ugugccacugcacuucagccug

SEQ ID NO: 316603 - RNA, 22 nt, Homo sapiens
ugugcuugcuucuucuccuagu

SEQ ID NO: 316604 - RNA, 22 nt, Homo sapiens
uguggcucuucuguucuccacu

SEQ ID NO: 316605 - RNA, 22 nt, Homo sapiens
ugugguuuuaguaaaacuaugu

SEQ ID NO: 316606 - RNA, 22 nt, Homo sapiens
ugugguuuuuuucuccaauagg

SEQ ID NO: 316607 - RNA, 21 nt, Homo sapiens
uguuaacaugcagauuacugg

SEQ ID NO: 316608 - RNA, 22 nt, Homo sapiens
uguuaaggcagagauaauacau

SEQ ID NO: 316609 - RNA, 22 nt, Homo sapiens
uguucuggagaguuuagucugg

SEQ ID NO: 316610 - RNA, 22 nt, Homo sapiens
uuaaaguguuugcagacaggug

SEQ ID NO: 316611 - RNA, 22 nt, Homo sapiens
uuaacagcacaugcugucccuu

SEQ ID NO: 316612 - RNA, 22 nt, Homo sapiens
uuaagcaguaguuaaggagagg

SEQ ID NO: 316613 - RNA, 22 nt, Homo sapiens
uuaaggaaggagucuuaaaugg

SEQ ID NO: 316614 - RNA, 22 nt, Homo sapiens
uuaaggcauucuuugucuucau

SEQ ID NO: 316615 - RNA, 22 nt, Homo sapiens
uuaaggcuuuaaguaaacacag

SEQ ID NO: 316616 - RNA, 22 nt, Homo sapiens
uuaaugcuuggggaguaguucu

SEQ ID NO: 316617 - RNA, 22 nt, Homo sapiens
uuacauguggugugaagaagag

SEQ ID NO: 316618 - RNA, 22 nt, Homo sapiens
uuacauguuuauggggguacau

SEQ ID NO: 316619 - RNA, 22 nt, Homo sapiens
uuacccuuuaacccuuuaaagu

SEQ ID NO: 316620 - RNA, 22 nt, Homo sapiens
uuagagcacugaucugcucuuu

SEQ ID NO: 316621 - RNA, 22 nt, Homo sapiens
uuagcagugugaaaaaagacua

SEQ ID NO: 316622 - RNA, 22 nt, Homo sapiens
uuauaaacaugaagauuugggg

SEQ ID NO: 316623 - RNA, 22 nt, Homo sapiens
uuauacucgucugaaugauucu

SEQ ID NO: 316624 - RNA, 22 nt, Homo sapiens
uuauagcacuaagaagguaaua

SEQ ID NO: 316625 - RNA, 22 nt, Homo sapiens
uuaugucuuugagcaaugcugu

SEQ ID NO: 316626 - RNA, 22 nt, Homo sapiens
uuauuagcacccuaccaugugg

SEQ ID NO: 316627 - RNA, 22 nt, Homo sapiens
uucaaaaccucugcuuaagccc

SEQ ID NO: 316628 - RNA, 22 nt, Homo sapiens
uucaagaauuaaaguggcuuuu

SEQ ID NO: 316629 - RNA, 22 nt, Homo sapiens
uucaagcugggcaaauaagggg

SEQ ID NO: 316630 - RNA, 22 nt, Homo sapiens
uucagcacaguguggaucauuc

SEQ ID NO: 316631 - RNA, 22 nt, Homo sapiens
uucaggcaccauugucauugau

SEQ ID NO: 316632 - RNA, 22 nt, Homo sapiens
uucagugucauuaacacaguag

SEQ ID NO: 316633 - RNA, 22 nt, Homo sapiens
uucauggaauauugaccauuuu

SEQ ID NO: 316634 - RNA, 22 nt, Homo sapiens
uuccacagggauuugcauugau

SEQ ID NO: 316635 - RNA, 22 nt, Homo sapiens
uucccagagagggacuucuaau

SEQ ID NO: 316636 - RNA, 22 nt, Homo sapiens
uucccuuucugaaaaucucauu

SEQ ID NO: 316637 - RNA, 22 nt, Homo sapiens
uucccuuugugcauaggauuug

SEQ ID NO: 316638 - RNA, 22 nt, Homo sapiens
uuccuacuguucaucaggaacc

SEQ ID NO: 316639 - RNA, 22 nt, Homo sapiens
uucgcagcucaguucaacuagg

SEQ ID NO: 316640 - RNA, 22 nt, Homo sapiens
uucuaaacaucuuacaaugcau

SEQ ID NO: 316641 - RNA, 22 nt, Homo sapiens
uucuaugguuaccaggcuaguc

SEQ ID NO: 316642 - RNA, 22 nt, Homo sapiens
uucucaauggcaacuuguugcu

SEQ ID NO: 316643 - RNA, 22 nt, Homo sapiens
uucugauggaguaguccacaga

SEQ ID NO: 316644 - RNA, 22 nt, Homo sapiens
uucuggaaaucagcagagggug

SEQ ID NO: 316645 - RNA, 22 nt, Homo sapiens
uucugguuaauacuugcaaaaa

SEQ ID NO: 316646 - RNA, 22 nt, Homo sapiens
uucuuagucaaguuguauuuca

SEQ ID NO: 316647 - RNA, 21 nt, Homo sapiens
uucuucaggcagaaggauuau

SEQ ID NO: 316648 - RNA, 22 nt, Homo sapiens
uucuuugcaugaucucaaaguc

SEQ ID NO: 316649 - RNA, 21 nt, Homo sapiens
uucuuugcucaguguuagagu

SEQ ID NO: 316650 - RNA, 17 nt, Homo sapiens
uugaaugcauuacuugg

SEQ ID NO: 316651 - RNA, 23 nt, Homo sapiens
uugaauguuuccccucccaaauu

SEQ ID NO: 316652 - RNA, 22 nt, Homo sapiens
uugacauauuugugcuuaagaa

SEQ ID NO: 316653 - RNA, 22 nt, Homo sapiens
uugagauggagucucgcugugu

SEQ ID NO: 316654 - RNA, 22 nt, Homo sapiens
uugagguauaaagguagguugu

SEQ ID NO: 316655 - RNA, 20 nt, Homo sapiens
uugaggugugaggggcagag

SEQ ID NO: 316656 - RNA, 22 nt, Homo sapiens
uugcaaaguugccaaggaagga

SEQ ID NO: 316657 - RNA, 21 nt, Homo sapiens
uugcaaaugcugcugccugau

SEQ ID NO: 316658 - RNA, 22 nt, Homo sapiens
uugcaccuugaagccaauagca

SEQ ID NO: 316659 - RNA, 20 nt, Homo sapiens
uugcagagcccaacccugga

SEQ ID NO: 316660 - RNA, 22 nt, Homo sapiens
uugcaguagucugaaagcaaua

SEQ ID NO: 316661 - RNA, 22 nt, Homo sapiens
uugcagugugacgacuauauuu

SEQ ID NO: 316662 - RNA, 22 nt, Homo sapiens
uugcauauguugaaccagccuu

SEQ ID NO: 316663 - RNA, 22 nt, Homo sapiens
uugcuuaggcuggagugcagug

SEQ ID NO: 316664 - RNA, 22 nt, Homo sapiens
uugcuuuguuacugcaguuucc

SEQ ID NO: 316665 - RNA, 22 nt, Homo sapiens
uugcuuuguugucuggggaaua

SEQ ID NO: 316666 - RNA, 22 nt, Homo sapiens
uuggaauuaagagauauuuucu

SEQ ID NO: 316667 - RNA, 22 nt, Homo sapiens
uuggcaaaugucacaaaucagg

SEQ ID NO: 316668 - RNA, 22 nt, Homo sapiens
uuggcagaguuaauuuguugag

SEQ ID NO: 316669 - RNA, 22 nt, Homo sapiens
uuggcauugaguuucaaaucau

SEQ ID NO: 316670 - RNA, 20 nt, Homo sapiens
uuggcauuuagacaagaguu

SEQ ID NO: 316671 - RNA, 23 nt, Homo sapiens
uuggccuccuugugucuagggcu

SEQ ID NO: 316672 - RNA, 22 nt, Homo sapiens
uuggcuuguaaaaugaaaagcu

SEQ ID NO: 316673 - RNA, 23 nt, Homo sapiens
uuggucucccaaaguguugagau

SEQ ID NO: 316674 - RNA, 22 nt, Homo sapiens
uuguaaacaucuguacauugcu

SEQ ID NO: 316675 - RNA, 22 nt, Homo sapiens
uugucaaacucauucuccaucc

SEQ ID NO: 316676 - RNA, 22 nt, Homo sapiens
uugucacuauaaauaagcauuu

SEQ ID NO: 316677 - RNA, 22 nt, Homo sapiens
uuguccuugagauaguuugcag

SEQ ID NO: 316678 - RNA, 22 nt, Homo sapiens
uugugaucuucagaaaguggcu

SEQ ID NO: 316679 - RNA, 21 nt, Homo sapiens
uugugccaaacccuggaggga

SEQ ID NO: 316680 - RNA, 22 nt, Homo sapiens
uugugguuuuagcacuguggau

SEQ ID NO: 316681 - RNA, 22 nt, Homo sapiens
uuguuauguuaaacuacugaaa

SEQ ID NO: 316682 - RNA, 22 nt, Homo sapiens
uuguuauguuggucaguaaugu

SEQ ID NO: 316683 - RNA, 22 nt, Homo sapiens
uuuaaggcaugccuguacaugc

SEQ ID NO: 316684 - RNA, 22 nt, Homo sapiens
uuuauucggcuaggagcuucgg

SEQ ID NO: 316685 - RNA, 22 nt, Homo sapiens
uuucaggcagggagcuucagug

SEQ ID NO: 316686 - RNA, 22 nt, Homo sapiens
uuucauggaggcauuuuagauu

SEQ ID NO: 316687 - RNA, 22 nt, Homo sapiens
uuuccauguuggugaaaugagg

SEQ ID NO: 316688 - RNA, 20 nt, Homo sapiens
uuucuccccuauaaaucuca

SEQ ID NO: 316689 - RNA, 21 nt, Homo sapiens
uuucugggggagcauggcagg

SEQ ID NO: 316690 - RNA, 23 nt, Homo sapiens
uuucuugggcaugcuaugucagu

SEQ ID NO: 316691 - RNA, 22 nt, Homo sapiens
uuugacuacugaugguguacgc

SEQ ID NO: 316692 - RNA, 22 nt, Homo sapiens
uuugcaccuuccuaguggcuga

SEQ ID NO: 316693 - RNA, 22 nt, Homo sapiens
uuugcugagucauuccaugcug

SEQ ID NO: 316694 - RNA, 22 nt, Homo sapiens
uuuggcaacguuggaucccuca

SEQ ID NO: 316695 - RNA, 22 nt, Homo sapiens
uuuggcaauuugacuguauagg

SEQ ID NO: 316696 - RNA, 22 nt, Homo sapiens
uuuggcauauuuuaagcugguu

SEQ ID NO: 316697 - RNA, 22 nt, Homo sapiens
uuuggcccccagcucaggacau

SEQ ID NO: 316698 - RNA, 22 nt, Homo sapiens
uuugguccuccuacagggcagg

SEQ ID NO: 316699 - RNA, 22 nt, Homo sapiens
uuugguugccucuaugagccug

SEQ ID NO: 316700 - RNA, 22 nt, Homo sapiens
uuugguuuuuguuaucacucau

SEQ ID NO: 316701 - RNA, 19 nt, Homo sapiens
uuuguauguuuccaguaau

SEQ ID NO: 316702 - RNA, 22 nt, Homo sapiens
uuugucauagcagcaggaaugg

SEQ ID NO: 316703 - RNA, 22 nt, Homo sapiens
uuuguucuucguuccugagcca

SEQ ID NO: 316704 - RNA, 22 nt, Homo sapiens
uuuugcaauauguuccugaaua

SEQ ID NO: 316705 - RNA, 22 nt, Homo sapiens
uuuugcaguuacagagagugag

SEQ ID NO: 316706 - RNA, 22 nt, Homo sapiens
uuuugcucuucggaagagcuug

SEQ ID NO: 316707 - RNA, 22 nt, Homo sapiens
uuuuggcacuuugucugauucu

SEQ ID NO: 316708 - RNA, 22 nt, Homo sapiens
uuuugguuguuggguaagagua

SEQ ID NO: 316709 - RNA, 22 nt, Homo sapiens
uuuuguacgccuguguccauca

SEQ ID NO: 316710 - RNA, 22 nt, Homo sapiens
aaaaggcuagcuaguaacagaa

SEQ ID NO: 316711 - RNA, 20 nt, Homo sapiens
aaacucugucuucuuuauca

SEQ ID NO: 316712 - RNA, 20 nt, Homo sapiens
aaaggcugugagaacgagau

SEQ ID NO: 316713 - RNA, 22 nt, Homo sapiens
aaagucuguuacagcuauuucu

SEQ ID NO: 316714 - RNA, 22 nt, Homo sapiens
aaagugcugagacagacuggga

SEQ ID NO: 316715 - RNA, 22 nt, Homo sapiens
aaaugcacaaagauuuugcacu

SEQ ID NO: 316716 - RNA, 22 nt, Homo sapiens
aaaugcagucuuuguucugggc

SEQ ID NO: 316717 - RNA, 22 nt, Homo sapiens
aaaugcaguugguggggauaug

SEQ ID NO: 316718 - RNA, 22 nt, Homo sapiens
aaaugcauaucaagauugcccu

SEQ ID NO: 316719 - RNA, 22 nt, Homo sapiens
aaaugcaucauuaggugauuuu

SEQ ID NO: 316720 - RNA, 22 nt, Homo sapiens
aaaugcauugagggaaaaggca

SEQ ID NO: 316721 - RNA, 22 nt, Homo sapiens
aaaugcuuucuuggaccauuug

SEQ ID NO: 316722 - RNA, 22 nt, Homo sapiens
aaauggcuuugaggguaggaca

SEQ ID NO: 316723 - RNA, 22 nt, Homo sapiens
aaauugcaaugcgaggcagagg

SEQ ID NO: 316724 - RNA, 22 nt, Homo sapiens
aacacggcccgcagagcaagcu

SEQ ID NO: 316725 - RNA, 22 nt, Homo sapiens
aacacuaucugccuuacaggga

SEQ ID NO: 316726 - RNA, 22 nt, Homo sapiens
aacaggguguuugcaguuucuu

SEQ ID NO: 316727 - RNA, 22 nt, Homo sapiens
aacagucuccaguuguauccau

SEQ ID NO: 316728 - RNA, 22 nt, Homo sapiens
aacagugcauuccuguccauau

SEQ ID NO: 316729 - RNA, 22 nt, Homo sapiens
aacugcuguuuggguacuggug

SEQ ID NO: 316730 - RNA, 22 nt, Homo sapiens
aagagguaggaaauggucauuu

SEQ ID NO: 316731 - RNA, 23 nt, Homo sapiens
aagagguaugacuaugaagugga

SEQ ID NO: 316732 - RNA, 22 nt, Homo sapiens
aagcaucacauaauggaucaug

SEQ ID NO: 316733 - RNA, 22 nt, Homo sapiens
aagcaugguuuccaggggucac

SEQ ID NO: 316734 - RNA, 22 nt, Homo sapiens
aagcuggagugcaguggugcga

SEQ ID NO: 316735 - RNA, 22 nt, Homo sapiens
aagcuguuguucauccugaauu

SEQ ID NO: 316736 - RNA, 22 nt, Homo sapiens
aaggaguagacaacauggcgcc

SEQ ID NO: 316737 - RNA, 22 nt, Homo sapiens
aaggcuguucauuuagcacagu

SEQ ID NO: 316738 - RNA, 22 nt, Homo sapiens
aagggaaugcgcugccuguguu

SEQ ID NO: 316739 - RNA, 19 nt, Homo sapiens
aaguaguugugacagaugc

SEQ ID NO: 316740 - RNA, 22 nt, Homo sapiens
aaguauuagcuaauugugcuua

SEQ ID NO: 316741 - RNA, 22 nt, Homo sapiens
aagugcaaauucccaggcucug

SEQ ID NO: 316742 - RNA, 22 nt, Homo sapiens
aagugcuggccuacucaaucga

SEQ ID NO: 316743 - RNA, 22 nt, Homo sapiens
aagugcugggauuggccgggca

SEQ ID NO: 316744 - RNA, 22 nt, Homo sapiens
aagugcuuuuuagauaugguuu

SEQ ID NO: 316745 - RNA, 22 nt, Homo sapiens
aagugucuuaccgggagggagu

SEQ ID NO: 316746 - RNA, 22 nt, Homo sapiens
cuggucaagagcaaaggccagg

SEQ ID NO: 316747 - RNA, 22 nt, Homo sapiens
cuguaugugagaaauaauaagu

SEQ ID NO: 316748 - RNA, 22 nt, Homo sapiens
cugucacugggaggggcagcag

SEQ ID NO: 316749 - RNA, 22 nt, Homo sapiens
cugugcuugauuauaugagugu

SEQ ID NO: 316750 - RNA, 20 nt, Homo sapiens
cuuaaugcagcauuucucag

SEQ ID NO: 316751 - RNA, 22 nt, Homo sapiens
cuucaugagacuuuuggaaggc

SEQ ID NO: 316752 - RNA, 22 nt, Homo sapiens
cuugcagagcccauggauguca

SEQ ID NO: 316753 - RNA, 22 nt, Homo sapiens
cuugcagagucauucuaauuuc

SEQ ID NO: 316754 - RNA, 22 nt, Homo sapiens
cuuggcauugccccuggaauuu

SEQ ID NO: 316755 - RNA, 22 nt, Homo sapiens
cuuggcauuguguugauagaag

SEQ ID NO: 316756 - RNA, 22 nt, Homo sapiens
cuuugauuauaaaaggguguuu

SEQ ID NO: 316757 - RNA, 22 nt, Homo sapiens
cuuugcaaauggccuuuccaag

SEQ ID NO: 316758 - RNA, 20 nt, Homo sapiens
cuuuggcaaugagaacaggg

SEQ ID NO: 316759 - RNA, 22 nt, Homo sapiens
cuuuuacacuguuagugggaau

SEQ ID NO: 316760 - RNA, 22 nt, Homo sapiens
cuuuuacacuguuggcaggauu

SEQ ID NO: 316761 - RNA, 22 nt, Homo sapiens
cuuuuggcuuagaauugucuug

SEQ ID NO: 316762 - RNA, 22 nt, Homo sapiens
cuuuuugcaaauacaacucuga

SEQ ID NO: 316763 - RNA, 22 nt, Homo sapiens
gaacuguuucuggugaaagagu

SEQ ID NO: 316764 - RNA, 22 nt, Homo sapiens
gaaggugcuuggugaaugcauu

SEQ ID NO: 316765 - RNA, 22 nt, Homo sapiens
gaagugcuuuuggacuaacagu

SEQ ID NO: 316766 - RNA, 22 nt, Homo sapiens
gaaucacagauuaugaguaucu

SEQ ID NO: 316767 - RNA, 22 nt, Homo sapiens
gaaugcuaccagcaucuagugg

SEQ ID NO: 316768 - RNA, 22 nt, Homo sapiens
gacagacacaauugauccauga

SEQ ID NO: 316769 - RNA, 22 nt, Homo sapiens
gagaaugagaggggaaggccac

SEQ ID NO: 316770 - RNA, 22 nt, Homo sapiens
gagacugagucucgcucugccg

SEQ ID NO: 316771 - RNA, 22 nt, Homo sapiens
gagacugagucuugcucuguca

SEQ ID NO: 316772 - RNA, 22 nt, Homo sapiens
gagagcaugugcuggcaucagu

SEQ ID NO: 316773 - RNA, 22 nt, Homo sapiens
gagaggucguauaugauuucug

SEQ ID NO: 316774 - RNA, 22 nt, Homo sapiens
gagauguagucuugcccuguca

SEQ ID NO: 316775 - RNA, 21 nt, Homo sapiens
gagcuaggugaggcuguaaug

SEQ ID NO: 316776 - RNA, 22 nt, Homo sapiens
gagcuagguuuugaauccagac

SEQ ID NO: 316777 - RNA, 22 nt, Homo sapiens
gagcuuguagugugaaugguau

SEQ ID NO: 316778 - RNA, 22 nt, Homo sapiens
gagguaaguaagaauggcaagc

SEQ ID NO: 316779 - RNA, 22 nt, Homo sapiens
gagguuauuggggugcuugugu

SEQ ID NO: 316780 - RNA, 21 nt, Homo sapiens
gagugcaaauaaagagagggc

SEQ ID NO: 316781 - RNA, 22 nt, Homo sapiens
gagugcaauggcaagaucuugg

SEQ ID NO: 316782 - RNA, 22 nt, Homo sapiens
gagugcaauggcaugaucuugg

SEQ ID NO: 316783 - RNA, 22 nt, Homo sapiens
gagugcaauggcgcgaucuggg

SEQ ID NO: 316784 - RNA, 22 nt, Homo sapiens
gaucucaguggauacugugaug

SEQ ID NO: 316785 - RNA, 22 nt, Homo sapiens
gcaaaguguuuuccaacuuggu

SEQ ID NO: 316786 - RNA, 22 nt, Homo sapiens
gcacagucaacacuuauucacc

SEQ ID NO: 316787 - RNA, 22 nt, Homo sapiens
gcagagaaacaggucuaaggag

SEQ ID NO: 316788 - RNA, 19 nt, Homo sapiens
gcagagaugugguagcuug

SEQ ID NO: 316789 - RNA, 23 nt, Homo sapiens
gcagcaaugucacagggguccgg

SEQ ID NO: 316790 - RNA, 22 nt, Homo sapiens
gcaguagugugaucuuggcuca

SEQ ID NO: 316791 - RNA, 23 nt, Homo sapiens
gcagucauuuggaaaagguugaa

SEQ ID NO: 316792 - RNA, 17 nt, Homo sapiens
gcauauguugaaccagc

SEQ ID NO: 316793 - RNA, 22 nt, Homo sapiens
gcucguuuuugccucugguugc

SEQ ID NO: 316794 - RNA, 22 nt, Homo sapiens
gcuggguucagagugggcugcg

SEQ ID NO: 316795 - RNA, 22 nt, Homo sapiens
gcugguauuacaggcaugagcc

SEQ ID NO: 316796 - RNA, 22 nt, Homo sapiens
gcuguugugaacuauacaucua

SEQ ID NO: 316797 - RNA, 22 nt, Homo sapiens
gcuucauggaggcugggcgcag

SEQ ID NO: 316798 - RNA, 22 nt, Homo sapiens
ggaaagaucagcuaaauguaag

SEQ ID NO: 316799 - RNA, 22 nt, Homo sapiens
ggaaaguaacccauucucuuac

SEQ ID NO: 316800 - RNA, 21 nt, Homo sapiens
ggaaaguuaaggaaauacccc

SEQ ID NO: 316801 - RNA, 23 nt, Homo sapiens
ggaaugaaaccugguuaugauau

SEQ ID NO: 316802 - RNA, 22 nt, Homo sapiens
ggaauguaguaauuugguuagu

SEQ ID NO: 316803 - RNA, 22 nt, Homo sapiens
ggacuaggagcuaggaagaucu

SEQ ID NO: 316804 - RNA, 20 nt, Homo sapiens
ggagguguugauuuuucuuu

SEQ ID NO: 316805 - RNA, 22 nt, Homo sapiens
ggaguaaaagaguaggaggaau

SEQ ID NO: 316806 - RNA, 22 nt, Homo sapiens
ggagucugacuuauaggaaccu

SEQ ID NO: 316807 - RNA, 22 nt, Homo sapiens
ggagucugauguucuaaggcag

SEQ ID NO: 316808 - RNA, 22 nt, Homo sapiens
ggagugucagaaacaguguccu

SEQ ID NO: 316809 - RNA, 22 nt, Homo sapiens
ggagugucccaaucucagcuca

SEQ ID NO: 316810 - RNA, 22 nt, Homo sapiens
ggcaacaauuccuacuucuuuu

SEQ ID NO: 316811 - RNA, 22 nt, Homo sapiens
ggcaaggauuagauucuccccu

SEQ ID NO: 316812 - RNA, 22 nt, Homo sapiens
ggcagaguggacauuuaaaugu

SEQ ID NO: 316813 - RNA, 22 nt, Homo sapiens
ggcauguuuaguagaauguggu

SEQ ID NO: 316814 - RNA, 22 nt, Homo sapiens
ggcuagagagcucagggauaug

SEQ ID NO: 316815 - RNA, 22 nt, Homo sapiens
ggcuauagauaugugaacacuu

SEQ ID NO: 316816 - RNA, 22 nt, Homo sapiens
ggcucagugggguccugguucu

SEQ ID NO: 316817 - RNA, 22 nt, Homo sapiens
ggcugguuuucaguuacugagu

SEQ ID NO: 316818 - RNA, 22 nt, Homo sapiens
ggcuuuggucacacaggggcaa

SEQ ID NO: 316819 - RNA, 22 nt, Homo sapiens
gggaguguguaggacccagugu

SEQ ID NO: 316820 - RNA, 20 nt, Homo sapiens
gggcaaguaugugggaaguc

SEQ ID NO: 316821 - RNA, 22 nt, Homo sapiens
gggcaugauggugcacacaugu

SEQ ID NO: 316822 - RNA, 22 nt, Homo sapiens
gggguaggcuacacugaguucc

SEQ ID NO: 316823 - RNA, 19 nt, Homo sapiens
ggucagcaaagucuagcug

SEQ ID NO: 316824 - RNA, 21 nt, Homo sapiens
ggugagaaaggagacauagac

SEQ ID NO: 316825 - RNA, 22 nt, Homo sapiens
guaaauaccaguuucuggaaca

SEQ ID NO: 316826 - RNA, 22 nt, Homo sapiens
guacauggaaugaaauucaaaa

SEQ ID NO: 316827 - RNA, 22 nt, Homo sapiens
guauaguaguacaaaaguuuuu

SEQ ID NO: 316828 - RNA, 22 nt, Homo sapiens
guaugauacuguaacagugggu

SEQ ID NO: 316829 - RNA, 22 nt, Homo sapiens
gucaaaugcacagaaccauuaa

SEQ ID NO: 316830 - RNA, 22 nt, Homo sapiens
gucaacauauuaauuauguucu

SEQ ID NO: 316831 - RNA, 22 nt, Homo sapiens
gucagcuuuuccuuacuuuagg

SEQ ID NO: 316832 - RNA, 22 nt, Homo sapiens
gucauggagggacauaacuaac

SEQ ID NO: 316833 - RNA, 22 nt, Homo sapiens
guccaguacucuuuccugaaaa

SEQ ID NO: 316834 - RNA, 20 nt, Homo sapiens
guccauuugcugccauugcu

SEQ ID NO: 316835 - RNA, 22 nt, Homo sapiens
guccuugaggcuuugacugugg

SEQ ID NO: 316836 - RNA, 22 nt, Homo sapiens
gucucccagccuacauauuucu

SEQ ID NO: 316837 - RNA, 22 nt, Homo sapiens
gugaaagauuaaaccagugugu

SEQ ID NO: 316838 - RNA, 22 nt, Homo sapiens
gugacagaguaagacccuguau

SEQ ID NO: 316839 - RNA, 22 nt, Homo sapiens
gugacagucaaagacaugacuu

SEQ ID NO: 316840 - RNA, 21 nt, Homo sapiens
gugaggucauugggcuuucug

SEQ ID NO: 316841 - RNA, 22 nt, Homo sapiens
gugaucuuucaggcuugaccau

SEQ ID NO: 316842 - RNA, 22 nt, Homo sapiens
gugaugguaguuuguauuucug

SEQ ID NO: 316843 - RNA, 22 nt, Homo sapiens
gugcaaguguaauacagcuagg

SEQ ID NO: 316844 - RNA, 22 nt, Homo sapiens
gugcacaacgugcagguuaguu

SEQ ID NO: 316845 - RNA, 22 nt, Homo sapiens
gugcuuguauuuaaaucaugug

SEQ ID NO: 316846 - RNA, 22 nt, Homo sapiens
guggaaaacauaugcuuguuga

SEQ ID NO: 316847 - RNA, 22 nt, Homo sapiens
guggaaaauuauugcuguuuuu

SEQ ID NO: 316848 - RNA, 22 nt, Homo sapiens
guggaaggucaugaauguucuu

SEQ ID NO: 316849 - RNA, 22 nt, Homo sapiens
guggacggagguugcagugagc

SEQ ID NO: 316850 - RNA, 22 nt, Homo sapiens
guggcaagaauguacaaaaggu

SEQ ID NO: 316851 - RNA, 22 nt, Homo sapiens
guggcagaacagguaggguucu

SEQ ID NO: 316852 - RNA, 19 nt, Homo sapiens
gugugcauaucacagagca

SEQ ID NO: 316853 - RNA, 22 nt, Homo sapiens
guuaaagacauccacauaggag

SEQ ID NO: 316854 - RNA, 22 nt, Homo sapiens
guuacagucuuguguaagguua

SEQ ID NO: 316855 - RNA, 22 nt, Homo sapiens
guucaucagggauacuggccuu

SEQ ID NO: 316856 - RNA, 23 nt, Homo sapiens
guucaucagggauauuggccuga

SEQ ID NO: 316857 - RNA, 22 nt, Homo sapiens
guugcucaggccggagugcagu

SEQ ID NO: 316858 - RNA, 22 nt, Homo sapiens
guugcucaggcugaagugcagu

SEQ ID NO: 316859 - RNA, 22 nt, Homo sapiens
uaaagcauguaauuagguuaga

SEQ ID NO: 316860 - RNA, 22 nt, Homo sapiens
uaaagcugaaaugauuaugaca

SEQ ID NO: 316861 - RNA, 21 nt, Homo sapiens
uaaagcuuagcuauaguggcu

SEQ ID NO: 316862 - RNA, 21 nt, Homo sapiens
uaaaggcuccaauuauacccc

SEQ ID NO: 316863 - RNA, 22 nt, Homo sapiens
uaaaugacugucaguagaugaa

SEQ ID NO: 316864 - RNA, 22 nt, Homo sapiens
uaacaguguauuuacuacuucc

SEQ ID NO: 316865 - RNA, 22 nt, Homo sapiens
uaacauucacaugcugcaaaaa

SEQ ID NO: 316866 - RNA, 20 nt, Homo sapiens
uaaggcacugugcuuuuagg

SEQ ID NO: 316867 - RNA, 20 nt, Homo sapiens
uaagugcauaggauauuucu

SEQ ID NO: 316868 - RNA, 22 nt, Homo sapiens
uaauaguguuaaugcuagagcu

SEQ ID NO: 316869 - RNA, 22 nt, Homo sapiens
uacaacacugguucgacaugug

SEQ ID NO: 316870 - RNA, 22 nt, Homo sapiens
uacagaauucugucccuugagu

SEQ ID NO: 316871 - RNA, 23 nt, Homo sapiens
uacagcugcagaaucaggcuaag

SEQ ID NO: 316872 - RNA, 22 nt, Homo sapiens
uacaguaauguuaaucuuugug

SEQ ID NO: 316873 - RNA, 22 nt, Homo sapiens
uacaguagaaugucuuucaaaa

SEQ ID NO: 316874 - RNA, 22 nt, Homo sapiens
uacaguaguaucuucauuuguu

SEQ ID NO: 316875 - RNA, 22 nt, Homo sapiens
uaccuaguaggagggaggugga

SEQ ID NO: 316876 - RNA, 22 nt, Homo sapiens
uacucuuuagcuccuuaaggaa

SEQ ID NO: 316877 - RNA, 22 nt, Homo sapiens
uacuuuguagauuguuuccuuu

SEQ ID NO: 316878 - RNA, 22 nt, Homo sapiens
uagaaugcauuagguugcccag

SEQ ID NO: 316879 - RNA, 22 nt, Homo sapiens
uagcaacauucagcucagguac

SEQ ID NO: 316880 - RNA, 22 nt, Homo sapiens
uagcaccucuuuggccuuucgu

SEQ ID NO: 316881 - RNA, 22 nt, Homo sapiens
uagcagacuauuuugugauaau

SEQ ID NO: 316882 - RNA, 22 nt, Homo sapiens
uaggcaauggagauagaggaug

SEQ ID NO: 316883 - RNA, 22 nt, Homo sapiens
uagguuaucucaaguguaauuu

SEQ ID NO: 316884 - RNA, 22 nt, Homo sapiens
uagguuaugauccaucuuggcu

SEQ ID NO: 316885 - RNA, 22 nt, Homo sapiens
uagugcugagauugagaagccc

SEQ ID NO: 316886 - RNA, 21 nt, Homo sapiens
uagugcugaggcaguauggga

SEQ ID NO: 316887 - RNA, 22 nt, Homo sapiens
uagugcuguaauucuaaugaaa

SEQ ID NO: 316888 - RNA, 22 nt, Homo sapiens
uaguucauuauguguugcucag

SEQ ID NO: 316889 - RNA, 22 nt, Homo sapiens
uauaacacccacauauagucuu

SEQ ID NO: 316890 - RNA, 22 nt, Homo sapiens
uauacagcaaguuacugugcug

SEQ ID NO: 316891 - RNA, 22 nt, Homo sapiens
uauacaugugccauguuggugu

SEQ ID NO: 316892 - RNA, 22 nt, Homo sapiens
uauacuguuuucuauaguggcu

SEQ ID NO: 316893 - RNA, 22 nt, Homo sapiens
uauagcacugaccuuccaggac

SEQ ID NO: 316894 - RNA, 21 nt, Homo sapiens
uauaugacuuacuauugccuc

SEQ ID NO: 316895 - RNA, 22 nt, Homo sapiens
uaugaaagcuacuucucacaau

SEQ ID NO: 316896 - RNA, 17 nt, Homo sapiens
uauguaguacuuauaaa

SEQ ID NO: 316897 - RNA, 22 nt, Homo sapiens
uaugugcaaauuaauugcuaga

SEQ ID NO: 316898 - RNA, 22 nt, Homo sapiens
uauuacacuuuagugucuucca

SEQ ID NO: 316899 - RNA, 22 nt, Homo sapiens
uauugcucaugcauuuaauuuc

SEQ ID NO: 316900 - RNA, 22 nt, Homo sapiens
ucaaaaucucuuagcugugucu

SEQ ID NO: 316901 - RNA, 22 nt, Homo sapiens
ucaacacaguuaaauggggaaa

SEQ ID NO: 316902 - RNA, 22 nt, Homo sapiens
ucaacauugcugucaggcaucu

SEQ ID NO: 316903 - RNA, 22 nt, Homo sapiens
ucaagcaauucgccugucucag

SEQ ID NO: 316904 - RNA, 22 nt, Homo sapiens
ucaagcaauucuccugccucag

SEQ ID NO: 316905 - RNA, 19 nt, Homo sapiens
ucaagcuauucuccugccu

SEQ ID NO: 316906 - RNA, 22 nt, Homo sapiens
ucacaguauucaugaacaugga

SEQ ID NO: 316907 - RNA, 22 nt, Homo sapiens
ucacagucacugucacguugaa

SEQ ID NO: 316908 - RNA, 22 nt, Homo sapiens
ucacagucggugacuucuugcu

SEQ ID NO: 316909 - RNA, 22 nt, Homo sapiens
ucacauaguuuucgggaccuug

SEQ ID NO: 316910 - RNA, 21 nt, Homo sapiens
ucacauggccagaguaggaac

SEQ ID NO: 316911 - RNA, 22 nt, Homo sapiens
ucaccaccuuccaggaccacug

SEQ ID NO: 316912 - RNA, 22 nt, Homo sapiens
ucaccuggggcacagcugaaga

SEQ ID NO: 316913 - RNA, 22 nt, Homo sapiens
ucacugaaaccacugccuccug

SEQ ID NO: 316914 - RNA, 22 nt, Homo sapiens
ucacugaaaccuccaccucucg

SEQ ID NO: 316915 - RNA, 22 nt, Homo sapiens
ucacugaaacuguccuggguua

SEQ ID NO: 316916 - RNA, 21 nt, Homo sapiens
ucacugagcaucaugguuuca

SEQ ID NO: 316917 - RNA, 22 nt, Homo sapiens
ucacuuuguuuuuggauaaguu

SEQ ID NO: 316918 - RNA, 22 nt, Homo sapiens
ucagaaccucugauuuauacuu

SEQ ID NO: 316919 - RNA, 22 nt, Homo sapiens
ucagacacugcccuccaccugu

SEQ ID NO: 316920 - RNA, 22 nt, Homo sapiens
ucagacacuguggccuuuggac

SEQ ID NO: 316921 - RNA, 22 nt, Homo sapiens
ucagagugcagggaguagcagc

SEQ ID NO: 316922 - RNA, 22 nt, Homo sapiens
ucagcaaugaccuaagcaaaua

SEQ ID NO: 316923 - RNA, 22 nt, Homo sapiens
ucagcagugugaaaacaaacua

SEQ ID NO: 316924 - RNA, 22 nt, Homo sapiens
ucagcagugugaaaauggacua

SEQ ID NO: 316925 - RNA, 22 nt, Homo sapiens
ucaggugcaguggcucaugcuu

SEQ ID NO: 316926 - RNA, 22 nt, Homo sapiens
ucaggugcaguggcucugaccu

SEQ ID NO: 316927 - RNA, 22 nt, Homo sapiens
ucaguacuuuggagcucacaua

SEQ ID NO: 316928 - RNA, 17 nt, Homo sapiens
gcugcauucauguagaa

SEQ ID NO: 316929 - RNA, 22 nt, Homo sapiens
gcuguauugacuuuguaucaua

SEQ ID NO: 316930 - RNA, 22 nt, Homo sapiens
gcuugguccccacccaaaucgc

SEQ ID NO: 316931 - RNA, 22 nt, Homo sapiens
gcuuugcaauggcauugaccau

SEQ ID NO: 316932 - RNA, 23 nt, Homo sapiens
ggaaacauccagucuuucaccau

SEQ ID NO: 316933 - RNA, 22 nt, Homo sapiens
ggaaagacuauuguaaaggaug

SEQ ID NO: 316934 - RNA, 22 nt, Homo sapiens
ggaaagauguaauauuaucuaa

SEQ ID NO: 316935 - RNA, 22 nt, Homo sapiens
ggaagguaauuggcuaaugaga

SEQ ID NO: 316936 - RNA, 17 nt, Homo sapiens
ggaaugaauuccagccc

SEQ ID NO: 316937 - RNA, 22 nt, Homo sapiens
ggaaugagaaauauuacacaau

SEQ ID NO: 316938 - RNA, 22 nt, Homo sapiens
ggaauggaacaaagucuugaaa

SEQ ID NO: 316939 - RNA, 22 nt, Homo sapiens
ggacauguauauauaugugugu

SEQ ID NO: 316940 - RNA, 22 nt, Homo sapiens
ggacuguaauaccaugaggaca

SEQ ID NO: 316941 - RNA, 22 nt, Homo sapiens
ggagaucuuguuaaaguacaga

SEQ ID NO: 316942 - RNA, 22 nt, Homo sapiens
ggagugucugugcuggucaaag

SEQ ID NO: 316943 - RNA, 22 nt, Homo sapiens
ggcaaagagacaugcaucgggg

SEQ ID NO: 316944 - RNA, 22 nt, Homo sapiens
ggcaccacagacgccaggcgug

SEQ ID NO: 316945 - RNA, 22 nt, Homo sapiens
ggcagagucuugcaucuuuaga

SEQ ID NO: 316946 - RNA, 22 nt, Homo sapiens
ggcagguaaggagugggagccu

SEQ ID NO: 316947 - RNA, 22 nt, Homo sapiens
ggcaguggaagugccaguuucu

SEQ ID NO: 316948 - RNA, 22 nt, Homo sapiens
ggcauguguggguuauuaaaga

SEQ ID NO: 316949 - RNA, 22 nt, Homo sapiens
gggaaaaugucuauugaaugaa

SEQ ID NO: 316950 - RNA, 22 nt, Homo sapiens
gggaagguaaucauuacuugau

SEQ ID NO: 316951 - RNA, 22 nt, Homo sapiens
gggaggucauuguucaaugcug

SEQ ID NO: 316952 - RNA, 22 nt, Homo sapiens
gggcaacauugaguacccugaa

SEQ ID NO: 316953 - RNA, 22 nt, Homo sapiens
gggcagaugucuggacaccuca

SEQ ID NO: 316954 - RNA, 22 nt, Homo sapiens
ggggcaaaaugccacgagucuc

SEQ ID NO: 316955 - RNA, 22 nt, Homo sapiens
gggggagugugguacccagcau

SEQ ID NO: 316956 - RNA, 22 nt, Homo sapiens
ggucaacaucaucaugguaagu

SEQ ID NO: 316957 - RNA, 22 nt, Homo sapiens
ggucugguguugaaauucuuca

SEQ ID NO: 316958 - RNA, 22 nt, Homo sapiens
guaacacaugcugcucucuggu

SEQ ID NO: 316959 - RNA, 16 nt, Homo sapiens
guacacaguaaguaug

SEQ ID NO: 316960 - RNA, 22 nt, Homo sapiens
guacaggugcaggaugggcagg

SEQ ID NO: 316961 - RNA, 22 nt, Homo sapiens
guacaugugcacagugugcagg

SEQ ID NO: 316962 - RNA, 22 nt, Homo sapiens
guagaagcacagggccuguauu

SEQ ID NO: 316963 - RNA, 22 nt, Homo sapiens
guauacaugucaaaacucacau

SEQ ID NO: 316964 - RNA, 22 nt, Homo sapiens
guauacuucugaaaauagcuau

SEQ ID NO: 316965 - RNA, 21 nt, Homo sapiens
guauggcauugauuaguuacu

SEQ ID NO: 316966 - RNA, 22 nt, Homo sapiens
gucaggaccucgguggcauucu

SEQ ID NO: 316967 - RNA, 22 nt, Homo sapiens
gucauggacaaggugugagcca

SEQ ID NO: 316968 - RNA, 22 nt, Homo sapiens
guccaaagugggagaggugggg

SEQ ID NO: 316969 - RNA, 21 nt, Homo sapiens
gucugguguuuuaaugaggac

SEQ ID NO: 316970 - RNA, 22 nt, Homo sapiens
gugacacuggagcuggcacaau

SEQ ID NO: 316971 - RNA, 22 nt, Homo sapiens
gugagaaucaaacuacauaaau

SEQ ID NO: 316972 - RNA, 22 nt, Homo sapiens
gugagcauuacucaugggauca

SEQ ID NO: 316973 - RNA, 22 nt, Homo sapiens
gugagucaugucccaucugauu

SEQ ID NO: 316974 - RNA, 22 nt, Homo sapiens
gugcaacaucccuccauaauuu

SEQ ID NO: 316975 - RNA, 22 nt, Homo sapiens
gugcacaaaucuuaaauguaca

SEQ ID NO: 316976 - RNA, 22 nt, Homo sapiens
gugcaguuuacaguuacccagu

SEQ ID NO: 316977 - RNA, 22 nt, Homo sapiens
gugcucauuuagagagaagcac

SEQ ID NO: 316978 - RNA, 22 nt, Homo sapiens
guggaaaaguaguugcgguuuu

SEQ ID NO: 316979 - RNA, 22 nt, Homo sapiens
guggaaguuaagugacuuucug

SEQ ID NO: 316980 - RNA, 22 nt, Homo sapiens
guggcaaguguuccaagaggcg

SEQ ID NO: 316981 - RNA, 22 nt, Homo sapiens
guggcagaaaagagaagcaaug

SEQ ID NO: 316982 - RNA, 22 nt, Homo sapiens
guggcauuucccaaaguauucu

SEQ ID NO: 316983 - RNA, 22 nt, Homo sapiens
gugggauaauuuuuggugcugu

SEQ ID NO: 316984 - RNA, 22 nt, Homo sapiens
guggguaaaucucuguucgagg

SEQ ID NO: 316985 - RNA, 22 nt, Homo sapiens
guggguaaaucucuguuugagg

SEQ ID NO: 316986 - RNA, 22 nt, Homo sapiens
gugguagaaauguagaugcuag

SEQ ID NO: 316987 - RNA, 22 nt, Homo sapiens
gugguuuuaauauucagucuag

SEQ ID NO: 316988 - RNA, 22 nt, Homo sapiens
gugguuuucaacuccaccugca

SEQ ID NO: 316989 - RNA, 22 nt, Homo sapiens
gugguuuuuaaaguaccugugg

SEQ ID NO: 316990 - RNA, 22 nt, Homo sapiens
gugguuuuuuucugccuuauag

SEQ ID NO: 316991 - RNA, 22 nt, Homo sapiens
guguaugugagaaugcucaugu

SEQ ID NO: 316992 - RNA, 22 nt, Homo sapiens
guucaucagggauacuggccug

SEQ ID NO: 316993 - RNA, 22 nt, Homo sapiens
guugcucaggcuggagugcagu

SEQ ID NO: 316994 - RNA, 22 nt, Homo sapiens
uaaaguuauugccccucaguua

SEQ ID NO: 316995 - RNA, 22 nt, Homo sapiens
uaacaaugucuuaugggcuuaa

SEQ ID NO: 316996 - RNA, 22 nt, Homo sapiens
uaacucugccuagugacauggu

SEQ ID NO: 316997 - RNA, 22 nt, Homo sapiens
uaagcagugcaagaauggaaua

SEQ ID NO: 316998 - RNA, 20 nt, Homo sapiens
uaagcauaguugucaggguc

SEQ ID NO: 316999 - RNA, 22 nt, Homo sapiens
uaaggaaggcugugugcuuuua

SEQ ID NO: 317000 - RNA, 22 nt, Homo sapiens
uaagggacgcccccuucucucu

SEQ ID NO: 317001 - RNA, 22 nt, Homo sapiens
uaagugcuugacuuugauguuu

SEQ ID NO: 317002 - RNA, 22 nt, Homo sapiens
uaaguggugcauuguuaaaugg

SEQ ID NO: 317003 - RNA, 22 nt, Homo sapiens
uaauacuagugaauagcaggau

SEQ ID NO: 317004 - RNA, 22 nt, Homo sapiens
uaaugugaauagugcuguaaug

SEQ ID NO: 317005 - RNA, 16 nt, Homo sapiens
uacaacagugaguaug

SEQ ID NO: 317006 - RNA, 22 nt, Homo sapiens
uacaagcacaggcagcaggcug

SEQ ID NO: 317007 - RNA, 22 nt, Homo sapiens
uacaccaauuuaaucaaaagca

SEQ ID NO: 317008 - RNA, 23 nt, Homo sapiens
uaccacauuccuucuuuccuguu

SEQ ID NO: 317009 - RNA, 22 nt, Homo sapiens
uacccuuuaguauaaaaucaga

SEQ ID NO: 317010 - RNA, 22 nt, Homo sapiens
uacuagaguagugcagagggga

SEQ ID NO: 317011 - RNA, 22 nt, Homo sapiens
uacugcauuucacuguuaaaga

SEQ ID NO: 317012 - RNA, 22 nt, Homo sapiens
uagaacaauugcuggauccgaa

SEQ ID NO: 317013 - RNA, 22 nt, Homo sapiens
uagaagcacuaucccuccuagu

SEQ ID NO: 317014 - RNA, 20 nt, Homo sapiens
uagacagcuagauuagauag

SEQ ID NO: 317015 - RNA, 20 nt, Homo sapiens
uagagagauauggggguucc

SEQ ID NO: 317016 - RNA, 22 nt, Homo sapiens
uagagguagccuacuacacacc

SEQ ID NO: 317017 - RNA, 22 nt, Homo sapiens
uagagguaggucuucgagucuc

SEQ ID NO: 317018 - RNA, 22 nt, Homo sapiens
uagagguauaccaaaaaggcau

SEQ ID NO: 317019 - RNA, 22 nt, Homo sapiens
uagcugaucuuuuaaagaauga

SEQ ID NO: 317020 - RNA, 22 nt, Homo sapiens
uaggaaugaacgauuuauuggu

SEQ ID NO: 317021 - RNA, 22 nt, Homo sapiens
uaggcaauguggcgaaacucug

SEQ ID NO: 317022 - RNA, 22 nt, Homo sapiens
uaggcaguuuuccuuucacagu

SEQ ID NO: 317023 - RNA, 22 nt, Homo sapiens
uaggggcacacuucgguuagca

SEQ ID NO: 317024 - RNA, 22 nt, Homo sapiens
uaggguaguaauaguuguuuca

SEQ ID NO: 317025 - RNA, 22 nt, Homo sapiens
uaguaaacauaguucuuuugcu

SEQ ID NO: 317026 - RNA, 22 nt, Homo sapiens
uaguguuuuucauuggcagagg

SEQ ID NO: 317027 - RNA, 22 nt, Homo sapiens
uaguucauuuuucuugcuuaga

SEQ ID NO: 317028 - RNA, 22 nt, Homo sapiens
uauagcagccugaacaaaguaa

SEQ ID NO: 317029 - RNA, 22 nt, Homo sapiens
uauagcuuuuuagggaauuugg

SEQ ID NO: 317030 - RNA, 22 nt, Homo sapiens
uaucacacgccuugcuucauuu

SEQ ID NO: 317031 - RNA, 22 nt, Homo sapiens
uaugaccuuggacaaguuacuu

SEQ ID NO: 317032 - RNA, 22 nt, Homo sapiens
uaugacuuuggaaaaauuacuu

SEQ ID NO: 317033 - RNA, 22 nt, Homo sapiens
uaugacuuuugaauacagaugg

SEQ ID NO: 317034 - RNA, 22 nt, Homo sapiens
uaugagcacauauguaucuaug

SEQ ID NO: 317035 - RNA, 22 nt, Homo sapiens
uauggcugcuuucacacuacaa

SEQ ID NO: 317036 - RNA, 22 nt, Homo sapiens
uauugcauuugagguugguuga

SEQ ID NO: 317037 - RNA, 22 nt, Homo sapiens
uauuggcucuguuucucugaag

SEQ ID NO: 317038 - RNA, 22 nt, Homo sapiens
uauuugcacucccaucauggug

SEQ ID NO: 317039 - RNA, 22 nt, Homo sapiens
ucaaaugauucuccugccucag

SEQ ID NO: 317040 - RNA, 22 nt, Homo sapiens
ucaaaugcuguauuguaguaau

SEQ ID NO: 317041 - RNA, 22 nt, Homo sapiens
ucaaauguuuguuuaaggcuua

SEQ ID NO: 317042 - RNA, 22 nt, Homo sapiens
ucaaauuccaagucuagguagg

SEQ ID NO: 317043 - RNA, 22 nt, Homo sapiens
ucaacagugggcacuguaaaug

SEQ ID NO: 317044 - RNA, 16 nt, Homo sapiens
ucacaaacucuagcag

SEQ ID NO: 317045 - RNA, 18 nt, Homo sapiens
ucacaaccacagugcugu

SEQ ID NO: 317046 - RNA, 22 nt, Homo sapiens
ucacacugaauuugaagcaaug

SEQ ID NO: 317047 - RNA, 22 nt, Homo sapiens
ucacacugucuugguuacucuu

SEQ ID NO: 317048 - RNA, 22 nt, Homo sapiens
ucacaguuggccuggccuuuua

SEQ ID NO: 317049 - RNA, 22 nt, Homo sapiens
ucacauggcagagaagaagcuc

SEQ ID NO: 317050 - RNA, 22 nt, Homo sapiens
ucacauuguacaaacagguaag

SEQ ID NO: 317051 - RNA, 22 nt, Homo sapiens
ucacauuguguagccugcucac

SEQ ID NO: 317052 - RNA, 22 nt, Homo sapiens
ucaccaccugcugauuguagag

SEQ ID NO: 317053 - RNA, 22 nt, Homo sapiens
ucacugaggucugagcuuuaug

SEQ ID NO: 317054 - RNA, 22 nt, Homo sapiens
ucacugcacuccagccuuuaug

SEQ ID NO: 317055 - RNA, 22 nt, Homo sapiens
ucagaaccuccuagcaguguuc

SEQ ID NO: 317056 - RNA, 22 nt, Homo sapiens
ucagacacugagcaaacgacua

SEQ ID NO: 317057 - RNA, 22 nt, Homo sapiens
ucagaguagaaacacuuccaua

SEQ ID NO: 317058 - RNA, 22 nt, Homo sapiens
ucagaguagagcgacuucuccu

SEQ ID NO: 317059 - RNA, 21 nt, Homo sapiens
ucaggcuuuuugagugccaau

SEQ ID NO: 317060 - RNA, 23 nt, Homo sapiens
ucaguacucuauaagugccagcu

SEQ ID NO: 317061 - RNA, 20 nt, Homo sapiens
ucagugauugguuuaguuau

SEQ ID NO: 317062 - RNA, 22 nt, Homo sapiens
ucauauugcgguucauugacuu

SEQ ID NO: 317063 - RNA, 22 nt, Homo sapiens
ucauccauacaguuagcaaagg

SEQ ID NO: 317064 - RNA, 22 nt, Homo sapiens
ucaucuggcgaaugugaagagu

SEQ ID NO: 317065 - RNA, 22 nt, Homo sapiens
uccaguacaggucucucauuuc

SEQ ID NO: 317066 - RNA, 22 nt, Homo sapiens
uccauuuguuguaggguauagu

SEQ ID NO: 317067 - RNA, 21 nt, Homo sapiens
uccuuggugaugcccugcagu

SEQ ID NO: 317068 - RNA, 22 nt, Homo sapiens
uccuuuggucaguauucuuuug

SEQ ID NO: 317069 - RNA, 22 nt, Homo sapiens
ucgcagcucacuggagccucga

SEQ ID NO: 317070 - RNA, 23 nt, Homo sapiens
ucgguccccuuggcugcccucgg

SEQ ID NO: 317071 - RNA, 22 nt, Homo sapiens
ucucaaccuccacacuacaaua

SEQ ID NO: 317072 - RNA, 22 nt, Homo sapiens
ucucauggagucaggagcagaa

SEQ ID NO: 317073 - RNA, 22 nt, Homo sapiens
ucucauugauucuggggugaug

SEQ ID NO: 317074 - RNA, 19 nt, Homo sapiens
ucugacagccccagucaac

SEQ ID NO: 317075 - RNA, 20 nt, Homo sapiens
ucuggccccuccaaaucuca

SEQ ID NO: 317076 - RNA, 22 nt, Homo sapiens
ucuggcuuucuuuacuuaaugu

SEQ ID NO: 317077 - RNA, 22 nt, Homo sapiens
ucugucuuugucaggaccagag

SEQ ID NO: 317078 - RNA, 22 nt, Homo sapiens
ucuuugauguucugaaagaugg

SEQ ID NO: 317079 - RNA, 19 nt, Homo sapiens
ucuuugcuuuucuaagagg

SEQ ID NO: 317080 - RNA, 22 nt, Homo sapiens
ugaaagacugaaagcuuuucuu

SEQ ID NO: 317081 - RNA, 22 nt, Homo sapiens
ugaaaguaauugcaguuuuuac

SEQ ID NO: 317082 - RNA, 22 nt, Homo sapiens
ugaaaguuauauugugaaauuc

SEQ ID NO: 317083 - RNA, 22 nt, Homo sapiens
ugaaauggaaagaguguagacu

SEQ ID NO: 317084 - RNA, 22 nt, Homo sapiens
ugaacagucaucucucuuguau

SEQ ID NO: 317085 - RNA, 21 nt, Homo sapiens
ugaauauuuggguugugucca

SEQ ID NO: 317086 - RNA, 22 nt, Homo sapiens
ugaaugcuaaaggaaaacagua

SEQ ID NO: 317087 - RNA, 21 nt, Homo sapiens
ugaaugcuuuaaauauuagaa

SEQ ID NO: 317088 - RNA, 23 nt, Homo sapiens
ugaauguaucgaaugugggaaag

SEQ ID NO: 317089 - RNA, 22 nt, Homo sapiens
ugacaugaagaaaaacagauuu

SEQ ID NO: 317090 - RNA, 22 nt, Homo sapiens
ugacuaggaaauuagaacuuuu

SEQ ID NO: 317091 - RNA, 22 nt, Homo sapiens
ugacugaguaguauuccacuau

SEQ ID NO: 317092 - RNA, 22 nt, Homo sapiens
ugacugugcagcuccaucaggg

SEQ ID NO: 317093 - RNA, 17 nt, Homo sapiens
ugagaacaugugguauu

SEQ ID NO: 317094 - RNA, 22 nt, Homo sapiens
ugagaacucaugaaucuuucca

SEQ ID NO: 317095 - RNA, 22 nt, Homo sapiens
ugagaagcauaccagugucugu

SEQ ID NO: 317096 - RNA, 19 nt, Homo sapiens
ugagaauguuaccaggucc

SEQ ID NO: 317097 - RNA, 22 nt, Homo sapiens
ugagaggugauaaagcaagggu

SEQ ID NO: 317098 - RNA, 22 nt, Homo sapiens
ugagauaaucaugugauuucau

SEQ ID NO: 317099 - RNA, 22 nt, Homo sapiens
ugagaugaggucucgcucuguc

SEQ ID NO: 317100 - RNA, 22 nt, Homo sapiens
ugagaugcaaaaugagaauugu

SEQ ID NO: 317101 - RNA, 22 nt, Homo sapiens
ugagauuaaucuuuaaguaaga

SEQ ID NO: 317102 - RNA, 22 nt, Homo sapiens
ugagcaauaaaguuacacaguu

SEQ ID NO: 317103 - RNA, 22 nt, Homo sapiens
ugagcuagggccuggaauaggg

SEQ ID NO: 317104 - RNA, 22 nt, Homo sapiens
ugagcugagauuaagcugcugc

SEQ ID NO: 317105 - RNA, 17 nt, Homo sapiens
ugagggaugccugguuc

SEQ ID NO: 317106 - RNA, 22 nt, Homo sapiens
ugagguaaaacaaggauuggau

SEQ ID NO: 317107 - RNA, 22 nt, Homo sapiens
ugagguaaugcuguagcuguga

SEQ ID NO: 317108 - RNA, 22 nt, Homo sapiens
ugaggugagauggcuaccccaa

SEQ ID NO: 317109 - RNA, 23 nt, Homo sapiens
ugagguguuaagcagacuugucu

SEQ ID NO: 317110 - RNA, 22 nt, Homo sapiens
ugagguguuauccagaguucuu

SEQ ID NO: 317111 - RNA, 22 nt, Homo sapiens
ugaucucagcucacugguugaa

SEQ ID NO: 317112 - RNA, 22 nt, Homo sapiens
ugaucucauuagcaccuuuagc

SEQ ID NO: 317113 - RNA, 22 nt, Homo sapiens
ugaugacucuguggccccaggc

SEQ ID NO: 317114 - RNA, 22 nt, Homo sapiens
ugauguugacuguaggcagaga

SEQ ID NO: 317115 - RNA, 18 nt, Homo sapiens
ugcaaacauguguguguu

SEQ ID NO: 317116 - RNA, 23 nt, Homo sapiens
aaagacuagucaggugcaguggu

SEQ ID NO: 317117 - RNA, 22 nt, Homo sapiens
aaagcacugaauaaauuugcuu

SEQ ID NO: 317118 - RNA, 22 nt, Homo sapiens
aaagcgcuguuaagaagacuga

SEQ ID NO: 317119 - RNA, 22 nt, Homo sapiens
aaaggcaucauuaguaccaagu

SEQ ID NO: 317120 - RNA, 22 nt, Homo sapiens
aaagggcacugugcuuuggcaa

SEQ ID NO: 317121 - RNA, 21 nt, Homo sapiens
aaaugcacauuacugcuggug

SEQ ID NO: 317122 - RNA, 22 nt, Homo sapiens
aaaugcagcacucaagugggaa

SEQ ID NO: 317123 - RNA, 22 nt, Homo sapiens
aaaugcccuaaaauggagcauc

SEQ ID NO: 317124 - RNA, 22 nt, Homo sapiens
aacaggcuccuaggggugcacc

SEQ ID NO: 317125 - RNA, 22 nt, Homo sapiens
aacauagucaugggguaauguu

SEQ ID NO: 317126 - RNA, 22 nt, Homo sapiens
aagagagcuaugugcauaauua

SEQ ID NO: 317127 - RNA, 22 nt, Homo sapiens
aagagguaauaacaaagcuucu

SEQ ID NO: 317128 - RNA, 22 nt, Homo sapiens
aagagguagaagcuugccuucu

SEQ ID NO: 317129 - RNA, 22 nt, Homo sapiens
aagagguagucugucccuuagc

SEQ ID NO: 317130 - RNA, 22 nt, Homo sapiens
aagagugucuuugugcuggccc

SEQ ID NO: 317131 - RNA, 19 nt, Homo sapiens
aagaugauguuugggcuaa

SEQ ID NO: 317132 - RNA, 22 nt, Homo sapiens
aagcacaauuucaccuucuugu

SEQ ID NO: 317133 - RNA, 22 nt, Homo sapiens
aagcaucauuuggaauuugaga

SEQ ID NO: 317134 - RNA, 22 nt, Homo sapiens
aagcuccauuucugccaugaga

SEQ ID NO: 317135 - RNA, 22 nt, Homo sapiens
aagcugguguugcugcucuguu

SEQ ID NO: 317136 - RNA, 22 nt, Homo sapiens
aaggaguagaauagaugcaccu

SEQ ID NO: 317137 - RNA, 22 nt, Homo sapiens
aaggcaagauacugguugcuga

SEQ ID NO: 317138 - RNA, 22 nt, Homo sapiens
aaggcagugugcacauaacacu

SEQ ID NO: 317139 - RNA, 22 nt, Homo sapiens
aaggcaugcaaagaacauuuua

SEQ ID NO: 317140 - RNA, 22 nt, Homo sapiens
aaggcuguuguguaauaggauu

SEQ ID NO: 317141 - RNA, 22 nt, Homo sapiens
aagguaguuuucuuuaaugcug

SEQ ID NO: 317142 - RNA, 22 nt, Homo sapiens
aagugcaaaucuguggcugaaa

SEQ ID NO: 317143 - RNA, 22 nt, Homo sapiens
aagugcccuauuuggcccuuga

SEQ ID NO: 317144 - RNA, 20 nt, Homo sapiens
aagugcuuccuuuuagaggg

SEQ ID NO: 317145 - RNA, 22 nt, Homo sapiens
aauaaagcauggcuacuccaua

SEQ ID NO: 317146 - RNA, 20 nt, Homo sapiens
aauaacagccccagggaggu

SEQ ID NO: 317147 - RNA, 22 nt, Homo sapiens
aauaagaaguggaagggaccgg

SEQ ID NO: 317148 - RNA, 22 nt, Homo sapiens
aauacucuauaagggaagcugu

SEQ ID NO: 317149 - RNA, 22 nt, Homo sapiens
aauacugugauaucgagcgauu

SEQ ID NO: 317150 - RNA, 22 nt, Homo sapiens
aaucacauugaaucugcuaccu

SEQ ID NO: 317151 - RNA, 22 nt, Homo sapiens
aauccauuugccgucuauccau

SEQ ID NO: 317152 - RNA, 22 nt, Homo sapiens
aaugcacauauauuuccuuauu

SEQ ID NO: 317153 - RNA, 22 nt, Homo sapiens
aaugccuagugugugacaggug

SEQ ID NO: 317154 - RNA, 22 nt, Homo sapiens
aauggcacaagaguaaacuguu

SEQ ID NO: 317155 - RNA, 22 nt, Homo sapiens
aauggccuuuuucauuauacug

SEQ ID NO: 317156 - RNA, 22 nt, Homo sapiens
acaaagcuagggaauccaucuu

SEQ ID NO: 317157 - RNA, 22 nt, Homo sapiens
acaagacuucuuguauucuagu

SEQ ID NO: 317158 - RNA, 22 nt, Homo sapiens
acacaguaagcacaguguagau

SEQ ID NO: 317159 - RNA, 22 nt, Homo sapiens
acagaaccauucacuccccugg

SEQ ID NO: 317160 - RNA, 22 nt, Homo sapiens
acagauagacauauauagcuca

SEQ ID NO: 317161 - RNA, 22 nt, Homo sapiens
acagaucagagauauuuagguu

SEQ ID NO: 317162 - RNA, 22 nt, Homo sapiens
acaguagugggcuacagaauca

SEQ ID NO: 317163 - RNA, 22 nt, Homo sapiens
acaguguagugacugccaacuu

SEQ ID NO: 317164 - RNA, 22 nt, Homo sapiens
acagugucugacacguaggaag

SEQ ID NO: 317165 - RNA, 18 nt, Homo sapiens
acaucccaugcuggggug

SEQ ID NO: 317166 - RNA, 22 nt, Homo sapiens
acauucagcuguuguuucaaug

SEQ ID NO: 317167 - RNA, 22 nt, Homo sapiens
acccaguagucauucaggagca

SEQ ID NO: 317168 - RNA, 23 nt, Homo sapiens
accuucauucauucagcugaagu

SEQ ID NO: 317169 - RNA, 22 nt, Homo sapiens
acuauacugaagcaaauuaaca

SEQ ID NO: 317170 - RNA, 22 nt, Homo sapiens
acuuuuugcaaccauuuggacc

SEQ ID NO: 317171 - RNA, 22 nt, Homo sapiens
agaauguuuuagaccaauacaa

SEQ ID NO: 317172 - RNA, 22 nt, Homo sapiens
agagaccuguaaaguucaggca

SEQ ID NO: 317173 - RNA, 22 nt, Homo sapiens
agagagguggguggagccccca

SEQ ID NO: 317174 - RNA, 22 nt, Homo sapiens
agagcacugcugcaggguucug

SEQ ID NO: 317175 - RNA, 22 nt, Homo sapiens
agagccacauuaaauaugggaa

SEQ ID NO: 317176 - RNA, 22 nt, Homo sapiens
agagguaagaauaguaguugga

SEQ ID NO: 317177 - RNA, 22 nt, Homo sapiens
agagguauacauuugagagcca

SEQ ID NO: 317178 - RNA, 22 nt, Homo sapiens
agaguaguuuauuaugcuaagg

SEQ ID NO: 317179 - RNA, 22 nt, Homo sapiens
agaugauguuucuggcacauga

SEQ ID NO: 317180 - RNA, 18 nt, Homo sapiens
agaugcaugcucacuaca

SEQ ID NO: 317181 - RNA, 22 nt, Homo sapiens
agcagcauuaugauauaucuua

SEQ ID NO: 317182 - RNA, 22 nt, Homo sapiens
agcaggacaauaugggaucagg

SEQ ID NO: 317183 - RNA, 22 nt, Homo sapiens
agcaucaugcaguugcuauuca

SEQ ID NO: 317184 - RNA, 21 nt, Homo sapiens
agccaguguuccuuguggcuc

SEQ ID NO: 317185 - RNA, 22 nt, Homo sapiens
agcugccagucuuguaaggccu

SEQ ID NO: 317186 - RNA, 22 nt, Homo sapiens
agcuguaguuuauucauguuaa

SEQ ID NO: 317187 - RNA, 22 nt, Homo sapiens
agcuguuguucucagaggcuuu

SEQ ID NO: 317188 - RNA, 22 nt, Homo sapiens
agcuuaugcuuggaagagauga

SEQ ID NO: 317189 - RNA, 22 nt, Homo sapiens
agcuuguagugauuugugguaa

SEQ ID NO: 317190 - RNA, 22 nt, Homo sapiens
agcuugugauuuagagugagag

SEQ ID NO: 317191 - RNA, 21 nt, Homo sapiens
agcuuguguguaucacagugu

SEQ ID NO: 317192 - RNA, 22 nt, Homo sapiens
aggaagguaaacuaacuugccu

SEQ ID NO: 317193 - RNA, 22 nt, Homo sapiens
aggcaaaugccagcaaucacac

SEQ ID NO: 317194 - RNA, 22 nt, Homo sapiens
aggcagcuguuauauacugagu

SEQ ID NO: 317195 - RNA, 22 nt, Homo sapiens
agggagcaaaguggucuuucuc

SEQ ID NO: 317196 - RNA, 22 nt, Homo sapiens
agggcaguguuaggacugucug

SEQ ID NO: 317197 - RNA, 22 nt, Homo sapiens
aggugcugacaggauagguuuc

SEQ ID NO: 317198 - RNA, 22 nt, Homo sapiens
aguagguguugguagagguuuc

SEQ ID NO: 317199 - RNA, 22 nt, Homo sapiens
agucacagguucuugggauuag

SEQ ID NO: 317200 - RNA, 22 nt, Homo sapiens
agugcaauaaggauguagaacu

SEQ ID NO: 317201 - RNA, 22 nt, Homo sapiens
agugcaaugauccggugcuggg

SEQ ID NO: 317202 - RNA, 22 nt, Homo sapiens
aguggaauuaagaaacugaauu

SEQ ID NO: 317203 - RNA, 19 nt, Homo sapiens
agugggcuagaaaucaggg

SEQ ID NO: 317204 - RNA, 22 nt, Homo sapiens
aguguuuuuaucaugaaagggu

SEQ ID NO: 317205 - RNA, 22 nt, Homo sapiens
aggcuuauuaagauucccuuau

SEQ ID NO: 317206 - RNA, 22 nt, Homo sapiens
agggcuuuugagcugagauggu

SEQ ID NO: 317207 - RNA, 22 nt, Homo sapiens
aggguuuuuauuuauguggcau

SEQ ID NO: 317208 - RNA, 22 nt, Homo sapiens
agguagcauagcgggaauauca

SEQ ID NO: 317209 - RNA, 22 nt, Homo sapiens
aggugguuuuaggcagagacau

SEQ ID NO: 317210 - RNA, 22 nt, Homo sapiens
aggugguuuugaugagcaggua

SEQ ID NO: 317211 - RNA, 22 nt, Homo sapiens
agugcaguggcacaaucuuggc

SEQ ID NO: 317212 - RNA, 22 nt, Homo sapiens
agugcaguggcucaaaaugccu

SEQ ID NO: 317213 - RNA, 22 nt, Homo sapiens
aguggaaucuguuauacuaacu

SEQ ID NO: 317214 - RNA, 22 nt, Homo sapiens
agugguaguacaggagauaccg

SEQ ID NO: 317215 - RNA, 22 nt, Homo sapiens
agugguuuuaaguagagcauac

SEQ ID NO: 317216 - RNA, 22 nt, Homo sapiens
auaagaugaaggaagccauauc

SEQ ID NO: 317217 - RNA, 23 nt, Homo sapiens
auaaugcaaguggugguaaucug

SEQ ID NO: 317218 - RNA, 22 nt, Homo sapiens
auacaaguuauuugaacugcgg

SEQ ID NO: 317219 - RNA, 22 nt, Homo sapiens
auacaugugccauguucgugug

SEQ ID NO: 317220 - RNA, 22 nt, Homo sapiens
auacauguuucauguuggugug

SEQ ID NO: 317221 - RNA, 22 nt, Homo sapiens
auagcagcagcuaguagugaua

SEQ ID NO: 317222 - RNA, 22 nt, Homo sapiens
auaguacuauugcaguguuaua

SEQ ID NO: 317223 - RNA, 22 nt, Homo sapiens
auaugcaaauccauagagacag

SEQ ID NO: 317224 - RNA, 22 nt, Homo sapiens
auaugcuuauuagcaagaaaua

SEQ ID NO: 317225 - RNA, 22 nt, Homo sapiens
auauguucucauucauaugugg

SEQ ID NO: 317226 - RNA, 22 nt, Homo sapiens
auauucaagugaggauggcuaa

SEQ ID NO: 317227 - RNA, 22 nt, Homo sapiens
auauucacuauaugcagaacca

SEQ ID NO: 317228 - RNA, 22 nt, Homo sapiens
aucaaaugcuggcagagugccu

SEQ ID NO: 317229 - RNA, 22 nt, Homo sapiens
aucaaauugucauuuuaaggau

SEQ ID NO: 317230 - RNA, 22 nt, Homo sapiens
aucacagagucacgggcaacuu

SEQ ID NO: 317231 - RNA, 22 nt, Homo sapiens
aucacauggccuagccuaaccu

SEQ ID NO: 317232 - RNA, 22 nt, Homo sapiens
aucagcagcaugaaaagcaacu

SEQ ID NO: 317233 - RNA, 22 nt, Homo sapiens
aucagugcauguuuguugagcu

SEQ ID NO: 317234 - RNA, 22 nt, Homo sapiens
aucauauccuagauauaacuuc

SEQ ID NO: 317235 - RNA, 22 nt, Homo sapiens
aucuaaaucucauaugggcaca

SEQ ID NO: 317236 - RNA, 22 nt, Homo sapiens
aucuugggugggaacugagaau

SEQ ID NO: 317237 - RNA, 22 nt, Homo sapiens
augaccagagagugcgcagggu

SEQ ID NO: 317238 - RNA, 20 nt, Homo sapiens
augacuagaggacaugguaa

SEQ ID NO: 317239 - RNA, 22 nt, Homo sapiens
augacuuuucugaaaaccacca

SEQ ID NO: 317240 - RNA, 22 nt, Homo sapiens
augagaaugauucuguuauggu

SEQ ID NO: 317241 - RNA, 22 nt, Homo sapiens
augagaauguaaguuaaugaaa

SEQ ID NO: 317242 - RNA, 20 nt, Homo sapiens
augagguguaugacacugaa

SEQ ID NO: 317243 - RNA, 22 nt, Homo sapiens
augauauguuuguagcuaucuc

SEQ ID NO: 317244 - RNA, 22 nt, Homo sapiens
augaucuguuuggugaucuugu

SEQ ID NO: 317245 - RNA, 19 nt, Homo sapiens
augcacgugaaaugcauuu

SEQ ID NO: 317246 - RNA, 22 nt, Homo sapiens
augccaagagacaaagggaauc

SEQ ID NO: 317247 - RNA, 22 nt, Homo sapiens
augccaagaugagcacgcgucu

SEQ ID NO: 317248 - RNA, 22 nt, Homo sapiens
augcuacauucuacaauuaggc

SEQ ID NO: 317249 - RNA, 22 nt, Homo sapiens
augcuuguugcagccugagccu

SEQ ID NO: 317250 - RNA, 22 nt, Homo sapiens
auggaaggagaggaaugaauga

SEQ ID NO: 317251 - RNA, 22 nt, Homo sapiens
auggaaugccauuuauaaugga

SEQ ID NO: 317252 - RNA, 22 nt, Homo sapiens
auggaauggcacuuugaagauu

SEQ ID NO: 317253 - RNA, 22 nt, Homo sapiens
auggacagaaaaaaauagaugu

SEQ ID NO: 317254 - RNA, 22 nt, Homo sapiens
auggcagaaucaagccgacagc

SEQ ID NO: 317255 - RNA, 22 nt, Homo sapiens
auggcagagucagaaagucagg

SEQ ID NO: 317256 - RNA, 22 nt, Homo sapiens
auggcaguuuauucuaaaucaa

SEQ ID NO: 317257 - RNA, 22 nt, Homo sapiens
auggcuagaaccuguauauuca

SEQ ID NO: 317258 - RNA, 20 nt, Homo sapiens
augucagaguguggguacgg

SEQ ID NO: 317259 - RNA, 22 nt, Homo sapiens
augucauagaagccugugaacc

SEQ ID NO: 317260 - RNA, 22 nt, Homo sapiens
auuauaguguauacuugaaauu

SEQ ID NO: 317261 - RNA, 22 nt, Homo sapiens
auucaagugaugugauucuucu

SEQ ID NO: 317262 - RNA, 22 nt, Homo sapiens
auuccacaguuaacacagaccg

SEQ ID NO: 317263 - RNA, 22 nt, Homo sapiens
auucuauaguccuaggauuggg

SEQ ID NO: 317264 - RNA, 22 nt, Homo sapiens
auucuugcuugaacuuggugca

SEQ ID NO: 317265 - RNA, 22 nt, Homo sapiens
auugcacuccagccccggggac

SEQ ID NO: 317266 - RNA, 22 nt, Homo sapiens
auugcacucuagccugggugac

SEQ ID NO: 317267 - RNA, 23 nt, Homo sapiens
auugcagaaucacagagguagug

SEQ ID NO: 317268 - RNA, 22 nt, Homo sapiens
auuguacucuagccucugggca

SEQ ID NO: 317269 - RNA, 22 nt, Homo sapiens
auugucauuuucugagaaguaa

SEQ ID NO: 317270 - RNA, 22 nt, Homo sapiens
auuuggcauagaguaucauucu

SEQ ID NO: 317271 - RNA, 22 nt, Homo sapiens
gagaaugagauuaugguuacau

SEQ ID NO: 317272 - RNA, 22 nt, Homo sapiens
gagacugagucucacucuguca

SEQ ID NO: 317273 - RNA, 22 nt, Homo sapiens
gagacugagucuugcucugucg

SEQ ID NO: 317274 - RNA, 21 nt, Homo sapiens
gagcacauuguccucuaacgc

SEQ ID NO: 317275 - RNA, 22 nt, Homo sapiens
gagcugaauugcugccauuugc

SEQ ID NO: 317276 - RNA, 22 nt, Homo sapiens
gagcugguccuuuaaggaugca

SEQ ID NO: 317277 - RNA, 22 nt, Homo sapiens
gaggcauugaaauauugcuuau

SEQ ID NO: 317278 - RNA, 22 nt, Homo sapiens
gagguaagaugauucguguccu

SEQ ID NO: 317279 - RNA, 23 nt, Homo sapiens
gagugcaaugacaugaucucgga

SEQ ID NO: 317280 - RNA, 22 nt, Homo sapiens
gagugcaauggcaccgucucgg

SEQ ID NO: 317281 - RNA, 22 nt, Homo sapiens
gagugcaauggcaugaucuggg

SEQ ID NO: 317282 - RNA, 22 nt, Homo sapiens
gagugcaauggcgcgaucucgg

SEQ ID NO: 317283 - RNA, 22 nt, Homo sapiens
gagugcaauggugcuaucucgg

SEQ ID NO: 317284 - RNA, 22 nt, Homo sapiens
gauaacagauaaugucaguuau

SEQ ID NO: 317285 - RNA, 22 nt, Homo sapiens
gauaucuuuuguauggugagcu

SEQ ID NO: 317286 - RNA, 22 nt, Homo sapiens
gauuucaucuuuagaggaagga

SEQ ID NO: 317287 - RNA, 22 nt, Homo sapiens
gcaaaguguuuuuaggaagucu

SEQ ID NO: 317288 - RNA, 17 nt, Homo sapiens
gcacuggcguaucccac

SEQ ID NO: 317289 - RNA, 22 nt, Homo sapiens
gcagcacaugacuguauguaua

SEQ ID NO: 317290 - RNA, 22 nt, Homo sapiens
gcaguucuguaguugaaauuua

SEQ ID NO: 317291 - RNA, 22 nt, Homo sapiens
gcauggaguggaaauucuuggg

SEQ ID NO: 317292 - RNA, 22 nt, Homo sapiens
gccaacauggcgcuccauucuu

SEQ ID NO: 317293 - RNA, 22 nt, Homo sapiens
gcccugauacauucuucugccu

SEQ ID NO: 317294 - RNA, 22 nt, Homo sapiens
auaaagccaugagcuugagaug

SEQ ID NO: 317295 - RNA, 22 nt, Homo sapiens
auaacauggaguuugucauuua

SEQ ID NO: 317296 - RNA, 22 nt, Homo sapiens
auaaggcugguauagacauuca

SEQ ID NO: 317297 - RNA, 22 nt, Homo sapiens
auacacauuccugggccucacc

SEQ ID NO: 317298 - RNA, 22 nt, Homo sapiens
auacagugaauaucuggggcag

SEQ ID NO: 317299 - RNA, 22 nt, Homo sapiens
auacaugugucauguugguuug

SEQ ID NO: 317300 - RNA, 20 nt, Homo sapiens
auaccacagacuggguaguu

SEQ ID NO: 317301 - RNA, 22 nt, Homo sapiens
auacuaugagauaauaaagacu

SEQ ID NO: 317302 - RNA, 22 nt, Homo sapiens
auacugguuuuugucaugugga

SEQ ID NO: 317303 - RNA, 22 nt, Homo sapiens
auacuguauaggauuguagccu

SEQ ID NO: 317304 - RNA, 22 nt, Homo sapiens
auagcagacauuucaaggcagg

SEQ ID NO: 317305 - RNA, 22 nt, Homo sapiens
auagcagcauauguaauguuga

SEQ ID NO: 317306 - RNA, 20 nt, Homo sapiens
auagcagcaugauuuauaau

SEQ ID NO: 317307 - RNA, 20 nt, Homo sapiens
auagcagcaugauuuauagu

SEQ ID NO: 317308 - RNA, 22 nt, Homo sapiens
auaucacaggaaaggaagauac

SEQ ID NO: 317309 - RNA, 22 nt, Homo sapiens
auaugacugccagggcccaguc

SEQ ID NO: 317310 - RNA, 16 nt, Homo sapiens
auaugacuuuaggagg

SEQ ID NO: 317311 - RNA, 21 nt, Homo sapiens
auauuacuguuagaggacugc

SEQ ID NO: 317312 - RNA, 22 nt, Homo sapiens
aucacauuuauaguggcacgca

SEQ ID NO: 317313 - RNA, 22 nt, Homo sapiens
aucagcaguguaaaaacggacu

SEQ ID NO: 317314 - RNA, 22 nt, Homo sapiens
auccucaguggcuuaaguauag

SEQ ID NO: 317315 - RNA, 22 nt, Homo sapiens
auccugaagcuuuacugaauuc

SEQ ID NO: 317316 - RNA, 22 nt, Homo sapiens
aucugcacaucuguguuuuugu

SEQ ID NO: 317317 - RNA, 22 nt, Homo sapiens
aucugcuccuggugaggguuuc

SEQ ID NO: 317318 - RNA, 22 nt, Homo sapiens
augaaauguaugagucuggguu

SEQ ID NO: 317319 - RNA, 22 nt, Homo sapiens
augaaugcacugcggguggaug

SEQ ID NO: 317320 - RNA, 22 nt, Homo sapiens
augaaugcagcacuguuuuucu

SEQ ID NO: 317321 - RNA, 23 nt, Homo sapiens
augaauguaaagaaugugggaag

SEQ ID NO: 317322 - RNA, 22 nt, Homo sapiens
augacagagauaugugaauuuu

SEQ ID NO: 317323 - RNA, 22 nt, Homo sapiens
augacuauugcacuuuccuggu

SEQ ID NO: 317324 - RNA, 22 nt, Homo sapiens
augacugucagggcagucauug

SEQ ID NO: 317325 - RNA, 22 nt, Homo sapiens
augagaugaggaauggcccucc

SEQ ID NO: 317326 - RNA, 22 nt, Homo sapiens
augagguauccaagcccagaaa

SEQ ID NO: 317327 - RNA, 22 nt, Homo sapiens
augaggugaguaaauaaaugaa

SEQ ID NO: 317328 - RNA, 22 nt, Homo sapiens
augaggugauaucuggaaauua

SEQ ID NO: 317329 - RNA, 22 nt, Homo sapiens
augaggugauuucuguucgggu

SEQ ID NO: 317330 - RNA, 22 nt, Homo sapiens
augaggugggcggcuuggaaga

SEQ ID NO: 317331 - RNA, 22 nt, Homo sapiens
augauacuggcuucauagaaug

SEQ ID NO: 317332 - RNA, 22 nt, Homo sapiens
augcacuuggcaggaugauucc

SEQ ID NO: 317333 - RNA, 22 nt, Homo sapiens
augcauaugucuuuauaguggc

SEQ ID NO: 317334 - RNA, 18 nt, Homo sapiens
augcauauuuuaaguugu

SEQ ID NO: 317335 - RNA, 19 nt, Homo sapiens
augcugguguugcucaaac

SEQ ID NO: 317336 - RNA, 22 nt, Homo sapiens
auggaaaugaagggcuggcccu

SEQ ID NO: 317337 - RNA, 22 nt, Homo sapiens
auggaaugguugggucauaagg

SEQ ID NO: 317338 - RNA, 22 nt, Homo sapiens
auggaggaggaagcugaaacaa

SEQ ID NO: 317339 - RNA, 22 nt, Homo sapiens
auggcaucgucaccuuuucagu

SEQ ID NO: 317340 - RNA, 22 nt, Homo sapiens
augggcacugauguauucugug

SEQ ID NO: 317341 - RNA, 22 nt, Homo sapiens
augguaagcugaaaauaucgaa

SEQ ID NO: 317342 - RNA, 22 nt, Homo sapiens
auguagugugauuuucacuaga

SEQ ID NO: 317343 - RNA, 22 nt, Homo sapiens
augucaaggugggugauaguuu

SEQ ID NO: 317344 - RNA, 22 nt, Homo sapiens
augugcaagaucauuaaagcuc

SEQ ID NO: 317345 - RNA, 22 nt, Homo sapiens
augugcaauggugucaccacau

SEQ ID NO: 317346 - RNA, 22 nt, Homo sapiens
augugguaguuauagugauaag

SEQ ID NO: 317347 - RNA, 23 nt, Homo sapiens
augugguuuuagguguugaacug

SEQ ID NO: 317348 - RNA, 23 nt, Homo sapiens
auuaagguuacuacaguaugagg

SEQ ID NO: 317349 - RNA, 22 nt, Homo sapiens
auuaaguaaugguuccaauaau

SEQ ID NO: 317350 - RNA, 20 nt, Homo sapiens
auuagacuugccuuauccuu

SEQ ID NO: 317351 - RNA, 21 nt, Homo sapiens
auuccacuuuuccuucaggga

SEQ ID NO: 317352 - RNA, 22 nt, Homo sapiens
auugaacacagaguagcuuucc

SEQ ID NO: 317353 - RNA, 22 nt, Homo sapiens
auugagcaaggucuccuaguau

SEQ ID NO: 317354 - RNA, 22 nt, Homo sapiens
auugagcacugacucugugcca

SEQ ID NO: 317355 - RNA, 22 nt, Homo sapiens
auugcacuccagccuggccaac

SEQ ID NO: 317356 - RNA, 22 nt, Homo sapiens
auugcacuccagccugggugag

SEQ ID NO: 317357 - RNA, 22 nt, Homo sapiens
auugcagaaaugacagagcgcc

SEQ ID NO: 317358 - RNA, 22 nt, Homo sapiens
auugcagauucgcuuuguguug

SEQ ID NO: 317359 - RNA, 22 nt, Homo sapiens
auugcuuacuaaucaucuucag

SEQ ID NO: 317360 - RNA, 22 nt, Homo sapiens
auuggcaauccauauauuuucu

SEQ ID NO: 317361 - RNA, 22 nt, Homo sapiens
auuggccaaugggacgucagca

SEQ ID NO: 317362 - RNA, 22 nt, Homo sapiens
auuguacuccagccuguggagc

SEQ ID NO: 317363 - RNA, 22 nt, Homo sapiens
auuguacugccccccuguugcu

SEQ ID NO: 317364 - RNA, 22 nt, Homo sapiens
auugucauuuauaacuguguag

SEQ ID NO: 317365 - RNA, 22 nt, Homo sapiens
auuugucacuauguggcuaaua

SEQ ID NO: 317366 - RNA, 22 nt, Homo sapiens
caaaggcuuccacugcauccuu

SEQ ID NO: 317367 - RNA, 22 nt, Homo sapiens
caaagugcugggaugggccagg

SEQ ID NO: 317368 - RNA, 22 nt, Homo sapiens
caacacuguuuauuggauagcc

SEQ ID NO: 317369 - RNA, 22 nt, Homo sapiens
caaggugcugagacaggagccc

SEQ ID NO: 317370 - RNA, 22 nt, Homo sapiens
cacaccuaccucauuauggaca

SEQ ID NO: 317371 - RNA, 22 nt, Homo sapiens
cacaggccugucucuuucuaac

SEQ ID NO: 317372 - RNA, 22 nt, Homo sapiens
cacaguagaauagagcacuagg

SEQ ID NO: 317373 - RNA, 22 nt, Homo sapiens
cacugcacuccagcuugugggc

SEQ ID NO: 317374 - RNA, 22 nt, Homo sapiens
cacugcauucuccaccucccag

SEQ ID NO: 317375 - RNA, 20 nt, Homo sapiens
cagagcaaagcaguccuggc

SEQ ID NO: 317376 - RNA, 22 nt, Homo sapiens
cagauacuggaguccugaaguu

SEQ ID NO: 317377 - RNA, 22 nt, Homo sapiens
cagcaaaucauccuauuugagc

SEQ ID NO: 317378 - RNA, 22 nt, Homo sapiens
cagcuguuguuccagucuuuua

SEQ ID NO: 317379 - RNA, 22 nt, Homo sapiens
caggcagucuggcucccaagug

SEQ ID NO: 317380 - RNA, 22 nt, Homo sapiens
caggcagucuggggguguaucc

SEQ ID NO: 317381 - RNA, 22 nt, Homo sapiens
caggugaaugccucuccuucug

SEQ ID NO: 317382 - RNA, 18 nt, Homo sapiens
cagugcaauacaggagag

SEQ ID NO: 317383 - RNA, 22 nt, Homo sapiens
cauacaugugcuugucuuaugc

SEQ ID NO: 317384 - RNA, 22 nt, Homo sapiens
cauauucacuuuacagagcugu

SEQ ID NO: 317385 - RNA, 22 nt, Homo sapiens
caucacuguugguacaaguaau

SEQ ID NO: 317386 - RNA, 22 nt, Homo sapiens
caugccauugcucuccugggug

SEQ ID NO: 317387 - RNA, 22 nt, Homo sapiens
ugcaaaguccucauucuuaccc

SEQ ID NO: 317388 - RNA, 22 nt, Homo sapiens
ugcaaauguuaggugucauuau

SEQ ID NO: 317389 - RNA, 19 nt, Homo sapiens
ugcagcaauguaaaagaca

SEQ ID NO: 317390 - RNA, 18 nt, Homo sapiens
ugcagcuuugugauuggc

SEQ ID NO: 317391 - RNA, 22 nt, Homo sapiens
ugcaguaggcccagcgggaggc

SEQ ID NO: 317392 - RNA, 22 nt, Homo sapiens
ugcaguguucuuuagaggaaau

SEQ ID NO: 317393 - RNA, 22 nt, Homo sapiens
ugcauuguggaucuaaaugcau

SEQ ID NO: 317394 - RNA, 22 nt, Homo sapiens
ugccaagauuucaggaauuaag

SEQ ID NO: 317395 - RNA, 22 nt, Homo sapiens
ugccaaggagucagucccuaga

SEQ ID NO: 317396 - RNA, 22 nt, Homo sapiens
ugccaguauuuuauugaagauu

SEQ ID NO: 317397 - RNA, 22 nt, Homo sapiens
ugccaguauuuuguugaagauu

SEQ ID NO: 317398 - RNA, 22 nt, Homo sapiens
ugcuauguaacacauuaccuuu

SEQ ID NO: 317399 - RNA, 22 nt, Homo sapiens
ugcuaugucagccaggcugguc

SEQ ID NO: 317400 - RNA, 22 nt, Homo sapiens
ugcuaugucuucucucacagag

SEQ ID NO: 317401 - RNA, 21 nt, Homo sapiens
ugcuauguuguccaggcuggc

SEQ ID NO: 317402 - RNA, 22 nt, Homo sapiens
ugcugcuguuaucauuuuacca

SEQ ID NO: 317403 - RNA, 23 nt, Homo sapiens
uggaacugaauuucuuagcauuu

SEQ ID NO: 317404 - RNA, 22 nt, Homo sapiens
uggaacugauauugauggaaaa

SEQ ID NO: 317405 - RNA, 20 nt, Homo sapiens
uggaacuuaauugauggaca

SEQ ID NO: 317406 - RNA, 22 nt, Homo sapiens
uggaagacacauaccugauaac

SEQ ID NO: 317407 - RNA, 22 nt, Homo sapiens
uggaagcaugcaaucugugggg

SEQ ID NO: 317408 - RNA, 22 nt, Homo sapiens
uggaagccuagauucuuuucuu

SEQ ID NO: 317409 - RNA, 20 nt, Homo sapiens
uggaaggcaucugcauuauu

SEQ ID NO: 317410 - RNA, 22 nt, Homo sapiens
uggaaguuaaaugacucuuucu

SEQ ID NO: 317411 - RNA, 21 nt, Homo sapiens
uggaaucuauuauuccaguuu

SEQ ID NO: 317412 - RNA, 22 nt, Homo sapiens
uggacuaaagaaacauuccgug

SEQ ID NO: 317413 - RNA, 22 nt, Homo sapiens
uggagggcuagucauuucuuuu

SEQ ID NO: 317414 - RNA, 22 nt, Homo sapiens
uggagguagagaugggaucucc

SEQ ID NO: 317415 - RNA, 19 nt, Homo sapiens
uggagucaucaugcugcua

SEQ ID NO: 317416 - RNA, 22 nt, Homo sapiens
uggaucuguucuauuuaucuga

SEQ ID NO: 317417 - RNA, 22 nt, Homo sapiens
uggauuuuaauuauucugucau

SEQ ID NO: 317418 - RNA, 22 nt, Homo sapiens
uggcacaaugacccuugugggc

SEQ ID NO: 317419 - RNA, 22 nt, Homo sapiens
uggcagauagaaaugugguuaa

SEQ ID NO: 317420 - RNA, 22 nt, Homo sapiens
uggcagauaggauacaggacua

SEQ ID NO: 317421 - RNA, 22 nt, Homo sapiens
uggcagaugagccgcgcuccaa

SEQ ID NO: 317422 - RNA, 22 nt, Homo sapiens
uggcagaugggugagcuggaga

SEQ ID NO: 317423 - RNA, 22 nt, Homo sapiens
uggcauguagucugggaccugg

SEQ ID NO: 317424 - RNA, 22 nt, Homo sapiens
uggcuagaugagauguacugca

SEQ ID NO: 317425 - RNA, 22 nt, Homo sapiens
uggcucuguuuguuaacuagac

SEQ ID NO: 317426 - RNA, 22 nt, Homo sapiens
uggcuguguccucucccaaauc

SEQ ID NO: 317427 - RNA, 22 nt, Homo sapiens
ugggaucuuuccuauuagcgag

SEQ ID NO: 317428 - RNA, 22 nt, Homo sapiens
uggggugugagggagaaagaaa

SEQ ID NO: 317429 - RNA, 22 nt, Homo sapiens
uggguaauggagaaauaaaucu

SEQ ID NO: 317430 - RNA, 19 nt, Homo sapiens
uggguaguuuucuggcugg

SEQ ID NO: 317431 - RNA, 23 nt, Homo sapiens
ugggucaguuuuucugacaucau

SEQ ID NO: 317432 - RNA, 22 nt, Homo sapiens
ugggugugaccgcucaaggggg

SEQ ID NO: 317433 - RNA, 22 nt, Homo sapiens
ugguccucugcuuccagaauuc

SEQ ID NO: 317434 - RNA, 22 nt, Homo sapiens
uggucuucuggccuccagaacc

SEQ ID NO: 317435 - RNA, 22 nt, Homo sapiens
uggucuuuucaacaaaugguau

SEQ ID NO: 317436 - RNA, 22 nt, Homo sapiens
uguaaagaaagcuguuguugua

SEQ ID NO: 317437 - RNA, 22 nt, Homo sapiens
uguagcagccauaaacacagug

SEQ ID NO: 317438 - RNA, 22 nt, Homo sapiens
uguauagaucugauucaucucc

SEQ ID NO: 317439 - RNA, 22 nt, Homo sapiens
uguauguugggucaaaguacau

SEQ ID NO: 317440 - RNA, 22 nt, Homo sapiens
ugucaaaugcagugauauuuga

SEQ ID NO: 317441 - RNA, 22 nt, Homo sapiens
ugucagaaucuagaggcugcua

SEQ ID NO: 317442 - RNA, 19 nt, Homo sapiens
ugucaucaucuuuucuugc

SEQ ID NO: 317443 - RNA, 22 nt, Homo sapiens
ugucauggugcucugggcccug

SEQ ID NO: 317444 - RNA, 22 nt, Homo sapiens
ugucauguagaaauuguccauu

SEQ ID NO: 317445 - RNA, 22 nt, Homo sapiens
ugucaugucaacuauggaauuu

SEQ ID NO: 317446 - RNA, 22 nt, Homo sapiens
ugucaugucuuuguguaucaau

SEQ ID NO: 317447 - RNA, 22 nt, Homo sapiens
ugucauucaggaaauucuaagu

SEQ ID NO: 317448 - RNA, 22 nt, Homo sapiens
ugucauuguggugcagauauaa

SEQ ID NO: 317449 - RNA, 22 nt, Homo sapiens
uguccugcagagguguuugccu

SEQ ID NO: 317450 - RNA, 21 nt, Homo sapiens
ugugaaaucuaggcagagguu

SEQ ID NO: 317451 - RNA, 22 nt, Homo sapiens
ugugaacacagaggcuauggca

SEQ ID NO: 317452 - RNA, 22 nt, Homo sapiens
ugugaacagaauuagucaccua

SEQ ID NO: 317453 - RNA, 19 nt, Homo sapiens
ugugaacaucacagagugu

SEQ ID NO: 317454 - RNA, 22 nt, Homo sapiens
ugugacagcacagcaucucuuu

SEQ ID NO: 317455 - RNA, 22 nt, Homo sapiens
ugugcaugaaauuuaccuuuaa

SEQ ID NO: 317456 - RNA, 21 nt, Homo sapiens
uguggcaauggccucacagau

SEQ ID NO: 317457 - RNA, 22 nt, Homo sapiens
uguuacagcagaauugauugca

SEQ ID NO: 317458 - RNA, 22 nt, Homo sapiens
uguucuggagaggcaggccaca

SEQ ID NO: 317459 - RNA, 22 nt, Homo sapiens
uuaaagccauaccugagagagu

SEQ ID NO: 317460 - RNA, 22 nt, Homo sapiens
uuaacacugccauugauacugu

SEQ ID NO: 317461 - RNA, 22 nt, Homo sapiens
uuaacagugucaaucuguagua

SEQ ID NO: 317462 - RNA, 22 nt, Homo sapiens
uuaacaguugcaugagacugag

SEQ ID NO: 317463 - RNA, 22 nt, Homo sapiens
uuaaggaaagcauuuaauucag

SEQ ID NO: 317464 - RNA, 22 nt, Homo sapiens
uuaagugcucaguuacucaguu

SEQ ID NO: 317465 - RNA, 22 nt, Homo sapiens
uuaauguaauugauugauugac

SEQ ID NO: 317466 - RNA, 22 nt, Homo sapiens
uuaauguaucuaucacaucaca

SEQ ID NO: 317467 - RNA, 22 nt, Homo sapiens
uuaauuguaucuauagauguca

SEQ ID NO: 317468 - RNA, 22 nt, Homo sapiens
uuacaaccucagcagugcaaag

SEQ ID NO: 317469 - RNA, 22 nt, Homo sapiens
uuacaaguggcaucucucugga

SEQ ID NO: 317470 - RNA, 22 nt, Homo sapiens
uuacacaguugguaggggcaga

SEQ ID NO: 317471 - RNA, 22 nt, Homo sapiens
uuacagugguugcuauugugaa

SEQ ID NO: 317472 - RNA, 22 nt, Homo sapiens
uuaccugagaaggugacauuug

SEQ ID NO: 317473 - RNA, 22 nt, Homo sapiens
uuagacaguggugcacugcacu

SEQ ID NO: 317474 - RNA, 22 nt, Homo sapiens
uuagcacaucuuucuauguaag

SEQ ID NO: 317475 - RNA, 22 nt, Homo sapiens
uuaguuuaucagugguuucuga

SEQ ID NO: 317476 - RNA, 22 nt, Homo sapiens
uuauguaaaucaaucuggaauc

SEQ ID NO: 317477 - RNA, 22 nt, Homo sapiens
uucaaauguucuuucaccaccc

SEQ ID NO: 317478 - RNA, 23 nt, Homo sapiens
uucaacagguagacccucccugc

SEQ ID NO: 317479 - RNA, 21 nt, Homo sapiens
uucacaagggaaguagggggc

SEQ ID NO: 317480 - RNA, 22 nt, Homo sapiens
gugaaagcaucugacugugcca

SEQ ID NO: 317481 - RNA, 22 nt, Homo sapiens
gugaaugcauuaagaaggggga

SEQ ID NO: 317482 - RNA, 22 nt, Homo sapiens
aaaagagcugagagguauucuu

SEQ ID NO: 317483 - RNA, 22 nt, Homo sapiens
aaacugaucugaaggccaggcu

SEQ ID NO: 317484 - RNA, 22 nt, Homo sapiens
aaagagcugagaccugguggag

SEQ ID NO: 317485 - RNA, 22 nt, Homo sapiens
aaagcuacaggaccugcucauu

SEQ ID NO: 317486 - RNA, 22 nt, Homo sapiens
aaagugcugagaguucuaacuu

SEQ ID NO: 317487 - RNA, 22 nt, Homo sapiens
aaagugcuuacuaaguugccaa

SEQ ID NO: 317488 - RNA, 22 nt, Homo sapiens
aaaguggacuaagugaauauga

SEQ ID NO: 317489 - RNA, 22 nt, Homo sapiens
aaaguggugugaguauguaucu

SEQ ID NO: 317490 - RNA, 22 nt, Homo sapiens
aaagugguuuuucagacuuuga

SEQ ID NO: 317491 - RNA, 22 nt, Homo sapiens
aaaugcaccacucuggugcagg

SEQ ID NO: 317492 - RNA, 22 nt, Homo sapiens
aaaugcacgcuacccagcuaga

SEQ ID NO: 317493 - RNA, 18 nt, Homo sapiens
aaauucugucccuucuuc

SEQ ID NO: 317494 - RNA, 22 nt, Homo sapiens
aacaccauucucuguaacaaga

SEQ ID NO: 317495 - RNA, 22 nt, Homo sapiens
aacagugccugucauuuaguag

SEQ ID NO: 317496 - RNA, 21 nt, Homo sapiens
aacagugcuuaguagauguuc

SEQ ID NO: 317497 - RNA, 21 nt, Homo sapiens
aagaaagcuggacuugccgcu

SEQ ID NO: 317498 - RNA, 22 nt, Homo sapiens
aagauauguuaguuauaaacuc

SEQ ID NO: 317499 - RNA, 21 nt, Homo sapiens
aagcacauugaguguguguga

SEQ ID NO: 317500 - RNA, 20 nt, Homo sapiens
aagcauggguuuuaggguca

SEQ ID NO: 317501 - RNA, 22 nt, Homo sapiens
aagcuggagugcaguggugcaa

SEQ ID NO: 317502 - RNA, 22 nt, Homo sapiens
aagcuggauuuaguguggagca

SEQ ID NO: 317503 - RNA, 22 nt, Homo sapiens
aagcuggauuucgcauccuguu

SEQ ID NO: 317504 - RNA, 22 nt, Homo sapiens
aaggaguagaggaauagcaaug

SEQ ID NO: 317505 - RNA, 22 nt, Homo sapiens
aaggaguaucuguuuucucacc

SEQ ID NO: 317506 - RNA, 22 nt, Homo sapiens
aaggcaagaaaauggauucucc

SEQ ID NO: 317507 - RNA, 22 nt, Homo sapiens
aagggaauguuguggcugguuu

SEQ ID NO: 317508 - RNA, 22 nt, Homo sapiens
aagggaauguugugguugguuu

SEQ ID NO: 317509 - RNA, 21 nt, Homo sapiens
aaggugguggugauugagaug

SEQ ID NO: 317510 - RNA, 22 nt, Homo sapiens
aagguggugucagagagcuuau

SEQ ID NO: 317511 - RNA, 22 nt, Homo sapiens
aaguaauggaguuauuuuauga

SEQ ID NO: 317512 - RNA, 22 nt, Homo sapiens
aaguagugcuugugcucaucuc

SEQ ID NO: 317513 - RNA, 22 nt, Homo sapiens
aaguaguuaggaacauucucuc

SEQ ID NO: 317514 - RNA, 22 nt, Homo sapiens
aaguauuaugaguccuuguuuu

SEQ ID NO: 317515 - RNA, 22 nt, Homo sapiens
aagugccauguggaugggcccu

SEQ ID NO: 317516 - RNA, 21 nt, Homo sapiens
aauaaagcaaccuuaugccau

SEQ ID NO: 317517 - RNA, 22 nt, Homo sapiens
aaucaccaugcacuacagccuu

SEQ ID NO: 317518 - RNA, 22 nt, Homo sapiens
aaucugggguuguuuggggagu

SEQ ID NO: 317519 - RNA, 22 nt, Homo sapiens
aaugacugugauauuuuucuuc

SEQ ID NO: 317520 - RNA, 22 nt, Homo sapiens
aaugcuguguuauuucaugacc

SEQ ID NO: 317521 - RNA, 22 nt, Homo sapiens
aucugguguauuggugcugggu

SEQ ID NO: 317522 - RNA, 22 nt, Homo sapiens
augagaaugaagccuggcgugu

SEQ ID NO: 317523 - RNA, 22 nt, Homo sapiens
augaggagguaugauuuucuga

SEQ ID NO: 317524 - RNA, 22 nt, Homo sapiens
augaggugaggucaguaaggua

SEQ ID NO: 317525 - RNA, 22 nt, Homo sapiens
augaggugggagaaucacuuga

SEQ ID NO: 317526 - RNA, 21 nt, Homo sapiens
augagguguacuguggugaaa

SEQ ID NO: 317527 - RNA, 22 nt, Homo sapiens
augagguguuuauuguauccug

SEQ ID NO: 317528 - RNA, 22 nt, Homo sapiens
augcaaacaucugaagagacau

SEQ ID NO: 317529 - RNA, 22 nt, Homo sapiens
augcacuguauaggaucuugcg

SEQ ID NO: 317530 - RNA, 22 nt, Homo sapiens
augcuuguguuggggcagugga

SEQ ID NO: 317531 - RNA, 22 nt, Homo sapiens
auggaauguauagucauguagg

SEQ ID NO: 317532 - RNA, 22 nt, Homo sapiens
auggcaaaauguuccuaguggu

SEQ ID NO: 317533 - RNA, 22 nt, Homo sapiens
auggcacugauggaaguaccuu

SEQ ID NO: 317534 - RNA, 18 nt, Homo sapiens
auggcagaacaauuuaca

SEQ ID NO: 317535 - RNA, 22 nt, Homo sapiens
auggcagugagucucuaguauu

SEQ ID NO: 317536 - RNA, 22 nt, Homo sapiens
auggcauugaagaguugucccu

SEQ ID NO: 317537 - RNA, 22 nt, Homo sapiens
auggcauuuuuagggcugggug

SEQ ID NO: 317538 - RNA, 22 nt, Homo sapiens
auggcccaguuugcuaucccua

SEQ ID NO: 317539 - RNA, 22 nt, Homo sapiens
auggcugagugauuucaaacag

SEQ ID NO: 317540 - RNA, 22 nt, Homo sapiens
augugcaacugcuggaacaguc

SEQ ID NO: 317541 - RNA, 22 nt, Homo sapiens
auguggcuuuccuagaucuuag

SEQ ID NO: 317542 - RNA, 18 nt, Homo sapiens
auguggcuuuugaaggcu

SEQ ID NO: 317543 - RNA, 22 nt, Homo sapiens
auugcacuccagcccgggugac

SEQ ID NO: 317544 - RNA, 22 nt, Homo sapiens
auugcauuuucagguuggucug

SEQ ID NO: 317545 - RNA, 22 nt, Homo sapiens
auugcugagacauugcuaaucu

SEQ ID NO: 317546 - RNA, 22 nt, Homo sapiens
auuggacagcauuucuagacuu

SEQ ID NO: 317547 - RNA, 22 nt, Homo sapiens
auuguucuuacaugcugucauc

SEQ ID NO: 317548 - RNA, 20 nt, Homo sapiens
auuuggcauaguuuaagcaa

SEQ ID NO: 317549 - RNA, 22 nt, Homo sapiens
caaaggcuguuauaggccagga

SEQ ID NO: 317550 - RNA, 22 nt, Homo sapiens
caacagucagcccauccacaga

SEQ ID NO: 317551 - RNA, 19 nt, Homo sapiens
caacccugcagagaaagga

SEQ ID NO: 317552 - RNA, 23 nt, Homo sapiens
caauacugaccucacguuaauag

SEQ ID NO: 317553 - RNA, 22 nt, Homo sapiens
caauacuguuaccugaaauagg

SEQ ID NO: 317554 - RNA, 22 nt, Homo sapiens
caaugguacuagauaucuucag

SEQ ID NO: 317555 - RNA, 22 nt, Homo sapiens
cacaaaguagauuagucuucca

SEQ ID NO: 317556 - RNA, 22 nt, Homo sapiens
caccacauuccauugaucaggc

SEQ ID NO: 317557 - RNA, 22 nt, Homo sapiens
cacccaguaagcaugaggcccu

SEQ ID NO: 317558 - RNA, 22 nt, Homo sapiens
cacccagucaucuuggguuuuu

SEQ ID NO: 317559 - RNA, 22 nt, Homo sapiens
cacugcgaccuccaccucccgg

SEQ ID NO: 317560 - RNA, 22 nt, Homo sapiens
cagacagugucccgagucccug

SEQ ID NO: 317561 - RNA, 22 nt, Homo sapiens
cagagugcauguuuagaugagu

SEQ ID NO: 317562 - RNA, 22 nt, Homo sapiens
cagauguaguauuuuagugaaa

SEQ ID NO: 317563 - RNA, 22 nt, Homo sapiens
cagcuaaauuguuaaauccaag

SEQ ID NO: 317564 - RNA, 23 nt, Homo sapiens
cagcuucauugaacauaacuccu

SEQ ID NO: 317565 - RNA, 22 nt, Homo sapiens
cagggcauuggcugguaccugg

SEQ ID NO: 317566 - RNA, 22 nt, Homo sapiens
cagggcauugucuucuuaguac

SEQ ID NO: 317567 - RNA, 19 nt, Homo sapiens
cagguagugugcugacaug

SEQ ID NO: 317568 - RNA, 22 nt, Homo sapiens
cagugucugcauuuggaacuca

SEQ ID NO: 317569 - RNA, 22 nt, Homo sapiens
caguuguuuuaugacauaagau

SEQ ID NO: 317570 - RNA, 21 nt, Homo sapiens
cauaaugcuacuuauuuuaug

SEQ ID NO: 317571 - RNA, 21 nt, Homo sapiens
caucaaauugucauggugggu

SEQ ID NO: 317572 - RNA, 19 nt, Homo sapiens
caucccugagcugaagugg

SEQ ID NO: 317573 - RNA, 22 nt, Homo sapiens
caugaaagugagaaacuccugg

SEQ ID NO: 317574 - RNA, 22 nt, Homo sapiens
cauggcacaucuuuucugacua

SEQ ID NO: 317575 - RNA, 22 nt, Homo sapiens
cauugguuccaguuuguccuua

SEQ ID NO: 317576 - RNA, 22 nt, Homo sapiens
cauuuuacuuuccagacgugga

SEQ ID NO: 317577 - RNA, 22 nt, Homo sapiens
ccaaggcacugauucuguacuc

SEQ ID NO: 317578 - RNA, 22 nt, Homo sapiens
ccacauuggaaaggaucccccc

SEQ ID NO: 317579 - RNA, 22 nt, Homo sapiens
ccagaguggagccuuugcgagg

SEQ ID NO: 317580 - RNA, 22 nt, Homo sapiens
ccaggguuccacgccuggcugu

SEQ ID NO: 317581 - RNA, 18 nt, Homo sapiens
ccagugcaaggaaagccc

SEQ ID NO: 317582 - RNA, 22 nt, Homo sapiens
cccucgagaaaccaucugcuga

SEQ ID NO: 317583 - RNA, 22 nt, Homo sapiens
cccugagaaaacuuuguccuua

SEQ ID NO: 317584 - RNA, 19 nt, Homo sapiens
cccuggcacauggaaaaug

SEQ ID NO: 317585 - RNA, 22 nt, Homo sapiens
cccuugcacuucagagcugcau

SEQ ID NO: 317586 - RNA, 22 nt, Homo sapiens
ccuuuuuguaguggaaguagga

SEQ ID NO: 317587 - RNA, 22 nt, Homo sapiens
cuaagauugucuuaguguguug

SEQ ID NO: 317588 - RNA, 17 nt, Homo sapiens
cuaaggcaagagucugc

SEQ ID NO: 317589 - RNA, 22 nt, Homo sapiens
cuaaggcaguagccugaauaau

SEQ ID NO: 317590 - RNA, 22 nt, Homo sapiens
cuaauacaguuguccaagcugg

SEQ ID NO: 317591 - RNA, 18 nt, Homo sapiens
cuaauacuauucaacaag

SEQ ID NO: 317592 - RNA, 22 nt, Homo sapiens
cuauggcuguaugacgugcaug

SEQ ID NO: 317593 - RNA, 22 nt, Homo sapiens
cuauucacaggcaauauguaca

SEQ ID NO: 317594 - RNA, 22 nt, Homo sapiens
cucaauuuggaauugucaguaa

SEQ ID NO: 317595 - RNA, 22 nt, Homo sapiens
cucacagucucucccuaauuuu

SEQ ID NO: 317596 - RNA, 22 nt, Homo sapiens
cucaccuugugauccacccgcc

SEQ ID NO: 317597 - RNA, 22 nt, Homo sapiens
cucacggcccugcgcacuggca

SEQ ID NO: 317598 - RNA, 22 nt, Homo sapiens
cucacugggaccacucugaagu

SEQ ID NO: 317599 - RNA, 22 nt, Homo sapiens
cucacugugguguccuuaggua

SEQ ID NO: 317600 - RNA, 22 nt, Homo sapiens
cucauggagauagagaauagaa

SEQ ID NO: 317601 - RNA, 22 nt, Homo sapiens
cucauugcaaucucugccuccc

SEQ ID NO: 317602 - RNA, 22 nt, Homo sapiens
cuccacugagcaggugggaggc

SEQ ID NO: 317603 - RNA, 22 nt, Homo sapiens
cuccaggugucauccaccuccu

SEQ ID NO: 317604 - RNA, 22 nt, Homo sapiens
cuccauuuggaacagauguccu

SEQ ID NO: 317605 - RNA, 22 nt, Homo sapiens
cucccuuugcugaauguuuuuc

SEQ ID NO: 317606 - RNA, 19 nt, Homo sapiens
cugaaacacagagagggcu

SEQ ID NO: 317607 - RNA, 20 nt, Homo sapiens
cugaaugucaaggcagaggu

SEQ ID NO: 317608 - RNA, 22 nt, Homo sapiens
cugagacacucuuaucugcaua

SEQ ID NO: 317609 - RNA, 22 nt, Homo sapiens
cugaggacaucagggaagcauc

SEQ ID NO: 317610 - RNA, 22 nt, Homo sapiens
acacagugucuguguauuuaaa

SEQ ID NO: 317611 - RNA, 22 nt, Homo sapiens
acacucuaguguucuuaaucag

SEQ ID NO: 317612 - RNA, 22 nt, Homo sapiens
acacuguaacucuuugagggca

SEQ ID NO: 317613 - RNA, 22 nt, Homo sapiens
acacuguccaguuaggcuacau

SEQ ID NO: 317614 - RNA, 19 nt, Homo sapiens
acaguaccuggcaugaggu

SEQ ID NO: 317615 - RNA, 22 nt, Homo sapiens
acaguggugcgaucucggcuca

SEQ ID NO: 317616 - RNA, 18 nt, Homo sapiens
acaguguguaaggguucu

SEQ ID NO: 317617 - RNA, 22 nt, Homo sapiens
acauggcacugcgggcuucuug

SEQ ID NO: 317618 - RNA, 22 nt, Homo sapiens
acccaguagccagauguagcug

SEQ ID NO: 317619 - RNA, 23 nt, Homo sapiens
accccuacaggcuuguguccugc

SEQ ID NO: 317620 - RNA, 22 nt, Homo sapiens
acccgcccagguguggccggga

SEQ ID NO: 317621 - RNA, 22 nt, Homo sapiens
acccggcaguaauccugcgcgc

SEQ ID NO: 317622 - RNA, 22 nt, Homo sapiens
acccuauagaggcaauaggcac

SEQ ID NO: 317623 - RNA, 22 nt, Homo sapiens
acccugucauccacauggugcu

SEQ ID NO: 317624 - RNA, 22 nt, Homo sapiens
acuaaggcacaauuuucucaua

SEQ ID NO: 317625 - RNA, 22 nt, Homo sapiens
agaauguauauucuguaguugu

SEQ ID NO: 317626 - RNA, 22 nt, Homo sapiens
agacuguaaugcauaauuuacu

SEQ ID NO: 317627 - RNA, 22 nt, Homo sapiens
agagaacugauuggaguugggc

SEQ ID NO: 317628 - RNA, 22 nt, Homo sapiens
agagaugaagauggggcucccg

SEQ ID NO: 317629 - RNA, 22 nt, Homo sapiens
agagcaaugacaugcuaugugg

SEQ ID NO: 317630 - RNA, 22 nt, Homo sapiens
agagcauugaguuaaugguuca

SEQ ID NO: 317631 - RNA, 22 nt, Homo sapiens
agagcuaguauuuacggagcau

SEQ ID NO: 317632 - RNA, 18 nt, Homo sapiens
agagcuaugaacauaugc

SEQ ID NO: 317633 - RNA, 22 nt, Homo sapiens
agagguaagcaguggcaagugc

SEQ ID NO: 317634 - RNA, 22 nt, Homo sapiens
agagguagaagauaggcuacag

SEQ ID NO: 317635 - RNA, 20 nt, Homo sapiens
agagugcuggacugaggagc

SEQ ID NO: 317636 - RNA, 22 nt, Homo sapiens
agauacaucuaugugucugugu

SEQ ID NO: 317637 - RNA, 22 nt, Homo sapiens
agaucacagucuuugguuuuag

SEQ ID NO: 317638 - RNA, 23 nt, Homo sapiens
agaugcaucuggcugcgaggcaa

SEQ ID NO: 317639 - RNA, 22 nt, Homo sapiens
agauggugauaaaugugguacc

SEQ ID NO: 317640 - RNA, 22 nt, Homo sapiens
agaugguguuggcugaguguau

SEQ ID NO: 317641 - RNA, 22 nt, Homo sapiens
agauguuguucaucugauuguu

SEQ ID NO: 317642 - RNA, 23 nt, Homo sapiens
agcaccaccccaggucacaagug

SEQ ID NO: 317643 - RNA, 21 nt, Homo sapiens
agcagcuuugguugaagcaga

SEQ ID NO: 317644 - RNA, 22 nt, Homo sapiens
agcuaguauuuucuuaaggauu

SEQ ID NO: 317645 - RNA, 22 nt, Homo sapiens
agcuaguauuuuguuaaggauu

SEQ ID NO: 317646 - RNA, 20 nt, Homo sapiens
agcugcagauauaaauccgc

SEQ ID NO: 317647 - RNA, 22 nt, Homo sapiens
agcuuguauuuguagccuguug

SEQ ID NO: 317648 - RNA, 19 nt, Homo sapiens
agcuuuggcuaacuuucuc

SEQ ID NO: 317649 - RNA, 22 nt, Homo sapiens
aggaacuguaacuaugucucug

SEQ ID NO: 317650 - RNA, 22 nt, Homo sapiens
aggaauuuaauguaugauaaua

SEQ ID NO: 317651 - RNA, 20 nt, Homo sapiens
aggacuacagaggguaggau

SEQ ID NO: 317652 - RNA, 22 nt, Homo sapiens
aggagcacaauggucaugugga

SEQ ID NO: 317653 - RNA, 22 nt, Homo sapiens
agggaagugugcuaugcauuua

SEQ ID NO: 317654 - RNA, 22 nt, Homo sapiens
agggcacuguagguccugccuc

SEQ ID NO: 317655 - RNA, 22 nt, Homo sapiens
agguaaacauggggacugcuac

SEQ ID NO: 317656 - RNA, 22 nt, Homo sapiens
agguagaguguuuuguucuucu

SEQ ID NO: 317657 - RNA, 22 nt, Homo sapiens
agguauauuggacagauguaaa

SEQ ID NO: 317658 - RNA, 22 nt, Homo sapiens
agguauguaugucuguacagcg

SEQ ID NO: 317659 - RNA, 22 nt, Homo sapiens
aggugcugagcagagaauccug

SEQ ID NO: 317660 - RNA, 22 nt, Homo sapiens
aguaacaggauccaaagaaugu

SEQ ID NO: 317661 - RNA, 22 nt, Homo sapiens
aguaacauuucuaguagagagu

SEQ ID NO: 317662 - RNA, 22 nt, Homo sapiens
agucaacaucaugaaguggaaa

SEQ ID NO: 317663 - RNA, 22 nt, Homo sapiens
agucaagauggcaagguaaggc

SEQ ID NO: 317664 - RNA, 22 nt, Homo sapiens
agucacagccuuuuacuuuaga

SEQ ID NO: 317665 - RNA, 22 nt, Homo sapiens
agucacagugaccuugucugac

SEQ ID NO: 317666 - RNA, 22 nt, Homo sapiens
agucagugucuguaaggagaac

SEQ ID NO: 317667 - RNA, 22 nt, Homo sapiens
agucaguguguauugauggcac

SEQ ID NO: 317668 - RNA, 22 nt, Homo sapiens
agucauggcagaaggcaccucu

SEQ ID NO: 317669 - RNA, 22 nt, Homo sapiens
agucugguguucucacacuagu

SEQ ID NO: 317670 - RNA, 22 nt, Homo sapiens
agugaacaaagaagugcagaua

SEQ ID NO: 317671 - RNA, 22 nt, Homo sapiens
agugauuuuaacuuccagcaau

SEQ ID NO: 317672 - RNA, 22 nt, Homo sapiens
agugcauugcaucucugcuuca

SEQ ID NO: 317673 - RNA, 22 nt, Homo sapiens
aguggauuuuauuugacaacua

SEQ ID NO: 317674 - RNA, 20 nt, Homo sapiens
agugguuuucaaauaugucu

SEQ ID NO: 317675 - RNA, 22 nt, Homo sapiens
auaaaccuacauuuucacuucu

SEQ ID NO: 317676 - RNA, 22 nt, Homo sapiens
auaaagacacuuggcaugauuu

SEQ ID NO: 317677 - RNA, 22 nt, Homo sapiens
auaaaugcuuagaucuguauau

SEQ ID NO: 317678 - RNA, 22 nt, Homo sapiens
auaaaugcuuccagucauuaaa

SEQ ID NO: 317679 - RNA, 22 nt, Homo sapiens
auaacagcauuauugcauacgu

SEQ ID NO: 317680 - RNA, 22 nt, Homo sapiens
auacaguaaugucuuaggcugu

SEQ ID NO: 317681 - RNA, 22 nt, Homo sapiens
auacaugugccauggugguuug

SEQ ID NO: 317682 - RNA, 22 nt, Homo sapiens
auacaugugccauguugguaug

SEQ ID NO: 317683 - RNA, 22 nt, Homo sapiens
auagucaguagucucauaauga

SEQ ID NO: 317684 - RNA, 22 nt, Homo sapiens
auagugcugcaauuaacauaca

SEQ ID NO: 317685 - RNA, 22 nt, Homo sapiens
auauuacagagaggaccuggga

SEQ ID NO: 317686 - RNA, 22 nt, Homo sapiens
auauuggccuaaaauucucuuu

SEQ ID NO: 317687 - RNA, 22 nt, Homo sapiens
auauuugguuaccugugggucu

SEQ ID NO: 317688 - RNA, 19 nt, Homo sapiens
aucaaacugcucuuugagg

SEQ ID NO: 317689 - RNA, 20 nt, Homo sapiens
aucaaagacuuagaggggga

SEQ ID NO: 317690 - RNA, 22 nt, Homo sapiens
aucaagcuugacuccuuaaagg

SEQ ID NO: 317691 - RNA, 22 nt, Homo sapiens
aucacagaacuuugagcagaga

SEQ ID NO: 317692 - RNA, 22 nt, Homo sapiens
aucaccagaugcuucaagcaga

SEQ ID NO: 317693 - RNA, 22 nt, Homo sapiens
aucacugggcaagauaucauga

SEQ ID NO: 317694 - RNA, 22 nt, Homo sapiens
aucacuggucaugagagaagua

SEQ ID NO: 317695 - RNA, 22 nt, Homo sapiens
aucacuuugcucuccagugugg

SEQ ID NO: 317696 - RNA, 22 nt, Homo sapiens
aaagucuguuuugucagagacu

SEQ ID NO: 317697 - RNA, 22 nt, Homo sapiens
aaagugcugggaucacacugaa

SEQ ID NO: 317698 - RNA, 22 nt, Homo sapiens
aaaguggugggauuccaggcau

SEQ ID NO: 317699 - RNA, 22 nt, Homo sapiens
aaaugacuuuuuaugcagagua

SEQ ID NO: 317700 - RNA, 22 nt, Homo sapiens
aaaugcuucuauguggcauguu

SEQ ID NO: 317701 - RNA, 22 nt, Homo sapiens
aaauggcuuuuugggcaaggug

SEQ ID NO: 317702 - RNA, 22 nt, Homo sapiens
aacagugcauucagggauauau

SEQ ID NO: 317703 - RNA, 22 nt, Homo sapiens
aacagugcuucauucacacauu

SEQ ID NO: 317704 - RNA, 22 nt, Homo sapiens
aacccugacacaagcagaauuu

SEQ ID NO: 317705 - RNA, 22 nt, Homo sapiens
aacuugcacuugauugagagcu

SEQ ID NO: 317706 - RNA, 22 nt, Homo sapiens
aagagguagcagucacaaaaga

SEQ ID NO: 317707 - RNA, 22 nt, Homo sapiens
aagauaguaaacauuuucugcu

SEQ ID NO: 317708 - RNA, 20 nt, Homo sapiens
aagcaagcauuugcaaucau

SEQ ID NO: 317709 - RNA, 21 nt, Homo sapiens
aagcaugguguaucuuuccau

SEQ ID NO: 317710 - RNA, 22 nt, Homo sapiens
aaggaaguaauuugguuuauag

SEQ ID NO: 317711 - RNA, 22 nt, Homo sapiens
aaggagugugauucuucaguuu

SEQ ID NO: 317712 - RNA, 22 nt, Homo sapiens
aaggcuauuugagaaugugugu

SEQ ID NO: 317713 - RNA, 20 nt, Homo sapiens
aaggcuuucgaguuccaggg

SEQ ID NO: 317714 - RNA, 22 nt, Homo sapiens
aagggaauguuguggcugguug

SEQ ID NO: 317715 - RNA, 22 nt, Homo sapiens
aaggugguuuucucuuggaguc

SEQ ID NO: 317716 - RNA, 22 nt, Homo sapiens
aaguaaaucuuaugucagggag

SEQ ID NO: 317717 - RNA, 22 nt, Homo sapiens
aaguaauugagguuuuugcugu

SEQ ID NO: 317718 - RNA, 22 nt, Homo sapiens
aagugcuucagaagacaauauu

SEQ ID NO: 317719 - RNA, 22 nt, Homo sapiens
aaguuguuggaguuccauuguu

SEQ ID NO: 317720 - RNA, 22 nt, Homo sapiens
aauaaagcaggguccuugcacu

SEQ ID NO: 317721 - RNA, 22 nt, Homo sapiens
aauaaagccugucucuuuagag

SEQ ID NO: 317722 - RNA, 22 nt, Homo sapiens
aauagcuguuuuuaauuccugc

SEQ ID NO: 317723 - RNA, 22 nt, Homo sapiens
aaucugauguuaucagcuuaag

SEQ ID NO: 317724 - RNA, 22 nt, Homo sapiens
aaugaaguuagauguugagaag

SEQ ID NO: 317725 - RNA, 22 nt, Homo sapiens
aaugacacugagcaucuuucau

SEQ ID NO: 317726 - RNA, 22 nt, Homo sapiens
aaugacuaagaugguacauuuu

SEQ ID NO: 317727 - RNA, 22 nt, Homo sapiens
aauucacuucuuuuaggcaggg

SEQ ID NO: 317728 - RNA, 22 nt, Homo sapiens
aauugcaucuguucuuugccag

SEQ ID NO: 317729 - RNA, 22 nt, Homo sapiens
aauugcucuccuccaaggucuu

SEQ ID NO: 317730 - RNA, 22 nt, Homo sapiens
aauuugucaccucucucccuuu

SEQ ID NO: 317731 - RNA, 22 nt, Homo sapiens
acaacaguuuuaucaccccaga

SEQ ID NO: 317732 - RNA, 22 nt, Homo sapiens
acacaaugguaaguguuugugu

SEQ ID NO: 317733 - RNA, 23 nt, Homo sapiens
acacaguaaacuaaaagcuagcu

SEQ ID NO: 317734 - RNA, 22 nt, Homo sapiens
acacaguaaauauugucuccuc

SEQ ID NO: 317735 - RNA, 20 nt, Homo sapiens
acacuggcuuugagauuuag

SEQ ID NO: 317736 - RNA, 22 nt, Homo sapiens
acacuguacuuauguuuugcag

SEQ ID NO: 317737 - RNA, 22 nt, Homo sapiens
acaggugaaguauuacacuaag

SEQ ID NO: 317738 - RNA, 22 nt, Homo sapiens
acagugcuucugauaugaugcc

SEQ ID NO: 317739 - RNA, 22 nt, Homo sapiens
acagugcuuggcacacaguaau

SEQ ID NO: 317740 - RNA, 23 nt, Homo sapiens
acaguggugugaucuuggcucag

SEQ ID NO: 317741 - RNA, 17 nt, Homo sapiens
acagugucuaugaaaug

SEQ ID NO: 317742 - RNA, 21 nt, Homo sapiens
acauguacacauguaugcaca

SEQ ID NO: 317743 - RNA, 22 nt, Homo sapiens
accaugcaguccaauaugcaca

SEQ ID NO: 317744 - RNA, 22 nt, Homo sapiens
acccaguaacauaugggaggga

SEQ ID NO: 317745 - RNA, 22 nt, Homo sapiens
acccaguguugggcagaacugu

SEQ ID NO: 317746 - RNA, 22 nt, Homo sapiens
acccucagaccaguuucccugg

SEQ ID NO: 317747 - RNA, 22 nt, Homo sapiens
accugagacuaggcauuuuaua

SEQ ID NO: 317748 - RNA, 18 nt, Homo sapiens
accuucauuccuuugccu

SEQ ID NO: 317749 - RNA, 22 nt, Homo sapiens
acuacuucuaaguuuuggaaga

SEQ ID NO: 317750 - RNA, 22 nt, Homo sapiens
acucagagauuagcacauguuu

SEQ ID NO: 317751 - RNA, 22 nt, Homo sapiens
acugcacuccagccugcccaac

SEQ ID NO: 317752 - RNA, 22 nt, Homo sapiens
acuguguguuugucuagcacag

SEQ ID NO: 317753 - RNA, 22 nt, Homo sapiens
acuuuguguuacccagcaagga

SEQ ID NO: 317754 - RNA, 21 nt, Homo sapiens
acuuuguugggggcugaggca

SEQ ID NO: 317755 - RNA, 22 nt, Homo sapiens
agacacugaaauguauugaaga

SEQ ID NO: 317756 - RNA, 22 nt, Homo sapiens
agacaguguguguauauauggu

SEQ ID NO: 317757 - RNA, 20 nt, Homo sapiens
agacuagggagcagaaagcc

SEQ ID NO: 317758 - RNA, 23 nt, Homo sapiens
agacugaaguaucugagacucag

SEQ ID NO: 317759 - RNA, 22 nt, Homo sapiens
auuugucaauacacuucuucca

SEQ ID NO: 317760 - RNA, 22 nt, Homo sapiens
auuuguccugccuuuuccuccu

SEQ ID NO: 317761 - RNA, 22 nt, Homo sapiens
auuuugguuacauaguugagcu

SEQ ID NO: 317762 - RNA, 22 nt, Homo sapiens
caaaccuguaggggccaagagg

SEQ ID NO: 317763 - RNA, 22 nt, Homo sapiens
caaagcacuuggcuuggaagau

SEQ ID NO: 317764 - RNA, 22 nt, Homo sapiens
caaauacuuucauguugucuug

SEQ ID NO: 317765 - RNA, 22 nt, Homo sapiens
caaauccucaccucaucaugaa

SEQ ID NO: 317766 - RNA, 22 nt, Homo sapiens
caaauugcuuguggaggauaau

SEQ ID NO: 317767 - RNA, 22 nt, Homo sapiens
caagacuguccaacauauuggg

SEQ ID NO: 317768 - RNA, 22 nt, Homo sapiens
caaggaauucucaauagaguua

SEQ ID NO: 317769 - RNA, 22 nt, Homo sapiens
caauacuguguugaauaagagu

SEQ ID NO: 317770 - RNA, 19 nt, Homo sapiens
caauacuucuuggcauaca

SEQ ID NO: 317771 - RNA, 21 nt, Homo sapiens
caaugacacuguagcugugcu

SEQ ID NO: 317772 - RNA, 22 nt, Homo sapiens
cacaguugccuaucuccugaag

SEQ ID NO: 317773 - RNA, 22 nt, Homo sapiens
cacauguuugcuacauuuuucu

SEQ ID NO: 317774 - RNA, 22 nt, Homo sapiens
cacauugcaggaaaguucauua

SEQ ID NO: 317775 - RNA, 22 nt, Homo sapiens
caccacuacaccccaggcuggg

SEQ ID NO: 317776 - RNA, 22 nt, Homo sapiens
cacugcacuccagucugacgac

SEQ ID NO: 317777 - RNA, 22 nt, Homo sapiens
cacugcaguaaauugcgucggu

SEQ ID NO: 317778 - RNA, 22 nt, Homo sapiens
cacugcauggucuagcuggguu

SEQ ID NO: 317779 - RNA, 22 nt, Homo sapiens
cagagguauugcaaaagccuag

SEQ ID NO: 317780 - RNA, 22 nt, Homo sapiens
cagauacuccuggucucaggag

SEQ ID NO: 317781 - RNA, 22 nt, Homo sapiens
cagauggucuuaaggcagccuu

SEQ ID NO: 317782 - RNA, 22 nt, Homo sapiens
caggcacgcuugggagacacac

SEQ ID NO: 317783 - RNA, 22 nt, Homo sapiens
cagugcaaagccucugcccaga

SEQ ID NO: 317784 - RNA, 22 nt, Homo sapiens
cagugcaaccuccaucucucgg

SEQ ID NO: 317785 - RNA, 22 nt, Homo sapiens
uaagggcacuaaucccauuuau

SEQ ID NO: 317786 - RNA, 22 nt, Homo sapiens
uaagguuacaaaggacuucaua

SEQ ID NO: 317787 - RNA, 22 nt, Homo sapiens
uaaguaauugugguuucugcca

SEQ ID NO: 317788 - RNA, 22 nt, Homo sapiens
uaaguaauugugguuuuugcca

SEQ ID NO: 317789 - RNA, 22 nt, Homo sapiens
uaagucuuuuuggaguuuauaa

SEQ ID NO: 317790 - RNA, 22 nt, Homo sapiens
uaagugguguucauucuuuuga

SEQ ID NO: 317791 - RNA, 22 nt, Homo sapiens
uaaguuagugugagaauuuugc

SEQ ID NO: 317792 - RNA, 20 nt, Homo sapiens
uaaguuguauuugucaugaa

SEQ ID NO: 317793 - RNA, 22 nt, Homo sapiens
uaauacuugucauaaaggcauu

SEQ ID NO: 317794 - RNA, 22 nt, Homo sapiens
uacaaccucugccucccaaguu

SEQ ID NO: 317795 - RNA, 22 nt, Homo sapiens
uacagugcuuuuugguggagaa

SEQ ID NO: 317796 - RNA, 22 nt, Homo sapiens
uacauguauguguuuauggcug

SEQ ID NO: 317797 - RNA, 22 nt, Homo sapiens
uaccacccuuuuuccagaagcc

SEQ ID NO: 317798 - RNA, 22 nt, Homo sapiens
uacugcugucagugccaaguag

SEQ ID NO: 317799 - RNA, 22 nt, Homo sapiens
uacuuaguagcuuauccugugg

SEQ ID NO: 317800 - RNA, 22 nt, Homo sapiens
uacuuuguagagugugagaauu

SEQ ID NO: 317801 - RNA, 22 nt, Homo sapiens
uagagaucuuauauuuuaugac

SEQ ID NO: 317802 - RNA, 22 nt, Homo sapiens
uagagguagagugacuucccca

SEQ ID NO: 317803 - RNA, 22 nt, Homo sapiens
uagagguagguguaugaacuag

SEQ ID NO: 317804 - RNA, 22 nt, Homo sapiens
uagagguauuaacaguagaaga

SEQ ID NO: 317805 - RNA, 21 nt, Homo sapiens
uagcaaauugcuauuaaggca

SEQ ID NO: 317806 - RNA, 22 nt, Homo sapiens
uagcacaucccuaaaaugcugu

SEQ ID NO: 317807 - RNA, 22 nt, Homo sapiens
uagcaccugugcacaccaggca

SEQ ID NO: 317808 - RNA, 22 nt, Homo sapiens
uagcagcaccccacucuacugg

SEQ ID NO: 317809 - RNA, 19 nt, Homo sapiens
uagcagcaugauuuauaau

SEQ ID NO: 317810 - RNA, 22 nt, Homo sapiens
uagcaguaucccaccaucuggu

SEQ ID NO: 317811 - RNA, 22 nt, Homo sapiens
uagcagucaagauagucauuau

SEQ ID NO: 317812 - RNA, 22 nt, Homo sapiens
uagcuguuggugggaagucaga

SEQ ID NO: 317813 - RNA, 22 nt, Homo sapiens
uaggcaauguacauaucggccc

SEQ ID NO: 317814 - RNA, 22 nt, Homo sapiens
uaggcauuuuucugauaaacua

SEQ ID NO: 317815 - RNA, 22 nt, Homo sapiens
uaggcuuuucugggaugugggc

SEQ ID NO: 317816 - RNA, 22 nt, Homo sapiens
uaguagugucccugacuaucac

SEQ ID NO: 317817 - RNA, 22 nt, Homo sapiens
uaguaguuuuguguauaauaau

SEQ ID NO: 317818 - RNA, 18 nt, Homo sapiens
uagugcuguucucaugau

SEQ ID NO: 317819 - RNA, 22 nt, Homo sapiens
uauaagacuagcagcugaauug

SEQ ID NO: 317820 - RNA, 22 nt, Homo sapiens
uauacaugugggcaucaggaga

SEQ ID NO: 317821 - RNA, 22 nt, Homo sapiens
uauaugucuuuguuauguugag

SEQ ID NO: 317822 - RNA, 22 nt, Homo sapiens
uaucacaaacuuagcaguuuaa

SEQ ID NO: 317823 - RNA, 20 nt, Homo sapiens
uaucacaggucagaaacccu

SEQ ID NO: 317824 - RNA, 23 nt, Homo sapiens
uaucucaaugcacagagaggaaa

SEQ ID NO: 317825 - RNA, 22 nt, Homo sapiens
uauggguguuauugcaugggag

SEQ ID NO: 317826 - RNA, 22 nt, Homo sapiens
uauggguuuuucauaaauaggu

SEQ ID NO: 317827 - RNA, 22 nt, Homo sapiens
uaugugcuuuguuaaacagaug

SEQ ID NO: 317828 - RNA, 22 nt, Homo sapiens
uauugucaccaucccuguuuua

SEQ ID NO: 317829 - RNA, 22 nt, Homo sapiens
ucaaaguaaagccucaggaugg

SEQ ID NO: 317830 - RNA, 22 nt, Homo sapiens
ucaaagugagcuccuucucacu

SEQ ID NO: 317831 - RNA, 22 nt, Homo sapiens
ucaacagugauggaaaguuaua

SEQ ID NO: 317832 - RNA, 22 nt, Homo sapiens
ucaagcaauucuccucucagcc

SEQ ID NO: 317833 - RNA, 22 nt, Homo sapiens
ucaagcaauucugcugccucag

SEQ ID NO: 317834 - RNA, 20 nt, Homo sapiens
ucaaggcacgaauaaaaguu

SEQ ID NO: 317835 - RNA, 22 nt, Homo sapiens
ucacagaugcuugacccauuuc

SEQ ID NO: 317836 - RNA, 22 nt, Homo sapiens
ucacagucaaaguaaucauaga

SEQ ID NO: 317837 - RNA, 20 nt, Homo sapiens
ucacagucacacauaauccu

SEQ ID NO: 317838 - RNA, 22 nt, Homo sapiens
ucacaguugauugaaacacagc

SEQ ID NO: 317839 - RNA, 22 nt, Homo sapiens
ucacauuguuauguaaauguuu

SEQ ID NO: 317840 - RNA, 22 nt, Homo sapiens
ucaccaccugcugaucauagag

SEQ ID NO: 317841 - RNA, 22 nt, Homo sapiens
ucacccacacaggagacaggga

SEQ ID NO: 317842 - RNA, 22 nt, Homo sapiens
ucaccuggagagcuugcuaaua

SEQ ID NO: 317843 - RNA, 22 nt, Homo sapiens
ucacugaaaccgccuccaccuc

SEQ ID NO: 317844 - RNA, 22 nt, Homo sapiens
ucacugaaaccuccgccuucug

SEQ ID NO: 317845 - RNA, 22 nt, Homo sapiens
ucacugcacucuccgccuugcg

SEQ ID NO: 317846 - RNA, 19 nt, Homo sapiens
ucacuggacagcacacuca

SEQ ID NO: 317847 - RNA, 18 nt, Homo sapiens
ucagagugcagacuauac

SEQ ID NO: 317848 - RNA, 22 nt, Homo sapiens
ucagaugaucugguaagaacuu

SEQ ID NO: 317849 - RNA, 20 nt, Homo sapiens
ucagcagucuggagcagagg

SEQ ID NO: 317850 - RNA, 22 nt, Homo sapiens
ucagcaguggacagaaugguag

SEQ ID NO: 317851 - RNA, 22 nt, Homo sapiens
ucagcaucacgugggcucccgu

SEQ ID NO: 317852 - RNA, 22 nt, Homo sapiens
ucaggcaccuuccucuuaucug

SEQ ID NO: 317853 - RNA, 23 nt, Homo sapiens
ucaguacuccacuuucaauagug

SEQ ID NO: 317854 - RNA, 18 nt, Homo sapiens
ucagucacugccuggcuu

SEQ ID NO: 317855 - RNA, 22 nt, Homo sapiens
ucagucuuuuaccauuaaguau

SEQ ID NO: 317856 - RNA, 21 nt, Homo sapiens
ucagugcugugggcaaggugc

SEQ ID NO: 317857 - RNA, 22 nt, Homo sapiens
ucauuguccaacuucuuucagu

SEQ ID NO: 317858 - RNA, 22 nt, Homo sapiens
uccacuuuugugcugaauugga

SEQ ID NO: 317859 - RNA, 17 nt, Homo sapiens
uccagauuucaauugaa

SEQ ID NO: 317860 - RNA, 22 nt, Homo sapiens
uccauuuguagguagugagaca

SEQ ID NO: 317861 - RNA, 19 nt, Homo sapiens
ucccaagaugcucauacau

SEQ ID NO: 317862 - RNA, 19 nt, Homo sapiens
uccccaguuuuccguucag

SEQ ID NO: 317863 - RNA, 22 nt, Homo sapiens
uccccugagaacuugcuagaaa

SEQ ID NO: 317864 - RNA, 22 nt, Homo sapiens
ucccuguguuccuuuugaauug

SEQ ID NO: 317865 - RNA, 22 nt, Homo sapiens
uccugcauucauccugguguug

SEQ ID NO: 317866 - RNA, 22 nt, Homo sapiens
uccuucacucuacaucuuuguu

SEQ ID NO: 317867 - RNA, 22 nt, Homo sapiens
ucuagcacuuacuggcugugug

SEQ ID NO: 317868 - RNA, 22 nt, Homo sapiens
ucucaguguuaucuaucugccu

SEQ ID NO: 317869 - RNA, 22 nt, Homo sapiens
ucuccauugaaauggacauaau

SEQ ID NO: 317870 - RNA, 22 nt, Homo sapiens
ucuccauuguccagaugaggaa

SEQ ID NO: 317871 - RNA, 17 nt, Homo sapiens
ucucccaucccuuucuc

SEQ ID NO: 317872 - RNA, 22 nt, Homo sapiens
ucugacagugagagaaaucuga

SEQ ID NO: 317873 - RNA, 22 nt, Homo sapiens
ucuggaauguaaaguuuauggg

SEQ ID NO: 317874 - RNA, 22 nt, Homo sapiens
ucuggcacucagaggccuugcu

SEQ ID NO: 317875 - RNA, 22 nt, Homo sapiens
ucugguuccuuggcuucggguc

SEQ ID NO: 317876 - RNA, 22 nt, Homo sapiens
ucuguacugccaaguuucuuua

SEQ ID NO: 317877 - RNA, 22 nt, Homo sapiens
ucugucuuguccucacccuaga

SEQ ID NO: 317878 - RNA, 22 nt, Homo sapiens
ucugucuuugccuaaguuuguc

SEQ ID NO: 317879 - RNA, 22 nt, Homo sapiens
uggaauuuagguugauaguaua

SEQ ID NO: 317880 - RNA, 22 nt, Homo sapiens
uggacuagagggugggcgaggu

SEQ ID NO: 317881 - RNA, 22 nt, Homo sapiens
uggcaagaaccacaguuacuuu

SEQ ID NO: 317882 - RNA, 22 nt, Homo sapiens
uggcaagaagagcaugagacca

SEQ ID NO: 317883 - RNA, 22 nt, Homo sapiens
uggcagauggugacaccauuag

SEQ ID NO: 317884 - RNA, 22 nt, Homo sapiens
uggcaucuguucuacacauaaa

SEQ ID NO: 317885 - RNA, 22 nt, Homo sapiens
uggcaugucguuuuucauagga

SEQ ID NO: 317886 - RNA, 22 nt, Homo sapiens
uggcauuuucucuguucuuaga

SEQ ID NO: 317887 - RNA, 22 nt, Homo sapiens
uggcuagaccugcauaacagcu

SEQ ID NO: 317888 - RNA, 20 nt, Homo sapiens
ugggaaauguccaggacaua

SEQ ID NO: 317889 - RNA, 22 nt, Homo sapiens
ugggaagaagguuuacuugcca

SEQ ID NO: 317890 - RNA, 22 nt, Homo sapiens
ugggcaaauugugagggaggua

SEQ ID NO: 317891 - RNA, 22 nt, Homo sapiens
uggguagauaucauaguugccc

SEQ ID NO: 317892 - RNA, 22 nt, Homo sapiens
ugguccacuaacccucaguauc

SEQ ID NO: 317893 - RNA, 22 nt, Homo sapiens
uggugcuuaaauaaggcuuuca

SEQ ID NO: 317894 - RNA, 22 nt, Homo sapiens
ugguggcuuuucguagguucac

SEQ ID NO: 317895 - RNA, 23 nt, Homo sapiens
ugguuuguaagagauggacugga

SEQ ID NO: 317896 - RNA, 22 nt, Homo sapiens
uguaaacucaguauguuuuacu

SEQ ID NO: 317897 - RNA, 20 nt, Homo sapiens
uguaacaaucuggauguugc

SEQ ID NO: 317898 - RNA, 22 nt, Homo sapiens
uguauauguuuguacauauguc

SEQ ID NO: 317899 - RNA, 22 nt, Homo sapiens
uguauguaauugaaguuaaguu

SEQ ID NO: 317900 - RNA, 20 nt, Homo sapiens
ugucaagaaacauuacuuau

SEQ ID NO: 317901 - RNA, 22 nt, Homo sapiens
ugucaaugggaauuuguuuuag

SEQ ID NO: 317902 - RNA, 22 nt, Homo sapiens
ugucacguugcuuuucuguugu

SEQ ID NO: 317903 - RNA, 22 nt, Homo sapiens
ugucaugguagcaaggacgagg

SEQ ID NO: 317904 - RNA, 22 nt, Homo sapiens
ugucaugguguuaauuuuccug

SEQ ID NO: 317905 - RNA, 22 nt, Homo sapiens
ugucauguaaagaguaaauggu

SEQ ID NO: 317906 - RNA, 22 nt, Homo sapiens
ugucauguauauaccacuucca

SEQ ID NO: 317907 - RNA, 18 nt, Homo sapiens
ugucccuuugcuguucau

SEQ ID NO: 317908 - RNA, 22 nt, Homo sapiens
ugucuaaagaauggcagacuca

SEQ ID NO: 317909 - RNA, 22 nt, Homo sapiens
ugucugagacuguuuuacuuuc

SEQ ID NO: 317910 - RNA, 22 nt, Homo sapiens
ugugaacaaaauuuguugcaua

SEQ ID NO: 317911 - RNA, 22 nt, Homo sapiens
ugugaacagcuccaaaugugga

SEQ ID NO: 317912 - RNA, 22 nt, Homo sapiens
ugugaacauuuuguauauauua

SEQ ID NO: 317913 - RNA, 22 nt, Homo sapiens
ugugacagcacgguucaacugc

SEQ ID NO: 317914 - RNA, 22 nt, Homo sapiens
ugugacaguguuacauuucaug

SEQ ID NO: 317915 - RNA, 22 nt, Homo sapiens
ugugacaguuaguuugguguua

SEQ ID NO: 317916 - RNA, 22 nt, Homo sapiens
ugugcacaaugugcagguuuga

SEQ ID NO: 317917 - RNA, 22 nt, Homo sapiens
ugugcacauaacauuuuuuuag

SEQ ID NO: 317918 - RNA, 22 nt, Homo sapiens
cauuccacuggauaaacaaggu

SEQ ID NO: 317919 - RNA, 22 nt, Homo sapiens
cauugucccucaaugacuauga

SEQ ID NO: 317920 - RNA, 22 nt, Homo sapiens
cauuuugguuaaauagguagcu

SEQ ID NO: 317921 - RNA, 22 nt, Homo sapiens
ccaaggaauacccucccuuuuu

SEQ ID NO: 317922 - RNA, 22 nt, Homo sapiens
ccaguuuucaagauaaugguuu

SEQ ID NO: 317923 - RNA, 22 nt, Homo sapiens
ccaguuuuucauuuauacuagu

SEQ ID NO: 317924 - RNA, 22 nt, Homo sapiens
cccaguagagauugccgaauug

SEQ ID NO: 317925 - RNA, 21 nt, Homo sapiens
cccugguguuuggaguuugag

SEQ ID NO: 317926 - RNA, 22 nt, Homo sapiens
cggaaugaaaauguccuucagu

SEQ ID NO: 317927 - RNA, 22 nt, Homo sapiens
cuaaagugcuuaaaaucucauu

SEQ ID NO: 317928 - RNA, 22 nt, Homo sapiens
cuaaaugcacugucaaaggaag

SEQ ID NO: 317929 - RNA, 22 nt, Homo sapiens
cuagagagaagcugugugaccu

SEQ ID NO: 317930 - RNA, 22 nt, Homo sapiens
cuagauuauccaacuuauuagc

SEQ ID NO: 317931 - RNA, 22 nt, Homo sapiens
cuauggcuguaaggauaguaac

SEQ ID NO: 317932 - RNA, 22 nt, Homo sapiens
cucaaaugguccagcuaguggu

SEQ ID NO: 317933 - RNA, 22 nt, Homo sapiens
cucaaguaauccucccgccuug

SEQ ID NO: 317934 - RNA, 21 nt, Homo sapiens
cucauauugcuuuuccauggu

SEQ ID NO: 317935 - RNA, 22 nt, Homo sapiens
cucauugcaaucuccaccuccc

SEQ ID NO: 317936 - RNA, 22 nt, Homo sapiens
cuccaguuucagaaucccaugu

SEQ ID NO: 317937 - RNA, 22 nt, Homo sapiens
cuccauuuaguccuuuuagaag

SEQ ID NO: 317938 - RNA, 22 nt, Homo sapiens
cucccagugacccaggaacagg

SEQ ID NO: 317939 - RNA, 22 nt, Homo sapiens
cucgcuccauuucggugaucaa

SEQ ID NO: 317940 - RNA, 22 nt, Homo sapiens
cucuuugaguuccuccuggugu

SEQ ID NO: 317941 - RNA, 22 nt, Homo sapiens
cugaaaagcaucugcauagcug

SEQ ID NO: 317942 - RNA, 22 nt, Homo sapiens
cugaccucugucaaagacaccc

SEQ ID NO: 317943 - RNA, 22 nt, Homo sapiens
cugagagaggagcuaaaacugc

SEQ ID NO: 317944 - RNA, 22 nt, Homo sapiens
cugagauaauuucuagguguca

SEQ ID NO: 317945 - RNA, 22 nt, Homo sapiens
cugagauaggacucugcuggcu

SEQ ID NO: 317946 - RNA, 22 nt, Homo sapiens
cugaucuguagcagccaccaca

SEQ ID NO: 317947 - RNA, 19 nt, Homo sapiens
cugcaagguaauaggucag

SEQ ID NO: 317948 - RNA, 19 nt, Homo sapiens
cugcaugagacaguugguu

SEQ ID NO: 317949 - RNA, 22 nt, Homo sapiens
cugccugagaaaauggagggca

SEQ ID NO: 317950 - RNA, 22 nt, Homo sapiens
cuggagcaaaggugacucuugu

SEQ ID NO: 317951 - RNA, 22 nt, Homo sapiens
cuggcccaguucugcguuuugc

SEQ ID NO: 317952 - RNA, 22 nt, Homo sapiens
cugugcauguuguccaauucuu

SEQ ID NO: 317953 - RNA, 22 nt, Homo sapiens
cugugguguaacucuuggggcg

SEQ ID NO: 317954 - RNA, 22 nt, Homo sapiens
cuguuugguuaucuuuuccugu

SEQ ID NO: 317955 - RNA, 22 nt, Homo sapiens
cuucagcaauauauccccuggg

SEQ ID NO: 317956 - RNA, 22 nt, Homo sapiens
cuucaugggagaaccacaggua

SEQ ID NO: 317957 - RNA, 20 nt, Homo sapiens
cuuccaguggccccaucuuu

SEQ ID NO: 317958 - RNA, 22 nt, Homo sapiens
cuugagcauauucuauauuaaa

SEQ ID NO: 317959 - RNA, 19 nt, Homo sapiens
cuugccccauucauccucu

SEQ ID NO: 317960 - RNA, 22 nt, Homo sapiens
cuuguacacuguuggugggaau

SEQ ID NO: 317961 - RNA, 22 nt, Homo sapiens
cuuuggcauuagccuguauaga

SEQ ID NO: 317962 - RNA, 22 nt, Homo sapiens
cuuuuacacugguggugggaau

SEQ ID NO: 317963 - RNA, 22 nt, Homo sapiens
cuuuuacacuguuggugggaau

SEQ ID NO: 317964 - RNA, 22 nt, Homo sapiens
gaaaugcucagggguuuuccag

SEQ ID NO: 317965 - RNA, 22 nt, Homo sapiens
gaagguaguuuauagauguggu

SEQ ID NO: 317966 - RNA, 22 nt, Homo sapiens
gaauggaacugacuauagcuga

SEQ ID NO: 317967 - RNA, 21 nt, Homo sapiens
gaauggcaccauuagcauaua

SEQ ID NO: 317968 - RNA, 22 nt, Homo sapiens
gaauguuuacuuuguuuaauac

SEQ ID NO: 317969 - RNA, 22 nt, Homo sapiens
gacacugucuucugcucuuaaa

SEQ ID NO: 317970 - RNA, 18 nt, Homo sapiens
gacagugugaagauuccu

SEQ ID NO: 317971 - RNA, 22 nt, Homo sapiens
gacaguuucucaggcuuccuua

SEQ ID NO: 317972 - RNA, 22 nt, Homo sapiens
gacccucuagagggaagcgcuu

SEQ ID NO: 317973 - RNA, 22 nt, Homo sapiens
gacugaguaagcagaagcaauu

SEQ ID NO: 317974 - RNA, 20 nt, Homo sapiens
gagaccugagauucacucaa

SEQ ID NO: 317975 - RNA, 22 nt, Homo sapiens
gagacugagucuugcccuguca

SEQ ID NO: 317976 - RNA, 22 nt, Homo sapiens
gagauacacccagugcagaggc

SEQ ID NO: 317977 - RNA, 22 nt, Homo sapiens
gagaucaaguauucuccacuaa

SEQ ID NO: 317978 - RNA, 22 nt, Homo sapiens
gagaucaguuaaugaagugagc

SEQ ID NO: 317979 - RNA, 22 nt, Homo sapiens
gagcacugaauacugugguggu

SEQ ID NO: 317980 - RNA, 22 nt, Homo sapiens
gagcaguugagagugcuggcca

SEQ ID NO: 317981 - RNA, 22 nt, Homo sapiens
gagcuaguagauuuuaaauauu

SEQ ID NO: 317982 - RNA, 22 nt, Homo sapiens
gagcugaaguuuccauuuguac

SEQ ID NO: 317983 - RNA, 22 nt, Homo sapiens
gaggacauuaugcuaaguggaa

SEQ ID NO: 317984 - RNA, 22 nt, Homo sapiens
gagguagguacaauugccacca

SEQ ID NO: 317985 - RNA, 22 nt, Homo sapiens
gagguauggauaucuggagagg

SEQ ID NO: 317986 - RNA, 22 nt, Homo sapiens
gagguugggaugagggauacag

SEQ ID NO: 317987 - RNA, 22 nt, Homo sapiens
gagugcaaagguccugaggugg

SEQ ID NO: 317988 - RNA, 22 nt, Homo sapiens
gagugcaauggcagaucuccgc

SEQ ID NO: 317989 - RNA, 22 nt, Homo sapiens
gagugcaauggugccaucucgg

SEQ ID NO: 317990 - RNA, 22 nt, Homo sapiens
gaguuaggaucucacuguguca

SEQ ID NO: 317991 - RNA, 22 nt, Homo sapiens
gaguucaaaucucagcucuguu

SEQ ID NO: 317992 - RNA, 22 nt, Homo sapiens
gaguucaauuuccagcuguucu

SEQ ID NO: 317993 - RNA, 19 nt, Homo sapiens
gauagacaucacagugcca

SEQ ID NO: 317994 - RNA, 21 nt, Homo sapiens
gauaucuuuauucccaagagc

SEQ ID NO: 317995 - RNA, 22 nt, Homo sapiens
gauuuguuggccugugagcuag

SEQ ID NO: 317996 - RNA, 22 nt, Homo sapiens
gauuuuccaguggcccugauca

SEQ ID NO: 317997 - RNA, 22 nt, Homo sapiens
gcacagaugaggagaggucuca

SEQ ID NO: 317998 - RNA, 22 nt, Homo sapiens
gcacaguuaaagggucauguga

SEQ ID NO: 317999 - RNA, 22 nt, Homo sapiens
gcagaguauagagggcugggcc

SEQ ID NO: 318000 - RNA, 22 nt, Homo sapiens
gcaggcaugacauuucacucuu

SEQ ID NO: 318001 - RNA, 17 nt, Homo sapiens
gcaguacuuaguaagga

SEQ ID NO: 318002 - RNA, 17 nt, Homo sapiens
gcauaugucgaaccagc

SEQ ID NO: 318003 - RNA, 17 nt, Homo sapiens
gcauauguugaaccagu

SEQ ID NO: 318004 - RNA, 22 nt, Homo sapiens
gcaucacagcuccugugcuggc

SEQ ID NO: 318005 - RNA, 22 nt, Homo sapiens
gcaucacagggagacaggccuc

SEQ ID NO: 318006 - RNA, 22 nt, Homo sapiens
gcccagauguuuggggucaugg

SEQ ID NO: 318007 - RNA, 22 nt, Homo sapiens
gccccaguacaggcuccuuaga

SEQ ID NO: 318008 - RNA, 22 nt, Homo sapiens
gccccgggugaugcagccguca

SEQ ID NO: 318009 - RNA, 22 nt, Homo sapiens
gcccuguugcccaggcuggagu

SEQ ID NO: 318010 - RNA, 22 nt, Homo sapiens
gccuuuggugacaggcaugugu

SEQ ID NO: 318011 - RNA, 17 nt, Homo sapiens
gcugauguuugcauuuu

SEQ ID NO: 318012 - RNA, 20 nt, Homo sapiens
uucagcaaaggaaugggagu

SEQ ID NO: 318013 - RNA, 22 nt, Homo sapiens
uucagcaggccaggcccugacu

SEQ ID NO: 318014 - RNA, 22 nt, Homo sapiens
uucaggcaccauggucauugau

SEQ ID NO: 318015 - RNA, 22 nt, Homo sapiens
uucaggcuccgugccagcuccg

SEQ ID NO: 318016 - RNA, 22 nt, Homo sapiens
uucauacaguggcugcacucca

SEQ ID NO: 318017 - RNA, 22 nt, Homo sapiens
uucaucacagucuccgaugccc

SEQ ID NO: 318018 - RNA, 18 nt, Homo sapiens
uucaucaguccucagcug

SEQ ID NO: 318019 - RNA, 22 nt, Homo sapiens
uucauggacucaauaguuucgc

SEQ ID NO: 318020 - RNA, 22 nt, Homo sapiens
uuccaagugggaaacaaaaaug

SEQ ID NO: 318021 - RNA, 22 nt, Homo sapiens
uuccacaaugguugaacuaguu

SEQ ID NO: 318022 - RNA, 22 nt, Homo sapiens
uuccagagucaccuuucugucg

SEQ ID NO: 318023 - RNA, 22 nt, Homo sapiens
uuccagugggacgagaugugga

SEQ ID NO: 318024 - RNA, 22 nt, Homo sapiens
uucccuagaacacauggaggga

SEQ ID NO: 318025 - RNA, 22 nt, Homo sapiens
uucccucagaaacacacagccc

SEQ ID NO: 318026 - RNA, 22 nt, Homo sapiens
uucccuuugaauuggaaaggug

SEQ ID NO: 318027 - RNA, 22 nt, Homo sapiens
uucccuuuguuaaauuggaaga

SEQ ID NO: 318028 - RNA, 22 nt, Homo sapiens
uucccuuuuuucuaguagguag

SEQ ID NO: 318029 - RNA, 22 nt, Homo sapiens
uucuacagugacugcagccaua

SEQ ID NO: 318030 - RNA, 22 nt, Homo sapiens
uucuaugguuuuuaugguguua

SEQ ID NO: 318031 - RNA, 22 nt, Homo sapiens
uucuauugguaauauuuucugu

SEQ ID NO: 318032 - RNA, 22 nt, Homo sapiens
uucucaguaauuccagauuuuu

SEQ ID NO: 318033 - RNA, 22 nt, Homo sapiens
uucucagugaacuccagcuugu

SEQ ID NO: 318034 - RNA, 22 nt, Homo sapiens
uucuuagucauguaauagucca

SEQ ID NO: 318035 - RNA, 22 nt, Homo sapiens
uucuuaguggcaccacuuuuuu

SEQ ID NO: 318036 - RNA, 22 nt, Homo sapiens
uucuucaggccacaaaaauggu

SEQ ID NO: 318037 - RNA, 22 nt, Homo sapiens
uugaaagaugaacuggauugga

SEQ ID NO: 318038 - RNA, 22 nt, Homo sapiens
uugaacugguaguuggaaaucu

SEQ ID NO: 318039 - RNA, 22 nt, Homo sapiens
uugaauguaugcuggguuuacu

SEQ ID NO: 318040 - RNA, 22 nt, Homo sapiens
uugaaugucuauuaaguuguuu

SEQ ID NO: 318041 - RNA, 22 nt, Homo sapiens
uugacauugcuguaguguccag

SEQ ID NO: 318042 - RNA, 22 nt, Homo sapiens
uugaggaagugguuccccagag

SEQ ID NO: 318043 - RNA, 22 nt, Homo sapiens
uugaggaggcagucuguccguu

SEQ ID NO: 318044 - RNA, 20 nt, Homo sapiens
uugaggucaggaguuuggga

SEQ ID NO: 318045 - RNA, 22 nt, Homo sapiens
uugaguagaaguaugucaguau

SEQ ID NO: 318046 - RNA, 23 nt, Homo sapiens
uugcaaagccugaaacucuucag

SEQ ID NO: 318047 - RNA, 22 nt, Homo sapiens
uugcacaauccugugagugagu

SEQ ID NO: 318048 - RNA, 22 nt, Homo sapiens
uugcacaauggaauuuaucuuu

SEQ ID NO: 318049 - RNA, 22 nt, Homo sapiens
uuggaaacgucaccuuuuccuu

SEQ ID NO: 318050 - RNA, 22 nt, Homo sapiens
uuggacagaugguuacauuuuu

SEQ ID NO: 318051 - RNA, 21 nt, Homo sapiens
uuggcacucuucucuccuuau

SEQ ID NO: 318052 - RNA, 22 nt, Homo sapiens
uuggcacugagcaagaacaggg

SEQ ID NO: 318053 - RNA, 22 nt, Homo sapiens
uuggcagaaaaggucggggguu

SEQ ID NO: 318054 - RNA, 19 nt, Homo sapiens
uuggcagaguugcccccua

SEQ ID NO: 318055 - RNA, 22 nt, Homo sapiens
uuggcaguaucuacuacagcua

SEQ ID NO: 318056 - RNA, 22 nt, Homo sapiens
uuggcagucugaggcacagacu

SEQ ID NO: 318057 - RNA, 22 nt, Homo sapiens
uuggcauugccaaacugucaac

SEQ ID NO: 318058 - RNA, 22 nt, Homo sapiens
uuggcauuguggauggaaucau

SEQ ID NO: 318059 - RNA, 22 nt, Homo sapiens
uuggcauuuuuagucaugggaa

SEQ ID NO: 318060 - RNA, 22 nt, Homo sapiens
uugggccacuuuaguuuccuua

SEQ ID NO: 318061 - RNA, 22 nt, Homo sapiens
uuguauguuucugugcacauga

SEQ ID NO: 318062 - RNA, 22 nt, Homo sapiens
uugucacugcacuccagucugg

SEQ ID NO: 318063 - RNA, 22 nt, Homo sapiens
uugucccauggggucuuccuuu

SEQ ID NO: 318064 - RNA, 22 nt, Homo sapiens
uuguccuugagauaguuugcug

SEQ ID NO: 318065 - RNA, 22 nt, Homo sapiens
uuguuauguaucucaagauaaa

SEQ ID NO: 318066 - RNA, 20 nt, Homo sapiens
uuuaagacaugcugaauuga

SEQ ID NO: 318067 - RNA, 22 nt, Homo sapiens
uuuacagucucauagguggaag

SEQ ID NO: 318068 - RNA, 22 nt, Homo sapiens
uuuauguggagcacuugacaca

SEQ ID NO: 318069 - RNA, 18 nt, Homo sapiens
uuucaggguggacaugag

SEQ ID NO: 318070 - RNA, 20 nt, Homo sapiens
uuucaguacuuucuacuggc

SEQ ID NO: 318071 - RNA, 22 nt, Homo sapiens
uuucauggcgaggcuucauggg

SEQ ID NO: 318072 - RNA, 23 nt, Homo sapiens
uuucauggggauuuacucauucc

SEQ ID NO: 318073 - RNA, 22 nt, Homo sapiens
uuuccaguuguucuagaaagcu

SEQ ID NO: 318074 - RNA, 22 nt, Homo sapiens
uuucccuuacuuaaacuuacuc

SEQ ID NO: 318075 - RNA, 22 nt, Homo sapiens
uuucccuuugcuuugucagcca

SEQ ID NO: 318076 - RNA, 16 nt, Homo sapiens
uuucuauguuuuacua

SEQ ID NO: 318077 - RNA, 22 nt, Homo sapiens
uuugacuagaguguuuuacaac

SEQ ID NO: 318078 - RNA, 22 nt, Homo sapiens
uuugagcaugcagauugccagg

SEQ ID NO: 318079 - RNA, 18 nt, Homo sapiens
uuugccacuucccagaaa

SEQ ID NO: 318080 - RNA, 22 nt, Homo sapiens
uuuggcaauaaacuccccuaac

SEQ ID NO: 318081 - RNA, 22 nt, Homo sapiens
uuuggcauuugaguuuguagga

SEQ ID NO: 318082 - RNA, 22 nt, Homo sapiens
uuuguacacgugggugaauugu

SEQ ID NO: 318083 - RNA, 22 nt, Homo sapiens
uuuguacuucauugguucuacu

SEQ ID NO: 318084 - RNA, 18 nt, Homo sapiens
uuuguacuuuuucuaaug

SEQ ID NO: 318085 - RNA, 21 nt, Homo sapiens
uuuguccaccuguguucacca

SEQ ID NO: 318086 - RNA, 22 nt, Homo sapiens
uuugucccccguaguucauaua

SEQ ID NO: 318087 - RNA, 22 nt, Homo sapiens
uuugugacacaaacacauauau

SEQ ID NO: 318088 - RNA, 22 nt, Homo sapiens
uuuuacagaggagguugcugau

SEQ ID NO: 318089 - RNA, 22 nt, Homo sapiens
uuuugcaaauuccaguggccau

SEQ ID NO: 318090 - RNA, 22 nt, Homo sapiens
uuuugcucuugguaaugaaaga

SEQ ID NO: 318091 - RNA, 18 nt, Homo sapiens
uuuuugaggcacagggga

SEQ ID NO: 318092 - RNA, 22 nt, Homo sapiens
aaagcagcaggugguuuucaau

SEQ ID NO: 318093 - RNA, 19 nt, Homo sapiens
aaaguguuuuaaagaggau

SEQ ID NO: 318094 - RNA, 22 nt, Homo sapiens
aaauucauuucagcucugggua

SEQ ID NO: 318095 - RNA, 18 nt, Homo sapiens
aaauucugucccuucuuc

SEQ ID NO: 318096 - RNA, 22 nt, Homo sapiens
aaauugcuuuugaagacuuagu

SEQ ID NO: 318097 - RNA, 22 nt, Homo sapiens
aacagaauccucuuuuccuggg

SEQ ID NO: 318098 - RNA, 22 nt, Homo sapiens
aacaggguguuugcaguuucuu

SEQ ID NO: 318099 - RNA, 22 nt, Homo sapiens
aacagugcauuccuguccauau

SEQ ID NO: 318100 - RNA, 22 nt, Homo sapiens
aacagugccugucauuuaguag

SEQ ID NO: 318101 - RNA, 22 nt, Homo sapiens
aacauguuuagcagauaccugu

SEQ ID NO: 318102 - RNA, 22 nt, Homo sapiens
aacuggccuccuugggaaauua

SEQ ID NO: 318103 - RNA, 22 nt, Homo sapiens
aagagcucauccauaguuguca

SEQ ID NO: 318104 - RNA, 23 nt, Homo sapiens
aagagguaugacuaugaagugga

SEQ ID NO: 318105 - RNA, 22 nt, Homo sapiens
aagggaauguuguagcugguuu

SEQ ID NO: 318106 - RNA, 22 nt, Homo sapiens
guguaaaacaauuagaggauuu

SEQ ID NO: 318107 - RNA, 22 nt, Homo sapiens
gugucaguggggagugaucuuc

SEQ ID NO: 318108 - RNA, 22 nt, Homo sapiens
gugugacagcuauagacaugau

SEQ ID NO: 318109 - RNA, 22 nt, Homo sapiens
gugugcauaugucuuuauagua

SEQ ID NO: 318110 - RNA, 20 nt, Homo sapiens
guuaaggcagcauuacucuu

SEQ ID NO: 318111 - RNA, 22 nt, Homo sapiens
guuagaugaagaccaagggcaa

SEQ ID NO: 318112 - RNA, 22 nt, Homo sapiens
guucagcaggggcuucaauggu

SEQ ID NO: 318113 - RNA, 20 nt, Homo sapiens
guucauguaauuaguucagg

SEQ ID NO: 318114 - RNA, 17 nt, Homo sapiens
guucccaguggcauuug

SEQ ID NO: 318115 - RNA, 22 nt, Homo sapiens
guugcucaggcuggagugcagu

SEQ ID NO: 318116 - RNA, 22 nt, Homo sapiens
guuggaauguauugcuacuucu

SEQ ID NO: 318117 - RNA, 22 nt, Homo sapiens
guuggucaaugugauuaggcca

SEQ ID NO: 318118 - RNA, 22 nt, Homo sapiens
uaaagcuagaauuguuccagca

SEQ ID NO: 318119 - RNA, 21 nt, Homo sapiens
uaacccugaaggagcucugga

SEQ ID NO: 318120 - RNA, 22 nt, Homo sapiens
uaaggcuagcaagaugagaaua

SEQ ID NO: 318121 - RNA, 22 nt, Homo sapiens
uaaguaaaugaaagguugauuu

SEQ ID NO: 318122 - RNA, 22 nt, Homo sapiens
uaagugaaggaaguguguuuac

SEQ ID NO: 318123 - RNA, 22 nt, Homo sapiens
uacaugugccauguugguuugc

SEQ ID NO: 318124 - RNA, 16 nt, Homo sapiens
uacauuuguuacaugg

SEQ ID NO: 318125 - RNA, 22 nt, Homo sapiens
uaccacaggcuggguaaucuau

SEQ ID NO: 318126 - RNA, 22 nt, Homo sapiens
uaccaugcagguguauguuugu

SEQ ID NO: 318127 - RNA, 22 nt, Homo sapiens
uaccauguaucugggaugcuuu

SEQ ID NO: 318128 - RNA, 22 nt, Homo sapiens
uaccauguauguuucuccauug

SEQ ID NO: 318129 - RNA, 22 nt, Homo sapiens
uacugcacuggaggccucagau

SEQ ID NO: 318130 - RNA, 22 nt, Homo sapiens
uagcaccuuagcauuucuagug

SEQ ID NO: 318131 - RNA, 22 nt, Homo sapiens
uagcagcauaaauggacuaaga

SEQ ID NO: 318132 - RNA, 22 nt, Homo sapiens
uagcuggaguuuuuguuauagg

SEQ ID NO: 318133 - RNA, 23 nt, Homo sapiens
uagcuucucccagaccugcuccc

SEQ ID NO: 318134 - RNA, 22 nt, Homo sapiens
uaggcacacaucuacuacaaau

SEQ ID NO: 318135 - RNA, 20 nt, Homo sapiens
uauagcaauuuuuuucuccu

SEQ ID NO: 318136 - RNA, 22 nt, Homo sapiens
uauaugcucugggauccugaaa

SEQ ID NO: 318137 - RNA, 22 nt, Homo sapiens
uaucaaggccacucauuuuaug

SEQ ID NO: 318138 - RNA, 22 nt, Homo sapiens
uaucagaguuacacugaagacu

SEQ ID NO: 318139 - RNA, 22 nt, Homo sapiens
uaugaugcuguuuagaaucucu

SEQ ID NO: 318140 - RNA, 22 nt, Homo sapiens
uauggguguuauugcaugggag

SEQ ID NO: 318141 - RNA, 22 nt, Homo sapiens
uauuccucuuuguugagguuau

SEQ ID NO: 318142 - RNA, 22 nt, Homo sapiens
uauuguuaaagauguuaaugau

SEQ ID NO: 318143 - RNA, 22 nt, Homo sapiens
uauuugauugacuuuagcagga

SEQ ID NO: 318144 - RNA, 22 nt, Homo sapiens
ucaaacauccccaccagggacu

SEQ ID NO: 318145 - RNA, 22 nt, Homo sapiens
ucaaaguaaagccucaggaugg

SEQ ID NO: 318146 - RNA, 22 nt, Homo sapiens
ucaaguacuuugcauagugccg

SEQ ID NO: 318147 - RNA, 18 nt, Homo sapiens
ucacaaccacagugcugu

SEQ ID NO: 318148 - RNA, 22 nt, Homo sapiens
ucacagucaaaguaaucauaga

SEQ ID NO: 318149 - RNA, 23 nt, Homo sapiens
ucacaguggcugcuuaauuguga

SEQ ID NO: 318150 - RNA, 22 nt, Homo sapiens
ucaccaccuuccaggaccacug

SEQ ID NO: 318151 - RNA, 22 nt, Homo sapiens
ucacccugacaugcggccgaac

SEQ ID NO: 318152 - RNA, 22 nt, Homo sapiens
ucagcaaugaccuaagcaaaua

SEQ ID NO: 318153 - RNA, 22 nt, Homo sapiens
ucagcaaugcugcacucuacug

SEQ ID NO: 318154 - RNA, 22 nt, Homo sapiens
ucaguaaaugcuguucucuuuu

SEQ ID NO: 318155 - RNA, 22 nt, Homo sapiens
ucagugaauacauguacucaug

SEQ ID NO: 318156 - RNA, 22 nt, Homo sapiens
ucaguucauggaggugucugcu

SEQ ID NO: 318157 - RNA, 22 nt, Homo sapiens
ucauaguacuuuguuuugaaaa

SEQ ID NO: 318158 - RNA, 21 nt, Homo sapiens
ucaucagucaaagacaauggu

SEQ ID NO: 318159 - RNA, 22 nt, Homo sapiens
ucaugaaguaguuaacugguug

SEQ ID NO: 318160 - RNA, 22 nt, Homo sapiens
ucaugugaggauaacaauagug

SEQ ID NO: 318161 - RNA, 20 nt, Homo sapiens
uccacugagcgucacggcag

SEQ ID NO: 318162 - RNA, 22 nt, Homo sapiens
uccaguacaggucucucauuuc

SEQ ID NO: 318163 - RNA, 22 nt, Homo sapiens
ucccaguguguagcuugucucu

SEQ ID NO: 318164 - RNA, 22 nt, Homo sapiens
ucccuguguuccuuuugaauug

SEQ ID NO: 318165 - RNA, 22 nt, Homo sapiens
uccugagaauagaguugcaugu

SEQ ID NO: 318166 - RNA, 22 nt, Homo sapiens
uccugagagcagacccucuaua

SEQ ID NO: 318167 - RNA, 22 nt, Homo sapiens
uccuugguugauccugugcaga

SEQ ID NO: 318168 - RNA, 23 nt, Homo sapiens
uccuugguuggcgcccuaugugu

SEQ ID NO: 318169 - RNA, 22 nt, Homo sapiens
uccuuuguuacaguuggcucug

SEQ ID NO: 318170 - RNA, 22 nt, Homo sapiens
ucucagugugguaaaaguuuuu

SEQ ID NO: 318171 - RNA, 21 nt, Homo sapiens
ucucauugugguuuuaauugg

SEQ ID NO: 318172 - RNA, 22 nt, Homo sapiens
ucucugacacugaccccaaaaa

SEQ ID NO: 318173 - RNA, 22 nt, Homo sapiens
ucugaaucguucccaugcagga

SEQ ID NO: 318174 - RNA, 22 nt, Homo sapiens
ucugacagugagagaaaucuga

SEQ ID NO: 318175 - RNA, 22 nt, Homo sapiens
ucugacucuggagucucagguu

SEQ ID NO: 318176 - RNA, 22 nt, Homo sapiens
ucuggagugugaaguggauaug

SEQ ID NO: 318177 - RNA, 20 nt, Homo sapiens
ucuggccccuccaaaucuca

SEQ ID NO: 318178 - RNA, 22 nt, Homo sapiens
ucugucacugaaucccugucac

SEQ ID NO: 318179 - RNA, 19 nt, Homo sapiens
ucugucacuggggguauuc

SEQ ID NO: 318180 - RNA, 22 nt, Homo sapiens
ucugucacugguggacgaucac

SEQ ID NO: 318181 - RNA, 22 nt, Homo sapiens
ucugucuuugucaggaccagag

SEQ ID NO: 318182 - RNA, 22 nt, Homo sapiens
ucuuaguuugggguggggauag

SEQ ID NO: 318183 - RNA, 22 nt, Homo sapiens
ucuuugaguggagcgaggcaga

SEQ ID NO: 318184 - RNA, 19 nt, Homo sapiens
ucuuugguacgugcuuuga

SEQ ID NO: 318185 - RNA, 22 nt, Homo sapiens
ucuuugguauuuguggggaauu

SEQ ID NO: 318186 - RNA, 22 nt, Homo sapiens
ucuuuggucaucaugggaagca

SEQ ID NO: 318187 - RNA, 22 nt, Homo sapiens
ucuuugguucuguuuauguaau

SEQ ID NO: 318188 - RNA, 22 nt, Homo sapiens
ugaagacauuuuugggugugua

SEQ ID NO: 318189 - RNA, 22 nt, Homo sapiens
ugaagugaagacucacagaagg

SEQ ID NO: 318190 - RNA, 22 nt, Homo sapiens
ugaaugcaucuagaaauuuauu

SEQ ID NO: 318191 - RNA, 22 nt, Homo sapiens
ugacagugugagauccugucuc

SEQ ID NO: 318192 - RNA, 23 nt, Homo sapiens
ugacuuaggccucaacuaugacu

SEQ ID NO: 318193 - RNA, 19 nt, Homo sapiens
ugagaacaugugguauuug

SEQ ID NO: 318194 - RNA, 22 nt, Homo sapiens
ugagaacugccuguauuuaucu

SEQ ID NO: 318195 - RNA, 22 nt, Homo sapiens
ugagagaugauaaaauguuugu

SEQ ID NO: 318196 - RNA, 22 nt, Homo sapiens
ugagaucagaaggauuucucug

SEQ ID NO: 318197 - RNA, 22 nt, Homo sapiens
ugaggcacucccuagcggggug

SEQ ID NO: 318198 - RNA, 22 nt, Homo sapiens
ugagguagguaccauuaucacu

SEQ ID NO: 318199 - RNA, 22 nt, Homo sapiens
ugauaagaaauuguucauguag

SEQ ID NO: 318200 - RNA, 22 nt, Homo sapiens
ugauaucugaucauccuugaua

SEQ ID NO: 318201 - RNA, 22 nt, Homo sapiens
cucauugcaaucucugccuccc

SEQ ID NO: 318202 - RNA, 22 nt, Homo sapiens
cuccauuuggaacagauguccu

SEQ ID NO: 318203 - RNA, 22 nt, Homo sapiens
cuccuggugauuggagugugaa

SEQ ID NO: 318204 - RNA, 21 nt, Homo sapiens
cucugguuugcauuggauuau

SEQ ID NO: 318205 - RNA, 22 nt, Homo sapiens
cucuuacaguguguggugaaag

SEQ ID NO: 318206 - RNA, 19 nt, Homo sapiens
cucuuuggugucucuucuu

SEQ ID NO: 318207 - RNA, 22 nt, Homo sapiens
cugaaagagcauuugaaugggu

SEQ ID NO: 318208 - RNA, 22 nt, Homo sapiens
cugaccauagacuacucugggc

SEQ ID NO: 318209 - RNA, 22 nt, Homo sapiens
cugaggugggaguuuuucucau

SEQ ID NO: 318210 - RNA, 22 nt, Homo sapiens
cugcuggucuuuaaggucuagg

SEQ ID NO: 318211 - RNA, 22 nt, Homo sapiens
cuggagcaaaggugacucuugu

SEQ ID NO: 318212 - RNA, 22 nt, Homo sapiens
cuggccagagacauucauuaaa

SEQ ID NO: 318213 - RNA, 22 nt, Homo sapiens
cugggaugauguaaauaggcua

SEQ ID NO: 318214 - RNA, 22 nt, Homo sapiens
cugggcaaugcggcuggauaga

SEQ ID NO: 318215 - RNA, 22 nt, Homo sapiens
cugugaucuuuuuucauguggu

SEQ ID NO: 318216 - RNA, 22 nt, Homo sapiens
cuuacagucuaucagccacaac

SEQ ID NO: 318217 - RNA, 22 nt, Homo sapiens
cuucaaguguggccaccugacc

SEQ ID NO: 318218 - RNA, 22 nt, Homo sapiens
cuucaaguuggaagggaccuaa

SEQ ID NO: 318219 - RNA, 22 nt, Homo sapiens
cuucaccaguuuggcagucuca

SEQ ID NO: 318220 - RNA, 22 nt, Homo sapiens
cuuggacaccucaugcccaccu

SEQ ID NO: 318221 - RNA, 23 nt, Homo sapiens
cuuuugcaaugugaucuugccac

SEQ ID NO: 318222 - RNA, 22 nt, Homo sapiens
cuuuuguggaucuucuguugcu

SEQ ID NO: 318223 - RNA, 22 nt, Homo sapiens
cuuuuugcugcagcaauacugg

SEQ ID NO: 318224 - RNA, 20 nt, Homo sapiens
cuuuuugcugugcugggagc

SEQ ID NO: 318225 - RNA, 22 nt, Homo sapiens
gaaagauuuccugagcuagaaa

SEQ ID NO: 318226 - RNA, 22 nt, Homo sapiens
gaagcagcauucugguuuuugg

SEQ ID NO: 318227 - RNA, 22 nt, Homo sapiens
gaaugucuuauugcucguugua

SEQ ID NO: 318228 - RNA, 18 nt, Homo sapiens
gacaguguggugauuccu

SEQ ID NO: 318229 - RNA, 22 nt, Homo sapiens
gacauguuuucaagauuuauaa

SEQ ID NO: 318230 - RNA, 20 nt, Homo sapiens
gacauguuuuguggccuaac

SEQ ID NO: 318231 - RNA, 16 nt, Homo sapiens
gacugggcugaggaau

SEQ ID NO: 318232 - RNA, 22 nt, Homo sapiens
gacuuugguagaggaaaaaucu

SEQ ID NO: 318233 - RNA, 22 nt, Homo sapiens
gagaugcaccuugucacguuuc

SEQ ID NO: 318234 - RNA, 22 nt, Homo sapiens
gaggaguauuuugucgaauguc

SEQ ID NO: 318235 - RNA, 22 nt, Homo sapiens
gaggcauuauucccaucuuaca

SEQ ID NO: 318236 - RNA, 22 nt, Homo sapiens
gagguaguuaaugcauucacua

SEQ ID NO: 318237 - RNA, 22 nt, Homo sapiens
gagugcaagguuuuucugagug

SEQ ID NO: 318238 - RNA, 23 nt, Homo sapiens
gagugcaaugacaugaucucgga

SEQ ID NO: 318239 - RNA, 22 nt, Homo sapiens
gauuucaucuuuagaggaagga

SEQ ID NO: 318240 - RNA, 22 nt, Homo sapiens
gauuuguauuaaaagugugacg

SEQ ID NO: 318241 - RNA, 22 nt, Homo sapiens
gauuuguuggccugugagcuag

SEQ ID NO: 318242 - RNA, 22 nt, Homo sapiens
gcaaaguguuuuccaacuuggu

SEQ ID NO: 318243 - RNA, 20 nt, Homo sapiens
gcagcaccauauuucuaaga

SEQ ID NO: 318244 - RNA, 22 nt, Homo sapiens
gcagugugaucacagcuuacug

SEQ ID NO: 318245 - RNA, 20 nt, Homo sapiens
gcaguguucugaccugaauc

SEQ ID NO: 318246 - RNA, 23 nt, Homo sapiens
gcuaggagagaugaaacacaggu

SEQ ID NO: 318247 - RNA, 22 nt, Homo sapiens
gcucugguuacaaaggcaaauu

SEQ ID NO: 318248 - RNA, 22 nt, Homo sapiens
gcuguaguugaggauuuuaaga

SEQ ID NO: 318249 - RNA, 22 nt, Homo sapiens
ugcauauguucaaaguauucug

SEQ ID NO: 318250 - RNA, 22 nt, Homo sapiens
ugcauauguugaaccaggcuug

SEQ ID NO: 318251 - RNA, 21 nt, Homo sapiens
ugcauggagaacacugagggu

SEQ ID NO: 318252 - RNA, 22 nt, Homo sapiens
ugcauugcacuugcaugagaua

SEQ ID NO: 318253 - RNA, 22 nt, Homo sapiens
ugccuuuguucuggaaugggaa

SEQ ID NO: 318254 - RNA, 21 nt, Homo sapiens
ugcuauguuguccaggcuggc

SEQ ID NO: 318255 - RNA, 22 nt, Homo sapiens
ugcuucauuggccaccaggaag

SEQ ID NO: 318256 - RNA, 22 nt, Homo sapiens
uggaagacaggcuguauuuuaa

SEQ ID NO: 318257 - RNA, 22 nt, Homo sapiens
uggaagcauagcagcgugugug

SEQ ID NO: 318258 - RNA, 21 nt, Homo sapiens
uggaaucuauuauuccaguuu

SEQ ID NO: 318259 - RNA, 22 nt, Homo sapiens
uggacuguaagugccuugagua

SEQ ID NO: 318260 - RNA, 22 nt, Homo sapiens
uggacuguaauagagaacagaa

SEQ ID NO: 318261 - RNA, 22 nt, Homo sapiens
uggagauguuuaaaauccacug

SEQ ID NO: 318262 - RNA, 22 nt, Homo sapiens
uggauagaacuaagugcuuaga

SEQ ID NO: 318263 - RNA, 22 nt, Homo sapiens
uggauaguaaagucagauuccc

SEQ ID NO: 318264 - RNA, 22 nt, Homo sapiens
uggcaacuugcaaccucauucu

SEQ ID NO: 318265 - RNA, 22 nt, Homo sapiens
uggcauggucugcccaaguuuc

SEQ ID NO: 318266 - RNA, 22 nt, Homo sapiens
uggcaugucagguuucuggguu

SEQ ID NO: 318267 - RNA, 22 nt, Homo sapiens
ugggaaauguagccuagcugug

SEQ ID NO: 318268 - RNA, 22 nt, Homo sapiens
uggguucccugucuguccuuga

SEQ ID NO: 318269 - RNA, 22 nt, Homo sapiens
ugguggcuuuucguagguucac

SEQ ID NO: 318270 - RNA, 22 nt, Homo sapiens
uguaagcagcagagacuauccu

SEQ ID NO: 318271 - RNA, 20 nt, Homo sapiens
uguacacaguguacccacau

SEQ ID NO: 318272 - RNA, 22 nt, Homo sapiens
uguagcagccauaaacacagug

SEQ ID NO: 318273 - RNA, 21 nt, Homo sapiens
ugucaagugggaaaacaugua

SEQ ID NO: 318274 - RNA, 22 nt, Homo sapiens
ugucaaguugugguucaauuuu

SEQ ID NO: 318275 - RNA, 22 nt, Homo sapiens
ugucaucauuugagagaagaaa

SEQ ID NO: 318276 - RNA, 22 nt, Homo sapiens
ugugacaaauuuaguggacugu

SEQ ID NO: 318277 - RNA, 19 nt, Homo sapiens
ugugacugguugucucgcu

SEQ ID NO: 318278 - RNA, 17 nt, Homo sapiens
ugugaucaucacccuug

SEQ ID NO: 318279 - RNA, 22 nt, Homo sapiens
ugugaugguuuagcauuuucuu

SEQ ID NO: 318280 - RNA, 22 nt, Homo sapiens
ugugguagugcuuaccugcagu

SEQ ID NO: 318281 - RNA, 22 nt, Homo sapiens
uuaaagugaucauaaggauagu

SEQ ID NO: 318282 - RNA, 22 nt, Homo sapiens
uuaaguacuucccuguuggaca

SEQ ID NO: 318283 - RNA, 22 nt, Homo sapiens
uuaagugcucaguuacucaguu

SEQ ID NO: 318284 - RNA, 22 nt, Homo sapiens
uuaauacugcuuaacuuuagga

SEQ ID NO: 318285 - RNA, 22 nt, Homo sapiens
uuaauagugacucauuuuccac

SEQ ID NO: 318286 - RNA, 22 nt, Homo sapiens
uuacaguguuuguucuguuacu

SEQ ID NO: 318287 - RNA, 22 nt, Homo sapiens
uuacaucaucacauuaguuugc

SEQ ID NO: 318288 - RNA, 22 nt, Homo sapiens
uuacaugucuugguaagguuag

SEQ ID NO: 318289 - RNA, 22 nt, Homo sapiens
uuacuguacugcucuuaaccug

SEQ ID NO: 318290 - RNA, 22 nt, Homo sapiens
uuacuguauagaaucaucuuga

SEQ ID NO: 318291 - RNA, 22 nt, Homo sapiens
uuaggcuaguuucuuaaacucu

SEQ ID NO: 318292 - RNA, 22 nt, Homo sapiens
uuagguagaauugauuaaguuu

SEQ ID NO: 318293 - RNA, 18 nt, Homo sapiens
uuauaugcauguguagga

SEQ ID NO: 318294 - RNA, 22 nt, Homo sapiens
uuauauguuuguacuuaggccu

SEQ ID NO: 318295 - RNA, 22 nt, Homo sapiens
uuaugucuuugagcaaugcugu

SEQ ID NO: 318296 - RNA, 22 nt, Homo sapiens
uucaaaguaaagggauggagac

SEQ ID NO: 318297 - RNA, 22 nt, Homo sapiens
uucaaaguguugguuuugggcu

SEQ ID NO: 318298 - RNA, 22 nt, Homo sapiens
uucaaaguuggaggacaaacug

SEQ ID NO: 318299 - RNA, 22 nt, Homo sapiens
uucaaguagguaggaccacagg

SEQ ID NO: 318300 - RNA, 22 nt, Homo sapiens
uucaaguaguucucaugccuca

SEQ ID NO: 318301 - RNA, 22 nt, Homo sapiens
cugagcccauucuggggagaag

SEQ ID NO: 318302 - RNA, 22 nt, Homo sapiens
cugaggcacggcgaccuuaagu

SEQ ID NO: 318303 - RNA, 22 nt, Homo sapiens
cuggauggugagauaaagaaaa

SEQ ID NO: 318304 - RNA, 22 nt, Homo sapiens
cuggcaaauaguagagccagga

SEQ ID NO: 318305 - RNA, 22 nt, Homo sapiens
cugggaugugacuguugccccc

SEQ ID NO: 318306 - RNA, 22 nt, Homo sapiens
cuggucaagagcaaaggccagg

SEQ ID NO: 318307 - RNA, 21 nt, Homo sapiens
cugguccccuuuauguaugug

SEQ ID NO: 318308 - RNA, 22 nt, Homo sapiens
cuguaaagaucacagagcuggu

SEQ ID NO: 318309 - RNA, 23 nt, Homo sapiens
cuguacacauauacaucuaagua

SEQ ID NO: 318310 - RNA, 22 nt, Homo sapiens
cuugaauguaaauaauguacag

SEQ ID NO: 318311 - RNA, 22 nt, Homo sapiens
cuugguuacauuuuccuagaaa

SEQ ID NO: 318312 - RNA, 22 nt, Homo sapiens
cuuuaguugucuccucaagggu

SEQ ID NO: 318313 - RNA, 22 nt, Homo sapiens
cuuugguuaauaggauauggca

SEQ ID NO: 318314 - RNA, 21 nt, Homo sapiens
cuuugguuucugacuugcaua

SEQ ID NO: 318315 - RNA, 22 nt, Homo sapiens
cuuuguggggucuuuccucaaa

SEQ ID NO: 318316 - RNA, 22 nt, Homo sapiens
cuuuuugcaaauacaacucuga

SEQ ID NO: 318317 - RNA, 22 nt, Homo sapiens
gaacuuguguugcuucacaugu

SEQ ID NO: 318318 - RNA, 22 nt, Homo sapiens
gaaguaauaaauggauucuuaa

SEQ ID NO: 318319 - RNA, 19 nt, Homo sapiens
gaaguguuuguucuccaug

SEQ ID NO: 318320 - RNA, 22 nt, Homo sapiens
gaauggaacugacuauagcuga

SEQ ID NO: 318321 - RNA, 20 nt, Homo sapiens
gacauguugguuugcugcac

SEQ ID NO: 318322 - RNA, 22 nt, Homo sapiens
gagaaguaaauuuauuugcaaa

SEQ ID NO: 318323 - RNA, 22 nt, Homo sapiens
gagcagacaugaggaccgcugg

SEQ ID NO: 318324 - RNA, 22 nt, Homo sapiens
gagcuuggguuaaaguugccuu

SEQ ID NO: 318325 - RNA, 22 nt, Homo sapiens
gaggagauauucugcuggaugg

SEQ ID NO: 318326 - RNA, 22 nt, Homo sapiens
gagguagaauguuuuucagcug

SEQ ID NO: 318327 - RNA, 22 nt, Homo sapiens
gagguagagaguuuugauucug

SEQ ID NO: 318328 - RNA, 22 nt, Homo sapiens
gagugcaauggcgcgaucuggg

SEQ ID NO: 318329 - RNA, 22 nt, Homo sapiens
gagugcauaugggccuguguca

SEQ ID NO: 318330 - RNA, 22 nt, Homo sapiens
gauauguuagggggagaaguua

SEQ ID NO: 318331 - RNA, 22 nt, Homo sapiens
gaucacaugggagaaugagagu

SEQ ID NO: 318332 - RNA, 22 nt, Homo sapiens
gauggcuacugauuaaauauag

SEQ ID NO: 318333 - RNA, 21 nt, Homo sapiens
gcaaacauccuuugaugccag

SEQ ID NO: 318334 - RNA, 23 nt, Homo sapiens
gcaaauaucguagagugucccug

SEQ ID NO: 318335 - RNA, 22 nt, Homo sapiens
gcacauggccccaucgugccga

SEQ ID NO: 318336 - RNA, 22 nt, Homo sapiens
gcacccugucaaaauggaccaa

SEQ ID NO: 318337 - RNA, 23 nt, Homo sapiens
gcagcaaugucacagggguccgg

SEQ ID NO: 318338 - RNA, 22 nt, Homo sapiens
gcagcacaugacuguauguaua

SEQ ID NO: 318339 - RNA, 22 nt, Homo sapiens
gcaggaaucuugagaaggauuc

SEQ ID NO: 318340 - RNA, 22 nt, Homo sapiens
gcaggaauuucucugcagaccc

SEQ ID NO: 318341 - RNA, 22 nt, Homo sapiens
gcaguguggguagagggcaaga

SEQ ID NO: 318342 - RNA, 16 nt, Homo sapiens
gcaguguguuuaauag

SEQ ID NO: 318343 - RNA, 22 nt, Homo sapiens
gcaguguucugggcaggaagaa

SEQ ID NO: 318344 - RNA, 22 nt, Homo sapiens
gcauauuuuaaaguguaaccug

SEQ ID NO: 318345 - RNA, 22 nt, Homo sapiens
gcauggccuuuaaaugucacag

SEQ ID NO: 318346 - RNA, 22 nt, Homo sapiens
gcccagcguucagggaggggcu

SEQ ID NO: 318347 - RNA, 22 nt, Homo sapiens
gcucaguuuccucagcugcaaa

SEQ ID NO: 318348 - RNA, 22 nt, Homo sapiens
gcuccuuugaguagcuucugug

SEQ ID NO: 318349 - RNA, 22 nt, Homo sapiens
gcugacagugguuauacuuaga

SEQ ID NO: 318350 - RNA, 22 nt, Homo sapiens
gcugguguucaggcccucaguc

SEQ ID NO: 318351 - RNA, 22 nt, Homo sapiens
ggaaagaucagcuaaauguaag

SEQ ID NO: 318352 - RNA, 21 nt, Homo sapiens
ggaaaguuaaggaaauacccc

SEQ ID NO: 318353 - RNA, 22 nt, Homo sapiens
ggagaucuuugaaguguugugc

SEQ ID NO: 318354 - RNA, 22 nt, Homo sapiens
ggaguguuccauuugucacauu

SEQ ID NO: 318355 - RNA, 22 nt, Homo sapiens
ggcaagaggagauucugcuccc

SEQ ID NO: 318356 - RNA, 22 nt, Homo sapiens
ggcacugugaugugagggggua

SEQ ID NO: 318357 - RNA, 22 nt, Homo sapiens
ggcaguuuguuugugaggucca

SEQ ID NO: 318358 - RNA, 22 nt, Homo sapiens
gggaacaugagaaugugaauga

SEQ ID NO: 318359 - RNA, 22 nt, Homo sapiens
gggcaaauuauguaucucucag

SEQ ID NO: 318360 - RNA, 19 nt, Homo sapiens
ggucauggagguuguguga

SEQ ID NO: 318361 - RNA, 22 nt, Homo sapiens
gguggugguauuucagaaaaug

SEQ ID NO: 318362 - RNA, 22 nt, Homo sapiens
guaaauguccugcuacagagug

SEQ ID NO: 318363 - RNA, 22 nt, Homo sapiens
guacaguacugaaugaauguau

SEQ ID NO: 318364 - RNA, 22 nt, Homo sapiens
guacauguaugcaugcaugcau

SEQ ID NO: 318365 - RNA, 22 nt, Homo sapiens
guagcagcaauuuacuccauac

SEQ ID NO: 318366 - RNA, 22 nt, Homo sapiens
guagcaugcaauauuauagaga

SEQ ID NO: 318367 - RNA, 22 nt, Homo sapiens
gucacagaggcuaagaccccac

SEQ ID NO: 318368 - RNA, 22 nt, Homo sapiens
gucacaggaaacuaauaugcgc

SEQ ID NO: 318369 - RNA, 22 nt, Homo sapiens
gucagagcacugaguugugggc

SEQ ID NO: 318370 - RNA, 22 nt, Homo sapiens
gucagggagggauagaugauua

SEQ ID NO: 318371 - RNA, 21 nt, Homo sapiens
guccaaaacaguguccaaugc

SEQ ID NO: 318372 - RNA, 22 nt, Homo sapiens
guccagagaagucauuacuuca

SEQ ID NO: 318373 - RNA, 22 nt, Homo sapiens
guccugaagaccuuccucugga

SEQ ID NO: 318374 - RNA, 22 nt, Homo sapiens
gucuccgagccguguggagccg

SEQ ID NO: 318375 - RNA, 22 nt, Homo sapiens
gucuggagacuugggucaucaa

SEQ ID NO: 318376 - RNA, 22 nt, Homo sapiens
gucuguuuggggaccuguggcc

SEQ ID NO: 318377 - RNA, 20 nt, Homo sapiens
gucuugcuccguugcccagg

SEQ ID NO: 318378 - RNA, 22 nt, Homo sapiens
gucuuggagaacucagcuuggc

SEQ ID NO: 318379 - RNA, 22 nt, Homo sapiens
gucuuggagacauugccauuga

SEQ ID NO: 318380 - RNA, 22 nt, Homo sapiens
gucuuuggaaagacaaaguuca

SEQ ID NO: 318381 - RNA, 17 nt, Homo sapiens
gucuuugguugaguuua

SEQ ID NO: 318382 - RNA, 22 nt, Homo sapiens
gugaauguaaagucaugugacu

SEQ ID NO: 318383 - RNA, 22 nt, Homo sapiens
gugaauguuuucuuacauggua

SEQ ID NO: 318384 - RNA, 21 nt, Homo sapiens
ugagaugcaaucaccagggag

SEQ ID NO: 318385 - RNA, 22 nt, Homo sapiens
ugagguagaaugauucuaauau

SEQ ID NO: 318386 - RNA, 22 nt, Homo sapiens
ugagugccuggagggcagggac

SEQ ID NO: 318387 - RNA, 22 nt, Homo sapiens
ugaguuauuaguagaggcuaug

SEQ ID NO: 318388 - RNA, 22 nt, Homo sapiens
ugaucuuuuuaauguccauggg

SEQ ID NO: 318389 - RNA, 22 nt, Homo sapiens
ugauguauuauuaagaccuggc

SEQ ID NO: 318390 - RNA, 19 nt, Homo sapiens
ugcaaauucuaaaaacuga

SEQ ID NO: 318391 - RNA, 22 nt, Homo sapiens
ugcaguguucuuuagaggaaau

SEQ ID NO: 318392 - RNA, 19 nt, Homo sapiens
uaacacaguuguguuugag

SEQ ID NO: 318393 - RNA, 22 nt, Homo sapiens
uaacaguguagaggccuauugg

SEQ ID NO: 318394 - RNA, 22 nt, Homo sapiens
uaaggcaaucagucaugguguu

SEQ ID NO: 318395 - RNA, 22 nt, Homo sapiens
uaaggcucuuguuauuuugagg

SEQ ID NO: 318396 - RNA, 22 nt, Homo sapiens
uaauacuugucauaaaggcauu

SEQ ID NO: 318397 - RNA, 16 nt, Homo sapiens
uacaacagugaguaug

SEQ ID NO: 318398 - RNA, 22 nt, Homo sapiens
uacaagcuaaaauggaagauca

SEQ ID NO: 318399 - RNA, 22 nt, Homo sapiens
uacagaauugcagguguggcag

SEQ ID NO: 318400 - RNA, 22 nt, Homo sapiens
uacaguaauguuaaucuuugug

SEQ ID NO: 318401 - RNA, 19 nt, Homo sapiens
uacaugcagcaggcacgca

SEQ ID NO: 318402 - RNA, 22 nt, Homo sapiens
uaccuuugucaguuacucaccu

SEQ ID NO: 318403 - RNA, 22 nt, Homo sapiens
uacuguacugcaguucugcaaa

SEQ ID NO: 318404 - RNA, 22 nt, Homo sapiens
uagagcaugugccauacguaca

SEQ ID NO: 318405 - RNA, 22 nt, Homo sapiens
uagcaccaggguugacugaccu

SEQ ID NO: 318406 - RNA, 22 nt, Homo sapiens
uagcaccucuuuggccuuucgu

SEQ ID NO: 318407 - RNA, 22 nt, Homo sapiens
uagcagacuauuuugugauaau

SEQ ID NO: 318408 - RNA, 22 nt, Homo sapiens
uagcagcaaagcaggaucugcu

SEQ ID NO: 318409 - RNA, 22 nt, Homo sapiens
uagcagcaccccacucuacugg

SEQ ID NO: 318410 - RNA, 20 nt, Homo sapiens
uagcagcagacagagggagg

SEQ ID NO: 318411 - RNA, 22 nt, Homo sapiens
uagcagcagugguguauuuaga

SEQ ID NO: 318412 - RNA, 19 nt, Homo sapiens
uagcagcaugauuuauaau

SEQ ID NO: 318413 - RNA, 22 nt, Homo sapiens
uaggaaguacaucucagaaucu

SEQ ID NO: 318414 - RNA, 22 nt, Homo sapiens
uaggagugugaacccuaugaac

SEQ ID NO: 318415 - RNA, 22 nt, Homo sapiens
uaggagugugaacccuguuuug

SEQ ID NO: 318416 - RNA, 23 nt, Homo sapiens
uagguuauuugguaaauauaugu

SEQ ID NO: 318417 - RNA, 22 nt, Homo sapiens
uagugacauugcugggaaugcu

SEQ ID NO: 318418 - RNA, 22 nt, Homo sapiens
uauacuguuuucuauaguggcu

SEQ ID NO: 318419 - RNA, 22 nt, Homo sapiens
uauaugcuaaacaagggguggg

SEQ ID NO: 318420 - RNA, 22 nt, Homo sapiens
uaucaucauuggcaggugagaa

SEQ ID NO: 318421 - RNA, 20 nt, Homo sapiens
uaugacaaagccuagugagu

SEQ ID NO: 318422 - RNA, 22 nt, Homo sapiens
uauggaaaucuuaccuuauggu

SEQ ID NO: 318423 - RNA, 22 nt, Homo sapiens
uauggcuuuuauuauguuguag

SEQ ID NO: 318424 - RNA, 22 nt, Homo sapiens
uauggguuuauuucuggucuca

SEQ ID NO: 318425 - RNA, 22 nt, Homo sapiens
uauggguuuuugucuguuuacu

SEQ ID NO: 318426 - RNA, 18 nt, Homo sapiens
uauuccucuuccucuauc

SEQ ID NO: 318427 - RNA, 22 nt, Homo sapiens
ucaaagugacaaaguugcagca

SEQ ID NO: 318428 - RNA, 22 nt, Homo sapiens
ucaaagugagcuccuucucacu

SEQ ID NO: 318429 - RNA, 21 nt, Homo sapiens
ucaaaguguucuuuuguugaa

SEQ ID NO: 318430 - RNA, 22 nt, Homo sapiens
ucaaauuccaagucuagguagg

SEQ ID NO: 318431 - RNA, 18 nt, Homo sapiens
ucaagcuauugucaugcc

SEQ ID NO: 318432 - RNA, 22 nt, Homo sapiens
ucaaguacuuauuugauaauua

SEQ ID NO: 318433 - RNA, 22 nt, Homo sapiens
ucacaaguguauagacaugucc

SEQ ID NO: 318434 - RNA, 22 nt, Homo sapiens
ucacagaugcuugacccauuuc

SEQ ID NO: 318435 - RNA, 22 nt, Homo sapiens
ucacaguaaauccagaagaaau

SEQ ID NO: 318436 - RNA, 22 nt, Homo sapiens
ucacagucggugacuucuugcu

SEQ ID NO: 318437 - RNA, 23 nt, Homo sapiens
ucacaguuacuuuugcaucaacc

SEQ ID NO: 318438 - RNA, 22 nt, Homo sapiens
ucacaguugauugaaacacagc

SEQ ID NO: 318439 - RNA, 20 nt, Homo sapiens
ucacccugacaucugcccag

SEQ ID NO: 318440 - RNA, 22 nt, Homo sapiens
ucacgcugcugcaaccagccug

SEQ ID NO: 318441 - RNA, 22 nt, Homo sapiens
ucacuguugaugggcaugcagg

SEQ ID NO: 318442 - RNA, 22 nt, Homo sapiens
ucagcacauucaaggccugccu

SEQ ID NO: 318443 - RNA, 22 nt, Homo sapiens
ucaguaaucuuagcugugcaga

SEQ ID NO: 318444 - RNA, 22 nt, Homo sapiens
ucagugucugugauggagaggu

SEQ ID NO: 318445 - RNA, 22 nt, Homo sapiens
ucaucaguuuuuuauaugugau

SEQ ID NO: 318446 - RNA, 22 nt, Homo sapiens
ucaugugagcacagagcaagau

SEQ ID NO: 318447 - RNA, 22 nt, Homo sapiens
ucauugcaaucucugccucccg

SEQ ID NO: 318448 - RNA, 22 nt, Homo sapiens
ucccagugaaaccccaccuuca

SEQ ID NO: 318449 - RNA, 22 nt, Homo sapiens
ucccgaggacaucugggggcaa

SEQ ID NO: 318450 - RNA, 22 nt, Homo sapiens
ucccuagacuccugccuuucag

SEQ ID NO: 318451 - RNA, 20 nt, Homo sapiens
ucccucaaacuuuuccacug

SEQ ID NO: 318452 - RNA, 20 nt, Homo sapiens
uccugagauucccaguucuc

SEQ ID NO: 318453 - RNA, 22 nt, Homo sapiens
ucucaauggguuguagacaaag

SEQ ID NO: 318454 - RNA, 22 nt, Homo sapiens
ucucaauuugauuacauucaua

SEQ ID NO: 318455 - RNA, 18 nt, Homo sapiens
ucucacagcaaucuguca

SEQ ID NO: 318456 - RNA, 21 nt, Homo sapiens
ucucucaaccaggaagugggc

SEQ ID NO: 318457 - RNA, 22 nt, Homo sapiens
ucucugaaacucuugacauccu

SEQ ID NO: 318458 - RNA, 22 nt, Homo sapiens
ucucugguuuucaaagcaguau

SEQ ID NO: 318459 - RNA, 22 nt, Homo sapiens
ucucuguuuauuuuugguguau

SEQ ID NO: 318460 - RNA, 22 nt, Homo sapiens
ucugcauaucaugcagaacuau

SEQ ID NO: 318461 - RNA, 20 nt, Homo sapiens
ucuggccccucuaaaucuca

SEQ ID NO: 318462 - RNA, 22 nt, Homo sapiens
ucuguaacauccaccuucuggg

SEQ ID NO: 318463 - RNA, 22 nt, Homo sapiens
ucugucuugugguuugagugcc

SEQ ID NO: 318464 - RNA, 22 nt, Homo sapiens
ucugugguuguugcauggaaug

SEQ ID NO: 318465 - RNA, 22 nt, Homo sapiens
ucuuaguuggaaugggauaagg

SEQ ID NO: 318466 - RNA, 22 nt, Homo sapiens
ucuuaguuuagauuagcaauuc

SEQ ID NO: 318467 - RNA, 22 nt, Homo sapiens
ucuuuggguguauuucacagcc

SEQ ID NO: 318468 - RNA, 22 nt, Homo sapiens
ucuuugguauugugaauagugu

SEQ ID NO: 318469 - RNA, 22 nt, Homo sapiens
ucuuugguucugugcagccuau

SEQ ID NO: 318470 - RNA, 22 nt, Homo sapiens
ucuuugguuguuuagggugcau

SEQ ID NO: 318471 - RNA, 22 nt, Homo sapiens
ugaauucuguccaaaauaacug

SEQ ID NO: 318472 - RNA, 22 nt, Homo sapiens
ugacaagaaagcgucuucuuuu

SEQ ID NO: 318473 - RNA, 22 nt, Homo sapiens
ugacaguguccucauucccaac

SEQ ID NO: 318474 - RNA, 22 nt, Homo sapiens
ugacaguguccuccuccugaga

SEQ ID NO: 318475 - RNA, 22 nt, Homo sapiens
ugacaugaagucucccucuguu

SEQ ID NO: 318476 - RNA, 22 nt, Homo sapiens
ugacauguauaucuuacgcuau

SEQ ID NO: 318477 - RNA, 22 nt, Homo sapiens
ugacuauugauuuagacgugcu

SEQ ID NO: 318478 - RNA, 22 nt, Homo sapiens
ugacugguguuuaaugagucaa

SEQ ID NO: 318479 - RNA, 22 nt, Homo sapiens
ugacuuaugcaacucugaugug

SEQ ID NO: 318480 - RNA, 22 nt, Homo sapiens
ugagaacaugcacuugagguug

SEQ ID NO: 318481 - RNA, 20 nt, Homo sapiens
ugagaacauguggcauuugg

SEQ ID NO: 318482 - RNA, 22 nt, Homo sapiens
ugagaacuuugucuuuuacucu

SEQ ID NO: 318483 - RNA, 22 nt, Homo sapiens
ugagacauauuauacugcuuuu

SEQ ID NO: 318484 - RNA, 22 nt, Homo sapiens
ugagacaugugaauauuuguac

SEQ ID NO: 318485 - RNA, 22 nt, Homo sapiens
ugagaccaacagauuccaguuc

SEQ ID NO: 318486 - RNA, 22 nt, Homo sapiens
cuaaggcaguagccugaauaau

SEQ ID NO: 318487 - RNA, 22 nt, Homo sapiens
cuaauucuguaccuggcacaua

SEQ ID NO: 318488 - RNA, 22 nt, Homo sapiens
cuacauuguagguauucaaacu

SEQ ID NO: 318489 - RNA, 22 nt, Homo sapiens
cuagaagguaagagcuggaugc

SEQ ID NO: 318490 - RNA, 22 nt, Homo sapiens
cuagcugcacuuccugcuacug

SEQ ID NO: 318491 - RNA, 22 nt, Homo sapiens
cucaaagugcuaagauuaggcu

SEQ ID NO: 318492 - RNA, 22 nt, Homo sapiens
cucaaguacaugggauuacagg

SEQ ID NO: 318493 - RNA, 22 nt, Homo sapiens
cucaauuuggaauugucaguaa

SEQ ID NO: 318494 - RNA, 22 nt, Homo sapiens
cucaggcacucugauuccagug

SEQ ID NO: 318495 - RNA, 22 nt, Homo sapiens
cucauugcaaucuccaccuccc

SEQ ID NO: 318496 - RNA, 23 nt, Homo sapiens
cuccaugagccguccagggccug

SEQ ID NO: 318497 - RNA, 22 nt, Homo sapiens
cuccauuuaguccuuuuagaag

SEQ ID NO: 318498 - RNA, 22 nt, Homo sapiens
cucuuuuguuccuaguuugauc

SEQ ID NO: 318499 - RNA, 20 nt, Homo sapiens
cugaggugggagaaucgcuu

SEQ ID NO: 318500 - RNA, 22 nt, Homo sapiens
cugaggugggaggauuggcuug

SEQ ID NO: 318501 - RNA, 22 nt, Homo sapiens
uuguaguagucucguucuuuua

SEQ ID NO: 318502 - RNA, 22 nt, Homo sapiens
uuguaguguuuauucugucaac

SEQ ID NO: 318503 - RNA, 23 nt, Homo sapiens
uuguccccuccaaagcucauguu

SEQ ID NO: 318504 - RNA, 22 nt, Homo sapiens
uuguccuccacauuugaucagu

SEQ ID NO: 318505 - RNA, 22 nt, Homo sapiens
uugugaucauugucaaauagug

SEQ ID NO: 318506 - RNA, 22 nt, Homo sapiens
cacacugucuuucagaaugguu

SEQ ID NO: 318507 - RNA, 22 nt, Homo sapiens
cacagcuagucaaugguagaca

SEQ ID NO: 318508 - RNA, 22 nt, Homo sapiens
caccuagacuggagugcagugg

SEQ ID NO: 318509 - RNA, 22 nt, Homo sapiens
cacugcauggucuagcuggguu

SEQ ID NO: 318510 - RNA, 22 nt, Homo sapiens
cagacaugucuuguggccgugg

SEQ ID NO: 318511 - RNA, 22 nt, Homo sapiens
cagagagcuugcccuuguauau

SEQ ID NO: 318512 - RNA, 20 nt, Homo sapiens
cagcacgcacaugagacugu

SEQ ID NO: 318513 - RNA, 20 nt, Homo sapiens
cagugcacuuucccacuggu

SEQ ID NO: 318514 - RNA, 23 nt, Homo sapiens
cagugguguuagagaaaucuuuu

SEQ ID NO: 318515 - RNA, 22 nt, Homo sapiens
cauacaguaggcacuauuugua

SEQ ID NO: 318516 - RNA, 22 nt, Homo sapiens
caucagcaauguaugaggguuc

SEQ ID NO: 318517 - RNA, 22 nt, Homo sapiens
cauggucaccuuccaaguuauu

SEQ ID NO: 318518 - RNA, 22 nt, Homo sapiens
cauuacacuuguaagguuuuuc

SEQ ID NO: 318519 - RNA, 22 nt, Homo sapiens
cauugcaugccagccugggcaa

SEQ ID NO: 318520 - RNA, 22 nt, Homo sapiens
cauugcauuccagucugggcaa

SEQ ID NO: 318521 - RNA, 22 nt, Homo sapiens
cauugcuaaaagucauauauaa

SEQ ID NO: 318522 - RNA, 22 nt, Homo sapiens
ccaagccucaguuucccucugu

SEQ ID NO: 318523 - RNA, 22 nt, Homo sapiens
ccaagugcuuaaaauuucauuu

SEQ ID NO: 318524 - RNA, 22 nt, Homo sapiens
ccagcaccauuuguugaauagg

SEQ ID NO: 318525 - RNA, 22 nt, Homo sapiens
ccccauuguugugguuuuaucu

SEQ ID NO: 318526 - RNA, 22 nt, Homo sapiens
cgugaggaaaacagaggguguu

SEQ ID NO: 318527 - RNA, 17 nt, Homo sapiens
cuaaggcaagagucugc

SEQ ID NO: 318528 - RNA, 22 nt, Homo sapiens
cuauauacugccugcugauuag

SEQ ID NO: 318529 - RNA, 22 nt, Homo sapiens
cucaaguagugguuuucauuga

SEQ ID NO: 318530 - RNA, 22 nt, Homo sapiens
cucacggugcaggcuucuggga

SEQ ID NO: 318531 - RNA, 22 nt, Homo sapiens
cucagugucuggcacacagaaa

SEQ ID NO: 318532 - RNA, 21 nt, Homo sapiens
cucauauugcuuuuccauggu

SEQ ID NO: 318533 - RNA, 22 nt, Homo sapiens
cuccacugagcaggugggaggc

SEQ ID NO: 318534 - RNA, 22 nt, Homo sapiens
cucuuuggaugccuuaggguua

SEQ ID NO: 318535 - RNA, 22 nt, Homo sapiens
cugacucagacacauguauaug

SEQ ID NO: 318536 - RNA, 22 nt, Homo sapiens
cugagagaggagcuaaaacugc

SEQ ID NO: 318537 - RNA, 22 nt, Homo sapiens
cugagaucaagucuugcucugu

SEQ ID NO: 318538 - RNA, 22 nt, Homo sapiens
cugaggaaguucuuuaacaguu

SEQ ID NO: 318539 - RNA, 22 nt, Homo sapiens
cugauaaguuuuucuuuauaag

SEQ ID NO: 318540 - RNA, 22 nt, Homo sapiens
cugauugucuauuuaguucacu

SEQ ID NO: 318541 - RNA, 22 nt, Homo sapiens
cugccacugacaccucaaggac

SEQ ID NO: 318542 - RNA, 18 nt, Homo sapiens
cugccagugugcucuccg

SEQ ID NO: 318543 - RNA, 22 nt, Homo sapiens
cugccugagaaaauggagggca

SEQ ID NO: 318544 - RNA, 22 nt, Homo sapiens
cuggaguaugaaccauguauca

SEQ ID NO: 318545 - RNA, 22 nt, Homo sapiens
cuggauauguugcaacauuucc

SEQ ID NO: 318546 - RNA, 22 nt, Homo sapiens
cuggcccaguucugcguuuugc

SEQ ID NO: 318547 - RNA, 22 nt, Homo sapiens
cugucacugggaggggcagcag

SEQ ID NO: 318548 - RNA, 22 nt, Homo sapiens
cugugcuaggcaaugugguaga

SEQ ID NO: 318549 - RNA, 22 nt, Homo sapiens
cuuaagcauugacuuuggacag

SEQ ID NO: 318550 - RNA, 22 nt, Homo sapiens
cuucaaaguuggcuaggagaca

SEQ ID NO: 318551 - RNA, 22 nt, Homo sapiens
cuucaaguaauucugauggcua

SEQ ID NO: 318552 - RNA, 22 nt, Homo sapiens
cuucaagucuuuggauaauuag

SEQ ID NO: 318553 - RNA, 22 nt, Homo sapiens
cuucccguuauugcccuugggu

SEQ ID NO: 318554 - RNA, 22 nt, Homo sapiens
cuucuguuaguucugauaacuu

SEQ ID NO: 318555 - RNA, 22 nt, Homo sapiens
gaaaauccauccccagggagua

SEQ ID NO: 318556 - RNA, 18 nt, Homo sapiens
gaaaugccucuugcuuac

SEQ ID NO: 318557 - RNA, 22 nt, Homo sapiens
gaacugggguuggguugcgaua

SEQ ID NO: 318558 - RNA, 22 nt, Homo sapiens
gaauucugucgcuuacuagaug

SEQ ID NO: 318559 - RNA, 22 nt, Homo sapiens
gacugaggaagcgcucucuccu

SEQ ID NO: 318560 - RNA, 22 nt, Homo sapiens
gagacggagucucgcucuguca

SEQ ID NO: 318561 - RNA, 22 nt, Homo sapiens
gagaugaaaucuugcucuguca

SEQ ID NO: 318562 - RNA, 22 nt, Homo sapiens
gagcaucaauggcaugugggaa

SEQ ID NO: 318563 - RNA, 22 nt, Homo sapiens
gagguguaaggacaacagagac

SEQ ID NO: 318564 - RNA, 22 nt, Homo sapiens
gagugcaauggcaugaucuggg

SEQ ID NO: 318565 - RNA, 22 nt, Homo sapiens
gagugcaauggugcuaucucgg

SEQ ID NO: 318566 - RNA, 22 nt, Homo sapiens
gauguguuuguuucuggaggag

SEQ ID NO: 318567 - RNA, 21 nt, Homo sapiens
gcaaaguggcuaccuugcucc

SEQ ID NO: 318568 - RNA, 22 nt, Homo sapiens
gcaaaguguuuuuaggaagucu

SEQ ID NO: 318569 - RNA, 22 nt, Homo sapiens
gcaauggaaucccuugaucaau

SEQ ID NO: 318570 - RNA, 22 nt, Homo sapiens
gcagaucuucgcgguaaguguu

SEQ ID NO: 318571 - RNA, 22 nt, Homo sapiens
gccaagaagugucuaagcagga

SEQ ID NO: 318572 - RNA, 22 nt, Homo sapiens
gcccuguaguauaguuugaagu

SEQ ID NO: 318573 - RNA, 22 nt, Homo sapiens
gcccuguugcccaggcuggagu

SEQ ID NO: 318574 - RNA, 22 nt, Homo sapiens
gcuaugguuuuuagcuccauca

SEQ ID NO: 318575 - RNA, 22 nt, Homo sapiens
gcuaugucuguugcucuugggc

SEQ ID NO: 318576 - RNA, 22 nt, Homo sapiens
gcuuugguucaaccaggcaauu

SEQ ID NO: 318577 - RNA, 22 nt, Homo sapiens
ggaaaucaucauucucgguaua

SEQ ID NO: 318578 - RNA, 17 nt, Homo sapiens
ggaagccuuugguuuaa

SEQ ID NO: 318579 - RNA, 22 nt, Homo sapiens
ggcauguugauagguagaugua

SEQ ID NO: 318580 - RNA, 22 nt, Homo sapiens
ggcauguuuaguagaauguggu

SEQ ID NO: 318581 - RNA, 22 nt, Homo sapiens
gggaagugugcagaguucucuu

SEQ ID NO: 318582 - RNA, 22 nt, Homo sapiens
guaaugcacucccaaagaucca

SEQ ID NO: 318583 - RNA, 22 nt, Homo sapiens
guacaguucucuuuguugucag

SEQ ID NO: 318584 - RNA, 22 nt, Homo sapiens
guacaugcauacaugcacaucu

SEQ ID NO: 318585 - RNA, 22 nt, Homo sapiens
guacaugcaugcaugggugugc

SEQ ID NO: 318586 - RNA, 22 nt, Homo sapiens
gucagcuuguccagagacucug

SEQ ID NO: 318587 - RNA, 22 nt, Homo sapiens
gucagugugauaucugcagggg

SEQ ID NO: 318588 - RNA, 22 nt, Homo sapiens
gucaguuugguuaaucauucca

SEQ ID NO: 318589 - RNA, 22 nt, Homo sapiens
gucauugcuuaucugcugacgu

SEQ ID NO: 318590 - RNA, 22 nt, Homo sapiens
gucucacagcuagcugcuuuau

SEQ ID NO: 318591 - RNA, 22 nt, Homo sapiens
gucuuuugcuagccagagagcu

SEQ ID NO: 318592 - RNA, 22 nt, Homo sapiens
gugaccagaugggcaggggugu

SEQ ID NO: 318593 - RNA, 22 nt, Homo sapiens
gugaccucuguugcugucacua

SEQ ID NO: 318594 - RNA, 22 nt, Homo sapiens
gugaggcacugcugcuuuccag

SEQ ID NO: 318595 - RNA, 22 nt, Homo sapiens
gugauuauuaugcacugcaugc

SEQ ID NO: 318596 - RNA, 23 nt, Homo sapiens
gugcaguggcgagauuucggcuc

SEQ ID NO: 318597 - RNA, 22 nt, Homo sapiens
gugccacugcaccuggccuaag

SEQ ID NO: 318598 - RNA, 22 nt, Homo sapiens
guggaaggucaugaauguucuu

SEQ ID NO: 318599 - RNA, 22 nt, Homo sapiens
guggcaagaauguacaaaaggu

SEQ ID NO: 318600 - RNA, 22 nt, Homo sapiens
guggcacgaugaucugggcuca

SEQ ID NO: 318601 - RNA, 22 nt, Homo sapiens
uugcaugguggaacuuggagcu

SEQ ID NO: 318602 - RNA, 22 nt, Homo sapiens
uugccaauauuuuacugagaag

SEQ ID NO: 318603 - RNA, 22 nt, Homo sapiens
uugccacuucucuugccccauu

SEQ ID NO: 318604 - RNA, 22 nt, Homo sapiens
uugcuagucucuguuucaggau

SEQ ID NO: 318605 - RNA, 22 nt, Homo sapiens
uuggacugggauggccgaggcu

SEQ ID NO: 318606 - RNA, 22 nt, Homo sapiens
uuggcaaagugucuggcauuua

SEQ ID NO: 318607 - RNA, 22 nt, Homo sapiens
uuggcuaugaguccuaugugca

SEQ ID NO: 318608 - RNA, 22 nt, Homo sapiens
uuggucacugacauguuugaaa

SEQ ID NO: 318609 - RNA, 22 nt, Homo sapiens
uuggucaggagccucccucuuu

SEQ ID NO: 318610 - RNA, 22 nt, Homo sapiens
uuguccccaucugcugccagaa

SEQ ID NO: 318611 - RNA, 22 nt, Homo sapiens
uuguccuggagguucuugcaag

SEQ ID NO: 318612 - RNA, 22 nt, Homo sapiens
uugugcuuguaacuacauucag

SEQ ID NO: 318613 - RNA, 22 nt, Homo sapiens
uugugucaaauggcaauuagca

SEQ ID NO: 318614 - RNA, 22 nt, Homo sapiens
uuuaaugcaucccaaaauguag

SEQ ID NO: 318615 - RNA, 22 nt, Homo sapiens
uuuacugucuucagucccucug

SEQ ID NO: 318616 - RNA, 22 nt, Homo sapiens
uuuagcaaagcaauuuacacca

SEQ ID NO: 318617 - RNA, 22 nt, Homo sapiens
uuucaagugcugucuuagcugu

SEQ ID NO: 318618 - RNA, 18 nt, Homo sapiens
uuucauugagugugauau

SEQ ID NO: 318619 - RNA, 22 nt, Homo sapiens
uuucccagugguacaguuuaua

SEQ ID NO: 318620 - RNA, 21 nt, Homo sapiens
uuuccuggagcguauggcuuc

SEQ ID NO: 318621 - RNA, 22 nt, Homo sapiens
uuugacuaccaggaauguucuu

SEQ ID NO: 318622 - RNA, 22 nt, Homo sapiens
uuugaggaaaggcauaaguagg

SEQ ID NO: 318623 - RNA, 22 nt, Homo sapiens
uuugcuuaaaguccuuguggga

SEQ ID NO: 318624 - RNA, 22 nt, Homo sapiens
uuuggaaugugcacucagauug

SEQ ID NO: 318625 - RNA, 22 nt, Homo sapiens
uuuggcauuagagagacuugca

SEQ ID NO: 318626 - RNA, 22 nt, Homo sapiens
uuuggcauuugaguuuguagga

SEQ ID NO: 318627 - RNA, 22 nt, Homo sapiens
uuuggucagcugcgggucagcu

SEQ ID NO: 318628 - RNA, 23 nt, Homo sapiens
uuuguacuaugucaguuuagaua

SEQ ID NO: 318629 - RNA, 22 nt, Homo sapiens
uuuguacuugaagaaucuuuau

SEQ ID NO: 318630 - RNA, 22 nt, Homo sapiens
uuuuccagugggacucccauua

SEQ ID NO: 318631 - RNA, 22 nt, Homo sapiens
uuuuggcuagaaauauaccucc

SEQ ID NO: 318632 - RNA, 22 nt, Homo sapiens
uuuuggcuuaaagagaauguau

SEQ ID NO: 318633 - RNA, 22 nt, Homo sapiens
uuuuguacgccuguguccauca

SEQ ID NO: 318634 - RNA, 18 nt, Homo sapiens
uuuuugaggcacagggga

SEQ ID NO: 318635 - RNA, 22 nt, Homo sapiens
uuuuugaguaaauauaaauugu

SEQ ID NO: 318636 - RNA, 21 nt, Homo sapiens
uuuuugguggucauggauaga

SEQ ID NO: 318637 - RNA, 20 nt, Homo sapiens
uugcugguguuagaggaggc

SEQ ID NO: 318638 - RNA, 22 nt, Homo sapiens
uugcugguuuucauaugagcag

SEQ ID NO: 318639 - RNA, 22 nt, Homo sapiens
uuggaagagaagggagauaaac

SEQ ID NO: 318640 - RNA, 22 nt, Homo sapiens
uuggacugugagguuucguggg

SEQ ID NO: 318641 - RNA, 22 nt, Homo sapiens
uuggcaauugcuaugauuugaa

SEQ ID NO: 318642 - RNA, 22 nt, Homo sapiens
uuggcauuuauucuaaggucaa

SEQ ID NO: 318643 - RNA, 22 nt, Homo sapiens
uugggcauugggcuaaacuccc

SEQ ID NO: 318644 - RNA, 22 nt, Homo sapiens
uuguccucuccaaaucucaugu

SEQ ID NO: 318645 - RNA, 22 nt, Homo sapiens
uugugcuuuugagcugagauga

SEQ ID NO: 318646 - RNA, 22 nt, Homo sapiens
uugugcuuuuuaaauagcuucc

SEQ ID NO: 318647 - RNA, 22 nt, Homo sapiens
uuguguuugaugcugacacgca

SEQ ID NO: 318648 - RNA, 22 nt, Homo sapiens
uuuaauacugcaucuuuacucu

SEQ ID NO: 318649 - RNA, 21 nt, Homo sapiens
uuuacuguggacccauugcuu

SEQ ID NO: 318650 - RNA, 22 nt, Homo sapiens
uuucacagcaauugccuauugu

SEQ ID NO: 318651 - RNA, 22 nt, Homo sapiens
uuucaggcagggagcuucagug

SEQ ID NO: 318652 - RNA, 22 nt, Homo sapiens
uuucaguagagacacgguuuug

SEQ ID NO: 318653 - RNA, 22 nt, Homo sapiens
uuucauggacgcaaugccuuuu

SEQ ID NO: 318654 - RNA, 20 nt, Homo sapiens
uuucuccccuauaaaucuca

SEQ ID NO: 318655 - RNA, 22 nt, Homo sapiens
uuucugagaccaaaacuuguaa

SEQ ID NO: 318656 - RNA, 21 nt, Homo sapiens
uuucugggggagcauggcagg

SEQ ID NO: 318657 - RNA, 22 nt, Homo sapiens
uuugaagcuaaggugcuugguu

SEQ ID NO: 318658 - RNA, 22 nt, Homo sapiens
uuugcagugucagcuucugugu

SEQ ID NO: 318659 - RNA, 22 nt, Homo sapiens
uuuggcagaaaacuaaaaggua

SEQ ID NO: 318660 - RNA, 22 nt, Homo sapiens
uuuggcauauuuuaagcugguu

SEQ ID NO: 318661 - RNA, 23 nt, Homo sapiens
uuuggcauuccagaaauuuucau

SEQ ID NO: 318662 - RNA, 22 nt, Homo sapiens
uuuggucacugccgccgccagc

SEQ ID NO: 318663 - RNA, 22 nt, Homo sapiens
uuugguuauauauauacacucu

SEQ ID NO: 318664 - RNA, 22 nt, Homo sapiens
uuugguuauuugaaacuagcau

SEQ ID NO: 318665 - RNA, 22 nt, Homo sapiens
uuuuaagcuacaagagacauau

SEQ ID NO: 318666 - RNA, 20 nt, Homo sapiens
uuuuagcuuuuauugaaagc

SEQ ID NO: 318667 - RNA, 22 nt, Homo sapiens
uuuuagcuuuucccaggacucc

SEQ ID NO: 318668 - RNA, 22 nt, Homo sapiens
uuuuaguugcucagguauucuc

SEQ ID NO: 318669 - RNA, 22 nt, Homo sapiens
uuuugggggugauucacacagu

SEQ ID NO: 318670 - RNA, 22 nt, Homo sapiens
uuuuugagguauaguguggcua

SEQ ID NO: 318671 - RNA, 19 nt, Homo sapiens
gcuucuugaggacgaugac

SEQ ID NO: 318672 - RNA, 22 nt, Homo sapiens
ggaauauaaaacuuuugacagg

SEQ ID NO: 318673 - RNA, 19 nt, Homo sapiens
ggaaugcaccaguccuugc

SEQ ID NO: 318674 - RNA, 22 nt, Homo sapiens
ggagaguaauuagacugaaaga

SEQ ID NO: 318675 - RNA, 22 nt, Homo sapiens
ggagucuugcuauguugccaag

SEQ ID NO: 318676 - RNA, 22 nt, Homo sapiens
ggagugucccaaucucagcuca

SEQ ID NO: 318677 - RNA, 22 nt, Homo sapiens
ggauacaucuggacagccgaau

SEQ ID NO: 318678 - RNA, 22 nt, Homo sapiens
ggcaugguggugugugccuaua

SEQ ID NO: 318679 - RNA, 22 nt, Homo sapiens
gggaacauggaaauucugcucu

SEQ ID NO: 318680 - RNA, 22 nt, Homo sapiens
gggcaugauggugcacacaugu

SEQ ID NO: 318681 - RNA, 22 nt, Homo sapiens
ggucauggagcuuuacuuuaug

SEQ ID NO: 318682 - RNA, 22 nt, Homo sapiens
ggucuuggagaauuguccuggg

SEQ ID NO: 318683 - RNA, 22 nt, Homo sapiens
gguggcaaaucugaguggcgcu

SEQ ID NO: 318684 - RNA, 22 nt, Homo sapiens
guaaauguccccugugauauug

SEQ ID NO: 318685 - RNA, 22 nt, Homo sapiens
guaagugguagagcugggcuau

SEQ ID NO: 318686 - RNA, 22 nt, Homo sapiens
guacaugcauaguuuauuucug

SEQ ID NO: 318687 - RNA, 22 nt, Homo sapiens
guaguuuaucagaaagaauagg

SEQ ID NO: 318688 - RNA, 22 nt, Homo sapiens
guauuugauuauagcaugcuua

SEQ ID NO: 318689 - RNA, 22 nt, Homo sapiens
gucaaagucuauuggcuaauuc

SEQ ID NO: 318690 - RNA, 22 nt, Homo sapiens
gucaaagugauuguaauuaggu

SEQ ID NO: 318691 - RNA, 22 nt, Homo sapiens
gucaggcaccgauacaguuuuu

SEQ ID NO: 318692 - RNA, 22 nt, Homo sapiens
gucagugauugauuuaaagacg

SEQ ID NO: 318693 - RNA, 22 nt, Homo sapiens
gucaguuucacucagcuggaac

SEQ ID NO: 318694 - RNA, 22 nt, Homo sapiens
gucccagagauauugugucuuu

SEQ ID NO: 318695 - RNA, 22 nt, Homo sapiens
gucuuuggaaaaaaugucuguu

SEQ ID NO: 318696 - RNA, 22 nt, Homo sapiens
gugaacagcagaugagugagug

SEQ ID NO: 318697 - RNA, 22 nt, Homo sapiens
gugcacaaaucuuaaauguaca

SEQ ID NO: 318698 - RNA, 22 nt, Homo sapiens
gugcacaacaugcaguuuuguu

SEQ ID NO: 318699 - RNA, 22 nt, Homo sapiens
gugcauguccacuaguccauau

SEQ ID NO: 318700 - RNA, 22 nt, Homo sapiens
gugcaugucuaugcgagucuaa

SEQ ID NO: 318701 - RNA, 22 nt, Homo sapiens
guggaagguaaugcagcuuacu

SEQ ID NO: 318702 - RNA, 22 nt, Homo sapiens
guggaaugcaguguugauucaa

SEQ ID NO: 318703 - RNA, 22 nt, Homo sapiens
guggacugggagagauaguucc

SEQ ID NO: 318704 - RNA, 22 nt, Homo sapiens
guguaaaucaaucuguugucuu

SEQ ID NO: 318705 - RNA, 23 nt, Homo sapiens
guuaagugaauguguacucuauu

SEQ ID NO: 318706 - RNA, 22 nt, Homo sapiens
guucaagugauagcugggauua

SEQ ID NO: 318707 - RNA, 21 nt, Homo sapiens
guucaagugauccuccugucu

SEQ ID NO: 318708 - RNA, 22 nt, Homo sapiens
guucccaguugaaaugauuagu

SEQ ID NO: 318709 - RNA, 22 nt, Homo sapiens
uaaacacucacuucauagccau

SEQ ID NO: 318710 - RNA, 22 nt, Homo sapiens
uaaagaugcugggaaggcuagg

SEQ ID NO: 318711 - RNA, 21 nt, Homo sapiens
uaaagcuagaaccuuagcuuu

SEQ ID NO: 318712 - RNA, 22 nt, Homo sapiens
uaaaugcuugagaugauggaua

SEQ ID NO: 318713 - RNA, 22 nt, Homo sapiens
uaacaaugucuuaugggcuuaa

SEQ ID NO: 318714 - RNA, 22 nt, Homo sapiens
uaacauuguugauuauacuaag

SEQ ID NO: 318715 - RNA, 22 nt, Homo sapiens
uaagacuguguaauuuaugaag

SEQ ID NO: 318716 - RNA, 22 nt, Homo sapiens
uaaggcuuugucuuaggacuuu

SEQ ID NO: 318717 - RNA, 22 nt, Homo sapiens
uaaguauuaggccccaggcugg

SEQ ID NO: 318718 - RNA, 22 nt, Homo sapiens
uaaguauuaugugcugcauuuu

SEQ ID NO: 318719 - RNA, 22 nt, Homo sapiens
uaagucuuuuuggaguuuauaa

SEQ ID NO: 318720 - RNA, 22 nt, Homo sapiens
uaagugaauuucacuacugagu

SEQ ID NO: 318721 - RNA, 20 nt, Homo sapiens
uaagugcuugaugaaugaac

SEQ ID NO: 318722 - RNA, 20 nt, Homo sapiens
uaagugcuuuauauugauua

SEQ ID NO: 318723 - RNA, 22 nt, Homo sapiens
uaaugcacauuuauuuuaccuu

SEQ ID NO: 318724 - RNA, 22 nt, Homo sapiens
uaaugcuguggucugguuuaaa

SEQ ID NO: 318725 - RNA, 22 nt, Homo sapiens
uaauucugacaacaguggcguu

SEQ ID NO: 318726 - RNA, 22 nt, Homo sapiens
uaauucuguauguaucagaguu

SEQ ID NO: 318727 - RNA, 22 nt, Homo sapiens
uacaacacugguucgacaugug

SEQ ID NO: 318728 - RNA, 22 nt, Homo sapiens
uacaagcacaggcagcaggcug

SEQ ID NO: 318729 - RNA, 22 nt, Homo sapiens
uacaggacuauagaacuuuccc

SEQ ID NO: 318730 - RNA, 22 nt, Homo sapiens
uacagucacauuccugaccaua

SEQ ID NO: 318731 - RNA, 22 nt, Homo sapiens
uacugcuaccuccagcuucugg

SEQ ID NO: 318732 - RNA, 21 nt, Homo sapiens
uacuggagauacagucugcaa

SEQ ID NO: 318733 - RNA, 19 nt, Homo sapiens
uacuggcucgggaauuuuc

SEQ ID NO: 318734 - RNA, 22 nt, Homo sapiens
uagcaccugugcacaccaggca

SEQ ID NO: 318735 - RNA, 22 nt, Homo sapiens
uagcagcaucucuggcuucuac

SEQ ID NO: 318736 - RNA, 22 nt, Homo sapiens
uagcagcauuuuuguagaguau

SEQ ID NO: 318737 - RNA, 22 nt, Homo sapiens
uagcagucaagauagucauuau

SEQ ID NO: 318738 - RNA, 22 nt, Homo sapiens
uagcaugucagucgccacacgu

SEQ ID NO: 318739 - RNA, 22 nt, Homo sapiens
uagcccagugagguugauuugg

SEQ ID NO: 318740 - RNA, 22 nt, Homo sapiens
uaggcagccagcuguggauuga

SEQ ID NO: 318741 - RNA, 22 nt, Homo sapiens
uaguuuaucuucuggauggaca

SEQ ID NO: 318742 - RNA, 22 nt, Homo sapiens
uauagcuuaaaguuuagauccu

SEQ ID NO: 318743 - RNA, 22 nt, Homo sapiens
uaucaccuugguagucuugggg

SEQ ID NO: 318744 - RNA, 22 nt, Homo sapiens
uaucagugaaucuuauuuugcc

SEQ ID NO: 318745 - RNA, 22 nt, Homo sapiens
uaucaugucuguguguaccuag

SEQ ID NO: 318746 - RNA, 22 nt, Homo sapiens
uaugaauuuuauccaggauaua

SEQ ID NO: 318747 - RNA, 22 nt, Homo sapiens
uauggcuucuuauucuuucccg

SEQ ID NO: 318748 - RNA, 22 nt, Homo sapiens
uauggcuuuguuaacauuuucu

SEQ ID NO: 318749 - RNA, 22 nt, Homo sapiens
uauggguuucagagggugauag

SEQ ID NO: 318750 - RNA, 20 nt, Homo sapiens
uaugguuuuagguauagcau

SEQ ID NO: 318751 - RNA, 22 nt, Homo sapiens
ucacaauguaaaugaggguugg

SEQ ID NO: 318752 - RNA, 22 nt, Homo sapiens
ucacagacugagccaaauagag

SEQ ID NO: 318753 - RNA, 22 nt, Homo sapiens
ucacagaggagaagaccuuuaa

SEQ ID NO: 318754 - RNA, 21 nt, Homo sapiens
ucacagccuaggaccugaaga

SEQ ID NO: 318755 - RNA, 22 nt, Homo sapiens
ucacagccuaguuuuauacauu

SEQ ID NO: 318756 - RNA, 22 nt, Homo sapiens
ucacaguagcaaauguuagaaa

SEQ ID NO: 318757 - RNA, 22 nt, Homo sapiens
ucacaguauucaugaacaugga

SEQ ID NO: 318758 - RNA, 22 nt, Homo sapiens
ucacagucugcgugaugagaca

SEQ ID NO: 318759 - RNA, 18 nt, Homo sapiens
ucacauggccgagagaga

SEQ ID NO: 318760 - RNA, 22 nt, Homo sapiens
ucacauuaagcuguuauuucuu

SEQ ID NO: 318761 - RNA, 16 nt, Homo sapiens
ucaccccuagagaucc

SEQ ID NO: 318762 - RNA, 22 nt, Homo sapiens
ucacccuguguuuugcguuugc

SEQ ID NO: 318763 - RNA, 21 nt, Homo sapiens
ucaccuguugcgaugaagcug

SEQ ID NO: 318764 - RNA, 22 nt, Homo sapiens
ucagcaccauguaacaauugau

SEQ ID NO: 318765 - RNA, 22 nt, Homo sapiens
ucaggcaccuuccucuuaucug

SEQ ID NO: 318766 - RNA, 22 nt, Homo sapiens
ugagaugagucucgcucuguca

SEQ ID NO: 318767 - RNA, 22 nt, Homo sapiens
ugagaugaguugcgcucugucg

SEQ ID NO: 318768 - RNA, 22 nt, Homo sapiens
ugagaugcuccucuugcaaagc

SEQ ID NO: 318769 - RNA, 22 nt, Homo sapiens
ugagcacauuuacaucaguucc

SEQ ID NO: 318770 - RNA, 22 nt, Homo sapiens
ugagcagaguuguuucuccuga

SEQ ID NO: 318771 - RNA, 22 nt, Homo sapiens
ugagucagucucacucugcugc

SEQ ID NO: 318772 - RNA, 22 nt, Homo sapiens
ugauaacauuucuucugguaca

SEQ ID NO: 318773 - RNA, 22 nt, Homo sapiens
ugauaagugaaagugcucuauc

SEQ ID NO: 318774 - RNA, 22 nt, Homo sapiens
ugauaggucacucaacagugag

SEQ ID NO: 318775 - RNA, 20 nt, Homo sapiens
ugaugcaaaucuuuaaaagu

SEQ ID NO: 318776 - RNA, 22 nt, Homo sapiens
ugauuuguuucaggaguuuucu

SEQ ID NO: 318777 - RNA, 22 nt, Homo sapiens
ugcaaaucuuguguaguuguga

SEQ ID NO: 318778 - RNA, 22 nt, Homo sapiens
ugcaagacugcaguuacuuuug

SEQ ID NO: 318779 - RNA, 17 nt, Homo sapiens
ugcaauuuaagcuagau

SEQ ID NO: 318780 - RNA, 22 nt, Homo sapiens
ugcaccaucuugcuucuguggu

SEQ ID NO: 318781 - RNA, 22 nt, Homo sapiens
ugcaccauugucaccuggguga

SEQ ID NO: 318782 - RNA, 22 nt, Homo sapiens
ugcagugugauuuucuggcuga

SEQ ID NO: 318783 - RNA, 22 nt, Homo sapiens
ugcagugugcuggggucuccau

SEQ ID NO: 318784 - RNA, 22 nt, Homo sapiens
ugcauacacaagcauacaugua

SEQ ID NO: 318785 - RNA, 22 nt, Homo sapiens
ugcauaucuuguggaauaucuc

SEQ ID NO: 318786 - RNA, 22 nt, Homo sapiens
ugcauaugucuuuauagcagca

SEQ ID NO: 318787 - RNA, 22 nt, Homo sapiens
ugcauauguugaaccagccuug

SEQ ID NO: 318788 - RNA, 21 nt, Homo sapiens
ugcuccauuuucuagccugaa

SEQ ID NO: 318789 - RNA, 19 nt, Homo sapiens
ugcugcauugugaccuugc

SEQ ID NO: 318790 - RNA, 22 nt, Homo sapiens
uggaaauuaacagggauugucc

SEQ ID NO: 318791 - RNA, 22 nt, Homo sapiens
uggaagauggaguuuuaucauu

SEQ ID NO: 318792 - RNA, 22 nt, Homo sapiens
uggaaggcuucauauguaaaga

SEQ ID NO: 318793 - RNA, 22 nt, Homo sapiens
uggagucuugcucuguugccca

SEQ ID NO: 318794 - RNA, 22 nt, Homo sapiens
uggauagaaauguacuguuuuc

SEQ ID NO: 318795 - RNA, 22 nt, Homo sapiens
uggauaguucuucuacuagagu

SEQ ID NO: 318796 - RNA, 22 nt, Homo sapiens
uggcaagaucacaauuacuuuu

SEQ ID NO: 318797 - RNA, 22 nt, Homo sapiens
uggcauggaaagcuuuucauac

SEQ ID NO: 318798 - RNA, 22 nt, Homo sapiens
uggcuaaguuaaucaaggagau

SEQ ID NO: 318799 - RNA, 22 nt, Homo sapiens
ugggaagagggagcgauuuugg

SEQ ID NO: 318800 - RNA, 22 nt, Homo sapiens
ugggaaugaaauuacauagcuu

SEQ ID NO: 318801 - RNA, 22 nt, Homo sapiens
ugggugugaccgcucaaggggg

SEQ ID NO: 318802 - RNA, 22 nt, Homo sapiens
uggugccgugguccuggggcca

SEQ ID NO: 318803 - RNA, 22 nt, Homo sapiens
ugguguuugagaagcugauguc

SEQ ID NO: 318804 - RNA, 22 nt, Homo sapiens
uguaaacuaugagcugauuauu

SEQ ID NO: 318805 - RNA, 22 nt, Homo sapiens
ugucaaacauuaugaugcucua

SEQ ID NO: 318806 - RNA, 22 nt, Homo sapiens
ugucaaggaaugucauugguuu

SEQ ID NO: 318807 - RNA, 22 nt, Homo sapiens
ugucacugugcagucaugcauu

SEQ ID NO: 318808 - RNA, 22 nt, Homo sapiens
ugucaguuucaguguuagccuu

SEQ ID NO: 318809 - RNA, 22 nt, Homo sapiens
uguccugaagcuuuguuaugua

SEQ ID NO: 318810 - RNA, 22 nt, Homo sapiens
ugucucaguucccuucucugga

SEQ ID NO: 318811 - RNA, 19 nt, Homo sapiens
ugugacugggccagccuag

SEQ ID NO: 318812 - RNA, 16 nt, Homo sapiens
ugugaucuuuuuucuu

SEQ ID NO: 318813 - RNA, 22 nt, Homo sapiens
ugugccacuccaggaggcuguu

SEQ ID NO: 318814 - RNA, 22 nt, Homo sapiens
uguggcaaagucuugugaauau

SEQ ID NO: 318815 - RNA, 22 nt, Homo sapiens
uguggcaaauggucaggaagaa

SEQ ID NO: 318816 - RNA, 22 nt, Homo sapiens
uguggcauuuucagaaaggaug

SEQ ID NO: 318817 - RNA, 22 nt, Homo sapiens
ugugggaggugcuaauguaaau

SEQ ID NO: 318818 - RNA, 22 nt, Homo sapiens
uguguaaagcuuguuccagaaa

SEQ ID NO: 318819 - RNA, 22 nt, Homo sapiens
uguguaaauaugauagaggaau

SEQ ID NO: 318820 - RNA, 22 nt, Homo sapiens
uguuacagcagaauugauugca

SEQ ID NO: 318821 - RNA, 22 nt, Homo sapiens
uguucuggagaggcaggccaca

SEQ ID NO: 318822 - RNA, 22 nt, Homo sapiens
uguuugcuguuuucuccaauga

SEQ ID NO: 318823 - RNA, 22 nt, Homo sapiens
uuaaaguguuugcagacaggug

SEQ ID NO: 318824 - RNA, 22 nt, Homo sapiens
uuaaggcagugucuaugccagu

SEQ ID NO: 318825 - RNA, 19 nt, Homo sapiens
uuaaguaguuagagggucu

SEQ ID NO: 318826 - RNA, 22 nt, Homo sapiens
uuaagugguagguggugcccaa

SEQ ID NO: 318827 - RNA, 22 nt, Homo sapiens
uuacagucaaguuacauuucuc

SEQ ID NO: 318828 - RNA, 22 nt, Homo sapiens
uuacagucuuaggcagugcuuu

SEQ ID NO: 318829 - RNA, 19 nt, Homo sapiens
uuacauccauugcauuuca

SEQ ID NO: 318830 - RNA, 22 nt, Homo sapiens
uuaccuugcacugagucugaaa

SEQ ID NO: 318831 - RNA, 22 nt, Homo sapiens
uuacuguagugucauaucguau

SEQ ID NO: 318832 - RNA, 22 nt, Homo sapiens
uuagcacaguucauucauguua

SEQ ID NO: 318833 - RNA, 23 nt, Homo sapiens
uuaguaaacucaaugacaccaca

SEQ ID NO: 318834 - RNA, 21 nt, Homo sapiens
uuagugcucaguuugacaaaa

SEQ ID NO: 318835 - RNA, 22 nt, Homo sapiens
uuaucucaguguuuguaaacaa

SEQ ID NO: 318836 - RNA, 22 nt, Homo sapiens
uucaagucaacaagcacuugag

SEQ ID NO: 318837 - RNA, 22 nt, Homo sapiens
uucacaguacucccuggaauua

SEQ ID NO: 318838 - RNA, 22 nt, Homo sapiens
uucacuguuaagcaguuaaacu

SEQ ID NO: 318839 - RNA, 22 nt, Homo sapiens
uucaguaaauguucuuacuaua

SEQ ID NO: 318840 - RNA, 22 nt, Homo sapiens
uuccacaauggcugaacuaguu

SEQ ID NO: 318841 - RNA, 22 nt, Homo sapiens
uuccaguaauagcacagcauug

SEQ ID NO: 318842 - RNA, 22 nt, Homo sapiens
uuccuggaggggaaguguccaa

SEQ ID NO: 318843 - RNA, 22 nt, Homo sapiens
uucuaguacucccuggagcugg

SEQ ID NO: 318844 - RNA, 22 nt, Homo sapiens
uucuaugguuuaauaguuuggg

SEQ ID NO: 318845 - RNA, 22 nt, Homo sapiens
uucugacuggugugagauggua

SEQ ID NO: 318846 - RNA, 22 nt, Homo sapiens
uucugccaaucaacccacaucc

SEQ ID NO: 318847 - RNA, 22 nt, Homo sapiens
uucugcuugaucuaguguguug

SEQ ID NO: 318848 - RNA, 22 nt, Homo sapiens
uucuucaggccacaaaaauggu

SEQ ID NO: 318849 - RNA, 22 nt, Homo sapiens
uucuugguguaguaguugaaaa

SEQ ID NO: 318850 - RNA, 22 nt, Homo sapiens
uugagacggaguuuugcucuug

SEQ ID NO: 318851 - RNA, 22 nt, Homo sapiens
uugagauggagucucacucugc

SEQ ID NO: 318852 - RNA, 22 nt, Homo sapiens
uugagauggagucuugcgcugu

SEQ ID NO: 318853 - RNA, 22 nt, Homo sapiens
uugagauggaguuucacucuug

SEQ ID NO: 318854 - RNA, 22 nt, Homo sapiens
uugagauggaguuucgcucuug

SEQ ID NO: 318855 - RNA, 22 nt, Homo sapiens
uugagauggaguuuugcucuug

SEQ ID NO: 318856 - RNA, 22 nt, Homo sapiens
uugagauggugccacuguacuc

SEQ ID NO: 318857 - RNA, 22 nt, Homo sapiens
uugagauguauguauauaaugu

SEQ ID NO: 318858 - RNA, 22 nt, Homo sapiens
uugagcacugucugugugcagu

SEQ ID NO: 318859 - RNA, 23 nt, Homo sapiens
uugaggcauguaccaucaauauc

SEQ ID NO: 318860 - RNA, 22 nt, Homo sapiens
uugaggugaagggcagagcagc

SEQ ID NO: 318861 - RNA, 22 nt, Homo sapiens
uugaguuugaguauucuaaagc

SEQ ID NO: 318862 - RNA, 22 nt, Homo sapiens
uugaucaauagaauacaacaga

SEQ ID NO: 318863 - RNA, 22 nt, Homo sapiens
uugaucuguguuagaagcuaag

SEQ ID NO: 318864 - RNA, 22 nt, Homo sapiens
uugcacaauggaauuuaucuuu

SEQ ID NO: 318865 - RNA, 22 nt, Homo sapiens
uugcaugguuuuuaucugaaau

SEQ ID NO: 318866 - RNA, 22 nt, Homo sapiens
uugcauguacguacagagagag

SEQ ID NO: 318867 - RNA, 22 nt, Homo sapiens
uugcuucuuucgucuggcccca

SEQ ID NO: 318868 - RNA, 22 nt, Homo sapiens
uuggaagacaaugcugauucuc

SEQ ID NO: 318869 - RNA, 22 nt, Homo sapiens
uuggaauuuuaaaauaggcaac

SEQ ID NO: 318870 - RNA, 22 nt, Homo sapiens
uuggacuggaacuauaccauug

SEQ ID NO: 318871 - RNA, 22 nt, Homo sapiens
uuggccuuucucuaaauacuuu

SEQ ID NO: 318872 - RNA, 22 nt, Homo sapiens
uuguaaagaucauaugcuguuc

SEQ ID NO: 318873 - RNA, 22 nt, Homo sapiens
uuguacuauuuuuaucagugau

SEQ ID NO: 318874 - RNA, 22 nt, Homo sapiens
agauguuguucaucugauuguu

SEQ ID NO: 318875 - RNA, 22 nt, Homo sapiens
agcaccauuagcguugggccgg

SEQ ID NO: 318876 - RNA, 22 nt, Homo sapiens
agcagcaauuuuguaugguuua

SEQ ID NO: 318877 - RNA, 22 nt, Homo sapiens
agcagcacaucccuuucuggcc

SEQ ID NO: 318878 - RNA, 22 nt, Homo sapiens
agcagcauggguauaaaucucc

SEQ ID NO: 318879 - RNA, 22 nt, Homo sapiens
agcagcauuaguggaaucuugu

SEQ ID NO: 318880 - RNA, 22 nt, Homo sapiens
agcaucacaugggcugcuuggg

SEQ ID NO: 318881 - RNA, 22 nt, Homo sapiens
agcaucaugcaguugcuauuca

SEQ ID NO: 318882 - RNA, 22 nt, Homo sapiens
agcucacagccuagcacuguga

SEQ ID NO: 318883 - RNA, 22 nt, Homo sapiens
agcucauugcaaccuccgccuc

SEQ ID NO: 318884 - RNA, 21 nt, Homo sapiens
agcuccacucguucccaaagc

SEQ ID NO: 318885 - RNA, 20 nt, Homo sapiens
agcuccauuccugaaggcug

SEQ ID NO: 318886 - RNA, 22 nt, Homo sapiens
agaaccauuagagggagauauu

SEQ ID NO: 318887 - RNA, 22 nt, Homo sapiens
agaccacuuuagagauuguuca

SEQ ID NO: 318888 - RNA, 22 nt, Homo sapiens
agauggguuuucacauguuggc

SEQ ID NO: 318889 - RNA, 22 nt, Homo sapiens
agcaccacaauuuccugccuaa

SEQ ID NO: 318890 - RNA, 22 nt, Homo sapiens
agcaccaccguugcucuauccc

SEQ ID NO: 318891 - RNA, 22 nt, Homo sapiens
agcagcuuugaucugaaugauu

SEQ ID NO: 318892 - RNA, 22 nt, Homo sapiens
agcauuacaugguacagagaag

SEQ ID NO: 318893 - RNA, 23 nt, Homo sapiens
agccuguugccuaggcagcucau

SEQ ID NO: 318894 - RNA, 22 nt, Homo sapiens
agcuccauuguaaucaccuggu

SEQ ID NO: 318895 - RNA, 22 nt, Homo sapiens
agcugguaguuuucuaguguuu

SEQ ID NO: 318896 - RNA, 22 nt, Homo sapiens
agcugguccugugacuugcuuc

SEQ ID NO: 318897 - RNA, 22 nt, Homo sapiens
agcuggucuacguguguaugag

SEQ ID NO: 318898 - RNA, 22 nt, Homo sapiens
agcuggucugauacuuaccucc

SEQ ID NO: 318899 - RNA, 22 nt, Homo sapiens
agcuuaugcuuggaagagauga

SEQ ID NO: 318900 - RNA, 22 nt, Homo sapiens
aggagaugaagcuuuaucuaaa

SEQ ID NO: 318901 - RNA, 21 nt, Homo sapiens
aggagcauucaugacgagguu

SEQ ID NO: 318902 - RNA, 22 nt, Homo sapiens
aggcuuuuggagaacacugcac

SEQ ID NO: 318903 - RNA, 22 nt, Homo sapiens
aguauuaggugaguguauuuca

SEQ ID NO: 318904 - RNA, 22 nt, Homo sapiens
agucacagccuuuuacuuuaga

SEQ ID NO: 318905 - RNA, 20 nt, Homo sapiens
agucaguuuauuuucucucu

SEQ ID NO: 318906 - RNA, 22 nt, Homo sapiens
agugcauugagacuugugaguu

SEQ ID NO: 318907 - RNA, 19 nt, Homo sapiens
aguggguguuuucuguuug

SEQ ID NO: 318908 - RNA, 22 nt, Homo sapiens
agugguguugccuguugaccua

SEQ ID NO: 318909 - RNA, 22 nt, Homo sapiens
auaaaguucugcuggcauauau

SEQ ID NO: 318910 - RNA, 22 nt, Homo sapiens
auaaaugcuuagaucuguauau

SEQ ID NO: 318911 - RNA, 22 nt, Homo sapiens
auaauguuugauugagcagaua

SEQ ID NO: 318912 - RNA, 22 nt, Homo sapiens
auacaaggaaugaagagauuug

SEQ ID NO: 318913 - RNA, 22 nt, Homo sapiens
auacaguguauguauaguacau

SEQ ID NO: 318914 - RNA, 22 nt, Homo sapiens
auacuguuucugaacuuugauu

SEQ ID NO: 318915 - RNA, 22 nt, Homo sapiens
auagaggacugaggugaucuuu

SEQ ID NO: 318916 - RNA, 22 nt, Homo sapiens
auagcagugugaaaauugacug

SEQ ID NO: 318917 - RNA, 22 nt, Homo sapiens
auauccuggagcauuuuugcaa

SEQ ID NO: 318918 - RNA, 17 nt, Homo sapiens
auaugaauuuuggagau

SEQ ID NO: 318919 - RNA, 22 nt, Homo sapiens
aucaaaguaggcauauguuuuu

SEQ ID NO: 318920 - RNA, 22 nt, Homo sapiens
aucaaguacuguacugaaagug

SEQ ID NO: 318921 - RNA, 22 nt, Homo sapiens
aucaaguaguuauacguaaagg

SEQ ID NO: 318922 - RNA, 22 nt, Homo sapiens
aucacagcuacuccucugucuu

SEQ ID NO: 318923 - RNA, 19 nt, Homo sapiens
aucaccagucuuuccacug

SEQ ID NO: 318924 - RNA, 22 nt, Homo sapiens
aucaccuggaguagcccguccc

SEQ ID NO: 318925 - RNA, 22 nt, Homo sapiens
aucagagccugugugcccugaa

SEQ ID NO: 318926 - RNA, 22 nt, Homo sapiens
auccaucagacggcaggcguug

SEQ ID NO: 318927 - RNA, 22 nt, Homo sapiens
aucucauggagguagagaguaa

SEQ ID NO: 318928 - RNA, 22 nt, Homo sapiens
augaauuuucugauguugggua

SEQ ID NO: 318929 - RNA, 22 nt, Homo sapiens
augacugagacuaacuuacuuu

SEQ ID NO: 318930 - RNA, 22 nt, Homo sapiens
augagauaggaacaaacuuaca

SEQ ID NO: 318931 - RNA, 22 nt, Homo sapiens
augaggcacugcgcccuacuga

SEQ ID NO: 318932 - RNA, 22 nt, Homo sapiens
augcacauauguacugcccuau

SEQ ID NO: 318933 - RNA, 22 nt, Homo sapiens
augcauauuccugggccucacu

SEQ ID NO: 318934 - RNA, 22 nt, Homo sapiens
augcauggagucuuucacaagu

SEQ ID NO: 318935 - RNA, 22 nt, Homo sapiens
augcauggcagagucaggguac

SEQ ID NO: 318936 - RNA, 22 nt, Homo sapiens
augcauggucugaagucaaccu

SEQ ID NO: 318937 - RNA, 22 nt, Homo sapiens
augccacugcacuucagccugg

SEQ ID NO: 318938 - RNA, 22 nt, Homo sapiens
augccacugcauaagguuuuca

SEQ ID NO: 318939 - RNA, 22 nt, Homo sapiens
augccacugcgcucuagccugg

SEQ ID NO: 318940 - RNA, 22 nt, Homo sapiens
augccacuguccuccugccuag

SEQ ID NO: 318941 - RNA, 22 nt, Homo sapiens
augccacuguuuaugucacuua

SEQ ID NO: 318942 - RNA, 22 nt, Homo sapiens
augccacuucucuaagucaugu

SEQ ID NO: 318943 - RNA, 22 nt, Homo sapiens
augcuacugaccccuacuuaca

SEQ ID NO: 318944 - RNA, 19 nt, Homo sapiens
augcugguguugcucaaac

SEQ ID NO: 318945 - RNA, 22 nt, Homo sapiens
augcuguuuugaauucucuaga

SEQ ID NO: 318946 - RNA, 22 nt, Homo sapiens
auggaagaaacgauuuucugga

SEQ ID NO: 318947 - RNA, 22 nt, Homo sapiens
auggaagacuccucuuugggua

SEQ ID NO: 318948 - RNA, 21 nt, Homo sapiens
auggacugugugacccugcac

SEQ ID NO: 318949 - RNA, 22 nt, Homo sapiens
auggauuuuaggauacaguuga

SEQ ID NO: 318950 - RNA, 22 nt, Homo sapiens
auggcaguuucagcuauaguuu

SEQ ID NO: 318951 - RNA, 22 nt, Homo sapiens
auggcuauucuucuuuugucag

SEQ ID NO: 318952 - RNA, 22 nt, Homo sapiens
auggucccuguuccaugcuccu

SEQ ID NO: 318953 - RNA, 22 nt, Homo sapiens
augugcacaugcuuacauguga

SEQ ID NO: 318954 - RNA, 22 nt, Homo sapiens
augugugcuugugacacagccu

SEQ ID NO: 318955 - RNA, 22 nt, Homo sapiens
auuaaguugugccugaaaacuu

SEQ ID NO: 318956 - RNA, 22 nt, Homo sapiens
auuacacuuucuauucaaugag

SEQ ID NO: 318957 - RNA, 22 nt, Homo sapiens
auuagguuggugcaaaacuuuc

SEQ ID NO: 318958 - RNA, 22 nt, Homo sapiens
auucaaagugcauguucccacu

SEQ ID NO: 318959 - RNA, 23 nt, Homo sapiens
auucaaguagugagagugguuau

SEQ ID NO: 318960 - RNA, 22 nt, Homo sapiens
auugcacucuaaccuaggugac

SEQ ID NO: 318961 - RNA, 22 nt, Homo sapiens
auugcagcccacccugggugau

SEQ ID NO: 318962 - RNA, 22 nt, Homo sapiens
auugcccaggcuggagugcagu

SEQ ID NO: 318963 - RNA, 20 nt, Homo sapiens
auuuggcauaguuuaagcaa

SEQ ID NO: 318964 - RNA, 22 nt, Homo sapiens
caaaagugguucuuauccuuuu

SEQ ID NO: 318965 - RNA, 22 nt, Homo sapiens
caaagucuucucauuaugucuu

SEQ ID NO: 318966 - RNA, 22 nt, Homo sapiens
caacauccaccuccuggguuca

SEQ ID NO: 318967 - RNA, 22 nt, Homo sapiens
caaugugcuuggggcacaugag

SEQ ID NO: 318968 - RNA, 22 nt, Homo sapiens
cagagaaugucuuuuuuaacca

SEQ ID NO: 318969 - RNA, 22 nt, Homo sapiens
cagcuaaauuguuaaauccaag

SEQ ID NO: 318970 - RNA, 22 nt, Homo sapiens
cagggaauguuauuuaauagca

SEQ ID NO: 318971 - RNA, 22 nt, Homo sapiens
caggugcauuggcugacaccug

SEQ ID NO: 318972 - RNA, 22 nt, Homo sapiens
cagucacagugacaggaugugg

SEQ ID NO: 318973 - RNA, 20 nt, Homo sapiens
cagugcaccuggcguguuga

SEQ ID NO: 318974 - RNA, 22 nt, Homo sapiens
caguggauuggauggauaaugc

SEQ ID NO: 318975 - RNA, 22 nt, Homo sapiens
cauacaugugcuugucuuaugc

SEQ ID NO: 318976 - RNA, 22 nt, Homo sapiens
caucacacuuggauguaagaca

SEQ ID NO: 318977 - RNA, 21 nt, Homo sapiens
cauccccugccauuguggucu

SEQ ID NO: 318978 - RNA, 22 nt, Homo sapiens
cauggguuuucucaaguaguca

SEQ ID NO: 318979 - RNA, 22 nt, Homo sapiens
ccacaguagucuugggaugggc

SEQ ID NO: 318980 - RNA, 22 nt, Homo sapiens
ccacccuggagaauuugagguc

SEQ ID NO: 318981 - RNA, 23 nt, Homo sapiens
uuucacagaaggauuguagggcc

SEQ ID NO: 318982 - RNA, 22 nt, Homo sapiens
uuucaggcaagggugacccuga

SEQ ID NO: 318983 - RNA, 22 nt, Homo sapiens
uuucccauuguucugcucugug

SEQ ID NO: 318984 - RNA, 22 nt, Homo sapiens
uuucccuuuagcuuagugauuu

SEQ ID NO: 318985 - RNA, 22 nt, Homo sapiens
uuuccuggagaaucuuaacaaa

SEQ ID NO: 318986 - RNA, 22 nt, Homo sapiens
uuugaagacuacugggagugaa

SEQ ID NO: 318987 - RNA, 19 nt, Homo sapiens
uuugccuaggcacauggcc

SEQ ID NO: 318988 - RNA, 22 nt, Homo sapiens
uuugccuuugugauauggucua

SEQ ID NO: 318989 - RNA, 22 nt, Homo sapiens
uuugcuuaguaaauguagaaaa

SEQ ID NO: 318990 - RNA, 22 nt, Homo sapiens
uuuggcauuuuacuacucaaau

SEQ ID NO: 318991 - RNA, 22 nt, Homo sapiens
uuugguccuccuacagggcagg

SEQ ID NO: 318992 - RNA, 22 nt, Homo sapiens
uuuguacuucauacaauaacuc

SEQ ID NO: 318993 - RNA, 22 nt, Homo sapiens
uuuguuugaagucgagacaacu

SEQ ID NO: 318994 - RNA, 22 nt, Homo sapiens
uuuuaguggacaaagguauuua

SEQ ID NO: 318995 - RNA, 22 nt, Homo sapiens
uuuugcaggcauuggaaguuua

SEQ ID NO: 318996 - RNA, 22 nt, Homo sapiens
uuuuggcucugucuguaucuuu

SEQ ID NO: 318997 - RNA, 19 nt, Homo sapiens
uuuuguacucugugacuug

SEQ ID NO: 318998 - RNA, 22 nt, Homo sapiens
uuuuugagaauuggugaaacac

SEQ ID NO: 318999 - RNA, 22 nt, Homo sapiens
uuuuugaguagcuggagagcag

SEQ ID NO: 319000 - RNA, 22 nt, Homo sapiens
aaguaaacauugagagacaaga

SEQ ID NO: 319001 - RNA, 22 nt, Homo sapiens
aagucaaggagagaagcuucag

SEQ ID NO: 319002 - RNA, 22 nt, Homo sapiens
aagugcuguaugggagccuagg

SEQ ID NO: 319003 - RNA, 22 nt, Homo sapiens
aaguggccuagagcgaccauuu

SEQ ID NO: 319004 - RNA, 17 nt, Homo sapiens
aaugagacauuucugcu

SEQ ID NO: 319005 - RNA, 22 nt, Homo sapiens
acacugucaugucucacaggca

SEQ ID NO: 319006 - RNA, 22 nt, Homo sapiens
acacugucugaugaaaguaguu

SEQ ID NO: 319007 - RNA, 21 nt, Homo sapiens
acaguacuugagaucuuuuga

SEQ ID NO: 319008 - RNA, 22 nt, Homo sapiens
acaguacuuuuggauuugugaa

SEQ ID NO: 319009 - RNA, 22 nt, Homo sapiens
acagucacaauuuguaccuuuu

SEQ ID NO: 319010 - RNA, 22 nt, Homo sapiens
acaguguguguguucaccuaga

SEQ ID NO: 319011 - RNA, 18 nt, Homo sapiens
acaucccaugcuggggug

SEQ ID NO: 319012 - RNA, 22 nt, Homo sapiens
acauggcacugcgggcuucuug

SEQ ID NO: 319013 - RNA, 22 nt, Homo sapiens
accccugugacggguauuugag

SEQ ID NO: 319014 - RNA, 22 nt, Homo sapiens
acccuggaggucuacagugcag

SEQ ID NO: 319015 - RNA, 22 nt, Homo sapiens
acucagagugggccccuagaua

SEQ ID NO: 319016 - RNA, 22 nt, Homo sapiens
acuggguuaauuugaagguuga

SEQ ID NO: 319017 - RNA, 19 nt, Homo sapiens
acuguacuccagucugggc

SEQ ID NO: 319018 - RNA, 19 nt, Homo sapiens
acuuuggugauuagaggga

SEQ ID NO: 319019 - RNA, 17 nt, Homo sapiens
acuuuuugaggaggcau

SEQ ID NO: 319020 - RNA, 22 nt, Homo sapiens
agaaauguuuauucaaacccgu

SEQ ID NO: 319021 - RNA, 22 nt, Homo sapiens
agacacugaaauguauugaaga

SEQ ID NO: 319022 - RNA, 22 nt, Homo sapiens
agacagcuggaguaucauagcu

SEQ ID NO: 319023 - RNA, 22 nt, Homo sapiens
agagcaaugacaugcuaugugg

SEQ ID NO: 319024 - RNA, 22 nt, Homo sapiens
agagcaaugggugaauauuaaa

SEQ ID NO: 319025 - RNA, 22 nt, Homo sapiens
agcaacauugagacugcaguug

SEQ ID NO: 319026 - RNA, 22 nt, Homo sapiens
agcagcaugaggggacuucugc

SEQ ID NO: 319027 - RNA, 22 nt, Homo sapiens
agcagcauuccaaaaaucugcu

SEQ ID NO: 319028 - RNA, 22 nt, Homo sapiens
agcuggaauuuaagguagauag

SEQ ID NO: 319029 - RNA, 22 nt, Homo sapiens
aggaauuuaauguaugauaaua

SEQ ID NO: 319030 - RNA, 22 nt, Homo sapiens
aggcaagcaucuugcucccuuc

SEQ ID NO: 319031 - RNA, 22 nt, Homo sapiens
aggcuuuuggagguggcuuucu

SEQ ID NO: 319032 - RNA, 22 nt, Homo sapiens
agugccuacuauguagaugcug

SEQ ID NO: 319033 - RNA, 22 nt, Homo sapiens
auaaaagcaggucuaggucagg

SEQ ID NO: 319034 - RNA, 22 nt, Homo sapiens
auaaaugcaaugguauuuuuga

SEQ ID NO: 319035 - RNA, 22 nt, Homo sapiens
auaaggcagcugcuaaaaggca

SEQ ID NO: 319036 - RNA, 22 nt, Homo sapiens
auacaugugcaggucagguuac

SEQ ID NO: 319037 - RNA, 22 nt, Homo sapiens
auacaugugccaugcuggugug

SEQ ID NO: 319038 - RNA, 22 nt, Homo sapiens
auacauguucaagggcauauau

SEQ ID NO: 319039 - RNA, 22 nt, Homo sapiens
auacuguauaggauuguagccu

SEQ ID NO: 319040 - RNA, 22 nt, Homo sapiens
auagcaauuugggaaucagacu

SEQ ID NO: 319041 - RNA, 20 nt, Homo sapiens
auagcagcaugauuuauagu

SEQ ID NO: 319042 - RNA, 22 nt, Homo sapiens
auagugaacuuugugagaacaa

SEQ ID NO: 319043 - RNA, 15 nt, Homo sapiens
auauaugcaaugugu

SEQ ID NO: 319044 - RNA, 22 nt, Homo sapiens
auaucacucccaauaucgcagg

SEQ ID NO: 319045 - RNA, 22 nt, Homo sapiens
auaucagugucuuacuguuuuu

SEQ ID NO: 319046 - RNA, 22 nt, Homo sapiens
aucaagcuggcauauguaguuc

SEQ ID NO: 319047 - RNA, 22 nt, Homo sapiens
aucaaguaaucugaguaagagu

SEQ ID NO: 319048 - RNA, 22 nt, Homo sapiens
aucagcagcaugaaaagcaacu

SEQ ID NO: 319049 - RNA, 22 nt, Homo sapiens
aucagcauucccaaaugaugug

SEQ ID NO: 319050 - RNA, 22 nt, Homo sapiens
aucagugcauguuuguugagcu

SEQ ID NO: 319051 - RNA, 22 nt, Homo sapiens
aucauccagccccagaagggag

SEQ ID NO: 319052 - RNA, 22 nt, Homo sapiens
auccucugagaucuaggcagag

SEQ ID NO: 319053 - RNA, 22 nt, Homo sapiens
auccugaagcuuuacugaauuc

SEQ ID NO: 319054 - RNA, 22 nt, Homo sapiens
aucuuguguugaauggugcaga

SEQ ID NO: 319055 - RNA, 22 nt, Homo sapiens
aucuuuggauacuugauauagu

SEQ ID NO: 319056 - RNA, 22 nt, Homo sapiens
aucuuuggcgggaauaucacag

SEQ ID NO: 319057 - RNA, 22 nt, Homo sapiens
aucuuuggucaucacagcuaga

SEQ ID NO: 319058 - RNA, 22 nt, Homo sapiens
augaagauguugccuuuuuaau

SEQ ID NO: 319059 - RNA, 22 nt, Homo sapiens
augaauucaucugguuuuggga

SEQ ID NO: 319060 - RNA, 22 nt, Homo sapiens
augacagugagugagcucucac

SEQ ID NO: 319061 - RNA, 22 nt, Homo sapiens
augacuaaaggguuuauguuga

SEQ ID NO: 319062 - RNA, 22 nt, Homo sapiens
augacuggauaauggacacaca

SEQ ID NO: 319063 - RNA, 22 nt, Homo sapiens
augagauucuuagagaagucug

SEQ ID NO: 319064 - RNA, 19 nt, Homo sapiens
augagcaauaguuuuaauc

SEQ ID NO: 319065 - RNA, 22 nt, Homo sapiens
augaggcaggaaaggcguaucu

SEQ ID NO: 319066 - RNA, 22 nt, Homo sapiens
augauuuuuguaucgccugaug

SEQ ID NO: 319067 - RNA, 22 nt, Homo sapiens
augcaaacaucugaagagacau

SEQ ID NO: 319068 - RNA, 20 nt, Homo sapiens
augcaaacccugcuuugugg

SEQ ID NO: 319069 - RNA, 22 nt, Homo sapiens
augcacaguccagcccaugugg

SEQ ID NO: 319070 - RNA, 22 nt, Homo sapiens
augcagacacaaguuauaguaa

SEQ ID NO: 319071 - RNA, 22 nt, Homo sapiens
augcagagucccagccccuagc

SEQ ID NO: 319072 - RNA, 22 nt, Homo sapiens
augcauaugucuuuauaguggc

SEQ ID NO: 319073 - RNA, 20 nt, Homo sapiens
augccacugagcagugguga

SEQ ID NO: 319074 - RNA, 22 nt, Homo sapiens
augccacugcacucuagccugg

SEQ ID NO: 319075 - RNA, 22 nt, Homo sapiens
augccacugcacuucagccugc

SEQ ID NO: 319076 - RNA, 19 nt, Homo sapiens
augccucaguuuuguacuu

SEQ ID NO: 319077 - RNA, 22 nt, Homo sapiens
augcuggugcuagaaacuggaa

SEQ ID NO: 319078 - RNA, 22 nt, Homo sapiens
augcuggugguucacaugcgca

SEQ ID NO: 319079 - RNA, 22 nt, Homo sapiens
auggcacagaguagaugcucaa

SEQ ID NO: 319080 - RNA, 22 nt, Homo sapiens
auggcacugccuggcuucaugg

SEQ ID NO: 319081 - RNA, 22 nt, Homo sapiens
auggcagcaccccacucuacug

SEQ ID NO: 319082 - RNA, 22 nt, Homo sapiens
augucuagagcaagagaugcug

SEQ ID NO: 319083 - RNA, 22 nt, Homo sapiens
auguggaaauguauaugugucu

SEQ ID NO: 319084 - RNA, 22 nt, Homo sapiens
auguggcacuugacuuucucgc

SEQ ID NO: 319085 - RNA, 22 nt, Homo sapiens
augugugcuugauguaaaaagu

SEQ ID NO: 319086 - RNA, 20 nt, Homo sapiens
auguucuggaggacagaagc

SEQ ID NO: 319087 - RNA, 22 nt, Homo sapiens
auuaaguaaugguuccaauaau

SEQ ID NO: 319088 - RNA, 22 nt, Homo sapiens
auuaagugaaugaaguuguucc

SEQ ID NO: 319089 - RNA, 22 nt, Homo sapiens
auuaagugcuugcagaagucca

SEQ ID NO: 319090 - RNA, 22 nt, Homo sapiens
auucacuguggcuuucucugau

SEQ ID NO: 319091 - RNA, 22 nt, Homo sapiens
auuccagauggaguugaggguu

SEQ ID NO: 319092 - RNA, 22 nt, Homo sapiens
caacacagugaaacccgucucu

SEQ ID NO: 319093 - RNA, 22 nt, Homo sapiens
caacaguaaagcauuuuuaagu

SEQ ID NO: 319094 - RNA, 22 nt, Homo sapiens
cacaaugucugguaggccacuu

SEQ ID NO: 319095 - RNA, 21 nt, Homo sapiens
ugaugcaauccgcuaggucgc

SEQ ID NO: 319096 - RNA, 22 nt, Homo sapiens
ugauuggagaacaaacugcaua

SEQ ID NO: 319097 - RNA, 22 nt, Homo sapiens
ugcauacugaaauauuuuagag

SEQ ID NO: 319098 - RNA, 22 nt, Homo sapiens
ugcauaucuucagccgggcacg

SEQ ID NO: 319099 - RNA, 22 nt, Homo sapiens
ugcauaugcagcauuuaugauu

SEQ ID NO: 319100 - RNA, 22 nt, Homo sapiens
ugcauauguugagaugcauauu

SEQ ID NO: 319101 - RNA, 22 nt, Homo sapiens
ugcauggaggagcuccccgcag

SEQ ID NO: 319102 - RNA, 20 nt, Homo sapiens
ugcauguccucacuuacuug

SEQ ID NO: 319103 - RNA, 22 nt, Homo sapiens
ugcauguucuuacucauacaug

SEQ ID NO: 319104 - RNA, 22 nt, Homo sapiens
ugcccuguaucccacuguuuca

SEQ ID NO: 319105 - RNA, 20 nt, Homo sapiens
ugccugacacucuuugcuuc

SEQ ID NO: 319106 - RNA, 22 nt, Homo sapiens
ugcuaugucagccaggcugguc

SEQ ID NO: 319107 - RNA, 22 nt, Homo sapiens
ugcuguguugcuggcuuaaaga

SEQ ID NO: 319108 - RNA, 22 nt, Homo sapiens
uggaaguuaaauuaguugauga

SEQ ID NO: 319109 - RNA, 22 nt, Homo sapiens
uggacagaaacauguuuucagu

SEQ ID NO: 319110 - RNA, 22 nt, Homo sapiens
uggaguaggccuaagaaugaca

SEQ ID NO: 319111 - RNA, 19 nt, Homo sapiens
uggagucaucaugcugcua

SEQ ID NO: 319112 - RNA, 22 nt, Homo sapiens
uggagucuugaugauuuucaaa

SEQ ID NO: 319113 - RNA, 19 nt, Homo sapiens
uggaugacugucugggucu

SEQ ID NO: 319114 - RNA, 22 nt, Homo sapiens
uggcagcugcuucaugggaugc

SEQ ID NO: 319115 - RNA, 22 nt, Homo sapiens
uggccagugucggaggccagga

SEQ ID NO: 319116 - RNA, 22 nt, Homo sapiens
uggcucuguuuguuaacuagac

SEQ ID NO: 319117 - RNA, 18 nt, Homo sapiens
ugggaagaaauucuucuc

SEQ ID NO: 319118 - RNA, 22 nt, Homo sapiens
ugggagacuacauuuuuaacaa

SEQ ID NO: 319119 - RNA, 22 nt, Homo sapiens
uggguagagaaucaggaucuua

SEQ ID NO: 319120 - RNA, 23 nt, Homo sapiens
ugggucaguuuuucugacaucau

SEQ ID NO: 319121 - RNA, 22 nt, Homo sapiens
ugguccuuuccauuggagacac

SEQ ID NO: 319122 - RNA, 22 nt, Homo sapiens
uguaauguuucaucauuauuaa

SEQ ID NO: 319123 - RNA, 22 nt, Homo sapiens
uguagucauuugaaggaugucc

SEQ ID NO: 319124 - RNA, 22 nt, Homo sapiens
uguauacauauguauguuuugu

SEQ ID NO: 319125 - RNA, 22 nt, Homo sapiens
ugucaguuucccuccucuuccu

SEQ ID NO: 319126 - RNA, 22 nt, Homo sapiens
ugucaugaaauauguuuuucua

SEQ ID NO: 319127 - RNA, 22 nt, Homo sapiens
ugucaugguguuaauuuuccug

SEQ ID NO: 319128 - RNA, 19 nt, Homo sapiens
uguccuagaggaguucaca

SEQ ID NO: 319129 - RNA, 22 nt, Homo sapiens
ugugcacaugauauaucacaua

SEQ ID NO: 319130 - RNA, 22 nt, Homo sapiens
uguggaaauggugcuacgaaca

SEQ ID NO: 319131 - RNA, 21 nt, Homo sapiens
uguggcaauggccucacagau

SEQ ID NO: 319132 - RNA, 22 nt, Homo sapiens
uguggcucuucuguucuccacu

SEQ ID NO: 319133 - RNA, 22 nt, Homo sapiens
uguggcugguggcaccuuuucc

SEQ ID NO: 319134 - RNA, 18 nt, Homo sapiens
uguggcuguuuuccaaua

SEQ ID NO: 319135 - RNA, 22 nt, Homo sapiens
uguuucuacugucucuguagua

SEQ ID NO: 319136 - RNA, 22 nt, Homo sapiens
uguuugcuuaacguggagccag

SEQ ID NO: 319137 - RNA, 22 nt, Homo sapiens
uuaaaagcuaucuccaagguca

SEQ ID NO: 319138 - RNA, 22 nt, Homo sapiens
uuaaaugucuguagaugugcug

SEQ ID NO: 319139 - RNA, 22 nt, Homo sapiens
uuaagccacucaagagauagag

SEQ ID NO: 319140 - RNA, 22 nt, Homo sapiens
uuaaggcauucuuugucuucau

SEQ ID NO: 319141 - RNA, 22 nt, Homo sapiens
uuaaucaggccguuuccuaaga

SEQ ID NO: 319142 - RNA, 22 nt, Homo sapiens
uuagaacuagaggaguuugagu

SEQ ID NO: 319143 - RNA, 22 nt, Homo sapiens
uuaggcaaugcucucaaauuug

SEQ ID NO: 319144 - RNA, 22 nt, Homo sapiens
uuagggcaggcaugagagaacu

SEQ ID NO: 319145 - RNA, 18 nt, Homo sapiens
uuagguaggucuuugugu

SEQ ID NO: 319146 - RNA, 20 nt, Homo sapiens
uuauaacuuuuguucugggg

SEQ ID NO: 319147 - RNA, 21 nt, Homo sapiens
uuauaguggcaugauuuauaa

SEQ ID NO: 319148 - RNA, 22 nt, Homo sapiens
uuaugaaguagguuaagagcag

SEQ ID NO: 319149 - RNA, 22 nt, Homo sapiens
uuaugcuugugugaauuuuccc

SEQ ID NO: 319150 - RNA, 22 nt, Homo sapiens
uuauuacuccuauuuuguagau

SEQ ID NO: 319151 - RNA, 22 nt, Homo sapiens
uucaaaguaaaaauguguucac

SEQ ID NO: 319152 - RNA, 22 nt, Homo sapiens
uucaagucuuggcuuugccacc

SEQ ID NO: 319153 - RNA, 22 nt, Homo sapiens
uucacagacaacuggucccuua

SEQ ID NO: 319154 - RNA, 22 nt, Homo sapiens
uucacagucacccuucuccaug

SEQ ID NO: 319155 - RNA, 22 nt, Homo sapiens
uucaccagggaagucucaacuc

SEQ ID NO: 319156 - RNA, 22 nt, Homo sapiens
uucagcuacuuggaaacagcaa

SEQ ID NO: 319157 - RNA, 22 nt, Homo sapiens
uucaggcuccugugagaaucua

SEQ ID NO: 319158 - RNA, 22 nt, Homo sapiens
uucauaguaacaguaacuaugg

SEQ ID NO: 319159 - RNA, 22 nt, Homo sapiens
uucauguaauauuucacagcuu

SEQ ID NO: 319160 - RNA, 22 nt, Homo sapiens
uucauguagucaucauccugcu

SEQ ID NO: 319161 - RNA, 22 nt, Homo sapiens
uucaugucuuggcuguuagagu

SEQ ID NO: 319162 - RNA, 22 nt, Homo sapiens
uucauuggauguuacacugugu

SEQ ID NO: 319163 - RNA, 22 nt, Homo sapiens
uuccuugguucagggaaggucc

SEQ ID NO: 319164 - RNA, 22 nt, Homo sapiens
uuccuugugacuaguagugacc

SEQ ID NO: 319165 - RNA, 20 nt, Homo sapiens
uucuaguacuucuguuucca

SEQ ID NO: 319166 - RNA, 22 nt, Homo sapiens
uucucaauggaugugggaccag

SEQ ID NO: 319167 - RNA, 22 nt, Homo sapiens
uucucagcccccugacagucag

SEQ ID NO: 319168 - RNA, 22 nt, Homo sapiens
uucuccugguggacccuaaacg

SEQ ID NO: 319169 - RNA, 22 nt, Homo sapiens
uucuggcucaggucaacacuuc

SEQ ID NO: 319170 - RNA, 22 nt, Homo sapiens
uucuguguuuaggucacggcua

SEQ ID NO: 319171 - RNA, 18 nt, Homo sapiens
uucuuguguugauauuuu

SEQ ID NO: 319172 - RNA, 22 nt, Homo sapiens
uucuuugguacaagggccgacc

SEQ ID NO: 319173 - RNA, 22 nt, Homo sapiens
uugaaguaugaccgcugagaau

SEQ ID NO: 319174 - RNA, 22 nt, Homo sapiens
uugaaugaaaugaugucauuug

SEQ ID NO: 319175 - RNA, 22 nt, Homo sapiens
uugagaugaagucuugcucucu

SEQ ID NO: 319176 - RNA, 22 nt, Homo sapiens
uugagaugaaguuuugcucuuu

SEQ ID NO: 319177 - RNA, 22 nt, Homo sapiens
uugagauggagucucacucugu

SEQ ID NO: 319178 - RNA, 22 nt, Homo sapiens
uugagauggagucucgcucugu

SEQ ID NO: 319179 - RNA, 22 nt, Homo sapiens
uugagauggagucuuguucuuu

SEQ ID NO: 319180 - RNA, 22 nt, Homo sapiens
uugagauggaguucauuuuugu

SEQ ID NO: 319181 - RNA, 22 nt, Homo sapiens
uugagcacaguagguuguggcu

SEQ ID NO: 319182 - RNA, 22 nt, Homo sapiens
uugagccaaggauugucuuucc

SEQ ID NO: 319183 - RNA, 22 nt, Homo sapiens
uugaggcaaugaggagaagcug

SEQ ID NO: 319184 - RNA, 16 nt, Homo sapiens
uugaggcaugucucag

SEQ ID NO: 319185 - RNA, 22 nt, Homo sapiens
uugagguaguacuuauuauugg

SEQ ID NO: 319186 - RNA, 22 nt, Homo sapiens
uugagugaaggcuguguucuug

SEQ ID NO: 319187 - RNA, 22 nt, Homo sapiens
uugagugaaugaaugauuaaau

SEQ ID NO: 319188 - RNA, 22 nt, Homo sapiens
uugcacauguugaaccagcaaa

SEQ ID NO: 319189 - RNA, 22 nt, Homo sapiens
uugcaucagcaggcauaauugg

SEQ ID NO: 319190 - RNA, 22 nt, Homo sapiens
agcucuuguuaguauuagcagu

SEQ ID NO: 319191 - RNA, 17 nt, Homo sapiens
agcuggaauuacgggag

SEQ ID NO: 319192 - RNA, 22 nt, Homo sapiens
agcuggucucaggugcccugcu

SEQ ID NO: 319193 - RNA, 22 nt, Homo sapiens
agcuggucuuggggaagaguag

SEQ ID NO: 319194 - RNA, 21 nt, Homo sapiens
agcugguuucuucuuacuccu

SEQ ID NO: 319195 - RNA, 22 nt, Homo sapiens
aguaaacuucagaguucuuccu

SEQ ID NO: 319196 - RNA, 20 nt, Homo sapiens
aguauucacuuuuuucaugg

SEQ ID NO: 319197 - RNA, 22 nt, Homo sapiens
agugcauaugucuuuuuggaag

SEQ ID NO: 319198 - RNA, 22 nt, Homo sapiens
agugccacugcacucuagccug

SEQ ID NO: 319199 - RNA, 22 nt, Homo sapiens
aguggugucugaguggccaggg

SEQ ID NO: 319200 - RNA, 22 nt, Homo sapiens
auaacucuguuuuuuucaugca

SEQ ID NO: 319201 - RNA, 22 nt, Homo sapiens
auacagguauacaaugcauaau

SEQ ID NO: 319202 - RNA, 22 nt, Homo sapiens
auacagucuguuagauuuccuc

SEQ ID NO: 319203 - RNA, 22 nt, Homo sapiens
auacaucugccauguuggugug

SEQ ID NO: 319204 - RNA, 22 nt, Homo sapiens
auacaugugugagcgaagaugu

SEQ ID NO: 319205 - RNA, 22 nt, Homo sapiens
auagaccuggagaguagauaua

SEQ ID NO: 319206 - RNA, 22 nt, Homo sapiens
auagcagugugagaaugaacua

SEQ ID NO: 319207 - RNA, 23 nt, Homo sapiens
auauaguagaugugcaguaacau

SEQ ID NO: 319208 - RNA, 22 nt, Homo sapiens
auauaugcacacgugugcauau

SEQ ID NO: 319209 - RNA, 22 nt, Homo sapiens
auaugcaaauccauagagacag

SEQ ID NO: 319210 - RNA, 22 nt, Homo sapiens
aucaaagugaaauauuaguuau

SEQ ID NO: 319211 - RNA, 22 nt, Homo sapiens
aucaaagugaauuaaugagaau

SEQ ID NO: 319212 - RNA, 22 nt, Homo sapiens
aucaaaguuucccagaaguugu

SEQ ID NO: 319213 - RNA, 22 nt, Homo sapiens
aucagcagcaugaaaacaggcu

SEQ ID NO: 319214 - RNA, 22 nt, Homo sapiens
aucaggcacacauuggaguuug

SEQ ID NO: 319215 - RNA, 22 nt, Homo sapiens
aucagugaaagugaaaucuccg

SEQ ID NO: 319216 - RNA, 22 nt, Homo sapiens
aucccaguucagccucugacac

SEQ ID NO: 319217 - RNA, 22 nt, Homo sapiens
auccuguagucucacagcccca

SEQ ID NO: 319218 - RNA, 22 nt, Homo sapiens
aucucagagaaaauuacuaaga

SEQ ID NO: 319219 - RNA, 22 nt, Homo sapiens
aucucaguuaaugacccuaugc

SEQ ID NO: 319220 - RNA, 19 nt, Homo sapiens
aucuggaguuccuggggcu

SEQ ID NO: 319221 - RNA, 22 nt, Homo sapiens
aucuuuggugcaugauacuuug

SEQ ID NO: 319222 - RNA, 22 nt, Homo sapiens
augaaguuagcucauuucuuuu

SEQ ID NO: 319223 - RNA, 22 nt, Homo sapiens
augaauacagcuaugcgugcau

SEQ ID NO: 319224 - RNA, 22 nt, Homo sapiens
augagaaucauuucagcuugua

SEQ ID NO: 319225 - RNA, 22 nt, Homo sapiens
augagagcugacuuuaaggcaa

SEQ ID NO: 319226 - RNA, 22 nt, Homo sapiens
augaggugauuucuguucgggu

SEQ ID NO: 319227 - RNA, 22 nt, Homo sapiens
augaucauggaaguuuuccugu

SEQ ID NO: 319228 - RNA, 22 nt, Homo sapiens
augcaaggaugguuagauauau

SEQ ID NO: 319229 - RNA, 22 nt, Homo sapiens
augccacugcacuccaaccugg

SEQ ID NO: 319230 - RNA, 22 nt, Homo sapiens
augccacuguacucuagccuag

SEQ ID NO: 319231 - RNA, 22 nt, Homo sapiens
augcuacuggauuuguauaaau

SEQ ID NO: 319232 - RNA, 22 nt, Homo sapiens
auguaagugugcucaaauguua

SEQ ID NO: 319233 - RNA, 22 nt, Homo sapiens
augugacagcaacccccagccc

SEQ ID NO: 319234 - RNA, 22 nt, Homo sapiens
augugacagugguuuuaagcgu

SEQ ID NO: 319235 - RNA, 22 nt, Homo sapiens
augugcuuauagguguauguuu

SEQ ID NO: 319236 - RNA, 22 nt, Homo sapiens
auguggaaagcagcaugauaug

SEQ ID NO: 319237 - RNA, 22 nt, Homo sapiens
auguguauuaccucgauuguga

SEQ ID NO: 319238 - RNA, 23 nt, Homo sapiens
augugugcuuggagagcaggaug

SEQ ID NO: 319239 - RNA, 22 nt, Homo sapiens
auuaagugcuugccagugcugg

SEQ ID NO: 319240 - RNA, 22 nt, Homo sapiens
auuaaguuaggauuuugagaua

SEQ ID NO: 319241 - RNA, 22 nt, Homo sapiens
auuaauguaauuaguaaaguug

SEQ ID NO: 319242 - RNA, 22 nt, Homo sapiens
auucaagugaugcagcuguuuu

SEQ ID NO: 319243 - RNA, 23 nt, Homo sapiens
auuccaguggcaauuggagaaac

SEQ ID NO: 319244 - RNA, 22 nt, Homo sapiens
auuccaguuguaagguuuuuca

SEQ ID NO: 319245 - RNA, 22 nt, Homo sapiens
auugcacuccauccuaggugac

SEQ ID NO: 319246 - RNA, 22 nt, Homo sapiens
auuggcauauccacgacaaugc

SEQ ID NO: 319247 - RNA, 22 nt, Homo sapiens
auuguaguuugcuauggcaaua

SEQ ID NO: 319248 - RNA, 22 nt, Homo sapiens
auuuggcagugaagggaucaca

SEQ ID NO: 319249 - RNA, 22 nt, Homo sapiens
caaagcacuuggcuuggaagau

SEQ ID NO: 319250 - RNA, 22 nt, Homo sapiens
caagggguggaaaugguagugu

SEQ ID NO: 319251 - RNA, 22 nt, Homo sapiens
cacagcuaacaacuguuucuuc

SEQ ID NO: 319252 - RNA, 23 nt, Homo sapiens
cacagggugaacaccccuaaucc

SEQ ID NO: 319253 - RNA, 22 nt, Homo sapiens
cacauguuugcuacauuuuucu

SEQ ID NO: 319254 - RNA, 22 nt, Homo sapiens
caccauguguucagaaggauug

SEQ ID NO: 319255 - RNA, 22 nt, Homo sapiens
cacugcacuccagccuaagagg

SEQ ID NO: 319256 - RNA, 20 nt, Homo sapiens
cagcuagugguaggagucgg

SEQ ID NO: 319257 - RNA, 22 nt, Homo sapiens
cagcugaugucgaaugcacucu

SEQ ID NO: 319258 - RNA, 22 nt, Homo sapiens
caguugguguacauauauguau

SEQ ID NO: 319259 - RNA, 22 nt, Homo sapiens
cauaaugcuaagagcugccccu

SEQ ID NO: 319260 - RNA, 22 nt, Homo sapiens
cauauaguaggugcucuguguu

SEQ ID NO: 319261 - RNA, 22 nt, Homo sapiens
caucccauucgaggggcacagc

SEQ ID NO: 319262 - RNA, 22 nt, Homo sapiens
caugucacuuccucucugaugg

SEQ ID NO: 319263 - RNA, 22 nt, Homo sapiens
cauuccacauguaggacaauuu

SEQ ID NO: 319264 - RNA, 22 nt, Homo sapiens
cccagugugaacuuggcauuuu

SEQ ID NO: 319265 - RNA, 22 nt, Homo sapiens
ccccauuugaacuccuucaacu

SEQ ID NO: 319266 - RNA, 22 nt, Homo sapiens
cccugaagacuccaccgucaug

SEQ ID NO: 319267 - RNA, 22 nt, Homo sapiens
cccuggacacacacuuuuauuc

SEQ ID NO: 319268 - RNA, 22 nt, Homo sapiens
ccucacaaccuuuauugaagag

SEQ ID NO: 319269 - RNA, 22 nt, Homo sapiens
ccuucuuuuguaaggcugaaua

SEQ ID NO: 319270 - RNA, 22 nt, Homo sapiens
cuaaaguauugagugguaaaga

SEQ ID NO: 319271 - RNA, 19 nt, Homo sapiens
gugugcauaucacagagca

SEQ ID NO: 319272 - RNA, 22 nt, Homo sapiens
gugugcauggagggggcaguga

SEQ ID NO: 319273 - RNA, 22 nt, Homo sapiens
guguuauuuugcugggaaugau

SEQ ID NO: 319274 - RNA, 22 nt, Homo sapiens
guugccuaggcuggagugcagu

SEQ ID NO: 319275 - RNA, 22 nt, Homo sapiens
guugcucaggcugaagugcagu

SEQ ID NO: 319276 - RNA, 22 nt, Homo sapiens
uaaagcuuagauccaugguggc

SEQ ID NO: 319277 - RNA, 22 nt, Homo sapiens
uaaaugcuuaauugaaugugga

SEQ ID NO: 319278 - RNA, 22 nt, Homo sapiens
uaacacagagcuccuaaucccu

SEQ ID NO: 319279 - RNA, 22 nt, Homo sapiens
uaacagcucuacagcugcucuu

SEQ ID NO: 319280 - RNA, 22 nt, Homo sapiens
uaacaguggucugugguaucug

SEQ ID NO: 319281 - RNA, 22 nt, Homo sapiens
uaacauugucuugcuuaguuuu

SEQ ID NO: 319282 - RNA, 22 nt, Homo sapiens
uaagcuauagugaauaaauugc

SEQ ID NO: 319283 - RNA, 22 nt, Homo sapiens
uaaggcaaguuuuuaguggaca

SEQ ID NO: 319284 - RNA, 22 nt, Homo sapiens
uaagggcaugcugcaugagagu

SEQ ID NO: 319285 - RNA, 22 nt, Homo sapiens
uaagugaauguuggcuacugaa

SEQ ID NO: 319286 - RNA, 22 nt, Homo sapiens
uaagugcuugacuuugauguuu

SEQ ID NO: 319287 - RNA, 22 nt, Homo sapiens
uacacacguguguauauauaca

SEQ ID NO: 319288 - RNA, 22 nt, Homo sapiens
uacagcacaggugcagguguug

SEQ ID NO: 319289 - RNA, 22 nt, Homo sapiens
uacaguacagugacaccauuau

SEQ ID NO: 319290 - RNA, 22 nt, Homo sapiens
uacaugcaugggcaugugugca

SEQ ID NO: 319291 - RNA, 22 nt, Homo sapiens
uacucacauucuguuucuugcu

SEQ ID NO: 319292 - RNA, 22 nt, Homo sapiens
uagaaagcaugaccuucagaua

SEQ ID NO: 319293 - RNA, 22 nt, Homo sapiens
uagaauggaagguugagaagaa

SEQ ID NO: 319294 - RNA, 22 nt, Homo sapiens
uagacacugcauauuuuuuuaa

SEQ ID NO: 319295 - RNA, 22 nt, Homo sapiens
uagaccaauuggcauauaguaa

SEQ ID NO: 319296 - RNA, 22 nt, Homo sapiens
uagacuguaagauccaggagag

SEQ ID NO: 319297 - RNA, 20 nt, Homo sapiens
uagaugcauuuagauucauu

SEQ ID NO: 319298 - RNA, 22 nt, Homo sapiens
uagcagaauauaccucuuacuu

SEQ ID NO: 319299 - RNA, 22 nt, Homo sapiens
uagcaucaauucauguuaugau

SEQ ID NO: 319300 - RNA, 22 nt, Homo sapiens
uaguagagauggggcacaugcc

SEQ ID NO: 319301 - RNA, 22 nt, Homo sapiens
uaguccauuuucaugcugcuau

SEQ ID NO: 319302 - RNA, 22 nt, Homo sapiens
uauacugucuuuguaugccuag

SEQ ID NO: 319303 - RNA, 22 nt, Homo sapiens
uaucacccuuucauuguucuuc

SEQ ID NO: 319304 - RNA, 21 nt, Homo sapiens
uauccacuugcaacagagaag

SEQ ID NO: 319305 - RNA, 22 nt, Homo sapiens
uauccugaagcuuuauuuaagu

SEQ ID NO: 319306 - RNA, 22 nt, Homo sapiens
uaugagcacauauguaucuaug

SEQ ID NO: 319307 - RNA, 22 nt, Homo sapiens
uaugcacacguguccaugugca

SEQ ID NO: 319308 - RNA, 22 nt, Homo sapiens
uauuacugucaauaucacagaa

SEQ ID NO: 319309 - RNA, 22 nt, Homo sapiens
uauuacuugucugugucucaau

SEQ ID NO: 319310 - RNA, 22 nt, Homo sapiens
uauuaugcacuuuauaaaaauu

SEQ ID NO: 319311 - RNA, 22 nt, Homo sapiens
uauuugauuaacaagagccuaa

SEQ ID NO: 319312 - RNA, 22 nt, Homo sapiens
ucaaagugcuauggcucagguu

SEQ ID NO: 319313 - RNA, 20 nt, Homo sapiens
ucaaauucuuggccuccagc

SEQ ID NO: 319314 - RNA, 20 nt, Homo sapiens
ucaaggcacgaauaaaaguu

SEQ ID NO: 319315 - RNA, 22 nt, Homo sapiens
ucaaguacugccuugcucuggc

SEQ ID NO: 319316 - RNA, 22 nt, Homo sapiens
ucaagugcauugauucaguauu

SEQ ID NO: 319317 - RNA, 16 nt, Homo sapiens
ucacaaacucuagcag

SEQ ID NO: 319318 - RNA, 22 nt, Homo sapiens
ucacacgugaacucaucacaga

SEQ ID NO: 319319 - RNA, 22 nt, Homo sapiens
ucacagacauugaggggaccuu

SEQ ID NO: 319320 - RNA, 22 nt, Homo sapiens
ucacagucacugucacguugaa

SEQ ID NO: 319321 - RNA, 22 nt, Homo sapiens
ucaccggcagacguggccugau

SEQ ID NO: 319322 - RNA, 21 nt, Homo sapiens
ucagggaccugcuguacugau

SEQ ID NO: 319323 - RNA, 22 nt, Homo sapiens
ucaguagagacaggauuucacc

SEQ ID NO: 319324 - RNA, 18 nt, Homo sapiens
ucagucacugccuggcuu

SEQ ID NO: 319325 - RNA, 22 nt, Homo sapiens
ucagugcuuggcacagagagcu

SEQ ID NO: 319326 - RNA, 22 nt, Homo sapiens
ucaguuuagguguaacggccac

SEQ ID NO: 319327 - RNA, 22 nt, Homo sapiens
ucaucagaguuuacaagcucag

SEQ ID NO: 319328 - RNA, 22 nt, Homo sapiens
ucauccauacaguuagcaaagg

SEQ ID NO: 319329 - RNA, 22 nt, Homo sapiens
ucaugacacuggcaggagcuaa

SEQ ID NO: 319330 - RNA, 22 nt, Homo sapiens
uccccugagaccccucagcacu

SEQ ID NO: 319331 - RNA, 19 nt, Homo sapiens
ucccuguagaccacagugc

SEQ ID NO: 319332 - RNA, 19 nt, Homo sapiens
ucucacagcucuacuaugu

SEQ ID NO: 319333 - RNA, 21 nt, Homo sapiens
ucuggcccccucaaaucucau

SEQ ID NO: 319334 - RNA, 21 nt, Homo sapiens
ucuggccccuccaaaucucau

SEQ ID NO: 319335 - RNA, 22 nt, Homo sapiens
ucugguggugaugagagacagu

SEQ ID NO: 319336 - RNA, 22 nt, Homo sapiens
ucugucaaaucuuauguuguag

SEQ ID NO: 319337 - RNA, 22 nt, Homo sapiens
ucuuugaguguauacuuagauu

SEQ ID NO: 319338 - RNA, 22 nt, Homo sapiens
ucuuugguaauggaugucugau

SEQ ID NO: 319339 - RNA, 22 nt, Homo sapiens
ucuuugguaggaguaggaggcc

SEQ ID NO: 319340 - RNA, 21 nt, Homo sapiens
ucuuuggucaccaguuuucau

SEQ ID NO: 319341 - RNA, 22 nt, Homo sapiens
ucuuuggucuacuuucauaugu

SEQ ID NO: 319342 - RNA, 22 nt, Homo sapiens
ucuuuggugaauggucauccag

SEQ ID NO: 319343 - RNA, 22 nt, Homo sapiens
ucuuugguuagguuuaguugau

SEQ ID NO: 319344 - RNA, 22 nt, Homo sapiens
ucuuugguugcacugcaggugu

SEQ ID NO: 319345 - RNA, 18 nt, Homo sapiens
ugaaacacauuuuuuccu

SEQ ID NO: 319346 - RNA, 22 nt, Homo sapiens
ugaaauguaaguugucuagucu

SEQ ID NO: 319347 - RNA, 22 nt, Homo sapiens
ugaaguaauguuuuauucuauu

SEQ ID NO: 319348 - RNA, 22 nt, Homo sapiens
ugaauguuugcuuacuuccaua

SEQ ID NO: 319349 - RNA, 22 nt, Homo sapiens
ugacaagauauggucuuaucaa

SEQ ID NO: 319350 - RNA, 22 nt, Homo sapiens
ugacaagcucccucugcaccuu

SEQ ID NO: 319351 - RNA, 22 nt, Homo sapiens
ugacaugaaggcaccucugucc

SEQ ID NO: 319352 - RNA, 21 nt, Homo sapiens
ugacauuauuucaugucagua

SEQ ID NO: 319353 - RNA, 22 nt, Homo sapiens
ugacuggagucuugcucugucg

SEQ ID NO: 319354 - RNA, 22 nt, Homo sapiens
ugagaacauggagaacccccca

SEQ ID NO: 319355 - RNA, 22 nt, Homo sapiens
ugagaucaugucauuugcacuc

SEQ ID NO: 319356 - RNA, 22 nt, Homo sapiens
ugagaugaagucuugcucuguu

SEQ ID NO: 319357 - RNA, 22 nt, Homo sapiens
aaaugcugucaaauuguguucu

SEQ ID NO: 319358 - RNA, 22 nt, Homo sapiens
aaauggcaccggcucuucccuc

SEQ ID NO: 319359 - RNA, 22 nt, Homo sapiens
aacagucuccaguuguauccau

SEQ ID NO: 319360 - RNA, 22 nt, Homo sapiens
aacucacauucuuucuugguac

SEQ ID NO: 319361 - RNA, 22 nt, Homo sapiens
aagaccuaugcaggaagaaaug

SEQ ID NO: 319362 - RNA, 22 nt, Homo sapiens
aagagguaauaacaaagcuucu

SEQ ID NO: 319363 - RNA, 22 nt, Homo sapiens
aagcagauguguugaaaguacu

SEQ ID NO: 319364 - RNA, 22 nt, Homo sapiens
aaggaguguggugaucuugggc

SEQ ID NO: 319365 - RNA, 22 nt, Homo sapiens
aagggaaugugguagcugguuu

SEQ ID NO: 319366 - RNA, 22 nt, Homo sapiens
aagggaauguugugguugguuu

SEQ ID NO: 319367 - RNA, 22 nt, Homo sapiens
aaguaaacauuuuguacaauaa

SEQ ID NO: 319368 - RNA, 22 nt, Homo sapiens
aaguauuaagacuaagaggcuu

SEQ ID NO: 319369 - RNA, 22 nt, Homo sapiens
aagugaauucauuguguuauau

SEQ ID NO: 319370 - RNA, 22 nt, Homo sapiens
aagugcuucagaagacaauauu

SEQ ID NO: 319371 - RNA, 22 nt, Homo sapiens
aauaugucugcuaauuguuucu

SEQ ID NO: 319372 - RNA, 17 nt, Homo sapiens
aaucagauuucugagga

SEQ ID NO: 319373 - RNA, 22 nt, Homo sapiens
aauggcaucuacguuaaauguc

SEQ ID NO: 319374 - RNA, 22 nt, Homo sapiens
aauggcucugauguuguuguga

SEQ ID NO: 319375 - RNA, 22 nt, Homo sapiens
aaugucaugaguccaaccagaa

SEQ ID NO: 319376 - RNA, 23 nt, Homo sapiens
aauugcuuuugaggacuuaguug

SEQ ID NO: 319377 - RNA, 21 nt, Homo sapiens
acaaagcuggagggagacugc

SEQ ID NO: 319378 - RNA, 22 nt, Homo sapiens
acaauguauauuuuacuguagg

SEQ ID NO: 319379 - RNA, 22 nt, Homo sapiens
acacaguauaugacaaugcuuu

SEQ ID NO: 319380 - RNA, 22 nt, Homo sapiens
acacaugugaaaaaaauguuac

SEQ ID NO: 319381 - RNA, 22 nt, Homo sapiens
acacaugugcguagacucuuua

SEQ ID NO: 319382 - RNA, 22 nt, Homo sapiens
acaccaugucuguuucugguuu

SEQ ID NO: 319383 - RNA, 22 nt, Homo sapiens
acacuguacuuauguuuugcag

SEQ ID NO: 319384 - RNA, 22 nt, Homo sapiens
acagcacugccaagugacccau

SEQ ID NO: 319385 - RNA, 22 nt, Homo sapiens
acaggagugggauuugaguccu

SEQ ID NO: 319386 - RNA, 20 nt, Homo sapiens
acaguagaagggauuucaaa

SEQ ID NO: 319387 - RNA, 18 nt, Homo sapiens
acagugcugucacugcuu

SEQ ID NO: 319388 - RNA, 17 nt, Homo sapiens
acagugucuaugaaaug

SEQ ID NO: 319389 - RNA, 19 nt, Homo sapiens
acagugucucuauaaugau

SEQ ID NO: 319390 - RNA, 22 nt, Homo sapiens
acccuguaggugcuggcagaga

SEQ ID NO: 319391 - RNA, 22 nt, Homo sapiens
acccugucauccacauggugcu

SEQ ID NO: 319392 - RNA, 22 nt, Homo sapiens
acuggacuuaaugaugaauugu

SEQ ID NO: 319393 - RNA, 22 nt, Homo sapiens
acuggcuuuugagaaaaacacu

SEQ ID NO: 319394 - RNA, 22 nt, Homo sapiens
acuuuuugauggggagaacauu

SEQ ID NO: 319395 - RNA, 22 nt, Homo sapiens
uucuuagucaaguuguauuuca

SEQ ID NO: 319396 - RNA, 21 nt, Homo sapiens
uucuucaggcagaaggauuau

SEQ ID NO: 319397 - RNA, 22 nt, Homo sapiens
uucuucaggcauucccagaagc

SEQ ID NO: 319398 - RNA, 22 nt, Homo sapiens
uucuucaguuacaacaaggggg

SEQ ID NO: 319399 - RNA, 21 nt, Homo sapiens
uucuuugcucaguguuagagu

SEQ ID NO: 319400 - RNA, 22 nt, Homo sapiens
uugacagagaaaagugugacuu

SEQ ID NO: 319401 - RNA, 20 nt, Homo sapiens
uugacaguggguuguuaaag

SEQ ID NO: 319402 - RNA, 22 nt, Homo sapiens
uugagacggagucuugcucuuu

SEQ ID NO: 319403 - RNA, 22 nt, Homo sapiens
uugagagaaaaggccaugccuu

SEQ ID NO: 319404 - RNA, 22 nt, Homo sapiens
uugagauggagucucacucuug

SEQ ID NO: 319405 - RNA, 22 nt, Homo sapiens
uugagauggagucucgcucuuu

SEQ ID NO: 319406 - RNA, 22 nt, Homo sapiens
uugagauggagucuugcacugu

SEQ ID NO: 319407 - RNA, 22 nt, Homo sapiens
uugagauggagucuugcucugu

SEQ ID NO: 319408 - RNA, 22 nt, Homo sapiens
uugagauggagucuuguucucu

SEQ ID NO: 319409 - RNA, 22 nt, Homo sapiens
uugagauggaguuucaauauug

SEQ ID NO: 319410 - RNA, 22 nt, Homo sapiens
uugagauggaguuucacucucg

SEQ ID NO: 319411 - RNA, 22 nt, Homo sapiens
uugaguuuaucuaaagaccugg

SEQ ID NO: 319412 - RNA, 22 nt, Homo sapiens
uugcagcauucugguuccuggu

SEQ ID NO: 319413 - RNA, 22 nt, Homo sapiens
uugcauaauaagagggauacgu

SEQ ID NO: 319414 - RNA, 22 nt, Homo sapiens
uugcaugggagcugggugaagc

SEQ ID NO: 319415 - RNA, 22 nt, Homo sapiens
uugcaugggagcugggugaggc

SEQ ID NO: 319416 - RNA, 22 nt, Homo sapiens
uugcuggugguucgagcaacac

SEQ ID NO: 319417 - RNA, 22 nt, Homo sapiens
ugcauaugucuuuauaguagca

SEQ ID NO: 319418 - RNA, 18 nt, Homo sapiens
ugcauauguugaaccagc

SEQ ID NO: 319419 - RNA, 22 nt, Homo sapiens
ugcaugcaucuuuuauaguagc

SEQ ID NO: 319420 - RNA, 22 nt, Homo sapiens
ugccagagacguagggaauauu

SEQ ID NO: 319421 - RNA, 22 nt, Homo sapiens
ugccugagcccagcccuguagu

SEQ ID NO: 319422 - RNA, 22 nt, Homo sapiens
ugccuuauuccaacugagcucu

SEQ ID NO: 319423 - RNA, 21 nt, Homo sapiens
ugccuuuguaguaggugucuu

SEQ ID NO: 319424 - RNA, 22 nt, Homo sapiens
ugcuauguuuucccuccuuauc

SEQ ID NO: 319425 - RNA, 22 nt, Homo sapiens
uggaaauuaagucuuuccugag

SEQ ID NO: 319426 - RNA, 22 nt, Homo sapiens
uggaagacaaguguuagcaugg

SEQ ID NO: 319427 - RNA, 19 nt, Homo sapiens
uggaauggauuuaaaugug

SEQ ID NO: 319428 - RNA, 22 nt, Homo sapiens
uggaauuuacuuauuuaggggc

SEQ ID NO: 319429 - RNA, 22 nt, Homo sapiens
uggacagacaagguuauagauc

SEQ ID NO: 319430 - RNA, 22 nt, Homo sapiens
uggaccccugcucgggagcccu

SEQ ID NO: 319431 - RNA, 21 nt, Homo sapiens
uggaccccuuccagucaucau

SEQ ID NO: 319432 - RNA, 22 nt, Homo sapiens
uggacugagauuucagcugcca

SEQ ID NO: 319433 - RNA, 22 nt, Homo sapiens
uggcauggggcagaacauuaca

SEQ ID NO: 319434 - RNA, 22 nt, Homo sapiens
uggcaugggguaguagcgcugg

SEQ ID NO: 319435 - RNA, 22 nt, Homo sapiens
ugggaauaugauacaggucuuu

SEQ ID NO: 319436 - RNA, 22 nt, Homo sapiens
ugggcagugggacagcuuugug

SEQ ID NO: 319437 - RNA, 22 nt, Homo sapiens
ugggccgcugcaggaugguccc

SEQ ID NO: 319438 - RNA, 22 nt, Homo sapiens
ugguacugucucuauuuuguag

SEQ ID NO: 319439 - RNA, 21 nt, Homo sapiens
uggucaguuuucucacuagga

SEQ ID NO: 319440 - RNA, 22 nt, Homo sapiens
uguaauuuaaaugauccuugga

SEQ ID NO: 319441 - RNA, 22 nt, Homo sapiens
uguacacauaugugggguacau

SEQ ID NO: 319442 - RNA, 22 nt, Homo sapiens
uguagggagagggaguugcacc

SEQ ID NO: 319443 - RNA, 21 nt, Homo sapiens
uguauacauggaagaaugguc

SEQ ID NO: 319444 - RNA, 22 nt, Homo sapiens
ugucacagagauuuugguaugu

SEQ ID NO: 319445 - RNA, 21 nt, Homo sapiens
ugucaguuuccagaguucaac

SEQ ID NO: 319446 - RNA, 22 nt, Homo sapiens
ugucaguuucuugagauggaac

SEQ ID NO: 319447 - RNA, 22 nt, Homo sapiens
ugucaguuuuaacuagggaaua

SEQ ID NO: 319448 - RNA, 22 nt, Homo sapiens
ugucaucauuccaucagggcuu

SEQ ID NO: 319449 - RNA, 22 nt, Homo sapiens
uguccaaauugaaucaucuggu

SEQ ID NO: 319450 - RNA, 22 nt, Homo sapiens
ugugacugguugucccacuuuc

SEQ ID NO: 319451 - RNA, 22 nt, Homo sapiens
ugugcaguuuuagcguauuuua

SEQ ID NO: 319452 - RNA, 22 nt, Homo sapiens
ugugccacuccagcucuagcuu

SEQ ID NO: 319453 - RNA, 22 nt, Homo sapiens
uuaaaguguuuucaaaauguca

SEQ ID NO: 319454 - RNA, 22 nt, Homo sapiens
uuaaaugcacauacuugagaaa

SEQ ID NO: 319455 - RNA, 18 nt, Homo sapiens
uuaaggcaggacuuuaag

SEQ ID NO: 319456 - RNA, 22 nt, Homo sapiens
uuaaggcagugcaucuggaguu

SEQ ID NO: 319457 - RNA, 22 nt, Homo sapiens
uuaaguagcugggcaugguggu

SEQ ID NO: 319458 - RNA, 22 nt, Homo sapiens
uuaaugacaucauaggugaagu

SEQ ID NO: 319459 - RNA, 22 nt, Homo sapiens
uuaauucugucugcccucaucc

SEQ ID NO: 319460 - RNA, 22 nt, Homo sapiens
uuacagcugcuccccaucacuc

SEQ ID NO: 319461 - RNA, 22 nt, Homo sapiens
uuacaguaugaguaagaguucu

SEQ ID NO: 319462 - RNA, 22 nt, Homo sapiens
uuacaguggugaccuuguauug

SEQ ID NO: 319463 - RNA, 22 nt, Homo sapiens
uuacauguggugugaagaagag

SEQ ID NO: 319464 - RNA, 22 nt, Homo sapiens
uuacguaguuuuggagaucaua

SEQ ID NO: 319465 - RNA, 22 nt, Homo sapiens
uuagcagugucccacuccuugg

SEQ ID NO: 319466 - RNA, 22 nt, Homo sapiens
uuagguagucucugucagaggg

SEQ ID NO: 319467 - RNA, 22 nt, Homo sapiens
uuauaaacaugaagauuugggg

SEQ ID NO: 319468 - RNA, 22 nt, Homo sapiens
uuauacucgucugaaugauucu

SEQ ID NO: 319469 - RNA, 22 nt, Homo sapiens
uuauaugcuaaacaaggggugg

SEQ ID NO: 319470 - RNA, 22 nt, Homo sapiens
uuauguaggcuauagcucugca

SEQ ID NO: 319471 - RNA, 22 nt, Homo sapiens
uuauuguccaaguuucccuuug

SEQ ID NO: 319472 - RNA, 22 nt, Homo sapiens
uucaaguaagaaagacaucagg

SEQ ID NO: 319473 - RNA, 22 nt, Homo sapiens
uucaaguguucaggagcuacag

SEQ ID NO: 319474 - RNA, 22 nt, Homo sapiens
uucaauuaauauuauacucuca

SEQ ID NO: 319475 - RNA, 22 nt, Homo sapiens
uucacagaaaaaggcgaugagg

SEQ ID NO: 319476 - RNA, 22 nt, Homo sapiens
uucacaguguuucucacgguua

SEQ ID NO: 319477 - RNA, 22 nt, Homo sapiens
uucaggcaccauggucauugau

SEQ ID NO: 319478 - RNA, 22 nt, Homo sapiens
uucaggcaccauugucauugau

SEQ ID NO: 319479 - RNA, 22 nt, Homo sapiens
uucaggcuuuuauuuacugaua

SEQ ID NO: 319480 - RNA, 22 nt, Homo sapiens
uucagguaguuuaacuguucca

SEQ ID NO: 319481 - RNA, 22 nt, Homo sapiens
uucauagaggacauuacuggag

SEQ ID NO: 319482 - RNA, 22 nt, Homo sapiens
uucauagucacauucgaugucu

SEQ ID NO: 319483 - RNA, 22 nt, Homo sapiens
uucaugcaucuguagugguuaa

SEQ ID NO: 319484 - RNA, 22 nt, Homo sapiens
uucccagagccugggagugagg

SEQ ID NO: 319485 - RNA, 22 nt, Homo sapiens
uucccagugguuagcucugguc

SEQ ID NO: 319486 - RNA, 22 nt, Homo sapiens
uuccuagagauuagcaagcugc

SEQ ID NO: 319487 - RNA, 22 nt, Homo sapiens
uuccugcacuugcuugccuaug

SEQ ID NO: 319488 - RNA, 22 nt, Homo sapiens
uucucaauggcaacuuguugcu

SEQ ID NO: 319489 - RNA, 22 nt, Homo sapiens
uucucauggugauggcaaaauc

SEQ ID NO: 319490 - RNA, 22 nt, Homo sapiens
uucucgcuuuuuccaccuguau

SEQ ID NO: 319491 - RNA, 22 nt, Homo sapiens
uucugugguugaaaggagagau

SEQ ID NO: 319492 - RNA, 22 nt, Homo sapiens
cugagugcaagugauccuccca

SEQ ID NO: 319493 - RNA, 22 nt, Homo sapiens
cugauacucuccuuuuagagag

SEQ ID NO: 319494 - RNA, 22 nt, Homo sapiens
cugauuguuugccucuaaaauc

SEQ ID NO: 319495 - RNA, 20 nt, Homo sapiens
cugcuccccuacaaaucuca

SEQ ID NO: 319496 - RNA, 22 nt, Homo sapiens
cuggaagaaaaucacgccaucu

SEQ ID NO: 319497 - RNA, 22 nt, Homo sapiens
cuguucaaauuguuugugaagu

SEQ ID NO: 319498 - RNA, 18 nt, Homo sapiens
cuuaacauugggaugaua

SEQ ID NO: 319499 - RNA, 22 nt, Homo sapiens
cuuaaggccagauaauuucuau

SEQ ID NO: 319500 - RNA, 22 nt, Homo sapiens
cuuaaguaguuguggaaugaau

SEQ ID NO: 319501 - RNA, 22 nt, Homo sapiens
cuuagguaggugccagguuuuu

SEQ ID NO: 319502 - RNA, 22 nt, Homo sapiens
cuucuugagggccugcugggaa

SEQ ID NO: 319503 - RNA, 22 nt, Homo sapiens
cuuuggcaaugucauuuucaau

SEQ ID NO: 319504 - RNA, 22 nt, Homo sapiens
cuuugguuuacuuggugcuagu

SEQ ID NO: 319505 - RNA, 22 nt, Homo sapiens
cuuuguguaggugccucuggcu

SEQ ID NO: 319506 - RNA, 22 nt, Homo sapiens
cuuuugugauucuucaguugcu

SEQ ID NO: 319507 - RNA, 21 nt, Homo sapiens
cuuuuuacucguucauaugca

SEQ ID NO: 319508 - RNA, 22 nt, Homo sapiens
cuuuuugcuagagucuaggguc

SEQ ID NO: 319509 - RNA, 22 nt, Homo sapiens
gacaccauuucaguacuagguu

SEQ ID NO: 319510 - RNA, 22 nt, Homo sapiens
gagaacugagauaagugauauu

SEQ ID NO: 319511 - RNA, 23 nt, Homo sapiens
gagaccagcuucagaaagcacga

SEQ ID NO: 319512 - RNA, 22 nt, Homo sapiens
gagacggagucucgcucugucg

SEQ ID NO: 319513 - RNA, 22 nt, Homo sapiens
gagacggagucuugcucuguug

SEQ ID NO: 319514 - RNA, 22 nt, Homo sapiens
gagauguagucuugcccuguca

SEQ ID NO: 319515 - RNA, 18 nt, Homo sapiens
gagcaccuuuuuugcaga

SEQ ID NO: 319516 - RNA, 22 nt, Homo sapiens
gaggagucagacugugcaaggu

SEQ ID NO: 319517 - RNA, 23 nt, Homo sapiens
gaguggagacucauugauuuccu

SEQ ID NO: 319518 - RNA, 22 nt, Homo sapiens
gaucuguuucaauugucuuagu

SEQ ID NO: 319519 - RNA, 22 nt, Homo sapiens
gaugcaaauuaagcuugggaca

SEQ ID NO: 319520 - RNA, 22 nt, Homo sapiens
gauggaguugucgccugggcug

SEQ ID NO: 319521 - RNA, 22 nt, Homo sapiens
gauguuguuuagccuuugaugu

SEQ ID NO: 319522 - RNA, 22 nt, Homo sapiens
gcagaauugguuucuucuaagg

SEQ ID NO: 319523 - RNA, 22 nt, Homo sapiens
gcagucacagggagauggugac

SEQ ID NO: 319524 - RNA, 22 nt, Homo sapiens
gcagugugauguuuuaaucuau

SEQ ID NO: 319525 - RNA, 22 nt, Homo sapiens
gcagugugugaggaauuugggu

SEQ ID NO: 319526 - RNA, 22 nt, Homo sapiens
gcuaaggcaggagcauugcuug

SEQ ID NO: 319527 - RNA, 22 nt, Homo sapiens
gcuccauuuuccauuucucuaa

SEQ ID NO: 319528 - RNA, 22 nt, Homo sapiens
gcugguauuacaggcaugagcc

SEQ ID NO: 319529 - RNA, 22 nt, Homo sapiens
ggaagacaguguggugauuccu

SEQ ID NO: 319530 - RNA, 22 nt, Homo sapiens
ggauacauuuuuccuccucuuc

SEQ ID NO: 319531 - RNA, 19 nt, Homo sapiens
ggcaagaguuguucugugu

SEQ ID NO: 319532 - RNA, 22 nt, Homo sapiens
gggcaaaacuguacugccaagg

SEQ ID NO: 319533 - RNA, 22 nt, Homo sapiens
ggggaguguggacaucacccug

SEQ ID NO: 319534 - RNA, 22 nt, Homo sapiens
ggucaaguaauccuggguguca

SEQ ID NO: 319535 - RNA, 19 nt, Homo sapiens
ggucacagggguuacaagg

SEQ ID NO: 319536 - RNA, 22 nt, Homo sapiens
guaaaucucuguuuucauggac

SEQ ID NO: 319537 - RNA, 22 nt, Homo sapiens
guaagucucaugagaucugaug

SEQ ID NO: 319538 - RNA, 22 nt, Homo sapiens
guauacuucugaaaauagcuau

SEQ ID NO: 319539 - RNA, 22 nt, Homo sapiens
guauaugccucaguuauagcac

SEQ ID NO: 319540 - RNA, 22 nt, Homo sapiens
guaugcaagugauaugacauau

SEQ ID NO: 319541 - RNA, 19 nt, Homo sapiens
gucaaagucgguauucaaa

SEQ ID NO: 319542 - RNA, 22 nt, Homo sapiens
gucaaguaaauguuaugguuau

SEQ ID NO: 319543 - RNA, 22 nt, Homo sapiens
gucacagaaaaagauaugccaa

SEQ ID NO: 319544 - RNA, 22 nt, Homo sapiens
gucacaguguuuguucauccca

SEQ ID NO: 319545 - RNA, 22 nt, Homo sapiens
gucaguucuugugguugcauuc

SEQ ID NO: 319546 - RNA, 22 nt, Homo sapiens
gucugcaugucauaugauagua

SEQ ID NO: 319547 - RNA, 22 nt, Homo sapiens
gucuguuugauccagaucaaaa

SEQ ID NO: 319548 - RNA, 22 nt, Homo sapiens
gucuuccagccuccaucuuucu

SEQ ID NO: 319549 - RNA, 22 nt, Homo sapiens
gucuugaaggcugaguaccugu

SEQ ID NO: 319550 - RNA, 22 nt, Homo sapiens
gugacagucaaagacaugacuu

SEQ ID NO: 319551 - RNA, 22 nt, Homo sapiens
gugagauuaccauuuaaaucag

SEQ ID NO: 319552 - RNA, 21 nt, Homo sapiens
gugaggaguuacuggcuuuga

SEQ ID NO: 319553 - RNA, 21 nt, Homo sapiens
gugcacaguaguguuuaauag

SEQ ID NO: 319554 - RNA, 22 nt, Homo sapiens
gugccacaguguuaagggauuc

SEQ ID NO: 319555 - RNA, 22 nt, Homo sapiens
gugccacugcacuccggccugg

SEQ ID NO: 319556 - RNA, 22 nt, Homo sapiens
guggacaugaauuuuggaggca

SEQ ID NO: 319557 - RNA, 22 nt, Homo sapiens
gugggcaaagcuaguguguaga

SEQ ID NO: 319558 - RNA, 21 nt, Homo sapiens
gugugcuugaauucagcuguc

SEQ ID NO: 319559 - RNA, 22 nt, Homo sapiens
guguucauggaauuugcaauug

SEQ ID NO: 319560 - RNA, 22 nt, Homo sapiens
guuauguuaaauuguuguaugc

SEQ ID NO: 319561 - RNA, 22 nt, Homo sapiens
guucaagugauucuacugccuc

SEQ ID NO: 319562 - RNA, 22 nt, Homo sapiens
guucaaguuuucucuugugggu

SEQ ID NO: 319563 - RNA, 22 nt, Homo sapiens
guuccuuguagaugcuggauau

SEQ ID NO: 319564 - RNA, 22 nt, Homo sapiens
guugcaauugauguaugucuga

SEQ ID NO: 319565 - RNA, 22 nt, Homo sapiens
guugcucaggccggagugcagu

SEQ ID NO: 319566 - RNA, 22 nt, Homo sapiens
guuuaggaaugagaauauuuag

SEQ ID NO: 319567 - RNA, 21 nt, Homo sapiens
uaaagcuuagcuauaguggcu

SEQ ID NO: 319568 - RNA, 21 nt, Homo sapiens
uaaaugucauacaaagcaaug

SEQ ID NO: 319569 - RNA, 18 nt, Homo sapiens
uaaauugcuucaccugag

SEQ ID NO: 319570 - RNA, 16 nt, Homo sapiens
uaacacaguucccacc

SEQ ID NO: 319571 - RNA, 22 nt, Homo sapiens
uucacgguguucacgggggucc

SEQ ID NO: 319572 - RNA, 22 nt, Homo sapiens
uucacugugcuuaaauucugcu

SEQ ID NO: 319573 - RNA, 22 nt, Homo sapiens
uucagaguggacagaaauuaag

SEQ ID NO: 319574 - RNA, 22 nt, Homo sapiens
uucaggcuccgugccagcuccg

SEQ ID NO: 319575 - RNA, 22 nt, Homo sapiens
uucagugucauuaacacaguag

SEQ ID NO: 319576 - RNA, 22 nt, Homo sapiens
uucauagucuaugcaaguaaga

SEQ ID NO: 319577 - RNA, 22 nt, Homo sapiens
uucauguaauuccauaagguaa

SEQ ID NO: 319578 - RNA, 22 nt, Homo sapiens
uuccacaaugguugaacuagcu

SEQ ID NO: 319579 - RNA, 22 nt, Homo sapiens
uuccacaaugguugaacuaguu

SEQ ID NO: 319580 - RNA, 22 nt, Homo sapiens
uuccagagucaccuuucugucg

SEQ ID NO: 319581 - RNA, 22 nt, Homo sapiens
uuccuuguagcaaaugcgauga

SEQ ID NO: 319582 - RNA, 22 nt, Homo sapiens
uuccuuguuuauuuacaggagg

SEQ ID NO: 319583 - RNA, 22 nt, Homo sapiens
uucuggcuuauaaacgugacuu

SEQ ID NO: 319584 - RNA, 22 nt, Homo sapiens
uucuuuggaaacaguacuaauu

SEQ ID NO: 319585 - RNA, 22 nt, Homo sapiens
uucuuuggauaaaguuuuaugc

SEQ ID NO: 319586 - RNA, 22 nt, Homo sapiens
uugaaaguaaacaucacaaaga

SEQ ID NO: 319587 - RNA, 22 nt, Homo sapiens
uugacaaggagugggguugaga

SEQ ID NO: 319588 - RNA, 22 nt, Homo sapiens
uugacauaguuucugaaauaga

SEQ ID NO: 319589 - RNA, 22 nt, Homo sapiens
uugagauggagccucacucugc

SEQ ID NO: 319590 - RNA, 22 nt, Homo sapiens
uugagauggagcuucacucuug

SEQ ID NO: 319591 - RNA, 22 nt, Homo sapiens
uugagauggagucucacucuuc

SEQ ID NO: 319592 - RNA, 22 nt, Homo sapiens
uugagauggagucucacucuuu

SEQ ID NO: 319593 - RNA, 22 nt, Homo sapiens
uugagauggagucuugcucucu

SEQ ID NO: 319594 - RNA, 22 nt, Homo sapiens
uugagauggagucuugcucuug

SEQ ID NO: 319595 - RNA, 22 nt, Homo sapiens
uugagauggaguguugcucugu

SEQ ID NO: 319596 - RNA, 22 nt, Homo sapiens
uugagauggaguuucacucugu

SEQ ID NO: 319597 - RNA, 22 nt, Homo sapiens
uugagauggaguuucgcucuuu

SEQ ID NO: 319598 - RNA, 22 nt, Homo sapiens
uugagggagcacagauucuuau

SEQ ID NO: 319599 - RNA, 22 nt, Homo sapiens
uugagguggugucuugcucugu

SEQ ID NO: 319600 - RNA, 22 nt, Homo sapiens
uugcaaacaucuuguuucacau

SEQ ID NO: 319601 - RNA, 22 nt, Homo sapiens
uuggaaugcaacagaaggauaa

SEQ ID NO: 319602 - RNA, 22 nt, Homo sapiens
uuggacugagaguuccaccauu

SEQ ID NO: 319603 - RNA, 22 nt, Homo sapiens
uuggucaucucccuccuuuuag

SEQ ID NO: 319604 - RNA, 23 nt, Homo sapiens
uuguacacuaagaaucgcagaug

SEQ ID NO: 319605 - RNA, 22 nt, Homo sapiens
uuguagcaaauguguaaacaaa

SEQ ID NO: 319606 - RNA, 22 nt, Homo sapiens
uugucacucuuccuaggguagg

SEQ ID NO: 319607 - RNA, 22 nt, Homo sapiens
uugucacugcacuccagucugg

SEQ ID NO: 319608 - RNA, 22 nt, Homo sapiens
uugucaguguucacucaaagcu

SEQ ID NO: 319609 - RNA, 22 nt, Homo sapiens
uuuaaggcaggucuggugguga

SEQ ID NO: 319610 - RNA, 22 nt, Homo sapiens
uuuacugugggguuucuuagag

SEQ ID NO: 319611 - RNA, 22 nt, Homo sapiens
uuuagcaauucauuuugugucu

SEQ ID NO: 319612 - RNA, 22 nt, Homo sapiens
uuuaggcaauauauucaugucu

SEQ ID NO: 319613 - RNA, 22 nt, Homo sapiens
agaaagugcuucccuuugguga

SEQ ID NO: 319614 - RNA, 22 nt, Homo sapiens
agacaguauuggcaaagugugu

SEQ ID NO: 319615 - RNA, 22 nt, Homo sapiens
agacuguaaugcauaauuuacu

SEQ ID NO: 319616 - RNA, 22 nt, Homo sapiens
agagacauugcuccaacucacc

SEQ ID NO: 319617 - RNA, 22 nt, Homo sapiens
agagauaauuagguuaaaugag

SEQ ID NO: 319618 - RNA, 22 nt, Homo sapiens
agagcacuguggguccaaauau

SEQ ID NO: 319619 - RNA, 19 nt, Homo sapiens
agcagaacaaauguguggg

SEQ ID NO: 319620 - RNA, 22 nt, Homo sapiens
agcagcaucgggaaguuggcca

SEQ ID NO: 319621 - RNA, 22 nt, Homo sapiens
agcagcauuaugauauaucuua

SEQ ID NO: 319622 - RNA, 22 nt, Homo sapiens
agcagugucauuuucuggugag

SEQ ID NO: 319623 - RNA, 18 nt, Homo sapiens
agcaucacugaucauccu

SEQ ID NO: 319624 - RNA, 22 nt, Homo sapiens
agcugugucuucuuaaagauuu

SEQ ID NO: 319625 - RNA, 22 nt, Homo sapiens
aggaagacugaaauugcuguuc

SEQ ID NO: 319626 - RNA, 21 nt, Homo sapiens
aggagauguuuguccuuuuag

SEQ ID NO: 319627 - RNA, 22 nt, Homo sapiens
aggagguagggugugaaacagc

SEQ ID NO: 319628 - RNA, 22 nt, Homo sapiens
agggaagugugcuaugcauuua

SEQ ID NO: 319629 - RNA, 22 nt, Homo sapiens
agguaauagcacaugauaccuu

SEQ ID NO: 319630 - RNA, 22 nt, Homo sapiens
auaaugcuggaacuagagggca

SEQ ID NO: 319631 - RNA, 22 nt, Homo sapiens
auacagugaauaucuggggcag

SEQ ID NO: 319632 - RNA, 22 nt, Homo sapiens
auacaugugccauguugguaug

SEQ ID NO: 319633 - RNA, 20 nt, Homo sapiens
auagcagcaugauuuauaau

SEQ ID NO: 319634 - RNA, 22 nt, Homo sapiens
auaggcaagaugagguuuuuau

SEQ ID NO: 319635 - RNA, 21 nt, Homo sapiens
auagggcuuguugauaguuaa

SEQ ID NO: 319636 - RNA, 22 nt, Homo sapiens
auauaugcuaagugcuaauaaa

SEQ ID NO: 319637 - RNA, 22 nt, Homo sapiens
aucaaaguaucucaauauggua

SEQ ID NO: 319638 - RNA, 22 nt, Homo sapiens
aucacagaacuuugagcagaga

SEQ ID NO: 319639 - RNA, 22 nt, Homo sapiens
aucaccagaugcuucaagcaga

SEQ ID NO: 319640 - RNA, 22 nt, Homo sapiens
aucagaaucucuugagaguguu

SEQ ID NO: 319641 - RNA, 22 nt, Homo sapiens
auccucaguggcuuaaguauag

SEQ ID NO: 319642 - RNA, 22 nt, Homo sapiens
auccuuuagacuguccaguuga

SEQ ID NO: 319643 - RNA, 22 nt, Homo sapiens
aucgugucuggcccugaaugcu

SEQ ID NO: 319644 - RNA, 21 nt, Homo sapiens
aucucacuugaauguaaaagc

SEQ ID NO: 319645 - RNA, 22 nt, Homo sapiens
aucugcauucccauguuuauug

SEQ ID NO: 319646 - RNA, 22 nt, Homo sapiens
aucuucucuugaagggugggga

SEQ ID NO: 319647 - RNA, 22 nt, Homo sapiens
aucuuugauuagacugauggau

SEQ ID NO: 319648 - RNA, 22 nt, Homo sapiens
aucuuuggugaguucuuugguc

SEQ ID NO: 319649 - RNA, 22 nt, Homo sapiens
augaaaacaugauuugccuguu

SEQ ID NO: 319650 - RNA, 22 nt, Homo sapiens
augacaaugaaucccuguuuca

SEQ ID NO: 319651 - RNA, 22 nt, Homo sapiens
augacaguguggauuauuguaa

SEQ ID NO: 319652 - RNA, 22 nt, Homo sapiens
augagaaugauucuguuauggu

SEQ ID NO: 319653 - RNA, 22 nt, Homo sapiens
augagacaguucccuuuaucuu

SEQ ID NO: 319654 - RNA, 22 nt, Homo sapiens
augagauuauguaaagagacca

SEQ ID NO: 319655 - RNA, 22 nt, Homo sapiens
augaggugggagaaucacuuga

SEQ ID NO: 319656 - RNA, 22 nt, Homo sapiens
augauacugaguugaguucuca

SEQ ID NO: 319657 - RNA, 22 nt, Homo sapiens
ccaggguugcuuuagauucuga

SEQ ID NO: 319658 - RNA, 19 nt, Homo sapiens
ccuuugguuuccaugacau

SEQ ID NO: 319659 - RNA, 22 nt, Homo sapiens
cuagcuccauauaaagcaggau

SEQ ID NO: 319660 - RNA, 22 nt, Homo sapiens
cuauuacuuuuauugaacucag

SEQ ID NO: 319661 - RNA, 21 nt, Homo sapiens
cucaaaguacugauauuacag

SEQ ID NO: 319662 - RNA, 22 nt, Homo sapiens
cucaaaguacuuugguuauugu

SEQ ID NO: 319663 - RNA, 22 nt, Homo sapiens
cucaaguaauccucccgccuug

SEQ ID NO: 319664 - RNA, 22 nt, Homo sapiens
cucacagugacacgaaccccca

SEQ ID NO: 319665 - RNA, 22 nt, Homo sapiens
cucacugugguguccuuaggua

SEQ ID NO: 319666 - RNA, 22 nt, Homo sapiens
cucccagagccaguuauaggcu

SEQ ID NO: 319667 - RNA, 22 nt, Homo sapiens
cucugauggagauauacaagga

SEQ ID NO: 319668 - RNA, 22 nt, Homo sapiens
cucugguggaagcagggggcaa

SEQ ID NO: 319669 - RNA, 22 nt, Homo sapiens
cucuuuuguuuagcugagaggg

SEQ ID NO: 319670 - RNA, 20 nt, Homo sapiens
gugacacucguuaaccucug

SEQ ID NO: 319671 - RNA, 22 nt, Homo sapiens
gugacacuggagcuggcacaau

SEQ ID NO: 319672 - RNA, 21 nt, Homo sapiens
gugcaaacaucauagaaugua

SEQ ID NO: 319673 - RNA, 22 nt, Homo sapiens
gugcaaacuccaggucucuuca

SEQ ID NO: 319674 - RNA, 22 nt, Homo sapiens
gugcaguuugaaaguagaaaca

SEQ ID NO: 319675 - RNA, 22 nt, Homo sapiens
guggaaguuaagugacuuucug

SEQ ID NO: 319676 - RNA, 22 nt, Homo sapiens
guggacagagacuaaauguugu

SEQ ID NO: 319677 - RNA, 22 nt, Homo sapiens
guggacggagguugcagugagc

SEQ ID NO: 319678 - RNA, 22 nt, Homo sapiens
guguaaaucugcugugaacauu

SEQ ID NO: 319679 - RNA, 22 nt, Homo sapiens
guguccucgaguacacaucagg

SEQ ID NO: 319680 - RNA, 22 nt, Homo sapiens
gugucuccuguggagcuaugua

SEQ ID NO: 319681 - RNA, 18 nt, Homo sapiens
aaaaagugcucaggccua

SEQ ID NO: 319682 - RNA, 22 nt, Homo sapiens
aaaagcauucagagugcugggc

SEQ ID NO: 319683 - RNA, 22 nt, Homo sapiens
aaaagcuuagaugggcuuguau

SEQ ID NO: 319684 - RNA, 22 nt, Homo sapiens
aaacauugaccucauccuggca

SEQ ID NO: 319685 - RNA, 22 nt, Homo sapiens
aaaccacagugugcugcugggg

SEQ ID NO: 319686 - RNA, 18 nt, Homo sapiens
aaacugcuuccuuggccu

SEQ ID NO: 319687 - RNA, 22 nt, Homo sapiens
aaaggaccacauauaugguggc

SEQ ID NO: 319688 - RNA, 22 nt, Homo sapiens
aaaguacucaguucaguuccgu

SEQ ID NO: 319689 - RNA, 22 nt, Homo sapiens
aaaugcaucauuaggugauuuu

SEQ ID NO: 319690 - RNA, 22 nt, Homo sapiens
aaauggauuaaguucacuugcu

SEQ ID NO: 319691 - RNA, 22 nt, Homo sapiens
aaaugguguuaguagaucuuua

SEQ ID NO: 319692 - RNA, 22 nt, Homo sapiens
aacaccaucccuuugaugcuuu

SEQ ID NO: 319693 - RNA, 22 nt, Homo sapiens
aacacuguuuccagucaugauc

SEQ ID NO: 319694 - RNA, 22 nt, Homo sapiens
aacaggguggugccugguccau

SEQ ID NO: 319695 - RNA, 22 nt, Homo sapiens
aaccuacauucuuaacuguugc

SEQ ID NO: 319696 - RNA, 22 nt, Homo sapiens
aagagaugaagguccugacugu

SEQ ID NO: 319697 - RNA, 22 nt, Homo sapiens
aaggaauucaaauuuucucugg

SEQ ID NO: 319698 - RNA, 22 nt, Homo sapiens
aaguacuguuuaaauugcagaa

SEQ ID NO: 319699 - RNA, 22 nt, Homo sapiens
aaguauuagugaggauauggaa

SEQ ID NO: 319700 - RNA, 22 nt, Homo sapiens
aagugcauguauuaguguaguc

SEQ ID NO: 319701 - RNA, 22 nt, Homo sapiens
aagugcuuuuuagauaugguuu

SEQ ID NO: 319702 - RNA, 22 nt, Homo sapiens
aagugucuuaccgggagggagu

SEQ ID NO: 319703 - RNA, 21 nt, Homo sapiens
aauacucuagguuaagagagc

SEQ ID NO: 319704 - RNA, 22 nt, Homo sapiens
aauacugaaaguauuuucaaau

SEQ ID NO: 319705 - RNA, 22 nt, Homo sapiens
aaucagcacacugugcuuucca

SEQ ID NO: 319706 - RNA, 22 nt, Homo sapiens
aaucuguagaaggugcacauuc

SEQ ID NO: 319707 - RNA, 22 nt, Homo sapiens
aaugcacauauauuuccuuauu

SEQ ID NO: 319708 - RNA, 22 nt, Homo sapiens
acaaaguguuuucugaaggccu

SEQ ID NO: 319709 - RNA, 22 nt, Homo sapiens
acacuguauccuucuguccuuu

SEQ ID NO: 319710 - RNA, 22 nt, Homo sapiens
acacugucucuugcugaccaug

SEQ ID NO: 319711 - RNA, 22 nt, Homo sapiens
acacuuucuggagcugcacaua

SEQ ID NO: 319712 - RNA, 22 nt, Homo sapiens
acagugucaugucguguucccc

SEQ ID NO: 319713 - RNA, 18 nt, Homo sapiens
acaguguguaaggguucu

SEQ ID NO: 319714 - RNA, 22 nt, Homo sapiens
acauaguagacacugaaaauau

SEQ ID NO: 319715 - RNA, 22 nt, Homo sapiens
acaucccaugccuggguacucc

SEQ ID NO: 319716 - RNA, 22 nt, Homo sapiens
acauguagacaacggacaaagu

SEQ ID NO: 319717 - RNA, 22 nt, Homo sapiens
acccagaauucagucuuaggcc

SEQ ID NO: 319718 - RNA, 18 nt, Homo sapiens
acccuucagcacugggcc

SEQ ID NO: 319719 - RNA, 21 nt, Homo sapiens
acugcacuccaaccucaacag

SEQ ID NO: 319720 - RNA, 22 nt, Homo sapiens
acugcauuugguaaagucaaga

SEQ ID NO: 319721 - RNA, 18 nt, Homo sapiens
acuggauguaaagggucc

SEQ ID NO: 319722 - RNA, 22 nt, Homo sapiens
acuuugguuuauagaauuuagg

SEQ ID NO: 319723 - RNA, 22 nt, Homo sapiens
aaagcacuggagucaucaucua

SEQ ID NO: 319724 - RNA, 22 nt, Homo sapiens
aaagcuaccagauucuguugga

SEQ ID NO: 319725 - RNA, 22 nt, Homo sapiens
aaagugcugggaucacacugaa

SEQ ID NO: 319726 - RNA, 22 nt, Homo sapiens
aaaugcauugagggaaaaggca

SEQ ID NO: 319727 - RNA, 20 nt, Homo sapiens
aaaugcuguaauguuuggga

SEQ ID NO: 319728 - RNA, 22 nt, Homo sapiens
aaaugcuuucuuggaccauuug

SEQ ID NO: 319729 - RNA, 22 nt, Homo sapiens
aaauucaugucaccucuaggua

SEQ ID NO: 319730 - RNA, 22 nt, Homo sapiens
aacagacugucacauaaaauug

SEQ ID NO: 319731 - RNA, 22 nt, Homo sapiens
aacaggcuccuaggggugcacc

SEQ ID NO: 319732 - RNA, 22 nt, Homo sapiens
aacucugucuccuucaaguuca

SEQ ID NO: 319733 - RNA, 22 nt, Homo sapiens
aagagguaggaaauggucauuu

SEQ ID NO: 319734 - RNA, 22 nt, Homo sapiens
aagcaccaauaggagauuuguc

SEQ ID NO: 319735 - RNA, 22 nt, Homo sapiens
aaggagugugauucuucaguuu

SEQ ID NO: 319736 - RNA, 22 nt, Homo sapiens
aaggcagucacuaaauagugag

SEQ ID NO: 319737 - RNA, 22 nt, Homo sapiens
aaggcaguggcagaagauguca

SEQ ID NO: 319738 - RNA, 22 nt, Homo sapiens
aagggaauguuguggcugguug

SEQ ID NO: 319739 - RNA, 22 nt, Homo sapiens
aagggaauguuguggcugguuu

SEQ ID NO: 319740 - RNA, 22 nt, Homo sapiens
aaguauuagcuaauugugcuua

SEQ ID NO: 319741 - RNA, 22 nt, Homo sapiens
aaguauuaugaguccuuguuuu

SEQ ID NO: 319742 - RNA, 22 nt, Homo sapiens
aauaagcugagagaauucuaca

SEQ ID NO: 319743 - RNA, 22 nt, Homo sapiens
aauacuuccaaaucuagucauu

SEQ ID NO: 319744 - RNA, 22 nt, Homo sapiens
aaucacauugaaucugcuaccu

SEQ ID NO: 319745 - RNA, 22 nt, Homo sapiens
aaugucaucuucaguuguacag

SEQ ID NO: 319746 - RNA, 22 nt, Homo sapiens
aaugugccuacagugggcuguu

SEQ ID NO: 319747 - RNA, 22 nt, Homo sapiens
aauucuguauuguuuagggacu

SEQ ID NO: 319748 - RNA, 22 nt, Homo sapiens
aauucugugagauggugcagau

SEQ ID NO: 319749 - RNA, 22 nt, Homo sapiens
aauuggugaccaagggaaggac

SEQ ID NO: 319750 - RNA, 22 nt, Homo sapiens
acaaagugccuccuuuuagagu

SEQ ID NO: 319751 - RNA, 22 nt, Homo sapiens
acacagugucuguguauuuaaa

SEQ ID NO: 319752 - RNA, 22 nt, Homo sapiens
acacuguaacucuuugagggca

SEQ ID NO: 319753 - RNA, 22 nt, Homo sapiens
acacuguagcugagggcaugcg

SEQ ID NO: 319754 - RNA, 22 nt, Homo sapiens
acagaauucucagaacugggag

SEQ ID NO: 319755 - RNA, 18 nt, Homo sapiens
acagugucuuacaccugu

SEQ ID NO: 319756 - RNA, 22 nt, Homo sapiens
acaucauugggggcuacaggug

SEQ ID NO: 319757 - RNA, 22 nt, Homo sapiens
acccuacauaguagauccuaca

SEQ ID NO: 319758 - RNA, 22 nt, Homo sapiens
acccuggaguaguaggaaucug

SEQ ID NO: 319759 - RNA, 22 nt, Homo sapiens
acucuguauaaacauugcugua

SEQ ID NO: 319760 - RNA, 21 nt, Homo sapiens
acugagagaucuggggcacau

SEQ ID NO: 319761 - RNA, 22 nt, Homo sapiens
acugagccuuuaaaugacuuca

SEQ ID NO: 319762 - RNA, 21 nt, Homo sapiens
acugauguuugaaauucgcug

SEQ ID NO: 319763 - RNA, 22 nt, Homo sapiens
acugcauaaauauguguaauau

SEQ ID NO: 319764 - RNA, 21 nt, Homo sapiens
acuuucuguggcaguccauuc

SEQ ID NO: 319765 - RNA, 22 nt, Homo sapiens
acuuugguuaucauacuuucag

SEQ ID NO: 319766 - RNA, 22 nt, Homo sapiens
agaauaauguccccccaaggga

SEQ ID NO: 319767 - RNA, 22 nt, Homo sapiens
agaauucugucauguuuauauu

SEQ ID NO: 319768 - RNA, 22 nt, Homo sapiens
agacagcugguagcacuuccug

SEQ ID NO: 319769 - RNA, 21 nt, Homo sapiens
agagaacugaaacaugugacu

SEQ ID NO: 319770 - RNA, 22 nt, Homo sapiens
uuguguuuuuaguagggaaggg

SEQ ID NO: 319771 - RNA, 22 nt, Homo sapiens
uuuaaaguuagaaggaaagggc

SEQ ID NO: 319772 - RNA, 22 nt, Homo sapiens
uuuaaggcacuucaugguuuca

SEQ ID NO: 319773 - RNA, 22 nt, Homo sapiens
uuuaaggcaugccuguacaugc

SEQ ID NO: 319774 - RNA, 22 nt, Homo sapiens
uuuaaguguuuguuccugaaaa

SEQ ID NO: 319775 - RNA, 22 nt, Homo sapiens
uuuagguauuugguauagcagu

SEQ ID NO: 319776 - RNA, 22 nt, Homo sapiens
uuuaucuguuuaaaacuguuca

SEQ ID NO: 319777 - RNA, 22 nt, Homo sapiens
uuuauguggagcacuugacaca

SEQ ID NO: 319778 - RNA, 23 nt, Homo sapiens
uuucaggcaggugaaagaccagc

SEQ ID NO: 319779 - RNA, 19 nt, Homo sapiens
uuucauguuuuuggugaga

SEQ ID NO: 319780 - RNA, 22 nt, Homo sapiens
uuucugcuugagagaauugcug

SEQ ID NO: 319781 - RNA, 21 nt, Homo sapiens
uuugaucauuaaaagugaauc

SEQ ID NO: 319782 - RNA, 22 nt, Homo sapiens
uuuggcaugggcuauuugcuuu

SEQ ID NO: 319783 - RNA, 22 nt, Homo sapiens
uuuggcuauguuguaucuuucc

SEQ ID NO: 319784 - RNA, 21 nt, Homo sapiens
uuuguaguagcaugauuuaua

SEQ ID NO: 319785 - RNA, 23 nt, Homo sapiens
uuuguaguagcaugauuuauaau

SEQ ID NO: 319786 - RNA, 19 nt, Homo sapiens
uuuguccugcccuuucuca

SEQ ID NO: 319787 - RNA, 22 nt, Homo sapiens
uuugugcuccuguugagaaucu

SEQ ID NO: 319788 - RNA, 22 nt, Homo sapiens
uuuguucuucguuccugagcca

SEQ ID NO: 319789 - RNA, 22 nt, Homo sapiens
uuuugcaguuacagagagugag

SEQ ID NO: 319790 - RNA, 22 nt, Homo sapiens
uuuuuuaguuagcugggcauga

SEQ ID NO: 319791 - RNA, 22 nt, Homo sapiens
augaucaucugaaagcuuuuac

SEQ ID NO: 319792 - RNA, 22 nt, Homo sapiens
augcaaacagcuaucuggcugg

SEQ ID NO: 319793 - RNA, 22 nt, Homo sapiens
augcaaacaucauagaguguac

SEQ ID NO: 319794 - RNA, 22 nt, Homo sapiens
augcaagaaauaucucuuuuuc

SEQ ID NO: 319795 - RNA, 18 nt, Homo sapiens
augcauauuuuaaguugu

SEQ ID NO: 319796 - RNA, 22 nt, Homo sapiens
augccacugcacuucagcuugg

SEQ ID NO: 319797 - RNA, 22 nt, Homo sapiens
auggaagcugauuagauaguac

SEQ ID NO: 319798 - RNA, 22 nt, Homo sapiens
auggaaggagaggaaugaauga

SEQ ID NO: 319799 - RNA, 22 nt, Homo sapiens
auggcaaaaaaugcaauuacuu

SEQ ID NO: 319800 - RNA, 18 nt, Homo sapiens
auggcagaacaauuuaca

SEQ ID NO: 319801 - RNA, 22 nt, Homo sapiens
auggucuuuuuguuaugagaga

SEQ ID NO: 319802 - RNA, 20 nt, Homo sapiens
auucaaguaugccuugagaa

SEQ ID NO: 319803 - RNA, 22 nt, Homo sapiens
auuccaguuugugagaagcugu

SEQ ID NO: 319804 - RNA, 22 nt, Homo sapiens
auuccuuaggcccuuugguuag

SEQ ID NO: 319805 - RNA, 22 nt, Homo sapiens
auucuauaguccuaggauuggg

SEQ ID NO: 319806 - RNA, 22 nt, Homo sapiens
auugcacaucugcacuacagcc

SEQ ID NO: 319807 - RNA, 22 nt, Homo sapiens
caaagucuucaguugauucuga

SEQ ID NO: 319808 - RNA, 22 nt, Homo sapiens
cacaaaguagauuagucuucca

SEQ ID NO: 319809 - RNA, 22 nt, Homo sapiens
cacccaguaagcaugaggcccu

SEQ ID NO: 319810 - RNA, 22 nt, Homo sapiens
caccgagguuggagugcagugg

SEQ ID NO: 319811 - RNA, 22 nt, Homo sapiens
caguaguagccccuuagaugga

SEQ ID NO: 319812 - RNA, 22 nt, Homo sapiens
cagucacugggauuauggucau

SEQ ID NO: 319813 - RNA, 22 nt, Homo sapiens
cagugucugcauuuggaacuca

SEQ ID NO: 319814 - RNA, 22 nt, Homo sapiens
caucacaugcuuauuuuccuca

SEQ ID NO: 319815 - RNA, 22 nt, Homo sapiens
caugacacuggcauguuucuuu

SEQ ID NO: 319816 - RNA, 22 nt, Homo sapiens
caugccacuguggacaaagaca

SEQ ID NO: 319817 - RNA, 22 nt, Homo sapiens
cauggcacagagaauguguucu

SEQ ID NO: 319818 - RNA, 22 nt, Homo sapiens
cauugcaacuucugccucccag

SEQ ID NO: 319819 - RNA, 22 nt, Homo sapiens
cauugguuuuucaggaguauau

SEQ ID NO: 319820 - RNA, 22 nt, Homo sapiens
ccagcaccauuuauuaaauagg

SEQ ID NO: 319821 - RNA, 22 nt, Homo sapiens
ccaucacaggccucagugggaa

SEQ ID NO: 319822 - RNA, 18 nt, Homo sapiens
cccagugacuuauggccu

SEQ ID NO: 319823 - RNA, 22 nt, Homo sapiens
cccugagaugugaauuucagag

SEQ ID NO: 319824 - RNA, 21 nt, Homo sapiens
ccugaagaagugaccucugag

SEQ ID NO: 319825 - RNA, 22 nt, Homo sapiens
ccugucuugaagagauccuccu

SEQ ID NO: 319826 - RNA, 22 nt, Homo sapiens
ccuucauccuccagcaggcuag

SEQ ID NO: 319827 - RNA, 21 nt, Homo sapiens
ccuugagaacaucaauuugcu

SEQ ID NO: 319828 - RNA, 22 nt, Homo sapiens
cuaaaguucuucugagagaaca

SEQ ID NO: 319829 - RNA, 22 nt, Homo sapiens
cuaaucugugcauagaagaggc

SEQ ID NO: 319830 - RNA, 22 nt, Homo sapiens
cuaauucuggccaaagggauaa

SEQ ID NO: 319831 - RNA, 22 nt, Homo sapiens
cuacaguuauguuuuaaaugug

SEQ ID NO: 319832 - RNA, 22 nt, Homo sapiens
cuagcaggcaagauaagauuca

SEQ ID NO: 319833 - RNA, 18 nt, Homo sapiens
cuaguguuucuugaauca

SEQ ID NO: 319834 - RNA, 22 nt, Homo sapiens
cucaaagucaagggaaagcagg

SEQ ID NO: 319835 - RNA, 22 nt, Homo sapiens
cucaaagugcugggacuggcug

SEQ ID NO: 319836 - RNA, 22 nt, Homo sapiens
cucaaagugcugggauuggcca

SEQ ID NO: 319837 - RNA, 19 nt, Homo sapiens
cucaaagugguauuuggag

SEQ ID NO: 319838 - RNA, 22 nt, Homo sapiens
cucaaaguguggucuguggguu

SEQ ID NO: 319839 - RNA, 22 nt, Homo sapiens
cucacagucucucccuaauuuu

SEQ ID NO: 319840 - RNA, 22 nt, Homo sapiens
cucacaguucuaaaggcaagaa

SEQ ID NO: 319841 - RNA, 22 nt, Homo sapiens
ucaggcacuaguaagaaaaagg

SEQ ID NO: 319842 - RNA, 21 nt, Homo sapiens
ucagugcaauucuauggggaa

SEQ ID NO: 319843 - RNA, 22 nt, Homo sapiens
ucauuguccaacuucuuucagu

SEQ ID NO: 319844 - RNA, 22 nt, Homo sapiens
uccacaguaaggacccugccuu

SEQ ID NO: 319845 - RNA, 19 nt, Homo sapiens
ucccaagaugcucauacau

SEQ ID NO: 319846 - RNA, 22 nt, Homo sapiens
ucccagugcuaugcaaaagccu

SEQ ID NO: 319847 - RNA, 22 nt, Homo sapiens
ucccaguggucuugaaacaggg

SEQ ID NO: 319848 - RNA, 22 nt, Homo sapiens
uccccugagaacuugcuagaaa

SEQ ID NO: 319849 - RNA, 22 nt, Homo sapiens
uccccugauaccaaccaccaug

SEQ ID NO: 319850 - RNA, 22 nt, Homo sapiens
ucccugaaaauuagcauuuuaa

SEQ ID NO: 319851 - RNA, 22 nt, Homo sapiens
uccuuuaguuaauaaagacaag

SEQ ID NO: 319852 - RNA, 22 nt, Homo sapiens
ucucuguuuagagccagcaauu

SEQ ID NO: 319853 - RNA, 22 nt, Homo sapiens
ucugacucugugaugggcccaa

SEQ ID NO: 319854 - RNA, 22 nt, Homo sapiens
ucuggccccucccaaaucucau

SEQ ID NO: 319855 - RNA, 22 nt, Homo sapiens
ucuggccccucucaaaucucau

SEQ ID NO: 319856 - RNA, 22 nt, Homo sapiens
ucugggguuagucaaagguaug

SEQ ID NO: 319857 - RNA, 22 nt, Homo sapiens
ucuguacuccuugaguagugcu

SEQ ID NO: 319858 - RNA, 22 nt, Homo sapiens
ucugucuuguccucacccuaga

SEQ ID NO: 319859 - RNA, 22 nt, Homo sapiens
ucugucuuugccuaaguuuguc

SEQ ID NO: 319860 - RNA, 22 nt, Homo sapiens
ucugugcugagaguugaaaguu

SEQ ID NO: 319861 - RNA, 22 nt, Homo sapiens
ucuuagguaagaaauuuuaaca

SEQ ID NO: 319862 - RNA, 22 nt, Homo sapiens
ucuucagucauauuggccugga

SEQ ID NO: 319863 - RNA, 22 nt, Homo sapiens
ucuugguuuauugauggagagg

SEQ ID NO: 319864 - RNA, 22 nt, Homo sapiens
ucuuucacuuagcaugauguuu

SEQ ID NO: 319865 - RNA, 22 nt, Homo sapiens
ucuuugguagaagcuauuuuau

SEQ ID NO: 319866 - RNA, 22 nt, Homo sapiens
ucuuugguaugugcaugugcuu

SEQ ID NO: 319867 - RNA, 22 nt, Homo sapiens
ucuuuggucagaaagauuacac

SEQ ID NO: 319868 - RNA, 22 nt, Homo sapiens
ucuuugguuucugucucuguaa

SEQ ID NO: 319869 - RNA, 22 nt, Homo sapiens
ugacauggagggugcggcugca

SEQ ID NO: 319870 - RNA, 22 nt, Homo sapiens
ugacauggugcucuuucaggca

SEQ ID NO: 319871 - RNA, 22 nt, Homo sapiens
ugacauguauuagcucagugcu

SEQ ID NO: 319872 - RNA, 22 nt, Homo sapiens
ugacauguccaggugguccugu

SEQ ID NO: 319873 - RNA, 21 nt, Homo sapiens
ugacauguugguuugcugcac

SEQ ID NO: 319874 - RNA, 22 nt, Homo sapiens
ugacuaggaggcuggaggauga

SEQ ID NO: 319875 - RNA, 22 nt, Homo sapiens
ugagaagugacgcagcaggguu

SEQ ID NO: 319876 - RNA, 22 nt, Homo sapiens
ugagacggagucuugcucuguc

SEQ ID NO: 319877 - RNA, 22 nt, Homo sapiens
ugagagaugaacuauucuugaa

SEQ ID NO: 319878 - RNA, 22 nt, Homo sapiens
ugagauaggaucuugcucuguu

SEQ ID NO: 319879 - RNA, 22 nt, Homo sapiens
ugagaugaugggauaagagggc

SEQ ID NO: 319880 - RNA, 20 nt, Homo sapiens
ugagaugcauugggauguuu

SEQ ID NO: 319881 - RNA, 22 nt, Homo sapiens
ugauauuuuugauccuuaaguu

SEQ ID NO: 319882 - RNA, 22 nt, Homo sapiens
ugaugacacugauuucuucaau

SEQ ID NO: 319883 - RNA, 22 nt, Homo sapiens
ugcaagaaacauauuccacaag

SEQ ID NO: 319884 - RNA, 22 nt, Homo sapiens
ugcagagucuguccugccugcc

SEQ ID NO: 319885 - RNA, 22 nt, Homo sapiens
ugcauauguauacaugugccau

SEQ ID NO: 319886 - RNA, 22 nt, Homo sapiens
aucagugaaagugaaaucuccg

SEQ ID NO: 319887 - RNA, 22 nt, Homo sapiens
aucagugagugguuagugaaug

SEQ ID NO: 319888 - RNA, 22 nt, Homo sapiens
aucagugauugauuuaaagacg

SEQ ID NO: 319889 - RNA, 22 nt, Homo sapiens
aucagugcagugggaacuagaa

SEQ ID NO: 319890 - RNA, 22 nt, Homo sapiens
aucagugcauguuuguugagcu

SEQ ID NO: 319891 - RNA, 22 nt, Homo sapiens
aucaucaugcacuacagccugg

SEQ ID NO: 319892 - RNA, 22 nt, Homo sapiens
aucauccagccccagaagggag

SEQ ID NO: 319893 - RNA, 22 nt, Homo sapiens
aucauccugucaggagcuguga

SEQ ID NO: 319894 - RNA, 22 nt, Homo sapiens
auccacagugucaauguuguga

SEQ ID NO: 319895 - RNA, 22 nt, Homo sapiens
auccacaugcaguuggaaacag

SEQ ID NO: 319896 - RNA, 23 nt, Homo sapiens
auccacauucuaguccuuuaugc

SEQ ID NO: 319897 - RNA, 22 nt, Homo sapiens
auccaguuuuaggagauuucua

SEQ ID NO: 319898 - RNA, 20 nt, Homo sapiens
aucccauuccugaagauacu

SEQ ID NO: 319899 - RNA, 22 nt, Homo sapiens
aucccgagacuuugcugaaguu

SEQ ID NO: 319900 - RNA, 22 nt, Homo sapiens
aucccugagccugacucucaga

SEQ ID NO: 319901 - RNA, 22 nt, Homo sapiens
aucccuuucucuggcuaggggg

SEQ ID NO: 319902 - RNA, 22 nt, Homo sapiens
aucccuuucugauacuuucccu

SEQ ID NO: 319903 - RNA, 22 nt, Homo sapiens
auccucugagagaguuucauaa

SEQ ID NO: 319904 - RNA, 22 nt, Homo sapiens
auccucugagaucuaggcagag

SEQ ID NO: 319905 - RNA, 22 nt, Homo sapiens
auccugagacuuugcugaaguu

SEQ ID NO: 319906 - RNA, 22 nt, Homo sapiens
auccuguagagaugagggugga

SEQ ID NO: 319907 - RNA, 22 nt, Homo sapiens
aucucaaugcuuuuguaggcca

SEQ ID NO: 319908 - RNA, 22 nt, Homo sapiens
aucucagcaacuaaagauccuu

SEQ ID NO: 319909 - RNA, 22 nt, Homo sapiens
aucucaguuaaugacccuaugc

SEQ ID NO: 319910 - RNA, 22 nt, Homo sapiens
aucucugagauguucugauuuu

SEQ ID NO: 319911 - RNA, 20 nt, Homo sapiens
aucucugggcaaaggaaaau

SEQ ID NO: 319912 - RNA, 22 nt, Homo sapiens
aucugcauuagggugaagaccu

SEQ ID NO: 319913 - RNA, 19 nt, Homo sapiens
aucuggaguuccuggggcu

SEQ ID NO: 319914 - RNA, 22 nt, Homo sapiens
aucuggcuccuuuugacaaugc

SEQ ID NO: 319915 - RNA, 22 nt, Homo sapiens
aucuggcuucuuuuaguccaca

SEQ ID NO: 319916 - RNA, 22 nt, Homo sapiens
aucugguguuuuucucccucgu

SEQ ID NO: 319917 - RNA, 22 nt, Homo sapiens
aucuguagauucagcacaagcu

SEQ ID NO: 319918 - RNA, 22 nt, Homo sapiens
aucuuggauuaccugggugggu

SEQ ID NO: 319919 - RNA, 22 nt, Homo sapiens
aucuuuaguggcuguuuucaga

SEQ ID NO: 319920 - RNA, 22 nt, Homo sapiens
aucuuugauuagacugauggau

SEQ ID NO: 319921 - RNA, 22 nt, Homo sapiens
aucuuugauuguagguacaaug

SEQ ID NO: 319922 - RNA, 22 nt, Homo sapiens
aucuuuggauacuugauauagu

SEQ ID NO: 319923 - RNA, 23 nt, Homo sapiens
augaaagcccuugcaaaugcugg

SEQ ID NO: 319924 - RNA, 22 nt, Homo sapiens
augaaagguugucuuaagccau

SEQ ID NO: 319925 - RNA, 22 nt, Homo sapiens
augaaaucuuuccugugaggau

SEQ ID NO: 319926 - RNA, 22 nt, Homo sapiens
augaaaucuuuggcagaucuua

SEQ ID NO: 319927 - RNA, 22 nt, Homo sapiens
augaaaugcauguuaaguccgu

SEQ ID NO: 319928 - RNA, 22 nt, Homo sapiens
augaaauugcuaucgcaguacu

SEQ ID NO: 319929 - RNA, 22 nt, Homo sapiens
augaacagagccuugagaaccu

SEQ ID NO: 319930 - RNA, 18 nt, Homo sapiens
augaacucaucaguucuu

SEQ ID NO: 319931 - RNA, 19 nt, Homo sapiens
augaacucauucuuuuuau

SEQ ID NO: 319932 - RNA, 22 nt, Homo sapiens
augaagagaaaguggaucuugg

SEQ ID NO: 319933 - RNA, 22 nt, Homo sapiens
augaaguauuaggacacauuua

SEQ ID NO: 319934 - RNA, 18 nt, Homo sapiens
augaagucaucacuuuua

SEQ ID NO: 319935 - RNA, 22 nt, Homo sapiens
uaucauagacaaucaguuauug

SEQ ID NO: 319936 - RNA, 22 nt, Homo sapiens
uaucauagucacuuccaguuug

SEQ ID NO: 319937 - RNA, 22 nt, Homo sapiens
uaucaucauguuuuugcugugu

SEQ ID NO: 319938 - RNA, 18 nt, Homo sapiens
uaucauguagggaaguug

SEQ ID NO: 319939 - RNA, 22 nt, Homo sapiens
uaucccaauguaauaucacaaa

SEQ ID NO: 319940 - RNA, 23 nt, Homo sapiens
uaucccuugccuuaugaugugag

SEQ ID NO: 319941 - RNA, 22 nt, Homo sapiens
uaucucagaugagacuuguaac

SEQ ID NO: 319942 - RNA, 22 nt, Homo sapiens
uaucugguuauugcugcugauu

SEQ ID NO: 319943 - RNA, 22 nt, Homo sapiens
uaugacuuuggaaaaauuacuu

SEQ ID NO: 319944 - RNA, 22 nt, Homo sapiens
uaugagacugguuaauuuuugu

SEQ ID NO: 319945 - RNA, 22 nt, Homo sapiens
uaugagacugugagugagaaau

SEQ ID NO: 319946 - RNA, 22 nt, Homo sapiens
uaugagaugaggccacugggua

SEQ ID NO: 319947 - RNA, 22 nt, Homo sapiens
uaugagcaaaaugaggguuagu

SEQ ID NO: 319948 - RNA, 22 nt, Homo sapiens
uaugagguagguaugacuauca

SEQ ID NO: 319949 - RNA, 22 nt, Homo sapiens
uaugaucacuacagcagggaug

SEQ ID NO: 319950 - RNA, 22 nt, Homo sapiens
uaugaugcugagguuuggagug

SEQ ID NO: 319951 - RNA, 22 nt, Homo sapiens
uaugcacacacguguuuaugug

SEQ ID NO: 319952 - RNA, 22 nt, Homo sapiens
uaugcacacucucccaggaggg

SEQ ID NO: 319953 - RNA, 22 nt, Homo sapiens
uaugcagacauuguuccaacca

SEQ ID NO: 319954 - RNA, 22 nt, Homo sapiens
uaugccucuucauaaaguauga

SEQ ID NO: 319955 - RNA, 22 nt, Homo sapiens
uauggauuugcauuccccaugu

SEQ ID NO: 319956 - RNA, 22 nt, Homo sapiens
uauggauuugccuauucuguau

SEQ ID NO: 319957 - RNA, 22 nt, Homo sapiens
uauggauuuuggaauauguggg

SEQ ID NO: 319958 - RNA, 22 nt, Homo sapiens
uauggcaaugcauaggaaggaa

SEQ ID NO: 319959 - RNA, 22 nt, Homo sapiens
auagugcugugaugaacauaca

SEQ ID NO: 319960 - RNA, 22 nt, Homo sapiens
auagugcuuuugaaucuuguug

SEQ ID NO: 319961 - RNA, 22 nt, Homo sapiens
auagugcuuuuuagaaccugga

SEQ ID NO: 319962 - RNA, 22 nt, Homo sapiens
auaguggcaugaucauagcuca

SEQ ID NO: 319963 - RNA, 19 nt, Homo sapiens
auaguguaggaaaacagcu

SEQ ID NO: 319964 - RNA, 22 nt, Homo sapiens
auauaguguuuuuugguacgcu

SEQ ID NO: 319965 - RNA, 22 nt, Homo sapiens
auaucaacaugguaggguuggu

SEQ ID NO: 319966 - RNA, 22 nt, Homo sapiens
auaucacaaacaagucuguacu

SEQ ID NO: 319967 - RNA, 22 nt, Homo sapiens
auaucagugucuuacuguuuuu

SEQ ID NO: 319968 - RNA, 22 nt, Homo sapiens
auauccaugccauagguuuuga

SEQ ID NO: 319969 - RNA, 22 nt, Homo sapiens
auaucccuguauaagugaaugu

SEQ ID NO: 319970 - RNA, 22 nt, Homo sapiens
auauccuggagcauuuuugcaa

SEQ ID NO: 319971 - RNA, 20 nt, Homo sapiens
auaugcagacacauacauac

SEQ ID NO: 319972 - RNA, 22 nt, Homo sapiens
auaugcauacauguaugcagga

SEQ ID NO: 319973 - RNA, 22 nt, Homo sapiens
auaugcuaauuuuuagucgagc

SEQ ID NO: 319974 - RNA, 22 nt, Homo sapiens
auauggcuaugugagcauacca

SEQ ID NO: 319975 - RNA, 22 nt, Homo sapiens
auaugguguuugcuauucagcu

SEQ ID NO: 319976 - RNA, 20 nt, Homo sapiens
auaugguugugagugauuuu

SEQ ID NO: 319977 - RNA, 22 nt, Homo sapiens
auauguaguauggaaacauugu

SEQ ID NO: 319978 - RNA, 22 nt, Homo sapiens
auaugugacuucaugcaaggcu

SEQ ID NO: 319979 - RNA, 22 nt, Homo sapiens
auauugcuccuaauaccacggu

SEQ ID NO: 319980 - RNA, 22 nt, Homo sapiens
auauuggccuaaaauucucuuu

SEQ ID NO: 319981 - RNA, 22 nt, Homo sapiens
auauugguuaaauauuauguga

SEQ ID NO: 319982 - RNA, 19 nt, Homo sapiens
aucaaacugcucuuugagg

SEQ ID NO: 319983 - RNA, 20 nt, Homo sapiens
aucaaagacuuagaggggga

SEQ ID NO: 319984 - RNA, 22 nt, Homo sapiens
aucaaguaaucugaguaagagu

SEQ ID NO: 319985 - RNA, 22 nt, Homo sapiens
aucaaguacuguacugaaagug

SEQ ID NO: 319986 - RNA, 22 nt, Homo sapiens
aucacagagucacgggcaacuu

SEQ ID NO: 319987 - RNA, 22 nt, Homo sapiens
aucacaggcaaaauuccuucuc

SEQ ID NO: 319988 - RNA, 22 nt, Homo sapiens
aucacagugaaaacagucaauu

SEQ ID NO: 319989 - RNA, 22 nt, Homo sapiens
aucaccagaugcuucaagcaga

SEQ ID NO: 319990 - RNA, 22 nt, Homo sapiens
aucaccauguguacauuagacc

SEQ ID NO: 319991 - RNA, 22 nt, Homo sapiens
aucacugggcaagauaucauga

SEQ ID NO: 319992 - RNA, 20 nt, Homo sapiens
aucagagacuaggauugcca

SEQ ID NO: 319993 - RNA, 22 nt, Homo sapiens
aucagagugaauaaugacaaaa

SEQ ID NO: 319994 - RNA, 22 nt, Homo sapiens
aucagagugaugguuuaaguau

SEQ ID NO: 319995 - RNA, 22 nt, Homo sapiens
aucagcagcaugaaaacaggcu

SEQ ID NO: 319996 - RNA, 22 nt, Homo sapiens
aucagcagcaugaaaacggacu

SEQ ID NO: 319997 - RNA, 18 nt, Homo sapiens
aucagggugaagagagga

SEQ ID NO: 319998 - RNA, 22 nt, Homo sapiens
aucauacuguuuugauuacugu

SEQ ID NO: 319999 - RNA, 22 nt, Homo sapiens
aucauauccuagauauaacuuc

SEQ ID NO: 320000 - RNA, 22 nt, Homo sapiens
aucauggaguauuugcaagucu

SEQ ID NO: 320001 - RNA, 22 nt, Homo sapiens
aucaugucuucccagugauucu

SEQ ID NO: 320002 - RNA, 18 nt, Homo sapiens
aucauugcacugucuugc

SEQ ID NO: 320003 - RNA, 22 nt, Homo sapiens
auccaguguuuucuuuugucac

SEQ ID NO: 320004 - RNA, 22 nt, Homo sapiens
aucccaguaaaaauggcuucua

SEQ ID NO: 320005 - RNA, 22 nt, Homo sapiens
auccugaagcuuuacugaauuc

SEQ ID NO: 320006 - RNA, 22 nt, Homo sapiens
auccugagacuuuucugaaguu

SEQ ID NO: 320007 - RNA, 22 nt, Homo sapiens
aucgcgccauuguacuccagcc

SEQ ID NO: 320008 - RNA, 22 nt, Homo sapiens
aucuagagaggcagucuggccg

SEQ ID NO: 320009 - RNA, 22 nt, Homo sapiens
aucucaguuaauuccaucuuuc

SEQ ID NO: 320010 - RNA, 22 nt, Homo sapiens
aucucuugccagucagaauggu

SEQ ID NO: 320011 - RNA, 22 nt, Homo sapiens
aucugcacaucuguguuuuugu

SEQ ID NO: 320012 - RNA, 22 nt, Homo sapiens
aucuucucuugaagggugggga

SEQ ID NO: 320013 - RNA, 22 nt, Homo sapiens
aucuugggugggaacugagaau

SEQ ID NO: 320014 - RNA, 22 nt, Homo sapiens
aucuuuggcgggaauaucacag

SEQ ID NO: 320015 - RNA, 22 nt, Homo sapiens
aucuuuggucaucacagcuaga

SEQ ID NO: 320016 - RNA, 22 nt, Homo sapiens
aucuuuggugcaugauacuuug

SEQ ID NO: 320017 - RNA, 22 nt, Homo sapiens
augaaacuggagcgccuggagg

SEQ ID NO: 320018 - RNA, 22 nt, Homo sapiens
augaaagucaauccccaagugu

SEQ ID NO: 320019 - RNA, 22 nt, Homo sapiens
augaacacuccaauuguacucc

SEQ ID NO: 320020 - RNA, 23 nt, Homo sapiens
augaacucaucauuuuuuauggc

SEQ ID NO: 320021 - RNA, 22 nt, Homo sapiens
augaagacaucgucugggauua

SEQ ID NO: 320022 - RNA, 22 nt, Homo sapiens
augaagaucucugccuuguguc

SEQ ID NO: 320023 - RNA, 22 nt, Homo sapiens
augaagucguuacuaccaauug

SEQ ID NO: 320024 - RNA, 23 nt, Homo sapiens
augaauguaaggaguguaagaaa

SEQ ID NO: 320025 - RNA, 22 nt, Homo sapiens
augaaugucuuauuuugagaaa

SEQ ID NO: 320026 - RNA, 22 nt, Homo sapiens
augaauucaucugguuuuggga

SEQ ID NO: 320027 - RNA, 19 nt, Homo sapiens
augacauuuggggguggac

SEQ ID NO: 320028 - RNA, 22 nt, Homo sapiens
ucaccuggggcacagcugaaga

SEQ ID NO: 320029 - RNA, 22 nt, Homo sapiens
ucacgcugcugcaaccagccug

SEQ ID NO: 320030 - RNA, 22 nt, Homo sapiens
ucacgguggaaucccagauccc

SEQ ID NO: 320031 - RNA, 20 nt, Homo sapiens
ucacuauggagcucuuucuu

SEQ ID NO: 320032 - RNA, 22 nt, Homo sapiens
ucacuauugacaacagugugga

SEQ ID NO: 320033 - RNA, 22 nt, Homo sapiens
ucacugaaacuguccuggguua

SEQ ID NO: 320034 - RNA, 21 nt, Homo sapiens
ucacugagcaucaugguuuca

SEQ ID NO: 320035 - RNA, 22 nt, Homo sapiens
ucacugagcuagaucacuugac

SEQ ID NO: 320036 - RNA, 22 nt, Homo sapiens
ucacugaggucugagcuuuaug

SEQ ID NO: 320037 - RNA, 20 nt, Homo sapiens
ucacugagugguccacagua

SEQ ID NO: 320038 - RNA, 22 nt, Homo sapiens
ucacugcacucuccgccuugcg

SEQ ID NO: 320039 - RNA, 22 nt, Homo sapiens
ucacugcacuucaggcuuucuc

SEQ ID NO: 320040 - RNA, 20 nt, Homo sapiens
ucacuggagcucauuugauu

SEQ ID NO: 320041 - RNA, 22 nt, Homo sapiens
ucacuggucuaaguggaggggg

SEQ ID NO: 320042 - RNA, 22 nt, Homo sapiens
ucacugugagaguuuauccugu

SEQ ID NO: 320043 - RNA, 22 nt, Homo sapiens
ucacugugcacauaugauaggu

SEQ ID NO: 320044 - RNA, 22 nt, Homo sapiens
ucacugugguuugggaaagugc

SEQ ID NO: 320045 - RNA, 22 nt, Homo sapiens
ucacuguguauguauaugcagg

SEQ ID NO: 320046 - RNA, 22 nt, Homo sapiens
ucacuuggugaacacauuaugu

SEQ ID NO: 320047 - RNA, 22 nt, Homo sapiens
ucacuuuggguacuauggaaau

SEQ ID NO: 320048 - RNA, 22 nt, Homo sapiens
uccuugagucuuugcucagaug

SEQ ID NO: 320049 - RNA, 22 nt, Homo sapiens
uccuugcacuaacuuaaggagg

SEQ ID NO: 320050 - RNA, 22 nt, Homo sapiens
uccuuuagacugaauccugaga

SEQ ID NO: 320051 - RNA, 22 nt, Homo sapiens
uccuuugguuauaggcaccucu

SEQ ID NO: 320052 - RNA, 22 nt, Homo sapiens
ucgagcaauugucaugucucag

SEQ ID NO: 320053 - RNA, 22 nt, Homo sapiens
ucgcauuucccucuguagcuuc

SEQ ID NO: 320054 - RNA, 22 nt, Homo sapiens
ucggcucagugcaagcucugcc

SEQ ID NO: 320055 - RNA, 22 nt, Homo sapiens
ucgguacuugagagagacacag

SEQ ID NO: 320056 - RNA, 22 nt, Homo sapiens
ucguggccugugaguccucccc

SEQ ID NO: 320057 - RNA, 22 nt, Homo sapiens
ucuaagaauucauuuauaagcc

SEQ ID NO: 320058 - RNA, 22 nt, Homo sapiens
ucuaauguaaccugcaaauauu

SEQ ID NO: 320059 - RNA, 22 nt, Homo sapiens
ucuagaugaaguauaaaguagu

SEQ ID NO: 320060 - RNA, 22 nt, Homo sapiens
ucuauuugggguaccuguggua

SEQ ID NO: 320061 - RNA, 22 nt, Homo sapiens
ucucaaguggucgcaguuagau

SEQ ID NO: 320062 - RNA, 22 nt, Homo sapiens
ucucacagaguugaauguuucu

SEQ ID NO: 320063 - RNA, 22 nt, Homo sapiens
ggcaugaggccauaaaaguaag

SEQ ID NO: 320064 - RNA, 22 nt, Homo sapiens
ggcaugauggcugaggcuucug

SEQ ID NO: 320065 - RNA, 22 nt, Homo sapiens
ggcaugguggugugugccuaua

SEQ ID NO: 320066 - RNA, 22 nt, Homo sapiens
ggcauguguggguuauuaaaga

SEQ ID NO: 320067 - RNA, 22 nt, Homo sapiens
ggcauugaguggguaggaguca

SEQ ID NO: 320068 - RNA, 22 nt, Homo sapiens
ggcauuguccaauuucugcccu

SEQ ID NO: 320069 - RNA, 21 nt, Homo sapiens
ggcauugugcccuugcucuag

SEQ ID NO: 320070 - RNA, 23 nt, Homo sapiens
ggcauuguggcucacaucuguaa

SEQ ID NO: 320071 - RNA, 22 nt, Homo sapiens
ggccagaugaucuaugaaggaa

SEQ ID NO: 320072 - RNA, 22 nt, Homo sapiens
ggccagaugcgguggcucacac

SEQ ID NO: 320073 - RNA, 22 nt, Homo sapiens
ggcccaguugcgggugguaccg

SEQ ID NO: 320074 - RNA, 22 nt, Homo sapiens
ggcccugauacaaguaaggucu

SEQ ID NO: 320075 - RNA, 22 nt, Homo sapiens
ggccuguaaacuagagacccug

SEQ ID NO: 320076 - RNA, 22 nt, Homo sapiens
ggcgccauugcacuccagccug

SEQ ID NO: 320077 - RNA, 22 nt, Homo sapiens
ggcgguguccuccaagugcuuc

SEQ ID NO: 320078 - RNA, 22 nt, Homo sapiens
ggcucagugaucuguuucugua

SEQ ID NO: 320079 - RNA, 22 nt, Homo sapiens
ggcucaguuuccuccgucugcu

SEQ ID NO: 320080 - RNA, 18 nt, Homo sapiens
ggcugguguuuuaguaua

SEQ ID NO: 320081 - RNA, 22 nt, Homo sapiens
ggcuuggaggaaugugagggcu

SEQ ID NO: 320082 - RNA, 22 nt, Homo sapiens
gggaagguaaucauuacuugau

SEQ ID NO: 320083 - RNA, 18 nt, Homo sapiens
gggaauauggggaguuga

SEQ ID NO: 320084 - RNA, 22 nt, Homo sapiens
gggaaugaagagaaccuuccca

SEQ ID NO: 320085 - RNA, 22 nt, Homo sapiens
gggaggucauuguucaaugcug

SEQ ID NO: 320086 - RNA, 22 nt, Homo sapiens
gggagugucuaaccuguuaaca

SEQ ID NO: 320087 - RNA, 22 nt, Homo sapiens
gggaugaauuagguauguuuau

SEQ ID NO: 320088 - RNA, 22 nt, Homo sapiens
gggcaagaagucuuguaguuuu

SEQ ID NO: 320089 - RNA, 22 nt, Homo sapiens
gggcagaugucuggacaccuca

SEQ ID NO: 320090 - RNA, 22 nt, Homo sapiens
gggcaugauggugcacacaugu

SEQ ID NO: 320091 - RNA, 22 nt, Homo sapiens
gggcaugaugucuuaugccuau

SEQ ID NO: 320092 - RNA, 22 nt, Homo sapiens
gggcaugugugugcacacacau

SEQ ID NO: 320093 - RNA, 22 nt, Homo sapiens
gggcgagaaucggcugcucagc

SEQ ID NO: 320094 - RNA, 23 nt, Homo sapiens
gggcuagaugagagcuuccuggg

SEQ ID NO: 320095 - RNA, 22 nt, Homo sapiens
ggggaauguuaaagaauuugca

SEQ ID NO: 320096 - RNA, 22 nt, Homo sapiens
gggggagugugguacccagcau

SEQ ID NO: 320097 - RNA, 22 nt, Homo sapiens
gggucauggaugugaagcuaga

SEQ ID NO: 320098 - RNA, 15 nt, Homo sapiens
ggguccucucccaaa

SEQ ID NO: 320099 - RNA, 22 nt, Homo sapiens
gguaaacauaagagagcugacu

SEQ ID NO: 320100 - RNA, 22 nt, Homo sapiens
gguaacaguggggcuaugcuua

SEQ ID NO: 320101 - RNA, 22 nt, Homo sapiens
gguauguaggucuacgguacaa

SEQ ID NO: 320102 - RNA, 22 nt, Homo sapiens
ggucaagcuagauuuuaaugau

SEQ ID NO: 320103 - RNA, 19 nt, Homo sapiens
ggucacagggguuacaagg

SEQ ID NO: 320104 - RNA, 22 nt, Homo sapiens
ggucacauuggacuaucaaguu

SEQ ID NO: 320105 - RNA, 22 nt, Homo sapiens
ggucacccugaugcuggugguc

SEQ ID NO: 320106 - RNA, 22 nt, Homo sapiens
ggucaggagaaugguaacugag

SEQ ID NO: 320107 - RNA, 19 nt, Homo sapiens
ggucauggagguuguguga

SEQ ID NO: 320108 - RNA, 22 nt, Homo sapiens
ggucuagagagagggguggacu

SEQ ID NO: 320109 - RNA, 22 nt, Homo sapiens
ggucugguguugaaauucuuca

SEQ ID NO: 320110 - RNA, 22 nt, Homo sapiens
ggucuuggagaauuguccuggg

SEQ ID NO: 320111 - RNA, 21 nt, Homo sapiens
ggugagaaaggagacauagac

SEQ ID NO: 320112 - RNA, 22 nt, Homo sapiens
ggugaggaaaguugaguuucua

SEQ ID NO: 320113 - RNA, 23 nt, Homo sapiens
ggugaggaguacagagucuucau

SEQ ID NO: 320114 - RNA, 22 nt, Homo sapiens
ggugauauguugagguuuuggg

SEQ ID NO: 320115 - RNA, 22 nt, Homo sapiens
ggugauguuugaguugagacag

SEQ ID NO: 320116 - RNA, 22 nt, Homo sapiens
guaacagucucaacaguggucu

SEQ ID NO: 320117 - RNA, 22 nt, Homo sapiens
guaaggaguaguguaacagugc

SEQ ID NO: 320118 - RNA, 22 nt, Homo sapiens
guaaggcuguuaucuucacguc

SEQ ID NO: 320119 - RNA, 22 nt, Homo sapiens
guaaguagcuuuagauauaaau

SEQ ID NO: 320120 - RNA, 22 nt, Homo sapiens
guaaguauuaggugugagauuc

SEQ ID NO: 320121 - RNA, 22 nt, Homo sapiens
guaauaccuuccccugcuggag

SEQ ID NO: 320122 - RNA, 22 nt, Homo sapiens
guaauacuuuugggauauuaga

SEQ ID NO: 320123 - RNA, 22 nt, Homo sapiens
guaaucucaccuacuugggagg

SEQ ID NO: 320124 - RNA, 22 nt, Homo sapiens
guaaucucagcuacucgggagg

SEQ ID NO: 320125 - RNA, 19 nt, Homo sapiens
guaaugugcuucaguagca

SEQ ID NO: 320126 - RNA, 22 nt, Homo sapiens
guacaaguaagaaaauugccca

SEQ ID NO: 320127 - RNA, 16 nt, Homo sapiens
guacacaguaaguaug

SEQ ID NO: 320128 - RNA, 22 nt, Homo sapiens
guacacauacauauaugugugu

SEQ ID NO: 320129 - RNA, 22 nt, Homo sapiens
guacaggugcaggaugggcagg

SEQ ID NO: 320130 - RNA, 22 nt, Homo sapiens
guacaguacugaaugaauguau

SEQ ID NO: 320131 - RNA, 22 nt, Homo sapiens
guacaguauaguaauaggauuu

SEQ ID NO: 320132 - RNA, 22 nt, Homo sapiens
guacagugcucacaaugagagc

SEQ ID NO: 320133 - RNA, 22 nt, Homo sapiens
guacaguuuagugcuuugagaa

SEQ ID NO: 320134 - RNA, 22 nt, Homo sapiens
guacaguuuucaguguucacug

SEQ ID NO: 320135 - RNA, 22 nt, Homo sapiens
guacaugcauaguuuauuucug

SEQ ID NO: 320136 - RNA, 22 nt, Homo sapiens
guacaugugcacagugugcagg

SEQ ID NO: 320137 - RNA, 22 nt, Homo sapiens
guacugagagacaguuacuguu

SEQ ID NO: 320138 - RNA, 22 nt, Homo sapiens
guagagagaaauacaaagcugu

SEQ ID NO: 320139 - RNA, 22 nt, Homo sapiens
guagaggaauggcuccaccaua

SEQ ID NO: 320140 - RNA, 22 nt, Homo sapiens
guagaucucaacacuggaagua

SEQ ID NO: 320141 - RNA, 22 nt, Homo sapiens
guagcagcuacuaaguugcugu

SEQ ID NO: 320142 - RNA, 22 nt, Homo sapiens
ugcauauuuuauaaagauggaa

SEQ ID NO: 320143 - RNA, 22 nt, Homo sapiens
ugcaugaugcugagauuuggga

SEQ ID NO: 320144 - RNA, 22 nt, Homo sapiens
ugcauggaagggagggaaagag

SEQ ID NO: 320145 - RNA, 22 nt, Homo sapiens
uaguugcauucaggauaugacg

SEQ ID NO: 320146 - RNA, 21 nt, Homo sapiens
ugcaugguagucacaugauuc

SEQ ID NO: 320147 - RNA, 22 nt, Homo sapiens
ugcauggucauacauggcaccc

SEQ ID NO: 320148 - RNA, 22 nt, Homo sapiens
ugcauuaucagauguuugcuuu

SEQ ID NO: 320149 - RNA, 22 nt, Homo sapiens
ugcauuguaggauguuuagcag

SEQ ID NO: 320150 - RNA, 22 nt, Homo sapiens
ugcauuguggaucuaaaugcau

SEQ ID NO: 320151 - RNA, 22 nt, Homo sapiens
ugccaaaaugggcuuuauaccg

SEQ ID NO: 320152 - RNA, 22 nt, Homo sapiens
ugccaagaacauuuucuguuuu

SEQ ID NO: 320153 - RNA, 22 nt, Homo sapiens
ugccaguauuuuauuaagaauu

SEQ ID NO: 320154 - RNA, 22 nt, Homo sapiens
ugccaguauuuuauugagcauu

SEQ ID NO: 320155 - RNA, 22 nt, Homo sapiens
ugccaguauuuuguugaagauu

SEQ ID NO: 320156 - RNA, 22 nt, Homo sapiens
ugccauagagauuuguggaacu

SEQ ID NO: 320157 - RNA, 22 nt, Homo sapiens
ugccaucauuaauauuaggcau

SEQ ID NO: 320158 - RNA, 19 nt, Homo sapiens
ugccauguaacaggaaaau

SEQ ID NO: 320159 - RNA, 19 nt, Homo sapiens
ugccauguagcacaugguc

SEQ ID NO: 320160 - RNA, 21 nt, Homo sapiens
ugcccaguggcuuggggucag

SEQ ID NO: 320161 - RNA, 22 nt, Homo sapiens
ugccuacagaaggggcucagca

SEQ ID NO: 320162 - RNA, 22 nt, Homo sapiens
ugccuaguagaaggugaacaug

SEQ ID NO: 320163 - RNA, 22 nt, Homo sapiens
ugccuagucuauugagagucuu

SEQ ID NO: 320164 - RNA, 22 nt, Homo sapiens
ugccuaguggaaggagagcaaa

SEQ ID NO: 320165 - RNA, 22 nt, Homo sapiens
ugccuaguguguugagaguuuu

SEQ ID NO: 320166 - RNA, 22 nt, Homo sapiens
ugccugagcccagcccuguagu

SEQ ID NO: 320167 - RNA, 22 nt, Homo sapiens
ugccugauacccucugucucuc

SEQ ID NO: 320168 - RNA, 22 nt, Homo sapiens
ugccuggagagcuccuacauau

SEQ ID NO: 320169 - RNA, 22 nt, Homo sapiens
ugccuuauuccaacugagcucu

SEQ ID NO: 320170 - RNA, 22 nt, Homo sapiens
ugccuuuguucuggaaugggaa

SEQ ID NO: 320171 - RNA, 22 nt, Homo sapiens
ugcgccauugcacucuagccug

SEQ ID NO: 320172 - RNA, 21 nt, Homo sapiens
ugcuacugucacuuccuuugu

SEQ ID NO: 320173 - RNA, 22 nt, Homo sapiens
ugcuaugucagccaggcugguc

SEQ ID NO: 320174 - RNA, 21 nt, Homo sapiens
ugcuccauuuucuagccugaa

SEQ ID NO: 320175 - RNA, 23 nt, Homo sapiens
ugcugagaccuagauccuaaaga

SEQ ID NO: 320176 - RNA, 22 nt, Homo sapiens
ugcugcaaacaggcaucugugg

SEQ ID NO: 320177 - RNA, 22 nt, Homo sapiens
ugcugcaaacaugagaggaagu

SEQ ID NO: 320178 - RNA, 22 nt, Homo sapiens
ugcugguauuauguuauccaga

SEQ ID NO: 320179 - RNA, 22 nt, Homo sapiens
ugcuggugucaucaaggcuuug

SEQ ID NO: 320180 - RNA, 22 nt, Homo sapiens
ugcuguuguuugaugaaguaau

SEQ ID NO: 320181 - RNA, 22 nt, Homo sapiens
ugcuuaggcuaacaaaaauagc

SEQ ID NO: 320182 - RNA, 22 nt, Homo sapiens
ugcuuaggcuuccuuacaguau

SEQ ID NO: 320183 - RNA, 22 nt, Homo sapiens
ugcuuagucuugcuuuagcuau

SEQ ID NO: 320184 - RNA, 22 nt, Homo sapiens
ugcuugagacacauaugaauuu

SEQ ID NO: 320185 - RNA, 22 nt, Homo sapiens
ugcuuguguucagguaaccuuu

SEQ ID NO: 320186 - RNA, 22 nt, Homo sapiens
ugcuuuguugaaaaucauuugg

SEQ ID NO: 320187 - RNA, 22 nt, Homo sapiens
uggaaaacaugcacauuggauu

SEQ ID NO: 320188 - RNA, 22 nt, Homo sapiens
uggaaaauuaggggagguuaua

SEQ ID NO: 320189 - RNA, 21 nt, Homo sapiens
uggaaacuucuagcuuacgua

SEQ ID NO: 320190 - RNA, 22 nt, Homo sapiens
uggaaaguacugagguccaccu

SEQ ID NO: 320191 - RNA, 22 nt, Homo sapiens
uggaaaguaguucuaaucuaag

SEQ ID NO: 320192 - RNA, 22 nt, Homo sapiens
uggaaaguccaagccaaccggg

SEQ ID NO: 320193 - RNA, 22 nt, Homo sapiens
uggaaauaaaauagaguuugcc

SEQ ID NO: 320194 - RNA, 22 nt, Homo sapiens
uggaacacaucuaaggaagcag

SEQ ID NO: 320195 - RNA, 22 nt, Homo sapiens
uggaacaccaggcuggcguggc

SEQ ID NO: 320196 - RNA, 20 nt, Homo sapiens
uggaacuuaauugauggaca

SEQ ID NO: 320197 - RNA, 22 nt, Homo sapiens
uggaagacaaguguuagcaugg

SEQ ID NO: 320198 - RNA, 23 nt, Homo sapiens
uggaagacuccucucuuggcugc

SEQ ID NO: 320199 - RNA, 22 nt, Homo sapiens
uggaaguaaucaugagguagca

SEQ ID NO: 320200 - RNA, 22 nt, Homo sapiens
uggaagugaacaaccaaggcag

SEQ ID NO: 320201 - RNA, 22 nt, Homo sapiens
uggaaguuaaauuaguugauga

SEQ ID NO: 320202 - RNA, 21 nt, Homo sapiens
uggaaucuauagaggcaguag

SEQ ID NO: 320203 - RNA, 20 nt, Homo sapiens
uggaaucugaagaucucagu

SEQ ID NO: 320204 - RNA, 22 nt, Homo sapiens
uggaaucuuaggugaaggcuuu

SEQ ID NO: 320205 - RNA, 21 nt, Homo sapiens
uggaauguucugacuucaggg

SEQ ID NO: 320206 - RNA, 22 nt, Homo sapiens
uggaauguuuaucaaaacagua

SEQ ID NO: 320207 - RNA, 18 nt, Homo sapiens
uggaauguuuggguuaau

SEQ ID NO: 320208 - RNA, 22 nt, Homo sapiens
uggacaagugcccuccaccuca

SEQ ID NO: 320209 - RNA, 22 nt, Homo sapiens
uggacauguacauauguguaug

SEQ ID NO: 320210 - RNA, 22 nt, Homo sapiens
uggaccccugcucgggagcccu

SEQ ID NO: 320211 - RNA, 21 nt, Homo sapiens
uggaccccuuccagucaucau

SEQ ID NO: 320212 - RNA, 21 nt, Homo sapiens
uggaccccuuccuuacaucau

SEQ ID NO: 320213 - RNA, 22 nt, Homo sapiens
uggacuagagggugggcgaggu

SEQ ID NO: 320214 - RNA, 22 nt, Homo sapiens
uggacuguaauuuuauaggcau

SEQ ID NO: 320215 - RNA, 22 nt, Homo sapiens
uggacuuuaauaaaagggaaau

SEQ ID NO: 320216 - RNA, 22 nt, Homo sapiens
uggagacugaucccucuuuccu

SEQ ID NO: 320217 - RNA, 22 nt, Homo sapiens
uggaggacugcagaacugaggc

SEQ ID NO: 320218 - RNA, 22 nt, Homo sapiens
uggagguagagaugggaucucc

SEQ ID NO: 320219 - RNA, 22 nt, Homo sapiens
uggagucgugcccuugcauuua

SEQ ID NO: 320220 - RNA, 22 nt, Homo sapiens
uggagucuugcucuguugccca

SEQ ID NO: 320221 - RNA, 22 nt, Homo sapiens
uggagugcgagggugaaacuuu

SEQ ID NO: 320222 - RNA, 22 nt, Homo sapiens
uggaguguaaauuaguucagcc

SEQ ID NO: 320223 - RNA, 22 nt, Homo sapiens
uggaguguaauuagccaucagu

SEQ ID NO: 320224 - RNA, 22 nt, Homo sapiens
uggaguguguugcagaugaagg

SEQ ID NO: 320225 - RNA, 22 nt, Homo sapiens
uggaguguuggggcaggaucuc

SEQ ID NO: 320226 - RNA, 22 nt, Homo sapiens
uggauagaacuaagugcuuaga

SEQ ID NO: 320227 - RNA, 22 nt, Homo sapiens
uggauagauacuauccaggacu

SEQ ID NO: 320228 - RNA, 22 nt, Homo sapiens
uggauauguuuauauguugucu

SEQ ID NO: 320229 - RNA, 22 nt, Homo sapiens
uggauccaucacgccucuuccc

SEQ ID NO: 320230 - RNA, 19 nt, Homo sapiens
uggaugacugucugggucu

SEQ ID NO: 320231 - RNA, 22 nt, Homo sapiens
uggaugacuguuauaugcauau

SEQ ID NO: 320232 - RNA, 22 nt, Homo sapiens
uggauugugaagaccaugggaa

SEQ ID NO: 320233 - RNA, 20 nt, Homo sapiens
uggauugugaugggauuugc

SEQ ID NO: 320234 - RNA, 22 nt, Homo sapiens
uggcaaaauauuuugguuucug

SEQ ID NO: 320235 - RNA, 21 nt, Homo sapiens
uggcaaaaugggcaguggguu

SEQ ID NO: 320236 - RNA, 22 nt, Homo sapiens
uggcaaagugugacgugggggu

SEQ ID NO: 320237 - RNA, 22 nt, Homo sapiens
uggcaagugggaccuaguuaaa

SEQ ID NO: 320238 - RNA, 22 nt, Homo sapiens
cuaaaugcacugucaaaggaag

SEQ ID NO: 320239 - RNA, 22 nt, Homo sapiens
uggcagcugcuucaugggaugc

SEQ ID NO: 320240 - RNA, 22 nt, Homo sapiens
uggcaggugcacuggcuuugaa

SEQ ID NO: 320241 - RNA, 22 nt, Homo sapiens
uggcaguuucacauggcucaac

SEQ ID NO: 320242 - RNA, 22 nt, Homo sapiens
uggcaguuuuugccuucaauac

SEQ ID NO: 320243 - RNA, 22 nt, Homo sapiens
uggcaugauauauauucguuug

SEQ ID NO: 320244 - RNA, 22 nt, Homo sapiens
uggcauguauuuuguguauuaa

SEQ ID NO: 320245 - RNA, 22 nt, Homo sapiens
uggcauuguccaauaaaauuuu

SEQ ID NO: 320246 - RNA, 22 nt, Homo sapiens
uggcauuuucucuguucuuaga

SEQ ID NO: 320247 - RNA, 22 nt, Homo sapiens
uggcauuuuguuuuagaauuag

SEQ ID NO: 320248 - RNA, 23 nt, Homo sapiens
uggccagaaacuucuuuucaucc

SEQ ID NO: 320249 - RNA, 22 nt, Homo sapiens
uggccagagggcaauuagcugu

SEQ ID NO: 320250 - RNA, 22 nt, Homo sapiens
uggccaguguuuuuccugggcu

SEQ ID NO: 320251 - RNA, 22 nt, Homo sapiens
uggccaguuuuuaauugggucu

SEQ ID NO: 320252 - RNA, 22 nt, Homo sapiens
uggccuguaacccucucauagg

SEQ ID NO: 320253 - RNA, 22 nt, Homo sapiens
uggcgagaugcucgugugcaga

SEQ ID NO: 320254 - RNA, 22 nt, Homo sapiens
uggcgggaaaguugggagaaga

SEQ ID NO: 320255 - RNA, 22 nt, Homo sapiens
uggcuaagaugcacacuucacu

SEQ ID NO: 320256 - RNA, 22 nt, Homo sapiens
uggcuacugaccugcuaggggg

SEQ ID NO: 320257 - RNA, 22 nt, Homo sapiens
uggcuagauauccagaguucug

SEQ ID NO: 320258 - RNA, 22 nt, Homo sapiens
uggcucauuucuaaacccagcu

SEQ ID NO: 320259 - RNA, 22 nt, Homo sapiens
uggcuccguuguacaggcugga

SEQ ID NO: 320260 - RNA, 20 nt, Homo sapiens
uggcucuuugcugcuaaagu

SEQ ID NO: 320261 - RNA, 22 nt, Homo sapiens
uggcuguguccucucccaaauc

SEQ ID NO: 320262 - RNA, 22 nt, Homo sapiens
uggcuguuuauuucacaugggu

SEQ ID NO: 320263 - RNA, 20 nt, Homo sapiens
uggcuucuuaauugcaggca

SEQ ID NO: 320264 - RNA, 22 nt, Homo sapiens
uggcuugauggcacaagguuuc

SEQ ID NO: 320265 - RNA, 22 nt, Homo sapiens
ugggaagauucuguguuuuucc

SEQ ID NO: 320266 - RNA, 22 nt, Homo sapiens
ugggaaugaaauuacauagcuu

SEQ ID NO: 320267 - RNA, 22 nt, Homo sapiens
ugggaccccuacucuuuccaca

SEQ ID NO: 320268 - RNA, 22 nt, Homo sapiens
ugggaucagcugggcucucugu

SEQ ID NO: 320269 - RNA, 22 nt, Homo sapiens
ugggaugaauacaaugggauca

SEQ ID NO: 320270 - RNA, 22 nt, Homo sapiens
ugggaugaugaaaaggcuuucu

SEQ ID NO: 320271 - RNA, 22 nt, Homo sapiens
ugggauguagccuucuauuuuc

SEQ ID NO: 320272 - RNA, 22 nt, Homo sapiens
ugggcaagugacuuggcuucuc

SEQ ID NO: 320273 - RNA, 22 nt, Homo sapiens
ugggcuagaugcuuugggguca

SEQ ID NO: 320274 - RNA, 22 nt, Homo sapiens
uggggcaaugaacauuuuugca

SEQ ID NO: 320275 - RNA, 22 nt, Homo sapiens
uggggcuuuuucuuguauucuc

SEQ ID NO: 320276 - RNA, 22 nt, Homo sapiens
uggguaauggagaaauaaaucu

SEQ ID NO: 320277 - RNA, 22 nt, Homo sapiens
uggguaguguaaagcacuccag

SEQ ID NO: 320278 - RNA, 23 nt, Homo sapiens
ugggucaguuuuucugacaucau

SEQ ID NO: 320279 - RNA, 22 nt, Homo sapiens
ugggugugaccgcucaaggggg

SEQ ID NO: 320280 - RNA, 22 nt, Homo sapiens
ugguaagaucagaacuggaguc

SEQ ID NO: 320281 - RNA, 22 nt, Homo sapiens
ugguaucuaagaugcacguugu

SEQ ID NO: 320282 - RNA, 22 nt, Homo sapiens
ugguaugucuuucuuccuguag

SEQ ID NO: 320283 - RNA, 22 nt, Homo sapiens
ugguauguugucucuuuguucu

SEQ ID NO: 320284 - RNA, 22 nt, Homo sapiens
ugguauuuaauauaugagaguu

SEQ ID NO: 320285 - RNA, 22 nt, Homo sapiens
uggucaaaucugaugugagaaa

SEQ ID NO: 320286 - RNA, 22 nt, Homo sapiens
uggucauggaaauagaaugcac

SEQ ID NO: 320287 - RNA, 22 nt, Homo sapiens
uggucccucugaaaauugggug

SEQ ID NO: 320288 - RNA, 22 nt, Homo sapiens
uggucuggagagucccgcccag

SEQ ID NO: 320289 - RNA, 17 nt, Homo sapiens
uggugcuugaaaguugc

SEQ ID NO: 320290 - RNA, 15 nt, Homo sapiens
uggugguguugagac

SEQ ID NO: 320291 - RNA, 22 nt, Homo sapiens
uguaaacauguauguguuuaug

SEQ ID NO: 320292 - RNA, 22 nt, Homo sapiens
uguaaaucugguuaauuggaua

SEQ ID NO: 320293 - RNA, 20 nt, Homo sapiens
uguaacaaucuggauguugc

SEQ ID NO: 320294 - RNA, 20 nt, Homo sapiens
uguaacacauggagaacucu

SEQ ID NO: 320295 - RNA, 22 nt, Homo sapiens
uguaacaguaguuacuauucuu

SEQ ID NO: 320296 - RNA, 22 nt, Homo sapiens
uguaaggcaguuagagcaaauu

SEQ ID NO: 320297 - RNA, 22 nt, Homo sapiens
uguaauaguaggcucacauuug

SEQ ID NO: 320298 - RNA, 19 nt, Homo sapiens
uguacacuguaaaccugug

SEQ ID NO: 320299 - RNA, 22 nt, Homo sapiens
uguagacagcacguaguugagu

SEQ ID NO: 320300 - RNA, 22 nt, Homo sapiens
uguagcacauuugaagagaagc

SEQ ID NO: 320301 - RNA, 21 nt, Homo sapiens
uguagcagcaugauucauagu

SEQ ID NO: 320302 - RNA, 22 nt, Homo sapiens
uguagcuuuugagauuuauauu

SEQ ID NO: 320303 - RNA, 22 nt, Homo sapiens
uguaguuugaaagcucccucug

SEQ ID NO: 320304 - RNA, 21 nt, Homo sapiens
uguauacauggaagaaugguc

SEQ ID NO: 320305 - RNA, 22 nt, Homo sapiens
uguauauguuuguacauauguc

SEQ ID NO: 320306 - RNA, 22 nt, Homo sapiens
uguauguagugaccagggccag

SEQ ID NO: 320307 - RNA, 22 nt, Homo sapiens
uguaugucugcucuuuggaacu

SEQ ID NO: 320308 - RNA, 22 nt, Homo sapiens
uguauguugggucaaaguacau

SEQ ID NO: 320309 - RNA, 22 nt, Homo sapiens
uguauugcuugaagagugaauu

SEQ ID NO: 320310 - RNA, 22 nt, Homo sapiens
ugucaaaugcagugauauuuga

SEQ ID NO: 320311 - RNA, 22 nt, Homo sapiens
ugucaaauucuggguuaaaaca

SEQ ID NO: 320312 - RNA, 21 nt, Homo sapiens
ugucaagaugacugcugcggc

SEQ ID NO: 320313 - RNA, 21 nt, Homo sapiens
ugucaagugggaaaacaugua

SEQ ID NO: 320314 - RNA, 22 nt, Homo sapiens
ugucacagagauuuugguaugu

SEQ ID NO: 320315 - RNA, 22 nt, Homo sapiens
ugucacaguuuguacuuuauag

SEQ ID NO: 320316 - RNA, 22 nt, Homo sapiens
ugucaccauuuguaggugagga

SEQ ID NO: 320317 - RNA, 22 nt, Homo sapiens
ugucacugugcagucaugcauu

SEQ ID NO: 320318 - RNA, 22 nt, Homo sapiens
ugucagaaucuagaggcugcua

SEQ ID NO: 320319 - RNA, 22 nt, Homo sapiens
ugucaggaguuuuagaaucuua

SEQ ID NO: 320320 - RNA, 22 nt, Homo sapiens
ugucauagauugcuuggaaaaa

SEQ ID NO: 320321 - RNA, 22 nt, Homo sapiens
ugucauggcauuuguaaacugc

SEQ ID NO: 320322 - RNA, 22 nt, Homo sapiens
ugucauggggaaaauaacagac

SEQ ID NO: 320323 - RNA, 22 nt, Homo sapiens
ugucaugucaacuauggaauuu

SEQ ID NO: 320324 - RNA, 22 nt, Homo sapiens
ugucauuggacuucuuucaugg

SEQ ID NO: 320325 - RNA, 16 nt, Homo sapiens
uguccaaauaaauaca

SEQ ID NO: 320326 - RNA, 22 nt, Homo sapiens
uguccauuuuuaugcuuauggu

SEQ ID NO: 320327 - RNA, 22 nt, Homo sapiens
ugucccaguuggguauugaauu

SEQ ID NO: 320328 - RNA, 20 nt, Homo sapiens
uauuugguuauuuccauggu

SEQ ID NO: 320329 - RNA, 22 nt, Homo sapiens
ucaaacauccccaccagggacu

SEQ ID NO: 320330 - RNA, 20 nt, Homo sapiens
ucaaagacauggcugucaga

SEQ ID NO: 320331 - RNA, 22 nt, Homo sapiens
ucaaaguagaaaaggggcaauu

SEQ ID NO: 320332 - RNA, 20 nt, Homo sapiens
ucaaaguaugcucugcacua

SEQ ID NO: 320333 - RNA, 18 nt, Homo sapiens
aguuguuuuauccugccc

SEQ ID NO: 320334 - RNA, 22 nt, Homo sapiens
aguuuugguugaguuacuagca

SEQ ID NO: 320335 - RNA, 22 nt, Homo sapiens
auaaaagcaggucuaggucagg

SEQ ID NO: 320336 - RNA, 18 nt, Homo sapiens
auaaacucaucauuuuua

SEQ ID NO: 320337 - RNA, 23 nt, Homo sapiens
auaaacugucaaaagccagcccu

SEQ ID NO: 320338 - RNA, 22 nt, Homo sapiens
auaaacugucaguggagaguaa

SEQ ID NO: 320339 - RNA, 22 nt, Homo sapiens
auaaagccaggagacguaauug

SEQ ID NO: 320340 - RNA, 22 nt, Homo sapiens
auaaaguagaggugaggugcau

SEQ ID NO: 320341 - RNA, 22 nt, Homo sapiens
auaacagcauuauugcauacgu

SEQ ID NO: 320342 - RNA, 22 nt, Homo sapiens
auaacaggaaauacagggcuuu

SEQ ID NO: 320343 - RNA, 22 nt, Homo sapiens
auaaccuauggaucuacucggg

SEQ ID NO: 320344 - RNA, 22 nt, Homo sapiens
auaacucuguuuuuuucaugca

SEQ ID NO: 320345 - RNA, 23 nt, Homo sapiens
auaagccuuuucuuucugcccca

SEQ ID NO: 320346 - RNA, 22 nt, Homo sapiens
auaaggaguaucauauuaaaac

SEQ ID NO: 320347 - RNA, 22 nt, Homo sapiens
auaagguuagcucugagaaagu

SEQ ID NO: 320348 - RNA, 22 nt, Homo sapiens
auaauagcugaucauuuagaag

SEQ ID NO: 320349 - RNA, 22 nt, Homo sapiens
auaauaucagguugugaugaug

SEQ ID NO: 320350 - RNA, 22 nt, Homo sapiens
auaaucaugucugaaaccuuug

SEQ ID NO: 320351 - RNA, 22 nt, Homo sapiens
auacaaguuauuugaacugcgg

SEQ ID NO: 320352 - RNA, 19 nt, Homo sapiens
auacacguguauacauaca

SEQ ID NO: 320353 - RNA, 22 nt, Homo sapiens
auacacguguauauguguaucu

SEQ ID NO: 320354 - RNA, 22 nt, Homo sapiens
auacagguauacaaugcauaau

SEQ ID NO: 320355 - RNA, 22 nt, Homo sapiens
auacaugugccauggugguuug

SEQ ID NO: 320356 - RNA, 22 nt, Homo sapiens
auacaugugccauguucgugug

SEQ ID NO: 320357 - RNA, 22 nt, Homo sapiens
auacuagucaagaauguaugag

SEQ ID NO: 320358 - RNA, 22 nt, Homo sapiens
auacuccugucucagcugagau

SEQ ID NO: 320359 - RNA, 22 nt, Homo sapiens
auagaggacugaggugaucuuu

SEQ ID NO: 320360 - RNA, 22 nt, Homo sapiens
auagaguuagaaagaaauguuu

SEQ ID NO: 320361 - RNA, 22 nt, Homo sapiens
auagaucauugucauuuuagau

SEQ ID NO: 320362 - RNA, 22 nt, Homo sapiens
auagcaagaugauugauccauu

SEQ ID NO: 320363 - RNA, 21 nt, Homo sapiens
auagcacaucagauuuuauua

SEQ ID NO: 320364 - RNA, 22 nt, Homo sapiens
auagcacauggcauccucucuu

SEQ ID NO: 320365 - RNA, 21 nt, Homo sapiens
auagcacuucacuugguuaga

SEQ ID NO: 320366 - RNA, 22 nt, Homo sapiens
auagcagcaccucacucuacug

SEQ ID NO: 320367 - RNA, 22 nt, Homo sapiens
auagcagcagcuaguagugaua

SEQ ID NO: 320368 - RNA, 22 nt, Homo sapiens
auagcagugugagaaugaacua

SEQ ID NO: 320369 - RNA, 22 nt, Homo sapiens
auagcauaucccacaugucaga

SEQ ID NO: 320370 - RNA, 22 nt, Homo sapiens
auaggagugugcacagaguagg

SEQ ID NO: 320371 - RNA, 22 nt, Homo sapiens
auaggcacauuaggaacuuuug

SEQ ID NO: 320372 - RNA, 22 nt, Homo sapiens
auagguagcauagcaggaauau

SEQ ID NO: 320373 - RNA, 22 nt, Homo sapiens
auagguauuuuuaaaugacugu

SEQ ID NO: 320374 - RNA, 22 nt, Homo sapiens
auaguagagagggcaaaaugcu

SEQ ID NO: 320375 - RNA, 22 nt, Homo sapiens
auagucaguagucucauaauga

SEQ ID NO: 320376 - RNA, 22 nt, Homo sapiens
auagugcugcaauaaacacacg

SEQ ID NO: 320377 - RNA, 22 nt, Homo sapiens
aaaagagcugagagguauucuu

SEQ ID NO: 320378 - RNA, 22 nt, Homo sapiens
aaaagcauucagagugcugggc

SEQ ID NO: 320379 - RNA, 22 nt, Homo sapiens
aaaaugcugauauugggcccca

SEQ ID NO: 320380 - RNA, 22 nt, Homo sapiens
aaacaccacgcggucccucgga

SEQ ID NO: 320381 - RNA, 22 nt, Homo sapiens
aaacagucuucuccugagggac

SEQ ID NO: 320382 - RNA, 22 nt, Homo sapiens
aaacauugaccucauccuggca

SEQ ID NO: 320383 - RNA, 22 nt, Homo sapiens
aaacccauauaccagcugugcu

SEQ ID NO: 320384 - RNA, 22 nt, Homo sapiens
aaacugcuuuccaugguggcug

SEQ ID NO: 320385 - RNA, 21 nt, Homo sapiens
aaacuggcccaauuguuccau

SEQ ID NO: 320386 - RNA, 22 nt, Homo sapiens
aaacuugucuaauuauaagcau

SEQ ID NO: 320387 - RNA, 22 nt, Homo sapiens
aaagcacugaauaaauuugcuu

SEQ ID NO: 320388 - RNA, 22 nt, Homo sapiens
aaagcaucacuuuuccuacuuu

SEQ ID NO: 320389 - RNA, 22 nt, Homo sapiens
aaagcugucaaggcaggaggcu

SEQ ID NO: 320390 - RNA, 22 nt, Homo sapiens
aaaggcacacacuccuuguuau

SEQ ID NO: 320391 - RNA, 20 nt, Homo sapiens
aaaggcugugagaacgagau

SEQ ID NO: 320392 - RNA, 22 nt, Homo sapiens
aaagggcuugaauacucuuuuu

SEQ ID NO: 320393 - RNA, 22 nt, Homo sapiens
aaagggcuuuguaaacuucaag

SEQ ID NO: 320394 - RNA, 22 nt, Homo sapiens
aaagguaguacuucuagaaggg

SEQ ID NO: 320395 - RNA, 22 nt, Homo sapiens
aaaguacucaguucaguuccgu

SEQ ID NO: 320396 - RNA, 22 nt, Homo sapiens
aaaguacugggauuggccgggu

SEQ ID NO: 320397 - RNA, 20 nt, Homo sapiens
aaaguaggcuaauaccaaaa

SEQ ID NO: 320398 - RNA, 22 nt, Homo sapiens
aaagugacuuagugccccauuu

SEQ ID NO: 320399 - RNA, 22 nt, Homo sapiens
aaagugauguccaggcuuucag

SEQ ID NO: 320400 - RNA, 22 nt, Homo sapiens
aaagugauuguaguuuuugcca

SEQ ID NO: 320401 - RNA, 22 nt, Homo sapiens
aaagugcaguacuucguauauu

SEQ ID NO: 320402 - RNA, 22 nt, Homo sapiens
aaagugcuaggauuaccugggg

SEQ ID NO: 320403 - RNA, 22 nt, Homo sapiens
aaagugcugagucuaggcgggg

SEQ ID NO: 320404 - RNA, 22 nt, Homo sapiens
aaagugcugggauuaggccagg

SEQ ID NO: 320405 - RNA, 22 nt, Homo sapiens
aaagugcuguagacugggcgca

SEQ ID NO: 320406 - RNA, 22 nt, Homo sapiens
aaagugcuuacuaaguugccaa

SEQ ID NO: 320407 - RNA, 22 nt, Homo sapiens
aaaguggacuaagugaauauga

SEQ ID NO: 320408 - RNA, 22 nt, Homo sapiens
aaaguucuguugauagugcuga

SEQ ID NO: 320409 - RNA, 19 nt, Homo sapiens
aaaguucuucccuuuggag

SEQ ID NO: 320410 - RNA, 22 nt, Homo sapiens
aaauccauuuguucagcuaugc

SEQ ID NO: 320411 - RNA, 22 nt, Homo sapiens
aaaugcagcacucaagugggaa

SEQ ID NO: 320412 - RNA, 22 nt, Homo sapiens
aaaugcccuaaaauggagcauc

SEQ ID NO: 320413 - RNA, 23 nt, Homo sapiens
aaaugcucucaggugccaguaga

SEQ ID NO: 320414 - RNA, 22 nt, Homo sapiens
aaauggauuaaguucacuugcu

SEQ ID NO: 320415 - RNA, 22 nt, Homo sapiens
aaauggcacaguaagggcauuu

SEQ ID NO: 320416 - RNA, 22 nt, Homo sapiens
aaaugggacugggguccuuuga

SEQ ID NO: 320417 - RNA, 18 nt, Homo sapiens
aaauucugucccuucuuc

SEQ ID NO: 320418 - RNA, 22 nt, Homo sapiens
aaauugcacaaguggugauuug

SEQ ID NO: 320419 - RNA, 22 nt, Homo sapiens
aaauugcauugagcugcuuauu

SEQ ID NO: 320420 - RNA, 22 nt, Homo sapiens
aaauugcuuuugaagacuuagu

SEQ ID NO: 320421 - RNA, 23 nt, Homo sapiens
aaauuugccuauuauuccuaugg

SEQ ID NO: 320422 - RNA, 22 nt, Homo sapiens
aacaccaucccuuugaugcuuu

SEQ ID NO: 320423 - RNA, 22 nt, Homo sapiens
aacaccuugcagggauuaugac

SEQ ID NO: 320424 - RNA, 22 nt, Homo sapiens
aacaggguguuugcaguuucuu

SEQ ID NO: 320425 - RNA, 22 nt, Homo sapiens
aacagucaauugcugaugaccu

SEQ ID NO: 320426 - RNA, 22 nt, Homo sapiens
aacagucuccaguuguauccau

SEQ ID NO: 320427 - RNA, 22 nt, Homo sapiens
aacagugcuguuauaaauguac

SEQ ID NO: 320428 - RNA, 22 nt, Homo sapiens
aaccuacauucuuaacuguugc

SEQ ID NO: 320429 - RNA, 22 nt, Homo sapiens
aaccuguaaccauaugaucagu

SEQ ID NO: 320430 - RNA, 22 nt, Homo sapiens
aaccuuuagucagcucuuagga

SEQ ID NO: 320431 - RNA, 22 nt, Homo sapiens
aacuaugucaaauaaaaugagg

SEQ ID NO: 320432 - RNA, 22 nt, Homo sapiens
aacugccucugacauaggcagg

SEQ ID NO: 320433 - RNA, 22 nt, Homo sapiens
aacugcucuuaccagauggguc

SEQ ID NO: 320434 - RNA, 22 nt, Homo sapiens
aacuggccugagaugaaaagug

SEQ ID NO: 320435 - RNA, 22 nt, Homo sapiens
aacuggccuggcgugcagaggg

SEQ ID NO: 320436 - RNA, 22 nt, Homo sapiens
aacugguauugaauuuaggaag

SEQ ID NO: 320437 - RNA, 22 nt, Homo sapiens
aagagagccagcugguauauuu

SEQ ID NO: 320438 - RNA, 22 nt, Homo sapiens
aagagagcuaugugcauaauua

SEQ ID NO: 320439 - RNA, 22 nt, Homo sapiens
aagagcauuggauggggagauu

SEQ ID NO: 320440 - RNA, 22 nt, Homo sapiens
aagaggccuaggaaucuguauu

SEQ ID NO: 320441 - RNA, 22 nt, Homo sapiens
aagagguuauagaguguauacu

SEQ ID NO: 320442 - RNA, 22 nt, Homo sapiens
aagagguuguaccuaaaguguu

SEQ ID NO: 320443 - RNA, 22 nt, Homo sapiens
aagagguuuaacugacucacag

SEQ ID NO: 320444 - RNA, 22 nt, Homo sapiens
aagauaguaaacauuuucugcu

SEQ ID NO: 320445 - RNA, 22 nt, Homo sapiens
aagaugauguucuuuuucuuag

SEQ ID NO: 320446 - RNA, 18 nt, Homo sapiens
uacagaacuggaguagaa

SEQ ID NO: 320447 - RNA, 22 nt, Homo sapiens
uacagaauauuucugcccugag

SEQ ID NO: 320448 - RNA, 22 nt, Homo sapiens
uacaguagaaugucuuucaaaa

SEQ ID NO: 320449 - RNA, 22 nt, Homo sapiens
uacagugcuuuuugguggagaa

SEQ ID NO: 320450 - RNA, 22 nt, Homo sapiens
uacaguggcaugucaggugcuu

SEQ ID NO: 320451 - RNA, 19 nt, Homo sapiens
cauggcuuauaauuuuaau

SEQ ID NO: 320452 - RNA, 22 nt, Homo sapiens
cauggcuuguauaagauucuca

SEQ ID NO: 320453 - RNA, 22 nt, Homo sapiens
cauggcuuuauuuucagcuucu

SEQ ID NO: 320454 - RNA, 22 nt, Homo sapiens
caugguguuaggcacugggaau

SEQ ID NO: 320455 - RNA, 22 nt, Homo sapiens
cauguaguagaaggagccagac

SEQ ID NO: 320456 - RNA, 22 nt, Homo sapiens
caugugcaugagcacauacgug

SEQ ID NO: 320457 - RNA, 22 nt, Homo sapiens
cauuaagcuacuuagaaggugc

SEQ ID NO: 320458 - RNA, 22 nt, Homo sapiens
cauuaguugaagugcagggaga

SEQ ID NO: 320459 - RNA, 22 nt, Homo sapiens
cauuccacauguaggacaauuu

SEQ ID NO: 320460 - RNA, 22 nt, Homo sapiens
cauugcacuccagccuagccaa

SEQ ID NO: 320461 - RNA, 22 nt, Homo sapiens
cauugcacuccagccuggccaa

SEQ ID NO: 320462 - RNA, 16 nt, Homo sapiens
cauugcacucuagccu

SEQ ID NO: 320463 - RNA, 22 nt, Homo sapiens
cauugcacucuagucuggguga

SEQ ID NO: 320464 - RNA, 22 nt, Homo sapiens
cauugcacugcuucuugggugu

SEQ ID NO: 320465 - RNA, 22 nt, Homo sapiens
cauugcacuuagacaacuuuug

SEQ ID NO: 320466 - RNA, 22 nt, Homo sapiens
cauugcagauccuucaaaugac

SEQ ID NO: 320467 - RNA, 22 nt, Homo sapiens
cauugcaguuuuugguguaucu

SEQ ID NO: 320468 - RNA, 22 nt, Homo sapiens
cauugcauuccagucugggcaa

SEQ ID NO: 320469 - RNA, 22 nt, Homo sapiens
cauugcccuccagccugggcaa

SEQ ID NO: 320470 - RNA, 22 nt, Homo sapiens
cauugguugaacagauuguguu

SEQ ID NO: 320471 - RNA, 22 nt, Homo sapiens
cauugguuggacaguucucucu

SEQ ID NO: 320472 - RNA, 22 nt, Homo sapiens
cauugucccucaaugucuauga

SEQ ID NO: 320473 - RNA, 22 nt, Homo sapiens
cauuugcacugagacucagcuu

SEQ ID NO: 320474 - RNA, 22 nt, Homo sapiens
cauuuuacuuuccagacgugga

SEQ ID NO: 320475 - RNA, 22 nt, Homo sapiens
ccaaaguauuuucacugauauc

SEQ ID NO: 320476 - RNA, 22 nt, Homo sapiens
ccaaauccauccaaaucauaga

SEQ ID NO: 320477 - RNA, 22 nt, Homo sapiens
ccaagugcuuaaaauuucauuu

SEQ ID NO: 320478 - RNA, 22 nt, Homo sapiens
ccaaguguucucauuguucaau

SEQ ID NO: 320479 - RNA, 23 nt, Homo sapiens
ccacaaugguugaacuagauuac

SEQ ID NO: 320480 - RNA, 22 nt, Homo sapiens
ccacagucuaugcaacaagguc

SEQ ID NO: 320481 - RNA, 22 nt, Homo sapiens
ccacccuuccacacccugggua

SEQ ID NO: 320482 - RNA, 22 nt, Homo sapiens
ccaccuguacuuaagucacuuu

SEQ ID NO: 320483 - RNA, 22 nt, Homo sapiens
ccacugggcuagguguuuugga

SEQ ID NO: 320484 - RNA, 22 nt, Homo sapiens
ccagaguggagccuuugcgagg

SEQ ID NO: 320485 - RNA, 22 nt, Homo sapiens
ccagaguuucugauucagcagg

SEQ ID NO: 320486 - RNA, 22 nt, Homo sapiens
ccaggguugcuuuagauucuga

SEQ ID NO: 320487 - RNA, 22 nt, Homo sapiens
ccagucuuggugucuguagcac

SEQ ID NO: 320488 - RNA, 21 nt, Homo sapiens
ccaguguaaugauagcaggca

SEQ ID NO: 320489 - RNA, 22 nt, Homo sapiens
ccaguguauuuuugggaccugc

SEQ ID NO: 320490 - RNA, 19 nt, Homo sapiens
ccaguguucugauugcacu

SEQ ID NO: 320491 - RNA, 22 nt, Homo sapiens
ccaguucaaugauauggaaacu

SEQ ID NO: 320492 - RNA, 22 nt, Homo sapiens
ccaucacacugugauuauuauc

SEQ ID NO: 320493 - RNA, 22 nt, Homo sapiens
ccaugaacuagaauagaacaug

SEQ ID NO: 320494 - RNA, 22 nt, Homo sapiens
ccauggcuauucuguaaggguu

SEQ ID NO: 320495 - RNA, 22 nt, Homo sapiens
ccauggcuucugcauucuguca

SEQ ID NO: 320496 - RNA, 22 nt, Homo sapiens
ccauugcacuccagccuaggca

SEQ ID NO: 320497 - RNA, 23 nt, Homo sapiens
ccauugcacuccagccucaguga

SEQ ID NO: 320498 - RNA, 22 nt, Homo sapiens
ccauugcacuucagccuaggug

SEQ ID NO: 320499 - RNA, 22 nt, Homo sapiens
cccacaguggccucauauccuu

SEQ ID NO: 320500 - RNA, 22 nt, Homo sapiens
cccagagacagaaugauaaacu

SEQ ID NO: 320501 - RNA, 22 nt, Homo sapiens
cccagaguucuuaaauacugag

SEQ ID NO: 320502 - RNA, 19 nt, Homo sapiens
cccagugucagagaagggu

SEQ ID NO: 320503 - RNA, 22 nt, Homo sapiens
cccaguguguuguggauauuua

SEQ ID NO: 320504 - RNA, 22 nt, Homo sapiens
cccaguguuacgugacagccug

SEQ ID NO: 320505 - RNA, 22 nt, Homo sapiens
cccaguuuugccacuuacuagc

SEQ ID NO: 320506 - RNA, 22 nt, Homo sapiens
cccugaagacuccaccgucaug

SEQ ID NO: 320507 - RNA, 22 nt, Homo sapiens
cccugaagauacagaguuuggg

SEQ ID NO: 320508 - RNA, 22 nt, Homo sapiens
cccugagaugugaauuucagag

SEQ ID NO: 320509 - RNA, 22 nt, Homo sapiens
cccugagcagccugaguuuccc

SEQ ID NO: 320510 - RNA, 22 nt, Homo sapiens
cccuguagcagcauucuuaaau

SEQ ID NO: 320511 - RNA, 22 nt, Homo sapiens
cccuguguuuagcugaagguuu

SEQ ID NO: 320512 - RNA, 22 nt, Homo sapiens
ccgagguaggaggaucacuuga

SEQ ID NO: 320513 - RNA, 23 nt, Homo sapiens
ccgugagagaguucauagaaagc

SEQ ID NO: 320514 - RNA, 22 nt, Homo sapiens
ccuaggcacugggguccagccc

SEQ ID NO: 320515 - RNA, 22 nt, Homo sapiens
ccucaguguuuaucauuauuuu

SEQ ID NO: 320516 - RNA, 22 nt, Homo sapiens
ccucuguaguccugcaagagga

SEQ ID NO: 320517 - RNA, 22 nt, Homo sapiens
ccucuuuguugagacuucacca

SEQ ID NO: 320518 - RNA, 22 nt, Homo sapiens
ccugagacugauugacucacaa

SEQ ID NO: 320519 - RNA, 22 nt, Homo sapiens
ccugagaucauacuguuaguaa

SEQ ID NO: 320520 - RNA, 22 nt, Homo sapiens
ccugaugacacgggagauguac

SEQ ID NO: 320521 - RNA, 19 nt, Homo sapiens
ccugcuguucuuuugcacc

SEQ ID NO: 320522 - RNA, 22 nt, Homo sapiens
ccuggaaugaagcuuauauugc

SEQ ID NO: 320523 - RNA, 22 nt, Homo sapiens
ccuggaucauugucauucccaa

SEQ ID NO: 320524 - RNA, 22 nt, Homo sapiens
ccuggcacugagcaguguucua

SEQ ID NO: 320525 - RNA, 22 nt, Homo sapiens
ccugguguuuugauggucgggu

SEQ ID NO: 320526 - RNA, 22 nt, Homo sapiens
ccugucuugaagagauccuccu

SEQ ID NO: 320527 - RNA, 22 nt, Homo sapiens
ccugugguuaaccagcuagaug

SEQ ID NO: 320528 - RNA, 22 nt, Homo sapiens
ccuucauucauuaauuuagccc

SEQ ID NO: 320529 - RNA, 22 nt, Homo sapiens
ccuucauugcaucuuuaagaga

SEQ ID NO: 320530 - RNA, 22 nt, Homo sapiens
ccuuggcaauggcuggggcuga

SEQ ID NO: 320531 - RNA, 19 nt, Homo sapiens
ccuugguuagguauauucc

SEQ ID NO: 320532 - RNA, 22 nt, Homo sapiens
ccuuuguuaguuugcugagaau

SEQ ID NO: 320533 - RNA, 22 nt, Homo sapiens
ccuuuuugaguugccagaguuc

SEQ ID NO: 320534 - RNA, 22 nt, Homo sapiens
ccuuuuuguaguggaaguagga

SEQ ID NO: 320535 - RNA, 22 nt, Homo sapiens
cgcccuguagcuagcuagaggu

SEQ ID NO: 320536 - RNA, 22 nt, Homo sapiens
cgcuggugucuaagcgacagcu

SEQ ID NO: 320537 - RNA, 22 nt, Homo sapiens
cgugaggaguauuuuuaggugc

SEQ ID NO: 320538 - RNA, 22 nt, Homo sapiens
cguugcacuccagccugggcaa

SEQ ID NO: 320539 - RNA, 22 nt, Homo sapiens
ucaaggcacuagcugagcugca

SEQ ID NO: 320540 - RNA, 22 nt, Homo sapiens
ucaaugggcuacacauugagug

SEQ ID NO: 320541 - RNA, 16 nt, Homo sapiens
ucacaaacucuagcag

SEQ ID NO: 320542 - RNA, 22 nt, Homo sapiens
ucacaauggcugaacuaauuua

SEQ ID NO: 320543 - RNA, 22 nt, Homo sapiens
ucacaauucucaauuugugaaa

SEQ ID NO: 320544 - RNA, 22 nt, Homo sapiens
ucacacgugaacucaucacaga

SEQ ID NO: 320545 - RNA, 22 nt, Homo sapiens
ucacacugaaacuaggguguga

SEQ ID NO: 320546 - RNA, 22 nt, Homo sapiens
ucacacugaauuugaagcaaug

SEQ ID NO: 320547 - RNA, 22 nt, Homo sapiens
ucacacugucuugguuacucuu

SEQ ID NO: 320548 - RNA, 21 nt, Homo sapiens
ucacagccuaggaccugaaga

SEQ ID NO: 320549 - RNA, 22 nt, Homo sapiens
ucacaguaacuuuguugcuuuu

SEQ ID NO: 320550 - RNA, 22 nt, Homo sapiens
ucacaguagagcuucuuucaga

SEQ ID NO: 320551 - RNA, 22 nt, Homo sapiens
ucacaguagcaaauguuagaaa

SEQ ID NO: 320552 - RNA, 22 nt, Homo sapiens
ucacaguagggaacugacaaag

SEQ ID NO: 320553 - RNA, 22 nt, Homo sapiens
ucacaguauucaugaacaugga

SEQ ID NO: 320554 - RNA, 22 nt, Homo sapiens
ucacagucaaaguaaucauaga

SEQ ID NO: 320555 - RNA, 22 nt, Homo sapiens
ucacagucugcgugaugagaca

SEQ ID NO: 320556 - RNA, 23 nt, Homo sapiens
ucacaguggcugcuuaauuguga

SEQ ID NO: 320557 - RNA, 22 nt, Homo sapiens
ucacaguugauugaaacacagc

SEQ ID NO: 320558 - RNA, 22 nt, Homo sapiens
ucacaugaauugucuuguucca

SEQ ID NO: 320559 - RNA, 22 nt, Homo sapiens
ucacaugcacaucucuggaacc

SEQ ID NO: 320560 - RNA, 22 nt, Homo sapiens
ucacauggcagagaagaagcuc

SEQ ID NO: 320561 - RNA, 22 nt, Homo sapiens
ucacaugugacauauauauuug

SEQ ID NO: 320562 - RNA, 22 nt, Homo sapiens
ucaccaccuuccaggaccacug

SEQ ID NO: 320563 - RNA, 22 nt, Homo sapiens
ucaccaguggcacuccagccug

SEQ ID NO: 320564 - RNA, 22 nt, Homo sapiens
ucaccuggagccuucacauucu

SEQ ID NO: 320565 - RNA, 22 nt, Homo sapiens
ucaccuugcacaguuguguggg

SEQ ID NO: 320566 - RNA, 23 nt, Homo sapiens
ucacggagaccugcaagaccaau

SEQ ID NO: 320567 - RNA, 23 nt, Homo sapiens
ucacuagaguccuggaguuugag

SEQ ID NO: 320568 - RNA, 21 nt, Homo sapiens
ucacuaguaaaaggugaacug

SEQ ID NO: 320569 - RNA, 22 nt, Homo sapiens
ucacugaaaccacugccuccug

SEQ ID NO: 320570 - RNA, 22 nt, Homo sapiens
ucacugcacuccagccuuuaug

SEQ ID NO: 320571 - RNA, 22 nt, Homo sapiens
ucacugcgaccuccaccucccg

SEQ ID NO: 320572 - RNA, 22 nt, Homo sapiens
ucacugcgaccuccgccucccg

SEQ ID NO: 320573 - RNA, 22 nt, Homo sapiens
ucacugcgaccucugccucccg

SEQ ID NO: 320574 - RNA, 19 nt, Homo sapiens
ucacuggacagcacacuca

SEQ ID NO: 320575 - RNA, 22 nt, Homo sapiens
ucacuggacucuagccugggug

SEQ ID NO: 320576 - RNA, 22 nt, Homo sapiens
ucacuggaggagaggaagugga

SEQ ID NO: 320577 - RNA, 22 nt, Homo sapiens
ucacuggagguuccugaaguuc

SEQ ID NO: 320578 - RNA, 22 nt, Homo sapiens
ucacuggccaaauucuggguga

SEQ ID NO: 320579 - RNA, 20 nt, Homo sapiens
ucacuggguucuugaagucu

SEQ ID NO: 320580 - RNA, 20 nt, Homo sapiens
ucacugugaacuucuugagg

SEQ ID NO: 320581 - RNA, 22 nt, Homo sapiens
ucacuuugacggccaacuucua

SEQ ID NO: 320582 - RNA, 22 nt, Homo sapiens
ucacuuuguauagcgacuggcu

SEQ ID NO: 320583 - RNA, 22 nt, Homo sapiens
ucagacacugcccuccaccugu

SEQ ID NO: 320584 - RNA, 22 nt, Homo sapiens
ucagagcaaagacacuuuauca

SEQ ID NO: 320585 - RNA, 22 nt, Homo sapiens
ucagaguagaaacacuuccaua

SEQ ID NO: 320586 - RNA, 22 nt, Homo sapiens
ucagaguguuuuccaacuuggu

SEQ ID NO: 320587 - RNA, 22 nt, Homo sapiens
ucagaucaguuccacaagaacu

SEQ ID NO: 320588 - RNA, 22 nt, Homo sapiens
uugcacagugguuuagagccug

SEQ ID NO: 320589 - RNA, 22 nt, Homo sapiens
uugcacauuuuuucuggcagaa

SEQ ID NO: 320590 - RNA, 22 nt, Homo sapiens
uugcacuccagcucuaggugac

SEQ ID NO: 320591 - RNA, 22 nt, Homo sapiens
uugcacuguaauuuauuuaugu

SEQ ID NO: 320592 - RNA, 22 nt, Homo sapiens
uugcacuugcugaggagugauu

SEQ ID NO: 320593 - RNA, 22 nt, Homo sapiens
uugcagaucccacacucacccu

SEQ ID NO: 320594 - RNA, 22 nt, Homo sapiens
uugcaggugguuuaugcaagac

SEQ ID NO: 320595 - RNA, 22 nt, Homo sapiens
uugcagugguuucacuggcaaa

SEQ ID NO: 320596 - RNA, 22 nt, Homo sapiens
uugcagugugacgacuauauuu

SEQ ID NO: 320597 - RNA, 22 nt, Homo sapiens
uugcauaauaagagggauacgu

SEQ ID NO: 320598 - RNA, 22 nt, Homo sapiens
uugcauauucucugaggcagga

SEQ ID NO: 320599 - RNA, 22 nt, Homo sapiens
uugcauugacacaugaagcuca

SEQ ID NO: 320600 - RNA, 22 nt, Homo sapiens
uugccaucaucucuuacucagu

SEQ ID NO: 320601 - RNA, 22 nt, Homo sapiens
uugccuaggcuggaguguggug

SEQ ID NO: 320602 - RNA, 22 nt, Homo sapiens
uugcuaagucaagagaaaugau

SEQ ID NO: 320603 - RNA, 22 nt, Homo sapiens
uugcuacauugauugccucuuu

SEQ ID NO: 320604 - RNA, 22 nt, Homo sapiens
uugcuauguugcccagucugga

SEQ ID NO: 320605 - RNA, 22 nt, Homo sapiens
uugcuucuuucgucuggcccca

SEQ ID NO: 320606 - RNA, 22 nt, Homo sapiens
uuggaaacauuuaugguaacag

SEQ ID NO: 320607 - RNA, 22 nt, Homo sapiens
uuggaaagagguguuuaugacu

SEQ ID NO: 320608 - RNA, 22 nt, Homo sapiens
uuggaaaguuguuguaguuauu

SEQ ID NO: 320609 - RNA, 22 nt, Homo sapiens
uuggaaauauguuaagugucau

SEQ ID NO: 320610 - RNA, 22 nt, Homo sapiens
uuggaaauguguuugcauucag

SEQ ID NO: 320611 - RNA, 22 nt, Homo sapiens
uuggaagacaaugcugauucuc

SEQ ID NO: 320612 - RNA, 22 nt, Homo sapiens
uuggaagcaugguuauugacgu

SEQ ID NO: 320613 - RNA, 22 nt, Homo sapiens
uuggaagguaaucaaaaguucu

SEQ ID NO: 320614 - RNA, 22 nt, Homo sapiens
uuggaauacuuguuaaagucca

SEQ ID NO: 320615 - RNA, 22 nt, Homo sapiens
uuggaaugcacacugagccugc

SEQ ID NO: 320616 - RNA, 22 nt, Homo sapiens
uuggaauguacucuagccuaug

SEQ ID NO: 320617 - RNA, 22 nt, Homo sapiens
uuggaauuaaccuggugcugga

SEQ ID NO: 320618 - RNA, 22 nt, Homo sapiens
uuggaauuagacaagugguggu

SEQ ID NO: 320619 - RNA, 22 nt, Homo sapiens
uuggaauuuauuuggaugggag

SEQ ID NO: 320620 - RNA, 19 nt, Homo sapiens
uuggaauuuuagaguuuga

SEQ ID NO: 320621 - RNA, 18 nt, Homo sapiens
uuggacggagagucaaau

SEQ ID NO: 320622 - RNA, 22 nt, Homo sapiens
uuggagagucacuaguuagugc

SEQ ID NO: 320623 - RNA, 22 nt, Homo sapiens
uuggagcacuggggcacugaca

SEQ ID NO: 320624 - RNA, 22 nt, Homo sapiens
uuggagcccuaacucucaguac

SEQ ID NO: 320625 - RNA, 22 nt, Homo sapiens
uuggagugugagagcagccugg

SEQ ID NO: 320626 - RNA, 22 nt, Homo sapiens
uuggauaguuuaugaaaaaugg

SEQ ID NO: 320627 - RNA, 22 nt, Homo sapiens
uuggauggucuuuauauaguau

SEQ ID NO: 320628 - RNA, 22 nt, Homo sapiens
uuggauuguuucuagauugggg

SEQ ID NO: 320629 - RNA, 22 nt, Homo sapiens
uuggcaaagugucuggcauuua

SEQ ID NO: 320630 - RNA, 22 nt, Homo sapiens
ugacagugugagacuuugucuc

SEQ ID NO: 320631 - RNA, 22 nt, Homo sapiens
ugacaucugcuugugcccagga

SEQ ID NO: 320632 - RNA, 22 nt, Homo sapiens
ugacaugaagaaaaacagauuu

SEQ ID NO: 320633 - RNA, 22 nt, Homo sapiens
ugacaugagauuugggaggggc

SEQ ID NO: 320634 - RNA, 22 nt, Homo sapiens
ugacauggaagauguucaugau

SEQ ID NO: 320635 - RNA, 22 nt, Homo sapiens
ugacauggaaguagguauacau

SEQ ID NO: 320636 - RNA, 22 nt, Homo sapiens
ugacauguauuagcucagugcu

SEQ ID NO: 320637 - RNA, 22 nt, Homo sapiens
ugacauguccaggugguccugu

SEQ ID NO: 320638 - RNA, 21 nt, Homo sapiens
ugacauguuggugugcugcac

SEQ ID NO: 320639 - RNA, 21 nt, Homo sapiens
ugacauguugguguucugcac

SEQ ID NO: 320640 - RNA, 21 nt, Homo sapiens
ugacauguugguuugcugcac

SEQ ID NO: 320641 - RNA, 18 nt, Homo sapiens
ugacauugagcugagaaa

SEQ ID NO: 320642 - RNA, 22 nt, Homo sapiens
ugacauugggagugaagugaag

SEQ ID NO: 320643 - RNA, 22 nt, Homo sapiens
ugacuaagaugaggucuggaua

SEQ ID NO: 320644 - RNA, 22 nt, Homo sapiens
ugacuagagcaauuggaaacaa

SEQ ID NO: 320645 - RNA, 22 nt, Homo sapiens
ugacuagcagagugagaaacuc

SEQ ID NO: 320646 - RNA, 22 nt, Homo sapiens
ugacuaggaaauuagaacuuuu

SEQ ID NO: 320647 - RNA, 22 nt, Homo sapiens
ugacuauaguaaucacuucaca

SEQ ID NO: 320648 - RNA, 22 nt, Homo sapiens
uugaguagaaguaugucaguau

SEQ ID NO: 320649 - RNA, 22 nt, Homo sapiens
uugaguauuggacugguaucuu

SEQ ID NO: 320650 - RNA, 22 nt, Homo sapiens
uugaguccauucgaugcugauu

SEQ ID NO: 320651 - RNA, 22 nt, Homo sapiens
uugagugaaugaaugauuaaau

SEQ ID NO: 320652 - RNA, 22 nt, Homo sapiens
uugauaguccuguaucuauuuu

SEQ ID NO: 320653 - RNA, 22 nt, Homo sapiens
uugauaguuuaauuaaugcuag

SEQ ID NO: 320654 - RNA, 22 nt, Homo sapiens
uugauaguuuuaaaauuaaucu

SEQ ID NO: 320655 - RNA, 22 nt, Homo sapiens
uugauaugacuaucuuuuaugu

SEQ ID NO: 320656 - RNA, 22 nt, Homo sapiens
uugauauguaguuggacuugau

SEQ ID NO: 320657 - RNA, 22 nt, Homo sapiens
uugauauguggaauauuuaucu

SEQ ID NO: 320658 - RNA, 22 nt, Homo sapiens
uugauauguuguuggauucacu

SEQ ID NO: 320659 - RNA, 22 nt, Homo sapiens
uugauauuaaguacugaagugg

SEQ ID NO: 320660 - RNA, 22 nt, Homo sapiens
uugaucaaaucugagugagaau

SEQ ID NO: 320661 - RNA, 22 nt, Homo sapiens
uugaucaauagaauacaacaga

SEQ ID NO: 320662 - RNA, 22 nt, Homo sapiens
uugaucuguguuagaagcuaag

SEQ ID NO: 320663 - RNA, 22 nt, Homo sapiens
uugauguugaggacauaaaccu

SEQ ID NO: 320664 - RNA, 22 nt, Homo sapiens
uugauugacaugucucuguuca

SEQ ID NO: 320665 - RNA, 22 nt, Homo sapiens
uugcaaaguuugccuccuguag

SEQ ID NO: 320666 - RNA, 22 nt, Homo sapiens
uugcaaaucucuuguguuuggu

SEQ ID NO: 320667 - RNA, 18 nt, Homo sapiens
uugcaaauucuucccugu

SEQ ID NO: 320668 - RNA, 22 nt, Homo sapiens
uugcaacauuguaaguuuauau

SEQ ID NO: 320669 - RNA, 22 nt, Homo sapiens
uugcaagaaaucagagccuucc

SEQ ID NO: 320670 - RNA, 22 nt, Homo sapiens
uugcacaauggaauuuaucuuu

SEQ ID NO: 320671 - RNA, 22 nt, Homo sapiens
uugcacauguugaaccagcaaa

SEQ ID NO: 320672 - RNA, 22 nt, Homo sapiens
uugcaccacugcguuccagccu

SEQ ID NO: 320673 - RNA, 22 nt, Homo sapiens
uugcacuauuaguauagauguc

SEQ ID NO: 320674 - RNA, 22 nt, Homo sapiens
uugcagagccccacacugggcu

SEQ ID NO: 320675 - RNA, 22 nt, Homo sapiens
uugcagagccccugcaaggguc

SEQ ID NO: 320676 - RNA, 22 nt, Homo sapiens
uugcagcaacauggaugaaacu

SEQ ID NO: 320677 - RNA, 22 nt, Homo sapiens
uugcaggcaugagccaccgugc

SEQ ID NO: 320678 - RNA, 22 nt, Homo sapiens
uugcaguagucugaaagcaaua

SEQ ID NO: 320679 - RNA, 22 nt, Homo sapiens
uugcauagaccgaugucuugga

SEQ ID NO: 320680 - RNA, 19 nt, Homo sapiens
uugcauagguugaaccagc

SEQ ID NO: 320681 - RNA, 22 nt, Homo sapiens
uugcauauguugaaccagccuu

SEQ ID NO: 320682 - RNA, 22 nt, Homo sapiens
uugcaugggagcugggugaggc

SEQ ID NO: 320683 - RNA, 22 nt, Homo sapiens
uugcauguacguacagagagag

SEQ ID NO: 320684 - RNA, 22 nt, Homo sapiens
uugcaugucugcuucuccuccu

SEQ ID NO: 320685 - RNA, 22 nt, Homo sapiens
uugcauuagugugguacauuug

SEQ ID NO: 320686 - RNA, 23 nt, Homo sapiens
uugcauugcccuccauaguacuc

SEQ ID NO: 320687 - RNA, 22 nt, Homo sapiens
uugccgggugcaguggcucaug

SEQ ID NO: 320688 - RNA, 22 nt, Homo sapiens
uugcucaggcuagaguucagcu

SEQ ID NO: 320689 - RNA, 22 nt, Homo sapiens
uugcucaggcuggaguacaaug

SEQ ID NO: 320690 - RNA, 22 nt, Homo sapiens
uugcuggugguucgagcaacac

SEQ ID NO: 320691 - RNA, 22 nt, Homo sapiens
uugcuuuguuacugcaguuucc

SEQ ID NO: 320692 - RNA, 22 nt, Homo sapiens
uuggaaacaccuggugagguua

SEQ ID NO: 320693 - RNA, 22 nt, Homo sapiens
uuggaacacauguuuuucuacc

SEQ ID NO: 320694 - RNA, 22 nt, Homo sapiens
uuggaacuguucguauugaaau

SEQ ID NO: 320695 - RNA, 22 nt, Homo sapiens
uuggaagauuacuuaguuuucu

SEQ ID NO: 320696 - RNA, 22 nt, Homo sapiens
uuggaauauaaccuguuucuaa

SEQ ID NO: 320697 - RNA, 23 nt, Homo sapiens
uuggaaugagaccuaagaguuuu

SEQ ID NO: 320698 - RNA, 22 nt, Homo sapiens
uuggaaugcaacagaaggauaa

SEQ ID NO: 320699 - RNA, 22 nt, Homo sapiens
uuggaaugugacugauaauauu

SEQ ID NO: 320700 - RNA, 22 nt, Homo sapiens
uuggacaagauugcagagaauu

SEQ ID NO: 320701 - RNA, 22 nt, Homo sapiens
uuggacugggauggccgaggcu

SEQ ID NO: 320702 - RNA, 22 nt, Homo sapiens
uuggacuucucaaggcaauaaa

SEQ ID NO: 320703 - RNA, 22 nt, Homo sapiens
uuggacuuuaagauagagaugu

SEQ ID NO: 320704 - RNA, 22 nt, Homo sapiens
uuggagagaaaggcaguuccug

SEQ ID NO: 320705 - RNA, 22 nt, Homo sapiens
uuggauuuugguggcaacucau

SEQ ID NO: 320706 - RNA, 22 nt, Homo sapiens
uuggcaaauagguuuuauugca

SEQ ID NO: 320707 - RNA, 22 nt, Homo sapiens
uuggcacgugguggggcucgga

SEQ ID NO: 320708 - RNA, 21 nt, Homo sapiens
uuggcacucuucucuccuuau

SEQ ID NO: 320709 - RNA, 22 nt, Homo sapiens
uuggcagcauuccagccaagca

SEQ ID NO: 320710 - RNA, 22 nt, Homo sapiens
uuggcaguaucuacuacagcua

SEQ ID NO: 320711 - RNA, 22 nt, Homo sapiens
uuggcagucugaggcacagacu

SEQ ID NO: 320712 - RNA, 22 nt, Homo sapiens
uuggcauugccaaacugucaac

SEQ ID NO: 320713 - RNA, 22 nt, Homo sapiens
uuggcauuguggauggaaucau

SEQ ID NO: 320714 - RNA, 22 nt, Homo sapiens
uuggcauuuuggacacccagga

SEQ ID NO: 320715 - RNA, 22 nt, Homo sapiens
uuggccagugucuuuuuuuccu

SEQ ID NO: 320716 - RNA, 22 nt, Homo sapiens
uuggccccucccaaauuucaug

SEQ ID NO: 320717 - RNA, 21 nt, Homo sapiens
uuggccuggaggccugaaugu

SEQ ID NO: 320718 - RNA, 22 nt, Homo sapiens
uuggccuuuucaaugccucuuu

SEQ ID NO: 320719 - RNA, 22 nt, Homo sapiens
uuggcgugaaacagccuuacau

SEQ ID NO: 320720 - RNA, 22 nt, Homo sapiens
uuggcucugcgucucgcggacg

SEQ ID NO: 320721 - RNA, 20 nt, Homo sapiens
gcugugcuuaauacacuuuc

SEQ ID NO: 320722 - RNA, 22 nt, Homo sapiens
gcuguguugugcccagcaucau

SEQ ID NO: 320723 - RNA, 22 nt, Homo sapiens
gcuguuugccgccaucgcagac

SEQ ID NO: 320724 - RNA, 22 nt, Homo sapiens
gcuuugguucaaccaggcaauu

SEQ ID NO: 320725 - RNA, 22 nt, Homo sapiens
gcuuuguuguugaugggaaauc

SEQ ID NO: 320726 - RNA, 22 nt, Homo sapiens
ggaaagaucagcuaaauguaag

SEQ ID NO: 320727 - RNA, 22 nt, Homo sapiens
ggaaaucaucauucucgguaua

SEQ ID NO: 320728 - RNA, 22 nt, Homo sapiens
ggaaaucucugaggcucccuuc

SEQ ID NO: 320729 - RNA, 23 nt, Homo sapiens
ggaaauguuuaagggguugggag

SEQ ID NO: 320730 - RNA, 22 nt, Homo sapiens
ggaaauguuuagcauccacuuu

SEQ ID NO: 320731 - RNA, 22 nt, Homo sapiens
ggaagaauaaugggccuuagag

SEQ ID NO: 320732 - RNA, 22 nt, Homo sapiens
ggaagaauauuaggggauuucg

SEQ ID NO: 320733 - RNA, 20 nt, Homo sapiens
ggaagagugacacaagguau

SEQ ID NO: 320734 - RNA, 22 nt, Homo sapiens
ggaagguaauugucagcucaua

SEQ ID NO: 320735 - RNA, 22 nt, Homo sapiens
ggaaguuaauacagauagagua

SEQ ID NO: 320736 - RNA, 20 nt, Homo sapiens
ggaauagucuacacucugac

SEQ ID NO: 320737 - RNA, 22 nt, Homo sapiens
ggaauauaaaacuuuugacagg

SEQ ID NO: 320738 - RNA, 19 nt, Homo sapiens
ggaaugcuauucaaccuuu

SEQ ID NO: 320739 - RNA, 22 nt, Homo sapiens
ggaaugugugucaugcuuuugc

SEQ ID NO: 320740 - RNA, 22 nt, Homo sapiens
ggaauguuaaggcgcuguuggu

SEQ ID NO: 320741 - RNA, 23 nt, Homo sapiens
ugagguguuaagcagacuugucu

SEQ ID NO: 320742 - RNA, 22 nt, Homo sapiens
ugagguuauuuguucaagaagu

SEQ ID NO: 320743 - RNA, 22 nt, Homo sapiens
ugaguaguauucuaugguaugu

SEQ ID NO: 320744 - RNA, 19 nt, Homo sapiens
ugaguauauuguauucauu

SEQ ID NO: 320745 - RNA, 22 nt, Homo sapiens
ugaguauguaggaugugucuua

SEQ ID NO: 320746 - RNA, 22 nt, Homo sapiens
ugagucaauucuaacaauggca

SEQ ID NO: 320747 - RNA, 23 nt, Homo sapiens
ugagucacuuugcuggggucucu

SEQ ID NO: 320748 - RNA, 22 nt, Homo sapiens
ugagucagucucacucugcugc

SEQ ID NO: 320749 - RNA, 22 nt, Homo sapiens
ugagucaugcuggagucauggc

SEQ ID NO: 320750 - RNA, 22 nt, Homo sapiens
ugagucauuuccuuaugcuacu

SEQ ID NO: 320751 - RNA, 22 nt, Homo sapiens
ugagugaaagaagcacuaagga

SEQ ID NO: 320752 - RNA, 22 nt, Homo sapiens
ugagugaaggggcucuguugug

SEQ ID NO: 320753 - RNA, 22 nt, Homo sapiens
ugagugagguucuacucuguga

SEQ ID NO: 320754 - RNA, 22 nt, Homo sapiens
ugaguggagacuguguguagag

SEQ ID NO: 320755 - RNA, 22 nt, Homo sapiens
ugaguguguaugugcauacaca

SEQ ID NO: 320756 - RNA, 22 nt, Homo sapiens
ugaguuaaucucuacgauagaa

SEQ ID NO: 320757 - RNA, 22 nt, Homo sapiens
ugaguuauuaguagaggcuaug

SEQ ID NO: 320758 - RNA, 22 nt, Homo sapiens
ugaguucuuuguagauucugug

SEQ ID NO: 320759 - RNA, 22 nt, Homo sapiens
ugaguucuuuuagggauauugc

SEQ ID NO: 320760 - RNA, 22 nt, Homo sapiens
ugaguuguugcauucuuggugu

SEQ ID NO: 320761 - RNA, 23 nt, Homo sapiens
ugauaacagcauaugaagauucu

SEQ ID NO: 320762 - RNA, 22 nt, Homo sapiens
ugauaagugagauagcaaguga

SEQ ID NO: 320763 - RNA, 22 nt, Homo sapiens
ugauagucuuugcuggugaccu

SEQ ID NO: 320764 - RNA, 18 nt, Homo sapiens
ugauaucaaugauagcca

SEQ ID NO: 320765 - RNA, 22 nt, Homo sapiens
ugauaucugaauagauacacaa

SEQ ID NO: 320766 - RNA, 22 nt, Homo sapiens
ugauaucugaucauccuugaua

SEQ ID NO: 320767 - RNA, 22 nt, Homo sapiens
ugauaugaaagggaaauaagug

SEQ ID NO: 320768 - RNA, 22 nt, Homo sapiens
ugauaugaaguuagcuggcugu

SEQ ID NO: 320769 - RNA, 22 nt, Homo sapiens
ugauaugcuuugaacucucugg

SEQ ID NO: 320770 - RNA, 22 nt, Homo sapiens
ugauaugugaguauaugguuau

SEQ ID NO: 320771 - RNA, 22 nt, Homo sapiens
ugauauguuagaaucuugcaag

SEQ ID NO: 320772 - RNA, 22 nt, Homo sapiens
ugaucucagcucacugguugaa

SEQ ID NO: 320773 - RNA, 22 nt, Homo sapiens
ugaucugucacuuaucacauuu

SEQ ID NO: 320774 - RNA, 22 nt, Homo sapiens
ugaucugucucggguuaucagu

SEQ ID NO: 320775 - RNA, 22 nt, Homo sapiens
ugaucuuuuuaauguccauggg

SEQ ID NO: 320776 - RNA, 22 nt, Homo sapiens
ugaugaaguauaggaagggcuu

SEQ ID NO: 320777 - RNA, 22 nt, Homo sapiens
ugaugacacugauuucuucaau

SEQ ID NO: 320778 - RNA, 20 nt, Homo sapiens
ugaugcaaaucuuuaaaagu

SEQ ID NO: 320779 - RNA, 21 nt, Homo sapiens
ugaugcaauccgcuaggucgc

SEQ ID NO: 320780 - RNA, 22 nt, Homo sapiens
ugauggcaauggcauucauuuu

SEQ ID NO: 320781 - RNA, 22 nt, Homo sapiens
ugauggcauuucauguuuguaa

SEQ ID NO: 320782 - RNA, 22 nt, Homo sapiens
ugaugguuuuauuaauaggacc

SEQ ID NO: 320783 - RNA, 22 nt, Homo sapiens
ugauguccaguucauagaaacu

SEQ ID NO: 320784 - RNA, 22 nt, Homo sapiens
ugaugucuugcaggcacgagau

SEQ ID NO: 320785 - RNA, 22 nt, Homo sapiens
ugaugugucaucugagagagug

SEQ ID NO: 320786 - RNA, 22 nt, Homo sapiens
ugauuagaggaaugguagauua

SEQ ID NO: 320787 - RNA, 19 nt, Homo sapiens
ugauuguaagcuuggugag

SEQ ID NO: 320788 - RNA, 22 nt, Homo sapiens
ugauuguucuguccccaggggc

SEQ ID NO: 320789 - RNA, 22 nt, Homo sapiens
ugauuuguccauguggcacgug

SEQ ID NO: 320790 - RNA, 18 nt, Homo sapiens
ugcaaacauguguguguu

SEQ ID NO: 320791 - RNA, 22 nt, Homo sapiens
ugcaaauguuaguaacaccacu

SEQ ID NO: 320792 - RNA, 22 nt, Homo sapiens
ugcaagaaacauauuccacaag

SEQ ID NO: 320793 - RNA, 22 nt, Homo sapiens
ugcaagaaucuuucaggcuagc

SEQ ID NO: 320794 - RNA, 22 nt, Homo sapiens
ugcaagacacuguccugggcau

SEQ ID NO: 320795 - RNA, 22 nt, Homo sapiens
ugcaagacugcaguuacuuuug

SEQ ID NO: 320796 - RNA, 22 nt, Homo sapiens
ugcaagaggagacuguacucag

SEQ ID NO: 320797 - RNA, 22 nt, Homo sapiens
ugcaagaugagauuuuggaugg

SEQ ID NO: 320798 - RNA, 22 nt, Homo sapiens
ugcaagcacacccagggauugu

SEQ ID NO: 320799 - RNA, 22 nt, Homo sapiens
ugcaaguaauuccagcuacuga

SEQ ID NO: 320800 - RNA, 22 nt, Homo sapiens
ugcacaguccagugcccacuga

SEQ ID NO: 320801 - RNA, 22 nt, Homo sapiens
ugcaccacugcaccccagucug

SEQ ID NO: 320802 - RNA, 22 nt, Homo sapiens
ugcaccacugcacuccacccug

SEQ ID NO: 320803 - RNA, 22 nt, Homo sapiens
ugcaccacugcacuccagcuug

SEQ ID NO: 320804 - RNA, 22 nt, Homo sapiens
ugcaccacugcacuccaggcug

SEQ ID NO: 320805 - RNA, 22 nt, Homo sapiens
ugcaccacugcuagccugggua

SEQ ID NO: 320806 - RNA, 22 nt, Homo sapiens
ugcaccauugcauacuuaauua

SEQ ID NO: 320807 - RNA, 20 nt, Homo sapiens
ugcagauucaaccaacugug

SEQ ID NO: 320808 - RNA, 22 nt, Homo sapiens
ugcagcauugcacuccagccug

SEQ ID NO: 320809 - RNA, 22 nt, Homo sapiens
ugcagcucagcugcggaguuuu

SEQ ID NO: 320810 - RNA, 22 nt, Homo sapiens
ugcaguaggcccagcgggaggc

SEQ ID NO: 320811 - RNA, 23 nt, Homo sapiens
ugcaguagugagaucuaggcuca

SEQ ID NO: 320812 - RNA, 22 nt, Homo sapiens
uuggcucuggcugggcuccagc

SEQ ID NO: 320813 - RNA, 22 nt, Homo sapiens
uuggcuuaguugaccacagucu

SEQ ID NO: 320814 - RNA, 22 nt, Homo sapiens
uuggcuuguaaaaugaaaagcu

SEQ ID NO: 320815 - RNA, 22 nt, Homo sapiens
uuggcuuuuaugcagcuuaggu

SEQ ID NO: 320816 - RNA, 22 nt, Homo sapiens
uugggaauguccuaauaucucg

SEQ ID NO: 320817 - RNA, 22 nt, Homo sapiens
uugggacccuguccuguaacaa

SEQ ID NO: 320818 - RNA, 22 nt, Homo sapiens
uugggauggaacuuuucaguga

SEQ ID NO: 320819 - RNA, 23 nt, Homo sapiens
uugggcaaaucacugagggcaga

SEQ ID NO: 320820 - RNA, 22 nt, Homo sapiens
uugggcauugggcuaaacuccc

SEQ ID NO: 320821 - RNA, 22 nt, Homo sapiens
uugggccacuuuaguuuccuua

SEQ ID NO: 320822 - RNA, 22 nt, Homo sapiens
uugggcuugagggugcccaguc

SEQ ID NO: 320823 - RNA, 22 nt, Homo sapiens
uugggcuuuuagguccuuaaca

SEQ ID NO: 320824 - RNA, 22 nt, Homo sapiens
uugggguagaauugcaacauau

SEQ ID NO: 320825 - RNA, 22 nt, Homo sapiens
uugggguaggaauauggaauga

SEQ ID NO: 320826 - RNA, 22 nt, Homo sapiens
uuggguagugaguuccuccagg

SEQ ID NO: 320827 - RNA, 22 nt, Homo sapiens
uuggguccucugguccuugguu

SEQ ID NO: 320828 - RNA, 22 nt, Homo sapiens
uugguacuaaaaaguagggugu

SEQ ID NO: 320829 - RNA, 22 nt, Homo sapiens
uugguaggcuggccucucucag

SEQ ID NO: 320830 - RNA, 22 nt, Homo sapiens
uugguaugaaaaggaauuagac

SEQ ID NO: 320831 - RNA, 22 nt, Homo sapiens
uuggucagcuagauuauucccu

SEQ ID NO: 320832 - RNA, 22 nt, Homo sapiens
uuggucaucucccuccuuuuag

SEQ ID NO: 320833 - RNA, 22 nt, Homo sapiens
uugguccacugugaaauuggga

SEQ ID NO: 320834 - RNA, 22 nt, Homo sapiens
uuugaguuugaggugcugauga

SEQ ID NO: 320835 - RNA, 16 nt, Homo sapiens
uuugcaagaucagaag

SEQ ID NO: 320836 - RNA, 22 nt, Homo sapiens
uuugcaauagguuguggggagg

SEQ ID NO: 320837 - RNA, 23 nt, Homo sapiens
uuugcacuugcuccuucuauggc

SEQ ID NO: 320838 - RNA, 22 nt, Homo sapiens
uuugcagagacuuguuaggaau

SEQ ID NO: 320839 - RNA, 22 nt, Homo sapiens
uuugcagagucuuucgcugggc

SEQ ID NO: 320840 - RNA, 22 nt, Homo sapiens
uuugcaguuuauuccuggggcu

SEQ ID NO: 320841 - RNA, 22 nt, Homo sapiens
uuugcauauguugaaccagccu

SEQ ID NO: 320842 - RNA, 22 nt, Homo sapiens
uuugccaaugggaauuuuccua

SEQ ID NO: 320843 - RNA, 18 nt, Homo sapiens
uuugccacuucccagaaa

SEQ ID NO: 320844 - RNA, 22 nt, Homo sapiens
uuugccuguagacacuuacccu

SEQ ID NO: 320845 - RNA, 22 nt, Homo sapiens
uuugcuuaaaucuuaaucagau

SEQ ID NO: 320846 - RNA, 22 nt, Homo sapiens
uuugcuuaguaaauguagaaaa

SEQ ID NO: 320847 - RNA, 22 nt, Homo sapiens
uuugcuucacuguuuggcaaaa

SEQ ID NO: 320848 - RNA, 22 nt, Homo sapiens
uuuggaaugugcacucagauug

SEQ ID NO: 320849 - RNA, 22 nt, Homo sapiens
uuuggcaaagaucaacauguua

SEQ ID NO: 320850 - RNA, 22 nt, Homo sapiens
uuuggcagaaaacaagaaucug

SEQ ID NO: 320851 - RNA, 22 nt, Homo sapiens
uuuggcagaaaacuaaaaggua

SEQ ID NO: 320852 - RNA, 22 nt, Homo sapiens
uuuggcaugggcuauuugcuuu

SEQ ID NO: 320853 - RNA, 22 nt, Homo sapiens
uuuggcauuaagaugcuguauc

SEQ ID NO: 320854 - RNA, 22 nt, Homo sapiens
uuuggcauuagagagacuugca

SEQ ID NO: 320855 - RNA, 22 nt, Homo sapiens
uuuggcauuagauaauugugua

SEQ ID NO: 320856 - RNA, 22 nt, Homo sapiens
uuuggcauuuaaauaugcaugg

SEQ ID NO: 320857 - RNA, 22 nt, Homo sapiens
uuuggcauuugaguuuguagga

SEQ ID NO: 320858 - RNA, 22 nt, Homo sapiens
uuuggcccugagggauggcaua

SEQ ID NO: 320859 - RNA, 22 nt, Homo sapiens
uuugggaaugaguuuaucauuu

SEQ ID NO: 320860 - RNA, 22 nt, Homo sapiens
uuugggaaugguuugucuccca

SEQ ID NO: 320861 - RNA, 22 nt, Homo sapiens
uuugggacuguauuaaaugccu

SEQ ID NO: 320862 - RNA, 22 nt, Homo sapiens
uuugguaguuuguugggaccca

SEQ ID NO: 320863 - RNA, 22 nt, Homo sapiens
uuuggucacugccgccgccagc

SEQ ID NO: 320864 - RNA, 22 nt, Homo sapiens
uuugguguauauguaaacuaug

SEQ ID NO: 320865 - RNA, 22 nt, Homo sapiens
uuugguugcauucacauauuuc

SEQ ID NO: 320866 - RNA, 22 nt, Homo sapiens
uuuguaauccuauuccaaagga

SEQ ID NO: 320867 - RNA, 22 nt, Homo sapiens
uuuguacacuguuggugguuau

SEQ ID NO: 320868 - RNA, 22 nt, Homo sapiens
uuuguacugagccaagauggua

SEQ ID NO: 320869 - RNA, 22 nt, Homo sapiens
uuuguacuucauacaauaacuc

SEQ ID NO: 320870 - RNA, 22 nt, Homo sapiens
uuuguacuugguguucuggaaa

SEQ ID NO: 320871 - RNA, 23 nt, Homo sapiens
uuuguaguagcaugauuuauaau

SEQ ID NO: 320872 - RNA, 20 nt, Homo sapiens
uuuguaucucuggguacugg

SEQ ID NO: 320873 - RNA, 22 nt, Homo sapiens
uuugucacccugaauguaagau

SEQ ID NO: 320874 - RNA, 22 nt, Homo sapiens
uuugucccccguaguucauaua

SEQ ID NO: 320875 - RNA, 22 nt, Homo sapiens
uuuguccccgcccagaucucau

SEQ ID NO: 320876 - RNA, 22 nt, Homo sapiens
uuugugaaugucauaagcucca

SEQ ID NO: 320877 - RNA, 22 nt, Homo sapiens
uuugugacacaaacacauauau

SEQ ID NO: 320878 - RNA, 22 nt, Homo sapiens
uuugugacuugcuucucagaau

SEQ ID NO: 320879 - RNA, 22 nt, Homo sapiens
uuugugcuaacuuuaacucuua

SEQ ID NO: 320880 - RNA, 22 nt, Homo sapiens
uuugugcuaaugcuagauuacu

SEQ ID NO: 320881 - RNA, 22 nt, Homo sapiens
uuugugcuccucucaguaugug

SEQ ID NO: 320882 - RNA, 22 nt, Homo sapiens
uuuguggaaugcucauguguag

SEQ ID NO: 320883 - RNA, 22 nt, Homo sapiens
uuuguguccccacccacaucuc

SEQ ID NO: 320884 - RNA, 22 nt, Homo sapiens
uuugugugugauuauaaaaggu

SEQ ID NO: 320885 - RNA, 22 nt, Homo sapiens
uuuuaacagccaggggacggcc

SEQ ID NO: 320886 - RNA, 20 nt, Homo sapiens
uuuuagcuuuuauugaaagc

SEQ ID NO: 320887 - RNA, 22 nt, Homo sapiens
uuuucaguuuuccagguagccg

SEQ ID NO: 320888 - RNA, 22 nt, Homo sapiens
uuuugcaaauuccaguggccau

SEQ ID NO: 320889 - RNA, 20 nt, Homo sapiens
uuuugcacuccuacuaaggu

SEQ ID NO: 320890 - RNA, 22 nt, Homo sapiens
uuuugcuccuggcaaacucaua

SEQ ID NO: 320891 - RNA, 22 nt, Homo sapiens
uuuugcuuuuccucggucccac

SEQ ID NO: 320892 - RNA, 22 nt, Homo sapiens
uuuuggcuagaaauauaccucc

SEQ ID NO: 320893 - RNA, 22 nt, Homo sapiens
uuuuggcuuaaagagaauguau

SEQ ID NO: 320894 - RNA, 22 nt, Homo sapiens
uuuuggcuuuuccucagcaagc

SEQ ID NO: 320895 - RNA, 22 nt, Homo sapiens
uuuugggggugauucacacagu

SEQ ID NO: 320896 - RNA, 22 nt, Homo sapiens
uuuugguaaugaacuuaggaag

SEQ ID NO: 320897 - RNA, 22 nt, Homo sapiens
uuuugguguacaauucuaugga

SEQ ID NO: 320898 - RNA, 22 nt, Homo sapiens
uuuugguuguuggguaagagua

SEQ ID NO: 320899 - RNA, 22 nt, Homo sapiens
uuuuugaguaaauauaaauugu

SEQ ID NO: 320900 - RNA, 22 nt, Homo sapiens
uuuuuggaggagguuagaucau

SEQ ID NO: 320901 - RNA, 22 nt, Homo sapiens
uuuuuggguaaugauuaucaau

SEQ ID NO: 320902 - RNA, 22 nt, Homo sapiens
ggugcagcacaccaacauggca

SEQ ID NO: 320903 - RNA, 22 nt, Homo sapiens
gguggcuuuuugugauggcuga

SEQ ID NO: 320904 - RNA, 22 nt, Homo sapiens
guaaauaccaguuucuggaaca

SEQ ID NO: 320905 - RNA, 22 nt, Homo sapiens
guaaaucucuguuuucauggac

SEQ ID NO: 320906 - RNA, 22 nt, Homo sapiens
guaaaugcagaugcaugaccuu

SEQ ID NO: 320907 - RNA, 22 nt, Homo sapiens
guaacacucuaaagggaugcac

SEQ ID NO: 320908 - RNA, 20 nt, Homo sapiens
guaacagcacuuucccaaag

SEQ ID NO: 320909 - RNA, 22 nt, Homo sapiens
guaacccuguaggccuaaagua

SEQ ID NO: 320910 - RNA, 22 nt, Homo sapiens
guaagagcauguaguggcucua

SEQ ID NO: 320911 - RNA, 22 nt, Homo sapiens
guaagugguagagcugggcuau

SEQ ID NO: 320912 - RNA, 22 nt, Homo sapiens
guaaucucagcuacuugggagc

SEQ ID NO: 320913 - RNA, 22 nt, Homo sapiens
guaaucucagcuacuugggagu

SEQ ID NO: 320914 - RNA, 22 nt, Homo sapiens
guacaagugcaguuucguuaca

SEQ ID NO: 320915 - RNA, 22 nt, Homo sapiens
guacacaacaugcagguuuguu

SEQ ID NO: 320916 - RNA, 22 nt, Homo sapiens
guacaguaguaaaagugaauga

SEQ ID NO: 320917 - RNA, 22 nt, Homo sapiens
guacaguggguguagggaccag

SEQ ID NO: 320918 - RNA, 22 nt, Homo sapiens
guacauguaugcaugcaugcau

SEQ ID NO: 320919 - RNA, 22 nt, Homo sapiens
guaccucaguuggaaaugcaga

SEQ ID NO: 320920 - RNA, 22 nt, Homo sapiens
guagaagcacagggccuguauu

SEQ ID NO: 320921 - RNA, 22 nt, Homo sapiens
guagaauguauacaguauacag

SEQ ID NO: 320922 - RNA, 22 nt, Homo sapiens
guagagguagacuuccuugucu

SEQ ID NO: 320923 - RNA, 22 nt, Homo sapiens
guagagguagauucuguuuuga

SEQ ID NO: 320924 - RNA, 22 nt, Homo sapiens
guagagugcugggcacuggcuc

SEQ ID NO: 320925 - RNA, 22 nt, Homo sapiens
guagcagaauaucagauaauuu

SEQ ID NO: 320926 - RNA, 22 nt, Homo sapiens
guagcagucacauagcagauug

SEQ ID NO: 320927 - RNA, 22 nt, Homo sapiens
uuacaguaugaguaagaguucu

SEQ ID NO: 320928 - RNA, 23 nt, Homo sapiens
uuacaguggcaugaucucugcuc

SEQ ID NO: 320929 - RNA, 22 nt, Homo sapiens
uuacaguguuuguucuguuacu

SEQ ID NO: 320930 - RNA, 22 nt, Homo sapiens
uuacauaguguguggguucggg

SEQ ID NO: 320931 - RNA, 22 nt, Homo sapiens
uuacaugcaugacaaggugcca

SEQ ID NO: 320932 - RNA, 22 nt, Homo sapiens
uuacaugucuugguaagguuag

SEQ ID NO: 320933 - RNA, 22 nt, Homo sapiens
uuacauguuguggguuguggcc

SEQ ID NO: 320934 - RNA, 22 nt, Homo sapiens
uuaccugagaaggugacauuug

SEQ ID NO: 320935 - RNA, 22 nt, Homo sapiens
uuacuagaaacagggcuucgcc

SEQ ID NO: 320936 - RNA, 20 nt, Homo sapiens
uuacuauguaguauuggcuc

SEQ ID NO: 320937 - RNA, 22 nt, Homo sapiens
uccuggcuccacuguuuauucc

SEQ ID NO: 320938 - RNA, 22 nt, Homo sapiens
uccuucacucuacaucuuuguu

SEQ ID NO: 320939 - RNA, 22 nt, Homo sapiens
uccuucaugcaucaauguaucc

SEQ ID NO: 320940 - RNA, 22 nt, Homo sapiens
uccuucauuugucaacucuagu

SEQ ID NO: 320941 - RNA, 22 nt, Homo sapiens
uccuugagaggacagagccaua

SEQ ID NO: 320942 - RNA, 22 nt, Homo sapiens
uccuuuggcuaacuuucuaagu

SEQ ID NO: 320943 - RNA, 22 nt, Homo sapiens
uccuuuggucaguauucuuuug

SEQ ID NO: 320944 - RNA, 22 nt, Homo sapiens
uccuuugguucuugucacccca

SEQ ID NO: 320945 - RNA, 22 nt, Homo sapiens
uccuuuguuacaguuggcucug

SEQ ID NO: 320946 - RNA, 18 nt, Homo sapiens
uccuuuugggguaggaga

SEQ ID NO: 320947 - RNA, 22 nt, Homo sapiens
ucgcagcucacuggagccucga

SEQ ID NO: 320948 - RNA, 19 nt, Homo sapiens
ucgcgccauucuccugccu

SEQ ID NO: 320949 - RNA, 22 nt, Homo sapiens
ucgcugggaaccagagguaaag

SEQ ID NO: 320950 - RNA, 22 nt, Homo sapiens
ucuaagacuaagggcuagcuuc

SEQ ID NO: 320951 - RNA, 22 nt, Homo sapiens
ucuaaguaguagcuggucagaa

SEQ ID NO: 320952 - RNA, 17 nt, Homo sapiens
ucuaauaauaugcauuu

SEQ ID NO: 320953 - RNA, 22 nt, Homo sapiens
ucuacccugugagggacacagu

SEQ ID NO: 320954 - RNA, 22 nt, Homo sapiens
ucuagcacuuacuggcugugug

SEQ ID NO: 320955 - RNA, 22 nt, Homo sapiens
ucuagccuaugaagcuugucca

SEQ ID NO: 320956 - RNA, 22 nt, Homo sapiens
ucuauggauaaaaugcccucau

SEQ ID NO: 320957 - RNA, 22 nt, Homo sapiens
ucuauugguugaaauugcuuuu

SEQ ID NO: 320958 - RNA, 22 nt, Homo sapiens
ucucaaccucccaaguagcugg

SEQ ID NO: 320959 - RNA, 22 nt, Homo sapiens
ucucaagaugguagaugggaau

SEQ ID NO: 320960 - RNA, 22 nt, Homo sapiens
ucucaauuugauuacauucaua

SEQ ID NO: 320961 - RNA, 22 nt, Homo sapiens
ucucacaccccucucauauacc

SEQ ID NO: 320962 - RNA, 22 nt, Homo sapiens
ucucacacugaauguguguggg

SEQ ID NO: 320963 - RNA, 22 nt, Homo sapiens
ucucagcacaaacaaaauugcu

SEQ ID NO: 320964 - RNA, 22 nt, Homo sapiens
ucucagugacugcugggucccc

SEQ ID NO: 320965 - RNA, 22 nt, Homo sapiens
ucucaguguuaucuaucugccu

SEQ ID NO: 320966 - RNA, 19 nt, Homo sapiens
ucucaguguuggucaggug

SEQ ID NO: 320967 - RNA, 22 nt, Homo sapiens
ucucaugaagauagagaauaga

SEQ ID NO: 320968 - RNA, 20 nt, Homo sapiens
ucucauggagggaaagagca

SEQ ID NO: 320969 - RNA, 23 nt, Homo sapiens
ucucauuccuugaaaauaaugac

SEQ ID NO: 320970 - RNA, 22 nt, Homo sapiens
ucuccaguuuccuucgucuauc

SEQ ID NO: 320971 - RNA, 22 nt, Homo sapiens
ucuccauuguccagaugaggaa

SEQ ID NO: 320972 - RNA, 22 nt, Homo sapiens
ucucccuaccugagccgagcca

SEQ ID NO: 320973 - RNA, 22 nt, Homo sapiens
ucucugauuaaacaagauagug

SEQ ID NO: 320974 - RNA, 22 nt, Homo sapiens
ucucuggauaucuacuuauguu

SEQ ID NO: 320975 - RNA, 22 nt, Homo sapiens
ucucugguuaugucauuaagca

SEQ ID NO: 320976 - RNA, 22 nt, Homo sapiens
ucucugguuuucaaagcaguau

SEQ ID NO: 320977 - RNA, 22 nt, Homo sapiens
ucucuuggugacuuaaaauguu

SEQ ID NO: 320978 - RNA, 22 nt, Homo sapiens
aucacuguccacucaucuuucu

SEQ ID NO: 320979 - RNA, 23 nt, Homo sapiens
aucacuguuaacaauuucuuccu

SEQ ID NO: 320980 - RNA, 22 nt, Homo sapiens
aucacuuucuauuucugugcca

SEQ ID NO: 320981 - RNA, 22 nt, Homo sapiens
aucagaaucucuugagaguguu

SEQ ID NO: 320982 - RNA, 20 nt, Homo sapiens
aucagagccggugaaagggc

SEQ ID NO: 320983 - RNA, 22 nt, Homo sapiens
aucagagccugugugcccugaa

SEQ ID NO: 320984 - RNA, 22 nt, Homo sapiens
aucagagugaaacaugggagau

SEQ ID NO: 320985 - RNA, 22 nt, Homo sapiens
aucagaguugucagggagcuuu

SEQ ID NO: 320986 - RNA, 22 nt, Homo sapiens
aucagauaccuguugggaaaug

SEQ ID NO: 320987 - RNA, 22 nt, Homo sapiens
aucagauggcuaaaacagaaga

SEQ ID NO: 320988 - RNA, 22 nt, Homo sapiens
aucagauguuuguauaggagua

SEQ ID NO: 320989 - RNA, 22 nt, Homo sapiens
aucagauuccacauuuuaucag

SEQ ID NO: 320990 - RNA, 22 nt, Homo sapiens
aucagcaguguaaaaacggacu

SEQ ID NO: 320991 - RNA, 22 nt, Homo sapiens
aucagcauucccaaaugaugug

SEQ ID NO: 320992 - RNA, 22 nt, Homo sapiens
aucaggcacacauuggaguuug

SEQ ID NO: 320993 - RNA, 23 nt, Homo sapiens
aucagguuguagaauguguuugc

SEQ ID NO: 320994 - RNA, 22 nt, Homo sapiens
aucauaucauuggugaacagug

SEQ ID NO: 320995 - RNA, 22 nt, Homo sapiens
aucaucacaguuguguguaaug

SEQ ID NO: 320996 - RNA, 22 nt, Homo sapiens
aucaugcacaugcauagguaug

SEQ ID NO: 320997 - RNA, 22 nt, Homo sapiens
aucauguaguaagacacauuua

SEQ ID NO: 320998 - RNA, 22 nt, Homo sapiens
aucauguuuauguguaggauau

SEQ ID NO: 320999 - RNA, 22 nt, Homo sapiens
aucauuaguuguggaauucuug

SEQ ID NO: 321000 - RNA, 22 nt, Homo sapiens
aucauugugcaucuucauucca

SEQ ID NO: 321001 - RNA, 22 nt, Homo sapiens
aucauugugugaguugauggga

SEQ ID NO: 321002 - RNA, 22 nt, Homo sapiens
auccaagagacugaugacuucc

SEQ ID NO: 321003 - RNA, 22 nt, Homo sapiens
auccagaugggcuuaauguaau

SEQ ID NO: 321004 - RNA, 22 nt, Homo sapiens
auccaucagacggcaggcguug

SEQ ID NO: 321005 - RNA, 22 nt, Homo sapiens
auccauugucuaaugcuaagau

SEQ ID NO: 321006 - RNA, 22 nt, Homo sapiens
aucccaguucagccucugacac

SEQ ID NO: 321007 - RNA, 22 nt, Homo sapiens
auccccugcacggggugucauu

SEQ ID NO: 321008 - RNA, 22 nt, Homo sapiens
aucccuguguccagcaccugug

SEQ ID NO: 321009 - RNA, 22 nt, Homo sapiens
auccuguaggcuaguagacagu

SEQ ID NO: 321010 - RNA, 21 nt, Homo sapiens
auccuucuuuuucaaccugug

SEQ ID NO: 321011 - RNA, 22 nt, Homo sapiens
aucgcacuccauccugggcaac

SEQ ID NO: 321012 - RNA, 22 nt, Homo sapiens
aucuaaaucucauaugggcaca

SEQ ID NO: 321013 - RNA, 22 nt, Homo sapiens
aucuacagccagucugguuugu

SEQ ID NO: 321014 - RNA, 22 nt, Homo sapiens
aucuacuugcugggucucugga

SEQ ID NO: 321015 - RNA, 22 nt, Homo sapiens
aucuagagacauaguaaagaau

SEQ ID NO: 321016 - RNA, 22 nt, Homo sapiens
aucucauuccuucugggcugau

SEQ ID NO: 321017 - RNA, 22 nt, Homo sapiens
aucugcauucccauguuuauug

SEQ ID NO: 321018 - RNA, 22 nt, Homo sapiens
aucuggguccguucugcuucuc

SEQ ID NO: 321019 - RNA, 22 nt, Homo sapiens
aucugguauuacugcaacugua

SEQ ID NO: 321020 - RNA, 22 nt, Homo sapiens
aucugguguuuccuucacauug

SEQ ID NO: 321021 - RNA, 22 nt, Homo sapiens
aucugugaaugaaguuauuuug

SEQ ID NO: 321022 - RNA, 22 nt, Homo sapiens
aucuugcauuugcuaaaaugca

SEQ ID NO: 321023 - RNA, 22 nt, Homo sapiens
aucuuugcugagaugcauggca

SEQ ID NO: 321024 - RNA, 22 nt, Homo sapiens
augaaaacaugauuugccuguu

SEQ ID NO: 321025 - RNA, 22 nt, Homo sapiens
augaaagugauaaaugucucua

SEQ ID NO: 321026 - RNA, 22 nt, Homo sapiens
augaaaguguguggaaacuuga

SEQ ID NO: 321027 - RNA, 22 nt, Homo sapiens
augaacgugugcauauaagcag

SEQ ID NO: 321028 - RNA, 22 nt, Homo sapiens
augaacuaugugggauguuuua

SEQ ID NO: 321029 - RNA, 22 nt, Homo sapiens
augaacucaucauuuuuauggc

SEQ ID NO: 321030 - RNA, 22 nt, Homo sapiens
augaagauguugccuuuuuaau

SEQ ID NO: 321031 - RNA, 22 nt, Homo sapiens
augaagcuagcugauugcugau

SEQ ID NO: 321032 - RNA, 22 nt, Homo sapiens
augaaguuagcucauuucuuuu

SEQ ID NO: 321033 - RNA, 22 nt, Homo sapiens
augaauacugcugcaaugaaca

SEQ ID NO: 321034 - RNA, 22 nt, Homo sapiens
augaauccauuccugccacaga

SEQ ID NO: 321035 - RNA, 22 nt, Homo sapiens
augaaugcagcacuguuuuucu

SEQ ID NO: 321036 - RNA, 23 nt, Homo sapiens
augaauguaaagaaugugggaag

SEQ ID NO: 321037 - RNA, 20 nt, Homo sapiens
augaauguccuugauggcau

SEQ ID NO: 321038 - RNA, 22 nt, Homo sapiens
augaauuuucugauguugggua

SEQ ID NO: 321039 - RNA, 22 nt, Homo sapiens
augacaguaugacuccaaaagu

SEQ ID NO: 321040 - RNA, 22 nt, Homo sapiens
augacauuccacagccguagag

SEQ ID NO: 321041 - RNA, 22 nt, Homo sapiens
augaccaugauccuugccgacc

SEQ ID NO: 321042 - RNA, 21 nt, Homo sapiens
augacccuggguguccuuucc

SEQ ID NO: 321043 - RNA, 18 nt, Homo sapiens
augaccugcggguuauau

SEQ ID NO: 321044 - RNA, 22 nt, Homo sapiens
augacugaguagcauuccauua

SEQ ID NO: 321045 - RNA, 22 nt, Homo sapiens
augacugucuugcagaggcuau

SEQ ID NO: 321046 - RNA, 22 nt, Homo sapiens
augagaacauaucaagugauug

SEQ ID NO: 321047 - RNA, 18 nt, Homo sapiens
augagagccgauuccugg

SEQ ID NO: 321048 - RNA, 22 nt, Homo sapiens
augagauaaaccaucucuuaag

SEQ ID NO: 321049 - RNA, 22 nt, Homo sapiens
augagauacuacaaaugaguuu

SEQ ID NO: 321050 - RNA, 22 nt, Homo sapiens
augagauaggaacaaacuuaca

SEQ ID NO: 321051 - RNA, 22 nt, Homo sapiens
augagauuguuugugugaaaua

SEQ ID NO: 321052 - RNA, 22 nt, Homo sapiens
augagcugauuuccuuaccaua

SEQ ID NO: 321053 - RNA, 22 nt, Homo sapiens
augaggagguaugauuuucuga

SEQ ID NO: 321054 - RNA, 22 nt, Homo sapiens
augaggcacugcgcccuacuga

SEQ ID NO: 321055 - RNA, 22 nt, Homo sapiens
augagggcggacgcccuggaga

SEQ ID NO: 321056 - RNA, 22 nt, Homo sapiens
augagguaguagaaagucaggu

SEQ ID NO: 321057 - RNA, 23 nt, Homo sapiens
augagguaucugagcccagaaau

SEQ ID NO: 321058 - RNA, 22 nt, Homo sapiens
augagguccuagccaacuuuuu

SEQ ID NO: 321059 - RNA, 22 nt, Homo sapiens
augaggugcagaggaaaugagu

SEQ ID NO: 321060 - RNA, 20 nt, Homo sapiens
augagguguaugacacugaa

SEQ ID NO: 321061 - RNA, 22 nt, Homo sapiens
augaguaugagaauacauuaag

SEQ ID NO: 321062 - RNA, 22 nt, Homo sapiens
augaguuccuuccuugccuagg

SEQ ID NO: 321063 - RNA, 22 nt, Homo sapiens
augauacuggcuucauagaaug

SEQ ID NO: 321064 - RNA, 22 nt, Homo sapiens
augauaugagaaaggaucaaca

SEQ ID NO: 321065 - RNA, 22 nt, Homo sapiens
augauauggguugucaguugua

SEQ ID NO: 321066 - RNA, 22 nt, Homo sapiens
augauauguuuguagcuaucuc

SEQ ID NO: 321067 - RNA, 22 nt, Homo sapiens
augauauuauucuagcccagag

SEQ ID NO: 321068 - RNA, 22 nt, Homo sapiens
augaucacaccacugcacucca

SEQ ID NO: 321069 - RNA, 22 nt, Homo sapiens
augaugaaguaagugcuuagga

SEQ ID NO: 321070 - RNA, 22 nt, Homo sapiens
augaugcugagguuugggguau

SEQ ID NO: 321071 - RNA, 22 nt, Homo sapiens
caaggaauucucaauagaguua

SEQ ID NO: 321072 - RNA, 22 nt, Homo sapiens
caagugacugagccgccucggc

SEQ ID NO: 321073 - RNA, 22 nt, Homo sapiens
caagugcuuucuuggggauuua

SEQ ID NO: 321074 - RNA, 22 nt, Homo sapiens
caaguguuuccuuaaauacuug

SEQ ID NO: 321075 - RNA, 22 nt, Homo sapiens
caauacuguuaccugaaauagg

SEQ ID NO: 321076 - RNA, 19 nt, Homo sapiens
caauacuucuuggcauaca

SEQ ID NO: 321077 - RNA, 21 nt, Homo sapiens
caaugacacuguagcugugcu

SEQ ID NO: 321078 - RNA, 22 nt, Homo sapiens
caauggcacgaucucgucucac

SEQ ID NO: 321079 - RNA, 22 nt, Homo sapiens
caaugguacuagauaucuucag

SEQ ID NO: 321080 - RNA, 22 nt, Homo sapiens
caaugugcuuggggcacaugag

SEQ ID NO: 321081 - RNA, 22 nt, Homo sapiens
cacaaaguagauuagucuucca

SEQ ID NO: 321082 - RNA, 22 nt, Homo sapiens
cacaccuaccucauuauggaca

SEQ ID NO: 321083 - RNA, 22 nt, Homo sapiens
cacagaauucauuggauuaccu

SEQ ID NO: 321084 - RNA, 22 nt, Homo sapiens
cacagcuagucaaugguagaca

SEQ ID NO: 321085 - RNA, 22 nt, Homo sapiens
cacaggaagaggcacggucccu

SEQ ID NO: 321086 - RNA, 22 nt, Homo sapiens
cacaggucauccuggaucaagg

SEQ ID NO: 321087 - RNA, 22 nt, Homo sapiens
cacagucugggcuuguuuguac

SEQ ID NO: 321088 - RNA, 22 nt, Homo sapiens
cacagucuugcaauauugagau

SEQ ID NO: 321089 - RNA, 21 nt, Homo sapiens
cacauggaggcagagagugua

SEQ ID NO: 321090 - RNA, 22 nt, Homo sapiens
cacauguuuuagcauggcuguu

SEQ ID NO: 321091 - RNA, 22 nt, Homo sapiens
caccagguuggagugcaguggu

SEQ ID NO: 321092 - RNA, 23 nt, Homo sapiens
caccaguauaauuagcuuuuaaa

SEQ ID NO: 321093 - RNA, 22 nt, Homo sapiens
caccauguguucagaaggauug

SEQ ID NO: 321094 - RNA, 22 nt, Homo sapiens
cacccgugcucccuccagcugc

SEQ ID NO: 321095 - RNA, 22 nt, Homo sapiens
caccugagcgggaugcucgccu

SEQ ID NO: 321096 - RNA, 22 nt, Homo sapiens
cacugcacuccagccuaagagg

SEQ ID NO: 321097 - RNA, 22 nt, Homo sapiens
cacugcacuccagcuuugguga

SEQ ID NO: 321098 - RNA, 22 nt, Homo sapiens
cacugcacuccagucccgucuc

SEQ ID NO: 321099 - RNA, 21 nt, Homo sapiens
cacugcaucacaggacagcau

SEQ ID NO: 321100 - RNA, 22 nt, Homo sapiens
cacugcauccuccaccugccag

SEQ ID NO: 321101 - RNA, 22 nt, Homo sapiens
cacugcauccucugccuggcgg

SEQ ID NO: 321102 - RNA, 22 nt, Homo sapiens
cacugcauggccacccauguua

SEQ ID NO: 321103 - RNA, 22 nt, Homo sapiens
cacugcauggucuagcuggguu

SEQ ID NO: 321104 - RNA, 23 nt, Homo sapiens
cacugggcagcagguguucccag

SEQ ID NO: 321105 - RNA, 22 nt, Homo sapiens
cacuuugguucaccugaguuuc

SEQ ID NO: 321106 - RNA, 22 nt, Homo sapiens
cagagaacauucagagcuguag

SEQ ID NO: 321107 - RNA, 22 nt, Homo sapiens
cagagaaugucuuuuuuaacca

SEQ ID NO: 321108 - RNA, 22 nt, Homo sapiens
cagagaucaugcaacugcucgc

SEQ ID NO: 321109 - RNA, 20 nt, Homo sapiens
cagagcaaagcaguccuggc

SEQ ID NO: 321110 - RNA, 22 nt, Homo sapiens
cagaugcaugaccugggcuugg

SEQ ID NO: 321111 - RNA, 22 nt, Homo sapiens
cagauggucuuaaggcagccuu

SEQ ID NO: 321112 - RNA, 22 nt, Homo sapiens
cagcaaaucauccuauuugagc

SEQ ID NO: 321113 - RNA, 22 nt, Homo sapiens
cagcaagucucuaagaguucau

SEQ ID NO: 321114 - RNA, 20 nt, Homo sapiens
cagcacgcacaugagacugu

SEQ ID NO: 321115 - RNA, 22 nt, Homo sapiens
cagcccuacacagacugacuca

SEQ ID NO: 321116 - RNA, 22 nt, Homo sapiens
cagcuaaauuguuaaauccaag

SEQ ID NO: 321117 - RNA, 20 nt, Homo sapiens
cagcuagugguaggagucgg

SEQ ID NO: 321118 - RNA, 22 nt, Homo sapiens
cagcucauugcagucucgaccu

SEQ ID NO: 321119 - RNA, 23 nt, Homo sapiens
cagcucauuuggguccccuuguc

SEQ ID NO: 321120 - RNA, 22 nt, Homo sapiens
cagcugguggcaagaagacaga

SEQ ID NO: 321121 - RNA, 22 nt, Homo sapiens
cagcuggugggagcuggguucc

SEQ ID NO: 321122 - RNA, 22 nt, Homo sapiens
cagcugguguuacaaaccagag

SEQ ID NO: 321123 - RNA, 22 nt, Homo sapiens
cagcuguuguuaugucugcagg

SEQ ID NO: 321124 - RNA, 22 nt, Homo sapiens
caggcaacauggcgaaacucug

SEQ ID NO: 321125 - RNA, 22 nt, Homo sapiens
caggcauuguauuguaaucccc

SEQ ID NO: 321126 - RNA, 22 nt, Homo sapiens
caggcuuuuccacacauggguu

SEQ ID NO: 321127 - RNA, 20 nt, Homo sapiens
cagggcaaugaggagguaaa

SEQ ID NO: 321128 - RNA, 22 nt, Homo sapiens
caggguccccuaccuuuugaug

SEQ ID NO: 321129 - RNA, 22 nt, Homo sapiens
cagguacaugcaugugugugca

SEQ ID NO: 321130 - RNA, 22 nt, Homo sapiens
cagguaggccaauguuuuccaa

SEQ ID NO: 321131 - RNA, 22 nt, Homo sapiens
cagguagucaacgggucuugga

SEQ ID NO: 321132 - RNA, 22 nt, Homo sapiens
caggugcauuggcugacaccug

SEQ ID NO: 321133 - RNA, 22 nt, Homo sapiens
caggugcuuacuuaauagccau

SEQ ID NO: 321134 - RNA, 22 nt, Homo sapiens
caguacaauguugauuagaagu

SEQ ID NO: 321135 - RNA, 22 nt, Homo sapiens
caguagcaugccucagaaugag

SEQ ID NO: 321136 - RNA, 22 nt, Homo sapiens
cagugaauuucaggucaagagu

SEQ ID NO: 321137 - RNA, 22 nt, Homo sapiens
cagugcaaccuccaucucucgg

SEQ ID NO: 321138 - RNA, 20 nt, Homo sapiens
cagugcaccuggcguguuga

SEQ ID NO: 321139 - RNA, 20 nt, Homo sapiens
cagugcacuuucccacuggu

SEQ ID NO: 321140 - RNA, 22 nt, Homo sapiens
cagugcauagaugugccacauu

SEQ ID NO: 321141 - RNA, 22 nt, Homo sapiens
cagugcuuguuauuguucuauu

SEQ ID NO: 321142 - RNA, 22 nt, Homo sapiens
cagugcuuuaucaaguccucca

SEQ ID NO: 321143 - RNA, 22 nt, Homo sapiens
caguggauuggauggauaaugc

SEQ ID NO: 321144 - RNA, 22 nt, Homo sapiens
cagugucugcauuuggaacuca

SEQ ID NO: 321145 - RNA, 22 nt, Homo sapiens
caguuacuugacacaaccaauu

SEQ ID NO: 321146 - RNA, 22 nt, Homo sapiens
caguuacuuuugcaccaaccua

SEQ ID NO: 321147 - RNA, 22 nt, Homo sapiens
caguugguguacauauauguau

SEQ ID NO: 321148 - RNA, 22 nt, Homo sapiens
cauaaagauggaggaggccagg

SEQ ID NO: 321149 - RNA, 19 nt, Homo sapiens
caucacagagucuuccauu

SEQ ID NO: 321150 - RNA, 22 nt, Homo sapiens
caucacaucugcaugguaagua

SEQ ID NO: 321151 - RNA, 21 nt, Homo sapiens
caucacauuacucaaaguccu

SEQ ID NO: 321152 - RNA, 22 nt, Homo sapiens
caucacuguugguacaaguaau

SEQ ID NO: 321153 - RNA, 22 nt, Homo sapiens
caucacuuugccuccgucucua

SEQ ID NO: 321154 - RNA, 22 nt, Homo sapiens
caucacuuuuccuuuuacagau

SEQ ID NO: 321155 - RNA, 22 nt, Homo sapiens
caucagauugagaucaucuaag

SEQ ID NO: 321156 - RNA, 22 nt, Homo sapiens
caucaggugaggauucaaugca

SEQ ID NO: 321157 - RNA, 22 nt, Homo sapiens
caucgcacuccagccuggguaa

SEQ ID NO: 321158 - RNA, 22 nt, Homo sapiens
caucgcacuccagcuugggcaa

SEQ ID NO: 321159 - RNA, 22 nt, Homo sapiens
caugacacuggcauguuucuuu

SEQ ID NO: 321160 - RNA, 19 nt, Homo sapiens
caugauacugcucccucuc

SEQ ID NO: 321161 - RNA, 22 nt, Homo sapiens
caugaugcuagguauggaugaa

SEQ ID NO: 321162 - RNA, 22 nt, Homo sapiens
caugcacugaguccaccucugg

SEQ ID NO: 321163 - RNA, 19 nt, Homo sapiens
caugccacugcacuugagu

SEQ ID NO: 321164 - RNA, 22 nt, Homo sapiens
cuguaauguaaugagacuacau

SEQ ID NO: 321165 - RNA, 22 nt, Homo sapiens
cuguaugugagaaauaauaagu

SEQ ID NO: 321166 - RNA, 19 nt, Homo sapiens
cugucacugaggaagacug

SEQ ID NO: 321167 - RNA, 22 nt, Homo sapiens
cugucuagagggcacaugaugc

SEQ ID NO: 321168 - RNA, 22 nt, Homo sapiens
cugucucagccucuccaguagc

SEQ ID NO: 321169 - RNA, 22 nt, Homo sapiens
cugucucagugaauugguuuua

SEQ ID NO: 321170 - RNA, 22 nt, Homo sapiens
cugucuggaguccuucgugugc

SEQ ID NO: 321171 - RNA, 22 nt, Homo sapiens
cugugcaaagcgcucucggggu

SEQ ID NO: 321172 - RNA, 22 nt, Homo sapiens
cugugcauggauuuuaagauug

SEQ ID NO: 321173 - RNA, 22 nt, Homo sapiens
cugugcauguaugcgugaguuc

SEQ ID NO: 321174 - RNA, 22 nt, Homo sapiens
cugugcauguuguccaauucuu

SEQ ID NO: 321175 - RNA, 22 nt, Homo sapiens
cugugcuugagagaugacacag

SEQ ID NO: 321176 - RNA, 22 nt, Homo sapiens
cugugcuuggagucccccuagg

SEQ ID NO: 321177 - RNA, 23 nt, Homo sapiens
cuguggauaugaguuguaaaugg

SEQ ID NO: 321178 - RNA, 22 nt, Homo sapiens
cuguggauguauugcacagucu

SEQ ID NO: 321179 - RNA, 22 nt, Homo sapiens
cugugguugagcuuugccauga

SEQ ID NO: 321180 - RNA, 22 nt, Homo sapiens
cuguguaguacuagauugagca

SEQ ID NO: 321181 - RNA, 22 nt, Homo sapiens
cuguuauguuugauggaugaau

SEQ ID NO: 321182 - RNA, 22 nt, Homo sapiens
cuguucaaauuguuugugaagu

SEQ ID NO: 321183 - RNA, 22 nt, Homo sapiens
cuguuugguuaucuuuuccugu

SEQ ID NO: 321184 - RNA, 22 nt, Homo sapiens
cuguuuguuuaggguacucaga

SEQ ID NO: 321185 - RNA, 22 nt, Homo sapiens
cuuaaagcgaauauugguggua

SEQ ID NO: 321186 - RNA, 22 nt, Homo sapiens
cuucaaguaauucugauggcua

SEQ ID NO: 321187 - RNA, 22 nt, Homo sapiens
cuucacuuuguuaaacuccaau

SEQ ID NO: 321188 - RNA, 22 nt, Homo sapiens
cuucagcaauauauccccuggg

SEQ ID NO: 321189 - RNA, 22 nt, Homo sapiens
cuucaugagacuuuuggaaggc

SEQ ID NO: 321190 - RNA, 22 nt, Homo sapiens
cuuccagcuggguucagucagu

SEQ ID NO: 321191 - RNA, 22 nt, Homo sapiens
cuuccauaguuacacccaggga

SEQ ID NO: 321192 - RNA, 22 nt, Homo sapiens
cuucucagugcucaucuuauuu

SEQ ID NO: 321193 - RNA, 22 nt, Homo sapiens
cuucuugagggccugcugggaa

SEQ ID NO: 321194 - RNA, 22 nt, Homo sapiens
cuucuugcuguguccucacaug

SEQ ID NO: 321195 - RNA, 22 nt, Homo sapiens
cuugacacugguuuucugaaua

SEQ ID NO: 321196 - RNA, 22 nt, Homo sapiens
cuugagacauuguuuuccaagu

SEQ ID NO: 321197 - RNA, 22 nt, Homo sapiens
cuugaucaaugugguacuugau

SEQ ID NO: 321198 - RNA, 22 nt, Homo sapiens
cuugcacucagaagauucaguu

SEQ ID NO: 321199 - RNA, 22 nt, Homo sapiens
cuugcagagcccauggauguca

SEQ ID NO: 321200 - RNA, 20 nt, Homo sapiens
cuuggcuuucuugguguuaa

SEQ ID NO: 321201 - RNA, 22 nt, Homo sapiens
cuugggcagugugcauguguau

SEQ ID NO: 321202 - RNA, 22 nt, Homo sapiens
cuugggccccacccaaaucuua

SEQ ID NO: 321203 - RNA, 22 nt, Homo sapiens
cuuggguugauugauaaugcca

SEQ ID NO: 321204 - RNA, 22 nt, Homo sapiens
cuugguuacauuuuccuagaaa

SEQ ID NO: 321205 - RNA, 22 nt, Homo sapiens
cuuguacuacuuaggaucugga

SEQ ID NO: 321206 - RNA, 22 nt, Homo sapiens
cuugucuugcacacgguugcca

SEQ ID NO: 321207 - RNA, 22 nt, Homo sapiens
cuuguuguggaggggagugcag

SEQ ID NO: 321208 - RNA, 22 nt, Homo sapiens
cuuugcaaaacauugagaccuc

SEQ ID NO: 321209 - RNA, 20 nt, Homo sapiens
cuuuggcaaugagaacaggg

SEQ ID NO: 321210 - RNA, 22 nt, Homo sapiens
cuuuggcacuuccuaagugcca

SEQ ID NO: 321211 - RNA, 22 nt, Homo sapiens
cuuuggccauagcuaaaugauu

SEQ ID NO: 321212 - RNA, 21 nt, Homo sapiens
cuuugguagaguuuuuagggu

SEQ ID NO: 321213 - RNA, 23 nt, Homo sapiens
cuuugguaggaaauuugaauuau

SEQ ID NO: 321214 - RNA, 22 nt, Homo sapiens
cuuugguucuguuuauaugcug

SEQ ID NO: 321215 - RNA, 22 nt, Homo sapiens
cuuuguaugucaugacaacugu

SEQ ID NO: 321216 - RNA, 22 nt, Homo sapiens
cuuugugcccuucugcccauca

SEQ ID NO: 321217 - RNA, 22 nt, Homo sapiens
cuuuguguaggugccucuggcu

SEQ ID NO: 321218 - RNA, 22 nt, Homo sapiens
cuuuuacacuguuggugggaau

SEQ ID NO: 321219 - RNA, 22 nt, Homo sapiens
cuuuuguggaucuucuguugcu

SEQ ID NO: 321220 - RNA, 20 nt, Homo sapiens
cuuuuugcugugcugggagc

SEQ ID NO: 321221 - RNA, 20 nt, Homo sapiens
gaaacaucuauccucuccuu

SEQ ID NO: 321222 - RNA, 22 nt, Homo sapiens
gaaagcugguauagauacauua

SEQ ID NO: 321223 - RNA, 22 nt, Homo sapiens
gaaaguguugagauuacaggca

SEQ ID NO: 321224 - RNA, 22 nt, Homo sapiens
gaaaucucuacuauuuugaucu

SEQ ID NO: 321225 - RNA, 22 nt, Homo sapiens
gaacuggcuuagugaaacuucc

SEQ ID NO: 321226 - RNA, 22 nt, Homo sapiens
gaacugggguuggguugcgaua

SEQ ID NO: 321227 - RNA, 22 nt, Homo sapiens
gaacuguaaagaaauucuaagg

SEQ ID NO: 321228 - RNA, 22 nt, Homo sapiens
gaagaucacacuguagaucuau

SEQ ID NO: 321229 - RNA, 22 nt, Homo sapiens
gaaggcacugugugccacccug

SEQ ID NO: 321230 - RNA, 22 nt, Homo sapiens
gaaggugcuuggugaaugcauu

SEQ ID NO: 321231 - RNA, 22 nt, Homo sapiens
gaagugguaggauugcuuuuga

SEQ ID NO: 321232 - RNA, 17 nt, Homo sapiens
gaaguguuucagcagcu

SEQ ID NO: 321233 - RNA, 19 nt, Homo sapiens
gaaguguuuguucuccaug

SEQ ID NO: 321234 - RNA, 22 nt, Homo sapiens
gaauacugacuauuucaucugg

SEQ ID NO: 321235 - RNA, 22 nt, Homo sapiens
gaauagugcugcaauaaacaua

SEQ ID NO: 321236 - RNA, 22 nt, Homo sapiens
gaauagugcugcaaugaacaua

SEQ ID NO: 321237 - RNA, 22 nt, Homo sapiens
gaaucauuggguugauucaaga

SEQ ID NO: 321238 - RNA, 21 nt, Homo sapiens
gaauggcaccauuagcauaua

SEQ ID NO: 321239 - RNA, 22 nt, Homo sapiens
gacacagugaagucucuacuug

SEQ ID NO: 321240 - RNA, 22 nt, Homo sapiens
gacaccauuucaguacuagguu

SEQ ID NO: 321241 - RNA, 22 nt, Homo sapiens
gacacuggguguuuguuggcgu

SEQ ID NO: 321242 - RNA, 22 nt, Homo sapiens
gacagguuuucuguuucugaaa

SEQ ID NO: 321243 - RNA, 22 nt, Homo sapiens
gacagugugauacuuagucuca

SEQ ID NO: 321244 - RNA, 22 nt, Homo sapiens
gacaguuuggugaggaagacga

SEQ ID NO: 321245 - RNA, 22 nt, Homo sapiens
gacauagcuagauaaccucaug

SEQ ID NO: 321246 - RNA, 22 nt, Homo sapiens
gacaucauuaugagauuuaaac

SEQ ID NO: 321247 - RNA, 22 nt, Homo sapiens
gaccccuagagauaggaggaac

SEQ ID NO: 321248 - RNA, 22 nt, Homo sapiens
gacccucuagagggaagcgcuu

SEQ ID NO: 321249 - RNA, 22 nt, Homo sapiens
gacgauaucaaggaaaugaagu

SEQ ID NO: 321250 - RNA, 17 nt, Homo sapiens
gacgaucaucaggaggc

SEQ ID NO: 321251 - RNA, 22 nt, Homo sapiens
gacguagagaaaugugaaaugg

SEQ ID NO: 321252 - RNA, 22 nt, Homo sapiens
gacuagaaauuauuuagugagc

SEQ ID NO: 321253 - RNA, 22 nt, Homo sapiens
gacuagagcugaucauguuacu

SEQ ID NO: 321254 - RNA, 22 nt, Homo sapiens
gacuagaggcaggcaccgcugc

SEQ ID NO: 321255 - RNA, 22 nt, Homo sapiens
gacuucaucauacuaugugugg

SEQ ID NO: 321256 - RNA, 22 nt, Homo sapiens
gagaacagagauaauuuuacuu

SEQ ID NO: 321257 - RNA, 22 nt, Homo sapiens
acacauacacauaugguguaua

SEQ ID NO: 321258 - RNA, 22 nt, Homo sapiens
acacauuggcaauucuggagca

SEQ ID NO: 321259 - RNA, 22 nt, Homo sapiens
acaccaugucuguuucugguuu

SEQ ID NO: 321260 - RNA, 22 nt, Homo sapiens
acacgggugccggcaucagcac

SEQ ID NO: 321261 - RNA, 22 nt, Homo sapiens
agaacccuuugaaauguguuug

SEQ ID NO: 321262 - RNA, 22 nt, Homo sapiens
agaacuguccauucagcaugaa

SEQ ID NO: 321263 - RNA, 19 nt, Homo sapiens
agaagugcauggucuagag

SEQ ID NO: 321264 - RNA, 22 nt, Homo sapiens
agaauguaaacagaauagagga

SEQ ID NO: 321265 - RNA, 22 nt, Homo sapiens
agaauguaacucuaugaaggca

SEQ ID NO: 321266 - RNA, 22 nt, Homo sapiens
agaauucugucauguuuauauu

SEQ ID NO: 321267 - RNA, 22 nt, Homo sapiens
agacaagauggcuugagguuca

SEQ ID NO: 321268 - RNA, 22 nt, Homo sapiens
aacacuaucugccuuacaggga

SEQ ID NO: 321269 - RNA, 22 nt, Homo sapiens
aacacuguuuccagucaugauc

SEQ ID NO: 321270 - RNA, 22 nt, Homo sapiens
aacagcacacccgcugcuucca

SEQ ID NO: 321271 - RNA, 22 nt, Homo sapiens
aacagcauaguacccgugauaa

SEQ ID NO: 321272 - RNA, 22 nt, Homo sapiens
aacagugcauuccuguccauau

SEQ ID NO: 321273 - RNA, 21 nt, Homo sapiens
aacagugcugaacagacaccu

SEQ ID NO: 321274 - RNA, 22 nt, Homo sapiens
aacauugaacuuggcacaccca

SEQ ID NO: 321275 - RNA, 22 nt, Homo sapiens
aaccacauggcucaguggacau

SEQ ID NO: 321276 - RNA, 22 nt, Homo sapiens
aacccugagucaugagucuaga

SEQ ID NO: 321277 - RNA, 22 nt, Homo sapiens
aaccuauaguauugaaaucaag

SEQ ID NO: 321278 - RNA, 22 nt, Homo sapiens
aacucacauucuuucuugguac

SEQ ID NO: 321279 - RNA, 22 nt, Homo sapiens
aacugcauuuucugauugugug

SEQ ID NO: 321280 - RNA, 22 nt, Homo sapiens
aacugcucuaauguggugggag

SEQ ID NO: 321281 - RNA, 22 nt, Homo sapiens
aacuggccuccuugggaaauua

SEQ ID NO: 321282 - RNA, 22 nt, Homo sapiens
aacuggucuuaugcaagcacua

SEQ ID NO: 321283 - RNA, 22 nt, Homo sapiens
aagagaugaagguccugacugu

SEQ ID NO: 321284 - RNA, 22 nt, Homo sapiens
aagagccgcaagggugaagggu

SEQ ID NO: 321285 - RNA, 22 nt, Homo sapiens
aagagcucucuguagcauguga

SEQ ID NO: 321286 - RNA, 22 nt, Homo sapiens
aagagguaauaacaaagcuucu

SEQ ID NO: 321287 - RNA, 22 nt, Homo sapiens
aagagguagcagucacaaaaga

SEQ ID NO: 321288 - RNA, 22 nt, Homo sapiens
aagagugucuuugugcuggccc

SEQ ID NO: 321289 - RNA, 22 nt, Homo sapiens
aagaucaucauagagggcauga

SEQ ID NO: 321290 - RNA, 20 nt, Homo sapiens
aagcaagcauuugcaaucau

SEQ ID NO: 321291 - RNA, 22 nt, Homo sapiens
aagcacaauuucaccuucuugu

SEQ ID NO: 321292 - RNA, 22 nt, Homo sapiens
aagcaggugaugagugggugug

SEQ ID NO: 321293 - RNA, 22 nt, Homo sapiens
aagcaggugugggaggaaaugg

SEQ ID NO: 321294 - RNA, 22 nt, Homo sapiens
aagcaucacauaauggaucaug

SEQ ID NO: 321295 - RNA, 22 nt, Homo sapiens
ucauggggugagcuacaggcac

SEQ ID NO: 321296 - RNA, 23 nt, Homo sapiens
ucauguauucccuguaaugggua

SEQ ID NO: 321297 - RNA, 22 nt, Homo sapiens
ucauucacucccuugaaguuag

SEQ ID NO: 321298 - RNA, 22 nt, Homo sapiens
ucauucauucauccagcuugag

SEQ ID NO: 321299 - RNA, 22 nt, Homo sapiens
ucauugcacuccagccugggug

SEQ ID NO: 321300 - RNA, 21 nt, Homo sapiens
ucauugguuggcugcccugua

SEQ ID NO: 321301 - RNA, 22 nt, Homo sapiens
uccagaguggugaugcuggggc

SEQ ID NO: 321302 - RNA, 17 nt, Homo sapiens
uccagauuucaauugaa

SEQ ID NO: 321303 - RNA, 22 nt, Homo sapiens
uccagguacucagggggcugag

SEQ ID NO: 321304 - RNA, 22 nt, Homo sapiens
uccagguuuugugaguuuaaau

SEQ ID NO: 321305 - RNA, 22 nt, Homo sapiens
uccagugcauucagacacuugg

SEQ ID NO: 321306 - RNA, 22 nt, Homo sapiens
uccaguguuauaauaugcgucu

SEQ ID NO: 321307 - RNA, 22 nt, Homo sapiens
uccaguuuuguuaacauauggu

SEQ ID NO: 321308 - RNA, 22 nt, Homo sapiens
uccaugagaauaguuaggcucu

SEQ ID NO: 321309 - RNA, 22 nt, Homo sapiens
uccauuuguucagcuucaggaa

SEQ ID NO: 321310 - RNA, 22 nt, Homo sapiens
ucccacugucuucucgugcucg

SEQ ID NO: 321311 - RNA, 22 nt, Homo sapiens
ucccagaaacgcauauguucau

SEQ ID NO: 321312 - RNA, 22 nt, Homo sapiens
ucccaguauucauuuacagaag

SEQ ID NO: 321313 - RNA, 22 nt, Homo sapiens
ucccagucuagagccggauugg

SEQ ID NO: 321314 - RNA, 22 nt, Homo sapiens
ucccaguguguagcuugucucu

SEQ ID NO: 321315 - RNA, 22 nt, Homo sapiens
ucccauguagcuaggauuacag

SEQ ID NO: 321316 - RNA, 22 nt, Homo sapiens
uccccaguaggcaauuaacacc

SEQ ID NO: 321317 - RNA, 19 nt, Homo sapiens
uccccaguuuuccguucag

SEQ ID NO: 321318 - RNA, 22 nt, Homo sapiens
uccccgagcccaggcugugacu

SEQ ID NO: 321319 - RNA, 22 nt, Homo sapiens
uccccugagaccccucagcacu

SEQ ID NO: 321320 - RNA, 19 nt, Homo sapiens
uccccuguggauaccaaga

SEQ ID NO: 321321 - RNA, 22 nt, Homo sapiens
ucccuacugggguacugccuag

SEQ ID NO: 321322 - RNA, 20 nt, Homo sapiens
ucccucaaacuuuuccacug

SEQ ID NO: 321323 - RNA, 22 nt, Homo sapiens
ucccugaaaaauuggcuuaaca

SEQ ID NO: 321324 - RNA, 22 nt, Homo sapiens
ucccugaagcugcagcaacaca

SEQ ID NO: 321325 - RNA, 22 nt, Homo sapiens
ucccugacagggucugagcuuu

SEQ ID NO: 321326 - RNA, 22 nt, Homo sapiens
ucccugaguaucuaauguguuu

SEQ ID NO: 321327 - RNA, 19 nt, Homo sapiens
ucccugagucuuagcuuga

SEQ ID NO: 321328 - RNA, 22 nt, Homo sapiens
ucccugguguuaguuuguucuu

SEQ ID NO: 321329 - RNA, 22 nt, Homo sapiens
ucccuguuaggcacagauuuau

SEQ ID NO: 321330 - RNA, 22 nt, Homo sapiens
ucccuguuguuucauaauuuua

SEQ ID NO: 321331 - RNA, 22 nt, Homo sapiens
ucccuuagccaaauccccagcc

SEQ ID NO: 321332 - RNA, 22 nt, Homo sapiens
uccugcauucugacuugcuuuc

SEQ ID NO: 321333 - RNA, 22 nt, Homo sapiens
uccuguaaucccagcuaccaga

SEQ ID NO: 321334 - RNA, 22 nt, Homo sapiens
uccuugagucugaacuuuggau

SEQ ID NO: 321335 - RNA, 22 nt, Homo sapiens
uccuuggucaaaaagaaagugu

SEQ ID NO: 321336 - RNA, 22 nt, Homo sapiens
uccuuggucauggaagagacag

SEQ ID NO: 321337 - RNA, 22 nt, Homo sapiens
uccuuggugacauuucuugucu

SEQ ID NO: 321338 - RNA, 22 nt, Homo sapiens
uccuuugguggagucuuuaggg

SEQ ID NO: 321339 - RNA, 20 nt, Homo sapiens
ucgcaccacuauacuccagc

SEQ ID NO: 321340 - RNA, 22 nt, Homo sapiens
ucgcagcacgagcaugcaaggu

SEQ ID NO: 321341 - RNA, 22 nt, Homo sapiens
ucgcgccauucuccugccucag

SEQ ID NO: 321342 - RNA, 22 nt, Homo sapiens
ucgcugggaagacugaaguguc

SEQ ID NO: 321343 - RNA, 23 nt, Homo sapiens
ucgguccccuuggcugcccucgg

SEQ ID NO: 321344 - RNA, 22 nt, Homo sapiens
ucgugccacugcacuccagccu

SEQ ID NO: 321345 - RNA, 22 nt, Homo sapiens
ucguucuugucaguuuauaaag

SEQ ID NO: 321346 - RNA, 22 nt, Homo sapiens
ucuaaugcucugagaacagugc

SEQ ID NO: 321347 - RNA, 22 nt, Homo sapiens
ucuaguaaugagaggcaggaga

SEQ ID NO: 321348 - RNA, 22 nt, Homo sapiens
ucuauggaguuugaaugagaaa

SEQ ID NO: 321349 - RNA, 22 nt, Homo sapiens
ucuaugguuuauuuccaagugu

SEQ ID NO: 321350 - RNA, 22 nt, Homo sapiens
ucucaaccuccacacuacaaua

SEQ ID NO: 321351 - RNA, 22 nt, Homo sapiens
ucucacagaguugaacuuucuu

SEQ ID NO: 321352 - RNA, 22 nt, Homo sapiens
ucucacaggguuauugaggggg

SEQ ID NO: 321353 - RNA, 22 nt, Homo sapiens
ucucaguggugcuggcagggga

SEQ ID NO: 321354 - RNA, 22 nt, Homo sapiens
ucucauagaggcagagaguaaa

SEQ ID NO: 321355 - RNA, 22 nt, Homo sapiens
ucucaugaagguggagaguagg

SEQ ID NO: 321356 - RNA, 22 nt, Homo sapiens
ucucauugauucuggggugaug

SEQ ID NO: 321357 - RNA, 22 nt, Homo sapiens
ucucccauccaugaacuucugu

SEQ ID NO: 321358 - RNA, 17 nt, Homo sapiens
ucucccaucccuuucuc

SEQ ID NO: 321359 - RNA, 22 nt, Homo sapiens
ucucugagaaaaguuucuccca

SEQ ID NO: 321360 - RNA, 22 nt, Homo sapiens
ucugaaucguucccaugcagga

SEQ ID NO: 321361 - RNA, 19 nt, Homo sapiens
ucugacagccccagucaac

SEQ ID NO: 321362 - RNA, 22 nt, Homo sapiens
ucugagaucaugucugugcugu

SEQ ID NO: 321363 - RNA, 22 nt, Homo sapiens
ucugagcaauagauguggauau

SEQ ID NO: 321364 - RNA, 22 nt, Homo sapiens
ucugauggaguugccagggaga

SEQ ID NO: 321365 - RNA, 23 nt, Homo sapiens
ucugauguuauaaaauucuuugg

SEQ ID NO: 321366 - RNA, 20 nt, Homo sapiens
ucugauugcaacugcaugag

SEQ ID NO: 321367 - RNA, 22 nt, Homo sapiens
ucugcaagucuaaacuagccau

SEQ ID NO: 321368 - RNA, 22 nt, Homo sapiens
ucuggcacugaugugggaugcu

SEQ ID NO: 321369 - RNA, 21 nt, Homo sapiens
ucuggcccccucaaaucucau

SEQ ID NO: 321370 - RNA, 21 nt, Homo sapiens
ucuggccccuccaaaucucau

SEQ ID NO: 321371 - RNA, 20 nt, Homo sapiens
ucuggccccucuaaaucuca

SEQ ID NO: 321372 - RNA, 22 nt, Homo sapiens
ucuggccccucucaaaucucau

SEQ ID NO: 321373 - RNA, 22 nt, Homo sapiens
ucuggccuacaaguaauuuuau

SEQ ID NO: 321374 - RNA, 22 nt, Homo sapiens
ucuggguuuuuacaauguuuac

SEQ ID NO: 321375 - RNA, 23 nt, Homo sapiens
ucugguguugucaaaugcugguu

SEQ ID NO: 321376 - RNA, 19 nt, Homo sapiens
ucuguaguuagggcuacag

SEQ ID NO: 321377 - RNA, 22 nt, Homo sapiens
ucugucacugguggacgaucac

SEQ ID NO: 321378 - RNA, 22 nt, Homo sapiens
ucugucuugugguuugagugcc

SEQ ID NO: 321379 - RNA, 22 nt, Homo sapiens
ucugugcggucuguguuaugaa

SEQ ID NO: 321380 - RNA, 22 nt, Homo sapiens
ucugugguuguugcauggaaug

SEQ ID NO: 321381 - RNA, 22 nt, Homo sapiens
ucuguguugaucacacugggag

SEQ ID NO: 321382 - RNA, 22 nt, Homo sapiens
ucuuaguuuagauuagcaauuc

SEQ ID NO: 321383 - RNA, 22 nt, Homo sapiens
ucuuauuuggggaaaggguccu

SEQ ID NO: 321384 - RNA, 17 nt, Homo sapiens
ucuucuguuacuguggc

SEQ ID NO: 321385 - RNA, 22 nt, Homo sapiens
ucuugcacacaguaaguguuuu

SEQ ID NO: 321386 - RNA, 22 nt, Homo sapiens
ucuuggcaaagaauuuuuggcu

SEQ ID NO: 321387 - RNA, 22 nt, Homo sapiens
ucuuggcauggcugaagauucc

SEQ ID NO: 321388 - RNA, 22 nt, Homo sapiens
ucuuggccaugaauggcaaggc

SEQ ID NO: 321389 - RNA, 22 nt, Homo sapiens
ucuuggguggauucauucuuuc

SEQ ID NO: 321390 - RNA, 22 nt, Homo sapiens
ucuugucacugcauccccagcu

SEQ ID NO: 321391 - RNA, 17 nt, Homo sapiens
ucuugugguucuugaau

SEQ ID NO: 321392 - RNA, 22 nt, Homo sapiens
ucuuuagguguuauaguucaag

SEQ ID NO: 321393 - RNA, 22 nt, Homo sapiens
ucuuuaguaauuucuguaaggc

SEQ ID NO: 321394 - RNA, 19 nt, Homo sapiens
ucuuuagucacauuuuuau

SEQ ID NO: 321395 - RNA, 22 nt, Homo sapiens
ucuuuaguuaagggacauuuua

SEQ ID NO: 321396 - RNA, 22 nt, Homo sapiens
ucuuucacuuagcaugauguuu

SEQ ID NO: 321397 - RNA, 22 nt, Homo sapiens
ucuuugagugcccugagucccu

SEQ ID NO: 321398 - RNA, 22 nt, Homo sapiens
ucuuugaguguauacuuagauu

SEQ ID NO: 321399 - RNA, 22 nt, Homo sapiens
ucuuugccuaacccaaggucau

SEQ ID NO: 321400 - RNA, 22 nt, Homo sapiens
ucuuugguaugugcaugugcuu

SEQ ID NO: 321401 - RNA, 22 nt, Homo sapiens
ucuuugguauugugaauagugu

SEQ ID NO: 321402 - RNA, 22 nt, Homo sapiens
ucuuugguauuuguggggaauu

SEQ ID NO: 321403 - RNA, 22 nt, Homo sapiens
ucuuugguucugugcagccuau

SEQ ID NO: 321404 - RNA, 22 nt, Homo sapiens
ucuuugguuguuuagggugcau

SEQ ID NO: 321405 - RNA, 22 nt, Homo sapiens
ucuuugguuucugucucuguaa

SEQ ID NO: 321406 - RNA, 22 nt, Homo sapiens
ucuuugucuacauccuguuaaa

SEQ ID NO: 321407 - RNA, 22 nt, Homo sapiens
ucuuuugugagucagccucucc

SEQ ID NO: 321408 - RNA, 18 nt, Homo sapiens
ugaaacacauuuuuuccu

SEQ ID NO: 321409 - RNA, 22 nt, Homo sapiens
ugaaagguauagguucuggagg

SEQ ID NO: 321410 - RNA, 22 nt, Homo sapiens
ugaaagguuuaauucugugaga

SEQ ID NO: 321411 - RNA, 22 nt, Homo sapiens
ugaaaguaauugcaguuuuuac

SEQ ID NO: 321412 - RNA, 22 nt, Homo sapiens
ugaaaguuauauugugaaauuc

SEQ ID NO: 321413 - RNA, 22 nt, Homo sapiens
ugaaauacuuaauuucuccaug

SEQ ID NO: 321414 - RNA, 22 nt, Homo sapiens
ugaaauaguuaaguugccuagu

SEQ ID NO: 321415 - RNA, 22 nt, Homo sapiens
ugaaaucauguaguuauugcaa

SEQ ID NO: 321416 - RNA, 22 nt, Homo sapiens
ugaaaucuuugaugguggcauu

SEQ ID NO: 321417 - RNA, 22 nt, Homo sapiens
ugaaaugauuauaugguguuug

SEQ ID NO: 321418 - RNA, 22 nt, Homo sapiens
ugaaaugguuaugugaggagau

SEQ ID NO: 321419 - RNA, 22 nt, Homo sapiens
ugaaauuauucuuaccaaggug

SEQ ID NO: 321420 - RNA, 22 nt, Homo sapiens
ugaaauuuuuuauucguuggcu

SEQ ID NO: 321421 - RNA, 22 nt, Homo sapiens
ugaacucagcauccagggccaa

SEQ ID NO: 321422 - RNA, 22 nt, Homo sapiens
ugaagacauuuuugggugugua

SEQ ID NO: 321423 - RNA, 22 nt, Homo sapiens
ugaagagucuaaaucugucuuc

SEQ ID NO: 321424 - RNA, 22 nt, Homo sapiens
ugaagcuaacuugauugugaug

SEQ ID NO: 321425 - RNA, 22 nt, Homo sapiens
ugaagggcauuguuuugccaaa

SEQ ID NO: 321426 - RNA, 22 nt, Homo sapiens
ugaaguaggcauaaguuaagcu

SEQ ID NO: 321427 - RNA, 22 nt, Homo sapiens
ugaaguguuuauuuuggccuuc

SEQ ID NO: 321428 - RNA, 22 nt, Homo sapiens
ugaauacuucaaaaaaauagcu

SEQ ID NO: 321429 - RNA, 22 nt, Homo sapiens
ugaauacuucguucaaagauaa

SEQ ID NO: 321430 - RNA, 22 nt, Homo sapiens
ugaauagacacuaaagacugua

SEQ ID NO: 321431 - RNA, 22 nt, Homo sapiens
ugaauagacagucacugccucc

SEQ ID NO: 321432 - RNA, 22 nt, Homo sapiens
ugaauagagcugcaguggacau

SEQ ID NO: 321433 - RNA, 22 nt, Homo sapiens
ugaauauguuucuaaaagugca

SEQ ID NO: 321434 - RNA, 22 nt, Homo sapiens
ugaauauuugcuacucacucuu

SEQ ID NO: 321435 - RNA, 22 nt, Homo sapiens
ugaaugcaucuagaaauuuauu

SEQ ID NO: 321436 - RNA, 22 nt, Homo sapiens
ugaauggauccaauucuuagua

SEQ ID NO: 321437 - RNA, 20 nt, Homo sapiens
ugaauguaauuacagaugua

SEQ ID NO: 321438 - RNA, 22 nt, Homo sapiens
ugaauguccauugauguuuuga

SEQ ID NO: 321439 - RNA, 22 nt, Homo sapiens
ugaauguucuuaaaacccuugu

SEQ ID NO: 321440 - RNA, 23 nt, Homo sapiens
ugaauguuuauucucggugcaga

SEQ ID NO: 321441 - RNA, 16 nt, Homo sapiens
ugaauguuuguggcug

SEQ ID NO: 321442 - RNA, 22 nt, Homo sapiens
ugaauucaucucacagaguuaa

SEQ ID NO: 321443 - RNA, 22 nt, Homo sapiens
ugacaagaacuuuccauaguaa

SEQ ID NO: 321444 - RNA, 17 nt, Homo sapiens
ugacagaaacuuguugu

SEQ ID NO: 321445 - RNA, 23 nt, Homo sapiens
ugacagaccuucuggaagaaguc

SEQ ID NO: 321446 - RNA, 22 nt, Homo sapiens
ugacagcugaagauguugaacc

SEQ ID NO: 321447 - RNA, 22 nt, Homo sapiens
ugacagguuggaauuaugggag

SEQ ID NO: 321448 - RNA, 22 nt, Homo sapiens
ugacaguaaacagucuugauua

SEQ ID NO: 321449 - RNA, 22 nt, Homo sapiens
ugacagugugagauccugucuc

SEQ ID NO: 321450 - RNA, 18 nt, Homo sapiens
ugacaguuucuuuauauu

SEQ ID NO: 321451 - RNA, 22 nt, Homo sapiens
ugacauagcuauuaagugaugc

SEQ ID NO: 321452 - RNA, 20 nt, Homo sapiens
ugacaucagcaauguaauaa

SEQ ID NO: 321453 - RNA, 22 nt, Homo sapiens
ugacaugauguuccuacacugu

SEQ ID NO: 321454 - RNA, 22 nt, Homo sapiens
ugacauggagguggaggaagau

SEQ ID NO: 321455 - RNA, 23 nt, Homo sapiens
ugacauguaauucaguccagcag

SEQ ID NO: 321456 - RNA, 21 nt, Homo sapiens
ugacauuauuucaugucagua

SEQ ID NO: 321457 - RNA, 22 nt, Homo sapiens
ugaccacugucuaagauaggug

SEQ ID NO: 321458 - RNA, 22 nt, Homo sapiens
ugacuacaccacacgguuaagg

SEQ ID NO: 321459 - RNA, 22 nt, Homo sapiens
ugacuacagauuugcugccaga

SEQ ID NO: 321460 - RNA, 22 nt, Homo sapiens
ugacuacaggucaggaagcugu

SEQ ID NO: 321461 - RNA, 22 nt, Homo sapiens
ugacuagggacauucuuccacg

SEQ ID NO: 321462 - RNA, 21 nt, Homo sapiens
ugacuagggauaugugccacu

SEQ ID NO: 321463 - RNA, 22 nt, Homo sapiens
ugacuauaguuuucuugacaca

SEQ ID NO: 321464 - RNA, 22 nt, Homo sapiens
ugacuauaucucuguauaaacu

SEQ ID NO: 321465 - RNA, 23 nt, Homo sapiens
ugacugaguauauguuuggugcu

SEQ ID NO: 321466 - RNA, 22 nt, Homo sapiens
ugacuggaaacaguguuauuug

SEQ ID NO: 321467 - RNA, 22 nt, Homo sapiens
ugacuggaacuuuagugagucu

SEQ ID NO: 321468 - RNA, 20 nt, Homo sapiens
ugacuggauacccuuuggcu

SEQ ID NO: 321469 - RNA, 18 nt, Homo sapiens
ugacuguccagguggacc

SEQ ID NO: 321470 - RNA, 22 nt, Homo sapiens
ugacugucuagauagagcuugg

SEQ ID NO: 321471 - RNA, 22 nt, Homo sapiens
ugacugugcagcuccaucaggg

SEQ ID NO: 321472 - RNA, 22 nt, Homo sapiens
ugacuucauuugguaauugggu

SEQ ID NO: 321473 - RNA, 22 nt, Homo sapiens
ugacuugaaacgugaacagauc

SEQ ID NO: 321474 - RNA, 22 nt, Homo sapiens
ugacuugaggcucgcacaaguu

SEQ ID NO: 321475 - RNA, 22 nt, Homo sapiens
ugacuuuagaauuuuauccaga

SEQ ID NO: 321476 - RNA, 22 nt, Homo sapiens
ugagaacagcagcuugggacac

SEQ ID NO: 321477 - RNA, 22 nt, Homo sapiens
ugagaacaugcacuugagguug

SEQ ID NO: 321478 - RNA, 22 nt, Homo sapiens
ugagaacauggagaacccccca

SEQ ID NO: 321479 - RNA, 22 nt, Homo sapiens
ugagaacaugugauauuuggug

SEQ ID NO: 321480 - RNA, 20 nt, Homo sapiens
ugagaacaugugguauuugg

SEQ ID NO: 321481 - RNA, 22 nt, Homo sapiens
ugagaaccucugugugcccacu

SEQ ID NO: 321482 - RNA, 22 nt, Homo sapiens
ugagaacuagagaacaagguga

SEQ ID NO: 321483 - RNA, 22 nt, Homo sapiens
ugagaacugccuguauuuaucu

SEQ ID NO: 321484 - RNA, 22 nt, Homo sapiens
ugagaacugguagcacuuguga

SEQ ID NO: 321485 - RNA, 22 nt, Homo sapiens
ugagaaugaugauugguaaacc

SEQ ID NO: 321486 - RNA, 22 nt, Homo sapiens
ugagaaugaugauuuccaguuu

SEQ ID NO: 321487 - RNA, 22 nt, Homo sapiens
ugagaaugcagaaucucgugca

SEQ ID NO: 321488 - RNA, 22 nt, Homo sapiens
ugagacaucugagauuuuaagc

SEQ ID NO: 321489 - RNA, 22 nt, Homo sapiens
ugagaccugaucuugguacugc

SEQ ID NO: 321490 - RNA, 22 nt, Homo sapiens
ugagacggagucucacucuguu

SEQ ID NO: 321491 - RNA, 22 nt, Homo sapiens
ugagacggagucucgcucuguc

SEQ ID NO: 321492 - RNA, 22 nt, Homo sapiens
ugagacggagucuggcacuguc

SEQ ID NO: 321493 - RNA, 22 nt, Homo sapiens
ugagacggagucuugcuaaguu

SEQ ID NO: 321494 - RNA, 22 nt, Homo sapiens
ugagacggaguuauuuauaaua

SEQ ID NO: 321495 - RNA, 22 nt, Homo sapiens
ugagacggaguuuugcucuugu

SEQ ID NO: 321496 - RNA, 22 nt, Homo sapiens
ugagacugaguuuccaucuugu

SEQ ID NO: 321497 - RNA, 22 nt, Homo sapiens
ugagacugaguuuugccuuugu

SEQ ID NO: 321498 - RNA, 22 nt, Homo sapiens
ugagacugguaauguguagggc

SEQ ID NO: 321499 - RNA, 22 nt, Homo sapiens
ugagagacaguuuguuaaaauu

SEQ ID NO: 321500 - RNA, 22 nt, Homo sapiens
ugagagaugaacucugauaugu

SEQ ID NO: 321501 - RNA, 21 nt, Homo sapiens
ugagaguaguguauuauucuc

SEQ ID NO: 321502 - RNA, 22 nt, Homo sapiens
ugagauaacuaaaaacauuuug

SEQ ID NO: 321503 - RNA, 22 nt, Homo sapiens
ugagauaaucaugugauuucau

SEQ ID NO: 321504 - RNA, 22 nt, Homo sapiens
ugagauagcauaagggacagaa

SEQ ID NO: 321505 - RNA, 22 nt, Homo sapiens
ugagaucaagguuaauauaauc

SEQ ID NO: 321506 - RNA, 22 nt, Homo sapiens
ugagaucacuaagagguaaugg

SEQ ID NO: 321507 - RNA, 22 nt, Homo sapiens
ugagauccugagaguugggacu

SEQ ID NO: 321508 - RNA, 19 nt, Homo sapiens
ugagaucuuuacuggguuu

SEQ ID NO: 321509 - RNA, 22 nt, Homo sapiens
ugagaucuuugcuguccucacc

SEQ ID NO: 321510 - RNA, 22 nt, Homo sapiens
ugagaugaaagcagaaagacuu

SEQ ID NO: 321511 - RNA, 22 nt, Homo sapiens
ugagaugacgacacaccucagu

SEQ ID NO: 321512 - RNA, 22 nt, Homo sapiens
ugagaugagagaaugcuugccu

SEQ ID NO: 321513 - RNA, 22 nt, Homo sapiens
ugagaugagggaagccuaggca

SEQ ID NO: 321514 - RNA, 22 nt, Homo sapiens
ugagaugagucucgcucuguca

SEQ ID NO: 321515 - RNA, 22 nt, Homo sapiens
ugagaugaguucucgcucuguc

SEQ ID NO: 321516 - RNA, 22 nt, Homo sapiens
ugagaugaguugcgcucugucg

SEQ ID NO: 321517 - RNA, 22 nt, Homo sapiens
ugagaugauuuaauggagccca

SEQ ID NO: 321518 - RNA, 22 nt, Homo sapiens
ugagaugcaaaaugagaauugu

SEQ ID NO: 321519 - RNA, 21 nt, Homo sapiens
ugagaugcaaucaccagggag

SEQ ID NO: 321520 - RNA, 22 nt, Homo sapiens
ugagaugcuuguaaauucauuu

SEQ ID NO: 321521 - RNA, 22 nt, Homo sapiens
ugagauggaguuucgcucuugu

SEQ ID NO: 321522 - RNA, 22 nt, Homo sapiens
ugagauggaucuuggauuugaa

SEQ ID NO: 321523 - RNA, 22 nt, Homo sapiens
ugagauggguaauuaaauggug

SEQ ID NO: 321524 - RNA, 22 nt, Homo sapiens
ugagauguuuagauuguugucu

SEQ ID NO: 321525 - RNA, 23 nt, Homo sapiens
ugagauuacccagaaagaguaua

SEQ ID NO: 321526 - RNA, 22 nt, Homo sapiens
ugagcaagaaauagaaacagau

SEQ ID NO: 321527 - RNA, 22 nt, Homo sapiens
ugagcacagcgugugggagagc

SEQ ID NO: 321528 - RNA, 22 nt, Homo sapiens
ugagcacauuuacaucaguucc

SEQ ID NO: 321529 - RNA, 22 nt, Homo sapiens
ugagcagaaagcugcaaggucg

SEQ ID NO: 321530 - RNA, 22 nt, Homo sapiens
ugagcagagaucacggcauugu

SEQ ID NO: 321531 - RNA, 22 nt, Homo sapiens
ugagcagaguuguuucuccuga

SEQ ID NO: 321532 - RNA, 22 nt, Homo sapiens
ugagcaucauucacaccuuggu

SEQ ID NO: 321533 - RNA, 22 nt, Homo sapiens
ugagcgaugggaggaagugaua

SEQ ID NO: 321534 - RNA, 22 nt, Homo sapiens
ugagcuaggucuugcucuguca

SEQ ID NO: 321535 - RNA, 17 nt, Homo sapiens
ugagcuaugauccuguc

SEQ ID NO: 321536 - RNA, 22 nt, Homo sapiens
ugagcucagcuuucuuuuucac

SEQ ID NO: 321537 - RNA, 22 nt, Homo sapiens
ugagcucaguauuucauaaaca

SEQ ID NO: 321538 - RNA, 22 nt, Homo sapiens
ugagcugagaucacacuacugu

SEQ ID NO: 321539 - RNA, 22 nt, Homo sapiens
ugagcugagaucaugcuauugu

SEQ ID NO: 321540 - RNA, 22 nt, Homo sapiens
ugaggacugagaggcacugugg

SEQ ID NO: 321541 - RNA, 22 nt, Homo sapiens
ugaggagugagaaauugguuuc

SEQ ID NO: 321542 - RNA, 22 nt, Homo sapiens
ugaggauaguguugaaggcagg

SEQ ID NO: 321543 - RNA, 22 nt, Homo sapiens
ugagguaacagaagcgagcauu

SEQ ID NO: 321544 - RNA, 22 nt, Homo sapiens
ugagguaagauguucauuuuuc

SEQ ID NO: 321545 - RNA, 22 nt, Homo sapiens
ugagguaugugaugucuuuuag

SEQ ID NO: 321546 - RNA, 22 nt, Homo sapiens
ugaggucacuuguuuuaugcuu

SEQ ID NO: 321547 - RNA, 21 nt, Homo sapiens
ugaggucaugaugcugcuucc

SEQ ID NO: 321548 - RNA, 22 nt, Homo sapiens
ugagguguuaacuuuacuuuua

SEQ ID NO: 321549 - RNA, 22 nt, Homo sapiens
ugagguguuauccagaguucuu

SEQ ID NO: 321550 - RNA, 22 nt, Homo sapiens
ugagguguuugugcaccaucug

SEQ ID NO: 321551 - RNA, 22 nt, Homo sapiens
ugagguuggggucagggcuagc

SEQ ID NO: 321552 - RNA, 22 nt, Homo sapiens
ugaguacugauuuaagauacac

SEQ ID NO: 321553 - RNA, 22 nt, Homo sapiens
ugaguagagaauucagcuaagg

SEQ ID NO: 321554 - RNA, 23 nt, Homo sapiens
ugaguaggugguuuuccccucac

SEQ ID NO: 321555 - RNA, 22 nt, Homo sapiens
ugaguagucagugggcaggaag

SEQ ID NO: 321556 - RNA, 22 nt, Homo sapiens
ugaguaucuugaugaauuugaa

SEQ ID NO: 321557 - RNA, 22 nt, Homo sapiens
ugagucgagauugcgccacugu

SEQ ID NO: 321558 - RNA, 22 nt, Homo sapiens
ugagugugacuuagcagaagga

SEQ ID NO: 321559 - RNA, 22 nt, Homo sapiens
ugaguuaauuuuuguaucaugu

SEQ ID NO: 321560 - RNA, 22 nt, Homo sapiens
ugaguucaauguuaaugaagca

SEQ ID NO: 321561 - RNA, 22 nt, Homo sapiens
ugaguucauggucauuugucac

SEQ ID NO: 321562 - RNA, 22 nt, Homo sapiens
ugaguucuuccuaucucugccu

SEQ ID NO: 321563 - RNA, 22 nt, Homo sapiens
ugaguuguaggggucaccuggc

SEQ ID NO: 321564 - RNA, 22 nt, Homo sapiens
ugauaacugaucuggauuugua

SEQ ID NO: 321565 - RNA, 22 nt, Homo sapiens
ugauaagaaauuguucauguag

SEQ ID NO: 321566 - RNA, 20 nt, Homo sapiens
ugauaaguugcacuuuccuu

SEQ ID NO: 321567 - RNA, 22 nt, Homo sapiens
ugauagaucugggcaaaguaaa

SEQ ID NO: 321568 - RNA, 22 nt, Homo sapiens
ugauaggucuguuuugaaaagg

SEQ ID NO: 321569 - RNA, 22 nt, Homo sapiens
ugauagugccuuuuauaucucu

SEQ ID NO: 321570 - RNA, 22 nt, Homo sapiens
ugauaugaucgcccuagcuuga

SEQ ID NO: 321571 - RNA, 22 nt, Homo sapiens
ugauaugucccucgacaucagg

SEQ ID NO: 321572 - RNA, 22 nt, Homo sapiens
ugauauguguaaacaauguaua

SEQ ID NO: 321573 - RNA, 22 nt, Homo sapiens
ugauauuuuugauccuuaaguu

SEQ ID NO: 321574 - RNA, 22 nt, Homo sapiens
ugaucacagcuugacuaaagga

SEQ ID NO: 321575 - RNA, 22 nt, Homo sapiens
ugauccagugcucaguuggagu

SEQ ID NO: 321576 - RNA, 22 nt, Homo sapiens
ugauccuguccuuaugauguua

SEQ ID NO: 321577 - RNA, 22 nt, Homo sapiens
ugaucuguguaacauaggaguc

SEQ ID NO: 321578 - RNA, 22 nt, Homo sapiens
ugaugacccugcaguucucaag

SEQ ID NO: 321579 - RNA, 22 nt, Homo sapiens
ugaugcugaugccugccagaag

SEQ ID NO: 321580 - RNA, 22 nt, Homo sapiens
ugaugguaguucagucaaugua

SEQ ID NO: 321581 - RNA, 22 nt, Homo sapiens
ugaugguuuuaaaaagaggagu

SEQ ID NO: 321582 - RNA, 21 nt, Homo sapiens
ugauguugaccuaaguaguga

SEQ ID NO: 321583 - RNA, 22 nt, Homo sapiens
ugauuuccaugagaacaugccu

SEQ ID NO: 321584 - RNA, 22 nt, Homo sapiens
ugauuugucucucagcccuacu

SEQ ID NO: 321585 - RNA, 19 nt, Homo sapiens
ugcaaauucuaaaaacuga

SEQ ID NO: 321586 - RNA, 22 nt, Homo sapiens
ugcaacauguguaccacucugu

SEQ ID NO: 321587 - RNA, 22 nt, Homo sapiens
ugcaagaaucagccuaucauua

SEQ ID NO: 321588 - RNA, 22 nt, Homo sapiens
ugcaagauaggcaguuugcacu

SEQ ID NO: 321589 - RNA, 22 nt, Homo sapiens
ugcaagaugauuucaauugaua

SEQ ID NO: 321590 - RNA, 20 nt, Homo sapiens
ugcaaguugccuuuggaggc

SEQ ID NO: 321591 - RNA, 22 nt, Homo sapiens
ugcaaucauuuggaggagaaga

SEQ ID NO: 321592 - RNA, 22 nt, Homo sapiens
ugcaaugucuucugaggggagc

SEQ ID NO: 321593 - RNA, 22 nt, Homo sapiens
ugcaaugugaaauaagcacauc

SEQ ID NO: 321594 - RNA, 22 nt, Homo sapiens
ugcaauuuaaugugucccaauu

SEQ ID NO: 321595 - RNA, 22 nt, Homo sapiens
ugcacacucuguaugagaaucu

SEQ ID NO: 321596 - RNA, 22 nt, Homo sapiens
ugcaccacuacacuccaggcug

SEQ ID NO: 321597 - RNA, 22 nt, Homo sapiens
ugcaccauggcacuccaggcug

SEQ ID NO: 321598 - RNA, 22 nt, Homo sapiens
ugcaccauugucaccuggguga

SEQ ID NO: 321599 - RNA, 22 nt, Homo sapiens
ugcagagaaacauuuuguauuu

SEQ ID NO: 321600 - RNA, 19 nt, Homo sapiens
ugcagcaauguaaaagaca

SEQ ID NO: 321601 - RNA, 20 nt, Homo sapiens
ugcagcacgggcccuuucca

SEQ ID NO: 321602 - RNA, 22 nt, Homo sapiens
ugcagcacugaacuucugggcu

SEQ ID NO: 321603 - RNA, 18 nt, Homo sapiens
ugcagcaucaguacccag

SEQ ID NO: 321604 - RNA, 21 nt, Homo sapiens
ugcagccauucagcccuaugc

SEQ ID NO: 321605 - RNA, 22 nt, Homo sapiens
ugcaggguccauugucccaagu

SEQ ID NO: 321606 - RNA, 22 nt, Homo sapiens
ugcagguacuugacaacuuggg

SEQ ID NO: 321607 - RNA, 22 nt, Homo sapiens
ugcaguacuuugaaauauacug

SEQ ID NO: 321608 - RNA, 20 nt, Homo sapiens
ugcaguguccucacuuguca

SEQ ID NO: 321609 - RNA, 22 nt, Homo sapiens
ugcagugugauuuucuggcuga

SEQ ID NO: 321610 - RNA, 22 nt, Homo sapiens
ugcauacacaagcauacaugua

SEQ ID NO: 321611 - RNA, 22 nt, Homo sapiens
ugcauaggagcagggucuaugu

SEQ ID NO: 321612 - RNA, 21 nt, Homo sapiens
ugcauaucucuaaugaccagu

SEQ ID NO: 321613 - RNA, 22 nt, Homo sapiens
ugcauaucuucuuuugagaaau

SEQ ID NO: 321614 - RNA, 22 nt, Homo sapiens
ugcauaugcagcauuuaugauu

SEQ ID NO: 321615 - RNA, 22 nt, Homo sapiens
ugcauauguauacaugugccau

SEQ ID NO: 321616 - RNA, 22 nt, Homo sapiens
ugcauaugucuuuauaguagca

SEQ ID NO: 321617 - RNA, 22 nt, Homo sapiens
ugcauauguugaaccaggcuug

SEQ ID NO: 321618 - RNA, 22 nt, Homo sapiens
ugcaucacaguacuccagccug

SEQ ID NO: 321619 - RNA, 22 nt, Homo sapiens
ugcauggagcucucuuuggacu

SEQ ID NO: 321620 - RNA, 22 nt, Homo sapiens
ugcauuagucuguucucacacu

SEQ ID NO: 321621 - RNA, 22 nt, Homo sapiens
ugcauugcacuugcaugagaua

SEQ ID NO: 321622 - RNA, 22 nt, Homo sapiens
ugccaaggagucagucccuaga

SEQ ID NO: 321623 - RNA, 22 nt, Homo sapiens
ugccagagacguagggaauauu

SEQ ID NO: 321624 - RNA, 22 nt, Homo sapiens
ugccagaugcaguguucaacaa

SEQ ID NO: 321625 - RNA, 22 nt, Homo sapiens
ugccaggaugaggucaauguuu

SEQ ID NO: 321626 - RNA, 22 nt, Homo sapiens
ugccaguauuuuauugaggauu

SEQ ID NO: 321627 - RNA, 22 nt, Homo sapiens
ugcccuguaucccacuguuuca

SEQ ID NO: 321628 - RNA, 22 nt, Homo sapiens
ugccuaggcccaguccucagaa

SEQ ID NO: 321629 - RNA, 22 nt, Homo sapiens
ugccuaggcuggaaugcaaugg

SEQ ID NO: 321630 - RNA, 22 nt, Homo sapiens
ugcgccauugcauuccagccug

SEQ ID NO: 321631 - RNA, 22 nt, Homo sapiens
ugcuagaagaucacacacauca

SEQ ID NO: 321632 - RNA, 22 nt, Homo sapiens
ugcuagaugaaguuugaguuuu

SEQ ID NO: 321633 - RNA, 22 nt, Homo sapiens
ugcuauguccccacccaaaucu

SEQ ID NO: 321634 - RNA, 22 nt, Homo sapiens
ugcuaugucuucucucacagag

SEQ ID NO: 321635 - RNA, 21 nt, Homo sapiens
ugcuauguuguccaggcuggc

SEQ ID NO: 321636 - RNA, 23 nt, Homo sapiens
ugcuccccucauggaugaauaaa

SEQ ID NO: 321637 - RNA, 18 nt, Homo sapiens
ugcuccccugggugagca

SEQ ID NO: 321638 - RNA, 22 nt, Homo sapiens
ugcugcaaucucggcacuuugg

SEQ ID NO: 321639 - RNA, 22 nt, Homo sapiens
ugcugcacaguucuuaagauua

SEQ ID NO: 321640 - RNA, 20 nt, Homo sapiens
ugcugcacuuaagcaugggc

SEQ ID NO: 321641 - RNA, 21 nt, Homo sapiens
ugcugcacuucuuuugcugug

SEQ ID NO: 321642 - RNA, 22 nt, Homo sapiens
ugcugcauuggggauuaaguuu

SEQ ID NO: 321643 - RNA, 22 nt, Homo sapiens
ugcugguaguuuaugacuaauu

SEQ ID NO: 321644 - RNA, 22 nt, Homo sapiens
ugcuggugauuaaauccugaag

SEQ ID NO: 321645 - RNA, 22 nt, Homo sapiens
ugcugguggucccauaugauua

SEQ ID NO: 321646 - RNA, 22 nt, Homo sapiens
ugcugguuuaaaaugcaaauuc

SEQ ID NO: 321647 - RNA, 22 nt, Homo sapiens
ugcuuugguagaaaucuuuggu

SEQ ID NO: 321648 - RNA, 22 nt, Homo sapiens
uggaaacuuauguucuucugug

SEQ ID NO: 321649 - RNA, 20 nt, Homo sapiens
uggaaaguaagucaugauau

SEQ ID NO: 321650 - RNA, 22 nt, Homo sapiens
uggaacacauaaauagcauagu

SEQ ID NO: 321651 - RNA, 22 nt, Homo sapiens
uggaacugauauugauggaaaa

SEQ ID NO: 321652 - RNA, 22 nt, Homo sapiens
uggaagacacauaccugauaac

SEQ ID NO: 321653 - RNA, 22 nt, Homo sapiens
uggaagacucuagucucuugag

SEQ ID NO: 321654 - RNA, 22 nt, Homo sapiens
uggaagacuuuagaggcuuaua

SEQ ID NO: 321655 - RNA, 22 nt, Homo sapiens
uggaagaugggaccucaguuuu

SEQ ID NO: 321656 - RNA, 22 nt, Homo sapiens
uggaagauuacuuuuuguugaa

SEQ ID NO: 321657 - RNA, 22 nt, Homo sapiens
uggaagauucuagaagauucca

SEQ ID NO: 321658 - RNA, 22 nt, Homo sapiens
uggaagcauagcagcgugugug

SEQ ID NO: 321659 - RNA, 20 nt, Homo sapiens
uggaagccuggugcuaucuu

SEQ ID NO: 321660 - RNA, 20 nt, Homo sapiens
uggaaggcaucugcauuauu

SEQ ID NO: 321661 - RNA, 22 nt, Homo sapiens
uggaaggcuucauauguaaaga

SEQ ID NO: 321662 - RNA, 22 nt, Homo sapiens
uggaagguaaguuuugagcauu

SEQ ID NO: 321663 - RNA, 22 nt, Homo sapiens
uggaagucaugcugcaagaaca

SEQ ID NO: 321664 - RNA, 22 nt, Homo sapiens
uggaagucuauggcauuugagu

SEQ ID NO: 321665 - RNA, 22 nt, Homo sapiens
uggaaguuaaaugacucuuucu

SEQ ID NO: 321666 - RNA, 19 nt, Homo sapiens
uggaaugaaauguuagggg

SEQ ID NO: 321667 - RNA, 20 nt, Homo sapiens
uggaaugcagccuccuucug

SEQ ID NO: 321668 - RNA, 19 nt, Homo sapiens
uggaauggauuuaaaugug

SEQ ID NO: 321669 - RNA, 22 nt, Homo sapiens
uggaaugguaucuuguuggggu

SEQ ID NO: 321670 - RNA, 22 nt, Homo sapiens
uggacagacaagguuauagauc

SEQ ID NO: 321671 - RNA, 22 nt, Homo sapiens
uggacaugaagggcacaggagg

SEQ ID NO: 321672 - RNA, 20 nt, Homo sapiens
uggaccagagagguggggac

SEQ ID NO: 321673 - RNA, 19 nt, Homo sapiens
uggaccccuuccuuacacc

SEQ ID NO: 321674 - RNA, 22 nt, Homo sapiens
uggacuguaagugccuugagua

SEQ ID NO: 321675 - RNA, 22 nt, Homo sapiens
uggacuguaauagagaacagaa

SEQ ID NO: 321676 - RNA, 23 nt, Homo sapiens
uggaggacaagcauggauaguga

SEQ ID NO: 321677 - RNA, 22 nt, Homo sapiens
uggagguaggugauauguagca

SEQ ID NO: 321678 - RNA, 20 nt, Homo sapiens
uggaggucaucugucacuac

SEQ ID NO: 321679 - RNA, 22 nt, Homo sapiens
uggaguaggccuaagaaugaca

SEQ ID NO: 321680 - RNA, 19 nt, Homo sapiens
uggagucaucaugcugcua

SEQ ID NO: 321681 - RNA, 16 nt, Homo sapiens
uggagucauccuugac

SEQ ID NO: 321682 - RNA, 22 nt, Homo sapiens
uggagugagaacuucaaugaug

SEQ ID NO: 321683 - RNA, 22 nt, Homo sapiens
uggagugcaauggugagaucuu

SEQ ID NO: 321684 - RNA, 22 nt, Homo sapiens
uggaguguagcggcaccuauua

SEQ ID NO: 321685 - RNA, 22 nt, Homo sapiens
uggaucaugcgaggccuccccu

SEQ ID NO: 321686 - RNA, 22 nt, Homo sapiens
uggaucauucuuucuugcaggg

SEQ ID NO: 321687 - RNA, 22 nt, Homo sapiens
uggaugacauccuuguaugcag

SEQ ID NO: 321688 - RNA, 21 nt, Homo sapiens
uggaugccuaggcagaaguuu

SEQ ID NO: 321689 - RNA, 22 nt, Homo sapiens
uggauggagaggcuugugaugc

SEQ ID NO: 321690 - RNA, 22 nt, Homo sapiens
uggauggugauuggaucaugga

SEQ ID NO: 321691 - RNA, 22 nt, Homo sapiens
uggauugagaagcuguggcuca

SEQ ID NO: 321692 - RNA, 18 nt, Homo sapiens
uggauuggaaaaguuccu

SEQ ID NO: 321693 - RNA, 22 nt, Homo sapiens
uggauuguaacauagaguaaau

SEQ ID NO: 321694 - RNA, 19 nt, Homo sapiens
uggauuguuagagcagugu

SEQ ID NO: 321695 - RNA, 22 nt, Homo sapiens
uggcaaaauggaauauguuggg

SEQ ID NO: 321696 - RNA, 22 nt, Homo sapiens
uggcaaaugaaagaaagccagu

SEQ ID NO: 321697 - RNA, 22 nt, Homo sapiens
uggcaaaugugagaugagaacu

SEQ ID NO: 321698 - RNA, 22 nt, Homo sapiens
uggcaagaacaacaauuacuuu

SEQ ID NO: 321699 - RNA, 22 nt, Homo sapiens
uggcaagagaacaacaucucuc

SEQ ID NO: 321700 - RNA, 22 nt, Homo sapiens
uggcaagagcaaaauguacagu

SEQ ID NO: 321701 - RNA, 22 nt, Homo sapiens
uggcaagagcugcauucaucug

SEQ ID NO: 321702 - RNA, 22 nt, Homo sapiens
uggcaagagggaugcaagguuu

SEQ ID NO: 321703 - RNA, 22 nt, Homo sapiens
uggcaagaucacaauuacuuuu

SEQ ID NO: 321704 - RNA, 19 nt, Homo sapiens
uggcacauguauacuuaug

SEQ ID NO: 321705 - RNA, 22 nt, Homo sapiens
uggcagaugcucuuggugccca

SEQ ID NO: 321706 - RNA, 22 nt, Homo sapiens
uggcagauggugacaccauuag

SEQ ID NO: 321707 - RNA, 22 nt, Homo sapiens
uggcagcgcaguugaaaaagaa

SEQ ID NO: 321708 - RNA, 22 nt, Homo sapiens
uggcagugggagauauuuuauu

SEQ ID NO: 321709 - RNA, 22 nt, Homo sapiens
uggcaguuuacaaaugccauga

SEQ ID NO: 321710 - RNA, 22 nt, Homo sapiens
uggcaguuuacagcuuuaggag

SEQ ID NO: 321711 - RNA, 20 nt, Homo sapiens
uggcaugaaauuuuccaagc

SEQ ID NO: 321712 - RNA, 22 nt, Homo sapiens
uggcaugaaguguguuuuaucu

SEQ ID NO: 321713 - RNA, 22 nt, Homo sapiens
uggcauggaguggauggcccca

SEQ ID NO: 321714 - RNA, 23 nt, Homo sapiens
uggcauuuuaguuagcuucagug

SEQ ID NO: 321715 - RNA, 22 nt, Homo sapiens
uggccaagagcacagauauugg

SEQ ID NO: 321716 - RNA, 22 nt, Homo sapiens
uggccaguugaagacaaugcuc

SEQ ID NO: 321717 - RNA, 22 nt, Homo sapiens
uggccuguaacgcugucucagc

SEQ ID NO: 321718 - RNA, 22 nt, Homo sapiens
uggcuacagaaaguacuaguga

SEQ ID NO: 321719 - RNA, 22 nt, Homo sapiens
uggcuacugacugaugauuaua

SEQ ID NO: 321720 - RNA, 22 nt, Homo sapiens
uggcuagaccugcauaacagcu

SEQ ID NO: 321721 - RNA, 21 nt, Homo sapiens
uggcuauuucuguggcauaca

SEQ ID NO: 321722 - RNA, 22 nt, Homo sapiens
uggcuguuuauuucacgugggu

SEQ ID NO: 321723 - RNA, 22 nt, Homo sapiens
uggcuuuuauuauguugaggua

SEQ ID NO: 321724 - RNA, 22 nt, Homo sapiens
uggcuuuuccaggcauuacgau

SEQ ID NO: 321725 - RNA, 22 nt, Homo sapiens
uggcuuuuguuauuuggaagcu

SEQ ID NO: 321726 - RNA, 20 nt, Homo sapiens
ugggaaauguccaggacaua

SEQ ID NO: 321727 - RNA, 20 nt, Homo sapiens
ugggaacaugugguauaugg

SEQ ID NO: 321728 - RNA, 22 nt, Homo sapiens
ugggaacugaggugaaaagaca

SEQ ID NO: 321729 - RNA, 22 nt, Homo sapiens
ugggaagcugcauuuuaacaag

SEQ ID NO: 321730 - RNA, 22 nt, Homo sapiens
ugggaauaugauacaggucuuu

SEQ ID NO: 321731 - RNA, 22 nt, Homo sapiens
ugggcaaaacuaagagcugugg

SEQ ID NO: 321732 - RNA, 22 nt, Homo sapiens
ugggcauuguuccuaguuaucu

SEQ ID NO: 321733 - RNA, 22 nt, Homo sapiens
ugggcggagacgugcagccgcc

SEQ ID NO: 321734 - RNA, 22 nt, Homo sapiens
uggggucguaggugcccgccag

SEQ ID NO: 321735 - RNA, 22 nt, Homo sapiens
uggguagagaaucaggaucuua

SEQ ID NO: 321736 - RNA, 22 nt, Homo sapiens
uggguagagcacugggggcgag

SEQ ID NO: 321737 - RNA, 19 nt, Homo sapiens
uggguagugaugagacaua

SEQ ID NO: 321738 - RNA, 22 nt, Homo sapiens
ugggucaguagcauguaugucu

SEQ ID NO: 321739 - RNA, 22 nt, Homo sapiens
uggguccccuacucuuuccaca

SEQ ID NO: 321740 - RNA, 22 nt, Homo sapiens
ugggugaguaucuauuauucag

SEQ ID NO: 321741 - RNA, 20 nt, Homo sapiens
ugguaauguaagagaggaga

SEQ ID NO: 321742 - RNA, 22 nt, Homo sapiens
ugguacuguccuucuagauucc

SEQ ID NO: 321743 - RNA, 22 nt, Homo sapiens
ugguaugucuagauggggaagu

SEQ ID NO: 321744 - RNA, 22 nt, Homo sapiens
ugguauguguucuaaaauuaug

SEQ ID NO: 321745 - RNA, 22 nt, Homo sapiens
ugguccacuaacccucaguauc

SEQ ID NO: 321746 - RNA, 21 nt, Homo sapiens
uggucccauaagauuacaaug

SEQ ID NO: 321747 - RNA, 21 nt, Homo sapiens
uggucccauaagauuauaaug

SEQ ID NO: 321748 - RNA, 22 nt, Homo sapiens
uggucccaugaacuuuagguca

SEQ ID NO: 321749 - RNA, 20 nt, Homo sapiens
ugguccccugagucuggcuu

SEQ ID NO: 321750 - RNA, 22 nt, Homo sapiens
uggugagaaaagaugucuuugu

SEQ ID NO: 321751 - RNA, 22 nt, Homo sapiens
uggugcaaugaagugaucucaa

SEQ ID NO: 321752 - RNA, 19 nt, Homo sapiens
uggugccuuguucuuggau

SEQ ID NO: 321753 - RNA, 20 nt, Homo sapiens
uggugucuuggaaagagcuc

SEQ ID NO: 321754 - RNA, 20 nt, Homo sapiens
ugguguuugaacagugaaug

SEQ ID NO: 321755 - RNA, 21 nt, Homo sapiens
ugguucaguucguuacgugug

SEQ ID NO: 321756 - RNA, 22 nt, Homo sapiens
ugguuccauauuaauuuuagga

SEQ ID NO: 321757 - RNA, 22 nt, Homo sapiens
uguaaaaagcccagccgcugag

SEQ ID NO: 321758 - RNA, 22 nt, Homo sapiens
uguaaacuuuugagauugacuu

SEQ ID NO: 321759 - RNA, 22 nt, Homo sapiens
uguaaagaaagcuguuguugua

SEQ ID NO: 321760 - RNA, 23 nt, Homo sapiens
uguaaagcuaugaauuauucuuu

SEQ ID NO: 321761 - RNA, 22 nt, Homo sapiens
uguaaaucuauuuuuaguguuu

SEQ ID NO: 321762 - RNA, 22 nt, Homo sapiens
uguaacugcuuagaagguuuua

SEQ ID NO: 321763 - RNA, 22 nt, Homo sapiens
uguaagugugcaauucagugau

SEQ ID NO: 321764 - RNA, 22 nt, Homo sapiens
uguaauggcagacuccggugga

SEQ ID NO: 321765 - RNA, 22 nt, Homo sapiens
uguaauguuucaucauuauuaa

SEQ ID NO: 321766 - RNA, 20 nt, Homo sapiens
uguacacaguguacccacau

SEQ ID NO: 321767 - RNA, 22 nt, Homo sapiens
uguagacaccaaagacagcaua

SEQ ID NO: 321768 - RNA, 22 nt, Homo sapiens
uguagauaucauuagugcugug

SEQ ID NO: 321769 - RNA, 22 nt, Homo sapiens
uguagcagccauaaacacagug

SEQ ID NO: 321770 - RNA, 22 nt, Homo sapiens
uguagggagagggaguugcacc

SEQ ID NO: 321771 - RNA, 22 nt, Homo sapiens
uguagucauuuggaguccagcu

SEQ ID NO: 321772 - RNA, 22 nt, Homo sapiens
uguauacugucuaauauguugu

SEQ ID NO: 321773 - RNA, 21 nt, Homo sapiens
uguauauguuuauacacacac

SEQ ID NO: 321774 - RNA, 22 nt, Homo sapiens
uguaugagagacauggcugcuu

SEQ ID NO: 321775 - RNA, 22 nt, Homo sapiens
uguaugaguuguuuauaaauuu

SEQ ID NO: 321776 - RNA, 22 nt, Homo sapiens
uguauguaauugaaguuaaguu

SEQ ID NO: 321777 - RNA, 22 nt, Homo sapiens
uguauguugauguuauauucug

SEQ ID NO: 321778 - RNA, 22 nt, Homo sapiens
uguauguuuaaggccaguggaa

SEQ ID NO: 321779 - RNA, 19 nt, Homo sapiens
ugucaaaugucuccugggg

SEQ ID NO: 321780 - RNA, 20 nt, Homo sapiens
ugucaagaaacauuacuuau

SEQ ID NO: 321781 - RNA, 22 nt, Homo sapiens
ugucaaugggaauuuguuuuag

SEQ ID NO: 321782 - RNA, 22 nt, Homo sapiens
ugucagaaucugagacgacaac

SEQ ID NO: 321783 - RNA, 22 nt, Homo sapiens
ugucaggagcaaugauaaauuu

SEQ ID NO: 321784 - RNA, 22 nt, Homo sapiens
ugucaguggucuggaugcagcc

SEQ ID NO: 321785 - RNA, 22 nt, Homo sapiens
ugucaguuucaguguuagccuu

SEQ ID NO: 321786 - RNA, 22 nt, Homo sapiens
ugucaguuucuugagauggaac

SEQ ID NO: 321787 - RNA, 22 nt, Homo sapiens
ugucauacaguaacaugguugg

SEQ ID NO: 321788 - RNA, 22 nt, Homo sapiens
ugucauauagaauguucuauga

SEQ ID NO: 321789 - RNA, 22 nt, Homo sapiens
ugucaugaacucacauucuggg

SEQ ID NO: 321790 - RNA, 22 nt, Homo sapiens
ugucaugguguuaauuuuccug

SEQ ID NO: 321791 - RNA, 22 nt, Homo sapiens
ugucauucaggaaauucuaagu

SEQ ID NO: 321792 - RNA, 22 nt, Homo sapiens
uguccaaaucagagguaccaaa

SEQ ID NO: 321793 - RNA, 22 nt, Homo sapiens
uguccaguguuccucagaagaa

SEQ ID NO: 321794 - RNA, 20 nt, Homo sapiens
ugucccaaccccauggguuc

SEQ ID NO: 321795 - RNA, 19 nt, Homo sapiens
ugucccagccauagaggca

SEQ ID NO: 321796 - RNA, 19 nt, Homo sapiens
uguccuagaggaguucaca

SEQ ID NO: 321797 - RNA, 20 nt, Homo sapiens
ugucuauggggguucucugc

SEQ ID NO: 321798 - RNA, 22 nt, Homo sapiens
ugucucagugauuggcuuucug

SEQ ID NO: 321799 - RNA, 22 nt, Homo sapiens
ugucucaguuacggcaauucca

SEQ ID NO: 321800 - RNA, 22 nt, Homo sapiens
ugucuggaguccauagaagugu

SEQ ID NO: 321801 - RNA, 22 nt, Homo sapiens
ugucuuguagacaauguauagu

SEQ ID NO: 321802 - RNA, 22 nt, Homo sapiens
ugucuuguagacugaaggcuuc

SEQ ID NO: 321803 - RNA, 22 nt, Homo sapiens
ugugaaacauggauagaacugg

SEQ ID NO: 321804 - RNA, 22 nt, Homo sapiens
ugugaaaucagauagccuuuuu

SEQ ID NO: 321805 - RNA, 22 nt, Homo sapiens
ugugaaauguuaucccgucgug

SEQ ID NO: 321806 - RNA, 22 nt, Homo sapiens
ugugaacaaaauuuguugcaua

SEQ ID NO: 321807 - RNA, 22 nt, Homo sapiens
ugugaacauuuuguauauauua

SEQ ID NO: 321808 - RNA, 20 nt, Homo sapiens
ugugaacuguagauagucuu

SEQ ID NO: 321809 - RNA, 22 nt, Homo sapiens
ugugaagaugagaugacgcccu

SEQ ID NO: 321810 - RNA, 22 nt, Homo sapiens
ugugaagauguuucuuaauuga

SEQ ID NO: 321811 - RNA, 22 nt, Homo sapiens
ugugaaugaagaaugcuaaccu

SEQ ID NO: 321812 - RNA, 22 nt, Homo sapiens
ugugacaaauuuaguggacugu

SEQ ID NO: 321813 - RNA, 22 nt, Homo sapiens
ugugacagguagguaauuuuug

SEQ ID NO: 321814 - RNA, 22 nt, Homo sapiens
ugugacaguguuacauuucaug

SEQ ID NO: 321815 - RNA, 22 nt, Homo sapiens
ugugacaguuaguuugguguua

SEQ ID NO: 321816 - RNA, 22 nt, Homo sapiens
ugugacuaguggugaaugacgc

SEQ ID NO: 321817 - RNA, 22 nt, Homo sapiens
ugugacucuggcacauggugag

SEQ ID NO: 321818 - RNA, 22 nt, Homo sapiens
ugugacugguugucccacuuuc

SEQ ID NO: 321819 - RNA, 22 nt, Homo sapiens
ugugagaaaugcagaaucucag

SEQ ID NO: 321820 - RNA, 22 nt, Homo sapiens
ugugagcuauggaguuguagag

SEQ ID NO: 321821 - RNA, 19 nt, Homo sapiens
ugugauaguugaaccugcc

SEQ ID NO: 321822 - RNA, 22 nt, Homo sapiens
ugugaucaauuagugaugucug

SEQ ID NO: 321823 - RNA, 22 nt, Homo sapiens
ugugaucaugcuccaggcgaga

SEQ ID NO: 321824 - RNA, 22 nt, Homo sapiens
ugugaucaugugugccuuaguc

SEQ ID NO: 321825 - RNA, 22 nt, Homo sapiens
ugugauuauuuaaauaggacag

SEQ ID NO: 321826 - RNA, 22 nt, Homo sapiens
ugugauuauuuauagacaguca

SEQ ID NO: 321827 - RNA, 22 nt, Homo sapiens
ugugcaaaaacaauugcgguuu

SEQ ID NO: 321828 - RNA, 22 nt, Homo sapiens
ugugcaaauuagcacaacccga

SEQ ID NO: 321829 - RNA, 22 nt, Homo sapiens
ugugcacaaccugcagguuugu

SEQ ID NO: 321830 - RNA, 22 nt, Homo sapiens
ugugcacaauguacagguuagu

SEQ ID NO: 321831 - RNA, 22 nt, Homo sapiens
ugugccacuccaaccuggguga

SEQ ID NO: 321832 - RNA, 22 nt, Homo sapiens
ugugccacuccaggaggcuguu

SEQ ID NO: 321833 - RNA, 22 nt, Homo sapiens
ugugccacugcacuccugggug

SEQ ID NO: 321834 - RNA, 22 nt, Homo sapiens
ugugccacugcacucugggcaa

SEQ ID NO: 321835 - RNA, 22 nt, Homo sapiens
ugugcuauguuauucacauggg

SEQ ID NO: 321836 - RNA, 22 nt, Homo sapiens
ugugcuugaauuuaguagcuua

SEQ ID NO: 321837 - RNA, 22 nt, Homo sapiens
uguggcaaauggucaggaagaa

SEQ ID NO: 321838 - RNA, 17 nt, Homo sapiens
uguggcucuuaugcuga

SEQ ID NO: 321839 - RNA, 22 nt, Homo sapiens
uguggcuuuuucuuggcugagg

SEQ ID NO: 321840 - RNA, 22 nt, Homo sapiens
ugugguauuagguguaguaucu

SEQ ID NO: 321841 - RNA, 23 nt, Homo sapiens
ugugguauuauuccauuuauagg

SEQ ID NO: 321842 - RNA, 22 nt, Homo sapiens
uguggucaucacuugaagguaa

SEQ ID NO: 321843 - RNA, 22 nt, Homo sapiens
ugugguccucugaaggcuuuuc

SEQ ID NO: 321844 - RNA, 22 nt, Homo sapiens
uguguaaagcuuguuccagaaa

SEQ ID NO: 321845 - RNA, 22 nt, Homo sapiens
uguguaaauaugauagaggaau

SEQ ID NO: 321846 - RNA, 22 nt, Homo sapiens
ugugucacugcacuccagccug

SEQ ID NO: 321847 - RNA, 22 nt, Homo sapiens
ugugucuacugagaugaucaug

SEQ ID NO: 321848 - RNA, 22 nt, Homo sapiens
ugugucuugagagucucgagaa

SEQ ID NO: 321849 - RNA, 22 nt, Homo sapiens
ugugucuuuuaucacacaaugu

SEQ ID NO: 321850 - RNA, 22 nt, Homo sapiens
uguuauguucuacuuuuaggug

SEQ ID NO: 321851 - RNA, 22 nt, Homo sapiens
uguuauguuuuagagguuucaa

SEQ ID NO: 321852 - RNA, 22 nt, Homo sapiens
uguugcacacacugaaauacac

SEQ ID NO: 321853 - RNA, 22 nt, Homo sapiens
uguugcacuccauccugggcga

SEQ ID NO: 321854 - RNA, 22 nt, Homo sapiens
uguugcauuugucaaggucaag

SEQ ID NO: 321855 - RNA, 22 nt, Homo sapiens
uguuggcauugcugcugacccu

SEQ ID NO: 321856 - RNA, 22 nt, Homo sapiens
uguuuaguuaagacauagaauu

SEQ ID NO: 321857 - RNA, 22 nt, Homo sapiens
uguuugcuguguggaguagcag

SEQ ID NO: 321858 - RNA, 22 nt, Homo sapiens
uucacugcacuccagccugggu

SEQ ID NO: 321859 - RNA, 22 nt, Homo sapiens
uucacuggagcccaggaguugg

SEQ ID NO: 321860 - RNA, 22 nt, Homo sapiens
uucacugugaacucauauucag

SEQ ID NO: 321861 - RNA, 20 nt, Homo sapiens
uucagcaaaggaaugggagu

SEQ ID NO: 321862 - RNA, 22 nt, Homo sapiens
uucaggcuccugugagaaucua

SEQ ID NO: 321863 - RNA, 22 nt, Homo sapiens
uucaggcuuuuauuuacugaua

SEQ ID NO: 321864 - RNA, 22 nt, Homo sapiens
uucagggagaaggcaaacguug

SEQ ID NO: 321865 - RNA, 22 nt, Homo sapiens
uucagguacuauaggcuguugg

SEQ ID NO: 321866 - RNA, 22 nt, Homo sapiens
uucagguaguuuaacuguucca

SEQ ID NO: 321867 - RNA, 22 nt, Homo sapiens
uucagguaucccuugucuauag

SEQ ID NO: 321868 - RNA, 22 nt, Homo sapiens
uucagguucauuugcugcuauu

SEQ ID NO: 321869 - RNA, 22 nt, Homo sapiens
uucaguagucaaaagauaaggg

SEQ ID NO: 321870 - RNA, 22 nt, Homo sapiens
uucagugagacgaaaacaacaa

SEQ ID NO: 321871 - RNA, 22 nt, Homo sapiens
uucaguggguggaugaauauga

SEQ ID NO: 321872 - RNA, 22 nt, Homo sapiens
uucaguucugcucugaucuuag

SEQ ID NO: 321873 - RNA, 18 nt, Homo sapiens
uucaguuuguaucugggg

SEQ ID NO: 321874 - RNA, 22 nt, Homo sapiens
uucauacaguggcugcacucca

SEQ ID NO: 321875 - RNA, 22 nt, Homo sapiens
uucauagucuaugcaaguaaga

SEQ ID NO: 321876 - RNA, 22 nt, Homo sapiens
uucauaguguaccugaaggcac

SEQ ID NO: 321877 - RNA, 21 nt, Homo sapiens
uucaucagccagaaaucaagc

SEQ ID NO: 321878 - RNA, 22 nt, Homo sapiens
uucaucaguuauauuggccuga

SEQ ID NO: 321879 - RNA, 22 nt, Homo sapiens
uucauggauggaaaugauuuug

SEQ ID NO: 321880 - RNA, 20 nt, Homo sapiens
uucaugggagcaaagaggcc

SEQ ID NO: 321881 - RNA, 22 nt, Homo sapiens
uucauguaaucaaggcagcuaa

SEQ ID NO: 321882 - RNA, 16 nt, Homo sapiens
uuccacagucgaggug

SEQ ID NO: 321883 - RNA, 20 nt, Homo sapiens
uuccagcacauuagggaagc

SEQ ID NO: 321884 - RNA, 22 nt, Homo sapiens
uuccagcugggggcaacucugc

SEQ ID NO: 321885 - RNA, 22 nt, Homo sapiens
uuccaggugggcgugggccugg

SEQ ID NO: 321886 - RNA, 22 nt, Homo sapiens
uuccaguauuugggcaagcgca

SEQ ID NO: 321887 - RNA, 22 nt, Homo sapiens
uuccaguggaguaaauggacaa

SEQ ID NO: 321888 - RNA, 22 nt, Homo sapiens
uuccaguguguucauccucaga

SEQ ID NO: 321889 - RNA, 22 nt, Homo sapiens
uucccagagaaaaggguuucuu

SEQ ID NO: 321890 - RNA, 22 nt, Homo sapiens
uucccagucaaacgaaggacuu

SEQ ID NO: 321891 - RNA, 22 nt, Homo sapiens
uucccuagaacacauggaggga

SEQ ID NO: 321892 - RNA, 22 nt, Homo sapiens
uucccugaaguguuacucuaga

SEQ ID NO: 321893 - RNA, 22 nt, Homo sapiens
uucccugagcaucuguugagcc

SEQ ID NO: 321894 - RNA, 22 nt, Homo sapiens
uucccugugugcagaugggugu

SEQ ID NO: 321895 - RNA, 22 nt, Homo sapiens
uucccuugcaggaugaucugga

SEQ ID NO: 321896 - RNA, 22 nt, Homo sapiens
uucccuuucuuaaagaguuagg

SEQ ID NO: 321897 - RNA, 22 nt, Homo sapiens
uuccugagaucagaauucaaau

SEQ ID NO: 321898 - RNA, 22 nt, Homo sapiens
uuccugaggccuccccagaagc

SEQ ID NO: 321899 - RNA, 22 nt, Homo sapiens
uuccugcacuugcuugccuaug

SEQ ID NO: 321900 - RNA, 22 nt, Homo sapiens
uuccugugacccccaagcccac

SEQ ID NO: 321901 - RNA, 22 nt, Homo sapiens
uuccuugagaaaggcacaaguu

SEQ ID NO: 321902 - RNA, 22 nt, Homo sapiens
uuccuugagagcuugauaucac

SEQ ID NO: 321903 - RNA, 21 nt, Homo sapiens
uucggcaauaugaaccaaugu

SEQ ID NO: 321904 - RNA, 22 nt, Homo sapiens
uucgucaugagacagaugcuga

SEQ ID NO: 321905 - RNA, 21 nt, Homo sapiens
uucuaaguaaauguuggacau

SEQ ID NO: 321906 - RNA, 22 nt, Homo sapiens
uucuaaguaagucuguggggaa

SEQ ID NO: 321907 - RNA, 22 nt, Homo sapiens
uucuacaggcuguucaagaagc

SEQ ID NO: 321908 - RNA, 22 nt, Homo sapiens
uucuagcacuuugggagacuga

SEQ ID NO: 321909 - RNA, 20 nt, Homo sapiens
uucuaguacuucuguuucca

SEQ ID NO: 321910 - RNA, 21 nt, Homo sapiens
uucuauggucagaauucaaua

SEQ ID NO: 321911 - RNA, 20 nt, Homo sapiens
uucuauggugaugaguccug

SEQ ID NO: 321912 - RNA, 22 nt, Homo sapiens
uucuaugguuuaauaguuuggg

SEQ ID NO: 321913 - RNA, 22 nt, Homo sapiens
uucuauugguaauauuuucugu

SEQ ID NO: 321914 - RNA, 22 nt, Homo sapiens
uucucagcccccugacagucag

SEQ ID NO: 321915 - RNA, 21 nt, Homo sapiens
uucucaggguguguccuaccc

SEQ ID NO: 321916 - RNA, 22 nt, Homo sapiens
uucucagugaaguuuagaacau

SEQ ID NO: 321917 - RNA, 22 nt, Homo sapiens
uucucaguucgguggcagugcu

SEQ ID NO: 321918 - RNA, 17 nt, Homo sapiens
uucucaguucugaucuc

SEQ ID NO: 321919 - RNA, 22 nt, Homo sapiens
uucuccugguggacccuaaacg

SEQ ID NO: 321920 - RNA, 22 nt, Homo sapiens
uucucuguggauugggugagag

SEQ ID NO: 321921 - RNA, 22 nt, Homo sapiens
uucugcuagucugucagaucuu

SEQ ID NO: 321922 - RNA, 22 nt, Homo sapiens
uucugcuugaucuaguguguug

SEQ ID NO: 321923 - RNA, 22 nt, Homo sapiens
uucuggcucgauucucugaccg

SEQ ID NO: 321924 - RNA, 22 nt, Homo sapiens
uucuggcuuuuaaagaaauguu

SEQ ID NO: 321925 - RNA, 19 nt, Homo sapiens
uucugguguuuuaagccaa

SEQ ID NO: 321926 - RNA, 22 nt, Homo sapiens
uucugugcugaaucaaagacug

SEQ ID NO: 321927 - RNA, 22 nt, Homo sapiens
uucugugcuuguggaugaagug

SEQ ID NO: 321928 - RNA, 22 nt, Homo sapiens
uucuuccagccuugaggggccc

SEQ ID NO: 321929 - RNA, 22 nt, Homo sapiens
uucuugcacuuaacugacauuc

SEQ ID NO: 321930 - RNA, 22 nt, Homo sapiens
uucuugcacuuggcccucauua

SEQ ID NO: 321931 - RNA, 22 nt, Homo sapiens
uucuuuaguucacuugcuccag

SEQ ID NO: 321932 - RNA, 22 nt, Homo sapiens
uucuuugcuuggaagcggggga

SEQ ID NO: 321933 - RNA, 22 nt, Homo sapiens
uucuuuggaaacaguacuaauu

SEQ ID NO: 321934 - RNA, 22 nt, Homo sapiens
uugaaagcuaucagagauucca

SEQ ID NO: 321935 - RNA, 22 nt, Homo sapiens
uugaaagucauuucuucuaagu

SEQ ID NO: 321936 - RNA, 22 nt, Homo sapiens
uugaaauguguaagcuccgaaa

SEQ ID NO: 321937 - RNA, 22 nt, Homo sapiens
uugaagacuaccuaccauacuu

SEQ ID NO: 321938 - RNA, 22 nt, Homo sapiens
uugaauaguggugaaaguuuga

SEQ ID NO: 321939 - RNA, 22 nt, Homo sapiens
uugaaugaaauuggugugggga

SEQ ID NO: 321940 - RNA, 22 nt, Homo sapiens
uugaaugaauggaaagaagggu

SEQ ID NO: 321941 - RNA, 17 nt, Homo sapiens
uugaaugcauuacuugg

SEQ ID NO: 321942 - RNA, 22 nt, Homo sapiens
uugaauguguugggaagcccuu

SEQ ID NO: 321943 - RNA, 22 nt, Homo sapiens
uugacagaccuuggucauaucc

SEQ ID NO: 321944 - RNA, 22 nt, Homo sapiens
uugacagagaaaagugugacuu

SEQ ID NO: 321945 - RNA, 20 nt, Homo sapiens
uugacagagggaaaguugcu

SEQ ID NO: 321946 - RNA, 22 nt, Homo sapiens
uugacauguaggcagggaaugg

SEQ ID NO: 321947 - RNA, 22 nt, Homo sapiens
uugaccacugggcacaguaagu

SEQ ID NO: 321948 - RNA, 22 nt, Homo sapiens
uugacgagaguaguagucuacc

SEQ ID NO: 321949 - RNA, 22 nt, Homo sapiens
uugacuagaccaucuuucuaga

SEQ ID NO: 321950 - RNA, 22 nt, Homo sapiens
uugacuguaagauggcuauuac

SEQ ID NO: 321951 - RNA, 22 nt, Homo sapiens
uugacugugguaauggaagcug

SEQ ID NO: 321952 - RNA, 22 nt, Homo sapiens
agcuguuguucucagaggcuuu

SEQ ID NO: 321953 - RNA, 22 nt, Homo sapiens
agcuguuuuugugggcauguga

SEQ ID NO: 321954 - RNA, 22 nt, Homo sapiens
agcuucauuccaacuuccuucu

SEQ ID NO: 321955 - RNA, 20 nt, Homo sapiens
agcuugguuuggaugaucac

SEQ ID NO: 321956 - RNA, 22 nt, Homo sapiens
agcuuguagugauuugugguaa

SEQ ID NO: 321957 - RNA, 22 nt, Homo sapiens
agcuuguauuuguagccuguug

SEQ ID NO: 321958 - RNA, 22 nt, Homo sapiens
agcuuuuugggaggccuuagga

SEQ ID NO: 321959 - RNA, 22 nt, Homo sapiens
aggaagcuagcauuuguucagu

SEQ ID NO: 321960 - RNA, 22 nt, Homo sapiens
aggaagugucuucuuuuaggca

SEQ ID NO: 321961 - RNA, 22 nt, Homo sapiens
aggaagugugcaauuaauuucu

SEQ ID NO: 321962 - RNA, 22 nt, Homo sapiens
cacacugucuuucagaaugguu

SEQ ID NO: 321963 - RNA, 22 nt, Homo sapiens
cacaggccugucucuuucuaac

SEQ ID NO: 321964 - RNA, 22 nt, Homo sapiens
cacagugaaugucaucauugcc

SEQ ID NO: 321965 - RNA, 22 nt, Homo sapiens
cacaguguuacugguaugaagu

SEQ ID NO: 321966 - RNA, 22 nt, Homo sapiens
cacaguguucauagccaucagg

SEQ ID NO: 321967 - RNA, 22 nt, Homo sapiens
cacaguguuccagcuauuugaa

SEQ ID NO: 321968 - RNA, 22 nt, Homo sapiens
cacaguugccuaucuccugaag

SEQ ID NO: 321969 - RNA, 22 nt, Homo sapiens
cacauguucaggagcacuuaga

SEQ ID NO: 321970 - RNA, 22 nt, Homo sapiens
cacauguuugcuacauuuuucu

SEQ ID NO: 321971 - RNA, 22 nt, Homo sapiens
caccacauuccauugaucaggc

SEQ ID NO: 321972 - RNA, 22 nt, Homo sapiens
caccaggugcccagcacggcca

SEQ ID NO: 321973 - RNA, 22 nt, Homo sapiens
caccccuaccugagucaggagu

SEQ ID NO: 321974 - RNA, 19 nt, Homo sapiens
caccgccugcccccugcug

SEQ ID NO: 321975 - RNA, 22 nt, Homo sapiens
cacugcacuccagcuugugggc

SEQ ID NO: 321976 - RNA, 22 nt, Homo sapiens
cacugcacuccaguuucgguaa

SEQ ID NO: 321977 - RNA, 22 nt, Homo sapiens
cacugcaguguaauuaagguug

SEQ ID NO: 321978 - RNA, 22 nt, Homo sapiens
cacugcauccuccauauccugg

SEQ ID NO: 321979 - RNA, 22 nt, Homo sapiens
cacugcauucuccaccucccag

SEQ ID NO: 321980 - RNA, 22 nt, Homo sapiens
cacugcauuggaugguuccucc

SEQ ID NO: 321981 - RNA, 22 nt, Homo sapiens
cacuggcacuguguuuagaugg

SEQ ID NO: 321982 - RNA, 17 nt, Homo sapiens
cacugggugcaagagga

SEQ ID NO: 321983 - RNA, 22 nt, Homo sapiens
cagaaguauugguaugcucugu

SEQ ID NO: 321984 - RNA, 22 nt, Homo sapiens
cagagaacugaguuauuuucuu

SEQ ID NO: 321985 - RNA, 22 nt, Homo sapiens
cagagucaagcucuuguuccau

SEQ ID NO: 321986 - RNA, 22 nt, Homo sapiens
cagagugcauguuuagaugagu

SEQ ID NO: 321987 - RNA, 22 nt, Homo sapiens
cagauacuggaguccugaaguu

SEQ ID NO: 321988 - RNA, 22 nt, Homo sapiens
cagauaguuguagauaugcagc

SEQ ID NO: 321989 - RNA, 22 nt, Homo sapiens
cagauaguuguagguguguggc

SEQ ID NO: 321990 - RNA, 22 nt, Homo sapiens
cagcagguuuuuaucaguuaag

SEQ ID NO: 321991 - RNA, 22 nt, Homo sapiens
cagcuaguuuuugguuuacagu

SEQ ID NO: 321992 - RNA, 23 nt, Homo sapiens
cagcuggugauuuuaaguugaag

SEQ ID NO: 321993 - RNA, 22 nt, Homo sapiens
cagcuggugcugcaccaguggg

SEQ ID NO: 321994 - RNA, 22 nt, Homo sapiens
caggaccucuugccuggaagcc

SEQ ID NO: 321995 - RNA, 22 nt, Homo sapiens
caggcaaggugaaguguacugg

SEQ ID NO: 321996 - RNA, 22 nt, Homo sapiens
cagggaauguuauuuaauagca

SEQ ID NO: 321997 - RNA, 22 nt, Homo sapiens
cagguacauuuuaaagggcuca

SEQ ID NO: 321998 - RNA, 22 nt, Homo sapiens
cagguauagucacuugcccaag

SEQ ID NO: 321999 - RNA, 22 nt, Homo sapiens
cagucacagugacaggaugugg

SEQ ID NO: 322000 - RNA, 20 nt, Homo sapiens
cagucaugaagaacugugag

SEQ ID NO: 322001 - RNA, 22 nt, Homo sapiens
cagugacacugaaaaguucggg

SEQ ID NO: 322002 - RNA, 22 nt, Homo sapiens
cagugcauccauguucagcagu

SEQ ID NO: 322003 - RNA, 22 nt, Homo sapiens
cagugcauguggcacucuccag

SEQ ID NO: 322004 - RNA, 20 nt, Homo sapiens
cagugcauugcuucugauuu

SEQ ID NO: 322005 - RNA, 22 nt, Homo sapiens
caguggacuaaauggggaauau

SEQ ID NO: 322006 - RNA, 22 nt, Homo sapiens
cagugguuuucucaguucagca

SEQ ID NO: 322007 - RNA, 22 nt, Homo sapiens
caguguaugcuucuauuuuugg

SEQ ID NO: 322008 - RNA, 22 nt, Homo sapiens
caguucaugguaggcaccauag

SEQ ID NO: 322009 - RNA, 22 nt, Homo sapiens
caguuguuuuaugacauaagau

SEQ ID NO: 322010 - RNA, 22 nt, Homo sapiens
cauacaagcuacaaucacaaag

SEQ ID NO: 322011 - RNA, 22 nt, Homo sapiens
cauacagcuaguaaguguaaga

SEQ ID NO: 322012 - RNA, 22 nt, Homo sapiens
cauacaguaggcacuauuugua

SEQ ID NO: 322013 - RNA, 22 nt, Homo sapiens
cauagcacugcacuucagccug

SEQ ID NO: 322014 - RNA, 22 nt, Homo sapiens
cauaugguuuuauguucuucau

SEQ ID NO: 322015 - RNA, 22 nt, Homo sapiens
caucacagcaaguagggagugg

SEQ ID NO: 322016 - RNA, 23 nt, Homo sapiens
caucacauagaggaaagaggaca

SEQ ID NO: 322017 - RNA, 22 nt, Homo sapiens
caucacaugcuuauuuuccuca

SEQ ID NO: 322018 - RNA, 22 nt, Homo sapiens
caucacauucugagauacugag

SEQ ID NO: 322019 - RNA, 22 nt, Homo sapiens
caucccauucgaggggcacagc

SEQ ID NO: 322020 - RNA, 21 nt, Homo sapiens
cauccccugccauuguggucu

SEQ ID NO: 322021 - RNA, 22 nt, Homo sapiens
caucccugucgucaagucucug

SEQ ID NO: 322022 - RNA, 22 nt, Homo sapiens
caugaaagugagaaacuccugg

SEQ ID NO: 322023 - RNA, 22 nt, Homo sapiens
caugacacauguuuaccuaugu

SEQ ID NO: 322024 - RNA, 22 nt, Homo sapiens
caugccacugcacgccauccug

SEQ ID NO: 322025 - RNA, 22 nt, Homo sapiens
cauggcacaucuuuucugacua

SEQ ID NO: 322026 - RNA, 22 nt, Homo sapiens
cauggcauuucaagauuuacca

SEQ ID NO: 322027 - RNA, 22 nt, Homo sapiens
cauggcccugggcugggcgaac

SEQ ID NO: 322028 - RNA, 22 nt, Homo sapiens
cauggcccuggguccauaggaa

SEQ ID NO: 322029 - RNA, 22 nt, Homo sapiens
cauggcucuuugcugcuaaagu

SEQ ID NO: 322030 - RNA, 22 nt, Homo sapiens
agacacugaaauguauugaaga

SEQ ID NO: 322031 - RNA, 20 nt, Homo sapiens
agacagcugcagcccacauc

SEQ ID NO: 322032 - RNA, 20 nt, Homo sapiens
agacaguguggagauuccuu

SEQ ID NO: 322033 - RNA, 22 nt, Homo sapiens
agacaucauuugauggugggag

SEQ ID NO: 322034 - RNA, 22 nt, Homo sapiens
agacuagaaaucauuuguugag

SEQ ID NO: 322035 - RNA, 22 nt, Homo sapiens
agacuagagggaaaugaguugg

SEQ ID NO: 322036 - RNA, 20 nt, Homo sapiens
agacuagggagcagaaagcc

SEQ ID NO: 322037 - RNA, 19 nt, Homo sapiens
agacuggcccaggcgggug

SEQ ID NO: 322038 - RNA, 22 nt, Homo sapiens
agacuuagagagucuauucuau

SEQ ID NO: 322039 - RNA, 22 nt, Homo sapiens
agagaacuguuuacacguuaau

SEQ ID NO: 322040 - RNA, 22 nt, Homo sapiens
agagagcuugggguguuaaauu

SEQ ID NO: 322041 - RNA, 22 nt, Homo sapiens
agagaucaacugaauuacugga

SEQ ID NO: 322042 - RNA, 22 nt, Homo sapiens
agagaucauuuuguuucaaauc

SEQ ID NO: 322043 - RNA, 22 nt, Homo sapiens
agagaugauuaacauuuuggua

SEQ ID NO: 322044 - RNA, 22 nt, Homo sapiens
agagauuauccuggcuucucug

SEQ ID NO: 322045 - RNA, 22 nt, Homo sapiens
agagcuaguauuuacggagcau

SEQ ID NO: 322046 - RNA, 22 nt, Homo sapiens
agagguauacauuugagagcca

SEQ ID NO: 322047 - RNA, 22 nt, Homo sapiens
agagguaugccugggcuggagc

SEQ ID NO: 322048 - RNA, 22 nt, Homo sapiens
agagguauuggaaggaguguca

SEQ ID NO: 322049 - RNA, 23 nt, Homo sapiens
agagguuuaaucaggcaguugcu

SEQ ID NO: 322050 - RNA, 22 nt, Homo sapiens
agagguuuaauugauucacagu

SEQ ID NO: 322051 - RNA, 22 nt, Homo sapiens
agagguuuuggggcugagagcu

SEQ ID NO: 322052 - RNA, 22 nt, Homo sapiens
agaguacugacguuugcaaauu

SEQ ID NO: 322053 - RNA, 19 nt, Homo sapiens
agaguauuguuacuucucu

SEQ ID NO: 322054 - RNA, 21 nt, Homo sapiens
agagucaucucuaucuguacc

SEQ ID NO: 322055 - RNA, 22 nt, Homo sapiens
agagugaagcuuuuuauauucu

SEQ ID NO: 322056 - RNA, 20 nt, Homo sapiens
agagugcugucuguccugag

SEQ ID NO: 322057 - RNA, 22 nt, Homo sapiens
agauauguuuaguuucaaaaug

SEQ ID NO: 322058 - RNA, 22 nt, Homo sapiens
agaucacagucuuugguuuuag

SEQ ID NO: 322059 - RNA, 23 nt, Homo sapiens
agaugcaucuggcugcgaggcaa

SEQ ID NO: 322060 - RNA, 22 nt, Homo sapiens
agaugcauuuuuauuggaauac

SEQ ID NO: 322061 - RNA, 22 nt, Homo sapiens
agauggguuuucacauguuggc

SEQ ID NO: 322062 - RNA, 22 nt, Homo sapiens
agaugguauuauagguuucugu

SEQ ID NO: 322063 - RNA, 22 nt, Homo sapiens
agaugguuuuguucacagcucu

SEQ ID NO: 322064 - RNA, 23 nt, Homo sapiens
agcaaaugcucuagcacuccaac

SEQ ID NO: 322065 - RNA, 22 nt, Homo sapiens
agcaagauccagucgcacagga

SEQ ID NO: 322066 - RNA, 22 nt, Homo sapiens
agcacacuggguggcuuaaaca

SEQ ID NO: 322067 - RNA, 22 nt, Homo sapiens
agcacagugguuaaguuucuua

SEQ ID NO: 322068 - RNA, 22 nt, Homo sapiens
agcacaguuaaaugaggcuucu

SEQ ID NO: 322069 - RNA, 22 nt, Homo sapiens
agcaccauuguacuccagccug

SEQ ID NO: 322070 - RNA, 23 nt, Homo sapiens
agcaccuuuccuccacuaucugc

SEQ ID NO: 322071 - RNA, 22 nt, Homo sapiens
agcacgaaaccaaauucuguga

SEQ ID NO: 322072 - RNA, 22 nt, Homo sapiens
agcagagcaguggauuuuguga

SEQ ID NO: 322073 - RNA, 22 nt, Homo sapiens
agcagauguuuagugagcgccu

SEQ ID NO: 322074 - RNA, 22 nt, Homo sapiens
agcagcaccaaacagacuaaga

SEQ ID NO: 322075 - RNA, 22 nt, Homo sapiens
agcagcaugcaaauggacuaau

SEQ ID NO: 322076 - RNA, 22 nt, Homo sapiens
agcagcauuaugauauaucuua

SEQ ID NO: 322077 - RNA, 22 nt, Homo sapiens
agcagcucaagacuuaaauuug

SEQ ID NO: 322078 - RNA, 22 nt, Homo sapiens
agcagcucaugccuuugggagg

SEQ ID NO: 322079 - RNA, 21 nt, Homo sapiens
agcagcuuugguugaagcaga

SEQ ID NO: 322080 - RNA, 22 nt, Homo sapiens
agcagguguccacaauguuugc

SEQ ID NO: 322081 - RNA, 22 nt, Homo sapiens
agcagugucauuuucuggugag

SEQ ID NO: 322082 - RNA, 22 nt, Homo sapiens
agcagugugaaaugauuuaagg

SEQ ID NO: 322083 - RNA, 22 nt, Homo sapiens
agcagugugagaauggacuaau

SEQ ID NO: 322084 - RNA, 22 nt, Homo sapiens
agcaguguggccuuagacccgg

SEQ ID NO: 322085 - RNA, 22 nt, Homo sapiens
agcaucagugauuuuguugaag

SEQ ID NO: 322086 - RNA, 22 nt, Homo sapiens
agcaucauaccaaucugguccu

SEQ ID NO: 322087 - RNA, 19 nt, Homo sapiens
agcaucauuauuguuuugg

SEQ ID NO: 322088 - RNA, 20 nt, Homo sapiens
agcaucauugcaauuuguca

SEQ ID NO: 322089 - RNA, 22 nt, Homo sapiens
agcaugauugggguugggcaca

SEQ ID NO: 322090 - RNA, 22 nt, Homo sapiens
agccaagacucuguuccccuug

SEQ ID NO: 322091 - RNA, 16 nt, Homo sapiens
agccaccauuuacuug

SEQ ID NO: 322092 - RNA, 22 nt, Homo sapiens
agccaguauuuuauugaggauu

SEQ ID NO: 322093 - RNA, 21 nt, Homo sapiens
agccaguguuccuuguggcuc

SEQ ID NO: 322094 - RNA, 22 nt, Homo sapiens
agccauacaacguaugcaugua

SEQ ID NO: 322095 - RNA, 22 nt, Homo sapiens
agcccauuuugcacugagaugc

SEQ ID NO: 322096 - RNA, 20 nt, Homo sapiens
agccccauguaaaccacaug

SEQ ID NO: 322097 - RNA, 22 nt, Homo sapiens
agccccauuuguugaaaagacg

SEQ ID NO: 322098 - RNA, 23 nt, Homo sapiens
agcccugugacucgaacgaggag

SEQ ID NO: 322099 - RNA, 22 nt, Homo sapiens
agccucauucuacauguuaaug

SEQ ID NO: 322100 - RNA, 21 nt, Homo sapiens
agcuaaauuggaaauuucugu

SEQ ID NO: 322101 - RNA, 22 nt, Homo sapiens
agcuaacauuuuuccucuucca

SEQ ID NO: 322102 - RNA, 22 nt, Homo sapiens
agcuacguuggggaaguucuca

SEQ ID NO: 322103 - RNA, 23 nt, Homo sapiens
agcuagagaggcuggggauacag

SEQ ID NO: 322104 - RNA, 22 nt, Homo sapiens
agcuauauugaggaugccauuc

SEQ ID NO: 322105 - RNA, 22 nt, Homo sapiens
agcuccauuguaaucaccuggu

SEQ ID NO: 322106 - RNA, 22 nt, Homo sapiens
agcuccuuucugcaggcagguc

SEQ ID NO: 322107 - RNA, 22 nt, Homo sapiens
agcuccuuugcuuuuuccagga

SEQ ID NO: 322108 - RNA, 22 nt, Homo sapiens
agcugauuuuaaguccuugucc

SEQ ID NO: 322109 - RNA, 22 nt, Homo sapiens
agcugcaauguuuaguauaaua

SEQ ID NO: 322110 - RNA, 20 nt, Homo sapiens
agcuggguguguuggugcau

SEQ ID NO: 322111 - RNA, 22 nt, Homo sapiens
agcugguaguuuucuaguguuu

SEQ ID NO: 322112 - RNA, 22 nt, Homo sapiens
agcuggucuuggggaagaguag

SEQ ID NO: 322113 - RNA, 21 nt, Homo sapiens
agcugguuuccacagugugcu

SEQ ID NO: 322114 - RNA, 20 nt, Homo sapiens
agcugguuuuaugaaucuuu

SEQ ID NO: 322115 - RNA, 22 nt, Homo sapiens
agcuguguugucugaagucaga

SEQ ID NO: 322116 - RNA, 22 nt, Homo sapiens
acacucucucauuacuuguuug

SEQ ID NO: 322117 - RNA, 22 nt, Homo sapiens
acacugcugaguaaauaauuuu

SEQ ID NO: 322118 - RNA, 20 nt, Homo sapiens
acacuggcuuugagauuuag

SEQ ID NO: 322119 - RNA, 22 nt, Homo sapiens
acacuggguaacauaucuguua

SEQ ID NO: 322120 - RNA, 22 nt, Homo sapiens
acacuguccaguuaggcuacau

SEQ ID NO: 322121 - RNA, 20 nt, Homo sapiens
acacugugcuaaggauuuuc

SEQ ID NO: 322122 - RNA, 22 nt, Homo sapiens
acagcacugccaagugacccau

SEQ ID NO: 322123 - RNA, 20 nt, Homo sapiens
acagcacugguuucaagcaa

SEQ ID NO: 322124 - RNA, 22 nt, Homo sapiens
acaggagugggauuugaguccu

SEQ ID NO: 322125 - RNA, 22 nt, Homo sapiens
acagguacacagaauauccaga

SEQ ID NO: 322126 - RNA, 22 nt, Homo sapiens
acaggugaaguauuacacuaag

SEQ ID NO: 322127 - RNA, 19 nt, Homo sapiens
acaguaccuggcaugaggu

SEQ ID NO: 322128 - RNA, 21 nt, Homo sapiens
acaguacuugagaucuuuuga

SEQ ID NO: 322129 - RNA, 20 nt, Homo sapiens
acaguagaagggauuucaaa

SEQ ID NO: 322130 - RNA, 20 nt, Homo sapiens
acaguauguuuggaugcaua

SEQ ID NO: 322131 - RNA, 22 nt, Homo sapiens
acagucauagcagccuuuguua

SEQ ID NO: 322132 - RNA, 23 nt, Homo sapiens
acagucuaguuugaagucaggua

SEQ ID NO: 322133 - RNA, 22 nt, Homo sapiens
acagugcuucugauaugaugcc

SEQ ID NO: 322134 - RNA, 22 nt, Homo sapiens
acagugcuuucaauguucagua

SEQ ID NO: 322135 - RNA, 17 nt, Homo sapiens
acagugcuuugcuuucc

SEQ ID NO: 322136 - RNA, 22 nt, Homo sapiens
acagugcuuuuguuccucuccu

SEQ ID NO: 322137 - RNA, 22 nt, Homo sapiens
acagugucaugucguguucccc

SEQ ID NO: 322138 - RNA, 22 nt, Homo sapiens
acagugucugacacguaggaag

SEQ ID NO: 322139 - RNA, 18 nt, Homo sapiens
acagugucuuacaccugu

SEQ ID NO: 322140 - RNA, 22 nt, Homo sapiens
acaucaggcuugugaugauuac

SEQ ID NO: 322141 - RNA, 22 nt, Homo sapiens
acaucauugggggcuacaggug

SEQ ID NO: 322142 - RNA, 22 nt, Homo sapiens
acauccauuugcuuuauuugcu

SEQ ID NO: 322143 - RNA, 22 nt, Homo sapiens
acaucccuugcucggggccccu

SEQ ID NO: 322144 - RNA, 22 nt, Homo sapiens
acaugcauauguuggaagaaag

SEQ ID NO: 322145 - RNA, 19 nt, Homo sapiens
acauggauuuugugcaaac

SEQ ID NO: 322146 - RNA, 22 nt, Homo sapiens
acauugcucuuaccaaguuugu

SEQ ID NO: 322147 - RNA, 22 nt, Homo sapiens
accaccauugcacugaacuuuc

SEQ ID NO: 322148 - RNA, 22 nt, Homo sapiens
acccacuagaugccaguggcac

SEQ ID NO: 322149 - RNA, 22 nt, Homo sapiens
acccagaauucagucuuaggcc

SEQ ID NO: 322150 - RNA, 22 nt, Homo sapiens
acccaguaacauaugggaggga

SEQ ID NO: 322151 - RNA, 22 nt, Homo sapiens
acccaguagucauucaggagca

SEQ ID NO: 322152 - RNA, 22 nt, Homo sapiens
accccauuugcacugagcccuu

SEQ ID NO: 322153 - RNA, 22 nt, Homo sapiens
acccucaagggacugacagaau

SEQ ID NO: 322154 - RNA, 22 nt, Homo sapiens
acccuggauucguggccuugaa

SEQ ID NO: 322155 - RNA, 22 nt, Homo sapiens
acccugugagagaguuaauauu

SEQ ID NO: 322156 - RNA, 22 nt, Homo sapiens
acccuuagguuaaaguugaguc

SEQ ID NO: 322157 - RNA, 22 nt, Homo sapiens
accugagacuaggcauuuuaua

SEQ ID NO: 322158 - RNA, 23 nt, Homo sapiens
accugauguuucuguggggagcc

SEQ ID NO: 322159 - RNA, 22 nt, Homo sapiens
accuggacacuuugggcuccuc

SEQ ID NO: 322160 - RNA, 22 nt, Homo sapiens
accuggcacuuagcaaaucuga

SEQ ID NO: 322161 - RNA, 22 nt, Homo sapiens
accuggguguauguucaguuug

SEQ ID NO: 322162 - RNA, 19 nt, Homo sapiens
accuguagaaaguacaaca

SEQ ID NO: 322163 - RNA, 22 nt, Homo sapiens
accugugguuacagucugucuc

SEQ ID NO: 322164 - RNA, 23 nt, Homo sapiens
accuucauucauucagcugaagu

SEQ ID NO: 322165 - RNA, 22 nt, Homo sapiens
accuuuacaacuuguuagagua

SEQ ID NO: 322166 - RNA, 22 nt, Homo sapiens
acgcagcacauucacagcuaug

SEQ ID NO: 322167 - RNA, 22 nt, Homo sapiens
acuauacugaagcaaauuaaca

SEQ ID NO: 322168 - RNA, 22 nt, Homo sapiens
acuccauuuggacucugggagg

SEQ ID NO: 322169 - RNA, 23 nt, Homo sapiens
acugagcaauguuuacauacuug

SEQ ID NO: 322170 - RNA, 22 nt, Homo sapiens
acugcacuccacccuuggcagc

SEQ ID NO: 322171 - RNA, 22 nt, Homo sapiens
acugcacuccagcccaggugac

SEQ ID NO: 322172 - RNA, 22 nt, Homo sapiens
acugcacuccagccuccugaca

SEQ ID NO: 322173 - RNA, 22 nt, Homo sapiens
acugcacuccagccuggacgaa

SEQ ID NO: 322174 - RNA, 22 nt, Homo sapiens
acugcacuccagccugugcgua

SEQ ID NO: 322175 - RNA, 22 nt, Homo sapiens
acugcacuccagccuuagugac

SEQ ID NO: 322176 - RNA, 22 nt, Homo sapiens
acugcacuccagccuugagagc

SEQ ID NO: 322177 - RNA, 22 nt, Homo sapiens
acugcacuccagccuuggcggc

SEQ ID NO: 322178 - RNA, 22 nt, Homo sapiens
acugcacuccagccuuugcgau

SEQ ID NO: 322179 - RNA, 22 nt, Homo sapiens
acugcacuccagcuugggugac

SEQ ID NO: 322180 - RNA, 20 nt, Homo sapiens
acugcacuccaggcugccca

SEQ ID NO: 322181 - RNA, 19 nt, Homo sapiens
acugcacuccuccuugggu

SEQ ID NO: 322182 - RNA, 20 nt, Homo sapiens
acugcacuucagccugcugg

SEQ ID NO: 322183 - RNA, 22 nt, Homo sapiens
acugcauaaauauguguaauau

SEQ ID NO: 322184 - RNA, 21 nt, Homo sapiens
acuggaccccuuccauacacc

SEQ ID NO: 322185 - RNA, 18 nt, Homo sapiens
acuggauguaaagggucc

SEQ ID NO: 322186 - RNA, 22 nt, Homo sapiens
acuggauguuagggauuuuauu

SEQ ID NO: 322187 - RNA, 20 nt, Homo sapiens
acuggcacugguaggugugg

SEQ ID NO: 322188 - RNA, 22 nt, Homo sapiens
acuggcucugcuuuacaaacag

SEQ ID NO: 322189 - RNA, 22 nt, Homo sapiens
acugggucaaaguagaaaacua

SEQ ID NO: 322190 - RNA, 22 nt, Homo sapiens
acugguguaugggaggucccaa

SEQ ID NO: 322191 - RNA, 22 nt, Homo sapiens
acuguacuacagccugggugac

SEQ ID NO: 322192 - RNA, 22 nt, Homo sapiens
acuguacuccagccugggugac

SEQ ID NO: 322193 - RNA, 22 nt, Homo sapiens
acuucauucucuggaucagaau

SEQ ID NO: 322194 - RNA, 22 nt, Homo sapiens
acuugacacuuauauuacucac

SEQ ID NO: 322195 - RNA, 22 nt, Homo sapiens
acuuggcaaaguuuuaaacagc

SEQ ID NO: 322196 - RNA, 22 nt, Homo sapiens
acuuugcuuagagggcauuaaa

SEQ ID NO: 322197 - RNA, 19 nt, Homo sapiens
acuuuggugauuagaggga

SEQ ID NO: 322198 - RNA, 22 nt, Homo sapiens
acuuugguuuauagaauuuagg

SEQ ID NO: 322199 - RNA, 21 nt, Homo sapiens
acuuuguugggggcugaggca

SEQ ID NO: 322200 - RNA, 22 nt, Homo sapiens
acuuuuguuauacagugugaua

SEQ ID NO: 322201 - RNA, 21 nt, Homo sapiens
agaaaaucuuaugggaaacau

SEQ ID NO: 322202 - RNA, 22 nt, Homo sapiens
agaaacacagguggaauugcuu

SEQ ID NO: 322203 - RNA, 22 nt, Homo sapiens
agaaagugcuucccuuugguga

SEQ ID NO: 322204 - RNA, 22 nt, Homo sapiens
agaaccauuagagggagauauu

SEQ ID NO: 322205 - RNA, 22 nt, Homo sapiens
caugggcacugacuugcauucg

SEQ ID NO: 322206 - RNA, 22 nt, Homo sapiens
caugguacugccacagaagagu

SEQ ID NO: 322207 - RNA, 22 nt, Homo sapiens
caugucacuuccucucugaugg

SEQ ID NO: 322208 - RNA, 22 nt, Homo sapiens
caugucuuuuaaacauucaacu

SEQ ID NO: 322209 - RNA, 19 nt, Homo sapiens
caugugcacuacuggcuuc

SEQ ID NO: 322210 - RNA, 20 nt, Homo sapiens
cauuacacuccaaccugggu

SEQ ID NO: 322211 - RNA, 22 nt, Homo sapiens
cauuacacuuguaagguuuuuc

SEQ ID NO: 322212 - RNA, 22 nt, Homo sapiens
cauuccacuggauaaacaaggu

SEQ ID NO: 322213 - RNA, 20 nt, Homo sapiens
cauuccacuuuccugucagu

SEQ ID NO: 322214 - RNA, 22 nt, Homo sapiens
cauugcaacuucugccucccag

SEQ ID NO: 322215 - RNA, 19 nt, Homo sapiens
cauugcacuccacccuggg

SEQ ID NO: 322216 - RNA, 22 nt, Homo sapiens
cauugcacuccagccuaggcaa

SEQ ID NO: 322217 - RNA, 22 nt, Homo sapiens
cauugcacuccagccugcugac

SEQ ID NO: 322218 - RNA, 22 nt, Homo sapiens
cauugcacuccagccuggcaac

SEQ ID NO: 322219 - RNA, 22 nt, Homo sapiens
cauugcacuccagccuuggcaa

SEQ ID NO: 322220 - RNA, 22 nt, Homo sapiens
cauugcacuccagccuugguga

SEQ ID NO: 322221 - RNA, 22 nt, Homo sapiens
cauugcacugcagcccgggcaa

SEQ ID NO: 322222 - RNA, 22 nt, Homo sapiens
cauugcaguaagagugggcucu

SEQ ID NO: 322223 - RNA, 22 nt, Homo sapiens
cauugcaugcauauggcuuggu

SEQ ID NO: 322224 - RNA, 22 nt, Homo sapiens
cauugcaugccagccugggcaa

SEQ ID NO: 322225 - RNA, 22 nt, Homo sapiens
ccaaggcacugauucuguacuc

SEQ ID NO: 322226 - RNA, 22 nt, Homo sapiens
ccaaguguuuucauuguuccau

SEQ ID NO: 322227 - RNA, 22 nt, Homo sapiens
ccacugcacuccagcccggcaa

SEQ ID NO: 322228 - RNA, 22 nt, Homo sapiens
ccacugggcaguuuauuaucag

SEQ ID NO: 322229 - RNA, 22 nt, Homo sapiens
ccagaguugccucagguuucug

SEQ ID NO: 322230 - RNA, 22 nt, Homo sapiens
ccagauguuuucauucagcaag

SEQ ID NO: 322231 - RNA, 22 nt, Homo sapiens
ccagcaccauuuguugaauagg

SEQ ID NO: 322232 - RNA, 22 nt, Homo sapiens
ccagguuucuagaauaauuccu

SEQ ID NO: 322233 - RNA, 22 nt, Homo sapiens
ccagugauuguauggugaaggu

SEQ ID NO: 322234 - RNA, 22 nt, Homo sapiens
ccagugguugggccggagacgg

SEQ ID NO: 322235 - RNA, 22 nt, Homo sapiens
ccagugucugacagacacggcg

SEQ ID NO: 322236 - RNA, 22 nt, Homo sapiens
ccaguguucuggaaggcugagu

SEQ ID NO: 322237 - RNA, 22 nt, Homo sapiens
ccaguuuucccagcaccauuaa

SEQ ID NO: 322238 - RNA, 22 nt, Homo sapiens
ccaguuuuucauuuauacuagu

SEQ ID NO: 322239 - RNA, 21 nt, Homo sapiens
ccauggcaaugguaaacugac

SEQ ID NO: 322240 - RNA, 21 nt, Homo sapiens
ccaugggacggaaugaauaca

SEQ ID NO: 322241 - RNA, 18 nt, Homo sapiens
ccauucaacagauuuguc

SEQ ID NO: 322242 - RNA, 22 nt, Homo sapiens
ccauugaacaugaaggaaugug

SEQ ID NO: 322243 - RNA, 22 nt, Homo sapiens
ccauugcacuccauccugggca

SEQ ID NO: 322244 - RNA, 22 nt, Homo sapiens
cccaguaaucuugccaguuuuc

SEQ ID NO: 322245 - RNA, 22 nt, Homo sapiens
cccaguagagauugccgaauug

SEQ ID NO: 322246 - RNA, 22 nt, Homo sapiens
cccagugugaacuuggcauuuu

SEQ ID NO: 322247 - RNA, 22 nt, Homo sapiens
cccagugugcugggugacagcu

SEQ ID NO: 322248 - RNA, 22 nt, Homo sapiens
cccauuguuaaguugaguaucu

SEQ ID NO: 322249 - RNA, 22 nt, Homo sapiens
ccccggguucugucugcccuug

SEQ ID NO: 322250 - RNA, 22 nt, Homo sapiens
ccccuguaaacuggcuucccug

SEQ ID NO: 322251 - RNA, 23 nt, Homo sapiens
cccucagaagugcagggagagaa

SEQ ID NO: 322252 - RNA, 22 nt, Homo sapiens
cccugaagaaagccuaggacau

SEQ ID NO: 322253 - RNA, 22 nt, Homo sapiens
cccugagagcagggucuuucuc

SEQ ID NO: 322254 - RNA, 19 nt, Homo sapiens
cccuggcacauggaaaaug

SEQ ID NO: 322255 - RNA, 21 nt, Homo sapiens
cccugguguuuggaguuugag

SEQ ID NO: 322256 - RNA, 22 nt, Homo sapiens
cccuucauucaaggguugugag

SEQ ID NO: 322257 - RNA, 22 nt, Homo sapiens
ccucacaaccuuuauugaagag

SEQ ID NO: 322258 - RNA, 22 nt, Homo sapiens
ccucauggagaacaucugcuag

SEQ ID NO: 322259 - RNA, 22 nt, Homo sapiens
ccucauggagaaccucugcuag

SEQ ID NO: 322260 - RNA, 22 nt, Homo sapiens
ccucauggagaacuucugcuag

SEQ ID NO: 322261 - RNA, 22 nt, Homo sapiens
ccucauugcuaucccaggcuga

SEQ ID NO: 322262 - RNA, 22 nt, Homo sapiens
ccucccuuuguugcaagggaaa

SEQ ID NO: 322263 - RNA, 21 nt, Homo sapiens
ccucuuugagggaagaaaggg

SEQ ID NO: 322264 - RNA, 22 nt, Homo sapiens
ccugagacgaauggagugaaca

SEQ ID NO: 322265 - RNA, 22 nt, Homo sapiens
ccugagguagaguuuauauuga

SEQ ID NO: 322266 - RNA, 22 nt, Homo sapiens
ccuggaagaaaggugcuaaaua

SEQ ID NO: 322267 - RNA, 22 nt, Homo sapiens
ccuggcaagagacugaagauag

SEQ ID NO: 322268 - RNA, 22 nt, Homo sapiens
ccuggguuacaggugugagcca

SEQ ID NO: 322269 - RNA, 22 nt, Homo sapiens
ccuguagcauccaagaagcugc

SEQ ID NO: 322270 - RNA, 22 nt, Homo sapiens
ccuugcacuucccaggugaggc

SEQ ID NO: 322271 - RNA, 22 nt, Homo sapiens
ccuuggcacuuugccacagugc

SEQ ID NO: 322272 - RNA, 22 nt, Homo sapiens
ccuugguugugcuucaacuucu

SEQ ID NO: 322273 - RNA, 22 nt, Homo sapiens
cgaggaguaucuuugugguguu

SEQ ID NO: 322274 - RNA, 22 nt, Homo sapiens
cgccugagcugaggaagcugca

SEQ ID NO: 322275 - RNA, 22 nt, Homo sapiens
cgcuggugaucuagacccccaa

SEQ ID NO: 322276 - RNA, 22 nt, Homo sapiens
cggcaguggguaagccaagcuu

SEQ ID NO: 322277 - RNA, 22 nt, Homo sapiens
cggugcaaauguaauugcaguu

SEQ ID NO: 322278 - RNA, 16 nt, Homo sapiens
cuaaaaugucuacuug

SEQ ID NO: 322279 - RNA, 22 nt, Homo sapiens
cuaaaguagccaggacugcagg

SEQ ID NO: 322280 - RNA, 22 nt, Homo sapiens
cuaaaguucuucugagagaaca

SEQ ID NO: 322281 - RNA, 22 nt, Homo sapiens
cuaaaugucucuacuaaguuua

SEQ ID NO: 322282 - RNA, 22 nt, Homo sapiens
cuaacacagagguuuauuucuc

SEQ ID NO: 322283 - RNA, 22 nt, Homo sapiens
cuaagguacuguuaacauugua

SEQ ID NO: 322284 - RNA, 18 nt, Homo sapiens
cuaauacuauucaacaag

SEQ ID NO: 322285 - RNA, 20 nt, Homo sapiens
cuaaucaucccagaagaaau

SEQ ID NO: 322286 - RNA, 22 nt, Homo sapiens
cuacaguguauuuauggagggu

SEQ ID NO: 322287 - RNA, 21 nt, Homo sapiens
cuacccuguauuagagaaaga

SEQ ID NO: 322288 - RNA, 23 nt, Homo sapiens
cuacuagucaagucuuuuccagu

SEQ ID NO: 322289 - RNA, 22 nt, Homo sapiens
cuacucuggagagugacaauca

SEQ ID NO: 322290 - RNA, 22 nt, Homo sapiens
cuagaagguaagagcuggaugc

SEQ ID NO: 322291 - RNA, 22 nt, Homo sapiens
cuagcacauaguuauucacuca

SEQ ID NO: 322292 - RNA, 22 nt, Homo sapiens
cuagcagaacaauacaauucgg

SEQ ID NO: 322293 - RNA, 22 nt, Homo sapiens
cuagcuuuugauguaaagugag

SEQ ID NO: 322294 - RNA, 22 nt, Homo sapiens
cuaggugauccacugcucucuu

SEQ ID NO: 322295 - RNA, 22 nt, Homo sapiens
cuagucacaggaguugaaggau

SEQ ID NO: 322296 - RNA, 22 nt, Homo sapiens
cuauacuguacacugaaugagg

SEQ ID NO: 322297 - RNA, 22 nt, Homo sapiens
aaucagcacacugugcuuucca

SEQ ID NO: 322298 - RNA, 20 nt, Homo sapiens
aaucuacuugcccauuuagc

SEQ ID NO: 322299 - RNA, 22 nt, Homo sapiens
aaucugggguuguuuggggagu

SEQ ID NO: 322300 - RNA, 22 nt, Homo sapiens
aaugacacugagcaucuuucau

SEQ ID NO: 322301 - RNA, 22 nt, Homo sapiens
aaugacucugccuaaauuucac

SEQ ID NO: 322302 - RNA, 22 nt, Homo sapiens
aaugcaagauguuaauuauagg

SEQ ID NO: 322303 - RNA, 22 nt, Homo sapiens
aaugcauaauuuguaugaggua

SEQ ID NO: 322304 - RNA, 22 nt, Homo sapiens
aaugcuaucuggaacauuguug

SEQ ID NO: 322305 - RNA, 22 nt, Homo sapiens
aauggcacacaccuggucuaac

SEQ ID NO: 322306 - RNA, 22 nt, Homo sapiens
aauggcaguagauggaugggua

SEQ ID NO: 322307 - RNA, 18 nt, Homo sapiens
aauggcucuggguucuaa

SEQ ID NO: 322308 - RNA, 22 nt, Homo sapiens
aauggcucuuccuggaguugug

SEQ ID NO: 322309 - RNA, 22 nt, Homo sapiens
aaugucaugaguccaaccagaa

SEQ ID NO: 322310 - RNA, 22 nt, Homo sapiens
aaugugcacuuggagccuugcu

SEQ ID NO: 322311 - RNA, 22 nt, Homo sapiens
aaugugcuguucagaggagucc

SEQ ID NO: 322312 - RNA, 22 nt, Homo sapiens
aauuacauggcaauugggaaau

SEQ ID NO: 322313 - RNA, 22 nt, Homo sapiens
aauuacucgugucuuuacugcu

SEQ ID NO: 322314 - RNA, 23 nt, Homo sapiens
aauugcacauuccuugcuggcag

SEQ ID NO: 322315 - RNA, 22 nt, Homo sapiens
aauugcacuggaaguaacugag

SEQ ID NO: 322316 - RNA, 22 nt, Homo sapiens
aauugcucuccuccaaggucuu

SEQ ID NO: 322317 - RNA, 22 nt, Homo sapiens
acacaguauaugacaaugcuuu

SEQ ID NO: 322318 - RNA, 22 nt, Homo sapiens
acacaugcuccacuguggccuc

SEQ ID NO: 322319 - RNA, 22 nt, Homo sapiens
acacauuagcaagugcuguuau

SEQ ID NO: 322320 - RNA, 22 nt, Homo sapiens
acaccaucuccuuauuucucuu

SEQ ID NO: 322321 - RNA, 22 nt, Homo sapiens
acacuggaggagagcuguugcu

SEQ ID NO: 322322 - RNA, 20 nt, Homo sapiens
acacuggaguaucaaggccc

SEQ ID NO: 322323 - RNA, 22 nt, Homo sapiens
acacuggaguuaaaggugauuu

SEQ ID NO: 322324 - RNA, 22 nt, Homo sapiens
acacuguaacucuuugagggca

SEQ ID NO: 322325 - RNA, 22 nt, Homo sapiens
acacuguauccuucuguccuuu

SEQ ID NO: 322326 - RNA, 22 nt, Homo sapiens
acacugucaugucucacaggca

SEQ ID NO: 322327 - RNA, 22 nt, Homo sapiens
acacuguugacauuuuguagug

SEQ ID NO: 322328 - RNA, 22 nt, Homo sapiens
acacuguuggugggaguguaaa

SEQ ID NO: 322329 - RNA, 22 nt, Homo sapiens
acagcagugccccacucuacug

SEQ ID NO: 322330 - RNA, 22 nt, Homo sapiens
acagccauuccagccaaauacu

SEQ ID NO: 322331 - RNA, 22 nt, Homo sapiens
acaggguuauuguaauaaugua

SEQ ID NO: 322332 - RNA, 22 nt, Homo sapiens
acaguacuuuuggauuugugaa

SEQ ID NO: 322333 - RNA, 22 nt, Homo sapiens
acagucuggagaaugggugcuc

SEQ ID NO: 322334 - RNA, 22 nt, Homo sapiens
acagugcugucugcuuuggcua

SEQ ID NO: 322335 - RNA, 22 nt, Homo sapiens
acagugcuguggucaugggucu

SEQ ID NO: 322336 - RNA, 22 nt, Homo sapiens
acagugcuguuguguuuucacg

SEQ ID NO: 322337 - RNA, 22 nt, Homo sapiens
acagugcuuggcacacaguaau

SEQ ID NO: 322338 - RNA, 23 nt, Homo sapiens
acaguggugugaucuuggcucag

SEQ ID NO: 322339 - RNA, 19 nt, Homo sapiens
acagugucucuauaaugau

SEQ ID NO: 322340 - RNA, 22 nt, Homo sapiens
acauaguagacacugaaaauau

SEQ ID NO: 322341 - RNA, 22 nt, Homo sapiens
acaucccaugccuggguacucc

SEQ ID NO: 322342 - RNA, 22 nt, Homo sapiens
acaugcaucauuaggugguuua

SEQ ID NO: 322343 - RNA, 22 nt, Homo sapiens
acauggcacugcgggcuucuug

SEQ ID NO: 322344 - RNA, 22 nt, Homo sapiens
acauucagcuguuguuucaaug

SEQ ID NO: 322345 - RNA, 18 nt, Homo sapiens
acauucagcuugaagaua

SEQ ID NO: 322346 - RNA, 22 nt, Homo sapiens
accacaggguaaaguuagauau

SEQ ID NO: 322347 - RNA, 22 nt, Homo sapiens
accacagugcuuccugcucacg

SEQ ID NO: 322348 - RNA, 22 nt, Homo sapiens
accacuguuucaagaagcuugu

SEQ ID NO: 322349 - RNA, 22 nt, Homo sapiens
accaguagaaucaguggauucu

SEQ ID NO: 322350 - RNA, 22 nt, Homo sapiens
accaguuuuuuauacaucuucu

SEQ ID NO: 322351 - RNA, 22 nt, Homo sapiens
acccaguguucaacauucacau

SEQ ID NO: 322352 - RNA, 21 nt, Homo sapiens
acccccacaccuccuuaguuc

SEQ ID NO: 322353 - RNA, 22 nt, Homo sapiens
acccggagagcaggcgagaagg

SEQ ID NO: 322354 - RNA, 22 nt, Homo sapiens
acccgggaggcaggagucauag

SEQ ID NO: 322355 - RNA, 22 nt, Homo sapiens
acccguuacuuagcagaccagg

SEQ ID NO: 322356 - RNA, 22 nt, Homo sapiens
acccucagaccaguuucccugg

SEQ ID NO: 322357 - RNA, 22 nt, Homo sapiens
acccuggaggucuacagugcag

SEQ ID NO: 322358 - RNA, 22 nt, Homo sapiens
acccuggaguaguaggaaucug

SEQ ID NO: 322359 - RNA, 22 nt, Homo sapiens
acccugucagcuggccugggca

SEQ ID NO: 322360 - RNA, 22 nt, Homo sapiens
acccugucauccacauggugcu

SEQ ID NO: 322361 - RNA, 22 nt, Homo sapiens
acccugugaauauuuaaacuuc

SEQ ID NO: 322362 - RNA, 22 nt, Homo sapiens
accucagcccggggaaguugag

SEQ ID NO: 322363 - RNA, 22 nt, Homo sapiens
accuguagcagacuuaauauuu

SEQ ID NO: 322364 - RNA, 23 nt, Homo sapiens
accugugguuauuuuacucuucc

SEQ ID NO: 322365 - RNA, 22 nt, Homo sapiens
accuucauuguugccaugucca

SEQ ID NO: 322366 - RNA, 22 nt, Homo sapiens
acguaguagguuuauaauauua

SEQ ID NO: 322367 - RNA, 22 nt, Homo sapiens
acgugcaugcacacacaugcgc

SEQ ID NO: 322368 - RNA, 22 nt, Homo sapiens
acuacauaugacaucuucuuua

SEQ ID NO: 322369 - RNA, 22 nt, Homo sapiens
acuagagaugcauuuguaguuu

SEQ ID NO: 322370 - RNA, 22 nt, Homo sapiens
acuaugcuuuucuuagaauuaa

SEQ ID NO: 322371 - RNA, 22 nt, Homo sapiens
acucagagagaacugucauuug

SEQ ID NO: 322372 - RNA, 22 nt, Homo sapiens
acucagagauuagcacauguuu

SEQ ID NO: 322373 - RNA, 22 nt, Homo sapiens
acucagagugggccccuagaua

SEQ ID NO: 322374 - RNA, 22 nt, Homo sapiens
acucugucuaguuguaaaauuu

SEQ ID NO: 322375 - RNA, 22 nt, Homo sapiens
acugagacugagaauguuucuu

SEQ ID NO: 322376 - RNA, 19 nt, Homo sapiens
acugagcuaccugggggca

SEQ ID NO: 322377 - RNA, 22 nt, Homo sapiens
acugaguguugauuuagauuaa

SEQ ID NO: 322378 - RNA, 21 nt, Homo sapiens
acugcacuccaaccucaacag

SEQ ID NO: 322379 - RNA, 22 nt, Homo sapiens
acugcacuccaaccuguugggc

SEQ ID NO: 322380 - RNA, 22 nt, Homo sapiens
acugcacuccaaccuuggugac

SEQ ID NO: 322381 - RNA, 18 nt, Homo sapiens
acugcacuccaccuuggg

SEQ ID NO: 322382 - RNA, 22 nt, Homo sapiens
acugcacuccagacucugucuc

SEQ ID NO: 322383 - RNA, 22 nt, Homo sapiens
acugcacuccagccucaugaca

SEQ ID NO: 322384 - RNA, 22 nt, Homo sapiens
acugcacuccagccucggcaau

SEQ ID NO: 322385 - RNA, 22 nt, Homo sapiens
acugcacuccagccucggggac

SEQ ID NO: 322386 - RNA, 22 nt, Homo sapiens
acugcacuccagccucggugac

SEQ ID NO: 322387 - RNA, 22 nt, Homo sapiens
acugcacuccagcuuuggguga

SEQ ID NO: 322388 - RNA, 22 nt, Homo sapiens
acugcacucccgcccgggugac

SEQ ID NO: 322389 - RNA, 22 nt, Homo sapiens
cuauaugucuguuuugguacca

SEQ ID NO: 322390 - RNA, 21 nt, Homo sapiens
cuaucucaguguuuacauuug

SEQ ID NO: 322391 - RNA, 22 nt, Homo sapiens
cuaugcuucuuaaauuaguuau

SEQ ID NO: 322392 - RNA, 22 nt, Homo sapiens
cuauggcagccacggccuggag

SEQ ID NO: 322393 - RNA, 22 nt, Homo sapiens
cuauggcuguaaggauaguaac

SEQ ID NO: 322394 - RNA, 22 nt, Homo sapiens
cuaugguuucucaaacuccuga

SEQ ID NO: 322395 - RNA, 22 nt, Homo sapiens
cuauuacuuuuauugaacucag

SEQ ID NO: 322396 - RNA, 22 nt, Homo sapiens
cuauucacaauggugaagauau

SEQ ID NO: 322397 - RNA, 19 nt, Homo sapiens
cuauugcacauagcugaag

SEQ ID NO: 322398 - RNA, 21 nt, Homo sapiens
cucaaaguacugauauuacag

SEQ ID NO: 322399 - RNA, 22 nt, Homo sapiens
cucaaaguacuuugguuauugu

SEQ ID NO: 322400 - RNA, 22 nt, Homo sapiens
cucaaguaauccucccgccuug

SEQ ID NO: 322401 - RNA, 22 nt, Homo sapiens
cucacagucagaagggacuugc

SEQ ID NO: 322402 - RNA, 22 nt, Homo sapiens
cucaccuugugauccuccugcc

SEQ ID NO: 322403 - RNA, 22 nt, Homo sapiens
cucacuaguaaggcuguuuagu

SEQ ID NO: 322404 - RNA, 22 nt, Homo sapiens
cucacugcauuucaguuuuguu

SEQ ID NO: 322405 - RNA, 22 nt, Homo sapiens
cucacugggaccacucugaagu

SEQ ID NO: 322406 - RNA, 22 nt, Homo sapiens
cucagagcacaguuuaugacag

SEQ ID NO: 322407 - RNA, 20 nt, Homo sapiens
cucagauuauucugaagcaa

SEQ ID NO: 322408 - RNA, 22 nt, Homo sapiens
cucagugguugauuuauuuauc

SEQ ID NO: 322409 - RNA, 22 nt, Homo sapiens
cucaguuuugccuuguuuaagg

SEQ ID NO: 322410 - RNA, 22 nt, Homo sapiens
cucauuaguuguuuuaagauga

SEQ ID NO: 322411 - RNA, 22 nt, Homo sapiens
cucauuggcuacugaggcuugu

SEQ ID NO: 322412 - RNA, 22 nt, Homo sapiens
cuccaguacagagagguuccuc

SEQ ID NO: 322413 - RNA, 22 nt, Homo sapiens
cuccauguggcuaacuuuuaaa

SEQ ID NO: 322414 - RNA, 22 nt, Homo sapiens
cuccauuuaguccuuuuagaag

SEQ ID NO: 322415 - RNA, 22 nt, Homo sapiens
cucccagugacccaggaacagg

SEQ ID NO: 322416 - RNA, 22 nt, Homo sapiens
cuccccuuuaguuucuuaauaa

SEQ ID NO: 322417 - RNA, 22 nt, Homo sapiens
cucccugagccagggcuuugac

SEQ ID NO: 322418 - RNA, 22 nt, Homo sapiens
cuccuguagccccaucaucuuu

SEQ ID NO: 322419 - RNA, 22 nt, Homo sapiens
cuccuugauuagaguauagagu

SEQ ID NO: 322420 - RNA, 22 nt, Homo sapiens
cucucaagaugcugggauuaca

SEQ ID NO: 322421 - RNA, 22 nt, Homo sapiens
cucucaguguggaggccagaaa

SEQ ID NO: 322422 - RNA, 22 nt, Homo sapiens
cucucugagccauggcugcccu

SEQ ID NO: 322423 - RNA, 22 nt, Homo sapiens
cucugguuucgcaggaaauaga

SEQ ID NO: 322424 - RNA, 22 nt, Homo sapiens
cucuuugaugugaaccgugguu

SEQ ID NO: 322425 - RNA, 22 nt, Homo sapiens
cucuuugcuucuggcaucauug

SEQ ID NO: 322426 - RNA, 22 nt, Homo sapiens
cucuuuuguuccuaguuugauc

SEQ ID NO: 322427 - RNA, 22 nt, Homo sapiens
cucuuuuguuuagcugagaggg

SEQ ID NO: 322428 - RNA, 22 nt, Homo sapiens
cugaaaugaauuauuuucuuuc

SEQ ID NO: 322429 - RNA, 22 nt, Homo sapiens
cugaaggcagguagaauagaga

SEQ ID NO: 322430 - RNA, 20 nt, Homo sapiens
cugaaugucaaggcagaggu

SEQ ID NO: 322431 - RNA, 22 nt, Homo sapiens
cugaauguuucacucugaaaug

SEQ ID NO: 322432 - RNA, 22 nt, Homo sapiens
cugacagucucauugauuugcu

SEQ ID NO: 322433 - RNA, 22 nt, Homo sapiens
cugaccauagacuacucugggc

SEQ ID NO: 322434 - RNA, 22 nt, Homo sapiens
cugaccucugucaaagacaccc

SEQ ID NO: 322435 - RNA, 22 nt, Homo sapiens
cugacugugcaugcccagcccc

SEQ ID NO: 322436 - RNA, 22 nt, Homo sapiens
cugacuuuagaacccaaaaagu

SEQ ID NO: 322437 - RNA, 22 nt, Homo sapiens
cugagacacucuuaucugcaua

SEQ ID NO: 322438 - RNA, 22 nt, Homo sapiens
cugagagaugagaccucucacu

SEQ ID NO: 322439 - RNA, 22 nt, Homo sapiens
cugagaguugaugaaauauggu

SEQ ID NO: 322440 - RNA, 22 nt, Homo sapiens
cugagauacacuaauagucucu

SEQ ID NO: 322441 - RNA, 22 nt, Homo sapiens
cugagaucaugggucagguggu

SEQ ID NO: 322442 - RNA, 22 nt, Homo sapiens
cugagauuaagauauugggagu

SEQ ID NO: 322443 - RNA, 22 nt, Homo sapiens
cugagcaagucauuuuguuaaa

SEQ ID NO: 322444 - RNA, 22 nt, Homo sapiens
cugaggaaguucuuuaacaguu

SEQ ID NO: 322445 - RNA, 22 nt, Homo sapiens
cugaggacaucagggaagcauc

SEQ ID NO: 322446 - RNA, 22 nt, Homo sapiens
cugaggcacggcgaccuuaagu

SEQ ID NO: 322447 - RNA, 22 nt, Homo sapiens
cugaggugggagaaucacauaa

SEQ ID NO: 322448 - RNA, 20 nt, Homo sapiens
cugagguugggguccuuccc

SEQ ID NO: 322449 - RNA, 22 nt, Homo sapiens
cugagugcaagugauccuccca

SEQ ID NO: 322450 - RNA, 22 nt, Homo sapiens
cugauauuuuucuggcuugugu

SEQ ID NO: 322451 - RNA, 22 nt, Homo sapiens
cugaucuaugaacacaggauau

SEQ ID NO: 322452 - RNA, 22 nt, Homo sapiens
cugauuguagagccccagggcu

SEQ ID NO: 322453 - RNA, 22 nt, Homo sapiens
cugauugucaucaauauuauua

SEQ ID NO: 322454 - RNA, 22 nt, Homo sapiens
cugauugucuauuuaguucacu

SEQ ID NO: 322455 - RNA, 19 nt, Homo sapiens
cugcaagguaauaggucag

SEQ ID NO: 322456 - RNA, 22 nt, Homo sapiens
cugcaauguuugaaauggcaaa

SEQ ID NO: 322457 - RNA, 22 nt, Homo sapiens
cugcacugagacccucuuugcu

SEQ ID NO: 322458 - RNA, 22 nt, Homo sapiens
cugcaguaaccacuguaggugu

SEQ ID NO: 322459 - RNA, 19 nt, Homo sapiens
cugcaugagacaguugguu

SEQ ID NO: 322460 - RNA, 22 nt, Homo sapiens
cugcauuugaugacguauggug

SEQ ID NO: 322461 - RNA, 18 nt, Homo sapiens
cugccagugugcucuccg

SEQ ID NO: 322462 - RNA, 22 nt, Homo sapiens
cugccuagaucugaaccuggcu

SEQ ID NO: 322463 - RNA, 22 nt, Homo sapiens
cugccuagauguuguagggggu

SEQ ID NO: 322464 - RNA, 22 nt, Homo sapiens
cugccugagaaaauggagggca

SEQ ID NO: 322465 - RNA, 22 nt, Homo sapiens
cugcuauauugguucaggcuug

SEQ ID NO: 322466 - RNA, 22 nt, Homo sapiens
cuggaaaguagacaaucuaaaa

SEQ ID NO: 322467 - RNA, 22 nt, Homo sapiens
cuggaagcacaacgcauuuauu

SEQ ID NO: 322468 - RNA, 22 nt, Homo sapiens
cuggaauauuagcuggucuuaa

SEQ ID NO: 322469 - RNA, 22 nt, Homo sapiens
cuggaaugcagcuuuaggggcu

SEQ ID NO: 322470 - RNA, 22 nt, Homo sapiens
cuggacaaaucuggaaagaacc

SEQ ID NO: 322471 - RNA, 22 nt, Homo sapiens
cuggagauauuggaagaaagaa

SEQ ID NO: 322472 - RNA, 22 nt, Homo sapiens
cuggagaucuugacauugaagu

SEQ ID NO: 322473 - RNA, 22 nt, Homo sapiens
cuggauagucaggagauauaua

SEQ ID NO: 322474 - RNA, 19 nt, Homo sapiens
cuggcaaaugcuuuggcca

SEQ ID NO: 322475 - RNA, 22 nt, Homo sapiens
cuggcaauaaauuuuuguguug

SEQ ID NO: 322476 - RNA, 22 nt, Homo sapiens
cuggcgagacagcuccaucacu

SEQ ID NO: 322477 - RNA, 22 nt, Homo sapiens
cugggaucaguucuagucagaa

SEQ ID NO: 322478 - RNA, 22 nt, Homo sapiens
cuggguacccuuuaaacaggaa

SEQ ID NO: 322479 - RNA, 22 nt, Homo sapiens
cugguaagaaggucuaagucaa

SEQ ID NO: 322480 - RNA, 22 nt, Homo sapiens
cugguaugcuucauaugcaaac

SEQ ID NO: 322481 - RNA, 22 nt, Homo sapiens
aagcaucauuuggaauuugaga

SEQ ID NO: 322482 - RNA, 23 nt, Homo sapiens
aagcaugcacagcuguuuguggu

SEQ ID NO: 322483 - RNA, 22 nt, Homo sapiens
aagccagugugacaggaaacuu

SEQ ID NO: 322484 - RNA, 22 nt, Homo sapiens
aagcuacauuuuauuuauguca

SEQ ID NO: 322485 - RNA, 22 nt, Homo sapiens
aagcuaggguuaauuuauuauu

SEQ ID NO: 322486 - RNA, 22 nt, Homo sapiens
aagcucuuguugaaucuuguca

SEQ ID NO: 322487 - RNA, 22 nt, Homo sapiens
aagcugccuugcugaggagaaa

SEQ ID NO: 322488 - RNA, 22 nt, Homo sapiens
aagcugccuugugaaggcauuc

SEQ ID NO: 322489 - RNA, 22 nt, Homo sapiens
aagcuggcuuucauugagugcu

SEQ ID NO: 322490 - RNA, 22 nt, Homo sapiens
aagcugguguguauuauucacu

SEQ ID NO: 322491 - RNA, 22 nt, Homo sapiens
aagcugguuuuauaucugugag

SEQ ID NO: 322492 - RNA, 22 nt, Homo sapiens
aagcuguguguaagcucucaca

SEQ ID NO: 322493 - RNA, 22 nt, Homo sapiens
aaggaagcuagcaggaauuggu

SEQ ID NO: 322494 - RNA, 22 nt, Homo sapiens
aaggaauucaaauuuucucugg

SEQ ID NO: 322495 - RNA, 22 nt, Homo sapiens
aaggagcuaagagaucauacau

SEQ ID NO: 322496 - RNA, 22 nt, Homo sapiens
aaggaguaucuguuuucucacc

SEQ ID NO: 322497 - RNA, 22 nt, Homo sapiens
aaggauuguaaaguugacaaau

SEQ ID NO: 322498 - RNA, 22 nt, Homo sapiens
aaggcaauuuguugugaggauu

SEQ ID NO: 322499 - RNA, 22 nt, Homo sapiens
aaggcaugcaguacguuucuau

SEQ ID NO: 322500 - RNA, 22 nt, Homo sapiens
aaggcauucucaaacuaguucu

SEQ ID NO: 322501 - RNA, 22 nt, Homo sapiens
aaggcuagagaagaagggcauc

SEQ ID NO: 322502 - RNA, 22 nt, Homo sapiens
aaggcuauuugagaaugugugu

SEQ ID NO: 322503 - RNA, 22 nt, Homo sapiens
aaggcucuuucaacguaaauua

SEQ ID NO: 322504 - RNA, 22 nt, Homo sapiens
aagggaaugugguagcugguuu

SEQ ID NO: 322505 - RNA, 22 nt, Homo sapiens
aagggaauguuguggcugguuu

SEQ ID NO: 322506 - RNA, 22 nt, Homo sapiens
aagggagcugcauaaucuugug

SEQ ID NO: 322507 - RNA, 22 nt, Homo sapiens
aagguaguuuucuuuaaugcug

SEQ ID NO: 322508 - RNA, 21 nt, Homo sapiens
aaggugguggugauugagaug

SEQ ID NO: 322509 - RNA, 22 nt, Homo sapiens
aaguacuguuuaaauugcagaa

SEQ ID NO: 322510 - RNA, 22 nt, Homo sapiens
aaguagcagaggcaagacuuga

SEQ ID NO: 322511 - RNA, 22 nt, Homo sapiens
aaguagugcuugugcucaucuc

SEQ ID NO: 322512 - RNA, 22 nt, Homo sapiens
aaguauguaucaagucauacuu

SEQ ID NO: 322513 - RNA, 22 nt, Homo sapiens
aaguauuagugaggauauggaa

SEQ ID NO: 322514 - RNA, 22 nt, Homo sapiens
aaguauuaugaguccuuguuuu

SEQ ID NO: 322515 - RNA, 22 nt, Homo sapiens
aagucaaggagagaagcuucag

SEQ ID NO: 322516 - RNA, 22 nt, Homo sapiens
aagucauggagaagguggaggu

SEQ ID NO: 322517 - RNA, 22 nt, Homo sapiens
aagucauggaggaguaugugag

SEQ ID NO: 322518 - RNA, 22 nt, Homo sapiens
aagugaaugugcuggaauagcu

SEQ ID NO: 322519 - RNA, 22 nt, Homo sapiens
aagugaauucauuguguuauau

SEQ ID NO: 322520 - RNA, 22 nt, Homo sapiens
aagugagaugcaguggaguucc

SEQ ID NO: 322521 - RNA, 22 nt, Homo sapiens
aagugcacuguaagugcaggau

SEQ ID NO: 322522 - RNA, 21 nt, Homo sapiens
aagugcucugggacucuaaau

SEQ ID NO: 322523 - RNA, 22 nt, Homo sapiens
aagugcuguccuaccuuuggga

SEQ ID NO: 322524 - RNA, 22 nt, Homo sapiens
aagugcuucagaagacaauauu

SEQ ID NO: 322525 - RNA, 20 nt, Homo sapiens
aagugcuuccuuuuagaggg

SEQ ID NO: 322526 - RNA, 22 nt, Homo sapiens
aagugcuucuuuccucgagaag

SEQ ID NO: 322527 - RNA, 22 nt, Homo sapiens
aaguggaauguuuguggcacaa

SEQ ID NO: 322528 - RNA, 23 nt, Homo sapiens
aagugguuuugaacccggacccu

SEQ ID NO: 322529 - RNA, 22 nt, Homo sapiens
aaguugguguaugagacagaag

SEQ ID NO: 322530 - RNA, 22 nt, Homo sapiens
aauaaagcaggguccuugcacu

SEQ ID NO: 322531 - RNA, 22 nt, Homo sapiens
aauaaagcauggcuacuccaua

SEQ ID NO: 322532 - RNA, 22 nt, Homo sapiens
aauaaagcugaauccuuccuga

SEQ ID NO: 322533 - RNA, 22 nt, Homo sapiens
aauaaaguaggaggugaggaaa

SEQ ID NO: 322534 - RNA, 22 nt, Homo sapiens
aauaaagucugaagugugcuua

SEQ ID NO: 322535 - RNA, 22 nt, Homo sapiens
aauaagaaguggaagggaccgg

SEQ ID NO: 322536 - RNA, 22 nt, Homo sapiens
aauaagcugagagaauucuaca

SEQ ID NO: 322537 - RNA, 22 nt, Homo sapiens
aauacucaguccuggugaggcu

SEQ ID NO: 322538 - RNA, 22 nt, Homo sapiens
aauacugaaaguauuuucaaau

SEQ ID NO: 322539 - RNA, 22 nt, Homo sapiens
aauacuuccaaaucuagucauu

SEQ ID NO: 322540 - RNA, 22 nt, Homo sapiens
aauagcauugaaucuaccaauu

SEQ ID NO: 322541 - RNA, 22 nt, Homo sapiens
aauaucacaguggguguacacc

SEQ ID NO: 322542 - RNA, 22 nt, Homo sapiens
aauaugucugcuaauuguuucu

SEQ ID NO: 322543 - RNA, 22 nt, Homo sapiens
aauaugucuugaaauuggguaa

SEQ ID NO: 322544 - RNA, 22 nt, Homo sapiens
aaucaccaugcacuacagccuu

SEQ ID NO: 322545 - RNA, 22 nt, Homo sapiens
aaucacuaugccaugaaguaca

SEQ ID NO: 322546 - RNA, 19 nt, Homo sapiens
augccacagugaggucaga

SEQ ID NO: 322547 - RNA, 20 nt, Homo sapiens
augccacugagcagugguga

SEQ ID NO: 322548 - RNA, 22 nt, Homo sapiens
augccacugcacuucagccugg

SEQ ID NO: 322549 - RNA, 22 nt, Homo sapiens
augccacuguacucuagccuag

SEQ ID NO: 322550 - RNA, 22 nt, Homo sapiens
augccacuucucuaagucaugu

SEQ ID NO: 322551 - RNA, 22 nt, Homo sapiens
augccuaagacccuguggggga

SEQ ID NO: 322552 - RNA, 19 nt, Homo sapiens
augccucaguuuuguacuu

SEQ ID NO: 322553 - RNA, 22 nt, Homo sapiens
augccucugacaauuggauucu

SEQ ID NO: 322554 - RNA, 22 nt, Homo sapiens
augcuacuggacaauggugacu

SEQ ID NO: 322555 - RNA, 22 nt, Homo sapiens
augcuacuggauuuguauaaau

SEQ ID NO: 322556 - RNA, 22 nt, Homo sapiens
auggaacauaacuauuugggga

SEQ ID NO: 322557 - RNA, 22 nt, Homo sapiens
auggaagaaaguuggguucuug

SEQ ID NO: 322558 - RNA, 22 nt, Homo sapiens
auggaagaauugucggggaugu

SEQ ID NO: 322559 - RNA, 22 nt, Homo sapiens
auggaagacuccucuuugggua

SEQ ID NO: 322560 - RNA, 22 nt, Homo sapiens
auggaaggagaggaaugaauga

SEQ ID NO: 322561 - RNA, 22 nt, Homo sapiens
auggaauguaaguuauguuugc

SEQ ID NO: 322562 - RNA, 22 nt, Homo sapiens
auggagcuugacaguuguagag

SEQ ID NO: 322563 - RNA, 22 nt, Homo sapiens
auggagguguggggagugaguu

SEQ ID NO: 322564 - RNA, 22 nt, Homo sapiens
auggaguguucugaauccuuug

SEQ ID NO: 322565 - RNA, 22 nt, Homo sapiens
auggauuuuaggauacaguuga

SEQ ID NO: 322566 - RNA, 22 nt, Homo sapiens
auggcaaugcgaugaugacuga

SEQ ID NO: 322567 - RNA, 22 nt, Homo sapiens
auggcacagaguagaugcucaa

SEQ ID NO: 322568 - RNA, 22 nt, Homo sapiens
auggcacucaaucaaguugaga

SEQ ID NO: 322569 - RNA, 22 nt, Homo sapiens
auggcacugccuggcuucaugg

SEQ ID NO: 322570 - RNA, 22 nt, Homo sapiens
auggcacuguguccugggguca

SEQ ID NO: 322571 - RNA, 22 nt, Homo sapiens
auggcagaaucaagccgacagc

SEQ ID NO: 322572 - RNA, 22 nt, Homo sapiens
auggcagagucagaaagucagg

SEQ ID NO: 322573 - RNA, 22 nt, Homo sapiens
auggcagcugacacuuccgucu

SEQ ID NO: 322574 - RNA, 22 nt, Homo sapiens
auggcagcugguuuuacccuag

SEQ ID NO: 322575 - RNA, 22 nt, Homo sapiens
auggcaguuuauucuaaaucaa

SEQ ID NO: 322576 - RNA, 22 nt, Homo sapiens
auggcauuuuuagggcugggug

SEQ ID NO: 322577 - RNA, 22 nt, Homo sapiens
auggcccaguuugcuaucccua

SEQ ID NO: 322578 - RNA, 22 nt, Homo sapiens
auggcccugaguucaauauauu

SEQ ID NO: 322579 - RNA, 22 nt, Homo sapiens
auggcccugcuaccacuuuucu

SEQ ID NO: 322580 - RNA, 22 nt, Homo sapiens
auggcccuguguggagcugcug

SEQ ID NO: 322581 - RNA, 22 nt, Homo sapiens
auggcuagaaccuguauauuca

SEQ ID NO: 322582 - RNA, 22 nt, Homo sapiens
auggcuagauuguaugguaguu

SEQ ID NO: 322583 - RNA, 22 nt, Homo sapiens
auggcucuguuccaugugucuu

SEQ ID NO: 322584 - RNA, 22 nt, Homo sapiens
auggcugugaaaugguaggugg

SEQ ID NO: 322585 - RNA, 22 nt, Homo sapiens
auggcugugagaucgacuuauu

SEQ ID NO: 322586 - RNA, 22 nt, Homo sapiens
auggcuguuucugcaaugucua

SEQ ID NO: 322587 - RNA, 22 nt, Homo sapiens
auggcuuuuccugucuugcaug

SEQ ID NO: 322588 - RNA, 21 nt, Homo sapiens
augggacuaacugaugggucu

SEQ ID NO: 322589 - RNA, 21 nt, Homo sapiens
augggguagaagagaaggcuu

SEQ ID NO: 322590 - RNA, 22 nt, Homo sapiens
augggucuccugaauacagcac

SEQ ID NO: 322591 - RNA, 22 nt, Homo sapiens
augguauggaaggucuggagga

SEQ ID NO: 322592 - RNA, 21 nt, Homo sapiens
auggugagaaaguagugucaa

SEQ ID NO: 322593 - RNA, 22 nt, Homo sapiens
auguaaacauuuggucuaaauu

SEQ ID NO: 322594 - RNA, 22 nt, Homo sapiens
auguaacaguauuuggagaugu

SEQ ID NO: 322595 - RNA, 22 nt, Homo sapiens
auguagugugauuuucacuaga

SEQ ID NO: 322596 - RNA, 22 nt, Homo sapiens
auguauacauagauacgugugu

SEQ ID NO: 322597 - RNA, 17 nt, Homo sapiens
auguauacauccaugua

SEQ ID NO: 322598 - RNA, 22 nt, Homo sapiens
guugcuuauuccuguaauccca

SEQ ID NO: 322599 - RNA, 22 nt, Homo sapiens
guuggcuguuucccccaaguga

SEQ ID NO: 322600 - RNA, 22 nt, Homo sapiens
guugggcccauagacugccagu

SEQ ID NO: 322601 - RNA, 22 nt, Homo sapiens
guugguuuccuguaacuggaca

SEQ ID NO: 322602 - RNA, 22 nt, Homo sapiens
guuguggcuugugauuaagcac

SEQ ID NO: 322603 - RNA, 22 nt, Homo sapiens
guuugcauagugcugggagggg

SEQ ID NO: 322604 - RNA, 15 nt, Homo sapiens
guuuuuggauacaau

SEQ ID NO: 322605 - RNA, 22 nt, Homo sapiens
guuuuuggggucacuauuaccg

SEQ ID NO: 322606 - RNA, 22 nt, Homo sapiens
uaaacacucacuucauagccau

SEQ ID NO: 322607 - RNA, 22 nt, Homo sapiens
uaaaccacguuuacauuugaga

SEQ ID NO: 322608 - RNA, 22 nt, Homo sapiens
uaaagaugcugggaaggcuagg

SEQ ID NO: 322609 - RNA, 22 nt, Homo sapiens
uaaagcugaaaugauuaugaca

SEQ ID NO: 322610 - RNA, 18 nt, Homo sapiens
uaaaggcacuguguuguu

SEQ ID NO: 322611 - RNA, 18 nt, Homo sapiens
uaaauugcuucaccugag

SEQ ID NO: 322612 - RNA, 22 nt, Homo sapiens
uaacaccuuugauagcacuuuu

SEQ ID NO: 322613 - RNA, 22 nt, Homo sapiens
uaacaguauaugugguaucuau

SEQ ID NO: 322614 - RNA, 22 nt, Homo sapiens
uaacagucuccucaagguguug

SEQ ID NO: 322615 - RNA, 22 nt, Homo sapiens
uaacaguggucugugguaucug

SEQ ID NO: 322616 - RNA, 22 nt, Homo sapiens
uaacaguguauuuacuacuucc

SEQ ID NO: 322617 - RNA, 22 nt, Homo sapiens
uaacauucacaugcugcaaaaa

SEQ ID NO: 322618 - RNA, 22 nt, Homo sapiens
uaacauugucuugcuuaguuuu

SEQ ID NO: 322619 - RNA, 22 nt, Homo sapiens
uaacuagaaaggagacaguugc

SEQ ID NO: 322620 - RNA, 22 nt, Homo sapiens
uaacuaguagauggcugacaua

SEQ ID NO: 322621 - RNA, 22 nt, Homo sapiens
uaacuccauuuggacucaguau

SEQ ID NO: 322622 - RNA, 22 nt, Homo sapiens
uaagaauucuguccgguauacu

SEQ ID NO: 322623 - RNA, 22 nt, Homo sapiens
uaagacacauguguucccaggc

SEQ ID NO: 322624 - RNA, 23 nt, Homo sapiens
uaagacacuaacuuuaugcuuug

SEQ ID NO: 322625 - RNA, 22 nt, Homo sapiens
uaagacuguuggcaauuuuugc

SEQ ID NO: 322626 - RNA, 22 nt, Homo sapiens
uaagcaguaaaugaagucuugc

SEQ ID NO: 322627 - RNA, 22 nt, Homo sapiens
uaagcagugcaagaauggaaua

SEQ ID NO: 322628 - RNA, 20 nt, Homo sapiens
uaagcauaguugucaggguc

SEQ ID NO: 322629 - RNA, 22 nt, Homo sapiens
agaauacugucuauucauggua

SEQ ID NO: 322630 - RNA, 22 nt, Homo sapiens
agaaugauccuucucagaggca

SEQ ID NO: 322631 - RNA, 22 nt, Homo sapiens
agaaugucaguauuggcuaaaa

SEQ ID NO: 322632 - RNA, 22 nt, Homo sapiens
agacacuguugaaaaggcccca

SEQ ID NO: 322633 - RNA, 22 nt, Homo sapiens
agacagcugguagcacuuccug

SEQ ID NO: 322634 - RNA, 22 nt, Homo sapiens
agacucauuuccauagucagcu

SEQ ID NO: 322635 - RNA, 23 nt, Homo sapiens
agacugaaguaucugagacucag

SEQ ID NO: 322636 - RNA, 22 nt, Homo sapiens
agacuguaaugcauaauuuacu

SEQ ID NO: 322637 - RNA, 22 nt, Homo sapiens
agagaacugauuggaguugggc

SEQ ID NO: 322638 - RNA, 22 nt, Homo sapiens
agagacauugcuccaacucacc

SEQ ID NO: 322639 - RNA, 22 nt, Homo sapiens
agagaccuguaaaguucaggca

SEQ ID NO: 322640 - RNA, 19 nt, Homo sapiens
agagacucauuguagcauu

SEQ ID NO: 322641 - RNA, 22 nt, Homo sapiens
agagagcuuuaacuacccauuu

SEQ ID NO: 322642 - RNA, 22 nt, Homo sapiens
agagauccucauuuuauagaca

SEQ ID NO: 322643 - RNA, 22 nt, Homo sapiens
agagcaauguuaucagucucug

SEQ ID NO: 322644 - RNA, 22 nt, Homo sapiens
agagccacauuaaauaugggaa

SEQ ID NO: 322645 - RNA, 21 nt, Homo sapiens
agaggacugaccacagcccua

SEQ ID NO: 322646 - RNA, 22 nt, Homo sapiens
agagguaagaauaguaguugga

SEQ ID NO: 322647 - RNA, 22 nt, Homo sapiens
agagguagaagauaggcuacag

SEQ ID NO: 322648 - RNA, 22 nt, Homo sapiens
agagguguuaaagucucuuuua

SEQ ID NO: 322649 - RNA, 22 nt, Homo sapiens
agagugcaaagguuggggcugg

SEQ ID NO: 322650 - RNA, 22 nt, Homo sapiens
agagugcaauggcaccaucucg

SEQ ID NO: 322651 - RNA, 20 nt, Homo sapiens
agagugcuggacugaggagc

SEQ ID NO: 322652 - RNA, 22 nt, Homo sapiens
agauauguuauugauguuaaug

SEQ ID NO: 322653 - RNA, 22 nt, Homo sapiens
agaucaauugcugauucgcucu

SEQ ID NO: 322654 - RNA, 22 nt, Homo sapiens
agaucacaguaccguaaggcug

SEQ ID NO: 322655 - RNA, 22 nt, Homo sapiens
agaucauaugcaguaaugaacu

SEQ ID NO: 322656 - RNA, 22 nt, Homo sapiens
agaugauguuucuggcacauga

SEQ ID NO: 322657 - RNA, 23 nt, Homo sapiens
agaugcauucuuguaggauauau

SEQ ID NO: 322658 - RNA, 22 nt, Homo sapiens
agaugcauugguggcauauuca

SEQ ID NO: 322659 - RNA, 22 nt, Homo sapiens
agauggauuuuguagccccagc

SEQ ID NO: 322660 - RNA, 23 nt, Homo sapiens
agauggcauuucaguucuuuagg

SEQ ID NO: 322661 - RNA, 22 nt, Homo sapiens
agaugguguuggcugaguguau

SEQ ID NO: 322662 - RNA, 22 nt, Homo sapiens
agcaagauugauggccugcagg

SEQ ID NO: 322663 - RNA, 22 nt, Homo sapiens
agcaauaugacauugcuacauc

SEQ ID NO: 322664 - RNA, 22 nt, Homo sapiens
agcacagugaaugguuuacuca

SEQ ID NO: 322665 - RNA, 23 nt, Homo sapiens
agcaccaccccaggucacaagug

SEQ ID NO: 322666 - RNA, 22 nt, Homo sapiens
agcaccaugggcugaguaagug

SEQ ID NO: 322667 - RNA, 22 nt, Homo sapiens
agcaccauuagcguugggccgg

SEQ ID NO: 322668 - RNA, 22 nt, Homo sapiens
agcaccguucaaacccagguua

SEQ ID NO: 322669 - RNA, 22 nt, Homo sapiens
agcagcaucgggaaguuggcca

SEQ ID NO: 322670 - RNA, 22 nt, Homo sapiens
agcagcauggguauaaaucucc

SEQ ID NO: 322671 - RNA, 22 nt, Homo sapiens
agcaggacaauaugggaucagg

SEQ ID NO: 322672 - RNA, 16 nt, Homo sapiens
agcagguguuagguga

SEQ ID NO: 322673 - RNA, 22 nt, Homo sapiens
agcagugugaaaauggacuaau

SEQ ID NO: 322674 - RNA, 19 nt, Homo sapiens
agcaguguggagauuucuc

SEQ ID NO: 322675 - RNA, 18 nt, Homo sapiens
agcaucacugaucauccu

SEQ ID NO: 322676 - RNA, 22 nt, Homo sapiens
agcaucauuugauguucccgag

SEQ ID NO: 322677 - RNA, 22 nt, Homo sapiens
agcaugacauauuguagagaaa

SEQ ID NO: 322678 - RNA, 17 nt, Homo sapiens
agcauguguuugagauu

SEQ ID NO: 322679 - RNA, 22 nt, Homo sapiens
agcccagagacuguguaaauuu

SEQ ID NO: 322680 - RNA, 22 nt, Homo sapiens
agcccauguggcugaggcuucu

SEQ ID NO: 322681 - RNA, 17 nt, Homo sapiens
agccccauuagcuaguu

SEQ ID NO: 322682 - RNA, 22 nt, Homo sapiens
agcccugugauuacuuuuauaa

SEQ ID NO: 322683 - RNA, 22 nt, Homo sapiens
agccuguguugaauuauagaaa

SEQ ID NO: 322684 - RNA, 22 nt, Homo sapiens
agcggcuguuccccuggucuau

SEQ ID NO: 322685 - RNA, 20 nt, Homo sapiens
agcuaguauuuccaugguua

SEQ ID NO: 322686 - RNA, 22 nt, Homo sapiens
agcuagugugauucuuuggggu

SEQ ID NO: 322687 - RNA, 18 nt, Homo sapiens
agcucaguguuugcuuac

SEQ ID NO: 322688 - RNA, 22 nt, Homo sapiens
agcucauugcaaccuccgccuc

SEQ ID NO: 322689 - RNA, 22 nt, Homo sapiens
agcuccaucuucagggguucag

SEQ ID NO: 322690 - RNA, 20 nt, Homo sapiens
agcuccauuccugaaggcug

SEQ ID NO: 322691 - RNA, 22 nt, Homo sapiens
agcucuauuagaagccgugggu

SEQ ID NO: 322692 - RNA, 22 nt, Homo sapiens
gagacggagucucgcucugucg

SEQ ID NO: 322693 - RNA, 22 nt, Homo sapiens
gagacggagucuugcucuguug

SEQ ID NO: 322694 - RNA, 22 nt, Homo sapiens
gagacugagucuugcucuguca

SEQ ID NO: 322695 - RNA, 22 nt, Homo sapiens
gagacugaguuuugcucuuguu

SEQ ID NO: 322696 - RNA, 21 nt, Homo sapiens
gagaggauucgccagccucuu

SEQ ID NO: 322697 - RNA, 22 nt, Homo sapiens
gagagguaguuuuuuggucguc

SEQ ID NO: 322698 - RNA, 22 nt, Homo sapiens
gagagugaaguuugcuaccugu

SEQ ID NO: 322699 - RNA, 22 nt, Homo sapiens
gagagugcuuuggguguaggcc

SEQ ID NO: 322700 - RNA, 22 nt, Homo sapiens
gagauaguguggguacagcuau

SEQ ID NO: 322701 - RNA, 22 nt, Homo sapiens
gagauauuauuucccuuucaca

SEQ ID NO: 322702 - RNA, 22 nt, Homo sapiens
gagaucaugcugguucucucau

SEQ ID NO: 322703 - RNA, 23 nt, Homo sapiens
gagaucauucuggaauuagagug

SEQ ID NO: 322704 - RNA, 22 nt, Homo sapiens
gagaucauugugggccaagcug

SEQ ID NO: 322705 - RNA, 22 nt, Homo sapiens
gagaucuuggccaaguuucuua

SEQ ID NO: 322706 - RNA, 22 nt, Homo sapiens
gagaugaaguuaaggaucuuua

SEQ ID NO: 322707 - RNA, 22 nt, Homo sapiens
gagaugcaccuugucacguuuc

SEQ ID NO: 322708 - RNA, 22 nt, Homo sapiens
gagauggagucuuuuucuguca

SEQ ID NO: 322709 - RNA, 22 nt, Homo sapiens
gagaugguacacauacgauucu

SEQ ID NO: 322710 - RNA, 22 nt, Homo sapiens
gagauguuuguuucacugucac

SEQ ID NO: 322711 - RNA, 22 nt, Homo sapiens
gagauuauuuaaaaggugauuu

SEQ ID NO: 322712 - RNA, 22 nt, Homo sapiens
gagcaaaaguauguauugguua

SEQ ID NO: 322713 - RNA, 22 nt, Homo sapiens
gagcaacaguggcagugguggg

SEQ ID NO: 322714 - RNA, 22 nt, Homo sapiens
gagcacauaugacauuuucuuc

SEQ ID NO: 322715 - RNA, 22 nt, Homo sapiens
gagcaccagucccugucagugc

SEQ ID NO: 322716 - RNA, 22 nt, Homo sapiens
gagccauggagaaaacagcuau

SEQ ID NO: 322717 - RNA, 22 nt, Homo sapiens
gagccuguaggaggagaggugg

SEQ ID NO: 322718 - RNA, 22 nt, Homo sapiens
gagcuagggucaugcuacugca

SEQ ID NO: 322719 - RNA, 21 nt, Homo sapiens
gagcuaggugaggcuguaaug

SEQ ID NO: 322720 - RNA, 21 nt, Homo sapiens
uaagcuaaacauucaguuaac

SEQ ID NO: 322721 - RNA, 22 nt, Homo sapiens
uaagcuagcauagggguaaauu

SEQ ID NO: 322722 - RNA, 22 nt, Homo sapiens
uaagcucauuccagccaugucc

SEQ ID NO: 322723 - RNA, 20 nt, Homo sapiens
uaaggcacugugcuuuuagg

SEQ ID NO: 322724 - RNA, 22 nt, Homo sapiens
uaaggcuagcaagaugagaaua

SEQ ID NO: 322725 - RNA, 22 nt, Homo sapiens
uaaggcuucuuggaauacugca

SEQ ID NO: 322726 - RNA, 22 nt, Homo sapiens
uaagggacgcccccuucucucu

SEQ ID NO: 322727 - RNA, 22 nt, Homo sapiens
uaagguauuuacauuucuguuu

SEQ ID NO: 322728 - RNA, 22 nt, Homo sapiens
uaagguguagacuggucacaag

SEQ ID NO: 322729 - RNA, 22 nt, Homo sapiens
uaagguuacaaaggacuucaua

SEQ ID NO: 322730 - RNA, 19 nt, Homo sapiens
uaaguagaugacugaugcu

SEQ ID NO: 322731 - RNA, 23 nt, Homo sapiens
uaagucacacagauuaauuuauu

SEQ ID NO: 322732 - RNA, 22 nt, Homo sapiens
uaagugaauauggacaguuagc

SEQ ID NO: 322733 - RNA, 22 nt, Homo sapiens
uaagugaauuugacagguaaug

SEQ ID NO: 322734 - RNA, 22 nt, Homo sapiens
uaaguggugcauuguuaaaugg

SEQ ID NO: 322735 - RNA, 22 nt, Homo sapiens
uaaguuguugacauuaggggaa

SEQ ID NO: 322736 - RNA, 22 nt, Homo sapiens
uaauaguuggcacuggagaaag

SEQ ID NO: 322737 - RNA, 22 nt, Homo sapiens
uaauauguuuugaaaucaggaa

SEQ ID NO: 322738 - RNA, 22 nt, Homo sapiens
uaaucacagagguuuggccuca

SEQ ID NO: 322739 - RNA, 22 nt, Homo sapiens
uaaucucagcuacucaggaggc

SEQ ID NO: 322740 - RNA, 22 nt, Homo sapiens
uaaugcaucagugguaguucuu

SEQ ID NO: 322741 - RNA, 22 nt, Homo sapiens
uaaugcaucaugguuggcaaac

SEQ ID NO: 322742 - RNA, 22 nt, Homo sapiens
uaaugcauguaaugggcugaua

SEQ ID NO: 322743 - RNA, 19 nt, Homo sapiens
uaaugccacugccuggcau

SEQ ID NO: 322744 - RNA, 21 nt, Homo sapiens
uaauggcaugaucucggcuca

SEQ ID NO: 322745 - RNA, 22 nt, Homo sapiens
uaaugugcuucucuaccauagg

SEQ ID NO: 322746 - RNA, 22 nt, Homo sapiens
uaauucugacaacaguggcguu

SEQ ID NO: 322747 - RNA, 22 nt, Homo sapiens
uaauugcaguucuguguuauau

SEQ ID NO: 322748 - RNA, 22 nt, Homo sapiens
uacaaccucugccucccaaguu

SEQ ID NO: 322749 - RNA, 21 nt, Homo sapiens
uacaaugcacaggagagccuc

SEQ ID NO: 322750 - RNA, 22 nt, Homo sapiens
uacacagucaaaaauuuccagg

SEQ ID NO: 322751 - RNA, 22 nt, Homo sapiens
uacaccaauuuaaucaaaagca

SEQ ID NO: 322752 - RNA, 22 nt, Homo sapiens
uacaccauuugauucuuuaagc

SEQ ID NO: 322753 - RNA, 20 nt, Homo sapiens
uacacguguagcauucucua

SEQ ID NO: 322754 - RNA, 22 nt, Homo sapiens
uacagaguagaagauuugcaga

SEQ ID NO: 322755 - RNA, 22 nt, Homo sapiens
uacagaguauccauuugaguuc

SEQ ID NO: 322756 - RNA, 22 nt, Homo sapiens
uacagcacugugcauagugguu

SEQ ID NO: 322757 - RNA, 22 nt, Homo sapiens
uacagcuaugugcaugcaugcu

SEQ ID NO: 322758 - RNA, 22 nt, Homo sapiens
uacaggacuauagaacuuuccc

SEQ ID NO: 322759 - RNA, 19 nt, Homo sapiens
uacaggacugagcugaggu

SEQ ID NO: 322760 - RNA, 22 nt, Homo sapiens
uacaggauagacaauuuauuaa

SEQ ID NO: 322761 - RNA, 22 nt, Homo sapiens
uacagguaugugucuauauaca

SEQ ID NO: 322762 - RNA, 22 nt, Homo sapiens
uacaggugcucuacagacagga

SEQ ID NO: 322763 - RNA, 22 nt, Homo sapiens
uacaggugcuuauguggacaua

SEQ ID NO: 322764 - RNA, 19 nt, Homo sapiens
uacaguacacaacaccuuu

SEQ ID NO: 322765 - RNA, 22 nt, Homo sapiens
uacaguacagugacaccauuau

SEQ ID NO: 322766 - RNA, 22 nt, Homo sapiens
uacaguauuaugagugauugaa

SEQ ID NO: 322767 - RNA, 22 nt, Homo sapiens
uacagucuagaggagaaucagg

SEQ ID NO: 322768 - RNA, 22 nt, Homo sapiens
uacagugcauagaggcaugaua

SEQ ID NO: 322769 - RNA, 22 nt, Homo sapiens
uacagugcuugguaucuaguaa

SEQ ID NO: 322770 - RNA, 22 nt, Homo sapiens
uacaguggugugaucucagcuc

SEQ ID NO: 322771 - RNA, 22 nt, Homo sapiens
uacaguguuuugguauuccaca

SEQ ID NO: 322772 - RNA, 22 nt, Homo sapiens
uacauguauacaggguuuacuu

SEQ ID NO: 322773 - RNA, 22 nt, Homo sapiens
uacauguauguguuuauggcug

SEQ ID NO: 322774 - RNA, 22 nt, Homo sapiens
uacaugugcacaacgugcaggu

SEQ ID NO: 322775 - RNA, 22 nt, Homo sapiens
uacauuggcuagguuuggaggc

SEQ ID NO: 322776 - RNA, 22 nt, Homo sapiens
uacauugucauauucucucucu

SEQ ID NO: 322777 - RNA, 22 nt, Homo sapiens
uaccacaggcuggguaaucuau

SEQ ID NO: 322778 - RNA, 22 nt, Homo sapiens
uaccacagucauuacacuugua

SEQ ID NO: 322779 - RNA, 23 nt, Homo sapiens
uaccacauuccuucuuuccuguu

SEQ ID NO: 322780 - RNA, 22 nt, Homo sapiens
uaccacauuguagagggcauuc

SEQ ID NO: 322781 - RNA, 22 nt, Homo sapiens
uaccagcauuucucuuuaagua

SEQ ID NO: 322782 - RNA, 22 nt, Homo sapiens
uacccaguaacaaguauuuugg

SEQ ID NO: 322783 - RNA, 22 nt, Homo sapiens
uacccucuggauacccuuguuc

SEQ ID NO: 322784 - RNA, 22 nt, Homo sapiens
uacuacuuucucuucugggaaa

SEQ ID NO: 322785 - RNA, 22 nt, Homo sapiens
auacaugugccauguugguuug

SEQ ID NO: 322786 - RNA, 22 nt, Homo sapiens
auacguacauaugcacauaugg

SEQ ID NO: 322787 - RNA, 22 nt, Homo sapiens
auacuaugagauaauaaagacu

SEQ ID NO: 322788 - RNA, 22 nt, Homo sapiens
auacugccuuuagcaaaacagu

SEQ ID NO: 322789 - RNA, 22 nt, Homo sapiens
auacugucucuugcuccugccc

SEQ ID NO: 322790 - RNA, 22 nt, Homo sapiens
auacuguuuuacaucauugccu

SEQ ID NO: 322791 - RNA, 21 nt, Homo sapiens
auacuugcauccuuggagaga

SEQ ID NO: 322792 - RNA, 22 nt, Homo sapiens
auagaaucaucugugcacuagu

SEQ ID NO: 322793 - RNA, 15 nt, Homo sapiens
auagaaugaaaggga

SEQ ID NO: 322794 - RNA, 22 nt, Homo sapiens
auagaccuggagaguagauaua

SEQ ID NO: 322795 - RNA, 22 nt, Homo sapiens
auagcaaugccccacuccuugg

SEQ ID NO: 322796 - RNA, 22 nt, Homo sapiens
auagcacacuauagcuucaaac

SEQ ID NO: 322797 - RNA, 22 nt, Homo sapiens
auagcacaguguguguacacca

SEQ ID NO: 322798 - RNA, 22 nt, Homo sapiens
auagcagaacagugucucacug

SEQ ID NO: 322799 - RNA, 22 nt, Homo sapiens
auagcagacauuucaaggcagg

SEQ ID NO: 322800 - RNA, 22 nt, Homo sapiens
auagcagcauauguaauguuga

SEQ ID NO: 322801 - RNA, 22 nt, Homo sapiens
auagcagugugaaaacagacua

SEQ ID NO: 322802 - RNA, 22 nt, Homo sapiens
auagccaguagagagcuguuag

SEQ ID NO: 322803 - RNA, 22 nt, Homo sapiens
auagcucuugcuuacccacugu

SEQ ID NO: 322804 - RNA, 22 nt, Homo sapiens
auagcugcucaggcuuuccuca

SEQ ID NO: 322805 - RNA, 22 nt, Homo sapiens
auaguacuauugcaguguuaua

SEQ ID NO: 322806 - RNA, 22 nt, Homo sapiens
auagugaacuuugugagaacaa

SEQ ID NO: 322807 - RNA, 21 nt, Homo sapiens
auagugcuagagaguagcagg

SEQ ID NO: 322808 - RNA, 22 nt, Homo sapiens
auagugcuauggcagaccuuga

SEQ ID NO: 322809 - RNA, 22 nt, Homo sapiens
auagugcugcaauaaacauaug

SEQ ID NO: 322810 - RNA, 22 nt, Homo sapiens
auagugcugcaauuaacauaca

SEQ ID NO: 322811 - RNA, 22 nt, Homo sapiens
gagcucauuaaaaauguagaau

SEQ ID NO: 322812 - RNA, 22 nt, Homo sapiens
gagcucauuguugcuaaagaga

SEQ ID NO: 322813 - RNA, 22 nt, Homo sapiens
gagcugaauugcugccauuugc

SEQ ID NO: 322814 - RNA, 22 nt, Homo sapiens
gagcugaucuuuucugauucca

SEQ ID NO: 322815 - RNA, 22 nt, Homo sapiens
gagcuguugguuugaaagaauu

SEQ ID NO: 322816 - RNA, 22 nt, Homo sapiens
gagcuuggguuaaaguugccuu

SEQ ID NO: 322817 - RNA, 22 nt, Homo sapiens
gaggaaguagcuacugucuuuc

SEQ ID NO: 322818 - RNA, 22 nt, Homo sapiens
gaggaaguuuacaaagcaucug

SEQ ID NO: 322819 - RNA, 22 nt, Homo sapiens
gaggacauuaugcuaaguggaa

SEQ ID NO: 322820 - RNA, 22 nt, Homo sapiens
gaggaucucuugagcccagaag

SEQ ID NO: 322821 - RNA, 22 nt, Homo sapiens
gaggcaagaguaguuaaguuag

SEQ ID NO: 322822 - RNA, 22 nt, Homo sapiens
gaggcauuauucccaucuuaca

SEQ ID NO: 322823 - RNA, 22 nt, Homo sapiens
gaggguguuguguugcuuaaua

SEQ ID NO: 322824 - RNA, 22 nt, Homo sapiens
gagguaagaaagucaguccuuc

SEQ ID NO: 322825 - RNA, 22 nt, Homo sapiens
gagguagaauguuuuucagcug

SEQ ID NO: 322826 - RNA, 22 nt, Homo sapiens
gagguaggaauaaacauuugaa

SEQ ID NO: 322827 - RNA, 21 nt, Homo sapiens
gagguagggauuaaagaccuc

SEQ ID NO: 322828 - RNA, 22 nt, Homo sapiens
gagguagggucccacuauguug

SEQ ID NO: 322829 - RNA, 22 nt, Homo sapiens
gaggucauguggcaggcagcca

SEQ ID NO: 322830 - RNA, 22 nt, Homo sapiens
gaggugauaucucauugugguu

SEQ ID NO: 322831 - RNA, 22 nt, Homo sapiens
gaggugguagguucacagcagc

SEQ ID NO: 322832 - RNA, 22 nt, Homo sapiens
gagguuuuagugagucccacug

SEQ ID NO: 322833 - RNA, 22 nt, Homo sapiens
gaguaacagcauaaauuuguga

SEQ ID NO: 322834 - RNA, 22 nt, Homo sapiens
gaguagugcugcaguaaacaca

SEQ ID NO: 322835 - RNA, 22 nt, Homo sapiens
gaguauauuugcacuguuaugu

SEQ ID NO: 322836 - RNA, 22 nt, Homo sapiens
gagucuauucaauguaguuaga

SEQ ID NO: 322837 - RNA, 22 nt, Homo sapiens
gagugcaauggcaagaucuugg

SEQ ID NO: 322838 - RNA, 22 nt, Homo sapiens
gagugcaauggcaugaucuugg

SEQ ID NO: 322839 - RNA, 22 nt, Homo sapiens
gagugcaauggcgcgaucucgg

SEQ ID NO: 322840 - RNA, 21 nt, Homo sapiens
gaguggcuuuuguuucaccag

SEQ ID NO: 322841 - RNA, 22 nt, Homo sapiens
gaguuuguacuaauuuguugua

SEQ ID NO: 322842 - RNA, 22 nt, Homo sapiens
gauaaaguauuggguacuaugc

SEQ ID NO: 322843 - RNA, 22 nt, Homo sapiens
gauaaauccagauucugaugua

SEQ ID NO: 322844 - RNA, 22 nt, Homo sapiens
gauaacagauaaugucaguuau

SEQ ID NO: 322845 - RNA, 21 nt, Homo sapiens
gauaaguuggcagccagcacc

SEQ ID NO: 322846 - RNA, 22 nt, Homo sapiens
gauacaguaugcaugugguauu

SEQ ID NO: 322847 - RNA, 19 nt, Homo sapiens
gauagacaucacagugcca

SEQ ID NO: 322848 - RNA, 19 nt, Homo sapiens
gauaucuagggggagguuc

SEQ ID NO: 322849 - RNA, 22 nt, Homo sapiens
gauauguaaaaauuauaucuga

SEQ ID NO: 322850 - RNA, 22 nt, Homo sapiens
gauauguucugagaaaugcauu

SEQ ID NO: 322851 - RNA, 22 nt, Homo sapiens
gauauguugaguagaguuuuug

SEQ ID NO: 322852 - RNA, 22 nt, Homo sapiens
gauauguuguuggauucgguua

SEQ ID NO: 322853 - RNA, 22 nt, Homo sapiens
gauauguuucuucaauaccuag

SEQ ID NO: 322854 - RNA, 22 nt, Homo sapiens
gauauugacuuauucuauguuu

SEQ ID NO: 322855 - RNA, 22 nt, Homo sapiens
gaucacaugggagaaugagagu

SEQ ID NO: 322856 - RNA, 22 nt, Homo sapiens
gaucagagugaaccuuguuaug

SEQ ID NO: 322857 - RNA, 22 nt, Homo sapiens
gaucauggaguuggguucaagg

SEQ ID NO: 322858 - RNA, 22 nt, Homo sapiens
gaucucaguggauacugugaug

SEQ ID NO: 322859 - RNA, 22 nt, Homo sapiens
gaucuguuguuuggaaguauca

SEQ ID NO: 322860 - RNA, 22 nt, Homo sapiens
gaucuguuucaauugucuuagu

SEQ ID NO: 322861 - RNA, 22 nt, Homo sapiens
gaucuguuuuccuauuguuugu

SEQ ID NO: 322862 - RNA, 22 nt, Homo sapiens
gaugagauguucucauggauug

SEQ ID NO: 322863 - RNA, 22 nt, Homo sapiens
gaugagguaggccugcuuugaa

SEQ ID NO: 322864 - RNA, 22 nt, Homo sapiens
gaugauguugaauguucucacc

SEQ ID NO: 322865 - RNA, 22 nt, Homo sapiens
gaugauguuggaaacuuggugc

SEQ ID NO: 322866 - RNA, 22 nt, Homo sapiens
gaugauguuugauaaauaauaa

SEQ ID NO: 322867 - RNA, 22 nt, Homo sapiens
gauggaguaauguaaucuugag

SEQ ID NO: 322868 - RNA, 22 nt, Homo sapiens
gauggcacuaagccauguagga

SEQ ID NO: 322869 - RNA, 22 nt, Homo sapiens
gauggcaugugcugccaccaag

SEQ ID NO: 322870 - RNA, 22 nt, Homo sapiens
gauggguuuuuugaagacagca

SEQ ID NO: 322871 - RNA, 22 nt, Homo sapiens
gaugguggucuacccuuucccu

SEQ ID NO: 322872 - RNA, 22 nt, Homo sapiens
gaugguuuucaccugcaugcuu

SEQ ID NO: 322873 - RNA, 22 nt, Homo sapiens
gauguagaaagagugggcugga

SEQ ID NO: 322874 - RNA, 22 nt, Homo sapiens
gauguguuuccaggauuuguuu

SEQ ID NO: 322875 - RNA, 22 nt, Homo sapiens
gauguguuuuaggaucucagca

SEQ ID NO: 322876 - RNA, 22 nt, Homo sapiens
gauuagaacagaagucagauua

SEQ ID NO: 322877 - RNA, 22 nt, Homo sapiens
gauuggcauugcugcaccugag

SEQ ID NO: 322878 - RNA, 22 nt, Homo sapiens
augaccagagguaugauguuug

SEQ ID NO: 322879 - RNA, 22 nt, Homo sapiens
augaccauuucaauugauaugg

SEQ ID NO: 322880 - RNA, 22 nt, Homo sapiens
augacugagacuaacuuacuuu

SEQ ID NO: 322881 - RNA, 22 nt, Homo sapiens
augacugucagggcagucauug

SEQ ID NO: 322882 - RNA, 22 nt, Homo sapiens
augagaauguaaguuaaugaaa

SEQ ID NO: 322883 - RNA, 22 nt, Homo sapiens
augagacauuaaaguguguuug

SEQ ID NO: 322884 - RNA, 22 nt, Homo sapiens
augagagcaacaccuucacuug

SEQ ID NO: 322885 - RNA, 22 nt, Homo sapiens
augagagcuaacuguggguaca

SEQ ID NO: 322886 - RNA, 22 nt, Homo sapiens
augagagcugacuuuaaggcaa

SEQ ID NO: 322887 - RNA, 22 nt, Homo sapiens
augagagugagagcagccccuu

SEQ ID NO: 322888 - RNA, 22 nt, Homo sapiens
augagaucaaauuuaagcuguu

SEQ ID NO: 322889 - RNA, 22 nt, Homo sapiens
augagaugaauaccgacgaugu

SEQ ID NO: 322890 - RNA, 22 nt, Homo sapiens
augagaugaggaauggcccucc

SEQ ID NO: 322891 - RNA, 22 nt, Homo sapiens
augagaugcaagauuagauggg

SEQ ID NO: 322892 - RNA, 22 nt, Homo sapiens
augagauucuuagagaagucug

SEQ ID NO: 322893 - RNA, 22 nt, Homo sapiens
augagcagaugcuccugccucu

SEQ ID NO: 322894 - RNA, 22 nt, Homo sapiens
augagcuaggacagaaugucag

SEQ ID NO: 322895 - RNA, 22 nt, Homo sapiens
augagcuauggagcucccaccu

SEQ ID NO: 322896 - RNA, 22 nt, Homo sapiens
augagcucauaaagagugauuu

SEQ ID NO: 322897 - RNA, 17 nt, Homo sapiens
augagcucaucauuuuu

SEQ ID NO: 322898 - RNA, 22 nt, Homo sapiens
augaggaaggagccuuugucug

SEQ ID NO: 322899 - RNA, 22 nt, Homo sapiens
augaggaagucaggcccagggg

SEQ ID NO: 322900 - RNA, 22 nt, Homo sapiens
augagguauccaagcccagaaa

SEQ ID NO: 322901 - RNA, 20 nt, Homo sapiens
gcaguacuuuuaguucuaag

SEQ ID NO: 322902 - RNA, 23 nt, Homo sapiens
gcagucauuuggaaaagguugaa

SEQ ID NO: 322903 - RNA, 22 nt, Homo sapiens
gcagugaugugaucauagcuca

SEQ ID NO: 322904 - RNA, 22 nt, Homo sapiens
gcagugcaguggcgcgaucucg

SEQ ID NO: 322905 - RNA, 22 nt, Homo sapiens
gcagugugaucacagcuuacug

SEQ ID NO: 322906 - RNA, 22 nt, Homo sapiens
gcaguguggguagagggcaaga

SEQ ID NO: 322907 - RNA, 20 nt, Homo sapiens
gcauaugucuuuauagcaga

SEQ ID NO: 322908 - RNA, 20 nt, Homo sapiens
gcauaugucuuuauggcagc

SEQ ID NO: 322909 - RNA, 17 nt, Homo sapiens
gcauauguugaaccagc

SEQ ID NO: 322910 - RNA, 22 nt, Homo sapiens
gcauauuuuaaaguguaaccug

SEQ ID NO: 322911 - RNA, 22 nt, Homo sapiens
gcaugaugaauaauaucacaag

SEQ ID NO: 322912 - RNA, 22 nt, Homo sapiens
gccaguauuuuauugagaauuu

SEQ ID NO: 322913 - RNA, 22 nt, Homo sapiens
gccaguauuuuguugagaauuu

SEQ ID NO: 322914 - RNA, 22 nt, Homo sapiens
gccauugcacuacagccuaggc

SEQ ID NO: 322915 - RNA, 22 nt, Homo sapiens
gccauugcacuccagccuaggu

SEQ ID NO: 322916 - RNA, 22 nt, Homo sapiens
gccauugcacuccagccucggc

SEQ ID NO: 322917 - RNA, 22 nt, Homo sapiens
gccauugcacucuagccuaggu

SEQ ID NO: 322918 - RNA, 22 nt, Homo sapiens
gccauugcacucuagccugagc

SEQ ID NO: 322919 - RNA, 22 nt, Homo sapiens
gcccacuguuaaauuuguuuua

SEQ ID NO: 322920 - RNA, 22 nt, Homo sapiens
gcccagauguuuggggucaugg

SEQ ID NO: 322921 - RNA, 22 nt, Homo sapiens
gccccgggugaugcagccguca

SEQ ID NO: 322922 - RNA, 22 nt, Homo sapiens
gcccugagauucuuggauucug

SEQ ID NO: 322923 - RNA, 22 nt, Homo sapiens
gcccuguaguauaguuugaagu

SEQ ID NO: 322924 - RNA, 22 nt, Homo sapiens
gcccuguugcccugaauacaua

SEQ ID NO: 322925 - RNA, 22 nt, Homo sapiens
gccuuuggugacaggcaugugu

SEQ ID NO: 322926 - RNA, 22 nt, Homo sapiens
gcgcagugggcugugccaucca

SEQ ID NO: 322927 - RNA, 19 nt, Homo sapiens
gcggcacuggagacacagc

SEQ ID NO: 322928 - RNA, 20 nt, Homo sapiens
gcuaaggcacgggaauuacu

SEQ ID NO: 322929 - RNA, 23 nt, Homo sapiens
gcuaggagagaugaaacacaggu

SEQ ID NO: 322930 - RNA, 22 nt, Homo sapiens
gcuaggagauccacugcucucu

SEQ ID NO: 322931 - RNA, 22 nt, Homo sapiens
gcucaugggcagugugauuguu

SEQ ID NO: 322932 - RNA, 22 nt, Homo sapiens
gcucguuuuugccucugguugc

SEQ ID NO: 322933 - RNA, 22 nt, Homo sapiens
gcugaaauguuuaauuugggag

SEQ ID NO: 322934 - RNA, 22 nt, Homo sapiens
gcugaguaguauuucauuguau

SEQ ID NO: 322935 - RNA, 22 nt, Homo sapiens
gcugauguuggccucugggcuu

SEQ ID NO: 322936 - RNA, 22 nt, Homo sapiens
gcugauguuuucagguaauucu

SEQ ID NO: 322937 - RNA, 22 nt, Homo sapiens
gcugcuguuauucaucagaacu

SEQ ID NO: 322938 - RNA, 22 nt, Homo sapiens
gcugcuguuuaguuucuccugg

SEQ ID NO: 322939 - RNA, 22 nt, Homo sapiens
gcuggugaaggcugaaaagugg

SEQ ID NO: 322940 - RNA, 22 nt, Homo sapiens
gcuggugacuuuaaguugaagc

SEQ ID NO: 322941 - RNA, 22 nt, Homo sapiens
gcugguguagagugcagaaagg

SEQ ID NO: 322942 - RNA, 19 nt, Homo sapiens
gcugguuguccacucucuc

SEQ ID NO: 322943 - RNA, 22 nt, Homo sapiens
gcugucaugagcaacacaugaa

SEQ ID NO: 322944 - RNA, 22 nt, Homo sapiens
gcugugauucuguguagauagu

SEQ ID NO: 322945 - RNA, 22 nt, Homo sapiens
gcuguugcuauuauuccgagaa
